United States Patent 7,618,814 (MICRORNA-RELATED NUCLEIC ACIDS AND USES THEREOF) - sequence listing, part 2

SEQ ID NO: 32845 - RNA, 32 nt, Human
acagugguuucccacgaggcaauacuuauuau

SEQ ID NO: 32846 - RNA, 32 nt, Human
acaguguaaacaggagucuaauuuguaucaau

SEQ ID NO: 32847 - RNA, 32 nt, Human
acaguguaacauccucucugguccuuuucugu

SEQ ID NO: 32848 - RNA, 20 nt, Human
acaguguacaagacugugcu

SEQ ID NO: 32849 - RNA, 23 nt, Human
acaguguagaccagacugccucu

SEQ ID NO: 32850 - RNA, 32 nt, Human
acaguguaggggaagcaauggaagaacuucua

SEQ ID NO: 32851 - RNA, 32 nt, Human
acaguguagugcucaguaggacagcauaguac

SEQ ID NO: 32852 - RNA, 20 nt, Human
acaguguauagucaaaggca

SEQ ID NO: 32853 - RNA, 32 nt, Human
acagugucaccugccagcaccaccacgccagg

SEQ ID NO: 32854 - RNA, 32 nt, Human
acaguguccagugcuccagccuaggagucuac

SEQ ID NO: 32855 - RNA, 32 nt, Human
acaguguccccaggaaccaccuucuggagccu

SEQ ID NO: 32856 - RNA, 21 nt, Human
acaguguccccaggaggccau

SEQ ID NO: 32857 - RNA, 32 nt, Human
acaguguccucgcucuaccucugccucuccgg

SEQ ID NO: 32858 - RNA, 32 nt, Human
acagugucugcagcugcugcccuucucccagg

SEQ ID NO: 32859 - RNA, 32 nt, Human
acagugucuggcacagaauagaugcucaauaa

SEQ ID NO: 32860 - RNA, 32 nt, Human
acagugugaaguuuaaugcuguugucaagagg

SEQ ID NO: 32861 - RNA, 32 nt, Human
acagugugacccugggcucuggcgggcaguag

SEQ ID NO: 32862 - RNA, 32 nt, Human
acagugugaggggcauggggaggcaggaguag

SEQ ID NO: 32863 - RNA, 32 nt, Human
acagugugcaaaacucacaaaggaaauccguc

SEQ ID NO: 32864 - RNA, 32 nt, Human
acagugugcagguuauaaaagcauuaauacau

SEQ ID NO: 32865 - RNA, 32 nt, Human
acagugugcucuggcugcugggagcccaucuc

SEQ ID NO: 32866 - RNA, 32 nt, Human
acaguguggaagaucgcaagugcugcuuccgu

SEQ ID NO: 32867 - RNA, 32 nt, Human
acaguguggcugggacccacuucucuccucug

SEQ ID NO: 32868 - RNA, 32 nt, Human
acagugugggaccugcccccagcuucugccac

SEQ ID NO: 32869 - RNA, 20 nt, Human
acaguguggggugaaacaag

SEQ ID NO: 32870 - RNA, 32 nt, Human
acagugugguagagaagacaguggaggaaaac

SEQ ID NO: 32871 - RNA, 32 nt, Human
acagugugugguuuuggcaugucuguuucagg

SEQ ID NO: 32872 - RNA, 32 nt, Human
acaguguucaaggucacagggucaaaauauau

SEQ ID NO: 32873 - RNA, 32 nt, Human
acaguguucugcagagccugagcugcugcugu

SEQ ID NO: 32874 - RNA, 32 nt, Human
acaguguugcauaugagccugcccucacuccc

SEQ ID NO: 32875 - RNA, 32 nt, Human
acaguguugcugcuggcagagaugcauuccag

SEQ ID NO: 32876 - RNA, 32 nt, Human
acaguguugggcaucugcuccccguggacaca

SEQ ID NO: 32877 - RNA, 32 nt, Human
acaguguugggggaugugaaugaggacaagcu

SEQ ID NO: 32878 - RNA, 32 nt, Human
acaguguugguuagcuuccugcauugauugcc

SEQ ID NO: 32879 - RNA, 32 nt, Human
acaguguuuauaugugugugagagaguaugau

SEQ ID NO: 32880 - RNA, 32 nt, Human
acaguguuuccacucuuucugcccucaccugg

SEQ ID NO: 32881 - RNA, 32 nt, Human
acaguguuugugucccugauuacuugagauua

SEQ ID NO: 32882 - RNA, 32 nt, Human
acaguuaaacggagaguauuggagagcacccc

SEQ ID NO: 32883 - RNA, 32 nt, Human
acaguuaaaggaacguuucaguuccuuucauu

SEQ ID NO: 32884 - RNA, 32 nt, Human
acaguuaaccagcccauuucuccacacuggua

SEQ ID NO: 32885 - RNA, 21 nt, Human
acaguuacaacgccucugcca

SEQ ID NO: 32886 - RNA, 32 nt, Human
acaguuacaauuuauugcuauauugugauacg

SEQ ID NO: 32887 - RNA, 32 nt, Human
acaguuacggcugaaguggcagggucaagcuu

SEQ ID NO: 32888 - RNA, 32 nt, Human
acaguuacuggcagaggaagaggaugaugauu

SEQ ID NO: 32889 - RNA, 22 nt, Human
acaguuagaucagagaaagcaa

SEQ ID NO: 32890 - RNA, 32 nt, Human
acaguuagcucccugagggcaagggacuguca

SEQ ID NO: 32891 - RNA, 17 nt, Human
acaguuagcuggagcug

SEQ ID NO: 32892 - RNA, 32 nt, Human
acaguuaggacaaauggggaggggacaccaug

SEQ ID NO: 32893 - RNA, 32 nt, Human
acaguuaucagcugccauugcucccugucugu

SEQ ID NO: 32894 - RNA, 32 nt, Human
acaguucacugcagccucaaccucuccagauu

SEQ ID NO: 32895 - RNA, 25 nt, Human
acaguucagcagcuaccacccuggc

SEQ ID NO: 32896 - RNA, 32 nt, Human
acaguucaggcauucucucuuuuagaacuuga

SEQ ID NO: 32897 - RNA, 32 nt, Human
acaguucagugcagugggugagagacgaguca

SEQ ID NO: 32898 - RNA, 32 nt, Human
acaguucaucuuccuuucuuccugcuaaccuu

SEQ ID NO: 32899 - RNA, 32 nt, Human
acaguucauggacugagucagucccaacgucc

SEQ ID NO: 32900 - RNA, 32 nt, Human
acaguuccagccacuaggaggccgucuuggaa

SEQ ID NO: 32901 - RNA, 32 nt, Human
acaguucccaaaggaggcuggaagugaagugc

SEQ ID NO: 32902 - RNA, 32 nt, Human
acaguucccaaguuuucccuugugcauuguuc

SEQ ID NO: 32903 - RNA, 32 nt, Human
acaguucccagagugggcuuugguggccaggg

SEQ ID NO: 32904 - RNA, 32 nt, Human
acaguucccaggcuggggaugcuuugccuugu

SEQ ID NO: 32905 - RNA, 32 nt, Human
acaguuccuagagcagugucuggcacauguuc

SEQ ID NO: 32906 - RNA, 32 nt, Human
acaguuccuggaaggcccuccagcuggaugcu

SEQ ID NO: 32907 - RNA, 32 nt, Human
acaguucgcuaguacaaggggucuucaggaag

SEQ ID NO: 32908 - RNA, 32 nt, Human
acaguucgggaggcagaguuagguggaucaau

SEQ ID NO: 32909 - RNA, 20 nt, Human
acaguucuacagaaaaacaa

SEQ ID NO: 32910 - RNA, 32 nt, Human
acaguucuagggacaggacucugaggugggug

SEQ ID NO: 32911 - RNA, 32 nt, Human
acaguucucauggaggaagaugcucagcuggg

SEQ ID NO: 32912 - RNA, 32 nt, Human
acaguucuccaugccaguaucugggugugggu

SEQ ID NO: 32913 - RNA, 32 nt, Human
acaguucucccugccccucagccugggggaag

SEQ ID NO: 32914 - RNA, 32 nt, Human
acaguucuccuggaagggagguuuuugcuuua

SEQ ID NO: 32915 - RNA, 32 nt, Human
acaguucucugacuugcagaaccugccaggug

SEQ ID NO: 32916 - RNA, 32 nt, Human
acaguucugcugcuguggcuucagcuuuggaa

SEQ ID NO: 32917 - RNA, 32 nt, Human
acaguucugggagugugaccuguaagccuccu

SEQ ID NO: 32918 - RNA, 32 nt, Human
acaguucuguaagcaucaggagcuagagacgc

SEQ ID NO: 32919 - RNA, 32 nt, Human
acaguucugucucuacuaccugaucuccuccu

SEQ ID NO: 32920 - RNA, 32 nt, Human
acaguucuuagcacugaacucgucacaguguu

SEQ ID NO: 32921 - RNA, 32 nt, Human
acaguugacaggugugccuuuagaugacccug

SEQ ID NO: 32922 - RNA, 32 nt, Human
acaguugagauucgcauauuugccuauucuuu

SEQ ID NO: 32923 - RNA, 32 nt, Human
acaguugagcaccccaaaucugaaaggcuucu

SEQ ID NO: 32924 - RNA, 18 nt, Human
acaguugcaaccaaggca

SEQ ID NO: 32925 - RNA, 32 nt, Human
acaguugcagauaggcugguuuucaugaggaa

SEQ ID NO: 32926 - RNA, 32 nt, Human
acaguugccaccaccucuguggcauugaaaug

SEQ ID NO: 32927 - RNA, 32 nt, Human
acaguugccuacaguauucagugcaguaacau

SEQ ID NO: 32928 - RNA, 32 nt, Human
acaguugccuuucaauucaguguuauacugug

SEQ ID NO: 32929 - RNA, 22 nt, Human
acaguugcucacgccuguaauc

SEQ ID NO: 32930 - RNA, 32 nt, Human
acaguugcuggcuuugcuccugggcaaggagg

SEQ ID NO: 32931 - RNA, 32 nt, Human
acaguuggaacccaaggaaggcaggccauccc

SEQ ID NO: 32932 - RNA, 32 nt, Human
acaguuggagauguuggauaaaugucuuuucu

SEQ ID NO: 32933 - RNA, 32 nt, Human
acaguugggaaaggaggcaguggcagaggggu

SEQ ID NO: 32934 - RNA, 32 nt, Human
acaguugggcggagcuuggguugggagugaga

SEQ ID NO: 32935 - RNA, 32 nt, Human
acaguuggggagcuccaggagcuguuuuaagu

SEQ ID NO: 32936 - RNA, 32 nt, Human
acaguuggggcucuccugccuucacgcguggg

SEQ ID NO: 32937 - RNA, 32 nt, Human
acaguugggggaggcagagccagcagguggac

SEQ ID NO: 32938 - RNA, 32 nt, Human
acaguugguggaaccaacgguacuacuucagu

SEQ ID NO: 32939 - RNA, 32 nt, Human
acaguuguauaaacaggaagccaggcuuuuga

SEQ ID NO: 32940 - RNA, 21 nt, Human
acaguugugacagaacaugca

SEQ ID NO: 32941 - RNA, 32 nt, Human
acaguugugacggauguauggauguucuugaa

SEQ ID NO: 32942 - RNA, 21 nt, Human
acaguuguggagaaaaaguaa

SEQ ID NO: 32943 - RNA, 32 nt, Human
acaguugugugguaacaagcuaauaugcuucc

SEQ ID NO: 32944 - RNA, 32 nt, Human
acaguuguguguguaucucauuccacuguucc

SEQ ID NO: 32945 - RNA, 24 nt, Human
acaguuguucucagcauaaaguca

SEQ ID NO: 32946 - RNA, 32 nt, Human
acaguuuaaagaaaacccagugguucaaacau

SEQ ID NO: 32947 - RNA, 32 nt, Human
acaguuuacugauuuagccagugaagagaaag

SEQ ID NO: 32948 - RNA, 32 nt, Human
acaguuuagcauauauaaacaaacaugauagg

SEQ ID NO: 32949 - RNA, 32 nt, Human
acaguuuauuucucccuucauccuuugcuaga

SEQ ID NO: 32950 - RNA, 32 nt, Human
acaguuucacagcaggacacugagggaauauu

SEQ ID NO: 32951 - RNA, 32 nt, Human
acaguuucacagucuuugccaguucuaaguac

SEQ ID NO: 32952 - RNA, 32 nt, Human
acaguuucauugauugacucuaccuccuugcc

SEQ ID NO: 32953 - RNA, 32 nt, Human
acaguuuccagaugcuaucacagacucugcua

SEQ ID NO: 32954 - RNA, 32 nt, Human
acaguuuccuaagcgcauaguuuuugguccug

SEQ ID NO: 32955 - RNA, 32 nt, Human
acaguuucuaaauucuuugaaaccacuuuacu

SEQ ID NO: 32956 - RNA, 32 nt, Human
acaguuucuaagcuacccaggcugccagaccg

SEQ ID NO: 32957 - RNA, 32 nt, Human
acaguuucuaagggcccguccccagcccgggc

SEQ ID NO: 32958 - RNA, 32 nt, Human
acaguuucucagccaggcagggacucuuuucc

SEQ ID NO: 32959 - RNA, 32 nt, Human
acaguuucuccuccuccccucagccuuguggc

SEQ ID NO: 32960 - RNA, 32 nt, Human
acaguuucugugagucaggggucugggcacug

SEQ ID NO: 32961 - RNA, 32 nt, Human
acaguuucuucccacagcuggauauuuuaccc

SEQ ID NO: 32962 - RNA, 32 nt, Human
acaguuugaaaauguugagacagcacagcagc

SEQ ID NO: 32963 - RNA, 32 nt, Human
acaguuugaacaaaaucuccucuuuuagcuga

SEQ ID NO: 32964 - RNA, 19 nt, Human
acaguuugcagaaaagcaa

SEQ ID NO: 32965 - RNA, 32 nt, Human
acaguuugcccguguguuauguaucaguuaua

SEQ ID NO: 32966 - RNA, 32 nt, Human
acaguuuggcauuggugcucucugccuggcag

SEQ ID NO: 32967 - RNA, 32 nt, Human
acaguuuggcugcugugucugcugcgcacgcc

SEQ ID NO: 32968 - RNA, 32 nt, Human
acaguuuggcuucacuucucugaccccagccu

SEQ ID NO: 32969 - RNA, 32 nt, Human
acaguuuguagucucucucagggagagagacu

SEQ ID NO: 32970 - RNA, 32 nt, Human
acaguuugugaggaccuuugcacuuugccauc

SEQ ID NO: 32971 - RNA, 32 nt, Human
acaguuuuaaugauguauuugaugaauuuaaa

SEQ ID NO: 32972 - RNA, 32 nt, Human
acaguuuuauaagaagauguuuuuaaaaccuu

SEQ ID NO: 32973 - RNA, 32 nt, Human
acaguuuucaucagugccuguaucugugguca

SEQ ID NO: 32974 - RNA, 32 nt, Human
acaguuuucucuccacacauaaauaacaccac

SEQ ID NO: 32975 - RNA, 32 nt, Human
acaguuuugcaacaggcagagcugugucgcac

SEQ ID NO: 32976 - RNA, 32 nt, Human
acaguuuugcaaccucugcuccaaagagaaaa

SEQ ID NO: 32977 - RNA, 32 nt, Human
acaguuuugcucuugucuccccggcuggagug

SEQ ID NO: 32978 - RNA, 32 nt, Human
acaguuuugugagacuuaagggucuuuuuaac

SEQ ID NO: 32979 - RNA, 32 nt, Human
acaguuuuugggauaggagaccagcgguuuug

SEQ ID NO: 32980 - RNA, 32 nt, Human
acauaaaaauaacuuuaauguaauuuauguug

SEQ ID NO: 32981 - RNA, 32 nt, Human
acauaaaaauagaguucuuugggcaaaacuuu

SEQ ID NO: 32982 - RNA, 32 nt, Human
acauaaaaauuagcugggggugguagcacaua

SEQ ID NO: 32983 - RNA, 32 nt, Human
acauaaaaccaccaaaauacauagcuucgaca

SEQ ID NO: 32984 - RNA, 32 nt, Human
acauaaaacuacucucuaccucuggcugggcc

SEQ ID NO: 32985 - RNA, 32 nt, Human
acauaaaagccaagccacccauuugcuuuuaa

SEQ ID NO: 32986 - RNA, 32 nt, Human
acauaaaaggaggagacauacaaugggggaag

SEQ ID NO: 32987 - RNA, 32 nt, Human
acauaaaauuaaagccuguggcauuuuuaaag

SEQ ID NO: 32988 - RNA, 32 nt, Human
acauaaacagcuuuaaugaccucuucaccuag

SEQ ID NO: 32989 - RNA, 32 nt, Human
acauaaaccaaugcauuccuggcuccauguua

SEQ ID NO: 32990 - RNA, 32 nt, Human
acauaaaccaggauuacaugugguguagcaag

SEQ ID NO: 32991 - RNA, 32 nt, Human
acauaaaccccacaugccccaggagcgaugug

SEQ ID NO: 32992 - RNA, 32 nt, Human
acauaaacucaaccccuucucuuccaaaagcu

SEQ ID NO: 32993 - RNA, 32 nt, Human
acauaaacuuguacaagaauguucauagcagu

SEQ ID NO: 32994 - RNA, 32 nt, Human
acauaaaggagaagauuugggagagggagagg

SEQ ID NO: 32995 - RNA, 32 nt, Human
acauaaaggccuucccucgcuguugaggccac

SEQ ID NO: 32996 - RNA, 32 nt, Human
acauaaaguccccagcgguuccugucacaccu

SEQ ID NO: 32997 - RNA, 32 nt, Human
acauaaaugaggaaagugaggacaaggagcaa

SEQ ID NO: 32998 - RNA, 32 nt, Human
acauaaauucagaaaguaugauagcaguguag

SEQ ID NO: 32999 - RNA, 32 nt, Human
acauaacaaaccugcacauugugcacauguac

SEQ ID NO: 33000 - RNA, 32 nt, Human
acauaacagcagcccugcaaaggggucuucca

SEQ ID NO: 33001 - RNA, 21 nt, Human
acauaaccauaugucauguag

SEQ ID NO: 33002 - RNA, 32 nt, Human
acauaaccuuuauacagaaucuucccaucucu

SEQ ID NO: 33003 - RNA, 32 nt, Human
acauaacucacaccccugcccccaccccaugc

SEQ ID NO: 33004 - RNA, 32 nt, Human
acauaagagcaucagaacaccuuccauuuuau

SEQ ID NO: 33005 - RNA, 32 nt, Human
acauaagaggauucauacuggagagaaaccau

SEQ ID NO: 33006 - RNA, 32 nt, Human
acauaagaggcaggaagaguuuugauucuauc

SEQ ID NO: 33007 - RNA, 32 nt, Human
acauaagaggggcagaaggcuugaccagaguu

SEQ ID NO: 33008 - RNA, 32 nt, Human
acauaagccaaaacauguaucucaucauugga

SEQ ID NO: 33009 - RNA, 32 nt, Human
acauaagccaggacauucugcugugagugacu

SEQ ID NO: 33010 - RNA, 32 nt, Human
acauaagcuaagaucacuauagguccauuucu

SEQ ID NO: 33011 - RNA, 32 nt, Human
acauaaggcaggcagggauacaaggcagucug

SEQ ID NO: 33012 - RNA, 32 nt, Human
acauaagguaauucauacuggagagaaacccu

SEQ ID NO: 33013 - RNA, 32 nt, Human
acauaagguaauucauucuggagagaaacccu

SEQ ID NO: 33014 - RNA, 32 nt, Human
acauaagguacugaaguuagccaagguugcuu

SEQ ID NO: 33015 - RNA, 31 nt, Human
acauaaguggacauagaaaaagaggcuggca

SEQ ID NO: 33016 - RNA, 32 nt, Human
acauaauaaaaguaauuucuacauuuguguag

SEQ ID NO: 33017 - RNA, 32 nt, Human
acauaauaaaaguaauuucuacauuugugugg

SEQ ID NO: 33018 - RNA, 32 nt, Human
acauaauaagacuuucuuaugugacuuagcug

SEQ ID NO: 33019 - RNA, 32 nt, Human
acauaauacaguuugagaacagccuggccaac

SEQ ID NO: 33020 - RNA, 32 nt, Human
acauaauacgcaaaucacauguaaguaagaga

SEQ ID NO: 33021 - RNA, 32 nt, Human
acauaaucaaagcuuaucuuuuuaagcacuaa

SEQ ID NO: 33022 - RNA, 32 nt, Human
acauaaucaacucccuauuaaauucuuuaaug

SEQ ID NO: 33023 - RNA, 32 nt, Human
acauaaucaagaaaugacuaaguaguuaugug

SEQ ID NO: 33024 - RNA, 32 nt, Human
acauaaucaaguuuugacuauuuggaaaccaa

SEQ ID NO: 33025 - RNA, 32 nt, Human
acauaaucauuucccaaaggauuucaccuccu

SEQ ID NO: 33026 - RNA, 32 nt, Human
acauaaucccaggucaguuagcacagaugccc

SEQ ID NO: 33027 - RNA, 32 nt, Human
acauaauuggacucugucacaaagggacuuug

SEQ ID NO: 33028 - RNA, 32 nt, Human
acauaauuuauggacgaaaugccuaaaaaugu

SEQ ID NO: 33029 - RNA, 32 nt, Human
acauaauuuggaauuguuuaagucuauuucag

SEQ ID NO: 33030 - RNA, 32 nt, Human
acauacaaaacuuaugaauuacccagcacaac

SEQ ID NO: 33031 - RNA, 32 nt, Human
acauacaagauacuccuggagcauuuugcagu

SEQ ID NO: 33032 - RNA, 32 nt, Human
acauacacaaaugcaucauacaugugugguga

SEQ ID NO: 33033 - RNA, 32 nt, Human
acauacacacaaaaacuuguacaccaauguuc

SEQ ID NO: 33034 - RNA, 32 nt, Human
acauacacacaaaacagcaaacuucagguaac

SEQ ID NO: 33035 - RNA, 32 nt, Human
acauacacacauaugucauauauuacuagcau

SEQ ID NO: 33036 - RNA, 32 nt, Human
acauacacacaugugcacacacccucaugcau

SEQ ID NO: 33037 - RNA, 32 nt, Human
acauacacacucauugacauacauucauucac

SEQ ID NO: 33038 - RNA, 32 nt, Human
acauacacagaauccucagauaacaggaggca

SEQ ID NO: 33039 - RNA, 32 nt, Human
acauacacagauugucuucagagccaaacgug

SEQ ID NO: 33040 - RNA, 32 nt, Human
acauacaggaauucaugcuggagagaaacccu

SEQ ID NO: 33041 - RNA, 32 nt, Human
acauacaggauuugaacucagaucugucugau

SEQ ID NO: 33042 - RNA, 32 nt, Human
acauacaggugcucaauaaacacuuguagagc

SEQ ID NO: 33043 - RNA, 32 nt, Human
acauacaguguuuuacauucucuccuuuauag

SEQ ID NO: 33044 - RNA, 32 nt, Human
acauacauacguaaggaucuuaaacccagucu

SEQ ID NO: 33045 - RNA, 32 nt, Human
acauacauaggcagaaagcaauuuuuagguga

SEQ ID NO: 33046 - RNA, 32 nt, Human
acauacaucccuccucugguaccacaguggcc

SEQ ID NO: 33047 - RNA, 32 nt, Human
acauacaucuaguauguuuaggguucuguguu

SEQ ID NO: 33048 - RNA, 32 nt, Human
acauacaugaucccaugcucccaagcuccauu

SEQ ID NO: 33049 - RNA, 32 nt, Human
acauacauggcuuccccaauguggcagaucaa

SEQ ID NO: 33050 - RNA, 32 nt, Human
acauacauggucuugcuuugucgcccaggcug

SEQ ID NO: 33051 - RNA, 32 nt, Human
acauacauugaauauguccaaagaaccauggu

SEQ ID NO: 33052 - RNA, 32 nt, Human
acauaccaaacccuagaaauguuuccaagaac

SEQ ID NO: 33053 - RNA, 32 nt, Human
acauaccagaacuuaaggaaugcggcaaaaac

SEQ ID NO: 33054 - RNA, 32 nt, Human
acauacccacacauuccagggcuggggugagc

SEQ ID NO: 33055 - RNA, 31 nt, Human
acauacccacuuagcaaaaccaaagcaccuu

SEQ ID NO: 33056 - RNA, 32 nt, Human
acauacccagagacacugagagagacagacag

SEQ ID NO: 33057 - RNA, 32 nt, Human
acauacccugcagcucucagcuggcugcagua

SEQ ID NO: 33058 - RNA, 32 nt, Human
acauaccucaaaauaauaaaacuaucuaugac

SEQ ID NO: 33059 - RNA, 32 nt, Human
acauaccuccaaaggcaggacuugccugauaa

SEQ ID NO: 33060 - RNA, 21 nt, Human
acauaccucugcaguaccuca

SEQ ID NO: 33061 - RNA, 32 nt, Human
acauaccugcgguuccagcuacucaagaggcu

SEQ ID NO: 33062 - RNA, 32 nt, Human
acauaccuggaggcugacguugccaaaccagc

SEQ ID NO: 33063 - RNA, 32 nt, Human
acauaccuguaauccaagcugcccaggagcug

SEQ ID NO: 33064 - RNA, 32 nt, Human
acauaccuguaaucccagcuacucaggaggcu

SEQ ID NO: 33065 - RNA, 32 nt, Human
acauaccuguaaucccagcuacucgggaggcu

SEQ ID NO: 33066 - RNA, 32 nt, Human
acauaccuguaaucccagcuacuuggaauugg

SEQ ID NO: 33067 - RNA, 32 nt, Human
acauaccuguaaucccagcuacuuugguggcu

SEQ ID NO: 33068 - RNA, 32 nt, Human
acauaccuguaaugccagcuacuugggaaggc

SEQ ID NO: 33069 - RNA, 32 nt, Human
acauaccuguagucccagcuacucuggaggcu

SEQ ID NO: 33070 - RNA, 32 nt, Human
acauaccuuguuauaugcagacauguauuucu

SEQ ID NO: 33071 - RNA, 32 nt, Human
acauacgacacacaccugugucuccccagggg

SEQ ID NO: 33072 - RNA, 32 nt, Human
acauacgagaggaacccaggagggcagcagac

SEQ ID NO: 33073 - RNA, 32 nt, Human
acauacgcacacacgugcacacauguacacac

SEQ ID NO: 33074 - RNA, 32 nt, Human
acauacgcuccucuauucuucccuucauccuc

SEQ ID NO: 33075 - RNA, 32 nt, Human
acauacguuguucuccccucucuggaucaagg

SEQ ID NO: 33076 - RNA, 32 nt, Human
acauacuacagacaagcuaccaaaaauuauuu

SEQ ID NO: 33077 - RNA, 32 nt, Human
acauacuacugccccauuggaagaagaaccag

SEQ ID NO: 33078 - RNA, 21 nt, Human
acauacucacagcccccgggc

SEQ ID NO: 33079 - RNA, 32 nt, Human
acauacucaugcacaugacucucccccauuuc

SEQ ID NO: 33080 - RNA, 32 nt, Human
acauacucauuucccaaaggauuucaccuccu

SEQ ID NO: 33081 - RNA, 32 nt, Human
acauacucucacacaggaaacgaccuggaaga

SEQ ID NO: 33082 - RNA, 32 nt, Human
acauacugaagcuccagccagggggauggguc

SEQ ID NO: 33083 - RNA, 32 nt, Human
acauacugcucuuuuccccucucccuccacac

SEQ ID NO: 33084 - RNA, 32 nt, Human
acauacugggaaaggcagaggguggagggaag

SEQ ID NO: 33085 - RNA, 31 nt, Human
acauacuuauaagucuaucauuuaaagacau

SEQ ID NO: 33086 - RNA, 32 nt, Human
acauacuucuuacuugucuguacaguaccuug

SEQ ID NO: 33087 - RNA, 32 nt, Human
acauacuugaagucccagcuguuugggaggcu

SEQ ID NO: 33088 - RNA, 32 nt, Human
acauacuugguauccaauaaauauuuguugga

SEQ ID NO: 33089 - RNA, 32 nt, Human
acauacuuguuccuccuccuagcucucucccu

SEQ ID NO: 33090 - RNA, 32 nt, Human
acauacuuuucagacugccuuucuuuuguaau

SEQ ID NO: 33091 - RNA, 32 nt, Human
acauagaaaacacaaaccacaacugacacagg

SEQ ID NO: 33092 - RNA, 32 nt, Human
acauagaaagaauauuaaagaguagguugaac

SEQ ID NO: 33093 - RNA, 32 nt, Human
acauagaaagacaugggcuaucagggaggaag

SEQ ID NO: 33094 - RNA, 32 nt, Human
acauagaaccuuagguagaacucccccaaauc

SEQ ID NO: 33095 - RNA, 32 nt, Human
acauagaaugauuuugcuuuucucuuuuauua

SEQ ID NO: 33096 - RNA, 32 nt, Human
acauagacauaaaaauacuguaugugacagca

SEQ ID NO: 33097 - RNA, 32 nt, Human
acauagaccaaacuuguauacacacagacauc

SEQ ID NO: 33098 - RNA, 32 nt, Human
acauagacuggguggcuuaagcaacagaaguu

SEQ ID NO: 33099 - RNA, 32 nt, Human
acauagagaacaaaagcauauuugaccaagca

SEQ ID NO: 33100 - RNA, 32 nt, Human
acauagagauagagacagagaggcagagaaga

SEQ ID NO: 33101 - RNA, 32 nt, Human
acauagagcacuugaaccuccuuuguaccugu

SEQ ID NO: 33102 - RNA, 30 nt, Human
acauagagccucucucuuuuccuguuucuu

SEQ ID NO: 33103 - RNA, 32 nt, Human
acauagaggagagagaaaauggcugaguuaaa

SEQ ID NO: 33104 - RNA, 32 nt, Human
acauagagggugagaggggagagcuggacaaa

SEQ ID NO: 33105 - RNA, 32 nt, Human
acauagaucucucccacuagagcccagaggga

SEQ ID NO: 33106 - RNA, 32 nt, Human
acauagaugaguaagucuagagaggacauugc

SEQ ID NO: 33107 - RNA, 32 nt, Human
acauagauuauccaggcugagauggaaaacaa

SEQ ID NO: 33108 - RNA, 32 nt, Human
acauagcaagccuguaccacucuacaguaaaa

SEQ ID NO: 33109 - RNA, 32 nt, Human
acauagcaccagccccagccaggagaaggaag

SEQ ID NO: 33110 - RNA, 32 nt, Human
acauagcagcgguuccugucauguguucaugu

SEQ ID NO: 33111 - RNA, 32 nt, Human
acauagcagggcuggggugcagaggaggccca

SEQ ID NO: 33112 - RNA, 32 nt, Human
acauagcauccagcgacaccacagccaaggga

SEQ ID NO: 33113 - RNA, 32 nt, Human
acauagccaccgaggcaccgacaggaagcugu

SEQ ID NO: 33114 - RNA, 32 nt, Human
acauagccauuuucucucuagggcuuucuuuc

SEQ ID NO: 33115 - RNA, 32 nt, Human
acauagcccaacaaagaacuucuuugacauuu

SEQ ID NO: 33116 - RNA, 32 nt, Human
acauagcccauugcccuuaaugaugguuucuu

SEQ ID NO: 33117 - RNA, 32 nt, Human
acauagccccaaccaccucugccagcaaccuu

SEQ ID NO: 33118 - RNA, 21 nt, Human
acauagcccccaaccugugua

SEQ ID NO: 33119 - RNA, 22 nt, Human
acauagcccuuucuuugccaug

SEQ ID NO: 33120 - RNA, 32 nt, Human
acauagccuaaauucuagccuggcagcaagag

SEQ ID NO: 33121 - RNA, 32 nt, Human
acauagcucacugcagccuugaacuccuggac

SEQ ID NO: 33122 - RNA, 32 nt, Human
acauagcucagcaacagaugcucucacgcuug

SEQ ID NO: 33123 - RNA, 32 nt, Human
acauagcucaguggucaagacuugggcuuggg

SEQ ID NO: 33124 - RNA, 32 nt, Human
acauagcuccuggagcgcgggacuuggacacg

SEQ ID NO: 33125 - RNA, 32 nt, Human
acauaggagaaaaaccuuaugaaugauuggau

SEQ ID NO: 33126 - RNA, 32 nt, Human
acauaggaggagaauacuugaagcaguaugcu

SEQ ID NO: 33127 - RNA, 32 nt, Human
acauaggaggauucauacuggagagaaaccau

SEQ ID NO: 33128 - RNA, 32 nt, Human
acauaggaggauucauacuggagagaaaccgu

SEQ ID NO: 33129 - RNA, 32 nt, Human
acauaggaggcugaggugggaggauuguuuga

SEQ ID NO: 33130 - RNA, 32 nt, Human
acauaggauaauucauacuggagagaaacuuu

SEQ ID NO: 33131 - RNA, 32 nt, Human
acauaggcagaagucaagaaaguuacucaaga

SEQ ID NO: 33132 - RNA, 32 nt, Human
acauaggcaguagccuccuccugggcuccaga

SEQ ID NO: 33133 - RNA, 32 nt, Human
acauaggccaccggccucauccaaggccccac

SEQ ID NO: 33134 - RNA, 32 nt, Human
acauaggcccaggcuauccaggcugcagugga

SEQ ID NO: 33135 - RNA, 32 nt, Human
acauaggccuccaggagcccucagugagaggg

SEQ ID NO: 33136 - RNA, 32 nt, Human
acauaggcuauauccuggaagugggcagggga

SEQ ID NO: 33137 - RNA, 32 nt, Human
acauagggaugaaguaaggugccugaaaaguu

SEQ ID NO: 33138 - RNA, 32 nt, Human
acauagggcucaucugagucugugauguucua

SEQ ID NO: 33139 - RNA, 32 nt, Human
acauagguaaacuguuacaaauccagaauggu

SEQ ID NO: 33140 - RNA, 32 nt, Human
acauagguaagccugugccauggugguuugcu

SEQ ID NO: 33141 - RNA, 32 nt, Human
acauaggucuuguuaagaaaccaguccugccu

SEQ ID NO: 33142 - RNA, 32 nt, Human
acauaguaaauccucuuuuugaugaguuucug

SEQ ID NO: 33143 - RNA, 32 nt, Human
acauaguauaauucacacuggagagaagccuu

SEQ ID NO: 33144 - RNA, 32 nt, Human
acauagucauuccucaaguuagcaucucuccu

SEQ ID NO: 33145 - RNA, 32 nt, Human
acauaguccagcuuucuaaaauccaggacucu

SEQ ID NO: 33146 - RNA, 32 nt, Human
acauagucugcucugggcggaagagcuuugcu

SEQ ID NO: 33147 - RNA, 23 nt, Human
acauagucuuaagcauuuuugca

SEQ ID NO: 33148 - RNA, 19 nt, Human
acauagucuucgugucuuu

SEQ ID NO: 33149 - RNA, 32 nt, Human
acauagugaagaagggagucucaguggguccu

SEQ ID NO: 33150 - RNA, 32 nt, Human
acauagugagcucucugccucuucggaacgau

SEQ ID NO: 33151 - RNA, 32 nt, Human
acauagugagggaaagaaaaagcuuaugcagu

SEQ ID NO: 33152 - RNA, 32 nt, Human
acauagugcaguuucaaaggaacucaccagac

SEQ ID NO: 33153 - RNA, 32 nt, Human
acauaguguaggucagcgugcuuagccuccug

SEQ ID NO: 33154 - RNA, 32 nt, Human
acauaguucaggaaguuuuuacauggucuacu

SEQ ID NO: 33155 - RNA, 32 nt, Human
acauaguugaaggauuuaacugaauguaugga

SEQ ID NO: 33156 - RNA, 32 nt, Human
acauaguugccucccuuauaacuucaguuuuu

SEQ ID NO: 33157 - RNA, 32 nt, Human
acauaguuguaacauaguugaaugacauuucu

SEQ ID NO: 33158 - RNA, 32 nt, Human
acauauaaaguuauaaaugaaggacaaggagg

SEQ ID NO: 33159 - RNA, 32 nt, Human
acauauaaguugagaaggugccugccauagcc

SEQ ID NO: 33160 - RNA, 32 nt, Human
acauauacaaauaaaacccugccuuguaaaau

SEQ ID NO: 33161 - RNA, 32 nt, Human
acauauacacagacguguagacacaaacauau

SEQ ID NO: 33162 - RNA, 32 nt, Human
acauauacacaugcacauacauacuuuuucug

SEQ ID NO: 33163 - RNA, 32 nt, Human
acauauacugauuuuaaaggcuccucagucau

SEQ ID NO: 33164 - RNA, 32 nt, Human
acauauacuucuuugcugaaugcuaauaaacu

SEQ ID NO: 33165 - RNA, 32 nt, Human
acauauaggggcacuuggguaaucuuggucag

SEQ ID NO: 33166 - RNA, 32 nt, Human
acauauagugauauagcaugucucuuuaguuu

SEQ ID NO: 33167 - RNA, 32 nt, Human
acauauauacaaaaauuagcugggcaucaugg

SEQ ID NO: 33168 - RNA, 32 nt, Human
acauauauacagauuguuggcauuugcaaaag

SEQ ID NO: 33169 - RNA, 21 nt, Human
acauauauguauguauacaca

SEQ ID NO: 33170 - RNA, 32 nt, Human
acauaucacagaacacacgcguccuuccaaga

SEQ ID NO: 33171 - RNA, 32 nt, Human
acauaucacgcugcugucaugauuuuguguca

SEQ ID NO: 33172 - RNA, 32 nt, Human
acauauccaggauuaugggagccccagccagu

SEQ ID NO: 33173 - RNA, 32 nt, Human
acauauccagggacucccuccuggccuuccug

SEQ ID NO: 33174 - RNA, 32 nt, Human
acauauccauuucuuuuccuaguuacggauga

SEQ ID NO: 33175 - RNA, 32 nt, Human
acauaucccagugcccuugccucauaauagau

SEQ ID NO: 33176 - RNA, 32 nt, Human
acauaucccuguuagcauuccccgggaccuuu

SEQ ID NO: 33177 - RNA, 32 nt, Human
acauauccuggaccaggcuuuucugcugaagc

SEQ ID NO: 33178 - RNA, 32 nt, Human
acauaucggaucuaagagauuaauaccauuag

SEQ ID NO: 33179 - RNA, 32 nt, Human
acauaucuagguauaugcuuucucucugcugu

SEQ ID NO: 33180 - RNA, 32 nt, Human
acauaucuaucucuuuuagaacuuuccagcuu

SEQ ID NO: 33181 - RNA, 32 nt, Human
acauaucucacaaacauuccccaaaccaggca

SEQ ID NO: 33182 - RNA, 32 nt, Human
acauaucucagguugucuaaguguuuuuaugu

SEQ ID NO: 33183 - RNA, 32 nt, Human
acauaucucuacgcugcaaauuuugggucuca

SEQ ID NO: 33184 - RNA, 32 nt, Human
acauaucucucaucuuuugguucuaacgugaa

SEQ ID NO: 33185 - RNA, 32 nt, Human
acauaucugaauggguaacaugaugagguacc

SEQ ID NO: 33186 - RNA, 32 nt, Human
acauaucugagacuggaaacaaaaaggguuua

SEQ ID NO: 33187 - RNA, 32 nt, Human
acauaugcaacauacuaauaccuuccugauuu

SEQ ID NO: 33188 - RNA, 32 nt, Human
acauaugcaauguauaugaauuauguagggau

SEQ ID NO: 33189 - RNA, 32 nt, Human
acauaugcacacacaugugcaaacauagccac

SEQ ID NO: 33190 - RNA, 32 nt, Human
acauaugcacacaggcacacauggcaaaacuc

SEQ ID NO: 33191 - RNA, 32 nt, Human
acauaugcacauaucaugaacagcguaaguuc

SEQ ID NO: 33192 - RNA, 31 nt, Human
acauaugcacuuuuuacauuuagaaacacug

SEQ ID NO: 33193 - RNA, 32 nt, Human
acauaugcaugggcuuggagaaaaugauauuc

SEQ ID NO: 33194 - RNA, 22 nt, Human
acauaugccaguuucacagaac

SEQ ID NO: 33195 - RNA, 32 nt, Human
acauaugcuuauauacaacuauguacaccuuu

SEQ ID NO: 33196 - RNA, 32 nt, Human
acauauggaauucauaguaugagccacauuuu

SEQ ID NO: 33197 - RNA, 32 nt, Human
acauauggaugacauuagcucauuacaguuau

SEQ ID NO: 33198 - RNA, 32 nt, Human
acauaugggaggagggggcagauuccuggccc

SEQ ID NO: 33199 - RNA, 32 nt, Human
acauauggucuauccuggagaauguuccaugu

SEQ ID NO: 33200 - RNA, 32 nt, Human
acauauguagauauuguuuucuguaaauaacc

SEQ ID NO: 33201 - RNA, 32 nt, Human
acauauguauacacacacauaauuugaaaacu

SEQ ID NO: 33202 - RNA, 18 nt, Human
acauauguauacccucga

SEQ ID NO: 33203 - RNA, 32 nt, Human
acauaugugaugagcacauacagacacaccuc

SEQ ID NO: 33204 - RNA, 32 nt, Human
acauaugugcugcacuccuucccuccugccuc

SEQ ID NO: 33205 - RNA, 18 nt, Human
acauauguuaucccuuga

SEQ ID NO: 33206 - RNA, 32 nt, Human
acauauguugcaagacccucccaugggggcac

SEQ ID NO: 33207 - RNA, 32 nt, Human
acauauuaaagaaacuuaaguggaaccagaag

SEQ ID NO: 33208 - RNA, 32 nt, Human
acauauuaauauuccaaucauaacuuuaauuc

SEQ ID NO: 33209 - RNA, 32 nt, Human
acauauuacacaaaacauugugccuuaaaaug

SEQ ID NO: 33210 - RNA, 32 nt, Human
acauauuacauacuucagacuuuugauauaaa

SEQ ID NO: 33211 - RNA, 32 nt, Human
acauauuagccaccagcugucuugcccaaggu

SEQ ID NO: 33212 - RNA, 32 nt, Human
acauauuagcuguguaauauagacaauuuacu

SEQ ID NO: 33213 - RNA, 32 nt, Human
acauauucacuacuugaucuugugaacacugg

SEQ ID NO: 33214 - RNA, 32 nt, Human
acauauucaguuuucaguagaagaacuuaaaa

SEQ ID NO: 33215 - RNA, 32 nt, Human
acauauucauucucucuucuccaucacccaua

SEQ ID NO: 33216 - RNA, 32 nt, Human
acauauucguuugguuucacuggauuuucuuc

SEQ ID NO: 33217 - RNA, 32 nt, Human
acauauucucaguccuccucuggucuacaaag

SEQ ID NO: 33218 - RNA, 32 nt, Human
acauauucuucucgagugcauaugaaacaucu

SEQ ID NO: 33219 - RNA, 32 nt, Human
acauauucuuuaugccacaccuaccacgggau

SEQ ID NO: 33220 - RNA, 32 nt, Human
acauauucuuucucccaauccaugccuucccu

SEQ ID NO: 33221 - RNA, 32 nt, Human
acauauugauuguuuccagucucugggccgaa

SEQ ID NO: 33222 - RNA, 32 nt, Human
acauauuggccuuuugcuauccuuccugcuau

SEQ ID NO: 33223 - RNA, 32 nt, Human
acauauuuaaugauguuuaagucugaaaaagu

SEQ ID NO: 33224 - RNA, 32 nt, Human
acauauuuaucuuuuccugugugauagguuuu

SEQ ID NO: 33225 - RNA, 32 nt, Human
acauauuuauuugagcugaacauuaguuugua

SEQ ID NO: 33226 - RNA, 32 nt, Human
acauauuuauuugagcugagcauuaguuugua

SEQ ID NO: 33227 - RNA, 32 nt, Human
acauauuuccggucaucucugguggugagagg

SEQ ID NO: 33228 - RNA, 32 nt, Human
acauauuucucagaaagauugccgggaagaug

SEQ ID NO: 33229 - RNA, 32 nt, Human
acauauuuuagauuuaucuuauuugaaaguau

SEQ ID NO: 33230 - RNA, 32 nt, Human
acauauuuucccuguuugcuuugcuacuguau

SEQ ID NO: 33231 - RNA, 32 nt, Human
acauauuuuccuuaauagaggaaugcuucgua

SEQ ID NO: 33232 - RNA, 32 nt, Human
acauauuuucuguaaauauacaugcgccggga

SEQ ID NO: 33233 - RNA, 32 nt, Human
acauauuuugcagccaguaauugacaguuaau

SEQ ID NO: 33234 - RNA, 32 nt, Human
acauauuuuggcaagccaaccaggagaaaaga

SEQ ID NO: 33235 - RNA, 32 nt, Human
acaucaaaaguggagaaugaggccaggcgugg

SEQ ID NO: 33236 - RNA, 32 nt, Human
acaucaaaaguuugcaacuacaagccgacgga

SEQ ID NO: 33237 - RNA, 32 nt, Human
acaucaaacccuggagcuugacauauauaaac

SEQ ID NO: 33238 - RNA, 32 nt, Human
acaucaaagcaucucacuccagccucugcuuc

SEQ ID NO: 33239 - RNA, 19 nt, Human
acaucaaagcuucuucaca

SEQ ID NO: 33240 - RNA, 32 nt, Human
acaucaaaggguucauacuggagagaaacccu

SEQ ID NO: 33241 - RNA, 32 nt, Human
acaucaaaguuacuccagagcaaccaagcaau

SEQ ID NO: 33242 - RNA, 19 nt, Human
acaucaaaguuaucucaca

SEQ ID NO: 33243 - RNA, 32 nt, Human
acaucaaauaccagcaccccaccugcacaaug

SEQ ID NO: 33244 - RNA, 20 nt, Human
acaucaacaaugccagcaua

SEQ ID NO: 33245 - RNA, 30 nt, Human
acaucaacagagcaaccagaaagacauugg

SEQ ID NO: 33246 - RNA, 32 nt, Human
acaucaacauaaacagucuuuggauacuaaau

SEQ ID NO: 33247 - RNA, 32 nt, Human
acaucaacccaagugcugggucaagugucuca

SEQ ID NO: 33248 - RNA, 32 nt, Human
acaucaacucacugcauaugcaacucaacuca

SEQ ID NO: 33249 - RNA, 32 nt, Human
acaucaagcucuucuucugugaugaaaccaaa

SEQ ID NO: 33250 - RNA, 32 nt, Human
acaucaagcugcaggcguucaauggcaauggg

SEQ ID NO: 33251 - RNA, 32 nt, Human
acaucaagugaauacugugaucgggaaacauu

SEQ ID NO: 33252 - RNA, 32 nt, Human
acaucaaguuaggggcaaauuagauuagagcu

SEQ ID NO: 33253 - RNA, 32 nt, Human
acaucaauggcagaaucauccagcgaaucaga

SEQ ID NO: 33254 - RNA, 32 nt, Human
acaucaauucacugcugaaccccuggccccag

SEQ ID NO: 33255 - RNA, 32 nt, Human
acaucaauuuggaacgagaggaguggaagcug

SEQ ID NO: 33256 - RNA, 32 nt, Human
acaucaauuuuucuccugacuuuugcucgggu

SEQ ID NO: 33257 - RNA, 32 nt, Human
acaucacaagcagauaggaaacgucuuacaga

SEQ ID NO: 33258 - RNA, 32 nt, Human
acaucacaaugacacacacaucacacacacau

SEQ ID NO: 33259 - RNA, 32 nt, Human
acaucacaccauugcacuccagccugggcaac

SEQ ID NO: 33260 - RNA, 32 nt, Human
acaucacaguauucauacuggagagaaaccuu

SEQ ID NO: 33261 - RNA, 32 nt, Human
acaucaccaagggccuggcaccaggugcccag

SEQ ID NO: 33262 - RNA, 32 nt, Human
acaucaccacagugaaaccugacuucauccua

SEQ ID NO: 33263 - RNA, 32 nt, Human
acaucaccagccugggcgacagagugagacuc

SEQ ID NO: 33264 - RNA, 32 nt, Human
acaucaccaguucugcccuggcagccuccugc

SEQ ID NO: 33265 - RNA, 21 nt, Human
acaucaccaucgucaaagagc

SEQ ID NO: 33266 - RNA, 22 nt, Human
acaucacccaaagcaguggcca

SEQ ID NO: 33267 - RNA, 23 nt, Human
acaucacccacaagggguuauca

SEQ ID NO: 33268 - RNA, 20 nt, Human
acaucacccaccagacagcu

SEQ ID NO: 33269 - RNA, 21 nt, Human
acaucacccacgacccugcca

SEQ ID NO: 33270 - RNA, 19 nt, Human
acaucacccacugugcagc

SEQ ID NO: 33271 - RNA, 32 nt, Human
acaucacccagccuggacgccgcuccucgccu

SEQ ID NO: 33272 - RNA, 21 nt, Human
acaucacccaggaagcgguca

SEQ ID NO: 33273 - RNA, 20 nt, Human
acaucaccccauaccagagc

SEQ ID NO: 33274 - RNA, 21 nt, Human
acaucacccccaccaccccca

SEQ ID NO: 33275 - RNA, 23 nt, Human
acaucacccuacagcaguucagg

SEQ ID NO: 33276 - RNA, 32 nt, Human
acaucacccuggcaaaugucauccgacagcug

SEQ ID NO: 33277 - RNA, 32 nt, Human
acaucaccggaagaaauauggaaggaaaggaa

SEQ ID NO: 33278 - RNA, 32 nt, Human
acaucaccuaccggcuggugcaguacuaccgc

SEQ ID NO: 33279 - RNA, 21 nt, Human
acaucaccucucagggucagc

SEQ ID NO: 33280 - RNA, 32 nt, Human
acaucaccugcagggggcgcggcugucuuucu

SEQ ID NO: 33281 - RNA, 32 nt, Human
acaucacguggaauuggaucccaggcucucuu

SEQ ID NO: 33282 - RNA, 32 nt, Human
acaucacucccaggugcccuagggggcacauu

SEQ ID NO: 33283 - RNA, 32 nt, Human
acaucacugagggcaucaaugaggcuguccuc

SEQ ID NO: 33284 - RNA, 32 nt, Human
acaucacugcacuccagccuggguaacagagu

SEQ ID NO: 33285 - RNA, 32 nt, Human
acaucacugcacuccauccugggugacagaga

SEQ ID NO: 33286 - RNA, 32 nt, Human
acaucacugcacugcugacgccgcccuuguga

SEQ ID NO: 33287 - RNA, 32 nt, Human
acaucacugcaguccagccugggugacagagc

SEQ ID NO: 33288 - RNA, 32 nt, Human
acaucacugccaguugcuggccagcuugcccu

SEQ ID NO: 33289 - RNA, 32 nt, Human
acaucacuggcgugauguaagacaauucagcc

SEQ ID NO: 33290 - RNA, 22 nt, Human
acaucacuuacuucucagacca

SEQ ID NO: 33291 - RNA, 32 nt, Human
acaucacuuuuaucuugcagcucccgagauuc

SEQ ID NO: 33292 - RNA, 32 nt, Human
acaucagaacucugugucagccacuuuuauuu

SEQ ID NO: 33293 - RNA, 32 nt, Human
acaucagacuccaaguucuucaguuuugagac

SEQ ID NO: 33294 - RNA, 32 nt, Human
acaucagaggcagagucagaggccuccauguc

SEQ ID NO: 33295 - RNA, 32 nt, Human
acaucagaguauucauacuggagagaagccac

SEQ ID NO: 33296 - RNA, 32 nt, Human
acaucagaguauucauacuggagagaagcccu

SEQ ID NO: 33297 - RNA, 32 nt, Human
acaucagaugaagaacaugagcaagagcuucu

SEQ ID NO: 33298 - RNA, 32 nt, Human
acaucagcaaauucucaaacaguuauggacuc

SEQ ID NO: 33299 - RNA, 21 nt, Human
acaucagcacugaagucagcc

SEQ ID NO: 33300 - RNA, 32 nt, Human
acaucagcagaaugguugggaaugucaucaug

SEQ ID NO: 33301 - RNA, 32 nt, Human
acaucagcagggacuggucuagacccucccuu

SEQ ID NO: 33302 - RNA, 32 nt, Human
acaucagcaguugaaagaugaagaggauaacu

SEQ ID NO: 33303 - RNA, 32 nt, Human
acaucagcaugcuggcugugaccccggaaaga

SEQ ID NO: 33304 - RNA, 32 nt, Human
acaucagcauuguauacacauauuuucacuuu

SEQ ID NO: 33305 - RNA, 32 nt, Human
acaucagccagcacugcacagacagcugcgac

SEQ ID NO: 33306 - RNA, 32 nt, Human
acaucagcccaggagcccugagcagcacaggc

SEQ ID NO: 33307 - RNA, 32 nt, Human
acaucagccuccaugaggccaagccuuguacc

SEQ ID NO: 33308 - RNA, 32 nt, Human
acaucaggaagugagcccagaaagcugaaggu

SEQ ID NO: 33309 - RNA, 32 nt, Human
acaucaggacagacagaguuuuuggugagaag

SEQ ID NO: 33310 - RNA, 32 nt, Human
acaucaggauaacacauucuacaaaucagcug

SEQ ID NO: 33311 - RNA, 32 nt, Human
acaucaggauaguuuacugaagcacaaucucu

SEQ ID NO: 33312 - RNA, 32 nt, Human
acaucagggacuacagugggaaaaaggccucc

SEQ ID NO: 33313 - RNA, 32 nt, Human
acaucagggagaagaagguauagguggggaag

SEQ ID NO: 33314 - RNA, 32 nt, Human
acaucagggagugauuaguccuggggaaauuc

SEQ ID NO: 33315 - RNA, 24 nt, Human
acaucagggcggccucccaggucc

SEQ ID NO: 33316 - RNA, 32 nt, Human
acaucaggguagggaaagcugcagcagugaug

SEQ ID NO: 33317 - RNA, 32 nt, Human
acaucagguaacucauacaggagagaaaccau

SEQ ID NO: 33318 - RNA, 32 nt, Human
acaucaggugaaauguuagggugaggagccaa

SEQ ID NO: 33319 - RNA, 22 nt, Human
acaucaggugccaccaccacca

SEQ ID NO: 33320 - RNA, 32 nt, Human
acaucaguaaacaugagcgguaccaaaccuga

SEQ ID NO: 33321 - RNA, 24 nt, Human
acaucaguacuaccaccaccacca

SEQ ID NO: 33322 - RNA, 32 nt, Human
acaucaguggcuucucaagggaagagccuugc

SEQ ID NO: 33323 - RNA, 32 nt, Human
acaucagugggaggcaggggaggcagauauua

SEQ ID NO: 33324 - RNA, 32 nt, Human
acaucagugucuccucccuccugcuuugcugc

SEQ ID NO: 33325 - RNA, 32 nt, Human
acaucaguguuuugagaaccuuggacuacucc

SEQ ID NO: 33326 - RNA, 24 nt, Human
acaucauaaaagcaaagucagcca

SEQ ID NO: 33327 - RNA, 32 nt, Human
acaucauaaccagcuuuuacauccauuuuaga

SEQ ID NO: 33328 - RNA, 32 nt, Human
acaucauacaaaccagaauguuuccaucaccc

SEQ ID NO: 33329 - RNA, 32 nt, Human
acaucauacguggcaaccacaagccaaucagu

SEQ ID NO: 33330 - RNA, 32 nt, Human
acaucauauacuuccucagaagcaauugcaac

SEQ ID NO: 33331 - RNA, 20 nt, Human
acaucaucagaggacgcccc

SEQ ID NO: 33332 - RNA, 24 nt, Human
acaucaucccacugggagugguua

SEQ ID NO: 33333 - RNA, 23 nt, Human
acaucauccccaccccuccccca

SEQ ID NO: 33334 - RNA, 32 nt, Human
acaucaucucacacuuucauguucuuccauuu

SEQ ID NO: 33335 - RNA, 32 nt, Human
acaucaucucuauccaugagucaccccagccu

SEQ ID NO: 33336 - RNA, 32 nt, Human
acaucaucuggcaugugugcucugcacuggcu

SEQ ID NO: 33337 - RNA, 32 nt, Human
acaucaugagccuucagucaggguuugucaga

SEQ ID NO: 33338 - RNA, 32 nt, Human
acaucaugccacugcacuccagccuggggcug

SEQ ID NO: 33339 - RNA, 21 nt, Human
acaucauguagcaguuagcca

SEQ ID NO: 33340 - RNA, 32 nt, Human
acaucaugugccagccuccacccucacgccau

SEQ ID NO: 33341 - RNA, 21 nt, Human
acaucauuaccaagguugcca

SEQ ID NO: 33342 - RNA, 32 nt, Human
acaucauucauucaagggcuaaauuuauauuu

SEQ ID NO: 33343 - RNA, 32 nt, Human
acaucauucuggcuggagagugcaauguguca

SEQ ID NO: 33344 - RNA, 32 nt, Human
acaucauuuauuuuugcaucccugucugcuuu

SEQ ID NO: 33345 - RNA, 32 nt, Human
acauccaagaggaaauaauccaggcaaggaag

SEQ ID NO: 33346 - RNA, 32 nt, Human
acauccaagcaccugcuccuucaaggggacaa

SEQ ID NO: 33347 - RNA, 32 nt, Human
acauccaagcuggggugcaguggcgcgaucuc

SEQ ID NO: 33348 - RNA, 32 nt, Human
acauccacaagucucggugcaguuaugauggu

SEQ ID NO: 33349 - RNA, 23 nt, Human
acauccacagcguguccucccuc

SEQ ID NO: 33350 - RNA, 32 nt, Human
acauccacaguguuuucauuuacucugcuugu

SEQ ID NO: 33351 - RNA, 32 nt, Human
acauccacaugcucugcaguccuggcccccuc

SEQ ID NO: 33352 - RNA, 32 nt, Human
acauccaccggacugcagcccaagucuggacc

SEQ ID NO: 33353 - RNA, 32 nt, Human
acauccaccucccagguucaagugauucuugu

SEQ ID NO: 33354 - RNA, 32 nt, Human
acauccaccuccuggguucaagcaauucuccu

SEQ ID NO: 33355 - RNA, 32 nt, Human
acauccaccuccuggguucaagcgauucuccu

SEQ ID NO: 33356 - RNA, 32 nt, Human
acauccagacacaucaucuccauccuccagaa

SEQ ID NO: 33357 - RNA, 32 nt, Human
acauccagacaggaugaggguggagggagagc

SEQ ID NO: 33358 - RNA, 32 nt, Human
acauccagcguugugccuuuucucuauaagga

SEQ ID NO: 33359 - RNA, 32 nt, Human
acauccagcucagcaaccacaagcacagaggc

SEQ ID NO: 33360 - RNA, 32 nt, Human
acauccagcuccuggguuucagcaauucuccu

SEQ ID NO: 33361 - RNA, 22 nt, Human
acauccagcugccccucccuca

SEQ ID NO: 33362 - RNA, 32 nt, Human
acauccaggaagguaggagaaggcaucugagu

SEQ ID NO: 33363 - RNA, 32 nt, Human
acauccagggcugugucuuccuugggggagga

SEQ ID NO: 33364 - RNA, 32 nt, Human
acauccagucaggaccugacccgucucugucu

SEQ ID NO: 33365 - RNA, 32 nt, Human
acauccagugucuccaaaauuguuuccuugua

SEQ ID NO: 33366 - RNA, 32 nt, Human
acauccaucccuccauucauccuuccauccau

SEQ ID NO: 33367 - RNA, 32 nt, Human
acauccaugccauuugaugauuccaccacucc

SEQ ID NO: 33368 - RNA, 32 nt, Human
acaucccaaagggaucucaagccuucagcucu

SEQ ID NO: 33369 - RNA, 32 nt, Human
acaucccaauggcccuguccuuuucuuuacug

SEQ ID NO: 33370 - RNA, 32 nt, Human
acaucccacucucugaacuacaaucacugugc

SEQ ID NO: 33371 - RNA, 32 nt, Human
acaucccacuggcugcuguucugaaaccaucu

SEQ ID NO: 33372 - RNA, 32 nt, Human
acaucccagcacccccucuccugcugcaauuc

SEQ ID NO: 33373 - RNA, 32 nt, Human
acaucccagcuccuguccugugccuucaccuc

SEQ ID NO: 33374 - RNA, 32 nt, Human
acaucccaggauuuauggugucugucuauggc

SEQ ID NO: 33375 - RNA, 32 nt, Human
acaucccaguuuuguucuaucuuucuguccca

SEQ ID NO: 33376 - RNA, 32 nt, Human
acaucccauggacuugucacccagucgccugg

SEQ ID NO: 33377 - RNA, 32 nt, Human
acauccccaacaacagcagggaccaaccuaug

SEQ ID NO: 33378 - RNA, 32 nt, Human
acauccccacuuccagcccauguacacuagug

SEQ ID NO: 33379 - RNA, 32 nt, Human
acauccccagagugaaagauggagcugggcca

SEQ ID NO: 33380 - RNA, 18 nt, Human
acauccccaugcccuuga

SEQ ID NO: 33381 - RNA, 32 nt, Human
acaucccccuuucccuuccuccugugcugucc

SEQ ID NO: 33382 - RNA, 21 nt, Human
acauccccuguccccucccca

SEQ ID NO: 33383 - RNA, 18 nt, Human
acauccccugucuacuca

SEQ ID NO: 33384 - RNA, 32 nt, Human
acauccccuuuagaguucacacaucuugcccu

SEQ ID NO: 33385 - RNA, 19 nt, Human
acaucccgcggccccagca

SEQ ID NO: 33386 - RNA, 32 nt, Human
acaucccgggacggaggaagagaugaaggcuc

SEQ ID NO: 33387 - RNA, 32 nt, Human
acaucccggggcccuggccacagcauuguagg

SEQ ID NO: 33388 - RNA, 32 nt, Human
acaucccuauaauuccagcuacucgggaggcc

SEQ ID NO: 33389 - RNA, 20 nt, Human
acaucccucaaggcugggug

SEQ ID NO: 33390 - RNA, 32 nt, Human
acaucccuccacuucuccaacuucuguuuaau

SEQ ID NO: 33391 - RNA, 32 nt, Human
acaucccuccaggugaccuccaccuaccaugg

SEQ ID NO: 33392 - RNA, 32 nt, Human
acaucccucuguucuucucuuccuccuucagc

SEQ ID NO: 33393 - RNA, 32 nt, Human
acaucccugaauucaggcauucacaagaugca

SEQ ID NO: 33394 - RNA, 32 nt, Human
acaucccugagcugaauggcuucugagucgga

SEQ ID NO: 33395 - RNA, 32 nt, Human
acaucccugccuguagcucuucuuagugccua

SEQ ID NO: 33396 - RNA, 32 nt, Human
acaucccugcucccuccuuccucauccagcac

SEQ ID NO: 33397 - RNA, 32 nt, Human
acaucccugcuggaugcaggacccguccaaag

SEQ ID NO: 33398 - RNA, 25 nt, Human
acaucccuggccuccacccccacca

SEQ ID NO: 33399 - RNA, 32 nt, Human
acaucccugggcagaguaccaggcugcugacc

SEQ ID NO: 33400 - RNA, 32 nt, Human
acaucccugggugaagauggggagacagugcg

SEQ ID NO: 33401 - RNA, 32 nt, Human
acaucccuguagucccagcuacucccagcuau

SEQ ID NO: 33402 - RNA, 32 nt, Human
acaucccuucucgugcucacacacuugcccac

SEQ ID NO: 33403 - RNA, 32 nt, Human
acaucccuugccaaaaucagugucuggggcuu

SEQ ID NO: 33404 - RNA, 32 nt, Human
acaucccuuggccccuccaucugggcuccugu

SEQ ID NO: 33405 - RNA, 32 nt, Human
acaucccuuucccugcaggaguguggucuaua

SEQ ID NO: 33406 - RNA, 32 nt, Human
acaucccuuucucccuucccuccucuugcucc

SEQ ID NO: 33407 - RNA, 32 nt, Human
acaucccuuugaaacaagauaacugagaauuu

SEQ ID NO: 33408 - RNA, 32 nt, Human
acaucccuuuugcucauccagaucuuaaugau

SEQ ID NO: 33409 - RNA, 32 nt, Human
acauccgaaaagcaaccaacuucuucauggaa

SEQ ID NO: 33410 - RNA, 32 nt, Human
acauccgaaagcuacaccacagaugccagugg

SEQ ID NO: 33411 - RNA, 32 nt, Human
acauccgccuccuggguucaagcgauucuccu

SEQ ID NO: 33412 - RNA, 32 nt, Human
acauccgccucugggguucaagugauucuccu

SEQ ID NO: 33413 - RNA, 32 nt, Human
acauccgccugacgcuggacgugaccuucggg

SEQ ID NO: 33414 - RNA, 32 nt, Human
acauccggugcaucaugagacaugcuucuuug

SEQ ID NO: 33415 - RNA, 32 nt, Human
acauccgucuuggaggagaggcugcagccaca

SEQ ID NO: 33416 - RNA, 32 nt, Human
acauccguugugcuugccugcguuuuggaagc

SEQ ID NO: 33417 - RNA, 32 nt, Human
acauccuaaccaggauauacucuguucuugaa

SEQ ID NO: 33418 - RNA, 32 nt, Human
acauccuaagccauccaaaagaguugguuaua

SEQ ID NO: 33419 - RNA, 32 nt, Human
acauccuagaagcagcggauggugaggacaca

SEQ ID NO: 33420 - RNA, 32 nt, Human
acauccuagcuccuucucaggccuccaacugu

SEQ ID NO: 33421 - RNA, 32 nt, Human
acauccucaaauacauggcacauucauuagca

SEQ ID NO: 33422 - RNA, 25 nt, Human
acauccucaauaaaaccuguuguau

SEQ ID NO: 33423 - RNA, 32 nt, Human
acauccucauuucccacgcuucuccuuccacc

SEQ ID NO: 33424 - RNA, 20 nt, Human
acauccuccaucccagcaua

SEQ ID NO: 33425 - RNA, 32 nt, Human
acauccucccaaagugugcuuacuucauuugu

SEQ ID NO: 33426 - RNA, 32 nt, Human
acauccuccugccucggccuccugaguagcug

SEQ ID NO: 33427 - RNA, 32 nt, Human
acauccuccugcuucagccuccagagaguugg

SEQ ID NO: 33428 - RNA, 32 nt, Human
acauccucucucuccaaguuuaucucauccuu

SEQ ID NO: 33429 - RNA, 32 nt, Human
acauccucucuuggccuuacugaagauggggg

SEQ ID NO: 33430 - RNA, 32 nt, Human
acauccucugagcaccuggccgugggaaugcc

SEQ ID NO: 33431 - RNA, 32 nt, Human
acauccugcauucauguaaacaguuugcuguu

SEQ ID NO: 33432 - RNA, 32 nt, Human
acauccugccauugcucacccuuucccuuuau

SEQ ID NO: 33433 - RNA, 32 nt, Human
acauccugcccaaaccacucuccucucguccc

SEQ ID NO: 33434 - RNA, 32 nt, Human
acauccugcuucugcaauuccagagagugcug

SEQ ID NO: 33435 - RNA, 32 nt, Human
acauccuggaguuuggcucuagucacuucugg

SEQ ID NO: 33436 - RNA, 32 nt, Human
acauccuggccuggcacaucagaaaggaaugg

SEQ ID NO: 33437 - RNA, 32 nt, Human
acauccuggcuccuaucucugccuuccaggca

SEQ ID NO: 33438 - RNA, 32 nt, Human
acauccugucucaaauaaauuacauuaaaugu

SEQ ID NO: 33439 - RNA, 32 nt, Human
acauccuucacuguguggaccuagagacucca

SEQ ID NO: 33440 - RNA, 32 nt, Human
acauccuucauauguauuucccugcacuggcc

SEQ ID NO: 33441 - RNA, 32 nt, Human
acauccuucccaacaccuccuucccaacaccu

SEQ ID NO: 33442 - RNA, 32 nt, Human
acauccuucccccagacacuguucccaaccug

SEQ ID NO: 33443 - RNA, 32 nt, Human
acauccuuucuuccuuucauucccaagauaua

SEQ ID NO: 33444 - RNA, 32 nt, Human
acaucgacccccaggccucggaaguggcuguc

SEQ ID NO: 33445 - RNA, 32 nt, Human
acaucgauauacauuuauuuacacucuugauu

SEQ ID NO: 33446 - RNA, 32 nt, Human
acaucgaugacgagcugaagcuguugucacuu

SEQ ID NO: 33447 - RNA, 32 nt, Human
acaucgccauuuuccucuuucccaacucuuac

SEQ ID NO: 33448 - RNA, 32 nt, Human
acaucgcgccacugcacuccagccugggcgac

SEQ ID NO: 33449 - RNA, 32 nt, Human
acaucgcgccacugcacuucagccuggacaac

SEQ ID NO: 33450 - RNA, 32 nt, Human
acaucgcgccauugcacuccagccugggugac

SEQ ID NO: 33451 - RNA, 32 nt, Human
acaucgcggcccuccagccuggccuaacacuu

SEQ ID NO: 33452 - RNA, 32 nt, Human
acaucggcacucuggaccuggccagcagccgc

SEQ ID NO: 33453 - RNA, 32 nt, Human
acaucggccacagccaccuugucuuugcucuu

SEQ ID NO: 33454 - RNA, 32 nt, Human
acaucggggaaucucuccaggacauuggagug

SEQ ID NO: 33455 - RNA, 21 nt, Human
acaucgguuucaccuccacca

SEQ ID NO: 33456 - RNA, 24 nt, Human
acaucguaguccacccccucccca

SEQ ID NO: 33457 - RNA, 32 nt, Human
acaucgucaagaacaagccagugcugcuugug

SEQ ID NO: 33458 - RNA, 32 nt, Human
acaucgucucucucauucaugacugggaagug

SEQ ID NO: 33459 - RNA, 23 nt, Human
acaucgucugacuugagucgcca

SEQ ID NO: 33460 - RNA, 32 nt, Human
acaucgugcauucuguaucagcugguccaguc

SEQ ID NO: 33461 - RNA, 32 nt, Human
acaucgugcugcagcuggacgacauccagcau

SEQ ID NO: 33462 - RNA, 32 nt, Human
acaucguggagcugugguggggccugcaguca

SEQ ID NO: 33463 - RNA, 32 nt, Human
acaucguggccucaggugccaggguuugaugg

SEQ ID NO: 33464 - RNA, 32 nt, Human
acaucuaacccccacaagucacugccucacug

SEQ ID NO: 33465 - RNA, 32 nt, Human
acaucuaagagacauucauuuggauuccccuc

SEQ ID NO: 33466 - RNA, 32 nt, Human
acaucuacagagacaaaauuaggaaggaagga

SEQ ID NO: 33467 - RNA, 32 nt, Human
acaucuaccccuguucugaaucaggauguuga

SEQ ID NO: 33468 - RNA, 32 nt, Human
acaucuacccuuuuaauauagcacucaucuuu

SEQ ID NO: 33469 - RNA, 32 nt, Human
acaucuaccgccaacccagcugcuucuggcag

SEQ ID NO: 33470 - RNA, 32 nt, Human
acaucuauacccugaaacuaggcaggcacaaa

SEQ ID NO: 33471 - RNA, 32 nt, Human
acaucuauacuuccuuguguucaucaacaaug

SEQ ID NO: 33472 - RNA, 32 nt, Human
acaucuauccuacuuaugcagaaaaauaggca

SEQ ID NO: 33473 - RNA, 32 nt, Human
acaucuauugcuuuuucccuucaucugucaca

SEQ ID NO: 33474 - RNA, 32 nt, Human
acaucucaagaaccagccuuucaaacaguuuc

SEQ ID NO: 33475 - RNA, 31 nt, Human
acaucucaaggaauucagcuguugaaaucau

SEQ ID NO: 33476 - RNA, 32 nt, Human
acaucucaagggcuugcagccccacugcuccu

SEQ ID NO: 33477 - RNA, 32 nt, Human
acaucucacuucugcuuccucaucucagccca

SEQ ID NO: 33478 - RNA, 32 nt, Human
acaucucagccaggaaccugggacuuuaggug

SEQ ID NO: 33479 - RNA, 32 nt, Human
acaucucaggugccaggggcugugggagcuug

SEQ ID NO: 33480 - RNA, 32 nt, Human
acaucucagugaauuugcaaguggaucauccu

SEQ ID NO: 33481 - RNA, 32 nt, Human
acaucucaguggcuggaggccaugccuuuuaa

SEQ ID NO: 33482 - RNA, 32 nt, Human
acaucucaucuucuguccucagauggauuuac

SEQ ID NO: 33483 - RNA, 32 nt, Human
acaucucaucuuuugacccaaucuuauucauu

SEQ ID NO: 33484 - RNA, 32 nt, Human
acaucucauugccucuuccugcccugggcugu

SEQ ID NO: 33485 - RNA, 32 nt, Human
acaucuccacccgauccuggagagcugugagg

SEQ ID NO: 33486 - RNA, 32 nt, Human
acaucuccagacuacaaaaauuggaaagcugg

SEQ ID NO: 33487 - RNA, 32 nt, Human
acaucucccauggaauugugagauaugaaaaa

SEQ ID NO: 33488 - RNA, 32 nt, Human
acaucuccccucagccucuccucacuauggcc

SEQ ID NO: 33489 - RNA, 32 nt, Human
acaucucccgaaccucuccagcuagauguccc

SEQ ID NO: 33490 - RNA, 32 nt, Human
acaucucccugcuguguccccugggcauuucu

SEQ ID NO: 33491 - RNA, 32 nt, Human
acaucuccuagagcugggaaugugucccuaac

SEQ ID NO: 33492 - RNA, 32 nt, Human
acaucuccuccccugaaaugcuuuucaguuug

SEQ ID NO: 33493 - RNA, 32 nt, Human
acaucuccugcacuucucaaguugcugccggu

SEQ ID NO: 33494 - RNA, 32 nt, Human
acaucuccugcaggacaggcccuagcuacuga

SEQ ID NO: 33495 - RNA, 32 nt, Human
acaucuccugccuuucugcucacuuuccugcc

SEQ ID NO: 33496 - RNA, 32 nt, Human
acaucucgggguuucagggugggcaggggguu

SEQ ID NO: 33497 - RNA, 32 nt, Human
acaucucguuugcuaguaucuaacagucuuag

SEQ ID NO: 33498 - RNA, 32 nt, Human
acaucucuaaagauuuauuucuuguuuuugag

SEQ ID NO: 33499 - RNA, 32 nt, Human
acaucucucauccccucuuccuuuauuccccc

SEQ ID NO: 33500 - RNA, 32 nt, Human
acaucucucucacccuucuacuuccuaugauu

SEQ ID NO: 33501 - RNA, 32 nt, Human
acaucucucugcccucucccuguguucugggc

SEQ ID NO: 33502 - RNA, 32 nt, Human
acaucucugaagaaguugaggggugggggaga

SEQ ID NO: 33503 - RNA, 32 nt, Human
acaucucugccuuugccuguguguguucuggg

SEQ ID NO: 33504 - RNA, 32 nt, Human
acaucucugcuggaauauuuggaaaagaacac

SEQ ID NO: 33505 - RNA, 32 nt, Human
acaucucuguaacccagcuggccccuggugcu

SEQ ID NO: 33506 - RNA, 32 nt, Human
acaucucuuugcagguagcagcaacaguugua

SEQ ID NO: 33507 - RNA, 32 nt, Human
acaucugaaaccaccaguaccaccaccacuac

SEQ ID NO: 33508 - RNA, 32 nt, Human
acaucugaaauccaaucauucaacuuggguuc

SEQ ID NO: 33509 - RNA, 31 nt, Human
acaucugaauuuauauaccuguugaguuuug

SEQ ID NO: 33510 - RNA, 32 nt, Human
acaucugacuccuggguucaagcaguucuucc

SEQ ID NO: 33511 - RNA, 32 nt, Human
acaucugcagacaagggccaggaagcaaggcu

SEQ ID NO: 33512 - RNA, 32 nt, Human
acaucugcaggcuuuuucuuaguguuccuauu

SEQ ID NO: 33513 - RNA, 32 nt, Human
acaucugcagugcuuccccaggguugacaagg

SEQ ID NO: 33514 - RNA, 32 nt, Human
acaucugccaucauuucucuccucuagagucc

SEQ ID NO: 33515 - RNA, 32 nt, Human
acaucugccauuguucugaagggagacgcuac

SEQ ID NO: 33516 - RNA, 32 nt, Human
acaucugcccuggccucuccugcuccagggca

SEQ ID NO: 33517 - RNA, 32 nt, Human
acaucugccugagagaucuccaagaauuacag

SEQ ID NO: 33518 - RNA, 32 nt, Human
acaucugcuccucacaugaaugcacucaccuc

SEQ ID NO: 33519 - RNA, 32 nt, Human
acaucugcuuccuguaggcccucugggcagaa

SEQ ID NO: 33520 - RNA, 32 nt, Human
acaucugcuucuaacauaucgcauguuuaugu

SEQ ID NO: 33521 - RNA, 32 nt, Human
acaucuggcccugaccccacuggaccaaaagg

SEQ ID NO: 33522 - RNA, 32 nt, Human
acaucuggcuccugcccucauugccuccaauc

SEQ ID NO: 33523 - RNA, 15 nt, Human
acaucuggcugcaca

SEQ ID NO: 33524 - RNA, 32 nt, Human
acaucuggcugcaggaauuucaauauguagaa

SEQ ID NO: 33525 - RNA, 32 nt, Human
acaucuggcuucccuucucagccucaugucca

SEQ ID NO: 33526 - RNA, 20 nt, Human
acaucuggggcugugugcau

SEQ ID NO: 33527 - RNA, 32 nt, Human
acaucuguauuaaacauaggagagaaguuuau

SEQ ID NO: 33528 - RNA, 32 nt, Human
acaucugucacugaaggagguggagcucccac

SEQ ID NO: 33529 - RNA, 32 nt, Human
acaucugucagggugugagcacuccaaggccu

SEQ ID NO: 33530 - RNA, 32 nt, Human
acaucuguccccucauuuuugagaucccccaa

SEQ ID NO: 33531 - RNA, 32 nt, Human
acaucugucuccaagccaaggugaccauucca

SEQ ID NO: 33532 - RNA, 32 nt, Human
acaucugucuccauuccugccaucucuuccug

SEQ ID NO: 33533 - RNA, 32 nt, Human
acaucugucuuggucacagagcugggugcugc

SEQ ID NO: 33534 - RNA, 32 nt, Human
acaucugugcaugccuguuugugcacauauau

SEQ ID NO: 33535 - RNA, 32 nt, Human
acaucuguggauucaaccaacugcagaucaaa

SEQ ID NO: 33536 - RNA, 32 nt, Human
acaucugugggugggccguggguagagggacc

SEQ ID NO: 33537 - RNA, 32 nt, Human
acaucuguggugagugaaaugcacgccauaca

SEQ ID NO: 33538 - RNA, 32 nt, Human
acaucuguguucuuccugucagcuccacgccc

SEQ ID NO: 33539 - RNA, 32 nt, Human
acaucuguguuuuagcaggugggauuugaagc

SEQ ID NO: 33540 - RNA, 32 nt, Human
acaucuguguuuuuauaucuguucccuacccc

SEQ ID NO: 33541 - RNA, 32 nt, Human
acaucuguguuuuuauaucuguucccuacccu

SEQ ID NO: 33542 - RNA, 32 nt, Human
acaucuguucauauauccuccuuaaccacaga

SEQ ID NO: 33543 - RNA, 32 nt, Human
acaucuguuuaugaaggccauauucaguacau

SEQ ID NO: 33544 - RNA, 32 nt, Human
acaucuuagaggcaugaagcccuugcucagau

SEQ ID NO: 33545 - RNA, 32 nt, Human
acaucuuagcacuuccgcucucaggccuccuc

SEQ ID NO: 33546 - RNA, 32 nt, Human
acaucuuaguucugaccuuguggaggccgcgu

SEQ ID NO: 33547 - RNA, 32 nt, Human
acaucuuauuuggugucucaaagcuguauuuc

SEQ ID NO: 33548 - RNA, 32 nt, Human
acaucuucacagauaucagagaaaagugaaaa

SEQ ID NO: 33549 - RNA, 32 nt, Human
acaucuucauucucuaaccacucuauugauuc

SEQ ID NO: 33550 - RNA, 32 nt, Human
acaucuuccuccucgcaggagggaccaggcgg

SEQ ID NO: 33551 - RNA, 32 nt, Human
acaucuucuccagcgcagacuuuugcuggaug

SEQ ID NO: 33552 - RNA, 32 nt, Human
acaucuucucucuuccccaucuugcauuggag

SEQ ID NO: 33553 - RNA, 32 nt, Human
acaucuucugccccuucucagccucccucacc

SEQ ID NO: 33554 - RNA, 32 nt, Human
acaucuugaagaacaagaaaguuguucuugug

SEQ ID NO: 33555 - RNA, 32 nt, Human
acaucuugccaccacaaguccacaccuggccu

SEQ ID NO: 33556 - RNA, 32 nt, Human
acaucuuggaagcaagaacaaucaggaccaaa

SEQ ID NO: 33557 - RNA, 32 nt, Human
acaucuuggagaaccuuucuuacucauuucag

SEQ ID NO: 33558 - RNA, 32 nt, Human
acaucuuggggaugggaugcaagucuaaccac

SEQ ID NO: 33559 - RNA, 32 nt, Human
acaucuugucucccucccagcaugggacucua

SEQ ID NO: 33560 - RNA, 32 nt, Human
acaucuuuagcugaucagaucucuccauaucc

SEQ ID NO: 33561 - RNA, 32 nt, Human
acaucuuucaguuucaugauuaaggauuguug

SEQ ID NO: 33562 - RNA, 32 nt, Human
acaucuuucucuguccccuccuugcccugucu

SEQ ID NO: 33563 - RNA, 32 nt, Human
acaucuuucugacagaagcaccucaucugugg

SEQ ID NO: 33564 - RNA, 21 nt, Human
acaucuuuggagaggauuuga

SEQ ID NO: 33565 - RNA, 32 nt, Human
acaucuuuggcaaccaggcugucagacugacc

SEQ ID NO: 33566 - RNA, 32 nt, Human
acaucuuuuccaaggcaaacccuguucaggcu

SEQ ID NO: 33567 - RNA, 16 nt, Human
acaugaaaaaucuuca

SEQ ID NO: 33568 - RNA, 32 nt, Human
acaugaaaacuucaacacagaggggaaucuug

SEQ ID NO: 33569 - RNA, 32 nt, Human
acaugaaaauacuagcuuauuuucugaaaugu

SEQ ID NO: 33570 - RNA, 32 nt, Human
acaugaaaaugagaagccugaugggaaccgcg

SEQ ID NO: 33571 - RNA, 17 nt, Human
acaugaaagaauccaca

SEQ ID NO: 33572 - RNA, 18 nt, Human
acaugaaagccuugcaca

SEQ ID NO: 33573 - RNA, 18 nt, Human
acaugaaagguccccaca

SEQ ID NO: 33574 - RNA, 32 nt, Human
acaugaaagguguguggaaaguggccagcauu

SEQ ID NO: 33575 - RNA, 18 nt, Human
acaugaaaguacuucuca

SEQ ID NO: 33576 - RNA, 32 nt, Human
acaugaaaguuauugcuaaaguagcugcucau

SEQ ID NO: 33577 - RNA, 32 nt, Human
acaugaacacagccugucugugcucagacaua

SEQ ID NO: 33578 - RNA, 32 nt, Human
acaugaacacaguggcuaucauuucccccuug

SEQ ID NO: 33579 - RNA, 32 nt, Human
acaugaacagguugaagaacuggagcgaagug

SEQ ID NO: 33580 - RNA, 23 nt, Human
acaugaacauucauugcaugcuc

SEQ ID NO: 33581 - RNA, 32 nt, Human
acaugaaccagcccacgcacagcuucacccua

SEQ ID NO: 33582 - RNA, 32 nt, Human
acaugaaccagcuguugcagucugcccacaaa

SEQ ID NO: 33583 - RNA, 32 nt, Human
acaugaacccaggaggcggagcuugcagugag

SEQ ID NO: 33584 - RNA, 32 nt, Human
acaugaacccaggagguugaagcugcgguggg

SEQ ID NO: 33585 - RNA, 32 nt, Human
acaugaaccucaccgucccucucucagcugua

SEQ ID NO: 33586 - RNA, 32 nt, Human
acaugaagaggcaccucuggggagcaaagagg

SEQ ID NO: 33587 - RNA, 32 nt, Human
acaugaagaucuggcacuggcuuuuugucacu

SEQ ID NO: 33588 - RNA, 32 nt, Human
acaugaagccaggugaagaggggccugauggg

SEQ ID NO: 33589 - RNA, 32 nt, Human
acaugaagccagugcacgccagccugggcgac

SEQ ID NO: 33590 - RNA, 32 nt, Human
acaugaagcccccuccuguagggacagcucag

SEQ ID NO: 33591 - RNA, 32 nt, Human
acaugaagccuccuuuucuugagcugguggag

SEQ ID NO: 33592 - RNA, 32 nt, Human
acaugaagcgugcuuuggacaaacuggauggc

SEQ ID NO: 33593 - RNA, 19 nt, Human
acaugaaggcccucucaca

SEQ ID NO: 33594 - RNA, 32 nt, Human
acaugaaggugggcuggccaggugagagcugc

SEQ ID NO: 33595 - RNA, 32 nt, Human
acaugaaguacaaauggaucacagaccugaau

SEQ ID NO: 33596 - RNA, 32 nt, Human
acaugaaguccagccgcuuccucccaaaaccu

SEQ ID NO: 33597 - RNA, 32 nt, Human
acaugaaguucugcccaucuuccugaccucca

SEQ ID NO: 33598 - RNA, 32 nt, Human
acaugaaguuugaacacuaaacaguaauguau

SEQ ID NO: 33599 - RNA, 32 nt, Human
acaugaauagaauucauuugcugagaggcaug

SEQ ID NO: 33600 - RNA, 32 nt, Human
acaugaauaggaaucuuccuggcacuuagugu

SEQ ID NO: 33601 - RNA, 32 nt, Human
acaugaaucucuugcgguuaggcuaagucccu

SEQ ID NO: 33602 - RNA, 32 nt, Human
acaugaaugaaaccccuccugccuugcagggu

SEQ ID NO: 33603 - RNA, 32 nt, Human
acaugaaugaacacuuuggauuuuguuguagu

SEQ ID NO: 33604 - RNA, 32 nt, Human
acaugaaugcauauauaaaaagugcugguuuc

SEQ ID NO: 33605 - RNA, 32 nt, Human
acaugaaugcauauauaaaaauugcugguuuc

SEQ ID NO: 33606 - RNA, 32 nt, Human
acaugaauucuaaguuuuggguaauguuaacu

SEQ ID NO: 33607 - RNA, 32 nt, Human
acaugacaaagaaagacuggaaaagugguuaa

SEQ ID NO: 33608 - RNA, 32 nt, Human
acaugacacagauguucucuaagauuacugga

SEQ ID NO: 33609 - RNA, 32 nt, Human
acaugacaggggagaucccacagcugcagcac

SEQ ID NO: 33610 - RNA, 32 nt, Human
acaugacaguaucuugaguuaugugaguuuuu

SEQ ID NO: 33611 - RNA, 32 nt, Human
acaugacaguguccaggucuuucagagagaac

SEQ ID NO: 33612 - RNA, 32 nt, Human
acaugacaucuuaaguagaaauaaguagggac

SEQ ID NO: 33613 - RNA, 32 nt, Human
acaugacauucuuuuucucuccuuccugaaaa

SEQ ID NO: 33614 - RNA, 32 nt, Human
acaugaccaaaaaccaaaagugcauucaaccu

SEQ ID NO: 33615 - RNA, 32 nt, Human
acaugacccacuuucuccccugggggacguug

SEQ ID NO: 33616 - RNA, 32 nt, Human
acaugacccugaguccccuggauuuugcauuc

SEQ ID NO: 33617 - RNA, 32 nt, Human
acaugacuagcacgcugagcucugcagggacc

SEQ ID NO: 33618 - RNA, 27 nt, Human
acaugacucauggagaagagcuuggcu

SEQ ID NO: 33619 - RNA, 32 nt, Human
acaugacuccagagagccacagugccaaacuc

SEQ ID NO: 33620 - RNA, 32 nt, Human
acaugacucccagugaggagaauucaggugau

SEQ ID NO: 33621 - RNA, 32 nt, Human
acaugacuguaaucccagcuacucaggaggcu

SEQ ID NO: 33622 - RNA, 32 nt, Human
acaugacuuggcuuucucauccagaaauuaug

SEQ ID NO: 33623 - RNA, 32 nt, Human
acaugagaaaggcauuccuggagugugaagcc

SEQ ID NO: 33624 - RNA, 32 nt, Human
acaugagaaagggagaggaagagaagcccagc

SEQ ID NO: 33625 - RNA, 32 nt, Human
acaugagaacauauuuccaagacagaggauuc

SEQ ID NO: 33626 - RNA, 32 nt, Human
acaugagaagugacgauggucaugacagaccc

SEQ ID NO: 33627 - RNA, 32 nt, Human
acaugagacaucaaucaaauauauagagaugu

SEQ ID NO: 33628 - RNA, 32 nt, Human
acaugagagagggagaaggaccgcguuuaccu

SEQ ID NO: 33629 - RNA, 32 nt, Human
acaugagauucugcucaucauugcucagcucc

SEQ ID NO: 33630 - RNA, 32 nt, Human
acaugagcagaaaauauuuucccacuggugug

SEQ ID NO: 33631 - RNA, 17 nt, Human
acaugagcagggugaga

SEQ ID NO: 33632 - RNA, 32 nt, Human
acaugagcccaggagguugaggcugcagugag

SEQ ID NO: 33633 - RNA, 32 nt, Human
acaugagcccaggaguucaaguucagccagag

SEQ ID NO: 33634 - RNA, 32 nt, Human
acaugagcccuuuuuaaaugugauuucccguc

SEQ ID NO: 33635 - RNA, 32 nt, Human
acaugagcucuuccugccacauugagaugauc

SEQ ID NO: 33636 - RNA, 32 nt, Human
acaugaggaauuuacucuggaagaggaaaauc

SEQ ID NO: 33637 - RNA, 32 nt, Human
acaugaggaccuggaggguucaucccgagggc

SEQ ID NO: 33638 - RNA, 32 nt, Human
acaugaggacucuauucuuuaacucccauuac

SEQ ID NO: 33639 - RNA, 32 nt, Human
acaugaggauauuucucaguaccacuuuguua

SEQ ID NO: 33640 - RNA, 32 nt, Human
acaugaggccaucucaggagauggagggcuug

SEQ ID NO: 33641 - RNA, 32 nt, Human
acaugagggcuguagggaaccccuggaggaca

SEQ ID NO: 33642 - RNA, 32 nt, Human
acaugaggggcagaaaugggaucacagagucu

SEQ ID NO: 33643 - RNA, 32 nt, Human
acaugagggugcucuugugacuuaauuuuugu

SEQ ID NO: 33644 - RNA, 32 nt, Human
acaugaggguguaagccuucagccuggcaagu

SEQ ID NO: 33645 - RNA, 32 nt, Human
acaugaggguuccaagugugcugaagaggaca

SEQ ID NO: 33646 - RNA, 32 nt, Human
acaugagguggugguggcgcagcagacugcga

SEQ ID NO: 33647 - RNA, 21 nt, Human
acaugauaaaagacacuccca

SEQ ID NO: 33648 - RNA, 20 nt, Human
acaugauaaacacauguccu

SEQ ID NO: 33649 - RNA, 17 nt, Human
acaugauaccacacuca

SEQ ID NO: 33650 - RNA, 32 nt, Human
acaugauagauaguuggucgauuacauugcua

SEQ ID NO: 33651 - RNA, 32 nt, Human
acaugaucacugcaggaugauccuccucccau

SEQ ID NO: 33652 - RNA, 32 nt, Human
acaugaucauagcucacuccagccugaagcaa

SEQ ID NO: 33653 - RNA, 32 nt, Human
acaugaucauagcucacugcagccuggaacuc

SEQ ID NO: 33654 - RNA, 32 nt, Human
acaugaucccauggcccugaauuuguauaccu

SEQ ID NO: 33655 - RNA, 32 nt, Human
acaugaucccuuaauucaggcucaggcugaag

SEQ ID NO: 33656 - RNA, 32 nt, Human
acaugauccgagacauccaggagacagagccc

SEQ ID NO: 33657 - RNA, 32 nt, Human
acaugauccucuccuuagucuuagcucauggg

SEQ ID NO: 33658 - RNA, 32 nt, Human
acaugaucucuagacugggacggugggguucc

SEQ ID NO: 33659 - RNA, 32 nt, Human
acaugaugcagagcaagccucugugauuccug

SEQ ID NO: 33660 - RNA, 32 nt, Human
acaugaugcaggcgaagcuugggaucuggcca

SEQ ID NO: 33661 - RNA, 27 nt, Human
acaugaugcagggggaggcacacccua

SEQ ID NO: 33662 - RNA, 32 nt, Human
acaugaugcaugcacagguuguacccacagac

SEQ ID NO: 33663 - RNA, 32 nt, Human
acaugaugucuuuuaugcuccuaaaacaucuu

SEQ ID NO: 33664 - RNA, 21 nt, Human
acaugaugugauuaucuucca

SEQ ID NO: 33665 - RNA, 32 nt, Human
acaugauucaugaugauuaaaauaucauacaa

SEQ ID NO: 33666 - RNA, 32 nt, Human
acaugauugcuuugugaaaugugcaaaugaua

SEQ ID NO: 33667 - RNA, 17 nt, Human
acaugauuuaucuucca

SEQ ID NO: 33668 - RNA, 32 nt, Human
acaugcaagccugaaaccuuugcauaugaguu

SEQ ID NO: 33669 - RNA, 32 nt, Human
acaugcaauauacuuauucacugucuaagucu

SEQ ID NO: 33670 - RNA, 21 nt, Human
acaugcacacacacauaugca

SEQ ID NO: 33671 - RNA, 32 nt, Human
acaugcacacacacaugcacacauauaugcac

SEQ ID NO: 33672 - RNA, 32 nt, Human
acaugcacacacccuccuuccccuagcaaaac

SEQ ID NO: 33673 - RNA, 32 nt, Human
acaugcacacacgcaugcacacacacaaagcc

SEQ ID NO: 33674 - RNA, 32 nt, Human
acaugcacacacuccucacacugcucaggcuc

SEQ ID NO: 33675 - RNA, 32 nt, Human
acaugcacaccaacaugcaugccgccggcaca

SEQ ID NO: 33676 - RNA, 32 nt, Human
acaugcacacucacgcucacacaugcugucac

SEQ ID NO: 33677 - RNA, 32 nt, Human
acaugcacacuguccccuauaggaccaugccu

SEQ ID NO: 33678 - RNA, 21 nt, Human
acaugcacauauguauacaca

SEQ ID NO: 33679 - RNA, 32 nt, Human
acaugcacauuccugucuucugccugcucccu

SEQ ID NO: 33680 - RNA, 19 nt, Human
acaugcaccccuggccuca

SEQ ID NO: 33681 - RNA, 32 nt, Human
acaugcaccuacacaaacauuuacauacaguu

SEQ ID NO: 33682 - RNA, 32 nt, Human
acaugcagacacaccugggcgucccgagguca

SEQ ID NO: 33683 - RNA, 32 nt, Human
acaugcagauccauaguauccuuuguaguguu

SEQ ID NO: 33684 - RNA, 32 nt, Human
acaugcagcuacucgggaggcugaggcaggag

SEQ ID NO: 33685 - RNA, 32 nt, Human
acaugcaggcagcuauuuggggaucuuuucac

SEQ ID NO: 33686 - RNA, 32 nt, Human
acaugcaggcccugcccccucgcuacagccag

SEQ ID NO: 33687 - RNA, 32 nt, Human
acaugcaggccggagcccucagcccggcagcu

SEQ ID NO: 33688 - RNA, 32 nt, Human
acaugcaguagcuucucugcuugagugagcug

SEQ ID NO: 33689 - RNA, 32 nt, Human
acaugcagugugcagccagucuggcucaggaa

SEQ ID NO: 33690 - RNA, 32 nt, Human
acaugcaguguggccaugaggucugccggaag

SEQ ID NO: 33691 - RNA, 32 nt, Human
acaugcauacacgaagaaaugcuaacggaagg

SEQ ID NO: 33692 - RNA, 19 nt, Human
acaugcaucaaacccuuga

SEQ ID NO: 33693 - RNA, 32 nt, Human
acaugcaucccccaccagaguaccauacagag

SEQ ID NO: 33694 - RNA, 32 nt, Human
acaugcaucuggguuuauaucugugugaccuu

SEQ ID NO: 33695 - RNA, 32 nt, Human
acaugcaugcaaauguccacugcagcacuauu

SEQ ID NO: 33696 - RNA, 31 nt, Human
acaugcaugcacacaaacaucacugcagccc

SEQ ID NO: 33697 - RNA, 32 nt, Human
acaugcaugcacacaaacguguacacaagugu

SEQ ID NO: 33698 - RNA, 32 nt, Human
acaugcauggauuuuuaaauugccugccaugc

SEQ ID NO: 33699 - RNA, 32 nt, Human
acaugcauuacacacaugcacacacauaugca

SEQ ID NO: 33700 - RNA, 32 nt, Human
acaugccaaacaucauacuucggaagcaauug

SEQ ID NO: 33701 - RNA, 24 nt, Human
acaugccaauuuuuauugcuuaaa

SEQ ID NO: 33702 - RNA, 32 nt, Human
acaugccacauggcuucucucucugcauggga

SEQ ID NO: 33703 - RNA, 32 nt, Human
acaugccacggcgguccuccaggcagggaaca

SEQ ID NO: 33704 - RNA, 32 nt, Human
acaugccacuggaagggaaguggguguccaug

SEQ ID NO: 33705 - RNA, 32 nt, Human
acaugccaguaaccccagcuacuagggaggcu

SEQ ID NO: 33706 - RNA, 32 nt, Human
acaugccagugggugugacuccuucauuuuuc

SEQ ID NO: 33707 - RNA, 27 nt, Human
acaugccaucaucucacauuguguuga

SEQ ID NO: 33708 - RNA, 32 nt, Human
acaugccaucugggacaggccaugugggagac

SEQ ID NO: 33709 - RNA, 32 nt, Human
acaugcccaaguaccccugcaggaugaagggc

SEQ ID NO: 33710 - RNA, 32 nt, Human
acaugcccacugcagcccuccagccucugguc

SEQ ID NO: 33711 - RNA, 32 nt, Human
acaugcccagcccagccacaggcugagcuggu

SEQ ID NO: 33712 - RNA, 32 nt, Human
acaugcccaguucaugucaucucucuuaagaa

SEQ ID NO: 33713 - RNA, 32 nt, Human
acaugcccaugccaccuaugccacagugccua

SEQ ID NO: 33714 - RNA, 32 nt, Human
acaugcccauucacuacagccuggaugacaag

SEQ ID NO: 33715 - RNA, 32 nt, Human
acaugcccauuucuccaguuuucuuaaucuga

SEQ ID NO: 33716 - RNA, 32 nt, Human
acaugccccaacaagaggaagacugucuggcu

SEQ ID NO: 33717 - RNA, 32 nt, Human
acaugccccucggccccagcacauggaaaacc

SEQ ID NO: 33718 - RNA, 32 nt, Human
acaugcccguaaucccagcuagucaggaggcu

SEQ ID NO: 33719 - RNA, 32 nt, Human
acaugccuauaaucccagcacuuugggaggcc

SEQ ID NO: 33720 - RNA, 32 nt, Human
acaugccuauaaucccagcuacucaggaggcu

SEQ ID NO: 33721 - RNA, 32 nt, Human
acaugccuauaaucccagcuacucgggaggcu

SEQ ID NO: 33722 - RNA, 32 nt, Human
acaugccuauaaucccagcuacuugggaggcu

SEQ ID NO: 33723 - RNA, 32 nt, Human
acaugccuauagucccagcuacucaggaggcu

SEQ ID NO: 33724 - RNA, 32 nt, Human
acaugccuauagucccagcugcuggggaggcu

SEQ ID NO: 33725 - RNA, 32 nt, Human
acaugccuaugauccagcuuuggucauaccca

SEQ ID NO: 33726 - RNA, 32 nt, Human
acaugccuaugaucccagcuacuggggaggcu

SEQ ID NO: 33727 - RNA, 16 nt, Human
acaugccucagugccu

SEQ ID NO: 33728 - RNA, 32 nt, Human
acaugccuccccagcccccgcucugacgauga

SEQ ID NO: 33729 - RNA, 24 nt, Human
acaugccucugccuuuuccuucaa

SEQ ID NO: 33730 - RNA, 32 nt, Human
acaugccugcaaucccagcuacuugagaggcu

SEQ ID NO: 33731 - RNA, 32 nt, Human
acaugccugcucccccuccaccuuccaccaug

SEQ ID NO: 33732 - RNA, 32 nt, Human
acaugccugcucccccuuugccuucugccaug

SEQ ID NO: 33733 - RNA, 32 nt, Human
acaugccuggagucccagcuacucgggaggcu

SEQ ID NO: 33734 - RNA, 32 nt, Human
acaugccugggcaacauaaugagacaggucuc

SEQ ID NO: 33735 - RNA, 32 nt, Human
acaugccuguaaacccagcuauucaggaggcu

SEQ ID NO: 33736 - RNA, 32 nt, Human
acaugccuguaacccagcuacucgggaggcug

SEQ ID NO: 33737 - RNA, 32 nt, Human
acaugccuguaacuccagcuacuugggaggcu

SEQ ID NO: 33738 - RNA, 32 nt, Human
acaugccuguaauaucagcuacucaggaggcu

SEQ ID NO: 33739 - RNA, 32 nt, Human
acaugccuguaaucccaacuacuugggaggcu

SEQ ID NO: 33740 - RNA, 32 nt, Human
acaugccuguaaucccagauacuugggaggcu

SEQ ID NO: 33741 - RNA, 32 nt, Human
acaugccuguaaucccagcacuuugggaagcu

SEQ ID NO: 33742 - RNA, 32 nt, Human
acaugccuguaaucccagcacuuugggaggcc

SEQ ID NO: 33743 - RNA, 32 nt, Human
acaugccuguaaucccagcacuuugggggucg

SEQ ID NO: 33744 - RNA, 32 nt, Human
acaugccuguaaucccagcuacacuggaggcu

SEQ ID NO: 33745 - RNA, 32 nt, Human
acaugccuguaaucccagcuacaugggaggcu

SEQ ID NO: 33746 - RNA, 32 nt, Human
acaugccuguaaucccagcuacccggggaggc

SEQ ID NO: 33747 - RNA, 32 nt, Human
acaugccuguaaucccagcuacgucaggaggc

SEQ ID NO: 33748 - RNA, 25 nt, Human
acaugccuguaaucccagcuacuca

SEQ ID NO: 33749 - RNA, 32 nt, Human
acaugccuguaaucccagcuacucaggaggcu

SEQ ID NO: 33750 - RNA, 32 nt, Human
acaugccuguaaucccagcuacucagggggcu

SEQ ID NO: 33751 - RNA, 32 nt, Human
acaugccuguaaucccagcuacucaugaggcu

SEQ ID NO: 33752 - RNA, 32 nt, Human
acaugccuguaaucccagcuacuccggaagcu

SEQ ID NO: 33753 - RNA, 32 nt, Human
acaugccuguaaucccagcuacucggaggcag

SEQ ID NO: 33754 - RNA, 32 nt, Human
acaugccuguaaucccagcuacucgggaggcu

SEQ ID NO: 33755 - RNA, 32 nt, Human
acaugccuguaaucccagcuacuuggcaggcu

SEQ ID NO: 33756 - RNA, 32 nt, Human
acaugccuguaaucccagcuacuugggaggcu

SEQ ID NO: 33757 - RNA, 32 nt, Human
acaugccuguaaucccagcugcucaggaggcu

SEQ ID NO: 33758 - RNA, 32 nt, Human
acaugccuguaaucccagcugcuggagaggcu

SEQ ID NO: 33759 - RNA, 32 nt, Human
acaugccuguaaucccaguuagucgggaggcu

SEQ ID NO: 33760 - RNA, 32 nt, Human
acaugccuguaaucccgguauuugggaggcug

SEQ ID NO: 33761 - RNA, 32 nt, Human
acaugccuguaauccgagugcuuugggaggcu

SEQ ID NO: 33762 - RNA, 32 nt, Human
acaugccuguaauccuagcacuuugggaggcc

SEQ ID NO: 33763 - RNA, 32 nt, Human
acaugccuguaauccuagcuacucgggaggcu

SEQ ID NO: 33764 - RNA, 32 nt, Human
acaugccuguaauccuggcuacuugggaggcu

SEQ ID NO: 33765 - RNA, 32 nt, Human
acaugccuguaaucgcagcuacucaggaggcu

SEQ ID NO: 33766 - RNA, 32 nt, Human
acaugccuguaaucucaacugcuugggaggcu

SEQ ID NO: 33767 - RNA, 32 nt, Human
acaugccuguaaucucagcgacuugggaggcu

SEQ ID NO: 33768 - RNA, 32 nt, Human
acaugccuguaaucucagcuacuagagaggcu

SEQ ID NO: 33769 - RNA, 32 nt, Human
acaugccuguaaucucagcuacucaggaggcu

SEQ ID NO: 33770 - RNA, 32 nt, Human
acaugccuguaaucucagcuacuugggaggcu

SEQ ID NO: 33771 - RNA, 32 nt, Human
acaugccuguaaugccagcuacucgggaggcu

SEQ ID NO: 33772 - RNA, 20 nt, Human
acaugccuguaauuccagcu

SEQ ID NO: 33773 - RNA, 32 nt, Human
acaugccuguaauuccagcuacuugggaggcu

SEQ ID NO: 33774 - RNA, 32 nt, Human
acaugccuguaauuccagcugcuugggagccu

SEQ ID NO: 33775 - RNA, 32 nt, Human
acaugccuguagcccuagcuacucuggaggcu

SEQ ID NO: 33776 - RNA, 32 nt, Human
acaugccuguagucccaccuacucgagaagcu

SEQ ID NO: 33777 - RNA, 20 nt, Human
acaugccuguagucccagcu

SEQ ID NO: 33778 - RNA, 32 nt, Human
acaugccuguagucccagcuacgugggaggcu

SEQ ID NO: 33779 - RNA, 32 nt, Human
acaugccuguagucccagcuacucaagaggcu

SEQ ID NO: 33780 - RNA, 32 nt, Human
acaugccuguagucccagcuacucaggaggcu

SEQ ID NO: 33781 - RNA, 32 nt, Human
acaugccuguagucccagcuacuccagaggcu

SEQ ID NO: 33782 - RNA, 32 nt, Human
acaugccuguagucccagcuacucgggaggcu

SEQ ID NO: 33783 - RNA, 32 nt, Human
acaugccuguagucccagcuacuggggaggcu

SEQ ID NO: 33784 - RNA, 32 nt, Human
acaugccuguagucccagcuacuugagaggcu

SEQ ID NO: 33785 - RNA, 32 nt, Human
acaugccuguagucccagcuacuugggaagcu

SEQ ID NO: 33786 - RNA, 32 nt, Human
acaugccuguagucccagcuauucaggaggcu

SEQ ID NO: 33787 - RNA, 32 nt, Human
acaugccuguagucccagcuucucaggaggcu

SEQ ID NO: 33788 - RNA, 20 nt, Human
acaugccuguaguuccagcu

SEQ ID NO: 33789 - RNA, 32 nt, Human
acaugccuguaguuccagcuacucaggaggcu

SEQ ID NO: 33790 - RNA, 32 nt, Human
acaugccuguauucccagcugcuugggaggcu

SEQ ID NO: 33791 - RNA, 32 nt, Human
acaugccugugaucccagcacuuugggaugcu

SEQ ID NO: 33792 - RNA, 32 nt, Human
acaugccugugaucccagcuacucaggaagcu

SEQ ID NO: 33793 - RNA, 32 nt, Human
acaugccugugaucccagcuacucaggaggcu

SEQ ID NO: 33794 - RNA, 32 nt, Human
acaugccugugaucccagcuacugaggaggcu

SEQ ID NO: 33795 - RNA, 32 nt, Human
acaugccuguggucccagcuacucagagggcu

SEQ ID NO: 33796 - RNA, 32 nt, Human
acaugccuguggucccagcuucuugggaggcu

SEQ ID NO: 33797 - RNA, 32 nt, Human
acaugccuguggucucagcuacucgggaggcu

SEQ ID NO: 33798 - RNA, 32 nt, Human
acaugccuguggucucagcuacuugggaggcu

SEQ ID NO: 33799 - RNA, 32 nt, Human
acaugccuguucugauucucauuugugucucu

SEQ ID NO: 33800 - RNA, 32 nt, Human
acaugccuguugucccagcugcuugggaggcu

SEQ ID NO: 33801 - RNA, 32 nt, Human
acaugccuugauaagugcauucagagcaauag

SEQ ID NO: 33802 - RNA, 27 nt, Human
acaugccuugcacuuguaccuggagga

SEQ ID NO: 33803 - RNA, 32 nt, Human
acaugccuuggggacauccugccuucaggacc

SEQ ID NO: 33804 - RNA, 32 nt, Human
acaugccuuuagucccagcuacucuggaggcu

SEQ ID NO: 33805 - RNA, 32 nt, Human
acaugcgauggcaacagaacccagggccugug

SEQ ID NO: 33806 - RNA, 32 nt, Human
acaugcgcacucucauaugccaccccaugugc

SEQ ID NO: 33807 - RNA, 32 nt, Human
acaugcgccuguaaucccagcuacucgggcag

SEQ ID NO: 33808 - RNA, 32 nt, Human
acaugcgcgugcgcacacacacaaacacacac

SEQ ID NO: 33809 - RNA, 32 nt, Human
acaugcgggcugggaaccgccucaccuccagg

SEQ ID NO: 33810 - RNA, 32 nt, Human
acaugcggucugcagugcacauuauaaggaau

SEQ ID NO: 33811 - RNA, 32 nt, Human
acaugcguacauauacauaacauacacacaau

SEQ ID NO: 33812 - RNA, 32 nt, Human
acaugcguccccuccucgcuugcucaguggaa

SEQ ID NO: 33813 - RNA, 32 nt, Human
acaugcgucgcagugagagcaccuacucugua

SEQ ID NO: 33814 - RNA, 32 nt, Human
acaugcucacacacucaugcuuucacauacau

SEQ ID NO: 33815 - RNA, 32 nt, Human
acaugcucacaucuuacucaacaucagagagu

SEQ ID NO: 33816 - RNA, 32 nt, Human
acaugcucagggaggcagaguucuuccauuag

SEQ ID NO: 33817 - RNA, 31 nt, Human
acaugcucauuaagugcuuguugaaaggaua

SEQ ID NO: 33818 - RNA, 32 nt, Human
acaugcuccuccuguccuucuggcggagcgug

SEQ ID NO: 33819 - RNA, 32 nt, Human
acaugcucuccgccuuccgggacuaccauggc

SEQ ID NO: 33820 - RNA, 32 nt, Human
acaugcucugcucucacguggcaccaguggau

SEQ ID NO: 33821 - RNA, 32 nt, Human
acaugcugaccagccucuaugugaugggagug

SEQ ID NO: 33822 - RNA, 32 nt, Human
acaugcugaccuuccugcagcaacugcgggug

SEQ ID NO: 33823 - RNA, 32 nt, Human
acaugcugagguacuacaugcgugacucacag

SEQ ID NO: 33824 - RNA, 27 nt, Human
acaugcugcagugucugugcuucccug

SEQ ID NO: 33825 - RNA, 32 nt, Human
acaugcugcaucuuucagccuggagacugugc

SEQ ID NO: 33826 - RNA, 32 nt, Human
acaugcugcuacugcuauuccauggauccuag

SEQ ID NO: 33827 - RNA, 32 nt, Human
acaugcuggagaagaaggaagggggaacccau

SEQ ID NO: 33828 - RNA, 32 nt, Human
acaugcuggccacugcugugaccacgacacug

SEQ ID NO: 33829 - RNA, 32 nt, Human
acaugcugggauuacaggcgugagccaacaca

SEQ ID NO: 33830 - RNA, 32 nt, Human
acaugcugguaauagcagcuacugagguggcu

SEQ ID NO: 33831 - RNA, 19 nt, Human
acaugcuguuaucuuuaca

SEQ ID NO: 33832 - RNA, 32 nt, Human
acaugcuuauaaucccagaaauuugggaggcc

SEQ ID NO: 33833 - RNA, 32 nt, Human
acaugcuucagaauccuauggaagagaauauu

SEQ ID NO: 33834 - RNA, 32 nt, Human
acaugcuucagaguguaccuuuugccauaacc

SEQ ID NO: 33835 - RNA, 32 nt, Human
acaugcuuguaaucccagcuacucgggagcug

SEQ ID NO: 33836 - RNA, 32 nt, Human
acaugcuuguaaucccagcuacucgggaggcu

SEQ ID NO: 33837 - RNA, 32 nt, Human
acaugcuugucagccccacgcugugcuccugc

SEQ ID NO: 33838 - RNA, 32 nt, Human
acaugcuuuaucaguagguccugagggcucca

SEQ ID NO: 33839 - RNA, 32 nt, Human
acaugcuuucacuauugugaugacauuaagaa

SEQ ID NO: 33840 - RNA, 23 nt, Human
acaugcuuucagucaaguacaga

SEQ ID NO: 33841 - RNA, 32 nt, Human
acaugcuuuuaagcuguguaacauaccugagg

SEQ ID NO: 33842 - RNA, 32 nt, Human
acauggaaaacccagagccacagagaaggucc

SEQ ID NO: 33843 - RNA, 32 nt, Human
acauggaaaugagagcccggcgcauggauuuu

SEQ ID NO: 33844 - RNA, 32 nt, Human
acauggaacagagcuugugggaugcuaauagu

SEQ ID NO: 33845 - RNA, 32 nt, Human
acauggaacaguguggcucuucugagcuuacg

SEQ ID NO: 33846 - RNA, 32 nt, Human
acauggaagaagauuuagagcucugcagcgau

SEQ ID NO: 33847 - RNA, 19 nt, Human
acauggaagccucagccug

SEQ ID NO: 33848 - RNA, 32 nt, Human
acauggaauagagcuucaagcaguucccaucc

SEQ ID NO: 33849 - RNA, 32 nt, Human
acauggacaagcuguuuucuuuucuagguuac

SEQ ID NO: 33850 - RNA, 32 nt, Human
acauggacacaccccaaacacgcacaggcucc

SEQ ID NO: 33851 - RNA, 19 nt, Human
acauggacaccauuucaug

SEQ ID NO: 33852 - RNA, 32 nt, Human
acauggacacuuccaggucccucacacuccgu

SEQ ID NO: 33853 - RNA, 31 nt, Human
acauggacauggugucccaugcccagaugau

SEQ ID NO: 33854 - RNA, 32 nt, Human
acauggaccacuggagccuggaauucugccac

SEQ ID NO: 33855 - RNA, 32 nt, Human
acauggacggucuuuuucuuuuauuauaaaag

SEQ ID NO: 33856 - RNA, 32 nt, Human
acauggacucaaagaagggaacaguagacacg

SEQ ID NO: 33857 - RNA, 32 nt, Human
acauggacuuguuuauagaggacaggucagcu

SEQ ID NO: 33858 - RNA, 32 nt, Human
acauggagacaggcccagagcacagagagagc

SEQ ID NO: 33859 - RNA, 27 nt, Human
acauggagacccucugugcaccccagg

SEQ ID NO: 33860 - RNA, 22 nt, Human
acauggagacugcacauggacu

SEQ ID NO: 33861 - RNA, 32 nt, Human
acauggagagaaucaugaaagcucaagcccua

SEQ ID NO: 33862 - RNA, 32 nt, Human
acauggagagagacucaaagagacuccaagau

SEQ ID NO: 33863 - RNA, 32 nt, Human
acauggagccauugaaaggaacaacacccuug

SEQ ID NO: 33864 - RNA, 32 nt, Human
acauggagcuaaauggcucaguggcuccagaa

SEQ ID NO: 33865 - RNA, 32 nt, Human
acauggagcugcaucuuuuuaaacguuguuuu

SEQ ID NO: 33866 - RNA, 32 nt, Human
acauggaggaacucaauaaaacuccugcuuca

SEQ ID NO: 33867 - RNA, 27 nt, Human
acauggagggagcugcuuugcugagag

SEQ ID NO: 33868 - RNA, 32 nt, Human
acauggagugaaagccauuugacucaacguuu

SEQ ID NO: 33869 - RNA, 32 nt, Human
acauggagugccugagcaugccaauaggcuuu

SEQ ID NO: 33870 - RNA, 32 nt, Human
acauggaucacacuaaauuucugucauuuaua

SEQ ID NO: 33871 - RNA, 19 nt, Human
acauggaugaaacuggaaa

SEQ ID NO: 33872 - RNA, 19 nt, Human
acauggaugaaauugaaaa

SEQ ID NO: 33873 - RNA, 19 nt, Human
acauggaugaagcuggaaa

SEQ ID NO: 33874 - RNA, 32 nt, Human
acauggaugcagagggacuccucccuaucuga

SEQ ID NO: 33875 - RNA, 27 nt, Human
acauggaugcaguggagccagggggac

SEQ ID NO: 33876 - RNA, 32 nt, Human
acauggauggaaacugaccaccuacuuugucc

SEQ ID NO: 33877 - RNA, 27 nt, Human
acauggcaaccagcgccguccccagug

SEQ ID NO: 33878 - RNA, 32 nt, Human
acauggcacauagaagacaggagcagcuccuc

SEQ ID NO: 33879 - RNA, 32 nt, Human
acauggcaccuacucagcaaugccuuccugga

SEQ ID NO: 33880 - RNA, 32 nt, Human
acauggcagagagaaagagagagaaagaguau

SEQ ID NO: 33881 - RNA, 32 nt, Human
acauggcagccuuauggugauccuggaacaca

SEQ ID NO: 33882 - RNA, 32 nt, Human
acauggcauuuggaaucaaguacauccagguu

SEQ ID NO: 33883 - RNA, 32 nt, Human
acauggccacauccaacauuuccucaggcaau

SEQ ID NO: 33884 - RNA, 27 nt, Human
acauggccaggggcugccucugcugcu

SEQ ID NO: 33885 - RNA, 32 nt, Human
acauggccuucgugaucuuucugcuguucuua

SEQ ID NO: 33886 - RNA, 32 nt, Human
acauggcggcaggcaagagagcaugugcaggg

SEQ ID NO: 33887 - RNA, 32 nt, Human
acauggcguaccguacacagagggacuugagc

SEQ ID NO: 33888 - RNA, 32 nt, Human
acauggcuauaaucccagguacuugggaagcu

SEQ ID NO: 33889 - RNA, 32 nt, Human
acauggcucacugcagccucaaccucccaggc

SEQ ID NO: 33890 - RNA, 32 nt, Human
acauggcucacugcagccucgaccuccugggc

SEQ ID NO: 33891 - RNA, 32 nt, Human
acauggcucugcccuccagaacuucaggcucu

SEQ ID NO: 33892 - RNA, 23 nt, Human
acauggcugauccuggugacuga

SEQ ID NO: 33893 - RNA, 32 nt, Human
acauggcugccagccccgccucccacccccac

SEQ ID NO: 33894 - RNA, 32 nt, Human
acauggcuggacuccagccaggaggacacacg

SEQ ID NO: 33895 - RNA, 32 nt, Human
acauggcugggucuucagaccccuggcucacc

SEQ ID NO: 33896 - RNA, 32 nt, Human
acauggcuuccccaauguggcagaucaagcug

SEQ ID NO: 33897 - RNA, 19 nt, Human
acaugggaaguauucuuga

SEQ ID NO: 33898 - RNA, 32 nt, Human
acaugggacaugccuuucuuuuccgaucaguu

SEQ ID NO: 33899 - RNA, 32 nt, Human
acaugggagcagaagagagagugagaaggggg

SEQ ID NO: 33900 - RNA, 32 nt, Human
acaugggagcuauagggaccucagggagcccc

SEQ ID NO: 33901 - RNA, 32 nt, Human
acaugggaggcggagguugcagugagccgaga

SEQ ID NO: 33902 - RNA, 32 nt, Human
acaugggaggcguagcuugcagugagcugaga

SEQ ID NO: 33903 - RNA, 32 nt, Human
acaugggaggcuaaggugggaggaucacuuga

SEQ ID NO: 33904 - RNA, 32 nt, Human
acaugggaggcugaggcacgagaaucacuuga

SEQ ID NO: 33905 - RNA, 32 nt, Human
acaugggaggcugaggcaggagaagggcguga

SEQ ID NO: 33906 - RNA, 32 nt, Human
acaugggaggcugaggcaggagaaucgcuuga

SEQ ID NO: 33907 - RNA, 32 nt, Human
acaugggaggcugaggcaggaggaucacuuga

SEQ ID NO: 33908 - RNA, 32 nt, Human
acaugggaggcugaggugggaggaucacuuga

SEQ ID NO: 33909 - RNA, 32 nt, Human
acaugggagggaggacagggaaggccaggcuu

SEQ ID NO: 33910 - RNA, 32 nt, Human
acaugggaguuucuuuauugcguaugcagcca

SEQ ID NO: 33911 - RNA, 32 nt, Human
acaugggaugggggaggcagagacugguccag

SEQ ID NO: 33912 - RNA, 32 nt, Human
acaugggcaagcacaagguaggugcuugggga

SEQ ID NO: 33913 - RNA, 19 nt, Human
acaugggccagcggcagcg

SEQ ID NO: 33914 - RNA, 32 nt, Human
acaugggccugagauuuuauuuuagaaaaagg

SEQ ID NO: 33915 - RNA, 32 nt, Human
acaugggcgauuccaaaagcaccgaggagugu

SEQ ID NO: 33916 - RNA, 32 nt, Human
acaugggcuacugcugggaagccugggcuguu

SEQ ID NO: 33917 - RNA, 32 nt, Human
acaugggcucaaaacccccuucccagggacgg

SEQ ID NO: 33918 - RNA, 31 nt, Human
acaugggcucucaauacauguugaaagcaag

SEQ ID NO: 33919 - RNA, 32 nt, Human
acaugggcugcacucgcugaggccaggcagcg

SEQ ID NO: 33920 - RNA, 32 nt, Human
acauggggaagcuuuaggaaugcugaguuuuc

SEQ ID NO: 33921 - RNA, 32 nt, Human
acauggggaggggacuagaugggcaaggggca

SEQ ID NO: 33922 - RNA, 23 nt, Human
acauggggcaaacugcugugcuc

SEQ ID NO: 33923 - RNA, 32 nt, Human
acauggggcugaaucucagacuucugaggugg

SEQ ID NO: 33924 - RNA, 32 nt, Human
acaugggggagagagacuuggaagaggaggag

SEQ ID NO: 33925 - RNA, 32 nt, Human
acauggguagagccugcaagaccugagaccuu

SEQ ID NO: 33926 - RNA, 32 nt, Human
acauggguagggaacagauacaccugguuaga

SEQ ID NO: 33927 - RNA, 32 nt, Human
acauggguaggucaguucuuugguccaagccu

SEQ ID NO: 33928 - RNA, 32 nt, Human
acauggguauaugccaucuucaugccuggcuc

SEQ ID NO: 33929 - RNA, 32 nt, Human
acaugggucaauguuaauucuuuuaucucugu

SEQ ID NO: 33930 - RNA, 32 nt, Human
acauggguggcugccugccugccugccugccu

SEQ ID NO: 33931 - RNA, 32 nt, Human
acauggguuccugugccacccuuuccccgccc

SEQ ID NO: 33932 - RNA, 32 nt, Human
acaugguaaaaccccaucucuacuaaaauaca

SEQ ID NO: 33933 - RNA, 32 nt, Human
acaugguagacagagguugcagugagccaaaa

SEQ ID NO: 33934 - RNA, 32 nt, Human
acaugguagcagaaauaggcccuuuuaugugu

SEQ ID NO: 33935 - RNA, 32 nt, Human
acauggucagaaacagugcuuggaaggacauu

SEQ ID NO: 33936 - RNA, 32 nt, Human
acauggucaucgugaaauaaaaaguccacucu

SEQ ID NO: 33937 - RNA, 32 nt, Human
acaugguccaguuucuagagggcacuagaacu

SEQ ID NO: 33938 - RNA, 32 nt, Human
acaugguccccaggcuggccugaggaugucac

SEQ ID NO: 33939 - RNA, 32 nt, Human
acauggucucacuauguugcugaggcuggucu

SEQ ID NO: 33940 - RNA, 32 nt, Human
acauggucucccacuguucugagcagguggca

SEQ ID NO: 33941 - RNA, 32 nt, Human
acauggugaaaccccaucucuccuaagauaca

SEQ ID NO: 33942 - RNA, 32 nt, Human
acauggugaaaccucgucucuacugaaaauaa

SEQ ID NO: 33943 - RNA, 32 nt, Human
acauggugaaaccucgucucuacugaaaauau

SEQ ID NO: 33944 - RNA, 32 nt, Human
acauggugaaaugaaaccccaucucaacuaaa

SEQ ID NO: 33945 - RNA, 31 nt, Human
acauggugacuuccuuccagagagcacagag

SEQ ID NO: 33946 - RNA, 32 nt, Human
acauggugagccuagcccugggacaucaggag

SEQ ID NO: 33947 - RNA, 27 nt, Human
acauggugagccuugaggaagacuugu

SEQ ID NO: 33948 - RNA, 32 nt, Human
acauggugcauccuuuaucaucacgaaagcaa

SEQ ID NO: 33949 - RNA, 32 nt, Human
acauggugccauccucacaggccuagcucaug

SEQ ID NO: 33950 - RNA, 32 nt, Human
acauggugcucuggaguggccuucaugaugcc

SEQ ID NO: 33951 - RNA, 32 nt, Human
acaugguggaaaggaccacgccuggcagcaaa

SEQ ID NO: 33952 - RNA, 32 nt, Human
acaugguggaguugagagagaggcucacugca

SEQ ID NO: 33953 - RNA, 32 nt, Human
acaugguggauucauguacuucaguguuuguu

SEQ ID NO: 33954 - RNA, 32 nt, Human
acaugguggccacagcuggagugaccgcagug

SEQ ID NO: 33955 - RNA, 32 nt, Human
acaugguggcucagcuucuaaucccagcacuu

SEQ ID NO: 33956 - RNA, 32 nt, Human
acauggugguggucgaagucagcagacacuag

SEQ ID NO: 33957 - RNA, 19 nt, Human
acaugguguauaccuucga

SEQ ID NO: 33958 - RNA, 22 nt, Human
acauggugucccaugcccagau

SEQ ID NO: 33959 - RNA, 32 nt, Human
acaugguucaaaaauccaagcagcguggaagg

SEQ ID NO: 33960 - RNA, 24 nt, Human
acaugguuuauuugaaguauuuua

SEQ ID NO: 33961 - RNA, 32 nt, Human
acaugguuuuucccuuuugccuaaaucagaac

SEQ ID NO: 33962 - RNA, 32 nt, Human
acauguaaaauggcauuucuaaaaguaccuac

SEQ ID NO: 33963 - RNA, 32 nt, Human
acauguaaacacauuuuaguguuucugguuug

SEQ ID NO: 33964 - RNA, 32 nt, Human
acauguaaaugcacaaugugacucauucucau

SEQ ID NO: 33965 - RNA, 19 nt, Human
acauguaacaaacucuagg

SEQ ID NO: 33966 - RNA, 32 nt, Human
acauguaagaauugcuuguugggaagagugcu

SEQ ID NO: 33967 - RNA, 23 nt, Human
acauguaaucacugggcugggug

SEQ ID NO: 33968 - RNA, 22 nt, Human
acauguacaggaccugcagcuu

SEQ ID NO: 33969 - RNA, 32 nt, Human
acauguaccaguucugucaucacugugaucuu

SEQ ID NO: 33970 - RNA, 32 nt, Human
acauguacccagacuucauuucuuucugcauc

SEQ ID NO: 33971 - RNA, 32 nt, Human
acauguaccuugaccaucguccuuccucucaa

SEQ ID NO: 33972 - RNA, 32 nt, Human
acauguacugcagcuucuugucucuguuuugg

SEQ ID NO: 33973 - RNA, 32 nt, Human
acauguacuguggcuccuacauggaucaucag

SEQ ID NO: 33974 - RNA, 32 nt, Human
acauguacuucuaacuggacaguuuucccuua

SEQ ID NO: 33975 - RNA, 32 nt, Human
acauguagaauuuguugucuucugcuaagcac

SEQ ID NO: 33976 - RNA, 32 nt, Human
acauguagcuacucaggaggcugagacaagaa

SEQ ID NO: 33977 - RNA, 31 nt, Human
acauguaggcuucucccuugugcaaagcuua

SEQ ID NO: 33978 - RNA, 17 nt, Human
acauguauauuuucaca

SEQ ID NO: 33979 - RNA, 32 nt, Human
acauguaucugugcuaggcauacaucccugua

SEQ ID NO: 33980 - RNA, 32 nt, Human
acauguaugaaggcugggcacgauggcucacg

SEQ ID NO: 33981 - RNA, 22 nt, Human
acauguaugaggagaccagcag

SEQ ID NO: 33982 - RNA, 18 nt, Human
acauguauuauuuucaca

SEQ ID NO: 33983 - RNA, 32 nt, Human
acaugucaaaccugcaaauucaguaguaacag

SEQ ID NO: 33984 - RNA, 27 nt, Human
acaugucacagcccugguuauacaguc

SEQ ID NO: 33985 - RNA, 31 nt, Human
acaugucacagcuggcaucgcaagcuagggg

SEQ ID NO: 33986 - RNA, 32 nt, Human
acaugucaccauucuauuccucagccuccaac

SEQ ID NO: 33987 - RNA, 32 nt, Human
acaugucacccacccaccgcaggcuggccggg

SEQ ID NO: 33988 - RNA, 32 nt, Human
acaugucaccccugcacuccugccuucccgug

SEQ ID NO: 33989 - RNA, 32 nt, Human
acaugucagaucuuuguacguaauuaaaaaua

SEQ ID NO: 33990 - RNA, 32 nt, Human
acaugucaggaaaaauaaagaacacuuucuac

SEQ ID NO: 33991 - RNA, 27 nt, Human
acaugucagggugggagucauauuaca

SEQ ID NO: 33992 - RNA, 32 nt, Human
acaugucauucuguagacuagaauuucuuaaa

SEQ ID NO: 33993 - RNA, 32 nt, Human
acaugucccagguacauaucccuucccuuuag

SEQ ID NO: 33994 - RNA, 32 nt, Human
acaugucccucuggagcuuccaccuggccagg

SEQ ID NO: 33995 - RNA, 32 nt, Human
acauguccgacauuauuuaauaaauaauuuuu

SEQ ID NO: 33996 - RNA, 32 nt, Human
acauguccucauucucagucugaccagaaugc

SEQ ID NO: 33997 - RNA, 27 nt, Human
acaugucggacccugagaugggauggg

SEQ ID NO: 33998 - RNA, 32 nt, Human
acaugucuauaauuccagcuacucaggaggcu

SEQ ID NO: 33999 - RNA, 32 nt, Human
acaugucuaugaucccagcuacuggagaggcu

SEQ ID NO: 34000 - RNA, 32 nt, Human
acaugucucaggagaaugugacauggggacuc

SEQ ID NO: 34001 - RNA, 32 nt, Human
acaugucucuccccauguuucuccccacuaga

SEQ ID NO: 34002 - RNA, 32 nt, Human
acaugucucucccugcucuuccagggugauuu

SEQ ID NO: 34003 - RNA, 23 nt, Human
acaugucucuguguaguuccagc

SEQ ID NO: 34004 - RNA, 32 nt, Human
acaugucucuugacaguagugcacuuggaaua

SEQ ID NO: 34005 - RNA, 32 nt, Human
acaugucugaaauccauauguuucauaugauc

SEQ ID NO: 34006 - RNA, 32 nt, Human
acaugucuguaaucccagcuacucaggaggcu

SEQ ID NO: 34007 - RNA, 32 nt, Human
acaugucuguaaucccagcuacucgggaggcu

SEQ ID NO: 34008 - RNA, 32 nt, Human
acaugucuguaauccuagcacuuugggaggcc

SEQ ID NO: 34009 - RNA, 32 nt, Human
acaugucuguagucccagcuacuugggcacac

SEQ ID NO: 34010 - RNA, 32 nt, Human
acaugucuucuuuccuacuuccucaagguucu

SEQ ID NO: 34011 - RNA, 32 nt, Human
acaugucuugaugaggggaaccacaaagagcu

SEQ ID NO: 34012 - RNA, 32 nt, Human
acaugucuuucaaagcacgcugacuuggguuu

SEQ ID NO: 34013 - RNA, 32 nt, Human
acaugucuuucauaggugauacaacuuuuuaa

SEQ ID NO: 34014 - RNA, 32 nt, Human
acaugugaaaacacaagucuuugagugugcac

SEQ ID NO: 34015 - RNA, 32 nt, Human
acaugugaccugcagaucuggcaucagaggcc

SEQ ID NO: 34016 - RNA, 32 nt, Human
acaugugacugauuaggaaauauuuuaugguc

SEQ ID NO: 34017 - RNA, 32 nt, Human
acaugugacuuccccuuucccuucccacucgc

SEQ ID NO: 34018 - RNA, 32 nt, Human
acaugugagaaguaagaaagaaacuaaagacc

SEQ ID NO: 34019 - RNA, 32 nt, Human
acaugugcacacacccucaugcaugggugucc

SEQ ID NO: 34020 - RNA, 32 nt, Human
acaugugcacacacgugugcacaaaugugcau

SEQ ID NO: 34021 - RNA, 32 nt, Human
acaugugcacacacugucuacauacaaaccau

SEQ ID NO: 34022 - RNA, 32 nt, Human
acaugugcacacauguaaaacaaaaaugaagc

SEQ ID NO: 34023 - RNA, 32 nt, Human
acaugugcacacauguagcuaaauaaaguaca

SEQ ID NO: 34024 - RNA, 32 nt, Human
acaugugcagcaaacaaaguggaaguauagau

SEQ ID NO: 34025 - RNA, 32 nt, Human
acaugugcagcagcuacuguauccugauagug

SEQ ID NO: 34026 - RNA, 24 nt, Human
acaugugcagcaggccauggagug

SEQ ID NO: 34027 - RNA, 32 nt, Human
acaugugcagcaggccauggaguguagcgggc

SEQ ID NO: 34028 - RNA, 32 nt, Human
acaugugccacuguucagcggagcugacuggu

SEQ ID NO: 34029 - RNA, 32 nt, Human
acaugugccugacaguacacuacucaagucga

SEQ ID NO: 34030 - RNA, 32 nt, Human
acaugugccuggaaguugaauuuguggcuguu

SEQ ID NO: 34031 - RNA, 32 nt, Human
acaugugccuguaaauuauuuugccgaaauaa

SEQ ID NO: 34032 - RNA, 32 nt, Human
acaugugcucaaggaaugcagaccacugugcu

SEQ ID NO: 34033 - RNA, 32 nt, Human
acauguggaaggcagagauugugucuagggug

SEQ ID NO: 34034 - RNA, 27 nt, Human
acauguggaaugauauugagcugcuaa

SEQ ID NO: 34035 - RNA, 32 nt, Human
acauguggagagccagggagaagaagagaaag

SEQ ID NO: 34036 - RNA, 32 nt, Human
acauguggagagccagggagaggaagagaaag

SEQ ID NO: 34037 - RNA, 32 nt, Human
acauguggcccuugccuucugagcagcuccca

SEQ ID NO: 34038 - RNA, 32 nt, Human
acaugugggaguuuucacaacaguaguuuugg

SEQ ID NO: 34039 - RNA, 32 nt, Human
acaugugggcagacgcuggugcccgaguucag

SEQ ID NO: 34040 - RNA, 19 nt, Human
acaugugggcauuuucaca

SEQ ID NO: 34041 - RNA, 32 nt, Human
acauguggucaucagaaaauaagccauuccuc

SEQ ID NO: 34042 - RNA, 32 nt, Human
acaugugguuccaggccagaggcauggaaguc

SEQ ID NO: 34043 - RNA, 32 nt, Human
acauguguaagugccagacagcugaaucuuua

SEQ ID NO: 34044 - RNA, 32 nt, Human
acauguguacaucucagccuuaucucaaggag

SEQ ID NO: 34045 - RNA, 32 nt, Human
acauguguacuuuuucaugaagcuuuuugcaa

SEQ ID NO: 34046 - RNA, 32 nt, Human
acauguguagacacaaacauauacacagaugu

SEQ ID NO: 34047 - RNA, 32 nt, Human
acauguguagccccaccagcccuccaaggcau

SEQ ID NO: 34048 - RNA, 32 nt, Human
acauguguagggcaucuucccccagaaucuua

SEQ ID NO: 34049 - RNA, 20 nt, Human
acauguguauguguacauug

SEQ ID NO: 34050 - RNA, 32 nt, Human
acaugugucgccucucucgcuacuacccaucc

SEQ ID NO: 34051 - RNA, 32 nt, Human
acauguguggugcacacaugcacacucggcuc

SEQ ID NO: 34052 - RNA, 29 nt, Human
acauguguucugugugugucuguauagcc

SEQ ID NO: 34053 - RNA, 21 nt, Human
acauguguuucauaaccugcc

SEQ ID NO: 34054 - RNA, 32 nt, Human
acauguguuuccuguuaaaacuccucuuguuc

SEQ ID NO: 34055 - RNA, 32 nt, Human
acauguuauauuuuugguuucucucuacugau

SEQ ID NO: 34056 - RNA, 32 nt, Human
acauguuauuggaacauauauguauguauuaa

SEQ ID NO: 34057 - RNA, 31 nt, Human
acauguucaauaaaaguuguugaaagauuaa

SEQ ID NO: 34058 - RNA, 32 nt, Human
acauguucaguauaaauauauguguagugaag

SEQ ID NO: 34059 - RNA, 32 nt, Human
acauguucauuuuccuucuuuuuaauuuuuaa

SEQ ID NO: 34060 - RNA, 32 nt, Human
acauguuccaugcugagccaaaggacacuccu

SEQ ID NO: 34061 - RNA, 32 nt, Human
acauguuccuacagccugugcaagaguggacg

SEQ ID NO: 34062 - RNA, 32 nt, Human
acauguuccucuuccuguuccuguugacaugu

SEQ ID NO: 34063 - RNA, 32 nt, Human
acauguuccuucauguacccccuuuucucuau

SEQ ID NO: 34064 - RNA, 32 nt, Human
acauguucucaggaccuccugagggcuauguc

SEQ ID NO: 34065 - RNA, 32 nt, Human
acauguucucaggaccuccugagggcuguguc

SEQ ID NO: 34066 - RNA, 32 nt, Human
acauguucuuuagcuaaccccuucccugccca

SEQ ID NO: 34067 - RNA, 32 nt, Human
acauguugagagagacugagacaggagucuuc

SEQ ID NO: 34068 - RNA, 32 nt, Human
acauguugcccauggggcugaggagacuguuc

SEQ ID NO: 34069 - RNA, 32 nt, Human
acauguugcuuccagacauacuucucugcaac

SEQ ID NO: 34070 - RNA, 31 nt, Human
acauguuggguguccauccuggggcagggaa

SEQ ID NO: 34071 - RNA, 32 nt, Human
acauguugugggaaagacccugugggagauau

SEQ ID NO: 34072 - RNA, 32 nt, Human
acauguuuccaaaauuuaaaagccuggguccc

SEQ ID NO: 34073 - RNA, 32 nt, Human
acauguuucuccaggaugccaaaggaaaugcu

SEQ ID NO: 34074 - RNA, 32 nt, Human
acauguuucuggaaguggguggguggguuuga

SEQ ID NO: 34075 - RNA, 32 nt, Human
acauguuugucugcauccucagggggcucgcc

SEQ ID NO: 34076 - RNA, 32 nt, Human
acauguuuuccugcugacucucuccccacuau

SEQ ID NO: 34077 - RNA, 32 nt, Human
acauguuuuccuuaaaagauggaagguuuuag

SEQ ID NO: 34078 - RNA, 32 nt, Human
acauguuuugagucuuacucugugccugaccu

SEQ ID NO: 34079 - RNA, 32 nt, Human
acauguuuuuauuuccucugcuggaauaggag

SEQ ID NO: 34080 - RNA, 32 nt, Human
acauuaaaaugcuggggcaagaugcaguacaa

SEQ ID NO: 34081 - RNA, 28 nt, Human
acauuaaagaucacuugguaguuagcca

SEQ ID NO: 34082 - RNA, 24 nt, Human
acauuaaaguuaaacuguauuuua

SEQ ID NO: 34083 - RNA, 32 nt, Human
acauuaaauagaaauaaugucauuugaaugaa

SEQ ID NO: 34084 - RNA, 21 nt, Human
acauuaaauauauguguuuua

SEQ ID NO: 34085 - RNA, 32 nt, Human
acauuaaauucacugugaaggcagcauacuua

SEQ ID NO: 34086 - RNA, 32 nt, Human
acauuaacaaaaugcaggaaucugccacauuu

SEQ ID NO: 34087 - RNA, 23 nt, Human
acauuaacauaaaauguauuuua

SEQ ID NO: 34088 - RNA, 32 nt, Human
acauuaacaugcugucucuaaggguggccccu

SEQ ID NO: 34089 - RNA, 32 nt, Human
acauuaaccagcugcccaggguucaagcuuga

SEQ ID NO: 34090 - RNA, 32 nt, Human
acauuaaccagcuuccugagacaugcacccuc

SEQ ID NO: 34091 - RNA, 23 nt, Human
acauuaaccucauuccaaguuaa

SEQ ID NO: 34092 - RNA, 32 nt, Human
acauuaacucaccucaaaccucugucuuuccu

SEQ ID NO: 34093 - RNA, 20 nt, Human
acauuaacugcuguauuuug

SEQ ID NO: 34094 - RNA, 32 nt, Human
acauuaagaaaaucauauugcuucuucuccua

SEQ ID NO: 34095 - RNA, 32 nt, Human
acauuaagacacaccucuggaucccuggaggg

SEQ ID NO: 34096 - RNA, 32 nt, Human
acauuaaggagaguuggaaaaggugaauuuau

SEQ ID NO: 34097 - RNA, 32 nt, Human
acauuaagguaaagguuuuggcuggucagugu

SEQ ID NO: 34098 - RNA, 32 nt, Human
acauuaagugaagagaggggacaaaggccagg

SEQ ID NO: 34099 - RNA, 32 nt, Human
acauuaauaaccccuucuuugacuuccucaag

SEQ ID NO: 34100 - RNA, 32 nt, Human
acauuaauaaccucaccaacauagcucaugcc

SEQ ID NO: 34101 - RNA, 18 nt, Human
acauuaauccccacccca

SEQ ID NO: 34102 - RNA, 32 nt, Human
acauuaauccccaccccaacagagccacuggc

SEQ ID NO: 34103 - RNA, 32 nt, Human
acauuaaugcacugaaugcaugcaucuuuccu

SEQ ID NO: 34104 - RNA, 21 nt, Human
acauuaauguuacuagcauca

SEQ ID NO: 34105 - RNA, 22 nt, Human
acauuaauucuucagaggcagg

SEQ ID NO: 34106 - RNA, 32 nt, Human
acauuacaaaggaaggaggagggaagagacuu

SEQ ID NO: 34107 - RNA, 32 nt, Human
acauuacagaauaugaaugagaaugugccaug

SEQ ID NO: 34108 - RNA, 32 nt, Human
acauuacaguguacacauuauacacugcaucu

SEQ ID NO: 34109 - RNA, 32 nt, Human
acauuacauacuccaaggaaauauaucaggga

SEQ ID NO: 34110 - RNA, 32 nt, Human
acauuaccaccugagcuccaccuccugugaga

SEQ ID NO: 34111 - RNA, 32 nt, Human
acauuaccagacaaaccacucaucacaguauu

SEQ ID NO: 34112 - RNA, 32 nt, Human
acauuaccagugguuugaucugggugaugaaa

SEQ ID NO: 34113 - RNA, 22 nt, Human
acauuaccugcucccaucacca

SEQ ID NO: 34114 - RNA, 32 nt, Human
acauuaccugggaaagcucuccucccuccuga

SEQ ID NO: 34115 - RNA, 32 nt, Human
acauuacuccaaaauaauuaaauuuaaggcuu

SEQ ID NO: 34116 - RNA, 32 nt, Human
acauuacuuaaacuuucuuuccagucaaccau

SEQ ID NO: 34117 - RNA, 32 nt, Human
acauuacuuaaccuuucugggccucugccacc

SEQ ID NO: 34118 - RNA, 21 nt, Human
acauuacuuauuugaggucag

SEQ ID NO: 34119 - RNA, 32 nt, Human
acauuacuucgcuccgucugccuggauuaaac

SEQ ID NO: 34120 - RNA, 32 nt, Human
acauuagaaaaauagcaacuuguguuacaaaa

SEQ ID NO: 34121 - RNA, 32 nt, Human
acauuagaaaggauuucucuuuacuaaggacu

SEQ ID NO: 34122 - RNA, 32 nt, Human
acauuagacaccuguguguaguggccucugau

SEQ ID NO: 34123 - RNA, 32 nt, Human
acauuagagaauugguccuggaagggaaagaa

SEQ ID NO: 34124 - RNA, 32 nt, Human
acauuagagccuguccgucugaucuagagaag

SEQ ID NO: 34125 - RNA, 32 nt, Human
acauuagcaaaaccaguggggccagcacacac

SEQ ID NO: 34126 - RNA, 32 nt, Human
acauuagcuuugcccgaaguuuuuccccacac

SEQ ID NO: 34127 - RNA, 32 nt, Human
acauuaggagcucuuucucucacucuucuguc

SEQ ID NO: 34128 - RNA, 32 nt, Human
acauuaggcugauguccuugcccauugccaag

SEQ ID NO: 34129 - RNA, 32 nt, Human
acauuagguuauagugacacugugagcuuugc

SEQ ID NO: 34130 - RNA, 31 nt, Human
acauuaguaagaagagaaaaauuuuggucau

SEQ ID NO: 34131 - RNA, 32 nt, Human
acauuaguguugggcaugaagccucaaggcuu

SEQ ID NO: 34132 - RNA, 32 nt, Human
acauuauacucauguguucucauguguucuug

SEQ ID NO: 34133 - RNA, 32 nt, Human
acauuauaucaacacuuugcucugcuuuguaa

SEQ ID NO: 34134 - RNA, 32 nt, Human
acauuaucagaacuuaaguccuggagaucaga

SEQ ID NO: 34135 - RNA, 32 nt, Human
acauuaucauucucaggccacugcauuuagcc

SEQ ID NO: 34136 - RNA, 32 nt, Human
acauuaucuacauuuuccucagccucuaucug

SEQ ID NO: 34137 - RNA, 32 nt, Human
acauuaucuaguucauugaaucauuguaugug

SEQ ID NO: 34138 - RNA, 32 nt, Human
acauuaugcagcccugcucaguagagacucac

SEQ ID NO: 34139 - RNA, 23 nt, Human
acauuaugcuagaaaaaaggagc

SEQ ID NO: 34140 - RNA, 32 nt, Human
acauuaugcuugguccggagagcugccuugga

SEQ ID NO: 34141 - RNA, 32 nt, Human
acauuauguggcugaaaaagaauauaaaaagc

SEQ ID NO: 34142 - RNA, 32 nt, Human
acauuauuacaggguuugugaggaccuuugac

SEQ ID NO: 34143 - RNA, 32 nt, Human
acauuauuauuaccaguaaccuuuauuaagca

SEQ ID NO: 34144 - RNA, 24 nt, Human
acauuauuccacauccacagaaca

SEQ ID NO: 34145 - RNA, 32 nt, Human
acauuauuucuucaaaggaaaggaaaggaauu

SEQ ID NO: 34146 - RNA, 32 nt, Human
acauucaaccaaugggaggcaccaagagaaga

SEQ ID NO: 34147 - RNA, 19 nt, Human
acauucaaccccuagcaua

SEQ ID NO: 34148 - RNA, 32 nt, Human
acauucaaggaagguuuccuggaagauuuagu

SEQ ID NO: 34149 - RNA, 32 nt, Human
acauucacagcccucugagucugaguccagau

SEQ ID NO: 34150 - RNA, 32 nt, Human
acauucacaugagaagagaugaccucaucugu

SEQ ID NO: 34151 - RNA, 32 nt, Human
acauucacccuuuauucacagucacuugcagu

SEQ ID NO: 34152 - RNA, 32 nt, Human
acauucaccucccugccuccucuccuuucuac

SEQ ID NO: 34153 - RNA, 22 nt, Human
acauucaccugccccaacucuc

SEQ ID NO: 34154 - RNA, 32 nt, Human
acauucagacacacucccuucugccuuccggc

SEQ ID NO: 34155 - RNA, 32 nt, Human
acauucagagacauagcuauagaauucucucu

SEQ ID NO: 34156 - RNA, 32 nt, Human
acauucagagucuugaaacagcaaucaaaagg

SEQ ID NO: 34157 - RNA, 32 nt, Human
acauucagauggugagggaguuaauaugguug

SEQ ID NO: 34158 - RNA, 32 nt, Human
acauucagauuuaauuacuguaaguaaaauuu

SEQ ID NO: 34159 - RNA, 32 nt, Human
acauucagccuucuugcacuuccagccucuuc

SEQ ID NO: 34160 - RNA, 32 nt, Human
acauucagcugguucgcacugauacggcucaa

SEQ ID NO: 34161 - RNA, 32 nt, Human
acauucaggacucugguuucuguuuugcuuga

SEQ ID NO: 34162 - RNA, 32 nt, Human
acauucaggagcugauauguguuucaaaggcu

SEQ ID NO: 34163 - RNA, 19 nt, Human
acauucaggcaccagcaua

SEQ ID NO: 34164 - RNA, 32 nt, Human
acauucaguagaacauuuuauugccuaguuga

SEQ ID NO: 34165 - RNA, 32 nt, Human
acauucagugccaagugcucccaugggaauaa

SEQ ID NO: 34166 - RNA, 32 nt, Human
acauucauaugagguccccagcaggggcuggc

SEQ ID NO: 34167 - RNA, 32 nt, Human
acauucauccacccugacgugcagaagcugcu

SEQ ID NO: 34168 - RNA, 32 nt, Human
acauucaugccauugugcaaccuucaccaccg

SEQ ID NO: 34169 - RNA, 32 nt, Human
acauuccaaacuuuagcaacaguuaucacacu

SEQ ID NO: 34170 - RNA, 32 nt, Human
acauuccaaauauucugggguugagggaaauu

SEQ ID NO: 34171 - RNA, 32 nt, Human
acauuccaagagagacaaaggcuggagccgag

SEQ ID NO: 34172 - RNA, 32 nt, Human
acauuccaauagacgaagugcacacaacacaa

SEQ ID NO: 34173 - RNA, 32 nt, Human
acauuccaaugccaaacauuucugcacaggga

SEQ ID NO: 34174 - RNA, 18 nt, Human
acauuccagauuaggaga

SEQ ID NO: 34175 - RNA, 32 nt, Human
acauuccauaaauauacuugaaauguuauuua

SEQ ID NO: 34176 - RNA, 32 nt, Human
acauuccauccagccugggcgacaagagcaaa

SEQ ID NO: 34177 - RNA, 32 nt, Human
acauuccauguauuuugaauaugagcaaaaac

SEQ ID NO: 34178 - RNA, 32 nt, Human
acauuccauuaaagaagagcaagaagcgaugg

SEQ ID NO: 34179 - RNA, 28 nt, Human
acauucccaagugccuguccuuauugga

SEQ ID NO: 34180 - RNA, 32 nt, Human
acauucccagaagagcggaaagaucauugacg

SEQ ID NO: 34181 - RNA, 32 nt, Human
acauucccaggccauguaggauaggauacucc

SEQ ID NO: 34182 - RNA, 32 nt, Human
acauucccauuggaagauacuggaccuuuccu

SEQ ID NO: 34183 - RNA, 32 nt, Human
acauuccccuccaguguucccuccuugagagc

SEQ ID NO: 34184 - RNA, 32 nt, Human
acauuccccugccuugccccugagcacuucug

SEQ ID NO: 34185 - RNA, 24 nt, Human
acauucccgcugcucgaagcagcu

SEQ ID NO: 34186 - RNA, 32 nt, Human
acauucccgucaucguuaguguuuccaguuga

SEQ ID NO: 34187 - RNA, 32 nt, Human
acauucccguuuuucuucuuacacucagaguu

SEQ ID NO: 34188 - RNA, 32 nt, Human
acauucccucuccugcccagaugcccuuugga

SEQ ID NO: 34189 - RNA, 32 nt, Human
acauucccucuccuggucucugggucuggcuu

SEQ ID NO: 34190 - RNA, 32 nt, Human
acauucccugcacacggucuuugagagagcag

SEQ ID NO: 34191 - RNA, 32 nt, Human
acauuccuagcuuuacagucuugcugugaauu

SEQ ID NO: 34192 - RNA, 32 nt, Human
acauuccuaggagagugucuguuugcaugaua

SEQ ID NO: 34193 - RNA, 32 nt, Human
acauuccucaaugaccucucccaaaccuccca

SEQ ID NO: 34194 - RNA, 23 nt, Human
acauuccucacguagcuucugcu

SEQ ID NO: 34195 - RNA, 23 nt, Human
acauuccuccaugcccgcugcuu

SEQ ID NO: 34196 - RNA, 32 nt, Human
acauuccucuaggacugguuuggggacgggug

SEQ ID NO: 34197 - RNA, 19 nt, Human
acauuccucucagcuccgc

SEQ ID NO: 34198 - RNA, 32 nt, Human
acauuccucugacuuuauacuguuauuacugc

SEQ ID NO: 34199 - RNA, 32 nt, Human
acauuccugacccucacuuuucucaucuguaa

SEQ ID NO: 34200 - RNA, 32 nt, Human
acauuccugcagcugaaucacagcucuugccc

SEQ ID NO: 34201 - RNA, 32 nt, Human
acauuccuggaaaauaucaagguggaauuuag

SEQ ID NO: 34202 - RNA, 32 nt, Human
acauuccuggaggagcugcuguuugagccagc

SEQ ID NO: 34203 - RNA, 32 nt, Human
acauuccugggugacaggcacagugcagaagc

SEQ ID NO: 34204 - RNA, 32 nt, Human
acauuccuggugucccaaagaauagcaaaaag

SEQ ID NO: 34205 - RNA, 32 nt, Human
acauuccuguaaucccagcuacucgggaggcu

SEQ ID NO: 34206 - RNA, 19 nt, Human
acauuccuuaggguccugc

SEQ ID NO: 34207 - RNA, 32 nt, Human
acauuccuuccuucucccaucuggauuccuaa

SEQ ID NO: 34208 - RNA, 32 nt, Human
acauuccuucuggaguuuguuuuugaaacucc

SEQ ID NO: 34209 - RNA, 32 nt, Human
acauuccuugagugacuaugaaugacugccgg

SEQ ID NO: 34210 - RNA, 32 nt, Human
acauuccuuuuguuguuuaauucuuuagaauc

SEQ ID NO: 34211 - RNA, 32 nt, Human
acauucgcgaggaucagccuugggucagagug

SEQ ID NO: 34212 - RNA, 32 nt, Human
acauucggcuuggugaaauccuucucuaaagc

SEQ ID NO: 34213 - RNA, 32 nt, Human
acauucuacuugauuuacacuuccuagucuac

SEQ ID NO: 34214 - RNA, 20 nt, Human
acauucuaguucucuucaca

SEQ ID NO: 34215 - RNA, 32 nt, Human
acauucuauagccauaaaccugaagaugagua

SEQ ID NO: 34216 - RNA, 32 nt, Human
acauucuaugaguaaacagcaagugcaacgua

SEQ ID NO: 34217 - RNA, 32 nt, Human
acauucuauggaaaaugguuucugguaaacug

SEQ ID NO: 34218 - RNA, 32 nt, Human
acauucucauguguaauauauguuuuuguauc

SEQ ID NO: 34219 - RNA, 32 nt, Human
acauucucauuguauguggucuccgcuguuug

SEQ ID NO: 34220 - RNA, 32 nt, Human
acauucucauuucuaaacaucuggaucugggu

SEQ ID NO: 34221 - RNA, 32 nt, Human
acauucuccaacaauaaagcacagaguggauu

SEQ ID NO: 34222 - RNA, 32 nt, Human
acauucuccaagaugcagcccaggagccucuc

SEQ ID NO: 34223 - RNA, 32 nt, Human
acauucuccaucugcgcaccacagggaggcaa

SEQ ID NO: 34224 - RNA, 32 nt, Human
acauucuccauggccagugaggaagucuugaa

SEQ ID NO: 34225 - RNA, 32 nt, Human
acauucuccccaggaagccggacucuaugggg

SEQ ID NO: 34226 - RNA, 32 nt, Human
acauucucuugcagaaacccuucaaaggcuug

SEQ ID NO: 34227 - RNA, 32 nt, Human
acauucugagacuucuuucuuccuuccuuuuu

SEQ ID NO: 34228 - RNA, 32 nt, Human
acauucugagauuacagcauugucuuagucaa

SEQ ID NO: 34229 - RNA, 32 nt, Human
acauucugagguacuggggguuauaacuucaa

SEQ ID NO: 34230 - RNA, 25 nt, Human
acauucugcccagaggggcugggga

SEQ ID NO: 34231 - RNA, 32 nt, Human
acauucuggguaggccuccagcaaacggaagc

SEQ ID NO: 34232 - RNA, 32 nt, Human
acauucuuacagcagggugucucuccaacagc

SEQ ID NO: 34233 - RNA, 32 nt, Human
acauucuuauacugcugucucaaauccaaaaa

SEQ ID NO: 34234 - RNA, 32 nt, Human
acauucuucagauuaacuucaggauuuauuug

SEQ ID NO: 34235 - RNA, 32 nt, Human
acauucuucauguggauguggccagugucagc

SEQ ID NO: 34236 - RNA, 32 nt, Human
acauucuucccauccugcuauccugcucgaag

SEQ ID NO: 34237 - RNA, 32 nt, Human
acauucuucccauccugcuauucugcucaaag

SEQ ID NO: 34238 - RNA, 32 nt, Human
acauucuucucuucucuccucucaaaaagccc

SEQ ID NO: 34239 - RNA, 32 nt, Human
acauucuugcacaggguggggcgcgcaguagg

SEQ ID NO: 34240 - RNA, 32 nt, Human
acauucuuuagaguggguugggugcauccaaa

SEQ ID NO: 34241 - RNA, 32 nt, Human
acauucuuugccuggugcacugugucuguggu

SEQ ID NO: 34242 - RNA, 32 nt, Human
acauucuuuuugaaauacuuucuucacuugac

SEQ ID NO: 34243 - RNA, 32 nt, Human
acauugaacccccagauucuccuguaccuccu

SEQ ID NO: 34244 - RNA, 32 nt, Human
acauugaacccccaggguacagccucguucuc

SEQ ID NO: 34245 - RNA, 32 nt, Human
acauugacucauuugccccuucccucucggaa

SEQ ID NO: 34246 - RNA, 32 nt, Human
acauugacucuugauggaaagacuuaagaaga

SEQ ID NO: 34247 - RNA, 22 nt, Human
acauugagaccagccaacuucu

SEQ ID NO: 34248 - RNA, 32 nt, Human
acauugagagcaccaagaaggugguggucaac

SEQ ID NO: 34249 - RNA, 32 nt, Human
acauugagcaaauggccacugaguagccccag

SEQ ID NO: 34250 - RNA, 21 nt, Human
acauugagcugcauggacagg

SEQ ID NO: 34251 - RNA, 32 nt, Human
acauugauagauggggugugggaccaacaaac

SEQ ID NO: 34252 - RNA, 32 nt, Human
acauugauagggcagagcagggagugugcaca

SEQ ID NO: 34253 - RNA, 32 nt, Human
acauugauaguugauuacacuguggcacgaau

SEQ ID NO: 34254 - RNA, 32 nt, Human
acauugaucuuaaaauuuuucucagucacuga

SEQ ID NO: 34255 - RNA, 32 nt, Human
acauugaugaugggaaggaaggaaugaagaga

SEQ ID NO: 34256 - RNA, 32 nt, Human
acauugauucacuggcgucuguuuucauuuua

SEQ ID NO: 34257 - RNA, 30 nt, Human
acauugcaacucuccaugcuccugcaauau

SEQ ID NO: 34258 - RNA, 32 nt, Human
acauugcacacacagucuguucagaggcauug

SEQ ID NO: 34259 - RNA, 32 nt, Human
acauugcauucugcacgggcauugacuaucuu

SEQ ID NO: 34260 - RNA, 32 nt, Human
acauugccaacuuaagacacacaaagcagauu

SEQ ID NO: 34261 - RNA, 32 nt, Human
acauugccuccuuccccucccucucucauggc

SEQ ID NO: 34262 - RNA, 32 nt, Human
acauugccuuucucaauacugagccccuaaac

SEQ ID NO: 34263 - RNA, 32 nt, Human
acauugcgccacugcacuccagcgcggaagac

SEQ ID NO: 34264 - RNA, 32 nt, Human
acauugcuaaucaauccucugccaugagccua

SEQ ID NO: 34265 - RNA, 32 nt, Human
acauugcuauaagaaaaguuacaagggaaagu

SEQ ID NO: 34266 - RNA, 32 nt, Human
acauugcucacaagcagauuuccccagcgucg

SEQ ID NO: 34267 - RNA, 32 nt, Human
acauugcugcauucaugcaagacugaaauuua

SEQ ID NO: 34268 - RNA, 32 nt, Human
acauugcugggaaccaagaaauaggaccaucc

SEQ ID NO: 34269 - RNA, 32 nt, Human
acauugcuguucacuagauuaucuuaacaaau

SEQ ID NO: 34270 - RNA, 31 nt, Human
acauuggaagagcagcaccuccucagccuga

SEQ ID NO: 34271 - RNA, 32 nt, Human
acauuggaccuaaacggugacucucauucuuu

SEQ ID NO: 34272 - RNA, 23 nt, Human
acauuggagaguucugaggccgg

SEQ ID NO: 34273 - RNA, 32 nt, Human
acauuggcaaagccuccuacagaaucaucaaa

SEQ ID NO: 34274 - RNA, 32 nt, Human
acauuggcagagguggggguuggcuguggccu

SEQ ID NO: 34275 - RNA, 20 nt, Human
acauuggcaucacccaggua

SEQ ID NO: 34276 - RNA, 32 nt, Human
acauuggcccaaaaauaucuugaagcaauggc

SEQ ID NO: 34277 - RNA, 32 nt, Human
acauuggcuccugccaaggucccucucucucc

SEQ ID NO: 34278 - RNA, 32 nt, Human
acauuggcuggaugugguggcuuaugcuugua

SEQ ID NO: 34279 - RNA, 32 nt, Human
acauuggcuuaucauggggaaaaagaggaucu

SEQ ID NO: 34280 - RNA, 32 nt, Human
acauuggcuuugcucagaugcagauggaagug

SEQ ID NO: 34281 - RNA, 20 nt, Human
acauugggaggccaaggcag

SEQ ID NO: 34282 - RNA, 21 nt, Human
acauugggaggccaaggcagg

SEQ ID NO: 34283 - RNA, 21 nt, Human
acauugggaggccgaggcagg

SEQ ID NO: 34284 - RNA, 21 nt, Human
acauugggaggcugaggcagg

SEQ ID NO: 34285 - RNA, 32 nt, Human
acauugggcucugggaauuuuaucuggguuuu

SEQ ID NO: 34286 - RNA, 32 nt, Human
acauugguuauuuuaugcuuucuuggauauaa

SEQ ID NO: 34287 - RNA, 32 nt, Human
acauuguaaauccuuuuuauauuaaguaacag

SEQ ID NO: 34288 - RNA, 32 nt, Human
acauuguaaguuccuaaaaacauuuuauuaaa

SEQ ID NO: 34289 - RNA, 32 nt, Human
acauuguacagaaugagcagucauguaaugaa

SEQ ID NO: 34290 - RNA, 19 nt, Human
acauuguauugguauuaca

SEQ ID NO: 34291 - RNA, 32 nt, Human
acauuguccugauccuuugcucugccaauuga

SEQ ID NO: 34292 - RNA, 32 nt, Human
acauugucugcugcacgugaucaugagggguu

SEQ ID NO: 34293 - RNA, 32 nt, Human
acauugugaauagaaccuacaugaaaacauac

SEQ ID NO: 34294 - RNA, 31 nt, Human
acauugugauaauccuucacagcaagaaacc

SEQ ID NO: 34295 - RNA, 32 nt, Human
acauuguggauccgcuaacaggcacagauguc

SEQ ID NO: 34296 - RNA, 23 nt, Human
acauugugugggccagaggcagg

SEQ ID NO: 34297 - RNA, 32 nt, Human
acauuguguucccccgcauuccaggcucaggg

SEQ ID NO: 34298 - RNA, 32 nt, Human
acauuguguuuccugcugaaucaagucuacau

SEQ ID NO: 34299 - RNA, 32 nt, Human
acauuguuacacuuaauuuuacagggcacaaa

SEQ ID NO: 34300 - RNA, 31 nt, Human
acauuguuaccucuauauaccaaagcacauu

SEQ ID NO: 34301 - RNA, 32 nt, Human
acauuguuaucuuuacucuucacaagaaccau

SEQ ID NO: 34302 - RNA, 32 nt, Human
acauuguuuccaggaccuccugagaagccuga

SEQ ID NO: 34303 - RNA, 32 nt, Human
acauuuaaacuuuuuaaaauacuuauuaaaaa

SEQ ID NO: 34304 - RNA, 32 nt, Human
acauuuaaagucaaaagaaaaguagaccguuu

SEQ ID NO: 34305 - RNA, 32 nt, Human
acauuuaacaaaaucuauaacugugaagcuua

SEQ ID NO: 34306 - RNA, 24 nt, Human
acauuuaacuaugguauuuaugga

SEQ ID NO: 34307 - RNA, 23 nt, Human
acauuuaauaaaaauguauuuua

SEQ ID NO: 34308 - RNA, 32 nt, Human
acauuuaauguucuuggccucugcuuuuaugu

SEQ ID NO: 34309 - RNA, 19 nt, Human
acauuuacaaaaagagcaa

SEQ ID NO: 34310 - RNA, 32 nt, Human
acauuuacaaccucuucucuccuuccaaccug

SEQ ID NO: 34311 - RNA, 32 nt, Human
acauuuacaagaaucacaucucugauuucagu

SEQ ID NO: 34312 - RNA, 32 nt, Human
acauuuacuuuugcuuucuaccugacugcccc

SEQ ID NO: 34313 - RNA, 32 nt, Human
acauuuagaagagaugcuggugauagucaucu

SEQ ID NO: 34314 - RNA, 32 nt, Human
acauuuagccacagcccaaaucuuccaggcaa

SEQ ID NO: 34315 - RNA, 32 nt, Human
acauuuagggaaaaggggcagcauguggggaa

SEQ ID NO: 34316 - RNA, 28 nt, Human
acauuuauaagugcugcuuacaucacug

SEQ ID NO: 34317 - RNA, 32 nt, Human
acauuuaucugugaccuauaucaaguacacau

SEQ ID NO: 34318 - RNA, 32 nt, Human
acauuuauuggcugggugugguggcucacacc

SEQ ID NO: 34319 - RNA, 32 nt, Human
acauuuauuguccucaaaauugcuuauggcca

SEQ ID NO: 34320 - RNA, 32 nt, Human
acauuuauuuacauuacauacauacauuuaca

SEQ ID NO: 34321 - RNA, 32 nt, Human
acauuucaaggauuuuuauugcucugugaguu

SEQ ID NO: 34322 - RNA, 32 nt, Human
acauuucacaacaucuuguagcaggcuuacua

SEQ ID NO: 34323 - RNA, 32 nt, Human
acauuucacagaagugccugagacgcggagac

SEQ ID NO: 34324 - RNA, 32 nt, Human
acauuucacaggcagagaggugccaucaguuc

SEQ ID NO: 34325 - RNA, 32 nt, Human
acauuucacgcagucagggaacaggugaggaa

SEQ ID NO: 34326 - RNA, 32 nt, Human
acauuucacugucaaagaagcuacuggcuugg

SEQ ID NO: 34327 - RNA, 32 nt, Human
acauuucaguaacagcuacaaacacaccugga

SEQ ID NO: 34328 - RNA, 32 nt, Human
acauuucauauguaaauaaacgugggacauuu

SEQ ID NO: 34329 - RNA, 32 nt, Human
acauuucaucuauuaucucugccucauuucug

SEQ ID NO: 34330 - RNA, 32 nt, Human
acauuuccaagaggagagaaaaaguggaguca

SEQ ID NO: 34331 - RNA, 32 nt, Human
acauuuccacugucuucccuggcagcugugau

SEQ ID NO: 34332 - RNA, 21 nt, Human
acauuuccagcuccugcugca

SEQ ID NO: 34333 - RNA, 32 nt, Human
acauuuccaucaccccagagaguucacuccug

SEQ ID NO: 34334 - RNA, 32 nt, Human
acauuuccauggugugagauccucuuuacucu

SEQ ID NO: 34335 - RNA, 32 nt, Human
acauuuccauuuucauuuucgagccaucaguu

SEQ ID NO: 34336 - RNA, 32 nt, Human
acauuucccagccugccugccccucugcccac

SEQ ID NO: 34337 - RNA, 32 nt, Human
acauuucccagggggcagaggcaggggcggga

SEQ ID NO: 34338 - RNA, 32 nt, Human
acauuucccauagccuugacagugccaggaga

SEQ ID NO: 34339 - RNA, 32 nt, Human
acauuucccaugagccucaaaacugaaugcug

SEQ ID NO: 34340 - RNA, 32 nt, Human
acauuuccccugcuugcacucccuucauccgg

SEQ ID NO: 34341 - RNA, 32 nt, Human
acauuucccucccauuugccuugccucagaaa

SEQ ID NO: 34342 - RNA, 32 nt, Human
acauuucccuguuucgagccaggcucuuccaa

SEQ ID NO: 34343 - RNA, 32 nt, Human
acauuucccuuggaggguucagagauuaaacu

SEQ ID NO: 34344 - RNA, 32 nt, Human
acauuucccuuucuucuuuccuuuuuguuuuu

SEQ ID NO: 34345 - RNA, 32 nt, Human
acauuuccggagccgcccugggugucagcggc

SEQ ID NO: 34346 - RNA, 32 nt, Human
acauuuccguaauaaaagaugccuucagaaac

SEQ ID NO: 34347 - RNA, 32 nt, Human
acauuuccuacaaaucagcguaguuacaaagg

SEQ ID NO: 34348 - RNA, 23 nt, Human
acauuuccucagucaaguucaga

SEQ ID NO: 34349 - RNA, 32 nt, Human
acauuuccuuucuacucuuucugccaagagcc

SEQ ID NO: 34350 - RNA, 32 nt, Human
acauuucuaggucacaugguaacucuauguuu

SEQ ID NO: 34351 - RNA, 32 nt, Human
acauuucuaguuuuauuuuaccaauaauuuua

SEQ ID NO: 34352 - RNA, 32 nt, Human
acauuucucaaagauuuuugagguuguauuug

SEQ ID NO: 34353 - RNA, 32 nt, Human
acauuucucacugccuucugucugcccaguuu

SEQ ID NO: 34354 - RNA, 32 nt, Human
acauuucuccacaaguggaccccacacagucg

SEQ ID NO: 34355 - RNA, 32 nt, Human
acauuucuccaccugugcccccucauguucac

SEQ ID NO: 34356 - RNA, 32 nt, Human
acauuucugccucugcugcuucagaggaugcg

SEQ ID NO: 34357 - RNA, 32 nt, Human
acauuucugugucauuucuaccacagaugcgc

SEQ ID NO: 34358 - RNA, 32 nt, Human
acauuucuguuuuucaaaauugaugcuuaauu

SEQ ID NO: 34359 - RNA, 32 nt, Human
acauuucuucagccucuccaccaagcucuuua

SEQ ID NO: 34360 - RNA, 32 nt, Human
acauuucuuucaucucucuugucuauaccuga

SEQ ID NO: 34361 - RNA, 32 nt, Human
acauuugaaaaguagaaaaauuagaaauuauu

SEQ ID NO: 34362 - RNA, 32 nt, Human
acauuugaaaccacuauuuacuuaauaauguc

SEQ ID NO: 34363 - RNA, 32 nt, Human
acauuugaacaaggggaaggggcagcuuacac

SEQ ID NO: 34364 - RNA, 32 nt, Human
acauuugaagaauucacccaggcuccagcuag

SEQ ID NO: 34365 - RNA, 22 nt, Human
acauuugacaugcccucccuca

SEQ ID NO: 34366 - RNA, 32 nt, Human
acauuugagauccaccuuacuguguuuucuac

SEQ ID NO: 34367 - RNA, 32 nt, Human
acauuugaugucuagauaacauucaugagauu

SEQ ID NO: 34368 - RNA, 32 nt, Human
acauuugauucuguguguuuuccauaauaaaa

SEQ ID NO: 34369 - RNA, 32 nt, Human
acauuugcacugacuguuuccucugccuggac

SEQ ID NO: 34370 - RNA, 32 nt, Human
acauuugccauuuuggaaagauuucugaaucg

SEQ ID NO: 34371 - RNA, 32 nt, Human
acauuugccccagggaaggucacagcugccug

SEQ ID NO: 34372 - RNA, 32 nt, Human
acauuugccguucugcaauauuugcuguucug

SEQ ID NO: 34373 - RNA, 32 nt, Human
acauuugccugugagucagagcuggaggccga

SEQ ID NO: 34374 - RNA, 32 nt, Human
acauuugcuuccuucacaggccugugugaaca

SEQ ID NO: 34375 - RNA, 32 nt, Human
acauuugcuuugagaaguggugguagaggcag

SEQ ID NO: 34376 - RNA, 32 nt, Human
acauuuggaaugcacacagcggcugccuccug

SEQ ID NO: 34377 - RNA, 32 nt, Human
acauuuggacagacuugauuuguauuuuauuu

SEQ ID NO: 34378 - RNA, 32 nt, Human
acauuuggagccauggaaucagagagaagagg

SEQ ID NO: 34379 - RNA, 32 nt, Human
acauuugggaggguggagggaggcaguguccu

SEQ ID NO: 34380 - RNA, 32 nt, Human
acauuugguaucuauuaccaagcugcccuuca

SEQ ID NO: 34381 - RNA, 32 nt, Human
acauuugguggcugaugcuguucuccuuugac

SEQ ID NO: 34382 - RNA, 32 nt, Human
acauuuguacuuuaagaaaaauuuaagugaca

SEQ ID NO: 34383 - RNA, 32 nt, Human
acauuuguagauuuuaaagaaaaauaugaaau

SEQ ID NO: 34384 - RNA, 32 nt, Human
acauuuguaggggcacuaauccagcccuuaaa

SEQ ID NO: 34385 - RNA, 32 nt, Human
acauuugucaccccacuggccuucucaggugc

SEQ ID NO: 34386 - RNA, 32 nt, Human
acauuugucagugauguugccuagaaucuucu

SEQ ID NO: 34387 - RNA, 32 nt, Human
acauuugucaucucuagggcaggcuggggcug

SEQ ID NO: 34388 - RNA, 32 nt, Human
acauuugucugccuggugcaaacaaggaaucc

SEQ ID NO: 34389 - RNA, 32 nt, Human
acauuugugauucucauuuucucaccauuaaa

SEQ ID NO: 34390 - RNA, 32 nt, Human
acauuuguuccaauggggagcuuggaagaugg

SEQ ID NO: 34391 - RNA, 32 nt, Human
acauuuguuuuuaguuaaaaguaucuacuuac

SEQ ID NO: 34392 - RNA, 32 nt, Human
acauuuuaaaaauguuuugccauagcuuuuua

SEQ ID NO: 34393 - RNA, 32 nt, Human
acauuuuaaccagcaacugguaacaaagagcu

SEQ ID NO: 34394 - RNA, 32 nt, Human
acauuuuacucucuccuccuagaaugcugccc

SEQ ID NO: 34395 - RNA, 32 nt, Human
acauuuuagcacugaggcugggguagcuuuug

SEQ ID NO: 34396 - RNA, 32 nt, Human
acauuuuaguugcagaagaaaggcuaggaaau

SEQ ID NO: 34397 - RNA, 32 nt, Human
acauuuucaaagauuuuuauuuugaaaaauga

SEQ ID NO: 34398 - RNA, 32 nt, Human
acauuuucauacugcugccuuccuacagcugc

SEQ ID NO: 34399 - RNA, 32 nt, Human
acauuuucauuucugaugcagccaccuucugg

SEQ ID NO: 34400 - RNA, 32 nt, Human
acauuuuccaaaaagaaaaauuaaaugauuau

SEQ ID NO: 34401 - RNA, 32 nt, Human
acauuuuccaaacauaaccccaaagaguacug

SEQ ID NO: 34402 - RNA, 32 nt, Human
acauuuuccccacucugucugccugcaucucc

SEQ ID NO: 34403 - RNA, 32 nt, Human
acauuuuccucuuucuccuuguuauuaggcau

SEQ ID NO: 34404 - RNA, 32 nt, Human
acauuuuccuguaaauguaugugugcauuugg

SEQ ID NO: 34405 - RNA, 32 nt, Human
acauuuuccuucauuuccagauccuuuauuuc

SEQ ID NO: 34406 - RNA, 32 nt, Human
acauuuucucuuuccuccucuugaacuuacau

SEQ ID NO: 34407 - RNA, 32 nt, Human
acauuuucugcugcugcugacagauuaaccca

SEQ ID NO: 34408 - RNA, 32 nt, Human
acauuuugaaguuuauagcuuccagauuacaa

SEQ ID NO: 34409 - RNA, 32 nt, Human
acauuuugagcagcgcgagaguagaagugaau

SEQ ID NO: 34410 - RNA, 32 nt, Human
acauuuugagguacauuguuuugucucagcua

SEQ ID NO: 34411 - RNA, 32 nt, Human
acauuuugauucuccagccugggcaacggagu

SEQ ID NO: 34412 - RNA, 31 nt, Human
acauuuugccucucucacuggucauguauuu

SEQ ID NO: 34413 - RNA, 32 nt, Human
acauuuugcucuuuggccugguguggacggaa

SEQ ID NO: 34414 - RNA, 32 nt, Human
acauuuuggucuacuuacuaugugcuagauuu

SEQ ID NO: 34415 - RNA, 32 nt, Human
acauuuuggugacuucugacucuccuuccacc

SEQ ID NO: 34416 - RNA, 32 nt, Human
acauuuuuaugaucaugacugaucagauuugc

SEQ ID NO: 34417 - RNA, 32 nt, Human
acauuuuucaaaguuacacaacagaaaugcaa

SEQ ID NO: 34418 - RNA, 32 nt, Human
acauuuuucaugcagucauuugcagugaauua

SEQ ID NO: 34419 - RNA, 32 nt, Human
acauuuuuccuggaacaagggagggaauaaau

SEQ ID NO: 34420 - RNA, 32 nt, Human
acauuuuucugcacaaacaaguuacaaaguuc

SEQ ID NO: 34421 - RNA, 32 nt, Human
acauuuuugcagcccuuuguauuuugugguag

SEQ ID NO: 34422 - RNA, 32 nt, Human
acauuuuuggucucuguuagaaguagacucug

SEQ ID NO: 34423 - RNA, 32 nt, Human
acauuuuugucuaaauagagugcaauauauaa

SEQ ID NO: 34424 - RNA, 32 nt, Human
accaaaaacacacaaagaaauuagcugggcau

SEQ ID NO: 34425 - RNA, 32 nt, Human
accaaaaaccaccuguaccccaaaaaguauug

SEQ ID NO: 34426 - RNA, 32 nt, Human
accaaaaagcuaguuuugucuaccucaguucu

SEQ ID NO: 34427 - RNA, 20 nt, Human
accaaaaagugcacaaggua

SEQ ID NO: 34428 - RNA, 23 nt, Human
accaaaaauagcagguacuucua

SEQ ID NO: 34429 - RNA, 32 nt, Human
accaaaaauucauaaucuaauaguuuaucagu

SEQ ID NO: 34430 - RNA, 32 nt, Human
accaaaacaagcagagauuaauaaccaggacu

SEQ ID NO: 34431 - RNA, 32 nt, Human
accaaaacagcuugaucuuccagaccuguucu

SEQ ID NO: 34432 - RNA, 32 nt, Human
accaaaacaugguccccaccuuuuggagcuua

SEQ ID NO: 34433 - RNA, 25 nt, Human
accaaaacccagugauugggccuua

SEQ ID NO: 34434 - RNA, 26 nt, Human
accaaaacccaugcacagugcugcag

SEQ ID NO: 34435 - RNA, 23 nt, Human
accaaaacgucuuuaggguucuc

SEQ ID NO: 34436 - RNA, 32 nt, Human
accaaaagcuggguuccaggaacuggaucaua

SEQ ID NO: 34437 - RNA, 32 nt, Human
accaaaauagugagugaucacacuucuaauag

SEQ ID NO: 34438 - RNA, 32 nt, Human
accaaaaucaagggguagggagagggaggagg

SEQ ID NO: 34439 - RNA, 32 nt, Human
accaaaaucuaacaaguaaauuuuggauuuug

SEQ ID NO: 34440 - RNA, 32 nt, Human
accaaaaucuuuccucauucacucuucacgug

SEQ ID NO: 34441 - RNA, 32 nt, Human
accaaaaugagguggugccacaggguggggca

SEQ ID NO: 34442 - RNA, 32 nt, Human
accaaacaaggcagacuugcaagaaccacggc

SEQ ID NO: 34443 - RNA, 32 nt, Human
accaaacaaguuggcuagaaagauuggaauau

SEQ ID NO: 34444 - RNA, 32 nt, Human
accaaacaauaccugcucauuuacacugagga

SEQ ID NO: 34445 - RNA, 32 nt, Human
accaaacagguuguuucucugcaguuuccaac

SEQ ID NO: 34446 - RNA, 32 nt, Human
accaaacauggcgaaaccccaucuguacugaa

SEQ ID NO: 34447 - RNA, 32 nt, Human
accaaaccaaaaauaaagaguuuaguugagga

SEQ ID NO: 34448 - RNA, 32 nt, Human
accaaaccaaaccauucuuauuuaaaccuugc

SEQ ID NO: 34449 - RNA, 32 nt, Human
accaaaccaaccaaucaaccaaacaaagaaaa

SEQ ID NO: 34450 - RNA, 18 nt, Human
accaaaccaagugccuca

SEQ ID NO: 34451 - RNA, 32 nt, Human
accaaaccacugccccucggagccugguagug

SEQ ID NO: 34452 - RNA, 32 nt, Human
accaaacccuccugauuucucuugccuuuucc

SEQ ID NO: 34453 - RNA, 32 nt, Human
accaaacccugagucaccacugacuguugccc

SEQ ID NO: 34454 - RNA, 32 nt, Human
accaaaccuauaggaagccuuccagugugagc

SEQ ID NO: 34455 - RNA, 32 nt, Human
accaaaccucccugcuaaucuccaugcccacg

SEQ ID NO: 34456 - RNA, 32 nt, Human
accaaacuaaggcuggagagagaagcgauggu

SEQ ID NO: 34457 - RNA, 32 nt, Human
accaaacuacacuguuuuaauugcuguaaauu

SEQ ID NO: 34458 - RNA, 32 nt, Human
accaaacuaugggacaguuaaacggagaguau

SEQ ID NO: 34459 - RNA, 32 nt, Human
accaaacucagaaaggcagagcagagcccagu

SEQ ID NO: 34460 - RNA, 32 nt, Human
accaaacugcacccuuucuugggugagugagc

SEQ ID NO: 34461 - RNA, 32 nt, Human
accaaacugcagcugcauggagcagccuaugg

SEQ ID NO: 34462 - RNA, 32 nt, Human
accaaacugguccccuccaccaaaaagcgggc

SEQ ID NO: 34463 - RNA, 32 nt, Human
accaaacuguaccuuagccacuuuggacacau

SEQ ID NO: 34464 - RNA, 32 nt, Human
accaaagaagugaaagaucucuacaaugaaaa

SEQ ID NO: 34465 - RNA, 32 nt, Human
accaaagacaggcaggagaugagggagguuau

SEQ ID NO: 34466 - RNA, 32 nt, Human
accaaagagaaguaacaaagauccuccguuug

SEQ ID NO: 34467 - RNA, 32 nt, Human
accaaagagcccucuuuccacgagacugaagu

SEQ ID NO: 34468 - RNA, 32 nt, Human
accaaagagcugcuuccugagaacaaguuauu

SEQ ID NO: 34469 - RNA, 32 nt, Human
accaaagagggcuuccucuagaagccaaggga

SEQ ID NO: 34470 - RNA, 32 nt, Human
accaaagauauaaucaccuagguuuacaaaua

SEQ ID NO: 34471 - RNA, 32 nt, Human
accaaagauggguggacuggaggcagcuggaa

SEQ ID NO: 34472 - RNA, 32 nt, Human
accaaagcaaaaugagaauuucacucuaccug

SEQ ID NO: 34473 - RNA, 32 nt, Human
accaaagcaauagaauuaaccuaaguguccau

SEQ ID NO: 34474 - RNA, 32 nt, Human
accaaagcagaggggcaggcagcacaccaccc

SEQ ID NO: 34475 - RNA, 32 nt, Human
accaaagcaggguuggggaaucccgaauggcc

SEQ ID NO: 34476 - RNA, 32 nt, Human
accaaagcauuuuauucgcaccuguacuuuau

SEQ ID NO: 34477 - RNA, 32 nt, Human
accaaagcccaggauggcuuggugggaguguc

SEQ ID NO: 34478 - RNA, 32 nt, Human
accaaagcccuacccuccagcacuccaaggca

SEQ ID NO: 34479 - RNA, 32 nt, Human
accaaagcucacuacugcgguuugccugugcc

SEQ ID NO: 34480 - RNA, 32 nt, Human
accaaagcugccugugccaugcccaaggccua

SEQ ID NO: 34481 - RNA, 32 nt, Human
accaaaggaaggaggaacacugaggggaaucc

SEQ ID NO: 34482 - RNA, 32 nt, Human
accaaaggagcucaguuuucaaacuuuaaugg

SEQ ID NO: 34483 - RNA, 32 nt, Human
accaaaggaggagagauguguuuuguucaaaa

SEQ ID NO: 34484 - RNA, 32 nt, Human
accaaaggcagccugccaccacccucacuguc

SEQ ID NO: 34485 - RNA, 32 nt, Human
accaaaggcaggaaggauccugccuugauuuu

SEQ ID NO: 34486 - RNA, 32 nt, Human
accaaaggcaggccuggcugggugcaguggcu

SEQ ID NO: 34487 - RNA, 32 nt, Human
accaaaggccaggaguuugaggcugcagugag

SEQ ID NO: 34488 - RNA, 32 nt, Human
accaaaggccugauuaucauaaauucauauag

SEQ ID NO: 34489 - RNA, 32 nt, Human
accaaaggccugucucucaccaacaagccaac

SEQ ID NO: 34490 - RNA, 32 nt, Human
accaaaggcugcaggugucuucacaucacagc

SEQ ID NO: 34491 - RNA, 32 nt, Human
accaaagggauuguuucucugccacccucaua

SEQ ID NO: 34492 - RNA, 32 nt, Human
accaaagguucaguccaggagcccacacagcc

SEQ ID NO: 34493 - RNA, 32 nt, Human
accaaagucacuuguuugaaaauaaaucuuua

SEQ ID NO: 34494 - RNA, 20 nt, Human
accaaagugcaggacaucaa

SEQ ID NO: 34495 - RNA, 32 nt, Human
accaaaguuugagaacugggaacuucaugcug

SEQ ID NO: 34496 - RNA, 32 nt, Human
accaaauacucuuauggggcaggcugggcaug

SEQ ID NO: 34497 - RNA, 32 nt, Human
accaaaucaacaacaaccuauuuagcuguucc

SEQ ID NO: 34498 - RNA, 32 nt, Human
accaaaucuaucucccuagugcagugucucca

SEQ ID NO: 34499 - RNA, 32 nt, Human
accaaaugacaccugcaggcucuaagccuuuc

SEQ ID NO: 34500 - RNA, 32 nt, Human
accaaaugccuaaaauuuuauuuuuaaaaagg

SEQ ID NO: 34501 - RNA, 30 nt, Human
accaaauggcaugcugggagaaaaugaaac

SEQ ID NO: 34502 - RNA, 32 nt, Human
accaaauggggaagaauuaggaaauaaucaug

SEQ ID NO: 34503 - RNA, 32 nt, Human
accaaaugguggggacccugagcccagcucug

SEQ ID NO: 34504 - RNA, 32 nt, Human
accaaauguucccugguuaugauucugaaagc

SEQ ID NO: 34505 - RNA, 32 nt, Human
accaaauuaccuaggcugagguuagagagauu

SEQ ID NO: 34506 - RNA, 32 nt, Human
accaaauucccaggaaucuugaaugcuuucuc

SEQ ID NO: 34507 - RNA, 32 nt, Human
accaaauuugguguuuguuuucaccuugacgc

SEQ ID NO: 34508 - RNA, 32 nt, Human
accaaauuuguccccucuucucucuguuaagg

SEQ ID NO: 34509 - RNA, 32 nt, Human
accaacaacacagacaagacccuguuuacaac

SEQ ID NO: 34510 - RNA, 32 nt, Human
accaacaaccaccacuacaccacacaugcuua

SEQ ID NO: 34511 - RNA, 32 nt, Human
accaacaaccucaacugccuacuccaaaaugu

SEQ ID NO: 34512 - RNA, 32 nt, Human
accaacaagccuucccccuccugcuggacaca

SEQ ID NO: 34513 - RNA, 20 nt, Human
accaacacaaaaagauguaa

SEQ ID NO: 34514 - RNA, 32 nt, Human
accaacacaccacucauuggaaaauggaaaaa

SEQ ID NO: 34515 - RNA, 32 nt, Human
accaacaccgugagugcagcaugccaucggcc

SEQ ID NO: 34516 - RNA, 32 nt, Human
accaacacuccuguaauuccaauaaagcaguu

SEQ ID NO: 34517 - RNA, 26 nt, Human
accaacacugacccuugaaccaauaa

SEQ ID NO: 34518 - RNA, 32 nt, Human
accaacacugccuuccuccagccugucccucc

SEQ ID NO: 34519 - RNA, 32 nt, Human
accaacagcaggaggagcaggaggagccggag

SEQ ID NO: 34520 - RNA, 32 nt, Human
accaacagccauucaucaucugaucucugcug

SEQ ID NO: 34521 - RNA, 32 nt, Human
accaacagccucugcaaucaggaaaagggagg

SEQ ID NO: 34522 - RNA, 32 nt, Human
accaacagguuucaguuccaacagaaaggucg

SEQ ID NO: 34523 - RNA, 32 nt, Human
accaacaguccccggugaagcugcaggacuuc

SEQ ID NO: 34524 - RNA, 32 nt, Human
accaacauaccagcaaaggaugcagcaccagu

SEQ ID NO: 34525 - RNA, 32 nt, Human
accaacaucugcucagcuucuggugaggccca

SEQ ID NO: 34526 - RNA, 32 nt, Human
accaacaucuguccuuagaaaggaccaucuca

SEQ ID NO: 34527 - RNA, 32 nt, Human
accaacaucuuucuaaacugcaaaggauauca

SEQ ID NO: 34528 - RNA, 32 nt, Human
accaacaugccuggcuaauuuuuguacuuuua

SEQ ID NO: 34529 - RNA, 32 nt, Human
accaacauggagaaacccccaucucuacugaa

SEQ ID NO: 34530 - RNA, 21 nt, Human
accaacauggagaaacccugu

SEQ ID NO: 34531 - RNA, 21 nt, Human
accaacauggcgaaacccugu

SEQ ID NO: 34532 - RNA, 19 nt, Human
accaacaugguaugggguu

SEQ ID NO: 34533 - RNA, 32 nt, Human
accaacauggugaaaaccccaucucuacuaaa

SEQ ID NO: 34534 - RNA, 21 nt, Human
accaacauggugaaaccucgu

SEQ ID NO: 34535 - RNA, 32 nt, Human
accaacauuaauuccauaugaaucaaguguuu

SEQ ID NO: 34536 - RNA, 17 nt, Human
accaaccaacaagggga

SEQ ID NO: 34537 - RNA, 32 nt, Human
accaaccaaccaaccaaccaaccaacaaacaa

SEQ ID NO: 34538 - RNA, 32 nt, Human
accaaccaaccaaccaaccaaccacaaaccac

SEQ ID NO: 34539 - RNA, 32 nt, Human
accaaccaaccaaccaaccacaaaccacccua

SEQ ID NO: 34540 - RNA, 32 nt, Human
accaaccaacuggccuguaucuaucuaucugg

SEQ ID NO: 34541 - RNA, 32 nt, Human
accaaccaaggagccuccagaaggaaaggagg

SEQ ID NO: 34542 - RNA, 32 nt, Human
accaaccaaguaugccccaaaccaaaggguuu

SEQ ID NO: 34543 - RNA, 32 nt, Human
accaaccacaucuggucucugccuucgguggc

SEQ ID NO: 34544 - RNA, 32 nt, Human
accaaccaccaccaccaccaaaaccaguuuau

SEQ ID NO: 34545 - RNA, 29 nt, Human
accaaccaccagacaagcagcugcagucu

SEQ ID NO: 34546 - RNA, 32 nt, Human
accaaccaccuugccggguguccucagccacc

SEQ ID NO: 34547 - RNA, 32 nt, Human
accaaccacgaccaccaccaccaccaccacuc

SEQ ID NO: 34548 - RNA, 32 nt, Human
accaaccagccaagaugaacauggugaagagg

SEQ ID NO: 34549 - RNA, 22 nt, Human
accaaccaggaagcagcuugaa

SEQ ID NO: 34550 - RNA, 32 nt, Human
accaaccaggguaguggcauggagcaccguaa

SEQ ID NO: 34551 - RNA, 32 nt, Human
accaaccagugagaauuucuuccuucagacgg

SEQ ID NO: 34552 - RNA, 32 nt, Human
accaaccauagaacuuuauaauaggacaguua

SEQ ID NO: 34553 - RNA, 32 nt, Human
accaacccaaauguccauccacaguugaagcu

SEQ ID NO: 34554 - RNA, 32 nt, Human
accaacccagggagucaaggaccagcaaacca

SEQ ID NO: 34555 - RNA, 32 nt, Human
accaaccccagggagauguuugcaguguggag

SEQ ID NO: 34556 - RNA, 32 nt, Human
accaacccggggacuggugccucugccugauc

SEQ ID NO: 34557 - RNA, 32 nt, Human
accaacccucagggagcccucagucuggugga

SEQ ID NO: 34558 - RNA, 32 nt, Human
accaacccuccaggacgaaguuucagaauugg

SEQ ID NO: 34559 - RNA, 32 nt, Human
accaacccucugcccccggcucaggccagagc

SEQ ID NO: 34560 - RNA, 32 nt, Human
accaacccugauuuccugcuucuccuuuucau

SEQ ID NO: 34561 - RNA, 32 nt, Human
accaacccugcaggccucaucuuucccaaaac

SEQ ID NO: 34562 - RNA, 32 nt, Human
accaacccuggcaacauaacaagacccugucu

SEQ ID NO: 34563 - RNA, 32 nt, Human
accaacccuguacugauucauugcacauaaau

SEQ ID NO: 34564 - RNA, 23 nt, Human
accaaccgaccaacauggugaaa

SEQ ID NO: 34565 - RNA, 19 nt, Human
accaaccgccccgcugcca

SEQ ID NO: 34566 - RNA, 22 nt, Human
accaaccgccuugcauccagug

SEQ ID NO: 34567 - RNA, 21 nt, Human
accaaccuagccaacauggug

SEQ ID NO: 34568 - RNA, 24 nt, Human
accaaccuagccaacauggugaaa

SEQ ID NO: 34569 - RNA, 24 nt, Human
accaaccuagucaacauggugaaa

SEQ ID NO: 34570 - RNA, 22 nt, Human
accaaccuccaacauggugaaa

SEQ ID NO: 34571 - RNA, 19 nt, Human
accaaccugaccaacaugg

SEQ ID NO: 34572 - RNA, 24 nt, Human
accaaccugaccaacauggagaaa

SEQ ID NO: 34573 - RNA, 24 nt, Human
accaaccugacuaacauggugaaa

SEQ ID NO: 34574 - RNA, 24 nt, Human
accaaccugagcaacauggcgaaa

SEQ ID NO: 34575 - RNA, 32 nt, Human
accaaccuggacaacauagcaagaccccaucu

SEQ ID NO: 34576 - RNA, 21 nt, Human
accaaccuggccaaaguggug

SEQ ID NO: 34577 - RNA, 24 nt, Human
accaaccuggccaaaguggugaaa

SEQ ID NO: 34578 - RNA, 32 nt, Human
accaaccuggccaacacagugagacccugucu

SEQ ID NO: 34579 - RNA, 18 nt, Human
accaaccuggccaacaug

SEQ ID NO: 34580 - RNA, 21 nt, Human
accaaccuggccaacauggug

SEQ ID NO: 34581 - RNA, 24 nt, Human
accaaccuggccaacauggugaaa

SEQ ID NO: 34582 - RNA, 24 nt, Human
accaaccuggccaacauguugaaa

SEQ ID NO: 34583 - RNA, 21 nt, Human
accaaccuggccaacauugug

SEQ ID NO: 34584 - RNA, 24 nt, Human
accaaccuggccaacauugugaaa

SEQ ID NO: 34585 - RNA, 21 nt, Human
accaaccuggcuaacacggug

SEQ ID NO: 34586 - RNA, 24 nt, Human
accaaccuggcuaacacggugaaa

SEQ ID NO: 34587 - RNA, 32 nt, Human
accaaccugggcaacaccgugagaccccaucu

SEQ ID NO: 34588 - RNA, 32 nt, Human
accaaccugggcaacauagugagacccccauc

SEQ ID NO: 34589 - RNA, 32 nt, Human
accaaccugggcaauauagugagacccuauuu

SEQ ID NO: 34590 - RNA, 32 nt, Human
accaaccugggugacagagcaagauugcaucu

SEQ ID NO: 34591 - RNA, 19 nt, Human
accaaccuggucagcaugg

SEQ ID NO: 34592 - RNA, 24 nt, Human
accaaccuggucuacauggugaaa

SEQ ID NO: 34593 - RNA, 24 nt, Human
accaaccugguuaacauggugaaa

SEQ ID NO: 34594 - RNA, 32 nt, Human
accaaccuuacccucguccccaacacaauccu

SEQ ID NO: 34595 - RNA, 22 nt, Human
accaaccuuucccagggcggca

SEQ ID NO: 34596 - RNA, 32 nt, Human
accaacgaaauccuaagcagcugagaccuuuc

SEQ ID NO: 34597 - RNA, 19 nt, Human
accaacgagucacagggua

SEQ ID NO: 34598 - RNA, 31 nt, Human
accaacggcaagagaggcugaucugucuaca

SEQ ID NO: 34599 - RNA, 32 nt, Human
accaacgggggaggggacgcugagcgcgccgu

SEQ ID NO: 34600 - RNA, 32 nt, Human
accaacggucucccccucccagcuucuuaccu

SEQ ID NO: 34601 - RNA, 21 nt, Human
accaacgugguaaaacccugu

SEQ ID NO: 34602 - RNA, 32 nt, Human
accaacuacuguagaagaugaggaaucuauug

SEQ ID NO: 34603 - RNA, 20 nt, Human
accaacucagcagcaaggug

SEQ ID NO: 34604 - RNA, 32 nt, Human
accaacucccaaaauauagguuacucuuguuc

SEQ ID NO: 34605 - RNA, 32 nt, Human
accaacucgaguguucagcccugugugcucuc

SEQ ID NO: 34606 - RNA, 32 nt, Human
accaacucugccaacggagccagcacagcuau

SEQ ID NO: 34607 - RNA, 32 nt, Human
accaacucuuucucucucugguguuuucuccu

SEQ ID NO: 34608 - RNA, 20 nt, Human
accaacugauuaugcaaggu

SEQ ID NO: 34609 - RNA, 22 nt, Human
accaacugcaaacaccccaggu

SEQ ID NO: 34610 - RNA, 32 nt, Human
accaacugcauugguuuuccaugaccuuaagg

SEQ ID NO: 34611 - RNA, 19 nt, Human
accaacugcuugcugaggu

SEQ ID NO: 34612 - RNA, 32 nt, Human
accaacugucuucuggaucuauuggauaucua

SEQ ID NO: 34613 - RNA, 32 nt, Human
accaacuguggacuuggaauaucagcagagua

SEQ ID NO: 34614 - RNA, 32 nt, Human
accaacuuagucaccaccccugccuccgguga

SEQ ID NO: 34615 - RNA, 32 nt, Human
accaacuuauuuagagcgaauuggacauggau

SEQ ID NO: 34616 - RNA, 32 nt, Human
accaacuugacaggggugcccaguuaccccac

SEQ ID NO: 34617 - RNA, 32 nt, Human
accaacuuggacaacauagugagaacccuuuc

SEQ ID NO: 34618 - RNA, 24 nt, Human
accaacuugggcaacauggugaaa

SEQ ID NO: 34619 - RNA, 32 nt, Human
accaacuuuaugccacuaagucauagccucag

SEQ ID NO: 34620 - RNA, 32 nt, Human
accaacuuuuauguaacaaacagccccucccc

SEQ ID NO: 34621 - RNA, 32 nt, Human
accaagaaaaugguuugcacgacuuugaacau

SEQ ID NO: 34622 - RNA, 32 nt, Human
accaagaacguuauucuuaaucuggaaauuug

SEQ ID NO: 34623 - RNA, 32 nt, Human
accaagaacucuuuccuguaauaagcaggauc

SEQ ID NO: 34624 - RNA, 32 nt, Human
accaagaacugcagcuugaggaauucucucca

SEQ ID NO: 34625 - RNA, 32 nt, Human
accaagaagaauugaggcugcuugggaggaag

SEQ ID NO: 34626 - RNA, 21 nt, Human
accaagaagagcgcucugcag

SEQ ID NO: 34627 - RNA, 32 nt, Human
accaagaagaucugggcagcuucuguuccugc

SEQ ID NO: 34628 - RNA, 32 nt, Human
accaagaagcagggaaauggacccaguggccu

SEQ ID NO: 34629 - RNA, 32 nt, Human
accaagaagccacgcauuuccccaaggucucc

SEQ ID NO: 34630 - RNA, 32 nt, Human
accaagaaucaacuugcaaaucugccauuaaa

SEQ ID NO: 34631 - RNA, 32 nt, Human
accaagacagaguugagucccacagcaaggga

SEQ ID NO: 34632 - RNA, 32 nt, Human
accaagacaggcucggagccaucagcugggug

SEQ ID NO: 34633 - RNA, 32 nt, Human
accaagaccagccuggccaagauggugaaacc

SEQ ID NO: 34634 - RNA, 32 nt, Human
accaagaccuucccauuccuccuccccacaug

SEQ ID NO: 34635 - RNA, 32 nt, Human
accaagacuccagagcagguggguucuugaug

SEQ ID NO: 34636 - RNA, 32 nt, Human
accaagacuucacccaaccacgguccuucacu

SEQ ID NO: 34637 - RNA, 32 nt, Human
accaagagaaaccaaacccaaacuccuuccuu

SEQ ID NO: 34638 - RNA, 32 nt, Human
accaagagaacccagaacugguucagagaucc

SEQ ID NO: 34639 - RNA, 23 nt, Human
accaagagaacuaacggcugcgg

SEQ ID NO: 34640 - RNA, 32 nt, Human
accaagagacaggcagcucaccaggguggaca

SEQ ID NO: 34641 - RNA, 32 nt, Human
accaagagaggaaggagaagggucccgugaac

SEQ ID NO: 34642 - RNA, 32 nt, Human
accaagagaguguuucuucacucaacucaggu

SEQ ID NO: 34643 - RNA, 32 nt, Human
accaagagauccucugucaagagaauuuccug

SEQ ID NO: 34644 - RNA, 32 nt, Human
accaagagcagcaagaacaaaagggagacuga

SEQ ID NO: 34645 - RNA, 32 nt, Human
accaagagcaggaagagguugcuggagcaaga

SEQ ID NO: 34646 - RNA, 25 nt, Human
accaagagcaggcaaagacacggga

SEQ ID NO: 34647 - RNA, 32 nt, Human
accaagagccucccugccguucgcugaguccc

SEQ ID NO: 34648 - RNA, 32 nt, Human
accaagagccuucucucuuccuguugacacuu

SEQ ID NO: 34649 - RNA, 32 nt, Human
accaagagcucucccgccuucucccucgagca

SEQ ID NO: 34650 - RNA, 32 nt, Human
accaagagcuguggacacagcacuccaacuua

SEQ ID NO: 34651 - RNA, 32 nt, Human
accaagagcuguucuucccagaagagcccugc

SEQ ID NO: 34652 - RNA, 32 nt, Human
accaagaggaagaugaagccuaccaggaauua

SEQ ID NO: 34653 - RNA, 32 nt, Human
accaagagggauuaacaagcagaggaguggug

SEQ ID NO: 34654 - RNA, 32 nt, Human
accaagagggcugagggugagguguggaaggg

SEQ ID NO: 34655 - RNA, 32 nt, Human
accaagaggggcucugccauuaguuggacccu

SEQ ID NO: 34656 - RNA, 23 nt, Human
accaagagucuugcuaccaggag

SEQ ID NO: 34657 - RNA, 23 nt, Human
accaagagugaccuacacacgag

SEQ ID NO: 34658 - RNA, 20 nt, Human
accaagagugaggggcagag

SEQ ID NO: 34659 - RNA, 22 nt, Human
accaagagugccccaccaagag

SEQ ID NO: 34660 - RNA, 32 nt, Human
accaagauauuccuuucaucucugguugaguu

SEQ ID NO: 34661 - RNA, 32 nt, Human
accaagaugauuccaaugagggguuggaauua

SEQ ID NO: 34662 - RNA, 32 nt, Human
accaagaugcccguuggccucugagcagucac

SEQ ID NO: 34663 - RNA, 32 nt, Human
accaagcacaugcacugauccaccgcacgaug

SEQ ID NO: 34664 - RNA, 32 nt, Human
accaagcagaagugaagagaaaagaggaggac

SEQ ID NO: 34665 - RNA, 32 nt, Human
accaagcagacuggagggaaagagugaggcca

SEQ ID NO: 34666 - RNA, 32 nt, Human
accaagcagaggugacauggugccaucaggag

SEQ ID NO: 34667 - RNA, 24 nt, Human
accaagcagcaggaauucaaagcu

SEQ ID NO: 34668 - RNA, 21 nt, Human
accaagcagcuuguggcggcu

SEQ ID NO: 34669 - RNA, 23 nt, Human
accaagcauuggaggaauaucgu

SEQ ID NO: 34670 - RNA, 32 nt, Human
accaagccaaagcaaaggaugcagccccucgg

SEQ ID NO: 34671 - RNA, 32 nt, Human
accaagccaagagggcuugggggugugcaggc

SEQ ID NO: 34672 - RNA, 21 nt, Human
accaagccacagcagguccuc

SEQ ID NO: 34673 - RNA, 32 nt, Human
accaagcccagccaauuguuuguauuuucagu

SEQ ID NO: 34674 - RNA, 32 nt, Human
accaagccccuucagcuucucccuccggaucg

SEQ ID NO: 34675 - RNA, 32 nt, Human
accaagcccggccaccacgcauggcaugcugu

SEQ ID NO: 34676 - RNA, 32 nt, Human
accaagcccuacucucuaguuuuccauauaau

SEQ ID NO: 34677 - RNA, 32 nt, Human
accaagcccuacuuuuguucuucuauaggccc

SEQ ID NO: 34678 - RNA, 32 nt, Human
accaagcccugcccccagcccaagaggagccc

SEQ ID NO: 34679 - RNA, 19 nt, Human
accaagcgauuugguccca

SEQ ID NO: 34680 - RNA, 22 nt, Human
accaagcucuccugggguuccc

SEQ ID NO: 34681 - RNA, 32 nt, Human
accaagcucugucucagaauugcacauguggc

SEQ ID NO: 34682 - RNA, 18 nt, Human
accaagcugacucacaag

SEQ ID NO: 34683 - RNA, 32 nt, Human
accaagcugagacccccauccccagcugcucu

SEQ ID NO: 34684 - RNA, 25 nt, Human
accaagcugauggggagggacuugu

SEQ ID NO: 34685 - RNA, 32 nt, Human
accaagcuggacugcaguggcaugaucucggc

SEQ ID NO: 34686 - RNA, 32 nt, Human
accaagcuggucucuaacuccugggcuuaagu

SEQ ID NO: 34687 - RNA, 32 nt, Human
accaagcuuccacccuuuuauaauaggaaggg

SEQ ID NO: 34688 - RNA, 23 nt, Human
accaagcuuuccugaccaccuga

SEQ ID NO: 34689 - RNA, 21 nt, Human
accaaggaccaguccaccuga

SEQ ID NO: 34690 - RNA, 16 nt, Human
accaaggacccaucaa

SEQ ID NO: 34691 - RNA, 32 nt, Human
accaaggagagagguugacaugaccuccccgc

SEQ ID NO: 34692 - RNA, 32 nt, Human
accaaggagaggggagcaaaugguuuugggca

SEQ ID NO: 34693 - RNA, 32 nt, Human
accaaggagagucuggacaaagcuacugaaac

SEQ ID NO: 34694 - RNA, 32 nt, Human
accaaggaggcagagguuguaguaagcugaca

SEQ ID NO: 34695 - RNA, 32 nt, Human
accaaggagguggagguugcagugagccggga

SEQ ID NO: 34696 - RNA, 32 nt, Human
accaaggcaagggggaugagaguucacggggc

SEQ ID NO: 34697 - RNA, 31 nt, Human
accaaggcaaugucuuacuaccucagcucag

SEQ ID NO: 34698 - RNA, 32 nt, Human
accaaggcacuccagccugggugacagaguga

SEQ ID NO: 34699 - RNA, 32 nt, Human
accaaggcagucucacuucucaaugacuggac

SEQ ID NO: 34700 - RNA, 32 nt, Human
accaaggccacagggagcuccaccuucucugg

SEQ ID NO: 34701 - RNA, 32 nt, Human
accaaggccaguagaaagcuauggcugcaaaa

SEQ ID NO: 34702 - RNA, 32 nt, Human
accaaggccaucuggagacuccuggcuuucug

SEQ ID NO: 34703 - RNA, 32 nt, Human
accaaggccauggaaguggaggcugcagaggc

SEQ ID NO: 34704 - RNA, 21 nt, Human
accaaggccccuccccaccau

SEQ ID NO: 34705 - RNA, 32 nt, Human
accaaggcccuugcaucuccccagaucguuuc

SEQ ID NO: 34706 - RNA, 32 nt, Human
accaaggcucauacuguccuguccuuacccuc

SEQ ID NO: 34707 - RNA, 32 nt, Human
accaaggcuuaggaauuucucaggccaccuua

SEQ ID NO: 34708 - RNA, 32 nt, Human
accaagggacuccaccaccaagucacuucccc

SEQ ID NO: 34709 - RNA, 32 nt, Human
accaagggagagaggggcccagggguagggaa

SEQ ID NO: 34710 - RNA, 32 nt, Human
accaagggaggcacuagcaagagguuggaggg

SEQ ID NO: 34711 - RNA, 32 nt, Human
accaagggaguuaaccuaccugaacuaaguag

SEQ ID NO: 34712 - RNA, 32 nt, Human
accaagggaucugccauugggacccuccagug

SEQ ID NO: 34713 - RNA, 32 nt, Human
accaagggauguggaguccaggcuggguccua

SEQ ID NO: 34714 - RNA, 32 nt, Human
accaagggcaaaaacuagaaacuguaacugcc

SEQ ID NO: 34715 - RNA, 32 nt, Human
accaagggcccucacucaggaacccuggagac

SEQ ID NO: 34716 - RNA, 32 nt, Human
accaagggccuccuggaaacaccagcucugac

SEQ ID NO: 34717 - RNA, 32 nt, Human
accaaggucacugagccaggacuggacccagg

SEQ ID NO: 34718 - RNA, 24 nt, Human
accaaggugaagccacugcugcag

SEQ ID NO: 34719 - RNA, 19 nt, Human
accaaggugagcagggccc

SEQ ID NO: 34720 - RNA, 32 nt, Human
accaagguggcagagguugcaguaagccaaga

SEQ ID NO: 34721 - RNA, 32 nt, Human
accaaggugugaacaugcccugaugccuaacc

SEQ ID NO: 34722 - RNA, 32 nt, Human
accaagguucuuuuuguuuacacaauacuuga

SEQ ID NO: 34723 - RNA, 32 nt, Human
accaagguuuugaaaucccaucaggucaccgc

SEQ ID NO: 34724 - RNA, 32 nt, Human
accaaguaaacccaggcagcgaggggcaaagc

SEQ ID NO: 34725 - RNA, 32 nt, Human
accaaguacagucucucgccugugcugucuca

SEQ ID NO: 34726 - RNA, 32 nt, Human
accaaguaccaguauaagcaucugccaucugc

SEQ ID NO: 34727 - RNA, 32 nt, Human
accaaguagaaggcacaugugcucugauggcc

SEQ ID NO: 34728 - RNA, 32 nt, Human
accaaguagcuccucuccugaaguaaauuuua

SEQ ID NO: 34729 - RNA, 32 nt, Human
accaaguagcuggagguggugaucagaugauc

SEQ ID NO: 34730 - RNA, 32 nt, Human
accaagucauucaccugaacaccagaauuaga

SEQ ID NO: 34731 - RNA, 32 nt, Human
accaaguccaaggccaggucucagucgguguc

SEQ ID NO: 34732 - RNA, 32 nt, Human
accaagucuccucaugaaaaccacagugaguc

SEQ ID NO: 34733 - RNA, 32 nt, Human
accaagucuccuccugugucacccugcggggc

SEQ ID NO: 34734 - RNA, 32 nt, Human
accaagucuguuucuuguuuuguauuuucucu

SEQ ID NO: 34735 - RNA, 32 nt, Human
accaagucuuggaggugauguguuacauuacg

SEQ ID NO: 34736 - RNA, 32 nt, Human
accaagugaaacgucucacaggcccaggacuu

SEQ ID NO: 34737 - RNA, 32 nt, Human
accaagugaagaggaggagaaagagucaacca

SEQ ID NO: 34738 - RNA, 32 nt, Human
accaagugagugagaggcagagcgaggacgcc

SEQ ID NO: 34739 - RNA, 32 nt, Human
accaagugauggaagagguuggaagugaauaa

SEQ ID NO: 34740 - RNA, 32 nt, Human
accaagugauggagaacggugucuggaauauu

SEQ ID NO: 34741 - RNA, 32 nt, Human
accaaguggaaccagaacaaggccccgacagg

SEQ ID NO: 34742 - RNA, 32 nt, Human
accaagugucugcaaguaaacaccuggaggug

SEQ ID NO: 34743 - RNA, 32 nt, Human
accaagugucugcaaguaacaccuggagguga

SEQ ID NO: 34744 - RNA, 32 nt, Human
accaagugugggcccacauggugugggccuuu

SEQ ID NO: 34745 - RNA, 32 nt, Human
accaaguucaaaacacuuucagauagaagucu

SEQ ID NO: 34746 - RNA, 24 nt, Human
accaaguuuucuuuucuucuccca

SEQ ID NO: 34747 - RNA, 32 nt, Human
accaauaaucacaacauguaauucagcaaaac

SEQ ID NO: 34748 - RNA, 32 nt, Human
accaauagaaauaaagauacauguggguguug

SEQ ID NO: 34749 - RNA, 32 nt, Human
accaauagagcagggaaagggaaauguagaua

SEQ ID NO: 34750 - RNA, 32 nt, Human
accaauagcccgugacacagaccucaggagau

SEQ ID NO: 34751 - RNA, 32 nt, Human
accaauagggcugagcucucugugggcuggca

SEQ ID NO: 34752 - RNA, 32 nt, Human
accaauauacaguggggcugaagucugcaagg

SEQ ID NO: 34753 - RNA, 32 nt, Human
accaauauacuuuuuaaaauuugguuauuuuu

SEQ ID NO: 34754 - RNA, 32 nt, Human
accaauaucuucuucaggcucugacaggccuc

SEQ ID NO: 34755 - RNA, 31 nt, Human
accaaucacagcucaugccgagguggaggua

SEQ ID NO: 34756 - RNA, 32 nt, Human
accaaucaccaccacagccugcaagugcacug

SEQ ID NO: 34757 - RNA, 32 nt, Human
accaaucagcauaggaaucugagaauugcucu

SEQ ID NO: 34758 - RNA, 32 nt, Human
accaaucaugccuucccagcagucccucaaag

SEQ ID NO: 34759 - RNA, 32 nt, Human
accaauccagaugccagcagccugucaaucac

SEQ ID NO: 34760 - RNA, 32 nt, Human
accaauccgcgcagggcagcgaggaggagcca

SEQ ID NO: 34761 - RNA, 32 nt, Human
accaauccucagccacuuugguguuuucucaa

SEQ ID NO: 34762 - RNA, 32 nt, Human
accaauccugggaggugggagcuggaaugggg

SEQ ID NO: 34763 - RNA, 32 nt, Human
accaaucuaggcaauguagugagacccugucu

SEQ ID NO: 34764 - RNA, 32 nt, Human
accaaucuggggcuggaaauguuaggagguug

SEQ ID NO: 34765 - RNA, 32 nt, Human
accaaugaagaagacaaagucuaaggaagaau

SEQ ID NO: 34766 - RNA, 32 nt, Human
accaaugcaguuucaccugcagagcucacccc

SEQ ID NO: 34767 - RNA, 32 nt, Human
accaaugccagaagaaaggggcuguagacccc

SEQ ID NO: 34768 - RNA, 32 nt, Human
accaaugcccacuuccccuccugggucaccuc

SEQ ID NO: 34769 - RNA, 32 nt, Human
accaauggcacccagagagggcauggaggcuc

SEQ ID NO: 34770 - RNA, 32 nt, Human
accaauggcccuuccaagagcugguuuuagag

SEQ ID NO: 34771 - RNA, 32 nt, Human
accaauggccuauuagcccccaaaaaguuagu

SEQ ID NO: 34772 - RNA, 32 nt, Human
accaaugggaggacggcggcgcagcccgcucc

SEQ ID NO: 34773 - RNA, 32 nt, Human
accaaugggcaauagagguugagagagauuca

SEQ ID NO: 34774 - RNA, 32 nt, Human
accaauggggacaccagcugaagacuggaagg

SEQ ID NO: 34775 - RNA, 32 nt, Human
accaaugugcuccgcuacauccagcugacuca

SEQ ID NO: 34776 - RNA, 32 nt, Human
accaauguggagagaggaagguggcaggucug

SEQ ID NO: 34777 - RNA, 32 nt, Human
accaaugugggccaaguggccaugaagggaga

SEQ ID NO: 34778 - RNA, 32 nt, Human
accaauguuauuuucaaaauauuugaaaucca

SEQ ID NO: 34779 - RNA, 32 nt, Human
accaauuauauuaaucaaauggaaauuaauug

SEQ ID NO: 34780 - RNA, 32 nt, Human
accaauuccugguuaaugaagggagagugugg

SEQ ID NO: 34781 - RNA, 32 nt, Human
accaauucuacccugcuccucuuuuccuuuuc

SEQ ID NO: 34782 - RNA, 32 nt, Human
accaauugcugcccaucuggccugugugccca

SEQ ID NO: 34783 - RNA, 32 nt, Human
accaauugguagaaucagaaacugucuuugga

SEQ ID NO: 34784 - RNA, 22 nt, Human
accaauugucaugcuugacaca

SEQ ID NO: 34785 - RNA, 32 nt, Human
accaauuguccaaccuccauuacaggggucuu

SEQ ID NO: 34786 - RNA, 20 nt, Human
accaauuucaauuuccuggu

SEQ ID NO: 34787 - RNA, 32 nt, Human
accaauuuccucccccuccucacucucacaag

SEQ ID NO: 34788 - RNA, 32 nt, Human
accaauuuguagaaugaauacauauuuucaaa

SEQ ID NO: 34789 - RNA, 32 nt, Human
accacaaacccugcugaacacagugucuguuc

SEQ ID NO: 34790 - RNA, 32 nt, Human
accacaaagcugaccaacuccugcuuccuuaa

SEQ ID NO: 34791 - RNA, 32 nt, Human
accacaacacgccaccgggagagaugcugaga

SEQ ID NO: 34792 - RNA, 32 nt, Human
accacaaccagcuucuccaggucauaugugcc

SEQ ID NO: 34793 - RNA, 24 nt, Human
accacaaccuccaccucccagguu

SEQ ID NO: 34794 - RNA, 24 nt, Human
accacaaccuccaccucccggguu

SEQ ID NO: 34795 - RNA, 24 nt, Human
accacaaccuccaccuccuggguu

SEQ ID NO: 34796 - RNA, 24 nt, Human
accacaaccuccgccucccagguu

SEQ ID NO: 34797 - RNA, 32 nt, Human
accacaaccugacacugggcaagauggcccac

SEQ ID NO: 34798 - RNA, 24 nt, Human
accacaaccuucaccuccccgguu

SEQ ID NO: 34799 - RNA, 23 nt, Human
accacaagaggcagggcagcggg

SEQ ID NO: 34800 - RNA, 32 nt, Human
accacaagccagccccucgcccucucuguggc

SEQ ID NO: 34801 - RNA, 32 nt, Human
accacaagcccgagggcaggcuugaguuaggc

SEQ ID NO: 34802 - RNA, 32 nt, Human
accacaaggaagcgaaacugggugcguucacu

SEQ ID NO: 34803 - RNA, 32 nt, Human
accacaaguccccaagagugugauauuccccu

SEQ ID NO: 34804 - RNA, 31 nt, Human
accacaauaaagagcccuccacccuccccac

SEQ ID NO: 34805 - RNA, 32 nt, Human
accacaaucaacuauugacacaugcuugcagg

SEQ ID NO: 34806 - RNA, 32 nt, Human
accacaauccacugacucaaccaggaaaucau

SEQ ID NO: 34807 - RNA, 32 nt, Human
accacaauccuccuccuccucuccaggggccu

SEQ ID NO: 34808 - RNA, 27 nt, Human
accacaaugagauaccaucucaugcca

SEQ ID NO: 34809 - RNA, 31 nt, Human
accacaaugccuggccccuguguguguacau

SEQ ID NO: 34810 - RNA, 32 nt, Human
accacacaaaggcaaggagcugaccaggaggu

SEQ ID NO: 34811 - RNA, 32 nt, Human
accacacaaggcaguugcccaaaccauucugu

SEQ ID NO: 34812 - RNA, 24 nt, Human
accacacaauauucccauguaaca

SEQ ID NO: 34813 - RNA, 23 nt, Human
accacacacacauggcaugcaug

SEQ ID NO: 34814 - RNA, 23 nt, Human
accacacaccaugggccucuaua

SEQ ID NO: 34815 - RNA, 32 nt, Human
accacacacucaggaagccuugucuaccuuuc

SEQ ID NO: 34816 - RNA, 21 nt, Human
accacacacuugugugcgugu

SEQ ID NO: 34817 - RNA, 32 nt, Human
accacacagaagucuggucaccucugggcgcc

SEQ ID NO: 34818 - RNA, 32 nt, Human
accacacagacaggguuucaccauguuggcca

SEQ ID NO: 34819 - RNA, 18 nt, Human
accacacagaggcugccu

SEQ ID NO: 34820 - RNA, 32 nt, Human
accacacagauguuccugucuccucgcauggg

SEQ ID NO: 34821 - RNA, 32 nt, Human
accacacagucuuucuuagccauuccaaaaag

SEQ ID NO: 34822 - RNA, 18 nt, Human
accacacauauguuauca

SEQ ID NO: 34823 - RNA, 32 nt, Human
accacacaugauuuuauuuuucucuuccuuug

SEQ ID NO: 34824 - RNA, 32 nt, Human
accacacauggucuccccaccugguuucagcu

SEQ ID NO: 34825 - RNA, 22 nt, Human
accacaccacaccucacugccc

SEQ ID NO: 34826 - RNA, 32 nt, Human
accacaccacugcacuccauccugggcaacag

SEQ ID NO: 34827 - RNA, 32 nt, Human
accacaccacugcacuccugccugggcaauag

SEQ ID NO: 34828 - RNA, 32 nt, Human
accacaccacugcuuuucagcauuguacugga

SEQ ID NO: 34829 - RNA, 22 nt, Human
accacaccagaaaugggaccua

SEQ ID NO: 34830 - RNA, 31 nt, Human
accacaccaguguccaugcccagagguucug

SEQ ID NO: 34831 - RNA, 19 nt, Human
accacaccaucccgagcag

SEQ ID NO: 34832 - RNA, 32 nt, Human
accacaccauugcacuccagccugggcaacaa

SEQ ID NO: 34833 - RNA, 32 nt, Human
accacacccaaggcugcuuuccagaaagcccg

SEQ ID NO: 34834 - RNA, 32 nt, Human
accacacccagccugggucucucuacuuuuaa

SEQ ID NO: 34835 - RNA, 32 nt, Human
accacacccagcuaaauuuuuguauuuuuagu

SEQ ID NO: 34836 - RNA, 32 nt, Human
accacacccagcuaauguuuuguauuuuuagu

SEQ ID NO: 34837 - RNA, 32 nt, Human
accacaccccugugacacacaacuuacucaug

SEQ ID NO: 34838 - RNA, 32 nt, Human
accacacccggcuaauauuuuguauuuuaaua

SEQ ID NO: 34839 - RNA, 32 nt, Human
accacacccuggaaggugcaguugggaagaaa

SEQ ID NO: 34840 - RNA, 32 nt, Human
accacaccuagcuaauauuuuguauuuuaaua

SEQ ID NO: 34841 - RNA, 32 nt, Human
accacaccuccuuuugcccuccgcaggagccu

SEQ ID NO: 34842 - RNA, 32 nt, Human
accacaccucugagagaagucagugcagacgg

SEQ ID NO: 34843 - RNA, 16 nt, Human
accacaccuggcccag

SEQ ID NO: 34844 - RNA, 32 nt, Human
accacaccuggcuaacuuuuuguauuuuuagu

SEQ ID NO: 34845 - RNA, 32 nt, Human
accacaccuggcuaguguuuuguauuuuuagu

SEQ ID NO: 34846 - RNA, 26 nt, Human
accacaccuugccaugcagagcaccu

SEQ ID NO: 34847 - RNA, 32 nt, Human
accacacgcaugcgccaccacgcccagcuaau

SEQ ID NO: 34848 - RNA, 32 nt, Human
accacacucauggcucaggucugccggggccg

SEQ ID NO: 34849 - RNA, 32 nt, Human
accacacuccagccugggugacagagugaaac

SEQ ID NO: 34850 - RNA, 32 nt, Human
accacacucccacacuccagccuggguaacag

SEQ ID NO: 34851 - RNA, 32 nt, Human
accacacucuccccagcaucuacucaagguag

SEQ ID NO: 34852 - RNA, 32 nt, Human
accacacugaccaaaucuggaucuuuggacua

SEQ ID NO: 34853 - RNA, 32 nt, Human
accacacugauccagcccugaguuccuagcca

SEQ ID NO: 34854 - RNA, 24 nt, Human
accacacugccaccacccugcaca

SEQ ID NO: 34855 - RNA, 31 nt, Human
accacacugugcggggagguuggcccagagc

SEQ ID NO: 34856 - RNA, 18 nt, Human
accacacuucaggugcua

SEQ ID NO: 34857 - RNA, 32 nt, Human
accacacuugcuggaugggcccacggagcgag

SEQ ID NO: 34858 - RNA, 32 nt, Human
accacagaaccucacaguuuauaaagcuguag

SEQ ID NO: 34859 - RNA, 32 nt, Human
accacagaagacagggaagaacuaccaggccu

SEQ ID NO: 34860 - RNA, 21 nt, Human
accacagaagucucagugcca

SEQ ID NO: 34861 - RNA, 32 nt, Human
accacagaauuggaugggcaucaggaaguaga

SEQ ID NO: 34862 - RNA, 17 nt, Human
accacagaccccccagg

SEQ ID NO: 34863 - RNA, 20 nt, Human
accacagacgcucuccaggu

SEQ ID NO: 34864 - RNA, 32 nt, Human
accacagacuacaacugcccagcuucaucuaa

SEQ ID NO: 34865 - RNA, 32 nt, Human
accacagagccaacuugugaagcacacagcuc

SEQ ID NO: 34866 - RNA, 32 nt, Human
accacagagcuugcccucagugaccaaauaau

SEQ ID NO: 34867 - RNA, 32 nt, Human
accacagaggcagaaggggugaugagugagag

SEQ ID NO: 34868 - RNA, 32 nt, Human
accacagaggggaccagggcacugugagcccu

SEQ ID NO: 34869 - RNA, 32 nt, Human
accacagaggugcuugccauuaugggaaauca

SEQ ID NO: 34870 - RNA, 32 nt, Human
accacagaguucacugcauugaaggaaaucac

SEQ ID NO: 34871 - RNA, 21 nt, Human
accacagauccauggcacuua

SEQ ID NO: 34872 - RNA, 32 nt, Human
accacagaucccuggauugcugggaauggaag

SEQ ID NO: 34873 - RNA, 32 nt, Human
accacagaugaccacaucuaauccugcuucua

SEQ ID NO: 34874 - RNA, 32 nt, Human
accacagauguaagaaagugauaagccauggc

SEQ ID NO: 34875 - RNA, 21 nt, Human
accacagcaauacccccaaca

SEQ ID NO: 34876 - RNA, 32 nt, Human
accacagcacaccggugcuggccacaccagcc

SEQ ID NO: 34877 - RNA, 32 nt, Human
accacagcacgugcuccagucagugguccugg

SEQ ID NO: 34878 - RNA, 32 nt, Human
accacagcacucaagccugggugacagagcaa

SEQ ID NO: 34879 - RNA, 32 nt, Human
accacagcacuccaaccugggugacagaguga

SEQ ID NO: 34880 - RNA, 32 nt, Human
accacagcagaggacggggugccggcaccucc

SEQ ID NO: 34881 - RNA, 32 nt, Human
accacagcagcaaagcacagagugugaccuuu

SEQ ID NO: 34882 - RNA, 21 nt, Human
accacagcaugcccggcuccu

SEQ ID NO: 34883 - RNA, 32 nt, Human
accacagcauucagcccugcagccugggaccu

SEQ ID NO: 34884 - RNA, 32 nt, Human
accacagccacuuuagaaaagcuuccuguacc

SEQ ID NO: 34885 - RNA, 32 nt, Human
accacagccagccaguaugaccuaucuuaauc

SEQ ID NO: 34886 - RNA, 32 nt, Human
accacagccagccuuagggaaaacuuggaagu

SEQ ID NO: 34887 - RNA, 32 nt, Human
accacagccagugucaggccucugccucuggg

SEQ ID NO: 34888 - RNA, 32 nt, Human
accacagccccagcugccucagagcaggcaca

SEQ ID NO: 34889 - RNA, 32 nt, Human
accacagcccugggcaaaggggaccagcaagu

SEQ ID NO: 34890 - RNA, 32 nt, Human
accacagccgcugaaugaggcuuccaggcguc

SEQ ID NO: 34891 - RNA, 23 nt, Human
accacagcucaaggaggccugcc

SEQ ID NO: 34892 - RNA, 23 nt, Human
accacagcucaagggggccugcc

SEQ ID NO: 34893 - RNA, 32 nt, Human
accacagcugagaagcaggcaauucuguaggc

SEQ ID NO: 34894 - RNA, 32 nt, Human
accacagcugcucuccaggugcugggcccugg

SEQ ID NO: 34895 - RNA, 20 nt, Human
accacagcuuacuccuuaug

SEQ ID NO: 34896 - RNA, 32 nt, Human
accacagcuuuaccaccucccguuaaguccuu

SEQ ID NO: 34897 - RNA, 32 nt, Human
accacaggaguuugugguguagcaccacccac

SEQ ID NO: 34898 - RNA, 32 nt, Human
accacaggauaguguacccacagauggguguu

SEQ ID NO: 34899 - RNA, 32 nt, Human
accacaggcaagugcaccaccaugacuggcua

SEQ ID NO: 34900 - RNA, 32 nt, Human
accacaggcaugagccacugugcccagccuag

SEQ ID NO: 34901 - RNA, 32 nt, Human
accacaggcaugugccaccaugccuagcuaau

SEQ ID NO: 34902 - RNA, 21 nt, Human
accacaggcccccgugccugc

SEQ ID NO: 34903 - RNA, 21 nt, Human
accacaggccugagccacugu

SEQ ID NO: 34904 - RNA, 32 nt, Human
accacaggccugagccacugugcccagccuug

SEQ ID NO: 34905 - RNA, 22 nt, Human
accacaggccuggcacauugug

SEQ ID NO: 34906 - RNA, 32 nt, Human
accacaggcgacugccaccacacccagcuaau

SEQ ID NO: 34907 - RNA, 32 nt, Human
accacaggcgcccaccaccacgcccagcuagu

SEQ ID NO: 34908 - RNA, 32 nt, Human
accacaggcgcgagccacugcguccggccggc

SEQ ID NO: 34909 - RNA, 32 nt, Human
accacaggcugcagcacaaggucuccaccauc

SEQ ID NO: 34910 - RNA, 32 nt, Human
accacaggcugccucaugacccuccuguccag

SEQ ID NO: 34911 - RNA, 21 nt, Human
accacaggcuggaguacagug

SEQ ID NO: 34912 - RNA, 32 nt, Human
accacagggaacuuccuuccagaggcuugcuu

SEQ ID NO: 34913 - RNA, 32 nt, Human
accacagggccacagagcuggagcuggaucua

SEQ ID NO: 34914 - RNA, 32 nt, Human
accacagggccaggcuguuugcuccccaucgg

SEQ ID NO: 34915 - RNA, 32 nt, Human
accacagggccugagaagucuugcuuuauggg

SEQ ID NO: 34916 - RNA, 18 nt, Human
accacagggccugcagca

SEQ ID NO: 34917 - RNA, 32 nt, Human
accacagggcugggcuacuaagcuuuuucagu

SEQ ID NO: 34918 - RNA, 22 nt, Human
accacagggguaugccaccaca

SEQ ID NO: 34919 - RNA, 32 nt, Human
accacagggguaugccaccacaccuggcuaau

SEQ ID NO: 34920 - RNA, 24 nt, Human
accacaggggucuccuuccaggcc

SEQ ID NO: 34921 - RNA, 32 nt, Human
accacaggguaacucuacaugcuguucuccua

SEQ ID NO: 34922 - RNA, 32 nt, Human
accacagggugaggucaaggugagcauucugg

SEQ ID NO: 34923 - RNA, 32 nt, Human
accacagguaguuaaugcugggggaagagggg

SEQ ID NO: 34924 - RNA, 25 nt, Human
accacaggugccuaccaccaugcca

SEQ ID NO: 34925 - RNA, 32 nt, Human
accacaggugcgcaccaccauacccagcuacu

SEQ ID NO: 34926 - RNA, 32 nt, Human
accacaggugugagccaccacaccuggcuaau

SEQ ID NO: 34927 - RNA, 19 nt, Human
accacagguguuggcugcc

SEQ ID NO: 34928 - RNA, 32 nt, Human
accacaguacuccagccuaggugacagagcga

SEQ ID NO: 34929 - RNA, 32 nt, Human
accacagucacagaacugggggucauuuucua

SEQ ID NO: 34930 - RNA, 21 nt, Human
accacagucagaauaaucuca

SEQ ID NO: 34931 - RNA, 32 nt, Human
accacaguccaaggagcucacccugggcaacc

SEQ ID NO: 34932 - RNA, 32 nt, Human
accacaguccucacgauggugcagugauuucu

SEQ ID NO: 34933 - RNA, 21 nt, Human
accacagucugaagcaaggug

SEQ ID NO: 34934 - RNA, 32 nt, Human
accacagucuucacccuacugaacccgucaag

SEQ ID NO: 34935 - RNA, 32 nt, Human
accacaguguucccucgcagcaccacaaccuc

SEQ ID NO: 34936 - RNA, 19 nt, Human
accacaguugaccacaggu

SEQ ID NO: 34937 - RNA, 32 nt, Human
accacaguuuaccucaggugugccuguugcuu

SEQ ID NO: 34938 - RNA, 32 nt, Human
accacauaaaaaggccagacagggcggggugu

SEQ ID NO: 34939 - RNA, 25 nt, Human
accacauaaaugaugaguuugugug

SEQ ID NO: 34940 - RNA, 32 nt, Human
accacauaucaaagguugggauuuucagaguc

SEQ ID NO: 34941 - RNA, 32 nt, Human
accacaucacacuuauuuccacauugaccaca

SEQ ID NO: 34942 - RNA, 32 nt, Human
accacaucagcagcaaaaccgccagggcugaa

SEQ ID NO: 34943 - RNA, 22 nt, Human
accacaucaggaucggaaucua

SEQ ID NO: 34944 - RNA, 32 nt, Human
accacauccacccagggauuaggguucaagua

SEQ ID NO: 34945 - RNA, 32 nt, Human
accacaucccaguaaggaaacagcugccagcu

SEQ ID NO: 34946 - RNA, 32 nt, Human
accacauccuggaagaggagggggccccggga

SEQ ID NO: 34947 - RNA, 32 nt, Human
accacaucggaagugauuuucuaaauuggauu

SEQ ID NO: 34948 - RNA, 32 nt, Human
accacaucuacucugugaacccuggcuuaguc

SEQ ID NO: 34949 - RNA, 32 nt, Human
accacaucuccccucacccucacccucccugc

SEQ ID NO: 34950 - RNA, 32 nt, Human
accacaucuggcuaacuuuuuguauuuuuagu

SEQ ID NO: 34951 - RNA, 32 nt, Human
accacaucuucucacuuauagaugguagcuaa

SEQ ID NO: 34952 - RNA, 24 nt, Human
accacaugcuugguguacuauaug

SEQ ID NO: 34953 - RNA, 21 nt, Human
accacaugguaaccuacuguu

SEQ ID NO: 34954 - RNA, 32 nt, Human
accacaugucuugaacauucacauggguuaaa

SEQ ID NO: 34955 - RNA, 19 nt, Human
accacauguucgcaaagua

SEQ ID NO: 34956 - RNA, 32 nt, Human
accacauuagggaauaagcaguauuugcaugg

SEQ ID NO: 34957 - RNA, 32 nt, Human
accacauucaucaccuuggcccugcacucuga

SEQ ID NO: 34958 - RNA, 32 nt, Human
accacauuccugcucagaaacugcucacuucc

SEQ ID NO: 34959 - RNA, 32 nt, Human
accacauuccuuccuuucuuucccaacuucuu

SEQ ID NO: 34960 - RNA, 32 nt, Human
accacauuccuuccuuucuuucccgacuucuu

SEQ ID NO: 34961 - RNA, 21 nt, Human
accacauucucccagggaccc

SEQ ID NO: 34962 - RNA, 31 nt, Human
accacauucuucaaggagguuguagacaaau

SEQ ID NO: 34963 - RNA, 32 nt, Human
accacauuguuaccaacaauagccggaagugg

SEQ ID NO: 34964 - RNA, 32 nt, Human
accacauuugagaaguauuuccauccagugcu

SEQ ID NO: 34965 - RNA, 32 nt, Human
accacauuuuuccucaaguucccuggagaaga

SEQ ID NO: 34966 - RNA, 32 nt, Human
accaccaaccccacagaaauacgaaaaacccu

SEQ ID NO: 34967 - RNA, 32 nt, Human
accaccaacuggcuggcccuccuccucuuccc

SEQ ID NO: 34968 - RNA, 25 nt, Human
accaccaagcaaggacuucuguaau

SEQ ID NO: 34969 - RNA, 32 nt, Human
accaccaaggcaaagcagcacagugugaauag

SEQ ID NO: 34970 - RNA, 32 nt, Human
accaccaauucucuuuggaggcuggggauagu

SEQ ID NO: 34971 - RNA, 32 nt, Human
accaccacaaaucaugguuaauaaaagagagu

SEQ ID NO: 34972 - RNA, 32 nt, Human
accaccacacuccagccugggugacagagcga

SEQ ID NO: 34973 - RNA, 32 nt, Human
accaccacacuccagccugggugacagaguga

SEQ ID NO: 34974 - RNA, 32 nt, Human
accaccacacuggccucugauggcaagacuug

SEQ ID NO: 34975 - RNA, 22 nt, Human
accaccacagccgccgccgcug

SEQ ID NO: 34976 - RNA, 32 nt, Human
accaccacagccgccgccgcuggccagggugc

SEQ ID NO: 34977 - RNA, 32 nt, Human
accaccaccaacaacaucaacacagaucuuca

SEQ ID NO: 34978 - RNA, 32 nt, Human
accaccaccaccacaaaagcacccaggccgcc

SEQ ID NO: 34979 - RNA, 32 nt, Human
accaccaccacugugcggugggcugagcaggu

SEQ ID NO: 34980 - RNA, 32 nt, Human
accaccaccagagccuccugcccagcccuggc

SEQ ID NO: 34981 - RNA, 32 nt, Human
accaccaccagauucuucuuugaagucaacuu

SEQ ID NO: 34982 - RNA, 25 nt, Human
accaccaccagugagcuccagccug

SEQ ID NO: 34983 - RNA, 32 nt, Human
accaccaccaugauccaaucccuucccaccag

SEQ ID NO: 34984 - RNA, 22 nt, Human
accaccaccgccaccaccgcug

SEQ ID NO: 34985 - RNA, 21 nt, Human
accaccaccgccgccgccucc

SEQ ID NO: 34986 - RNA, 32 nt, Human
accaccacgacagcccuuccuccaucagaaga

SEQ ID NO: 34987 - RNA, 21 nt, Human
accaccacgcagccgccgccg

SEQ ID NO: 34988 - RNA, 32 nt, Human
accaccacucuggcuggcuuccaagggcacaa

SEQ ID NO: 34989 - RNA, 32 nt, Human
accaccacuuccuggguucaagcgauucuccu

SEQ ID NO: 34990 - RNA, 32 nt, Human
accaccagaagggagagggaaccagauaugca

SEQ ID NO: 34991 - RNA, 32 nt, Human
accaccagaguccuuggacucccccugggucu

SEQ ID NO: 34992 - RNA, 32 nt, Human
accaccagauacagaaaugugcuuuaacauca

SEQ ID NO: 34993 - RNA, 19 nt, Human
accaccagauaguguuaca

SEQ ID NO: 34994 - RNA, 32 nt, Human
accaccagcaccauccucuccucccagcagcc

SEQ ID NO: 34995 - RNA, 32 nt, Human
accaccagcagccugcguacccaggccccaag

SEQ ID NO: 34996 - RNA, 32 nt, Human
accaccagcauguucauguccagaccucggca

SEQ ID NO: 34997 - RNA, 32 nt, Human
accaccagccagcuaauuuuuguauuuuuagu

SEQ ID NO: 34998 - RNA, 23 nt, Human
accaccagccccaacuguaggca

SEQ ID NO: 34999 - RNA, 32 nt, Human
accaccagcccuggugacaggguggagacccc

SEQ ID NO: 35000 - RNA, 32 nt, Human
accaccagccuaucccugaaaaagcaaagaca

SEQ ID NO: 35001 - RNA, 30 nt, Human
accaccagccucuccaagcucaaguacaaa

SEQ ID NO: 35002 - RNA, 32 nt, Human
accaccagcgaugcccagcccuugguagagcu

SEQ ID NO: 35003 - RNA, 23 nt, Human
accaccagcgccuggugucauca

SEQ ID NO: 35004 - RNA, 32 nt, Human
accaccagcuccucuccacuucccaagggaga

SEQ ID NO: 35005 - RNA, 32 nt, Human
accaccaggagagaggcagaggggcugugccg

SEQ ID NO: 35006 - RNA, 32 nt, Human
accaccaggaggugagcuugcucugggaggca

SEQ ID NO: 35007 - RNA, 22 nt, Human
accaccaggggcugucugcaau

SEQ ID NO: 35008 - RNA, 32 nt, Human
accaccagggggcagaguugcacuuuuccagg

SEQ ID NO: 35009 - RNA, 21 nt, Human
accaccaguuuacccugaaac

SEQ ID NO: 35010 - RNA, 32 nt, Human
accaccaucaccaagcagaucacgcccuacgu

SEQ ID NO: 35011 - RNA, 32 nt, Human
accaccauccaccaguucaccuccuccagcuc

SEQ ID NO: 35012 - RNA, 18 nt, Human
accaccaucccugggagg

SEQ ID NO: 35013 - RNA, 32 nt, Human
accaccaucucaggaaaggcuguugugcuggu

SEQ ID NO: 35014 - RNA, 32 nt, Human
accaccaucuccuggguucaggcgauucuucc

SEQ ID NO: 35015 - RNA, 32 nt, Human
accaccaucuucuauucaaaugaagugaguca

SEQ ID NO: 35016 - RNA, 32 nt, Human
accaccaugccuggcuaauuucuguauuuuua

SEQ ID NO: 35017 - RNA, 32 nt, Human
accaccaugccuggcuaauuuuguauuucuag

SEQ ID NO: 35018 - RNA, 32 nt, Human
accaccaugccuggcuaauuuuguauuuuuag

SEQ ID NO: 35019 - RNA, 32 nt, Human
accaccaugccuggcuaauuuuugcauuuuua

SEQ ID NO: 35020 - RNA, 32 nt, Human
accaccaugccuggcuaauuuuuguauuuuau

SEQ ID NO: 35021 - RNA, 32 nt, Human
accaccaugccuggcuaauuuuuguauuuuua

SEQ ID NO: 35022 - RNA, 32 nt, Human
accaccaugccuggcuaauuuuuguauuuuug

SEQ ID NO: 35023 - RNA, 32 nt, Human
accaccaugccuggcuaguuuuuguauuuuua

SEQ ID NO: 35024 - RNA, 32 nt, Human
accaccaugccuggcugauuuuuguauuuuua

SEQ ID NO: 35025 - RNA, 32 nt, Human
accaccaugccuggcugguuuuuguauuuuua

SEQ ID NO: 35026 - RNA, 32 nt, Human
accaccaugccugucuaauuuuuguacuuuuc

SEQ ID NO: 35027 - RNA, 31 nt, Human
accaccaugcuggccucagggcugcuucugg

SEQ ID NO: 35028 - RNA, 32 nt, Human
accacccaacuggccccaguacauucauucuc

SEQ ID NO: 35029 - RNA, 32 nt, Human
accacccaaugaguucagcuugcccacugccu

SEQ ID NO: 35030 - RNA, 20 nt, Human
accacccacacccccagcac

SEQ ID NO: 35031 - RNA, 18 nt, Human
accacccaccucaaggaa

SEQ ID NO: 35032 - RNA, 32 nt, Human
accacccaccucauccuggcucagccugguga

SEQ ID NO: 35033 - RNA, 32 nt, Human
accacccagcaacuacuccuggaugcauccua

SEQ ID NO: 35034 - RNA, 32 nt, Human
accacccagcuggucagacucugauguugggu

SEQ ID NO: 35035 - RNA, 32 nt, Human
accacccagcugguuccagcccuggccaaggu

SEQ ID NO: 35036 - RNA, 32 nt, Human
accacccagcuucucccugagggcccaccagc

SEQ ID NO: 35037 - RNA, 32 nt, Human
accacccagcuuucucccagccacagccaaga

SEQ ID NO: 35038 - RNA, 24 nt, Human
accacccaggucccgcagcugccu

SEQ ID NO: 35039 - RNA, 32 nt, Human
accacccauaaaugacagugacuuuuucaaua

SEQ ID NO: 35040 - RNA, 32 nt, Human
accacccaugaucccaggcuggaggaagcagc

SEQ ID NO: 35041 - RNA, 24 nt, Human
accaccccagcccaccccgccacc

SEQ ID NO: 35042 - RNA, 32 nt, Human
accaccccaucuuccaugagggcucuaacggc

SEQ ID NO: 35043 - RNA, 24 nt, Human
accacccccaccgcccccaccacc

SEQ ID NO: 35044 - RNA, 24 nt, Human
accacccccaccgcccccaccgcc

SEQ ID NO: 35045 - RNA, 32 nt, Human
accacccccgcaccugcccucggccuuuguga

SEQ ID NO: 35046 - RNA, 21 nt, Human
accacccccucauccagggaa

SEQ ID NO: 35047 - RNA, 20 nt, Human
accacccccuccccagggag

SEQ ID NO: 35048 - RNA, 32 nt, Human
accacccccugcccucugcugccauaaucaca

SEQ ID NO: 35049 - RNA, 19 nt, Human
accaccccgccccaaggaa

SEQ ID NO: 35050 - RNA, 31 nt, Human
accaccccguuucagcccucagccucagggc

SEQ ID NO: 35051 - RNA, 32 nt, Human
accaccccugcagugggcugccagcugggcca

SEQ ID NO: 35052 - RNA, 20 nt, Human
accaccccugggauggcacu

SEQ ID NO: 35053 - RNA, 32 nt, Human
accaccccuucccagucaacccuuuacccuca

SEQ ID NO: 35054 - RNA, 19 nt, Human
accacccggcccugcaaca

SEQ ID NO: 35055 - RNA, 32 nt, Human
accacccgggcaacccucugggcuuguguucc

SEQ ID NO: 35056 - RNA, 32 nt, Human
accacccuaaguuugaauauggacuuuggagc

SEQ ID NO: 35057 - RNA, 19 nt, Human
accacccucaaguacuucc

SEQ ID NO: 35058 - RNA, 32 nt, Human
accacccucaccaauucucucaauccccauga

SEQ ID NO: 35059 - RNA, 32 nt, Human
accacccucacuguccuccagcccaggauggg

SEQ ID NO: 35060 - RNA, 19 nt, Human
accacccucccggcguauc

SEQ ID NO: 35061 - RNA, 32 nt, Human
accacccucuccaaccccucccuucccgaccc

SEQ ID NO: 35062 - RNA, 22 nt, Human
accacccucuuucuguacuuca

SEQ ID NO: 35063 - RNA, 19 nt, Human
accacccugagguuagcca

SEQ ID NO: 35064 - RNA, 18 nt, Human
accacccugagguuucca

SEQ ID NO: 35065 - RNA, 18 nt, Human
accacccugagugcuuca

SEQ ID NO: 35066 - RNA, 32 nt, Human
accacccugccugauccugccccugccugacc

SEQ ID NO: 35067 - RNA, 21 nt, Human
accacccugcuagaugucauc

SEQ ID NO: 35068 - RNA, 18 nt, Human
accacccugcugugauca

SEQ ID NO: 35069 - RNA, 32 nt, Human
accacccuggacaauauggugaaacccugucu

SEQ ID NO: 35070 - RNA, 32 nt, Human
accacccuggcaguuccagccuguaggggagu

SEQ ID NO: 35071 - RNA, 23 nt, Human
accacccuggccaacaugcgaaa

SEQ ID NO: 35072 - RNA, 22 nt, Human
accacccuggccaacaugguga

SEQ ID NO: 35073 - RNA, 24 nt, Human
accacccuggccaacauggugaaa

SEQ ID NO: 35074 - RNA, 24 nt, Human
accacccuggccaauauggugaaa

SEQ ID NO: 35075 - RNA, 32 nt, Human
accacccuggcuuauguggaacaccuaucagg

SEQ ID NO: 35076 - RNA, 32 nt, Human
accacccugggaaacauaaugcugccccuugg

SEQ ID NO: 35077 - RNA, 20 nt, Human
accacccugugugugucauc

SEQ ID NO: 35078 - RNA, 17 nt, Human
accacccuguuacauca

SEQ ID NO: 35079 - RNA, 32 nt, Human
accacccuguucucuguccuauggucacucag

SEQ ID NO: 35080 - RNA, 32 nt, Human
accacccuugagagaagaggcagcagcagcgg

SEQ ID NO: 35081 - RNA, 20 nt, Human
accacccuuguauuuuauca

SEQ ID NO: 35082 - RNA, 19 nt, Human
accacccuuuggucaauca

SEQ ID NO: 35083 - RNA, 32 nt, Human
accaccgagcaggcacagcacagcagugacuc

SEQ ID NO: 35084 - RNA, 24 nt, Human
acccaggcuggagugcuguggugu

SEQ ID NO: 35085 - RNA, 22 nt, Human
acccaggcuggaguggaguggc

SEQ ID NO: 35086 - RNA, 22 nt, Human
acccaggcuggaguggaguggu

SEQ ID NO: 35087 - RNA, 21 nt, Human
acccaggcuggaguguaagug

SEQ ID NO: 35088 - RNA, 22 nt, Human
acccaggcuggaguguaguagc

SEQ ID NO: 35089 - RNA, 22 nt, Human
acccaggcuggaguguaguggc

SEQ ID NO: 35090 - RNA, 23 nt, Human
acccaggcuggaguguaguggcg

SEQ ID NO: 35091 - RNA, 23 nt, Human
acccaggcuggaguguaguggug

SEQ ID NO: 35092 - RNA, 24 nt, Human
acccaggcuggaguguaguggugu

SEQ ID NO: 35093 - RNA, 32 nt, Human
acccaggcuggagugugcaguggcgcggugcg

SEQ ID NO: 35094 - RNA, 24 nt, Human
acccaggcuggaguuauagugacg

SEQ ID NO: 35095 - RNA, 23 nt, Human
acccaggcuggaguucaguggug

SEQ ID NO: 35096 - RNA, 23 nt, Human
acccaggcuggcgugcaauggcg

SEQ ID NO: 35097 - RNA, 24 nt, Human
acccaggcuggcgugcaguggugu

SEQ ID NO: 35098 - RNA, 22 nt, Human
acccaggcuggcuccuggggcg

SEQ ID NO: 35099 - RNA, 32 nt, Human
acccaggcuggcugagagccugcagggaagag

SEQ ID NO: 35100 - RNA, 32 nt, Human
acccaggcugggaauugcaguggcacaauccc

SEQ ID NO: 35101 - RNA, 22 nt, Human
acccaggcugggaugcaguggc

SEQ ID NO: 35102 - RNA, 23 nt, Human
acccaggcuggggugcaguggcg

SEQ ID NO: 35103 - RNA, 24 nt, Human
acccaggcuggggugcaguggcgu

SEQ ID NO: 35104 - RNA, 32 nt, Human
acccaggcuggucucaaacuccugggcacaag

SEQ ID NO: 35105 - RNA, 32 nt, Human
acccaggcuggucucaaacuccugggcucaag

SEQ ID NO: 35106 - RNA, 32 nt, Human
acccaggcuggucucaacuccugggcucaagc

SEQ ID NO: 35107 - RNA, 22 nt, Human
acccaggcuguagugcaguggc

SEQ ID NO: 35108 - RNA, 24 nt, Human
acccaggcuguaguggaguggugu

SEQ ID NO: 35109 - RNA, 32 nt, Human
acccaggcugugaucuguccugggcggggacc

SEQ ID NO: 35110 - RNA, 17 nt, Human
acccaggcuguggggga

SEQ ID NO: 35111 - RNA, 21 nt, Human
acccaggcuugcaaagugacg

SEQ ID NO: 35112 - RNA, 32 nt, Human
acccagggacacuccaacucuacacagcucag

SEQ ID NO: 35113 - RNA, 32 nt, Human
acccagggaccucgggcuggagcccagcagga

SEQ ID NO: 35114 - RNA, 32 nt, Human
acccagggagagagcuguuacugcuccagaga

SEQ ID NO: 35115 - RNA, 32 nt, Human
acccagggagcuggaguugagcuguuccccua

SEQ ID NO: 35116 - RNA, 32 nt, Human
acccagggaggucgaugcugcagugagcuaug

SEQ ID NO: 35117 - RNA, 32 nt, Human
acccagggauccuagacaggucaacuggaagg

SEQ ID NO: 35118 - RNA, 32 nt, Human
acccagggcagggagagaagaaccuagaggcc

SEQ ID NO: 35119 - RNA, 32 nt, Human
acccagggccagacuguguuuguuagaauccc

SEQ ID NO: 35120 - RNA, 32 nt, Human
acccagggccuggccuucucucccagcagccu

SEQ ID NO: 35121 - RNA, 32 nt, Human
acccagggcugaggccugccccaugaagaggc

SEQ ID NO: 35122 - RNA, 32 nt, Human
acccagggcugcugcucauccugggcaagcug

SEQ ID NO: 35123 - RNA, 32 nt, Human
acccaggggaaacugagucccucacccccuuc

SEQ ID NO: 35124 - RNA, 32 nt, Human
acccaggggauggaggucuacccuggacacua

SEQ ID NO: 35125 - RNA, 21 nt, Human
acccaggggcacgcucugggc

SEQ ID NO: 35126 - RNA, 32 nt, Human
acccaggggcccugugguccagggugagaguc

SEQ ID NO: 35127 - RNA, 32 nt, Human
acccagggggcagagguugcagugagccgaga

SEQ ID NO: 35128 - RNA, 32 nt, Human
acccaggggguggagguugcacugagccgaga

SEQ ID NO: 35129 - RNA, 32 nt, Human
acccagggucagcugagcuccuugugggggcu

SEQ ID NO: 35130 - RNA, 32 nt, Human
acccagggugguggcgaggugggagcuggcag

SEQ ID NO: 35131 - RNA, 32 nt, Human
acccaggguuuccccuuccccuucccuucuga

SEQ ID NO: 35132 - RNA, 32 nt, Human
acccagguaaacacuggcuuugguagaauugu

SEQ ID NO: 35133 - RNA, 32 nt, Human
acccaggucaucugagugaugccucagaucug

SEQ ID NO: 35134 - RNA, 21 nt, Human
acccagguccacgugguucca

SEQ ID NO: 35135 - RNA, 32 nt, Human
acccagguccccaauugagaaugucuugcuug

SEQ ID NO: 35136 - RNA, 20 nt, Human
acccaggucugcugcccagg

SEQ ID NO: 35137 - RNA, 32 nt, Human
acccaggucugucgguuuacgagaaugcaguu

SEQ ID NO: 35138 - RNA, 32 nt, Human
acccagguggcggagguugcagugagccgaca

SEQ ID NO: 35139 - RNA, 32 nt, Human
acccagguucaagugauucucgugucucagcc

SEQ ID NO: 35140 - RNA, 32 nt, Human
acccagguuguggagguuguagugagccgaga

SEQ ID NO: 35141 - RNA, 32 nt, Human
acccaguaagcuucuaccauuguuaggagcau

SEQ ID NO: 35142 - RNA, 32 nt, Human
acccaguaaugaggggcagggaagggaacugg

SEQ ID NO: 35143 - RNA, 32 nt, Human
acccaguacucccuccagccucagcuggcuga

SEQ ID NO: 35144 - RNA, 32 nt, Human
acccaguagaggaagguugcaguaagcugaga

SEQ ID NO: 35145 - RNA, 24 nt, Human
acccaguagccgccgccgccgccg

SEQ ID NO: 35146 - RNA, 32 nt, Human
acccaguaggcggaaguugcagugagcugaaa

SEQ ID NO: 35147 - RNA, 32 nt, Human
acccaguagguguggaggauaaaggcuucugu

SEQ ID NO: 35148 - RNA, 32 nt, Human
acccaguagucaccaaggcagguagugugaua

SEQ ID NO: 35149 - RNA, 32 nt, Human
acccagucacauuggcagagguggggguuggc

SEQ ID NO: 35150 - RNA, 32 nt, Human
acccaguccaagaggccugggcugaggacgug

SEQ ID NO: 35151 - RNA, 32 nt, Human
acccaguccagccuccuggcuguugacuuccc

SEQ ID NO: 35152 - RNA, 32 nt, Human
acccaguccagcugcuauaacugcuuggacac

SEQ ID NO: 35153 - RNA, 22 nt, Human
acccaguccuucccagggaccc

SEQ ID NO: 35154 - RNA, 32 nt, Human
acccagucugggauaggaggaggucggggaag

SEQ ID NO: 35155 - RNA, 21 nt, Human
acccagugaaaguggcuggua

SEQ ID NO: 35156 - RNA, 32 nt, Human
acccagugaacccaaggccugaagagaauuug

SEQ ID NO: 35157 - RNA, 31 nt, Human
acccagugacuucuuuuugcccaggccugga

SEQ ID NO: 35158 - RNA, 32 nt, Human
acccagugagauacauguuuauucaaacacaa

SEQ ID NO: 35159 - RNA, 32 nt, Human
acccagugcagccuggcaccuacccacccacc

SEQ ID NO: 35160 - RNA, 32 nt, Human
acccagugcccucuccccucagccucuccccu

SEQ ID NO: 35161 - RNA, 32 nt, Human
acccagugcugcagguuucuccugggugaaga

SEQ ID NO: 35162 - RNA, 32 nt, Human
acccagugcuggccgccuucuuggugccaaac

SEQ ID NO: 35163 - RNA, 32 nt, Human
acccagugcuuaauagcagggaagaagguacu

SEQ ID NO: 35164 - RNA, 32 nt, Human
acccaguggaacacuuagugacuaucacagcc

SEQ ID NO: 35165 - RNA, 32 nt, Human
acccaguggcaucagcagucacagagcaccaa

SEQ ID NO: 35166 - RNA, 32 nt, Human
acccagugguagcuuuggaagcugcuuucgag

SEQ ID NO: 35167 - RNA, 32 nt, Human
acccagugguagcuuuggaagcugcuuugcag

SEQ ID NO: 35168 - RNA, 32 nt, Human
acccaguggugaagccaaagcacaggaaugcu

SEQ ID NO: 35169 - RNA, 32 nt, Human
acccaguguccaucuuuccacccucccugauc

SEQ ID NO: 35170 - RNA, 25 nt, Human
acccaguguuagcaccaaaguccca

SEQ ID NO: 35171 - RNA, 23 nt, Human
acccaguuaaggccagaccaggc

SEQ ID NO: 35172 - RNA, 32 nt, Human
acccaguugguagaggagucaggaggugggag

SEQ ID NO: 35173 - RNA, 32 nt, Human
acccauaaaccaguucaagaaagggaugaagg

SEQ ID NO: 35174 - RNA, 32 nt, Human
acccauaaggcagagguugcagugagcugaga

SEQ ID NO: 35175 - RNA, 25 nt, Human
acccauaaucaagacaaauuugcca

SEQ ID NO: 35176 - RNA, 32 nt, Human
acccauaauccagcuacuugggaggcugaagc

SEQ ID NO: 35177 - RNA, 32 nt, Human
acccauaaugccacucagcaagccuugguugu

SEQ ID NO: 35178 - RNA, 32 nt, Human
acccauagcuuggugucauuaacauaauuauu

SEQ ID NO: 35179 - RNA, 32 nt, Human
acccauagggcuggcucacauccagucacucc

SEQ ID NO: 35180 - RNA, 32 nt, Human
acccauauuucauccaggaggccgccuucacc

SEQ ID NO: 35181 - RNA, 19 nt, Human
acccaucaauguggcccca

SEQ ID NO: 35182 - RNA, 32 nt, Human
acccaucaccaccaccaccacggugaccccaa

SEQ ID NO: 35183 - RNA, 32 nt, Human
acccaucacuuuaaauccuuaaaguuagaagc

SEQ ID NO: 35184 - RNA, 32 nt, Human
acccaucagaacuuggugcagcacagccccgc

SEQ ID NO: 35185 - RNA, 32 nt, Human
acccaucaggguggaggagcuggugacacuca

SEQ ID NO: 35186 - RNA, 32 nt, Human
acccaucaugccacaccgguacccuccucccg

SEQ ID NO: 35187 - RNA, 32 nt, Human
acccaucccacacaccagcugugugaccuugg

SEQ ID NO: 35188 - RNA, 18 nt, Human
acccaucccaccccucca

SEQ ID NO: 35189 - RNA, 32 nt, Human
acccaucccaggagucagcuuggacuaucaca

SEQ ID NO: 35190 - RNA, 32 nt, Human
acccaucccagggcuccucuggagcuaauccu

SEQ ID NO: 35191 - RNA, 32 nt, Human
acccaucccucugcccuccaccucuaccacuc

SEQ ID NO: 35192 - RNA, 32 nt, Human
acccaucccuggggcuuccuuugcucugccuu

SEQ ID NO: 35193 - RNA, 32 nt, Human
acccauccuaggcccgcuuucuugccgagcca

SEQ ID NO: 35194 - RNA, 32 nt, Human
acccauccuccacucccucuucuuuaacccag

SEQ ID NO: 35195 - RNA, 32 nt, Human
acccauccucggcgguucccaucaccacugca

SEQ ID NO: 35196 - RNA, 32 nt, Human
acccauccucuacuuagucacucuuauagagc

SEQ ID NO: 35197 - RNA, 32 nt, Human
acccauccucuucuccccguacugccucaacc

SEQ ID NO: 35198 - RNA, 32 nt, Human
acccauccugucuaucuucucaguugaguuuu

SEQ ID NO: 35199 - RNA, 32 nt, Human
acccaucggggaaaaagucuaaauuggagauc

SEQ ID NO: 35200 - RNA, 32 nt, Human
acccaucuacuuuaucugucauguccuucuuc

SEQ ID NO: 35201 - RNA, 32 nt, Human
acccaucuauuuuuguuugggaagaggaaacu

SEQ ID NO: 35202 - RNA, 32 nt, Human
acccaucuccaccucccaaagugcuaggauua

SEQ ID NO: 35203 - RNA, 32 nt, Human
acccaucucccaguugcauaguacagugucug

SEQ ID NO: 35204 - RNA, 32 nt, Human
acccaucucccccucacugaaugccucaaugu

SEQ ID NO: 35205 - RNA, 32 nt, Human
acccaucuccccucagaagaggcuuucucucu

SEQ ID NO: 35206 - RNA, 32 nt, Human
acccaucuccccuccgccucuuuggcugcagu

SEQ ID NO: 35207 - RNA, 32 nt, Human
acccaucucccuugucaugcugggcagcccac

SEQ ID NO: 35208 - RNA, 32 nt, Human
acccaucucuacuaaaaauaaaauuagccagg

SEQ ID NO: 35209 - RNA, 32 nt, Human
acccaucucuacuaaaaauaaaauuagccaug

SEQ ID NO: 35210 - RNA, 32 nt, Human
acccaucucucccuuacccaucuugcuuccaa

SEQ ID NO: 35211 - RNA, 32 nt, Human
acccaucugcaaauaucucccucucuccaaca

SEQ ID NO: 35212 - RNA, 32 nt, Human
acccaucugcucaccagaucucaggcaggaaa

SEQ ID NO: 35213 - RNA, 21 nt, Human
acccaucugcuccuccagcca

SEQ ID NO: 35214 - RNA, 32 nt, Human
acccaucuggcagcugcugugccugagguggc

SEQ ID NO: 35215 - RNA, 32 nt, Human
acccaucuguagucccagcuacuugggaggcu

SEQ ID NO: 35216 - RNA, 32 nt, Human
acccaucugucuggccagaccuguucuccaga

SEQ ID NO: 35217 - RNA, 32 nt, Human
acccaucuucacagcucuggugccaguggauu

SEQ ID NO: 35218 - RNA, 32 nt, Human
acccaucuucacuuggugcugccaucaacuuu

SEQ ID NO: 35219 - RNA, 32 nt, Human
acccaucuuuugcagugcaugccuuccuacuu

SEQ ID NO: 35220 - RNA, 29 nt, Human
acccaugaaacaaucauucccauuguuuc

SEQ ID NO: 35221 - RNA, 32 nt, Human
acccaugaaagagacccagugguuacugugca

SEQ ID NO: 35222 - RNA, 32 nt, Human
acccaugaaguaaguagacaagaaaaggagga

SEQ ID NO: 35223 - RNA, 23 nt, Human
acccaugaaugugagcuuaccag

SEQ ID NO: 35224 - RNA, 21 nt, Human
acccaugacaaacucuccaga

SEQ ID NO: 35225 - RNA, 21 nt, Human
acccaugacuuccucucgcca

SEQ ID NO: 35226 - RNA, 32 nt, Human
acccaugagauggguguccuaagagccaaggg

SEQ ID NO: 35227 - RNA, 32 nt, Human
acccaugagcagcuucagcagaguguaggucc

SEQ ID NO: 35228 - RNA, 32 nt, Human
acccaugagcccacagacagagcuguauuaag

SEQ ID NO: 35229 - RNA, 32 nt, Human
acccaugaggcggagguugcagugagccgaga

SEQ ID NO: 35230 - RNA, 32 nt, Human
acccaugagguggagguugcggugagccaaga

SEQ ID NO: 35231 - RNA, 32 nt, Human
acccaugcagaguuuccaggugugcacuggaa

SEQ ID NO: 35232 - RNA, 32 nt, Human
acccaugcaggaaagaaagcccauggaagagg

SEQ ID NO: 35233 - RNA, 32 nt, Human
acccaugccuggcuaauuuuuguacuuuuugu

SEQ ID NO: 35234 - RNA, 32 nt, Human
acccaugcuguaucugcaucccugucauucgu

SEQ ID NO: 35235 - RNA, 32 nt, Human
acccaugcugucuccacuucacaauauuugau

SEQ ID NO: 35236 - RNA, 32 nt, Human
acccauggcaggcagugaaaagagccaggagu

SEQ ID NO: 35237 - RNA, 22 nt, Human
acccauggccucucuccaggcc

SEQ ID NO: 35238 - RNA, 32 nt, Human
acccauggcgacaggaaugggagaaaggugug

SEQ ID NO: 35239 - RNA, 32 nt, Human
acccaugggcaggguggguggagggacugaug

SEQ ID NO: 35240 - RNA, 32 nt, Human
acccaugguaccuuaaaaaccuucuaaaaugc

SEQ ID NO: 35241 - RNA, 32 nt, Human
acccauggugcacaccuguaguccuccaugag

SEQ ID NO: 35242 - RNA, 32 nt, Human
acccaugucaucccagagaggugaucacaggg

SEQ ID NO: 35243 - RNA, 29 nt, Human
acccaugucugggaacugccccugccuac

SEQ ID NO: 35244 - RNA, 32 nt, Human
acccauuacaugcacauguacucacauacucc

SEQ ID NO: 35245 - RNA, 32 nt, Human
acccauuacugagagguacagagcguacagcc

SEQ ID NO: 35246 - RNA, 31 nt, Human
acccauuagaugcaggcucuaccucaaguac

SEQ ID NO: 35247 - RNA, 29 nt, Human
acccauuaucugugugugccugggagucc

SEQ ID NO: 35248 - RNA, 32 nt, Human
acccauucacacagcaggacucuucucacaug

SEQ ID NO: 35249 - RNA, 24 nt, Human
acccauuccaacuacagcaguuca

SEQ ID NO: 35250 - RNA, 18 nt, Human
acccauuccagggacccu

SEQ ID NO: 35251 - RNA, 32 nt, Human
acccauuccuuuacacaugaucuauggcagag

SEQ ID NO: 35252 - RNA, 24 nt, Human
acccauucuaaacaagggcauuca

SEQ ID NO: 35253 - RNA, 32 nt, Human
acccauucuccaccaacaucuuucuaaacugc

SEQ ID NO: 35254 - RNA, 32 nt, Human
acccauucuccucaucccucugcucucuggcc

SEQ ID NO: 35255 - RNA, 32 nt, Human
acccauucuuguacucccuugugaucuauaaa

SEQ ID NO: 35256 - RNA, 32 nt, Human
acccauucuuucuuuaucaucucccuccaaag

SEQ ID NO: 35257 - RNA, 32 nt, Human
acccauugaacauucggcacgugaccuugugg

SEQ ID NO: 35258 - RNA, 32 nt, Human
acccauugacucaccuuauccaaagcaaguuu

SEQ ID NO: 35259 - RNA, 32 nt, Human
acccauugccaagagaggaugcaucuggggag

SEQ ID NO: 35260 - RNA, 23 nt, Human
acccauugucugcugcccaaggg

SEQ ID NO: 35261 - RNA, 24 nt, Human
acccauuuaauuuauaaugguuuu

SEQ ID NO: 35262 - RNA, 32 nt, Human
acccauuuauuuccuuccuuccuuccuucuuu

SEQ ID NO: 35263 - RNA, 32 nt, Human
acccauuucaacaaaauugaacacaggacucu

SEQ ID NO: 35264 - RNA, 23 nt, Human
acccauuucacaaggacagcuca

SEQ ID NO: 35265 - RNA, 32 nt, Human
acccauuuccucacauccuugccaguacuuca

SEQ ID NO: 35266 - RNA, 32 nt, Human
acccauuucuuucuuuccuuccuuccuucuuu

SEQ ID NO: 35267 - RNA, 23 nt, Human
acccauuuuauuuauuggcuuug

SEQ ID NO: 35268 - RNA, 32 nt, Human
acccauuuucacauucccaucugucaccaauu

SEQ ID NO: 35269 - RNA, 32 nt, Human
acccauuuugacaaaguggaacaguggagcug

SEQ ID NO: 35270 - RNA, 32 nt, Human
acccauuuugcacuagaggaaaaccaugaagc

SEQ ID NO: 35271 - RNA, 32 nt, Human
acccauuuuugaagagggugaaguuuggagaa

SEQ ID NO: 35272 - RNA, 21 nt, Human
accccaaaacaggucuggcca

SEQ ID NO: 35273 - RNA, 18 nt, Human
accccaaaagccuguggc

SEQ ID NO: 35274 - RNA, 21 nt, Human
accccaaaauaaccccuugau

SEQ ID NO: 35275 - RNA, 32 nt, Human
accccaaaaugcugggacuuugagauugcacu

SEQ ID NO: 35276 - RNA, 32 nt, Human
accccaaaccuccucagcucaccucucucucu

SEQ ID NO: 35277 - RNA, 31 nt, Human
accccaaagagaccgccaucauggacgaccu

SEQ ID NO: 35278 - RNA, 22 nt, Human
accccaaagaugucucuggcua

SEQ ID NO: 35279 - RNA, 32 nt, Human
accccaaagggcccucgcagcacuguuugaaa

SEQ ID NO: 35280 - RNA, 17 nt, Human
accccaaagggcuacca

SEQ ID NO: 35281 - RNA, 32 nt, Human
accccaaagugcugggauuacaggcgugaagc

SEQ ID NO: 35282 - RNA, 32 nt, Human
accccaaaucacacugcacacagggucccuga

SEQ ID NO: 35283 - RNA, 32 nt, Human
accccaaaugaccacaacacaguacaauugcc

SEQ ID NO: 35284 - RNA, 32 nt, Human
accccaaaugcagcaauggccuggugauuccc

SEQ ID NO: 35285 - RNA, 32 nt, Human
accccaaauggauuuccagucaauucagaagc

SEQ ID NO: 35286 - RNA, 32 nt, Human
accccaaaugucccuuucuggaggaagccacc

SEQ ID NO: 35287 - RNA, 18 nt, Human
accccaacaccacugcca

SEQ ID NO: 35288 - RNA, 32 nt, Human
accccaacacccaccggcacacagaccccaac

SEQ ID NO: 35289 - RNA, 19 nt, Human
accccaacaccucaccucc

SEQ ID NO: 35290 - RNA, 20 nt, Human
accccaacagcacccucucc

SEQ ID NO: 35291 - RNA, 18 nt, Human
accccaacccaacaacca

SEQ ID NO: 35292 - RNA, 21 nt, Human
accccaaccccaauaggggag

SEQ ID NO: 35293 - RNA, 21 nt, Human
accccaacccuucaacuacca

SEQ ID NO: 35294 - RNA, 15 nt, Human
accccaacggaucca

SEQ ID NO: 35295 - RNA, 19 nt, Human
accccaacuacugaaucca

SEQ ID NO: 35296 - RNA, 18 nt, Human
accccaacuacuuuucau

SEQ ID NO: 35297 - RNA, 18 nt, Human
accccaacuccagcccau

SEQ ID NO: 35298 - RNA, 32 nt, Human
accccaacucugucuucucucuuuagagguaa

SEQ ID NO: 35299 - RNA, 18 nt, Human
accccaacugagucccca

SEQ ID NO: 35300 - RNA, 16 nt, Human
accccaacugccucca

SEQ ID NO: 35301 - RNA, 17 nt, Human
accccaacugucuacca

SEQ ID NO: 35302 - RNA, 17 nt, Human
accccaacugucuccau

SEQ ID NO: 35303 - RNA, 21 nt, Human
accccaacuucaaugucuuga

SEQ ID NO: 35304 - RNA, 17 nt, Human
accccaacuugaagcca

SEQ ID NO: 35305 - RNA, 32 nt, Human
accccaagcccaccucccuuguccucagccua

SEQ ID NO: 35306 - RNA, 18 nt, Human
accccaagcccgcccggc

SEQ ID NO: 35307 - RNA, 32 nt, Human
accccaaggaagagaauggcugucuuuggcgg

SEQ ID NO: 35308 - RNA, 22 nt, Human
accccaaggcagccugggguua

SEQ ID NO: 35309 - RNA, 32 nt, Human
accccaagucuggcuccauuccuggccuucug

SEQ ID NO: 35310 - RNA, 19 nt, Human
accccaagugcacgcugug

SEQ ID NO: 35311 - RNA, 32 nt, Human
accccaaucacuuccgaccugcuggccugcca

SEQ ID NO: 35312 - RNA, 32 nt, Human
accccaaucucagaaauucaaauuuaagcaug

SEQ ID NO: 35313 - RNA, 32 nt, Human
accccaauuacugcuggcaucuuaguugagag

SEQ ID NO: 35314 - RNA, 32 nt, Human
accccaauuccuggcccugucuugaagcauuu

SEQ ID NO: 35315 - RNA, 32 nt, Human
accccaauucuggcccacaccuauggcucagg

SEQ ID NO: 35316 - RNA, 21 nt, Human
accccacaacccacauccucc

SEQ ID NO: 35317 - RNA, 31 nt, Human
accccacaagugucuucacuguggaaaaccu

SEQ ID NO: 35318 - RNA, 18 nt, Human
accccacacaccccuucc

SEQ ID NO: 35319 - RNA, 32 nt, Human
accccacacacucugccaugcacacaggagga

SEQ ID NO: 35320 - RNA, 32 nt, Human
accccacaccaggccguccucccgggcccucc

SEQ ID NO: 35321 - RNA, 32 nt, Human
accccacacccacauccucucuuuuccacaca

SEQ ID NO: 35322 - RNA, 32 nt, Human
accccacacuggggcccuccuccugggccuga

SEQ ID NO: 35323 - RNA, 32 nt, Human
accccacagaagugcuuucuucucccaauuca

SEQ ID NO: 35324 - RNA, 32 nt, Human
accccacagagcugucugugggugccuucuca

SEQ ID NO: 35325 - RNA, 24 nt, Human
accccacagccaaucagcuacaga

SEQ ID NO: 35326 - RNA, 32 nt, Human
accccacagcgagggaagagacaggaugcguc

SEQ ID NO: 35327 - RNA, 23 nt, Human
accccacagcgcacacagaacac

SEQ ID NO: 35328 - RNA, 32 nt, Human
accccacaggaagggggaaggaaggagggaau

SEQ ID NO: 35329 - RNA, 32 nt, Human
accccacagucgggcuggcaucuggggacagg

SEQ ID NO: 35330 - RNA, 32 nt, Human
accccacaguucccacggcaucugccacucuu

SEQ ID NO: 35331 - RNA, 32 nt, Human
accccacaugcuguccucacagguggcgccuu

SEQ ID NO: 35332 - RNA, 32 nt, Human
accccacauggauucucaacagguggccggug

SEQ ID NO: 35333 - RNA, 32 nt, Human
accccacauggcauauaccacccaucucuggu

SEQ ID NO: 35334 - RNA, 32 nt, Human
accccacauugcacucccaucucugcaugcuc

SEQ ID NO: 35335 - RNA, 32 nt, Human
accccaccaccacccgcaacacugccgcuguc

SEQ ID NO: 35336 - RNA, 32 nt, Human
accccaccacugcacuccagccuggaugacag

SEQ ID NO: 35337 - RNA, 32 nt, Human
accccaccagaaauggagagcacacagcagaa

SEQ ID NO: 35338 - RNA, 32 nt, Human
accccaccagaacaugcccgggugaccuccuc

SEQ ID NO: 35339 - RNA, 32 nt, Human
accccaccagccccuuucaucccuccuuccuc

SEQ ID NO: 35340 - RNA, 32 nt, Human
accccaccagccuggcccugggaacagcaggc

SEQ ID NO: 35341 - RNA, 23 nt, Human
accccaccauaaccuccuacuca

SEQ ID NO: 35342 - RNA, 23 nt, Human
accccaccauggcccagggaccc

SEQ ID NO: 35343 - RNA, 32 nt, Human
accccaccauugcacuccaguccgggaaacaa

SEQ ID NO: 35344 - RNA, 19 nt, Human
accccacccaaagcugccu

SEQ ID NO: 35345 - RNA, 32 nt, Human
accccacccaacuggccaaguguuaagugaug

SEQ ID NO: 35346 - RNA, 32 nt, Human
accccacccaggagcugaggcugauggagccc

SEQ ID NO: 35347 - RNA, 32 nt, Human
accccaccccacccuucacaccuggcugauuu

SEQ ID NO: 35348 - RNA, 20 nt, Human
accccaccccacgcuccagc

SEQ ID NO: 35349 - RNA, 32 nt, Human
accccaccccgggagggcagagccagaagaag

SEQ ID NO: 35350 - RNA, 19 nt, Human
accccaccccuccacucca

SEQ ID NO: 35351 - RNA, 32 nt, Human
accccacccuccaccucaauccccucccaucu

SEQ ID NO: 35352 - RNA, 32 nt, Human
accccacccuccaggguuagggggagcaggaa

SEQ ID NO: 35353 - RNA, 32 nt, Human
accccacccuccuccacccucuacccucaagu

SEQ ID NO: 35354 - RNA, 17 nt, Human
accccacccugccacca

SEQ ID NO: 35355 - RNA, 32 nt, Human
accccacccuugcccccagcccucucucccug

SEQ ID NO: 35356 - RNA, 32 nt, Human
accccacccuuucuccuccuccuuccucugag

SEQ ID NO: 35357 - RNA, 32 nt, Human
accccaccuaaaggacagguggcccucacaca

SEQ ID NO: 35358 - RNA, 32 nt, Human
accccaccuagaccacccuccaugucagguac

SEQ ID NO: 35359 - RNA, 32 nt, Human
accccaccucccccucucccuccuccccuuug

SEQ ID NO: 35360 - RNA, 32 nt, Human
accccaccucgagcuccuggaugcacugcuau

SEQ ID NO: 35361 - RNA, 32 nt, Human
accccaccucgaggagcuuccugagcaggugg

SEQ ID NO: 35362 - RNA, 16 nt, Human
accccaccugccaccg

SEQ ID NO: 35363 - RNA, 32 nt, Human
accccaccuggaacccgaccucccagccucgc

SEQ ID NO: 35364 - RNA, 32 nt, Human
accccaccugggaaccuuuuucccucaguuag

SEQ ID NO: 35365 - RNA, 32 nt, Human
accccaccugugaacuccuaccagagagaaac

SEQ ID NO: 35366 - RNA, 32 nt, Human
accccaccuugggcccccucuggagcagcccc

SEQ ID NO: 35367 - RNA, 32 nt, Human
accccacgcccaccuccaccccaggagccgaa

SEQ ID NO: 35368 - RNA, 22 nt, Human
accccacggcccggaggacaca

SEQ ID NO: 35369 - RNA, 32 nt, Human
accccacucaccaguucugcugccucagguca

SEQ ID NO: 35370 - RNA, 17 nt, Human
accccacucacuuccau

SEQ ID NO: 35371 - RNA, 32 nt, Human
accccacucagcucaccucucccuccaccucc

SEQ ID NO: 35372 - RNA, 19 nt, Human
accccacucccaagggaag

SEQ ID NO: 35373 - RNA, 18 nt, Human
accccacucccacauggg

SEQ ID NO: 35374 - RNA, 21 nt, Human
accccacucccaccuuugaag

SEQ ID NO: 35375 - RNA, 32 nt, Human
accccacucccucugcugcagcacccccauac

SEQ ID NO: 35376 - RNA, 32 nt, Human
accccacucuccaggacccauggaguccuuca

SEQ ID NO: 35377 - RNA, 32 nt, Human
accccacugaagauggaaguagagcagucugc

SEQ ID NO: 35378 - RNA, 21 nt, Human
accccacugacgucuuucaga

SEQ ID NO: 35379 - RNA, 32 nt, Human
accccacugcauuccagccugggugacagagc

SEQ ID NO: 35380 - RNA, 20 nt, Human
accccacuggccacugccau

SEQ ID NO: 35381 - RNA, 32 nt, Human
accccacuggccacugccauccugcugccuuc

SEQ ID NO: 35382 - RNA, 20 nt, Human
accccacuguagacaggaaa

SEQ ID NO: 35383 - RNA, 32 nt, Human
accccacuguagacaggaaagccaggccagga

SEQ ID NO: 35384 - RNA, 32 nt, Human
accccacuguccuccagccugggcaacagaga

SEQ ID NO: 35385 - RNA, 21 nt, Human
accccacuuccagugaagaag

SEQ ID NO: 35386 - RNA, 21 nt, Human
accccacuuccuucucggaag

SEQ ID NO: 35387 - RNA, 32 nt, Human
accccagaagcagcaguggcagcuugggaaau

SEQ ID NO: 35388 - RNA, 32 nt, Human
accccagaagccccaauuuccccaagccccau

SEQ ID NO: 35389 - RNA, 19 nt, Human
accccagaaggccugggca

SEQ ID NO: 35390 - RNA, 22 nt, Human
accccagaauuccauguugaaa

SEQ ID NO: 35391 - RNA, 32 nt, Human
accccagacagcccuucuggcacagggacagg

SEQ ID NO: 35392 - RNA, 21 nt, Human
accccagaccccagacacagg

SEQ ID NO: 35393 - RNA, 32 nt, Human
accccagacccuggcuggccaggaugaaguau

SEQ ID NO: 35394 - RNA, 23 nt, Human
accccagacuuaaugaauuucag

SEQ ID NO: 35395 - RNA, 24 nt, Human
accccagagacucauucucugcca

SEQ ID NO: 35396 - RNA, 32 nt, Human
accccagagccagcccucccacuaccaccacc

SEQ ID NO: 35397 - RNA, 18 nt, Human
accccagagcccuguggc

SEQ ID NO: 35398 - RNA, 23 nt, Human
accccagagccugacccugcaga

SEQ ID NO: 35399 - RNA, 22 nt, Human
accccagagcgggagcuguggc

SEQ ID NO: 35400 - RNA, 21 nt, Human
accccagagcuaggccgcgga

SEQ ID NO: 35401 - RNA, 32 nt, Human
accccagaggcagaggcugaagugagccaaga

SEQ ID NO: 35402 - RNA, 32 nt, Human
accccagaggcagagguugcagugagcugaga

SEQ ID NO: 35403 - RNA, 32 nt, Human
accccagaggcagagguugcggugagccgaga

SEQ ID NO: 35404 - RNA, 32 nt, Human
accccagaggcggagguugcagugagccgaga

SEQ ID NO: 35405 - RNA, 32 nt, Human
accccagaggucaagacugcagugagcugaga

SEQ ID NO: 35406 - RNA, 32 nt, Human
accccagagguggagguugcagugagccgaga

SEQ ID NO: 35407 - RNA, 24 nt, Human
accccagaguccccagaugagcug

SEQ ID NO: 35408 - RNA, 32 nt, Human
accccagagugaggaggacgcaggggucagag

SEQ ID NO: 35409 - RNA, 32 nt, Human
accccagaugcaugggccagagggccggcccc

SEQ ID NO: 35410 - RNA, 32 nt, Human
accccagcaaccccugugucuccuacuccugc

SEQ ID NO: 35411 - RNA, 17 nt, Human
accccagcaacuguggc

SEQ ID NO: 35412 - RNA, 19 nt, Human
accccagcaagugguccua

SEQ ID NO: 35413 - RNA, 18 nt, Human
accccagcagcgcugcgg

SEQ ID NO: 35414 - RNA, 21 nt, Human
accccagcaggaccugccagc

SEQ ID NO: 35415 - RNA, 20 nt, Human
accccagcagugacuaccau

SEQ ID NO: 35416 - RNA, 32 nt, Human
accccagcaguggugcaggacagcugccagca

SEQ ID NO: 35417 - RNA, 21 nt, Human
accccagcaucagccuguagc

SEQ ID NO: 35418 - RNA, 17 nt, Human
accccagcaugcuugug

SEQ ID NO: 35419 - RNA, 16 nt, Human
accccagccacaccau

SEQ ID NO: 35420 - RNA, 21 nt, Human
accccagccacaggcuguggc

SEQ ID NO: 35421 - RNA, 19 nt, Human
accccagccaccccagcca

SEQ ID NO: 35422 - RNA, 22 nt, Human
accccagccaccgcccugcggc

SEQ ID NO: 35423 - RNA, 32 nt, Human
accccagccacuccagaaacccaaugggaggg

SEQ ID NO: 35424 - RNA, 17 nt, Human
accccagccagcauggc

SEQ ID NO: 35425 - RNA, 32 nt, Human
accccagccagccugucaccaugcugacagca

SEQ ID NO: 35426 - RNA, 16 nt, Human
accccagccagcugug

SEQ ID NO: 35427 - RNA, 21 nt, Human
accccagcccaacuccagggc

SEQ ID NO: 35428 - RNA, 32 nt, Human
accccagcccaccucacuaucauacucagcuu

SEQ ID NO: 35429 - RNA, 21 nt, Human
accccagcccaggcaccaggc

SEQ ID NO: 35430 - RNA, 20 nt, Human
accccagcccaggccggggc

SEQ ID NO: 35431 - RNA, 18 nt, Human
accccagcccagggcggc

SEQ ID NO: 35432 - RNA, 20 nt, Human
accccagccccacuccgggc

SEQ ID NO: 35433 - RNA, 22 nt, Human
accccagcccccaccuuucaga

SEQ ID NO: 35434 - RNA, 21 nt, Human
accccagcccccauccugggc

SEQ ID NO: 35435 - RNA, 23 nt, Human
accccagccccccaaacuuuggc

SEQ ID NO: 35436 - RNA, 19 nt, Human
accccagcccccgucugug

SEQ ID NO: 35437 - RNA, 21 nt, Human
accccagccccgcacagaggc

SEQ ID NO: 35438 - RNA, 19 nt, Human
accccagccccgcccaggc

SEQ ID NO: 35439 - RNA, 20 nt, Human
accccagccccugcccaggc

SEQ ID NO: 35440 - RNA, 20 nt, Human
accccagccccugucagggc

SEQ ID NO: 35441 - RNA, 21 nt, Human
accccagccccugugccaggc

SEQ ID NO: 35442 - RNA, 19 nt, Human
accccagcccgacccuccc

SEQ ID NO: 35443 - RNA, 20 nt, Human
accccagcccgccguccagc

SEQ ID NO: 35444 - RNA, 22 nt, Human
accccagcccggcuggcccggc

SEQ ID NO: 35445 - RNA, 20 nt, Human
accccagcccguaccugggc

SEQ ID NO: 35446 - RNA, 19 nt, Human
accccagcccgugcagcug

SEQ ID NO: 35447 - RNA, 19 nt, Human
accccagcccuaggcuggg

SEQ ID NO: 35448 - RNA, 20 nt, Human
accccagcccugcacggggc

SEQ ID NO: 35449 - RNA, 32 nt, Human
accccagcccugcccuugcuuccuucaauaaa

SEQ ID NO: 35450 - RNA, 21 nt, Human
accccagcccugcgcaugggc

SEQ ID NO: 35451 - RNA, 18 nt, Human
accccagcccuggaggug

SEQ ID NO: 35452 - RNA, 25 nt, Human
accccagcccuggcaucugcccaga

SEQ ID NO: 35453 - RNA, 18 nt, Human
accccagcccuggggugg

SEQ ID NO: 35454 - RNA, 18 nt, Human
accccagcccugucuggc

SEQ ID NO: 35455 - RNA, 21 nt, Human
accccagcccuugggccuggc

SEQ ID NO: 35456 - RNA, 18 nt, Human
accccagccgcauccccu

SEQ ID NO: 35457 - RNA, 32 nt, Human
accccagccggaggaagugagcucuccugggg

SEQ ID NO: 35458 - RNA, 19 nt, Human
accccagccggaucugggc

SEQ ID NO: 35459 - RNA, 24 nt, Human
accccagccggcugcguuccucuc

SEQ ID NO: 35460 - RNA, 21 nt, Human
accccagccggcugcuggagc

SEQ ID NO: 35461 - RNA, 20 nt, Human
accccagccggcuuccuggc

SEQ ID NO: 35462 - RNA, 19 nt, Human
accccagccgggcugccgc

SEQ ID NO: 35463 - RNA, 19 nt, Human
accccagccggggcucugg

SEQ ID NO: 35464 - RNA, 19 nt, Human
accccagccuaggcugcgc

SEQ ID NO: 35465 - RNA, 23 nt, Human
accccagccucagacagacacag

SEQ ID NO: 35466 - RNA, 32 nt, Human
accccagccucaucuucuaggccuuuuccauc

SEQ ID NO: 35467 - RNA, 32 nt, Human
accccagccucauuuucuuucuguuccuuccc

SEQ ID NO: 35468 - RNA, 23 nt, Human
accccagccuccccacccaccuc

SEQ ID NO: 35469 - RNA, 19 nt, Human
accccagccucccugaggc

SEQ ID NO: 35470 - RNA, 21 nt, Human
accccagccucugccaacggc

SEQ ID NO: 35471 - RNA, 22 nt, Human
accccagccucuuccaggagag

SEQ ID NO: 35472 - RNA, 20 nt, Human
accccagccuggccacgcag

SEQ ID NO: 35473 - RNA, 21 nt, Human
accccagccuggccgccuggc

SEQ ID NO: 35474 - RNA, 32 nt, Human
accccagccugggaagaacauuuuccugaaca

SEQ ID NO: 35475 - RNA, 22 nt, Human
accccagccugggcaacagagc

SEQ ID NO: 35476 - RNA, 21 nt, Human
accccagccugggcgacagag

SEQ ID NO: 35477 - RNA, 23 nt, Human
accccagccugggggccacaagg

SEQ ID NO: 35478 - RNA, 26 nt, Human
accccagccugggugacagagcgaga

SEQ ID NO: 35479 - RNA, 19 nt, Human
accccagccuggugccggc

SEQ ID NO: 35480 - RNA, 32 nt, Human
accccagccugguggcagaggaagcagguggc

SEQ ID NO: 35481 - RNA, 17 nt, Human
accccagccuggugugg

SEQ ID NO: 35482 - RNA, 20 nt, Human
accccagccuugagcuuagc

SEQ ID NO: 35483 - RNA, 19 nt, Human
accccagcgcgacugcagc

SEQ ID NO: 35484 - RNA, 32 nt, Human
accccagcggagaguguuccuuuuggucccuc

SEQ ID NO: 35485 - RNA, 19 nt, Human
accccagcuaaggcauggc

SEQ ID NO: 35486 - RNA, 31 nt, Human
accccagcuacucaggagguugaggcaggag

SEQ ID NO: 35487 - RNA, 32 nt, Human
accccagcuauugcauuuccagcugcugccag

SEQ ID NO: 35488 - RNA, 20 nt, Human
accccagcucaagccauggc

SEQ ID NO: 35489 - RNA, 19 nt, Human
accccagcucaccccuggc

SEQ ID NO: 35490 - RNA, 32 nt, Human
accccagcucacuagccuucauauaugccuua

SEQ ID NO: 35491 - RNA, 32 nt, Human
accccagcucagcuccaauuucccaggcuuuc

SEQ ID NO: 35492 - RNA, 17 nt, Human
accccagcuccacugug

SEQ ID NO: 35493 - RNA, 16 nt, Human
accccagcucccugug

SEQ ID NO: 35494 - RNA, 19 nt, Human
accccagcuccgacugcgg

SEQ ID NO: 35495 - RNA, 19 nt, Human
accccagcuccgcugcugc

SEQ ID NO: 35496 - RNA, 32 nt, Human
accccagcucugccucacaggcaggcaggccc

SEQ ID NO: 35497 - RNA, 19 nt, Human
accccagcucuggcuaugc

SEQ ID NO: 35498 - RNA, 32 nt, Human
accccagcucuggggcuugggggugaggguca

SEQ ID NO: 35499 - RNA, 16 nt, Human
accccagcugcugcca

SEQ ID NO: 35500 - RNA, 19 nt, Human
accccagcuggcccguggc

SEQ ID NO: 35501 - RNA, 21 nt, Human
accccagcugugagccuuggc

SEQ ID NO: 35502 - RNA, 32 nt, Human
accccagcuguuacccagcccggggcaggugc

SEQ ID NO: 35503 - RNA, 32 nt, Human
accccagcuucucucuccuggccagugauuac

SEQ ID NO: 35504 - RNA, 21 nt, Human
accccagcuugggagcugugg

SEQ ID NO: 35505 - RNA, 19 nt, Human
accccagcuuguccuuggc

SEQ ID NO: 35506 - RNA, 21 nt, Human
accccagcuuuucacuggggc

SEQ ID NO: 35507 - RNA, 23 nt, Human
accccaggaauggcuucaacaga

SEQ ID NO: 35508 - RNA, 23 nt, Human
accccaggacacccacccaccca

SEQ ID NO: 35509 - RNA, 32 nt, Human
accccaggagaaaguguccaggugggggcugg

SEQ ID NO: 35510 - RNA, 32 nt, Human
accccaggaggcagagguugaagugagccagg

SEQ ID NO: 35511 - RNA, 32 nt, Human
accccaggaggcgaagauugcagugagcugau

SEQ ID NO: 35512 - RNA, 32 nt, Human
accccaggaggcucuuaucuccccagccccgc

SEQ ID NO: 35513 - RNA, 32 nt, Human
accccaggagguggacauugcagugagccgag

SEQ ID NO: 35514 - RNA, 25 nt, Human
accccaggagucuaaaauccagguc

SEQ ID NO: 35515 - RNA, 32 nt, Human
accccaggcaacauuuauuuauuggaaauuga

SEQ ID NO: 35516 - RNA, 32 nt, Human
accccaggcacagacccugcugugcucuuugg

SEQ ID NO: 35517 - RNA, 22 nt, Human
accccaggcaugcaccaccuca

SEQ ID NO: 35518 - RNA, 22 nt, Human
accccaggccgagaucuugccc

SEQ ID NO: 35519 - RNA, 32 nt, Human
accccaggccugaaaaggaugcaaagccugcu

SEQ ID NO: 35520 - RNA, 30 nt, Human
accccaggccugcaaucauaagcgacugaa

SEQ ID NO: 35521 - RNA, 21 nt, Human
accccaggcuacauauggaag

SEQ ID NO: 35522 - RNA, 21 nt, Human
accccaggcucaggcugcaga

SEQ ID NO: 35523 - RNA, 32 nt, Human
accccagggaaaucacucuuuacaauuuguaa

SEQ ID NO: 35524 - RNA, 32 nt, Human
accccagggaggcacagggggagcaugaagag

SEQ ID NO: 35525 - RNA, 32 nt, Human
accccagggaugaccuagagucuaacccugac

SEQ ID NO: 35526 - RNA, 18 nt, Human
accccagggccaacuccc

SEQ ID NO: 35527 - RNA, 32 nt, Human
accccaggggaggaggagaugggcaggauuua

SEQ ID NO: 35528 - RNA, 32 nt, Human
accccaggggcagacuccagaucaucagacac

SEQ ID NO: 35529 - RNA, 18 nt, Human
accccagggggccuuggc

SEQ ID NO: 35530 - RNA, 22 nt, Human
accccaggggucugguacagcc

SEQ ID NO: 35531 - RNA, 22 nt, Human
accccagggucaagccugcucu

SEQ ID NO: 35532 - RNA, 24 nt, Human
accccaggugauccaccugccuca

SEQ ID NO: 35533 - RNA, 19 nt, Human
accccaggugcagccuggc

SEQ ID NO: 35534 - RNA, 32 nt, Human
accccaggugcggcuggaucugucuuugacuu

SEQ ID NO: 35535 - RNA, 26 nt, Human
accccaggugguggagguugcaguga

SEQ ID NO: 35536 - RNA, 32 nt, Human
accccaggugguggagguugcagugagccaag

SEQ ID NO: 35537 - RNA, 32 nt, Human
accccagguguccagagcacugccccaugccc

SEQ ID NO: 35538 - RNA, 32 nt, Human
accccagguucucaccucagggguuaagagcu

SEQ ID NO: 35539 - RNA, 19 nt, Human
accccaguaagauuguggc

SEQ ID NO: 35540 - RNA, 18 nt, Human
accccaguagcgcugggc

SEQ ID NO: 35541 - RNA, 32 nt, Human
accccagucacuccucucuagggcagaagacu

SEQ ID NO: 35542 - RNA, 17 nt, Human
accccagucuaacacca

SEQ ID NO: 35543 - RNA, 17 nt, Human
accccagucuagcacca

SEQ ID NO: 35544 - RNA, 17 nt, Human
accccagucugccucca

SEQ ID NO: 35545 - RNA, 21 nt, Human
accccagugauaaucuauggc

SEQ ID NO: 35546 - RNA, 18 nt, Human
accccagugccacugugg

SEQ ID NO: 35547 - RNA, 19 nt, Human
accccagugcccgcugggc

SEQ ID NO: 35548 - RNA, 32 nt, Human
accccagugcccgcugggcccagccuggggac

SEQ ID NO: 35549 - RNA, 17 nt, Human
accccagugcugcugug

SEQ ID NO: 35550 - RNA, 32 nt, Human
accccaguuagucagcaagaagacugaguugc

SEQ ID NO: 35551 - RNA, 32 nt, Human
accccaguucccaaacacaggaagugauuuuc

SEQ ID NO: 35552 - RNA, 19 nt, Human
accccaguugggcuuuggc

SEQ ID NO: 35553 - RNA, 32 nt, Human
accccauaaauauacaaaauuauuugucaauu

SEQ ID NO: 35554 - RNA, 32 nt, Human
accccauaagauuuaccagccaucagcucuau

SEQ ID NO: 35555 - RNA, 32 nt, Human
accccauauguagcaaaaaucagggcuggggg

SEQ ID NO: 35556 - RNA, 32 nt, Human
accccaucacugggguguguuuauuugauggu

SEQ ID NO: 35557 - RNA, 32 nt, Human
accccauccagccacaccaccucugccuucca

SEQ ID NO: 35558 - RNA, 22 nt, Human
accccauccuugcuucaucuca

SEQ ID NO: 35559 - RNA, 32 nt, Human
accccaucgagaugaaauuaaacagauuagaa

SEQ ID NO: 35560 - RNA, 32 nt, Human
accccaucucuaagaaaaagaaaaagaaauaa

SEQ ID NO: 35561 - RNA, 32 nt, Human
accccaucucuacaaaaauacaaaaauuagcc

SEQ ID NO: 35562 - RNA, 32 nt, Human
accccaucucuacaaaaauacaaaauuagcca

SEQ ID NO: 35563 - RNA, 21 nt, Human
accccaucucuaugcuguggc

SEQ ID NO: 35564 - RNA, 21 nt, Human
accccaucucucagggacccu

SEQ ID NO: 35565 - RNA, 32 nt, Human
accccaucugacuaccccagacucugccugcc

SEQ ID NO: 35566 - RNA, 32 nt, Human
accccaucuguuugccugaggcugcagcaaaa

SEQ ID NO: 35567 - RNA, 32 nt, Human
accccaucuuccacaucuuuaaagcucaugug

SEQ ID NO: 35568 - RNA, 32 nt, Human
accccaucuuugcugggauucccaucaacucu

SEQ ID NO: 35569 - RNA, 26 nt, Human
accccaugaggacaugcagagcaccu

SEQ ID NO: 35570 - RNA, 22 nt, Human
accccaugauccacccgccuca

SEQ ID NO: 35571 - RNA, 32 nt, Human
accccaugcucaagccuccccgcuagcagccc

SEQ ID NO: 35572 - RNA, 32 nt, Human
accccauuaagaagguuggcuuggccaggcag

SEQ ID NO: 35573 - RNA, 32 nt, Human
accccauucccuauccucucccuaaucccaaa

SEQ ID NO: 35574 - RNA, 32 nt, Human
accccauucucucuguucguccuuccuugacc

SEQ ID NO: 35575 - RNA, 32 nt, Human
accccauucugggacugcucaggcuccccaag

SEQ ID NO: 35576 - RNA, 32 nt, Human
accccauucuuuccuucucugaaaguggugcu

SEQ ID NO: 35577 - RNA, 32 nt, Human
accccauugcacuccagccuggacaacaagag

SEQ ID NO: 35578 - RNA, 32 nt, Human
accccauuucacuccagccugggcgacaagag

SEQ ID NO: 35579 - RNA, 20 nt, Human
accccauuuucaugguccua

SEQ ID NO: 35580 - RNA, 23 nt, Human
acccccaaaagggaagcagagga

SEQ ID NO: 35581 - RNA, 22 nt, Human
acccccaaagagagacgugggg

SEQ ID NO: 35582 - RNA, 23 nt, Human
acccccaaaggaaaagccagagg

SEQ ID NO: 35583 - RNA, 32 nt, Human
acccccaaagugcuggauuacaggugugagcc

SEQ ID NO: 35584 - RNA, 22 nt, Human
acccccaaaucacucucagggu

SEQ ID NO: 35585 - RNA, 32 nt, Human
acccccaaccaccaucuaccacuacggccacc

SEQ ID NO: 35586 - RNA, 32 nt, Human
acccccaacccccauccccaguucgagccgcc

SEQ ID NO: 35587 - RNA, 17 nt, Human
acccccaacccccuucc

SEQ ID NO: 35588 - RNA, 21 nt, Human
acccccaaccccugcccacag

SEQ ID NO: 35589 - RNA, 32 nt, Human
acccccaacccgucacagcguggccgugggug

SEQ ID NO: 35590 - RNA, 21 nt, Human
acccccaaccucccagaggga

SEQ ID NO: 35591 - RNA, 20 nt, Human
acccccaacgcguccucuca

SEQ ID NO: 35592 - RNA, 18 nt, Human
acccccaacucccuucca

SEQ ID NO: 35593 - RNA, 32 nt, Human
acccccaagaaugcaggcucugccuggcacgc

SEQ ID NO: 35594 - RNA, 32 nt, Human
acccccaagcuuccaccugucccucuccuaug

SEQ ID NO: 35595 - RNA, 32 nt, Human
acccccaaggcggagcuugcagugagccgaga

SEQ ID NO: 35596 - RNA, 32 nt, Human
acccccaauauuuuuggacuggcagacucaag

SEQ ID NO: 35597 - RNA, 32 nt, Human
acccccacaauccucuccugaaacuuaaaaac

SEQ ID NO: 35598 - RNA, 32 nt, Human
acccccacacacaaccuccccuguuuucacau

SEQ ID NO: 35599 - RNA, 32 nt, Human
acccccacagaccugcucuggacacuugcuca

SEQ ID NO: 35600 - RNA, 20 nt, Human
acccccacagcccgaagcag

SEQ ID NO: 35601 - RNA, 32 nt, Human
acccccacagccggagcccccgccgcuccaca

SEQ ID NO: 35602 - RNA, 32 nt, Human
acccccacaucccggguucaagugauucuccu

SEQ ID NO: 35603 - RNA, 32 nt, Human
acccccaccaacaccguccagagaggccugag

SEQ ID NO: 35604 - RNA, 19 nt, Human
acccccaccaccccuuuca

SEQ ID NO: 35605 - RNA, 32 nt, Human
acccccaccacugcagacucgcucuaggaaga

SEQ ID NO: 35606 - RNA, 32 nt, Human
acccccaccagcggcccugcuugcuccguagc

SEQ ID NO: 35607 - RNA, 32 nt, Human
acccccaccagcuguagcugaacgucuggaug

SEQ ID NO: 35608 - RNA, 32 nt, Human
acccccaccaugaaccugucagccucuuuccc

SEQ ID NO: 35609 - RNA, 32 nt, Human
acccccacccagcacacacacagaugucaggg

SEQ ID NO: 35610 - RNA, 22 nt, Human
acccccaccccaaauuaaaaug

SEQ ID NO: 35611 - RNA, 32 nt, Human
acccccaccccacggacguguugcagugauau

SEQ ID NO: 35612 - RNA, 32 nt, Human
acccccaccccuccacuggccagccugggggu

SEQ ID NO: 35613 - RNA, 23 nt, Human
acccccaccccucugccaaagua

SEQ ID NO: 35614 - RNA, 32 nt, Human
acccccacccugccucuauccuaaggaagacc

SEQ ID NO: 35615 - RNA, 32 nt, Human
acccccaccucccagguucaagcgauucuccu

SEQ ID NO: 35616 - RNA, 32 nt, Human
acccccaccucccggguucaagcgauucaccu

SEQ ID NO: 35617 - RNA, 32 nt, Human
acccccaccucccugcagcuuugaggcuggcg

SEQ ID NO: 35618 - RNA, 24 nt, Human
acccccaccuccugcaauaaaaua

SEQ ID NO: 35619 - RNA, 22 nt, Human
acccccaccuccugcaauuaaa

SEQ ID NO: 35620 - RNA, 32 nt, Human
acccccaccugucagaagucccucgcagcucc

SEQ ID NO: 35621 - RNA, 32 nt, Human
acccccacgugguguaagcagaggaggaauug

SEQ ID NO: 35622 - RNA, 32 nt, Human
acccccacucacugcauccugggaaccuucgc

SEQ ID NO: 35623 - RNA, 32 nt, Human
acccccacucccaccaucugcagguggugaaa

SEQ ID NO: 35624 - RNA, 32 nt, Human
acccccacucccgccucagggccaggcccagg

SEQ ID NO: 35625 - RNA, 32 nt, Human
acccccacucuugccuggauucugagugucac

SEQ ID NO: 35626 - RNA, 21 nt, Human
acccccacugcaggcuguggc

SEQ ID NO: 35627 - RNA, 19 nt, Human
acccccacuggcccuucca

SEQ ID NO: 35628 - RNA, 32 nt, Human
acccccacuguuguggucagccccagagaauu

SEQ ID NO: 35629 - RNA, 32 nt, Human
acccccagacacauccacacagaugaccucac

SEQ ID NO: 35630 - RNA, 32 nt, Human
acccccagaggcgcagagguggccgcugugcu

SEQ ID NO: 35631 - RNA, 32 nt, Human
acccccagagguggcccuuguuuacagugagg

SEQ ID NO: 35632 - RNA, 32 nt, Human
acccccagaguguggaaagaaagaccaucucc

SEQ ID NO: 35633 - RNA, 32 nt, Human
acccccagcacccagagccuaggcagccggaa

SEQ ID NO: 35634 - RNA, 32 nt, Human
acccccagcauggcuuggaagacugaaaggca

SEQ ID NO: 35635 - RNA, 32 nt, Human
acccccagccaaggccugcugaccgcgccgag

SEQ ID NO: 35636 - RNA, 32 nt, Human
acccccagcccccacccagccugcuggcagag

SEQ ID NO: 35637 - RNA, 32 nt, Human
acccccagcugccuccugagggugugggguua

SEQ ID NO: 35638 - RNA, 21 nt, Human
acccccagcuugacuucuuuc

SEQ ID NO: 35639 - RNA, 32 nt, Human
acccccagcuuuucuuggugugacacaaaggu

SEQ ID NO: 35640 - RNA, 32 nt, Human
acccccaggccagagugcaguggugcaaucuc

SEQ ID NO: 35641 - RNA, 32 nt, Human
acccccaggccagagugcaguggugcgaucuc

SEQ ID NO: 35642 - RNA, 32 nt, Human
acccccaggcccaaugucugaccugugcccac

SEQ ID NO: 35643 - RNA, 32 nt, Human
acccccaggugggaggggcaggaagcagccgg

SEQ ID NO: 35644 - RNA, 32 nt, Human
acccccaggugucugaguccaggcacuaagaa

SEQ ID NO: 35645 - RNA, 32 nt, Human
acccccaguguggcugucugcgagauugggcc

SEQ ID NO: 35646 - RNA, 32 nt, Human
acccccaguucugggcugggauccuggcucca

SEQ ID NO: 35647 - RNA, 32 nt, Human
acccccaguugacaucaagccucggcagccaa

SEQ ID NO: 35648 - RNA, 32 nt, Human
acccccaucccacccaaccacaggccccacuu

SEQ ID NO: 35649 - RNA, 32 nt, Human
acccccauccugucugucuccacucucauccc

SEQ ID NO: 35650 - RNA, 22 nt, Human
acccccaucgcuacaaaaaaua

SEQ ID NO: 35651 - RNA, 32 nt, Human
acccccaucucccagguucaagcgauucuccu

SEQ ID NO: 35652 - RNA, 22 nt, Human
acccccaucucuacaaaaaaua

SEQ ID NO: 35653 - RNA, 32 nt, Human
acccccaucuuccuccucccgacaucgcaaac

SEQ ID NO: 35654 - RNA, 32 nt, Human
acccccaucuugcccuuccuguuccuuggcaa

SEQ ID NO: 35655 - RNA, 21 nt, Human
acccccaugcugacccccuuc

SEQ ID NO: 35656 - RNA, 32 nt, Human
acccccaugggacaggugaggggcucggacgg

SEQ ID NO: 35657 - RNA, 32 nt, Human
acccccaugugcacccuucucccuccagccug

SEQ ID NO: 35658 - RNA, 22 nt, Human
acccccauuaaauucacuuuca

SEQ ID NO: 35659 - RNA, 32 nt, Human
acccccauuauauuaauuuucagggauaguaa

SEQ ID NO: 35660 - RNA, 22 nt, Human
accccccaccaacccccuucua

SEQ ID NO: 35661 - RNA, 22 nt, Human
accccccaccucccacccccca

SEQ ID NO: 35662 - RNA, 18 nt, Human
accccccagcaccuucca

SEQ ID NO: 35663 - RNA, 23 nt, Human
accccccgccgccccccuggaaa

SEQ ID NO: 35664 - RNA, 21 nt, Human
accccccggcuucagggaccc

SEQ ID NO: 35665 - RNA, 18 nt, Human
accccccucaccccagcc

SEQ ID NO: 35666 - RNA, 20 nt, Human
accccccuccuaccccuccc

SEQ ID NO: 35667 - RNA, 18 nt, Human
accccccugccccgcucc

SEQ ID NO: 35668 - RNA, 22 nt, Human
accccccugcugcugcccaagc

SEQ ID NO: 35669 - RNA, 22 nt, Human
accccccuuggccuccccucca

SEQ ID NO: 35670 - RNA, 32 nt, Human
acccccgaggggcaagguggaggagcucuccu

SEQ ID NO: 35671 - RNA, 32 nt, Human
acccccgcaccaccugcugugugccagccuga

SEQ ID NO: 35672 - RNA, 32 nt, Human
acccccgcagaggcagaaugaacccauaggga

SEQ ID NO: 35673 - RNA, 32 nt, Human
acccccgccagacagacucccaaccagacuga

SEQ ID NO: 35674 - RNA, 32 nt, Human
acccccgccagaccuggugaagaggaucauaa

SEQ ID NO: 35675 - RNA, 20 nt, Human
acccccgcccuacacucagc

SEQ ID NO: 35676 - RNA, 32 nt, Human
acccccgcccuccaaggggcccccaugggaca

SEQ ID NO: 35677 - RNA, 32 nt, Human
acccccgccuccaggguucaagugauucuccu

SEQ ID NO: 35678 - RNA, 32 nt, Human
acccccgccucccggguucaggagacucgcuu

SEQ ID NO: 35679 - RNA, 32 nt, Human
acccccgccuccuggguucaagcgauucuccu

SEQ ID NO: 35680 - RNA, 32 nt, Human
acccccgccuggcugcgucuuccucugcuaua

SEQ ID NO: 35681 - RNA, 32 nt, Human
acccccgcgccccagcccuggcagcccgggac

SEQ ID NO: 35682 - RNA, 32 nt, Human
acccccgcgccgcgcccugcccgccgcucgga

SEQ ID NO: 35683 - RNA, 32 nt, Human
acccccgcuccccaacccuucuugccugggua

SEQ ID NO: 35684 - RNA, 32 nt, Human
acccccgcuucccggguucaagcaauucuccu

SEQ ID NO: 35685 - RNA, 19 nt, Human
acccccggcaaacguccca

SEQ ID NO: 35686 - RNA, 32 nt, Human
acccccggcccaggccaccgcagaccaccucc

SEQ ID NO: 35687 - RNA, 16 nt, Human
acccccggcgccccca

SEQ ID NO: 35688 - RNA, 32 nt, Human
acccccggcggccacagaaacggguacccagu

SEQ ID NO: 35689 - RNA, 16 nt, Human
acccccggcucgccca

SEQ ID NO: 35690 - RNA, 20 nt, Human
acccccgggacuuuacccca

SEQ ID NO: 35691 - RNA, 32 nt, Human
acccccgguccaagccuccccuccaccacugc

SEQ ID NO: 35692 - RNA, 22 nt, Human
acccccgucagcaggcccuccc

SEQ ID NO: 35693 - RNA, 22 nt, Human
acccccguccgccauccugccc

SEQ ID NO: 35694 - RNA, 32 nt, Human
acccccuaaaaauacaaaaauuagccgggcgu

SEQ ID NO: 35695 - RNA, 32 nt, Human
acccccuaaaaccccuucaucacuuucauucu

SEQ ID NO: 35696 - RNA, 32 nt, Human
acccccuaaagauggcgcacccggcagccccc

SEQ ID NO: 35697 - RNA, 32 nt, Human
acccccuaaagguaucugugguauuggcagga

SEQ ID NO: 35698 - RNA, 32 nt, Human
acccccuagagugcucuguguaugcggaugau

SEQ ID NO: 35699 - RNA, 32 nt, Human
acccccuagugauggaaugacagggucuggug

SEQ ID NO: 35700 - RNA, 18 nt, Human
acccccucaaccccuucc

SEQ ID NO: 35701 - RNA, 32 nt, Human
acccccucacacacacuggaaagugagggugg

SEQ ID NO: 35702 - RNA, 32 nt, Human
acccccucacacacuaugcucucucaagaaug

SEQ ID NO: 35703 - RNA, 32 nt, Human
acccccucacacugaguucacagugcgcccuc

SEQ ID NO: 35704 - RNA, 32 nt, Human
acccccucagcaccaucugccucuaacucuga

SEQ ID NO: 35705 - RNA, 32 nt, Human
acccccucagcuuagaucaccaaacagacaag

SEQ ID NO: 35706 - RNA, 32 nt, Human
acccccuccagccccacaccugggccuccccc

SEQ ID NO: 35707 - RNA, 32 nt, Human
acccccuccaggaccggguuucucagccuugg

SEQ ID NO: 35708 - RNA, 19 nt, Human
acccccucccacacucagg

SEQ ID NO: 35709 - RNA, 32 nt, Human
acccccucccagucuucaggcuugccacgcuc

SEQ ID NO: 35710 - RNA, 32 nt, Human
acccccuccccaacaugccccaccccaccccu

SEQ ID NO: 35711 - RNA, 18 nt, Human
acccccucccucaaggaa

SEQ ID NO: 35712 - RNA, 21 nt, Human
acccccucccuuucacagaga

SEQ ID NO: 35713 - RNA, 32 nt, Human
acccccuccuacccucucuccuguaccccuuu

SEQ ID NO: 35714 - RNA, 32 nt, Human
acccccuccuaccucuuuucugugccaccugc

SEQ ID NO: 35715 - RNA, 32 nt, Human
acccccuccugccuccauccaccggggcuaug

SEQ ID NO: 35716 - RNA, 32 nt, Human
acccccuccuggcaaucaauacagcuucauua

SEQ ID NO: 35717 - RNA, 32 nt, Human
acccccuccuucagacacccucaaccucuucu

SEQ ID NO: 35718 - RNA, 24 nt, Human
acccccugaaaaucauaugggcuu

SEQ ID NO: 35719 - RNA, 18 nt, Human
acccccugagacuaucau

SEQ ID NO: 35720 - RNA, 32 nt, Human
acccccugcaaucccccaccuuucggggucuc

SEQ ID NO: 35721 - RNA, 19 nt, Human
acccccugcccccaaagaa

SEQ ID NO: 35722 - RNA, 32 nt, Human
acccccugcccuuuugcuucccucccaucagu

SEQ ID NO: 35723 - RNA, 32 nt, Human
acccccugccggacccuccacccuucggcccc

SEQ ID NO: 35724 - RNA, 31 nt, Human
acccccugccucuuuugguuguuguucuuaa

SEQ ID NO: 35725 - RNA, 32 nt, Human
acccccugccuuaucucugccugcacgcccug

SEQ ID NO: 35726 - RNA, 32 nt, Human
acccccugccuuccccagcuugcccauuuccc

SEQ ID NO: 35727 - RNA, 23 nt, Human
acccccugcucccgcccaccuga

SEQ ID NO: 35728 - RNA, 32 nt, Human
acccccugcugcccacucuccugcugcucggg

SEQ ID NO: 35729 - RNA, 23 nt, Human
acccccuggagccagacagcagu

SEQ ID NO: 35730 - RNA, 32 nt, Human
acccccuggggugggaucugagcucccaccuc

SEQ ID NO: 35731 - RNA, 32 nt, Human
acccccuggugccugcaggccacccagggacc

SEQ ID NO: 35732 - RNA, 32 nt, Human
acccccuuaccucccccagugccuucuucaga

SEQ ID NO: 35733 - RNA, 23 nt, Human
acccccuuaccuuucacagagga

SEQ ID NO: 35734 - RNA, 23 nt, Human
acccccuucagcaggcaccucca

SEQ ID NO: 35735 - RNA, 32 nt, Human
acccccuuccaggagaggaugggcaggcauuu

SEQ ID NO: 35736 - RNA, 24 nt, Human
acccccuucccagccucugggaaa

SEQ ID NO: 35737 - RNA, 32 nt, Human
acccccuucccccacccagagacugggcagcu

SEQ ID NO: 35738 - RNA, 32 nt, Human
acccccuuccccggcuccccugcccacccugc

SEQ ID NO: 35739 - RNA, 18 nt, Human
acccccuucccucuggca

SEQ ID NO: 35740 - RNA, 20 nt, Human
acccccuucccugcugagca

SEQ ID NO: 35741 - RNA, 25 nt, Human
acccccuuccugucaugcccagggc

SEQ ID NO: 35742 - RNA, 32 nt, Human
acccccuuccuucuggagccuuagcucugaaa

SEQ ID NO: 35743 - RNA, 32 nt, Human
acccccuuccuugcugcccucccuucccugcc

SEQ ID NO: 35744 - RNA, 32 nt, Human
acccccuucucugcccauuccccagccucucu

SEQ ID NO: 35745 - RNA, 16 nt, Human
acccccuugacaccau

SEQ ID NO: 35746 - RNA, 32 nt, Human
acccccuuuagauuccucuguuucuucuaccu

SEQ ID NO: 35747 - RNA, 32 nt, Human
acccccuuuucuuccuacucugugccuggagc

SEQ ID NO: 35748 - RNA, 32 nt, Human
accccgaaaagcaagugccacuguuagaaaug

SEQ ID NO: 35749 - RNA, 19 nt, Human
accccgaacccgcacuccc

SEQ ID NO: 35750 - RNA, 32 nt, Human
accccgacacccaccggcacacagaccccaac

SEQ ID NO: 35751 - RNA, 32 nt, Human
accccgacauaggagggcaccacccacauggc

SEQ ID NO: 35752 - RNA, 32 nt, Human
accccgaccaccugcccaaccugcucuccucu

SEQ ID NO: 35753 - RNA, 19 nt, Human
accccgacgccacagccca

SEQ ID NO: 35754 - RNA, 32 nt, Human
accccgacugcgacuccaccugggaggaggac

SEQ ID NO: 35755 - RNA, 21 nt, Human
accccgagcaagacccugcac

SEQ ID NO: 35756 - RNA, 32 nt, Human
accccgagcugcgcagccuggcgcggcgugcg

SEQ ID NO: 35757 - RNA, 32 nt, Human
accccgaggagcucuguaagucccugcuccuc

SEQ ID NO: 35758 - RNA, 23 nt, Human
accccgaggcaaccggcugcaga

SEQ ID NO: 35759 - RNA, 32 nt, Human
accccgagggccugaggagagggagcuguggg

SEQ ID NO: 35760 - RNA, 32 nt, Human
accccgauuggcuggagaauugacuugggaga

SEQ ID NO: 35761 - RNA, 32 nt, Human
accccgcaaacucgugggcagugcagugcugg

SEQ ID NO: 35762 - RNA, 32 nt, Human
accccgcacagccuggguagcguguggaagau

SEQ ID NO: 35763 - RNA, 19 nt, Human
accccgcacucacacuccc

SEQ ID NO: 35764 - RNA, 32 nt, Human
accccgcagcuagccaacccagagccaggaga

SEQ ID NO: 35765 - RNA, 32 nt, Human
accccgccaccugggucagugcccgccccggg

SEQ ID NO: 35766 - RNA, 32 nt, Human
accccgccagcucacgcccuccaugaggcucg

SEQ ID NO: 35767 - RNA, 18 nt, Human
accccgcccaaccguggc

SEQ ID NO: 35768 - RNA, 32 nt, Human
accccgcccacaacagggaguuaaacuggagg

SEQ ID NO: 35769 - RNA, 32 nt, Human
accccgcccagccuggcagauuuuauuuaauc

SEQ ID NO: 35770 - RNA, 24 nt, Human
accccgcccgcgccgccgccgccg

SEQ ID NO: 35771 - RNA, 32 nt, Human
accccgcccugccucugagaccccgccucacc

SEQ ID NO: 35772 - RNA, 20 nt, Human
accccgccgccgccgccgcc

SEQ ID NO: 35773 - RNA, 21 nt, Human
accccgccgccgccgccgccg

SEQ ID NO: 35774 - RNA, 19 nt, Human
accccgccgccgccgccgu

SEQ ID NO: 35775 - RNA, 32 nt, Human
accccgccucauuccucacgccgagcuccaga

SEQ ID NO: 35776 - RNA, 32 nt, Human
accccgccugcuucauccacaucaggaggguc

SEQ ID NO: 35777 - RNA, 32 nt, Human
accccgccuggcugcaccccugcccagcaugu

SEQ ID NO: 35778 - RNA, 32 nt, Human
accccgccugggaacaacagucauucuuccuc

SEQ ID NO: 35779 - RNA, 24 nt, Human
accccgcgagcgcagggguccucu

SEQ ID NO: 35780 - RNA, 32 nt, Human
accccgcgccucucccccgccuccuccugccg

SEQ ID NO: 35781 - RNA, 32 nt, Human
accccgcucagguucugccugccuuacugggg

SEQ ID NO: 35782 - RNA, 19 nt, Human
accccgcuccccaacaccu

SEQ ID NO: 35783 - RNA, 32 nt, Human
accccgcugcagaucaccuggccccaccagcc

SEQ ID NO: 35784 - RNA, 32 nt, Human
accccgcugcagggauggccuccugggcuaag

SEQ ID NO: 35785 - RNA, 32 nt, Human
accccgcugccuggcgggcagccccugcugga

SEQ ID NO: 35786 - RNA, 32 nt, Human
accccgcugccugggcccugugguugcugggc

SEQ ID NO: 35787 - RNA, 32 nt, Human
accccgcugggaacuccuccaggggcugagau

SEQ ID NO: 35788 - RNA, 32 nt, Human
accccggaaaauccucugucuccagucucugg

SEQ ID NO: 35789 - RNA, 32 nt, Human
accccggagagggagucagccgagguccuggc

SEQ ID NO: 35790 - RNA, 32 nt, Human
accccggagagggcggacgagcagggcgccgg

SEQ ID NO: 35791 - RNA, 32 nt, Human
accccggagagugaagacucugccugucggac

SEQ ID NO: 35792 - RNA, 25 nt, Human
accccggagauggagguugcaguga

SEQ ID NO: 35793 - RNA, 32 nt, Human
accccggagauggagguugcagugagccaaga

SEQ ID NO: 35794 - RNA, 32 nt, Human
accccggagccgcagagaggggaagaggcaga

SEQ ID NO: 35795 - RNA, 32 nt, Human
accccggaggcagagguuucagugagccgaga

SEQ ID NO: 35796 - RNA, 32 nt, Human
accccggaggcggagcuugcagugagccgaga

SEQ ID NO: 35797 - RNA, 25 nt, Human
accccggaggcggagguugcaguga

SEQ ID NO: 35798 - RNA, 32 nt, Human
accccggaggcggagguugcagugagcugaga

SEQ ID NO: 35799 - RNA, 32 nt, Human
accccggagguagagguugcagugagccgaga

SEQ ID NO: 35800 - RNA, 32 nt, Human
accccggcaacuucuagaugaacccaagugaa

SEQ ID NO: 35801 - RNA, 24 nt, Human
accccggcccugugccugcucgga

SEQ ID NO: 35802 - RNA, 23 nt, Human
accccggccugaccucucucgga

SEQ ID NO: 35803 - RNA, 23 nt, Human
accccggcgcccgggcucccaga

SEQ ID NO: 35804 - RNA, 32 nt, Human
accccggcggcagacgcagguucgggaccaug

SEQ ID NO: 35805 - RNA, 24 nt, Human
accccggcucugggccccaucaga

SEQ ID NO: 35806 - RNA, 32 nt, Human
accccggcuuccuggggacacaggguuggcac

SEQ ID NO: 35807 - RNA, 32 nt, Human
accccgggaccaccccucccuuccagcuaugu

SEQ ID NO: 35808 - RNA, 32 nt, Human
accccgggagacugaacugcaggguucaagcc

SEQ ID NO: 35809 - RNA, 32 nt, Human
accccgggagcacugcccuaggagccuggacc

SEQ ID NO: 35810 - RNA, 32 nt, Human
accccgggagguggaggcugcagugaguugug

SEQ ID NO: 35811 - RNA, 32 nt, Human
accccgggcaccaugggccacuccaggauggg

SEQ ID NO: 35812 - RNA, 32 nt, Human
accccgggcaggcaaaggcaguggguagagga

SEQ ID NO: 35813 - RNA, 28 nt, Human
accccgggcagggcugccuccucaccuc

SEQ ID NO: 35814 - RNA, 32 nt, Human
accccgggccaacauggaaaacccagagccac

SEQ ID NO: 35815 - RNA, 32 nt, Human
accccgggcccaggcgugcuggucaccaugac

SEQ ID NO: 35816 - RNA, 32 nt, Human
accccgggcucaacaucucacuucucccacag

SEQ ID NO: 35817 - RNA, 32 nt, Human
accccggggacaugcccccacccgggaggggc

SEQ ID NO: 35818 - RNA, 32 nt, Human
accccggggccaccgggaggcacuuuugugga

SEQ ID NO: 35819 - RNA, 32 nt, Human
accccggggcucuccuguucucucacauuuaa

SEQ ID NO: 35820 - RNA, 32 nt, Human
accccggggcugcccuuugcaggugugaguca

SEQ ID NO: 35821 - RNA, 21 nt, Human
accccggggcugcgcacugca

SEQ ID NO: 35822 - RNA, 32 nt, Human
accccgggggcacacaggcuccacacugccac

SEQ ID NO: 35823 - RNA, 32 nt, Human
accccggguauugaccccagacaacaaugcca

SEQ ID NO: 35824 - RNA, 32 nt, Human
accccgggugcuguucccucggucacccuguu

SEQ ID NO: 35825 - RNA, 32 nt, Human
accccguaucuacaaaaauuagccagguguug

SEQ ID NO: 35826 - RNA, 32 nt, Human
accccguauggcacuagagacuuauugcauua

SEQ ID NO: 35827 - RNA, 32 nt, Human
accccguccugacccccucugccuguucaucu

SEQ ID NO: 35828 - RNA, 32 nt, Human
accccgucgcacaggcuggagugcaguggcaa

SEQ ID NO: 35829 - RNA, 32 nt, Human
accccgucgcccuuuuguccagcgucugcagc

SEQ ID NO: 35830 - RNA, 32 nt, Human
accccgucucauuccuccaccugccguggacu

SEQ ID NO: 35831 - RNA, 32 nt, Human
accccgucucuacaaaaauacaaaaauuagcc

SEQ ID NO: 35832 - RNA, 32 nt, Human
accccgucugcgccgcugugcuguugucugcc

SEQ ID NO: 35833 - RNA, 32 nt, Human
accccgugaccucccucucuccuuccagucac

SEQ ID NO: 35834 - RNA, 32 nt, Human
accccgugagccagcagagagccauaaaucca

SEQ ID NO: 35835 - RNA, 19 nt, Human
accccguggacuggcccag

SEQ ID NO: 35836 - RNA, 32 nt, Human
accccguucuuccucugcucucaacccauugc

SEQ ID NO: 35837 - RNA, 32 nt, Human
accccguuuuuguuauuuuguuucugguuuuu

SEQ ID NO: 35838 - RNA, 32 nt, Human
accccuaagaaagguucucugaaaauuauuug

SEQ ID NO: 35839 - RNA, 32 nt, Human
accccuaagucaagucacggguuuccauagcc

SEQ ID NO: 35840 - RNA, 32 nt, Human
accccuacaaacagcacccccaccauguuuaa

SEQ ID NO: 35841 - RNA, 32 nt, Human
accccuaccagcuguaccagcgucuggaacag

SEQ ID NO: 35842 - RNA, 32 nt, Human
accccuaccccuggcuguacugcucaggcugc

SEQ ID NO: 35843 - RNA, 32 nt, Human
accccuacccuuucccaaacccuucgguauug

SEQ ID NO: 35844 - RNA, 32 nt, Human
accccuacuccagccccugaaauaaaccacuc

SEQ ID NO: 35845 - RNA, 32 nt, Human
accccuacuggcugacccuuugacacccuucu

SEQ ID NO: 35846 - RNA, 17 nt, Human
accccuagaacugccau

SEQ ID NO: 35847 - RNA, 32 nt, Human
accccuagcauacugccuggcacacaguaaau

SEQ ID NO: 35848 - RNA, 32 nt, Human
accccuagcuaccacugccuccaggcuacugc

SEQ ID NO: 35849 - RNA, 21 nt, Human
accccuaggaacccccaggga

SEQ ID NO: 35850 - RNA, 32 nt, Human
accccuaggaauguaaucaguguuaggaugcc

SEQ ID NO: 35851 - RNA, 31 nt, Human
accccuagggaauaccuacucagcuuaagaa

SEQ ID NO: 35852 - RNA, 32 nt, Human
accccuaugaguguugaacaugugagaaagcc

SEQ ID NO: 35853 - RNA, 26 nt, Human
accccucaaccuggcucaucaacaga

SEQ ID NO: 35854 - RNA, 31 nt, Human
accccucacagcucaagccaaguccagcggc

SEQ ID NO: 35855 - RNA, 32 nt, Human
accccucacccagcugugguccggcuuuggga

SEQ ID NO: 35856 - RNA, 24 nt, Human
accccucaccccagaagcagcagu

SEQ ID NO: 35857 - RNA, 32 nt, Human
accccucacugcacucugcucaucacgggagg

SEQ ID NO: 35858 - RNA, 32 nt, Human
accccucagcaagaacagccugccugguggcc

SEQ ID NO: 35859 - RNA, 32 nt, Human
accccucagccuucucagcauuuccuuauccc

SEQ ID NO: 35860 - RNA, 32 nt, Human
accccucaggcuguuccagucuggcuuuugca

SEQ ID NO: 35861 - RNA, 32 nt, Human
accccucaucaggaguuccagugcugcaugcg

SEQ ID NO: 35862 - RNA, 17 nt, Human
accccucaugucagcuu

SEQ ID NO: 35863 - RNA, 32 nt, Human
accccucauugcugcaaugcagccucugcugg

SEQ ID NO: 35864 - RNA, 32 nt, Human
accccuccaacuaugcccuccccaccaugccu

SEQ ID NO: 35865 - RNA, 20 nt, Human
accccuccacacuucagcuc

SEQ ID NO: 35866 - RNA, 32 nt, Human
accccuccacaggaguuaucaggauuuuucug

SEQ ID NO: 35867 - RNA, 21 nt, Human
accccuccaccccgcaagcuc

SEQ ID NO: 35868 - RNA, 32 nt, Human
accccuccacguaucuuuccuaggcagaucac

SEQ ID NO: 35869 - RNA, 32 nt, Human
accccuccauuucucgccauggccccugcacu

SEQ ID NO: 35870 - RNA, 32 nt, Human
accccucccaacccuucuuccagggucaggga

SEQ ID NO: 35871 - RNA, 32 nt, Human
accccucccaaccucaaugcccugccauuaaa

SEQ ID NO: 35872 - RNA, 32 nt, Human
accccucccacacaccuugcucuggcuucucu

SEQ ID NO: 35873 - RNA, 32 nt, Human
accccucccagcccucuccuccuguuccuccu

SEQ ID NO: 35874 - RNA, 23 nt, Human
accccuccccucgugucagcuca

SEQ ID NO: 35875 - RNA, 24 nt, Human
accccuccccuucucccacagcca

SEQ ID NO: 35876 - RNA, 32 nt, Human
accccucccgcgcagcgccacccggccuggga

SEQ ID NO: 35877 - RNA, 25 nt, Human
accccucccucuguccaccagccca

SEQ ID NO: 35878 - RNA, 32 nt, Human
accccucccugccaccaggcacugccuggagg

SEQ ID NO: 35879 - RNA, 32 nt, Human
accccucccuugccccuuuccugggcccagaa

SEQ ID NO: 35880 - RNA, 22 nt, Human
accccuccgacucaccggccca

SEQ ID NO: 35881 - RNA, 32 nt, Human
accccuccggccccgucucucuuggacccacc

SEQ ID NO: 35882 - RNA, 32 nt, Human
accccuccucacugccucuccucucugggaca

SEQ ID NO: 35883 - RNA, 32 nt, Human
accccuccuccacccccacggcagacccuggu

SEQ ID NO: 35884 - RNA, 32 nt, Human
accccuccuugcagaacaguaucucugggacg

SEQ ID NO: 35885 - RNA, 32 nt, Human
accccucgcagcugcuuccuucugccugggau

SEQ ID NO: 35886 - RNA, 32 nt, Human
accccucgccucccucuccagcagcucccaca

SEQ ID NO: 35887 - RNA, 19 nt, Human
accccucgcucguucccuc

SEQ ID NO: 35888 - RNA, 19 nt, Human
accccucggccauucccuc

SEQ ID NO: 35889 - RNA, 32 nt, Human
accccucgggcucgucaguagggcuguggcug

SEQ ID NO: 35890 - RNA, 32 nt, Human
accccucuacuuccccucuuucccuucugaga

SEQ ID NO: 35891 - RNA, 32 nt, Human
accccucuauuuauuucccuuccacagugugg

SEQ ID NO: 35892 - RNA, 32 nt, Human
accccucuccagguuaucccagaaaugaccca

SEQ ID NO: 35893 - RNA, 32 nt, Human
accccucuccaucacugccaugguucggagac

SEQ ID NO: 35894 - RNA, 32 nt, Human
accccucuccaucacugccaugguuuggagac

SEQ ID NO: 35895 - RNA, 32 nt, Human
accccucuccccugcugucucuuggggcucuc

SEQ ID NO: 35896 - RNA, 32 nt, Human
accccucucgcgggugcugguggagaaaggac

SEQ ID NO: 35897 - RNA, 32 nt, Human
accccucucuccccaccuucccucucccggca

SEQ ID NO: 35898 - RNA, 32 nt, Human
accccucucuccccacuccucuucuccgaccc

SEQ ID NO: 35899 - RNA, 32 nt, Human
accccucucugagucacagaauggagcuaagu

SEQ ID NO: 35900 - RNA, 32 nt, Human
accccucugagaacagugaggcugguccucgu

SEQ ID NO: 35901 - RNA, 32 nt, Human
accccucugccagccgggccccggcugcagaa

SEQ ID NO: 35902 - RNA, 24 nt, Human
accccucugccaucacccagccca

SEQ ID NO: 35903 - RNA, 32 nt, Human
accccucugcccccucccuuguucucaagccu

SEQ ID NO: 35904 - RNA, 32 nt, Human
accccucugccuccucucgaugccuuacaguu

SEQ ID NO: 35905 - RNA, 32 nt, Human
accccucugccuggcaccuggauacccugggc

SEQ ID NO: 35906 - RNA, 32 nt, Human
accccucuguaaccuccauaauccaucagguc

SEQ ID NO: 35907 - RNA, 24 nt, Human
accccucuguggaacccacaaggg

SEQ ID NO: 35908 - RNA, 32 nt, Human
accccucuucccccuuccccugcgcccucccu

SEQ ID NO: 35909 - RNA, 32 nt, Human
accccucuuucauguauuaaaauaacacugag

SEQ ID NO: 35910 - RNA, 32 nt, Human
accccugaacagcuggacagcugggcuguggg

SEQ ID NO: 35911 - RNA, 32 nt, Human
accccugaaccgcgaagcgacagggaaagcgc

SEQ ID NO: 35912 - RNA, 19 nt, Human
accccugaaccuccagcca

SEQ ID NO: 35913 - RNA, 32 nt, Human
accccugaauuaagaggugcuguuauacauug

SEQ ID NO: 35914 - RNA, 32 nt, Human
accccugacccccauccucuuuuccuaccucu

SEQ ID NO: 35915 - RNA, 23 nt, Human
accccugaccucaggugauccgc

SEQ ID NO: 35916 - RNA, 32 nt, Human
accccugagauggguccacgcaucucucuaca

SEQ ID NO: 35917 - RNA, 32 nt, Human
accccugagccaagcugacuuccagucuucag

SEQ ID NO: 35918 - RNA, 20 nt, Human
accccugagccaccuguggc

SEQ ID NO: 35919 - RNA, 32 nt, Human
accccugcaacuggcccuccgcagccgaaagc

SEQ ID NO: 35920 - RNA, 32 nt, Human
accccugcacacauuacgacaggucccuaaau

SEQ ID NO: 35921 - RNA, 25 nt, Human
accccugcacccccagcugggggag

SEQ ID NO: 35922 - RNA, 18 nt, Human
accccugcaccuccagcc

SEQ ID NO: 35923 - RNA, 32 nt, Human
accccugcacuccagccugggugacagaguga

SEQ ID NO: 35924 - RNA, 32 nt, Human
accccugcacuccagccugggugacagcuaga

SEQ ID NO: 35925 - RNA, 24 nt, Human
accccugcacuccaggcugggcaa

SEQ ID NO: 35926 - RNA, 32 nt, Human
accccugcagccagagguuugcaguggguagu

SEQ ID NO: 35927 - RNA, 32 nt, Human
accccugcagucccccuggcugugccagguaa

SEQ ID NO: 35928 - RNA, 32 nt, Human
accccugcaucuuccugcugggcacaggcgag

SEQ ID NO: 35929 - RNA, 32 nt, Human
accccugcaugccaagcugccugcugccccag

SEQ ID NO: 35930 - RNA, 20 nt, Human
accccugcauggcugaacag

SEQ ID NO: 35931 - RNA, 32 nt, Human
accccugccacucaccccuccuggcccaggcc

SEQ ID NO: 35932 - RNA, 32 nt, Human
accccugccaucacugccccacauggacaaaa

SEQ ID NO: 35933 - RNA, 32 nt, Human
accccugcccagcagcccugagcucagcugca

SEQ ID NO: 35934 - RNA, 32 nt, Human
accccugcccaugcgcgggaggcugcagcaug

SEQ ID NO: 35935 - RNA, 32 nt, Human
accccugccccgugugugccccggguguucuc

SEQ ID NO: 35936 - RNA, 32 nt, Human
accccugccggccagcaggcaggauggugcuu

SEQ ID NO: 35937 - RNA, 22 nt, Human
accccugccuucuggcaagcaa

SEQ ID NO: 35938 - RNA, 32 nt, Human
accccugcgcugugcugaccccagggcucagc

SEQ ID NO: 35939 - RNA, 32 nt, Human
accccugcgucgagcugggaagguuccaugaa

SEQ ID NO: 35940 - RNA, 32 nt, Human
accccugcucaggccuucucucuggcugccag

SEQ ID NO: 35941 - RNA, 20 nt, Human
accccugcuccagccucgau

SEQ ID NO: 35942 - RNA, 21 nt, Human
accccugcugaugaugagcaa

SEQ ID NO: 35943 - RNA, 32 nt, Human
accccugcuguugcugccacugcuucaauauu

SEQ ID NO: 35944 - RNA, 32 nt, Human
accccugcuuccugguucucagucccacccca

SEQ ID NO: 35945 - RNA, 32 nt, Human
accccuggaaccugguugggcaguaggggagg

SEQ ID NO: 35946 - RNA, 20 nt, Human
accccuggaccccagccuca

SEQ ID NO: 35947 - RNA, 32 nt, Human
accccuggacuaggcccugcuucagugcccac

SEQ ID NO: 35948 - RNA, 32 nt, Human
accccuggaggcggcggcggcggcgagggagc

SEQ ID NO: 35949 - RNA, 32 nt, Human
accccuggccccugagcccacacccucucgga

SEQ ID NO: 35950 - RNA, 32 nt, Human
accccuggccuccccagguccuccuguauuug

SEQ ID NO: 35951 - RNA, 31 nt, Human
accccuggccugacucccaugcaaguagcug

SEQ ID NO: 35952 - RNA, 32 nt, Human
accccuggccuugacgcuaucucccaucaccu

SEQ ID NO: 35953 - RNA, 32 nt, Human
accccuggcugcaguggccaggugacauuccu

SEQ ID NO: 35954 - RNA, 32 nt, Human
accccuggcugggacugaaccacccagagcgg

SEQ ID NO: 35955 - RNA, 21 nt, Human
accccugggccaugccuagau

SEQ ID NO: 35956 - RNA, 32 nt, Human
accccugggccucuccccaugcugccuccccu

SEQ ID NO: 35957 - RNA, 32 nt, Human
accccugggggaaaagccuggguuggguuuag

SEQ ID NO: 35958 - RNA, 32 nt, Human
accccugguacucagcacacacaugcuuaccu

SEQ ID NO: 35959 - RNA, 32 nt, Human
accccuggugcugggucccugcugcuuucucu

SEQ ID NO: 35960 - RNA, 19 nt, Human
accccugguuaccuguggc

SEQ ID NO: 35961 - RNA, 32 nt, Human
accccugguuccuuuaagucuuaagugaugcc

SEQ ID NO: 35962 - RNA, 32 nt, Human
accccuguccccaccaggcucagagccagacc

SEQ ID NO: 35963 - RNA, 32 nt, Human
accccugucuccucuccuccuccagcccccag

SEQ ID NO: 35964 - RNA, 32 nt, Human
accccugucugcccuucucccuccugcuucug

SEQ ID NO: 35965 - RNA, 32 nt, Human
accccugucuuucuccuccugacugguggucu

SEQ ID NO: 35966 - RNA, 22 nt, Human
accccugugccccuccuagggg

SEQ ID NO: 35967 - RNA, 24 nt, Human
accccugugccugggacaggggag

SEQ ID NO: 35968 - RNA, 32 nt, Human
accccuguggcccacucugccuuccagagaga

SEQ ID NO: 35969 - RNA, 32 nt, Human
accccuguguccugcuucucacucucuuccau

SEQ ID NO: 35970 - RNA, 32 nt, Human
accccuguuccccucagcuuucccuccucgcu

SEQ ID NO: 35971 - RNA, 32 nt, Human
accccuucaagcaguuguuucccauucccaac

SEQ ID NO: 35972 - RNA, 32 nt, Human
accccuucacagacugacagaaugguuuuguu

SEQ ID NO: 35973 - RNA, 32 nt, Human
accccuucagcuuuccugagcugaaguccuug

SEQ ID NO: 35974 - RNA, 23 nt, Human
accccuuccaagugccuuuuuaa

SEQ ID NO: 35975 - RNA, 17 nt, Human
accccuuccacgcugug

SEQ ID NO: 35976 - RNA, 32 nt, Human
accccuuccacuccaguaggggacaccuuucu

SEQ ID NO: 35977 - RNA, 32 nt, Human
accccuuccaugcucaucucacugcccaguga

SEQ ID NO: 35978 - RNA, 32 nt, Human
accccuuccccgccccucucccggccggccuc

SEQ ID NO: 35979 - RNA, 32 nt, Human
accccuucccuggcuucucugcugcaauuuuu

SEQ ID NO: 35980 - RNA, 32 nt, Human
accccuucgucugugggcaccagcacuucauu

SEQ ID NO: 35981 - RNA, 32 nt, Human
accccuucucagacuccaguugggccggacuc

SEQ ID NO: 35982 - RNA, 32 nt, Human
accccuucuccuggcuuugaggaaggugcucc

SEQ ID NO: 35983 - RNA, 24 nt, Human
accccuucuguuacauaagggcuu

SEQ ID NO: 35984 - RNA, 32 nt, Human
accccuucuuccgaggaggggguggguaaaag

SEQ ID NO: 35985 - RNA, 32 nt, Human
accccuugaacccccaugcaaugagcuucuaa

SEQ ID NO: 35986 - RNA, 32 nt, Human
accccuugcccaggcaaggaaagacagcagug

SEQ ID NO: 35987 - RNA, 32 nt, Human
accccuuggcccacugcaucucagguuuccua

SEQ ID NO: 35988 - RNA, 32 nt, Human
accccuuggcccuucgcucuugcugccuuaac

SEQ ID NO: 35989 - RNA, 30 nt, Human
accccuugggaccacauggcacaaugggac

SEQ ID NO: 35990 - RNA, 32 nt, Human
accccuugggcccucuggggcuuccccucccc

SEQ ID NO: 35991 - RNA, 32 nt, Human
accccuuuccacgugcuccccuucccagccac

SEQ ID NO: 35992 - RNA, 32 nt, Human
accccuuucccugcaaccuccuugacucuggc

SEQ ID NO: 35993 - RNA, 32 nt, Human
accccuuuccuguaaccugcacuuugggaugg

SEQ ID NO: 35994 - RNA, 32 nt, Human
accccuuucucccacccagccccaacccccag

SEQ ID NO: 35995 - RNA, 32 nt, Human
accccuuucuggcucucccauuuccugagacc

SEQ ID NO: 35996 - RNA, 32 nt, Human
accccuuucuucuuauuucucccuuuuggaau

SEQ ID NO: 35997 - RNA, 32 nt, Human
accccuuugucccugcacucagcccuguggcc

SEQ ID NO: 35998 - RNA, 32 nt, Human
accccuuugucuccaaccuccauuucuguuca

SEQ ID NO: 35999 - RNA, 17 nt, Human
accccuuugucugccuc

SEQ ID NO: 36000 - RNA, 32 nt, Human
acccgaaacagcccuccgucuuccugcccaug

SEQ ID NO: 36001 - RNA, 32 nt, Human
acccgaaagccgcugggaaaaguuuacccaag

SEQ ID NO: 36002 - RNA, 32 nt, Human
acccgaacaccaugggccucgaggggacugcu

SEQ ID NO: 36003 - RNA, 32 nt, Human
acccgaacccuucgccugaauaacuccagccc

SEQ ID NO: 36004 - RNA, 32 nt, Human
acccgaacuccugguuuggcgcuuugugaagc

SEQ ID NO: 36005 - RNA, 32 nt, Human
acccgaagcccaggcugaagaguuuaacuuug

SEQ ID NO: 36006 - RNA, 32 nt, Human
acccgaagcugcuucugcccagucccagccgc

SEQ ID NO: 36007 - RNA, 32 nt, Human
acccgacaaacagggcagccagagccagacag

SEQ ID NO: 36008 - RNA, 22 nt, Human
acccgacaacuaccacucccca

SEQ ID NO: 36009 - RNA, 32 nt, Human
acccgacacacaaaagccgcuuucuccgcgcc

SEQ ID NO: 36010 - RNA, 32 nt, Human
acccgacacaccuacccugcugaccccuucug

SEQ ID NO: 36011 - RNA, 32 nt, Human
acccgacucgcuggcgcuucauggagaacuuc

SEQ ID NO: 36012 - RNA, 32 nt, Human
acccgacugcccuaccagccugcacaugggua

SEQ ID NO: 36013 - RNA, 32 nt, Human
acccgagagacggagguugcagugagcugaua

SEQ ID NO: 36014 - RNA, 32 nt, Human
acccgagaggcggaaguugcagugagccgaga

SEQ ID NO: 36015 - RNA, 32 nt, Human
acccgagaggcggagcuugcagugagccaaga

SEQ ID NO: 36016 - RNA, 32 nt, Human
acccgagaggcggagcuugcagugagcugaga

SEQ ID NO: 36017 - RNA, 32 nt, Human
acccgagaggcggagguugcagugagcccaga

SEQ ID NO: 36018 - RNA, 32 nt, Human
acccgagaggcggagguugcagugagccgaga

SEQ ID NO: 36019 - RNA, 32 nt, Human
acccgagagguggagguugaagugagccaaga

SEQ ID NO: 36020 - RNA, 32 nt, Human
acccgagagguggagguugcagugaaccaaga

SEQ ID NO: 36021 - RNA, 32 nt, Human
acccgagagguggagguugcagugagccaaaa

SEQ ID NO: 36022 - RNA, 32 nt, Human
acccgagauaguaccacugcacuccagccugg

SEQ ID NO: 36023 - RNA, 32 nt, Human
acccgagaucacacccucauuuuucacauuau

SEQ ID NO: 36024 - RNA, 32 nt, Human
acccgagcaagaagcagcucccagagagaaag

SEQ ID NO: 36025 - RNA, 32 nt, Human
acccgagcaccuucucuucacucagccaacug

SEQ ID NO: 36026 - RNA, 20 nt, Human
acccgagcccccacccgccu

SEQ ID NO: 36027 - RNA, 32 nt, Human
acccgagcccuccacaccagccuccuguaucu

SEQ ID NO: 36028 - RNA, 32 nt, Human
acccgagccuagagcaggcucaugcccaaaau

SEQ ID NO: 36029 - RNA, 23 nt, Human
acccgagccugcccccugccagg

SEQ ID NO: 36030 - RNA, 20 nt, Human
acccgagccuuuugucaagg

SEQ ID NO: 36031 - RNA, 32 nt, Human
acccgagcugggaccaguaccuggguccccag

SEQ ID NO: 36032 - RNA, 32 nt, Human
acccgaggagcaggacagagaagacggccccu

SEQ ID NO: 36033 - RNA, 32 nt, Human
acccgagggccaggaagaaccgcucucgcaua

SEQ ID NO: 36034 - RNA, 32 nt, Human
acccgagucugccucucggagcagggagcuca

SEQ ID NO: 36035 - RNA, 30 nt, Human
acccgaugauccugagccaggagcucugug

SEQ ID NO: 36036 - RNA, 31 nt, Human
acccgaugccucucaugaucugucucuuuag

SEQ ID NO: 36037 - RNA, 32 nt, Human
acccgcaaccacagcaagaacuccaccagcag

SEQ ID NO: 36038 - RNA, 32 nt, Human
acccgcacacacagcaggaggggccugcccag

SEQ ID NO: 36039 - RNA, 32 nt, Human
acccgcacagaacuuggucucuggaauccagc

SEQ ID NO: 36040 - RNA, 32 nt, Human
acccgcacuggcagcgggaggcagagggagga

SEQ ID NO: 36041 - RNA, 24 nt, Human
acccgcagccuaggcaggcucugc

SEQ ID NO: 36042 - RNA, 32 nt, Human
acccgcagccucccccgcugccucccuagggc

SEQ ID NO: 36043 - RNA, 32 nt, Human
acccgcagccugaagaagcugauagcggaccc

SEQ ID NO: 36044 - RNA, 24 nt, Human
acccgcagcuccuggcgcucggcg

SEQ ID NO: 36045 - RNA, 32 nt, Human
acccgcagggggaaggagggaggcugacaagc

SEQ ID NO: 36046 - RNA, 32 nt, Human
acccgcagugcgcgcaccacaccagguucacc

SEQ ID NO: 36047 - RNA, 32 nt, Human
acccgcauccugggugaugaagucagacacgc

SEQ ID NO: 36048 - RNA, 32 nt, Human
acccgcaucuucuguuaggcaggaucuguaca

SEQ ID NO: 36049 - RNA, 23 nt, Human
acccgcaugaucccuucccgcca

SEQ ID NO: 36050 - RNA, 32 nt, Human
acccgcauuggauaucagagcugggagggccc

SEQ ID NO: 36051 - RNA, 32 nt, Human
acccgccaaagaccccuucggugugccggcag

SEQ ID NO: 36052 - RNA, 32 nt, Human
acccgccacugcauuccacagccuguagaagu

SEQ ID NO: 36053 - RNA, 32 nt, Human
acccgccagcacacccuuagccuccagcaccc

SEQ ID NO: 36054 - RNA, 32 nt, Human
acccgcccaagacugcagcccaaucaacgccu

SEQ ID NO: 36055 - RNA, 32 nt, Human
acccgcccacggucuauucauagggucccaaa

SEQ ID NO: 36056 - RNA, 32 nt, Human
acccgcccaggagcgcgcagcugggguucuag

SEQ ID NO: 36057 - RNA, 32 nt, Human
acccgcccauaauaacacuccagucuggggcu

SEQ ID NO: 36058 - RNA, 32 nt, Human
acccgccccauccugggucauuacagaguggg

SEQ ID NO: 36059 - RNA, 32 nt, Human
acccgccccugccccugccccugcuacugcca

SEQ ID NO: 36060 - RNA, 32 nt, Human
acccgcccuccccguccugccuccucggcccc

SEQ ID NO: 36061 - RNA, 32 nt, Human
acccgcccugcacuugaccgcagcaggaggga

SEQ ID NO: 36062 - RNA, 32 nt, Human
acccgccgcaagcaucuugaacugacagccac

SEQ ID NO: 36063 - RNA, 32 nt, Human
acccgccgccuccgcucuccccggcugcaggc

SEQ ID NO: 36064 - RNA, 32 nt, Human
acccgccucaccucucacccuccuccaguccc

SEQ ID NO: 36065 - RNA, 32 nt, Human
acccgccucuacugccggcuccgcgcccuucc

SEQ ID NO: 36066 - RNA, 25 nt, Human
acccgccugcagaucugggauccag

SEQ ID NO: 36067 - RNA, 32 nt, Human
acccgccugccuggccgcaggugguucucccu

SEQ ID NO: 36068 - RNA, 32 nt, Human
acccgccugccuggggcggugcugcaccaggu

SEQ ID NO: 36069 - RNA, 32 nt, Human
acccgccugccugucccugaggggccuggugc

SEQ ID NO: 36070 - RNA, 32 nt, Human
acccgccugggaacaagggaugaggaggaguu

SEQ ID NO: 36071 - RNA, 32 nt, Human
acccgccugggcuugcagcccgccacuuuacu

SEQ ID NO: 36072 - RNA, 32 nt, Human
acccgccuguaaucccagcuacucgggaggcu

SEQ ID NO: 36073 - RNA, 31 nt, Human
acccgccuucuagcugggccugggcucgcgg

SEQ ID NO: 36074 - RNA, 32 nt, Human
acccgccuuugccugcgagucucccucgcugg

SEQ ID NO: 36075 - RNA, 32 nt, Human
acccgcgagagggaagaagcaggaggucucag

SEQ ID NO: 36076 - RNA, 21 nt, Human
acccgcgaggaagggcccgcg

SEQ ID NO: 36077 - RNA, 32 nt, Human
acccgcgaggcggagacugcagugagccgaga

SEQ ID NO: 36078 - RNA, 32 nt, Human
acccgcgcacggcuggcuacaccccgacgcca

SEQ ID NO: 36079 - RNA, 24 nt, Human
acccgcggacccacagaccccgcg

SEQ ID NO: 36080 - RNA, 32 nt, Human
acccgcggagccagaagagggaggaaaggaga

SEQ ID NO: 36081 - RNA, 32 nt, Human
acccgcggcgcaggagcuucaguggucugggg

SEQ ID NO: 36082 - RNA, 22 nt, Human
acccgcggcucaaaucuccggg

SEQ ID NO: 36083 - RNA, 23 nt, Human
acccgcggcuucccuggcucccg

SEQ ID NO: 36084 - RNA, 24 nt, Human
acccgcgggacaacucuacgugca

SEQ ID NO: 36085 - RNA, 32 nt, Human
acccgcggggaugaggagguugucagugauug

SEQ ID NO: 36086 - RNA, 25 nt, Human
acccgcguaccggccgccgccgccg

SEQ ID NO: 36087 - RNA, 32 nt, Human
acccgcuaaugagcuguugacacuguuguucc

SEQ ID NO: 36088 - RNA, 32 nt, Human
acccgcuccaucuuccguggaacagggacacu

SEQ ID NO: 36089 - RNA, 32 nt, Human
acccgcucccaccaggcagcugaggccacuuu

SEQ ID NO: 36090 - RNA, 32 nt, Human
acccgcucccaccucacaccccucagccacaa

SEQ ID NO: 36091 - RNA, 32 nt, Human
acccgcuccgcagccggcaccaugcgcgagau

SEQ ID NO: 36092 - RNA, 32 nt, Human
acccgcuccuuugacauuggugccccacucca

SEQ ID NO: 36093 - RNA, 32 nt, Human
acccgcucguccccuucucuuucugccacccu

SEQ ID NO: 36094 - RNA, 32 nt, Human
acccgcucguuuuggcggcagcucguguccca

SEQ ID NO: 36095 - RNA, 32 nt, Human
acccgcugccaccuccauagagcuccgacuca

SEQ ID NO: 36096 - RNA, 32 nt, Human
acccgcuggccccugggcccagccugggcacc

SEQ ID NO: 36097 - RNA, 32 nt, Human
acccgcuggcgaccgcugccuccgggaaguuu

SEQ ID NO: 36098 - RNA, 32 nt, Human
acccgcuggcuuccagucuccaccuucccgcc

SEQ ID NO: 36099 - RNA, 32 nt, Human
acccgcuucagauagaucauuguuagauauuu

SEQ ID NO: 36100 - RNA, 32 nt, Human
acccgcuuucacucuucgaauuugugcuuagc

SEQ ID NO: 36101 - RNA, 32 nt, Human
acccgcuuucagcccugugcucuggccccaga

SEQ ID NO: 36102 - RNA, 32 nt, Human
acccgcuuucucucuggucuucucccaggcug

SEQ ID NO: 36103 - RNA, 32 nt, Human
acccggaagcacuuacccuccacuuccuccuc

SEQ ID NO: 36104 - RNA, 32 nt, Human
acccggaaggcagagcuugcagugagccgaga

SEQ ID NO: 36105 - RNA, 32 nt, Human
acccggaaggcagagguugcagugagccgaga

SEQ ID NO: 36106 - RNA, 32 nt, Human
acccggaaggcggagcuugcagugagccgaga

SEQ ID NO: 36107 - RNA, 25 nt, Human
acccggaaggcggagguugcaguga

SEQ ID NO: 36108 - RNA, 32 nt, Human
acccggaaggcggagguugcagugagccaaga

SEQ ID NO: 36109 - RNA, 32 nt, Human
acccggaagguggagguugcagugagccgaga

SEQ ID NO: 36110 - RNA, 32 nt, Human
acccggaagguggagguuguugcggugagcug

SEQ ID NO: 36111 - RNA, 32 nt, Human
acccggaagguggaguuugcagugagccgaga

SEQ ID NO: 36112 - RNA, 32 nt, Human
acccggaccaguggcugggagccccacacaga

SEQ ID NO: 36113 - RNA, 32 nt, Human
acccggagagguggaauuucacuuugaaauuc

SEQ ID NO: 36114 - RNA, 32 nt, Human
acccggagccaugucuucacauaggaggaaag

SEQ ID NO: 36115 - RNA, 32 nt, Human
acccggagccgcccgcaugcagcuucaccucc

SEQ ID NO: 36116 - RNA, 32 nt, Human
acccggagccucagggaugggcucaggcugau

SEQ ID NO: 36117 - RNA, 32 nt, Human
acccggagcuccucacccggcaccacaucugu

SEQ ID NO: 36118 - RNA, 32 nt, Human
acccggagcucuuggcagcccauugcugccug

SEQ ID NO: 36119 - RNA, 32 nt, Human
acccggaggcagagguugcagugagccgagau

SEQ ID NO: 36120 - RNA, 32 nt, Human
acccggaggcagggagccaccuccucagcuuc

SEQ ID NO: 36121 - RNA, 24 nt, Human
acccggaggcagggguugcaguga

SEQ ID NO: 36122 - RNA, 32 nt, Human
acccggaggcggaaccggcagugcagcccgaa

SEQ ID NO: 36123 - RNA, 22 nt, Human
acccggaggcggagguugcggu

SEQ ID NO: 36124 - RNA, 32 nt, Human
acccggaggcggagguugcgguaagccgagau

SEQ ID NO: 36125 - RNA, 32 nt, Human
acccggaggguacgcagacuccacacucagua

SEQ ID NO: 36126 - RNA, 32 nt, Human
acccggaugcagagucuacagccugacccagc

SEQ ID NO: 36127 - RNA, 32 nt, Human
acccggcacccacuuuccaaaauggccaugga

SEQ ID NO: 36128 - RNA, 32 nt, Human
acccggcaggaagagguugcauugagcugaga

SEQ ID NO: 36129 - RNA, 32 nt, Human
acccggcaggcagagcuugcagugagccgaga

SEQ ID NO: 36130 - RNA, 32 nt, Human
acccggcaggcagagguugcagugagccgaga

SEQ ID NO: 36131 - RNA, 32 nt, Human
acccggcaggcaggaacucacccuggagcccu

SEQ ID NO: 36132 - RNA, 32 nt, Human
acccggcaggcggagguugcagugagcggaga

SEQ ID NO: 36133 - RNA, 32 nt, Human
acccggcagggaagggaggaguuggcaagaau

SEQ ID NO: 36134 - RNA, 22 nt, Human
acccggccacggaggagccaca

SEQ ID NO: 36135 - RNA, 23 nt, Human
acccggcccacuggcagacacag

SEQ ID NO: 36136 - RNA, 32 nt, Human
acccggccccugcugguucaggguuggccccu

SEQ ID NO: 36137 - RNA, 32 nt, Human
acccggccccuguguucugccugccaggccag

SEQ ID NO: 36138 - RNA, 32 nt, Human
acccggcccuacuggaggguguuuucacgaau

SEQ ID NO: 36139 - RNA, 32 nt, Human
acccggcccucugccagcauaaaccacucaca

SEQ ID NO: 36140 - RNA, 32 nt, Human
acccggcccuugccucauguuugaaugauaau

SEQ ID NO: 36141 - RNA, 32 nt, Human
acccggccugugccccagcucuccccgagggc

SEQ ID NO: 36142 - RNA, 32 nt, Human
acccggccuuucuuucucccucuugcaaccaa

SEQ ID NO: 36143 - RNA, 32 nt, Human
acccggcggacagagcgcgccccgcgcccgcg

SEQ ID NO: 36144 - RNA, 32 nt, Human
acccggcgggaagagguugcagugagccaaga

SEQ ID NO: 36145 - RNA, 32 nt, Human
acccggcgggcagagguugcaguaagcagaga

SEQ ID NO: 36146 - RNA, 32 nt, Human
acccggcgggggcggagccagcgggcgggcgc

SEQ ID NO: 36147 - RNA, 32 nt, Human
acccggcucccaggauccucauuaggaagccc

SEQ ID NO: 36148 - RNA, 32 nt, Human
acccggcucuacugcccgucccggacgacuca

SEQ ID NO: 36149 - RNA, 32 nt, Human
acccggcugcaaccucucacuguagaacugcc

SEQ ID NO: 36150 - RNA, 32 nt, Human
acccggcugccuccuccucuuccuggcugcag

SEQ ID NO: 36151 - RNA, 32 nt, Human
acccggcugcugauggccuggugccagcuggg

SEQ ID NO: 36152 - RNA, 32 nt, Human
acccggcugggcaggcccggacagcucccgcg

SEQ ID NO: 36153 - RNA, 32 nt, Human
acccggcuguagcugcucucacaccggcccaa

SEQ ID NO: 36154 - RNA, 32 nt, Human
acccgggaagcagagguugcagugacagagau

SEQ ID NO: 36155 - RNA, 32 nt, Human
acccgggaagcagagguugcagugagcugagg

SEQ ID NO: 36156 - RNA, 32 nt, Human
acccgggaagcagagguugcggugagccgaga

SEQ ID NO: 36157 - RNA, 32 nt, Human
acccgggaagcagagguugcggugagcugaga

SEQ ID NO: 36158 - RNA, 32 nt, Human
acccgggaagcagagucugcagugagccaaga

SEQ ID NO: 36159 - RNA, 32 nt, Human
acccgggaagcggagcuugcagugagccgaga

SEQ ID NO: 36160 - RNA, 32 nt, Human
acccgggaagcggagguugcagggagccgaga

SEQ ID NO: 36161 - RNA, 32 nt, Human
acccgggaagcggagguugcagugagccaaga

SEQ ID NO: 36162 - RNA, 32 nt, Human
acccgggaagcggagguugcagugagccgaga

SEQ ID NO: 36163 - RNA, 32 nt, Human
acccgggaaggcggaaguugcagugagccgag

SEQ ID NO: 36164 - RNA, 32 nt, Human
acccgggaaguggagguugcagugagccaaga

SEQ ID NO: 36165 - RNA, 32 nt, Human
acccgggaaguggagguugccgugagucgaga

SEQ ID NO: 36166 - RNA, 32 nt, Human
acccgggacaguggucaggaagcccugagcau

SEQ ID NO: 36167 - RNA, 32 nt, Human
acccgggacgcagggguugcagugagcggaga

SEQ ID NO: 36168 - RNA, 32 nt, Human
acccgggacuccuccuguccugggccgaaugc

SEQ ID NO: 36169 - RNA, 32 nt, Human
acccgggagacggagguugcagugagcugaga

SEQ ID NO: 36170 - RNA, 32 nt, Human
acccgggagacggcgcuugcagugagccgaga

SEQ ID NO: 36171 - RNA, 32 nt, Human
acccgggagacgggagguuguggugagcugag

SEQ ID NO: 36172 - RNA, 32 nt, Human
acccgggagaugaagguugcagugagcugagg

SEQ ID NO: 36173 - RNA, 32 nt, Human
acccgggagauggcgcuugcagugagcugaga

SEQ ID NO: 36174 - RNA, 32 nt, Human
acccgggagcggagguugcagugagcugagau

SEQ ID NO: 36175 - RNA, 32 nt, Human
acccgggaggaagagcuugcagugagccgaga

SEQ ID NO: 36176 - RNA, 32 nt, Human
acccgggaggaggagcuugcagugagccgaga

SEQ ID NO: 36177 - RNA, 32 nt, Human
acccgggaggaggagguugcacugagccgaga

SEQ ID NO: 36178 - RNA, 32 nt, Human
acccgggaggcaaagguugcagugagcugaga

SEQ ID NO: 36179 - RNA, 32 nt, Human
acccgggaggcagaaguugcagugaacugaaa

SEQ ID NO: 36180 - RNA, 32 nt, Human
acccgggaggcagaccuugcagugagccaaga

SEQ ID NO: 36181 - RNA, 32 nt, Human
acccgggaggcagacuuugcagugagcugaga

SEQ ID NO: 36182 - RNA, 32 nt, Human
acccgggaggcagagauagcagugaacugaga

SEQ ID NO: 36183 - RNA, 32 nt, Human
acccgggaggcagagauugcaguaagcugaga

SEQ ID NO: 36184 - RNA, 32 nt, Human
acccgggaggcagagcuugcaguaagccgaga

SEQ ID NO: 36185 - RNA, 32 nt, Human
acccgggaggcagagcuugcagugagcagaga

SEQ ID NO: 36186 - RNA, 32 nt, Human
acccgggaggcagagcuugcagugagccaaga

SEQ ID NO: 36187 - RNA, 32 nt, Human
acccgggaggcagagcuugcagugagccgaga

SEQ ID NO: 36188 - RNA, 32 nt, Human
acccgggaggcagagcuugcagugagcugaga

SEQ ID NO: 36189 - RNA, 32 nt, Human
acccgggaggcagagcuugcagugagucgaga

SEQ ID NO: 36190 - RNA, 32 nt, Human
acccgggaggcagagcuugcggugagccgaga

SEQ ID NO: 36191 - RNA, 32 nt, Human
acccgggaggcagagcuuguggugagccgaga

SEQ ID NO: 36192 - RNA, 32 nt, Human
acccgggaggcagaggcugcacucuagccugg

SEQ ID NO: 36193 - RNA, 32 nt, Human
acccgggaggcagaggcugcagagagccaagg

SEQ ID NO: 36194 - RNA, 32 nt, Human
acccgggaggcagaggcugcagugagccgaga

SEQ ID NO: 36195 - RNA, 32 nt, Human
acccgggaggcagaggcugcagugagcugaga

SEQ ID NO: 36196 - RNA, 32 nt, Human
acccgggaggcagaggcuguagugagccaaga

SEQ ID NO: 36197 - RNA, 32 nt, Human
acccgggaggcagagggugcaguaagccgaga

SEQ ID NO: 36198 - RNA, 32 nt, Human
acccgggaggcagagguaguagugagcugaag

SEQ ID NO: 36199 - RNA, 32 nt, Human
acccgggaggcagagguggcugugagccgagg

SEQ ID NO: 36200 - RNA, 32 nt, Human
acccgggaggcagagguuacagugagccaaga

SEQ ID NO: 36201 - RNA, 32 nt, Human
acccgggaggcagagguuaucgugagcugaca

SEQ ID NO: 36202 - RNA, 32 nt, Human
acccgggaggcagagguugaagugagcugaga

SEQ ID NO: 36203 - RNA, 32 nt, Human
acccgggaggcagagguugcacugagcugaga

SEQ ID NO: 36204 - RNA, 32 nt, Human
acccgggaggcagagguugcagccggcugaga

SEQ ID NO: 36205 - RNA, 32 nt, Human
acccgggaggcagagguugcaguaagcagagg

SEQ ID NO: 36206 - RNA, 32 nt, Human
acccgggaggcagagguugcagugaacccaga

SEQ ID NO: 36207 - RNA, 32 nt, Human
acccgggaggcagagguugcagugacccaaga

SEQ ID NO: 36208 - RNA, 32 nt, Human
acccgggaggcagagguugcagugagccaaga

SEQ ID NO: 36209 - RNA, 32 nt, Human
acccgggaggcagagguugcagugagccgaca

SEQ ID NO: 36210 - RNA, 32 nt, Human
acccgggaggcagagguugcagugagccgaga

SEQ ID NO: 36211 - RNA, 32 nt, Human
acccgggaggcagagguugcagugagcugaga

SEQ ID NO: 36212 - RNA, 32 nt, Human
acccgggaggcagagguugcagugaggugaga

SEQ ID NO: 36213 - RNA, 32 nt, Human
acccgggaggcagagguugcagugagucgaga

SEQ ID NO: 36214 - RNA, 32 nt, Human
acccgggaggcagagguugcagugaguggaga

SEQ ID NO: 36215 - RNA, 32 nt, Human
acccgggaggcagagguugcaguguggugaga

SEQ ID NO: 36216 - RNA, 32 nt, Human
acccgggaggcagagguugcauugagccgaga

SEQ ID NO: 36217 - RNA, 32 nt, Human
acccgggaggcagagguugcggugagccaaga

SEQ ID NO: 36218 - RNA, 32 nt, Human
acccgggaggcagagguugcggugagccgaga

SEQ ID NO: 36219 - RNA, 32 nt, Human
acccgggaggcagagguugcuguaagcugaga

SEQ ID NO: 36220 - RNA, 32 nt, Human
acccgggaggcagagguuguagugagcccaga

SEQ ID NO: 36221 - RNA, 32 nt, Human
acccgggaggcagagguugugagcugagaucg

SEQ ID NO: 36222 - RNA, 32 nt, Human
acccgggaggcagagguuguguugagccaaga

SEQ ID NO: 36223 - RNA, 32 nt, Human
acccgggaggcagcaguugcagugagcugaga

SEQ ID NO: 36224 - RNA, 32 nt, Human
acccgggaggcaguggcugcagugagcugaga

SEQ ID NO: 36225 - RNA, 32 nt, Human
acccgggaggcauagcuugcagugagccgaga

SEQ ID NO: 36226 - RNA, 32 nt, Human
acccgggaggcgagcuugcagugagccgagau

SEQ ID NO: 36227 - RNA, 32 nt, Human
acccgggaggcggaacuugcagugagccaaga

SEQ ID NO: 36228 - RNA, 32 nt, Human
acccgggaggcggagauugcagugagccaaga

SEQ ID NO: 36229 - RNA, 32 nt, Human
acccgggaggcggagauugcagugagcugaga

SEQ ID NO: 36230 - RNA, 32 nt, Human
acccgggaggcggagcuuacagugagcugaga

SEQ ID NO: 36231 - RNA, 32 nt, Human
acccgggaggcggagcuugcagugaaccgaga

SEQ ID NO: 36232 - RNA, 32 nt, Human
acccgggaggcggagcuugcagugagccaaga

SEQ ID NO: 36233 - RNA, 32 nt, Human
acccgggaggcggagcuugcagugagcccaga

SEQ ID NO: 36234 - RNA, 32 nt, Human
acccgggaggcggagcuugcagugagccgaaa

SEQ ID NO: 36235 - RNA, 32 nt, Human
acccgggaggcggagcuugcagugagccgaga

SEQ ID NO: 36236 - RNA, 32 nt, Human
acccgggaggcggagcuugcagugagccgagg

SEQ ID NO: 36237 - RNA, 32 nt, Human
acccgggaggcggagcuugcagugagccuuga

SEQ ID NO: 36238 - RNA, 32 nt, Human
acccgggaggcggagcuugcagugagcggaga

SEQ ID NO: 36239 - RNA, 32 nt, Human
acccgggaggcggagcuugcagugagcugaga

SEQ ID NO: 36240 - RNA, 32 nt, Human
acccgggaggcggaggcugcagugagccgaga

SEQ ID NO: 36241 - RNA, 32 nt, Human
acccgggaggcggaggcugcagugagucgaga

SEQ ID NO: 36242 - RNA, 32 nt, Human
acccgggaggcggagguuacagugagccgaga

SEQ ID NO: 36243 - RNA, 32 nt, Human
acccgggaggcggagguuacagugagccuuuu

SEQ ID NO: 36244 - RNA, 32 nt, Human
acccgggaggcggagguuacagugagcugaga

SEQ ID NO: 36245 - RNA, 32 nt, Human
acccgggaggcggagguuccagugagccgaga

SEQ ID NO: 36246 - RNA, 32 nt, Human
acccgggaggcggagguugcaguaagccgaga

SEQ ID NO: 36247 - RNA, 32 nt, Human
acccgggaggcggagguugcagucagccgaga

SEQ ID NO: 36248 - RNA, 25 nt, Human
acccgggaggcggagguugcaguga

SEQ ID NO: 36249 - RNA, 32 nt, Human
acccgggaggcggagguugcagugagccaaga

SEQ ID NO: 36250 - RNA, 32 nt, Human
acccgggaggcggagguugcagugagccgaaa

SEQ ID NO: 36251 - RNA, 32 nt, Human
acccgggaggcggagguugcagugagccgaga

SEQ ID NO: 36252 - RNA, 32 nt, Human
acccgggaggcggagguugcagugagccugga

SEQ ID NO: 36253 - RNA, 32 nt, Human
acccgggaggcggagguugcagugagcuaaga

SEQ ID NO: 36254 - RNA, 32 nt, Human
acccgggaggcggagguugcagugagcugaga

SEQ ID NO: 36255 - RNA, 32 nt, Human
acccgggaggcggagguugcagugagguaaga

SEQ ID NO: 36256 - RNA, 32 nt, Human
acccgggaggcggagguugcagugagucaagg

SEQ ID NO: 36257 - RNA, 32 nt, Human
acccgggaggcggagguugcaguuagccaaga

SEQ ID NO: 36258 - RNA, 32 nt, Human
acccgggaggcggagguugcaugagcugagau

SEQ ID NO: 36259 - RNA, 32 nt, Human
acccgggaggcggagguugccgugagucgaga

SEQ ID NO: 36260 - RNA, 32 nt, Human
acccgggaggcggagguugcgacccaaagcuu

SEQ ID NO: 36261 - RNA, 32 nt, Human
acccgggaggcggagguugcggugagccaaga

SEQ ID NO: 36262 - RNA, 32 nt, Human
acccgggaggcggagguugcggugagccgaga

SEQ ID NO: 36263 - RNA, 32 nt, Human
acccgggaggcggagguuguagugagccgaga

SEQ ID NO: 36264 - RNA, 32 nt, Human
acccgggaggcggagguuguggugagccaaga

SEQ ID NO: 36265 - RNA, 32 nt, Human
acccgggaggcggagguuguggugagccgaga

SEQ ID NO: 36266 - RNA, 32 nt, Human
acccgggaggcggagguuguggugagcugaaa

SEQ ID NO: 36267 - RNA, 32 nt, Human
acccgggaggcggagguuguggugagcugaga

SEQ ID NO: 36268 - RNA, 32 nt, Human
acccgggaggcggagguuucagugagccgaga

SEQ ID NO: 36269 - RNA, 32 nt, Human
acccgggaggcggaguuugcagugagccaaga

SEQ ID NO: 36270 - RNA, 32 nt, Human
acccgggaggcggaucuugcagugagcggaga

SEQ ID NO: 36271 - RNA, 25 nt, Human
acccgggaggcggggguugcaguga

SEQ ID NO: 36272 - RNA, 32 nt, Human
acccgggaggcuaagguugcagugagccgaga

SEQ ID NO: 36273 - RNA, 32 nt, Human
acccgggaggcugaggcaggagaaucacuuga

SEQ ID NO: 36274 - RNA, 32 nt, Human
acccgggaggcugaggcaggagaaucacuugu

SEQ ID NO: 36275 - RNA, 32 nt, Human
acccgggaggcugaggcaggagaaucgcuuga

SEQ ID NO: 36276 - RNA, 32 nt, Human
acccgggaggcugagguugcagugaguggaga

SEQ ID NO: 36277 - RNA, 32 nt, Human
acccgggaggcugaguugggaggauccuuuga

SEQ ID NO: 36278 - RNA, 32 nt, Human
acccgggagggagagguugcagugagccaaga

SEQ ID NO: 36279 - RNA, 32 nt, Human
acccgggagguagagcuugcagugaaccgaga

SEQ ID NO: 36280 - RNA, 32 nt, Human
acccgggagguagaggcugcagugagccgaga

SEQ ID NO: 36281 - RNA, 32 nt, Human
acccgggagguagagguugcagugagccgaga

SEQ ID NO: 36282 - RNA, 32 nt, Human
acccgggaggugaaggaugcagugagccaaga

SEQ ID NO: 36283 - RNA, 32 nt, Human
acccgggaggugcagguugcagugagccaaga

SEQ ID NO: 36284 - RNA, 32 nt, Human
acccgggagguggaacuugcagugagccgaga

SEQ ID NO: 36285 - RNA, 32 nt, Human
acccgggagguggagauugcagugagcccaga

SEQ ID NO: 36286 - RNA, 32 nt, Human
acccgggagguggagauugcagugagcugaga

SEQ ID NO: 36287 - RNA, 32 nt, Human
acccgggagguggagccuacagugagucaaca

SEQ ID NO: 36288 - RNA, 32 nt, Human
acccgggagguggagcuuccagugagccgaga

SEQ ID NO: 36289 - RNA, 32 nt, Human
acccgggagguggagcuugcagugagccaaga

SEQ ID NO: 36290 - RNA, 32 nt, Human
acccgggagguggagcuugcagugagccgaga

SEQ ID NO: 36291 - RNA, 32 nt, Human
acccgggagguggagcuugcagugagcggaga

SEQ ID NO: 36292 - RNA, 32 nt, Human
acccgggagguggagcuugcagugagcugaga

SEQ ID NO: 36293 - RNA, 32 nt, Human
acccgggagguggagcuugcagugagcuggga

SEQ ID NO: 36294 - RNA, 32 nt, Human
acccgggagguggagcuugcaguggguggaga

SEQ ID NO: 36295 - RNA, 32 nt, Human
acccgggagguggagcuugcggugagcugaga

SEQ ID NO: 36296 - RNA, 32 nt, Human
acccgggagguggagcuuguagugaggcgaga

SEQ ID NO: 36297 - RNA, 32 nt, Human
acccgggagguggaggcugcaaugagcugaga

SEQ ID NO: 36298 - RNA, 32 nt, Human
acccgggagguggaggcugcagcgagccaaga

SEQ ID NO: 36299 - RNA, 32 nt, Human
acccgggagguggaggcugcagugagccgaga

SEQ ID NO: 36300 - RNA, 32 nt, Human
acccgggagguggaggcugcagugaguuaaga

SEQ ID NO: 36301 - RNA, 32 nt, Human
acccgggagguggaggcugcggugagccaaga

SEQ ID NO: 36302 - RNA, 32 nt, Human
acccgggagguggaggucgcggugagccgaga

SEQ ID NO: 36303 - RNA, 32 nt, Human
acccgggagguggagguggcagugagccgaga

SEQ ID NO: 36304 - RNA, 32 nt, Human
acccgggagguggagguuacagugagccgaga

SEQ ID NO: 36305 - RNA, 32 nt, Human
acccgggagguggagguuacagugagcugaga

SEQ ID NO: 36306 - RNA, 32 nt, Human
acccgggagguggagguucuagugagccgaga

SEQ ID NO: 36307 - RNA, 32 nt, Human
acccgggagguggagguugcaaugagccaaga

SEQ ID NO: 36308 - RNA, 32 nt, Human
acccgggagguggagguugcagcaagccgaga

SEQ ID NO: 36309 - RNA, 32 nt, Human
acccgggagguggagguugcagggagccgagg

SEQ ID NO: 36310 - RNA, 32 nt, Human
acccgggagguggagguugcaguaagccgaga

SEQ ID NO: 36311 - RNA, 25 nt, Human
acccgggagguggagguugcaguga

SEQ ID NO: 36312 - RNA, 32 nt, Human
acccgggagguggagguugcagugaaccaaga

SEQ ID NO: 36313 - RNA, 32 nt, Human
acccgggagguggagguugcagugagccaaga

SEQ ID NO: 36314 - RNA, 32 nt, Human
acccgggagguggagguugcagugagccgaga

SEQ ID NO: 36315 - RNA, 32 nt, Human
acccgggagguggagguugcagugagcuaaga

SEQ ID NO: 36316 - RNA, 32 nt, Human
acccgggagguggagguugcagugagcugaga

SEQ ID NO: 36317 - RNA, 32 nt, Human
acccgggagguggagguugcagugaggugaga

SEQ ID NO: 36318 - RNA, 32 nt, Human
acccgggagguggagguugccgugagccaaga

SEQ ID NO: 36319 - RNA, 32 nt, Human
acccgggagguggagguugccgugagcugaga

SEQ ID NO: 36320 - RNA, 32 nt, Human
acccgggagguggagguugccgugaguugaga

SEQ ID NO: 36321 - RNA, 32 nt, Human
acccgggagguggagguugcgaugagcugaga

SEQ ID NO: 36322 - RNA, 32 nt, Human
acccgggagguggagguugcggugagccaaga

SEQ ID NO: 36323 - RNA, 32 nt, Human
acccgggagguggagguugcggugagcugaga

SEQ ID NO: 36324 - RNA, 32 nt, Human
acccgggagguggagguuguagcgagcugaga

SEQ ID NO: 36325 - RNA, 32 nt, Human
acccgggagguggagguuguagugagcugaga

SEQ ID NO: 36326 - RNA, 32 nt, Human
acccgggagguggagguuguggugagcugaga

SEQ ID NO: 36327 - RNA, 32 nt, Human
acccgggagguggcaguugcagggagcuaaga

SEQ ID NO: 36328 - RNA, 32 nt, Human
acccgggaggugggaguuguagugagccgaga

SEQ ID NO: 36329 - RNA, 32 nt, Human
acccgggagguguagguugcagugagccgaga

SEQ ID NO: 36330 - RNA, 32 nt, Human
acccgggaguggagcuugcaaugagccaagau

SEQ ID NO: 36331 - RNA, 32 nt, Human
acccgggaguuaaagguugcagugagccgaga

SEQ ID NO: 36332 - RNA, 32 nt, Human
acccgggaguuccagcccuaggccaggcuccg

SEQ ID NO: 36333 - RNA, 32 nt, Human
acccgggaguuggagguugcagugagccaaga

SEQ ID NO: 36334 - RNA, 32 nt, Human
acccgggaugcagagguugcagugagcugaga

SEQ ID NO: 36335 - RNA, 32 nt, Human
acccgggcacuucucagcauggccaucuucuc

SEQ ID NO: 36336 - RNA, 32 nt, Human
acccgggcagcggagguugcagugagccgaga

SEQ ID NO: 36337 - RNA, 24 nt, Human
acccgggcagggcucccacagaga

SEQ ID NO: 36338 - RNA, 32 nt, Human
acccgggcaguggccaguggccuuaagggagc

SEQ ID NO: 36339 - RNA, 32 nt, Human
acccgggcaucgugcccaggaggcgagaaagg

SEQ ID NO: 36340 - RNA, 32 nt, Human
acccgggccaugccccuggcugggcagccugg

SEQ ID NO: 36341 - RNA, 32 nt, Human
acccgggcccaagagggggccccaauggagca

SEQ ID NO: 36342 - RNA, 32 nt, Human
acccgggcccgguggaggcugcagugagacga

SEQ ID NO: 36343 - RNA, 32 nt, Human
acccgggcccucucuguuugaaccgaacccga

SEQ ID NO: 36344 - RNA, 32 nt, Human
acccgggccgcgugugagcgcacuuugcaccu

SEQ ID NO: 36345 - RNA, 32 nt, Human
acccgggcggcggaaguugcagugagccgaga

SEQ ID NO: 36346 - RNA, 32 nt, Human
acccgggcggcggagauugcagugagccgagg

SEQ ID NO: 36347 - RNA, 26 nt, Human
acccgggcgggccgccgccgccgccg

SEQ ID NO: 36348 - RNA, 32 nt, Human
acccgggcgguggagcuugcagugagccgaga

SEQ ID NO: 36349 - RNA, 32 nt, Human
acccgggcgguggagguuguagugagccaaga

SEQ ID NO: 36350 - RNA, 32 nt, Human
acccgggcuuugaagccaccuccagggccaga

SEQ ID NO: 36351 - RNA, 32 nt, Human
acccggggaaccuagaccaggucuccagaggc

SEQ ID NO: 36352 - RNA, 21 nt, Human
acccggggacccccaacuccu

SEQ ID NO: 36353 - RNA, 24 nt, Human
acccggggagccgccgccgccccg

SEQ ID NO: 36354 - RNA, 32 nt, Human
acccggggaggcugaggcaggagaauugcuug

SEQ ID NO: 36355 - RNA, 32 nt, Human
acccggggaggggccuggaggagagauagcug

SEQ ID NO: 36356 - RNA, 32 nt, Human
acccggggccuccugcagauuucggaaauugg

SEQ ID NO: 36357 - RNA, 32 nt, Human
acccgggggcagaggcugcagugagccgagau

SEQ ID NO: 36358 - RNA, 32 nt, Human
acccggggguuccagccccuagcugcucugga

SEQ ID NO: 36359 - RNA, 32 nt, Human
acccgggguuaaacagcagaggcuccaugugg

SEQ ID NO: 36360 - RNA, 32 nt, Human
acccggguggcagagguugcagugagccgaaa

SEQ ID NO: 36361 - RNA, 32 nt, Human
acccggguggcagagguugcagugagcugaga

SEQ ID NO: 36362 - RNA, 32 nt, Human
acccggguggcgcuggaaguuaucaguggcua

SEQ ID NO: 36363 - RNA, 32 nt, Human
acccggguggcggcgcuugcagugagcugagc

SEQ ID NO: 36364 - RNA, 32 nt, Human
acccgguagaggcggagguugcagugagccga

SEQ ID NO: 36365 - RNA, 32 nt, Human
acccgguaggcagagguugcagugagccgagg

SEQ ID NO: 36366 - RNA, 32 nt, Human
acccgguaggcggagcuugcagugagcugaga

SEQ ID NO: 36367 - RNA, 32 nt, Human
acccgguaggggagcuugcagugagcccagau

SEQ ID NO: 36368 - RNA, 32 nt, Human
acccgguagguggagguugcagugagccgaga

SEQ ID NO: 36369 - RNA, 32 nt, Human
acccggugcagagggagggagagccagguccg

SEQ ID NO: 36370 - RNA, 32 nt, Human
acccggugcaucuggcacguggccaggagcca

SEQ ID NO: 36371 - RNA, 32 nt, Human
acccggugccacacucacccagaagacgaaac

SEQ ID NO: 36372 - RNA, 32 nt, Human
acccgguggcauucugggggaggaguggggcc

SEQ ID NO: 36373 - RNA, 32 nt, Human
acccgguggcugcugaggcggccgagaugcuc

SEQ ID NO: 36374 - RNA, 32 nt, Human
acccgguggggagggguggggagccggagcuc

SEQ ID NO: 36375 - RNA, 19 nt, Human
acccggugguguggcccca

SEQ ID NO: 36376 - RNA, 32 nt, Human
acccggugucccaccaggcuccaggcucccac

SEQ ID NO: 36377 - RNA, 32 nt, Human
acccgguguugccaccaugcaccauggcaugc

SEQ ID NO: 36378 - RNA, 22 nt, Human
acccgguugcugcugcccaagg

SEQ ID NO: 36379 - RNA, 32 nt, Human
acccgguuucuaaucccugcucugucacuaac

SEQ ID NO: 36380 - RNA, 32 nt, Human
acccgguuuuauuuagacuuguuuucccguuu

SEQ ID NO: 36381 - RNA, 32 nt, Human
acccgguuuucccagcggcauuuccgaugaca

SEQ ID NO: 36382 - RNA, 32 nt, Human
acccguacccagcuaauuuuuguauuuuagua

SEQ ID NO: 36383 - RNA, 32 nt, Human
acccguagggagaggcggguugcgggcggcgg

SEQ ID NO: 36384 - RNA, 32 nt, Human
acccguaucugcccuccuugcugguagaagcu

SEQ ID NO: 36385 - RNA, 32 nt, Human
acccgucaaccagagcgugccuccgggccagc

SEQ ID NO: 36386 - RNA, 32 nt, Human
acccgucaauauggcggcgaucggccgcggcc

SEQ ID NO: 36387 - RNA, 32 nt, Human
acccgucccaauaaccacccacggccaggagg

SEQ ID NO: 36388 - RNA, 32 nt, Human
acccguccccacuccuuccucugcaugaccuu

SEQ ID NO: 36389 - RNA, 32 nt, Human
acccguccucaccauguuugccacaucugggg

SEQ ID NO: 36390 - RNA, 32 nt, Human
acccgucuacauugccuucuucaagggcaggu

SEQ ID NO: 36391 - RNA, 32 nt, Human
acccgucuccucccucuccuucccugggcucc

SEQ ID NO: 36392 - RNA, 32 nt, Human
acccgucuggaacucaguuuccccagcuguga

SEQ ID NO: 36393 - RNA, 32 nt, Human
acccgucugugaauguguccacucucuucugc

SEQ ID NO: 36394 - RNA, 32 nt, Human
acccgugaggcagagguugcagugaaccgaga

SEQ ID NO: 36395 - RNA, 32 nt, Human
acccgugaggcagagguugcagugagccgaga

SEQ ID NO: 36396 - RNA, 32 nt, Human
acccgugaggcggagguuguagugagccaaga

SEQ ID NO: 36397 - RNA, 32 nt, Human
acccgugcagauuaaaguaacugugaaguuuu

SEQ ID NO: 36398 - RNA, 21 nt, Human
acccgugcaugucaucacaaa

SEQ ID NO: 36399 - RNA, 32 nt, Human
acccgugccuguauauuccacgcuuugcgcac

SEQ ID NO: 36400 - RNA, 32 nt, Human
acccgugcgggauguggaggggcccggggcgc

SEQ ID NO: 36401 - RNA, 32 nt, Human
acccguggcagcccuggcggacgcaggagcga

SEQ ID NO: 36402 - RNA, 32 nt, Human
acccgugggauggugcccagggguugccuugg

SEQ ID NO: 36403 - RNA, 32 nt, Human
acccgugggccuggggugugccugcgucuagc

SEQ ID NO: 36404 - RNA, 32 nt, Human
acccguggugcugcugccaugcggcgcuucug

SEQ ID NO: 36405 - RNA, 32 nt, Human
acccguggugggcaaauguccaggccugggcu

SEQ ID NO: 36406 - RNA, 32 nt, Human
acccguguauguuaugaaaacaugguuugaua

SEQ ID NO: 36407 - RNA, 32 nt, Human
acccguguccuagagucggaaagagaagcuaa

SEQ ID NO: 36408 - RNA, 24 nt, Human
acccgugugccccuucccaccaua

SEQ ID NO: 36409 - RNA, 32 nt, Human
acccguguggcagagguugcggugaguguaga

SEQ ID NO: 36410 - RNA, 32 nt, Human
acccguuccaucccgggcuaucccaguucccc

SEQ ID NO: 36411 - RNA, 21 nt, Human
acccguugcccaggcuggagg

SEQ ID NO: 36412 - RNA, 32 nt, Human
acccguuuggggucucaucucuacuucuaggg

SEQ ID NO: 36413 - RNA, 32 nt, Human
acccuaaagauuuccccaguacagucagcucu

SEQ ID NO: 36414 - RNA, 32 nt, Human
acccuaaaggcagagguugcagugagccgaga

SEQ ID NO: 36415 - RNA, 32 nt, Human
acccuaacccacccucuuuaccaaccccuuuc

SEQ ID NO: 36416 - RNA, 23 nt, Human
acccuaacccugauacuaacccu

SEQ ID NO: 36417 - RNA, 32 nt, Human
acccuaagaucagcuagacucucugccuuguu

SEQ ID NO: 36418 - RNA, 21 nt, Human
acccuaagccagaaccacuca

SEQ ID NO: 36419 - RNA, 32 nt, Human
acccuaagcgcccgcucacuccugccuuuauu

SEQ ID NO: 36420 - RNA, 24 nt, Human
acccuaaugagcaccuccgggaaa

SEQ ID NO: 36421 - RNA, 32 nt, Human
acccuaauuaacauaaagaccauucaucagcg

SEQ ID NO: 36422 - RNA, 32 nt, Human
acccuacagauggggcuuuggggguuugcucc

SEQ ID NO: 36423 - RNA, 24 nt, Human
acccuacaucacuccauucugccc

SEQ ID NO: 36424 - RNA, 32 nt, Human
acccuacaugucucuucucugcacuccagggc

SEQ ID NO: 36425 - RNA, 32 nt, Human
acccuaccaggcucccugucucggcucuccuu

SEQ ID NO: 36426 - RNA, 32 nt, Human
acccuacccagccugcugccucagcacagcca

SEQ ID NO: 36427 - RNA, 20 nt, Human
acccuaccccaugccuuggu

SEQ ID NO: 36428 - RNA, 32 nt, Human
acccuaccuccagggcauagucagucugggcu

SEQ ID NO: 36429 - RNA, 32 nt, Human
acccuaccugcccugccugccugcugccccuc

SEQ ID NO: 36430 - RNA, 32 nt, Human
acccuacgcugccccucacacccuaugcucag

SEQ ID NO: 36431 - RNA, 32 nt, Human
acccuacucccugugccuccagccucgacuag

SEQ ID NO: 36432 - RNA, 32 nt, Human
acccuacucuacuggauucaaggccaguaaau

SEQ ID NO: 36433 - RNA, 32 nt, Human
acccuacucucugugccuccagccucgacuag

SEQ ID NO: 36434 - RNA, 32 nt, Human
acccuacuuggcaugaaaaaggaagcucaguu

SEQ ID NO: 36435 - RNA, 32 nt, Human
acccuacuuucagcagggcuuugaggcuggga

SEQ ID NO: 36436 - RNA, 21 nt, Human
acccuagagaacugccuuugu

SEQ ID NO: 36437 - RNA, 32 nt, Human
acccuagagccauaccuucacugacaucucau

SEQ ID NO: 36438 - RNA, 32 nt, Human
acccuagagccugggaccuggccauccucugc

SEQ ID NO: 36439 - RNA, 32 nt, Human
acccuagaggcggaguuugcagugagccgaga

SEQ ID NO: 36440 - RNA, 23 nt, Human
acccuagaugagcuguccugcuc

SEQ ID NO: 36441 - RNA, 24 nt, Human
acccuagaugauuucauccugccc

SEQ ID NO: 36442 - RNA, 32 nt, Human
acccuagaugauuucauccugccccucacuuc

SEQ ID NO: 36443 - RNA, 17 nt, Human
acccuagccccuccuua

SEQ ID NO: 36444 - RNA, 32 nt, Human
acccuagccugaggcuccacuggaagaucucg

SEQ ID NO: 36445 - RNA, 32 nt, Human
acccuagcucacugcaaccuccaacugcuggg

SEQ ID NO: 36446 - RNA, 32 nt, Human
acccuagcugugguaggaaguggcccucagag

SEQ ID NO: 36447 - RNA, 26 nt, Human
acccuagcuuggguggcagagcaaga

SEQ ID NO: 36448 - RNA, 32 nt, Human
acccuagcuuuucauuaucuacaaucaauagu

SEQ ID NO: 36449 - RNA, 32 nt, Human
acccuaggcuauacaagucucagucuagggga

SEQ ID NO: 36450 - RNA, 32 nt, Human
acccuaggcuuccuccuggaugugauggggau

SEQ ID NO: 36451 - RNA, 32 nt, Human
acccuaggcuuuuccccucugugacuggcaga

SEQ ID NO: 36452 - RNA, 23 nt, Human
acccuaggucucccuuccaggcc

SEQ ID NO: 36453 - RNA, 32 nt, Human
acccuauaaaggagggagcucguggcgaggca

SEQ ID NO: 36454 - RNA, 32 nt, Human
acccuauaaccucaggccuuggcauugagucc

SEQ ID NO: 36455 - RNA, 32 nt, Human
acccuauacucucagucuccccaacccacccc

SEQ ID NO: 36456 - RNA, 32 nt, Human
acccuauacucuugccuuggugcugucgcaga

SEQ ID NO: 36457 - RNA, 32 nt, Human
acccuauaugcugcugccucaggcagagcccu

SEQ ID NO: 36458 - RNA, 32 nt, Human
acccuauccuacacuacuaggaacuugcacag

SEQ ID NO: 36459 - RNA, 32 nt, Human
acccuaugauccagcauuuccacuucugggug

SEQ ID NO: 36460 - RNA, 20 nt, Human
acccuauucaauaaauggug

SEQ ID NO: 36461 - RNA, 32 nt, Human
acccuauucucagggaagauggaauuuaguuu

SEQ ID NO: 36462 - RNA, 32 nt, Human
acccuauugcccaggcuggagugcaauggcgu

SEQ ID NO: 36463 - RNA, 32 nt, Human
acccuauuguaagcggagaaacuuagugugcg

SEQ ID NO: 36464 - RNA, 32 nt, Human
acccuauuguccugccacaucucccucuccga

SEQ ID NO: 36465 - RNA, 32 nt, Human
acccuauuuuucccuguucccuggugccacag

SEQ ID NO: 36466 - RNA, 32 nt, Human
acccucaaaagcugcaccacagccuggagaau

SEQ ID NO: 36467 - RNA, 32 nt, Human
acccucaaacacccagcucagccacacacaac

SEQ ID NO: 36468 - RNA, 22 nt, Human
acccucaacagaacuuucaucu

SEQ ID NO: 36469 - RNA, 32 nt, Human
acccucaacccggcuacccuguugccuguaga

SEQ ID NO: 36470 - RNA, 32 nt, Human
acccucaagaaacccccagugccuuguaugaa

SEQ ID NO: 36471 - RNA, 32 nt, Human
acccucaagaggaguuagaaaagagguccuug

SEQ ID NO: 36472 - RNA, 32 nt, Human
acccucaaguguaaccaucacaagauaaggcc

SEQ ID NO: 36473 - RNA, 18 nt, Human
acccucaaugaacuacca

SEQ ID NO: 36474 - RNA, 32 nt, Human
acccucacaccgcugcuccucuggaccucugu

SEQ ID NO: 36475 - RNA, 32 nt, Human
acccucacauccccauccccuucuagccuuuc

SEQ ID NO: 36476 - RNA, 32 nt, Human
acccucacaucucccuuccugaauuucuuuag

SEQ ID NO: 36477 - RNA, 32 nt, Human
acccucacaugccucccccaucccugcuggua

SEQ ID NO: 36478 - RNA, 32 nt, Human
acccucaccaucuacaaaauggagauuaauaa

SEQ ID NO: 36479 - RNA, 32 nt, Human
acccucacccuccacccuuugcugcugaccuc

SEQ ID NO: 36480 - RNA, 20 nt, Human
acccucaccuaccccuccca

SEQ ID NO: 36481 - RNA, 32 nt, Human
acccucacggagacuugccagcaauggcagaa

SEQ ID NO: 36482 - RNA, 32 nt, Human
acccucacucagccuuuucccuccaggcaucu

SEQ ID NO: 36483 - RNA, 32 nt, Human
acccucacugcccucaaggacaacagcagggu

SEQ ID NO: 36484 - RNA, 32 nt, Human
acccucacugggugggacugccagcggagagu

SEQ ID NO: 36485 - RNA, 32 nt, Human
acccucacuguccuccagcccaggaugggcca

SEQ ID NO: 36486 - RNA, 32 nt, Human
acccucacuucccccuucccuaccucuuucuc

SEQ ID NO: 36487 - RNA, 32 nt, Human
acccucacuucuuuaccaaaugcauuuccaaa

SEQ ID NO: 36488 - RNA, 32 nt, Human
acccucagaacugaagagguucagagaacuuu

SEQ ID NO: 36489 - RNA, 32 nt, Human
acccucagaccccauucucucuguucguccuu

SEQ ID NO: 36490 - RNA, 32 nt, Human
acccucagaccugccccggggccagguggaga

SEQ ID NO: 36491 - RNA, 19 nt, Human
acccucagcaccccuucca

SEQ ID NO: 36492 - RNA, 32 nt, Human
acccucagcugcuggaggccacccuggcccag

SEQ ID NO: 36493 - RNA, 19 nt, Human
acccucaggccacccucca

SEQ ID NO: 36494 - RNA, 27 nt, Human
acccucaguaaauaguggugcauuugu

SEQ ID NO: 36495 - RNA, 32 nt, Human
acccucaguagaauuggauuuccaugucagcc

SEQ ID NO: 36496 - RNA, 32 nt, Human
acccucagucuucucaugaauaaauuccuuca

SEQ ID NO: 36497 - RNA, 32 nt, Human
acccucaguuuucaccaagauguuguaaggag

SEQ ID NO: 36498 - RNA, 32 nt, Human
acccucauccuagccucgugacuucuggucua

SEQ ID NO: 36499 - RNA, 32 nt, Human
acccucaucuggagagaggcaagaacagggca

SEQ ID NO: 36500 - RNA, 32 nt, Human
acccucaugccuggaccccugagagcuucuga

SEQ ID NO: 36501 - RNA, 32 nt, Human
acccucauuccucugguggggagcugccugca

SEQ ID NO: 36502 - RNA, 17 nt, Human
acccuccaaagcccucc

SEQ ID NO: 36503 - RNA, 24 nt, Human
acccuccaaguccuaaccccucca

SEQ ID NO: 36504 - RNA, 21 nt, Human
acccuccacacacuucuucca

SEQ ID NO: 36505 - RNA, 17 nt, Human
acccuccacaccuccca

SEQ ID NO: 36506 - RNA, 18 nt, Human
acccuccacagccuccca

SEQ ID NO: 36507 - RNA, 32 nt, Human
acccuccacaguacuccagaaaggacuguccu

SEQ ID NO: 36508 - RNA, 20 nt, Human
acccuccaccccagcugcca

SEQ ID NO: 36509 - RNA, 16 nt, Human
acccuccaccccgucc

SEQ ID NO: 36510 - RNA, 20 nt, Human
acccuccacccuguccccca

SEQ ID NO: 36511 - RNA, 19 nt, Human
acccuccacccuucucccc

SEQ ID NO: 36512 - RNA, 17 nt, Human
acccuccacccuuuucc

SEQ ID NO: 36513 - RNA, 20 nt, Human
acccuccaccucccaccucc

SEQ ID NO: 36514 - RNA, 18 nt, Human
acccuccaccuccuugca

SEQ ID NO: 36515 - RNA, 15 nt, Human
acccuccaccucuuc

SEQ ID NO: 36516 - RNA, 20 nt, Human
acccuccaccuuccccucca

SEQ ID NO: 36517 - RNA, 21 nt, Human
acccuccacucuccucuucca

SEQ ID NO: 36518 - RNA, 32 nt, Human
acccuccacuuccuccuccuguuuggcuucug

SEQ ID NO: 36519 - RNA, 17 nt, Human
acccuccagaccuccca

SEQ ID NO: 36520 - RNA, 32 nt, Human
acccuccagagccaggaggccaaggcugugaa

SEQ ID NO: 36521 - RNA, 19 nt, Human
acccuccagcccccuccca

SEQ ID NO: 36522 - RNA, 32 nt, Human
acccuccagcccugguccccagccccugcuac

SEQ ID NO: 36523 - RNA, 32 nt, Human
acccuccagcuccugacucugccuauuguucc

SEQ ID NO: 36524 - RNA, 32 nt, Human
acccuccaggagaccccagugucugugguuuc

SEQ ID NO: 36525 - RNA, 32 nt, Human
acccuccaggcuucggggaaauguggguuugc

SEQ ID NO: 36526 - RNA, 32 nt, Human
acccuccagguguccuucgcacccaacagugc

SEQ ID NO: 36527 - RNA, 20 nt, Human
acccuccaguccccugccca

SEQ ID NO: 36528 - RNA, 32 nt, Human
acccuccagucgugcccugcaggccuggccca

SEQ ID NO: 36529 - RNA, 20 nt, Human
acccuccaucaaguccucca

SEQ ID NO: 36530 - RNA, 19 nt, Human
acccuccauccacuuccca

SEQ ID NO: 36531 - RNA, 18 nt, Human
acccuccauccccacccu

SEQ ID NO: 36532 - RNA, 21 nt, Human
acccuccauccccacccucca

SEQ ID NO: 36533 - RNA, 21 nt, Human
acccuccaucccucaccuucc

SEQ ID NO: 36534 - RNA, 21 nt, Human
acccuccaucuaccccuucca

SEQ ID NO: 36535 - RNA, 19 nt, Human
acccuccaucuacuggccc

SEQ ID NO: 36536 - RNA, 19 nt, Human
acccuccaugccccugcca

SEQ ID NO: 36537 - RNA, 20 nt, Human
acccuccauuucucccccuc

SEQ ID NO: 36538 - RNA, 32 nt, Human
acccuccauuucucccccucacccaugcugag

SEQ ID NO: 36539 - RNA, 32 nt, Human
acccucccaaaaugcugggauuacaggcguaa

SEQ ID NO: 36540 - RNA, 32 nt, Human
acccucccaaagugcugggauuacaggcauca

SEQ ID NO: 36541 - RNA, 32 nt, Human
acccucccaaagugcugggauuacaggcauga

SEQ ID NO: 36542 - RNA, 32 nt, Human
acccucccaaagugcugggauuauaggcauga

SEQ ID NO: 36543 - RNA, 21 nt, Human
acccucccaagcaccauguca

SEQ ID NO: 36544 - RNA, 32 nt, Human
acccucccaaguagcugggacuacaggcgccu

SEQ ID NO: 36545 - RNA, 32 nt, Human
acccucccaaguagcugggauuacaggugccc

SEQ ID NO: 36546 - RNA, 20 nt, Human
acccucccacccaccuucca

SEQ ID NO: 36547 - RNA, 32 nt, Human
acccucccacucccaucuccuuaccucuggaa

SEQ ID NO: 36548 - RNA, 32 nt, Human
acccucccaucgugcaaaauuacccugcccag

SEQ ID NO: 36549 - RNA, 32 nt, Human
acccucccauguagcugggauuacagcugccu

SEQ ID NO: 36550 - RNA, 32 nt, Human
acccuccccaagugcuggaauuacaggcguga

SEQ ID NO: 36551 - RNA, 32 nt, Human
acccuccccaccuagcccuccaaccaaggcua

SEQ ID NO: 36552 - RNA, 19 nt, Human
acccuccccacucccucca

SEQ ID NO: 36553 - RNA, 32 nt, Human
acccuccccaggaaggaggaggguguucagga

SEQ ID NO: 36554 - RNA, 32 nt, Human
acccuccccaucuuugcugagcucucaguucc

SEQ ID NO: 36555 - RNA, 32 nt, Human
acccucccccacuugccaccaucccccaucac

SEQ ID NO: 36556 - RNA, 32 nt, Human
acccucccccagaagcucacaaaggaaaacgg

SEQ ID NO: 36557 - RNA, 32 nt, Human
acccucccccagacacagcccaggucccuccg

SEQ ID NO: 36558 - RNA, 19 nt, Human
acccuccccccaccuucca

SEQ ID NO: 36559 - RNA, 19 nt, Human
acccuccccgcacccccca

SEQ ID NO: 36560 - RNA, 32 nt, Human
acccuccccgcugugguuggcagccacccacc

SEQ ID NO: 36561 - RNA, 32 nt, Human
acccuccccguggcucaggucuccccuauccc

SEQ ID NO: 36562 - RNA, 32 nt, Human
acccuccccuagugggcucugggguuccacca

SEQ ID NO: 36563 - RNA, 19 nt, Human
acccuccccucccccuucc

SEQ ID NO: 36564 - RNA, 32 nt, Human
acccuccccuccggcagccucucccauggcca

SEQ ID NO: 36565 - RNA, 32 nt, Human
acccuccccugccggccugcgccagcuggacc

SEQ ID NO: 36566 - RNA, 32 nt, Human
acccuccccugccuccgaggccugccugcuac

SEQ ID NO: 36567 - RNA, 32 nt, Human
acccuccccugccuccgaggccugccugcucc

SEQ ID NO: 36568 - RNA, 32 nt, Human
acccucccgaguagcugggacuacaggcgugg

SEQ ID NO: 36569 - RNA, 32 nt, Human
acccucccgaguagcugggacuacaggugccu

SEQ ID NO: 36570 - RNA, 32 nt, Human
acccucccgaguagcugggauuacaggcacac

SEQ ID NO: 36571 - RNA, 32 nt, Human
acccucccgaguagcugggauuacaggcgccc

SEQ ID NO: 36572 - RNA, 32 nt, Human
acccucccgagucacugggauuacaggcgccc

SEQ ID NO: 36573 - RNA, 32 nt, Human
acccucccuagagggcccuugucugagaaacc

SEQ ID NO: 36574 - RNA, 32 nt, Human
acccucccucaaggaauccugucagaagaugu

SEQ ID NO: 36575 - RNA, 32 nt, Human
acccucccucccccauccuccccaaaauagcc

SEQ ID NO: 36576 - RNA, 32 nt, Human
acccucccuccccgcuucccugccucacccuc

SEQ ID NO: 36577 - RNA, 32 nt, Human
acccucccuccccucccggcuccccggccaga

SEQ ID NO: 36578 - RNA, 20 nt, Human
acccucccuccuccaaggaa

SEQ ID NO: 36579 - RNA, 32 nt, Human
acccucccugcuccaagugcaccaggaugcaa

SEQ ID NO: 36580 - RNA, 32 nt, Human
acccucccuguucaucccauguuagcuccaaa

SEQ ID NO: 36581 - RNA, 32 nt, Human
acccucccuguuuaaagaaggaaucugagaug

SEQ ID NO: 36582 - RNA, 32 nt, Human
acccucccuucgccacccuccacccacccacc

SEQ ID NO: 36583 - RNA, 32 nt, Human
acccucccuuucucuuuccucauugccuucuc

SEQ ID NO: 36584 - RNA, 19 nt, Human
acccuccgaacucccccca

SEQ ID NO: 36585 - RNA, 21 nt, Human
acccuccgccccacccccucc

SEQ ID NO: 36586 - RNA, 32 nt, Human
acccuccgccccacuccagccaguguggggag

SEQ ID NO: 36587 - RNA, 23 nt, Human
acccuccgcugccgccgccgccg

SEQ ID NO: 36588 - RNA, 32 nt, Human
acccuccggcaucugugacucuaccucaagga

SEQ ID NO: 36589 - RNA, 32 nt, Human
acccuccuaucccgggaggagccucagguccu

SEQ ID NO: 36590 - RNA, 32 nt, Human
acccuccucagaggcccggggaagggaagagc

SEQ ID NO: 36591 - RNA, 32 nt, Human
acccuccucaugcccacccagcaagggacaga

SEQ ID NO: 36592 - RNA, 32 nt, Human
acccuccuccacccucuacccucaaguagucc

SEQ ID NO: 36593 - RNA, 20 nt, Human
acccuccuccccuccuucca

SEQ ID NO: 36594 - RNA, 24 nt, Human
acccuccucccucugcccccucca

SEQ ID NO: 36595 - RNA, 32 nt, Human
acccuccuccugccacccuuguggacuaagac

SEQ ID NO: 36596 - RNA, 32 nt, Human
acccuccuccugccacccuuguggacuaggac

SEQ ID NO: 36597 - RNA, 32 nt, Human
acccuccuccuugccuguaucuugacagcauc

SEQ ID NO: 36598 - RNA, 32 nt, Human
acccuccuccuuucuucuccccacauccgcac

SEQ ID NO: 36599 - RNA, 32 nt, Human
acccuccucucacccuccacccuccaggagac

SEQ ID NO: 36600 - RNA, 32 nt, Human
acccuccucugccucccaaagugcugugauua

SEQ ID NO: 36601 - RNA, 32 nt, Human
acccuccucuuggaauuacaagcccugggguu

SEQ ID NO: 36602 - RNA, 32 nt, Human
acccuccugaguagaugggacuacagguacgu

SEQ ID NO: 36603 - RNA, 32 nt, Human
acccuccugaguagcugggacuacaggugugc

SEQ ID NO: 36604 - RNA, 32 nt, Human
acccuccugcagcagaacuacagaccugccau

SEQ ID NO: 36605 - RNA, 32 nt, Human
acccuccugccccaucuccaucccuucuuuua

SEQ ID NO: 36606 - RNA, 19 nt, Human
acccuccugcccccucucc

SEQ ID NO: 36607 - RNA, 32 nt, Human
acccuccugccucacagcuuuaucuuuguauu

SEQ ID NO: 36608 - RNA, 32 nt, Human
acccuccugccuccucuccaggcccuuguucg

SEQ ID NO: 36609 - RNA, 32 nt, Human
acccuccugccugggccgcagccgccgccgcg

SEQ ID NO: 36610 - RNA, 32 nt, Human
acccuccugcugagcugccccugcugcuuaag

SEQ ID NO: 36611 - RNA, 24 nt, Human
acccuccuggcuaacacagugaaa

SEQ ID NO: 36612 - RNA, 32 nt, Human
acccuccugggcugccaggauuuagcagggag

SEQ ID NO: 36613 - RNA, 32 nt, Human
acccuccuguaccuccggccucccagcggccc

SEQ ID NO: 36614 - RNA, 32 nt, Human
acccuccuguccugacaggcucagcucugcau

SEQ ID NO: 36615 - RNA, 22 nt, Human
acccuccugugacaugguccca

SEQ ID NO: 36616 - RNA, 32 nt, Human
acccuccuuauuucuguuacuacuugucugug

SEQ ID NO: 36617 - RNA, 32 nt, Human
acccuccuucacguucucuuguggaaucaugu

SEQ ID NO: 36618 - RNA, 32 nt, Human
acccuccuucuauuuucccuacccugcaacuu

SEQ ID NO: 36619 - RNA, 32 nt, Human
acccucgcaaacuguggccuggcggaaauccu

SEQ ID NO: 36620 - RNA, 32 nt, Human
acccucgcagcccagaggcgcccagaggaagu

SEQ ID NO: 36621 - RNA, 32 nt, Human
acccucgcagugaguguuacaguucuuaaaga

SEQ ID NO: 36622 - RNA, 32 nt, Human
acccucgcagugaguguuacaguucuuaaagg

SEQ ID NO: 36623 - RNA, 32 nt, Human
acccucgccugccucggggccaguacauaccg

SEQ ID NO: 36624 - RNA, 25 nt, Human
acccucgcugcaccuaccccuccca

SEQ ID NO: 36625 - RNA, 32 nt, Human
acccucgcuuucuccggcuuccucuggcccag

SEQ ID NO: 36626 - RNA, 32 nt, Human
acccucggacucaggcaggacauggcaggaug

SEQ ID NO: 36627 - RNA, 32 nt, Human
acccucggagaugcugcugcagugagugguuc

SEQ ID NO: 36628 - RNA, 32 nt, Human
acccucggauuccuuccuuggcucucggggcc

SEQ ID NO: 36629 - RNA, 23 nt, Human
acccucggcccaaagcucccaga

SEQ ID NO: 36630 - RNA, 32 nt, Human
acccucggcccagugggaggccagcuuggcuc

SEQ ID NO: 36631 - RNA, 32 nt, Human
acccucggcccucccugucacugcagggcagc

SEQ ID NO: 36632 - RNA, 32 nt, Human
acccucgggcagccccuccagcuuccugggag

SEQ ID NO: 36633 - RNA, 32 nt, Human
acccucgggugagagagcagcccaggggcacg

SEQ ID NO: 36634 - RNA, 32 nt, Human
acccucggucaccccaaccucuggcucugagc

SEQ ID NO: 36635 - RNA, 18 nt, Human
acccucgguccccuucca

SEQ ID NO: 36636 - RNA, 32 nt, Human
acccucggugggcagcgcacuccagucuuccc

SEQ ID NO: 36637 - RNA, 32 nt, Human
acccucguagucaauaaggucuugccacauuu

SEQ ID NO: 36638 - RNA, 32 nt, Human
acccucguguccucccuucauccugcggggcu

SEQ ID NO: 36639 - RNA, 20 nt, Human
acccucuaacccccacucca

SEQ ID NO: 36640 - RNA, 32 nt, Human
acccucuacaggagaagugcacccuagggccu

SEQ ID NO: 36641 - RNA, 32 nt, Human
acccucuacuaugccuucuauguggcugugcu

SEQ ID NO: 36642 - RNA, 20 nt, Human
acccucuacugacccuccca

SEQ ID NO: 36643 - RNA, 32 nt, Human
acccucuagggcagugccugcccucagcucuc

SEQ ID NO: 36644 - RNA, 32 nt, Human
acccucuaucagcaguggcccaggaaggaggu

SEQ ID NO: 36645 - RNA, 32 nt, Human
acccucucaagugcccucuccgagcugguagg

SEQ ID NO: 36646 - RNA, 20 nt, Human
acccucucaccgugguccca

SEQ ID NO: 36647 - RNA, 32 nt, Human
acccucuccagccucagaccugagacagggcu

SEQ ID NO: 36648 - RNA, 32 nt, Human
acccucucccccuuaucuaucuccuucucggc

SEQ ID NO: 36649 - RNA, 32 nt, Human
acccucucccuccuaacccucuccuugccuga

SEQ ID NO: 36650 - RNA, 32 nt, Human
acccucucccuggcugccucaggcuucucuua

SEQ ID NO: 36651 - RNA, 20 nt, Human
acccucuccuagcacuguca

SEQ ID NO: 36652 - RNA, 32 nt, Human
acccucuccuccugaaacuuuagucacuccug

SEQ ID NO: 36653 - RNA, 32 nt, Human
acccucuccucugaccuccacucacucauccc

SEQ ID NO: 36654 - RNA, 32 nt, Human
acccucuccucuuccuucuccuuucucccauu

SEQ ID NO: 36655 - RNA, 21 nt, Human
acccucuccuugaugcagcuu

SEQ ID NO: 36656 - RNA, 32 nt, Human
acccucucucagacuguuugguuuuugagcau

SEQ ID NO: 36657 - RNA, 32 nt, Human
acccucucuccaggacuugucagcuggugguu

SEQ ID NO: 36658 - RNA, 32 nt, Human
acccucucuccucggaugaccugccuccuaau

SEQ ID NO: 36659 - RNA, 32 nt, Human
acccucucuccucuuuguucucucauuguugu

SEQ ID NO: 36660 - RNA, 32 nt, Human
acccucucugacauugggugggagacucuggg

SEQ ID NO: 36661 - RNA, 32 nt, Human
acccucugaagccacagccagagcuguauguu

SEQ ID NO: 36662 - RNA, 32 nt, Human
acccucugaccuuucaguuuuccauagcagcc

SEQ ID NO: 36663 - RNA, 18 nt, Human
acccucugacucccucca

SEQ ID NO: 36664 - RNA, 32 nt, Human
acccucugagauaacuguuuucaucuacagaa

SEQ ID NO: 36665 - RNA, 19 nt, Human
acccucugaucucccucca

SEQ ID NO: 36666 - RNA, 32 nt, Human
acccucugcccaacucuggcagucucuccugg

SEQ ID NO: 36667 - RNA, 32 nt, Human
acccucugcccuucuaagucauagacuaggua

SEQ ID NO: 36668 - RNA, 18 nt, Human
acccucugccgacuacca

SEQ ID NO: 36669 - RNA, 32 nt, Human
acccucuggacaggacaugcugggcaggggac

SEQ ID NO: 36670 - RNA, 32 nt, Human
acccucuggaugccuuucuugucacuuaguau

SEQ ID NO: 36671 - RNA, 32 nt, Human
acccucuggccuaggcuggcuccagugugcca

SEQ ID NO: 36672 - RNA, 23 nt, Human
acccucugggaggccaaggcagg

SEQ ID NO: 36673 - RNA, 23 nt, Human
acccucuggggacaagagucuga

SEQ ID NO: 36674 - RNA, 32 nt, Human
acccucuggggcaggaggggcuugggcuuccc

SEQ ID NO: 36675 - RNA, 18 nt, Human
acccucuggggccacgug

SEQ ID NO: 36676 - RNA, 32 nt, Human
acccucuguccuggcuuugaaagagaaacugg

SEQ ID NO: 36677 - RNA, 18 nt, Human
acccucugugccccuccc

SEQ ID NO: 36678 - RNA, 32 nt, Human
acccucuguggacacccacacucugcagggac

SEQ ID NO: 36679 - RNA, 23 nt, Human
acccucuuccuacuggucucucu

SEQ ID NO: 36680 - RNA, 32 nt, Human
acccucuuccuucucuuugaccccugugacuc

SEQ ID NO: 36681 - RNA, 24 nt, Human
acccucuucgccugguacagcccu

SEQ ID NO: 36682 - RNA, 32 nt, Human
acccucuugucccuaccagcagcuucucuugc

SEQ ID NO: 36683 - RNA, 32 nt, Human
acccucuuuauaacuuccuccccaccggccuc

SEQ ID NO: 36684 - RNA, 32 nt, Human
acccucuuuccaggaccucaguaggcaccguu

SEQ ID NO: 36685 - RNA, 18 nt, Human
acccucuuuccccuucua

SEQ ID NO: 36686 - RNA, 20 nt, Human
acccucuuuggauggugcca

SEQ ID NO: 36687 - RNA, 32 nt, Human
acccugaaacacagcaaaccuucauccggcug

SEQ ID NO: 36688 - RNA, 32 nt, Human
acccugaaaccagcuuuauccauagcuucugc

SEQ ID NO: 36689 - RNA, 32 nt, Human
acccugaacaaaucuugggugggugaaggccu

SEQ ID NO: 36690 - RNA, 32 nt, Human
acccugaagaggagggggagggugagccgggc

SEQ ID NO: 36691 - RNA, 32 nt, Human
acccugaaggcugaggcaggagcauugcuuga

SEQ ID NO: 36692 - RNA, 32 nt, Human
acccugaauuaaauagucacaugguaacaauu

SEQ ID NO: 36693 - RNA, 32 nt, Human
acccugaauuccucacaccuaacccugauagu

SEQ ID NO: 36694 - RNA, 32 nt, Human
acccugacaaguguccaugaugcugggcccug

SEQ ID NO: 36695 - RNA, 32 nt, Human
acccugacacagccccagaccccacaaagccu

SEQ ID NO: 36696 - RNA, 21 nt, Human
acccugaccaacaguccagcc

SEQ ID NO: 36697 - RNA, 32 nt, Human
acccugaccaacaugaaaccccgucucuacua

SEQ ID NO: 36698 - RNA, 26 nt, Human
acccugaccacugaguaauacagccc

SEQ ID NO: 36699 - RNA, 21 nt, Human
acccugaccagaucaucagcc

SEQ ID NO: 36700 - RNA, 25 nt, Human
acccugaccccugacgcauagcccu

SEQ ID NO: 36701 - RNA, 32 nt, Human
acccugacccucuccagccucagaccugagac

SEQ ID NO: 36702 - RNA, 24 nt, Human
acccugacccugaggcauagcccu

SEQ ID NO: 36703 - RNA, 23 nt, Human
acccugaccguguacauagcccu

SEQ ID NO: 36704 - RNA, 22 nt, Human
acccugacguugugauacgccc

SEQ ID NO: 36705 - RNA, 32 nt, Human
acccugacucuuccagccuccauguccagacc

SEQ ID NO: 36706 - RNA, 32 nt, Human
acccugagaacacacacagacacacaacacac

SEQ ID NO: 36707 - RNA, 32 nt, Human
acccugagaacagugcucuguguaugauaagu

SEQ ID NO: 36708 - RNA, 26 nt, Human
acccugagaaguggcugguacaaccc

SEQ ID NO: 36709 - RNA, 17 nt, Human
acccugagaccaugagu

SEQ ID NO: 36710 - RNA, 32 nt, Human
acccugagagaaggguugagaagaaucaucuc

SEQ ID NO: 36711 - RNA, 32 nt, Human
acccugagagaauccagcagauuauuaaaaga

SEQ ID NO: 36712 - RNA, 32 nt, Human
acccugagaggcagauuuuugucuuacaucuc

SEQ ID NO: 36713 - RNA, 32 nt, Human
acccugagagggcgguggagguggugaggagg

SEQ ID NO: 36714 - RNA, 17 nt, Human
acccugagcagaaagag

SEQ ID NO: 36715 - RNA, 32 nt, Human
acccugagcagcccauguacauggaagaucuu

SEQ ID NO: 36716 - RNA, 32 nt, Human
acccugagcaguuccuggaggcugcggccacc

SEQ ID NO: 36717 - RNA, 32 nt, Human
acccugagccugacgagggugaggagugacgg

SEQ ID NO: 36718 - RNA, 32 nt, Human
acccugagcgccagacaccaugaaccuuccuu

SEQ ID NO: 36719 - RNA, 32 nt, Human
acccugaggaagaggaacucuacacuucucuc

SEQ ID NO: 36720 - RNA, 32 nt, Human
acccugaggcggagguuucagaguagaaggug

SEQ ID NO: 36721 - RNA, 32 nt, Human
acccugagggaugugaggccagacagcuccuu

SEQ ID NO: 36722 - RNA, 32 nt, Human
acccugagggccugccgggcugccuuugcccc

SEQ ID NO: 36723 - RNA, 32 nt, Human
acccugagggccugugccugggugagaugucu

SEQ ID NO: 36724 - RNA, 32 nt, Human
acccugaucucauggcugucucuccuuucauu

SEQ ID NO: 36725 - RNA, 23 nt, Human
acccugaugaagacaaagccagg

SEQ ID NO: 36726 - RNA, 32 nt, Human
acccugaugagaccuuaguguucuccaggcuc

SEQ ID NO: 36727 - RNA, 32 nt, Human
acccugaugccaccccuuaccagccggguaac

SEQ ID NO: 36728 - RNA, 32 nt, Human
acccugauuccguccagcaccugcggaguugg

SEQ ID NO: 36729 - RNA, 32 nt, Human
acccugauuccucuaucucccccagcccuagg

SEQ ID NO: 36730 - RNA, 32 nt, Human
acccugauucggugccuuucuguuuaccagcu

SEQ ID NO: 36731 - RNA, 32 nt, Human
acccugauugaaugugugaugugaacugacuu

SEQ ID NO: 36732 - RNA, 23 nt, Human
acccugauuuaggagaagccagg

SEQ ID NO: 36733 - RNA, 32 nt, Human
acccugauuucccucacuucuugcucauuccu

SEQ ID NO: 36734 - RNA, 24 nt, Human
acccugcaaaagagacagguccuc

SEQ ID NO: 36735 - RNA, 32 nt, Human
acccugcaaagccacagggguggagcugccaa

SEQ ID NO: 36736 - RNA, 32 nt, Human
acccugcaaagccacagguggggagcugccca

SEQ ID NO: 36737 - RNA, 21 nt, Human
acccugcaagagaggccuucu

SEQ ID NO: 36738 - RNA, 32 nt, Human
acccugcaagcuguuuccacaucagaacuccc

SEQ ID NO: 36739 - RNA, 32 nt, Human
acccugcaagggaggagccaggagcaagcauu

SEQ ID NO: 36740 - RNA, 32 nt, Human
acccugcacaaagccucagccuggugaaaaca

SEQ ID NO: 36741 - RNA, 32 nt, Human
acccugcacucacccacagcagcuccauccac

SEQ ID NO: 36742 - RNA, 32 nt, Human
acccugcacugaggccggccaggucucggggc

SEQ ID NO: 36743 - RNA, 32 nt, Human
acccugcagcgggccagcuauggugggaagcc

SEQ ID NO: 36744 - RNA, 32 nt, Human
acccugcagcuccagccuucuccauacuucaa

SEQ ID NO: 36745 - RNA, 32 nt, Human
acccugcagcuccucaaaccagccuguauuga

SEQ ID NO: 36746 - RNA, 32 nt, Human
acccugcaggccaacguggcccagcuggaggg

SEQ ID NO: 36747 - RNA, 32 nt, Human
acccugcaggccaggccagcuuccccucacuu

SEQ ID NO: 36748 - RNA, 20 nt, Human
acccugcagucuucauccuc

SEQ ID NO: 36749 - RNA, 21 nt, Human
acccugcagugaggggcccuc

SEQ ID NO: 36750 - RNA, 19 nt, Human
acccugcauaacccuccca

SEQ ID NO: 36751 - RNA, 32 nt, Human
acccugcaucgcuccagccgccgcggccaugu

SEQ ID NO: 36752 - RNA, 32 nt, Human
acccugcaugagcgccugcggggccuggaggc

SEQ ID NO: 36753 - RNA, 32 nt, Human
acccugcauguuuaacaccagggagcuuggaa

SEQ ID NO: 36754 - RNA, 32 nt, Human
acccugcauuguggucaggagcacugaaugcc

SEQ ID NO: 36755 - RNA, 32 nt, Human
acccugccaagcucugagcucugcucccaggg

SEQ ID NO: 36756 - RNA, 32 nt, Human
acccugccacuuguaauuuucagaaucacuga

SEQ ID NO: 36757 - RNA, 32 nt, Human
acccugccagccacgacguuuccucuuucccc

SEQ ID NO: 36758 - RNA, 32 nt, Human
acccugccagccgcccgcccgcccggcgcaga

SEQ ID NO: 36759 - RNA, 32 nt, Human
acccugccaggacugcagcccccauggugaug

SEQ ID NO: 36760 - RNA, 32 nt, Human
acccugccagugccagggugggcuggggacuc

SEQ ID NO: 36761 - RNA, 32 nt, Human
acccugcccacagcaggcccuccugcccagcu

SEQ ID NO: 36762 - RNA, 32 nt, Human
acccugcccaggauggggccagccucgugcuc

SEQ ID NO: 36763 - RNA, 32 nt, Human
acccugcccagucgcuguugggcugcugcgga

SEQ ID NO: 36764 - RNA, 32 nt, Human
acccugccccuccccagcaucccagcugggcc

SEQ ID NO: 36765 - RNA, 32 nt, Human
acccugccccucucugucauagcuaacaggaa

SEQ ID NO: 36766 - RNA, 32 nt, Human
acccugccccucucugucguagcuaacaggaa

SEQ ID NO: 36767 - RNA, 32 nt, Human
acccugccccuggagcagcagcuuugauacca

SEQ ID NO: 36768 - RNA, 32 nt, Human
acccugccccuuaccagccuuguggcagcggg

SEQ ID NO: 36769 - RNA, 32 nt, Human
acccugcccgcucucccagccugugcuccuuu

SEQ ID NO: 36770 - RNA, 32 nt, Human
acccugcccuggaagguggguuucccucgagc

SEQ ID NO: 36771 - RNA, 32 nt, Human
acccugcccugugggcccccaaauggaaaugg

SEQ ID NO: 36772 - RNA, 32 nt, Human
acccugccggguagcuggggcuacaggagcau

SEQ ID NO: 36773 - RNA, 32 nt, Human
acccugccuaccugcaggcagauggaccggag

SEQ ID NO: 36774 - RNA, 32 nt, Human
acccugccucccacaguuccuccccuaaucug

SEQ ID NO: 36775 - RNA, 32 nt, Human
acccugccuccccucuucacugaccccaucuc

SEQ ID NO: 36776 - RNA, 31 nt, Human
acccugccucugaagccagguguugagacca

SEQ ID NO: 36777 - RNA, 32 nt, Human
acccugccugcacuccuccaccaucacaaucu

SEQ ID NO: 36778 - RNA, 32 nt, Human
acccugccugccgucugugcuuccuccugccc

SEQ ID NO: 36779 - RNA, 32 nt, Human
acccugccuggcaacagagaccccaagaccua

SEQ ID NO: 36780 - RNA, 32 nt, Human
acccugccugggaaucaucucuaaugcuacua

SEQ ID NO: 36781 - RNA, 32 nt, Human
acccugccugggcacacugcuuggggaggucu

SEQ ID NO: 36782 - RNA, 32 nt, Human
acccugccuggugcuggagggcaguaugggag

SEQ ID NO: 36783 - RNA, 32 nt, Human
acccugccuugucgcagccagccugcucuuac

SEQ ID NO: 36784 - RNA, 32 nt, Human
acccugccuuuaugguacgaagagucuaauag

SEQ ID NO: 36785 - RNA, 20 nt, Human
acccugcgacuacgcugcgg

SEQ ID NO: 36786 - RNA, 32 nt, Human
acccugcgaggcaaggguuugcccaguuugca

SEQ ID NO: 36787 - RNA, 23 nt, Human
acccugcgccuccagagguccuc

SEQ ID NO: 36788 - RNA, 22 nt, Human
acccugcgcuccccgccccgcu

SEQ ID NO: 36789 - RNA, 32 nt, Human
acccugcggccaggccuggugccaugagcagg

SEQ ID NO: 36790 - RNA, 32 nt, Human
acccugcguuucucccucccaggcuaggaacc

SEQ ID NO: 36791 - RNA, 20 nt, Human
acccugcuauaaacuguggc

SEQ ID NO: 36792 - RNA, 32 nt, Human
acccugcuauuuucuccuugugugacuuugga

SEQ ID NO: 36793 - RNA, 32 nt, Human
acccugcucacugcuggcaucaccugagccua

SEQ ID NO: 36794 - RNA, 32 nt, Human
acccugcucccagggacuuggguggaugcgcu

SEQ ID NO: 36795 - RNA, 31 nt, Human
acccugcucucuggccuccuggcugugucac

SEQ ID NO: 36796 - RNA, 32 nt, Human
acccugcucucuggccuccuggcugugucaca

SEQ ID NO: 36797 - RNA, 18 nt, Human
acccugcucugccugcca

SEQ ID NO: 36798 - RNA, 32 nt, Human
acccugcucugccugccagcggccugcccugc

SEQ ID NO: 36799 - RNA, 32 nt, Human
acccugcucugggaucccuugugaggcugccc

SEQ ID NO: 36800 - RNA, 32 nt, Human
acccugcuggucagaggugcaagcagaugaga

SEQ ID NO: 36801 - RNA, 32 nt, Human
acccugcuguggggcccugccuuuguggggag

SEQ ID NO: 36802 - RNA, 32 nt, Human
acccugcuguuccucucccugccuguucugca

SEQ ID NO: 36803 - RNA, 32 nt, Human
acccugcuucacccucacccccuccuggcaau

SEQ ID NO: 36804 - RNA, 32 nt, Human
acccugcuucccuagagagaacugaucucaug

SEQ ID NO: 36805 - RNA, 22 nt, Human
acccugcuuccucgaccccccu

SEQ ID NO: 36806 - RNA, 32 nt, Human
acccugcuugcagcucagguuucggggugcuu

SEQ ID NO: 36807 - RNA, 32 nt, Human
acccugcuugcucaccaggccuagagaauggc

SEQ ID NO: 36808 - RNA, 32 nt, Human
acccugcuuucguacaaggaagggggacgaug

SEQ ID NO: 36809 - RNA, 32 nt, Human
acccuggaaagccacaaguguggugcugccca

SEQ ID NO: 36810 - RNA, 32 nt, Human
acccuggaaagccagggugugagugggguggu

SEQ ID NO: 36811 - RNA, 32 nt, Human
acccuggaaauucuuuccuuccugauuugccc

SEQ ID NO: 36812 - RNA, 32 nt, Human
acccuggaacagccacaaugucugccccuuag

SEQ ID NO: 36813 - RNA, 32 nt, Human
acccuggaaccugagucccaagaaaugguaga

SEQ ID NO: 36814 - RNA, 32 nt, Human
acccuggaacuggcccacccacugugucuucc

SEQ ID NO: 36815 - RNA, 32 nt, Human
acccuggaagagcaaaugccuccuguugucuu

SEQ ID NO: 36816 - RNA, 32 nt, Human
acccuggaagcaggaaggauugccagauaguu

SEQ ID NO: 36817 - RNA, 32 nt, Human
acccuggaaggaagcaggauggcagccggaac

SEQ ID NO: 36818 - RNA, 32 nt, Human
acccuggaaguggagguugcagugagccuguc

SEQ ID NO: 36819 - RNA, 32 nt, Human
acccuggaaucagcauggaugagaccagagga

SEQ ID NO: 36820 - RNA, 32 nt, Human
acccuggaccagagguaggagcccaagguccg

SEQ ID NO: 36821 - RNA, 32 nt, Human
acccuggaccaguggucucacauggugcuacg

SEQ ID NO: 36822 - RNA, 32 nt, Human
acccuggaccucuucugccacgcgcucauuuu

SEQ ID NO: 36823 - RNA, 32 nt, Human
acccuggacuccugugugccuccugccauccc

SEQ ID NO: 36824 - RNA, 32 nt, Human
acccuggagaaggaggccaggagccagccacu

SEQ ID NO: 36825 - RNA, 32 nt, Human
acccuggagagggcgcagccgaugcgggcggc

SEQ ID NO: 36826 - RNA, 32 nt, Human
acccuggagcagcucagggcucagggggccac

SEQ ID NO: 36827 - RNA, 32 nt, Human
acccuggagccaagggucuuucacaucaccua

SEQ ID NO: 36828 - RNA, 32 nt, Human
acccuggaggagaagaggaaagagaaagccaa

SEQ ID NO: 36829 - RNA, 32 nt, Human
acccuggaggcaccugguggccaugcuccucu

SEQ ID NO: 36830 - RNA, 32 nt, Human
acccuggaggcagaggugguagugagccgaga

SEQ ID NO: 36831 - RNA, 32 nt, Human
acccuggaggcagagguugcaaugagccgaga

SEQ ID NO: 36832 - RNA, 32 nt, Human
acccuggaggcagagguugcagugagccaaga

SEQ ID NO: 36833 - RNA, 25 nt, Human
acccuggaggcagagguuguaguga

SEQ ID NO: 36834 - RNA, 32 nt, Human
acccuggaggcagagguuguagugagucguga

SEQ ID NO: 36835 - RNA, 32 nt, Human
acccuggaggcagagguuguggugagcugaga

SEQ ID NO: 36836 - RNA, 32 nt, Human
acccuggaggcagagguuguggugagucgaga

SEQ ID NO: 36837 - RNA, 32 nt, Human
acccuggaggcggaaguugcagugagccgaga

SEQ ID NO: 36838 - RNA, 32 nt, Human
acccuggaggcggagguuccagugagcugaga

SEQ ID NO: 36839 - RNA, 32 nt, Human
acccuggaggcggagguugcagugagccgaga

SEQ ID NO: 36840 - RNA, 32 nt, Human
acccuggaggcggagguugcagugaguggaga

SEQ ID NO: 36841 - RNA, 32 nt, Human
acccuggaggcggagguugccgugagccaaga

SEQ ID NO: 36842 - RNA, 32 nt, Human
acccuggagggcccugagcccaccgcaccagg

SEQ ID NO: 36843 - RNA, 32 nt, Human
acccuggaggggaagguggcuucccccaagca

SEQ ID NO: 36844 - RNA, 32 nt, Human
acccuggaggggacccgggaacaguaguagaa

SEQ ID NO: 36845 - RNA, 32 nt, Human
acccuggagguagaaguugcagugagccaaga

SEQ ID NO: 36846 - RNA, 32 nt, Human
acccuggagguagaggcugcagugagccaaga

SEQ ID NO: 36847 - RNA, 32 nt, Human
acccuggagguggagguugcagugagccgaga

SEQ ID NO: 36848 - RNA, 32 nt, Human
acccuggagguggagguugcagugagcugaga

SEQ ID NO: 36849 - RNA, 32 nt, Human
acccuggagguggcgguugcagugagcacaga

SEQ ID NO: 36850 - RNA, 32 nt, Human
acccuggagguugagguugcagugagcugaga

SEQ ID NO: 36851 - RNA, 32 nt, Human
acccuggaugccucauggagaauuaagagaga

SEQ ID NO: 36852 - RNA, 32 nt, Human
acccuggaugcuguugaagggccaagagaucu

SEQ ID NO: 36853 - RNA, 32 nt, Human
acccuggcaaagcagcaacacacaugcuccgu

SEQ ID NO: 36854 - RNA, 32 nt, Human
acccuggcaaagcagcucacacacugcagcca

SEQ ID NO: 36855 - RNA, 32 nt, Human
acccuggcaagaaccucuguguccagauguuu

SEQ ID NO: 36856 - RNA, 32 nt, Human
acccuggcagcaucccaccuccugaguccucu

SEQ ID NO: 36857 - RNA, 22 nt, Human
acccuggcagucccaggcagca

SEQ ID NO: 36858 - RNA, 21 nt, Human
acccuggcauguccuuccaga

SEQ ID NO: 36859 - RNA, 32 nt, Human
acccuggccaugacaggcaagucggugaagga

SEQ ID NO: 36860 - RNA, 20 nt, Human
acccuggcccacuccacagg

SEQ ID NO: 36861 - RNA, 32 nt, Human
acccuggccucugcacuccccugcugggugug

SEQ ID NO: 36862 - RNA, 21 nt, Human
acccuggccuggucccugguc

SEQ ID NO: 36863 - RNA, 32 nt, Human
acccuggcgauaucacuuuaacuuucugaacc

SEQ ID NO: 36864 - RNA, 32 nt, Human
acccuggcgggcccucuccccaccucaccucu

SEQ ID NO: 36865 - RNA, 32 nt, Human
acccuggcggggaagcaguaguguucccauug

SEQ ID NO: 36866 - RNA, 22 nt, Human
acccuggcucacagacaugguc

SEQ ID NO: 36867 - RNA, 32 nt, Human
acccuggcucaggcuucugggcucugagaaau

SEQ ID NO: 36868 - RNA, 24 nt, Human
acccuggcucaugcugccauaguc

SEQ ID NO: 36869 - RNA, 32 nt, Human
acccuggcuccauccagucucuugccuuccuc

SEQ ID NO: 36870 - RNA, 32 nt, Human
acccuggcuccucuuuccccagcuucugucug

SEQ ID NO: 36871 - RNA, 32 nt, Human
acccuggcuccuggcccgagccugggcucccu

SEQ ID NO: 36872 - RNA, 21 nt, Human
acccuggcuccuucacaggga

SEQ ID NO: 36873 - RNA, 25 nt, Human
acccuggcugcccagcagcagcccu

SEQ ID NO: 36874 - RNA, 32 nt, Human
acccuggcuggaggggauaggagggcuuuuaa

SEQ ID NO: 36875 - RNA, 32 nt, Human
acccuggcuuccaucaugagugcagugucauc

SEQ ID NO: 36876 - RNA, 32 nt, Human
acccuggcuucucuuuggcacaucagccccua

SEQ ID NO: 36877 - RNA, 32 nt, Human
acccugggaaaccagcuggggcugcacagggc

SEQ ID NO: 36878 - RNA, 32 nt, Human
acccugggacaggcacaggcugggcagaggca

SEQ ID NO: 36879 - RNA, 20 nt, Human
acccugggacugugguucca

SEQ ID NO: 36880 - RNA, 32 nt, Human
acccugggagcggagauugcagugagcugaga

SEQ ID NO: 36881 - RNA, 32 nt, Human
acccugggaggaggcagguggggagggaaccc

SEQ ID NO: 36882 - RNA, 32 nt, Human
acccugggaggcacauccaggcuugggaaacg

SEQ ID NO: 36883 - RNA, 32 nt, Human
acccugggaggcagagguugcagugagucgag

SEQ ID NO: 36884 - RNA, 26 nt, Human
acccugggaggcggagguuguaguga

SEQ ID NO: 36885 - RNA, 32 nt, Human
acccugggagguggagguggcagugagccgag

SEQ ID NO: 36886 - RNA, 32 nt, Human
acccugggccacugcaccccaccaggacggca

SEQ ID NO: 36887 - RNA, 32 nt, Human
acccugggcccccagccucuggccucccucca

SEQ ID NO: 36888 - RNA, 32 nt, Human
acccugggcucccacagccagcauugggggaa

SEQ ID NO: 36889 - RNA, 32 nt, Human
acccuggggagggaagggacagaggaagcuau

SEQ ID NO: 36890 - RNA, 32 nt, Human
acccuggggaggugaaagucagagagcgaagc

SEQ ID NO: 36891 - RNA, 19 nt, Human
acccuggggccacccauca

SEQ ID NO: 36892 - RNA, 32 nt, Human
acccuggggcccuggccuucugccugaaggcc

SEQ ID NO: 36893 - RNA, 32 nt, Human
acccuggggccucccaccccagccucccugag

SEQ ID NO: 36894 - RNA, 32 nt, Human
acccuggguaaaggguguaggaaagguuuugu

SEQ ID NO: 36895 - RNA, 32 nt, Human
acccuggguccccaggagguggugucaagaga

SEQ ID NO: 36896 - RNA, 32 nt, Human
acccugggugaggggcuggugggcaggaaggu

SEQ ID NO: 36897 - RNA, 31 nt, Human
acccugggugcgaggaacugggugaagggaa

SEQ ID NO: 36898 - RNA, 20 nt, Human
acccugguccgccucccugg

SEQ ID NO: 36899 - RNA, 32 nt, Human
acccugguccuuggauccccuucgucccaccu

SEQ ID NO: 36900 - RNA, 32 nt, Human
acccuggucuugcugcucauaucugccaggaa

SEQ ID NO: 36901 - RNA, 23 nt, Human
acccuggugaaccccgggugcua

SEQ ID NO: 36902 - RNA, 32 nt, Human
acccuggugaccaaaguggcuccggucagcgc

SEQ ID NO: 36903 - RNA, 32 nt, Human
acccuggugccuggcagguucucccucugccc

SEQ ID NO: 36904 - RNA, 32 nt, Human
acccuggugcugugcagccucuggcagagcau

SEQ ID NO: 36905 - RNA, 32 nt, Human
acccuggugucaucaucucccaggauccauga

SEQ ID NO: 36906 - RNA, 32 nt, Human
acccugguuaggugagccucuaggaaaacuua

SEQ ID NO: 36907 - RNA, 32 nt, Human
acccugguuucaaugaaccuaaccucauuauu

SEQ ID NO: 36908 - RNA, 32 nt, Human
acccugguuucaaugaaccuaaccucauucuu

SEQ ID NO: 36909 - RNA, 32 nt, Human
acccugguuucgcugagaacaaacucugagau

SEQ ID NO: 36910 - RNA, 32 nt, Human
acccugguuucugagcuccagaaacucuguau

SEQ ID NO: 36911 - RNA, 32 nt, Human
acccugguuuggagcugggaggaagaaggggg

SEQ ID NO: 36912 - RNA, 32 nt, Human
acccugucacauagagaugaaaagccggcuuu

SEQ ID NO: 36913 - RNA, 32 nt, Human
acccugucaccacugaaccuugauuuaacaga

SEQ ID NO: 36914 - RNA, 32 nt, Human
acccugucacccaggcuggaaugcaauggcac

SEQ ID NO: 36915 - RNA, 32 nt, Human
acccugucacucaggcuggagcacaguggugu

SEQ ID NO: 36916 - RNA, 22 nt, Human
acccugucagacguugguccca

SEQ ID NO: 36917 - RNA, 32 nt, Human
acccuguccuccaccugccuuccauuuugaag

SEQ ID NO: 36918 - RNA, 32 nt, Human
acccuguccuccucacugggggcaggguggag

SEQ ID NO: 36919 - RNA, 32 nt, Human
acccuguccugcuucucacacugacaucugcu

SEQ ID NO: 36920 - RNA, 32 nt, Human
acccuguccuugggauagcuuucuugagcaua

SEQ ID NO: 36921 - RNA, 32 nt, Human
acccugucgcccaggcuggagugcaaugccgu

SEQ ID NO: 36922 - RNA, 32 nt, Human
acccugucgcccagggggcgugcuguccagca

SEQ ID NO: 36923 - RNA, 29 nt, Human
acccugucucugugugguuggguugggag

SEQ ID NO: 36924 - RNA, 32 nt, Human
acccugucuugaagacccugaccucaagugau

SEQ ID NO: 36925 - RNA, 32 nt, Human
acccugucuuucucucuggccugcugcucucu

SEQ ID NO: 36926 - RNA, 31 nt, Human
acccugugacugucucccacgagaagaacua

SEQ ID NO: 36927 - RNA, 32 nt, Human
acccugugagccaccgagacugaaccaaaccc

SEQ ID NO: 36928 - RNA, 32 nt, Human
acccugugauggggcccugccuccuuugugag

SEQ ID NO: 36929 - RNA, 32 nt, Human
acccugugcucuaaacaguuaggguuuguucc

SEQ ID NO: 36930 - RNA, 32 nt, Human
acccuguggcccaagcaggccugcugaacuca

SEQ ID NO: 36931 - RNA, 32 nt, Human
acccugugggcuguaagcaagcucaggcuagu

SEQ ID NO: 36932 - RNA, 32 nt, Human
acccugugggggcggcugugggggaggucccu

SEQ ID NO: 36933 - RNA, 19 nt, Human
acccuguguaccuccucca

SEQ ID NO: 36934 - RNA, 32 nt, Human
acccugugucauagccucauccaucagccagg

SEQ ID NO: 36935 - RNA, 32 nt, Human
acccuguguguaucuucaucuggcuguuuacu

SEQ ID NO: 36936 - RNA, 32 nt, Human
acccuguucaaccucucaggaacagggauucu

SEQ ID NO: 36937 - RNA, 32 nt, Human
acccuguuccgcccgcccagcaugcagaacaa

SEQ ID NO: 36938 - RNA, 32 nt, Human
acccuguucuuagaaaauguguuuaguuaugg

SEQ ID NO: 36939 - RNA, 32 nt, Human
acccuguugccaggcuggaaugcaguggcgcg

SEQ ID NO: 36940 - RNA, 32 nt, Human
acccuguugcccaggcuacagugcaauggcau

SEQ ID NO: 36941 - RNA, 32 nt, Human
acccuguugcccaggcuggaauacaguggcac

SEQ ID NO: 36942 - RNA, 32 nt, Human
acccuguugcccaggcuggagugcaauggcgc

SEQ ID NO: 36943 - RNA, 32 nt, Human
acccuguugcccaggcuggagugcaauggugc

SEQ ID NO: 36944 - RNA, 32 nt, Human
acccuguuggccaggcuggagugcaguaagug

SEQ ID NO: 36945 - RNA, 24 nt, Human
acccuguugggugagcacagcccu

SEQ ID NO: 36946 - RNA, 32 nt, Human
acccuguugucaccccagcugaauuucuuaug

SEQ ID NO: 36947 - RNA, 32 nt, Human
acccuguuuaugcgguaccggaguagcagugu

SEQ ID NO: 36948 - RNA, 32 nt, Human
acccuuaaacaucaguagacugggagcuguac

SEQ ID NO: 36949 - RNA, 20 nt, Human
acccuuaacccugacccgga

SEQ ID NO: 36950 - RNA, 32 nt, Human
acccuuaaguuccuaguucacaguuauuccca

SEQ ID NO: 36951 - RNA, 32 nt, Human
acccuuacaagaaaacuggucugcaaagagaa

SEQ ID NO: 36952 - RNA, 32 nt, Human
acccuuacccuuuccuccuuuaucacaaccac

SEQ ID NO: 36953 - RNA, 32 nt, Human
acccuuagaaguauugccuacuuauccgggcu

SEQ ID NO: 36954 - RNA, 32 nt, Human
acccuuaggacagggucccugcuguguucccc

SEQ ID NO: 36955 - RNA, 32 nt, Human
acccuuaggaguucgauggagagaccaugagg

SEQ ID NO: 36956 - RNA, 32 nt, Human
acccuuaggcugggaccucccucccuccucug

SEQ ID NO: 36957 - RNA, 32 nt, Human
acccuuauguuagccacaucuggaugagaaca

SEQ ID NO: 36958 - RNA, 19 nt, Human
acccuuauuuccaaaggaa

SEQ ID NO: 36959 - RNA, 19 nt, Human
acccuucaaugccugcucc

SEQ ID NO: 36960 - RNA, 19 nt, Human
acccuucaaugcuguggcc

SEQ ID NO: 36961 - RNA, 32 nt, Human
acccuucaaugugcccgugugccuaaauauuc

SEQ ID NO: 36962 - RNA, 18 nt, Human
acccuucaauuguuacca

SEQ ID NO: 36963 - RNA, 32 nt, Human
acccuucaauuuccucuucuuuuuccucugac

SEQ ID NO: 36964 - RNA, 32 nt, Human
acccuucacauggaagauuaaugagggaaauc

SEQ ID NO: 36965 - RNA, 32 nt, Human
acccuucaccucccaccucuuccucaccuugg

SEQ ID NO: 36966 - RNA, 32 nt, Human
acccuucaccuccccuaaccccaaacauagau

SEQ ID NO: 36967 - RNA, 32 nt, Human
acccuucacucaccaucuuuucccacaaucaa

SEQ ID NO: 36968 - RNA, 32 nt, Human
acccuucagccaauaaauaccaucuguuggug

SEQ ID NO: 36969 - RNA, 32 nt, Human
acccuucagccggagaccagaguccagucccg

SEQ ID NO: 36970 - RNA, 18 nt, Human
acccuucagggugcccca

SEQ ID NO: 36971 - RNA, 18 nt, Human
acccuucaggucugccca

SEQ ID NO: 36972 - RNA, 19 nt, Human
acccuucagguggcauccc

SEQ ID NO: 36973 - RNA, 32 nt, Human
acccuucaggugguucccuugugcaccguuca

SEQ ID NO: 36974 - RNA, 19 nt, Human
acccuucagugaggcccca

SEQ ID NO: 36975 - RNA, 32 nt, Human
acccuucagugcaguguaccagggaagagacc

SEQ ID NO: 36976 - RNA, 32 nt, Human
acccuucauacacacacgcacacacgcacaca

SEQ ID NO: 36977 - RNA, 31 nt, Human
acccuucauacuucuuugaucuuuggaagaa

SEQ ID NO: 36978 - RNA, 32 nt, Human
acccuucauacuucuuugaucuuuggaagaag

SEQ ID NO: 36979 - RNA, 32 nt, Human
acccuucauagcuuagcccaggaaaaauaaaa

SEQ ID NO: 36980 - RNA, 32 nt, Human
acccuucaucauccucauucagagguauggau

SEQ ID NO: 36981 - RNA, 32 nt, Human
acccuucaugaaaccaccucugcaguccugga

SEQ ID NO: 36982 - RNA, 32 nt, Human
acccuucaugggcugcagaggccccacugcag

SEQ ID NO: 36983 - RNA, 32 nt, Human
acccuuccaagcuuuccugcucaguguucuac

SEQ ID NO: 36984 - RNA, 32 nt, Human
acccuuccacacaauagccucuguagguuagg

SEQ ID NO: 36985 - RNA, 18 nt, Human
acccuuccacauccuccu

SEQ ID NO: 36986 - RNA, 19 nt, Human
acccuuccaccucaagaug

SEQ ID NO: 36987 - RNA, 32 nt, Human
acccuuccagauccccggccccggcugugacu

SEQ ID NO: 36988 - RNA, 32 nt, Human
acccuuccaucagugucuuccagccugcaugg

SEQ ID NO: 36989 - RNA, 21 nt, Human
acccuuccccaccggacugug

SEQ ID NO: 36990 - RNA, 18 nt, Human
acccuuccccgcuguggc

SEQ ID NO: 36991 - RNA, 32 nt, Human
acccuuccccuccucaaggaucacccauccuc

SEQ ID NO: 36992 - RNA, 32 nt, Human
acccuucccugccuccagcugucagccugguu

SEQ ID NO: 36993 - RNA, 32 nt, Human
acccuucccuuccccucucccuucugccuuuc

SEQ ID NO: 36994 - RNA, 32 nt, Human
acccuucccuuuccucugcuucucuccucauc

SEQ ID NO: 36995 - RNA, 32 nt, Human
acccuuccuagagcggaggaaccgggucgugc

SEQ ID NO: 36996 - RNA, 32 nt, Human
acccuuccuauuggucuguccugggccaacug

SEQ ID NO: 36997 - RNA, 32 nt, Human
acccuuccucaucugugccugucuguccaacc

SEQ ID NO: 36998 - RNA, 32 nt, Human
acccuuccuccaccucagcucagagcacagug

SEQ ID NO: 36999 - RNA, 32 nt, Human
acccuuccuccaccucaguucagagcacagug

SEQ ID NO: 37000 - RNA, 32 nt, Human
acccuuccugcauuucucuucucagcucuucc

SEQ ID NO: 37001 - RNA, 32 nt, Human
acccuuccuucuggauucaccaauuguuaaca

SEQ ID NO: 37002 - RNA, 32 nt, Human
acccuuccuuguaucugucuucccaggagaga

SEQ ID NO: 37003 - RNA, 19 nt, Human
acccuuccuuuggcuccca

SEQ ID NO: 37004 - RNA, 32 nt, Human
acccuucgucucuucaucugucaccaaagaca

SEQ ID NO: 37005 - RNA, 32 nt, Human
acccuucuacugugcugaccauuaggauacau

SEQ ID NO: 37006 - RNA, 32 nt, Human
acccuucuccaugcucauccccaaacuggggc

SEQ ID NO: 37007 - RNA, 32 nt, Human
acccuucuccuggggcauuuguuuuguuuuca

SEQ ID NO: 37008 - RNA, 20 nt, Human
acccuucucgaccccuucca

SEQ ID NO: 37009 - RNA, 20 nt, Human
acccuucugaccuggucuca

SEQ ID NO: 37010 - RNA, 32 nt, Human
acccuucugagaucacccucccugcuucccca

SEQ ID NO: 37011 - RNA, 32 nt, Human
acccuucugcucccggccgccgcuuuccgccg

SEQ ID NO: 37012 - RNA, 32 nt, Human
acccuucuguaggaugcauuucaggcucagag

SEQ ID NO: 37013 - RNA, 32 nt, Human
acccuucuuggccucugcucagcuacucuggu

SEQ ID NO: 37014 - RNA, 32 nt, Human
acccuucuugguagaagcuaaggugugagcug

SEQ ID NO: 37015 - RNA, 32 nt, Human
acccuucuuguccuccucucuggccccaucca

SEQ ID NO: 37016 - RNA, 32 nt, Human
acccuucuugucuuuacuuccuccuuacccaa

SEQ ID NO: 37017 - RNA, 18 nt, Human
acccuucuuugggucuca

SEQ ID NO: 37018 - RNA, 32 nt, Human
acccuugaacaacacagguuagagcugcauau

SEQ ID NO: 37019 - RNA, 32 nt, Human
acccuugaagauuuggccugggccagugagac

SEQ ID NO: 37020 - RNA, 32 nt, Human
acccuugagagaagaggcagcagcagcggcgg

SEQ ID NO: 37021 - RNA, 32 nt, Human
acccuugaggugggcauggagugagcagaaga

SEQ ID NO: 37022 - RNA, 32 nt, Human
acccuugcacugacacucuuagcacagagucu

SEQ ID NO: 37023 - RNA, 32 nt, Human
acccuugcagugagugugaguuccuuccaggu

SEQ ID NO: 37024 - RNA, 20 nt, Human
acccuugccauccugcaaca

SEQ ID NO: 37025 - RNA, 21 nt, Human
acccuugccccaguccugccc

SEQ ID NO: 37026 - RNA, 32 nt, Human
acccuugccccugcuuguccuggaccacuuuu

SEQ ID NO: 37027 - RNA, 32 nt, Human
acccuugccugccuccuaggcuggaagccaug

SEQ ID NO: 37028 - RNA, 32 nt, Human
acccuugcgugcuguggagacccuacucucuu

SEQ ID NO: 37029 - RNA, 32 nt, Human
acccuugcugaaccuugugcuccagggguccu

SEQ ID NO: 37030 - RNA, 32 nt, Human
acccuugcugcaggcuagggagcugcaguccc

SEQ ID NO: 37031 - RNA, 32 nt, Human
acccuugcuggcugaucaccuugagcaacuua

SEQ ID NO: 37032 - RNA, 32 nt, Human
acccuugcugucuaagccuuguggcuggaggg

SEQ ID NO: 37033 - RNA, 32 nt, Human
acccuugcuugccuuuuucagagaaaaagaaa

SEQ ID NO: 37034 - RNA, 32 nt, Human
acccuuggaagggugucagggucugggcucgc

SEQ ID NO: 37035 - RNA, 32 nt, Human
acccuuggacaacauuuaucauaauuugucau

SEQ ID NO: 37036 - RNA, 32 nt, Human
acccuuggcagcaaucaaagugccaguggcuc

SEQ ID NO: 37037 - RNA, 32 nt, Human
acccuuggcagcccugugccucucgaauguua

SEQ ID NO: 37038 - RNA, 32 nt, Human
acccuuggcugaaaauucccuccuuagucuac

SEQ ID NO: 37039 - RNA, 32 nt, Human
acccuuggcuugggcccaugcccagcgcaggc

SEQ ID NO: 37040 - RNA, 32 nt, Human
acccuugggacaauccuucaugugagcaaagu

SEQ ID NO: 37041 - RNA, 32 nt, Human
acccuugggaucuggggcuuccuggccuggcc

SEQ ID NO: 37042 - RNA, 32 nt, Human
acccuugggccugggccucugccccucccaac

SEQ ID NO: 37043 - RNA, 23 nt, Human
acccuuggggagcugaucuaucu

SEQ ID NO: 37044 - RNA, 32 nt, Human
acccuuggucuuggcacccuucugccuuauac

SEQ ID NO: 37045 - RNA, 32 nt, Human
acccuugguucccacaugcacagaugcuacgg

SEQ ID NO: 37046 - RNA, 32 nt, Human
acccuuguaagccccuuccuuccucccuugcc

SEQ ID NO: 37047 - RNA, 32 nt, Human
acccuuguacggcuguuuggguccccgaucac

SEQ ID NO: 37048 - RNA, 32 nt, Human
acccuuguagcucuggguaagaugaccugagu

SEQ ID NO: 37049 - RNA, 32 nt, Human
acccuuguaucauguuuuccucccaucuucua

SEQ ID NO: 37050 - RNA, 32 nt, Human
acccuugucauccauuagagcgguaaucaaga

SEQ ID NO: 37051 - RNA, 32 nt, Human
acccuuguccuagaaccuacccccucucaagg

SEQ ID NO: 37052 - RNA, 32 nt, Human
acccuugucuacucugccccuggauggugcgg

SEQ ID NO: 37053 - RNA, 32 nt, Human
acccuugugugggaacaggugcuccccaaaca

SEQ ID NO: 37054 - RNA, 32 nt, Human
acccuuguugcccaggcuggagugcaauggcg

SEQ ID NO: 37055 - RNA, 32 nt, Human
acccuuguugcccaggcuguaguacaauggca

SEQ ID NO: 37056 - RNA, 32 nt, Human
acccuuguuggggaguggguggcagguggggg

SEQ ID NO: 37057 - RNA, 32 nt, Human
acccuuuacugcacuuucugaccaggagcuac

SEQ ID NO: 37058 - RNA, 32 nt, Human
acccuuucaaguagcugggauuacagguaccu

SEQ ID NO: 37059 - RNA, 32 nt, Human
acccuuuccuggggcucuucuggugcugggag

SEQ ID NO: 37060 - RNA, 32 nt, Human
acccuuuccuucaucaucacucccugcauucu

SEQ ID NO: 37061 - RNA, 21 nt, Human
acccuuucgucaccucuucca

SEQ ID NO: 37062 - RNA, 32 nt, Human
acccuuucuccaccacagccaaggccuggaga

SEQ ID NO: 37063 - RNA, 32 nt, Human
acccuuucuccuccuccuuccucugaguugac

SEQ ID NO: 37064 - RNA, 32 nt, Human
acccuuucugcaucccugucccuggcauccac

SEQ ID NO: 37065 - RNA, 32 nt, Human
acccuuugaagagcaggaaggccagggcacag

SEQ ID NO: 37066 - RNA, 32 nt, Human
acccuuugaggguuugaguuacucuaaauagg

SEQ ID NO: 37067 - RNA, 32 nt, Human
acccuuugccucucccccuuuaauuugccuuu

SEQ ID NO: 37068 - RNA, 32 nt, Human
acccuuugcuaccuaugugcccgguuuuacuc

SEQ ID NO: 37069 - RNA, 32 nt, Human
acccuuugggaggccgggacagguggaucacc

SEQ ID NO: 37070 - RNA, 32 nt, Human
acccuuugucagccugacagugccucaucuga

SEQ ID NO: 37071 - RNA, 32 nt, Human
acccuuugugacugcugaccccugagccaccc

SEQ ID NO: 37072 - RNA, 32 nt, Human
acccuuugugguuacaguuugagacuuccaaa

SEQ ID NO: 37073 - RNA, 18 nt, Human
acccuuuguuuuggccca

SEQ ID NO: 37074 - RNA, 32 nt, Human
acccuuuucacucugggcuucucccaaaaccc

SEQ ID NO: 37075 - RNA, 32 nt, Human
acccuuuuccccucacccucugcccuucuaag

SEQ ID NO: 37076 - RNA, 32 nt, Human
acccuuuuccucaccugcucaaccauuauuca

SEQ ID NO: 37077 - RNA, 32 nt, Human
acccuuuuccuccaaaacaaaaauuagaggau

SEQ ID NO: 37078 - RNA, 32 nt, Human
acccuuuucuccccauaucuguuuggacauga

SEQ ID NO: 37079 - RNA, 32 nt, Human
acccuuuugggaucagcacugaaagugacgcc

SEQ ID NO: 37080 - RNA, 32 nt, Human
acccuuuugugguuuugaacaccaacauacug

SEQ ID NO: 37081 - RNA, 32 nt, Human
acccuuuuguguugcccuucuuuccaucaagg

SEQ ID NO: 37082 - RNA, 32 nt, Human
acccuuuuucuuucuuuucgccccgcugcugu

SEQ ID NO: 37083 - RNA, 31 nt, Human
accgaaagucuccugcuuucacugcgguccc

SEQ ID NO: 37084 - RNA, 24 nt, Human
accgaaagugggcggcggccgcgg

SEQ ID NO: 37085 - RNA, 32 nt, Human
accgaaaucuggcaaauacauaccuuuggaga

SEQ ID NO: 37086 - RNA, 32 nt, Human
accgaacaucuucucgugggcuuacuggccau

SEQ ID NO: 37087 - RNA, 32 nt, Human
accgaagaacugcucucugacagaacagagac

SEQ ID NO: 37088 - RNA, 32 nt, Human
accgaagagccaguaaccaguagcuccaacuu

SEQ ID NO: 37089 - RNA, 32 nt, Human
accgaagcagagggugcuguuucaacgccacc

SEQ ID NO: 37090 - RNA, 21 nt, Human
accgaagccacagggcagcau

SEQ ID NO: 37091 - RNA, 32 nt, Human
accgaagccagcugcccggccaggcgaccugc

SEQ ID NO: 37092 - RNA, 32 nt, Human
accgaagcccaggcacauguauuuugcaaaac

SEQ ID NO: 37093 - RNA, 32 nt, Human
accgaagccgccuguggacagccugagucacc

SEQ ID NO: 37094 - RNA, 32 nt, Human
accgaagcucacucccuuccucuccaucucuc

SEQ ID NO: 37095 - RNA, 32 nt, Human
accgaaggcccccagaguguuucugugugaaa

SEQ ID NO: 37096 - RNA, 21 nt, Human
accgaaggccggcggccgcgg

SEQ ID NO: 37097 - RNA, 32 nt, Human
accgaaggggagaaaguuaaagaaaucgccca

SEQ ID NO: 37098 - RNA, 32 nt, Human
accgaaguagccgcgcucccagcugcuugcag

SEQ ID NO: 37099 - RNA, 32 nt, Human
accgaagucaggcccugaagccgguccugcuc

SEQ ID NO: 37100 - RNA, 32 nt, Human
accgaaguggauggaaggggacugggguuucu

SEQ ID NO: 37101 - RNA, 32 nt, Human
accgaaguucugucuacugaugcagcacaaga

SEQ ID NO: 37102 - RNA, 32 nt, Human
accgaauauggccugacauuugcaaagaaaug

SEQ ID NO: 37103 - RNA, 32 nt, Human
accgacaagauggagcauugaugggggagauc

SEQ ID NO: 37104 - RNA, 32 nt, Human
accgacagccaucaccuccuucuuggaacagc

SEQ ID NO: 37105 - RNA, 32 nt, Human
accgacagugaugagcaucuugaagucuuauu

SEQ ID NO: 37106 - RNA, 32 nt, Human
accgaccagugguaagcacccaggaagcaacu

SEQ ID NO: 37107 - RNA, 32 nt, Human
accgaccccagccuggccgccuggcaugggga

SEQ ID NO: 37108 - RNA, 32 nt, Human
accgaccccugucugcccuucucccuccugcu

SEQ ID NO: 37109 - RNA, 32 nt, Human
accgaccuguguuagacgaaccuguguugccu

SEQ ID NO: 37110 - RNA, 32 nt, Human
accgacgagagaucauuggaagcugccuucua

SEQ ID NO: 37111 - RNA, 32 nt, Human
accgacggccgcuggagugcacuggcaugauc

SEQ ID NO: 37112 - RNA, 32 nt, Human
accgacgggagcgggagccggagcagcugcgg

SEQ ID NO: 37113 - RNA, 32 nt, Human
accgacguguuucuccccgaccguggcuuugc

SEQ ID NO: 37114 - RNA, 32 nt, Human
accgacuaccccagucccagggaagguggggc

SEQ ID NO: 37115 - RNA, 32 nt, Human
accgacugcggguguucaccacaggccaggcc

SEQ ID NO: 37116 - RNA, 32 nt, Human
accgacuguaggaagcggaauguugaaagccg

SEQ ID NO: 37117 - RNA, 32 nt, Human
accgacuuauucauguuaauguagcauaauau

SEQ ID NO: 37118 - RNA, 32 nt, Human
accgacuuuguccuuuuucucagcaucagagc

SEQ ID NO: 37119 - RNA, 32 nt, Human
accgagaaaggagccaugggccagaucuuuug

SEQ ID NO: 37120 - RNA, 32 nt, Human
accgagaacuagcaguggcccugcacucaagc

SEQ ID NO: 37121 - RNA, 32 nt, Human
accgagacaaugauaugcaagugcaaaagaau

SEQ ID NO: 37122 - RNA, 32 nt, Human
accgagacagaaguaccugaaaacagcugugc

SEQ ID NO: 37123 - RNA, 32 nt, Human
accgagaccagccuggggagccggugacugag

SEQ ID NO: 37124 - RNA, 32 nt, Human
accgagagaagaagagaaagaaaagaaaaaga

SEQ ID NO: 37125 - RNA, 32 nt, Human
accgagagagugaggagccagacgacaagcac

SEQ ID NO: 37126 - RNA, 23 nt, Human
accgagaggagggaccagcgcgg

SEQ ID NO: 37127 - RNA, 32 nt, Human
accgagaugccauuaacauucaucuaaaaaug

SEQ ID NO: 37128 - RNA, 32 nt, Human
accgagauggcuccgccagccugcugcugccc

SEQ ID NO: 37129 - RNA, 32 nt, Human
accgagauugugccacuacacuccagccuggc

SEQ ID NO: 37130 - RNA, 32 nt, Human
accgagcagacggaggugagcugagagcugag

SEQ ID NO: 37131 - RNA, 32 nt, Human
accgagccacuguacuccagccuaggugacaa

SEQ ID NO: 37132 - RNA, 32 nt, Human
accgagcccugagugcugugcugcugcugguc

SEQ ID NO: 37133 - RNA, 32 nt, Human
accgagccgggugguggcgggagcagcgggag

SEQ ID NO: 37134 - RNA, 32 nt, Human
accgagccuggcucucggucagcaggugauga

SEQ ID NO: 37135 - RNA, 32 nt, Human
accgagccuucucccuguccuucugucucuga

SEQ ID NO: 37136 - RNA, 24 nt, Human
accgagcgggccgccgccgccgcc

SEQ ID NO: 37137 - RNA, 25 nt, Human
accgagcuucagcaagcucucucca

SEQ ID NO: 37138 - RNA, 32 nt, Human
accgaggaaaugugcuuccugagggagugggu

SEQ ID NO: 37139 - RNA, 32 nt, Human
accgaggaacacugggcugagcacaugacagg

SEQ ID NO: 37140 - RNA, 32 nt, Human
accgaggagagcgcgggagccaaccugggcgc

SEQ ID NO: 37141 - RNA, 32 nt, Human
accgaggaggcagagcuugcagugagccaaga

SEQ ID NO: 37142 - RNA, 32 nt, Human
accgaggaggcgaagguugcagugagccgaga

SEQ ID NO: 37143 - RNA, 32 nt, Human
accgaggcaggcggaucaugaggucaggagau

SEQ ID NO: 37144 - RNA, 32 nt, Human
accgaggcaggggcugcagccacccacuggga

SEQ ID NO: 37145 - RNA, 32 nt, Human
accgaggcauggggcucccugggcuguucugc

SEQ ID NO: 37146 - RNA, 32 nt, Human
accgaggccccucccuccuccuggaacagcuu

SEQ ID NO: 37147 - RNA, 32 nt, Human
accgaggcuacagcuccacacgccccgguccc

SEQ ID NO: 37148 - RNA, 20 nt, Human
accgaggcuggagugcaaug

SEQ ID NO: 37149 - RNA, 20 nt, Human
accgaggcuggagugcagug

SEQ ID NO: 37150 - RNA, 32 nt, Human
accgaggggccagauggcuucgaccggcuuag

SEQ ID NO: 37151 - RNA, 32 nt, Human
accgaggggucauccgcacagagcgaggugca

SEQ ID NO: 37152 - RNA, 32 nt, Human
accgagguggccauggagacuccaccuggauc

SEQ ID NO: 37153 - RNA, 22 nt, Human
accgaguccccuccuccacuga

SEQ ID NO: 37154 - RNA, 32 nt, Human
accgaguggcagggcggccacuguggcggggc

SEQ ID NO: 37155 - RNA, 32 nt, Human
accgaguggucaguagucacuucaacucuuag

SEQ ID NO: 37156 - RNA, 32 nt, Human
accgaguuccagguagugguuuugccuuuccc

SEQ ID NO: 37157 - RNA, 32 nt, Human
accgaugacucugcuuuaaagcgugucucuca

SEQ ID NO: 37158 - RNA, 32 nt, Human
accgaugaugauugaggcguggcagcguccuu

SEQ ID NO: 37159 - RNA, 32 nt, Human
accgaugcacagucuucccauuuuacacuuuu

SEQ ID NO: 37160 - RNA, 32 nt, Human
accgaugcugcucucugcgggugacagggaga

SEQ ID NO: 37161 - RNA, 32 nt, Human
accgaugcugugcagcucacaccacuccagaa

SEQ ID NO: 37162 - RNA, 32 nt, Human
accgauggcauggugcuauauccugccugggc

SEQ ID NO: 37163 - RNA, 32 nt, Human
accgaugucccuuugauaaccugcacucacca

SEQ ID NO: 37164 - RNA, 32 nt, Human
accgauucccaugccuccuuucuagccugaag

SEQ ID NO: 37165 - RNA, 21 nt, Human
accgauuuccugcccaccuga

SEQ ID NO: 37166 - RNA, 32 nt, Human
accgauuugaucuuaauccuguauuuaaaguu

SEQ ID NO: 37167 - RNA, 32 nt, Human
accgcaacagagccauggagaagagccacacu

SEQ ID NO: 37168 - RNA, 32 nt, Human
accgcaaccauaggagcuggauccugacaucc

SEQ ID NO: 37169 - RNA, 24 nt, Human
accgcaaccuccaccucccggguu

SEQ ID NO: 37170 - RNA, 24 nt, Human
accgcaaccuccaccuccugaguu

SEQ ID NO: 37171 - RNA, 24 nt, Human
accgcaaccuccaccuccuggguu

SEQ ID NO: 37172 - RNA, 24 nt, Human
accgcaaccuccgccucccagguu

SEQ ID NO: 37173 - RNA, 24 nt, Human
accgcaaccuccgccucccggguu

SEQ ID NO: 37174 - RNA, 24 nt, Human
accgcaaccuccuccucccggguu

SEQ ID NO: 37175 - RNA, 24 nt, Human
accgcaagcccugccuccuggguu

SEQ ID NO: 37176 - RNA, 24 nt, Human
accgcaagcgauucacccaccuca

SEQ ID NO: 37177 - RNA, 24 nt, Human
accgcaagcuccgccucccggguu

SEQ ID NO: 37178 - RNA, 32 nt, Human
accgcacacagcauggcuuccagccugaagug

SEQ ID NO: 37179 - RNA, 32 nt, Human
accgcaccacugcacuccagccugggcgacag

SEQ ID NO: 37180 - RNA, 32 nt, Human
accgcacccucauguguuuucucccccaggag

SEQ ID NO: 37181 - RNA, 32 nt, Human
accgcaccuggcccccuuccuucgucuuaguc

SEQ ID NO: 37182 - RNA, 32 nt, Human
accgcacggcgccgcugcaggaggccgccggc

SEQ ID NO: 37183 - RNA, 32 nt, Human
accgcacuccagccugggcaacagagugagac

SEQ ID NO: 37184 - RNA, 32 nt, Human
accgcacuuaucucccuuguccuguauccuuu

SEQ ID NO: 37185 - RNA, 32 nt, Human
accgcagaagaacugaagacuguugugugcuc

SEQ ID NO: 37186 - RNA, 32 nt, Human
accgcagaaggaaggcagggaggaggcagaga

SEQ ID NO: 37187 - RNA, 32 nt, Human
accgcagaccagcaacaguaguaugaacucca

SEQ ID NO: 37188 - RNA, 19 nt, Human
accgcagagcccagcucag

SEQ ID NO: 37189 - RNA, 32 nt, Human
accgcagaggacuuggggaccagcaagcaacc

SEQ ID NO: 37190 - RNA, 32 nt, Human
accgcagaggccucuggggauuguaguuuugg

SEQ ID NO: 37191 - RNA, 32 nt, Human
accgcagagugggaagagaguaccggcaucgg

SEQ ID NO: 37192 - RNA, 32 nt, Human
accgcagcagggcugcagucacauccugcgcg

SEQ ID NO: 37193 - RNA, 32 nt, Human
accgcagccccugagggaacagugccgucuua

SEQ ID NO: 37194 - RNA, 32 nt, Human
accgcagccgccgaggccagugugugagccgg

SEQ ID NO: 37195 - RNA, 32 nt, Human
accgcagcuccagcugccguccugggcagacu

SEQ ID NO: 37196 - RNA, 18 nt, Human
accgcagcucgcggcggg

SEQ ID NO: 37197 - RNA, 18 nt, Human
accgcagcugagcaggug

SEQ ID NO: 37198 - RNA, 32 nt, Human
accgcaggcagcaguuugcguuuugaagguua

SEQ ID NO: 37199 - RNA, 32 nt, Human
accgcaguagccgccucugccgccgcggacuu

SEQ ID NO: 37200 - RNA, 32 nt, Human
accgcaguccaugccccauuguggaccaccca

SEQ ID NO: 37201 - RNA, 32 nt, Human
accgcagucccgggaguaagcauuucaaaggg

SEQ ID NO: 37202 - RNA, 32 nt, Human
accgcauaauuauucauuaaacuacaaacuuu

SEQ ID NO: 37203 - RNA, 32 nt, Human
accgcaucccuuacauagagagcagaggccug

SEQ ID NO: 37204 - RNA, 32 nt, Human
accgcauccgcccaugcacagggagcagaugg

SEQ ID NO: 37205 - RNA, 24 nt, Human
accgcauccuccaccucccagguu

SEQ ID NO: 37206 - RNA, 32 nt, Human
accgcaucgucggcucggaggcugaggggcug

SEQ ID NO: 37207 - RNA, 32 nt, Human
accgcauguacccugagggcucauggugaaua

SEQ ID NO: 37208 - RNA, 32 nt, Human
accgcauucccuccugacucagacucaccgcg

SEQ ID NO: 37209 - RNA, 32 nt, Human
accgcauugcuuguuguugcgcuucggaggcg

SEQ ID NO: 37210 - RNA, 32 nt, Human
accgcauuucucuccuuccugauucugauguu

SEQ ID NO: 37211 - RNA, 21 nt, Human
accgccaccaccgccgccgcc

SEQ ID NO: 37212 - RNA, 23 nt, Human
accgccaccgccaccgccaccgc

SEQ ID NO: 37213 - RNA, 22 nt, Human
accgccaccgccaccgccgccg

SEQ ID NO: 37214 - RNA, 24 nt, Human
accgccaccuccgccccccggguu

SEQ ID NO: 37215 - RNA, 21 nt, Human
accgccaccugcuuccaggcc

SEQ ID NO: 37216 - RNA, 32 nt, Human
accgccacucauccccuugucucccucucuga

SEQ ID NO: 37217 - RNA, 32 nt, Human
accgccacuuucuccugccuuccuuguggcug

SEQ ID NO: 37218 - RNA, 32 nt, Human
accgccagagucccagacaccgguuuuccuag

SEQ ID NO: 37219 - RNA, 32 nt, Human
accgccagccccaggccaggcugcgagggccg

SEQ ID NO: 37220 - RNA, 32 nt, Human
accgccagcucuguucuuccucagccagccuc

SEQ ID NO: 37221 - RNA, 32 nt, Human
accgccaggagccgcuggugcaguggcauagc

SEQ ID NO: 37222 - RNA, 21 nt, Human
accgccagggcccugcugggu

SEQ ID NO: 37223 - RNA, 22 nt, Human
accgccagugcugcagggggug

SEQ ID NO: 37224 - RNA, 32 nt, Human
accgccaucuuccaguaauucgccaaagugac

SEQ ID NO: 37225 - RNA, 31 nt, Human
accgccaugggccucacuaucuccucccucu

SEQ ID NO: 37226 - RNA, 32 nt, Human
accgcccacaggacuucauagcugccauccga

SEQ ID NO: 37227 - RNA, 32 nt, Human
accgcccagaauaagauuacaguuguuggggu

SEQ ID NO: 37228 - RNA, 32 nt, Human
accgcccagcuucucccugagggcccaccagc

SEQ ID NO: 37229 - RNA, 32 nt, Human
accgcccaggguggagaaggaggcccuugcuu

SEQ ID NO: 37230 - RNA, 32 nt, Human
accgcccaguaggaagaaaaaugagacauuuu

SEQ ID NO: 37231 - RNA, 16 nt, Human
accgccccaccacaga

SEQ ID NO: 37232 - RNA, 32 nt, Human
accgcccccugcugccccuccugcggccuccc

SEQ ID NO: 37233 - RNA, 32 nt, Human
accgccccuccaggaugcuggggacagggcuc

SEQ ID NO: 37234 - RNA, 32 nt, Human
accgccccucgcucccccuccccuggggccgc

SEQ ID NO: 37235 - RNA, 32 nt, Human
accgccccugcuccccucuccgacccuuugag

SEQ ID NO: 37236 - RNA, 32 nt, Human
accgcccgcccuucccugccccgggcuccucc

SEQ ID NO: 37237 - RNA, 32 nt, Human
accgcccucccgcguucccaugacaacgacac

SEQ ID NO: 37238 - RNA, 32 nt, Human
accgcccucccucuccccggggcccauggcgg

SEQ ID NO: 37239 - RNA, 32 nt, Human
accgcccugcacccuccacccggccaggcccc

SEQ ID NO: 37240 - RNA, 32 nt, Human
accgcccuggacaauauggugaagcccuaucu

SEQ ID NO: 37241 - RNA, 24 nt, Human
accgcccuggcuaacauggugaaa

SEQ ID NO: 37242 - RNA, 32 nt, Human
accgcccuuucccagcugcacucgcccugugg

SEQ ID NO: 37243 - RNA, 32 nt, Human
accgccgaguggaccugcuguaacccugugug

SEQ ID NO: 37244 - RNA, 32 nt, Human
accgccgcaccgaggccugggcccugccaaag

SEQ ID NO: 37245 - RNA, 32 nt, Human
accgccgcagaggcagcaggcacuccccacgc

SEQ ID NO: 37246 - RNA, 25 nt, Human
accgccgcagccgccgccgccgccg

SEQ ID NO: 37247 - RNA, 24 nt, Human
accgccgccaccgccgccgccgcc

SEQ ID NO: 37248 - RNA, 32 nt, Human
accgccgccacuggggcagccagcacaaucgg

SEQ ID NO: 37249 - RNA, 32 nt, Human
accgccgcccuuuaacacagucuggauuuaau

SEQ ID NO: 37250 - RNA, 24 nt, Human
accgccgccgccgccaccaccgcc

SEQ ID NO: 37251 - RNA, 24 nt, Human
accgccgccgccgccaccacugcc

SEQ ID NO: 37252 - RNA, 22 nt, Human
accgccgccgccgccgccgccg

SEQ ID NO: 37253 - RNA, 25 nt, Human
accgccgccgccgccgccgccgccg

SEQ ID NO: 37254 - RNA, 25 nt, Human
accgccgccgccgccgccgccgcug

SEQ ID NO: 37255 - RNA, 22 nt, Human
accgccgccgccgucgccgccg

SEQ ID NO: 37256 - RNA, 22 nt, Human
accgccgccuccgccaccgccg

SEQ ID NO: 37257 - RNA, 32 nt, Human
accgccgcggucgucggggagccccggggcuc

SEQ ID NO: 37258 - RNA, 32 nt, Human
accgccgcucgggccauguccgaggggcgcgc

SEQ ID NO: 37259 - RNA, 25 nt, Human
accgccgcugccgccgccgccgccg

SEQ ID NO: 37260 - RNA, 32 nt, Human
accgccgcuucugcaaggucucagggacgggc

SEQ ID NO: 37261 - RNA, 32 nt, Human
accgccgguccugccaaggggcuacuuccugc

SEQ ID NO: 37262 - RNA, 25 nt, Human
accgccgucgccgccgccgcagccg

SEQ ID NO: 37263 - RNA, 31 nt, Human
accgccguggugagucuggccaacaccaagc

SEQ ID NO: 37264 - RNA, 32 nt, Human
accgccucagccgccucgcacauuuagucuug

SEQ ID NO: 37265 - RNA, 32 nt, Human
accgccucccacccacugagggcaggagggcu

SEQ ID NO: 37266 - RNA, 24 nt, Human
accgccuccccugccaccgccgcc

SEQ ID NO: 37267 - RNA, 32 nt, Human
accgccucucaccuucuccaucgugcaugucc

SEQ ID NO: 37268 - RNA, 23 nt, Human
accgccugagugagaaccagggg

SEQ ID NO: 37269 - RNA, 32 nt, Human
accgccugcacugccaugccuggaggcagaca

SEQ ID NO: 37270 - RNA, 32 nt, Human
accgccugcagcugcgcgaggagugccgccgc

SEQ ID NO: 37271 - RNA, 32 nt, Human
accgccugcuaaaaauacccgacuggaggagc

SEQ ID NO: 37272 - RNA, 32 nt, Human
accgccugcucccuccggacagcacacuccug

SEQ ID NO: 37273 - RNA, 24 nt, Human
accgccuggaccuuugcccggagg

SEQ ID NO: 37274 - RNA, 19 nt, Human
accgccuggagccgccggg

SEQ ID NO: 37275 - RNA, 32 nt, Human
accgccuggcccagccuccaccagggaccccu

SEQ ID NO: 37276 - RNA, 23 nt, Human
accgccugggcaacauggugaaa

SEQ ID NO: 37277 - RNA, 32 nt, Human
accgccugggccugagccugaccgggccauuc

SEQ ID NO: 37278 - RNA, 32 nt, Human
accgccuguggaacaguggggacgcugcuggu

SEQ ID NO: 37279 - RNA, 32 nt, Human
accgccugugggacccagagggcuugaggaca

SEQ ID NO: 37280 - RNA, 32 nt, Human
accgccuucccaacaccuccuucccaaacccc

SEQ ID NO: 37281 - RNA, 32 nt, Human
accgccuugagucuggccaaggaggugauuaa

SEQ ID NO: 37282 - RNA, 28 nt, Human
accgcgacccggggcgccucauccucag

SEQ ID NO: 37283 - RNA, 32 nt, Human
accgcgacuuccuaaggucugucuccucugaa

SEQ ID NO: 37284 - RNA, 32 nt, Human
accgcgaggaaggcacccugcugccugcacuu

SEQ ID NO: 37285 - RNA, 32 nt, Human
accgcgcaagggccccugccucccgggagacu

SEQ ID NO: 37286 - RNA, 32 nt, Human
accgcgccacugcacuccagccugggcaacaa

SEQ ID NO: 37287 - RNA, 32 nt, Human
accgcgccacugcacuccagccugggcaacag

SEQ ID NO: 37288 - RNA, 32 nt, Human
accgcgcccagccuaauuuuuguauuuuuagu

SEQ ID NO: 37289 - RNA, 32 nt, Human
accgcgcccagccugaaauacucuauauuggg

SEQ ID NO: 37290 - RNA, 32 nt, Human
accgcgccccagggguuggaggaccuugucug

SEQ ID NO: 37291 - RNA, 32 nt, Human
accgcgccgcggaccucacaccugcgcagccc

SEQ ID NO: 37292 - RNA, 32 nt, Human
accgcgccuauaauccuagcacuuugggaggc

SEQ ID NO: 37293 - RNA, 32 nt, Human
accgcgcgugcuucuagaaagggggcguggag

SEQ ID NO: 37294 - RNA, 32 nt, Human
accgcggcaauguccagcaauaguuuuccuua

SEQ ID NO: 37295 - RNA, 32 nt, Human
accgcggcagauugaggcauugauugggggag

SEQ ID NO: 37296 - RNA, 32 nt, Human
accgcgggcccugcacccuggcccagauggcg

SEQ ID NO: 37297 - RNA, 32 nt, Human
accgcggugcaagagcccagcccaggggcgcu

SEQ ID NO: 37298 - RNA, 24 nt, Human
accgcguagccgucgccaccgccg

SEQ ID NO: 37299 - RNA, 32 nt, Human
accgcgucccgagagccccagaagucggcggg

SEQ ID NO: 37300 - RNA, 32 nt, Human
accgcguggcuugcgauguccaugucuucagc

SEQ ID NO: 37301 - RNA, 32 nt, Human
accgcgugggacagagcaagaucuucuuccgg

SEQ ID NO: 37302 - RNA, 32 nt, Human
accgcgugggccgcggggugcugguaggagug

SEQ ID NO: 37303 - RNA, 32 nt, Human
accgcuacacuccagccugggugacagaguga

SEQ ID NO: 37304 - RNA, 23 nt, Human
accgcuaccgccgccgccgccgc

SEQ ID NO: 37305 - RNA, 32 nt, Human
accgcuagauaaacgugugccugucccccagg

SEQ ID NO: 37306 - RNA, 32 nt, Human
accgcucagcugucuuguaaaacagugaacac

SEQ ID NO: 37307 - RNA, 32 nt, Human
accgcuccaguucucaucaucucccaggcaga

SEQ ID NO: 37308 - RNA, 18 nt, Human
accgcucccagcuuauca

SEQ ID NO: 37309 - RNA, 32 nt, Human
accgcucccuucuaaccuucccccucugagaa

SEQ ID NO: 37310 - RNA, 32 nt, Human
accgcucgaaucucccuggggugcccucccca

SEQ ID NO: 37311 - RNA, 32 nt, Human
accgcucugggagagaaauaagcacugggaga

SEQ ID NO: 37312 - RNA, 32 nt, Human
accgcugcacucaagccugggugacagugaga

SEQ ID NO: 37313 - RNA, 32 nt, Human
accgcugcacucaagcuugggugacagagcaa

SEQ ID NO: 37314 - RNA, 32 nt, Human
accgcugcacuccagccugggugacagaauga

SEQ ID NO: 37315 - RNA, 32 nt, Human
accgcugcacuccagccugggugacagagcga

SEQ ID NO: 37316 - RNA, 32 nt, Human
accgcugcagagcauugaggauguaugugaug

SEQ ID NO: 37317 - RNA, 32 nt, Human
accgcugccaagccuguucucccccauuacaa

SEQ ID NO: 37318 - RNA, 32 nt, Human
accgcugccccaggagcagcacgaggaagaga

SEQ ID NO: 37319 - RNA, 32 nt, Human
accgcugccucagccucugccucccagccucu

SEQ ID NO: 37320 - RNA, 32 nt, Human
accgcuggccggcagcccugggcugaggcaca

SEQ ID NO: 37321 - RNA, 32 nt, Human
accgcuucacuuucucccuccugccgccgccg

SEQ ID NO: 37322 - RNA, 32 nt, Human
accgcuucagggacggagacaggaccggcgga

SEQ ID NO: 37323 - RNA, 32 nt, Human
accgcuucccccaaguucugcuguuggacucu

SEQ ID NO: 37324 - RNA, 32 nt, Human
accgcuucgacuggaagauccaccuccccacu

SEQ ID NO: 37325 - RNA, 22 nt, Human
accgcuucucagccacaaaccc

SEQ ID NO: 37326 - RNA, 32 nt, Human
accgcuucucagccacaaacccugccucuuuu

SEQ ID NO: 37327 - RNA, 32 nt, Human
accgcuugaacccgggaggcggagauugcagu

SEQ ID NO: 37328 - RNA, 32 nt, Human
accgcuugagccugagagaugaagguugcagu

SEQ ID NO: 37329 - RNA, 32 nt, Human
accgcuuggagggagugugcucugaguuaagc

SEQ ID NO: 37330 - RNA, 32 nt, Human
accgcuuguacccaggagguggagguugcagu

SEQ ID NO: 37331 - RNA, 32 nt, Human
accggaaagcacaacuguguaaggagagacua

SEQ ID NO: 37332 - RNA, 32 nt, Human
accggaacccaagauggcugcgcuguugcuga

SEQ ID NO: 37333 - RNA, 32 nt, Human
accggaaccccaguuacccggggaggacgugg

SEQ ID NO: 37334 - RNA, 32 nt, Human
accggaaggcagagguugcagugagccaagau

SEQ ID NO: 37335 - RNA, 32 nt, Human
accggaagugacgagaccugucggccauggag

SEQ ID NO: 37336 - RNA, 32 nt, Human
accggaagugcugcccgcugcccagaagaacu

SEQ ID NO: 37337 - RNA, 31 nt, Human
accggacaagugucauguuaaaagacagaug

SEQ ID NO: 37338 - RNA, 32 nt, Human
accggacccacuaauccucugggauuggccga

SEQ ID NO: 37339 - RNA, 32 nt, Human
accggacuccacacaucaacacugucauguga

SEQ ID NO: 37340 - RNA, 32 nt, Human
accggagaacccacaauaauagaaaucuuuuc

SEQ ID NO: 37341 - RNA, 31 nt, Human
accggagagguuuugccucagcugcucucaa

SEQ ID NO: 37342 - RNA, 32 nt, Human
accggagcuacaccacgcagcugaccaugaac

SEQ ID NO: 37343 - RNA, 32 nt, Human
accggagcugaauuaccuuucacuuucaaaaa

SEQ ID NO: 37344 - RNA, 32 nt, Human
accggagcuguggggcagaagcaucccaggcc

SEQ ID NO: 37345 - RNA, 32 nt, Human
accggagcuugucuuuaaaaaugagcaggaag

SEQ ID NO: 37346 - RNA, 32 nt, Human
accggaggacaccuacacggaggacuccugcu

SEQ ID NO: 37347 - RNA, 32 nt, Human
accggaggauccccgcccugccccgccccgcg

SEQ ID NO: 37348 - RNA, 32 nt, Human
accggaggcaggcugggugcaguggcucaugc

SEQ ID NO: 37349 - RNA, 32 nt, Human
accggagggaggaggaggaggaagaagagcgg

SEQ ID NO: 37350 - RNA, 32 nt, Human
accggaguucauguucaauaaauauugggugu

SEQ ID NO: 37351 - RNA, 32 nt, Human
accggaucugcugccgcugagcuugcagaauc

SEQ ID NO: 37352 - RNA, 32 nt, Human
accggaucuggauuggggagguuggucaggga

SEQ ID NO: 37353 - RNA, 32 nt, Human
accggaucuucacuucucagugggauuuuguc

SEQ ID NO: 37354 - RNA, 32 nt, Human
accggauggggguagugagcaaaucugcccug

SEQ ID NO: 37355 - RNA, 32 nt, Human
accggauuccccuggugaaucugugugccccc

SEQ ID NO: 37356 - RNA, 32 nt, Human
accggauuguucaaaguggaccccaggggaga

SEQ ID NO: 37357 - RNA, 32 nt, Human
accggcacagccgcgggagcaugggcaggagg

SEQ ID NO: 37358 - RNA, 32 nt, Human
accggcacagggcagagaugcggguggcccaa

SEQ ID NO: 37359 - RNA, 32 nt, Human
accggcagaaauggaaguauccauacauuuuu

SEQ ID NO: 37360 - RNA, 32 nt, Human
accggcagaacagucugaucucuuuguauguu

SEQ ID NO: 37361 - RNA, 32 nt, Human
accggcagaucuuccucuacaccuugggcaaa

SEQ ID NO: 37362 - RNA, 21 nt, Human
accggcagccgcugucccggc

SEQ ID NO: 37363 - RNA, 32 nt, Human
accggcagggaaggaggaaauggaguuuuccu

SEQ ID NO: 37364 - RNA, 32 nt, Human
accggcagggcuggggugagaccccucccuuc

SEQ ID NO: 37365 - RNA, 32 nt, Human
accggcauccacacaaaaccaaacaggagcag

SEQ ID NO: 37366 - RNA, 32 nt, Human
accggcauccuccuagggagggauuauuauua

SEQ ID NO: 37367 - RNA, 32 nt, Human
accggccaaauaaauggaaccugcugagagag

SEQ ID NO: 37368 - RNA, 32 nt, Human
accggccaccccaccgcccacccggcucccgg

SEQ ID NO: 37369 - RNA, 18 nt, Human
accggccacccucuucca

SEQ ID NO: 37370 - RNA, 32 nt, Human
accggccacugcagcccuggugagggcgggug

SEQ ID NO: 37371 - RNA, 32 nt, Human
accggccagggugggaccuagguuuuaacucg

SEQ ID NO: 37372 - RNA, 32 nt, Human
accggccaucauuggaaucagcuaaugguaaa

SEQ ID NO: 37373 - RNA, 32 nt, Human
accggcccugcuccuuccuccucuagguccag

SEQ ID NO: 37374 - RNA, 32 nt, Human
accggcccugcuccuuccuccucugggcccag

SEQ ID NO: 37375 - RNA, 32 nt, Human
accggccgcuucuguccucggacccauuccaa

SEQ ID NO: 37376 - RNA, 32 nt, Human
accggccgggcugacguguuucaucuggcagc

SEQ ID NO: 37377 - RNA, 32 nt, Human
accggccucacacuaguaucgcauguccacua

SEQ ID NO: 37378 - RNA, 17 nt, Human
accggccuccaggugcu

SEQ ID NO: 37379 - RNA, 32 nt, Human
accggccuccccucuccuucugggccgcagag

SEQ ID NO: 37380 - RNA, 32 nt, Human
accggccucuguccucuccacuagcgccaggg

SEQ ID NO: 37381 - RNA, 32 nt, Human
accggccugcuguucuguccuuccaucccucu

SEQ ID NO: 37382 - RNA, 32 nt, Human
accggccugcuuuuuagcuccugggcccuaac

SEQ ID NO: 37383 - RNA, 24 nt, Human
accggccuggccaacauggugaaa

SEQ ID NO: 37384 - RNA, 24 nt, Human
accggccuggccaacguggugaaa

SEQ ID NO: 37385 - RNA, 24 nt, Human
accggccuggccaauauggugaaa

SEQ ID NO: 37386 - RNA, 24 nt, Human
accggccuggucaacauggugaaa

SEQ ID NO: 37387 - RNA, 32 nt, Human
accggcgccaucagcuaccacccguacggcag

SEQ ID NO: 37388 - RNA, 32 nt, Human
accggcgcugacagcuguaggcuguagccugc

SEQ ID NO: 37389 - RNA, 32 nt, Human
accggcucaagcaauccucccaucucagccuc

SEQ ID NO: 37390 - RNA, 32 nt, Human
accggcuccccaagcccuccccaccaaggggu

SEQ ID NO: 37391 - RNA, 22 nt, Human
accggcuccuucuccaagaaag

SEQ ID NO: 37392 - RNA, 32 nt, Human
accggcuccuugguccaguucugcaccggggu

SEQ ID NO: 37393 - RNA, 32 nt, Human
accggcugaagcagggcaaguucugaccagga

SEQ ID NO: 37394 - RNA, 32 nt, Human
accggcugcacccaggcugugaccucagcuga

SEQ ID NO: 37395 - RNA, 32 nt, Human
accggcugccaggagaaaaccucauggaucac

SEQ ID NO: 37396 - RNA, 32 nt, Human
accggcuggaggaagagcaggaagaggcggug

SEQ ID NO: 37397 - RNA, 24 nt, Human
accggcuggcgcggccagcuggaa

SEQ ID NO: 37398 - RNA, 32 nt, Human
accggcuuaagaaacggcgcaccacaagacua

SEQ ID NO: 37399 - RNA, 32 nt, Human
accggcuucucggcuuggauccugggcugggu

SEQ ID NO: 37400 - RNA, 32 nt, Human
accgggagaggaacuuccagaccagccccuca

SEQ ID NO: 37401 - RNA, 32 nt, Human
accgggagcggcuucuggaggagcgcgaccug

SEQ ID NO: 37402 - RNA, 32 nt, Human
accgggagcuggcucuggaggcugcggaggcg

SEQ ID NO: 37403 - RNA, 32 nt, Human
accgggaggaagcagcugcggccaucgcgccg

SEQ ID NO: 37404 - RNA, 32 nt, Human
accgggaggagcagacgacuccggacgcgcca

SEQ ID NO: 37405 - RNA, 32 nt, Human
accgggaggcagaaguugcagugagccgagau

SEQ ID NO: 37406 - RNA, 32 nt, Human
accgggaggcggaaguugcagugagccaagau

SEQ ID NO: 37407 - RNA, 32 nt, Human
accgggaggcggagguugaggugagccgaaau

SEQ ID NO: 37408 - RNA, 32 nt, Human
accgggaggcggagguugcagugagccgagau

SEQ ID NO: 37409 - RNA, 32 nt, Human
accgggagucccgguuaucccaaaaaggguug

SEQ ID NO: 37410 - RNA, 32 nt, Human
accgggauccuggaaggugaguguguaugaau

SEQ ID NO: 37411 - RNA, 32 nt, Human
accgggcaacaacugccauccagccugucgcc

SEQ ID NO: 37412 - RNA, 32 nt, Human
accgggcacagcaagcggcccagaucucaguc

SEQ ID NO: 37413 - RNA, 32 nt, Human
accgggcagagggaggggaggagaggaggccg

SEQ ID NO: 37414 - RNA, 32 nt, Human
accgggcagcaaccccacucccacucggaggc

SEQ ID NO: 37415 - RNA, 21 nt, Human
accgggcagggaggggugcug

SEQ ID NO: 37416 - RNA, 32 nt, Human
accgggcaguuccugaccagcaccccaccaag

SEQ ID NO: 37417 - RNA, 32 nt, Human
accgggccaggcucggagcugcagggaauccg

SEQ ID NO: 37418 - RNA, 32 nt, Human
accgggcccagggcaagcagaugucgcaagcc

SEQ ID NO: 37419 - RNA, 32 nt, Human
accgggcgaggacugcagccucgaguccaccu

SEQ ID NO: 37420 - RNA, 30 nt, Human
accgggcucagcuccagggcacagucacuu

SEQ ID NO: 37421 - RNA, 32 nt, Human
accgggcucccagaagagcuggcauugugucu

SEQ ID NO: 37422 - RNA, 32 nt, Human
accgggcuggacugcccugaucccugggacgu

SEQ ID NO: 37423 - RNA, 32 nt, Human
accgggcuuaggcaggcuguugaggagcugug

SEQ ID NO: 37424 - RNA, 32 nt, Human
accggggagacggagguugcagugagccgagu

SEQ ID NO: 37425 - RNA, 32 nt, Human
accggggagcagcugcuccauugugccucgag

SEQ ID NO: 37426 - RNA, 32 nt, Human
accggggaggcagagguugcagugagcugaga

SEQ ID NO: 37427 - RNA, 32 nt, Human
accggggaggcagagguugcaguuaagccgag

SEQ ID NO: 37428 - RNA, 25 nt, Human
accggggaggcggagauugcaguga

SEQ ID NO: 37429 - RNA, 32 nt, Human
accggggaggcggagcuugcagugagccaaga

SEQ ID NO: 37430 - RNA, 25 nt, Human
accggggaggcggagguuacaguga

SEQ ID NO: 37431 - RNA, 32 nt, Human
accggggaggcggagguuacagugagccgaga

SEQ ID NO: 37432 - RNA, 32 nt, Human
accggggaggcggggguugcaaugagcuaaga

SEQ ID NO: 37433 - RNA, 32 nt, Human
accggggaggcugaggcaggagaaucgcuaga

SEQ ID NO: 37434 - RNA, 32 nt, Human
accggggagguggaggcugcagugagccgaga

SEQ ID NO: 37435 - RNA, 32 nt, Human
accggggagguggagguugcagugagcugaga

SEQ ID NO: 37436 - RNA, 32 nt, Human
accggggaguuggagguugcagugagccgaga

SEQ ID NO: 37437 - RNA, 32 nt, Human
accggggccaacacuggcagcuggagauggcg

SEQ ID NO: 37438 - RNA, 32 nt, Human
accggggccggagacguggcagccgcccugcc

SEQ ID NO: 37439 - RNA, 32 nt, Human
accggggcuccagccugcaccugcaccaggca

SEQ ID NO: 37440 - RNA, 32 nt, Human
accgggggacuggccggcccgcuucgugccug

SEQ ID NO: 37441 - RNA, 32 nt, Human
accgggggaggaggaggaggagaagguggaga

SEQ ID NO: 37442 - RNA, 31 nt, Human
accgggggcaaaggagguggcaugucgguca

SEQ ID NO: 37443 - RNA, 32 nt, Human
accgggguaaagggagggaagcaauucaauuu

SEQ ID NO: 37444 - RNA, 31 nt, Human
accggguaauaguguccgacagcagauuuua

SEQ ID NO: 37445 - RNA, 32 nt, Human
accgggugagugagaaggagagcggggcaagc

SEQ ID NO: 37446 - RNA, 32 nt, Human
accggguggggagggggcugguugggagagga

SEQ ID NO: 37447 - RNA, 32 nt, Human
accgggugucugcgguaggaacaagagggcug

SEQ ID NO: 37448 - RNA, 32 nt, Human
accgguaaccaccacuuccccacaccgccgcc

SEQ ID NO: 37449 - RNA, 20 nt, Human
accggucagaccagcccgag

SEQ ID NO: 37450 - RNA, 32 nt, Human
accggucuacaucgcacccccacccccacccc

SEQ ID NO: 37451 - RNA, 24 nt, Human
accggucuggccaacauggugaaa

SEQ ID NO: 37452 - RNA, 32 nt, Human
accggugggugaggggugauguagagucaaug

SEQ ID NO: 37453 - RNA, 32 nt, Human
accgguggugcuggucugccuuugccaacuau

SEQ ID NO: 37454 - RNA, 32 nt, Human
accgguguccccguccgcguccuuccuccccg

SEQ ID NO: 37455 - RNA, 32 nt, Human
accgguugcucugagaguagcugguaaagagg

SEQ ID NO: 37456 - RNA, 32 nt, Human
accgguugucgccccaguggccgcccucugag

SEQ ID NO: 37457 - RNA, 32 nt, Human
accguaauccuagcuacucgggagacugacgg

SEQ ID NO: 37458 - RNA, 32 nt, Human
accguaccaccgcucgccagcacgcaggggga

SEQ ID NO: 37459 - RNA, 27 nt, Human
accguagccugggugauaagagugaga

SEQ ID NO: 37460 - RNA, 32 nt, Human
accguauacguucacacacaugcacuauguaa

SEQ ID NO: 37461 - RNA, 32 nt, Human
accguaugaggugaauggacagccagccacca

SEQ ID NO: 37462 - RNA, 32 nt, Human
accguauucuucauuccuucuuuuggaaaugu

SEQ ID NO: 37463 - RNA, 32 nt, Human
accgucacaggccaccaccacgccgucaauga

SEQ ID NO: 37464 - RNA, 18 nt, Human
accgucaccacccgacag

SEQ ID NO: 37465 - RNA, 32 nt, Human
accgucagccucccuccccucuccacccuuca

SEQ ID NO: 37466 - RNA, 32 nt, Human
accgucaugccuggcuaauuuuuguauuuuug

SEQ ID NO: 37467 - RNA, 32 nt, Human
accgucauuggccugugaagcauuggacauuu

SEQ ID NO: 37468 - RNA, 32 nt, Human
accguccagcaaagccagcacagcagagauga

SEQ ID NO: 37469 - RNA, 32 nt, Human
accguccagcagcugcugcucuccaaggcugc

SEQ ID NO: 37470 - RNA, 32 nt, Human
accguccagccccugaccacacuuguuccuag

SEQ ID NO: 37471 - RNA, 32 nt, Human
accgucccacaccuuuuacuugcucagugcug

SEQ ID NO: 37472 - RNA, 32 nt, Human
accgucccagaaccuccuugcucugcaguccc

SEQ ID NO: 37473 - RNA, 32 nt, Human
accgucccucugccagccauaggcccugccuc

SEQ ID NO: 37474 - RNA, 32 nt, Human
accgucccuugaucucucauacuuucucccug

SEQ ID NO: 37475 - RNA, 19 nt, Human
accguccucaccccugucc

SEQ ID NO: 37476 - RNA, 24 nt, Human
accguccuggccgacauggugaaa

SEQ ID NO: 37477 - RNA, 24 nt, Human
accguccuggcuaacacggugaaa

SEQ ID NO: 37478 - RNA, 24 nt, Human
accguccuggcuaacauggugaaa

SEQ ID NO: 37479 - RNA, 32 nt, Human
accguccuggcuucgaacccagcucuuccacc

SEQ ID NO: 37480 - RNA, 32 nt, Human
accgucggcccgagggcgcagaccugaggcga

SEQ ID NO: 37481 - RNA, 24 nt, Human
accgucguggcuaacacggugaaa

SEQ ID NO: 37482 - RNA, 32 nt, Human
accgucuaguugggaaagucacccuacagggu

SEQ ID NO: 37483 - RNA, 32 nt, Human
accgucucauuuccccucuguuucucaguucc

SEQ ID NO: 37484 - RNA, 32 nt, Human
accgucugccuugcuccucucuucccaaauca

SEQ ID NO: 37485 - RNA, 32 nt, Human
accgucuucucccuauucccucucucucccag

SEQ ID NO: 37486 - RNA, 32 nt, Human
accgucuuuaccucagcuccuagggccuccag

SEQ ID NO: 37487 - RNA, 32 nt, Human
accgugaaggaaaugaagguugagaaccugga

SEQ ID NO: 37488 - RNA, 32 nt, Human
accgugacaucaggccagagguuuccaaucag

SEQ ID NO: 37489 - RNA, 32 nt, Human
accgugaccccagcuccggagccugcugaaaa

SEQ ID NO: 37490 - RNA, 32 nt, Human
accgugacccccuccuccuccuucuuugccac

SEQ ID NO: 37491 - RNA, 32 nt, Human
accgugaccccuguccccacacugaccugugu

SEQ ID NO: 37492 - RNA, 32 nt, Human
accgugagcuuggaggcagugcaccacauaaa

SEQ ID NO: 37493 - RNA, 32 nt, Human
accgugagggggaccauccauccaggagagua

SEQ ID NO: 37494 - RNA, 32 nt, Human
accgugauggagaggacagagcaggggcucca

SEQ ID NO: 37495 - RNA, 32 nt, Human
accgugauugagcccaagaaaccagggacuua

SEQ ID NO: 37496 - RNA, 32 nt, Human
accgugauugagcuugucagcagagcugaaag

SEQ ID NO: 37497 - RNA, 32 nt, Human
accgugcagcuuuggccugggcacagacccug

SEQ ID NO: 37498 - RNA, 32 nt, Human
accgugccacugcacuccagccuggcaacaga

SEQ ID NO: 37499 - RNA, 32 nt, Human
accgugccacugcacuccagccugggcaacac

SEQ ID NO: 37500 - RNA, 32 nt, Human
accgugccacuguacuccagccugggcagcag

SEQ ID NO: 37501 - RNA, 32 nt, Human
accgugcccagccuggacuugccuuuuaccuc

SEQ ID NO: 37502 - RNA, 32 nt, Human
accgugccuggcuuugcuguggauucuuuugg

SEQ ID NO: 37503 - RNA, 32 nt, Human
accgugcucagccuguuucucucugcccucua

SEQ ID NO: 37504 - RNA, 32 nt, Human
accgugcugcuugauagaaugacuuugagguc

SEQ ID NO: 37505 - RNA, 32 nt, Human
accgugcuucagaaucccagcacauaguaaaa

SEQ ID NO: 37506 - RNA, 32 nt, Human
accguggagaggaggcauucacuguggggugu

SEQ ID NO: 37507 - RNA, 21 nt, Human
accguggaggcagggggcaag

SEQ ID NO: 37508 - RNA, 32 nt, Human
accguggaugcugaaguuagagcacgucgcca

SEQ ID NO: 37509 - RNA, 32 nt, Human
accguggcacaguccugcucagucccuggacu

SEQ ID NO: 37510 - RNA, 20 nt, Human
accguggccaggccaucucc

SEQ ID NO: 37511 - RNA, 32 nt, Human
accguggccccuccuggccccugggccuccug

SEQ ID NO: 37512 - RNA, 32 nt, Human
accgugggaacagcaggcuugggagugcagcc

SEQ ID NO: 37513 - RNA, 19 nt, Human
accgugggccucagagcug

SEQ ID NO: 37514 - RNA, 32 nt, Human
accgugggugguaaugcagugggagccaccuc

SEQ ID NO: 37515 - RNA, 24 nt, Human
accguggucuccugcugucccgcg

SEQ ID NO: 37516 - RNA, 32 nt, Human
accguggucucgaucuccugaccucgugaucc

SEQ ID NO: 37517 - RNA, 32 nt, Human
accguggucugugaauggagagagugagcugg

SEQ ID NO: 37518 - RNA, 32 nt, Human
accguguccuagagagccucuaugcauuucaa

SEQ ID NO: 37519 - RNA, 32 nt, Human
accgugucugcagcacgcuuccgucuccgcau

SEQ ID NO: 37520 - RNA, 32 nt, Human
accgugugggcuguaguagcgggagggguggg

SEQ ID NO: 37521 - RNA, 32 nt, Human
accguguuagccaggcuggucucgaucugacc

SEQ ID NO: 37522 - RNA, 28 nt, Human
accguguucagugcugcuucacucuacc

SEQ ID NO: 37523 - RNA, 20 nt, Human
accguucacuuccccuucca

SEQ ID NO: 37524 - RNA, 16 nt, Human
accguuccaccacaga

SEQ ID NO: 37525 - RNA, 32 nt, Human
accguuccagaaaucccaacucucacacccag

SEQ ID NO: 37526 - RNA, 32 nt, Human
accguucccuuccuccugccuggaccauggua

SEQ ID NO: 37527 - RNA, 32 nt, Human
accguucuguacuggcuuacucuaaugguguu

SEQ ID NO: 37528 - RNA, 32 nt, Human
accguuuaugaggaaaacugagcaggguggca

SEQ ID NO: 37529 - RNA, 32 nt, Human
accguuuccucuucucuuucccuggccaaugg

SEQ ID NO: 37530 - RNA, 32 nt, Human
accguuucugacucugugcccugucccugagc

SEQ ID NO: 37531 - RNA, 32 nt, Human
accguuugucauggaagccagggagccuggga

SEQ ID NO: 37532 - RNA, 23 nt, Human
accuaaaaaauuccuaggugcua

SEQ ID NO: 37533 - RNA, 32 nt, Human
accuaaaaaccugagaggaaggggacaaguag

SEQ ID NO: 37534 - RNA, 32 nt, Human
accuaaaaccaauuucaaaauggcuuucuuug

SEQ ID NO: 37535 - RNA, 32 nt, Human
accuaaaagaugacagaagcauagcccuuaac

SEQ ID NO: 37536 - RNA, 31 nt, Human
accuaaaaggauauguuaucacuggaauuua

SEQ ID NO: 37537 - RNA, 32 nt, Human
accuaaaaucuuuacacuuucaucucaaagau

SEQ ID NO: 37538 - RNA, 32 nt, Human
accuaaacauuccaacccuuaaagcuaaaaca

SEQ ID NO: 37539 - RNA, 32 nt, Human
accuaaaccauccuaagugacuguggaauucu

SEQ ID NO: 37540 - RNA, 32 nt, Human
accuaaagaccagcaaccauacugaaacaagu

SEQ ID NO: 37541 - RNA, 32 nt, Human
accuaaagcaggaggccaggagcccagccucu

SEQ ID NO: 37542 - RNA, 22 nt, Human
accuaaagcuggcacuagcaaa

SEQ ID NO: 37543 - RNA, 32 nt, Human
accuaaaggacaaaugucagagcccagcagga

SEQ ID NO: 37544 - RNA, 32 nt, Human
accuaaauagaaagcgaacuucaagagaaguu

SEQ ID NO: 37545 - RNA, 32 nt, Human
accuaaauagcaaaagcaauccuaagcaaaaa

SEQ ID NO: 37546 - RNA, 32 nt, Human
accuaaauccugauuauaggcuuuucauuucu

SEQ ID NO: 37547 - RNA, 32 nt, Human
accuaaauuuugcuuaaggaaggccuuuauca

SEQ ID NO: 37548 - RNA, 32 nt, Human
accuaacaaaggcauaaugaugggacuucuca

SEQ ID NO: 37549 - RNA, 20 nt, Human
accuaacaacgaccggcgcc

SEQ ID NO: 37550 - RNA, 32 nt, Human
accuaacacccccuagcaaaacucacagagcu

SEQ ID NO: 37551 - RNA, 32 nt, Human
accuaacagcuguccccaacucucauucauga

SEQ ID NO: 37552 - RNA, 32 nt, Human
accuaacaggaaauagcuaaacacaacacacc

SEQ ID NO: 37553 - RNA, 32 nt, Human
accuaacaggaugucagcagggcaguuaacuc

SEQ ID NO: 37554 - RNA, 32 nt, Human
accuaaccagagggccagaguuuggggugcug

SEQ ID NO: 37555 - RNA, 32 nt, Human
accuaaccagcuuguauuggccaucuggaaua

SEQ ID NO: 37556 - RNA, 32 nt, Human
accuaaccaggaggccagagcgguuugaaaac

SEQ ID NO: 37557 - RNA, 32 nt, Human
accuaacucuagaccaccuucagcucuuuuau

SEQ ID NO: 37558 - RNA, 32 nt, Human
accuaacuuuuuaguaaccagauuuucaaaaa

SEQ ID NO: 37559 - RNA, 32 nt, Human
accuaagaagugagaauccuaggcauccccau

SEQ ID NO: 37560 - RNA, 32 nt, Human
accuaagauucucuggcucagccccagccuuu

SEQ ID NO: 37561 - RNA, 32 nt, Human
accuaagccgcgagccuuugcccacacggaga

SEQ ID NO: 37562 - RNA, 32 nt, Human
accuaagcuucucuuucuccuagaagguaaaa

SEQ ID NO: 37563 - RNA, 32 nt, Human
accuaagcuuucaguguauccagauccacauc

SEQ ID NO: 37564 - RNA, 32 nt, Human
accuaaggaagcgcgaugcuggaacacauccc

SEQ ID NO: 37565 - RNA, 32 nt, Human
accuaaggacugccugcuuucuggucacaugu

SEQ ID NO: 37566 - RNA, 32 nt, Human
accuaaggccugauguuuaccuggagccagau

SEQ ID NO: 37567 - RNA, 32 nt, Human
accuaagguagaaagcugcccaucgggggccc

SEQ ID NO: 37568 - RNA, 32 nt, Human
accuaaggucuuagaaaaucuuaacuugaaaa

SEQ ID NO: 37569 - RNA, 32 nt, Human
accuaaguacacacaaacaaaaacaugcccac

SEQ ID NO: 37570 - RNA, 32 nt, Human
accuaagucaucuucgaguccucagcacuuca

SEQ ID NO: 37571 - RNA, 32 nt, Human
accuaaguccuuccaccugccacccccuuccc

SEQ ID NO: 37572 - RNA, 32 nt, Human
accuaagucuauauucacuguguccuuuucug

SEQ ID NO: 37573 - RNA, 32 nt, Human
accuaagugccgccugacccuuguacacuagg

SEQ ID NO: 37574 - RNA, 32 nt, Human
accuaagugccucaggacugcaccuuagggca

SEQ ID NO: 37575 - RNA, 32 nt, Human
accuaagugccuccccaaccagggucuguccu

SEQ ID NO: 37576 - RNA, 32 nt, Human
accuaaguggcagagguugcagugagcugaga

SEQ ID NO: 37577 - RNA, 32 nt, Human
accuaauaaggcaugcgaaauguucucaugaa

SEQ ID NO: 37578 - RNA, 32 nt, Human
accuaaucaaaggcacuuacugcugcucagaa

SEQ ID NO: 37579 - RNA, 32 nt, Human
accuaaucaaucaguguaucagugcaucuggu

SEQ ID NO: 37580 - RNA, 32 nt, Human
accuaaucacucccaaaguccaccuccuaaca

SEQ ID NO: 37581 - RNA, 32 nt, Human
accuaauggccuuggacaccagauucuuuccc

SEQ ID NO: 37582 - RNA, 32 nt, Human
accuaaugguuuuuaauuuugguacaacuccu

SEQ ID NO: 37583 - RNA, 32 nt, Human
accuaauuauaguagugagaacuauuucuuuu

SEQ ID NO: 37584 - RNA, 32 nt, Human
accuaauuugucugaaauuaaauuuaauaguu

SEQ ID NO: 37585 - RNA, 32 nt, Human
accuaauuuuguagcuucagaacaggugugac

SEQ ID NO: 37586 - RNA, 28 nt, Human
accuacaagugguuugccucauugccuu

SEQ ID NO: 37587 - RNA, 32 nt, Human
accuacaaucaccagucucaaaugcgcuauug

SEQ ID NO: 37588 - RNA, 32 nt, Human
accuacacugaucuuaguucucuuaugaaaaa

SEQ ID NO: 37589 - RNA, 32 nt, Human
accuacagaaaagaugcagaugcaagaauaau

SEQ ID NO: 37590 - RNA, 32 nt, Human
accuacagacaugcagaacaugcacguguaca

SEQ ID NO: 37591 - RNA, 32 nt, Human
accuacagccuggaagaagagaguaucuggaa

SEQ ID NO: 37592 - RNA, 32 nt, Human
accuacagcgugccuuggcacugggcuagaga

SEQ ID NO: 37593 - RNA, 32 nt, Human
accuacaggaggccacugcaucaacacgccac

SEQ ID NO: 37594 - RNA, 32 nt, Human
accuacagggaagaguaggugagcugucgggg

SEQ ID NO: 37595 - RNA, 32 nt, Human
accuacagguaagucuacauccucucugacag

SEQ ID NO: 37596 - RNA, 32 nt, Human
accuacaguaaauggguaugauuguagcuucc

SEQ ID NO: 37597 - RNA, 32 nt, Human
accuaccaaccaggaacauguugcuucucagg

SEQ ID NO: 37598 - RNA, 32 nt, Human
accuaccaccccacuggcugguuccagaacgu

SEQ ID NO: 37599 - RNA, 32 nt, Human
accuaccagaccuucccaucagggaagagggu

SEQ ID NO: 37600 - RNA, 32 nt, Human
accuaccauuggagagcuugguuccuugccuc

SEQ ID NO: 37601 - RNA, 32 nt, Human
accuacccaacaagaaccaaccugagcagcug

SEQ ID NO: 37602 - RNA, 32 nt, Human
accuacccaauuggcccaacacugucugcccc

SEQ ID NO: 37603 - RNA, 32 nt, Human
accuacccaggccacuggagugagucuagaga

SEQ ID NO: 37604 - RNA, 32 nt, Human
accuaccccucccauugcaaagccaacuugga

SEQ ID NO: 37605 - RNA, 19 nt, Human
accuaccccugcugcacca

SEQ ID NO: 37606 - RNA, 19 nt, Human
accuacccgugccugagaa

SEQ ID NO: 37607 - RNA, 32 nt, Human
accuacccucagaaaggaggaggaaugucuuu

SEQ ID NO: 37608 - RNA, 32 nt, Human
accuacccucgccucuggaauggccuacccaa

SEQ ID NO: 37609 - RNA, 32 nt, Human
accuaccucaaagggcaguuuugaggcaugac

SEQ ID NO: 37610 - RNA, 32 nt, Human
accuaccucaaagggcaguuuugaggcgugac

SEQ ID NO: 37611 - RNA, 32 nt, Human
accuaccucaaaggggugguauaagguuuaaa

SEQ ID NO: 37612 - RNA, 32 nt, Human
accuaccucacagugggagggcaggagauuuu

SEQ ID NO: 37613 - RNA, 31 nt, Human
accuaccucauaggggagguugugaggccac

SEQ ID NO: 37614 - RNA, 32 nt, Human
accuaccuccacccucccccuagccagccagg

SEQ ID NO: 37615 - RNA, 32 nt, Human
accuaccugauccugaucacuuccuaaacugc

SEQ ID NO: 37616 - RNA, 20 nt, Human
accuaccuuggagcugggug

SEQ ID NO: 37617 - RNA, 32 nt, Human
accuaccuuugccuuuuucugucauggagaau

SEQ ID NO: 37618 - RNA, 32 nt, Human
accuacgcucuuaccagcuggagggaguaaac

SEQ ID NO: 37619 - RNA, 22 nt, Human
accuacggcaccugcuggacca

SEQ ID NO: 37620 - RNA, 32 nt, Human
accuacgguggagggggcaggcgggggacaga

SEQ ID NO: 37621 - RNA, 27 nt, Human
accuacuaaaaauauaaaaauuagcug

SEQ ID NO: 37622 - RNA, 32 nt, Human
accuacuaaaaauauaaaaauuagcugggugu

SEQ ID NO: 37623 - RNA, 32 nt, Human
accuacuaugugcagugcaguuacuccaaucu

SEQ ID NO: 37624 - RNA, 32 nt, Human
accuacucgagaagcugagauagggucaccug

SEQ ID NO: 37625 - RNA, 32 nt, Human
accuacucuccacucuuugcaucagugggaau

SEQ ID NO: 37626 - RNA, 32 nt, Human
accuacucugagucucacaucucuaaaccuca

SEQ ID NO: 37627 - RNA, 32 nt, Human
accuacugaacccagagucaggaagagauuua

SEQ ID NO: 37628 - RNA, 23 nt, Human
accuacugcgaccacccaccuca

SEQ ID NO: 37629 - RNA, 32 nt, Human
accuacugcgaccacccaccucauccuggcuc

SEQ ID NO: 37630 - RNA, 32 nt, Human
acgaagccgcggcccgggcacagccauggccc

SEQ ID NO: 37631 - RNA, 32 nt, Human
acgaagcugcucagcaacuccaccugcccgcc

SEQ ID NO: 37632 - RNA, 32 nt, Human
acgaagcugcugcaggaugagaagauggcagc

SEQ ID NO: 37633 - RNA, 32 nt, Human
acgaagcuuccagaggaaggaauacacagcaa

SEQ ID NO: 37634 - RNA, 32 nt, Human
acgaaggagaagcaaacacugcgcagcgggac

SEQ ID NO: 37635 - RNA, 32 nt, Human
acgaaggcguuggccaaggcauuugguuccgc

SEQ ID NO: 37636 - RNA, 32 nt, Human
acgaaguacagaacacaaacagucuuuguucu

SEQ ID NO: 37637 - RNA, 32 nt, Human
acgaaguaguuaauuuuagaaaaggauuuacu

SEQ ID NO: 37638 - RNA, 32 nt, Human
acgaagucaagaguucaagaccagccuggcca

SEQ ID NO: 37639 - RNA, 32 nt, Human
acgaagucagaagaucaaaaccagccuggcca

SEQ ID NO: 37640 - RNA, 32 nt, Human
acgaagucaguaguuugagaccagccuggcca

SEQ ID NO: 37641 - RNA, 32 nt, Human
acgaagucgggaguuugagaccagccugacca

SEQ ID NO: 37642 - RNA, 32 nt, Human
acgaagucucgcuauguugcccaggcuggucu

SEQ ID NO: 37643 - RNA, 32 nt, Human
acgaaguguaccaaaucucagcuauuggacug

SEQ ID NO: 37644 - RNA, 32 nt, Human
acgaaguucuggcaaauguggaaaaccuggcc

SEQ ID NO: 37645 - RNA, 32 nt, Human
acgaauagccacugcauaccaaccugggcaau

SEQ ID NO: 37646 - RNA, 32 nt, Human
acgaauaguaaauaaugaacucgugcaagaca

SEQ ID NO: 37647 - RNA, 32 nt, Human
acgaaucacugcacccagccuauggaacaucu

SEQ ID NO: 37648 - RNA, 32 nt, Human
acgaaucagcugcaggucucuguuuugaaaaa

SEQ ID NO: 37649 - RNA, 32 nt, Human
acgaaucagcugcgggcggagacauggccaac

SEQ ID NO: 37650 - RNA, 32 nt, Human
acgaaucccuuccuccucuccccuuuaccccc

SEQ ID NO: 37651 - RNA, 32 nt, Human
acgaaucugguggaggugcggucaguugugac

SEQ ID NO: 37652 - RNA, 32 nt, Human
acgaaugaaugacagacagagaggaggaaaaa

SEQ ID NO: 37653 - RNA, 32 nt, Human
acgaaugcuucugccugugcugugcauucccg

SEQ ID NO: 37654 - RNA, 20 nt, Human
acgaauggacugaugguuug

SEQ ID NO: 37655 - RNA, 32 nt, Human
acgaauggagaugcaggagcugcgggagccga

SEQ ID NO: 37656 - RNA, 18 nt, Human
acgaaugggguucaacgg

SEQ ID NO: 37657 - RNA, 32 nt, Human
acgaauuguuaucugaaaggcuuucauucuuu

SEQ ID NO: 37658 - RNA, 32 nt, Human
acgacaaacacgagacgccacuguggaaugag

SEQ ID NO: 37659 - RNA, 32 nt, Human
acgacaacauuuuauuucuccugacccuuuug

SEQ ID NO: 37660 - RNA, 32 nt, Human
acgacaagaccaccaacguguccuuguacccu

SEQ ID NO: 37661 - RNA, 31 nt, Human
acgacaagccaagaagaccuguugaaaguuu

SEQ ID NO: 37662 - RNA, 32 nt, Human
acgacaagcuacgucuccacacuggucuacac

SEQ ID NO: 37663 - RNA, 32 nt, Human
acgacacagagguucucaucauucugcugagg

SEQ ID NO: 37664 - RNA, 32 nt, Human
acgacaccacugcacuccagccugggugacag

SEQ ID NO: 37665 - RNA, 32 nt, Human
acgacacugcacuccagccugggcaacggaga

SEQ ID NO: 37666 - RNA, 32 nt, Human
acgacacugccagugccagcaguguccuuggg

SEQ ID NO: 37667 - RNA, 32 nt, Human
acgacagacccaggcuggagucuuggcugugc

SEQ ID NO: 37668 - RNA, 18 nt, Human
acgacagagacaaggaaa

SEQ ID NO: 37669 - RNA, 32 nt, Human
acgacagcacauccacccuccaccucuagccc

SEQ ID NO: 37670 - RNA, 32 nt, Human
acgacagcacuggagggucuucccucucagau

SEQ ID NO: 37671 - RNA, 32 nt, Human
acgacagccccacggcacagcagaucaugcgg

SEQ ID NO: 37672 - RNA, 32 nt, Human
acgacagcccucugcugaccucacccggcagg

SEQ ID NO: 37673 - RNA, 32 nt, Human
acgacagugcaugcacuccagccugggcaaca

SEQ ID NO: 37674 - RNA, 32 nt, Human
acgacaucaaagaacucauacgugggaauguu

SEQ ID NO: 37675 - RNA, 21 nt, Human
acgaccaccgaccugagccug

SEQ ID NO: 37676 - RNA, 32 nt, Human
acgaccaccgccccaccaccuccugggaccac

SEQ ID NO: 37677 - RNA, 32 nt, Human
acgaccaccgcggccgccggaaacccaaagcg

SEQ ID NO: 37678 - RNA, 21 nt, Human
acgaccaccguggccaucugc

SEQ ID NO: 37679 - RNA, 32 nt, Human
acgaccagaguauugcccugccaccacuaucu

SEQ ID NO: 37680 - RNA, 32 nt, Human
acgaccaugccuggcuaauuuuguauuuuuag

SEQ ID NO: 37681 - RNA, 32 nt, Human
acgaccccuccagcaaaggagucugaggcuga

SEQ ID NO: 37682 - RNA, 32 nt, Human
acgaccccugcagcaaagaagcccgagacuga

SEQ ID NO: 37683 - RNA, 32 nt, Human
acgacccgagggcuggagucggccccgcgccu

SEQ ID NO: 37684 - RNA, 32 nt, Human
acgacccucuuucagguggauucagagaccug

SEQ ID NO: 37685 - RNA, 24 nt, Human
acgacccuggccaacauggugaaa

SEQ ID NO: 37686 - RNA, 32 nt, Human
acgacccuugcucuccaggcuguuaaccuuuu

SEQ ID NO: 37687 - RNA, 32 nt, Human
acgaccgcggggcuuccucucccaggucuuuc

SEQ ID NO: 37688 - RNA, 32 nt, Human
acgaccuccucgggggaaagcacaccucaugc

SEQ ID NO: 37689 - RNA, 32 nt, Human
acgaccuccucgggggcuccgggggcuucacg

SEQ ID NO: 37690 - RNA, 32 nt, Human
acgaccucuuugugaagccucuucuggguuua

SEQ ID NO: 37691 - RNA, 32 nt, Human
acgaccuugcugcagugcaucagcagaugcca

SEQ ID NO: 37692 - RNA, 32 nt, Human
acgaccuuucuuucuuuauuucucagccugcc

SEQ ID NO: 37693 - RNA, 32 nt, Human
acgacgacagcaggaacaacgcggccucagcc

SEQ ID NO: 37694 - RNA, 32 nt, Human
acgacgaggcgggccagagcugagcgugagga

SEQ ID NO: 37695 - RNA, 32 nt, Human
acgacgaguucugcgcggcggugcgggccuac

SEQ ID NO: 37696 - RNA, 32 nt, Human
acgacgaugaugcagaaauguagggccauaca

SEQ ID NO: 37697 - RNA, 32 nt, Human
acgacgauuucagcuaggaggcugaggcagga

SEQ ID NO: 37698 - RNA, 32 nt, Human
acgacgccuacaguccugcccugcugcugcug

SEQ ID NO: 37699 - RNA, 32 nt, Human
acgacgcucugccucuccuuauccuucacauu

SEQ ID NO: 37700 - RNA, 32 nt, Human
acgacgcuggcggcccagccugggcagguuuc

SEQ ID NO: 37701 - RNA, 32 nt, Human
acgacgcuugccccggcccacccuccaucccc

SEQ ID NO: 37702 - RNA, 32 nt, Human
acgacgcuugcggcccagccugggcagguuuc

SEQ ID NO: 37703 - RNA, 32 nt, Human
acgacggcccagcccuggccccggcugcgguc

SEQ ID NO: 37704 - RNA, 32 nt, Human
acgacgggcgcuggcaccaccuggcccucgag

SEQ ID NO: 37705 - RNA, 32 nt, Human
acgacggugaagccccgucucugcuaagagug

SEQ ID NO: 37706 - RNA, 31 nt, Human
acgacgugggucucugggacugccugugccg

SEQ ID NO: 37707 - RNA, 32 nt, Human
acgacucaaaaucaacuaucagugaugacagg

SEQ ID NO: 37708 - RNA, 32 nt, Human
acgacucccaggaaggccuagagcagacccuu

SEQ ID NO: 37709 - RNA, 32 nt, Human
acgacuccuguaaucccagcacuuugggaggc

SEQ ID NO: 37710 - RNA, 32 nt, Human
acgacucugcccucagcuucacagucaccgaa

SEQ ID NO: 37711 - RNA, 32 nt, Human
acgacucugggcacuuccccugaagcuccucu

SEQ ID NO: 37712 - RNA, 32 nt, Human
acgacugaagagagcaagggauuuccugggac

SEQ ID NO: 37713 - RNA, 32 nt, Human
acgacugaagucaguguagaccugagcuggga

SEQ ID NO: 37714 - RNA, 32 nt, Human
acgacugcaucuucuuggcacauuuauuauac

SEQ ID NO: 37715 - RNA, 32 nt, Human
acgacugcauucuagccugggugacagagcga

SEQ ID NO: 37716 - RNA, 32 nt, Human
acgacuggaagggcgugaggccucccagcagu

SEQ ID NO: 37717 - RNA, 32 nt, Human
acgacuggacuacugccugacguugucaguca

SEQ ID NO: 37718 - RNA, 32 nt, Human
acgacuggagccgccucucgccgacagcgggg

SEQ ID NO: 37719 - RNA, 32 nt, Human
acgacuggccuuccugccuccagccuggcuuc

SEQ ID NO: 37720 - RNA, 32 nt, Human
acgacugggugaugcuggacaugggagauagg

SEQ ID NO: 37721 - RNA, 32 nt, Human
acgacuucagcagccucaggagaggacuucca

SEQ ID NO: 37722 - RNA, 32 nt, Human
acgacuuggacuucuucccucgcuucucuucg

SEQ ID NO: 37723 - RNA, 32 nt, Human
acgacuuuacuaccugcagaccugcacuauaa

SEQ ID NO: 37724 - RNA, 32 nt, Human
acgacuuucuacugccuguuccaggcccuggc

SEQ ID NO: 37725 - RNA, 32 nt, Human
acgagaaaaagaaaaagagagagagccacgua

SEQ ID NO: 37726 - RNA, 32 nt, Human
acgagaaagaggaaugggggcagggcaggcca

SEQ ID NO: 37727 - RNA, 32 nt, Human
acgagaacaaagacucugagaaaagcacagau

SEQ ID NO: 37728 - RNA, 32 nt, Human
acgagaacaacaaaaauacuuuccuugaacau

SEQ ID NO: 37729 - RNA, 32 nt, Human
acgagaacccccaggguacaggaggaggcugg

SEQ ID NO: 37730 - RNA, 32 nt, Human
acgagaagagaaugccuucuagaugcaaaauc

SEQ ID NO: 37731 - RNA, 32 nt, Human
acgagaagagaggagcagggaggagggggagc

SEQ ID NO: 37732 - RNA, 32 nt, Human
acgagaauccacccauccuaccaaugcaugca

SEQ ID NO: 37733 - RNA, 32 nt, Human
acgagaaucugcaggagcugaacuggggccug

SEQ ID NO: 37734 - RNA, 32 nt, Human
acgagacacauuugggacgaaggugaaagaga

SEQ ID NO: 37735 - RNA, 25 nt, Human
acgagacaugaauauaguccaacca

SEQ ID NO: 37736 - RNA, 32 nt, Human
acgagaccacccugggcaacauggugaaaucc

SEQ ID NO: 37737 - RNA, 32 nt, Human
acgagaccaggaguucaagaccagccugacca

SEQ ID NO: 37738 - RNA, 32 nt, Human
acgagaccauccuggcuaacacggugaaaccc

SEQ ID NO: 37739 - RNA, 32 nt, Human
acgagacccaagugaagaucugguuccagaac

SEQ ID NO: 37740 - RNA, 32 nt, Human
acgagaccgcggcgucuccagccucgguacca

SEQ ID NO: 37741 - RNA, 32 nt, Human
acgagaccuaguuuccaaggaagaacucacug

SEQ ID NO: 37742 - RNA, 32 nt, Human
acgagacggucuucacuguccauuccaacagc

SEQ ID NO: 37743 - RNA, 32 nt, Human
acgagacuagagggagugggguugcaguggcu

SEQ ID NO: 37744 - RNA, 32 nt, Human
acgagacucucuccuccuccucaccucauugu

SEQ ID NO: 37745 - RNA, 32 nt, Human
acgagagagucuuccagguacugauccuguuu

SEQ ID NO: 37746 - RNA, 32 nt, Human
acgagagcagaugcuagauuugcucagugacg

SEQ ID NO: 37747 - RNA, 32 nt, Human
acgagagcuccuccucaggggccuggcacuca

SEQ ID NO: 37748 - RNA, 31 nt, Human
acgagagggacaaucccagcuuccccaacau

SEQ ID NO: 37749 - RNA, 32 nt, Human
acgagaucagccuggccagcacggugaaaccc

SEQ ID NO: 37750 - RNA, 32 nt, Human
acgagaucaggaguucaagaccagccuggcca

SEQ ID NO: 37751 - RNA, 32 nt, Human
acgagaucaggaguuggagaccagccuggcca

SEQ ID NO: 37752 - RNA, 32 nt, Human
acgagaucaguguggacagucuggacuucaac

SEQ ID NO: 37753 - RNA, 32 nt, Human
acgagaucuuccuuccgcucugaggcaacccc

SEQ ID NO: 37754 - RNA, 30 nt, Human
acgagauguucuugcugccucuuccggcug

SEQ ID NO: 37755 - RNA, 32 nt, Human
acgagauucugucuuaaaugaaugagugaaug

SEQ ID NO: 37756 - RNA, 32 nt, Human
acgagcaaaccugaaagcuacucucucagcuu

SEQ ID NO: 37757 - RNA, 32 nt, Human
acgagcacaagacggagguugagguggggcua

SEQ ID NO: 37758 - RNA, 32 nt, Human
acgagcacaggagggagguugagguggggcua

SEQ ID NO: 37759 - RNA, 31 nt, Human
acgagcaccugugaauccacagcagaacagc

SEQ ID NO: 37760 - RNA, 32 nt, Human
acgagcacugggucugcagcuguggggacagg

SEQ ID NO: 37761 - RNA, 32 nt, Human
acgagcagcuccaggcuggaguucugguucuu

SEQ ID NO: 37762 - RNA, 32 nt, Human
acgagcaggaaagcucuggaaaugucuucuug

SEQ ID NO: 37763 - RNA, 32 nt, Human
acgagcaggcccggaagugagcuggaagacag

SEQ ID NO: 37764 - RNA, 32 nt, Human
acgagcaguggaggaaacagccucccaaaagg

SEQ ID NO: 37765 - RNA, 32 nt, Human
acgagcaugaaugccaucaauguaauagacaa

SEQ ID NO: 37766 - RNA, 32 nt, Human
acgagccaaggaguuugagaccagcuugggca

SEQ ID NO: 37767 - RNA, 32 nt, Human
acgagccacauguaggcaguucagaggugcuu

SEQ ID NO: 37768 - RNA, 32 nt, Human
acgagccacgguggcccugccucuccccgcuc

SEQ ID NO: 37769 - RNA, 32 nt, Human
acgagccagggccacacugagcagaaaggaga

SEQ ID NO: 37770 - RNA, 22 nt, Human
acgagcccaagggccacggcug

SEQ ID NO: 37771 - RNA, 20 nt, Human
acgagccccacagggacccu

SEQ ID NO: 37772 - RNA, 32 nt, Human
acgagccccuccaccuugauagcuccuugaua

SEQ ID NO: 37773 - RNA, 32 nt, Human
acgagcccucacccuucuugucuuccuuccca

SEQ ID NO: 37774 - RNA, 19 nt, Human
acgagccugggcaacaugg

SEQ ID NO: 37775 - RNA, 32 nt, Human
acgagccugggguggagaggagggagccggca

SEQ ID NO: 37776 - RNA, 32 nt, Human
acgagcgcucugcuccucuccugggccccugc

SEQ ID NO: 37777 - RNA, 32 nt, Human
acgagcgggcccagggcugagcccagcggcgu

SEQ ID NO: 37778 - RNA, 32 nt, Human
acgagcgucugaagacguccucccgagggcag

SEQ ID NO: 37779 - RNA, 22 nt, Human
acgagcucccggacuccaucca

SEQ ID NO: 37780 - RNA, 24 nt, Human
acgagcugcccgauggccagguca

SEQ ID NO: 37781 - RNA, 32 nt, Human
acgagcuggaggaggagaaggaaggcccggcg

SEQ ID NO: 37782 - RNA, 32 nt, Human
acgaggaaaaggaaagagucucagaguggaac

SEQ ID NO: 37783 - RNA, 32 nt, Human
acgaggaagcaguucaagccgggccuggccua

SEQ ID NO: 37784 - RNA, 32 nt, Human
acgaggaaggagaauacuacagcaaccuggaa

SEQ ID NO: 37785 - RNA, 32 nt, Human
acgaggaagggcagacuggugaaaucgcaaac

SEQ ID NO: 37786 - RNA, 32 nt, Human
acgaggacaaauauggaugagguggagagugg

SEQ ID NO: 37787 - RNA, 20 nt, Human
acgaggacaggacccuuggc

SEQ ID NO: 37788 - RNA, 32 nt, Human
acgaggaccaucgggggcaggucguuggagac

SEQ ID NO: 37789 - RNA, 32 nt, Human
acgaggacugaacaaggugcugucucacugcc

SEQ ID NO: 37790 - RNA, 32 nt, Human
acgaggagacgcgaggaggagggaggaggaag

SEQ ID NO: 37791 - RNA, 32 nt, Human
acgaggagaggcaaugguggucuuggcaacag

SEQ ID NO: 37792 - RNA, 20 nt, Human
acgaggagcgcguagcccac

SEQ ID NO: 37793 - RNA, 32 nt, Human
acgaggaggaggaggaggaagaggggauggag

SEQ ID NO: 37794 - RNA, 32 nt, Human
acgaggaggagguggaggaggagagguggcag

SEQ ID NO: 37795 - RNA, 32 nt, Human
acgaggaggcagcaggagcagugacggugacu

SEQ ID NO: 37796 - RNA, 32 nt, Human
acgaggaggcaggaccucccaccuucaggucu

SEQ ID NO: 37797 - RNA, 32 nt, Human
acgaggaggggcggggcgauagggauccagag

SEQ ID NO: 37798 - RNA, 32 nt, Human
acgaggaucagacggccugaacuccggacugu

SEQ ID NO: 37799 - RNA, 32 nt, Human
acgaggaugaagggaagggagagccagugacg

SEQ ID NO: 37800 - RNA, 32 nt, Human
acgaggaugaggaggaggaaggugaagaggag

SEQ ID NO: 37801 - RNA, 32 nt, Human
acgaggaugagggagaagaauaagcagcugcc

SEQ ID NO: 37802 - RNA, 32 nt, Human
acgaggauuaauuucauuuaucuggaaaauuu

SEQ ID NO: 37803 - RNA, 32 nt, Human
acgaggcaaggagccugcacacugauggagga

SEQ ID NO: 37804 - RNA, 32 nt, Human
acgaggcagcagccugacccaggauggcucua

SEQ ID NO: 37805 - RNA, 32 nt, Human
acgaggcagccuggcccuuaucugcacugggc

SEQ ID NO: 37806 - RNA, 32 nt, Human
acgaggcagcugucccaugcucugcugagcac

SEQ ID NO: 37807 - RNA, 32 nt, Human
acgaggcaggaacuuucgucucugccucucgu

SEQ ID NO: 37808 - RNA, 32 nt, Human
acgaggcaucaguugggaagaggggacgcaca

SEQ ID NO: 37809 - RNA, 32 nt, Human
acgaggcauguggaucaccugaggucgggagu

SEQ ID NO: 37810 - RNA, 32 nt, Human
acgaggccacagcaucuucuacaaaggacuca

SEQ ID NO: 37811 - RNA, 32 nt, Human
acgaggccaccagggugacugcgggauuccga

SEQ ID NO: 37812 - RNA, 32 nt, Human
acgaggccacgagacccacugcuuuuggguau

SEQ ID NO: 37813 - RNA, 32 nt, Human
acgaggccaggagaucaagaccauccuggcua

SEQ ID NO: 37814 - RNA, 23 nt, Human
acgaggccaucagcugccaugca

SEQ ID NO: 37815 - RNA, 32 nt, Human
acgaggcccucgggcccagcccccacagugcu

SEQ ID NO: 37816 - RNA, 24 nt, Human
acgaggccgccugacgccucagca

SEQ ID NO: 37817 - RNA, 32 nt, Human
acgaggcgcugcggcuccaccugaccaguggg

SEQ ID NO: 37818 - RNA, 32 nt, Human
acgaggcgcugcggcuccaccugccagugggu

SEQ ID NO: 37819 - RNA, 32 nt, Human
acgaggcggcuguggcgguggcugaggcggcu

SEQ ID NO: 37820 - RNA, 32 nt, Human
acgaggcuacaaaggcuccgcucacaaaagaa

SEQ ID NO: 37821 - RNA, 32 nt, Human
acgaggcugagguggaaggaucaagugagcgc

SEQ ID NO: 37822 - RNA, 32 nt, Human
acgaggcugccuccagcauuuccugauuuccu

SEQ ID NO: 37823 - RNA, 32 nt, Human
acgaggcugcggcggaggagguggcggcggcc

SEQ ID NO: 37824 - RNA, 32 nt, Human
acgaggcugcugaccagaagagguuuagugcc

SEQ ID NO: 37825 - RNA, 32 nt, Human
acgaggcugcuguuugucuacuuccuccugcu

SEQ ID NO: 37826 - RNA, 32 nt, Human
acgaggcugggccugccucacucuccagggcc

SEQ ID NO: 37827 - RNA, 32 nt, Human
acgaggcuucaggcugagguggcagauaguga

SEQ ID NO: 37828 - RNA, 32 nt, Human
acgaggcuuccgcccuguugugaagugggugu

SEQ ID NO: 37829 - RNA, 32 nt, Human
acgagggagccccagaacagggguccggcggu

SEQ ID NO: 37830 - RNA, 32 nt, Human
acgagggcgagcugagguggaggcaggcugcg

SEQ ID NO: 37831 - RNA, 32 nt, Human
acgagggcgcggcggaggcucccguggccucg

SEQ ID NO: 37832 - RNA, 32 nt, Human
acgaggggagaaaggcaggcagccggcgggcg

SEQ ID NO: 37833 - RNA, 32 nt, Human
acgaggggagcgaagguaggaggcagggcuug

SEQ ID NO: 37834 - RNA, 32 nt, Human
acgaggggaggaggaggaggaggagaggagca

SEQ ID NO: 37835 - RNA, 32 nt, Human
acgaggggaggcacggugcggagagcgucgca

SEQ ID NO: 37836 - RNA, 32 nt, Human
acgaggggaggcugcucugugaaggaaccgcc

SEQ ID NO: 37837 - RNA, 32 nt, Human
acgaggggauggcagaggaggugaggagggag

SEQ ID NO: 37838 - RNA, 32 nt, Human
acgaggggccaggagagcagcagcaucauaag

SEQ ID NO: 37839 - RNA, 31 nt, Human
acgaggggccucucugagggggcugugucug

SEQ ID NO: 37840 - RNA, 32 nt, Human
acgagggucaggaccugcauccugccucagag

SEQ ID NO: 37841 - RNA, 32 nt, Human
acgagggucuagcucuaccacauucaggaggc

SEQ ID NO: 37842 - RNA, 32 nt, Human
acgagggugcuuucacuggucugcaccauggc

SEQ ID NO: 37843 - RNA, 32 nt, Human
acgagggugguguugggccggugcugcugccg

SEQ ID NO: 37844 - RNA, 32 nt, Human
acgagguagggagaucaagaccauccuggcua

SEQ ID NO: 37845 - RNA, 32 nt, Human
acgaggucaagagaucaagaccagccugacca

SEQ ID NO: 37846 - RNA, 32 nt, Human
acgaggucaagagaucaagaccauccuggcca

SEQ ID NO: 37847 - RNA, 32 nt, Human
acgaggucagaagaucaagaccauccuggcca

SEQ ID NO: 37848 - RNA, 32 nt, Human
acgaggucagaaguccaagaccagccuggcca

SEQ ID NO: 37849 - RNA, 32 nt, Human
acgaggucagaaguucaagaccagccuagcca

SEQ ID NO: 37850 - RNA, 32 nt, Human
acgaggucagcaguucgagaccagccugacca

SEQ ID NO: 37851 - RNA, 32 nt, Human
acgaggucaggaauucaagaccagccuggcca

SEQ ID NO: 37852 - RNA, 32 nt, Human
acgaggucaggaauucgagaccagccuggcca

SEQ ID NO: 37853 - RNA, 32 nt, Human
acgaggucaggagaucaagaccauccuggcua

SEQ ID NO: 37854 - RNA, 32 nt, Human
acgaggucaggagaucgagaccagccugacca

SEQ ID NO: 37855 - RNA, 32 nt, Human
acgaggucaggagaucgagaccagccuggcua

SEQ ID NO: 37856 - RNA, 32 nt, Human
acgaggucaggagauggagaccauccuggcua

SEQ ID NO: 37857 - RNA, 32 nt, Human
acgaggucaggaguucaaaaccagccugacca

SEQ ID NO: 37858 - RNA, 32 nt, Human
acgaggucaggaguucaaaaccagccugucca

SEQ ID NO: 37859 - RNA, 32 nt, Human
acgaggucaggaguucaagaccacccuggcca

SEQ ID NO: 37860 - RNA, 32 nt, Human
acgaggucaggaguucaagaccagccuggcca

SEQ ID NO: 37861 - RNA, 32 nt, Human
acgaggucaggaguucaagaccagccuugcca

SEQ ID NO: 37862 - RNA, 32 nt, Human
acgaggucaggaguuccagaccagccuggcca

SEQ ID NO: 37863 - RNA, 32 nt, Human
acgaggucaggaguucgaaaccagccuggcca

SEQ ID NO: 37864 - RNA, 32 nt, Human
acgaggucaggaguucgagaccagccugacca

SEQ ID NO: 37865 - RNA, 32 nt, Human
acgaggucaggaguucgagaccagccugccca

SEQ ID NO: 37866 - RNA, 32 nt, Human
acgaggucaggaguucgagaccagccuggcca

SEQ ID NO: 37867 - RNA, 32 nt, Human
acgaggucaggaguucgagggcagccugacca

SEQ ID NO: 37868 - RNA, 32 nt, Human
acgaggucaggaguuugagaccagccugacca

SEQ ID NO: 37869 - RNA, 32 nt, Human
acgaggucaggaguuugagaccagccugauca

SEQ ID NO: 37870 - RNA, 32 nt, Human
acgaggucaggauauugagaccauccuggcua

SEQ ID NO: 37871 - RNA, 32 nt, Human
acgaggucaggcguuuaagaccagcuugacca

SEQ ID NO: 37872 - RNA, 32 nt, Human
acgaggucagggguucaagaccagccugacca

SEQ ID NO: 37873 - RNA, 32 nt, Human
acgaggucaguaguucgagaccagccugguca

SEQ ID NO: 37874 - RNA, 24 nt, Human
acgaggucuacaaugccauuccca

SEQ ID NO: 37875 - RNA, 32 nt, Human
acgaggucucacuauguugcccaggcuggucu

SEQ ID NO: 37876 - RNA, 32 nt, Human
acgaggucuugcuauguugcccaggcuggucc

SEQ ID NO: 37877 - RNA, 32 nt, Human
acgaggugacacacucaggagacacaggugug

SEQ ID NO: 37878 - RNA, 32 nt, Human
acgagguggaaagggcuccugaagcagcugca

SEQ ID NO: 37879 - RNA, 32 nt, Human
acgaggugggagcggagagggaaggaggagga

SEQ ID NO: 37880 - RNA, 32 nt, Human
acgagguggggaagcugcuaacccgacccgga

SEQ ID NO: 37881 - RNA, 32 nt, Human
acgagguuaggaguucgagaccagccuggcca

SEQ ID NO: 37882 - RNA, 32 nt, Human
acgagguucacugguccgcaggggagggccgg

SEQ ID NO: 37883 - RNA, 32 nt, Human
acgagguuucuugucucucuggcuccaccaga

SEQ ID NO: 37884 - RNA, 32 nt, Human
acgaguaucugaaggcauuuucagcucuagca

SEQ ID NO: 37885 - RNA, 21 nt, Human
acgagucacgcacccccuuca

SEQ ID NO: 37886 - RNA, 32 nt, Human
acgagucauuucugccugacugcuccagcuaa

SEQ ID NO: 37887 - RNA, 32 nt, Human
acgagugacccucaacuuccagccucugagca

SEQ ID NO: 37888 - RNA, 32 nt, Human
acgagugcagcacagucugggaagaaaggcgu

SEQ ID NO: 37889 - RNA, 32 nt, Human
acgagugguaucuugagaaaugggauugugag

SEQ ID NO: 37890 - RNA, 32 nt, Human
acgagugucaaugauugcuggaacaggugggg

SEQ ID NO: 37891 - RNA, 32 nt, Human
acgagugucugucagugagcgggcgggaggaa

SEQ ID NO: 37892 - RNA, 32 nt, Human
acgagugugcgugagugugagccaccuuggca

SEQ ID NO: 37893 - RNA, 29 nt, Human
acgagugugcugucagugccuggccaugu

SEQ ID NO: 37894 - RNA, 32 nt, Human
acgagugugggagagggaggagaggggaucac

SEQ ID NO: 37895 - RNA, 32 nt, Human
acgaguucaagaccagccuggccaaggcggca

SEQ ID NO: 37896 - RNA, 32 nt, Human
acgaguucaggaguucaagaccagccuggcca

SEQ ID NO: 37897 - RNA, 32 nt, Human
acgaguuccagggagcucuguccuggugaccg

SEQ ID NO: 37898 - RNA, 32 nt, Human
acgaguuccccagggcugcacucuagauucca

SEQ ID NO: 37899 - RNA, 32 nt, Human
acgaguucgagaccagccugaccaacauggag

SEQ ID NO: 37900 - RNA, 32 nt, Human
acgaguucuaacucaguggcguuugcccugau

SEQ ID NO: 37901 - RNA, 32 nt, Human
acgaguucugaugaaccauacauaucauuaaa

SEQ ID NO: 37902 - RNA, 32 nt, Human
acgaguucuguucuggccggagcaccagaccc

SEQ ID NO: 37903 - RNA, 32 nt, Human
acgaguuggaucucgaggaaucugcaguggag

SEQ ID NO: 37904 - RNA, 32 nt, Human
acgaguugguuugggagcugccagucuccugg

SEQ ID NO: 37905 - RNA, 32 nt, Human
acgaguuguacucccuccuccuggaagccaag

SEQ ID NO: 37906 - RNA, 32 nt, Human
acgaguuuaagaccagccugggcaacauggug

SEQ ID NO: 37907 - RNA, 32 nt, Human
acgaguuugagaccagccugaccaacguuaag

SEQ ID NO: 37908 - RNA, 32 nt, Human
acgaguuuucaguuguucggcaacaugaggaa

SEQ ID NO: 37909 - RNA, 32 nt, Human
acgauaagccugggaaagggaggcugggugag

SEQ ID NO: 37910 - RNA, 32 nt, Human
acgauaaugauccacgcaaagaggaggaaauu

SEQ ID NO: 37911 - RNA, 32 nt, Human
acgauacagucagcaagaggaagccaggaaug

SEQ ID NO: 37912 - RNA, 32 nt, Human
acgauacagucagcaagaggaagccgggaaug

SEQ ID NO: 37913 - RNA, 32 nt, Human
acgauaggaaggaggaaagaagaaagagaaaa

SEQ ID NO: 37914 - RNA, 32 nt, Human
acgauauaaauacaagauaaauuaucacugga

SEQ ID NO: 37915 - RNA, 32 nt, Human
acgauauacuccugagcuuucacucugcuggc

SEQ ID NO: 37916 - RNA, 32 nt, Human
acgauaucucuagcuccuauaccaccaccacc

SEQ ID NO: 37917 - RNA, 32 nt, Human
acgaucaaagagacaccuggcucaaggaccaa

SEQ ID NO: 37918 - RNA, 32 nt, Human
acgaucaagccacugcacuccagccugggcga

SEQ ID NO: 37919 - RNA, 32 nt, Human
acgaucacaccacugcacucuggccugcaugc

SEQ ID NO: 37920 - RNA, 32 nt, Human
acgaucacggacagguaugcacugguaacaug

SEQ ID NO: 37921 - RNA, 32 nt, Human
acgaucaguccaucccagagggaccggaguua

SEQ ID NO: 37922 - RNA, 32 nt, Human
acgaucaugccacugcacuccacucugggcaa

SEQ ID NO: 37923 - RNA, 32 nt, Human
acgauccucacugcaacauuccuuauccaauc

SEQ ID NO: 37924 - RNA, 32 nt, Human
acgauccucccgccucagccuccgaguagcug

SEQ ID NO: 37925 - RNA, 32 nt, Human
acgauccucuuucugggcauuccuaggggaga

SEQ ID NO: 37926 - RNA, 32 nt, Human
acgauccugcacuccagccugggcaacagaga

SEQ ID NO: 37927 - RNA, 32 nt, Human
acgauccuucugauuuaaguacagcuggaaag

SEQ ID NO: 37928 - RNA, 32 nt, Human
acgaucgaggagagagacaagcggcagcagag

SEQ ID NO: 37929 - RNA, 32 nt, Human
acgaucgcaccacugcauucuagccuuaguga

SEQ ID NO: 37930 - RNA, 32 nt, Human
acgaucgcuugagccuuggaggcggagguugc

SEQ ID NO: 37931 - RNA, 32 nt, Human
acgaucguaccacuacacuccagccugggcaa

SEQ ID NO: 37932 - RNA, 32 nt, Human
acgaucuagcugugcaaaggcauuucaaagaa

SEQ ID NO: 37933 - RNA, 32 nt, Human
acgaucugaagugggguccccaacaagaucag

SEQ ID NO: 37934 - RNA, 32 nt, Human
acgaucugcaaacuccgccuccuggguucaag

SEQ ID NO: 37935 - RNA, 32 nt, Human
acgaucuggaugaagagagagggggugagaga

SEQ ID NO: 37936 - RNA, 32 nt, Human
acgaucugggcuuugucaugguguuuuacguu

SEQ ID NO: 37937 - RNA, 32 nt, Human
acgaucuugcucccaggaccugccucuuccca

SEQ ID NO: 37938 - RNA, 32 nt, Human
acgaugaaaugcucccuccacugccgggccuu

SEQ ID NO: 37939 - RNA, 32 nt, Human
acgaugaacuauacauauuuguauuucuacuu

SEQ ID NO: 37940 - RNA, 32 nt, Human
acgaugacaaacacacauuacacacacaacau

SEQ ID NO: 37941 - RNA, 32 nt, Human
acgaugacaaacacacauuacacacacaucac

SEQ ID NO: 37942 - RNA, 32 nt, Human
acgaugacacacaaguucaugaaacauuucac

SEQ ID NO: 37943 - RNA, 28 nt, Human
acgaugacagaaaaggaggugcuggagu

SEQ ID NO: 37944 - RNA, 24 nt, Human
acgaugacugaaggcuccuuugac

SEQ ID NO: 37945 - RNA, 32 nt, Human
acgaugagcuuuucacaucaccuuuaugguuu

SEQ ID NO: 37946 - RNA, 32 nt, Human
acgaugaggucccagaggaggggccgggggcc

SEQ ID NO: 37947 - RNA, 32 nt, Human
acgaugcacccaccgcccugagggcccguccu

SEQ ID NO: 37948 - RNA, 32 nt, Human
acgaugccaucgucuguccaggaaaagaaagg

SEQ ID NO: 37949 - RNA, 32 nt, Human
acgaugcccccaggaaccucagcccgggugcu

SEQ ID NO: 37950 - RNA, 32 nt, Human
acgaugcccugccuuuuacuagcuacuuuaga

SEQ ID NO: 37951 - RNA, 32 nt, Human
acgaugcggggcugugugccggccuucuugcu

SEQ ID NO: 37952 - RNA, 20 nt, Human
acgaugcuacaaaagaaauu

SEQ ID NO: 37953 - RNA, 32 nt, Human
acgauggcagugcagucaucaucuucaggaug

SEQ ID NO: 37954 - RNA, 28 nt, Human
acgauggcggaggaagaaggaccaccug

SEQ ID NO: 37955 - RNA, 28 nt, Human
acgaugggggccaggacaccuuugccuu

SEQ ID NO: 37956 - RNA, 28 nt, Human
acgaugguggaccacuuggccaacacgg

SEQ ID NO: 37957 - RNA, 32 nt, Human
acgaugucaggaguucgagaccagccuggcca

SEQ ID NO: 37958 - RNA, 21 nt, Human
acgauguggcugcccggcaga

SEQ ID NO: 37959 - RNA, 32 nt, Human
acgaugugggguguggaggaggagaacaggcc

SEQ ID NO: 37960 - RNA, 32 nt, Human
acgauguuugaaaaucaacacauaacugaaau

SEQ ID NO: 37961 - RNA, 32 nt, Human
acgauguuuggcuaugugugugugcaugugug

SEQ ID NO: 37962 - RNA, 32 nt, Human
acgauuaauggaagcccaggaggaaagacuug

SEQ ID NO: 37963 - RNA, 32 nt, Human
acgauucugcccaguguccucagucugucccc

SEQ ID NO: 37964 - RNA, 32 nt, Human
acgauugaaaugaaaucacauaguucgugcuc

SEQ ID NO: 37965 - RNA, 32 nt, Human
acgauugcaccacuucaucccagccugggaga

SEQ ID NO: 37966 - RNA, 32 nt, Human
acgauugcagagccuuggggugcccggugcgg

SEQ ID NO: 37967 - RNA, 20 nt, Human
acgauuggaaacuacauuua

SEQ ID NO: 37968 - RNA, 32 nt, Human
acgauuggccagacaucaccucagaucugaga

SEQ ID NO: 37969 - RNA, 32 nt, Human
acgauuuccacugggaagagacaggaauucua

SEQ ID NO: 37970 - RNA, 32 nt, Human
acgauuugagacaacuuguuguauugagggac

SEQ ID NO: 37971 - RNA, 32 nt, Human
acgauuuguguaucuuuuuguuuuugguugug

SEQ ID NO: 37972 - RNA, 32 nt, Human
acgcaaauaagaaaccaagggauaaaacuguu

SEQ ID NO: 37973 - RNA, 32 nt, Human
acgcaacacaggcuacacagaugagaaaaugg

SEQ ID NO: 37974 - RNA, 32 nt, Human
acgcaaccaggaugugggagccgguacaaggc

SEQ ID NO: 37975 - RNA, 32 nt, Human
acgcaacccuuccaucagugucuuccagccug

SEQ ID NO: 37976 - RNA, 32 nt, Human
acgcaaccgccaggaggaaaggcgggacacag

SEQ ID NO: 37977 - RNA, 32 nt, Human
acgcaacuuugcuauauuucucuccaacaagg

SEQ ID NO: 37978 - RNA, 32 nt, Human
acgcaagagguuucagcauucccaauuaucaa

SEQ ID NO: 37979 - RNA, 32 nt, Human
acgcaagcacgccuuaaacacacagauauaga

SEQ ID NO: 37980 - RNA, 32 nt, Human
acgcaagccuuaaaauuuuucuuaagacagag

SEQ ID NO: 37981 - RNA, 32 nt, Human
acgcaagugaagccgagucacaggacccggau

SEQ ID NO: 37982 - RNA, 32 nt, Human
acgcaaguucccaguuggagcuccagccugac

SEQ ID NO: 37983 - RNA, 32 nt, Human
acgcaaguucccaguuggagcugcagccuaac

SEQ ID NO: 37984 - RNA, 32 nt, Human
acgcaauccuccugccacagcuucccaaguag

SEQ ID NO: 37985 - RNA, 32 nt, Human
acgcaaucgauggauuguguccuaggaagacu

SEQ ID NO: 37986 - RNA, 32 nt, Human
acgcacaauggcacgugugcgcuuauugucuc

SEQ ID NO: 37987 - RNA, 32 nt, Human
acgcacacaccacacacauacacacacgcauu

SEQ ID NO: 37988 - RNA, 32 nt, Human
acgcacacagaagccugcuggaagacaggucu

SEQ ID NO: 37989 - RNA, 32 nt, Human
acgcacacaugcacgcacacacacauaugggg

SEQ ID NO: 37990 - RNA, 32 nt, Human
acgcacagaggcugggcugcgguccagaugcg

SEQ ID NO: 37991 - RNA, 32 nt, Human
acgcacagccaaggacuccaaaaucacaacag

SEQ ID NO: 37992 - RNA, 17 nt, Human
acgcacauauauacaca

SEQ ID NO: 37993 - RNA, 32 nt, Human
acgcacaucccaugagagugcauaccagggag

SEQ ID NO: 37994 - RNA, 32 nt, Human
acgcaccacaaacacaugcgcaggcuccugca

SEQ ID NO: 37995 - RNA, 32 nt, Human
acgcaccaccuugcccugcauuuccccggcuu

SEQ ID NO: 37996 - RNA, 32 nt, Human
acgcaccagcagccgccuccaugcccuagguu

SEQ ID NO: 37997 - RNA, 32 nt, Human
acgcaccaguagucccagcuacucgggaggcu

SEQ ID NO: 37998 - RNA, 32 nt, Human
acgcaccauuuugucaggugggagauuuggaa

SEQ ID NO: 37999 - RNA, 32 nt, Human
acgcacccccacugcuguuuucacauccuuuc

SEQ ID NO: 38000 - RNA, 32 nt, Human
acgcaccccggcgauuuuugcgcaccgggagc

SEQ ID NO: 38001 - RNA, 32 nt, Human
acgcaccccuucccccgugugaacacgaguga

SEQ ID NO: 38002 - RNA, 32 nt, Human
acgcaccccuugcuugccaaauugcaggcaag

SEQ ID NO: 38003 - RNA, 32 nt, Human
acgcacccgcagggaggguggggagagcuggc

SEQ ID NO: 38004 - RNA, 32 nt, Human
acgcacccguaguuccagcuacuugggaggcu

SEQ ID NO: 38005 - RNA, 32 nt, Human
acgcacccuccaggaugcucgcugggauuccc

SEQ ID NO: 38006 - RNA, 32 nt, Human
acgcaccuauagucccagcuacucgggagucu

SEQ ID NO: 38007 - RNA, 32 nt, Human
acgcaccuccccuccgcuuguggccauguacc

SEQ ID NO: 38008 - RNA, 32 nt, Human
acgcaccugcaagcuuugcucuagggauugaa

SEQ ID NO: 38009 - RNA, 32 nt, Human
acgcaccugcagucccagcuacuugggaggcu

SEQ ID NO: 38010 - RNA, 32 nt, Human
acgcaccugcauucccagcuacuugggaggcu

SEQ ID NO: 38011 - RNA, 32 nt, Human
acgcaccuguaaucccagcuacucaggaggcc

SEQ ID NO: 38012 - RNA, 32 nt, Human
acgcaccuguaaucccagcuacucgggaggcu

SEQ ID NO: 38013 - RNA, 32 nt, Human
acgcaccuguaaucccagcugcucuggaggcu

SEQ ID NO: 38014 - RNA, 32 nt, Human
acgcaccuguagucccagcuacucgggaggcu

SEQ ID NO: 38015 - RNA, 32 nt, Human
acgcaccugugaucccagcuacuuaggagguu

SEQ ID NO: 38016 - RNA, 32 nt, Human
acgcaccuuagaggagugggaaaggccaccag

SEQ ID NO: 38017 - RNA, 32 nt, Human
acgcaccuugcugcaguguccagaagcggccu

SEQ ID NO: 38018 - RNA, 32 nt, Human
acgcacgcacacacacauacagagcucucuga

SEQ ID NO: 38019 - RNA, 32 nt, Human
acgcacgcacacacgaugcacacgcaugcaca

SEQ ID NO: 38020 - RNA, 32 nt, Human
acgcacgcacacacucuuacacgagagcacac

SEQ ID NO: 38021 - RNA, 32 nt, Human
acgcacguguaguuccagcuacucaggaagcu

SEQ ID NO: 38022 - RNA, 32 nt, Human
acgcacuccagccugggcgacagagcgagacc

SEQ ID NO: 38023 - RNA, 32 nt, Human
acgcacuccagccugggugacagagcgagacu

SEQ ID NO: 38024 - RNA, 19 nt, Human
acgcacucuggccugcaug

SEQ ID NO: 38025 - RNA, 32 nt, Human
acgcacugacacugcccaggccaagcaaaagc

SEQ ID NO: 38026 - RNA, 32 nt, Human
acgcacugcagaauuuguuuauccugcucuuu

SEQ ID NO: 38027 - RNA, 32 nt, Human
acgcacugcagccucuaccuccugggcucaag

SEQ ID NO: 38028 - RNA, 32 nt, Human
acgcacugcauggucuguuuauucucuaauuc

SEQ ID NO: 38029 - RNA, 31 nt, Human
acgcacugccucucuaagcuggccucagguu

SEQ ID NO: 38030 - RNA, 32 nt, Human
acgcacugucacaccucugcauuuccagcccc

SEQ ID NO: 38031 - RNA, 32 nt, Human
acgcacuucgggaggucgaggcaggaggauca

SEQ ID NO: 38032 - RNA, 32 nt, Human
acgcacuugaucccaugcucccagccucuguu

SEQ ID NO: 38033 - RNA, 32 nt, Human
acgcacuuucagggauguggucagauucgagg

SEQ ID NO: 38034 - RNA, 32 nt, Human
acgcagaagguauucauuuuuccuaguauuug

SEQ ID NO: 38035 - RNA, 32 nt, Human
acgcagacacacacaaauauacgcauauggac

SEQ ID NO: 38036 - RNA, 32 nt, Human
acgcagacagcaaaagcuaaaucagcaugaca

SEQ ID NO: 38037 - RNA, 32 nt, Human
acgcagaccaguacuggaguucguggugcugg

SEQ ID NO: 38038 - RNA, 32 nt, Human
acgcagagccccggagcaccacggggucgggg

SEQ ID NO: 38039 - RNA, 32 nt, Human
acgcagaggcagugucaugaggggacacgugg

SEQ ID NO: 38040 - RNA, 32 nt, Human
acgcagagguccaacuugccacccgcgucccu

SEQ ID NO: 38041 - RNA, 32 nt, Human
acgcagauagaagauccaagaaaacaauggag

SEQ ID NO: 38042 - RNA, 32 nt, Human
acgcagcaaagagaggagagaccccaagucag

SEQ ID NO: 38043 - RNA, 32 nt, Human
acgcagcacagcaucagacagcucugucacgg

SEQ ID NO: 38044 - RNA, 32 nt, Human
acgcagcacagcccuccagcuggggucaggug

SEQ ID NO: 38045 - RNA, 32 nt, Human
acgcagcaccuuggaaguuguuuucaaccaua

SEQ ID NO: 38046 - RNA, 32 nt, Human
acgcagcacucccaugucugccgguuccccug

SEQ ID NO: 38047 - RNA, 32 nt, Human
acgcagcagcaaccuugggcuuccugcggggu

SEQ ID NO: 38048 - RNA, 32 nt, Human
acgcagcagcaccccagcuagggauagggcuc

SEQ ID NO: 38049 - RNA, 19 nt, Human
acgcagcaggcucugggug

SEQ ID NO: 38050 - RNA, 20 nt, Human
acgcagcagguaucugggug

SEQ ID NO: 38051 - RNA, 32 nt, Human
acgcagcauguggcuucauugaggcaguugau

SEQ ID NO: 38052 - RNA, 23 nt, Human
acgcagcccaucuucaugucauc

SEQ ID NO: 38053 - RNA, 32 nt, Human
acgcagccccaucccacacacacaggcccggu

SEQ ID NO: 38054 - RNA, 26 nt, Human
acgcagccgcuccgggagccagggaa

SEQ ID NO: 38055 - RNA, 32 nt, Human
acgcagccuauagguccgcaggccaguccucc

SEQ ID NO: 38056 - RNA, 32 nt, Human
acgcagccuggguggcagagggcagggucauc

SEQ ID NO: 38057 - RNA, 32 nt, Human
acgcagccugggugggugaggggagagacggu

SEQ ID NO: 38058 - RNA, 32 nt, Human
acgcagcuccacccucaccacuagcccacccu

SEQ ID NO: 38059 - RNA, 32 nt, Human
acgcagcuggagcagggcugagcccaggagca

SEQ ID NO: 38060 - RNA, 32 nt, Human
acgcagcugggaacaugugcaggcugaugaag

SEQ ID NO: 38061 - RNA, 32 nt, Human
acgcagcugggugcagaagcuguggggucgga

SEQ ID NO: 38062 - RNA, 32 nt, Human
acgcagcuuuuagguuuguuugaauaagagau

SEQ ID NO: 38063 - RNA, 32 nt, Human
acgcaggaaacuauggcugagcacggggcuca

SEQ ID NO: 38064 - RNA, 32 nt, Human
acgcaggaagugagugguugagccagaaugaa

SEQ ID NO: 38065 - RNA, 32 nt, Human
acgcaggacagaguggacucugccugugaugg

SEQ ID NO: 38066 - RNA, 32 nt, Human
acgcaggacaggcaggagagauucuuccuaaa

SEQ ID NO: 38067 - RNA, 32 nt, Human
acgcaggacgccgccucacgcaagccgggaca

SEQ ID NO: 38068 - RNA, 32 nt, Human
acgcaggagcugcugcugcaguugcagaagga

SEQ ID NO: 38069 - RNA, 32 nt, Human
acgcaggagcuguggaaauggugagcgcugug

SEQ ID NO: 38070 - RNA, 32 nt, Human
acgcaggaggcugaggcugcagugaguuguga

SEQ ID NO: 38071 - RNA, 32 nt, Human
acgcaggaggggccgacguuucccuggcgugc

SEQ ID NO: 38072 - RNA, 32 nt, Human
acgcaggcacucacauucacacacauacacac

SEQ ID NO: 38073 - RNA, 32 nt, Human
acgcaggcagaacuccuuauugugggacuuga

SEQ ID NO: 38074 - RNA, 32 nt, Human
acgcaggcaggcggcgggcagcgggaggcggc

SEQ ID NO: 38075 - RNA, 32 nt, Human
acgcaggccaggagucuucacacucaggcacc

SEQ ID NO: 38076 - RNA, 32 nt, Human
acgcaggccuccauaacaauuauuucagugca

SEQ ID NO: 38077 - RNA, 32 nt, Human
acgcaggcguggagugcagcgucugcccggaa

SEQ ID NO: 38078 - RNA, 32 nt, Human
acgcaggcugccaggcuggcguacaguggcgc

SEQ ID NO: 38079 - RNA, 32 nt, Human
acgcagggaggguggagguguccugaggcuga

SEQ ID NO: 38080 - RNA, 32 nt, Human
acgcagggcucucccaaguucccaccgagccg

SEQ ID NO: 38081 - RNA, 32 nt, Human
acgcaggggagaagaaggggaaagaggcuugu

SEQ ID NO: 38082 - RNA, 32 nt, Human
acgcagggggcucggaggacucaggccgcagc

SEQ ID NO: 38083 - RNA, 32 nt, Human
acgcagguggcugaagcagaagaaucacuuga

SEQ ID NO: 38084 - RNA, 32 nt, Human
acgcagguggugagccuuaaggacaagcuaga

SEQ ID NO: 38085 - RNA, 32 nt, Human
acgcaguaaggucugugcugggccaagagcag

SEQ ID NO: 38086 - RNA, 19 nt, Human
acgcagucccgggccucca

SEQ ID NO: 38087 - RNA, 32 nt, Human
acgcagucucauuugaccccuuugcuuccaga

SEQ ID NO: 38088 - RNA, 32 nt, Human
acgcagugcagagccccaaagcucaggcuauu

SEQ ID NO: 38089 - RNA, 24 nt, Human
acgcaguggcucacgccuguaauc

SEQ ID NO: 38090 - RNA, 24 nt, Human
acgcaguggcucaugccuguaauc

SEQ ID NO: 38091 - RNA, 32 nt, Human
acgcaguguaaacccaguggcuucucugaccu

SEQ ID NO: 38092 - RNA, 32 nt, Human
acgcagugugacccucaaaaagcuuuuagccu

SEQ ID NO: 38093 - RNA, 32 nt, Human
acgcaguucuuuccaugggcauagguaagcug

SEQ ID NO: 38094 - RNA, 32 nt, Human
acgcauacacacacagacacacagaugugggg

SEQ ID NO: 38095 - RNA, 32 nt, Human
acgcauccgccccaggacuggagcucacacug

SEQ ID NO: 38096 - RNA, 32 nt, Human
acgcauccugugucccugucucuguagcuccu

SEQ ID NO: 38097 - RNA, 32 nt, Human
acgcaucucuacuccucugcgugagugcgugu

SEQ ID NO: 38098 - RNA, 32 nt, Human
acgcaucuguggucccagcuacucgggagacu

SEQ ID NO: 38099 - RNA, 32 nt, Human
acgcaugcacacacacaaagccuuaagcagaa

SEQ ID NO: 38100 - RNA, 32 nt, Human
acgcaugcacacacacauucaguauuuuaaaa

SEQ ID NO: 38101 - RNA, 32 nt, Human
acgcaugcacacacgcacacaugcacacacac

SEQ ID NO: 38102 - RNA, 32 nt, Human
acgcaugcacacacgugcgcacgcacacacac

SEQ ID NO: 38103 - RNA, 32 nt, Human
acgcaugccuguaaucccagcuacucgggagg

SEQ ID NO: 38104 - RNA, 32 nt, Human
acgcauguauaugcaucaccacguagccagga

SEQ ID NO: 38105 - RNA, 32 nt, Human
acgcaugugcaggggacccaagcugggaggua

SEQ ID NO: 38106 - RNA, 32 nt, Human
acgcaugugccaugugugcagauauguaucgu

SEQ ID NO: 38107 - RNA, 32 nt, Human
acgcauguggcuccagcccggccuggccgcca

SEQ ID NO: 38108 - RNA, 32 nt, Human
acgcauguugacugagaccuagagucauggau

SEQ ID NO: 38109 - RNA, 32 nt, Human
acgcauucuacagaacacagguuccaggaggc

SEQ ID NO: 38110 - RNA, 32 nt, Human
acgcauugccacggaaacauacagaggaugcc

SEQ ID NO: 38111 - RNA, 32 nt, Human
acgcauugggcuuuagcuguuuuucucauuug

SEQ ID NO: 38112 - RNA, 32 nt, Human
acgccaagaaaaucacugacgaccucucggca

SEQ ID NO: 38113 - RNA, 32 nt, Human
acgccaagaaggagaaccuacucuccacucuu

SEQ ID NO: 38114 - RNA, 32 nt, Human
acgccaagauggcgccacuacacuccagccug

SEQ ID NO: 38115 - RNA, 19 nt, Human
acgccaagccugacuuuaa

SEQ ID NO: 38116 - RNA, 32 nt, Human
acgccaaggcuucuuacugguccuccucuugu

SEQ ID NO: 38117 - RNA, 24 nt, Human
acgccaaguuguccgagcuggagg

SEQ ID NO: 38118 - RNA, 32 nt, Human
acgccaaucccaaaggcaugcagauggcugug

SEQ ID NO: 38119 - RNA, 32 nt, Human
acgccacagcacuccagccugggcgacagagu

SEQ ID NO: 38120 - RNA, 19 nt, Human
acgccacagcuggcugcug

SEQ ID NO: 38121 - RNA, 32 nt, Human
acgccaccacaguggccguggcgcauggcugc

SEQ ID NO: 38122 - RNA, 32 nt, Human
acgccaccaccaggagagaggcagaggggcug

SEQ ID NO: 38123 - RNA, 32 nt, Human
acgccaccacugggaagguugugugcaggaac

SEQ ID NO: 38124 - RNA, 32 nt, Human
acgccaccaugcagugcagacuacccauugaa

SEQ ID NO: 38125 - RNA, 32 nt, Human
acgccaccauucagucaccagacugggugccc

SEQ ID NO: 38126 - RNA, 19 nt, Human
acgccacccccacccgccu

SEQ ID NO: 38127 - RNA, 32 nt, Human
acgccaccguggaaguggaugugcaggugccu

SEQ ID NO: 38128 - RNA, 32 nt, Human
acgccacuacacuccagccugggcaacagagg

SEQ ID NO: 38129 - RNA, 32 nt, Human
acgccacuacacuccagccugggcgacagagc

SEQ ID NO: 38130 - RNA, 32 nt, Human
acgccacucacugccuccuuccuccugguguu

SEQ ID NO: 38131 - RNA, 32 nt, Human
acgccacugaacuccagccugggagacagcaa

SEQ ID NO: 38132 - RNA, 32 nt, Human
acgccacugaacuccagccugggugacagagu

SEQ ID NO: 38133 - RNA, 32 nt, Human
acgccacugcaacuccagcuugggugacagag

SEQ ID NO: 38134 - RNA, 32 nt, Human
acgccacugcacuaaugucuggugacagaguu

SEQ ID NO: 38135 - RNA, 32 nt, Human
acgccacugcacuacagccuggacgacagagc

SEQ ID NO: 38136 - RNA, 32 nt, Human
acgccacugcacuauagccuaggugacagagu

SEQ ID NO: 38137 - RNA, 32 nt, Human
acgccacugcacucaagccugggcgacagagc

SEQ ID NO: 38138 - RNA, 32 nt, Human
acgccacugcacuccaaccugggugacagagc

SEQ ID NO: 38139 - RNA, 32 nt, Human
acgccacugcacuccaacuugggcaacagaca

SEQ ID NO: 38140 - RNA, 32 nt, Human
acgccacugcacuccaccugggcaacaagaac

SEQ ID NO: 38141 - RNA, 32 nt, Human
acgccacugcacuccagcacccugggcgacag

SEQ ID NO: 38142 - RNA, 32 nt, Human
acgccacugcacuccagcccgggcgacaguuc

SEQ ID NO: 38143 - RNA, 32 nt, Human
acgccacugcacuccagcccgggcggcagagg

SEQ ID NO: 38144 - RNA, 32 nt, Human
acgccacugcacuccagcccggggacagagca

SEQ ID NO: 38145 - RNA, 32 nt, Human
acgccacugcacuccagcccgggugacagagc

SEQ ID NO: 38146 - RNA, 32 nt, Human
acgccacugcacuccagccuaggcgacagagc

SEQ ID NO: 38147 - RNA, 32 nt, Human
acgccacugcacuccagccucggugacagagc

SEQ ID NO: 38148 - RNA, 32 nt, Human
acgccacugcacuccagccugagugacagagc

SEQ ID NO: 38149 - RNA, 32 nt, Human
acgccacugcacuccagccugcggacagacca

SEQ ID NO: 38150 - RNA, 32 nt, Human
acgccacugcacuccagccuggacaacagagu

SEQ ID NO: 38151 - RNA, 32 nt, Human
acgccacugcacuccagccuggaggccagagu

SEQ ID NO: 38152 - RNA, 32 nt, Human
acgccacugcacuccagccuggaugacagagc

SEQ ID NO: 38153 - RNA, 32 nt, Human
acgccacugcacuccagccuggcgacagagcg

SEQ ID NO: 38154 - RNA, 32 nt, Human
acgccacugcacuccagccugggagacagagc

SEQ ID NO: 38155 - RNA, 32 nt, Human
acgccacugcacuccagccugggagacagagu

SEQ ID NO: 38156 - RNA, 32 nt, Human
acgccacugcacuccagccugggcaacaagag

SEQ ID NO: 38157 - RNA, 32 nt, Human
acgccacugcacuccagccugggcaacacagc

SEQ ID NO: 38158 - RNA, 32 nt, Human
acgccacugcacuccagccugggcaacagaga

SEQ ID NO: 38159 - RNA, 32 nt, Human
acgccacugcacuccagccugggcaacagagc

SEQ ID NO: 38160 - RNA, 32 nt, Human
acgccacugcacuccagccugggcaacagagu

SEQ ID NO: 38161 - RNA, 32 nt, Human
acgccacugcacuccagccugggcaacaguga

SEQ ID NO: 38162 - RNA, 32 nt, Human
acgccacugcacuccagccugggcaacggauu

SEQ ID NO: 38163 - RNA, 32 nt, Human
acgccacugcacuccagccugggccacagaau

SEQ ID NO: 38164 - RNA, 32 nt, Human
acgccacugcacuccagccugggcgacagaau

SEQ ID NO: 38165 - RNA, 32 nt, Human
acgccacugcacuccagccugggcgacagaga

SEQ ID NO: 38166 - RNA, 32 nt, Human
acgccacugcacuccagccugggcgacagagc

SEQ ID NO: 38167 - RNA, 32 nt, Human
acgccacugcacuccagccugggcgacagagu

SEQ ID NO: 38168 - RNA, 32 nt, Human
acgccacugcacuccagccugggcgacaguga

SEQ ID NO: 38169 - RNA, 32 nt, Human
acgccacugcacuccagccugggcgauggagc

SEQ ID NO: 38170 - RNA, 32 nt, Human
acgccacugcacuccagccugggcugcagggu

SEQ ID NO: 38171 - RNA, 32 nt, Human
acgccacugcacuccagccuggguaacaagag

SEQ ID NO: 38172 - RNA, 32 nt, Human
acgccacugcacuccagccuggguaacagagc

SEQ ID NO: 38173 - RNA, 32 nt, Human
acgccacugcacuccagccugggugacagaac

SEQ ID NO: 38174 - RNA, 32 nt, Human
acgccacugcacuccagccugggugacagaga

SEQ ID NO: 38175 - RNA, 32 nt, Human
acgccacugcacuccagccugggugacagagc

SEQ ID NO: 38176 - RNA, 32 nt, Human
acgccacugcacuccagccugggugacagagu

SEQ ID NO: 38177 - RNA, 32 nt, Human
acgccacugcacuccagccugggugacaguga

SEQ ID NO: 38178 - RNA, 32 nt, Human
acgccacugcacuccagccugggugacggagc

SEQ ID NO: 38179 - RNA, 32 nt, Human
acgccacugcacuccagccuggucaacagagu

SEQ ID NO: 38180 - RNA, 32 nt, Human
acgccacugcacuccagccuggugacagagca

SEQ ID NO: 38181 - RNA, 32 nt, Human
acgccacugcacuccagccuggugacagcgug

SEQ ID NO: 38182 - RNA, 32 nt, Human
acgccacugcacuccagccuguugacaaagca

SEQ ID NO: 38183 - RNA, 32 nt, Human
acgccacugcacuccagcgugggcaacagagc

SEQ ID NO: 38184 - RNA, 32 nt, Human
acgccacugcacuccagcuggagugacagagc

SEQ ID NO: 38185 - RNA, 32 nt, Human
acgccacugcacuccagcuugggugacaaagu

SEQ ID NO: 38186 - RNA, 32 nt, Human
acgccacugcacuccagucugggugacagaga

SEQ ID NO: 38187 - RNA, 32 nt, Human
acgccacugcacuccaguguaggcaacagagu

SEQ ID NO: 38188 - RNA, 32 nt, Human
acgccacugcacuccauccagccugggugaca

SEQ ID NO: 38189 - RNA, 32 nt, Human
acgccacugcacucuagccuaggcgacagagu

SEQ ID NO: 38190 - RNA, 32 nt, Human
acgccacugcacucuagccugggauacagagc

SEQ ID NO: 38191 - RNA, 32 nt, Human
acgccacugcacucuagccugggcaacaagag

SEQ ID NO: 38192 - RNA, 32 nt, Human
acgccacugcacucuagccugggcaauaagag

SEQ ID NO: 38193 - RNA, 32 nt, Human
acgccacugcacuugagccugggcgacacagc

SEQ ID NO: 38194 - RNA, 32 nt, Human
acgccacugcauuccagccugggcgacagagc

SEQ ID NO: 38195 - RNA, 32 nt, Human
acgccacugcauuccagccuggugacagagcg

SEQ ID NO: 38196 - RNA, 32 nt, Human
acgccacugcauuccagccugugcgacagaau

SEQ ID NO: 38197 - RNA, 32 nt, Human
acgccacugcccuccagccuggggagacagag

SEQ ID NO: 38198 - RNA, 32 nt, Human
acgccacugcgcuccagccugggcgaaagagu

SEQ ID NO: 38199 - RNA, 32 nt, Human
acgccacuguacuccagccuggaugacacagc

SEQ ID NO: 38200 - RNA, 32 nt, Human
acgccacuguacuccagccugggagacacagu

SEQ ID NO: 38201 - RNA, 32 nt, Human
acgccacuguacuucuagccuggguuacagag

SEQ ID NO: 38202 - RNA, 32 nt, Human
acgccacugugcuccagccugggcaacaaagu

SEQ ID NO: 38203 - RNA, 32 nt, Human
acgccagaacuccaggcaguggccugagcugu

SEQ ID NO: 38204 - RNA, 32 nt, Human
acgccagaaucuggccggguucugagcuuguu

SEQ ID NO: 38205 - RNA, 32 nt, Human
acgccagagccagcaggggcuguuucgggccg

SEQ ID NO: 38206 - RNA, 32 nt, Human
acgccagagucccagcccuggaaccguucaga

SEQ ID NO: 38207 - RNA, 32 nt, Human
acgccagauccucugucccaccccaggccuug

SEQ ID NO: 38208 - RNA, 26 nt, Human
acgccagccuggccaacauggugaaa

SEQ ID NO: 38209 - RNA, 32 nt, Human
acgccaggaaugcugcacgcugggcagucccu

SEQ ID NO: 38210 - RNA, 32 nt, Human
acgccaggacagacgauggcagaggagagggc

SEQ ID NO: 38211 - RNA, 32 nt, Human
acgccaggaggaggacacggccgccgagagca

SEQ ID NO: 38212 - RNA, 30 nt, Human
acgccaggcgagcccagggcacagaugcug

SEQ ID NO: 38213 - RNA, 32 nt, Human
acgccagggcagcagccguugcucagagagaa

SEQ ID NO: 38214 - RNA, 32 nt, Human
acgccaguaauugauugauaacaggaagcuau

SEQ ID NO: 38215 - RNA, 32 nt, Human
acgccagugcacuccagccugagagacagagu

SEQ ID NO: 38216 - RNA, 32 nt, Human
acgccauagcaauugcacuccggccugggcaa

SEQ ID NO: 38217 - RNA, 32 nt, Human
acgccaucacugcugguggugaggaaauggug

SEQ ID NO: 38218 - RNA, 32 nt, Human
acgccauccuccugccucagcuacucaggaga

SEQ ID NO: 38219 - RNA, 32 nt, Human
acgccaucuccacucuuguggucaucauggcc

SEQ ID NO: 38220 - RNA, 32 nt, Human
acgccauuacacuccagccuggcugacagugc

SEQ ID NO: 38221 - RNA, 32 nt, Human
acgccauuacacuccagccugggcaacagagc

SEQ ID NO: 38222 - RNA, 32 nt, Human
acgccauucuccugccucagcuacucaggagg

SEQ ID NO: 38223 - RNA, 32 nt, Human
acgccauugaguugagcuggccuagcgaugga

SEQ ID NO: 38224 - RNA, 32 nt, Human
acgccauugcacuccaaccugggugacaagag

SEQ ID NO: 38225 - RNA, 32 nt, Human
acgccauugcacuccagccuaggcaacgagag

SEQ ID NO: 38226 - RNA, 32 nt, Human
acgccauugcacuccagccuaggcaauaagag

SEQ ID NO: 38227 - RNA, 32 nt, Human
acgccauugcacuccagccuaggcgacagagu

SEQ ID NO: 38228 - RNA, 32 nt, Human
acgccauugcacuccagccugggcaacaagag

SEQ ID NO: 38229 - RNA, 32 nt, Human
acgccauugcacuccagccugggcaacaagcg

SEQ ID NO: 38230 - RNA, 32 nt, Human
acgccauugcacuccagccugggcaacagagc

SEQ ID NO: 38231 - RNA, 32 nt, Human
acgccauugcacuccagccugggcaacagagu

SEQ ID NO: 38232 - RNA, 32 nt, Human
acgccauugcacuccagccugggcaacagugu

SEQ ID NO: 38233 - RNA, 32 nt, Human
acgccauugcacuccagccugggcaacgagag

SEQ ID NO: 38234 - RNA, 32 nt, Human
acgccauugcacuccagccugggcaauaagag

SEQ ID NO: 38235 - RNA, 32 nt, Human
acgccauugcacuccagccugggcgacagagu

SEQ ID NO: 38236 - RNA, 32 nt, Human
acgccauugcacuccagccugggggacagagc

SEQ ID NO: 38237 - RNA, 32 nt, Human
acgccauugcacuccagccugggugacaagag

SEQ ID NO: 38238 - RNA, 32 nt, Human
acgccauugcacuccagccugggugacacagu

SEQ ID NO: 38239 - RNA, 32 nt, Human
acgccauugcacuccagccugggugacagaac

SEQ ID NO: 38240 - RNA, 32 nt, Human
acgccauugcacuccagccugggugacagagu

SEQ ID NO: 38241 - RNA, 32 nt, Human
acgccauugcacuccagccugggugagaagag

SEQ ID NO: 38242 - RNA, 32 nt, Human
acgccauugcacuccagccugugcgacaagag

SEQ ID NO: 38243 - RNA, 32 nt, Human
acgccauugcacuccagcuugggcaauaagaa

SEQ ID NO: 38244 - RNA, 32 nt, Human
acgccauugcacuccagucugagcaacaagag

SEQ ID NO: 38245 - RNA, 32 nt, Human
acgccauugcacuccagucugguugacagagu

SEQ ID NO: 38246 - RNA, 32 nt, Human
acgccauuguacuccagccuggcaacagagcg

SEQ ID NO: 38247 - RNA, 32 nt, Human
acgccauuguacuccagccugggcaacaagag

SEQ ID NO: 38248 - RNA, 32 nt, Human
acgccauuguacuccagccugggcgacagagc

SEQ ID NO: 38249 - RNA, 32 nt, Human
acgcccaaacuaaacuccucauuccuacccuu

SEQ ID NO: 38250 - RNA, 32 nt, Human
acgcccaagccacccauugucauucauugugu

SEQ ID NO: 38251 - RNA, 32 nt, Human
acgcccaaucagcugcuggugacauugucucc

SEQ ID NO: 38252 - RNA, 32 nt, Human
acgcccacacucauugcacaucuucucuucag

SEQ ID NO: 38253 - RNA, 32 nt, Human
acgcccagccacagcaagcccugucccuuugc

SEQ ID NO: 38254 - RNA, 32 nt, Human
acgcccagcuaauuuuuauauucuuuaguaaa

SEQ ID NO: 38255 - RNA, 21 nt, Human
acgcccagcugaggcuggggg

SEQ ID NO: 38256 - RNA, 24 nt, Human
acgcccagguacucagcuggccca

SEQ ID NO: 38257 - RNA, 24 nt, Human
acgcccaggucggugcucggccca

SEQ ID NO: 38258 - RNA, 32 nt, Human
acgcccagugccuucacagccaaggccagacu

SEQ ID NO: 38259 - RNA, 32 nt, Human
acgcccaucuucugccucauaguggucacuca

SEQ ID NO: 38260 - RNA, 32 nt, Human
acgcccaugugccucuggucucagggacuaca

SEQ ID NO: 38261 - RNA, 32 nt, Human
acgccccagacccaggcucaggaggacugaga

SEQ ID NO: 38262 - RNA, 32 nt, Human
acgcccccaccagcucaaauuccgagugcaga

SEQ ID NO: 38263 - RNA, 32 nt, Human
acgcccccacucucccuccacacuuccagggu

SEQ ID NO: 38264 - RNA, 32 nt, Human
acgcccccaguuccacaccauggguguuggau

SEQ ID NO: 38265 - RNA, 28 nt, Human
acgcccccaucugcugccuuuucuauug

SEQ ID NO: 38266 - RNA, 32 nt, Human
acgcccccguugagguucacuuccuggauccu

SEQ ID NO: 38267 - RNA, 32 nt, Human
acgccccuaccugcuccuuccugggcccucag

SEQ ID NO: 38268 - RNA, 20 nt, Human
acgccccuccaaaccuccag

SEQ ID NO: 38269 - RNA, 32 nt, Human
acgccccucuacugcuauguggcuucaaccag

SEQ ID NO: 38270 - RNA, 32 nt, Human
acgccccugcaccucugcuccggugcacaaau

SEQ ID NO: 38271 - RNA, 32 nt, Human
acgccccugcccuggccgcacaggguuggguu

SEQ ID NO: 38272 - RNA, 32 nt, Human
acgccccugguggacaggaugguucggcaaag

SEQ ID NO: 38273 - RNA, 32 nt, Human
acgcccgccauggaaggcuuucagcuccaaga

SEQ ID NO: 38274 - RNA, 32 nt, Human
acgcccgcccucucgccuucgccgaaccaaag

SEQ ID NO: 38275 - RNA, 32 nt, Human
acgcccggccuggaguuuuuaggguaaaacgu

SEQ ID NO: 38276 - RNA, 32 nt, Human
acgcccggcuaauuuuuguguuuuaguagaga

SEQ ID NO: 38277 - RNA, 32 nt, Human
acgcccgguugcaggccaggaccgaguuggac

SEQ ID NO: 38278 - RNA, 32 nt, Human
acgcccuauacaacuuggcuucacauacuuuu

SEQ ID NO: 38279 - RNA, 32 nt, Human
acgcccucacugcaggcuccccuccucggcuu

SEQ ID NO: 38280 - RNA, 32 nt, Human
acgcccucagcccuccgggcacacgugccgcc

SEQ ID NO: 38281 - RNA, 24 nt, Human
acgcccucccccaagcccacccag

SEQ ID NO: 38282 - RNA, 32 nt, Human
acgcccucccuggcccccgccugggccuccuu

SEQ ID NO: 38283 - RNA, 32 nt, Human
acgcccuccugguuugggaagcugcugcucuu

SEQ ID NO: 38284 - RNA, 32 nt, Human
acgcccucgacucuuggaucugcuccgagacc

SEQ ID NO: 38285 - RNA, 32 nt, Human
acgcccucuaucugcagguccccagccugggu

SEQ ID NO: 38286 - RNA, 32 nt, Human
acgcccugaggguggccacgcugccagguguu

SEQ ID NO: 38287 - RNA, 32 nt, Human
acgcccugagguggaacagaggugagaggaag

SEQ ID NO: 38288 - RNA, 19 nt, Human
acgcccugcccagucccau

SEQ ID NO: 38289 - RNA, 32 nt, Human
acgcccugcuucgucgccuccuuucucuccca

SEQ ID NO: 38290 - RNA, 32 nt, Human
acgcccuggaacgucuguggcagccucuguca

SEQ ID NO: 38291 - RNA, 32 nt, Human
acgcccuggcaggacacaggcacuuuuccaau

SEQ ID NO: 38292 - RNA, 32 nt, Human
acgcccuuguccccgcccuccugagcuaugaa

SEQ ID NO: 38293 - RNA, 32 nt, Human
acgccgagaaguucccgcggcagccgcggauc

SEQ ID NO: 38294 - RNA, 32 nt, Human
acgccgagagccagagagaugucggauuucga

SEQ ID NO: 38295 - RNA, 32 nt, Human
acgccgagugccugugacgcgccggcuugacu

SEQ ID NO: 38296 - RNA, 32 nt, Human
acgccgcagcgcucgcuuucccuucccuccuc

SEQ ID NO: 38297 - RNA, 32 nt, Human
acgccgccacggucaucuucgccugccccgcc

SEQ ID NO: 38298 - RNA, 21 nt, Human
acgccgccgccgccgccgccg

SEQ ID NO: 38299 - RNA, 20 nt, Human
acgccgccgccgccgcugcc

SEQ ID NO: 38300 - RNA, 32 nt, Human
acgccgccuggaggccagaggggucaguggcc

SEQ ID NO: 38301 - RNA, 32 nt, Human
acgccgcgacgggaacuugaggugggaacuuu

SEQ ID NO: 38302 - RNA, 32 nt, Human
acgccgcggccaccgggcccacggccaccaga

SEQ ID NO: 38303 - RNA, 32 nt, Human
acgccgcgugcuccuguucagcccugccgagg

SEQ ID NO: 38304 - RNA, 32 nt, Human
acgccgcugcacuccagcuugaaugacagagg

SEQ ID NO: 38305 - RNA, 32 nt, Human
acgccggcaagucccaacaggcugccagcagu

SEQ ID NO: 38306 - RNA, 32 nt, Human
acgccggggaccccuccccagagccggccgga

SEQ ID NO: 38307 - RNA, 32 nt, Human
acgccgggggugaaaauguacgucuguagcau

SEQ ID NO: 38308 - RNA, 32 nt, Human
acgccgggugcucugguaaugggcccugccgc

SEQ ID NO: 38309 - RNA, 32 nt, Human
acgccggguucacacguguguucacagagcua

SEQ ID NO: 38310 - RNA, 32 nt, Human
acgccgucagcugagaagagugaggcagcgcc

SEQ ID NO: 38311 - RNA, 32 nt, Human
acgccgucugcacgugccugugccucacccag

SEQ ID NO: 38312 - RNA, 32 nt, Human
acgccgugucagucgggagggagggagcgagc

SEQ ID NO: 38313 - RNA, 32 nt, Human
acgccguugcacuccagccugggcaacaagag

SEQ ID NO: 38314 - RNA, 32 nt, Human
acgccucaagcacgggcaccagccgucaucuc

SEQ ID NO: 38315 - RNA, 32 nt, Human
acgccucagauggggaaacugaagcccaaugu

SEQ ID NO: 38316 - RNA, 32 nt, Human
acgccucagucgccucacuccugggccugcug

SEQ ID NO: 38317 - RNA, 32 nt, Human
acgccucccuccuggccaggcuguucgagcac

SEQ ID NO: 38318 - RNA, 32 nt, Human
acgccuccgggagcugugucccugagcccccu

SEQ ID NO: 38319 - RNA, 32 nt, Human
acgccuccuggacuccagcgccuggaggaggc

SEQ ID NO: 38320 - RNA, 32 nt, Human
acgccucgcucaccgccgccgcuucucccugc

SEQ ID NO: 38321 - RNA, 32 nt, Human
acgccucguuacccuucuuccuuccgcuucaa

SEQ ID NO: 38322 - RNA, 32 nt, Human
acgccucucccugcacucccuccuggagcucu

SEQ ID NO: 38323 - RNA, 32 nt, Human
acgccucugcacuccagccugggcaacaagag

SEQ ID NO: 38324 - RNA, 32 nt, Human
acgccucugcagcugcagcccucguucucuug

SEQ ID NO: 38325 - RNA, 26 nt, Human
acgccugaccucagaugauccaccca

SEQ ID NO: 38326 - RNA, 32 nt, Human
acgccugacucugugcgagcuucuuucugugu

SEQ ID NO: 38327 - RNA, 29 nt, Human
acgccugcacaaugaaggcuuguucacac

SEQ ID NO: 38328 - RNA, 32 nt, Human
acgccugcagagacucaaauauugagaggacu

SEQ ID NO: 38329 - RNA, 32 nt, Human
acgccugccuguagucccagcuacucgggagg

SEQ ID NO: 38330 - RNA, 32 nt, Human
acgccugcgcccaucuuucacacacauucugg

SEQ ID NO: 38331 - RNA, 32 nt, Human
acgccugcgccuguaaucccagcacuuuggga

SEQ ID NO: 38332 - RNA, 32 nt, Human
acgccuggagaguuguggacuggggcaaccuu

SEQ ID NO: 38333 - RNA, 32 nt, Human
acgccuggauccugccuccgccaggccggcug

SEQ ID NO: 38334 - RNA, 32 nt, Human
acgccuggccgaaaaacccacucucauaacag

SEQ ID NO: 38335 - RNA, 32 nt, Human
acgccugggaggauguaccagagccuggcgcu

SEQ ID NO: 38336 - RNA, 32 nt, Human
acgccugggccuugcugccaggaagcuucggc

SEQ ID NO: 38337 - RNA, 32 nt, Human
acgccuggguuuuccacucgaagaggaagucc

SEQ ID NO: 38338 - RNA, 32 nt, Human
acgccuguaaucccagcacuugggaggccaag

SEQ ID NO: 38339 - RNA, 32 nt, Human
acgccuguaaucccuuagcuacucaggaggcu

SEQ ID NO: 38340 - RNA, 23 nt, Human
acgccugucugcaggcgcugcug

SEQ ID NO: 38341 - RNA, 32 nt, Human
acgccuguggcucaucggcuucccucuuaacc

SEQ ID NO: 38342 - RNA, 32 nt, Human
acgccuguggguucaccaccuccuaggagggu

SEQ ID NO: 38343 - RNA, 32 nt, Human
acgccuguggucccagcacuuuggcaggugug

SEQ ID NO: 38344 - RNA, 32 nt, Human
acgccuuaggaaggggacaaccaggccccgcc

SEQ ID NO: 38345 - RNA, 32 nt, Human
acgccuuccaccugccccacugcuucuucgcu

SEQ ID NO: 38346 - RNA, 32 nt, Human
acgccuuccauucauuguauuacggauuuggu

SEQ ID NO: 38347 - RNA, 32 nt, Human
acgccuucuucaccuguguccucugccucuga

SEQ ID NO: 38348 - RNA, 19 nt, Human
acgccuuggaaccguccuu

SEQ ID NO: 38349 - RNA, 32 nt, Human
acgccuuguucuucucaagagaaaguuguaac

SEQ ID NO: 38350 - RNA, 32 nt, Human
acgccuuucccucugcugauggggccuccggg

SEQ ID NO: 38351 - RNA, 32 nt, Human
acgcgaaagaaaugggcauaaguagaaugaag

SEQ ID NO: 38352 - RNA, 32 nt, Human
acgcgaccagaggacagcucugugcugauccc

SEQ ID NO: 38353 - RNA, 32 nt, Human
acgcgacccaaaaccaaaugacccaccaccac

SEQ ID NO: 38354 - RNA, 32 nt, Human
acgcgacccucgagacgacagcgcggcuacug

SEQ ID NO: 38355 - RNA, 32 nt, Human
acgcgagggcaccucuggaggggagcgccugc

SEQ ID NO: 38356 - RNA, 30 nt, Human
acgcgaugcuauucgacaaggugaaagcgu

SEQ ID NO: 38357 - RNA, 32 nt, Human
acgcgcacacacucacgcacacacaagcagag

SEQ ID NO: 38358 - RNA, 32 nt, Human
acgcgcagagugaaaaugguccaccauucagg

SEQ ID NO: 38359 - RNA, 32 nt, Human
acgcgcaggcgcagagagccccagccacgccg

SEQ ID NO: 38360 - RNA, 32 nt, Human
acgcgcauguguuugccagggauggggccacc

SEQ ID NO: 38361 - RNA, 32 nt, Human
acgcgccccacgcauccucuuccauccccagg

SEQ ID NO: 38362 - RNA, 32 nt, Human
acgcgccccagccccggagcagggucaggguc

SEQ ID NO: 38363 - RNA, 32 nt, Human
acgcgcccugcucucacggccucggcacaggc

SEQ ID NO: 38364 - RNA, 32 nt, Human
acgcgccgcaggaggcugggacugguccaguu

SEQ ID NO: 38365 - RNA, 32 nt, Human
acgcgccgccgagccaccaucaugccugggca

SEQ ID NO: 38366 - RNA, 32 nt, Human
acgcgccucggggaacagccuggcccaaagcc

SEQ ID NO: 38367 - RNA, 32 nt, Human
acgcgccuguaauaccagcuacucaggaggcu

SEQ ID NO: 38368 - RNA, 32 nt, Human
acgcgccuguaaucccagccacucaggaagcu

SEQ ID NO: 38369 - RNA, 32 nt, Human
acgcgccuguaaucccagcuacccaggaggcu

SEQ ID NO: 38370 - RNA, 32 nt, Human
acgcgccuguaaucccagcuacucaagaggcu

SEQ ID NO: 38371 - RNA, 32 nt, Human
acgcgccuguaaucccagcuacucaggaggcu

SEQ ID NO: 38372 - RNA, 32 nt, Human
acgcgccuguaaucccagcuacucgggaggcu

SEQ ID NO: 38373 - RNA, 32 nt, Human
acgcgccuguaaucccagcuacuugggaggcu

SEQ ID NO: 38374 - RNA, 32 nt, Human
acgcgccuguaaucccagcuauucgggaggcu

SEQ ID NO: 38375 - RNA, 20 nt, Human
acgcgccuguagucccagcu

SEQ ID NO: 38376 - RNA, 32 nt, Human
acgcgccuguagucccagcuacacgggaggcu

SEQ ID NO: 38377 - RNA, 32 nt, Human
acgcgccuguagucccagcuacucaggaggcu

SEQ ID NO: 38378 - RNA, 32 nt, Human
acgcgccuguagucccagcuacucgggaggcu

SEQ ID NO: 38379 - RNA, 32 nt, Human
acgcgccuguagucccagcugcucaggaggcu

SEQ ID NO: 38380 - RNA, 32 nt, Human
acgcgccuguaguccuagcuacuccggaggcu

SEQ ID NO: 38381 - RNA, 32 nt, Human
acgcgccuucuaaaccugagggagugggcacg

SEQ ID NO: 38382 - RNA, 32 nt, Human
acgcgcggcggcggaggcugcgcgcgggccac

SEQ ID NO: 38383 - RNA, 32 nt, Human
acgcgcucagccccuucucggccucgggaggg

SEQ ID NO: 38384 - RNA, 32 nt, Human
acgcgcuccugacagcccccaaggauugagca

SEQ ID NO: 38385 - RNA, 32 nt, Human
acgcgcucuccaccacccaacccaaaccauga

SEQ ID NO: 38386 - RNA, 32 nt, Human
acgcgcugcagccuccagcccgcggcaagcgg

SEQ ID NO: 38387 - RNA, 32 nt, Human
acgcgcugcucaccugucuuuuuggcuucucc

SEQ ID NO: 38388 - RNA, 32 nt, Human
acgcgcuggcccugccacuccagccuggccuc

SEQ ID NO: 38389 - RNA, 32 nt, Human
acgcgcuggguguccagcucucugucacagcu

SEQ ID NO: 38390 - RNA, 32 nt, Human
acgcgcuguccuggcuggaggagguggagcag

SEQ ID NO: 38391 - RNA, 32 nt, Human
acgcgcuucguauuucagaaggcgcugcguuc

SEQ ID NO: 38392 - RNA, 32 nt, Human
acgcgcuuguagucccagcuacucgggaggcu

SEQ ID NO: 38393 - RNA, 32 nt, Human
acgcggaagaggagcugugggaagggggagga

SEQ ID NO: 38394 - RNA, 32 nt, Human
acgcggagaagaggagaggaccuacaagaacg

SEQ ID NO: 38395 - RNA, 32 nt, Human
acgcggagaggaggagaggcugagggagggag

SEQ ID NO: 38396 - RNA, 32 nt, Human
acgcggagcugggaaaagggaggcagaggagg

SEQ ID NO: 38397 - RNA, 21 nt, Human
acgcggccaccgagcuggagg

SEQ ID NO: 38398 - RNA, 32 nt, Human
acgcggcccacuguggcguucccagugcccgg

SEQ ID NO: 38399 - RNA, 32 nt, Human
acgcggccucuggaggugcacccuggaccccc

SEQ ID NO: 38400 - RNA, 21 nt, Human
acgcggcugcaagccaaggag

SEQ ID NO: 38401 - RNA, 21 nt, Human
acgcggcugccuuaucgggaa

SEQ ID NO: 38402 - RNA, 32 nt, Human
acgcggcuggguccaagaaugccucaggaugg

SEQ ID NO: 38403 - RNA, 32 nt, Human
acgcgggaggcagagacugcagugagccgaga

SEQ ID NO: 38404 - RNA, 32 nt, Human
acgcgggagggguggaggcugcggggagccgg

SEQ ID NO: 38405 - RNA, 32 nt, Human
acgcgggagucgcagagagggaccccgggcgc

SEQ ID NO: 38406 - RNA, 32 nt, Human
acgcgggcaugcugguggccucaggaauacga

SEQ ID NO: 38407 - RNA, 32 nt, Human
acgcgggccagccucagcaccgacagccgacg

SEQ ID NO: 38408 - RNA, 32 nt, Human
acgcgggcgaggaagaccagccccggggcccc

SEQ ID NO: 38409 - RNA, 32 nt, Human
acgcgggcgccacaugcccagccugggagcaa

SEQ ID NO: 38410 - RNA, 32 nt, Human
acgcggggaagaggaggcggaaaaggacgcaa

SEQ ID NO: 38411 - RNA, 32 nt, Human
acgcggggccugggacucgaccagccucuccc

SEQ ID NO: 38412 - RNA, 32 nt, Human
acgcggguggcaccgugcgagcuccaggagcc

SEQ ID NO: 38413 - RNA, 32 nt, Human
acgcgguacagcugcccaagggcguucguaac

SEQ ID NO: 38414 - RNA, 32 nt, Human
acgcguccagccaggagaggcagagggaggca

SEQ ID NO: 38415 - RNA, 32 nt, Human
acgcgucccaccccaggcucucacugggcgcu

SEQ ID NO: 38416 - RNA, 32 nt, Human
acgcguccggccgccuccuagcggcccgggcc

SEQ ID NO: 38417 - RNA, 32 nt, Human
acgcguccuccauccucucucuccuuggcacu

SEQ ID NO: 38418 - RNA, 23 nt, Human
acgcgugacccagccaucgggga

SEQ ID NO: 38419 - RNA, 32 nt, Human
acgcgugagcaugcauguguguguacacgugu

SEQ ID NO: 38420 - RNA, 24 nt, Human
acgcgugauauugaccaucgggga

SEQ ID NO: 38421 - RNA, 32 nt, Human
acgcgugcauaugcuacacauaugugcuucuc

SEQ ID NO: 38422 - RNA, 32 nt, Human
acgcgugggcaggcagcagccgggcagggaug

SEQ ID NO: 38423 - RNA, 32 nt, Human
acgcgugguagccccaggaugggugaguucaa

SEQ ID NO: 38424 - RNA, 32 nt, Human
acgcgugugcaggagcggcagauggggagaca

SEQ ID NO: 38425 - RNA, 32 nt, Human
acgcuaagugagguccuauggguggggcccua

SEQ ID NO: 38426 - RNA, 32 nt, Human
acgcuaagugucugagacugacaucggaacca

SEQ ID NO: 38427 - RNA, 32 nt, Human
acgcuaauguucaugacuccuggccuugggau

SEQ ID NO: 38428 - RNA, 32 nt, Human
acgcuacugcgcuccagccugagugauagagu

SEQ ID NO: 38429 - RNA, 32 nt, Human
acgcuacuggcaacacggcaguauuuagccac

SEQ ID NO: 38430 - RNA, 30 nt, Human
acgcuauguccagcaaaggcuccgugguuc

SEQ ID NO: 38431 - RNA, 22 nt, Human
acgcuauuuacucagcuaccca

SEQ ID NO: 38432 - RNA, 32 nt, Human
acgcucaggcagugcuuccuuccagaugggcu

SEQ ID NO: 38433 - RNA, 32 nt, Human
acgcucagggagcaaaccugguuaagauugga

SEQ ID NO: 38434 - RNA, 32 nt, Human
acgcucaguccucaggcgucgaggguagcucc

SEQ ID NO: 38435 - RNA, 32 nt, Human
acgcucaguucugcccaggcccggcuccaccc

SEQ ID NO: 38436 - RNA, 32 nt, Human
acgcucaucucuggaaggggcagcccugagug

SEQ ID NO: 38437 - RNA, 32 nt, Human
acgcuccaagccccauagacugauucaggaag

SEQ ID NO: 38438 - RNA, 32 nt, Human
acgcuccagaauggagguccugagggagaagg

SEQ ID NO: 38439 - RNA, 32 nt, Human
acgcuccagcacaguggccaggaaaagaaaua

SEQ ID NO: 38440 - RNA, 32 nt, Human
acgcucccagggccuggcugggccagcuuccc

SEQ ID NO: 38441 - RNA, 32 nt, Human
acgcucccauuuuaccgagguggaucugaggc

SEQ ID NO: 38442 - RNA, 32 nt, Human
acgcuccccucccagggauguguccgccagau

SEQ ID NO: 38443 - RNA, 32 nt, Human
acgcuccccugagagguuucuggggcccgcug

SEQ ID NO: 38444 - RNA, 32 nt, Human
acgcucccuccacccccugcgcaaaaagaccc

SEQ ID NO: 38445 - RNA, 32 nt, Human
acgcucccucccccugccuccuccuccuccuc

SEQ ID NO: 38446 - RNA, 32 nt, Human
acgcuccgcagccucaggucuuggcucucacu

SEQ ID NO: 38447 - RNA, 32 nt, Human
acgcuccggauaguucccgagggucauccgcg

SEQ ID NO: 38448 - RNA, 32 nt, Human
acgcuccucaccuagccccuguccugagggug

SEQ ID NO: 38449 - RNA, 32 nt, Human
acgcuccucuacucuuugagacaucacuggcc

SEQ ID NO: 38450 - RNA, 32 nt, Human
acgcuccucuucuccccuccuccuccugccgg

SEQ ID NO: 38451 - RNA, 32 nt, Human
acgcuccugcacccucuccccguccauaccgc

SEQ ID NO: 38452 - RNA, 32 nt, Human
acgcuccugccuggugcccgugggcuugaauu

SEQ ID NO: 38453 - RNA, 32 nt, Human
acgcuccuguccagacuacuaacagcacaaga

SEQ ID NO: 38454 - RNA, 32 nt, Human
acgcuccugugcugcugaccaacacagcugcu

SEQ ID NO: 38455 - RNA, 32 nt, Human
acgcuccuugccucaccaaccuucccauacac

SEQ ID NO: 38456 - RNA, 32 nt, Human
acgcucggugccuguaucuacuccggggccua

SEQ ID NO: 38457 - RNA, 32 nt, Human
acgcucgugagcugacugcucugcuccacugg

SEQ ID NO: 38458 - RNA, 32 nt, Human
acgcucucagcagacuugaguccugguccuuc

SEQ ID NO: 38459 - RNA, 32 nt, Human
acgcucuccuguccucccugugcucagggcug

SEQ ID NO: 38460 - RNA, 32 nt, Human
acgcucugagcugagagagaagaaauagcuau

SEQ ID NO: 38461 - RNA, 32 nt, Human
acgcucugucuccucaaccucuaccuggcgga

SEQ ID NO: 38462 - RNA, 32 nt, Human
acgcucugugguuugucagaccugcaagcaag

SEQ ID NO: 38463 - RNA, 32 nt, Human
acgcucuugggucgucucaugagacccagggg

SEQ ID NO: 38464 - RNA, 21 nt, Human
acgcugaagcccaggagagcg

SEQ ID NO: 38465 - RNA, 32 nt, Human
acgcugacacuuggccaaaggguccucaccuc

SEQ ID NO: 38466 - RNA, 32 nt, Human
acgcugacccuccugacaguggcaggacugga

SEQ ID NO: 38467 - RNA, 32 nt, Human
acgcugagacgguuugggggugggugggcggg

SEQ ID NO: 38468 - RNA, 32 nt, Human
acgcugaggaggaggaggaggcggaggaggcg

SEQ ID NO: 38469 - RNA, 32 nt, Human
acgcugaggccugggagucucuugagcuccac

SEQ ID NO: 38470 - RNA, 22 nt, Human
acgcugaggucaggaguucgag

SEQ ID NO: 38471 - RNA, 32 nt, Human
acgcugcagcucucuccagcccuguuggcauc

SEQ ID NO: 38472 - RNA, 32 nt, Human
acgcugcccagcccuggcgauggcaacggcga

SEQ ID NO: 38473 - RNA, 32 nt, Human
acgcugcccagccuucaaccugaacugccccc

SEQ ID NO: 38474 - RNA, 32 nt, Human
acgcugcccuagcgggaucugaagggauuuug

SEQ ID NO: 38475 - RNA, 32 nt, Human
acgcugccucaggcccuaggcuggccuaggaa

SEQ ID NO: 38476 - RNA, 32 nt, Human
acgcugccuccguuccuaggagagaagacuuc

SEQ ID NO: 38477 - RNA, 32 nt, Human
acgcugccucuguggaagucucuccucgcggg

SEQ ID NO: 38478 - RNA, 32 nt, Human
acgcugccucugugguucccucccucauuuuu

SEQ ID NO: 38479 - RNA, 32 nt, Human
acgcugcugggcaaccugcucaucauggccac

SEQ ID NO: 38480 - RNA, 32 nt, Human
acgcugcuuaggaaccggggacucaggagugc

SEQ ID NO: 38481 - RNA, 32 nt, Human
acgcugcuuccccacucucuccccuccccuca

SEQ ID NO: 38482 - RNA, 22 nt, Human
acgcugcuugcguagacgcugc

SEQ ID NO: 38483 - RNA, 32 nt, Human
acgcuggaagucugcagggggagggagagggg

SEQ ID NO: 38484 - RNA, 32 nt, Human
acgcuggaauuuuucuccccauggaauguaag

SEQ ID NO: 38485 - RNA, 24 nt, Human
acgcuggaccagugaaaacugagg

SEQ ID NO: 38486 - RNA, 23 nt, Human
acgcuggacgagucggaccgagg

SEQ ID NO: 38487 - RNA, 32 nt, Human
acgcuggacuuccagccccacaccucugacaa

SEQ ID NO: 38488 - RNA, 22 nt, Human
acgcuggagcuggagugcgagg

SEQ ID NO: 38489 - RNA, 32 nt, Human
acgcuggaggaggagugggagcucccagccug

SEQ ID NO: 38490 - RNA, 23 nt, Human
acgcuggagugcagugagccgag

SEQ ID NO: 38491 - RNA, 24 nt, Human
acgcuggaucagggggagcccgag

SEQ ID NO: 38492 - RNA, 32 nt, Human
acgcuggcccucuccuuccccgaacacagcac

SEQ ID NO: 38493 - RNA, 31 nt, Human
acgcuggcccuucucccaugcaggguccagg

SEQ ID NO: 38494 - RNA, 32 nt, Human
acgcuggcugcagggacccggugacagcguga

SEQ ID NO: 38495 - RNA, 32 nt, Human
acgcugggagguggaugcugcagugagcagug

SEQ ID NO: 38496 - RNA, 32 nt, Human
acgcugggccagcugcuuacuuauccacugcu

SEQ ID NO: 38497 - RNA, 32 nt, Human
acgcugggccgcggccucuggagcugggauuu

SEQ ID NO: 38498 - RNA, 32 nt, Human
acgcuggguccccucuguuggggguuuggggu

SEQ ID NO: 38499 - RNA, 32 nt, Human
acgcuggucucaaacuccuggacucaugggau

SEQ ID NO: 38500 - RNA, 32 nt, Human
acgcuggucucgaauuccuggccucaaaugau

SEQ ID NO: 38501 - RNA, 32 nt, Human
acgcuggucuuaaacuccugaccucaagugau

SEQ ID NO: 38502 - RNA, 32 nt, Human
acgcuggucuugaacuccugggcucaagcgau

SEQ ID NO: 38503 - RNA, 32 nt, Human
acgcuggugcagcucucgcugcagcagcucgu

SEQ ID NO: 38504 - RNA, 32 nt, Human
acgcuggugggagcuugagucuggucugaguc

SEQ ID NO: 38505 - RNA, 32 nt, Human
acgcuggugggccuguuguggaguacgcuuug

SEQ ID NO: 38506 - RNA, 32 nt, Human
acgcugguuucgaacuccugaccacauguggu

SEQ ID NO: 38507 - RNA, 32 nt, Human
acgcuguagacaccuucaccuccaucgugccc

SEQ ID NO: 38508 - RNA, 32 nt, Human
acgcugucaccaggcuggagugcaguggcgcg

SEQ ID NO: 38509 - RNA, 32 nt, Human
acgcugugaagagaggagccgcggcggucagu

SEQ ID NO: 38510 - RNA, 32 nt, Human
acgcugugcucccuccucggcggccacgcgcg

SEQ ID NO: 38511 - RNA, 32 nt, Human
acgcuguguggagaguccaggaugacgggauc

SEQ ID NO: 38512 - RNA, 32 nt, Human
acgcuguuccaucacagucuccaacuaaggcu

SEQ ID NO: 38513 - RNA, 32 nt, Human
acgcuuacugccagggugaccccagcccuggg

SEQ ID NO: 38514 - RNA, 32 nt, Human
acgcuuagcaggcugcacugaggcggagaaau

SEQ ID NO: 38515 - RNA, 32 nt, Human
acgcuuauucagucugcagagaagccaaaagg

SEQ ID NO: 38516 - RNA, 32 nt, Human
acgcuuauugcccaggcuggagugcaauggca

SEQ ID NO: 38517 - RNA, 32 nt, Human
acgcuuccacuaacuagcuucugaccuguuug

SEQ ID NO: 38518 - RNA, 32 nt, Human
acgcuuccaucuuuauccagagguaaucauag

SEQ ID NO: 38519 - RNA, 32 nt, Human
acgcuucccaaagcuuuucuuuaauucugacu

SEQ ID NO: 38520 - RNA, 32 nt, Human
acgcuuccuccaccucagcucagagcacagug

SEQ ID NO: 38521 - RNA, 18 nt, Human
acgcuucuaccccuucca

SEQ ID NO: 38522 - RNA, 32 nt, Human
acgcuucugcauccaccucugcccucauucug

SEQ ID NO: 38523 - RNA, 32 nt, Human
acgcuugaacccaggaggcagagguugcagug

SEQ ID NO: 38524 - RNA, 24 nt, Human
acgcuugaacccaggaggcggagg

SEQ ID NO: 38525 - RNA, 32 nt, Human
acgcuugaacccaggaggcggagguugcagug

SEQ ID NO: 38526 - RNA, 32 nt, Human
acgcuugcacacaugcacacagaccacauagc

SEQ ID NO: 38527 - RNA, 32 nt, Human
acgcuugcaugucaaaccccugucuuugcgga

SEQ ID NO: 38528 - RNA, 32 nt, Human
acgcuugcuagccaccccggagcacugcucuc

SEQ ID NO: 38529 - RNA, 32 nt, Human
acgcuugucacguccucagccucccagcauuc

SEQ ID NO: 38530 - RNA, 32 nt, Human
acgcuuucccacccuccuacuucacacccauu

SEQ ID NO: 38531 - RNA, 32 nt, Human
acgcuuucucccagcaugcagcgggaggaggg

SEQ ID NO: 38532 - RNA, 32 nt, Human
acgcuuuggacugagaagcaucgaggcuauag

SEQ ID NO: 38533 - RNA, 32 nt, Human
acgcuuuggucuucagccuugcacuggcucuu

SEQ ID NO: 38534 - RNA, 32 nt, Human
acgcuuuugugggagagaaaaucauugcaaaa

SEQ ID NO: 38535 - RNA, 32 nt, Human
acggaaaauggcgccucacggcccggguaguc

SEQ ID NO: 38536 - RNA, 32 nt, Human
acggaaacugaucaaaucacaugugaacaaau

SEQ ID NO: 38537 - RNA, 32 nt, Human
acggaaagagaccagaccuggaaaagacagag

SEQ ID NO: 38538 - RNA, 32 nt, Human
acggaaccacgcaaacuccuucuguaggcuuu

SEQ ID NO: 38539 - RNA, 32 nt, Human
acggaaccaucgacccacaggguuaaucccaa

SEQ ID NO: 38540 - RNA, 32 nt, Human
acggaacuccaccccugccggucagccugccu

SEQ ID NO: 38541 - RNA, 21 nt, Human
acggaacugccauccugugag

SEQ ID NO: 38542 - RNA, 32 nt, Human
acggaagaaaacccuaugaauguaaugaaugu

SEQ ID NO: 38543 - RNA, 32 nt, Human
acggaagacgacaaggaggagccggaagaugc

SEQ ID NO: 38544 - RNA, 32 nt, Human
acggaagagccagcaggagcagcguggucauu

SEQ ID NO: 38545 - RNA, 32 nt, Human
acggaagcagagggugcuguuucaacgccacc

SEQ ID NO: 38546 - RNA, 23 nt, Human
acggaagcagcagcgggccggca

SEQ ID NO: 38547 - RNA, 32 nt, Human
acggaagcaugucacaccacugcuuggucuug

SEQ ID NO: 38548 - RNA, 16 nt, Human
acggaagccaguucca

SEQ ID NO: 38549 - RNA, 20 nt, Human
acggaagccgagacugcgcu

SEQ ID NO: 38550 - RNA, 32 nt, Human
acggaaggaucuccagaggagccugggcuucg

SEQ ID NO: 38551 - RNA, 32 nt, Human
acggaaggcugaauguagggucauuuuguaug

SEQ ID NO: 38552 - RNA, 32 nt, Human
acggaagggcucuuucacagcuggcagagcga

SEQ ID NO: 38553 - RNA, 32 nt, Human
acggaagugaagauuccugggaucuaacuugc

SEQ ID NO: 38554 - RNA, 32 nt, Human
acggaauaagagaccuguuuuaaaaaggaacu

SEQ ID NO: 38555 - RNA, 32 nt, Human
acggaauagaaccagcugggcccaguggcuca

SEQ ID NO: 38556 - RNA, 32 nt, Human
acggaauccuaugugaagcaucagggccugaa

SEQ ID NO: 38557 - RNA, 32 nt, Human
acggaaucggagcucuggaggcugggcuggcc

SEQ ID NO: 38558 - RNA, 32 nt, Human
acggaaucucucugucagccaggcuggagugu

SEQ ID NO: 38559 - RNA, 32 nt, Human
acggaaugccagauccuacugccuuguugguu

SEQ ID NO: 38560 - RNA, 32 nt, Human
acggaauuccaauauuuauaauuaaagaaaau

SEQ ID NO: 38561 - RNA, 18 nt, Human
acggaauugaagagcaag

SEQ ID NO: 38562 - RNA, 32 nt, Human
acggacaaggaggcggggccugcagcuggcuu

SEQ ID NO: 38563 - RNA, 32 nt, Human
acggacacagaaugucuggagagggcagcagg

SEQ ID NO: 38564 - RNA, 32 nt, Human
acggacagcugagaugggagacaggagagaug

SEQ ID NO: 38565 - RNA, 32 nt, Human
acggacaggaagcacagcagguuuauccagau

SEQ ID NO: 38566 - RNA, 32 nt, Human
acggacagggaaugagacugaguuuauagcug

SEQ ID NO: 38567 - RNA, 32 nt, Human
acggacagggcagagggcagcgggcagcucca

SEQ ID NO: 38568 - RNA, 32 nt, Human
acggacauccuuuuucuuucucucuuucuuuu

SEQ ID NO: 38569 - RNA, 32 nt, Human
acggacauggccccuggcugugcuaacagagg

SEQ ID NO: 38570 - RNA, 32 nt, Human
acggaccaacagcaagagaccugcuagcacag

SEQ ID NO: 38571 - RNA, 32 nt, Human
acggaccacucggacccccaccccugcccgcc

SEQ ID NO: 38572 - RNA, 32 nt, Human
acggaccaggccugggcuccagcugggacaac

SEQ ID NO: 38573 - RNA, 21 nt, Human
acggacccaacggccagguca

SEQ ID NO: 38574 - RNA, 32 nt, Human
acggaccccagccacucucgggggcagacguc

SEQ ID NO: 38575 - RNA, 32 nt, Human
acggacccucauuccucccagggaccccagac

SEQ ID NO: 38576 - RNA, 23 nt, Human
acggaccuacccagcuuggccca

SEQ ID NO: 38577 - RNA, 32 nt, Human
acggaccuggagauuaggaaagagaaaagguu

SEQ ID NO: 38578 - RNA, 32 nt, Human
acggaccuggggacugggcugagaggguggac

SEQ ID NO: 38579 - RNA, 21 nt, Human
acggaccuucggcgccugggg

SEQ ID NO: 38580 - RNA, 32 nt, Human
acggaccuuggcugacauauguugguagguac

SEQ ID NO: 38581 - RNA, 32 nt, Human
acggacgaggcagaggaguggccggucccaug

SEQ ID NO: 38582 - RNA, 32 nt, Human
acggacggcaggucaggaaagccaggacucag

SEQ ID NO: 38583 - RNA, 32 nt, Human
acggacggggcagccgugcucacagcucagca

SEQ ID NO: 38584 - RNA, 32 nt, Human
acggacgugugauacacacaugcauguacagg

SEQ ID NO: 38585 - RNA, 32 nt, Human
acggacuacaauucuaucccucccagagggag

SEQ ID NO: 38586 - RNA, 32 nt, Human
acggacuaguucuuccugcgugaccacggaug

SEQ ID NO: 38587 - RNA, 23 nt, Human
acggacucccugggcccugggga

SEQ ID NO: 38588 - RNA, 32 nt, Human
acggacucguggagacgcgccgccgccgccgc

SEQ ID NO: 38589 - RNA, 32 nt, Human
acggacucuccauuccagaaccauggcccaau

SEQ ID NO: 38590 - RNA, 32 nt, Human
acggacucucccaggccugccugcauggcauc

SEQ ID NO: 38591 - RNA, 32 nt, Human
acggacucugccugugugacucccaggccccg

SEQ ID NO: 38592 - RNA, 32 nt, Human
acggacucuggccccggacucugcuuacccug

SEQ ID NO: 38593 - RNA, 32 nt, Human
acggacucuugcuauguugcccaggcuggucu

SEQ ID NO: 38594 - RNA, 32 nt, Human
acggacugcguuccgcagcuccuggguggggu

SEQ ID NO: 38595 - RNA, 32 nt, Human
acggacuuugggaggccgaggcaggcagauca

SEQ ID NO: 38596 - RNA, 32 nt, Human
acggagaagaggagagagaagccagggccgag

SEQ ID NO: 38597 - RNA, 32 nt, Human
acggagaagaggagaggcagagagggcgcggg

SEQ ID NO: 38598 - RNA, 32 nt, Human
acggagaccuauuugaaagaucaaagauugau

SEQ ID NO: 38599 - RNA, 32 nt, Human
acggagacugcggguccaagcugcaguagaac

SEQ ID NO: 38600 - RNA, 32 nt, Human
acggagagaggcagcagcaggaggaacagaaa

SEQ ID NO: 38601 - RNA, 32 nt, Human
acggagagcacugugacuccagcccuggcucg

SEQ ID NO: 38602 - RNA, 32 nt, Human
acggagagcucugcugugaugggcuaggcacu

SEQ ID NO: 38603 - RNA, 32 nt, Human
acggagaggcaggugagagggagguggcuaag

SEQ ID NO: 38604 - RNA, 32 nt, Human
acggagaguauuaagaaauggagagaaaaaua

SEQ ID NO: 38605 - RNA, 32 nt, Human
acggagagucugacuuaacuacauacaucuuc

SEQ ID NO: 38606 - RNA, 32 nt, Human
acggagagugggggacuagcugugcauggcac

SEQ ID NO: 38607 - RNA, 32 nt, Human
acggagcaagcugaaacugagacaagauuaua

SEQ ID NO: 38608 - RNA, 32 nt, Human
acggagcagggaaaccgcaggagccugcagga

SEQ ID NO: 38609 - RNA, 32 nt, Human
acggagccagggcuguagcagagaggcuaguc

SEQ ID NO: 38610 - RNA, 32 nt, Human
acggagcccagccuggauuccugugccugcuc

SEQ ID NO: 38611 - RNA, 32 nt, Human
acggagccccaucgcacacacacaagcccggu

SEQ ID NO: 38612 - RNA, 32 nt, Human
acggagccucccaggcuggggcagugggcaug

SEQ ID NO: 38613 - RNA, 32 nt, Human
acggagccucuuuguguccacuguggaaagga

SEQ ID NO: 38614 - RNA, 32 nt, Human
acggagccugccccucccuccuggcccacgug

SEQ ID NO: 38615 - RNA, 21 nt, Human
acggagccugggcaaccuccu

SEQ ID NO: 38616 - RNA, 32 nt, Human
acggagcucacugcagacucgccauccccguc

SEQ ID NO: 38617 - RNA, 32 nt, Human
acggagcugugcuuagggaagagcagagaugc

SEQ ID NO: 38618 - RNA, 32 nt, Human
acggaggagaacugagcagagcagagcaucga

SEQ ID NO: 38619 - RNA, 32 nt, Human
acggaggagcccacggaggagccccagcgucc

SEQ ID NO: 38620 - RNA, 32 nt, Human
acggaggagcgguuggccaacgcaguggcggc

SEQ ID NO: 38621 - RNA, 32 nt, Human
acggaggagcuagcugaguaugcugaaauccg

SEQ ID NO: 38622 - RNA, 32 nt, Human
acggaggaggggcagagccaggaggcaguggg

SEQ ID NO: 38623 - RNA, 32 nt, Human
acggaggcaaaaggaaaaagcagcccgcauca

SEQ ID NO: 38624 - RNA, 32 nt, Human
acggagggacuggccagggcacccugugcugc

SEQ ID NO: 38625 - RNA, 32 nt, Human
acggagggagcuacgaccuugaccauccccug

SEQ ID NO: 38626 - RNA, 32 nt, Human
acggaggggccaggagucucacaguggagggc

SEQ ID NO: 38627 - RNA, 32 nt, Human
acggaggguggagggcccugcgccugcgcgga

SEQ ID NO: 38628 - RNA, 32 nt, Human
acggaguaggagcagagggaagagagagggau

SEQ ID NO: 38629 - RNA, 32 nt, Human
acggaguauuucugucccucgugaagucacgu

SEQ ID NO: 38630 - RNA, 32 nt, Human
acggagucucacuccauugcccaggcuggagu

SEQ ID NO: 38631 - RNA, 32 nt, Human
acggagucucacucuugucacucaggcuggag

SEQ ID NO: 38632 - RNA, 32 nt, Human
acggagucuuccagaacaccucccucugaacu

SEQ ID NO: 38633 - RNA, 32 nt, Human
acggagucuuccucugucgcccaggcuggagu

SEQ ID NO: 38634 - RNA, 32 nt, Human
acggagucuugcuauguugcccaggcuggucu

SEQ ID NO: 38635 - RNA, 32 nt, Human
acggaguggauggucaccuuccucacuuauug

SEQ ID NO: 38636 - RNA, 32 nt, Human
acggaguucugggaugggaggggugggagcau

SEQ ID NO: 38637 - RNA, 32 nt, Human
acggaguugcccaggcuggagugcagcgcaug

SEQ ID NO: 38638 - RNA, 32 nt, Human
acggauaaguacuguucuuuucccucuuagau

SEQ ID NO: 38639 - RNA, 32 nt, Human
acggauaccucauuugaaacucagccuaguaa

SEQ ID NO: 38640 - RNA, 32 nt, Human
acggauaguucagacaauucagaaaagacugg

SEQ ID NO: 38641 - RNA, 32 nt, Human
acggauauaguauuuccuccucuuuguuuuua

SEQ ID NO: 38642 - RNA, 32 nt, Human
acggauccuccuccucccuuauucccuugcuc

SEQ ID NO: 38643 - RNA, 32 nt, Human
acggauccugcacugacucuggaaaaggcaua

SEQ ID NO: 38644 - RNA, 32 nt, Human
acggauccugcugugugagcccuucagcugca

SEQ ID NO: 38645 - RNA, 32 nt, Human
acggaugacucugccccucagagcuugcagac

SEQ ID NO: 38646 - RNA, 32 nt, Human
acggaugcaauuuccaggcugugcuguggacu

SEQ ID NO: 38647 - RNA, 32 nt, Human
acggaugcacacacagauggucacacagagau

SEQ ID NO: 38648 - RNA, 23 nt, Human
acggaugccagagggacugggga

SEQ ID NO: 38649 - RNA, 32 nt, Human
acggauggaagaggaaaacacugagaacaaca

SEQ ID NO: 38650 - RNA, 32 nt, Human
acggauggcaggcaagggacuuaagugaugga

SEQ ID NO: 38651 - RNA, 32 nt, Human
acggaugggaccugggcccagacagucccccu

SEQ ID NO: 38652 - RNA, 32 nt, Human
acggaugggcccugugucucaggagugggguu

SEQ ID NO: 38653 - RNA, 32 nt, Human
acggauguagcccguagguggggagggcagca

SEQ ID NO: 38654 - RNA, 32 nt, Human
acggaugugcccuugggggcaggugugggagc

SEQ ID NO: 38655 - RNA, 32 nt, Human
acggauucaaagacuuauuuugaaaguuggaa

SEQ ID NO: 38656 - RNA, 23 nt, Human
acggauuccuguggauaugggga

SEQ ID NO: 38657 - RNA, 32 nt, Human
acggauucucuauguugcccaggcuggucuca

SEQ ID NO: 38658 - RNA, 32 nt, Human
acggauuggagacucccucucccuggugggcc

SEQ ID NO: 38659 - RNA, 32 nt, Human
acggauuuccuugaagccucucuccuucucug

SEQ ID NO: 38660 - RNA, 32 nt, Human
acggcaaaaggcagagaucaguuccuugagua

SEQ ID NO: 38661 - RNA, 32 nt, Human
acggcaaaggcagccuuuuucuggccuugacu

SEQ ID NO: 38662 - RNA, 32 nt, Human
acggcaacuuggaccagugcaagugcgcacag

SEQ ID NO: 38663 - RNA, 32 nt, Human
acggcaagaggaaaggaggggucucgggacau

SEQ ID NO: 38664 - RNA, 32 nt, Human
acggcaagaggagcaagagcaaggaccgcaag

SEQ ID NO: 38665 - RNA, 32 nt, Human
acggcaaggagagaacgagugaugauguguag

SEQ ID NO: 38666 - RNA, 32 nt, Human
acggcaaugccuuugaacuuggcagcucuggc

SEQ ID NO: 38667 - RNA, 32 nt, Human
acggcacaaguagagagaaacuaccuaccuca

SEQ ID NO: 38668 - RNA, 32 nt, Human
acggcacagagggagggagcgagcgagcagug

SEQ ID NO: 38669 - RNA, 32 nt, Human
acggcaccaugccauccucugccuucugugca

SEQ ID NO: 38670 - RNA, 21 nt, Human
acggcacccaccacgacgccc

SEQ ID NO: 38671 - RNA, 32 nt, Human
acggcacccuuucccuaccuuuuccuucuuua

SEQ ID NO: 38672 - RNA, 32 nt, Human
acggcacguuccaucucuccccaugccacuga

SEQ ID NO: 38673 - RNA, 32 nt, Human
acggcacuccagccugggcagcagagugagac

SEQ ID NO: 38674 - RNA, 32 nt, Human
acggcacuccagccugggugacagagugagac

SEQ ID NO: 38675 - RNA, 32 nt, Human
acggcacuggguggggccgagcuccagggcug

SEQ ID NO: 38676 - RNA, 32 nt, Human
acggcagaaguagagagaaacuaccuaccuca

SEQ ID NO: 38677 - RNA, 32 nt, Human
acggcagacccuggugucccuggaccucaccg

SEQ ID NO: 38678 - RNA, 32 nt, Human
acggcagagacaguuucccuccccgcuauacc

SEQ ID NO: 38679 - RNA, 32 nt, Human
acggcagaggaacaaaggugugcucugagcuu

SEQ ID NO: 38680 - RNA, 32 nt, Human
acggcagaggcccugaggauccagcagggcuc

SEQ ID NO: 38681 - RNA, 19 nt, Human
acggcagaugccugacaga

SEQ ID NO: 38682 - RNA, 32 nt, Human
acggcagcagaacugucucuucugaaaaccag

SEQ ID NO: 38683 - RNA, 32 nt, Human
acggcagccucagagccccgcggggagcgcgc

SEQ ID NO: 38684 - RNA, 31 nt, Human
acggcagcgacagcgggcaggagggagaaag

SEQ ID NO: 38685 - RNA, 32 nt, Human
acggcagcuguucuuggaacagggcgacaaug

SEQ ID NO: 38686 - RNA, 32 nt, Human
acggcaggccgagagcgcggcgcccgggccug

SEQ ID NO: 38687 - RNA, 32 nt, Human
acggcaggcguguggcagccacacacaggcgg

SEQ ID NO: 38688 - RNA, 32 nt, Human
acggcagggcugggaaguucagugccuggaaa

SEQ ID NO: 38689 - RNA, 32 nt, Human
acggcaguauauuuguccccacccucaucucu

SEQ ID NO: 38690 - RNA, 32 nt, Human
acggcagugaggaagccagccgggaagagagg

SEQ ID NO: 38691 - RNA, 32 nt, Human
acggcauaguccagugucaucugaaggggcca

SEQ ID NO: 38692 - RNA, 32 nt, Human
acggcauccucuucauuccucucagccaaaaa

SEQ ID NO: 38693 - RNA, 32 nt, Human
acggcaugccuguacuggcacuuugguuuuug

SEQ ID NO: 38694 - RNA, 32 nt, Human
acggcauuacauuccauccagccugggcgaca

SEQ ID NO: 38695 - RNA, 32 nt, Human
acggcauuauagagagaggagaggaggggaag

SEQ ID NO: 38696 - RNA, 32 nt, Human
acggccacaggcaaggggguugcaguggccgc

SEQ ID NO: 38697 - RNA, 20 nt, Human
acggccacaggggcgcacgg

SEQ ID NO: 38698 - RNA, 32 nt, Human
acggccaccaugccuggcuaaucuuuuaaauu

SEQ ID NO: 38699 - RNA, 24 nt, Human
acggccacccaccauggccgcaga

SEQ ID NO: 38700 - RNA, 32 nt, Human
acggccacccacccuucuccccugccccgucc

SEQ ID NO: 38701 - RNA, 32 nt, Human
acggccacugaauacuguuaagaaggagguuu

SEQ ID NO: 38702 - RNA, 32 nt, Human
acggccacuuuccuguuucucaguaucugccg

SEQ ID NO: 38703 - RNA, 32 nt, Human
acggccagcgccagcaggagggcggcuaccag

SEQ ID NO: 38704 - RNA, 32 nt, Human
acggccaggcagagaagaccaugggaguuccc

SEQ ID NO: 38705 - RNA, 32 nt, Human
acggccagggagaagcuccucuccccagccca

SEQ ID NO: 38706 - RNA, 23 nt, Human
acggccaucaaccuggccauccc

SEQ ID NO: 38707 - RNA, 32 nt, Human
acggccaucccuuugcucccagccuggcucca

SEQ ID NO: 38708 - RNA, 18 nt, Human
acggccaugccccacaga

SEQ ID NO: 38709 - RNA, 32 nt, Human
acggcccaacauccagucuuuccccaggacag

SEQ ID NO: 38710 - RNA, 32 nt, Human
acggcccacacugucuaagacgcccccacgaa

SEQ ID NO: 38711 - RNA, 32 nt, Human
acggcccagcuggauuuuggacuucuggccuc

SEQ ID NO: 38712 - RNA, 32 nt, Human
acggcccagguggcaggauguccuggucuggc

SEQ ID NO: 38713 - RNA, 21 nt, Human
acggccccaccaccaccacca

SEQ ID NO: 38714 - RNA, 32 nt, Human
acggccccgugaggacacagggagaggacacc

SEQ ID NO: 38715 - RNA, 32 nt, Human
acggccccuacaggcuggcccugcaauggggc

SEQ ID NO: 38716 - RNA, 32 nt, Human
acggccccuccaggagggagccgggagauuac

SEQ ID NO: 38717 - RNA, 32 nt, Human
acggcccggggguucccuucugcuccauggag

SEQ ID NO: 38718 - RNA, 22 nt, Human
acggcccgugaacgcgcgcgga

SEQ ID NO: 38719 - RNA, 32 nt, Human
acggcccugcagccagcucacguccagguuca

SEQ ID NO: 38720 - RNA, 32 nt, Human
acggcccugcagcucccccugccgugcccugg

SEQ ID NO: 38721 - RNA, 32 nt, Human
acggcccugcucuguucccugggacacccccg

SEQ ID NO: 38722 - RNA, 32 nt, Human
acggcccugcugcggacggagcgcggaaacug

SEQ ID NO: 38723 - RNA, 32 nt, Human
acggcccuggggacuguggcccuggcccuggc

SEQ ID NO: 38724 - RNA, 32 nt, Human
acggcccuggguggaauugauguugggaagau

SEQ ID NO: 38725 - RNA, 32 nt, Human
acggcccuuccaggagccaguggcugggagca

SEQ ID NO: 38726 - RNA, 32 nt, Human
acggccgcaccucccccaugcaccccacccuc

SEQ ID NO: 38727 - RNA, 32 nt, Human
acggccgcagagucccagcccccagcccugcu

SEQ ID NO: 38728 - RNA, 24 nt, Human
acggccgccuccccgcccgccccc

SEQ ID NO: 38729 - RNA, 20 nt, Human
acggccgcggcugcacagga

SEQ ID NO: 38730 - RNA, 20 nt, Human
acggccgcugugccacagga

SEQ ID NO: 38731 - RNA, 32 nt, Human
acggccggaagccaggugaggccaggccggcg

SEQ ID NO: 38732 - RNA, 32 nt, Human
acggccggcaccugggggcacacacaugcagg

SEQ ID NO: 38733 - RNA, 32 nt, Human
acggccgggaagggucaguuggaggcaggcgc

SEQ ID NO: 38734 - RNA, 32 nt, Human
acggccguccuggccaugccucugccuugaug

SEQ ID NO: 38735 - RNA, 20 nt, Human
acggccgucgcuccgucucc

SEQ ID NO: 38736 - RNA, 32 nt, Human
acggccuauaggauuguuaagacugaauauuu

SEQ ID NO: 38737 - RNA, 32 nt, Human
acggccucagucccucccagcugcaguaccag

SEQ ID NO: 38738 - RNA, 32 nt, Human
acggccucccaaagugcugugauuaccggugu

SEQ ID NO: 38739 - RNA, 32 nt, Human
acggccucccaaguagcugggauuacaggugc

SEQ ID NO: 38740 - RNA, 32 nt, Human
acggccucuccuucaucacaggccggggauuc

SEQ ID NO: 38741 - RNA, 32 nt, Human
acggccuggaggagggagguugugguuggaug

SEQ ID NO: 38742 - RNA, 23 nt, Human
acggccuggccaacauggugaaa

SEQ ID NO: 38743 - RNA, 32 nt, Human
acggccuggcgacgguuucccugcugcugcag

SEQ ID NO: 38744 - RNA, 32 nt, Human
acggccuggguuucuggccucugugaucuccc

SEQ ID NO: 38745 - RNA, 32 nt, Human
acggccuguggcuggacugccugcugcugccc

SEQ ID NO: 38746 - RNA, 32 nt, Human
acggccuguucccagcuucucuccugguuccc

SEQ ID NO: 38747 - RNA, 32 nt, Human
acggccuuagcgugcauacggccagguguuca

SEQ ID NO: 38748 - RNA, 32 nt, Human
acggccuucacucugucuggggcacauucacu

SEQ ID NO: 38749 - RNA, 19 nt, Human
acggcgaaacucugucucu

SEQ ID NO: 38750 - RNA, 22 nt, Human
acggcgagccccaggagccggg

SEQ ID NO: 38751 - RNA, 32 nt, Human
acggcgagccuccagcccucuccuacuuugau

SEQ ID NO: 38752 - RNA, 23 nt, Human
acggcgagccucccguccaggug

SEQ ID NO: 38753 - RNA, 32 nt, Human
acggcgagcgccuggugcuggggaguggaggg

SEQ ID NO: 38754 - RNA, 32 nt, Human
acggcgaugaggcccuugaauguggucacuuu

SEQ ID NO: 38755 - RNA, 32 nt, Human
acggcgcccacauaggcgagguugagcugcug

SEQ ID NO: 38756 - RNA, 19 nt, Human
acggcgcgaccccgacaga

SEQ ID NO: 38757 - RNA, 32 nt, Human
acggcgcugagccugcacggccgcuuccggcu

SEQ ID NO: 38758 - RNA, 32 nt, Human
acggcggaggcagcggagcccugggccaucgu

SEQ ID NO: 38759 - RNA, 32 nt, Human
acggcggcacggcugcagccuggaugggaagu

SEQ ID NO: 38760 - RNA, 32 nt, Human
acggcggcaggacggcggcaggaugugugacc

SEQ ID NO: 38761 - RNA, 32 nt, Human
acggcggcagucgucccuccccacgcgggcgc

SEQ ID NO: 38762 - RNA, 32 nt, Human
acggcggcggcagaggcggcggcggccgggcc

SEQ ID NO: 38763 - RNA, 32 nt, Human
acggcggcuuugacucggacugcagcgaggac

SEQ ID NO: 38764 - RNA, 32 nt, Human
acggcgggagcuugcaggggugcgggggugug

SEQ ID NO: 38765 - RNA, 32 nt, Human
acggcgggcucgcagcuccugucaaaucugga

SEQ ID NO: 38766 - RNA, 32 nt, Human
acggcggggccagcccagcccacagcagucuc

SEQ ID NO: 38767 - RNA, 32 nt, Human
acggcgggggcuguggccggguccccaugggg

SEQ ID NO: 38768 - RNA, 32 nt, Human
acggcgggugccuggagggcagcucugggcuc

SEQ ID NO: 38769 - RNA, 32 nt, Human
acggcggguggguggaggaugcggugcgcggg

SEQ ID NO: 38770 - RNA, 32 nt, Human
acggcgguggucuugcgggaggcgugggcugg

SEQ ID NO: 38771 - RNA, 32 nt, Human
acggcgguuucuggacucuuccuugcccuguu

SEQ ID NO: 38772 - RNA, 32 nt, Human
acggcgucagcagaucugccugugcugggacu

SEQ ID NO: 38773 - RNA, 32 nt, Human
acggcuaaccuggaccuggaacuguagggcca

SEQ ID NO: 38774 - RNA, 32 nt, Human
acggcuacaagaagguugugaaaauucacucu

SEQ ID NO: 38775 - RNA, 32 nt, Human
acggcuacagacgccgcggggccaggucguug

SEQ ID NO: 38776 - RNA, 32 nt, Human
acggcuacuggggccgccuccuccaggcgggg

SEQ ID NO: 38777 - RNA, 32 nt, Human
acggcuagccugggcaacagagugagaccccg

SEQ ID NO: 38778 - RNA, 32 nt, Human
acggcucacgccuguaucccagcacuuuggaa

SEQ ID NO: 38779 - RNA, 32 nt, Human
acggcucacugcaaccuccaccuccugaguuc

SEQ ID NO: 38780 - RNA, 32 nt, Human
acggcucacugcagccucuaccuccccaggcu

SEQ ID NO: 38781 - RNA, 32 nt, Human
acggcucacugcagccugcgccucccagcguc

SEQ ID NO: 38782 - RNA, 32 nt, Human
acggcucacugcagccuugacgcccugggcuc

SEQ ID NO: 38783 - RNA, 32 nt, Human
acggcucagcauggacugcagcaccggauggu

SEQ ID NO: 38784 - RNA, 32 nt, Human
acggcuccaccagggucaccccgaguguccag

SEQ ID NO: 38785 - RNA, 32 nt, Human
acggcuccuccaccauccucagccagugcaac

SEQ ID NO: 38786 - RNA, 32 nt, Human
acggcugagaacuaacccucucugguuuuacu

SEQ ID NO: 38787 - RNA, 32 nt, Human
acggcugagccaagagcuugcuuucagcuuua

SEQ ID NO: 38788 - RNA, 32 nt, Human
acggcugcauaccugcacuuucaguuucuaag

SEQ ID NO: 38789 - RNA, 32 nt, Human
acggcugcggcgcuuugugcuccagucgcucc

SEQ ID NO: 38790 - RNA, 32 nt, Human
acggcugcucacuggcccccacuuuguuucuu

SEQ ID NO: 38791 - RNA, 32 nt, Human
acggcugcuccaguucauggccucccaggggu

SEQ ID NO: 38792 - RNA, 32 nt, Human
acggcuggaaauucuuauuuccccuuuccaau

SEQ ID NO: 38793 - RNA, 32 nt, Human
acggcuggagagaaauagggagaugcaggaag

SEQ ID NO: 38794 - RNA, 32 nt, Human
acggcuggagaguucagcugugugugcauagu

SEQ ID NO: 38795 - RNA, 32 nt, Human
acggcuggaggccaccgagaagaaggaggaag

SEQ ID NO: 38796 - RNA, 32 nt, Human
acggcugggcuccugggcugccuucagugucu

SEQ ID NO: 38797 - RNA, 32 nt, Human
acggcugggugguccuaagccacuggguggau

SEQ ID NO: 38798 - RNA, 32 nt, Human
acggcugucccucauggagaccucaugccaug

SEQ ID NO: 38799 - RNA, 19 nt, Human
acggcugucucccccugaa

SEQ ID NO: 38800 - RNA, 32 nt, Human
acggcugugucaccaucauccagagcuugggc

SEQ ID NO: 38801 - RNA, 32 nt, Human
acggcuuagccgcggugcagacugcggcggcg

SEQ ID NO: 38802 - RNA, 32 nt, Human
acggcuucguucuucaccauguuugucaccag

SEQ ID NO: 38803 - RNA, 32 nt, Human
acggcuucucacugggacuggagaccucguuc

SEQ ID NO: 38804 - RNA, 32 nt, Human
acggcuucucaugcuauuucuaccucacuuug

SEQ ID NO: 38805 - RNA, 32 nt, Human
acggcuucuccuccuccucuugcuccuccagc

SEQ ID NO: 38806 - RNA, 32 nt, Human
acggcuuuggagacaaucaaguaacaacugaa

SEQ ID NO: 38807 - RNA, 32 nt, Human
acgggaaaaugagaaacacuggguaccaagug

SEQ ID NO: 38808 - RNA, 32 nt, Human
acgggaaaggcagcccuuugacacgcacgcga

SEQ ID NO: 38809 - RNA, 32 nt, Human
acgggaaaggcgcagagcaggcgcgggcggcg

SEQ ID NO: 38810 - RNA, 32 nt, Human
acgggaacacgugcugcugggccgggcuaggg

SEQ ID NO: 38811 - RNA, 32 nt, Human
acgggaaccagccugcuguucagaccagucug

SEQ ID NO: 38812 - RNA, 32 nt, Human
acgggaaccugaccagcgacaccaucuucauu

SEQ ID NO: 38813 - RNA, 32 nt, Human
acgggaagcaucuuccagaagugugauuggga

SEQ ID NO: 38814 - RNA, 21 nt, Human
acgggaaggacggcugccggg

SEQ ID NO: 38815 - RNA, 32 nt, Human
acgggaaguacacgcccgugaaauucacggag

SEQ ID NO: 38816 - RNA, 32 nt, Human
acgggaaguucugcaaguguucuccaggggca

SEQ ID NO: 38817 - RNA, 18 nt, Human
acgggacacccugacaga

SEQ ID NO: 38818 - RNA, 32 nt, Human
acgggacagagccagggcacucaccaggcugc

SEQ ID NO: 38819 - RNA, 22 nt, Human
acgggacaggccuccuuggcaa

SEQ ID NO: 38820 - RNA, 32 nt, Human
acgggaccagcugcuggccacauuuccugcuu

SEQ ID NO: 38821 - RNA, 32 nt, Human
acgggaccagcuguacuacgagugcuacucgg

SEQ ID NO: 38822 - RNA, 32 nt, Human
acgggacccagcuguagugagguugcagugau

SEQ ID NO: 38823 - RNA, 32 nt, Human
acgggaccucucauggugcaccaccugcacga

SEQ ID NO: 38824 - RNA, 32 nt, Human
acgggacgcuccgucuuugaagaaagaagaga

SEQ ID NO: 38825 - RNA, 32 nt, Human
acgggacucuacugccgagaccaggcucacgc

SEQ ID NO: 38826 - RNA, 32 nt, Human
acgggacugggcccugaaccaauaaagccguc

SEQ ID NO: 38827 - RNA, 32 nt, Human
acgggagaggagaagagggagacccgccgccu

SEQ ID NO: 38828 - RNA, 32 nt, Human
acgggagagggaggggcaacagagguccaggg

SEQ ID NO: 38829 - RNA, 32 nt, Human
acgggagagguggagaaaaaugagagauaugc

SEQ ID NO: 38830 - RNA, 32 nt, Human
acgggagauuaccagugaaauaguuugguucu

SEQ ID NO: 38831 - RNA, 32 nt, Human
acgggagcaauguugccgcuguacggagagug

SEQ ID NO: 38832 - RNA, 32 nt, Human
acgggagcagaggaagcacagagcugggcaua

SEQ ID NO: 38833 - RNA, 32 nt, Human
acgggagcaggaggagaagauacgagagcagg

SEQ ID NO: 38834 - RNA, 32 nt, Human
acgggagcagugagggagauagagaggguugg

SEQ ID NO: 38835 - RNA, 32 nt, Human
acgggagcaucucuugagccugagaaguggag

SEQ ID NO: 38836 - RNA, 32 nt, Human
acgggagccagccuguggcccccagccuccug

SEQ ID NO: 38837 - RNA, 32 nt, Human
acgggagcccaggagcucuggccggcaggucc

SEQ ID NO: 38838 - RNA, 32 nt, Human
acgggagcugcgagcaggugggcagaugaggg

SEQ ID NO: 38839 - RNA, 32 nt, Human
acgggagcuguggacagagcucccucacuuca

SEQ ID NO: 38840 - RNA, 32 nt, Human
acgggaggaggcagcugcggcggggccgaauc

SEQ ID NO: 38841 - RNA, 32 nt, Human
acgggaggaucacgaggucaagagaucgacag

SEQ ID NO: 38842 - RNA, 32 nt, Human
acgggaggauccugucucacacccuacgaugg

SEQ ID NO: 38843 - RNA, 32 nt, Human
acgggaggaugaggugggagaaucacucgaac

SEQ ID NO: 38844 - RNA, 32 nt, Human
acgggaggcagaggugggagaaucgcuugaac

SEQ ID NO: 38845 - RNA, 32 nt, Human
acgggaggcccgagaugggcucaggggcccga

SEQ ID NO: 38846 - RNA, 32 nt, Human
acgggaggcugaggcaggagaauggcaugaac

SEQ ID NO: 38847 - RNA, 32 nt, Human
acgggaggcugaggcaggagaauggcgugagc

SEQ ID NO: 38848 - RNA, 32 nt, Human
acgggaggcugcaggauggucaagcugacggc

SEQ ID NO: 38849 - RNA, 32 nt, Human
acgggaggcuuaggcaggagaauuccuugaac

SEQ ID NO: 38850 - RNA, 32 nt, Human
acgggagguggcggagguggcggcggaggcga

SEQ ID NO: 38851 - RNA, 32 nt, Human
acgggaggugugagcccaaaggucuggaccca

SEQ ID NO: 38852 - RNA, 32 nt, Human
acgggaucccuucacaucucauacccaguaag

SEQ ID NO: 38853 - RNA, 32 nt, Human
acgggaugauugcuugagcucaggaguuugag

SEQ ID NO: 38854 - RNA, 32 nt, Human
acgggaugccaagcccugccugauguggcucu

SEQ ID NO: 38855 - RNA, 30 nt, Human
acgggauggaggcgggagagccaggaggcc

SEQ ID NO: 38856 - RNA, 32 nt, Human
acgggauuuaguugugagcauccucccgaugc

SEQ ID NO: 38857 - RNA, 32 nt, Human
acgggauuuguugauucucuccauuuuggugu

SEQ ID NO: 38858 - RNA, 32 nt, Human
acgggcaaauccaucccucucucccucacagu

SEQ ID NO: 38859 - RNA, 32 nt, Human
acgggcacaggugggaguugggagcaaagcgg

SEQ ID NO: 38860 - RNA, 32 nt, Human
acgggcaccuaaaagaagcaucucugaccaga

SEQ ID NO: 38861 - RNA, 32 nt, Human
acgggcagaccucucuucucuccccagucccu

SEQ ID NO: 38862 - RNA, 32 nt, Human
acgggcagaguggaucagggagggagggucga

SEQ ID NO: 38863 - RNA, 32 nt, Human
acgggcagcuagugagccagagggcgaucccg

SEQ ID NO: 38864 - RNA, 32 nt, Human
acgggcaggcagcgcgacuggcagcggugagc

SEQ ID NO: 38865 - RNA, 19 nt, Human
acgggcaggcgcgcgcggg

SEQ ID NO: 38866 - RNA, 32 nt, Human
acgggcaggcucaggcgggaagaaggaggcau

SEQ ID NO: 38867 - RNA, 32 nt, Human
acgggcaguggcugcucguguccucugccacc

SEQ ID NO: 38868 - RNA, 32 nt, Human
acgggcaucaucucuuaauccucagaacaucc

SEQ ID NO: 38869 - RNA, 32 nt, Human
acgggcaugguggcucacaccuguaaucccag

SEQ ID NO: 38870 - RNA, 32 nt, Human
acgggccaaauacuacagccaccaaggccaua

SEQ ID NO: 38871 - RNA, 22 nt, Human
acgggccacuggcugcugggga

SEQ ID NO: 38872 - RNA, 32 nt, Human
acgggccaugggcugagccccgcugagcccgc

SEQ ID NO: 38873 - RNA, 32 nt, Human
acgggcccauaccacacagacugcucuccaau

SEQ ID NO: 38874 - RNA, 32 nt, Human
acgggccccaggagggaagcgcugucuaggca

SEQ ID NO: 38875 - RNA, 32 nt, Human
acgggccccgccucagacuccaacacucacaa

SEQ ID NO: 38876 - RNA, 17 nt, Human
acgggcccggacauccc

SEQ ID NO: 38877 - RNA, 32 nt, Human
acgggcccucccccaaccucucucugauccaa

SEQ ID NO: 38878 - RNA, 32 nt, Human
acgggccgccgccugcccuggagcacaggcua

SEQ ID NO: 38879 - RNA, 32 nt, Human
acgggccgucugcuccuccuuggacaguugca

SEQ ID NO: 38880 - RNA, 32 nt, Human
acgggccuuccaggagcaagcacuaccuguuc

SEQ ID NO: 38881 - RNA, 32 nt, Human
acgggcgaagccgccugcugccgcccaggaag

SEQ ID NO: 38882 - RNA, 32 nt, Human
acgggcgacagucccgcccagccccggaccug

SEQ ID NO: 38883 - RNA, 32 nt, Human
acgggcgcccgccaccacgcccggcuaauuuu

SEQ ID NO: 38884 - RNA, 28 nt, Human
acgggcggcaaugcugccuccuuccccg

SEQ ID NO: 38885 - RNA, 32 nt, Human
acgggcggcacagucacuucugccuguugcuc

SEQ ID NO: 38886 - RNA, 32 nt, Human
acgggcggcgggauagcgggaccccggcggcg

SEQ ID NO: 38887 - RNA, 32 nt, Human
acgggcggcucacccuggacacugugaugcgc

SEQ ID NO: 38888 - RNA, 32 nt, Human
acgggcggcuggugcuuuuuccuugccggcgu

SEQ ID NO: 38889 - RNA, 32 nt, Human
acgggcgggcugggaaggucuccuccccucac

SEQ ID NO: 38890 - RNA, 32 nt, Human
acgggcuaugcugcuguugcguguggguaccc

SEQ ID NO: 38891 - RNA, 32 nt, Human
acgggcucagcagccagaggaggccggugaag

SEQ ID NO: 38892 - RNA, 32 nt, Human
acgggcucagcccaggaagaggagaaacgauc

SEQ ID NO: 38893 - RNA, 29 nt, Human
acgggcuccaggagucgucgccacacucg

SEQ ID NO: 38894 - RNA, 32 nt, Human
acgggcugaauaacauacucuuuugucuugga

SEQ ID NO: 38895 - RNA, 32 nt, Human
acgggcugagccagacagcaggcuccaggcuc

SEQ ID NO: 38896 - RNA, 32 nt, Human
acgggcugccagaagagagagaggcagagagc

SEQ ID NO: 38897 - RNA, 32 nt, Human
acgggcugggcccugugucccagguuucacag

SEQ ID NO: 38898 - RNA, 32 nt, Human
acgggcugggggcuucucaggauuccacagcc

SEQ ID NO: 38899 - RNA, 32 nt, Human
acgggcuuagugggcuucagccagcuuuucuc

SEQ ID NO: 38900 - RNA, 27 nt, Human
acgggcuuauaauuugccauuugugaa

SEQ ID NO: 38901 - RNA, 32 nt, Human
acgggcuugcacacagcaggugcucagcaaau

SEQ ID NO: 38902 - RNA, 31 nt, Human
acgggcuugggggaaagaugguggggaccaa

SEQ ID NO: 38903 - RNA, 32 nt, Human
acgggcuuguguucugcuccauacuuuuucuc

SEQ ID NO: 38904 - RNA, 24 nt, Human
acgggcuuuccacagcgcggggga

SEQ ID NO: 38905 - RNA, 32 nt, Human
acggggaagccuguccuugugcgccuucagac

SEQ ID NO: 38906 - RNA, 32 nt, Human
acggggaauucuuaaaacugugcucaacuauu

SEQ ID NO: 38907 - RNA, 32 nt, Human
acggggaccgggccgcacuccagccugcccuu

SEQ ID NO: 38908 - RNA, 32 nt, Human
acggggacuauacucacuucuacuucugcuac

SEQ ID NO: 38909 - RNA, 32 nt, Human
acggggacuggagggagccaggugacauggag

SEQ ID NO: 38910 - RNA, 20 nt, Human
acggggacuuccuugugcga

SEQ ID NO: 38911 - RNA, 32 nt, Human
acggggagagcagaaagcuuugggcguccugg

SEQ ID NO: 38912 - RNA, 32 nt, Human
acggggagaggccuucaccccaugcucaagcc

SEQ ID NO: 38913 - RNA, 32 nt, Human
acggggagcucccaagcagcagccaggaugcu

SEQ ID NO: 38914 - RNA, 21 nt, Human
acggggaggacggggccaggg

SEQ ID NO: 38915 - RNA, 20 nt, Human
acggggaggccaccaccagg

SEQ ID NO: 38916 - RNA, 32 nt, Human
acggggaggugaggaauaagauccuuaaaaua

SEQ ID NO: 38917 - RNA, 23 nt, Human
acggggagguuuguuugugugaa

SEQ ID NO: 38918 - RNA, 25 nt, Human
acggggaugaccuguggcgcacaaa

SEQ ID NO: 38919 - RNA, 32 nt, Human
acggggcacaucuggcugggaagucacaugga

SEQ ID NO: 38920 - RNA, 32 nt, Human
acggggcacugcccuggcucuggguaaggacg

SEQ ID NO: 38921 - RNA, 32 nt, Human
acggggcagaugucuacuuguucaguuuuuca

SEQ ID NO: 38922 - RNA, 32 nt, Human
acggggccagagccaaggaagcuuccacuucu

SEQ ID NO: 38923 - RNA, 32 nt, Human
acggggccaggccugcagccaggucuccuauc

SEQ ID NO: 38924 - RNA, 32 nt, Human
acggggccaggggaggcauagcagaaagacug

SEQ ID NO: 38925 - RNA, 22 nt, Human
acggggccauccagccugugaa

SEQ ID NO: 38926 - RNA, 32 nt, Human
acggggcccaggaccagccucaguuucucacc

SEQ ID NO: 38927 - RNA, 32 nt, Human
acggggcccaggaggucaggagagcagcccgu

SEQ ID NO: 38928 - RNA, 32 nt, Human
acggggcccaggcuagagugcaguggcgugag

SEQ ID NO: 38929 - RNA, 32 nt, Human
acggggcccgaccaggauggugcaguggcggc

SEQ ID NO: 38930 - RNA, 32 nt, Human
acggggcccgcgccugccucccuuccccgcca

SEQ ID NO: 38931 - RNA, 32 nt, Human
acggggcccuuaccugugacccucuuugcuga

SEQ ID NO: 38932 - RNA, 32 nt, Human
acggggccugcucugagccccuugcuggcaag

SEQ ID NO: 38933 - RNA, 32 nt, Human
acggggccugggcucccgggcccgaggaggaa

SEQ ID NO: 38934 - RNA, 32 nt, Human
acggggcgcugccucuguagggguuaaaucca

SEQ ID NO: 38935 - RNA, 32 nt, Human
acggggcggauggcgcccagcccagcccuaac

SEQ ID NO: 38936 - RNA, 32 nt, Human
acggggcgggggcggggcggcagugagcucgg

SEQ ID NO: 38937 - RNA, 32 nt, Human
acggggcggucucuuccgccuccugccugguu

SEQ ID NO: 38938 - RNA, 32 nt, Human
acggggcgucggcugcugcggccccgcagugu

SEQ ID NO: 38939 - RNA, 32 nt, Human
acggggcucugcuuccucaucauuccagcuca

SEQ ID NO: 38940 - RNA, 32 nt, Human
acggggcugggaaaaugaauaagaauuauaac

SEQ ID NO: 38941 - RNA, 32 nt, Human
acgggggaagugagaggaaagaggcgggggcg

SEQ ID NO: 38942 - RNA, 22 nt, Human
acgggggcacuuggaggaccug

SEQ ID NO: 38943 - RNA, 32 nt, Human
acgggggcagccugcucuccuccuggggcccu

SEQ ID NO: 38944 - RNA, 32 nt, Human
acgggggcaguguggggaaugcagcccuggug

SEQ ID NO: 38945 - RNA, 32 nt, Human
acgggggccuucuccauaggaagaggaggcga

SEQ ID NO: 38946 - RNA, 32 nt, Human
acgggggcucacgccugucaccccagagcuuu

SEQ ID NO: 38947 - RNA, 32 nt, Human
acgggggcugcacgcggcuggccggcuuccuc

SEQ ID NO: 38948 - RNA, 32 nt, Human
acgggggugagaaaggggaggccgccucugag

SEQ ID NO: 38949 - RNA, 32 nt, Human
acgggggugcuggaauuggcacuucagggcca

SEQ ID NO: 38950 - RNA, 32 nt, Human
acggggguggguggggugaagagaucuuguga

SEQ ID NO: 38951 - RNA, 32 nt, Human
acgggguacugaggcggaagguuugaagguua

SEQ ID NO: 38952 - RNA, 32 nt, Human
acgggguauuagguggaacugagggaaacaga

SEQ ID NO: 38953 - RNA, 32 nt, Human
acggggucaggagaucaagaccauccuggcua

SEQ ID NO: 38954 - RNA, 32 nt, Human
acggggucagggcuggagggcacaggcagagg

SEQ ID NO: 38955 - RNA, 32 nt, Human
acggggucauacuacauacaagcauaagcaaa

SEQ ID NO: 38956 - RNA, 32 nt, Human
acggggucauuuccucuaaggaccaccauaau

SEQ ID NO: 38957 - RNA, 32 nt, Human
acgggguccaccuucugcuccagccagaggag

SEQ ID NO: 38958 - RNA, 32 nt, Human
acggggucgccacugcacccagccugugucuu

SEQ ID NO: 38959 - RNA, 32 nt, Human
acggggucugggugggcugggugcugggaaug

SEQ ID NO: 38960 - RNA, 19 nt, Human
acggggucuuaccauguug

SEQ ID NO: 38961 - RNA, 32 nt, Human
acggggugagucaaccugggacucggucucag

SEQ ID NO: 38962 - RNA, 32 nt, Human
acgggguggaguggucaguggagccagcaccc

SEQ ID NO: 38963 - RNA, 32 nt, Human
acgggguggccgggaacucucuaggcaagaau

SEQ ID NO: 38964 - RNA, 32 nt, Human
acgggguggcugugugggauguggucauggag

SEQ ID NO: 38965 - RNA, 32 nt, Human
acgggguggggaggggaauggggaggggguuu

SEQ ID NO: 38966 - RNA, 32 nt, Human
acgggguggguugaggccucucugccacccgu

SEQ ID NO: 38967 - RNA, 32 nt, Human
acgggguuaggaguucaggaccagccuggcca

SEQ ID NO: 38968 - RNA, 20 nt, Human
acgggguuucaccauauugg

SEQ ID NO: 38969 - RNA, 19 nt, Human
acgggguuucaccauguug

SEQ ID NO: 38970 - RNA, 20 nt, Human
acgggguuucaccauguugg

SEQ ID NO: 38971 - RNA, 19 nt, Human
acgggguuucaccguguua

SEQ ID NO: 38972 - RNA, 32 nt, Human
acgggguuugaccauguuggucaggguggucu

SEQ ID NO: 38973 - RNA, 32 nt, Human
acgggguuuuacuauguugcccaggcaggucu

SEQ ID NO: 38974 - RNA, 32 nt, Human
acgggguuuugccauguugcccaggcuggaag

SEQ ID NO: 38975 - RNA, 32 nt, Human
acgggguuuugccauguugcccaggcuggucu

SEQ ID NO: 38976 - RNA, 32 nt, Human
acggguaagggagggcaggggugagggggagc

SEQ ID NO: 38977 - RNA, 32 nt, Human
acgggucacagccugguagucccacaugugcc

SEQ ID NO: 38978 - RNA, 32 nt, Human
acgggucaccagcucugccggcugaggcagag

SEQ ID NO: 38979 - RNA, 32 nt, Human
acgggugaaaucuguugcccugccugguuucu

SEQ ID NO: 38980 - RNA, 32 nt, Human
acgggugagcagagccuggagccccgggcagg

SEQ ID NO: 38981 - RNA, 32 nt, Human
acgggugagguagcucacaccuguaaucccag

SEQ ID NO: 38982 - RNA, 32 nt, Human
acgggugccacagcccaggucggaguggccca

SEQ ID NO: 38983 - RNA, 19 nt, Human
acgggugccuguaguccca

SEQ ID NO: 38984 - RNA, 32 nt, Human
acgggugcgguggaggcggccuugcgguggug

SEQ ID NO: 38985 - RNA, 32 nt, Human
acgggugcucugaccugcuuggaagaggccaa

SEQ ID NO: 38986 - RNA, 32 nt, Human
acggguggaagagaggcagccuccugcuccgg

SEQ ID NO: 38987 - RNA, 32 nt, Human
acggguggcuguagccugcgcguuuguguaaa

SEQ ID NO: 38988 - RNA, 32 nt, Human
acgggugggcccuguccaaucaguugaaggca

SEQ ID NO: 38989 - RNA, 32 nt, Human
acggguucaagcaauucuccugccucagccuc

SEQ ID NO: 38990 - RNA, 32 nt, Human
acggguucagcccagugcgguggggcuggggc

SEQ ID NO: 38991 - RNA, 32 nt, Human
acgguacccaacugccaccucccuucaaccau

SEQ ID NO: 38992 - RNA, 32 nt, Human
acgguaccugccaccagccauggcagugcauc

SEQ ID NO: 38993 - RNA, 32 nt, Human
acgguacugggcccugugauucucccagcccu

SEQ ID NO: 38994 - RNA, 32 nt, Human
acgguagcaaugggauauaauaccuuucuaag

SEQ ID NO: 38995 - RNA, 32 nt, Human
acgguagggcugggcagaggugucucuccuug

SEQ ID NO: 38996 - RNA, 19 nt, Human
acgguauccucgcuaguuu

SEQ ID NO: 38997 - RNA, 32 nt, Human
acggucaaaacuuucaaaagacaugaaacguc

SEQ ID NO: 38998 - RNA, 32 nt, Human
acggucacuccucugcccugcauuggccuuga

SEQ ID NO: 38999 - RNA, 32 nt, Human
acggucaggcucuggccagggcagagggcugc

SEQ ID NO: 39000 - RNA, 32 nt, Human
acggucaugacauacugaagcuccagccaggg

SEQ ID NO: 39001 - RNA, 32 nt, Human
acgguccaagcaaaggcucuuuucagagccac

SEQ ID NO: 39002 - RNA, 32 nt, Human
acgguccaggagcugugauguggcuguggucu

SEQ ID NO: 39003 - RNA, 32 nt, Human
acgguccaucagcgcucugccuuccagcuaga

SEQ ID NO: 39004 - RNA, 32 nt, Human
acgguccaugaguugccauccuucccucuucc

SEQ ID NO: 39005 - RNA, 32 nt, Human
acggucccaccauguuacccagccuggucuca

SEQ ID NO: 39006 - RNA, 32 nt, Human
acggucccagcaccggggaggacuggagagcg

SEQ ID NO: 39007 - RNA, 32 nt, Human
acggucccgagccauggggguguugaugucca

SEQ ID NO: 39008 - RNA, 24 nt, Human
acggucccgccggcgccaccaccg

SEQ ID NO: 39009 - RNA, 32 nt, Human
acggucccugcucuuccaagguggggacagug

SEQ ID NO: 39010 - RNA, 32 nt, Human
acggucccuuuaugcuaagucagugguucuca

SEQ ID NO: 39011 - RNA, 32 nt, Human
acgguccggagcaagcccagaggcagaggagg

SEQ ID NO: 39012 - RNA, 18 nt, Human
acgguccucgccaucuuc

SEQ ID NO: 39013 - RNA, 20 nt, Human
acgguccucggcccaucucc

SEQ ID NO: 39014 - RNA, 28 nt, Human
acgguccugagaugagccucaucccugg

SEQ ID NO: 39015 - RNA, 32 nt, Human
acgguccugaugcggcagccugggcgggugca

SEQ ID NO: 39016 - RNA, 32 nt, Human
acgguccuuggcuauguauugggcguuggagg

SEQ ID NO: 39017 - RNA, 32 nt, Human
acggucgcagggccgagggaggaccugugggc

SEQ ID NO: 39018 - RNA, 21 nt, Human
acggucgccaccugagucucc

SEQ ID NO: 39019 - RNA, 32 nt, Human
acggucgccagauuucugcuccugggcacauu

SEQ ID NO: 39020 - RNA, 32 nt, Human
acggucuccagccacgauaccugggccaaucc

SEQ ID NO: 39021 - RNA, 32 nt, Human
acggucugauuuucucuuuggauucuuccaaa

SEQ ID NO: 39022 - RNA, 32 nt, Human
acggucuguucuguuucaaggcacucuagauu

SEQ ID NO: 39023 - RNA, 32 nt, Human
acggucuucccucuucccucagucccaaaucc

SEQ ID NO: 39024 - RNA, 32 nt, Human
acggucuuggucuugacugcaaguuguccagg

SEQ ID NO: 39025 - RNA, 32 nt, Human
acggugaaaaggcaaauagguauagcuauuuu

SEQ ID NO: 39026 - RNA, 19 nt, Human
acggugaaacccugucucu

SEQ ID NO: 39027 - RNA, 19 nt, Human
acggugaaacuccgucucu

SEQ ID NO: 39028 - RNA, 32 nt, Human
acggugaaaugacaugcaaaggccauaguugu

SEQ ID NO: 39029 - RNA, 20 nt, Human
acggugaagugaucugugaa

SEQ ID NO: 39030 - RNA, 19 nt, Human
acggugacccaugccuaga

SEQ ID NO: 39031 - RNA, 32 nt, Human
acggugaccccuuuuagucaggagagugcaga

SEQ ID NO: 39032 - RNA, 22 nt, Human
acggugacuaaaagccccugaa

SEQ ID NO: 39033 - RNA, 20 nt, Human
acggugacuccagugcugga

SEQ ID NO: 39034 - RNA, 21 nt, Human
acggugacuccagugcuggac

SEQ ID NO: 39035 - RNA, 22 nt, Human
acggugacucucauucuuuaac

SEQ ID NO: 39036 - RNA, 20 nt, Human
acggugacuguggccuugaa

SEQ ID NO: 39037 - RNA, 32 nt, Human
acggugagaagcagagaaggcacuugcauccu

SEQ ID NO: 39038 - RNA, 32 nt, Human
acggugaggccccagcgccugcagccaaagcu

SEQ ID NO: 39039 - RNA, 32 nt, Human
acggugaguuacuaauuaacuuuuggcaggua

SEQ ID NO: 39040 - RNA, 32 nt, Human
acggugauccaggaggcucaaagagaagccaa

SEQ ID NO: 39041 - RNA, 32 nt, Human
acggugccaccaccaaggucucagccugggcc

SEQ ID NO: 39042 - RNA, 32 nt, Human
acggugccacugcacuccagcuugggugacag

SEQ ID NO: 39043 - RNA, 32 nt, Human
acggugccagggagguggcggccagggccagg

SEQ ID NO: 39044 - RNA, 32 nt, Human
acggugccauugcucuccagccugggcgacaa

SEQ ID NO: 39045 - RNA, 32 nt, Human
acggugcccaugcugcccagccuggagguaaa

SEQ ID NO: 39046 - RNA, 32 nt, Human
acggugcguggugugcagacagcaggagcuca

SEQ ID NO: 39047 - RNA, 32 nt, Human
acggugcucaggacagggggcgggggcagggg

SEQ ID NO: 39048 - RNA, 32 nt, Human
acggugcucccagggcguuggagcaggcggag

SEQ ID NO: 39049 - RNA, 32 nt, Human
acggugcugaagccugcagcagggcaggaugg

SEQ ID NO: 39050 - RNA, 32 nt, Human
acggugcugcugcugcacggccuaucgcagaa

SEQ ID NO: 39051 - RNA, 32 nt, Human
acgguggaagggagagaaagagaaagaaggua

SEQ ID NO: 39052 - RNA, 32 nt, Human
acgguggagccccauccaaggagccagggccc

SEQ ID NO: 39053 - RNA, 32 nt, Human
acgguggaggcagaggugacaguucccagagu

SEQ ID NO: 39054 - RNA, 24 nt, Human
acgguggcagagucuccuuggcaa

SEQ ID NO: 39055 - RNA, 32 nt, Human
acgguggcaggcagguggaggcugcgcacagc

SEQ ID NO: 39056 - RNA, 19 nt, Human
acgguggccacccccugag

SEQ ID NO: 39057 - RNA, 21 nt, Human
acgguggccccuccucagcaa

SEQ ID NO: 39058 - RNA, 29 nt, Human
acgguggcggucaucauccccuuuaacac

SEQ ID NO: 39059 - RNA, 32 nt, Human
acgguggcggucaucauccccuuuaacaccgg

SEQ ID NO: 39060 - RNA, 32 nt, Human
acgguggcucacaccuguaaccccagcacugu

SEQ ID NO: 39061 - RNA, 22 nt, Human
acgguggcucacaccuguaauc

SEQ ID NO: 39062 - RNA, 32 nt, Human
acgguggcucacaccugucaucccagcacuuu

SEQ ID NO: 39063 - RNA, 22 nt, Human
acgguggcucacacuuauaauc

SEQ ID NO: 39064 - RNA, 22 nt, Human
acgguggcucacgccuauaauc

SEQ ID NO: 39065 - RNA, 22 nt, Human
acgguggcucacgccuguaauc

SEQ ID NO: 39066 - RNA, 32 nt, Human
acgguggcuccaccacuuccgcaggccuggaa

SEQ ID NO: 39067 - RNA, 32 nt, Human
acgguggcuuacaccuguaacccuggcauuuu

SEQ ID NO: 39068 - RNA, 22 nt, Human
acgguggcuuacaccuguaauc

SEQ ID NO: 39069 - RNA, 32 nt, Human
acggugggaaaauaaguugacuuucaaaucac

SEQ ID NO: 39070 - RNA, 32 nt, Human
acggugggacgggacugcagccucccagaggc

SEQ ID NO: 39071 - RNA, 32 nt, Human
acggugggcggggagagcucgaggggaggccc

SEQ ID NO: 39072 - RNA, 21 nt, Human
acggugggggaaucccuugag

SEQ ID NO: 39073 - RNA, 21 nt, Human
acggugggggcaccccgugga

SEQ ID NO: 39074 - RNA, 32 nt, Human
acgguggucgccagggcgagaggcgggagccg

SEQ ID NO: 39075 - RNA, 32 nt, Human
acgguggucucgaucuccugaccucgugaucc

SEQ ID NO: 39076 - RNA, 32 nt, Human
acgguggucuucucccugcuuggcacccugcg

SEQ ID NO: 39077 - RNA, 21 nt, Human
acgguggugcaccauccugaa

SEQ ID NO: 39078 - RNA, 32 nt, Human
acgguggugcgaucaaagcucacugcagccuu

SEQ ID NO: 39079 - RNA, 22 nt, Human
acggugguucacaccuguaauc

SEQ ID NO: 39080 - RNA, 32 nt, Human
acggugguucacaccuguaaucccggcauuuu

SEQ ID NO: 39081 - RNA, 32 nt, Human
acgguguaccugcugcucagagcccccaaggc

SEQ ID NO: 39082 - RNA, 32 nt, Human
acggugucacccaggguggaauacaguggugu

SEQ ID NO: 39083 - RNA, 32 nt, Human
acggugucacugcacuccagccugggugacag

SEQ ID NO: 39084 - RNA, 32 nt, Human
acggugucuucaauaaauggugcugggaaagc

SEQ ID NO: 39085 - RNA, 32 nt, Human
acggugucuuucuuuccuuccuccuucuucuc

SEQ ID NO: 39086 - RNA, 32 nt, Human
acggugugcccuggccugccuucuucuugugu

SEQ ID NO: 39087 - RNA, 32 nt, Human
acgguguuagccacuacaccuggccuggauug

SEQ ID NO: 39088 - RNA, 32 nt, Human
acgguguucaucucaauagaaaucgggcaccu

SEQ ID NO: 39089 - RNA, 32 nt, Human
acgguuaaacugugcauuucucauuuugaugu

SEQ ID NO: 39090 - RNA, 32 nt, Human
acgguuacagcugguucuguagaaagagggaa

SEQ ID NO: 39091 - RNA, 32 nt, Human
acgguucaagacugagcaacucccugaauuuu

SEQ ID NO: 39092 - RNA, 32 nt, Human
acgguucaucugacaccuguguaaagcugacc

SEQ ID NO: 39093 - RNA, 32 nt, Human
acgguuccacuccugaguggucuugggugaau

SEQ ID NO: 39094 - RNA, 32 nt, Human
acgguucccagcgucugcucccacggugucca

SEQ ID NO: 39095 - RNA, 32 nt, Human
acgguugcaacaguguuccuuuucuugguuuu

SEQ ID NO: 39096 - RNA, 22 nt, Human
acgguugcucacgccuguaauc

SEQ ID NO: 39097 - RNA, 32 nt, Human
acgguugggggaggcagagguggcacuggagg

SEQ ID NO: 39098 - RNA, 32 nt, Human
acgguuguuugcuaacguauccuugaauucug

SEQ ID NO: 39099 - RNA, 32 nt, Human
acgguuuaugugugugccucauuccuuuccca

SEQ ID NO: 39100 - RNA, 32 nt, Human
acgguuucaguuaacacauugcaacuaacuuu

SEQ ID NO: 39101 - RNA, 32 nt, Human
acgguuuccucgggccgguggagggaaacaug

SEQ ID NO: 39102 - RNA, 32 nt, Human
acgguuugugcugcuguuucuggggcucugaa

SEQ ID NO: 39103 - RNA, 32 nt, Human
acgguuuugagcguagggggaggcgugagagg

SEQ ID NO: 39104 - RNA, 32 nt, Human
acgguuuugguugaggcuuguggcaaugcaca

SEQ ID NO: 39105 - RNA, 32 nt, Human
acgguuuuucuucugccaaggcuacuuccuuu

SEQ ID NO: 39106 - RNA, 32 nt, Human
acguaaaaccaaaaacuauaaaaacccuagaa

SEQ ID NO: 39107 - RNA, 32 nt, Human
acguaaacaguauuuauuauaaauuacuaccg

SEQ ID NO: 39108 - RNA, 32 nt, Human
acguaaaggcaugacuuccuggcaccacaggg

SEQ ID NO: 39109 - RNA, 32 nt, Human
acguaaagucauaauuugcaaaauauuuggca

SEQ ID NO: 39110 - RNA, 32 nt, Human
acguaaauagcugucaucaucauuaucuuuua

SEQ ID NO: 39111 - RNA, 32 nt, Human
acguaacaaaccugcacauugugcacauguac

SEQ ID NO: 39112 - RNA, 32 nt, Human
acguaagaacuggccaugacagccuguguuuc

SEQ ID NO: 39113 - RNA, 32 nt, Human
acguaagaccuccugcccuuagcucucuugcu

SEQ ID NO: 39114 - RNA, 32 nt, Human
acguaagauguggcuaguucugagaugugaaa

SEQ ID NO: 39115 - RNA, 32 nt, Human
acguaagauuccaacuguagccacuuucacua

SEQ ID NO: 39116 - RNA, 32 nt, Human
acguaaggcucaauaucugcguugaccaccua

SEQ ID NO: 39117 - RNA, 32 nt, Human
acguaaguauaugaaauagugcagacuguuuc

SEQ ID NO: 39118 - RNA, 32 nt, Human
acguaagugauacucuguccacucuuuugauu

SEQ ID NO: 39119 - RNA, 32 nt, Human
acguaauuacucagugcuuugaagggacaucc

SEQ ID NO: 39120 - RNA, 32 nt, Human
acguacaaggcagauggagcauugacguuuuc

SEQ ID NO: 39121 - RNA, 32 nt, Human
acguacacaaugcacacaugcacacacgcaca

SEQ ID NO: 39122 - RNA, 32 nt, Human
acguacaguacaacauuucaaggaaaugaaua

SEQ ID NO: 39123 - RNA, 32 nt, Human
acguacauuccuuuuuccuuuuucugccucuu

SEQ ID NO: 39124 - RNA, 19 nt, Human
acguaccacacugacccug

SEQ ID NO: 39125 - RNA, 32 nt, Human
acguaccaucagagaaggcauacuggagagau

SEQ ID NO: 39126 - RNA, 32 nt, Human
acguaccuguaaucucagcuacucaggaggcu

SEQ ID NO: 39127 - RNA, 32 nt, Human
acguaccuguagucccagcuacuugggaggcu

SEQ ID NO: 39128 - RNA, 32 nt, Human
acguacgcacacacgcacaugcacagauaugc

SEQ ID NO: 39129 - RNA, 32 nt, Human
acguacucaagggagcgcgcccgcguuauccu

SEQ ID NO: 39130 - RNA, 32 nt, Human
acguacucagucauuggugucuuuggagugac

SEQ ID NO: 39131 - RNA, 32 nt, Human
acguacuccaugcgcuaccugcugcccagcgu

SEQ ID NO: 39132 - RNA, 32 nt, Human
acguacugcagccucaaccuccugggcucaag

SEQ ID NO: 39133 - RNA, 32 nt, Human
acguacugggauuacaggcgugagccaccgcg

SEQ ID NO: 39134 - RNA, 23 nt, Human
acguacugugguuaccccuguga

SEQ ID NO: 39135 - RNA, 32 nt, Human
acguacuuccuuggagaccugcauuugccaac

SEQ ID NO: 39136 - RNA, 32 nt, Human
acguacuuccuuucuuucuucccucuguuauu

SEQ ID NO: 39137 - RNA, 32 nt, Human
acguagaggcagacccaugugcugcuguugca

SEQ ID NO: 39138 - RNA, 32 nt, Human
acguagccauuagagaugacagagguaauauc

SEQ ID NO: 39139 - RNA, 32 nt, Human
acguagcucugccugccugucaaccccucacu

SEQ ID NO: 39140 - RNA, 32 nt, Human
acguagcugugggcggggucuuggggaugagg

SEQ ID NO: 39141 - RNA, 32 nt, Human
acguaggaaaauguccuuucucagggaguggg

SEQ ID NO: 39142 - RNA, 32 nt, Human
acguaggaggggccguggggucccuaagugau

SEQ ID NO: 39143 - RNA, 32 nt, Human
acguaggccaccggccucauccagggccccac

SEQ ID NO: 39144 - RNA, 32 nt, Human
acguaggccaggagccucagcgcugccccuuc

SEQ ID NO: 39145 - RNA, 32 nt, Human
acguaggcuaccacucuccgggcaccggcugg

SEQ ID NO: 39146 - RNA, 32 nt, Human
acguauaauguucuacaauuuuuguuaucaca

SEQ ID NO: 39147 - RNA, 32 nt, Human
acguauccuguuguugaguucucugggucaga

SEQ ID NO: 39148 - RNA, 32 nt, Human
acguaugccacauagccccugcgaagaaaagg

SEQ ID NO: 39149 - RNA, 32 nt, Human
acguauggcaggcagacugggagcaggaaaac

SEQ ID NO: 39150 - RNA, 32 nt, Human
acguauugggacaagcauuguacuggcaggca

SEQ ID NO: 39151 - RNA, 32 nt, Human
acguauugguucuuuauuaaauaauuuuugaa

SEQ ID NO: 39152 - RNA, 32 nt, Human
acguauuugguccucugaugaaugacuguccc

SEQ ID NO: 39153 - RNA, 22 nt, Human
acgucaaagcacacaagacaua

SEQ ID NO: 39154 - RNA, 32 nt, Human
acgucaacuuccuauccuugccugacacuguc

SEQ ID NO: 39155 - RNA, 32 nt, Human
acgucaagguggugaugcugggcaaggaguac

SEQ ID NO: 39156 - RNA, 32 nt, Human
acgucaaguugaaauuagguacagcuguugcu

SEQ ID NO: 39157 - RNA, 32 nt, Human
acgucacacucccagaccccugaggggcccac

SEQ ID NO: 39158 - RNA, 32 nt, Human
acgucacaguuuuucugcucuggucauuugca

SEQ ID NO: 39159 - RNA, 32 nt, Human
acgucaccagagagacagcuguugagaccgcu

SEQ ID NO: 39160 - RNA, 32 nt, Human
acgucacugaagggcugaaggaagccaacgac

SEQ ID NO: 39161 - RNA, 32 nt, Human
acgucacugcacuccagcuugggcaacagagc

SEQ ID NO: 39162 - RNA, 32 nt, Human
acgucacugcacuccggccugggugacagagc

SEQ ID NO: 39163 - RNA, 32 nt, Human
acgucacugcacucuagccugggcaacagagu

SEQ ID NO: 39164 - RNA, 32 nt, Human
acgucacugcauuccagccuggauaauagagu

SEQ ID NO: 39165 - RNA, 32 nt, Human
acgucacugcauuccagccugggugacagagc

SEQ ID NO: 39166 - RNA, 27 nt, Human
acgucacuggggcuuuggggucagcua

SEQ ID NO: 39167 - RNA, 32 nt, Human
acgucacuguacuccagccugggugacagagu

SEQ ID NO: 39168 - RNA, 32 nt, Human
acgucagauacaaaugucucuauccaauuuca

SEQ ID NO: 39169 - RNA, 32 nt, Human
acgucagcauuuucuucucugcacuuauaaga

SEQ ID NO: 39170 - RNA, 32 nt, Human
acgucagccagcacugcacagacagcugcgac

SEQ ID NO: 39171 - RNA, 32 nt, Human
acgucagcuucuucauuuuaauucuccuuuua

SEQ ID NO: 39172 - RNA, 32 nt, Human
acgucaggaccuccccacacacccacacgaug

SEQ ID NO: 39173 - RNA, 32 nt, Human
acgucaggcagccgggacaccggagugucccc

SEQ ID NO: 39174 - RNA, 32 nt, Human
acgucauagaauauucuucuuccucucaggag

SEQ ID NO: 39175 - RNA, 32 nt, Human
acgucaucuccagcuccagccugcuggggccu

SEQ ID NO: 39176 - RNA, 32 nt, Human
acgucaugccacgcuuaacaccucuaacaacu

SEQ ID NO: 39177 - RNA, 32 nt, Human
acgucauugcacuccagccuggucaacaagag

SEQ ID NO: 39178 - RNA, 32 nt, Human
acgucauugcacuccauccugagccacaagag

SEQ ID NO: 39179 - RNA, 32 nt, Human
acgucauugcucuccagccugggcaacagagc

SEQ ID NO: 39180 - RNA, 32 nt, Human
acguccaccccagccucacauugccagauguu

SEQ ID NO: 39181 - RNA, 32 nt, Human
acguccaccuccuggguucaagcgauucuccu

SEQ ID NO: 39182 - RNA, 32 nt, Human
acguccaccucuugaguucaagcgauucuccu

SEQ ID NO: 39183 - RNA, 22 nt, Human
acguccaccuggguguguucau

SEQ ID NO: 39184 - RNA, 32 nt, Human
acguccacgcagcagagggacaugggccauuc

SEQ ID NO: 39185 - RNA, 18 nt, Human
acguccagccugugucca

SEQ ID NO: 39186 - RNA, 32 nt, Human
acguccaggacacaccuguaucccagagagca

SEQ ID NO: 39187 - RNA, 32 nt, Human
acguccagucauaguaacuucccuugaacuuc

SEQ ID NO: 39188 - RNA, 32 nt, Human
acguccaucucgcucaucaucaccgacacguc

SEQ ID NO: 39189 - RNA, 32 nt, Human
acguccaugaggaaaacucccagugaugaucu

SEQ ID NO: 39190 - RNA, 32 nt, Human
acgucccagggagggaggggcggcccacaccc

SEQ ID NO: 39191 - RNA, 32 nt, Human
acgucccaggucucugcacacccguggaauuc

SEQ ID NO: 39192 - RNA, 32 nt, Human
acguccccacuauguucugucuugagaagggg

SEQ ID NO: 39193 - RNA, 32 nt, Human
acguccccaugccugggugcugugaggccuga

SEQ ID NO: 39194 - RNA, 32 nt, Human
acgucccccacuccuggcaccaugaaggcggc

SEQ ID NO: 39195 - RNA, 32 nt, Human
acguccccgcgccgggccucaggcuccuuccu

SEQ ID NO: 39196 - RNA, 32 nt, Human
acguccccuccagggccuagagcuggggacca

SEQ ID NO: 39197 - RNA, 32 nt, Human
acguccccucccaccucuccccaaaccccugc

SEQ ID NO: 39198 - RNA, 32 nt, Human
acgucccgcaggcggagguaggccgcgggagg

SEQ ID NO: 39199 - RNA, 32 nt, Human
acgucccgggcacugucaugcccagcuuggag

SEQ ID NO: 39200 - RNA, 32 nt, Human
acguccgagcagccgccuugacuggggaaggg

SEQ ID NO: 39201 - RNA, 32 nt, Human
acguccgccucccagguucaagcgauucucau

SEQ ID NO: 39202 - RNA, 32 nt, Human
acguccgccuccuggguucaagugauucuucu

SEQ ID NO: 39203 - RNA, 32 nt, Human
acguccgcuacaccgaagccuggugagcuccc

SEQ ID NO: 39204 - RNA, 32 nt, Human
acguccgggcaguggagggagggacacagccu

SEQ ID NO: 39205 - RNA, 32 nt, Human
acguccuacuccucacacugcucuacugcuca

SEQ ID NO: 39206 - RNA, 32 nt, Human
acguccuccuacuuaauucuucuucaagauug

SEQ ID NO: 39207 - RNA, 32 nt, Human
acguccuccugaauaccuguacuuccaagagg

SEQ ID NO: 39208 - RNA, 32 nt, Human
acguccucuccaggaagggaccccggguucac

SEQ ID NO: 39209 - RNA, 32 nt, Human
acguccucuccaggaggggaccccggguucac

SEQ ID NO: 39210 - RNA, 21 nt, Human
acguccugagccucccuguga

SEQ ID NO: 39211 - RNA, 32 nt, Human
acguccugggguagcuccugaccuccgaccuu

SEQ ID NO: 39212 - RNA, 32 nt, Human
acguccugggugcugucaugcccagcuuggag

SEQ ID NO: 39213 - RNA, 32 nt, Human
acguccugguauuucuauccuugcccuccaug

SEQ ID NO: 39214 - RNA, 32 nt, Human
acguccuguuuucccaccuaccccuguaacgc

SEQ ID NO: 39215 - RNA, 32 nt, Human
acguccuugccuucuugggagcuccaagcggc

SEQ ID NO: 39216 - RNA, 32 nt, Human
acgucgaaaccaguggagauuacuaaaccgua

SEQ ID NO: 39217 - RNA, 31 nt, Human
acgucgacuucaucagccaggagggagagcu

SEQ ID NO: 39218 - RNA, 32 nt, Human
acgucgcaaagcagaaacugaaaacugaucca

SEQ ID NO: 39219 - RNA, 32 nt, Human
acgucgccuccccuucauccaccucucucuca

SEQ ID NO: 39220 - RNA, 32 nt, Human
acgucggacuccgucuccgcggcagggaagca

SEQ ID NO: 39221 - RNA, 32 nt, Human
acgucggcagccccagccccagaaaaggaacc

SEQ ID NO: 39222 - RNA, 32 nt, Human
acgucggccauuccaggccccguuuuucccuu

SEQ ID NO: 39223 - RNA, 21 nt, Human
acgucgucgccgccgccgccg

SEQ ID NO: 39224 - RNA, 32 nt, Human
acgucuaaggagagaugcccagcugggagucc

SEQ ID NO: 39225 - RNA, 32 nt, Human
acgucuagcaaagcccuugcccucucugagcc

SEQ ID NO: 39226 - RNA, 32 nt, Human
acgucuagcucucagcagagcugggagcaaag

SEQ ID NO: 39227 - RNA, 32 nt, Human
acgucuauuucccucagacacagggauccuug

SEQ ID NO: 39228 - RNA, 32 nt, Human
acgucucaaugccaucgucgccgccaccauga

SEQ ID NO: 39229 - RNA, 32 nt, Human
acgucuccacccagcgcucauccuggcaaggg

SEQ ID NO: 39230 - RNA, 32 nt, Human
acgucuccuccagggauggcgcuggcggcuuu

SEQ ID NO: 39231 - RNA, 32 nt, Human
acgucuccugucuucuuuaccugauccacagg

SEQ ID NO: 39232 - RNA, 32 nt, Human
acgucuccuuuucugagugagucuaggauagu

SEQ ID NO: 39233 - RNA, 32 nt, Human
acgucucucccgaggaucuggcccuggacuuc

SEQ ID NO: 39234 - RNA, 32 nt, Human
acgucucugucucugggccuuuguuccccuau

SEQ ID NO: 39235 - RNA, 32 nt, Human
acgucugacuuagugggcaccugaccacuuug

SEQ ID NO: 39236 - RNA, 32 nt, Human
acgucugcacggccuccaccuucuguacagug

SEQ ID NO: 39237 - RNA, 32 nt, Human
acgucugcccuggguguuaggagcgaggugca

SEQ ID NO: 39238 - RNA, 32 nt, Human
acgucugccucagccacugccuccgagaagca

SEQ ID NO: 39239 - RNA, 32 nt, Human
acgucugccuccuggguucaagcaauucuccu

SEQ ID NO: 39240 - RNA, 32 nt, Human
acgucugcgcagcaagaaaagaaucucaguug

SEQ ID NO: 39241 - RNA, 32 nt, Human
acgucugcuucaugacucccuaaugccuuccc

SEQ ID NO: 39242 - RNA, 32 nt, Human
acgucuggccacacugacucagucccaguaac

SEQ ID NO: 39243 - RNA, 32 nt, Human
acgucuguaaucuuugggagcacuuugggagg

SEQ ID NO: 39244 - RNA, 32 nt, Human
acgucugugcacuguccuccugcugguuaucc

SEQ ID NO: 39245 - RNA, 32 nt, Human
acgucuguggcagcuucugucucgcugggacc

SEQ ID NO: 39246 - RNA, 32 nt, Human
acgucuguguccaccaguccugcucagaaucu

SEQ ID NO: 39247 - RNA, 32 nt, Human
acgucugugugagcuguucuaggccgagggcc

SEQ ID NO: 39248 - RNA, 32 nt, Human
acgucuuaacucugcugcuucccaaggauggc

SEQ ID NO: 39249 - RNA, 32 nt, Human
acgucuucggcggaugucauggugcugaacca

SEQ ID NO: 39250 - RNA, 32 nt, Human
acgucuugagucugggauuauccgcauuguau

SEQ ID NO: 39251 - RNA, 32 nt, Human
acgucuuggucuccacagaaccacagugccuu

SEQ ID NO: 39252 - RNA, 32 nt, Human
acgucuuuccaucauggucuuaacaaccauga

SEQ ID NO: 39253 - RNA, 32 nt, Human
acgucuuuggaaggaggaagggggugagggag

SEQ ID NO: 39254 - RNA, 32 nt, Human
acgucuuuggacucagcuccugcccagcuccc

SEQ ID NO: 39255 - RNA, 32 nt, Human
acgugaaaaacauaggauacaaaacuuuaaag

SEQ ID NO: 39256 - RNA, 32 nt, Human
acgugaaaacacucaaggccuagggggaggac

SEQ ID NO: 39257 - RNA, 32 nt, Human
acgugaaaaccaacaaauaaugcuuaaaggcc

SEQ ID NO: 39258 - RNA, 32 nt, Human
acgugaaaucagugaggugagacuucccagac

SEQ ID NO: 39259 - RNA, 31 nt, Human
acgugaagcucaagauaccuguagaaagaaa

SEQ ID NO: 39260 - RNA, 32 nt, Human
acgugaagucacggguaggggccaggccccuc

SEQ ID NO: 39261 - RNA, 32 nt, Human
acgugaagugaggaggggguugggaggggaga

SEQ ID NO: 39262 - RNA, 32 nt, Human
acgugaaugaaaccaggccauagcugucauaa

SEQ ID NO: 39263 - RNA, 32 nt, Human
acgugaauggccaggaucagauugugcccggc

SEQ ID NO: 39264 - RNA, 32 nt, Human
acgugaccacuagccuccuggagccagagagu

SEQ ID NO: 39265 - RNA, 32 nt, Human
acgugaccaucaaccaaccagcggucagaauc

SEQ ID NO: 39266 - RNA, 32 nt, Human
acgugacccaggcuggaguguaguagcuauuc

SEQ ID NO: 39267 - RNA, 32 nt, Human
acgugaccccuccuagccucaggcucccucgu

SEQ ID NO: 39268 - RNA, 32 nt, Human
acgugacccugacccaauaaggguggaaggcu

SEQ ID NO: 39269 - RNA, 32 nt, Human
acgugacccugugccccgccucccggggugcc

SEQ ID NO: 39270 - RNA, 32 nt, Human
acgugaccgcucaguacauggagcggcugaac

SEQ ID NO: 39271 - RNA, 32 nt, Human
acgugaccuccaggaaagcaguucuggccgag

SEQ ID NO: 39272 - RNA, 32 nt, Human
acgugaccuggugacagugcugacuuggcugu

SEQ ID NO: 39273 - RNA, 32 nt, Human
acgugacucccacauguaaucaggagaaaggg

SEQ ID NO: 39274 - RNA, 32 nt, Human
acgugacuguguguuuccacacuugagaaguc

SEQ ID NO: 39275 - RNA, 32 nt, Human
acgugacuuuuuagauccucaccauuucugcu

SEQ ID NO: 39276 - RNA, 32 nt, Human
acgugagaaaggacaugaggagacuaaagacc

SEQ ID NO: 39277 - RNA, 32 nt, Human
acgugagaccugcgacaaagacagguuagaga

SEQ ID NO: 39278 - RNA, 32 nt, Human
acgugagagcacugccgcgguggguugugggg

SEQ ID NO: 39279 - RNA, 32 nt, Human
acgugagcccaggaauucaaggcugcagugaa

SEQ ID NO: 39280 - RNA, 32 nt, Human
acgugagcuaauuauaucaaauaaguaucaca

SEQ ID NO: 39281 - RNA, 32 nt, Human
acgugagcuggugcuucgugugcuccaaaggg

SEQ ID NO: 39282 - RNA, 32 nt, Human
acgugaggaggcugcaacucagcacuaaguag

SEQ ID NO: 39283 - RNA, 32 nt, Human
acgugaggcaccacaaccagccuggaugauuc

SEQ ID NO: 39284 - RNA, 32 nt, Human
acgugagggaaagauauugaagaggaguugga

SEQ ID NO: 39285 - RNA, 32 nt, Human
acgugagggagauggauuaaugugaguaacag

SEQ ID NO: 39286 - RNA, 32 nt, Human
acgugagggcaugaaugguucauucaggcagc

SEQ ID NO: 39287 - RNA, 32 nt, Human
acgugaggucaccuugggaggguggguggaug

SEQ ID NO: 39288 - RNA, 22 nt, Human
acgugaguccaggaggucaagg

SEQ ID NO: 39289 - RNA, 32 nt, Human
acgugauaaagugcaagcacuuuuccauuuua

SEQ ID NO: 39290 - RNA, 32 nt, Human
acgugauaugacucuguuuuccuugcuuguuu

SEQ ID NO: 39291 - RNA, 32 nt, Human
acgugaucaucaccacugacagaugauucaca

SEQ ID NO: 39292 - RNA, 32 nt, Human
acgugaucugcuggcccucaggcugcugcucu

SEQ ID NO: 39293 - RNA, 32 nt, Human
acgugaugaagaguaucgaagugaagauauuc

SEQ ID NO: 39294 - RNA, 32 nt, Human
acgugauggacgcggucccagcgcggcgcugg

SEQ ID NO: 39295 - RNA, 19 nt, Human
acgugaugugcugcucugu

SEQ ID NO: 39296 - RNA, 32 nt, Human
acgugauguucuacaaugacauugagaaaagg

SEQ ID NO: 39297 - RNA, 18 nt, Human
acgugauucuggagccuu

SEQ ID NO: 39298 - RNA, 32 nt, Human
acgugauugaccuuggcgagaucauguuucua

SEQ ID NO: 39299 - RNA, 31 nt, Human
acgugauugacucucccuuagcugagagggc

SEQ ID NO: 39300 - RNA, 32 nt, Human
acgugcaaacagccacuucccagccccacucc

SEQ ID NO: 39301 - RNA, 32 nt, Human
acgugcaauaaagaagcacauuauuuuagcuu

SEQ ID NO: 39302 - RNA, 32 nt, Human
acgugcagagugagagugguaugaauuuuccu

SEQ ID NO: 39303 - RNA, 30 nt, Human
acgugcagccucuccaugucugauuacaaa

SEQ ID NO: 39304 - RNA, 32 nt, Human
acgugcaguggugaauggaggcugccagcagc

SEQ ID NO: 39305 - RNA, 32 nt, Human
acgugcauacuccugaaucggauguaaaugca

SEQ ID NO: 39306 - RNA, 31 nt, Human
acgugcauuuuuacucaacuaccucagguau

SEQ ID NO: 39307 - RNA, 32 nt, Human
acgugccaagacuagcucagaaaagccggcag

SEQ ID NO: 39308 - RNA, 32 nt, Human
acgugcccacuggucuggggucaggguuuucu

SEQ ID NO: 39309 - RNA, 32 nt, Human
acgugccccuucccaggcuccuggggccccuu

SEQ ID NO: 39310 - RNA, 32 nt, Human
acgugccccuugucgcgcgucucccauccuga

SEQ ID NO: 39311 - RNA, 32 nt, Human
acgugcccuccccaccucacuagacucuccgg

SEQ ID NO: 39312 - RNA, 32 nt, Human
acgugcccuguguuccggccccggcuggggcu

SEQ ID NO: 39313 - RNA, 32 nt, Human
acgugccuaagcugcugcagcuggcacccggu

SEQ ID NO: 39314 - RNA, 32 nt, Human
acgugccuagcauggcucaucaacaucugaac

SEQ ID NO: 39315 - RNA, 32 nt, Human
acgugccuccuuccucuucaccuugugcccug

SEQ ID NO: 39316 - RNA, 32 nt, Human
acgugccugccugcuaccccugcccagcugcu

SEQ ID NO: 39317 - RNA, 32 nt, Human
acgugccuggggagagaagcaagagcaggcug

SEQ ID NO: 39318 - RNA, 32 nt, Human
acgugccuguaaucccagcuaccugggaggcu

SEQ ID NO: 39319 - RNA, 32 nt, Human
acgugccuguaaucccagcuacucaggaggcu

SEQ ID NO: 39320 - RNA, 32 nt, Human
acgugccuguaaucccagcuacucgcaaggcu

SEQ ID NO: 39321 - RNA, 32 nt, Human
acgugccuguaaucccagcuacucgggaggcu

SEQ ID NO: 39322 - RNA, 32 nt, Human
acgugccuguaaucccaguuacucaggaggcu

SEQ ID NO: 39323 - RNA, 32 nt, Human
acgugccuguaaucccaguuacuugggaggcu

SEQ ID NO: 39324 - RNA, 32 nt, Human
acgugccuguaaucucagcaacucaggaggcu

SEQ ID NO: 39325 - RNA, 32 nt, Human
acgugccuguaaucucagcuacucaggaggau

SEQ ID NO: 39326 - RNA, 32 nt, Human
acgugccuguaauuccagcuacuugggaggcu

SEQ ID NO: 39327 - RNA, 32 nt, Human
acgugccuguagccccagcuacuugggaggcu

SEQ ID NO: 39328 - RNA, 32 nt, Human
acgugccuguagucccagcuacaugggaggcu

SEQ ID NO: 39329 - RNA, 32 nt, Human
acgugccuguagucccagcuacucaggaggcu

SEQ ID NO: 39330 - RNA, 32 nt, Human
acgugccuguagucccagcuacuccggaggcu

SEQ ID NO: 39331 - RNA, 32 nt, Human
acgugccuguagucccagcuacucgggaagcu

SEQ ID NO: 39332 - RNA, 32 nt, Human
acgugccuguagucccagcuacucgggaggcu

SEQ ID NO: 39333 - RNA, 32 nt, Human
acgugccuguagucccagcuacucuauagccu

SEQ ID NO: 39334 - RNA, 32 nt, Human
acgugccuguagucccagcuacucuggaggcu

SEQ ID NO: 39335 - RNA, 32 nt, Human
acgugccuguagucccagcuacuucggggacu

SEQ ID NO: 39336 - RNA, 32 nt, Human
acgugccuguagucccagcuccuugggaggcu

SEQ ID NO: 39337 - RNA, 32 nt, Human
acgugccuguagucccagcuguccuggaggcu

SEQ ID NO: 39338 - RNA, 32 nt, Human
acgugccuguagucucagcuacuugggaggcu

SEQ ID NO: 39339 - RNA, 20 nt, Human
acgugccuguaguuccagcu

SEQ ID NO: 39340 - RNA, 32 nt, Human
acgugccuguaguuccagcuacuugggaggca

SEQ ID NO: 39341 - RNA, 32 nt, Human
acgugccugugaucccagcuacuugggaggcu

SEQ ID NO: 39342 - RNA, 32 nt, Human
acgugccuguggucccagcuacucgagaggcu

SEQ ID NO: 39343 - RNA, 32 nt, Human
acgugccuguggucccagcuacuugggaggcu

SEQ ID NO: 39344 - RNA, 32 nt, Human
acgugccuguuaucucagcuacuugggaagcu

SEQ ID NO: 39345 - RNA, 32 nt, Human
acgugccuguucugauucucauuugugucucu

SEQ ID NO: 39346 - RNA, 32 nt, Human
acgugccuuuaguuccagcuacucaggaggcu

SEQ ID NO: 39347 - RNA, 32 nt, Human
acgugcgaguguccgcgguccugcugcugucu

SEQ ID NO: 39348 - RNA, 32 nt, Human
acgugcggagcacguccccuccagacugaagg

SEQ ID NO: 39349 - RNA, 32 nt, Human
acgugcucagccacccucuggcucagcggggc

SEQ ID NO: 39350 - RNA, 32 nt, Human
acgugcuccacuccagcucccugccagugcag

SEQ ID NO: 39351 - RNA, 32 nt, Human
acgugcuccccuucccagccacugacucacag

SEQ ID NO: 39352 - RNA, 32 nt, Human
acgugcuccugugucuaccccaacacaaaggu

SEQ ID NO: 39353 - RNA, 32 nt, Human
acgugcugggauuacagccgguggucaugcca

SEQ ID NO: 39354 - RNA, 32 nt, Human
acgugcugggauuacaggcaugagccaccacg

SEQ ID NO: 39355 - RNA, 32 nt, Human
acgugcugggauuacaggcaugagccacuacg

SEQ ID NO: 39356 - RNA, 32 nt, Human
acgugcugggauuacaggugugagccacuacg

SEQ ID NO: 39357 - RNA, 32 nt, Human
acgugcuggguggaccuaagguuccuucccac

SEQ ID NO: 39358 - RNA, 32 nt, Human
acgugcuguccaccaggccuuggagacaggcu

SEQ ID NO: 39359 - RNA, 32 nt, Human
acgugcuuguagucccagcuacuugggaggcu

SEQ ID NO: 39360 - RNA, 32 nt, Human
acgugcuuguggucccagcuacucaggaggcu

SEQ ID NO: 39361 - RNA, 32 nt, Human
acguggaacugaggcagcuguauggaggccaa

SEQ ID NO: 39362 - RNA, 32 nt, Human
acguggacagcgacuccuccuccagucacagc

SEQ ID NO: 39363 - RNA, 32 nt, Human
acguggaccucaacuucugauuccagaacacg

SEQ ID NO: 39364 - RNA, 32 nt, Human
acguggagcugcucaacuuagagugaggcagg

SEQ ID NO: 39365 - RNA, 32 nt, Human
acguggagcugcugccccggggaggccuggcc

SEQ ID NO: 39366 - RNA, 32 nt, Human
acguggagcuggaccacgccacccuggugcgc

SEQ ID NO: 39367 - RNA, 32 nt, Human
acguggaggcagagguugcagugagccgagau

SEQ ID NO: 39368 - RNA, 32 nt, Human
acguggaggcccuguccuagugcugaggacac

SEQ ID NO: 39369 - RNA, 32 nt, Human
acguggagguuagaauagagggcagaguaaaa

SEQ ID NO: 39370 - RNA, 32 nt, Human
acguggaguuacagaagccauugaaaaguuua

SEQ ID NO: 39371 - RNA, 32 nt, Human
acguggaguuuuccuucccagaaucucacugc

SEQ ID NO: 39372 - RNA, 32 nt, Human
acguggaugagcuccuggacauggagagugac

SEQ ID NO: 39373 - RNA, 32 nt, Human
acguggaugcccaggacaggacuguucuacau

SEQ ID NO: 39374 - RNA, 32 nt, Human
acguggaugcugguuagaaaugcaacaucagg

SEQ ID NO: 39375 - RNA, 32 nt, Human
acguggcagccugcgucugcuugucuaugucu

SEQ ID NO: 39376 - RNA, 32 nt, Human
acguggcaggcaggccucaguugaggacguga

SEQ ID NO: 39377 - RNA, 32 nt, Human
acguggcaugaucuugauaacuguugaaucug

SEQ ID NO: 39378 - RNA, 32 nt, Human
acguggcauguggccuguggccugugucccau

SEQ ID NO: 39379 - RNA, 32 nt, Human
acguggcauguguaggugaauuacaggggcca

SEQ ID NO: 39380 - RNA, 32 nt, Human
acguggccaaccuggggacucuggccuuaaga

SEQ ID NO: 39381 - RNA, 32 nt, Human
acguggccaccugcccagcuucacaccucccc

SEQ ID NO: 39382 - RNA, 32 nt, Human
acguggcccgcccccggcagggcacagcgcgc

SEQ ID NO: 39383 - RNA, 32 nt, Human
acguggccuuucacugguugugaauugguaug

SEQ ID NO: 39384 - RNA, 32 nt, Human
acguggcucaggcaguggguagaaaggggcag

SEQ ID NO: 39385 - RNA, 32 nt, Human
acguggcucgacuauagaaaacuccacugacu

SEQ ID NO: 39386 - RNA, 32 nt, Human
acguggcugccacgcugacacacccacauuca

SEQ ID NO: 39387 - RNA, 32 nt, Human
acguggcuggagagagaagugggagggagggg

SEQ ID NO: 39388 - RNA, 17 nt, Human
acguggcuggcauugca

SEQ ID NO: 39389 - RNA, 32 nt, Human
acguggcuucacuuggcacagcuccucugagu

SEQ ID NO: 39390 - RNA, 32 nt, Human
acguggcuuccagauuugcaucugugcugcag

SEQ ID NO: 39391 - RNA, 32 nt, Human
acgugggaaccgccgcagcuccacacuccagg

SEQ ID NO: 39392 - RNA, 32 nt, Human
acgugggacagaggacacagagguggaagauu

SEQ ID NO: 39393 - RNA, 22 nt, Human
acgugggagaaggagccuacca

SEQ ID NO: 39394 - RNA, 32 nt, Human
acgugggaggcagaaguugcagugagccaaga

SEQ ID NO: 39395 - RNA, 25 nt, Human
acgugggaggcagagguugcaguga

SEQ ID NO: 39396 - RNA, 32 nt, Human
acgugggaggcagagguugcagugagccgaga

SEQ ID NO: 39397 - RNA, 32 nt, Human
acgugggaggcagagguugcagugaguggaga

SEQ ID NO: 39398 - RNA, 32 nt, Human
acgugggaggcggagguugcagcgagcugaga

SEQ ID NO: 39399 - RNA, 25 nt, Human
acgugggaggcggagguugcaguga

SEQ ID NO: 39400 - RNA, 32 nt, Human
acgugggaggcggagguugcagugagcugaga

SEQ ID NO: 39401 - RNA, 25 nt, Human
acgugggaggcggagguuguaguga

SEQ ID NO: 39402 - RNA, 32 nt, Human
acgugggaggcggagguuguagugagccagga

SEQ ID NO: 39403 - RNA, 32 nt, Human
acgugggaggcugaggcaggagaaucacuuga

SEQ ID NO: 39404 - RNA, 32 nt, Human
acgugggauagauaacugagaggcucagaauc

SEQ ID NO: 39405 - RNA, 32 nt, Human
acgugggaugugaaaaucaaagaacacaugac

SEQ ID NO: 39406 - RNA, 32 nt, Human
acgugggcagaggcgcagggccacugcgccga

SEQ ID NO: 39407 - RNA, 32 nt, Human
acgugggcccagcaguccugugcuuggaaaug

SEQ ID NO: 39408 - RNA, 32 nt, Human
acgugggcggcgugguuccaagcacagugaag

SEQ ID NO: 39409 - RNA, 32 nt, Human
acgugggcuccagggacuggaguguaaugcuc

SEQ ID NO: 39410 - RNA, 18 nt, Human
acgugggcugucuucaca

SEQ ID NO: 39411 - RNA, 32 nt, Human
acguggggaaacugaggcccggagggggccga

SEQ ID NO: 39412 - RNA, 32 nt, Human
acguggggagcguguuaaaauuacagauuccu

SEQ ID NO: 39413 - RNA, 32 nt, Human
acguggggaggguggaggggugacaguggagg

SEQ ID NO: 39414 - RNA, 32 nt, Human
acguggggaugcugcuguggcuucuugucuuc

SEQ ID NO: 39415 - RNA, 32 nt, Human
acguggggcagccaccccugcccagcgagagc

SEQ ID NO: 39416 - RNA, 32 nt, Human
acgugguccuuucucuugccugugagcuggug

SEQ ID NO: 39417 - RNA, 32 nt, Human
acguggugaggguggccugggccugggcaccc

SEQ ID NO: 39418 - RNA, 32 nt, Human
acgugguguggggcucugggggugggguggaa

SEQ ID NO: 39419 - RNA, 32 nt, Human
acgugguugccuggccugggcugcgcccagca

SEQ ID NO: 39420 - RNA, 32 nt, Human
acguguaaaacacaguuccuacugcacaagua

SEQ ID NO: 39421 - RNA, 32 nt, Human
acguguaaucccaguacuuuggaagguggagg

SEQ ID NO: 39422 - RNA, 32 nt, Human
acguguaccuagaagggauggaagaggccucc

SEQ ID NO: 39423 - RNA, 32 nt, Human
acguguaccuggagggccgcugccucaauugc

SEQ ID NO: 39424 - RNA, 32 nt, Human
acguguaucacuucaucucucugcucuccaag

SEQ ID NO: 39425 - RNA, 32 nt, Human
acguguauucauugaugucugccuguaacuuc

SEQ ID NO: 39426 - RNA, 32 nt, Human
acgugucaacucugcuuaauuaagcacuuuga

SEQ ID NO: 39427 - RNA, 32 nt, Human
acguguccacacaugcuccagacccuggggca

SEQ ID NO: 39428 - RNA, 32 nt, Human
acgugucccaaaggaaacuggucuccacccac

SEQ ID NO: 39429 - RNA, 32 nt, Human
acguguccccagagcuuuacagugccacgaca

SEQ ID NO: 39430 - RNA, 32 nt, Human
acgugucccugaauuccaucugacucuaauuu

SEQ ID NO: 39431 - RNA, 32 nt, Human
acgugucccuucugaacugaugcuuucucacu

SEQ ID NO: 39432 - RNA, 23 nt, Human
acguguccgaggggcccccgggu

SEQ ID NO: 39433 - RNA, 32 nt, Human
acguguccguccacccuuccaucagcgggucu

SEQ ID NO: 39434 - RNA, 32 nt, Human
acguguccucagccaagguggccuguccaguc

SEQ ID NO: 39435 - RNA, 32 nt, Human
acgugucggcgcucacacacacaugcuagccc

SEQ ID NO: 39436 - RNA, 32 nt, Human
acgugucgucuggaaugggcuugggggccacg

SEQ ID NO: 39437 - RNA, 32 nt, Human
acgugucuccuccuccucaucuuagcuuccag

SEQ ID NO: 39438 - RNA, 32 nt, Human
acgugucuguaaucccagcuacccgggaggcu

SEQ ID NO: 39439 - RNA, 32 nt, Human
acgugucuguaaucccagcuacucuggagacu

SEQ ID NO: 39440 - RNA, 32 nt, Human
acgugugcacacacaaugcacacaacuccuau

SEQ ID NO: 39441 - RNA, 32 nt, Human
acgugugcacacgcaugcacacacacauucag

SEQ ID NO: 39442 - RNA, 32 nt, Human
acgugugcaguggggagaaugaugcuauccug

SEQ ID NO: 39443 - RNA, 32 nt, Human
acgugugcauuucagcuacaucaugccgcgcu

SEQ ID NO: 39444 - RNA, 32 nt, Human
acgugugcccucucccuguccuuccuuuccau

SEQ ID NO: 39445 - RNA, 32 nt, Human
acgugugcucaguuuggcaugugugaucguca

SEQ ID NO: 39446 - RNA, 32 nt, Human
acgugugcugggaucuacuuucccucugggau

SEQ ID NO: 39447 - RNA, 32 nt, Human
acgugugcugggugggagaaggcgaggcggca

SEQ ID NO: 39448 - RNA, 32 nt, Human
acguguggacucuugguggcucugcugucuca

SEQ ID NO: 39449 - RNA, 32 nt, Human
acguguggagccaggccuggccaggcaggggc

SEQ ID NO: 39450 - RNA, 32 nt, Human
acgugugggcuuuauuugggccacuuucuuua

SEQ ID NO: 39451 - RNA, 32 nt, Human
acguguggggaaggcuauuuguuugcagcauu

SEQ ID NO: 39452 - RNA, 32 nt, Human
acguguguaaauaggcuguggcuacggugggu

SEQ ID NO: 39453 - RNA, 24 nt, Human
acguguguauauacacacacauaa

SEQ ID NO: 39454 - RNA, 32 nt, Human
acguguguccccauggcuuguggaucagcuaa

SEQ ID NO: 39455 - RNA, 32 nt, Human
acgugugugcacgcaugugcacaugccuccag

SEQ ID NO: 39456 - RNA, 32 nt, Human
acgugugugcacguacacacacauacacacac

SEQ ID NO: 39457 - RNA, 32 nt, Human
acgugugugcaggaaacggggacguggggagg

SEQ ID NO: 39458 - RNA, 32 nt, Human
acgugugugcugcgugcuucacauccucuauu

SEQ ID NO: 39459 - RNA, 32 nt, Human
acgugugugguguuugugugucugugccuggc

SEQ ID NO: 39460 - RNA, 32 nt, Human
acguguguguaaggggaggcugccucacuuug

SEQ ID NO: 39461 - RNA, 32 nt, Human
acguguucuagagugaagggggugcgggugug

SEQ ID NO: 39462 - RNA, 32 nt, Human
acguguugggacagaugcucaugugugccaca

SEQ ID NO: 39463 - RNA, 17 nt, Human
acguguuugguauuaca

SEQ ID NO: 39464 - RNA, 32 nt, Human
acguguuuuugagccucucucccuccuuucag

SEQ ID NO: 39465 - RNA, 32 nt, Human
acguuaaauuccacauuuuccucugagaacac

SEQ ID NO: 39466 - RNA, 32 nt, Human
acguuaaccaauauaucuauagcuuuagauua

SEQ ID NO: 39467 - RNA, 32 nt, Human
acguuaauguuuucagucauuguguguccuuu

SEQ ID NO: 39468 - RNA, 32 nt, Human
acguuaauuuaaaagaacauuaugaggauuag

SEQ ID NO: 39469 - RNA, 32 nt, Human
acguuacaucggaacccagauggcuguauuca

SEQ ID NO: 39470 - RNA, 32 nt, Human
acguuacuuagacugcaagcuagaaagccacc

SEQ ID NO: 39471 - RNA, 32 nt, Human
acguuaggccaggccuuaucugaaaggccagc

SEQ ID NO: 39472 - RNA, 32 nt, Human
acguuagguguuguuuggcaagaaaccacacu

SEQ ID NO: 39473 - RNA, 32 nt, Human
acguuagguucugcggauaaaggaggaauaag

SEQ ID NO: 39474 - RNA, 32 nt, Human
acguuauauaaagagaaaauugaauuuaacaa

SEQ ID NO: 39475 - RNA, 32 nt, Human
acguuaucacauuucuaaugaggauucacauu

SEQ ID NO: 39476 - RNA, 32 nt, Human
acguuauccaaggacauggaaaagccaacacc

SEQ ID NO: 39477 - RNA, 32 nt, Human
acguuaugauaguacaagacagagguugagcc

SEQ ID NO: 39478 - RNA, 32 nt, Human
acguuaugccagccagagucaggcuggaaagu

SEQ ID NO: 39479 - RNA, 32 nt, Human
acguuaugguggcuucagcuucacuaggaaug

SEQ ID NO: 39480 - RNA, 32 nt, Human
acguucaccgagcuggccaacaucgccauccc

SEQ ID NO: 39481 - RNA, 32 nt, Human
acguucacuuccuagguccucuccuucugaug

SEQ ID NO: 39482 - RNA, 32 nt, Human
acguucagcaccaugaaggcuuuccgggaccu

SEQ ID NO: 39483 - RNA, 32 nt, Human
acguucagcuucuuuuuauuugccuccuaguc

SEQ ID NO: 39484 - RNA, 32 nt, Human
acguucaucggagcaggccggggccuggccuu

SEQ ID NO: 39485 - RNA, 32 nt, Human
acguucauguggccaccaugaccccgucggca

SEQ ID NO: 39486 - RNA, 32 nt, Human
acguuccacugcccuggcccagggcccaggcc

SEQ ID NO: 39487 - RNA, 32 nt, Human
acguuccaggcacgcaucuaggaaaaggagcu

SEQ ID NO: 39488 - RNA, 32 nt, Human
acguucccucuuuccuccuugucuuccacuau

SEQ ID NO: 39489 - RNA, 32 nt, Human
acguuccugcaaucccagcuacucauaaggcu

SEQ ID NO: 39490 - RNA, 32 nt, Human
acguuccuggagaguccggccaaccuguccca

SEQ ID NO: 39491 - RNA, 32 nt, Human
acguuccuuguuucuuuucucccaugacacug

SEQ ID NO: 39492 - RNA, 32 nt, Human
acguuccuuuaaucccagcuacucgggagguu

SEQ ID NO: 39493 - RNA, 32 nt, Human
acguucuccauuuuccugucauugggucaugu

SEQ ID NO: 39494 - RNA, 32 nt, Human
acguucucuccguuccuucuuccuucauacau

SEQ ID NO: 39495 - RNA, 32 nt, Human
acguucucuccuaaucucaguaacuuuguuaa

SEQ ID NO: 39496 - RNA, 32 nt, Human
acguucucucugccugugagccagucuaguuc

SEQ ID NO: 39497 - RNA, 32 nt, Human
acguucucuuucucccucccgccuccgucccc

SEQ ID NO: 39498 - RNA, 32 nt, Human
acguucuggacugucuucucccugcacaagcc

SEQ ID NO: 39499 - RNA, 32 nt, Human
acguucuguaauagaaaaccugaaacgaugau

SEQ ID NO: 39500 - RNA, 31 nt, Human
acguucuugcauccucagccugugucagcac

SEQ ID NO: 39501 - RNA, 32 nt, Human
acguugccaccacucaucgcaggaugaggaua

SEQ ID NO: 39502 - RNA, 32 nt, Human
acguugccuguagaauccuccucugccuggga

SEQ ID NO: 39503 - RNA, 32 nt, Human
acguugccuuauacucucuacuucagaugaug

SEQ ID NO: 39504 - RNA, 32 nt, Human
acguugcugaguaaagagguguuacucaccuu

SEQ ID NO: 39505 - RNA, 32 nt, Human
acguugcuggugguuuuucagcucccuucccu

SEQ ID NO: 39506 - RNA, 32 nt, Human
acguuggaggggaagugaauucaccccagacc

SEQ ID NO: 39507 - RNA, 32 nt, Human
acguuggagugggggcaccaggcuggagggga

SEQ ID NO: 39508 - RNA, 32 nt, Human
acguuggaguuugggcuggagcuccucccucc

SEQ ID NO: 39509 - RNA, 32 nt, Human
acguuggcucugacugccuuuggagguggaga

SEQ ID NO: 39510 - RNA, 32 nt, Human
acguugggacuggccaggaacugcugcaaaga

SEQ ID NO: 39511 - RNA, 32 nt, Human
acguugggauggauuacagaggaugugcccuc

SEQ ID NO: 39512 - RNA, 32 nt, Human
acguugggggcccugcccugaauggucaauuu

SEQ ID NO: 39513 - RNA, 32 nt, Human
acguuggguaggggguguaacuggggaggagg

SEQ ID NO: 39514 - RNA, 32 nt, Human
acguugggugguguuugguagguuucccucca

SEQ ID NO: 39515 - RNA, 32 nt, Human
acguuggucuugaacuccugaccuugugaucc

SEQ ID NO: 39516 - RNA, 32 nt, Human
acguuguagagugcuuaucagagaguaccauu

SEQ ID NO: 39517 - RNA, 32 nt, Human
acguuuacacgacuugaguuuugaaccccgau

SEQ ID NO: 39518 - RNA, 32 nt, Human
acguuucccucucugcuucccaccccaucucu

SEQ ID NO: 39519 - RNA, 32 nt, Human
acguuucuccccggcuccucugggcuaaggca

SEQ ID NO: 39520 - RNA, 32 nt, Human
acguuucugaacagggucugugcuauguguaa

SEQ ID NO: 39521 - RNA, 32 nt, Human
acguuucugcagcuauucugagcacaccuuga

SEQ ID NO: 39522 - RNA, 32 nt, Human
acguuucuggcaugguggauguuuucauguug

SEQ ID NO: 39523 - RNA, 32 nt, Human
acguuucuggccuggguuuuguggucaucuau

SEQ ID NO: 39524 - RNA, 32 nt, Human
acguuucuuccaucucccuugcaggcacaggg

SEQ ID NO: 39525 - RNA, 32 nt, Human
acguuugagagcuguguuggcaagaccucagg

SEQ ID NO: 39526 - RNA, 32 nt, Human
acguuugagauggguauaucaguaagaagagg

SEQ ID NO: 39527 - RNA, 32 nt, Human
acguuugcaaacaugucccggaucgaaaagau

SEQ ID NO: 39528 - RNA, 32 nt, Human
acguuugcuacaaaugaugagccaacagccau

SEQ ID NO: 39529 - RNA, 32 nt, Human
acguuuuaacaugcucaccucagcaaaaguua

SEQ ID NO: 39530 - RNA, 32 nt, Human
acguuuuauucagucuguaaauuaacuggccc

SEQ ID NO: 39531 - RNA, 30 nt, Human
acguuuucuuuuuaccuaguugcuauagug

SEQ ID NO: 39532 - RNA, 32 nt, Human
acguuuugggcccuggaaucagaucauaguuc

SEQ ID NO: 39533 - RNA, 32 nt, Human
acguuuuguagcccacugcaucuggauauaua

SEQ ID NO: 39534 - RNA, 32 nt, Human
acguuuuucuguugcugauuguuaacauagag

SEQ ID NO: 39535 - RNA, 32 nt, Human
acguuuuuguaguguggccgugcugcgcugag

SEQ ID NO: 39536 - RNA, 32 nt, Human
acuaaaaauacaaaaagauuagccaggcaugg

SEQ ID NO: 39537 - RNA, 32 nt, Human
acuaaaaauacaaaacaauuagccgggcgugg

SEQ ID NO: 39538 - RNA, 32 nt, Human
acuaaaaauacaaaauuagcugggcauggugg

SEQ ID NO: 39539 - RNA, 32 nt, Human
acuaaaaauacaaaauuagcugggcguggugg

SEQ ID NO: 39540 - RNA, 32 nt, Human
acuaaaaauacaaaauuagcuggguuuggugg

SEQ ID NO: 39541 - RNA, 32 nt, Human
acuaaaaauacaaacaaauuagccgggcgugg

SEQ ID NO: 39542 - RNA, 32 nt, Human
acuaaaaauacagaaaaauuagccaggguugg

SEQ ID NO: 39543 - RNA, 32 nt, Human
acuaaaaauacagaaauuaggccaggcgcggu

SEQ ID NO: 39544 - RNA, 32 nt, Human
acuaaaaaugcggaagaguuagccaggcgugg

SEQ ID NO: 39545 - RNA, 32 nt, Human
acuaaaaaugucccagcagcugggagcccaac

SEQ ID NO: 39546 - RNA, 32 nt, Human
acuaaaaauguucugugaaaacaagcagcuag

SEQ ID NO: 39547 - RNA, 32 nt, Human
acuaaaacauaccaaccuacuucauuuccuag

SEQ ID NO: 39548 - RNA, 32 nt, Human
acuaaaacggcaucugcauacaaugggaaaag

SEQ ID NO: 39549 - RNA, 21 nt, Human
acuaaaacuauggagaaacuu

SEQ ID NO: 39550 - RNA, 32 nt, Human
acuaaaacugauuugaguuggauuuaugauuu

SEQ ID NO: 39551 - RNA, 23 nt, Human
acuaaaacuguguggaaaagguu

SEQ ID NO: 39552 - RNA, 32 nt, Human
acuaaaaggcagggguuaaaaaugauuauaua

SEQ ID NO: 39553 - RNA, 32 nt, Human
acuaaaaguggcauagagaauacacauauaaa

SEQ ID NO: 39554 - RNA, 32 nt, Human
acuaaaauaauuagaaaguagcuuauuuauug

SEQ ID NO: 39555 - RNA, 32 nt, Human
acuaaaauacaaaaaguuagcugggcuuggcg

SEQ ID NO: 39556 - RNA, 32 nt, Human
acuaaaauacaaaaauuagcugggcaugauga

SEQ ID NO: 39557 - RNA, 32 nt, Human
acuaaaauacaaaaauuagcugggcaugaugg

SEQ ID NO: 39558 - RNA, 32 nt, Human
acuaaaauacaaaaauuagcugggcauggugg

SEQ ID NO: 39559 - RNA, 32 nt, Human
acuaaaauacaaaaauuagcugggcaugguug

SEQ ID NO: 39560 - RNA, 32 nt, Human
acuaaaauacaaaaauuagcuggguguggugg

SEQ ID NO: 39561 - RNA, 32 nt, Human
acuaaaauacccccucaugccacccaccccag

SEQ ID NO: 39562 - RNA, 32 nt, Human
acuaaaauaggaacauccgacacacaccguuu

SEQ ID NO: 39563 - RNA, 32 nt, Human
acuaaaauaguacaaaaauuagccgggcgugg

SEQ ID NO: 39564 - RNA, 22 nt, Human
acuaaaaucuauaauaaagcuu

SEQ ID NO: 39565 - RNA, 32 nt, Human
acuaaaaucugccauuuggcucucugguuaac

SEQ ID NO: 39566 - RNA, 32 nt, Human
acuaaaaucuuucucucuagucuuucucacuu

SEQ ID NO: 39567 - RNA, 32 nt, Human
acuaaaauggaaagcuaguuuugagaaauuau

SEQ ID NO: 39568 - RNA, 32 nt, Human
acuaaaauuggaaugacacagaggagauuagc

SEQ ID NO: 39569 - RNA, 32 nt, Human
acuaaaauuucccuguugcucuuuggaaucaa

SEQ ID NO: 39570 - RNA, 32 nt, Human
acuaaacagguuacagaauaucuguauguacu

SEQ ID NO: 39571 - RNA, 32 nt, Human
acuaaacaguuuggauggucagucucuacugg

SEQ ID NO: 39572 - RNA, 32 nt, Human
acuaaacauacaaaauuagcugggcauggugg

SEQ ID NO: 39573 - RNA, 32 nt, Human
acuaaacaucacagcaagcucuaucucugagc

SEQ ID NO: 39574 - RNA, 32 nt, Human
acuaaacauggcugaggcugggcuccagccag

SEQ ID NO: 39575 - RNA, 32 nt, Human
acuaaaccaccugaaucuagcacuaaaccacc

SEQ ID NO: 39576 - RNA, 32 nt, Human
acuaaaccuguacaaaauagcugacaguuuua

SEQ ID NO: 39577 - RNA, 32 nt, Human
acuaaacuagugaaugaacccaggauuugaac

SEQ ID NO: 39578 - RNA, 32 nt, Human
acuaaacucauccuaggcugggcauggugacu

SEQ ID NO: 39579 - RNA, 32 nt, Human
acuaaacucuggggcuuguccugugcuugcuu

SEQ ID NO: 39580 - RNA, 32 nt, Human
acuaaacucuguggaagggaagggguugccuc

SEQ ID NO: 39581 - RNA, 32 nt, Human
acuaaacugcaacuucuaaauuccauguggca

SEQ ID NO: 39582 - RNA, 32 nt, Human
acuaaacuguuuuucucacagcagaggaaccu

SEQ ID NO: 39583 - RNA, 31 nt, Human
acuaaacuuuaauauuuccauuuaaaauuaa

SEQ ID NO: 39584 - RNA, 32 nt, Human
acuaaagaaagggagagaaagagaagcuauau

SEQ ID NO: 39585 - RNA, 32 nt, Human
acuaaagaaaucccaucaagcaaauggugugu

SEQ ID NO: 39586 - RNA, 32 nt, Human
acuaaagaaccaauucaaauggaugcugaaca

SEQ ID NO: 39587 - RNA, 32 nt, Human
acuaaagaauaacauauaagcacacaaauugg

SEQ ID NO: 39588 - RNA, 20 nt, Human
acuaaagagaaucccaggaa

SEQ ID NO: 39589 - RNA, 32 nt, Human
acuaaagagaugggaguucaccugagggcaag

SEQ ID NO: 39590 - RNA, 31 nt, Human
acuaaagagcccucugggccuguguugcugu

SEQ ID NO: 39591 - RNA, 32 nt, Human
acuaaagagcuucuaugcuuccuuguuuccau

SEQ ID NO: 39592 - RNA, 32 nt, Human
acuaaagagggaagauaaagaggcucccaacc

SEQ ID NO: 39593 - RNA, 32 nt, Human
acuaaagauaaauaaggagaaaacauuuagga

SEQ ID NO: 39594 - RNA, 32 nt, Human
acuaaagcaaaauuuccagggguagggacugg

SEQ ID NO: 39595 - RNA, 32 nt, Human
acuaaagcaguuugguggccuuuucacauucu

SEQ ID NO: 39596 - RNA, 32 nt, Human
acuaaagccagccugaccuuccuuccuguuag

SEQ ID NO: 39597 - RNA, 32 nt, Human
acuaaaggaagugggaacuuagaaccagacag

SEQ ID NO: 39598 - RNA, 32 nt, Human
acuaaaggagcccccacuccagcuucagaacc

SEQ ID NO: 39599 - RNA, 32 nt, Human
acuaaaggauccagagagcagcucccuuucuc

SEQ ID NO: 39600 - RNA, 32 nt, Human
acuaaaggcugcagggggugcuaaggaaggaa

SEQ ID NO: 39601 - RNA, 32 nt, Human
acuaaaggggagaagagccacccccagcaucc

SEQ ID NO: 39602 - RNA, 32 nt, Human
acuaaaggucuggccaaugucuugccccaccc

SEQ ID NO: 39603 - RNA, 22 nt, Human
acuaaaguuaguuggaaaagcu

SEQ ID NO: 39604 - RNA, 32 nt, Human
acuaaaguuaucuccccauucuaugguuacau

SEQ ID NO: 39605 - RNA, 21 nt, Human
acuaaaguugguagaaaaguu

SEQ ID NO: 39606 - RNA, 32 nt, Human
acuaaaguuuuuaaaauauacuuauuucuaag

SEQ ID NO: 39607 - RNA, 32 nt, Human
acuaaauacacaaagcaugccuuaaacccagu

SEQ ID NO: 39608 - RNA, 32 nt, Human
acuaaauaccaguuaucacagacuucacuggc

SEQ ID NO: 39609 - RNA, 32 nt, Human
acuaaauacccacucuggugagcauauuccau

SEQ ID NO: 39610 - RNA, 32 nt, Human
acuaaauauauguacaaagaacuaugcugucu

SEQ ID NO: 39611 - RNA, 32 nt, Human
acuaaauauuuuuaucggcuaggcgugguggu

SEQ ID NO: 39612 - RNA, 32 nt, Human
acuaaauccaucucagaaugcugcaggcacca

SEQ ID NO: 39613 - RNA, 32 nt, Human
acuaaaucuccaagaccuggugugcggaggca

SEQ ID NO: 39614 - RNA, 32 nt, Human
acuaaaucugcugccagaacucaagcaacagu

SEQ ID NO: 39615 - RNA, 32 nt, Human
acuaaaugaaguucucauuucucuccaacaga

SEQ ID NO: 39616 - RNA, 32 nt, Human
acuaaaugaauccacagcuacuuacucaucuu

SEQ ID NO: 39617 - RNA, 32 nt, Human
acuaaaugcaccugggucaggcugucuguggg

SEQ ID NO: 39618 - RNA, 32 nt, Human
acuaaauguaugucaguauggaaguacuuaua

SEQ ID NO: 39619 - RNA, 32 nt, Human
acuaaauuaaugccaugguaacauaaguuaga

SEQ ID NO: 39620 - RNA, 32 nt, Human
acuaaauucuccccagaaugcuuuuaaauuuu

SEQ ID NO: 39621 - RNA, 32 nt, Human
acuaacaaaagguacuaggauuagcugcaauc

SEQ ID NO: 39622 - RNA, 32 nt, Human
acuaacaaacuacauuccccagccuccuucac

SEQ ID NO: 39623 - RNA, 32 nt, Human
acuaacaaaggagaccuggugaucugccgacc

SEQ ID NO: 39624 - RNA, 32 nt, Human
acuaacaaaguggucgcaggagauuuuggaac

SEQ ID NO: 39625 - RNA, 32 nt, Human
acuaacacaccauucuuuagugcagugaaauu

SEQ ID NO: 39626 - RNA, 32 nt, Human
acuaacacagcccuggaaagaaaagcaaaaag

SEQ ID NO: 39627 - RNA, 32 nt, Human
acuaacacuaaaugugcuguuuuccuuguuuu

SEQ ID NO: 39628 - RNA, 32 nt, Human
acuaacacucccccuccuccaccccagccugc

SEQ ID NO: 39629 - RNA, 32 nt, Human
acuaacagagggcuagagaaagcaucuucugc

SEQ ID NO: 39630 - RNA, 32 nt, Human
acuaacagugaggggacaaagcauugauagga

SEQ ID NO: 39631 - RNA, 32 nt, Human
acuaacagugggcugaaaccaaccuuggguug

SEQ ID NO: 39632 - RNA, 32 nt, Human
acuaacaguucccuccucacagggucgcuaua

SEQ ID NO: 39633 - RNA, 32 nt, Human
acuaacaucucuagugaucccuuugucagugg

SEQ ID NO: 39634 - RNA, 32 nt, Human
acuaacaugaaugacuacuggagugucuucaa

SEQ ID NO: 39635 - RNA, 32 nt, Human
acuaacauggcacacacauacacuccugcgug

SEQ ID NO: 39636 - RNA, 32 nt, Human
acuaacauggugaaacccccaucuacacuaaa

SEQ ID NO: 39637 - RNA, 32 nt, Human
acuaaccaccaccaccaccaccgccgccacca

SEQ ID NO: 39638 - RNA, 32 nt, Human
acuaaccaguacucauguauggagauuauaaa

SEQ ID NO: 39639 - RNA, 32 nt, Human
acuaaccauuauaaaaagaagaaaaauaaagg

SEQ ID NO: 39640 - RNA, 32 nt, Human
acuaacccagaagagaggggugggcuggggca

SEQ ID NO: 39641 - RNA, 32 nt, Human
acuaacccaguuugaacccuggcacugccacg

SEQ ID NO: 39642 - RNA, 32 nt, Human
acuaaccucaaggauccugagucuccuucagc

SEQ ID NO: 39643 - RNA, 32 nt, Human
acuaaccuccaggucagcugcagcugcaaaau

SEQ ID NO: 39644 - RNA, 32 nt, Human
acuaaccugcagaaaaacacaaacaaaaacag

SEQ ID NO: 39645 - RNA, 32 nt, Human
acuaaccugggugacagaaugagacccuguuu

SEQ ID NO: 39646 - RNA, 32 nt, Human
acuaaccugugagcuuccccaggucagguauc

SEQ ID NO: 39647 - RNA, 32 nt, Human
acuaaccuuacauacacucuagaccaaaauaa

SEQ ID NO: 39648 - RNA, 32 nt, Human
acuaacgcccugcuccaucggcacuggugucc

SEQ ID NO: 39649 - RNA, 32 nt, Human
acuaacucaccacugugcuucccugcagacac

SEQ ID NO: 39650 - RNA, 32 nt, Human
acuaacuccuuuccauuccccugggugucuca

SEQ ID NO: 39651 - RNA, 32 nt, Human
acuaacugucuuuuuaacaaaacauuuucagu

SEQ ID NO: 39652 - RNA, 32 nt, Human
acuaacugugugaccuuaggcuggagugcaau

SEQ ID NO: 39653 - RNA, 32 nt, Human
acuaacuucauacauuuaucggcauuguccaa

SEQ ID NO: 39654 - RNA, 32 nt, Human
acuaacuucauuagcauuuccauacauuguuu

SEQ ID NO: 39655 - RNA, 32 nt, Human
acuaacuuggcccugacugguugugcaaccau

SEQ ID NO: 39656 - RNA, 32 nt, Human
acuaagaacaacugguuccuuccuucagaaga

SEQ ID NO: 39657 - RNA, 32 nt, Human
acuaagaacagagcaggugacaaggaugacua

SEQ ID NO: 39658 - RNA, 32 nt, Human
acuaagaacccuuggauguaacauacuaguua

SEQ ID NO: 39659 - RNA, 32 nt, Human
acuaagaagacagaaacaagcaaagccgccac

SEQ ID NO: 39660 - RNA, 32 nt, Human
acuaagaauacaaaauuagcugggcauggugg

SEQ ID NO: 39661 - RNA, 32 nt, Human
acuaagaauucacugcagcagcagguuacaua

SEQ ID NO: 39662 - RNA, 32 nt, Human
acuaagacagacuguagaugcauuuuaaauau

SEQ ID NO: 39663 - RNA, 32 nt, Human
acuaagaccagagggaggauuauccuugaccu

SEQ ID NO: 39664 - RNA, 32 nt, Human
acuaagacuuggaaauuauucucuccaguguc

SEQ ID NO: 39665 - RNA, 21 nt, Human
acuaagagccaaggcccacca

SEQ ID NO: 39666 - RNA, 32 nt, Human
acuaagagggaaaugagauauuuggggcagaa

SEQ ID NO: 39667 - RNA, 31 nt, Human
acuaagagggcgaucaccaugccaggacaag

SEQ ID NO: 39668 - RNA, 32 nt, Human
acuaagaucucagggaaugacuguguucugua

SEQ ID NO: 39669 - RNA, 32 nt, Human
acuaagaugauauuucagaagaguuggcugcc

SEQ ID NO: 39670 - RNA, 23 nt, Human
acuaagcaagcuuugaggaggca

SEQ ID NO: 39671 - RNA, 32 nt, Human
acuaagcaugcuguacccccucagcuuagauc

SEQ ID NO: 39672 - RNA, 32 nt, Human
acuaagcauugacagaauaucuuaaaauggua

SEQ ID NO: 39673 - RNA, 32 nt, Human
acuaagccaacaaaagagagcaucucuucuca

SEQ ID NO: 39674 - RNA, 32 nt, Human
acuaagccaaccuccucucacagccucuguau

SEQ ID NO: 39675 - RNA, 32 nt, Human
acuaagccaggcauaaccacagccaagcagau

SEQ ID NO: 39676 - RNA, 32 nt, Human
acuaagcccaggagccagaccuggcccgggga

SEQ ID NO: 39677 - RNA, 32 nt, Human
acuaagccuaagaaguucccugguuuuuccca

SEQ ID NO: 39678 - RNA, 32 nt, Human
acuaagccuccuaucacuaguaaccuuccagc

SEQ ID NO: 39679 - RNA, 32 nt, Human
acuaagcucacugcugucucacccucaccaga

SEQ ID NO: 39680 - RNA, 32 nt, Human
acuaagcucugauuuuucaucuugcccaaauu

SEQ ID NO: 39681 - RNA, 32 nt, Human
acuaagcugcaagcacaggccauuucucaugg

SEQ ID NO: 39682 - RNA, 32 nt, Human
acuaagcuggccccagccuugucuugauauua

SEQ ID NO: 39683 - RNA, 32 nt, Human
acuaagcugguuucccccuccgcaggguuuug

SEQ ID NO: 39684 - RNA, 17 nt, Human
acuaaggacccaaggca

SEQ ID NO: 39685 - RNA, 32 nt, Human
acuaaggaggcugaggcaggagaaucacuuga

SEQ ID NO: 39686 - RNA, 32 nt, Human
acuaaggagggucuggccagaggaacagacca

SEQ ID NO: 39687 - RNA, 32 nt, Human
acuaaggaugcugaaguuccgaacaguccaug

SEQ ID NO: 39688 - RNA, 32 nt, Human
acuaaggcccaagcucuuucucucggcaccuu

SEQ ID NO: 39689 - RNA, 32 nt, Human
acuaaggcucagagcaguugggguucaaugcc

SEQ ID NO: 39690 - RNA, 32 nt, Human
acuaaggcuucugcuuccuugcugcuguggug

SEQ ID NO: 39691 - RNA, 32 nt, Human
acuaagggaggcagcuuuaaacucccagaagg

SEQ ID NO: 39692 - RNA, 32 nt, Human
acuaagggauggggcagucucugcccaaacau

SEQ ID NO: 39693 - RNA, 32 nt, Human
acuaagggcaucuagcagcaguagccagagag

SEQ ID NO: 39694 - RNA, 32 nt, Human
acuaaggggguaggaauggaagaugguaucuu

SEQ ID NO: 39695 - RNA, 32 nt, Human
acuaaggguaaacucaggguucccugagcuau

SEQ ID NO: 39696 - RNA, 32 nt, Human
acuaaggguguaaguaauuaucgggaacagug

SEQ ID NO: 39697 - RNA, 32 nt, Human
acuaagguaauuucucacacaccaguuuaucu

SEQ ID NO: 39698 - RNA, 32 nt, Human
acuaaggugggauggauagcagggucucaggc

SEQ ID NO: 39699 - RNA, 32 nt, Human
acuaagguucuugagcuuaucucccaagguac

SEQ ID NO: 39700 - RNA, 32 nt, Human
acuaaguaggaaaucccuugagcuuagaccug

SEQ ID NO: 39701 - RNA, 32 nt, Human
acuaaguauaaauauuauggacuuuguuaaac

SEQ ID NO: 39702 - RNA, 32 nt, Human
acuaaguauaccaaaauaauugacucuauuau

SEQ ID NO: 39703 - RNA, 23 nt, Human
acuaagucauccauauacuccca

SEQ ID NO: 39704 - RNA, 32 nt, Human
acuaagucccaccaauucauguuuucacccuu

SEQ ID NO: 39705 - RNA, 25 nt, Human
acuaagucuugcaucauaaauucua

SEQ ID NO: 39706 - RNA, 32 nt, Human
acuaagugauucagacuuuccuuacuuuuaaa

SEQ ID NO: 39707 - RNA, 31 nt, Human
acuaagugcauuuucaucacagaaaagaguu

SEQ ID NO: 39708 - RNA, 32 nt, Human
acuaagugccuccccaagacccugacugaguc

SEQ ID NO: 39709 - RNA, 32 nt, Human
acuaagugggccugaauagggagugugggaga

SEQ ID NO: 39710 - RNA, 32 nt, Human
acuaagugggugucaccuggugggccucccuu

SEQ ID NO: 39711 - RNA, 32 nt, Human
acuaagugguuuucuugcucccacucccuacc

SEQ ID NO: 39712 - RNA, 32 nt, Human
acuaaguucuuggugcccucuucggcagccaa

SEQ ID NO: 39713 - RNA, 32 nt, Human
acuaauaaaauauuuccuguguguucuaugca

SEQ ID NO: 39714 - RNA, 32 nt, Human
acuaauaaccauuugucuuucccauuuugugc

SEQ ID NO: 39715 - RNA, 32 nt, Human
acuaauaagccaaggaaucgacauauauuagg

SEQ ID NO: 39716 - RNA, 32 nt, Human
acuaauaauaaauaugucuaucaaauaccucu

SEQ ID NO: 39717 - RNA, 32 nt, Human
acuaauaaucccugaucugugugauuguacug

SEQ ID NO: 39718 - RNA, 32 nt, Human
acuaauacaugguuuaaagucacagccguuug

SEQ ID NO: 39719 - RNA, 32 nt, Human
acuaauacuaaagaaguugggggagcucgaga

SEQ ID NO: 39720 - RNA, 32 nt, Human
acuaauagauuagcugggugggauggcccaug

SEQ ID NO: 39721 - RNA, 32 nt, Human
acuaauauacauuguuuaugcuuucuuuaaaa

SEQ ID NO: 39722 - RNA, 32 nt, Human
acuaauauuuggaauuuucauauaaguggauu

SEQ ID NO: 39723 - RNA, 32 nt, Human
acuaaucaaagacacuauuuucauacuagauu

SEQ ID NO: 39724 - RNA, 19 nt, Human
acuaaucaaugcugaggug

SEQ ID NO: 39725 - RNA, 32 nt, Human
acuaaucacagaauccacucccuacaccuuuu

SEQ ID NO: 39726 - RNA, 32 nt, Human
acuaauccagugccugguagacagcgggccuc

SEQ ID NO: 39727 - RNA, 32 nt, Human
acuaaucccugcgcaggacuucccaggacccc

SEQ ID NO: 39728 - RNA, 32 nt, Human
acuaaucuccagaacauuuuuccucuuaccaa

SEQ ID NO: 39729 - RNA, 32 nt, Human
acuaaucuuccauccagacccacaugaagcaa

SEQ ID NO: 39730 - RNA, 32 nt, Human
acuaaugaaaucaaacccccaagcugcuuguu

SEQ ID NO: 39731 - RNA, 32 nt, Human
acuaaugagaccuacaauuaugcuaacauuuu

SEQ ID NO: 39732 - RNA, 32 nt, Human
acuaaugagaggaucaccugagcccaggaguu

SEQ ID NO: 39733 - RNA, 32 nt, Human
acuaaugccauguaggaugguaugacaaggca

SEQ ID NO: 39734 - RNA, 32 nt, Human
acuaaugcuccacuccauuggcacuaacgccc

SEQ ID NO: 39735 - RNA, 32 nt, Human
acuaaugcuuugauuggauuugccaguucacc

SEQ ID NO: 39736 - RNA, 32 nt, Human
acuaauggaagcgauucucccaugcucaugug

SEQ ID NO: 39737 - RNA, 29 nt, Human
acuaauggaauguuuuaccagcacuuuug

SEQ ID NO: 39738 - RNA, 32 nt, Human
acuaauggauacaggcauguaucugccguaca

SEQ ID NO: 39739 - RNA, 32 nt, Human
acuaauggggaugagguucugguacaagauga

SEQ ID NO: 39740 - RNA, 32 nt, Human
acuaaugggucuuguccucaagcagcacuauu

SEQ ID NO: 39741 - RNA, 32 nt, Human
acuaauguaaccauuuuaugaagguugaagug

SEQ ID NO: 39742 - RNA, 29 nt, Human
acuaauguucacuagaucugugccacugc

SEQ ID NO: 39743 - RNA, 31 nt, Human
acuaauuaggcauauacuaugccaagcagug

SEQ ID NO: 39744 - RNA, 32 nt, Human
acuaauucagaucucucccagagaacuacugg

SEQ ID NO: 39745 - RNA, 31 nt, Human
acuaauuccagcuagaggaccagccucccug

SEQ ID NO: 39746 - RNA, 21 nt, Human
acuaauuccuauuucugccac

SEQ ID NO: 39747 - RNA, 32 nt, Human
acuaauucuacaaugccuuucucuuuagucag

SEQ ID NO: 39748 - RNA, 32 nt, Human
acuaauugacucuuaguuucuuugcucagauu

SEQ ID NO: 39749 - RNA, 32 nt, Human
acuaauugagguacaucugcaagugagacuuu

SEQ ID NO: 39750 - RNA, 32 nt, Human
acuaauugggaugucauaguacuuggcugccg

SEQ ID NO: 39751 - RNA, 32 nt, Human
acuaauugguauccacuacuuguacagcuuac

SEQ ID NO: 39752 - RNA, 32 nt, Human
acuaauuucuccgaguggugcauaaucuuauu

SEQ ID NO: 39753 - RNA, 32 nt, Human
acuaauuuucacugcuaauaauucuguaagga

SEQ ID NO: 39754 - RNA, 32 nt, Human
acuacaaacaccugccuugggggugaagugaa

SEQ ID NO: 39755 - RNA, 32 nt, Human
acuacaaaccaccaucuaccaucugccaggcc

SEQ ID NO: 39756 - RNA, 32 nt, Human
acuacaaagaaaacauguuuuccugcuuggaa

SEQ ID NO: 39757 - RNA, 32 nt, Human
acuacaaagaacagcaggacacagaggugacc

SEQ ID NO: 39758 - RNA, 32 nt, Human
acuacaacagcuacagugugucauaagcugga

SEQ ID NO: 39759 - RNA, 21 nt, Human
acuacaacauacaucucuuca

SEQ ID NO: 39760 - RNA, 32 nt, Human
acuacaacauuaugaagacauucuuuuguacc

SEQ ID NO: 39761 - RNA, 24 nt, Human
acuacaaccuccaccuccuggguu

SEQ ID NO: 39762 - RNA, 24 nt, Human
acuacaacuuccgccucccggguu

SEQ ID NO: 39763 - RNA, 32 nt, Human
acuacaagcaugcacagcugcacuuggcuuag

SEQ ID NO: 39764 - RNA, 32 nt, Human
acuacaagcggcugccaccacaccuggcuauu

SEQ ID NO: 39765 - RNA, 24 nt, Human
acuacaagcucugccucccgaguu

SEQ ID NO: 39766 - RNA, 32 nt, Human
acuacaagucuugacuaagaaggaaagaggaa

SEQ ID NO: 39767 - RNA, 32 nt, Human
acuacaagugugagccacugugccaggcacaa

SEQ ID NO: 39768 - RNA, 32 nt, Human
acuacaauagaagacauuuucacuggaauuac

SEQ ID NO: 39769 - RNA, 32 nt, Human
acuacaauauuuggccaauaagaaauauacac

SEQ ID NO: 39770 - RNA, 32 nt, Human
acuacaauggcugcuggaaagaggcguaagga

SEQ ID NO: 39771 - RNA, 32 nt, Human
acuacaauguaaucuguuucccagggaaauaa

SEQ ID NO: 39772 - RNA, 32 nt, Human
acuacaauugcuuguuaaaauauuuuauaagu

SEQ ID NO: 39773 - RNA, 32 nt, Human
acuacacaaaaauagaacaauuagucugaauu

SEQ ID NO: 39774 - RNA, 32 nt, Human
acuacacaacuugcuacuuucagaaaacuuuu

SEQ ID NO: 39775 - RNA, 32 nt, Human
acuacacagauggagggcaugggauaggacag

SEQ ID NO: 39776 - RNA, 32 nt, Human
acuacacauuggguacagugugcacugcuugg

SEQ ID NO: 39777 - RNA, 15 nt, Human
acuacaccugcccca

SEQ ID NO: 39778 - RNA, 32 nt, Human
acuacaccugcuccaggaccaaucagugaaac

SEQ ID NO: 39779 - RNA, 32 nt, Human
acuacaccuugccuugcuguuuguccugagau

SEQ ID NO: 39780 - RNA, 32 nt, Human
acuacaccuuggagacugcacacaauuuccuu

SEQ ID NO: 39781 - RNA, 32 nt, Human
acuacacuccagccuggaugacagagugagac

SEQ ID NO: 39782 - RNA, 32 nt, Human
acuacacuccagccugggcaacagagugagac

SEQ ID NO: 39783 - RNA, 32 nt, Human
acuacacuccagccugggcgacagagugaccc

SEQ ID NO: 39784 - RNA, 32 nt, Human
acuacacuccagccugggugacagagugagau

SEQ ID NO: 39785 - RNA, 32 nt, Human
acuacacugcacuggauugcuauauuuuuaac

SEQ ID NO: 39786 - RNA, 32 nt, Human
acuacagaaucaccuccucuugaagauauuga

SEQ ID NO: 39787 - RNA, 32 nt, Human
acuacagagcagcuccccaggagcucaggugg

SEQ ID NO: 39788 - RNA, 32 nt, Human
acuacagauacuugaaaacagaaccaaauaaa

SEQ ID NO: 39789 - RNA, 32 nt, Human
acuacagaucucccaguaauuuuucuuauuua

SEQ ID NO: 39790 - RNA, 32 nt, Human
acuacagcaaacaagcuaccccugccaguccu

SEQ ID NO: 39791 - RNA, 32 nt, Human
acuacagcaagccuggcacgaccucuaaggcg

SEQ ID NO: 39792 - RNA, 32 nt, Human
acuacagcacagauuucaccucugucuugaau

SEQ ID NO: 39793 - RNA, 32 nt, Human
acuacagcauagaauuuugccugggugccacc

SEQ ID NO: 39794 - RNA, 32 nt, Human
acuacagccuaaagccuugccuuuguaauuug

SEQ ID NO: 39795 - RNA, 32 nt, Human
acuacagccucgaacuccuaggcucaagcgau

SEQ ID NO: 39796 - RNA, 26 nt, Human
acuacagccugggugacagagcaaga

SEQ ID NO: 39797 - RNA, 32 nt, Human
acuacagcguguacaugggcaggugugucccc

SEQ ID NO: 39798 - RNA, 22 nt, Human
acuacaggacgggcaccagcca

SEQ ID NO: 39799 - RNA, 32 nt, Human
acuacaggcacacaccaccacgcccagcuaau

SEQ ID NO: 39800 - RNA, 32 nt, Human
acuacaggcacacaccaccacgcccagcucua

SEQ ID NO: 39801 - RNA, 32 nt, Human
acuacaggcacacgcugccacgcccagcugau

SEQ ID NO: 39802 - RNA, 32 nt, Human
acuacaggcacccaccaccacgcccagcuaau

SEQ ID NO: 39803 - RNA, 32 nt, Human
acuacaggcacccgccaacacgcccggcuaau

SEQ ID NO: 39804 - RNA, 32 nt, Human
acuacaggcacccgccacagugccugggcuaa

SEQ ID NO: 39805 - RNA, 32 nt, Human
acuacaggcaccugccaacacgcccggcuaau

SEQ ID NO: 39806 - RNA, 32 nt, Human
acuacaggcaccugccaccacgcccagcuaau

SEQ ID NO: 39807 - RNA, 32 nt, Human
acuacaggcaccugccacgaugccuagcuaau

SEQ ID NO: 39808 - RNA, 25 nt, Human
acuacaggcacgcaccaccaugcca

SEQ ID NO: 39809 - RNA, 32 nt, Human
acuacaggcacgugccaccacgcccagcuaau

SEQ ID NO: 39810 - RNA, 32 nt, Human
acuacaggcagcuccccucuguaccccaacuc

SEQ ID NO: 39811 - RNA, 22 nt, Human
acuacaggcaugaaauacugug

SEQ ID NO: 39812 - RNA, 32 nt, Human
acuacaggcaugagccaccgugcccggccucu

SEQ ID NO: 39813 - RNA, 32 nt, Human
acuacaggcaugagccacugugcccagccugu

SEQ ID NO: 39814 - RNA, 32 nt, Human
acuacaggcaugagucaccacaccuggcugau

SEQ ID NO: 39815 - RNA, 32 nt, Human
acuacaggcaugcaccaccacgcccagcuaau

SEQ ID NO: 39816 - RNA, 32 nt, Human
acuacaggcaugcgccaccacgcccagcuaau

SEQ ID NO: 39817 - RNA, 32 nt, Human
acuacaggcaugcgccaccacgcccagcugau

SEQ ID NO: 39818 - RNA, 32 nt, Human
acuacaggcaugugccaccacgcccagcuaag

SEQ ID NO: 39819 - RNA, 32 nt, Human
acuacaggcgcaugccaucacgcacagcuaau

SEQ ID NO: 39820 - RNA, 32 nt, Human
acuacaggcgcccaccaccacgcccagcuaau

SEQ ID NO: 39821 - RNA, 32 nt, Human
acuacaggcgcccgccaccacgcccagcuaau

SEQ ID NO: 39822 - RNA, 32 nt, Human
acuacaggcgcccgcuaccguacccggcuaau

SEQ ID NO: 39823 - RNA, 32 nt, Human
acuacaggcgcgcaccaccacgcccagcuaau

SEQ ID NO: 39824 - RNA, 32 nt, Human
acuacaggcgugagccacagugccuggccuga

SEQ ID NO: 39825 - RNA, 32 nt, Human
acuacaggcgugagccaccacgcccggccagc

SEQ ID NO: 39826 - RNA, 32 nt, Human
acuacaggcgugagccaccaugcccggcuaau

SEQ ID NO: 39827 - RNA, 32 nt, Human
acuacaggcgugagccagcacgcccagcuaau

SEQ ID NO: 39828 - RNA, 32 nt, Human
acuacaggcuccugccaccacgcccagcaauu

SEQ ID NO: 39829 - RNA, 32 nt, Human
acuacaggcuugugccaccacacucagcuaau

SEQ ID NO: 39830 - RNA, 32 nt, Human
acuacagguacccaccaccacgcccagcuaau

SEQ ID NO: 39831 - RNA, 32 nt, Human
acuacagguaccccaucauacccagcuuaaca

SEQ ID NO: 39832 - RNA, 32 nt, Human
acuacaggugagugccaccacacucagcuaau

SEQ ID NO: 39833 - RNA, 32 nt, Human
acuacaggugcaugccaccacgcacagcuacu

SEQ ID NO: 39834 - RNA, 32 nt, Human
acuacaggugcaugccaccacgcccagcuaau

SEQ ID NO: 39835 - RNA, 25 nt, Human
acuacaggugcaugccaccaugcca

SEQ ID NO: 39836 - RNA, 32 nt, Human
acuacaggugcccaccaacacgcccggcuaau

SEQ ID NO: 39837 - RNA, 32 nt, Human
acuacaggugcccaccaccaugcccagcuaau

SEQ ID NO: 39838 - RNA, 32 nt, Human
acuacaggugcccgccaccacgcccagcuaau

SEQ ID NO: 39839 - RNA, 32 nt, Human
acuacaggugcccgcuaccacacccggcuaau

SEQ ID NO: 39840 - RNA, 32 nt, Human
acuacaggugcgcaccaccaugcccagcuaau

SEQ ID NO: 39841 - RNA, 32 nt, Human
acuacaggugcgcaccaccaugcccggcuuuu

SEQ ID NO: 39842 - RNA, 32 nt, Human
acuacaggugcgugccaccacacccagcuaaa

SEQ ID NO: 39843 - RNA, 32 nt, Human
acuacaggugcgugcuaccacgcccagcuacu

SEQ ID NO: 39844 - RNA, 32 nt, Human
acuacaggugugagccaccacucccagccuga

SEQ ID NO: 39845 - RNA, 32 nt, Human
acuacaggugugagccaccaugcccggccuuc

SEQ ID NO: 39846 - RNA, 32 nt, Human
acuacaggugugagucaccaaagcccaguuaa

SEQ ID NO: 39847 - RNA, 32 nt, Human
acuacaggugugcaccaccaugcccagcuagu

SEQ ID NO: 39848 - RNA, 32 nt, Human
acuacaggugugcaccaccaugcccagguaau

SEQ ID NO: 39849 - RNA, 32 nt, Human
acuacaggugugcgccaccacgcccagcuaau

SEQ ID NO: 39850 - RNA, 32 nt, Human
acuacaggugugugccaccacacccagagagu

SEQ ID NO: 39851 - RNA, 32 nt, Human
acuacagguguucuuaggaggcugcuggagaa

SEQ ID NO: 39852 - RNA, 32 nt, Human
acuacaguacagugagugaccccagccuccug

SEQ ID NO: 39853 - RNA, 32 nt, Human
acuacaguagacacaagggcuggacaugcaga

SEQ ID NO: 39854 - RNA, 17 nt, Human
acuacaguauuuacuga

SEQ ID NO: 39855 - RNA, 32 nt, Human
acuacaguauuuuuaaguagcccucuaaauac

SEQ ID NO: 39856 - RNA, 31 nt, Human
acuacagucaccaaggagggauuuggggaau

SEQ ID NO: 39857 - RNA, 32 nt, Human
acuacaguucaucacaggguucagcagaguac

SEQ ID NO: 39858 - RNA, 20 nt, Human
acuacaguugcugucacuga

SEQ ID NO: 39859 - RNA, 20 nt, Human
acuacaguuuccuacaugug

SEQ ID NO: 39860 - RNA, 32 nt, Human
acuacaguuuuaaaaagaagaaaggagagcgu

SEQ ID NO: 39861 - RNA, 32 nt, Human
acuacauaaaacuugauucuguuucucuacuu

SEQ ID NO: 39862 - RNA, 32 nt, Human
acuacauacaucuucugcugguguuuuguuca

SEQ ID NO: 39863 - RNA, 32 nt, Human
acuacauccauaguuucuggugaaccuguaau

SEQ ID NO: 39864 - RNA, 32 nt, Human
acuacaucccacauuaguguucuuuauauacc

SEQ ID NO: 39865 - RNA, 32 nt, Human
acuacauccgcaugggcacccaacccaucuau

SEQ ID NO: 39866 - RNA, 32 nt, Human
acuacaucugagauggagaccuuuccucugcu

SEQ ID NO: 39867 - RNA, 32 nt, Human
acuacaucuguaacuagugaauacucuguuga

SEQ ID NO: 39868 - RNA, 22 nt, Human
acuacaugcacuuggcugcaua

SEQ ID NO: 39869 - RNA, 32 nt, Human
acuacaugcgugacucacaggcagccaaggac

SEQ ID NO: 39870 - RNA, 32 nt, Human
acuacauggaacauucuccaggauagccauau

SEQ ID NO: 39871 - RNA, 32 nt, Human
acuacauguuaaguuacacugaaaguucaugu

SEQ ID NO: 39872 - RNA, 32 nt, Human
acuacauuagaagagagcauuucuccauuguc

SEQ ID NO: 39873 - RNA, 32 nt, Human
acuacauuuauuggucccuccuccuuuccagc

SEQ ID NO: 39874 - RNA, 32 nt, Human
acuaccaaagaaacaaauacuccucaguuuga

SEQ ID NO: 39875 - RNA, 32 nt, Human
acuaccaaguauacuggugaaaucucgauggg

SEQ ID NO: 39876 - RNA, 32 nt, Human
acuaccaauuccagguuaacuuuguuggagaa

SEQ ID NO: 39877 - RNA, 32 nt, Human
acuaccaccucaccugguccucagucagaaac

SEQ ID NO: 39878 - RNA, 32 nt, Human
acuaccaccuccuggguucaagcgauucgccu

SEQ ID NO: 39879 - RNA, 32 nt, Human
acuaccaccugugucuggacacaugcuuaugu

SEQ ID NO: 39880 - RNA, 32 nt, Human
acuaccacuccaagccuggccccaccagugcu

SEQ ID NO: 39881 - RNA, 32 nt, Human
acuaccagaccucacguguugcagugauaaca

SEQ ID NO: 39882 - RNA, 24 nt, Human
acuaccagccugggaggcccaggu

SEQ ID NO: 39883 - RNA, 32 nt, Human
acuaccaggaaggggagcggcugggauggcgc

SEQ ID NO: 39884 - RNA, 32 nt, Human
acuaccaguccucugcaguuacauggccacau

SEQ ID NO: 39885 - RNA, 32 nt, Human
acuaccauccauccuauuugaauuaucaagca

SEQ ID NO: 39886 - RNA, 32 nt, Human
acuaccaucccaccaccugcugaggagaaaaa

SEQ ID NO: 39887 - RNA, 32 nt, Human
acuaccaucggugggccaguucugccucucug

SEQ ID NO: 39888 - RNA, 32 nt, Human
acuacccaaccccaccaccacugccaccucca

SEQ ID NO: 39889 - RNA, 32 nt, Human
acuacccacaugcaccaccaugcacggcuaau

SEQ ID NO: 39890 - RNA, 32 nt, Human
acuacccacaugcugaucuauuggggaacaga

SEQ ID NO: 39891 - RNA, 32 nt, Human
acuacccacguagugaaucuuuugucugcaau

SEQ ID NO: 39892 - RNA, 32 nt, Human
acuacccaugucuccacgaaggcguccuggag

SEQ ID NO: 39893 - RNA, 32 nt, Human
acuaccccacaggauuucagacuugcaugggg

SEQ ID NO: 39894 - RNA, 32 nt, Human
acuaccccaucaaccuugcugccaucaagaug

SEQ ID NO: 39895 - RNA, 20 nt, Human
acuacccccggagggaggag

SEQ ID NO: 39896 - RNA, 32 nt, Human
acuaccccggccccagcacccgccaggaugug

SEQ ID NO: 39897 - RNA, 32 nt, Human
acuaccccuccagcaacugggaggugggacug

SEQ ID NO: 39898 - RNA, 32 nt, Human
acuaccccugcaccuguuccccugcugucccc

SEQ ID NO: 39899 - RNA, 32 nt, Human
acuaccccuguagcugugaaccuccgggcuca

SEQ ID NO: 39900 - RNA, 32 nt, Human
acuacccugcuuacuggugccugcugccagcc

SEQ ID NO: 39901 - RNA, 32 nt, Human
acuacccuucuccuuuccuucccaggcccuuu

SEQ ID NO: 39902 - RNA, 19 nt, Human
acuaccgcccugggaggaa

SEQ ID NO: 39903 - RNA, 32 nt, Human
acuaccggcgcacgccaccacgcccagcuaau

SEQ ID NO: 39904 - RNA, 32 nt, Human
acuaccgggcugcaaucaaagcagaaaggauc

SEQ ID NO: 39905 - RNA, 20 nt, Human
acuaccguuuauuuuacuga

SEQ ID NO: 39906 - RNA, 32 nt, Human
acuaccuaacggauagcauuuguaaauacucu

SEQ ID NO: 39907 - RNA, 32 nt, Human
acuaccuaauuuaaaagaagaagacauuuuga

SEQ ID NO: 39908 - RNA, 32 nt, Human
acuaccuaccggcuccaguggugggacuucac

SEQ ID NO: 39909 - RNA, 32 nt, Human
acuaccuaggaggcagaagcuaagugauuugc

SEQ ID NO: 39910 - RNA, 32 nt, Human
acuaccuauaguccaaaauccccaccucacag

SEQ ID NO: 39911 - RNA, 32 nt, Human
acuaccuauaguccaaaauccccaucucacag

SEQ ID NO: 39912 - RNA, 32 nt, Human
acuaccuauauguaugugcuguaugugggcau

SEQ ID NO: 39913 - RNA, 32 nt, Human
acuaccuccuuuccccuagauuuccuuucauu

SEQ ID NO: 39914 - RNA, 32 nt, Human
acuaccucgacuucucuuucugcuccacacgu

SEQ ID NO: 39915 - RNA, 32 nt, Human
acuaccucuagacugcccucccgggcuggcgu

SEQ ID NO: 39916 - RNA, 31 nt, Human
acuaccucucucuucuggccugugucuaagg

SEQ ID NO: 39917 - RNA, 32 nt, Human
acuaccugacucaggaaucggcucuggaaggu

SEQ ID NO: 39918 - RNA, 32 nt, Human
acuaccugagaguuaucagagcugggguugug

SEQ ID NO: 39919 - RNA, 32 nt, Human
acuaccugaugccaggagcuuagggcuuugca

SEQ ID NO: 39920 - RNA, 32 nt, Human
acuaccugaugggcacauggacaggcugcaga

SEQ ID NO: 39921 - RNA, 22 nt, Human
acuaccugcauaggagacccug

SEQ ID NO: 39922 - RNA, 32 nt, Human
acuaccugcccagaaaaaugcuggaggcuggg

SEQ ID NO: 39923 - RNA, 20 nt, Human
acuaccugccuuguaacccu

SEQ ID NO: 39924 - RNA, 19 nt, Human
acuaccugggacaagguga

SEQ ID NO: 39925 - RNA, 18 nt, Human
acuaccugggugacagga

SEQ ID NO: 39926 - RNA, 32 nt, Human
acuaccugucccaguacacgaaagggcgcugg

SEQ ID NO: 39927 - RNA, 32 nt, Human
acuaccuguucugcaggcggguccuggccucc

SEQ ID NO: 39928 - RNA, 32 nt, Human
acuaccuuccaaagugcugggauuacaggcgu

SEQ ID NO: 39929 - RNA, 32 nt, Human
acuaccuucccacccauacacauccauguuca

SEQ ID NO: 39930 - RNA, 32 nt, Human
acuaccuugucaugauccuccuucuuuuuccu

SEQ ID NO: 39931 - RNA, 25 nt, Human
acuaccuugugauucaaccauuuca

SEQ ID NO: 39932 - RNA, 32 nt, Human
acuaccuuucaaaaccagcacugugugggaau

SEQ ID NO: 39933 - RNA, 32 nt, Human
acuaccuuucccagcagcucaggcucaacugg

SEQ ID NO: 39934 - RNA, 32 nt, Human
acuaccuuuguccaggccugggugguauaggg

SEQ ID NO: 39935 - RNA, 32 nt, Human
acuacgagcaggcgaacgccacccucaaucag

SEQ ID NO: 39936 - RNA, 32 nt, Human
acuacgagugagugaggcugggaggaacacca

SEQ ID NO: 39937 - RNA, 32 nt, Human
acuacgcacagacucgacggugccaucagcau

SEQ ID NO: 39938 - RNA, 32 nt, Human
acuacgccaaaaccacacugaccaggcacuug

SEQ ID NO: 39939 - RNA, 32 nt, Human
acuacgccacugcacuccagccuggaggccag

SEQ ID NO: 39940 - RNA, 22 nt, Human
acuacgcccaucuccuaccuca

SEQ ID NO: 39941 - RNA, 32 nt, Human
acuacgcuacuugguugagccuggugaagaau

SEQ ID NO: 39942 - RNA, 32 nt, Human
acuacggagcccaugcccuggaggaacucugu

SEQ ID NO: 39943 - RNA, 32 nt, Human
acuacggaggggaacugcagagccagaagagc

SEQ ID NO: 39944 - RNA, 32 nt, Human
acuacggcacugcuccaggcaggccugguuau

SEQ ID NO: 39945 - RNA, 32 nt, Human
acuacgggcacacaccaccaugccuggcuaau

SEQ ID NO: 39946 - RNA, 32 nt, Human
acuacggggcggugccugcuguggaaaugccu

SEQ ID NO: 39947 - RNA, 32 nt, Human
acuacgggugugcgccaccacgcccagcuaau

SEQ ID NO: 39948 - RNA, 32 nt, Human
acuacgguaggugccuggcggaagggaguggg

SEQ ID NO: 39949 - RNA, 32 nt, Human
acuacgugaucugauugagauguacauaguuu

SEQ ID NO: 39950 - RNA, 32 nt, Human
acuacuacagaaguccagauaccacagucuga

SEQ ID NO: 39951 - RNA, 32 nt, Human
acuacuacccauucagaagagcagaaagcauc

SEQ ID NO: 39952 - RNA, 32 nt, Human
acuacuacccauucagaagagcagaaaguauc

SEQ ID NO: 39953 - RNA, 32 nt, Human
acuacuaucaccgaccuucccuagccgcugga

SEQ ID NO: 39954 - RNA, 32 nt, Human
acuacuauggaaugcaaagauuuggaaccaca

SEQ ID NO: 39955 - RNA, 32 nt, Human
acuacucagcuuucuuucagucaacccauaag

SEQ ID NO: 39956 - RNA, 32 nt, Human
acuacuccagaggcugaggugggaggauggcu

SEQ ID NO: 39957 - RNA, 32 nt, Human
acuacuccagccugggugacaaaguaagaccc

SEQ ID NO: 39958 - RNA, 32 nt, Human
acuacuccggagacaggguuuggcugugucua

SEQ ID NO: 39959 - RNA, 32 nt, Human
acuacuccggagucaggaggcagcagcggcgg

SEQ ID NO: 39960 - RNA, 32 nt, Human
acuacuccuccaggcccccagccugggacagc

SEQ ID NO: 39961 - RNA, 32 nt, Human
acuacuccucuccuccuccuccuccucuuccu

SEQ ID NO: 39962 - RNA, 32 nt, Human
acuacucucucucagaucccaggauuggcaug

SEQ ID NO: 39963 - RNA, 32 nt, Human
acuacucugccuuuuaaugucucauuuugccu

SEQ ID NO: 39964 - RNA, 32 nt, Human
acuacugaggugucaaguccugccuuuccuuu

SEQ ID NO: 39965 - RNA, 32 nt, Human
acuacugaucacuggggcaaaucaaagcaucc

SEQ ID NO: 39966 - RNA, 32 nt, Human
acuacugauguucacgaugccacacagucaca

SEQ ID NO: 39967 - RNA, 32 nt, Human
acuacugcacuccagccugggugacagaguaa

SEQ ID NO: 39968 - RNA, 32 nt, Human
acuacugcacuccagccugggugacagaguga

SEQ ID NO: 39969 - RNA, 32 nt, Human
acuacugcacuugagcaugaauggguaguagc

SEQ ID NO: 39970 - RNA, 32 nt, Human
acuacugcacuugcacugcccuuacuuugaag

SEQ ID NO: 39971 - RNA, 32 nt, Human
acuacugcagcagucccugaaccacuaaacuu

SEQ ID NO: 39972 - RNA, 32 nt, Human
acuacugcauuccagccugggugacagaguga

SEQ ID NO: 39973 - RNA, 32 nt, Human
acuacugcccugccuugggccuugcugcugcu

SEQ ID NO: 39974 - RNA, 32 nt, Human
acuacugccucaccucaggaagcacauaaugu

SEQ ID NO: 39975 - RNA, 32 nt, Human
acuacugccucuaccagaaaugucuuuuaaua

SEQ ID NO: 39976 - RNA, 32 nt, Human
acuacugccugccugccugccugcuacggcuc

SEQ ID NO: 39977 - RNA, 32 nt, Human
acuacugccugccugccugccugcuacgguga

SEQ ID NO: 39978 - RNA, 32 nt, Human
acuacugccuggcuaauuuuuauguuuuuagu

SEQ ID NO: 39979 - RNA, 32 nt, Human
acuacugcuggggccuuccuucauccucugag

SEQ ID NO: 39980 - RNA, 32 nt, Human
acuacugcuggggcugccaccuccuccuccag

SEQ ID NO: 39981 - RNA, 32 nt, Human
acuacugcuuuuccuaaaugcauacuguauau

SEQ ID NO: 39982 - RNA, 32 nt, Human
acuacuggcaaagcacuugcauuuuucauuag

SEQ ID NO: 39983 - RNA, 32 nt, Human
acuacugggcaaagaguguagaucagagcagc

SEQ ID NO: 39984 - RNA, 32 nt, Human
acuacugguguuuuucugccuugagaaaacaa

SEQ ID NO: 39985 - RNA, 32 nt, Human
acuacuguaaguuuuguuuuucacaaagcucu

SEQ ID NO: 39986 - RNA, 32 nt, Human
acuacuguacuacuguacuccagccuggggga

SEQ ID NO: 39987 - RNA, 32 nt, Human
acuacugugacuuugucugcagaagagcugga

SEQ ID NO: 39988 - RNA, 17 nt, Human
acuacugugcuucuugg

SEQ ID NO: 39989 - RNA, 18 nt, Human
acuacugugggccacugg

SEQ ID NO: 39990 - RNA, 16 nt, Human
acuacuguguuccugg

SEQ ID NO: 39991 - RNA, 18 nt, Human
acuacuguguugcacugg

SEQ ID NO: 39992 - RNA, 18 nt, Human
acuacuguguuucacuga

SEQ ID NO: 39993 - RNA, 32 nt, Human
acuacuguuuauuuuucccugcugugcccaga

SEQ ID NO: 39994 - RNA, 32 nt, Human
acuacuguuuccaagauaaaugagcuaauaag

SEQ ID NO: 39995 - RNA, 32 nt, Human
acuacuucaaugaucauuucacaagaaaaaga

SEQ ID NO: 39996 - RNA, 32 nt, Human
acuacuucauuuuaaugugagggauuuguuua

SEQ ID NO: 39997 - RNA, 32 nt, Human
acuacuuccucacacuuacugaacauguacuc

SEQ ID NO: 39998 - RNA, 32 nt, Human
acuacuucucccugguuucauucauguucuga

SEQ ID NO: 39999 - RNA, 32 nt, Human
acuacuugaucuugugaacacuggaaagacug

SEQ ID NO: 40000 - RNA, 32 nt, Human
acuacuuguuacugccaugcugcuugcccucc

SEQ ID NO: 40001 - RNA, 32 nt, Human
acuacuuucaagguauuuuucuuccaagcuga

SEQ ID NO: 40002 - RNA, 32 nt, Human
acuacuuucauucaggcuggagugcaguggca

SEQ ID NO: 40003 - RNA, 32 nt, Human
acuacuuuguucuuugguuaagauccaaaaga

SEQ ID NO: 40004 - RNA, 32 nt, Human
acuacuuuuaaaaaguuugaaaauuagaggac

SEQ ID NO: 40005 - RNA, 32 nt, Human
acuacuuuugacaacgccucaaacuuuucuaa

SEQ ID NO: 40006 - RNA, 32 nt, Human
acuagaaaagagacaguucuucugcugacaac

SEQ ID NO: 40007 - RNA, 32 nt, Human
acuagaaaaggcagaaagcaguguauuaaggu

SEQ ID NO: 40008 - RNA, 19 nt, Human
acuagaaaaucuaaucuua

SEQ ID NO: 40009 - RNA, 32 nt, Human
acuagaaaaugagaaaauugucuggguuccaa

SEQ ID NO: 40010 - RNA, 32 nt, Human
acuagaaacauacauuauucaucaaaagaaau

SEQ ID NO: 40011 - RNA, 32 nt, Human
acuagaaauacagaaaaauuagcugggugugg

SEQ ID NO: 40012 - RNA, 32 nt, Human
acuagaacccugucuccuacuuccuaguguaa

SEQ ID NO: 40013 - RNA, 32 nt, Human
acuagaacccuugucuuccucuuacccaaauu

SEQ ID NO: 40014 - RNA, 32 nt, Human
acuagaaccgggaggcggaaguugcagugagc

SEQ ID NO: 40015 - RNA, 32 nt, Human
acuagaagaccuucauccuccccuuccucugc

SEQ ID NO: 40016 - RNA, 32 nt, Human
acuagaagcugcauaagcuacacaggaugugc

SEQ ID NO: 40017 - RNA, 32 nt, Human
acuagaagcuucagcccggaagacaggcugcu

SEQ ID NO: 40018 - RNA, 32 nt, Human
acuagaaucaauuuguuccuuguuaaaggccu

SEQ ID NO: 40019 - RNA, 32 nt, Human
acuagaauggcagcggcagcaaauagggcucc

SEQ ID NO: 40020 - RNA, 32 nt, Human
acuagaaugugagcuccuuaagggcaggaaaa

SEQ ID NO: 40021 - RNA, 24 nt, Human
acuagaauuagaagcagagccuga

SEQ ID NO: 40022 - RNA, 32 nt, Human
acuagaauuuugaagacaggaaaguggagguu

SEQ ID NO: 40023 - RNA, 32 nt, Human
acuagacaaagaaccugcaucaauaucaggac

SEQ ID NO: 40024 - RNA, 32 nt, Human
acuagacagccaggagcccagcagaacaagug

SEQ ID NO: 40025 - RNA, 32 nt, Human
acuagacagccccucugagcacaugcauagug

SEQ ID NO: 40026 - RNA, 32 nt, Human
acuagacagccuguccguccgccauggcuucc

SEQ ID NO: 40027 - RNA, 32 nt, Human
acuagacaucucaucagccacuugugugaaga

SEQ ID NO: 40028 - RNA, 32 nt, Human
acuagacccacagacaugaaaagcaaccuuag

SEQ ID NO: 40029 - RNA, 32 nt, Human
acuagacccacuggacucaccucccccaucuc

SEQ ID NO: 40030 - RNA, 32 nt, Human
acuagaccccacaccagggcacccuaagaggg

SEQ ID NO: 40031 - RNA, 32 nt, Human
acuagaccucaagacuccauaaguagcucuca

SEQ ID NO: 40032 - RNA, 32 nt, Human
acuagaccucugucugugucgguccagugucu

SEQ ID NO: 40033 - RNA, 32 nt, Human
acuagacucuaacccagcaccagggugcccac

SEQ ID NO: 40034 - RNA, 32 nt, Human
acuagacuugaaaagaaaccauuugagauuug

SEQ ID NO: 40035 - RNA, 32 nt, Human
acuagacuuuucuauuggccugugccaucgcc

SEQ ID NO: 40036 - RNA, 32 nt, Human
acuagagaauucugugcaaacauaucaucucu

SEQ ID NO: 40037 - RNA, 32 nt, Human
acuagagacgggcacccaggcugcagugugug

SEQ ID NO: 40038 - RNA, 32 nt, Human
acuagagaggcugaggcaggagaaucacuuga

SEQ ID NO: 40039 - RNA, 32 nt, Human
acuagagagggagggggaagagcagaaguuag

SEQ ID NO: 40040 - RNA, 32 nt, Human
acuagagagguugaggugggaggaucacuuga

SEQ ID NO: 40041 - RNA, 32 nt, Human
acuagagcauccugccugccuucuccacugag

SEQ ID NO: 40042 - RNA, 32 nt, Human
acuagagcgacugucagugugguuggcaguga

SEQ ID NO: 40043 - RNA, 32 nt, Human
acuagagggagugggguugcaguggcugccug

SEQ ID NO: 40044 - RNA, 32 nt, Human
acuagagugagcaaucauaccuuauaaaugac

SEQ ID NO: 40045 - RNA, 32 nt, Human
acuagaguuccuugugggauuggaccagcauu

SEQ ID NO: 40046 - RNA, 32 nt, Human
acuagaugacucuguaaagacucuccaggcca

SEQ ID NO: 40047 - RNA, 32 nt, Human
acuagauggcuccaucccaaggcaucuuguca

SEQ ID NO: 40048 - RNA, 32 nt, Human
acuagaugugugugugcacacacacagaaacc

SEQ ID NO: 40049 - RNA, 32 nt, Human
acuagauuagcaggcaaaacuaugaugguuug

SEQ ID NO: 40050 - RNA, 32 nt, Human
acuagauuagugcuuucuagcaaacgguucug

SEQ ID NO: 40051 - RNA, 32 nt, Human
acuagauugcaugcuuccuccuuugcucuugg

SEQ ID NO: 40052 - RNA, 32 nt, Human
acuagauugugagcuccuugagggaaaggaac

SEQ ID NO: 40053 - RNA, 32 nt, Human
acuagcaauauaggguuuuguuugguugguug

SEQ ID NO: 40054 - RNA, 32 nt, Human
acuagcaauguucauacuuaauaaaaacauua

SEQ ID NO: 40055 - RNA, 32 nt, Human
acuagcacaccacugcaugucucuagaaugcu

SEQ ID NO: 40056 - RNA, 32 nt, Human
acuagcagaggcacuuucgcagcccacccugc

SEQ ID NO: 40057 - RNA, 32 nt, Human
acuagcagaggcuagacccagaaagagggaac

SEQ ID NO: 40058 - RNA, 32 nt, Human
acuagcaggaacagacuugggaccaaaaaucc

SEQ ID NO: 40059 - RNA, 32 nt, Human
acuagcaggagaaaggccacaaggccugcgug

SEQ ID NO: 40060 - RNA, 32 nt, Human
acuagcauccaccaaaugcaagaagaauaaac

SEQ ID NO: 40061 - RNA, 32 nt, Human
acuagcaugcagauacccaugcucugacuuuc

SEQ ID NO: 40062 - RNA, 32 nt, Human
acuagcaugccuguguucccagcuacuuggga

SEQ ID NO: 40063 - RNA, 32 nt, Human
acuagcauguguuucugcaguuuguuacacac

SEQ ID NO: 40064 - RNA, 32 nt, Human
acuagcauuuauuaggggaaaaugagguucuc

SEQ ID NO: 40065 - RNA, 31 nt, Human
acuagccacagcuaagcuccacaaagccuag

SEQ ID NO: 40066 - RNA, 32 nt, Human
acuagccacuccugccaggccgccgggauggu

SEQ ID NO: 40067 - RNA, 32 nt, Human
acuagccagaugcagugcaagguguacgacuc

SEQ ID NO: 40068 - RNA, 32 nt, Human
acuagccagcugugggcucuucagcaaaccac

SEQ ID NO: 40069 - RNA, 32 nt, Human
acuagccagcuuccucgcaucuucaccagcau

SEQ ID NO: 40070 - RNA, 32 nt, Human
acuagccaggcagggcugggcgcgguggcuca

SEQ ID NO: 40071 - RNA, 19 nt, Human
acuagcccaaccaacaugg

SEQ ID NO: 40072 - RNA, 32 nt, Human
acuagcccaggcccuggaaaagggagggcacu

SEQ ID NO: 40073 - RNA, 32 nt, Human
acuagccgaagagauuccucugaaaaucuugg

SEQ ID NO: 40074 - RNA, 32 nt, Human
acuagccgccccaaggcccccaaaaggcaacc

SEQ ID NO: 40075 - RNA, 32 nt, Human
acuagccuaggcaacauagugagacccugucu

SEQ ID NO: 40076 - RNA, 32 nt, Human
acuagccuagguaacauagugagacccugucu

SEQ ID NO: 40077 - RNA, 32 nt, Human
acuagccucuagccacacagguuccaucccaa

SEQ ID NO: 40078 - RNA, 24 nt, Human
acuagccugaccaacauggugaaa

SEQ ID NO: 40079 - RNA, 32 nt, Human
acuagccugcacaacauacugagacccugacu

SEQ ID NO: 40080 - RNA, 32 nt, Human
acuagccuggacaacauacuaaaaccucaucu

SEQ ID NO: 40081 - RNA, 32 nt, Human
acuagccuggacaacaucgugaaaccuugucu

SEQ ID NO: 40082 - RNA, 32 nt, Human
acuagccuggacaacuaagugagacuccaucu

SEQ ID NO: 40083 - RNA, 32 nt, Human
acuagccuggacagcauggcaaaacccuaucu

SEQ ID NO: 40084 - RNA, 32 nt, Human
acuagccuggagcuacccgucuggacucgcag

SEQ ID NO: 40085 - RNA, 21 nt, Human
acuagccuggccaacacggug

SEQ ID NO: 40086 - RNA, 24 nt, Human
acuagccuggccaacacggugaaa

SEQ ID NO: 40087 - RNA, 21 nt, Human
acuagccuggccaacauagca

SEQ ID NO: 40088 - RNA, 24 nt, Human
acuagccuggccaacauagugaaa

SEQ ID NO: 40089 - RNA, 19 nt, Human
acuagccuggccaacaugg

SEQ ID NO: 40090 - RNA, 24 nt, Human
acuagccuggccaacauggugaaa

SEQ ID NO: 40091 - RNA, 24 nt, Human
acuagccuggccaagauggugaaa

SEQ ID NO: 40092 - RNA, 20 nt, Human
acuagccuggccaauauggu

SEQ ID NO: 40093 - RNA, 32 nt, Human
acuagccugggcaacauaaugagaccccaucu

SEQ ID NO: 40094 - RNA, 24 nt, Human
acuagccugggcaacaugaugaaa

SEQ ID NO: 40095 - RNA, 24 nt, Human
acuagccugggcaacauggugaaa

SEQ ID NO: 40096 - RNA, 32 nt, Human
acuagccugggcaacauggugagaccccaucu

SEQ ID NO: 40097 - RNA, 32 nt, Human
acugaaaggagguggggucacagugaauuuca

SEQ ID NO: 40098 - RNA, 32 nt, Human
acugaaaggcugugaccagccugguggcgcga

SEQ ID NO: 40099 - RNA, 27 nt, Human
acugaaagggaaaacaaaauacuugac

SEQ ID NO: 40100 - RNA, 32 nt, Human
acugaaaggggucccaacagaggugaagaucc

SEQ ID NO: 40101 - RNA, 32 nt, Human
acugaaaggucuguggccaucugugagguaga

SEQ ID NO: 40102 - RNA, 32 nt, Human
acugaaauacaaaacuuaaccgggcuuggugg

SEQ ID NO: 40103 - RNA, 32 nt, Human
acugaaauacaaaagaaauuagccaggugugg

SEQ ID NO: 40104 - RNA, 32 nt, Human
acugaaaucuccugcugacuuugagagcugag

SEQ ID NO: 40105 - RNA, 19 nt, Human
acugaaauggaagauccug

SEQ ID NO: 40106 - RNA, 32 nt, Human
acugaaauggcugaggugggguuugggguauc

SEQ ID NO: 40107 - RNA, 32 nt, Human
acugaaauuguuuuaccagcucccagggugga

SEQ ID NO: 40108 - RNA, 21 nt, Human
acugaaauuuggaaaaaggca

SEQ ID NO: 40109 - RNA, 32 nt, Human
acugaacaaccugcuccugaaugacuacuggg

SEQ ID NO: 40110 - RNA, 19 nt, Human
acugaacaacuguugggau

SEQ ID NO: 40111 - RNA, 32 nt, Human
acugaacaaugagacaauguugaggacucaaa

SEQ ID NO: 40112 - RNA, 32 nt, Human
acugaacacaaggggagggaaagaucauuaca

SEQ ID NO: 40113 - RNA, 32 nt, Human
acugaacacauccagccacaggcaccagcugg

SEQ ID NO: 40114 - RNA, 23 nt, Human
acugaacaccacagugcccgcca

SEQ ID NO: 40115 - RNA, 32 nt, Human
acugaacaccuugagaggaaggacugugucuu

SEQ ID NO: 40116 - RNA, 32 nt, Human
acugaacaggcaggccacuuugccucuaaauu

SEQ ID NO: 40117 - RNA, 32 nt, Human
acugaacauagcuguauagguuugugauuauu

SEQ ID NO: 40118 - RNA, 32 nt, Human
acugaacccauuacuuuuccaagaccagaaaa

SEQ ID NO: 40119 - RNA, 32 nt, Human
acugaacccgggaggcggaggcugcagugggc

SEQ ID NO: 40120 - RNA, 32 nt, Human
acugaaccucucucuaguagccuggauuuauc

SEQ ID NO: 40121 - RNA, 32 nt, Human
acugaaccucugccgguuaagaugguguuagg

SEQ ID NO: 40122 - RNA, 32 nt, Human
acugaacgcugagccggggagguccaacucca

SEQ ID NO: 40123 - RNA, 32 nt, Human
acugaacgcugcagggcagggaagaaauaaau

SEQ ID NO: 40124 - RNA, 32 nt, Human
acugaacuauuuucaaagcagaaaaauugaca

SEQ ID NO: 40125 - RNA, 32 nt, Human
acugaacucacaccugguaccacucagaaccu

SEQ ID NO: 40126 - RNA, 32 nt, Human
acugaacucaguguccaguauaaugcagaauu

SEQ ID NO: 40127 - RNA, 32 nt, Human
acugaacuccagccugggcaacagagugagau

SEQ ID NO: 40128 - RNA, 32 nt, Human
acugaacuccagccugggcaacaggugagauu

SEQ ID NO: 40129 - RNA, 32 nt, Human
acugaacuccagccugggugacagagugagac

SEQ ID NO: 40130 - RNA, 32 nt, Human
acugaacucugggcugcuucucuguguguaaa

SEQ ID NO: 40131 - RNA, 32 nt, Human
acugaacuguagaagcagagcagcagcaguua

SEQ ID NO: 40132 - RNA, 32 nt, Human
acugaacuuauaaaugugggcuguaauuccac

SEQ ID NO: 40133 - RNA, 32 nt, Human
acugaacuuauucaaccuacaggaggccacug

SEQ ID NO: 40134 - RNA, 32 nt, Human
acugaagaaaaaugccaaugugacguuugugu

SEQ ID NO: 40135 - RNA, 32 nt, Human
acugaagaaaaccacuaauaacaacaagaaua

SEQ ID NO: 40136 - RNA, 32 nt, Human
acugaagaaagagaacuccagaggguuugaca

SEQ ID NO: 40137 - RNA, 32 nt, Human
acugaagaacauccagaaaagauuuugacuga

SEQ ID NO: 40138 - RNA, 32 nt, Human
acugaagaaggugcauugauacauuuuuaaau

SEQ ID NO: 40139 - RNA, 32 nt, Human
acugaagacaccuuuugcaucucccccaucca

SEQ ID NO: 40140 - RNA, 32 nt, Human
acugaagagauagcuuucaagggcccaacacu

SEQ ID NO: 40141 - RNA, 32 nt, Human
acugaagagauugccugguucaucuuguaguc

SEQ ID NO: 40142 - RNA, 32 nt, Human
acugaagagcaucuccccacccagucaccuga

SEQ ID NO: 40143 - RNA, 32 nt, Human
acugaagaggaaaaggauacuggagaucuaaa

SEQ ID NO: 40144 - RNA, 32 nt, Human
acugaagaggcugaggugggaggaucgcuuga

SEQ ID NO: 40145 - RNA, 32 nt, Human
acugaagagggagggagggaggagugcugaag

SEQ ID NO: 40146 - RNA, 32 nt, Human
acugaagauuuuauuuauucuucucucugauu

SEQ ID NO: 40147 - RNA, 32 nt, Human
acugaagcagcaaacccacaaagcaucaaaag

SEQ ID NO: 40148 - RNA, 32 nt, Human
acugaagcagccccggagaaggagaaccgagu

SEQ ID NO: 40149 - RNA, 32 nt, Human
acugaagcaugucugaaaucuuccugccauca

SEQ ID NO: 40150 - RNA, 32 nt, Human
acugaagccacaggcugguggccauguucucu

SEQ ID NO: 40151 - RNA, 32 nt, Human
acugaagccucaaccucccuggguuugagcaa

SEQ ID NO: 40152 - RNA, 23 nt, Human
acugaagcucgagaagggccuga

SEQ ID NO: 40153 - RNA, 32 nt, Human
acugaagcugaaccucugccuuuaggaguccc

SEQ ID NO: 40154 - RNA, 32 nt, Human
acugaagcugcacucugaaaacugggcaguuu

SEQ ID NO: 40155 - RNA, 32 nt, Human
acugaaggaaccguaggagccugcucucagaa

SEQ ID NO: 40156 - RNA, 32 nt, Human
acugaaggcauggcggcggggugcaggggaaa

SEQ ID NO: 40157 - RNA, 32 nt, Human
acugaagggaccuuagcaaucaucucauccau

SEQ ID NO: 40158 - RNA, 32 nt, Human
acugaagggguaagcaaaccagauggauuuca

SEQ ID NO: 40159 - RNA, 32 nt, Human
acugaaggugaagauccaagauucuaaauucc

SEQ ID NO: 40160 - RNA, 19 nt, Human
acugaaggugggcaaggug

SEQ ID NO: 40161 - RNA, 32 nt, Human
acugaagguugcgaugccuuacucugacggga

SEQ ID NO: 40162 - RNA, 23 nt, Human
acugaaguaugggaggcuucuga

SEQ ID NO: 40163 - RNA, 32 nt, Human
acugaagucccaggcugggggugucaauggac

SEQ ID NO: 40164 - RNA, 28 nt, Human
acugaagucguacucuggggcccugcag

SEQ ID NO: 40165 - RNA, 32 nt, Human
acugaagugggucugugucacacagguauuuc

SEQ ID NO: 40166 - RNA, 32 nt, Human
acugaaguguugggcagagagggggcuuaagg

SEQ ID NO: 40167 - RNA, 32 nt, Human
acugaaguuagcugggugugguggcucaugcc

SEQ ID NO: 40168 - RNA, 32 nt, Human
acugaaguugcagauaaugaggacuuaccauu

SEQ ID NO: 40169 - RNA, 32 nt, Human
acugaaguuguggcauaugaaaaaggugcuuu

SEQ ID NO: 40170 - RNA, 32 nt, Human
acugaaguuuuguggcagagaagaacuuguua

SEQ ID NO: 40171 - RNA, 32 nt, Human
acugaauaaagaaaauaugguacauauucacc

SEQ ID NO: 40172 - RNA, 32 nt, Human
acugaauaaugugaggaagcagugauguuucu

SEQ ID NO: 40173 - RNA, 32 nt, Human
acugaauaauguuuuaaugauaggguauuaug

SEQ ID NO: 40174 - RNA, 32 nt, Human
acugaauacuauaggcaauugcagcacaaugg

SEQ ID NO: 40175 - RNA, 32 nt, Human
acugaauauaucauguccacaguagauuuuca

SEQ ID NO: 40176 - RNA, 28 nt, Human
acugaauauauuaaacacuaaaaaccug

SEQ ID NO: 40177 - RNA, 32 nt, Human
acugaauaucagauuugucaucaggaauacuc

SEQ ID NO: 40178 - RNA, 32 nt, Human
acugaaucaccaccccagaagagcgagaggcu

SEQ ID NO: 40179 - RNA, 32 nt, Human
acugaauccaacauauccacaagcaaguuauc

SEQ ID NO: 40180 - RNA, 32 nt, Human
acugaaucccugaacagagaauaucucuugua

SEQ ID NO: 40181 - RNA, 32 nt, Human
acugaauccuuuaacuuggccaaaggacccuu

SEQ ID NO: 40182 - RNA, 21 nt, Human
acugaaucgaagcaggccuga

SEQ ID NO: 40183 - RNA, 32 nt, Human
acugaaucgccacuacagccugggugcaaaau

SEQ ID NO: 40184 - RNA, 32 nt, Human
acugaaucuaccugccuaagggacuuaacuug

SEQ ID NO: 40185 - RNA, 32 nt, Human
acugaaucucagggauaaugggucaacccaga

SEQ ID NO: 40186 - RNA, 32 nt, Human
acugaaucuguagcuuccggauaccguagccc

SEQ ID NO: 40187 - RNA, 32 nt, Human
acugaaucugucuacccuucauucaugagaac

SEQ ID NO: 40188 - RNA, 32 nt, Human
acugaaucuucaagaccaaagcagaaaagaaa

SEQ ID NO: 40189 - RNA, 32 nt, Human
acugaaugacaugcaacaggugaagguuuaua

SEQ ID NO: 40190 - RNA, 32 nt, Human
acugaaugacucucugucuuacacagcuacuc

SEQ ID NO: 40191 - RNA, 32 nt, Human
acugaaugaguggagggcagagacaggccugg

SEQ ID NO: 40192 - RNA, 32 nt, Human
acugaaugcaaaccacaggguuucgcagcgug

SEQ ID NO: 40193 - RNA, 32 nt, Human
acugaaugccaggcuaggaaggaggcggcucu

SEQ ID NO: 40194 - RNA, 21 nt, Human
acugaaugccuccccaaaggc

SEQ ID NO: 40195 - RNA, 23 nt, Human
acugaauggagggcccccaggaa

SEQ ID NO: 40196 - RNA, 32 nt, Human
acugaaugggaaggaauguggauagcuuugga

SEQ ID NO: 40197 - RNA, 32 nt, Human
acugaauggggguggaccuggcauuuaucugg

SEQ ID NO: 40198 - RNA, 32 nt, Human
acugaauucugaacuuuucaggagguacugug

SEQ ID NO: 40199 - RNA, 32 nt, Human
acugaauuucaggaaaugggauagagcuucua

SEQ ID NO: 40200 - RNA, 32 nt, Human
acugaauuuccugcuuuccugguugaauuuuc

SEQ ID NO: 40201 - RNA, 32 nt, Human
acugaauuuucaguauuuuaucucaaguagau

SEQ ID NO: 40202 - RNA, 32 nt, Human
acugacaaaagcaaaucaauaacucuaaauuc

SEQ ID NO: 40203 - RNA, 32 nt, Human
acugacaaaucaugauaagggcacaaaagcug

SEQ ID NO: 40204 - RNA, 32 nt, Human
acugacaacucuuacgacagagggagaguggu

SEQ ID NO: 40205 - RNA, 32 nt, Human
acugacaaguagaaucaaaggugcagcugacu

SEQ ID NO: 40206 - RNA, 31 nt, Human
acugacaauugugucuccacagcagaggugg

SEQ ID NO: 40207 - RNA, 32 nt, Human
acugacacacagauugcaaagguccucggcca

SEQ ID NO: 40208 - RNA, 32 nt, Human
acugacacagccacaguuuccaaaaagugcag

SEQ ID NO: 40209 - RNA, 32 nt, Human
acugacaccuguaaucccagcacauugggagg

SEQ ID NO: 40210 - RNA, 32 nt, Human
acugacacuacccuuaguuuuaauuuucccug

SEQ ID NO: 40211 - RNA, 32 nt, Human
acugacacugucagcucuccuggguggcaaga

SEQ ID NO: 40212 - RNA, 32 nt, Human
acugacacuugguuccauccauuuaggggccu

SEQ ID NO: 40213 - RNA, 32 nt, Human
acugacagacggagugacagacggacugacca

SEQ ID NO: 40214 - RNA, 32 nt, Human
acugacagacuuagaaccugaggucucauuca

SEQ ID NO: 40215 - RNA, 32 nt, Human
acugacagauuguccgggcaaaccuggaaauu

SEQ ID NO: 40216 - RNA, 32 nt, Human
acugacagccagagacagcaggagaaggguug

SEQ ID NO: 40217 - RNA, 32 nt, Human
acugacagcccagaccccauacuuuaggucau

SEQ ID NO: 40218 - RNA, 32 nt, Human
acugacagcccgcagucuucuggacuucuuuu

SEQ ID NO: 40219 - RNA, 32 nt, Human
acugacagccucccacccccaucucucccucc

SEQ ID NO: 40220 - RNA, 32 nt, Human
acugacagccucugccccaggccugaguccuu

SEQ ID NO: 40221 - RNA, 32 nt, Human
acugacaggaggaaccaaggaggcacguaucu

SEQ ID NO: 40222 - RNA, 18 nt, Human
acugacaggaggcaaggu

SEQ ID NO: 40223 - RNA, 32 nt, Human
acugacaggcagagaauaggaauaugcagcug

SEQ ID NO: 40224 - RNA, 32 nt, Human
acugacaggccugauggagcuuguggcuggcc

SEQ ID NO: 40225 - RNA, 32 nt, Human
acugacaggugcugacuuuacaugcacugugg

SEQ ID NO: 40226 - RNA, 32 nt, Human
acugacaguauuaaggguaggauguugcucug

SEQ ID NO: 40227 - RNA, 32 nt, Human
acugacaguuucugaggcagaagccguaucau

SEQ ID NO: 40228 - RNA, 32 nt, Human
acugacauaagaaucaauaaaaugauuguuuu

SEQ ID NO: 40229 - RNA, 32 nt, Human
acugacauaccccauguacacacacagaucua

SEQ ID NO: 40230 - RNA, 24 nt, Human
acugacauaguaaagcucaacaaa

SEQ ID NO: 40231 - RNA, 32 nt, Human
acugacaugacuuggcuuucucauccagaaau

SEQ ID NO: 40232 - RNA, 32 nt, Human
acugacaugcauuauuuucacugugaauucac

SEQ ID NO: 40233 - RNA, 32 nt, Human
acugacaugccucugcugcuuuugcuuuguac

SEQ ID NO: 40234 - RNA, 31 nt, Human
acugacaugcucuucugacaucagacucaag

SEQ ID NO: 40235 - RNA, 23 nt, Human
acugacauuggaucacugacaaa

SEQ ID NO: 40236 - RNA, 32 nt, Human
acugaccaaguugggucccggguggggagccu

SEQ ID NO: 40237 - RNA, 32 nt, Human
acugaccacagccuuugugcuuuugaagccua

SEQ ID NO: 40238 - RNA, 32 nt, Human
acugaccacugaucucuggccuagcagccauu

SEQ ID NO: 40239 - RNA, 32 nt, Human
acugaccagcaaaauggagaagaucagagaau

SEQ ID NO: 40240 - RNA, 32 nt, Human
acugaccagcggcugcucaagccgcaagcucu

SEQ ID NO: 40241 - RNA, 32 nt, Human
acugaccaggauugugaaagaguucuucuguu

SEQ ID NO: 40242 - RNA, 32 nt, Human
acugaccaggggauagguugaggcagauggug

SEQ ID NO: 40243 - RNA, 32 nt, Human
acugaccagguaaucuggaccucagagauaga

SEQ ID NO: 40244 - RNA, 32 nt, Human
acugaccaucaucucaggaugucucuuucugg

SEQ ID NO: 40245 - RNA, 32 nt, Human
acugaccaucuccgacacagaaacccaucgaa

SEQ ID NO: 40246 - RNA, 32 nt, Human
acugaccaucuggacacacccugcugcgaauc

SEQ ID NO: 40247 - RNA, 32 nt, Human
acugaccaugaacaggauuucugcacgaaugu

SEQ ID NO: 40248 - RNA, 32 nt, Human
acugaccauggcccaacagcaaacaaaugaug

SEQ ID NO: 40249 - RNA, 32 nt, Human
acugacccacauuggcaccuguuaggagaccu

SEQ ID NO: 40250 - RNA, 32 nt, Human
acugacccacugcauuccagccuggcgacaga

SEQ ID NO: 40251 - RNA, 32 nt, Human
acugacccagaacaagcucaucuugaaggggg

SEQ ID NO: 40252 - RNA, 32 nt, Human
acugacccagaacacuggcccucggaaaccug

SEQ ID NO: 40253 - RNA, 32 nt, Human
acugacccaggaggagaaagcagccauuggca

SEQ ID NO: 40254 - RNA, 32 nt, Human
acugaccccagccaccacuucagugugauuua

SEQ ID NO: 40255 - RNA, 32 nt, Human
acugaccccagggcugaccaccagccucucau

SEQ ID NO: 40256 - RNA, 32 nt, Human
acugaccccucuuagaucuacuuccccugccc

SEQ ID NO: 40257 - RNA, 32 nt, Human
acugaccccuggcugcgacuucuccagcccag

SEQ ID NO: 40258 - RNA, 32 nt, Human
acugacccugcucucuccuuucccuguuagac

SEQ ID NO: 40259 - RNA, 32 nt, Human
acugacccuggucaccagaggcugcaauucag

SEQ ID NO: 40260 - RNA, 32 nt, Human
acugaccguaaaccacagacgcucuccagguu

SEQ ID NO: 40261 - RNA, 32 nt, Human
acugaccucaaauaaucccagcacuuugggag

SEQ ID NO: 40262 - RNA, 32 nt, Human
acugaccugccuguagccccagugacagcuag

SEQ ID NO: 40263 - RNA, 32 nt, Human
acugaccuguucuguugacuggggcccugcag

SEQ ID NO: 40264 - RNA, 20 nt, Human
acugaccuuaauauugggau

SEQ ID NO: 40265 - RNA, 32 nt, Human
acugacgcucacucugggcuucccaagcaccc

SEQ ID NO: 40266 - RNA, 32 nt, Human
acugacgguucccugaggauggggcuguuucu

SEQ ID NO: 40267 - RNA, 32 nt, Human
acugacguauguuucccuuugugaauuaauaa

SEQ ID NO: 40268 - RNA, 32 nt, Human
acugacgucuaccucauggggcugcugugugg

SEQ ID NO: 40269 - RNA, 32 nt, Human
acugacuaaaaauguugggcuaaagccauuaa

SEQ ID NO: 40270 - RNA, 31 nt, Human
acugacuacagcuagaaagccaggcgcacaa

SEQ ID NO: 40271 - RNA, 32 nt, Human
acugacuagauuuauucauaccaugagacaac

SEQ ID NO: 40272 - RNA, 32 nt, Human
acugacuagcugugccacucugggcaaaugcu

SEQ ID NO: 40273 - RNA, 32 nt, Human
acugacuaggguaguggggugcauuugguuuu

SEQ ID NO: 40274 - RNA, 22 nt, Human
acugacuaguacuccugggaug

SEQ ID NO: 40275 - RNA, 32 nt, Human
acugacuaguacuccugggaugccaugccacg

SEQ ID NO: 40276 - RNA, 32 nt, Human
acugacucaaagccaggggccgacagccuugu

SEQ ID NO: 40277 - RNA, 32 nt, Human
acugacucaccucucucuuucucagucccaaa

SEQ ID NO: 40278 - RNA, 32 nt, Human
acugacucaggaaaguuugucuaauuuggcac

SEQ ID NO: 40279 - RNA, 32 nt, Human
acugacuccagccaagaaaccugagccccuuu

SEQ ID NO: 40280 - RNA, 32 nt, Human
acugacuccagccucugcuccgggaggcccuc

SEQ ID NO: 40281 - RNA, 32 nt, Human
acugacuccauacauaaccuccuugaaaaacc

SEQ ID NO: 40282 - RNA, 32 nt, Human
acugacuccuguuugcucgcuggaccaacccc

SEQ ID NO: 40283 - RNA, 32 nt, Human
acugacucggcagugugcaguggugcaugcac

SEQ ID NO: 40284 - RNA, 32 nt, Human
acugacucuuccugcuuccucacuuucccagc

SEQ ID NO: 40285 - RNA, 32 nt, Human
acugacugacugcggccgccuccggccaggac

SEQ ID NO: 40286 - RNA, 32 nt, Human
acugacugcauggcagcugugugcucagcccg

SEQ ID NO: 40287 - RNA, 32 nt, Human
acugacugcccacugaccagagcccgggccag

SEQ ID NO: 40288 - RNA, 32 nt, Human
acugacugcccuuuuccaugugucuucauucu

SEQ ID NO: 40289 - RNA, 32 nt, Human
acugacuggaagggaaguucaggcucugagac

SEQ ID NO: 40290 - RNA, 32 nt, Human
acugacuggagcaggcauggcccaccaggcuu

SEQ ID NO: 40291 - RNA, 32 nt, Human
acugacuggauguguggggaguuuauaucacu

SEQ ID NO: 40292 - RNA, 32 nt, Human
acugacuggcagagacaggagagguagauguc

SEQ ID NO: 40293 - RNA, 29 nt, Human
acugacuggcugcagccuucccacgccaa

SEQ ID NO: 40294 - RNA, 32 nt, Human
acugacugggcaaggcuucuugggcaucgaug

SEQ ID NO: 40295 - RNA, 32 nt, Human
acugacugggucucaguauguugcccaggcug

SEQ ID NO: 40296 - RNA, 32 nt, Human
acugacugguccagaagacagaggguacaaca

SEQ ID NO: 40297 - RNA, 32 nt, Human
acugacuguaguuaauuuugucacagaaucua

SEQ ID NO: 40298 - RNA, 32 nt, Human
acugacuguguggcauggagcauggcuguucc

SEQ ID NO: 40299 - RNA, 32 nt, Human
acugacuuaugagaaagcaaagcacugguaca

SEQ ID NO: 40300 - RNA, 32 nt, Human
acugacuucaaaaugaggucacuugggcacag

SEQ ID NO: 40301 - RNA, 32 nt, Human
acugacuucucccacccuucugucucccccau

SEQ ID NO: 40302 - RNA, 32 nt, Human
acugacuugcuaugucacccugggcaagucac

SEQ ID NO: 40303 - RNA, 32 nt, Human
acugacuugcuccccucuccuuuucuucucuu

SEQ ID NO: 40304 - RNA, 32 nt, Human
acugacuuugauccuguuccacuuuugaaauu

SEQ ID NO: 40305 - RNA, 32 nt, Human
acugacuuugccuacggcaaagaaggaaaaac

SEQ ID NO: 40306 - RNA, 32 nt, Human
acugagaaaggagccacgggccagaucuuuug

SEQ ID NO: 40307 - RNA, 32 nt, Human
acugagaaaggagccacgguccagaucuuuug

SEQ ID NO: 40308 - RNA, 32 nt, Human
acugagaaaggggaaagggaagggugccacgu

SEQ ID NO: 40309 - RNA, 32 nt, Human
acugagaaaugccacagaaugugcaggaagcc

SEQ ID NO: 40310 - RNA, 32 nt, Human
acugagaacagaggacggccagugaguccaag

SEQ ID NO: 40311 - RNA, 24 nt, Human
acugagaaccaaaggaaggaucca

SEQ ID NO: 40312 - RNA, 32 nt, Human
acugagaagaguguauugacucugaguguaag

SEQ ID NO: 40313 - RNA, 32 nt, Human
acugagaagcaagaggaggagaaaaagauguc

SEQ ID NO: 40314 - RNA, 32 nt, Human
acugagaagcaugcacugugaccugcacaccc

SEQ ID NO: 40315 - RNA, 32 nt, Human
acugagaaggauggaagaaggagccaggcacc

SEQ ID NO: 40316 - RNA, 32 nt, Human
acugagaaguuuuaagagaugauaggguugga

SEQ ID NO: 40317 - RNA, 32 nt, Human
acugagaaucccugagugcccucugccccuuc

SEQ ID NO: 40318 - RNA, 32 nt, Human
acugagaaugugccacuggacucccagccugg

SEQ ID NO: 40319 - RNA, 32 nt, Human
acugagacaacaaugcaaguggguaauaguca

SEQ ID NO: 40320 - RNA, 21 nt, Human
acugagacaagcagggcuuga

SEQ ID NO: 40321 - RNA, 32 nt, Human
acugagacagccugagauauggccucauggga

SEQ ID NO: 40322 - RNA, 32 nt, Human
acugagaccaaggauucagcauuagaacaucu

SEQ ID NO: 40323 - RNA, 32 nt, Human
acugagaccagccugggcaacauagagagacc

SEQ ID NO: 40324 - RNA, 32 nt, Human
acugagaccauccuagccaacauggugaaaac

SEQ ID NO: 40325 - RNA, 32 nt, Human
acugagaccauccuagccaacauggugaaacc

SEQ ID NO: 40326 - RNA, 32 nt, Human
acugagaccauccuggccaacauggugaacac

SEQ ID NO: 40327 - RNA, 32 nt, Human
acugagacccaggccuggcaggaccgugccua

SEQ ID NO: 40328 - RNA, 32 nt, Human
acugagaccuguacugaauaagacaagagaaa

SEQ ID NO: 40329 - RNA, 32 nt, Human
acugagacggugggacacacgccccuaccugc

SEQ ID NO: 40330 - RNA, 32 nt, Human
acugagacuccagccucuccuccuggggccac

SEQ ID NO: 40331 - RNA, 32 nt, Human
acugagacugacacuucugcucccggccgccc

SEQ ID NO: 40332 - RNA, 32 nt, Human
acugagagacagaggcagcaucugccauucua

SEQ ID NO: 40333 - RNA, 32 nt, Human
acugagagagccagaggcagagaggugagggu

SEQ ID NO: 40334 - RNA, 32 nt, Human
acugagagagggcugauaaacuaggguccucc

SEQ ID NO: 40335 - RNA, 32 nt, Human
acugagagagggcuuaucacuauauccagcua

SEQ ID NO: 40336 - RNA, 32 nt, Human
acugagagagugaggagccagacgacaagcac

SEQ ID NO: 40337 - RNA, 22 nt, Human
acugagagccagauaccugcca

SEQ ID NO: 40338 - RNA, 32 nt, Human
acugagagcuggagaguuggugauaagcgaga

SEQ ID NO: 40339 - RNA, 32 nt, Human
acugagagcuuccaaaaugcccaggcaggcuc

SEQ ID NO: 40340 - RNA, 32 nt, Human
acugagaggcagcaaaggcggugacacucccc

SEQ ID NO: 40341 - RNA, 32 nt, Human
acugagaggccgaucacuugaggucaggaguu

SEQ ID NO: 40342 - RNA, 32 nt, Human
acugagaucauggcuaggaaacggagccugac

SEQ ID NO: 40343 - RNA, 32 nt, Human
acugagauccuccagccuggacaugcugccca

SEQ ID NO: 40344 - RNA, 32 nt, Human
acugagaucuaggcccucagcaaccagcucug

SEQ ID NO: 40345 - RNA, 32 nt, Human
acugagauugugccacuacacuccagccuggg

SEQ ID NO: 40346 - RNA, 32 nt, Human
acugagauugugccacugcacuccagccuggg

SEQ ID NO: 40347 - RNA, 32 nt, Human
acugagcaaucagcacaggccucuccucccaa

SEQ ID NO: 40348 - RNA, 32 nt, Human
acugagcacacagcaaugguaucaccuagaga

SEQ ID NO: 40349 - RNA, 32 nt, Human
acugagcaccgccaccauggggaaggggguug

SEQ ID NO: 40350 - RNA, 20 nt, Human
acugagcaccugcugggcug

SEQ ID NO: 40351 - RNA, 32 nt, Human
acugagcaccugcugggcugagcuucuaccua

SEQ ID NO: 40352 - RNA, 32 nt, Human
acugagcaccuguccuccgccucggccucugc

SEQ ID NO: 40353 - RNA, 32 nt, Human
acugagcaccuuaucuugccaccuuagccuua

SEQ ID NO: 40354 - RNA, 32 nt, Human
acugagcacgguagggcagccuggugagaggg

SEQ ID NO: 40355 - RNA, 32 nt, Human
acugagcagcgggaacugggggcucugcucau

SEQ ID NO: 40356 - RNA, 32 nt, Human
acugagcagcuggaagcacacuggcuaucugc

SEQ ID NO: 40357 - RNA, 32 nt, Human
acugagcaggaagaggauggaucaacaagggu

SEQ ID NO: 40358 - RNA, 32 nt, Human
acugagcaggguggcaaaauggaaaaggaaca

SEQ ID NO: 40359 - RNA, 32 nt, Human
acugagcagggugggaccagaggauaccucug

SEQ ID NO: 40360 - RNA, 22 nt, Human
acugagcaucaugccuggcaca

SEQ ID NO: 40361 - RNA, 32 nt, Human
acugagcauguggcuuucuauuucuauggaaa

SEQ ID NO: 40362 - RNA, 32 nt, Human
acugagccaaggaauacaaagauagcuaacac

SEQ ID NO: 40363 - RNA, 32 nt, Human
acugagccaaugacuuuaccagcugcugacua

SEQ ID NO: 40364 - RNA, 32 nt, Human
acugagccacagccugggccucccgggaggga

SEQ ID NO: 40365 - RNA, 32 nt, Human
acugagccacaggucccugaagaguccgcaga

SEQ ID NO: 40366 - RNA, 32 nt, Human
acugagccacagugaugcaugcuuuucgggga

SEQ ID NO: 40367 - RNA, 31 nt, Human
acugagccacccaaggagguggggacugcuc

SEQ ID NO: 40368 - RNA, 21 nt, Human
acugagccaccccagcauccu

SEQ ID NO: 40369 - RNA, 22 nt, Human
acugagccacgaucacaccauu

SEQ ID NO: 40370 - RNA, 32 nt, Human
acugagccacugcacuccagccugggcaauag

SEQ ID NO: 40371 - RNA, 21 nt, Human
acugagccgagaucacaccac

SEQ ID NO: 40372 - RNA, 32 nt, Human
acugagccgugcagcugggauuugaaccaggc

SEQ ID NO: 40373 - RNA, 32 nt, Human
acugagccuccagaugguagugaauggucucu

SEQ ID NO: 40374 - RNA, 32 nt, Human
acugagccuuucucccauugguagcuugcucu

SEQ ID NO: 40375 - RNA, 32 nt, Human
acugagcgccauggcccugccucugcugccgg

SEQ ID NO: 40376 - RNA, 32 nt, Human
acugagcgguaaugucauuagaucagauacaa

SEQ ID NO: 40377 - RNA, 32 nt, Human
acugagcuauugaaggccuuacuuuccagauc

SEQ ID NO: 40378 - RNA, 32 nt, Human
acugagcuccauaacacaagagaggcucugaa

SEQ ID NO: 40379 - RNA, 32 nt, Human
acugagcuccuuuguuccucccccuccagccu

SEQ ID NO: 40380 - RNA, 32 nt, Human
acugagcugacaguaaagcugcagugauugag

SEQ ID NO: 40381 - RNA, 32 nt, Human
acugagcugagcuguggcaugugggguccgag

SEQ ID NO: 40382 - RNA, 28 nt, Human
acugagcugagugcugcccuuuauuaaa

SEQ ID NO: 40383 - RNA, 32 nt, Human
acugagcugccuccugucucuccacucuggag

SEQ ID NO: 40384 - RNA, 32 nt, Human
acugagcugcuaaaauaaaccuguuuaagaga

SEQ ID NO: 40385 - RNA, 32 nt, Human
acugagcugggcaggacacaggcgagcucagg

SEQ ID NO: 40386 - RNA, 32 nt, Human
acugagcugucuucaguggaagcccgaggcag

SEQ ID NO: 40387 - RNA, 22 nt, Human
acugagcugugaucacaccacu

SEQ ID NO: 40388 - RNA, 32 nt, Human
acugagcuuccucuccccaggacccgcauggg

SEQ ID NO: 40389 - RNA, 32 nt, Human
acugagcuucuuucuccucccuuaguacauuc

SEQ ID NO: 40390 - RNA, 32 nt, Human
acugagcuuggaagaggaucuugcuguccugg

SEQ ID NO: 40391 - RNA, 32 nt, Human
acugaggaaaaccagaggaagccuguguagau

SEQ ID NO: 40392 - RNA, 25 nt, Human
acugaggaaagcagagggguuccug

SEQ ID NO: 40393 - RNA, 32 nt, Human
acugaggaaccaugcagauugugcccaagagu

SEQ ID NO: 40394 - RNA, 32 nt, Human
acugaggaauguugaagauugcagugauggaa

SEQ ID NO: 40395 - RNA, 32 nt, Human
acugaggacacaggcacccaggauaaggacaa

SEQ ID NO: 40396 - RNA, 32 nt, Human
acugaggacccggugccggaggccgugggcgg

SEQ ID NO: 40397 - RNA, 32 nt, Human
acugaggacccugcuacuccccaagccagagc

SEQ ID NO: 40398 - RNA, 32 nt, Human
acugaggacugagucugucacuagaggacuug

SEQ ID NO: 40399 - RNA, 22 nt, Human
acugaggagacaacgcccacca

SEQ ID NO: 40400 - RNA, 32 nt, Human
acugaggagacuggagcaaaauucagcuugaa

SEQ ID NO: 40401 - RNA, 32 nt, Human
acugaggagaugaagguuacagugagccaagu

SEQ ID NO: 40402 - RNA, 32 nt, Human
acugaggagcacagagcagagagcagacucug

SEQ ID NO: 40403 - RNA, 32 nt, Human
acugaggagcgcagagcagagagcagacucug

SEQ ID NO: 40404 - RNA, 32 nt, Human
acugaggaggccuuuguucagcaaagaaaccu

SEQ ID NO: 40405 - RNA, 32 nt, Human
acugaggaggcugacggaggaggaucacuuga

SEQ ID NO: 40406 - RNA, 32 nt, Human
acugaggaggcugaggcaggagaaucacuuga

SEQ ID NO: 40407 - RNA, 32 nt, Human
acugaggaggcugaggugggaggauugcuuga

SEQ ID NO: 40408 - RNA, 32 nt, Human
acugaggagguggagguugcagugagccgaga

SEQ ID NO: 40409 - RNA, 32 nt, Human
acugaggaguugagcaaaucuguucuauucug

SEQ ID NO: 40410 - RNA, 32 nt, Human
acugaggaugaaacugacuuuugucuuuugga

SEQ ID NO: 40411 - RNA, 32 nt, Human
acugaggauggagagaaagaagaugagucugg

SEQ ID NO: 40412 - RNA, 19 nt, Human
acugaggcaauggaugcug

SEQ ID NO: 40413 - RNA, 32 nt, Human
acugaggcaccaauggcugagcaggaagggcg

SEQ ID NO: 40414 - RNA, 18 nt, Human
acugaggcagagcaaggu

SEQ ID NO: 40415 - RNA, 32 nt, Human
acugaggcaggcggagcugcuaagagccugcu

SEQ ID NO: 40416 - RNA, 32 nt, Human
acugaggcagggaguuggcucucuugguggag

SEQ ID NO: 40417 - RNA, 32 nt, Human
acugaggccacugcacccuuucucggggaaga

SEQ ID NO: 40418 - RNA, 32 nt, Human
acugaggccagcauggcugggcccaggaugcu

SEQ ID NO: 40419 - RNA, 32 nt, Human
acugaggcccagaauugcuaaguggcuugcuu

SEQ ID NO: 40420 - RNA, 32 nt, Human
acugaggcccagagcggggaaguggcuugcuc

SEQ ID NO: 40421 - RNA, 23 nt, Human
acugaggccgaaagugccugcca

SEQ ID NO: 40422 - RNA, 32 nt, Human
acugaggccuggagaaguggaaucacuggccu

SEQ ID NO: 40423 - RNA, 32 nt, Human
acugaggcuacagcugcuaucacaugccgaac

SEQ ID NO: 40424 - RNA, 32 nt, Human
acugaggcucagagaaaugacauaacucagcu

SEQ ID NO: 40425 - RNA, 32 nt, Human
acugaggcucagauaaguccaaaugaaaugaa

SEQ ID NO: 40426 - RNA, 32 nt, Human
acugaggcugcuuuuuaguuggugcuaaccua

SEQ ID NO: 40427 - RNA, 32 nt, Human
acugaggcuggccgagccacacugucucccca

SEQ ID NO: 40428 - RNA, 32 nt, Human
acugagggagccagaggaguccuguaggcagg

SEQ ID NO: 40429 - RNA, 30 nt, Human
acugagggagcuuguacagaaagaauuaaa

SEQ ID NO: 40430 - RNA, 32 nt, Human
acugagggcagggaucacagggccagguuuuu

SEQ ID NO: 40431 - RNA, 32 nt, Human
acugagggcaguccuguggcugaggggcacag

SEQ ID NO: 40432 - RNA, 32 nt, Human
acugagggcucuggacgggcuccaggaacccu

SEQ ID NO: 40433 - RNA, 32 nt, Human
acugaggggauucucuacugccaagccccugc

SEQ ID NO: 40434 - RNA, 32 nt, Human
acugaggggcaggcuacuggggugggguagcu

SEQ ID NO: 40435 - RNA, 32 nt, Human
acugaggggcucagggugaggguugccuauug

SEQ ID NO: 40436 - RNA, 32 nt, Human
acugaggggcugggcacccaacccuuuuccac

SEQ ID NO: 40437 - RNA, 32 nt, Human
acugagggggcagaggcaguggcucuuuagaa

SEQ ID NO: 40438 - RNA, 32 nt, Human
acugagggggccugaagcuacaugcaccuccc

SEQ ID NO: 40439 - RNA, 32 nt, Human
acugagggggcuggaggcgaagggugggagca

SEQ ID NO: 40440 - RNA, 32 nt, Human
acugaggguaggggacagggaggcucaggacg

SEQ ID NO: 40441 - RNA, 32 nt, Human
acugaggguggugggaggggaucaccuggguu

SEQ ID NO: 40442 - RNA, 32 nt, Human
acugaggguugagacaaaacuuuaaggauaca

SEQ ID NO: 40443 - RNA, 32 nt, Human
acugagguacaggcacguucaccacaguccca

SEQ ID NO: 40444 - RNA, 32 nt, Human
acugagguauggagccuccaucaucaugcucu

SEQ ID NO: 40445 - RNA, 32 nt, Human
acugaggucucgaacugccgaccucaggcugu

SEQ ID NO: 40446 - RNA, 32 nt, Human
acugaggugcagcagauggcagugguaaccaa

SEQ ID NO: 40447 - RNA, 32 nt, Human
acugaggugccccacagcagcagguguugagc

SEQ ID NO: 40448 - RNA, 32 nt, Human
acugaggugcuggcuagcucaugugugaauuc

SEQ ID NO: 40449 - RNA, 32 nt, Human
acugagguguuuguuuguuuguuaggcagugc

SEQ ID NO: 40450 - RNA, 32 nt, Human
acugagguuucuguucaaacugugaguucugu

SEQ ID NO: 40451 - RNA, 32 nt, Human
acugaguagacaggacuggaaauccauucucu

SEQ ID NO: 40452 - RNA, 32 nt, Human
acugagucaccacaccccucuccccugaucaa

SEQ ID NO: 40453 - RNA, 32 nt, Human
acugagucagaaacuggggauguggcccaggc

SEQ ID NO: 40454 - RNA, 32 nt, Human
acugagucauaauaaauaugugcugaaccguu

SEQ ID NO: 40455 - RNA, 32 nt, Human
acugaguccacucacucgaagaaugucaguac

SEQ ID NO: 40456 - RNA, 32 nt, Human
acugaguccccaguccugucccuucccugacu

SEQ ID NO: 40457 - RNA, 22 nt, Human
acugaguccccuaccagccccu

SEQ ID NO: 40458 - RNA, 32 nt, Human
acugagucggccggaagaagauaaagaaaaca

SEQ ID NO: 40459 - RNA, 32 nt, Human
acugagucucugaggggcuaccaggaaagcgc

SEQ ID NO: 40460 - RNA, 32 nt, Human
acugagugaaacuugcccucuggcuugauuca

SEQ ID NO: 40461 - RNA, 32 nt, Human
acugagugacaucaguuagagagguuaccuca

SEQ ID NO: 40462 - RNA, 32 nt, Human
acugagugagccuuuugcaggaaaaggcuaag

SEQ ID NO: 40463 - RNA, 32 nt, Human
acugagugcugggagugaguugguaauaugag

SEQ ID NO: 40464 - RNA, 32 nt, Human
acugagugcugggauccaaggcauucuacagg

SEQ ID NO: 40465 - RNA, 32 nt, Human
acugaguggggaaaggaguuacacccgugagu

SEQ ID NO: 40466 - RNA, 32 nt, Human
acugagugucggcaucagcacugagcuagaca

SEQ ID NO: 40467 - RNA, 32 nt, Human
acugagugugcacugguagaugccguuucuuc

SEQ ID NO: 40468 - RNA, 32 nt, Human
acugaguuacuaaacaacagacuccaugcuga

SEQ ID NO: 40469 - RNA, 32 nt, Human
acugaguuccagugauaugacaggcuuucaau

SEQ ID NO: 40470 - RNA, 32 nt, Human
acugaguugcgggggccuuggagaccuccagg

SEQ ID NO: 40471 - RNA, 32 nt, Human
acugaguugcgugucuguaaaugucugcgcag

SEQ ID NO: 40472 - RNA, 32 nt, Human
acugaguugcugguugacugaggccagucacu

SEQ ID NO: 40473 - RNA, 32 nt, Human
acugaguuucgcucuugucauccuggcuggag

SEQ ID NO: 40474 - RNA, 32 nt, Human
acugauaaaauacucuagccugggccagagaa

SEQ ID NO: 40475 - RNA, 32 nt, Human
acugauaaaaucugaaaguaacucugacauag

SEQ ID NO: 40476 - RNA, 32 nt, Human
acugauaagcggccacuuuaggaguguagcaa

SEQ ID NO: 40477 - RNA, 32 nt, Human
acugauaauaagcuuugaauggugcuaauaag

SEQ ID NO: 40478 - RNA, 32 nt, Human
acugauaaucagcuuuauuuuacaaaagaguu

SEQ ID NO: 40479 - RNA, 32 nt, Human
acugauaaucuagccauuuauuagacuuuaag

SEQ ID NO: 40480 - RNA, 32 nt, Human
acugauacauuccaagcauacaugcacacuga

SEQ ID NO: 40481 - RNA, 32 nt, Human
acugauaccaccugcgugucccuuccuccccg

SEQ ID NO: 40482 - RNA, 32 nt, Human
acugauaccauguuggcagcaacagauguugg

SEQ ID NO: 40483 - RNA, 23 nt, Human
acugauaggaauacauuucuuca

SEQ ID NO: 40484 - RNA, 32 nt, Human
acugauagggacaggaaggaaaggaggauuag

SEQ ID NO: 40485 - RNA, 32 nt, Human
acugauaguuucuuucuuucauaucacaugua

SEQ ID NO: 40486 - RNA, 32 nt, Human
acugauauucugguuagcagggccaggacaag

SEQ ID NO: 40487 - RNA, 32 nt, Human
acugaucaaauacauuagcuucaucagaugaa

SEQ ID NO: 40488 - RNA, 32 nt, Human
acugaucacagauucuuucccaccucacaauc

SEQ ID NO: 40489 - RNA, 32 nt, Human
acugaucacccauggcugccucuccuauuauc

SEQ ID NO: 40490 - RNA, 32 nt, Human
acugaucacucucaucaguggcagauuuuggu

SEQ ID NO: 40491 - RNA, 27 nt, Human
acugaucacugcagccuccacuuccca

SEQ ID NO: 40492 - RNA, 32 nt, Human
acugaucacuuaccuucuucucuuucagacuu

SEQ ID NO: 40493 - RNA, 19 nt, Human
acugaucagcagacuggga

SEQ ID NO: 40494 - RNA, 32 nt, Human
acugaucaguucucugaaaauauuuccaaaau

SEQ ID NO: 40495 - RNA, 32 nt, Human
acugaucauaccacugcacuccagucugggca

SEQ ID NO: 40496 - RNA, 19 nt, Human
acugaucauccgcgggaug

SEQ ID NO: 40497 - RNA, 32 nt, Human
acugaucauccucccuuucuccuuggcuugaa

SEQ ID NO: 40498 - RNA, 32 nt, Human
acugaucauggaaacucaccccaaaccuugaa

SEQ ID NO: 40499 - RNA, 32 nt, Human
acugaucauucaugggaaauggucaaaagaca

SEQ ID NO: 40500 - RNA, 32 nt, Human
acugauccagcaguuccacuccuggguaugua

SEQ ID NO: 40501 - RNA, 32 nt, Human
acugauccucccucccugucaacuccuaaucu

SEQ ID NO: 40502 - RNA, 32 nt, Human
acugauccucgaggccuccugccguggcuggg

SEQ ID NO: 40503 - RNA, 23 nt, Human
acugauccuuauuuugcugggau

SEQ ID NO: 40504 - RNA, 32 nt, Human
acugaucucacagaugaggagagagaagaaac

SEQ ID NO: 40505 - RNA, 32 nt, Human
acugaucucuccucccacccuacauucucuug

SEQ ID NO: 40506 - RNA, 32 nt, Human
acugaucugagccuuguucugcccuuccacuu

SEQ ID NO: 40507 - RNA, 32 nt, Human
acugaucugauaaugucaacuuuugaaaacag

SEQ ID NO: 40508 - RNA, 32 nt, Human
acugaucugcacuaaugugggcaaacagaggg

SEQ ID NO: 40509 - RNA, 32 nt, Human
acugaucugcuugacagacgugggaucucagu

SEQ ID NO: 40510 - RNA, 32 nt, Human
acugaucuuccuauuugagucucuugagacaa

SEQ ID NO: 40511 - RNA, 32 nt, Human
acugaucuuggguuuccuauucugccuccccu

SEQ ID NO: 40512 - RNA, 32 nt, Human
acugaugaaauggcacagcauaacauuuaauu

SEQ ID NO: 40513 - RNA, 32 nt, Human
acugaugaaggcagacaguaggagguuggcag

SEQ ID NO: 40514 - RNA, 32 nt, Human
acugaugaauauagggcccagauggaccaagu

SEQ ID NO: 40515 - RNA, 32 nt, Human
acugaugacccacccaggcugaccaggccagc

SEQ ID NO: 40516 - RNA, 32 nt, Human
acugaugaggucuuaacaaaaaccaguguggc

SEQ ID NO: 40517 - RNA, 32 nt, Human
acugaugauucugagcugugcuucuucaagua

SEQ ID NO: 40518 - RNA, 32 nt, Human
acugaugcagggguauacuugcccucacuugc

SEQ ID NO: 40519 - RNA, 32 nt, Human
acugaugccagcugccccugaggaugccagua

SEQ ID NO: 40520 - RNA, 21 nt, Human
acugaugccauaccugggaug

SEQ ID NO: 40521 - RNA, 32 nt, Human
acugaugccccagggaaguaugcauuagccuu

SEQ ID NO: 40522 - RNA, 32 nt, Human
acugaugccccagggauucccaccccacuucu

SEQ ID NO: 40523 - RNA, 32 nt, Human
acugaugccuguaaucccaacacuuuguuggg

SEQ ID NO: 40524 - RNA, 32 nt, Human
acugaugcugccauuugcccagccucuuccau

SEQ ID NO: 40525 - RNA, 29 nt, Human
acugaugcuggaugacaacagacucucca

SEQ ID NO: 40526 - RNA, 32 nt, Human
acugauggaagcacacaaguggagagaaguug

SEQ ID NO: 40527 - RNA, 29 nt, Human
acugauggacaggcucaagagauucagag

SEQ ID NO: 40528 - RNA, 32 nt, Human
acugauggagugaaauccccaggagaugcaga

SEQ ID NO: 40529 - RNA, 32 nt, Human
acugauggaguggcacaaauucccagugucug

SEQ ID NO: 40530 - RNA, 32 nt, Human
acugauggcaugugccuguaaucccagcuucu

SEQ ID NO: 40531 - RNA, 29 nt, Human
acugauggccuccugggguggagaaaagc

SEQ ID NO: 40532 - RNA, 32 nt, Human
acugauggccuguccuggaugccaggcacuug

SEQ ID NO: 40533 - RNA, 32 nt, Human
acugaugggaaagggaaggcuggcagcaguga

SEQ ID NO: 40534 - RNA, 32 nt, Human
acugaugggaccagggaagugggauggggcca

SEQ ID NO: 40535 - RNA, 32 nt, Human
acugaugggcuucugccccugcccuuccucac

SEQ ID NO: 40536 - RNA, 32 nt, Human
acugaugucccugugaacaccugcacuaugag

SEQ ID NO: 40537 - RNA, 32 nt, Human
acugaugugugaaugacauugcagugagcuag

SEQ ID NO: 40538 - RNA, 32 nt, Human
acugauguuuacucucugggcacuguuguaag

SEQ ID NO: 40539 - RNA, 32 nt, Human
acugauuacauacccaaaggcucuuuucagag

SEQ ID NO: 40540 - RNA, 32 nt, Human
acugauuagggaggggauuugcacagggaggu

SEQ ID NO: 40541 - RNA, 32 nt, Human
acugauuauuaaaaugacauguauuuaucaga

SEQ ID NO: 40542 - RNA, 32 nt, Human
acugauucaaucugcaugccagccuggaggag

SEQ ID NO: 40543 - RNA, 32 nt, Human
acugauucagaaacugacuuggggaaggaauu

SEQ ID NO: 40544 - RNA, 32 nt, Human
acugauucagcccuuugugguuugcaguccug

SEQ ID NO: 40545 - RNA, 32 nt, Human
acugauucccuccaggcauaaauguucaaucu

SEQ ID NO: 40546 - RNA, 32 nt, Human
acugauucucucuuguccuucacaucaccauu

SEQ ID NO: 40547 - RNA, 32 nt, Human
acugauucugccaccauauagugaacacgauu

SEQ ID NO: 40548 - RNA, 32 nt, Human
acugauucuguguaacuuacuauuuuuccagg

SEQ ID NO: 40549 - RNA, 32 nt, Human
acugauucuuacccagcccuggucaagaaucu

SEQ ID NO: 40550 - RNA, 32 nt, Human
acugauugcauuccagccugggugacagagcu

SEQ ID NO: 40551 - RNA, 32 nt, Human
acugauuggcacuuaagcuuuuucugauuguu

SEQ ID NO: 40552 - RNA, 32 nt, Human
acugauugggcuucauacuuuaugcuggcugu

SEQ ID NO: 40553 - RNA, 32 nt, Human
acugauugugcugucucccucucccacccgug

SEQ ID NO: 40554 - RNA, 18 nt, Human
acugauuguuuucacuga

SEQ ID NO: 40555 - RNA, 32 nt, Human
acugauuuccccuggccacccucucaccuaau

SEQ ID NO: 40556 - RNA, 24 nt, Human
acugauuucuggguuucugccacg

SEQ ID NO: 40557 - RNA, 32 nt, Human
acugauuugcacucuugguucuuuggagccuu

SEQ ID NO: 40558 - RNA, 32 nt, Human
acugauuugcuucccuuccugccauggcugga

SEQ ID NO: 40559 - RNA, 32 nt, Human
acugauuugggcugaauguauguaaauagguu

SEQ ID NO: 40560 - RNA, 32 nt, Human
acugauuuuaaucugacuaugacacugagcau

SEQ ID NO: 40561 - RNA, 32 nt, Human
acugauuuuguagagcugcugggagaaccgga

SEQ ID NO: 40562 - RNA, 32 nt, Human
acugcaaaaacucaaaaauuagccaggcgugc

SEQ ID NO: 40563 - RNA, 32 nt, Human
acugcaaaaauagaacguagcaaaauggcuuc

SEQ ID NO: 40564 - RNA, 32 nt, Human
acugcaaaacacaagcuggagaguuuuaggua

SEQ ID NO: 40565 - RNA, 24 nt, Human
acugcaaaaucugccucccggguu

SEQ ID NO: 40566 - RNA, 32 nt, Human
acugcaaaauguguccugucuaaaaaugauuc

SEQ ID NO: 40567 - RNA, 23 nt, Human
acugcaaacccgccucccagguu

SEQ ID NO: 40568 - RNA, 22 nt, Human
acugcaaaccgccucccggguu

SEQ ID NO: 40569 - RNA, 32 nt, Human
acugcaaacucauaccuucccuaucacaauca

SEQ ID NO: 40570 - RNA, 24 nt, Human
acugcaaacuccgccucccagguu

SEQ ID NO: 40571 - RNA, 24 nt, Human
acugcaaacuccgccucccggguu

SEQ ID NO: 40572 - RNA, 24 nt, Human
acugcaaacuccgccuuccagguu

SEQ ID NO: 40573 - RNA, 24 nt, Human
acugcaaacuccgcuuccuggguu

SEQ ID NO: 40574 - RNA, 20 nt, Human
acugcaaacucuuucucuua

SEQ ID NO: 40575 - RNA, 25 nt, Human
acugcaaacuggauuaguucuuuua

SEQ ID NO: 40576 - RNA, 32 nt, Human
acugcaaagcaguuugaugacacuguuuuaau

SEQ ID NO: 40577 - RNA, 32 nt, Human
acugcaaaggaaagagagagaaaacaagcaaa

SEQ ID NO: 40578 - RNA, 32 nt, Human
acugcaaaggcugugguggcugugaggacacu

SEQ ID NO: 40579 - RNA, 25 nt, Human
acugcaaaucuccgccucccagguu

SEQ ID NO: 40580 - RNA, 32 nt, Human
acugcaaauguccccuugauggggaauccgug

SEQ ID NO: 40581 - RNA, 32 nt, Human
acugcaacaauucagugccaggaaaggagcau

SEQ ID NO: 40582 - RNA, 32 nt, Human
acugcaacacaaagcuccaccaggaggcuggu

SEQ ID NO: 40583 - RNA, 32 nt, Human
acugcaacacaugcaggcagcuauuuggggau

SEQ ID NO: 40584 - RNA, 24 nt, Human
acugcaacauccgccucccggguu

SEQ ID NO: 40585 - RNA, 24 nt, Human
acugcaacccccacaucccggguu

SEQ ID NO: 40586 - RNA, 24 nt, Human
acugcaacccccaucucccagguu

SEQ ID NO: 40587 - RNA, 24 nt, Human
acugcaacccccgccccccggguu

SEQ ID NO: 40588 - RNA, 24 nt, Human
acugcaacccccgccucccggguu

SEQ ID NO: 40589 - RNA, 23 nt, Human
acugcaaccccgccucccagguu

SEQ ID NO: 40590 - RNA, 23 nt, Human
acugcaacccucccucccggguu

SEQ ID NO: 40591 - RNA, 19 nt, Human
acugcaaccucaaccuucu

SEQ ID NO: 40592 - RNA, 23 nt, Human
acugcaaccucaccucccggguu

SEQ ID NO: 40593 - RNA, 19 nt, Human
acugcaaccucagccuccu

SEQ ID NO: 40594 - RNA, 24 nt, Human
acugcaaccuccaccucacagguu

SEQ ID NO: 40595 - RNA, 24 nt, Human
acugcaaccuccaccuccaggguu

SEQ ID NO: 40596 - RNA, 23 nt, Human
acugcaaccuccaccuccagguu

SEQ ID NO: 40597 - RNA, 22 nt, Human
acugcaaccuccaccucccagg

SEQ ID NO: 40598 - RNA, 23 nt, Human
acugcaaccuccaccucccaggu

SEQ ID NO: 40599 - RNA, 24 nt, Human
acugcaaccuccaccucccagguu

SEQ ID NO: 40600 - RNA, 25 nt, Human
acugcaaccuccaccuccccggguu

SEQ ID NO: 40601 - RNA, 24 nt, Human
acugcaaccuccaccucccgaguu

SEQ ID NO: 40602 - RNA, 21 nt, Human
acugcaaccuccaccucccgg

SEQ ID NO: 40603 - RNA, 22 nt, Human
acugcaaccuccaccucccggg

SEQ ID NO: 40604 - RNA, 23 nt, Human
acugcaaccuccaccucccgggu

SEQ ID NO: 40605 - RNA, 24 nt, Human
acugcaaccuccaccucccggguu

SEQ ID NO: 40606 - RNA, 24 nt, Human
acugcaaccuccaccucccugguu

SEQ ID NO: 40607 - RNA, 23 nt, Human
acugcaaccuccaccuccggguu

SEQ ID NO: 40608 - RNA, 19 nt, Human
acugcaaccuccaccuccu

SEQ ID NO: 40609 - RNA, 24 nt, Human
acugcaaccuccaccuccuagguu

SEQ ID NO: 40610 - RNA, 24 nt, Human
acugcaaccuccaccuccugaguu

SEQ ID NO: 40611 - RNA, 21 nt, Human
acugcaaccuccaccuccugg

SEQ ID NO: 40612 - RNA, 22 nt, Human
acugcaaccuccaccuccuggg

SEQ ID NO: 40613 - RNA, 24 nt, Human
acugcaaccuccaccuccuggguu

SEQ ID NO: 40614 - RNA, 24 nt, Human
acugcaaccuccaccucgcagguu

SEQ ID NO: 40615 - RNA, 24 nt, Human
acugcaaccuccaccucgcggguu

SEQ ID NO: 40616 - RNA, 24 nt, Human
acugcaaccuccaccucucagguu

SEQ ID NO: 40617 - RNA, 24 nt, Human
acugcaaccuccacuucccagguu

SEQ ID NO: 40618 - RNA, 32 nt, Human
acugcaaccuccgccucacagcuucaagauuc

SEQ ID NO: 40619 - RNA, 24 nt, Human
acugcaaccuccgccucccagguu

SEQ ID NO: 40620 - RNA, 24 nt, Human
acugcaaccuccgccucccgaguu

SEQ ID NO: 40621 - RNA, 22 nt, Human
acugcaaccuccgccucccggg

SEQ ID NO: 40622 - RNA, 24 nt, Human
acugcaaccuccgccucccggguu

SEQ ID NO: 40623 - RNA, 24 nt, Human
acugcaaccuccuccucccggguu

SEQ ID NO: 40624 - RNA, 24 nt, Human
acugcaaccucuaccucccagguu

SEQ ID NO: 40625 - RNA, 21 nt, Human
acugcaaccucugcccucccg

SEQ ID NO: 40626 - RNA, 32 nt, Human
acugcaaccucuuccuccugguucaagcgauu

SEQ ID NO: 40627 - RNA, 32 nt, Human
acugcaaccugacacaaugcucagaaacagaa

SEQ ID NO: 40628 - RNA, 32 nt, Human
acugcaaccugacagaugagacacauggacuc

SEQ ID NO: 40629 - RNA, 32 nt, Human
acugcaaccugacaggaugcucagacaagaau

SEQ ID NO: 40630 - RNA, 23 nt, Human
acugcaaccuucaccuccagguu

SEQ ID NO: 40631 - RNA, 24 nt, Human
acugcaaccuucgccucccagguu

SEQ ID NO: 40632 - RNA, 24 nt, Human
acugcaaccuucgccucccgaguu

SEQ ID NO: 40633 - RNA, 24 nt, Human
acugcaacguccgccucccagguu

SEQ ID NO: 40634 - RNA, 24 nt, Human
acugcaacguccgccucccggguu

SEQ ID NO: 40635 - RNA, 23 nt, Human
acugcaacuccaccucccggguu

SEQ ID NO: 40636 - RNA, 32 nt, Human
acugcaacucuacaaaaauacaaaaauuagcc

SEQ ID NO: 40637 - RNA, 23 nt, Human
acugcaacucugugaagcagggu

SEQ ID NO: 40638 - RNA, 24 nt, Human
acugcaacuuccaccucccagguu

SEQ ID NO: 40639 - RNA, 24 nt, Human
acugcaacuuccaccucccggguu

SEQ ID NO: 40640 - RNA, 24 nt, Human
acugcaacuuccaccuccuggguu

SEQ ID NO: 40641 - RNA, 24 nt, Human
acugcaacuuccacuucccggguu

SEQ ID NO: 40642 - RNA, 32 nt, Human
acugcaacuucugccucccaugcuuacgugau

SEQ ID NO: 40643 - RNA, 32 nt, Human
acugcaacuucuguauccuuccuuccccucca

SEQ ID NO: 40644 - RNA, 32 nt, Human
acugcaacuugccuuuuccauuacagaaauuu

SEQ ID NO: 40645 - RNA, 24 nt, Human
acugcaacuugcgccucccggguu

SEQ ID NO: 40646 - RNA, 32 nt, Human
acugcaagaagaggcgggauacuuucagcuuu

SEQ ID NO: 40647 - RNA, 24 nt, Human
acugcaagauccgccucccggguu

SEQ ID NO: 40648 - RNA, 24 nt, Human
acugcaagccccaccuucugaguu

SEQ ID NO: 40649 - RNA, 24 nt, Human
acugcaagcccugccuccuggguu

SEQ ID NO: 40650 - RNA, 24 nt, Human
acugcaagcuccaacucccggguu

SEQ ID NO: 40651 - RNA, 24 nt, Human
acugcaagcuccaccucccagguu

SEQ ID NO: 40652 - RNA, 24 nt, Human
acugcaagcuccaccucccggguu

SEQ ID NO: 40653 - RNA, 24 nt, Human
acugcaagcuccaccuccuggguu

SEQ ID NO: 40654 - RNA, 24 nt, Human
acugcaagcuccacuuccuggguu

SEQ ID NO: 40655 - RNA, 24 nt, Human
acugcaagcuccaucucccagguu

SEQ ID NO: 40656 - RNA, 22 nt, Human
acugcaagcuccgccucccagg

SEQ ID NO: 40657 - RNA, 24 nt, Human
acugcaagcuccgccucccagguu

SEQ ID NO: 40658 - RNA, 24 nt, Human
acugcaagcuccgccucccgaguu

SEQ ID NO: 40659 - RNA, 24 nt, Human
acugcaagcuccgccucccggguu

SEQ ID NO: 40660 - RNA, 24 nt, Human
acugcaagcuccgccuccgggguu

SEQ ID NO: 40661 - RNA, 24 nt, Human
acugcaagcuccgccuccuggguu

SEQ ID NO: 40662 - RNA, 24 nt, Human
acugcaagcuccgccucucggguu

SEQ ID NO: 40663 - RNA, 24 nt, Human
acugcaagcuccggcucccagguu

SEQ ID NO: 40664 - RNA, 24 nt, Human
acugcaagcucggccuccuggguu

SEQ ID NO: 40665 - RNA, 26 nt, Human
acugcaagcucugcccuccccggguu

SEQ ID NO: 40666 - RNA, 24 nt, Human
acugcaagcucugccucccagguu

SEQ ID NO: 40667 - RNA, 22 nt, Human
acugcaagcucugccucccggg

SEQ ID NO: 40668 - RNA, 24 nt, Human
acugcaagcucugccucccggguu

SEQ ID NO: 40669 - RNA, 24 nt, Human
acugcaagcucugccucccguguu

SEQ ID NO: 40670 - RNA, 24 nt, Human
acugcaagcucugccuccuggguu

SEQ ID NO: 40671 - RNA, 24 nt, Human
acugcaagcucugccucucagguu

SEQ ID NO: 40672 - RNA, 24 nt, Human
acugcaagcucugcguccuggguu

SEQ ID NO: 40673 - RNA, 24 nt, Human
acugcaagcucugcuucccagguu

SEQ ID NO: 40674 - RNA, 24 nt, Human
acugcaagcucugcuuccuggguu

SEQ ID NO: 40675 - RNA, 24 nt, Human
acugcaagcuuccccuuccggguu

SEQ ID NO: 40676 - RNA, 24 nt, Human
acugcaagcuucgccucccggguu

SEQ ID NO: 40677 - RNA, 18 nt, Human
acugcaaggagcagggug

SEQ ID NO: 40678 - RNA, 32 nt, Human
acugcaaggcugggacugggaggcagagccgc

SEQ ID NO: 40679 - RNA, 32 nt, Human
acugcaaguggaaugaggcaggaagcagaaac

SEQ ID NO: 40680 - RNA, 24 nt, Human
acugcaaguuccgccucccggguu

SEQ ID NO: 40681 - RNA, 21 nt, Human
acugcaauaaacauacaugug

SEQ ID NO: 40682 - RNA, 24 nt, Human
acugcaaucuccaccuccuggguu

SEQ ID NO: 40683 - RNA, 24 nt, Human
acugcaaucuccaucucccggguu

SEQ ID NO: 40684 - RNA, 24 nt, Human
acugcaaucuccgccucccagguu

SEQ ID NO: 40685 - RNA, 24 nt, Human
acugcaaucuccgccucccggguu

SEQ ID NO: 40686 - RNA, 32 nt, Human
acugcaaugauguucuuccuggaauucaugaa

SEQ ID NO: 40687 - RNA, 32 nt, Human
acugcacaaaaauaaaaauuccaagcugugga

SEQ ID NO: 40688 - RNA, 32 nt, Human
acugcacaaaggagaacuaguccuaagauccu

SEQ ID NO: 40689 - RNA, 32 nt, Human
acugcacacaagugccaugcuuugccaccacc

SEQ ID NO: 40690 - RNA, 32 nt, Human
acugcacacagggucccugaaauccacuuuua

SEQ ID NO: 40691 - RNA, 32 nt, Human
acugcacaccacugccucaugcuuccuggggc

SEQ ID NO: 40692 - RNA, 32 nt, Human
acugcacacucuggaccucaccugcagauaca

SEQ ID NO: 40693 - RNA, 32 nt, Human
acugcacacugcacuccauccugggcgacagu

SEQ ID NO: 40694 - RNA, 32 nt, Human
acugcacagagcaggagagccuguccugccuc

SEQ ID NO: 40695 - RNA, 22 nt, Human
acugcacagagcgcacaaggug

SEQ ID NO: 40696 - RNA, 32 nt, Human
acugcacagcgggcagaggcagaggaacacag

SEQ ID NO: 40697 - RNA, 19 nt, Human
acugcacaggugagcaagg

SEQ ID NO: 40698 - RNA, 32 nt, Human
acugcacauaugcaagccauuugcacucugga

SEQ ID NO: 40699 - RNA, 32 nt, Human
acugcaccacugcacuccacccugggcagagg

SEQ ID NO: 40700 - RNA, 32 nt, Human
acugcaccacugcacuccagccugggcaacaa

SEQ ID NO: 40701 - RNA, 32 nt, Human
acugcaccacugcacuucagccugggugacag

SEQ ID NO: 40702 - RNA, 32 nt, Human
acugcaccaucuggacaacagagcaagacucc

SEQ ID NO: 40703 - RNA, 32 nt, Human
acugcaccauugcauuccagccugggcaacaa

SEQ ID NO: 40704 - RNA, 32 nt, Human
acugcacccacugucaucaccuagaagacagg

SEQ ID NO: 40705 - RNA, 32 nt, Human
acugcacccagccugugucuuccagcucuaau

SEQ ID NO: 40706 - RNA, 32 nt, Human
acugcacccucaaccuccuggguucaagcaau

SEQ ID NO: 40707 - RNA, 32 nt, Human
acugcacccugguccucuccccaguccccagu

SEQ ID NO: 40708 - RNA, 32 nt, Human
acugcacccuuguccccacaagcagaagcaca

SEQ ID NO: 40709 - RNA, 21 nt, Human
acugcaccuccaccuuccggg

SEQ ID NO: 40710 - RNA, 23 nt, Human
acugcaccuccgccucccagguu

SEQ ID NO: 40711 - RNA, 31 nt, Human
acugcaccucugucucccaaguucaagugau

SEQ ID NO: 40712 - RNA, 32 nt, Human
acugcaccuuaaccugggcacugggagccugu

SEQ ID NO: 40713 - RNA, 32 nt, Human
acugcacgcacuccagccugggcgacagagcg

SEQ ID NO: 40714 - RNA, 32 nt, Human
acugcacgcacuccagccugggugacagagcg

SEQ ID NO: 40715 - RNA, 32 nt, Human
acugcacgcugcagcagggcccagggaguuga

SEQ ID NO: 40716 - RNA, 32 nt, Human
acugcacguaacacuccuccuuaggccuggag

SEQ ID NO: 40717 - RNA, 32 nt, Human
acugcacucaggcuggagugcagugguacgau

SEQ ID NO: 40718 - RNA, 20 nt, Human
acugcacuccaaccugggca

SEQ ID NO: 40719 - RNA, 32 nt, Human
acugcacuccagcacuccagccugggugacag

SEQ ID NO: 40720 - RNA, 32 nt, Human
acugcacuccagccagggcaacagugagacuc

SEQ ID NO: 40721 - RNA, 32 nt, Human
acugcacuccagccccagcugggugacagagu

SEQ ID NO: 40722 - RNA, 32 nt, Human
acugcacuccagccuaggcaacagagugagac

SEQ ID NO: 40723 - RNA, 32 nt, Human
acugcacuccagccuaggcgacagagugagac

SEQ ID NO: 40724 - RNA, 32 nt, Human
acugcacuccagccuaggugacagagugagac

SEQ ID NO: 40725 - RNA, 32 nt, Human
acugcacuccagccugccuggaugacagagcg

SEQ ID NO: 40726 - RNA, 32 nt, Human
acugcacuccagccuggaaaacggagugagag

SEQ ID NO: 40727 - RNA, 32 nt, Human
acugcacuccagccuggacaacagagugagaa

SEQ ID NO: 40728 - RNA, 32 nt, Human
acugcacuccagccuggacaacagagugagac

SEQ ID NO: 40729 - RNA, 32 nt, Human
acugcacuccagccuggacaacggagugagac

SEQ ID NO: 40730 - RNA, 32 nt, Human
acugcacuccagccuggacgacagagugagac

SEQ ID NO: 40731 - RNA, 32 nt, Human
acugcacuccagccuggacgacagagugagau

SEQ ID NO: 40732 - RNA, 32 nt, Human
acugcacuccagccuggaggccagagugagac

SEQ ID NO: 40733 - RNA, 32 nt, Human
acugcacuccagccuggaugacagagugaaac

SEQ ID NO: 40734 - RNA, 32 nt, Human
acugcacuccagccuggaugacagagugagac

SEQ ID NO: 40735 - RNA, 32 nt, Human
acugcacuccagccuggccugggcaacagagc

SEQ ID NO: 40736 - RNA, 32 nt, Human
acugcacuccagccuggcgacaaagugagacu

SEQ ID NO: 40737 - RNA, 32 nt, Human
acugcacuccagccuggcgacacagugagacu

SEQ ID NO: 40738 - RNA, 32 nt, Human
acugcacuccagccuggcgacagagugagacu

SEQ ID NO: 40739 - RNA, 32 nt, Human
acugcacuccagccuggcuacagagugagauu

SEQ ID NO: 40740 - RNA, 32 nt, Human
acugcacuccagccuggcugacagugagacac

SEQ ID NO: 40741 - RNA, 20 nt, Human
acugcacuccagccugggca

SEQ ID NO: 40742 - RNA, 32 nt, Human
acugcacuccagccugggcaacaagugcgaaa

SEQ ID NO: 40743 - RNA, 32 nt, Human
acugcacuccagccugggcaacagagugaaac

SEQ ID NO: 40744 - RNA, 32 nt, Human
acugcacuccagccugggcaacagagugacac

SEQ ID NO: 40745 - RNA, 32 nt, Human
acugcacuccagccugggcaacagagugagac

SEQ ID NO: 40746 - RNA, 32 nt, Human
acugcacuccagccugggcaacagagugagau

SEQ ID NO: 40747 - RNA, 32 nt, Human
acugcacuccagccugggcaacagagugaggc

SEQ ID NO: 40748 - RNA, 32 nt, Human
acugcacuccagccugggcaacagaguggacu

SEQ ID NO: 40749 - RNA, 32 nt, Human
acugcacuccagccugggcaaccaggugagac

SEQ ID NO: 40750 - RNA, 32 nt, Human
acugcacuccagccugggcaacguggugagac

SEQ ID NO: 40751 - RNA, 32 nt, Human
acugcacuccagccugggcaauagagugagac

SEQ ID NO: 40752 - RNA, 32 nt, Human
acugcacuccagccugggcaauagagugagcc

SEQ ID NO: 40753 - RNA, 32 nt, Human
acugcacuccagccugggcaauggagugagac

SEQ ID NO: 40754 - RNA, 32 nt, Human
acugcacuccagccugggcagcagagugagac

SEQ ID NO: 40755 - RNA, 32 nt, Human
acugcacuccagccugggccacagagugagau

SEQ ID NO: 40756 - RNA, 32 nt, Human
acugcacuccagccugggcgacagagugacuc

SEQ ID NO: 40757 - RNA, 32 nt, Human
acugcacuccagccugggcgacagagugagac

SEQ ID NO: 40758 - RNA, 32 nt, Human
acugcacuccagccugggcgacagagugaggc

SEQ ID NO: 40759 - RNA, 32 nt, Human
acugcacuccagccugggcgacagcgugagau

SEQ ID NO: 40760 - RNA, 32 nt, Human
acugcacuccagccugggcgacgagugaaacu

SEQ ID NO: 40761 - RNA, 32 nt, Human
acugcacuccagccugggcgacggagugagac

SEQ ID NO: 40762 - RNA, 32 nt, Human
acugcacuccagccugggcgauggagugagac

SEQ ID NO: 40763 - RNA, 32 nt, Human
acugcacuccagccugggcgucagagugagaa

SEQ ID NO: 40764 - RNA, 32 nt, Human
acugcacuccagccugggcugcagggugaggu

SEQ ID NO: 40765 - RNA, 32 nt, Human
acugcacuccagccugggugacagaguaagac

SEQ ID NO: 40766 - RNA, 32 nt, Human
acugcacuccagccugggugacagaguaauac

SEQ ID NO: 40767 - RNA, 32 nt, Human
acugcacuccagccugggugacagaguaggac

SEQ ID NO: 40768 - RNA, 32 nt, Human
acugcacuccagccugggugacagagugagac

SEQ ID NO: 40769 - RNA, 32 nt, Human
acugcacuccagccugggugacagagugagau

SEQ ID NO: 40770 - RNA, 32 nt, Human
acugcacuccagccugggugacagagugaggc

SEQ ID NO: 40771 - RNA, 32 nt, Human
acugcacuccagccugggugacagagugagug

SEQ ID NO: 40772 - RNA, 32 nt, Human
acugcacuccagccugggugacagugugaaac

SEQ ID NO: 40773 - RNA, 32 nt, Human
acugcacuccagccugggugacggugagacuu

SEQ ID NO: 40774 - RNA, 32 nt, Human
acugcacuccagccugggugacugagugagac

SEQ ID NO: 40775 - RNA, 32 nt, Human
acugcacuccagccugggugauagagugagaa

SEQ ID NO: 40776 - RNA, 32 nt, Human
acugcacuccagccugggugauagagugagac

SEQ ID NO: 40777 - RNA, 32 nt, Human
acugcacuccagccugggugauagagugagau

SEQ ID NO: 40778 - RNA, 32 nt, Human
acugcacuccagccuggguggcagagugagac

SEQ ID NO: 40779 - RNA, 32 nt, Human
acugcacuccagccugggugucagagcgagaa

SEQ ID NO: 40780 - RNA, 32 nt, Human
acugcacuccagccuggucaauggagugcgac

SEQ ID NO: 40781 - RNA, 32 nt, Human
acugcacuccagccuggugacagggcgagacu

SEQ ID NO: 40782 - RNA, 32 nt, Human
acugcacuccagcuggagugacagagccaaac

SEQ ID NO: 40783 - RNA, 32 nt, Human
acugcacuccagcuugggcaacagggcgagac

SEQ ID NO: 40784 - RNA, 32 nt, Human
acugcacuccagcuugggcgacggagugagac

SEQ ID NO: 40785 - RNA, 32 nt, Human
acugcacuccauccagccugggugacagggcg

SEQ ID NO: 40786 - RNA, 32 nt, Human
acugcacuccauccagccugggugacagggug

SEQ ID NO: 40787 - RNA, 32 nt, Human
acugcacugcacgccagccuaggcgacagagu

SEQ ID NO: 40788 - RNA, 32 nt, Human
acugcacugcacuccagccugggugacaaagc

SEQ ID NO: 40789 - RNA, 32 nt, Human
acugcacugccccuucucccuccugagagcuc

SEQ ID NO: 40790 - RNA, 32 nt, Human
acugcacugccuggcucagcugcacgcugcag

SEQ ID NO: 40791 - RNA, 17 nt, Human
acugcacuggcagggug

SEQ ID NO: 40792 - RNA, 19 nt, Human
acugcacugggaaacacag

SEQ ID NO: 40793 - RNA, 32 nt, Human
acugcacugggaacuguggaaccacccagcuc

SEQ ID NO: 40794 - RNA, 32 nt, Human
acugcacuguugcugacuacuacucugccaau

SEQ ID NO: 40795 - RNA, 32 nt, Human
acugcacuguuucucccucccuuggacgacac

SEQ ID NO: 40796 - RNA, 32 nt, Human
acugcagaaaccagugagauacccaccugcuu

SEQ ID NO: 40797 - RNA, 32 nt, Human
acugcagaaagugggccugagccucgaggaug

SEQ ID NO: 40798 - RNA, 32 nt, Human
acugcagaagaaaagucccacugaggaaaaga

SEQ ID NO: 40799 - RNA, 32 nt, Human
acugcagaaggguguugugaugaccaguuuua

SEQ ID NO: 40800 - RNA, 32 nt, Human
acugcagaagguguauguuggggagaacugaa

SEQ ID NO: 40801 - RNA, 32 nt, Human
acugcagacuccaacuccuggccucaaacuau

SEQ ID NO: 40802 - RNA, 32 nt, Human
acugcagacucucaaacuugcucauuuaaaaa

SEQ ID NO: 40803 - RNA, 32 nt, Human
acugcagagaacacagaagccagcaagcagca

SEQ ID NO: 40804 - RNA, 17 nt, Human
acugcagaggcagggug

SEQ ID NO: 40805 - RNA, 32 nt, Human
acugcagaggcugaggcaggaaaauugcuuga

SEQ ID NO: 40806 - RNA, 32 nt, Human
acugcagaggggcaguggcuggcagugccagg

SEQ ID NO: 40807 - RNA, 32 nt, Human
acugcagaguguauuuuucuuccuccucaacu

SEQ ID NO: 40808 - RNA, 21 nt, Human
acugcagaucaaaaauauuga

SEQ ID NO: 40809 - RNA, 32 nt, Human
acugcagaucuugagauaugucagccucuaca

SEQ ID NO: 40810 - RNA, 32 nt, Human
acugcagcaaaacugcauuuuauguccugugu

SEQ ID NO: 40811 - RNA, 21 nt, Human
acugcagcaaaucucuccuua

SEQ ID NO: 40812 - RNA, 32 nt, Human
acugcagcacaaaauuaucgacucuggcgaga

SEQ ID NO: 40813 - RNA, 32 nt, Human
acugcagcagaaaggcucugaagguccaaaga

SEQ ID NO: 40814 - RNA, 32 nt, Human
acugcagcagaccugggguugugcacaacagc

SEQ ID NO: 40815 - RNA, 32 nt, Human
acugcagcaggccacuggggacagaagggccc

SEQ ID NO: 40816 - RNA, 32 nt, Human
acugcagcagggaaggguggcuggcuggcucc

SEQ ID NO: 40817 - RNA, 32 nt, Human
acugcagcagucuggccagcuccagggacaga

SEQ ID NO: 40818 - RNA, 32 nt, Human
acugcagccagcuuugcugcacuugcuggugc

SEQ ID NO: 40819 - RNA, 32 nt, Human
acugcagccaugagcagcaaugagugcuucaa

SEQ ID NO: 40820 - RNA, 32 nt, Human
acugcagcccagccagugguuccagguccagc

SEQ ID NO: 40821 - RNA, 32 nt, Human
acugcagccccagcuggcaucuugacugcaac

SEQ ID NO: 40822 - RNA, 32 nt, Human
acugcagccggggagagcaggacgcgccaucu

SEQ ID NO: 40823 - RNA, 32 nt, Human
acugcagccucaaacuccuaggcucaggugau

SEQ ID NO: 40824 - RNA, 32 nt, Human
acugcagccucaaacuccugggcucaagcaau

SEQ ID NO: 40825 - RNA, 32 nt, Human
acugcagccucaaacuccugggcucaagcgau

SEQ ID NO: 40826 - RNA, 32 nt, Human
acugcagccucaaacuccugggcucaagugau

SEQ ID NO: 40827 - RNA, 32 nt, Human
acugcagccucaaacuccugggcucaggccau

SEQ ID NO: 40828 - RNA, 19 nt, Human
acugcagccucaaccuccu

SEQ ID NO: 40829 - RNA, 32 nt, Human
acugcagccucaaccuccuggacucagagaug

SEQ ID NO: 40830 - RNA, 32 nt, Human
acugcagccucaaccuccugggcuaagugauc

SEQ ID NO: 40831 - RNA, 32 nt, Human
acugcagccucaaccuccugggcucaagugau

SEQ ID NO: 40832 - RNA, 32 nt, Human
acugcagccucaaccuccugggcucaggugau

SEQ ID NO: 40833 - RNA, 32 nt, Human
acugcagccucaaccuccuggggccaagugau

SEQ ID NO: 40834 - RNA, 32 nt, Human
acugcagccucaaccuccuggguucaagugau

SEQ ID NO: 40835 - RNA, 32 nt, Human
acugcagccucaaccugcagugcucaaggaau

SEQ ID NO: 40836 - RNA, 24 nt, Human
acugcagccuccaccuccagaguu

SEQ ID NO: 40837 - RNA, 24 nt, Human
acugcagccuccaccuccaggguu

SEQ ID NO: 40838 - RNA, 22 nt, Human
acugcagccuccaccucccagg

SEQ ID NO: 40839 - RNA, 24 nt, Human
acugcagccuccaccucccagguu

SEQ ID NO: 40840 - RNA, 24 nt, Human
acugcagccuccaccuccccgguu

SEQ ID NO: 40841 - RNA, 22 nt, Human
acugcagccuccaccucccggg

SEQ ID NO: 40842 - RNA, 24 nt, Human
acugcagccuccaccucccggguu

SEQ ID NO: 40843 - RNA, 22 nt, Human
acugcagccuccaccuccuggg

SEQ ID NO: 40844 - RNA, 32 nt, Human
acugcagccuccaccuccugggcucaaaguga

SEQ ID NO: 40845 - RNA, 32 nt, Human
acugcagccuccaccuccugggcucaagcgau

SEQ ID NO: 40846 - RNA, 32 nt, Human
acugcagccuccaccuccugggcucaugugau

SEQ ID NO: 40847 - RNA, 32 nt, Human
acugcagccuccaccuccugggcucuccagcg

SEQ ID NO: 40848 - RNA, 24 nt, Human
acugcagccuccaccuccuggguu

SEQ ID NO: 40849 - RNA, 32 nt, Human
acugcagccuccacuuccuggguucacaugau

SEQ ID NO: 40850 - RNA, 32 nt, Human
acugcagccuccauccucuggguucaagcaau

SEQ ID NO: 40851 - RNA, 24 nt, Human
acugcagccuccaucucccggguu

SEQ ID NO: 40852 - RNA, 24 nt, Human
acugcagccuccgccucccgaguu

SEQ ID NO: 40853 - RNA, 24 nt, Human
acugcagccuccgccucccggguu

SEQ ID NO: 40854 - RNA, 22 nt, Human
acugcagccucgaccucccggg

SEQ ID NO: 40855 - RNA, 32 nt, Human
acugcagccuggaacuccugggcucaggaucc

SEQ ID NO: 40856 - RNA, 26 nt, Human
acugcagccuggaugacagagcgaga

SEQ ID NO: 40857 - RNA, 26 nt, Human
acugcagccugggcgacagagcgaga

SEQ ID NO: 40858 - RNA, 24 nt, Human
acugcagccuucaccucccggguu

SEQ ID NO: 40859 - RNA, 32 nt, Human
acugcagccuugaacuccuaggcucaucaugc

SEQ ID NO: 40860 - RNA, 32 nt, Human
acugcagccuugacccccucccugaccucccc

SEQ ID NO: 40861 - RNA, 32 nt, Human
acugcagccuuguggauuuuccacacagcagc

SEQ ID NO: 40862 - RNA, 32 nt, Human
acugcagcgagcauuucuggugccucaaguga

SEQ ID NO: 40863 - RNA, 21 nt, Human
acugcagcgcagaguugggug

SEQ ID NO: 40864 - RNA, 32 nt, Human
acugcagcggccggcucucaccucuccccugu

SEQ ID NO: 40865 - RNA, 32 nt, Human
acugcagcgggaaguggcuucucuccagaaua

SEQ ID NO: 40866 - RNA, 32 nt, Human
acugcagcgucaccucuucccugggccuccca

SEQ ID NO: 40867 - RNA, 32 nt, Human
acugcagcuaucucucgccucagccccucaag

SEQ ID NO: 40868 - RNA, 30 nt, Human
acugcagcucuccaucagcuccugucucca

SEQ ID NO: 40869 - RNA, 32 nt, Human
acugcagcugaucugggcacagugguuuucac

SEQ ID NO: 40870 - RNA, 32 nt, Human
acugcagcuucaggacccuauggaugaggccg

SEQ ID NO: 40871 - RNA, 24 nt, Human
acugcagcuuccaucucccagguu

SEQ ID NO: 40872 - RNA, 32 nt, Human
acugcagcuucuacuugagcccucucucucug

SEQ ID NO: 40873 - RNA, 32 nt, Human
acugcagcuuugccaaggucugugauaugguu

SEQ ID NO: 40874 - RNA, 32 nt, Human
acugcaggaaagcgaagguggagagagaagag

SEQ ID NO: 40875 - RNA, 32 nt, Human
acugcaggaauuacaaacugaagaggacucug

SEQ ID NO: 40876 - RNA, 32 nt, Human
acugcaggacaagccucccuggaugaucgagg

SEQ ID NO: 40877 - RNA, 32 nt, Human
acugcaggacugccccucacuugaccaguccc

SEQ ID NO: 40878 - RNA, 32 nt, Human
acugcaggagggccaacaggugagaugggaag

SEQ ID NO: 40879 - RNA, 32 nt, Human
acugcaggcagcuucagccauguugugaaacu

SEQ ID NO: 40880 - RNA, 32 nt, Human
acugcaggcaugagccaucacacccggcuggu

SEQ ID NO: 40881 - RNA, 32 nt, Human
acugcaggcgugagccaccgcgcccggccaac

SEQ ID NO: 40882 - RNA, 32 nt, Human
acugcaggcucuuuccccagaccugcuucuag

SEQ ID NO: 40883 - RNA, 23 nt, Human
acugcaggcugguuuuaggucuu

SEQ ID NO: 40884 - RNA, 27 nt, Human
acugcaggcuuuccugugguuggucag

SEQ ID NO: 40885 - RNA, 32 nt, Human
acugcagggaaugcaucggggauagcugaugg

SEQ ID NO: 40886 - RNA, 32 nt, Human
acugcagggcacugugccugagcucugacagu

SEQ ID NO: 40887 - RNA, 32 nt, Human
acugcagggcugggaagaagcugcacuuccag

SEQ ID NO: 40888 - RNA, 32 nt, Human
acugcaggggaaguccagggaggcucauggac

SEQ ID NO: 40889 - RNA, 32 nt, Human
acugcaggggacggccagagcgagcugugcaa

SEQ ID NO: 40890 - RNA, 32 nt, Human
acugcaggggagggaaggaggagcagccuggg

SEQ ID NO: 40891 - RNA, 32 nt, Human
acugcaggggccaggugcagccaccgugcagc

SEQ ID NO: 40892 - RNA, 32 nt, Human
acugcagggguguuccaccacacccagccaau

SEQ ID NO: 40893 - RNA, 32 nt, Human
acugcagggucuggggcugaagcugaugcugg

SEQ ID NO: 40894 - RNA, 32 nt, Human
acugcagguaaugccuuucccuucaggaagcc

SEQ ID NO: 40895 - RNA, 32 nt, Human
acugcaggucuugggacuugucagccuccaca

SEQ ID NO: 40896 - RNA, 21 nt, Human
acugcaggugcagagcauccu

SEQ ID NO: 40897 - RNA, 17 nt, Human
acugcagguguaccuua

SEQ ID NO: 40898 - RNA, 32 nt, Human
acugcaggugugcaccaccaugcccagcuaau

SEQ ID NO: 40899 - RNA, 32 nt, Human
acugcaguaggcuuccucuguagagcucugaa

SEQ ID NO: 40900 - RNA, 32 nt, Human
acugcaguauucccaauugcacuggcccuggg

SEQ ID NO: 40901 - RNA, 32 nt, Human
acugcaguauugauguuuuacugcaaaucuua

SEQ ID NO: 40902 - RNA, 32 nt, Human
acugcagucaccaaguaaaacaacaaauagcu

SEQ ID NO: 40903 - RNA, 32 nt, Human
acugcagucagcuguccuuccuugugugucug

SEQ ID NO: 40904 - RNA, 32 nt, Human
acugcaguccacagugugcugcuggaauaauu

SEQ ID NO: 40905 - RNA, 32 nt, Human
acugcaguccgcagcccagccugggcgacaga

SEQ ID NO: 40906 - RNA, 16 nt, Human
acugcagucgucaagg

SEQ ID NO: 40907 - RNA, 32 nt, Human
acugcagucuccaacuccuggccucaagggau

SEQ ID NO: 40908 - RNA, 24 nt, Human
acugcagucuccaccuccuggguu

SEQ ID NO: 40909 - RNA, 32 nt, Human
acugcagucucgaacuccuggacucaagcagu

SEQ ID NO: 40910 - RNA, 32 nt, Human
acugcagucuucaacuccugaccucaagcaau

SEQ ID NO: 40911 - RNA, 32 nt, Human
acugcagucuugaacuccugggcucaagggau

SEQ ID NO: 40912 - RNA, 32 nt, Human
acugcagugagcuaugguggcaccacugcacu

SEQ ID NO: 40913 - RNA, 20 nt, Human
acugcagugagggucaaagg

SEQ ID NO: 40914 - RNA, 16 nt, Human
acugcagugcaaggug

SEQ ID NO: 40915 - RNA, 23 nt, Human
acugcagugcugcagugccaggu

SEQ ID NO: 40916 - RNA, 22 nt, Human
acugcagugcuuuggcaaggug

SEQ ID NO: 40917 - RNA, 32 nt, Human
acugcaguggauacaaggaagggccuuucucg

SEQ ID NO: 40918 - RNA, 18 nt, Human
acugcaguggcaauagug

SEQ ID NO: 40919 - RNA, 32 nt, Human
acugcaguggcaggucuggaccaaaugacacc

SEQ ID NO: 40920 - RNA, 32 nt, Human
acugcaguggcugcugcuugcuugccuccucg

SEQ ID NO: 40921 - RNA, 20 nt, Human
acugcaguggcuggagagug

SEQ ID NO: 40922 - RNA, 17 nt, Human
acugcagugggaaggug

SEQ ID NO: 40923 - RNA, 18 nt, Human
acugcaguguaguaaugg

SEQ ID NO: 40924 - RNA, 18 nt, Human
acugcagugucguuggug

SEQ ID NO: 40925 - RNA, 18 nt, Human
acugcagugucuaaaggu

SEQ ID NO: 40926 - RNA, 32 nt, Human
acugcagugucuggagguugcgggaaggagac

SEQ ID NO: 40927 - RNA, 18 nt, Human
acugcaguguuaucagug

SEQ ID NO: 40928 - RNA, 32 nt, Human
acugcaguucgaggagcucgucuaccucugga

SEQ ID NO: 40929 - RNA, 16 nt, Human
acugcaguugaaaggg

SEQ ID NO: 40930 - RNA, 17 nt, Human
acugcaguugcucaagg

SEQ ID NO: 40931 - RNA, 32 nt, Human
acugcaguugcugcugcagcugagguacagcg

SEQ ID NO: 40932 - RNA, 17 nt, Human
acugcaguuggccaagg

SEQ ID NO: 40933 - RNA, 32 nt, Human
acugcaguugggucgcccccaggccaacgcuc

SEQ ID NO: 40934 - RNA, 20 nt, Human
acugcaguuucagaaaggug

SEQ ID NO: 40935 - RNA, 32 nt, Human
acugcauaaugucagcauuuugugcuuuuggc

SEQ ID NO: 40936 - RNA, 32 nt, Human
acugcauauacaaaucaacucacugcauaugc

SEQ ID NO: 40937 - RNA, 32 nt, Human
acugcauaugcacaucaacucacugcauaugc

SEQ ID NO: 40938 - RNA, 32 nt, Human
acugcauauucacuuuaugugguuucagaaua

SEQ ID NO: 40939 - RNA, 22 nt, Human
acugcaucaaaguuggggaacc

SEQ ID NO: 40940 - RNA, 32 nt, Human
acugcaucacugcacuccagccugggcaacac

SEQ ID NO: 40941 - RNA, 32 nt, Human
acugcaucaugucccgguauagcuaccagagu

SEQ ID NO: 40942 - RNA, 19 nt, Human
acugcauccucaaccuccu

SEQ ID NO: 40943 - RNA, 32 nt, Human
acugcauccucaaccuccuggguucagauuau

SEQ ID NO: 40944 - RNA, 24 nt, Human
acugcauccuccaccuccuggguu

SEQ ID NO: 40945 - RNA, 24 nt, Human
acugcauccuccgccucccggguu

SEQ ID NO: 40946 - RNA, 32 nt, Human
acugcaucgggacuuuuuaauucuucagacac

SEQ ID NO: 40947 - RNA, 32 nt, Human
acugcaucugcagcucucgcucugccucuucc

SEQ ID NO: 40948 - RNA, 24 nt, Human
acugcaucuuccgccucccggguu

SEQ ID NO: 40949 - RNA, 32 nt, Human
acugcaucuucuccccuugccaccccauggcc

SEQ ID NO: 40950 - RNA, 32 nt, Human
acugcaugaagaaggucuggggacucacacag

SEQ ID NO: 40951 - RNA, 32 nt, Human
acugcaugauuuauuaguuucucuccacucug

SEQ ID NO: 40952 - RNA, 32 nt, Human
acugcaugccauguaauucugaaucauuugau

SEQ ID NO: 40953 - RNA, 21 nt, Human
acugcaugcugaugagcaagg

SEQ ID NO: 40954 - RNA, 29 nt, Human
acugcauggcugcuuuccuuuccuuuacu

SEQ ID NO: 40955 - RNA, 32 nt, Human
acugcauguaccauuugcauggcuccagaaau

SEQ ID NO: 40956 - RNA, 32 nt, Human
acugcaugugccacaccugucuguucgccauu

SEQ ID NO: 40957 - RNA, 32 nt, Human
acugcauuacuuuuguaaaaacacugguuaau

SEQ ID NO: 40958 - RNA, 32 nt, Human
acugcauuagauucuccagcgcacgcacgcgc

SEQ ID NO: 40959 - RNA, 32 nt, Human
acugcauuccagccugggcacuagagugagac

SEQ ID NO: 40960 - RNA, 32 nt, Human
acugcauuccccucuacuuuaaagcuuauauc

SEQ ID NO: 40961 - RNA, 32 nt, Human
acugcauucccuacccugcuucccuagagaga

SEQ ID NO: 40962 - RNA, 32 nt, Human
acugcauucuguuucuccuuuugugcccugau

SEQ ID NO: 40963 - RNA, 32 nt, Human
acugcauuggcugggugcaguggcucaugccu

SEQ ID NO: 40964 - RNA, 18 nt, Human
acugcauuguuucacugg

SEQ ID NO: 40965 - RNA, 32 nt, Human
acugcauuuaaaacaaaacaaaacagaaaaau

SEQ ID NO: 40966 - RNA, 32 nt, Human
acugcauuuccuucuugcucugucuacagccu

SEQ ID NO: 40967 - RNA, 32 nt, Human
acugccaaagugagagcugcuggagaacucau

SEQ ID NO: 40968 - RNA, 32 nt, Human
acugccaaccaccgggucacacugcugccuag

SEQ ID NO: 40969 - RNA, 32 nt, Human
acugccaaccugacccugucaucccgauugac

SEQ ID NO: 40970 - RNA, 32 nt, Human
acugccaagagcccugaacaggagccaccaug

SEQ ID NO: 40971 - RNA, 25 nt, Human
acugccaagauuaucugaugcucuc

SEQ ID NO: 40972 - RNA, 32 nt, Human
acugccaagcagggggacaaguauucuggcgg

SEQ ID NO: 40973 - RNA, 22 nt, Human
acugccaaggcacgaccacggg

SEQ ID NO: 40974 - RNA, 32 nt, Human
acugccaaggguggggucucaggagucaggca

SEQ ID NO: 40975 - RNA, 32 nt, Human
acugccaauuucugaggcugaagccauuucac

SEQ ID NO: 40976 - RNA, 32 nt, Human
acugccacacaguagcuguuacccacaggcag

SEQ ID NO: 40977 - RNA, 32 nt, Human
acugccacacgcagcucagccugggcggcaca

SEQ ID NO: 40978 - RNA, 32 nt, Human
acugccacacgcugggacuucggagacggcuc

SEQ ID NO: 40979 - RNA, 32 nt, Human
acugccacagacaaaccacccccacuccuacc

SEQ ID NO: 40980 - RNA, 32 nt, Human
acugccacaguuuuagaauaagcacugucacu

SEQ ID NO: 40981 - RNA, 32 nt, Human
acugccacauuggugcuguuguauugaaggug

SEQ ID NO: 40982 - RNA, 32 nt, Human
acugccaccacuggcggccugggaccagcugg

SEQ ID NO: 40983 - RNA, 32 nt, Human
acugccaccagcaaugcccugccuugcugccu

SEQ ID NO: 40984 - RNA, 32 nt, Human
acugccaccauccuggagacauuuugcagggc

SEQ ID NO: 40985 - RNA, 32 nt, Human
acugccaccaugcugcucacuuaugucaucca

SEQ ID NO: 40986 - RNA, 32 nt, Human
acugccaccgcacacgugcacacacgccaaca

SEQ ID NO: 40987 - RNA, 32 nt, Human
acugccaccgcuccugccccagaagguuguuu

SEQ ID NO: 40988 - RNA, 24 nt, Human
acugccaccuccaccucccgaguu

SEQ ID NO: 40989 - RNA, 24 nt, Human
acugccaccuccaccuccuggguu

SEQ ID NO: 40990 - RNA, 32 nt, Human
acugccaccugcagccgcagccuggacugcug

SEQ ID NO: 40991 - RNA, 32 nt, Human
acugccacuacccgcuccagagcuuuaaggaa

SEQ ID NO: 40992 - RNA, 32 nt, Human
acugccacuccacuccaggugggccacuccaa

SEQ ID NO: 40993 - RNA, 32 nt, Human
acugccacuccauuucauuaagcuauugacua

SEQ ID NO: 40994 - RNA, 32 nt, Human
acugccacugcaacucugcacguccaggaggg

SEQ ID NO: 40995 - RNA, 32 nt, Human
acugccacugggugacacagacugucguuugg

SEQ ID NO: 40996 - RNA, 32 nt, Human
acugccacuuuugcauaaauaaaacucuagac

SEQ ID NO: 40997 - RNA, 32 nt, Human
acugccagagcagguggggaaaaagaggagaa

SEQ ID NO: 40998 - RNA, 32 nt, Human
acugccagcauuucccuuccuuccucuccugu

SEQ ID NO: 40999 - RNA, 23 nt, Human
acugccagccaucgggcccaggu

SEQ ID NO: 41000 - RNA, 32 nt, Human
acugccagcucuuccuagcuggagaggagccc

SEQ ID NO: 41001 - RNA, 21 nt, Human
acugccaggaaggcccagggu

SEQ ID NO: 41002 - RNA, 32 nt, Human
acugccaggaccaaggcugagcccagcugugg

SEQ ID NO: 41003 - RNA, 24 nt, Human
acugccaggagccaaggccuaggu

SEQ ID NO: 41004 - RNA, 32 nt, Human
acugccaggaggaggagaggaggaggggagga

SEQ ID NO: 41005 - RNA, 32 nt, Human
acugccaggaugcccaggacaccagcucccug

SEQ ID NO: 41006 - RNA, 32 nt, Human
acugccaggccgaggcucagccccagacucuc

SEQ ID NO: 41007 - RNA, 32 nt, Human
acugccaggcugggugcaguggcucacaccug

SEQ ID NO: 41008 - RNA, 32 nt, Human
acugccaggcuuagacgcuuuaucuuuauuuu

SEQ ID NO: 41009 - RNA, 32 nt, Human
acugccaggcuucauucuuccauaugauccuc

SEQ ID NO: 41010 - RNA, 32 nt, Human
acugccagggaagggaagggggaccugggucu

SEQ ID NO: 41011 - RNA, 32 nt, Human
acugccagggcccaaagaaaugggugagcagu

SEQ ID NO: 41012 - RNA, 32 nt, Human
acugccagguaugggccagcaguuuccugcca

SEQ ID NO: 41013 - RNA, 32 nt, Human
acugccaucacagcagguuuccucauccagau

SEQ ID NO: 41014 - RNA, 32 nt, Human
acugccaucaggaaggugcuacuggccucgag

SEQ ID NO: 41015 - RNA, 32 nt, Human
acugccaucaucaucccaaggcaggcugcuac

SEQ ID NO: 41016 - RNA, 32 nt, Human
acugccaucauuucagcuucuggccacuggga

SEQ ID NO: 41017 - RNA, 32 nt, Human
acugccauccagcuuuggugcaauggcugagu

SEQ ID NO: 41018 - RNA, 32 nt, Human
acugccaucuucaagcugggugcaguggcuca

SEQ ID NO: 41019 - RNA, 32 nt, Human
acugccaugccaguggcugccaccacaaugcc

SEQ ID NO: 41020 - RNA, 32 nt, Human
acugccaugcugcaagagcagaauugaguagu

SEQ ID NO: 41021 - RNA, 32 nt, Human
acugccauguaucucaggcuuggguucacacc

SEQ ID NO: 41022 - RNA, 32 nt, Human
acugccauugccgccuccugccaccaggcuca

SEQ ID NO: 41023 - RNA, 32 nt, Human
acugcccaaacaggggccaagugcgccccaau

SEQ ID NO: 41024 - RNA, 32 nt, Human
acugcccacucugauaugccugggugagccua

SEQ ID NO: 41025 - RNA, 32 nt, Human
acugcccagaguccguccagccacucagcagc

SEQ ID NO: 41026 - RNA, 32 nt, Human
acugcccagcaacccggucacugcccaggacc

SEQ ID NO: 41027 - RNA, 32 nt, Human
acugcccaggcagagggcagggcuggaccaug

SEQ ID NO: 41028 - RNA, 32 nt, Human
acugcccaggccagaggguagagcacaggggu

SEQ ID NO: 41029 - RNA, 32 nt, Human
acugcccagggaggggccuggggcugggagca

SEQ ID NO: 41030 - RNA, 32 nt, Human
acugcccagggaguucaccuugcccgcuaccu

SEQ ID NO: 41031 - RNA, 32 nt, Human
acugcccagugcccacuacuucccagggacuc

SEQ ID NO: 41032 - RNA, 32 nt, Human
acugcccaugaccugaaggcuccagguggcuu

SEQ ID NO: 41033 - RNA, 32 nt, Human
acugcccaugucauuuguuuccagaaacgagg

SEQ ID NO: 41034 - RNA, 21 nt, Human
acugccccacaaaggccuggg

SEQ ID NO: 41035 - RNA, 32 nt, Human
acugccccacaagcuccagucauggguagugu

SEQ ID NO: 41036 - RNA, 32 nt, Human
acugccccaucuuuaucugggacuuagccucc

SEQ ID NO: 41037 - RNA, 32 nt, Human
acugccccauuggugccuuuucagccaucuga

SEQ ID NO: 41038 - RNA, 32 nt, Human
acugcccccacaccuccugacaccuccauaua

SEQ ID NO: 41039 - RNA, 32 nt, Human
acugcccccacugucccccuacccaccgaugg

SEQ ID NO: 41040 - RNA, 32 nt, Human
acugcccccugagauguacacccugauugcca

SEQ ID NO: 41041 - RNA, 32 nt, Human
acugcccccugccugcuccggcacugccccag

SEQ ID NO: 41042 - RNA, 32 nt, Human
acugcccccuggcugaagagucugcuuuaaau

SEQ ID NO: 41043 - RNA, 32 nt, Human
acugcccccuuuccuuuucugaccuccuuuug

SEQ ID NO: 41044 - RNA, 32 nt, Human
acugccccuagauacacaaucaccucaaguga

SEQ ID NO: 41045 - RNA, 22 nt, Human
acugccccucucauucucuuca

SEQ ID NO: 41046 - RNA, 32 nt, Human
acugccccucucugggcuucaguuuccuccuu

SEQ ID NO: 41047 - RNA, 32 nt, Human
acugccccuguccuccccacccugucaugugu

SEQ ID NO: 41048 - RNA, 32 nt, Human
acugccccuuuccucucccucagaauuugugu

SEQ ID NO: 41049 - RNA, 32 nt, Human
acugcccggccaagccccagccucagccugcg

SEQ ID NO: 41050 - RNA, 21 nt, Human
acugcccucacccucagccgu

SEQ ID NO: 41051 - RNA, 20 nt, Human
acugcccucagagcccucug

SEQ ID NO: 41052 - RNA, 32 nt, Human
acugcccuccagccuggaugacagagugagau

SEQ ID NO: 41053 - RNA, 32 nt, Human
acugcccuccucuccacccagcugcugccuau

SEQ ID NO: 41054 - RNA, 21 nt, Human
acugcccucgccuuccgggug

SEQ ID NO: 41055 - RNA, 32 nt, Human
acugcccucuagccuagacgacagagugagac

SEQ ID NO: 41056 - RNA, 32 nt, Human
acugcccucuccccaaccucuccucuaaccca

SEQ ID NO: 41057 - RNA, 32 nt, Human
acugcccucuccccgucucuagcucagaggcc

SEQ ID NO: 41058 - RNA, 32 nt, Human
acugcccugaguauuguaguuuacauacagga

SEQ ID NO: 41059 - RNA, 32 nt, Human
acugcccugcagccagccccagguaauguggu

SEQ ID NO: 41060 - RNA, 32 nt, Human
acugcccuggagguggcggccugcugcuguua

SEQ ID NO: 41061 - RNA, 32 nt, Human
acugcccuggaugugguggagcugggcuggga

SEQ ID NO: 41062 - RNA, 32 nt, Human
acugcccuggccagggcuggucucagccccga

SEQ ID NO: 41063 - RNA, 17 nt, Human
acugcccuguuuacuga

SEQ ID NO: 41064 - RNA, 32 nt, Human
acugcccuuauggagcuugcaguccagugagg

SEQ ID NO: 41065 - RNA, 32 nt, Human
acugcccuucuccaucucuuccuccuuguuca

SEQ ID NO: 41066 - RNA, 32 nt, Human
acugcccuucucuugcugccuccugggcaggg

SEQ ID NO: 41067 - RNA, 32 nt, Human
acugcccuucuuggaaguuugcaggauuggau

SEQ ID NO: 41068 - RNA, 32 nt, Human
acugcccuugccccuuucaucucccagcagcc

SEQ ID NO: 41069 - RNA, 32 nt, Human
acugcccuuuaggcucccagggccagaggagc

SEQ ID NO: 41070 - RNA, 32 nt, Human
acugcccuuuccaacugcuccagaacucuugg

SEQ ID NO: 41071 - RNA, 32 nt, Human
acugccgagcuugugagaaggaagggauggau

SEQ ID NO: 41072 - RNA, 32 nt, Human
acugccgcaagucugcagcccggcgccaccau

SEQ ID NO: 41073 - RNA, 32 nt, Human
acugccgccucccggguucaagcaauucucau

SEQ ID NO: 41074 - RNA, 32 nt, Human
acugccggagacucgggaggcugagcuuuccu

SEQ ID NO: 41075 - RNA, 32 nt, Human
acugccggaggugagagcgcagcaguagcuuc

SEQ ID NO: 41076 - RNA, 31 nt, Human
acugccggcagcaggcagaggagggaggggg

SEQ ID NO: 41077 - RNA, 32 nt, Human
acugccggcugguucccugcgcgcaguagcuc

SEQ ID NO: 41078 - RNA, 32 nt, Human
acugccgggcgaccgcgggaaaauuccaaaaa

SEQ ID NO: 41079 - RNA, 32 nt, Human
acugccgucaucucauuuuauagaugaggaaa

SEQ ID NO: 41080 - RNA, 32 nt, Human
acugccgucauuucagcuucuggccacuggga

SEQ ID NO: 41081 - RNA, 32 nt, Human
acugccguuucuuuggggcugccugugauacu

SEQ ID NO: 41082 - RNA, 32 nt, Human
acugccuaauaucuauuuaccuaacaacaaaa

SEQ ID NO: 41083 - RNA, 32 nt, Human
acugccuaauuguugcuguuguuguugcuguu

SEQ ID NO: 41084 - RNA, 32 nt, Human
acugccuacagaugcagcugaagguuccaugg

SEQ ID NO: 41085 - RNA, 32 nt, Human
acugccuacccaagccugucuuucccagcguc

SEQ ID NO: 41086 - RNA, 32 nt, Human
acugccuacccagcacuaccccaaacccccag

SEQ ID NO: 41087 - RNA, 32 nt, Human
acugccuacuacuaggagaaagaggcaaauga

SEQ ID NO: 41088 - RNA, 32 nt, Human
acugccuaguggagcugagagaagagggucac

SEQ ID NO: 41089 - RNA, 32 nt, Human
acugccuaugccaagucccuggaaaaggagcu

SEQ ID NO: 41090 - RNA, 32 nt, Human
acugccucagaagggagccacugugaaccucu

SEQ ID NO: 41091 - RNA, 32 nt, Human
acugccucagccacacacggcuuaggagauug

SEQ ID NO: 41092 - RNA, 32 nt, Human
acugccucagccaccaggacccuucucaguag

SEQ ID NO: 41093 - RNA, 32 nt, Human
acugccucagcccaugugcccugccggccagg

SEQ ID NO: 41094 - RNA, 32 nt, Human
acugccuccaacugccccaugcugccugagaa

SEQ ID NO: 41095 - RNA, 19 nt, Human
acugccuccaccacaggca

SEQ ID NO: 41096 - RNA, 21 nt, Human
acugccucccccagggauccu

SEQ ID NO: 41097 - RNA, 32 nt, Human
acugccuccucucaccaaccaaauugucuagc

SEQ ID NO: 41098 - RNA, 32 nt, Human
acugccuccuguuccagcuccugcugcugcuc

SEQ ID NO: 41099 - RNA, 21 nt, Human
acugccuccuguuuucucccu

SEQ ID NO: 41100 - RNA, 32 nt, Human
acugccuccuuuucccugucaugcucaucagc

SEQ ID NO: 41101 - RNA, 32 nt, Human
acugccucgauguuccagcugcccaucuugaa

SEQ ID NO: 41102 - RNA, 32 nt, Human
acugccucuaagacauccugcuuggcagguuc

SEQ ID NO: 41103 - RNA, 32 nt, Human
acugccucuccucucugggacaggcugggacc

SEQ ID NO: 41104 - RNA, 32 nt, Human
acugccucugcugcccugggaucauuacugug

SEQ ID NO: 41105 - RNA, 32 nt, Human
acugccucugcuuccaggaaaggcaaggggga

SEQ ID NO: 41106 - RNA, 32 nt, Human
acugccucuguggacuuagguuccaguccagu

SEQ ID NO: 41107 - RNA, 32 nt, Human
acugccucuuccugccucuccccacccugccc

SEQ ID NO: 41108 - RNA, 32 nt, Human
acugccugaacccaggaggcagagguugcggu

SEQ ID NO: 41109 - RNA, 32 nt, Human
acugccugaauacaggcuuuagguuccccugg

SEQ ID NO: 41110 - RNA, 32 nt, Human
acugccugacucaggugccucucgugguccaa

SEQ ID NO: 41111 - RNA, 32 nt, Human
acugccugcccagagccaucaggaugagcagu

SEQ ID NO: 41112 - RNA, 32 nt, Human
acugccugccucucuccuuuccuuccucaucc

SEQ ID NO: 41113 - RNA, 31 nt, Human
acugccugccucuugcggaacuggguuacac

SEQ ID NO: 41114 - RNA, 32 nt, Human
acugccugccugggcacguugcuguugcugcc

SEQ ID NO: 41115 - RNA, 32 nt, Human
acugccugcucuuccauaucauggcccuccac

SEQ ID NO: 41116 - RNA, 32 nt, Human
acugccugcugccuuuccacagcuauaaugga

SEQ ID NO: 41117 - RNA, 32 nt, Human
acugccugcuugaaagcacuuucugaccuaca

SEQ ID NO: 41118 - RNA, 32 nt, Human
acugccuggcagaacauaccacugaacuagua

SEQ ID NO: 41119 - RNA, 24 nt, Human
acugccuggccaaucaccugcaga

SEQ ID NO: 41120 - RNA, 32 nt, Human
acugccuggccuugaaaaucucagcuuggugu

SEQ ID NO: 41121 - RNA, 32 nt, Human
acugccugggaccgcccugccucaccagggcu

SEQ ID NO: 41122 - RNA, 20 nt, Human
acugccugggcucaagugau

SEQ ID NO: 41123 - RNA, 32 nt, Human
acugccugggcuccagccaccgacaugccuga

SEQ ID NO: 41124 - RNA, 32 nt, Human
acugccugggugccaugaaagaggccagcgug

SEQ ID NO: 41125 - RNA, 32 nt, Human
acugccugggugugcgccaguuugcugagaca

SEQ ID NO: 41126 - RNA, 32 nt, Human
acugccuguagagacaauacaguaagcauagu

SEQ ID NO: 41127 - RNA, 32 nt, Human
acugccuguagucccagcuauuccagggggcu

SEQ ID NO: 41128 - RNA, 31 nt, Human
acugccuguuccccacugccuguguucgcag

SEQ ID NO: 41129 - RNA, 32 nt, Human
acugccuuacagccacauuggcagcugugacc

SEQ ID NO: 41130 - RNA, 24 nt, Human
acugccuucauaguuuuagcuuuu

SEQ ID NO: 41131 - RNA, 32 nt, Human
acugccuucccauggcgaucuauaaguugaaa

SEQ ID NO: 41132 - RNA, 32 nt, Human
acugccuucucccguccuccccuccccuuccc

SEQ ID NO: 41133 - RNA, 32 nt, Human
acugccuucuccucucugggccuuuguuuccu

SEQ ID NO: 41134 - RNA, 32 nt, Human
acugccuucuguccaccaacauuuagugccag

SEQ ID NO: 41135 - RNA, 32 nt, Human
acugccuuggcaggaggguuuggggcuuccac

SEQ ID NO: 41136 - RNA, 32 nt, Human
acugccuugugagcauccccggucugggcagg

SEQ ID NO: 41137 - RNA, 32 nt, Human
acugccuuuauuuucccuccucccucuuguuu

SEQ ID NO: 41138 - RNA, 18 nt, Human
acugccuuucagccuugg

SEQ ID NO: 41139 - RNA, 32 nt, Human
acugccuuucugaaggcuggggagaggcuuug

SEQ ID NO: 41140 - RNA, 32 nt, Human
acugccuuugacuuccugacuguccccuggcu

SEQ ID NO: 41141 - RNA, 32 nt, Human
acugccuuugccuggcuuguuuugucucuuug

SEQ ID NO: 41142 - RNA, 21 nt, Human
acugccuuugugagcaaagug

SEQ ID NO: 41143 - RNA, 32 nt, Human
acugccuuugugcuuuccuccucucuccgcug

SEQ ID NO: 41144 - RNA, 32 nt, Human
acugccuuuucuuccuccuccugaccuuauuu

SEQ ID NO: 41145 - RNA, 32 nt, Human
acugcgacaguguggcguucccagcgcggcaa

SEQ ID NO: 41146 - RNA, 32 nt, Human
acugcgaccagaagauguuuccauguccuaau

SEQ ID NO: 41147 - RNA, 24 nt, Human
acugcgaccuccaccuccuggguu

SEQ ID NO: 41148 - RNA, 32 nt, Human
acugcgagagugaggcacauggccccugcaga

SEQ ID NO: 41149 - RNA, 32 nt, Human
acugcgaggcgaaggugaccggggaccgagca

SEQ ID NO: 41150 - RNA, 32 nt, Human
acugcgcacacagcugccugccucgccagaug

SEQ ID NO: 41151 - RNA, 32 nt, Human
acugcgccaccacaucacaugaccuuaacaug

SEQ ID NO: 41152 - RNA, 32 nt, Human
acugcgccaccgcgcuccagccugggugacag

SEQ ID NO: 41153 - RNA, 32 nt, Human
acugcgccacggcacuccagccugggcgacag

SEQ ID NO: 41154 - RNA, 32 nt, Human
acugcgccacugcacuccagccugggcaacag

SEQ ID NO: 41155 - RNA, 32 nt, Human
acugcgccacugcacuccagucugggacaaca

SEQ ID NO: 41156 - RNA, 32 nt, Human
acugcgccacugccaucggacaggaggauucc

SEQ ID NO: 41157 - RNA, 32 nt, Human
acugcgccauugcacuccagcccgggcaacaa

SEQ ID NO: 41158 - RNA, 32 nt, Human
acugcgcccagccuguuccuuauacucuuuaa

SEQ ID NO: 41159 - RNA, 32 nt, Human
acugcgccccaccucccugccuguguguguua

SEQ ID NO: 41160 - RNA, 32 nt, Human
acugcgcccgagaggcagcgcucagacagcgg

SEQ ID NO: 41161 - RNA, 32 nt, Human
acugcgcccuccacccucacucugccauuguu

SEQ ID NO: 41162 - RNA, 32 nt, Human
acugcgcccuggaggacgcgggcuggcugcug

SEQ ID NO: 41163 - RNA, 32 nt, Human
acugcgcccuggcccaagagccccagagacug

SEQ ID NO: 41164 - RNA, 32 nt, Human
acugcgcccuuaacugcauccagccuggggcu

SEQ ID NO: 41165 - RNA, 32 nt, Human
acugcgcgccucucccaggucucagcucuggg

SEQ ID NO: 41166 - RNA, 32 nt, Human
acugcgcggucauuuagcaaaucugcaagaga

SEQ ID NO: 41167 - RNA, 32 nt, Human
acugcgcuccagccugggcaacagagugagac

SEQ ID NO: 41168 - RNA, 32 nt, Human
acugcgcuccagccugggcgacagagugguau

SEQ ID NO: 41169 - RNA, 24 nt, Human
acugcgcugccgccgccgccgccg

SEQ ID NO: 41170 - RNA, 32 nt, Human
acugcgcuuacuccucugacccuccuucuauu

SEQ ID NO: 41171 - RNA, 32 nt, Human
acugcggaagggacgaggguucccuggagucu

SEQ ID NO: 41172 - RNA, 32 nt, Human
acugcggacagugugggccagggaggaaaacc

SEQ ID NO: 41173 - RNA, 32 nt, Human
acugcggagucugagaaaaggcagaagaaggg

SEQ ID NO: 41174 - RNA, 32 nt, Human
acugcggaugagaccggugcgacucaugaagg

SEQ ID NO: 41175 - RNA, 32 nt, Human
acugcggauggugcugcuguccccagccucuc

SEQ ID NO: 41176 - RNA, 32 nt, Human
acugcggccacagcuucugccucaggugcauc

SEQ ID NO: 41177 - RNA, 32 nt, Human
acugcggcccucaccagguccugggcucggac

SEQ ID NO: 41178 - RNA, 21 nt, Human
acugcggcgcggggcaaggug

SEQ ID NO: 41179 - RNA, 32 nt, Human
acugcgggaggcaggggaugcauggguguccc

SEQ ID NO: 41180 - RNA, 32 nt, Human
acugcgggccaccaugagggaggacuucuugg

SEQ ID NO: 41181 - RNA, 32 nt, Human
acugcgggcgagauggagcugagggaaggcag

SEQ ID NO: 41182 - RNA, 32 nt, Human
acugcggggaggugagggguggguuugggacu

SEQ ID NO: 41183 - RNA, 32 nt, Human
acugcggggcuuuuuaaaugcuucccuggacu

SEQ ID NO: 41184 - RNA, 32 nt, Human
acugcggguguucaccacaggccaggcccuaa

SEQ ID NO: 41185 - RNA, 32 nt, Human
acugcggucuccugccugugcuucagugacug

SEQ ID NO: 41186 - RNA, 32 nt, Human
acugcgguuaaaguggcuggaguggagucuug

SEQ ID NO: 41187 - RNA, 32 nt, Human
acugcguaggagagggagaugauccagagaca

SEQ ID NO: 41188 - RNA, 17 nt, Human
acugcgucccacgcggg

SEQ ID NO: 41189 - RNA, 31 nt, Human
acugcgugagagaaaacagcugguguuuaug

SEQ ID NO: 41190 - RNA, 32 nt, Human
acugcgugagagugugugcgugcaugggagug

SEQ ID NO: 41191 - RNA, 32 nt, Human
acugcgugcaagguggccucugccuggggccg

SEQ ID NO: 41192 - RNA, 32 nt, Human
acugcgugguccugcaacccugguuccagucu

SEQ ID NO: 41193 - RNA, 32 nt, Human
acugcuaaaauuaccaaauaauuuaaauaaag

SEQ ID NO: 41194 - RNA, 32 nt, Human
acugcuacaguuauccagguucuuuuaaauua

SEQ ID NO: 41195 - RNA, 31 nt, Human
acugcuacaguucagcaccuguuuuaugugc

SEQ ID NO: 41196 - RNA, 32 nt, Human
acugcuacauggugguacccaagauaauucuc

SEQ ID NO: 41197 - RNA, 32 nt, Human
acugcuaccgccagcacuagaccuggggcccu

SEQ ID NO: 41198 - RNA, 21 nt, Human
acugcuacggcgcaagagccu

SEQ ID NO: 41199 - RNA, 32 nt, Human
acugcuacuaccucggcuaccuggaggaggug

SEQ ID NO: 41200 - RNA, 32 nt, Human
acugcuacuuggaacaaaucgccccuuggcug

SEQ ID NO: 41201 - RNA, 32 nt, Human
acugcuacuuggagcucagaagccacuuuauc

SEQ ID NO: 41202 - RNA, 32 nt, Human
acugcuagagagagauaccaggcccuuagccu

SEQ ID NO: 41203 - RNA, 32 nt, Human
acugcuaggaagcaaggaugcaacaagaugau

SEQ ID NO: 41204 - RNA, 32 nt, Human
acugcuagggaaaugauuuugguguuuugggu

SEQ ID NO: 41205 - RNA, 32 nt, Human
acugcuaucuucuccauccgaggacaguuuuc

SEQ ID NO: 41206 - RNA, 32 nt, Human
acugcucacaggagacagaguagggacucgug

SEQ ID NO: 41207 - RNA, 32 nt, Human
acugcucacugcagccuccaccuccugggcuc

SEQ ID NO: 41208 - RNA, 32 nt, Human
acugcucacugcagccucgaccucccaaggcc

SEQ ID NO: 41209 - RNA, 32 nt, Human
acugcucagugcaaccucugccucccaggauc

SEQ ID NO: 41210 - RNA, 32 nt, Human
acugcucauagauaacaacuggaacauuauaa

SEQ ID NO: 41211 - RNA, 32 nt, Human
acugcucauccuccuccgccugucgccgccgu

SEQ ID NO: 41212 - RNA, 32 nt, Human
acugcuccaucuccugauguaggaggucaucu

SEQ ID NO: 41213 - RNA, 32 nt, Human
acugcuccccuucaucucuuacccuugccccc

SEQ ID NO: 41214 - RNA, 32 nt, Human
acugcuccgcauccugcuguguguccuguucc

SEQ ID NO: 41215 - RNA, 32 nt, Human
acugcuccuaccacuccagcaacgccagauaa

SEQ ID NO: 41216 - RNA, 32 nt, Human
acugcuccugcucuuugcccuguaucccauga

SEQ ID NO: 41217 - RNA, 32 nt, Human
acugcuccugggccuggagcaguauucccacc

SEQ ID NO: 41218 - RNA, 32 nt, Human
acugcucgccggccuacaugggguuaauucaa

SEQ ID NO: 41219 - RNA, 32 nt, Human
acugcucggaagacauugguagauggaccaua

SEQ ID NO: 41220 - RNA, 32 nt, Human
acugcucgugccaguuuggaagugacccuucu

SEQ ID NO: 41221 - RNA, 32 nt, Human
acugcucuacacaacagaagugaggcccaggg

SEQ ID NO: 41222 - RNA, 32 nt, Human
acugcucuaccugaauuuagacuaagcaguaa

SEQ ID NO: 41223 - RNA, 32 nt, Human
acugcucuccaaggaacuggaccuguccagac

SEQ ID NO: 41224 - RNA, 32 nt, Human
acugcucugcgggcggguggucuuagcuccag

SEQ ID NO: 41225 - RNA, 32 nt, Human
acugcucuggaaggggccccucagcugggcag

SEQ ID NO: 41226 - RNA, 32 nt, Human
acugcucuggacugacauugcucagguucgga

SEQ ID NO: 41227 - RNA, 32 nt, Human
acugcucuggggcccaugugcaagugaccugu

SEQ ID NO: 41228 - RNA, 32 nt, Human
acugcucuucccuccccucuccagcuacauac

SEQ ID NO: 41229 - RNA, 32 nt, Human
acugcucuuggagcuccucuccuagcuggagc

SEQ ID NO: 41230 - RNA, 32 nt, Human
acugcucuuggucccugugccugcugggggug

SEQ ID NO: 41231 - RNA, 32 nt, Human
acugcugacaaauaauuccugagguucuccac

SEQ ID NO: 41232 - RNA, 32 nt, Human
acugcugacaccaggcaccagcagguugcuga

SEQ ID NO: 41233 - RNA, 32 nt, Human
acugcugacagcuugggagcugcugugcccag

SEQ ID NO: 41234 - RNA, 32 nt, Human
acugcugaccacccuccccucagccauggaca

SEQ ID NO: 41235 - RNA, 32 nt, Human
acugcugaccucggccgccccuccucaccgaa

SEQ ID NO: 41236 - RNA, 26 nt, Human
acugcugacuucaggugauccacccg

SEQ ID NO: 41237 - RNA, 32 nt, Human
acugcugagaaggcuguccuuccuaacuugug

SEQ ID NO: 41238 - RNA, 32 nt, Human
acugcugagauuacaggcgugagccaccgcac

SEQ ID NO: 41239 - RNA, 32 nt, Human
acugcugagccaugcagggcagccugguggcg

SEQ ID NO: 41240 - RNA, 32 nt, Human
acugcugagcuggcccuuggggagaggugauu

SEQ ID NO: 41241 - RNA, 32 nt, Human
acugcugagugauucauaaacauaucaaccaa

SEQ ID NO: 41242 - RNA, 19 nt, Human
acugcugaugcaaauuggc

SEQ ID NO: 41243 - RNA, 32 nt, Human
acugcugcaaacauuguacauccaaauuaaag

SEQ ID NO: 41244 - RNA, 32 nt, Human
acugcugcaaccucccccuccuggguucaagc

SEQ ID NO: 41245 - RNA, 32 nt, Human
acugcugcacacagcaccaugacaaagucagu

SEQ ID NO: 41246 - RNA, 32 nt, Human
acugcugcagaggccguggcacuugucauggg

SEQ ID NO: 41247 - RNA, 32 nt, Human
acugcugcauuccagccagggugacagaguga

SEQ ID NO: 41248 - RNA, 32 nt, Human
acugcugccaucuucgcugcuagucaggguuc

SEQ ID NO: 41249 - RNA, 32 nt, Human
acugcugcgccgugccucacacagccgaggcg

SEQ ID NO: 41250 - RNA, 32 nt, Human
acugcugcggcuccuccugcaggccugagggg

SEQ ID NO: 41251 - RNA, 32 nt, Human
acugcugcuacugcuucuacaauguaaaaugu

SEQ ID NO: 41252 - RNA, 32 nt, Human
acugcugcugacugggcagggcccuggacccc

SEQ ID NO: 41253 - RNA, 24 nt, Human
acugcugcugcugcugcucagggc

SEQ ID NO: 41254 - RNA, 32 nt, Human
acugcugcuggggcuggcagagcaguuggcug

SEQ ID NO: 41255 - RNA, 32 nt, Human
acugcugcugucacugccauccauuggagccc

SEQ ID NO: 41256 - RNA, 32 nt, Human
acugcugcuucucagggaauccgacaccagcc

SEQ ID NO: 41257 - RNA, 32 nt, Human
acugcuggaagugguggcccaccagagccucc

SEQ ID NO: 41258 - RNA, 32 nt, Human
acugcuggacugcuccuggcucugucagcaaa

SEQ ID NO: 41259 - RNA, 32 nt, Human
acugcuggacuuacccugggcugcaguccauu

SEQ ID NO: 41260 - RNA, 32 nt, Human
acugcuggagagagucguacuggggaggcagc

SEQ ID NO: 41261 - RNA, 32 nt, Human
acugcuggagccugagagguggaggaguucug

SEQ ID NO: 41262 - RNA, 32 nt, Human
acugcuggcaugcagugcccucacagagaccc

SEQ ID NO: 41263 - RNA, 32 nt, Human
acugcuggcauuacaggugugagccaccaugc

SEQ ID NO: 41264 - RNA, 32 nt, Human
acugcuggccagggguaggauaguauaggaag

SEQ ID NO: 41265 - RNA, 32 nt, Human
acugcugggauuacaggcgugaaccacugcac

SEQ ID NO: 41266 - RNA, 32 nt, Human
acugcugggauuacaggcgugagccaccacac

SEQ ID NO: 41267 - RNA, 32 nt, Human
acugcugggauuacaggcgugagccaccgcac

SEQ ID NO: 41268 - RNA, 32 nt, Human
acugcugggauuacaggcgugagccaccgcgc

SEQ ID NO: 41269 - RNA, 32 nt, Human
acugcugggauuacaggcgugagccacucugc

SEQ ID NO: 41270 - RNA, 32 nt, Human
acugcugggauuacaggcgugugccaccaugc

SEQ ID NO: 41271 - RNA, 32 nt, Human
acugcugggauuacaggugugagccaccaugc

SEQ ID NO: 41272 - RNA, 32 nt, Human
acugcugggauuacaggugugagccaccguga

SEQ ID NO: 41273 - RNA, 32 nt, Human
acugcugggauuauaggcaugagccacugcgc

SEQ ID NO: 41274 - RNA, 32 nt, Human
acugcugggauuauaggcgugagccaccguac

SEQ ID NO: 41275 - RNA, 32 nt, Human
acugcuggggacggcgccugagcucucagggg

SEQ ID NO: 41276 - RNA, 32 nt, Human
acugcuggggagaggagggcagugaggagcga

SEQ ID NO: 41277 - RNA, 32 nt, Human
acugcuggggaugcugaaggguggugacuaau

SEQ ID NO: 41278 - RNA, 32 nt, Human
acugcuggggccgauugaacacuggacuuuug

SEQ ID NO: 41279 - RNA, 32 nt, Human
acugcugggugguggaggugggcaguggcacc

SEQ ID NO: 41280 - RNA, 32 nt, Human
acugcuggugggguagggaugagggagggagg

SEQ ID NO: 41281 - RNA, 32 nt, Human
acugcugucagugcaaagaugggauggacuuu

SEQ ID NO: 41282 - RNA, 32 nt, Human
acugcuguccagccacagccccagcccaggca

SEQ ID NO: 41283 - RNA, 32 nt, Human
acugcuguccauaaaccagaagccugacaugu

SEQ ID NO: 41284 - RNA, 32 nt, Human
acugcugucccagaggagaguccugugcgacc

SEQ ID NO: 41285 - RNA, 32 nt, Human
acugcuguccggagaggagggagccugaaguc

SEQ ID NO: 41286 - RNA, 32 nt, Human
acugcugugacgggggcucccugcugccccgg

SEQ ID NO: 41287 - RNA, 32 nt, Human
acugcugugauggaauaacaagggucagauuu

SEQ ID NO: 41288 - RNA, 32 nt, Human
acugcuguguuugagcucugcagcccagggac

SEQ ID NO: 41289 - RNA, 32 nt, Human
acugcuguuaaagacauaccugagacugggua

SEQ ID NO: 41290 - RNA, 32 nt, Human
acugcuguuuguacugucugucuucacauuca

SEQ ID NO: 41291 - RNA, 32 nt, Human
acugcuuacaauaucuuuagguuccugaaacu

SEQ ID NO: 41292 - RNA, 32 nt, Human
acugcuuagagcgagagcagagcaaacugcgc

SEQ ID NO: 41293 - RNA, 32 nt, Human
acugcuucaaggguaaaagagugcaucgcuuu

SEQ ID NO: 41294 - RNA, 32 nt, Human
acugcuucaugugcccccuacccuccacccca

SEQ ID NO: 41295 - RNA, 32 nt, Human
acugcuucauucugccucuaguaccagcgguu

SEQ ID NO: 41296 - RNA, 32 nt, Human
acugcuuccacuggacagaaaaagcaaacuga

SEQ ID NO: 41297 - RNA, 32 nt, Human
acugcuuccccguaauuccuucagagguugcu

SEQ ID NO: 41298 - RNA, 32 nt, Human
acugcuuccucacauccaucugauugcaccau

SEQ ID NO: 41299 - RNA, 32 nt, Human
acugcuuccuccuuggccccucaggcccuugg

SEQ ID NO: 41300 - RNA, 32 nt, Human
acugcuuccucuccagcuguggcuccaucugc

SEQ ID NO: 41301 - RNA, 32 nt, Human
acugcuuccugggcucucaugaucucagcuga

SEQ ID NO: 41302 - RNA, 32 nt, Human
acugcuucugcccucugccugccagugcccau

SEQ ID NO: 41303 - RNA, 25 nt, Human
acugcuucugugaaagaaaagucaa

SEQ ID NO: 41304 - RNA, 32 nt, Human
acugcuucugugaacagucuuugucuccuccc

SEQ ID NO: 41305 - RNA, 32 nt, Human
acugcuucuuaacaccuccaccagggggaagg

SEQ ID NO: 41306 - RNA, 21 nt, Human
acugcuucuuggagcuuugga

SEQ ID NO: 41307 - RNA, 32 nt, Human
acugcuugaacccagaaggcagagguugcagu

SEQ ID NO: 41308 - RNA, 32 nt, Human
acugcuugaacccaggaggcagagguugcagu

SEQ ID NO: 41309 - RNA, 32 nt, Human
acugcuugaacccgagaggcggagcuugcagu

SEQ ID NO: 41310 - RNA, 32 nt, Human
acugcuugagccuggaagacauagguugcagu

SEQ ID NO: 41311 - RNA, 32 nt, Human
acugcuugagcucaggagguugaggcugcaga

SEQ ID NO: 41312 - RNA, 32 nt, Human
acugcuugcccagggugcagugugagugugau

SEQ ID NO: 41313 - RNA, 32 nt, Human
acugcuugcugguccuguggcagaucaagaag

SEQ ID NO: 41314 - RNA, 32 nt, Human
acugcuuggaagaaggaaacggaagcugacau

SEQ ID NO: 41315 - RNA, 19 nt, Human
acugcuugguccucaggua

SEQ ID NO: 41316 - RNA, 32 nt, Human
acugcuuguugcucccugucgucugcaccaua

SEQ ID NO: 41317 - RNA, 32 nt, Human
acugcuuguuuugcacaagaagugauuuugug

SEQ ID NO: 41318 - RNA, 32 nt, Human
acugcuuuaccuccccuccuacugagucaggu

SEQ ID NO: 41319 - RNA, 32 nt, Human
acugcuuuacuaaggagaugugcaaugcugaa

SEQ ID NO: 41320 - RNA, 32 nt, Human
acugcuuuccaggggcuaauguuauucugcca

SEQ ID NO: 41321 - RNA, 32 nt, Human
acugcuuucccuccccugucaggucucuccug

SEQ ID NO: 41322 - RNA, 32 nt, Human
acugcuuugaagccugaagccaugaaaaugca

SEQ ID NO: 41323 - RNA, 32 nt, Human
acugcuuugcagcugucugcaugccuaauaua

SEQ ID NO: 41324 - RNA, 32 nt, Human
acugcuuugcauaaaacugggaagaaagagaa

SEQ ID NO: 41325 - RNA, 32 nt, Human
acugcuuugccuggccgggcgcgguggcucac

SEQ ID NO: 41326 - RNA, 32 nt, Human
acugcuuuggauuggggucaauugcaguccac

SEQ ID NO: 41327 - RNA, 32 nt, Human
acugcuuuguguccuuauggacuuuaguauua

SEQ ID NO: 41328 - RNA, 32 nt, Human
acugcuuuuucaucaagugaauauuuaaaaag

SEQ ID NO: 41329 - RNA, 32 nt, Human
acugcuuuuuguauuuggagagagugacuauu

SEQ ID NO: 41330 - RNA, 32 nt, Human
acuggaaaacaaauucccccaaaacacaugga

SEQ ID NO: 41331 - RNA, 32 nt, Human
acuggaaaagaugccugccccugcugccacau

SEQ ID NO: 41332 - RNA, 32 nt, Human
acuggaaacagccuuuuccucauuuucugugu

SEQ ID NO: 41333 - RNA, 32 nt, Human
acuggaaaccagcacugucagcacuuugagcc

SEQ ID NO: 41334 - RNA, 32 nt, Human
acuggaaaggacagcccuugaccuggguucug

SEQ ID NO: 41335 - RNA, 32 nt, Human
acuggaaaggccauuagaauugccccagcaga

SEQ ID NO: 41336 - RNA, 32 nt, Human
acuggaaauacugauggaagcacacaagugga

SEQ ID NO: 41337 - RNA, 32 nt, Human
acuggaaaucccucucugcugcuuuuguuggu

SEQ ID NO: 41338 - RNA, 32 nt, Human
acuggaaauguucaacuguaguuuuauuaagg

SEQ ID NO: 41339 - RNA, 32 nt, Human
acuggaacaaagaagagagggagugagagaaa

SEQ ID NO: 41340 - RNA, 32 nt, Human
acuggaacauaguucuccuucaaguguuggcg

SEQ ID NO: 41341 - RNA, 32 nt, Human
acuggaacccggaagguggagguugcagugag

SEQ ID NO: 41342 - RNA, 32 nt, Human
acuggaaccuaccgcuacacagccacuaacca

SEQ ID NO: 41343 - RNA, 32 nt, Human
acuggaaccugggagccggaggcugcagugag

SEQ ID NO: 41344 - RNA, 32 nt, Human
acuggaacgucgggggcaaagcauacacacac

SEQ ID NO: 41345 - RNA, 32 nt, Human
acuggaacucacaaaggucuccuucaccgaaa

SEQ ID NO: 41346 - RNA, 32 nt, Human
acuggaacucucaugcguugcuggugggaaug

SEQ ID NO: 41347 - RNA, 32 nt, Human
acuggaacugaacugccuucucugcacgcuug

SEQ ID NO: 41348 - RNA, 32 nt, Human
acuggaacugcaacuccagcguccucagcacc

SEQ ID NO: 41349 - RNA, 32 nt, Human
acuggaagaaagagacagagaaggagugucaa

SEQ ID NO: 41350 - RNA, 32 nt, Human
acuggaagauccaccuccccacugccuuuucu

SEQ ID NO: 41351 - RNA, 23 nt, Human
acuggaagccagaaaaucagguu

SEQ ID NO: 41352 - RNA, 32 nt, Human
acuggaagccaggggacuccagccugggcggg

SEQ ID NO: 41353 - RNA, 32 nt, Human
acuggaagcucccuccgcggucggauucugga

SEQ ID NO: 41354 - RNA, 32 nt, Human
acuggaaggauucucauaagaugcaggauagu

SEQ ID NO: 41355 - RNA, 32 nt, Human
acuggaaggcagagguugcagugagccaagau

SEQ ID NO: 41356 - RNA, 32 nt, Human
acuggaaggcagagguugcagugagccgagau

SEQ ID NO: 41357 - RNA, 32 nt, Human
acuggaaggccucagcccccagccacugggcu

SEQ ID NO: 41358 - RNA, 32 nt, Human
acuggaagggagcagaggccagcugggggcca

SEQ ID NO: 41359 - RNA, 32 nt, Human
acuggaaggggaaaggaagggaagggagggag

SEQ ID NO: 41360 - RNA, 32 nt, Human
acuggaagguccuugccugaacuccagaggug

SEQ ID NO: 41361 - RNA, 32 nt, Human
acuggaagugaugucauaagguugugaugugu

SEQ ID NO: 41362 - RNA, 32 nt, Human
acuggaaucaaggggagggggaagggaaugaa

SEQ ID NO: 41363 - RNA, 32 nt, Human
acuggaaucucucauuaaaguucuuggaacau

SEQ ID NO: 41364 - RNA, 32 nt, Human
acuggaaucucuccaccucaucguaucuaagg

SEQ ID NO: 41365 - RNA, 21 nt, Human
acuggaaucuguaaaccuuga

SEQ ID NO: 41366 - RNA, 32 nt, Human
acuggaaugaccuccugaccacucccucccgg

SEQ ID NO: 41367 - RNA, 32 nt, Human
acuggaauggcuguguccuagucugcuggggc

SEQ ID NO: 41368 - RNA, 32 nt, Human
acuggaauuacaaaugagaagagucuacaaua

SEQ ID NO: 41369 - RNA, 22 nt, Human
acuggaauucucagaugccuga

SEQ ID NO: 41370 - RNA, 22 nt, Human
acuggaauuuaaagacagcgca

SEQ ID NO: 41371 - RNA, 22 nt, Human
acuggacaaguacgggauccug

SEQ ID NO: 41372 - RNA, 32 nt, Human
acuggacaaugccacuccuccuguacaccugu

SEQ ID NO: 41373 - RNA, 32 nt, Human
acuggacacaguacuggugaaacugaggagag

SEQ ID NO: 41374 - RNA, 32 nt, Human
acuggacacugcaggcaagguguugguaacug

SEQ ID NO: 41375 - RNA, 32 nt, Human
acuggacagauggaguuaaaaagagcuuuugu

SEQ ID NO: 41376 - RNA, 19 nt, Human
acuggacagauggauucua

SEQ ID NO: 41377 - RNA, 27 nt, Human
acuggacaggacauccaccccaaaggg

SEQ ID NO: 41378 - RNA, 31 nt, Human
acuggacaggugggaagaugggaaugaggac

SEQ ID NO: 41379 - RNA, 32 nt, Human
acuggacaugccacuccccggccucguggcag

SEQ ID NO: 41380 - RNA, 32 nt, Human
acuggaccacugcaccguggagcagaggugaa

SEQ ID NO: 41381 - RNA, 32 nt, Human
acuggaccagcuccaaaaggaaaaagaugaac

SEQ ID NO: 41382 - RNA, 32 nt, Human
acuggaccauuuaaaugugcauggcccaugag

SEQ ID NO: 41383 - RNA, 32 nt, Human
acuggacccauucaaucucaucuugauaaaga

SEQ ID NO: 41384 - RNA, 32 nt, Human
acuggacccccagagggucaagaucgaggaua

SEQ ID NO: 41385 - RNA, 32 nt, Human
acuggacccugaccacuggcucuugggcaaac

SEQ ID NO: 41386 - RNA, 32 nt, Human
acuggaccgcugccaccucuugguagccaucg

SEQ ID NO: 41387 - RNA, 32 nt, Human
acuggaccuauguaucagccguacacacagaa

SEQ ID NO: 41388 - RNA, 32 nt, Human
acuggaccugaggagaccucagccucggugcu

SEQ ID NO: 41389 - RNA, 32 nt, Human
acuggaccugccuuggcuucuuugaucccaac

SEQ ID NO: 41390 - RNA, 32 nt, Human
acuggaccuucucauauuacguuuaaggaaga

SEQ ID NO: 41391 - RNA, 32 nt, Human
acuggacgcauuuuuauacauaggguaagcgc

SEQ ID NO: 41392 - RNA, 21 nt, Human
acuggacggcugccaaggagg

SEQ ID NO: 41393 - RNA, 18 nt, Human
acuggacggggaaaccua

SEQ ID NO: 41394 - RNA, 32 nt, Human
acuggacuaagccuccugggccuuguaugaaa

SEQ ID NO: 41395 - RNA, 32 nt, Human
acuggacuaggggagucaggagacccggguuc

SEQ ID NO: 41396 - RNA, 32 nt, Human
acuggacuaugaaccuggaccgcuaggauacc

SEQ ID NO: 41397 - RNA, 32 nt, Human
acuggacuccagccugggcgacagagugagac

SEQ ID NO: 41398 - RNA, 32 nt, Human
acuggacuccaggagcagggaucuugagucaa

SEQ ID NO: 41399 - RNA, 32 nt, Human
acuggacugccacaacagaucacugaaauucu

SEQ ID NO: 41400 - RNA, 32 nt, Human
acuggacugggugagaggacagagguggcucg

SEQ ID NO: 41401 - RNA, 32 nt, Human
acuggacuguaguagaggcauuuggaauacuu

SEQ ID NO: 41402 - RNA, 32 nt, Human
acuggacugugagcugccugaggucagggauu

SEQ ID NO: 41403 - RNA, 32 nt, Human
acuggacuucauuuugauacuugucuauccuu

SEQ ID NO: 41404 - RNA, 32 nt, Human
acuggacuugcaguguaaacagagacgcugca

SEQ ID NO: 41405 - RNA, 32 nt, Human
acuggagaaaaaugaauuuuguugggcaggaa

SEQ ID NO: 41406 - RNA, 21 nt, Human
acuggagaaagcagcucuuga

SEQ ID NO: 41407 - RNA, 32 nt, Human
acuggagaaagggaaccacagagccaggagga

SEQ ID NO: 41408 - RNA, 32 nt, Human
acuggagaagcagcagggcaacuucaaggcca

SEQ ID NO: 41409 - RNA, 32 nt, Human
acuggagaaggugagcgcugaagaaccaggau

SEQ ID NO: 41410 - RNA, 32 nt, Human
acuggagacacaaguggagaaaaccuccagcu

SEQ ID NO: 41411 - RNA, 32 nt, Human
acuggagacccaggacccugugcaggagcagc

SEQ ID NO: 41412 - RNA, 19 nt, Human
acuggagacgcacagaucc

SEQ ID NO: 41413 - RNA, 32 nt, Human
acuggagagaggcauuaaagaaccagggaagg

SEQ ID NO: 41414 - RNA, 32 nt, Human
acuggagagagguggaaugaaguggcaagggg

SEQ ID NO: 41415 - RNA, 32 nt, Human
acuggagagcagggggaggccacgugagguug

SEQ ID NO: 41416 - RNA, 32 nt, Human
acuggagagccaaggccucuguuuuagucuuu

SEQ ID NO: 41417 - RNA, 32 nt, Human
acuggagagcuccaaggaaagccccucgguaa

SEQ ID NO: 41418 - RNA, 32 nt, Human
acuggagaggcugacccaggggauggacauuc

SEQ ID NO: 41419 - RNA, 32 nt, Human
acuggagaggcugaggcaggagaaucacuuag

SEQ ID NO: 41420 - RNA, 32 nt, Human
acuggagagggaugcccuagcccucgaggggc

SEQ ID NO: 41421 - RNA, 32 nt, Human
acuggagagggcggucgcaggagccugcgagg

SEQ ID NO: 41422 - RNA, 32 nt, Human
acuggagagugaggaggaggaggagccuuggu

SEQ ID NO: 41423 - RNA, 32 nt, Human
acuggagaugcugagauuuaaacccgggugcu

SEQ ID NO: 41424 - RNA, 32 nt, Human
acuggagauggggagucccaggaagcucaugu

SEQ ID NO: 41425 - RNA, 32 nt, Human
acuggagcaaaagguccuucugugcacccugg

SEQ ID NO: 41426 - RNA, 32 nt, Human
acuggagcacagccuccugccucccagcccgg

SEQ ID NO: 41427 - RNA, 32 nt, Human
acuggagcaguggugcaauuauggcucacugc

SEQ ID NO: 41428 - RNA, 32 nt, Human
acuggagccaagugcgcugagcucucacauga

SEQ ID NO: 41429 - RNA, 32 nt, Human
acuggagccaggcuggaagucaaguggcuucu

SEQ ID NO: 41430 - RNA, 32 nt, Human
acuggagcccaggaggucaaggcugcagugag

SEQ ID NO: 41431 - RNA, 32 nt, Human
acuggagcccaggaguuugaggcugcagcgag

SEQ ID NO: 41432 - RNA, 32 nt, Human
acuggagcccaggauuggcagcguggaaucag

SEQ ID NO: 41433 - RNA, 32 nt, Human
acuggagccuccauuuacuggggagaauagaa

SEQ ID NO: 41434 - RNA, 32 nt, Human
acuggagccugcaaaugcauuguguuugcucu

SEQ ID NO: 41435 - RNA, 32 nt, Human
acuggagccuggaccccgccucccaggacaug

SEQ ID NO: 41436 - RNA, 32 nt, Human
acuggagcggccccgcccugcccuugccugcc

SEQ ID NO: 41437 - RNA, 32 nt, Human
acuggagcuccaggagccauccuggaauuucu

SEQ ID NO: 41438 - RNA, 32 nt, Human
acuggagcugcuaagacacaugguugcacaga

SEQ ID NO: 41439 - RNA, 32 nt, Human
acuggaggaacagcagcucugggaggcacaga

SEQ ID NO: 41440 - RNA, 32 nt, Human
acuggaggaaccucuggagcagcuguuggcug

SEQ ID NO: 41441 - RNA, 32 nt, Human
acuggaggaggugaggucgagagccagguuca

SEQ ID NO: 41442 - RNA, 32 nt, Human
acuggaggcaacagaaagaaaugaagugacuc

SEQ ID NO: 41443 - RNA, 32 nt, Human
acuggaggccaagaguuggagagcagacuggg

SEQ ID NO: 41444 - RNA, 32 nt, Human
acuggaggccaucaacccucuugguugaggcc

SEQ ID NO: 41445 - RNA, 32 nt, Human
acuggaggcccagaugugcccaucacguuuuu

SEQ ID NO: 41446 - RNA, 32 nt, Human
acuggaggccuccugaggccaggaacgugcaa

SEQ ID NO: 41447 - RNA, 23 nt, Human
acuggaggcggagguugcaguga

SEQ ID NO: 41448 - RNA, 32 nt, Human
acuggaggcgggaucacucaggcuccagccca

SEQ ID NO: 41449 - RNA, 32 nt, Human
acuggaggcucuguucugccucuuaucagcca

SEQ ID NO: 41450 - RNA, 32 nt, Human
acuggaggcugagucaggagaaucacuugaac

SEQ ID NO: 41451 - RNA, 32 nt, Human
acuggaggcuucagccuugcuguuuacacaca

SEQ ID NO: 41452 - RNA, 32 nt, Human
acuggagggaaagagugaggccagccugcccg

SEQ ID NO: 41453 - RNA, 32 nt, Human
acuggagggagagacgugggcacaaaggucgc

SEQ ID NO: 41454 - RNA, 32 nt, Human
acuggaggguaaacaagguggagagaagcuuc

SEQ ID NO: 41455 - RNA, 32 nt, Human
acuggaggguuccgggaaaagagcagaggaaa

SEQ ID NO: 41456 - RNA, 32 nt, Human
acuggagguccaguaggccuggccggggcccu

SEQ ID NO: 41457 - RNA, 32 nt, Human
acuggagguccccagaagacuauguuccuguc

SEQ ID NO: 41458 - RNA, 32 nt, Human
acuggagguggcagugccuguuuaugaacuaa

SEQ ID NO: 41459 - RNA, 32 nt, Human
acuggagguguccucuggaugaagggaaagug

SEQ ID NO: 41460 - RNA, 32 nt, Human
acuggaguacaggaguuuggggcuguagugug

SEQ ID NO: 41461 - RNA, 32 nt, Human
acuggagucaucugaaggcucaacuggaccgg

SEQ ID NO: 41462 - RNA, 32 nt, Human
acuggaguccaggaguucaagguggcagugag

SEQ ID NO: 41463 - RNA, 32 nt, Human
acuggagucugagaggaggagguggagacuau

SEQ ID NO: 41464 - RNA, 32 nt, Human
acuggagugcaggaguucaagaccagccuggg

SEQ ID NO: 41465 - RNA, 32 nt, Human
acuggauaaagccacacaauaagcaccucuaa

SEQ ID NO: 41466 - RNA, 32 nt, Human
acuggauaaggagagaauagcuuuuauguacu

SEQ ID NO: 41467 - RNA, 18 nt, Human
acuggauacuagaucuua

SEQ ID NO: 41468 - RNA, 32 nt, Human
acuggaucacaaaaugugauaaaacuuuaaau

SEQ ID NO: 41469 - RNA, 32 nt, Human
acuggaucccagcugccuuccugggcuugugc

SEQ ID NO: 41470 - RNA, 32 nt, Human
acuggaucugcaggugggaugagggagacaga

SEQ ID NO: 41471 - RNA, 32 nt, Human
acuggaugagagugugggagguggaugcggga

SEQ ID NO: 41472 - RNA, 32 nt, Human
acuggaugagaugguaucucacugugguuuuu

SEQ ID NO: 41473 - RNA, 32 nt, Human
acuggaugagggcagaugaggacaggaagaga

SEQ ID NO: 41474 - RNA, 32 nt, Human
acuggaugcaaagcuagaaaauauugcaauaa

SEQ ID NO: 41475 - RNA, 32 nt, Human
acuggauggaaagaugaguuguguagguuauc

SEQ ID NO: 41476 - RNA, 32 nt, Human
acuggauggaguuagggaaacugaggcaaaag

SEQ ID NO: 41477 - RNA, 32 nt, Human
acuggauggauaaugaugccacugagugagug

SEQ ID NO: 41478 - RNA, 32 nt, Human
acuggauggcaucagaauugucuggaaguuuu

SEQ ID NO: 41479 - RNA, 32 nt, Human
acuggaugucuccugaucccaggcugggaccc

SEQ ID NO: 41480 - RNA, 32 nt, Human
acuggauguguccugaucuacuccuucuccuu

SEQ ID NO: 41481 - RNA, 32 nt, Human
acuggauuauaacauggacaaaucuuauuuug

SEQ ID NO: 41482 - RNA, 32 nt, Human
acuggauucucuuccugaagcgaaggggcucc

SEQ ID NO: 41483 - RNA, 32 nt, Human
acuggauuugaagucagaagaccuggguucuu

SEQ ID NO: 41484 - RNA, 32 nt, Human
acuggauuuguuguucuuucagaaagcuuuga

SEQ ID NO: 41485 - RNA, 32 nt, Human
acuggauuuuccagauccuugugguccuggaa

SEQ ID NO: 41486 - RNA, 32 nt, Human
acuggcaaagcaguccagccuccgucuucugg

SEQ ID NO: 41487 - RNA, 32 nt, Human
acuggcaaaggcagaucuccccuccuuccagu

SEQ ID NO: 41488 - RNA, 31 nt, Human
acuggcaaccacacaacucagggaaaggaau

SEQ ID NO: 41489 - RNA, 32 nt, Human
acuggcaagagggagaaaggacgcugccgccu

SEQ ID NO: 41490 - RNA, 32 nt, Human
acuggcaagguuuuuaaaaaugagguaaaugc

SEQ ID NO: 41491 - RNA, 32 nt, Human
acuggcaauacuccagccuggugacagaguga

SEQ ID NO: 41492 - RNA, 32 nt, Human
acuggcacacacacauacacacauaugcacaa

SEQ ID NO: 41493 - RNA, 32 nt, Human
acuggcacagcaacaucaggguugugacagag

SEQ ID NO: 41494 - RNA, 32 nt, Human
acuggcacagccagucccuggugaaggcuuaa

SEQ ID NO: 41495 - RNA, 32 nt, Human
acuggcacaggaccucuucauugcaggaagau

SEQ ID NO: 41496 - RNA, 32 nt, Human
acuggcacauuuucucuguuucucucuccgau

SEQ ID NO: 41497 - RNA, 22 nt, Human
acuggcacccaccacgacgccc

SEQ ID NO: 41498 - RNA, 32 nt, Human
acuggcaccucacacuccuucuugucaggagc

SEQ ID NO: 41499 - RNA, 32 nt, Human
acuggcaccuggagagcccuuaagucuguccu

SEQ ID NO: 41500 - RNA, 19 nt, Human
acuggcacgcaugagcacc

SEQ ID NO: 41501 - RNA, 32 nt, Human
acuggcacucaacaccagcccaugaaaagagc

SEQ ID NO: 41502 - RNA, 32 nt, Human
acuggcacugcacgaggggccaggagagcagc

SEQ ID NO: 41503 - RNA, 32 nt, Human
acuggcacugugaccuuagcauuuaguuuucu

SEQ ID NO: 41504 - RNA, 32 nt, Human
acuggcagagacgcagaagggaaaguguccag

SEQ ID NO: 41505 - RNA, 32 nt, Human
acuggcagagauucaaagaagccacuaaagca

SEQ ID NO: 41506 - RNA, 32 nt, Human
acuggcagagccuguaguuggaaaggggacag

SEQ ID NO: 41507 - RNA, 32 nt, Human
acuggcagagcuggaggaggaggagggcaaac

SEQ ID NO: 41508 - RNA, 32 nt, Human
acuggcagccaucuaugguaccacugaaaccc

SEQ ID NO: 41509 - RNA, 32 nt, Human
acuggcagccuugccacacuguccucauuccc

SEQ ID NO: 41510 - RNA, 32 nt, Human
acuggcagcuggccgggcgcucgcagugggag

SEQ ID NO: 41511 - RNA, 19 nt, Human
acuggcagcuguggaaaug

SEQ ID NO: 41512 - RNA, 32 nt, Human
acuggcaggaggcaggugcagggaggccuggg

SEQ ID NO: 41513 - RNA, 21 nt, Human
acuggcaggcagaaagugcaa

SEQ ID NO: 41514 - RNA, 32 nt, Human
acuggcaggcagcucuaccugcagccccugug

SEQ ID NO: 41515 - RNA, 32 nt, Human
acuggcagggcggucacgggaccugcgggcug

SEQ ID NO: 41516 - RNA, 32 nt, Human
acuggcaggggagacaggagccuagcggagcc

SEQ ID NO: 41517 - RNA, 32 nt, Human
acuggcagguuugugagccucuucccaccccc

SEQ ID NO: 41518 - RNA, 32 nt, Human
acuggcagucgaauuauauccuagcguuaucu

SEQ ID NO: 41519 - RNA, 22 nt, Human
acuggcaguuucaaggaugcaa

SEQ ID NO: 41520 - RNA, 32 nt, Human
acuggcaguuuugaacuucccuuccuuaaagu

SEQ ID NO: 41521 - RNA, 32 nt, Human
acuggcauacuauguggaugugacaguggcgu

SEQ ID NO: 41522 - RNA, 32 nt, Human
acuggcaucaagauuccucagacuccaugagu

SEQ ID NO: 41523 - RNA, 32 nt, Human
acuggcaucgcagcuuccugucuguuuauaua

SEQ ID NO: 41524 - RNA, 32 nt, Human
acuggcaugguggcaugcgccuguaaucccag

SEQ ID NO: 41525 - RNA, 32 nt, Human
acuggcauuguuagcuggggacauggaagugg

SEQ ID NO: 41526 - RNA, 32 nt, Human
acuggccaacacagcgagacccccaucucuaa

SEQ ID NO: 41527 - RNA, 32 nt, Human
acuggccaagcuucuuuccuucauacaggggu

SEQ ID NO: 41528 - RNA, 32 nt, Human
acuggccacagagauauccuggaagacacgug

SEQ ID NO: 41529 - RNA, 22 nt, Human
acuggccacagggcgcuggggg

SEQ ID NO: 41530 - RNA, 23 nt, Human
acuggccaccucugaacccuuug

SEQ ID NO: 41531 - RNA, 32 nt, Human
acuggccacgcacaggcucuggcucuggaagg

SEQ ID NO: 41532 - RNA, 32 nt, Human
acuggccacgcgggggcaguggaggcacaggc

SEQ ID NO: 41533 - RNA, 32 nt, Human
acuggccagcucaagagguuuggauauggacc

SEQ ID NO: 41534 - RNA, 32 nt, Human
acuggccaguacuuagucacguggcuacaucu

SEQ ID NO: 41535 - RNA, 32 nt, Human
acuggccagugugggguuagcagaucgaauaa

SEQ ID NO: 41536 - RNA, 32 nt, Human
acuggccauaaaccacagacucucuccaggcu

SEQ ID NO: 41537 - RNA, 32 nt, Human
acuggccauggagccgcgcacaggggacgccg

SEQ ID NO: 41538 - RNA, 32 nt, Human
acuggccauucuggucaucucagucuggaacu

SEQ ID NO: 41539 - RNA, 32 nt, Human
acuggccauugaggaggcucucagcggagucg

SEQ ID NO: 41540 - RNA, 32 nt, Human
acuggcccaaccacaggagcugccaguaucca

SEQ ID NO: 41541 - RNA, 32 nt, Human
acuggcccaagauuugguaaagagauuucauu

SEQ ID NO: 41542 - RNA, 32 nt, Human
acuggcccacguccccaugccugggugcugug

SEQ ID NO: 41543 - RNA, 32 nt, Human
acuggcccagaagucugggugccugaguucua

SEQ ID NO: 41544 - RNA, 32 nt, Human
acuggcccagcagaggguggauaugugggcug

SEQ ID NO: 41545 - RNA, 32 nt, Human
acuggcccagggccaccucuugcuuggggagc

SEQ ID NO: 41546 - RNA, 32 nt, Human
acuggcccaguucacuguaccuggacuuaccc

SEQ ID NO: 41547 - RNA, 32 nt, Human
acuggccccaggugaugcugccuuugcugucc

SEQ ID NO: 41548 - RNA, 32 nt, Human
acuggcccccagugucaggcaggaggugaccc

SEQ ID NO: 41549 - RNA, 32 nt, Human
acuggccccuguccuuggccagucccaagccc

SEQ ID NO: 41550 - RNA, 32 nt, Human
acuggccccuuugccugaccuggacuuggaga

SEQ ID NO: 41551 - RNA, 32 nt, Human
acuggcccucaccuccacgccuaccucauagc

SEQ ID NO: 41552 - RNA, 32 nt, Human
acuggcccugaccacauagaugcugcgccgcc

SEQ ID NO: 41553 - RNA, 32 nt, Human
acuggcccugcagcuugucuccauggugggcu

SEQ ID NO: 41554 - RNA, 32 nt, Human
acuggcccugcagggcgcccacccugcggccc

SEQ ID NO: 41555 - RNA, 32 nt, Human
acuggcccugccaccugaccucagccucaggg

SEQ ID NO: 41556 - RNA, 32 nt, Human
acuggcccuggccugucuccagcucugcgccu

SEQ ID NO: 41557 - RNA, 32 nt, Human
acuggccgcugcuggucuuccugcugcccgcc

SEQ ID NO: 41558 - RNA, 32 nt, Human
acuggccggcagccuggugagcccucaccucc

SEQ ID NO: 41559 - RNA, 32 nt, Human
acuggccuaccuagcagaccuggauuuuucuu

SEQ ID NO: 41560 - RNA, 32 nt, Human
acuggccuccuagcccaacuacuuugucagcu

SEQ ID NO: 41561 - RNA, 32 nt, Human
acuggccuccuccagggaugaucaacagggca

SEQ ID NO: 41562 - RNA, 20 nt, Human
acuggccugaggagcagcag

SEQ ID NO: 41563 - RNA, 32 nt, Human
acuggccugcagcuuugccaacauuaccugaa

SEQ ID NO: 41564 - RNA, 32 nt, Human
acuggccugccuggccccucccuccaggccag

SEQ ID NO: 41565 - RNA, 32 nt, Human
acuggccuggccacacugcucuccaguagcac

SEQ ID NO: 41566 - RNA, 32 nt, Human
acuggccugggcagguggcgggaacguugcug

SEQ ID NO: 41567 - RNA, 32 nt, Human
acuggccugggugacagagcaggacaugagac

SEQ ID NO: 41568 - RNA, 32 nt, Human
acuggccuguggugacugcacacagcucgcaa

SEQ ID NO: 41569 - RNA, 32 nt, Human
acuggccuguggugaugcaaagcugcuuugcu

SEQ ID NO: 41570 - RNA, 32 nt, Human
acuggccuugagauaagcaaugcugaagcacu

SEQ ID NO: 41571 - RNA, 32 nt, Human
acuggccuuuguuucacauguccucauucuca

SEQ ID NO: 41572 - RNA, 32 nt, Human
acuggcgaggcugaggcuggaggaucacugga

SEQ ID NO: 41573 - RNA, 32 nt, Human
acuggcgaggcugcugggguugcagcgggaca

SEQ ID NO: 41574 - RNA, 32 nt, Human
acuggcgaucaucaagcaaaagcugccaauua

SEQ ID NO: 41575 - RNA, 32 nt, Human
acuggcgcaguggcucaugccgguaauccagu

SEQ ID NO: 41576 - RNA, 32 nt, Human
acuggcggagccagagagauguaacuucaccc

SEQ ID NO: 41577 - RNA, 20 nt, Human
acuggcggccaggggcacag

SEQ ID NO: 41578 - RNA, 32 nt, Human
acuggcggucugcacuucucucccggguucca

SEQ ID NO: 41579 - RNA, 22 nt, Human
acuggcguccauagucagaccc

SEQ ID NO: 41580 - RNA, 24 nt, Human
acuggcguccguccacagaagccc

SEQ ID NO: 41581 - RNA, 23 nt, Human
acuggcgucuaagacagugaccu

SEQ ID NO: 41582 - RNA, 32 nt, Human
acuggcguuagcugauuaacccauguaaauag

SEQ ID NO: 41583 - RNA, 32 nt, Human
acuggcuaacuagguugagaaaccggcgccac

SEQ ID NO: 41584 - RNA, 24 nt, Human
acuggcuacacaacagagaugcaa

SEQ ID NO: 41585 - RNA, 32 nt, Human
acuggcucaagcaaucugcccaccucggucuc

SEQ ID NO: 41586 - RNA, 32 nt, Human
acuggcucauuucucgcaaauaccucgaaggg

SEQ ID NO: 41587 - RNA, 32 nt, Human
acuggcuccaacacugcaacauggggacauuu

SEQ ID NO: 41588 - RNA, 16 nt, Human
acuggcuccaacugcc

SEQ ID NO: 41589 - RNA, 32 nt, Human
acuggcuccaucauacauauucaccacuugag

SEQ ID NO: 41590 - RNA, 32 nt, Human
acuggcucccugcagcucugcggcuacacgcg

SEQ ID NO: 41591 - RNA, 32 nt, Human
acuggcuccuccagugcacagauuugcaaccg

SEQ ID NO: 41592 - RNA, 32 nt, Human
acuggcuccuggaagggaugaggguccagaga

SEQ ID NO: 41593 - RNA, 32 nt, Human
acuggcuccugggcguuagaugaaugaaucga

SEQ ID NO: 41594 - RNA, 32 nt, Human
acuggcucgcuacacacaacacugaccccugc

SEQ ID NO: 41595 - RNA, 32 nt, Human
acuggcucgugugccauccauauccaucuuuc

SEQ ID NO: 41596 - RNA, 32 nt, Human
acuggcucucaggggccagcuccccaugggcg

SEQ ID NO: 41597 - RNA, 32 nt, Human
acuggcucucugagagagaguagcccuaccua

SEQ ID NO: 41598 - RNA, 32 nt, Human
acuggcugaaggaagccaagaggaucacugcu

SEQ ID NO: 41599 - RNA, 32 nt, Human
acuggcugaccccuccuuguaauguagacaga

SEQ ID NO: 41600 - RNA, 32 nt, Human
acuggcugaccugguggccgugguggagauga

SEQ ID NO: 41601 - RNA, 32 nt, Human
acuggcugagcaccugcugugugugcacugcu

SEQ ID NO: 41602 - RNA, 32 nt, Human
acuggcugaucuguagcugcuuucacuccaag

SEQ ID NO: 41603 - RNA, 32 nt, Human
acuggcugcccaggcugaauggcagugccugg

SEQ ID NO: 41604 - RNA, 32 nt, Human
acuggcugccuuguuccuggccuaggacuuag

SEQ ID NO: 41605 - RNA, 32 nt, Human
acuggcugcguuccgggagacucggggcaaga

SEQ ID NO: 41606 - RNA, 32 nt, Human
acuggcugcugcugcccugcgcgcugcuggcu

SEQ ID NO: 41607 - RNA, 32 nt, Human
acuggcuggacccucugcccugggcaggaggu

SEQ ID NO: 41608 - RNA, 32 nt, Human
acuggcuggaggccugccugugucuagagcuc

SEQ ID NO: 41609 - RNA, 32 nt, Human
acuggcuggccaucuggccugccuggaggaga

SEQ ID NO: 41610 - RNA, 32 nt, Human
acuggcuggcugucuugcaucagucccaggcc

SEQ ID NO: 41611 - RNA, 32 nt, Human
acuggcuggugcugggggagcugcagauggcc

SEQ ID NO: 41612 - RNA, 32 nt, Human
acuggcugguugcugggggcaggugucacagc

SEQ ID NO: 41613 - RNA, 32 nt, Human
acuggcugugagagccgcagugaauggcugga

SEQ ID NO: 41614 - RNA, 32 nt, Human
acuggcugugcauaaaaccacccaucuagguc

SEQ ID NO: 41615 - RNA, 32 nt, Human
acuggcuguggcuggaaucugccuuuuaucac

SEQ ID NO: 41616 - RNA, 32 nt, Human
acuggcugugugaccuuaggcccggagcugcc

SEQ ID NO: 41617 - RNA, 18 nt, Human
acuggcugugugaucuca

SEQ ID NO: 41618 - RNA, 32 nt, Human
acuggcuuaagccaggagccacuggcugcugg

SEQ ID NO: 41619 - RNA, 32 nt, Human
acuggcuuacagauuuacaugugcacacacac

SEQ ID NO: 41620 - RNA, 32 nt, Human
acuggcuucagccuccccaccuucuucagcca

SEQ ID NO: 41621 - RNA, 32 nt, Human
acuggcuucccauugccucucuugagugucag

SEQ ID NO: 41622 - RNA, 32 nt, Human
acuggcuucccccuaccaaguuaugcuuaaaa

SEQ ID NO: 41623 - RNA, 32 nt, Human
acuggcuucccucugcugcugccuuggcuucc

SEQ ID NO: 41624 - RNA, 32 nt, Human
acuggcuuccuccaaagucccaauacucuagc

SEQ ID NO: 41625 - RNA, 32 nt, Human
acuggcuucuaggguucugggcucaggcagga

SEQ ID NO: 41626 - RNA, 32 nt, Human
acuggcuucucaauuuucuuccuucucugccc

SEQ ID NO: 41627 - RNA, 32 nt, Human
acuggcuucucccuuucuuacucacacugacc

SEQ ID NO: 41628 - RNA, 32 nt, Human
acuggcuugauggaucacccccaggaggggaa

SEQ ID NO: 41629 - RNA, 32 nt, Human
acuggcuuguuugccuuaacuuguaguaccag

SEQ ID NO: 41630 - RNA, 32 nt, Human
acuggcuuugagcucucuggguacagugucug

SEQ ID NO: 41631 - RNA, 32 nt, Human
acuggcuuuggaauuaaauagcuuagauugua

SEQ ID NO: 41632 - RNA, 31 nt, Human
acuggcuuuuccucugggccuggguuggugc

SEQ ID NO: 41633 - RNA, 32 nt, Human
acuggcuuuucucuccccuggccuuugcugaa

SEQ ID NO: 41634 - RNA, 32 nt, Human
acugggaaaccagugacugaggccuggaccca

SEQ ID NO: 41635 - RNA, 27 nt, Human
acugggaaacuguguugaagcuccuga

SEQ ID NO: 41636 - RNA, 32 nt, Human
acugggaaagccccagguaaccccggacuggu

SEQ ID NO: 41637 - RNA, 32 nt, Human
acugggaaaugggagcacaguacuggaaaaug

SEQ ID NO: 41638 - RNA, 32 nt, Human
acugggaaccacagaggaaggaugagguggga

SEQ ID NO: 41639 - RNA, 32 nt, Human
acugggaacucaguuucuagccccagguuccu

SEQ ID NO: 41640 - RNA, 32 nt, Human
acugggaacuccagaaguuguggggagagugg

SEQ ID NO: 41641 - RNA, 32 nt, Human
acugggaacugcaccagaugcucagacuuggu

SEQ ID NO: 41642 - RNA, 32 nt, Human
acugggaagaucuagccuaaagaggcuucucu

SEQ ID NO: 41643 - RNA, 32 nt, Human
acugggaaggagggccccacagcuucagacug

SEQ ID NO: 41644 - RNA, 32 nt, Human
acugggaagggcccuucaggucaccaaacauc

SEQ ID NO: 41645 - RNA, 32 nt, Human
acugggaaguccauuugcaagcugagcgccag

SEQ ID NO: 41646 - RNA, 26 nt, Human
acugggaagucugaugugggcaggua

SEQ ID NO: 41647 - RNA, 32 nt, Human
acugggaauggggucagucacagcagaaccgu

SEQ ID NO: 41648 - RNA, 21 nt, Human
acugggaaugucaggcuccug

SEQ ID NO: 41649 - RNA, 32 nt, Human
acugggaccaaagggguggggauaauggggag

SEQ ID NO: 41650 - RNA, 32 nt, Human
acugggaccagcugaacgagacggucuucacu

SEQ ID NO: 41651 - RNA, 32 nt, Human
acugggaccccaggcaugcaccaccucaccaa

SEQ ID NO: 41652 - RNA, 32 nt, Human
acugggacccuccccagccuggagaguucauc

SEQ ID NO: 41653 - RNA, 32 nt, Human
acugggacccucugccccaagccucaguuccu

SEQ ID NO: 41654 - RNA, 32 nt, Human
acugggacuaaaugcuaccaucuucuguauug

SEQ ID NO: 41655 - RNA, 32 nt, Human
acugggacuguggccuggccugcuccaggaug

SEQ ID NO: 41656 - RNA, 32 nt, Human
acugggagacugcuugguguucccugaggaca

SEQ ID NO: 41657 - RNA, 32 nt, Human
acugggagacuugccuggguucccaggacuug

SEQ ID NO: 41658 - RNA, 32 nt, Human
acugggagccuucuggaauccugcagaggguc

SEQ ID NO: 41659 - RNA, 32 nt, Human
acugggagcugcagaccggagcuguuccuauu

SEQ ID NO: 41660 - RNA, 32 nt, Human
acugggagcugcagaccggagcuguucuucag

SEQ ID NO: 41661 - RNA, 32 nt, Human
acugggagcugcagaccggagcuguucuucuu

SEQ ID NO: 41662 - RNA, 32 nt, Human
acugggaggagagaauguuccaggcagaggaa

SEQ ID NO: 41663 - RNA, 32 nt, Human
acugggaggaggcggugcggcgaagcgcucag

SEQ ID NO: 41664 - RNA, 32 nt, Human
acugggaggcagggguuggagugagccaggac

SEQ ID NO: 41665 - RNA, 32 nt, Human
acugggaggcagguuuggaggcugcaguggga

SEQ ID NO: 41666 - RNA, 32 nt, Human
acugggaggcggagcuugcagugagccgagau

SEQ ID NO: 41667 - RNA, 32 nt, Human
acugggaggcucagaggacccuuccugcccac

SEQ ID NO: 41668 - RNA, 32 nt, Human
acugggaggcugcugccuccuuccugcccaug

SEQ ID NO: 41669 - RNA, 32 nt, Human
acugggaggggcccuggcagcaugaaaccccc

SEQ ID NO: 41670 - RNA, 32 nt, Human
acugggaggguccccuccuccuucccuacucc

SEQ ID NO: 41671 - RNA, 32 nt, Human
acugggagguggagguugcagugagccaagau

SEQ ID NO: 41672 - RNA, 32 nt, Human
acugggagguugaagcagaauugcuugaaccc

SEQ ID NO: 41673 - RNA, 32 nt, Human
acugggagugggcuccucggggucgggcaucu

SEQ ID NO: 41674 - RNA, 32 nt, Human
acugggagugggggucagagaggcagauuccu

SEQ ID NO: 41675 - RNA, 32 nt, Human
acugggauaaagcaagaagacugauuuuauga

SEQ ID NO: 41676 - RNA, 32 nt, Human
acugggauccaucucccacuaguaggaagaag

SEQ ID NO: 41677 - RNA, 32 nt, Human
acugggaugaugagaggcaaugcuggaguguu

SEQ ID NO: 41678 - RNA, 32 nt, Human
acugggauggauccacuguggguggggaggag

SEQ ID NO: 41679 - RNA, 32 nt, Human
acugggcaacagagcaagacccugucucuuga

SEQ ID NO: 41680 - RNA, 32 nt, Human
acugggcaacauagcaagaccccgucucuaca

SEQ ID NO: 41681 - RNA, 19 nt, Human
acugggcaccguggaucug

SEQ ID NO: 41682 - RNA, 20 nt, Human
acugggcacucuuggaucug

SEQ ID NO: 41683 - RNA, 32 nt, Human
acugggcacucuuggaucuggagcucacaacu

SEQ ID NO: 41684 - RNA, 32 nt, Human
acugggcacuugggguccagaggcagggccuu

SEQ ID NO: 41685 - RNA, 32 nt, Human
acugggcagaucccaggcugggcaugggggug

SEQ ID NO: 41686 - RNA, 32 nt, Human
acugggcagcaguucugggugucuggaauggg

SEQ ID NO: 41687 - RNA, 30 nt, Human
acugggcagcaucaccagcuccuguaccgu

SEQ ID NO: 41688 - RNA, 32 nt, Human
acugggcagcgggcauccuacuuccaaggcua

SEQ ID NO: 41689 - RNA, 32 nt, Human
acugggcaggaggcaggagauggcaauggaag

SEQ ID NO: 41690 - RNA, 32 nt, Human
acugggcaggcacagagcaggggcugcccagg

SEQ ID NO: 41691 - RNA, 32 nt, Human
acugggcaggcugcaaaugucuguguuaaaac

SEQ ID NO: 41692 - RNA, 32 nt, Human
acugggcaggggccuuggugggcagauggcaa

SEQ ID NO: 41693 - RNA, 32 nt, Human
acugggcagggugggggcaacccagaggaccc

SEQ ID NO: 41694 - RNA, 32 nt, Human
acugggcauaggcagagaucucuggaguguug

SEQ ID NO: 41695 - RNA, 32 nt, Human
acugggcauaugguucacgccuguaauuccag

SEQ ID NO: 41696 - RNA, 32 nt, Human
acugggcaucuccugagccuaggcaauagcug

SEQ ID NO: 41697 - RNA, 32 nt, Human
acugggcaucuucugcacuuucucugcauuug

SEQ ID NO: 41698 - RNA, 32 nt, Human
acugggcaugaagaagggagcacagcagguac

SEQ ID NO: 41699 - RNA, 32 nt, Human
acugggcaugagggguuccuccccuccagcuc

SEQ ID NO: 41700 - RNA, 18 nt, Human
acugggcauuugccaaag

SEQ ID NO: 41701 - RNA, 32 nt, Human
acugggccacugcacuccagccuggaugacag

SEQ ID NO: 41702 - RNA, 32 nt, Human
acugggccagcccugcagcccaaaacccaggg

SEQ ID NO: 41703 - RNA, 32 nt, Human
acugggccaggaucuguaucauccuucgcaga

SEQ ID NO: 41704 - RNA, 32 nt, Human
acugggccaggcaccucccucacaggacaauc

SEQ ID NO: 41705 - RNA, 32 nt, Human
acugggccauuuuagacccccagggaaacagc

SEQ ID NO: 41706 - RNA, 32 nt, Human
acugggccauuuuguucucagagggacaaaac

SEQ ID NO: 41707 - RNA, 32 nt, Human
acugggcccaggaguucgaggugcaguuuggc

SEQ ID NO: 41708 - RNA, 32 nt, Human
acugggccccaccuccacaguucccagaagca

SEQ ID NO: 41709 - RNA, 32 nt, Human
acugggccccgacugcagccugcauucugcac

SEQ ID NO: 41710 - RNA, 32 nt, Human
acugggccccucgcccccuccuccagcggccu

SEQ ID NO: 41711 - RNA, 32 nt, Human
acugggcccuuccagagggagcucuuuggcca

SEQ ID NO: 41712 - RNA, 32 nt, Human
acugggcccuugacaguguccuuugacauucc

SEQ ID NO: 41713 - RNA, 32 nt, Human
acugggccuccgcuucccagcaacgcagccag

SEQ ID NO: 41714 - RNA, 32 nt, Human
acugggccugcagccuuccucuucugggacug

SEQ ID NO: 41715 - RNA, 32 nt, Human
acugggccugcagcucccuucuccugggacuu

SEQ ID NO: 41716 - RNA, 32 nt, Human
acugggccuguugcccuuucuguaccauuuau

SEQ ID NO: 41717 - RNA, 32 nt, Human
acugggcgacagagcaagacucugucucucuc

SEQ ID NO: 41718 - RNA, 32 nt, Human
acugggcgagccugccggccucuagauggccu

SEQ ID NO: 41719 - RNA, 32 nt, Human
acugggcgagggacugggaaagaggcauauuu

SEQ ID NO: 41720 - RNA, 32 nt, Human
acugggcggccaggggaugacaguauggacuu

SEQ ID NO: 41721 - RNA, 32 nt, Human
acugggcuaaucucccccuagcuucaagcugu

SEQ ID NO: 41722 - RNA, 32 nt, Human
acugggcuacagcuucuaucacaugccgaacu

SEQ ID NO: 41723 - RNA, 32 nt, Human
acugggcuagccugcacugccugggaaagucg

SEQ ID NO: 41724 - RNA, 32 nt, Human
acugggcuaggcugcaacuuuaucucauuuaa

SEQ ID NO: 41725 - RNA, 32 nt, Human
acugggcucacugcagccuagaccugcugggc

SEQ ID NO: 41726 - RNA, 32 nt, Human
acugggcucacuggcagcccugacccucuauu

SEQ ID NO: 41727 - RNA, 32 nt, Human
acugggcucagccugucccccacuccugccug

SEQ ID NO: 41728 - RNA, 32 nt, Human
acugggcuccagccugggcgacagagugagag

SEQ ID NO: 41729 - RNA, 23 nt, Human
acugggcucccacucagccccug

SEQ ID NO: 41730 - RNA, 32 nt, Human
acugggcucugcccucauuuucuguuuauugc

SEQ ID NO: 41731 - RNA, 32 nt, Human
acugggcugacccuuuugauuuccaaacucag

SEQ ID NO: 41732 - RNA, 32 nt, Human
acugggcugcagaaucucacaugggcaccaug

SEQ ID NO: 41733 - RNA, 18 nt, Human
acugggcugcaggugcug

SEQ ID NO: 41734 - RNA, 32 nt, Human
acugggcugcagguuccagcuguugcugcuag

SEQ ID NO: 41735 - RNA, 32 nt, Human
acugggcugcauucucaggagauuaggcauuc

SEQ ID NO: 41736 - RNA, 32 nt, Human
acugggcugggagagaagauggggaagugugu

SEQ ID NO: 41737 - RNA, 32 nt, Human
acugggcugggcaggugcaggccaccgccguc

SEQ ID NO: 41738 - RNA, 32 nt, Human
acugggcuggggaagcagaugcuugcuggcca

SEQ ID NO: 41739 - RNA, 32 nt, Human
acugggcugugugaggguggggugggaggggg

SEQ ID NO: 41740 - RNA, 32 nt, Human
acugggcuuagcugggccucugaggccuguau

SEQ ID NO: 41741 - RNA, 32 nt, Human
acugggcuucaagguacagccuaauggcuugc

SEQ ID NO: 41742 - RNA, 32 nt, Human
acugggcuuccuaccaguuucucagaauuaca

SEQ ID NO: 41743 - RNA, 24 nt, Human
acuggggaaaguggaggcuccuga

SEQ ID NO: 41744 - RNA, 22 nt, Human
acuggggaaauaaaaccucuga

SEQ ID NO: 41745 - RNA, 20 nt, Human
acuggggaacuucaggcucc

SEQ ID NO: 41746 - RNA, 32 nt, Human
acuggggaagcagagguuguagugagccgaga

SEQ ID NO: 41747 - RNA, 32 nt, Human
acuggggaauaauauaccuuacacucuagggu

SEQ ID NO: 41748 - RNA, 32 nt, Human
acuggggaccagcccccuucucccacaaauaa

SEQ ID NO: 41749 - RNA, 22 nt, Human
acuggggagacgaggaccccga

SEQ ID NO: 41750 - RNA, 19 nt, Human
acuggggagcacugccaaa

SEQ ID NO: 41751 - RNA, 32 nt, Human
acuggggagcgggaccagagagacaggcugcu

SEQ ID NO: 41752 - RNA, 32 nt, Human
acuggggaggagaagguugcagugagccgaga

SEQ ID NO: 41753 - RNA, 32 nt, Human
acuggggaggagagacaggauaaagggcagau

SEQ ID NO: 41754 - RNA, 32 nt, Human
acuggggaggcagagguugcagugagacaaga

SEQ ID NO: 41755 - RNA, 32 nt, Human
acuggggaggcagagguugcaguggcccgaga

SEQ ID NO: 41756 - RNA, 32 nt, Human
acuggggaggcagagguugcggugagcccaga

SEQ ID NO: 41757 - RNA, 32 nt, Human
acuggggaggcugaggcacgagaaucacuuga

SEQ ID NO: 41758 - RNA, 32 nt, Human
acuggggaggcugaggcaggaaaaugguguca

SEQ ID NO: 41759 - RNA, 32 nt, Human
acuggggaggcugaggcaggacaaugacguga

SEQ ID NO: 41760 - RNA, 32 nt, Human
acuggggaggcugaggcaggacaauggcguga

SEQ ID NO: 41761 - RNA, 26 nt, Human
acuggggaggcugaggcaggagaauc

SEQ ID NO: 41762 - RNA, 32 nt, Human
acuggggaggcugaggcaggagaaucacuuga

SEQ ID NO: 41763 - RNA, 32 nt, Human
acuggggaggcugaggcaggagaaucgcuuga

SEQ ID NO: 41764 - RNA, 32 nt, Human
acuggggaggcugaggcaggagaaucguuuua

SEQ ID NO: 41765 - RNA, 32 nt, Human
acuggggaggcugaggcgggagaaucgcuuga

SEQ ID NO: 41766 - RNA, 32 nt, Human
acuggggaggcugaggugggaggauugcuuga

SEQ ID NO: 41767 - RNA, 32 nt, Human
acuggggagggaacuccgccccucgcgggaga

SEQ ID NO: 41768 - RNA, 32 nt, Human
acuggggagggcugcagucacauugauguaag

SEQ ID NO: 41769 - RNA, 32 nt, Human
acuggggaggggcauccuggagugcuggucua

SEQ ID NO: 41770 - RNA, 32 nt, Human
acuggggaggucuagcauguggcguaggaggg

SEQ ID NO: 41771 - RNA, 32 nt, Human
acuggggaggugugugucagggccaagguccu

SEQ ID NO: 41772 - RNA, 32 nt, Human
acuggggcagagggacagggaagccaggucga

SEQ ID NO: 41773 - RNA, 32 nt, Human
acuggggcaggcggaccuuguagucuugugag

SEQ ID NO: 41774 - RNA, 32 nt, Human
acuggggcaggcggagggcccugcgugcuccu

SEQ ID NO: 41775 - RNA, 32 nt, Human
acuggggccacugcucugccgcggagauaagu

SEQ ID NO: 41776 - RNA, 32 nt, Human
acuggggccacugcucugcugcggagauaagu

SEQ ID NO: 41777 - RNA, 32 nt, Human
acuggggccaggcaggcggaaaagagaacaga

SEQ ID NO: 41778 - RNA, 32 nt, Human
acuggggcccacccuucucaccagcacuaaau

SEQ ID NO: 41779 - RNA, 32 nt, Human
acuggggcccagcagcugccuccugaggugac

SEQ ID NO: 41780 - RNA, 21 nt, Human
acuggggccucccccaaagga

SEQ ID NO: 41781 - RNA, 32 nt, Human
acuggggcucuugagcagcuugcuuuagccug

SEQ ID NO: 41782 - RNA, 32 nt, Human
acuggggcuuggcucacugcuaccuccgccuc

SEQ ID NO: 41783 - RNA, 32 nt, Human
acuggggcuuugauuuggaggaauggggcagg

SEQ ID NO: 41784 - RNA, 32 nt, Human
acugggggaagaggagccaaugacaggguagg

SEQ ID NO: 41785 - RNA, 32 nt, Human
acugggggacuugggguagggggacagacggg

SEQ ID NO: 41786 - RNA, 32 nt, Human
acugggggaggcagggcacagggagaugcuca

SEQ ID NO: 41787 - RNA, 32 nt, Human
acugggggcuccccaccuccuugcucucccca

SEQ ID NO: 41788 - RNA, 32 nt, Human
acuggggguugcggcggcugcccacgccggaa

SEQ ID NO: 41789 - RNA, 32 nt, Human
acugggguacagcaaagggacgauccuccaga

SEQ ID NO: 41790 - RNA, 32 nt, Human
acugggguagggcugaacagcugcauucgaga

SEQ ID NO: 41791 - RNA, 32 nt, Human
acugggguagggcugaacagcugcauucgagg

SEQ ID NO: 41792 - RNA, 32 nt, Human
acugggguagggucauaccacagggaaauacc

SEQ ID NO: 41793 - RNA, 32 nt, Human
acuggggucagggcacagcaacuuagcgaggc

SEQ ID NO: 41794 - RNA, 32 nt, Human
acugggguccucuugguucugccugcagccug

SEQ ID NO: 41795 - RNA, 32 nt, Human
acuggggucucccacaagguggggucaggaga

SEQ ID NO: 41796 - RNA, 32 nt, Human
acuggggucuccugcccucucuguugagccag

SEQ ID NO: 41797 - RNA, 32 nt, Human
acuggggugggagggggcagggggcuuggcuc

SEQ ID NO: 41798 - RNA, 32 nt, Human
acugggguuuguacaugcuggggaggagccuu

SEQ ID NO: 41799 - RNA, 32 nt, Human
acugggguuuuauuucugaagcauuuuauagg

SEQ ID NO: 41800 - RNA, 32 nt, Human
acuggguacagaugaggagcaggugcauugga

SEQ ID NO: 41801 - RNA, 32 nt, Human
acuggguacaguaccuccagccccagggcccu

SEQ ID NO: 41802 - RNA, 32 nt, Human
acuggguagcuggugugaacacaggggguacu

SEQ ID NO: 41803 - RNA, 32 nt, Human
acuggguaugaaacuauuugauuucuagucuu

SEQ ID NO: 41804 - RNA, 32 nt, Human
acuggguaugccucucuauccucucuccuccc

SEQ ID NO: 41805 - RNA, 32 nt, Human
acuggguauggagggucuugagugucagcagg

SEQ ID NO: 41806 - RNA, 32 nt, Human
acugggucaaagcugcaugaaaccaggcccug

SEQ ID NO: 41807 - RNA, 32 nt, Human
acugggucaaagcuuauuuaaguauacggaca

SEQ ID NO: 41808 - RNA, 32 nt, Human
acugggucagcccucagaaacugcagcagcca

SEQ ID NO: 41809 - RNA, 32 nt, Human
acugggucaggaguuugagaccagccuggcca

SEQ ID NO: 41810 - RNA, 19 nt, Human
acugggucucacuauguug

SEQ ID NO: 41811 - RNA, 19 nt, Human
acugggucucaguauguug

SEQ ID NO: 41812 - RNA, 32 nt, Human
acugggucucucucaaggccacucggcuacuc

SEQ ID NO: 41813 - RNA, 32 nt, Human
acugggucucucuccacccgggagcugaggag

SEQ ID NO: 41814 - RNA, 32 nt, Human
acugggucugggggcucccuggagcuccuccu

SEQ ID NO: 41815 - RNA, 32 nt, Human
acugggucuuggcuggguugaagguuccaagc

SEQ ID NO: 41816 - RNA, 32 nt, Human
acugggugaaucuggcaggaaucuauccauug

SEQ ID NO: 41817 - RNA, 32 nt, Human
acugggugagaaaggaacagguggauuuugaa

SEQ ID NO: 41818 - RNA, 32 nt, Human
acugggugccguggagcuuagccucagcgagu

SEQ ID NO: 41819 - RNA, 18 nt, Human
acugggugcguucacuga

SEQ ID NO: 41820 - RNA, 32 nt, Human
acuggguggagaaaggagacuugcccaccugu

SEQ ID NO: 41821 - RNA, 32 nt, Human
acuggguggagcuguggcagggggcacugagc

SEQ ID NO: 41822 - RNA, 32 nt, Human
acugggugucuuuuucuuuucaucuggcaacc

SEQ ID NO: 41823 - RNA, 32 nt, Human
acugggugugaggcacacagccuaaagucagc

SEQ ID NO: 41824 - RNA, 32 nt, Human
acuggguguggccuggcuucugggacaggcac

SEQ ID NO: 41825 - RNA, 32 nt, Human
acugggugugggccgugagguuuaggaggcuu

SEQ ID NO: 41826 - RNA, 32 nt, Human
acuggguuaaauauuuugcuaacugguuaaac

SEQ ID NO: 41827 - RNA, 32 nt, Human
acuggguuucgcuguguuagccuggauggucu

SEQ ID NO: 41828 - RNA, 32 nt, Human
acuggguuucuagcccauggacuucacauaag

SEQ ID NO: 41829 - RNA, 32 nt, Human
acugguaaaauuauaugguuuauuuuaaaugc

SEQ ID NO: 41830 - RNA, 32 nt, Human
acugguaacaggcugggugcaauggcucacac

SEQ ID NO: 41831 - RNA, 20 nt, Human
acugguaauuccaggugcug

SEQ ID NO: 41832 - RNA, 32 nt, Human
acugguaauuccaggugcugcgcuuggcagag

SEQ ID NO: 41833 - RNA, 32 nt, Human
acugguaccaaaacagauauagaucaauggaa

SEQ ID NO: 41834 - RNA, 32 nt, Human
acugguaccaacacagauauagagaccucaga

SEQ ID NO: 41835 - RNA, 32 nt, Human
acugguacgugggugaggggauggaggaaggc

SEQ ID NO: 41836 - RNA, 23 nt, Human
acugguacuauagcauuuugcua

SEQ ID NO: 41837 - RNA, 32 nt, Human
acugguacuguugccaagcaaucugcuuggaa

SEQ ID NO: 41838 - RNA, 32 nt, Human
acugguacuuccuuucaguagggcgcuaaugu

SEQ ID NO: 41839 - RNA, 32 nt, Human
acugguagcucccugcuaguuugcugucuucc

SEQ ID NO: 41840 - RNA, 32 nt, Human
acugguaggaugagggauauuauggugggaaa

SEQ ID NO: 41841 - RNA, 32 nt, Human
acugguauaaauacaucucucuccaauuuggc

SEQ ID NO: 41842 - RNA, 32 nt, Human
acugguauagcuguggagagggagacauuucu

SEQ ID NO: 41843 - RNA, 32 nt, Human
acugguauccacuccauaccacagcccuuggc

SEQ ID NO: 41844 - RNA, 32 nt, Human
acugguaugaacagaucugauuucuuacagag

SEQ ID NO: 41845 - RNA, 32 nt, Human
acugguauugcugcuggagggcugugggcucc

SEQ ID NO: 41846 - RNA, 28 nt, Human
acuggucaagugaaugccucauguuucu

SEQ ID NO: 41847 - RNA, 32 nt, Human
acuggucagacucuauagcuuccaaaccaucg

SEQ ID NO: 41848 - RNA, 31 nt, Human
acuggucagagaguucgcaguggggagaagu

SEQ ID NO: 41849 - RNA, 18 nt, Human
acuggucagcuuagcucu

SEQ ID NO: 41850 - RNA, 32 nt, Human
acuggucaggcugugccuucaccucuguagcu

SEQ ID NO: 41851 - RNA, 32 nt, Human
acuggucaggggcagagucugggugcuguccu

SEQ ID NO: 41852 - RNA, 32 nt, Human
acuggucaguuauuuaaaauacuggcauaccu

SEQ ID NO: 41853 - RNA, 32 nt, Human
acuggucauacaggguaagcaccagggacaau

SEQ ID NO: 41854 - RNA, 32 nt, Human
acuggucaugccaggcacacacugcugcccaa

SEQ ID NO: 41855 - RNA, 32 nt, Human
acugguccagauguccccgccccacaucccuu

SEQ ID NO: 41856 - RNA, 32 nt, Human
acugguccagcucugacaucccuuccuggaaa

SEQ ID NO: 41857 - RNA, 32 nt, Human
acugguccagcugcccugggcuccuuuucuau

SEQ ID NO: 41858 - RNA, 32 nt, Human
acuggucccacacgcaccccaggccccacucc

SEQ ID NO: 41859 - RNA, 32 nt, Human
acugguccccaccuuucccuugccuaucccua

SEQ ID NO: 41860 - RNA, 32 nt, Human
acuggucccugccugacagcaccugcugggcc

SEQ ID NO: 41861 - RNA, 32 nt, Human
acugguccuuucucagccucucucgugcuuuu

SEQ ID NO: 41862 - RNA, 32 nt, Human
acuggucgagcuguuugaggccaucgagcaga

SEQ ID NO: 41863 - RNA, 32 nt, Human
acuggucggaagagagaaagaacaguuucagu

SEQ ID NO: 41864 - RNA, 32 nt, Human
acuggucggugcugccugguccuggccugggg

SEQ ID NO: 41865 - RNA, 32 nt, Human
acuggucuacacacacagaggaugcuggauac

SEQ ID NO: 41866 - RNA, 32 nt, Human
acuggucuccacugccaugccuuuucaagguu

SEQ ID NO: 41867 - RNA, 32 nt, Human
acuggucucccugcuucauucuugccccacac

SEQ ID NO: 41868 - RNA, 32 nt, Human
acuggucucucagaggagucccccagggcccg

SEQ ID NO: 41869 - RNA, 32 nt, Human
acuggucucugccugggcucaaccucugugau

SEQ ID NO: 41870 - RNA, 32 nt, Human
acuggucugcugcugcaggcuucaucuaaaac

SEQ ID NO: 41871 - RNA, 32 nt, Human
acuggugaacacuucagccuuaaugaguguau

SEQ ID NO: 41872 - RNA, 32 nt, Human
acuggugaacagugucugugggcugcuguggg

SEQ ID NO: 41873 - RNA, 32 nt, Human
acuggugaccaccaccccuucuugucacuguc

SEQ ID NO: 41874 - RNA, 32 nt, Human
acuggugacuccaggaaccauuuucaccuauu

SEQ ID NO: 41875 - RNA, 32 nt, Human
acuggugagauuacaggcaugagccaccacaa

SEQ ID NO: 41876 - RNA, 31 nt, Human
acuggugagggggcagcaugggugaagccca

SEQ ID NO: 41877 - RNA, 32 nt, Human
acuggugcaaauggguccagaauuuucaaauc

SEQ ID NO: 41878 - RNA, 32 nt, Human
acuggugcaggcucguuguaccacugcaaccg

SEQ ID NO: 41879 - RNA, 32 nt, Human
acuggugcauuuucauguauguuguaccucaa

SEQ ID NO: 41880 - RNA, 32 nt, Human
acuggugccugccucccacauuugcccuuggu

SEQ ID NO: 41881 - RNA, 32 nt, Human
acuggugcuccaggaaccagguggugacgaac

SEQ ID NO: 41882 - RNA, 32 nt, Human
acuggugcugugcuccagccuuaucaguuagg

SEQ ID NO: 41883 - RNA, 18 nt, Human
acugguggaaagcagcag

SEQ ID NO: 41884 - RNA, 32 nt, Human
acugguggaggaacugcccuggccuagagacc

SEQ ID NO: 41885 - RNA, 32 nt, Human
acugguggcacguuccuuuaaucccagcuacu

SEQ ID NO: 41886 - RNA, 32 nt, Human
acugguggcauuuugccccugcccugagaucu

SEQ ID NO: 41887 - RNA, 32 nt, Human
acugguggccagugggaggugaugguggaccu

SEQ ID NO: 41888 - RNA, 32 nt, Human
acugguggcuacagcuacaucacgggaggagg

SEQ ID NO: 41889 - RNA, 32 nt, Human
acuggugggaggcuggcggagucagugacuau

SEQ ID NO: 41890 - RNA, 32 nt, Human
acuggugggccaucuguucuucuggcugacau

SEQ ID NO: 41891 - RNA, 32 nt, Human
acugguggucacggcucacucuagccuugaau

SEQ ID NO: 41892 - RNA, 32 nt, Human
acuggugguggugggagaucaggaaaauaacu

SEQ ID NO: 41893 - RNA, 32 nt, Human
acuggugucuucaggggccacaccaaccuucu

SEQ ID NO: 41894 - RNA, 32 nt, Human
acugguguggauggcccaggaggugcuggagc

SEQ ID NO: 41895 - RNA, 32 nt, Human
acugguguugggggcagugggaagaggguggu

SEQ ID NO: 41896 - RNA, 32 nt, Human
acugguguuuauauuugcacaaaguauugaua

SEQ ID NO: 41897 - RNA, 32 nt, Human
acugguguuuauccgucacucgccgagguucc

SEQ ID NO: 41898 - RNA, 32 nt, Human
acugguuaaguacagggucaccagagaaaguu

SEQ ID NO: 41899 - RNA, 32 nt, Human
acugguuaguauaucucaguaguuucaugaaa

SEQ ID NO: 41900 - RNA, 32 nt, Human
acugguuauagugggauaggaggcagaaaaug

SEQ ID NO: 41901 - RNA, 32 nt, Human
acugguucauucuccauuacugcaagagaaug

SEQ ID NO: 41902 - RNA, 32 nt, Human
acugguuccucugcucugaggguggguccagg

SEQ ID NO: 41903 - RNA, 32 nt, Human
acugguuccuucagaucagccacaccuuuucc

SEQ ID NO: 41904 - RNA, 32 nt, Human
acugguucucaaacuuuuuggucucagacccc

SEQ ID NO: 41905 - RNA, 32 nt, Human
acugguucucagugggagguaauggaaaguag

SEQ ID NO: 41906 - RNA, 32 nt, Human
acugguucugcagcuuguccuuuugcccacau

SEQ ID NO: 41907 - RNA, 32 nt, Human
acugguugaaaccucuggaaguacagaaggga

SEQ ID NO: 41908 - RNA, 32 nt, Human
acugguugaggguggaaccuccaggcaggaac

SEQ ID NO: 41909 - RNA, 32 nt, Human
acugguugcagaggcuggaagugaaauaaaga

SEQ ID NO: 41910 - RNA, 32 nt, Human
acugguuguagcuuucauggguucugaacuaa

SEQ ID NO: 41911 - RNA, 32 nt, Human
acugguuucacucugucucccagggccaggcc

SEQ ID NO: 41912 - RNA, 32 nt, Human
acugguuuccucagccuuccuucagccuguaa

SEQ ID NO: 41913 - RNA, 32 nt, Human
acugguuucucuccuuagaaaaguagguuucu

SEQ ID NO: 41914 - RNA, 32 nt, Human
acugguuuuccccaaagcuggcaguuuugugg

SEQ ID NO: 41915 - RNA, 32 nt, Human
acugguuuugcugugguuggauacagauacca

SEQ ID NO: 41916 - RNA, 19 nt, Human
acuguaaacauuagcucuu

SEQ ID NO: 41917 - RNA, 32 nt, Human
acuguaaagcagguggugggagaaguaccaau

SEQ ID NO: 41918 - RNA, 32 nt, Human
acuguaacaaaggagcuucuuguccccuuggu

SEQ ID NO: 41919 - RNA, 32 nt, Human
acuguaacacuuuccucugccuuuuucucuua

SEQ ID NO: 41920 - RNA, 32 nt, Human
acuguaaccuaaauguauuacuucugauaaaa

SEQ ID NO: 41921 - RNA, 32 nt, Human
acuguaacuaugacaguagaguuugauaccug

SEQ ID NO: 41922 - RNA, 32 nt, Human
acuguaagaaauaaaucucuguucuuuauaaa

SEQ ID NO: 41923 - RNA, 32 nt, Human
acuguaagcagucuggguugggcagaaggcag

SEQ ID NO: 41924 - RNA, 32 nt, Human
acuguaagccaguuuuagcugcacugauuuca

SEQ ID NO: 41925 - RNA, 24 nt, Human
acuguaagcuccgccucccggguu

SEQ ID NO: 41926 - RNA, 32 nt, Human
acuguaaggcagcaguguuagcaugggaguaa

SEQ ID NO: 41927 - RNA, 32 nt, Human
acuguaaggcguggaauaggaguugcucagug

SEQ ID NO: 41928 - RNA, 23 nt, Human
acuguaaguuccuagcuggcuag

SEQ ID NO: 41929 - RNA, 18 nt, Human
acuguaauaagcucauca

SEQ ID NO: 41930 - RNA, 32 nt, Human
acuguaaucacagugacucaggaggcugaggu

SEQ ID NO: 41931 - RNA, 32 nt, Human
acuguaaucccagcuacucaggaggcugaggc

SEQ ID NO: 41932 - RNA, 32 nt, Human
acuguaaugucaucaaaugcaauguuuuuauu

SEQ ID NO: 41933 - RNA, 32 nt, Human
acuguacaaucaguaaugggaugcucuaaaga

SEQ ID NO: 41934 - RNA, 32 nt, Human
acuguacagaggaaacucaagccuuaaauguu

SEQ ID NO: 41935 - RNA, 32 nt, Human
acuguacaguaauggucaacuuugccacuugc

SEQ ID NO: 41936 - RNA, 32 nt, Human
acuguacaucaggagauuguguuguuuucuuc

SEQ ID NO: 41937 - RNA, 32 nt, Human
acuguacaugugcugagagaagcauccugccc

SEQ ID NO: 41938 - RNA, 32 nt, Human
acuguaccaagcuuugcagaucuuuuccgaca

SEQ ID NO: 41939 - RNA, 32 nt, Human
acuguaccagagggccagggaggaggagaaag

SEQ ID NO: 41940 - RNA, 32 nt, Human
acuguacccagaggugccugagguccuaaaac

SEQ ID NO: 41941 - RNA, 32 nt, Human
acuguacccugagacagguccccaccacccca

SEQ ID NO: 41942 - RNA, 32 nt, Human
acuguacccuguuccuccugggcucaagugau

SEQ ID NO: 41943 - RNA, 32 nt, Human
acuguaccugccugcugaacagccugcccccg

SEQ ID NO: 41944 - RNA, 32 nt, Human
acuguacgacagagcaagacuccgucucaaaa

SEQ ID NO: 41945 - RNA, 32 nt, Human
acuguacgcaaguugagugccagaccucuagu

SEQ ID NO: 41946 - RNA, 32 nt, Human
acuguacuaaccuacagagaugcuaagagaaa

SEQ ID NO: 41947 - RNA, 32 nt, Human
acuguacuaauucuuacacugccuguauacuu

SEQ ID NO: 41948 - RNA, 32 nt, Human
acuguacuacuguacuccagccugggggaaag

SEQ ID NO: 41949 - RNA, 32 nt, Human
acuguacuccagccuggaugacagaguggaga

SEQ ID NO: 41950 - RNA, 32 nt, Human
acuguacuccagccugggcaacagagugagac

SEQ ID NO: 41951 - RNA, 32 nt, Human
acuguacuccagccugggcgacggagugagac

SEQ ID NO: 41952 - RNA, 32 nt, Human
acuguacuccagccugggugacagagugagac

SEQ ID NO: 41953 - RNA, 32 nt, Human
acuguacuccagccugggugacagagugaggc

SEQ ID NO: 41954 - RNA, 32 nt, Human
acuguacuccagccugggugacagagugauac

SEQ ID NO: 41955 - RNA, 32 nt, Human
acuguacuccagccugggugacgagcgaaacu

SEQ ID NO: 41956 - RNA, 32 nt, Human
acuguacuccagccugggugaggagagcgaga

SEQ ID NO: 41957 - RNA, 32 nt, Human
acuguacuccagccugggugauaggaugagac

SEQ ID NO: 41958 - RNA, 32 nt, Human
acuguacuccugggauaugggggcgggggcgg

SEQ ID NO: 41959 - RNA, 32 nt, Human
acuguacucuccaauaaagcaccuuguugaaa

SEQ ID NO: 41960 - RNA, 32 nt, Human
acuguacucuucucagcuugagcuuaacauag

SEQ ID NO: 41961 - RNA, 32 nt, Human
acuguacuguucaagucaauguuaauaaagca

SEQ ID NO: 41962 - RNA, 32 nt, Human
acuguacuugcagccccugccaugaggucaau

SEQ ID NO: 41963 - RNA, 32 nt, Human
acuguagaagugaaaguaauuucacaauuaaa

SEQ ID NO: 41964 - RNA, 32 nt, Human
acuguagacuccugcauagccuuccaaaguuc

SEQ ID NO: 41965 - RNA, 31 nt, Human
acuguagacuuucagcagcaaucucagaagc

SEQ ID NO: 41966 - RNA, 32 nt, Human
acuguagaggugagguuucaccauguugccca

SEQ ID NO: 41967 - RNA, 23 nt, Human
acuguagaugaucacaugaugaa

SEQ ID NO: 41968 - RNA, 24 nt, Human
acuguagaugccccaaggaaccaa

SEQ ID NO: 41969 - RNA, 32 nt, Human
acuguagauugcuucuguaguacuccuuaaga

SEQ ID NO: 41970 - RNA, 32 nt, Human
acuguagcacuggccucugugccacagcuacu

SEQ ID NO: 41971 - RNA, 32 nt, Human
acuguagcagcaaaagcaaauuggucuccaca

SEQ ID NO: 41972 - RNA, 32 nt, Human
acuguagcauucuaucacaauaucaucuggaa

SEQ ID NO: 41973 - RNA, 32 nt, Human
acuguagcccaggucauuguauuucagacaua

SEQ ID NO: 41974 - RNA, 32 nt, Human
acuguagccccugcuggcugagcuccagccug

SEQ ID NO: 41975 - RNA, 32 nt, Human
acuguagccuaaacuccaguccgagguuggau

SEQ ID NO: 41976 - RNA, 32 nt, Human
acuguagccuuuuaagcuucagucucagcaga

SEQ ID NO: 41977 - RNA, 32 nt, Human
acuguagcgucugccugcucccuggacucgca

SEQ ID NO: 41978 - RNA, 32 nt, Human
acuguagcuucaguuauuggugagucuaagga

SEQ ID NO: 41979 - RNA, 32 nt, Human
acuguagcuuguuguuugggggaccaaauuuu

SEQ ID NO: 41980 - RNA, 32 nt, Human
acuguagggcugggcagcugggagacaggcuc

SEQ ID NO: 41981 - RNA, 32 nt, Human
acuguagggcugggcgcagcaucccuaggucu

SEQ ID NO: 41982 - RNA, 32 nt, Human
acuguagguccagaaaacuaauuauuggcauc

SEQ ID NO: 41983 - RNA, 32 nt, Human
acuguaggugggagggagcugauuuuggggug

SEQ ID NO: 41984 - RNA, 32 nt, Human
acuguaguaaagcccugaaauagauaaucucu

SEQ ID NO: 41985 - RNA, 32 nt, Human
acuguagucagcugggaauggggaaggugcau

SEQ ID NO: 41986 - RNA, 32 nt, Human
acuguagucccagcuacucaggagacugaggc

SEQ ID NO: 41987 - RNA, 32 nt, Human
acuguagucccagcuacucaggcugaggcagg

SEQ ID NO: 41988 - RNA, 32 nt, Human
acuguagucccagcuacucgcgagacugaggc

SEQ ID NO: 41989 - RNA, 32 nt, Human
acuguagucccagcuacucgggaggcugaggc

SEQ ID NO: 41990 - RNA, 32 nt, Human
acuguagucccagcuacucgggagguugaggc

SEQ ID NO: 41991 - RNA, 32 nt, Human
acuguagucccagcuauucagaaggcugaggc

SEQ ID NO: 41992 - RNA, 32 nt, Human
acuguagucucaaccuccugggcucaagagau

SEQ ID NO: 41993 - RNA, 32 nt, Human
acuguagucucccacugugggaguugccuugc

SEQ ID NO: 41994 - RNA, 22 nt, Human
acuguagucucugaguccuuug

SEQ ID NO: 41995 - RNA, 32 nt, Human
acuguaguggagcugcucaaccaccugcccag

SEQ ID NO: 41996 - RNA, 32 nt, Human
acuguaguggcuguaauacaugaugauguggg

SEQ ID NO: 41997 - RNA, 32 nt, Human
acuguaguucaagugacuuuccuacuuuugua

SEQ ID NO: 41998 - RNA, 32 nt, Human
acuguaguuucuucaugcuuuccagaguuaga

SEQ ID NO: 41999 - RNA, 32 nt, Human
acuguaguuugucagagacuccaguuuacauc

SEQ ID NO: 42000 - RNA, 32 nt, Human
acuguauaccaggaacacaaauucauuaaauc

SEQ ID NO: 42001 - RNA, 32 nt, Human
acuguauaugaccuuaaucuuugugcagccug

SEQ ID NO: 42002 - RNA, 32 nt, Human
acuguaucacccaggccagaguguaguggcac

SEQ ID NO: 42003 - RNA, 32 nt, Human
acuguaucagccccaagcaggugguggucccu

SEQ ID NO: 42004 - RNA, 32 nt, Human
acuguaucagguacauuccagccuguuggcaa

SEQ ID NO: 42005 - RNA, 32 nt, Human
acuguaucuaccgaagaugguuugcugaaagc

SEQ ID NO: 42006 - RNA, 32 nt, Human
acuguaucugccucugugccugugcacaugaa

SEQ ID NO: 42007 - RNA, 32 nt, Human
acuguaucuggaaugcuuuguaauacuugcau

SEQ ID NO: 42008 - RNA, 32 nt, Human
acuguaugacaauuaccaggugcucuacugcu

SEQ ID NO: 42009 - RNA, 32 nt, Human
acuguaugagacagaggggacuucagucuuuc

SEQ ID NO: 42010 - RNA, 32 nt, Human
acuguaugaggaggaggaggaggaggauguga

SEQ ID NO: 42011 - RNA, 32 nt, Human
acuguaugcucacaacuuaguguaauauacca

SEQ ID NO: 42012 - RNA, 32 nt, Human
acuguauggcuacaguucaugguauaagguca

SEQ ID NO: 42013 - RNA, 32 nt, Human
acuguauguaauucuaauuaccuuauaacagu

SEQ ID NO: 42014 - RNA, 32 nt, Human
acuguaugugcaugcauucacacacacauaug

SEQ ID NO: 42015 - RNA, 32 nt, Human
acuguauguggacuguggagaaaguaagucac

SEQ ID NO: 42016 - RNA, 32 nt, Human
acuguaugugugugccuugcacacacacccau

SEQ ID NO: 42017 - RNA, 32 nt, Human
acuguauguguguuccuugaagccaggugcag

SEQ ID NO: 42018 - RNA, 32 nt, Human
acuguauuaguccauucucacacugcuauaaa

SEQ ID NO: 42019 - RNA, 32 nt, Human
acuguauuccagccuggacgacugagugagac

SEQ ID NO: 42020 - RNA, 32 nt, Human
acuguauucugugccuuccaucaugauuucca

SEQ ID NO: 42021 - RNA, 32 nt, Human
acuguauuugacaaaggaaacucuuaaauuau

SEQ ID NO: 42022 - RNA, 32 nt, Human
acuguauuuuuauuaaauaaaauuuaaacauc

SEQ ID NO: 42023 - RNA, 32 nt, Human
acugucaaacaauaaagggagaauggugcugu

SEQ ID NO: 42024 - RNA, 32 nt, Human
acugucaaacuuugucacccuaacuucguauu

SEQ ID NO: 42025 - RNA, 32 nt, Human
acugucaaauagccuccuaaaagaugaguuug

SEQ ID NO: 42026 - RNA, 32 nt, Human
acugucaaccaggccagagugcagugaagauc

SEQ ID NO: 42027 - RNA, 32 nt, Human
acugucaagggaggugcuggagagggauuaac

SEQ ID NO: 42028 - RNA, 32 nt, Human
acugucaauuguucucagauuuggcauggaua

SEQ ID NO: 42029 - RNA, 30 nt, Human
acugucacaagaaauauuuccaccucaaaa

SEQ ID NO: 42030 - RNA, 32 nt, Human
acugucacagcccuccccaccccacauccagg

SEQ ID NO: 42031 - RNA, 32 nt, Human
acugucacagccggguccucaaacagcuccga

SEQ ID NO: 42032 - RNA, 32 nt, Human
acugucacagguauuuuugcugugcugugcaa

SEQ ID NO: 42033 - RNA, 32 nt, Human
acugucaccaaacagaccaucuucccaggccu

SEQ ID NO: 42034 - RNA, 32 nt, Human
acugucaccaggcuggagugcaguggugcaau

SEQ ID NO: 42035 - RNA, 32 nt, Human
acugucacccaggcugcuggaguacaguggca

SEQ ID NO: 42036 - RNA, 32 nt, Human
acugucacccaugagguauggaaggagcgggc

SEQ ID NO: 42037 - RNA, 32 nt, Human
acugucaccuaggcuggagugcagugguaaau

SEQ ID NO: 42038 - RNA, 23 nt, Human
acugucaccuucucuucaucaca

SEQ ID NO: 42039 - RNA, 32 nt, Human
acugucacgccuguaaucccaguacuuuggga

SEQ ID NO: 42040 - RNA, 32 nt, Human
acugucacugcacauggaccucugggaagacg

SEQ ID NO: 42041 - RNA, 24 nt, Human
acugucacuucuuuggcugggcag

SEQ ID NO: 42042 - RNA, 32 nt, Human
acugucagaccacaucugcagcucugauuagu

SEQ ID NO: 42043 - RNA, 32 nt, Human
acugucagauuugccaagucacagaggcgcag

SEQ ID NO: 42044 - RNA, 32 nt, Human
acugucagccaugcaagccucaguuuucccau

SEQ ID NO: 42045 - RNA, 24 nt, Human
acugucagcucucauauucuucca

SEQ ID NO: 42046 - RNA, 32 nt, Human
acugucagcuggguuucaugucaucuucugcu

SEQ ID NO: 42047 - RNA, 32 nt, Human
acugucagcuguaaguggaagcaauauuacuu

SEQ ID NO: 42048 - RNA, 32 nt, Human
acugucagggagggccagggaggcagagcggg

SEQ ID NO: 42049 - RNA, 32 nt, Human
acugucagggcccagagagaagaaaaagacag

SEQ ID NO: 42050 - RNA, 32 nt, Human
acugucaggggcccuguccucaaccccggguc

SEQ ID NO: 42051 - RNA, 32 nt, Human
acugucaggggcccuguccucaacccuggguc

SEQ ID NO: 42052 - RNA, 32 nt, Human
acugucagguaucaugucugcuuucuaagugg

SEQ ID NO: 42053 - RNA, 32 nt, Human
acugucagucucacuucugcugucccaguccu

SEQ ID NO: 42054 - RNA, 32 nt, Human
acugucagugaguguucuuuaggugguaggac

SEQ ID NO: 42055 - RNA, 32 nt, Human
acugucagugcuagauuuagcacaguauuuug

SEQ ID NO: 42056 - RNA, 32 nt, Human
acugucaguuuaugcugacguaaugaacugcg

SEQ ID NO: 42057 - RNA, 32 nt, Human
acugucaucacuggggcagggaaguccuguuc

SEQ ID NO: 42058 - RNA, 32 nt, Human
acugucauccuaacguuugucauuccaguuug

SEQ ID NO: 42059 - RNA, 21 nt, Human
acugucaucuggacagcuguu

SEQ ID NO: 42060 - RNA, 32 nt, Human
acugucaucuugcuucccaaucuaagaaccug

SEQ ID NO: 42061 - RNA, 19 nt, Human
acugucaucuuuucucaug

SEQ ID NO: 42062 - RNA, 32 nt, Human
acugucauggugcuggcaggaauggcuaaggg

SEQ ID NO: 42063 - RNA, 25 nt, Human
acugucauuaugcguuuuagccucu

SEQ ID NO: 42064 - RNA, 32 nt, Human
acugucauuccuuggugucugugcugggcaug

SEQ ID NO: 42065 - RNA, 20 nt, Human
acugucauuguucagcgcuu

SEQ ID NO: 42066 - RNA, 24 nt, Human
acugucauuguuguugcccagagc

SEQ ID NO: 42067 - RNA, 32 nt, Human
acuguccaaaaacagaagaagaagaagagaau

SEQ ID NO: 42068 - RNA, 32 nt, Human
acuguccaaguuacgacuuccaaccaaacuau

SEQ ID NO: 42069 - RNA, 32 nt, Human
acuguccagaucuagucuguaaacccagcuua

SEQ ID NO: 42070 - RNA, 32 nt, Human
acuguccagccaagggccccuacgucucagcc

SEQ ID NO: 42071 - RNA, 32 nt, Human
acuguccaggagaugcaugucuuuguauugga

SEQ ID NO: 42072 - RNA, 32 nt, Human
acuguccagggaaagagccaggaauggcagug

SEQ ID NO: 42073 - RNA, 32 nt, Human
acuguccauauucuccagaggauuaccuggcu

SEQ ID NO: 42074 - RNA, 32 nt, Human
acuguccauuucucccugucugucccaugggc

SEQ ID NO: 42075 - RNA, 32 nt, Human
acugucccaccgccuccugccucucuccucuc

SEQ ID NO: 42076 - RNA, 32 nt, Human
acugucccacuccaucacccaggcuggagucc

SEQ ID NO: 42077 - RNA, 32 nt, Human
acugucccagagacaccugagccaccccacag

SEQ ID NO: 42078 - RNA, 32 nt, Human
acugucccauccccagguccccaaacuuaugg

SEQ ID NO: 42079 - RNA, 32 nt, Human
acuguccccacagcaggugccuggugggccag

SEQ ID NO: 42080 - RNA, 32 nt, Human
acuguccccagagccuguggagauagagccug

SEQ ID NO: 42081 - RNA, 32 nt, Human
acuguccccagccugccugccuccguuucccu

SEQ ID NO: 42082 - RNA, 32 nt, Human
acugucccccauuaguucuguccccuucacaa

SEQ ID NO: 42083 - RNA, 19 nt, Human
acugucccccuggccggcu

SEQ ID NO: 42084 - RNA, 32 nt, Human
acugucccccuuccucuucuucugccccuuca

SEQ ID NO: 42085 - RNA, 32 nt, Human
acuguccccgcccccuauuuguggacuaaaga

SEQ ID NO: 42086 - RNA, 32 nt, Human
acuguccccuggcaguaccacagccuuauccu

SEQ ID NO: 42087 - RNA, 32 nt, Human
acugucccuaguaguugggauuacaggcacau

SEQ ID NO: 42088 - RNA, 32 nt, Human
acugucccugcuccucggugugacuugcuccc

SEQ ID NO: 42089 - RNA, 32 nt, Human
acugucccugucccuauuuauccaccauccaa

SEQ ID NO: 42090 - RNA, 32 nt, Human
acuguccggagcacuccuucccuucccugguu

SEQ ID NO: 42091 - RNA, 32 nt, Human
acuguccguaauggaaugguaaaacuccauga

SEQ ID NO: 42092 - RNA, 32 nt, Human
acuguccucacacuccuggaucacugagcaga

SEQ ID NO: 42093 - RNA, 32 nt, Human
acuguccucaggaaguggagaucuagccaggu

SEQ ID NO: 42094 - RNA, 32 nt, Human
acuguccuccacugcuagacacccccagaaug

SEQ ID NO: 42095 - RNA, 32 nt, Human
acuguccucccaucucugcccaugagccacag

SEQ ID NO: 42096 - RNA, 19 nt, Human
acuguccucuuuggcucuu

SEQ ID NO: 42097 - RNA, 17 nt, Human
acuguccugagcaaggu

SEQ ID NO: 42098 - RNA, 32 nt, Human
acuguccugcuuguacaacaugguuuggggug

SEQ ID NO: 42099 - RNA, 24 nt, Human
acuguccuggacaacauggugaaa

SEQ ID NO: 42100 - RNA, 32 nt, Human
acuguccuggacaacauggugaaacccugucu

SEQ ID NO: 42101 - RNA, 32 nt, Human
acuguccuggguggagggcaggugaacacaag

SEQ ID NO: 42102 - RNA, 32 nt, Human
acuguccugucaccccuccucgcuacagugau

SEQ ID NO: 42103 - RNA, 32 nt, Human
acuguccugugagcuuuaugucaggagacugu

SEQ ID NO: 42104 - RNA, 32 nt, Human
acuguccugugaggacagcugaggccaaggag

SEQ ID NO: 42105 - RNA, 32 nt, Human
acuguccuguuguggggcuggagcugcuccca

SEQ ID NO: 42106 - RNA, 32 nt, Human
acuguccuuccuggcccuugcauggaugcagu

SEQ ID NO: 42107 - RNA, 32 nt, Human
acuguccuucuuuuucuccucucccucccucc

SEQ ID NO: 42108 - RNA, 32 nt, Human
acuguccuuuaaacuccaguggcuggccaggc

SEQ ID NO: 42109 - RNA, 31 nt, Human
acuguccuuucuucugggccccuggucccag

SEQ ID NO: 42110 - RNA, 18 nt, Human
acuguccuuuucauccca

SEQ ID NO: 42111 - RNA, 32 nt, Human
acugucgaccagauugcuugggccaucggaau

SEQ ID NO: 42112 - RNA, 32 nt, Human
acugucgacuucuuccucuggugaaguggguu

SEQ ID NO: 42113 - RNA, 32 nt, Human
acugucgccaggcuggagugcaguggugcgau

SEQ ID NO: 42114 - RNA, 32 nt, Human
acugucggcucagagcccucugccucaaugcc

SEQ ID NO: 42115 - RNA, 32 nt, Human
acugucgucuucuguuagugccaugcgagucc

SEQ ID NO: 42116 - RNA, 32 nt, Human
acugucuaccuugccagauccucagugcguau

SEQ ID NO: 42117 - RNA, 32 nt, Human
acugucuaggauucagcugaaccaccaggaac

SEQ ID NO: 42118 - RNA, 32 nt, Human
acugucuauuugccugcaguccagccuauggc

SEQ ID NO: 42119 - RNA, 32 nt, Human
acugucucaagcugagagauguuuuuaguagc

SEQ ID NO: 42120 - RNA, 32 nt, Human
acugucucacgugacuauuaagcaacuauaca

SEQ ID NO: 42121 - RNA, 32 nt, Human
acugucucaggaguggaaggcaauggcccacu

SEQ ID NO: 42122 - RNA, 32 nt, Human
acugucucauuuccuuuucccaccucuccccu

SEQ ID NO: 42123 - RNA, 32 nt, Human
acugucuccagaacagcaaccacauugaauuc

SEQ ID NO: 42124 - RNA, 32 nt, Human
acugucuccccuuuaccagcaaaccugacuuc

SEQ ID NO: 42125 - RNA, 32 nt, Human
acugucuccuaggcuggagugcagugguguga

SEQ ID NO: 42126 - RNA, 32 nt, Human
acugucuccucugcuccucccaccucaucccu

SEQ ID NO: 42127 - RNA, 32 nt, Human
acugucuccuggcggaccacccccucugacag

SEQ ID NO: 42128 - RNA, 32 nt, Human
acugucucggguuggcucccagccuggagguc

SEQ ID NO: 42129 - RNA, 32 nt, Human
acugucucucggcugcagcccuggugcgaccc

SEQ ID NO: 42130 - RNA, 32 nt, Human
acugucugauuugggcuuucugcuuuacuucc

SEQ ID NO: 42131 - RNA, 32 nt, Human
acugucugcucaggcugguggugacaggaucc

SEQ ID NO: 42132 - RNA, 32 nt, Human
acugucugcuuuucuuuucccuuccacaggcu

SEQ ID NO: 42133 - RNA, 32 nt, Human
acugucuggaaaccacaggcuccagcauauca

SEQ ID NO: 42134 - RNA, 32 nt, Human
acugucuggcccugucugccucugguuccugc

SEQ ID NO: 42135 - RNA, 32 nt, Human
acugucugggcugagagagggggcugcagguu

SEQ ID NO: 42136 - RNA, 28 nt, Human
acugucugguagcucucuagcuggcugg

SEQ ID NO: 42137 - RNA, 32 nt, Human
acugucuuaaauaaaaacucaauguuuaguug

SEQ ID NO: 42138 - RNA, 32 nt, Human
acugucuucccuuggacaauaaugaauguauc

SEQ ID NO: 42139 - RNA, 32 nt, Human
acugucuucuaaccuucccuugccugcuauga

SEQ ID NO: 42140 - RNA, 32 nt, Human
acugucuucucuuccuccuccaccgagucgug

SEQ ID NO: 42141 - RNA, 32 nt, Human
acugucuugacugucacggaacagaucuuguu

SEQ ID NO: 42142 - RNA, 20 nt, Human
acugucuugcacaugccgga

SEQ ID NO: 42143 - RNA, 32 nt, Human
acugucuugcccaggcuggagugcaguggccu

SEQ ID NO: 42144 - RNA, 32 nt, Human
acugucuugcccagguaagcuggggcagagcc

SEQ ID NO: 42145 - RNA, 32 nt, Human
acugucuuggcuguggggcuaggggcuggggc

SEQ ID NO: 42146 - RNA, 32 nt, Human
acugucuugguggcccugggcgagucuugaac

SEQ ID NO: 42147 - RNA, 32 nt, Human
acugucuuugagggaucagagcagaaaccucc

SEQ ID NO: 42148 - RNA, 32 nt, Human
acugugaaaagacacaucacacaaucaccuug

SEQ ID NO: 42149 - RNA, 32 nt, Human
acugugaaagagacaauuugauuggggaagaa

SEQ ID NO: 42150 - RNA, 32 nt, Human
acugugaacauggaagccucagccugaaugug

SEQ ID NO: 42151 - RNA, 32 nt, Human
acugugaacuuucaacuacuaucaaggauaau

SEQ ID NO: 42152 - RNA, 32 nt, Human
acugugaagagagcaggaaaguagugcacagu

SEQ ID NO: 42153 - RNA, 32 nt, Human
acugugacacacuacaccacacacaacagcca

SEQ ID NO: 42154 - RNA, 32 nt, Human
acugugacacugcacuccagccugggcaacag

SEQ ID NO: 42155 - RNA, 32 nt, Human
acugugacacuggcccucccacuucccucuuu

SEQ ID NO: 42156 - RNA, 32 nt, Human
acugugaccacagccccgacgcggggcuguuu

SEQ ID NO: 42157 - RNA, 32 nt, Human
acugugacccucucccuucccugcugccuugc

SEQ ID NO: 42158 - RNA, 22 nt, Human
acugugacccucugcuggccgg

SEQ ID NO: 42159 - RNA, 32 nt, Human
acugugaccugccgaaguccacugccuuugcc

SEQ ID NO: 42160 - RNA, 32 nt, Human
acugugaccugugacaaaucgcugcauuuuua

SEQ ID NO: 42161 - RNA, 32 nt, Human
acugugaccuugagaagauucuucccauucuc

SEQ ID NO: 42162 - RNA, 32 nt, Human
acugugagacugugggagauuuacugcgacau

SEQ ID NO: 42163 - RNA, 32 nt, Human
acugugagcaccacugcacuaagccagugcgg

SEQ ID NO: 42164 - RNA, 32 nt, Human
acugugagccguaccaguaccccuacgugcau

SEQ ID NO: 42165 - RNA, 32 nt, Human
acugugagcucuacagaccgauuugcacccau

SEQ ID NO: 42166 - RNA, 32 nt, Human
acugugagcuguucccgccuagccagggccau

SEQ ID NO: 42167 - RNA, 32 nt, Human
acugugaggaagagcaggcaccagcagcagaa

SEQ ID NO: 42168 - RNA, 32 nt, Human
acugugaggagagaggcggacugugaggcagc

SEQ ID NO: 42169 - RNA, 32 nt, Human
acugugaggagcuugugccugccugugcagag

SEQ ID NO: 42170 - RNA, 32 nt, Human
acugugaggagguggagaacguggcagggauc

SEQ ID NO: 42171 - RNA, 32 nt, Human
acugugagggcgcacuggguccuuugggguuu

SEQ ID NO: 42172 - RNA, 32 nt, Human
acugugaguucauuaaaccucuuuccuuuaua

SEQ ID NO: 42173 - RNA, 32 nt, Human
acugugaguuucccuccuuccuucccucuaau

SEQ ID NO: 42174 - RNA, 32 nt, Human
acugugaucaaggcugaggccaccugggauga

SEQ ID NO: 42175 - RNA, 32 nt, Human
acugugaugccgaggguggagugcaguggcac

SEQ ID NO: 42176 - RNA, 32 nt, Human
acugugaugggcaguggaaagaagagggaaag

SEQ ID NO: 42177 - RNA, 32 nt, Human
acugugauuagacggcagccucgaugaucacc

SEQ ID NO: 42178 - RNA, 32 nt, Human
acugugauugcacucccagcccagaucagcau

SEQ ID NO: 42179 - RNA, 18 nt, Human
acugugauuuuuaucaca

SEQ ID NO: 42180 - RNA, 32 nt, Human
acugugcaacacagacaagucuucugccagac

SEQ ID NO: 42181 - RNA, 19 nt, Human
acugugcaauaauuucugu

SEQ ID NO: 42182 - RNA, 32 nt, Human
acugugcacaccauuggacugcugaccacagu

SEQ ID NO: 42183 - RNA, 32 nt, Human
acugugcaccugcagcuccacacccucuaggc

SEQ ID NO: 42184 - RNA, 32 nt, Human
acugugcacucuaauccuccaucuucacaugg

SEQ ID NO: 42185 - RNA, 32 nt, Human
acugugcauguaaauuuuaaauggguacuuug

SEQ ID NO: 42186 - RNA, 32 nt, Human
acugugccaccaacaagucuuccucuuggcgc

SEQ ID NO: 42187 - RNA, 32 nt, Human
acugugccaccaagaguccaacucacuggcua

SEQ ID NO: 42188 - RNA, 32 nt, Human
acugugccacucuacuccagccugggcaacac

SEQ ID NO: 42189 - RNA, 32 nt, Human
acugugccacugcaccucuagucugggugaca

SEQ ID NO: 42190 - RNA, 32 nt, Human
acugugccacugcacuccagccugggcaacac

SEQ ID NO: 42191 - RNA, 32 nt, Human
acugugccacugcacuccagccugggugacag

SEQ ID NO: 42192 - RNA, 32 nt, Human
acugugccacugcacuccagccuggucaacaa

SEQ ID NO: 42193 - RNA, 32 nt, Human
acugugccacugcaguccagccugggugacag

SEQ ID NO: 42194 - RNA, 32 nt, Human
acugugccaguacaauacaugccucagccccc

SEQ ID NO: 42195 - RNA, 32 nt, Human
acugugccaguggaagcagguguauugugggc

SEQ ID NO: 42196 - RNA, 32 nt, Human
acugugccauuaaaccucuuuuucuuuauaaa

SEQ ID NO: 42197 - RNA, 32 nt, Human
acugugccauuauguaaauacagguuauuccc

SEQ ID NO: 42198 - RNA, 32 nt, Human
acugugccauugcacuccaagccugggcaaca

SEQ ID NO: 42199 - RNA, 32 nt, Human
acugugccauugcacuccagucggguuaacag

SEQ ID NO: 42200 - RNA, 32 nt, Human
acugugcccacucuuucuggguuuuccaaggg

SEQ ID NO: 42201 - RNA, 32 nt, Human
acugugcccagccgaugagcucauuuagaugg

SEQ ID NO: 42202 - RNA, 32 nt, Human
acugugcccagccuguuccacugacauuucuu

SEQ ID NO: 42203 - RNA, 32 nt, Human
acugugcccagccuuuucuguauuaaauuuuu

SEQ ID NO: 42204 - RNA, 32 nt, Human
acugugcccugccuucagcuuuggugaaaggg

SEQ ID NO: 42205 - RNA, 32 nt, Human
acugugcccugcuggggaggugccagggaaug

SEQ ID NO: 42206 - RNA, 32 nt, Human
acugugcccuggagggcuccacauggcccccg

SEQ ID NO: 42207 - RNA, 32 nt, Human
acugugccuagccauucccuagccuuuucguc

SEQ ID NO: 42208 - RNA, 32 nt, Human
acugugccucgccuaauuuuuguauuuucguu

SEQ ID NO: 42209 - RNA, 32 nt, Human
acugugccugcaggagagccacugccuccccu

SEQ ID NO: 42210 - RNA, 32 nt, Human
acugugccuguccaagaaaacagauuucuuga

SEQ ID NO: 42211 - RNA, 32 nt, Human
acugugccuucauccccauccugggcccugac

SEQ ID NO: 42212 - RNA, 32 nt, Human
acugugccuuuuccuuucuuuuuacacauccu

SEQ ID NO: 42213 - RNA, 32 nt, Human
acugugcggaggcaggauuucccuggggaaag

SEQ ID NO: 42214 - RNA, 32 nt, Human
acugugcgugccacuaccaaagccuucugggc

SEQ ID NO: 42215 - RNA, 32 nt, Human
acugugcuacugcacuccagccugggcaacag

SEQ ID NO: 42216 - RNA, 32 nt, Human
acugugcuccagccugggcaacagagugagac

SEQ ID NO: 42217 - RNA, 32 nt, Human
acugugcugcugcuguggagcggcgccgaccu

SEQ ID NO: 42218 - RNA, 32 nt, Human
acugugcuggcccccauggucacagcugcugc

SEQ ID NO: 42219 - RNA, 32 nt, Human
acugugcuugagugccuggugaagaaugugau

SEQ ID NO: 42220 - RNA, 32 nt, Human
acugugcuuuguuuccucuguuucuuccaauu

SEQ ID NO: 42221 - RNA, 32 nt, Human
acuguggaaaccagaucuguuuagucuccugu

SEQ ID NO: 42222 - RNA, 32 nt, Human
acuguggaacacaaggggagucucagcaucug

SEQ ID NO: 42223 - RNA, 32 nt, Human
acuguggaacugcugcuucuaucagaagaccu

SEQ ID NO: 42224 - RNA, 32 nt, Human
acuguggaaggcugucuuuggcauuuuaauau

SEQ ID NO: 42225 - RNA, 32 nt, Human
acuguggacacauccucuccacccucugggcc

SEQ ID NO: 42226 - RNA, 32 nt, Human
acuguggacacguauggaaagacuggaccccc

SEQ ID NO: 42227 - RNA, 32 nt, Human
acuguggaccuugaaguuagcagcgugggcuu

SEQ ID NO: 42228 - RNA, 32 nt, Human
acuguggaccuuuuauaugugccuucacuuua

SEQ ID NO: 42229 - RNA, 32 nt, Human
acuguggacuccacgacccuguccucggcccu

SEQ ID NO: 42230 - RNA, 32 nt, Human
acuguggacugagaggauggaggcagguccaa

SEQ ID NO: 42231 - RNA, 32 nt, Human
acuguggacuuugcccugaaaccuucugggag

SEQ ID NO: 42232 - RNA, 32 nt, Human
acuguggagcucuaacaguauuuguuuccuga

SEQ ID NO: 42233 - RNA, 32 nt, Human
acuguggagcucuggaaggcuuggugggagug

SEQ ID NO: 42234 - RNA, 23 nt, Human
acuguggaggaauggggaccagg

SEQ ID NO: 42235 - RNA, 32 nt, Human
acuguggaggcugaggugagaggauaccuuga

SEQ ID NO: 42236 - RNA, 32 nt, Human
acuguggagguggagugcagcauuugaccuuu

SEQ ID NO: 42237 - RNA, 20 nt, Human
acuguggagguggcugguca

SEQ ID NO: 42238 - RNA, 32 nt, Human
acuguggagugacaccaguaacacagccaaag

SEQ ID NO: 42239 - RNA, 32 nt, Human
acuguggauccagagacacaggcacgacuaga

SEQ ID NO: 42240 - RNA, 32 nt, Human
acuguggauuguacauuuaacuuuggaauggc

SEQ ID NO: 42241 - RNA, 32 nt, Human
acuguggcaaagccucacaaagcccccucucc

SEQ ID NO: 42242 - RNA, 32 nt, Human
acuguggcacaguccugcucaguuucuagucc

SEQ ID NO: 42243 - RNA, 32 nt, Human
acuguggcagcuccuuguuacuuuccauacca

SEQ ID NO: 42244 - RNA, 32 nt, Human
acuguggcaggugggaauaauccugcccuuga

SEQ ID NO: 42245 - RNA, 32 nt, Human
acuguggccacccggcuugcugccuuccgggg

SEQ ID NO: 42246 - RNA, 32 nt, Human
acuguggccaggucuggaaagccaggcaagac

SEQ ID NO: 42247 - RNA, 23 nt, Human
acuguggccccaccccaagccgu

SEQ ID NO: 42248 - RNA, 32 nt, Human
acuguggcggcggcuccucuucugccugugua

SEQ ID NO: 42249 - RNA, 32 nt, Human
acuguggcuaaguguggggaccagacaggacu

SEQ ID NO: 42250 - RNA, 20 nt, Human
acuguggcucacgccuguaa

SEQ ID NO: 42251 - RNA, 32 nt, Human
acuguggcugccuccccuccacggccuccagg

SEQ ID NO: 42252 - RNA, 32 nt, Human
acuguggcuucaggaugaagacaugagagaaa

SEQ ID NO: 42253 - RNA, 32 nt, Human
acuguggcuucucaauaaauauucagaugucc

SEQ ID NO: 42254 - RNA, 32 nt, Human
acugugggagagagaacaggacccgggaugga

SEQ ID NO: 42255 - RNA, 32 nt, Human
acugugggaggccaagggggcagaucacuuca

SEQ ID NO: 42256 - RNA, 32 nt, Human
acugugggaggcggaggcgggaggaucaugag

SEQ ID NO: 42257 - RNA, 21 nt, Human
acugugggagugauuggccag

SEQ ID NO: 42258 - RNA, 23 nt, Human
acugugggcaaagcggcugcuag

SEQ ID NO: 42259 - RNA, 32 nt, Human
acugugggcagcaucuaagccauguccaaggu

SEQ ID NO: 42260 - RNA, 32 nt, Human
acugugggcaguaucacauggcucucaaaauu

SEQ ID NO: 42261 - RNA, 32 nt, Human
acugugggccacucgcugcagaaauguagaug

SEQ ID NO: 42262 - RNA, 32 nt, Human
acugugggccuccaccaggcgcaggugacccu

SEQ ID NO: 42263 - RNA, 21 nt, Human
acugugggcuaggguggucag

SEQ ID NO: 42264 - RNA, 32 nt, Human
acugugggcugggaggagggaggcaggggaga

SEQ ID NO: 42265 - RNA, 32 nt, Human
acuguggggacaucucgugaggggacacgaaa

SEQ ID NO: 42266 - RNA, 32 nt, Human
acuguggggaggagcaugucagguuugggcuu

SEQ ID NO: 42267 - RNA, 32 nt, Human
acuguggggaggaggaggaagaagaggaggag

SEQ ID NO: 42268 - RNA, 20 nt, Human
acuguggggaggcuggccgg

SEQ ID NO: 42269 - RNA, 32 nt, Human
acuguggggauccccaucuggccucgacaggg

SEQ ID NO: 42270 - RNA, 32 nt, Human
acuguggggccaggcaugaccacucucagguu

SEQ ID NO: 42271 - RNA, 32 nt, Human
acuguggggcuggagcguggugggcaagagga

SEQ ID NO: 42272 - RNA, 23 nt, Human
acuguggggcuucugccggccgg

SEQ ID NO: 42273 - RNA, 32 nt, Human
acugugggguaggucggggagaggguaaggga

SEQ ID NO: 42274 - RNA, 32 nt, Human
acuguggggugagggaaggagcgcuuggaguc

SEQ ID NO: 42275 - RNA, 20 nt, Human
acuguggguacaccuauaaa

SEQ ID NO: 42276 - RNA, 32 nt, Human
acuguggguagccugggauuaggccucaucau

SEQ ID NO: 42277 - RNA, 32 nt, Human
acuguggguauugugacauaaugcugggccca

SEQ ID NO: 42278 - RNA, 32 nt, Human
acuguggucaaagauuuguguguauuuguaag

SEQ ID NO: 42279 - RNA, 32 nt, Human
acuguggucaauaugaauuuaaaccacguagu

SEQ ID NO: 42280 - RNA, 32 nt, Human
acugugguccauggacuacacagugaguagag

SEQ ID NO: 42281 - RNA, 32 nt, Human
acuguggucccagcuacaggggaggcugagac

SEQ ID NO: 42282 - RNA, 32 nt, Human
acuguggucccagcuacucgggaggcugaggg

SEQ ID NO: 42283 - RNA, 32 nt, Human
acuguggucucaaucuccugacuucauggucc

SEQ ID NO: 42284 - RNA, 32 nt, Human
acuguggucuggguccgaaggcugcaagacgc

SEQ ID NO: 42285 - RNA, 32 nt, Human
acuguggugaaauggcuccagaggucuguaca

SEQ ID NO: 42286 - RNA, 32 nt, Human
acuguggugaauuuagcaacacuuaugaaguu

SEQ ID NO: 42287 - RNA, 32 nt, Human
acuguggugagaaaccucacuguccaugguua

SEQ ID NO: 42288 - RNA, 32 nt, Human
acuguggugcggcuucaugugauaugacagug

SEQ ID NO: 42289 - RNA, 32 nt, Human
acuguggugugugcugggcaaauguggccuga

SEQ ID NO: 42290 - RNA, 32 nt, Human
acugugguucuucgagagaagcugcccauccg

SEQ ID NO: 42291 - RNA, 32 nt, Human
acugugguugccugccuucccagcuccacgcg

SEQ ID NO: 42292 - RNA, 32 nt, Human
acuguguaaagaaagaaaaagggaaguaccaa

SEQ ID NO: 42293 - RNA, 32 nt, Human
acuguguaaccuggagaggcaggugugagcgg

SEQ ID NO: 42294 - RNA, 32 nt, Human
acuguguaccagaaucaguuguuggagaaaau

SEQ ID NO: 42295 - RNA, 24 nt, Human
acuguguacccccaggcuggcuag

SEQ ID NO: 42296 - RNA, 21 nt, Human
acuguguacuugucuggucag

SEQ ID NO: 42297 - RNA, 32 nt, Human
acuguguagagacauuuuccacacagccagaa

SEQ ID NO: 42298 - RNA, 32 nt, Human
acuguguagcuaccucacaaccaguccugucu

SEQ ID NO: 42299 - RNA, 32 nt, Human
acuguguauacccuacgagccugcacuccuua

SEQ ID NO: 42300 - RNA, 32 nt, Human
acuguguaugcuggcauucacacucuacucac

SEQ ID NO: 42301 - RNA, 32 nt, Human
acugugucaacaacaggaaacuauuuguauuu

SEQ ID NO: 42302 - RNA, 32 nt, Human
acugugucacccagacuggaaugcagugacac

SEQ ID NO: 42303 - RNA, 32 nt, Human
acugugucacccaggcuggagugcaguggcac

SEQ ID NO: 42304 - RNA, 32 nt, Human
acugugucacccaggcuggagugcaguggcgc

SEQ ID NO: 42305 - RNA, 32 nt, Human
acugugucacccaggcuggagugcaguggugc

SEQ ID NO: 42306 - RNA, 31 nt, Human
acugugucacuuugagggccugucucugggg

SEQ ID NO: 42307 - RNA, 32 nt, Human
acugugucagcaagcugagagggaaacugaag

SEQ ID NO: 42308 - RNA, 32 nt, Human
acugugucauccagagcuggagugcagcggca

SEQ ID NO: 42309 - RNA, 32 nt, Human
acugugucaugcaggcuggagugaagucgugu

SEQ ID NO: 42310 - RNA, 32 nt, Human
acugugucaugcaggcuggagugcaguggcau

SEQ ID NO: 42311 - RNA, 32 nt, Human
acugugucauugcacuccagccugggcgacaa

SEQ ID NO: 42312 - RNA, 32 nt, Human
acuguguccagagacaugggccucccacuccu

SEQ ID NO: 42313 - RNA, 32 nt, Human
acugugucccccaggcuggagugcaguggcac

SEQ ID NO: 42314 - RNA, 32 nt, Human
acuguguccuagagagccucuaugcauuucaa

SEQ ID NO: 42315 - RNA, 32 nt, Human
acugugucgcccaggcuggagugcaaguggca

SEQ ID NO: 42316 - RNA, 32 nt, Human
acugugucgcccaggcuggagugcaguggcgu

SEQ ID NO: 42317 - RNA, 32 nt, Human
acugugucucugaauuccugucuuccaaauug

SEQ ID NO: 42318 - RNA, 32 nt, Human
acugugugaauccaguguucacauucacacuu

SEQ ID NO: 42319 - RNA, 32 nt, Human
acugugugaccagcggaaacagguguguguga

SEQ ID NO: 42320 - RNA, 32 nt, Human
acugugugaccuuaggcuggagugcaauggca

SEQ ID NO: 42321 - RNA, 32 nt, Human
acugugugacugugugggagccuggacugaca

SEQ ID NO: 42322 - RNA, 32 nt, Human
acugugugagagaagaagagaaagcagcagaa

SEQ ID NO: 42323 - RNA, 32 nt, Human
acugugugagccuugggcaaguuacucagccu

SEQ ID NO: 42324 - RNA, 22 nt, Human
acugugugccccaagggccagg

SEQ ID NO: 42325 - RNA, 32 nt, Human
acugugugcucaagguguccaggcuuuugggg

SEQ ID NO: 42326 - RNA, 32 nt, Human
acugugugcuuuuggugggguggagagguggg

SEQ ID NO: 42327 - RNA, 32 nt, Human
acuguguggacugugaugccacacagaguggu

SEQ ID NO: 42328 - RNA, 32 nt, Human
acugugugggaaauagaguuuaagucaucaaa

SEQ ID NO: 42329 - RNA, 32 nt, Human
acuguguguauguguguauauguauguuuuga

SEQ ID NO: 42330 - RNA, 32 nt, Human
acugugugugaggaacagucacuacccacugg

SEQ ID NO: 42331 - RNA, 32 nt, Human
acuguguuacucaggagguuucuauaaugcca

SEQ ID NO: 42332 - RNA, 32 nt, Human
acuguguucuauuuaccaguggagauuuucug

SEQ ID NO: 42333 - RNA, 32 nt, Human
acuguguugcaucauccuccaguuugccuggu

SEQ ID NO: 42334 - RNA, 32 nt, Human
acuguguugcccaggcuagagugcaguggugc

SEQ ID NO: 42335 - RNA, 32 nt, Human
acuguguugcccaggcuggagugcaaauggcu

SEQ ID NO: 42336 - RNA, 32 nt, Human
acuguguugcccaggcuggagugcaguagugc

SEQ ID NO: 42337 - RNA, 32 nt, Human
acuguguugguggugcugaugaaucugccaga

SEQ ID NO: 42338 - RNA, 32 nt, Human
acuguguugugcacucaugcacugaccuuaca

SEQ ID NO: 42339 - RNA, 32 nt, Human
acuguguuuaguugcaaggauuuuuccaugug

SEQ ID NO: 42340 - RNA, 32 nt, Human
acuguguuuaucucccuuuaaaacccuaccua

SEQ ID NO: 42341 - RNA, 32 nt, Human
acuguguuucuggugccaaggcucuugagggc

SEQ ID NO: 42342 - RNA, 32 nt, Human
acuguguuuucacucaaaccacugacuuaaca

SEQ ID NO: 42343 - RNA, 32 nt, Human
acuguguuuucagucacuuccuuucugugaaa

SEQ ID NO: 42344 - RNA, 32 nt, Human
acuguguuuuuagcccuucaccucucagcuuu

SEQ ID NO: 42345 - RNA, 32 nt, Human
acuguuaaauaccaccaguccagcuuuggcaa

SEQ ID NO: 42346 - RNA, 32 nt, Human
acuguuaaaucagccagaguugguguucaagu

SEQ ID NO: 42347 - RNA, 31 nt, Human
acuguuaauuucauacuauguugaaacuagu

SEQ ID NO: 42348 - RNA, 32 nt, Human
acuguuacagaauccuagccugugguaaaugc

SEQ ID NO: 42349 - RNA, 32 nt, Human
acuguuacaggguagaagaugcagcucaggga

SEQ ID NO: 42350 - RNA, 32 nt, Human
acuguuaccuugaauucugggcucaggugauc

SEQ ID NO: 42351 - RNA, 32 nt, Human
acuguuacuggcagcauuguauaaaagacacg

SEQ ID NO: 42352 - RNA, 32 nt, Human
acuguuagaaaauggacacugugcccagcccg

SEQ ID NO: 42353 - RNA, 32 nt, Human
acuguuagagucaggcaaaucagcaaagcacu

SEQ ID NO: 42354 - RNA, 32 nt, Human
acuguuagagugggaagucugagggaacugga

SEQ ID NO: 42355 - RNA, 32 nt, Human
acuguuagauuacugauaacgcggauagauuu

SEQ ID NO: 42356 - RNA, 32 nt, Human
acuguuaucccucccucuugcuggcuuugcug

SEQ ID NO: 42357 - RNA, 32 nt, Human
acuguucagggccacggagaauucucgaaguc

SEQ ID NO: 42358 - RNA, 32 nt, Human
acuguucaggggauccuucuguuucucacggg

SEQ ID NO: 42359 - RNA, 32 nt, Human
acuguucaucagcugucacuaaacuuauuuua

SEQ ID NO: 42360 - RNA, 32 nt, Human
acuguucauggaggagcugggcccugcagauc

SEQ ID NO: 42361 - RNA, 32 nt, Human
acuguuccaaacgccucccaccuggugugcac

SEQ ID NO: 42362 - RNA, 32 nt, Human
acuguuccagagaaggugcggggccagcugcu

SEQ ID NO: 42363 - RNA, 32 nt, Human
acuguuccaggacaguccugaccucggccugg

SEQ ID NO: 42364 - RNA, 32 nt, Human
acuguuccauuuuccguaucugcuucgggcuu

SEQ ID NO: 42365 - RNA, 32 nt, Human
acuguucccuggcaaauucugaccacaccugg

SEQ ID NO: 42366 - RNA, 32 nt, Human
acuguucccuuagguuuuuccccaccucaauu

SEQ ID NO: 42367 - RNA, 32 nt, Human
acuguuccuaguuucuuagacuuaucugcaua

SEQ ID NO: 42368 - RNA, 32 nt, Human
acuguuccucugggaaaggagcagggaccucu

SEQ ID NO: 42369 - RNA, 32 nt, Human
acuguuccuuggaaacuguagucuuauggaga

SEQ ID NO: 42370 - RNA, 18 nt, Human
acuguuccuuugcucaua

SEQ ID NO: 42371 - RNA, 32 nt, Human
acuguucgaucaugugggguccuuauuuacaa

SEQ ID NO: 42372 - RNA, 19 nt, Human
acuguucucugaguccuuu

SEQ ID NO: 42373 - RNA, 32 nt, Human
acuguucucugccugccugauacccucaccac

SEQ ID NO: 42374 - RNA, 32 nt, Human
acuguucucuucucuacccugcccuaaccagg

SEQ ID NO: 42375 - RNA, 32 nt, Human
acuguucugaacaccaguaccaaccacagaga

SEQ ID NO: 42376 - RNA, 21 nt, Human
acuguucugcaaagguggcaa

SEQ ID NO: 42377 - RNA, 32 nt, Human
acuguucugcugcugaucacgagggcaccaga

SEQ ID NO: 42378 - RNA, 32 nt, Human
acuguucuguucuguauuuuggcaucuguguu

SEQ ID NO: 42379 - RNA, 32 nt, Human
acuguucuguucugucuucucuguccauuuua

SEQ ID NO: 42380 - RNA, 32 nt, Human
acuguucuuucaaucucagcaauguuuccuuc

SEQ ID NO: 42381 - RNA, 32 nt, Human
acuguugaauacuauuuauccaagguaucaag

SEQ ID NO: 42382 - RNA, 32 nt, Human
acuguugaauaucuuugaacuugcuguuuuca

SEQ ID NO: 42383 - RNA, 32 nt, Human
acuguugaccuucucagcaucucccuuuugcc

SEQ ID NO: 42384 - RNA, 32 nt, Human
acuguugagcccuuuugguguugcgaguugaa

SEQ ID NO: 42385 - RNA, 32 nt, Human
acuguugaucaaagcacagaacagguucaaau

SEQ ID NO: 42386 - RNA, 32 nt, Human
acuguugcaccaggcugagaaagcagcaauau

SEQ ID NO: 42387 - RNA, 32 nt, Human
acuguugcaguuuacaaccugcccuccaggga

SEQ ID NO: 42388 - RNA, 32 nt, Human
acuguugccacaaguauuuucuugagagauuu

SEQ ID NO: 42389 - RNA, 32 nt, Human
acuguugccacggugaugaagggagacaucca

SEQ ID NO: 42390 - RNA, 32 nt, Human
acuguugccaggcuggagugcaguggcacaau

SEQ ID NO: 42391 - RNA, 32 nt, Human
acuguugcccaggcuggagugcagugacgcga

SEQ ID NO: 42392 - RNA, 32 nt, Human
acuguugcccaugcuuuuuaagccacaucccu

SEQ ID NO: 42393 - RNA, 32 nt, Human
acuguugccugggcuggaaugcaguggugcga

SEQ ID NO: 42394 - RNA, 32 nt, Human
acuguugccugggcuggaaugcagugguguga

SEQ ID NO: 42395 - RNA, 32 nt, Human
acuguugccuuauuaaccccucccucucccac

SEQ ID NO: 42396 - RNA, 32 nt, Human
acuguugcucuuggugggcuuggcagggacua

SEQ ID NO: 42397 - RNA, 32 nt, Human
acuguugcugcacuccagccugagugacagag

SEQ ID NO: 42398 - RNA, 32 nt, Human
acuguugcugcugcgggagacugugggcuguu

SEQ ID NO: 42399 - RNA, 32 nt, Human
acuguuggacaguuaguuuagauguguugcau

SEQ ID NO: 42400 - RNA, 18 nt, Human
acuguuggaguucacuga

SEQ ID NO: 42401 - RNA, 32 nt, Human
acuguuggcuccuucccauuuaugagagagcc

SEQ ID NO: 42402 - RNA, 32 nt, Human
acuguugggauuacaggcaugagccaccacgc

SEQ ID NO: 42403 - RNA, 32 nt, Human
acuguuggugugagaccagugcuccugguggu

SEQ ID NO: 42404 - RNA, 32 nt, Human
acuguuguaucuugaauaaacgcugcugcuuc

SEQ ID NO: 42405 - RNA, 32 nt, Human
acuguugucacuuuugaaacuaggccuaugaa

SEQ ID NO: 42406 - RNA, 32 nt, Human
acuguugucccuguuuuccuuugggggaauuu

SEQ ID NO: 42407 - RNA, 21 nt, Human
acuguugucuuguuucacuga

SEQ ID NO: 42408 - RNA, 32 nt, Human
acuguuguugcccaggcuggagugcaguggcg

SEQ ID NO: 42409 - RNA, 32 nt, Human
acuguuguuucucuguggacugggcaaggugg

SEQ ID NO: 42410 - RNA, 32 nt, Human
acuguuguuugcccagccugggcugcagaaag

SEQ ID NO: 42411 - RNA, 32 nt, Human
acuguuuaaagaaaucacagaacaguacuuuu

SEQ ID NO: 42412 - RNA, 32 nt, Human
acuguuuaaaucacaggaagaagcggcuuuaa

SEQ ID NO: 42413 - RNA, 32 nt, Human
acuguuuaccauucuuccacugugcuguuaua

SEQ ID NO: 42414 - RNA, 32 nt, Human
acuguuuaugagacacauccaggaguuauguu

SEQ ID NO: 42415 - RNA, 32 nt, Human
acuguuuaugcugcuggaacuuagcacugucu

SEQ ID NO: 42416 - RNA, 32 nt, Human
acuguuucacacacaggagauugugagcugug

SEQ ID NO: 42417 - RNA, 32 nt, Human
acuguuucacaggcagccaccaugcccaugcu

SEQ ID NO: 42418 - RNA, 32 nt, Human
acuguuucaguuaauaugcugcacaccacaca

SEQ ID NO: 42419 - RNA, 32 nt, Human
acuguuucauaaggggucaaguuacauuuucc

SEQ ID NO: 42420 - RNA, 32 nt, Human
acuguuucauugcuuuuuaaauuuuucacgug

SEQ ID NO: 42421 - RNA, 32 nt, Human
acuguuuccucuuucugcuucuuucaucacau

SEQ ID NO: 42422 - RNA, 32 nt, Human
acuguuucuacuccucccuccuccuccacugc

SEQ ID NO: 42423 - RNA, 32 nt, Human
acuguuucucucuaagacaccauuguuuuccc

SEQ ID NO: 42424 - RNA, 32 nt, Human
acuguuucugaacaacaaccuucuucgguccu

SEQ ID NO: 42425 - RNA, 32 nt, Human
acuguuugccaaugguuguauuuaguaagauu

SEQ ID NO: 42426 - RNA, 32 nt, Human
acuguuugcuuucuccugucaugguuaagaga

SEQ ID NO: 42427 - RNA, 32 nt, Human
acuguuuggggugccucucugcagccuccccg

SEQ ID NO: 42428 - RNA, 32 nt, Human
acuguuuguaucugcgcccagaauucucagug

SEQ ID NO: 42429 - RNA, 32 nt, Human
acuguuuguuuaccuugagcaguaaacccgaa

SEQ ID NO: 42430 - RNA, 32 nt, Human
acuguuuguuugccaguccugcccuaaggcag

SEQ ID NO: 42431 - RNA, 32 nt, Human
acuguuuuagagugaauccugggguguucugc

SEQ ID NO: 42432 - RNA, 32 nt, Human
acuguuuuaggugagccaugcacacaauguga

SEQ ID NO: 42433 - RNA, 32 nt, Human
acuguuuuauuugaaggaaaccugugugauuu

SEQ ID NO: 42434 - RNA, 32 nt, Human
acuguuuucaaggaggugcuuaggauuguggg

SEQ ID NO: 42435 - RNA, 16 nt, Human
acuguuuucaucuaca

SEQ ID NO: 42436 - RNA, 32 nt, Human
acuguuuucccuugagauuuccuucuccuaug

SEQ ID NO: 42437 - RNA, 19 nt, Human
acuguuuucuuucaccgca

SEQ ID NO: 42438 - RNA, 32 nt, Human
acuguuuucuuucugcccucuuccuaaugccc

SEQ ID NO: 42439 - RNA, 32 nt, Human
acuguuuugccuggcgcugcugccccacugca

SEQ ID NO: 42440 - RNA, 32 nt, Human
acuguuuuuaacaugcuugggguuugauaaaa

SEQ ID NO: 42441 - RNA, 32 nt, Human
acuguuuuuagguuuugcuauuacaaaauacu

SEQ ID NO: 42442 - RNA, 23 nt, Human
acuuaaaaauauauaaauaauuc

SEQ ID NO: 42443 - RNA, 32 nt, Human
acuuaaaacacugcuacacugaugcuuuugug

SEQ ID NO: 42444 - RNA, 32 nt, Human
acuuaaaacauggugccuauaucugagagacc

SEQ ID NO: 42445 - RNA, 32 nt, Human
acuuaaaacuauuuaagaacugauguuccgau

SEQ ID NO: 42446 - RNA, 32 nt, Human
acuuaaaagcagcugcaggccuguggggaacg

SEQ ID NO: 42447 - RNA, 32 nt, Human
acuuaaaauaccucaugcauuguaaaagcuau

SEQ ID NO: 42448 - RNA, 32 nt, Human
acuuaaaauauccacuggacacugugaaauac

SEQ ID NO: 42449 - RNA, 32 nt, Human
acuuaaaccagggcaggaaggaauggaaggau

SEQ ID NO: 42450 - RNA, 32 nt, Human
acuuaaacccaggaggcggagguugcagugag

SEQ ID NO: 42451 - RNA, 32 nt, Human
acuuaaacccaggagguggagguugcagugag

SEQ ID NO: 42452 - RNA, 32 nt, Human
acuuaaacccgggaggugaaggaugcagugag

SEQ ID NO: 42453 - RNA, 32 nt, Human
acuuaaaccugaauuggaauuacuucuguaca

SEQ ID NO: 42454 - RNA, 32 nt, Human
acuuaaagaaguccagcuagagagggaugaau

SEQ ID NO: 42455 - RNA, 32 nt, Human
acuuaaaggaagcacaggcaaguguucagugu

SEQ ID NO: 42456 - RNA, 32 nt, Human
acuuaaaugcuuguugaaugagugagauguuu

SEQ ID NO: 42457 - RNA, 32 nt, Human
acuuaacaacuaaagggcaacauauagacuuu

SEQ ID NO: 42458 - RNA, 31 nt, Human
acuuaacaaguguacugcagaauaaacuacc

SEQ ID NO: 42459 - RNA, 32 nt, Human
acuuaacacagaaacgcaauaaacacacacaa

SEQ ID NO: 42460 - RNA, 32 nt, Human
acuuaacagaggagguaaagggagguuuucac

SEQ ID NO: 42461 - RNA, 32 nt, Human
acuuaacagaugccuccucuccaaagagaauu

SEQ ID NO: 42462 - RNA, 32 nt, Human
acuuaacauaccauggccugagcuaaguacca

SEQ ID NO: 42463 - RNA, 32 nt, Human
acuuaacauguuuucugucauaguuagaugug

SEQ ID NO: 42464 - RNA, 32 nt, Human
acuuaaccacuguuaagugaucugugaucaag

SEQ ID NO: 42465 - RNA, 32 nt, Human
acuuaacccauguuuucucuuuauauaaucac

SEQ ID NO: 42466 - RNA, 32 nt, Human
acuuaaccucucugugcuucagucucccuguc

SEQ ID NO: 42467 - RNA, 32 nt, Human
acuuaaccucucugugcuuugugugccuaagc

SEQ ID NO: 42468 - RNA, 32 nt, Human
acuuaacgugucacuucuccucccagaggcag

SEQ ID NO: 42469 - RNA, 32 nt, Human
acuuaacucaaaggcguuguggcucuaagauu

SEQ ID NO: 42470 - RNA, 32 nt, Human
acuuaacuugcaaggaaguuacaaggucccag

SEQ ID NO: 42471 - RNA, 32 nt, Human
acuuaagagagggaagugggcuggggagagua

SEQ ID NO: 42472 - RNA, 32 nt, Human
acuuaagaguuuucaagaugucaaacuuaagg

SEQ ID NO: 42473 - RNA, 32 nt, Human
acuuaagcaagauacaaaugugcugccugcag

SEQ ID NO: 42474 - RNA, 32 nt, Human
acuuaagcccaggagugauuugugcagccaag

SEQ ID NO: 42475 - RNA, 32 nt, Human
acuuaagcccgggaggucgaggcugcugugag

SEQ ID NO: 42476 - RNA, 32 nt, Human
acuuaagccuggaagguggaaguugcagugag

SEQ ID NO: 42477 - RNA, 32 nt, Human
acuuaagccugggaagucaagccugcagugaa

SEQ ID NO: 42478 - RNA, 32 nt, Human
acuuaaggccaugaguuugaggcuacagagag

SEQ ID NO: 42479 - RNA, 32 nt, Human
acuuaaggggccaaggcaggaggaucacuuga

SEQ ID NO: 42480 - RNA, 32 nt, Human
acuuaaguaucuccuaaaugugauacagaaga

SEQ ID NO: 42481 - RNA, 32 nt, Human
acuuaaguguguuguuccugaacuuucuguaa

SEQ ID NO: 42482 - RNA, 32 nt, Human
acuuaaguuuuccagagaacuaaauaguaaua

SEQ ID NO: 42483 - RNA, 32 nt, Human
acuuaauaaccagggaaccagccaaauacugu

SEQ ID NO: 42484 - RNA, 32 nt, Human
acuuaauacccauugaaauuucaccucaggug

SEQ ID NO: 42485 - RNA, 32 nt, Human
acuuaauacuauacuuaauuauuggacuauca

SEQ ID NO: 42486 - RNA, 32 nt, Human
acuuaauauucuccacaguuaccuuuagagag

SEQ ID NO: 42487 - RNA, 32 nt, Human
acuuaauauuuuuauaaaguauuguaauauug

SEQ ID NO: 42488 - RNA, 32 nt, Human
acuuaaucaccacuucaucuaauuuuagcaag

SEQ ID NO: 42489 - RNA, 32 nt, Human
acuuaaucgcacuguuucuaauucuuuuuaca

SEQ ID NO: 42490 - RNA, 32 nt, Human
acuuaaucuuucuccauccugugcuccaaaaa

SEQ ID NO: 42491 - RNA, 32 nt, Human
acuuaaugcucaguauuaccuuccucacuaug

SEQ ID NO: 42492 - RNA, 32 nt, Human
acuuaauggaaagguaaauggucagauaaaaa

SEQ ID NO: 42493 - RNA, 32 nt, Human
acuuaauguugguuccaguccuucaacuguuc

SEQ ID NO: 42494 - RNA, 32 nt, Human
acuuaauuccuguaaucccagcauuuugagag

SEQ ID NO: 42495 - RNA, 32 nt, Human
acuuaauucuuucuaaagaugaaaugggauug

SEQ ID NO: 42496 - RNA, 32 nt, Human
acuuacaaaguacacuauguaagaacugaggu

SEQ ID NO: 42497 - RNA, 32 nt, Human
acuuacaagcaaagcaguuccacccaugacca

SEQ ID NO: 42498 - RNA, 32 nt, Human
acuuacaaggcugagggcuguggugugcauua

SEQ ID NO: 42499 - RNA, 32 nt, Human
acuuacaaugaagagcauuuggaguuguaugc

SEQ ID NO: 42500 - RNA, 23 nt, Human
acuuacacuucccuuccccuuca

SEQ ID NO: 42501 - RNA, 32 nt, Human
acuuacagaccaaccaaccaccuugcuggaac

SEQ ID NO: 42502 - RNA, 32 nt, Human
acuuacagagcuggcccaaugagacaaauaag

SEQ ID NO: 42503 - RNA, 32 nt, Human
acuuacagaggauuuuuauuugugaauauuuc

SEQ ID NO: 42504 - RNA, 32 nt, Human
acuuacagccugacagauuaggaguccgauaa

SEQ ID NO: 42505 - RNA, 32 nt, Human
acuuacagcucacgccuguaaucccagcacuu

SEQ ID NO: 42506 - RNA, 32 nt, Human
acuuacagggcuaggauuucaguguugucaga

SEQ ID NO: 42507 - RNA, 32 nt, Human
acuuacagugacuaucuaagguugugauaaau

SEQ ID NO: 42508 - RNA, 32 nt, Human
acuuacaguggguccaguggguccccagacuc

SEQ ID NO: 42509 - RNA, 32 nt, Human
acuuacaugagcagcuaaauaaaugaugggau

SEQ ID NO: 42510 - RNA, 32 nt, Human
acuuacauggugcagcugcuacaaggccugga

SEQ ID NO: 42511 - RNA, 32 nt, Human
acuuaccaaggagaaagaggagagacagcagu

SEQ ID NO: 42512 - RNA, 32 nt, Human
acuuaccacaacuugugccuccuggguucaag

SEQ ID NO: 42513 - RNA, 32 nt, Human
acuuaccacucugccuaagagccaccuacugg

SEQ ID NO: 42514 - RNA, 32 nt, Human
acuuaccauagcagugacaauggcagucuugg

SEQ ID NO: 42515 - RNA, 32 nt, Human
acuuacccaaggcucuucuccuuggaggacag

SEQ ID NO: 42516 - RNA, 32 nt, Human
acuuacccagaacauucugcccccggaaugca

SEQ ID NO: 42517 - RNA, 32 nt, Human
acuuacccagcuguuauacauguuuucaguuc

SEQ ID NO: 42518 - RNA, 32 nt, Human
acuuacccugggcuggagaguugguuucaggu

SEQ ID NO: 42519 - RNA, 32 nt, Human
acuuacccuuuaaauuauucagaaggaugucc

SEQ ID NO: 42520 - RNA, 32 nt, Human
acuuaccuaaggccacacaguuagcaacaagc

SEQ ID NO: 42521 - RNA, 32 nt, Human
acuuaccucuacuguuagacuaggcgacucac

SEQ ID NO: 42522 - RNA, 32 nt, Human
acuuaccugagagugagagauguguaggaaga

SEQ ID NO: 42523 - RNA, 17 nt, Human
acuuaccuguaguccca

SEQ ID NO: 42524 - RNA, 32 nt, Human
acuuaccuguagucccagcuacuugggaagca

SEQ ID NO: 42525 - RNA, 19 nt, Human
acuuaccugucugcccuca

SEQ ID NO: 42526 - RNA, 32 nt, Human
acuuaccuuccccucaugccgcucccaucucu

SEQ ID NO: 42527 - RNA, 32 nt, Human
acuuacgccuguaaucucagcacuuugggagg

SEQ ID NO: 42528 - RNA, 32 nt, Human
acuuacguuacugucaucaccauuaaaagaau

SEQ ID NO: 42529 - RNA, 32 nt, Human
acuuacuacugcacuccugcuuuugugggaaa

SEQ ID NO: 42530 - RNA, 32 nt, Human
acuuacucaaggccacacagcaaguaggugag

SEQ ID NO: 42531 - RNA, 32 nt, Human
acuuacucauuugacuuuugcacugacuguau

SEQ ID NO: 42532 - RNA, 32 nt, Human
acuuacucauuuuucucccccaagugagcugc

SEQ ID NO: 42533 - RNA, 32 nt, Human
acuuacugaccggccugggcugcucugagaca

SEQ ID NO: 42534 - RNA, 32 nt, Human
acuuacugaugacugaccacacugucuuguga

SEQ ID NO: 42535 - RNA, 32 nt, Human
acuuacugccuccccugcugcuccuccugagc

SEQ ID NO: 42536 - RNA, 32 nt, Human
acuuacugccugggccccugcccagcagccuc

SEQ ID NO: 42537 - RNA, 32 nt, Human
acuuacugcggccgcccggcucuugggaacca

SEQ ID NO: 42538 - RNA, 32 nt, Human
acuuacugcugcucagaaccucaggccuccaa

SEQ ID NO: 42539 - RNA, 32 nt, Human
acuuacuggccuuggcuggcucuucagcucuu

SEQ ID NO: 42540 - RNA, 32 nt, Human
acuuacuguggacuucauagcuuacugacaga

SEQ ID NO: 42541 - RNA, 32 nt, Human
acuuacugugugacuuugggcaaguuccuucc

SEQ ID NO: 42542 - RNA, 32 nt, Human
acuuacuucccauccaggucucagaggucuca

SEQ ID NO: 42543 - RNA, 32 nt, Human
acuuacuuccccaagauauugagaggucauau

SEQ ID NO: 42544 - RNA, 15 nt, Human
acuuacuucgugucc

SEQ ID NO: 42545 - RNA, 32 nt, Human
acuuacuugccaccagcuugugcauuuagugu

SEQ ID NO: 42546 - RNA, 32 nt, Human
acuuagaaaaccagcucagcacugccugcucc

SEQ ID NO: 42547 - RNA, 32 nt, Human
acuuagaaagcaugguaugagcacaggucaug

SEQ ID NO: 42548 - RNA, 32 nt, Human
acuuagaaauuccaggaacacaauuaggauau

SEQ ID NO: 42549 - RNA, 20 nt, Human
acuuagaacacucacugcac

SEQ ID NO: 42550 - RNA, 32 nt, Human
acuuagaaccucuguuggaauguggcugaguc

SEQ ID NO: 42551 - RNA, 32 nt, Human
acuuagaagaaaaggcagagacaggcaagaca

SEQ ID NO: 42552 - RNA, 32 nt, Human
acuuagaagcugaagaaaauagacauagccgg

SEQ ID NO: 42553 - RNA, 21 nt, Human
acuuagaauauauuuuauuua

SEQ ID NO: 42554 - RNA, 24 nt, Human
acuuagaaugagaaaaauaaugca

SEQ ID NO: 42555 - RNA, 32 nt, Human
acuuagaaugauguaauauuccaggaugcugc

SEQ ID NO: 42556 - RNA, 32 nt, Human
acuuagaauguacacagauccaaaauagaauc

SEQ ID NO: 42557 - RNA, 32 nt, Human
acuuagagaaccuauagcaucuucucauuccc

SEQ ID NO: 42558 - RNA, 32 nt, Human
acuuagagaagaggaagagaauaggaaaacca

SEQ ID NO: 42559 - RNA, 32 nt, Human
acuuagagauacaaucacgucacaggucucuu

SEQ ID NO: 42560 - RNA, 32 nt, Human
acuuagaggaggaucgcuugaucucaggaggu

SEQ ID NO: 42561 - RNA, 32 nt, Human
acuuagagguggagcaguuggauucugugcag

SEQ ID NO: 42562 - RNA, 32 nt, Human
acuuagaugcuuccagcacauacguagguagc

SEQ ID NO: 42563 - RNA, 32 nt, Human
acuuagauuguauugcucacauguucguuccu

SEQ ID NO: 42564 - RNA, 32 nt, Human
acuuagcacuuguauaaucagacuggaaaugg

SEQ ID NO: 42565 - RNA, 32 nt, Human
acuuagcagagcaguuccuccuggggccugcg

SEQ ID NO: 42566 - RNA, 24 nt, Human
acuuagcauaaagucuuuaagaug

SEQ ID NO: 42567 - RNA, 32 nt, Human
acuuagccagcccuggcuguuguauuaccaaa

SEQ ID NO: 42568 - RNA, 32 nt, Human
acuuagcccaagagugcaaaucugccagccua

SEQ ID NO: 42569 - RNA, 32 nt, Human
acuuagccuugaucuguacccucguagucaau

SEQ ID NO: 42570 - RNA, 24 nt, Human
acuuagccuuggcauuugugcaga

SEQ ID NO: 42571 - RNA, 32 nt, Human
acuuagccuuucugguuucccuuccugugcau

SEQ ID NO: 42572 - RNA, 32 nt, Human
acuuagcucaccgcaaccuccaccucccgggu

SEQ ID NO: 42573 - RNA, 32 nt, Human
acuuagcucccuuuuaaaaggagcacauuaaa

SEQ ID NO: 42574 - RNA, 32 nt, Human
acuuagcuggugggaaaggaggguucuggaag

SEQ ID NO: 42575 - RNA, 24 nt, Human
acuuagcugugauacugacaggua

SEQ ID NO: 42576 - RNA, 32 nt, Human
acuuagcuucucagggguaaagacagacagac

SEQ ID NO: 42577 - RNA, 32 nt, Human
acuuaggaagagauaaggcaagagcuagauuu

SEQ ID NO: 42578 - RNA, 32 nt, Human
acuuaggacuuccucugggcaccagggcagug

SEQ ID NO: 42579 - RNA, 32 nt, Human
acuuaggaggcugaggcaggagaaucacauca

SEQ ID NO: 42580 - RNA, 32 nt, Human
acuuaggaggcugaggcaggagaaucgcuuga

SEQ ID NO: 42581 - RNA, 32 nt, Human
acuuaggaggcugaggcaggagaaucucuuga

SEQ ID NO: 42582 - RNA, 32 nt, Human
acuuaggaggcugaggcaggaggaucauuuga

SEQ ID NO: 42583 - RNA, 32 nt, Human
acuuaggaggcugaggcaugagaaucacuuaa

SEQ ID NO: 42584 - RNA, 32 nt, Human
agaaaugggguuuuaccguguuggccaggcug

SEQ ID NO: 42585 - RNA, 32 nt, Human
agaaaugggguuuugccauguuggccaggcug

SEQ ID NO: 42586 - RNA, 32 nt, Human
agaaaugucacacuaaaagguauaucaaaagc

SEQ ID NO: 42587 - RNA, 29 nt, Human
agaaaugucauccucaggcacgccagacu

SEQ ID NO: 42588 - RNA, 32 nt, Human
agaaaugucaucucucuucuaucugugguugc

SEQ ID NO: 42589 - RNA, 32 nt, Human
agaaaugucaucugcaaauacagaccauuuuu

SEQ ID NO: 42590 - RNA, 32 nt, Human
agaaaugucaucugcauugugcagauggaaaa

SEQ ID NO: 42591 - RNA, 32 nt, Human
agaaauguccaguuuugagugacuguaguaug

SEQ ID NO: 42592 - RNA, 32 nt, Human
agaaauguccccagaguggagaaguucaguuc

SEQ ID NO: 42593 - RNA, 32 nt, Human
agaaauguccugaagucacacagcuaauggca

SEQ ID NO: 42594 - RNA, 32 nt, Human
agaaaugucuaaagcugcuucucccaacaccg

SEQ ID NO: 42595 - RNA, 32 nt, Human
agaaaugucuauguuuucuacuccaauucaua

SEQ ID NO: 42596 - RNA, 32 nt, Human
agaaaugugcaggagcggagggacagcgacac

SEQ ID NO: 42597 - RNA, 32 nt, Human
agaaaugugccguggugugcagcaucccuuga

SEQ ID NO: 42598 - RNA, 21 nt, Human
agaaaugugccucauuugcca

SEQ ID NO: 42599 - RNA, 32 nt, Human
agaaaugugguauguggagaaguucuguaugu

SEQ ID NO: 42600 - RNA, 31 nt, Human
agaaaugugguggaaacaggagugaauaaag

SEQ ID NO: 42601 - RNA, 32 nt, Human
agaaauguguaacucuccaagagaugcagaca

SEQ ID NO: 42602 - RNA, 32 nt, Human
agaaauguuagacauugagcuaccacaggacc

SEQ ID NO: 42603 - RNA, 22 nt, Human
agaaauguuuuaaaagggacuu

SEQ ID NO: 42604 - RNA, 18 nt, Human
agaaauguuuuucuucca

SEQ ID NO: 42605 - RNA, 32 nt, Human
agaaauuaaaguccguuuuacugugaauauag

SEQ ID NO: 42606 - RNA, 32 nt, Human
agaaauuacuggagaaaagcuugugagcucgc

SEQ ID NO: 42607 - RNA, 22 nt, Human
agaaauuagaacaaacuggaga

SEQ ID NO: 42608 - RNA, 32 nt, Human
agaaauuauaacggagauguuugaacuaaugu

SEQ ID NO: 42609 - RNA, 32 nt, Human
agaaauuaucaaagcaauagaaauagcuuggu

SEQ ID NO: 42610 - RNA, 32 nt, Human
agaaauuauugguuuguguugcucuggggaaa

SEQ ID NO: 42611 - RNA, 32 nt, Human
agaaauucagcaguauuauaucugccaacaau

SEQ ID NO: 42612 - RNA, 32 nt, Human
agaaauucauguuuacuuuucuagguguauga

SEQ ID NO: 42613 - RNA, 32 nt, Human
agaaauucauuuccucaccuguaguggccacc

SEQ ID NO: 42614 - RNA, 32 nt, Human
agaaauuccugccucguucaaugcggcaaguu

SEQ ID NO: 42615 - RNA, 32 nt, Human
agaaauucuuaagaugccaauguaauaaaugu

SEQ ID NO: 42616 - RNA, 32 nt, Human
agaaauucuucagucaguccaggacagacgag

SEQ ID NO: 42617 - RNA, 32 nt, Human
agaaauugagccagcacuaucuguacuccaac

SEQ ID NO: 42618 - RNA, 32 nt, Human
agaaauugaguauuuucugacauaagaauaua

SEQ ID NO: 42619 - RNA, 32 nt, Human
agaaauugcaagauggaagcagacaguacagg

SEQ ID NO: 42620 - RNA, 32 nt, Human
agaaauugcccuuuuaaaagcauguacgugaa

SEQ ID NO: 42621 - RNA, 23 nt, Human
agaaauuggccuucagcuggaga

SEQ ID NO: 42622 - RNA, 32 nt, Human
agaaauuggcucaccuugggaaacccagggaa

SEQ ID NO: 42623 - RNA, 32 nt, Human
agaaauugggagagagaaauagaaggcuugau

SEQ ID NO: 42624 - RNA, 32 nt, Human
agaaauugggugauguuuuugugcccagcaac

SEQ ID NO: 42625 - RNA, 32 nt, Human
agaaauuguauuucaaccacauccaugaaaau

SEQ ID NO: 42626 - RNA, 32 nt, Human
agaaauuguccaugccaccaauuccacugcua

SEQ ID NO: 42627 - RNA, 32 nt, Human
agaaauuguuaacugcaagugagagcucaucc

SEQ ID NO: 42628 - RNA, 32 nt, Human
agaaauuguucccaguugaugucuuuugggga

SEQ ID NO: 42629 - RNA, 32 nt, Human
agaaauuguugacauaaaauaaagaauugaag

SEQ ID NO: 42630 - RNA, 32 nt, Human
agaaauuguuggaucuggcagucuaggaauga

SEQ ID NO: 42631 - RNA, 32 nt, Human
agaaauuucauuuacuauuuuaguauguaaau

SEQ ID NO: 42632 - RNA, 32 nt, Human
agaaauuuccacugcuguucuucacuuucauc

SEQ ID NO: 42633 - RNA, 32 nt, Human
agaaauuuccuuuacuucauaauuauuuguua

SEQ ID NO: 42634 - RNA, 32 nt, Human
agaaauuucugugguggggagggggcaaucuc

SEQ ID NO: 42635 - RNA, 32 nt, Human
agaaauuugagaccagccugggcaacauagca

SEQ ID NO: 42636 - RNA, 32 nt, Human
agaaauuugucaggcugggugcaguggcucau

SEQ ID NO: 42637 - RNA, 32 nt, Human
agaaauuuuggauuuuucaucacuuucucuuu

SEQ ID NO: 42638 - RNA, 32 nt, Human
agaacaaaaagaaccaaguagagagaguggag

SEQ ID NO: 42639 - RNA, 21 nt, Human
agaacaaaacaaaacaaaaca

SEQ ID NO: 42640 - RNA, 32 nt, Human
agaacaaaacauuagcauuucucugccgugga

SEQ ID NO: 42641 - RNA, 32 nt, Human
agaacaaacccugccaagugcugcuuuggaaa

SEQ ID NO: 42642 - RNA, 32 nt, Human
agaacaaacgggagugaccuagugcagcccug

SEQ ID NO: 42643 - RNA, 32 nt, Human
agaacaaacuauucuuuacccauuuuguagcu

SEQ ID NO: 42644 - RNA, 32 nt, Human
agaacaaacuauugcugacucaugagcacuau

SEQ ID NO: 42645 - RNA, 32 nt, Human
agaacaaagcaggugagaucauguaugugacu

SEQ ID NO: 42646 - RNA, 32 nt, Human
agaacaaauaugauucuccucucccaaauaaa

SEQ ID NO: 42647 - RNA, 32 nt, Human
agaacaaauggcacagcaucccugccaggauc

SEQ ID NO: 42648 - RNA, 32 nt, Human
agaacaacagcaggcuuccuggagccacaugg

SEQ ID NO: 42649 - RNA, 32 nt, Human
agaacaacagccacuuuugugggagcccaaga

SEQ ID NO: 42650 - RNA, 32 nt, Human
agaacaacagggugaaaccccaucucuaauaa

SEQ ID NO: 42651 - RNA, 20 nt, Human
agaacaacaucccucuuccu

SEQ ID NO: 42652 - RNA, 32 nt, Human
agaacaacccagcaauugucucuuaaugcgau

SEQ ID NO: 42653 - RNA, 32 nt, Human
agaacaaccugaccaacauggagaaacccugu

SEQ ID NO: 42654 - RNA, 32 nt, Human
agaacaacuggucugguuuccacuggaguacc

SEQ ID NO: 42655 - RNA, 32 nt, Human
agaacaacuucugccaucuucuggggccugua

SEQ ID NO: 42656 - RNA, 32 nt, Human
agaacaagaguauauaaaguuauucuuugaau

SEQ ID NO: 42657 - RNA, 32 nt, Human
agaacaagcagcacaaacagacgcucagcgag

SEQ ID NO: 42658 - RNA, 32 nt, Human
agaacaagccagacuuggugguuuccaagcaa

SEQ ID NO: 42659 - RNA, 31 nt, Human
agaacaaggcacuucaguccuauucaacaua

SEQ ID NO: 42660 - RNA, 32 nt, Human
agaacaaggccuguuucuuuucugccauccaa

SEQ ID NO: 42661 - RNA, 32 nt, Human
agaacaaggggaggaggaagcuauggauacag

SEQ ID NO: 42662 - RNA, 32 nt, Human
agaacaaguucagaguccuuuacgagaaggag

SEQ ID NO: 42663 - RNA, 20 nt, Human
agaacaauaaauaugugcca

SEQ ID NO: 42664 - RNA, 32 nt, Human
agaacaauacuccauucccuccccucuacccc

SEQ ID NO: 42665 - RNA, 32 nt, Human
agaacaauauagucugggaaucccagaauguc

SEQ ID NO: 42666 - RNA, 32 nt, Human
agaacaaucccuccccuugcacuugugaaaac

SEQ ID NO: 42667 - RNA, 20 nt, Human
agaacaaugcaaggaaguca

SEQ ID NO: 42668 - RNA, 23 nt, Human
agaacaaugccagggcccaggag

SEQ ID NO: 42669 - RNA, 32 nt, Human
agaacaaugucagaaacucgaugaauguguug

SEQ ID NO: 42670 - RNA, 32 nt, Human
agaacacaauuuggggaacagaagggcuuuug

SEQ ID NO: 42671 - RNA, 32 nt, Human
agaacacacaaaccaugcucuacuccaccccc

SEQ ID NO: 42672 - RNA, 32 nt, Human
agaacacacacguuuucccuacagcagaggcc

SEQ ID NO: 42673 - RNA, 21 nt, Human
agaacacagagaaaucagaga

SEQ ID NO: 42674 - RNA, 32 nt, Human
agaacacagcuggaggcaucacauuaccugac

SEQ ID NO: 42675 - RNA, 32 nt, Human
agaacacaucuaggcucuuuuccccaggagag

SEQ ID NO: 42676 - RNA, 32 nt, Human
agaacaccaaauaucaccagacugccuaagag

SEQ ID NO: 42677 - RNA, 32 nt, Human
agaacacccacugccuagaggccaucuuaaag

SEQ ID NO: 42678 - RNA, 32 nt, Human
agaacacccacuggccaguccuagagcuccug

SEQ ID NO: 42679 - RNA, 32 nt, Human
agaacacccuggccuccuccaucaugucggcc

SEQ ID NO: 42680 - RNA, 32 nt, Human
agaacaccgcgcagcgugacugugaguugcuc

SEQ ID NO: 42681 - RNA, 19 nt, Human
agaacaccggacccagggg

SEQ ID NO: 42682 - RNA, 32 nt, Human
agaacaccuccauggauucagggaagggcuga

SEQ ID NO: 42683 - RNA, 32 nt, Human
agaacacgcuagaaugggauucccucuggacu

SEQ ID NO: 42684 - RNA, 32 nt, Human
agaacacggguuuucauggcugccuuugguuu

SEQ ID NO: 42685 - RNA, 32 nt, Human
agaacacuagcuaaggaagggaaagggaagug

SEQ ID NO: 42686 - RNA, 32 nt, Human
agaacacugcacuccaauuuccucgggcagcc

SEQ ID NO: 42687 - RNA, 32 nt, Human
agaacacugcucugucugccucccuggaccca

SEQ ID NO: 42688 - RNA, 19 nt, Human
agaacacuggacccagggg

SEQ ID NO: 42689 - RNA, 32 nt, Human
agaacacuguuuuaauguauuuccuugaucug

SEQ ID NO: 42690 - RNA, 20 nt, Human
agaacacuuacuguuccuga

SEQ ID NO: 42691 - RNA, 32 nt, Human
agaacacuucucugugcucagugggagccagg

SEQ ID NO: 42692 - RNA, 32 nt, Human
agaacacuugacugacucuugggccaccucug

SEQ ID NO: 42693 - RNA, 32 nt, Human
agaacacuugcuggucuugaaaaugaagccau

SEQ ID NO: 42694 - RNA, 32 nt, Human
agaacacuuucugggcuaacauaguccucaca

SEQ ID NO: 42695 - RNA, 19 nt, Human
agaacagaacaugugccaa

SEQ ID NO: 42696 - RNA, 32 nt, Human
agaacagaacccucuccagccugcugacccga

SEQ ID NO: 42697 - RNA, 19 nt, Human
agaacagaagaaggaucug

SEQ ID NO: 42698 - RNA, 32 nt, Human
agaacagaaggugggcagggcgggggaggcag

SEQ ID NO: 42699 - RNA, 32 nt, Human
agaacagaccaccaccauccauagccuggaug

SEQ ID NO: 42700 - RNA, 18 nt, Human
agaacagacuggaaacug

SEQ ID NO: 42701 - RNA, 32 nt, Human
agaacagagaggaggaggagggagaaauggcc

SEQ ID NO: 42702 - RNA, 32 nt, Human
agaacagagcaggacccaggaugcaagacccu

SEQ ID NO: 42703 - RNA, 32 nt, Human
agaacagaggugcacaccaccauaucuggcuu

SEQ ID NO: 42704 - RNA, 32 nt, Human
agaacagauaccaucauccugccuuuguuagc

SEQ ID NO: 42705 - RNA, 32 nt, Human
agaacagaucaaagcccaagagagcugcuggc

SEQ ID NO: 42706 - RNA, 32 nt, Human
agaacagcaagcucucugucccugcaccccca

SEQ ID NO: 42707 - RNA, 32 nt, Human
agaacagcaauauauucuuucuugcagaccga

SEQ ID NO: 42708 - RNA, 32 nt, Human
agaacagcaccucagagcucuuaaaugcuuau

SEQ ID NO: 42709 - RNA, 32 nt, Human
agaacagcagagaauuuugaucucuugagcag

SEQ ID NO: 42710 - RNA, 32 nt, Human
agaacagcagagccuccugcacccucagcaag

SEQ ID NO: 42711 - RNA, 32 nt, Human
agaacagcagcucuuuaaguguuugcauuuuc

SEQ ID NO: 42712 - RNA, 32 nt, Human
agaacagcagugguggcaacuaugccuugccu

SEQ ID NO: 42713 - RNA, 32 nt, Human
agaacagccaggccuggugagucacuccuggg

SEQ ID NO: 42714 - RNA, 32 nt, Human
agaacagccugaccaacauggugaaacuccau

SEQ ID NO: 42715 - RNA, 32 nt, Human
agaacagcugccuggucuucucucccagucug

SEQ ID NO: 42716 - RNA, 32 nt, Human
agaacagcuggaucuugcucagucucugccag

SEQ ID NO: 42717 - RNA, 32 nt, Human
agaacagcugucuggucuaaccucucacuggu

SEQ ID NO: 42718 - RNA, 32 nt, Human
agaacagcuguuccaagaaaagaaggauccug

SEQ ID NO: 42719 - RNA, 17 nt, Human
agaacagcuuguucuca

SEQ ID NO: 42720 - RNA, 22 nt, Human
agaacaggaccuaggcccugug

SEQ ID NO: 42721 - RNA, 32 nt, Human
agaacaggaccuaggcccugugcaauggcuca

SEQ ID NO: 42722 - RNA, 32 nt, Human
agaacaggacuccagcaaagcacuuuucagcc

SEQ ID NO: 42723 - RNA, 32 nt, Human
agaacaggagauggagaaagcaaguggaagac

SEQ ID NO: 42724 - RNA, 32 nt, Human
agaacaggagucugaaagagcucauguucucc

SEQ ID NO: 42725 - RNA, 32 nt, Human
agaacaggauguggcaucccccaaagcccauc

SEQ ID NO: 42726 - RNA, 30 nt, Human
agaacaggcagagacagggcacagucucua

SEQ ID NO: 42727 - RNA, 18 nt, Human
agaacaggccucauucca

SEQ ID NO: 42728 - RNA, 30 nt, Human
agaacaggccucuccauuugcucuucagau

SEQ ID NO: 42729 - RNA, 32 nt, Human
agaacagggcaggcacgggcagcuccuguucu

SEQ ID NO: 42730 - RNA, 32 nt, Human
agaacaggggcuuccccaaguugcccagaaag

SEQ ID NO: 42731 - RNA, 32 nt, Human
agaacagguaauuuacuccugccugcagaaua

SEQ ID NO: 42732 - RNA, 32 nt, Human
agaacaguaagggagcagagugguuaaggacu

SEQ ID NO: 42733 - RNA, 32 nt, Human
agaacaguaauuggcccagacagguaggugug

SEQ ID NO: 42734 - RNA, 32 nt, Human
agaacagugagguucugauagccccggacacu

SEQ ID NO: 42735 - RNA, 32 nt, Human
agaacagugaucucucagcucuccagcuguaa

SEQ ID NO: 42736 - RNA, 32 nt, Human
agaacagugccauuaagacaacuacagcccuc

SEQ ID NO: 42737 - RNA, 32 nt, Human
agaacaguggcacaccaccagugaggcacaug

SEQ ID NO: 42738 - RNA, 18 nt, Human
agaacaguuccaagcaca

SEQ ID NO: 42739 - RNA, 32 nt, Human
agaacaguucuauccuggugccuuacgaauaa

SEQ ID NO: 42740 - RNA, 32 nt, Human
agaacaguuggaucuugcucagucucugucag

SEQ ID NO: 42741 - RNA, 32 nt, Human
agaacaguuguccaggaugcuggcugguggaa

SEQ ID NO: 42742 - RNA, 32 nt, Human
agaacauagcaaaaauauaaccgaaaguuggc

SEQ ID NO: 42743 - RNA, 32 nt, Human
agaacauauuuuaagagacagaacuuagacau

SEQ ID NO: 42744 - RNA, 22 nt, Human
agaacaucagccucaucuuccu

SEQ ID NO: 42745 - RNA, 32 nt, Human
agaacauccauuauaaaaggugcaaugguguc

SEQ ID NO: 42746 - RNA, 32 nt, Human
agaacaucccacccucaacucauuccaaccac

SEQ ID NO: 42747 - RNA, 32 nt, Human
agaacauccccuugacaguugcagccucuuga

SEQ ID NO: 42748 - RNA, 32 nt, Human
agaacauccguccguccaucugcaucucuguc

SEQ ID NO: 42749 - RNA, 32 nt, Human
agaacauccuguuugugaauucugaguuugaa

SEQ ID NO: 42750 - RNA, 32 nt, Human
agaacauccuuaaaugucuaacaacaagggcu

SEQ ID NO: 42751 - RNA, 32 nt, Human
agaacaucuggaccaggcaggcucggccaacc

SEQ ID NO: 42752 - RNA, 32 nt, Human
agaacaugaugggccugaacucggacaaguga

SEQ ID NO: 42753 - RNA, 32 nt, Human
agaacaugcauauaaaggaaacauaucuguaa

SEQ ID NO: 42754 - RNA, 32 nt, Human
agaacauggaaagaaaauuuaacagguuaauu

SEQ ID NO: 42755 - RNA, 32 nt, Human
agaacauggacucauguggaugugguuuggcu

SEQ ID NO: 42756 - RNA, 32 nt, Human
agaacauggggaggggacuagaugggcaaggg

SEQ ID NO: 42757 - RNA, 32 nt, Human
agaacauggugacagacagacaugcuucgaag

SEQ ID NO: 42758 - RNA, 32 nt, Human
agaacauguuuuaaaaagauacacucuaucac

SEQ ID NO: 42759 - RNA, 32 nt, Human
agaacauuaacaaaagcaauuguauuacuucc

SEQ ID NO: 42760 - RNA, 17 nt, Human
agaacauuccaaguaca

SEQ ID NO: 42761 - RNA, 32 nt, Human
agaacauuccagaacccguuguggaaaaaccc

SEQ ID NO: 42762 - RNA, 32 nt, Human
agaacauucccccagauguuccaacugugacu

SEQ ID NO: 42763 - RNA, 32 nt, Human
agaacauuccuccuggcuuaguuguagcagac

SEQ ID NO: 42764 - RNA, 32 nt, Human
agaacauugcauaggaaugucuggaaaaagcc

SEQ ID NO: 42765 - RNA, 32 nt, Human
agaacauugccucugggugucauguggaccag

SEQ ID NO: 42766 - RNA, 32 nt, Human
agaacauugugguaggggaagggacucacuuu

SEQ ID NO: 42767 - RNA, 32 nt, Human
agaacauuuacaauuuugucuccuucaauaac

SEQ ID NO: 42768 - RNA, 32 nt, Human
agaacauuugacuucccugcaaaccuugguau

SEQ ID NO: 42769 - RNA, 32 nt, Human
agaacauuuuagccauugauguucacacgugg

SEQ ID NO: 42770 - RNA, 32 nt, Human
agaacauuuucagauuccccuccuuacauccu

SEQ ID NO: 42771 - RNA, 32 nt, Human
agaacauuuuuaaaaugucuuuuucuauguca

SEQ ID NO: 42772 - RNA, 32 nt, Human
agaaccaaacucaaagaauucugcagguucag

SEQ ID NO: 42773 - RNA, 32 nt, Human
agaaccaaaguggcauccuaagaguuguuaaa

SEQ ID NO: 42774 - RNA, 21 nt, Human
agaaccaaccaaacucaggag

SEQ ID NO: 42775 - RNA, 32 nt, Human
agaaccaaggaagugccuucauucugcuuugu

SEQ ID NO: 42776 - RNA, 32 nt, Human
agaaccaaugauuucuaagucuucuccuggau

SEQ ID NO: 42777 - RNA, 32 nt, Human
agaaccaaugucguaguucaucagccuccgaa

SEQ ID NO: 42778 - RNA, 32 nt, Human
agaaccacagcagcucuauuugccuauuccuc

SEQ ID NO: 42779 - RNA, 21 nt, Human
agaaccacaggagauccagga

SEQ ID NO: 42780 - RNA, 32 nt, Human
agaaccacaggcccuggccugccuugggccgg

SEQ ID NO: 42781 - RNA, 20 nt, Human
agaaccacagggcccaggag

SEQ ID NO: 42782 - RNA, 32 nt, Human
agaaccacaguugaaaccugcuuuuaucauuu

SEQ ID NO: 42783 - RNA, 32 nt, Human
agaaccacccagcccagaaguuccagggaagg

SEQ ID NO: 42784 - RNA, 20 nt, Human
agaaccacccagcgucuccc

SEQ ID NO: 42785 - RNA, 19 nt, Human
agaaccacuccuccaggag

SEQ ID NO: 42786 - RNA, 18 nt, Human
agaaccacugagaacccc

SEQ ID NO: 42787 - RNA, 32 nt, Human
agaaccacugauuuaaagugugacaguuccag

SEQ ID NO: 42788 - RNA, 17 nt, Human
agaaccacuguccuccu

SEQ ID NO: 42789 - RNA, 32 nt, Human
agaaccacuugcaggaagaacucuagagaauu

SEQ ID NO: 42790 - RNA, 32 nt, Human
agaaccacuuggcugcucauuccuucuggagg

SEQ ID NO: 42791 - RNA, 21 nt, Human
agaaccagaacccaccaggag

SEQ ID NO: 42792 - RNA, 32 nt, Human
agaaccagaagugcagccccucucacaggcag

SEQ ID NO: 42793 - RNA, 32 nt, Human
agaaccagagcaucucgaggcaacuguuagaa

SEQ ID NO: 42794 - RNA, 32 nt, Human
agaaccagagguccaaagaggcccagacccag

SEQ ID NO: 42795 - RNA, 22 nt, Human
agaaccagaggugcugccuucc

SEQ ID NO: 42796 - RNA, 28 nt, Human
agaaccagaggugcugccuucccugucu

SEQ ID NO: 42797 - RNA, 32 nt, Human
agaaccagaguccucagccucacccugaagug

SEQ ID NO: 42798 - RNA, 32 nt, Human
agaaccagccaguucgcuuuuucuccuaaggu

SEQ ID NO: 42799 - RNA, 32 nt, Human
agaaccagccuggacaacauagugagaccccg

SEQ ID NO: 42800 - RNA, 18 nt, Human
agaaccagcgcaagcaca

SEQ ID NO: 42801 - RNA, 21 nt, Human
agaaccagcuacgcccaugag

SEQ ID NO: 42802 - RNA, 18 nt, Human
agaaccagcucaaguaca

SEQ ID NO: 42803 - RNA, 32 nt, Human
agaaccagcugaaccaugaaacaaacaaaaau

SEQ ID NO: 42804 - RNA, 32 nt, Human
agaaccaggagagaugauggugugauuacagc

SEQ ID NO: 42805 - RNA, 32 nt, Human
agaaccaggagggagagugcagccaggcucag

SEQ ID NO: 42806 - RNA, 32 nt, Human
agaaccaggagguaagagucucuggagacagu

SEQ ID NO: 42807 - RNA, 32 nt, Human
agaaccaggauccugagaugagcuugagcuuu

SEQ ID NO: 42808 - RNA, 18 nt, Human
agaaccaggcuacaagag

SEQ ID NO: 42809 - RNA, 19 nt, Human
agaaccaggcuggcaggag

SEQ ID NO: 42810 - RNA, 32 nt, Human
agaaccagggcagcuucugccccuagagggcc

SEQ ID NO: 42811 - RNA, 32 nt, Human
agaaccaggucugcuccccaccuuacucggau

SEQ ID NO: 42812 - RNA, 32 nt, Human
agaaccaguccuuccuuuugacccaccccagg

SEQ ID NO: 42813 - RNA, 32 nt, Human
agaaccagugacaccaucacugagcuuccuaa

SEQ ID NO: 42814 - RNA, 20 nt, Human
agaaccagugagaucuggag

SEQ ID NO: 42815 - RNA, 19 nt, Human
agaaccagugcaccucagg

SEQ ID NO: 42816 - RNA, 32 nt, Human
agaaccagugcccggccccacacugccucugu

SEQ ID NO: 42817 - RNA, 19 nt, Human
agaaccagugccuaaagag

SEQ ID NO: 42818 - RNA, 19 nt, Human
agaaccaguggcugagcgg

SEQ ID NO: 42819 - RNA, 20 nt, Human
agaaccagugggcgaggggg

SEQ ID NO: 42820 - RNA, 19 nt, Human
agaaccaguuaccccggga

SEQ ID NO: 42821 - RNA, 32 nt, Human
agaaccaguucuggagcucaggccuuccugag

SEQ ID NO: 42822 - RNA, 32 nt, Human
agaaccauaaaacgcuaugcagaaggaacauu

SEQ ID NO: 42823 - RNA, 32 nt, Human
agaaccauaguuguuuuguucacuacuguaua

SEQ ID NO: 42824 - RNA, 17 nt, Human
agaaccauauccaagca

SEQ ID NO: 42825 - RNA, 32 nt, Human
agaaccaucaacacaagugacaugucauagca

SEQ ID NO: 42826 - RNA, 32 nt, Human
agaaccaugaggaggaaaugaacgcccuuuga

SEQ ID NO: 42827 - RNA, 18 nt, Human
agaaccaugcugucuucc

SEQ ID NO: 42828 - RNA, 32 nt, Human
agaaccauggucgccacuguuuucccucugua

SEQ ID NO: 42829 - RNA, 32 nt, Human
agaaccauuugcaauauggauuucuuagagau

SEQ ID NO: 42830 - RNA, 31 nt, Human
agaaccauuuuuacuuuacauccuaaaacug

SEQ ID NO: 42831 - RNA, 32 nt, Human
agaacccaaaaaucaggaauaggugauagacc

SEQ ID NO: 42832 - RNA, 19 nt, Human
agaacccaagagccaggag

SEQ ID NO: 42833 - RNA, 21 nt, Human
agaacccaagcccacauccaa

SEQ ID NO: 42834 - RNA, 32 nt, Human
agaacccaagguugagugcaacugggguugca

SEQ ID NO: 42835 - RNA, 32 nt, Human
agaacccaagucuccugacuccuggccuucua

SEQ ID NO: 42836 - RNA, 32 nt, Human
agaacccacagucaguuccugccuccugcaga

SEQ ID NO: 42837 - RNA, 19 nt, Human
agaacccaccagucuuucu

SEQ ID NO: 42838 - RNA, 32 nt, Human
agaacccaccucucccccaagggccucagccu

SEQ ID NO: 42839 - RNA, 32 nt, Human
agaacccaccuguagcccugagguucuuuucc

SEQ ID NO: 42840 - RNA, 23 nt, Human
agaacccaccuugcagcuuuucu

SEQ ID NO: 42841 - RNA, 21 nt, Human
agaacccagaaauaaagccaa

SEQ ID NO: 42842 - RNA, 20 nt, Human
agaacccagcaacccaggag

SEQ ID NO: 42843 - RNA, 32 nt, Human
agaacccagcagcgauguggagguggagaccc

SEQ ID NO: 42844 - RNA, 32 nt, Human
agaacccagcagugcccugcccugcagucuga

SEQ ID NO: 42845 - RNA, 32 nt, Human
agaacccagccucugcucacacccgccccagc

SEQ ID NO: 42846 - RNA, 32 nt, Human
agaacccaggagacggagguugcagugagccg

SEQ ID NO: 42847 - RNA, 32 nt, Human
agaacccaggaggcagagcuugcagugagccg

SEQ ID NO: 42848 - RNA, 32 nt, Human
agaacccaggagguggagacugcagugagcca

SEQ ID NO: 42849 - RNA, 20 nt, Human
agaacccagggauccaggag

SEQ ID NO: 42850 - RNA, 22 nt, Human
agaacccaggggcacgcucugg

SEQ ID NO: 42851 - RNA, 32 nt, Human
agaacccagggugguggcgaggugggagcugg

SEQ ID NO: 42852 - RNA, 24 nt, Human
agaacccagguaagcucggucuca

SEQ ID NO: 42853 - RNA, 20 nt, Human
agaacccaggucgucuuucu

SEQ ID NO: 42854 - RNA, 32 nt, Human
agaacccaugugcugauucccuguaaucuucc

SEQ ID NO: 42855 - RNA, 32 nt, Human
agaaccccaaaccacuaaaaacuaccuaaaca

SEQ ID NO: 42856 - RNA, 32 nt, Human
agaaccccagagggugagacaucagugcugag

SEQ ID NO: 42857 - RNA, 21 nt, Human
agaaccccagcggugcugguc

SEQ ID NO: 42858 - RNA, 32 nt, Human
agaaccccaugggggugugggggugaaguugg

SEQ ID NO: 42859 - RNA, 32 nt, Human
agaacccccaggagcgcccaggcuugggcagc

SEQ ID NO: 42860 - RNA, 32 nt, Human
agaacccccuagugaggagcugaacuugcuca

SEQ ID NO: 42861 - RNA, 32 nt, Human
agaaccccuccagggccggccugcggaggagc

SEQ ID NO: 42862 - RNA, 32 nt, Human
agaaccccugccaagaccuuugcucacugccu

SEQ ID NO: 42863 - RNA, 22 nt, Human
agaaccccugccagaaggcugg

SEQ ID NO: 42864 - RNA, 32 nt, Human
agaaccccugcucccccuguccccaccccagg

SEQ ID NO: 42865 - RNA, 32 nt, Human
agaaccccugggcugggccugcagugacccac

SEQ ID NO: 42866 - RNA, 21 nt, Human
agaaccccuugaacccgggag

SEQ ID NO: 42867 - RNA, 32 nt, Human
agaacccgcagacgaggccgagcugcugccgu

SEQ ID NO: 42868 - RNA, 20 nt, Human
agaacccgccaaugcugggg

SEQ ID NO: 42869 - RNA, 19 nt, Human
agaacccgcugggacuggc

SEQ ID NO: 42870 - RNA, 32 nt, Human
agaacccgggaggcggagcuugcagugagccg

SEQ ID NO: 42871 - RNA, 32 nt, Human
agaacccgggaggcggagguugcagugagccg

SEQ ID NO: 42872 - RNA, 32 nt, Human
agaacccgggagguggagcuugcggugagcug

SEQ ID NO: 42873 - RNA, 32 nt, Human
agaacccggucuccagugucacaaacaggccu

SEQ ID NO: 42874 - RNA, 32 nt, Human
agaacccuccaccccuacccccaacccucaga

SEQ ID NO: 42875 - RNA, 20 nt, Human
agaacccuccugaauuuucc

SEQ ID NO: 42876 - RNA, 32 nt, Human
agaacccuccugcuguuacggaggcagcacaa

SEQ ID NO: 42877 - RNA, 17 nt, Human
agaacccucuguuuucc

SEQ ID NO: 42878 - RNA, 32 nt, Human
agaacccugggaacgggaggcgaagggauaau

SEQ ID NO: 42879 - RNA, 19 nt, Human
agaacccugggagccagga

SEQ ID NO: 42880 - RNA, 18 nt, Human
agaacccuggggacccag

SEQ ID NO: 42881 - RNA, 32 nt, Human
agaacccuggggacccuaauguuggacucucg

SEQ ID NO: 42882 - RNA, 21 nt, Human
agaaccgcugccccacccccu

SEQ ID NO: 42883 - RNA, 21 nt, Human
agaaccgcuggaacccgggag

SEQ ID NO: 42884 - RNA, 21 nt, Human
agaaccgcuugaacccgggag

SEQ ID NO: 42885 - RNA, 21 nt, Human
agaaccgcuuguacccaggag

SEQ ID NO: 42886 - RNA, 20 nt, Human
agaaccggaaacacccagga

SEQ ID NO: 42887 - RNA, 32 nt, Human
agaaccggaaggcauccaguggggaagggaaa

SEQ ID NO: 42888 - RNA, 32 nt, Human
agaaccgggaggcggaaguugcagugagccaa

SEQ ID NO: 42889 - RNA, 32 nt, Human
agaaccgggaugcaaggagcugccugugacac

SEQ ID NO: 42890 - RNA, 32 nt, Human
agaaccgugaacugaagggacagggaacagcc

SEQ ID NO: 42891 - RNA, 32 nt, Human
agaaccuacaucuuucaugcuuucauugucuc

SEQ ID NO: 42892 - RNA, 32 nt, Human
agaaccuacuuaagauagaacaugguuuuggc

SEQ ID NO: 42893 - RNA, 32 nt, Human
agaaccuagaagccaaaagccacacagaaggg

SEQ ID NO: 42894 - RNA, 32 nt, Human
agaaccuaggagggaaaggaagauugagcaac

SEQ ID NO: 42895 - RNA, 32 nt, Human
agaaccuaucgaugacuuacugugcauggucu

SEQ ID NO: 42896 - RNA, 32 nt, Human
agaaccucaaacaggauggaacaucaguggau

SEQ ID NO: 42897 - RNA, 18 nt, Human
agaaccucaagagccuga

SEQ ID NO: 42898 - RNA, 32 nt, Human
agaaccucacguccuucugccugggcaagagc

SEQ ID NO: 42899 - RNA, 32 nt, Human
agaaccucagccagaaaggcaaggaggaaauc

SEQ ID NO: 42900 - RNA, 32 nt, Human
agaaccucagcccuaucuccauuucccuaucu

SEQ ID NO: 42901 - RNA, 32 nt, Human
agaaccucaggcuccaccucagaccuacuaug

SEQ ID NO: 42902 - RNA, 32 nt, Human
agaaccucccuaguugcugcuauaucaaacac

SEQ ID NO: 42903 - RNA, 32 nt, Human
agaaccucccuugaaugucugucacacucaca

SEQ ID NO: 42904 - RNA, 32 nt, Human
agaaccuccucuccucccuuguccaggugugu

SEQ ID NO: 42905 - RNA, 32 nt, Human
agaaccuccucucugcugaaagcugaacacuc

SEQ ID NO: 42906 - RNA, 19 nt, Human
agaaccuccucuguccucc

SEQ ID NO: 42907 - RNA, 32 nt, Human
agaaccucuccucuggaagcagcucugagggg

SEQ ID NO: 42908 - RNA, 19 nt, Human
agaaccucugcaucuggca

SEQ ID NO: 42909 - RNA, 32 nt, Human
agaaccucugccuccgagacaggcuggcccac

SEQ ID NO: 42910 - RNA, 32 nt, Human
agaaccucuugggagacagaagaggcaucugu

SEQ ID NO: 42911 - RNA, 21 nt, Human
agaaccugacaacuccaggag

SEQ ID NO: 42912 - RNA, 32 nt, Human
agaaccugauccugaagaguggcacaacugug

SEQ ID NO: 42913 - RNA, 32 nt, Human
agaaccugcccacagcucuccccgcuacaggc

SEQ ID NO: 42914 - RNA, 32 nt, Human
agaaccuggaccugacagccaaccuccuccac

SEQ ID NO: 42915 - RNA, 32 nt, Human
agaaccuggagcuuccugaagaagcaaagccu

SEQ ID NO: 42916 - RNA, 32 nt, Human
agaaccugggaaggaaaaccaguagcaucagc

SEQ ID NO: 42917 - RNA, 32 nt, Human
agaaccugggaggcggagcuugcagugagcca

SEQ ID NO: 42918 - RNA, 32 nt, Human
agaaccugggaggcggagguugcagucagcca

SEQ ID NO: 42919 - RNA, 32 nt, Human
agaaccugucaugggcuggggcucagauuuuc

SEQ ID NO: 42920 - RNA, 18 nt, Human
agaaccuguccaggcaca

SEQ ID NO: 42921 - RNA, 20 nt, Human
agaaccuuaaggaguccuug

SEQ ID NO: 42922 - RNA, 19 nt, Human
agaaccuucaaguccuucc

SEQ ID NO: 42923 - RNA, 32 nt, Human
agaaccuucuccccaccucugaguuauucucu

SEQ ID NO: 42924 - RNA, 32 nt, Human
agaaccuucuuugguuccauguugacugacuu

SEQ ID NO: 42925 - RNA, 32 nt, Human
agaaccuugcugggguuggagguuucacuugc

SEQ ID NO: 42926 - RNA, 32 nt, Human
agaaccuuggaguucauauuucacaaauauua

SEQ ID NO: 42927 - RNA, 32 nt, Human
agaaccuuguguccaaggagguccuucaggag

SEQ ID NO: 42928 - RNA, 32 nt, Human
agaacgacuuuccagguuugaagauuaugaaa

SEQ ID NO: 42929 - RNA, 32 nt, Human
agaacgagaagccagcuccuggaguuguuugc

SEQ ID NO: 42930 - RNA, 32 nt, Human
agaacgagagcaaagcaugugggugaagagaa

SEQ ID NO: 42931 - RNA, 32 nt, Human
agaacgagcugaugcucaacuccagccucaug

SEQ ID NO: 42932 - RNA, 32 nt, Human
agaacgaggaagaagaaacccuaggcagacac

SEQ ID NO: 42933 - RNA, 32 nt, Human
agaacgaggaggaaggagagaaaauggcaucc

SEQ ID NO: 42934 - RNA, 32 nt, Human
agaacgaggaggaaggagagaaaauggcgucc

SEQ ID NO: 42935 - RNA, 20 nt, Human
agaacgaugucaagugaaga

SEQ ID NO: 42936 - RNA, 32 nt, Human
agaacgauucugagugauuggcaccaagccuu

SEQ ID NO: 42937 - RNA, 32 nt, Human
agaacgcccgcuccagcgaucucuccacugug

SEQ ID NO: 42938 - RNA, 32 nt, Human
agaacgccgccuccuccgcuugcggccggucu

SEQ ID NO: 42939 - RNA, 32 nt, Human
agaacgccucagggucuugccugcugugagug

SEQ ID NO: 42940 - RNA, 32 nt, Human
agaacgcguccagcaaccgcgacccacgacga

SEQ ID NO: 42941 - RNA, 32 nt, Human
agaacggaagaagagaucaggaagagaaggag

SEQ ID NO: 42942 - RNA, 32 nt, Human
agaacggagagggaugcaggccagccagggau

SEQ ID NO: 42943 - RNA, 32 nt, Human
agaacggagggccuauggaggcccaugagggg

SEQ ID NO: 42944 - RNA, 32 nt, Human
agaacggauauaaucagucuggccucuacaac

SEQ ID NO: 42945 - RNA, 32 nt, Human
agaacggccacuggugugggaggggagcgcac

SEQ ID NO: 42946 - RNA, 21 nt, Human
agaacggcgugaacccgggag

SEQ ID NO: 42947 - RNA, 32 nt, Human
agaacgggagaggcaguuccuaccuugggaau

SEQ ID NO: 42948 - RNA, 32 nt, Human
agaacgggcccagggugcuguggagaucaacu

SEQ ID NO: 42949 - RNA, 32 nt, Human
agaacgggcuugauccuagccaugcgggagag

SEQ ID NO: 42950 - RNA, 32 nt, Human
agaacggggaagauaaccgaagggugguuuga

SEQ ID NO: 42951 - RNA, 32 nt, Human
agaacggggcccuguccaucacgcuggccaca

SEQ ID NO: 42952 - RNA, 32 nt, Human
agaacgggggcccuacccucuguuucuccuag

SEQ ID NO: 42953 - RNA, 32 nt, Human
agaacggugggaacugaggcggcacugcaggc

SEQ ID NO: 42954 - RNA, 32 nt, Human
agaacguaaaacugaggacagaggaggaaagc

SEQ ID NO: 42955 - RNA, 32 nt, Human
agaacguaccauugaagucgcaugcuauguuu

SEQ ID NO: 42956 - RNA, 32 nt, Human
agaacgucuaucuauccauaccaauaaucugg

SEQ ID NO: 42957 - RNA, 32 nt, Human
agaacgugcccagccacaucaucuuuaucucc

SEQ ID NO: 42958 - RNA, 32 nt, Human
agaacguggagugcgggggagcuguggauggu

SEQ ID NO: 42959 - RNA, 32 nt, Human
agaacgugucagagacaguggacagggaagcg

SEQ ID NO: 42960 - RNA, 25 nt, Human
agaacguuuuccuggacugcccugg

SEQ ID NO: 42961 - RNA, 19 nt, Human
agaacuaaaacuaagcaua

SEQ ID NO: 42962 - RNA, 32 nt, Human
agaacuaaaaggcucuguggcuuacauuucaa

SEQ ID NO: 42963 - RNA, 17 nt, Human
agaacuaaacuaagaca

SEQ ID NO: 42964 - RNA, 18 nt, Human
agaacuaaacuuagcaua

SEQ ID NO: 42965 - RNA, 32 nt, Human
agaacuaaaugcuguaccacagagccgggugu

SEQ ID NO: 42966 - RNA, 16 nt, Human
agaacuaacaccugca

SEQ ID NO: 42967 - RNA, 32 nt, Human
agaacuaacuauucaacacacaccuagaggag

SEQ ID NO: 42968 - RNA, 32 nt, Human
agaacuaagaagaaggaggaagaaagaaggag

SEQ ID NO: 42969 - RNA, 32 nt, Human
agaacuaagacaucugugcuaaggcaucuauu

SEQ ID NO: 42970 - RNA, 18 nt, Human
agaacuaagaccaaaaca

SEQ ID NO: 42971 - RNA, 32 nt, Human
agaacuaaggcugaaaccucggaggaacaacc

SEQ ID NO: 42972 - RNA, 32 nt, Human
agaacuaagggaggucugugcauuuuaaacac

SEQ ID NO: 42973 - RNA, 19 nt, Human
agaacuaauacgccaagca

SEQ ID NO: 42974 - RNA, 18 nt, Human
agaacuaaucauucagca

SEQ ID NO: 42975 - RNA, 32 nt, Human
agaacuacaagugacauaacagaagaaaaaua

SEQ ID NO: 42976 - RNA, 20 nt, Human
agaacuaccagacgagcaca

SEQ ID NO: 42977 - RNA, 20 nt, Human
agaacuacuaccuccaggag

SEQ ID NO: 42978 - RNA, 32 nt, Human
agaacuacucauccagcaucuccuggguugag

SEQ ID NO: 42979 - RNA, 32 nt, Human
agaacuacuucacaguaguugcagugaggauu

SEQ ID NO: 42980 - RNA, 32 nt, Human
agaacuagagaagcaagagcaaacacauucaa

SEQ ID NO: 42981 - RNA, 32 nt, Human
agaacuagagaagcaagagcaaacacauugaa

SEQ ID NO: 42982 - RNA, 32 nt, Human
agaacuagaguuccuauuuucagcuaguugaa

SEQ ID NO: 42983 - RNA, 32 nt, Human
agaacuagauaacaugguaacagagaauugau

SEQ ID NO: 42984 - RNA, 32 nt, Human
agaacuagauagagccucccaacccugauuua

SEQ ID NO: 42985 - RNA, 32 nt, Human
agaacuagauaggauuucaccauguugcccag

SEQ ID NO: 42986 - RNA, 32 nt, Human
agaacuagcuggagaaggcaagagugaaggug

SEQ ID NO: 42987 - RNA, 32 nt, Human
agaacuaggguacugaucagcuaauuuccgug

SEQ ID NO: 42988 - RNA, 32 nt, Human
agaacuauaaauuuuguuuaagcaauuuauaa

SEQ ID NO: 42989 - RNA, 32 nt, Human
agaacuaugacuguaagccucaguacuguaca

SEQ ID NO: 42990 - RNA, 23 nt, Human
agaacuauggugugaauaccaca

SEQ ID NO: 42991 - RNA, 32 nt, Human
agaacuauuuuauucuaaacagacucauuaca

SEQ ID NO: 42992 - RNA, 32 nt, Human
agaacucaagcuccaugaggagauguuucaug

SEQ ID NO: 42993 - RNA, 32 nt, Human
agaacucaagggacaggaaggagaugaguugg

SEQ ID NO: 42994 - RNA, 32 nt, Human
agaacucaagugaagggcaaucagggcagacu

SEQ ID NO: 42995 - RNA, 32 nt, Human
agaacucaaugcagaugcauugguuauuaccc

SEQ ID NO: 42996 - RNA, 22 nt, Human
agaacucacaacccccucucug

SEQ ID NO: 42997 - RNA, 32 nt, Human
agaacucaccauugcacuccagccuggaugac

SEQ ID NO: 42998 - RNA, 24 nt, Human
agaacucaccccagugcccucugg

SEQ ID NO: 42999 - RNA, 32 nt, Human
agaacucacuggggccuacagcuuugaucccu

SEQ ID NO: 43000 - RNA, 32 nt, Human
agaacucagaguugugugugcaaugcacaccc

SEQ ID NO: 43001 - RNA, 32 nt, Human
agaacucagcagcugccaccgcagcugccucc

SEQ ID NO: 43002 - RNA, 32 nt, Human
agaacucaggaaaugugucugaagccagagcg

SEQ ID NO: 43003 - RNA, 32 nt, Human
agaacucaggcugccuccagccagccuuugcc

SEQ ID NO: 43004 - RNA, 32 nt, Human
agaacucagucauucugaucugcuuuggccau

SEQ ID NO: 43005 - RNA, 32 nt, Human
agaacucaucacagaaaugaaauacagugguc

SEQ ID NO: 43006 - RNA, 32 nt, Human
agaacucauguaacccuccuguuucuuacauc

SEQ ID NO: 43007 - RNA, 32 nt, Human
agaacucauuagcugugugacucugggugagu

SEQ ID NO: 43008 - RNA, 32 nt, Human
agaacucauuuuacagaacuugguuuccuuug

SEQ ID NO: 43009 - RNA, 23 nt, Human
agaacuccagaauccagagcaaa

SEQ ID NO: 43010 - RNA, 32 nt, Human
agaacuccagcaaauccaauggcuacaaacua

SEQ ID NO: 43011 - RNA, 32 nt, Human
agaacuccaggauauaggaagccagagaaagu

SEQ ID NO: 43012 - RNA, 32 nt, Human
agaacuccaucuugagaugaaauaacaucuac

SEQ ID NO: 43013 - RNA, 32 nt, Human
agaacuccaucuuuguacucuucagaugaaua

SEQ ID NO: 43014 - RNA, 32 nt, Human
agaacuccauuccggccaaccuaggaggucuc

SEQ ID NO: 43015 - RNA, 32 nt, Human
agaacuccauuugacagaugaggaaacggcga

SEQ ID NO: 43016 - RNA, 32 nt, Human
agaacuccccugucuguucucuuugcucuauc

SEQ ID NO: 43017 - RNA, 32 nt, Human
agaacucccuagugaggagcugaacuugcuca

SEQ ID NO: 43018 - RNA, 32 nt, Human
agaacucccuuucaacagaauucacuuguggc

SEQ ID NO: 43019 - RNA, 32 nt, Human
agaacuccgaggcugagacuaggguuuuagcg

SEQ ID NO: 43020 - RNA, 32 nt, Human
agaacuccugcauggcucacacagacuggggg

SEQ ID NO: 43021 - RNA, 32 nt, Human
agaacuccuucauuauaacuaaauuguucaca

SEQ ID NO: 43022 - RNA, 32 nt, Human
agaacucuauuucacugucacuucauccauua

SEQ ID NO: 43023 - RNA, 32 nt, Human
agaacucucacauaagcggccaccucacuuca

SEQ ID NO: 43024 - RNA, 24 nt, Human
agaacucuccaccccagcucccac

SEQ ID NO: 43025 - RNA, 32 nt, Human
agaacucuccacccucaucucucugcguauuu

SEQ ID NO: 43026 - RNA, 32 nt, Human
agaacucucucccuggucucugccagcccaag

SEQ ID NO: 43027 - RNA, 32 nt, Human
agaacucucuggcacuaugggcacuugcacau

SEQ ID NO: 43028 - RNA, 26 nt, Human
agaacucucuugccuucaccaaccca

SEQ ID NO: 43029 - RNA, 32 nt, Human
agaacucugacugcagaacugccgcucucagu

SEQ ID NO: 43030 - RNA, 32 nt, Human
agaacucugagcagugcuugaaugaaguugua

SEQ ID NO: 43031 - RNA, 32 nt, Human
agaacucugauugccagaggcuuuucauuaau

SEQ ID NO: 43032 - RNA, 32 nt, Human
agaacucuggaaggccaaguucaucgcagcau

SEQ ID NO: 43033 - RNA, 32 nt, Human
agaacucuggauccugaacuggaagaaaaugu

SEQ ID NO: 43034 - RNA, 32 nt, Human
agaacucugggcuuggguaaugagcaggaaga

SEQ ID NO: 43035 - RNA, 32 nt, Human
agaacucuguaacccagcugcagcuucagucu

SEQ ID NO: 43036 - RNA, 32 nt, Human
agaacucuguauccaucagagaauauggaacu

SEQ ID NO: 43037 - RNA, 19 nt, Human
agaacucugugcccaggag

SEQ ID NO: 43038 - RNA, 32 nt, Human
agaacucugugccugguuucugaggacuguuu

SEQ ID NO: 43039 - RNA, 32 nt, Human
agaacucuguuacacauauuuuugacccauau

SEQ ID NO: 43040 - RNA, 32 nt, Human
agaacucuuaacgugaacauuuugucagccca

SEQ ID NO: 43041 - RNA, 21 nt, Human
agaacucuucauugucagcaa

SEQ ID NO: 43042 - RNA, 18 nt, Human
agaacucuuccuaaaagc

SEQ ID NO: 43043 - RNA, 32 nt, Human
agaacucuucuuuuucuuucuagagacuccau

SEQ ID NO: 43044 - RNA, 18 nt, Human
agaacucuugcucuuccu

SEQ ID NO: 43045 - RNA, 32 nt, Human
agaacugaaagcacuagagcagccuuggggac

SEQ ID NO: 43046 - RNA, 32 nt, Human
agaacugaaaguguuuucagguaucuuuguag

SEQ ID NO: 43047 - RNA, 32 nt, Human
agaacugaagauuccuggugcuuuuguuaaca

SEQ ID NO: 43048 - RNA, 32 nt, Human
agaacugaauggcagucugccuuuguguugau

SEQ ID NO: 43049 - RNA, 32 nt, Human
agaacugacucaaagcccuguggccuccuuga

SEQ ID NO: 43050 - RNA, 32 nt, Human
agaacugagguuucaauaaacaguuucaguug

SEQ ID NO: 43051 - RNA, 32 nt, Human
agaacugauagagagaacugaacgaaugaaga

SEQ ID NO: 43052 - RNA, 32 nt, Human
agaacugaucuucacauuggaacaaggagaag

SEQ ID NO: 43053 - RNA, 19 nt, Human
agaacugauggccagcaca

SEQ ID NO: 43054 - RNA, 32 nt, Human
agaacugcaaugugcggcccuccuggaggcag

SEQ ID NO: 43055 - RNA, 32 nt, Human
agaacugcacagucuagcugcuucuagucagc

SEQ ID NO: 43056 - RNA, 20 nt, Human
agaacugcacucuucaggaa

SEQ ID NO: 43057 - RNA, 32 nt, Human
agaacugcagccccuggaaaagaagagacagc

SEQ ID NO: 43058 - RNA, 32 nt, Human
agaacugccaacguguucaucagugagagggu

SEQ ID NO: 43059 - RNA, 32 nt, Human
agaacugcccagccacggguuuuuaacccacc

SEQ ID NO: 43060 - RNA, 16 nt, Human
agaacugccgcucuca

SEQ ID NO: 43061 - RNA, 21 nt, Human
agaacugccugaacccaggag

SEQ ID NO: 43062 - RNA, 32 nt, Human
agaacugccuuugcacuaaauuagugacuugg

SEQ ID NO: 43063 - RNA, 32 nt, Human
agaacugcucagggacauuaaaggucaaaagu

SEQ ID NO: 43064 - RNA, 23 nt, Human
agaacugcuccccaaaucaguga

SEQ ID NO: 43065 - RNA, 32 nt, Human
agaacugcuccuucaucguaaauuuagaagac

SEQ ID NO: 43066 - RNA, 32 nt, Human
agaacugcugaaagagacaaacucagccaaaa

SEQ ID NO: 43067 - RNA, 32 nt, Human
agaacugcugcgcgggaggccauggccggcaa

SEQ ID NO: 43068 - RNA, 32 nt, Human
agaacugcuggcauauugagcccucucucuuu

SEQ ID NO: 43069 - RNA, 32 nt, Human
agaacugcugggaggcuguggcgcgaggcggg

SEQ ID NO: 43070 - RNA, 21 nt, Human
agaacugcuugaacccaggag

SEQ ID NO: 43071 - RNA, 32 nt, Human
agaacugcuugaaccugggaggcggagguugc

SEQ ID NO: 43072 - RNA, 32 nt, Human
agaacugcuugaaccugggagguggagguugc

SEQ ID NO: 43073 - RNA, 21 nt, Human
agaacugcuugagcccaggag

SEQ ID NO: 43074 - RNA, 32 nt, Human
agaacuggacagacgaccaccauauucacuga

SEQ ID NO: 43075 - RNA, 32 nt, Human
agaacuggacuugaguuugcaaggugggaggc

SEQ ID NO: 43076 - RNA, 32 nt, Human
agaacuggagccaggacuaagugagaaaaacu

SEQ ID NO: 43077 - RNA, 17 nt, Human
agaacuggagcgaagug

SEQ ID NO: 43078 - RNA, 32 nt, Human
agaacuggagguggcagcagugguaccugcau

SEQ ID NO: 43079 - RNA, 18 nt, Human
agaacuggcacacacaca

SEQ ID NO: 43080 - RNA, 32 nt, Human
agaacuggcagguuccugccuccugacguacc

SEQ ID NO: 43081 - RNA, 32 nt, Human
agaacuggcccaaacaccucagcucugguccc

SEQ ID NO: 43082 - RNA, 32 nt, Human
agaacuggccuccagccgguguccucauucca

SEQ ID NO: 43083 - RNA, 21 nt, Human
agaacuggccuccccagccca

SEQ ID NO: 43084 - RNA, 32 nt, Human
agaacuggcucaggccaagaucaccaaagacc

SEQ ID NO: 43085 - RNA, 32 nt, Human
agaacuggcuggagcugcuuauucuuggccuu

SEQ ID NO: 43086 - RNA, 32 nt, Human
agaacugggaaggccacagggguggggcagcc

SEQ ID NO: 43087 - RNA, 32 nt, Human
agaacugggauuacaggcaugaggcaccgugc

SEQ ID NO: 43088 - RNA, 32 nt, Human
agaacugggauugcaggcgugagccaccgcgc

SEQ ID NO: 43089 - RNA, 21 nt, Human
agaacuggggacacucugggc

SEQ ID NO: 43090 - RNA, 22 nt, Human
agaacugggguacagccugggc

SEQ ID NO: 43091 - RNA, 32 nt, Human
agaacugggucuccagcacucacuaagacgga

SEQ ID NO: 43092 - RNA, 30 nt, Human
agaacuggucucuacagggcacaguucagc

SEQ ID NO: 43093 - RNA, 32 nt, Human
agaacuggucuucucacacuuucucugaauca

SEQ ID NO: 43094 - RNA, 32 nt, Human
agaacuggugcagcuucucucucccucccucc

SEQ ID NO: 43095 - RNA, 32 nt, Human
agaacuguagaaagccacacacuacuacaucc

SEQ ID NO: 43096 - RNA, 32 nt, Human
agaacuguaugucagacauccauguuuguaaa

SEQ ID NO: 43097 - RNA, 32 nt, Human
agaacuguauuuuuaagguuguuuuccccuaa

SEQ ID NO: 43098 - RNA, 19 nt, Human
agaacugucgggaccagga

SEQ ID NO: 43099 - RNA, 32 nt, Human
agaacugugaaaacuuuuauuccuucaugauc

SEQ ID NO: 43100 - RNA, 32 nt, Human
agaacugugaaagagagcagucaggaaugcua

SEQ ID NO: 43101 - RNA, 32 nt, Human
agaacugugaaauaauaaauguguauuguugg

SEQ ID NO: 43102 - RNA, 20 nt, Human
agaacugugacccccaaccc

SEQ ID NO: 43103 - RNA, 32 nt, Human
agaacugugguuuugacuuccuuaucucuugg

SEQ ID NO: 43104 - RNA, 32 nt, Human
agaacuguguuuuuaaacuguaggagaauuua

SEQ ID NO: 43105 - RNA, 32 nt, Human
agaacuguugauuuauuacaguucucaaauua

SEQ ID NO: 43106 - RNA, 32 nt, Human
agaacuuaaaaaguaauuuuuggaaaugaggc

SEQ ID NO: 43107 - RNA, 32 nt, Human
agaacuuaaaggcccauaguaacugcgaauga

SEQ ID NO: 43108 - RNA, 32 nt, Human
agaacuuaagaccugauucuagcaauaaacgu

SEQ ID NO: 43109 - RNA, 21 nt, Human
agaacuuaauggaaaacaaga

SEQ ID NO: 43110 - RNA, 25 nt, Human
agaacuuaccaaaaugaaagcaaca

SEQ ID NO: 43111 - RNA, 32 nt, Human
agaacuuaccauugaaaacagagcuuuuaggc

SEQ ID NO: 43112 - RNA, 32 nt, Human
agaacuuacucacccaucccacugacaccaug

SEQ ID NO: 43113 - RNA, 17 nt, Human
agaacuuacuggaagug

SEQ ID NO: 43114 - RNA, 32 nt, Human
agaacuuaucucacuccugugaacuuucaggc

SEQ ID NO: 43115 - RNA, 32 nt, Human
agaacuucagggacccguguccuagagucgga

SEQ ID NO: 43116 - RNA, 32 nt, Human
agaacuucagggacugggagcagaggccccuc

SEQ ID NO: 43117 - RNA, 32 nt, Human
agaacuucccugccuccuccagucucuccauc

SEQ ID NO: 43118 - RNA, 32 nt, Human
agaacuuccguuuaaaccuuccuugccugccg

SEQ ID NO: 43119 - RNA, 32 nt, Human
agaacuugaagccaccaugggagaugaagauu

SEQ ID NO: 43120 - RNA, 32 nt, Human
agaacuugaccacugccacaccagcccugggg

SEQ ID NO: 43121 - RNA, 32 nt, Human
agaacuugaggccagggaccaggccuucaaga

SEQ ID NO: 43122 - RNA, 32 nt, Human
agaacuugcaaaacaacacagcuuuucaguuc

SEQ ID NO: 43123 - RNA, 32 nt, Human
agaacuugcauucuguguucaucaccaggaua

SEQ ID NO: 43124 - RNA, 32 nt, Human
agaacuugccagauagaaaagacuuaaaugga

SEQ ID NO: 43125 - RNA, 19 nt, Human
agaacuuggcaaguuuucu

SEQ ID NO: 43126 - RNA, 19 nt, Human
agaacuuguaccaaguaca

SEQ ID NO: 43127 - RNA, 32 nt, Human
agaacuuguuuccagaccagcauccaguggcc

SEQ ID NO: 43128 - RNA, 32 nt, Human
agaacuuguuuuggaugugauuauauguacga

SEQ ID NO: 43129 - RNA, 32 nt, Human
agaacuuuaaccggagcuucaucuagugauug

SEQ ID NO: 43130 - RNA, 19 nt, Human
agaacuuuagcuccaggga

SEQ ID NO: 43131 - RNA, 32 nt, Human
agaacuuuaguauuaaaucaguucucaauuuc

SEQ ID NO: 43132 - RNA, 32 nt, Human
agaacuuuccucacccgccccugcccagacag

SEQ ID NO: 43133 - RNA, 32 nt, Human
agaacuuuccuuucugccucuucaauccaucu

SEQ ID NO: 43134 - RNA, 32 nt, Human
agaacuuucucuugcuaucauugcuccuuuug

SEQ ID NO: 43135 - RNA, 19 nt, Human
agaacuuugaaccuaggag

SEQ ID NO: 43136 - RNA, 32 nt, Human
agaacuuugagcuaugugaggcacgcagaauu

SEQ ID NO: 43137 - RNA, 32 nt, Human
agaacuuugggaggccgaggugaguggauugc

SEQ ID NO: 43138 - RNA, 32 nt, Human
agaacuuuuccucaucauaggacaccuuaaag

SEQ ID NO: 43139 - RNA, 32 nt, Human
agaacuuuuugcuuccccuccuccaaguuuua

SEQ ID NO: 43140 - RNA, 23 nt, Human
agaacuuuuuugggaaccaggag

SEQ ID NO: 43141 - RNA, 32 nt, Human
agaagaaaaagaggaggaaaaagguagggaga

SEQ ID NO: 43142 - RNA, 32 nt, Human
agaagaaaaagaggaggaaaaaguggauuaca

SEQ ID NO: 43143 - RNA, 32 nt, Human
agaagaaaaagggcuucucucugggcuccaca

SEQ ID NO: 43144 - RNA, 32 nt, Human
agaagaaaacuagaacuuuagagcaggaguaa

SEQ ID NO: 43145 - RNA, 32 nt, Human
agaagaaaaggcaugggucuuuguuugagauc

SEQ ID NO: 43146 - RNA, 32 nt, Human
agaagaaaaguaaaaguacccauuguuucacu

SEQ ID NO: 43147 - RNA, 32 nt, Human
agaagaaaaucagagagggaagaucugguauu

SEQ ID NO: 43148 - RNA, 24 nt, Human
agaagaaacacugaggaaagaaga

SEQ ID NO: 43149 - RNA, 32 nt, Human
agaagaaacauggugaaaacaggcugagguug

SEQ ID NO: 43150 - RNA, 32 nt, Human
agaagaaagcuucaguuuacuguuuccaugcu

SEQ ID NO: 43151 - RNA, 32 nt, Human
agaagaaagcuuccaguuguccccagcugcca

SEQ ID NO: 43152 - RNA, 32 nt, Human
agaagaaaggaaacaaugugauucaagauauu

SEQ ID NO: 43153 - RNA, 32 nt, Human
agaagaaaggagcugaggaggagaagccaaag

SEQ ID NO: 43154 - RNA, 32 nt, Human
agaagaaagggaggggaggggagaaucgagga

SEQ ID NO: 43155 - RNA, 32 nt, Human
agaagaaaguccagaggaggcuggccuggagg

SEQ ID NO: 43156 - RNA, 32 nt, Human
agaagaaaguggaggaagugcuagaagaggag

SEQ ID NO: 43157 - RNA, 32 nt, Human
agaagaaauaccaauaacacacacagaacaaa

SEQ ID NO: 43158 - RNA, 32 nt, Human
agaagaaaugugccuccggaccaacuggucug

SEQ ID NO: 43159 - RNA, 32 nt, Human
agaagaaccagcuccacggcuccugcuucugc

SEQ ID NO: 43160 - RNA, 32 nt, Human
agaagaagaaacuguuucuccaggcgacuuug

SEQ ID NO: 43161 - RNA, 32 nt, Human
agaagaagaagaggaagaaagaacaguagaaa

SEQ ID NO: 43162 - RNA, 32 nt, Human
agaagaagaagaggaggaagagagggaaagag

SEQ ID NO: 43163 - RNA, 32 nt, Human
agaagaagaagaggaggaggaggaggaggaag

SEQ ID NO: 43164 - RNA, 32 nt, Human
agaagaagaccacccccauuguucugcauccu

SEQ ID NO: 43165 - RNA, 32 nt, Human
agaagaagagacacaaaucucuaccucccaug

SEQ ID NO: 43166 - RNA, 32 nt, Human
agaagaagagagcauagccaccuaggggagga

SEQ ID NO: 43167 - RNA, 32 nt, Human
agaagaagaggaagaagaggaggcggcggcgc

SEQ ID NO: 43168 - RNA, 32 nt, Human
agaagaagaggaagagaggccugagcgagcau

SEQ ID NO: 43169 - RNA, 32 nt, Human
agaagaagaggaggaggaggaggaggaagaag

SEQ ID NO: 43170 - RNA, 32 nt, Human
agaagaagaggguggagcaggaggcucucacu

SEQ ID NO: 43171 - RNA, 32 nt, Human
agaagaagcaaaccuguuucuccucauuugga

SEQ ID NO: 43172 - RNA, 32 nt, Human
agaagaagccagggaagcagugcaauggcuuc

SEQ ID NO: 43173 - RNA, 32 nt, Human
agaagaagcugaacuucagacugugaaaggua

SEQ ID NO: 43174 - RNA, 32 nt, Human
agaagaagcugaugcccugaggcugggcacag

SEQ ID NO: 43175 - RNA, 32 nt, Human
agaagaaggaaagagagggauggggaaagaca

SEQ ID NO: 43176 - RNA, 32 nt, Human
agaagaaggaagcuggaccaggaaccuuggaa

SEQ ID NO: 43177 - RNA, 32 nt, Human
agaagaaggagaaagggagaaagcucaagaaa

SEQ ID NO: 43178 - RNA, 32 nt, Human
agaagaaggagaagaagagggagagaagaaag

SEQ ID NO: 43179 - RNA, 32 nt, Human
agaagaaggaggaggaggaggaggaggaggag

SEQ ID NO: 43180 - RNA, 32 nt, Human
agaagaaggcacaggaggaucucuaagcagua

SEQ ID NO: 43181 - RNA, 32 nt, Human
agaagaaggcagcacaggaucuguagcugagg

SEQ ID NO: 43182 - RNA, 32 nt, Human
agaagaaggcgcugucugggggagacagguua

SEQ ID NO: 43183 - RNA, 32 nt, Human
agaagaaggcggagaggcaguucuccagccgc

SEQ ID NO: 43184 - RNA, 32 nt, Human
agaagaaggcucaagaauuuauucaccaguuc

SEQ ID NO: 43185 - RNA, 32 nt, Human
agaagaaggcugggucucaguccuaugggaga

SEQ ID NO: 43186 - RNA, 32 nt, Human
agaagaagggaagagagcagcaguagcuuaag

SEQ ID NO: 43187 - RNA, 31 nt, Human
agaagaaguaagaaagaaaaagccuguuggc

SEQ ID NO: 43188 - RNA, 32 nt, Human
agaagaagugaguguuucuaugaguggaaaaa

SEQ ID NO: 43189 - RNA, 32 nt, Human
agaagaaucaaccugcacugccauccacacag

SEQ ID NO: 43190 - RNA, 32 nt, Human
agaagaaucagccuggcagcagcauugugauu

SEQ ID NO: 43191 - RNA, 32 nt, Human
agaagaaucauccacaccacucuucgccaccc

SEQ ID NO: 43192 - RNA, 32 nt, Human
agaagaaucuggaucauuagauaaaaauggcu

SEQ ID NO: 43193 - RNA, 32 nt, Human
agaagaaucuuuccuuuguccuguucuaaccu

SEQ ID NO: 43194 - RNA, 32 nt, Human
agaagaaugaagcaaguucacuuucaaucaag

SEQ ID NO: 43195 - RNA, 22 nt, Human
agaagaaugagaagacaggaga

SEQ ID NO: 43196 - RNA, 32 nt, Human
agaagaaugauacuguuuaugaugaauccaua

SEQ ID NO: 43197 - RNA, 32 nt, Human
agaagaaugccaccaugccagucaccauguug

SEQ ID NO: 43198 - RNA, 22 nt, Human
agaagaauguuggccucucuuc

SEQ ID NO: 43199 - RNA, 32 nt, Human
agaagacaaaucugguagacacuacugugaca

SEQ ID NO: 43200 - RNA, 32 nt, Human
agaagacaaggcacagugcagcuuggugaagc

SEQ ID NO: 43201 - RNA, 32 nt, Human
agaagacaaugagacgagaacacuucuaaggc

SEQ ID NO: 43202 - RNA, 32 nt, Human
agaagacacaguguccauccucccagauugga

SEQ ID NO: 43203 - RNA, 19 nt, Human
agaagacacugaagaauuu

SEQ ID NO: 43204 - RNA, 32 nt, Human
agaagacacugucucaugggccugugcuguca

SEQ ID NO: 43205 - RNA, 32 nt, Human
agaagacagaaacgacaugagcacagcaggaa

SEQ ID NO: 43206 - RNA, 32 nt, Human
agaagacagaaucaacaugagcacagcaggaa

SEQ ID NO: 43207 - RNA, 32 nt, Human
agaagacagaaucaauaugagcacagcaggaa

SEQ ID NO: 43208 - RNA, 32 nt, Human
agaagacagagcuauuucagaggcucugugug

SEQ ID NO: 43209 - RNA, 32 nt, Human
agaagacagcaaauacugcuugagcccuggau

SEQ ID NO: 43210 - RNA, 16 nt, Human
agaagacagcagggga

SEQ ID NO: 43211 - RNA, 32 nt, Human
agaagacagccaugcacugagcuggggacaug

SEQ ID NO: 43212 - RNA, 32 nt, Human
agaagacagccgaagucaaagccacauccucu

SEQ ID NO: 43213 - RNA, 24 nt, Human
agaagacaggaggaagaaagggag

SEQ ID NO: 43214 - RNA, 18 nt, Human
agaagacagucccaggag

SEQ ID NO: 43215 - RNA, 32 nt, Human
agaagacauacaaaagccucuucugaaggaaa

SEQ ID NO: 43216 - RNA, 32 nt, Human
agaagacaugcugcuauggucacugagggguu

SEQ ID NO: 43217 - RNA, 32 nt, Human
agaagacauggcuuccagaaaagagaaugcga

SEQ ID NO: 43218 - RNA, 32 nt, Human
agaagacauguuccucuaugcuaagaugauua

SEQ ID NO: 43219 - RNA, 32 nt, Human
agaagaccaaggggaagaggugcaguggggag

SEQ ID NO: 43220 - RNA, 32 nt, Human
agaagaccaccugaauucucaucccaucuaag

SEQ ID NO: 43221 - RNA, 21 nt, Human
agaagaccacgagacuuggua

SEQ ID NO: 43222 - RNA, 26 nt, Human
agaagaccagcacccucaaccuggua

SEQ ID NO: 43223 - RNA, 32 nt, Human
agaagaccauguccauagcccugaagcaggua

SEQ ID NO: 43224 - RNA, 32 nt, Human
agaagacccucgggaagcagucagacugcacu

SEQ ID NO: 43225 - RNA, 32 nt, Human
agaagacccugggaguucccuggggacccuga

SEQ ID NO: 43226 - RNA, 32 nt, Human
agaagaccucagaaaccgaaagaaaaccacca

SEQ ID NO: 43227 - RNA, 32 nt, Human
agaagaccuccaggugccgguugcugggcuca

SEQ ID NO: 43228 - RNA, 32 nt, Human
agaagaccucgucccuuccuagucagggcauc

SEQ ID NO: 43229 - RNA, 32 nt, Human
agaagaccucuggcuuuccuggaacacagaug

SEQ ID NO: 43230 - RNA, 32 nt, Human
agaagaccugaguucuucucucaguuccaagc

SEQ ID NO: 43231 - RNA, 32 nt, Human
agaagaccugggacagaggacugcugucugcc

SEQ ID NO: 43232 - RNA, 24 nt, Human
agaagaccuuucuagaaccuggua

SEQ ID NO: 43233 - RNA, 32 nt, Human
agaagacgacauccagcugcucaaaucagcuc

SEQ ID NO: 43234 - RNA, 32 nt, Human
agaagacgcccgcgccccagccccaggcgccu

SEQ ID NO: 43235 - RNA, 32 nt, Human
agaagacgcccucaccuaucuggaccagguga

SEQ ID NO: 43236 - RNA, 32 nt, Human
agaagacggaggucaagccugaagauaguggc

SEQ ID NO: 43237 - RNA, 32 nt, Human
agaagacguaguguaugagaaagggccauuuu

SEQ ID NO: 43238 - RNA, 32 nt, Human
agaagacgucuccccuucucugccucaccugg

SEQ ID NO: 43239 - RNA, 20 nt, Human
agaagacguggaggggagcc

SEQ ID NO: 43240 - RNA, 32 nt, Human
agaagacuaucauaugaaccagaaaggguaac

SEQ ID NO: 43241 - RNA, 32 nt, Human
agaagacuaugcugaaacuaucgcucacauuc

SEQ ID NO: 43242 - RNA, 32 nt, Human
agaagacucaaggaaguggggauuagauuagg

SEQ ID NO: 43243 - RNA, 32 nt, Human
agaagacucuuacuugcaugugucucaggguc

SEQ ID NO: 43244 - RNA, 32 nt, Human
agaagacugaaagaguagaaagaaguugcugu

SEQ ID NO: 43245 - RNA, 32 nt, Human
agaagacugagggagcacaggagaagccacaa

SEQ ID NO: 43246 - RNA, 32 nt, Human
agaagacuggaauuccuuucucccagaugauc

SEQ ID NO: 43247 - RNA, 32 nt, Human
agaagacugugacaacucaugaccugcauccu

SEQ ID NO: 43248 - RNA, 32 nt, Human
agaagacuguucugcaauuugcugccaaaugc

SEQ ID NO: 43249 - RNA, 17 nt, Human
agaagacuguuuuuagu

SEQ ID NO: 43250 - RNA, 32 nt, Human
agaagagaaaauuugaaaauguccuuaugcuu

SEQ ID NO: 43251 - RNA, 23 nt, Human
agaagagaaaccaguacaaaaga

SEQ ID NO: 43252 - RNA, 32 nt, Human
agaagagaaacuuggcuucuguuuucgcaaag

SEQ ID NO: 43253 - RNA, 32 nt, Human
agaagagaaagaaguccucuuggggcuuuuua

SEQ ID NO: 43254 - RNA, 32 nt, Human
agaagagaaaggugagaaagaagaggaagaua

SEQ ID NO: 43255 - RNA, 32 nt, Human
agaagagaaauguucaccauguagggaauguu

SEQ ID NO: 43256 - RNA, 32 nt, Human
agaagagaagaaaaagggaggagagagaagga

SEQ ID NO: 43257 - RNA, 32 nt, Human
agaagagaagaauggggacaacagaaaccugc

SEQ ID NO: 43258 - RNA, 22 nt, Human
agaagagaagguugaaaagaga

SEQ ID NO: 43259 - RNA, 32 nt, Human
agaagagaauacucauuuuuguccaguguuuu

SEQ ID NO: 43260 - RNA, 20 nt, Human
agaagagaaugcaccccuga

SEQ ID NO: 43261 - RNA, 32 nt, Human
agaagagacacagaucacagaugaucaaguag

SEQ ID NO: 43262 - RNA, 24 nt, Human
agaagagacacugaggacaagaga

SEQ ID NO: 43263 - RNA, 32 nt, Human
agaagagacagaggagaggaaagggaaguagu

SEQ ID NO: 43264 - RNA, 22 nt, Human
agaagagacaggagaucagaga

SEQ ID NO: 43265 - RNA, 32 nt, Human
agaagagacagugaccaccuuuugaagagcuc

SEQ ID NO: 43266 - RNA, 32 nt, Human
agaagagacucugcugggcuuuuucaugucug

SEQ ID NO: 43267 - RNA, 32 nt, Human
agaagagacuugcagugaacuguuuuugugcc

SEQ ID NO: 43268 - RNA, 23 nt, Human
agaagagacuuuaaaauaagaga

SEQ ID NO: 43269 - RNA, 32 nt, Human
agaagagagaaaagagaugggaagacucugug

SEQ ID NO: 43270 - RNA, 32 nt, Human
agaagagaggagacaugucaggaauagauuag

SEQ ID NO: 43271 - RNA, 32 nt, Human
agaagagaggccauccucucaccagaucuaca

SEQ ID NO: 43272 - RNA, 32 nt, Human
agaagagagggucucccuggggugggguugcu

SEQ ID NO: 43273 - RNA, 32 nt, Human
agaagagagugucuccugacacugugugcaug

SEQ ID NO: 43274 - RNA, 21 nt, Human
agaagagaucaguccacccag

SEQ ID NO: 43275 - RNA, 25 nt, Human
agaagagaugagaagaggcacaaga

SEQ ID NO: 43276 - RNA, 32 nt, Human
agaagagauggaagggcauggcccugcaggcg

SEQ ID NO: 43277 - RNA, 32 nt, Human
agaagagauggucucuccccagccaugggcca

SEQ ID NO: 43278 - RNA, 32 nt, Human
agaagagaugucagcaaagcaagugaugaagc

SEQ ID NO: 43279 - RNA, 32 nt, Human
agaagagauuccagaaucaucaucugugauga

SEQ ID NO: 43280 - RNA, 21 nt, Human
agaagagauugaagacagaga

SEQ ID NO: 43281 - RNA, 32 nt, Human
agaagagcaaacugaggcuuucuuggacagca

SEQ ID NO: 43282 - RNA, 32 nt, Human
agaagagcacagagcccugaggggcugggcug

SEQ ID NO: 43283 - RNA, 32 nt, Human
agaagagcagugaccccagcagagaggggccu

SEQ ID NO: 43284 - RNA, 32 nt, Human
agaagagccaagaguccaggaggcccuggucc

SEQ ID NO: 43285 - RNA, 32 nt, Human
agaagagccacaggaacaucauuccucucccg

SEQ ID NO: 43286 - RNA, 24 nt, Human
agaagagcccuugaaaacaaggga

SEQ ID NO: 43287 - RNA, 32 nt, Human
agaagagccuccuauucuucucuguccucaua

SEQ ID NO: 43288 - RNA, 21 nt, Human
agaagagcgagcccgagugcc

SEQ ID NO: 43289 - RNA, 32 nt, Human
agaagagcggagagagaaggaagaggcgaugu

SEQ ID NO: 43290 - RNA, 32 nt, Human
agaagagcuguucacagccagacuggcacagu

SEQ ID NO: 43291 - RNA, 32 nt, Human
agaagagcuuuguggugauaauuuuguaucuu

SEQ ID NO: 43292 - RNA, 32 nt, Human
agaagaggaaaaucacuguuuuugucaaggau

SEQ ID NO: 43293 - RNA, 32 nt, Human
agaagaggaaagggaggaaaccuagcagagga

SEQ ID NO: 43294 - RNA, 32 nt, Human
agaagaggaagagaugagggaaggccuggcuc

SEQ ID NO: 43295 - RNA, 32 nt, Human
agaagaggaagaggaaagaaaaggagucaggg

SEQ ID NO: 43296 - RNA, 32 nt, Human
agaagaggaagaggaaagaaagacaagucagg

SEQ ID NO: 43297 - RNA, 32 nt, Human
agaagaggaagaggaaagcaaaggagucaggg

SEQ ID NO: 43298 - RNA, 32 nt, Human
agaagaggaagaggaagaggaagagaggaagc

SEQ ID NO: 43299 - RNA, 32 nt, Human
agaagaggaagauggagguggaguacugguuu

SEQ ID NO: 43300 - RNA, 32 nt, Human
agaagaggagaaacuucaacgccuuccagaaa

SEQ ID NO: 43301 - RNA, 22 nt, Human
agaagaggagaggacacagaga

SEQ ID NO: 43302 - RNA, 32 nt, Human
agaagaggagcaggagaaacaaaucguuaaaa

SEQ ID NO: 43303 - RNA, 32 nt, Human
agaagaggagccaaaacaucauaguugaaccg

SEQ ID NO: 43304 - RNA, 32 nt, Human
agaagaggaggaaaaugcccaucaagccacug

SEQ ID NO: 43305 - RNA, 32 nt, Human
agaagaggaggaggagaaagaagcagcaacga

SEQ ID NO: 43306 - RNA, 32 nt, Human
agaagaggaggaggaggaagaggaggaggagg

SEQ ID NO: 43307 - RNA, 32 nt, Human
agaagaggaggaggaggaggaggaagaagaaa

SEQ ID NO: 43308 - RNA, 32 nt, Human
agaagaggaggaggaggaggaggaggaggagg

SEQ ID NO: 43309 - RNA, 18 nt, Human
agaagaggaggaggcaga

SEQ ID NO: 43310 - RNA, 32 nt, Human
agaagaggaucagcagugcagccccaggaugc

SEQ ID NO: 43311 - RNA, 32 nt, Human
agaagaggcagggggcgaagugcaguggcuca

SEQ ID NO: 43312 - RNA, 32 nt, Human
agaagaggcagggucacccucucuccacguca

SEQ ID NO: 43313 - RNA, 32 nt, Human
agaagaggccauacugcuccagccggggcucc

SEQ ID NO: 43314 - RNA, 32 nt, Human
agaagaggcgggcacuggagcacuguucggac

SEQ ID NO: 43315 - RNA, 32 nt, Human
agaagaggcugcaggcaaugcagaaacggcgc

SEQ ID NO: 43316 - RNA, 32 nt, Human
agaagaggcuuccaaucaguguggaaagugac

SEQ ID NO: 43317 - RNA, 32 nt, Human
agaagagggaagaggaaggaaggugggugggg

SEQ ID NO: 43318 - RNA, 32 nt, Human
agaagagggaauaugcauugcaguucagcaaa

SEQ ID NO: 43319 - RNA, 32 nt, Human
agaagagggagaagcacgucacugugguugua

SEQ ID NO: 43320 - RNA, 32 nt, Human
agaagagggaggaggagcccaggcgucuguuu

SEQ ID NO: 43321 - RNA, 32 nt, Human
agaagagggccaccauccuccagaccccagaa

SEQ ID NO: 43322 - RNA, 32 nt, Human
agaagagggcggaggaaaagcccuagcuccug

SEQ ID NO: 43323 - RNA, 21 nt, Human
agaagaggggaaagcaagaga

SEQ ID NO: 43324 - RNA, 32 nt, Human
agaagaggguccaggcuggaaaccugaacuuu

SEQ ID NO: 43325 - RNA, 32 nt, Human
agaagaggguggagcaggaggcucucacuggu

SEQ ID NO: 43326 - RNA, 32 nt, Human
agaagagguacucggagcuggagcagcagcug

SEQ ID NO: 43327 - RNA, 32 nt, Human
agaagaggucacuagauguugcagugaaaaau

SEQ ID NO: 43328 - RNA, 32 nt, Human
agaagaguaagccgccaugugacuguuuagaa

SEQ ID NO: 43329 - RNA, 21 nt, Human
agaagaguaccuagcacaaag

SEQ ID NO: 43330 - RNA, 32 nt, Human
agaagaguaccuugaaccuauaguuuccugaa

SEQ ID NO: 43331 - RNA, 18 nt, Human
agaagaguagcccaggag

SEQ ID NO: 43332 - RNA, 32 nt, Human
agaagaguauaagugggaagucuuguuuguug

SEQ ID NO: 43333 - RNA, 32 nt, Human
agaagaguaucagaaagaguccucagccuucc

SEQ ID NO: 43334 - RNA, 32 nt, Human
agaagaguauugaaaguauuuggaggaaaaug

SEQ ID NO: 43335 - RNA, 32 nt, Human
agaagagucagugagaccagcacucucaaaca

SEQ ID NO: 43336 - RNA, 32 nt, Human
agaagaguccucuggggaggaccccaagggcc

SEQ ID NO: 43337 - RNA, 32 nt, Human
agaagagucugaggcagcuggagaugggguug

SEQ ID NO: 43338 - RNA, 32 nt, Human
agaagagucuguggucacuugaggaggcgagu

SEQ ID NO: 43339 - RNA, 32 nt, Human
agaagagugagccugcaugccaauucuaagcu

SEQ ID NO: 43340 - RNA, 32 nt, Human
agaagagugcaucuccagccuaugaaacagcu

SEQ ID NO: 43341 - RNA, 32 nt, Human
agaagagugccacauuuauuuuuauaucuaua

SEQ ID NO: 43342 - RNA, 18 nt, Human
agaagagugcgcugcagg

SEQ ID NO: 43343 - RNA, 32 nt, Human
agaagaguggcagugggcucaugcuccuggaa

SEQ ID NO: 43344 - RNA, 23 nt, Human
agaagaguuaaagcugcgcccuc

SEQ ID NO: 43345 - RNA, 32 nt, Human
agaagaguuaacauuuacacagugcuuuuuac

SEQ ID NO: 43346 - RNA, 32 nt, Human
agaagaguuacagaaaaugaaaaagaaaauga

SEQ ID NO: 43347 - RNA, 32 nt, Human
agaagaguuagaagucauugcuccagagaauu

SEQ ID NO: 43348 - RNA, 23 nt, Human
agaagaguuaggaaugccucccu

SEQ ID NO: 43349 - RNA, 24 nt, Human
agaagaguugacaacaucucacuc

SEQ ID NO: 43350 - RNA, 32 nt, Human
agaagauaccagaugccucuguccucauuuug

SEQ ID NO: 43351 - RNA, 32 nt, Human
agaagauagaauggucagaauuucgagaacug

SEQ ID NO: 43352 - RNA, 32 nt, Human
agaagauagggucaacuucuucaguugaguua

SEQ ID NO: 43353 - RNA, 21 nt, Human
agaagauagugggagggggcc

SEQ ID NO: 43354 - RNA, 32 nt, Human
agaagauaucacugcagccugcuuugugcuuu

SEQ ID NO: 43355 - RNA, 32 nt, Human
agaagaucaaaaccagccuggccaacauggug

SEQ ID NO: 43356 - RNA, 32 nt, Human
agaagaucaagaccagccugggaaauauagca

SEQ ID NO: 43357 - RNA, 32 nt, Human
agaagaucaccacugcuguuguggacccucua

SEQ ID NO: 43358 - RNA, 32 nt, Human
agaagaucacuugaggccaggaguucgagacc

SEQ ID NO: 43359 - RNA, 32 nt, Human
agaagaucauccagacuuaaauguuugggccu

SEQ ID NO: 43360 - RNA, 32 nt, Human
agaagauccaaguuuaaaauugccugcggaau

SEQ ID NO: 43361 - RNA, 32 nt, Human
agaagauccucagaccaggacaguaacugcca

SEQ ID NO: 43362 - RNA, 22 nt, Human
agaagaucuauggaaacacaga

SEQ ID NO: 43363 - RNA, 32 nt, Human
agaagaugaaagaaggaaguggcauccuuuug

SEQ ID NO: 43364 - RNA, 32 nt, Human
agaagaugaacaaaggauccggcucucaaaag

SEQ ID NO: 43365 - RNA, 32 nt, Human
agaagaugaagauaaggaaaagaaaaggccau

SEQ ID NO: 43366 - RNA, 32 nt, Human
agaagaugacaagcccugcuccagucacccgg

SEQ ID NO: 43367 - RNA, 32 nt, Human
agaagaugccagcuucucucuccagggugcuu

SEQ ID NO: 43368 - RNA, 32 nt, Human
agaagaugccauugcacuccagccugggcaac

SEQ ID NO: 43369 - RNA, 32 nt, Human
agaagaugcccagggcccagaagccaucagaa

SEQ ID NO: 43370 - RNA, 30 nt, Human
agaagaugccuggggguccaggaguccucc

SEQ ID NO: 43371 - RNA, 30 nt, Human
agaagaugcggaaggagaauggggaggcga

SEQ ID NO: 43372 - RNA, 32 nt, Human
agaagaugcuccagcaacacagccugggcccc

SEQ ID NO: 43373 - RNA, 32 nt, Human
agaagaugcugaugcugcugauccaagagcca

SEQ ID NO: 43374 - RNA, 30 nt, Human
agaagaugcugcagucccuggccggcagcu

SEQ ID NO: 43375 - RNA, 32 nt, Human
agaagauggaaauggauacaguaagaugcugc

SEQ ID NO: 43376 - RNA, 31 nt, Human
agaagauggacaagcucugcucagaacaaag

SEQ ID NO: 43377 - RNA, 32 nt, Human
agaagauggaccugaggagcugguggagaaac

SEQ ID NO: 43378 - RNA, 32 nt, Human
agaagauggcagagaagaaccgcaaggaugcc

SEQ ID NO: 43379 - RNA, 29 nt, Human
agaagauggcugcugauauauucccccgu

SEQ ID NO: 43380 - RNA, 30 nt, Human
agaagauggggaggaaaaagauucagaucc

SEQ ID NO: 43381 - RNA, 32 nt, Human
agaagaugggucugcugaucuggucauccaac

SEQ ID NO: 43382 - RNA, 30 nt, Human
agaagauggguggagaggaugaugaacuca

SEQ ID NO: 43383 - RNA, 32 nt, Human
agaagaugguuucuuuuauaauaaucuuguug

SEQ ID NO: 43384 - RNA, 32 nt, Human
agaagauguucaaaagaaaacauucacaaaau

SEQ ID NO: 43385 - RNA, 32 nt, Human
agaagauguuugacuugcucaaagucaagcag

SEQ ID NO: 43386 - RNA, 32 nt, Human
agaagauucucgccccuucccucucucccugc

SEQ ID NO: 43387 - RNA, 20 nt, Human
agaagauucuguauuaguua

SEQ ID NO: 43388 - RNA, 32 nt, Human
agaagauugaagaacagaagacuuuagacaaa

SEQ ID NO: 43389 - RNA, 23 nt, Human
agaagauugggccgccucuccuc

SEQ ID NO: 43390 - RNA, 32 nt, Human
agaagauuuacaccacuaucuccguuccaucu

SEQ ID NO: 43391 - RNA, 32 nt, Human
agaagauuuagcaccacuaucucuguuccauc

SEQ ID NO: 43392 - RNA, 32 nt, Human
agaagcaaaaggagggaguuucuggaacugca

SEQ ID NO: 43393 - RNA, 32 nt, Human
agaagcaaaugcccaagcugugcucagaacug

SEQ ID NO: 43394 - RNA, 32 nt, Human
agaagcaagaauugcuuuugaaggaaauggau

SEQ ID NO: 43395 - RNA, 32 nt, Human
agaagcaagaggaggagaaaaagaugucuuuu

SEQ ID NO: 43396 - RNA, 32 nt, Human
agaagcaagccagccaauagaauggggugauu

SEQ ID NO: 43397 - RNA, 32 nt, Human
agaagcaagcuauuggagcugaaggaaccuga

SEQ ID NO: 43398 - RNA, 32 nt, Human
agaagcaaguggcuuucaacacacaacagcag

SEQ ID NO: 43399 - RNA, 32 nt, Human
agaagcaaguuucacaguuaaacacagaaaua

SEQ ID NO: 43400 - RNA, 22 nt, Human
agaagcacaauggcccuucgcu

SEQ ID NO: 43401 - RNA, 32 nt, Human
agaagcacagaagaauugguuccuuccauuau

SEQ ID NO: 43402 - RNA, 32 nt, Human
agaagcacaucaaauaccagcaccccaccugc

SEQ ID NO: 43403 - RNA, 32 nt, Human
agaagcacaugaacuacagccuggagguggag

SEQ ID NO: 43404 - RNA, 32 nt, Human
agaagcaccagcagaccucuaagaacugcucu

SEQ ID NO: 43405 - RNA, 32 nt, Human
agaagcaccagccugcugccagcggggcagcc

SEQ ID NO: 43406 - RNA, 32 nt, Human
agaagcaccagcugaucugcagacuccaagga

SEQ ID NO: 43407 - RNA, 32 nt, Human
agaagcaccugaggccuugguucaugcagugu

SEQ ID NO: 43408 - RNA, 31 nt, Human
agaagcacucauuucugaccaccaggcuaug

SEQ ID NO: 43409 - RNA, 32 nt, Human
agaagcagaaacuggcaggccauggaccuuaa

SEQ ID NO: 43410 - RNA, 32 nt, Human
agaagcagaaaguaggagagaucacgaucuca

SEQ ID NO: 43411 - RNA, 32 nt, Human
agaagcagaaugcagaaggagaaugauccuuu

SEQ ID NO: 43412 - RNA, 32 nt, Human
agaagcagaggaaggagaggagaggggcacag

SEQ ID NO: 43413 - RNA, 32 nt, Human
agaagcagaguuucauuaccuguauuguagcc

SEQ ID NO: 43414 - RNA, 32 nt, Human
agaagcagcaacaacagcagaguuguuaagaa

SEQ ID NO: 43415 - RNA, 21 nt, Human
agaagcagcaacuugcaaggg

SEQ ID NO: 43416 - RNA, 32 nt, Human
agaagcagcaggugacaggagcagggccccug

SEQ ID NO: 43417 - RNA, 32 nt, Human
agaagcagccaagagcuggagccagaccagga

SEQ ID NO: 43418 - RNA, 32 nt, Human
agaagcagccaagauuccgggaagcgcgucuu

SEQ ID NO: 43419 - RNA, 32 nt, Human
agaagcagccuggguguguaaagagauaguca

SEQ ID NO: 43420 - RNA, 32 nt, Human
agaagcagcuccaggaguuagcugagacaccc

SEQ ID NO: 43421 - RNA, 17 nt, Human
agaagcagcucccagag

SEQ ID NO: 43422 - RNA, 32 nt, Human
agaagcagcuccucuuuaaacuccucaucucu

SEQ ID NO: 43423 - RNA, 32 nt, Human
agaagcagcucucugaggguucugaaaucaau

SEQ ID NO: 43424 - RNA, 32 nt, Human
agaagcagcugacaguggucguggaaguugga

SEQ ID NO: 43425 - RNA, 32 nt, Human
agaagcagcuuugaauaccuucauuuuaugua

SEQ ID NO: 43426 - RNA, 32 nt, Human
agaagcaggaagcagacaguaagugacagccg

SEQ ID NO: 43427 - RNA, 32 nt, Human
agaagcaggagaaggcaacugagauccuucag

SEQ ID NO: 43428 - RNA, 32 nt, Human
agaagcaggaggaucauuugagcccagaaguu

SEQ ID NO: 43429 - RNA, 32 nt, Human
agaagcaggagggagaguggcgcugcuguugu

SEQ ID NO: 43430 - RNA, 32 nt, Human
agaagcaggagguggagaagacccagugaagu

SEQ ID NO: 43431 - RNA, 32 nt, Human
agaagcagucaagcccaugaacuacaaccccg

SEQ ID NO: 43432 - RNA, 32 nt, Human
agaagcagugccugggucccucacggaggaaa

SEQ ID NO: 43433 - RNA, 32 nt, Human
agaagcaguggccaagacuaccuuggugcugg

SEQ ID NO: 43434 - RNA, 32 nt, Human
agaagcaguggccaccaccauggauacaggcc

SEQ ID NO: 43435 - RNA, 32 nt, Human
agaagcaguguuuucugccaaguagcggacgc

SEQ ID NO: 43436 - RNA, 32 nt, Human
agaagcaguuccagucagccccugccacugug

SEQ ID NO: 43437 - RNA, 32 nt, Human
agaagcauacaacaugagcaaagcuuuuucuc

SEQ ID NO: 43438 - RNA, 32 nt, Human
agaagcaucaggagcccagcugucugcagugg

SEQ ID NO: 43439 - RNA, 22 nt, Human
agaagcaucccaacucuucucu

SEQ ID NO: 43440 - RNA, 32 nt, Human
agaagcauccucugccaagaccaaaaggaaag

SEQ ID NO: 43441 - RNA, 32 nt, Human
agaagcaugcagcaccuccugcuucacucucu

SEQ ID NO: 43442 - RNA, 32 nt, Human
agaagcauggcaacaguacaauauugccgaug

SEQ ID NO: 43443 - RNA, 19 nt, Human
agaagcaugggauccagga

SEQ ID NO: 43444 - RNA, 32 nt, Human
agaagccaaagaggaggaggcaggagaagcag

SEQ ID NO: 43445 - RNA, 32 nt, Human
agaagccaaucagcaugcacucccccauucug

SEQ ID NO: 43446 - RNA, 32 nt, Human
agaagccacaggggcagggggagcagccgagc

SEQ ID NO: 43447 - RNA, 32 nt, Human
agaagccacaguccuucagccuccaauuggug

SEQ ID NO: 43448 - RNA, 32 nt, Human
agaagccaccacuggcuuucaggcuugggggu

SEQ ID NO: 43449 - RNA, 32 nt, Human
agaagccacugaggaacggccuggugaaggac

SEQ ID NO: 43450 - RNA, 32 nt, Human
agaagccagaggauucccgaguguggcugucu

SEQ ID NO: 43451 - RNA, 32 nt, Human
agaagccagcaagcagcagggaagggaggcga

SEQ ID NO: 43452 - RNA, 32 nt, Human
agaagccagcacuguggcagggugcuggggag

SEQ ID NO: 43453 - RNA, 32 nt, Human
agaagccagcagagaggcaugggacagguucc

SEQ ID NO: 43454 - RNA, 22 nt, Human
agaagccagcagggggcagcgu

SEQ ID NO: 43455 - RNA, 32 nt, Human
agaagccagcccccaaccccagcccuuccgua

SEQ ID NO: 43456 - RNA, 21 nt, Human
agaagccagccggcuggcagc

SEQ ID NO: 43457 - RNA, 32 nt, Human
agaagccaggaggcagagguugcagugagcca

SEQ ID NO: 43458 - RNA, 32 nt, Human
agaagccaggcacaaaaggccacauaguauau

SEQ ID NO: 43459 - RNA, 32 nt, Human
agaagccaggcugcguguguaaguggcaggga

SEQ ID NO: 43460 - RNA, 32 nt, Human
agaagccaggguguuucuccccucuauucuuu

SEQ ID NO: 43461 - RNA, 32 nt, Human
agaagccauaguccuucagccuccaauugaua

SEQ ID NO: 43462 - RNA, 32 nt, Human
agaagccaucaucuagaaacaauguugauaac

SEQ ID NO: 43463 - RNA, 32 nt, Human
agaagccauccuaaggugcuuaccucacacgc

SEQ ID NO: 43464 - RNA, 32 nt, Human
agaagccauccugaaaugaaacuagucuaaaa

SEQ ID NO: 43465 - RNA, 32 nt, Human
agaagcccaaacuuuauuuuuauaaagggaga

SEQ ID NO: 43466 - RNA, 32 nt, Human
agaagcccaccaugcagagcugugaucuagag

SEQ ID NO: 43467 - RNA, 20 nt, Human
agaagcccagagggggccug

SEQ ID NO: 43468 - RNA, 32 nt, Human
agaagcccaggccggccggaagaggagccgag

SEQ ID NO: 43469 - RNA, 32 nt, Human
agaagcccaggggagaaacaaagggaaugauc

SEQ ID NO: 43470 - RNA, 31 nt, Human
agaagcccaguacuggagcuaauguuugugu

SEQ ID NO: 43471 - RNA, 32 nt, Human
agaagcccaguucucaggagaugaggcuacca

SEQ ID NO: 43472 - RNA, 32 nt, Human
agaagccccaagaaggagguuggggccagcuc

SEQ ID NO: 43473 - RNA, 19 nt, Human
agaagccccacaucuuccu

SEQ ID NO: 43474 - RNA, 32 nt, Human
agaagcccccuucacgauccacccuuucaggc

SEQ ID NO: 43475 - RNA, 32 nt, Human
agaagccccucaggaagagaaucgaggccaag

SEQ ID NO: 43476 - RNA, 32 nt, Human
agaagccccuuuccccuuuguuuuccuuccuu

SEQ ID NO: 43477 - RNA, 32 nt, Human
agaagcccugcaggcugggugggcaggacacg

SEQ ID NO: 43478 - RNA, 32 nt, Human
agaagcccugccagcagagcaggcuggcguuu

SEQ ID NO: 43479 - RNA, 32 nt, Human
agaagcccugcuccucuucuccccaccaaggc

SEQ ID NO: 43480 - RNA, 26 nt, Human
agaagccgcagcgccgccucuucucu

SEQ ID NO: 43481 - RNA, 32 nt, Human
agaagccgccagccccuuucucccucugccug

SEQ ID NO: 43482 - RNA, 32 nt, Human
agaagccgccucuggacuaucuccccagacca

SEQ ID NO: 43483 - RNA, 19 nt, Human
agaagccggagcuggcagc

SEQ ID NO: 43484 - RNA, 32 nt, Human
agaagccggcucugagccacgcccuuucaccc

SEQ ID NO: 43485 - RNA, 32 nt, Human
agaagccgggcgaaguggcccaugccuguaau

SEQ ID NO: 43486 - RNA, 32 nt, Human
agaagccggugggcaaugagaucaugucugcu

SEQ ID NO: 43487 - RNA, 32 nt, Human
agaagccuacaucuucuuauucuauuuaggaa

SEQ ID NO: 43488 - RNA, 32 nt, Human
agaagccuccacugccauggagacugccuggc

SEQ ID NO: 43489 - RNA, 32 nt, Human
agaagccuccuugaaccagucugcaacccugc

SEQ ID NO: 43490 - RNA, 32 nt, Human
agaagccucugccucccuagcuuuucugcuau

SEQ ID NO: 43491 - RNA, 32 nt, Human
agaagccugccuggugcccacagccgucuggc

SEQ ID NO: 43492 - RNA, 32 nt, Human
agaagccugcgaggaagccuauggaauaguuu

SEQ ID NO: 43493 - RNA, 32 nt, Human
agaagccuggagaagagagaacuauuuaaaag

SEQ ID NO: 43494 - RNA, 32 nt, Human
agaagccuggcuuauuucaggcugacagcugg

SEQ ID NO: 43495 - RNA, 32 nt, Human
agaagccuggggagucggggagguagggagag

SEQ ID NO: 43496 - RNA, 32 nt, Human
agaagccuguaucuuuuuccucuucaguagau

SEQ ID NO: 43497 - RNA, 32 nt, Human
agaagccuguguggucugggccagucucugcc

SEQ ID NO: 43498 - RNA, 32 nt, Human
agaagccuguuccagccgcagccgcugcagcc

SEQ ID NO: 43499 - RNA, 32 nt, Human
agaagccuuagcaacacugcucaccacaguau

SEQ ID NO: 43500 - RNA, 32 nt, Human
agaagccuuccagccugcggugcugucugcug

SEQ ID NO: 43501 - RNA, 22 nt, Human
agaagcgaccgcagcgggagcc

SEQ ID NO: 43502 - RNA, 32 nt, Human
agaagcgagccacacccccaucgcaugcccua

SEQ ID NO: 43503 - RNA, 32 nt, Human
agaagcgauggaaacuuauuucuaugggacag

SEQ ID NO: 43504 - RNA, 32 nt, Human
agaagcgcagaggcugagcccgcccccgcccc

SEQ ID NO: 43505 - RNA, 32 nt, Human
agaagcgccagccugccuggcugucuuccacc

SEQ ID NO: 43506 - RNA, 19 nt, Human
agaagcggaacccagagcu

SEQ ID NO: 43507 - RNA, 19 nt, Human
agaagcggaggcccaggag

SEQ ID NO: 43508 - RNA, 32 nt, Human
agaagcggcaggcggaggcgcgguccgggcgc

SEQ ID NO: 43509 - RNA, 20 nt, Human
agaagcggccggagcccgcc

SEQ ID NO: 43510 - RNA, 32 nt, Human
agaagcggcgggccaccaggcugcagucuccc

SEQ ID NO: 43511 - RNA, 32 nt, Human
agaagcggcuaguggcggcugccugcgucccc

SEQ ID NO: 43512 - RNA, 32 nt, Human
agaagcgggaguggcugauggaagcaccuaaa

SEQ ID NO: 43513 - RNA, 32 nt, Human
agaagcgggcucugagccacgcccuuucaccc

SEQ ID NO: 43514 - RNA, 32 nt, Human
agaagcggggagaagagcgagacagagaugcu

SEQ ID NO: 43515 - RNA, 32 nt, Human
agaagcgugcgugcguuugcaaguaagagaac

SEQ ID NO: 43516 - RNA, 32 nt, Human
agaagcguuugucagcccuggagcccagagcg

SEQ ID NO: 43517 - RNA, 32 nt, Human
agaagcuaaggcagguggaucacuugaggcca

SEQ ID NO: 43518 - RNA, 32 nt, Human
agaagcuacgaaaaagggagcuguuuaaauuu

SEQ ID NO: 43519 - RNA, 32 nt, Human
agaagcuacugcuaucugcugcucugggaaau

SEQ ID NO: 43520 - RNA, 32 nt, Human
agaagcuacugguuuauucccaauuguugaug

SEQ ID NO: 43521 - RNA, 32 nt, Human
agaagcuagugagcaugugagcaagcggugug

SEQ ID NO: 43522 - RNA, 32 nt, Human
agaagcuauauagagaaaaggaaaccacugaa

SEQ ID NO: 43523 - RNA, 32 nt, Human
agaagcucaaagccaaaaucaggcaacugacg

SEQ ID NO: 43524 - RNA, 32 nt, Human
agaagcucagauguuccucagagcuacgauau

SEQ ID NO: 43525 - RNA, 32 nt, Human
agaagcucagccgccuuugaugaccuagaagc

SEQ ID NO: 43526 - RNA, 32 nt, Human
agaagcucaguagccuuuggggacggccacuc

SEQ ID NO: 43527 - RNA, 32 nt, Human
agaagcucaucugaccuccugacucucagccc

SEQ ID NO: 43528 - RNA, 18 nt, Human
agaagcucauuccaggaa

SEQ ID NO: 43529 - RNA, 32 nt, Human
agaagcucccagaacacucaggaaacuucucc

SEQ ID NO: 43530 - RNA, 32 nt, Human
agaagcuccgugagccucagccaccccucaga

SEQ ID NO: 43531 - RNA, 17 nt, Human
agaagcuccuucaggaa

SEQ ID NO: 43532 - RNA, 32 nt, Human
agaagcucuagcgucagguaacaaauagacag

SEQ ID NO: 43533 - RNA, 22 nt, Human
agaagcucugccucucuucucu

SEQ ID NO: 43534 - RNA, 32 nt, Human
agaagcucuggccccaggcuugucacuagcag

SEQ ID NO: 43535 - RNA, 32 nt, Human
agaagcugaaaaagcuggagugcaauggcacc

SEQ ID NO: 43536 - RNA, 32 nt, Human
agaagcugaacaggagaaagacaaacagaaag

SEQ ID NO: 43537 - RNA, 32 nt, Human
agaagcugaagaggauaagagcaaggaaacaa

SEQ ID NO: 43538 - RNA, 32 nt, Human
agaagcugaagcacaagaauugcuugaacccu

SEQ ID NO: 43539 - RNA, 32 nt, Human
agaagcugaagcccagaguggggaaggggagu

SEQ ID NO: 43540 - RNA, 32 nt, Human
agaagcugagacccuuccccagugucugaggc

SEQ ID NO: 43541 - RNA, 32 nt, Human
agaagcugagauuacaggcaugugccaccaca

SEQ ID NO: 43542 - RNA, 32 nt, Human
agaagcugagauuacggaugaccaccaccacu

SEQ ID NO: 43543 - RNA, 32 nt, Human
agaagcugaggcaccuccuacucccaucugaa

SEQ ID NO: 43544 - RNA, 32 nt, Human
agaagcugauucuaucacauuguaagaugccu

SEQ ID NO: 43545 - RNA, 32 nt, Human
agaagcugccauuuaccagcccucugugauuu

SEQ ID NO: 43546 - RNA, 19 nt, Human
agaagcugcuacaagauga

SEQ ID NO: 43547 - RNA, 32 nt, Human
agaagcugcuauuccuacuggcuaucuaagaa

SEQ ID NO: 43548 - RNA, 32 nt, Human
agaagcuggaggaggagggggaagaggagugg

SEQ ID NO: 43549 - RNA, 32 nt, Human
agaagcuggcaaagaacauggaagagauguuu

SEQ ID NO: 43550 - RNA, 18 nt, Human
agaagcuggcaggacugg

SEQ ID NO: 43551 - RNA, 17 nt, Human
agaagcuggccuggggu

SEQ ID NO: 43552 - RNA, 32 nt, Human
agaagcuggcuaaccuccacuuccacauucca

SEQ ID NO: 43553 - RNA, 29 nt, Human
agaagcuggcugcuaagaugucacugggg

SEQ ID NO: 43554 - RNA, 32 nt, Human
agaagcugggagggagggggaggugaaaaggg

SEQ ID NO: 43555 - RNA, 32 nt, Human
agaagcugggauuacaggcaugcgccaccacg

SEQ ID NO: 43556 - RNA, 32 nt, Human
agaagcugggcagaagcaggaggaucauuuga

SEQ ID NO: 43557 - RNA, 32 nt, Human
agaagcugggcccagccgcggugccugcuggc

SEQ ID NO: 43558 - RNA, 32 nt, Human
agaagcugggcugcaccugcgggggugggcau

SEQ ID NO: 43559 - RNA, 25 nt, Human
agaagcuggugcagccacacaggga

SEQ ID NO: 43560 - RNA, 32 nt, Human
agaagcugguuugugaagcaccugccaugaaa

SEQ ID NO: 43561 - RNA, 32 nt, Human
agaagcugucuaaaccuccuacuccucaacuc

SEQ ID NO: 43562 - RNA, 32 nt, Human
agaagcuguggggucggagaggcguuuggaga

SEQ ID NO: 43563 - RNA, 32 nt, Human
agaagcuguucauuccauucacguaugguaau

SEQ ID NO: 43564 - RNA, 32 nt, Human
agaagcuuacuuccugcugcaugcuuugccga

SEQ ID NO: 43565 - RNA, 32 nt, Human
agaagcuucagaggagggaagggggugggaag

SEQ ID NO: 43566 - RNA, 32 nt, Human
agaagcuuccagcacugguucaucagaucagg

SEQ ID NO: 43567 - RNA, 32 nt, Human
agaagcuucuguggcggcuggaaguggacgga

SEQ ID NO: 43568 - RNA, 30 nt, Human
agaagcuugcaaauuacagaaagaauaaaa

SEQ ID NO: 43569 - RNA, 32 nt, Human
agaagcuuggccugagucucccagcagagaaa

SEQ ID NO: 43570 - RNA, 32 nt, Human
agaagcuugugcaaagcagccaccuuggacca

SEQ ID NO: 43571 - RNA, 32 nt, Human
agaagcuuuagagguaugaggcugcagaaccg

SEQ ID NO: 43572 - RNA, 32 nt, Human
agaagcuuuccucugcuauucccauucucuuu

SEQ ID NO: 43573 - RNA, 32 nt, Human
agaagcuuuccugcccccucuuccucuaguag

SEQ ID NO: 43574 - RNA, 32 nt, Human
agaagcuuucuuccaaacuccugggccuccga

SEQ ID NO: 43575 - RNA, 32 nt, Human
agaagcuuuguaggugcaacuuccccuuggag

SEQ ID NO: 43576 - RNA, 19 nt, Human
agaaggaaagaagggggcc

SEQ ID NO: 43577 - RNA, 32 nt, Human
agaaggaaagaggguacucucuggcugggcug

SEQ ID NO: 43578 - RNA, 18 nt, Human
agaaggaaauccaagcca

SEQ ID NO: 43579 - RNA, 32 nt, Human
agaaggaaauugucccgaaucccugcagucuu

SEQ ID NO: 43580 - RNA, 32 nt, Human
agaaggaaauugucccgaaucccugcaguggg

SEQ ID NO: 43581 - RNA, 32 nt, Human
agaaggaacccucacacaccacugauaggaau

SEQ ID NO: 43582 - RNA, 21 nt, Human
agaaggaacgccuuccaggaa

SEQ ID NO: 43583 - RNA, 32 nt, Human
agaaggaagaagcacccucuccccggccuccu

SEQ ID NO: 43584 - RNA, 32 nt, Human
agaaggaagaggaggaagaacuaaagaaggag

SEQ ID NO: 43585 - RNA, 32 nt, Human
agaaggaagaggaggaagcugagaagcuggaa

SEQ ID NO: 43586 - RNA, 32 nt, Human
agaaggaagaggaggaagcugagggcccgcug

SEQ ID NO: 43587 - RNA, 32 nt, Human
agaaggaagaggagguggaggcuugaugagga

SEQ ID NO: 43588 - RNA, 32 nt, Human
agaaggaagaggauuccaggcugagagcacug

SEQ ID NO: 43589 - RNA, 32 nt, Human
agaaggaagccaccauggaugcagugaugaca

SEQ ID NO: 43590 - RNA, 32 nt, Human
agaaggaaggaaggagaaagagaaggaaagaa

SEQ ID NO: 43591 - RNA, 32 nt, Human
agaaggaaggcagcuuguuccagaccuuggug

SEQ ID NO: 43592 - RNA, 32 nt, Human
agaaggaaggcugagccucuccccagccuuca

SEQ ID NO: 43593 - RNA, 32 nt, Human
agaaggaagggccuugcagccacagagacacu

SEQ ID NO: 43594 - RNA, 32 nt, Human
agaaggaaggggauaggcagcuuugacaggug

SEQ ID NO: 43595 - RNA, 32 nt, Human
agaaggaagguauguaccuuccuuccaccagg

SEQ ID NO: 43596 - RNA, 32 nt, Human
agaaggaagguggcgaaggcagugagugcucu

SEQ ID NO: 43597 - RNA, 32 nt, Human
agaaggaauggcugguccagaggcuuuugucc

SEQ ID NO: 43598 - RNA, 32 nt, Human
agaaggaaugugccaguauggcucccugggug

SEQ ID NO: 43599 - RNA, 32 nt, Human
agaaggaauuggcaacacugaaaccuccagaa

SEQ ID NO: 43600 - RNA, 32 nt, Human
agaaggacaacaaaggccaauuugccaucacc

SEQ ID NO: 43601 - RNA, 32 nt, Human
agaaggacaagcuguuauuuuccuuuuuauua

SEQ ID NO: 43602 - RNA, 32 nt, Human
agaaggacagucagaggaguggccaccuguuu

SEQ ID NO: 43603 - RNA, 32 nt, Human
agaaggacauuuuacugcagugagaaugaggg

SEQ ID NO: 43604 - RNA, 20 nt, Human
agaaggaccccacacuuggu

SEQ ID NO: 43605 - RNA, 32 nt, Human
agaaggaccccagcucuugaagggcugagugg

SEQ ID NO: 43606 - RNA, 21 nt, Human
agaaggacccggaggggccug

SEQ ID NO: 43607 - RNA, 32 nt, Human
agaaggacccuccccaacccuggagacacccu

SEQ ID NO: 43608 - RNA, 32 nt, Human
agaaggaccucccagcccccaaaggaucuccc

SEQ ID NO: 43609 - RNA, 32 nt, Human
agaaggagacaccuccuggaggccccaguccc

SEQ ID NO: 43610 - RNA, 32 nt, Human
agaaggagagagaagaagaugaaguuugccag

SEQ ID NO: 43611 - RNA, 32 nt, Human
agaaggagagagacccgagggagccaccugcc

SEQ ID NO: 43612 - RNA, 21 nt, Human
agaaggagaggaaugggggag

SEQ ID NO: 43613 - RNA, 32 nt, Human
agaaggagaggagaaaaugaagaggcaugaag

SEQ ID NO: 43614 - RNA, 20 nt, Human
agaaggagagugauggggag

SEQ ID NO: 43615 - RNA, 32 nt, Human
agaaggagcaagaagcaacugggauggcucag

SEQ ID NO: 43616 - RNA, 32 nt, Human
agaaggagcacccaccucccucccucugugac

SEQ ID NO: 43617 - RNA, 18 nt, Human
agaaggagcagcugggga

SEQ ID NO: 43618 - RNA, 32 nt, Human
agaaggagccacggaagaggcggaagguggac

SEQ ID NO: 43619 - RNA, 32 nt, Human
agaaggagccaucuccaucuugaaggaacuca

SEQ ID NO: 43620 - RNA, 18 nt, Human
agaaggagcccaggcaca

SEQ ID NO: 43621 - RNA, 32 nt, Human
agaaggagccucugcugccucccaggcugcug

SEQ ID NO: 43622 - RNA, 32 nt, Human
agaaggagccuggagcccaugaggcagccagc

SEQ ID NO: 43623 - RNA, 32 nt, Human
agaaggaggaaaugcauucucagagaagccaa

SEQ ID NO: 43624 - RNA, 32 nt, Human
agaaggaggaaccuuuuccuucugcagccccu

SEQ ID NO: 43625 - RNA, 32 nt, Human
agaaggaggaggaggaagagagugugaaacag

SEQ ID NO: 43626 - RNA, 32 nt, Human
agaaggaggaggaggaagaggaggagcgcagu

SEQ ID NO: 43627 - RNA, 32 nt, Human
agaaggaggaggaggagagaaaggcggcucuu

SEQ ID NO: 43628 - RNA, 32 nt, Human
agaaggaggaggaggagagaggaaagagcgga

SEQ ID NO: 43629 - RNA, 32 nt, Human
agaaggaggaggaggaggaggaggaggagggg

SEQ ID NO: 43630 - RNA, 32 nt, Human
agaaggaggaggaggaggucggaaagugggaa

SEQ ID NO: 43631 - RNA, 32 nt, Human
agaaggaggaggaggagguuuaggucaagaag

SEQ ID NO: 43632 - RNA, 19 nt, Human
agaaggaggaggcagaaug

SEQ ID NO: 43633 - RNA, 18 nt, Human
agaaggaggcagcaggga

SEQ ID NO: 43634 - RNA, 20 nt, Human
agaaggaggcaggaagggag

SEQ ID NO: 43635 - RNA, 32 nt, Human
agaaggaggcggaagagagccaccggccagac

SEQ ID NO: 43636 - RNA, 19 nt, Human
agaaggaggucagccugga

SEQ ID NO: 43637 - RNA, 19 nt, Human
agaaggaggugagggggcc

SEQ ID NO: 43638 - RNA, 32 nt, Human
agaaggagguggcgcaagagccuggacgcacg

SEQ ID NO: 43639 - RNA, 32 nt, Human
agaaggagguguuggggugagguggugguguu

SEQ ID NO: 43640 - RNA, 32 nt, Human
agaaggagucccccaugcccugccugaaauga

SEQ ID NO: 43641 - RNA, 32 nt, Human
agaaggagugaaacaugugaacuuucuggcga

SEQ ID NO: 43642 - RNA, 32 nt, Human
agaaggagugcucuucaucaacuaauagagca

SEQ ID NO: 43643 - RNA, 32 nt, Human
agaaggauagaaccuggaagaucaauaucucc

SEQ ID NO: 43644 - RNA, 32 nt, Human
agaaggaucaccugaguccaggaauuugagac

SEQ ID NO: 43645 - RNA, 32 nt, Human
agaaggaucaccuugaggccaggaguuuaagg

SEQ ID NO: 43646 - RNA, 32 nt, Human
agaaggaucuagucugcccacuacauucucaa

SEQ ID NO: 43647 - RNA, 32 nt, Human
agaaggaugccaugaaggaaaugacugcuuug

SEQ ID NO: 43648 - RNA, 32 nt, Human
agaaggaugggaagagaaaaggagcaguuuua

SEQ ID NO: 43649 - RNA, 22 nt, Human
agaaggaugggggccaucuauc

SEQ ID NO: 43650 - RNA, 22 nt, Human
agaaggauuguuaaauguggga

SEQ ID NO: 43651 - RNA, 32 nt, Human
agaaggcaaacacacccaccuucauccugagc

SEQ ID NO: 43652 - RNA, 25 nt, Human
agaaggcaacacaaauugcaaggga

SEQ ID NO: 43653 - RNA, 32 nt, Human
agaaggcaaguuggcaggaguggagaccacag

SEQ ID NO: 43654 - RNA, 32 nt, Human
agaaggcacaauaugggcacuuuaaaugaagc

SEQ ID NO: 43655 - RNA, 32 nt, Human
agaaggcacacagagauucuggaucuccugcu

SEQ ID NO: 43656 - RNA, 32 nt, Human
agaaggcacuagcuuccugggccccucacccc

SEQ ID NO: 43657 - RNA, 32 nt, Human
agaaggcagaagggagagaugaagcccaagaa

SEQ ID NO: 43658 - RNA, 20 nt, Human
agaaggcagagaaaggagga

SEQ ID NO: 43659 - RNA, 32 nt, Human
agaaggcagagcagugucugugcugccagguc

SEQ ID NO: 43660 - RNA, 32 nt, Human
agaaggcagaggaggagggagggagggaagga

SEQ ID NO: 43661 - RNA, 22 nt, Human
agaaggcagagggagagggaga

SEQ ID NO: 43662 - RNA, 32 nt, Human
agaaggcagaucugggagacugcugcaguguc

SEQ ID NO: 43663 - RNA, 32 nt, Human
agaaggcagcugagacugggcccagugagggc

SEQ ID NO: 43664 - RNA, 31 nt, Human
agaaggcaggagagagacacaagcuggcaaa

SEQ ID NO: 43665 - RNA, 32 nt, Human
agaaggcaggagagagacacaagcuggcaaag

SEQ ID NO: 43666 - RNA, 27 nt, Human
agaaggcaggagggcaaaaggggccug

SEQ ID NO: 43667 - RNA, 32 nt, Human
agaaggcaggcaggaagagacagagauggaug

SEQ ID NO: 43668 - RNA, 32 nt, Human
agaaggcaggcagggcccagugagaggggagc

SEQ ID NO: 43669 - RNA, 32 nt, Human
agaaggcagggugagggaucugggagagcagg

SEQ ID NO: 43670 - RNA, 32 nt, Human
agaaggcagguuuugugaaggccaggcagggu

SEQ ID NO: 43671 - RNA, 22 nt, Human
agaaggcaguagaaaggaggaa

SEQ ID NO: 43672 - RNA, 32 nt, Human
agaaggcaguuccaguuuuagcacagauuugu

SEQ ID NO: 43673 - RNA, 31 nt, Human
agaaggcaguuuccucuacuugcccaagagc

SEQ ID NO: 43674 - RNA, 32 nt, Human
agaaggcauccagcaagaacugcacaagaaac

SEQ ID NO: 43675 - RNA, 32 nt, Human
agaaggcaugaaauugucuagcagagcagggg

SEQ ID NO: 43676 - RNA, 32 nt, Human
agaaggcauggcuggggaagccucaggaaaug

SEQ ID NO: 43677 - RNA, 32 nt, Human
agaaggcauuguucuccagacacaucuaugga

SEQ ID NO: 43678 - RNA, 32 nt, Human
agaaggccaagaaggaggaugaagcccagccu

SEQ ID NO: 43679 - RNA, 32 nt, Human
agaaggccaccccgccuggaggcacaggccau

SEQ ID NO: 43680 - RNA, 25 nt, Human
agaaggccaccucuaauggggccug

SEQ ID NO: 43681 - RNA, 32 nt, Human
agaaggccacuggugugcaggugugggcuccu

SEQ ID NO: 43682 - RNA, 32 nt, Human
agaaggccagagcagagaggggcacacagaga

SEQ ID NO: 43683 - RNA, 32 nt, Human
agaaggccagcccacugggcccuggggcugcc

SEQ ID NO: 43684 - RNA, 32 nt, Human
agaaggccagccccagcggcuuccccagccuc

SEQ ID NO: 43685 - RNA, 23 nt, Human
agaaggccagggccaggagccug

SEQ ID NO: 43686 - RNA, 32 nt, Human
agaaggccagugcccaggcauaggguuagcuc

SEQ ID NO: 43687 - RNA, 32 nt, Human
agaaggcccacuguggagccagccucccuaug

SEQ ID NO: 43688 - RNA, 32 nt, Human
agaaggcccagccugggacccucugggcugcu

SEQ ID NO: 43689 - RNA, 32 nt, Human
agaaggcccaggaagugacggccgccucccgg

SEQ ID NO: 43690 - RNA, 23 nt, Human
agaaggccccuccagggggacug

SEQ ID NO: 43691 - RNA, 24 nt, Human
agaaggcccggaagaggggaccug

SEQ ID NO: 43692 - RNA, 32 nt, Human
agaaggcccucaauaaaggcuuccugaggaac

SEQ ID NO: 43693 - RNA, 20 nt, Human
agaaggccgagggcggggcu

SEQ ID NO: 43694 - RNA, 32 nt, Human
agaaggccgggggcucaagaccuaccuguuga

SEQ ID NO: 43695 - RNA, 32 nt, Human
agaaggccguggggagugggggccagugccug

SEQ ID NO: 43696 - RNA, 32 nt, Human
agaaggccuccugucccugccugcucugggug

SEQ ID NO: 43697 - RNA, 32 nt, Human
agaaggccucucucuucuguggcccccaccug

SEQ ID NO: 43698 - RNA, 32 nt, Human
agaaggccugggaggggaauggggcuggagac

SEQ ID NO: 43699 - RNA, 32 nt, Human
agaaggccugggggaaggaugggaggaugcuu

SEQ ID NO: 43700 - RNA, 28 nt, Human
agaaggccuggugcugcccuggcaucag

SEQ ID NO: 43701 - RNA, 32 nt, Human
agaaggccuguaugcugggccaguggagcagu

SEQ ID NO: 43702 - RNA, 32 nt, Human
agaaggccuuggugggggugggggaggagguu

SEQ ID NO: 43703 - RNA, 32 nt, Human
agaaggccuuucuccccauggucagccacacg

SEQ ID NO: 43704 - RNA, 32 nt, Human
agaaggccuuugugcccccaaaaagaggcgaa

SEQ ID NO: 43705 - RNA, 20 nt, Human
agaaggcggcugcugggcag

SEQ ID NO: 43706 - RNA, 24 nt, Human
agaaggcggggcuggcagccucca

SEQ ID NO: 43707 - RNA, 32 nt, Human
agaaggcucuuaucaauguuauuuauuugauu

SEQ ID NO: 43708 - RNA, 32 nt, Human
agaaggcugaggcagcuggagcuacuucuggg

SEQ ID NO: 43709 - RNA, 32 nt, Human
agaaggcugcagcccagcccgccugagacacg

SEQ ID NO: 43710 - RNA, 32 nt, Human
agaaggcugcccgcgcggccagccugcaggag

SEQ ID NO: 43711 - RNA, 22 nt, Human
agaaggcugccuccugcugcug

SEQ ID NO: 43712 - RNA, 32 nt, Human
agaaggcugcuacgaggaguacagaggccgcu

SEQ ID NO: 43713 - RNA, 32 nt, Human
agaaggcuggacugcauaagcauggcaguuuu

SEQ ID NO: 43714 - RNA, 22 nt, Human
agaaggcuggggcuauuuacca

SEQ ID NO: 43715 - RNA, 22 nt, Human
agaaggcugguggaaaaaggcc

SEQ ID NO: 43716 - RNA, 20 nt, Human
agaaggcuguucacuuacua

SEQ ID NO: 43717 - RNA, 32 nt, Human
agaaggcuugcagcccagaaggagccagaaga

SEQ ID NO: 43718 - RNA, 19 nt, Human
agaagggaaaagacuggaa

SEQ ID NO: 43719 - RNA, 32 nt, Human
agaagggaaaagguauuuuuguuuuuguuguu

SEQ ID NO: 43720 - RNA, 32 nt, Human
agaagggaaacugaggagagacccgcaacuca

SEQ ID NO: 43721 - RNA, 32 nt, Human
agaagggaaaggcagagggugugauuauggug

SEQ ID NO: 43722 - RNA, 32 nt, Human
agaagggaaauaccaucaaaagacugaacauc

SEQ ID NO: 43723 - RNA, 32 nt, Human
agaagggaaggaaggaaagaagagaggaaaga

SEQ ID NO: 43724 - RNA, 32 nt, Human
agaagggaaggcggagggcggcggggacaaga

SEQ ID NO: 43725 - RNA, 32 nt, Human
agaagggaaggugggugggcaccugagagauu

SEQ ID NO: 43726 - RNA, 31 nt, Human
agaagggaagugucccacaccaggacagaac

SEQ ID NO: 43727 - RNA, 32 nt, Human
agaagggaauacuguauuuuuccacuagaaac

SEQ ID NO: 43728 - RNA, 32 nt, Human
agaagggacagacagagguucucagugaugag

SEQ ID NO: 43729 - RNA, 32 nt, Human
agaagggacccgaggaggaggcuuccaucacg

SEQ ID NO: 43730 - RNA, 18 nt, Human
agaagggagagccgggga

SEQ ID NO: 43731 - RNA, 32 nt, Human
agaagggagagggaggaggccggggcgggagu

SEQ ID NO: 43732 - RNA, 32 nt, Human
agaagggagagggcccgucggacagccacagc

SEQ ID NO: 43733 - RNA, 32 nt, Human
agaagggagauugaagaaggugggcccagggg

SEQ ID NO: 43734 - RNA, 32 nt, Human
agaagggagcucuggagcaggaccagcugggg

SEQ ID NO: 43735 - RNA, 16 nt, Human
agaagggagcugggga

SEQ ID NO: 43736 - RNA, 32 nt, Human
agaagggagcuuccaaccuuuuaacuugagga

SEQ ID NO: 43737 - RNA, 22 nt, Human
agaagggaggcauggcaaggga

SEQ ID NO: 43738 - RNA, 32 nt, Human
agaagggaggggcuggggguucccaggagcca

SEQ ID NO: 43739 - RNA, 32 nt, Human
agaagggauaccgucuccuugaagaggaaacu

SEQ ID NO: 43740 - RNA, 32 nt, Human
agaagggauccggaugggggagcucuguacag

SEQ ID NO: 43741 - RNA, 18 nt, Human
agaagggaucuaagcaca

SEQ ID NO: 43742 - RNA, 32 nt, Human
agaagggauggagagaaagaaugaaguagaug

SEQ ID NO: 43743 - RNA, 21 nt, Human
agaagggauuucaccauguug

SEQ ID NO: 43744 - RNA, 32 nt, Human
agaagggcagcaccucuguguuuaauggaaau

SEQ ID NO: 43745 - RNA, 32 nt, Human
agaagggcagggaggagguuguccuggagagg

SEQ ID NO: 43746 - RNA, 32 nt, Human
agaagggcagggcugaggccucucauuccaga

SEQ ID NO: 43747 - RNA, 32 nt, Human
agaagggcaguuacuggagacuguaucugcag

SEQ ID NO: 43748 - RNA, 32 nt, Human
agaagggccaguccugccuggccaggcagauc

SEQ ID NO: 43749 - RNA, 32 nt, Human
agaagggccccaaugccaacucuuagucuuuu

SEQ ID NO: 43750 - RNA, 32 nt, Human
agaagggccuggugccggccugcugccccggc

SEQ ID NO: 43751 - RNA, 32 nt, Human
agaagggcucagggcaccagcaaccaagccag

SEQ ID NO: 43752 - RNA, 32 nt, Human
agaagggcugagcugaaaacuucacuccuccu

SEQ ID NO: 43753 - RNA, 32 nt, Human
agaagggcugggaggcgggcagcagccucugg

SEQ ID NO: 43754 - RNA, 32 nt, Human
agaagggcugggaggcgggcagcagccucuug

SEQ ID NO: 43755 - RNA, 32 nt, Human
agaagggcuuacaggcauggacaugcagguug

SEQ ID NO: 43756 - RNA, 32 nt, Human
agaaggggaaacugaggcccagggaggagagu

SEQ ID NO: 43757 - RNA, 32 nt, Human
agaaggggagaaacaggauggaagggugguuu

SEQ ID NO: 43758 - RNA, 32 nt, Human
agaaggggagaaagcuuauggcugggucuggu

SEQ ID NO: 43759 - RNA, 32 nt, Human
agaaggggagggguaggaggagagggaggagg

SEQ ID NO: 43760 - RNA, 32 nt, Human
agaaggggagugagaguucagggaggcccuuc

SEQ ID NO: 43761 - RNA, 32 nt, Human
agaaggggaguuccacuucucagucccgcaug

SEQ ID NO: 43762 - RNA, 32 nt, Human
agaaggggcaacucgugugucuucccaguguc

SEQ ID NO: 43763 - RNA, 32 nt, Human
agaaggggcagaagaaccacauuuuucauuua

SEQ ID NO: 43764 - RNA, 32 nt, Human
agaaggggcgaacugcuugucuugaggagguc

SEQ ID NO: 43765 - RNA, 22 nt, Human
agaaggggcuggagagggccug

SEQ ID NO: 43766 - RNA, 32 nt, Human
agaagggggcagguaaagcagagauuuuagca

SEQ ID NO: 43767 - RNA, 32 nt, Human
agaagggggcuggccccaggaggaggaggaaa

SEQ ID NO: 43768 - RNA, 32 nt, Human
agaagggggcuggguaggcaagcacuccuugg

SEQ ID NO: 43769 - RNA, 32 nt, Human
agaagggggcuuucaaccaggcucacccaggc

SEQ ID NO: 43770 - RNA, 21 nt, Human
agaaggggucucacuauguug

SEQ ID NO: 43771 - RNA, 32 nt, Human
agaaggggugaugagugagaggcgagugguag

SEQ ID NO: 43772 - RNA, 21 nt, Human
agaagggguuucaccacauug

SEQ ID NO: 43773 - RNA, 32 nt, Human
agaagggucauggauggugaggucaguacugc

SEQ ID NO: 43774 - RNA, 32 nt, Human
agaaggguccuucccucuccccaagacuuggu

SEQ ID NO: 43775 - RNA, 32 nt, Human
agaagggugccacauuuuuccagcuuuaagug

SEQ ID NO: 43776 - RNA, 31 nt, Human
agaaggguggagagagaaucugggaagagaa

SEQ ID NO: 43777 - RNA, 21 nt, Human
agaagggugggaacccgggag

SEQ ID NO: 43778 - RNA, 32 nt, Human
agaaggguguaauuaaggauuuccacccccga

SEQ ID NO: 43779 - RNA, 22 nt, Human
agaagguaaaccccacuuacca

SEQ ID NO: 43780 - RNA, 32 nt, Human
agaagguacagauaccucagauucgggaaacu

SEQ ID NO: 43781 - RNA, 32 nt, Human
agaagguaccuugcccaggucuggcacauagu

SEQ ID NO: 43782 - RNA, 32 nt, Human
agaagguacugugggccauggccacaccugau

SEQ ID NO: 43783 - RNA, 32 nt, Human
agaagguagauaagaauuaaaaggguuuaauu

SEQ ID NO: 43784 - RNA, 32 nt, Human
agaagguagauccuaaaaagcauggugagagg

SEQ ID NO: 43785 - RNA, 32 nt, Human
agaagguagcagacagacagacggaucuaacc

SEQ ID NO: 43786 - RNA, 32 nt, Human
agaagguagguauauugguggcugaggucucu

SEQ ID NO: 43787 - RNA, 32 nt, Human
agaagguaguacaggcuucacuuccucaccaa

SEQ ID NO: 43788 - RNA, 32 nt, Human
agaagguauguacugccugaggucacaugaca

SEQ ID NO: 43789 - RNA, 32 nt, Human
agaagguauguggcauuuauuuggauaaaauu

SEQ ID NO: 43790 - RNA, 32 nt, Human
agaagguccaauaggcaggguuaguauaaugg

SEQ ID NO: 43791 - RNA, 32 nt, Human
agaaggucccauuccaggucuugcccaagucu

SEQ ID NO: 43792 - RNA, 22 nt, Human
agaaggucccucccaucugcca

SEQ ID NO: 43793 - RNA, 31 nt, Human
agaagguccuggucucccaugcccaagggau

SEQ ID NO: 43794 - RNA, 23 nt, Human
agaaggucuacaccugcaaggga

SEQ ID NO: 43795 - RNA, 19 nt, Human
agaaggucucacuauguug

SEQ ID NO: 43796 - RNA, 32 nt, Human
agaaggucucccauguguagacagugcgugga

SEQ ID NO: 43797 - RNA, 32 nt, Human
agaaggucucugaagaucuggacugaggaccc

SEQ ID NO: 43798 - RNA, 19 nt, Human
agaaggucugagagggaag

SEQ ID NO: 43799 - RNA, 32 nt, Human
agaaggucugcagcuucacuccugagccagcg

SEQ ID NO: 43800 - RNA, 32 nt, Human
agaaggucuucaguuuccagaagaaccaaagc

SEQ ID NO: 43801 - RNA, 32 nt, Human
agaaggugaacccagaugaggcucaucaggaa

SEQ ID NO: 43802 - RNA, 32 nt, Human
agaaggugaaggcucugaaagcaaagaugcag

SEQ ID NO: 43803 - RNA, 32 nt, Human
agaaggugaaugacguccucaagagcggcugg

SEQ ID NO: 43804 - RNA, 32 nt, Human
agaaggugaguuccuggaccucagggaggaag

SEQ ID NO: 43805 - RNA, 32 nt, Human
agaaggugaguuuauguaaagauauggcaucu

SEQ ID NO: 43806 - RNA, 32 nt, Human
agaaggugaugaggcagagagugaacaugaca

SEQ ID NO: 43807 - RNA, 32 nt, Human
agaaggugccaggucagcaggagcagcagcag

SEQ ID NO: 43808 - RNA, 32 nt, Human
agaaggugcccagcgcuacuucccagguuuuu

SEQ ID NO: 43809 - RNA, 32 nt, Human
agaaggugccccuucaggcaccuaggggagag

SEQ ID NO: 43810 - RNA, 32 nt, Human
agaaggugccugaagaagucucucuucucucu

SEQ ID NO: 43811 - RNA, 32 nt, Human
agaaggugcugcaggacaaccuggacaaguug

SEQ ID NO: 43812 - RNA, 26 nt, Human
agaaggugcuugguguucgccugcca

SEQ ID NO: 43813 - RNA, 32 nt, Human
agaagguggaaggucccagagccccggagccu

SEQ ID NO: 43814 - RNA, 32 nt, Human
agaagguggagggagacgagaagccgccgaga

SEQ ID NO: 43815 - RNA, 32 nt, Human
agaagguggagguggcagugagccgagaucac

SEQ ID NO: 43816 - RNA, 32 nt, Human
agaagguggcaucugacugcggcucauacagg

SEQ ID NO: 43817 - RNA, 32 nt, Human
agaagguguguaggguggguaguggaagugac

SEQ ID NO: 43818 - RNA, 32 nt, Human
agaagguguuugcuagacaaaggggcuugcuu

SEQ ID NO: 43819 - RNA, 32 nt, Human
agaagguuaaagcugacaacaugugaaacauc

SEQ ID NO: 43820 - RNA, 32 nt, Human
agaagguuauucuagcaggaguaccaguacag

SEQ ID NO: 43821 - RNA, 32 nt, Human
agaagguuccaagaacucuggugucugaccua

SEQ ID NO: 43822 - RNA, 32 nt, Human
agaagguucugaccagcuucugcagaggauaa

SEQ ID NO: 43823 - RNA, 32 nt, Human
agaagguucuucuuauuuugugggcugguugc

SEQ ID NO: 43824 - RNA, 32 nt, Human
agaagguugggguuccagaaaggcaucugugu

SEQ ID NO: 43825 - RNA, 32 nt, Human
agaagguugucaagcaaagccuuugagcguuu

SEQ ID NO: 43826 - RNA, 32 nt, Human
agaagguuucacuaagugauuugggccugagg

SEQ ID NO: 43827 - RNA, 32 nt, Human
agaagguuuccagagauagaagauaacucagg

SEQ ID NO: 43828 - RNA, 32 nt, Human
agaagguuuccuucucuuuuucaacuucaugu

SEQ ID NO: 43829 - RNA, 32 nt, Human
agaagguuuggguguccuccugggguucuuuu

SEQ ID NO: 43830 - RNA, 32 nt, Human
agaaguaaacucauccacuuugcucagagaag

SEQ ID NO: 43831 - RNA, 32 nt, Human
agaaguaaauugcaaacaaaucugucaguugu

SEQ ID NO: 43832 - RNA, 32 nt, Human
agaaguaacaaaucaguggccuuauggagaca

SEQ ID NO: 43833 - RNA, 32 nt, Human
agaaguaacagcauguguuuauccugauggaa

SEQ ID NO: 43834 - RNA, 32 nt, Human
agaaguaagccuuggacuguagcugauuauaa

SEQ ID NO: 43835 - RNA, 32 nt, Human
agaaguaaugcuuuccaucaggguaaauaaga

SEQ ID NO: 43836 - RNA, 32 nt, Human
agaaguacucacugguaauuagcuaccaucuu

SEQ ID NO: 43837 - RNA, 32 nt, Human
agaaguacugacuggucuccucuaucguguuu

SEQ ID NO: 43838 - RNA, 32 nt, Human
agaaguacugggugcuggagggagagcucggg

SEQ ID NO: 43839 - RNA, 18 nt, Human
agaaguagauggagcaga

SEQ ID NO: 43840 - RNA, 32 nt, Human
agaaguagcccaaacucuucccucugcugaca

SEQ ID NO: 43841 - RNA, 32 nt, Human
agaaguaggcuggaggaugaguugggacaguc

SEQ ID NO: 43842 - RNA, 32 nt, Human
agaaguagguccugucggcccugcugcugucc

SEQ ID NO: 43843 - RNA, 32 nt, Human
agaaguaguaaggcugggcacuguggcucacg

SEQ ID NO: 43844 - RNA, 32 nt, Human
agaaguaguacaccuugucaucaucacccacu

SEQ ID NO: 43845 - RNA, 32 nt, Human
agaaguagugagucaguguggaagagagguga

SEQ ID NO: 43846 - RNA, 32 nt, Human
agaaguaguuccuguccuuaaggaauuuccuu

SEQ ID NO: 43847 - RNA, 18 nt, Human
agaaguaucugccuuuag

SEQ ID NO: 43848 - RNA, 32 nt, Human
agaaguauucuuuccauuuuucuucugggaaa

SEQ ID NO: 43849 - RNA, 32 nt, Human
agaagucaacucuggcacccacccucaucaaa

SEQ ID NO: 43850 - RNA, 32 nt, Human
agaagucacagaggcccugggcacccagagcc

SEQ ID NO: 43851 - RNA, 32 nt, Human
agaagucacugcuugaggcucagcugcugugu

SEQ ID NO: 43852 - RNA, 32 nt, Human
agaagucagacucacuagacuuuugguucgag

SEQ ID NO: 43853 - RNA, 32 nt, Human
agaagucaggagagagggugaagcggagcagc

SEQ ID NO: 43854 - RNA, 32 nt, Human
agaagucaggguggaauccacacagagcgcau

SEQ ID NO: 43855 - RNA, 32 nt, Human
agaagucagugaucauucaaaagacucagaga

SEQ ID NO: 43856 - RNA, 32 nt, Human
agaagucauccuggagcacagcucuucccacg

SEQ ID NO: 43857 - RNA, 32 nt, Human
agaagucaugcagguacugagcacagguggcc

SEQ ID NO: 43858 - RNA, 32 nt, Human
agaagucauguaacuguggcugccucuuuuca

SEQ ID NO: 43859 - RNA, 32 nt, Human
agaaguccaaaccucagcagcacacaauauac

SEQ ID NO: 43860 - RNA, 32 nt, Human
agaaguccaagaccagccuggccaacauggug

SEQ ID NO: 43861 - RNA, 32 nt, Human
agaaguccagcaugcuugaugggugaagagag

SEQ ID NO: 43862 - RNA, 32 nt, Human
agaaguccagccgccaagcccagccuuccccg

SEQ ID NO: 43863 - RNA, 32 nt, Human
agaaguccagcugugagucucuccccaaagca

SEQ ID NO: 43864 - RNA, 32 nt, Human
agaaguccagggcugcacuguggugugagggu

SEQ ID NO: 43865 - RNA, 18 nt, Human
agaaguccaggguugcuu

SEQ ID NO: 43866 - RNA, 32 nt, Human
agaagucccaagacugucacucugugcaagac

SEQ ID NO: 43867 - RNA, 32 nt, Human
agaagucccagggaguggaggccccugccaug

SEQ ID NO: 43868 - RNA, 32 nt, Human
agaagucccuuuccuguucugucucuucauug

SEQ ID NO: 43869 - RNA, 32 nt, Human
agaaguccgaucucccuagggccccaccugga

SEQ ID NO: 43870 - RNA, 32 nt, Human
agaaguccuagggguuuaacuguacauacuac

SEQ ID NO: 43871 - RNA, 32 nt, Human
agaaguccuauuguucacgcugggcaguugcu

SEQ ID NO: 43872 - RNA, 32 nt, Human
agaaguccuguagggagaugggcaguuaccuu

SEQ ID NO: 43873 - RNA, 19 nt, Human
agaagucggccagcagcuc

SEQ ID NO: 43874 - RNA, 32 nt, Human
agaagucgugagccugcgguccagucagucca

SEQ ID NO: 43875 - RNA, 21 nt, Human
agaagucuuaagucuguggca

SEQ ID NO: 43876 - RNA, 32 nt, Human
agaagucuugugggacagagacuugaguuagg

SEQ ID NO: 43877 - RNA, 32 nt, Human
agaagugaaaagguccucugaggaucagauca

SEQ ID NO: 43878 - RNA, 32 nt, Human
agaagugaauacugcaacacugucucaaaggu

SEQ ID NO: 43879 - RNA, 32 nt, Human
agaagugacagccugcuggcaguccucacagc

SEQ ID NO: 43880 - RNA, 19 nt, Human
agaagugaccuagaaggca

SEQ ID NO: 43881 - RNA, 32 nt, Human
agaagugacuccccuucucccaucagcccaaa

SEQ ID NO: 43882 - RNA, 32 nt, Human
agaagugagccagccacugagaucacauugca

SEQ ID NO: 43883 - RNA, 22 nt, Human
agaagugaggauguagaagcca

SEQ ID NO: 43884 - RNA, 32 nt, Human
agaagugaguaccugcagaaaaguagguaaag

SEQ ID NO: 43885 - RNA, 32 nt, Human
agaagugaugcccaacuuucugccagauguag

SEQ ID NO: 43886 - RNA, 32 nt, Human
agaagugaugcuuuugccaguggaugaucugg

SEQ ID NO: 43887 - RNA, 32 nt, Human
agaagugcaagaccagccugcgcaaacagcaa

SEQ ID NO: 43888 - RNA, 32 nt, Human
agaagugcaauuuuaucuccugccuuucauuc

SEQ ID NO: 43889 - RNA, 32 nt, Human
agaagugcagagaguaagguguccuuauguug

SEQ ID NO: 43890 - RNA, 32 nt, Human
agaagugcagcucuguuaggagccuugaaggu

SEQ ID NO: 43891 - RNA, 31 nt, Human
agaagugcagcugcugcgccugugucgggac

SEQ ID NO: 43892 - RNA, 31 nt, Human
agaagugcagcugcugugccuguguccggac

SEQ ID NO: 43893 - RNA, 32 nt, Human
agaagugcagcugcugugccuguguccggaca

SEQ ID NO: 43894 - RNA, 31 nt, Human
agaagugcagcugcugugccugugucgggac

SEQ ID NO: 43895 - RNA, 32 nt, Human
agaagugcagcugcugugccugugucgggaca

SEQ ID NO: 43896 - RNA, 31 nt, Human
agaagugccgcugcugugccuguguugggag

SEQ ID NO: 43897 - RNA, 32 nt, Human
agaagugccgcugcugugccuguguugggaga

SEQ ID NO: 43898 - RNA, 32 nt, Human
agaagugcgaacccuuugcaguggggaggagc

SEQ ID NO: 43899 - RNA, 32 nt, Human
agaagugcucugccugccagugcagugcccag

SEQ ID NO: 43900 - RNA, 32 nt, Human
agaagugcugggagcagcagcuggggaagcug

SEQ ID NO: 43901 - RNA, 32 nt, Human
agaagugcuguaagucugaagcuguuccccgc

SEQ ID NO: 43902 - RNA, 23 nt, Human
agaaguggacaucccacauguuc

SEQ ID NO: 43903 - RNA, 22 nt, Human
agaaguggagaagcagaggcca

SEQ ID NO: 43904 - RNA, 19 nt, Human
agaaguggagcguaagcca

SEQ ID NO: 43905 - RNA, 31 nt, Human
agaaguggaguugguggaugggugggcaugg

SEQ ID NO: 43906 - RNA, 21 nt, Human
agaaguggaugcccacaugcc

SEQ ID NO: 43907 - RNA, 32 nt, Human
agaaguggcacguccuggagcugcagaggcga

SEQ ID NO: 43908 - RNA, 32 nt, Human
agaaguggcagugcccaacagcuuugggaugg

SEQ ID NO: 43909 - RNA, 32 nt, Human
agaaguggcugaaaaugaauucugagcuuucu

SEQ ID NO: 43910 - RNA, 32 nt, Human
agaaguggcugcagauuggagcccaaagccuu

SEQ ID NO: 43911 - RNA, 32 nt, Human
agaaguggcuuccuuuggaggugggagugggc

SEQ ID NO: 43912 - RNA, 22 nt, Human
agaaguggcuuggagggaacuu

SEQ ID NO: 43913 - RNA, 32 nt, Human
agaagugggaaagagagaggaaugggauggag

SEQ ID NO: 43914 - RNA, 32 nt, Human
agaagugggacaucgagggcucugcuguccuc

SEQ ID NO: 43915 - RNA, 32 nt, Human
agaagugggaggauagcuugggcccaggagau

SEQ ID NO: 43916 - RNA, 20 nt, Human
agaagugggauuagaagaca

SEQ ID NO: 43917 - RNA, 32 nt, Human
agaagugggcaggcuuggcugaaaugagaacu

SEQ ID NO: 43918 - RNA, 32 nt, Human
agaagugggcuuagagggguuuucccugcucu

SEQ ID NO: 43919 - RNA, 32 nt, Human
agaagugggugguggcagccuccacccuuucu

SEQ ID NO: 43920 - RNA, 32 nt, Human
agaaguggugaaugucauggagcccagcugaa

SEQ ID NO: 43921 - RNA, 23 nt, Human
agaaguggugcgccaagcacagc

SEQ ID NO: 43922 - RNA, 32 nt, Human
agaagugucagauggcaguggaagcaugugug

SEQ ID NO: 43923 - RNA, 19 nt, Human
agaagugucccagaaguca

SEQ ID NO: 43924 - RNA, 32 nt, Human
agaagugugagucccaguuccacccacaacca

SEQ ID NO: 43925 - RNA, 32 nt, Human
agaagugugcauguacacacaccacacacaca

SEQ ID NO: 43926 - RNA, 20 nt, Human
agaaguguggcacugcuaua

SEQ ID NO: 43927 - RNA, 32 nt, Human
agaaguguuuauuuucuucccuucccuucccu

SEQ ID NO: 43928 - RNA, 32 nt, Human
agaaguguuucuggugggcucugcgggagaag

SEQ ID NO: 43929 - RNA, 32 nt, Human
agaaguguuugcccacacagcaaaugguccau

SEQ ID NO: 43930 - RNA, 32 nt, Human
agaaguuaaaaaggagagguggaaccuuccca

SEQ ID NO: 43931 - RNA, 32 nt, Human
agaaguuagaguccagccuggccaacauggug

SEQ ID NO: 43932 - RNA, 32 nt, Human
agaaguuagggagggauaggagcccuggguag

SEQ ID NO: 43933 - RNA, 32 nt, Human
agaaguuauacaacauacaggcuucuaggucu

SEQ ID NO: 43934 - RNA, 32 nt, Human
agaaguuaucucccucucccugugaugccuug

SEQ ID NO: 43935 - RNA, 32 nt, Human
agaaguuaugccacugccacuuuugcuugccc

SEQ ID NO: 43936 - RNA, 32 nt, Human
agaaguuauuuuucccuuccagaggggucuau

SEQ ID NO: 43937 - RNA, 32 nt, Human
agaaguucaagaccagccugaccaacaucgug

SEQ ID NO: 43938 - RNA, 32 nt, Human
agaaguucaagaccagccugagcaacaugaug

SEQ ID NO: 43939 - RNA, 32 nt, Human
agaaguucaagaccagccugcacaucacgaga

SEQ ID NO: 43940 - RNA, 32 nt, Human
agaaguucaagaccagccuggccaacaugggg

SEQ ID NO: 43941 - RNA, 32 nt, Human
agaaguucaagaccagccuggccaacauggug

SEQ ID NO: 43942 - RNA, 32 nt, Human
agaaguucaaggccagccuggacgacauagcg

SEQ ID NO: 43943 - RNA, 32 nt, Human
agaaguucacuggagggcccagccuggggaaa

SEQ ID NO: 43944 - RNA, 32 nt, Human
agaaguucaggagagaaagaagucauaaccau

SEQ ID NO: 43945 - RNA, 32 nt, Human
agaaguucaucaauggcuuggcuggaggacaa

SEQ ID NO: 43946 - RNA, 32 nt, Human
agaaguucauguccaaacguccucuuuaguuu

SEQ ID NO: 43947 - RNA, 32 nt, Human
agaaguucauuugcugaaucgcugaaguucau

SEQ ID NO: 43948 - RNA, 32 nt, Human
agaaguuccacugcacuccagccuggguuaca

SEQ ID NO: 43949 - RNA, 32 nt, Human
agaaguuccuggggcuccguguugcaguucag

SEQ ID NO: 43950 - RNA, 32 nt, Human
agaaguucgagaccagccuaaccaacauggug

SEQ ID NO: 43951 - RNA, 32 nt, Human
agaaguucgagaccagccugagcaacauggug

SEQ ID NO: 43952 - RNA, 32 nt, Human
agaaguucgagaccagccuggccaacauggug

SEQ ID NO: 43953 - RNA, 32 nt, Human
agaaguucgagaccagccuuggccaacauggc

SEQ ID NO: 43954 - RNA, 32 nt, Human
agaaguucgaggccagccuggccaacaugaca

SEQ ID NO: 43955 - RNA, 32 nt, Human
agaaguugcacacagaagucccagggaccuuu

SEQ ID NO: 43956 - RNA, 32 nt, Human
agaaguugcuggaaggcccacuguccagcagc

SEQ ID NO: 43957 - RNA, 32 nt, Human
agaaguuggagguggagcugugacuggcugag

SEQ ID NO: 43958 - RNA, 32 nt, Human
agaaguuggcauuaucuuccuggcagauugcu

SEQ ID NO: 43959 - RNA, 32 nt, Human
agaaguuggccaaaauacugccuguacuguua

SEQ ID NO: 43960 - RNA, 17 nt, Human
agaaguugggggagcuc

SEQ ID NO: 43961 - RNA, 32 nt, Human
agaaguugugcaaacugaagacaaaacuguuu

SEQ ID NO: 43962 - RNA, 32 nt, Human
agaaguuguuucugguuuuuccuugccccugu

SEQ ID NO: 43963 - RNA, 32 nt, Human
agaaguuuagagggggaagaaaagaaugauaa

SEQ ID NO: 43964 - RNA, 20 nt, Human
agaaguuuauccggaagcca

SEQ ID NO: 43965 - RNA, 32 nt, Human
agaaguuuauguguagggacugugggaaggcu

SEQ ID NO: 43966 - RNA, 32 nt, Human
agaaguuucugcacucagccaggcggcaucaa

SEQ ID NO: 43967 - RNA, 32 nt, Human
agaaguuugaaaccagccuggacuacauggug

SEQ ID NO: 43968 - RNA, 31 nt, Human
agaaguuugagaaaaagacugaauaauaucu

SEQ ID NO: 43969 - RNA, 32 nt, Human
agaaguuugagaccagccuaggcaacauugca

SEQ ID NO: 43970 - RNA, 32 nt, Human
agaaguuugagaccagccugaccaacauggug

SEQ ID NO: 43971 - RNA, 32 nt, Human
agaaguuugagaccagccuggcaaacauggca

SEQ ID NO: 43972 - RNA, 32 nt, Human
agaaguuugagaccagccuggccaacauaauu

SEQ ID NO: 43973 - RNA, 32 nt, Human
agaaguuugagaccagccuggccaacauggug

SEQ ID NO: 43974 - RNA, 32 nt, Human
agaaguuugagaccagccuggccaauauggcg

SEQ ID NO: 43975 - RNA, 32 nt, Human
agaaguuugagaccagccugggcaacauagug

SEQ ID NO: 43976 - RNA, 32 nt, Human
agaaguuugagaccagccugugcaacauaucu

SEQ ID NO: 43977 - RNA, 32 nt, Human
agaaguuugagaccagccuugccaacacagug

SEQ ID NO: 43978 - RNA, 24 nt, Human
agaaguuugcuguccaggagccag

SEQ ID NO: 43979 - RNA, 32 nt, Human
agaaguuugugagaauguggccgcccuuuucc

SEQ ID NO: 43980 - RNA, 32 nt, Human
agaaguuuugacugcaggaccgggagcucccu

SEQ ID NO: 43981 - RNA, 32 nt, Human
agaaguuuuggacaagccuccccaaauguggc

SEQ ID NO: 43982 - RNA, 32 nt, Human
agaauaaaaauuagaguuagacaaaguauuaa

SEQ ID NO: 43983 - RNA, 32 nt, Human
agaauaaaaauuagaguuagacaaaguauuag

SEQ ID NO: 43984 - RNA, 32 nt, Human
agaauaaaaugagaacucuggagugagcuaaa

SEQ ID NO: 43985 - RNA, 24 nt, Human
agaauaaacacauuuagccuuaua

SEQ ID NO: 43986 - RNA, 32 nt, Human
agaauaaauaugcucagccacccugugggccg

SEQ ID NO: 43987 - RNA, 32 nt, Human
agaauaacacccuucuaggggaggcggguggg

SEQ ID NO: 43988 - RNA, 32 nt, Human
agaauaacacuggcuuuggguagugccauggc

SEQ ID NO: 43989 - RNA, 32 nt, Human
agaauaaccacagccucagauacuggggacuu

SEQ ID NO: 43990 - RNA, 32 nt, Human
agaauaaccacugcacuccaaccugggcaaca

SEQ ID NO: 43991 - RNA, 21 nt, Human
agaauaaccaugaaaauacaa

SEQ ID NO: 43992 - RNA, 32 nt, Human
agaauaaccuaggcugcuggaaagcacccuuu

SEQ ID NO: 43993 - RNA, 22 nt, Human
agaauaaccuucaaauaaaaua

SEQ ID NO: 43994 - RNA, 32 nt, Human
agaauaacugguuuuaaaauuuucugcaauac

SEQ ID NO: 43995 - RNA, 18 nt, Human
agaauaacuuuccaggaa

SEQ ID NO: 43996 - RNA, 32 nt, Human
agaauaagcagcugccuggagccuauucacua

SEQ ID NO: 43997 - RNA, 22 nt, Human
agaauaaggaggaggagggaga

SEQ ID NO: 43998 - RNA, 32 nt, Human
agaauaaggaggaggagggagaagagaaaaug

SEQ ID NO: 43999 - RNA, 32 nt, Human
agaauaagggacaaauggguucccugugcuuc

SEQ ID NO: 44000 - RNA, 32 nt, Human
agaauaaguccuucuguuuucucuuuaacauu

SEQ ID NO: 44001 - RNA, 32 nt, Human
agaauaauacaugaucacagaaaugcauacca

SEQ ID NO: 44002 - RNA, 18 nt, Human
agaauaauacuccgagua

SEQ ID NO: 44003 - RNA, 32 nt, Human
agaauaaugaaugagauuaauuaagaaaugaa

SEQ ID NO: 44004 - RNA, 32 nt, Human
agaauaaugucacuucauuugauuaugacuac

SEQ ID NO: 44005 - RNA, 32 nt, Human
agaauacaaaggauggucugugggaaaauaua

SEQ ID NO: 44006 - RNA, 32 nt, Human
agaauacaaaugcugggcugggcacaguggcu

SEQ ID NO: 44007 - RNA, 22 nt, Human
agaauacaaccucaugcucccu

SEQ ID NO: 44008 - RNA, 32 nt, Human
agaauacaucauucacagacuuugguguuuua

SEQ ID NO: 44009 - RNA, 32 nt, Human
agaauaccuguguggugcuguccuuccucaag

SEQ ID NO: 44010 - RNA, 32 nt, Human
agaauacucugccucugcuucauguagcaaau

SEQ ID NO: 44011 - RNA, 32 nt, Human
agaauacuggagaagagagagggugggcagag

SEQ ID NO: 44012 - RNA, 32 nt, Human
agaauacuuuagagcuaccaaaauuagcagca

SEQ ID NO: 44013 - RNA, 32 nt, Human
agaauacuuucaauucugaagaugucuggcua

SEQ ID NO: 44014 - RNA, 32 nt, Human
agaauagaaagccacaggucuagcagggaagc

SEQ ID NO: 44015 - RNA, 32 nt, Human
agaauagaaggaaggugauaggaugugaugau

SEQ ID NO: 44016 - RNA, 32 nt, Human
agaauagaaggugggcagggcgggggaggcag

SEQ ID NO: 44017 - RNA, 20 nt, Human
agaauagacgaagaccccga

SEQ ID NO: 44018 - RNA, 32 nt, Human
agaauagacuccuggguuguuuuacaaaugug

SEQ ID NO: 44019 - RNA, 32 nt, Human
agaauagagaacaggaacgagguggagagcaa

SEQ ID NO: 44020 - RNA, 32 nt, Human
agaauagaugcucaauaaacaccagcugcuac

SEQ ID NO: 44021 - RNA, 32 nt, Human
agaauagcaagggggaagucugcccccauguu

SEQ ID NO: 44022 - RNA, 32 nt, Human
agaauagcacaaugaacaugcauauacccuuc

SEQ ID NO: 44023 - RNA, 32 nt, Human
agaauagcaugaaccagggagguggagggugc

SEQ ID NO: 44024 - RNA, 22 nt, Human
agaauagccugggcaacauagc

SEQ ID NO: 44025 - RNA, 21 nt, Human
agaauagcgugaacccgggag

SEQ ID NO: 44026 - RNA, 21 nt, Human
agaauagcuggaacccaggag

SEQ ID NO: 44027 - RNA, 21 nt, Human
agaauagcuggaacccgggag

SEQ ID NO: 44028 - RNA, 32 nt, Human
agaauagcuugaaccugggaggcggauguugc

SEQ ID NO: 44029 - RNA, 21 nt, Human
agaauagggagaaggaggaga

SEQ ID NO: 44030 - RNA, 32 nt, Human
agaauagggagguggagaaugaugacuuaccc

SEQ ID NO: 44031 - RNA, 32 nt, Human
agaauagggcccugacuuugugcuggucuggc

SEQ ID NO: 44032 - RNA, 32 nt, Human
agaauagggcugggcacaguggcucacgccug

SEQ ID NO: 44033 - RNA, 32 nt, Human
agaauaggucaaaauuccaaaaccauggacau

SEQ ID NO: 44034 - RNA, 21 nt, Human
agaauagugugaacccaggag

SEQ ID NO: 44035 - RNA, 32 nt, Human
agaauauaaggagauggacaaaccgugugggu

SEQ ID NO: 44036 - RNA, 32 nt, Human
agaauauaaggaggcagaaaaauaugaaaaga

SEQ ID NO: 44037 - RNA, 32 nt, Human
agaauauacaugcacaucagcucaaugucuuu

SEQ ID NO: 44038 - RNA, 32 nt, Human
agaauauaugaaugacuaauauacaaaagauu

SEQ ID NO: 44039 - RNA, 32 nt, Human
agaauaucaauggaaaaggagaaggaccuccu

SEQ ID NO: 44040 - RNA, 32 nt, Human
agaauaucacacacggaauccucauucauucc

SEQ ID NO: 44041 - RNA, 32 nt, Human
agaauauccaaagaauaaggaggaggaugaac

SEQ ID NO: 44042 - RNA, 32 nt, Human
agaauaucccagaguaauuggaguuuuucuuu

SEQ ID NO: 44043 - RNA, 32 nt, Human
agaauaucucaaagacguggauuuucauuuca

SEQ ID NO: 44044 - RNA, 32 nt, Human
agaauaugacaugcugaaccaggcaugguggc

SEQ ID NO: 44045 - RNA, 32 nt, Human
agaauaugcccuuuauuaugcuaucauugcua

SEQ ID NO: 44046 - RNA, 32 nt, Human
agaauaugccuuuugcuagccugcugugaugc

SEQ ID NO: 44047 - RNA, 19 nt, Human
agaauauggaacucaggag

SEQ ID NO: 44048 - RNA, 32 nt, Human
agaauauggagccaggcccugccugguuacua

SEQ ID NO: 44049 - RNA, 32 nt, Human
agaauaugggaucucucaccuagucauuguau

SEQ ID NO: 44050 - RNA, 32 nt, Human
agaauaugguccauuccaucugaguuuucaaa

SEQ ID NO: 44051 - RNA, 32 nt, Human
agaauauguauucuauucacaagacucaacaa

SEQ ID NO: 44052 - RNA, 32 nt, Human
agaauauuagggaugagauggaagaggagagg

SEQ ID NO: 44053 - RNA, 32 nt, Human
agaauauuauccugguuuaacaacagugcccu

SEQ ID NO: 44054 - RNA, 32 nt, Human
agaauauuucugcagauaauuucuauugaaau

SEQ ID NO: 44055 - RNA, 18 nt, Human
agaauauuugguuuuccu

SEQ ID NO: 44056 - RNA, 32 nt, Human
agaauauuuuaacuuccuuggacucauuuuaa

SEQ ID NO: 44057 - RNA, 32 nt, Human
agaaucaaacaacauggggacugagggaggga

SEQ ID NO: 44058 - RNA, 32 nt, Human
agaaucaaaggcagagaagaccagccgugcuc

SEQ ID NO: 44059 - RNA, 32 nt, Human
agaaucaaccaaggagccugagcccaggaagg

SEQ ID NO: 44060 - RNA, 32 nt, Human
agaaucaagcuagaaggccacaugucaccgug

SEQ ID NO: 44061 - RNA, 32 nt, Human
agaaucaaggagugugcucucaaaugagagga

SEQ ID NO: 44062 - RNA, 21 nt, Human
agaaucaauagaacccaggag

SEQ ID NO: 44063 - RNA, 32 nt, Human
agaaucaauuauauuugaaaagcugccugugu

SEQ ID NO: 44064 - RNA, 32 nt, Human
agaaucacaaagguccuagaaaccacuuggcu

SEQ ID NO: 44065 - RNA, 32 nt, Human
agaaucacaauccuagucuaucuagcuccuca

SEQ ID NO: 44066 - RNA, 32 nt, Human
agaaucaccagcuguuccuaguggcugcuggg

SEQ ID NO: 44067 - RNA, 21 nt, Human
agaaucaccugaacccaggag

SEQ ID NO: 44068 - RNA, 21 nt, Human
agaaucaccugagcccaggag

SEQ ID NO: 44069 - RNA, 24 nt, Human
agaaucacucacaaaacucucaca

SEQ ID NO: 44070 - RNA, 21 nt, Human
agaaucacucgaacccaggag

SEQ ID NO: 44071 - RNA, 32 nt, Human
agaaucacucgaaccugggagguggagguugc

SEQ ID NO: 44072 - RNA, 21 nt, Human
agaaucacucgccauucuccu

SEQ ID NO: 44073 - RNA, 21 nt, Human
agaaucacuuaaacccaggag

SEQ ID NO: 44074 - RNA, 20 nt, Human
agaaucacuucagcccagga

SEQ ID NO: 44075 - RNA, 20 nt, Human
agaaucacuucagcccggga

SEQ ID NO: 44076 - RNA, 32 nt, Human
agaaucacuugaacccaaaaggcagacauugc

SEQ ID NO: 44077 - RNA, 21 nt, Human
agaaucacuugaacccaggag

SEQ ID NO: 44078 - RNA, 32 nt, Human
agaaucacuugaacccaggagguguugcagug

SEQ ID NO: 44079 - RNA, 20 nt, Human
agaaucacuugaaccgggga

SEQ ID NO: 44080 - RNA, 32 nt, Human
agaaucacuugaaccugggaggcggaggcugc

SEQ ID NO: 44081 - RNA, 32 nt, Human
agaaucacuugaaccugggaggcggagguugc

SEQ ID NO: 44082 - RNA, 32 nt, Human
agaaucacuugaaccugggaggcggagguugu

SEQ ID NO: 44083 - RNA, 32 nt, Human
agaaucacuugaaccugggaggcggauguuga

SEQ ID NO: 44084 - RNA, 32 nt, Human
agaaucacuugaaccugggagguggagacugc

SEQ ID NO: 44085 - RNA, 32 nt, Human
agaaucacuugaaccugggagguggagguuau

SEQ ID NO: 44086 - RNA, 32 nt, Human
agaaucacuugaaccugggagguggagguugc

SEQ ID NO: 44087 - RNA, 32 nt, Human
agaaucacuugaaccugggagguggagguuuc

SEQ ID NO: 44088 - RNA, 32 nt, Human
agaaucacuugaaccugggagguggauguugc

SEQ ID NO: 44089 - RNA, 32 nt, Human
agaaucacuugaagcugggaggcggagguugc

SEQ ID NO: 44090 - RNA, 22 nt, Human
agaaucacuugaaucccaggag

SEQ ID NO: 44091 - RNA, 32 nt, Human
agaaucacuugaaucugggagguggagguugc

SEQ ID NO: 44092 - RNA, 21 nt, Human
agaaucacuugagcccaggag

SEQ ID NO: 44093 - RNA, 32 nt, Human
agaaucacuuuuccucaauuguccucuguguc

SEQ ID NO: 44094 - RNA, 32 nt, Human
agaaucagaacaggcucuguauguggaucaaa

SEQ ID NO: 44095 - RNA, 32 nt, Human
agaaucagagacuuuaaucuugaacucacagc

SEQ ID NO: 44096 - RNA, 32 nt, Human
agaaucagaucccagaccuuuggggagaagga

SEQ ID NO: 44097 - RNA, 32 nt, Human
agaaucagaucugcuccccagcaucuucuguu

SEQ ID NO: 44098 - RNA, 32 nt, Human
agaaucagccugcagaagcagagcaagcauau

SEQ ID NO: 44099 - RNA, 32 nt, Human
agaaucagccuggagauugggcaggaacagag

SEQ ID NO: 44100 - RNA, 32 nt, Human
agaaucaggaaagccuuuaugguguggcuaaa

SEQ ID NO: 44101 - RNA, 32 nt, Human
agaaucaggaacaguuucuagaauacacuuga

SEQ ID NO: 44102 - RNA, 32 nt, Human
agaaucaggugaugacucaugggaucugauca

SEQ ID NO: 44103 - RNA, 32 nt, Human
agaaucaguucugagccuccucgccucccggc

SEQ ID NO: 44104 - RNA, 17 nt, Human
agaaucauacaagcaca

SEQ ID NO: 44105 - RNA, 32 nt, Human
agaaucauacauacuuucaagagaauuccaca

SEQ ID NO: 44106 - RNA, 20 nt, Human
agaaucauacucuccaggaa

SEQ ID NO: 44107 - RNA, 32 nt, Human
agaaucauaugacuugcuuuuuccauuccagu

SEQ ID NO: 44108 - RNA, 32 nt, Human
agaaucaucaucgccacugaaaaccaggcccu

SEQ ID NO: 44109 - RNA, 32 nt, Human
agaaucauccacaagucaccccaaaccuugga

SEQ ID NO: 44110 - RNA, 32 nt, Human
agaaucaucuccccugccccacaaacaugaaa

SEQ ID NO: 44111 - RNA, 21 nt, Human
agaaucaucugaacccaggag

SEQ ID NO: 44112 - RNA, 21 nt, Human
agaaucaugaaaccacaggag

SEQ ID NO: 44113 - RNA, 32 nt, Human
agaaucaugcaagcuuccucccucagccauug

SEQ ID NO: 44114 - RNA, 31 nt, Human
agaaucaugccacccucaaagccucauccac

SEQ ID NO: 44115 - RNA, 23 nt, Human
agaaucaugccuccccaucuccu

SEQ ID NO: 44116 - RNA, 32 nt, Human
agaaucauggcggaaggugaaugaggagcaaa

SEQ ID NO: 44117 - RNA, 32 nt, Human
agaaucauguuaacuauuggguugugacugaa

SEQ ID NO: 44118 - RNA, 18 nt, Human
agaaucauuguccaggag

SEQ ID NO: 44119 - RNA, 20 nt, Human
agaaucauuucaacccggga

SEQ ID NO: 44120 - RNA, 18 nt, Human
agaaucauuuuucuuccu

SEQ ID NO: 44121 - RNA, 22 nt, Human
agaauccaagaucugccaggaa

SEQ ID NO: 44122 - RNA, 32 nt, Human
agaauccacagcaaccagcaccaugcccauga

SEQ ID NO: 44123 - RNA, 21 nt, Human
agaauccaccuuaggccucag

SEQ ID NO: 44124 - RNA, 32 nt, Human
agaauccacugauuuucuguggcuccagugag

SEQ ID NO: 44125 - RNA, 32 nt, Human
agaauccagagcucguagcuguccucagcugu

SEQ ID NO: 44126 - RNA, 32 nt, Human
agaauccagcugggcuagaggcugagcaccuu

SEQ ID NO: 44127 - RNA, 32 nt, Human
agaauccaggccccaucucccccaacuccaca

SEQ ID NO: 44128 - RNA, 32 nt, Human
agaauccagggaugggaggggaagggacggau

SEQ ID NO: 44129 - RNA, 32 nt, Human
agaauccaguguuucugcuuucaguuucuugg

SEQ ID NO: 44130 - RNA, 32 nt, Human
agaauccauaacugccuagagccuggggcccu

SEQ ID NO: 44131 - RNA, 20 nt, Human
agaaucccaagggcccagga

SEQ ID NO: 44132 - RNA, 21 nt, Human
agaaucccagaauucuaggaa

SEQ ID NO: 44133 - RNA, 23 nt, Human
agaaucccagcccagaaucccga

SEQ ID NO: 44134 - RNA, 32 nt, Human
agaaucccagccccagcaucuccaagcauagg

SEQ ID NO: 44135 - RNA, 21 nt, Human
agaaucccaggacagaaagau

SEQ ID NO: 44136 - RNA, 32 nt, Human
agaaucccagguccugggccugguuuucuaau

SEQ ID NO: 44137 - RNA, 32 nt, Human
agaaucccaucuuugccagauacguuaacuuu

SEQ ID NO: 44138 - RNA, 32 nt, Human
agaauccccaaaagugucaugcuuuuaaacaa

SEQ ID NO: 44139 - RNA, 19 nt, Human
agaauccccggcguuuuuc

SEQ ID NO: 44140 - RNA, 32 nt, Human
agaauccccuccagauaagagauuuugaguga

SEQ ID NO: 44141 - RNA, 32 nt, Human
agaauccccuugacacucccaccaucuucacc

SEQ ID NO: 44142 - RNA, 32 nt, Human
agaaucccuacuggaagccugcaagucuaaga

SEQ ID NO: 44143 - RNA, 32 nt, Human
agaaucccuagcugccccagcccagucuuucu

SEQ ID NO: 44144 - RNA, 18 nt, Human
agaaucccucacucuucc

SEQ ID NO: 44145 - RNA, 32 nt, Human
agaaucccugguucagccuggaaggcgagggg

SEQ ID NO: 44146 - RNA, 21 nt, Human
agaaucccuugaacccaggag

SEQ ID NO: 44147 - RNA, 32 nt, Human
agaaucccuugaaccugggaggcggagguugc

SEQ ID NO: 44148 - RNA, 32 nt, Human
agaaucccuugaaccugggaggcggagguugu

SEQ ID NO: 44149 - RNA, 32 nt, Human
agaaucccuugaaccugggagguggagguugc

SEQ ID NO: 44150 - RNA, 18 nt, Human
agaauccggcuccaggaa

SEQ ID NO: 44151 - RNA, 32 nt, Human
agaauccuaagcucuggaaauauuucaugaca

SEQ ID NO: 44152 - RNA, 18 nt, Human
agaauccuaaugcuucuu

SEQ ID NO: 44153 - RNA, 20 nt, Human
agaauccuagauaguuuucc

SEQ ID NO: 44154 - RNA, 32 nt, Human
agaauccuagaugaaccacacgcuuuacuaag

SEQ ID NO: 44155 - RNA, 32 nt, Human
agaauccuagccccacuaaugccaagucuguu

SEQ ID NO: 44156 - RNA, 20 nt, Human
agaauccuagugacaaaguc

SEQ ID NO: 44157 - RNA, 18 nt, Human
agaauccucagcucuccu

SEQ ID NO: 44158 - RNA, 18 nt, Human
agaauccucagcuggaga

SEQ ID NO: 44159 - RNA, 32 nt, Human
agaauccucaguuggaaucauugcuaauauuu

SEQ ID NO: 44160 - RNA, 32 nt, Human
agaauccuccacccccugauccucccugggga

SEQ ID NO: 44161 - RNA, 18 nt, Human
agaauccucccggaaccu

SEQ ID NO: 44162 - RNA, 18 nt, Human
agaauccuccuguggccu

SEQ ID NO: 44163 - RNA, 15 nt, Human
agaauccuccuuccu

SEQ ID NO: 44164 - RNA, 19 nt, Human
agaauccucuccauuuucc

SEQ ID NO: 44165 - RNA, 17 nt, Human
agaauccucuccuuucu

SEQ ID NO: 44166 - RNA, 18 nt, Human
agaauccucucucccccu

SEQ ID NO: 44167 - RNA, 19 nt, Human
agaauccucucuuucuucu

SEQ ID NO: 44168 - RNA, 19 nt, Human
agaauccucugaccuaccu

SEQ ID NO: 44169 - RNA, 17 nt, Human
agaauccucuuuccucc

SEQ ID NO: 44170 - RNA, 32 nt, Human
agaauccugaggaccuggagugcaaugagaau

SEQ ID NO: 44171 - RNA, 17 nt, Human
agaauccugccucuccc

SEQ ID NO: 44172 - RNA, 17 nt, Human
agaauccugcucuuccu

SEQ ID NO: 44173 - RNA, 19 nt, Human
agaauccuggcccuucucc

SEQ ID NO: 44174 - RNA, 19 nt, Human
agaauccugguccuucucc

SEQ ID NO: 44175 - RNA, 32 nt, Human
agaauccuguuaggucgguuuagaugaaugcu

SEQ ID NO: 44176 - RNA, 32 nt, Human
agaauccuguuuccauccuccugguuccuucu

SEQ ID NO: 44177 - RNA, 17 nt, Human
agaauccuuccucuccu

SEQ ID NO: 44178 - RNA, 32 nt, Human
agaauccuuuaaggaggguggcggugcugacu

SEQ ID NO: 44179 - RNA, 21 nt, Human
agaauccuuucagcucuuccu

SEQ ID NO: 44180 - RNA, 19 nt, Human
agaauccuuuccucuucuu

SEQ ID NO: 44181 - RNA, 17 nt, Human
agaauccuuugucuucc

SEQ ID NO: 44182 - RNA, 32 nt, Human
agaaucgacaccuugcaacugugccuucaaag

SEQ ID NO: 44183 - RNA, 32 nt, Human
agaaucgcaugcuguagaaaugcucaaaagug

SEQ ID NO: 44184 - RNA, 32 nt, Human
agaaucgccuaccugugccugcguguaaacca

SEQ ID NO: 44185 - RNA, 21 nt, Human
agaaucgccugaacccaggag

SEQ ID NO: 44186 - RNA, 21 nt, Human
agaaucgcgugaacccaggag

SEQ ID NO: 44187 - RNA, 21 nt, Human
agaaucgcuagaacccaggag

SEQ ID NO: 44188 - RNA, 21 nt, Human
agaaucgcuagaacccgggag

SEQ ID NO: 44189 - RNA, 21 nt, Human
agaaucgcucgaacccaggag

SEQ ID NO: 44190 - RNA, 21 nt, Human
agaaucgcuggaacccaggag

SEQ ID NO: 44191 - RNA, 21 nt, Human
agaaucgcuuaaacccaggag

SEQ ID NO: 44192 - RNA, 32 nt, Human
agaaucgcuugaaacugggagguggagguugc

SEQ ID NO: 44193 - RNA, 32 nt, Human
agaaucgcuugaaccagggaagcggagguugc

SEQ ID NO: 44194 - RNA, 32 nt, Human
agaaucgcuugaacccacagggcagaggucac

SEQ ID NO: 44195 - RNA, 20 nt, Human
agaaucgcuugaacccagau

SEQ ID NO: 44196 - RNA, 21 nt, Human
agaaucgcuugaacccaggag

SEQ ID NO: 44197 - RNA, 32 nt, Human
agaaucgcuugaaccugggaggcggaaguugc

SEQ ID NO: 44198 - RNA, 32 nt, Human
agaaucgcuugaaccugggaggcggagauugc

SEQ ID NO: 44199 - RNA, 32 nt, Human
agaaucgcuugaaccugggaggcggaggaggu

SEQ ID NO: 44200 - RNA, 32 nt, Human
agaaucgcuugaaccugggaggcggagguugc

SEQ ID NO: 44201 - RNA, 32 nt, Human
agaaucgcuugaaccugggagguggaaguugc

SEQ ID NO: 44202 - RNA, 32 nt, Human
agaaucgcuugaaccugggagguggagauugc

SEQ ID NO: 44203 - RNA, 32 nt, Human
agaaucgcuugaaccugggagguggaggcagu

SEQ ID NO: 44204 - RNA, 32 nt, Human
agaaucgcuugaaccugggagguggaggggag

SEQ ID NO: 44205 - RNA, 32 nt, Human
agaaucgcuugaaccugggagguggagguuac

SEQ ID NO: 44206 - RNA, 32 nt, Human
agaaucgcuugaaccugggagguggagguugc

SEQ ID NO: 44207 - RNA, 32 nt, Human
agaaucgcuugaaccugggagguggagguugu

SEQ ID NO: 44208 - RNA, 32 nt, Human
agaaucgcuugaaccugggagguggaguugca

SEQ ID NO: 44209 - RNA, 32 nt, Human
agaaucgcuugaaucugggaggcggagauugc

SEQ ID NO: 44210 - RNA, 32 nt, Human
agaaucgcuugaaucugggaggcggagguugc

SEQ ID NO: 44211 - RNA, 21 nt, Human
agaaucgcuugacuccaggag

SEQ ID NO: 44212 - RNA, 21 nt, Human
agaaucgcuugagcccaggag

SEQ ID NO: 44213 - RNA, 20 nt, Human
agaaucgcuugagccgggga

SEQ ID NO: 44214 - RNA, 32 nt, Human
agaaucgcuugagccugggagguggagguugc

SEQ ID NO: 44215 - RNA, 32 nt, Human
agaaucgcuugagucugggaggcggagguugc

SEQ ID NO: 44216 - RNA, 32 nt, Human
agaaucgcuuggaccugggagguggagguugc

SEQ ID NO: 44217 - RNA, 21 nt, Human
agaaucgcuugggcccaggag

SEQ ID NO: 44218 - RNA, 18 nt, Human
agaaucguuuaucuuucu

SEQ ID NO: 44219 - RNA, 21 nt, Human
agaaucguuugaacccaggag

SEQ ID NO: 44220 - RNA, 32 nt, Human
agaaucuaaaaauucauguugaaagggaauga

SEQ ID NO: 44221 - RNA, 32 nt, Human
agaaucuaaagccaguggcuugaggcuacagg

SEQ ID NO: 44222 - RNA, 32 nt, Human
agaaucuaaccucaagaauaagaaauacaagu

SEQ ID NO: 44223 - RNA, 24 nt, Human
agaaucuacaacauagggccccag

SEQ ID NO: 44224 - RNA, 17 nt, Human
agaaucuacccaaagga

SEQ ID NO: 44225 - RNA, 18 nt, Human
agaaucuacuaucuggaa

SEQ ID NO: 44226 - RNA, 20 nt, Human
agaaucuacuuauccuuccu

SEQ ID NO: 44227 - RNA, 20 nt, Human
agaaucuacuuuccacagaa

SEQ ID NO: 44228 - RNA, 32 nt, Human
agaaucuagucuaugugguugcgccaucugug

SEQ ID NO: 44229 - RNA, 20 nt, Human
agaaucuauauccucaggaa

SEQ ID NO: 44230 - RNA, 21 nt, Human
agaaucuauauuccaagcaca

SEQ ID NO: 44231 - RNA, 32 nt, Human
agaaucuaucuuuugcccuacagugucccggc

SEQ ID NO: 44232 - RNA, 32 nt, Human
agaaucuaugcaagccucaucaacaccacuuu

SEQ ID NO: 44233 - RNA, 31 nt, Human
agaaucucaauaaauuuaugugaagagaaug

SEQ ID NO: 44234 - RNA, 32 nt, Human
agaaucucacauggaccccauaaauguguaca

SEQ ID NO: 44235 - RNA, 32 nt, Human
agaaucucauuuucuucuuucuuccauucccu

SEQ ID NO: 44236 - RNA, 32 nt, Human
agaaucucccucugucccccaggcuggagugc

SEQ ID NO: 44237 - RNA, 19 nt, Human
agaaucucgaacccaggag

SEQ ID NO: 44238 - RNA, 32 nt, Human
agaaucucgcucuauggcccaggcuggaguac

SEQ ID NO: 44239 - RNA, 32 nt, Human
agaaucucgcucugcacuccagccuaggugac

SEQ ID NO: 44240 - RNA, 19 nt, Human
agaaucucguccccucccu

SEQ ID NO: 44241 - RNA, 32 nt, Human
agaaucucuaccagggcaguguggaggggaaa

SEQ ID NO: 44242 - RNA, 16 nt, Human
agaaucucugcaggaa

SEQ ID NO: 44243 - RNA, 32 nt, Human
agaaucucuggacggagcugcuggcagcuucu

SEQ ID NO: 44244 - RNA, 32 nt, Human
agaaucucuguggggcgaugcugcagcggcug

SEQ ID NO: 44245 - RNA, 19 nt, Human
agaaucucuuauucuuccu

SEQ ID NO: 44246 - RNA, 21 nt, Human
agaaucucuugaacccaggag

SEQ ID NO: 44247 - RNA, 32 nt, Human
agaaucucuugaaccugggaggcggagguugc

SEQ ID NO: 44248 - RNA, 21 nt, Human
agaaucucuugaauccaggag

SEQ ID NO: 44249 - RNA, 18 nt, Human
agaaucugaacccaggaa

SEQ ID NO: 44250 - RNA, 32 nt, Human
agaaucugaagauagaaagggaagaaaaguaa

SEQ ID NO: 44251 - RNA, 20 nt, Human
agaaucugacacugucuucc

SEQ ID NO: 44252 - RNA, 32 nt, Human
agaaucugccugaaagggcuggagaggggcag

SEQ ID NO: 44253 - RNA, 32 nt, Human
agaaucugccuuucagcccuuccuucugguca

SEQ ID NO: 44254 - RNA, 32 nt, Human
agaaucuggaacaaagcaauguuaacaaagaa

SEQ ID NO: 44255 - RNA, 32 nt, Human
agaaucuggcacuuuacucauuuccuuugaua

SEQ ID NO: 44256 - RNA, 32 nt, Human
agaaucugggaagagaaauggagaauaagcag

SEQ ID NO: 44257 - RNA, 32 nt, Human
agaaucuggggucugcugaauuggcuucuuuu

SEQ ID NO: 44258 - RNA, 19 nt, Human
agaaucuggucuguuuccu

SEQ ID NO: 44259 - RNA, 32 nt, Human
agaaucuguacagcucuccguuuaugacaguu

SEQ ID NO: 44260 - RNA, 32 nt, Human
agaaucuguaccaauaccaugaaguucaggcu

SEQ ID NO: 44261 - RNA, 32 nt, Human
agaaucuucagagccacaggcuuuucaagaca

SEQ ID NO: 44262 - RNA, 32 nt, Human
agaaucuucauucaucucucucuuucagcgaa

SEQ ID NO: 44263 - RNA, 32 nt, Human
agaaucuuccaaaacuaauacagacuugcaua

SEQ ID NO: 44264 - RNA, 32 nt, Human
agaaucuuccacaugcuccaagccacaggucc

SEQ ID NO: 44265 - RNA, 32 nt, Human
agaaucuuucacaccccacuccugcuaucagu

SEQ ID NO: 44266 - RNA, 18 nt, Human
agaaucuuucauuuuccu

SEQ ID NO: 44267 - RNA, 17 nt, Human
agaaucuuucggucucc

SEQ ID NO: 44268 - RNA, 32 nt, Human
agaaucuuucuuuccauccugcauggcugaga

SEQ ID NO: 44269 - RNA, 32 nt, Human
agaaugaaagaguaaccugucccagaggagag

SEQ ID NO: 44270 - RNA, 32 nt, Human
agaaugaaagggcccagagaggguggugaccu

SEQ ID NO: 44271 - RNA, 31 nt, Human
agaaugaacaacacaaccggaagcgggauuc

SEQ ID NO: 44272 - RNA, 32 nt, Human
agaaugaacauguaaaguuacaaaaugaacuc

SEQ ID NO: 44273 - RNA, 32 nt, Human
agaaugaacugcuccucuguguguacuucaua

SEQ ID NO: 44274 - RNA, 32 nt, Human
agaaugaacuucugucugccucguggagccaa

SEQ ID NO: 44275 - RNA, 28 nt, Human
agaaugaagccaauucaaaaacuccuag

SEQ ID NO: 44276 - RNA, 32 nt, Human
agaaugaagggccuaccugagcacacaagccc

SEQ ID NO: 44277 - RNA, 32 nt, Human
agaaugaagggggugaggccugagggagggag

SEQ ID NO: 44278 - RNA, 32 nt, Human
agaaugaaguccaggaggagaagggcucauug

SEQ ID NO: 44279 - RNA, 22 nt, Human
agaaugaauuauguaucccuuc

SEQ ID NO: 44280 - RNA, 24 nt, Human
agaaugaauuauuuuaucuccucc

SEQ ID NO: 44281 - RNA, 32 nt, Human
agaaugaauucaaccugcucuguccauuaugu

SEQ ID NO: 44282 - RNA, 32 nt, Human
agaaugacaaaggaggcacucguucucuuuuc

SEQ ID NO: 44283 - RNA, 32 nt, Human
agaaugacaagauagauggagaggagggacuc

SEQ ID NO: 44284 - RNA, 32 nt, Human
agaaugacagaugcaauucuuccugccaugca

SEQ ID NO: 44285 - RNA, 32 nt, Human
agaaugacauacuagucugcaggaugaauuuc

SEQ ID NO: 44286 - RNA, 21 nt, Human
agaaugacaugaacccaggag

SEQ ID NO: 44287 - RNA, 32 nt, Human
agaaugaccaaaauggccucuaaaagauguua

SEQ ID NO: 44288 - RNA, 28 nt, Human
agaaugaccacagcccuggaaccugagg

SEQ ID NO: 44289 - RNA, 32 nt, Human
agaaugacccagagucaaggccaagucugcag

SEQ ID NO: 44290 - RNA, 28 nt, Human
agaaugacugaaaaagccccagagccac

SEQ ID NO: 44291 - RNA, 32 nt, Human
agaaugacugcguuuguaaaagaaggaccacc

SEQ ID NO: 44292 - RNA, 32 nt, Human
agaaugagacuccagcacagucauuccuccac

SEQ ID NO: 44293 - RNA, 32 nt, Human
agaaugagacuugccaccagggacauccaggc

SEQ ID NO: 44294 - RNA, 32 nt, Human
agaaugagacuuugcuugcauccaggcauuca

SEQ ID NO: 44295 - RNA, 32 nt, Human
agaaugagauggggauacaagcaugguggugu

SEQ ID NO: 44296 - RNA, 32 nt, Human
agaaugagaugggguuuugccguguuacccag

SEQ ID NO: 44297 - RNA, 32 nt, Human
agaaugagauucaccaguaggggagggagggg

SEQ ID NO: 44298 - RNA, 32 nt, Human
agaaugagcaggaaggagagccaagccuacag

SEQ ID NO: 44299 - RNA, 32 nt, Human
agaaugagccaguggcaugagaucagucugca

SEQ ID NO: 44300 - RNA, 32 nt, Human
agaaugagcgcagaggugacagacagccacug

SEQ ID NO: 44301 - RNA, 32 nt, Human
agaaugagcggguggagaaacuggaaugucgc

SEQ ID NO: 44302 - RNA, 32 nt, Human
agaaugagcuggagcuugagcuggagcaggac

SEQ ID NO: 44303 - RNA, 32 nt, Human
agaaugagcuguacacaucuugggacaaucug

SEQ ID NO: 44304 - RNA, 32 nt, Human
agaaugaggaagacagagggccuccaagugag

SEQ ID NO: 44305 - RNA, 32 nt, Human
agaaugaggagaaaaaggagaaaagggaaaag

SEQ ID NO: 44306 - RNA, 32 nt, Human
agaaugaggagaaagcaagaagagugaccccc

SEQ ID NO: 44307 - RNA, 32 nt, Human
agaaugaggagaagauuucauugcagagcgag

SEQ ID NO: 44308 - RNA, 32 nt, Human
agaaugaggagcacugguucugggcaggcagu

SEQ ID NO: 44309 - RNA, 23 nt, Human
agaaugaggcagacaccaggcca

SEQ ID NO: 44310 - RNA, 32 nt, Human
agaaugagguuagaagacugcagcuuggaguc

SEQ ID NO: 44311 - RNA, 32 nt, Human
agaaugaguuugacaaauugacagaaguaggc

SEQ ID NO: 44312 - RNA, 32 nt, Human
agaaugauauccaguaagcacauguuuauuca

SEQ ID NO: 44313 - RNA, 32 nt, Human
agaaugaucuuuacugaauuugcccuuuauaa

SEQ ID NO: 44314 - RNA, 21 nt, Human
agaaugaugggaacccgggag

SEQ ID NO: 44315 - RNA, 32 nt, Human
agaaugauucaaagcagaggaauuuauuaugc

SEQ ID NO: 44316 - RNA, 32 nt, Human
agaaugcaccacugcaguccagccuaggcaac

SEQ ID NO: 44317 - RNA, 31 nt, Human
agaaugcaguuuccaaguacggcucucaguu

SEQ ID NO: 44318 - RNA, 32 nt, Human
agaaugcauacaaacuccagggcugcucucuc

SEQ ID NO: 44319 - RNA, 32 nt, Human
agaaugcauauguaacccaugcacauaaccag

SEQ ID NO: 44320 - RNA, 32 nt, Human
agaaugcauucccugaaucugugccugcacug

SEQ ID NO: 44321 - RNA, 32 nt, Human
agaaugccacagucccccaacccuccacagag

SEQ ID NO: 44322 - RNA, 32 nt, Human
agaaugccacugcacuacagccugggcgacaa

SEQ ID NO: 44323 - RNA, 32 nt, Human
agaaugccacuuuuucuuuuauuucauaccaa

SEQ ID NO: 44324 - RNA, 22 nt, Human
agaaugccaggaagggggccug

SEQ ID NO: 44325 - RNA, 32 nt, Human
agaaugccaucuauuaaaaacaugguuaauau

SEQ ID NO: 44326 - RNA, 32 nt, Human
agaaugccauguugcugaucgugguaauaagc

SEQ ID NO: 44327 - RNA, 19 nt, Human
agaaugcccugcccugcga

SEQ ID NO: 44328 - RNA, 32 nt, Human
agaaugcccugccugccugccugccaggccaa

SEQ ID NO: 44329 - RNA, 32 nt, Human
agaaugccucuucuccuccaaaggaucacaac

SEQ ID NO: 44330 - RNA, 32 nt, Human
agaaugccuggcauuagcccuagaaaggaggu

SEQ ID NO: 44331 - RNA, 28 nt, Human
agaaugcggccacuccaaggaggccggg

SEQ ID NO: 44332 - RNA, 32 nt, Human
agaaugcucacugcaccacguucaagccugag

SEQ ID NO: 44333 - RNA, 32 nt, Human
agaaugcucauuuugacagaggcccaaauccu

SEQ ID NO: 44334 - RNA, 23 nt, Human
agaaugcucuucccuugcuguua

SEQ ID NO: 44335 - RNA, 21 nt, Human
agaaugcugagguuacaggca

SEQ ID NO: 44336 - RNA, 32 nt, Human
agaaugcugcaacuucucuucucucuggacuu

SEQ ID NO: 44337 - RNA, 21 nt, Human
agaaugcugcucgguccuccu

SEQ ID NO: 44338 - RNA, 28 nt, Human
agaaugcuggagccuuugcccuguuggg

SEQ ID NO: 44339 - RNA, 32 nt, Human
agaaugcuucugaguuagugggacucuguguc

SEQ ID NO: 44340 - RNA, 32 nt, Human
agaaugcuuuaauccuuucuuuagaaugcugu

SEQ ID NO: 44341 - RNA, 21 nt, Human
agaauggaacccagaguccug

SEQ ID NO: 44342 - RNA, 32 nt, Human
agaauggaaccucuggcauucuucccagaaag

SEQ ID NO: 44343 - RNA, 32 nt, Human
agaauggaacucaaggaaaucugugucagugg

SEQ ID NO: 44344 - RNA, 28 nt, Human
agaauggaauccguaaaacaaaggauuu

SEQ ID NO: 44345 - RNA, 21 nt, Human
agaauggacaccauccaggaa

SEQ ID NO: 44346 - RNA, 32 nt, Human
agaauggacagugugucuaaggaugugauuua

SEQ ID NO: 44347 - RNA, 32 nt, Human
agaauggacaucuuugcugaagacuucaaaau

SEQ ID NO: 44348 - RNA, 23 nt, Human
agaauggacccagggacaagaga

SEQ ID NO: 44349 - RNA, 32 nt, Human
agaauggagacagaaagccacugcugucagug

SEQ ID NO: 44350 - RNA, 32 nt, Human
agaauggagacggcauucuuggacuucacugg

SEQ ID NO: 44351 - RNA, 32 nt, Human
agaauggagcaguacaugggaaaggaggcaug

SEQ ID NO: 44352 - RNA, 32 nt, Human
agaauggaggcaggggacaagggaggcagugg

SEQ ID NO: 44353 - RNA, 32 nt, Human
agaauggagucuaaucccagcacuuugggagg

SEQ ID NO: 44354 - RNA, 32 nt, Human
agaauggaugaaauagacccaaagcugaauuc

SEQ ID NO: 44355 - RNA, 32 nt, Human
agaauggauggcuggggagagguggaggcuga

SEQ ID NO: 44356 - RNA, 32 nt, Human
agaauggcacuuccaaugggcgggcaccgcuc

SEQ ID NO: 44357 - RNA, 32 nt, Human
agaauggcagcaucuauuuccucuuuuguuug

SEQ ID NO: 44358 - RNA, 32 nt, Human
agaauggcaggagaggaugugggggcuccacc

SEQ ID NO: 44359 - RNA, 21 nt, Human
agaauggcaugaacccaggag

SEQ ID NO: 44360 - RNA, 21 nt, Human
agaauggcaugaacccgggag

SEQ ID NO: 44361 - RNA, 32 nt, Human
agaauggcgagugauugcuuuccuucagagaa

SEQ ID NO: 44362 - RNA, 21 nt, Human
agaauggcgugaacccaggag

SEQ ID NO: 44363 - RNA, 21 nt, Human
agaauggcgugaacccgggag

SEQ ID NO: 44364 - RNA, 21 nt, Human
agaauggcgugaaccuaggag

SEQ ID NO: 44365 - RNA, 32 nt, Human
agaauggcgugaacuugggagguggagcuuac

SEQ ID NO: 44366 - RNA, 21 nt, Human
agaauggcgugaauccaggag

SEQ ID NO: 44367 - RNA, 32 nt, Human
agaauggcgugagagcagcugaccucaucaaa

SEQ ID NO: 44368 - RNA, 32 nt, Human
agaauggcugcuugcccugccaaugcaauaau

SEQ ID NO: 44369 - RNA, 21 nt, Human
agaauggcuggaacccgggag

SEQ ID NO: 44370 - RNA, 32 nt, Human
agaauggcuucaggcuggggcugcagucaccu

SEQ ID NO: 44371 - RNA, 32 nt, Human
agaauggcuugaaccugggagguggagguugc

SEQ ID NO: 44372 - RNA, 32 nt, Human
agaaugggaaaaagacagggagagaaagcagg

SEQ ID NO: 44373 - RNA, 32 nt, Human
agaaugggaaagagaauguuccugguaaaacu

SEQ ID NO: 44374 - RNA, 32 nt, Human
agaaugggaagcugugcucugggcauuaucga

SEQ ID NO: 44375 - RNA, 32 nt, Human
agaaugggaaguuuccucuggguuggagccuc

SEQ ID NO: 44376 - RNA, 32 nt, Human
agaaugggcagacugaagacuguguccaaauu

SEQ ID NO: 44377 - RNA, 32 nt, Human
agaaugggcccagugggggcugggcaggccca

SEQ ID NO: 44378 - RNA, 32 nt, Human
agaaugggcugcagaagauuuagauguuuucc

SEQ ID NO: 44379 - RNA, 32 nt, Human
agaauggggaaaggguaacuuauugcagcagc

SEQ ID NO: 44380 - RNA, 32 nt, Human
agaauggggaauggagaggugggcagggguuc

SEQ ID NO: 44381 - RNA, 32 nt, Human
agaauggggaggcaagaucucagggacaccaa

SEQ ID NO: 44382 - RNA, 32 nt, Human
agaauggggauaauuaugucccagggguauau

SEQ ID NO: 44383 - RNA, 32 nt, Human
agaaugggggacaaggguggcuuuguaaauag

SEQ ID NO: 44384 - RNA, 32 nt, Human
agaauggggugagaggagacaugaggaaagac

SEQ ID NO: 44385 - RNA, 18 nt, Human
agaauggguuuccaggaa

SEQ ID NO: 44386 - RNA, 21 nt, Human
agaaugguaugaauccaggag

SEQ ID NO: 44387 - RNA, 28 nt, Human
agaauggugagguuggcaagcggcggag

SEQ ID NO: 44388 - RNA, 26 nt, Human
agaauggugccaccacucaagcaaca

SEQ ID NO: 44389 - RNA, 21 nt, Human
agaauggugcgaacccgggag

SEQ ID NO: 44390 - RNA, 32 nt, Human
agaauggugcggagcuugcagugagccgagau

SEQ ID NO: 44391 - RNA, 32 nt, Human
agaaugguggcagaaugagugagcaagcagau

SEQ ID NO: 44392 - RNA, 22 nt, Human
agaaugguguaaaacccaggag

SEQ ID NO: 44393 - RNA, 32 nt, Human
agaaugguguaaaacccaggaggcagagcuug

SEQ ID NO: 44394 - RNA, 21 nt, Human
agaauggugugaacccaggag

SEQ ID NO: 44395 - RNA, 20 nt, Human
agaauggugugaacccggga

SEQ ID NO: 44396 - RNA, 21 nt, Human
agaauggugugaacccgggag

SEQ ID NO: 44397 - RNA, 21 nt, Human
agaaugguguggacccaggag

SEQ ID NO: 44398 - RNA, 32 nt, Human
agaaugguguggccaccuccucccuuucaagc

SEQ ID NO: 44399 - RNA, 32 nt, Human
agaaugguugggaaugucaucaugagcagccu

SEQ ID NO: 44400 - RNA, 32 nt, Human
agaaugguuugggguaucacacaaaacaccag

SEQ ID NO: 44401 - RNA, 32 nt, Human
agaauguaagguauaucauucuaaagauagag

SEQ ID NO: 44402 - RNA, 32 nt, Human
agaauguaaugaaagaccuguacuggugccgg

SEQ ID NO: 44403 - RNA, 32 nt, Human
agaauguacacuuggccaggugcaguggcuca

SEQ ID NO: 44404 - RNA, 31 nt, Human
agaaugucaauaaauuugcuuuuugagaugu

SEQ ID NO: 44405 - RNA, 32 nt, Human
agaaugucaggccacuuuggggacuuggcaaa

SEQ ID NO: 44406 - RNA, 32 nt, Human
agaaugucaguucuguuuuaaguaacagaauu

SEQ ID NO: 44407 - RNA, 32 nt, Human
agaauguccacaggccuggccugggggcugug

SEQ ID NO: 44408 - RNA, 28 nt, Human
agaaugucccguuuucgaggcugcagua

SEQ ID NO: 44409 - RNA, 32 nt, Human
agaaugucucuuccuugugcuaccacaacccu

SEQ ID NO: 44410 - RNA, 32 nt, Human
agaaugucuguuucuaacaaauccacaaauag

SEQ ID NO: 44411 - RNA, 32 nt, Human
agaaugucuuucuccucuccuaagucuuugcu

SEQ ID NO: 44412 - RNA, 32 nt, Human
agaaugucuuucugcauauuacugaacagaau

SEQ ID NO: 44413 - RNA, 32 nt, Human
agaaugugaaauucugaccaccuuuuggcuuu

SEQ ID NO: 44414 - RNA, 32 nt, Human
agaaugugagacaauuuucuauugaauacgau

SEQ ID NO: 44415 - RNA, 32 nt, Human
agaaugugagacaauuuucuauugaauaugau

SEQ ID NO: 44416 - RNA, 32 nt, Human
agaaugugaggucuucuuccagaagcuucugc

SEQ ID NO: 44417 - RNA, 23 nt, Human
agaaugugccaagagucccgcca

SEQ ID NO: 44418 - RNA, 32 nt, Human
agaaugugccacuggacucccagccuggguga

SEQ ID NO: 44419 - RNA, 32 nt, Human
agaaugugcuaaugugauuaccucauauuagc

SEQ ID NO: 44420 - RNA, 32 nt, Human
agaaugugcuuugguguauugagucugaugag

SEQ ID NO: 44421 - RNA, 32 nt, Human
agaauguggcaaagccuuuaaccaguuuucaa

SEQ ID NO: 44422 - RNA, 32 nt, Human
agaauguggcuucauccucuuccucuguggga

SEQ ID NO: 44423 - RNA, 29 nt, Human
agaaugugucugucuuugccuggugucuu

SEQ ID NO: 44424 - RNA, 28 nt, Human
agaaugugugggcgaacauccugucacu

SEQ ID NO: 44425 - RNA, 32 nt, Human
agaauguuauuguugacucucucccaagugcc

SEQ ID NO: 44426 - RNA, 32 nt, Human
agaauguucuuuuggccacugugaagccucag

SEQ ID NO: 44427 - RNA, 32 nt, Human
agaauguugacacacaaggcuuggggauuaga

SEQ ID NO: 44428 - RNA, 32 nt, Human
agaauguugcaccugcucuaguaccauagguc

SEQ ID NO: 44429 - RNA, 32 nt, Human
agaauuaaaagcuucccaaaaaccaaucagaa

SEQ ID NO: 44430 - RNA, 32 nt, Human
agaauuaaaaggcaguugcuguggaaacaguu

SEQ ID NO: 44431 - RNA, 32 nt, Human
agaauuaaaggccauggaugaagaugggcuug

SEQ ID NO: 44432 - RNA, 32 nt, Human
agaauuaacuccauuccagucucugcauguaa

SEQ ID NO: 44433 - RNA, 26 nt, Human
agaauuaacugaucugaagugacugg

SEQ ID NO: 44434 - RNA, 32 nt, Human
agaauuaacuuagucuguaauguggcuucaaa

SEQ ID NO: 44435 - RNA, 32 nt, Human
agaauuacacaagugugacuauacaaauugua

SEQ ID NO: 44436 - RNA, 32 nt, Human
agaauuacagaagccccugcccagugaacaga

SEQ ID NO: 44437 - RNA, 32 nt, Human
agaauuacaguacacaucuccagaauccauaa

SEQ ID NO: 44438 - RNA, 32 nt, Human
agaauuacugcacugggcagacuaaguuggau

SEQ ID NO: 44439 - RNA, 21 nt, Human
agaauuacuugaacccaggag

SEQ ID NO: 44440 - RNA, 21 nt, Human
agaauuacuugagcccaggag

SEQ ID NO: 44441 - RNA, 32 nt, Human
agaauuagcaugugcguagugaagagcacagg

SEQ ID NO: 44442 - RNA, 32 nt, Human
agaauuagccugggcaacagagcaagacucug

SEQ ID NO: 44443 - RNA, 31 nt, Human
agaauuaggcacuuggaacguuuuugcuggc

SEQ ID NO: 44444 - RNA, 31 nt, Human
agaauuaggcacuuggagcguuuuugcuggc

SEQ ID NO: 44445 - RNA, 32 nt, Human
agaauuaggggccuugaaaauaugacaaacuc

SEQ ID NO: 44446 - RNA, 32 nt, Human
agaauuauagagccauggaaggucaggcuaca

SEQ ID NO: 44447 - RNA, 32 nt, Human
agaauuauagucuuuggugcucuguuuucaau

SEQ ID NO: 44448 - RNA, 32 nt, Human
agaauuaugucuguaaguuggaagagaauuaa

SEQ ID NO: 44449 - RNA, 32 nt, Human
agaauuauguuuaguuaggaaaaaggaaaguc

SEQ ID NO: 44450 - RNA, 32 nt, Human
agaauuauuugaaccugggaggcggagguugc

SEQ ID NO: 44451 - RNA, 32 nt, Human
agaauucacauaugaacuauuucuaggcuuug

SEQ ID NO: 44452 - RNA, 32 nt, Human
agaauucacccaggcuccagcuagaucaucag

SEQ ID NO: 44453 - RNA, 32 nt, Human
agaauucacuguaauggaaucuugccucuaau

SEQ ID NO: 44454 - RNA, 32 nt, Human
agaauucagaacuuggguuucaauuguagaau

SEQ ID NO: 44455 - RNA, 32 nt, Human
agaauucagagccaauaugugcuugcuuauua

SEQ ID NO: 44456 - RNA, 32 nt, Human
agaauucagcagcucaacaguaaugaaaguga

SEQ ID NO: 44457 - RNA, 32 nt, Human
agaauucaucugggacuggcuuuugcuuuagg

SEQ ID NO: 44458 - RNA, 32 nt, Human
agaauucauggacacggcccccagucaggggg

SEQ ID NO: 44459 - RNA, 19 nt, Human
agaauuccaaaaacccuga

SEQ ID NO: 44460 - RNA, 32 nt, Human
agaauuccaagaacuguuacauauaaucauau

SEQ ID NO: 44461 - RNA, 32 nt, Human
agaauuccagaaggaggccagggcauaaguug

SEQ ID NO: 44462 - RNA, 20 nt, Human
agaauuccaugaacccagga

SEQ ID NO: 44463 - RNA, 32 nt, Human
agaauuccgagccagcccauuucuagaauguc

SEQ ID NO: 44464 - RNA, 32 nt, Human
agaauuccucccuggauggaagugguccuuau

SEQ ID NO: 44465 - RNA, 32 nt, Human
agaauuccuguguggcccuccugucuggagug

SEQ ID NO: 44466 - RNA, 32 nt, Human
agaauuccuuuaaucauugcugcccaggggcu

SEQ ID NO: 44467 - RNA, 32 nt, Human
agaauucgguggggugaaugccacuccaaaug

SEQ ID NO: 44468 - RNA, 32 nt, Human
agaauucuaggcagcaccuuagggagggacug

SEQ ID NO: 44469 - RNA, 32 nt, Human
agaauucucauuggaagaaaugacaggaaagc

SEQ ID NO: 44470 - RNA, 32 nt, Human
agaauucucccaucgcacaccugggggcaagu

SEQ ID NO: 44471 - RNA, 32 nt, Human
agaauucucugcacuccucucugcuucacauu

SEQ ID NO: 44472 - RNA, 32 nt, Human
agaauucugaguuuuucaaacacuagucuaga

SEQ ID NO: 44473 - RNA, 32 nt, Human
agaauucugggcaagucacccaggaugcuggg

SEQ ID NO: 44474 - RNA, 32 nt, Human
agaauucuuaccaucuuacuccugccucccca

SEQ ID NO: 44475 - RNA, 32 nt, Human
agaauucuuaucucuagcuugguuuccacaug

SEQ ID NO: 44476 - RNA, 32 nt, Human
agaauucuucauccuccacgguucacuagcuc

SEQ ID NO: 44477 - RNA, 21 nt, Human
agaauucuuugaacccaggag

SEQ ID NO: 44478 - RNA, 32 nt, Human
agaauugaaagaagaacuugaaaccagaguga

SEQ ID NO: 44479 - RNA, 32 nt, Human
agaauugaaagagaccugagguucauccaguc

SEQ ID NO: 44480 - RNA, 32 nt, Human
agaauugaaaucaagacuauuucuuuggaaua

SEQ ID NO: 44481 - RNA, 32 nt, Human
agaauugaacccaggagguggagguugcagug

SEQ ID NO: 44482 - RNA, 32 nt, Human
agaauugacacccaugagaguguuuuguggua

SEQ ID NO: 44483 - RNA, 32 nt, Human
agaauugacggcucuggacccaggacagacag

SEQ ID NO: 44484 - RNA, 18 nt, Human
agaauugagacucaggag

SEQ ID NO: 44485 - RNA, 32 nt, Human
agaauugagcccagauaugacauugugcaugc

SEQ ID NO: 44486 - RNA, 32 nt, Human
agaauugaggaaaugcaaagugaagaauucua

SEQ ID NO: 44487 - RNA, 32 nt, Human
agaauugaggagggguuguguuaaccaauuag

SEQ ID NO: 44488 - RNA, 32 nt, Human
agaauugagggaagagagagaccuucuuauau

SEQ ID NO: 44489 - RNA, 32 nt, Human
agaauugaguccauuuucuagcugccuuuauu

SEQ ID NO: 44490 - RNA, 32 nt, Human
agaauugauaaauguguacaacaggguccuuu

SEQ ID NO: 44491 - RNA, 32 nt, Human
agaauugauugcucagccgagugugggaacag

SEQ ID NO: 44492 - RNA, 32 nt, Human
agaauugcacacaguuuccaggaauaucuuuu

SEQ ID NO: 44493 - RNA, 31 nt, Human
agaauugcacuuuccugcuugucaugacuuu

SEQ ID NO: 44494 - RNA, 32 nt, Human
agaauugccuagauuccuucucucaucaacgg

SEQ ID NO: 44495 - RNA, 21 nt, Human
agaauugccugaacccaggag

SEQ ID NO: 44496 - RNA, 21 nt, Human
agaauugccugagcccaggag

SEQ ID NO: 44497 - RNA, 32 nt, Human
agaauugcgcugcuucagccccaucuccagcc

SEQ ID NO: 44498 - RNA, 21 nt, Human
agaauugcgugaauccaggag

SEQ ID NO: 44499 - RNA, 21 nt, Human
agaauugcugaaacccgggag

SEQ ID NO: 44500 - RNA, 21 nt, Human
agaauugcuggaacccaggag

SEQ ID NO: 44501 - RNA, 32 nt, Human
agaauugcuugaacagggaggcagagguugca

SEQ ID NO: 44502 - RNA, 21 nt, Human
agaauugcuugaacccaggag

SEQ ID NO: 44503 - RNA, 32 nt, Human
agaauugcuugaaccugggaggaggagguugc

SEQ ID NO: 44504 - RNA, 32 nt, Human
agaauugcuugaaccugggaggcggaaguugc

SEQ ID NO: 44505 - RNA, 32 nt, Human
agaauugcuugaaccugggaggcggagguugc

SEQ ID NO: 44506 - RNA, 32 nt, Human
agaauugcuugaaccugggaggcggagguugu

SEQ ID NO: 44507 - RNA, 32 nt, Human
agaauugcuugaaccugggagguggagguugc

SEQ ID NO: 44508 - RNA, 32 nt, Human
agaauugcuugacccugggagguggagguggc

SEQ ID NO: 44509 - RNA, 21 nt, Human
agaauugcuugagcccaggag

SEQ ID NO: 44510 - RNA, 32 nt, Human
agaauugcuugagccugggaggcagagauugc

SEQ ID NO: 44511 - RNA, 32 nt, Human
agaauugcuugagccugggagguggagguugc

SEQ ID NO: 44512 - RNA, 32 nt, Human
agaauugcuugagccugggagguggagguuuc

SEQ ID NO: 44513 - RNA, 32 nt, Human
agaauugcuuggaccuaggagguggagguugc

SEQ ID NO: 44514 - RNA, 21 nt, Human
agaauugcuugggcccaggag

SEQ ID NO: 44515 - RNA, 32 nt, Human
agaauugcuuugaacccgggaggcagagguug

SEQ ID NO: 44516 - RNA, 32 nt, Human
agaauugcuuuguggcugggugcagugguuca

SEQ ID NO: 44517 - RNA, 32 nt, Human
agaauuggaagaggaggcagaagaggagcagc

SEQ ID NO: 44518 - RNA, 32 nt, Human
agaauuggagagcaguaaaagacugaagauaa

SEQ ID NO: 44519 - RNA, 32 nt, Human
agaauuggauccuaggugcuuagcccugcaau

SEQ ID NO: 44520 - RNA, 32 nt, Human
agaauuggaucuggcagccccuccucaggaag

SEQ ID NO: 44521 - RNA, 32 nt, Human
agaauuggcccagccucagauccugucuuuag

SEQ ID NO: 44522 - RNA, 32 nt, Human
agaauuggcucaauaaagauuucaagauccuc

SEQ ID NO: 44523 - RNA, 32 nt, Human
agaauuggcuuguauaguuauaacaaccacag

SEQ ID NO: 44524 - RNA, 32 nt, Human
agaauugggcugggaccucucuccccaacugc

SEQ ID NO: 44525 - RNA, 32 nt, Human
agaauugggcugggguuucuccuucuuuucag

SEQ ID NO: 44526 - RNA, 32 nt, Human
agaauuggguuauauuugaaauugcugauacu

SEQ ID NO: 44527 - RNA, 32 nt, Human
agaauuggguucugucaugaagggaguagcac

SEQ ID NO: 44528 - RNA, 32 nt, Human
agaauugguggucugggcuggauuccagagaa

SEQ ID NO: 44529 - RNA, 21 nt, Human
agaauugguugaacccaggag

SEQ ID NO: 44530 - RNA, 32 nt, Human
agaauuguaaacagaacaaaaugagugaugug

SEQ ID NO: 44531 - RNA, 20 nt, Human
agaauuguaaacucuaggaa

SEQ ID NO: 44532 - RNA, 32 nt, Human
agaauuguagcaccaugaaacagaccucuggg

SEQ ID NO: 44533 - RNA, 32 nt, Human
agaauugucgugcuuugagaaaacaccugagg

SEQ ID NO: 44534 - RNA, 32 nt, Human
agaauugugccuugcauauuacuugagcuuaa

SEQ ID NO: 44535 - RNA, 32 nt, Human
agaauugugugaauguucugaucacuaccacc

SEQ ID NO: 44536 - RNA, 32 nt, Human
agaauuguuccugccuuuagcuuuucagaacu

SEQ ID NO: 44537 - RNA, 32 nt, Human
agaauuguuguugggcugggcgcaguggaucg

SEQ ID NO: 44538 - RNA, 32 nt, Human
agaauuguuugaaccugggaggcggaggcugc

SEQ ID NO: 44539 - RNA, 32 nt, Human
agaauuguuuuuagaaauuuauucuuaucuua

SEQ ID NO: 44540 - RNA, 32 nt, Human
agaauuuagagagugcauuggugaggauucuu

SEQ ID NO: 44541 - RNA, 18 nt, Human
agaauuuagcuuccagga

SEQ ID NO: 44542 - RNA, 32 nt, Human
agaauuuaguuuguacucaguggacagugcug

SEQ ID NO: 44543 - RNA, 32 nt, Human
agaauuuauguucaccuuuauuacaauuucaa

SEQ ID NO: 44544 - RNA, 32 nt, Human
agaauuucauucuuucaugcucuguaccucaa

SEQ ID NO: 44545 - RNA, 32 nt, Human
agaauuucauucuuugucauuauaauccaaaa

SEQ ID NO: 44546 - RNA, 19 nt, Human
agaauuuccccaucuuucu

SEQ ID NO: 44547 - RNA, 32 nt, Human
agaauuuccugcaugcucacacagcccuuccc

SEQ ID NO: 44548 - RNA, 32 nt, Human
agaauuucgagaccagccuggccaacauggug

SEQ ID NO: 44549 - RNA, 32 nt, Human
agaauuucucucugucgcccaggcuggaguac

SEQ ID NO: 44550 - RNA, 32 nt, Human
agaauuucugaaagagaaagagaaguagaugg

SEQ ID NO: 44551 - RNA, 32 nt, Human
agaauuucuggaaguggucacuuuaaaaauua

SEQ ID NO: 44552 - RNA, 32 nt, Human
agaauuugaagucacugucugaggagcuggug

SEQ ID NO: 44553 - RNA, 32 nt, Human
agaauuugaggaacuggaugugacugucauug

SEQ ID NO: 44554 - RNA, 32 nt, Human
agaauuugccaauauuuuucaaggagaggcuu

SEQ ID NO: 44555 - RNA, 32 nt, Human
agaauuuggagaugguucugcccacucugauu

SEQ ID NO: 44556 - RNA, 32 nt, Human
agaauuuggagaugguucugcccacucugguu

SEQ ID NO: 44557 - RNA, 18 nt, Human
agaauuuggagucuucuu

SEQ ID NO: 44558 - RNA, 32 nt, Human
agaauuuggcuuaauucucacuccagguaagu

SEQ ID NO: 44559 - RNA, 32 nt, Human
agaauuuggggaagaagucacauaucaguccu

SEQ ID NO: 44560 - RNA, 32 nt, Human
agaauuugugaacccacaagaacauuaauguc

SEQ ID NO: 44561 - RNA, 32 nt, Human
agaauuuuaaauacaauaaacacuucauauua

SEQ ID NO: 44562 - RNA, 19 nt, Human
agaauuuuaucuucuuccu

SEQ ID NO: 44563 - RNA, 32 nt, Human
agaauuuucacuguagugucauccccucacag

SEQ ID NO: 44564 - RNA, 32 nt, Human
agaauuuuccaaagucaaugggcuuagcauga

SEQ ID NO: 44565 - RNA, 21 nt, Human
agaauuuucuccccgucuucc

SEQ ID NO: 44566 - RNA, 32 nt, Human
agaauuuucuguuuuaaugcauguuauacuuu

SEQ ID NO: 44567 - RNA, 19 nt, Human
agaauuuugaaaaucccga

SEQ ID NO: 44568 - RNA, 32 nt, Human
agaauuuugcagaaucuaagagucacaccucu

SEQ ID NO: 44569 - RNA, 32 nt, Human
agaauuuuuaaaacaaaaucucucauuccagc

SEQ ID NO: 44570 - RNA, 18 nt, Human
agaauuuuuagucuucuu

SEQ ID NO: 44571 - RNA, 20 nt, Human
agacaaaaagacagacaagg

SEQ ID NO: 44572 - RNA, 32 nt, Human
agacaaaaauaagagccugaagcaaugcuuac

SEQ ID NO: 44573 - RNA, 32 nt, Human
agacaaaaaugaaagagacacaggguguauau

SEQ ID NO: 44574 - RNA, 32 nt, Human
agacaaaaaugagaaccugaagcaaugcuuac

SEQ ID NO: 44575 - RNA, 32 nt, Human
agacaaaaaugagagccugaagcaaugcuuac

SEQ ID NO: 44576 - RNA, 32 nt, Human
agacaaaaaugagggccugaagcaaugcuuac

SEQ ID NO: 44577 - RNA, 32 nt, Human
agacaaaaauuagcugggcguggugguacaug

SEQ ID NO: 44578 - RNA, 32 nt, Human
agacaaaacuccagcacauaaaggacaaugac

SEQ ID NO: 44579 - RNA, 32 nt, Human
agacaaaagagaaagaugacaaguaggacuua

SEQ ID NO: 44580 - RNA, 32 nt, Human
agacaaaaggaccugggucugcauuucccaaa

SEQ ID NO: 44581 - RNA, 32 nt, Human
agacaaaauaaagguuaaagagggcauaaagg

SEQ ID NO: 44582 - RNA, 32 nt, Human
agacaaaauagaggagagaaagagagcaugag

SEQ ID NO: 44583 - RNA, 32 nt, Human
agacaaacaaaacgcacaaagccuaugagcuc

SEQ ID NO: 44584 - RNA, 23 nt, Human
agacaaaccaaucaaccacgaca

SEQ ID NO: 44585 - RNA, 32 nt, Human
agacaaacccuugaugcuccuugcucggcguu

SEQ ID NO: 44586 - RNA, 32 nt, Human
agacaaacccuugugcaccuuucucccaccuc

SEQ ID NO: 44587 - RNA, 32 nt, Human
agacaaacgagaaaauccuggcuacccaaguc

SEQ ID NO: 44588 - RNA, 32 nt, Human
agacaaagacaccugaggacuaugcugacucg

SEQ ID NO: 44589 - RNA, 32 nt, Human
agacaaagagggugaggucuucaugagucucc

SEQ ID NO: 44590 - RNA, 32 nt, Human
agacaaagaggguggaaaacucugaauuagcc

SEQ ID NO: 44591 - RNA, 32 nt, Human
agacaaagaucauuccacucagccugggacga

SEQ ID NO: 44592 - RNA, 32 nt, Human
agacaaagcaaagccacauuuugcauuagaca

SEQ ID NO: 44593 - RNA, 32 nt, Human
agacaaagcaguuccagguggucaagggcagu

SEQ ID NO: 44594 - RNA, 32 nt, Human
agacaaagccgcgguaaugaauggagcguccg

SEQ ID NO: 44595 - RNA, 24 nt, Human
agacaaagcugauggcacuauguu

SEQ ID NO: 44596 - RNA, 32 nt, Human
agacaaagcugcagagcacauuccaugccaga

SEQ ID NO: 44597 - RNA, 32 nt, Human
agacaaagcugugggagccaagaauaagacag

SEQ ID NO: 44598 - RNA, 32 nt, Human
agacaaaggccaccaucuuccagaccccagaa

SEQ ID NO: 44599 - RNA, 24 nt, Human
agacaaaggcuaaaaaacaugcca

SEQ ID NO: 44600 - RNA, 32 nt, Human
agacaaaggcucuacacauacugcaugcucag

SEQ ID NO: 44601 - RNA, 32 nt, Human
agacaaagggcacccuuguggcuuugggaccu

SEQ ID NO: 44602 - RNA, 21 nt, Human
agacaaaguaguauuauguug

SEQ ID NO: 44603 - RNA, 21 nt, Human
agacaaagucucacucuguug

SEQ ID NO: 44604 - RNA, 21 nt, Human
agacaaagucucacuguguca

SEQ ID NO: 44605 - RNA, 21 nt, Human
agacaaagucucgcucuguca

SEQ ID NO: 44606 - RNA, 21 nt, Human
agacaaagucuuguucuguug

SEQ ID NO: 44607 - RNA, 32 nt, Human
agacaaaguucagauagcugcuaaugaagaga

SEQ ID NO: 44608 - RNA, 32 nt, Human
agacaaauaaacagcagaagcaaauggucacc

SEQ ID NO: 44609 - RNA, 32 nt, Human
agacaaauaauuuugggagcugccuuugcaaa

SEQ ID NO: 44610 - RNA, 22 nt, Human
agacaaauacucuagauuccac

SEQ ID NO: 44611 - RNA, 32 nt, Human
agacaaauagugaaccagagagccagaagccc

SEQ ID NO: 44612 - RNA, 20 nt, Human
agacaaaucuuacuaucuug

SEQ ID NO: 44613 - RNA, 32 nt, Human
agacaaauggauucccuuagaaguaagauuuc

SEQ ID NO: 44614 - RNA, 32 nt, Human
agacaacaagcagacucaaccaggccucuuug

SEQ ID NO: 44615 - RNA, 31 nt, Human
agacaacacaacacaggaggggauaaguacc

SEQ ID NO: 44616 - RNA, 32 nt, Human
agacaacacuucagaagcauacuacagccugc

SEQ ID NO: 44617 - RNA, 32 nt, Human
agacaacagagugagacccccaucucuccaaa

SEQ ID NO: 44618 - RNA, 32 nt, Human
agacaacagauugagguuagaggaucaguagg

SEQ ID NO: 44619 - RNA, 32 nt, Human
agacaacauggugaaaccuugucucuaugaaa

SEQ ID NO: 44620 - RNA, 32 nt, Human
agacaacauuguaagagagaugagcacuucua

SEQ ID NO: 44621 - RNA, 31 nt, Human
agacaaccaggguccaucaguagagggaacc

SEQ ID NO: 44622 - RNA, 32 nt, Human
agacaaccucauucagccucuugggcuccuuu

SEQ ID NO: 44623 - RNA, 32 nt, Human
agacaaccuggggaugccuguccccuaccugc

SEQ ID NO: 44624 - RNA, 32 nt, Human
agacaacuccuccaaaagaugaaccacauucu

SEQ ID NO: 44625 - RNA, 21 nt, Human
agacaacuguugaaaacucca

SEQ ID NO: 44626 - RNA, 32 nt, Human
agacaacuucccucauuccaucaucaccaucu

SEQ ID NO: 44627 - RNA, 21 nt, Human
agacaagaaagggugcuuuca

SEQ ID NO: 44628 - RNA, 32 nt, Human
agacaagaagugagacuggagggaaaggguag

SEQ ID NO: 44629 - RNA, 32 nt, Human
agacaagaauuugaccuagagaacaaauucaa

SEQ ID NO: 44630 - RNA, 32 nt, Human
agacaagaauuuuccauucuguuuucauaacu

SEQ ID NO: 44631 - RNA, 32 nt, Human
agacaagacacauggacccugccuuuauggua

SEQ ID NO: 44632 - RNA, 32 nt, Human
agacaagacaucugaaaagcucuccugcagca

SEQ ID NO: 44633 - RNA, 32 nt, Human
agacaagaccagccuggccaacauggugaaac

SEQ ID NO: 44634 - RNA, 32 nt, Human
agacaagaccagggcuggagcugggguggaag

SEQ ID NO: 44635 - RNA, 32 nt, Human
agacaagacuuugacaggggugccuaauuuuu

SEQ ID NO: 44636 - RNA, 32 nt, Human
agacaagagaaauuuggccagauggggaaggu

SEQ ID NO: 44637 - RNA, 23 nt, Human
agacaagagaguagccucuccag

SEQ ID NO: 44638 - RNA, 32 nt, Human
agacaagaggagaaggagagccugggacggga

SEQ ID NO: 44639 - RNA, 32 nt, Human
agacaagaggcggcuccccagccuggguuucc

SEQ ID NO: 44640 - RNA, 22 nt, Human
agacaagaguuucaccauguug

SEQ ID NO: 44641 - RNA, 20 nt, Human
agacaagaguuucucucugu

SEQ ID NO: 44642 - RNA, 32 nt, Human
agacaagauggcuaggccaucaccaaccaacg

SEQ ID NO: 44643 - RNA, 32 nt, Human
agacaagauuccugggcccugccuuccauaca

SEQ ID NO: 44644 - RNA, 32 nt, Human
agacaagcagaauuauuaauguagguaaugcc

SEQ ID NO: 44645 - RNA, 32 nt, Human
agacaagcagguggaggcauccagugauuucu

SEQ ID NO: 44646 - RNA, 32 nt, Human
agacaagcguguuuggcagugccaggccucuu

SEQ ID NO: 44647 - RNA, 32 nt, Human
agacaagcucugcccagcuacauugagauccc

SEQ ID NO: 44648 - RNA, 32 nt, Human
agacaaggaaacugaggccagagggaggagag

SEQ ID NO: 44649 - RNA, 32 nt, Human
agacaaggaaacugaggcucagggaagccaag

SEQ ID NO: 44650 - RNA, 32 nt, Human
agacaaggaagcagggccagcagugagacuau

SEQ ID NO: 44651 - RNA, 32 nt, Human
agacaaggaccagcuuuggggccuccaccugc

SEQ ID NO: 44652 - RNA, 32 nt, Human
agacaaggacuuugauccuguccccuuuggca

SEQ ID NO: 44653 - RNA, 32 nt, Human
agacaaggagaaaccugaaagcagcccaguua

SEQ ID NO: 44654 - RNA, 32 nt, Human
agacaaggauggacuguagcagugaguuggca

SEQ ID NO: 44655 - RNA, 32 nt, Human
agacaaggcucuggacagccgguccagccaca

SEQ ID NO: 44656 - RNA, 32 nt, Human
agacaaggcugcagucaaaugggaggguccag

SEQ ID NO: 44657 - RNA, 32 nt, Human
agacaaggcuucagaagaagugucuaaaucac

SEQ ID NO: 44658 - RNA, 32 nt, Human
agacaagggaaagcaggugagggagagaguag

SEQ ID NO: 44659 - RNA, 23 nt, Human
agacaagggaaauguagacuuca

SEQ ID NO: 44660 - RNA, 22 nt, Human
agacaagggucuuaccauguug

SEQ ID NO: 44661 - RNA, 32 nt, Human
agacaagggugguggccgcucuggaggugccu

SEQ ID NO: 44662 - RNA, 21 nt, Human
agacaaggucucacuacauug

SEQ ID NO: 44663 - RNA, 19 nt, Human
agacaaggucucacuaugu

SEQ ID NO: 44664 - RNA, 32 nt, Human
agacaaggucucacuauguggcccaggcuggu

SEQ ID NO: 44665 - RNA, 21 nt, Human
agacaaggucucacucuguca

SEQ ID NO: 44666 - RNA, 21 nt, Human
agacaaggucucgccauguug

SEQ ID NO: 44667 - RNA, 21 nt, Human
agacaaggucucgcuaugcug

SEQ ID NO: 44668 - RNA, 32 nt, Human
agacaaggugcaaagcgaaacugguugcucaa

SEQ ID NO: 44669 - RNA, 21 nt, Human
agacaagguuucaccauauug

SEQ ID NO: 44670 - RNA, 25 nt, Human
agacaagguuucaccauauuggcca

SEQ ID NO: 44671 - RNA, 20 nt, Human
agacaagguuucaccauguu

SEQ ID NO: 44672 - RNA, 21 nt, Human
agacaagguuucaccauguua

SEQ ID NO: 44673 - RNA, 21 nt, Human
agacaagguuucaccauguug

SEQ ID NO: 44674 - RNA, 21 nt, Human
agacaagguuucacccuguug

SEQ ID NO: 44675 - RNA, 21 nt, Human
agacaagguuucacuauguug

SEQ ID NO: 44676 - RNA, 21 nt, Human
agacaagguuucgccauguug

SEQ ID NO: 44677 - RNA, 25 nt, Human
agacaagguuucgccauguuggcca

SEQ ID NO: 44678 - RNA, 21 nt, Human
agacaagguuucgcuauguug

SEQ ID NO: 44679 - RNA, 21 nt, Human
agacaagguuuugccauguug

SEQ ID NO: 44680 - RNA, 32 nt, Human
agacaaguccccuugccucccucuacugagag

SEQ ID NO: 44681 - RNA, 32 nt, Human
agacaagugcagcugcugugccugugccagga

SEQ ID NO: 44682 - RNA, 22 nt, Human
agacaagugugggcaacacagc

SEQ ID NO: 44683 - RNA, 32 nt, Human
agacaagugugggcaacacagcaagaccccau

SEQ ID NO: 44684 - RNA, 32 nt, Human
agacaaguuccggcaagggagcagggaagaug

SEQ ID NO: 44685 - RNA, 32 nt, Human
agacaauaaggguuuuuaguuuuaucuacucu

SEQ ID NO: 44686 - RNA, 32 nt, Human
agacaauacccuucaaacuuugagaguuuaca

SEQ ID NO: 44687 - RNA, 32 nt, Human
agacaauacugugccuagccugugcaagggau

SEQ ID NO: 44688 - RNA, 32 nt, Human
agacaauaggaagagaugucagcucugcucuc

SEQ ID NO: 44689 - RNA, 32 nt, Human
agacaauaugggauggucggaggcagaggugu

SEQ ID NO: 44690 - RNA, 32 nt, Human
agacaauggaaacuguaccauacacauuggaa

SEQ ID NO: 44691 - RNA, 32 nt, Human
agacaaugggagacggcuuugaugaguggaga

SEQ ID NO: 44692 - RNA, 30 nt, Human
agacaaugugcccagugcccgcugcagcua

SEQ ID NO: 44693 - RNA, 32 nt, Human
agacaauguugacuaaugaauuaagauacauu

SEQ ID NO: 44694 - RNA, 32 nt, Human
agacaauucaagaucagcccugaaaaggggua

SEQ ID NO: 44695 - RNA, 32 nt, Human
agacaauucuucuuccaauguggcucagggaa

SEQ ID NO: 44696 - RNA, 32 nt, Human
agacaauucuucuuccaguguugcucagggaa

SEQ ID NO: 44697 - RNA, 32 nt, Human
agacaauucuuucucacuccugcccagagggu

SEQ ID NO: 44698 - RNA, 32 nt, Human
agacaauugugccuuuuaggagcuuuauguuu

SEQ ID NO: 44699 - RNA, 32 nt, Human
agacaauuuccuuuuuguccuuuuauauuuuu

SEQ ID NO: 44700 - RNA, 32 nt, Human
agacacaagcgcgcacacaggcuccgcacaca

SEQ ID NO: 44701 - RNA, 32 nt, Human
agacacacaagaaaucuggcuuggccaggauu

SEQ ID NO: 44702 - RNA, 32 nt, Human
agacacacacauauaucaauucucaugagugu

SEQ ID NO: 44703 - RNA, 32 nt, Human
agacacacaccuacccuccccagcuuuccagg

SEQ ID NO: 44704 - RNA, 32 nt, Human
agacacacagucagugucaggccauggacagg

SEQ ID NO: 44705 - RNA, 32 nt, Human
agacacacaguucuuccugcucugccuuuuuc

SEQ ID NO: 44706 - RNA, 32 nt, Human
agacacacauaaacucgcuucugagcguccac

SEQ ID NO: 44707 - RNA, 32 nt, Human
agacacaccaugagccuccucgucacccuucu

SEQ ID NO: 44708 - RNA, 32 nt, Human
agacacacgagaccaggcuuuaccaugaaagc

SEQ ID NO: 44709 - RNA, 32 nt, Human
agacacacgggaccuaaucagccucaaguuag

SEQ ID NO: 44710 - RNA, 32 nt, Human
agacacacucagcaaccacacggaucugacag

SEQ ID NO: 44711 - RNA, 32 nt, Human
agacacagaacagugcuuggcacauuguaaua

SEQ ID NO: 44712 - RNA, 32 nt, Human
agacacagaagcaccaggcuugccuggggugc

SEQ ID NO: 44713 - RNA, 32 nt, Human
agacacagaaggcagacugggugaggagaccu

SEQ ID NO: 44714 - RNA, 32 nt, Human
agacacagagagaagagggccgaggagagagg

SEQ ID NO: 44715 - RNA, 32 nt, Human
agacacagccauugccuccaccuccaccacag

SEQ ID NO: 44716 - RNA, 32 nt, Human
agacacagccuucugccuccucgccucuccug

SEQ ID NO: 44717 - RNA, 31 nt, Human
agacacaggcacuucucuccacagccugcua

SEQ ID NO: 44718 - RNA, 32 nt, Human
agacacagggaaaugggucuuagccuggggcc

SEQ ID NO: 44719 - RNA, 32 nt, Human
agacacagggccugugccccgagauuccagau

SEQ ID NO: 44720 - RNA, 32 nt, Human
agacacagggucucaccauguugcccagccug

SEQ ID NO: 44721 - RNA, 32 nt, Human
agacacagggucucacuauguugcccaggccg

SEQ ID NO: 44722 - RNA, 32 nt, Human
agacacagggucucgcuguguugcccaggcug

SEQ ID NO: 44723 - RNA, 32 nt, Human
agacacaggguuucaccauauuggccaggcug

SEQ ID NO: 44724 - RNA, 32 nt, Human
agacacaggguuucauaauguuccccaggcug

SEQ ID NO: 44725 - RNA, 32 nt, Human
agacacaggguuucuccauguuggucaggcug

SEQ ID NO: 44726 - RNA, 32 nt, Human
agacacaggucuuccccagaaucucacguggc

SEQ ID NO: 44727 - RNA, 21 nt, Human
agacacagucucacucuguca

SEQ ID NO: 44728 - RNA, 32 nt, Human
agacacaguggacaauggcauccuggaacacc

SEQ ID NO: 44729 - RNA, 32 nt, Human
agacacaguggacugaaaggacugguugaaag

SEQ ID NO: 44730 - RNA, 32 nt, Human
agacacaguucugugguggccaggccuguggg

SEQ ID NO: 44731 - RNA, 20 nt, Human
agacacaguuucacucguug

SEQ ID NO: 44732 - RNA, 32 nt, Human
agacacauaaugaagacuaagaaaaggaagaa

SEQ ID NO: 44733 - RNA, 32 nt, Human
agacacauauccacacagauacccacagaugc

SEQ ID NO: 44734 - RNA, 32 nt, Human
agacacauaugcacgagagagacagaggagga

SEQ ID NO: 44735 - RNA, 32 nt, Human
agacacaucacccagucucugcccucauguuc

SEQ ID NO: 44736 - RNA, 32 nt, Human
agacacaucauuuauacacaggcacaggggcc

SEQ ID NO: 44737 - RNA, 32 nt, Human
agacacaucggcuguucacacguuccccgcaa

SEQ ID NO: 44738 - RNA, 32 nt, Human
agacacaucuuccuuuuacuaacuggauaaaa

SEQ ID NO: 44739 - RNA, 32 nt, Human
agacacauggccuucuuuguguacaugacaug

SEQ ID NO: 44740 - RNA, 32 nt, Human
agacacauggcuugaaaauggaagacacaaaa

SEQ ID NO: 44741 - RNA, 32 nt, Human
agacacauguuucuccccagccuaaguguagu

SEQ ID NO: 44742 - RNA, 32 nt, Human
agacacauuacguggaccuggucccaggcuca

SEQ ID NO: 44743 - RNA, 32 nt, Human
agacaccaaacagagguaauggcacuuuacug

SEQ ID NO: 44744 - RNA, 32 nt, Human
agacaccaaaccagagguggaggaagaacggu

SEQ ID NO: 44745 - RNA, 27 nt, Human
agacaccaagccuuuagacuccagcag

SEQ ID NO: 44746 - RNA, 24 nt, Human
agacaccacucugguuucuucacu

SEQ ID NO: 44747 - RNA, 32 nt, Human
agacaccacugccaccaccaccaaccacgacc

SEQ ID NO: 44748 - RNA, 32 nt, Human
agacaccacuucucaugcuucucccucccuac

SEQ ID NO: 44749 - RNA, 32 nt, Human
agacaccagaacuuggguugagggcacuacca

SEQ ID NO: 44750 - RNA, 32 nt, Human
agacaccagacagacagauacugugaacuugg

SEQ ID NO: 44751 - RNA, 32 nt, Human
agacaccagacugaaguaaacagcugugcauc

SEQ ID NO: 44752 - RNA, 32 nt, Human
agacaccagaguagcugggaccacaggugugu

SEQ ID NO: 44753 - RNA, 32 nt, Human
agacaccagaugcucacggagaugcuggacac

SEQ ID NO: 44754 - RNA, 32 nt, Human
agacaccagcacuucugcuugcugggcuggcu

SEQ ID NO: 44755 - RNA, 32 nt, Human
agacaccagcagguggcugcagugacguuagg

SEQ ID NO: 44756 - RNA, 32 nt, Human
agacaccagccuagccuggcucugccccgcag

SEQ ID NO: 44757 - RNA, 32 nt, Human
agacaccagcucugaggccaguuaaucauccc

SEQ ID NO: 44758 - RNA, 32 nt, Human
agacaccagggcagccuggcccagaggagcaa

SEQ ID NO: 44759 - RNA, 32 nt, Human
agacaccagguguggagaugggucacuuaauu

SEQ ID NO: 44760 - RNA, 32 nt, Human
agacaccagugccucagaaacugcucggucag

SEQ ID NO: 44761 - RNA, 32 nt, Human
agacaccaugaaggaguaugugcuccuauuau

SEQ ID NO: 44762 - RNA, 32 nt, Human
agacaccaugaccacccuugaugauaaguugc

SEQ ID NO: 44763 - RNA, 25 nt, Human
agacacccaaccccaacuccagcag

SEQ ID NO: 44764 - RNA, 32 nt, Human
agacaccccagccaccuggcucagagagggac

SEQ ID NO: 44765 - RNA, 32 nt, Human
agacacccccaccuuccuccagccugugcgca

SEQ ID NO: 44766 - RNA, 32 nt, Human
agacacccccuaaaauucucacccucagcuau

SEQ ID NO: 44767 - RNA, 32 nt, Human
agacaccccugcccagcccacagcugccagag

SEQ ID NO: 44768 - RNA, 32 nt, Human
agacaccccugccuagcgugcugcuggcuguu

SEQ ID NO: 44769 - RNA, 32 nt, Human
agacacccucauuccuguaucuccaggacugg

SEQ ID NO: 44770 - RNA, 32 nt, Human
agacaccgaggcaggaggauugguugaggcca

SEQ ID NO: 44771 - RNA, 32 nt, Human
agacaccgcuggcugcuggacacccucuucac

SEQ ID NO: 44772 - RNA, 32 nt, Human
agacaccuaauguaacaaagucguucggcuuc

SEQ ID NO: 44773 - RNA, 32 nt, Human
agacaccuaucagagaagcagcaucaaccuag

SEQ ID NO: 44774 - RNA, 32 nt, Human
agacaccucugaguaaacucccagaaagccug

SEQ ID NO: 44775 - RNA, 32 nt, Human
agacaccucugucugccccacuguccuggggu

SEQ ID NO: 44776 - RNA, 32 nt, Human
agacaccugaaggaggugaggaagagagcccu

SEQ ID NO: 44777 - RNA, 32 nt, Human
agacaccugccacucgugaaugcaucugauaa

SEQ ID NO: 44778 - RNA, 32 nt, Human
agacaccugggcagacacugcaagaugagcuu

SEQ ID NO: 44779 - RNA, 32 nt, Human
agacaccuguagucccagcuacuuggagggca

SEQ ID NO: 44780 - RNA, 20 nt, Human
agacaccuguccccugcccu

SEQ ID NO: 44781 - RNA, 32 nt, Human
agacaccugugggagccggaagccagggggcc

SEQ ID NO: 44782 - RNA, 32 nt, Human
agacaccuguggucccagcuauucgggaggcu

SEQ ID NO: 44783 - RNA, 32 nt, Human
agacaccuuucagcucccuccugaagcaggcu

SEQ ID NO: 44784 - RNA, 32 nt, Human
agacacgaaagaacccggucuccagugucaca

SEQ ID NO: 44785 - RNA, 32 nt, Human
agacacgagcccccucccccagcccgucaccc

SEQ ID NO: 44786 - RNA, 31 nt, Human
agacacgcaaugucaggccauggcuggguca

SEQ ID NO: 44787 - RNA, 32 nt, Human
agacacgcaucccuugucuggccccaggcugc

SEQ ID NO: 44788 - RNA, 32 nt, Human
agacacggcccagggccccgaagaucaauaac

SEQ ID NO: 44789 - RNA, 32 nt, Human
agacacgggguuucaccauguuggccaggcug

SEQ ID NO: 44790 - RNA, 32 nt, Human
agacacggguuuucaccauguuggucaggcug

SEQ ID NO: 44791 - RNA, 32 nt, Human
agacacgucuuuucauuccaguccaguucagg

SEQ ID NO: 44792 - RNA, 32 nt, Human
agacacgugcuguuccaccucccuucagacua

SEQ ID NO: 44793 - RNA, 25 nt, Human
agacacguggacagggauagacaga

SEQ ID NO: 44794 - RNA, 32 nt, Human
agacacguguuuacuauguuacccaggcugga

SEQ ID NO: 44795 - RNA, 32 nt, Human
agacacuaagcagauuacaugaccuuauuuua

SEQ ID NO: 44796 - RNA, 32 nt, Human
agacacuaccuauucaugcagggcagaaacca

SEQ ID NO: 44797 - RNA, 32 nt, Human
agacacuaccugggagaugguggaggaugaag

SEQ ID NO: 44798 - RNA, 32 nt, Human
agacacuacuccuacuuaucuugcucauaaag

SEQ ID NO: 44799 - RNA, 32 nt, Human
agacacuaucagcagggacagaugugugggag

SEQ ID NO: 44800 - RNA, 32 nt, Human
agacacucaacaaccagaacaguuuuauuauu

SEQ ID NO: 44801 - RNA, 29 nt, Human
agacacucaauaaauaauuguugaauuca

SEQ ID NO: 44802 - RNA, 31 nt, Human
agacacucaauaaauacuuguugaauucaaa

SEQ ID NO: 44803 - RNA, 31 nt, Human
agacacucaauaaauauugccugaaaaugaa

SEQ ID NO: 44804 - RNA, 32 nt, Human
agacacucaaugccagccuguuaaagcagcug

SEQ ID NO: 44805 - RNA, 32 nt, Human
agacacucacacaauucucaauccacauuuca

SEQ ID NO: 44806 - RNA, 32 nt, Human
agacacucagacacccucacaaacacaguagu

SEQ ID NO: 44807 - RNA, 32 nt, Human
agacacucagccagacaggaggaaacugugac

SEQ ID NO: 44808 - RNA, 32 nt, Human
agacacucagcccuccccacccuggcucuccu

SEQ ID NO: 44809 - RNA, 31 nt, Human
agacacucaguaaauagcuguugaaugaaug

SEQ ID NO: 44810 - RNA, 32 nt, Human
agacacucaugcccuggcaauguggcugccag

SEQ ID NO: 44811 - RNA, 32 nt, Human
agacacuccaccacaaacuuuucacuuuagag

SEQ ID NO: 44812 - RNA, 32 nt, Human
agacacucggcgagguggaggugagggcgggc

SEQ ID NO: 44813 - RNA, 21 nt, Human
agacacucucaggccuggagg

SEQ ID NO: 44814 - RNA, 32 nt, Human
agacacugacaagcacgcacacacacgcaaau

SEQ ID NO: 44815 - RNA, 32 nt, Human
agacacugacugggcgaugggagcugcccacc

SEQ ID NO: 44816 - RNA, 32 nt, Human
agacacugauugacuggaagaccuggauuucu

SEQ ID NO: 44817 - RNA, 32 nt, Human
agacacugcaacaacaggagugcaaacuucuc

SEQ ID NO: 44818 - RNA, 32 nt, Human
agacacugcagagccugggagcaggggagggg

SEQ ID NO: 44819 - RNA, 32 nt, Human
agacacuggagcugcucugucccugaagaggc

SEQ ID NO: 44820 - RNA, 32 nt, Human
agacacugggagacagaaggggccggucccca

SEQ ID NO: 44821 - RNA, 32 nt, Human
agacacuguucuggacauuaaggcaacaaaau

SEQ ID NO: 44822 - RNA, 32 nt, Human
agacacuguugaauauugauguccuuauaaau

SEQ ID NO: 44823 - RNA, 32 nt, Human
agacacuuaaaauguuggggaaacguaagcgu

SEQ ID NO: 44824 - RNA, 32 nt, Human
agacacuuagaaguuauugaggacuuuaaaga

SEQ ID NO: 44825 - RNA, 32 nt, Human
agacacuucaugcuccaaggcuuuugagacac

SEQ ID NO: 44826 - RNA, 32 nt, Human
agacacuucccagcgauuccagccugggcucc

SEQ ID NO: 44827 - RNA, 32 nt, Human
agacacuuccgucacaucccaccccauccucc

SEQ ID NO: 44828 - RNA, 32 nt, Human
agacacuuuacagauaaccaguucucaugaaa

SEQ ID NO: 44829 - RNA, 19 nt, Human
agacacuuucacuguguug

SEQ ID NO: 44830 - RNA, 32 nt, Human
agacagaaaaggauuccaaugagaacuucagg

SEQ ID NO: 44831 - RNA, 32 nt, Human
agacagaaacccagaaaccaccugccacgaug

SEQ ID NO: 44832 - RNA, 19 nt, Human
agacagaaacucaagcagg

SEQ ID NO: 44833 - RNA, 32 nt, Human
agacagaaauauuuugccacuguuguuacuau

SEQ ID NO: 44834 - RNA, 32 nt, Human
agacagaagaagagaaacugggccagcauuau

SEQ ID NO: 44835 - RNA, 32 nt, Human
agacagaagaagucagagaagugaagagagau

SEQ ID NO: 44836 - RNA, 32 nt, Human
agacagaagagugagaagcagauggaggagaa

SEQ ID NO: 44837 - RNA, 32 nt, Human
agacagaaggggaggaagagaggccucguguc

SEQ ID NO: 44838 - RNA, 22 nt, Human
agacagaagucaaaaggaagag

SEQ ID NO: 44839 - RNA, 32 nt, Human
agacagaaguugagaaagguaacucuuaaacu

SEQ ID NO: 44840 - RNA, 32 nt, Human
agacagaaucaacauggaaagcacgacccaca

SEQ ID NO: 44841 - RNA, 32 nt, Human
agacagaaucucacuccagccugggcaacaga

SEQ ID NO: 44842 - RNA, 32 nt, Human
agacagaaugacagagagagaaaaugauucuc

SEQ ID NO: 44843 - RNA, 23 nt, Human
agacagacaagaagaggaagaga

SEQ ID NO: 44844 - RNA, 32 nt, Human
agacagacagacagacaggggguuguacagaa

SEQ ID NO: 44845 - RNA, 32 nt, Human
agacagacagcaagacacagaggcagagagac

SEQ ID NO: 44846 - RNA, 32 nt, Human
agacagacagcuagguggcugcagcccagcgc

SEQ ID NO: 44847 - RNA, 32 nt, Human
agacagacaugagagacaagcaucuucuuucc

SEQ ID NO: 44848 - RNA, 32 nt, Human
agacagaccacacaaacaccacugaaggaacg

SEQ ID NO: 44849 - RNA, 32 nt, Human
agacagaccagaaauuacccacccaaccaggc

SEQ ID NO: 44850 - RNA, 32 nt, Human
agacagaccaucucccugugguuguuugacug

SEQ ID NO: 44851 - RNA, 32 nt, Human
agacagacggcacgauggcacugagcucccag

SEQ ID NO: 44852 - RNA, 19 nt, Human
agacagacgggcacugcua

SEQ ID NO: 44853 - RNA, 32 nt, Human
agacagacuuccaagaguuacuguccacccgg

SEQ ID NO: 44854 - RNA, 32 nt, Human
agacagagaagauccuguguguuucucuguac

SEQ ID NO: 44855 - RNA, 32 nt, Human
agacagagaagccucucucaggagccagauga

SEQ ID NO: 44856 - RNA, 32 nt, Human
agacagagacaaagaggagacacuccaggaag

SEQ ID NO: 44857 - RNA, 32 nt, Human
agacagagacagagagagacugagggagagac

SEQ ID NO: 44858 - RNA, 32 nt, Human
agacagagagaaagaggagacacuccaggaag

SEQ ID NO: 44859 - RNA, 32 nt, Human
agacagagaggaggggacgaaggacgagccau

SEQ ID NO: 44860 - RNA, 32 nt, Human
agacagagagggcugaagccuugucagcaccu

SEQ ID NO: 44861 - RNA, 20 nt, Human
agacagagcacugacuaugu

SEQ ID NO: 44862 - RNA, 22 nt, Human
agacagagccaagcacugcuca

SEQ ID NO: 44863 - RNA, 32 nt, Human
agacagagccccacccucagaugcacaugagc

SEQ ID NO: 44864 - RNA, 32 nt, Human
agacagagccgauggggccagagcaggcagaa

SEQ ID NO: 44865 - RNA, 19 nt, Human
agacagagccucgcucguu

SEQ ID NO: 44866 - RNA, 17 nt, Human
agacagagcuagacugu

SEQ ID NO: 44867 - RNA, 19 nt, Human
agacagagcucgccuccua

SEQ ID NO: 44868 - RNA, 32 nt, Human
agacagagcugaccccuccaccaccaaaggcc

SEQ ID NO: 44869 - RNA, 18 nt, Human
agacagagcugggauguu

SEQ ID NO: 44870 - RNA, 32 nt, Human
agacagagcugguucuaagauuuaauacagug

SEQ ID NO: 44871 - RNA, 21 nt, Human
agacagagcuucuccauguug

SEQ ID NO: 44872 - RNA, 19 nt, Human
agacagagcuucucucugu

SEQ ID NO: 44873 - RNA, 21 nt, Human
agacagagcuucucucuguug

SEQ ID NO: 44874 - RNA, 32 nt, Human
agacagaggaagcagagccaggugccgagcgc

SEQ ID NO: 44875 - RNA, 32 nt, Human
agacagaggagaaaguggagcggggagggaau

SEQ ID NO: 44876 - RNA, 32 nt, Human
agacagaggaggcagagagggagagaaacaga

SEQ ID NO: 44877 - RNA, 32 nt, Human
agacagaggcaggaggaugacccagggucuag

SEQ ID NO: 44878 - RNA, 32 nt, Human
agacagaggccugaagcaaagacaucuggguc

SEQ ID NO: 44879 - RNA, 17 nt, Human
agacagaggcgcauguu

SEQ ID NO: 44880 - RNA, 15 nt, Human
agacagaggcucugu

SEQ ID NO: 44881 - RNA, 32 nt, Human
agacagagggagcagugaauagcaauagggug

SEQ ID NO: 44882 - RNA, 19 nt, Human
agacagagguugcagugag

SEQ ID NO: 44883 - RNA, 32 nt, Human
agacagaguagggacucgugugcacuggccac

SEQ ID NO: 44884 - RNA, 20 nt, Human
agacagagucacaaaugcug

SEQ ID NO: 44885 - RNA, 21 nt, Human
agacagagucaugcucuguca

SEQ ID NO: 44886 - RNA, 21 nt, Human
agacagagucccacucuguca

SEQ ID NO: 44887 - RNA, 16 nt, Human
agacagaguccucugu

SEQ ID NO: 44888 - RNA, 20 nt, Human
agacagagucucacacugug

SEQ ID NO: 44889 - RNA, 21 nt, Human
agacagagucucacacuguug

SEQ ID NO: 44890 - RNA, 21 nt, Human
agacagagucucacccuguug

SEQ ID NO: 44891 - RNA, 21 nt, Human
agacagagucucaccuuguca

SEQ ID NO: 44892 - RNA, 19 nt, Human
agacagagucucacucugu

SEQ ID NO: 44893 - RNA, 21 nt, Human
agacagagucucacucuguca

SEQ ID NO: 44894 - RNA, 21 nt, Human
agacagagucucacucugucc

SEQ ID NO: 44895 - RNA, 21 nt, Human
agacagagucucacucuguug

SEQ ID NO: 44896 - RNA, 20 nt, Human
agacagagucucacucuugu

SEQ ID NO: 44897 - RNA, 21 nt, Human
agacagagucucacugucuug

SEQ ID NO: 44898 - RNA, 19 nt, Human
agacagagucucacuguug

SEQ ID NO: 44899 - RNA, 18 nt, Human
agacagagucucacuuug

SEQ ID NO: 44900 - RNA, 19 nt, Human
agacagagucucacuuugu

SEQ ID NO: 44901 - RNA, 21 nt, Human
agacagagucucacuuuguca

SEQ ID NO: 44902 - RNA, 21 nt, Human
agacagagucucacuuuguug

SEQ ID NO: 44903 - RNA, 21 nt, Human
agacagagucucaugcuguug

SEQ ID NO: 44904 - RNA, 21 nt, Human
agacagagucucauucuguca

SEQ ID NO: 44905 - RNA, 21 nt, Human
agacagagucucccucuguca

SEQ ID NO: 44906 - RNA, 18 nt, Human
agacagagucuccuaguu

SEQ ID NO: 44907 - RNA, 19 nt, Human
agacagagucucgcacugu

SEQ ID NO: 44908 - RNA, 21 nt, Human
agacagagucucgcacuguug

SEQ ID NO: 44909 - RNA, 21 nt, Human
agacagagucucgccuuguca

SEQ ID NO: 44910 - RNA, 21 nt, Human
agacagagucucgcgcuguug

SEQ ID NO: 44911 - RNA, 20 nt, Human
agacagagucucgcuauugu

SEQ ID NO: 44912 - RNA, 19 nt, Human
agacagagucucgcucugu

SEQ ID NO: 44913 - RNA, 21 nt, Human
agacagagucucgcucuguca

SEQ ID NO: 44914 - RNA, 20 nt, Human
agacagagucucgcucuguu

SEQ ID NO: 44915 - RNA, 21 nt, Human
agacagagucucgcucuguug

SEQ ID NO: 44916 - RNA, 21 nt, Human
agacagagucucgcuuuguug

SEQ ID NO: 44917 - RNA, 19 nt, Human
agacagagucucguucugu

SEQ ID NO: 44918 - RNA, 21 nt, Human
agacagagucucucucugucc

SEQ ID NO: 44919 - RNA, 17 nt, Human
agacagagucucuguug

SEQ ID NO: 44920 - RNA, 19 nt, Human
agacagagucucuuucugu

SEQ ID NO: 44921 - RNA, 19 nt, Human
agacagagucuggcucugu

SEQ ID NO: 44922 - RNA, 21 nt, Human
agacagagucuggcucuguca

SEQ ID NO: 44923 - RNA, 20 nt, Human
agacagagucugguucuguu

SEQ ID NO: 44924 - RNA, 19 nt, Human
agacagagucuuacucugu

SEQ ID NO: 44925 - RNA, 21 nt, Human
agacagagucuuacucuguca

SEQ ID NO: 44926 - RNA, 21 nt, Human
agacagagucuuacucuguug

SEQ ID NO: 44927 - RNA, 21 nt, Human
agacagagucuuauucuguca

SEQ ID NO: 44928 - RNA, 19 nt, Human
agacagagucuuccucugu

SEQ ID NO: 44929 - RNA, 19 nt, Human
agacagagucuugcucugu

SEQ ID NO: 44930 - RNA, 21 nt, Human
agacagagucuugcucuguca

SEQ ID NO: 44931 - RNA, 21 nt, Human
agacagagucuugcucuguug

SEQ ID NO: 44932 - RNA, 22 nt, Human
agacagagucuugcucuuguug

SEQ ID NO: 44933 - RNA, 21 nt, Human
agacagagucuugcuuuguca

SEQ ID NO: 44934 - RNA, 21 nt, Human
agacagagucuugcuuuguug

SEQ ID NO: 44935 - RNA, 20 nt, Human
agacagagucuuggucuguu

SEQ ID NO: 44936 - RNA, 21 nt, Human
agacagagucuuggucuguug

SEQ ID NO: 44937 - RNA, 21 nt, Human
agacagagucuuucucuguca

SEQ ID NO: 44938 - RNA, 32 nt, Human
agacagagugagccaaugcucaccagccccag

SEQ ID NO: 44939 - RNA, 32 nt, Human
agacagagugauggccagcuuggggacauuug

SEQ ID NO: 44940 - RNA, 32 nt, Human
agacagagugcuuagaauuagauuugugauca

SEQ ID NO: 44941 - RNA, 32 nt, Human
agacagaguuaggaaguguggagucagaaugc

SEQ ID NO: 44942 - RNA, 21 nt, Human
agacagaguuucaccauguug

SEQ ID NO: 44943 - RNA, 25 nt, Human
agacagaguuucaccauguuggcca

SEQ ID NO: 44944 - RNA, 19 nt, Human
agacagaguuucacucugu

SEQ ID NO: 44945 - RNA, 21 nt, Human
agacagaguuucacucuguca

SEQ ID NO: 44946 - RNA, 22 nt, Human
agacagaguuucauucuuguug

SEQ ID NO: 44947 - RNA, 19 nt, Human
agacagaguuucauuguca

SEQ ID NO: 44948 - RNA, 19 nt, Human
agacagaguuucgcuuugu

SEQ ID NO: 44949 - RNA, 21 nt, Human
agacagaguuucgucauguug

SEQ ID NO: 44950 - RNA, 19 nt, Human
agacagaguuucucucugu

SEQ ID NO: 44951 - RNA, 21 nt, Human
agacagaguuucucucuguug

SEQ ID NO: 44952 - RNA, 22 nt, Human
agacagaguuuggcucuuguug

SEQ ID NO: 44953 - RNA, 21 nt, Human
agacagaguuuuaccauguug

SEQ ID NO: 44954 - RNA, 25 nt, Human
agacagaguuuuaccauguuggcca

SEQ ID NO: 44955 - RNA, 21 nt, Human
agacagaguuuugccauguug

SEQ ID NO: 44956 - RNA, 21 nt, Human
agacagaguuuugcuauguug

SEQ ID NO: 44957 - RNA, 21 nt, Human
agacagaguuuugcuguguug

SEQ ID NO: 44958 - RNA, 32 nt, Human
agacagaucugaauguucaguucuagccaagg

SEQ ID NO: 44959 - RNA, 32 nt, Human
agacagaugagcuccugccugcucugagacaa

SEQ ID NO: 44960 - RNA, 32 nt, Human
agacagaugcugggacaucauccuuggguacu

SEQ ID NO: 44961 - RNA, 32 nt, Human
agacagauggccuuauagauuuggaaaaugag

SEQ ID NO: 44962 - RNA, 32 nt, Human
agacagaugggacucaagcaggaugggugcua

SEQ ID NO: 44963 - RNA, 32 nt, Human
agacagaugugaaggaaauggaaaugaggcaa

SEQ ID NO: 44964 - RNA, 32 nt, Human
agacagauuuccauguaaaugugcacaagcca

SEQ ID NO: 44965 - RNA, 32 nt, Human
agacagauuugggccagacuccuguguccuug

SEQ ID NO: 44966 - RNA, 32 nt, Human
agacagcaauagaaaacuaauaaaccucccuc

SEQ ID NO: 44967 - RNA, 32 nt, Human
agacagcaccacugcacuccagccugggugac

SEQ ID NO: 44968 - RNA, 32 nt, Human
agacagcaccauugcaccccagccugagcaac

SEQ ID NO: 44969 - RNA, 32 nt, Human
agacagcagaagcagacaccuccagugaacua

SEQ ID NO: 44970 - RNA, 32 nt, Human
agacagcagcacgaggcaggcacuuuuacuuc

SEQ ID NO: 44971 - RNA, 32 nt, Human
agacagcagcuguacagacaaugcuggggcgg

SEQ ID NO: 44972 - RNA, 32 nt, Human
agacagcaggcagagcuccagaugggcaagga

SEQ ID NO: 44973 - RNA, 31 nt, Human
agacagcaguuucccuauauuauuuggaguc

SEQ ID NO: 44974 - RNA, 21 nt, Human
agacagcaucucacuauguug

SEQ ID NO: 44975 - RNA, 32 nt, Human
agacagcaucucuagaucuccagggaggagag

SEQ ID NO: 44976 - RNA, 32 nt, Human
agacagcaucuucucuauuggccucucaggga

SEQ ID NO: 44977 - RNA, 32 nt, Human
agacagcauggaggacuuucugcucuccaaug

SEQ ID NO: 44978 - RNA, 27 nt, Human
agacagcauugcuccccagcccuccag

SEQ ID NO: 44979 - RNA, 32 nt, Human
agacagccaagcucauguuuucuccugaucaa

SEQ ID NO: 44980 - RNA, 32 nt, Human
agacagccacggacacagcacauggcgggaga

SEQ ID NO: 44981 - RNA, 32 nt, Human
agacagcccaguagcugugagucggucugaca

SEQ ID NO: 44982 - RNA, 32 nt, Human
agacagccccaacacaugcacauguguguaca

SEQ ID NO: 44983 - RNA, 32 nt, Human
agacagccccaggucacuucuggcacagaagu

SEQ ID NO: 44984 - RNA, 32 nt, Human
agacagcccccaggacccugagaggcagagug

SEQ ID NO: 44985 - RNA, 32 nt, Human
agacagccccuauccuccauucuugagucagg

SEQ ID NO: 44986 - RNA, 32 nt, Human
agacagcccuccacuccagcucugagacccuu

SEQ ID NO: 44987 - RNA, 32 nt, Human
agacagcccugccuauccucuguauauaggcc

SEQ ID NO: 44988 - RNA, 32 nt, Human
agacagccucuucuccucuggggccucaagaa

SEQ ID NO: 44989 - RNA, 32 nt, Human
agacagccugagcccuggcccugcugcuuggu

SEQ ID NO: 44990 - RNA, 32 nt, Human
agacagccugaguaaaaggcuuggaaguugga

SEQ ID NO: 44991 - RNA, 32 nt, Human
agacagccugggccgguccucacucacugucu

SEQ ID NO: 44992 - RNA, 32 nt, Human
agacagccuuucugcugccuuggguuucugug

SEQ ID NO: 44993 - RNA, 32 nt, Human
agacagcgccgggaagaugagcacggaaggug

SEQ ID NO: 44994 - RNA, 32 nt, Human
agacagcggacagacgcucacgcccaggggau

SEQ ID NO: 44995 - RNA, 32 nt, Human
agacagcggggccugggcuaaggccaagggcu

SEQ ID NO: 44996 - RNA, 32 nt, Human
agacagcgucagggcaucaucuguagaaacgc

SEQ ID NO: 44997 - RNA, 20 nt, Human
agacagcgucucacucuguu

SEQ ID NO: 44998 - RNA, 21 nt, Human
agacagcgucuuacuauguug

SEQ ID NO: 44999 - RNA, 20 nt, Human
agacagcguuucaccauguu

SEQ ID NO: 45000 - RNA, 32 nt, Human
agacagcuaccagccacaggugugcagacuca

SEQ ID NO: 45001 - RNA, 32 nt, Human
agacagcucuacugcaccaccccagcccuucc

SEQ ID NO: 45002 - RNA, 32 nt, Human
agacagcugcugucugcuucagguccagaguu

SEQ ID NO: 45003 - RNA, 32 nt, Human
agacagcugggcaggcuccuggagcugauggc

SEQ ID NO: 45004 - RNA, 32 nt, Human
agacagcugggggaguggggagacaggaggaa

SEQ ID NO: 45005 - RNA, 32 nt, Human
agacagcuguuccacuugcacacacgcacaca

SEQ ID NO: 45006 - RNA, 30 nt, Human
agacagcuuuaaaaucuguucacuuucaaa

SEQ ID NO: 45007 - RNA, 32 nt, Human
agacaggaaaugaccugaccucaaaccagaug

SEQ ID NO: 45008 - RNA, 21 nt, Human
agacaggaagaaaagaagaga

SEQ ID NO: 45009 - RNA, 32 nt, Human
agacaggaagcauggguuugcccacagaccug

SEQ ID NO: 45010 - RNA, 32 nt, Human
agacaggaaggaaggaaggaaggaaggaagga

SEQ ID NO: 45011 - RNA, 32 nt, Human
agacaggaauugaugcuucaguccuggggcag

SEQ ID NO: 45012 - RNA, 32 nt, Human
agacaggaccccuauguccaggaaaggggaaa

SEQ ID NO: 45013 - RNA, 32 nt, Human
agacaggaccccuggggccaggagaggugggu

SEQ ID NO: 45014 - RNA, 32 nt, Human
agacaggacucaccaucucugccucccaugag

SEQ ID NO: 45015 - RNA, 21 nt, Human
agacaggagaaucgcuugaac

SEQ ID NO: 45016 - RNA, 32 nt, Human
agacaggagaaucgcuugagcuggagugcagu

SEQ ID NO: 45017 - RNA, 32 nt, Human
agacaggagacuggaagaaggggccagaaauu

SEQ ID NO: 45018 - RNA, 32 nt, Human
agacaggagagagagggagggagcgagaggga

SEQ ID NO: 45019 - RNA, 32 nt, Human
agacaggagagggggaucggugggcggucccg

SEQ ID NO: 45020 - RNA, 23 nt, Human
agacaggagcagguagcaucuca

SEQ ID NO: 45021 - RNA, 32 nt, Human
agacaggagggcaagggccaugcugaagggac

SEQ ID NO: 45022 - RNA, 32 nt, Human
agacaggagggcccuggcugugcaccugggga

SEQ ID NO: 45023 - RNA, 32 nt, Human
agacaggagggugggagcaggacagagaaacu

SEQ ID NO: 45024 - RNA, 32 nt, Human
agacaggaguccauucacuccucugcucucua

SEQ ID NO: 45025 - RNA, 20 nt, Human
agacaggaucucacuauguu

SEQ ID NO: 45026 - RNA, 21 nt, Human
agacaggaucucacuauguug

SEQ ID NO: 45027 - RNA, 32 nt, Human
agacaggaucucaggcuggagugcaguggcac

SEQ ID NO: 45028 - RNA, 21 nt, Human
agacaggauuucaccauguug

SEQ ID NO: 45029 - RNA, 25 nt, Human
agacaggauuucaccauguuggcca

SEQ ID NO: 45030 - RNA, 21 nt, Human
agacaggauuucacuauguug

SEQ ID NO: 45031 - RNA, 25 nt, Human
agacaggauuucacuauguuggcca

SEQ ID NO: 45032 - RNA, 25 nt, Human
agacaggauuucacuauguugguca

SEQ ID NO: 45033 - RNA, 20 nt, Human
agacaggauuucacuguguu

SEQ ID NO: 45034 - RNA, 21 nt, Human
agacaggauuucaucauguug

SEQ ID NO: 45035 - RNA, 25 nt, Human
agacaggauuucaucauguuggcca

SEQ ID NO: 45036 - RNA, 21 nt, Human
agacaggauuucaucguguug

SEQ ID NO: 45037 - RNA, 21 nt, Human
agacaggauuucuccauguug

SEQ ID NO: 45038 - RNA, 25 nt, Human
agacaggauuucuccauguugguca

SEQ ID NO: 45039 - RNA, 21 nt, Human
agacaggauuuuaccauguug

SEQ ID NO: 45040 - RNA, 25 nt, Human
agacaggauuuuaccauguuggcca

SEQ ID NO: 45041 - RNA, 21 nt, Human
agacaggauuuuacuguguug

SEQ ID NO: 45042 - RNA, 21 nt, Human
agacaggauuuugcuguguug

SEQ ID NO: 45043 - RNA, 32 nt, Human
agacaggcaagcugagccucuauguggcacca

SEQ ID NO: 45044 - RNA, 32 nt, Human
agacaggcagagaaggagagaggcagagaggg

SEQ ID NO: 45045 - RNA, 21 nt, Human
agacaggcagaucacaagguc

SEQ ID NO: 45046 - RNA, 32 nt, Human
agacaggcaguguaguguaauggcuaagaaca

SEQ ID NO: 45047 - RNA, 32 nt, Human
agacaggccaccggaagauggggaaagagcua

SEQ ID NO: 45048 - RNA, 32 nt, Human
agacaggccagagcaucccccuccuccaccau

SEQ ID NO: 45049 - RNA, 32 nt, Human
agacaggccauggaggcagcacugagccagca

SEQ ID NO: 45050 - RNA, 32 nt, Human
agacaggcccucagagugcucuguagagcugu

SEQ ID NO: 45051 - RNA, 32 nt, Human
agacaggccugaugccaaaggcuuugggcuca

SEQ ID NO: 45052 - RNA, 32 nt, Human
agacaggccugggacgggcucucccucacagc

SEQ ID NO: 45053 - RNA, 32 nt, Human
agacaggcucagugacgguugaaggaaucgga

SEQ ID NO: 45054 - RNA, 21 nt, Human
agacaggcucucaccauguug

SEQ ID NO: 45055 - RNA, 32 nt, Human
agacaggcugucucgcugacccuucuggccuu

SEQ ID NO: 45056 - RNA, 25 nt, Human
agacaggcuuucgcuguguuggcca

SEQ ID NO: 45057 - RNA, 32 nt, Human
agacagggaagacagcauaaagagcuagugug

SEQ ID NO: 45058 - RNA, 32 nt, Human
agacagggacgaagcagagaccucuacagacc

SEQ ID NO: 45059 - RNA, 32 nt, Human
agacagggacuauaacagggaggcagaauuca

SEQ ID NO: 45060 - RNA, 32 nt, Human
agacagggagacagacagagaggcagagagaa

SEQ ID NO: 45061 - RNA, 32 nt, Human
agacagggagacagggucucacuguguugccu

SEQ ID NO: 45062 - RNA, 32 nt, Human
agacagggagggcugaaggcugugcagcaccc

SEQ ID NO: 45063 - RNA, 21 nt, Human
agacagggauucaacauguug

SEQ ID NO: 45064 - RNA, 19 nt, Human
agacagggcaaaaggaaga

SEQ ID NO: 45065 - RNA, 21 nt, Human
agacagggcaucacuguguug

SEQ ID NO: 45066 - RNA, 32 nt, Human
agacagggccagggagaaauuagccagugcag

SEQ ID NO: 45067 - RNA, 21 nt, Human
agacagggccucacucuguug

SEQ ID NO: 45068 - RNA, 32 nt, Human
agacagggccuuccaucuagagcccagcaccu

SEQ ID NO: 45069 - RNA, 19 nt, Human
agacagggccuugcucugu

SEQ ID NO: 45070 - RNA, 21 nt, Human
agacagggcuucaccauguug

SEQ ID NO: 45071 - RNA, 22 nt, Human
agacagggcuucaccauguugg

SEQ ID NO: 45072 - RNA, 24 nt, Human
agacagggcuucaccauguuggca

SEQ ID NO: 45073 - RNA, 20 nt, Human
agacagggcuucacuguguu

SEQ ID NO: 45074 - RNA, 32 nt, Human
agacaggggagaagaaaauucagauggagcgu

SEQ ID NO: 45075 - RNA, 32 nt, Human
agacaggggagagagaaagacaaagaggggac

SEQ ID NO: 45076 - RNA, 32 nt, Human
agacaggggaucucauuauguugcccaaacug

SEQ ID NO: 45077 - RNA, 22 nt, Human
agacagggguuucaccacguug

SEQ ID NO: 45078 - RNA, 22 nt, Human
agacagggguuucaccauauug

SEQ ID NO: 45079 - RNA, 32 nt, Human
agacagggguuucuuccauguugcccaggcug

SEQ ID NO: 45080 - RNA, 21 nt, Human
agacaggguaucuccauguug

SEQ ID NO: 45081 - RNA, 21 nt, Human
agacaggguauugccguguug

SEQ ID NO: 45082 - RNA, 32 nt, Human
agacagggucucaacucuguuacccaggcugg

SEQ ID NO: 45083 - RNA, 21 nt, Human
agacagggucucaccauguca

SEQ ID NO: 45084 - RNA, 25 nt, Human
agacagggucucaccaugucauuca

SEQ ID NO: 45085 - RNA, 20 nt, Human
agacagggucucaccauguu

SEQ ID NO: 45086 - RNA, 21 nt, Human
agacagggucucaccauguug

SEQ ID NO: 45087 - RNA, 22 nt, Human
agacagggucucaccauguugg

SEQ ID NO: 45088 - RNA, 21 nt, Human
agacagggucucacuauauug

SEQ ID NO: 45089 - RNA, 32 nt, Human
agacagggucucacuauguggcccaggcuggu

SEQ ID NO: 45090 - RNA, 21 nt, Human
agacagggucucacuauguug

SEQ ID NO: 45091 - RNA, 19 nt, Human
agacagggucucacucugu

SEQ ID NO: 45092 - RNA, 21 nt, Human
agacagggucucacucuguca

SEQ ID NO: 45093 - RNA, 20 nt, Human
agacagggucucacucuguu

SEQ ID NO: 45094 - RNA, 21 nt, Human
agacagggucucacucuguug

SEQ ID NO: 45095 - RNA, 21 nt, Human
agacagggucucacugcauug

SEQ ID NO: 45096 - RNA, 19 nt, Human
agacagggucucacugugu

SEQ ID NO: 45097 - RNA, 21 nt, Human
agacagggucucacuguguug

SEQ ID NO: 45098 - RNA, 21 nt, Human
agacagggucucacuuuguug

SEQ ID NO: 45099 - RNA, 32 nt, Human
agacagggucuccagcccaaacuuggcuuccu

SEQ ID NO: 45100 - RNA, 21 nt, Human
agacagggucucccuauguug

SEQ ID NO: 45101 - RNA, 21 nt, Human
agacagggucucgccauguug

SEQ ID NO: 45102 - RNA, 19 nt, Human
agacagggucucgcucugu

SEQ ID NO: 45103 - RNA, 32 nt, Human
agacagggucucucucuguggcccaggcugaa

SEQ ID NO: 45104 - RNA, 19 nt, Human
agacagggucuggcucugu

SEQ ID NO: 45105 - RNA, 32 nt, Human
agacagggucuugacuggagugcaguggugcg

SEQ ID NO: 45106 - RNA, 19 nt, Human
agacagggucuugcucugu

SEQ ID NO: 45107 - RNA, 19 nt, Human
agacagggugucacucugu

SEQ ID NO: 45108 - RNA, 22 nt, Human
agacaggguucuuaccauguug

SEQ ID NO: 45109 - RNA, 26 nt, Human
agacaggguucuuaccauguuggcca

SEQ ID NO: 45110 - RNA, 21 nt, Human
agacaggguuucacaauguug

SEQ ID NO: 45111 - RNA, 21 nt, Human
agacaggguuucaccacauug

SEQ ID NO: 45112 - RNA, 25 nt, Human
agacaggguuucaccacauuggcca

SEQ ID NO: 45113 - RNA, 21 nt, Human
agacaggguuucaccacguug

SEQ ID NO: 45114 - RNA, 25 nt, Human
agacaggguuucaccacguuggcca

SEQ ID NO: 45115 - RNA, 21 nt, Human
agacaggguuucaccagguug

SEQ ID NO: 45116 - RNA, 25 nt, Human
agacaggguuucaccagguuggcca

SEQ ID NO: 45117 - RNA, 21 nt, Human
agacaggguuucaccauauug

SEQ ID NO: 45118 - RNA, 22 nt, Human
agacaggguuucaccauauugg

SEQ ID NO: 45119 - RNA, 25 nt, Human
agacaggguuucaccauauuggcca

SEQ ID NO: 45120 - RNA, 25 nt, Human
agacaggguuucaccauauugguca

SEQ ID NO: 45121 - RNA, 21 nt, Human
agacaggguuucaccaucuug

SEQ ID NO: 45122 - RNA, 18 nt, Human
agacaggguuucaccaug

SEQ ID NO: 45123 - RNA, 19 nt, Human
agacaggguuucaccaugu

SEQ ID NO: 45124 - RNA, 21 nt, Human
agacaggguuucaccauguca

SEQ ID NO: 45125 - RNA, 32 nt, Human
agacaggguuucaccaugucagccaggauggu

SEQ ID NO: 45126 - RNA, 20 nt, Human
agacaggguuucaccauguu

SEQ ID NO: 45127 - RNA, 25 nt, Human
agacaggguuucaccauguuaguca

SEQ ID NO: 45128 - RNA, 21 nt, Human
agacaggguuucaccauguug

SEQ ID NO: 45129 - RNA, 25 nt, Human
agacaggguuucaccauguugccca

SEQ ID NO: 45130 - RNA, 22 nt, Human
agacaggguuucaccauguugg

SEQ ID NO: 45131 - RNA, 25 nt, Human
agacaggguuucaccauguuggcca

SEQ ID NO: 45132 - RNA, 25 nt, Human
agacaggguuucaccauguuggccg

SEQ ID NO: 45133 - RNA, 24 nt, Human
agacaggguuucaccauguugguc

SEQ ID NO: 45134 - RNA, 25 nt, Human
agacaggguuucaccauguugguca

SEQ ID NO: 45135 - RNA, 25 nt, Human
agacaggguuucaccauguugguua

SEQ ID NO: 45136 - RNA, 25 nt, Human
agacaggguuucaccauguugucca

SEQ ID NO: 45137 - RNA, 25 nt, Human
agacaggguuucaccauguuuguca

SEQ ID NO: 45138 - RNA, 21 nt, Human
agacaggguuucaccauuuug

SEQ ID NO: 45139 - RNA, 25 nt, Human
agacaggguuucaccauuuuggcca

SEQ ID NO: 45140 - RNA, 20 nt, Human
agacaggguuucacccuguu

SEQ ID NO: 45141 - RNA, 32 nt, Human
agacaggguuucaccgucuuggcuagcugguc

SEQ ID NO: 45142 - RNA, 20 nt, Human
agacaggguuucaccguguu

SEQ ID NO: 45143 - RNA, 21 nt, Human
agacaggguuucaccguguua

SEQ ID NO: 45144 - RNA, 21 nt, Human
agacaggguuucaccguguug

SEQ ID NO: 45145 - RNA, 25 nt, Human
agacaggguuucaccguguugguca

SEQ ID NO: 45146 - RNA, 21 nt, Human
agacaggguuucacuacguug

SEQ ID NO: 45147 - RNA, 25 nt, Human
agacaggguuucacuacguuggcca

SEQ ID NO: 45148 - RNA, 21 nt, Human
agacaggguuucacuaugcug

SEQ ID NO: 45149 - RNA, 32 nt, Human
agagagaggagaaaggcgaaggagaaggagga

SEQ ID NO: 45150 - RNA, 32 nt, Human
agagagaggagaagaggaggaggcagaggaag

SEQ ID NO: 45151 - RNA, 32 nt, Human
agagagaggagaagggaggcaagggaggggca

SEQ ID NO: 45152 - RNA, 32 nt, Human
agagagaggagaagggaggcaggggaggggca

SEQ ID NO: 45153 - RNA, 32 nt, Human
agagagaggagagagaaggaaauauguguaug

SEQ ID NO: 45154 - RNA, 32 nt, Human
agagagaggagagagaggagagaggagagagg

SEQ ID NO: 45155 - RNA, 32 nt, Human
agagagaggagaggaggggaagagccucaguc

SEQ ID NO: 45156 - RNA, 32 nt, Human
agagagaggagggacugucacacuggugcuga

SEQ ID NO: 45157 - RNA, 32 nt, Human
agagagaggcagagagggagagagggagagug

SEQ ID NO: 45158 - RNA, 32 nt, Human
agagagaggccgcggccgccagcguggggaug

SEQ ID NO: 45159 - RNA, 32 nt, Human
agagagaggccugggggccaccaaauauuccc

SEQ ID NO: 45160 - RNA, 32 nt, Human
agagagaggcugcagaggucaccaggaaaguu

SEQ ID NO: 45161 - RNA, 32 nt, Human
agagagagggagagagacagagagagcaggga

SEQ ID NO: 45162 - RNA, 31 nt, Human
agagagagggagagagagugagagagacuga

SEQ ID NO: 45163 - RNA, 32 nt, Human
agagagagggagcaggcggagcgagagaggga

SEQ ID NO: 45164 - RNA, 32 nt, Human
agagagagggccagggcugaguucacgggcuc

SEQ ID NO: 45165 - RNA, 32 nt, Human
agagagagggccaguaagggcaacuccuauca

SEQ ID NO: 45166 - RNA, 32 nt, Human
agagagagggucucacuauauugcccaaguug

SEQ ID NO: 45167 - RNA, 32 nt, Human
agagagagugugacagaggaucugccugugaa

SEQ ID NO: 45168 - RNA, 32 nt, Human
agagagaguuucagcgucauccuugaacgcag

SEQ ID NO: 45169 - RNA, 32 nt, Human
agagagaguuugggucuuucuccucugugccu

SEQ ID NO: 45170 - RNA, 32 nt, Human
agagagauaguauguaguaggaagagagacau

SEQ ID NO: 45171 - RNA, 32 nt, Human
agagagaugacacggcaagaagaaggaugcua

SEQ ID NO: 45172 - RNA, 32 nt, Human
agagagaugcuguugaaucagaaacagaucaa

SEQ ID NO: 45173 - RNA, 32 nt, Human
agagagauggccuggguuaucauugcugauag

SEQ ID NO: 45174 - RNA, 31 nt, Human
agagagaugggugaggggaccuggagaggua

SEQ ID NO: 45175 - RNA, 32 nt, Human
agagagcaaccuccucccucguagagggagau

SEQ ID NO: 45176 - RNA, 32 nt, Human
agagagcaagacugcaggaacggagggguccu

SEQ ID NO: 45177 - RNA, 32 nt, Human
agagagcaagcgguaccagagguaccagcuuc

SEQ ID NO: 45178 - RNA, 24 nt, Human
agagagcaaggggcuuucuuacca

SEQ ID NO: 45179 - RNA, 32 nt, Human
agagagcacagcccuugccuggagcccaggaa

SEQ ID NO: 45180 - RNA, 18 nt, Human
agagagcacaucgccuga

SEQ ID NO: 45181 - RNA, 20 nt, Human
agagagcacgucacacucuu

SEQ ID NO: 45182 - RNA, 32 nt, Human
agagagcacugcacuuccccaaaacggaaggg

SEQ ID NO: 45183 - RNA, 32 nt, Human
agagagcacugugcaagccaaaugguucaaua

SEQ ID NO: 45184 - RNA, 32 nt, Human
agagagcagagcccagaaaugucuuuugcagg

SEQ ID NO: 45185 - RNA, 32 nt, Human
agagagcagagcuuagucaguggaggaaauca

SEQ ID NO: 45186 - RNA, 32 nt, Human
agagagcagagggggucaugcagugagugggu

SEQ ID NO: 45187 - RNA, 32 nt, Human
agagagcagccaggagcuuccugucaguaacc

SEQ ID NO: 45188 - RNA, 32 nt, Human
agagagcagcccuggagcaggagcggcaggag

SEQ ID NO: 45189 - RNA, 24 nt, Human
agagagcagccgggagaagcagag

SEQ ID NO: 45190 - RNA, 32 nt, Human
agagagcagccuggcccucaccagugcgcaag

SEQ ID NO: 45191 - RNA, 32 nt, Human
agagagcagcuucugccacuucccagguaagc

SEQ ID NO: 45192 - RNA, 32 nt, Human
agagagcagcuuuaaacucagggacagagcca

SEQ ID NO: 45193 - RNA, 32 nt, Human
agagagcaggacaaggcagacagaaggucagg

SEQ ID NO: 45194 - RNA, 32 nt, Human
agagagcaggagacggagagucgguggagugu

SEQ ID NO: 45195 - RNA, 23 nt, Human
agagagcaggcaggcccacugcu

SEQ ID NO: 45196 - RNA, 32 nt, Human
agagagcagggugggguaaggaggagaaaaua

SEQ ID NO: 45197 - RNA, 32 nt, Human
agagagcagguggcggaugcagcugagagcuc

SEQ ID NO: 45198 - RNA, 32 nt, Human
agagagcagguguacacccaaccaaagugauu

SEQ ID NO: 45199 - RNA, 32 nt, Human
agagagcaucucccccugguccaugccccucc

SEQ ID NO: 45200 - RNA, 32 nt, Human
agagagccagggccauggaggccaacaugccg

SEQ ID NO: 45201 - RNA, 32 nt, Human
agagagccaggucuguagcuccuggcccucca

SEQ ID NO: 45202 - RNA, 32 nt, Human
agagagcccagcacccaagauccagcagggga

SEQ ID NO: 45203 - RNA, 32 nt, Human
agagagccccucauccuuccucugggaccaga

SEQ ID NO: 45204 - RNA, 32 nt, Human
agagagcccucagcuacucugugaaugacuug

SEQ ID NO: 45205 - RNA, 32 nt, Human
agagagcccugagaccagugcaccgcugcugc

SEQ ID NO: 45206 - RNA, 32 nt, Human
agagagcccugagacccgccccagcugccacc

SEQ ID NO: 45207 - RNA, 32 nt, Human
agagagccgcucccuccacugcccgaggggag

SEQ ID NO: 45208 - RNA, 32 nt, Human
agagagccgggaguuggggaggggguauuuau

SEQ ID NO: 45209 - RNA, 32 nt, Human
agagagccucacucaccuccccaacuaagcaa

SEQ ID NO: 45210 - RNA, 32 nt, Human
agagagccugcaauuggaaauaugagaaauuc

SEQ ID NO: 45211 - RNA, 32 nt, Human
agagagccuggcaggaccagagccuuaccuuu

SEQ ID NO: 45212 - RNA, 21 nt, Human
agagagccuuaucucugcccu

SEQ ID NO: 45213 - RNA, 32 nt, Human
agagagccuuucuccagcccaugcuggcuggg

SEQ ID NO: 45214 - RNA, 32 nt, Human
agagagccuuucucccagcuuugccgccugug

SEQ ID NO: 45215 - RNA, 32 nt, Human
agagagccuuucuuccuguucuucuucgucuu

SEQ ID NO: 45216 - RNA, 32 nt, Human
agagagccuuuucaaaggacuuuucauccagc

SEQ ID NO: 45217 - RNA, 20 nt, Human
agagagcgagcgccaccgcc

SEQ ID NO: 45218 - RNA, 32 nt, Human
agagagcgcugggagccggaggggagcgcagc

SEQ ID NO: 45219 - RNA, 21 nt, Human
agagagcgggcagaccuggca

SEQ ID NO: 45220 - RNA, 32 nt, Human
agagagcuacagucuucauuuuagugcuuuac

SEQ ID NO: 45221 - RNA, 24 nt, Human
agagagcucugccgccaccuuccu

SEQ ID NO: 45222 - RNA, 32 nt, Human
agagagcucugccgccaccuuccuucagagcu

SEQ ID NO: 45223 - RNA, 23 nt, Human
agagagcucugggccuucuuccu

SEQ ID NO: 45224 - RNA, 20 nt, Human
agagagcucugggcugcucc

SEQ ID NO: 45225 - RNA, 32 nt, Human
agagagcugaaccugcaucccggaccugcggc

SEQ ID NO: 45226 - RNA, 32 nt, Human
agagagcugccuuguuccuuguggccauguga

SEQ ID NO: 45227 - RNA, 32 nt, Human
agagagcugcgaugugaacugccccuccccuc

SEQ ID NO: 45228 - RNA, 32 nt, Human
agagagcuggcgggaccccagcaaugcgugca

SEQ ID NO: 45229 - RNA, 32 nt, Human
agagagcugggacaguggaggcuggcagaagc

SEQ ID NO: 45230 - RNA, 32 nt, Human
agagagcugggaggggcacaggcagcaagguc

SEQ ID NO: 45231 - RNA, 32 nt, Human
agagagcuguggcacaccaucaugcauaccaa

SEQ ID NO: 45232 - RNA, 32 nt, Human
agagagcugugguucuccaucauugggggagu

SEQ ID NO: 45233 - RNA, 32 nt, Human
agagagcuucagcagacucaggaagacaccuu

SEQ ID NO: 45234 - RNA, 32 nt, Human
agagagcuugaugcuuucugccuucugucuca

SEQ ID NO: 45235 - RNA, 32 nt, Human
agagagcuuuguccccggccuccuggacacau

SEQ ID NO: 45236 - RNA, 32 nt, Human
agagaggaaagcauuaggcagauggaauguac

SEQ ID NO: 45237 - RNA, 32 nt, Human
agagaggaaaguugaguuccaccucugaaaug

SEQ ID NO: 45238 - RNA, 32 nt, Human
agagaggaaaguuuaagcagggugcauuagaa

SEQ ID NO: 45239 - RNA, 32 nt, Human
agagaggaaauccaaugacaaugguacuggca

SEQ ID NO: 45240 - RNA, 32 nt, Human
agagaggaagaaacaaaggcagcuguggccuc

SEQ ID NO: 45241 - RNA, 32 nt, Human
agagaggaagcacaaugagcagugauacuaaa

SEQ ID NO: 45242 - RNA, 23 nt, Human
agagaggaaggaggugacguuca

SEQ ID NO: 45243 - RNA, 32 nt, Human
agagaggaaggccgcugcauccugccugcccg

SEQ ID NO: 45244 - RNA, 32 nt, Human
agagaggaagucagaggguagggaccuuugcc

SEQ ID NO: 45245 - RNA, 32 nt, Human
agagaggaaugagaaagaaggaagugaugcaa

SEQ ID NO: 45246 - RNA, 17 nt, Human
agagaggacagagcaua

SEQ ID NO: 45247 - RNA, 15 nt, Human
agagaggacuuucau

SEQ ID NO: 45248 - RNA, 32 nt, Human
agagaggagagaggagaggaaagggaaggaga

SEQ ID NO: 45249 - RNA, 32 nt, Human
agagaggagaggaggaagauugagcuggggca

SEQ ID NO: 45250 - RNA, 32 nt, Human
agagaggagaggggguacgggcaguggcugcu

SEQ ID NO: 45251 - RNA, 32 nt, Human
agagaggagaggggucagggaaggccucccug

SEQ ID NO: 45252 - RNA, 32 nt, Human
agagaggagagggugagugggguauagggccc

SEQ ID NO: 45253 - RNA, 32 nt, Human
agagaggagagugaacagggagcggggcuuuu

SEQ ID NO: 45254 - RNA, 32 nt, Human
agagaggagccaaguucuaguaguuucaguuc

SEQ ID NO: 45255 - RNA, 23 nt, Human
agagaggagcgggccuucuauca

SEQ ID NO: 45256 - RNA, 32 nt, Human
agagaggaggacguguacuccaggcgaggccu

SEQ ID NO: 45257 - RNA, 32 nt, Human
agagaggaggagaaggagggugagaggagcaa

SEQ ID NO: 45258 - RNA, 32 nt, Human
agagaggaggcagaggcugggaaugggagcag

SEQ ID NO: 45259 - RNA, 32 nt, Human
agagaggaggcuggguuugacuccagggaagg

SEQ ID NO: 45260 - RNA, 32 nt, Human
agagaggagggcacugguggucuccugcuuag

SEQ ID NO: 45261 - RNA, 32 nt, Human
agagaggaguuccuucccuuucaacgagggcu

SEQ ID NO: 45262 - RNA, 32 nt, Human
agagaggauggagagggagagacugaauuguu

SEQ ID NO: 45263 - RNA, 32 nt, Human
agagaggaugugccaucaugauuaaugaaaac

SEQ ID NO: 45264 - RNA, 32 nt, Human
agagaggcaaagaaacauugugaaaucuccaa

SEQ ID NO: 45265 - RNA, 32 nt, Human
agagaggcacagaaugugccaggggugugcug

SEQ ID NO: 45266 - RNA, 32 nt, Human
agagaggcacagaccugucuccugggugcauc

SEQ ID NO: 45267 - RNA, 32 nt, Human
agagaggcacgcucacccucacccucaugggc

SEQ ID NO: 45268 - RNA, 32 nt, Human
agagaggcacggccacuggagcugucucagag

SEQ ID NO: 45269 - RNA, 32 nt, Human
agagaggcagagagacagagagggagagaggg

SEQ ID NO: 45270 - RNA, 32 nt, Human
agagaggcagagagagacagagaagcagagac

SEQ ID NO: 45271 - RNA, 32 nt, Human
agagaggcagagagagauagagacagaguccu

SEQ ID NO: 45272 - RNA, 32 nt, Human
agagaggcagagagggaaagaggcagagaagg

SEQ ID NO: 45273 - RNA, 32 nt, Human
agagaggcagagagggagagaggcagagagac

SEQ ID NO: 45274 - RNA, 32 nt, Human
agagaggcagagagggagagaggcagagaggg

SEQ ID NO: 45275 - RNA, 24 nt, Human
agagaggcaggauuccugcugacu

SEQ ID NO: 45276 - RNA, 22 nt, Human
agagaggcauuggugcgaggga

SEQ ID NO: 45277 - RNA, 32 nt, Human
agagaggccagagagacagcgggccccagcgc

SEQ ID NO: 45278 - RNA, 32 nt, Human
agagaggccaggaugguggaagagggccagac

SEQ ID NO: 45279 - RNA, 32 nt, Human
agagaggcccaggaugguggaggcugaggaac

SEQ ID NO: 45280 - RNA, 32 nt, Human
agagaggccccaggaguggguggagaguggag

SEQ ID NO: 45281 - RNA, 21 nt, Human
agagaggcccgcccgcccacc

SEQ ID NO: 45282 - RNA, 21 nt, Human
agagaggcccgccugcccacc

SEQ ID NO: 45283 - RNA, 21 nt, Human
agagaggcccggccgccggcc

SEQ ID NO: 45284 - RNA, 32 nt, Human
agagaggccgccgccuccgcccggugguucuc

SEQ ID NO: 45285 - RNA, 23 nt, Human
agagaggccugaaccuguugacu

SEQ ID NO: 45286 - RNA, 24 nt, Human
agagaggccuuggcccagcugacc

SEQ ID NO: 45287 - RNA, 32 nt, Human
agagaggcggagcggccaggagagaggggauu

SEQ ID NO: 45288 - RNA, 23 nt, Human
agagaggcggccguccugucaac

SEQ ID NO: 45289 - RNA, 32 nt, Human
agagaggcucagagagcugggaagcagacagg

SEQ ID NO: 45290 - RNA, 32 nt, Human
agagagggacuagagugccagauggaggagcu

SEQ ID NO: 45291 - RNA, 32 nt, Human
agagagggagacacccggaggagcagguggga

SEQ ID NO: 45292 - RNA, 32 nt, Human
agagagggagagaaacagaggagacagagagg

SEQ ID NO: 45293 - RNA, 32 nt, Human
agagagggagagaaagggagagagggagggag

SEQ ID NO: 45294 - RNA, 32 nt, Human
agagagggagagaagggcuccccagaucuaca

SEQ ID NO: 45295 - RNA, 32 nt, Human
agagagggagagagacagagagagcagggauc

SEQ ID NO: 45296 - RNA, 32 nt, Human
agagagggagagagaggaaagggaaggaagaa

SEQ ID NO: 45297 - RNA, 32 nt, Human
agagagggagagagagggagagaaagggagag

SEQ ID NO: 45298 - RNA, 32 nt, Human
agagagggagagagcgagcgagcaacagcgag

SEQ ID NO: 45299 - RNA, 32 nt, Human
agagagggagagaggcagagagacagagaggg

SEQ ID NO: 45300 - RNA, 32 nt, Human
agagagggagagaggcagagagggagagaggc

SEQ ID NO: 45301 - RNA, 32 nt, Human
agagagggagagagggacagagagagauagag

SEQ ID NO: 45302 - RNA, 32 nt, Human
agagagggaggcacguaggaacaagcaaugag

SEQ ID NO: 45303 - RNA, 32 nt, Human
agagagggaggcagaaguaaagaggcccggga

SEQ ID NO: 45304 - RNA, 32 nt, Human
agagagggagggaagagagugacggagaagga

SEQ ID NO: 45305 - RNA, 32 nt, Human
agagagggagggaggaaggaaggaagggagga

SEQ ID NO: 45306 - RNA, 32 nt, Human
agagagggaguuucaccauguuggccagguug

SEQ ID NO: 45307 - RNA, 32 nt, Human
agagagggaguuucaccauguuggucagguug

SEQ ID NO: 45308 - RNA, 32 nt, Human
agagagggaguuucgccauguuggccaggcug

SEQ ID NO: 45309 - RNA, 21 nt, Human
agagagggcacagagcucaug

SEQ ID NO: 45310 - RNA, 32 nt, Human
agagagggcacgagaacccaaagggaauagag

SEQ ID NO: 45311 - RNA, 32 nt, Human
agagagggccaggcagucgcacugugaacaga

SEQ ID NO: 45312 - RNA, 32 nt, Human
agagagggccuggggcagacuuaggaucagga

SEQ ID NO: 45313 - RNA, 32 nt, Human
agagagggcgcgguggccuggccaagacuuua

SEQ ID NO: 45314 - RNA, 32 nt, Human
agagagggcguuuugccauguuggcuaggcug

SEQ ID NO: 45315 - RNA, 32 nt, Human
agagagggcugcagccagggcccugccagccu

SEQ ID NO: 45316 - RNA, 32 nt, Human
agagaggggaaaauggguguugacugaggaau

SEQ ID NO: 45317 - RNA, 32 nt, Human
agagaggggaccccuuuuacuacagggcacac

SEQ ID NO: 45318 - RNA, 32 nt, Human
agagaggggagggagagagaagagcaccagaa

SEQ ID NO: 45319 - RNA, 31 nt, Human
agagaggggccugguguaucacuggaggaaa

SEQ ID NO: 45320 - RNA, 32 nt, Human
agagaggggccugguguaucacuggaggaaau

SEQ ID NO: 45321 - RNA, 32 nt, Human
agagagggggagagguuucuccaugcuacucu

SEQ ID NO: 45322 - RNA, 32 nt, Human
agagagggggcgcggaaggaaggaggcgggac

SEQ ID NO: 45323 - RNA, 32 nt, Human
agagaggggguucaggaugcugcgugguucca

SEQ ID NO: 45324 - RNA, 32 nt, Human
agagaggggguuucaccacguuggccagguug

SEQ ID NO: 45325 - RNA, 32 nt, Human
agagaggggguuucaccguggucucgaucucc

SEQ ID NO: 45326 - RNA, 32 nt, Human
agagaggggguuucaccguguuagccaggaug

SEQ ID NO: 45327 - RNA, 32 nt, Human
agagaggggguuucacuauguugcucaagcug

SEQ ID NO: 45328 - RNA, 32 nt, Human
agagaggggguuucaucauguuaccuaggcug

SEQ ID NO: 45329 - RNA, 32 nt, Human
agagaggggguuucuccauguuggucaggcug

SEQ ID NO: 45330 - RNA, 32 nt, Human
agagaggggguuuuuccauguuggccaggcug

SEQ ID NO: 45331 - RNA, 32 nt, Human
agagaggggugaugccuggugcugguggaacc

SEQ ID NO: 45332 - RNA, 17 nt, Human
agagaggguauuucaua

SEQ ID NO: 45333 - RNA, 32 nt, Human
agagaggguauuuugccauguugcccaggcua

SEQ ID NO: 45334 - RNA, 32 nt, Human
agagagguagguggcacagaagauggggcuuu

SEQ ID NO: 45335 - RNA, 32 nt, Human
agagaggugacaacccacccagacugcaguuc

SEQ ID NO: 45336 - RNA, 32 nt, Human
agagaggugaggcagcugcggaagaaaaguag

SEQ ID NO: 45337 - RNA, 32 nt, Human
agagaggugcugccuuuucuaagucauaauga

SEQ ID NO: 45338 - RNA, 31 nt, Human
agagagguggagaaaccuaaagacugaggag

SEQ ID NO: 45339 - RNA, 32 nt, Human
agagagguggaggaggccagcucgcuccaaaa

SEQ ID NO: 45340 - RNA, 20 nt, Human
agagaggugggacugcaagg

SEQ ID NO: 45341 - RNA, 32 nt, Human
agagaggugggugggagggugggagggugggg

SEQ ID NO: 45342 - RNA, 32 nt, Human
agagaggugugagccccuugucucacaccggc

SEQ ID NO: 45343 - RNA, 19 nt, Human
agagagguuucaccauguu

SEQ ID NO: 45344 - RNA, 23 nt, Human
agagagucaaauaucacacucuu

SEQ ID NO: 45345 - RNA, 32 nt, Human
agagaguccuaggggacuacagaaggaaaaag

SEQ ID NO: 45346 - RNA, 32 nt, Human
agagagucgcaucucagugcaggagagacagu

SEQ ID NO: 45347 - RNA, 32 nt, Human
agagagucucucucuaccacauagcccaauga

SEQ ID NO: 45348 - RNA, 32 nt, Human
agagagucuuccagguacugauccuguuucuu

SEQ ID NO: 45349 - RNA, 23 nt, Human
agagagugaaccccccaccacca

SEQ ID NO: 45350 - RNA, 32 nt, Human
agagagugaagaacaggagcaugaagaggaug

SEQ ID NO: 45351 - RNA, 32 nt, Human
agagagugaagacacaaugaacagaaacuucc

SEQ ID NO: 45352 - RNA, 21 nt, Human
agagagugaggaagagaagga

SEQ ID NO: 45353 - RNA, 32 nt, Human
agagagugcgcuuuggaaauuuauuccaguuu

SEQ ID NO: 45354 - RNA, 32 nt, Human
agagagugcuccugaauggucacgagugguug

SEQ ID NO: 45355 - RNA, 31 nt, Human
agagaguggagaggagagagagcaaauauug

SEQ ID NO: 45356 - RNA, 32 nt, Human
agagaguggccagauguggugccuggagcgac

SEQ ID NO: 45357 - RNA, 24 nt, Human
agagaguggggaucuccauuugcc

SEQ ID NO: 45358 - RNA, 32 nt, Human
agagaguggguuucacuauguuggccaggcug

SEQ ID NO: 45359 - RNA, 31 nt, Human
agagagugguaaaucucagaaagcacaagca

SEQ ID NO: 45360 - RNA, 32 nt, Human
agagagugguuacaugaggcaggugugaggga

SEQ ID NO: 45361 - RNA, 32 nt, Human
agagagugucuagggcaggugagcuacagggu

SEQ ID NO: 45362 - RNA, 32 nt, Human
agagagugucuucaugccaaccacagccuguu

SEQ ID NO: 45363 - RNA, 32 nt, Human
agagagugugugugcccacugcugcccaacau

SEQ ID NO: 45364 - RNA, 32 nt, Human
agagaguucccaucuucucucaccccuuucau

SEQ ID NO: 45365 - RNA, 32 nt, Human
agagauaaaaccugaguaccagagccacuuuu

SEQ ID NO: 45366 - RNA, 32 nt, Human
agagauaaaccaguucacgccggagccccgug

SEQ ID NO: 45367 - RNA, 32 nt, Human
agagauaacauacauucccuuugguaucacag

SEQ ID NO: 45368 - RNA, 32 nt, Human
agagauaagaggaggaagcuaauaagagacug

SEQ ID NO: 45369 - RNA, 32 nt, Human
agagauaaucccuaucaaagcuucugggauca

SEQ ID NO: 45370 - RNA, 32 nt, Human
agagauaaugcagacugucauggguggggaau

SEQ ID NO: 45371 - RNA, 23 nt, Human
agagauacugguuuccugcccuu

SEQ ID NO: 45372 - RNA, 32 nt, Human
agagauagaggaaguggaaccagagagcuggg

SEQ ID NO: 45373 - RNA, 32 nt, Human
agagauagaggaggaggagggggaggaagagg

SEQ ID NO: 45374 - RNA, 32 nt, Human
agagauagagucuugcuauguuguccaggcug

SEQ ID NO: 45375 - RNA, 32 nt, Human
agagauagauaacgccuucauuccaauuaauu

SEQ ID NO: 45376 - RNA, 19 nt, Human
agagauagccuguggcccu

SEQ ID NO: 45377 - RNA, 32 nt, Human
agagauagggauucaccauguuggccaggcug

SEQ ID NO: 45378 - RNA, 32 nt, Human
agagauaggguccugcuacauugcccaggcug

SEQ ID NO: 45379 - RNA, 32 nt, Human
agagauagggucucaccauguuggccaggcug

SEQ ID NO: 45380 - RNA, 32 nt, Human
agagauagggucuugcuauguugcccaggcug

SEQ ID NO: 45381 - RNA, 32 nt, Human
agagauagggucuugcuguguugcccaggcua

SEQ ID NO: 45382 - RNA, 32 nt, Human
agagauaggguuucacauguuggccaagcugg

SEQ ID NO: 45383 - RNA, 32 nt, Human
agagauaggguuucaccaugucucccaggcug

SEQ ID NO: 45384 - RNA, 32 nt, Human
agagauaggguuucaccauguugcccaggcug

SEQ ID NO: 45385 - RNA, 32 nt, Human
agagauaggguuucaccauguugcuuaggcug

SEQ ID NO: 45386 - RNA, 32 nt, Human
agagauaggguuucaccauguuggccaggcug

SEQ ID NO: 45387 - RNA, 32 nt, Human
agagauaggguuucaccguguuggccaggcug

SEQ ID NO: 45388 - RNA, 32 nt, Human
agagauaggguuucauuacauugcucaggcug

SEQ ID NO: 45389 - RNA, 32 nt, Human
agagauaggguuuuaccauauugcccaggcug

SEQ ID NO: 45390 - RNA, 32 nt, Human
agagauagguucuugcuaugaugcccaagcug

SEQ ID NO: 45391 - RNA, 32 nt, Human
agagauagugacagccuggggugaggacuuua

SEQ ID NO: 45392 - RNA, 32 nt, Human
agagauauacuuuggaauguuucccaaaauua

SEQ ID NO: 45393 - RNA, 32 nt, Human
agagauauagaccaauggaacagaacagggcc

SEQ ID NO: 45394 - RNA, 32 nt, Human
agagauauuccaggaaugugggugacggccua

SEQ ID NO: 45395 - RNA, 32 nt, Human
agagauauuuccucaaauuugccucaagaugg

SEQ ID NO: 45396 - RNA, 32 nt, Human
agagaucaagccaucggagcugcuagaguucu

SEQ ID NO: 45397 - RNA, 32 nt, Human
agagaucaaucaggugcugcuuugauucuacu

SEQ ID NO: 45398 - RNA, 32 nt, Human
agagaucacaacauugcacuucagccugguga

SEQ ID NO: 45399 - RNA, 32 nt, Human
agagaucacaccacugcacuacagccucggca

SEQ ID NO: 45400 - RNA, 32 nt, Human
agagaucacaccacugcacuccagccugggca

SEQ ID NO: 45401 - RNA, 32 nt, Human
agagaucacaccacugcacuccagccugggug

SEQ ID NO: 45402 - RNA, 32 nt, Human
agagaucacaccacugcacucuagccugggug

SEQ ID NO: 45403 - RNA, 32 nt, Human
agagaucacaccagaguacaugucucugccuc

SEQ ID NO: 45404 - RNA, 32 nt, Human
agagaucacaugcuucacaagguauaagauau

SEQ ID NO: 45405 - RNA, 32 nt, Human
agagaucacgccacugcacuccagccuggaug

SEQ ID NO: 45406 - RNA, 32 nt, Human
agagaucacggucaugaagaucagcccccaag

SEQ ID NO: 45407 - RNA, 32 nt, Human
agagaucacuagaacagaaaaacaacccagau

SEQ ID NO: 45408 - RNA, 32 nt, Human
agagaucagagaccuaaagugccagaccaaag

SEQ ID NO: 45409 - RNA, 32 nt, Human
agagaucagcccuacuagaugcagagaacccg

SEQ ID NO: 45410 - RNA, 32 nt, Human
agagaucaggccacugcacuccagccugaaca

SEQ ID NO: 45411 - RNA, 23 nt, Human
agagaucaguggcacggaagcuc

SEQ ID NO: 45412 - RNA, 32 nt, Human
agagaucaugccacugcacuagagccugggca

SEQ ID NO: 45413 - RNA, 32 nt, Human
agagaucaugccacugcacuccagccugggca

SEQ ID NO: 45414 - RNA, 32 nt, Human
agagaucaugccacugcacuccagccugggcc

SEQ ID NO: 45415 - RNA, 32 nt, Human
agagaucaugccacugcacuccagccugggcg

SEQ ID NO: 45416 - RNA, 32 nt, Human
agagauccagcacauucucaguacuguggugc

SEQ ID NO: 45417 - RNA, 32 nt, Human
agagaucccggcucccagcccacugaguggcu

SEQ ID NO: 45418 - RNA, 32 nt, Human
agagaucccgggagaacuccagagcuccgggg

SEQ ID NO: 45419 - RNA, 32 nt, Human
agagauccgccucccuugcccuucccccgccc

SEQ ID NO: 45420 - RNA, 32 nt, Human
agagauccugagccacagccgcccagcccugc

SEQ ID NO: 45421 - RNA, 32 nt, Human
agagauccugcgcgcucccugugugggcucca

SEQ ID NO: 45422 - RNA, 32 nt, Human
agagauccuuccauuccaucuaguuuuuggaa

SEQ ID NO: 45423 - RNA, 32 nt, Human
agagaucgcgccaccgcacuccagccucgccg

SEQ ID NO: 45424 - RNA, 32 nt, Human
agagaucgcgccacugcaacccagccugggug

SEQ ID NO: 45425 - RNA, 32 nt, Human
agagaucgcgccacugcacuccagccugggug

SEQ ID NO: 45426 - RNA, 32 nt, Human
agagaucgugccacugcacuccagccugggug

SEQ ID NO: 45427 - RNA, 32 nt, Human
agagaucgugccacugcacuccagccugguga

SEQ ID NO: 45428 - RNA, 32 nt, Human
agagaucgugccacugcacuccagcuugggca

SEQ ID NO: 45429 - RNA, 32 nt, Human
agagaucugagcugucucuuaaaggggacagu

SEQ ID NO: 45430 - RNA, 32 nt, Human
agagaucugcugucagucugcuuauccuucca

SEQ ID NO: 45431 - RNA, 32 nt, Human
agagaucugucagagaaggcauuuccuaagug

SEQ ID NO: 45432 - RNA, 32 nt, Human
agagaucugugggcaaaagcccaggacgugac

SEQ ID NO: 45433 - RNA, 32 nt, Human
agagaucuugucucaucuucugagaggugccu

SEQ ID NO: 45434 - RNA, 29 nt, Human
agagaugaaaaaggaagggaggaaaaggu

SEQ ID NO: 45435 - RNA, 25 nt, Human
agagaugaaaagccggcuuuuucuu

SEQ ID NO: 45436 - RNA, 32 nt, Human
agagaugaaagaaagaaagaguggguuucaga

SEQ ID NO: 45437 - RNA, 23 nt, Human
agagaugaaaggcauauuuucuu

SEQ ID NO: 45438 - RNA, 23 nt, Human
agagaugaaaguguggcuuuuua

SEQ ID NO: 45439 - RNA, 19 nt, Human
agagaugaaauguuuuuuc

SEQ ID NO: 45440 - RNA, 25 nt, Human
agagaugaacagaaaacuuuuucuu

SEQ ID NO: 45441 - RNA, 32 nt, Human
agagaugaacauacacaucucuauuaacucca

SEQ ID NO: 45442 - RNA, 25 nt, Human
agagaugaagagaaaacuuuuucuu

SEQ ID NO: 45443 - RNA, 32 nt, Human
agagaugaagugaaccagagggauggagacuu

SEQ ID NO: 45444 - RNA, 32 nt, Human
agagaugaaguuucaccguguuggccaggaug

SEQ ID NO: 45445 - RNA, 26 nt, Human
agagaugaccaauggaauuuuucuua

SEQ ID NO: 45446 - RNA, 31 nt, Human
agagaugacuuccucccuugaaaacgaagca

SEQ ID NO: 45447 - RNA, 23 nt, Human
agagaugagaaaucgaccuauac

SEQ ID NO: 45448 - RNA, 32 nt, Human
agagaugagaagcagagggcuuggggaaagcc

SEQ ID NO: 45449 - RNA, 32 nt, Human
agagaugagcucuugcuauguugcccaggcug

SEQ ID NO: 45450 - RNA, 32 nt, Human
agagaugaggucucaccauguugcccaggcug

SEQ ID NO: 45451 - RNA, 32 nt, Human
agagaugaggucucacuauguugcccagcugg

SEQ ID NO: 45452 - RNA, 32 nt, Human
agagaugaggucucacuauguugcccaggcug

SEQ ID NO: 45453 - RNA, 32 nt, Human
agagaugaggucucacuguguugcccacggug

SEQ ID NO: 45454 - RNA, 32 nt, Human
agagaugaggucucacuuuguugcccaggcua

SEQ ID NO: 45455 - RNA, 32 nt, Human
agagaugaggucucccuauguugcccaggcug

SEQ ID NO: 45456 - RNA, 32 nt, Human
agagaugaggucuugccauguuacccaggcug

SEQ ID NO: 45457 - RNA, 32 nt, Human
agagaugaggucuugcuauguugcccaagcua

SEQ ID NO: 45458 - RNA, 32 nt, Human
agagaugaggucuugcuuuguugucuaggcug

SEQ ID NO: 45459 - RNA, 32 nt, Human
agagaugaggugggaaggauggguugggugaa

SEQ ID NO: 45460 - RNA, 32 nt, Human
agagaugagguuucaccauauuggccaggcug

SEQ ID NO: 45461 - RNA, 32 nt, Human
agagaugagguuucaccaugauggccaggcug

SEQ ID NO: 45462 - RNA, 32 nt, Human
agagaugagguuucaccauguuggccaggcug

SEQ ID NO: 45463 - RNA, 32 nt, Human
agagaugagguuucaccauuuuggccaggcug

SEQ ID NO: 45464 - RNA, 32 nt, Human
agagaugagguuucaccguguuggccaggcug

SEQ ID NO: 45465 - RNA, 32 nt, Human
agagaugagguuucaccuuguuggccaggaug

SEQ ID NO: 45466 - RNA, 32 nt, Human
agagaugagguuucaccuuguuggucaggcug

SEQ ID NO: 45467 - RNA, 32 nt, Human
agagaugagguuucacuguguuggccaggcug

SEQ ID NO: 45468 - RNA, 32 nt, Human
agagaugagguuucgccauguuggccaggcug

SEQ ID NO: 45469 - RNA, 32 nt, Human
agagaugagguuucgcuauauugaccaggcug

SEQ ID NO: 45470 - RNA, 32 nt, Human
agagaugagguuucuccauguuggucaggcug

SEQ ID NO: 45471 - RNA, 32 nt, Human
agagaugauggaaguccucaucuacugccauc

SEQ ID NO: 45472 - RNA, 32 nt, Human
agagaugaugggcaaaccaaacuccuacugag

SEQ ID NO: 45473 - RNA, 32 nt, Human
agagaugaugguuccauugcucuuggcuucau

SEQ ID NO: 45474 - RNA, 32 nt, Human
agagaugauucugucucauccaaucaagacuu

SEQ ID NO: 45475 - RNA, 32 nt, Human
agagaugauuuggaagaugggggugaaggaca

SEQ ID NO: 45476 - RNA, 29 nt, Human
agagaugcacccggagccuuugcucaauu

SEQ ID NO: 45477 - RNA, 32 nt, Human
agagaugcagaacugggcccguggagcagcag

SEQ ID NO: 45478 - RNA, 20 nt, Human
agagaugccagugugcacug

SEQ ID NO: 45479 - RNA, 32 nt, Human
agagaugccauccacccccaucuaggugaggg

SEQ ID NO: 45480 - RNA, 32 nt, Human
agagaugccccaggguggagggggugggaaug

SEQ ID NO: 45481 - RNA, 32 nt, Human
agagaugccguccacccccaucuaggugaggg

SEQ ID NO: 45482 - RNA, 32 nt, Human
agagaugccuguaauggugagacuuuggaucc

SEQ ID NO: 45483 - RNA, 32 nt, Human
agagaugcggccuugcucuguugcccaggcug

SEQ ID NO: 45484 - RNA, 32 nt, Human
agagaugcgguauuuggccugggaaauucugc

SEQ ID NO: 45485 - RNA, 32 nt, Human
agagaugcggucuugcuguguugccuaggcug

SEQ ID NO: 45486 - RNA, 32 nt, Human
agagaugcucuccugggaccucaguacccugc

SEQ ID NO: 45487 - RNA, 32 nt, Human
agagaugcuuugccagucucauauauaaauga

SEQ ID NO: 45488 - RNA, 32 nt, Human
agagauggagucucgcucugucacccagccug

SEQ ID NO: 45489 - RNA, 32 nt, Human
agagauggagucuugcuauauugcccaggcug

SEQ ID NO: 45490 - RNA, 32 nt, Human
agagauggaguuucaccacguuggccaagcug

SEQ ID NO: 45491 - RNA, 32 nt, Human
agagauggaguuucaccacguuggucaggcug

SEQ ID NO: 45492 - RNA, 32 nt, Human
agagauggaguuucaccauauugcccaggcug

SEQ ID NO: 45493 - RNA, 32 nt, Human
agagauggaguuucaccaugguggucaggcug

SEQ ID NO: 45494 - RNA, 32 nt, Human
agagauggaguuucaccauguuacccaggaug

SEQ ID NO: 45495 - RNA, 32 nt, Human
agagauggaguuucaccauguugcccaggcug

SEQ ID NO: 45496 - RNA, 32 nt, Human
agagauggaguuucaccauguuggccaggaug

SEQ ID NO: 45497 - RNA, 32 nt, Human
agagauggaguuucaccauguuggccaggcug

SEQ ID NO: 45498 - RNA, 32 nt, Human
agagauggcaucucacuauguugcccaggcug

SEQ ID NO: 45499 - RNA, 32 nt, Human
agagauggcaucucacuuuguugcccaggcua

SEQ ID NO: 45500 - RNA, 32 nt, Human
agagauggcaucuugcuaugucguccaggcug

SEQ ID NO: 45501 - RNA, 32 nt, Human
agagauggccaugcauacuucugccucuaucc

SEQ ID NO: 45502 - RNA, 29 nt, Human
agagauggccugguggaaagccuggauug

SEQ ID NO: 45503 - RNA, 32 nt, Human
agagauggcguuucaccauguuggccaggcug

SEQ ID NO: 45504 - RNA, 32 nt, Human
agagauggcuuccaggcaaggaaguucuaucu

SEQ ID NO: 45505 - RNA, 32 nt, Human
agagaugggaggauacuugaauccaggcauuu

SEQ ID NO: 45506 - RNA, 32 nt, Human
agagaugggaggggcacaaagaggaggacccc

SEQ ID NO: 45507 - RNA, 32 nt, Human
agagaugggaucccacuauauugcacaggcug

SEQ ID NO: 45508 - RNA, 32 nt, Human
agagaugggaucgaggcugcaccaccaccauc

SEQ ID NO: 45509 - RNA, 32 nt, Human
agagaugggaucucaccauguugcccaggcua

SEQ ID NO: 45510 - RNA, 32 nt, Human
agagaugggaucucacuagguugcccaggcug

SEQ ID NO: 45511 - RNA, 32 nt, Human
agagaugggaucuugcuauuuugcccaggcug

SEQ ID NO: 45512 - RNA, 32 nt, Human
agagaugggauuucaccauguuacucaggcug

SEQ ID NO: 45513 - RNA, 32 nt, Human
agagaugggauuucaccauguugcccaggcug

SEQ ID NO: 45514 - RNA, 32 nt, Human
agagaugggauuucaccauguuggccaggcug

SEQ ID NO: 45515 - RNA, 32 nt, Human
agagaugggauuucaccauguuggcuaggcug

SEQ ID NO: 45516 - RNA, 32 nt, Human
agagaugggauuucgccauguuggccaggcug

SEQ ID NO: 45517 - RNA, 32 nt, Human
agagaugggauuuugccauguugcccaggcug

SEQ ID NO: 45518 - RNA, 32 nt, Human
agagaugggcauaagucaggaacuugggagga

SEQ ID NO: 45519 - RNA, 32 nt, Human
agagaugggcccaucauuaggggccagcaucc

SEQ ID NO: 45520 - RNA, 32 nt, Human
agagauggggacuugcuauguugcccagacug

SEQ ID NO: 45521 - RNA, 21 nt, Human
agagauggggauggaguccca

SEQ ID NO: 45522 - RNA, 32 nt, Human
agagauggggcagaggugggccucccacuccu

SEQ ID NO: 45523 - RNA, 32 nt, Human
agagauggggcuucaccaucuugaccaggcug

SEQ ID NO: 45524 - RNA, 32 nt, Human
agagauggggcuucaccauguuggccaggcug

SEQ ID NO: 45525 - RNA, 32 nt, Human
agagaugggggcucccuauguugcccaggcug

SEQ ID NO: 45526 - RNA, 32 nt, Human
agagauggggguuuuccauauugcccaggcug

SEQ ID NO: 45527 - RNA, 32 nt, Human
agagauggggucuagcucuaucacccaggcug

SEQ ID NO: 45528 - RNA, 32 nt, Human
agagauggggucucacaguguugcccaggcug

SEQ ID NO: 45529 - RNA, 32 nt, Human
agagauggggucucaccauguuacccaggcug

SEQ ID NO: 45530 - RNA, 32 nt, Human
agagauggggucucaccauguuggccagacug

SEQ ID NO: 45531 - RNA, 32 nt, Human
agagauggggucucacccuguuggccaggcug

SEQ ID NO: 45532 - RNA, 32 nt, Human
agagauggggucucacuaugucgcccagggua

SEQ ID NO: 45533 - RNA, 32 nt, Human
agagauggggucucacuauguugcccaggcua

SEQ ID NO: 45534 - RNA, 32 nt, Human
agagauggggucucacuauguugcccaggcug

SEQ ID NO: 45535 - RNA, 32 nt, Human
agagauggggucucacuauguugcccagucua

SEQ ID NO: 45536 - RNA, 32 nt, Human
agagauggggucucacuguuguucaaacuggu

SEQ ID NO: 45537 - RNA, 32 nt, Human
agagauggggucucccuauguugcccaggcug

SEQ ID NO: 45538 - RNA, 32 nt, Human
agagauggggucucgccauguugcccgggcug

SEQ ID NO: 45539 - RNA, 32 nt, Human
agagauggggucucgccguguugcacagacug

SEQ ID NO: 45540 - RNA, 32 nt, Human
agagauggggucucguuuugucgcccaggcug

SEQ ID NO: 45541 - RNA, 32 nt, Human
agagauggggucucuccauguuggucaggcug

SEQ ID NO: 45542 - RNA, 29 nt, Human
agagauggggucuggcuauguugcccagg

SEQ ID NO: 45543 - RNA, 32 nt, Human
agagauggggucuggcuguguugcccaggcug

SEQ ID NO: 45544 - RNA, 32 nt, Human
agagauggggucuuacuauguugcccaggcug

SEQ ID NO: 45545 - RNA, 32 nt, Human
agagauggggucuuacuauguuguccaggcua

SEQ ID NO: 45546 - RNA, 32 nt, Human
agagauggggucuugccauauuugccaggcug

SEQ ID NO: 45547 - RNA, 32 nt, Human
agagauggggucuugcuauauugcccaggcug

SEQ ID NO: 45548 - RNA, 32 nt, Human
agagauggggucuugcuguguuaccugggcua

SEQ ID NO: 45549 - RNA, 32 nt, Human
agagauggggucuugcuguguugcccaggcua

SEQ ID NO: 45550 - RNA, 32 nt, Human
agagauggggucuugcuguguugcccagguug

SEQ ID NO: 45551 - RNA, 32 nt, Human
agagauggggucuugcuuuguugcccaggcug

SEQ ID NO: 45552 - RNA, 32 nt, Human
agagauggggucuugcuuuguugcccagguua

SEQ ID NO: 45553 - RNA, 32 nt, Human
agagauggggucuuguucugucaccuagggug

SEQ ID NO: 45554 - RNA, 32 nt, Human
agagaugggguuccaccauguuggccaggcug

SEQ ID NO: 45555 - RNA, 32 nt, Human
agagaugggguugaaacccccauguuggccag

SEQ ID NO: 45556 - RNA, 32 nt, Human
agagaugggguuuauccauguuggucaggcug

SEQ ID NO: 45557 - RNA, 32 nt, Human
agagaugggguuucaacauauuggccaggcug

SEQ ID NO: 45558 - RNA, 32 nt, Human
agagaugggguuucacaauuuuggccaggcug

SEQ ID NO: 45559 - RNA, 32 nt, Human
agagaugggguuucaccaaguuagccaggaug

SEQ ID NO: 45560 - RNA, 32 nt, Human
agagaugggguuucaccaaguuggcuagacua

SEQ ID NO: 45561 - RNA, 32 nt, Human
agagaugggguuucaccacauuggccaggaug

SEQ ID NO: 45562 - RNA, 32 nt, Human
agagaugggguuucaccacauuggccaggcug

SEQ ID NO: 45563 - RNA, 32 nt, Human
agagaugggguuucaccacguuagccaggaug

SEQ ID NO: 45564 - RNA, 32 nt, Human
agagaugggguuucaccacguugcccaggcug

SEQ ID NO: 45565 - RNA, 32 nt, Human
agagaugggguuucaccacguuggccacacug

SEQ ID NO: 45566 - RNA, 32 nt, Human
agagaugggguuucaccacguuggccaggaug

SEQ ID NO: 45567 - RNA, 32 nt, Human
agagaugggguuucaccacguuggccaggcua

SEQ ID NO: 45568 - RNA, 32 nt, Human
agagaugggguuucaccacguuggccagggug

SEQ ID NO: 45569 - RNA, 32 nt, Human
agagaugggguuucaccauacuggcuaggcug

SEQ ID NO: 45570 - RNA, 32 nt, Human
agagaugggguuucaccauauuggccaagcug

SEQ ID NO: 45571 - RNA, 32 nt, Human
agagaugggguuucaccauauuggccaggcug

SEQ ID NO: 45572 - RNA, 32 nt, Human
agagaugggguuucaccauauuggucacguca

SEQ ID NO: 45573 - RNA, 32 nt, Human
agagaugggguuucaccauauuggucaggcug

SEQ ID NO: 45574 - RNA, 32 nt, Human
agagaugggguuucaccaucuuggccaggcug

SEQ ID NO: 45575 - RNA, 32 nt, Human
agagaugggguuucaccaugcuggccaagcug

SEQ ID NO: 45576 - RNA, 32 nt, Human
agagaugggguuucaccaugcuggccaggcug

SEQ ID NO: 45577 - RNA, 32 nt, Human
agagaugggguuucaccauggccaggcugguc

SEQ ID NO: 45578 - RNA, 32 nt, Human
agagaugggguuucaccauguaggccaggaug

SEQ ID NO: 45579 - RNA, 32 nt, Human
agagaugggguuucaccaugucucaaacuccu

SEQ ID NO: 45580 - RNA, 32 nt, Human
agagaugggguuucaccaugugggccgggcug

SEQ ID NO: 45581 - RNA, 32 nt, Human
agagaugggguuucaccauguuaaccaggaug

SEQ ID NO: 45582 - RNA, 32 nt, Human
agagaugggguuucaccauguuaccaggaugg

SEQ ID NO: 45583 - RNA, 32 nt, Human
agagaugggguuucaccauguuagccaggaug

SEQ ID NO: 45584 - RNA, 32 nt, Human
agagaugggguuucaccauguuagccaggcug

SEQ ID NO: 45585 - RNA, 32 nt, Human
agagaugggguuucaccauguuagucaggaug

SEQ ID NO: 45586 - RNA, 32 nt, Human
agagaugggguuucaccauguugaccaggaug

SEQ ID NO: 45587 - RNA, 32 nt, Human
agagaugggguuucaccauguugaucaggcug

SEQ ID NO: 45588 - RNA, 32 nt, Human
agagaugggguuucaccauguugcccaggcug

SEQ ID NO: 45589 - RNA, 32 nt, Human
agagaugggguuucaccauguugccuaggcug

SEQ ID NO: 45590 - RNA, 32 nt, Human
agagaugggguuucaccauguugccugggcug

SEQ ID NO: 45591 - RNA, 32 nt, Human
agagaugggguuucaccauguuggacaggcug

SEQ ID NO: 45592 - RNA, 32 nt, Human
agagaugggguuucaccauguuggccagacug

SEQ ID NO: 45593 - RNA, 32 nt, Human
agagaugggguuucaccauguuggccagauga

SEQ ID NO: 45594 - RNA, 32 nt, Human
agagaugggguuucaccauguuggccaggaug

SEQ ID NO: 45595 - RNA, 32 nt, Human
agagaugggguuucaccauguuggccaggauu

SEQ ID NO: 45596 - RNA, 32 nt, Human
agagaugggguuucaccauguuggccaggcag

SEQ ID NO: 45597 - RNA, 32 nt, Human
agagaugggguuucaccauguuggccaggccg

SEQ ID NO: 45598 - RNA, 32 nt, Human
agagaugggguuucaccauguuggccaggcua

SEQ ID NO: 45599 - RNA, 32 nt, Human
agagaugggguuucaccauguuggccaggcug

SEQ ID NO: 45600 - RNA, 32 nt, Human
agagaugggguuucaccauguuggccagggug

SEQ ID NO: 45601 - RNA, 32 nt, Human
agagaugggguuucaccauguuggccagguug

SEQ ID NO: 45602 - RNA, 32 nt, Human
agagaugggguuucaccauguuggcuaggaug

SEQ ID NO: 45603 - RNA, 32 nt, Human
agagaugggguuucaccauguuggcuaggcug

SEQ ID NO: 45604 - RNA, 32 nt, Human
agagaugggguuucaccauguuggcugggcug

SEQ ID NO: 45605 - RNA, 32 nt, Human
agagaugggguuucaccauguuggucaggcag

SEQ ID NO: 45606 - RNA, 32 nt, Human
agagaugggguuucaccauguuggucaggcua

SEQ ID NO: 45607 - RNA, 32 nt, Human
agagaugggguuucaccauguuggucaggcug

SEQ ID NO: 45608 - RNA, 32 nt, Human
agagaugggguuucaccauguugguuaggcug

SEQ ID NO: 45609 - RNA, 32 nt, Human
agagaugggguuucaccauguuguccaggcug

SEQ ID NO: 45610 - RNA, 32 nt, Human
agagaugggguuucaccauguugucuaggcug

SEQ ID NO: 45611 - RNA, 32 nt, Human
agagaugggguuucaccauguuugccaggaug

SEQ ID NO: 45612 - RNA, 32 nt, Human
agagaugggguuucaccauuuuggccauucua

SEQ ID NO: 45613 - RNA, 32 nt, Human
agagaugggguuucacccagcuacucaggagg

SEQ ID NO: 45614 - RNA, 32 nt, Human
agagaugggguuucacccuauuggucaggcug

SEQ ID NO: 45615 - RNA, 32 nt, Human
agagaugggguuucacccuguuagccaggaag

SEQ ID NO: 45616 - RNA, 32 nt, Human
agagaugggguuucaccggguuagccaggaug

SEQ ID NO: 45617 - RNA, 32 nt, Human
agagaugggguuucaccguauuagccaggaug

SEQ ID NO: 45618 - RNA, 32 nt, Human
agagaugggguuucaccgugcuggccaggcug

SEQ ID NO: 45619 - RNA, 32 nt, Human
agagaugggguuucaccguguuaccaggaugg

SEQ ID NO: 45620 - RNA, 32 nt, Human
agagaugggguuucaccguguuagccaggaug

SEQ ID NO: 45621 - RNA, 32 nt, Human
agagaugggguuucaccguguuagccaggcug

SEQ ID NO: 45622 - RNA, 32 nt, Human
agagaugggguuucaccguguuaggcaggaug

SEQ ID NO: 45623 - RNA, 32 nt, Human
agagaugggguuucaccguguuagucaggaug

SEQ ID NO: 45624 - RNA, 32 nt, Human
agagaugggguuucaccguguuggccagaaug

SEQ ID NO: 45625 - RNA, 32 nt, Human
agagaugggguuucaccguguuggccaggcug

SEQ ID NO: 45626 - RNA, 32 nt, Human
agagaugggguuucaccuuguuggccagacug

SEQ ID NO: 45627 - RNA, 32 nt, Human
agagaugggguuucaccuuguuggccaggcug

SEQ ID NO: 45628 - RNA, 32 nt, Human
agagaugggguuucaccuuguuggguggccag

SEQ ID NO: 45629 - RNA, 32 nt, Human
agagaugggguuucaccuuguuggucaagcug

SEQ ID NO: 45630 - RNA, 32 nt, Human
agagaugggguuucacgauguuggccaggcug

SEQ ID NO: 45631 - RNA, 32 nt, Human
agagaugggguuucacguuguuagccaggaug

SEQ ID NO: 45632 - RNA, 32 nt, Human
agagaugggguuucacuauguugccuaggcug

SEQ ID NO: 45633 - RNA, 32 nt, Human
agagaugggguuucacuauguuggccaggcua

SEQ ID NO: 45634 - RNA, 32 nt, Human
agagaugggguuucacuauguuggccaggcug

SEQ ID NO: 45635 - RNA, 32 nt, Human
agagaugggguuucacuauguuggucaggcua

SEQ ID NO: 45636 - RNA, 32 nt, Human
agagaugggguuucacuguguuagccgggaug

SEQ ID NO: 45637 - RNA, 32 nt, Human
agagaugggguuucacuguguuggccaggcug

SEQ ID NO: 45638 - RNA, 32 nt, Human
agagaugggguuucacuguuuuggccaggcug

SEQ ID NO: 45639 - RNA, 32 nt, Human
agagaugggguuucaucacguugaccaggcug

SEQ ID NO: 45640 - RNA, 32 nt, Human
agagaugggguuucaucacguugcccaggcug

SEQ ID NO: 45641 - RNA, 32 nt, Human
agagaugggguuucaucauauuggucagggug

SEQ ID NO: 45642 - RNA, 32 nt, Human
agagaugggguuucaucauguugcccaggcug

SEQ ID NO: 45643 - RNA, 32 nt, Human
agagaugggguuucaucauguuggccaggcua

SEQ ID NO: 45644 - RNA, 32 nt, Human
agagaugggguuucaucauguuggccaggcug

SEQ ID NO: 45645 - RNA, 32 nt, Human
agagaugggguuucaucauguuggccagguug

SEQ ID NO: 45646 - RNA, 32 nt, Human
agagaugggguuucaucauguuugccagacug

SEQ ID NO: 45647 - RNA, 32 nt, Human
agagaugggguuucaucguguuagccaggaug

SEQ ID NO: 45648 - RNA, 32 nt, Human
agagaugggguuucauuauguuggccaggcug

SEQ ID NO: 45649 - RNA, 32 nt, Human
agagaugggguuuccccauguuggccaggcug

SEQ ID NO: 45650 - RNA, 32 nt, Human
agagaugggguuucgccacauugcccagguug

SEQ ID NO: 45651 - RNA, 32 nt, Human
agagaugggguuucgccagguuggccaggcug

SEQ ID NO: 45652 - RNA, 32 nt, Human
agagaugggguuucgccauguugaccaggcug

SEQ ID NO: 45653 - RNA, 32 nt, Human
agagaugggguuucgccauguugcccagcagg

SEQ ID NO: 45654 - RNA, 32 nt, Human
agagaugggguuucgccauguugcccaggcua

SEQ ID NO: 45655 - RNA, 32 nt, Human
agagaugggguuucgccauguuggccaagcug

SEQ ID NO: 45656 - RNA, 32 nt, Human
agagaugggguuucgccauguuggccacgcug

SEQ ID NO: 45657 - RNA, 32 nt, Human
agagaugggguuucgccauguuggccaggcca

SEQ ID NO: 45658 - RNA, 32 nt, Human
agagaugggguuucgccauguuggccaggcug

SEQ ID NO: 45659 - RNA, 32 nt, Human
agagaugggguuucgccauguuugucaggcug

SEQ ID NO: 45660 - RNA, 32 nt, Human
agagaugggguuucgcguguuggucaggcugg

SEQ ID NO: 45661 - RNA, 29 nt, Human
agagaugggguuucgcuauguuggccaag

SEQ ID NO: 45662 - RNA, 32 nt, Human
agagaugggguuucgcuauguuggccaggcug

SEQ ID NO: 45663 - RNA, 32 nt, Human
agagaugggguuucgucauguugcccaggcug

SEQ ID NO: 45664 - RNA, 32 nt, Human
agagaugggguuucgucauguuggccagacug

SEQ ID NO: 45665 - RNA, 32 nt, Human
agagaugggguuucucauauuggucaggcugg

SEQ ID NO: 45666 - RNA, 32 nt, Human
agagaugggguuucuccaugguggucaggcug

SEQ ID NO: 45667 - RNA, 32 nt, Human
agagaugggguuucuccauguauugcccaggc

SEQ ID NO: 45668 - RNA, 32 nt, Human
agagaugggguuucuccauguugaucagacua

SEQ ID NO: 45669 - RNA, 32 nt, Human
agagaugggguuucuccauguuggccagaaug

SEQ ID NO: 45670 - RNA, 32 nt, Human
agagaugggguuucuccauguuggccaggcug

SEQ ID NO: 45671 - RNA, 29 nt, Human
agagaugggguuucuccauguuggucagg

SEQ ID NO: 45672 - RNA, 32 nt, Human
agagaugggguuucuccauguuggucaggcug

SEQ ID NO: 45673 - RNA, 32 nt, Human
agagaugggguuucuccuuauugcccaggaug

SEQ ID NO: 45674 - RNA, 32 nt, Human
agagaugggguuucucgauguuggccaggcug

SEQ ID NO: 45675 - RNA, 32 nt, Human
agagaugggguuucucuguguugcccagucuu

SEQ ID NO: 45676 - RNA, 32 nt, Human
agagaugggguuugaccauguuggccaggaug

SEQ ID NO: 45677 - RNA, 32 nt, Human
agagaugggguuugaccauguuggccaggcug

SEQ ID NO: 45678 - RNA, 32 nt, Human
agagaugggguuugaccguguuagccaggaug

SEQ ID NO: 45679 - RNA, 32 nt, Human
agagaugggguuuggccaugauggccaggcug

SEQ ID NO: 45680 - RNA, 32 nt, Human
agagaugggguuuuaccauauugcccaggcug

SEQ ID NO: 45681 - RNA, 32 nt, Human
agagaugggguuuuaccauguggccaggcugg

SEQ ID NO: 45682 - RNA, 32 nt, Human
agagaugggguuuuaccauguuaggauggucu

SEQ ID NO: 45683 - RNA, 32 nt, Human
agagaugggguuuuaccauguuggccaggcug

SEQ ID NO: 45684 - RNA, 32 nt, Human
agagaugggguuuuaccauguuggucaggcug

SEQ ID NO: 45685 - RNA, 32 nt, Human
agagaugggguuuugccauauuggccaggcug

SEQ ID NO: 45686 - RNA, 32 nt, Human
agagaugggguuuugccauguugcccaggcug

SEQ ID NO: 45687 - RNA, 32 nt, Human
agagaugggguuuugccauguugcccaggcuu

SEQ ID NO: 45688 - RNA, 32 nt, Human
agagaugggguuuugccauguugcucaggcug

SEQ ID NO: 45689 - RNA, 32 nt, Human
agagaugggguuuugccauguuggccagacug

SEQ ID NO: 45690 - RNA, 32 nt, Human
agagaugggguuuugccauguuggccaggcug

SEQ ID NO: 45691 - RNA, 32 nt, Human
agagaugggguuuugccauguuggucaggcug

SEQ ID NO: 45692 - RNA, 32 nt, Human
agagaugggguuuugccauguuugccgggcug

SEQ ID NO: 45693 - RNA, 32 nt, Human
agagaugggguuuugccguguugcccagacug

SEQ ID NO: 45694 - RNA, 32 nt, Human
agagaugggguuuugccuuguuggccaggcug

SEQ ID NO: 45695 - RNA, 32 nt, Human
agagaugggguuuugcucugucgcccaggcug

SEQ ID NO: 45696 - RNA, 29 nt, Human
agagaugggugaggggaccuggagaggua

SEQ ID NO: 45697 - RNA, 32 nt, Human
agagauggguuuucaccauauuggucaggcug

SEQ ID NO: 45698 - RNA, 32 nt, Human
agagauggguuuucaccaugguggccaggcug

SEQ ID NO: 45699 - RNA, 32 nt, Human
agagauggguuuucgccauguugcccaggcug

SEQ ID NO: 45700 - RNA, 32 nt, Human
agagaugguaacuugcuauguuguccagauug

SEQ ID NO: 45701 - RNA, 32 nt, Human
agagaugguagcaucagcacuuaaucuuuauc

SEQ ID NO: 45702 - RNA, 32 nt, Human
agagauggucacagagggcagcagggacagga

SEQ ID NO: 45703 - RNA, 22 nt, Human
agagauggugaagagacugcau

SEQ ID NO: 45704 - RNA, 32 nt, Human
agagaugguguuucaccauguuggccaggaug

SEQ ID NO: 45705 - RNA, 32 nt, Human
agagauguauggggaucaccuuugccagagcu

SEQ ID NO: 45706 - RNA, 32 nt, Human
agagaugucauugcccuggugagccaggucuu

SEQ ID NO: 45707 - RNA, 32 nt, Human
agagaugugaaggagggaaggagcaggagagc

SEQ ID NO: 45708 - RNA, 32 nt, Human
agagaugugccaucuugcauuuggaaaguacu

SEQ ID NO: 45709 - RNA, 32 nt, Human
agagaugugcccccacccccacccucgaccac

SEQ ID NO: 45710 - RNA, 32 nt, Human
agagaugugccucauucugugccuccuucugu

SEQ ID NO: 45711 - RNA, 32 nt, Human
agagaugugccuggggaucaggccaugagaau

SEQ ID NO: 45712 - RNA, 32 nt, Human
agagauguggagaaccagggguauaacuaagg

SEQ ID NO: 45713 - RNA, 32 nt, Human
agagauguggucacacuguguugcccaggcug

SEQ ID NO: 45714 - RNA, 32 nt, Human
agagauguggucucccuguauugcccagucug

SEQ ID NO: 45715 - RNA, 32 nt, Human
agagaugugguuucuccauguuggccaggcug

SEQ ID NO: 45716 - RNA, 32 nt, Human
agagauguucaccuuuuccuugcugauugcua

SEQ ID NO: 45717 - RNA, 32 nt, Human
agagauguugagugcugagauuucaaggcuca

SEQ ID NO: 45718 - RNA, 32 nt, Human
agagauguuguuucaccauguugcccgggcug

SEQ ID NO: 45719 - RNA, 32 nt, Human
agagauguuuaaaauuuuaaacuuuuucuacc

SEQ ID NO: 45720 - RNA, 32 nt, Human
agagauguuucagaauacaaaauuaguauaug

SEQ ID NO: 45721 - RNA, 32 nt, Human
agagauuaagacuauucucccagucccacuac

SEQ ID NO: 45722 - RNA, 32 nt, Human
agagauuaaucagggaaugaaauccaggugga

SEQ ID NO: 45723 - RNA, 32 nt, Human
agagauuaccaccaccacccccuccuucagac

SEQ ID NO: 45724 - RNA, 32 nt, Human
agagauuacuccugagaugcaaacuggaguuc

SEQ ID NO: 45725 - RNA, 32 nt, Human
agagauuaguuauaccuuauaccauuauguug

SEQ ID NO: 45726 - RNA, 32 nt, Human
agagauuauuuggaauaacgugcugaguuugu

SEQ ID NO: 45727 - RNA, 32 nt, Human
agagauucaaaaccaggaucuuuaauaaucua

SEQ ID NO: 45728 - RNA, 22 nt, Human
agagauucaauuucccuggagg

SEQ ID NO: 45729 - RNA, 32 nt, Human
agagauuccaacugacagaaucugccagaagc

SEQ ID NO: 45730 - RNA, 32 nt, Human
agagauuccagaagccucuccuccccgccgcc

SEQ ID NO: 45731 - RNA, 32 nt, Human
agagauuccagugaguugagaucaugccccug

SEQ ID NO: 45732 - RNA, 32 nt, Human
agagauuccucuccuuuuacugugucuuguau

SEQ ID NO: 45733 - RNA, 32 nt, Human
agagauucuaaaacauguucagcacuuucugg

SEQ ID NO: 45734 - RNA, 32 nt, Human
agagauucuccaaggacagauggcaguggagc

SEQ ID NO: 45735 - RNA, 32 nt, Human
agagauucucuccagcggcagcagaaaacggg

SEQ ID NO: 45736 - RNA, 32 nt, Human
agagauucugaugccacugaaguuugaggagc

SEQ ID NO: 45737 - RNA, 32 nt, Human
agagauucuucuggugauguuuacuuaaaaag

SEQ ID NO: 45738 - RNA, 32 nt, Human
agagauugagagggaugucgggcaguucccau

SEQ ID NO: 45739 - RNA, 32 nt, Human
agagauugagccacugcacuccagccugggug

SEQ ID NO: 45740 - RNA, 32 nt, Human
agagauugaggcaugaggauugcuugagcuug

SEQ ID NO: 45741 - RNA, 32 nt, Human
agagauugcaccacugcacuccagucugggca

SEQ ID NO: 45742 - RNA, 32 nt, Human
agagauugcaccacugcauuccaaccugggcg

SEQ ID NO: 45743 - RNA, 32 nt, Human
agagauugcaucuggccugggagaucaggaaa

SEQ ID NO: 45744 - RNA, 20 nt, Human
agagauugcccacacucugc

SEQ ID NO: 45745 - RNA, 32 nt, Human
agagauugccugguucaucuuguagucuucca

SEQ ID NO: 45746 - RNA, 32 nt, Human
agagauugcgccacugcacucaagucugggcg

SEQ ID NO: 45747 - RNA, 32 nt, Human
agagauugcggaaaccuggugccggaaacaga

SEQ ID NO: 45748 - RNA, 32 nt, Human
agagauuggaggccaggauggagaauugguug

SEQ ID NO: 45749 - RNA, 32 nt, Human
agagauuggguuucaccauguuggccaggaug

SEQ ID NO: 45750 - RNA, 32 nt, Human
agagauugugccacugcacuccagccuggcaa

SEQ ID NO: 45751 - RNA, 32 nt, Human
agagauuucagccaaggcugggccagccuuuu

SEQ ID NO: 45752 - RNA, 32 nt, Human
agagauuucuagauugacagcuguuuuaguac

SEQ ID NO: 45753 - RNA, 32 nt, Human
agagauuugcagcccucgccccucccugagaa

SEQ ID NO: 45754 - RNA, 32 nt, Human
agagauuuuaaaggagaaaguacucuggguuu

SEQ ID NO: 45755 - RNA, 32 nt, Human
agagauuuugaaaaccaauuguauuuaaccag

SEQ ID NO: 45756 - RNA, 32 nt, Human
agagauuuugccuugaguauagcaauaauaaa

SEQ ID NO: 45757 - RNA, 32 nt, Human
agagauuuuucuuaacuaaggagugcaaguag

SEQ ID NO: 45758 - RNA, 32 nt, Human
agagcaaaaacuguaucauuucuuauaugauu

SEQ ID NO: 45759 - RNA, 32 nt, Human
agagcaaaaagggagagagcaggaaagcgagc

SEQ ID NO: 45760 - RNA, 32 nt, Human
agagcaaaaccuuccagccuugccugcuuggu

SEQ ID NO: 45761 - RNA, 32 nt, Human
agagcaaaacuaagugauagaaaauauuucac

SEQ ID NO: 45762 - RNA, 32 nt, Human
agagcaaaauggagggggaggggccagaaaua

SEQ ID NO: 45763 - RNA, 16 nt, Human
agagcaaaccauguca

SEQ ID NO: 45764 - RNA, 32 nt, Human
agagcaaacgaggucccugagagcuccaccua

SEQ ID NO: 45765 - RNA, 32 nt, Human
agagcaaagcagcgcaggggucagggaggugg

SEQ ID NO: 45766 - RNA, 32 nt, Human
agagcaaaggaaagccccugaagaaguaaaaa

SEQ ID NO: 45767 - RNA, 32 nt, Human
agagcaaaggcccagccaggagagaggacaga

SEQ ID NO: 45768 - RNA, 32 nt, Human
agagcaaagggaacccagcaguucugagugag

SEQ ID NO: 45769 - RNA, 32 nt, Human
agagcaaaugcuggcuaaagcaucuaaucacc

SEQ ID NO: 45770 - RNA, 32 nt, Human
agagcaacacaaaauggacucagcacggauca

SEQ ID NO: 45771 - RNA, 32 nt, Human
agagcaacagcagcugcaagacauuguuucuc

SEQ ID NO: 45772 - RNA, 32 nt, Human
agagcaacagcccaguccugaggaugggaggg

SEQ ID NO: 45773 - RNA, 25 nt, Human
agagcaacagccccagagccugggc

SEQ ID NO: 45774 - RNA, 32 nt, Human
agagcaacagggcaaggccuggggaagcuggg

SEQ ID NO: 45775 - RNA, 32 nt, Human
agagcaaccauguuuuagcauaaugggaugac

SEQ ID NO: 45776 - RNA, 32 nt, Human
agagcaaccuaagcuaagucacucugcgauau

SEQ ID NO: 45777 - RNA, 32 nt, Human
agagcaacggucacaaucaagucuuaaugaug

SEQ ID NO: 45778 - RNA, 32 nt, Human
agagcaacucugcagggucugcuccaagaggc

SEQ ID NO: 45779 - RNA, 20 nt, Human
agagcaacuuauuuuccaca

SEQ ID NO: 45780 - RNA, 32 nt, Human
agagcaacuucugcuugcucugagcccccugc

SEQ ID NO: 45781 - RNA, 32 nt, Human
agagcaagaagaaaggagaagccucuucuauc

SEQ ID NO: 45782 - RNA, 23 nt, Human
agagcaagaaggcguacacgagg

SEQ ID NO: 45783 - RNA, 21 nt, Human
agagcaagacccugucucuug

SEQ ID NO: 45784 - RNA, 32 nt, Human
agagcaagagaggaccuugggccccguccuag

SEQ ID NO: 45785 - RNA, 32 nt, Human
agagcaagagauucauacaggccaagugauga

SEQ ID NO: 45786 - RNA, 32 nt, Human
agagcaagcagacccagccacacugcucaaag

SEQ ID NO: 45787 - RNA, 32 nt, Human
agagcaaggccuuggcagccagcuuuucagag

SEQ ID NO: 45788 - RNA, 32 nt, Human
agagcaagggacguggacggggcagugagcca

SEQ ID NO: 45789 - RNA, 32 nt, Human
agagcaagggagggaggaaggcggugagagag

SEQ ID NO: 45790 - RNA, 32 nt, Human
agagcaaggucuucauucaugguccugagcag

SEQ ID NO: 45791 - RNA, 32 nt, Human
agagcaagguuauuguuggcucaggccuuguu

SEQ ID NO: 45792 - RNA, 32 nt, Human
agagcaaguuguacucaaagcauucaguuaaa

SEQ ID NO: 45793 - RNA, 32 nt, Human
agagcaaguuucuaaaugggagacugcugagg

SEQ ID NO: 45794 - RNA, 32 nt, Human
agagcaauauguuuccuucucuguaacagugu

SEQ ID NO: 45795 - RNA, 32 nt, Human
agagcaaucacugcacccagccaccucuauau

SEQ ID NO: 45796 - RNA, 31 nt, Human
agagcaaugaacaggagaaggagggagagag

SEQ ID NO: 45797 - RNA, 32 nt, Human
agagcaaugguacgaaaacaaggacuagagcu

SEQ ID NO: 45798 - RNA, 22 nt, Human
agagcacaagugcugcauggaa

SEQ ID NO: 45799 - RNA, 32 nt, Human
agagcacaauguaguuauucuaaugcccaguu

SEQ ID NO: 45800 - RNA, 32 nt, Human
agagcacaauuucaaaagucucugugcagugg

SEQ ID NO: 45801 - RNA, 32 nt, Human
agagcacacaagcgugaagaaaaggaucuuaa

SEQ ID NO: 45802 - RNA, 32 nt, Human
agagcacaccacugcacuccagccugggcaac

SEQ ID NO: 45803 - RNA, 32 nt, Human
agagcacacccagggcuggaaagcccuggaac

SEQ ID NO: 45804 - RNA, 32 nt, Human
agagcacacuuuaagaauccuaaagcacuaag

SEQ ID NO: 45805 - RNA, 32 nt, Human
agagcacagagaagcucccagcuuugaagguc

SEQ ID NO: 45806 - RNA, 32 nt, Human
agagcacagcuggccccggcguuucaugaagu

SEQ ID NO: 45807 - RNA, 32 nt, Human
agagcacaggcagaggaugggcggagcaaagc

SEQ ID NO: 45808 - RNA, 32 nt, Human
agagcacaguaguucagaaacuauuuagagcu

SEQ ID NO: 45809 - RNA, 32 nt, Human
agagcacaugagauguccucagcugggcuugg

SEQ ID NO: 45810 - RNA, 32 nt, Human
agagcacauggcccccagaggcuuccagucuc

SEQ ID NO: 45811 - RNA, 32 nt, Human
agagcacaugucaggggcaguggaggcuggcu

SEQ ID NO: 45812 - RNA, 32 nt, Human
agagcaccaccaggaccgggugagugagaagg

SEQ ID NO: 45813 - RNA, 32 nt, Human
agagcaccaccuucucuuuuugcccauauugc

SEQ ID NO: 45814 - RNA, 32 nt, Human
agagcaccacugaacuuagaccucucaacaca

SEQ ID NO: 45815 - RNA, 32 nt, Human
agagcaccagagaguuuucugguaauccacgc

SEQ ID NO: 45816 - RNA, 21 nt, Human
agagcaccagccugcauggaa

SEQ ID NO: 45817 - RNA, 32 nt, Human
agagcaccauaacauagcuccgaaagggagag

SEQ ID NO: 45818 - RNA, 32 nt, Human
agagcacccacuguccugaccagagucucagu

SEQ ID NO: 45819 - RNA, 32 nt, Human
agagcacccacugugaaguccuacaggaagua

SEQ ID NO: 45820 - RNA, 32 nt, Human
agagcacccgggcuugcccucaacuuugcucu

SEQ ID NO: 45821 - RNA, 22 nt, Human
agagcaccgccggggccacagg

SEQ ID NO: 45822 - RNA, 32 nt, Human
agagcaccgcugcacucgcggccggcgaugcg

SEQ ID NO: 45823 - RNA, 32 nt, Human
agagcaccugcagaggagcaggaggccggagc

SEQ ID NO: 45824 - RNA, 32 nt, Human
agagcaccugcaggaaggggcggcuguaggcg

SEQ ID NO: 45825 - RNA, 32 nt, Human
agagcaccugccugcccugccgauguguccug

SEQ ID NO: 45826 - RNA, 32 nt, Human
agagcaccuggugaugauggagaagauccuag

SEQ ID NO: 45827 - RNA, 32 nt, Human
agagcacgccacugcacuccagccugggugac

SEQ ID NO: 45828 - RNA, 32 nt, Human
agagcacgccauugcacuccacacuccagccu

SEQ ID NO: 45829 - RNA, 32 nt, Human
agagcacggcugaccauuucugcuccgggauc

SEQ ID NO: 45830 - RNA, 32 nt, Human
agagcacgugccugcauguacuugcacacagg

SEQ ID NO: 45831 - RNA, 32 nt, Human
agagcacguguuucgcggccugggcagccugg

SEQ ID NO: 45832 - RNA, 32 nt, Human
agagcacuaagauaacaccuucaagagacuug

SEQ ID NO: 45833 - RNA, 32 nt, Human
agagcacugagucucugggauucuggcaaggu

SEQ ID NO: 45834 - RNA, 32 nt, Human
agagcacugccaggacccaccacuggaagcag

SEQ ID NO: 45835 - RNA, 32 nt, Human
agagcacuggagcuggagggagcuccagccaa

SEQ ID NO: 45836 - RNA, 19 nt, Human
agagcacuggcauuuggca

SEQ ID NO: 45837 - RNA, 32 nt, Human
agagcacuggcucuccagccccaggaggagaa

SEQ ID NO: 45838 - RNA, 32 nt, Human
agagcacugugacuccagcccuggcucggagc

SEQ ID NO: 45839 - RNA, 32 nt, Human
agagcacuuccuuccagggcaaggagcaggcg

SEQ ID NO: 45840 - RNA, 32 nt, Human
agagcacuuggagauggcaaugcugaaccuca

SEQ ID NO: 45841 - RNA, 32 nt, Human
agagcacuuggagauggcaaugcugaccuaau

SEQ ID NO: 45842 - RNA, 32 nt, Human
agagcacuuggagauggcaaugcugaccucac

SEQ ID NO: 45843 - RNA, 32 nt, Human
agagcacuuuuccuugcaugaguaauuuucug

SEQ ID NO: 45844 - RNA, 32 nt, Human
agagcagaaaagcugaaaauucuaaacaucag

SEQ ID NO: 45845 - RNA, 18 nt, Human
agagcagaaauuauacug

SEQ ID NO: 45846 - RNA, 18 nt, Human
agagcagaacguuuggga

SEQ ID NO: 45847 - RNA, 32 nt, Human
agagcagaacuccaagcugcugugcugggcgu

SEQ ID NO: 45848 - RNA, 32 nt, Human
agagcagaacuccaggccucaggaaaggacug

SEQ ID NO: 45849 - RNA, 32 nt, Human
agagcagaauugagggagagaccuuucuuccu

SEQ ID NO: 45850 - RNA, 32 nt, Human
agagcagacagaaauaccccacacauucccca

SEQ ID NO: 45851 - RNA, 32 nt, Human
agagcagacauauauccugccuuuagacaaga

SEQ ID NO: 45852 - RNA, 32 nt, Human
agagcagaccaggcccgguggagaauuaggug

SEQ ID NO: 45853 - RNA, 32 nt, Human
agagcagacgccgggauccaggagaaugcucg

SEQ ID NO: 45854 - RNA, 32 nt, Human
agagcagagcagagaacuguggggaacgcugu

SEQ ID NO: 45855 - RNA, 32 nt, Human
agagcagagccgcggagucugcggcgcgggug

SEQ ID NO: 45856 - RNA, 32 nt, Human
agagcagagcugcagacaggaauaagaagaac

SEQ ID NO: 45857 - RNA, 17 nt, Human
agagcagagcuuuggga

SEQ ID NO: 45858 - RNA, 20 nt, Human
agagcagaggagggccuggg

SEQ ID NO: 45859 - RNA, 18 nt, Human
agagcagaggcccaggag

SEQ ID NO: 45860 - RNA, 32 nt, Human
agagcagaggcugaggcacggggagccagccc

SEQ ID NO: 45861 - RNA, 32 nt, Human
agagcagagggaaaggaggcuggagaggcuuc

SEQ ID NO: 45862 - RNA, 32 nt, Human
agagcagagggcaagggcugccugagccuugu

SEQ ID NO: 45863 - RNA, 32 nt, Human
agagcagaggucuucucugcaccaaccacucu

SEQ ID NO: 45864 - RNA, 32 nt, Human
agagcagagguuuagaggcacaauucugcuuu

SEQ ID NO: 45865 - RNA, 32 nt, Human
agagcagauccaggccccagaaagccucaccu

SEQ ID NO: 45866 - RNA, 32 nt, Human
agagcagaugccauuuuguacauguaugaaau

SEQ ID NO: 45867 - RNA, 32 nt, Human
agagcagauggaaacuuccuucucuaugcaca

SEQ ID NO: 45868 - RNA, 32 nt, Human
agagcagcaagucggccucccugggcccagcu

SEQ ID NO: 45869 - RNA, 32 nt, Human
agagcagcaaguucauacaacaugcauguucu

SEQ ID NO: 45870 - RNA, 32 nt, Human
agagcagcacagaaacaagcuacucugacauu

SEQ ID NO: 45871 - RNA, 32 nt, Human
agagcagcacagcucaucaguccccaaagccc

SEQ ID NO: 45872 - RNA, 32 nt, Human
agagcagcacuaccccucccaccuccaaagca

SEQ ID NO: 45873 - RNA, 32 nt, Human
agagcagcagagaaaagcugaugggagugaga

SEQ ID NO: 45874 - RNA, 22 nt, Human
agagcagcagcagagcugagua

SEQ ID NO: 45875 - RNA, 26 nt, Human
agagcagcagcauucaggccugggca

SEQ ID NO: 45876 - RNA, 23 nt, Human
agagcagcagcgacaacucagca

SEQ ID NO: 45877 - RNA, 21 nt, Human
agagcagcagcggcccaagca

SEQ ID NO: 45878 - RNA, 20 nt, Human
agagcagcagcuaccuggca

SEQ ID NO: 45879 - RNA, 19 nt, Human
agagcagcagcuacgggca

SEQ ID NO: 45880 - RNA, 31 nt, Human
agagcagcaggacccuucacagcagguccuu

SEQ ID NO: 45881 - RNA, 23 nt, Human
agagcagcaguuuucuccugggc

SEQ ID NO: 45882 - RNA, 32 nt, Human
agagcagcauaaucuacagagagacagggaca

SEQ ID NO: 45883 - RNA, 20 nt, Human
agagcagcauggggccuggg

SEQ ID NO: 45884 - RNA, 32 nt, Human
agagcagccacagaagcugugccugaagggug

SEQ ID NO: 45885 - RNA, 32 nt, Human
agagcagccacugcuacugcuaaugccaccac

SEQ ID NO: 45886 - RNA, 32 nt, Human
agagcagcccaggccaugacccugccgagcac

SEQ ID NO: 45887 - RNA, 32 nt, Human
agagcagcccauuuuccucuggauucauugau

SEQ ID NO: 45888 - RNA, 32 nt, Human
agagcagccucaccaggcagggcucuggcuag

SEQ ID NO: 45889 - RNA, 22 nt, Human
agagcagcgcuggcaucgggca

SEQ ID NO: 45890 - RNA, 32 nt, Human
agagcagcggccuguaccugcaggcagguaga

SEQ ID NO: 45891 - RNA, 32 nt, Human
agagcagcgggcacuccuuccugggcagggug

SEQ ID NO: 45892 - RNA, 32 nt, Human
agagcagcgucccagcccuguuuuccaggacu

SEQ ID NO: 45893 - RNA, 32 nt, Human
agagcagcgucuucuguguuuccuucaugugu

SEQ ID NO: 45894 - RNA, 32 nt, Human
agagcagcucacuucucuguguucugccuccc

SEQ ID NO: 45895 - RNA, 32 nt, Human
agagcagcucuggcagagaccucugcccuccu

SEQ ID NO: 45896 - RNA, 32 nt, Human
agagcagcugaaaucacaaaaccuggaagacu

SEQ ID NO: 45897 - RNA, 24 nt, Human
agagcagcuggccggccccaggca

SEQ ID NO: 45898 - RNA, 32 nt, Human
agagcagcuggcuccauuggcuucucccugca

SEQ ID NO: 45899 - RNA, 32 nt, Human
agagcagcugggggcccugccugugccgucgc

SEQ ID NO: 45900 - RNA, 32 nt, Human
agagcagcuuagaggaucucccaaggaugaaa

SEQ ID NO: 45901 - RNA, 23 nt, Human
agagcaggaagaggcgcccugug

SEQ ID NO: 45902 - RNA, 32 nt, Human
agagcaggaaggacaggaagcuggcagaacgg

SEQ ID NO: 45903 - RNA, 22 nt, Human
agagcaggaaggagaguccugu

SEQ ID NO: 45904 - RNA, 32 nt, Human
agagcaggacagugaugguguccccagggcug

SEQ ID NO: 45905 - RNA, 32 nt, Human
agagcaggacaugagacauagauacagugggg

SEQ ID NO: 45906 - RNA, 32 nt, Human
agagcaggaccacaucgauaguauuuaauaau

SEQ ID NO: 45907 - RNA, 32 nt, Human
agagcaggacucacagguuggaagagaaucac

SEQ ID NO: 45908 - RNA, 32 nt, Human
agagcaggagcaggaaaaggaggcucagcacu

SEQ ID NO: 45909 - RNA, 32 nt, Human
agagcaggagccaggccaggcgggagggaaag

SEQ ID NO: 45910 - RNA, 32 nt, Human
agagcaggaggcagagcccgcgggaagcucgg

SEQ ID NO: 45911 - RNA, 19 nt, Human
agagcaggagggagacuga

SEQ ID NO: 45912 - RNA, 22 nt, Human
agagcaggaggggccugucucc

SEQ ID NO: 45913 - RNA, 32 nt, Human
agagcaggauagcucuuccuccccaggacuug

SEQ ID NO: 45914 - RNA, 32 nt, Human
agagcaggcaggcagaguggagagggagagac

SEQ ID NO: 45915 - RNA, 32 nt, Human
agagcaggcagggcacagcagagcaggcugga

SEQ ID NO: 45916 - RNA, 32 nt, Human
agagcaggccccaguccuccugggaggcuggc

SEQ ID NO: 45917 - RNA, 21 nt, Human
agagcaggccugccagccccu

SEQ ID NO: 45918 - RNA, 22 nt, Human
agagcaggcucagacucugggu

SEQ ID NO: 45919 - RNA, 32 nt, Human
agagcagggaaaggcagccccagagggauccc

SEQ ID NO: 45920 - RNA, 32 nt, Human
agagcagggaggaaaaguuaggguagauuauu

SEQ ID NO: 45921 - RNA, 32 nt, Human
agagcagggaggaagcagagcagugcuuagaa

SEQ ID NO: 45922 - RNA, 32 nt, Human
agagcagggcugcauuuccagcaggagcugcg

SEQ ID NO: 45923 - RNA, 32 nt, Human
agagcagggcuggagggaaggagccaggaggg

SEQ ID NO: 45924 - RNA, 32 nt, Human
agagcagggcugggcgccucuguccuggcccg

SEQ ID NO: 45925 - RNA, 32 nt, Human
agagcaggggagccaccagccacaggcagcca

SEQ ID NO: 45926 - RNA, 32 nt, Human
agagcagggucugggcuccugccucaccgcug

SEQ ID NO: 45927 - RNA, 32 nt, Human
agagcaggguuccgagucugaggaagacauaa

SEQ ID NO: 45928 - RNA, 32 nt, Human
agagcaggugacaaggaugacuaaggucagag

SEQ ID NO: 45929 - RNA, 32 nt, Human
agagcagguuccugucaauguucugaguucga

SEQ ID NO: 45930 - RNA, 32 nt, Human
agagcagguuguaggcacagaggaugggcagc

SEQ ID NO: 45931 - RNA, 32 nt, Human
agagcagucgcuccagccggggcugcaggugg

SEQ ID NO: 45932 - RNA, 32 nt, Human
agagcagugagccagccccuccuccgaccaag

SEQ ID NO: 45933 - RNA, 32 nt, Human
agagcagugagggggagacucacccacccucu

SEQ ID NO: 45934 - RNA, 32 nt, Human
agagcagugcacuccagucugcagguacugca

SEQ ID NO: 45935 - RNA, 32 nt, Human
agagcagugcugaucacuggauccuguaugug

SEQ ID NO: 45936 - RNA, 32 nt, Human
agagcaguggacacaucucagcaggucggucu

SEQ ID NO: 45937 - RNA, 32 nt, Human
agagcauaaggcuucagggcccaaguugggag

SEQ ID NO: 45938 - RNA, 32 nt, Human
agagcauacaccaaugauuauuucucacaguu

SEQ ID NO: 45939 - RNA, 32 nt, Human
agagcauacgccaggagccuccugccucaaag

SEQ ID NO: 45940 - RNA, 32 nt, Human
agagcauaggaaaccacacagacuugggcagg

SEQ ID NO: 45941 - RNA, 32 nt, Human
agagcauccaugagucaagcccccuccccaca

SEQ ID NO: 45942 - RNA, 32 nt, Human
agagcaucccauagccaggaugauaguggacu

SEQ ID NO: 45943 - RNA, 32 nt, Human
agagcauccccuuccuccuuucccuggccacu

SEQ ID NO: 45944 - RNA, 22 nt, Human
agagcaucccguguggauauga

SEQ ID NO: 45945 - RNA, 32 nt, Human
agagcauccuccuuagagaaaggucaguguug

SEQ ID NO: 45946 - RNA, 32 nt, Human
agagcaucgauucucauucucucccucucccu

SEQ ID NO: 45947 - RNA, 26 nt, Human
agagcaucuaaccugaugcucuugga

SEQ ID NO: 45948 - RNA, 32 nt, Human
agagcaucuccucuuaaggauacgugccuugg

SEQ ID NO: 45949 - RNA, 32 nt, Human
agagcaucucugaggaacaaaggugccagggc

SEQ ID NO: 45950 - RNA, 32 nt, Human
agagcaucuuggacacauuucuccccugagaa

SEQ ID NO: 45951 - RNA, 32 nt, Human
agagcaugaaugggccuacaccugccaaggcu

SEQ ID NO: 45952 - RNA, 22 nt, Human
agagcaugaucaugaguccugu

SEQ ID NO: 45953 - RNA, 32 nt, Human
agagcaugaucuguuuggccacaugcaagugu

SEQ ID NO: 45954 - RNA, 32 nt, Human
agagcaugccgcugcacuccagccugggagac

SEQ ID NO: 45955 - RNA, 32 nt, Human
agagcaugcucacccagcucugcuccaaggcc

SEQ ID NO: 45956 - RNA, 32 nt, Human
agagcaugcugggucugcaucuccucucgucu

SEQ ID NO: 45957 - RNA, 23 nt, Human
agagcaugggcugggccugggca

SEQ ID NO: 45958 - RNA, 32 nt, Human
agagcauugaucauuucucuccccuucaugaa

SEQ ID NO: 45959 - RNA, 32 nt, Human
agagcauugccauccauucaaaccagauuagg

SEQ ID NO: 45960 - RNA, 32 nt, Human
agagcauugccauucccugccuggggcgggcc

SEQ ID NO: 45961 - RNA, 32 nt, Human
agagcauuggggcuggaguguuccggcaaaga

SEQ ID NO: 45962 - RNA, 20 nt, Human
agagcauuucagccagagga

SEQ ID NO: 45963 - RNA, 32 nt, Human
agagcauuuuaaauucaggaagugguucugga

SEQ ID NO: 45964 - RNA, 32 nt, Human
agagcauuuuacaagaguucugaccuggaugg

SEQ ID NO: 45965 - RNA, 32 nt, Human
agagcauuuugacaaagacagaggacuuggac

SEQ ID NO: 45966 - RNA, 32 nt, Human
agagccaaaaacaaauagugccaucugcccca

SEQ ID NO: 45967 - RNA, 32 nt, Human
agagccaaaaucagagcuggaaccugaggaga

SEQ ID NO: 45968 - RNA, 32 nt, Human
agagccaaaaugucacaguuccuaucugugag

SEQ ID NO: 45969 - RNA, 21 nt, Human
agagccaagacccucggccuc

SEQ ID NO: 45970 - RNA, 32 nt, Human
agagccaagcaacacacaccuccuugggccca

SEQ ID NO: 45971 - RNA, 32 nt, Human
agagccaagccgccagcgcugcgaugugggcc

SEQ ID NO: 45972 - RNA, 21 nt, Human
agagccaagccucucaaccuc

SEQ ID NO: 45973 - RNA, 32 nt, Human
agagccaaggguuuauugugaagaacugucau

SEQ ID NO: 45974 - RNA, 32 nt, Human
agagccaaggugcaauguagcaggacaacuca

SEQ ID NO: 45975 - RNA, 32 nt, Human
agagccaaguaaagacagaggcagggacugaa

SEQ ID NO: 45976 - RNA, 24 nt, Human
agagccacaaaacaaaacacaaca

SEQ ID NO: 45977 - RNA, 32 nt, Human
agagccacaagaagagccggagagggaaugag

SEQ ID NO: 45978 - RNA, 32 nt, Human
agagccacagaaucaugagugcagagcugugg

SEQ ID NO: 45979 - RNA, 32 nt, Human
agagccacaggccagacccggcgagggcaccg

SEQ ID NO: 45980 - RNA, 32 nt, Human
agagccacagucaggggccuucugagaccugu

SEQ ID NO: 45981 - RNA, 32 nt, Human
agagccacaucaggacuugcugugcauuucaa

SEQ ID NO: 45982 - RNA, 32 nt, Human
agagccaccaagagaggaaggagaaggguccc

SEQ ID NO: 45983 - RNA, 20 nt, Human
agagccaccaagccugccag

SEQ ID NO: 45984 - RNA, 32 nt, Human
agagccaccagccaugcccgggaucguggugu

SEQ ID NO: 45985 - RNA, 32 nt, Human
agagccaccgccccggacuucucccucuguca

SEQ ID NO: 45986 - RNA, 22 nt, Human
agagccaccugccagccucgcu

SEQ ID NO: 45987 - RNA, 32 nt, Human
agagccacuaguggacgccagguccagccagc

SEQ ID NO: 45988 - RNA, 32 nt, Human
agagccacucacugucauucugcucugaccuu

SEQ ID NO: 45989 - RNA, 32 nt, Human
agagccacugccuccccugccuccccugccug

SEQ ID NO: 45990 - RNA, 32 nt, Human
agagccacugggggaauaggggcuugcucuca

SEQ ID NO: 45991 - RNA, 17 nt, Human
agagccacugucugagc

SEQ ID NO: 45992 - RNA, 20 nt, Human
agagccagaaauauuuuccu

SEQ ID NO: 45993 - RNA, 22 nt, Human
agagccagaagcugcccuuccu

SEQ ID NO: 45994 - RNA, 23 nt, Human
agagccagaaguagccgcccgcu

SEQ ID NO: 45995 - RNA, 24 nt, Human
agagccagaaguucuaugccuccu

SEQ ID NO: 45996 - RNA, 32 nt, Human
agagccagaaugacuuuuccacccucgggcug

SEQ ID NO: 45997 - RNA, 18 nt, Human
agagccagagacccaaga

SEQ ID NO: 45998 - RNA, 27 nt, Human
agagccagagacuucuugggccuuccu

SEQ ID NO: 45999 - RNA, 22 nt, Human
agagccagagauuccuccuccu

SEQ ID NO: 46000 - RNA, 32 nt, Human
agagccagagcugugcagggaggaagggguga

SEQ ID NO: 46001 - RNA, 24 nt, Human
agagccagaggugcuugcuguccu

SEQ ID NO: 46002 - RNA, 23 nt, Human
agagccagaguguacacauuccu

SEQ ID NO: 46003 - RNA, 32 nt, Human
agagccagcgagcauaugcugcaugaggaccu

SEQ ID NO: 46004 - RNA, 21 nt, Human
agagccagcgcugcgcuguca

SEQ ID NO: 46005 - RNA, 32 nt, Human
agagccagcugcuugcucacagccacauuucc

SEQ ID NO: 46006 - RNA, 32 nt, Human
agagccaggaaaugcauccucccacagagccc

SEQ ID NO: 46007 - RNA, 32 nt, Human
agagccaggagcccuucaaggucuccacagag

SEQ ID NO: 46008 - RNA, 26 nt, Human
agagccaggagucaagugcagugcca

SEQ ID NO: 46009 - RNA, 20 nt, Human
agagccaggcccggcccucc

SEQ ID NO: 46010 - RNA, 32 nt, Human
agagccaggguaaggggaucugcuagaaguug

SEQ ID NO: 46011 - RNA, 32 nt, Human
agagccagggucucacuauguugcccaggcag

SEQ ID NO: 46012 - RNA, 32 nt, Human
agagccaggguuuugccauguuggccaggcug

SEQ ID NO: 46013 - RNA, 24 nt, Human
agagccaggugcugccagccugcc

SEQ ID NO: 46014 - RNA, 32 nt, Human
agagccaguagagacagcuguagauaacaaua

SEQ ID NO: 46015 - RNA, 32 nt, Human
agagccagucucuagcccaugaccagcacuca

SEQ ID NO: 46016 - RNA, 32 nt, Human
agagccagucuucugcgguuucuugaagaaug

SEQ ID NO: 46017 - RNA, 32 nt, Human
agagccagugucucccagcccacauaggaggu

SEQ ID NO: 46018 - RNA, 32 nt, Human
agagccaguuggagccaggaacaggcaggagc

SEQ ID NO: 46019 - RNA, 24 nt, Human
agagccaucacggugcggaagcuc

SEQ ID NO: 46020 - RNA, 21 nt, Human
agagccaucuuccccagugga

SEQ ID NO: 46021 - RNA, 32 nt, Human
agagccaugcgguucaugagugcagcgugcug

SEQ ID NO: 46022 - RNA, 32 nt, Human
agagccaugcugucuagucuugaagucccuca

SEQ ID NO: 46023 - RNA, 22 nt, Human
agagccauggcugacagugcca

SEQ ID NO: 46024 - RNA, 32 nt, Human
agagccauuucaaucuugacuuccuagucgag

SEQ ID NO: 46025 - RNA, 32 nt, Human
agagcccaagauggaauggaaggugaaaauua

SEQ ID NO: 46026 - RNA, 20 nt, Human
agagcccaaggaccaugccu

SEQ ID NO: 46027 - RNA, 32 nt, Human
agagcccaaggaguucugggagagggaccaga

SEQ ID NO: 46028 - RNA, 32 nt, Human
agagcccaaggguuugaggagccuucuaugac

SEQ ID NO: 46029 - RNA, 19 nt, Human
agagcccacacccaugccc

SEQ ID NO: 46030 - RNA, 32 nt, Human
agagcccacauguagcccugagguucccuucc

SEQ ID NO: 46031 - RNA, 32 nt, Human
agagcccacauguagcccugagguuuccuucc

SEQ ID NO: 46032 - RNA, 32 nt, Human
agagcccaccaccaccauggcccaggauggag

SEQ ID NO: 46033 - RNA, 32 nt, Human
agagcccaccuguggaaggacauggcggggcg

SEQ ID NO: 46034 - RNA, 32 nt, Human
agagcccagaagccacgugcagagaccuagcc

SEQ ID NO: 46035 - RNA, 32 nt, Human
agagcccagaggugccuggggcugagugugag

SEQ ID NO: 46036 - RNA, 23 nt, Human
agagcccagccaucuuucacuga

SEQ ID NO: 46037 - RNA, 18 nt, Human
agagcccagcuugccagg

SEQ ID NO: 46038 - RNA, 32 nt, Human
agagcccaggagguugagaaugcagugagcuu

SEQ ID NO: 46039 - RNA, 32 nt, Human
agagcccaggcuccgggguccacagcacagga

SEQ ID NO: 46040 - RNA, 32 nt, Human
agagcccaguaggaggggcaggaggccgacac

SEQ ID NO: 46041 - RNA, 32 nt, Human
agagcccauacagcacagugagagagacagau

SEQ ID NO: 46042 - RNA, 21 nt, Human
agagcccaugccugccuuccu

SEQ ID NO: 46043 - RNA, 32 nt, Human
agagcccaugguguguuucugauuugagucca

SEQ ID NO: 46044 - RNA, 32 nt, Human
agagcccaugugcugagccacugugcuauacu

SEQ ID NO: 46045 - RNA, 32 nt, Human
agagcccauucugcaagaccuggcugagccag

SEQ ID NO: 46046 - RNA, 32 nt, Human
agagccccaagcaggacgaaaaagaggcauac

SEQ ID NO: 46047 - RNA, 32 nt, Human
agagccccacccauccuuccucugcgcccacc

SEQ ID NO: 46048 - RNA, 32 nt, Human
agagccccaccgcgaaccacaggaagccaucc

SEQ ID NO: 46049 - RNA, 32 nt, Human
agagccccagagagaggagcugggagcggagg

SEQ ID NO: 46050 - RNA, 32 nt, Human
agagccccagcagcaagagcaacgacacccug

SEQ ID NO: 46051 - RNA, 32 nt, Human
agagccccagccacagagacaggcuacgugua

SEQ ID NO: 46052 - RNA, 32 nt, Human
agagccccagccccagaauucccaggaauuuc

SEQ ID NO: 46053 - RNA, 32 nt, Human
agagccccagccccucaugucuugccgcccuu

SEQ ID NO: 46054 - RNA, 32 nt, Human
agagccccaggcucccccuccaccgccuccgc

SEQ ID NO: 46055 - RNA, 28 nt, Human
agagccccaggugcugccccuucucucc

SEQ ID NO: 46056 - RNA, 32 nt, Human
agagccccagucuccagccccuucccuagcac

SEQ ID NO: 46057 - RNA, 32 nt, Human
agagcccccacccggcaccacacagaccccau

SEQ ID NO: 46058 - RNA, 32 nt, Human
agagcccccagaggagugugagucccaggggu

SEQ ID NO: 46059 - RNA, 32 nt, Human
agagcccccaggagacugggacccaaagaacu

SEQ ID NO: 46060 - RNA, 32 nt, Human
agagcccccggagcccucccagcccucaggcc

SEQ ID NO: 46061 - RNA, 32 nt, Human
agagcccccggugggagccaggccgggacgcg

SEQ ID NO: 46062 - RNA, 32 nt, Human
agagcccccucgggcaaugcgacccagaaccg

SEQ ID NO: 46063 - RNA, 32 nt, Human
agagcccccugagcucagcccucugccuggag

SEQ ID NO: 46064 - RNA, 32 nt, Human
agagcccccugcccugcccugccccgugucca

SEQ ID NO: 46065 - RNA, 32 nt, Human
agagcccccugcucugcugcucugccuguccg

SEQ ID NO: 46066 - RNA, 32 nt, Human
agagccccucauccuuccucugggaccagaug

SEQ ID NO: 46067 - RNA, 32 nt, Human
agagccccuccaccucaggccccagccccugc

SEQ ID NO: 46068 - RNA, 32 nt, Human
agagccccuccccaucuuccucucucuaaaaa

SEQ ID NO: 46069 - RNA, 32 nt, Human
agagccccugaacaguaaaguuuugcuccagc

SEQ ID NO: 46070 - RNA, 32 nt, Human
agagcccgauuuccucaggaggcaugucgggc

SEQ ID NO: 46071 - RNA, 32 nt, Human
agagcccuaagaaggacacagagccggggagc

SEQ ID NO: 46072 - RNA, 32 nt, Human
agagcccuauccagcacacugcuccuuccccc

SEQ ID NO: 46073 - RNA, 24 nt, Human
agagcccucagcccagacccugug

SEQ ID NO: 46074 - RNA, 32 nt, Human
agagcccucagucggggcaggccaggggaggg

SEQ ID NO: 46075 - RNA, 32 nt, Human
agagcccuccagaauacccaucauauagcccc

SEQ ID NO: 46076 - RNA, 32 nt, Human
agagcccugaccucaucuuccaccucagcaac

SEQ ID NO: 46077 - RNA, 32 nt, Human
agagcccugcaaccagcaguccagggagaagu

SEQ ID NO: 46078 - RNA, 32 nt, Human
agagcccugcaagcugagccaccgggagggga

SEQ ID NO: 46079 - RNA, 32 nt, Human
agagcccugcagcucuaagauauuagcuacuu

SEQ ID NO: 46080 - RNA, 32 nt, Human
agagcccuggagagguggggagcugcugaagg

SEQ ID NO: 46081 - RNA, 21 nt, Human
agagcccugggggugcuguuc

SEQ ID NO: 46082 - RNA, 32 nt, Human
agagcccuucaagaggagagucuggggaugga

SEQ ID NO: 46083 - RNA, 32 nt, Human
agagcccuucacaaaugugaacuuuaaaauca

SEQ ID NO: 46084 - RNA, 32 nt, Human
agagcccuuucucccauccauuggagguccca

SEQ ID NO: 46085 - RNA, 32 nt, Human
agagccgagaaggaggaggaggagagaggaaa

SEQ ID NO: 46086 - RNA, 32 nt, Human
agagccgagaggagggaagccaggggucccag

SEQ ID NO: 46087 - RNA, 32 nt, Human
agagccgcaggugugugcugcuaugacaucuc

SEQ ID NO: 46088 - RNA, 32 nt, Human
agagccgcaguccagucuuggauccuucagag

SEQ ID NO: 46089 - RNA, 32 nt, Human
agagccgccaggaccuggagcugcacgguugc

SEQ ID NO: 46090 - RNA, 32 nt, Human
agagccgccauccacaggaucucccucgagac

SEQ ID NO: 46091 - RNA, 32 nt, Human
agagccgcccaagaugauagacaggagcugaa

SEQ ID NO: 46092 - RNA, 32 nt, Human
agagccgccuccaugugguuucggagucgagg

SEQ ID NO: 46093 - RNA, 32 nt, Human
agagccgcucagcuccguucacucucugccuu

SEQ ID NO: 46094 - RNA, 32 nt, Human
agagccgcugcucugggaagugaguucgccug

SEQ ID NO: 46095 - RNA, 32 nt, Human
agagccgcuguuccucuccugccuuuagagag

SEQ ID NO: 46096 - RNA, 22 nt, Human
agagccgcuuaugggugugguc

SEQ ID NO: 46097 - RNA, 32 nt, Human
agagccggaaccgggcgggcagaggggcgcuc

SEQ ID NO: 46098 - RNA, 32 nt, Human
agagccggcaggcggcggcggugguggcgggg

SEQ ID NO: 46099 - RNA, 21 nt, Human
agagccggcccgccucuccuc

SEQ ID NO: 46100 - RNA, 32 nt, Human
agagccggcucaaucaaauccuacggauaaag

SEQ ID NO: 46101 - RNA, 32 nt, Human
agagccgggaggcagagggaguagugaccgcc

SEQ ID NO: 46102 - RNA, 32 nt, Human
agagccgggccuggccuguccuacugugugug

SEQ ID NO: 46103 - RNA, 32 nt, Human
agagccgggguuucaccaucuuggccaggcug

SEQ ID NO: 46104 - RNA, 24 nt, Human
agagccgucccgcgccgcccgcuc

SEQ ID NO: 46105 - RNA, 32 nt, Human
agagccguggccaggagaaccccuugccaccu

SEQ ID NO: 46106 - RNA, 32 nt, Human
agagccguucuucaccacgccugggcccaugu

SEQ ID NO: 46107 - RNA, 32 nt, Human
agagccuaagccgccuccauggccccaggaag

SEQ ID NO: 46108 - RNA, 32 nt, Human
agagccuacaagcacagaaacuaguuauagau

SEQ ID NO: 46109 - RNA, 32 nt, Human
agagccuaugguauguggaugugaucaaacca

SEQ ID NO: 46110 - RNA, 32 nt, Human
agagccucaaagcuuccaggccaagacaagca

SEQ ID NO: 46111 - RNA, 32 nt, Human
agagccucacaggcugaguucuugccucugug

SEQ ID NO: 46112 - RNA, 32 nt, Human
agagccucagccacuagcugcgaugcauguga

SEQ ID NO: 46113 - RNA, 32 nt, Human
agagccucagccagcccaggauccguccucau

SEQ ID NO: 46114 - RNA, 32 nt, Human
agagccucagggguuucuagccccagaucuag

SEQ ID NO: 46115 - RNA, 26 nt, Human
agagccucaguaaacccauggaacac

SEQ ID NO: 46116 - RNA, 32 nt, Human
agagccucauuucccgcuggaucguccucugc

SEQ ID NO: 46117 - RNA, 32 nt, Human
agagccuccagaggaaugcagcccuguugauc

SEQ ID NO: 46118 - RNA, 32 nt, Human
agagccuccaucugccaagaacauucaguugg

SEQ ID NO: 46119 - RNA, 32 nt, Human
agagccucccaaagugcuggcuaccugcugag

SEQ ID NO: 46120 - RNA, 32 nt, Human
agagccucccaaaguguugggauuacaggcau

SEQ ID NO: 46121 - RNA, 32 nt, Human
agagccuccuauucuucucuguccucauaaau

SEQ ID NO: 46122 - RNA, 32 nt, Human
agagccuccugggugucaaguacucuguugug

SEQ ID NO: 46123 - RNA, 32 nt, Human
agagccucgcugucuguccuccguccucccga

SEQ ID NO: 46124 - RNA, 32 nt, Human
agagccucguaccaaucucucugucuuuaaaa

SEQ ID NO: 46125 - RNA, 32 nt, Human
agagccucucaguaggagcagaaaaguuacug

SEQ ID NO: 46126 - RNA, 32 nt, Human
agagccucucucuuuuccuguuucuuggcucu

SEQ ID NO: 46127 - RNA, 32 nt, Human
agagccucugugggaaugcuuggcagcccaug

SEQ ID NO: 46128 - RNA, 32 nt, Human
agagccucuuucuccccagagcccccggccca

SEQ ID NO: 46129 - RNA, 31 nt, Human
agagccugaaaacuguuuucacuggguucca

SEQ ID NO: 46130 - RNA, 32 nt, Human
agagccugaagacauugggaaaggcugggccu

SEQ ID NO: 46131 - RNA, 32 nt, Human
agagccugacaccucugcagggaauucuacca

SEQ ID NO: 46132 - RNA, 32 nt, Human
agagccugagccacugcgccccgccagacguc

SEQ ID NO: 46133 - RNA, 32 nt, Human
agagccugagcucccagccacugaggaggggu

SEQ ID NO: 46134 - RNA, 32 nt, Human
agagccugagucacucuccccaggagacccag

SEQ ID NO: 46135 - RNA, 32 nt, Human
agagccugcaaggagcucccgagucugaggac

SEQ ID NO: 46136 - RNA, 32 nt, Human
agagccugcaggugccuuggccgcgugcauag

SEQ ID NO: 46137 - RNA, 32 nt, Human
agagccugccacccucccccuucaaugcaccu

SEQ ID NO: 46138 - RNA, 32 nt, Human
agagccugccagccacagcaaucaggacucac

SEQ ID NO: 46139 - RNA, 32 nt, Human
agagccugcgaggucaagcugcagagaacaug

SEQ ID NO: 46140 - RNA, 32 nt, Human
agagccugcucuaugcggaucuggaccaucua

SEQ ID NO: 46141 - RNA, 32 nt, Human
agagccugcugcagugcagcccagggagaugc

SEQ ID NO: 46142 - RNA, 32 nt, Human
agagccugcuguccucccugccuuccaccuug

SEQ ID NO: 46143 - RNA, 32 nt, Human
agagccuggaaagauucgaagugucacagaga

SEQ ID NO: 46144 - RNA, 32 nt, Human
agagccuggacaccuccagccuucaauaaaua

SEQ ID NO: 46145 - RNA, 32 nt, Human
agagccuggacagauguaaugagaacuaaaga

SEQ ID NO: 46146 - RNA, 32 nt, Human
agagccuggaccuacagcgcuguugguggagg

SEQ ID NO: 46147 - RNA, 32 nt, Human
agagccuggcaagagcuccugaaccaguuuca

SEQ ID NO: 46148 - RNA, 32 nt, Human
agagccuggccuccaaaccccauaaagugguc

SEQ ID NO: 46149 - RNA, 32 nt, Human
agagccuggccugcucuugugggcugugguug

SEQ ID NO: 46150 - RNA, 32 nt, Human
agagccuggccuggccccuggccuuggcugca

SEQ ID NO: 46151 - RNA, 32 nt, Human
agagccuggccugggagccaggauggccaucc

SEQ ID NO: 46152 - RNA, 29 nt, Human
agagccugggaacuuucaucccccacuga

SEQ ID NO: 46153 - RNA, 32 nt, Human
agagccugggcaacaagagcgaaacuccgucu

SEQ ID NO: 46154 - RNA, 21 nt, Human
agagccugggcaacauaguga

SEQ ID NO: 46155 - RNA, 32 nt, Human
agagccugggcaacauagugagaccccaucuc

SEQ ID NO: 46156 - RNA, 32 nt, Human
agagccugggcugggcccgguggaggcuccug

SEQ ID NO: 46157 - RNA, 32 nt, Human
agagccuggggcaucccagagcccagggcauc

SEQ ID NO: 46158 - RNA, 32 nt, Human
agagccugggggucaaguguucccuggcucgc

SEQ ID NO: 46159 - RNA, 32 nt, Human
agagccuggggucugggugggagaagcgugac

SEQ ID NO: 46160 - RNA, 32 nt, Human
agagccugguacgcugggaggcuggucugggg

SEQ ID NO: 46161 - RNA, 32 nt, Human
agagccugguuggccauucucaugcccaccag

SEQ ID NO: 46162 - RNA, 32 nt, Human
agagccuguaccaccaauguuucaagaggagc

SEQ ID NO: 46163 - RNA, 32 nt, Human
agagccuguaucuggauuuagcacuugaaaga

SEQ ID NO: 46164 - RNA, 24 nt, Human
agagccuguccauugggugcaguc

SEQ ID NO: 46165 - RNA, 23 nt, Human
agagccugucgagggugccaguu

SEQ ID NO: 46166 - RNA, 32 nt, Human
agagccugucguuccucccgcuaaggucagcc

SEQ ID NO: 46167 - RNA, 32 nt, Human
agagccuguggggugacucggagcagcaggug

SEQ ID NO: 46168 - RNA, 32 nt, Human
agagccugugugugugcaugcaggggugaggu

SEQ ID NO: 46169 - RNA, 32 nt, Human
agagccuuagacccagcacgccuuggauuagc

SEQ ID NO: 46170 - RNA, 32 nt, Human
agagccuuagacccagcacuccuuggauuggc

SEQ ID NO: 46171 - RNA, 32 nt, Human
agagccuugaagggaaccucacaggcuuagcc

SEQ ID NO: 46172 - RNA, 32 nt, Human
agagccuuggccgggaaggagcgcggccaguc

SEQ ID NO: 46173 - RNA, 32 nt, Human
agagccuuggugggugagagagggagcucuuc

SEQ ID NO: 46174 - RNA, 19 nt, Human
agagccuuuagucauuuua

SEQ ID NO: 46175 - RNA, 32 nt, Human
agagccuuuccucugcaagugggacugaaacu

SEQ ID NO: 46176 - RNA, 32 nt, Human
agagcgaccgcugcucggccugcugugccaca

SEQ ID NO: 46177 - RNA, 32 nt, Human
agagcgacuucuuuugcuaugaguaauacauu

SEQ ID NO: 46178 - RNA, 32 nt, Human
agagcgagaagagagagagggcgagcugggcc

SEQ ID NO: 46179 - RNA, 32 nt, Human
agagcgagcaggggagagcgagaccaguuuua

SEQ ID NO: 46180 - RNA, 31 nt, Human
agagcgagcgagagagaaaggguucuggauu

SEQ ID NO: 46181 - RNA, 32 nt, Human
agagcgagcgagagagauuuccuuggaaauuu

SEQ ID NO: 46182 - RNA, 32 nt, Human
agagcgagcucccacugcuccuugggaauggu

SEQ ID NO: 46183 - RNA, 32 nt, Human
agagcgagcugccaaccugcugugcugagacu

SEQ ID NO: 46184 - RNA, 32 nt, Human
agagcgaggcggggcagugaggacuccgcgac

SEQ ID NO: 46185 - RNA, 20 nt, Human
agagcgagggccccacacug

SEQ ID NO: 46186 - RNA, 16 nt, Human
agagcgaguacuuuug

SEQ ID NO: 46187 - RNA, 32 nt, Human
agagcgagucucggagaagaugugguggcuuc

SEQ ID NO: 46188 - RNA, 32 nt, Human
agagcgauuuguguccuuucuuaugaaccuuc

SEQ ID NO: 46189 - RNA, 32 nt, Human
agagcgcaaagugcuagccacuggaaaugcau

SEQ ID NO: 46190 - RNA, 32 nt, Human
agagcgcaccauugcacuccagccuugggcga

SEQ ID NO: 46191 - RNA, 32 nt, Human
agagcgcacugaggggcuccaggucggcccgc

SEQ ID NO: 46192 - RNA, 32 nt, Human
agagcgcagugcacucccgugcucugggacac

SEQ ID NO: 46193 - RNA, 17 nt, Human
agagcgcccuccaggga

SEQ ID NO: 46194 - RNA, 16 nt, Human
agagcgccggccccuc

SEQ ID NO: 46195 - RNA, 32 nt, Human
agagcgccgucuccacaagaguuuacaaauga

SEQ ID NO: 46196 - RNA, 15 nt, Human
agagcgccucuccuc

SEQ ID NO: 46197 - RNA, 32 nt, Human
agagcgccugggacagcuuguccgccaggcuu

SEQ ID NO: 46198 - RNA, 32 nt, Human
agagcgccuucgggggccgcggcggaaggcca

SEQ ID NO: 46199 - RNA, 32 nt, Human
agagcgcgaggccgggcagggggccagacucg

SEQ ID NO: 46200 - RNA, 32 nt, Human
agagcgcggcccugcgucagagcgagacucag

SEQ ID NO: 46201 - RNA, 32 nt, Human
agagcgcggucccagcccggccacugcggauc

SEQ ID NO: 46202 - RNA, 32 nt, Human
agagcgcucaucacuggcuggggacagagccg

SEQ ID NO: 46203 - RNA, 32 nt, Human
agagcggagcccaaaggaaggaugggagcccu

SEQ ID NO: 46204 - RNA, 32 nt, Human
agagcggagccugcacccuccaccucccgccc

SEQ ID NO: 46205 - RNA, 32 nt, Human
agagcggagcggagcugccgcugagcaaaggc

SEQ ID NO: 46206 - RNA, 17 nt, Human
agagcggaggaccagga

SEQ ID NO: 46207 - RNA, 32 nt, Human
agagcggaggagagagaggcagaagaacccug

SEQ ID NO: 46208 - RNA, 32 nt, Human
agagcggaggcugggcuuggccaggggcccga

SEQ ID NO: 46209 - RNA, 32 nt, Human
agagcggaucugccacuggcccaggucuggac

SEQ ID NO: 46210 - RNA, 32 nt, Human
agagcggcccugggugacagcgccgcggggcc

SEQ ID NO: 46211 - RNA, 32 nt, Human
agagcggcugagggcugccucacugcaaaucc

SEQ ID NO: 46212 - RNA, 32 nt, Human
agagcgggagugagagcaggaacgacgcagag

SEQ ID NO: 46213 - RNA, 32 nt, Human
agagcgggcaggagguuggauaacaaaaauag

SEQ ID NO: 46214 - RNA, 32 nt, Human
agagcgggcccaggcucugugaggaggcaagg

SEQ ID NO: 46215 - RNA, 32 nt, Human
agagcggggaaggcugaguccacacugcaagu

SEQ ID NO: 46216 - RNA, 32 nt, Human
agagcggggagcugcagcacagcaacagugau

SEQ ID NO: 46217 - RNA, 32 nt, Human
agagcggggaggaggagaggucggaaugucuc

SEQ ID NO: 46218 - RNA, 21 nt, Human
agagcggguuucaccauguug

SEQ ID NO: 46219 - RNA, 22 nt, Human
agagcggguuucaccauguugg

SEQ ID NO: 46220 - RNA, 32 nt, Human
agagcguaagguuuccgggcaguaauucuauc

SEQ ID NO: 46221 - RNA, 32 nt, Human
agagcguccugcaaccccagcccucaccagga

SEQ ID NO: 46222 - RNA, 32 nt, Human
agagcgugagccaccagggaagccacucgccu

SEQ ID NO: 46223 - RNA, 32 nt, Human
agagcgugcugcagaucauccccagcucuucg

SEQ ID NO: 46224 - RNA, 32 nt, Human
agagcgugcugugugagguggagggcgguuuu

SEQ ID NO: 46225 - RNA, 32 nt, Human
agagcguguggaccccaaacaagucugcgcaa

SEQ ID NO: 46226 - RNA, 32 nt, Human
agagcguguggcaucuccaccucaagggugca

SEQ ID NO: 46227 - RNA, 32 nt, Human
agagcguucuccauggaucugccuuacuacca

SEQ ID NO: 46228 - RNA, 32 nt, Human
agagcuaaaauuagggagaagagaggagucau

SEQ ID NO: 46229 - RNA, 32 nt, Human
agagcuaaagcagcccacccagcucccagaga

SEQ ID NO: 46230 - RNA, 32 nt, Human
agagcuaacauaaaggacaggccacaccacag

SEQ ID NO: 46231 - RNA, 32 nt, Human
agagcuaacgugggcccagcaguccugugcuu

SEQ ID NO: 46232 - RNA, 32 nt, Human
agagcuaagcauggagucaaggagaacuacau

SEQ ID NO: 46233 - RNA, 31 nt, Human
agagcuaaggggagagaaauuggggcugagu

SEQ ID NO: 46234 - RNA, 32 nt, Human
agagcuaaguuuuuaugcugaagaggagaaug

SEQ ID NO: 46235 - RNA, 32 nt, Human
agagcuaauaauuaucccucugucagagauga

SEQ ID NO: 46236 - RNA, 32 nt, Human
agagcuacagccgcggaacaaccacgccuggg

SEQ ID NO: 46237 - RNA, 32 nt, Human
agagcuacaggaguucaagaaacccaugaaaa

SEQ ID NO: 46238 - RNA, 32 nt, Human
agagcuaccagcugcccuguuggcuucgcugg

SEQ ID NO: 46239 - RNA, 32 nt, Human
agagcuaccauguccucuuggagcagacagcg

SEQ ID NO: 46240 - RNA, 19 nt, Human
agagcuaccuccccgggga

SEQ ID NO: 46241 - RNA, 32 nt, Human
agagcuacucagaaauggacaaagaaaacggg

SEQ ID NO: 46242 - RNA, 32 nt, Human
agagcuacugcuggcccuggcuccgcagccug

SEQ ID NO: 46243 - RNA, 18 nt, Human
agagcuagaaacucagga

SEQ ID NO: 46244 - RNA, 32 nt, Human
agagcuagagaagggaaagacuuuaucauccc

SEQ ID NO: 46245 - RNA, 32 nt, Human
agagcuagagcuaggcccugcccuuaccuagg

SEQ ID NO: 46246 - RNA, 32 nt, Human
agagcuagaugaagguauguugccaaaauuua

SEQ ID NO: 46247 - RNA, 32 nt, Human
agagcuagcccaggccaggggucaauguucau

SEQ ID NO: 46248 - RNA, 32 nt, Human
agagcuaggaguuugagaccagccugggcaau

SEQ ID NO: 46249 - RNA, 32 nt, Human
agagcuaggcuguggugcuggaagccaggaca

SEQ ID NO: 46250 - RNA, 32 nt, Human
agagcuagggacccugagcugcucucaggacg

SEQ ID NO: 46251 - RNA, 32 nt, Human
agagcuagggcagugggcucugcaggccaccu

SEQ ID NO: 46252 - RNA, 32 nt, Human
agagcuagggcugcugcuucugcuccagcccc

SEQ ID NO: 46253 - RNA, 32 nt, Human
agagcuaguuuuaaaauaaugaucucagauuu

SEQ ID NO: 46254 - RNA, 32 nt, Human
agagcuaugagauacgcacaauacuugcuguu

SEQ ID NO: 46255 - RNA, 32 nt, Human
agagcuauuggcucagcuguuucccaucagcu

SEQ ID NO: 46256 - RNA, 32 nt, Human
agagcuauuugugguuguugagguuugaaaag

SEQ ID NO: 46257 - RNA, 32 nt, Human
agagcucaacacaguaccagaugcuccagaaa

SEQ ID NO: 46258 - RNA, 32 nt, Human
agagcucaagagccuuccuacucuuuggaacu

SEQ ID NO: 46259 - RNA, 32 nt, Human
agagcucacccagaaagcaucuugccgggggc

SEQ ID NO: 46260 - RNA, 32 nt, Human
agagcucacccaggcggggguguuguggguac

SEQ ID NO: 46261 - RNA, 32 nt, Human
agagcucaccugcugggaggagguggcccaga

SEQ ID NO: 46262 - RNA, 32 nt, Human
agagcucacgcuccugucccccggcugguccg

SEQ ID NO: 46263 - RNA, 32 nt, Human
agagcucacugagccuccaccuggggucucug

SEQ ID NO: 46264 - RNA, 32 nt, Human
agagcucacugcagcuucaaucuccuggcuca

SEQ ID NO: 46265 - RNA, 32 nt, Human
agagcucacugcauccuugaccucccagacuc

SEQ ID NO: 46266 - RNA, 32 nt, Human
agagcucagagcucugaauuuccucauuuggg

SEQ ID NO: 46267 - RNA, 32 nt, Human
agagcucagcagggcccuggagagauggccac

SEQ ID NO: 46268 - RNA, 32 nt, Human
agagcucagcaugggcagggguucuggguagg

SEQ ID NO: 46269 - RNA, 32 nt, Human
agagcucagccaucuuucucauccgucaggca

SEQ ID NO: 46270 - RNA, 23 nt, Human
agagcucagcccgcuggacuugu

SEQ ID NO: 46271 - RNA, 32 nt, Human
agagcucaggaugagggaaaagaaaaagauug

SEQ ID NO: 46272 - RNA, 32 nt, Human
agagcucaguguggguccagagauggugucag

SEQ ID NO: 46273 - RNA, 32 nt, Human
agagcucaucuacccugucuguuggucagacu

SEQ ID NO: 46274 - RNA, 32 nt, Human
agagcucaugcugcugcuccuggguggacccg

SEQ ID NO: 46275 - RNA, 32 nt, Human
agagcucauggacuucaagucccgccgggucu

SEQ ID NO: 46276 - RNA, 32 nt, Human
agagcucauuccccaggaaucucuaagaccag

SEQ ID NO: 46277 - RNA, 32 nt, Human
agagcuccaguucuuuauaacaaaacagggau

SEQ ID NO: 46278 - RNA, 32 nt, Human
agagcuccauguccaagugcugugcucagucu

SEQ ID NO: 46279 - RNA, 32 nt, Human
agagcucccaucugccccacucgccuuugccc

SEQ ID NO: 46280 - RNA, 32 nt, Human
agagcuccccuuguauccucucuaagccacuc

SEQ ID NO: 46281 - RNA, 32 nt, Human
agagcucccugccucuggcuucuccaccuuug

SEQ ID NO: 46282 - RNA, 32 nt, Human
agagcucccuugccuuaccuggaggaagaaug

SEQ ID NO: 46283 - RNA, 32 nt, Human
agagcuccgagaguucaacaccagccugggcc

SEQ ID NO: 46284 - RNA, 32 nt, Human
agagcuccucacccucuuuccaccaugugagg

SEQ ID NO: 46285 - RNA, 32 nt, Human
agagcuccucauguucuugcauggcccaagau

SEQ ID NO: 46286 - RNA, 32 nt, Human
agagcuccugacaggauugaugguccuucccc

SEQ ID NO: 46287 - RNA, 32 nt, Human
agagcuccugaggggcagaggagcagagaugc

SEQ ID NO: 46288 - RNA, 32 nt, Human
agagcuccugggccugcugccugcacaccaca

SEQ ID NO: 46289 - RNA, 32 nt, Human
agagcuccuucacucaccgacucucaucagga

SEQ ID NO: 46290 - RNA, 32 nt, Human
agagcucguaguucaauaacauuccaaagaac

SEQ ID NO: 46291 - RNA, 32 nt, Human
agagcucgugggauuccugcugcuccaggugu

SEQ ID NO: 46292 - RNA, 32 nt, Human
agagcucguguccucugucucuugccucggug

SEQ ID NO: 46293 - RNA, 32 nt, Human
agagcucuaaagauggggcuucggggguagga

SEQ ID NO: 46294 - RNA, 28 nt, Human
agagcucucaaugcugccuaucgggcgg

SEQ ID NO: 46295 - RNA, 32 nt, Human
agagcucucacagaugaagcaggaacugcucu

SEQ ID NO: 46296 - RNA, 32 nt, Human
agagcucuccacgaguguucagucuuagaacu

SEQ ID NO: 46297 - RNA, 21 nt, Human
agagcucuccccagccccgug

SEQ ID NO: 46298 - RNA, 32 nt, Human
agagcucucugagggugauggggcugagcagg

SEQ ID NO: 46299 - RNA, 32 nt, Human
agagcucucuucaauaaauucgucaggucaaa

SEQ ID NO: 46300 - RNA, 32 nt, Human
agagcucugcacccagccugcccgcccacacc

SEQ ID NO: 46301 - RNA, 32 nt, Human
agagcucugccucccucgauucguuaugugaa

SEQ ID NO: 46302 - RNA, 32 nt, Human
agagcucugccuuacagcuagagcaagagugu

SEQ ID NO: 46303 - RNA, 32 nt, Human
agagcucuggccaggcugugccaguguguccc

SEQ ID NO: 46304 - RNA, 32 nt, Human
agagcucugggagccaaccgggucuguacugu

SEQ ID NO: 46305 - RNA, 32 nt, Human
agagcucugggagccuuucggcaaaucuugaa

SEQ ID NO: 46306 - RNA, 32 nt, Human
agagcucuguuaguguccccucuuggggguca

SEQ ID NO: 46307 - RNA, 32 nt, Human
agagcucuuaacugcuaugcugcacugccuca

SEQ ID NO: 46308 - RNA, 32 nt, Human
agagcucuucccuccuccuuuuucuuccuccu

SEQ ID NO: 46309 - RNA, 32 nt, Human
agagcucuucuuucuaccuuucugcucccggc

SEQ ID NO: 46310 - RNA, 32 nt, Human
agagcugaaaacacaagcccaggagugcagac

SEQ ID NO: 46311 - RNA, 32 nt, Human
agagcugaaguacugcacccagcaucaccagc

SEQ ID NO: 46312 - RNA, 32 nt, Human
agagcugaauaacauguuaggcucacacaugc

SEQ ID NO: 46313 - RNA, 32 nt, Human
agagcugaccaaggcuagagagggaucaaugu

SEQ ID NO: 46314 - RNA, 32 nt, Human
agagcugacgcuccaccucccaccuccaaguc

SEQ ID NO: 46315 - RNA, 32 nt, Human
agagcugacuccaggcccaggcuguggucccc

SEQ ID NO: 46316 - RNA, 32 nt, Human
agagcugacucugaagagagucuucacuuacu

SEQ ID NO: 46317 - RNA, 32 nt, Human
agagcugagacuguuggcuccuucccauuuau

SEQ ID NO: 46318 - RNA, 32 nt, Human
agagcugagauuacaggcgugagccaccaugc

SEQ ID NO: 46319 - RNA, 32 nt, Human
agagcugaggcagaaucccuuuuucauucauu

SEQ ID NO: 46320 - RNA, 18 nt, Human
agagcugaggccagucca

SEQ ID NO: 46321 - RNA, 32 nt, Human
agagcugaggggacagggaggagcagaagcca

SEQ ID NO: 46322 - RNA, 32 nt, Human
agagcugaggggaugugggggccccaaacuca

SEQ ID NO: 46323 - RNA, 32 nt, Human
agagcugaucagcagcuugugccuggcauccc

SEQ ID NO: 46324 - RNA, 19 nt, Human
agagcugauccagagcaca

SEQ ID NO: 46325 - RNA, 32 nt, Human
agagcugaucugccucucacacagguccuggu

SEQ ID NO: 46326 - RNA, 32 nt, Human
agagcugauuccugccuugucuucuccacugu

SEQ ID NO: 46327 - RNA, 32 nt, Human
agagcugcaagugccuggcagaaugcccugcc

SEQ ID NO: 46328 - RNA, 32 nt, Human
agagcugcacagcugcucccagagccugagca

SEQ ID NO: 46329 - RNA, 32 nt, Human
agagcugcacgccgguccacagacacacucac

SEQ ID NO: 46330 - RNA, 32 nt, Human
agagcugcagaaaaggguggggucgcuuccca

SEQ ID NO: 46331 - RNA, 32 nt, Human
agagcugcagaaccagucccucugagugaagu

SEQ ID NO: 46332 - RNA, 32 nt, Human
agagcugcagcccugcccugucacucaccuca

SEQ ID NO: 46333 - RNA, 32 nt, Human
agagcugcaggaugucuggggucugggcaagu

SEQ ID NO: 46334 - RNA, 32 nt, Human
agagcugcaguuucagccgcgacagcaagaac

SEQ ID NO: 46335 - RNA, 32 nt, Human
agagcugcccggcucacugcagccugguuacg

SEQ ID NO: 46336 - RNA, 32 nt, Human
agagcugccucugccuuuauccugggagaugg

SEQ ID NO: 46337 - RNA, 32 nt, Human
agagcugccuguaaacacguuugacugcuuga

SEQ ID NO: 46338 - RNA, 32 nt, Human
agagcugcggagggggaggggaagaagaaggc

SEQ ID NO: 46339 - RNA, 32 nt, Human
agagcugcugaguucaggaugccugcgugugg

SEQ ID NO: 46340 - RNA, 32 nt, Human
agagcugcuggagaacaccauggaggccaugg

SEQ ID NO: 46341 - RNA, 32 nt, Human
agagcugcuucugcagggaguuuucuggaaug

SEQ ID NO: 46342 - RNA, 32 nt, Human
agagcuggaaaagcuucagacagagcuuggua

SEQ ID NO: 46343 - RNA, 32 nt, Human
agagcuggaaagagcagcguuuugaaaugagg

SEQ ID NO: 46344 - RNA, 32 nt, Human
agagcuggaagcugcaaaggagcccagagcuc

SEQ ID NO: 46345 - RNA, 32 nt, Human
agagcuggaaggcaggaugaggagagguauga

SEQ ID NO: 46346 - RNA, 32 nt, Human
agagcuggaccccgcagcugaagcggaaaugu

SEQ ID NO: 46347 - RNA, 32 nt, Human
agagcuggacuaauccagugccugguagacag

SEQ ID NO: 46348 - RNA, 32 nt, Human
agagcuggagacaccaucucccaccgagaguc

SEQ ID NO: 46349 - RNA, 32 nt, Human
agagcuggagagccaugggugaggcagcuugu

SEQ ID NO: 46350 - RNA, 32 nt, Human
agagcuggagccagaccaggaaccugagccag

SEQ ID NO: 46351 - RNA, 32 nt, Human
agagcuggagcccaucuuucugccuccaucca

SEQ ID NO: 46352 - RNA, 32 nt, Human
agagcuggaggagaagaggagugaggggccuc

SEQ ID NO: 46353 - RNA, 32 nt, Human
agagcuggaggagggggugaccagcuuggagu

SEQ ID NO: 46354 - RNA, 32 nt, Human
agagcuggagugacaugggaggggaggcggau

SEQ ID NO: 46355 - RNA, 32 nt, Human
agagcuggcaagcaucuucucauuauguuugg

SEQ ID NO: 46356 - RNA, 32 nt, Human
agagcuggcaggaggaaaagcggguucgaguc

SEQ ID NO: 46357 - RNA, 32 nt, Human
agagcuggcauaucuggucagaacugcagggc

SEQ ID NO: 46358 - RNA, 32 nt, Human
agagcuggccugguugaaggaaggguggaggu

SEQ ID NO: 46359 - RNA, 32 nt, Human
agagcugggaagcagacaggaaggagagaagc

SEQ ID NO: 46360 - RNA, 23 nt, Human
agagcugggacucaguucuuggc

SEQ ID NO: 46361 - RNA, 32 nt, Human
agagcugggaggccaaggguucacugggcuug

SEQ ID NO: 46362 - RNA, 32 nt, Human
agagcugggaggcggcgaucgcagcugggccg

SEQ ID NO: 46363 - RNA, 32 nt, Human
agagcugggauaaaaggcgugagccaccgcgc

SEQ ID NO: 46364 - RNA, 32 nt, Human
agagcugggauuacaagugugagccaccgcgc

SEQ ID NO: 46365 - RNA, 32 nt, Human
agagcugggauuacaggcaugagccacugugc

SEQ ID NO: 46366 - RNA, 32 nt, Human
agagcugggauuacaggcaugagucaccacgc

SEQ ID NO: 46367 - RNA, 32 nt, Human
agagcugggauuacaggcgugagacaccgcgc

SEQ ID NO: 46368 - RNA, 32 nt, Human
agagcugggauuacaggugugagcuaccgcgc

SEQ ID NO: 46369 - RNA, 32 nt, Human
agagcugggauugguggagggagcaggugcca

SEQ ID NO: 46370 - RNA, 18 nt, Human
agagcugggcccccuggg

SEQ ID NO: 46371 - RNA, 32 nt, Human
agagcugggcgagaggccuagagccaggacca

SEQ ID NO: 46372 - RNA, 23 nt, Human
agagcugggcucaggcccugggc

SEQ ID NO: 46373 - RNA, 32 nt, Human
agagcugggcuggggcagggggcagcuccuca

SEQ ID NO: 46374 - RNA, 32 nt, Human
agagcuggggaccacagccaggcucuggcaug

SEQ ID NO: 46375 - RNA, 32 nt, Human
agagcuggggcaagcaaggagccuuccugucc

SEQ ID NO: 46376 - RNA, 32 nt, Human
agagcuggggcagaggcaggaagcaggggccc

SEQ ID NO: 46377 - RNA, 18 nt, Human
agagcuggggcucuggga

SEQ ID NO: 46378 - RNA, 32 nt, Human
agagcuggggcuuguuacagaaaaauaaucau

SEQ ID NO: 46379 - RNA, 32 nt, Human
agagcuggggucuggcaaacaggcuggguuug

SEQ ID NO: 46380 - RNA, 32 nt, Human
agagcugggucuggcugagcaccagcugcgcu

SEQ ID NO: 46381 - RNA, 19 nt, Human
agagcuggguuccuuggga

SEQ ID NO: 46382 - RNA, 32 nt, Human
agagcuggucacagugcugcucugcacaccag

SEQ ID NO: 46383 - RNA, 31 nt, Human
agagcuggugagagaggagucagguggccuu

SEQ ID NO: 46384 - RNA, 32 nt, Human
agagcugguggaagugugucugaacucggagu

SEQ ID NO: 46385 - RNA, 22 nt, Human
agagcugguggugcagccuucc

SEQ ID NO: 46386 - RNA, 32 nt, Human
agagcugguucugaggcucgcauccggaggga

SEQ ID NO: 46387 - RNA, 32 nt, Human
agagcugucuuccuccuccgaggcucugggcu

SEQ ID NO: 46388 - RNA, 32 nt, Human
agagcugugaagccucugagggccuggcuucu

SEQ ID NO: 46389 - RNA, 32 nt, Human
agagcugugaggagaagucagugaagaacacc

SEQ ID NO: 46390 - RNA, 32 nt, Human
agagcugugauggcuaacugauguuuauaaug

SEQ ID NO: 46391 - RNA, 32 nt, Human
agagcuguggcugaggccuacccuggcggccu

SEQ ID NO: 46392 - RNA, 32 nt, Human
agagcugugguuuugaagauuuuccuucccca

SEQ ID NO: 46393 - RNA, 32 nt, Human
agagcuguuacuuaugugugagggcuuuauuc

SEQ ID NO: 46394 - RNA, 32 nt, Human
agagcuguucaacaucacugaaaccuuuaaga

SEQ ID NO: 46395 - RNA, 32 nt, Human
agagcuguuccccaccgcccugccucuuccgg

SEQ ID NO: 46396 - RNA, 32 nt, Human
agagcuguucugucuucucuucugucucuucu

SEQ ID NO: 46397 - RNA, 22 nt, Human
agagcuguugccaaaucaguga

SEQ ID NO: 46398 - RNA, 32 nt, Human
agagcuguuuggaaacuucuccuucacacacc

SEQ ID NO: 46399 - RNA, 32 nt, Human
agagcuguuuuuaaugauguuauucuagaaug

SEQ ID NO: 46400 - RNA, 32 nt, Human
agagcuuacugucacagcaacuccuuugcaag

SEQ ID NO: 46401 - RNA, 32 nt, Human
agagcuucaagcaauggccccauccucaaaga

SEQ ID NO: 46402 - RNA, 32 nt, Human
agagcuucacgauccccaucccugaacaacca

SEQ ID NO: 46403 - RNA, 32 nt, Human
agagcuucauggcuugcuuaaauuacuuagcu

SEQ ID NO: 46404 - RNA, 32 nt, Human
agagcuuccagccugagaaccccaggcccguc

SEQ ID NO: 46405 - RNA, 32 nt, Human
agagcuucccugcuuccaacacuuguuauuug

SEQ ID NO: 46406 - RNA, 32 nt, Human
agagcuuccucuugaucucuguuuuuaagcag

SEQ ID NO: 46407 - RNA, 32 nt, Human
agagcuucggaagaaagagcagcagcucucuc

SEQ ID NO: 46408 - RNA, 22 nt, Human
agagcuucuccccagccuuccu

SEQ ID NO: 46409 - RNA, 32 nt, Human
agagcuucuccucauuccaauguguuuugcuu

SEQ ID NO: 46410 - RNA, 32 nt, Human
agagcuucucucuguugcccaggcuggagugc

SEQ ID NO: 46411 - RNA, 32 nt, Human
agagcuucugaguuuccaagcucugagucacc

SEQ ID NO: 46412 - RNA, 32 nt, Human
agagcuucugaucccagcuauuagggacagaa

SEQ ID NO: 46413 - RNA, 32 nt, Human
agagcuugagaggcaggucccuggagaucauc

SEQ ID NO: 46414 - RNA, 32 nt, Human
agagcuugaggugggagcggggcugggaggaa

SEQ ID NO: 46415 - RNA, 32 nt, Human
agagcuugaguuaaaucuagguacaguuacag

SEQ ID NO: 46416 - RNA, 20 nt, Human
agagcuuggaagacuggaga

SEQ ID NO: 46417 - RNA, 32 nt, Human
agagcuuggccagggguccugccccuccccca

SEQ ID NO: 46418 - RNA, 32 nt, Human
agagcuuggcucucuggcagauuuccucuagu

SEQ ID NO: 46419 - RNA, 22 nt, Human
agagcuugggagagugcugguc

SEQ ID NO: 46420 - RNA, 32 nt, Human
agagcuugggcuguagcuucggggagugcaag

SEQ ID NO: 46421 - RNA, 32 nt, Human
agagcuuggggaggggaugacagcccugaauu

SEQ ID NO: 46422 - RNA, 32 nt, Human
agagcuugugacuggacuccagccugggcaac

SEQ ID NO: 46423 - RNA, 32 nt, Human
agagcuugugggagccaaggagcaccuuggac

SEQ ID NO: 46424 - RNA, 22 nt, Human
agagcuuguuccuguucaguga

SEQ ID NO: 46425 - RNA, 32 nt, Human
agagcuuuaucugaaaucagaggggaacuauc

SEQ ID NO: 46426 - RNA, 32 nt, Human
agagcuuucaccuuuuuacauuucccuucuga

SEQ ID NO: 46427 - RNA, 32 nt, Human
agagcuuuccucuccucucucuugcucucaga

SEQ ID NO: 46428 - RNA, 32 nt, Human
agagcuuucggagcugacacugacagcuucag

SEQ ID NO: 46429 - RNA, 32 nt, Human
agagcuuucuucccgaaccccaaggagggaga

SEQ ID NO: 46430 - RNA, 23 nt, Human
agagcuuugaguccugucugcug

SEQ ID NO: 46431 - RNA, 32 nt, Human
agagcuuugcagauaacaaaauagccuauccu

SEQ ID NO: 46432 - RNA, 32 nt, Human
agagcuuugccaccucuccauuuuugccuugg

SEQ ID NO: 46433 - RNA, 32 nt, Human
agagcuuuugacugaguucuuggacaagauac

SEQ ID NO: 46434 - RNA, 20 nt, Human
agaggaaaaaacauaguuga

SEQ ID NO: 46435 - RNA, 32 nt, Human
agaggaaaaagcuugaagagcuggagccacug

SEQ ID NO: 46436 - RNA, 32 nt, Human
agaggaaaacucaagugaaaagugcuagacau

SEQ ID NO: 46437 - RNA, 32 nt, Human
agaggaaaagagaguaguuuugucuucaagua

SEQ ID NO: 46438 - RNA, 32 nt, Human
agaggaaaagucacuugcccaaagucacacag

SEQ ID NO: 46439 - RNA, 32 nt, Human
agaggaaacagaauaucagagagagucaaugg

SEQ ID NO: 46440 - RNA, 32 nt, Human
agaggaaacaggcugagagaagaaaaaugacu

SEQ ID NO: 46441 - RNA, 32 nt, Human
agaggaaacaugagagcagaauucagcaugag

SEQ ID NO: 46442 - RNA, 32 nt, Human
agaggaaaccuauccuccucaccagaagagcc

SEQ ID NO: 46443 - RNA, 32 nt, Human
agaggaaagaaacacuucucgaaauugugcaa

SEQ ID NO: 46444 - RNA, 32 nt, Human
agaggaaagaacccugggaacgggaggcgaag

SEQ ID NO: 46445 - RNA, 31 nt, Human
agaggaaagagacucauguugcucaauguga

SEQ ID NO: 46446 - RNA, 32 nt, Human
agaggaaagaggaauucuucaucugcccuauc

SEQ ID NO: 46447 - RNA, 23 nt, Human
agaggaaagaugccaagcugcuu

SEQ ID NO: 46448 - RNA, 32 nt, Human
agaggaaaggacaggaggacagguggugauuu

SEQ ID NO: 46449 - RNA, 32 nt, Human
agaggaaaggccugugacagagcagggcacca

SEQ ID NO: 46450 - RNA, 24 nt, Human
agaggaaaggcuggaaggaaagga

SEQ ID NO: 46451 - RNA, 24 nt, Human
agaggaaagggaaggagaggggag

SEQ ID NO: 46452 - RNA, 32 nt, Human
agaggaaagggaggggugccccagaggcacca

SEQ ID NO: 46453 - RNA, 32 nt, Human
agaggaaaggggucuucccuggaacgcuucag

SEQ ID NO: 46454 - RNA, 27 nt, Human
agaggaaauggauccaggagaaggaga

SEQ ID NO: 46455 - RNA, 32 nt, Human
agaggaaauggcccugagccucacccgagcag

SEQ ID NO: 46456 - RNA, 31 nt, Human
agaggaaaugugucucccuccaaggccccaa

SEQ ID NO: 46457 - RNA, 32 nt, Human
agaggaaauucuguaaucaaugcuggaaaucg

SEQ ID NO: 46458 - RNA, 32 nt, Human
agaggaaauuucacaugcaaagccacagucau

SEQ ID NO: 46459 - RNA, 32 nt, Human
agaggaacagagaacccagagucaggguccua

SEQ ID NO: 46460 - RNA, 32 nt, Human
agaggaacagagaagaggccccagagcaaggc

SEQ ID NO: 46461 - RNA, 17 nt, Human
agaggaacccaaguaca

SEQ ID NO: 46462 - RNA, 32 nt, Human
agaggaacccuuuagcuguuucugcagcugag

SEQ ID NO: 46463 - RNA, 23 nt, Human
agaggaaccuguaguuuuuucca

SEQ ID NO: 46464 - RNA, 21 nt, Human
agaggaacggugggagaaggg

SEQ ID NO: 46465 - RNA, 32 nt, Human
agaggaacuaaggccuucuaucagacugccug

SEQ ID NO: 46466 - RNA, 32 nt, Human
agaggaacuggguguaaccccaggaaggagag

SEQ ID NO: 46467 - RNA, 32 nt, Human
agaggaacuuaagaaguauggagugacgacuu

SEQ ID NO: 46468 - RNA, 20 nt, Human
agaggaacuuuauucuucca

SEQ ID NO: 46469 - RNA, 32 nt, Human
agaggaagaaaggagagaggggagccagggga

SEQ ID NO: 46470 - RNA, 21 nt, Human
agaggaagaaagugaagggga

SEQ ID NO: 46471 - RNA, 23 nt, Human
agaggaagaagaagaaggaggag

SEQ ID NO: 46472 - RNA, 32 nt, Human
agaggaagaagaggagauggcugaaacauaua

SEQ ID NO: 46473 - RNA, 32 nt, Human
agaggaagacgagggagcaggagcuuggcuga

SEQ ID NO: 46474 - RNA, 32 nt, Human
agaggaagacguucuugcauccucagccugug

SEQ ID NO: 46475 - RNA, 21 nt, Human
agaggaagagaggaagcggag

SEQ ID NO: 46476 - RNA, 32 nt, Human
agaggaagagcauccucaauagacucacuccc

SEQ ID NO: 46477 - RNA, 32 nt, Human
agaggaagagccaaugugugaggaguugggag

SEQ ID NO: 46478 - RNA, 23 nt, Human
agaggaagaggaaagaaaaggag

SEQ ID NO: 46479 - RNA, 32 nt, Human
agaggaagaggaaagaaagaagaggagggaau

SEQ ID NO: 46480 - RNA, 32 nt, Human
agaggaagaggaagaagaggagauggcugaaa

SEQ ID NO: 46481 - RNA, 32 nt, Human
agaggaagaggaagagaggaagcggagggaac

SEQ ID NO: 46482 - RNA, 22 nt, Human
agaggaagaggaagaggaagag

SEQ ID NO: 46483 - RNA, 32 nt, Human
agaggaagaggaagaggaagagaggaagcgga

SEQ ID NO: 46484 - RNA, 32 nt, Human
agaggaagaggaggaggaggagaccggcagca

SEQ ID NO: 46485 - RNA, 32 nt, Human
agaggaagauagagauuuccuuucuccccuga

SEQ ID NO: 46486 - RNA, 32 nt, Human
agaggaagccagcuggcuuugcacuugaccuc

SEQ ID NO: 46487 - RNA, 32 nt, Human
agaggaagcugaaggcagaaagagaugcagag

SEQ ID NO: 46488 - RNA, 18 nt, Human
agaggaagcugggagaag

SEQ ID NO: 46489 - RNA, 32 nt, Human
agaggaaggaagcacgccaaguuaggccuggg

SEQ ID NO: 46490 - RNA, 22 nt, Human
agaggaaggagaaagaggagga

SEQ ID NO: 46491 - RNA, 25 nt, Human
agaggaaggagaaagaggaggagag

SEQ ID NO: 46492 - RNA, 32 nt, Human
agaggaaggagaggagaggggcacagggucuc

SEQ ID NO: 46493 - RNA, 15 nt, Human
agaggaaggagccca

SEQ ID NO: 46494 - RNA, 32 nt, Human
agaggaaggaggaggaaugagaggggcaggaa

SEQ ID NO: 46495 - RNA, 32 nt, Human
agaggaaggaggcacugcugaauggcuauggc

SEQ ID NO: 46496 - RNA, 24 nt, Human
agaggaaggccgggagaaggggag

SEQ ID NO: 46497 - RNA, 22 nt, Human
agaggaaggccuccugagggag

SEQ ID NO: 46498 - RNA, 22 nt, Human
agaggaagggaaggaaggagag

SEQ ID NO: 46499 - RNA, 32 nt, Human
agaggaagggaggccugaggggcagauugguu

SEQ ID NO: 46500 - RNA, 32 nt, Human
agaggaagggauggguggacucacaggaaguc

SEQ ID NO: 46501 - RNA, 26 nt, Human
agaggaagggcacagagaggaaggga

SEQ ID NO: 46502 - RNA, 22 nt, Human
agaggaagguaaagaagaagag

SEQ ID NO: 46503 - RNA, 32 nt, Human
agaggaaggucuagauuuccugcucuuaauaa

SEQ ID NO: 46504 - RNA, 21 nt, Human
agaggaaggucugaagaugag

SEQ ID NO: 46505 - RNA, 32 nt, Human
agaggaaguaaucaaccuuuacuucccaagcu

SEQ ID NO: 46506 - RNA, 24 nt, Human
agaggaaguagcgagagaagagag

SEQ ID NO: 46507 - RNA, 32 nt, Human
agaggaagucuuguuuaauaaaaaccuuuuga

SEQ ID NO: 46508 - RNA, 32 nt, Human
agaggaagugcugcuguaauugggagcacaag

SEQ ID NO: 46509 - RNA, 32 nt, Human
agaggaaguggaucugcuucuccaguuuuuga

SEQ ID NO: 46510 - RNA, 32 nt, Human
agaggaaguugugagagaaauugauaagcuuu

SEQ ID NO: 46511 - RNA, 23 nt, Human
agaggaauaacuuagcuugcaca

SEQ ID NO: 46512 - RNA, 32 nt, Human
agaggaaucagacaguucucacccucaagggg

SEQ ID NO: 46513 - RNA, 32 nt, Human
agaggaaucuuccuuuucuauuuaugaagauu

SEQ ID NO: 46514 - RNA, 21 nt, Human
agaggaaugaaacuacuuaca

SEQ ID NO: 46515 - RNA, 32 nt, Human
agaggaaugaguguccaggcagaguucagaag

SEQ ID NO: 46516 - RNA, 32 nt, Human
agaggaauggauuugacuuuucugcuaggauu

SEQ ID NO: 46517 - RNA, 32 nt, Human
agaggaauuuacaaauggguuuuuaacaaaug

SEQ ID NO: 46518 - RNA, 32 nt, Human
agaggacaaaacugaauaaagugaauguuaau

SEQ ID NO: 46519 - RNA, 32 nt, Human
agaggacaaaggugccuucuguagacacuccu

SEQ ID NO: 46520 - RNA, 32 nt, Human
agaggacaaagguugugucuugcuuuugucuc

SEQ ID NO: 46521 - RNA, 32 nt, Human
agaggacacagcaagugaguccuccccacucu

SEQ ID NO: 46522 - RNA, 32 nt, Human
agaggacacagccucugcugggacagggaaca

SEQ ID NO: 46523 - RNA, 32 nt, Human
agaggacacagccucugcugggacagggaaua

SEQ ID NO: 46524 - RNA, 32 nt, Human
agaggacacaggagccuggggugcaggugccu

SEQ ID NO: 46525 - RNA, 32 nt, Human
agaggacacagucugucauccccacuggaaag

SEQ ID NO: 46526 - RNA, 32 nt, Human
agaggacaccaacuccaugcagauggcagccc

SEQ ID NO: 46527 - RNA, 20 nt, Human
agaggacaccaggaagagcg

SEQ ID NO: 46528 - RNA, 32 nt, Human
agaggacacugaggacuaguuugggaaaugaa

SEQ ID NO: 46529 - RNA, 32 nt, Human
agaggacagcaacuggugauuguuucagagaa

SEQ ID NO: 46530 - RNA, 32 nt, Human
agaggacagggaggguggaggaguggauagaa

SEQ ID NO: 46531 - RNA, 32 nt, Human
agaggacaggguggagaggaggagaacccuga

SEQ ID NO: 46532 - RNA, 32 nt, Human
agaggacagugaauuacuccuaggucggcucu

SEQ ID NO: 46533 - RNA, 32 nt, Human
agaggacauguuuucucccuggagcugagcug

SEQ ID NO: 46534 - RNA, 32 nt, Human
agaggaccaagaaaaaucaacaaacaaaucaa

SEQ ID NO: 46535 - RNA, 32 nt, Human
agaggaccaaugcuugcauggagaauggacga

SEQ ID NO: 46536 - RNA, 20 nt, Human
agaggaccaggagaaggggg

SEQ ID NO: 46537 - RNA, 32 nt, Human
agaggacccauggcuagcagggaagggccugg

SEQ ID NO: 46538 - RNA, 32 nt, Human
agaggaccccaggcgaccagaguccaggcuga

SEQ ID NO: 46539 - RNA, 32 nt, Human
agaggacccugaggccuucugcaguguuugug

SEQ ID NO: 46540 - RNA, 32 nt, Human
agaggacccugaguccccaccugcggcucccc

SEQ ID NO: 46541 - RNA, 32 nt, Human
agaggacccuugccucagccucgggaagcccc

SEQ ID NO: 46542 - RNA, 32 nt, Human
agaggaccgaggacaggggccggacauugggg

SEQ ID NO: 46543 - RNA, 32 nt, Human
agaggaccgggaggcaccccacccuccccacc

SEQ ID NO: 46544 - RNA, 32 nt, Human
agaggaccucagaacccaggagccagaggaac

SEQ ID NO: 46545 - RNA, 32 nt, Human
agaggaccuggcugggccccaagccuuggaca

SEQ ID NO: 46546 - RNA, 24 nt, Human
agaggaccugggccucugcuguca

SEQ ID NO: 46547 - RNA, 32 nt, Human
agaggacgaagaggaggaggaugaggaggaca

SEQ ID NO: 46548 - RNA, 32 nt, Human
agaggacgaucucuugagaaaggaaagacuuc

SEQ ID NO: 46549 - RNA, 32 nt, Human
agaggacgccuccacccacaggaaggagccag

SEQ ID NO: 46550 - RNA, 32 nt, Human
agaggacgggggcagagaagugaugaagggaa

SEQ ID NO: 46551 - RNA, 32 nt, Human
agaggacuauagaaauuccugcucuucacaga

SEQ ID NO: 46552 - RNA, 19 nt, Human
agaggacucggaagucaga

SEQ ID NO: 46553 - RNA, 32 nt, Human
agaggacugaaaccuccacugcaggcugguuu

SEQ ID NO: 46554 - RNA, 32 nt, Human
agaggacugaccacagccuggcuggcagcugc

SEQ ID NO: 46555 - RNA, 25 nt, Human
agaggacugacuauacccuggcuga

SEQ ID NO: 46556 - RNA, 32 nt, Human
agaggacugcagcugccuaggucugcggccac

SEQ ID NO: 46557 - RNA, 32 nt, Human
agaggacugcugucugcccucucuggucaccc

SEQ ID NO: 46558 - RNA, 32 nt, Human
agaggacuggacccugggucucagguuccagc

SEQ ID NO: 46559 - RNA, 32 nt, Human
agaggacugggaggagaauggaggcaagaaaa

SEQ ID NO: 46560 - RNA, 32 nt, Human
agaggacugugucuccuggagcuguucaccag

SEQ ID NO: 46561 - RNA, 32 nt, Human
agaggacuucuccuuuuucucucccuccagag

SEQ ID NO: 46562 - RNA, 32 nt, Human
agaggacuugaggccaugaggucuggccucuu

SEQ ID NO: 46563 - RNA, 32 nt, Human
agaggacuugcuauuugccaggugcuuuaugu

SEQ ID NO: 46564 - RNA, 32 nt, Human
agaggagaaaugcaggcuggcagagcaauuuc

SEQ ID NO: 46565 - RNA, 32 nt, Human
agaggagaaccuucggcgcucugacaaggagu

SEQ ID NO: 46566 - RNA, 32 nt, Human
agaggagaacggcuguuccaccugccagcaga

SEQ ID NO: 46567 - RNA, 32 nt, Human
agaggagaagaagggccuuccuaguagaggca

SEQ ID NO: 46568 - RNA, 19 nt, Human
agaggagaagagacuggaa

SEQ ID NO: 46569 - RNA, 32 nt, Human
agaggagaagagcaaacaggcacuuugaggaa

SEQ ID NO: 46570 - RNA, 32 nt, Human
agaggagaagaggaggaggcagaggaagaaag

SEQ ID NO: 46571 - RNA, 21 nt, Human
agaggagaaggaggaggagag

SEQ ID NO: 46572 - RNA, 32 nt, Human
agaggagaaggaugccugggugccaggcaaga

SEQ ID NO: 46573 - RNA, 32 nt, Human
agaggagaaggccgcggcggaggcaggugaga

SEQ ID NO: 46574 - RNA, 32 nt, Human
agaggagaccaugggcccugccccacccacuc

SEQ ID NO: 46575 - RNA, 32 nt, Human
agaggagacccaggcagugucagcagugaagg

SEQ ID NO: 46576 - RNA, 32 nt, Human
agaggagacuaaaucacaucaauuugcccaaa

SEQ ID NO: 46577 - RNA, 32 nt, Human
agaggagagaaaagaacucaagggggaaacug

SEQ ID NO: 46578 - RNA, 32 nt, Human
agaggagagagaggagagaggagagagggagg

SEQ ID NO: 46579 - RNA, 22 nt, Human
agaggagagaggagagagggag

SEQ ID NO: 46580 - RNA, 32 nt, Human
agaggagagaggaggaggaggaggcugagaga

SEQ ID NO: 46581 - RNA, 32 nt, Human
agaggagagagggagggaagagagugacggag

SEQ ID NO: 46582 - RNA, 32 nt, Human
agaggagagccacaugccugaguaagaacagu

SEQ ID NO: 46583 - RNA, 32 nt, Human
agaggagagcccagaaggccacaaacauuaac

SEQ ID NO: 46584 - RNA, 32 nt, Human
agaggagaggaaagggaaggagaggggagggc

SEQ ID NO: 46585 - RNA, 32 nt, Human
agaggagaggcagagagggcgcggggaccguc

SEQ ID NO: 46586 - RNA, 32 nt, Human
agaggagaggcagcagcauggcgaguguccug

SEQ ID NO: 46587 - RNA, 32 nt, Human
agaggagaggccugauggggcagagcuggacg

SEQ ID NO: 46588 - RNA, 20 nt, Human
agaggagagggagaaaggga

SEQ ID NO: 46589 - RNA, 32 nt, Human
agaggagaggggcacagggucucuaccauccc

SEQ ID NO: 46590 - RNA, 32 nt, Human
agaggagaguucuaaggucaccucuggcugca

SEQ ID NO: 46591 - RNA, 18 nt, Human
agaggagauccuaaccca

SEQ ID NO: 46592 - RNA, 32 nt, Human
agaggagaugaaggccaaggaggaggagcuca

SEQ ID NO: 46593 - RNA, 32 nt, Human
agaggagaugauugaugaggccaggugcggug

SEQ ID NO: 46594 - RNA, 32 nt, Human
agaggagauggaaacugacauacccaacccac

SEQ ID NO: 46595 - RNA, 32 nt, Human
agaggagaugggggugggagggacugaguuga

SEQ ID NO: 46596 - RNA, 32 nt, Human
agaggagcaaacuggggcccauugaaggguga

SEQ ID NO: 46597 - RNA, 18 nt, Human
agaggagcaaagcugccu

SEQ ID NO: 46598 - RNA, 21 nt, Human
agaggagcagagaggaaggag

SEQ ID NO: 46599 - RNA, 32 nt, Human
agaggagcagagaggaaggagaaagaggagga

SEQ ID NO: 46600 - RNA, 32 nt, Human
agaggagcagcagggucagggugcuggguucc

SEQ ID NO: 46601 - RNA, 22 nt, Human
agaggagcaggaagcaaggcca

SEQ ID NO: 46602 - RNA, 19 nt, Human
agaggagcaggagggggcc

SEQ ID NO: 46603 - RNA, 32 nt, Human
agaggagccacuucgcccagacuuuguuuccc

SEQ ID NO: 46604 - RNA, 32 nt, Human
agaggagcccacacaaagcuugaaagccugug

SEQ ID NO: 46605 - RNA, 32 nt, Human
agaggagccccaugcccagccuggcugagccc

SEQ ID NO: 46606 - RNA, 32 nt, Human
agaggagcccuagagagagaaaaagaaagaaa

SEQ ID NO: 46607 - RNA, 32 nt, Human
agaggagccgcgcgaaggucaccccgcgcccg

SEQ ID NO: 46608 - RNA, 22 nt, Human
agaggagccggagacgagacca

SEQ ID NO: 46609 - RNA, 32 nt, Human
agaggagccugagaagaggcagaggaagggcg

SEQ ID NO: 46610 - RNA, 23 nt, Human
agaggagcgagccaagcuggcca

SEQ ID NO: 46611 - RNA, 32 nt, Human
agaggagcgcugggcuggaggcauuuucccca

SEQ ID NO: 46612 - RNA, 32 nt, Human
agaggagcggucuguuacaucuucccauuugg

SEQ ID NO: 46613 - RNA, 32 nt, Human
agaggagcuugucuuccuuguccucuguuccc

SEQ ID NO: 46614 - RNA, 32 nt, Human
agaggaggaaacugaggcagggacaggggcuu

SEQ ID NO: 46615 - RNA, 19 nt, Human
agaggaggaaagagcaggc

SEQ ID NO: 46616 - RNA, 32 nt, Human
agaggaggaaagggaaaggguaggccuguaga

SEQ ID NO: 46617 - RNA, 22 nt, Human
agaggaggaagaagaggaggag

SEQ ID NO: 46618 - RNA, 22 nt, Human
agaggaggaagaggaaggggag

SEQ ID NO: 46619 - RNA, 32 nt, Human
agaggaggaagaggaaggggagagggacgaga

SEQ ID NO: 46620 - RNA, 32 nt, Human
agaggaggaagaggaggagaaggcgaggccac

SEQ ID NO: 46621 - RNA, 32 nt, Human
agaggaggaagugagacggggaagggaggagc

SEQ ID NO: 46622 - RNA, 25 nt, Human
agaggaggaaucguggaaaacaaga

SEQ ID NO: 46623 - RNA, 22 nt, Human
agaggaggacaaaaagggggag

SEQ ID NO: 46624 - RNA, 32 nt, Human
agaggaggacaguggaggugagcaugugaaag

SEQ ID NO: 46625 - RNA, 32 nt, Human
agaggaggacuccuccugggccuggugcuucg

SEQ ID NO: 46626 - RNA, 32 nt, Human
agaggaggacuggggcuugacaaggacacggg

SEQ ID NO: 46627 - RNA, 32 nt, Human
agaggaggagaaagaugacccagaaguggauu

SEQ ID NO: 46628 - RNA, 19 nt, Human
agaggaggagaaggaggag

SEQ ID NO: 46629 - RNA, 32 nt, Human
agaggaggagacccggccagaggagcagagcg

SEQ ID NO: 46630 - RNA, 20 nt, Human
agaggaggagacgaagggga

SEQ ID NO: 46631 - RNA, 32 nt, Human
agaggaggagcagcuuuacacugaugaagugu

SEQ ID NO: 46632 - RNA, 32 nt, Human
agaggaggagccaaggcagucagugggccgca

SEQ ID NO: 46633 - RNA, 21 nt, Human
agaggaggaggaaagggggag

SEQ ID NO: 46634 - RNA, 22 nt, Human
agaggaggaggaagaacgggag

SEQ ID NO: 46635 - RNA, 32 nt, Human
agaggaggaggaagaggaggaagaggaugacc

SEQ ID NO: 46636 - RNA, 22 nt, Human
agaggaggaggaggaagaggag

SEQ ID NO: 46637 - RNA, 21 nt, Human
agaggaggaggaggaagggag

SEQ ID NO: 46638 - RNA, 21 nt, Human
agaggaggaggaggaggaaga

SEQ ID NO: 46639 - RNA, 32 nt, Human
agaggaggaggaggaggaagaaagaaaaccaa

SEQ ID NO: 46640 - RNA, 32 nt, Human
agaggaggaggaggaggaagaauaggaggaaa

SEQ ID NO: 46641 - RNA, 32 nt, Human
agaggaggaggaggaggaggaagaagaaagau

SEQ ID NO: 46642 - RNA, 32 nt, Human
agaggaggaggaggaggaggaagagguggagg

SEQ ID NO: 46643 - RNA, 32 nt, Human
agaggaggaggaggaggaggaagcugaagacg

SEQ ID NO: 46644 - RNA, 32 nt, Human
agaggaggaggaggaggaggaaggggcuugga

SEQ ID NO: 46645 - RNA, 32 nt, Human
agaggaggaggaggaggaggagaaggcucugg

SEQ ID NO: 46646 - RNA, 32 nt, Human
agaggaggaggaggaggaggaggaggaggagg

SEQ ID NO: 46647 - RNA, 32 nt, Human
agaggaggaggccaucaccucuggccucuucc

SEQ ID NO: 46648 - RNA, 32 nt, Human
agaggaggaggcggcggcggggcagugaaacu

SEQ ID NO: 46649 - RNA, 32 nt, Human
agaggaggagguggagcaggaguggggagaga

SEQ ID NO: 46650 - RNA, 32 nt, Human
agaggaggaugagagcuucuccccagccuucc

SEQ ID NO: 46651 - RNA, 21 nt, Human
agaggaggcagagagagggag

SEQ ID NO: 46652 - RNA, 32 nt, Human
agaggaggccaaggagagguuguuuguucaug

SEQ ID NO: 46653 - RNA, 32 nt, Human
agaggaggcccaggcaauaucaggagucaagg

SEQ ID NO: 46654 - RNA, 32 nt, Human
agaggaggcccaggcagugccaggagucaagg

SEQ ID NO: 46655 - RNA, 32 nt, Human
agaggaggccucagcaagugucagccacacga

SEQ ID NO: 46656 - RNA, 32 nt, Human
agaggaggcgcgagaauggagguggaggccgu

SEQ ID NO: 46657 - RNA, 32 nt, Human
agaggaggcugacugggaugggguggcagcug

SEQ ID NO: 46658 - RNA, 32 nt, Human
agaggaggcuggcagagcuggggacugagggc

SEQ ID NO: 46659 - RNA, 32 nt, Human
agaggagggaaacugcccaguuuucccccggc

SEQ ID NO: 46660 - RNA, 32 nt, Human
agaggagggaaagggguggcucuggcaggaaa

SEQ ID NO: 46661 - RNA, 32 nt, Human
agaggagggagaggaggaagaggaaggggagg

SEQ ID NO: 46662 - RNA, 32 nt, Human
agaggagggagcaguuugcagugcccagccac

SEQ ID NO: 46663 - RNA, 32 nt, Human
agaggagggaggaggaauaaggggaaggaaga

SEQ ID NO: 46664 - RNA, 32 nt, Human
agaggagggaggaggcgcgccgcgccauggug

SEQ ID NO: 46665 - RNA, 32 nt, Human
agaggagggaggaucacuugaacccaggaauu

SEQ ID NO: 46666 - RNA, 32 nt, Human
agaggagggaggcaggcugcagcuucagccac

SEQ ID NO: 46667 - RNA, 32 nt, Human
agaggagggcacggggaagggcaaacggucca

SEQ ID NO: 46668 - RNA, 32 nt, Human
agaggagggcagugaauaugcugagaggaguu

SEQ ID NO: 46669 - RNA, 26 nt, Human
agaggagggcaugccauugcaagaga

SEQ ID NO: 46670 - RNA, 32 nt, Human
agaggagggccaagaaaaugagcuugguuucc

SEQ ID NO: 46671 - RNA, 32 nt, Human
agaggagggcccuguccggcauguguggguau

SEQ ID NO: 46672 - RNA, 32 nt, Human
agaggagggcuggaggcagagaguguaagugu

SEQ ID NO: 46673 - RNA, 32 nt, Human
agaggaggggaaggggaggcagaggaggaaca

SEQ ID NO: 46674 - RNA, 32 nt, Human
agaggaggggagagaggcaccuggcacucugc

SEQ ID NO: 46675 - RNA, 32 nt, Human
agaggaggggaggaggaggaggaggaggaggu

SEQ ID NO: 46676 - RNA, 32 nt, Human
agaggagggggaaggaaguaugacagauguua

SEQ ID NO: 46677 - RNA, 32 nt, Human
agaggagggggaccagcaccagcugggaggca

SEQ ID NO: 46678 - RNA, 19 nt, Human
agaggagggggcggaggca

SEQ ID NO: 46679 - RNA, 32 nt, Human
agaggagggggcuccaaugacacuccgggguu

SEQ ID NO: 46680 - RNA, 23 nt, Human
agaggagggggcuuccccaagga

SEQ ID NO: 46681 - RNA, 32 nt, Human
agaggaggggugaagauuggggccaguaucga

SEQ ID NO: 46682 - RNA, 32 nt, Human
agaggaggguggggucagggccgccccuucuc

SEQ ID NO: 46683 - RNA, 32 nt, Human
agaggagguagacucuuuggcacuuuggcaca

SEQ ID NO: 46684 - RNA, 32 nt, Human
agaggaggugaggagggaggaagcguccggag

SEQ ID NO: 46685 - RNA, 32 nt, Human
agaggaggugaguggcuuguugggaggaagcu

SEQ ID NO: 46686 - RNA, 32 nt, Human
agaggagguggaccagaacuuuuggaacuagu

SEQ ID NO: 46687 - RNA, 32 nt, Human
agaggagguggaggcuugaugaggagguggug

SEQ ID NO: 46688 - RNA, 32 nt, Human
agaggaggugugagcagcugaagggucgguca

SEQ ID NO: 46689 - RNA, 32 nt, Human
agaggaguagaagguaaaagaaaaugcuggga

SEQ ID NO: 46690 - RNA, 32 nt, Human
agaggagucaggaggugggaggccgugggcuu

SEQ ID NO: 46691 - RNA, 32 nt, Human
agaggaguccuuuccucucugccugcccuuuc

SEQ ID NO: 46692 - RNA, 32 nt, Human
agaggagucuauucaaaccucuugccuauuuu

SEQ ID NO: 46693 - RNA, 18 nt, Human
agaggagucucguucugu

SEQ ID NO: 46694 - RNA, 32 nt, Human
agaggagucugcucaggagccagcacaggaca

SEQ ID NO: 46695 - RNA, 32 nt, Human
agaggagugcacuugccagacacuucggggcu

SEQ ID NO: 46696 - RNA, 32 nt, Human
agaggagugccaccccgagcuuacccuucugg

SEQ ID NO: 46697 - RNA, 19 nt, Human
agaggagugcuuuucuucu

SEQ ID NO: 46698 - RNA, 21 nt, Human
agaggaguggccacaaggcca

SEQ ID NO: 46699 - RNA, 32 nt, Human
agaggaguggugguagagauagugacagccug

SEQ ID NO: 46700 - RNA, 32 nt, Human
agaggaguguaggccuuccagugcaggaaggu

SEQ ID NO: 46701 - RNA, 32 nt, Human
agaggagugucagacagcuguugucaacaggc

SEQ ID NO: 46702 - RNA, 32 nt, Human
agaggagugugagaggugaguccaagguugag

SEQ ID NO: 46703 - RNA, 24 nt, Human
agaggauagcacuggcaucuggca

SEQ ID NO: 46704 - RNA, 32 nt, Human
agaggaucaaaaccaucagcaacaacauaaua

SEQ ID NO: 46705 - RNA, 32 nt, Human
agaggaucaagacuucuuugugcucaaauacc

SEQ ID NO: 46706 - RNA, 32 nt, Human
agaggaucacuugaggccaggaguuccagacc

SEQ ID NO: 46707 - RNA, 32 nt, Human
agaggauccccgagagccacaccagcucugga

SEQ ID NO: 46708 - RNA, 32 nt, Human
agaggauccuugagcccaggagguugaggcug

SEQ ID NO: 46709 - RNA, 32 nt, Human
agaggaucugcuccacugucuccuggggcagu

SEQ ID NO: 46710 - RNA, 32 nt, Human
agaggaucugcuuuauagaauuuccuuucagu

SEQ ID NO: 46711 - RNA, 32 nt, Human
agaggaugaaguauauccuguaagucuaagga

SEQ ID NO: 46712 - RNA, 32 nt, Human
agaggaugaauacccauccuauccaaagggaa

SEQ ID NO: 46713 - RNA, 32 nt, Human
agaggaugaccagcaauuaauuauccccagaa

SEQ ID NO: 46714 - RNA, 32 nt, Human
agaggaugacucuagggugcucucccacuugc

SEQ ID NO: 46715 - RNA, 32 nt, Human
agaggaugacucuguucacacccaauccagcg

SEQ ID NO: 46716 - RNA, 32 nt, Human
agaggaugaggagaaacggaaugaggaagugc

SEQ ID NO: 46717 - RNA, 32 nt, Human
agaggaugcauauuauucagcaucagacagcc

SEQ ID NO: 46718 - RNA, 32 nt, Human
agaggaugcaucuggggagagcaaagcacuaa

SEQ ID NO: 46719 - RNA, 20 nt, Human
agaggaugcauuuucuucca

SEQ ID NO: 46720 - RNA, 30 nt, Human
agaggaugccccaggcccuggagcgugcag

SEQ ID NO: 46721 - RNA, 32 nt, Human
agaggaugcugaggccuucuuccaagaccaaa

SEQ ID NO: 46722 - RNA, 23 nt, Human
agaggaugcugcucaggagccag

SEQ ID NO: 46723 - RNA, 32 nt, Human
agaggaugugggguuguaguaccucuggguga

SEQ ID NO: 46724 - RNA, 32 nt, Human
agaggauuagguacuuaggagcaaagaaagaa

SEQ ID NO: 46725 - RNA, 32 nt, Human
agaggauugcuugaggccaggaguuuguuacc

SEQ ID NO: 46726 - RNA, 32 nt, Human
agaggcaaaaggaugcucugaaaugacugucc

SEQ ID NO: 46727 - RNA, 32 nt, Human
agaggcaaauggagaguaacagaagagugucu

SEQ ID NO: 46728 - RNA, 21 nt, Human
agaggcaacccugggggccag

SEQ ID NO: 46729 - RNA, 32 nt, Human
agaggcaacgggcggcagguugcaguggaggg

SEQ ID NO: 46730 - RNA, 32 nt, Human
agaggcaagaacucugcagcuuccugccuucu

SEQ ID NO: 46731 - RNA, 32 nt, Human
agaggcaagcagggcgggcuggauacggagcg

SEQ ID NO: 46732 - RNA, 32 nt, Human
agaggcaagggaaagccgaagacugaaaauug

SEQ ID NO: 46733 - RNA, 32 nt, Human
agaggcaagguuucaccaucuuggucaaguug

SEQ ID NO: 46734 - RNA, 32 nt, Human
agaggcaauacugauuauccacugggaaacag

SEQ ID NO: 46735 - RNA, 32 nt, Human
agaggcacagacauggcaggagagggaggggu

SEQ ID NO: 46736 - RNA, 32 nt, Human
agaggcacagucuguaucccaucucuaacuuc

SEQ ID NO: 46737 - RNA, 32 nt, Human
agaggcacauggucaggggacaauuguauaag

SEQ ID NO: 46738 - RNA, 32 nt, Human
agaggcacaugugcacgcacacacaacuugug

SEQ ID NO: 46739 - RNA, 32 nt, Human
agaggcaccaccuggggaagacugccuuggag

SEQ ID NO: 46740 - RNA, 32 nt, Human
agaggcaccagaggauuccugcucuguccccu

SEQ ID NO: 46741 - RNA, 32 nt, Human
agaggcacugagaguggaggucucagacucuu

SEQ ID NO: 46742 - RNA, 32 nt, Human
agaggcacuggcugcacuggacccaagcauag

SEQ ID NO: 46743 - RNA, 32 nt, Human
agaggcagaaaccaugugcagaggcugggaga

SEQ ID NO: 46744 - RNA, 32 nt, Human
agaggcagaagagacagacgaggcagagacaa

SEQ ID NO: 46745 - RNA, 32 nt, Human
agaggcagaagauuaagauaagaaauauaaga

SEQ ID NO: 46746 - RNA, 32 nt, Human
agaggcagacaggcgcuggacagaggggcagg

SEQ ID NO: 46747 - RNA, 19 nt, Human
agaggcagagacccagggg

SEQ ID NO: 46748 - RNA, 32 nt, Human
agaggcagagagaaacagagacagagagacag

SEQ ID NO: 46749 - RNA, 32 nt, Human
agaggcagagagaaacagagacagagaggcag

SEQ ID NO: 46750 - RNA, 32 nt, Human
agaggcagagccaagaccagaacccagguuuc

SEQ ID NO: 46751 - RNA, 32 nt, Human
agaggcagagccucuguggccuagcuagugac

SEQ ID NO: 46752 - RNA, 32 nt, Human
agaggcagaggcaggagaaucgcuugaaccug

SEQ ID NO: 46753 - RNA, 32 nt, Human
agaggcagagucucaccauguugccuaggcug

SEQ ID NO: 46754 - RNA, 32 nt, Human
agaggcagaguuucaccauguuggccaggaug

SEQ ID NO: 46755 - RNA, 32 nt, Human
agaggcagaguuugcagugagcugagaucgug

SEQ ID NO: 46756 - RNA, 32 nt, Human
agaggcagcaaagcagcccuuauaggguauuu

SEQ ID NO: 46757 - RNA, 18 nt, Human
agaggcagcacccaggag

SEQ ID NO: 46758 - RNA, 32 nt, Human
agaggcagcagugauggcuacagccauaccuu

SEQ ID NO: 46759 - RNA, 19 nt, Human
agaggcagccacucaugga

SEQ ID NO: 46760 - RNA, 32 nt, Human
agaggcagcccagccccggccucccagcuuac

SEQ ID NO: 46761 - RNA, 21 nt, Human
agaggcagccccaagaaccua

SEQ ID NO: 46762 - RNA, 32 nt, Human
agaggcagcucagaguggaggcucuaggcagg

SEQ ID NO: 46763 - RNA, 23 nt, Human
agaggcagcugcuccaggaacag

SEQ ID NO: 46764 - RNA, 32 nt, Human
agaggcagcugggggcagggaggacucauuaa

SEQ ID NO: 46765 - RNA, 32 nt, Human
agaggcaggaagagcuagucuuagcauuuaua

SEQ ID NO: 46766 - RNA, 32 nt, Human
agaggcaggaggaucacuugagcccaggaguu

SEQ ID NO: 46767 - RNA, 32 nt, Human
agaggcaggaggaucgcuugagcccagcaugg

SEQ ID NO: 46768 - RNA, 32 nt, Human
agaggcaggaugucaccauguuuuccaggcug

SEQ ID NO: 46769 - RNA, 32 nt, Human
agaggcaggauuucaccauguuuuccaggcug

SEQ ID NO: 46770 - RNA, 32 nt, Human
agaggcaggcacaagacaaaaugaaucucucc

SEQ ID NO: 46771 - RNA, 32 nt, Human
agaggcaggcagaccugggccucccaggaugg

SEQ ID NO: 46772 - RNA, 32 nt, Human
agaggcagggucuugcuauauugcucggaggu

SEQ ID NO: 46773 - RNA, 32 nt, Human
agaggcagggucuugcucuaucacccaagcug

SEQ ID NO: 46774 - RNA, 32 nt, Human
agaggcagggucuugcuguauugcccaggcug

SEQ ID NO: 46775 - RNA, 32 nt, Human
agaggcaggguuuagccauguugaucaggcug

SEQ ID NO: 46776 - RNA, 32 nt, Human
agaggcaggguuucaccauguuagccaggaug

SEQ ID NO: 46777 - RNA, 32 nt, Human
agaggcaggguuucaccauguugaccaggcug

SEQ ID NO: 46778 - RNA, 32 nt, Human
agaggcaggguuucaccauguuggccaggcug

SEQ ID NO: 46779 - RNA, 32 nt, Human
agaggcaggguuucuccauguuggucaggcug

SEQ ID NO: 46780 - RNA, 32 nt, Human
agaggcaggucucugagucuccuggccaggaa

SEQ ID NO: 46781 - RNA, 32 nt, Human
agaggcagguuuucaccauguuggcuaggcug

SEQ ID NO: 46782 - RNA, 32 nt, Human
agaggcaguaggaacccagcucucagggcugu

SEQ ID NO: 46783 - RNA, 21 nt, Human
agaggcaguuaacccuguagc

SEQ ID NO: 46784 - RNA, 32 nt, Human
agaggcauggcugggccuccaucucugccuaa

SEQ ID NO: 46785 - RNA, 27 nt, Human
agaggcauuucagaguaggagaugcag

SEQ ID NO: 46786 - RNA, 32 nt, Human
agaggcauuugcaccagcucccugcacacucg

SEQ ID NO: 46787 - RNA, 32 nt, Human
agaggcauuugugucaugaggaaucucuccug

SEQ ID NO: 46788 - RNA, 32 nt, Human
agaggccaaaaccaggcuucagguucgggaag

SEQ ID NO: 46789 - RNA, 32 nt, Human
agaggccaaagaaggaggauggcuugagccca

SEQ ID NO: 46790 - RNA, 32 nt, Human
agaggccaaggcaggaggauugcuugaguuca

SEQ ID NO: 46791 - RNA, 32 nt, Human
agaggccaaggcaugagaaucgcuugaaccug

SEQ ID NO: 46792 - RNA, 32 nt, Human
agaggccaaggcugauaguuuagaugaaaaga

SEQ ID NO: 46793 - RNA, 32 nt, Human
agaggccaaggugggagaauugcuugaggcca

SEQ ID NO: 46794 - RNA, 32 nt, Human
agaggccacaaagacauuacaguuuuuguucc

SEQ ID NO: 46795 - RNA, 32 nt, Human
agaggccacagcugcuggcuuccugggcuucu

SEQ ID NO: 46796 - RNA, 32 nt, Human
agaggccacaugcuuuccucacaguuucucuc

SEQ ID NO: 46797 - RNA, 32 nt, Human
agaggccaccacugcuuuucaugcaggaguua

SEQ ID NO: 46798 - RNA, 32 nt, Human
agaggccaccccggcccggccuccaggcagag

SEQ ID NO: 46799 - RNA, 32 nt, Human
agaggccaccucuccugggcuucucagugucu

SEQ ID NO: 46800 - RNA, 32 nt, Human
agaggccacucgggggcaucgcgaguacacgg

SEQ ID NO: 46801 - RNA, 32 nt, Human
agaggccacugcaccugggcuagggguccaca

SEQ ID NO: 46802 - RNA, 32 nt, Human
agaggccacuggccaggccucccaggcaggug

SEQ ID NO: 46803 - RNA, 32 nt, Human
agaggccacuggcuuccagaugucccagccuc

SEQ ID NO: 46804 - RNA, 32 nt, Human
agaggccacugucccuuaagacugccggaguc

SEQ ID NO: 46805 - RNA, 32 nt, Human
agaggccagcagaggagccagcuuacaggaug

SEQ ID NO: 46806 - RNA, 32 nt, Human
agaggccagcugcacuccugcacgggguuccu

SEQ ID NO: 46807 - RNA, 32 nt, Human
agaggccagcuguguucgaguccucugugccu

SEQ ID NO: 46808 - RNA, 32 nt, Human
agaggccagggaggguuuaggggaugguucug

SEQ ID NO: 46809 - RNA, 32 nt, Human
agaggccaggguggccagcaguggcugggucc

SEQ ID NO: 46810 - RNA, 15 nt, Human
agaggccaggugcuc

SEQ ID NO: 46811 - RNA, 32 nt, Human
agaggccagguugaggggauuacuugagccca

SEQ ID NO: 46812 - RNA, 17 nt, Human
agaggccaucaagcaca

SEQ ID NO: 46813 - RNA, 32 nt, Human
agaggccaucugcagggccaagccacaggaag

SEQ ID NO: 46814 - RNA, 32 nt, Human
agaggccaugaaggagcaaguuuuguauuugu

SEQ ID NO: 46815 - RNA, 22 nt, Human
agaggccaugcgcaaugugugg

SEQ ID NO: 46816 - RNA, 32 nt, Human
agaggccauuacuguaucucauggccucuuga

SEQ ID NO: 46817 - RNA, 32 nt, Human
agaggccauucaaccgucaaacaccauuuggu

SEQ ID NO: 46818 - RNA, 32 nt, Human
agaggcccaagucccuaggagacgccaguccc

SEQ ID NO: 46819 - RNA, 32 nt, Human
agaggcccagcccucagaaacccuucagugcu

SEQ ID NO: 46820 - RNA, 19 nt, Human
agaggcccaggaaucggag

SEQ ID NO: 46821 - RNA, 28 nt, Human
agaggcccaggaugagccucaucuuguc

SEQ ID NO: 46822 - RNA, 32 nt, Human
agaggcccaggaugguggaggcugaggaacug

SEQ ID NO: 46823 - RNA, 32 nt, Human
agaggcccaggcagccaccagcacagagaaga

SEQ ID NO: 46824 - RNA, 32 nt, Human
agaggcccaguagacaugcaccaccugcuuga

SEQ ID NO: 46825 - RNA, 32 nt, Human
agaggcccaugcuggagacuggaaggguuccc

SEQ ID NO: 46826 - RNA, 32 nt, Human
agaggccccacgcccccacucucccuccacac

SEQ ID NO: 46827 - RNA, 32 nt, Human
agaggccccagccgacaagugucgcccacaag

SEQ ID NO: 46828 - RNA, 32 nt, Human
agaggccccagccugcggcccuggagcgcuac

SEQ ID NO: 46829 - RNA, 19 nt, Human
agaggccccgggcccagga

SEQ ID NO: 46830 - RNA, 17 nt, Human
agaggccccuucuuggg

SEQ ID NO: 46831 - RNA, 32 nt, Human
agaggccccuugcccaccaugaagggaaccug

SEQ ID NO: 46832 - RNA, 32 nt, Human
agaggcccggggccaggaaagcagagacagac

SEQ ID NO: 46833 - RNA, 18 nt, Human
agaggcccuccucugccu

SEQ ID NO: 46834 - RNA, 21 nt, Human
agaggcccucgggccuggaga

SEQ ID NO: 46835 - RNA, 21 nt, Human
agaggcccucucucagaugaa

SEQ ID NO: 46836 - RNA, 32 nt, Human
agaggcccucucuccucccugccuccugaccc

SEQ ID NO: 46837 - RNA, 32 nt, Human
agaggcccugcagagcggcaggauggagauau

SEQ ID NO: 46838 - RNA, 32 nt, Human
agaggcccugcagagcggcaggauggagaugu

SEQ ID NO: 46839 - RNA, 32 nt, Human
agaggcccugccugaacccacagugccaggca

SEQ ID NO: 46840 - RNA, 32 nt, Human
agaggcccuggaauugugggugaggcugucug

SEQ ID NO: 46841 - RNA, 32 nt, Human
agaggcccuggaggaggguggggcuggccggg

SEQ ID NO: 46842 - RNA, 32 nt, Human
agaggcccugggccgaggugcagugacccugc

SEQ ID NO: 46843 - RNA, 32 nt, Human
agaggccgaaacaggaggauccuuugagccua

SEQ ID NO: 46844 - RNA, 32 nt, Human
agaggccgacucagaggagacucugcugcuug

SEQ ID NO: 46845 - RNA, 32 nt, Human
agaggccgacuggagcaagguuugcuggcaga

SEQ ID NO: 46846 - RNA, 32 nt, Human
agaggccgagauaggcggauugcuugagccca

SEQ ID NO: 46847 - RNA, 32 nt, Human
agaggccgaggugagacgggaagauggcuuga

SEQ ID NO: 46848 - RNA, 32 nt, Human
agaggccggagggagaggaggcgaggggcggc

SEQ ID NO: 46849 - RNA, 32 nt, Human
agaggccggcagaucacuugagcccaggaguu

SEQ ID NO: 46850 - RNA, 32 nt, Human
agaggccgucaacauggaaaagcagccccaga

SEQ ID NO: 46851 - RNA, 27 nt, Human
agaggccuaagaggcucacugcccuau

SEQ ID NO: 46852 - RNA, 24 nt, Human
agaggccuaaguuugcuggccugu

SEQ ID NO: 46853 - RNA, 32 nt, Human
agaggccuccacucacuccagaccccuauagc

SEQ ID NO: 46854 - RNA, 32 nt, Human
agaggccuccugccggcaaccagcacuagugg

SEQ ID NO: 46855 - RNA, 32 nt, Human
agaggccugacccccugcuccuggccugaaau

SEQ ID NO: 46856 - RNA, 32 nt, Human
agaggccugagagcgggagggccaggcugcca

SEQ ID NO: 46857 - RNA, 32 nt, Human
agaggccugcagccucccacaugccuuaaggg

SEQ ID NO: 46858 - RNA, 32 nt, Human
agaggccuggaccaccuggggcucccugagga

SEQ ID NO: 46859 - RNA, 32 nt, Human
agaggccuggcaggcaggcuuggcaugguugg

SEQ ID NO: 46860 - RNA, 32 nt, Human
agaggccugggaaaggagauagccuugcuccg

SEQ ID NO: 46861 - RNA, 32 nt, Human
agaggccugggccugcacugccugcagccgac

SEQ ID NO: 46862 - RNA, 32 nt, Human
agaggccuggggugggacagggagggccggcg

SEQ ID NO: 46863 - RNA, 32 nt, Human
agaggccuguaaucccagcuacuugggaggcu

SEQ ID NO: 46864 - RNA, 32 nt, Human
agaggccuguaaucccaguuccuugggaggcu

SEQ ID NO: 46865 - RNA, 32 nt, Human
agaggccuucaucugccaucacucgugucucu

SEQ ID NO: 46866 - RNA, 32 nt, Human
agaggccuuguccuguuucuguguucuguuuc

SEQ ID NO: 46867 - RNA, 32 nt, Human
agaggcgaacagcucaggcagcgcagguguga

SEQ ID NO: 46868 - RNA, 32 nt, Human
agaggcgaaguuuccccauguuggccaggcug

SEQ ID NO: 46869 - RNA, 23 nt, Human
agaggcgaccugucaggggccag

SEQ ID NO: 46870 - RNA, 32 nt, Human
agaggcgagagggagagcgugcgcgagaggag

SEQ ID NO: 46871 - RNA, 19 nt, Human
agaggcgagcagagcccgc

SEQ ID NO: 46872 - RNA, 32 nt, Human
agaggcgcagagguggccgcugugcugucccg

SEQ ID NO: 46873 - RNA, 19 nt, Human
agaggcgccccggggggug

SEQ ID NO: 46874 - RNA, 32 nt, Human
agaggcgccgugccucgggccccuggugggag

SEQ ID NO: 46875 - RNA, 32 nt, Human
agaggcgccugccaccuccuccucaucuccgg

SEQ ID NO: 46876 - RNA, 32 nt, Human
agaggcgccuucucuucucugggcauuccccg

SEQ ID NO: 46877 - RNA, 32 nt, Human
agaggcgcuacgguggcaucacagauccuggc

SEQ ID NO: 46878 - RNA, 32 nt, Human
agaggcgcugggaagauggcuggugaggagcu

SEQ ID NO: 46879 - RNA, 32 nt, Human
agaggcgcuuggcugggcucucagcccgccac

SEQ ID NO: 46880 - RNA, 17 nt, Human
agaggcggaagaggagg

SEQ ID NO: 46881 - RNA, 32 nt, Human
agaggcggagagaaugugggagcacuucagag

SEQ ID NO: 46882 - RNA, 24 nt, Human
agaggcggagccgccgcccugccg

SEQ ID NO: 46883 - RNA, 20 nt, Human
agaggcggagcgagcccccg

SEQ ID NO: 46884 - RNA, 21 nt, Human
agaggcggagcuggcccggcg

SEQ ID NO: 46885 - RNA, 32 nt, Human
agaggcggagucugaggagcuggggaaggaac

SEQ ID NO: 46886 - RNA, 32 nt, Human
agaggcggaguuucaccauguuggccaggaug

SEQ ID NO: 46887 - RNA, 32 nt, Human
agaggcggaguuucgccauguuggucaggcug

SEQ ID NO: 46888 - RNA, 32 nt, Human
agaggcggcaggaggagcaggagaggcugcug

SEQ ID NO: 46889 - RNA, 32 nt, Human
agaggcgggaggauugagugaggccaggaguu

SEQ ID NO: 46890 - RNA, 32 nt, Human
agaggcgggaggauugagugggccaggaguuc

SEQ ID NO: 46891 - RNA, 32 nt, Human
agaggcgggaggauugagugggccaggaguuu

SEQ ID NO: 46892 - RNA, 32 nt, Human
agaggcgggaggauugcuugaggccgaggguu

SEQ ID NO: 46893 - RNA, 32 nt, Human
agaggcgggcagaucacuugaggucaggaguu

SEQ ID NO: 46894 - RNA, 32 nt, Human
agaggcgggcggaucacuugagacaggccugg

SEQ ID NO: 46895 - RNA, 31 nt, Human
agaggcgggcuucucccagccaugguguccc

SEQ ID NO: 46896 - RNA, 32 nt, Human
agaggcgggggacagcagaggcugcagacugg

SEQ ID NO: 46897 - RNA, 32 nt, Human
agaggcgggguuucaccaugcuggucaggaug

SEQ ID NO: 46898 - RNA, 32 nt, Human
agaggcgggguuucaccauguuagccaggaug

SEQ ID NO: 46899 - RNA, 32 nt, Human
agaggcgggguuucaccauguugcccagacug

SEQ ID NO: 46900 - RNA, 32 nt, Human
agaggcgggguuucaccauguuggccaggaug

SEQ ID NO: 46901 - RNA, 32 nt, Human
agaggcgggguuucaccauguuggccaggcug

SEQ ID NO: 46902 - RNA, 32 nt, Human
agaggcgggguuucaccauguuggcuaggaug

SEQ ID NO: 46903 - RNA, 32 nt, Human
agaggcgggguuucaucauguugaacuccuga

SEQ ID NO: 46904 - RNA, 32 nt, Human
agaggcgggguuucaucauguuggccaggcug

SEQ ID NO: 46905 - RNA, 32 nt, Human
agaggcgggguuucgccauguuacacuggcug

SEQ ID NO: 46906 - RNA, 32 nt, Human
agaggcgggguuucgccauguugcccaggcua

SEQ ID NO: 46907 - RNA, 32 nt, Human
agaggcgggguuucgucauguuggccaggcug

SEQ ID NO: 46908 - RNA, 32 nt, Human
agaggcgugaccaaggccacagagcuaugggu

SEQ ID NO: 46909 - RNA, 32 nt, Human
agaggcgugagcccucucagucucacaguccc

SEQ ID NO: 46910 - RNA, 32 nt, Human
agaggcgugaggagaggaaagcagggaggucu

SEQ ID NO: 46911 - RNA, 32 nt, Human
agaggcgugauaucuggauggaaguugggcug

SEQ ID NO: 46912 - RNA, 32 nt, Human
agaggcuaaaaguuuuuaaauuagcugugugg

SEQ ID NO: 46913 - RNA, 32 nt, Human
agaggcuaagacgggaggauugcuugaaucca

SEQ ID NO: 46914 - RNA, 32 nt, Human
agaggcuaagccauaauagaaagaauggagaa

SEQ ID NO: 46915 - RNA, 32 nt, Human
agaggcuaaggcaggaaaaucgcuugaaccca

SEQ ID NO: 46916 - RNA, 32 nt, Human
agaggcuaaggcaggagaauugcuugaaccug

SEQ ID NO: 46917 - RNA, 32 nt, Human
agaggcuacaaggacuuagugcaucagaugua

SEQ ID NO: 46918 - RNA, 23 nt, Human
agaggcuagaaucaucuuuccua

SEQ ID NO: 46919 - RNA, 32 nt, Human
agaggcuaggagaggcugggcccggugaaaag

SEQ ID NO: 46920 - RNA, 21 nt, Human
agaggcuauuuuugcuccaca

SEQ ID NO: 46921 - RNA, 32 nt, Human
agaggcucacugcccuaucuccuucuuuccuc

SEQ ID NO: 46922 - RNA, 32 nt, Human
agaggcucagcaaugucuucgaccacguggug

SEQ ID NO: 46923 - RNA, 32 nt, Human
agaggcucagcauccugcacaugcccuuucca

SEQ ID NO: 46924 - RNA, 32 nt, Human
agaggcucagccagcucagagcgcagccugga

SEQ ID NO: 46925 - RNA, 32 nt, Human
agaggcucagcccuagggaaaggcugcucuug

SEQ ID NO: 46926 - RNA, 32 nt, Human
agaggcucagcugaggcaagaagagcaccauc

SEQ ID NO: 46927 - RNA, 32 nt, Human
agaggcucagucuguugagucuguugugacug

SEQ ID NO: 46928 - RNA, 32 nt, Human
agaggcucccuaaugugcuccuguccuccaug

SEQ ID NO: 46929 - RNA, 32 nt, Human
agaggcucccucugccaagaaagcagagaucu

SEQ ID NO: 46930 - RNA, 32 nt, Human
agaggcuccuuucauaugccugaggccacacc

SEQ ID NO: 46931 - RNA, 32 nt, Human
agaggcucguauuguguuucugcugaccaaag

SEQ ID NO: 46932 - RNA, 32 nt, Human
agaggcucuagcugugugcggggccugaaggg

SEQ ID NO: 46933 - RNA, 32 nt, Human
agaggcucucuccuggugccugcaccugcacu

SEQ ID NO: 46934 - RNA, 24 nt, Human
agaggcucugugccgccgcuguca

SEQ ID NO: 46935 - RNA, 32 nt, Human
agaggcucuguggcgggggucccugagagugc

SEQ ID NO: 46936 - RNA, 32 nt, Human
agaggcugaacaugaauccacagaucagaaac

SEQ ID NO: 46937 - RNA, 32 nt, Human
agaggcugaacaugaauccacagaucagaaau

SEQ ID NO: 46938 - RNA, 32 nt, Human
agaggcugaaccgccccugccugccgcgcauc

SEQ ID NO: 46939 - RNA, 32 nt, Human
agaggcugaaggacagggaacucuccauuauu

SEQ ID NO: 46940 - RNA, 32 nt, Human
agaggcugacugcucacaccugggcagcacuc

SEQ ID NO: 46941 - RNA, 31 nt, Human
agaggcugacuucugcccccuugucaaggag

SEQ ID NO: 46942 - RNA, 32 nt, Human
agaggcugagagaagaaggaagaaucagccca

SEQ ID NO: 46943 - RNA, 32 nt, Human
agaggcugagccaggaggaucgcuugagccca

SEQ ID NO: 46944 - RNA, 32 nt, Human
agaggcugagccgggaagauugcuugagccca

SEQ ID NO: 46945 - RNA, 32 nt, Human
agaggcugagcugagugcgcgugagaaagagg

SEQ ID NO: 46946 - RNA, 32 nt, Human
agaggcugaggcacgagaauugcuugaaccca

SEQ ID NO: 46947 - RNA, 32 nt, Human
agaggcugaggcagcagaauugcuugaacccg

SEQ ID NO: 46948 - RNA, 32 nt, Human
agaggcugaggcaggaaaaucgcuugaacccg

SEQ ID NO: 46949 - RNA, 32 nt, Human
agaggcugaggcaggaaaaucgcuugaaccug

SEQ ID NO: 46950 - RNA, 32 nt, Human
agaggcugaggcaggaaaauugcuugaaccug

SEQ ID NO: 46951 - RNA, 32 nt, Human
agaggcugaggcaggagaaucgccugaaccca

SEQ ID NO: 46952 - RNA, 32 nt, Human
agaggcugaggcaggagaaucgcuugaaccca

SEQ ID NO: 46953 - RNA, 32 nt, Human
agaggcugaggcaggagaaucgcuugaaccug

SEQ ID NO: 46954 - RNA, 32 nt, Human
agaggcugaggcaggagaaucgcuugaacuug

SEQ ID NO: 46955 - RNA, 32 nt, Human
agaggcugaggcaggagaauugcuugaaccca

SEQ ID NO: 46956 - RNA, 32 nt, Human
agaggcugaggcaggagaauugcuugaaccug

SEQ ID NO: 46957 - RNA, 32 nt, Human
agaggcugaggcaggagaauugcuugaacgcg

SEQ ID NO: 46958 - RNA, 32 nt, Human
agaggcugaggcaggaggacugcuugagccca

SEQ ID NO: 46959 - RNA, 32 nt, Human
agaggcugaggcaggaggaucccuugagccca

SEQ ID NO: 46960 - RNA, 32 nt, Human
agaggcugaggcaggaggaucgcuugaacccg

SEQ ID NO: 46961 - RNA, 32 nt, Human
agaggcugaggcaggaggauugcuggaggcca

SEQ ID NO: 46962 - RNA, 32 nt, Human
agaggcugaggcaggaggauugcuugagcccu

SEQ ID NO: 46963 - RNA, 32 nt, Human
agaggcugaggcaggaggauugcuugagucca

SEQ ID NO: 46964 - RNA, 32 nt, Human
agaggcugaggcaugaggaucucuugaacccg

SEQ ID NO: 46965 - RNA, 32 nt, Human
agaggcugaggccagagaaucgcuugaaccug

SEQ ID NO: 46966 - RNA, 32 nt, Human
agaggcugaggcgggaggaucgcuugagccaa

SEQ ID NO: 46967 - RNA, 32 nt, Human
agaggcugaggcgggaggauugcuugagccca

SEQ ID NO: 46968 - RNA, 32 nt, Human
agaggcugaggcuggagaaucgcuugaacccg

SEQ ID NO: 46969 - RNA, 32 nt, Human
agaggcugagguaggaggaucgccugaccagg

SEQ ID NO: 46970 - RNA, 32 nt, Human
agaggcugaggugagaggagcaagugagccca

SEQ ID NO: 46971 - RNA, 32 nt, Human
agaggcugaggugggagaaucgcuugaacccg

SEQ ID NO: 46972 - RNA, 32 nt, Human
agaggcugaggugggaggaucgcuugagcccc

SEQ ID NO: 46973 - RNA, 32 nt, Human
agaggcugaggugggaggauugcuugagccca

SEQ ID NO: 46974 - RNA, 32 nt, Human
agaggcugagucaggagaauugcuugaacccu

SEQ ID NO: 46975 - RNA, 31 nt, Human
agaggcugaguggaaagguggucuggagccc

SEQ ID NO: 46976 - RNA, 32 nt, Human
agaggcugauugaggaguccugcuggcccacu

SEQ ID NO: 46977 - RNA, 32 nt, Human
agaggcugauuucuccccucuccugggccagg

SEQ ID NO: 46978 - RNA, 32 nt, Human
agaggcugcaauaaggugccaugaaaucaaaa

SEQ ID NO: 46979 - RNA, 32 nt, Human
agaggcugcaauauuccauccugggugucugg

SEQ ID NO: 46980 - RNA, 32 nt, Human
agaggcugcaauauuccguccugggugucugg

SEQ ID NO: 46981 - RNA, 32 nt, Human
agaggcugcacccuccaaccucccauuggcuc

SEQ ID NO: 46982 - RNA, 32 nt, Human
agaggcugcacucuagccugggcaacagagca

SEQ ID NO: 46983 - RNA, 23 nt, Human
agaggcugcaggaacuugugugg

SEQ ID NO: 46984 - RNA, 32 nt, Human
agaggcugcaggacugggcacagcaugagauc

SEQ ID NO: 46985 - RNA, 32 nt, Human
agaggcugcaucacucagcucuuuuucuugca

SEQ ID NO: 46986 - RNA, 32 nt, Human
agaggcugccucugugugugguuuaaguaaac

SEQ ID NO: 46987 - RNA, 32 nt, Human
agaggcugccuuucugguuccaucuccuuggg

SEQ ID NO: 46988 - RNA, 32 nt, Human
agaggcugcuccugccugcuucgaucauuucu

SEQ ID NO: 46989 - RNA, 32 nt, Human
agaggcugcucuggagaacaaugagguccuca

SEQ ID NO: 46990 - RNA, 32 nt, Human
agaggcugcugaggccugggccccaggggcgu

SEQ ID NO: 46991 - RNA, 32 nt, Human
agaggcugcugagggcagaggaugcaacacua

SEQ ID NO: 46992 - RNA, 32 nt, Human
agaggcuggaaugggugucccagcaagagaug

SEQ ID NO: 46993 - RNA, 32 nt, Human
agaggcuggacagagggaggauucaagucggg

SEQ ID NO: 46994 - RNA, 32 nt, Human
agaggcuggaggaucauuucagcccaggaggu

SEQ ID NO: 46995 - RNA, 32 nt, Human
agaggcuggcaaugcuguuucacuggaggaca

SEQ ID NO: 46996 - RNA, 32 nt, Human
agaggcuggcacugagccugcuuguugggaaa

SEQ ID NO: 46997 - RNA, 32 nt, Human
agaggcugggccaggcuucaguucaggccugu

SEQ ID NO: 46998 - RNA, 32 nt, Human
agaggcugggcugguuuaucuccucugccuag

SEQ ID NO: 46999 - RNA, 32 nt, Human
agaggcuggggugggcagauugcuugagcuga

SEQ ID NO: 47000 - RNA, 19 nt, Human
agaggcugggugggccagg

SEQ ID NO: 47001 - RNA, 32 nt, Human
agaggcuggugagggagcaggaagcagugugu

SEQ ID NO: 47002 - RNA, 32 nt, Human
agaggcuguagacccuccgcucuugggcacgu

SEQ ID NO: 47003 - RNA, 32 nt, Human
agaggcugucauauaucaaagcagcucaggug

SEQ ID NO: 47004 - RNA, 32 nt, Human
agaggcugucccuggaccuggagcugcaggca

SEQ ID NO: 47005 - RNA, 32 nt, Human
agaggcugucccuugcagacacaugccccuuu

SEQ ID NO: 47006 - RNA, 32 nt, Human
agaggcugugaagugcugaaucaccuuuaaug

SEQ ID NO: 47007 - RNA, 31 nt, Human
agaggcugugggcugucacagaugcuguguc

SEQ ID NO: 47008 - RNA, 32 nt, Human
agaggcugugugagaagcugcagccgccggca

SEQ ID NO: 47009 - RNA, 32 nt, Human
agaggcuuaccccuguaagaacagauauaagu

SEQ ID NO: 47010 - RNA, 32 nt, Human
agaggcuuagaggcgagugggaagggacucag

SEQ ID NO: 47011 - RNA, 32 nt, Human
agaggcuucaccagcugaauucugugccuaac

SEQ ID NO: 47012 - RNA, 32 nt, Human
agaggcuuccacccugcucacauguugggaau

SEQ ID NO: 47013 - RNA, 32 nt, Human
agaggcuucccuggcuggugccugagcccggc

SEQ ID NO: 47014 - RNA, 32 nt, Human
agaggcuuccuugagccacccuucccacccca

SEQ ID NO: 47015 - RNA, 32 nt, Human
agaggcuucuccccagcucugugcuuccacug

SEQ ID NO: 47016 - RNA, 32 nt, Human
agaggcuugaaccuggcaccacaggggucugg

SEQ ID NO: 47017 - RNA, 32 nt, Human
agaggcuugacucgucucaggugcaauccuua

SEQ ID NO: 47018 - RNA, 32 nt, Human
agaggcuugccuggcuauuccuguucuggugu

SEQ ID NO: 47019 - RNA, 32 nt, Human
agaggcuuggaccugggcagcuccugccccuc

SEQ ID NO: 47020 - RNA, 32 nt, Human
agaggcuugggaugaagggugggugaaguuga

SEQ ID NO: 47021 - RNA, 32 nt, Human
agaggcuuguaaccugaacuucuguguggugg

SEQ ID NO: 47022 - RNA, 32 nt, Human
agaggcuuguaagagcagauugacaggugaau

SEQ ID NO: 47023 - RNA, 32 nt, Human
agaggcuuguuggaaucaauucugcacaauag

SEQ ID NO: 47024 - RNA, 32 nt, Human
agaggcuuuccagauuguucuaaagaagacuu

SEQ ID NO: 47025 - RNA, 32 nt, Human
agaggcuuucucucugaccucauuccaagauc

SEQ ID NO: 47026 - RNA, 32 nt, Human
agagggaaaauaaccuguccaaagucacacag

SEQ ID NO: 47027 - RNA, 32 nt, Human
agagggaaaaugacugcgcccagccugauuua

SEQ ID NO: 47028 - RNA, 20 nt, Human
agagggaaaauugcagggac

SEQ ID NO: 47029 - RNA, 32 nt, Human
agagggaaacacagcagcaucucuccacugaa

SEQ ID NO: 47030 - RNA, 32 nt, Human
agagggaaacauuugugcuuuuagggauaauc

SEQ ID NO: 47031 - RNA, 32 nt, Human
agagggaaagcgacccagacagcagccccucc

SEQ ID NO: 47032 - RNA, 32 nt, Human
agagggaaagcgagagggagacggacguugag

SEQ ID NO: 47033 - RNA, 32 nt, Human
agagggaaagucacuugcccaaagucacccag

SEQ ID NO: 47034 - RNA, 21 nt, Human
agagggaaauuuauagcacua

SEQ ID NO: 47035 - RNA, 32 nt, Human
agagggaacaguugggacuagaagcaaaagug

SEQ ID NO: 47036 - RNA, 32 nt, Human
agagggaagagagagggaugagagggagggag

SEQ ID NO: 47037 - RNA, 32 nt, Human
agagggaagagcaaaccccagcgagauccccc

SEQ ID NO: 47038 - RNA, 32 nt, Human
agagggaagaggagagaaaagacagggacuuu

SEQ ID NO: 47039 - RNA, 32 nt, Human
agagggaagcccuugcugccugccauucccag

SEQ ID NO: 47040 - RNA, 32 nt, Human
agagggaagccuauuuuguuaacugguuuggg

SEQ ID NO: 47041 - RNA, 32 nt, Human
agagggaaggaggaggaggaggagcaaaggug

SEQ ID NO: 47042 - RNA, 32 nt, Human
agagggaaguggagaggguaggcugggaccag

SEQ ID NO: 47043 - RNA, 32 nt, Human
agagggacaacauccaaacuguuugcaguagg

SEQ ID NO: 47044 - RNA, 32 nt, Human
agagggaccagaacuuccccucccuuccccuu

SEQ ID NO: 47045 - RNA, 32 nt, Human
agagggaccuggcaggcagagcuccagaaggg

SEQ ID NO: 47046 - RNA, 32 nt, Human
agagggacguggggagaaagaagccagaagcc

SEQ ID NO: 47047 - RNA, 32 nt, Human
agagggacugagacccagggaggcugaaugac

SEQ ID NO: 47048 - RNA, 32 nt, Human
agagggacugcacucuugucagggaagcccua

SEQ ID NO: 47049 - RNA, 32 nt, Human
agagggacugccuucucccaaaaggagcuccc

SEQ ID NO: 47050 - RNA, 32 nt, Human
agagggacugggcggcuugucccaggcugcug

SEQ ID NO: 47051 - RNA, 32 nt, Human
agagggacugugugagaagggaagagacugcu

SEQ ID NO: 47052 - RNA, 22 nt, Human
agagggagaaaacgaaggggag

SEQ ID NO: 47053 - RNA, 32 nt, Human
agagggagaaauguucauugcacagagaaugu

SEQ ID NO: 47054 - RNA, 32 nt, Human
agagggagaccccauuccaagcucccucuucc

SEQ ID NO: 47055 - RNA, 32 nt, Human
agagggagagaagggcuccccagaucuacacc

SEQ ID NO: 47056 - RNA, 20 nt, Human
agagggagagagaagaagag

SEQ ID NO: 47057 - RNA, 32 nt, Human
agagggagagagaagaagaggaagaagaggag

SEQ ID NO: 47058 - RNA, 32 nt, Human
agagggagagagaagcaggagagggggaggaa

SEQ ID NO: 47059 - RNA, 32 nt, Human
agagggagagagaaggugacacggauggaaga

SEQ ID NO: 47060 - RNA, 32 nt, Human
agagggagagagaggcccgcccgcucgccggc

SEQ ID NO: 47061 - RNA, 23 nt, Human
agagggagagaggcagagaggga

SEQ ID NO: 47062 - RNA, 32 nt, Human
agagggagaggacaggaggaggagccuucccc

SEQ ID NO: 47063 - RNA, 32 nt, Human
agagggagaggcugcuggacgagguggaggag

SEQ ID NO: 47064 - RNA, 32 nt, Human
agagggagagguuuucuagucugcaaacugaa

SEQ ID NO: 47065 - RNA, 32 nt, Human
agagggagagugagaucuuggggcuuagagga

SEQ ID NO: 47066 - RNA, 32 nt, Human
agagggagaugagagagcucucuggacaggaa

SEQ ID NO: 47067 - RNA, 32 nt, Human
agagggagauuauauccccaacuccagggacc

SEQ ID NO: 47068 - RNA, 32 nt, Human
agagggagauucuugacuagggccaaggcuaa

SEQ ID NO: 47069 - RNA, 32 nt, Human
agagggagcaacacccuuccacccuccugcuc

SEQ ID NO: 47070 - RNA, 32 nt, Human
agagggagcaccaggcccugcaggaccucgug

SEQ ID NO: 47071 - RNA, 32 nt, Human
agagggagcacucgauacacaccgaugggcug

SEQ ID NO: 47072 - RNA, 32 nt, Human
agagggagcagcgggcacgaucaaagagacac

SEQ ID NO: 47073 - RNA, 32 nt, Human
agagggagcaggcagagggugggggaccuggc

SEQ ID NO: 47074 - RNA, 32 nt, Human
agagggagcccaugggcuguuugaauuuggga

SEQ ID NO: 47075 - RNA, 19 nt, Human
agagggagcccuccaggag

SEQ ID NO: 47076 - RNA, 32 nt, Human
agagggagccuccugcucccugcuccaggaug

SEQ ID NO: 47077 - RNA, 32 nt, Human
agagggagccuguaccagccugccuucuccag

SEQ ID NO: 47078 - RNA, 32 nt, Human
agagggagcgagagaauggcuccaaccuggcc

SEQ ID NO: 47079 - RNA, 32 nt, Human
agagggagcugggaaggaaggaagggggcgcu

SEQ ID NO: 47080 - RNA, 32 nt, Human
agagggagcuggucuccagccaggugagcaac

SEQ ID NO: 47081 - RNA, 20 nt, Human
agagggaggaagaaagggag

SEQ ID NO: 47082 - RNA, 32 nt, Human
agagggaggaagcagggaagaaauggccagaa

SEQ ID NO: 47083 - RNA, 32 nt, Human
agagggaggagaggcgcggggagccaggccuc

SEQ ID NO: 47084 - RNA, 32 nt, Human
agagggaggaggaaaggaaggagagagaugcc

SEQ ID NO: 47085 - RNA, 32 nt, Human
agagggaggaggccacggagacuuggagcauu

SEQ ID NO: 47086 - RNA, 32 nt, Human
agagggaggcaggugggaauugagggugaggg

SEQ ID NO: 47087 - RNA, 32 nt, Human
agagggaggcggggcggaaaggcgagaggugu

SEQ ID NO: 47088 - RNA, 20 nt, Human
agagggagggaaggcagagc

SEQ ID NO: 47089 - RNA, 32 nt, Human
agagggagggagaagagagauaguggguaugc

SEQ ID NO: 47090 - RNA, 32 nt, Human
agagggagggagagagaaagacgaagggagag

SEQ ID NO: 47091 - RNA, 32 nt, Human
agagggagggaggaaggaaggaagggaggaag

SEQ ID NO: 47092 - RNA, 20 nt, Human
agagggagggccgggccagg

SEQ ID NO: 47093 - RNA, 32 nt, Human
agagggaggggaggggcugagcugugaggaga

SEQ ID NO: 47094 - RNA, 32 nt, Human
agagggaggguuuaguacaugggagggcuagc

SEQ ID NO: 47095 - RNA, 32 nt, Human
agagggagugcuuccuggaggagguggcauca

SEQ ID NO: 47096 - RNA, 32 nt, Human
agagggaguggagcccagggagagggagcgcg

SEQ ID NO: 47097 - RNA, 32 nt, Human
agagggaguggagggucaggugagaucucaga

SEQ ID NO: 47098 - RNA, 32 nt, Human
agagggaguugucacgcuacagugaguggcug

SEQ ID NO: 47099 - RNA, 32 nt, Human
agagggaucaagcacaggcuaaggagaggaaa

SEQ ID NO: 47100 - RNA, 32 nt, Human
agagggaucacgaccucagcagagccaggaga

SEQ ID NO: 47101 - RNA, 32 nt, Human
agagggaugagggggagcaggagggcaggcgu

SEQ ID NO: 47102 - RNA, 32 nt, Human
agagggaugaggugcugggagggauagagggg

SEQ ID NO: 47103 - RNA, 32 nt, Human
agagggauguguggggacuaugggcaaacaga

SEQ ID NO: 47104 - RNA, 32 nt, Human
agagggauugagccaagaggugagggugcacg

SEQ ID NO: 47105 - RNA, 32 nt, Human
agagggcaaggagagagcagagaacacacuuu

SEQ ID NO: 47106 - RNA, 32 nt, Human
agagggcaaggcagagcgcaagccccaugacu

SEQ ID NO: 47107 - RNA, 32 nt, Human
agagggcaaguggaugggaauuugucagcguu

SEQ ID NO: 47108 - RNA, 32 nt, Human
agagggcaaugggauuaaaccaaccugcuugg

SEQ ID NO: 47109 - RNA, 19 nt, Human
agagggcacagcccuccuc

SEQ ID NO: 47110 - RNA, 32 nt, Human
agagggcagaaaaggccuauauggauggagaa

SEQ ID NO: 47111 - RNA, 32 nt, Human
agagggcagaugcagagcaggugguaguggga

SEQ ID NO: 47112 - RNA, 32 nt, Human
agagggcagccuggcucccucccaggccaagg

SEQ ID NO: 47113 - RNA, 32 nt, Human
agagggcaggcugagccagggagcaaaaaggc

SEQ ID NO: 47114 - RNA, 32 nt, Human
agagggcaggguggugacugaggaccagcucc

SEQ ID NO: 47115 - RNA, 32 nt, Human
agagggcauauggggcccugccaacaccacuu

SEQ ID NO: 47116 - RNA, 32 nt, Human
agagggccacacccacccuguccagaguagag

SEQ ID NO: 47117 - RNA, 32 nt, Human
agagggccacacugcaaccucagcuuaacaug

SEQ ID NO: 47118 - RNA, 32 nt, Human
agagggccagagcgucggggaggcaagaugau

SEQ ID NO: 47119 - RNA, 32 nt, Human
agagggccagcucccagccucuugcuuccugg

SEQ ID NO: 47120 - RNA, 32 nt, Human
agagggccagggcugaguucacgggcucuuuc

SEQ ID NO: 47121 - RNA, 32 nt, Human
agagggccauuuucaugaccagagggaucugu

SEQ ID NO: 47122 - RNA, 32 nt, Human
agagggcccacagggggaugggcuggcugugg

SEQ ID NO: 47123 - RNA, 32 nt, Human
agagggcccagaguuccuucuccacccccgcu

SEQ ID NO: 47124 - RNA, 17 nt, Human
agagggcccuccaggaa

SEQ ID NO: 47125 - RNA, 32 nt, Human
agagggcccuggaaggaagggucuccugcugc

SEQ ID NO: 47126 - RNA, 32 nt, Human
agagggccuaggacagagucuuaaauaauacu

SEQ ID NO: 47127 - RNA, 32 nt, Human
agagggccuccuuccagggaggaguaggaugg

SEQ ID NO: 47128 - RNA, 32 nt, Human
agagggccuggagugaggacugaacacugggg

SEQ ID NO: 47129 - RNA, 32 nt, Human
agagggccugggagaagagucugacgagcaag

SEQ ID NO: 47130 - RNA, 32 nt, Human
agagggccugggccaccaucggccgcacccac

SEQ ID NO: 47131 - RNA, 32 nt, Human
agagggcgaaggcaggaaggggagugagaaag

SEQ ID NO: 47132 - RNA, 32 nt, Human
agagggcgacucugguggugcuuuuguauguu

SEQ ID NO: 47133 - RNA, 32 nt, Human
agagggcggcacagcuucuauaggagcacagg

SEQ ID NO: 47134 - RNA, 32 nt, Human
agagggcggggugcaggcggaauggcccucgu

SEQ ID NO: 47135 - RNA, 32 nt, Human
agagggcucuauacuccuuaugugacugcagc

SEQ ID NO: 47136 - RNA, 20 nt, Human
agagggcugagcaacucagg

SEQ ID NO: 47137 - RNA, 32 nt, Human
agagggcugagcagcucaggaagccuguaaug

SEQ ID NO: 47138 - RNA, 32 nt, Human
agagggcuggauggacuggcccauggaaguaa

SEQ ID NO: 47139 - RNA, 32 nt, Human
agagggcugggcggggaggagcugcuacugcu

SEQ ID NO: 47140 - RNA, 32 nt, Human
agagggcugggcucccagacuccugggugcug

SEQ ID NO: 47141 - RNA, 32 nt, Human
agagggcugggugggagcccagaaggauagaa

SEQ ID NO: 47142 - RNA, 32 nt, Human
agagggcuugcaucacgucacuccagugguuc

SEQ ID NO: 47143 - RNA, 32 nt, Human
agagggcuuuuguaaauuaugcauuuauugua

SEQ ID NO: 47144 - RNA, 32 nt, Human
agaggggaaaugagaggguccugcaggcagag

SEQ ID NO: 47145 - RNA, 32 nt, Human
agaggggaagccccagcgccgagaagcccgcu

SEQ ID NO: 47146 - RNA, 32 nt, Human
agaggggaaggaggaggaagaaguguaagaag

SEQ ID NO: 47147 - RNA, 32 nt, Human
agaggggaaggaggugcgacgccccuuacauc

SEQ ID NO: 47148 - RNA, 32 nt, Human
agaggggaaggccuucgggaagaggcuuccug

SEQ ID NO: 47149 - RNA, 32 nt, Human
agaggggaaugagggcugaguuaugaaaagau

SEQ ID NO: 47150 - RNA, 32 nt, Human
agaggggacacauggguguccagggagaaggc

SEQ ID NO: 47151 - RNA, 32 nt, Human
agaggggagacugugguagaaggaagacagaa

SEQ ID NO: 47152 - RNA, 32 nt, Human
agaggggagagggacgcacagcacugccugcc

SEQ ID NO: 47153 - RNA, 32 nt, Human
agaggggagcccacugcccugaagggagagac

SEQ ID NO: 47154 - RNA, 32 nt, Human
agaggggagcugcgggccagagccccggaggg

SEQ ID NO: 47155 - RNA, 32 nt, Human
agaggggaggaaagccaagggaagggaccuaa

SEQ ID NO: 47156 - RNA, 32 nt, Human
agaggggaggcaggggccccugugcucucuga

SEQ ID NO: 47157 - RNA, 32 nt, Human
agaggggaggcuggggucacagcuggccacug

SEQ ID NO: 47158 - RNA, 32 nt, Human
agaggggagggaugccugggaagugguuaaca

SEQ ID NO: 47159 - RNA, 32 nt, Human
agaggggaggggagaggccauggccgucccag

SEQ ID NO: 47160 - RNA, 32 nt, Human
agaggggaggggccuagggagccccaccuugu

SEQ ID NO: 47161 - RNA, 32 nt, Human
agaggggagguggaguuggaaauguggguguu

SEQ ID NO: 47162 - RNA, 32 nt, Human
agaggggauaggaggagggaaacacuagacaa

SEQ ID NO: 47163 - RNA, 32 nt, Human
agaggggcacaagauggagggagcaugucagg

SEQ ID NO: 47164 - RNA, 32 nt, Human
agaggggcagcuuuauacagaggaggggcaca

SEQ ID NO: 47165 - RNA, 22 nt, Human
agaggggcaggaccugcaggga

SEQ ID NO: 47166 - RNA, 32 nt, Human
agaggggcaggaccugcagggaagaagcagcc

SEQ ID NO: 47167 - RNA, 23 nt, Human
agaggggcaguguuugcaaggga

SEQ ID NO: 47168 - RNA, 32 nt, Human
agaggggccacuucuucagggugagccccggc

SEQ ID NO: 47169 - RNA, 32 nt, Human
agaggggccauccucagggugaggacgggauc

SEQ ID NO: 47170 - RNA, 17 nt, Human
agaggggcccauucaua

SEQ ID NO: 47171 - RNA, 32 nt, Human
agaggggcccuagagcccccacagaaaggacu

SEQ ID NO: 47172 - RNA, 32 nt, Human
agaggggcccuggcgcaaacauuuauccuggg

SEQ ID NO: 47173 - RNA, 23 nt, Human
agaggggcggaagccgcaaggga

SEQ ID NO: 47174 - RNA, 32 nt, Human
agaggggcgggggcgagagggaagugggcggg

SEQ ID NO: 47175 - RNA, 32 nt, Human
agaggggcucaggaacugggagccucgugggu

SEQ ID NO: 47176 - RNA, 32 nt, Human
agaggggcugccaguccucucugggccgcagc

SEQ ID NO: 47177 - RNA, 32 nt, Human
agaggggcuggcugggucccuuugucagacuc

SEQ ID NO: 47178 - RNA, 32 nt, Human
agaggggcugggccucucuuugcacauggaca

SEQ ID NO: 47179 - RNA, 20 nt, Human
agagggggagagaaggagag

SEQ ID NO: 47180 - RNA, 22 nt, Human
agagggggaggaagaggaggag

SEQ ID NO: 47181 - RNA, 21 nt, Human
agagggggaggagaaggagga

SEQ ID NO: 47182 - RNA, 32 nt, Human
agagggggaggcagcccuucccagggacucgg

SEQ ID NO: 47183 - RNA, 32 nt, Human
agagggggaggccuucgggaagaggcuuccug

SEQ ID NO: 47184 - RNA, 32 nt, Human
agagggggcaucugaacgcagagcagggagcu

SEQ ID NO: 47185 - RNA, 32 nt, Human
agagggggccugggacuuccaugccuuaaacc

SEQ ID NO: 47186 - RNA, 32 nt, Human
agagggggcugcagguuuuuaagagagcagcu

SEQ ID NO: 47187 - RNA, 32 nt, Human
agagggggcuggggcgcacggagaagcagguc

SEQ ID NO: 47188 - RNA, 32 nt, Human
agagggggcugggggugggugggcagggcuuu

SEQ ID NO: 47189 - RNA, 32 nt, Human
agaggggguaagaccuuccugggaccgcaaaa

SEQ ID NO: 47190 - RNA, 32 nt, Human
agaggggguagguuuggagggaggccauuuuc

SEQ ID NO: 47191 - RNA, 21 nt, Human
agagggggucagagaagggga

SEQ ID NO: 47192 - RNA, 32 nt, Human
agagggggucuauuugggaggaaagguguggc

SEQ ID NO: 47193 - RNA, 31 nt, Human
agagggggugagagagggcaggcggggacug

SEQ ID NO: 47194 - RNA, 32 nt, Human
agagggggugggggagccagccucccagcgug

SEQ ID NO: 47195 - RNA, 32 nt, Human
agagggggugggggugggggaggggagagggg

SEQ ID NO: 47196 - RNA, 21 nt, Human
agaggggguuucaccacguug

SEQ ID NO: 47197 - RNA, 20 nt, Human
agaggggguuucaccauguu

SEQ ID NO: 47198 - RNA, 21 nt, Human
agaggggguuucaccauguug

SEQ ID NO: 47199 - RNA, 32 nt, Human
agaggggguuucaccauguuggcuagcugguc

SEQ ID NO: 47200 - RNA, 32 nt, Human
agagggguauacacagggaggccaggcagccu

SEQ ID NO: 47201 - RNA, 32 nt, Human
agaggggucaaagaaggaggaggagggugggg

SEQ ID NO: 47202 - RNA, 32 nt, Human
agaggggucgcuugugugcaugugugugcuau

SEQ ID NO: 47203 - RNA, 19 nt, Human
agaggggugagcuggagga

SEQ ID NO: 47204 - RNA, 32 nt, Human
agaggggugaggcccuggggaggcagggguug

SEQ ID NO: 47205 - RNA, 32 nt, Human
agaggggugcaaggcccugccugcuccacuuu

SEQ ID NO: 47206 - RNA, 32 nt, Human
agaggggugcagaagagagagcagagccccuu

SEQ ID NO: 47207 - RNA, 32 nt, Human
agaggggugcuggugggcucugcagggcccgc

SEQ ID NO: 47208 - RNA, 32 nt, Human
agaggggugcugucugccacuugcucccugcc

SEQ ID NO: 47209 - RNA, 32 nt, Human
agagggguggccuggggugcuucaugagaaau

SEQ ID NO: 47210 - RNA, 32 nt, Human
agaggggugggcaggugggaguagcugaggaa

SEQ ID NO: 47211 - RNA, 32 nt, Human
agagggguggggcuccugccugcuccauggag

SEQ ID NO: 47212 - RNA, 32 nt, Human
agagggguuccugcccaggaucuuacaacaca

SEQ ID NO: 47213 - RNA, 32 nt, Human
agagggguucuuuagggagugcuucuggggaa

SEQ ID NO: 47214 - RNA, 32 nt, Human
agagggguugcuggaggugacaaggauugggu

SEQ ID NO: 47215 - RNA, 32 nt, Human
agaggguaaaaauguaugagcagcuuaacuga

SEQ ID NO: 47216 - RNA, 32 nt, Human
agaggguagggagggguggacaaaaguauuua

SEQ ID NO: 47217 - RNA, 32 nt, Human
agaggguaguaucuguggguccuggccuuucu

SEQ ID NO: 47218 - RNA, 22 nt, Human
agaggguagugggugggcuagg

SEQ ID NO: 47219 - RNA, 32 nt, Human
agagggucacaguccaugaucugaccaacuaa

SEQ ID NO: 47220 - RNA, 32 nt, Human
agaggguccccaguccuggccucugcccgccc

SEQ ID NO: 47221 - RNA, 32 nt, Human
agaggguccuggaggugggguugauggguuuc

SEQ ID NO: 47222 - RNA, 32 nt, Human
agagggucggggcuugcccuccaccuuggacu

SEQ ID NO: 47223 - RNA, 32 nt, Human
agagggugaacaaauggggcauucaaguugug

SEQ ID NO: 47224 - RNA, 32 nt, Human
agagggugaaggagaaauaagguaaaggggaa

SEQ ID NO: 47225 - RNA, 21 nt, Human
agagggugagagccaccauca

SEQ ID NO: 47226 - RNA, 32 nt, Human
agagggugagagccaccaucacucauguucuu

SEQ ID NO: 47227 - RNA, 32 nt, Human
agagggugagcgacaugugcagaacggccccu

SEQ ID NO: 47228 - RNA, 32 nt, Human
agagggugaggcaggagaaucgcuugaaccug

SEQ ID NO: 47229 - RNA, 32 nt, Human
agagggugaugagacaggacuagaaaguagug

SEQ ID NO: 47230 - RNA, 32 nt, Human
agagggugcuaguaccaacacagggaaaacgg

SEQ ID NO: 47231 - RNA, 32 nt, Human
agagggugcuuacaaccuugacucccuuucuc

SEQ ID NO: 47232 - RNA, 32 nt, Human
agaggguggcagaaggaaugcgugggugacuu

SEQ ID NO: 47233 - RNA, 32 nt, Human
agaggguggccguccucacaccugugcgcagc

SEQ ID NO: 47234 - RNA, 31 nt, Human
agaggguggguggcagaggggagcagagcca

SEQ ID NO: 47235 - RNA, 32 nt, Human
agagggugugugagcgacaugggcccagcauc

SEQ ID NO: 47236 - RNA, 32 nt, Human
agaggguguuuguggugaagaggcagaaccga

SEQ ID NO: 47237 - RNA, 32 nt, Human
agaggguuaagggaacaacagagauggggcug

SEQ ID NO: 47238 - RNA, 32 nt, Human
agaggguugaggagaugagggagaagcagcaa

SEQ ID NO: 47239 - RNA, 32 nt, Human
agaggguuucacuugcucugaagacccugguc

SEQ ID NO: 47240 - RNA, 32 nt, Human
agaggguuugaguuuccacauggcugaucccu

SEQ ID NO: 47241 - RNA, 32 nt, Human
agagguaaaaagaugauggaagguguggugac

SEQ ID NO: 47242 - RNA, 32 nt, Human
agagguaaaggaggcagggugggggagcccug

SEQ ID NO: 47243 - RNA, 19 nt, Human
agagguaaaggguggggca

SEQ ID NO: 47244 - RNA, 32 nt, Human
agagguaagacagagagaggggcacaggaugu

SEQ ID NO: 47245 - RNA, 21 nt, Human
agagguaagaggaagaggcag

SEQ ID NO: 47246 - RNA, 32 nt, Human
agagguaaggggugaggaugugauugauuucc

SEQ ID NO: 47247 - RNA, 32 nt, Human
agagguacagccugacgcuauggcaggcugcc

SEQ ID NO: 47248 - RNA, 32 nt, Human
agagguacgagaugcccaaguuugucaguuga

SEQ ID NO: 47249 - RNA, 32 nt, Human
agagguacuagucaugcagucugguaccgacu

SEQ ID NO: 47250 - RNA, 32 nt, Human
agagguagaaaagauugggucuaggauauggu

SEQ ID NO: 47251 - RNA, 32 nt, Human
agagguagaaaggacauuggaaagagacagca

SEQ ID NO: 47252 - RNA, 32 nt, Human
agagguagcccaaaaaggggagugaucuuuca

SEQ ID NO: 47253 - RNA, 32 nt, Human
agagguagccccgggagaggcccucagggacc

SEQ ID NO: 47254 - RNA, 32 nt, Human
agagguagugagccaguguccugggccucugg

SEQ ID NO: 47255 - RNA, 32 nt, Human
agagguagugguagaacauccuacugauuuca

SEQ ID NO: 47256 - RNA, 32 nt, Human
agagguaucuuugucaaaagcuucugguucaa

SEQ ID NO: 47257 - RNA, 32 nt, Human
agagguaugugcugauuuguuuggauauuuga

SEQ ID NO: 47258 - RNA, 32 nt, Human
agaggucaagaguuugagaccagcuuggugaa

SEQ ID NO: 47259 - RNA, 32 nt, Human
agaggucacuaaaagaccaagaugggaaacgu

SEQ ID NO: 47260 - RNA, 32 nt, Human
agaggucagagggucugggcagaggagggacc

SEQ ID NO: 47261 - RNA, 32 nt, Human
agaggucagggaacuccuuacccuagccaggg

SEQ ID NO: 47262 - RNA, 32 nt, Human
agaggucaggggucagcuggagaggggcuggg

SEQ ID NO: 47263 - RNA, 32 nt, Human
agaggucagguguucaagaccagccugaccaa

SEQ ID NO: 47264 - RNA, 32 nt, Human
agagguccagaaggaaugaccauggagcggaa

SEQ ID NO: 47265 - RNA, 32 nt, Human
agaggucccuuagggucucuagaguugaaaau

SEQ ID NO: 47266 - RNA, 32 nt, Human
agaggucgccaaagccugcagccuggccuggg

SEQ ID NO: 47267 - RNA, 32 nt, Human
agaggucuauuuuuaccuacugugucuuggaa

SEQ ID NO: 47268 - RNA, 32 nt, Human
agaggucucccucaauccuccccuuuagggaa

SEQ ID NO: 47269 - RNA, 32 nt, Human
agaggucuccuggcagcccucauuaggaauuc

SEQ ID NO: 47270 - RNA, 32 nt, Human
agaggucucuccccagccucaggcagggauuu

SEQ ID NO: 47271 - RNA, 21 nt, Human
agaggucucucccuguccucc

SEQ ID NO: 47272 - RNA, 32 nt, Human
agaggucugaagccuuccuggccacaggcauc

SEQ ID NO: 47273 - RNA, 32 nt, Human
agaggucugcaggaagugacucccgggcaagg

SEQ ID NO: 47274 - RNA, 32 nt, Human
agaggucugcauucucauuggaaaugucuguu

SEQ ID NO: 47275 - RNA, 32 nt, Human
agaggucugcccagggugggagcagugucacu

SEQ ID NO: 47276 - RNA, 32 nt, Human
agaggucugcuccuuccugccaccuuucuccu

SEQ ID NO: 47277 - RNA, 32 nt, Human
agaggucuggaaaauuuugaugcaaagauggc

SEQ ID NO: 47278 - RNA, 32 nt, Human
agaggucugggacucaagagagacaucucagc

SEQ ID NO: 47279 - RNA, 32 nt, Human
agaggucuggggaggaugaagagcagaaagaa

SEQ ID NO: 47280 - RNA, 32 nt, Human
agaggucuguacaucacauacauaugcacaca

SEQ ID NO: 47281 - RNA, 32 nt, Human
agaggugaaaauggagguuucagggaaacugc

SEQ ID NO: 47282 - RNA, 32 nt, Human
agaggugaaagagaagccuggcucuguucacg

SEQ ID NO: 47283 - RNA, 32 nt, Human
agaggugaaaucuugcaaguuguagcaagagc

SEQ ID NO: 47284 - RNA, 32 nt, Human
agaggugaaggacauggagcagcugcuggccc

SEQ ID NO: 47285 - RNA, 32 nt, Human
agaggugaaggagucagagaggcgacaggaua

SEQ ID NO: 47286 - RNA, 32 nt, Human
agaggugaaguauucaggcugaucuggaacuc

SEQ ID NO: 47287 - RNA, 32 nt, Human
agaggugacaccauaaaguccugcugauaaug

SEQ ID NO: 47288 - RNA, 32 nt, Human
agaggugacaggaaggcugggagcagcuuugu

SEQ ID NO: 47289 - RNA, 32 nt, Human
agaggugacaucucccucccaccccucaucca

SEQ ID NO: 47290 - RNA, 32 nt, Human
agaggugagaagggagaaaggagggagugggc

SEQ ID NO: 47291 - RNA, 32 nt, Human
agaggugagaggaugggaaggagcagccaggc

SEQ ID NO: 47292 - RNA, 32 nt, Human
agaggugagggugugcuuuacuuuuugauaaa

SEQ ID NO: 47293 - RNA, 32 nt, Human
agaggugagguuucaccauguugcccaggcug

SEQ ID NO: 47294 - RNA, 32 nt, Human
agaggugcagagcgaggaggccggcaaauccc

SEQ ID NO: 47295 - RNA, 21 nt, Human
agaggugcagggaagaggcag

SEQ ID NO: 47296 - RNA, 32 nt, Human
agaggugccauccagccccugccgucuaucca

SEQ ID NO: 47297 - RNA, 32 nt, Human
agaggugccugggaggaguggcccugauccag

SEQ ID NO: 47298 - RNA, 32 nt, Human
agaggugcggacacuuuccagcaccugaaagc

SEQ ID NO: 47299 - RNA, 17 nt, Human
agaggugcggccgggga

SEQ ID NO: 47300 - RNA, 32 nt, Human
agaggugcucugaggauccagggccuuguguu

SEQ ID NO: 47301 - RNA, 32 nt, Human
agaggugcugugcugcuccacaaggcaaaaca

SEQ ID NO: 47302 - RNA, 32 nt, Human
agagguggaagagacagugugggcugagagca

SEQ ID NO: 47303 - RNA, 32 nt, Human
agagguggacagagaagacagcagagaccaug

SEQ ID NO: 47304 - RNA, 32 nt, Human
agagguggacccaggaggaguggcagguggug

SEQ ID NO: 47305 - RNA, 32 nt, Human
agagguggagaacgacaagcagcagcgcugca

SEQ ID NO: 47306 - RNA, 31 nt, Human
agagguggagcaaucucagguaaaggcaaaa

SEQ ID NO: 47307 - RNA, 32 nt, Human
agagguggaggaggaggaggaagagguggagg

SEQ ID NO: 47308 - RNA, 32 nt, Human
agagguggaggaggaggaggaggagguggugg

SEQ ID NO: 47309 - RNA, 32 nt, Human
agagguggagucuugcucuguuauccaggcug

SEQ ID NO: 47310 - RNA, 32 nt, Human
agagguggagucuugcuguguugcccaggaug

SEQ ID NO: 47311 - RNA, 32 nt, Human
agagguggauccuguaggcuaaaaggcuucca

SEQ ID NO: 47312 - RNA, 32 nt, Human
agagguggcagaggcagggccauaccaucauc

SEQ ID NO: 47313 - RNA, 32 nt, Human
agagguggcaggagaauuucuacugagcgagc

SEQ ID NO: 47314 - RNA, 32 nt, Human
agagguggcaggucuugcccuuuggccaacag

SEQ ID NO: 47315 - RNA, 32 nt, Human
agagguggcaguggagguuuguuaucgaccca

SEQ ID NO: 47316 - RNA, 32 nt, Human
agagguggcccugggcucacagcugguguuug

SEQ ID NO: 47317 - RNA, 32 nt, Human
agagguggcuuacaccuguaaucccaacacuu

SEQ ID NO: 47318 - RNA, 32 nt, Human
agaggugggaggacugauugaggccaggaguu

SEQ ID NO: 47319 - RNA, 32 nt, Human
agaggugggaggacugcuugaggccaggaguu

SEQ ID NO: 47320 - RNA, 32 nt, Human
agaggugggaggaugccuugagcuugagaggu

SEQ ID NO: 47321 - RNA, 32 nt, Human
agaggugggaggauggcuugagcccauaauca

SEQ ID NO: 47322 - RNA, 32 nt, Human
agaggugggaggauugagugaggccagaaguu

SEQ ID NO: 47323 - RNA, 32 nt, Human
agaggugggaggauugcuuggucccaggaguu

SEQ ID NO: 47324 - RNA, 32 nt, Human
agaggugggaggucagaggagaugggggccgg

SEQ ID NO: 47325 - RNA, 32 nt, Human
agaggugggaggucagaggagaugggggcugg

SEQ ID NO: 47326 - RNA, 32 nt, Human
agaggugggaggugggaggggaagggagaaau

SEQ ID NO: 47327 - RNA, 32 nt, Human
agaggugggagugagguuuucuggccugaagc

SEQ ID NO: 47328 - RNA, 32 nt, Human
agaggugggauagaggaagggagguuugagcc

SEQ ID NO: 47329 - RNA, 22 nt, Human
agaggugggcgugggugcuggu

SEQ ID NO: 47330 - RNA, 32 nt, Human
agagguggggguaaacaaugagcucaguuuua

SEQ ID NO: 47331 - RNA, 32 nt, Human
agagguggggucuugccacauugcccaggcug

SEQ ID NO: 47332 - RNA, 32 nt, Human
agagguggggugcuggggcugcaugauuuuug

SEQ ID NO: 47333 - RNA, 32 nt, Human
agaggugggguuucaccagguuggccaggcuu

SEQ ID NO: 47334 - RNA, 32 nt, Human
agaggugggguuucaccauauugcccagggug

SEQ ID NO: 47335 - RNA, 32 nt, Human
agaggugggguuucaccaucuuggccaggcug

SEQ ID NO: 47336 - RNA, 32 nt, Human
agaggugggguuucaccaugcuggucaggaug

SEQ ID NO: 47337 - RNA, 32 nt, Human
agaggugggguuucaccguguuggucaggcug

SEQ ID NO: 47338 - RNA, 32 nt, Human
agaggugggguuucaucguguuaccaggaugg

SEQ ID NO: 47339 - RNA, 32 nt, Human
agaggugggguuuuacuaugcuguccagacug

SEQ ID NO: 47340 - RNA, 32 nt, Human
agaggugggguuuugccauguuggccaggcug

SEQ ID NO: 47341 - RNA, 32 nt, Human
agagguggguggaucacucaaguccaggaguu

SEQ ID NO: 47342 - RNA, 32 nt, Human
agagguguacauucuagaaacagcuguuaaca

SEQ ID NO: 47343 - RNA, 32 nt, Human
agagguguauauacagggaggccaggcagccu

SEQ ID NO: 47344 - RNA, 32 nt, Human
agaggugucaugaagaaaguucuguucaauaa

SEQ ID NO: 47345 - RNA, 32 nt, Human
agaggugucuuugcuugguuugguggggcugc

SEQ ID NO: 47346 - RNA, 32 nt, Human
agaggugugaaguuagacucuaugaugaaaca

SEQ ID NO: 47347 - RNA, 32 nt, Human
agaggugugggaugucagaacauccaagucag

SEQ ID NO: 47348 - RNA, 32 nt, Human
agagguguggugaaucagcaugucacauucca

SEQ ID NO: 47349 - RNA, 32 nt, Human
agagguguuacgagaaugcaguuaauuuuaac

SEQ ID NO: 47350 - RNA, 32 nt, Human
agagguuacugugauuuugccccugaaggauc

SEQ ID NO: 47351 - RNA, 32 nt, Human
agagguuacuuuugacaaaugggugguuugug

SEQ ID NO: 47352 - RNA, 32 nt, Human
agagguuagacuuacccuccucccucuuucca

SEQ ID NO: 47353 - RNA, 32 nt, Human
agagguuagagagaagagagucagcaacagca

SEQ ID NO: 47354 - RNA, 32 nt, Human
agagguuagucuagacugggccugcucauucu

SEQ ID NO: 47355 - RNA, 32 nt, Human
agagguucaagaccagccugggcaacacagug

SEQ ID NO: 47356 - RNA, 32 nt, Human
agagguucaggcaccugcccaaggucacacag

SEQ ID NO: 47357 - RNA, 32 nt, Human
agagguuccagagaaaucaguguugcaguaaa

SEQ ID NO: 47358 - RNA, 32 nt, Human
agagguuccugaucuagccccagaccuggcca

SEQ ID NO: 47359 - RNA, 32 nt, Human
agagguucuaggugaugcugagaccuuggugu

SEQ ID NO: 47360 - RNA, 32 nt, Human
agagguucuguggggacagagcugggaguccu

SEQ ID NO: 47361 - RNA, 32 nt, Human
agagguucuugcaaccauacaggauccagaag

SEQ ID NO: 47362 - RNA, 32 nt, Human
agagguucuuuucaaaggggcaucuuaguagg

SEQ ID NO: 47363 - RNA, 32 nt, Human
agagguugaguaagcugagaacaggucauugc

SEQ ID NO: 47364 - RNA, 32 nt, Human
agagguugcaggagcugagaucacgccauugc

SEQ ID NO: 47365 - RNA, 32 nt, Human
agagguugcaguaagccaagaucgugccauug

SEQ ID NO: 47366 - RNA, 32 nt, Human
agagguugcaguaagccaagaucgugccucug

SEQ ID NO: 47367 - RNA, 32 nt, Human
agagguugcagugagccgagaucaugucacug

SEQ ID NO: 47368 - RNA, 32 nt, Human
agagguugcagugagcugagaucaugucacug

SEQ ID NO: 47369 - RNA, 32 nt, Human
agagguugcagugagcugagaucauguuucug

SEQ ID NO: 47370 - RNA, 20 nt, Human
agagguugcugaacuuuaaa

SEQ ID NO: 47371 - RNA, 32 nt, Human
agagguuggaaagagaagagaggcugggagcg

SEQ ID NO: 47372 - RNA, 32 nt, Human
agagguuggaagggaaauggcucugggcugga

SEQ ID NO: 47373 - RNA, 19 nt, Human
agagguuggaagggaagag

SEQ ID NO: 47374 - RNA, 32 nt, Human
agagguugggaagugaccauuuggaugucugg

SEQ ID NO: 47375 - RNA, 32 nt, Human
agagguugggccugaugggagcaacacucauc

SEQ ID NO: 47376 - RNA, 32 nt, Human
agagguuguguacacaggaccuggccuggaug

SEQ ID NO: 47377 - RNA, 32 nt, Human
agagguuuaaacacuggccuuggcggcugagg

SEQ ID NO: 47378 - RNA, 32 nt, Human
agagguuuagugccauguucagugggcuguuu

SEQ ID NO: 47379 - RNA, 32 nt, Human
agagguuuccugaagaaacagaccuaacugua

SEQ ID NO: 47380 - RNA, 32 nt, Human
agagguuucucacaccucuguucccagggccc

SEQ ID NO: 47381 - RNA, 32 nt, Human
agagguuugcagggguacacguguccuuuccc

SEQ ID NO: 47382 - RNA, 32 nt, Human
agagguuugcagggguacacguguccuuuccg

SEQ ID NO: 47383 - RNA, 32 nt, Human
agagguuugccaugccccagcuucuuuucuca

SEQ ID NO: 47384 - RNA, 32 nt, Human
agagguuugguuugauaccucugccucccucc

SEQ ID NO: 47385 - RNA, 32 nt, Human
agaguaaaaagaaaguaacccaaacugcagug

SEQ ID NO: 47386 - RNA, 32 nt, Human
agaguaaaaagcuaaugacgaggaaccgaaaa

SEQ ID NO: 47387 - RNA, 32 nt, Human
agaguaaaaauuaggugugaaaauaggaaaau

SEQ ID NO: 47388 - RNA, 20 nt, Human
agaguaaaaggaugauggga

SEQ ID NO: 47389 - RNA, 32 nt, Human
agaguaaagaagcagaaagagaaagaauuugc

SEQ ID NO: 47390 - RNA, 32 nt, Human
agaguaacacacuggaccgaggaaaagucaga

SEQ ID NO: 47391 - RNA, 32 nt, Human
agaguaacacgauucccugcugaccccuuaac

SEQ ID NO: 47392 - RNA, 32 nt, Human
agaguaacugauuaaaaugaggucauuagcag

SEQ ID NO: 47393 - RNA, 32 nt, Human
agaguaagacaaaacuccagcacauaaaggac

SEQ ID NO: 47394 - RNA, 32 nt, Human
agaguaagcuggaccugcaaccugccugagcc

SEQ ID NO: 47395 - RNA, 32 nt, Human
agaguaagggaaguuuuggaaaagaauagaaa

SEQ ID NO: 47396 - RNA, 23 nt, Human
agaguaauauuuuuaauguaaua

SEQ ID NO: 47397 - RNA, 32 nt, Human
agaguaaucaauauauuguauuucagcacgaa

SEQ ID NO: 47398 - RNA, 32 nt, Human
agaguaauuccuauccugugugccucagaagc

SEQ ID NO: 47399 - RNA, 32 nt, Human
agaguacaagucugagguggagggagucaugg

SEQ ID NO: 47400 - RNA, 32 nt, Human
agaguacacagcuggcaccagagcaucacaga

SEQ ID NO: 47401 - RNA, 21 nt, Human
agaguacacccuuuccaggaa

SEQ ID NO: 47402 - RNA, 32 nt, Human
agaguacagaaauucauuaugcugcuaauuua

SEQ ID NO: 47403 - RNA, 32 nt, Human
agaguaccaggaugccaccgcagaagaggagg

SEQ ID NO: 47404 - RNA, 32 nt, Human
agaguaccccucugagcugcaggcuggaaggg

SEQ ID NO: 47405 - RNA, 32 nt, Human
agaguaccuagcacaaaguagacauucaauaa

SEQ ID NO: 47406 - RNA, 32 nt, Human
agaguacgguucccuccugucucccucuucuu

SEQ ID NO: 47407 - RNA, 32 nt, Human
agaguacgugccuuaaucuuuaucuuuguaau

SEQ ID NO: 47408 - RNA, 32 nt, Human
agaguacuaauucacuaugaacacuuuuguca

SEQ ID NO: 47409 - RNA, 32 nt, Human
agaguacugccuucaugugcaggauggggaca

SEQ ID NO: 47410 - RNA, 32 nt, Human
agaguacugugugcugagagaccauggcaaag

SEQ ID NO: 47411 - RNA, 32 nt, Human
agaguacuugcucucguccugugaauuuucuu

SEQ ID NO: 47412 - RNA, 32 nt, Human
agaguacuugguaucuggaugaaucgacacuc

SEQ ID NO: 47413 - RNA, 30 nt, Human
agaguagacuucuccaugcccuucaguuau

SEQ ID NO: 47414 - RNA, 32 nt, Human
agaguagaggugccuugaggggaccaggaagc

SEQ ID NO: 47415 - RNA, 32 nt, Human
agaguagaugcugaccugggcacuccaccauu

SEQ ID NO: 47416 - RNA, 32 nt, Human
agaguagcucucugccagccaggcuggagugc

SEQ ID NO: 47417 - RNA, 31 nt, Human
agaguaggaaauacugugucacuggaggccu

SEQ ID NO: 47418 - RNA, 32 nt, Human
agaguaggacagugggguggagcugagaugga

SEQ ID NO: 47419 - RNA, 32 nt, Human
agaguaggagagaaguuagggcuggcacaccu

SEQ ID NO: 47420 - RNA, 32 nt, Human
agaguaggaugcugggcacucaggugugugug

SEQ ID NO: 47421 - RNA, 32 nt, Human
agaguagggaaucucauccaucacagaucgca

SEQ ID NO: 47422 - RNA, 32 nt, Human
agaguagggcggcgcuggaggagggcggugcg

SEQ ID NO: 47423 - RNA, 32 nt, Human
agaguaggguguaauugagugaaggaauccug

SEQ ID NO: 47424 - RNA, 32 nt, Human
agaguaguccuaggaagcccacugauccccaa

SEQ ID NO: 47425 - RNA, 32 nt, Human
agaguaguucaauggauugagaaaaauauguu

SEQ ID NO: 47426 - RNA, 32 nt, Human
agaguauaaaaagccaaaggucaaagucaaag

SEQ ID NO: 47427 - RNA, 32 nt, Human
agaguauaugaggaggcaguauggcugugcag

SEQ ID NO: 47428 - RNA, 32 nt, Human
agaguauccuaccaggaguaauauuuggaaua

SEQ ID NO: 47429 - RNA, 32 nt, Human
agaguaucuuuguugcuugcucugccaaaugc

SEQ ID NO: 47430 - RNA, 21 nt, Human
agaguaugaggaugaguccca

SEQ ID NO: 47431 - RNA, 32 nt, Human
agaguauggaggcugagccaggccuuggguuu

SEQ ID NO: 47432 - RNA, 32 nt, Human
agaguauguaguggcuucuuuugaacuguuag

SEQ ID NO: 47433 - RNA, 32 nt, Human
agaguauguauuaaaagcaaaaauucccauga

SEQ ID NO: 47434 - RNA, 19 nt, Human
agaguauuacaucaucuua

SEQ ID NO: 47435 - RNA, 32 nt, Human
agaguauucagugcuuucuaaguagcagcccc

SEQ ID NO: 47436 - RNA, 32 nt, Human
agaguauucguggucagggaggugacccgugg

SEQ ID NO: 47437 - RNA, 32 nt, Human
agaguauugccucauguuaccuaccugcuauu

SEQ ID NO: 47438 - RNA, 32 nt, Human
agaguauugcuaaaccaaggaggcagaccuca

SEQ ID NO: 47439 - RNA, 32 nt, Human
agaguauuggagagcaccccagcugagucauc

SEQ ID NO: 47440 - RNA, 32 nt, Human
agagucaaaggcagaggggcuuccaggcccug

SEQ ID NO: 47441 - RNA, 32 nt, Human
agagucaaugagaacacacacaaccuacaaau

SEQ ID NO: 47442 - RNA, 32 nt, Human
agagucacaagccucgaggugccuucuucagg

SEQ ID NO: 47443 - RNA, 32 nt, Human
agagucacagcuucagguguuugcugaaucca

SEQ ID NO: 47444 - RNA, 32 nt, Human
agagucacagucaagggccuucugagaccugu

SEQ ID NO: 47445 - RNA, 32 nt, Human
agagucaccaaacacguggauauuuuuggucu

SEQ ID NO: 47446 - RNA, 19 nt, Human
agagucaccaccuugccgg

SEQ ID NO: 47447 - RNA, 32 nt, Human
agagucacccaggcuggagugcaguggugaga

SEQ ID NO: 47448 - RNA, 32 nt, Human
agagucacucaguaucagggaucuacugucuu

SEQ ID NO: 47449 - RNA, 32 nt, Human
agagucacuccugccuucaccaugaaguccag

SEQ ID NO: 47450 - RNA, 32 nt, Human
agagucagaagaggagaaggccacgguacaga

SEQ ID NO: 47451 - RNA, 32 nt, Human
agagucagaagcugaguccaggcaacugcuug

SEQ ID NO: 47452 - RNA, 32 nt, Human
agagucagaagugggaagagugagccaggcaa

SEQ ID NO: 47453 - RNA, 32 nt, Human
agagucagacacuggagaaaucuuaggauuua

SEQ ID NO: 47454 - RNA, 32 nt, Human
agagucagacugcuccuggugccaugaacgga

SEQ ID NO: 47455 - RNA, 32 nt, Human
agagucagaggacccugugcuugcugguggug

SEQ ID NO: 47456 - RNA, 32 nt, Human
agagucagccagcucuggaauggucuggaaau

SEQ ID NO: 47457 - RNA, 32 nt, Human
agagucagccucauccccuccucagccuugug

SEQ ID NO: 47458 - RNA, 32 nt, Human
agagucagcugaugaguucuguaccaaacacu

SEQ ID NO: 47459 - RNA, 32 nt, Human
agagucagcugccgaacggagaucagaauaga

SEQ ID NO: 47460 - RNA, 31 nt, Human
agagucaggaaacuuccuuugacugauguuc

SEQ ID NO: 47461 - RNA, 32 nt, Human
agagucaggaaggugggaguuggcugcugagg

SEQ ID NO: 47462 - RNA, 32 nt, Human
agagucaggggacagggagggagcuccacacu

SEQ ID NO: 47463 - RNA, 32 nt, Human
agagucaggguuucacccuguugcccacucug

SEQ ID NO: 47464 - RNA, 32 nt, Human
agagucagguuccacaguuucaagcauggcca

SEQ ID NO: 47465 - RNA, 32 nt, Human
agagucaguauaguuggagcugucuucauuua

SEQ ID NO: 47466 - RNA, 32 nt, Human
agagucauauuuugauuauuguauuuauucca

SEQ ID NO: 47467 - RNA, 32 nt, Human
agagucaucaugccacuugagcagaggaguca

SEQ ID NO: 47468 - RNA, 18 nt, Human
agagucauucuuuccuca

SEQ ID NO: 47469 - RNA, 32 nt, Human
agagucauuuacauaguucaguuuuuaccuca

SEQ ID NO: 47470 - RNA, 32 nt, Human
agagucauuuacucuccucugccuccauuugu

SEQ ID NO: 47471 - RNA, 32 nt, Human
agaguccaaacaccuacccacaccugcuuugu

SEQ ID NO: 47472 - RNA, 32 nt, Human
agaguccaaguggcaggacuugagguuggcuu

SEQ ID NO: 47473 - RNA, 32 nt, Human
agaguccaauuuaaggaacacagagcagcgcu

SEQ ID NO: 47474 - RNA, 32 nt, Human
agaguccacccuuugugcaaggcgagaaccaa

SEQ ID NO: 47475 - RNA, 32 nt, Human
agaguccagcacuuggccgcucaugggccuuc

SEQ ID NO: 47476 - RNA, 32 nt, Human
agaguccagccaccaucuuccugacuguccca

SEQ ID NO: 47477 - RNA, 32 nt, Human
agaguccaggaaggggcggggagaagccuggg

SEQ ID NO: 47478 - RNA, 32 nt, Human
agaguccagggagagugcgcgggcggccgccg

SEQ ID NO: 47479 - RNA, 32 nt, Human
agaguccaugggcagugagacccuggauauga

SEQ ID NO: 47480 - RNA, 32 nt, Human
agagucccacucugucacccaggcuggagugc

SEQ ID NO: 47481 - RNA, 32 nt, Human
agagucccagccccaaauagaccccaucucuu

SEQ ID NO: 47482 - RNA, 32 nt, Human
agagucccaguuauucuugcugccuuugauaa

SEQ ID NO: 47483 - RNA, 32 nt, Human
agagucccaucuuuggugaggcuguuucugga

SEQ ID NO: 47484 - RNA, 32 nt, Human
agagucccauggaaaaauggcaccaggccggg

SEQ ID NO: 47485 - RNA, 32 nt, Human
agaguccccggcgcucugagguuggagagaaa

SEQ ID NO: 47486 - RNA, 32 nt, Human
agagucccugcagucccuuucgacuugcauuu

SEQ ID NO: 47487 - RNA, 32 nt, Human
agaguccggccugggagccgucagagcagccc

SEQ ID NO: 47488 - RNA, 32 nt, Human
agaguccguggcugaugucugcacugaccaga

SEQ ID NO: 47489 - RNA, 32 nt, Human
agaguccuaaggagcaccaacucuagaaaagg

SEQ ID NO: 47490 - RNA, 32 nt, Human
agaguccuccaccccaucacuagagugcucug

SEQ ID NO: 47491 - RNA, 32 nt, Human
agaguccuccagagcugggaucccaugggcgc

SEQ ID NO: 47492 - RNA, 18 nt, Human
agaguccucccauccccu

SEQ ID NO: 47493 - RNA, 32 nt, Human
agaguccucgggccuccugggucugggacgug

SEQ ID NO: 47494 - RNA, 32 nt, Human
agaguccucguggggagagggacagagacaga

SEQ ID NO: 47495 - RNA, 32 nt, Human
agaguccugaguaccucgugggaacuugggca

SEQ ID NO: 47496 - RNA, 32 nt, Human
agaguccugccuggcccuacgaugaggccacu

SEQ ID NO: 47497 - RNA, 32 nt, Human
agaguccuggagaagguggaguagucagaaaa

SEQ ID NO: 47498 - RNA, 32 nt, Human
agaguccugugggcugaaauaucagacuggga

SEQ ID NO: 47499 - RNA, 32 nt, Human
agaguccuguucugcugagguuugaacuccug

SEQ ID NO: 47500 - RNA, 32 nt, Human
agaguccuuccucuccccuuuugaggcauccc

SEQ ID NO: 47501 - RNA, 32 nt, Human
agaguccuuucaggaagguggagcugcauugg

SEQ ID NO: 47502 - RNA, 32 nt, Human
agaguccuuugaacugcugagucacuucuagg

SEQ ID NO: 47503 - RNA, 32 nt, Human
agagucgcccuugccaggaaaauuccacccag

SEQ ID NO: 47504 - RNA, 32 nt, Human
agagucgcugcuggccucaggcauuugaauua

SEQ ID NO: 47505 - RNA, 32 nt, Human
agagucgcuugaaccugggagggcggagguug

SEQ ID NO: 47506 - RNA, 32 nt, Human
agagucgcuugagccugggaggcggggguugu

SEQ ID NO: 47507 - RNA, 32 nt, Human
agagucggagcuuuaccauguuggucaggcug

SEQ ID NO: 47508 - RNA, 20 nt, Human
agagucggaguugagacugg

SEQ ID NO: 47509 - RNA, 32 nt, Human
agagucgggguuucaccauguugcccaggcug

SEQ ID NO: 47510 - RNA, 23 nt, Human
agagucggucccugcuccuguga

SEQ ID NO: 47511 - RNA, 20 nt, Human
agagucgucuccucgauacc

SEQ ID NO: 47512 - RNA, 32 nt, Human
agagucuacuucagaagcggaggcacugggag

SEQ ID NO: 47513 - RNA, 32 nt, Human
agagucuagaggaauuuuuguuuccuugauua

SEQ ID NO: 47514 - RNA, 32 nt, Human
agagucucacccugucacccaggcuggaaugc

SEQ ID NO: 47515 - RNA, 32 nt, Human
agagucucacccuguugcccaggcuggagugc

SEQ ID NO: 47516 - RNA, 32 nt, Human
agagucucacucuguugcccagccuggagugc

SEQ ID NO: 47517 - RNA, 32 nt, Human
agagucucacuuugacacccaggcuggagugc

SEQ ID NO: 47518 - RNA, 32 nt, Human
agagucucagaauaugcucugcugggccagcu

SEQ ID NO: 47519 - RNA, 32 nt, Human
agagucucauaaggagcacgcaaccuagaucc

SEQ ID NO: 47520 - RNA, 32 nt, Human
agagucuccagaugggggcaucagggugaggu

SEQ ID NO: 47521 - RNA, 32 nt, Human
agagucucccaaaguugcccaggcuggucuca

SEQ ID NO: 47522 - RNA, 32 nt, Human
agagucuccuucucuucucuucuuugggaugc

SEQ ID NO: 47523 - RNA, 32 nt, Human
agagucucgcuccauugcccaggcuggacugc

SEQ ID NO: 47524 - RNA, 32 nt, Human
agagucucgcuccgucacccaggcuggagugc

SEQ ID NO: 47525 - RNA, 32 nt, Human
agagucucgcucucuuguccaggcuggagugc

SEQ ID NO: 47526 - RNA, 32 nt, Human
agagucucgcucuguugcccagccuggagugc

SEQ ID NO: 47527 - RNA, 32 nt, Human
agagucucuagagguagaaauuugccuugcug

SEQ ID NO: 47528 - RNA, 32 nt, Human
agagucucucucugucacccaggcuggagugc

SEQ ID NO: 47529 - RNA, 32 nt, Human
agagucucucucuguugcccaggcuggagugc

SEQ ID NO: 47530 - RNA, 32 nt, Human
agagucucuugguguuggcuucgugcuuccgg

SEQ ID NO: 47531 - RNA, 32 nt, Human
agagucugaagcaggagaauugcuugaaccug

SEQ ID NO: 47532 - RNA, 32 nt, Human
agagucugagccugagcaacauaaugagaccc

SEQ ID NO: 47533 - RNA, 32 nt, Human
agagucugagggaggggagugggagucucagc

SEQ ID NO: 47534 - RNA, 32 nt, Human
agagucugcugcugucuguucugcagagagua

SEQ ID NO: 47535 - RNA, 32 nt, Human
agagucuggaauagguuauccacuccaucuuc

SEQ ID NO: 47536 - RNA, 32 nt, Human
agagucugggagaacuccaaugcugaauggag

SEQ ID NO: 47537 - RNA, 32 nt, Human
agagucugggagagaacacagggagccagccg

SEQ ID NO: 47538 - RNA, 32 nt, Human
agagucuggggagagaaaagguggccaggauc

SEQ ID NO: 47539 - RNA, 32 nt, Human
agagucuggggcuguguguugagcagccuuaa

SEQ ID NO: 47540 - RNA, 32 nt, Human
agagucugggguccugagaggccgagaccuga

SEQ ID NO: 47541 - RNA, 32 nt, Human
agagucuugcccugucgccuggcuggagugga

SEQ ID NO: 47542 - RNA, 32 nt, Human
agagucuugcucugcuggagugcgguggugca

SEQ ID NO: 47543 - RNA, 32 nt, Human
agagucuuggcugggcugaaucugcugcuugu

SEQ ID NO: 47544 - RNA, 32 nt, Human
agagucuuucagcugaaacuuuugccaugaag

SEQ ID NO: 47545 - RNA, 32 nt, Human
agagucuuucucugucacccaggcuggagugc

SEQ ID NO: 47546 - RNA, 32 nt, Human
agagucuuucuucuuuggcuuguuuuguuuuu

SEQ ID NO: 47547 - RNA, 32 nt, Human
agagugaaaaggagggagacuaguuagaaauu

SEQ ID NO: 47548 - RNA, 23 nt, Human
agagugaaaccccaucucuacua

SEQ ID NO: 47549 - RNA, 32 nt, Human
agagugaaacucugucucaaaauaauauuaau

SEQ ID NO: 47550 - RNA, 32 nt, Human
agagugaagagcacaccgccacccugauuaag

SEQ ID NO: 47551 - RNA, 32 nt, Human
agagugaagaggaggaggcagccuggacucca

SEQ ID NO: 47552 - RNA, 32 nt, Human
agagugaaugcugccaagaguuccucagauua

SEQ ID NO: 47553 - RNA, 32 nt, Human
agagugaaugucccccaucauguggcccaacu

SEQ ID NO: 47554 - RNA, 32 nt, Human
agagugaauucccucacucgucucccccaaca

SEQ ID NO: 47555 - RNA, 32 nt, Human
agagugacagagcugaaaaacucacuuugaga

SEQ ID NO: 47556 - RNA, 32 nt, Human
agagugacagugcuagaagaccccagagagag

SEQ ID NO: 47557 - RNA, 32 nt, Human
agagugacgaggccuaucaguacuggaggaca

SEQ ID NO: 47558 - RNA, 32 nt, Human
agagugacuggcagaguaagagaaggggagag

SEQ ID NO: 47559 - RNA, 32 nt, Human
agagugacuuggggagggagaaauaggaggag

SEQ ID NO: 47560 - RNA, 32 nt, Human
agagugagaagcauauaucugaaggaaacgua

SEQ ID NO: 47561 - RNA, 32 nt, Human
agagugagaaguggggagagugagccagguga

SEQ ID NO: 47562 - RNA, 32 nt, Human
agagugagagggcuugagacccucccucaacc

SEQ ID NO: 47563 - RNA, 32 nt, Human
agagugagccuucugucccauuccuguuagac

SEQ ID NO: 47564 - RNA, 32 nt, Human
agagugaggacagcagcaccugccucggggug

SEQ ID NO: 47565 - RNA, 32 nt, Human
agagugaggaggacgcaggggucagagguggc

SEQ ID NO: 47566 - RNA, 32 nt, Human
agagugagggaaaugagcuuggcuucugggac

SEQ ID NO: 47567 - RNA, 32 nt, Human
agagugagggacgcaaccacaagccaaggaac

SEQ ID NO: 47568 - RNA, 32 nt, Human
agagugagggcagaugucuccagccaggacug

SEQ ID NO: 47569 - RNA, 32 nt, Human
agagugagggccugaggucuggcugcuugccc

SEQ ID NO: 47570 - RNA, 32 nt, Human
agagugaggguuucaccauguuggccaggcug

SEQ ID NO: 47571 - RNA, 32 nt, Human
agagugagguaguggcgagaaagcugacucca

SEQ ID NO: 47572 - RNA, 32 nt, Human
agagugagugccugagucauccaaggccagua

SEQ ID NO: 47573 - RNA, 32 nt, Human
agagugaguggcgauccccauccuggagacug

SEQ ID NO: 47574 - RNA, 32 nt, Human
agagugaugaaugauuuuauugguggcagcug

SEQ ID NO: 47575 - RNA, 32 nt, Human
agagugaugaggugguguggggagggugggga

SEQ ID NO: 47576 - RNA, 32 nt, Human
agagugauuauacaacuuccauucucucacuu

SEQ ID NO: 47577 - RNA, 32 nt, Human
agagugcaaaucugccagccuaggcaacauag

SEQ ID NO: 47578 - RNA, 32 nt, Human
agagugcaaucccaaagccacagagaaaugaa

SEQ ID NO: 47579 - RNA, 32 nt, Human
agagugcacacaguggggccucaaagguuaug

SEQ ID NO: 47580 - RNA, 32 nt, Human
agagugcacagcccuuguucugccagcuggag

SEQ ID NO: 47581 - RNA, 32 nt, Human
agagugcaccauugcacuccagccugggcaaa

SEQ ID NO: 47582 - RNA, 32 nt, Human
agagugcacuacuguacuccagccagggcaag

SEQ ID NO: 47583 - RNA, 23 nt, Human
agagugcagaaccgucccaggca

SEQ ID NO: 47584 - RNA, 32 nt, Human
agagugcagagacgaaggugcgagaugagcac

SEQ ID NO: 47585 - RNA, 32 nt, Human
agagugcagcccagggcaggcaucaggacagg

SEQ ID NO: 47586 - RNA, 32 nt, Human
agagugcagccuggaucucucgccuggguuuc

SEQ ID NO: 47587 - RNA, 32 nt, Human
agagugcagcugcagugccaaacagaagggac

SEQ ID NO: 47588 - RNA, 32 nt, Human
agagugcagggcgcuguguccagccgggggaa

SEQ ID NO: 47589 - RNA, 32 nt, Human
agagugcaggggguugggaggaagcauguaag

SEQ ID NO: 47590 - RNA, 32 nt, Human
agagugcagggugggggcaagacugggcugua

SEQ ID NO: 47591 - RNA, 32 nt, Human
agagugcaggugauuucgcagcagguuucuug

SEQ ID NO: 47592 - RNA, 32 nt, Human
agagugccacgccuccacagcuugccccaagc

SEQ ID NO: 47593 - RNA, 32 nt, Human
agagugcccaggagagggucugagggguggga

SEQ ID NO: 47594 - RNA, 32 nt, Human
agagugcccauguugugcuuugucuuguugag

SEQ ID NO: 47595 - RNA, 32 nt, Human
agagugccccacugcacuccagccugggugac

SEQ ID NO: 47596 - RNA, 32 nt, Human
agagugccugguagagacagagcggaacggcc

SEQ ID NO: 47597 - RNA, 32 nt, Human
agagugccugguggagacagagcggaacgccc

SEQ ID NO: 47598 - RNA, 32 nt, Human
agagugccuuucucuuuuuauagcugagaaag

SEQ ID NO: 47599 - RNA, 32 nt, Human
agagugcgauaugaggguacagugaguuuggc

SEQ ID NO: 47600 - RNA, 32 nt, Human
agagugcgccacuucacuccagccugggcaac

SEQ ID NO: 47601 - RNA, 32 nt, Human
agagugcugacauacuaugugaagcuacuauu

SEQ ID NO: 47602 - RNA, 32 nt, Human
agagugcugcaaggugaggccugcugugcugc

SEQ ID NO: 47603 - RNA, 32 nt, Human
agagugcugcagcuguuucugucucgaacggc

SEQ ID NO: 47604 - RNA, 19 nt, Human
agagugcugcugguuccuu

SEQ ID NO: 47605 - RNA, 32 nt, Human
agagugcuggguugggauuacaggcgugagcc

SEQ ID NO: 47606 - RNA, 32 nt, Human
agagugcuuuaauaggggcugcuuugggggac

SEQ ID NO: 47607 - RNA, 32 nt, Human
agaguggaaccaggaaggauucuggagccaca

SEQ ID NO: 47608 - RNA, 32 nt, Human
agaguggaaugcaggggcaugccaucaaauaa

SEQ ID NO: 47609 - RNA, 32 nt, Human
agaguggacguugcacaucacugugaaaccuu

SEQ ID NO: 47610 - RNA, 19 nt, Human
agaguggacucuucccucu

SEQ ID NO: 47611 - RNA, 32 nt, Human
agaguggagggccgcugaauaagcuuccaaaa

SEQ ID NO: 47612 - RNA, 32 nt, Human
agaguggaguggcaugaacacaacgcacugca

SEQ ID NO: 47613 - RNA, 32 nt, Human
agaguggauaagaggcaaacagcacauaacuc

SEQ ID NO: 47614 - RNA, 32 nt, Human
agaguggaucgcugggcugggcuaacggcgac

SEQ ID NO: 47615 - RNA, 32 nt, Human
agaguggauuacaggcaugagccacuguaccu

SEQ ID NO: 47616 - RNA, 32 nt, Human
agaguggcaaagccuuuaauuauagcucacuc

SEQ ID NO: 47617 - RNA, 32 nt, Human
agaguggcaccaggcugaguuaagugggacug

SEQ ID NO: 47618 - RNA, 32 nt, Human
agaguggcagagcugugggcucugcuguucuc

SEQ ID NO: 47619 - RNA, 19 nt, Human
agaguggcaggccuggaga

SEQ ID NO: 47620 - RNA, 32 nt, Human
agaguggcaguugccucugagggaaggugggu

SEQ ID NO: 47621 - RNA, 32 nt, Human
agaguggcauuggcagcaggugcugcuacccu

SEQ ID NO: 47622 - RNA, 32 nt, Human
agaguggcugaugucaaggagaacaaggaugc

SEQ ID NO: 47623 - RNA, 32 nt, Human
agaguggcuggaagaaugcuucaggugucaga

SEQ ID NO: 47624 - RNA, 32 nt, Human
agaguggcuuucuaccacacacagccuguccc

SEQ ID NO: 47625 - RNA, 32 nt, Human
agagugggaagcuuccugggggaccucagcca

SEQ ID NO: 47626 - RNA, 32 nt, Human
agagugggagaaagggagucaggcgcauuggg

SEQ ID NO: 47627 - RNA, 32 nt, Human
agagugggagagaagaggagagggcuuggaua

SEQ ID NO: 47628 - RNA, 32 nt, Human
agagugggagagugggagacagaggaaggaag

SEQ ID NO: 47629 - RNA, 32 nt, Human
agagugggaggaagcagagggagggacugggc

SEQ ID NO: 47630 - RNA, 21 nt, Human
agagugggaggagaaaucuga

SEQ ID NO: 47631 - RNA, 32 nt, Human
agagugggaggcagagugugauggggaggagg

SEQ ID NO: 47632 - RNA, 19 nt, Human
agagugggagggagacuga

SEQ ID NO: 47633 - RNA, 32 nt, Human
agauugcaccauugcacuccagcuugggugac

SEQ ID NO: 47634 - RNA, 32 nt, Human
agauugcaccauugcauuccagccugggcaac

SEQ ID NO: 47635 - RNA, 32 nt, Human
agauugcaccauugcauuccagccugggugac

SEQ ID NO: 47636 - RNA, 32 nt, Human
agauugcaccauugcccuccagccugagcaac

SEQ ID NO: 47637 - RNA, 32 nt, Human
agauugcaccauuguacuccagccugggcaau

SEQ ID NO: 47638 - RNA, 32 nt, Human
agauugcaccauuucauuccagccugggcaac

SEQ ID NO: 47639 - RNA, 32 nt, Human
agauugcaccccugcacuccaggcugggcaac

SEQ ID NO: 47640 - RNA, 32 nt, Human
agauugcacccugcacucuagccugggcaaca

SEQ ID NO: 47641 - RNA, 32 nt, Human
agauugcaccgcugcacuccagccuggcgaca

SEQ ID NO: 47642 - RNA, 32 nt, Human
agauugcaccuuuguacuccagccugggcaac

SEQ ID NO: 47643 - RNA, 32 nt, Human
agauugcacuacuacacuccagccuggugaca

SEQ ID NO: 47644 - RNA, 32 nt, Human
agauugcacuacugcacuccagacuggugacg

SEQ ID NO: 47645 - RNA, 32 nt, Human
agauugcacuacugcacuccagccugggugac

SEQ ID NO: 47646 - RNA, 32 nt, Human
agauugcacuauugcacuccagccugggcaac

SEQ ID NO: 47647 - RNA, 32 nt, Human
agauugcagaagcaccagaacuaggagcagcc

SEQ ID NO: 47648 - RNA, 32 nt, Human
agauugcaguaagccaggaucaugccacugca

SEQ ID NO: 47649 - RNA, 32 nt, Human
agauugcaguaagccgagaucgugccacugca

SEQ ID NO: 47650 - RNA, 32 nt, Human
agauugcagugaaccgagaucgcgccacugca

SEQ ID NO: 47651 - RNA, 32 nt, Human
agauugcagugagccgagaucacgccauugca

SEQ ID NO: 47652 - RNA, 32 nt, Human
agauugcagugagccgagaucacgcuacugcg

SEQ ID NO: 47653 - RNA, 32 nt, Human
agauugcagugagccgagaucccgccacugca

SEQ ID NO: 47654 - RNA, 32 nt, Human
agauugcagugagccgagaucgugucacugca

SEQ ID NO: 47655 - RNA, 32 nt, Human
agauugcaucacugcacuccagccugggcgau

SEQ ID NO: 47656 - RNA, 32 nt, Human
agauugcaucacugcacuccagcuugggugac

SEQ ID NO: 47657 - RNA, 32 nt, Human
agauugcaucauugcacuccagccugggcaac

SEQ ID NO: 47658 - RNA, 20 nt, Human
agauugcaugagcccaggag

SEQ ID NO: 47659 - RNA, 32 nt, Human
agauugcauggcugcacucuagccugggugac

SEQ ID NO: 47660 - RNA, 32 nt, Human
agauugccaagugccagcagcugcagcaagaa

SEQ ID NO: 47661 - RNA, 32 nt, Human
agauugccacugcacuccagccugggcaacaa

SEQ ID NO: 47662 - RNA, 32 nt, Human
agauugccauuuuuaucuuggaagaacuagug

SEQ ID NO: 47663 - RNA, 32 nt, Human
agauugcccacugcacuccagccugggcaaca

SEQ ID NO: 47664 - RNA, 32 nt, Human
agauugcccagggaugauguuauggagauauc

SEQ ID NO: 47665 - RNA, 32 nt, Human
agauugccccacugcacuccacccugggcaau

SEQ ID NO: 47666 - RNA, 32 nt, Human
agauugccccacugcacuccagccuaggcaac

SEQ ID NO: 47667 - RNA, 32 nt, Human
agauugcccccgcuacacuccagccuggucga

SEQ ID NO: 47668 - RNA, 32 nt, Human
agauugccgugagccgagaucaugccacugca

SEQ ID NO: 47669 - RNA, 32 nt, Human
agauugccugagcucaggaguuugagaccaac

SEQ ID NO: 47670 - RNA, 32 nt, Human
agauugccugagcucaggaguuugagaccagc

SEQ ID NO: 47671 - RNA, 32 nt, Human
agauugccugcucucucugugccuagccucaa

SEQ ID NO: 47672 - RNA, 32 nt, Human
agauugccugggacccagccgugcaggggcag

SEQ ID NO: 47673 - RNA, 32 nt, Human
agauugccuguguccugccucuugccucuugu

SEQ ID NO: 47674 - RNA, 32 nt, Human
agauugcgccaccgcacuccagccugggcaac

SEQ ID NO: 47675 - RNA, 32 nt, Human
agauugcgccaccgcacuccagccugggcgac

SEQ ID NO: 47676 - RNA, 32 nt, Human
agauugcgccacugcacaccagucuggagaca

SEQ ID NO: 47677 - RNA, 32 nt, Human
agauugcgccacugcacacuagcuugggugac

SEQ ID NO: 47678 - RNA, 32 nt, Human
agauugcgccacugcaccccagcaugagcgac

SEQ ID NO: 47679 - RNA, 32 nt, Human
agauugcgccacugcaccccagccuggacaac

SEQ ID NO: 47680 - RNA, 32 nt, Human
agauugcgccacugcaccccagccugggcgac

SEQ ID NO: 47681 - RNA, 32 nt, Human
agauugcgccacugcaccccagccugggugac

SEQ ID NO: 47682 - RNA, 32 nt, Human
agauugcgccacugcacucaagucugggcgac

SEQ ID NO: 47683 - RNA, 32 nt, Human
agauugcgccacugcacuccaaccugggcaau

SEQ ID NO: 47684 - RNA, 32 nt, Human
agauugcgccacugcacuccacccugggugac

SEQ ID NO: 47685 - RNA, 32 nt, Human
agauugcgccacugcacuccagccagggcgaa

SEQ ID NO: 47686 - RNA, 32 nt, Human
agauugcgccacugcacuccagcccuggcgac

SEQ ID NO: 47687 - RNA, 32 nt, Human
agauugcgccacugcacuccagccuaggugau

SEQ ID NO: 47688 - RNA, 32 nt, Human
agauugcgccacugcacuccagccugacgaca

SEQ ID NO: 47689 - RNA, 32 nt, Human
agauugcgccacugcacuccagccuggcgaca

SEQ ID NO: 47690 - RNA, 32 nt, Human
agauugcgccacugcacuccagccugggagac

SEQ ID NO: 47691 - RNA, 32 nt, Human
agauugcgccacugcacuccagccugggcaac

SEQ ID NO: 47692 - RNA, 32 nt, Human
agauugcgccacugcacuccagccugggcaau

SEQ ID NO: 47693 - RNA, 32 nt, Human
agauugcgccacugcacuccagccugggcagc

SEQ ID NO: 47694 - RNA, 32 nt, Human
agauugcgccacugcacuccagccugggcgac

SEQ ID NO: 47695 - RNA, 32 nt, Human
agauugcgccacugcacuccagccugggcuac

SEQ ID NO: 47696 - RNA, 32 nt, Human
agauugcgccacugcacuccagccugggggac

SEQ ID NO: 47697 - RNA, 32 nt, Human
agauugcgccacugcacuccagccuggguaac

SEQ ID NO: 47698 - RNA, 32 nt, Human
agauugcgccacugcacuccagccugggugac

SEQ ID NO: 47699 - RNA, 32 nt, Human
agauugcgccacugcacuccagccugguugac

SEQ ID NO: 47700 - RNA, 32 nt, Human
agauugcgccacugcacuccagcgugggcuac

SEQ ID NO: 47701 - RNA, 32 nt, Human
agauugcgccacugcacuccagucugggcgac

SEQ ID NO: 47702 - RNA, 32 nt, Human
agauugcgccacugcacuccagucuggucggc

SEQ ID NO: 47703 - RNA, 32 nt, Human
agauugcgccacugcacucuagccuaagcaau

SEQ ID NO: 47704 - RNA, 32 nt, Human
agauugcgccacugcacuucagccuggaugac

SEQ ID NO: 47705 - RNA, 32 nt, Human
agauugcgccacugcacuucagccugggcaac

SEQ ID NO: 47706 - RNA, 32 nt, Human
agauugcgccacugcaguccgcaguccagccu

SEQ ID NO: 47707 - RNA, 32 nt, Human
agauugcgccacugcaguccgcaguccggccu

SEQ ID NO: 47708 - RNA, 32 nt, Human
agauugcgccacugcaguccgcagucuggccu

SEQ ID NO: 47709 - RNA, 32 nt, Human
agauugcgccacugcauuccagccugggugac

SEQ ID NO: 47710 - RNA, 32 nt, Human
agauugcgccacugcauucuagccuggaugac

SEQ ID NO: 47711 - RNA, 32 nt, Human
agauugcgccacugcgcuccagccugggcaac

SEQ ID NO: 47712 - RNA, 32 nt, Human
agauugcgccacuggacuccagccugcgugac

SEQ ID NO: 47713 - RNA, 32 nt, Human
agauugcgccacuguacuccagccuggcaaca

SEQ ID NO: 47714 - RNA, 32 nt, Human
agauugcgccacuguacuccagccugggugac

SEQ ID NO: 47715 - RNA, 32 nt, Human
agauugcgccacuguacuccagcuugggcaac

SEQ ID NO: 47716 - RNA, 32 nt, Human
agauugcgccacuguacuccugggcaacagcg

SEQ ID NO: 47717 - RNA, 32 nt, Human
agauugcgccacuucacuccagccugggugac

SEQ ID NO: 47718 - RNA, 32 nt, Human
agauugcgccauugcacuccagccuagguaac

SEQ ID NO: 47719 - RNA, 32 nt, Human
agauugcgccauugcacuccagccugggcaaa

SEQ ID NO: 47720 - RNA, 32 nt, Human
agauugcgccauugcacuccagccugggcaac

SEQ ID NO: 47721 - RNA, 32 nt, Human
agauugcgccauugcacuccagccuggggaca

SEQ ID NO: 47722 - RNA, 32 nt, Human
agauugcgccauugcagcacagccugguuaca

SEQ ID NO: 47723 - RNA, 32 nt, Human
agauugcgccauugcagggcagccugguuaca

SEQ ID NO: 47724 - RNA, 32 nt, Human
agauugcgccauugcauuccagccugggcaac

SEQ ID NO: 47725 - RNA, 32 nt, Human
agauugcgccauugcauuccagccugggugac

SEQ ID NO: 47726 - RNA, 32 nt, Human
agauugcgccauuguacuccagccugggcaac

SEQ ID NO: 47727 - RNA, 32 nt, Human
agauugcgccauuguacuccagccugggggac

SEQ ID NO: 47728 - RNA, 32 nt, Human
agauugcgccauugugcuccagccugggugac

SEQ ID NO: 47729 - RNA, 32 nt, Human
agauugcgcccccugcacuccagccugggcuu

SEQ ID NO: 47730 - RNA, 32 nt, Human
agauugcgccccugcacuccaaccuggacaac

SEQ ID NO: 47731 - RNA, 32 nt, Human
agauugcgccgcuacauuccagccugggcaac

SEQ ID NO: 47732 - RNA, 32 nt, Human
agauugcgccgcugcacuccagccugggcgac

SEQ ID NO: 47733 - RNA, 32 nt, Human
agauugcgccguuguacuccagccugggcaac

SEQ ID NO: 47734 - RNA, 32 nt, Human
agauugcgcuacuacgcuacagccugggugac

SEQ ID NO: 47735 - RNA, 32 nt, Human
agauugcgcuacugaacuccagccuggguuac

SEQ ID NO: 47736 - RNA, 32 nt, Human
agauugcgcuacugcacuccagccuaggcaac

SEQ ID NO: 47737 - RNA, 32 nt, Human
agauugcgcuacugcacuccagccugggcgac

SEQ ID NO: 47738 - RNA, 32 nt, Human
agauugcgcugcugcacuccaaccugggcgac

SEQ ID NO: 47739 - RNA, 32 nt, Human
agauugcggugagccuagaucuugccacugcu

SEQ ID NO: 47740 - RNA, 32 nt, Human
agauugcgucacugcacuccaaccugggugac

SEQ ID NO: 47741 - RNA, 32 nt, Human
agauugcgucacugcacuccagccugagcaac

SEQ ID NO: 47742 - RNA, 32 nt, Human
agauugcgucacugcacuccagccugggcgac

SEQ ID NO: 47743 - RNA, 32 nt, Human
agauugcgucacugcacugcagccugggugac

SEQ ID NO: 47744 - RNA, 32 nt, Human
agauugcuccauugcacuccagccugggcaac

SEQ ID NO: 47745 - RNA, 32 nt, Human
agauugcuccauugcacuccagccugggcgau

SEQ ID NO: 47746 - RNA, 32 nt, Human
agauugcucuuaaaauguauucaguuauuuag

SEQ ID NO: 47747 - RNA, 19 nt, Human
agauugcuucagcccagga

SEQ ID NO: 47748 - RNA, 20 nt, Human
agauugcuugaacccaggag

SEQ ID NO: 47749 - RNA, 20 nt, Human
agauugcuugagcccaggag

SEQ ID NO: 47750 - RNA, 32 nt, Human
agauugcuugagcucaggaguucgagaccagc

SEQ ID NO: 47751 - RNA, 32 nt, Human
agauugcuuuugaacuuuggcucucuucacuu

SEQ ID NO: 47752 - RNA, 32 nt, Human
agauuggaacauccuagagacuuguugaaugg

SEQ ID NO: 47753 - RNA, 32 nt, Human
agauuggaacccagacuugcaguccagcgcug

SEQ ID NO: 47754 - RNA, 32 nt, Human
agauuggaccaauccuuuuugcaccaaagugc

SEQ ID NO: 47755 - RNA, 32 nt, Human
agauuggaccacugcucuccagccugggcaac

SEQ ID NO: 47756 - RNA, 32 nt, Human
agauuggagccauggcuuuggaacagaaccag

SEQ ID NO: 47757 - RNA, 32 nt, Human
agauuggaguuaaucugagcauggaagacuau

SEQ ID NO: 47758 - RNA, 22 nt, Human
agauuggauaaugauggcugua

SEQ ID NO: 47759 - RNA, 32 nt, Human
agauuggaugaaacugugcacguuuuuguccc

SEQ ID NO: 47760 - RNA, 32 nt, Human
agauuggcacccaggcugggagcuugccagga

SEQ ID NO: 47761 - RNA, 32 nt, Human
agauuggcacuucccuguccagcacuacaacu

SEQ ID NO: 47762 - RNA, 32 nt, Human
agauuggccauugcacuccagccugggugaca

SEQ ID NO: 47763 - RNA, 32 nt, Human
agauuggccgggaauuugaggcugcaaggaua

SEQ ID NO: 47764 - RNA, 32 nt, Human
agauuggcgaaauuuaacauuuacagauuagu

SEQ ID NO: 47765 - RNA, 32 nt, Human
agauuggcuacaggagcggggugcaggacugg

SEQ ID NO: 47766 - RNA, 32 nt, Human
agauuggcuuggcaucugcacuccagcccagg

SEQ ID NO: 47767 - RNA, 32 nt, Human
agauuggcuugucucagggugggaagugggag

SEQ ID NO: 47768 - RNA, 32 nt, Human
agauugggaaggagguauuuucugguuuucgc

SEQ ID NO: 47769 - RNA, 32 nt, Human
agauugggaaggcucagaagggcagaguugaa

SEQ ID NO: 47770 - RNA, 32 nt, Human
agauugggccacugcacuccacccugggcgac

SEQ ID NO: 47771 - RNA, 32 nt, Human
agauugggccaggugggauuacaggcgcgagc

SEQ ID NO: 47772 - RNA, 32 nt, Human
agauugggccugggcgcuggagcugcuguggc

SEQ ID NO: 47773 - RNA, 32 nt, Human
agauuggggacucugguucccucgccaagugu

SEQ ID NO: 47774 - RNA, 32 nt, Human
agauugggggaguggggagggggaagaagaac

SEQ ID NO: 47775 - RNA, 32 nt, Human
agauuggggugguggaggcaguagggagaugg

SEQ ID NO: 47776 - RNA, 24 nt, Human
agauuggguugccagccacuuccu

SEQ ID NO: 47777 - RNA, 21 nt, Human
agauuggguuucaccauguug

SEQ ID NO: 47778 - RNA, 25 nt, Human
agauuggguuucaccauguuggcca

SEQ ID NO: 47779 - RNA, 32 nt, Human
agauugguauauuucauacaaagugauggcuu

SEQ ID NO: 47780 - RNA, 32 nt, Human
agauuggucccaccgcacuccagccugggcaa

SEQ ID NO: 47781 - RNA, 32 nt, Human
agauuggucucaaacuccuggacucaagugau

SEQ ID NO: 47782 - RNA, 32 nt, Human
agauuggucucaaacuccuggccucucacucc

SEQ ID NO: 47783 - RNA, 32 nt, Human
agauugguggggagggagggcgggagguagau

SEQ ID NO: 47784 - RNA, 32 nt, Human
agauuguaccacugcacuccaaccuggguuac

SEQ ID NO: 47785 - RNA, 32 nt, Human
agauuguaccacugcacuccagccugggcaac

SEQ ID NO: 47786 - RNA, 32 nt, Human
agauuguaccacugcacuccagccuggucaau

SEQ ID NO: 47787 - RNA, 32 nt, Human
agauuguaccacugcacuccagucugggcaac

SEQ ID NO: 47788 - RNA, 32 nt, Human
agauuguaccacugcacuccaguuuggcaaca

SEQ ID NO: 47789 - RNA, 32 nt, Human
agauuguaccacugcgcuccaaacugggugac

SEQ ID NO: 47790 - RNA, 32 nt, Human
agauuguaccacuguacuccagccugggcugg

SEQ ID NO: 47791 - RNA, 32 nt, Human
agauuguaccaugcacuccagccuggguaaca

SEQ ID NO: 47792 - RNA, 32 nt, Human
agauuguaccauggcacuccagccuggacaac

SEQ ID NO: 47793 - RNA, 32 nt, Human
agauuguaccauugcacuccagccugggcaac

SEQ ID NO: 47794 - RNA, 21 nt, Human
agauugucagcuugguccaca

SEQ ID NO: 47795 - RNA, 32 nt, Human
agauuguccauguccagaaacaacagugucuu

SEQ ID NO: 47796 - RNA, 32 nt, Human
agauuguccuggccgcgaccuggaccuccaug

SEQ ID NO: 47797 - RNA, 32 nt, Human
agauugucuucugcuaauuccucugguauguu

SEQ ID NO: 47798 - RNA, 18 nt, Human
agauugucuuuaucacca

SEQ ID NO: 47799 - RNA, 32 nt, Human
agauugugaauagcuccauccagccugagaaa

SEQ ID NO: 47800 - RNA, 32 nt, Human
agauugugacacugcacuccagccugggcaac

SEQ ID NO: 47801 - RNA, 32 nt, Human
agauugugaugaagugaaaaacugcucccuau

SEQ ID NO: 47802 - RNA, 32 nt, Human
agauugugcacugcacucuagccugggggaag

SEQ ID NO: 47803 - RNA, 32 nt, Human
agauugugccaccacacuccagccugggcgac

SEQ ID NO: 47804 - RNA, 32 nt, Human
agauugugccacggcacuccagccugggcagc

SEQ ID NO: 47805 - RNA, 32 nt, Human
agauugugccacuacacuccagccuggccaca

SEQ ID NO: 47806 - RNA, 32 nt, Human
agauugugccacuacacuccagccugggagac

SEQ ID NO: 47807 - RNA, 32 nt, Human
agauugugccacuacacuccagccugggcaac

SEQ ID NO: 47808 - RNA, 32 nt, Human
agauugugccacuacacuccagccugggugac

SEQ ID NO: 47809 - RNA, 32 nt, Human
agauugugccacuccccuccagccugggcgac

SEQ ID NO: 47810 - RNA, 32 nt, Human
agauugugccacugcacaccagccuggacaac

SEQ ID NO: 47811 - RNA, 32 nt, Human
agauugugccacugcacaccggccugggugac

SEQ ID NO: 47812 - RNA, 32 nt, Human
agauugugccacugcacacuccaaucugggug

SEQ ID NO: 47813 - RNA, 32 nt, Human
agauugugccacugcaccccagccuuggcaac

SEQ ID NO: 47814 - RNA, 32 nt, Human
agauugugccacugcacgcacuccagccuggg

SEQ ID NO: 47815 - RNA, 32 nt, Human
agauugugccacugcacuccaaccugggugac

SEQ ID NO: 47816 - RNA, 32 nt, Human
agauugugccacugcacuccacccugggcaac

SEQ ID NO: 47817 - RNA, 32 nt, Human
agauugugccacugcacuccagccagagugac

SEQ ID NO: 47818 - RNA, 32 nt, Human
agauugugccacugcacuccagccuaggcaac

SEQ ID NO: 47819 - RNA, 32 nt, Human
agauugugccacugcacuccagccuaggcgac

SEQ ID NO: 47820 - RNA, 32 nt, Human
agauugugccacugcacuccagccugagcaac

SEQ ID NO: 47821 - RNA, 32 nt, Human
agauugugccacugcacuccagccuggacgac

SEQ ID NO: 47822 - RNA, 32 nt, Human
agauugugccacugcacuccagccuggcaaca

SEQ ID NO: 47823 - RNA, 32 nt, Human
agauugugccacugcacuccagccugggagac

SEQ ID NO: 47824 - RNA, 32 nt, Human
agauugugccacugcacuccagccugggcaac

SEQ ID NO: 47825 - RNA, 32 nt, Human
agauugugccacugcacuccagccugggcaau

SEQ ID NO: 47826 - RNA, 32 nt, Human
agauugugccacugcacuccagccugggccac

SEQ ID NO: 47827 - RNA, 32 nt, Human
agauugugccacugcacuccagccugggcgac

SEQ ID NO: 47828 - RNA, 32 nt, Human
agauugugccacugcacuccagccugggcgau

SEQ ID NO: 47829 - RNA, 32 nt, Human
agauugugccacugcacuccagccuggguaac

SEQ ID NO: 47830 - RNA, 32 nt, Human
agauugugccacugcacuccagccugggugaa

SEQ ID NO: 47831 - RNA, 32 nt, Human
agauugugccacugcacuccagccugggugac

SEQ ID NO: 47832 - RNA, 32 nt, Human
agauugugccacugcacuccagccuuggcaac

SEQ ID NO: 47833 - RNA, 32 nt, Human
agauugugccacugcacuccagcgugggcaac

SEQ ID NO: 47834 - RNA, 32 nt, Human
agauugugccacugcacuccagcuggguggca

SEQ ID NO: 47835 - RNA, 32 nt, Human
agauugugccacugcacucccgccugggcgac

SEQ ID NO: 47836 - RNA, 32 nt, Human
agauugugccacugcacucgagccugggugac

SEQ ID NO: 47837 - RNA, 32 nt, Human
agauugugccacugcacucuagccuagguggc

SEQ ID NO: 47838 - RNA, 32 nt, Human
agauugugccacugcacucuagccucggugac

SEQ ID NO: 47839 - RNA, 32 nt, Human
agauugugccacugcacucuagccuggacagc

SEQ ID NO: 47840 - RNA, 32 nt, Human
agauugugccacugcacucuagccugggcaau

SEQ ID NO: 47841 - RNA, 32 nt, Human
agauugugccacugcacucuagccugggugac

SEQ ID NO: 47842 - RNA, 32 nt, Human
agauugugccacugcacugcaggcugggugac

SEQ ID NO: 47843 - RNA, 32 nt, Human
agauugugccacugcacuucagccugggcgac

SEQ ID NO: 47844 - RNA, 32 nt, Human
agauugugccacugcacuucagcuugggugac

SEQ ID NO: 47845 - RNA, 32 nt, Human
agauugugccacugcauucuagccugggcgau

SEQ ID NO: 47846 - RNA, 32 nt, Human
agauugugccacugcccuccagccugggugac

SEQ ID NO: 47847 - RNA, 32 nt, Human
agauugugccacugcgcuccagccugggcgac

SEQ ID NO: 47848 - RNA, 32 nt, Human
agauugugccacugcucuccagccugggaggc

SEQ ID NO: 47849 - RNA, 32 nt, Human
agauugugccacuguacaccagccugggugac

SEQ ID NO: 47850 - RNA, 32 nt, Human
agauugugccacuguacuccagccaggccaca

SEQ ID NO: 47851 - RNA, 32 nt, Human
agauugugccacuguacuccagccuggaagac

SEQ ID NO: 47852 - RNA, 32 nt, Human
agauugugccacuguacuccagccugggugac

SEQ ID NO: 47853 - RNA, 32 nt, Human
agauugugccacuguacuccagccuggugaca

SEQ ID NO: 47854 - RNA, 32 nt, Human
agauugugccacuguacugcagccugggugac

SEQ ID NO: 47855 - RNA, 32 nt, Human
agauugugccacuucacuccagccugggugac

SEQ ID NO: 47856 - RNA, 32 nt, Human
agauugugccacuucauuccagccugggcgac

SEQ ID NO: 47857 - RNA, 32 nt, Human
agauugugccauugcacuacagccuggucaac

SEQ ID NO: 47858 - RNA, 32 nt, Human
agauugugccauugcacuccaaccugggcaac

SEQ ID NO: 47859 - RNA, 32 nt, Human
agauugugccauugcacuccagccugggcaac

SEQ ID NO: 47860 - RNA, 32 nt, Human
agauugugccauugcacuccagccugggcgac

SEQ ID NO: 47861 - RNA, 32 nt, Human
agauugugccauugcacuccagccugggcuac

SEQ ID NO: 47862 - RNA, 32 nt, Human
agauugugccauugcacuccagccugggugac

SEQ ID NO: 47863 - RNA, 32 nt, Human
agauugugccauugcacuccagccugggugau

SEQ ID NO: 47864 - RNA, 32 nt, Human
agauugugccauugcacugcagccuggaugac

SEQ ID NO: 47865 - RNA, 32 nt, Human
agauugugccccugcacuccagccugagcgac

SEQ ID NO: 47866 - RNA, 32 nt, Human
agauugugccgcugcacuccagccuggcgaca

SEQ ID NO: 47867 - RNA, 32 nt, Human
agauugugcuaaggcuugagugcauugagccc

SEQ ID NO: 47868 - RNA, 32 nt, Human
agauugugcuacugcacucuagauugggugac

SEQ ID NO: 47869 - RNA, 32 nt, Human
agauugugcugcugcacuccagccugggagac

SEQ ID NO: 47870 - RNA, 32 nt, Human
agauugugcugcugcacuccagccugggugaa

SEQ ID NO: 47871 - RNA, 32 nt, Human
agauuguggcacugcacuccagucugggugac

SEQ ID NO: 47872 - RNA, 32 nt, Human
agauugugggcaaagaguugagucagugagaa

SEQ ID NO: 47873 - RNA, 32 nt, Human
agauuguggggagggguagagagaauaaucau

SEQ ID NO: 47874 - RNA, 32 nt, Human
agauugugucauugcacuccagccugggcaac

SEQ ID NO: 47875 - RNA, 32 nt, Human
agauuguuaagucauuuugcugccaccagacc

SEQ ID NO: 47876 - RNA, 32 nt, Human
agauuguuucaacuagacucccccucuccccu

SEQ ID NO: 47877 - RNA, 18 nt, Human
agauuguuucugcccuca

SEQ ID NO: 47878 - RNA, 32 nt, Human
agauuuaaagaagaaagggcacagauguacug

SEQ ID NO: 47879 - RNA, 32 nt, Human
agauuuaacagcuuuuaacagugaguuucguu

SEQ ID NO: 47880 - RNA, 32 nt, Human
agauuuaaccauuuucauacucuuagaugauu

SEQ ID NO: 47881 - RNA, 32 nt, Human
agauuuaaguaaaggagguaaaugcuaaauuc

SEQ ID NO: 47882 - RNA, 32 nt, Human
agauuuacauaguaaguuucacacuaccuuau

SEQ ID NO: 47883 - RNA, 32 nt, Human
agauuuaccagaaacaguccuuugucuagaug

SEQ ID NO: 47884 - RNA, 32 nt, Human
agauuuacccagcacucugagauaaauaccau

SEQ ID NO: 47885 - RNA, 18 nt, Human
agauuuaccccgucuucc

SEQ ID NO: 47886 - RNA, 32 nt, Human
agauuuacuaaacaaaagaaacucuccaccua

SEQ ID NO: 47887 - RNA, 32 nt, Human
agauuuagaaaccaguguguggugccagcucu

SEQ ID NO: 47888 - RNA, 32 nt, Human
agauuuagaggccgcuacagaaguccuuacug

SEQ ID NO: 47889 - RNA, 32 nt, Human
agauuuagagggagggagagucugaccuggau

SEQ ID NO: 47890 - RNA, 32 nt, Human
agauuuagguuuacauaacuacucugacauac

SEQ ID NO: 47891 - RNA, 20 nt, Human
agauuuaguacuagcuucau

SEQ ID NO: 47892 - RNA, 32 nt, Human
agauuuauauccuuucuuuuggguuaggaucu

SEQ ID NO: 47893 - RNA, 32 nt, Human
agauuuauauuuagcaaaauguuagcauguau

SEQ ID NO: 47894 - RNA, 32 nt, Human
agauuuaucccuguggagaguggguggauuca

SEQ ID NO: 47895 - RNA, 32 nt, Human
agauuuauggugcuugaaauguugcuaaacgu

SEQ ID NO: 47896 - RNA, 32 nt, Human
agauuuauuucaguguauuucagucuguuaua

SEQ ID NO: 47897 - RNA, 32 nt, Human
agauuuauuucugcuuugccucccuucagcua

SEQ ID NO: 47898 - RNA, 32 nt, Human
agauuucaaacagugauagacuugccauuuua

SEQ ID NO: 47899 - RNA, 32 nt, Human
agauuucaaauaguccuccccaccucaacugu

SEQ ID NO: 47900 - RNA, 32 nt, Human
agauuucaacaucagaugguugaagcuggaag

SEQ ID NO: 47901 - RNA, 32 nt, Human
agauuucaauccauagccucacuuaacuguag

SEQ ID NO: 47902 - RNA, 32 nt, Human
agauuucaccaaccccagugcccagaagaggg

SEQ ID NO: 47903 - RNA, 32 nt, Human
agauuucaccagugcacuccagccugggugac

SEQ ID NO: 47904 - RNA, 32 nt, Human
agauuucacugccccacuggauuuugggcuug

SEQ ID NO: 47905 - RNA, 32 nt, Human
agauuucacuucuaaggaguugauugauuaaa

SEQ ID NO: 47906 - RNA, 32 nt, Human
agauuucagacacagaagucuguccauggcuc

SEQ ID NO: 47907 - RNA, 32 nt, Human
agauuuccaauacuguauaaucuagaaauggc

SEQ ID NO: 47908 - RNA, 32 nt, Human
agauuucccacauucccaugaauaucaagaau

SEQ ID NO: 47909 - RNA, 32 nt, Human
agauuucccacuggucugcugggagaaucaag

SEQ ID NO: 47910 - RNA, 32 nt, Human
agauuuccuccccucagucaacccccauaacc

SEQ ID NO: 47911 - RNA, 32 nt, Human
agauuuccucuguuccagagccugcucuggag

SEQ ID NO: 47912 - RNA, 32 nt, Human
agauuuccuggugagguugcguggguggauua

SEQ ID NO: 47913 - RNA, 32 nt, Human
agauuuccuuucuccccugacaaagcccucaa

SEQ ID NO: 47914 - RNA, 32 nt, Human
agauuucucaaaggcugaaguuuucaaccuag

SEQ ID NO: 47915 - RNA, 32 nt, Human
agauuucucaaggcaucuuaaguguagcaugc

SEQ ID NO: 47916 - RNA, 32 nt, Human
agauuucuccucaaggccucuggagcaaccag

SEQ ID NO: 47917 - RNA, 32 nt, Human
agauuucuccuccaaaauacaucucaugggca

SEQ ID NO: 47918 - RNA, 32 nt, Human
agauuucugaagagugcagcugccugaaccga

SEQ ID NO: 47919 - RNA, 32 nt, Human
agauuucugacugguaggguuucuccaggcuc

SEQ ID NO: 47920 - RNA, 19 nt, Human
agauuucuucccgccuucu

SEQ ID NO: 47921 - RNA, 32 nt, Human
agauuucuucuuucucuuauuccuccuguuuc

SEQ ID NO: 47922 - RNA, 32 nt, Human
agauuugaaaacaaacuucucgcaacugaagg

SEQ ID NO: 47923 - RNA, 32 nt, Human
agauuugacuaacagugagccuuauuaagaac

SEQ ID NO: 47924 - RNA, 32 nt, Human
agauuugacugguuuugcagaagauuacaguu

SEQ ID NO: 47925 - RNA, 32 nt, Human
agauuugagggaggggagauggagaggagagg

SEQ ID NO: 47926 - RNA, 32 nt, Human
agauuugaguaugauaugauaaaggcuuucua

SEQ ID NO: 47927 - RNA, 32 nt, Human
agauuugaguggggacacagauccaaaccaua

SEQ ID NO: 47928 - RNA, 32 nt, Human
agauuugauuugccuggagucuuuuggaggca

SEQ ID NO: 47929 - RNA, 32 nt, Human
agauuugcaaacaugagugcugagggguacca

SEQ ID NO: 47930 - RNA, 32 nt, Human
agauuugcaauggcuggcaucugcuuuauucc

SEQ ID NO: 47931 - RNA, 32 nt, Human
agauuugcaccgcuguacuccagccugggcaa

SEQ ID NO: 47932 - RNA, 31 nt, Human
agauuugcacuuuccuaagggcagaagcaug

SEQ ID NO: 47933 - RNA, 32 nt, Human
agauuugcaugggcuggccgggcacaguggcu

SEQ ID NO: 47934 - RNA, 32 nt, Human
agauuugccaguaggaacugagauucaacguc

SEQ ID NO: 47935 - RNA, 32 nt, Human
agauuugccaugucccccagacccugcuucug

SEQ ID NO: 47936 - RNA, 32 nt, Human
agauuugcccauagguuaaacaugguuagaaa

SEQ ID NO: 47937 - RNA, 32 nt, Human
agauuugcccccgccuuguuuugaaagccccu

SEQ ID NO: 47938 - RNA, 32 nt, Human
agauuugccuggacuucccuucccagggaggg

SEQ ID NO: 47939 - RNA, 32 nt, Human
agauuugccuuguucucccagaaaagcucauu

SEQ ID NO: 47940 - RNA, 32 nt, Human
agauuugcuaucuaccagcuuguuacuuuggg

SEQ ID NO: 47941 - RNA, 32 nt, Human
agauuugcucccagacccucugaucucccucc

SEQ ID NO: 47942 - RNA, 32 nt, Human
agauuugcugugugaugcugucuccucuccag

SEQ ID NO: 47943 - RNA, 32 nt, Human
agauuugcuugaaccugggagguggagguugc

SEQ ID NO: 47944 - RNA, 32 nt, Human
agauuuggaaugggaccagaggcccuugaaaa

SEQ ID NO: 47945 - RNA, 32 nt, Human
agauuuggacugcuuuucacaguugagguugu

SEQ ID NO: 47946 - RNA, 32 nt, Human
agauuuggagaccugggcuugaguuccagcug

SEQ ID NO: 47947 - RNA, 32 nt, Human
agauuuggagcaggguggucacacugaccuug

SEQ ID NO: 47948 - RNA, 32 nt, Human
agauuuggauggggacacagcuaaaucauauc

SEQ ID NO: 47949 - RNA, 32 nt, Human
agauuugggaccuucauaucagcacuuuggac

SEQ ID NO: 47950 - RNA, 32 nt, Human
agauuugggccagacuccuguguccuugcuug

SEQ ID NO: 47951 - RNA, 32 nt, Human
agauuugggccauacguuggaaaauaagacau

SEQ ID NO: 47952 - RNA, 18 nt, Human
agauuuggggucacagca

SEQ ID NO: 47953 - RNA, 32 nt, Human
agauuugggugaggacacagagccauaccaua

SEQ ID NO: 47954 - RNA, 32 nt, Human
agauuugggugaggacacagauccaaacuguc

SEQ ID NO: 47955 - RNA, 32 nt, Human
agauuugggugaggacacagccaaaccaguca

SEQ ID NO: 47956 - RNA, 32 nt, Human
agauuugggugagggcacggccaaaccauguc

SEQ ID NO: 47957 - RNA, 32 nt, Human
agauuugggugggaacacagagccaaaccaua

SEQ ID NO: 47958 - RNA, 32 nt, Human
agauuuggguggggacacagccaaaccauaac

SEQ ID NO: 47959 - RNA, 32 nt, Human
agauuuggguggggacacagccaaaccauauc

SEQ ID NO: 47960 - RNA, 32 nt, Human
agauuuggguggggacacagccaaaccauguc

SEQ ID NO: 47961 - RNA, 32 nt, Human
agauuuggucagaauuugaggccaguuuccua

SEQ ID NO: 47962 - RNA, 32 nt, Human
agauuugguccccaguagagagccaggugaac

SEQ ID NO: 47963 - RNA, 32 nt, Human
agauuuggugcaggaaaacuaccuggaguacc

SEQ ID NO: 47964 - RNA, 32 nt, Human
agauuuguaauauuucucucuuuuuagagaaa

SEQ ID NO: 47965 - RNA, 32 nt, Human
agauuugucagcugucagggugcagugggacg

SEQ ID NO: 47966 - RNA, 32 nt, Human
agauuuguccuuuuauuucuccaucuuuauag

SEQ ID NO: 47967 - RNA, 32 nt, Human
agauuugugucacucuucugccuucgugaaaa

SEQ ID NO: 47968 - RNA, 32 nt, Human
agauuuguuguaagaaagacugugcagaggag

SEQ ID NO: 47969 - RNA, 32 nt, Human
agauuuuaaauggguugugcaagcauuaaaau

SEQ ID NO: 47970 - RNA, 32 nt, Human
agauuuuaacauccuuugcggucccaguccaa

SEQ ID NO: 47971 - RNA, 32 nt, Human
agauuuuacuaaaaugcaaaaauguaguuuca

SEQ ID NO: 47972 - RNA, 32 nt, Human
agauuuuagaaaaacauuuaaacuuuuuaaaa

SEQ ID NO: 47973 - RNA, 32 nt, Human
agauuuuagcaggaagagacaggcaaggaaag

SEQ ID NO: 47974 - RNA, 32 nt, Human
agauuuuauugaaugaaacaagcagguguuua

SEQ ID NO: 47975 - RNA, 32 nt, Human
agauuuucauucuucuucuggccaaagcucag

SEQ ID NO: 47976 - RNA, 32 nt, Human
agauuuuccagcggaucccccgguggccucau

SEQ ID NO: 47977 - RNA, 32 nt, Human
agauuuucucagaaaugugugaaagaaccuca

SEQ ID NO: 47978 - RNA, 32 nt, Human
agauuuucuccucaucucugaauggcugggug

SEQ ID NO: 47979 - RNA, 32 nt, Human
agauuuucuccucuucuggagucaauuuuguc

SEQ ID NO: 47980 - RNA, 32 nt, Human
agauuuucucugcaguuugcugaggcccagga

SEQ ID NO: 47981 - RNA, 24 nt, Human
agauuuucuucuguuuucuuugcu

SEQ ID NO: 47982 - RNA, 32 nt, Human
agauuuucuugggcaucucccggaaagugcgu

SEQ ID NO: 47983 - RNA, 20 nt, Human
agauuuugaggaaucagaga

SEQ ID NO: 47984 - RNA, 32 nt, Human
agauuuugcaacugcacuccagccugggcuac

SEQ ID NO: 47985 - RNA, 32 nt, Human
agauuuugcagcuguaaagcagagguagcaua

SEQ ID NO: 47986 - RNA, 32 nt, Human
agauuuugcccagaggaguaaauggagguggg

SEQ ID NO: 47987 - RNA, 32 nt, Human
agauuuugcucuucaauguugccuguaaacuu

SEQ ID NO: 47988 - RNA, 32 nt, Human
agauuuugggcaacaaguaccuacuaaguaaa

SEQ ID NO: 47989 - RNA, 32 nt, Human
agauuuugguacugcaacugcuuuccucuugc

SEQ ID NO: 47990 - RNA, 32 nt, Human
agauuuuggugaggaaacuugcuggaguuuuc

SEQ ID NO: 47991 - RNA, 32 nt, Human
agauuuugguggggacacagccaaaccauauc

SEQ ID NO: 47992 - RNA, 32 nt, Human
agauuuugucuguggauggagacaguggcagc

SEQ ID NO: 47993 - RNA, 21 nt, Human
agauuuuguuucccucuguaa

SEQ ID NO: 47994 - RNA, 32 nt, Human
agauuuuuacccaggccagugcagagaggugu

SEQ ID NO: 47995 - RNA, 32 nt, Human
agauuuuuauuugagccuacuaauuugugguu

SEQ ID NO: 47996 - RNA, 32 nt, Human
agauuuuucaaaggauggugacccugcuugua

SEQ ID NO: 47997 - RNA, 32 nt, Human
agauuuuuccauccugucucucuuacuguuuu

SEQ ID NO: 47998 - RNA, 32 nt, Human
agauuuuucuauucuuuucccuugacguuuac

SEQ ID NO: 47999 - RNA, 32 nt, Human
agauuuuucugauuuuuaaacuccugaaaaau

SEQ ID NO: 48000 - RNA, 32 nt, Human
agauuuuugcaaccuccuccugagccgggauu

SEQ ID NO: 48001 - RNA, 31 nt, Human
agauuuuugggaacguuacagaugcuaccuu

SEQ ID NO: 48002 - RNA, 32 nt, Human
agauuuuuguagccaagcagaguuguagaggg

SEQ ID NO: 48003 - RNA, 23 nt, Human
agauuuuugucuguucucuuugu

SEQ ID NO: 48004 - RNA, 24 nt, Human
agauuuuuuaaaucccucuucgcu

SEQ ID NO: 48005 - RNA, 27 nt, Human
agauuuuuucuagaugguuuuuucauu

SEQ ID NO: 48006 - RNA, 32 nt, Human
agcaaaaacccccacucugugccucugcugag

SEQ ID NO: 48007 - RNA, 31 nt, Human
agcaaaaagagacuugaauguuguggacaaa

SEQ ID NO: 48008 - RNA, 32 nt, Human
agcaaaaagaggaggaggaagaggagcucagg

SEQ ID NO: 48009 - RNA, 32 nt, Human
agcaaaaagaggagggggcauaaagacuggau

SEQ ID NO: 48010 - RNA, 32 nt, Human
agcaaaaagggagagagcaggaaagcgagcac

SEQ ID NO: 48011 - RNA, 32 nt, Human
agcaaaaaguuucuuuucugaggcugccauac

SEQ ID NO: 48012 - RNA, 32 nt, Human
agcaaaaaguuuuccagggagugagaaaagca

SEQ ID NO: 48013 - RNA, 18 nt, Human
agcaaaaauaacuuugga

SEQ ID NO: 48014 - RNA, 32 nt, Human
agcaaaaaugucagaugauaucaggaaaaggu

SEQ ID NO: 48015 - RNA, 32 nt, Human
agcaaaaauuggaugcauaaaguaauauuuac

SEQ ID NO: 48016 - RNA, 32 nt, Human
agcaaaacacuggauuuccuccccucagcagc

SEQ ID NO: 48017 - RNA, 32 nt, Human
agcaaaaccuauaauuaagccaaaauucaaau

SEQ ID NO: 48018 - RNA, 32 nt, Human
agcaaaaccuuacaaaugugaagaauguggca

SEQ ID NO: 48019 - RNA, 32 nt, Human
agcaaaacuccccggugugacugaggcacaca

SEQ ID NO: 48020 - RNA, 32 nt, Human
agcaaaacucgccuguuuuuguccucaauggc

SEQ ID NO: 48021 - RNA, 32 nt, Human
agcaaaagaacagcaggugcagccagcucuag

SEQ ID NO: 48022 - RNA, 32 nt, Human
agcaaaagaagagaugagaagaggcacaagaa

SEQ ID NO: 48023 - RNA, 25 nt, Human
agcaaaagcaaaggagcguggggaa

SEQ ID NO: 48024 - RNA, 20 nt, Human
agcaaaagcagaaacgugaa

SEQ ID NO: 48025 - RNA, 32 nt, Human
agcaaaagcaucuaugugagaccauuuagcac

SEQ ID NO: 48026 - RNA, 32 nt, Human
agcaaaagcuggaagcauuccccuugagaacu

SEQ ID NO: 48027 - RNA, 32 nt, Human
agcaaaaguauggagcaagaccuguagugaca

SEQ ID NO: 48028 - RNA, 22 nt, Human
agcaaaagucagucagggugaa

SEQ ID NO: 48029 - RNA, 19 nt, Human
agcaaaagucuuaggugaa

SEQ ID NO: 48030 - RNA, 32 nt, Human
agcaaaaguguucacauuacugagcaaacuau

SEQ ID NO: 48031 - RNA, 32 nt, Human
agcaaaauaaagaagaagaagaggaggaagag

SEQ ID NO: 48032 - RNA, 32 nt, Human
agcaaaauaaugaauggccacugugaaaaauu

SEQ ID NO: 48033 - RNA, 32 nt, Human
agcaaaauacuucaaaugaauaguauuaacuu

SEQ ID NO: 48034 - RNA, 32 nt, Human
agcaaaaucacuuaucuguucuuuucggcuaa

SEQ ID NO: 48035 - RNA, 32 nt, Human
agcaaaauccuccccuggccuccugggacugc

SEQ ID NO: 48036 - RNA, 23 nt, Human
agcaaaaugaacauuacuacuca

SEQ ID NO: 48037 - RNA, 31 nt, Human
agcaaaaugggaaaugaggcaaguuauccuu

SEQ ID NO: 48038 - RNA, 32 nt, Human
agcaaacaacaaacaaaccaaaauguggggaa

SEQ ID NO: 48039 - RNA, 32 nt, Human
agcaaacacagcacagaaaaugacucaccaac

SEQ ID NO: 48040 - RNA, 32 nt, Human
agcaaacaccacugccugcaggagccugggcu

SEQ ID NO: 48041 - RNA, 32 nt, Human
agcaaacacccaccccagaacaagccgacaca

SEQ ID NO: 48042 - RNA, 32 nt, Human
agcaaacacuccacccuccaccuuccauuuuc

SEQ ID NO: 48043 - RNA, 32 nt, Human
agcaaacagagggucagucacaggauguucug

SEQ ID NO: 48044 - RNA, 32 nt, Human
agcaaacagagugaaaugccauuuuucauauu

SEQ ID NO: 48045 - RNA, 32 nt, Human
agcaaacagauggcaggaugggcacugccgag

SEQ ID NO: 48046 - RNA, 32 nt, Human
agcaaacagcacaaucucacccucacaggaaa

SEQ ID NO: 48047 - RNA, 32 nt, Human
agcaaacaggcagcgcgcgacaauggcggucg

SEQ ID NO: 48048 - RNA, 32 nt, Human
agcaaacauuuggaauuuacaugugggcagac

SEQ ID NO: 48049 - RNA, 32 nt, Human
agcaaaccaagugccggagcaccagcgccgcc

SEQ ID NO: 48050 - RNA, 32 nt, Human
agcaaacccucacaucucccaccaauaacaca

SEQ ID NO: 48051 - RNA, 32 nt, Human
agcaaacccuugucaagccuaccagagcagcu

SEQ ID NO: 48052 - RNA, 32 nt, Human
agcaaaccuccaggaaggccuuugggcauggc

SEQ ID NO: 48053 - RNA, 32 nt, Human
agcaaaccugcaggaagagaucauggaaaaac

SEQ ID NO: 48054 - RNA, 32 nt, Human
agcaaaccugcccccucugccucccagugcac

SEQ ID NO: 48055 - RNA, 32 nt, Human
agcaaaccugcuguuuaacaucagggugacca

SEQ ID NO: 48056 - RNA, 32 nt, Human
agcaaaccuugauuuagcuccaagaaauugag

SEQ ID NO: 48057 - RNA, 32 nt, Human
agcaaacggcagaacuaacaauaaccaaacua

SEQ ID NO: 48058 - RNA, 32 nt, Human
agcaaacgucacagcaaaaacagccuuaaaag

SEQ ID NO: 48059 - RNA, 32 nt, Human
agcaaacuagggucucaguauugagaaacgca

SEQ ID NO: 48060 - RNA, 22 nt, Human
agcaaacuauugcaaggacaaa

SEQ ID NO: 48061 - RNA, 32 nt, Human
agcaaacucuucuccauagcaguccaguagug

SEQ ID NO: 48062 - RNA, 32 nt, Human
agcaaacugcagaggucacuccaggcuguggc

SEQ ID NO: 48063 - RNA, 32 nt, Human
agcaaacugcucccagauguccuuucucccug

SEQ ID NO: 48064 - RNA, 32 nt, Human
agcaaacugcuggcaccuauucuggguugcuu

SEQ ID NO: 48065 - RNA, 32 nt, Human
agcaaacuguaaacugucagggugauaaaaug

SEQ ID NO: 48066 - RNA, 32 nt, Human
agcaaagaaagaagguugguagugaaacacaa

SEQ ID NO: 48067 - RNA, 32 nt, Human
agcaaagaacuaaaggaggggaagaaaagcac

SEQ ID NO: 48068 - RNA, 32 nt, Human
agcaaagaaucuuugucacaccccaggaaguc

SEQ ID NO: 48069 - RNA, 32 nt, Human
agcaaagacaagguggcuuuggccgaugucca

SEQ ID NO: 48070 - RNA, 32 nt, Human
agcaaagacagaaacugauguuccaugcaugu

SEQ ID NO: 48071 - RNA, 24 nt, Human
agcaaagacagccagcgugcucag

SEQ ID NO: 48072 - RNA, 20 nt, Human
agcaaagacauucugcucag

SEQ ID NO: 48073 - RNA, 23 nt, Human
agcaaagacuugcuaauguuuga

SEQ ID NO: 48074 - RNA, 32 nt, Human
agcaaagagaagagcauuggggcuggaguguu

SEQ ID NO: 48075 - RNA, 32 nt, Human
agcaaagagcugagugaguccucugcucucca

SEQ ID NO: 48076 - RNA, 32 nt, Human
agcaaagaggaaggaagggaggucugugguca

SEQ ID NO: 48077 - RNA, 32 nt, Human
agcaaagaggcagagaugcguguguggcuucu

SEQ ID NO: 48078 - RNA, 32 nt, Human
agcaaagaggggcaauggcugcuuucagcuuu

SEQ ID NO: 48079 - RNA, 32 nt, Human
agcaaagaugaauuuaaaauauugauauacau

SEQ ID NO: 48080 - RNA, 22 nt, Human
agcaaagaugacagugcugcag

SEQ ID NO: 48081 - RNA, 32 nt, Human
agcaaagaugugaaaauaucugcucaaaacuu

SEQ ID NO: 48082 - RNA, 32 nt, Human
agcaaagcaagagcugaaaacugugugcauaa

SEQ ID NO: 48083 - RNA, 32 nt, Human
agcaaagcaagccacaccaugggugagaucaa

SEQ ID NO: 48084 - RNA, 24 nt, Human
agcaaagcacugugcugugcucag

SEQ ID NO: 48085 - RNA, 32 nt, Human
agcaaagcagaaaacagugccccaaauggaaa

SEQ ID NO: 48086 - RNA, 32 nt, Human
agcaaagcagacaaucuuuuucuugaaauuac

SEQ ID NO: 48087 - RNA, 32 nt, Human
agcaaagcagcaucucuuaaaauucaauauga

SEQ ID NO: 48088 - RNA, 32 nt, Human
agcaaagcagcaugauaaggacugcagcgggg

SEQ ID NO: 48089 - RNA, 18 nt, Human
agcaaagcagcauggggg

SEQ ID NO: 48090 - RNA, 32 nt, Human
agcaaagccagccuggggcuugcauguugauc

SEQ ID NO: 48091 - RNA, 32 nt, Human
agcaaagcccagaaagcagaacccaggaaccc

SEQ ID NO: 48092 - RNA, 32 nt, Human
agcaaagccccagcuuuuacagguuauucgcg

SEQ ID NO: 48093 - RNA, 32 nt, Human
agcaaagccgacccuauccaguccuugggacu

SEQ ID NO: 48094 - RNA, 32 nt, Human
agcaaagccucuguagccagacugccucucua

SEQ ID NO: 48095 - RNA, 32 nt, Human
agcaaagccuuaugaguguggccaguguggga

SEQ ID NO: 48096 - RNA, 32 nt, Human
agcaaagcuguauccuggaguuggucugugau

SEQ ID NO: 48097 - RNA, 32 nt, Human
agcaaaggaaaccuccacaagugcugcaacag

SEQ ID NO: 48098 - RNA, 32 nt, Human
agcaaaggaaguggcuugaaggaugugcuagu

SEQ ID NO: 48099 - RNA, 32 nt, Human
agcaaaggacaguaagaaguuggcuggcaaaa

SEQ ID NO: 48100 - RNA, 32 nt, Human
agcaaaggagagaagccuggaagaaccagucc

SEQ ID NO: 48101 - RNA, 22 nt, Human
agcaaaggagagcaggaaguug

SEQ ID NO: 48102 - RNA, 32 nt, Human
agcaaaggagccugagaguuagcuggccacag

SEQ ID NO: 48103 - RNA, 32 nt, Human
agcaaaggagcugagcugguggaggaagaaga

SEQ ID NO: 48104 - RNA, 32 nt, Human
agcaaaggagguggagcacaagcuggaccucu

SEQ ID NO: 48105 - RNA, 21 nt, Human
agcaaaggcugcuggugucag

SEQ ID NO: 48106 - RNA, 32 nt, Human
agcaaaggcugcuucuccuccagugcugaucu

SEQ ID NO: 48107 - RNA, 32 nt, Human
agcaaagggaaagaaaugcuuggaggaggcuc

SEQ ID NO: 48108 - RNA, 32 nt, Human
agcaaagggacaagaaggauucccuggagaaa

SEQ ID NO: 48109 - RNA, 32 nt, Human
agcaaaggggcagguggggacacuccaagugg

SEQ ID NO: 48110 - RNA, 23 nt, Human
agcaaagggugcauuucagggug

SEQ ID NO: 48111 - RNA, 32 nt, Human
agcaaaggugcacuccagacucugggggugga

SEQ ID NO: 48112 - RNA, 24 nt, Human
agcaaagguuaauuuaaggacaaa

SEQ ID NO: 48113 - RNA, 32 nt, Human
agcaaagguucaauuuaaaagaaaaauuaucu

SEQ ID NO: 48114 - RNA, 32 nt, Human
agcaaagucaagacaggagaccagcugccuuu

SEQ ID NO: 48115 - RNA, 32 nt, Human
agcaaagucuacagcacauagucuuuguaagg

SEQ ID NO: 48116 - RNA, 32 nt, Human
agcaaagugagccauagugggccaggcugccc

SEQ ID NO: 48117 - RNA, 26 nt, Human
agcaaaguguaacggccaacacuuug

SEQ ID NO: 48118 - RNA, 20 nt, Human
agcaaauaagccagcagaug

SEQ ID NO: 48119 - RNA, 21 nt, Human
agcaaauaaugccuacuacuc

SEQ ID NO: 48120 - RNA, 32 nt, Human
agcaaauacaaaccuuuauacuaauggauuaa

SEQ ID NO: 48121 - RNA, 32 nt, Human
agcaaauacauuggcaauacagcugcuuuugc

SEQ ID NO: 48122 - RNA, 23 nt, Human
agcaaaucagcccuucucugaac

SEQ ID NO: 48123 - RNA, 32 nt, Human
agcaaauccaucuccaaacaugauacucuugg

SEQ ID NO: 48124 - RNA, 32 nt, Human
agcaaauccuggcaagugacccagcucuucuc

SEQ ID NO: 48125 - RNA, 32 nt, Human
agcaaaucucuggguaugucucugguaaagac

SEQ ID NO: 48126 - RNA, 32 nt, Human
agcaaaucugcaucuucucuuauuucugaccu

SEQ ID NO: 48127 - RNA, 32 nt, Human
agcaaaugaacccagaauggaacaguggggag

SEQ ID NO: 48128 - RNA, 21 nt, Human
agcaaaugaaccuacuucuca

SEQ ID NO: 48129 - RNA, 31 nt, Human
agcaaaugccacucugggcagucuuuugugu

SEQ ID NO: 48130 - RNA, 18 nt, Human
agcaaaugccaggucuag

SEQ ID NO: 48131 - RNA, 32 nt, Human
agcaaauggaagagaauggaccaguaauuucu

SEQ ID NO: 48132 - RNA, 32 nt, Human
agcaaaugggcccugacuguaaauuagugaag

SEQ ID NO: 48133 - RNA, 30 nt, Human
agcaaaugguucagcaggauguucagggcc

SEQ ID NO: 48134 - RNA, 32 nt, Human
agcaaauguccucuucuccuugcugcuagagu

SEQ ID NO: 48135 - RNA, 32 nt, Human
agcaaaugucuauccaguuaagucacaugccc

SEQ ID NO: 48136 - RNA, 32 nt, Human
agcaaaugucucugcuaccauuuccuuaaggu

SEQ ID NO: 48137 - RNA, 32 nt, Human
agcaaauuaaauccaugcugcaauacaauucu

SEQ ID NO: 48138 - RNA, 32 nt, Human
agcaaauuagggacugagucauggcagaaaua

SEQ ID NO: 48139 - RNA, 32 nt, Human
agcaaauuauguuaagagacagugauggcuag

SEQ ID NO: 48140 - RNA, 32 nt, Human
agcaaauugguugaucuuuaaggcaguagguu

SEQ ID NO: 48141 - RNA, 32 nt, Human
agcaaauuguuauuuuaaaaaguuuucuuguu

SEQ ID NO: 48142 - RNA, 32 nt, Human
agcaacaaaggcgugaaagaagugaaaagaag

SEQ ID NO: 48143 - RNA, 32 nt, Human
agcaacaacgcuccccuugcucugccuuuggu

SEQ ID NO: 48144 - RNA, 32 nt, Human
agcaacacacagauuugucgccucuguccccg

SEQ ID NO: 48145 - RNA, 32 nt, Human
agcaacacacaugcuccgucugacaagguggu

SEQ ID NO: 48146 - RNA, 32 nt, Human
agcaacacagugagacccccaucucuacaaaa

SEQ ID NO: 48147 - RNA, 32 nt, Human
agcaacacccaccccugcccuucuuggcccau

SEQ ID NO: 48148 - RNA, 32 nt, Human
agcaacacccuuccacccuccugcuccagccu

SEQ ID NO: 48149 - RNA, 32 nt, Human
agcaacaccucucugcccucccucccuuuguc

SEQ ID NO: 48150 - RNA, 32 nt, Human
agcaacacuggggagagccuggagcagccgga

SEQ ID NO: 48151 - RNA, 32 nt, Human
agcaacagaaguaaauugaagauacuggcuaa

SEQ ID NO: 48152 - RNA, 32 nt, Human
agcaacagauuugagguaccagugcauagcag

SEQ ID NO: 48153 - RNA, 32 nt, Human
agcaacagcaaaagcccuaacuucuuauacgu

SEQ ID NO: 48154 - RNA, 24 nt, Human
agcaacagcagcagauccaagaag

SEQ ID NO: 48155 - RNA, 32 nt, Human
agcaacaggcgcagggccugcccacgcccuuu

SEQ ID NO: 48156 - RNA, 32 nt, Human
agcaacaggcuggagggagagggaagcaagac

SEQ ID NO: 48157 - RNA, 32 nt, Human
agcaacagguaucgaggacucuccaaaccccc

SEQ ID NO: 48158 - RNA, 32 nt, Human
agcaacaggugaggacagacgucuggaagccc

SEQ ID NO: 48159 - RNA, 32 nt, Human
agcaacaguaauggaguacaugagcacuggaa

SEQ ID NO: 48160 - RNA, 20 nt, Human
agcaacaguccacagcccuu

SEQ ID NO: 48161 - RNA, 32 nt, Human
agcaacaguccucaggagggccaagggagucu

SEQ ID NO: 48162 - RNA, 32 nt, Human
agcaacaguguagugagaacagcacccaugaa

SEQ ID NO: 48163 - RNA, 32 nt, Human
agcaacauacagaagaaaaagaauuuguugag

SEQ ID NO: 48164 - RNA, 32 nt, Human
agcaacauagugaggaucccaucucuacgccc

SEQ ID NO: 48165 - RNA, 32 nt, Human
agcaacaugcgauucuggaggcacggggguaa

SEQ ID NO: 48166 - RNA, 32 nt, Human
agcaacauggacaacauguuugagagcuacgu

SEQ ID NO: 48167 - RNA, 31 nt, Human
agcaacaugggagaaacugagaaaagaauug

SEQ ID NO: 48168 - RNA, 32 nt, Human
agcaacaugugcaacacauacaaggacaaaaa

SEQ ID NO: 48169 - RNA, 32 nt, Human
agcaacauuaaauuugguuuguuuugcuaugu

SEQ ID NO: 48170 - RNA, 32 nt, Human
agcaacauugggugacagaacuucuuagcacc

SEQ ID NO: 48171 - RNA, 32 nt, Human
agcaaccaaacuuggagugguuauugcagaca

SEQ ID NO: 48172 - RNA, 32 nt, Human
agcaaccaagagugucaguuguacccgaggcg

SEQ ID NO: 48173 - RNA, 32 nt, Human
agcaaccaaucacaaccauaaagcuacaagca

SEQ ID NO: 48174 - RNA, 21 nt, Human
agcaaccagcaacuccagggu

SEQ ID NO: 48175 - RNA, 32 nt, Human
agcaaccaggcccugcugcagcuugaggcggc

SEQ ID NO: 48176 - RNA, 32 nt, Human
agcaaccaugacugacuuaagcagaaaaggaa

SEQ ID NO: 48177 - RNA, 32 nt, Human
agcaacccaucuuucuucaguauguauguucu

SEQ ID NO: 48178 - RNA, 32 nt, Human
agcaacccaucuuuguucagcaucccaggaga

SEQ ID NO: 48179 - RNA, 32 nt, Human
agcaaccccagccucuguucugcccuuuccaa

SEQ ID NO: 48180 - RNA, 23 nt, Human
agcaacccccugccccaagagug

SEQ ID NO: 48181 - RNA, 32 nt, Human
agcaaccccugcaugccauucuuuuugggcuc

SEQ ID NO: 48182 - RNA, 18 nt, Human
agcaacccucagcucagg

SEQ ID NO: 48183 - RNA, 20 nt, Human
agcaacccucugaagaaggg

SEQ ID NO: 48184 - RNA, 32 nt, Human
agcaacccugggaaaagugacuucaucccuuc

SEQ ID NO: 48185 - RNA, 32 nt, Human
agcaacccuucuuuuucccuuugacuucuaca

SEQ ID NO: 48186 - RNA, 32 nt, Human
agcaaccgcgagcaauuucuugggaccaaagu

SEQ ID NO: 48187 - RNA, 22 nt, Human
agcaaccgugcagccacgaaca

SEQ ID NO: 48188 - RNA, 32 nt, Human
agcaaccuaaguguccaucaacagaugaaugg

SEQ ID NO: 48189 - RNA, 32 nt, Human
agcaaccuaaugaucucuaucucugaacaucu

SEQ ID NO: 48190 - RNA, 32 nt, Human
agcaaccuccacuucuucagcaccacacacac

SEQ ID NO: 48191 - RNA, 32 nt, Human
agcaaccuccuccccagugccuccuggaucaa

SEQ ID NO: 48192 - RNA, 32 nt, Human
agcaaccucuuagaugugcacacaccacuuug

SEQ ID NO: 48193 - RNA, 32 nt, Human
agcaaccugcacuccagccugggugacagagc

SEQ ID NO: 48194 - RNA, 32 nt, Human
agcaaccugcagcugaggucgccggcgccuuu

SEQ ID NO: 48195 - RNA, 32 nt, Human
agcaaccugucuggcaagggacaggaagcuga

SEQ ID NO: 48196 - RNA, 32 nt, Human
agcaaccuguuuugacaaaucugauuaaaaug

SEQ ID NO: 48197 - RNA, 32 nt, Human
agcaaccuuugaauccagcucuagucagucua

SEQ ID NO: 48198 - RNA, 32 nt, Human
agcaaccuuuguauauuggagacuucagagua

SEQ ID NO: 48199 - RNA, 32 nt, Human
agcaacgacugcugcugguguguauuuuugua

SEQ ID NO: 48200 - RNA, 32 nt, Human
agcaacgccagccugggucacaguccaucaaa

SEQ ID NO: 48201 - RNA, 32 nt, Human
agcaacgcuacuuucuaagggcauuuuucccu

SEQ ID NO: 48202 - RNA, 32 nt, Human
agcaacgcuaguggcucaugccuguaauccag

SEQ ID NO: 48203 - RNA, 32 nt, Human
agcaacggaaauuucauugcuccuggguggaa

SEQ ID NO: 48204 - RNA, 32 nt, Human
agcaacggcagcaacuggcccucccaggaccc

SEQ ID NO: 48205 - RNA, 32 nt, Human
agcaacgggagguggaggauccuggagguguc

SEQ ID NO: 48206 - RNA, 32 nt, Human
agcaacgggcuggggcagccugcagcugccca

SEQ ID NO: 48207 - RNA, 32 nt, Human
agcaacgugauggaggacuugggggaaaagga

SEQ ID NO: 48208 - RNA, 24 nt, Human
agcaacuaaaauggccucguccuu

SEQ ID NO: 48209 - RNA, 32 nt, Human
agcaacuaauucuggugcucaggcugggcucu

SEQ ID NO: 48210 - RNA, 23 nt, Human
agcaacuagaaaauugucauuuc

SEQ ID NO: 48211 - RNA, 32 nt, Human
agcaacuagcaggugucucagcagagcaagaa

SEQ ID NO: 48212 - RNA, 32 nt, Human
agcaacuagcuuagaguaaaucuucaguaauu

SEQ ID NO: 48213 - RNA, 32 nt, Human
agcaacuaugcuguucauguccccaggaaugg

SEQ ID NO: 48214 - RNA, 32 nt, Human
agcaacuccuggcuucccagcagccggaacac

SEQ ID NO: 48215 - RNA, 32 nt, Human
agcaacucggaagaggaaagaaaggaagucag

SEQ ID NO: 48216 - RNA, 32 nt, Human
agcaacucuccucuggcgugacagccggcaug

SEQ ID NO: 48217 - RNA, 32 nt, Human
agcaacucuuuuucaaccacugcucaucaguu

SEQ ID NO: 48218 - RNA, 32 nt, Human
agcaacuggaaagaagaaaugcagagauuugc

SEQ ID NO: 48219 - RNA, 32 nt, Human
agcaacuggagaaauguuuuuccuucaagaaa

SEQ ID NO: 48220 - RNA, 32 nt, Human
agcaacuggguggaggcugcccaggugguggc

SEQ ID NO: 48221 - RNA, 32 nt, Human
agcaacuggugcugcugaccgaggcccccgag

SEQ ID NO: 48222 - RNA, 32 nt, Human
agcaacugugaccacagcgaggaugcggggcu

SEQ ID NO: 48223 - RNA, 32 nt, Human
agcaacugugggcaucaggcuguggggcggca

SEQ ID NO: 48224 - RNA, 32 nt, Human
agcaacuuaguggcaaaaaguaauguuguacu

SEQ ID NO: 48225 - RNA, 23 nt, Human
agcaacuucauauaagcauggug

SEQ ID NO: 48226 - RNA, 32 nt, Human
agcaacuucauccagggcaucaagcaagccag

SEQ ID NO: 48227 - RNA, 32 nt, Human
agcaacuugcccaaguccuucuucuuuuccca

SEQ ID NO: 48228 - RNA, 32 nt, Human
agcaacuuggaagaggaaagaaaagaagucag

SEQ ID NO: 48229 - RNA, 32 nt, Human
agcaacuuucugagagcagaaugccagaauau

SEQ ID NO: 48230 - RNA, 19 nt, Human
agcaagaaaacaccugcug

SEQ ID NO: 48231 - RNA, 32 nt, Human
agcaagaaaagugaagaaagaaugcagaauug

SEQ ID NO: 48232 - RNA, 32 nt, Human
agcaagaaacaguauccacaguggacuccggg

SEQ ID NO: 48233 - RNA, 32 nt, Human
agcaagaaagaaaaagacagaaaacaaaugcg

SEQ ID NO: 48234 - RNA, 32 nt, Human
agcaagaaagaaaagaaggaaggaagagaggu

SEQ ID NO: 48235 - RNA, 24 nt, Human
agcaagaaagcacgaaagcaagca

SEQ ID NO: 48236 - RNA, 32 nt, Human
agcaagaaaguggaggggcgggcagagccaga

SEQ ID NO: 48237 - RNA, 32 nt, Human
agcaagaacagagccagcacacacauuggagc

SEQ ID NO: 48238 - RNA, 27 nt, Human
agcaagaacugcacaagaaacggaguc

SEQ ID NO: 48239 - RNA, 32 nt, Human
agcaagaagaaagacguggcagcaagcgggag

SEQ ID NO: 48240 - RNA, 32 nt, Human
agcaagaagaugguguuucugccccucaaaug

SEQ ID NO: 48241 - RNA, 32 nt, Human
agcaagaagauugggagaaaguagcuguggga

SEQ ID NO: 48242 - RNA, 32 nt, Human
agcaagaaguaggaagaaguugagacagggag

SEQ ID NO: 48243 - RNA, 32 nt, Human
agcaagaaugacugucagaacaugugcaguaa

SEQ ID NO: 48244 - RNA, 32 nt, Human
agcaagacaagccagagaucucccacaccucc

SEQ ID NO: 48245 - RNA, 32 nt, Human
agcaagacaggacgggagaacaaggacaagcu

SEQ ID NO: 48246 - RNA, 32 nt, Human
agcaagacaugucuucacaaggccaacaggag

SEQ ID NO: 48247 - RNA, 23 nt, Human
agcaagaccagccccuccuccuc

SEQ ID NO: 48248 - RNA, 32 nt, Human
agcaagacccaauauuuggcuaguucagggag

SEQ ID NO: 48249 - RNA, 32 nt, Human
agcaagacccaccccacacugccuucaccauc

SEQ ID NO: 48250 - RNA, 32 nt, Human
agcaagaccccaaacagggcguggcugccacg

SEQ ID NO: 48251 - RNA, 32 nt, Human
agcaagaccccuggcaaacugggcacuuggcc

SEQ ID NO: 48252 - RNA, 23 nt, Human
agcaagacccugcuuuccccucu

SEQ ID NO: 48253 - RNA, 32 nt, Human
agcaagacccugcuuuccccucuuguccucca

SEQ ID NO: 48254 - RNA, 31 nt, Human
agcaagacgaaaacacacaggagggaaaauc

SEQ ID NO: 48255 - RNA, 32 nt, Human
agcaagacucgaauaggcugguggugacacuu

SEQ ID NO: 48256 - RNA, 22 nt, Human
agcaagacuugaggacagcuca

SEQ ID NO: 48257 - RNA, 32 nt, Human
agcaagacuuuauaauuccuucugccuaacuu

SEQ ID NO: 48258 - RNA, 32 nt, Human
agcaagagacuccccaggugugccuggccugg

SEQ ID NO: 48259 - RNA, 32 nt, Human
agcaagagacuggccuagcagccaggcccggc

SEQ ID NO: 48260 - RNA, 32 nt, Human
agcaagagaggcuuuccacuucaacggcaaag

SEQ ID NO: 48261 - RNA, 32 nt, Human
agcaagagaugaacuuaaguacucugaaguac

SEQ ID NO: 48262 - RNA, 23 nt, Human
agcaagagcaccccaucuucagg

SEQ ID NO: 48263 - RNA, 32 nt, Human
agcaagagcuccagagagaagucgaggaagag

SEQ ID NO: 48264 - RNA, 32 nt, Human
agcaagagcuuugugggcuguuuugucauggu

SEQ ID NO: 48265 - RNA, 32 nt, Human
agcaagaggaagagauggggucgcaggggccc

SEQ ID NO: 48266 - RNA, 32 nt, Human
agcaagaggauugcauucagccuaguuccugg

SEQ ID NO: 48267 - RNA, 22 nt, Human
agcaagagguagcccccucucc

SEQ ID NO: 48268 - RNA, 32 nt, Human
agcaagagguggaauggcuagacacugaauca

SEQ ID NO: 48269 - RNA, 32 nt, Human
agcaagaguagagagagugccuggauuucaug

SEQ ID NO: 48270 - RNA, 32 nt, Human
agcaagaguaggguuguggaaagaccaagcug

SEQ ID NO: 48271 - RNA, 31 nt, Human
agcaagagucauuccaucacagggacugcau

SEQ ID NO: 48272 - RNA, 18 nt, Human
agcaagagugaaacucca

SEQ ID NO: 48273 - RNA, 32 nt, Human
agcaagagugugaggcaagagaagcuggaacc

SEQ ID NO: 48274 - RNA, 32 nt, Human
agcaagauaacggcauauaacacugccauuac

SEQ ID NO: 48275 - RNA, 22 nt, Human
agcaagauggagucccaugaga

SEQ ID NO: 48276 - RNA, 31 nt, Human
agcaagauggcugacuccaaagaggguguuu

SEQ ID NO: 48277 - RNA, 31 nt, Human
agcaagauggguaacaucacaguagauucgu

SEQ ID NO: 48278 - RNA, 32 nt, Human
agcaagauuuccucuuugcaaaaucauauuuu

SEQ ID NO: 48279 - RNA, 32 nt, Human
agcaagcaacccagugauagcagcccagcucu

SEQ ID NO: 48280 - RNA, 28 nt, Human
agcaagcaaguugcugccuauucuauag

SEQ ID NO: 48281 - RNA, 32 nt, Human
agcaagcaccugggugugcuccaggcuuccug

SEQ ID NO: 48282 - RNA, 32 nt, Human
agcaagcacugcaagcagcacauucucaagag

SEQ ID NO: 48283 - RNA, 32 nt, Human
agcaagcacuugaagagaaggaaggggagaaa

SEQ ID NO: 48284 - RNA, 23 nt, Human
agcaagcagaucacuugagguca

SEQ ID NO: 48285 - RNA, 32 nt, Human
agcaagcaggcagcaggcugccggcgggcggg

SEQ ID NO: 48286 - RNA, 32 nt, Human
agcaagcaggugugagcaccuauuucacuacc

SEQ ID NO: 48287 - RNA, 32 nt, Human
agcaagcaguacaguggcauucccagggggac

SEQ ID NO: 48288 - RNA, 32 nt, Human
agcaagcaucacaguaauggaucucugucaga

SEQ ID NO: 48289 - RNA, 32 nt, Human
agcaagcaugacaauccucacuucacugaguu

SEQ ID NO: 48290 - RNA, 32 nt, Human
agcaagcauguugaauuuaaaauaugaauaac

SEQ ID NO: 48291 - RNA, 18 nt, Human
agcaagccagugagcagc

SEQ ID NO: 48292 - RNA, 32 nt, Human
agcaagccauuuaauccgguucuuggagaaac

SEQ ID NO: 48293 - RNA, 32 nt, Human
agcaagcccaggagaagacucuccgccccacg

SEQ ID NO: 48294 - RNA, 32 nt, Human
agcaagccgguaagucucuccagguaggacuu

SEQ ID NO: 48295 - RNA, 32 nt, Human
agcaagccucacugccacugugccuuuggggc

SEQ ID NO: 48296 - RNA, 32 nt, Human
agcaagccuguccuuccugacccggcgguuaa

SEQ ID NO: 48297 - RNA, 17 nt, Human
agcaagcgcgggcggca

SEQ ID NO: 48298 - RNA, 32 nt, Human
agcaagcguguauuuuccuugucugcugcuau

SEQ ID NO: 48299 - RNA, 32 nt, Human
agcaagcuagacaaggcauggaagagagagug

SEQ ID NO: 48300 - RNA, 32 nt, Human
agcaagcucaacuacauuccagggcgcccagg

SEQ ID NO: 48301 - RNA, 32 nt, Human
agcaagcucugcccuggcuguggguaucagga

SEQ ID NO: 48302 - RNA, 32 nt, Human
agcaagcugagucugaacaaauggaucuuucu

SEQ ID NO: 48303 - RNA, 32 nt, Human
agcaagcugcuuuuguuacaccugccaucugc

SEQ ID NO: 48304 - RNA, 32 nt, Human
agcaagcuggcguacugcgaggggaagcucac

SEQ ID NO: 48305 - RNA, 32 nt, Human
agcaagcuggcuuuuggaaaugaaucaggaac

SEQ ID NO: 48306 - RNA, 24 nt, Human
agcaagcuucaaagaagcccagug

SEQ ID NO: 48307 - RNA, 32 nt, Human
agcaaggaaagaaauuaaggaaagaaguuaag

SEQ ID NO: 48308 - RNA, 32 nt, Human
agcaaggaaaguguuucuaucacuggaaggag

SEQ ID NO: 48309 - RNA, 32 nt, Human
agcaaggaccaucccaacucaggaugaacccu

SEQ ID NO: 48310 - RNA, 32 nt, Human
agcaaggacgcugcaaacuugcgcagcgcggg

SEQ ID NO: 48311 - RNA, 32 nt, Human
agcaaggacugcuguguguggguguguuccuc

SEQ ID NO: 48312 - RNA, 32 nt, Human
agcaaggagagugcaugacucacuggaaccgc

SEQ ID NO: 48313 - RNA, 32 nt, Human
agcaaggagggugugguggguugaaagccauc

SEQ ID NO: 48314 - RNA, 32 nt, Human
agcaaggagguccacugcuccaguuggcugca

SEQ ID NO: 48315 - RNA, 19 nt, Human
agcaaggaggugggcagca

SEQ ID NO: 48316 - RNA, 32 nt, Human
agcaaggagugaccugcucagcaaaggcauca

SEQ ID NO: 48317 - RNA, 32 nt, Human
agcaaggaucuuucacccacagaaagagagca

SEQ ID NO: 48318 - RNA, 17 nt, Human
agcaaggaugagcagca

SEQ ID NO: 48319 - RNA, 32 nt, Human
agcaaggaugcagucucccaggagaggaugca

SEQ ID NO: 48320 - RNA, 32 nt, Human
agcaaggcaccugcagguugggccauacuggc

SEQ ID NO: 48321 - RNA, 32 nt, Human
agcaaggcagaauggccaccccugccaaaguu

SEQ ID NO: 48322 - RNA, 32 nt, Human
agcaaggcagaauggccaccccugccaagguu

SEQ ID NO: 48323 - RNA, 32 nt, Human
agcaaggcaguaacaccacaaaagcaaaacca

SEQ ID NO: 48324 - RNA, 32 nt, Human
agcaaggcaugucugcacagggccuagcauga

SEQ ID NO: 48325 - RNA, 32 nt, Human
agcaaggcauguuuuaguugagugcucugguc

SEQ ID NO: 48326 - RNA, 32 nt, Human
agcaaggccaaagacuuuugagaauguguaug

SEQ ID NO: 48327 - RNA, 32 nt, Human
agcaaggcccacugcugcuccugggugagaag

SEQ ID NO: 48328 - RNA, 32 nt, Human
agcaaggcccagccaaggagguacagauuccu

SEQ ID NO: 48329 - RNA, 32 nt, Human
agcaaggccggccgcccugccggugugccgcc

SEQ ID NO: 48330 - RNA, 22 nt, Human
agcaaggcgcggggccccgguc

SEQ ID NO: 48331 - RNA, 32 nt, Human
agcaaggcugcacccuccuugaucaucacagg

SEQ ID NO: 48332 - RNA, 24 nt, Human
agcaaggcuguacccucaaugcag

SEQ ID NO: 48333 - RNA, 32 nt, Human
agcaagggaaggaaagcggggaaaggaggaag

SEQ ID NO: 48334 - RNA, 32 nt, Human
agcaagggaaggaggaagaaaggaaagaggag

SEQ ID NO: 48335 - RNA, 32 nt, Human
agcaagggaagugacaggaaauggagcugggg

SEQ ID NO: 48336 - RNA, 32 nt, Human
agcaagggacguggacggggcagugagccagg

SEQ ID NO: 48337 - RNA, 32 nt, Human
agcaagggagggaggaaggcggugagagaggc

SEQ ID NO: 48338 - RNA, 32 nt, Human
agcaagggagggagggagcgcgaguccgagag

SEQ ID NO: 48339 - RNA, 32 nt, Human
agcaagggaucacugugcuggguuuaaaugcg

SEQ ID NO: 48340 - RNA, 32 nt, Human
agcaagggcagcuugacucuauccugggauga

SEQ ID NO: 48341 - RNA, 32 nt, Human
agcaagggcaggguucagaaagacugaaugua

SEQ ID NO: 48342 - RNA, 32 nt, Human
agcaagggccaaacauucuuuaucccucccac

SEQ ID NO: 48343 - RNA, 32 nt, Human
agcaagggccuccgucuucccuuccuuaacuc

SEQ ID NO: 48344 - RNA, 32 nt, Human
agcaaggggaagugccugaagacauacacugg

SEQ ID NO: 48345 - RNA, 32 nt, Human
agcaaggggcccugaccucgggaugagauaac

SEQ ID NO: 48346 - RNA, 32 nt, Human
agcaaggggcuggggccagggagcagagcuuc

SEQ ID NO: 48347 - RNA, 32 nt, Human
agcaagguagagugagccaauggcgagagauc

SEQ ID NO: 48348 - RNA, 32 nt, Human
agcaaggucagcugccccacgccuguaucugg

SEQ ID NO: 48349 - RNA, 32 nt, Human
agcaaggucccugcggccaccaccuccuccuc

SEQ ID NO: 48350 - RNA, 32 nt, Human
agcaaggugaagcacaaggccggcaagcaggg

SEQ ID NO: 48351 - RNA, 32 nt, Human
agcaagguggcugaacuauagucuggaagccc

SEQ ID NO: 48352 - RNA, 32 nt, Human
agcaagguuaucaugcagaauuggguaagaau

SEQ ID NO: 48353 - RNA, 32 nt, Human
agcaagguuuguucaucuuccuuuccugucau

SEQ ID NO: 48354 - RNA, 32 nt, Human
agcaaguagugguuugguuucuaucauauaga

SEQ ID NO: 48355 - RNA, 32 nt, Human
agcaagucaaugucaccgacagugaugaggag

SEQ ID NO: 48356 - RNA, 22 nt, Human
agcaagucacacaugagcagca

SEQ ID NO: 48357 - RNA, 32 nt, Human
agcaagucacaccugccagugcccucauccuu

SEQ ID NO: 48358 - RNA, 32 nt, Human
agcaagucagcuuuuagugaaaugugaaaauu

SEQ ID NO: 48359 - RNA, 24 nt, Human
agcaagucccccagccccacccca

SEQ ID NO: 48360 - RNA, 32 nt, Human
agcaagucccugcagugagcacuagggacagu

SEQ ID NO: 48361 - RNA, 32 nt, Human
agcaaguccguauccuggaaguguuauuuuau

SEQ ID NO: 48362 - RNA, 32 nt, Human
agcaaguccucccaacugcaguaagucugagg

SEQ ID NO: 48363 - RNA, 32 nt, Human
agcaagucguccaaaccuuccaaaaagaagca

SEQ ID NO: 48364 - RNA, 32 nt, Human
agcaagucuuuuuaaaugcugcuuuauuucac

SEQ ID NO: 48365 - RNA, 32 nt, Human
agcaagugaacaaaacaaguugcagaacggag

SEQ ID NO: 48366 - RNA, 32 nt, Human
agcaagugcacuuuuaaauguguuacuaagau

SEQ ID NO: 48367 - RNA, 32 nt, Human
agcaagugugcaagacuccagaagcagaagcc

SEQ ID NO: 48368 - RNA, 32 nt, Human
agcaaguguuauuucuuaaauuucucaaaugc

SEQ ID NO: 48369 - RNA, 32 nt, Human
agcaaguguucacugcuccuugcugcauugau

SEQ ID NO: 48370 - RNA, 32 nt, Human
agcaaguuacuuuugagcgccuacuguguguc

SEQ ID NO: 48371 - RNA, 24 nt, Human
agcaaguugaagagaugaguaaca

SEQ ID NO: 48372 - RNA, 21 nt, Human
agcaaguuggcaaaacagaca

SEQ ID NO: 48373 - RNA, 32 nt, Human
agcaauaaaagcuucccccugauauccauccc

SEQ ID NO: 48374 - RNA, 32 nt, Human
agcaauaaauugguggggaagaggagguuuua

SEQ ID NO: 48375 - RNA, 32 nt, Human
agcaauaacuucagaggaggugaagacaucug

SEQ ID NO: 48376 - RNA, 32 nt, Human
agcaauaaggcccagccccgccuucugcuguu

SEQ ID NO: 48377 - RNA, 32 nt, Human
agcaauaaguaggaaguacuguaaaagaauua

SEQ ID NO: 48378 - RNA, 32 nt, Human
agcaauaaugguuugguucacuuuaugaaaaa

SEQ ID NO: 48379 - RNA, 32 nt, Human
agcaauacagagaaaaacaaacaaacauaauu

SEQ ID NO: 48380 - RNA, 32 nt, Human
agcaauacaggagaggaugaagggaggagcuc

SEQ ID NO: 48381 - RNA, 32 nt, Human
agcaauacuacacaacuugcuacuuucagaaa

SEQ ID NO: 48382 - RNA, 32 nt, Human
agcaauacucacugaccuacuaguuuauuuug

SEQ ID NO: 48383 - RNA, 32 nt, Human
agcaauacuguguaacaaauccgccaacacuc

SEQ ID NO: 48384 - RNA, 32 nt, Human
agcaauacuguugccagaaaggacacuccaua

SEQ ID NO: 48385 - RNA, 19 nt, Human
agcaauagacaguguuggu

SEQ ID NO: 48386 - RNA, 32 nt, Human
agcaauagacaguguugguaaugguugugcug

SEQ ID NO: 48387 - RNA, 32 nt, Human
agcaauagauggggcuuccuaccauuuguugg

SEQ ID NO: 48388 - RNA, 32 nt, Human
agcaauaggaagagaguguuauucugagacag

SEQ ID NO: 48389 - RNA, 31 nt, Human
agcaauaggcuucuccccugagcagagaccg

SEQ ID NO: 48390 - RNA, 32 nt, Human
agcaauagugaugcagaaccugucauuagcau

SEQ ID NO: 48391 - RNA, 32 nt, Human
agcaauauacauaggaguggaauugcuagguc

SEQ ID NO: 48392 - RNA, 32 nt, Human
agcaauaucccacaauaccucugacaaugaaa

SEQ ID NO: 48393 - RNA, 32 nt, Human
agcaaucaaaguguuuguuaauaaaagaaaaa

SEQ ID NO: 48394 - RNA, 32 nt, Human
agcaaucaagccacaggccuuauuucauaugu

SEQ ID NO: 48395 - RNA, 32 nt, Human
agcaaucaagcuuaucuggauauuucuuucuu

SEQ ID NO: 48396 - RNA, 32 nt, Human
agcaaucacgugcacacaggcagcauuaaugg

SEQ ID NO: 48397 - RNA, 32 nt, Human
agcaaucacugcacccagccaccucuauauac

SEQ ID NO: 48398 - RNA, 32 nt, Human
agcaaucagcccaccucugccucccaaagcgu

SEQ ID NO: 48399 - RNA, 32 nt, Human
agcaaucaggagagacagggcucggggaaggc

SEQ ID NO: 48400 - RNA, 22 nt, Human
agcaaucagucagggcugcagu

SEQ ID NO: 48401 - RNA, 32 nt, Human
agcaauccaagugauccucccaccucaaccuu

SEQ ID NO: 48402 - RNA, 32 nt, Human
agcaauccacccaccucugccucccaaagugc

SEQ ID NO: 48403 - RNA, 23 nt, Human
agcaauccaggcuuaugaagaug

SEQ ID NO: 48404 - RNA, 32 nt, Human
agcaaucccacaugcuuuucacaaacauuaaa

SEQ ID NO: 48405 - RNA, 32 nt, Human
agcaaucccccagccucggccucccaaagugc

SEQ ID NO: 48406 - RNA, 32 nt, Human
agcaauccuuggcuaacagaagauucuuccag

SEQ ID NO: 48407 - RNA, 32 nt, Human
agcaaucuaguacaaaccucucauuuuacaga

SEQ ID NO: 48408 - RNA, 32 nt, Human
agcaaucucaaccucuauuucuagaucacauu

SEQ ID NO: 48409 - RNA, 32 nt, Human
agcaaucugcauuuuaacaagcaccccaguca

SEQ ID NO: 48410 - RNA, 32 nt, Human
agcaaucuggaaggaacaaaaauguuuucugu

SEQ ID NO: 48411 - RNA, 32 nt, Human
agcaaucuucacuccagucucugccucugugu

SEQ ID NO: 48412 - RNA, 20 nt, Human
agcaaucuucauuaaugcag

SEQ ID NO: 48413 - RNA, 32 nt, Human
agcaaucuuccuuaauagcauuucaagccaug

SEQ ID NO: 48414 - RNA, 32 nt, Human
agcaaucuuccuuaauagcauuucaagccgug

SEQ ID NO: 48415 - RNA, 32 nt, Human
agcaaucuuugcuguucugcagccucugcugg

SEQ ID NO: 48416 - RNA, 32 nt, Human
agcaaugaaggcuggagaaugcagccuggauu

SEQ ID NO: 48417 - RNA, 21 nt, Human
agcaaugaccuguccacuuca

SEQ ID NO: 48418 - RNA, 32 nt, Human
agcaaugagaggagggagugagacuguuggcu

SEQ ID NO: 48419 - RNA, 32 nt, Human
agcaaugaggucuugcuguguugcccaggcug

SEQ ID NO: 48420 - RNA, 32 nt, Human
agcaaugaucguaccacugcacuccagccuag

SEQ ID NO: 48421 - RNA, 32 nt, Human
agcaaugcacaaugugucugggucaucacagc

SEQ ID NO: 48422 - RNA, 32 nt, Human
agcaaugcagagcccccauggagggcaggugg

SEQ ID NO: 48423 - RNA, 32 nt, Human
agcaaugcagcucaggagugccugggagcaca

SEQ ID NO: 48424 - RNA, 32 nt, Human
agcaaugcuaucuaccuucacacuccugagcu

SEQ ID NO: 48425 - RNA, 32 nt, Human
agcaauggcaccugggcagugccagggcuuaa

SEQ ID NO: 48426 - RNA, 32 nt, Human
agcaauggccagagcauuucucaccaguucug

SEQ ID NO: 48427 - RNA, 32 nt, Human
agcaaugggaugcaggaagaagaggcaggaga

SEQ ID NO: 48428 - RNA, 32 nt, Human
agcaaugggguuucaccaugcuggccaggcuu

SEQ ID NO: 48429 - RNA, 32 nt, Human
agcaaugguccaucagcucucugccuuccagc

SEQ ID NO: 48430 - RNA, 32 nt, Human
agcaauggucucaccauagcugcuggaaucac

SEQ ID NO: 48431 - RNA, 32 nt, Human
agcaaugugguuuugcagcucugacuucugcu

SEQ ID NO: 48432 - RNA, 22 nt, Human
agcaauguugggaaacaguguc

SEQ ID NO: 48433 - RNA, 21 nt, Human
agcaauguuuguugcuugcca

SEQ ID NO: 48434 - RNA, 32 nt, Human
agcaauuaaagaaaauagaauguggccacuua

SEQ ID NO: 48435 - RNA, 23 nt, Human
agcaauuacuugaggacaguuca

SEQ ID NO: 48436 - RNA, 32 nt, Human
agcaauuaggaaggaaggagaacaggaggagg

SEQ ID NO: 48437 - RNA, 32 nt, Human
agcaauuaggagaccuuuuguauucagacucu

SEQ ID NO: 48438 - RNA, 32 nt, Human
agcaauucaacagauaauagagcaauguuuag

SEQ ID NO: 48439 - RNA, 32 nt, Human
agcaauucauucucucugaacacacauugcua

SEQ ID NO: 48440 - RNA, 32 nt, Human
agcaauuccacuucuaggaauguacauacuca

SEQ ID NO: 48441 - RNA, 32 nt, Human
agcaauucccaggucauagcucaagaauuguu

SEQ ID NO: 48442 - RNA, 32 nt, Human
agcaauucucaugccucugccucucgggcagc

SEQ ID NO: 48443 - RNA, 32 nt, Human
agcaauucucauuccucucagccaaaggccug

SEQ ID NO: 48444 - RNA, 32 nt, Human
agcaauucuccagccucagccucccaaguagc

SEQ ID NO: 48445 - RNA, 32 nt, Human
agcaauucuccagccucugccucccgaguagc

SEQ ID NO: 48446 - RNA, 32 nt, Human
agcaauucuccugccucagccucccagauagc

SEQ ID NO: 48447 - RNA, 32 nt, Human
agcaauucuccugccucagccucccagguggc

SEQ ID NO: 48448 - RNA, 32 nt, Human
agcaauucucugccucagccuccugaguaacu

SEQ ID NO: 48449 - RNA, 32 nt, Human
agcaauucuguccucugauucccaccccuacc

SEQ ID NO: 48450 - RNA, 32 nt, Human
agcaauugcacaguuacauacacagucaauua

SEQ ID NO: 48451 - RNA, 32 nt, Human
agcaauugcaccacugcacuccagccugggug

SEQ ID NO: 48452 - RNA, 32 nt, Human
agcaauugcacuccggccugggcaacaagagc

SEQ ID NO: 48453 - RNA, 32 nt, Human
agcaauugguugucauuguccuaaacagagca

SEQ ID NO: 48454 - RNA, 32 nt, Human
agcaauugucugccucucccucugccucccuc

SEQ ID NO: 48455 - RNA, 32 nt, Human
agcaauuucccaaguguguguuuguuuuauau

SEQ ID NO: 48456 - RNA, 32 nt, Human
agcaauuuggugauucauuugcagcaaaauac

SEQ ID NO: 48457 - RNA, 32 nt, Human
agcaauuuuagguauauagaaguaggaagaag

SEQ ID NO: 48458 - RNA, 32 nt, Human
agcacaaacacaaggucauggccacacuguga

SEQ ID NO: 48459 - RNA, 32 nt, Human
agcacaaaggauuugaguaggaagaugaccag

SEQ ID NO: 48460 - RNA, 32 nt, Human
agcacaaagugcugggauuacaggcaugacca

SEQ ID NO: 48461 - RNA, 22 nt, Human
agcacaaaugcuguccauggcc

SEQ ID NO: 48462 - RNA, 32 nt, Human
agcacaacacaaauuccauccaagaggagaau

SEQ ID NO: 48463 - RNA, 32 nt, Human
agcacaaccuuuuccucaccagucccaugcug

SEQ ID NO: 48464 - RNA, 32 nt, Human
agcacaacucagccucccaggcugccagcaau

SEQ ID NO: 48465 - RNA, 32 nt, Human
agcacaacuuggcccugcguucccaggaaggg

SEQ ID NO: 48466 - RNA, 32 nt, Human
agcacaagaaguccuggagucuuuggaaggua

SEQ ID NO: 48467 - RNA, 32 nt, Human
agcacaagacaggcacauuccgcucacagcau

SEQ ID NO: 48468 - RNA, 32 nt, Human
agcacaagaggaagagagagacccucacugcu

SEQ ID NO: 48469 - RNA, 23 nt, Human
agcacaagauccuugcaugcaca

SEQ ID NO: 48470 - RNA, 32 nt, Human
agcacaagcagccugaggguuccaugggcuca

SEQ ID NO: 48471 - RNA, 23 nt, Human
agcacaagccauacaucgcaggu

SEQ ID NO: 48472 - RNA, 32 nt, Human
agcacaagccugauuuaugucacugcacuucu

SEQ ID NO: 48473 - RNA, 32 nt, Human
agcacaagccugggagugacgggaugggggag

SEQ ID NO: 48474 - RNA, 20 nt, Human
agcacaagcugccaggccug

SEQ ID NO: 48475 - RNA, 32 nt, Human
agcacaaggacucugugcaucuugacugcacc

SEQ ID NO: 48476 - RNA, 32 nt, Human
agcacaaggcauuggcccucuggacuccuuuc

SEQ ID NO: 48477 - RNA, 32 nt, Human
agcacaaggcccagaucggaaaccccaaacuc

SEQ ID NO: 48478 - RNA, 26 nt, Human
agcacaaggugggaucaggcugccuc

SEQ ID NO: 48479 - RNA, 32 nt, Human
agcacaaguaccacucuuggucagcuuuuguu

SEQ ID NO: 48480 - RNA, 32 nt, Human
agcacaaguuagggaggaagaggcaggcgaug

SEQ ID NO: 48481 - RNA, 32 nt, Human
agcacaaugaacagauuuaccaucccgaagaa

SEQ ID NO: 48482 - RNA, 32 nt, Human
agcacaauucugucccugucccugccccgccc

SEQ ID NO: 48483 - RNA, 32 nt, Human
agcacaauuggcagagaugaggcggguggugg

SEQ ID NO: 48484 - RNA, 21 nt, Human
agcacacaacugcacugaagc

SEQ ID NO: 48485 - RNA, 32 nt, Human
agcacacaagcgcauuucagaaacuuaucaaa

SEQ ID NO: 48486 - RNA, 32 nt, Human
agcacacacagaauaacccugcauccaaauuc

SEQ ID NO: 48487 - RNA, 31 nt, Human
agcacacacagcuaagagauaagaaggcugc

SEQ ID NO: 48488 - RNA, 32 nt, Human
agcacacacaugcaaggcauauacauggacac

SEQ ID NO: 48489 - RNA, 32 nt, Human
agcacacacaugcuuaccuaaugcaucacugu

SEQ ID NO: 48490 - RNA, 18 nt, Human
agcacacacaugugcaca

SEQ ID NO: 48491 - RNA, 20 nt, Human
agcacacaccauauuucaaa

SEQ ID NO: 48492 - RNA, 32 nt, Human
agcacacaccaugaagaucaccagcuuggaug

SEQ ID NO: 48493 - RNA, 23 nt, Human
agcacacacccugcgggccuuca

SEQ ID NO: 48494 - RNA, 32 nt, Human
agcacacaccucuuugccaucuaugccagcau

SEQ ID NO: 48495 - RNA, 32 nt, Human
agcacacaccuguaaucccagcuacuugagag

SEQ ID NO: 48496 - RNA, 32 nt, Human
agcacacacucaucauggauugcucagaguuc

SEQ ID NO: 48497 - RNA, 32 nt, Human
agcacacacuucccugcuucugagcccauuaa

SEQ ID NO: 48498 - RNA, 32 nt, Human
agcacacagaagcaugagguucaugacucucc

SEQ ID NO: 48499 - RNA, 32 nt, Human
agcacacagcacaggcgccguccuauaacauc

SEQ ID NO: 48500 - RNA, 32 nt, Human
agcacacaggccugccccucuccagccagcuc

SEQ ID NO: 48501 - RNA, 32 nt, Human
agcacacaggguauccacauguuacccugcag

SEQ ID NO: 48502 - RNA, 32 nt, Human
agcacacaugcgcacacacacuugcauucaug

SEQ ID NO: 48503 - RNA, 32 nt, Human
agcacacauuugcagugcaccuacuguguuug

SEQ ID NO: 48504 - RNA, 32 nt, Human
agcacaccaacccggcuuucuucugagggaca

SEQ ID NO: 48505 - RNA, 32 nt, Human
agcacaccacugcacuccagccugggcaacaa

SEQ ID NO: 48506 - RNA, 32 nt, Human
agcacaccauccuuagcacucugggugucugg

SEQ ID NO: 48507 - RNA, 32 nt, Human
agcacaccccggggagacagugcaaugaaagg

SEQ ID NO: 48508 - RNA, 32 nt, Human
agcacacccugaaucaccccuacuacagcacg

SEQ ID NO: 48509 - RNA, 32 nt, Human
agcacacccugaaucaccccuacuggcugacc

SEQ ID NO: 48510 - RNA, 21 nt, Human
agcacaccgagcuggcccgca

SEQ ID NO: 48511 - RNA, 32 nt, Human
agcacaccggcauccccaccugcugcagggac

SEQ ID NO: 48512 - RNA, 32 nt, Human
agcacaccguuuccuguugcucagggacucau

SEQ ID NO: 48513 - RNA, 32 nt, Human
agcacaccucaccuccaugccccacacuugcc

SEQ ID NO: 48514 - RNA, 32 nt, Human
agcacaccuccaggaacaaacucccuggccug

SEQ ID NO: 48515 - RNA, 32 nt, Human
agcacaccugcacucccacacgcccacccagc

SEQ ID NO: 48516 - RNA, 32 nt, Human
agcacacgacuugcccuagagccauggcuggg

SEQ ID NO: 48517 - RNA, 32 nt, Human
agcacacgcaugcugccugcugugcuggagua

SEQ ID NO: 48518 - RNA, 32 nt, Human
agcacacgccuguaaucccagcuacuugggag

SEQ ID NO: 48519 - RNA, 32 nt, Human
agcacacgucggagaacaggaggcucacaaaa

SEQ ID NO: 48520 - RNA, 32 nt, Human
agcacacuacagccuccaacucuugggcucaa

SEQ ID NO: 48521 - RNA, 32 nt, Human
agcacacuacagccuccaacucuuggguucaa

SEQ ID NO: 48522 - RNA, 32 nt, Human
agcacacucggagcuugugcuuugucuccacg

SEQ ID NO: 48523 - RNA, 18 nt, Human
agcacacucucagucaua

SEQ ID NO: 48524 - RNA, 32 nt, Human
agcacacucuucuugggcccuagaaggucagu

SEQ ID NO: 48525 - RNA, 32 nt, Human
agcacacugcagccuggaacuccugggaucag

SEQ ID NO: 48526 - RNA, 32 nt, Human
agcacacugcaggcugcugcuauucccugucu

SEQ ID NO: 48527 - RNA, 32 nt, Human
agcacacugccaggaugggagcugcugggagg

SEQ ID NO: 48528 - RNA, 32 nt, Human
agcacacugggcccuggcugggaguagagggg

SEQ ID NO: 48529 - RNA, 32 nt, Human
agcacacuuccccuccccaucuucccacuuaa

SEQ ID NO: 48530 - RNA, 22 nt, Human
agcacagaaaugcaaggucuaa

SEQ ID NO: 48531 - RNA, 19 nt, Human
agcacagaacguugccuaa

SEQ ID NO: 48532 - RNA, 32 nt, Human
agcacagaacugcucccucuucaucuccauau

SEQ ID NO: 48533 - RNA, 21 nt, Human
agcacagaacuuugaaccuag

SEQ ID NO: 48534 - RNA, 32 nt, Human
agcacagaagcugccuuuccuugaguaauaau

SEQ ID NO: 48535 - RNA, 32 nt, Human
agcacagaagucagcgggcaucuccuggagac

SEQ ID NO: 48536 - RNA, 17 nt, Human
agcacagaauaauaucu

SEQ ID NO: 48537 - RNA, 19 nt, Human
agcacagaaugaguauuua

SEQ ID NO: 48538 - RNA, 31 nt, Human
agcacagaauuuuagaauacuaugggggcug

SEQ ID NO: 48539 - RNA, 32 nt, Human
agcacagacguggggcauccccagaaagacuc

SEQ ID NO: 48540 - RNA, 32 nt, Human
agcacagacuggacuaagccuccugggccuug

SEQ ID NO: 48541 - RNA, 23 nt, Human
agcacagacuguucuauauuuga

SEQ ID NO: 48542 - RNA, 32 nt, Human
agcacagagaacagccaacggguucagggaac

SEQ ID NO: 48543 - RNA, 32 nt, Human
agcacagagcucgggaggacuccaccugcucu

SEQ ID NO: 48544 - RNA, 15 nt, Human
agcacagagcugccu

SEQ ID NO: 48545 - RNA, 21 nt, Human
agcacagagcugggauauuua

SEQ ID NO: 48546 - RNA, 22 nt, Human
agcacagaucaaacauauuuaa

SEQ ID NO: 48547 - RNA, 32 nt, Human
agcacagauggccaugaauugucauuuauagu

SEQ ID NO: 48548 - RNA, 20 nt, Human
agcacagauuaucauaucug

SEQ ID NO: 48549 - RNA, 32 nt, Human
agcacagauucacuggcugggucuccagucuc

SEQ ID NO: 48550 - RNA, 20 nt, Human
agcacagauugcagugaacc

SEQ ID NO: 48551 - RNA, 17 nt, Human
agcacagauugcugccc

SEQ ID NO: 48552 - RNA, 32 nt, Human
agcacagcaaagccgcuauagccagacuaccu

SEQ ID NO: 48553 - RNA, 20 nt, Human
agcacagcagagauaucuaa

SEQ ID NO: 48554 - RNA, 32 nt, Human
agcacagcagcauccacccagccugggcucaa

SEQ ID NO: 48555 - RNA, 32 nt, Human
agcacagcagccgcucagagacaggaauagaa

SEQ ID NO: 48556 - RNA, 32 nt, Human
agcacagcaggcagcugcaggagcagugggag

SEQ ID NO: 48557 - RNA, 32 nt, Human
agcacagcaguaggaagcccagugucccccaa

SEQ ID NO: 48558 - RNA, 19 nt, Human
agcacagccacaggagcgg

SEQ ID NO: 48559 - RNA, 32 nt, Human
agcacagccaguuaaaagaugcagccucacug

SEQ ID NO: 48560 - RNA, 18 nt, Human
agcacagccuuccaugcc

SEQ ID NO: 48561 - RNA, 18 nt, Human
agcacagcucagguuccc

SEQ ID NO: 48562 - RNA, 18 nt, Human
agcacagcucggguuccc

SEQ ID NO: 48563 - RNA, 32 nt, Human
agcacaggaacggucagaaacugggcucauca

SEQ ID NO: 48564 - RNA, 32 nt, Human
agcacaggaagccgaagcuggggucagaugag

SEQ ID NO: 48565 - RNA, 32 nt, Human
agcacaggaagucacacugaggggacacauuc

SEQ ID NO: 48566 - RNA, 32 nt, Human
agcacaggaaucuucuucuuggcagcugcagu

SEQ ID NO: 48567 - RNA, 32 nt, Human
agcacaggaauguuaacauguaugacagggga

SEQ ID NO: 48568 - RNA, 32 nt, Human
agcacaggagacggagguugcugugagcugag

SEQ ID NO: 48569 - RNA, 32 nt, Human
agcacaggaguuggaggauacagugagccaug

SEQ ID NO: 48570 - RNA, 21 nt, Human
agcacaggauaaaauacuuga

SEQ ID NO: 48571 - RNA, 18 nt, Human
agcacaggauuguuccug

SEQ ID NO: 48572 - RNA, 32 nt, Human
agcacaggcaacaguucagagguagugguaga

SEQ ID NO: 48573 - RNA, 22 nt, Human
agcacaggcagaggaugggcgg

SEQ ID NO: 48574 - RNA, 32 nt, Human
agcacaggcccagguggaucaucucaugcuaa

SEQ ID NO: 48575 - RNA, 18 nt, Human
agcacaggcugagaccug

SEQ ID NO: 48576 - RNA, 32 nt, Human
agcacaggcugucugcagucucaggcuuccua

SEQ ID NO: 48577 - RNA, 32 nt, Human
agcacagggaaaggacaaauacuugucaacua

SEQ ID NO: 48578 - RNA, 32 nt, Human
agcacagggaggcagaggcuuggguaaacuca

SEQ ID NO: 48579 - RNA, 32 nt, Human
agcacagggauucucaagaccugaguauuuuu

SEQ ID NO: 48580 - RNA, 32 nt, Human
agcacagggcccuggggcccuggcuggcagga

SEQ ID NO: 48581 - RNA, 32 nt, Human
agcacagggcuggaccacuaugcccuggagga

SEQ ID NO: 48582 - RNA, 32 nt, Human
agcacagggcugggugauacguacacccuaag

SEQ ID NO: 48583 - RNA, 32 nt, Human
agcacaggggacgcaaugggaggcagggacac

SEQ ID NO: 48584 - RNA, 21 nt, Human
agcacaggggaggauaccuga

SEQ ID NO: 48585 - RNA, 21 nt, Human
agcacagggggacaugccugg

SEQ ID NO: 48586 - RNA, 32 nt, Human
agcacagggggucccaccaaggacaaggacaa

SEQ ID NO: 48587 - RNA, 32 nt, Human
agcacaggguggacagucucugcggugggcag

SEQ ID NO: 48588 - RNA, 32 nt, Human
agcacagguauuucaggugugaaagaaucagu

SEQ ID NO: 48589 - RNA, 19 nt, Human
agcacaggucacugccuga

SEQ ID NO: 48590 - RNA, 20 nt, Human
agcacagguggcagcggcug

SEQ ID NO: 48591 - RNA, 19 nt, Human
agcacaggugucugccuag

SEQ ID NO: 48592 - RNA, 20 nt, Human
agcacagguucucagucuaa

SEQ ID NO: 48593 - RNA, 23 nt, Human
agcacaguaauguggcacugagc

SEQ ID NO: 48594 - RNA, 20 nt, Human
agcacaguauuaauauuuag

SEQ ID NO: 48595 - RNA, 23 nt, Human
agcacagucuuccuggugccuag

SEQ ID NO: 48596 - RNA, 32 nt, Human
agcacagugacuugcaccaaacagguguugca

SEQ ID NO: 48597 - RNA, 32 nt, Human
agcacagugagggcugguaccacccacuccug

SEQ ID NO: 48598 - RNA, 32 nt, Human
agcacaguggagauaaauuaacaggcauauuc

SEQ ID NO: 48599 - RNA, 32 nt, Human
agcacagugugggcaaccggacaggauggauu

SEQ ID NO: 48600 - RNA, 32 nt, Human
agcacaguuagcagauggugguuggcucccuc

SEQ ID NO: 48601 - RNA, 32 nt, Human
agcacaguucugcugcuguggcuucagcuuug

SEQ ID NO: 48602 - RNA, 32 nt, Human
agcacaguuuuuaauaaaugcuuguuacauuc

SEQ ID NO: 48603 - RNA, 32 nt, Human
agcacauaccuguaaucccagcuacucaggag

SEQ ID NO: 48604 - RNA, 32 nt, Human
agcacauacucagaccuguuuuguuaacuaga

SEQ ID NO: 48605 - RNA, 31 nt, Human
agcacauaggacagacugaaagacuguaauu

SEQ ID NO: 48606 - RNA, 32 nt, Human
agcacauaggcucaggcuucuguaggcuuccu

SEQ ID NO: 48607 - RNA, 20 nt, Human
agcacauaugcaaugccuga

SEQ ID NO: 48608 - RNA, 19 nt, Human
agcacauauuuaguaucua

SEQ ID NO: 48609 - RNA, 32 nt, Human
agcacaucacacaccauccccacugucauuca

SEQ ID NO: 48610 - RNA, 32 nt, Human
agcacaucacauuuaggacguugaagauuuuu

SEQ ID NO: 48611 - RNA, 32 nt, Human
agcacaucaucuuccuaggcagucucuucccc

SEQ ID NO: 48612 - RNA, 25 nt, Human
agcacauccacuggagaugcugggc

SEQ ID NO: 48613 - RNA, 32 nt, Human
agcacauccugccugcuguugcagccuggcug

SEQ ID NO: 48614 - RNA, 32 nt, Human
agcacaucuuucucacacuuugcucuuuggaa

SEQ ID NO: 48615 - RNA, 32 nt, Human
agcacaugagauguccucagcugggcuuggcu

SEQ ID NO: 48616 - RNA, 32 nt, Human
agcacaugcauaguggcaucagcagcuuccug

SEQ ID NO: 48617 - RNA, 32 nt, Human
agcacaugcaugcacaccaguacacacacagu

SEQ ID NO: 48618 - RNA, 32 nt, Human
agcacaugcccaggaucguguguguggggcuu

SEQ ID NO: 48619 - RNA, 32 nt, Human
agcacaugccccagcugggcuguuaccgggcc

SEQ ID NO: 48620 - RNA, 32 nt, Human
agcacaugccuauaaucccagcacuuugggag

SEQ ID NO: 48621 - RNA, 32 nt, Human
agcacaugccuguggucccagcuacucagagg

SEQ ID NO: 48622 - RNA, 20 nt, Human
agcacauggcagauuugcaa

SEQ ID NO: 48623 - RNA, 32 nt, Human
agcacauggcaggccauugcugagggcacagg

SEQ ID NO: 48624 - RNA, 30 nt, Human
agcacauggugacagugaugccgcuggaga

SEQ ID NO: 48625 - RNA, 32 nt, Human
agcacaugguuucugccuccagcaugcuagau

SEQ ID NO: 48626 - RNA, 32 nt, Human
agcacauguacacugguguuggacagagcagc

SEQ ID NO: 48627 - RNA, 18 nt, Human
agcacauguccuauccca

SEQ ID NO: 48628 - RNA, 32 nt, Human
agcacauguguaucagccuguccuggcugauu

SEQ ID NO: 48629 - RNA, 32 nt, Human
agcacauguuucagagagcacaggguugggga

SEQ ID NO: 48630 - RNA, 32 nt, Human
agcacauguuucagagagcacaggguuggggg

SEQ ID NO: 48631 - RNA, 32 nt, Human
agcacauugacccauagcacacacauacacac

SEQ ID NO: 48632 - RNA, 32 nt, Human
agcacauugcugcaaugugguacgugaauugc

SEQ ID NO: 48633 - RNA, 32 nt, Human
agcacauuucagcccccacccccucggggcuc

SEQ ID NO: 48634 - RNA, 19 nt, Human
agcaccaaagcagaggggc

SEQ ID NO: 48635 - RNA, 18 nt, Human
agcaccaaagccccuggc

SEQ ID NO: 48636 - RNA, 22 nt, Human
agcaccaacacgucccacgcug

SEQ ID NO: 48637 - RNA, 20 nt, Human
agcaccaacccggaaguggc

SEQ ID NO: 48638 - RNA, 32 nt, Human
agcaccaacucaaccuuugcuuuuuggaugag

SEQ ID NO: 48639 - RNA, 32 nt, Human
agcaccaagcaggggucaggcccugguggagg

SEQ ID NO: 48640 - RNA, 32 nt, Human
agcaccaagcggugguggcuguggaggaagcc

SEQ ID NO: 48641 - RNA, 32 nt, Human
agcaccaaggcgagcuccgggcucagaccaac

SEQ ID NO: 48642 - RNA, 32 nt, Human
agcaccaagggcccccgacacuccacuccugc

SEQ ID NO: 48643 - RNA, 28 nt, Human
agcaccaagggcuugcugccuuguuucc

SEQ ID NO: 48644 - RNA, 32 nt, Human
agcaccaaucccaacaugaaauuauauuacuc

SEQ ID NO: 48645 - RNA, 32 nt, Human
agcaccacacagacacucugcagagcacguag

SEQ ID NO: 48646 - RNA, 32 nt, Human
agcaccacacugggugcgucuccagucaucug

SEQ ID NO: 48647 - RNA, 32 nt, Human
agcaccacagaaugauccggguucagguugcg

SEQ ID NO: 48648 - RNA, 32 nt, Human
agcaccacagcagaggaggcccaggcagugcc

SEQ ID NO: 48649 - RNA, 32 nt, Human
agcaccacaguauaaaauacuacagcacucug

SEQ ID NO: 48650 - RNA, 32 nt, Human
agcaccaccaggucggaaggaggagacccacg

SEQ ID NO: 48651 - RNA, 21 nt, Human
agcaccaccccggccacggcg

SEQ ID NO: 48652 - RNA, 20 nt, Human
agcaccacggcagcaggagg

SEQ ID NO: 48653 - RNA, 25 nt, Human
agcaccacucugcugccccaccacg

SEQ ID NO: 48654 - RNA, 32 nt, Human
agcaccacugcacagagcuuugggaggcugca

SEQ ID NO: 48655 - RNA, 32 nt, Human
agcaccacugcacuaagccagugcggagcugu

SEQ ID NO: 48656 - RNA, 32 nt, Human
agcaccacugcacuccagccaggaaugaggca

SEQ ID NO: 48657 - RNA, 32 nt, Human
agcaccacugcacuccagccugggagacagag

SEQ ID NO: 48658 - RNA, 32 nt, Human
agcaccacugcacuccagccugggcaacagag

SEQ ID NO: 48659 - RNA, 32 nt, Human
agcaccacugcacuccagccugggugacagag

SEQ ID NO: 48660 - RNA, 32 nt, Human
agcaccacugcacuccaggcugggugacagag

SEQ ID NO: 48661 - RNA, 32 nt, Human
agcaccacugcacuucagccuggacaacagag

SEQ ID NO: 48662 - RNA, 32 nt, Human
agcaccacugcacuucuaguugacagagugag

SEQ ID NO: 48663 - RNA, 32 nt, Human
agcaccacugcacuuuagccugggcgacaaga

SEQ ID NO: 48664 - RNA, 32 nt, Human
agcaccacugcaguccagccugggcgacagag

SEQ ID NO: 48665 - RNA, 32 nt, Human
agcaccacugcaugcaagccugggcaauagag

SEQ ID NO: 48666 - RNA, 32 nt, Human
agcaccacugcgcuccagccugggugaggaga

SEQ ID NO: 48667 - RNA, 32 nt, Human
agcaccacuugagacugggggcagcauggagu

SEQ ID NO: 48668 - RNA, 32 nt, Human
agcaccagaguccccggaccugugucugcccu

SEQ ID NO: 48669 - RNA, 32 nt, Human
agcaccagcagcuccuggccuaccucaaaagc

SEQ ID NO: 48670 - RNA, 32 nt, Human
agcaccagcaucaguccugccucccaggaacc

SEQ ID NO: 48671 - RNA, 18 nt, Human
agcaccagccaggccacg

SEQ ID NO: 48672 - RNA, 32 nt, Human
agcaccagcucccuccugccugaagauguucc

SEQ ID NO: 48673 - RNA, 32 nt, Human
agcaccagcugaucugcagacuccaaggaggu

SEQ ID NO: 48674 - RNA, 32 nt, Human
agcaccaggacugcaagaggccauagagaaua

SEQ ID NO: 48675 - RNA, 32 nt, Human
agcaccaggaugcccauucgggugccugcuga

SEQ ID NO: 48676 - RNA, 32 nt, Human
agcaccaggcacagggauuuccuagccgagca

SEQ ID NO: 48677 - RNA, 32 nt, Human
agcaccaggcacgaacccaccugcugagagac

SEQ ID NO: 48678 - RNA, 32 nt, Human
agcaccaggccagggguugauuugaaacguga

SEQ ID NO: 48679 - RNA, 32 nt, Human
agcaccaggcccuuugccaucuguggagcaag

SEQ ID NO: 48680 - RNA, 32 nt, Human
agcaccaggcugggagaugaggugcacacagu

SEQ ID NO: 48681 - RNA, 32 nt, Human
agcaccagggcccugguggaggcugcuguggg

SEQ ID NO: 48682 - RNA, 19 nt, Human
agcaccaucccacgguggc

SEQ ID NO: 48683 - RNA, 32 nt, Human
agcaccaucccuggccuccucacauaggaauc

SEQ ID NO: 48684 - RNA, 31 nt, Human
agcaccaugccugcuugucgccuaggcccgc

SEQ ID NO: 48685 - RNA, 32 nt, Human
agcaccaugccuggcuaauuuuguauuuguag

SEQ ID NO: 48686 - RNA, 32 nt, Human
agcaccauggcaguaacccuauccuugggaau

SEQ ID NO: 48687 - RNA, 31 nt, Human
agcaccaugucccugcaguacggggcggagg

SEQ ID NO: 48688 - RNA, 32 nt, Human
agcaccauuagcccauuucccccaaauuaaac

SEQ ID NO: 48689 - RNA, 32 nt, Human
agcaccauugcaccccagccugagcaacaaga

SEQ ID NO: 48690 - RNA, 32 nt, Human
agcaccauugcacuccagccugggcgacucca

SEQ ID NO: 48691 - RNA, 32 nt, Human
agcacccaaaccgcaggcccugcucuggcagg

SEQ ID NO: 48692 - RNA, 32 nt, Human
agcacccaaccugacccccaucugccacaggg

SEQ ID NO: 48693 - RNA, 32 nt, Human
agcacccaagcuuggcugaguccuugggagcc

SEQ ID NO: 48694 - RNA, 24 nt, Human
agcacccacacccaccuccucucc

SEQ ID NO: 48695 - RNA, 32 nt, Human
agcacccacagcaccgcggcagcagcuagugc

SEQ ID NO: 48696 - RNA, 32 nt, Human
agcacccaccaucacuaccugcaccugcugug

SEQ ID NO: 48697 - RNA, 32 nt, Human
agcacccaccccuguguggcccccaggcccuc

SEQ ID NO: 48698 - RNA, 32 nt, Human
agcacccacccucucugugcucccgucugcac

SEQ ID NO: 48699 - RNA, 32 nt, Human
agcacccaccucccuacucucccucauggcgu

SEQ ID NO: 48700 - RNA, 32 nt, Human
agcacccacgugucaggcuuuguggugucugu

SEQ ID NO: 48701 - RNA, 32 nt, Human
agcacccagaacuccauaccaucggccgggug

SEQ ID NO: 48702 - RNA, 32 nt, Human
agcacccagagugagcuggaguggguccccau

SEQ ID NO: 48703 - RNA, 32 nt, Human
agcacccagaucaagaaauggaacauaaccag

SEQ ID NO: 48704 - RNA, 16 nt, Human
agcacccagcaugggc

SEQ ID NO: 48705 - RNA, 32 nt, Human
agcacccagccaggagaccugcagcccugcgc

SEQ ID NO: 48706 - RNA, 22 nt, Human
agcacccagcccaccccuuccu

SEQ ID NO: 48707 - RNA, 32 nt, Human
agcacccagcucauggcuuacauccccaugcc

SEQ ID NO: 48708 - RNA, 32 nt, Human
agcacccaggagaaacagggcaguggaccaau

SEQ ID NO: 48709 - RNA, 32 nt, Human
agcacccaggagaugcugagaagaucacccag

SEQ ID NO: 48710 - RNA, 32 nt, Human
agcacccaggagcggggaagcgaagugcgaga

SEQ ID NO: 48711 - RNA, 32 nt, Human
agcaccccaucaaaaguaguucaucaaauguc

SEQ ID NO: 48712 - RNA, 32 nt, Human
agcacccccaacagccagcacucuucuccuag

SEQ ID NO: 48713 - RNA, 32 nt, Human
agcacccccagccaggucagagucggcccgua

SEQ ID NO: 48714 - RNA, 32 nt, Human
agcacccccagccugccuuugccaccagcccc

SEQ ID NO: 48715 - RNA, 32 nt, Human
agcacccccuccggugugcacacaggccagug

SEQ ID NO: 48716 - RNA, 32 nt, Human
agcacccccucuccucuucaccucuuccugcu

SEQ ID NO: 48717 - RNA, 32 nt, Human
agcaccccuauucccaggagcuucuggccuga

SEQ ID NO: 48718 - RNA, 32 nt, Human
agcaccccugguacucagcacacacaugcuua

SEQ ID NO: 48719 - RNA, 32 nt, Human
agcaccccuugccucuguggcagcugcgagug

SEQ ID NO: 48720 - RNA, 32 nt, Human
agcacccgagcccuggaguggcccaguacccu

SEQ ID NO: 48721 - RNA, 32 nt, Human
agcacccgcucugauuccccacagccuuucuc

SEQ ID NO: 48722 - RNA, 32 nt, Human
agcacccgcugaacaucagccugggagacgcg

SEQ ID NO: 48723 - RNA, 32 nt, Human
agcacccucaggagaaguggcgccgcaggggu

SEQ ID NO: 48724 - RNA, 32 nt, Human
agcacccuccacuucucuccuaggcaaugaga

SEQ ID NO: 48725 - RNA, 32 nt, Human
agcacccuccagggcaguccugugacuguuuc

SEQ ID NO: 48726 - RNA, 19 nt, Human
agcacccucccagcaacca

SEQ ID NO: 48727 - RNA, 32 nt, Human
agcacccucccaggcgcuccuggagccagggu

SEQ ID NO: 48728 - RNA, 18 nt, Human
agcacccucccugcucuc

SEQ ID NO: 48729 - RNA, 32 nt, Human
agcacccucuaaguggaggacagaacauuguu

SEQ ID NO: 48730 - RNA, 32 nt, Human
agcacccucugcagccccacuccugggccuuc

SEQ ID NO: 48731 - RNA, 23 nt, Human
agcacccucuuaugucccauggc

SEQ ID NO: 48732 - RNA, 25 nt, Human
agcacccucuuguauuccuauggca

SEQ ID NO: 48733 - RNA, 21 nt, Human
agcacccugaaccccauggca

SEQ ID NO: 48734 - RNA, 32 nt, Human
agcacccugagcugcugagauggggcgggccg

SEQ ID NO: 48735 - RNA, 21 nt, Human
agcacccugccucaauggaga

SEQ ID NO: 48736 - RNA, 32 nt, Human
agcacccugggcgacagagugagacccugucu

SEQ ID NO: 48737 - RNA, 32 nt, Human
agcacccuggggaggagguguugcuguccagg

SEQ ID NO: 48738 - RNA, 32 nt, Human
agcacccuguaaggcaggagcaggcagcucag

SEQ ID NO: 48739 - RNA, 32 nt, Human
agcacccuuuacugcuguguauggggcuucac

SEQ ID NO: 48740 - RNA, 32 nt, Human
agcaccgacagaaacccacacaccugcaggga

SEQ ID NO: 48741 - RNA, 32 nt, Human
agcaccgagagccacuuccuggagcaugcucc

SEQ ID NO: 48742 - RNA, 32 nt, Human
agcaccgagaugggugaugugucccugcgucu

SEQ ID NO: 48743 - RNA, 32 nt, Human
agcaccgaugucccuuugauaaccugcacuca

SEQ ID NO: 48744 - RNA, 32 nt, Human
agcaccgcccacccugccccucagucaugcag

SEQ ID NO: 48745 - RNA, 32 nt, Human
agcaccgcguucccguccucuuccgcuuggcc

SEQ ID NO: 48746 - RNA, 32 nt, Human
agcaccgcugcacucgcggccggcgaugcggg

SEQ ID NO: 48747 - RNA, 32 nt, Human
agcaccgcugcccucaggcuugaggggugcuu

SEQ ID NO: 48748 - RNA, 32 nt, Human
agcaccggaaguccagggagggccaaguccac

SEQ ID NO: 48749 - RNA, 32 nt, Human
agcaccggaggaagaaagaggaggggcuggcu

SEQ ID NO: 48750 - RNA, 32 nt, Human
agcaccggcacuaagcucccaccgcucagcga

SEQ ID NO: 48751 - RNA, 32 nt, Human
agcaccggcuccaggccagcgugggccgcucu

SEQ ID NO: 48752 - RNA, 20 nt, Human
agcaccgggccgacggcggc

SEQ ID NO: 48753 - RNA, 21 nt, Human
agcaccgucugcuccuccuca

SEQ ID NO: 48754 - RNA, 32 nt, Human
agcaccgucugguucauugucuugaacucugc

SEQ ID NO: 48755 - RNA, 32 nt, Human
agcaccgugcagcuuuggccugggcacagacc

SEQ ID NO: 48756 - RNA, 32 nt, Human
agcaccuaaaacagugcuugacauauaccuaa

SEQ ID NO: 48757 - RNA, 18 nt, Human
agcaccuaaggggcacca

SEQ ID NO: 48758 - RNA, 32 nt, Human
agcaccuacugucugccaggccccagagcuca

SEQ ID NO: 48759 - RNA, 32 nt, Human
agcaccuagguugaagcaccugguuuauaggc

SEQ ID NO: 48760 - RNA, 32 nt, Human
agcaccucaccugagaccuccacuccacaucu

SEQ ID NO: 48761 - RNA, 32 nt, Human
agcaccucacugccguccuguuccuacucacc

SEQ ID NO: 48762 - RNA, 32 nt, Human
agcaccucagacagucaggcagugaugaacau

SEQ ID NO: 48763 - RNA, 22 nt, Human
agcaccucaugccuuccauuaa

SEQ ID NO: 48764 - RNA, 32 nt, Human
agcaccucaugggaucagaaaagagaaagaug

SEQ ID NO: 48765 - RNA, 32 nt, Human
agcaccuccccaagccgcuaccaccagcccuc

SEQ ID NO: 48766 - RNA, 32 nt, Human
agcaccuccugccucgaacuggcugcaaaggg

SEQ ID NO: 48767 - RNA, 32 nt, Human
agcaccuccuuugcuggucagacauggagccu

SEQ ID NO: 48768 - RNA, 32 nt, Human
agcaccucuccgcucacucucuuccuccugcu

SEQ ID NO: 48769 - RNA, 32 nt, Human
agcaccucugcagccucugcucugcugccuug

SEQ ID NO: 48770 - RNA, 32 nt, Human
agcaccucugcagccugcugggccucagguuc

SEQ ID NO: 48771 - RNA, 32 nt, Human
agcaccucuucaaccaccuccggcuuccagga

SEQ ID NO: 48772 - RNA, 32 nt, Human
agcaccucuugaaauccagauguucauauuag

SEQ ID NO: 48773 - RNA, 32 nt, Human
agcaccugagacugaagcuccucccaagacag

SEQ ID NO: 48774 - RNA, 32 nt, Human
agcaccugcaggaaggggcggcuguaggcgca

SEQ ID NO: 48775 - RNA, 32 nt, Human
agcaccugcaugcucagacuucuuguggcgcc

SEQ ID NO: 48776 - RNA, 32 nt, Human
agcaccugcccaggguaggccuggcaugaggg

SEQ ID NO: 48777 - RNA, 32 nt, Human
agcaccugccccaccugcccacagagaacaca

SEQ ID NO: 48778 - RNA, 32 nt, Human
agcaccugcccuucucacccauggcccaccca

SEQ ID NO: 48779 - RNA, 32 nt, Human
agcaccugccggcagaguuccccagccuggag

SEQ ID NO: 48780 - RNA, 32 nt, Human
agcaccugccuccccgacccucgcuggggcgg

SEQ ID NO: 48781 - RNA, 32 nt, Human
agcaccuggagccucuggaggaagaggaggga

SEQ ID NO: 48782 - RNA, 19 nt, Human
agcaccuggaggggcacca

SEQ ID NO: 48783 - RNA, 32 nt, Human
agcaccuggccccaggacugagguccugagaa

SEQ ID NO: 48784 - RNA, 32 nt, Human
agcaccugggagggcagggaggcuuuggugac

SEQ ID NO: 48785 - RNA, 32 nt, Human
agcaccugggccagcggcugagcuguacauac

SEQ ID NO: 48786 - RNA, 32 nt, Human
agcaccugggcuccugccaguuucaugugugc

SEQ ID NO: 48787 - RNA, 32 nt, Human
agcaccuggggaggggcaguggcgggcuccag

SEQ ID NO: 48788 - RNA, 32 nt, Human
agcaccuguaaucccagcuacucgggaggcug

SEQ ID NO: 48789 - RNA, 32 nt, Human
agcaccuguaaucccagcuacucgggagggug

SEQ ID NO: 48790 - RNA, 32 nt, Human
agcaccuguaaucccagcuacucuggaggcug

SEQ ID NO: 48791 - RNA, 32 nt, Human
agcaccuguagucccagcuacucgggaggcug

SEQ ID NO: 48792 - RNA, 32 nt, Human
agcaccugugacuccaguaccuacuacugguu

SEQ ID NO: 48793 - RNA, 32 nt, Human
agcaccuuaagccaccacccucagccacaauu

SEQ ID NO: 48794 - RNA, 32 nt, Human
agcaccuuaguguugcucugccucagccagcu

SEQ ID NO: 48795 - RNA, 32 nt, Human
agcaccuuccaaggagccaacuuuuauucccu

SEQ ID NO: 48796 - RNA, 32 nt, Human
agcaccuuccccuggagcccucagggagcgcg

SEQ ID NO: 48797 - RNA, 31 nt, Human
agcaccuuccuacagagaugacuuuaaaagg

SEQ ID NO: 48798 - RNA, 32 nt, Human
agcaccuuccucuccagccagaggcugaccug

SEQ ID NO: 48799 - RNA, 21 nt, Human
agcaccuuccucucccaggca

SEQ ID NO: 48800 - RNA, 32 nt, Human
agcaccuucguuucuccucuagaccagggaca

SEQ ID NO: 48801 - RNA, 32 nt, Human
agcaccuucugucucgcugucucccucugugc

SEQ ID NO: 48802 - RNA, 32 nt, Human
agcaccuugcagagguuaaagccagcgggucc

SEQ ID NO: 48803 - RNA, 32 nt, Human
agcaccuugccuggccccuccccaggcucccu

SEQ ID NO: 48804 - RNA, 32 nt, Human
agcaccuuguuuccucagcacuuuaucucuau

SEQ ID NO: 48805 - RNA, 32 nt, Human
agcaccuuucauucaggcaugaugccaggugc

SEQ ID NO: 48806 - RNA, 32 nt, Human
agcaccuuucuacagacuggacugcccagcuc

SEQ ID NO: 48807 - RNA, 32 nt, Human
agcaccuuucuccccuccccucuuuccucacc

SEQ ID NO: 48808 - RNA, 32 nt, Human
agcacgaagucacaucccagccccagagucac

SEQ ID NO: 48809 - RNA, 32 nt, Human
agcacgaaguuucuagugccacacacaguauu

SEQ ID NO: 48810 - RNA, 32 nt, Human
agcacgaaucacugcacccagccuauggaaca

SEQ ID NO: 48811 - RNA, 32 nt, Human
agcacgacucagcguggcaggcuguagcuuuc

SEQ ID NO: 48812 - RNA, 32 nt, Human
agcacgauggagauuuggacacugugugcuuu

SEQ ID NO: 48813 - RNA, 32 nt, Human
agcacgcacgcuccgaaugacuccuggugcua

SEQ ID NO: 48814 - RNA, 24 nt, Human
agcacgcacgugugugagcacgca

SEQ ID NO: 48815 - RNA, 32 nt, Human
agcacgcaugcaucacaugcauugucaucagu

SEQ ID NO: 48816 - RNA, 32 nt, Human
agcacgccacugcacuccagccugggugacag

SEQ ID NO: 48817 - RNA, 32 nt, Human
agcacgcccuaguggaccugcgccuggauuau

SEQ ID NO: 48818 - RNA, 32 nt, Human
agcacgccguccagauccccaggauaagagac

SEQ ID NO: 48819 - RNA, 32 nt, Human
agcacgccugugcucugugcuugccucaccag

SEQ ID NO: 48820 - RNA, 32 nt, Human
agcacgcuaugacauccaugugcgcguggcag

SEQ ID NO: 48821 - RNA, 32 nt, Human
agcacgcuccaucccucaugcucagcugccuc

SEQ ID NO: 48822 - RNA, 32 nt, Human
agcacggaagaugcccacgugccugagccacc

SEQ ID NO: 48823 - RNA, 32 nt, Human
agcacggagcggaagggagagcaggggagaga

SEQ ID NO: 48824 - RNA, 32 nt, Human
agcacggagcgggagagcguggcgagagaaug

SEQ ID NO: 48825 - RNA, 32 nt, Human
agcacggcacuucagccuaggugacagaguga

SEQ ID NO: 48826 - RNA, 18 nt, Human
agcacggcccgcgggcgg

SEQ ID NO: 48827 - RNA, 19 nt, Human
agcacggcuccccauggcc

SEQ ID NO: 48828 - RNA, 32 nt, Human
agcacggcucuguccccagccugggaaagccc

SEQ ID NO: 48829 - RNA, 32 nt, Human
agcacgggcaggcaugggguccccugggugga

SEQ ID NO: 48830 - RNA, 32 nt, Human
agcacgggcaugccuuggaauauugccaagcu

SEQ ID NO: 48831 - RNA, 32 nt, Human
agcacgggccauaugaauaacauggugugcuu

SEQ ID NO: 48832 - RNA, 32 nt, Human
agcacgggcucccucucgcguggccucgccgg

SEQ ID NO: 48833 - RNA, 32 nt, Human
agcacggggaggcggcggcggcggcggcggcc

SEQ ID NO: 48834 - RNA, 32 nt, Human
agcacggggcccaggcuagagugcaguggcgu

SEQ ID NO: 48835 - RNA, 32 nt, Human
agcacgggugacuucuuuuucucuucauuagc

SEQ ID NO: 48836 - RNA, 32 nt, Human
agcacgggugaggugccucccuucucugggca

SEQ ID NO: 48837 - RNA, 32 nt, Human
agcacguaguuuauguuccugaggcagcacuu

SEQ ID NO: 48838 - RNA, 32 nt, Human
agcacguauuucuccccucuaguaccucugca

SEQ ID NO: 48839 - RNA, 19 nt, Human
agcacguccccugcaccac

SEQ ID NO: 48840 - RNA, 22 nt, Human
agcacguccccugcaccacggc

SEQ ID NO: 48841 - RNA, 32 nt, Human
agcacgugagcaucuguccuuucuacccguuc

SEQ ID NO: 48842 - RNA, 32 nt, Human
agcacgugcacaaauucaugugccgugccuua

SEQ ID NO: 48843 - RNA, 32 nt, Human
agcacgugcaccaaggaguggagggagggccc

SEQ ID NO: 48844 - RNA, 32 nt, Human
agcacgugccuguagucccagcuacucgggag

SEQ ID NO: 48845 - RNA, 27 nt, Human
agcacguuggcgaggaaaaacaaaaca

SEQ ID NO: 48846 - RNA, 32 nt, Human
agcacuaaaggaagcaucacagcaacuggcug

SEQ ID NO: 48847 - RNA, 27 nt, Human
agcacuaaaugcuuuggugguguuugc

SEQ ID NO: 48848 - RNA, 32 nt, Human
agcacuaagggagccagcgcacagcacagcca

SEQ ID NO: 48849 - RNA, 32 nt, Human
agcacuaaucuacugccagcugucccacccua

SEQ ID NO: 48850 - RNA, 24 nt, Human
agcacuacagaaacccugguucuu

SEQ ID NO: 48851 - RNA, 25 nt, Human
agcacuacauucuguaaccuuguuu

SEQ ID NO: 48852 - RNA, 21 nt, Human
agcacuacauucuuuuaucuu

SEQ ID NO: 48853 - RNA, 32 nt, Human
agcacuacccauacuggauggagcuaccaaga

SEQ ID NO: 48854 - RNA, 32 nt, Human
agcacuacccuccucucuccccagaugugacu

SEQ ID NO: 48855 - RNA, 32 nt, Human
agcacuacugcacuuaguagcuaugugauuuu

SEQ ID NO: 48856 - RNA, 17 nt, Human
agcacuacugcuggcca

SEQ ID NO: 48857 - RNA, 32 nt, Human
agcacuacuguggcugaaaaacuucucuucaa

SEQ ID NO: 48858 - RNA, 16 nt, Human
agcacuagaugcagca

SEQ ID NO: 48859 - RNA, 23 nt, Human
agcacuagcaacauuuggcuaua

SEQ ID NO: 48860 - RNA, 32 nt, Human
agcacuagccagccaggaauugcccaucccag

SEQ ID NO: 48861 - RNA, 32 nt, Human
agcacuaggauuacaggugugagccaccaugc

SEQ ID NO: 48862 - RNA, 32 nt, Human
agcacuaucacugcaaccuccgccuccugggu

SEQ ID NO: 48863 - RNA, 32 nt, Human
agcacuauccucaucucuccccagaugugacu

SEQ ID NO: 48864 - RNA, 32 nt, Human
agcacuaugcaagcccaggcccucugcugagc

SEQ ID NO: 48865 - RNA, 32 nt, Human
agcacuauuaucaguucugccuagguaaaugu

SEQ ID NO: 48866 - RNA, 32 nt, Human
agcacucacccucucugugcucccgucugcac

SEQ ID NO: 48867 - RNA, 32 nt, Human
agcacucacucuugaaggcacacacauacaca

SEQ ID NO: 48868 - RNA, 22 nt, Human
agcacucacuggagacccuugg

SEQ ID NO: 48869 - RNA, 32 nt, Human
agcacucagcucagccuccuguccccaugagc

SEQ ID NO: 48870 - RNA, 32 nt, Human
agcacucagcugugucagauuugauuaauauu

SEQ ID NO: 48871 - RNA, 32 nt, Human
agcacucaggagaggggagaaaggaggugcac

SEQ ID NO: 48872 - RNA, 32 nt, Human
agcacucauccagaaggcccugaggaagaaga

SEQ ID NO: 48873 - RNA, 32 nt, Human
agcacuccagaaaucucucugccaucauuacc

SEQ ID NO: 48874 - RNA, 32 nt, Human
agcacuccagccugggcgacagagugagacuc

SEQ ID NO: 48875 - RNA, 32 nt, Human
agcacucccaggagaaccagcaucuucaugug

SEQ ID NO: 48876 - RNA, 32 nt, Human
agcacucccucagagacccaaacagugggggc

SEQ ID NO: 48877 - RNA, 32 nt, Human
agcacucccuuuccucuagaucggccugaggc

SEQ ID NO: 48878 - RNA, 32 nt, Human
agcacuccgaggaauggccaagcccucaucgc

SEQ ID NO: 48879 - RNA, 32 nt, Human
agcacuccuccuuccugaccuccaggcuucca

SEQ ID NO: 48880 - RNA, 32 nt, Human
agcacuccucuguagagaggugggauccuugu

SEQ ID NO: 48881 - RNA, 32 nt, Human
agcacuccuggagcuugccaccagcuuggacu

SEQ ID NO: 48882 - RNA, 32 nt, Human
agcacuccugggcacucuggaagcaggcuguu

SEQ ID NO: 48883 - RNA, 32 nt, Human
agcacuccuuuccccugcuguccccuucgacc

SEQ ID NO: 48884 - RNA, 32 nt, Human
agcacucggggucccuggagggcaagcccugc

SEQ ID NO: 48885 - RNA, 32 nt, Human
agcacucgugggagccacagggcaggggcagc

SEQ ID NO: 48886 - RNA, 32 nt, Human
agcacucucagccuccccgccuucagcuguca

SEQ ID NO: 48887 - RNA, 32 nt, Human
agcacucugaaugcuccagucacaccuuauag

SEQ ID NO: 48888 - RNA, 32 nt, Human
agcacucugcaugacuuuaauucuugggacaa

SEQ ID NO: 48889 - RNA, 32 nt, Human
agcacucugccgcucaagagcugguuuguuaa

SEQ ID NO: 48890 - RNA, 32 nt, Human
agcacucuuucugcaagugucuugcucacagu

SEQ ID NO: 48891 - RNA, 32 nt, Human
agcacugaaaaccucuccaccugggccagggu

SEQ ID NO: 48892 - RNA, 32 nt, Human
agcacugacccaaggaguucuguuaugguacu

SEQ ID NO: 48893 - RNA, 32 nt, Human
agcacugaccccagcaaccucuuucucuugcc

SEQ ID NO: 48894 - RNA, 32 nt, Human
agcacugacucagagguucaggcuuuuuccaa

SEQ ID NO: 48895 - RNA, 32 nt, Human
agcacugagccagcaggaaggaucucacaggu

SEQ ID NO: 48896 - RNA, 32 nt, Human
agcacugagcuggcugucugucauucgaauga

SEQ ID NO: 48897 - RNA, 32 nt, Human
agcacugagcugugugcacugugccagggaca

SEQ ID NO: 48898 - RNA, 32 nt, Human
agcacugagguuuccugauuccuggguggagc

SEQ ID NO: 48899 - RNA, 32 nt, Human
agcacugagucucugggauucuggcaagguac

SEQ ID NO: 48900 - RNA, 32 nt, Human
agcacugaucuagggcaggagucagcagucug

SEQ ID NO: 48901 - RNA, 32 nt, Human
agcacugaugggacacagcagguggcaacggg

SEQ ID NO: 48902 - RNA, 32 nt, Human
agcacugaugggggcccucugcaccaaccaga

SEQ ID NO: 48903 - RNA, 32 nt, Human
agcacugauuuuagcucugagaacaaacaaau

SEQ ID NO: 48904 - RNA, 32 nt, Human
agcacugcaaucaauaccucacaaagcgacuc

SEQ ID NO: 48905 - RNA, 32 nt, Human
agcacugcacugacgguuuggagaccugagcc

SEQ ID NO: 48906 - RNA, 32 nt, Human
agcacugcagccacaagccauggcagucgugg

SEQ ID NO: 48907 - RNA, 32 nt, Human
agcacugcagccucaaccuccugggcucaagc

SEQ ID NO: 48908 - RNA, 19 nt, Human
agcacugcagcgagcagca

SEQ ID NO: 48909 - RNA, 32 nt, Human
agcacugccacccuggccauugcuguggugcc

SEQ ID NO: 48910 - RNA, 20 nt, Human
agcacugccagcaccagcgg

SEQ ID NO: 48911 - RNA, 21 nt, Human
agcacugccagccuccucucc

SEQ ID NO: 48912 - RNA, 32 nt, Human
agcacugccaguuaaagagcauuagaagaggu

SEQ ID NO: 48913 - RNA, 17 nt, Human
agcacugccauuggcca

SEQ ID NO: 48914 - RNA, 32 nt, Human
agcacugcccuauuagcaauguuaacaaaaau

SEQ ID NO: 48915 - RNA, 32 nt, Human
agcacugccuuugccagcauccuaaaucugga

SEQ ID NO: 48916 - RNA, 32 nt, Human
agcacugcucuuccccuccuauaaucauaaua

SEQ ID NO: 48917 - RNA, 32 nt, Human
agcacugcugggugguggaggugggcaguggc

SEQ ID NO: 48918 - RNA, 32 nt, Human
agcacugcuguuccauggcugugugacuuucg

SEQ ID NO: 48919 - RNA, 32 nt, Human
agcacugcuguugggaaggugacugcaggaaa

SEQ ID NO: 48920 - RNA, 32 nt, Human
agcacugcuuccucccuucuucaacggcaucu

SEQ ID NO: 48921 - RNA, 32 nt, Human
agcacugcuucuugguccuuguuuucuuuugc

SEQ ID NO: 48922 - RNA, 32 nt, Human
agcacugcuuugccaagguuggaacauuggcu

SEQ ID NO: 48923 - RNA, 32 nt, Human
agcacuggaauuucacacuuuaaugauaauau

SEQ ID NO: 48924 - RNA, 32 nt, Human
agcacuggaggaagagcgccugugcugugguc

SEQ ID NO: 48925 - RNA, 32 nt, Human
agcacuggagggcagaggccucaguguccagc

SEQ ID NO: 48926 - RNA, 32 nt, Human
agcacuggagguggaaggggucaugggggucu

SEQ ID NO: 48927 - RNA, 32 nt, Human
agcacuggagugcagggaggagaggggaaggg

SEQ ID NO: 48928 - RNA, 32 nt, Human
agcacuggauuccucaguccaccagcucagac

SEQ ID NO: 48929 - RNA, 32 nt, Human
agcacuggcccagggaugcuagcaaagcccag

SEQ ID NO: 48930 - RNA, 32 nt, Human
agcacuggcccccucuccccagccucagcugc

SEQ ID NO: 48931 - RNA, 32 nt, Human
agcacuggccccuuggugcacacacauucccu

SEQ ID NO: 48932 - RNA, 32 nt, Human
agcacuggccuccccuggcuccugccuggaag

SEQ ID NO: 48933 - RNA, 32 nt, Human
agcacuggccucugccccuccuccuuccagca

SEQ ID NO: 48934 - RNA, 32 nt, Human
agcacugggaggaaaagcugaguuaagaaaau

SEQ ID NO: 48935 - RNA, 32 nt, Human
agcacugggauuacaagcaugagccacugugc

SEQ ID NO: 48936 - RNA, 32 nt, Human
agcacugggauuacaggcaugagccaccaugc

SEQ ID NO: 48937 - RNA, 32 nt, Human
agcacugggauuacaggcaugagccaccgcgc

SEQ ID NO: 48938 - RNA, 32 nt, Human
agcacugggauuacaggcgugagccaccacau

SEQ ID NO: 48939 - RNA, 32 nt, Human
agcacugggauuacaggcgugagccacccggc

SEQ ID NO: 48940 - RNA, 32 nt, Human
agcacugggauuacaggcgugagccaccgcgc

SEQ ID NO: 48941 - RNA, 32 nt, Human
agcacugggauuacaggcuugaggcacugcac

SEQ ID NO: 48942 - RNA, 32 nt, Human
agcacugggauuacaggugugaaccaccguac

SEQ ID NO: 48943 - RNA, 32 nt, Human
agcacugggauuacaggugugagccaccgcgc

SEQ ID NO: 48944 - RNA, 32 nt, Human
agcacugggcaggcacagagcaggggcugccc

SEQ ID NO: 48945 - RNA, 32 nt, Human
agcacugggcuucugcuuucugcucuggccca

SEQ ID NO: 48946 - RNA, 32 nt, Human
agcacuggggugggggagcaggagaaagccag

SEQ ID NO: 48947 - RNA, 32 nt, Human
agcacugucacugcaaguccagcccccuuugc

SEQ ID NO: 48948 - RNA, 32 nt, Human
agcacugucagagaaugaccacugcagccagc

SEQ ID NO: 48949 - RNA, 32 nt, Human
agcacugucaugagccucacuaagcuauuuug

SEQ ID NO: 48950 - RNA, 32 nt, Human
agcacugucaugccugcuugggugauagauaa

SEQ ID NO: 48951 - RNA, 32 nt, Human
agcacuguccccuggcaguaccacagccuuau

SEQ ID NO: 48952 - RNA, 32 nt, Human
agcacugucucaggcuggaggucagcgaaccu

SEQ ID NO: 48953 - RNA, 16 nt, Human
agcacugucugagcug

SEQ ID NO: 48954 - RNA, 32 nt, Human
agcacugucugcacuuucuuguuuacuguuug

SEQ ID NO: 48955 - RNA, 32 nt, Human
agcacugugaaaccaacauuucuucagugaaa

SEQ ID NO: 48956 - RNA, 32 nt, Human
agcacugugacuccagcccuggcucggagcac

SEQ ID NO: 48957 - RNA, 32 nt, Human
agcacugugagguuucagggauuggcagaggg

SEQ ID NO: 48958 - RNA, 32 nt, Human
agcacugugcuccggcaaggcuugccuuagga

SEQ ID NO: 48959 - RNA, 32 nt, Human
agcacugugggcaugguguuucccucucuggg

SEQ ID NO: 48960 - RNA, 32 nt, Human
agcacugugguuuuccuuuugcacuugaagga

SEQ ID NO: 48961 - RNA, 31 nt, Human
agcacuguuggggcucccauggcagggagaa

SEQ ID NO: 48962 - RNA, 32 nt, Human
agcacuuaaccagccacccagaguucccucac

SEQ ID NO: 48963 - RNA, 32 nt, Human
agcacuuacccuccacuuccuccuccuguuug

SEQ ID NO: 48964 - RNA, 32 nt, Human
agcacuuacuucuaccauucagagaugagcac

SEQ ID NO: 48965 - RNA, 32 nt, Human
agcacuuagggaggccgaggcagguggaucac

SEQ ID NO: 48966 - RNA, 32 nt, Human
agcacuuagggaggcuggggcgggcgaaucgc

SEQ ID NO: 48967 - RNA, 32 nt, Human
agcacuuagggaggucaacguaggaggaucac

SEQ ID NO: 48968 - RNA, 32 nt, Human
agcacuucacccagagccuggcacacaguagg

SEQ ID NO: 48969 - RNA, 32 nt, Human
agcacuucaggauaugcuguuuugcugugugc

SEQ ID NO: 48970 - RNA, 32 nt, Human
agcacuucauggagucuuguuuugaagaugac

SEQ ID NO: 48971 - RNA, 32 nt, Human
agcacuuccaaacccaaaggcucuuuucagag

SEQ ID NO: 48972 - RNA, 32 nt, Human
agcacuuccaagggaguggcuuuucuugaaaa

SEQ ID NO: 48973 - RNA, 32 nt, Human
agcacuucccgcugcugccugccugugauguc

SEQ ID NO: 48974 - RNA, 32 nt, Human
agcacuucccuugccaggcacucacccauccu

SEQ ID NO: 48975 - RNA, 32 nt, Human
agcacuuccuacgcugcaaagcagcaaagaaa

SEQ ID NO: 48976 - RNA, 32 nt, Human
agcacuuccucgaugugccugcccugaaggag

SEQ ID NO: 48977 - RNA, 32 nt, Human
agcacuucgaggaggaggaggaggccggggug

SEQ ID NO: 48978 - RNA, 32 nt, Human
agcacuucuacacaccuccucacugacacccc

SEQ ID NO: 48979 - RNA, 32 nt, Human
agcacuucugcucuccucuaccagaaucacuc

SEQ ID NO: 48980 - RNA, 32 nt, Human
agcacuucuguaaccuucagcauuucuuacag

SEQ ID NO: 48981 - RNA, 32 nt, Human
agcacuucuguaaccuucagcauuucuuugaa

SEQ ID NO: 48982 - RNA, 32 nt, Human
agcacuugaaaggaaacaaaacucccuuucac

SEQ ID NO: 48983 - RNA, 32 nt, Human
agcacuugaacccaggaggcagugguugcaau

SEQ ID NO: 48984 - RNA, 32 nt, Human
agcacuugaacccgggagguggagguugcagu

SEQ ID NO: 48985 - RNA, 32 nt, Human
agcacuugaaucugggaucucgccuuauucuc

SEQ ID NO: 48986 - RNA, 32 nt, Human
agcacuugagccuaggagguuaaggcuauagu

SEQ ID NO: 48987 - RNA, 32 nt, Human
agcacuugagucgacuggaggcugccaggaau

SEQ ID NO: 48988 - RNA, 32 nt, Human
agcacuugccggcauuuggccugcugcuggug

SEQ ID NO: 48989 - RNA, 32 nt, Human
agcacuugccuguagucccaacuacuugggag

SEQ ID NO: 48990 - RNA, 32 nt, Human
agcacuuggggaggacaaugugggguggauca

SEQ ID NO: 48991 - RNA, 32 nt, Human
agcacuuguauuuuccagccuaggcuuugugu

SEQ ID NO: 48992 - RNA, 32 nt, Human
agcacuugucuuucuccugccucagcagcacg

SEQ ID NO: 48993 - RNA, 32 nt, Human
agcacuuguuuuguucauuuguggacuuggca

SEQ ID NO: 48994 - RNA, 32 nt, Human
agcacuuuaaaaggcugaggcaggcaguucac

SEQ ID NO: 48995 - RNA, 32 nt, Human
agcacuuuaggagccccagacaggaggaucac

SEQ ID NO: 48996 - RNA, 32 nt, Human
agcacuuuccaucgaggacuuggguggcagag

SEQ ID NO: 48997 - RNA, 20 nt, Human
agcacuuucugccuuguccu

SEQ ID NO: 48998 - RNA, 32 nt, Human
agcacuuugagaggccaagacaggcagaucac

SEQ ID NO: 48999 - RNA, 32 nt, Human
agcacuuugaugcucauauuaccccaaaucac

SEQ ID NO: 49000 - RNA, 32 nt, Human
agcacuuugggaggcaggggcggguggaucac

SEQ ID NO: 49001 - RNA, 32 nt, Human
agcacuuugggaggccgaggugaguggaucac

SEQ ID NO: 49002 - RNA, 32 nt, Human
agcacuuugggaggccggugggcagaucauga

SEQ ID NO: 49003 - RNA, 32 nt, Human
agcacuuugggaggccuaggcaaguggaucac

SEQ ID NO: 49004 - RNA, 32 nt, Human
agcacuuugggaggccuaggcagguggaucac

SEQ ID NO: 49005 - RNA, 32 nt, Human
agcacuuugggaggcggguggaucaccuaagg

SEQ ID NO: 49006 - RNA, 32 nt, Human
agcacuuugggagguugaggcaggcgugucac

SEQ ID NO: 49007 - RNA, 32 nt, Human
agcacuuuuaaagagcauuuagguaauaccag

SEQ ID NO: 49008 - RNA, 32 nt, Human
agcacuuuuaugagagacauuuuccaugacua

SEQ ID NO: 49009 - RNA, 32 nt, Human
agcacuuuugggaggcagagaugggaggauac

SEQ ID NO: 49010 - RNA, 32 nt, Human
agcacuuuugggaggccaagacaggaggauca

SEQ ID NO: 49011 - RNA, 32 nt, Human
agcacuuuugggaggcugagguugggaguuca

SEQ ID NO: 49012 - RNA, 21 nt, Human
agcacuuuuuacauuugcgaa

SEQ ID NO: 49013 - RNA, 32 nt, Human
agcagaaaaaggcugugcugcccugaagaaug

SEQ ID NO: 49014 - RNA, 20 nt, Human
agcagaaaacauucaaugca

SEQ ID NO: 49015 - RNA, 32 nt, Human
agcagaaaaguggaccuugggggcugguucug

SEQ ID NO: 49016 - RNA, 32 nt, Human
agcagaaaauaacauacccuguauucaaaauu

SEQ ID NO: 49017 - RNA, 23 nt, Human
agcagaaacaauagccaaugcag

SEQ ID NO: 49018 - RNA, 32 nt, Human
agcagaaaccgaaauggcuuucugguguucuc

SEQ ID NO: 49019 - RNA, 32 nt, Human
agcagaaacugaaugacugcucagggaggugu

SEQ ID NO: 49020 - RNA, 32 nt, Human
agcagaaacuucuuuucauucuuccaaagcau

SEQ ID NO: 49021 - RNA, 32 nt, Human
agcagaaagacccugaaggcaggcugcaaaug

SEQ ID NO: 49022 - RNA, 32 nt, Human
agcagaaaggccauugacgcugccacucaaac

SEQ ID NO: 49023 - RNA, 32 nt, Human
agcagaaagggcugcggaggcagugagugguu

SEQ ID NO: 49024 - RNA, 20 nt, Human
agcagaaaguucaacuucca

SEQ ID NO: 49025 - RNA, 32 nt, Human
agcagaaauaggguuuucucaucuucaccauc

SEQ ID NO: 49026 - RNA, 32 nt, Human
agcagaaauccaagcaccaccaaacacagugu

SEQ ID NO: 49027 - RNA, 32 nt, Human
agcagaaauggcuccaaaauggcagcucauca

SEQ ID NO: 49028 - RNA, 32 nt, Human
agcagaaauguccuucugaguacuggccucau

SEQ ID NO: 49029 - RNA, 32 nt, Human
agcagaaauguuccugcacuagacaauuaaag

SEQ ID NO: 49030 - RNA, 32 nt, Human
agcagaaauuagucuagcucccaaucaguggg

SEQ ID NO: 49031 - RNA, 32 nt, Human
agcagaacagaauccuuuuccucuuuuccuuc

SEQ ID NO: 49032 - RNA, 32 nt, Human
agcagaaccagcucccccaacuccagcagagc

SEQ ID NO: 49033 - RNA, 32 nt, Human
agcagaaccauaggccuuuccuuuguuuuggg

SEQ ID NO: 49034 - RNA, 32 nt, Human
agcagaacccagacccugaguccuugggccag

SEQ ID NO: 49035 - RNA, 32 nt, Human
agcagaaccucacaucuuccccaaaccugaua

SEQ ID NO: 49036 - RNA, 21 nt, Human
agcagaaccuccacucccucc

SEQ ID NO: 49037 - RNA, 32 nt, Human
agcagaaccugaggagaaaagcagguggaagg

SEQ ID NO: 49038 - RNA, 32 nt, Human
agcagaacuacaaagaugagaaauuaccagaa

SEQ ID NO: 49039 - RNA, 32 nt, Human
agcagaacucuguucccaggcaccacaagaau

SEQ ID NO: 49040 - RNA, 21 nt, Human
agcagaacugcccucagggug

SEQ ID NO: 49041 - RNA, 32 nt, Human
agcagaagaaucugugaaagaauaugaaauga

SEQ ID NO: 49042 - RNA, 32 nt, Human
agcagaagagaucuacccaucucaccugcucu

SEQ ID NO: 49043 - RNA, 32 nt, Human
agcagaagagccuccuucagcagcuacugacu

SEQ ID NO: 49044 - RNA, 32 nt, Human
agcagaagagggaggcuuccugacugacacag

SEQ ID NO: 49045 - RNA, 32 nt, Human
agcagaagcagcugagugucuccugauacccg

SEQ ID NO: 49046 - RNA, 32 nt, Human
agcagaaggaagaagaugcgcugagaguccuc

SEQ ID NO: 49047 - RNA, 32 nt, Human
agcagaagggagagagggagggcgcaagggga

SEQ ID NO: 49048 - RNA, 32 nt, Human
agcagaaggugaagcaggaagcacuugguuuu

SEQ ID NO: 49049 - RNA, 20 nt, Human
agcagaaggugucugggcca

SEQ ID NO: 49050 - RNA, 32 nt, Human
agcagaagucacgcuccccaucccccagggga

SEQ ID NO: 49051 - RNA, 32 nt, Human
agcagaauauuugcaacauuuguuuuguauag

SEQ ID NO: 49052 - RNA, 32 nt, Human
agcagaaucaaaggagggagcccugcagggca

SEQ ID NO: 49053 - RNA, 32 nt, Human
agcagaaucauagcucugaaaagagaagcucc

SEQ ID NO: 49054 - RNA, 25 nt, Human
agcagaaucccccacucccacccca

SEQ ID NO: 49055 - RNA, 23 nt, Human
agcagaaucguaagagcuuugaa

SEQ ID NO: 49056 - RNA, 32 nt, Human
agcagaaugcuauaauaugcuaugaugacugg

SEQ ID NO: 49057 - RNA, 32 nt, Human
agcagaauguacuugauauuauuucagggucc

SEQ ID NO: 49058 - RNA, 32 nt, Human
agcagaaugugcuucucucuggcagcuggccu

SEQ ID NO: 49059 - RNA, 32 nt, Human
agcagaauuucucagcauuccagagagagauu

SEQ ID NO: 49060 - RNA, 32 nt, Human
agcagacaaagaggcccugcuccagggcgcac

SEQ ID NO: 49061 - RNA, 32 nt, Human
agcagacaaagucaauaaaagagcugucugac

SEQ ID NO: 49062 - RNA, 32 nt, Human
agcagacaagaaagggcaugcaaggccuucuc

SEQ ID NO: 49063 - RNA, 32 nt, Human
agcagacaagguugagaauccauugcuggaau

SEQ ID NO: 49064 - RNA, 24 nt, Human
agcagacaaucacagugcccauca

SEQ ID NO: 49065 - RNA, 32 nt, Human
agcagacaauccaggcugaugcuuuugcugag

SEQ ID NO: 49066 - RNA, 32 nt, Human
agcagacacagcccuuccaggaccagaggcca

SEQ ID NO: 49067 - RNA, 32 nt, Human
agcagacacugcaacagaugccuccuagaaaa

SEQ ID NO: 49068 - RNA, 32 nt, Human
agcagacagaagcagaacagagcccggggcuc

SEQ ID NO: 49069 - RNA, 32 nt, Human
agcagacagagagaggagguugucugggacag

SEQ ID NO: 49070 - RNA, 32 nt, Human
agcagacagcaucuacuccuuauuuauaguaa

SEQ ID NO: 49071 - RNA, 32 nt, Human
agcagacagccaggccaggguaggcagugccu

SEQ ID NO: 49072 - RNA, 32 nt, Human
agcagacaggcagggcuugcuguguugcucug

SEQ ID NO: 49073 - RNA, 32 nt, Human
agcagacagggccaagaaucuccaugcugucu

SEQ ID NO: 49074 - RNA, 32 nt, Human
agcagacauugguuuacucugcagccuguguu

SEQ ID NO: 49075 - RNA, 32 nt, Human
agcagaccagaugcccagcaacuccuaggcuc

SEQ ID NO: 49076 - RNA, 32 nt, Human
agcagaccagccuggccaaugccuaugggugg

SEQ ID NO: 49077 - RNA, 32 nt, Human
agcagacccugggccuuucucuagacugagca

SEQ ID NO: 49078 - RNA, 32 nt, Human
agcagaccuaccacucuccaggcagauagugc

SEQ ID NO: 49079 - RNA, 32 nt, Human
agcagaccugaaaaguccaugaccugagcuuu

SEQ ID NO: 49080 - RNA, 32 nt, Human
agcagaccuggguguggugcugccuggcacug

SEQ ID NO: 49081 - RNA, 32 nt, Human
agcagaccuguugccacggugacugaagcccc

SEQ ID NO: 49082 - RNA, 32 nt, Human
agcagaccuugccugccuacugcccaggccug

SEQ ID NO: 49083 - RNA, 32 nt, Human
agcagacggcucggagcaacauggacaacaug

SEQ ID NO: 49084 - RNA, 32 nt, Human
agcagacuccagccccuggaccccuggggugg

SEQ ID NO: 49085 - RNA, 32 nt, Human
agcagacugggagccacuugaggcuaucauuu

SEQ ID NO: 49086 - RNA, 32 nt, Human
agcagacugugcaugcuccuguccccacucac

SEQ ID NO: 49087 - RNA, 32 nt, Human
agcagacuguggugaauuuagcaacacuuaug

SEQ ID NO: 49088 - RNA, 21 nt, Human
agcagacuguuaggagcagua

SEQ ID NO: 49089 - RNA, 32 nt, Human
agcagacuuuccugccagugucagaaaauccu

SEQ ID NO: 49090 - RNA, 32 nt, Human
agcagagaaacccauguccucucuccauagag

SEQ ID NO: 49091 - RNA, 32 nt, Human
agcagagaaacccauguccucucuccauaggg

SEQ ID NO: 49092 - RNA, 32 nt, Human
agcagagaaaccugacugggaggcagaaaaga

SEQ ID NO: 49093 - RNA, 32 nt, Human
agcagagaaauuaaguggcuugcucaagguca

SEQ ID NO: 49094 - RNA, 32 nt, Human
agcagagaacacagcaaauuuguccagacuuc

SEQ ID NO: 49095 - RNA, 32 nt, Human
agcagagaacagaggugcacaccaccauaucu

SEQ ID NO: 49096 - RNA, 32 nt, Human
agcagagaacguguguguuaggagaacucggc

SEQ ID NO: 49097 - RNA, 32 nt, Human
agcagagaagcucagcgcccagccuggggaau

SEQ ID NO: 49098 - RNA, 32 nt, Human
agcagagaaggcacuugcauccuaugcagccc

SEQ ID NO: 49099 - RNA, 32 nt, Human
agcagagacaacugccacccagccugggccuu

SEQ ID NO: 49100 - RNA, 32 nt, Human
agcagagagacuccuccagacccacucagacc

SEQ ID NO: 49101 - RNA, 32 nt, Human
agcagagagaggaggcagaggcugggaauggg

SEQ ID NO: 49102 - RNA, 32 nt, Human
agcagagagagggagcugcaccagccucucac

SEQ ID NO: 49103 - RNA, 32 nt, Human
agcagagagccugggagagccaucucuuaacc

SEQ ID NO: 49104 - RNA, 32 nt, Human
agcagagaggaaggagaaagaggaggagagag

SEQ ID NO: 49105 - RNA, 32 nt, Human
agcagagaggagcggcaccagcagagggaagu

SEQ ID NO: 49106 - RNA, 32 nt, Human
agcagagagggagggcaggcgggagggagggc

SEQ ID NO: 49107 - RNA, 32 nt, Human
agcagagaggggugaauggaagaaggagcgag

SEQ ID NO: 49108 - RNA, 32 nt, Human
agcagagauagggagaggaggugaggggcacc

SEQ ID NO: 49109 - RNA, 32 nt, Human
agcagagaucuuccagagugucagccuccagc

SEQ ID NO: 49110 - RNA, 19 nt, Human
agcagagaugcagccagug

SEQ ID NO: 49111 - RNA, 32 nt, Human
agcagagauggggguuucaccauguuggccag

SEQ ID NO: 49112 - RNA, 32 nt, Human
agcagagauugcccccgcuacacuccagccug

SEQ ID NO: 49113 - RNA, 32 nt, Human
agcagagcaaacugcuuuccagccugaagccu

SEQ ID NO: 49114 - RNA, 32 nt, Human
agcagagcaagucugcaggugcaccacuuccc

SEQ ID NO: 49115 - RNA, 32 nt, Human
agcagagcacugggugagagggagaagaccuu

SEQ ID NO: 49116 - RNA, 32 nt, Human
agcagagcauuuaacccagaaucugaaaucuc

SEQ ID NO: 49117 - RNA, 32 nt, Human
agcagagccaggagagguugggugacacccac

SEQ ID NO: 49118 - RNA, 21 nt, Human
agcagagccagggcagggcga

SEQ ID NO: 49119 - RNA, 32 nt, Human
agcagagccauggagaauaagcauugacuacc

SEQ ID NO: 49120 - RNA, 22 nt, Human
agcagagcccacagaggcucgu

SEQ ID NO: 49121 - RNA, 32 nt, Human
agcagagcccaggaaucuggauuuuguacccg

SEQ ID NO: 49122 - RNA, 32 nt, Human
agcagagcccuggaugaaguggacgagcagcu

SEQ ID NO: 49123 - RNA, 32 nt, Human
agcagagccgggaagguggguggcccauuaca

SEQ ID NO: 49124 - RNA, 32 nt, Human
agcagagccgggagcuggagguucugcgggag

SEQ ID NO: 49125 - RNA, 32 nt, Human
agcagagccuggggcugguucacagcuaaacc

SEQ ID NO: 49126 - RNA, 32 nt, Human
agcagagcgaauacucagcagagauggugccc

SEQ ID NO: 49127 - RNA, 32 nt, Human
agcagagcgugccgcuacacuccagccugaug

SEQ ID NO: 49128 - RNA, 17 nt, Human
agcagagcuccugggaa

SEQ ID NO: 49129 - RNA, 32 nt, Human
agcagagcugaccuuaggaccgagcaccaggg

SEQ ID NO: 49130 - RNA, 32 nt, Human
agcagagcugccugacccucuugauuucugcu

SEQ ID NO: 49131 - RNA, 32 nt, Human
agcagagcuggguuuaaugagcauuuaaucua

SEQ ID NO: 49132 - RNA, 32 nt, Human
agcagagcuuacuucauugucuguccccaccc

SEQ ID NO: 49133 - RNA, 32 nt, Human
agcagagcuuccccugaaggugccaucagcca

SEQ ID NO: 49134 - RNA, 32 nt, Human
agcagagcuucucagugggcacagucucuuac

SEQ ID NO: 49135 - RNA, 32 nt, Human
agcagaggaaggcaggggauuuaggaucgccc

SEQ ID NO: 49136 - RNA, 32 nt, Human
agcagaggaaggggcuggugacccuggugcug

SEQ ID NO: 49137 - RNA, 32 nt, Human
agcagaggaggaagaggaagaguggggaugga

SEQ ID NO: 49138 - RNA, 32 nt, Human
agcagaggaggaagaggaggaagaaggaaaga

SEQ ID NO: 49139 - RNA, 32 nt, Human
agcagaggaggcagguggguggagggggaugc

SEQ ID NO: 49140 - RNA, 32 nt, Human
agcagaggaggggccgcugccacccaccuccc

SEQ ID NO: 49141 - RNA, 32 nt, Human
agcagaggcaaggggugccaggaguccccagc

SEQ ID NO: 49142 - RNA, 32 nt, Human
agcagaggcagcaggagcaggaggagcgugaa

SEQ ID NO: 49143 - RNA, 19 nt, Human
agcagaggcauccuugagc

SEQ ID NO: 49144 - RNA, 32 nt, Human
agcagaggccaagaguuugagggagaaauagu

SEQ ID NO: 49145 - RNA, 32 nt, Human
agcagaggccacgauugggaagacagacccag

SEQ ID NO: 49146 - RNA, 23 nt, Human
agcagaggccgagacccugcagg

SEQ ID NO: 49147 - RNA, 32 nt, Human
agcagaggccggcaguggaggcugagcaggga

SEQ ID NO: 49148 - RNA, 32 nt, Human
agcagaggccuccucuggagugagaggcucca

SEQ ID NO: 49149 - RNA, 32 nt, Human
agcagaggcuccagcgagggcaccagugccug

SEQ ID NO: 49150 - RNA, 32 nt, Human
agcagaggcugagugggcuucuggcuccuaga

SEQ ID NO: 49151 - RNA, 32 nt, Human
agcagaggcugcaggaacuuguguggggaucu

SEQ ID NO: 49152 - RNA, 19 nt, Human
agcagaggcuuuccuuggu

SEQ ID NO: 49153 - RNA, 32 nt, Human
agcagagggaauucacaggacccccugagaag

SEQ ID NO: 49154 - RNA, 32 nt, Human
agcagagggagagagaaggugacacggaugga

SEQ ID NO: 49155 - RNA, 32 nt, Human
agcagagggaggcagaagcguggaggaagggg

SEQ ID NO: 49156 - RNA, 32 nt, Human
agcagagggaggugggcugaggccucgguggg

SEQ ID NO: 49157 - RNA, 32 nt, Human
agcagagggaggugggggagagggaaauaaag

SEQ ID NO: 49158 - RNA, 32 nt, Human
agcagaggggaggcuggggucacagcuggcca

SEQ ID NO: 49159 - RNA, 32 nt, Human
agcagaggggcagaggcccacauuggaagagc

SEQ ID NO: 49160 - RNA, 32 nt, Human
agcagaggggcagcgauagacucuggggaugg

SEQ ID NO: 49161 - RNA, 20 nt, Human
agcagagggggcgcccgguc

SEQ ID NO: 49162 - RNA, 32 nt, Human
agcagaggggucggaaagggaaaacaacuacg

SEQ ID NO: 49163 - RNA, 32 nt, Human
agcagaggucgcggagguggcgagcgaggccg

SEQ ID NO: 49164 - RNA, 32 nt, Human
agcagaggugagcugagugcagugagccaaga

SEQ ID NO: 49165 - RNA, 32 nt, Human
agcagagguugagauucugccucccaggagag

SEQ ID NO: 49166 - RNA, 20 nt, Human
agcagaguauggaagcaccu

SEQ ID NO: 49167 - RNA, 21 nt, Human
agcagaguccacuagcccgug

SEQ ID NO: 49168 - RNA, 32 nt, Human
agcagaguccaugagaaagaaggagggauggg

SEQ ID NO: 49169 - RNA, 32 nt, Human
agcagagucucccgcugcaaucugggugguaa

SEQ ID NO: 49170 - RNA, 32 nt, Human
agcagagugggaggcaggcaucauaguugcug

SEQ ID NO: 49171 - RNA, 32 nt, Human
agcagaguggggugauguugguuguaugugca

SEQ ID NO: 49172 - RNA, 22 nt, Human
agcagaguguaggucccacuuc

SEQ ID NO: 49173 - RNA, 23 nt, Human
agcagagugucugugacccaccu

SEQ ID NO: 49174 - RNA, 32 nt, Human
agcagaguuccugcccauggucuugagcugaa

SEQ ID NO: 49175 - RNA, 19 nt, Human
agcagaguucuggccagug

SEQ ID NO: 49176 - RNA, 32 nt, Human
agcagaguugggggaggagggggagcccuggu

SEQ ID NO: 49177 - RNA, 32 nt, Human
agcagaguuguuaaagaguacuggaauagggg

SEQ ID NO: 49178 - RNA, 32 nt, Human
agcagaguuugugaccaaagucagaguggauc

SEQ ID NO: 49179 - RNA, 32 nt, Human
agcagauaaugcuuucuuuuccagucaucuuu

SEQ ID NO: 49180 - RNA, 32 nt, Human
agcagauacaggaguggggagggggcuguaac

SEQ ID NO: 49181 - RNA, 32 nt, Human
agcagauacuaaaacaaacaaaacuuuggacc

SEQ ID NO: 49182 - RNA, 32 nt, Human
agcagauacuagaaacaaacaaaacuuuggac

SEQ ID NO: 49183 - RNA, 32 nt, Human
agcagauagaaaacuaauauacucccuuuaau

SEQ ID NO: 49184 - RNA, 32 nt, Human
agcagauagaaucaugaacgaaaaugagagca

SEQ ID NO: 49185 - RNA, 18 nt, Human
agcagauagaugguccag

SEQ ID NO: 49186 - RNA, 18 nt, Human
agcagauauuacuuccau

SEQ ID NO: 49187 - RNA, 32 nt, Human
agcagaucaaaaagcacaaagagcuggggcag

SEQ ID NO: 49188 - RNA, 19 nt, Human
agcagaucacuugagguca

SEQ ID NO: 49189 - RNA, 32 nt, Human
agcagauccaucuccaccaacacagacaacac

SEQ ID NO: 49190 - RNA, 32 nt, Human
agcagaucccaauucaucccacaaacagaugc

SEQ ID NO: 49191 - RNA, 32 nt, Human
agcagaucgagaccagccuggccaacauggug

SEQ ID NO: 49192 - RNA, 32 nt, Human
agcagaucgagauggagaaggucuagcaccuu

SEQ ID NO: 49193 - RNA, 32 nt, Human
agcagaucuccuguggccaggaguucaagccu

SEQ ID NO: 49194 - RNA, 32 nt, Human
agcagaugaaaugucaugauugguguccaggc

SEQ ID NO: 49195 - RNA, 32 nt, Human
agcagaugaacagaaggaguagaguaaaacug

SEQ ID NO: 49196 - RNA, 32 nt, Human
agcagaugaagagagggccagaguaguguucu

SEQ ID NO: 49197 - RNA, 32 nt, Human
agcagaugagccaggguagagggcuggccccu

SEQ ID NO: 49198 - RNA, 32 nt, Human
agcagaugaggugaaaaggccaagagguuugg

SEQ ID NO: 49199 - RNA, 30 nt, Human
agcagaugcccagcuguagcugugcauuga

SEQ ID NO: 49200 - RNA, 32 nt, Human
agcagauggaaacuuccuucucuaugcacacu

SEQ ID NO: 49201 - RNA, 32 nt, Human
agcagauggaaaugcuaaugaggucaaacgua

SEQ ID NO: 49202 - RNA, 32 nt, Human
agcagaugggccuucuccgggaugaggcccug

SEQ ID NO: 49203 - RNA, 32 nt, Human
agcagaugguuuugacugucuuuuugcucuuu

SEQ ID NO: 49204 - RNA, 31 nt, Human
agcagaugugagagaggaaaaggaucuguuu

SEQ ID NO: 49205 - RNA, 32 nt, Human
agcagauguugcaaacuuucauaccacugcug

SEQ ID NO: 49206 - RNA, 32 nt, Human
agcagauuaacaggccaggcgcaguggcucac

SEQ ID NO: 49207 - RNA, 32 nt, Human
agcagauucaauggcucacauucuuucaaaag

SEQ ID NO: 49208 - RNA, 32 nt, Human
agcagauucuucacgcccagcuucuaccucac

SEQ ID NO: 49209 - RNA, 21 nt, Human
agcagauuuuaagaaauuaua

SEQ ID NO: 49210 - RNA, 32 nt, Human
agcagcaaaaagagcauggagcugaggaguac

SEQ ID NO: 49211 - RNA, 32 nt, Human
agcagcaaacuaaauucugagaaauaaacgag

SEQ ID NO: 49212 - RNA, 32 nt, Human
agcagcaaaggaugagcggaaccuuggaaaag

SEQ ID NO: 49213 - RNA, 32 nt, Human
agcagcaaaucgcuucaccuucuugaagccuc

SEQ ID NO: 49214 - RNA, 32 nt, Human
agcagcaacagcaacaaaugacuuaucaacaa

SEQ ID NO: 49215 - RNA, 32 nt, Human
agcagcaacaguugucuguccagcccccaccc

SEQ ID NO: 49216 - RNA, 32 nt, Human
agcagcaacauuaaaccagcccugccaacauc

SEQ ID NO: 49217 - RNA, 27 nt, Human
agcagcaacauuagcaagaccccguuu

SEQ ID NO: 49218 - RNA, 23 nt, Human
agcagcaagaucacuugagccca

SEQ ID NO: 49219 - RNA, 32 nt, Human
agcagcaaggccaccuuccagcuggagcuccc

SEQ ID NO: 49220 - RNA, 32 nt, Human
agcagcaauaugccacuguacaaaacugaaga

SEQ ID NO: 49221 - RNA, 32 nt, Human
agcagcacaaagaaacagccuuacacugggca

SEQ ID NO: 49222 - RNA, 32 nt, Human
agcagcacaaccuugaccagagcuuggguccu

SEQ ID NO: 49223 - RNA, 32 nt, Human
agcagcacaagaaaccaguuucuucaucugaa

SEQ ID NO: 49224 - RNA, 18 nt, Human
agcagcacagaugcgcug

SEQ ID NO: 49225 - RNA, 32 nt, Human
agcagcacaggcagaggccuggggagaguuua

SEQ ID NO: 49226 - RNA, 19 nt, Human
agcagcacagucucaggca

SEQ ID NO: 49227 - RNA, 32 nt, Human
agcagcacauucaaccauuuguuuucagucag

SEQ ID NO: 49228 - RNA, 32 nt, Human
agcagcacauuuccugguucaguggcuugagc

SEQ ID NO: 49229 - RNA, 32 nt, Human
agcagcaccagcccuguggggcauggagugga

SEQ ID NO: 49230 - RNA, 32 nt, Human
agcagcaccccgcaugcacuacccccauuuca

SEQ ID NO: 49231 - RNA, 32 nt, Human
agcagcaccuacccuguuccuagcucugcccc

SEQ ID NO: 49232 - RNA, 32 nt, Human
agcagcaccucacccucacuugccgggguguu

SEQ ID NO: 49233 - RNA, 32 nt, Human
agcagcaccuccucuucuagcagccaguccuc

SEQ ID NO: 49234 - RNA, 32 nt, Human
agcagcaccuccugucccuugaccuuaacucu

SEQ ID NO: 49235 - RNA, 26 nt, Human
agcagcaccuguaugaagccucagug

SEQ ID NO: 49236 - RNA, 32 nt, Human
agcagcaccuuaauaccucuugugacaguuac

SEQ ID NO: 49237 - RNA, 23 nt, Human
agcagcacgugugagcugggcca

SEQ ID NO: 49238 - RNA, 32 nt, Human
agcagcacugcacccucacuagccagaguguu

SEQ ID NO: 49239 - RNA, 32 nt, Human
agcagcacuggaagcaguuccaccacaugugc

SEQ ID NO: 49240 - RNA, 32 nt, Human
agcagcacuucagaggaugacgacagugagag

SEQ ID NO: 49241 - RNA, 32 nt, Human
agcagcacuuuuugcacagucuggggcggggu

SEQ ID NO: 49242 - RNA, 32 nt, Human
agcagcagaaggcagggguuaaaucaggauaa

SEQ ID NO: 49243 - RNA, 32 nt, Human
agcagcagaaggugaagcaggaagcacuuggu

SEQ ID NO: 49244 - RNA, 32 nt, Human
agcagcagaagugccccuucuccaggaucaag

SEQ ID NO: 49245 - RNA, 32 nt, Human
agcagcagaauggggaauggagaggugggcag

SEQ ID NO: 49246 - RNA, 32 nt, Human
agcagcagacagggucuccagagcacacgaca

SEQ ID NO: 49247 - RNA, 32 nt, Human
agcagcagagacagagccaggagcaguccagu

SEQ ID NO: 49248 - RNA, 32 nt, Human
agcagcagagaccucaucagcagaccaaggaa

SEQ ID NO: 49249 - RNA, 32 nt, Human
agcagcagagcaucuccucuuaaggauacgug

SEQ ID NO: 49250 - RNA, 25 nt, Human
agcagcagaggcagcaggagcagga

SEQ ID NO: 49251 - RNA, 32 nt, Human
agcagcagaguauaaggugcuuuaauuuaaua

SEQ ID NO: 49252 - RNA, 32 nt, Human
agcagcagagugaacugcagaggcagagauag

SEQ ID NO: 49253 - RNA, 32 nt, Human
agcagcagagugaacugcagagucagagauag

SEQ ID NO: 49254 - RNA, 32 nt, Human
agcagcagaguugcaagaggucuuggaaccug

SEQ ID NO: 49255 - RNA, 23 nt, Human
agcagcagaucuccgggauucug

SEQ ID NO: 49256 - RNA, 32 nt, Human
agcagcagauuguaaaaagugugacaaacaca

SEQ ID NO: 49257 - RNA, 20 nt, Human
agcagcagcaacggaccuug

SEQ ID NO: 49258 - RNA, 32 nt, Human
agcagcagcacccugcaagccagccuggccag

SEQ ID NO: 49259 - RNA, 19 nt, Human
agcagcagcagcacuugaa

SEQ ID NO: 49260 - RNA, 32 nt, Human
agcagcagcagcagcaagaguaacucugacuu

SEQ ID NO: 49261 - RNA, 21 nt, Human
agcagcagcagcagcaggcgg

SEQ ID NO: 49262 - RNA, 19 nt, Human
agcagcagcagcaggagcg

SEQ ID NO: 49263 - RNA, 21 nt, Human
agcagcagcagcguucugcug

SEQ ID NO: 49264 - RNA, 16 nt, Human
agcagcagcauguaca

SEQ ID NO: 49265 - RNA, 32 nt, Human
agcagcagccaagauacacaggagauggagcc

SEQ ID NO: 49266 - RNA, 32 nt, Human
agcagcagccgacugagcugagcccagcaggu

SEQ ID NO: 49267 - RNA, 32 nt, Human
agcagcagccggcgaggagggagcagcagcag

SEQ ID NO: 49268 - RNA, 32 nt, Human
agcagcagccucuaucaccggaugcugcccac

SEQ ID NO: 49269 - RNA, 32 nt, Human
agcagcagccugagcguggagggcaaggagcu

SEQ ID NO: 49270 - RNA, 32 nt, Human
agcagcagcgcccccugagaaauguucacucu

SEQ ID NO: 49271 - RNA, 22 nt, Human
agcagcagcgcuacagcccaga

SEQ ID NO: 49272 - RNA, 32 nt, Human
agcagcagcgggcugaagccauccgugucccg

SEQ ID NO: 49273 - RNA, 32 nt, Human
agcagcagcuagccaggcaaagggggcaaugg

SEQ ID NO: 49274 - RNA, 32 nt, Human
agcagcagcucccuccagggaggcccuggguc

SEQ ID NO: 49275 - RNA, 20 nt, Human
agcagcagcugcaggcccag

SEQ ID NO: 49276 - RNA, 22 nt, Human
agcagcagcuggacccccaaag

SEQ ID NO: 49277 - RNA, 32 nt, Human
agcagcagcuuccccacccaggacaaggccua

SEQ ID NO: 49278 - RNA, 32 nt, Human
agcagcaggaagcacucccagccaccagugcc

SEQ ID NO: 49279 - RNA, 32 nt, Human
agcagcaggaaggaugugggacucuguccaag

SEQ ID NO: 49280 - RNA, 25 nt, Human
agcagcaggaccaguaccuggguca

SEQ ID NO: 49281 - RNA, 18 nt, Human
agcagcaggaccccggaa

SEQ ID NO: 49282 - RNA, 32 nt, Human
agcagcaggagaaaaucgggacuccgaccuca

SEQ ID NO: 49283 - RNA, 32 nt, Human
agcagcaggagaagcaguggccagaggggaga

SEQ ID NO: 49284 - RNA, 32 nt, Human
agcagcaggagaauaggaugccucucacucac

SEQ ID NO: 49285 - RNA, 32 nt, Human
agcagcaggcagccggagggagugagagccac

SEQ ID NO: 49286 - RNA, 23 nt, Human
agcagcagggaagcucugggcca

SEQ ID NO: 49287 - RNA, 32 nt, Human
agcagcagguuguggagguggccaugacagug

SEQ ID NO: 49288 - RNA, 32 nt, Human
agcagcagugacggggcaccuugcuguguguc

SEQ ID NO: 49289 - RNA, 32 nt, Human
agcagcagugccucgcaccccagcacgcccgc

SEQ ID NO: 49290 - RNA, 32 nt, Human
agcagcauaagaguagucacaaacauguuuug

SEQ ID NO: 49291 - RNA, 32 nt, Human
agcagcauaccuccauguugugaaggcaucug

SEQ ID NO: 49292 - RNA, 32 nt, Human
agcagcauaggcuuuaucucccuacuuccucc

SEQ ID NO: 49293 - RNA, 32 nt, Human
agcagcaucaggacagcagagcagagcccccg

SEQ ID NO: 49294 - RNA, 32 nt, Human
agcagcauccaccccaccccaucuuugcugcc

SEQ ID NO: 49295 - RNA, 18 nt, Human
agcagcauccgccgaggc

SEQ ID NO: 49296 - RNA, 19 nt, Human
agcagcaucuacucuaggc

SEQ ID NO: 49297 - RNA, 32 nt, Human
agcagcaucucuaggacccuucugauugacau

SEQ ID NO: 49298 - RNA, 32 nt, Human
agcagcaucugaacugaggcuucuucaguccu

SEQ ID NO: 49299 - RNA, 32 nt, Human
agcagcaucugccccaauuucagcugaagauu

SEQ ID NO: 49300 - RNA, 19 nt, Human
agcagcaucuuugcugggc

SEQ ID NO: 49301 - RNA, 22 nt, Human
agcagcaugagcaucuggguca

SEQ ID NO: 49302 - RNA, 32 nt, Human
agcagcauggccagguccuccagugcccaggu

SEQ ID NO: 49303 - RNA, 32 nt, Human
agcagcauugacugguuuacaggcccugcucc

SEQ ID NO: 49304 - RNA, 32 nt, Human
agcagcauuuacagaaaugccaaaaaugugcc

SEQ ID NO: 49305 - RNA, 32 nt, Human
agcagccaaaauggauccccagugcacuaugg

SEQ ID NO: 49306 - RNA, 31 nt, Human
agcagccaacuuuucugacaaaauggauguu

SEQ ID NO: 49307 - RNA, 32 nt, Human
agcagccaagcccccauucccagagcagaccc

SEQ ID NO: 49308 - RNA, 25 nt, Human
agcagccaaucaaagcagcuagcag

SEQ ID NO: 49309 - RNA, 20 nt, Human
agcagccacaagucuuuacu

SEQ ID NO: 49310 - RNA, 32 nt, Human
agcagccacaguuucagacaaauguucagugu

SEQ ID NO: 49311 - RNA, 32 nt, Human
agcagccacauuugcaaccuuggccaucuguc

SEQ ID NO: 49312 - RNA, 32 nt, Human
agcagccaccagcaaacaccacugccugcagg

SEQ ID NO: 49313 - RNA, 32 nt, Human
agcagccaccagcccaaccacuugugucuucu

SEQ ID NO: 49314 - RNA, 32 nt, Human
agcagccaccuggccucacucuggccacaggu

SEQ ID NO: 49315 - RNA, 32 nt, Human
agcagccacgggacgggguagagccaggggug

SEQ ID NO: 49316 - RNA, 32 nt, Human
agcagccacuccucaaugcucaauggcucccc

SEQ ID NO: 49317 - RNA, 32 nt, Human
agcagccacugaacucccccaucccagggcuc

SEQ ID NO: 49318 - RNA, 32 nt, Human
agcagccacugcacaggaggaggugacaaacc

SEQ ID NO: 49319 - RNA, 32 nt, Human
agcagccacugucauuucucagugguuuugcc

SEQ ID NO: 49320 - RNA, 32 nt, Human
agcagccagagcuccuggaggaaaggcagucg

SEQ ID NO: 49321 - RNA, 32 nt, Human
agcagccagaggacgagccggagcagcccccg

SEQ ID NO: 49322 - RNA, 24 nt, Human
agcagccagaggaggccggugaag

SEQ ID NO: 49323 - RNA, 32 nt, Human
agcagccagagggguuuaacaggagugcagag

SEQ ID NO: 49324 - RNA, 23 nt, Human
agcagccagagugaccccgaaag

SEQ ID NO: 49325 - RNA, 17 nt, Human
agcagccagaugggcug

SEQ ID NO: 49326 - RNA, 32 nt, Human
agcagccagcacaaagggcccaggaagccagc

SEQ ID NO: 49327 - RNA, 21 nt, Human
agcagccagcagagcgugaug

SEQ ID NO: 49328 - RNA, 18 nt, Human
agcagccagcagcugcau

SEQ ID NO: 49329 - RNA, 24 nt, Human
agcagccagcagcugcauggugaa

SEQ ID NO: 49330 - RNA, 22 nt, Human
agcagccagcccuuugaagaug

SEQ ID NO: 49331 - RNA, 32 nt, Human
agcagccagcuccugguagcugaugaggauca

SEQ ID NO: 49332 - RNA, 32 nt, Human
agcagccaggaggcgggcggaagagugggugg

SEQ ID NO: 49333 - RNA, 32 nt, Human
agcagccaggcagaaccaggacaggugaggug

SEQ ID NO: 49334 - RNA, 32 nt, Human
agcagccaggcuguggagaggaggcgggcggg

SEQ ID NO: 49335 - RNA, 32 nt, Human
agcagccagguaauuacuagaugaaggaaugc

SEQ ID NO: 49336 - RNA, 20 nt, Human
agcagccaguagccccgaaa

SEQ ID NO: 49337 - RNA, 32 nt, Human
agcagccagucacccuggccagucccacuucc

SEQ ID NO: 49338 - RNA, 19 nt, Human
agcagccauagauaauaca

SEQ ID NO: 49339 - RNA, 32 nt, Human
agcagccauagcuguguggaggcuucagcaua

SEQ ID NO: 49340 - RNA, 21 nt, Human
agcagccauaggcagauaaag

SEQ ID NO: 49341 - RNA, 32 nt, Human
agcagccauggcagucauuaaagagaaaggag

SEQ ID NO: 49342 - RNA, 32 nt, Human
agcagccauguggugggcaugugugacuacuc

SEQ ID NO: 49343 - RNA, 32 nt, Human
agcagcccaaggcaccuguccucugacccacc

SEQ ID NO: 49344 - RNA, 28 nt, Human
agcagcccaagugcuccugaguccuugc

SEQ ID NO: 49345 - RNA, 28 nt, Human
agcagcccaagugucaucccauucaccc

SEQ ID NO: 49346 - RNA, 22 nt, Human
agcagcccacuccuucccaugg

SEQ ID NO: 49347 - RNA, 32 nt, Human
agcagcccacucuuguguucucaggcagggga

SEQ ID NO: 49348 - RNA, 32 nt, Human
agcagcccagaacagcacaugugggggaggug

SEQ ID NO: 49349 - RNA, 23 nt, Human
agcagcccagcaccuccacuggg

SEQ ID NO: 49350 - RNA, 32 nt, Human
agcagcccagcucuggugaguguccuugagcu

SEQ ID NO: 49351 - RNA, 32 nt, Human
agcagcccaggggauuucaaagagcucagacu

SEQ ID NO: 49352 - RNA, 32 nt, Human
agcagcccaguaaacugcgggcgaagagaucu

SEQ ID NO: 49353 - RNA, 32 nt, Human
agcagcccaugcacacagaauggcagccacau

SEQ ID NO: 49354 - RNA, 32 nt, Human
agcagccccaggagcacaaccugagauuucua

SEQ ID NO: 49355 - RNA, 32 nt, Human
agcagccccaggaggggaccagaggggaugcu

SEQ ID NO: 49356 - RNA, 19 nt, Human
agcagccccaggaguccca

SEQ ID NO: 49357 - RNA, 32 nt, Human
agcagccccaggagucccagacccgugccgau

SEQ ID NO: 49358 - RNA, 23 nt, Human
agcagccccauguauucucuggg

SEQ ID NO: 49359 - RNA, 25 nt, Human
agcagcccccagguugccugggcca

SEQ ID NO: 49360 - RNA, 32 nt, Human
agcagcccccuucauucaauuaccucccgccg

SEQ ID NO: 49361 - RNA, 32 nt, Human
agcagccccgcacuugcuguaggaauuauuag

SEQ ID NO: 49362 - RNA, 32 nt, Human
agcagccccggguaugagaggcaggacucaga

SEQ ID NO: 49363 - RNA, 24 nt, Human
agcagccccucgcggcagccccga

SEQ ID NO: 49364 - RNA, 28 nt, Human
agcagccccugcgcugccucaucuacau

SEQ ID NO: 49365 - RNA, 32 nt, Human
agcagccccuggcaaugagcugccugaugaug

SEQ ID NO: 49366 - RNA, 32 nt, Human
agcagcccuccccucccuccccuuaugagguc

SEQ ID NO: 49367 - RNA, 32 nt, Human
agcagcccuccgagucgagccucugcccccga

SEQ ID NO: 49368 - RNA, 32 nt, Human
agcagcccucgaggcccucacagaugucuagg

SEQ ID NO: 49369 - RNA, 32 nt, Human
agcagcccugaugucauuuuuguauuucagga

SEQ ID NO: 49370 - RNA, 32 nt, Human
agcagcccugcacuccacgcuggccaagaagg

SEQ ID NO: 49371 - RNA, 32 nt, Human
agcagcccugcagccucugccucucucagccg

SEQ ID NO: 49372 - RNA, 32 nt, Human
agcagcccugggaaaaggcuguggccucaggg

SEQ ID NO: 49373 - RNA, 32 nt, Human
agcagcccugggugccuggcugaauuugguuu

SEQ ID NO: 49374 - RNA, 32 nt, Human
agcagcccugugaggcugaggcugcagccagc

SEQ ID NO: 49375 - RNA, 32 nt, Human
agcagcccuucccugcucaaagccuuuccgca

SEQ ID NO: 49376 - RNA, 17 nt, Human
agcagcccuucuuuacu

SEQ ID NO: 49377 - RNA, 18 nt, Human
agcagccgagcgagagca

SEQ ID NO: 49378 - RNA, 23 nt, Human
agcagccgaggcuggccgggaga

SEQ ID NO: 49379 - RNA, 32 nt, Human
agcagccgaggcuggccgggagagggaggaag

SEQ ID NO: 49380 - RNA, 18 nt, Human
agcagccgccuccugccc

SEQ ID NO: 49381 - RNA, 32 nt, Human
agcagccgcgauggccagcaccaggaguaucg

SEQ ID NO: 49382 - RNA, 32 nt, Human
agcagccgcucggcgccugccugcucagaagc

SEQ ID NO: 49383 - RNA, 22 nt, Human
agcagccgggacugcaggcaca

SEQ ID NO: 49384 - RNA, 32 nt, Human
agcagccggguuggaagugucucuccacaguc

SEQ ID NO: 49385 - RNA, 19 nt, Human
agcagccgucauacugaug

SEQ ID NO: 49386 - RNA, 32 nt, Human
agcagccgucauacugauggccaucggcacgg

SEQ ID NO: 49387 - RNA, 20 nt, Human
agcagccuauuccucucugg

SEQ ID NO: 49388 - RNA, 32 nt, Human
agcagccucaaauuccagaaguggaggcucca

SEQ ID NO: 49389 - RNA, 32 nt, Human
agcagccucacugcaucuuucucuucccaugc

SEQ ID NO: 49390 - RNA, 32 nt, Human
agcagccucagcaaucaaacuauucccucacu

SEQ ID NO: 49391 - RNA, 32 nt, Human
agcagccucagccucugccuguccagcgccaa

SEQ ID NO: 49392 - RNA, 23 nt, Human
agcagccucccggcgcgaugaag

SEQ ID NO: 49393 - RNA, 32 nt, Human
agcagccucccuucuccucucccuccacuccc

SEQ ID NO: 49394 - RNA, 32 nt, Human
agcagccuccucucuuccugccugagcaccgc

SEQ ID NO: 49395 - RNA, 32 nt, Human
agcagccucgggcaggggucucaggcccgugg

SEQ ID NO: 49396 - RNA, 32 nt, Human
agcagccucuacccucagcauccuggccacaa

SEQ ID NO: 49397 - RNA, 32 nt, Human
agcagccucuccccaucuaccuagcaacuguc

SEQ ID NO: 49398 - RNA, 32 nt, Human
agcagccucugaggccgcccccagagagcauc

SEQ ID NO: 49399 - RNA, 32 nt, Human
agcagccucuucaugaauuacagcugaggggg

SEQ ID NO: 49400 - RNA, 32 nt, Human
agcagccugaacugagaguccaugccgaguuu

SEQ ID NO: 49401 - RNA, 21 nt, Human
agcagccugacaguccagcug

SEQ ID NO: 49402 - RNA, 32 nt, Human
agcagccugagcaacauagugagaccccaucc

SEQ ID NO: 49403 - RNA, 32 nt, Human
agcagccugcaagcugggagcuugcaugggug

SEQ ID NO: 49404 - RNA, 32 nt, Human
agcagccugcagcugccccaagccauggcuga

SEQ ID NO: 49405 - RNA, 32 nt, Human
agcagccugccccaugcuuccagccugcagaa

SEQ ID NO: 49406 - RNA, 32 nt, Human
agcagccugccuggcuggcucccuuggcugug

SEQ ID NO: 49407 - RNA, 32 nt, Human
agcagccuggaacagacccaggcggaggacac

SEQ ID NO: 49408 - RNA, 32 nt, Human
agcagccuggaacccacgccuccugaggacac

SEQ ID NO: 49409 - RNA, 32 nt, Human
agcagccuggacugcagcucucagaggccagg

SEQ ID NO: 49410 - RNA, 21 nt, Human
agcagccuggcuccccugggg

SEQ ID NO: 49411 - RNA, 32 nt, Human
agcagccuggcugccuugucauggccuccugg

SEQ ID NO: 49412 - RNA, 32 nt, Human
agcagccugggugacagagcgagacucuuguc

SEQ ID NO: 49413 - RNA, 32 nt, Human
agcagccuggguuccaaaguccuggccccagc

SEQ ID NO: 49414 - RNA, 32 nt, Human
agcagccuguagaugggguaagugcuguggau

SEQ ID NO: 49415 - RNA, 32 nt, Human
agcagccuguguauauuccuaacacuuuguuc

SEQ ID NO: 49416 - RNA, 32 nt, Human
agcagccuguucccaguucccugggccucugg

SEQ ID NO: 49417 - RNA, 32 nt, Human
agcagccuguuccugcacuccacccugcuggc

SEQ ID NO: 49418 - RNA, 32 nt, Human
agcagccuuaacuucccuugggcggcucuagg

SEQ ID NO: 49419 - RNA, 32 nt, Human
agcagccuuggcuuuuccucuccugggugcuc

SEQ ID NO: 49420 - RNA, 22 nt, Human
agcagccuugguuccucugggg

SEQ ID NO: 49421 - RNA, 32 nt, Human
agcagccuuuugucccagcucagcuuugaucu

SEQ ID NO: 49422 - RNA, 32 nt, Human
agcagcgaccuccacucccgccaccgucugag

SEQ ID NO: 49423 - RNA, 32 nt, Human
agcagcgagaggcagaggcggcggcggcgggg

SEQ ID NO: 49424 - RNA, 32 nt, Human
agcagcgagagggagaggcgagaguaaggcgc

SEQ ID NO: 49425 - RNA, 32 nt, Human
agcagcgagcucggaugcaucucuccaaaagc

SEQ ID NO: 49426 - RNA, 32 nt, Human
agcagcgaggcaggaggaagaagggggcacug

SEQ ID NO: 49427 - RNA, 32 nt, Human
agcagcgagggcucuaagaccacccagcucuc

SEQ ID NO: 49428 - RNA, 32 nt, Human
agcagcgaguccuugccucccggcggcucagg

SEQ ID NO: 49429 - RNA, 32 nt, Human
agcagcgcacuaaguuacaucuugccuuaucu

SEQ ID NO: 49430 - RNA, 32 nt, Human
agcagcgcacugcaaccuggaccuccugggcu

SEQ ID NO: 49431 - RNA, 32 nt, Human
agcagcgcagaggcuuuggaggcugcaguguc

SEQ ID NO: 49432 - RNA, 32 nt, Human
agcagcgcaggauccagguuuccugccccagu

SEQ ID NO: 49433 - RNA, 32 nt, Human
agcagcgcaggggucagggagguggagacacu

SEQ ID NO: 49434 - RNA, 32 nt, Human
agcagcgcagucucagaucacugcaaccuccg

SEQ ID NO: 49435 - RNA, 32 nt, Human
agcagcgcaugcagacucacguguagggccag

SEQ ID NO: 49436 - RNA, 32 nt, Human
agcagcgccaggauuccucggcagucgucccc

SEQ ID NO: 49437 - RNA, 32 nt, Human
agcagcgccauggaggacucugaagcacuggg

SEQ ID NO: 49438 - RNA, 32 nt, Human
agcagcgccuccuucaggguuggcugggagcu

SEQ ID NO: 49439 - RNA, 24 nt, Human
agcagcgcggagagcugacuauua

SEQ ID NO: 49440 - RNA, 32 nt, Human
agcagcgcgggcagcgagaugcagcaccgagg

SEQ ID NO: 49441 - RNA, 32 nt, Human
agcagcgcggucgcuggaaacugaggcuucau

SEQ ID NO: 49442 - RNA, 32 nt, Human
agcagcgcuucucacagacgugcacagaccug

SEQ ID NO: 49443 - RNA, 32 nt, Human
agcagcggagaaacguuucucuuuccucucag

SEQ ID NO: 49444 - RNA, 32 nt, Human
agcagcggcaggcccagcuugugugcagcggc

SEQ ID NO: 49445 - RNA, 22 nt, Human
agcagcggcaucaggaggagga

SEQ ID NO: 49446 - RNA, 32 nt, Human
agcagcggccagcaucaccacacccgcggcac

SEQ ID NO: 49447 - RNA, 32 nt, Human
agcagcggcgccgccucccagaguucagaccc

SEQ ID NO: 49448 - RNA, 19 nt, Human
agcagcggcggccgagggg

SEQ ID NO: 49449 - RNA, 32 nt, Human
agcagcggcucucgccuguaaucccagcacuu

SEQ ID NO: 49450 - RNA, 19 nt, Human
agcagcggcuggagcagca

SEQ ID NO: 49451 - RNA, 23 nt, Human
agcagcgggaacugggggcucug

SEQ ID NO: 49452 - RNA, 32 nt, Human
agcagcgggcugggcacauccucuccucucuc

SEQ ID NO: 49453 - RNA, 32 nt, Human
agcagcgguggagucuguguugcaccuaggac

SEQ ID NO: 49454 - RNA, 32 nt, Human
agcagcgucccuuugguuuggcccagaggggc

SEQ ID NO: 49455 - RNA, 23 nt, Human
agcagcguggagacauuagguca

SEQ ID NO: 49456 - RNA, 17 nt, Human
agcagcguggaggggcc

SEQ ID NO: 49457 - RNA, 24 nt, Human
agcagcguggaggugucugggcca

SEQ ID NO: 49458 - RNA, 20 nt, Human
agcagcguggggagcuggcc

SEQ ID NO: 49459 - RNA, 23 nt, Human
agcagcguuccaaccugaggcca

SEQ ID NO: 49460 - RNA, 32 nt, Human
agcagcguucugagagacgcacaggagaccaa

SEQ ID NO: 49461 - RNA, 32 nt, Human
agcagcuaagagaaauuugagaggaaaagugg

SEQ ID NO: 49462 - RNA, 32 nt, Human
agcagcuacagaucguccuacucaccagcugg

SEQ ID NO: 49463 - RNA, 32 nt, Human
agcagcuacuucuaguuggucaccuuggcccc

SEQ ID NO: 49464 - RNA, 32 nt, Human
agcagcuagaguccgggauccccagccuacug

SEQ ID NO: 49465 - RNA, 32 nt, Human
agcagcuagcaugcguggcugugcacaguggc

SEQ ID NO: 49466 - RNA, 32 nt, Human
agcagcuaggaguacaguugggagccacugua

SEQ ID NO: 49467 - RNA, 32 nt, Human
agcagcuauggacagcagaguagcuaugguca

SEQ ID NO: 49468 - RNA, 18 nt, Human
agcagcucaaaggcacag

SEQ ID NO: 49469 - RNA, 32 nt, Human
agcagcucaaugagugccuacagcagaaagcc

SEQ ID NO: 49470 - RNA, 32 nt, Human
agcagcucagcaacccuugcugugcucaaguu

SEQ ID NO: 49471 - RNA, 32 nt, Human
agcagcuccacaaccaccuccagccugggaga

SEQ ID NO: 49472 - RNA, 32 nt, Human
agcagcuccagagcaugggacaccuggcugac

SEQ ID NO: 49473 - RNA, 32 nt, Human
agcagcuccagcagcgccagcaggcgggaucg

SEQ ID NO: 49474 - RNA, 32 nt, Human
agcagcuccagcccagagcacucggccagcag

SEQ ID NO: 49475 - RNA, 19 nt, Human
agcagcuccaggagcccag

SEQ ID NO: 49476 - RNA, 32 nt, Human
agcagcuccaggagucaggcaaccuccaauca

SEQ ID NO: 49477 - RNA, 32 nt, Human
agcagcuccaggcuggaguucugguucuucca

SEQ ID NO: 49478 - RNA, 32 nt, Human
agcagcucccacaaugcaccagggcauaugca

SEQ ID NO: 49479 - RNA, 17 nt, Human
agcagcucccagugcca

SEQ ID NO: 49480 - RNA, 32 nt, Human
agcagcuccgaauuuuuaccuggaauauuuug

SEQ ID NO: 49481 - RNA, 32 nt, Human
agcagcuccgagaagaugaacuccuuggucug

SEQ ID NO: 49482 - RNA, 32 nt, Human
agcagcuccggcggccgagacgggggcggcgg

SEQ ID NO: 49483 - RNA, 32 nt, Human
agcagcuccgucaugagucuagcuaccaagau

SEQ ID NO: 49484 - RNA, 32 nt, Human
agcagcuccuaggagccuggcagggaaaggca

SEQ ID NO: 49485 - RNA, 32 nt, Human
agcagcuccucugcaggcacagccuggacuau

SEQ ID NO: 49486 - RNA, 32 nt, Human
agcagcuccugcuugaguucugagggcaucau

SEQ ID NO: 49487 - RNA, 32 nt, Human
agcagcuccuggcugggcugggcagacucagc

SEQ ID NO: 49488 - RNA, 32 nt, Human
agcagcuccuucuggacccagucuggaagguc

SEQ ID NO: 49489 - RNA, 32 nt, Human
agcagcucuccuuccccugccuucagcucaag

SEQ ID NO: 49490 - RNA, 32 nt, Human
agcagcucugagucuuuuggaggacagggacg

SEQ ID NO: 49491 - RNA, 32 nt, Human
agcagcucugggaggcacagagugcaggucuc

SEQ ID NO: 49492 - RNA, 32 nt, Human
agcagcucugugaugggaucccagacuguccc

SEQ ID NO: 49493 - RNA, 17 nt, Human
agcagcucuucagcaca

SEQ ID NO: 49494 - RNA, 32 nt, Human
agcagcucuucccacgccuaugaaguugaagc

SEQ ID NO: 49495 - RNA, 32 nt, Human
agcagcugaaggagcagcaggagaugcagcag

SEQ ID NO: 49496 - RNA, 32 nt, Human
agcagcugaaggaggaguuuguggaaaauuua

SEQ ID NO: 49497 - RNA, 32 nt, Human
agcagcugacacuuuuucccagaagggagaga

SEQ ID NO: 49498 - RNA, 32 nt, Human
agcagcugagauuacaggugcaugccaccacu

SEQ ID NO: 49499 - RNA, 32 nt, Human
agcagcugcacguccgaggcuuggggaggacc

SEQ ID NO: 49500 - RNA, 32 nt, Human
agcagcugcagcguuuucucuccugggaaccc

SEQ ID NO: 49501 - RNA, 32 nt, Human
agcagcugcauccagaucucauuaugcaucag

SEQ ID NO: 49502 - RNA, 20 nt, Human
agcagcugccagccccggca

SEQ ID NO: 49503 - RNA, 32 nt, Human
agcagcugccgaggccggagcaauggcggaac

SEQ ID NO: 49504 - RNA, 32 nt, Human
agcagcugccguggcgucuggccacauggagc

SEQ ID NO: 49505 - RNA, 32 nt, Human
agcagcugccuucaccauggacagcauaagca

SEQ ID NO: 49506 - RNA, 32 nt, Human
agcagcugcuccauugugccucgaggccccga

SEQ ID NO: 49507 - RNA, 32 nt, Human
agcagcugcuccugacagggaugcucaugccc

SEQ ID NO: 49508 - RNA, 32 nt, Human
agcagcugcucuggagcagggauccaccagau

SEQ ID NO: 49509 - RNA, 32 nt, Human
agcagcugcugcgggccagggcgggccaggac

SEQ ID NO: 49510 - RNA, 20 nt, Human
agcagcugcugcugccagua

SEQ ID NO: 49511 - RNA, 32 nt, Human
agcagcugcugucucuccaaugcagcuccaca

SEQ ID NO: 49512 - RNA, 20 nt, Human
agcagcuggaagaagcccag

SEQ ID NO: 49513 - RNA, 32 nt, Human
agcagcuggaggaggagcagggaggcaaguca

SEQ ID NO: 49514 - RNA, 32 nt, Human
agcagcuggaggaggaggaggaggauacgcca

SEQ ID NO: 49515 - RNA, 32 nt, Human
agcagcuggaggugacgccgggcagauuacgc

SEQ ID NO: 49516 - RNA, 32 nt, Human
agcagcuggcagaacccccguguuggcucccu

SEQ ID NO: 49517 - RNA, 23 nt, Human
agcagcuggcagagagcccagug

SEQ ID NO: 49518 - RNA, 17 nt, Human
agcagcuggcagcgcug

SEQ ID NO: 49519 - RNA, 32 nt, Human
agcagcuggcagcggagagagcagcccuggag

SEQ ID NO: 49520 - RNA, 16 nt, Human
agcagcuggcagggga

SEQ ID NO: 49521 - RNA, 32 nt, Human
agcagcuggcugucauggcaacaggaggcugu

SEQ ID NO: 49522 - RNA, 32 nt, Human
agcagcuggcuguguuugcagugcaaauagcu

SEQ ID NO: 49523 - RNA, 32 nt, Human
agcagcugggagagugccuugugugcagugac

SEQ ID NO: 49524 - RNA, 32 nt, Human
agcagcugggauuacaggcaaacgccaccaca

SEQ ID NO: 49525 - RNA, 32 nt, Human
agcagcugggauuacaggcgcacgccacuaug

SEQ ID NO: 49526 - RNA, 32 nt, Human
agcagcugggauuacaggcgcccacuaauuuu

SEQ ID NO: 49527 - RNA, 32 nt, Human
agcagcugggauuacaggcgcuggccacacac

SEQ ID NO: 49528 - RNA, 32 nt, Human
agcagcugggauuacagguaugcgccaccaug

SEQ ID NO: 49529 - RNA, 32 nt, Human
agcagcugggauuacaggugcccgccaccacg

SEQ ID NO: 49530 - RNA, 32 nt, Human
agcagcugggauuacaggugcgugccaccaca

SEQ ID NO: 49531 - RNA, 32 nt, Human
agcagcugggcagucacaucuggaaauggaaa

SEQ ID NO: 49532 - RNA, 32 nt, Human
agcagcugggcuggggagcagaaaacacacuu

SEQ ID NO: 49533 - RNA, 32 nt, Human
agcagcuggggguuccaccucaggguggggcg

SEQ ID NO: 49534 - RNA, 23 nt, Human
agcagcugguacuucugcuaggg

SEQ ID NO: 49535 - RNA, 32 nt, Human
agcagcugucugggagucaaggcugcaguagc

SEQ ID NO: 49536 - RNA, 32 nt, Human
agcagcugugacaugaagugaaugaaguccac

SEQ ID NO: 49537 - RNA, 32 nt, Human
agcagcugugagcagccagagcugaugcccgg

SEQ ID NO: 49538 - RNA, 32 nt, Human
agcagcugugagcuggagacagcagagggacc

SEQ ID NO: 49539 - RNA, 32 nt, Human
agcagcuguuucaaacaccaaugucaccucuc

SEQ ID NO: 49540 - RNA, 32 nt, Human
agcagcuuagaaucccagcugcuggcucgggc

SEQ ID NO: 49541 - RNA, 23 nt, Human
agcagcuuagacuuccgccgggg

SEQ ID NO: 49542 - RNA, 32 nt, Human
agcagcuuccacauaggguugagccugugggu

SEQ ID NO: 49543 - RNA, 32 nt, Human
agcagcuuccaucaggaacauggagcaggcag

SEQ ID NO: 49544 - RNA, 32 nt, Human
agcagcuucucccugucuuccucuccucucuu

SEQ ID NO: 49545 - RNA, 32 nt, Human
agcagcuucuccugcugacuggccaaucacug

SEQ ID NO: 49546 - RNA, 32 nt, Human
agcagcuugcccagcuaggagcagcagcaaca

SEQ ID NO: 49547 - RNA, 32 nt, Human
agcagcuugcccagcucuugaguacaguggug

SEQ ID NO: 49548 - RNA, 32 nt, Human
agcagcuugcugcucaaccucuagugucccuc

SEQ ID NO: 49549 - RNA, 32 nt, Human
agcagcuuggcccuuuucacagagguggccuu

SEQ ID NO: 49550 - RNA, 32 nt, Human
agcagcuugguauucauaaauauugggauugg

SEQ ID NO: 49551 - RNA, 32 nt, Human
agcagcuugguucuccccucuggccccuggag

SEQ ID NO: 49552 - RNA, 32 nt, Human
agcagcuuguguugucacgcuucuucuuuuga

SEQ ID NO: 49553 - RNA, 32 nt, Human
agcagcuuugagaugaccagucugguuuuugu

SEQ ID NO: 49554 - RNA, 17 nt, Human
agcagcuuuucuccuuu

SEQ ID NO: 49555 - RNA, 32 nt, Human
agcaggaaacauagaacucagagccagauccc

SEQ ID NO: 49556 - RNA, 32 nt, Human
agcaggaaacauggugaugcugggugacggcu

SEQ ID NO: 49557 - RNA, 32 nt, Human
agcaggaaagaacaacuccagaugggaggaac

SEQ ID NO: 49558 - RNA, 32 nt, Human
agcaggaaagagagcucccuggucuccuggga

SEQ ID NO: 49559 - RNA, 32 nt, Human
agcaggaaauaucugugggcuugugcacggac

SEQ ID NO: 49560 - RNA, 32 nt, Human
agcaggaaaucauucugaccucagguuaggca

SEQ ID NO: 49561 - RNA, 19 nt, Human
agcaggaacagcagccggg

SEQ ID NO: 49562 - RNA, 32 nt, Human
agcaggaacagcuugggucccguggaugacau

SEQ ID NO: 49563 - RNA, 32 nt, Human
agcaggaacagggagagaguagggacagcgac

SEQ ID NO: 49564 - RNA, 32 nt, Human
agcaggaaccacaggcaggcaccaccauaccc

SEQ ID NO: 49565 - RNA, 31 nt, Human
agcaggaaccagggccuacuccucuuauggu

SEQ ID NO: 49566 - RNA, 32 nt, Human
agcaggaaccuaaaauaucugccaucaucugc

SEQ ID NO: 49567 - RNA, 32 nt, Human
agcaggaaccucuccauccucacuuuccaucc

SEQ ID NO: 49568 - RNA, 32 nt, Human
agcaggaaccuugucuguguuguucauggcua

SEQ ID NO: 49569 - RNA, 32 nt, Human
agcaggaacuauaggcaugugccaccaugccc

SEQ ID NO: 49570 - RNA, 32 nt, Human
agcaggaacugagagcuucccacccagcaccu

SEQ ID NO: 49571 - RNA, 32 nt, Human
agcaggaagaaggcuccucucuccaucgcacc

SEQ ID NO: 49572 - RNA, 32 nt, Human
agcaggaagcagcucaggacagggaagacaaa

SEQ ID NO: 49573 - RNA, 32 nt, Human
agcaggaagccgccuaccaccaugagcagcac

SEQ ID NO: 49574 - RNA, 19 nt, Human
agcaggaagcggggcagca

SEQ ID NO: 49575 - RNA, 32 nt, Human
agcaggaagcuccaaagggaauggggguaugg

SEQ ID NO: 49576 - RNA, 23 nt, Human
agcaggaaggaccagguucugcu

SEQ ID NO: 49577 - RNA, 32 nt, Human
agcaggaaggagagcagaaaaggggaugggcu

SEQ ID NO: 49578 - RNA, 32 nt, Human
agcaggaaggccuggguggaucggccuccucu

SEQ ID NO: 49579 - RNA, 32 nt, Human
agcaggaaggcggccuccugcccacccgccgc

SEQ ID NO: 49580 - RNA, 32 nt, Human
agcaggaagggccaggaccagaaccuugccca

SEQ ID NO: 49581 - RNA, 32 nt, Human
agcaggaagggcucccugcccuugggguuuug

SEQ ID NO: 49582 - RNA, 32 nt, Human
agcaggaaggucucaccugaggugaaccuucg

SEQ ID NO: 49583 - RNA, 23 nt, Human
agcaggaauccuagaagcaaaug

SEQ ID NO: 49584 - RNA, 32 nt, Human
agcaggaauugccccuguucagagcagccgga

SEQ ID NO: 49585 - RNA, 32 nt, Human
agcaggacaacgaagaggcagaaggaucuggg

SEQ ID NO: 49586 - RNA, 32 nt, Human
agcaggacacgugaacacccagacacccacuc

SEQ ID NO: 49587 - RNA, 16 nt, Human
agcaggacagcaagca

SEQ ID NO: 49588 - RNA, 25 nt, Human
agcaggacaguccgcgccuggggga

SEQ ID NO: 49589 - RNA, 32 nt, Human
agcaggacaugagacauagauacaguggggag

SEQ ID NO: 49590 - RNA, 20 nt, Human
agcaggaccagcaggcacag

SEQ ID NO: 49591 - RNA, 32 nt, Human
agcaggaccagcugccuuucucaccaccacag

SEQ ID NO: 49592 - RNA, 32 nt, Human
agcaggacccuagaggagacucucauucgauu

SEQ ID NO: 49593 - RNA, 22 nt, Human
agcaggaccgcguccucccgcc

SEQ ID NO: 49594 - RNA, 23 nt, Human
agcaggacucaugggucccaguu

SEQ ID NO: 49595 - RNA, 32 nt, Human
agcaggacuggguagcagagccgggaaggugg

SEQ ID NO: 49596 - RNA, 32 nt, Human
agcaggagaagacauacugcagggcucaguga

SEQ ID NO: 49597 - RNA, 32 nt, Human
agcaggagacuccacuuucuuccuuuguacag

SEQ ID NO: 49598 - RNA, 32 nt, Human
agcaggagagagaagaaacaggccagcuguga

SEQ ID NO: 49599 - RNA, 32 nt, Human
agcaggagagaggugguagggagcagccagcc

SEQ ID NO: 49600 - RNA, 31 nt, Human
agcaggagagccccuguuuccuggccgggga

SEQ ID NO: 49601 - RNA, 32 nt, Human
agcaggagagggaggcuuccugacugacacag

SEQ ID NO: 49602 - RNA, 32 nt, Human
agcaggagcagcagagcagcagcuaagacccc

SEQ ID NO: 49603 - RNA, 32 nt, Human
agcaggagccuguaaucccagcuguucgggag

SEQ ID NO: 49604 - RNA, 32 nt, Human
agcaggagcgagagaugagaaagggaauccag

SEQ ID NO: 49605 - RNA, 32 nt, Human
agcaggagcugcagcgagccggguaccuggac

SEQ ID NO: 49606 - RNA, 24 nt, Human
agcaggagcuuccgccuccucucc

SEQ ID NO: 49607 - RNA, 32 nt, Human
agcaggaggaagaggaggaggcccguuggcgu

SEQ ID NO: 49608 - RNA, 32 nt, Human
agcaggaggaccucacccacacccauggcaaa

SEQ ID NO: 49609 - RNA, 32 nt, Human
agcaggaggagaaagagaagcuugucucagaa

SEQ ID NO: 49610 - RNA, 32 nt, Human
agcaggaggagaagauacgagagcaggaggag

SEQ ID NO: 49611 - RNA, 32 nt, Human
agcaggaggagaagauaugggagcaggaggag

SEQ ID NO: 49612 - RNA, 32 nt, Human
agcaggaggagaagaugugugagcaggaagag

SEQ ID NO: 49613 - RNA, 32 nt, Human
agcaggaggagagagccccugaagugaggaaa

SEQ ID NO: 49614 - RNA, 32 nt, Human
agcaggaggagcggagaaaggagagggcgggg

SEQ ID NO: 49615 - RNA, 32 nt, Human
agcaggaggagguggcggcggcgggaagaugc

SEQ ID NO: 49616 - RNA, 32 nt, Human
agcaggaggagguggguggggugaaggaggag

SEQ ID NO: 49617 - RNA, 32 nt, Human
agcaggaggaggugguggcggcgggaagaugc

SEQ ID NO: 49618 - RNA, 32 nt, Human
agcaggaggaguuuggauaaagcugaaguucc

SEQ ID NO: 49619 - RNA, 32 nt, Human
agcaggaggcggaggugcaggggccgcccgag

SEQ ID NO: 49620 - RNA, 32 nt, Human
agcaggaggcggaggugguggaaggcuguuuc

SEQ ID NO: 49621 - RNA, 32 nt, Human
agcaggagggccuggcugggugaggggaggcc

SEQ ID NO: 49622 - RNA, 32 nt, Human
agcaggaggggagaaacaggagaggagaggcc

SEQ ID NO: 49623 - RNA, 32 nt, Human
agcaggaggggcgagcugggaggcaggaggca

SEQ ID NO: 49624 - RNA, 32 nt, Human
agcaggagucgccccggggcagcagcggcagc

SEQ ID NO: 49625 - RNA, 32 nt, Human
agcaggaguggaugcagccugaucagggucug

SEQ ID NO: 49626 - RNA, 32 nt, Human
agcaggagugugaggaggagacagccucagcg

SEQ ID NO: 49627 - RNA, 32 nt, Human
agcaggaguuaauggaccggccauccauagcg

SEQ ID NO: 49628 - RNA, 32 nt, Human
agcaggaucacucccuagcuucucugagcaca

SEQ ID NO: 49629 - RNA, 32 nt, Human
agcaggauccuggggccgaggcugcagcucag

SEQ ID NO: 49630 - RNA, 32 nt, Human
agcaggaucugucucaccauacacugagaacu

SEQ ID NO: 49631 - RNA, 32 nt, Human
agcaggaugaccucuucagcuucuggggcccg

SEQ ID NO: 49632 - RNA, 32 nt, Human
agcaggauugcaggggacacagggaagcacug

SEQ ID NO: 49633 - RNA, 32 nt, Human
agcaggcaagaagcggaggcagugaguacagc

SEQ ID NO: 49634 - RNA, 32 nt, Human
agcaggcaagacuuuuucucuguguuaggaaa

SEQ ID NO: 49635 - RNA, 32 nt, Human
agcaggcaagaugcugaaaaugcugaggcaaa

SEQ ID NO: 49636 - RNA, 32 nt, Human
agcaggcaaucaauaaauauuuguugacugau

SEQ ID NO: 49637 - RNA, 32 nt, Human
agcaggcaauuucaccaccaaaugccaagaaa

SEQ ID NO: 49638 - RNA, 22 nt, Human
agcaggcacacagcaggggcuc

SEQ ID NO: 49639 - RNA, 32 nt, Human
agcaggcacagagccagcagcagaucacacuu

SEQ ID NO: 49640 - RNA, 32 nt, Human
agcaggcaccuguaaucccagcuacuugggag

SEQ ID NO: 49641 - RNA, 32 nt, Human
agcaggcacuggcugagaaugaggugaacugu

SEQ ID NO: 49642 - RNA, 32 nt, Human
agcaggcagaagaaaaggcagcuguggugugu

SEQ ID NO: 49643 - RNA, 32 nt, Human
agcaggcagagcggggaggugccugagcuggg

SEQ ID NO: 49644 - RNA, 23 nt, Human
agcaggcagaucaccugagguca

SEQ ID NO: 49645 - RNA, 23 nt, Human
agcaggcagaucaccugagguua

SEQ ID NO: 49646 - RNA, 32 nt, Human
agcaggcagcaccccucugccagccgggcccc

SEQ ID NO: 49647 - RNA, 32 nt, Human
agcaggcagcaccccucugccagccgggcucc

SEQ ID NO: 49648 - RNA, 32 nt, Human
agcaggcagccugucuggguuccugaggccug

SEQ ID NO: 49649 - RNA, 32 nt, Human
agcaggcagcggcagagagggaauggugcagg

SEQ ID NO: 49650 - RNA, 32 nt, Human
agcaggcagcgggcggcggggagcagcaugga

SEQ ID NO: 49651 - RNA, 32 nt, Human
agcaggcagcuccugugcuguaaagaaaauug

SEQ ID NO: 49652 - RNA, 32 nt, Human
agcaggcagcuccuguguuuucuugagggugg

SEQ ID NO: 49653 - RNA, 32 nt, Human
agcaggcaggacacaggagggauggcacugcc

SEQ ID NO: 49654 - RNA, 32 nt, Human
agcaggcaggagagagaggggaaggagguaug

SEQ ID NO: 49655 - RNA, 25 nt, Human
agcaggcaggagcaggggaggcucg

SEQ ID NO: 49656 - RNA, 32 nt, Human
agcaggcaggcaggagguccuguuagcccugc

SEQ ID NO: 49657 - RNA, 32 nt, Human
agcaggcaggccucccggucagggagccucug

SEQ ID NO: 49658 - RNA, 24 nt, Human
agcaggcaggcuggggaggccagu

SEQ ID NO: 49659 - RNA, 32 nt, Human
agcaggcaggggacccagggggacuguggcac

SEQ ID NO: 49660 - RNA, 32 nt, Human
agcaggcagggugggagugagcguggcugagg

SEQ ID NO: 49661 - RNA, 32 nt, Human
agcaggcaguccagagaacuggccuccccagc

SEQ ID NO: 49662 - RNA, 18 nt, Human
agcaggcauaggguagca

SEQ ID NO: 49663 - RNA, 32 nt, Human
agcaggcauggaaggggaauugcagugucccu

SEQ ID NO: 49664 - RNA, 32 nt, Human
agcaggcaugguccuggaaaauuggggaauga

SEQ ID NO: 49665 - RNA, 18 nt, Human
agcaggccaccaagagca

SEQ ID NO: 49666 - RNA, 32 nt, Human
agcaggccagacacagucugaugccagcuggg

SEQ ID NO: 49667 - RNA, 15 nt, Human
agcaggccaggcaca

SEQ ID NO: 49668 - RNA, 18 nt, Human
agcaggcccagccuuccu

SEQ ID NO: 49669 - RNA, 32 nt, Human
agcaggcccaggagaauuaggaaggccauggg

SEQ ID NO: 49670 - RNA, 20 nt, Human
agcaggcccagugggaggcu

SEQ ID NO: 49671 - RNA, 32 nt, Human
agcaggcccauugcaccccucugccuccucuc

SEQ ID NO: 49672 - RNA, 32 nt, Human
agcaggcccccuuguccuuccugggcccuggu

SEQ ID NO: 49673 - RNA, 32 nt, Human
agcaggcccggcaguuggaggaaggccagagg

SEQ ID NO: 49674 - RNA, 32 nt, Human
agcaggcccgggagccgggaggcugcgggcgg

SEQ ID NO: 49675 - RNA, 32 nt, Human
agcaggcccggggagggugguuaccgcugagg

SEQ ID NO: 49676 - RNA, 17 nt, Human
agcaggcccuccugccc

SEQ ID NO: 49677 - RNA, 32 nt, Human
agcaggcccugggccuccaccucugugcaggg

SEQ ID NO: 49678 - RNA, 32 nt, Human
agcaggccgaggaggaagaagaggggcagugg

SEQ ID NO: 49679 - RNA, 16 nt, Human
agcaggccgggcagca

SEQ ID NO: 49680 - RNA, 32 nt, Human
agcaggccucccgugccucugccagcaaggag

SEQ ID NO: 49681 - RNA, 17 nt, Human
agcaggccucugaggca

SEQ ID NO: 49682 - RNA, 32 nt, Human
agcaggccuggauggaggccuagaaagcccuu

SEQ ID NO: 49683 - RNA, 32 nt, Human
agcaggccugugccuccacaucaucuuguugu

SEQ ID NO: 49684 - RNA, 32 nt, Human
agcaggccuuccucccucccacccccaauguc

SEQ ID NO: 49685 - RNA, 32 nt, Human
agcaggccuuggggcucacugaaggcucgaag

SEQ ID NO: 49686 - RNA, 32 nt, Human
agcaggcgagcugacauucugcagccuggacg

SEQ ID NO: 49687 - RNA, 32 nt, Human
agcaggcgccagcgguggaggcugagucgcag

SEQ ID NO: 49688 - RNA, 32 nt, Human
agcaggcgcuuguaaucccagcuacuugggag

SEQ ID NO: 49689 - RNA, 32 nt, Human
agcaggcggagcgagagagggagaaacaggcg

SEQ ID NO: 49690 - RNA, 23 nt, Human
agcaggcggaucaccugagguca

SEQ ID NO: 49691 - RNA, 32 nt, Human
agcaggcggcuccugugcuguaaagaaaauug

SEQ ID NO: 49692 - RNA, 19 nt, Human
agcaggcggggaggaggcu

SEQ ID NO: 49693 - RNA, 32 nt, Human
agcaggcgugggugccaccacccucuagcccc

SEQ ID NO: 49694 - RNA, 32 nt, Human
agcaggcucagcccaaggguccgcauuagugg

SEQ ID NO: 49695 - RNA, 32 nt, Human
agcaggcucccugagugaugagcuugaaccug

SEQ ID NO: 49696 - RNA, 32 nt, Human
agcaggcuccgaaucaccaucucccucacaug

SEQ ID NO: 49697 - RNA, 32 nt, Human
agcaggcuccugggguucccaauuccaggcau

SEQ ID NO: 49698 - RNA, 32 nt, Human
agcaggcucuacuccagaacagaacccacagu

SEQ ID NO: 49699 - RNA, 32 nt, Human
agcaggcugcagcugcuggaugaagcccccag

SEQ ID NO: 49700 - RNA, 32 nt, Human
agcaggcugccaccccuucuaccucaccacug

SEQ ID NO: 49701 - RNA, 32 nt, Human
agcaggcugccugucugugguccaggcuucag

SEQ ID NO: 49702 - RNA, 32 nt, Human
agcaggcuggagaagcgaggccagcaggccag

SEQ ID NO: 49703 - RNA, 32 nt, Human
agcaggcugggcccuaggcaggaagcuggcuu

SEQ ID NO: 49704 - RNA, 22 nt, Human
agcaggcuggggaccuccuccc

SEQ ID NO: 49705 - RNA, 32 nt, Human
agcaggcuguccaggcugggcuugguggucag

SEQ ID NO: 49706 - RNA, 32 nt, Human
agcaggcuguggcccaggccuccugggugaca

SEQ ID NO: 49707 - RNA, 32 nt, Human
agcaggcugugggguggagcacuggacuccgg

SEQ ID NO: 49708 - RNA, 32 nt, Human
agcaggcuuacugccaucaacauugcuugaaa

SEQ ID NO: 49709 - RNA, 32 nt, Human
agcaggcuuccaugcugcugugggcguccuug

SEQ ID NO: 49710 - RNA, 32 nt, Human
agcaggcuugggccugucauggcuggccggaa

SEQ ID NO: 49711 - RNA, 32 nt, Human
agcagggaacaaaggagcggagaggggagggg

SEQ ID NO: 49712 - RNA, 32 nt, Human
agcagggaacugcucguguccuccaucuuugc

SEQ ID NO: 49713 - RNA, 32 nt, Human
agcagggaagaugagaacaaucagggcuagaa

SEQ ID NO: 49714 - RNA, 32 nt, Human
agcagggaauacagucguuccaucagagcugg

SEQ ID NO: 49715 - RNA, 32 nt, Human
agcagggacagcacagacccucuggcuggggc

SEQ ID NO: 49716 - RNA, 32 nt, Human
agcagggacagcccacaccugaagagcacgcc

SEQ ID NO: 49717 - RNA, 32 nt, Human
agcagggacccaggcaguggggcuguuagguu

SEQ ID NO: 49718 - RNA, 20 nt, Human
agcagggacccugguuucca

SEQ ID NO: 49719 - RNA, 32 nt, Human
agcagggaccugccacaagugggggcaccauc

SEQ ID NO: 49720 - RNA, 32 nt, Human
agcagggacuacaggcaugcgccaccacgccc

SEQ ID NO: 49721 - RNA, 24 nt, Human
agcagggagaggagucuuuccucc

SEQ ID NO: 49722 - RNA, 32 nt, Human
agcagggagagggagucggacaugaggcugag

SEQ ID NO: 49723 - RNA, 32 nt, Human
agcagggagaggggcggagaggcagcgaaccu

SEQ ID NO: 49724 - RNA, 32 nt, Human
agcagggagcacuuggcuccuggcagagggag

SEQ ID NO: 49725 - RNA, 32 nt, Human
agcagggagcaguguucagaggcaaagcagcc

SEQ ID NO: 49726 - RNA, 32 nt, Human
agcagggagcuuugggacagggcuggggcccc

SEQ ID NO: 49727 - RNA, 32 nt, Human
agcagggaggccaugugcucagccuggccacg

SEQ ID NO: 49728 - RNA, 32 nt, Human
agcagggaggcuggggccugcaguuucacgca

SEQ ID NO: 49729 - RNA, 32 nt, Human
agcagggaggguguugaggaggcuucugcgag

SEQ ID NO: 49730 - RNA, 32 nt, Human
agcagggaucagccuggagaucauccgcucag

SEQ ID NO: 49731 - RNA, 32 nt, Human
agcagggauccaagaaugugccaagagucccg

SEQ ID NO: 49732 - RNA, 32 nt, Human
agcagggaucguaccacugcacuccagccugg

SEQ ID NO: 49733 - RNA, 32 nt, Human
agcagggaucugcucccuaucuagacagaucu

SEQ ID NO: 49734 - RNA, 32 nt, Human
agcagggauuacaggcaugcaccaccaugccu

SEQ ID NO: 49735 - RNA, 32 nt, Human
agcagggauuacaggcaugcacccacaugcca

SEQ ID NO: 49736 - RNA, 32 nt, Human
agcagggauuacaggugugugccaccaugccu

SEQ ID NO: 49737 - RNA, 32 nt, Human
agcagggauuaccggugugcaccaccaugccu

SEQ ID NO: 49738 - RNA, 32 nt, Human
agcagggcaccguguaugaaugcaguuuggug

SEQ ID NO: 49739 - RNA, 18 nt, Human
agcagggcagaacugggg

SEQ ID NO: 49740 - RNA, 32 nt, Human
agcagggcaggcagggguuggagugggcauag

SEQ ID NO: 49741 - RNA, 32 nt, Human
agcagggcagggaccccucuccccugcugucu

SEQ ID NO: 49742 - RNA, 32 nt, Human
agcagggcagggcuccaccaggaggcuucggu

SEQ ID NO: 49743 - RNA, 15 nt, Human
agcagggcaggggcu

SEQ ID NO: 49744 - RNA, 32 nt, Human
agcagggcagugagccgugaaguuccuagugg

SEQ ID NO: 49745 - RNA, 21 nt, Human
agcagggcaucagcugaggga

SEQ ID NO: 49746 - RNA, 32 nt, Human
agcagggcaucucugaaacaaaggcagcagcc

SEQ ID NO: 49747 - RNA, 32 nt, Human
agcagggcaugguggugcaugccaguaauucc

SEQ ID NO: 49748 - RNA, 16 nt, Human
agcagggcauguagca

SEQ ID NO: 49749 - RNA, 18 nt, Human
agcagggccaagaugggg

SEQ ID NO: 49750 - RNA, 18 nt, Human
agcagggccacucccggc

SEQ ID NO: 49751 - RNA, 20 nt, Human
agcagggccacucggccggc

SEQ ID NO: 49752 - RNA, 19 nt, Human
agcagggccagccccgguc

SEQ ID NO: 49753 - RNA, 20 nt, Human
agcagggccagccccgguca

SEQ ID NO: 49754 - RNA, 21 nt, Human
agcagggccaggacaagggga

SEQ ID NO: 49755 - RNA, 24 nt, Human
agcagggccaggcgggcucggggg

SEQ ID NO: 49756 - RNA, 20 nt, Human
agcagggccagguccugguc

SEQ ID NO: 49757 - RNA, 32 nt, Human
agcagggccagucucagggcccggagacgaac

SEQ ID NO: 49758 - RNA, 23 nt, Human
agcagggcccaugaccgggugga

SEQ ID NO: 49759 - RNA, 19 nt, Human
agcagggccccccgcccgg

SEQ ID NO: 49760 - RNA, 21 nt, Human
agcagggcccgcugccccagg

SEQ ID NO: 49761 - RNA, 32 nt, Human
agcagggcccgcugccccaggcaccuaccgcu

SEQ ID NO: 49762 - RNA, 16 nt, Human
agcagggcccgguccc

SEQ ID NO: 49763 - RNA, 19 nt, Human
agcagggccgccugguccc

SEQ ID NO: 49764 - RNA, 21 nt, Human
agcagggccgccuugggcagg

SEQ ID NO: 49765 - RNA, 32 nt, Human
agcagggccuccucuuccuccugguguuugaa

SEQ ID NO: 49766 - RNA, 21 nt, Human
agcagggccucgugccccggc

SEQ ID NO: 49767 - RNA, 32 nt, Human
agcagggccuggccaggcagaguguuaucacc

SEQ ID NO: 49768 - RNA, 32 nt, Human
agcagggcgcaaacccaggacaucugugccag

SEQ ID NO: 49769 - RNA, 17 nt, Human
agcagggcgccugggaa

SEQ ID NO: 49770 - RNA, 20 nt, Human
agcagggcuccagucccagg

SEQ ID NO: 49771 - RNA, 16 nt, Human
agcagggcuccuggga

SEQ ID NO: 49772 - RNA, 16 nt, Human
agcagggcucugggaa

SEQ ID NO: 49773 - RNA, 32 nt, Human
agcagggcuggggaagaaauggcaaacuaggg

SEQ ID NO: 49774 - RNA, 22 nt, Human
agcagggcugugcugccugggg

SEQ ID NO: 49775 - RNA, 32 nt, Human
agcaggggaagaggugcucucagagacagcag

SEQ ID NO: 49776 - RNA, 32 nt, Human
agcaggggacaagcaggcucaccccgcccuug

SEQ ID NO: 49777 - RNA, 32 nt, Human
agcaggggacagugcagggaggugugggguaa

SEQ ID NO: 49778 - RNA, 32 nt, Human
agcaggggagagagugagcgugagcuuggcau

SEQ ID NO: 49779 - RNA, 32 nt, Human
agcaggggagccaccagccacaggcagccacu

SEQ ID NO: 49780 - RNA, 32 nt, Human
agcaggggagggaacccagaggcuggggauga

SEQ ID NO: 49781 - RNA, 32 nt, Human
agcaggggaggugagacagagaugaggaggga

SEQ ID NO: 49782 - RNA, 32 nt, Human
agcaggggagguuuaguuggucucagcacauc

SEQ ID NO: 49783 - RNA, 23 nt, Human
agcaggggcacagcaggccucaa

SEQ ID NO: 49784 - RNA, 32 nt, Human
agcaggggcacagcaggccucaagagccccua

SEQ ID NO: 49785 - RNA, 32 nt, Human
agcaggggcaucugggaggcucuggcugccuu

SEQ ID NO: 49786 - RNA, 32 nt, Human
agcaggggcucaauaaaugcuuguugaacuug

SEQ ID NO: 49787 - RNA, 32 nt, Human
agcaggggcucagacuaccacacuccugcaga

SEQ ID NO: 49788 - RNA, 24 nt, Human
agcaggggcucccagcagugugua

SEQ ID NO: 49789 - RNA, 32 nt, Human
agcaggggcugacaggguggcaggugacuuuc

SEQ ID NO: 49790 - RNA, 32 nt, Human
agcaggggcugggagagcagaagggcaggccc

SEQ ID NO: 49791 - RNA, 32 nt, Human
agcagggggaaagguaggaaaaagagguaauu

SEQ ID NO: 49792 - RNA, 32 nt, Human
agcagggggacacagaccugcccaagccaccc

SEQ ID NO: 49793 - RNA, 32 nt, Human
agcagggggcagcagaggccaacagggagcuc

SEQ ID NO: 49794 - RNA, 32 nt, Human
agcaggggugaggagagcaggagaguaggggu

SEQ ID NO: 49795 - RNA, 24 nt, Human
agcagggguuggggaaacagcauc

SEQ ID NO: 49796 - RNA, 32 nt, Human
agcaggguaagcaggcuggcccaggguaaggg

SEQ ID NO: 49797 - RNA, 32 nt, Human
agcaggguacagcccauucccccagcccuggc

SEQ ID NO: 49798 - RNA, 32 nt, Human
agcagggucaagccucuuauuccaggagaagg

SEQ ID NO: 49799 - RNA, 32 nt, Human
agcagggucaccaacccagaucuccaggccca

SEQ ID NO: 49800 - RNA, 32 nt, Human
agcagggucacuucucauuuucuuugcugacu

SEQ ID NO: 49801 - RNA, 32 nt, Human
agcagggucaucuguagggccaccccacagcu

SEQ ID NO: 49802 - RNA, 32 nt, Human
agcaggguccauugcuggcaauggauggccca

SEQ ID NO: 49803 - RNA, 32 nt, Human
agcagggucccaaggauugggagaucuagugu

SEQ ID NO: 49804 - RNA, 32 nt, Human
agcaggguccuuccuugcaaaguacuauacag

SEQ ID NO: 49805 - RNA, 32 nt, Human
agcaggguggccguggugaaggagaacguguu

SEQ ID NO: 49806 - RNA, 31 nt, Human
agcagggugggaaggccucagauggcaucag

SEQ ID NO: 49807 - RNA, 32 nt, Human
agcagggugugugcagguuccuccucuacggu

SEQ ID NO: 49808 - RNA, 32 nt, Human
agcaggguucuccucaaagccucacaaccaua

SEQ ID NO: 49809 - RNA, 32 nt, Human
agcagguaaaacagggcuugccaugcugaggc

SEQ ID NO: 49810 - RNA, 32 nt, Human
agcagguaaagauggcagcuaccauguuccgg

SEQ ID NO: 49811 - RNA, 32 nt, Human
agcagguaaagucuacugacagaaagucagca

SEQ ID NO: 49812 - RNA, 32 nt, Human
agcagguaauuguucguggcacguuguggcag

SEQ ID NO: 49813 - RNA, 32 nt, Human
agcagguacagaggcccugcagcagggcaccc

SEQ ID NO: 49814 - RNA, 32 nt, Human
agcagguacaguuaaggaauaaguagaacuaa

SEQ ID NO: 49815 - RNA, 32 nt, Human
agcagguagcugccaugugcagcccaggccca

SEQ ID NO: 49816 - RNA, 32 nt, Human
agcagguagggagagcgcacugggaagcucgg

SEQ ID NO: 49817 - RNA, 19 nt, Human
agcaggucacugcugguuu

SEQ ID NO: 49818 - RNA, 20 nt, Human
agcaggucagaagagggaga

SEQ ID NO: 49819 - RNA, 32 nt, Human
agcaggucagugcaucgaguucuguuuccgug

SEQ ID NO: 49820 - RNA, 32 nt, Human
agcagguccaaagaaggggugggaggagggaa

SEQ ID NO: 49821 - RNA, 32 nt, Human
agcagguccaccagaccacccgcugggacuca

SEQ ID NO: 49822 - RNA, 18 nt, Human
agcagguccgaggcacag

SEQ ID NO: 49823 - RNA, 32 nt, Human
agcagguccgccagaccacccgcugggacuca

SEQ ID NO: 49824 - RNA, 30 nt, Human
agcagguccucaauaaauacucgcuggauc

SEQ ID NO: 49825 - RNA, 32 nt, Human
agcagguccuggcaagugcauuccacccgaac

SEQ ID NO: 49826 - RNA, 32 nt, Human
agcaggucgagaaaaugucuuuccuuucacuu

SEQ ID NO: 49827 - RNA, 32 nt, Human
agcaggucgcccagggcuuggcuacuguaggu

SEQ ID NO: 49828 - RNA, 32 nt, Human
agcaggucgccuccagccugaccagcaucggc

SEQ ID NO: 49829 - RNA, 24 nt, Human
agcaggucggccgcccucccgucc

SEQ ID NO: 49830 - RNA, 24 nt, Human
agcaggucuaggaauucgccuggu

SEQ ID NO: 49831 - RNA, 18 nt, Human
agcaggucucaggcacag

SEQ ID NO: 49832 - RNA, 32 nt, Human
agcaggucugaaugacaccaggucgcugcugu

SEQ ID NO: 49833 - RNA, 32 nt, Human
agcaggucuuccagacccugcgauccuuucug

SEQ ID NO: 49834 - RNA, 32 nt, Human
agcaggucuuuuaguugaaugcagcaugugca

SEQ ID NO: 49835 - RNA, 32 nt, Human
agcaggugaaagccaccauggcagauccugau

SEQ ID NO: 49836 - RNA, 32 nt, Human
agcaggugacauccuuccccuuccacccugcu

SEQ ID NO: 49837 - RNA, 32 nt, Human
agcaggugagaggcucugcuucugcugccgcu

SEQ ID NO: 49838 - RNA, 32 nt, Human
agcaggugaggagagagauugagaacuaugag

SEQ ID NO: 49839 - RNA, 19 nt, Human
agcaggugcacgggcaaca

SEQ ID NO: 49840 - RNA, 32 nt, Human
agcaggugcagaggcacugcagcugcucgguu

SEQ ID NO: 49841 - RNA, 32 nt, Human
agcaggugccaccaccaccacaaaagacacca

SEQ ID NO: 49842 - RNA, 23 nt, Human
agcaggugccacggcccgccccg

SEQ ID NO: 49843 - RNA, 32 nt, Human
agcaggugcccaggagagaggggauaaugaag

SEQ ID NO: 49844 - RNA, 32 nt, Human
agcaggugccuguaaucacagcuacucgggag

SEQ ID NO: 49845 - RNA, 32 nt, Human
agcaggugccuguaaucccagcuacuggggaa

SEQ ID NO: 49846 - RNA, 32 nt, Human
agcaggugcucaauaaauaucugccgacugga

SEQ ID NO: 49847 - RNA, 32 nt, Human
agcaggugcucaauaaaugauucuuagugacu

SEQ ID NO: 49848 - RNA, 32 nt, Human
agcagguggaguuuucaguaauuuguucaagu

SEQ ID NO: 49849 - RNA, 32 nt, Human
agcagguggaucaucugaggucgggagauuga

SEQ ID NO: 49850 - RNA, 32 nt, Human
agcagguggaugaggucagaucaccuuuggua

SEQ ID NO: 49851 - RNA, 32 nt, Human
agcagguggauuugggcccaggcccuguucac

SEQ ID NO: 49852 - RNA, 19 nt, Human
agcagguggcaggcuguua

SEQ ID NO: 49853 - RNA, 32 nt, Human
agcagguggcccagggaggcagauacagcaca

SEQ ID NO: 49854 - RNA, 32 nt, Human
agcagguggccuggucugugagccgcaggcac

SEQ ID NO: 49855 - RNA, 32 nt, Human
agcaggugggcagaucaaagcugcucagugcc

SEQ ID NO: 49856 - RNA, 32 nt, Human
agcaggugguagugggacaggacaauuggagc

SEQ ID NO: 49857 - RNA, 32 nt, Human
agcaggugugguuugagccaggaccuggggcg

SEQ ID NO: 49858 - RNA, 32 nt, Human
agcaggugugugccaccaugcccagcuaauuu

SEQ ID NO: 49859 - RNA, 32 nt, Human
agcagguucaguuaaaaguauaucagagauac

SEQ ID NO: 49860 - RNA, 20 nt, Human
agcagguuccugcccuugaa

SEQ ID NO: 49861 - RNA, 32 nt, Human
agcagguucuagaagguggauguguucuaugg

SEQ ID NO: 49862 - RNA, 32 nt, Human
agcagguucugccucccguccccucggagggc

SEQ ID NO: 49863 - RNA, 32 nt, Human
agcagguugcagcugcuggcacaaauagccug

SEQ ID NO: 49864 - RNA, 32 nt, Human
agcagguugcccaccaagcuggaaggcaguga

SEQ ID NO: 49865 - RNA, 18 nt, Human
agcagguuguaggcacag

SEQ ID NO: 49866 - RNA, 32 nt, Human
agcagguuuccuggcauguucuaaacuguuuu

SEQ ID NO: 49867 - RNA, 32 nt, Human
agcagguuuugcggaacccccaugacgcaggc

SEQ ID NO: 49868 - RNA, 32 nt, Human
agcaguaaaauggcucugucuucuacaggaua

SEQ ID NO: 49869 - RNA, 32 nt, Human
agcaguaaaggagugagcacuuuggguccuua

SEQ ID NO: 49870 - RNA, 32 nt, Human
agcaguaaaggcugauugacacacagggggau

SEQ ID NO: 49871 - RNA, 32 nt, Human
agcaguaacaggaaaccacuuaucacauggag

SEQ ID NO: 49872 - RNA, 32 nt, Human
agcaguacaauuucagcauaucucuggcucag

SEQ ID NO: 49873 - RNA, 32 nt, Human
agcaguacagaagugccuuuuacucauuugag

SEQ ID NO: 49874 - RNA, 21 nt, Human
agcaguagacagcccuggaca

SEQ ID NO: 49875 - RNA, 24 nt, Human
agcaguagacagcccuggacacuc

SEQ ID NO: 49876 - RNA, 32 nt, Human
agcaguagauaccccggggcugugcuuuagcg

SEQ ID NO: 49877 - RNA, 31 nt, Human
agcaguagcaagucucccaugugaggccaga

SEQ ID NO: 49878 - RNA, 32 nt, Human
agcaguaggaucucgguuuccagcccagugca

SEQ ID NO: 49879 - RNA, 32 nt, Human
agcaguaggcaugacagucaccaggaaggaca

SEQ ID NO: 49880 - RNA, 32 nt, Human
agcaguagugcgcaggcaagacuuuucaguga

SEQ ID NO: 49881 - RNA, 32 nt, Human
agcaguaucuaggagaccacgaaggaauacca

SEQ ID NO: 49882 - RNA, 32 nt, Human
agcaguaucucaaugguacuaguaaauaaaua

SEQ ID NO: 49883 - RNA, 32 nt, Human
agcaguaugagaaugaacuaacacaguaaauu

SEQ ID NO: 49884 - RNA, 32 nt, Human
agcaguauggcauccccuccccaggaucucgg

SEQ ID NO: 49885 - RNA, 32 nt, Human
agcagucaaaggacacacauggugggaccugu

SEQ ID NO: 49886 - RNA, 32 nt, Human
agcagucagccaauucauaugcuuugucucug

SEQ ID NO: 49887 - RNA, 32 nt, Human
agcagucaggcagacccagugauaugguaaga

SEQ ID NO: 49888 - RNA, 32 nt, Human
agcagucagggagagacagaacugggggaaag

SEQ ID NO: 49889 - RNA, 32 nt, Human
agcagucauaauuccacauaagccugagacuc

SEQ ID NO: 49890 - RNA, 32 nt, Human
agcagucaucccugccaccagccagagcacag

SEQ ID NO: 49891 - RNA, 32 nt, Human
agcagucauccuguggcucuggcuccagagga

SEQ ID NO: 49892 - RNA, 32 nt, Human
agcaguccacaaagugcugggauuacaggugu

SEQ ID NO: 49893 - RNA, 21 nt, Human
agcaguccauuucuaccaagg

SEQ ID NO: 49894 - RNA, 32 nt, Human
agcagucccagagggcccaucuguaaagaucg

SEQ ID NO: 49895 - RNA, 25 nt, Human
agcagucccucugcaccccagagug

SEQ ID NO: 49896 - RNA, 32 nt, Human
agcaguccuaucacaagcucauggccuuggac

SEQ ID NO: 49897 - RNA, 32 nt, Human
agcaguccucccaccuuggccucccagaaugc

SEQ ID NO: 49898 - RNA, 32 nt, Human
agcaguccugagggcccugccucccagucccu

SEQ ID NO: 49899 - RNA, 20 nt, Human
agcaguccugcccccacccc

SEQ ID NO: 49900 - RNA, 22 nt, Human
agcaguccugugcuuggaaaug

SEQ ID NO: 49901 - RNA, 32 nt, Human
agcaguccuugcaggugccuuucuuguaccuc

SEQ ID NO: 49902 - RNA, 32 nt, Human
agcagucgccuaguuagggcucagaguggaag

SEQ ID NO: 49903 - RNA, 32 nt, Human
agcagucggcuuucugcugggcucggagccag

SEQ ID NO: 49904 - RNA, 32 nt, Human
agcagucguggugaaaccggucagcuguggac

SEQ ID NO: 49905 - RNA, 32 nt, Human
agcagucuaggagcuugcagccacccuguuag

SEQ ID NO: 49906 - RNA, 32 nt, Human
agcagucucacagaaggcaggcuaguccauuc

SEQ ID NO: 49907 - RNA, 32 nt, Human
agcagucucacugcagucuuauuuccaaguaa

SEQ ID NO: 49908 - RNA, 32 nt, Human
agcagucucagcccucuucucgucucauuccc

SEQ ID NO: 49909 - RNA, 32 nt, Human
agcagucucaggccagcuucucugugaccccu

SEQ ID NO: 49910 - RNA, 32 nt, Human
agcagucuccacugcaaccacucuggccaagg

SEQ ID NO: 49911 - RNA, 32 nt, Human
agcagucucugccuugccuuuagccccuccca

SEQ ID NO: 49912 - RNA, 32 nt, Human
agcagucucuggucccagcccaccccauggcc

SEQ ID NO: 49913 - RNA, 32 nt, Human
agcagucugggcaacauggugagaccccaucu

SEQ ID NO: 49914 - RNA, 32 nt, Human
agcagucugggcacacacgagcagguggcauc

SEQ ID NO: 49915 - RNA, 32 nt, Human
agcagucuuacuauccacagcaguauaugucu

SEQ ID NO: 49916 - RNA, 32 nt, Human
agcagucuuaguccuugcccugccucaguuua

SEQ ID NO: 49917 - RNA, 18 nt, Human
agcagucuucccaccuca

SEQ ID NO: 49918 - RNA, 32 nt, Human
agcagucuuuacaugcagccuuuuguugcaca

SEQ ID NO: 49919 - RNA, 32 nt, Human
agcagugaaaaguagagguugcccauguggau

SEQ ID NO: 49920 - RNA, 32 nt, Human
agcagugacacucccgucgcucggugaggacg

SEQ ID NO: 49921 - RNA, 31 nt, Human
agcagugaccacagccuuaccaaagcagacg

SEQ ID NO: 49922 - RNA, 32 nt, Human
agcagugacccucccuacucuucuuuuuaaug

SEQ ID NO: 49923 - RNA, 32 nt, Human
agcagugacccucccuucuagucuuuauuuau

SEQ ID NO: 49924 - RNA, 32 nt, Human
agcagugagcugcaggcuuagaggggugacca

SEQ ID NO: 49925 - RNA, 32 nt, Human
agcagugaggaagagaaaagcagagauaagca

SEQ ID NO: 49926 - RNA, 32 nt, Human
agcagugaggagaaugaauaccuuccaagacc

SEQ ID NO: 49927 - RNA, 32 nt, Human
agcagugaggccuucugcccuggccuugggga

SEQ ID NO: 49928 - RNA, 32 nt, Human
agcagugagggaguuaacacagcagcugacuc

SEQ ID NO: 49929 - RNA, 32 nt, Human
agcagugaguguccugaaacaucacagggcuc

SEQ ID NO: 49930 - RNA, 32 nt, Human
agcagugauaaacagagaccacugcagcagcc

SEQ ID NO: 49931 - RNA, 32 nt, Human
agcagugaucacucagccauuuuaccucaccc

SEQ ID NO: 49932 - RNA, 32 nt, Human
agcagugaugcucucaaugggaagaugugcaa

SEQ ID NO: 49933 - RNA, 32 nt, Human
agcagugccaugggacauuucuagguguagag

SEQ ID NO: 49934 - RNA, 32 nt, Human
agcagugcccagccacuaaccugcacaagauc

SEQ ID NO: 49935 - RNA, 32 nt, Human
agcagugccccuggcccaguucugagccaacc

SEQ ID NO: 49936 - RNA, 32 nt, Human
agcagugccuucuugcugcauccucuggagag

SEQ ID NO: 49937 - RNA, 32 nt, Human
agcagugcucacgccuuguaaucccagcacuu

SEQ ID NO: 49938 - RNA, 32 nt, Human
agcagugcucugggaauaaacagcugcccuag

SEQ ID NO: 49939 - RNA, 32 nt, Human
agcagugcugaggagaugccaaggucaggcau

SEQ ID NO: 49940 - RNA, 32 nt, Human
agcagugcugcuuggaaaauagcaaacucaaa

SEQ ID NO: 49941 - RNA, 32 nt, Human
agcagugcuggguggagagagccagaaaacag

SEQ ID NO: 49942 - RNA, 32 nt, Human
agcagugcuguccuuuuguucucuccauugga

SEQ ID NO: 49943 - RNA, 32 nt, Human
agcagugcuucccuccuccacccuccacucau

SEQ ID NO: 49944 - RNA, 32 nt, Human
agcagugcuuuaucucauguccuugaauauag

SEQ ID NO: 49945 - RNA, 32 nt, Human
agcaguggacuacagcucacuaccacacaggc

SEQ ID NO: 49946 - RNA, 32 nt, Human
agcaguggaggccugagggcuugagggaggcu

SEQ ID NO: 49947 - RNA, 32 nt, Human
agcaguggaguugagugaggaggcagaugucc

SEQ ID NO: 49948 - RNA, 32 nt, Human
agcaguggaguuuaaaaauugucucuuuucaa

SEQ ID NO: 49949 - RNA, 32 nt, Human
agcaguggcaaccccuuuuggccagggccagg

SEQ ID NO: 49950 - RNA, 23 nt, Human
agcaguggccacaaggcugcuuu

SEQ ID NO: 49951 - RNA, 25 nt, Human
agcaguggccaggccacccaaagga

SEQ ID NO: 49952 - RNA, 32 nt, Human
agcaguggcccaggaaggaggucaagcaucuu

SEQ ID NO: 49953 - RNA, 32 nt, Human
agcaguggcgccuccuagcucaggacaguggc

SEQ ID NO: 49954 - RNA, 32 nt, Human
agcaguggcuaacaccuguaaucccaacaguu

SEQ ID NO: 49955 - RNA, 32 nt, Human
agcaguggcucacaccuauagucccagcacuc

SEQ ID NO: 49956 - RNA, 32 nt, Human
agcaguggcucacaccuguaaucccaacacuu

SEQ ID NO: 49957 - RNA, 32 nt, Human
agcaguggcucacgccuguaaucccagaacuu

SEQ ID NO: 49958 - RNA, 32 nt, Human
agcaguggcucacgccuguaaucccagcacuu

SEQ ID NO: 49959 - RNA, 32 nt, Human
agcaguggcucaugcccguaaucccagcacuu

SEQ ID NO: 49960 - RNA, 32 nt, Human
agcaguggcucaugccuguaaucccagcacuu

SEQ ID NO: 49961 - RNA, 32 nt, Human
agcaguggcuggggcuuuguuuuuaaauuuug

SEQ ID NO: 49962 - RNA, 32 nt, Human
agcagugggagaccgaggugggcagaucacuu

SEQ ID NO: 49963 - RNA, 32 nt, Human
agcagugggaggagcugucgagucagguacgu

SEQ ID NO: 49964 - RNA, 32 nt, Human
agcagugggaggaggagaaggaggaggaggag

SEQ ID NO: 49965 - RNA, 32 nt, Human
agcagugggcagugagcccccgagaggauaaa

SEQ ID NO: 49966 - RNA, 32 nt, Human
agcagugggcugaagggcuccucaagugcugc

SEQ ID NO: 49967 - RNA, 32 nt, Human
agcagugggugaggccgagggacugcccagag

SEQ ID NO: 49968 - RNA, 32 nt, Human
agcagugguggagaguccccagcugggagacc

SEQ ID NO: 49969 - RNA, 32 nt, Human
agcagugguuccuguuucuagguuguggaucu

SEQ ID NO: 49970 - RNA, 32 nt, Human
agcaguguacagugaagcggaggcagagcggc

SEQ ID NO: 49971 - RNA, 32 nt, Human
agcaguguagugagaagaaagccagacuuaag

SEQ ID NO: 49972 - RNA, 32 nt, Human
agcaguguccagugcaguaccuggaccggagc

SEQ ID NO: 49973 - RNA, 32 nt, Human
agcagugucucccacuccuugugaagucugag

SEQ ID NO: 49974 - RNA, 32 nt, Human
agcagugugaccuugggcaaggccuuccuaag

SEQ ID NO: 49975 - RNA, 32 nt, Human
agcagugugcagagaguguggugggccuggga

SEQ ID NO: 49976 - RNA, 32 nt, Human
agcagugugcuccuagcauacaugcauauagg

SEQ ID NO: 49977 - RNA, 32 nt, Human
agcagugugggaggcaguggggcagguagagc

SEQ ID NO: 49978 - RNA, 32 nt, Human
agcagugugggugggggcgcucuggguggagg

SEQ ID NO: 49979 - RNA, 32 nt, Human
agcaguguggucaccuggauacucgaguauag

SEQ ID NO: 49980 - RNA, 32 nt, Human
agcagugugguguuucaggcagagcucuggcc

SEQ ID NO: 49981 - RNA, 32 nt, Human
agcaguguuaccccuggcugggagucaguauu

SEQ ID NO: 49982 - RNA, 32 nt, Human
agcaguguuccagugugugaacaaaucuuuug

SEQ ID NO: 49983 - RNA, 32 nt, Human
agcaguguuccuggccaucuuugcuacuuucc

SEQ ID NO: 49984 - RNA, 31 nt, Human
agcaguguugcucagcuccuaccucugugcc

SEQ ID NO: 49985 - RNA, 20 nt, Human
agcaguuaacccagaggcca

SEQ ID NO: 49986 - RNA, 32 nt, Human
agcaguuagaaaagcagacucccugugguggc

SEQ ID NO: 49987 - RNA, 25 nt, Human
agcaguuagaaucuaccaggcacag

SEQ ID NO: 49988 - RNA, 32 nt, Human
agcaguucaaagagcagagagguggggccaga

SEQ ID NO: 49989 - RNA, 32 nt, Human
agcaguucaagaccagccugaccaacauggug

SEQ ID NO: 49990 - RNA, 32 nt, Human
agcaguucaagaccagccuggccagcauagug

SEQ ID NO: 49991 - RNA, 32 nt, Human
agcaguucaagaccagccugggcaacacaggg

SEQ ID NO: 49992 - RNA, 32 nt, Human
agcaguucaguuacagcauucucuccauaccc

SEQ ID NO: 49993 - RNA, 22 nt, Human
agcaguucaugauacagccuca

SEQ ID NO: 49994 - RNA, 32 nt, Human
agcaguucauugucaaguuggacuuuaaguga

SEQ ID NO: 49995 - RNA, 20 nt, Human
agcaguuccaauuccucuca

SEQ ID NO: 49996 - RNA, 32 nt, Human
agcaguuccacagcacagccuggucaguccug

SEQ ID NO: 49997 - RNA, 32 nt, Human
agcaguucccaauccuagguauuuaaguggac

SEQ ID NO: 49998 - RNA, 24 nt, Human
agcaguuccggcacggcagcccca

SEQ ID NO: 49999 - RNA, 32 nt, Human
agcaguuccgggagcggauggagaagcagcag

SEQ ID NO: 50000 - RNA, 22 nt, Human
agcaguuccucauucacaucaa

SEQ ID NO: 50001 - RNA, 32 nt, Human
agcaguucgagaccagccugaccaacauggug

SEQ ID NO: 50002 - RNA, 32 nt, Human
agcaguucgagaccagccuggacaacaucgug

SEQ ID NO: 50003 - RNA, 32 nt, Human
agcaguucgagaccagccuggacaacauugug

SEQ ID NO: 50004 - RNA, 32 nt, Human
agcaguucgagaccagccuggccaacauggca

SEQ ID NO: 50005 - RNA, 32 nt, Human
agcaguucgagaccagccuggccaacauggcg

SEQ ID NO: 50006 - RNA, 32 nt, Human
agcaguucgagaccagccugggcaacacagag

SEQ ID NO: 50007 - RNA, 32 nt, Human
agcaguucgagaccagccuggucaacauggug

SEQ ID NO: 50008 - RNA, 32 nt, Human
agcaguucugguuccuccuggccauccgccug

SEQ ID NO: 50009 - RNA, 32 nt, Human
agcaguucuuccccaucagccucccaaguagg

SEQ ID NO: 50010 - RNA, 32 nt, Human
agcaguugagccccgaaggagaucaggcagcc

SEQ ID NO: 50011 - RNA, 32 nt, Human
agcaguugccuguaaucucaacuacuugggag

SEQ ID NO: 50012 - RNA, 32 nt, Human
agcaguugcucccgcacuccaggccugugcua

SEQ ID NO: 50013 - RNA, 32 nt, Human
agcaguuggccacacuguguggagggcaccuc

SEQ ID NO: 50014 - RNA, 32 nt, Human
agcaguuuaguccauacuuugcacugacauac

SEQ ID NO: 50015 - RNA, 31 nt, Human
agcaguuucaggacuucauucauuagugguu

SEQ ID NO: 50016 - RNA, 32 nt, Human
agcaguuucaggacuucauucauuagugguua

SEQ ID NO: 50017 - RNA, 32 nt, Human
agcaguuuccaggaacaucaauguggggaacu

SEQ ID NO: 50018 - RNA, 16 nt, Human
agcaguuucugagcug

SEQ ID NO: 50019 - RNA, 32 nt, Human
agcaguuugagaccagccuggccaacaugaug

SEQ ID NO: 50020 - RNA, 32 nt, Human
agcaguuugagaccagccuggccaacaugccg

SEQ ID NO: 50021 - RNA, 32 nt, Human
agcaguuugagaccagccuggccaacaugcug

SEQ ID NO: 50022 - RNA, 32 nt, Human
agcaguuugagaccagccuggccaacauggca

SEQ ID NO: 50023 - RNA, 32 nt, Human
agcaguuugcuccccuccugaugcccucuggu

SEQ ID NO: 50024 - RNA, 32 nt, Human
agcaguuuuacaucacaugcagccaagaucag

SEQ ID NO: 50025 - RNA, 32 nt, Human
agcaguuuucuggaacucuccaccuccgucuc

SEQ ID NO: 50026 - RNA, 32 nt, Human
agcaguuuugagaagagagggacauaggcuag

SEQ ID NO: 50027 - RNA, 32 nt, Human
agcaguuuuuaaaauaguguaggauaauauaa

SEQ ID NO: 50028 - RNA, 32 nt, Human
agcauaaaauucuuaaaauauauuucagauau

SEQ ID NO: 50029 - RNA, 32 nt, Human
agcauaaagcaaggagguuugaaggaaguucg

SEQ ID NO: 50030 - RNA, 32 nt, Human
agcauaaagcaggggucguggacuccaaggcu

SEQ ID NO: 50031 - RNA, 32 nt, Human
agcauaaauuuagaaaaaucacuucugaccuu

SEQ ID NO: 50032 - RNA, 32 nt, Human
agcauaacuguacuaaauccuuuuaccagauc

SEQ ID NO: 50033 - RNA, 32 nt, Human
agcauaacuguacuaaauccuuuuuccauauc

SEQ ID NO: 50034 - RNA, 32 nt, Human
agcauaacuguacuaaaucuuuuuccagauca

SEQ ID NO: 50035 - RNA, 21 nt, Human
agcauaagaagugguugcuuc

SEQ ID NO: 50036 - RNA, 32 nt, Human
agcauaaucugaaaacaucuagcccaaaggua

SEQ ID NO: 50037 - RNA, 32 nt, Human
agcauaauuccaagguggccaagcagauguca

SEQ ID NO: 50038 - RNA, 31 nt, Human
agcauaauuucugaucuacauuuaaauacua

SEQ ID NO: 50039 - RNA, 32 nt, Human
agcauacacacccauguuccucacucaggaca

SEQ ID NO: 50040 - RNA, 32 nt, Human
agcauacacacguuuuucuagguacagcuccc

SEQ ID NO: 50041 - RNA, 32 nt, Human
agcauacacagaugaaggugggaaggaugguc

SEQ ID NO: 50042 - RNA, 32 nt, Human
agcauaccgugcaacaguucugggaaaugcca

SEQ ID NO: 50043 - RNA, 32 nt, Human
agcauacuauaauuuuaauuguccucacuuuu

SEQ ID NO: 50044 - RNA, 32 nt, Human
agcauacugucacgccuguaaucccaguacuu

SEQ ID NO: 50045 - RNA, 32 nt, Human
agcauacuuggccucccccaccucccugcccu

SEQ ID NO: 50046 - RNA, 32 nt, Human
agcauacuuuaaaggccacuguugcaaagucu

SEQ ID NO: 50047 - RNA, 20 nt, Human
agcauagaacugauacuuga

SEQ ID NO: 50048 - RNA, 32 nt, Human
agcauagaagcggacaccagaggcuccuggac

SEQ ID NO: 50049 - RNA, 32 nt, Human
agcauagaaguuaagaaugaagaucagauuca

SEQ ID NO: 50050 - RNA, 32 nt, Human
agcauagagcuuucuccgcagcauccugccug

SEQ ID NO: 50051 - RNA, 19 nt, Human
agcauagaucuugacuuga

SEQ ID NO: 50052 - RNA, 32 nt, Human
agcauagauucacaauaggagcaacuuucaaa

SEQ ID NO: 50053 - RNA, 32 nt, Human
agcauagauucuauuuacaaaauguuuguuua

SEQ ID NO: 50054 - RNA, 21 nt, Human
agcauagauugucaaauguaa

SEQ ID NO: 50055 - RNA, 32 nt, Human
agcauagcauacugccuucugacagacugggu

SEQ ID NO: 50056 - RNA, 32 nt, Human
agcauagccaagggacguugaccuggacugaa

SEQ ID NO: 50057 - RNA, 32 nt, Human
agcauagccacacccauucauuuaugguauug

SEQ ID NO: 50058 - RNA, 32 nt, Human
agcauagccagcucccccuccuucaccuagug

SEQ ID NO: 50059 - RNA, 32 nt, Human
agcauaggcugcauaugagucuuuaacaucuu

SEQ ID NO: 50060 - RNA, 32 nt, Human
agcauagggaccucagggauggggaagaaacc

SEQ ID NO: 50061 - RNA, 32 nt, Human
agcauaguaagugcuuucuuucuuuuuaagcu

SEQ ID NO: 50062 - RNA, 32 nt, Human
agcauagucuagaggcuggaggggcucuguga

SEQ ID NO: 50063 - RNA, 32 nt, Human
agcauagucucugcaagauuuuguucuuugaa

SEQ ID NO: 50064 - RNA, 32 nt, Human
agcauaguguauaagugaguacacucuaauua

SEQ ID NO: 50065 - RNA, 32 nt, Human
agcauaguuucuuaagacagaggccauuuggu

SEQ ID NO: 50066 - RNA, 32 nt, Human
agcauauaaaaaggcauguuuggaaagcaaca

SEQ ID NO: 50067 - RNA, 32 nt, Human
agcauauaucggagccacacauggacaccucu

SEQ ID NO: 50068 - RNA, 32 nt, Human
agcauaucuaauaucuagguuacuugagagac

SEQ ID NO: 50069 - RNA, 32 nt, Human
agcauaugcauacacacauauauacauguaua

SEQ ID NO: 50070 - RNA, 21 nt, Human
agcauaugccaaugccaaaaa

SEQ ID NO: 50071 - RNA, 32 nt, Human
agcauaugccuguggucccagcuacugaggag

SEQ ID NO: 50072 - RNA, 32 nt, Human
agcauauggaaagaugggaacagaauuucagu

SEQ ID NO: 50073 - RNA, 21 nt, Human
agcauauguaaccucuccaaa

SEQ ID NO: 50074 - RNA, 32 nt, Human
agcauauguguauguaugcguauguauguaug

SEQ ID NO: 50075 - RNA, 32 nt, Human
agcauauuccccucagucuucuaggagggcag

SEQ ID NO: 50076 - RNA, 32 nt, Human
agcauauucucuaaaugagauauuguguggcu

SEQ ID NO: 50077 - RNA, 23 nt, Human
agcauauugcaacacauguucuu

SEQ ID NO: 50078 - RNA, 32 nt, Human
agcauauugugguaaauuuucucccaaaacuu

SEQ ID NO: 50079 - RNA, 32 nt, Human
agcauauuuacaccaauuauuuuauguaaucc

SEQ ID NO: 50080 - RNA, 32 nt, Human
agcauauuucccaaucauugucuucauuccac

SEQ ID NO: 50081 - RNA, 32 nt, Human
agcaucaaaaugucaagauucaucagcucuuc

SEQ ID NO: 50082 - RNA, 32 nt, Human
agcaucaacaggcuguccagaucaauuggcac

SEQ ID NO: 50083 - RNA, 32 nt, Human
agcaucaagccuuggccucucggaggccucug

SEQ ID NO: 50084 - RNA, 32 nt, Human
agcaucaaggccagaggaggccacaugcugac

SEQ ID NO: 50085 - RNA, 23 nt, Human
agcaucaaugcacacaccugcug

SEQ ID NO: 50086 - RNA, 32 nt, Human
agcaucacauaaaaaugaugggacaauaaauu

SEQ ID NO: 50087 - RNA, 32 nt, Human
agcaucacaucaacuaaugaccaacuguaaug

SEQ ID NO: 50088 - RNA, 32 nt, Human
agcaucaccacugugguguguugccccuugag

SEQ ID NO: 50089 - RNA, 31 nt, Human
agcaucaccagcuagaaaguggcagagccag

SEQ ID NO: 50090 - RNA, 32 nt, Human
agcaucaccucaggccaggugcaguggcucac

SEQ ID NO: 50091 - RNA, 32 nt, Human
agcaucaccucuaucugccucaucucacacug

SEQ ID NO: 50092 - RNA, 32 nt, Human
agcaucagaggagcacaugaaccgaaugcuuc

SEQ ID NO: 50093 - RNA, 32 nt, Human
agcaucagagggcugauggauuccaaaccagg

SEQ ID NO: 50094 - RNA, 32 nt, Human
agcaucagauggggaaaggcaguucuccucua

SEQ ID NO: 50095 - RNA, 32 nt, Human
agcaucagcaacccuuuccagguagaaauucc

SEQ ID NO: 50096 - RNA, 21 nt, Human
agcaucagcaugguuuagggg

SEQ ID NO: 50097 - RNA, 32 nt, Human
agcaucagcugcgucuuccauguggccugggg

SEQ ID NO: 50098 - RNA, 32 nt, Human
agcaucagcuucagccccagacccugcaguuu

SEQ ID NO: 50099 - RNA, 32 nt, Human
agcaucaggaagggaaaggccugcaucuugug

SEQ ID NO: 50100 - RNA, 32 nt, Human
agcaucagggcugcucucugaggagcugcccc

SEQ ID NO: 50101 - RNA, 32 nt, Human
agcaucaguccagucugugguguccuggcacu

SEQ ID NO: 50102 - RNA, 32 nt, Human
agcaucagucuacaccaacaccaugcgggguu

SEQ ID NO: 50103 - RNA, 32 nt, Human
agcaucauaagccacaggguggggcagccaag

SEQ ID NO: 50104 - RNA, 32 nt, Human
agcaucauaagggaauguagccuuccaacaga

SEQ ID NO: 50105 - RNA, 32 nt, Human
agcaucauccuuuccccuccccucucuuccuc

SEQ ID NO: 50106 - RNA, 21 nt, Human
agcaucauggagacccgcagg

SEQ ID NO: 50107 - RNA, 32 nt, Human
agcaucauuaagaucaguuuuaagggguauag

SEQ ID NO: 50108 - RNA, 26 nt, Human
agcaucauuacaauacaguauuucuu

SEQ ID NO: 50109 - RNA, 32 nt, Human
agcauccacaucaacauucaccagcuagaaau

SEQ ID NO: 50110 - RNA, 32 nt, Human
agcauccagcaagucaaugucaccgacaguga

SEQ ID NO: 50111 - RNA, 32 nt, Human
agcauccaggaaccccagagcaggcaguggau

SEQ ID NO: 50112 - RNA, 32 nt, Human
agcauccaggacaacaauguggaccugauucu

SEQ ID NO: 50113 - RNA, 32 nt, Human
agcauccaggcagguauuagugcccagugaug

SEQ ID NO: 50114 - RNA, 19 nt, Human
agcauccaggcgguucuga

SEQ ID NO: 50115 - RNA, 23 nt, Human
agcauccaggcugaccucaagga

SEQ ID NO: 50116 - RNA, 32 nt, Human
agcauccaguggcugcuggcauacagccucau

SEQ ID NO: 50117 - RNA, 32 nt, Human
agcauccaucaucaucgucgucugucaaugau

SEQ ID NO: 50118 - RNA, 32 nt, Human
agcauccauguucacuuauggcugguuuugcu

SEQ ID NO: 50119 - RNA, 32 nt, Human
agcauccauucauauauucauucagucagcua

SEQ ID NO: 50120 - RNA, 32 nt, Human
agcauccauuuugccaauuuuaaagacauucu

SEQ ID NO: 50121 - RNA, 32 nt, Human
agcaucccaaagugcugggauuacaggcauga

SEQ ID NO: 50122 - RNA, 32 nt, Human
agcaucccaaaguguugggauuacagccguga

SEQ ID NO: 50123 - RNA, 32 nt, Human
agcaucccaagacuggaccugggagacccuga

SEQ ID NO: 50124 - RNA, 32 nt, Human
agcaucccaaguagcugggauaacaggugcca

SEQ ID NO: 50125 - RNA, 32 nt, Human
agcaucccaaguagcugggauuacaggcaccc

SEQ ID NO: 50126 - RNA, 32 nt, Human
agcaucccaauuuagaaaacagaggaguuugu

SEQ ID NO: 50127 - RNA, 32 nt, Human
agcaucccagagagacaguaggaaauuucucc

SEQ ID NO: 50128 - RNA, 32 nt, Human
agcaucccagggcuuugugcagucucuaauuc

SEQ ID NO: 50129 - RNA, 23 nt, Human
agcauccccaccccaccccuccu

SEQ ID NO: 50130 - RNA, 32 nt, Human
agcauccccaccccucuccucugcccacccga

SEQ ID NO: 50131 - RNA, 32 nt, Human
agcauccccagcugccccacaucuugccucug

SEQ ID NO: 50132 - RNA, 32 nt, Human
agcaucccccagcugcucccaucuugcuggaa

SEQ ID NO: 50133 - RNA, 32 nt, Human
agcauccccuccacuccagaguuggguggcac

SEQ ID NO: 50134 - RNA, 32 nt, Human
agcauccccuccacuccagaguugggugguac

SEQ ID NO: 50135 - RNA, 17 nt, Human
agcauccccuccaggga

SEQ ID NO: 50136 - RNA, 32 nt, Human
agcauccccucggggcagucagcccaacugag

SEQ ID NO: 50137 - RNA, 32 nt, Human
agcccuuccuccucugggggccugggcaucag

SEQ ID NO: 50138 - RNA, 24 nt, Human
agcccuuccugaucccccagcuga

SEQ ID NO: 50139 - RNA, 32 nt, Human
agcccuuccugcagggaaccucaggcuucaga

SEQ ID NO: 50140 - RNA, 18 nt, Human
agcccuuccuggcuccca

SEQ ID NO: 50141 - RNA, 32 nt, Human
agcccuucucccacugugcuggcagaggcacu

SEQ ID NO: 50142 - RNA, 32 nt, Human
agcccuucuccuccaccaguuccccagagcag

SEQ ID NO: 50143 - RNA, 32 nt, Human
agcccuucuccuccccuggcucuuagggcacc

SEQ ID NO: 50144 - RNA, 32 nt, Human
agcccuucugcccuuaaaugcuuccuugggca

SEQ ID NO: 50145 - RNA, 32 nt, Human
agcccuucugccuuuugcugguguuucuggaa

SEQ ID NO: 50146 - RNA, 32 nt, Human
agcccuucuucagacacggcuacuucugcuuc

SEQ ID NO: 50147 - RNA, 32 nt, Human
agcccuucuuucuacuuugucaaacaguucuu

SEQ ID NO: 50148 - RNA, 32 nt, Human
agcccuugaacuugaguaaauaacaacucccu

SEQ ID NO: 50149 - RNA, 32 nt, Human
agcccuugaaucugagaaucccccaguuaaga

SEQ ID NO: 50150 - RNA, 18 nt, Human
agcccuugagcccccaga

SEQ ID NO: 50151 - RNA, 32 nt, Human
agcccuugaggcagaggugccgagugacugcc

SEQ ID NO: 50152 - RNA, 32 nt, Human
agcccuugcauccagggcucucaagaggcaaa

SEQ ID NO: 50153 - RNA, 32 nt, Human
agcccuugccuccgagcucuggcuucaagggg

SEQ ID NO: 50154 - RNA, 32 nt, Human
agcccuuggcucugcuggguuuccugacugua

SEQ ID NO: 50155 - RNA, 20 nt, Human
agcccuugggacuccaggag

SEQ ID NO: 50156 - RNA, 32 nt, Human
agcccuuggguggggccaggaggaggugaugg

SEQ ID NO: 50157 - RNA, 32 nt, Human
agcccuugguagagcuugaaccaccuucuaua

SEQ ID NO: 50158 - RNA, 32 nt, Human
agcccuugugugugcaggggugcacauguuug

SEQ ID NO: 50159 - RNA, 32 nt, Human
agcccuuguucacgagaagcaagaagcccccu

SEQ ID NO: 50160 - RNA, 32 nt, Human
agcccuuucaaccaugagauagugggauuuaa

SEQ ID NO: 50161 - RNA, 32 nt, Human
agcccuuuccagcacuguuggucugaugaaca

SEQ ID NO: 50162 - RNA, 32 nt, Human
agcccuuucccaggcgguagcgggggcagugg

SEQ ID NO: 50163 - RNA, 32 nt, Human
agcccuuucucaggguuggacccccugagauc

SEQ ID NO: 50164 - RNA, 17 nt, Human
agcccuuucuccccaca

SEQ ID NO: 50165 - RNA, 32 nt, Human
agcccuuucuguagugggggaaagguggcugg

SEQ ID NO: 50166 - RNA, 32 nt, Human
agcccuuucuugccucuccagugcuauuuucc

SEQ ID NO: 50167 - RNA, 32 nt, Human
agcccuuugcccugucccugcugccugaggug

SEQ ID NO: 50168 - RNA, 32 nt, Human
agcccuuugccuguagagccagccuugguugg

SEQ ID NO: 50169 - RNA, 32 nt, Human
agcccuuugcuccccuggcgacugccuggaca

SEQ ID NO: 50170 - RNA, 22 nt, Human
agcccuuugggaggcugaggcg

SEQ ID NO: 50171 - RNA, 32 nt, Human
agcccuuugucagaugaguagguugcgaaaau

SEQ ID NO: 50172 - RNA, 32 nt, Human
agcccuuuguguguaauagcccccaggggugg

SEQ ID NO: 50173 - RNA, 32 nt, Human
agcccuuuuagauuuuggcacugugaaacccc

SEQ ID NO: 50174 - RNA, 32 nt, Human
agccgaaauuacagacgugugccaccaugcuu

SEQ ID NO: 50175 - RNA, 32 nt, Human
agccgaacuuugaguuacugugcaagauuuuu

SEQ ID NO: 50176 - RNA, 32 nt, Human
agccgaaggaguaaggugcugcaaugauguua

SEQ ID NO: 50177 - RNA, 32 nt, Human
agccgacacuccugaccucucuguucacccug

SEQ ID NO: 50178 - RNA, 21 nt, Human
agccgaccaagaucccucccu

SEQ ID NO: 50179 - RNA, 21 nt, Human
agccgacccccaugcccggca

SEQ ID NO: 50180 - RNA, 32 nt, Human
agccgaccuccaccuccuccuccuccuucucc

SEQ ID NO: 50181 - RNA, 32 nt, Human
agccgaccuugccuaccagcuccugggugucc

SEQ ID NO: 50182 - RNA, 32 nt, Human
agccgacgacgucuguggagugcauugugcac

SEQ ID NO: 50183 - RNA, 32 nt, Human
agccgacucacuugcaacuccaccucagcagu

SEQ ID NO: 50184 - RNA, 22 nt, Human
agccgacucgcagggccugcuc

SEQ ID NO: 50185 - RNA, 32 nt, Human
agccgacucugggugcggacugugggagcuga

SEQ ID NO: 50186 - RNA, 32 nt, Human
agccgacugcaugaaccaaaguucucaccuaa

SEQ ID NO: 50187 - RNA, 32 nt, Human
agccgagaaggaggaggaggagagaggaaaga

SEQ ID NO: 50188 - RNA, 32 nt, Human
agccgagacacugccaccuccacauagcucuc

SEQ ID NO: 50189 - RNA, 32 nt, Human
agccgagaccauaccacugcauuccagccugg

SEQ ID NO: 50190 - RNA, 22 nt, Human
agccgagaccccggggcucugc

SEQ ID NO: 50191 - RNA, 32 nt, Human
agccgagacugugcuccagccugggcgacaga

SEQ ID NO: 50192 - RNA, 32 nt, Human
agccgagagcaggagucggcucugaguucccu

SEQ ID NO: 50193 - RNA, 32 nt, Human
agccgagagccgggggcagacgggcggggguu

SEQ ID NO: 50194 - RNA, 32 nt, Human
agccgagaggaagggagggcagcucgggccga

SEQ ID NO: 50195 - RNA, 32 nt, Human
agccgagaggagcugggcugaaucuccaggcg

SEQ ID NO: 50196 - RNA, 32 nt, Human
agccgagaucacaccauugcacugcagccugg

SEQ ID NO: 50197 - RNA, 32 nt, Human
agccgagaucacgccaucacacugcagccuag

SEQ ID NO: 50198 - RNA, 32 nt, Human
agccgagaucauaccacugcacuccagccugg

SEQ ID NO: 50199 - RNA, 32 nt, Human
agccgagaucauaccauugcacuccagccuag

SEQ ID NO: 50200 - RNA, 32 nt, Human
agccgagaucauaccauugcacuccagccugg

SEQ ID NO: 50201 - RNA, 32 nt, Human
agccgagaucgcgccaccacacuccagccuga

SEQ ID NO: 50202 - RNA, 23 nt, Human
agccgagaucgcgcuacugcacu

SEQ ID NO: 50203 - RNA, 32 nt, Human
agccgagauuacuccagccuaggcaacagagc

SEQ ID NO: 50204 - RNA, 32 nt, Human
agccgagauuaugucacuccagccugggcaac

SEQ ID NO: 50205 - RNA, 23 nt, Human
agccgagauugcaccacugcacu

SEQ ID NO: 50206 - RNA, 32 nt, Human
agccgagauugcgcuacugaacuccagccugg

SEQ ID NO: 50207 - RNA, 32 nt, Human
agccgagauugugcacuccagccuggguaaca

SEQ ID NO: 50208 - RNA, 32 nt, Human
agccgagauugugccacugaacuccaaccugc

SEQ ID NO: 50209 - RNA, 32 nt, Human
agccgagcagaggggccgccuccgcccgcacc

SEQ ID NO: 50210 - RNA, 32 nt, Human
agccgagcagccuggcaacggcgguggcgccc

SEQ ID NO: 50211 - RNA, 32 nt, Human
agccgagcgcagggggcggggaagggaccugc

SEQ ID NO: 50212 - RNA, 32 nt, Human
agccgaggaaggggagaaagccacaaccuuca

SEQ ID NO: 50213 - RNA, 32 nt, Human
agccgaggaccaucucugccacccuggcaccu

SEQ ID NO: 50214 - RNA, 23 nt, Human
agccgaggagcccggagccccgc

SEQ ID NO: 50215 - RNA, 32 nt, Human
agccgaggaguuugagucugcagugagcuaug

SEQ ID NO: 50216 - RNA, 32 nt, Human
agccgaggcauuccagccugggcaacagagug

SEQ ID NO: 50217 - RNA, 19 nt, Human
agccgaggccagcccugcc

SEQ ID NO: 50218 - RNA, 21 nt, Human
agccgaggcccggccccgccg

SEQ ID NO: 50219 - RNA, 32 nt, Human
agccgaggccucggaagcagguuuuucccaga

SEQ ID NO: 50220 - RNA, 32 nt, Human
agccgaggcuucuuccucugaacuuuugggcc

SEQ ID NO: 50221 - RNA, 24 nt, Human
agccgagggaacaagccccaaccg

SEQ ID NO: 50222 - RNA, 32 nt, Human
agccgagggcaagaagagaacaaggacccucu

SEQ ID NO: 50223 - RNA, 23 nt, Human
agccgaggggcucuggagugccu

SEQ ID NO: 50224 - RNA, 32 nt, Human
agccgaggggguggggguugcagugagccaag

SEQ ID NO: 50225 - RNA, 32 nt, Human
agccgagguggcgcggcggcaccagcuccagg

SEQ ID NO: 50226 - RNA, 32 nt, Human
agccgagucacaggacccggauguugucaguu

SEQ ID NO: 50227 - RNA, 32 nt, Human
agccgagugcucauggaguuuccucaaagacu

SEQ ID NO: 50228 - RNA, 32 nt, Human
agccgagugugcuggggucuccgaagaggguc

SEQ ID NO: 50229 - RNA, 32 nt, Human
agccgagugugggaacaguccagcccuggcau

SEQ ID NO: 50230 - RNA, 21 nt, Human
agccgaucgugccacugcacu

SEQ ID NO: 50231 - RNA, 32 nt, Human
agccgaucucuaggcccuucuugcacugccac

SEQ ID NO: 50232 - RNA, 32 nt, Human
agccgauggagcgugguguagcagaacagcuc

SEQ ID NO: 50233 - RNA, 30 nt, Human
agccgauggcaucuccgggcucuggcuuuu

SEQ ID NO: 50234 - RNA, 32 nt, Human
agccgaugggcccuggaggcagcccauuaaag

SEQ ID NO: 50235 - RNA, 32 nt, Human
agccgauggggaggggauggagaaacaagaca

SEQ ID NO: 50236 - RNA, 30 nt, Human
agccgauggggagggggaggaggaugcuaa

SEQ ID NO: 50237 - RNA, 32 nt, Human
agccgauggggcccugagcaggacgugccucu

SEQ ID NO: 50238 - RNA, 32 nt, Human
agccgauucauguacugaugccaaucagcuag

SEQ ID NO: 50239 - RNA, 32 nt, Human
agccgauuugugcugcucucagcagccaccgg

SEQ ID NO: 50240 - RNA, 32 nt, Human
agccgauuuuguguuaaaauguugacaacagc

SEQ ID NO: 50241 - RNA, 32 nt, Human
agccgcaauacugaugaagcugagaagcagcc

SEQ ID NO: 50242 - RNA, 22 nt, Human
agccgcacagcccuccccuccu

SEQ ID NO: 50243 - RNA, 32 nt, Human
agccgcacagcccuccccuccugcgcuggaaa

SEQ ID NO: 50244 - RNA, 32 nt, Human
agccgcacagucggaggaagggccggagcgag

SEQ ID NO: 50245 - RNA, 32 nt, Human
agccgcacaugcagcacacaggucugcagagu

SEQ ID NO: 50246 - RNA, 32 nt, Human
agccgcaccccuccacccccacccugcccacg

SEQ ID NO: 50247 - RNA, 32 nt, Human
agccgcacccgagaggagguguggguguuccg

SEQ ID NO: 50248 - RNA, 32 nt, Human
agccgcaccuggagaagcugacccugggcauc

SEQ ID NO: 50249 - RNA, 32 nt, Human
agccgcacuguuuuacaagugaagaguuaugc

SEQ ID NO: 50250 - RNA, 22 nt, Human
agccgcagaagggaguccacuc

SEQ ID NO: 50251 - RNA, 32 nt, Human
agccgcagacugaaggcugcacugugagccuc

SEQ ID NO: 50252 - RNA, 32 nt, Human
agccgcagagggccugggcacgccauccgucc

SEQ ID NO: 50253 - RNA, 32 nt, Human
agccgcagccaaguagagggggcugggccgcg

SEQ ID NO: 50254 - RNA, 21 nt, Human
agccgcagccaccagccgccc

SEQ ID NO: 50255 - RNA, 22 nt, Human
agccgcagccagccccucccgc

SEQ ID NO: 50256 - RNA, 24 nt, Human
agccgcagccaggcgaggccacuc

SEQ ID NO: 50257 - RNA, 32 nt, Human
agccgcagccccugugcacaccuaacacaggg

SEQ ID NO: 50258 - RNA, 20 nt, Human
agccgcagcccgccgcgcgc

SEQ ID NO: 50259 - RNA, 21 nt, Human
agccgcagccgccgcccccuc

SEQ ID NO: 50260 - RNA, 32 nt, Human
agccgcagccuccucgugauccucccuagcau

SEQ ID NO: 50261 - RNA, 32 nt, Human
agccgcagccuucuggaagcuccaggcggucu

SEQ ID NO: 50262 - RNA, 21 nt, Human
agccgcagcgcagaggcccgc

SEQ ID NO: 50263 - RNA, 32 nt, Human
agccgcagcugcaggaguccugcccgcccaga

SEQ ID NO: 50264 - RNA, 32 nt, Human
agccgcaggaggaaggagguugugcagggucu

SEQ ID NO: 50265 - RNA, 32 nt, Human
agccgcaggaggaggaggaggucgucgggggc

SEQ ID NO: 50266 - RNA, 32 nt, Human
agccgcagggcugagaccacguccaugcuggc

SEQ ID NO: 50267 - RNA, 32 nt, Human
agccgccaacagcagcgcuguuagugagcuaa

SEQ ID NO: 50268 - RNA, 20 nt, Human
agccgccaagugauuuucuc

SEQ ID NO: 50269 - RNA, 22 nt, Human
agccgccacacccugggccugg

SEQ ID NO: 50270 - RNA, 21 nt, Human
agccgccaccgccgcugccgc

SEQ ID NO: 50271 - RNA, 31 nt, Human
agccgccagcucucuggguauguuccuugca

SEQ ID NO: 50272 - RNA, 32 nt, Human
agccgccaggagcguugcuucucaaccuagga

SEQ ID NO: 50273 - RNA, 22 nt, Human
agccgccaucacuucaggccgc

SEQ ID NO: 50274 - RNA, 32 nt, Human
agccgcccaaaguguugggauuacaggcauga

SEQ ID NO: 50275 - RNA, 32 nt, Human
agccgcccaaguaucugggaccacaggcgugc

SEQ ID NO: 50276 - RNA, 32 nt, Human
agccgcccaccagguugccaggaggaggcggg

SEQ ID NO: 50277 - RNA, 32 nt, Human
agccgcccacggucuguucucagauuccuaau

SEQ ID NO: 50278 - RNA, 32 nt, Human
agccgcccaggccuuuagggagggaggguuuc

SEQ ID NO: 50279 - RNA, 32 nt, Human
agccgcccauugaucguguccugugcugaaga

SEQ ID NO: 50280 - RNA, 32 nt, Human
agccgccccaucugccccacagucuccggccu

SEQ ID NO: 50281 - RNA, 32 nt, Human
agccgcccccaccccauaccuugaucuaccau

SEQ ID NO: 50282 - RNA, 32 nt, Human
agccgccccucuccuccugggcugcagagcca

SEQ ID NO: 50283 - RNA, 32 nt, Human
agccgcccgccaccccagaggggugccagaug

SEQ ID NO: 50284 - RNA, 32 nt, Human
agccgcccgcccaccugggccugggccccggu

SEQ ID NO: 50285 - RNA, 32 nt, Human
agccgcccgcugaggucagaaggaggcgucug

SEQ ID NO: 50286 - RNA, 22 nt, Human
agccgcccgugccuccaggggc

SEQ ID NO: 50287 - RNA, 31 nt, Human
agccgcccugagagagaauagagcugccacu

SEQ ID NO: 50288 - RNA, 32 nt, Human
agccgccgagacugcagggagccuggccccgg

SEQ ID NO: 50289 - RNA, 32 nt, Human
agccgccgccgcuggccagggugcuggacaag

SEQ ID NO: 50290 - RNA, 23 nt, Human
agccgccgcgccgagcauggcca

SEQ ID NO: 50291 - RNA, 32 nt, Human
agccgccgcgggccugcugagcuccggagcgc

SEQ ID NO: 50292 - RNA, 32 nt, Human
agccgccggccuccggccuccugggccccucc

SEQ ID NO: 50293 - RNA, 32 nt, Human
agccgccggcugccccucgcucccaggcgcca

SEQ ID NO: 50294 - RNA, 23 nt, Human
agccgccgugaugagcacagcca

SEQ ID NO: 50295 - RNA, 22 nt, Human
agccgccgugccggggccgcca

SEQ ID NO: 50296 - RNA, 24 nt, Human
agccgccguggaguaacacagcca

SEQ ID NO: 50297 - RNA, 32 nt, Human
agccgccucacaggucggcggacgggccaggc

SEQ ID NO: 50298 - RNA, 32 nt, Human
agccgccuccggaaugcacaggcgagucccug

SEQ ID NO: 50299 - RNA, 20 nt, Human
agccgccucgcuccucuuca

SEQ ID NO: 50300 - RNA, 32 nt, Human
agccgccucggggaugagaggggacucguggg

SEQ ID NO: 50301 - RNA, 32 nt, Human
agccgccugaguagcugcacuauaggcaccac

SEQ ID NO: 50302 - RNA, 32 nt, Human
agccgccugaguagcugggaccacaguuucag

SEQ ID NO: 50303 - RNA, 32 nt, Human
agccgccugcagagccggaagccacccaaccu

SEQ ID NO: 50304 - RNA, 32 nt, Human
agccgccugcagcggggcccuccugaggcccc

SEQ ID NO: 50305 - RNA, 32 nt, Human
agccgccugccugcccugcucugcggcugugg

SEQ ID NO: 50306 - RNA, 20 nt, Human
agccgccuuucucggaacug

SEQ ID NO: 50307 - RNA, 32 nt, Human
agccgcgacuccuggcccugagcccgggcuua

SEQ ID NO: 50308 - RNA, 32 nt, Human
agccgcgagcccagggaugggagcacgcgggg

SEQ ID NO: 50309 - RNA, 32 nt, Human
agccgcgagguggacggggcgguggggccugc

SEQ ID NO: 50310 - RNA, 32 nt, Human
agccgcgauugcaccaccacacuccagccugc

SEQ ID NO: 50311 - RNA, 32 nt, Human
agccgcgccagcugccgggacacugcugccag

SEQ ID NO: 50312 - RNA, 32 nt, Human
agccgcgcucccaccacccacacccaccgcgc

SEQ ID NO: 50313 - RNA, 32 nt, Human
agccgcgcuugcagcgucugggagaaucuuuc

SEQ ID NO: 50314 - RNA, 32 nt, Human
agccgcggccgcggccacagucaugcucaguc

SEQ ID NO: 50315 - RNA, 19 nt, Human
agccgcggcggccgagggg

SEQ ID NO: 50316 - RNA, 32 nt, Human
agccgcggcucgcgccuuucuuggccuccggg

SEQ ID NO: 50317 - RNA, 32 nt, Human
agccgcgggaccagcgccugaggugccccgga

SEQ ID NO: 50318 - RNA, 32 nt, Human
agccgcgggccgcugggaacuccacucgggga

SEQ ID NO: 50319 - RNA, 32 nt, Human
agccgcgggucccugugaaccggcacauuccu

SEQ ID NO: 50320 - RNA, 32 nt, Human
agccgcgggucggaaggaaggacguggggagc

SEQ ID NO: 50321 - RNA, 32 nt, Human
agccgcuaguccccucccuccugggggagcag

SEQ ID NO: 50322 - RNA, 32 nt, Human
agccgcucauagaccccgccugccguccgguc

SEQ ID NO: 50323 - RNA, 22 nt, Human
agccgcucccggagcccggccg

SEQ ID NO: 50324 - RNA, 32 nt, Human
agccgcuccugguucuggagucuuaggagguu

SEQ ID NO: 50325 - RNA, 32 nt, Human
agccgcucuccucugacggguccugccucagu

SEQ ID NO: 50326 - RNA, 32 nt, Human
agccgcucugcccgcugaccugagugcuucuc

SEQ ID NO: 50327 - RNA, 31 nt, Human
agccgcucuguaaauccuuguugaaagaaug

SEQ ID NO: 50328 - RNA, 32 nt, Human
agccgcucugugcaucccaggcugcccuguua

SEQ ID NO: 50329 - RNA, 32 nt, Human
agccgcugagcccagaggucccgcuggccccu

SEQ ID NO: 50330 - RNA, 21 nt, Human
agccgcugcaaaaucaugcca

SEQ ID NO: 50331 - RNA, 32 nt, Human
agccgcugcagccaccaccgccaccauguccu

SEQ ID NO: 50332 - RNA, 32 nt, Human
agccgcugccaaggacagagccccagaauaac

SEQ ID NO: 50333 - RNA, 32 nt, Human
agccgcugcccaggggaguggcuguggggagg

SEQ ID NO: 50334 - RNA, 16 nt, Human
agccgcugcugagcug

SEQ ID NO: 50335 - RNA, 32 nt, Human
agccgcuggcucccagccuggcugaagcgggg

SEQ ID NO: 50336 - RNA, 32 nt, Human
agccgcugggcccagccugguuaucucuguuu

SEQ ID NO: 50337 - RNA, 32 nt, Human
agccgcuggugcaguggcauagcagguggcag

SEQ ID NO: 50338 - RNA, 32 nt, Human
agccgcugugggcuccuggggagauggagggg

SEQ ID NO: 50339 - RNA, 32 nt, Human
agccgcuguugccucccagccccugcuagcug

SEQ ID NO: 50340 - RNA, 32 nt, Human
agccgcuuccggauggcucuucccaagggagg

SEQ ID NO: 50341 - RNA, 32 nt, Human
agccgcuuccucuccacugaagagcuaugaga

SEQ ID NO: 50342 - RNA, 32 nt, Human
agccgcuucugcgaggaggacgaggcggcgcu

SEQ ID NO: 50343 - RNA, 32 nt, Human
agccgcuugccucugugagcuuucuaggccug

SEQ ID NO: 50344 - RNA, 32 nt, Human
agccggaaccacuccugguucagagaggcagc

SEQ ID NO: 50345 - RNA, 32 nt, Human
agccggaauaucuaaaugccucuccuuggcga

SEQ ID NO: 50346 - RNA, 32 nt, Human
agccggaccagccuugggcaacagcgugcgac

SEQ ID NO: 50347 - RNA, 21 nt, Human
agccggagccggagccccaca

SEQ ID NO: 50348 - RNA, 19 nt, Human
agccggagcggcgggcuga

SEQ ID NO: 50349 - RNA, 32 nt, Human
agccggagcuaguggaagacucugccucaccu

SEQ ID NO: 50350 - RNA, 32 nt, Human
agccggaggagcccucagacagcaguggcauc

SEQ ID NO: 50351 - RNA, 32 nt, Human
agccggaggaggaggaggaggaggaggcaaag

SEQ ID NO: 50352 - RNA, 32 nt, Human
agccggaggaucgcggagucccaaugaaacgg

SEQ ID NO: 50353 - RNA, 32 nt, Human
agccggaggcugcaggaugaugcgguucaugc

SEQ ID NO: 50354 - RNA, 17 nt, Human
agccggagucugaacug

SEQ ID NO: 50355 - RNA, 32 nt, Human
agccggagugaucucugcuuagggugguuuga

SEQ ID NO: 50356 - RNA, 32 nt, Human
agccggaguuggccugaacuuuaggaaaugag

SEQ ID NO: 50357 - RNA, 27 nt, Human
agccggauaccucuggcccccacccca

SEQ ID NO: 50358 - RNA, 32 nt, Human
agccggauccccucagccuuccagguccucaa

SEQ ID NO: 50359 - RNA, 32 nt, Human
agccggaucuccccaucuccccuacucacucu

SEQ ID NO: 50360 - RNA, 32 nt, Human
agccggcaagagaagaaaggcuaccaggacag

SEQ ID NO: 50361 - RNA, 32 nt, Human
agccggcacagggucugcucuuucucugccag

SEQ ID NO: 50362 - RNA, 32 nt, Human
agccggcagggaggggccgcggcggagccuua

SEQ ID NO: 50363 - RNA, 32 nt, Human
agccggcaguaagcccagaggucuccacccca

SEQ ID NO: 50364 - RNA, 23 nt, Human
agccggcauuccuccaggaccug

SEQ ID NO: 50365 - RNA, 32 nt, Human
agccggccaccagucccggcagagccacuagg

SEQ ID NO: 50366 - RNA, 32 nt, Human
agccggccagacucucaucuugaugucuugau

SEQ ID NO: 50367 - RNA, 32 nt, Human
agccggccauggaagguaauggccccgcugcu

SEQ ID NO: 50368 - RNA, 32 nt, Human
agccggcccagcgggagccaggucagggccug

SEQ ID NO: 50369 - RNA, 19 nt, Human
agccggcccaggcccacag

SEQ ID NO: 50370 - RNA, 32 nt, Human
agccggcccaggcucggugaggaggcaagguu

SEQ ID NO: 50371 - RNA, 32 nt, Human
agccggccccugcugcugcucgggcagcugca

SEQ ID NO: 50372 - RNA, 32 nt, Human
agccggcccugaggacaguccugcccauccac

SEQ ID NO: 50373 - RNA, 32 nt, Human
agccggcccuggaaccagguggaggggaggca

SEQ ID NO: 50374 - RNA, 32 nt, Human
agccggccggccagggcagcggcaggcgcggc

SEQ ID NO: 50375 - RNA, 32 nt, Human
agccggccuggggaccugggggagacacggag

SEQ ID NO: 50376 - RNA, 22 nt, Human
agccggcguggacccagggcug

SEQ ID NO: 50377 - RNA, 32 nt, Human
agccggcuagaggccagcgccgccgccgccgc

SEQ ID NO: 50378 - RNA, 32 nt, Human
agccggcucacugcacuacccccgcccccuuc

SEQ ID NO: 50379 - RNA, 32 nt, Human
agccggcucccagaccguuggcaccgauugcc

SEQ ID NO: 50380 - RNA, 32 nt, Human
agccggcucccgcuccuacccugcaaacagac

SEQ ID NO: 50381 - RNA, 32 nt, Human
agccggcugcagcugccacaucccuggguuua

SEQ ID NO: 50382 - RNA, 19 nt, Human
agccggcugcccugggcac

SEQ ID NO: 50383 - RNA, 32 nt, Human
agccgggaacagagaaguguggggaagagaua

SEQ ID NO: 50384 - RNA, 32 nt, Human
agccgggaacagcugcgauggggaagcucugg

SEQ ID NO: 50385 - RNA, 23 nt, Human
agccgggacgcggagccccgccg

SEQ ID NO: 50386 - RNA, 32 nt, Human
agccgggacuacaggcaugcaccaccaugccc

SEQ ID NO: 50387 - RNA, 32 nt, Human
agccgggacuacaggcgcccaccaccaugccc

SEQ ID NO: 50388 - RNA, 32 nt, Human
agccgggacuacaggugccugccaccacgccu

SEQ ID NO: 50389 - RNA, 32 nt, Human
agccgggagacacccaggugcccagcccagcc

SEQ ID NO: 50390 - RNA, 32 nt, Human
agccgggagcccagcgaagagagcgagcaagc

SEQ ID NO: 50391 - RNA, 32 nt, Human
agccgggagccgggggcagacgggcggggguu

SEQ ID NO: 50392 - RNA, 32 nt, Human
agccgggagcuagcggccgccgccauguccca

SEQ ID NO: 50393 - RNA, 32 nt, Human
agccgggagcuggagguucugcgggagcagcu

SEQ ID NO: 50394 - RNA, 32 nt, Human
agccgggaggcagagggaguagugaccgccuu

SEQ ID NO: 50395 - RNA, 32 nt, Human
agccgggaggggcgcugcggggaagccaccug

SEQ ID NO: 50396 - RNA, 32 nt, Human
agccgggagguggggguugcagugagccgaga

SEQ ID NO: 50397 - RNA, 32 nt, Human
agccgggaucacgccacugaacuccagccugg

SEQ ID NO: 50398 - RNA, 20 nt, Human
agccgggaugagcaggaggc

SEQ ID NO: 50399 - RNA, 24 nt, Human
agccgggaugugacccuccagggu

SEQ ID NO: 50400 - RNA, 32 nt, Human
agccgggcacuggggagggaaagggcaccagg

SEQ ID NO: 50401 - RNA, 32 nt, Human
agccgggcagaggcgccccucaccucccggac

SEQ ID NO: 50402 - RNA, 32 nt, Human
agccgggcagaggcgccccucaccucccggau

SEQ ID NO: 50403 - RNA, 32 nt, Human
agccgggcagaggcgccccucaccuccuggac

SEQ ID NO: 50404 - RNA, 32 nt, Human
agccgggcaggugggaggcacgggguugcgga

SEQ ID NO: 50405 - RNA, 32 nt, Human
agccgggcagguuuugagcugcagagacccgu

SEQ ID NO: 50406 - RNA, 32 nt, Human
agccgggcaugguggcacacaucucuaguccc

SEQ ID NO: 50407 - RNA, 21 nt, Human
agccgggccaacauggugaaa

SEQ ID NO: 50408 - RNA, 32 nt, Human
agccgggccaaggacagccaccguugccccgc

SEQ ID NO: 50409 - RNA, 32 nt, Human
agccgggccgggaagcagagccuggucgugag

SEQ ID NO: 50410 - RNA, 16 nt, Human
agccgggccugagcug

SEQ ID NO: 50411 - RNA, 32 nt, Human
agccgggccuggccagagaagcaacacacacg

SEQ ID NO: 50412 - RNA, 32 nt, Human
agccgggcgccucaccugucagccgcaccggc

SEQ ID NO: 50413 - RNA, 32 nt, Human
agccgggcgggcggaggggcgguugggacggc

SEQ ID NO: 50414 - RNA, 32 nt, Human
agccgggcggggacagacagagccggaagcgc

SEQ ID NO: 50415 - RNA, 32 nt, Human
agccgggcgggugggaggggccggagcaaaag

SEQ ID NO: 50416 - RNA, 32 nt, Human
agccgggcgucacgccuguaaucccagcacuu

SEQ ID NO: 50417 - RNA, 32 nt, Human
agccgggcguggcaccuguagucccagcuacu

SEQ ID NO: 50418 - RNA, 32 nt, Human
agccgggcgugguccuagcuacucgggagacu

SEQ ID NO: 50419 - RNA, 32 nt, Human
agccgggcgugguggcgggugccugggaggcu

SEQ ID NO: 50420 - RNA, 19 nt, Human
agccgggcucuuuauggug

SEQ ID NO: 50421 - RNA, 32 nt, Human
agccgggcuggcaggagcaggauggcggcggc

SEQ ID NO: 50422 - RNA, 32 nt, Human
agccgggcuuccuggguguuucaggcaaggaa

SEQ ID NO: 50423 - RNA, 20 nt, Human
agccgggcuuuccugagcug

SEQ ID NO: 50424 - RNA, 32 nt, Human
agccggggacacaccauccugcucgcaggugc

SEQ ID NO: 50425 - RNA, 23 nt, Human
agccggggacggagccgccgccg

SEQ ID NO: 50426 - RNA, 32 nt, Human
agccggggaggaggggguugcagugagccgag

SEQ ID NO: 50427 - RNA, 26 nt, Human
agccggggaggcagagguugcaguga

SEQ ID NO: 50428 - RNA, 32 nt, Human
agccggggaggcagagguugcagugagccgag

SEQ ID NO: 50429 - RNA, 32 nt, Human
agccggggagguggaggcugcagugaacugag

SEQ ID NO: 50430 - RNA, 32 nt, Human
agccggggcagacacccagcuggcuggguccu

SEQ ID NO: 50431 - RNA, 32 nt, Human
agccggggccuggguggcgggugggggccggg

SEQ ID NO: 50432 - RNA, 20 nt, Human
agccggggcucccccugccu

SEQ ID NO: 50433 - RNA, 32 nt, Human
agccgggggcagucccgaacucugugcuuggc

SEQ ID NO: 50434 - RNA, 32 nt, Human
agccgggggccgguggccagagcgagggcacc

SEQ ID NO: 50435 - RNA, 32 nt, Human
agccgggguccucggaucuggcccaggugagg

SEQ ID NO: 50436 - RNA, 21 nt, Human
agccggggugggaaccaggag

SEQ ID NO: 50437 - RNA, 32 nt, Human
agccggguccugcugcucacaagcccagagcu

SEQ ID NO: 50438 - RNA, 32 nt, Human
agccgggucugccucuucugggagggcagcag

SEQ ID NO: 50439 - RNA, 32 nt, Human
agccgggugacagcacuaaccagaccuccagc

SEQ ID NO: 50440 - RNA, 32 nt, Human
agccgggugcugcugcuccugcugcugcugcc

SEQ ID NO: 50441 - RNA, 32 nt, Human
agccggguuggaagugucucuccacagucacc

SEQ ID NO: 50442 - RNA, 32 nt, Human
agccgguagggagaggauaggagaagaggagg

SEQ ID NO: 50443 - RNA, 32 nt, Human
agccgguagggguggaaaggggacucagauga

SEQ ID NO: 50444 - RNA, 32 nt, Human
agccggucaucacccagccucugagagcaguu

SEQ ID NO: 50445 - RNA, 32 nt, Human
agccggucucaaacuccugagcucaagugauc

SEQ ID NO: 50446 - RNA, 32 nt, Human
agccggugcgcaucaccaugcgcggccuggcu

SEQ ID NO: 50447 - RNA, 32 nt, Human
agccggugcgcgaccucgcagugagcagggag

SEQ ID NO: 50448 - RNA, 32 nt, Human
agccgguggugaggaagcaugguggggucucc

SEQ ID NO: 50449 - RNA, 25 nt, Human
agccgguggugguggcacacaccua

SEQ ID NO: 50450 - RNA, 32 nt, Human
agccgguucccuccucuccaggcccccucccc

SEQ ID NO: 50451 - RNA, 32 nt, Human
agccgguugcccaccccagcccucugguccau

SEQ ID NO: 50452 - RNA, 32 nt, Human
agccguaaucacucugugccucaguuuccucg

SEQ ID NO: 50453 - RNA, 23 nt, Human
agccguaaucccagcuacucggg

SEQ ID NO: 50454 - RNA, 32 nt, Human
agccguagagacaaacccccacccugagcccg

SEQ ID NO: 50455 - RNA, 32 nt, Human
agccguagcccuugugcucaggagcugcuccu

SEQ ID NO: 50456 - RNA, 32 nt, Human
agccgucauucucuccccacuccacgcucccc

SEQ ID NO: 50457 - RNA, 32 nt, Human
agccguccaaagugcugggauuacaagcguga

SEQ ID NO: 50458 - RNA, 32 nt, Human
agccguccaccaacuagccagcugccaccgug

SEQ ID NO: 50459 - RNA, 32 nt, Human
agccguccauucauugugcuucaucaagugcu

SEQ ID NO: 50460 - RNA, 32 nt, Human
agccgucccugaccaggcuuaguugcuuccca

SEQ ID NO: 50461 - RNA, 32 nt, Human
agccgucucaacaaugguuacagagaugaauc

SEQ ID NO: 50462 - RNA, 32 nt, Human
agccgucuccacccugucugccucccgaacag

SEQ ID NO: 50463 - RNA, 32 nt, Human
agccgucugcugcugcugcaggaggcuccacu

SEQ ID NO: 50464 - RNA, 24 nt, Human
agccgucugugacaucccaccucg

SEQ ID NO: 50465 - RNA, 32 nt, Human
agccgugaaccacugcacccagccaaugggug

SEQ ID NO: 50466 - RNA, 32 nt, Human
agccgugaaccuuugcaccccauguucccaga

SEQ ID NO: 50467 - RNA, 32 nt, Human
agccgugaccuugccuucauugcuucauccag

SEQ ID NO: 50468 - RNA, 32 nt, Human
agccgugagccaaguaaaccucuuuaauuacc

SEQ ID NO: 50469 - RNA, 32 nt, Human
agccgugagccacugcacccagccccaaucca

SEQ ID NO: 50470 - RNA, 32 nt, Human
agccgugccaggccaucugccugcucaugggg

SEQ ID NO: 50471 - RNA, 19 nt, Human
agccgugccaucucugccc

SEQ ID NO: 50472 - RNA, 32 nt, Human
agccgugcuguggguuuccuucccucuggcuc

SEQ ID NO: 50473 - RNA, 18 nt, Human
agccguggcuccauggcc

SEQ ID NO: 50474 - RNA, 32 nt, Human
agccguggcugaggccacccccagaggagccc

SEQ ID NO: 50475 - RNA, 32 nt, Human
agccgugggaggaagggggcguggcaaggggu

SEQ ID NO: 50476 - RNA, 32 nt, Human
agccguggggcagaggcugcagagccccagga

SEQ ID NO: 50477 - RNA, 32 nt, Human
agccguggggcagaggcugcggagccccagaa

SEQ ID NO: 50478 - RNA, 32 nt, Human
agccguggggcagaggcugcggagccccagga

SEQ ID NO: 50479 - RNA, 32 nt, Human
agccguggguugagcugcucuccucugaaggu

SEQ ID NO: 50480 - RNA, 32 nt, Human
agccguguaaaaccugcagugccugaaaccug

SEQ ID NO: 50481 - RNA, 32 nt, Human
agccguguggcuguggcagagacaguggccgg

SEQ ID NO: 50482 - RNA, 32 nt, Human
agccguuaggcugaauguuacugcuugccaua

SEQ ID NO: 50483 - RNA, 32 nt, Human
agccguucccuguccauguccacagaaggaga

SEQ ID NO: 50484 - RNA, 32 nt, Human
agccguuccggaugcuuuaggcugccggaugu

SEQ ID NO: 50485 - RNA, 32 nt, Human
agccguucucacagaugcuccugggccaccgu

SEQ ID NO: 50486 - RNA, 32 nt, Human
agccguucucaugcaaaauaccugugucagaa

SEQ ID NO: 50487 - RNA, 32 nt, Human
agccguugaccaugguugcaacuggcaguuug

SEQ ID NO: 50488 - RNA, 32 nt, Human
agccguugugcuccagccugggcgacagaagu

SEQ ID NO: 50489 - RNA, 32 nt, Human
agccuaaaacaaacacucagauguggguguau

SEQ ID NO: 50490 - RNA, 32 nt, Human
agccuaacagcaaaggcucuuuucagagccac

SEQ ID NO: 50491 - RNA, 32 nt, Human
agccuaagacacaucugugaauacuuagauuu

SEQ ID NO: 50492 - RNA, 32 nt, Human
agccuaagagaucaaggcugcagugagccaug

SEQ ID NO: 50493 - RNA, 20 nt, Human
agccuaaggagcuagaacug

SEQ ID NO: 50494 - RNA, 32 nt, Human
agccuaagggcuauccucugaagcagagucac

SEQ ID NO: 50495 - RNA, 32 nt, Human
agccuaaggggagggggcugccaggagcccug

SEQ ID NO: 50496 - RNA, 32 nt, Human
agccuaagggggugggagacgccggccccuug

SEQ ID NO: 50497 - RNA, 21 nt, Human
agccuaauuugguucuggacu

SEQ ID NO: 50498 - RNA, 32 nt, Human
agccuacaacuacucgccacacuggcucuucc

SEQ ID NO: 50499 - RNA, 32 nt, Human
agccuacacugcacccuggcuggcaggggugc

SEQ ID NO: 50500 - RNA, 28 nt, Human
agccuacagaguagcugggaauacaagu

SEQ ID NO: 50501 - RNA, 32 nt, Human
agccuacaucuucuuauucuauuuaggaaucg

SEQ ID NO: 50502 - RNA, 32 nt, Human
agccuacauggugaaaccccuucucuacuaaa

SEQ ID NO: 50503 - RNA, 32 nt, Human
agccuaccaaagugcugggauuacaggcguga

SEQ ID NO: 50504 - RNA, 32 nt, Human
agccuaccaagcagcugggacuacaggucugc

SEQ ID NO: 50505 - RNA, 32 nt, Human
agccuaccaaguagcugggaccaugggugugu

SEQ ID NO: 50506 - RNA, 32 nt, Human
agccuaccaaguagcugggauaauacaccacc

SEQ ID NO: 50507 - RNA, 32 nt, Human
agccuaccaaguagcugggauuacaggagugc

SEQ ID NO: 50508 - RNA, 32 nt, Human
agccuaccaaguagcugggauuacaggugugu

SEQ ID NO: 50509 - RNA, 18 nt, Human
agccuaccaggcuugccc

SEQ ID NO: 50510 - RNA, 21 nt, Human
agccuacccaacauggugaaa

SEQ ID NO: 50511 - RNA, 32 nt, Human
agccuacccguaaacugccacccaagaaggac

SEQ ID NO: 50512 - RNA, 32 nt, Human
agccuacccugccugcacuccuccaccaucac

SEQ ID NO: 50513 - RNA, 32 nt, Human
agccuaccuucaccaccuauauccagaagggg

SEQ ID NO: 50514 - RNA, 32 nt, Human
agccuacgaucacuuccgcuccugccugcacg

SEQ ID NO: 50515 - RNA, 20 nt, Human
agccuacgccugugcugcug

SEQ ID NO: 50516 - RNA, 23 nt, Human
agccuacguguugguaaauccaa

SEQ ID NO: 50517 - RNA, 32 nt, Human
agccuacucuaaauuauugauaaccucuuccu

SEQ ID NO: 50518 - RNA, 32 nt, Human
agccuacucuccuaccucgccuccaggccucg

SEQ ID NO: 50519 - RNA, 32 nt, Human
agccuacugcuggcucagguuccagucuucgu

SEQ ID NO: 50520 - RNA, 32 nt, Human
agccuacuggguagcugggacuacaggggugc

SEQ ID NO: 50521 - RNA, 32 nt, Human
agccuacuugcaggagauauggaaggcagaag

SEQ ID NO: 50522 - RNA, 22 nt, Human
agccuagaccugcugggcucaa

SEQ ID NO: 50523 - RNA, 32 nt, Human
agccuagagccaggacugaagcuucaagaugg

SEQ ID NO: 50524 - RNA, 32 nt, Human
agccuagaggagcuguuccuuccuucacagau

SEQ ID NO: 50525 - RNA, 32 nt, Human
agccuagaucccucgcaugcacaguucauagu

SEQ ID NO: 50526 - RNA, 31 nt, Human
agccuagaugagagagauagagagugaguac

SEQ ID NO: 50527 - RNA, 32 nt, Human
agccuagcacugcagagugcuggugaguccag

SEQ ID NO: 50528 - RNA, 21 nt, Human
agccuagccaacauggugaaa

SEQ ID NO: 50529 - RNA, 21 nt, Human
agccuagccaacguggugaaa

SEQ ID NO: 50530 - RNA, 22 nt, Human
agccuagccaccucccacccca

SEQ ID NO: 50531 - RNA, 32 nt, Human
agccuagccaugggggugagggggagugggug

SEQ ID NO: 50532 - RNA, 32 nt, Human
agccuagcccuggccuugaccucccaggagcg

SEQ ID NO: 50533 - RNA, 32 nt, Human
agccuagcccugggacaucaggagacugggcu

SEQ ID NO: 50534 - RNA, 32 nt, Human
agccuagcugggugggaagacggagcccugaa

SEQ ID NO: 50535 - RNA, 18 nt, Human
agccuagcuucuggccug

SEQ ID NO: 50536 - RNA, 24 nt, Human
agccuaggaagucgaggcugcagu

SEQ ID NO: 50537 - RNA, 32 nt, Human
agccuaggaagucgaggcugcagugagcugag

SEQ ID NO: 50538 - RNA, 32 nt, Human
agccuaggacguugaggcugcagugagcugug

SEQ ID NO: 50539 - RNA, 32 nt, Human
agccuaggacucaggcuggaggcaauuccuug

SEQ ID NO: 50540 - RNA, 26 nt, Human
agccuaggaggcagagguugcaguga

SEQ ID NO: 50541 - RNA, 24 nt, Human
agccuaggaggucaaggcugcagu

SEQ ID NO: 50542 - RNA, 32 nt, Human
agccuaggaggucaaggcugcagugagccaug

SEQ ID NO: 50543 - RNA, 32 nt, Human
agccuaggagguugaggcugcagugagcuaug

SEQ ID NO: 50544 - RNA, 32 nt, Human
agccuaggaguggucagggucccgggaguggc

SEQ ID NO: 50545 - RNA, 32 nt, Human
agccuaggcaaagcuuuaaacccuucucugug

SEQ ID NO: 50546 - RNA, 21 nt, Human
agccuaggcaacauggugaaa

SEQ ID NO: 50547 - RNA, 32 nt, Human
agccuaggcauggugagacuccaucucaaaaa

SEQ ID NO: 50548 - RNA, 32 nt, Human
agccuaggccagagcacuuuacuccaggcagg

SEQ ID NO: 50549 - RNA, 18 nt, Human
agccuaggcccugagcug

SEQ ID NO: 50550 - RNA, 32 nt, Human
agccuagggaaaaggcuuaggaagauggagaa

SEQ ID NO: 50551 - RNA, 32 nt, Human
agccuagggcagcagggagucuugaagugauc

SEQ ID NO: 50552 - RNA, 32 nt, Human
agccuagggcauaggucaucacugcaggggug

SEQ ID NO: 50553 - RNA, 17 nt, Human
agccuagggcugagcug

SEQ ID NO: 50554 - RNA, 32 nt, Human
agccuaggugguaggagcuugaucuuuguuuc

SEQ ID NO: 50555 - RNA, 32 nt, Human
agccuaggugucucaggccccugggccccgca

SEQ ID NO: 50556 - RNA, 32 nt, Human
agccuagugccagaaauguccaagaugccagg

SEQ ID NO: 50557 - RNA, 32 nt, Human
agccuaguuccuuccuggccccucucucacug

SEQ ID NO: 50558 - RNA, 32 nt, Human
agccuauaaauaaguuccaaaauaucgaauuc

SEQ ID NO: 50559 - RNA, 23 nt, Human
agccuauaaucccagcacuucgg

SEQ ID NO: 50560 - RNA, 24 nt, Human
agccuauaaucccagcacuuuggg

SEQ ID NO: 50561 - RNA, 32 nt, Human
agccuauacugauggccuuagcuuuguucagu

SEQ ID NO: 50562 - RNA, 32 nt, Human
agccuauaucacagcuaacuucuucagucuca

SEQ ID NO: 50563 - RNA, 32 nt, Human
agccuaucuucugguuucuuccucuccgcugg

SEQ ID NO: 50564 - RNA, 32 nt, Human
agccuaugauuuugcagaggugucacacugua

SEQ ID NO: 50565 - RNA, 31 nt, Human
agccuaugccagccugggccugucuccaccg

SEQ ID NO: 50566 - RNA, 32 nt, Human
agccuauguaguucaauuaauauauaaggaaa

SEQ ID NO: 50567 - RNA, 32 nt, Human
agccuauugggcagcugggacuacaggcaugc

SEQ ID NO: 50568 - RNA, 32 nt, Human
agccuauuuuagugauauggcagcacggauau

SEQ ID NO: 50569 - RNA, 32 nt, Human
agccuauuuugcugaguguucccacuggaucc

SEQ ID NO: 50570 - RNA, 32 nt, Human
agccucaaaaauaugagugaagcacaaucaaa

SEQ ID NO: 50571 - RNA, 32 nt, Human
agccucaaaccucauauaccacucucuuccga

SEQ ID NO: 50572 - RNA, 22 nt, Human
agccucaaacuacugggcucaa

SEQ ID NO: 50573 - RNA, 22 nt, Human
agccucaaacuccugggcucaa

SEQ ID NO: 50574 - RNA, 22 nt, Human
agccucaaacuccugggcucag

SEQ ID NO: 50575 - RNA, 22 nt, Human
agccucaaacuucuggccucaa

SEQ ID NO: 50576 - RNA, 32 nt, Human
agccucaaagauggccagcuggaggugaucuu

SEQ ID NO: 50577 - RNA, 32 nt, Human
agccucaaauuacuggacugagguguccuccu

SEQ ID NO: 50578 - RNA, 22 nt, Human
agccucaaauuccugggcucaa

SEQ ID NO: 50579 - RNA, 32 nt, Human
agccucaacauggagaaaccccaucucuacua

SEQ ID NO: 50580 - RNA, 32 nt, Human
agccucaacauggagaaaccccgucucuacua

SEQ ID NO: 50581 - RNA, 22 nt, Human
agccucaaccucccuggcucaa

SEQ ID NO: 50582 - RNA, 22 nt, Human
agccucaaccuccugagcucaa

SEQ ID NO: 50583 - RNA, 32 nt, Human
agccucaaccuccuggacucagagaugucggc

SEQ ID NO: 50584 - RNA, 22 nt, Human
agccucaaccuccugggcucaa

SEQ ID NO: 50585 - RNA, 22 nt, Human
agccucaaccuccugggcucag

SEQ ID NO: 50586 - RNA, 22 nt, Human
agccucaaccugcagugcucaa

SEQ ID NO: 50587 - RNA, 22 nt, Human
agccucaaccugcugggcucaa

SEQ ID NO: 50588 - RNA, 22 nt, Human
agccucaaccuucuggguucaa

SEQ ID NO: 50589 - RNA, 23 nt, Human
agccucaacucugccccacccca

SEQ ID NO: 50590 - RNA, 22 nt, Human
agccucaacuucccaggcucaa

SEQ ID NO: 50591 - RNA, 21 nt, Human
agccucaacuuccuggacuca

SEQ ID NO: 50592 - RNA, 22 nt, Human
agccucaacuuccuggacucaa

SEQ ID NO: 50593 - RNA, 32 nt, Human
agccucaagcccaugaaugccaccccagucau

SEQ ID NO: 50594 - RNA, 32 nt, Human
agccucaaguaguucccuuuuuguauuaauaa

SEQ ID NO: 50595 - RNA, 22 nt, Human
agccucaaucuuccaggcucaa

SEQ ID NO: 50596 - RNA, 32 nt, Human
agccucacaaguagcugggauuacaggugccc

SEQ ID NO: 50597 - RNA, 28 nt, Human
agccucacaccagcugccuccuccacuc

SEQ ID NO: 50598 - RNA, 18 nt, Human
agccucacaggccuggcc

SEQ ID NO: 50599 - RNA, 20 nt, Human
agccucacaggcggugcacg

SEQ ID NO: 50600 - RNA, 19 nt, Human
agccucacaggcucugcug

SEQ ID NO: 50601 - RNA, 19 nt, Human
agccucacagggcuuugcc

SEQ ID NO: 50602 - RNA, 32 nt, Human
agccucaccacucacaagcugugugacuucaa

SEQ ID NO: 50603 - RNA, 32 nt, Human
agccucacccaccuaugaucuguccuuuccca

SEQ ID NO: 50604 - RNA, 32 nt, Human
agccucacccagccugagcgggguucccuggu

SEQ ID NO: 50605 - RNA, 21 nt, Human
agccucaccucauuccaacac

SEQ ID NO: 50606 - RNA, 20 nt, Human
agccucaccucugccccagg

SEQ ID NO: 50607 - RNA, 32 nt, Human
agccucaccuucucuggugauaacuccagcac

SEQ ID NO: 50608 - RNA, 32 nt, Human
agccucaccuuuccugccgucccuccuguugu

SEQ ID NO: 50609 - RNA, 32 nt, Human
agccucacgaguagcuggaauuacaggcaggc

SEQ ID NO: 50610 - RNA, 32 nt, Human
agccucacgaguagcugggacuacaggcaugc

SEQ ID NO: 50611 - RNA, 32 nt, Human
agccucacgaguagcugggacuacaggcgccu

SEQ ID NO: 50612 - RNA, 32 nt, Human
agccucacgaguagcugggauuacaggcaugc

SEQ ID NO: 50613 - RNA, 23 nt, Human
agccucacgccccgcccccaggc

SEQ ID NO: 50614 - RNA, 32 nt, Human
agccucacgugagacuccuuuuaagacuaaac

SEQ ID NO: 50615 - RNA, 18 nt, Human
agccucacuccuggacug

SEQ ID NO: 50616 - RNA, 32 nt, Human
agccucacugaacgccugcucugguugaaggu

SEQ ID NO: 50617 - RNA, 24 nt, Human
agccucacuggcauccccaaacac

SEQ ID NO: 50618 - RNA, 32 nt, Human
agccucacuuccagcccagccugggcccgcag

SEQ ID NO: 50619 - RNA, 32 nt, Human
agccucacuuuccugucucugcccuuaauggg

SEQ ID NO: 50620 - RNA, 32 nt, Human
agccucagaagcagacucugaagccggagagc

SEQ ID NO: 50621 - RNA, 32 nt, Human
agccucagaaggaggaguaugugggaaguuua

SEQ ID NO: 50622 - RNA, 32 nt, Human
agccucagaccagcuauggggagaggacaaca

SEQ ID NO: 50623 - RNA, 22 nt, Human
agccucagacuccuggguucaa

SEQ ID NO: 50624 - RNA, 32 nt, Human
agccucagagacagagaaggagagggggagau

SEQ ID NO: 50625 - RNA, 32 nt, Human
agccucagagagauuaguaccccacuugcaaa

SEQ ID NO: 50626 - RNA, 32 nt, Human
agccucagaggggcaggcauccccgcacagac

SEQ ID NO: 50627 - RNA, 32 nt, Human
agccucagaucuuccccauucaggaaggguuu

SEQ ID NO: 50628 - RNA, 32 nt, Human
agccucagaugggaagaagucagaggaaccag

SEQ ID NO: 50629 - RNA, 32 nt, Human
agccucagcccugucuguacugcucguccagc

SEQ ID NO: 50630 - RNA, 32 nt, Human
agccucagccucauguaacccauuguuuccaa

SEQ ID NO: 50631 - RNA, 32 nt, Human
agccucagccuccugaguagcuggaauuacag

SEQ ID NO: 50632 - RNA, 32 nt, Human
agccucagccuccugaguagcugggauuacag

SEQ ID NO: 50633 - RNA, 32 nt, Human
agccucagccuccuuagacugaccccucaggc

SEQ ID NO: 50634 - RNA, 32 nt, Human
agccucagcggaccacucuucucuccaaggaa

SEQ ID NO: 50635 - RNA, 22 nt, Human
agccucagcguccugggcucaa

SEQ ID NO: 50636 - RNA, 32 nt, Human
agccucagcuacucaggggguugaggugggaa

SEQ ID NO: 50637 - RNA, 32 nt, Human
agccucagcuacucggguggcagaggagaaga

SEQ ID NO: 50638 - RNA, 32 nt, Human
agccucagcucagccucccccugcugcucauc

SEQ ID NO: 50639 - RNA, 32 nt, Human
agccucagcucucuuuucagagaagaucaaag

SEQ ID NO: 50640 - RNA, 32 nt, Human
agccucaggagaaggaaggagaucccuuuuca

SEQ ID NO: 50641 - RNA, 32 nt, Human
agccucaggagguugaggcugcagugagcugu

SEQ ID NO: 50642 - RNA, 32 nt, Human
agccucaggggcuccagauccuagccagaggc

SEQ ID NO: 50643 - RNA, 32 nt, Human
agccucagguaacugcauccugcccagcauga

SEQ ID NO: 50644 - RNA, 32 nt, Human
agccucaguccccagcagagccugugucucac

SEQ ID NO: 50645 - RNA, 32 nt, Human
agccucaguucugcuugugggcgggccugucu

SEQ ID NO: 50646 - RNA, 18 nt, Human
agccucaguuucugacug

SEQ ID NO: 50647 - RNA, 22 nt, Human
agccucauacuccugggcucaa

SEQ ID NO: 50648 - RNA, 22 nt, Human
agccucauagaacaggaggcug

SEQ ID NO: 50649 - RNA, 32 nt, Human
agccucaucacagacaugaaacucacugccgc

SEQ ID NO: 50650 - RNA, 32 nt, Human
agccucaucagacccuucuccaugcacauccu

SEQ ID NO: 50651 - RNA, 32 nt, Human
agccucaucugcuccuuuccuccccugccuca

SEQ ID NO: 50652 - RNA, 32 nt, Human
agccucaugaauagcugggauuacaggugccc

SEQ ID NO: 50653 - RNA, 32 nt, Human
agccucaugaguagcugggacuacaggcacca

SEQ ID NO: 50654 - RNA, 32 nt, Human
agccucaugaguagcugggauuacagguaugu

SEQ ID NO: 50655 - RNA, 32 nt, Human
agccucauugugaaaggcacuggacuuggacc

SEQ ID NO: 50656 - RNA, 32 nt, Human
agccuccaaaagugcugggauuauagguguga

SEQ ID NO: 50657 - RNA, 32 nt, Human
agccuccaaaguagcugggauuacaggcaccc

SEQ ID NO: 50658 - RNA, 32 nt, Human
agccuccaaaguagcugggauuacaggcaugc

SEQ ID NO: 50659 - RNA, 32 nt, Human
agccuccaaaguagcugggauuacagguuugc

SEQ ID NO: 50660 - RNA, 32 nt, Human
agccuccaaaguagcugggauugcaggugccu

SEQ ID NO: 50661 - RNA, 21 nt, Human
agccuccaaaguuucugcacc

SEQ ID NO: 50662 - RNA, 32 nt, Human
agccuccaacccaggaggggaaguggagauaa

SEQ ID NO: 50663 - RNA, 22 nt, Human
agccuccaacuccugggcucaa

SEQ ID NO: 50664 - RNA, 22 nt, Human
agccuccaacucuugggcucaa

SEQ ID NO: 50665 - RNA, 32 nt, Human
agccuccaacuucucccgaaucccacuggauu

SEQ ID NO: 50666 - RNA, 32 nt, Human
agccuccacccagccacaucuugggaaaagaa

SEQ ID NO: 50667 - RNA, 32 nt, Human
agccuccacccuuucucuaugccugcaacaaa

SEQ ID NO: 50668 - RNA, 22 nt, Human
agccuccaccuccugggcucaa

SEQ ID NO: 50669 - RNA, 32 nt, Human
agccuccaccuccugggcucaaguguccuccc

SEQ ID NO: 50670 - RNA, 22 nt, Human
agccuccaccuccuggguucaa

SEQ ID NO: 50671 - RNA, 32 nt, Human
agccuccaccugccaaacccgagugauuccuu

SEQ ID NO: 50672 - RNA, 21 nt, Human
agccuccacuguguccagaga

SEQ ID NO: 50673 - RNA, 32 nt, Human
agccuccagaacugugggacauaaauuccugu

SEQ ID NO: 50674 - RNA, 22 nt, Human
agccuccagaagccaaaaccau

SEQ ID NO: 50675 - RNA, 22 nt, Human
agccuccagaagcuggaaccau

SEQ ID NO: 50676 - RNA, 32 nt, Human
agccuccagaauagcugggauuacaggcguac

SEQ ID NO: 50677 - RNA, 22 nt, Human
agccuccagacccugcuaacca

SEQ ID NO: 50678 - RNA, 22 nt, Human
agccuccagagaaaagauucaa

SEQ ID NO: 50679 - RNA, 32 nt, Human
agccuccagagcagcugggauuacagcagcuu

SEQ ID NO: 50680 - RNA, 32 nt, Human
agccuccagaguaacagggauuacaggcauac

SEQ ID NO: 50681 - RNA, 32 nt, Human
agccuccagaguagcuaggacuacaggcagug

SEQ ID NO: 50682 - RNA, 32 nt, Human
agccuccagaguagcuaggauuacagauacgu

SEQ ID NO: 50683 - RNA, 32 nt, Human
agccuccagaguagcucagauuacaguguuuu

SEQ ID NO: 50684 - RNA, 32 nt, Human
agccuccagaguagcuggaacuacaggugccc

SEQ ID NO: 50685 - RNA, 32 nt, Human
agccuccagaguagcuggaauuacaggcacau

SEQ ID NO: 50686 - RNA, 32 nt, Human
agccuccagaguagcugggaccgcaggcacuu

SEQ ID NO: 50687 - RNA, 32 nt, Human
agccuccagaguagcugggacuacaggcacac

SEQ ID NO: 50688 - RNA, 32 nt, Human
agccuccagaguagcugggacuacaggcaccc

SEQ ID NO: 50689 - RNA, 32 nt, Human
agccuccagaguagcugggacuacaggcaugu

SEQ ID NO: 50690 - RNA, 32 nt, Human
agccuccagaguagcugggacuacaggugccc

SEQ ID NO: 50691 - RNA, 32 nt, Human
agccuccagaguagcugggacugcgggcgccc

SEQ ID NO: 50692 - RNA, 32 nt, Human
agccuccagaguagcugggauuacaggcaccu

SEQ ID NO: 50693 - RNA, 32 nt, Human
agccuccagaguagcugggauuacaggcacgc

SEQ ID NO: 50694 - RNA, 32 nt, Human
agccuccagaguagcugggauuacaggcacgu

SEQ ID NO: 50695 - RNA, 32 nt, Human
agccuccagaguagcugggauuacaggcaugc

SEQ ID NO: 50696 - RNA, 32 nt, Human
agccuccagaguagcugggauuacaggcgccc

SEQ ID NO: 50697 - RNA, 32 nt, Human
agccuccagaguagcugggauuuuaggugugc

SEQ ID NO: 50698 - RNA, 32 nt, Human
agccuccagaguaucugggauuacauaugucg

SEQ ID NO: 50699 - RNA, 21 nt, Human
agccuccagcaggccacacca

SEQ ID NO: 50700 - RNA, 22 nt, Human
agccuccagcauuugcacacca

SEQ ID NO: 50701 - RNA, 22 nt, Human
agccuccagccucucccuccag

SEQ ID NO: 50702 - RNA, 21 nt, Human
agccuccagccucucucgggg

SEQ ID NO: 50703 - RNA, 32 nt, Human
agccuccagcuccucagaccuccugggugggg

SEQ ID NO: 50704 - RNA, 32 nt, Human
agccuccagcuggcuccugagcucugcaccag

SEQ ID NO: 50705 - RNA, 20 nt, Human
agccuccagggaucuacacc

SEQ ID NO: 50706 - RNA, 32 nt, Human
agccuccagguaacaggcuucagagagaauag

SEQ ID NO: 50707 - RNA, 32 nt, Human
agccuccauauagcugguggggaccaaguuuc

SEQ ID NO: 50708 - RNA, 22 nt, Human
agccuccaucuccugggcucaa

SEQ ID NO: 50709 - RNA, 32 nt, Human
agccuccaucugccaagaacauucaguuggau

SEQ ID NO: 50710 - RNA, 32 nt, Human
agccuccauggcugaugaccucagcuuucaca

SEQ ID NO: 50711 - RNA, 32 nt, Human
agccuccaugugggaaccucuaaccugggaaa

SEQ ID NO: 50712 - RNA, 22 nt, Human
agccuccauugcccacccgcca

SEQ ID NO: 50713 - RNA, 32 nt, Human
agccucccaaaaagcugggauuacuagcauga

SEQ ID NO: 50714 - RNA, 32 nt, Human
agccucccaaaauacugggauuacaggcuuga

SEQ ID NO: 50715 - RNA, 32 nt, Human
agccucccaaaaugcugggauuacaggcauga

SEQ ID NO: 50716 - RNA, 32 nt, Human
agccucccaaaaugcugggauuacaggcguga

SEQ ID NO: 50717 - RNA, 32 nt, Human
agccucccaaaaugcugggauuacaggcuuga

SEQ ID NO: 50718 - RNA, 32 nt, Human
agccucccaaaaugcugggauuacagguauga

SEQ ID NO: 50719 - RNA, 32 nt, Human
agccucccaaaaugcuuggauuacaggcauga

SEQ ID NO: 50720 - RNA, 32 nt, Human
agccucccaaaauggugggauuacaggugugu

SEQ ID NO: 50721 - RNA, 32 nt, Human
agccucccaaaauucugggauuacaggcauaa

SEQ ID NO: 50722 - RNA, 32 nt, Human
agccucccaaacuacugggauuacagguugua

SEQ ID NO: 50723 - RNA, 32 nt, Human
agccucccaaacugcugggauuacaggcguga

SEQ ID NO: 50724 - RNA, 32 nt, Human
agccucccaaacugcugggauuacaggcgugu

SEQ ID NO: 50725 - RNA, 32 nt, Human
agccucccaaacugcugggauuacagguguga

SEQ ID NO: 50726 - RNA, 32 nt, Human
agccucccaaagagcugggauuacagguguga

SEQ ID NO: 50727 - RNA, 32 nt, Human
agccucccaaagcgcugggauuacagguguga

SEQ ID NO: 50728 - RNA, 32 nt, Human
agccucccaaaggguugggauuaccggcauga

SEQ ID NO: 50729 - RNA, 32 nt, Human
agccucccaaaguacugggauuacaaacauaa

SEQ ID NO: 50730 - RNA, 32 nt, Human
agccucccaaaguacugggauuacaggcauga

SEQ ID NO: 50731 - RNA, 32 nt, Human
agccucccaaaguacugggauuacaggcguga

SEQ ID NO: 50732 - RNA, 32 nt, Human
agccucccaaaguacugggauuacaggugaga

SEQ ID NO: 50733 - RNA, 32 nt, Human
agccucccaaaguacugggauuauaggcauga

SEQ ID NO: 50734 - RNA, 32 nt, Human
agccucccaaaguacugggauuauagguguga

SEQ ID NO: 50735 - RNA, 32 nt, Human
agccucccaaaguccugggauuacaggcguga

SEQ ID NO: 50736 - RNA, 32 nt, Human
agccucccaaaguccugggauuacaggcugag

SEQ ID NO: 50737 - RNA, 32 nt, Human
agccucccaaagugcagggauuacaggcacaa

SEQ ID NO: 50738 - RNA, 32 nt, Human
agccucccaaagugcagggauuacaggcauga

SEQ ID NO: 50739 - RNA, 32 nt, Human
agccucccaaagugccgggauuacaggcguga

SEQ ID NO: 50740 - RNA, 32 nt, Human
agccucccaaagugcuaagauuacaggcguga

SEQ ID NO: 50741 - RNA, 32 nt, Human
agccucccaaagugcuagaauuacaggcauua

SEQ ID NO: 50742 - RNA, 32 nt, Human
agccucccaaagugcuaggauuacacagcccu

SEQ ID NO: 50743 - RNA, 32 nt, Human
agccucccaaagugcuaggauuacaggauaag

SEQ ID NO: 50744 - RNA, 32 nt, Human
agccucccaaagugcuaggauuacaggcauaa

SEQ ID NO: 50745 - RNA, 32 nt, Human
agccucccaaagugcuaggauuacaggcauga

SEQ ID NO: 50746 - RNA, 32 nt, Human
agccucccaaagugcuaggauuacaggcaugg

SEQ ID NO: 50747 - RNA, 32 nt, Human
agccucccaaagugcuaggauuacaggccuga

SEQ ID NO: 50748 - RNA, 32 nt, Human
agccucccaaagugcuaggauuacaggcguga

SEQ ID NO: 50749 - RNA, 32 nt, Human
agccucccaaagugcuaggauuacaggcgugu

SEQ ID NO: 50750 - RNA, 32 nt, Human
agccucccaaagugcuaggauuacagguguaa

SEQ ID NO: 50751 - RNA, 32 nt, Human
agccucccaaagugcuaggauuacagguguga

SEQ ID NO: 50752 - RNA, 32 nt, Human
agccucccaaagugcugacauuacagguguga

SEQ ID NO: 50753 - RNA, 32 nt, Human
agccucccaaagugcugagauuacagacauga

SEQ ID NO: 50754 - RNA, 32 nt, Human
agccucccaaagugcugagauuacaggcauaa

SEQ ID NO: 50755 - RNA, 32 nt, Human
agccucccaaagugcugagauuacaggcauga

SEQ ID NO: 50756 - RNA, 32 nt, Human
agccucccaaagugcugagauuacaggcguga

SEQ ID NO: 50757 - RNA, 32 nt, Human
agccucccaaagugcugagauuacagggguga

SEQ ID NO: 50758 - RNA, 32 nt, Human
agccucccaaagugcugagauuacagguguga

SEQ ID NO: 50759 - RNA, 32 nt, Human
agccucccaaagugcugagauuacuggcuuga

SEQ ID NO: 50760 - RNA, 32 nt, Human
agccucccaaagugcugagauuauaggcacga

SEQ ID NO: 50761 - RNA, 32 nt, Human
agccucccaaagugcugauauuacaggcguga

SEQ ID NO: 50762 - RNA, 32 nt, Human
agccucccaaagugcuggaauuacaggcguga

SEQ ID NO: 50763 - RNA, 32 nt, Human
agccucccaaagugcuggcauuacaggcgugu

SEQ ID NO: 50764 - RNA, 32 nt, Human
agccucccaaagugcugggaucacaggcauga

SEQ ID NO: 50765 - RNA, 32 nt, Human
agccucccaaagugcugggaugacaggcguga

SEQ ID NO: 50766 - RNA, 32 nt, Human
agccucccaaagugcugggaugacaggcgugc

SEQ ID NO: 50767 - RNA, 32 nt, Human
agccucccaaagugcugggaugacagguguga

SEQ ID NO: 50768 - RNA, 32 nt, Human
agccucccaaagugcugggaugauaggcguga

SEQ ID NO: 50769 - RNA, 32 nt, Human
agccucccaaagugcugggauuaacagguaug

SEQ ID NO: 50770 - RNA, 32 nt, Human
agccucccaaagugcugggauuacaagcauga

SEQ ID NO: 50771 - RNA, 32 nt, Human
agccucccaaagugcugggauuacaagcguga

SEQ ID NO: 50772 - RNA, 32 nt, Human
agccucccaaagugcugggauuacaaguauga

SEQ ID NO: 50773 - RNA, 32 nt, Human
agccucccaaagugcugggauuacaaguguga

SEQ ID NO: 50774 - RNA, 32 nt, Human
agccucccaaagugcugggauuacagaccuga

SEQ ID NO: 50775 - RNA, 32 nt, Human
agccucccaaagugcugggauuacagacguga

SEQ ID NO: 50776 - RNA, 32 nt, Human
agccucccaaagugcugggauuacagaugaua

SEQ ID NO: 50777 - RNA, 32 nt, Human
agccucccaaagugcugggauuacagauguga

SEQ ID NO: 50778 - RNA, 32 nt, Human
agccucccaaagugcugggauuacagcccuga

SEQ ID NO: 50779 - RNA, 32 nt, Human
agccucccaaagugcugggauuacagcgaaga

SEQ ID NO: 50780 - RNA, 32 nt, Human
agccucccaaagugcugggauuacagcgugag

SEQ ID NO: 50781 - RNA, 32 nt, Human
agccucccaaagugcugggauuacagcuguga

SEQ ID NO: 50782 - RNA, 32 nt, Human
agccucccaaagugcugggauuacaggaauuu

SEQ ID NO: 50783 - RNA, 32 nt, Human
agccucccaaagugcugggauuacaggaguga

SEQ ID NO: 50784 - RNA, 32 nt, Human
agccucccaaagugcugggauuacaggaugag

SEQ ID NO: 50785 - RNA, 32 nt, Human
agccucccaaagugcugggauuacaggcaacu

SEQ ID NO: 50786 - RNA, 32 nt, Human
agccucccaaagugcugggauuacaggcauaa

SEQ ID NO: 50787 - RNA, 32 nt, Human
agccucccaaagugcugggauuacaggcauca

SEQ ID NO: 50788 - RNA, 32 nt, Human
agccucccaaagugcugggauuacaggcauga

SEQ ID NO: 50789 - RNA, 32 nt, Human
agccucccaaagugcugggauuacaggccacu

SEQ ID NO: 50790 - RNA, 32 nt, Human
agccucccaaagugcugggauuacaggccccu

SEQ ID NO: 50791 - RNA, 32 nt, Human
agccucccaaagugcugggauuacaggccuga

SEQ ID NO: 50792 - RNA, 32 nt, Human
agccucccaaagugcugggauuacaggcgcaa

SEQ ID NO: 50793 - RNA, 32 nt, Human
agccucccaaagugcugggauuacaggcgcga

SEQ ID NO: 50794 - RNA, 32 nt, Human
agccucccaaagugcugggauuacaggcggcc

SEQ ID NO: 50795 - RNA, 32 nt, Human
agccucccaaagugcugggauuacaggcguga

SEQ ID NO: 50796 - RNA, 32 nt, Human
agccucccaaagugcugggauuacaggcgugu

SEQ ID NO: 50797 - RNA, 32 nt, Human
agccucccaaagugcugggauuacaggcuuaa

SEQ ID NO: 50798 - RNA, 32 nt, Human
agccucccaaagugcugggauuacaggcuuca

SEQ ID NO: 50799 - RNA, 32 nt, Human
agccucccaaagugcugggauuacaggcuuga

SEQ ID NO: 50800 - RNA, 32 nt, Human
agccucccaaagugcugggauuacaggcuugg

SEQ ID NO: 50801 - RNA, 32 nt, Human
agccucccaaagugcugggauuacagggguga

SEQ ID NO: 50802 - RNA, 32 nt, Human
agccucccaaagugcugggauuacagguauga

SEQ ID NO: 50803 - RNA, 32 nt, Human
agccucccaaagugcugggauuacagguggga

SEQ ID NO: 50804 - RNA, 32 nt, Human
agccucccaaagugcugggauuacagguguaa

SEQ ID NO: 50805 - RNA, 32 nt, Human
agccucccaaagugcugggauuacagguguga

SEQ ID NO: 50806 - RNA, 32 nt, Human
agccucccaaagugcugggauuacagucauga

SEQ ID NO: 50807 - RNA, 32 nt, Human
agccucccaaagugcugggauuacaguugcga

SEQ ID NO: 50808 - RNA, 32 nt, Human
agccucccaaagugcugggauuaccggcuuga

SEQ ID NO: 50809 - RNA, 32 nt, Human
agccucccaaagugcugggauuaccgguauga

SEQ ID NO: 50810 - RNA, 32 nt, Human
agccucccaaagugcugggauuacugguguga

SEQ ID NO: 50811 - RNA, 32 nt, Human
agccucccaaagugcugggauuaggugugagc

SEQ ID NO: 50812 - RNA, 32 nt, Human
agccucccaaagugcugggauuauacguaugg

SEQ ID NO: 50813 - RNA, 32 nt, Human
agccucccaaagugcugggauuauaggcauga

SEQ ID NO: 50814 - RNA, 32 nt, Human
agccucccaaagugcugggauuauaggcguga

SEQ ID NO: 50815 - RNA, 32 nt, Human
agccucccaaagugcugggauuauaggcuggg

SEQ ID NO: 50816 - RNA, 32 nt, Human
agccucccaaagugcugggauuauagguguga

SEQ ID NO: 50817 - RNA, 32 nt, Human
agccucccaaagugcugggauugcaggcauga

SEQ ID NO: 50818 - RNA, 32 nt, Human
agccucccaaagugcugggauugcaggugcga

SEQ ID NO: 50819 - RNA, 32 nt, Human
agccucccaaagugcugggauugcagguguga

SEQ ID NO: 50820 - RNA, 32 nt, Human
agccucccaaagugcuuggauuacaggcauaa

SEQ ID NO: 50821 - RNA, 32 nt, Human
agccucccaaagugguaggauuacaggcguga

SEQ ID NO: 50822 - RNA, 32 nt, Human
agccucccaaaguggugggauuacagguguga

SEQ ID NO: 50823 - RNA, 32 nt, Human
agccucccaaaguggugggauuauaggcauga

SEQ ID NO: 50824 - RNA, 32 nt, Human
agccucccaaaguguggggauuacaggugcga

SEQ ID NO: 50825 - RNA, 32 nt, Human
agccucccaaaguguugagauuacaggcauga

SEQ ID NO: 50826 - RNA, 32 nt, Human
agccucccaaaguguugggauuacagacauua

SEQ ID NO: 50827 - RNA, 32 nt, Human
agccucccaaaguguugggauuacaggcauga

SEQ ID NO: 50828 - RNA, 32 nt, Human
agccucccaaaguguugggauuacaggcguga

SEQ ID NO: 50829 - RNA, 32 nt, Human
agccucccaaaguguugggauuacagguguga

SEQ ID NO: 50830 - RNA, 32 nt, Human
agccucccaaaguguugggauuauaagcguga

SEQ ID NO: 50831 - RNA, 32 nt, Human
agccucccaaaguucugggauuacaggcauga

SEQ ID NO: 50832 - RNA, 32 nt, Human
agccucccaaaguucugggauuacagguguga

SEQ ID NO: 50833 - RNA, 32 nt, Human
agccucccaaauagcggggauuacuggugcgu

SEQ ID NO: 50834 - RNA, 32 nt, Human
agccucccaaauagcugggacuacaaggugcc

SEQ ID NO: 50835 - RNA, 32 nt, Human
agccucccaaauagcugggacuacaggcacag

SEQ ID NO: 50836 - RNA, 32 nt, Human
agccucccaaauagcugggacuacaggucuac

SEQ ID NO: 50837 - RNA, 32 nt, Human
agccucccaaauagcugggaucacuggcacaa

SEQ ID NO: 50838 - RNA, 32 nt, Human
agccucccaaauagcugggauuacaggcaccc

SEQ ID NO: 50839 - RNA, 32 nt, Human
agccucccaaauagcugggauuacaggugcau

SEQ ID NO: 50840 - RNA, 32 nt, Human
agccucccaaauagcugggauuacaguugccu

SEQ ID NO: 50841 - RNA, 32 nt, Human
agccucccaaauagcuggggcuaccaugguau

SEQ ID NO: 50842 - RNA, 32 nt, Human
agccucccaaauagcugugauuacaggcgugc

SEQ ID NO: 50843 - RNA, 32 nt, Human
agccucccaaauuacugggauuacaggcauga

SEQ ID NO: 50844 - RNA, 32 nt, Human
agccucccaaauugcugggauuacaggcauga

SEQ ID NO: 50845 - RNA, 32 nt, Human
agccucccaaauugcugggauuacaggcguga

SEQ ID NO: 50846 - RNA, 32 nt, Human
agccucccaaauugcugggauuuacaggcaug

SEQ ID NO: 50847 - RNA, 32 nt, Human
agccucccaaccacacaacacaucaaacagga

SEQ ID NO: 50848 - RNA, 32 nt, Human
agccucccaacguacugggauuacaggcguga

SEQ ID NO: 50849 - RNA, 32 nt, Human
agccucccaacgugcugggauuacagccggug

SEQ ID NO: 50850 - RNA, 32 nt, Human
agccucccaacuagcugggauuacaggcgugc

SEQ ID NO: 50851 - RNA, 32 nt, Human
agccucccaacuugcugggauuacagguguga

SEQ ID NO: 50852 - RNA, 32 nt, Human
agccucccaagaagcugggauuacaggcaugc

SEQ ID NO: 50853 - RNA, 32 nt, Human
agccucccaagagggccgggugagggaugagg

SEQ ID NO: 50854 - RNA, 32 nt, Human
agccucccaagcagcugagauuacaggugcau

SEQ ID NO: 50855 - RNA, 32 nt, Human
agccucccaagcagcugggaagauaggcacgu

SEQ ID NO: 50856 - RNA, 32 nt, Human
agccucccaagcagcugggacuacaccaccac

SEQ ID NO: 50857 - RNA, 32 nt, Human
agccucccaagcagcugggacuacauguaugu

SEQ ID NO: 50858 - RNA, 32 nt, Human
agccucccaagcagcugggauuacaggcgcac

SEQ ID NO: 50859 - RNA, 32 nt, Human
agccucccaagcagcugggauuauagacaccc

SEQ ID NO: 50860 - RNA, 32 nt, Human
agccucccaagcuuucaccaucauggaccaga

SEQ ID NO: 50861 - RNA, 32 nt, Human
agccucccaaggagcugggauuacaggcacgc

SEQ ID NO: 50862 - RNA, 32 nt, Human
agccucccaaggugcugggauuacaggcacga

SEQ ID NO: 50863 - RNA, 32 nt, Human
agccucccaaggugcugggauuacaggcauga

SEQ ID NO: 50864 - RNA, 32 nt, Human
agccucccaaggugcugggauuacagguguga

SEQ ID NO: 50865 - RNA, 32 nt, Human
agccucccaaggugcugggauugcaggccggc

SEQ ID NO: 50866 - RNA, 32 nt, Human
agccucccaaguaacugggacugcaggcacau

SEQ ID NO: 50867 - RNA, 32 nt, Human
agccucccaaguaacugggauuacaggcaugc

SEQ ID NO: 50868 - RNA, 32 nt, Human
agccucccaaguaacugggauuacaggcaugu

SEQ ID NO: 50869 - RNA, 32 nt, Human
agccucccaaguaccugggacuacaggcacgc

SEQ ID NO: 50870 - RNA, 32 nt, Human
agccucccaaguaccugggacuacaggcguga

SEQ ID NO: 50871 - RNA, 32 nt, Human
agccucccaaguaccugggacuacaggugcgu

SEQ ID NO: 50872 - RNA, 32 nt, Human
agccucccaaguaccugggacuacaggugugc

SEQ ID NO: 50873 - RNA, 32 nt, Human
agccucccaaguaccugggauuacaggagcuc

SEQ ID NO: 50874 - RNA, 32 nt, Human
agccucccaaguaccugggauuacaggcaugu

SEQ ID NO: 50875 - RNA, 32 nt, Human
agccucccaaguacugggauuacagcuuccau

SEQ ID NO: 50876 - RNA, 32 nt, Human
agccucccaaguacugggauuacaggugccca

SEQ ID NO: 50877 - RNA, 32 nt, Human
agccucccaaguagauuacaggauuacaggag

SEQ ID NO: 50878 - RNA, 32 nt, Human
agccucccaaguagcagggacuauaggugugc

SEQ ID NO: 50879 - RNA, 32 nt, Human
agccucccaaguagccaggauuacaggcaccc

SEQ ID NO: 50880 - RNA, 32 nt, Human
agccucccaaguagccgggacuacaggcgcgc

SEQ ID NO: 50881 - RNA, 32 nt, Human
agccucccaaguagccgggacuacaggugccu

SEQ ID NO: 50882 - RNA, 32 nt, Human
agccucccaaguagccgggauugcaggcgcgc

SEQ ID NO: 50883 - RNA, 32 nt, Human
agccucccaaguagccggggccacaggugugu

SEQ ID NO: 50884 - RNA, 32 nt, Human
agccucccaaguagcuagaacuacaggugugu

SEQ ID NO: 50885 - RNA, 32 nt, Human
agccucccaaguagcuagcugggacuacaggc

SEQ ID NO: 50886 - RNA, 32 nt, Human
agccucccaaguagcuaggaccacaggugcgu

SEQ ID NO: 50887 - RNA, 32 nt, Human
agccucccaaguagcuaggacuacaggcacuc

SEQ ID NO: 50888 - RNA, 32 nt, Human
agccucccaaguagcuaggacuacaggcgccc

SEQ ID NO: 50889 - RNA, 32 nt, Human
agccucccaaguagcuaggacuacaggcgugu

SEQ ID NO: 50890 - RNA, 32 nt, Human
agccucccaaguagcuaggacuacaggugccc

SEQ ID NO: 50891 - RNA, 32 nt, Human
agccucccaaguagcuaggacuacaggugugc

SEQ ID NO: 50892 - RNA, 32 nt, Human
agccucccaaguagcuaggacugcaggcacca

SEQ ID NO: 50893 - RNA, 32 nt, Human
agccucccaaguagcuaggauuacagacaccc

SEQ ID NO: 50894 - RNA, 32 nt, Human
agccucccaaguagcuaggauuacaggcaugu

SEQ ID NO: 50895 - RNA, 32 nt, Human
agccucccaaguagcuagggauacagacacau

SEQ ID NO: 50896 - RNA, 32 nt, Human
agccucccaaguagcuccgauuacaggcaccc

SEQ ID NO: 50897 - RNA, 32 nt, Human
agccucccaaguagcucggacuacaggcgucc

SEQ ID NO: 50898 - RNA, 32 nt, Human
agccucccaaguagcugagacuacaggcacau

SEQ ID NO: 50899 - RNA, 32 nt, Human
agccucccaaguagcugagacuacaggcgugc

SEQ ID NO: 50900 - RNA, 32 nt, Human
agccucccaaguagcugagacuacaggugugc

SEQ ID NO: 50901 - RNA, 32 nt, Human
agccucccaaguagcugagacuacaggugugu

SEQ ID NO: 50902 - RNA, 32 nt, Human
agccucccaaguagcugagacuacagguucac

SEQ ID NO: 50903 - RNA, 32 nt, Human
agccucccaaguagcugagacuccagguauau

SEQ ID NO: 50904 - RNA, 32 nt, Human
agccucccaaguagcugagacugcaggcacga

SEQ ID NO: 50905 - RNA, 32 nt, Human
agccucccaaguagcugagauuacagaugcaa

SEQ ID NO: 50906 - RNA, 32 nt, Human
agccucccaaguagcugagauuacaggcacau

SEQ ID NO: 50907 - RNA, 32 nt, Human
agccucccaaguagcugagauuacaggugugc

SEQ ID NO: 50908 - RNA, 32 nt, Human
agccucccaaguagcugcgacuauggguguga

SEQ ID NO: 50909 - RNA, 32 nt, Human
agccucccaaguagcuggaacuacaggcucau

SEQ ID NO: 50910 - RNA, 32 nt, Human
agccucccaaguagcuggaacuauaggcacaa

SEQ ID NO: 50911 - RNA, 32 nt, Human
agccucccaaguagcuggaauuacaggagccc

SEQ ID NO: 50912 - RNA, 32 nt, Human
agccucccaaguagcuggaauuacaggcacau

SEQ ID NO: 50913 - RNA, 32 nt, Human
agccucccaaguagcuggaauuacaggcaccu

SEQ ID NO: 50914 - RNA, 32 nt, Human
agccucccaaguagcuggaauuacaggcgugu

SEQ ID NO: 50915 - RNA, 32 nt, Human
agccucccaaguagcuggaauuacagggaccc

SEQ ID NO: 50916 - RNA, 32 nt, Human
agccucccaaguagcuggauuacaggugcaug

SEQ ID NO: 50917 - RNA, 32 nt, Human
agccucccaaguagcuggcacuacagacacgc

SEQ ID NO: 50918 - RNA, 32 nt, Human
agccucccaaguagcugggaaaacaggccugu

SEQ ID NO: 50919 - RNA, 32 nt, Human
agccucccaaguagcugggaauacaggcacgc

SEQ ID NO: 50920 - RNA, 32 nt, Human
agccucccaaguagcugggaauacaggugucu

SEQ ID NO: 50921 - RNA, 32 nt, Human
agccucccaaguagcugggaauauagguguga

SEQ ID NO: 50922 - RNA, 32 nt, Human
agccucccaaguagcugggacaacaggugaaa

SEQ ID NO: 50923 - RNA, 32 nt, Human
agccucccaaguagcugggacaacaggugugc

SEQ ID NO: 50924 - RNA, 32 nt, Human
agccucccaaguagcugggaccacacgcaugc

SEQ ID NO: 50925 - RNA, 32 nt, Human
agccucccaaguagcugggaccacaggcagau

SEQ ID NO: 50926 - RNA, 32 nt, Human
agccucccaaguagcugggaccacaggcaugc

SEQ ID NO: 50927 - RNA, 32 nt, Human
agccucccaaguagcugggaccacaggcgccc

SEQ ID NO: 50928 - RNA, 32 nt, Human
agccucccaaguagcugggaccaccaugccca

SEQ ID NO: 50929 - RNA, 32 nt, Human
agccucccaaguagcugggaccgcaggcacac

SEQ ID NO: 50930 - RNA, 32 nt, Human
agccucccaaguagcugggacuacaagugcac

SEQ ID NO: 50931 - RNA, 32 nt, Human
agccucccaaguagcugggacuacaagugugu

SEQ ID NO: 50932 - RNA, 32 nt, Human
agccucccaaguagcugggacuacagaaucaa

SEQ ID NO: 50933 - RNA, 32 nt, Human
agccucccaaguagcugggacuacagaugcac

SEQ ID NO: 50934 - RNA, 32 nt, Human
agccucccaaguagcugggacuacaggcacac

SEQ ID NO: 50935 - RNA, 32 nt, Human
agccucccaaguagcugggacuacaggcaccc

SEQ ID NO: 50936 - RNA, 32 nt, Human
agccucccaaguagcugggacuacaggcaccu

SEQ ID NO: 50937 - RNA, 32 nt, Human
agccucccaaguagcugggacuacaggcacgu

SEQ ID NO: 50938 - RNA, 32 nt, Human
agccucccaaguagcugggacuacaggcauga

SEQ ID NO: 50939 - RNA, 32 nt, Human
agccucccaaguagcugggacuacaggcaugc

SEQ ID NO: 50940 - RNA, 32 nt, Human
agccucccaaguagcugggacuacaggcaugu

SEQ ID NO: 50941 - RNA, 32 nt, Human
agccucccaaguagcugggacuacaggcgccc

SEQ ID NO: 50942 - RNA, 32 nt, Human
agccucccaaguagcugggacuacaggcgccu

SEQ ID NO: 50943 - RNA, 32 nt, Human
agccucccaaguagcugggacuacaggcuuuc

SEQ ID NO: 50944 - RNA, 32 nt, Human
agccucccaaguagcugggacuacaggugcac

SEQ ID NO: 50945 - RNA, 32 nt, Human
agccucccaaguagcugggacuacaggugcau

SEQ ID NO: 50946 - RNA, 32 nt, Human
agccucccaaguagcugggacuacaggugcuc

SEQ ID NO: 50947 - RNA, 32 nt, Human
agccucccaaguagcugggacuacagguguac

SEQ ID NO: 50948 - RNA, 32 nt, Human
agccucccaaguagcugggacuacagguguau

SEQ ID NO: 50949 - RNA, 32 nt, Human
agccucccaaguagcugggacuacaggugugc

SEQ ID NO: 50950 - RNA, 32 nt, Human
agccucccaaguagcugggacuacaggugugu

SEQ ID NO: 50951 - RNA, 32 nt, Human
agccucccaaguagcugggacuacagguugcu

SEQ ID NO: 50952 - RNA, 32 nt, Human
agccucccaaguagcugggacuacagucaugu

SEQ ID NO: 50953 - RNA, 32 nt, Human
agccucccaaguagcugggacuacaguugugc

SEQ ID NO: 50954 - RNA, 32 nt, Human
agccucccaaguagcugggacuacaugcacau

SEQ ID NO: 50955 - RNA, 32 nt, Human
agccucccaaguagcugggacuacccgugcau

SEQ ID NO: 50956 - RNA, 32 nt, Human
agccucccaaguagcugggacuacggaugccu

SEQ ID NO: 50957 - RNA, 32 nt, Human
agccucccaaguagcugggacuacgggcacac

SEQ ID NO: 50958 - RNA, 32 nt, Human
agccucccaaguagcugggacuacgggcacau

SEQ ID NO: 50959 - RNA, 32 nt, Human
agccucccaaguagcugggacuacuggcaccc

SEQ ID NO: 50960 - RNA, 32 nt, Human
agccucccaaguagcugggacuauaggcacac

SEQ ID NO: 50961 - RNA, 32 nt, Human
agccucccaaguagcugggacuauaggcaccu

SEQ ID NO: 50962 - RNA, 32 nt, Human
agccucccaaguagcugggacuauaggcgccc

SEQ ID NO: 50963 - RNA, 32 nt, Human
agccucccaaguagcugggacuauaggugcgu

SEQ ID NO: 50964 - RNA, 32 nt, Human
agccucccaaguagcugggacuauagucacuu

SEQ ID NO: 50965 - RNA, 32 nt, Human
agccucccaaguagcugggacugcaggcauga

SEQ ID NO: 50966 - RNA, 32 nt, Human
agccucccaaguagcugggacugcaggugugc

SEQ ID NO: 50967 - RNA, 32 nt, Human
agccucccaaguagcugggacuucagacgccc

SEQ ID NO: 50968 - RNA, 32 nt, Human
agccucccaaguagcugggagccugggcaugc

SEQ ID NO: 50969 - RNA, 32 nt, Human
agccucccaaguagcugggaggacagguguga

SEQ ID NO: 50970 - RNA, 32 nt, Human
agccucccaaguagcugggaguacagcgucug

SEQ ID NO: 50971 - RNA, 32 nt, Human
agccucccaaguagcugggauaacaggcgccc

SEQ ID NO: 50972 - RNA, 32 nt, Human
agccucccaaguagcugggaugacaggcgcac

SEQ ID NO: 50973 - RNA, 32 nt, Human
agccucccaaguagcugggauuaaaggcacgu

SEQ ID NO: 50974 - RNA, 32 nt, Human
agccucccaaguagcugggauuacaccaccau

SEQ ID NO: 50975 - RNA, 32 nt, Human
agccucccaaguagcugggauuacagacucau

SEQ ID NO: 50976 - RNA, 32 nt, Human
agccucccaaguagcugggauuacagaucaug

SEQ ID NO: 50977 - RNA, 32 nt, Human
agccucccaaguagcugggauuacagaugugu

SEQ ID NO: 50978 - RNA, 32 nt, Human
agccucccaaguagcugggauuacagauugau

SEQ ID NO: 50979 - RNA, 32 nt, Human
agccucccaaguagcugggauuacagcgauug

SEQ ID NO: 50980 - RNA, 32 nt, Human
agccucccaaguagcugggauuacaggcacaa

SEQ ID NO: 50981 - RNA, 32 nt, Human
agccucccaaguagcugggauuacaggcacag

SEQ ID NO: 50982 - RNA, 32 nt, Human
agccucccaaguagcugggauuacaggcacau

SEQ ID NO: 50983 - RNA, 32 nt, Human
agccucccaaguagcugggauuacaggcaccc

SEQ ID NO: 50984 - RNA, 32 nt, Human
agccucccaaguagcugggauuacaggcaccu

SEQ ID NO: 50985 - RNA, 32 nt, Human
agccucccaaguagcugggauuacaggcacgc

SEQ ID NO: 50986 - RNA, 32 nt, Human
agccucccaaguagcugggauuacaggcagac

SEQ ID NO: 50987 - RNA, 32 nt, Human
agccucccaaguagcugggauuacaggcagca

SEQ ID NO: 50988 - RNA, 32 nt, Human
agccucccaaguagcugggauuacaggcauac

SEQ ID NO: 50989 - RNA, 32 nt, Human
agccucccaaguagcugggauuacaggcaugc

SEQ ID NO: 50990 - RNA, 32 nt, Human
agccucccaaguagcugggauuacaggcaugg

SEQ ID NO: 50991 - RNA, 32 nt, Human
agccucccaaguagcugggauuacaggcaugu

SEQ ID NO: 50992 - RNA, 32 nt, Human
agccucccaaguagcugggauuacaggcgcac

SEQ ID NO: 50993 - RNA, 32 nt, Human
agccucccaaguagcugggauuacaggcgcau

SEQ ID NO: 50994 - RNA, 32 nt, Human
agccucccaaguagcugggauuacaggcgccu

SEQ ID NO: 50995 - RNA, 32 nt, Human
agccucccaaguagcugggauuacaggcgcgu

SEQ ID NO: 50996 - RNA, 32 nt, Human
agccucccaaguagcugggauuacaggcgucc

SEQ ID NO: 50997 - RNA, 32 nt, Human
agccucccaaguagcugggauuacaggcgugc

SEQ ID NO: 50998 - RNA, 32 nt, Human
agccucccaaguagcugggauuacaggcgugu

SEQ ID NO: 50999 - RNA, 32 nt, Human
agccucccaaguagcugggauuacaggugcac

SEQ ID NO: 51000 - RNA, 32 nt, Human
agccucccaaguagcugggauuacaggugcag

SEQ ID NO: 51001 - RNA, 32 nt, Human
agccucccaaguagcugggauuacaggugccc

SEQ ID NO: 51002 - RNA, 32 nt, Human
agccucccaaguagcugggauuacaggugccu

SEQ ID NO: 51003 - RNA, 32 nt, Human
agccucccaaguagcugggauuacaggugcuc

SEQ ID NO: 51004 - RNA, 32 nt, Human
agccucccaaguagcugggauuacaggugucc

SEQ ID NO: 51005 - RNA, 32 nt, Human
agccucccaaguagcugggauuacagguguga

SEQ ID NO: 51006 - RNA, 32 nt, Human
agccucccaaguagcugggauuacaggugugc

SEQ ID NO: 51007 - RNA, 32 nt, Human
agccucccaaguagcugggauuacaggugugu

SEQ ID NO: 51008 - RNA, 32 nt, Human
agccucccaaguagcugggauuacagucaggc

SEQ ID NO: 51009 - RNA, 32 nt, Human
agccucccaaguagcugggauuacagugccug

SEQ ID NO: 51010 - RNA, 32 nt, Human
agccucccaaguagcugggauuacaguuccca

SEQ ID NO: 51011 - RNA, 32 nt, Human
agccucccaaguagcugggauuacaguuucca

SEQ ID NO: 51012 - RNA, 32 nt, Human
agccucccaaguagcugggauuacaugugugu

SEQ ID NO: 51013 - RNA, 32 nt, Human
agccucccaaguagcugggauuacgggcaugc

SEQ ID NO: 51014 - RNA, 32 nt, Human
agccucccaaguagcugggauuacuggugcac

SEQ ID NO: 51015 - RNA, 32 nt, Human
agccucccaaguagcugggauuauaggcaccu

SEQ ID NO: 51016 - RNA, 32 nt, Human
agccucccaaguagcugggauuauaggugccc

SEQ ID NO: 51017 - RNA, 32 nt, Human
agccucccaaguagcugggauuauaggugugu

SEQ ID NO: 51018 - RNA, 32 nt, Human
agccucccaaguagcugggauugcaggcgccc

SEQ ID NO: 51019 - RNA, 32 nt, Human
agccucccaaguagcuggggacuacaggugcg

SEQ ID NO: 51020 - RNA, 32 nt, Human
agccucccaaguagcuggggcuacaggcaccc

SEQ ID NO: 51021 - RNA, 32 nt, Human
agccucccaaguagcugggguuacaggcauuu

SEQ ID NO: 51022 - RNA, 32 nt, Human
agccucccaaguagcuggguuuauaggugccc

SEQ ID NO: 51023 - RNA, 32 nt, Human
agccucccaaguagcuggguuuauaugugccc

SEQ ID NO: 51024 - RNA, 32 nt, Human
agccucccaaguagcugguaccacaggcgcca

SEQ ID NO: 51025 - RNA, 32 nt, Human
agccucccaaguagcugguacuacaggugcgu

SEQ ID NO: 51026 - RNA, 32 nt, Human
agccucccaaguagcugugacuaaaggugcac

SEQ ID NO: 51027 - RNA, 32 nt, Human
agccucccaaguagcugugacuacaggcgcau

SEQ ID NO: 51028 - RNA, 32 nt, Human
agccucccaaguagcuuggacuacaggcccug

SEQ ID NO: 51029 - RNA, 32 nt, Human
agccucccaaguagcuuggacuauaggugcau

SEQ ID NO: 51030 - RNA, 32 nt, Human
agccucccaaguagcuuggauuacagagguug

SEQ ID NO: 51031 - RNA, 32 nt, Human
agccucccaaguaggugggacuacaggugccc

SEQ ID NO: 51032 - RNA, 32 nt, Human
agccucccaaguaggugggacuauagguucgc

SEQ ID NO: 51033 - RNA, 32 nt, Human
agccucccaaguaggugggauuacaggcaugc

SEQ ID NO: 51034 - RNA, 32 nt, Human
agccucccaaguaggugggauuacaggcgccc

SEQ ID NO: 51035 - RNA, 32 nt, Human
agccucccaaguaguugggacuacaggcaugc

SEQ ID NO: 51036 - RNA, 32 nt, Human
agccucccaaguaguugggauuacaggcaccu

SEQ ID NO: 51037 - RNA, 32 nt, Human
agccucccaaguaguugggauuacaggcaugc

SEQ ID NO: 51038 - RNA, 32 nt, Human
agccucccaaguaguugggauuacgggcaugc

SEQ ID NO: 51039 - RNA, 32 nt, Human
agccucccaaguaucugggacuacaggcaugc

SEQ ID NO: 51040 - RNA, 32 nt, Human
agccucccaagucacugggauuacaggugccc

SEQ ID NO: 51041 - RNA, 32 nt, Human
agccucccaaguggcuaagacuuaacaaacag

SEQ ID NO: 51042 - RNA, 32 nt, Human
agccucccaaguggcugggauuacaggcgcaa

SEQ ID NO: 51043 - RNA, 32 nt, Human
agccucccaaguggcugggauuauaggugccc

SEQ ID NO: 51044 - RNA, 32 nt, Human
agccucccaaguggcugggauugcaggcauga

SEQ ID NO: 51045 - RNA, 32 nt, Human
agccucccaaugugcugagauugcaggcauga

SEQ ID NO: 51046 - RNA, 32 nt, Human
agccucccaaugugcugggauuacaggcauga

SEQ ID NO: 51047 - RNA, 32 nt, Human
agccucccacaagaccuggggcucagggcagc

SEQ ID NO: 51048 - RNA, 32 nt, Human
agccucccacagugcugggauuacaggcaugg

SEQ ID NO: 51049 - RNA, 32 nt, Human
agccucccacagugcugggauuacaggcguga

SEQ ID NO: 51050 - RNA, 32 nt, Human
agccucccacagugcugggauuagaggcauga

SEQ ID NO: 51051 - RNA, 32 nt, Human
agccucccaccucggucuucugaguagcuggg

SEQ ID NO: 51052 - RNA, 32 nt, Human
agccucccagacggcugggauuccaggcguga

SEQ ID NO: 51053 - RNA, 32 nt, Human
agccucccagacugcugagauuacaggcguga

SEQ ID NO: 51054 - RNA, 32 nt, Human
agccucccagacuguugggauuacaggcauga

SEQ ID NO: 51055 - RNA, 32 nt, Human
agccucccagaguacugggauuacaggcucuu

SEQ ID NO: 51056 - RNA, 32 nt, Human
agccucccagagugcuaggauuacaggcauga

SEQ ID NO: 51057 - RNA, 32 nt, Human
agccucccagagugcuaggauuacaggccuuu

SEQ ID NO: 51058 - RNA, 32 nt, Human
agccucccagagugcugggauuacaauuguga

SEQ ID NO: 51059 - RNA, 32 nt, Human
agccucccagagugcugggauuacagguguga

SEQ ID NO: 51060 - RNA, 32 nt, Human
agccucccagauagcugggacuacaggcacac

SEQ ID NO: 51061 - RNA, 29 nt, Human
agccucccaggagggagacgcuggggugc

SEQ ID NO: 51062 - RNA, 32 nt, Human
agccucccaggagggagacgcuggggugcaaa

SEQ ID NO: 51063 - RNA, 32 nt, Human
agccucccagguagcugggaauacaagcgugu

SEQ ID NO: 51064 - RNA, 32 nt, Human
agccucccagguagcugggacuacaggcacac

SEQ ID NO: 51065 - RNA, 32 nt, Human
agccucccagguagcugggacuacaggcgugc

SEQ ID NO: 51066 - RNA, 32 nt, Human
agccucccagguagcugggacuauaggcacgu

SEQ ID NO: 51067 - RNA, 32 nt, Human
agccucccagguagcugggacuaugggugcac

SEQ ID NO: 51068 - RNA, 32 nt, Human
agccucccagguagcugggauagcaggugugu

SEQ ID NO: 51069 - RNA, 32 nt, Human
agccucccagguagcugggauuacaggcaccc

SEQ ID NO: 51070 - RNA, 32 nt, Human
agccucccagguagcugggauuacaggcaugc

SEQ ID NO: 51071 - RNA, 32 nt, Human
agccucccagguagcugggauuacaggcuccc

SEQ ID NO: 51072 - RNA, 32 nt, Human
agccucccagguagcugggauuucaggugugc

SEQ ID NO: 51073 - RNA, 32 nt, Human
agccucccagguggcugggauuacaggcaugc

SEQ ID NO: 51074 - RNA, 32 nt, Human
agccucccagugugcugggauuacaggcauga

SEQ ID NO: 51075 - RNA, 32 nt, Human
agccucccauauagcugggauuauaggugccu

SEQ ID NO: 51076 - RNA, 32 nt, Human
agccucccaucgccuucaaccuggcugcauuc

SEQ ID NO: 51077 - RNA, 32 nt, Human
agccuccccaacuacuccagacuguccugcuc

SEQ ID NO: 51078 - RNA, 32 nt, Human
agccuccccaagugcugggauuacaggcguga

SEQ ID NO: 51079 - RNA, 21 nt, Human
agccuccccaaucccagccca

SEQ ID NO: 51080 - RNA, 32 nt, Human
agccuccccagcagcugggacuacaggcacac

SEQ ID NO: 51081 - RNA, 32 nt, Human
agccuccccagcagcugggacuacaggcaccc

SEQ ID NO: 51082 - RNA, 32 nt, Human
agccuccccagcagcugggacuacaggugcac

SEQ ID NO: 51083 - RNA, 32 nt, Human
agccuccccaguagcugagacuauacaggugc

SEQ ID NO: 51084 - RNA, 32 nt, Human
agccuccccaguagcugagauugcaggcacau

SEQ ID NO: 51085 - RNA, 32 nt, Human
agccuccccaguagcuggaacuacaggcaugc

SEQ ID NO: 51086 - RNA, 32 nt, Human
agccuccccaguagcuggaacuacaggcgugc

SEQ ID NO: 51087 - RNA, 32 nt, Human
agccuccccaguagcuggaacuacaggugugu

SEQ ID NO: 51088 - RNA, 32 nt, Human
agccuccccaguagcugggaauacaggcaccc

SEQ ID NO: 51089 - RNA, 32 nt, Human
agccuccccaguagcugggaccacaggcucau

SEQ ID NO: 51090 - RNA, 32 nt, Human
agccuccccaguagcugggacuacagacgugu

SEQ ID NO: 51091 - RNA, 32 nt, Human
agccuccccaguagcugggacuacaggcaugu

SEQ ID NO: 51092 - RNA, 32 nt, Human
agccuccccaguagcugggacuacaggccucc

SEQ ID NO: 51093 - RNA, 32 nt, Human
agccuccccaguagcugggacuacaggcgccc

SEQ ID NO: 51094 - RNA, 32 nt, Human
agccuccccaguagcugggacuacaggcgccu

SEQ ID NO: 51095 - RNA, 32 nt, Human
agccuccccaguagcugggacuacaggugugc

SEQ ID NO: 51096 - RNA, 32 nt, Human
agccuccccaguagcugggacuacggggucgc

SEQ ID NO: 51097 - RNA, 32 nt, Human
agccuccccaguagcugggacuccaggcaccc

SEQ ID NO: 51098 - RNA, 32 nt, Human
agccuccccaguagcugggaucacaggugccc

SEQ ID NO: 51099 - RNA, 32 nt, Human
agccuccccaguagcugggauuacaggcacca

SEQ ID NO: 51100 - RNA, 32 nt, Human
agccuccccaguagcugggauuacaggcaccc

SEQ ID NO: 51101 - RNA, 32 nt, Human
agccuccccaguagcugggauuacaggcaccu

SEQ ID NO: 51102 - RNA, 32 nt, Human
agccuccccaguagcugggauuacaggcgccc

SEQ ID NO: 51103 - RNA, 32 nt, Human
agccuccccaguagcugggauuacaggcgccg

SEQ ID NO: 51104 - RNA, 32 nt, Human
agccuccccaguagcugggauuacaggcgugg

SEQ ID NO: 51105 - RNA, 32 nt, Human
agccuccccaguagcugggauuacaggcucau

SEQ ID NO: 51106 - RNA, 32 nt, Human
agccuccccaguagcugggauuacaguguuau

SEQ ID NO: 51107 - RNA, 32 nt, Human
agccuccccaguagcugugauuaaaggcgccu

SEQ ID NO: 51108 - RNA, 32 nt, Human
agccucccccaagcuccuccacugacccagga

SEQ ID NO: 51109 - RNA, 32 nt, Human
agccucccccgcagcuaggauuacaggcacgc

SEQ ID NO: 51110 - RNA, 32 nt, Human
agccucccccguugccccucuggauccacugc

SEQ ID NO: 51111 - RNA, 32 nt, Human
agccuccccgagugcugggauuaaagacguga

SEQ ID NO: 51112 - RNA, 20 nt, Human
agccuccccuagcccacccc

SEQ ID NO: 51113 - RNA, 32 nt, Human
agccuccccucaggcuuuccagucaccaggga

SEQ ID NO: 51114 - RNA, 32 nt, Human
agccuccccucggcgaucgcgcagccccaucu

SEQ ID NO: 51115 - RNA, 23 nt, Human
agccuccccucuuccccucccca

SEQ ID NO: 51116 - RNA, 32 nt, Human
agccuccccugccccugccugcccacccugcc

SEQ ID NO: 51117 - RNA, 32 nt, Human
agccuccccuggugaagacacaaacugucacc

SEQ ID NO: 51118 - RNA, 23 nt, Human
agccuccccuucuucccgcccca

SEQ ID NO: 51119 - RNA, 32 nt, Human
agccucccgaaaugcuuugggauuacgggugu

SEQ ID NO: 51120 - RNA, 32 nt, Human
agccucccgaagagcugggauuacacgcauac

SEQ ID NO: 51121 - RNA, 32 nt, Human
agccucccgaagugcugggauuacaggcguaa

SEQ ID NO: 51122 - RNA, 32 nt, Human
agccucccgaagugcugggauuacaggcguga

SEQ ID NO: 51123 - RNA, 32 nt, Human
agccucccgaaguguugggauuacaggcacga

SEQ ID NO: 51124 - RNA, 32 nt, Human
agccucccgaauagcugggacuacagguguga

SEQ ID NO: 51125 - RNA, 32 nt, Human
agccucccgaauagcugggauuacacgugccc

SEQ ID NO: 51126 - RNA, 32 nt, Human
agccucccgaauagcugggauuacaggcgccc

SEQ ID NO: 51127 - RNA, 32 nt, Human
agccucccgaauaucugggauuacaggugccc

SEQ ID NO: 51128 - RNA, 32 nt, Human
agccucccgagcagcugggacuacaggcgccc

SEQ ID NO: 51129 - RNA, 32 nt, Human
agccucccgagcagcugggacuacaggcgugc

SEQ ID NO: 51130 - RNA, 32 nt, Human
agccucccgagcagcugggauuacaggcgccc

SEQ ID NO: 51131 - RNA, 32 nt, Human
agccucccgaguaacugggacuacagcugcag

SEQ ID NO: 51132 - RNA, 32 nt, Human
agccucccgaguaacugggacuacaggcgcgu

SEQ ID NO: 51133 - RNA, 32 nt, Human
agccucccgaguaacugggacuacaggugccc

SEQ ID NO: 51134 - RNA, 32 nt, Human
agccucccgaguaacugggauuacaggcgggc

SEQ ID NO: 51135 - RNA, 32 nt, Human
agccucccgaguaacugggauuacaggcuugu

SEQ ID NO: 51136 - RNA, 32 nt, Human
agccucccgaguaacugggauuauaggcaugc

SEQ ID NO: 51137 - RNA, 32 nt, Human
agccucccgaguaccugagauuagcccaggua

SEQ ID NO: 51138 - RNA, 32 nt, Human
agccucccgaguaccugggacuacaggcacuc

SEQ ID NO: 51139 - RNA, 32 nt, Human
agccucccgaguaccugggauuacaggcaugc

SEQ ID NO: 51140 - RNA, 32 nt, Human
agccucccgaguaccugggauuacaggcaugu

SEQ ID NO: 51141 - RNA, 32 nt, Human
agccucccgaguacugggaauauaggugcacg

SEQ ID NO: 51142 - RNA, 32 nt, Human
agccucccgaguacugggacuacaggcgcccg

SEQ ID NO: 51143 - RNA, 32 nt, Human
agccucccgaguagcagggauuaccggugugc

SEQ ID NO: 51144 - RNA, 32 nt, Human
agccucccgaguagccaggauuaaaggugccu

SEQ ID NO: 51145 - RNA, 32 nt, Human
agccucccgaguagccgggacuacaggcgccc

SEQ ID NO: 51146 - RNA, 32 nt, Human
agccucccgaguagcggggauuacaggcacgc

SEQ ID NO: 51147 - RNA, 32 nt, Human
agccucccgaguagcggggauuacaggcgcac

SEQ ID NO: 51148 - RNA, 32 nt, Human
agccucccgaguagcuaggacuacaggcacgu

SEQ ID NO: 51149 - RNA, 32 nt, Human
agccucccgaguagcuaggauuacagaagcau

SEQ ID NO: 51150 - RNA, 32 nt, Human
agccucccgaguagcuaggauuacaggcgccc

SEQ ID NO: 51151 - RNA, 32 nt, Human
agccucccgaguagcucagauuacaggcaugu

SEQ ID NO: 51152 - RNA, 32 nt, Human
agccucccgaguagcugagaccacaggugcgu

SEQ ID NO: 51153 - RNA, 32 nt, Human
agccucccgaguagcugagacuacaggcaccu

SEQ ID NO: 51154 - RNA, 32 nt, Human
agccucccgaguagcugagacuacaggcaugc

SEQ ID NO: 51155 - RNA, 32 nt, Human
agccucccgaguagcugagacuacaggugcau

SEQ ID NO: 51156 - RNA, 32 nt, Human
agccucccgaguagcugagacuucaggugcau

SEQ ID NO: 51157 - RNA, 32 nt, Human
agccucccgaguagcugagauuacaggcgccc

SEQ ID NO: 51158 - RNA, 32 nt, Human
agccucccgaguagcugagauuacaggugcac

SEQ ID NO: 51159 - RNA, 32 nt, Human
agccucccgaguagcugagauuacaggugcgc

SEQ ID NO: 51160 - RNA, 32 nt, Human
agccucccgaguagcugagauuacagguuuuu

SEQ ID NO: 51161 - RNA, 32 nt, Human
agccucccgaguagcugagauuauaggcaccu

SEQ ID NO: 51162 - RNA, 32 nt, Human
agccucccgaguagcugagauuauaggcgugc

SEQ ID NO: 51163 - RNA, 32 nt, Human
agccucccgaguagcugcaauuacaggagccu

SEQ ID NO: 51164 - RNA, 32 nt, Human
agccucccgaguagcugcgacuacaggcgccg

SEQ ID NO: 51165 - RNA, 32 nt, Human
agccucccgaguagcuggaaccacagaacauc

SEQ ID NO: 51166 - RNA, 32 nt, Human
agccucccgaguagcuggaacuacaggcacac

SEQ ID NO: 51167 - RNA, 32 nt, Human
agccucccgaguagcuggaauuacaggcaccu

SEQ ID NO: 51168 - RNA, 32 nt, Human
agccucccgaguagcuggaauuacaggcaugc

SEQ ID NO: 51169 - RNA, 32 nt, Human
agccucccgaguagcuggaauuauaggcgugc

SEQ ID NO: 51170 - RNA, 32 nt, Human
agccucccgaguagcuggaauugcagacaccc

SEQ ID NO: 51171 - RNA, 32 nt, Human
agccucccgaguagcuggacuaacaggcacac

SEQ ID NO: 51172 - RNA, 32 nt, Human
agccucccgaguagcuggauuuacagaugcau

SEQ ID NO: 51173 - RNA, 32 nt, Human
agccucccgaguagcuggcacuacaggcaccc

SEQ ID NO: 51174 - RNA, 32 nt, Human
agccucccgaguagcuggcauuacaggcaugu

SEQ ID NO: 51175 - RNA, 32 nt, Human
agccucccgaguagcuggcauuacaggcgccc

SEQ ID NO: 51176 - RNA, 32 nt, Human
agccucccgaguagcuggcauuacaggcgccu

SEQ ID NO: 51177 - RNA, 32 nt, Human
agccucccgaguagcugggacaacagguacgc

SEQ ID NO: 51178 - RNA, 32 nt, Human
agccucccgaguagcugggaccacaggggccc

SEQ ID NO: 51179 - RNA, 32 nt, Human
agccucccgaguagcugggaccacaggugccu

SEQ ID NO: 51180 - RNA, 32 nt, Human
agccucccgaguagcugggaccacagguguau

SEQ ID NO: 51181 - RNA, 32 nt, Human
agccucccgaguagcugggaccgcgggugugu

SEQ ID NO: 51182 - RNA, 32 nt, Human
agccucccgaguagcugggacuacaagcggcu

SEQ ID NO: 51183 - RNA, 32 nt, Human
agccucccgaguagcugggacuacaagugugc

SEQ ID NO: 51184 - RNA, 32 nt, Human
agccucccgaguagcugggacuacacccagcu

SEQ ID NO: 51185 - RNA, 32 nt, Human
agccucccgaguagcugggacuacagaagugc

SEQ ID NO: 51186 - RNA, 32 nt, Human
agccucccgaguagcugggacuacagacaccc

SEQ ID NO: 51187 - RNA, 32 nt, Human
agccucccgaguagcugggacuacagagucuu

SEQ ID NO: 51188 - RNA, 32 nt, Human
agccucccgaguagcugggacuacaggagcgu

SEQ ID NO: 51189 - RNA, 32 nt, Human
agccucccgaguagcugggacuacaggcacaa

SEQ ID NO: 51190 - RNA, 32 nt, Human
agccucccgaguagcugggacuacaggcaccc

SEQ ID NO: 51191 - RNA, 32 nt, Human
agccucccgaguagcugggacuacaggcaccu

SEQ ID NO: 51192 - RNA, 32 nt, Human
agccucccgaguagcugggacuacaggcacgu

SEQ ID NO: 51193 - RNA, 32 nt, Human
agccucccgaguagcugggacuacaggcaggc

SEQ ID NO: 51194 - RNA, 32 nt, Human
agccucccgaguagcugggacuacaggcaugc

SEQ ID NO: 51195 - RNA, 32 nt, Human
agccucccgaguagcugggacuacaggcaugu

SEQ ID NO: 51196 - RNA, 32 nt, Human
agccucccgaguagcugggacuacaggcgcca

SEQ ID NO: 51197 - RNA, 32 nt, Human
agccucccgaguagcugggacuacaggcgccc

SEQ ID NO: 51198 - RNA, 32 nt, Human
agccucccgaguagcugggacuacaggcgccu

SEQ ID NO: 51199 - RNA, 32 nt, Human
agccucccgaguagcugggacuacaggcgcgc

SEQ ID NO: 51200 - RNA, 32 nt, Human
agccucccgaguagcugggacuacaggcgcgu

SEQ ID NO: 51201 - RNA, 32 nt, Human
agccucccgaguagcugggacuacaggcggcc

SEQ ID NO: 51202 - RNA, 32 nt, Human
agccucccgaguagcugggacuacaggcgucc

SEQ ID NO: 51203 - RNA, 32 nt, Human
agccucccgaguagcugggacuacaggcgugc

SEQ ID NO: 51204 - RNA, 32 nt, Human
agccucccgaguagcugggacuacaggcgugu

SEQ ID NO: 51205 - RNA, 32 nt, Human
agccucccgaguagcugggacuacaggggccc

SEQ ID NO: 51206 - RNA, 32 nt, Human
agccucccgaguagcugggacuacaggugcac

SEQ ID NO: 51207 - RNA, 32 nt, Human
agccucccgaguagcugggacuacaggugcau

SEQ ID NO: 51208 - RNA, 32 nt, Human
agccucccgaguagcugggacuacaggugcca

SEQ ID NO: 51209 - RNA, 32 nt, Human
agccucccgaguagcugggacuacaggugccc

SEQ ID NO: 51210 - RNA, 32 nt, Human
agccucccgaguagcugggacuacaggugccu

SEQ ID NO: 51211 - RNA, 32 nt, Human
agccucccgaguagcugggacuacaggugucc

SEQ ID NO: 51212 - RNA, 32 nt, Human
agccucccgaguagcugggacuacaggugugc

SEQ ID NO: 51213 - RNA, 32 nt, Human
agccucccgaguagcugggacuacaggugugg

SEQ ID NO: 51214 - RNA, 32 nt, Human
agccucccgaguagcugggacuacgggcacgc

SEQ ID NO: 51215 - RNA, 32 nt, Human
agccucccgaguagcugggacuacugguacau

SEQ ID NO: 51216 - RNA, 32 nt, Human
agccucccgaguagcugggacuagaggaacgu

SEQ ID NO: 51217 - RNA, 32 nt, Human
agccucccgaguagcugggacuauagaugcgc

SEQ ID NO: 51218 - RNA, 32 nt, Human
agccucccgaguagcugggacuauaggcgccc

SEQ ID NO: 51219 - RNA, 32 nt, Human
agccucccgaguagcugggacuauaggugggc

SEQ ID NO: 51220 - RNA, 32 nt, Human
agccucccgaguagcugggacuauaggugugu

SEQ ID NO: 51221 - RNA, 32 nt, Human
agccucccgaguagcugggacugcaggcacac

SEQ ID NO: 51222 - RNA, 32 nt, Human
agccucccgaguagcugggacugcaggugugu

SEQ ID NO: 51223 - RNA, 32 nt, Human
agccucccgaguagcugggaguacaggcacac

SEQ ID NO: 51224 - RNA, 32 nt, Human
agccucccgaguagcugggaguacaggugcac

SEQ ID NO: 51225 - RNA, 32 nt, Human
agccucccgaguagcugggagugcaggugcac

SEQ ID NO: 51226 - RNA, 32 nt, Human
agccucccgaguagcugggaucacaggugugc

SEQ ID NO: 51227 - RNA, 32 nt, Human
agccucccgaguagcugggauuacaagcaccc

SEQ ID NO: 51228 - RNA, 32 nt, Human
agccucccgaguagcugggauuacaagugcac

SEQ ID NO: 51229 - RNA, 32 nt, Human
agccucccgaguagcugggauuacaagugcgc

SEQ ID NO: 51230 - RNA, 32 nt, Human
agccucccgaguagcugggauuacagacaugu

SEQ ID NO: 51231 - RNA, 32 nt, Human
agccucccgaguagcugggauuacagccugaa

SEQ ID NO: 51232 - RNA, 32 nt, Human
agccucccgaguagcugggauuacaggaagau

SEQ ID NO: 51233 - RNA, 32 nt, Human
agccucccgaguagcugggauuacaggaaucu

SEQ ID NO: 51234 - RNA, 32 nt, Human
agccucccgaguagcugggauuacaggagcgu

SEQ ID NO: 51235 - RNA, 32 nt, Human
agccucccgaguagcugggauuacaggaggcu

SEQ ID NO: 51236 - RNA, 32 nt, Human
agccucccgaguagcugggauuacaggaugac

SEQ ID NO: 51237 - RNA, 32 nt, Human
agccucccgaguagcugggauuacaggcacac

SEQ ID NO: 51238 - RNA, 32 nt, Human
agccucccgaguagcugggauuacaggcaccc

SEQ ID NO: 51239 - RNA, 32 nt, Human
agccucccgaguagcugggauuacaggcaccu

SEQ ID NO: 51240 - RNA, 32 nt, Human
agccucccgaguagcugggauuacaggcacgc

SEQ ID NO: 51241 - RNA, 32 nt, Human
agccucccgaguagcugggauuacaggcaucu

SEQ ID NO: 51242 - RNA, 32 nt, Human
agccucccgaguagcugggauuacaggcauga

SEQ ID NO: 51243 - RNA, 32 nt, Human
agccucccgaguagcugggauuacaggcaugc

SEQ ID NO: 51244 - RNA, 32 nt, Human
agccucccgaguagcugggauuacaggcaugu

SEQ ID NO: 51245 - RNA, 32 nt, Human
agccucccgaguagcugggauuacaggcgcac

SEQ ID NO: 51246 - RNA, 32 nt, Human
agccucccgaguagcugggauuacaggcgccc

SEQ ID NO: 51247 - RNA, 32 nt, Human
agccucccgaguagcugggauuacaggcgccu

SEQ ID NO: 51248 - RNA, 32 nt, Human
agccucccgaguagcugggauuacaggcgugc

SEQ ID NO: 51249 - RNA, 32 nt, Human
agccucccgaguagcugggauuacaggcgugu

SEQ ID NO: 51250 - RNA, 32 nt, Human
agccucccgaguagcugggauuacagggugaa

SEQ ID NO: 51251 - RNA, 32 nt, Human
agccucccgaguagcugggauuacaggugagc

SEQ ID NO: 51252 - RNA, 32 nt, Human
agccucccgaguagcugggauuacaggugcau

SEQ ID NO: 51253 - RNA, 32 nt, Human
agccucccgaguagcugggauuacaggugccc

SEQ ID NO: 51254 - RNA, 32 nt, Human
agccucccgaguagcugggauuacaggugccu

SEQ ID NO: 51255 - RNA, 32 nt, Human
agccucccgaguagcugggauuacaggugcgc

SEQ ID NO: 51256 - RNA, 32 nt, Human
agccucccgaguagcugggauuacagguggug

SEQ ID NO: 51257 - RNA, 32 nt, Human
agccucccgaguagcugggauuacaggugugc

SEQ ID NO: 51258 - RNA, 32 nt, Human
agccucccgaguagcugggauuacaggugugg

SEQ ID NO: 51259 - RNA, 32 nt, Human
agccucccgaguagcugggauuacgggcauau

SEQ ID NO: 51260 - RNA, 32 nt, Human
agccucccgaguagcugggauuacgggcgccc

SEQ ID NO: 51261 - RNA, 32 nt, Human
agccucccgaguagcugggauuacuggugccc

SEQ ID NO: 51262 - RNA, 32 nt, Human
agccucccgaguagcugggauuagaggcgcca

SEQ ID NO: 51263 - RNA, 32 nt, Human
agccucccgaguagcugggauuagaggcgugu

SEQ ID NO: 51264 - RNA, 32 nt, Human
agccucccgaguagcugggauuauagacacgu

SEQ ID NO: 51265 - RNA, 32 nt, Human
agccucccgaguagcugggauuauaggcaccc

SEQ ID NO: 51266 - RNA, 32 nt, Human
agccucccgaguagcugggauuauaggcaccu

SEQ ID NO: 51267 - RNA, 32 nt, Human
agccucccgaguagcugggauuauaggcgagu

SEQ ID NO: 51268 - RNA, 32 nt, Human
agccucccgaguagcugggauuaugggcgccc

SEQ ID NO: 51269 - RNA, 32 nt, Human
agccucccgaguagcugggauuccaggcgccc

SEQ ID NO: 51270 - RNA, 32 nt, Human
agccucccgaguagcugggauuccaggugccc

SEQ ID NO: 51271 - RNA, 32 nt, Human
agccucccgaguagcugggauugcaggagccu

SEQ ID NO: 51272 - RNA, 32 nt, Human
agccucccgaguagcugggauugcaggcgccc

SEQ ID NO: 51273 - RNA, 32 nt, Human
agccucccgaguagcugggauugcagguaccc

SEQ ID NO: 51274 - RNA, 32 nt, Human
agccucccgaguagcugggauugcaggugccc

SEQ ID NO: 51275 - RNA, 32 nt, Human
agccucccgaguagcugggccuaaaggugccc

SEQ ID NO: 51276 - RNA, 32 nt, Human
agccucccgaguagcugggcuuacgggcacau

SEQ ID NO: 51277 - RNA, 32 nt, Human
agccucccgaguagcuggggcuacaggugugu

SEQ ID NO: 51278 - RNA, 32 nt, Human
agccucccgaguagcugggguuacaggcaugc

SEQ ID NO: 51279 - RNA, 32 nt, Human
agccucccgaguagcuggguuuacagguaugc

SEQ ID NO: 51280 - RNA, 32 nt, Human
agccucccgaguagcugguaaaacaggucaac

SEQ ID NO: 51281 - RNA, 32 nt, Human
agccucccgaguagcugguacuacaggcacac

SEQ ID NO: 51282 - RNA, 32 nt, Human
agccucccgaguagcuuggacuacaggcgugc

SEQ ID NO: 51283 - RNA, 32 nt, Human
agccucccgaguagggaggaccacagguguga

SEQ ID NO: 51284 - RNA, 32 nt, Human
agccucccgaguaggugggaccacaggcaugc

SEQ ID NO: 51285 - RNA, 32 nt, Human
agccucccgaguaggugggacuacaggugccc

SEQ ID NO: 51286 - RNA, 32 nt, Human
agccucccgaguaggugggauuauaggagcgu

SEQ ID NO: 51287 - RNA, 32 nt, Human
agccucccgaguaguugggauuacaggcgccu

SEQ ID NO: 51288 - RNA, 32 nt, Human
agccucccgaguaguugggauuacaggugacu

SEQ ID NO: 51289 - RNA, 32 nt, Human
agccucccgaguaucugggauuauaagcaaga

SEQ ID NO: 51290 - RNA, 32 nt, Human
agccucccgaguaucuggggcuacaggcaugu

SEQ ID NO: 51291 - RNA, 32 nt, Human
agccucccgagugacucggauuacaggcaugu

SEQ ID NO: 51292 - RNA, 32 nt, Human
agccucccgaguggcugggauuagcggcaugc

SEQ ID NO: 51293 - RNA, 32 nt, Human
agccucccgaguugcugggauugcgggcaugg

SEQ ID NO: 51294 - RNA, 32 nt, Human
agccucccgauaagcugagauuacaggaguuu

SEQ ID NO: 51295 - RNA, 32 nt, Human
agccucccgauuagcugggacuacaggcgccc

SEQ ID NO: 51296 - RNA, 32 nt, Human
agccucccgauuagcugggaucacaggugugc

SEQ ID NO: 51297 - RNA, 32 nt, Human
agccucccgcgcagcugggacugcaggggugu

SEQ ID NO: 51298 - RNA, 32 nt, Human
agccucccggggagcugggaccacaggcacgu

SEQ ID NO: 51299 - RNA, 32 nt, Human
agccucccggguagcugggacuacaggcgccu

SEQ ID NO: 51300 - RNA, 32 nt, Human
agccucccggguagcugggauuacaggcaugu

SEQ ID NO: 51301 - RNA, 32 nt, Human
agccucccggguagcugggauugcagacgugc

SEQ ID NO: 51302 - RNA, 32 nt, Human
agccucccggguagcugguacuacaggcuccu

SEQ ID NO: 51303 - RNA, 32 nt, Human
agccucccggguggcugggaucacaggcgugc

SEQ ID NO: 51304 - RNA, 32 nt, Human
agccucccggguggcugggauuguaggagugu

SEQ ID NO: 51305 - RNA, 32 nt, Human
agccucccguguagcugggacuacaggcacgc

SEQ ID NO: 51306 - RNA, 32 nt, Human
agccucccguguagcugggacuacaggcgccc

SEQ ID NO: 51307 - RNA, 32 nt, Human
agccucccguguagcugggauuacaggcgcgc

SEQ ID NO: 51308 - RNA, 32 nt, Human
agccucccuaagugcggggauuacaggcuuga

SEQ ID NO: 51309 - RNA, 32 nt, Human
agccucccuaagugcugggauugcaggcguga

SEQ ID NO: 51310 - RNA, 32 nt, Human
agccucccuaauagcugggacuacaggcaacc

SEQ ID NO: 51311 - RNA, 32 nt, Human
agccucccuaauaguugggauuacaggcaccc

SEQ ID NO: 51312 - RNA, 32 nt, Human
agccucccuagcagcugggacuauuagugcac

SEQ ID NO: 51313 - RNA, 32 nt, Human
agccucccuaguagcugggacuacaggcaccc

SEQ ID NO: 51314 - RNA, 32 nt, Human
agccucccuaguagcugggacuacaggcaugc

SEQ ID NO: 51315 - RNA, 32 nt, Human
agccucccuaguagcugggacuacagggaugu

SEQ ID NO: 51316 - RNA, 32 nt, Human
agccucccuaguagcugggacuacagguaugc

SEQ ID NO: 51317 - RNA, 32 nt, Human
agccucccuaguagcugggacuacaggugcgu

SEQ ID NO: 51318 - RNA, 32 nt, Human
agccucccuaguagcugggacuuuaaguguac

SEQ ID NO: 51319 - RNA, 32 nt, Human
agccucccuaguagcugggaugacaagcacac

SEQ ID NO: 51320 - RNA, 32 nt, Human
agccucccuaguagcugggaugacaggcgccu

SEQ ID NO: 51321 - RNA, 32 nt, Human
agccucccuaguagcugggauuacagccaugc

SEQ ID NO: 51322 - RNA, 32 nt, Human
agccucccuaguagcugggauuacaggcacac

SEQ ID NO: 51323 - RNA, 32 nt, Human
agccucccuaguagcugggauuacaggcaugc

SEQ ID NO: 51324 - RNA, 32 nt, Human
agccucccuaguagcugggauuacaggcaugu

SEQ ID NO: 51325 - RNA, 32 nt, Human
agccucccuaguagcugggauuacaggcgccc

SEQ ID NO: 51326 - RNA, 32 nt, Human
agccucccuaguagcugggauuacaggcgcgc

SEQ ID NO: 51327 - RNA, 32 nt, Human
agccucccuaguagcugggauuacaggugcac

SEQ ID NO: 51328 - RNA, 32 nt, Human
agccucccuaguagcugggauuauaggcgccc

SEQ ID NO: 51329 - RNA, 32 nt, Human
agccucccuaguggcugggauuacaggcgccu

SEQ ID NO: 51330 - RNA, 32 nt, Human
agccucccucagagcugggacuacaggcgugc

SEQ ID NO: 51331 - RNA, 32 nt, Human
agccucccuccacccccagaaaauugcuucca

SEQ ID NO: 51332 - RNA, 24 nt, Human
agccucccuccccaccucacccca

SEQ ID NO: 51333 - RNA, 32 nt, Human
agccucccuccccucuccacccuucagugcug

SEQ ID NO: 51334 - RNA, 22 nt, Human
agccucccuccugugcuugcca

SEQ ID NO: 51335 - RNA, 32 nt, Human
agccucccugcgcacccgguugcccggagccc

SEQ ID NO: 51336 - RNA, 32 nt, Human
agccucccuggcagcugggauuacaggugcac

SEQ ID NO: 51337 - RNA, 32 nt, Human
agccucccugguagcugggauuacagguguga

SEQ ID NO: 51338 - RNA, 32 nt, Human
agccucccuuguagcugggaccacaggugcau

SEQ ID NO: 51339 - RNA, 32 nt, Human
agccucccuuucucucccauguuuccauuccu

SEQ ID NO: 51340 - RNA, 32 nt, Human
agccuccgaaagugcugggaucacagguggga

SEQ ID NO: 51341 - RNA, 32 nt, Human
agccuccgaaagugcugggauuacaggcguga

SEQ ID NO: 51342 - RNA, 32 nt, Human
agccuccgaaguagcugggaauuacaggcacc

SEQ ID NO: 51343 - RNA, 32 nt, Human
agccuccgaaguagcugggauuacaggcgccc

SEQ ID NO: 51344 - RNA, 32 nt, Human
agccuccgagguagcugggaccauaggcgugc

SEQ ID NO: 51345 - RNA, 32 nt, Human
agccuccgcaguagcugggacuacaggcaugc

SEQ ID NO: 51346 - RNA, 23 nt, Human
agccuccgcauugcccccacccc

SEQ ID NO: 51347 - RNA, 21 nt, Human
agccuccgcccggcccgggca

SEQ ID NO: 51348 - RNA, 22 nt, Human
agccuccgccuccugggcucaa

SEQ ID NO: 51349 - RNA, 22 nt, Human
agccuccgcuuccuggguucaa

SEQ ID NO: 51350 - RNA, 32 nt, Human
agccuccggaagggaggcggccucuggccccg

SEQ ID NO: 51351 - RNA, 32 nt, Human
agccuccggaggaggaggcggaggccgaggac

SEQ ID NO: 51352 - RNA, 32 nt, Human
agccuccggaguaacuggcauuacaggcgccu

SEQ ID NO: 51353 - RNA, 32 nt, Human
agccuccggaguagcugcgacuacaggcgcgc

SEQ ID NO: 51354 - RNA, 32 nt, Human
agccuccggaguagcugggaauacaggugcag

SEQ ID NO: 51355 - RNA, 32 nt, Human
agccuccggaguagcugggaccacaggcgccc

SEQ ID NO: 51356 - RNA, 32 nt, Human
agccuccggaguagcugggaccacagguucau

SEQ ID NO: 51357 - RNA, 32 nt, Human
agccuccggaguagcugggauuacaggcacau

SEQ ID NO: 51358 - RNA, 32 nt, Human
agccuccggaguagcugggauuacaggcacgu

SEQ ID NO: 51359 - RNA, 32 nt, Human
agccuccggaguagcugggauuacaggcaugc

SEQ ID NO: 51360 - RNA, 32 nt, Human
agccuccggaguagcugggauuacaggcgugc

SEQ ID NO: 51361 - RNA, 32 nt, Human
agccuccggaguagcugggauugcaggcaccc

SEQ ID NO: 51362 - RNA, 32 nt, Human
agccuccggaguagcugggguuacaggcacgg

SEQ ID NO: 51363 - RNA, 32 nt, Human
agccuccggaugagguggcugccaccaggccc

SEQ ID NO: 51364 - RNA, 32 nt, Human
agccuccggggcaccuucaggcaagcgggugg

SEQ ID NO: 51365 - RNA, 32 nt, Human
agccuccgggguagcugggaccacaggcacgc

SEQ ID NO: 51366 - RNA, 32 nt, Human
agccuccguuagggggugggaaaggacuuugc

SEQ ID NO: 51367 - RNA, 32 nt, Human
agccuccuaaagcacugggauuacaggcuuga

SEQ ID NO: 51368 - RNA, 32 nt, Human
agccuccuaaagcacugggauuacagguguga

SEQ ID NO: 51369 - RNA, 32 nt, Human
agccuccuaaagugcugcgauuacaggcauga

SEQ ID NO: 51370 - RNA, 32 nt, Human
agccuccuaaagugcugggauuacaggccuga

SEQ ID NO: 51371 - RNA, 32 nt, Human
agccuccuaaagugcugggauuauaggcauga

SEQ ID NO: 51372 - RNA, 32 nt, Human
agccuccuaaguaccugggauuacaggcaugu

SEQ ID NO: 51373 - RNA, 32 nt, Human
agccuccuaaguagcugagaccacagggacac

SEQ ID NO: 51374 - RNA, 32 nt, Human
agccuccuaaguagcugagacuacagacgugc

SEQ ID NO: 51375 - RNA, 32 nt, Human
agccuccuaaguagcugggaccacagugaggu

SEQ ID NO: 51376 - RNA, 32 nt, Human
agccuccuaaguagcugggauuacaagugccc

SEQ ID NO: 51377 - RNA, 32 nt, Human
agccuccuaaguagcugggauuacaggaaaug

SEQ ID NO: 51378 - RNA, 32 nt, Human
agccuccuaaguagcugggauuacaggcaccc

SEQ ID NO: 51379 - RNA, 32 nt, Human
agccuccuaaguagcugggauuacaggcaugc

SEQ ID NO: 51380 - RNA, 32 nt, Human
agccuccuaaguagcugggauuacaggcgcgu

SEQ ID NO: 51381 - RNA, 32 nt, Human
agccuccuaaguaucugggauuacaggcaugu

SEQ ID NO: 51382 - RNA, 32 nt, Human
agccuccuaaugcagucuucugcacaguccug

SEQ ID NO: 51383 - RNA, 32 nt, Human
agccuccuacguccuggcugggccugguccca

SEQ ID NO: 51384 - RNA, 32 nt, Human
agccuccuagagugcugggauuacagacauga

SEQ ID NO: 51385 - RNA, 32 nt, Human
agccuccuagauaacugggauuacaggugccc

SEQ ID NO: 51386 - RNA, 32 nt, Human
agccuccucacaacaugacagcuggcuuagua

SEQ ID NO: 51387 - RNA, 32 nt, Human
agccuccucacaggugggcugggcuggcaagg

SEQ ID NO: 51388 - RNA, 32 nt, Human
agccuccucaggagcugggauuacaggcgccc

SEQ ID NO: 51389 - RNA, 32 nt, Human
agccuccucaguagcugagauuacaggcaugc

SEQ ID NO: 51390 - RNA, 32 nt, Human
agccuccucaguagcugggauuacaggcaugu

SEQ ID NO: 51391 - RNA, 32 nt, Human
agccuccuccacuccaggccaugcaacagccu

SEQ ID NO: 51392 - RNA, 22 nt, Human
agccuccuccagcccccaggca

SEQ ID NO: 51393 - RNA, 32 nt, Human
agccuccucccgccuaagagcaacaaugccug

SEQ ID NO: 51394 - RNA, 32 nt, Human
agccuccuccugggccagcucuugugcuacag

SEQ ID NO: 51395 - RNA, 32 nt, Human
agccuccuccuuggagcucuguagccaucgug

SEQ ID NO: 51396 - RNA, 32 nt, Human
agccuccucucuccuucugucccacugcccuc

SEQ ID NO: 51397 - RNA, 18 nt, Human
agccuccucugcaugcca

SEQ ID NO: 51398 - RNA, 32 nt, Human
agccuccucuuagagcuccugaauucuggagc

SEQ ID NO: 51399 - RNA, 32 nt, Human
agccuccucuugcccaaacaugaagggugcuu

SEQ ID NO: 51400 - RNA, 32 nt, Human
agccuccugaaaagcugggauuacagggcccu

SEQ ID NO: 51401 - RNA, 32 nt, Human
agccuccugaacagcugggaccacaggugcac

SEQ ID NO: 51402 - RNA, 32 nt, Human
agccuccugaauagccgggauuacagucgucc

SEQ ID NO: 51403 - RNA, 32 nt, Human
agccuccugaauagcugggaauacaggugcac

SEQ ID NO: 51404 - RNA, 32 nt, Human
agccuccugaauagcugggacuacaggcuugc

SEQ ID NO: 51405 - RNA, 32 nt, Human
agccuccugaauagcugggacuacagguucua

SEQ ID NO: 51406 - RNA, 32 nt, Human
agccuccugaauagcugggauuacaggcaccc

SEQ ID NO: 51407 - RNA, 32 nt, Human
agccuccugaauagcugggauuacaggcaccu

SEQ ID NO: 51408 - RNA, 32 nt, Human
agccuccugaauagcugggauuacaggugcac

SEQ ID NO: 51409 - RNA, 32 nt, Human
agccuccugaauaucugggauuacagagacug

SEQ ID NO: 51410 - RNA, 32 nt, Human
agccuccugaauaucugggauuacaggugccc

SEQ ID NO: 51411 - RNA, 32 nt, Human
agccuccugagaagcugagauuacaggcaugu

SEQ ID NO: 51412 - RNA, 32 nt, Human
agccuccugagcagcugggaccgcgggagugu

SEQ ID NO: 51413 - RNA, 32 nt, Human
agccuccugagcagcugggacuacagacacac

SEQ ID NO: 51414 - RNA, 32 nt, Human
agccuccugagcagcugggacuacaggcgcau

SEQ ID NO: 51415 - RNA, 32 nt, Human
agccuccugagcagcugggacuacaggcgccu

SEQ ID NO: 51416 - RNA, 32 nt, Human
agccuccugagcagcugggauuacaggcgcac

SEQ ID NO: 51417 - RNA, 32 nt, Human
agccuccugagcagcugggauuacaggcgcug

SEQ ID NO: 51418 - RNA, 32 nt, Human
agccuccugagcagcugggauuacaggugcgu

SEQ ID NO: 51419 - RNA, 32 nt, Human
agccuccugagccuguggguccccacucaccc

SEQ ID NO: 51420 - RNA, 32 nt, Human
agccuccugaggagcugcgauuacagguaacc

SEQ ID NO: 51421 - RNA, 32 nt, Human
agccuccugaggagcugggacuacaggugcgu

SEQ ID NO: 51422 - RNA, 32 nt, Human
agccuccugaguaacugagauuacaggcacaa

SEQ ID NO: 51423 - RNA, 32 nt, Human
agccuccugaguaacuggaauugcaggucaga

SEQ ID NO: 51424 - RNA, 32 nt, Human
agccuccugaguaacugggacuacaggcacag

SEQ ID NO: 51425 - RNA, 32 nt, Human
agccuccugaguaacugggacuacaggcgccc

SEQ ID NO: 51426 - RNA, 32 nt, Human
agccuccugaguaacugggacuauaggauuuc

SEQ ID NO: 51427 - RNA, 32 nt, Human
agccuccugaguaacugggacuguaaacauga

SEQ ID NO: 51428 - RNA, 32 nt, Human
agccuccugaguaacugggaucauaggcgcac

SEQ ID NO: 51429 - RNA, 32 nt, Human
agccuccugaguaacugggauuacagagccca

SEQ ID NO: 51430 - RNA, 32 nt, Human
agccuccugaguaacugggguuacaggcgcgc

SEQ ID NO: 51431 - RNA, 32 nt, Human
agccuccugaguaccugagacuacagaugugc

SEQ ID NO: 51432 - RNA, 32 nt, Human
agccuccugaguaccugagauuacaggcaccc

SEQ ID NO: 51433 - RNA, 32 nt, Human
agccuccugaguaccugggacuacaggugcau

SEQ ID NO: 51434 - RNA, 32 nt, Human
agccuccugaguaccugggauuacaggcgcgc

SEQ ID NO: 51435 - RNA, 32 nt, Human
agccuccugaguaccugggauuacaggugcac

SEQ ID NO: 51436 - RNA, 32 nt, Human
agccuccugaguagauggaacuacagggcaug

SEQ ID NO: 51437 - RNA, 32 nt, Human
agccuccugaguagaugggacuacaggcacag

SEQ ID NO: 51438 - RNA, 32 nt, Human
agccuccugaguagaugggacuguaggcaccu

SEQ ID NO: 51439 - RNA, 32 nt, Human
agccuccugaguagcaauuacagggagcauuu

SEQ ID NO: 51440 - RNA, 32 nt, Human
agccuccugaguagcagagacuacagagccuc

SEQ ID NO: 51441 - RNA, 32 nt, Human
agccuccugaguagccaggacuauggcaugua

SEQ ID NO: 51442 - RNA, 32 nt, Human
agccuccugaguagccgaaauuacagacgugu

SEQ ID NO: 51443 - RNA, 32 nt, Human
agccuccugaguagcuaaggacuacagggcga

SEQ ID NO: 51444 - RNA, 32 nt, Human
agccuccugaguagcuaggaccauaggcacau

SEQ ID NO: 51445 - RNA, 32 nt, Human
agccuccugaguagcuaggacuacaggcaugu

SEQ ID NO: 51446 - RNA, 32 nt, Human
agccuccugaguagcuaggacuacaggugcau

SEQ ID NO: 51447 - RNA, 32 nt, Human
agccuccugaguagcuaggacuacaggugugc

SEQ ID NO: 51448 - RNA, 32 nt, Human
agccuccugaguagcuaggacuauaggcacac

SEQ ID NO: 51449 - RNA, 32 nt, Human
agccuccugaguagcuaggacuauaggcaugc

SEQ ID NO: 51450 - RNA, 32 nt, Human
agccuccugaguagcuaggacugcaggugcuc

SEQ ID NO: 51451 - RNA, 32 nt, Human
agccuccugaguagcuaggacuguaggcaugu

SEQ ID NO: 51452 - RNA, 32 nt, Human
agccuccugaguagcuaggauuacaggcaugu

SEQ ID NO: 51453 - RNA, 32 nt, Human
agccuccugaguagcuaggauuacaggugccu

SEQ ID NO: 51454 - RNA, 32 nt, Human
agccuccugaguagcuaggauuacaggugugu

SEQ ID NO: 51455 - RNA, 32 nt, Human
agccuccugaguagcuaggguuaccugccacc

SEQ ID NO: 51456 - RNA, 32 nt, Human
agccuccugaguagcuaugacuacagguaugu

SEQ ID NO: 51457 - RNA, 32 nt, Human
agccuccugaguagcugagaccacaggcgugu

SEQ ID NO: 51458 - RNA, 32 nt, Human
agccuccugaguagcugagacuacaggugagu

SEQ ID NO: 51459 - RNA, 32 nt, Human
agccuccugaguagcugagauuacaggcacac

SEQ ID NO: 51460 - RNA, 32 nt, Human
agccuccugaguagcugagauuacaggugccc

SEQ ID NO: 51461 - RNA, 32 nt, Human
agccuccugaguagcugagauuacaggugugu

SEQ ID NO: 51462 - RNA, 32 nt, Human
agccuccugaguagcugagauuauaggccuac

SEQ ID NO: 51463 - RNA, 32 nt, Human
agccuccugaguagcugauacuacaggcaccc

SEQ ID NO: 51464 - RNA, 32 nt, Human
agccuccugaguagcugcgacuacaggugcau

SEQ ID NO: 51465 - RNA, 32 nt, Human
agccuccugaguagcuggaaccacaggcaugu

SEQ ID NO: 51466 - RNA, 32 nt, Human
agccuccugaguagcuggaacugcagaugugc

SEQ ID NO: 51467 - RNA, 32 nt, Human
agccuccugaguagcuggaauuacaggaggau

SEQ ID NO: 51468 - RNA, 32 nt, Human
agccuccugaguagcuggaauuacaggcaccc

SEQ ID NO: 51469 - RNA, 32 nt, Human
agccuccugaguagcuggaauuacaggcgccc

SEQ ID NO: 51470 - RNA, 32 nt, Human
agccuccugaguagcuggaauuauaggcacau

SEQ ID NO: 51471 - RNA, 32 nt, Human
agccuccugaguagcuggauuacaggcaugug

SEQ ID NO: 51472 - RNA, 32 nt, Human
agccuccugaguagcuggauuacagggccugg

SEQ ID NO: 51473 - RNA, 32 nt, Human
agccuccugaguagcuggcacuguaggcaugu

SEQ ID NO: 51474 - RNA, 32 nt, Human
agccuccugaguagcuggcauuauaggugccc

SEQ ID NO: 51475 - RNA, 32 nt, Human
agccuccugaguagcugggaauacagcaugcg

SEQ ID NO: 51476 - RNA, 32 nt, Human
agccuccugaguagcugggaccacaggcgacu

SEQ ID NO: 51477 - RNA, 32 nt, Human
agccuccugaguagcugggaccacaggcgagu

SEQ ID NO: 51478 - RNA, 32 nt, Human
agccuccugaguagcugggaccacagguaugc

SEQ ID NO: 51479 - RNA, 32 nt, Human
agccuccugaguagcugggaccacaggugugu

SEQ ID NO: 51480 - RNA, 32 nt, Human
agccuccugaguagcugggaccauaggcucac

SEQ ID NO: 51481 - RNA, 32 nt, Human
agccuccugaguagcugggaccauagguguga

SEQ ID NO: 51482 - RNA, 32 nt, Human
agccuccugaguagcugggacuacaagcaugc

SEQ ID NO: 51483 - RNA, 32 nt, Human
agccuccugaguagcugggacuacaagugugc

SEQ ID NO: 51484 - RNA, 32 nt, Human
agccuccugaguagcugggacuacagaugcau

SEQ ID NO: 51485 - RNA, 32 nt, Human
agccuccugaguagcugggacuacagauguag

SEQ ID NO: 51486 - RNA, 32 nt, Human
agccuccugaguagcugggacuacaggaauua

SEQ ID NO: 51487 - RNA, 32 nt, Human
agccuccugaguagcugggacuacaggagcuc

SEQ ID NO: 51488 - RNA, 32 nt, Human
agccuccugaguagcugggacuacaggcacac

SEQ ID NO: 51489 - RNA, 32 nt, Human
agccuccugaguagcugggacuacaggcacau

SEQ ID NO: 51490 - RNA, 32 nt, Human
agccuccugaguagcugggacuacaggcaccc

SEQ ID NO: 51491 - RNA, 32 nt, Human
agccuccugaguagcugggacuacaggcaccu

SEQ ID NO: 51492 - RNA, 32 nt, Human
agccuccugaguagcugggacuacaggcacgc

SEQ ID NO: 51493 - RNA, 32 nt, Human
agccuccugaguagcugggacuacaggcacgu

SEQ ID NO: 51494 - RNA, 32 nt, Human
agccuccugaguagcugggacuacaggcauga

SEQ ID NO: 51495 - RNA, 32 nt, Human
agccuccugaguagcugggacuacaggcaugc

SEQ ID NO: 51496 - RNA, 32 nt, Human
agccuccugaguagcugggacuacaggcaugu

SEQ ID NO: 51497 - RNA, 32 nt, Human
agccuccugaguagcugggacuacaggccccu

SEQ ID NO: 51498 - RNA, 32 nt, Human
agccuccugaguagcugggacuacaggcgcca

SEQ ID NO: 51499 - RNA, 32 nt, Human
agccuccugaguagcugggacuacaggcgccc

SEQ ID NO: 51500 - RNA, 32 nt, Human
agccuccugaguagcugggacuacaggcgccu

SEQ ID NO: 51501 - RNA, 32 nt, Human
agccuccugaguagcugggacuacaggcgcuc

SEQ ID NO: 51502 - RNA, 32 nt, Human
agccuccugaguagcugggacuacaggcgugu

SEQ ID NO: 51503 - RNA, 32 nt, Human
agccuccugaguagcugggacuacaggcucau

SEQ ID NO: 51504 - RNA, 32 nt, Human
agccuccugaguagcugggacuacaggcuugc

SEQ ID NO: 51505 - RNA, 32 nt, Human
agccuccugaguagcugggacuacaggcuugu

SEQ ID NO: 51506 - RNA, 32 nt, Human
agccuccugaguagcugggacuacagguaugc

SEQ ID NO: 51507 - RNA, 32 nt, Human
agccuccugaguagcugggacuacaggugccc

SEQ ID NO: 51508 - RNA, 32 nt, Human
agccuccugaguagcugggacuacaggugccu

SEQ ID NO: 51509 - RNA, 32 nt, Human
agccuccugaguagcugggacuacaggugcgu

SEQ ID NO: 51510 - RNA, 32 nt, Human
agccuccugaguagcugggacuacagguguac

SEQ ID NO: 51511 - RNA, 32 nt, Human
agccuccugaguagcugggacuacaggugugc

SEQ ID NO: 51512 - RNA, 32 nt, Human
agccuccugaguagcugggacuacaggugugu

SEQ ID NO: 51513 - RNA, 32 nt, Human
agccuccugaguagcugggacuacaguugugc

SEQ ID NO: 51514 - RNA, 32 nt, Human
agccuccugaguagcugggacuacaguuucgu

SEQ ID NO: 51515 - RNA, 32 nt, Human
agccuccugaguagcugggacuacaugcgcac

SEQ ID NO: 51516 - RNA, 32 nt, Human
agccuccugaguagcugggacuagaggcacgc

SEQ ID NO: 51517 - RNA, 32 nt, Human
agccuccugaguagcugggacuagaggcaugu

SEQ ID NO: 51518 - RNA, 32 nt, Human
agccuccugaguagcugggacuagaggcgugu

SEQ ID NO: 51519 - RNA, 32 nt, Human
agccuccugaguagcugggacuauaggcaugu

SEQ ID NO: 51520 - RNA, 32 nt, Human
agccuccugaguagcugggacuauaggccugu

SEQ ID NO: 51521 - RNA, 32 nt, Human
agccuccugaguagcugggacuauaggcgcgu

SEQ ID NO: 51522 - RNA, 32 nt, Human
agccuccugaguagcugggacuauaggcuccc

SEQ ID NO: 51523 - RNA, 32 nt, Human
agccuccugaguagcugggacuauaggugcau

SEQ ID NO: 51524 - RNA, 32 nt, Human
agccuccugaguagcugggacuauagguugcu

SEQ ID NO: 51525 - RNA, 32 nt, Human
agccuccugaguagcugggacugcagaagugc

SEQ ID NO: 51526 - RNA, 32 nt, Human
agccuccugaguagcugggacugcaggcaccc

SEQ ID NO: 51527 - RNA, 32 nt, Human
agccuccugaguagcugggacugcaggcacgc

SEQ ID NO: 51528 - RNA, 32 nt, Human
agccuccugaguagcugggaggacaggcauau

SEQ ID NO: 51529 - RNA, 32 nt, Human
agccuccugaguagcugggaguacaggcgugc

SEQ ID NO: 51530 - RNA, 32 nt, Human
agccuccugaguagcugggauaacagacaugc

SEQ ID NO: 51531 - RNA, 32 nt, Human
agccuccugaguagcugggauaacaggugugg

SEQ ID NO: 51532 - RNA, 32 nt, Human
agccuccugaguagcugggaucacaggcacac

SEQ ID NO: 51533 - RNA, 32 nt, Human
agccuccugaguagcugggaucacaggugugu

SEQ ID NO: 51534 - RNA, 32 nt, Human
agccuccugaguagcugggaucauagaugccu

SEQ ID NO: 51535 - RNA, 32 nt, Human
agccuccugaguagcugggaucauaggcacgc

SEQ ID NO: 51536 - RNA, 32 nt, Human
agccuccugaguagcugggaugacaggcgugc

SEQ ID NO: 51537 - RNA, 32 nt, Human
agccuccugaguagcugggaugacaggugcac

SEQ ID NO: 51538 - RNA, 32 nt, Human
agccuccugaguagcugggauuacaaccgugu

SEQ ID NO: 51539 - RNA, 32 nt, Human
agccuccugaguagcugggauuacaagggcac

SEQ ID NO: 51540 - RNA, 32 nt, Human
agccuccugaguagcugggauuacagaaaauc

SEQ ID NO: 51541 - RNA, 32 nt, Human
agccuccugaguagcugggauuacagacaccc

SEQ ID NO: 51542 - RNA, 32 nt, Human
agccuccugaguagcugggauuacagacaugc

SEQ ID NO: 51543 - RNA, 32 nt, Human
agccuccugaguagcugggauuacagacgcac

SEQ ID NO: 51544 - RNA, 32 nt, Human
agccuccugaguagcugggauuacagacucca

SEQ ID NO: 51545 - RNA, 32 nt, Human
agccuccugaguagcugggauuacagauccug

SEQ ID NO: 51546 - RNA, 32 nt, Human
agccuccugaguagcugggauuacagauguau

SEQ ID NO: 51547 - RNA, 32 nt, Human
agccuccugaguagcugggauuacagaugugc

SEQ ID NO: 51548 - RNA, 32 nt, Human
agccuccugaguagcugggauuacagcacccg

SEQ ID NO: 51549 - RNA, 32 nt, Human
agccuccugaguagcugggauuacagcucugg

SEQ ID NO: 51550 - RNA, 32 nt, Human
agccuccugaguagcugggauuacaggaccag

SEQ ID NO: 51551 - RNA, 32 nt, Human
agccuccugaguagcugggauuacaggcaacu

SEQ ID NO: 51552 - RNA, 32 nt, Human
agccuccugaguagcugggauuacaggcacac

SEQ ID NO: 51553 - RNA, 32 nt, Human
agccuccugaguagcugggauuacaggcacau

SEQ ID NO: 51554 - RNA, 32 nt, Human
agccuccugaguagcugggauuacaggcaccc

SEQ ID NO: 51555 - RNA, 32 nt, Human
agccuccugaguagcugggauuacaggcaccu

SEQ ID NO: 51556 - RNA, 32 nt, Human
agccuccugaguagcugggauuacaggcacgc

SEQ ID NO: 51557 - RNA, 32 nt, Human
agccuccugaguagcugggauuacaggcagac

SEQ ID NO: 51558 - RNA, 32 nt, Human
agccuccugaguagcugggauuacaggcauac

SEQ ID NO: 51559 - RNA, 32 nt, Human
agccuccugaguagcugggauuacaggcaucc

SEQ ID NO: 51560 - RNA, 32 nt, Human
agccuccugaguagcugggauuacaggcauga

SEQ ID NO: 51561 - RNA, 32 nt, Human
agccuccugaguagcugggauuacaggcaugc

SEQ ID NO: 51562 - RNA, 32 nt, Human
agccuccugaguagcugggauuacaggcaugu

SEQ ID NO: 51563 - RNA, 32 nt, Human
agccuccugaguagcugggauuacaggcgcac

SEQ ID NO: 51564 - RNA, 32 nt, Human
agccuccugaguagcugggauuacaggcgccc

SEQ ID NO: 51565 - RNA, 32 nt, Human
agccuccugaguagcugggauuacaggcgccu

SEQ ID NO: 51566 - RNA, 32 nt, Human
agccuccugaguagcugggauuacaggcgcgu

SEQ ID NO: 51567 - RNA, 32 nt, Human
agccuccugaguagcugggauuacaggcgucc

SEQ ID NO: 51568 - RNA, 32 nt, Human
agccuccugaguagcugggauuacaggcgugc

SEQ ID NO: 51569 - RNA, 32 nt, Human
agccuccugaguagcugggauuacaggcgugu

SEQ ID NO: 51570 - RNA, 32 nt, Human
agccuccugaguagcugggauuacaggcuccu

SEQ ID NO: 51571 - RNA, 32 nt, Human
agccuccugaguagcugggauuacagggcgcu

SEQ ID NO: 51572 - RNA, 32 nt, Human
agccuccugaguagcugggauuacagguaugu

SEQ ID NO: 51573 - RNA, 32 nt, Human
agccuccugaguagcugggauuacaggugccc

SEQ ID NO: 51574 - RNA, 32 nt, Human
agccuccugaguagcugggauuacaggugccu

SEQ ID NO: 51575 - RNA, 32 nt, Human
agccuccugaguagcugggauuacaggugcgc

SEQ ID NO: 51576 - RNA, 32 nt, Human
agccuccugaguagcugggauuacaggugcgu

SEQ ID NO: 51577 - RNA, 32 nt, Human
agccuccugaguagcugggauuacagguguau

SEQ ID NO: 51578 - RNA, 32 nt, Human
agccuccugaguagcugggauuacaggugucg

SEQ ID NO: 51579 - RNA, 32 nt, Human
agccuccugaguagcugggauuacaggugugc

SEQ ID NO: 51580 - RNA, 32 nt, Human
agccuccugaguagcugggauuacaggugugu

SEQ ID NO: 51581 - RNA, 32 nt, Human
agccuccugaguagcugggauuacagguuccu

SEQ ID NO: 51582 - RNA, 32 nt, Human
agccuccugaguagcugggauuaccagugcac

SEQ ID NO: 51583 - RNA, 32 nt, Human
agccuccugaguagcugggauuacgggcaugu

SEQ ID NO: 51584 - RNA, 32 nt, Human
agccuccugaguagcugggauuauaggcacac

SEQ ID NO: 51585 - RNA, 32 nt, Human
agccuccugaguagcugggauuauaggcacau

SEQ ID NO: 51586 - RNA, 32 nt, Human
agccuccugaguagcugggauuauaggcacgu

SEQ ID NO: 51587 - RNA, 32 nt, Human
agccuccugaguagcugggauuauaggcaugc

SEQ ID NO: 51588 - RNA, 32 nt, Human
agccuccugaguagcugggauuauaggcgaga

SEQ ID NO: 51589 - RNA, 32 nt, Human
agccuccugaguagcugggauuauaggcgucu

SEQ ID NO: 51590 - RNA, 32 nt, Human
agccuccugaguagcugggauuauaggcgugc

SEQ ID NO: 51591 - RNA, 32 nt, Human
agccuccugaguagcugggauuauaggcgugu

SEQ ID NO: 51592 - RNA, 32 nt, Human
agccuccugaguagcugggauuauagguacau

SEQ ID NO: 51593 - RNA, 32 nt, Human
agccuccugaguagcugggauuauaggugcau

SEQ ID NO: 51594 - RNA, 32 nt, Human
agccuccugaguagcugggauuauaggugcga

SEQ ID NO: 51595 - RNA, 32 nt, Human
agccuccugaguagcugggauuauggacaaau

SEQ ID NO: 51596 - RNA, 32 nt, Human
agccuccugaguagcugggauuaugggcgccc

SEQ ID NO: 51597 - RNA, 32 nt, Human
agccuccugaguagcugggauuaugggugccu

SEQ ID NO: 51598 - RNA, 32 nt, Human
agccuccugaguagcugggauugcaggcaccc

SEQ ID NO: 51599 - RNA, 32 nt, Human
agccuccugaguagcugggauugcaggugccc

SEQ ID NO: 51600 - RNA, 32 nt, Human
agccuccugaguagcugggcacgguguuguac

SEQ ID NO: 51601 - RNA, 32 nt, Human
agccuccugaguagcugggccuauagguuccc

SEQ ID NO: 51602 - RNA, 32 nt, Human
agccuccugaguagcugggcugacaggcaccc

SEQ ID NO: 51603 - RNA, 32 nt, Human
agccuccugaguagcugggcuuacaggcaccc

SEQ ID NO: 51604 - RNA, 32 nt, Human
agccuccugaguagcuggggcuacaggcgccu

SEQ ID NO: 51605 - RNA, 32 nt, Human
agccuccugaguagcuggggcuacaggugugu

SEQ ID NO: 51606 - RNA, 32 nt, Human
agccuccugaguagcuggguuuacaggugccu

SEQ ID NO: 51607 - RNA, 32 nt, Human
agccuccugaguagcugguagcugggacuaua

SEQ ID NO: 51608 - RNA, 32 nt, Human
agccuccugaguagcuggugcgcacgaccaua

SEQ ID NO: 51609 - RNA, 32 nt, Human
agccuccugaguagcuguacuacaggaaugca

SEQ ID NO: 51610 - RNA, 32 nt, Human
agccuccugaguagcugugacuacaggcgccc

SEQ ID NO: 51611 - RNA, 32 nt, Human
agccuccugaguagcugugauuacaggcaugc

SEQ ID NO: 51612 - RNA, 32 nt, Human
agccuccugaguagcuuggauuacaggcacaa

SEQ ID NO: 51613 - RNA, 32 nt, Human
agccuccugaguaggugggauuacagaugccc

SEQ ID NO: 51614 - RNA, 32 nt, Human
agccuccugaguaguugggacuacaggcauau

SEQ ID NO: 51615 - RNA, 32 nt, Human
agccuccugaguaguugggacuaccaguagau

SEQ ID NO: 51616 - RNA, 32 nt, Human
agccuccugaguaguugggauuacagaugccc

SEQ ID NO: 51617 - RNA, 32 nt, Human
agccuccugaguaucugggacuacagaugcgu

SEQ ID NO: 51618 - RNA, 32 nt, Human
agccuccugaguaucugggauuacaggcgugc

SEQ ID NO: 51619 - RNA, 32 nt, Human
agccuccugaguaucuggguuuacaggugugu

SEQ ID NO: 51620 - RNA, 32 nt, Human
agccuccugagucgcugggauuacugagauug

SEQ ID NO: 51621 - RNA, 32 nt, Human
agccuccugaguggcugggauuacaggcaugc

SEQ ID NO: 51622 - RNA, 32 nt, Human
agccuccugaguggcugggauuacaggcgccc

SEQ ID NO: 51623 - RNA, 32 nt, Human
agccuccugaguggcugggauuauaggugugu

SEQ ID NO: 51624 - RNA, 32 nt, Human
agccuccugauuaccugggauuacaggcaugu

SEQ ID NO: 51625 - RNA, 32 nt, Human
agccuccugauuagcugggacuacagguucag

SEQ ID NO: 51626 - RNA, 32 nt, Human
agccuccugauuagcugggacuauaggcgugu

SEQ ID NO: 51627 - RNA, 32 nt, Human
agccuccugauuagcugggauuacaggcaugc

SEQ ID NO: 51628 - RNA, 32 nt, Human
agccuccugauuagcugggauuacaggcgugu

SEQ ID NO: 51629 - RNA, 32 nt, Human
agccuccugcaccuccucaccucccagccugc

SEQ ID NO: 51630 - RNA, 32 nt, Human
agccuccugcagcagcagcagacggcucggag

SEQ ID NO: 51631 - RNA, 32 nt, Human
agccuccugcagcgcccgccugccaaugugag

SEQ ID NO: 51632 - RNA, 23 nt, Human
agccuccugccacccacacacca

SEQ ID NO: 51633 - RNA, 32 nt, Human
agccuccugcccacccagggcccuuuacucuc

SEQ ID NO: 51634 - RNA, 32 nt, Human
agccuccugccccugcuuucugcccagggagg

SEQ ID NO: 51635 - RNA, 32 nt, Human
agccuccugccugcacccuccaccucuucuaa

SEQ ID NO: 51636 - RNA, 32 nt, Human
agccuccugccugcccuggccuugcuggggcc

SEQ ID NO: 51637 - RNA, 32 nt, Human
agccuccugcgcuccgguaccugggcguccca

SEQ ID NO: 51638 - RNA, 32 nt, Human
agccuccugcguagcugggacuacaggcacac

SEQ ID NO: 51639 - RNA, 23 nt, Human
agccuccugcucacuccacccca

SEQ ID NO: 51640 - RNA, 32 nt, Human
agccuccugcucaugcugcacgggccuccccu

SEQ ID NO: 51641 - RNA, 32 nt, Human
agccuccugcucauguugugcaggccuccccu

SEQ ID NO: 51642 - RNA, 19 nt, Human
agccuccugcucuuaacug

SEQ ID NO: 51643 - RNA, 32 nt, Human
agccuccugggcagucguaaggguugcggcgu

SEQ ID NO: 51644 - RNA, 32 nt, Human
agccuccugggcauguuugucugugugcugua

SEQ ID NO: 51645 - RNA, 23 nt, Human
agccuccugggguccccaggcac

SEQ ID NO: 51646 - RNA, 32 nt, Human
agccuccuggguagcugggacuacaggcuugc

SEQ ID NO: 51647 - RNA, 32 nt, Human
agccuccuggguagcugggauuacaagcaccc

SEQ ID NO: 51648 - RNA, 32 nt, Human
agccuccuggguagcugggauuacaggcacgc

SEQ ID NO: 51649 - RNA, 32 nt, Human
agccuccuggguagcugggauuacaggugccc

SEQ ID NO: 51650 - RNA, 32 nt, Human
agccuccuguaaucccagcuacuugggaggcu

SEQ ID NO: 51651 - RNA, 32 nt, Human
agccuccuguguaacugggauuacaggcuccc

SEQ ID NO: 51652 - RNA, 32 nt, Human
agccuccuguguagcugggauuauagauugga

SEQ ID NO: 51653 - RNA, 32 nt, Human
agccuccuuagacugaccccucaggccccuag

SEQ ID NO: 51654 - RNA, 22 nt, Human
agccuccuucgaggcugugcug

SEQ ID NO: 51655 - RNA, 32 nt, Human
agccuccuugguuguucuugggccacaggagc

SEQ ID NO: 51656 - RNA, 32 nt, Human
agccucgaaaagugcugggauuacaggcguga

SEQ ID NO: 51657 - RNA, 32 nt, Human
agccucgaaaucagauaggcaccaccaaccuc

SEQ ID NO: 51658 - RNA, 22 nt, Human
agccucgaacuccugggcucaa

SEQ ID NO: 51659 - RNA, 22 nt, Human
agccucgaacuccugggcuuaa

SEQ ID NO: 51660 - RNA, 22 nt, Human
agccucgaaucccugggcucaa

SEQ ID NO: 51661 - RNA, 21 nt, Human
agccucgacaccuggguucaa

SEQ ID NO: 51662 - RNA, 22 nt, Human
agccucgaccucccgggcucaa

SEQ ID NO: 51663 - RNA, 23 nt, Human
agccucgaccucccugggcucaa

SEQ ID NO: 51664 - RNA, 22 nt, Human
agccucgaccuccugggcucaa

SEQ ID NO: 51665 - RNA, 32 nt, Human
agccucgaccuccugggcucaaguguccuccu

SEQ ID NO: 51666 - RNA, 22 nt, Human
agccucgaccucuggggcucaa

SEQ ID NO: 51667 - RNA, 22 nt, Human
agccucgaccuuccaggcuuaa

SEQ ID NO: 51668 - RNA, 17 nt, Human
agccucgacuguccccu

SEQ ID NO: 51669 - RNA, 22 nt, Human
agccucgacuuccugggcucaa

SEQ ID NO: 51670 - RNA, 31 nt, Human
agccucgagaaaaugucuacagcagaucuga

SEQ ID NO: 51671 - RNA, 32 nt, Human
agccucgaguagcugggacuacaggcgcaugc

SEQ ID NO: 51672 - RNA, 32 nt, Human
agccucgagucucccauguuguaguacauucu

SEQ ID NO: 51673 - RNA, 32 nt, Human
agccucgaguuagugcucuggaagaggacaug

SEQ ID NO: 51674 - RNA, 32 nt, Human
agccucgauauccuuaauucaccaaggauccu

SEQ ID NO: 51675 - RNA, 32 nt, Human
agccucgauccucugcucacucagcccagcca

SEQ ID NO: 51676 - RNA, 32 nt, Human
agccucgauuguaccacugcacuccagccugg

SEQ ID NO: 51677 - RNA, 32 nt, Human
agccucgcaaguagcugggacuacagccgugc

SEQ ID NO: 51678 - RNA, 21 nt, Human
agccucgccaacauggcgaaa

SEQ ID NO: 51679 - RNA, 32 nt, Human
agccucgccagccugcugccaguacacccagg

SEQ ID NO: 51680 - RNA, 19 nt, Human
agccucgcccccugcccac

SEQ ID NO: 51681 - RNA, 32 nt, Human
agccucgccugacagaaugagcggcucggacg

SEQ ID NO: 51682 - RNA, 19 nt, Human
agccucgccugcugugcug

SEQ ID NO: 51683 - RNA, 32 nt, Human
agccucgccuggguucuggaggcugcggggcc

SEQ ID NO: 51684 - RNA, 32 nt, Human
agccucgcgagcagcugggacuacaggugccc

SEQ ID NO: 51685 - RNA, 32 nt, Human
agccucgcgaguagcuaggacuacaggcgcau

SEQ ID NO: 51686 - RNA, 32 nt, Human
agccucgcgaguagcuggaauuacaggaagcu

SEQ ID NO: 51687 - RNA, 32 nt, Human
agccucgcuccugggggcgcugcugggaaagc

SEQ ID NO: 51688 - RNA, 32 nt, Human
agccucggaagcagggccuggccggcagagca

SEQ ID NO: 51689 - RNA, 32 nt, Human
agccucggaggcggagguugcagugagcugag

SEQ ID NO: 51690 - RNA, 32 nt, Human
agccucggcaaaccaauuuggggaagaagcaa

SEQ ID NO: 51691 - RNA, 20 nt, Human
agccucggccuucugaagug

SEQ ID NO: 51692 - RNA, 32 nt, Human
agccucggcucagcacaucccuugccaaaauc

SEQ ID NO: 51693 - RNA, 32 nt, Human
agccucgggccucaccacccagcugcagccca

SEQ ID NO: 51694 - RNA, 32 nt, Human
agccucgggggcagaggugauagauguggggu

SEQ ID NO: 51695 - RNA, 32 nt, Human
agccucguaaagugcugggauuacagggguga

SEQ ID NO: 51696 - RNA, 32 nt, Human
agccucguaaauugcugggauuacaggcauga

SEQ ID NO: 51697 - RNA, 32 nt, Human
agccucgugaguagcugagauuacaggcgccc

SEQ ID NO: 51698 - RNA, 32 nt, Human
agccucuaaacagacaggaauuuagaaaaagu

SEQ ID NO: 51699 - RNA, 22 nt, Human
agccucuaacuccugggcucaa

SEQ ID NO: 51700 - RNA, 32 nt, Human
agccucuacaaugaaaugcagaagaguucauu

SEQ ID NO: 51701 - RNA, 26 nt, Human
agccucuacacacccagcuccugcca

SEQ ID NO: 51702 - RNA, 32 nt, Human
agccucuacuaaaaauacaaaaauuagcuggg

SEQ ID NO: 51703 - RNA, 22 nt, Human
agccucuacuuucuucuugcca

SEQ ID NO: 51704 - RNA, 22 nt, Human
agccucuagggaccccuccucc

SEQ ID NO: 51705 - RNA, 22 nt, Human
agccucuagucgccuccugcca

SEQ ID NO: 51706 - RNA, 32 nt, Human
agccucuauaaauauguaauaucaucauggga

SEQ ID NO: 51707 - RNA, 32 nt, Human
agccucucaaaaugcugggauuacagguguga

SEQ ID NO: 51708 - RNA, 32 nt, Human
agccucucaaacugcugggauuauaggcauga

SEQ ID NO: 51709 - RNA, 32 nt, Human
agccucucaaagagcugggauuacaggcauga

SEQ ID NO: 51710 - RNA, 32 nt, Human
agccucucaaagcgcugggauuacaggcauga

SEQ ID NO: 51711 - RNA, 32 nt, Human
agccucucaaagugcugggauuacaagcauga

SEQ ID NO: 51712 - RNA, 32 nt, Human
agccucucaaagugcugggauuacaggccuga

SEQ ID NO: 51713 - RNA, 32 nt, Human
agccucucaaagugcugggauuacaggcguga

SEQ ID NO: 51714 - RNA, 32 nt, Human
agccucucaaagugcugggauuacagguguga

SEQ ID NO: 51715 - RNA, 32 nt, Human
agccucucaaagugcugggauuacaggugugc

SEQ ID NO: 51716 - RNA, 32 nt, Human
agccucucaaagugcugggauuacaguaggga

SEQ ID NO: 51717 - RNA, 32 nt, Human
agccucucaaagugcugggauuacagucuccg

SEQ ID NO: 51718 - RNA, 32 nt, Human
agccucucaaagugcugggauuacgggcauga

SEQ ID NO: 51719 - RNA, 32 nt, Human
agccucucaaagugcugggauuauaggcguga

SEQ ID NO: 51720 - RNA, 32 nt, Human
agccucucaaagugcugggauuauaggcuuga

SEQ ID NO: 51721 - RNA, 32 nt, Human
agccucucaaauagcugggacuacaggcagca

SEQ ID NO: 51722 - RNA, 32 nt, Human
agccucucaaguaacugggauuacaggcaugc

SEQ ID NO: 51723 - RNA, 32 nt, Human
agccucucaaguagcggauuacaggcgcccac

SEQ ID NO: 51724 - RNA, 32 nt, Human
agccucucaaguagcugggacuacagaugugg

SEQ ID NO: 51725 - RNA, 32 nt, Human
agccucucaaguagcugggacuacaggcaugu

SEQ ID NO: 51726 - RNA, 32 nt, Human
agccucucaaguagcugggacuacaggcgccc

SEQ ID NO: 51727 - RNA, 32 nt, Human
agccucucaaguagcugggacuacaggugcac

SEQ ID NO: 51728 - RNA, 32 nt, Human
agccucucaaguagcugggauuacaagcaugc

SEQ ID NO: 51729 - RNA, 32 nt, Human
agccucucaaguagcugggauuacaggcgccc

SEQ ID NO: 51730 - RNA, 32 nt, Human
agccucucaaguagcugggauuacagggcacc

SEQ ID NO: 51731 - RNA, 32 nt, Human
agccucucaaguagcugggauuacagggcuuc

SEQ ID NO: 51732 - RNA, 32 nt, Human
agccucucagaggaggaggagcuggagacagg

SEQ ID NO: 51733 - RNA, 32 nt, Human
agccucucagagugcugggaucacaggcguga

SEQ ID NO: 51734 - RNA, 32 nt, Human
agccucucauagaaauugccuccaguccaguu

SEQ ID NO: 51735 - RNA, 32 nt, Human
agccucuccaagugcugggauuacaggcauca

SEQ ID NO: 51736 - RNA, 32 nt, Human
agccucuccacucaccagcaggcggucucugu

SEQ ID NO: 51737 - RNA, 21 nt, Human
agccucuccagacccacuugc

SEQ ID NO: 51738 - RNA, 32 nt, Human
agccucuccaguagcuggaacuacaggcaugc

SEQ ID NO: 51739 - RNA, 32 nt, Human
agccucuccaguagcuggaacuacaggcgugc

SEQ ID NO: 51740 - RNA, 32 nt, Human
agccucuccaguagcugggauuacaggugugu

SEQ ID NO: 51741 - RNA, 32 nt, Human
agccucuccauacuuacuccucucacagccca

SEQ ID NO: 51742 - RNA, 23 nt, Human
agccucucccuacucccauccca

SEQ ID NO: 51743 - RNA, 32 nt, Human
agccucucccucucccccagcuaguccccuga

SEQ ID NO: 51744 - RNA, 32 nt, Human
agccucuccugaaacaagaggggccgguggaa

SEQ ID NO: 51745 - RNA, 16 nt, Human
agccucuccugaauug

SEQ ID NO: 51746 - RNA, 32 nt, Human
agccucuccugccucugcaggccuggcagcua

SEQ ID NO: 51747 - RNA, 32 nt, Human
agccucucgagcagcuggaauuacaggcacgu

SEQ ID NO: 51748 - RNA, 32 nt, Human
agccucucgagcagcugggauuacagguaugc

SEQ ID NO: 51749 - RNA, 32 nt, Human
agccucucgaguagcuaggacuacaggcacau

SEQ ID NO: 51750 - RNA, 32 nt, Human
agccucucgaguagcuaggauuacaggcaugc

SEQ ID NO: 51751 - RNA, 32 nt, Human
agccucucgaguagcugcgacuacaggugccc

SEQ ID NO: 51752 - RNA, 32 nt, Human
agccucucgaguagcuggaauuacaggucugg

SEQ ID NO: 51753 - RNA, 32 nt, Human
agccucucgaguagcugggaccacaguugugu

SEQ ID NO: 51754 - RNA, 32 nt, Human
agccucucgaguagcugggacuacaggcguga

SEQ ID NO: 51755 - RNA, 32 nt, Human
agccucucgaguagcugggacuacaggcgugc

SEQ ID NO: 51756 - RNA, 32 nt, Human
agccucucgaguagcugggaguacagaugcac

SEQ ID NO: 51757 - RNA, 32 nt, Human
agccucucgaguagcugggauuacaggcaccu

SEQ ID NO: 51758 - RNA, 32 nt, Human
agccucucgaguagcugggauuacaggcaugc

SEQ ID NO: 51759 - RNA, 32 nt, Human
agccucucgaguagcugggauuacaggcgcau

SEQ ID NO: 51760 - RNA, 32 nt, Human
agccucucgaguagcugggauuauaggcgucc

SEQ ID NO: 51761 - RNA, 32 nt, Human
agccucucgaguagcuggggcuacagcuaugc

SEQ ID NO: 51762 - RNA, 32 nt, Human
agccucucgaguggcugggauuacaggcaucc

SEQ ID NO: 51763 - RNA, 32 nt, Human
agccucucuaguagcugagauuacaggcaugc

SEQ ID NO: 51764 - RNA, 32 nt, Human
agccucucuaguagcuggggcuccaggcauga

SEQ ID NO: 51765 - RNA, 17 nt, Human
agccucucucugaacug

SEQ ID NO: 51766 - RNA, 32 nt, Human
agccucucugcagccccucuuuuccuucaauc

SEQ ID NO: 51767 - RNA, 32 nt, Human
agccucucuggaagagaaaggaagagccagca

SEQ ID NO: 51768 - RNA, 32 nt, Human
agccucucuggccauugcagagcugcuggccu

SEQ ID NO: 51769 - RNA, 32 nt, Human
agccucucugguagcugggauuacagggaagg

SEQ ID NO: 51770 - RNA, 32 nt, Human
agccucucuuucuccuccacauacugcagccu

SEQ ID NO: 51771 - RNA, 32 nt, Human
agccucucuuugauagaauuuugaggccaugc

SEQ ID NO: 51772 - RNA, 32 nt, Human
agccucucuuuuccaggaaccuugccacaccu

SEQ ID NO: 51773 - RNA, 32 nt, Human
agccucugaaauugcugggauuacaggcauga

SEQ ID NO: 51774 - RNA, 32 nt, Human
agccucugaacaguaaaguuuugcuccagcca

SEQ ID NO: 51775 - RNA, 32 nt, Human
agccucugaaguagcugggacuacaggcguua

SEQ ID NO: 51776 - RNA, 32 nt, Human
agccucugaaguagcugggauuacaggcaugu

SEQ ID NO: 51777 - RNA, 32 nt, Human
agccucugagcugucauggacccacucugaug

SEQ ID NO: 51778 - RNA, 32 nt, Human
agccucugcaacagcucugccuccucuccagu

SEQ ID NO: 51779 - RNA, 32 nt, Human
agccucugcaccuggcuagggccaguguuuuu

SEQ ID NO: 51780 - RNA, 32 nt, Human
agccucugccaagcugaguauaugagaccuuu

SEQ ID NO: 51781 - RNA, 32 nt, Human
agccucugccacccuccaccuccucggucagc

SEQ ID NO: 51782 - RNA, 32 nt, Human
agccucugccauccacuugaggguauugagag

SEQ ID NO: 51783 - RNA, 32 nt, Human
agccucugcccaucccccucaagggcugcagg

SEQ ID NO: 51784 - RNA, 32 nt, Human
agccucugcccuccuccagcccggauggcucu

SEQ ID NO: 51785 - RNA, 32 nt, Human
agccucugccucuuccucugucuccugugggc

SEQ ID NO: 51786 - RNA, 32 nt, Human
agccucugcucccuccuggggacccacagcag

SEQ ID NO: 51787 - RNA, 32 nt, Human
agccucugcugcaaaugcucagcccugcuguu

SEQ ID NO: 51788 - RNA, 32 nt, Human
agccucugcugcaggugaggguugggggcagg

SEQ ID NO: 51789 - RNA, 32 nt, Human
agccucugcugcuccugcuccuggguuugaag

SEQ ID NO: 51790 - RNA, 32 nt, Human
agccucugcuguacacagaaacuacaggcucu

SEQ ID NO: 51791 - RNA, 32 nt, Human
agccucugcuuucccuuccuguccugagcaca

SEQ ID NO: 51792 - RNA, 32 nt, Human
agccucuggaguagcuggaacuacaggcuaaa

SEQ ID NO: 51793 - RNA, 32 nt, Human
agccucuggaguagcugggaccucaggcgcgc

SEQ ID NO: 51794 - RNA, 32 nt, Human
agccucuggaguagcugggacuacagacaugc

SEQ ID NO: 51795 - RNA, 32 nt, Human
agccucuggaguagcugggacuacaggcgugu

SEQ ID NO: 51796 - RNA, 32 nt, Human
agccucuggaguagcugggauuacagauggga

SEQ ID NO: 51797 - RNA, 32 nt, Human
agccucuggaguagcugggauuacaggcacgc

SEQ ID NO: 51798 - RNA, 32 nt, Human
agccucuggaguagcugggauuacaggugcgc

SEQ ID NO: 51799 - RNA, 32 nt, Human
agccucuggcugcaucugugcagccacauccu

SEQ ID NO: 51800 - RNA, 29 nt, Human
agccucuggcugcucuccuucccaauagu

SEQ ID NO: 51801 - RNA, 32 nt, Human
agccucugggaggguggcauguggcagcugca

SEQ ID NO: 51802 - RNA, 32 nt, Human
agccucuggggaggggaggugugaagccagag

SEQ ID NO: 51803 - RNA, 32 nt, Human
agccucugguggguuaucuccucuuugagaug

SEQ ID NO: 51804 - RNA, 32 nt, Human
agccucugucaugaggaacggaaaugcgaggg

SEQ ID NO: 51805 - RNA, 19 nt, Human
agccucugucccugaacug

SEQ ID NO: 51806 - RNA, 22 nt, Human
agccucugucucccgggcucaa

SEQ ID NO: 51807 - RNA, 32 nt, Human
agccucugucugccuagugagacauuuuugag

SEQ ID NO: 51808 - RNA, 32 nt, Human
agccucuguuccuccuggacauaggaaggucc

SEQ ID NO: 51809 - RNA, 19 nt, Human
agccucuguuggccugagg

SEQ ID NO: 51810 - RNA, 32 nt, Human
agccucuuaaguagcugagacuacaggugcgc

SEQ ID NO: 51811 - RNA, 32 nt, Human
agccucuuacguagcugggauuacaggcauga

SEQ ID NO: 51812 - RNA, 32 nt, Human
agccucuucacacccaccuggcuugcaucccc

SEQ ID NO: 51813 - RNA, 32 nt, Human
agccucuucauccucaaacaggaccaggccuc

SEQ ID NO: 51814 - RNA, 26 nt, Human
agccucuucccagcacccaccugcca

SEQ ID NO: 51815 - RNA, 32 nt, Human
agccucuuccucccucagaucccaccagaccc

SEQ ID NO: 51816 - RNA, 32 nt, Human
agccucuucucccaggggagcuacucaggacu

SEQ ID NO: 51817 - RNA, 32 nt, Human
agccucuucuccccaugcuucuaggaacugcc

SEQ ID NO: 51818 - RNA, 32 nt, Human
agccucuucugcgcacccaccugcugcaucuu

SEQ ID NO: 51819 - RNA, 32 nt, Human
agccucuucugggagaccccucuccccacgua

SEQ ID NO: 51820 - RNA, 32 nt, Human
agccucuucugugucuccuggguggcacuucu

SEQ ID NO: 51821 - RNA, 32 nt, Human
agccucuugaauagcugggacuagaagcaugc

SEQ ID NO: 51822 - RNA, 32 nt, Human
agccucuugaauagcugggauuacaggcgccc

SEQ ID NO: 51823 - RNA, 32 nt, Human
agccucuugaguagcuaggauuaccagugcac

SEQ ID NO: 51824 - RNA, 32 nt, Human
agccucuugaguagcuagguacaggcaccugc

SEQ ID NO: 51825 - RNA, 32 nt, Human
agccucuugaguagcugggacuacaggcgcac

SEQ ID NO: 51826 - RNA, 32 nt, Human
agccucuugaguagcugggacuacaggugccc

SEQ ID NO: 51827 - RNA, 32 nt, Human
agccucuugaguagcugggauuacaggaacgc

SEQ ID NO: 51828 - RNA, 32 nt, Human
agccucuugaguagcugggauuacaggcaugc

SEQ ID NO: 51829 - RNA, 32 nt, Human
agccucuugaguagcugggauuacaggcgccc

SEQ ID NO: 51830 - RNA, 32 nt, Human
agccucuugaguagcuugguuuauaggcgcau

SEQ ID NO: 51831 - RNA, 32 nt, Human
agccucuugaguggcugggauugcaggcgccc

SEQ ID NO: 51832 - RNA, 32 nt, Human
agccucuugaguggcugggauugcgggcacau

SEQ ID NO: 51833 - RNA, 32 nt, Human
agccucuugccuggcccugcugagaccacugc

SEQ ID NO: 51834 - RNA, 32 nt, Human
agccucuugccuggcugccagugggaguagcc

SEQ ID NO: 51835 - RNA, 32 nt, Human
agccucuugucagagcccucaggcaggcagau

SEQ ID NO: 51836 - RNA, 32 nt, Human
agccucuuguggugguggcugugcccccuaug

SEQ ID NO: 51837 - RNA, 23 nt, Human
agccucuuuccgcccugcccucc

SEQ ID NO: 51838 - RNA, 32 nt, Human
agccucuuuccucaccaaauggcaugcuggga

SEQ ID NO: 51839 - RNA, 32 nt, Human
agccucuuucuggagaccccaaagcuggaggg

SEQ ID NO: 51840 - RNA, 32 nt, Human
agccucuuuugcuuccuuuucuugcccaugcc

SEQ ID NO: 51841 - RNA, 28 nt, Human
agccugaaaagugcugucacgucagcgg

SEQ ID NO: 51842 - RNA, 32 nt, Human
agccugaacugaggccuugugugucaggcccu

SEQ ID NO: 51843 - RNA, 19 nt, Human
agccugaacuuccugaagg

SEQ ID NO: 51844 - RNA, 31 nt, Human
agccugaagagaccagugagcucacugugac

SEQ ID NO: 51845 - RNA, 20 nt, Human
agccugaagagcuuggacug

SEQ ID NO: 51846 - RNA, 32 nt, Human
agccugaaguacacucucgcugugcugucauu

SEQ ID NO: 51847 - RNA, 32 nt, Human
agccugaaguagugaugaguagucugggcccu

SEQ ID NO: 51848 - RNA, 32 nt, Human
agccugacauggugaaaccccaucucuacgaa

SEQ ID NO: 51849 - RNA, 32 nt, Human
agccugaccaaacauggcgaaaccccaucugu

SEQ ID NO: 51850 - RNA, 32 nt, Human
agccugaccaacacugagaaaccccaucucua

SEQ ID NO: 51851 - RNA, 21 nt, Human
agccugaccaacaugaugaaa

SEQ ID NO: 51852 - RNA, 21 nt, Human
agccugaccaacauggagaaa

SEQ ID NO: 51853 - RNA, 21 nt, Human
agccugaccaacaugguagaa

SEQ ID NO: 51854 - RNA, 21 nt, Human
agccugaccaacauggugaaa

SEQ ID NO: 51855 - RNA, 32 nt, Human
agccugaccaacauggugaaaaccccaucucu

SEQ ID NO: 51856 - RNA, 21 nt, Human
agccugaccaacguggcgaaa

SEQ ID NO: 51857 - RNA, 21 nt, Human
agccugaccaacguggugaaa

SEQ ID NO: 51858 - RNA, 21 nt, Human
agccugaccaauauggugaaa

SEQ ID NO: 51859 - RNA, 21 nt, Human
agccugaccaucauggugaaa

SEQ ID NO: 51860 - RNA, 32 nt, Human
agccugaccccaugccugucauggaacccucc

SEQ ID NO: 51861 - RNA, 32 nt, Human
agccugaccuuccagucucucuucccacucag

SEQ ID NO: 51862 - RNA, 32 nt, Human
agccugacgccgugccccuccuggcccauacg

SEQ ID NO: 51863 - RNA, 32 nt, Human
agccugacucuucccuuccccucucucauucc

SEQ ID NO: 51864 - RNA, 32 nt, Human
agccugacugcaacucaccucgaaggcggacc

SEQ ID NO: 51865 - RNA, 32 nt, Human
agccugagaagaggcagaggaagggcgaaaca

SEQ ID NO: 51866 - RNA, 32 nt, Human
agccugagaagcugcuggaggagaugcccaag

SEQ ID NO: 51867 - RNA, 32 nt, Human
agccugagaaugaccugcccuggccccagccc

SEQ ID NO: 51868 - RNA, 32 nt, Human
agccugagaccccagcccuggccuccccacuc

SEQ ID NO: 51869 - RNA, 32 nt, Human
agccugagagaugaagguugcagugagccgug

SEQ ID NO: 51870 - RNA, 32 nt, Human
agccugagaguuaggagaaauauuucagagcc

SEQ ID NO: 51871 - RNA, 21 nt, Human
agccugagcaacacugugaga

SEQ ID NO: 51872 - RNA, 32 nt, Human
agccugagcaacauagaccccaucucuaaaaa

SEQ ID NO: 51873 - RNA, 21 nt, Human
agccugagcaacauggugaaa

SEQ ID NO: 51874 - RNA, 32 nt, Human
agccugagcaaugacucgcaagcaauguuaga

SEQ ID NO: 51875 - RNA, 20 nt, Human
agccugagccagcacuugcc

SEQ ID NO: 51876 - RNA, 32 nt, Human
agccugagcccuggcccugcugcuuggugaau

SEQ ID NO: 51877 - RNA, 32 nt, Human
agccugagccgcugcggugagccaacccaaac

SEQ ID NO: 51878 - RNA, 32 nt, Human
agccugagcgagagacggggaagcacggagga

SEQ ID NO: 51879 - RNA, 32 nt, Human
agccugagcucuuccccaugcuugggacacgu

SEQ ID NO: 51880 - RNA, 32 nt, Human
agccugagcuuuguguagcucgagcuuugugu

SEQ ID NO: 51881 - RNA, 31 nt, Human
agccugaggagaccuggguaguggagacgcu

SEQ ID NO: 51882 - RNA, 32 nt, Human
agccugaggaggagggagagggaggaacaacc

SEQ ID NO: 51883 - RNA, 32 nt, Human
agccugaggcccgaggucagaggauucaggaa

SEQ ID NO: 51884 - RNA, 21 nt, Human
agccugaggcucuggagugcc

SEQ ID NO: 51885 - RNA, 32 nt, Human
agccugaggggaaggaaggaaguacgggcgaa

SEQ ID NO: 51886 - RNA, 32 nt, Human
agccugaggugaucuuucccuccucugaacua

SEQ ID NO: 51887 - RNA, 32 nt, Human
agccugaggugcagcuuuuauuuauguuuucc

SEQ ID NO: 51888 - RNA, 32 nt, Human
agccugagguggguggaggggacaguguucug

SEQ ID NO: 51889 - RNA, 32 nt, Human
agccugagguuugcucucuucccuucaucagg

SEQ ID NO: 51890 - RNA, 32 nt, Human
agccugagucuccagcccaaaccugccuuccu

SEQ ID NO: 51891 - RNA, 32 nt, Human
agccugaguggagcagagaugggcaccaguug

SEQ ID NO: 51892 - RNA, 32 nt, Human
agccugagugggguggugcaggccgguagucu

SEQ ID NO: 51893 - RNA, 32 nt, Human
agccugauagaaaucagugguguggggcacug

SEQ ID NO: 51894 - RNA, 32 nt, Human
agccugaugauggggaacccagagccacccgc

SEQ ID NO: 51895 - RNA, 32 nt, Human
agccugaugcauugugauggccaucugcccag

SEQ ID NO: 51896 - RNA, 32 nt, Human
agccugaugccaccuccucuguucuuggaaca

SEQ ID NO: 51897 - RNA, 32 nt, Human
agccugauuuuggggaggaggaaggggcgauu

SEQ ID NO: 51898 - RNA, 32 nt, Human
agccugcaaaacugauguaacuggagagcuac

SEQ ID NO: 51899 - RNA, 32 nt, Human
agccugcaaaucucccucuuguggaauuccac

SEQ ID NO: 51900 - RNA, 32 nt, Human
agccugcaacaugccagccacugugauagagg

SEQ ID NO: 51901 - RNA, 32 nt, Human
agccugcaaccaggacgcucuccaggaggcgg

SEQ ID NO: 51902 - RNA, 32 nt, Human
agccugcaaccuuugcacuccacugugcaaug

SEQ ID NO: 51903 - RNA, 32 nt, Human
agccugcaagauggagguugcagugagcucag

SEQ ID NO: 51904 - RNA, 32 nt, Human
agccugcaauaucuuuccuuccuuccuugcua

SEQ ID NO: 51905 - RNA, 22 nt, Human
agccugcaaucccagcuacuug

SEQ ID NO: 51906 - RNA, 32 nt, Human
agccugcacacacacuuccuguccacaggggg

SEQ ID NO: 51907 - RNA, 24 nt, Human
agccugcacagcuucuugcacuca

SEQ ID NO: 51908 - RNA, 32 nt, Human
agccugcacugggagcacagccagguuccccc

SEQ ID NO: 51909 - RNA, 22 nt, Human
agccugcagaaccagcacacca

SEQ ID NO: 51910 - RNA, 32 nt, Human
agccugcagaagcagagcaagcauaugaaaca

SEQ ID NO: 51911 - RNA, 32 nt, Human
agccugcagagaagaaagugaggccgggagcc

SEQ ID NO: 51912 - RNA, 32 nt, Human
agccugcagcaacagaacacuugaccuuaaaa

SEQ ID NO: 51913 - RNA, 32 nt, Human
agccugcagcagcugcaguaagccaagaucau

SEQ ID NO: 51914 - RNA, 32 nt, Human
agccugcagcauggcccagcuguuccugcccc

SEQ ID NO: 51915 - RNA, 32 nt, Human
agccugcagccugccagagcagagccacccgc

SEQ ID NO: 51916 - RNA, 32 nt, Human
agccugcaggaccucgugccaccccgagggcu

SEQ ID NO: 51917 - RNA, 32 nt, Human
agccugcaggccagaagcaguguuacacacuu

SEQ ID NO: 51918 - RNA, 32 nt, Human
agccugcagggugggugucgggacaugcugau

SEQ ID NO: 51919 - RNA, 32 nt, Human
agccugcaggguggugcugggacugagccagu

SEQ ID NO: 51920 - RNA, 32 nt, Human
agccugcagggugugggcagagaagggcaucu

SEQ ID NO: 51921 - RNA, 32 nt, Human
agccugcagguaggaccauugcagugaugggc

SEQ ID NO: 51922 - RNA, 32 nt, Human
agccugcagguggcaccgguggcccuggcugc

SEQ ID NO: 51923 - RNA, 24 nt, Human
agccugcagucccagcuacuuggg

SEQ ID NO: 51924 - RNA, 32 nt, Human
agccugcagugagccgagaucgcgccacugca

SEQ ID NO: 51925 - RNA, 32 nt, Human
agccugcaucugucuguccuuccuuccauugc

SEQ ID NO: 51926 - RNA, 32 nt, Human
agccugcauggaacuuccuuccucacucagcu

SEQ ID NO: 51927 - RNA, 18 nt, Human
agccugcauucugagcug

SEQ ID NO: 51928 - RNA, 32 nt, Human
agccugccaaagcacugggauuacaggcauga

SEQ ID NO: 51929 - RNA, 32 nt, Human
agccugccaaagugcugggauuacuggcguga

SEQ ID NO: 51930 - RNA, 19 nt, Human
agccugccaacaccugccu

SEQ ID NO: 51931 - RNA, 20 nt, Human
agccugccaacauggugaaa

SEQ ID NO: 51932 - RNA, 32 nt, Human
agccugccaagcagcgugccccgguugcaggc

SEQ ID NO: 51933 - RNA, 32 nt, Human
agccugccaaguagcuggauuacaggcacgug

SEQ ID NO: 51934 - RNA, 32 nt, Human
agccugccaaguagcugggacuaccggcgccc

SEQ ID NO: 51935 - RNA, 32 nt, Human
agccugccaaguagcugggauuacagacaggc

SEQ ID NO: 51936 - RNA, 32 nt, Human
agccugccaaguagcugggauuacaggcaugc

SEQ ID NO: 51937 - RNA, 31 nt, Human
agccugccacccucugggccuccuaccugug

SEQ ID NO: 51938 - RNA, 32 nt, Human
agccugccaccugaacuacucauaggaaauga

SEQ ID NO: 51939 - RNA, 32 nt, Human
agccugccacuaccccgagucucuccagguca

SEQ ID NO: 51940 - RNA, 32 nt, Human
agccugccacuugccucccugccugcuucugg

SEQ ID NO: 51941 - RNA, 32 nt, Human
agccugccauguccacaguuccuugggcugcu

SEQ ID NO: 51942 - RNA, 21 nt, Human
agccugcccaacauggugaaa

SEQ ID NO: 51943 - RNA, 32 nt, Human
agccugcccacagcagccuccuagaguuagca

SEQ ID NO: 51944 - RNA, 32 nt, Human
agccugcccaccucucagcccugggccaggga

SEQ ID NO: 51945 - RNA, 32 nt, Human
agccugcccacuacauccagccuguggcuuug

SEQ ID NO: 51946 - RNA, 32 nt, Human
agccugcccagccugcaccacccugcccgccc

SEQ ID NO: 51947 - RNA, 32 nt, Human
agccugcccaggaugcaggagccuuugaugag

SEQ ID NO: 51948 - RNA, 32 nt, Human
agccugcccaggugcugagauuacauguauga

SEQ ID NO: 51949 - RNA, 32 nt, Human
agccugcccgcagccuuauaguggggagggaa

SEQ ID NO: 51950 - RNA, 32 nt, Human
agccugcccugagaagguuuucuuccuucugu

SEQ ID NO: 51951 - RNA, 32 nt, Human
agccugcccugccuccuccaucagauccuuug

SEQ ID NO: 51952 - RNA, 32 nt, Human
agccugcccuggaggggaaggaaguccaugca

SEQ ID NO: 51953 - RNA, 32 nt, Human
agccugccgaguagcugggacuacaggucuaa

SEQ ID NO: 51954 - RNA, 32 nt, Human
agccugccgagugccugcgauuacaggcgcgc

SEQ ID NO: 51955 - RNA, 20 nt, Human
agccugccgcuccuggacug

SEQ ID NO: 51956 - RNA, 32 nt, Human
agccugccuaacucugccugguggcagugagc

SEQ ID NO: 51957 - RNA, 32 nt, Human
agccugccuaguagcugggacuacaggcgcgc

SEQ ID NO: 51958 - RNA, 32 nt, Human
agccugccuauaagguugggauuagcaugcaa

SEQ ID NO: 51959 - RNA, 32 nt, Human
agccugccucccagguuucuggcuuguggggg

SEQ ID NO: 51960 - RNA, 16 nt, Human
agccugccuccuccca

SEQ ID NO: 51961 - RNA, 32 nt, Human
agccugccugcagggauggucuccuuuuaaag

SEQ ID NO: 51962 - RNA, 32 nt, Human
agccugccugucgucuguggccaugcccauca

SEQ ID NO: 51963 - RNA, 32 nt, Human
agccugccuucccaacaucaugcccauagucu

SEQ ID NO: 51964 - RNA, 32 nt, Human
agccugcgaggaagguggggucucagugcuuu

SEQ ID NO: 51965 - RNA, 23 nt, Human
agccugcgaggccaaggcugcag

SEQ ID NO: 51966 - RNA, 26 nt, Human
agccugcgccccccucccuccucucc

SEQ ID NO: 51967 - RNA, 17 nt, Human
agccugcgccugagcug

SEQ ID NO: 51968 - RNA, 32 nt, Human
agccugcgcgcaucugucacucagggacuuuc

SEQ ID NO: 51969 - RNA, 32 nt, Human
agccugcgcuuuccgccuuccuucccucacaa

SEQ ID NO: 51970 - RNA, 22 nt, Human
agccugcggacccgcccaggga

SEQ ID NO: 51971 - RNA, 32 nt, Human
agccugcggcgccagccucacggagggccgug

SEQ ID NO: 51972 - RNA, 32 nt, Human
agccugcgucuggucugugucacacacagcag

SEQ ID NO: 51973 - RNA, 32 nt, Human
agccugcgugacacaaccacacuguagccugu

SEQ ID NO: 51974 - RNA, 20 nt, Human
agccugcgugagccgaggcg

SEQ ID NO: 51975 - RNA, 25 nt, Human
agccugcuagaacccccacccacca

SEQ ID NO: 51976 - RNA, 23 nt, Human
agccugcucagccuucucugagc

SEQ ID NO: 51977 - RNA, 32 nt, Human
agccugcuccagugacagcccaagauagaauc

SEQ ID NO: 51978 - RNA, 32 nt, Human
agccugcuccccgcaccccauggaggcgcaau

SEQ ID NO: 51979 - RNA, 32 nt, Human
agccugcucccucacccaggcacugggcaagu

SEQ ID NO: 51980 - RNA, 32 nt, Human
agccugcucccuccuaagaagaucccaagaau

SEQ ID NO: 51981 - RNA, 32 nt, Human
agccugcucuccccaaccacucuccccagauc

SEQ ID NO: 51982 - RNA, 32 nt, Human
agccugcucucggugugggccuaugucuaggc

SEQ ID NO: 51983 - RNA, 32 nt, Human
agccugcugaccagcugggaugauaggcaggc

SEQ ID NO: 51984 - RNA, 32 nt, Human
agccugcugagacucccuagccacagaaacag

SEQ ID NO: 51985 - RNA, 32 nt, Human
agccugcugagcuccacugguuuauccggggc

SEQ ID NO: 51986 - RNA, 32 nt, Human
agccugcugaguagcugggacuacaggcacau

SEQ ID NO: 51987 - RNA, 32 nt, Human
agccugcugaguagcugggauugcaggugugu

SEQ ID NO: 51988 - RNA, 32 nt, Human
agccugcugccuccccuccaucagccacagcu

SEQ ID NO: 51989 - RNA, 32 nt, Human
agccugcugcgcaccuucuccugcugcuaccc

SEQ ID NO: 51990 - RNA, 32 nt, Human
agccugcugucucaggaagcuguagaaggagu

SEQ ID NO: 51991 - RNA, 32 nt, Human
agccugcugugugccaggcuuugugcugagug

SEQ ID NO: 51992 - RNA, 32 nt, Human
agccugcuucagggcuucaggcugcuucugcu

SEQ ID NO: 51993 - RNA, 32 nt, Human
agccugcuugagcaucccuugugagcugugaa

SEQ ID NO: 51994 - RNA, 32 nt, Human
agccugcuuucagccaucaccuugccacagug

SEQ ID NO: 51995 - RNA, 32 nt, Human
agccuggaaaaaucacacuucuuugucauugu

SEQ ID NO: 51996 - RNA, 32 nt, Human
agccuggaaauguugacccucaaagggcauaa

SEQ ID NO: 51997 - RNA, 32 nt, Human
agccuggaacuccugggcucaggauccuucug

SEQ ID NO: 51998 - RNA, 32 nt, Human
agccuggaagacagaguaagauccaauuucac

SEQ ID NO: 51999 - RNA, 32 nt, Human
agccuggaaggucaagacugcagugagcugug

SEQ ID NO: 52000 - RNA, 32 nt, Human
agccuggaagguggaaguugcagugagucgag

SEQ ID NO: 52001 - RNA, 32 nt, Human
agccuggaaguguuacuggugccuggaacuga

SEQ ID NO: 52002 - RNA, 32 nt, Human
agccuggaaucagcuggagaacaucugcccuc

SEQ ID NO: 52003 - RNA, 22 nt, Human
agccuggaauuccugggcucaa

SEQ ID NO: 52004 - RNA, 32 nt, Human
agccuggacaacacagugagaccucaucucua

SEQ ID NO: 52005 - RNA, 21 nt, Human
agccuggacaacauggugaaa

SEQ ID NO: 52006 - RNA, 18 nt, Human
agccuggacacccaggag

SEQ ID NO: 52007 - RNA, 32 nt, Human
agccuggacucggcacucacagcugcugugca

SEQ ID NO: 52008 - RNA, 18 nt, Human
agccuggacucugagcug

SEQ ID NO: 52009 - RNA, 32 nt, Human
agccuggacuggccuccaggaugaggaugggg

SEQ ID NO: 52010 - RNA, 32 nt, Human
agccuggagaacugcaggggccaagguggagg

SEQ ID NO: 52011 - RNA, 32 nt, Human
agccuggagacguucuuggugaaagcuguggu

SEQ ID NO: 52012 - RNA, 32 nt, Human
agccuggagauguagaggcugcaaugagcugu

SEQ ID NO: 52013 - RNA, 32 nt, Human
agccuggagauguagaggcugcagugagcugu

SEQ ID NO: 52014 - RNA, 18 nt, Human
agccuggagauuggacug

SEQ ID NO: 52015 - RNA, 32 nt, Human
agccuggagccagaaccugugaagagcggaag

SEQ ID NO: 52016 - RNA, 23 nt, Human
agccuggaggucaaggcugcagu

SEQ ID NO: 52017 - RNA, 32 nt, Human
agccuggaggucaaggcugcagugagccaugu

SEQ ID NO: 52018 - RNA, 32 nt, Human
agccuggagucgggggacccagcuggaggcca

SEQ ID NO: 52019 - RNA, 32 nt, Human
agccuggaugacagagaaggucaugggaacau

SEQ ID NO: 52020 - RNA, 32 nt, Human
  misc_feature (28)..(28): n is a, c, g or u
agccuggaugacagagugagaccuuaunucaa

SEQ ID NO: 52021 - RNA, 32 nt, Human
agccuggaugacagagugagaccuugucucaa

SEQ ID NO: 52022 - RNA, 32 nt, Human
agccuggaugacagagugagacuccaucucaa

SEQ ID NO: 52023 - RNA, 32 nt, Human
agccuggaugacagagugagacuccgucucaa

SEQ ID NO: 52024 - RNA, 32 nt, Human
agccuggaugagggucuuuagcaaagauggaa

SEQ ID NO: 52025 - RNA, 18 nt, Human
agccuggauucgaaucug

SEQ ID NO: 52026 - RNA, 32 nt, Human
agccuggauugcuuaguaggggaauaaggcau

SEQ ID NO: 52027 - RNA, 32 nt, Human
agccuggauuuuuauuucugccaugaaaccca

SEQ ID NO: 52028 - RNA, 21 nt, Human
agccuggcaaacaugaugaaa

SEQ ID NO: 52029 - RNA, 21 nt, Human
agccuggcaaacauggcgaaa

SEQ ID NO: 52030 - RNA, 32 nt, Human
agccuggcacuucccauucaggccaccugcuu

SEQ ID NO: 52031 - RNA, 32 nt, Human
agccuggcagaggcacccauuccauucccagc

SEQ ID NO: 52032 - RNA, 17 nt, Human
agccuggcagcuagcug

SEQ ID NO: 52033 - RNA, 32 nt, Human
agccuggcaucuuccuguucuaccuccucauu

SEQ ID NO: 52034 - RNA, 21 nt, Human
agccuggccaacacggugaaa

SEQ ID NO: 52035 - RNA, 32 nt, Human
agccuggccaacagacgugagccauuuuccca

SEQ ID NO: 52036 - RNA, 21 nt, Human
agccuggccaacauagcgaaa

SEQ ID NO: 52037 - RNA, 21 nt, Human
agccuggccaacauagggaaa

SEQ ID NO: 52038 - RNA, 32 nt, Human
agccuggccaacauauagugaaacccagucuc

SEQ ID NO: 52039 - RNA, 21 nt, Human
agccuggccaacaucaugaaa

SEQ ID NO: 52040 - RNA, 21 nt, Human
agccuggccaacaugaugaaa

SEQ ID NO: 52041 - RNA, 21 nt, Human
agccuggccaacaugaugaag

SEQ ID NO: 52042 - RNA, 21 nt, Human
agccuggccaacauggagaaa

SEQ ID NO: 52043 - RNA, 32 nt, Human
agccuggccaacauggcagaaaccccaucucu

SEQ ID NO: 52044 - RNA, 20 nt, Human
agccuggccaacauggcgaa

SEQ ID NO: 52045 - RNA, 21 nt, Human
agccuggccaacauggcgaaa

SEQ ID NO: 52046 - RNA, 21 nt, Human
agccuggccaacauggcggaa

SEQ ID NO: 52047 - RNA, 21 nt, Human
agccuggccaacauggggaaa

SEQ ID NO: 52048 - RNA, 18 nt, Human
agccuggccaacauggug

SEQ ID NO: 52049 - RNA, 20 nt, Human
agccuggccaacauggugaa

SEQ ID NO: 52050 - RNA, 21 nt, Human
agccuggccaacauggugaaa

SEQ ID NO: 52051 - RNA, 21 nt, Human
agccuggccaacauggugaag

SEQ ID NO: 52052 - RNA, 21 nt, Human
agccuggccaacaugguggaa

SEQ ID NO: 52053 - RNA, 32 nt, Human
agccuggccaacaugucagaacuacuaaaaau

SEQ ID NO: 52054 - RNA, 21 nt, Human
agccuggccaacauugugaaa

SEQ ID NO: 52055 - RNA, 32 nt, Human
agccuggccaacccagccuggucaacauggug

SEQ ID NO: 52056 - RNA, 21 nt, Human
agccuggccaaccuggugaaa

SEQ ID NO: 52057 - RNA, 21 nt, Human
agccuggccaacgugaugaaa

SEQ ID NO: 52058 - RNA, 21 nt, Human
agccuggccaacguggugaaa

SEQ ID NO: 52059 - RNA, 21 nt, Human
agccuggccaacuuagugaaa

SEQ ID NO: 52060 - RNA, 21 nt, Human
agccuggccaacuugaugaaa

SEQ ID NO: 52061 - RNA, 21 nt, Human
agccuggccaacuuggugaaa

SEQ ID NO: 52062 - RNA, 21 nt, Human
agccuggccaagauggugaaa

SEQ ID NO: 52063 - RNA, 21 nt, Human
agccuggccaauauggugaaa

SEQ ID NO: 52064 - RNA, 32 nt, Human
agccuggccaauauggugaaaccacgucucua

SEQ ID NO: 52065 - RNA, 20 nt, Human
agccuggccacauggugaaa

SEQ ID NO: 52066 - RNA, 32 nt, Human
agccuggccaccaucucccuggagauggagcg

SEQ ID NO: 52067 - RNA, 21 nt, Human
agccuggccaccauggugaaa

SEQ ID NO: 52068 - RNA, 32 nt, Human
agccuggccacugccuagcuggaaugggagga

SEQ ID NO: 52069 - RNA, 21 nt, Human
agccuggccagcacggugaaa

SEQ ID NO: 52070 - RNA, 21 nt, Human
agccuggccagcauagugaaa

SEQ ID NO: 52071 - RNA, 21 nt, Human
agccuggccagcauggcgaaa

SEQ ID NO: 52072 - RNA, 21 nt, Human
agccuggccagcauggugaaa

SEQ ID NO: 52073 - RNA, 32 nt, Human
agccuggccagcugcucagaccagcuugcaga

SEQ ID NO: 52074 - RNA, 21 nt, Human
agccuggccaucauggugaaa

SEQ ID NO: 52075 - RNA, 25 nt, Human
agccuggcccagcccaccucccccu

SEQ ID NO: 52076 - RNA, 32 nt, Human
agccuggccccagggacuucacggauccccug

SEQ ID NO: 52077 - RNA, 19 nt, Human
agccuggccccucaccaca

SEQ ID NO: 52078 - RNA, 32 nt, Human
agccuggccccucugcugagcacuuugcgcug

SEQ ID NO: 52079 - RNA, 18 nt, Human
agccuggccccuggaacu

SEQ ID NO: 52080 - RNA, 17 nt, Human
agccuggcccugagcug

SEQ ID NO: 52081 - RNA, 32 nt, Human
agccuggcccuggaggguggucacggccccuc

SEQ ID NO: 52082 - RNA, 18 nt, Human
agccuggcccuggcacug

SEQ ID NO: 52083 - RNA, 15 nt, Human
agccuggccuaauug

SEQ ID NO: 52084 - RNA, 32 nt, Human
agccuggccuacaugguugaaaccccaucucu

SEQ ID NO: 52085 - RNA, 22 nt, Human
agccuggccuccagccccagca

SEQ ID NO: 52086 - RNA, 32 nt, Human
agccuggccuccugaugcugugcucuucaucu

SEQ ID NO: 52087 - RNA, 17 nt, Human
agccuggccucugccug

SEQ ID NO: 52088 - RNA, 17 nt, Human
agccuggccugacgcug

SEQ ID NO: 52089 - RNA, 32 nt, Human
agccuggccugaggcaggcugcgcgggaggcc

SEQ ID NO: 52090 - RNA, 18 nt, Human
agccuggccugccaaacu

SEQ ID NO: 52091 - RNA, 32 nt, Human
agccuggccugcuccccucuggucaccgacac

SEQ ID NO: 52092 - RNA, 18 nt, Human
agccuggccuggagccug

SEQ ID NO: 52093 - RNA, 17 nt, Human
agccuggccuggcacug

SEQ ID NO: 52094 - RNA, 17 nt, Human
agccuggccuggcucug

SEQ ID NO: 52095 - RNA, 32 nt, Human
agccuggccugggccucuuacccacuugguug

SEQ ID NO: 52096 - RNA, 17 nt, Human
agccuggccuguggcug

SEQ ID NO: 52097 - RNA, 18 nt, Human
agccuggccuucaugacu

SEQ ID NO: 52098 - RNA, 17 nt, Human
agccuggccuugaaucc

SEQ ID NO: 52099 - RNA, 32 nt, Human
agccuggccuugagggaggggugcaggugugg

SEQ ID NO: 52100 - RNA, 21 nt, Human
agccuggcuaacacagugaaa

SEQ ID NO: 52101 - RNA, 21 nt, Human
agccuggcuaacacggugaaa

SEQ ID NO: 52102 - RNA, 21 nt, Human
agccuggcuaacauggcgaaa

SEQ ID NO: 52103 - RNA, 21 nt, Human
agccuggcuaacauggugaaa

SEQ ID NO: 52104 - RNA, 32 nt, Human
agccuggcuauacagugcauccuugaacuguc

SEQ ID NO: 52105 - RNA, 32 nt, Human
agccuggcucaggccuuucugggcugcuucuc

SEQ ID NO: 52106 - RNA, 18 nt, Human
agccuggcuccugaaucc

SEQ ID NO: 52107 - RNA, 17 nt, Human
agccuggcucugaagug

SEQ ID NO: 52108 - RNA, 17 nt, Human
agccuggcucugcuuug

SEQ ID NO: 52109 - RNA, 17 nt, Human
agccuggcucuggccug

SEQ ID NO: 52110 - RNA, 18 nt, Human
agccuggcucuugugcug

SEQ ID NO: 52111 - RNA, 32 nt, Human
agccuggcugacacaggugugaagaggccauc

SEQ ID NO: 52112 - RNA, 16 nt, Human
agccuggcugcugcug

SEQ ID NO: 52113 - RNA, 15 nt, Human
agccuggcuggacug

SEQ ID NO: 52114 - RNA, 18 nt, Human
agccuggcuggagagcug

SEQ ID NO: 52115 - RNA, 32 nt, Human
agccuggcuggcuuagugccucuuaguccauc

SEQ ID NO: 52116 - RNA, 16 nt, Human
agccuggcugggacug

SEQ ID NO: 52117 - RNA, 17 nt, Human
agccuggcugugggcug

SEQ ID NO: 52118 - RNA, 20 nt, Human
agccuggcuguuguguggua

SEQ ID NO: 52119 - RNA, 17 nt, Human
agccuggcuucaaauug

SEQ ID NO: 52120 - RNA, 18 nt, Human
agccuggcuucagagcug

SEQ ID NO: 52121 - RNA, 18 nt, Human
agccuggcuuccccggau

SEQ ID NO: 52122 - RNA, 17 nt, Human
agccuggcuucuagcug

SEQ ID NO: 52123 - RNA, 15 nt, Human
agccuggcuucucug

SEQ ID NO: 52124 - RNA, 32 nt, Human
agccuggcuucugguugucauggaugcacugg

SEQ ID NO: 52125 - RNA, 17 nt, Human
agccuggcuucugucug

SEQ ID NO: 52126 - RNA, 17 nt, Human
agccuggcuucuuacug

SEQ ID NO: 52127 - RNA, 17 nt, Human
agccuggcuugaaccug

SEQ ID NO: 52128 - RNA, 32 nt, Human
agccuggcuugaaccugggaggcggagguugc

SEQ ID NO: 52129 - RNA, 17 nt, Human
agccuggcuugagacug

SEQ ID NO: 52130 - RNA, 15 nt, Human
agccuggcuuggcug

SEQ ID NO: 52131 - RNA, 32 nt, Human
agccuggcuuuggguacagcauguggaugaag

SEQ ID NO: 52132 - RNA, 18 nt, Human
agccuggcuuuuauaacu

SEQ ID NO: 52133 - RNA, 15 nt, Human
agccuggcuuuucug

SEQ ID NO: 52134 - RNA, 17 nt, Human
agccuggcuuuugccug

SEQ ID NO: 52135 - RNA, 32 nt, Human
agccugggaaagaggcugggcugccugugauc

SEQ ID NO: 52136 - RNA, 24 nt, Human
agccugggaacucaaggcugcagu

SEQ ID NO: 52137 - RNA, 32 nt, Human
agccugggaaggcagccggugccugaauacuu

SEQ ID NO: 52138 - RNA, 24 nt, Human
agccugggaagucaagccugcagu

SEQ ID NO: 52139 - RNA, 32 nt, Human
agccugggaagucaagccugcagugagccaug

SEQ ID NO: 52140 - RNA, 32 nt, Human
agccugggaaguggaaguugcagugagccaag

SEQ ID NO: 52141 - RNA, 32 nt, Human
agccugggaaguggaggcugcagugagccuag

SEQ ID NO: 52142 - RNA, 32 nt, Human
agccugggaaguggagguugcaguaggcugaa

SEQ ID NO: 52143 - RNA, 32 nt, Human
agccugggaaguugaggcugcagugagccgug

SEQ ID NO: 52144 - RNA, 32 nt, Human
agccugggaauucgaagcugcagugagcuaug

SEQ ID NO: 52145 - RNA, 32 nt, Human
agccugggaauuugcauuuccacaggcauccg

SEQ ID NO: 52146 - RNA, 24 nt, Human
agccugggagaccaccccuugcca

SEQ ID NO: 52147 - RNA, 32 nt, Human
agccugggagaucgaggcugcagugagccaag

SEQ ID NO: 52148 - RNA, 32 nt, Human
agccugggagauggagguugcagugagcugag

SEQ ID NO: 52149 - RNA, 32 nt, Human
agccugggagcaaggguugcagugagcugaga

SEQ ID NO: 52150 - RNA, 32 nt, Human
agccugggagcgcagguugcaaugagccaaga

SEQ ID NO: 52151 - RNA, 32 nt, Human
agccugggaggaagagguugcagugagccgag

SEQ ID NO: 52152 - RNA, 32 nt, Human
agccugggaggagaaggagccgggaggggcgc

SEQ ID NO: 52153 - RNA, 32 nt, Human
agccugggaggcagagauugcacugagccgag

SEQ ID NO: 52154 - RNA, 32 nt, Human
agccugggaggcagaggcugcagugagccgag

SEQ ID NO: 52155 - RNA, 32 nt, Human
agccugggaggcagagguugcagugagccaag

SEQ ID NO: 52156 - RNA, 32 nt, Human
agccugggaggcagagguugcagugagccgag

SEQ ID NO: 52157 - RNA, 32 nt, Human
agccugggaggcagagguugcagugagcugag

SEQ ID NO: 52158 - RNA, 32 nt, Human
agccugggaggcagagguugcugugagccgag

SEQ ID NO: 52159 - RNA, 26 nt, Human
agccugggaggcggagguugcaguga

SEQ ID NO: 52160 - RNA, 32 nt, Human
agccugggaggcggagguugcagugagccgag

SEQ ID NO: 52161 - RNA, 32 nt, Human
agccugggaggcggggguuguggugagccgag

SEQ ID NO: 52162 - RNA, 32 nt, Human
agccugggaggucaagccuacagugagccaug

SEQ ID NO: 52163 - RNA, 24 nt, Human
agccugggaggucaaggcugcagu

SEQ ID NO: 52164 - RNA, 32 nt, Human
agccugggaggucaaggcugcagugaaccaug

SEQ ID NO: 52165 - RNA, 32 nt, Human
agccugggaggucaaggcugcagugagccaug

SEQ ID NO: 52166 - RNA, 32 nt, Human
agccugggaggucaaggcugcagugagccgag

SEQ ID NO: 52167 - RNA, 32 nt, Human
agccugggaggucaaggcugcagugagccgug

SEQ ID NO: 52168 - RNA, 32 nt, Human
agccugggaggucaaggcugcagugagcugug

SEQ ID NO: 52169 - RNA, 32 nt, Human
agccugggaggucgaggcugcagugagcugug

SEQ ID NO: 52170 - RNA, 32 nt, Human
agccugggagguggaggcuacugugagccaug

SEQ ID NO: 52171 - RNA, 32 nt, Human
agccugggagguggagguugcacugaguagag

SEQ ID NO: 52172 - RNA, 26 nt, Human
agccugggagguggagguugcaguga

SEQ ID NO: 52173 - RNA, 32 nt, Human
agccugggagguggagguugcagugagcuaag

SEQ ID NO: 52174 - RNA, 32 nt, Human
agccugggagguggagguugcagugaguggag

SEQ ID NO: 52175 - RNA, 32 nt, Human
agccugggagguggagguugccagugagucga

SEQ ID NO: 52176 - RNA, 32 nt, Human
agccugggagguggagguuucagugagcuggg

SEQ ID NO: 52177 - RNA, 32 nt, Human
agccugggagguggaguuugcagugagcuaag

SEQ ID NO: 52178 - RNA, 32 nt, Human
agccugggagguugaggcugcagugagccaug

SEQ ID NO: 52179 - RNA, 32 nt, Human
agccugggagguugaggcugcaguggcuauga

SEQ ID NO: 52180 - RNA, 32 nt, Human
agccugggagguugugguugcagugagcuaug

SEQ ID NO: 52181 - RNA, 32 nt, Human
agccugggaguucgaggcugcagugagcaaug

SEQ ID NO: 52182 - RNA, 32 nt, Human
agccugggaguuugaggcugcagugagcuaug

SEQ ID NO: 52183 - RNA, 32 nt, Human
agccugggaugucaaggcugcagugagcugug

SEQ ID NO: 52184 - RNA, 32 nt, Human
agccugggcaacaacagcaaaacuccaucuca

SEQ ID NO: 52185 - RNA, 22 nt, Human
agccugggcaacaagagcgaaa

SEQ ID NO: 52186 - RNA, 19 nt, Human
agccugggcaacacagaga

SEQ ID NO: 52187 - RNA, 19 nt, Human
agccugggcaacacaggga

SEQ ID NO: 52188 - RNA, 19 nt, Human
agccugggcaacacaguga

SEQ ID NO: 52189 - RNA, 32 nt, Human
agccugggcaacagagagagacagucccuggc

SEQ ID NO: 52190 - RNA, 19 nt, Human
agccugggcaacagagcga

SEQ ID NO: 52191 - RNA, 32 nt, Human
agccugggcaacaggugagauucugucuccaa

SEQ ID NO: 52192 - RNA, 19 nt, Human
agccugggcaacauagcga

SEQ ID NO: 52193 - RNA, 21 nt, Human
agccugggcaacauggugaaa

SEQ ID NO: 52194 - RNA, 30 nt, Human
agccugggcagcagagcaagacucugucuc

SEQ ID NO: 52195 - RNA, 32 nt, Human
agccugggcagccugcgcugcugaccacccuc

SEQ ID NO: 52196 - RNA, 32 nt, Human
agccugggcagcuguccccacccuuuuucaug

SEQ ID NO: 52197 - RNA, 32 nt, Human
agccugggcaggcagauguaccauuguuagug

SEQ ID NO: 52198 - RNA, 32 nt, Human
agccugggccagaaucccggaccccucaccuc

SEQ ID NO: 52199 - RNA, 32 nt, Human
agccugggccagaaugagacuccgucucaaaa

SEQ ID NO: 52200 - RNA, 32 nt, Human
agccugggcccggcuggggaggggguggcagg

SEQ ID NO: 52201 - RNA, 19 nt, Human
agccugggcgacacagcga

SEQ ID NO: 52202 - RNA, 21 nt, Human
agccugggcgacagagcgaga

SEQ ID NO: 52203 - RNA, 32 nt, Human
agccugggcgacagagugacccugccucaaaa

SEQ ID NO: 52204 - RNA, 21 nt, Human
agccugggcggccugagagcg

SEQ ID NO: 52205 - RNA, 32 nt, Human
agccugggcgggugcaggagaucgugggcgcc

SEQ ID NO: 52206 - RNA, 32 nt, Human
agccugggcgucggagccaccuccugggcagc

SEQ ID NO: 52207 - RNA, 32 nt, Human
agccugggcuacagagcaagaccucaucuuuc

SEQ ID NO: 52208 - RNA, 32 nt, Human
agccugggcucccagccccucucuccuuuucc

SEQ ID NO: 52209 - RNA, 32 nt, Human
agccugggcugugccacacaagcacuucaucg

SEQ ID NO: 52210 - RNA, 18 nt, Human
agccugggcuuccaggcc

SEQ ID NO: 52211 - RNA, 17 nt, Human
agccugggcuugagcug

SEQ ID NO: 52212 - RNA, 32 nt, Human
agccuggggacccccugggaucacccagccau

SEQ ID NO: 52213 - RNA, 24 nt, Human
agccuggggacugcagcccaggga

SEQ ID NO: 52214 - RNA, 32 nt, Human
agccuggggaucuuguuaaaaugcagauccug

SEQ ID NO: 52215 - RNA, 32 nt, Human
agccuggggcaggcccuagcaggccaggccac

SEQ ID NO: 52216 - RNA, 32 nt, Human
agccuggggcccugugauccucugguuucuuc

SEQ ID NO: 52217 - RNA, 32 nt, Human
agccuggggcugccucugcucuccaagaccca

SEQ ID NO: 52218 - RNA, 32 nt, Human
agccugggggacugaggcugcagugagccaug

SEQ ID NO: 52219 - RNA, 32 nt, Human
agccuggggucuccagccuggcugcugcuggg

SEQ ID NO: 52220 - RNA, 32 nt, Human
agccuggggugaggguaagggguagggggcuu

SEQ ID NO: 52221 - RNA, 32 nt, Human
agccugggguggagaggagggagccggcaucu

SEQ ID NO: 52222 - RNA, 32 nt, Human
agccugggucugccuuuuguccagaucagcug

SEQ ID NO: 52223 - RNA, 32 nt, Human
agccugggugacacuccagccugggugacaaa

SEQ ID NO: 52224 - RNA, 32 nt, Human
agccugggugacagagcaaacucucucuuaaa

SEQ ID NO: 52225 - RNA, 21 nt, Human
agccugggugacagagcaaga

SEQ ID NO: 52226 - RNA, 32 nt, Human
agccugggugacagagugaaacccuuaaucaa

SEQ ID NO: 52227 - RNA, 32 nt, Human
agccugggugacagagugagacuccaccucaa

SEQ ID NO: 52228 - RNA, 32 nt, Human
agccugggugacagagugagacuccaucucaa

SEQ ID NO: 52229 - RNA, 32 nt, Human
agccugggugacagagugagaucuugucucaa

SEQ ID NO: 52230 - RNA, 31 nt, Human
agccugggugagagagcaagacccugccuca

SEQ ID NO: 52231 - RNA, 31 nt, Human
agccugggugagagagugagacacuguccca

SEQ ID NO: 52232 - RNA, 32 nt, Human
agccuggguguccucugaggccagccucucca

SEQ ID NO: 52233 - RNA, 32 nt, Human
agccugguaggcugaggcugcagugagccaag

SEQ ID NO: 52234 - RNA, 32 nt, Human
agccugguauaaccucuggcuccaugggcagc

SEQ ID NO: 52235 - RNA, 21 nt, Human
agccuggucaacauagugaaa

SEQ ID NO: 52236 - RNA, 21 nt, Human
agccuggucaacauggugaaa

SEQ ID NO: 52237 - RNA, 32 nt, Human
agccuggucagccugguggguacccucuaugc

SEQ ID NO: 52238 - RNA, 32 nt, Human
agccuggucuacugaguaagcccacuguugag

SEQ ID NO: 52239 - RNA, 32 nt, Human
agccuggucucaaacuccugaccucaagugac

SEQ ID NO: 52240 - RNA, 32 nt, Human
agccuggucucaaacuccuguccucaagugau

SEQ ID NO: 52241 - RNA, 32 nt, Human
agccuggucucgaacuccugaccucaggugau

SEQ ID NO: 52242 - RNA, 32 nt, Human
agccuggucucgaacucuugaccuccugaucc

SEQ ID NO: 52243 - RNA, 16 nt, Human
agccuggucugcacug

SEQ ID NO: 52244 - RNA, 32 nt, Human
agccuggucuugaacuccugaccucaagugau

SEQ ID NO: 52245 - RNA, 32 nt, Human
agccuggucuugaacuccugaccucaggugau

SEQ ID NO: 52246 - RNA, 32 nt, Human
agccuggugagguuuguacucuaaggagccca

SEQ ID NO: 52247 - RNA, 32 nt, Human
agccuggugcccauccucccgaccccuaccca

SEQ ID NO: 52248 - RNA, 32 nt, Human
agccuggugccuguaaucccagcuacucggga

SEQ ID NO: 52249 - RNA, 32 nt, Human
agccugguggacccaaggagaaggucccauuu

SEQ ID NO: 52250 - RNA, 32 nt, Human
agccugguggcagaggaagcagguggcaccaa

SEQ ID NO: 52251 - RNA, 21 nt, Human
agccugguggcugcugcccca

SEQ ID NO: 52252 - RNA, 32 nt, Human
agccuggugguacuggccacgccccucaaggc

SEQ ID NO: 52253 - RNA, 32 nt, Human
agccugguguucaccaggccugguagaugaga

SEQ ID NO: 52254 - RNA, 32 nt, Human
agccugguucaaaaucagucacucccuucaga

SEQ ID NO: 52255 - RNA, 32 nt, Human
agccugguucacaggcuuagugauggagauau

SEQ ID NO: 52256 - RNA, 32 nt, Human
agccugguuggaccauuguccaugccucagga

SEQ ID NO: 52257 - RNA, 32 nt, Human
agccugguuuccugggcugggcucaggaaagc

SEQ ID NO: 52258 - RNA, 24 nt, Human
agccuguaaucccaacacuuuggg

SEQ ID NO: 52259 - RNA, 24 nt, Human
agccuguaaucccagcacguuggg

SEQ ID NO: 52260 - RNA, 24 nt, Human
agccuguaaucccagcacuuuggg

SEQ ID NO: 52261 - RNA, 24 nt, Human
agccuguaaucccagcaguuuggg

SEQ ID NO: 52262 - RNA, 24 nt, Human
agccuguaaucccagcuacucagg

SEQ ID NO: 52263 - RNA, 24 nt, Human
agccuguaaucccagcuauuuggg

SEQ ID NO: 52264 - RNA, 19 nt, Human
agccuguaaucccagcugc

SEQ ID NO: 52265 - RNA, 24 nt, Human
agccuguaaucccagcuguucggg

SEQ ID NO: 52266 - RNA, 24 nt, Human
agccuguaaucccaguacuuuggg

SEQ ID NO: 52267 - RNA, 24 nt, Human
agccuguaauccuagcacuuuggg

SEQ ID NO: 52268 - RNA, 24 nt, Human
agccuguaauccuagcuacucagg

SEQ ID NO: 52269 - RNA, 24 nt, Human
agccuguaaucucagcuacucagg

SEQ ID NO: 52270 - RNA, 24 nt, Human
agccuguaaucucugcacuuuggg

SEQ ID NO: 52271 - RNA, 32 nt, Human
agccuguaccuacaggccauauugcucaggcu

SEQ ID NO: 52272 - RNA, 32 nt, Human
agccuguacuagcuuuugaaauccagaaguuu

SEQ ID NO: 52273 - RNA, 32 nt, Human
agccuguacucccagcacuuuuggaggccgag

SEQ ID NO: 52274 - RNA, 32 nt, Human
agccuguagccccugagcugacgcagacacaa

SEQ ID NO: 52275 - RNA, 24 nt, Human
agccuguagucccagauacucagg

SEQ ID NO: 52276 - RNA, 24 nt, Human
agccuguagucccagcuacacggg

SEQ ID NO: 52277 - RNA, 24 nt, Human
agccuguagucccagcuacucagg

SEQ ID NO: 52278 - RNA, 24 nt, Human
agccuguagucccagcuacuccgg

SEQ ID NO: 52279 - RNA, 24 nt, Human
agccuguagucccagcuacucggg

SEQ ID NO: 52280 - RNA, 24 nt, Human
agccuguaguccuagcuacucggg

SEQ ID NO: 52281 - RNA, 24 nt, Human
agccuguaguuccagcuacucggg

SEQ ID NO: 52282 - RNA, 32 nt, Human
agccuguauguacugcuuuaacuccuggaaga

SEQ ID NO: 52283 - RNA, 32 nt, Human
agccugucaaguagcugggauuacaggcgugu

SEQ ID NO: 52284 - RNA, 32 nt, Human
agccugucaccacugccauauuccugccugcu

SEQ ID NO: 52285 - RNA, 32 nt, Human
agccugucacccgugugaagaugaaggggcuc

SEQ ID NO: 52286 - RNA, 32 nt, Human
agccugucaggcugggcggguccauauccggg

SEQ ID NO: 52287 - RNA, 21 nt, Human
agccuguccaacauggugaaa

SEQ ID NO: 52288 - RNA, 32 nt, Human
agccuguccccacuaucccucuugucagcacg

SEQ ID NO: 52289 - RNA, 32 nt, Human
agccugucccuccaauuuacugcacauaagau

SEQ ID NO: 52290 - RNA, 32 nt, Human
agccugucccugcgcugcgccuccaggcugga

SEQ ID NO: 52291 - RNA, 32 nt, Human
agccuguccgcaaauacuaggagaaguggcug

SEQ ID NO: 52292 - RNA, 32 nt, Human
agccuguccgcuaugcggcuccugccucuagc

SEQ ID NO: 52293 - RNA, 32 nt, Human
agccuguccugccuccaguccaccuguggccu

SEQ ID NO: 52294 - RNA, 32 nt, Human
agccuguccugucucuauucuaggcaagagag

SEQ ID NO: 52295 - RNA, 24 nt, Human
agccugucgucccagcuacucagg

SEQ ID NO: 52296 - RNA, 32 nt, Human
agccugucguggccgugaccuccaacugggag

SEQ ID NO: 52297 - RNA, 32 nt, Human
agccugucucagaggacaccagaauggagcgc

SEQ ID NO: 52298 - RNA, 17 nt, Human
agccugucucugaauug

SEQ ID NO: 52299 - RNA, 32 nt, Human
agccugucucugcuaagggcaaauccuccggu

SEQ ID NO: 52300 - RNA, 32 nt, Human
agccugucugccuggaaaccaugccaugucuu

SEQ ID NO: 52301 - RNA, 32 nt, Human
agccugucugcucuccccacauuagcccuuag

SEQ ID NO: 52302 - RNA, 32 nt, Human
agccugucugugcaucccccaucccagccagg

SEQ ID NO: 52303 - RNA, 21 nt, Human
agccugucuuagccugagcug

SEQ ID NO: 52304 - RNA, 32 nt, Human
agccugucuugcucauucaugcagccucaaca

SEQ ID NO: 52305 - RNA, 32 nt, Human
agccugugaccucucagucagacuggggugca

SEQ ID NO: 52306 - RNA, 32 nt, Human
agccugugacuuuccucccuggacaaaggcau

SEQ ID NO: 52307 - RNA, 32 nt, Human
agccugugagggagguggcggguccccacugu

SEQ ID NO: 52308 - RNA, 32 nt, Human
agccugugaggucgaggcuacagugagcaaag

SEQ ID NO: 52309 - RNA, 32 nt, Human
agccugugaggucgaggcugcagugagccgag

SEQ ID NO: 52310 - RNA, 32 nt, Human
agccugugcagaaggggcaggacugcagugca

SEQ ID NO: 52311 - RNA, 21 nt, Human
agccugugcccuucugaagug

SEQ ID NO: 52312 - RNA, 32 nt, Human
agccuguggcagcugcugccccagccacagcu

SEQ ID NO: 52313 - RNA, 32 nt, Human
agccuguggcauuuuuccuccuucucccuaac

SEQ ID NO: 52314 - RNA, 32 nt, Human
agccuguggcuaaaguuuccacaucccauuaa

SEQ ID NO: 52315 - RNA, 20 nt, Human
agccugugggaccucaggag

SEQ ID NO: 52316 - RNA, 18 nt, Human
agccugugggcccaggag

SEQ ID NO: 52317 - RNA, 32 nt, Human
agccuguggggaugaggaaggagagccacagg

SEQ ID NO: 52318 - RNA, 24 nt, Human
agccuguggucucaacuacucagg

SEQ ID NO: 52319 - RNA, 32 nt, Human
agccuguggucuccauggcaauggguguccau

SEQ ID NO: 52320 - RNA, 32 nt, Human
agccuguggugaucccagcagcuuuggagggc

SEQ ID NO: 52321 - RNA, 32 nt, Human
agccugugguggccuugcauccugacuggaug

SEQ ID NO: 52322 - RNA, 32 nt, Human
agccugugguugauggaaauucacaaagugag

SEQ ID NO: 52323 - RNA, 20 nt, Human
agccugugguuucugagcug

SEQ ID NO: 52324 - RNA, 23 nt, Human
agccuguguaacagcuccuuggg

SEQ ID NO: 52325 - RNA, 32 nt, Human
agccuguguccaggcuggggagcccgugucug

SEQ ID NO: 52326 - RNA, 21 nt, Human
agccugugugcuacugaacug

SEQ ID NO: 52327 - RNA, 32 nt, Human
agccugugugugugcaugcaggggugagguau

SEQ ID NO: 52328 - RNA, 21 nt, Human
agccuguguguucacacacca

SEQ ID NO: 52329 - RNA, 32 nt, Human
agccuguguguucuucaccugugccugcuccu

SEQ ID NO: 52330 - RNA, 24 nt, Human
agccuguguucccagcugcuuagg

SEQ ID NO: 52331 - RNA, 32 nt, Human
agccuguucuguaguucaagguggcagagaaa

SEQ ID NO: 52332 - RNA, 25 nt, Human
agccuguuggaaaagaagcccugug

SEQ ID NO: 52333 - RNA, 32 nt, Human
agccuguuugcuagggagagugagugagugcu

SEQ ID NO: 52334 - RNA, 25 nt, Human
agccuuaaacaugcccccacuccca

SEQ ID NO: 52335 - RNA, 32 nt, Human
agccuuaaauacacacugaguuuagaaaaaug

SEQ ID NO: 52336 - RNA, 32 nt, Human
agccuuaaguaggaagaaauugcagugucuau

SEQ ID NO: 52337 - RNA, 32 nt, Human
agccuuaauuccuucccuaucuccuuaccaaa

SEQ ID NO: 52338 - RNA, 32 nt, Human
agccuuacaaguggcgagggaaagcacacaaa

SEQ ID NO: 52339 - RNA, 32 nt, Human
agccuuaccaacaccaaagaaacauccaagca

SEQ ID NO: 52340 - RNA, 32 nt, Human
agccuuacuggguccuuacccugggccaaaca

SEQ ID NO: 52341 - RNA, 32 nt, Human
agccuuagaacuccucauucucauguugcuau

SEQ ID NO: 52342 - RNA, 32 nt, Human
agccuuagaagaggaagcaaaggcagauucag

SEQ ID NO: 52343 - RNA, 32 nt, Human
agccuuagagguggggguucaucaggagcacu

SEQ ID NO: 52344 - RNA, 32 nt, Human
agccuuagaugaccuccagcaacuucaguucu

SEQ ID NO: 52345 - RNA, 32 nt, Human
agccuuagccuccugaguagcuaggacuguag

SEQ ID NO: 52346 - RNA, 32 nt, Human
agccuuagccugggcgacagagcgagaccaca

SEQ ID NO: 52347 - RNA, 32 nt, Human
agccuuagcuggcugccaugucuccugccugu

SEQ ID NO: 52348 - RNA, 32 nt, Human
agccuuagguuagugcccagugcagugccaga

SEQ ID NO: 52349 - RNA, 19 nt, Human
agccuuagucccugagcug

SEQ ID NO: 52350 - RNA, 32 nt, Human
agccuuauccaaggaggaagagauggagaccg

SEQ ID NO: 52351 - RNA, 32 nt, Human
agccuucaagugggcggagcugagggcagcag

SEQ ID NO: 52352 - RNA, 22 nt, Human
agccuucaauuccugggcucag

SEQ ID NO: 52353 - RNA, 32 nt, Human
agccuucaccaauggguaccacugagcagggg

SEQ ID NO: 52354 - RNA, 32 nt, Human
agccuucacccuggcuggaagcucuuuucugc

SEQ ID NO: 52355 - RNA, 23 nt, Human
agccuucaccuucccccacccca

SEQ ID NO: 52356 - RNA, 32 nt, Human
agccuucacucugcccagaugugcuuccugug

SEQ ID NO: 52357 - RNA, 32 nt, Human
agccuucacuuccagcugcucuccccaacggc

SEQ ID NO: 52358 - RNA, 32 nt, Human
agccuucagcagcagcucacacccuaccuucc

SEQ ID NO: 52359 - RNA, 32 nt, Human
agccuucagccaaaccucauugcuuuauaaac

SEQ ID NO: 52360 - RNA, 32 nt, Human
agccuucagcuccuuccuuucuccuuaaagag

SEQ ID NO: 52361 - RNA, 32 nt, Human
agccuucagggugggaggcacaagaucauucc

SEQ ID NO: 52362 - RNA, 32 nt, Human
agccuucaguuggaggaacacagccagcuccu

SEQ ID NO: 52363 - RNA, 32 nt, Human
agccuucaguuuccucccuuggaauaaucacu

SEQ ID NO: 52364 - RNA, 32 nt, Human
agccuucauccagccgcagcccuuuagaguuc

SEQ ID NO: 52365 - RNA, 32 nt, Human
agccuucaugccacgaacaugcuccacagccu

SEQ ID NO: 52366 - RNA, 32 nt, Human
agccuucauuucuucuaguucccuucaauauc

SEQ ID NO: 52367 - RNA, 32 nt, Human
agccuuccaaaauguugggauuacaggcguga

SEQ ID NO: 52368 - RNA, 32 nt, Human
agccuuccaaagugcuaggauuacaggcguga

SEQ ID NO: 52369 - RNA, 32 nt, Human
agccuuccaaagugcugggaugacagcgugag

SEQ ID NO: 52370 - RNA, 32 nt, Human
agccuuccaaagugcugggauuacaggcauga

SEQ ID NO: 52371 - RNA, 32 nt, Human
agccuuccaaagugcugggauuacaggcguga

SEQ ID NO: 52372 - RNA, 32 nt, Human
agccuuccaaagugcugggauuacagguguca

SEQ ID NO: 52373 - RNA, 32 nt, Human
agccuuccaaagugcugggauuacuggcagga

SEQ ID NO: 52374 - RNA, 32 nt, Human
agccuuccaaagugcugggauucuggguguga

SEQ ID NO: 52375 - RNA, 32 nt, Human
agccuuccaaagugcugguauuacagguguga

SEQ ID NO: 52376 - RNA, 32 nt, Human
agccuuccaaaguguugggauuauaggcguga

SEQ ID NO: 52377 - RNA, 32 nt, Human
agccuuccaacauuucuuguugauagugaugu

SEQ ID NO: 52378 - RNA, 32 nt, Human
agccuuccaacuagcugggacuacaggugcgc

SEQ ID NO: 52379 - RNA, 32 nt, Human
agccuuccaagaagcugggauuacaagcgccc

SEQ ID NO: 52380 - RNA, 32 nt, Human
agccuuccaaguagcuaggacaacaggugcgu

SEQ ID NO: 52381 - RNA, 32 nt, Human
agccuuccaaguagcugggacuacaggcaugc

SEQ ID NO: 52382 - RNA, 32 nt, Human
agccuuccaaguagcugggacuacaggugccc

SEQ ID NO: 52383 - RNA, 32 nt, Human
agccuuccaaguagcugggacuacaggugugc

SEQ ID NO: 52384 - RNA, 32 nt, Human
agccuuccaaguagcugggaguacaagcauau

SEQ ID NO: 52385 - RNA, 32 nt, Human
agccuuccaaguagcugggauuacaagugccc

SEQ ID NO: 52386 - RNA, 32 nt, Human
agccuuccaaguagcugggauuacaggaguua

SEQ ID NO: 52387 - RNA, 32 nt, Human
agccuuccaaguagcugggauuacaggugugc

SEQ ID NO: 52388 - RNA, 32 nt, Human
agccuuccaaguagcugggucuacaggugcau

SEQ ID NO: 52389 - RNA, 32 nt, Human
agccuuccaaguaguugggacuacccacaugc

SEQ ID NO: 52390 - RNA, 32 nt, Human
agccuuccagcuccuccuccugacugaccgcu

SEQ ID NO: 52391 - RNA, 28 nt, Human
agccuuccaugccccgacccccacccca

SEQ ID NO: 52392 - RNA, 32 nt, Human
agccuuccaugguagagauuucucuuaagagu

SEQ ID NO: 52393 - RNA, 32 nt, Human
agccuucccaagugcugggauuacagguguga

SEQ ID NO: 52394 - RNA, 32 nt, Human
agccuucccaguagcugggacuacagcuggau

SEQ ID NO: 52395 - RNA, 32 nt, Human
agccuucccauuagcugggauuacaggcaugc

SEQ ID NO: 52396 - RNA, 32 nt, Human
agccuucccccgugaucccuguggaccccgau

SEQ ID NO: 52397 - RNA, 32 nt, Human
agccuuccccuugagcuccuuuucacuccuga

SEQ ID NO: 52398 - RNA, 32 nt, Human
agccuucccgccacaccaaccaaccaauagac

SEQ ID NO: 52399 - RNA, 22 nt, Human
agccuucccuaauuccacccca

SEQ ID NO: 52400 - RNA, 24 nt, Human
agccuucccugcagccccucccca

SEQ ID NO: 52401 - RNA, 32 nt, Human
agccuucccugccgucaagguggcgucuuacu

SEQ ID NO: 52402 - RNA, 32 nt, Human
agccuucccuguucuccagccuaggugguuca

SEQ ID NO: 52403 - RNA, 32 nt, Human
agccuucccuugcccaugugaaaagauccgcu

SEQ ID NO: 52404 - RNA, 32 nt, Human
agccuuccgagcagcugggacuacaggagccu

SEQ ID NO: 52405 - RNA, 32 nt, Human
agccuuccgaguagcugggaccacaggcaugc

SEQ ID NO: 52406 - RNA, 32 nt, Human
agccuuccgaguagcugggacuacaggcgcau

SEQ ID NO: 52407 - RNA, 32 nt, Human
agccuuccgaguagcugggacuacagugcuuc

SEQ ID NO: 52408 - RNA, 32 nt, Human
agccuuccgaguagcugggaucgcaggcgccu

SEQ ID NO: 52409 - RNA, 32 nt, Human
agccuuccgaguagcugggauuacaggcaccc

SEQ ID NO: 52410 - RNA, 32 nt, Human
agccuuccgaguagcugggauuacaggcaccu

SEQ ID NO: 52411 - RNA, 32 nt, Human
agccuuccgaguagcugggauuacaggcgccc

SEQ ID NO: 52412 - RNA, 32 nt, Human
agccuuccgaguagcugggauuacaggcuccu

SEQ ID NO: 52413 - RNA, 32 nt, Human
agccuuccgaguagcugggauuacagggaugu

SEQ ID NO: 52414 - RNA, 32 nt, Human
agccuuccgaguagcugggauuacaggugccc

SEQ ID NO: 52415 - RNA, 32 nt, Human
agccuuccgaguagcugggauuacaggugugu

SEQ ID NO: 52416 - RNA, 32 nt, Human
agccuuccgcaggccagcaggcaggucagcuu

SEQ ID NO: 52417 - RNA, 32 nt, Human
agccuuccgggggcucuuuaccaggaaccgcu

SEQ ID NO: 52418 - RNA, 32 nt, Human
agccuuccuaguagcugggacuacagguaugc

SEQ ID NO: 52419 - RNA, 32 nt, Human
agccuuccugcuaggccacccuccucccuucc

SEQ ID NO: 52420 - RNA, 32 nt, Human
agccuuccuggugaguuucuacagucaucccu

SEQ ID NO: 52421 - RNA, 32 nt, Human
agccuuccuguguucccagcaguuucucucuc

SEQ ID NO: 52422 - RNA, 24 nt, Human
agccuuccuucugcucccacccca

SEQ ID NO: 52423 - RNA, 32 nt, Human
agccuuccuuucuccugccccaagggcccaga

SEQ ID NO: 52424 - RNA, 32 nt, Human
agccuucgaacucugacuggucgauccucuuu

SEQ ID NO: 52425 - RNA, 32 nt, Human
agccuucgccuccuggguucaaguguuuccgg

SEQ ID NO: 52426 - RNA, 32 nt, Human
agccuucggaguggcugggauuacaggugugc

SEQ ID NO: 52427 - RNA, 32 nt, Human
agccuucuaaagugcugggauuacaggcguga

SEQ ID NO: 52428 - RNA, 22 nt, Human
agccuucuacaguuugauagcu

SEQ ID NO: 52429 - RNA, 32 nt, Human
agccuucucauagcucaagcuuucccuucuug

SEQ ID NO: 52430 - RNA, 32 nt, Human
agccuucuccacugucucauuuccuuuuccca

SEQ ID NO: 52431 - RNA, 32 nt, Human
agccuucuccaggacaaccugcuggaacgcag

SEQ ID NO: 52432 - RNA, 32 nt, Human
agccuucuccucgacucucucuuccauugaua

SEQ ID NO: 52433 - RNA, 32 nt, Human
agccuucucugccugucccuccgauccuuguc

SEQ ID NO: 52434 - RNA, 32 nt, Human
agccuucugagcagcugggauuaugaaggggu

SEQ ID NO: 52435 - RNA, 32 nt, Human
agccuucugaguagcuggaauuacaggcuguc

SEQ ID NO: 52436 - RNA, 32 nt, Human
agccuucugaguagcugggaccacaggcgugc

SEQ ID NO: 52437 - RNA, 32 nt, Human
agccuucugaguagcugggacuacaggcacac

SEQ ID NO: 52438 - RNA, 32 nt, Human
agccuucugaguagcugggacuacaggcacau

SEQ ID NO: 52439 - RNA, 32 nt, Human
agccuucugaguagcugggacuacaggugugc

SEQ ID NO: 52440 - RNA, 32 nt, Human
agccuucugaguagcugggacuacaguugguu

SEQ ID NO: 52441 - RNA, 32 nt, Human
agccuucugaguagcugggaguacaggcgccc

SEQ ID NO: 52442 - RNA, 32 nt, Human
agccuucugaguagcugggauuacacgcgugu

SEQ ID NO: 52443 - RNA, 32 nt, Human
agccuucugaguagcugggauuacaggcaagc

SEQ ID NO: 52444 - RNA, 32 nt, Human
agccuucugaguagcugggauuacaggcaugc

SEQ ID NO: 52445 - RNA, 32 nt, Human
agccuucugaguaguuuggacuacagguacau

SEQ ID NO: 52446 - RNA, 23 nt, Human
agccuucugaugaucccacucca

SEQ ID NO: 52447 - RNA, 32 nt, Human
agccuucugcacucacagccgaagggaaagca

SEQ ID NO: 52448 - RNA, 32 nt, Human
agccuucugcaugccuguccucccucugcaag

SEQ ID NO: 52449 - RNA, 32 nt, Human
agccuucugcguaaagauggacuugcaggagg

SEQ ID NO: 52450 - RNA, 32 nt, Human
agccuucugcuccccaauucucucuguugcag

SEQ ID NO: 52451 - RNA, 32 nt, Human
agccuucuggaagguaggcuuugcgcuuggug

SEQ ID NO: 52452 - RNA, 21 nt, Human
agccuucuucacccacuucca

SEQ ID NO: 52453 - RNA, 32 nt, Human
agccuucuucagcucagcccucuucuauuucu

SEQ ID NO: 52454 - RNA, 18 nt, Human
agccuucuucccaacuca

SEQ ID NO: 52455 - RNA, 32 nt, Human
agccuucuucccucacggcucuucucccgguc

SEQ ID NO: 52456 - RNA, 32 nt, Human
agccuucuugauggcaccuugaaagugaacuu

SEQ ID NO: 52457 - RNA, 32 nt, Human
agccuucuugcuuucauuuuccuugaauguac

SEQ ID NO: 52458 - RNA, 32 nt, Human
agccuucuuuccccaucaguccaaaugucccu

SEQ ID NO: 52459 - RNA, 32 nt, Human
agccuugaaccaggaauauccaggaagaggaa

SEQ ID NO: 52460 - RNA, 21 nt, Human
agccuugaacucugggcucaa

SEQ ID NO: 52461 - RNA, 32 nt, Human
agccuugaagccagggugccgggaggaaggga

SEQ ID NO: 52462 - RNA, 32 nt, Human
agccuugacaaaacguuccuggaacucaagcu

SEQ ID NO: 52463 - RNA, 21 nt, Human
agccuugacaacauggugaaa

SEQ ID NO: 52464 - RNA, 32 nt, Human
agccuugaccauucuccaccuuccagggacag

SEQ ID NO: 52465 - RNA, 22 nt, Human
agccuugaccuccugggcucaa

SEQ ID NO: 52466 - RNA, 22 nt, Human
agccuugaccuucuaggcucaa

SEQ ID NO: 52467 - RNA, 32 nt, Human
agccuugacucugccagacucuccucugaacu

SEQ ID NO: 52468 - RNA, 22 nt, Human
agccuugacuuccugggcucaa

SEQ ID NO: 52469 - RNA, 32 nt, Human
agccuugagacugugcuauacacacacagcug

SEQ ID NO: 52470 - RNA, 32 nt, Human
agccuugagccucugagggucaguaagugaag

SEQ ID NO: 52471 - RNA, 32 nt, Human
agccuugagcuucagcccauuucucuccauuu

SEQ ID NO: 52472 - RNA, 32 nt, Human
agccuugaggccaggagggcagugagcuguga

SEQ ID NO: 52473 - RNA, 32 nt, Human
agccuugauguuaaaagacacagccaugcucu

SEQ ID NO: 52474 - RNA, 32 nt, Human
agccuugauuauaccacugcacuccagccugg

SEQ ID NO: 52475 - RNA, 32 nt, Human
agccuugcaaauagccagugcuaguucugacc

SEQ ID NO: 52476 - RNA, 32 nt, Human
agccuugcacagaaaagccugcuuguugguuu

SEQ ID NO: 52477 - RNA, 32 nt, Human
agccuugcagggccacugggaguuugugccca

SEQ ID NO: 52478 - RNA, 32 nt, Human
agccuugcaucaaccucuugggccucagccaa

SEQ ID NO: 52479 - RNA, 32 nt, Human
agccuugcaugucaguaaacaggaaggaagga

SEQ ID NO: 52480 - RNA, 21 nt, Human
agccuugccaacauagugaaa

SEQ ID NO: 52481 - RNA, 21 nt, Human
agccuugccaacauggugaaa

SEQ ID NO: 52482 - RNA, 32 nt, Human
agccuugccccaggacccuugggugcaugagu

SEQ ID NO: 52483 - RNA, 32 nt, Human
agccuugcuguugggugaauaguuugacucua

SEQ ID NO: 52484 - RNA, 32 nt, Human
agccuugcuuuccucuuuuuagaauuuauuuu

SEQ ID NO: 52485 - RNA, 32 nt, Human
agccuuggaaagaaaccagggggccaggggaa

SEQ ID NO: 52486 - RNA, 32 nt, Human
agccuuggaggcggagguugcagugagcugag

SEQ ID NO: 52487 - RNA, 32 nt, Human
agccuuggauacuccaugggguggggguggaa

SEQ ID NO: 52488 - RNA, 21 nt, Human
agccuuggcaacauggugaaa

SEQ ID NO: 52489 - RNA, 23 nt, Human
agccuuggcaccucccaagacug

SEQ ID NO: 52490 - RNA, 22 nt, Human
agccuuggccaacauggcgaaa

SEQ ID NO: 52491 - RNA, 32 nt, Human
agccuuggccaacauggcgaaaccccaucgcu

SEQ ID NO: 52492 - RNA, 32 nt, Human
agccuuggccuccagcagcccuucccugccca

SEQ ID NO: 52493 - RNA, 23 nt, Human
agccuuggcuucccugggcucaa

SEQ ID NO: 52494 - RNA, 32 nt, Human
agccuugggcuccagcccucugccuuuucauc

SEQ ID NO: 52495 - RNA, 32 nt, Human
agccuugggcugggcagcugcuggccuggauc

SEQ ID NO: 52496 - RNA, 32 nt, Human
agccuugggggugugauguggggaagagcuau

SEQ ID NO: 52497 - RNA, 32 nt, Human
agccuugggguccuguuaaaccacagacaguu

SEQ ID NO: 52498 - RNA, 32 nt, Human
agccuugggugaggucgccucccaggaagucc

SEQ ID NO: 52499 - RNA, 32 nt, Human
agccuugguaacccagacaugccuucagucag

SEQ ID NO: 52500 - RNA, 32 nt, Human
agccuuggugccugugagcucaucucccagga

SEQ ID NO: 52501 - RNA, 16 nt, Human
agccuugguuuaacug

SEQ ID NO: 52502 - RNA, 18 nt, Human
agccuugguuuccugaac

SEQ ID NO: 52503 - RNA, 32 nt, Human
agccuuguacagucugcuccucuuguuccuga

SEQ ID NO: 52504 - RNA, 32 nt, Human
agccuuguccuuccugugugcucccugagagc

SEQ ID NO: 52505 - RNA, 32 nt, Human
agccuugucuuccucuuuccucugucaguuca

SEQ ID NO: 52506 - RNA, 32 nt, Human
agccuugugagguuuccaggcaggcugauugc

SEQ ID NO: 52507 - RNA, 22 nt, Human
agccuugugcagaggcccagug

SEQ ID NO: 52508 - RNA, 24 nt, Human
agccuuguggccaguuccucuuca

SEQ ID NO: 52509 - RNA, 32 nt, Human
agccuugugugugaucuuuucugucuucccca

SEQ ID NO: 52510 - RNA, 32 nt, Human
agccuuguucugcccuuccacuuuccacuuua

SEQ ID NO: 52511 - RNA, 22 nt, Human
agccuuuaacuacugggcucaa

SEQ ID NO: 52512 - RNA, 32 nt, Human
agccuuuagugccagcagggccuguguccugg

SEQ ID NO: 52513 - RNA, 32 nt, Human
agccuuucaagcagcuaggaguacaguuggga

SEQ ID NO: 52514 - RNA, 32 nt, Human
agccuuucaaguggcugggaugacuacaggca

SEQ ID NO: 52515 - RNA, 32 nt, Human
agccuuucagcccuucugaguccccggcccuu

SEQ ID NO: 52516 - RNA, 21 nt, Human
agccuuucaucuucuuucuca

SEQ ID NO: 52517 - RNA, 32 nt, Human
agccuuucccacccccuucccugcugagcacg

SEQ ID NO: 52518 - RNA, 32 nt, Human
agccuuuccccuccccuccacuucuuggguaa

SEQ ID NO: 52519 - RNA, 32 nt, Human
agccuuuccgcagccgcauccacccaccaugg

SEQ ID NO: 52520 - RNA, 32 nt, Human
agccuuucgaguagcuggaaugacuacaggca

SEQ ID NO: 52521 - RNA, 32 nt, Human
agccuuucgaguagcugggacuacaggugugu

SEQ ID NO: 52522 - RNA, 32 nt, Human
agccuuucguucugcugaccaaauggccaguu

SEQ ID NO: 52523 - RNA, 17 nt, Human
agccuuucuccaccagg

SEQ ID NO: 52524 - RNA, 32 nt, Human
agccuuucuccaccaggccccucaucugaaua

SEQ ID NO: 52525 - RNA, 32 nt, Human
agccuuucuccaggugggagugcaguggcaug

SEQ ID NO: 52526 - RNA, 32 nt, Human
agccuuucuccucuucucuucuugggacagga

SEQ ID NO: 52527 - RNA, 18 nt, Human
agccuuucucugccauca

SEQ ID NO: 52528 - RNA, 32 nt, Human
agccuuucuggcagguccuccccucucuuguc

SEQ ID NO: 52529 - RNA, 32 nt, Human
agccuuucugugguaucugaugcaggaaggac

SEQ ID NO: 52530 - RNA, 32 nt, Human
agccuuugagaaaaucucguggucacgaauuu

SEQ ID NO: 52531 - RNA, 21 nt, Human
agccuuugauuuccuggacug

SEQ ID NO: 52532 - RNA, 19 nt, Human
agccuuugcaacuggacug

SEQ ID NO: 52533 - RNA, 32 nt, Human
agccuuugcacaggcuggcugcguguucuuga

SEQ ID NO: 52534 - RNA, 32 nt, Human
agccuuugcaggagccucccugggcuuagcug

SEQ ID NO: 52535 - RNA, 32 nt, Human
agccuuuggaacgugagccacugugggcuggc

SEQ ID NO: 52536 - RNA, 32 nt, Human
agccuuuggauuccggacugggauggaaagag

SEQ ID NO: 52537 - RNA, 32 nt, Human
agccuuuggggguugggguuucugccacuucc

SEQ ID NO: 52538 - RNA, 32 nt, Human
agccuuuguucuggaaaccccagagagggcug

SEQ ID NO: 52539 - RNA, 32 nt, Human
agccuuuguuguccucccauccauccauuaag

SEQ ID NO: 52540 - RNA, 20 nt, Human
agccuuuguuucuugaacug

SEQ ID NO: 52541 - RNA, 32 nt, Human
agccuuuuaaaacuggagguaggauaauugcg

SEQ ID NO: 52542 - RNA, 32 nt, Human
agccuuuuacccucuugccuccugccuccgcg

SEQ ID NO: 52543 - RNA, 32 nt, Human
agccuuuuccaauauuuaguauuguagucuuc

SEQ ID NO: 52544 - RNA, 23 nt, Human
agccuuuugaccaccuggugcca

SEQ ID NO: 52545 - RNA, 32 nt, Human
agccuuuugcuuucagcaccucuacagaccuu

SEQ ID NO: 52546 - RNA, 32 nt, Human
agccuuuugucacccaggcuggagugccaugg

SEQ ID NO: 52547 - RNA, 32 nt, Human
agccuuuuucauuaaggauacaaccuauuugu

SEQ ID NO: 52548 - RNA, 32 nt, Human
agccuuuuugaaggggacacagucuaggaggg

SEQ ID NO: 52549 - RNA, 20 nt, Human
agccuuuuugccuugaacug

SEQ ID NO: 52550 - RNA, 32 nt, Human
agcgaaaauugcacuaaaugaaucucguucca

SEQ ID NO: 52551 - RNA, 32 nt, Human
agcgaaacacacaaaccagccucaacuuacac

SEQ ID NO: 52552 - RNA, 32 nt, Human
agcgaaaccagcuucaucucccagagaauggg

SEQ ID NO: 52553 - RNA, 32 nt, Human
agcgaaacuuccucacaccucuuggucuuggu

SEQ ID NO: 52554 - RNA, 32 nt, Human
agcgaaacuucuguggaaguuccaguguucuc

SEQ ID NO: 52555 - RNA, 32 nt, Human
agcgaaagaaaagagaagugacagaaacaacu

SEQ ID NO: 52556 - RNA, 32 nt, Human
agcgaaaggauuagcaguguguggaaagaaca

SEQ ID NO: 52557 - RNA, 32 nt, Human
agcgaacaggaggcaagggcuagauugcagcu

SEQ ID NO: 52558 - RNA, 32 nt, Human
agcgaacaugcugugugggcucagccgggaga

SEQ ID NO: 52559 - RNA, 32 nt, Human
agcgaacugaugugccacccagucacagagug

SEQ ID NO: 52560 - RNA, 32 nt, Human
agcgaacugucagccucagccucccagugugc

SEQ ID NO: 52561 - RNA, 32 nt, Human
agcgaagaaauggcaucaaucuaggcaucuuu

SEQ ID NO: 52562 - RNA, 32 nt, Human
agcgaagacagggcacagccugggcagauggg

SEQ ID NO: 52563 - RNA, 18 nt, Human
agcgaagagcggccuccu

SEQ ID NO: 52564 - RNA, 32 nt, Human
agcgaagcaaaaccacccggcccacaagagac

SEQ ID NO: 52565 - RNA, 32 nt, Human
agcgaagcacgaggccgccaggagcaaaccca

SEQ ID NO: 52566 - RNA, 32 nt, Human
agcgaagcuacaccgcacuuccgacagcacac

SEQ ID NO: 52567 - RNA, 32 nt, Human
agcgaagcuguggccuuggugaagcugcccuc

SEQ ID NO: 52568 - RNA, 32 nt, Human
agcgaagggaaugccugaugaaaacaacauuc

SEQ ID NO: 52569 - RNA, 32 nt, Human
agcgaaguaaagggaguaggggagacugagac

SEQ ID NO: 52570 - RNA, 32 nt, Human
agcgaagugugguggcuuccaaggaauacaaa

SEQ ID NO: 52571 - RNA, 32 nt, Human
agcgaauagagagagaaucagcuauugaaagg

SEQ ID NO: 52572 - RNA, 32 nt, Human
agcgaaugauaagggaaaaguucucagggaau

SEQ ID NO: 52573 - RNA, 32 nt, Human
agcgaauguaugaaugaaaaugcaucuauuuc

SEQ ID NO: 52574 - RNA, 32 nt, Human
agcgaauuauagcgaacugcggaaaggugagg

SEQ ID NO: 52575 - RNA, 32 nt, Human
agcgaauucauacuaugacagcagaaacaaaa

SEQ ID NO: 52576 - RNA, 32 nt, Human
agcgacaagccgcuggcagccgcggaucucac

SEQ ID NO: 52577 - RNA, 32 nt, Human
agcgacacaagugcccugggcgcgugcagccc

SEQ ID NO: 52578 - RNA, 32 nt, Human
agcgacacguagggacgggcugaaccagcuuu

SEQ ID NO: 52579 - RNA, 32 nt, Human
agcgacacuuuacucacagccuggcuugaguc

SEQ ID NO: 52580 - RNA, 32 nt, Human
agcgacagagccaaaaucagagcuggaaccug

SEQ ID NO: 52581 - RNA, 32 nt, Human
agcgacagccacuuuuuacucucccuccugac

SEQ ID NO: 52582 - RNA, 32 nt, Human
agcgacagcugcagacgggcugaaccagcuuu

SEQ ID NO: 52583 - RNA, 32 nt, Human
agcgacaggguuguaccauguuggccauccug

SEQ ID NO: 52584 - RNA, 32 nt, Human
agcgacaggugaggacagacgucuggaagccc

SEQ ID NO: 52585 - RNA, 32 nt, Human
agcgacaugugcagaacggccccuuggcugca

SEQ ID NO: 52586 - RNA, 32 nt, Human
agcgaccagucggaggaugaggugacgccguc

SEQ ID NO: 52587 - RNA, 32 nt, Human
agcgacccaaagugcugggauuacagguguga

SEQ ID NO: 52588 - RNA, 32 nt, Human
agcgacccacacagcugggauggagggcucca

SEQ ID NO: 52589 - RNA, 32 nt, Human
agcgaccccugccuggccguggcuagcauggc

SEQ ID NO: 52590 - RNA, 32 nt, Human
agcgacccugcagcugcucgcucugauguacc

SEQ ID NO: 52591 - RNA, 32 nt, Human
agcgaccuccagggccuccuaccugcugagga

SEQ ID NO: 52592 - RNA, 32 nt, Human
agcgaccugccccgcggcaagcgcggccgcgg

SEQ ID NO: 52593 - RNA, 28 nt, Human
agcgacucaccaguugccucaucuuucc

SEQ ID NO: 52594 - RNA, 32 nt, Human
agcgacuccgaagaucagccccaaugaacaug

SEQ ID NO: 52595 - RNA, 32 nt, Human
agcgacuccgauccucccucugagccuugcuc

SEQ ID NO: 52596 - RNA, 32 nt, Human
agcgacuccuuggacagaggccugggcccuca

SEQ ID NO: 52597 - RNA, 32 nt, Human
agcgacugaaucuggcggagaugcucagccuc

SEQ ID NO: 52598 - RNA, 32 nt, Human
agcgacugauguuaguuguuacccagaucccc

SEQ ID NO: 52599 - RNA, 32 nt, Human
agcgacuggggcuugcuggacccgcuccccug

SEQ ID NO: 52600 - RNA, 32 nt, Human
agcgacugucuccgaaccuucuggaccugccc

SEQ ID NO: 52601 - RNA, 32 nt, Human
agcgacuuccaauauucauguuucugagaauu

SEQ ID NO: 52602 - RNA, 32 nt, Human
agcgacuuuuaugacauccaccaggagaucgg

SEQ ID NO: 52603 - RNA, 32 nt, Human
agcgagaagcccggagguugcgcuggcuuggc

SEQ ID NO: 52604 - RNA, 32 nt, Human
agcgagacaagaagaauggagaagggggcagc

SEQ ID NO: 52605 - RNA, 32 nt, Human
agcgagaccaaaacagguggaauccgggcugg

SEQ ID NO: 52606 - RNA, 32 nt, Human
agcgagacugucucaaaacaaaacaaaacaaa

SEQ ID NO: 52607 - RNA, 32 nt, Human
agcgagagaggaggggagagacccuggccagg

SEQ ID NO: 52608 - RNA, 19 nt, Human
agcgagagcgagugccuga

SEQ ID NO: 52609 - RNA, 32 nt, Human
agcgagaggcagcaagguggccacagugucac

SEQ ID NO: 52610 - RNA, 32 nt, Human
agcgagaguggggcgggcugagcccggauccg

SEQ ID NO: 52611 - RNA, 32 nt, Human
agcgagaucacccugcucugcccagcccccag

SEQ ID NO: 52612 - RNA, 32 nt, Human
agcgagaucgguucgcagcccagcuccgugag

SEQ ID NO: 52613 - RNA, 20 nt, Human
agcgagaugccagccuuccu

SEQ ID NO: 52614 - RNA, 32 nt, Human
agcgagaugggaagagaaaacuggccagaggc

SEQ ID NO: 52615 - RNA, 31 nt, Human
agcgagauggguaacaucacaguagauucgu

SEQ ID NO: 52616 - RNA, 32 nt, Human
agcgagauuccacccccgccaccuguagaggu

SEQ ID NO: 52617 - RNA, 32 nt, Human
agcgagcacagcuguucuccgacauggcuacg

SEQ ID NO: 52618 - RNA, 21 nt, Human
agcgagcagcgccgcgggaga

SEQ ID NO: 52619 - RNA, 21 nt, Human
agcgagcagcggccgagcgga

SEQ ID NO: 52620 - RNA, 32 nt, Human
agcgagcagggcuccccgccuuaacuuccucc

SEQ ID NO: 52621 - RNA, 32 nt, Human
agcgagcagguguguguggguccuccaccacu

SEQ ID NO: 52622 - RNA, 32 nt, Human
agcgagcaugaccauaugccauucucgucucc

SEQ ID NO: 52623 - RNA, 32 nt, Human
agcgagcaugucguggacacacacagacuauu

SEQ ID NO: 52624 - RNA, 32 nt, Human
agcgagccaggccgccuggacgcccagcccuu

SEQ ID NO: 52625 - RNA, 19 nt, Human
agcgagccaucacuggaca

SEQ ID NO: 52626 - RNA, 32 nt, Human
agcgagcccagagggauuuugccgcugcuucc

SEQ ID NO: 52627 - RNA, 32 nt, Human
agcgagccccugacucugggccugcguccugc

SEQ ID NO: 52628 - RNA, 22 nt, Human
agcgagccgccgccgggcagcg

SEQ ID NO: 52629 - RNA, 32 nt, Human
agcgagccuagccuccccgcgcccugggcagu

SEQ ID NO: 52630 - RNA, 32 nt, Human
agcgagccucucucccugaucuuacgugcuca

SEQ ID NO: 52631 - RNA, 32 nt, Human
agcgagccuuucagcuauucagugccagcggu

SEQ ID NO: 52632 - RNA, 32 nt, Human
agcgagccuuuucccugguguugcagcuguug

SEQ ID NO: 52633 - RNA, 32 nt, Human
agcgagcgccagcuccggccagccugggacag

SEQ ID NO: 52634 - RNA, 32 nt, Human
agcgagcgcccagcuccugacacugcuggaga

SEQ ID NO: 52635 - RNA, 32 nt, Human
agcgagcggaaggcuucccgacugcauuuugc

SEQ ID NO: 52636 - RNA, 32 nt, Human
agcgagcuuaaggaguggggugcagcgucugg

SEQ ID NO: 52637 - RNA, 32 nt, Human
agcgagcuuugcugggagaggggguagcuagc

SEQ ID NO: 52638 - RNA, 32 nt, Human
agcgaggagagcccuggcugaggcaucaggaa

SEQ ID NO: 52639 - RNA, 32 nt, Human
agcgaggagccgcggcggcguggagccggcgg

SEQ ID NO: 52640 - RNA, 32 nt, Human
agcgaggagcggcggcagaggaaaggccaggc

SEQ ID NO: 52641 - RNA, 32 nt, Human
agcgaggagcgggcagaggcagcuccggcggc

SEQ ID NO: 52642 - RNA, 32 nt, Human
agcgaggaggggcggagcccugcuuccggaau

SEQ ID NO: 52643 - RNA, 32 nt, Human
agcugcugacaggggaccuggccauucucagg

SEQ ID NO: 52644 - RNA, 32 nt, Human
agcugcugaccuggccccuuucugcggcugcg

SEQ ID NO: 52645 - RNA, 32 nt, Human
agcugcugagccaccaacucccaaagccagcc

SEQ ID NO: 52646 - RNA, 24 nt, Human
agcugcugagcucccucaaccugc

SEQ ID NO: 52647 - RNA, 23 nt, Human
agcugcugcaaaagcugaugaag

SEQ ID NO: 52648 - RNA, 32 nt, Human
agcugcugcaaccuccaccucccggguucaag

SEQ ID NO: 52649 - RNA, 32 nt, Human
agcugcugcaagacagcaaugacaguccaccu

SEQ ID NO: 52650 - RNA, 32 nt, Human
agcugcugcaggggacccucaggcuggauggu

SEQ ID NO: 52651 - RNA, 32 nt, Human
agcugcugccacuccagcaagggaaauaaugc

SEQ ID NO: 52652 - RNA, 32 nt, Human
agcugcugcccagccaugagagauguaaaguc

SEQ ID NO: 52653 - RNA, 31 nt, Human
agcugcugccucucuccugggaccguggggu

SEQ ID NO: 52654 - RNA, 32 nt, Human
agcugcugcuaugucucucuucugucuuauuc

SEQ ID NO: 52655 - RNA, 32 nt, Human
agcugcugcuccaaggccuggccacaugcaga

SEQ ID NO: 52656 - RNA, 32 nt, Human
agcugcugcucccauguuauuuuauugggguc

SEQ ID NO: 52657 - RNA, 32 nt, Human
agcugcugcucugggaggcuaaggcucaucuc

SEQ ID NO: 52658 - RNA, 32 nt, Human
agcugcugcuuccagugggccugggcccagga

SEQ ID NO: 52659 - RNA, 32 nt, Human
agcugcugcuuuggcgggaguuggaagcuggu

SEQ ID NO: 52660 - RNA, 32 nt, Human
agcugcuggaaccucuucccuaugaauucaug

SEQ ID NO: 52661 - RNA, 32 nt, Human
agcugcuggagacagagucagagcagucaagg

SEQ ID NO: 52662 - RNA, 32 nt, Human
agcugcuggaggaggcggagaggcagagggag

SEQ ID NO: 52663 - RNA, 19 nt, Human
agcugcuggagugcagugg

SEQ ID NO: 52664 - RNA, 32 nt, Human
agcugcuggcaggugggccugccuguggagga

SEQ ID NO: 52665 - RNA, 32 nt, Human
agcugcuggccacauuuccugcuuuauuuuaa

SEQ ID NO: 52666 - RNA, 32 nt, Human
agcugcuggcuuugaagaaagagcugauggug

SEQ ID NO: 52667 - RNA, 32 nt, Human
agcugcugggcccagaggugacauuugacuuu

SEQ ID NO: 52668 - RNA, 32 nt, Human
agcugcugggccggcccugccuugcgcuagca

SEQ ID NO: 52669 - RNA, 32 nt, Human
agcugcugggcugcgagccagggguuggacuc

SEQ ID NO: 52670 - RNA, 32 nt, Human
agcugcugggcugcggcuguggggcugggggc

SEQ ID NO: 52671 - RNA, 32 nt, Human
agcugcugggcugcggggaagaggggcugcac

SEQ ID NO: 52672 - RNA, 32 nt, Human
agcugcuggucccagagagugcagcccagggc

SEQ ID NO: 52673 - RNA, 31 nt, Human
agcugcugguccucugggcuuggucauggga

SEQ ID NO: 52674 - RNA, 32 nt, Human
agcugcugguuagugggcagccccugcucauc

SEQ ID NO: 52675 - RNA, 32 nt, Human
agcugcugguucuguacugcaggccucaguga

SEQ ID NO: 52676 - RNA, 32 nt, Human
agcugcuguccaggaacuuuccagcaguaucc

SEQ ID NO: 52677 - RNA, 32 nt, Human
agcugcugucugcagagccugcucggauccug

SEQ ID NO: 52678 - RNA, 27 nt, Human
agcugcugugccucacagcgcugugag

SEQ ID NO: 52679 - RNA, 32 nt, Human
agcugcuguggaggcuggguggccacacaggc

SEQ ID NO: 52680 - RNA, 32 nt, Human
agcugcuguguccuccuccuuggugauggaca

SEQ ID NO: 52681 - RNA, 32 nt, Human
agcugcugugugaccugggagugauuuugaca

SEQ ID NO: 52682 - RNA, 32 nt, Human
agcugcuguugcucccccgccugcuguugcuc

SEQ ID NO: 52683 - RNA, 32 nt, Human
agcugcuguuuucuuccaugcaauauuguaua

SEQ ID NO: 52684 - RNA, 32 nt, Human
agcugcuucccagugcucacagauggcuggcc

SEQ ID NO: 52685 - RNA, 32 nt, Human
agcugcuucucagucaugaauguggccauggc

SEQ ID NO: 52686 - RNA, 32 nt, Human
agcugcuucucccccaugccucacugguccca

SEQ ID NO: 52687 - RNA, 21 nt, Human
agcugcuugacccccaggcac

SEQ ID NO: 52688 - RNA, 32 nt, Human
agcugcuugagagacaucaccuggagaagaag

SEQ ID NO: 52689 - RNA, 32 nt, Human
agcugcuugcccauguuucccugcccccuuca

SEQ ID NO: 52690 - RNA, 32 nt, Human
agcugcuugcuuguacuguccauccuucaggc

SEQ ID NO: 52691 - RNA, 32 nt, Human
agcugcuugggaggcugaggcagagaauugcu

SEQ ID NO: 52692 - RNA, 32 nt, Human
agcugcuugugaugaaucagagcugcucgugc

SEQ ID NO: 52693 - RNA, 32 nt, Human
agcugcuuuucaccaucucaagaagccuaaga

SEQ ID NO: 52694 - RNA, 32 nt, Human
agcugcuuuuucuaaucuccugccucucccca

SEQ ID NO: 52695 - RNA, 32 nt, Human
agcuggaaaagauacucccagcugacagggug

SEQ ID NO: 52696 - RNA, 32 nt, Human
agcuggaaagagagagaagggccucacaguga

SEQ ID NO: 52697 - RNA, 32 nt, Human
agcuggaaccacaggcaugugccaccaugccu

SEQ ID NO: 52698 - RNA, 32 nt, Human
agcuggaaccacgggggugugccaccacgccu

SEQ ID NO: 52699 - RNA, 32 nt, Human
agcuggaacccagcuuacauuuuguuauuucu

SEQ ID NO: 52700 - RNA, 32 nt, Human
agcuggaacuacagacaugcaccaccaugccu

SEQ ID NO: 52701 - RNA, 32 nt, Human
agcuggaacuacaggcacgcaccaccgcaccu

SEQ ID NO: 52702 - RNA, 32 nt, Human
agcuggaacuacaggcaugcaccaauuuuugu

SEQ ID NO: 52703 - RNA, 32 nt, Human
agcuggaacuacaggcaugcaccaccaugccu

SEQ ID NO: 52704 - RNA, 32 nt, Human
agcuggaacuacaggcaugcaucaccaugucc

SEQ ID NO: 52705 - RNA, 32 nt, Human
agcuggaacuacaggcgugugccaccaugucu

SEQ ID NO: 52706 - RNA, 32 nt, Human
agcuggaacuacaggugcccgccacuaugccc

SEQ ID NO: 52707 - RNA, 32 nt, Human
agcuggaacuacaggugugcaccaccaugccu

SEQ ID NO: 52708 - RNA, 32 nt, Human
agcuggaacuauaggggcaugccaccaugccu

SEQ ID NO: 52709 - RNA, 32 nt, Human
agcuggaacuuggguggggaggggacaugagg

SEQ ID NO: 52710 - RNA, 32 nt, Human
agcuggaagagaggcuuuggaauguucccagc

SEQ ID NO: 52711 - RNA, 32 nt, Human
agcuggaagaggaggaggaggagaggcggcgg

SEQ ID NO: 52712 - RNA, 32 nt, Human
agcuggaagauaccucucuggccccggcacau

SEQ ID NO: 52713 - RNA, 32 nt, Human
agcuggaagcacacuggcuaucugcggaagga

SEQ ID NO: 52714 - RNA, 32 nt, Human
agcuggaaggagggagguuagagccacccaug

SEQ ID NO: 52715 - RNA, 32 nt, Human
agcuggaaggcgggcaccagccucuggggagg

SEQ ID NO: 52716 - RNA, 32 nt, Human
agcuggaaggcgucguucuccuuucccagcuc

SEQ ID NO: 52717 - RNA, 31 nt, Human
agcuggaagucaaggcuccucacuuagcuuu

SEQ ID NO: 52718 - RNA, 32 nt, Human
agcuggaaucgcugcacuuuacacacucaaaa

SEQ ID NO: 52719 - RNA, 32 nt, Human
agcuggaaugugccacagaggccccaccugaa

SEQ ID NO: 52720 - RNA, 32 nt, Human
agcuggaauuacaagcaugcacugcuaugccc

SEQ ID NO: 52721 - RNA, 32 nt, Human
agcuggaauuacagacgccugccaccacgcac

SEQ ID NO: 52722 - RNA, 32 nt, Human
agcuggaauuacaggcacacaccaccacgccu

SEQ ID NO: 52723 - RNA, 32 nt, Human
agcuggaauuacaggcacauaccacugcaccc

SEQ ID NO: 52724 - RNA, 32 nt, Human
agcuggaauuacaggcacaugacacugugccc

SEQ ID NO: 52725 - RNA, 32 nt, Human
agcuggaauuacaggcacccaccaccacaccc

SEQ ID NO: 52726 - RNA, 32 nt, Human
agcuggaauuacaggcaccugccaccacaucc

SEQ ID NO: 52727 - RNA, 32 nt, Human
agcuggaauuacaggcaccugccaccacgccu

SEQ ID NO: 52728 - RNA, 32 nt, Human
agcuggaauuacaggcaccugccacuaugccc

SEQ ID NO: 52729 - RNA, 32 nt, Human
agcuggaauuacaggcaggcgccaccaggccc

SEQ ID NO: 52730 - RNA, 32 nt, Human
agcuggaauuacaggcaugcgccagcacgccc

SEQ ID NO: 52731 - RNA, 32 nt, Human
agcuggaauuacaggcaugcgccaugacgccu

SEQ ID NO: 52732 - RNA, 32 nt, Human
agcuggaauuacaggcaugugccgccaugccu

SEQ ID NO: 52733 - RNA, 32 nt, Human
agcuggaauuacaggugcccaccaccaugccu

SEQ ID NO: 52734 - RNA, 32 nt, Human
agcuggaauuacaggugccugccaccaugccc

SEQ ID NO: 52735 - RNA, 32 nt, Human
agcuggaauuauaggcacaugccaccacgacu

SEQ ID NO: 52736 - RNA, 32 nt, Human
agcuggaauuauaggcgugcaccaccacgccc

SEQ ID NO: 52737 - RNA, 32 nt, Human
agcuggacauacugcuggaguccagugcuuuc

SEQ ID NO: 52738 - RNA, 17 nt, Human
agcuggaccagaaucua

SEQ ID NO: 52739 - RNA, 32 nt, Human
agcuggaccaggagguggaggcucaggggacc

SEQ ID NO: 52740 - RNA, 32 nt, Human
agcuggaccaggugcucagacugaggcggccg

SEQ ID NO: 52741 - RNA, 32 nt, Human
agcuggaccgagagaugagcaggagcguggac

SEQ ID NO: 52742 - RNA, 32 nt, Human
agcuggaccuaguuucacaaucuguugucucc

SEQ ID NO: 52743 - RNA, 32 nt, Human
agcuggaccucagcccugggugcugggccuug

SEQ ID NO: 52744 - RNA, 32 nt, Human
agcuggaccugcagggguggucccgccacaac

SEQ ID NO: 52745 - RNA, 20 nt, Human
agcuggacgccccucccggg

SEQ ID NO: 52746 - RNA, 32 nt, Human
agcuggacgcugcagcuggaacuagcgugcca

SEQ ID NO: 52747 - RNA, 32 nt, Human
agcuggacuaaaucacuaguuaauucuacaau

SEQ ID NO: 52748 - RNA, 32 nt, Human
agcuggacugaggauggugggcaggaggccgg

SEQ ID NO: 52749 - RNA, 32 nt, Human
agcuggacuggccuuacuucugccuuuuucac

SEQ ID NO: 52750 - RNA, 26 nt, Human
agcuggacuguguggcuggggccuga

SEQ ID NO: 52751 - RNA, 32 nt, Human
agcuggagaagcuccaccugggaugggaagcu

SEQ ID NO: 52752 - RNA, 32 nt, Human
agcuggagagcaaguuucugggccuguuccca

SEQ ID NO: 52753 - RNA, 32 nt, Human
agcuggagaggaaggggugaggcgugggaucg

SEQ ID NO: 52754 - RNA, 32 nt, Human
agcuggagagggugcguuucacuguggggugu

SEQ ID NO: 52755 - RNA, 32 nt, Human
agcuggagagguagucagaaauucagucuugc

SEQ ID NO: 52756 - RNA, 32 nt, Human
agcuggagaguugaggcaggcagcaaagacug

SEQ ID NO: 52757 - RNA, 32 nt, Human
agcuggagaugaggcaggagaggaaggcaagg

SEQ ID NO: 52758 - RNA, 32 nt, Human
agcuggagaugaggcugagauccagaguuucc

SEQ ID NO: 52759 - RNA, 32 nt, Human
agcuggagcacgcucuaagagagaugccugcu

SEQ ID NO: 52760 - RNA, 32 nt, Human
agcuggagcacuacugcccugccuugggccuu

SEQ ID NO: 52761 - RNA, 21 nt, Human
agcuggagcaggguugcggug

SEQ ID NO: 52762 - RNA, 32 nt, Human
agcuggagccaaccuacgugccaggccccgug

SEQ ID NO: 52763 - RNA, 32 nt, Human
agcuggagccaggaugcgaagcagcuguaaug

SEQ ID NO: 52764 - RNA, 18 nt, Human
agcuggagccucuugagg

SEQ ID NO: 52765 - RNA, 32 nt, Human
agcuggagccuugccuagcuggugaucacaca

SEQ ID NO: 52766 - RNA, 32 nt, Human
agcuggagcgggaaacuggagcuuaaauucug

SEQ ID NO: 52767 - RNA, 17 nt, Human
agcuggagcucccggug

SEQ ID NO: 52768 - RNA, 18 nt, Human
agcuggagcucucccagg

SEQ ID NO: 52769 - RNA, 17 nt, Human
agcuggagcugggcuga

SEQ ID NO: 52770 - RNA, 32 nt, Human
agcuggaggacacaucuagcugccauugcaac

SEQ ID NO: 52771 - RNA, 32 nt, Human
agcuggaggacauugcccugcccugcgcggcc

SEQ ID NO: 52772 - RNA, 32 nt, Human
agcuggaggaccaggcaagcugaggcgggggc

SEQ ID NO: 52773 - RNA, 32 nt, Human
agcuggaggaggaggaggaggauacgccaguc

SEQ ID NO: 52774 - RNA, 32 nt, Human
agcuggaggaggaggagggcaaacccgagggc

SEQ ID NO: 52775 - RNA, 32 nt, Human
agcuggaggagggcaggggcugagggagugag

SEQ ID NO: 52776 - RNA, 32 nt, Human
agcuggaggagggggugaccagcuuggagucu

SEQ ID NO: 52777 - RNA, 32 nt, Human
agcuggaggcaggaggauggauccucaucucc

SEQ ID NO: 52778 - RNA, 32 nt, Human
agcuggaggcccgggcuggaggggcaguguug

SEQ ID NO: 52779 - RNA, 32 nt, Human
agcuggaggcggagcuuggcaacaugcagccg

SEQ ID NO: 52780 - RNA, 32 nt, Human
agcuggagggacaugagugucccugggccguc

SEQ ID NO: 52781 - RNA, 32 nt, Human
agcuggagggauagaccauggccacaccugcu

SEQ ID NO: 52782 - RNA, 32 nt, Human
agcuggagggcagaggaggcggcgcggggugu

SEQ ID NO: 52783 - RNA, 32 nt, Human
agcuggagggcagggggcuggggaaggggguc

SEQ ID NO: 52784 - RNA, 32 nt, Human
agcuggagggccacaugcacacacagccuagc

SEQ ID NO: 52785 - RNA, 32 nt, Human
agcuggagggugcugggcaggagcuggccagu

SEQ ID NO: 52786 - RNA, 32 nt, Human
agcuggaggugagcuucugaggccuuugccau

SEQ ID NO: 52787 - RNA, 32 nt, Human
agcuggagguggaaaauggugccuggagcuac

SEQ ID NO: 52788 - RNA, 31 nt, Human
agcuggagguggagagaaaucaggcugggac

SEQ ID NO: 52789 - RNA, 32 nt, Human
agcuggagugaaaauuuuguuuugaaaaggug

SEQ ID NO: 52790 - RNA, 32 nt, Human
agcuggagugaugcagggaggaaaggcagagu

SEQ ID NO: 52791 - RNA, 32 nt, Human
agcuggaguguuggucuccuaggaccaaggcc

SEQ ID NO: 52792 - RNA, 32 nt, Human
agcuggaucaacugauggcccaaccaacugga

SEQ ID NO: 52793 - RNA, 32 nt, Human
agcuggaucuacuacagggaagggaagagggu

SEQ ID NO: 52794 - RNA, 32 nt, Human
agcuggaucuguuugcaugcaggaugaagagg

SEQ ID NO: 52795 - RNA, 32 nt, Human
agcuggaucuuagagaaaaugaauauuuaaau

SEQ ID NO: 52796 - RNA, 21 nt, Human
agcuggaugccugggaaccac

SEQ ID NO: 52797 - RNA, 20 nt, Human
agcuggaugugccucccagg

SEQ ID NO: 52798 - RNA, 24 nt, Human
agcuggaugugccucccaggccug

SEQ ID NO: 52799 - RNA, 21 nt, Human
agcuggauuaucuugaaccug

SEQ ID NO: 52800 - RNA, 21 nt, Human
agcuggauuaugguggccuga

SEQ ID NO: 52801 - RNA, 32 nt, Human
agcuggauuggccagugcaccuuguauucagu

SEQ ID NO: 52802 - RNA, 32 nt, Human
agcuggauuuaaucaucccugcccuacauaua

SEQ ID NO: 52803 - RNA, 32 nt, Human
agcuggauuuacagaugcaugccaccacgccc

SEQ ID NO: 52804 - RNA, 17 nt, Human
agcuggauuuugaacug

SEQ ID NO: 52805 - RNA, 32 nt, Human
agcuggcaaccuccguugucccuucccauuug

SEQ ID NO: 52806 - RNA, 32 nt, Human
agcuggcaacuucucccccaggugccuucccc

SEQ ID NO: 52807 - RNA, 32 nt, Human
agcuggcaaucaggagaagaagcacuuuguuu

SEQ ID NO: 52808 - RNA, 32 nt, Human
agcuggcaaugccaccacacgcuucagagaaa

SEQ ID NO: 52809 - RNA, 32 nt, Human
agcuggcagaguuguguuugcaguguaguccu

SEQ ID NO: 52810 - RNA, 32 nt, Human
agcuggcagcugguuggugcuuacaccuuggc

SEQ ID NO: 52811 - RNA, 32 nt, Human
agcuggcaggacugccggucacacaccagcac

SEQ ID NO: 52812 - RNA, 32 nt, Human
agcuggcaggaggugggcugagcugcuccggg

SEQ ID NO: 52813 - RNA, 32 nt, Human
agcuggcaggcagaguggucacauuacagaug

SEQ ID NO: 52814 - RNA, 32 nt, Human
agcuggcagggcagaaagcagugucgaucaac

SEQ ID NO: 52815 - RNA, 32 nt, Human
agcuggcagugaaugugccacuguaugucaac

SEQ ID NO: 52816 - RNA, 32 nt, Human
agcuggcauccauauccacuucuccggguuug

SEQ ID NO: 52817 - RNA, 32 nt, Human
agcuggcaucugaccuuggcacucgaacugac

SEQ ID NO: 52818 - RNA, 32 nt, Human
agcuggcaugcuuggcugugugcaguggccag

SEQ ID NO: 52819 - RNA, 32 nt, Human
agcuggcauuacaggcacaugccaccacgccc

SEQ ID NO: 52820 - RNA, 32 nt, Human
agcuggcauuacaggcaugugucaccaugccc

SEQ ID NO: 52821 - RNA, 32 nt, Human
agcuggcauuacaggcgcccaccaccacgcuc

SEQ ID NO: 52822 - RNA, 32 nt, Human
agcuggcauuacaggcgccugccaccagaccu

SEQ ID NO: 52823 - RNA, 32 nt, Human
agcuggcauuauaggugcccaccaccaugccu

SEQ ID NO: 52824 - RNA, 32 nt, Human
agcuggccaagugcuugugccagcagcaugga

SEQ ID NO: 52825 - RNA, 32 nt, Human
agcuggccaauacuuccuggccuagaaaaaua

SEQ ID NO: 52826 - RNA, 32 nt, Human
agcuggccaaucagcccaggaggggcagguuc

SEQ ID NO: 52827 - RNA, 32 nt, Human
agcuggccacaccugugaggcugcagugauug

SEQ ID NO: 52828 - RNA, 22 nt, Human
agcuggccacacuucuccagga

SEQ ID NO: 52829 - RNA, 32 nt, Human
agcuggccaccaacacagaggcccugcagagc

SEQ ID NO: 52830 - RNA, 25 nt, Human
agcuggccaccggcccaacugcagc

SEQ ID NO: 52831 - RNA, 32 nt, Human
agcuggccaccuggccacccucuacacggcuc

SEQ ID NO: 52832 - RNA, 20 nt, Human
agcuggcccacugggcaggu

SEQ ID NO: 52833 - RNA, 32 nt, Human
agcuggcccagccuggagcuggcgcugugcag

SEQ ID NO: 52834 - RNA, 32 nt, Human
agcuggcccaggaaaggcugccugcagaggac

SEQ ID NO: 52835 - RNA, 32 nt, Human
agcuggccccauccuggagaccagccuuuugc

SEQ ID NO: 52836 - RNA, 32 nt, Human
agcuggcccccuucuguuuuauguuugguuuu

SEQ ID NO: 52837 - RNA, 32 nt, Human
agcuggccccuggcugccuggaggacccuggg

SEQ ID NO: 52838 - RNA, 32 nt, Human
agcuggcccuccaccaucuucacauuccaaga

SEQ ID NO: 52839 - RNA, 32 nt, Human
agcuggcccuccacuccugcuccugugcggag

SEQ ID NO: 52840 - RNA, 32 nt, Human
agcuggcccucggggaacccgcacacacagca

SEQ ID NO: 52841 - RNA, 16 nt, Human
agcuggcccugaacug

SEQ ID NO: 52842 - RNA, 32 nt, Human
agcuggcccugccucugccuggccggcgccgc

SEQ ID NO: 52843 - RNA, 18 nt, Human
agcuggcccugcggcuga

SEQ ID NO: 52844 - RNA, 32 nt, Human
agcuggcccuggcuggagauggcuagccccug

SEQ ID NO: 52845 - RNA, 32 nt, Human
agcuggcccuucccaucuccccucuccccucu

SEQ ID NO: 52846 - RNA, 32 nt, Human
agcuggccgagcugcaagcaccugaguuaccu

SEQ ID NO: 52847 - RNA, 17 nt, Human
agcuggccgcgggcugg

SEQ ID NO: 52848 - RNA, 32 nt, Human
agcuggccgugcaggacagccuggagagugac

SEQ ID NO: 52849 - RNA, 20 nt, Human
agcuggccgugucucuggga

SEQ ID NO: 52850 - RNA, 32 nt, Human
agcuggccucacuguguccugccugaauuccu

SEQ ID NO: 52851 - RNA, 32 nt, Human
agcuggccucuaaaggauggcacugaggcacc

SEQ ID NO: 52852 - RNA, 32 nt, Human
agcuggccucugcuucacuuuuguuucagcuc

SEQ ID NO: 52853 - RNA, 32 nt, Human
agcuggccugggagcagaaguuucggugagga

SEQ ID NO: 52854 - RNA, 32 nt, Human
agcuggccugggagggagaaggggcuggagag

SEQ ID NO: 52855 - RNA, 17 nt, Human
agcuggcgggcugaggc

SEQ ID NO: 52856 - RNA, 31 nt, Human
agcuggcuaaugucucccuaguagccaauua

SEQ ID NO: 52857 - RNA, 32 nt, Human
agcuggcucugacaucaaccugggagguaaca

SEQ ID NO: 52858 - RNA, 32 nt, Human
agcuggcucugagcgccuccauccaaggccag

SEQ ID NO: 52859 - RNA, 32 nt, Human
agcuggcucuucugcugaccucagauaccagc

SEQ ID NO: 52860 - RNA, 32 nt, Human
agcuggcugacagcuuucgagagugggccugc

SEQ ID NO: 52861 - RNA, 23 nt, Human
agcuggcugcaaacccagugcug

SEQ ID NO: 52862 - RNA, 32 nt, Human
agcuggcugcagccuccaccucccuggcucaa

SEQ ID NO: 52863 - RNA, 32 nt, Human
agcuggcugcagguguccugggccaaggagca

SEQ ID NO: 52864 - RNA, 32 nt, Human
agcuggcugccaugucuccugccuguaauccc

SEQ ID NO: 52865 - RNA, 32 nt, Human
agcuggcuggcucugagccaggaagccuuguu

SEQ ID NO: 52866 - RNA, 32 nt, Human
agcuggcuggcugggagccucggggaccgccc

SEQ ID NO: 52867 - RNA, 32 nt, Human
agcuggcugggaacugggagaagagcuggagc

SEQ ID NO: 52868 - RNA, 32 nt, Human
agcuggcugggagcagagguggcuuugucuuu

SEQ ID NO: 52869 - RNA, 20 nt, Human
agcuggcuggggcccaggag

SEQ ID NO: 52870 - RNA, 32 nt, Human
agcuggcugucgaaaucacagcucuucauuuu

SEQ ID NO: 52871 - RNA, 32 nt, Human
agcuggcuucugggacuguccugggcccaagu

SEQ ID NO: 52872 - RNA, 32 nt, Human
agcuggcuuuguggggcugcaaaggacuuuua

SEQ ID NO: 52873 - RNA, 32 nt, Human
agcugggaaaacaggccugugccaccacaccg

SEQ ID NO: 52874 - RNA, 32 nt, Human
agcugggaacagcuucagagucaggcucagcc

SEQ ID NO: 52875 - RNA, 32 nt, Human
agcugggaaccacugacccagacucaguuccu

SEQ ID NO: 52876 - RNA, 32 nt, Human
agcugggaaccagcaucucagcgccagcucua

SEQ ID NO: 52877 - RNA, 32 nt, Human
agcugggaagauaggcacgugccaccacaccc

SEQ ID NO: 52878 - RNA, 32 nt, Human
agcugggaaggcgucucccggaagacgaacuc

SEQ ID NO: 52879 - RNA, 32 nt, Human
agcugggaauacaagcauacaccaccaugccc

SEQ ID NO: 52880 - RNA, 32 nt, Human
agcugggaauacaagcgugugcccccacagcc

SEQ ID NO: 52881 - RNA, 32 nt, Human
agcugggaauacagcaugcgccacuacaccug

SEQ ID NO: 52882 - RNA, 32 nt, Human
agcugggaauacaggcacccgccaccaugccc

SEQ ID NO: 52883 - RNA, 32 nt, Human
agcugggaauacaggcacgccaccaugcccag

SEQ ID NO: 52884 - RNA, 32 nt, Human
agcugggaauacaggugcacgccacuaugcau

SEQ ID NO: 52885 - RNA, 32 nt, Human
agcugggaauacaggugcaggcugccacgccc

SEQ ID NO: 52886 - RNA, 32 nt, Human
agcugggaauacaggugcgcgccgccgcaccu

SEQ ID NO: 52887 - RNA, 32 nt, Human
agcugggaauacaggugucugccaccauaccc

SEQ ID NO: 52888 - RNA, 32 nt, Human
agcugggacaacagguacgcaccaccacggcc

SEQ ID NO: 52889 - RNA, 32 nt, Human
agcugggacaacaggugcccgccaccacgcuc

SEQ ID NO: 52890 - RNA, 32 nt, Human
agcugggacaacaggugugcaccaccaugccc

SEQ ID NO: 52891 - RNA, 32 nt, Human
agcugggacagguggagaaggaaguaggaaug

SEQ ID NO: 52892 - RNA, 32 nt, Human
agcugggaccaaaagugugugccaccauggcc

SEQ ID NO: 52893 - RNA, 32 nt, Human
agcugggaccacagacgucugccaccaagccc

SEQ ID NO: 52894 - RNA, 32 nt, Human
agcugggaccacaggcacgugccaccacaccc

SEQ ID NO: 52895 - RNA, 32 nt, Human
agcugggaccacaggcacgugccaccauguug

SEQ ID NO: 52896 - RNA, 32 nt, Human
agcugggaccacaggcagaugccaccacacca

SEQ ID NO: 52897 - RNA, 32 nt, Human
agcugggaccacaggcaugcacaaccacgccu

SEQ ID NO: 52898 - RNA, 32 nt, Human
agcugggaccacaggcaugcaccacuacgcau

SEQ ID NO: 52899 - RNA, 32 nt, Human
agcugggaccacaggcaugcgccaccacuccu

SEQ ID NO: 52900 - RNA, 32 nt, Human
agcugggaccacaggcgacugccaccacaccc

SEQ ID NO: 52901 - RNA, 32 nt, Human
agcugggaccacaggcgcccaccaccacgccc

SEQ ID NO: 52902 - RNA, 32 nt, Human
agcugggaccacaggcgugcaccaccaugccc

SEQ ID NO: 52903 - RNA, 32 nt, Human
agcugggaccacagggguaugccaccacaccu

SEQ ID NO: 52904 - RNA, 32 nt, Human
agcugggaccacagguaugcaccaccacgccc

SEQ ID NO: 52905 - RNA, 18 nt, Human
agcugggaccacaggugc

SEQ ID NO: 52906 - RNA, 32 nt, Human
agcugggaccacaggugcacgccaccacaccu

SEQ ID NO: 52907 - RNA, 32 nt, Human
agcugggaccacaggugcaugccaccacgccu

SEQ ID NO: 52908 - RNA, 32 nt, Human
agcugggaccacaggugcaugccaccaugccu

SEQ ID NO: 52909 - RNA, 32 nt, Human
agcugggaccacaggugcccgccaccacaccc

SEQ ID NO: 52910 - RNA, 32 nt, Human
agcugggaccacaggugcccgccaccacgccu

SEQ ID NO: 52911 - RNA, 32 nt, Human
agcugggaccacaggugccuaccaccaugcca

SEQ ID NO: 52912 - RNA, 32 nt, Human
agcugggaccacaggugugcaccaccacgccc

SEQ ID NO: 52913 - RNA, 32 nt, Human
agcugggaccacaggugugugccaccacaccu

SEQ ID NO: 52914 - RNA, 32 nt, Human
agcugggaccacagguucaugccaccauggcc

SEQ ID NO: 52915 - RNA, 32 nt, Human
agcugggaccacaguugugugccaccacacuu

SEQ ID NO: 52916 - RNA, 32 nt, Human
agcugggaccauaggcgugcaccaccauacuc

SEQ ID NO: 52917 - RNA, 32 nt, Human
agcugggaccccggggagggcgagggaggcca

SEQ ID NO: 52918 - RNA, 32 nt, Human
agcugggaccgcaggcacuugccaccacgccc

SEQ ID NO: 52919 - RNA, 32 nt, Human
agcugggaccgcgggagugugccaccacaccc

SEQ ID NO: 52920 - RNA, 32 nt, Human
agcugggaccgcgggugugugccaccacacca

SEQ ID NO: 52921 - RNA, 32 nt, Human
agcugggaccuccucugccacucccgccuccu

SEQ ID NO: 52922 - RNA, 32 nt, Human
agcugggacgacaggcgugcaccacugcgccu

SEQ ID NO: 52923 - RNA, 32 nt, Human
agcugggacuacaagcacaugccaccaugccc

SEQ ID NO: 52924 - RNA, 32 nt, Human
agcugggacuacaagcaugcaccaccacgccc

SEQ ID NO: 52925 - RNA, 32 nt, Human
agcugggacuacaagcaugcaccacuacacuc

SEQ ID NO: 52926 - RNA, 32 nt, Human
agcugggacuacaagcgcacaccaccacgccu

SEQ ID NO: 52927 - RNA, 32 nt, Human
agcugggacuacaagcgcgcaccaccacuccc

SEQ ID NO: 52928 - RNA, 32 nt, Human
agcugggacuacaagcggcugccaccacaccu

SEQ ID NO: 52929 - RNA, 32 nt, Human
agcugggacuacaagugcaugcugccacacca

SEQ ID NO: 52930 - RNA, 32 nt, Human
agcugggacuacaagugccugccaccacgccu

SEQ ID NO: 52931 - RNA, 32 nt, Human
agcugggacuacaagugugcaccaccaugccu

SEQ ID NO: 52932 - RNA, 32 nt, Human
agcugggacuacaagugugcaccaccauggcu

SEQ ID NO: 52933 - RNA, 32 nt, Human
agcugggacuacagaagugcaccaccacaccc

SEQ ID NO: 52934 - RNA, 32 nt, Human
agcugggacuacagacaugcaccaccacaccu

SEQ ID NO: 52935 - RNA, 32 nt, Human
agcugggacuacagacgugugccaccacgccu

SEQ ID NO: 52936 - RNA, 32 nt, Human
agcugggacuacagccgugcaccacuacaucc

SEQ ID NO: 52937 - RNA, 32 nt, Human
agcugggacuacaggagccugccaccacaucu

SEQ ID NO: 52938 - RNA, 32 nt, Human
agcugggacuacaggcaaccaccaccacuccu

SEQ ID NO: 52939 - RNA, 32 nt, Human
agcugggacuacaggcacacaccaccacaccu

SEQ ID NO: 52940 - RNA, 32 nt, Human
agcugggacuacaggcacacaccaccacgccc

SEQ ID NO: 52941 - RNA, 32 nt, Human
agcugggacuacaggcacacaccaccaugccc

SEQ ID NO: 52942 - RNA, 32 nt, Human
agcugggacuacaggcacacaccaucacccuc

SEQ ID NO: 52943 - RNA, 32 nt, Human
agcugggacuacaggcacacaccaucaugccc

SEQ ID NO: 52944 - RNA, 32 nt, Human
agcugggacuacaggcacacaucaccacaucc

SEQ ID NO: 52945 - RNA, 32 nt, Human
agcugggacuacaggcacacaucgccacaccc

SEQ ID NO: 52946 - RNA, 32 nt, Human
agcugggacuacaggcacacgccaccacaccc

SEQ ID NO: 52947 - RNA, 32 nt, Human
agcugggacuacaggcacacgccaccacgcgu

SEQ ID NO: 52948 - RNA, 32 nt, Human
agcugggacuacaggcacacgccaccucgccc

SEQ ID NO: 52949 - RNA, 32 nt, Human
agcugggacuacaggcacacgcugccacgccc

SEQ ID NO: 52950 - RNA, 32 nt, Human
agcugggacuacaggcacaggccaccacaccu

SEQ ID NO: 52951 - RNA, 32 nt, Human
agcugggacuacaggcacaugccaccaaacuu

SEQ ID NO: 52952 - RNA, 32 nt, Human
agcugggacuacaggcacaugccaccacgccc

SEQ ID NO: 52953 - RNA, 32 nt, Human
agcugggacuacaggcacaugccaccaugccc

SEQ ID NO: 52954 - RNA, 32 nt, Human
agcugggacuacaggcacccacaaccacaccc

SEQ ID NO: 52955 - RNA, 32 nt, Human
agcugggacuacaggcacccaccaccacaccc

SEQ ID NO: 52956 - RNA, 32 nt, Human
agcugggacuacaggcacccaccaccuccauu

SEQ ID NO: 52957 - RNA, 32 nt, Human
agcugggacuacaggcacccaccaucaugcuu

SEQ ID NO: 52958 - RNA, 32 nt, Human
agcugggacuacaggcacccaccaucaugucu

SEQ ID NO: 52959 - RNA, 32 nt, Human
agcugggacuacaggcacccaccgucacgccc

SEQ ID NO: 52960 - RNA, 32 nt, Human
agcugggacuacaggcacccacuaccacgccu

SEQ ID NO: 52961 - RNA, 32 nt, Human
agcugggacuacaggcacccgccaacacgccc

SEQ ID NO: 52962 - RNA, 32 nt, Human
agcugggacuacaggcacccgccaccacaccc

SEQ ID NO: 52963 - RNA, 32 nt, Human
agcugggacuacaggcacccgccaccacaucc

SEQ ID NO: 52964 - RNA, 32 nt, Human
agcugggacuacaggcacccgccaccacgccc

SEQ ID NO: 52965 - RNA, 32 nt, Human
agcugggacuacaggcacccgccaccacgccu

SEQ ID NO: 52966 - RNA, 32 nt, Human
agcugggacuacaggcacccgccaccaugccc

SEQ ID NO: 52967 - RNA, 32 nt, Human
agcugggacuacaggcaccugccaccacaccc

SEQ ID NO: 52968 - RNA, 32 nt, Human
agcugggacuacaggcaccugccaccaccacc

SEQ ID NO: 52969 - RNA, 32 nt, Human
agcugggacuacaggcaccugccaccaccccc

SEQ ID NO: 52970 - RNA, 32 nt, Human
agcugggacuacaggcaccugccaccacgccc

SEQ ID NO: 52971 - RNA, 32 nt, Human
agcugggacuacaggcaccugccaccacgccu

SEQ ID NO: 52972 - RNA, 32 nt, Human
agcugggacuacaggcaccugccaccaugccc

SEQ ID NO: 52973 - RNA, 32 nt, Human
agcugggacuacaggcaccugccaccaugcgc

SEQ ID NO: 52974 - RNA, 32 nt, Human
agcugggacuacaggcacgcaccaccacaccu

SEQ ID NO: 52975 - RNA, 32 nt, Human
agcugggacuacaggcacgcaccaccaugcca

SEQ ID NO: 52976 - RNA, 32 nt, Human
agcugggacuacaggcacgcgccaccacagcc

SEQ ID NO: 52977 - RNA, 32 nt, Human
agcugggacuacaggcacgcgccaccaugccc

SEQ ID NO: 52978 - RNA, 32 nt, Human
agcugggacuacaggcacgcgccacuacacuc

SEQ ID NO: 52979 - RNA, 32 nt, Human
agcugggacuacaggcacgugccaccacaccu

SEQ ID NO: 52980 - RNA, 32 nt, Human
agcugggacuacaggcacgugccaccacgccc

SEQ ID NO: 52981 - RNA, 32 nt, Human
agcugggacuacaggcacgugccaccaugccu

SEQ ID NO: 52982 - RNA, 32 nt, Human
agcugggacuacaggcacgugcuaccacgccc

SEQ ID NO: 52983 - RNA, 32 nt, Human
agcugggacuacaggcaggcgccuaccaccac

SEQ ID NO: 52984 - RNA, 32 nt, Human
agcugggacuacaggcaggugccaccaugccu

SEQ ID NO: 52985 - RNA, 32 nt, Human
agcugggacuacaggcauaugccaucacaccc

SEQ ID NO: 52986 - RNA, 32 nt, Human
agcugggacuacaggcaugaaccaccacgccu

SEQ ID NO: 52987 - RNA, 32 nt, Human
agcugggacuacaggcaugagccaccaugccu

SEQ ID NO: 52988 - RNA, 32 nt, Human
agcugggacuacaggcaugagccaccgugccc

SEQ ID NO: 52989 - RNA, 32 nt, Human
agcugggacuacaggcaugagucaccacaccu

SEQ ID NO: 52990 - RNA, 32 nt, Human
agcugggacuacaggcaugcaacaccacacca

SEQ ID NO: 52991 - RNA, 32 nt, Human
agcugggacuacaggcaugcaccaccacaccc

SEQ ID NO: 52992 - RNA, 32 nt, Human
agcugggacuacaggcaugcaccaccacaucc

SEQ ID NO: 52993 - RNA, 32 nt, Human
agcugggacuacaggcaugcaccaccacgcca

SEQ ID NO: 52994 - RNA, 32 nt, Human
agcugggacuacaggcaugcaccaccacgccc

SEQ ID NO: 52995 - RNA, 32 nt, Human
agcugggacuacaggcaugcaccaccaugccc

SEQ ID NO: 52996 - RNA, 32 nt, Human
agcugggacuacaggcaugcaccaccaugccu

SEQ ID NO: 52997 - RNA, 32 nt, Human
agcugggacuacaggcaugcaccagcacacug

SEQ ID NO: 52998 - RNA, 32 nt, Human
agcugggacuacaggcaugcacuaccaaaccu

SEQ ID NO: 52999 - RNA, 32 nt, Human
agcugggacuacaggcaugcauaaccacaucc

SEQ ID NO: 53000 - RNA, 32 nt, Human
agcugggacuacaggcaugcaucacuaugcuc

SEQ ID NO: 53001 - RNA, 32 nt, Human
agcugggacuacaggcaugcgccaccacaccc

SEQ ID NO: 53002 - RNA, 32 nt, Human
agcugggacuacaggcaugcgccaccacgcca

SEQ ID NO: 53003 - RNA, 32 nt, Human
agcugggacuacaggcaugcgccacugcgccc

SEQ ID NO: 53004 - RNA, 32 nt, Human
agcugggacuacaggcauguaacaccauacuu

SEQ ID NO: 53005 - RNA, 32 nt, Human
agcugggacuacaggcauguaccagcacaccc

SEQ ID NO: 53006 - RNA, 32 nt, Human
agcugggacuacaggcauguaccgccaugccu

SEQ ID NO: 53007 - RNA, 32 nt, Human
agcugggacuacaggcaugugccaccacaccu

SEQ ID NO: 53008 - RNA, 32 nt, Human
agcugggacuacaggcaugugccaccacgccc

SEQ ID NO: 53009 - RNA, 32 nt, Human
agcugggacuacaggcaugugccaccaugccc

SEQ ID NO: 53010 - RNA, 32 nt, Human
agcugggacuacaggcaugugccaccaugccu

SEQ ID NO: 53011 - RNA, 32 nt, Human
agcugggacuacaggcaugugccaccaugucc

SEQ ID NO: 53012 - RNA, 32 nt, Human
agcugggacuacaggcgcacaccaccacacug

SEQ ID NO: 53013 - RNA, 32 nt, Human
agcugggacuacaggcgcacaccaccacgcca

SEQ ID NO: 53014 - RNA, 32 nt, Human
agcugggacuacaggcgcaugccaccacaccc

SEQ ID NO: 53015 - RNA, 32 nt, Human
agcugggacuacaggcgcaugccaccaugccc

SEQ ID NO: 53016 - RNA, 32 nt, Human
agcugggacuacaggcgcccaccaccacacau

SEQ ID NO: 53017 - RNA, 32 nt, Human
agcugggacuacaggcgcccaccaccacaguu

SEQ ID NO: 53018 - RNA, 32 nt, Human
agcugggacuacaggcgcccaccaccacgccc

SEQ ID NO: 53019 - RNA, 32 nt, Human
agcugggacuacaggcgcccaccaccacgccu

SEQ ID NO: 53020 - RNA, 32 nt, Human
agcugggacuacaggcgcccaccaccaugccc

SEQ ID NO: 53021 - RNA, 32 nt, Human
agcugggacuacaggcgccugccaccacaccc

SEQ ID NO: 53022 - RNA, 32 nt, Human
agcugggacuacaggcgccugccaccacaucc

SEQ ID NO: 53023 - RNA, 32 nt, Human
agcugggacuacaggcgccugccaccacuccu

SEQ ID NO: 53024 - RNA, 32 nt, Human
agcugggacuacaggcgccugccaccagccug

SEQ ID NO: 53025 - RNA, 32 nt, Human
agcugggacuacaggcgccugccaccaugccc

SEQ ID NO: 53026 - RNA, 32 nt, Human
agcugggacuacaggcgcgcaccaccacgccc

SEQ ID NO: 53027 - RNA, 32 nt, Human
agcugggacuacaggcgcgugccaccacaacc

SEQ ID NO: 53028 - RNA, 32 nt, Human
agcugggacuacaggcgcgugccaccacgccc

SEQ ID NO: 53029 - RNA, 32 nt, Human
agcugggacuacaggcguccaccaccacgccc

SEQ ID NO: 53030 - RNA, 32 nt, Human
agcugggacuacaggcgugcaccaccacaccc

SEQ ID NO: 53031 - RNA, 32 nt, Human
agcugggacuacaggcgugcaccaccacgccu

SEQ ID NO: 53032 - RNA, 32 nt, Human
agcugggacuacaggcgugugccaccaagccc

SEQ ID NO: 53033 - RNA, 32 nt, Human
agcugggacuacaggcgugugccaccacaccu

SEQ ID NO: 53034 - RNA, 32 nt, Human
agcugggacuacaggcgugugccaccaugccc

SEQ ID NO: 53035 - RNA, 32 nt, Human
agcugggacuacaggcucaugccaccacaccu

SEQ ID NO: 53036 - RNA, 32 nt, Human
agcugggacuacaggcuugcaccaccacaccc

SEQ ID NO: 53037 - RNA, 32 nt, Human
agcugggacuacaggcuugugccaccacacuc

SEQ ID NO: 53038 - RNA, 32 nt, Human
agcugggacuacaggggugcaccaccaugccc

SEQ ID NO: 53039 - RNA, 32 nt, Human
agcugggacuacagguacccaccaccacgccc

SEQ ID NO: 53040 - RNA, 32 nt, Human
agcugggacuacagguaccugccaccacgccu

SEQ ID NO: 53041 - RNA, 32 nt, Human
agcugggacuacagguacgugccaccacaccc

SEQ ID NO: 53042 - RNA, 32 nt, Human
agcugggacuacagguaugcaccacagcucca

SEQ ID NO: 53043 - RNA, 32 nt, Human
agcugggacuacagguaugcaccaccaugccu

SEQ ID NO: 53044 - RNA, 32 nt, Human
agcugggacuacagguaugcaccacgaccagc

SEQ ID NO: 53045 - RNA, 32 nt, Human
agcugggacuacaggucuacaccaccacuccc

SEQ ID NO: 53046 - RNA, 32 nt, Human
agcugggacuacaggucugcaccacugcaccc

SEQ ID NO: 53047 - RNA, 32 nt, Human
agcugggacuacaggugcacaccaccacaccu

SEQ ID NO: 53048 - RNA, 32 nt, Human
agcugggacuacaggugcaccaccacaccugg

SEQ ID NO: 53049 - RNA, 32 nt, Human
agcugggacuacaggugcacgccaccacaacu

SEQ ID NO: 53050 - RNA, 32 nt, Human
agcugggacuacaggugcacgccaccacgccu

SEQ ID NO: 53051 - RNA, 32 nt, Human
agcugggacuacaggugcacgcuaccaugccc

SEQ ID NO: 53052 - RNA, 32 nt, Human
agcugggacuacaggugcacgcuaccaugccu

SEQ ID NO: 53053 - RNA, 32 nt, Human
agcugggacuacaggugcaugccaccacaccu

SEQ ID NO: 53054 - RNA, 32 nt, Human
agcugggacuacaggugcaugccaccacgcac

SEQ ID NO: 53055 - RNA, 32 nt, Human
agcugggacuacaggugcaugccaccacgccc

SEQ ID NO: 53056 - RNA, 32 nt, Human
agcugggacuacaggugcaugccaccacgccu

SEQ ID NO: 53057 - RNA, 32 nt, Human
agcugggacuacaggugcaugccaccaugcca

SEQ ID NO: 53058 - RNA, 32 nt, Human
agcugggacuacaggugcaugccacgacgccc

SEQ ID NO: 53059 - RNA, 32 nt, Human
agcugggacuacaggugcaugccacuaagccc

SEQ ID NO: 53060 - RNA, 32 nt, Human
agcugggacuacaggugcaugcuaccaugccc

SEQ ID NO: 53061 - RNA, 32 nt, Human
agcugggacuacaggugccaucagaccuggcu

SEQ ID NO: 53062 - RNA, 32 nt, Human
agcugggacuacaggugcccaccaacacgccc

SEQ ID NO: 53063 - RNA, 32 nt, Human
agcugggacuacaggugcccaccaccacaccc

SEQ ID NO: 53064 - RNA, 32 nt, Human
agcugggacuacaggugcccaccaccacgccu

SEQ ID NO: 53065 - RNA, 32 nt, Human
agcugggacuacaggugcccaccaccacgcuu

SEQ ID NO: 53066 - RNA, 32 nt, Human
agcugggacuacaggugcccaccaccaugccc

SEQ ID NO: 53067 - RNA, 32 nt, Human
agcugggacuacaggugcccgccaccacacca

SEQ ID NO: 53068 - RNA, 32 nt, Human
agcugggacuacaggugcccgccaccaccacg

SEQ ID NO: 53069 - RNA, 32 nt, Human
agcugggacuacaggugcccgccaccacgccc

SEQ ID NO: 53070 - RNA, 32 nt, Human
agcugggacuacaggugcccgccaccacgguc

SEQ ID NO: 53071 - RNA, 32 nt, Human
agcugggacuacaggugcccgccaccaugccc

SEQ ID NO: 53072 - RNA, 32 nt, Human
agcugggacuacaggugcccgccaccgugccc

SEQ ID NO: 53073 - RNA, 32 nt, Human
agcugggacuacaggugcccgccccgacaccu

SEQ ID NO: 53074 - RNA, 32 nt, Human
agcugggacuacaggugcccgcuaccacaccc

SEQ ID NO: 53075 - RNA, 32 nt, Human
agcugggacuacaggugcccuccaccacgcuu

SEQ ID NO: 53076 - RNA, 32 nt, Human
agcugggacuacaggugccugccaccaagcuc

SEQ ID NO: 53077 - RNA, 32 nt, Human
agcugggacuacaggugccugccaccacaccc

SEQ ID NO: 53078 - RNA, 32 nt, Human
agcugggacuacaggugccugccaccacgccu

SEQ ID NO: 53079 - RNA, 32 nt, Human
agcugggacuacaggugccugcgaccacaccc

SEQ ID NO: 53080 - RNA, 32 nt, Human
agcugggacuacaggugcgcaccaccaugccc

SEQ ID NO: 53081 - RNA, 32 nt, Human
agcugggacuacaggugcgcacuaccacgccu

SEQ ID NO: 53082 - RNA, 32 nt, Human
agcugggacuacaggugcgcgccaccgugccu

SEQ ID NO: 53083 - RNA, 32 nt, Human
agcugggacuacaggugcgugccaccaugccc

SEQ ID NO: 53084 - RNA, 32 nt, Human
agcugggacuacaggugcgugccaccaugccu

SEQ ID NO: 53085 - RNA, 32 nt, Human
agcugggacuacaggugcgugccacuaugcca

SEQ ID NO: 53086 - RNA, 32 nt, Human
agcugggacuacaggugcgugcuaccacgccc

SEQ ID NO: 53087 - RNA, 32 nt, Human
agcugggacuacaggugcucaccaccacaccc

SEQ ID NO: 53088 - RNA, 32 nt, Human
agcugggacuacaggugcuccauuaaaucagg

SEQ ID NO: 53089 - RNA, 32 nt, Human
agcugggacuacagguguacaccaccacgccu

SEQ ID NO: 53090 - RNA, 32 nt, Human
agcugggacuacagguguacaccaccaugccu

SEQ ID NO: 53091 - RNA, 32 nt, Human
agcugggacuacagguguccaccaccaugccu

SEQ ID NO: 53092 - RNA, 32 nt, Human
agcugggacuacaggugugcaccaccacaccc

SEQ ID NO: 53093 - RNA, 32 nt, Human
agcugggacuacaggugugcaccaccacaccu

SEQ ID NO: 53094 - RNA, 32 nt, Human
agcugggacuacaggugugcaccaccacagcu

SEQ ID NO: 53095 - RNA, 32 nt, Human
agcugggacuacaggugugcaccaccaugccc

SEQ ID NO: 53096 - RNA, 32 nt, Human
agcugggacuacaggugugcaccacuacuccu

SEQ ID NO: 53097 - RNA, 32 nt, Human
agcugggacuacaggugugcaccacuaugccu

SEQ ID NO: 53098 - RNA, 32 nt, Human
agcugggacuacaggugugcaccacugcgucu

SEQ ID NO: 53099 - RNA, 32 nt, Human
agcugggacuacaggugugugccaccacaccc

SEQ ID NO: 53100 - RNA, 32 nt, Human
agcugggacuacaggugugugccaccaugccc

SEQ ID NO: 53101 - RNA, 32 nt, Human
agcugggacuacagucaugugccaccacgccc

SEQ ID NO: 53102 - RNA, 32 nt, Human
agcugggacuacaguugugcaccaccacacca

SEQ ID NO: 53103 - RNA, 32 nt, Human
agcugggacuacaugcgcacaccaccacgucc

SEQ ID NO: 53104 - RNA, 32 nt, Human
agcugggacuacauguaugugccaccacaccu

SEQ ID NO: 53105 - RNA, 32 nt, Human
agcugggacuaccggcgcccaccaccacgccu

SEQ ID NO: 53106 - RNA, 32 nt, Human
agcugggacuacggaugccugccaccacgccu

SEQ ID NO: 53107 - RNA, 32 nt, Human
agcugggacuacgggcacacaccaccaugccu

SEQ ID NO: 53108 - RNA, 32 nt, Human
agcugggacuacgggcacgcaccaccacgucu

SEQ ID NO: 53109 - RNA, 32 nt, Human
agcugggacuacugguacaugccaccaggccu

SEQ ID NO: 53110 - RNA, 32 nt, Human
agcugggacuacuggugugcaccaccacaccc

SEQ ID NO: 53111 - RNA, 32 nt, Human
agcugggacuagaagcaugcaccaccaugccc

SEQ ID NO: 53112 - RNA, 32 nt, Human
agcugggacuagagaugugugccaccaugccc

SEQ ID NO: 53113 - RNA, 32 nt, Human
agcugggacuagaggaacgugccaccaugacu

SEQ ID NO: 53114 - RNA, 32 nt, Human
agcugggacuagaggcaugcgccaccacaccc

SEQ ID NO: 53115 - RNA, 32 nt, Human
agcugggacuauaaacgugcaccaccacaccc

SEQ ID NO: 53116 - RNA, 32 nt, Human
agcugggacuauaggcacgcaccaccaugccu

SEQ ID NO: 53117 - RNA, 32 nt, Human
agcugggacuauaggcacgugccaccacaccc

SEQ ID NO: 53118 - RNA, 32 nt, Human
agcugggacuauaggcgcgugccaccacaacc

SEQ ID NO: 53119 - RNA, 32 nt, Human
agcugggacuauaggcgugugccaccaugccc

SEQ ID NO: 53120 - RNA, 32 nt, Human
agcugggacuauaggugcacaccaccacaccu

SEQ ID NO: 53121 - RNA, 32 nt, Human
agcugggacuauaggugcaugccaccaugccc

SEQ ID NO: 53122 - RNA, 32 nt, Human
agcugggacuauaggugcgugccaccacaccc

SEQ ID NO: 53123 - RNA, 32 nt, Human
agcugggacuauaggugcgugccaccaugccc

SEQ ID NO: 53124 - RNA, 32 nt, Human
agcugggacuauagucacuugccaccaugccc

SEQ ID NO: 53125 - RNA, 32 nt, Human
agcugggacuaugggugcacaccaccacgccu

SEQ ID NO: 53126 - RNA, 32 nt, Human
agcugggacuauuagugcacaccaccacaccu

SEQ ID NO: 53127 - RNA, 32 nt, Human
agcugggacuccaggcacccaccaccacuccc

SEQ ID NO: 53128 - RNA, 32 nt, Human
agcugggacugcaggcaugagccaucacaccc

SEQ ID NO: 53129 - RNA, 32 nt, Human
agcugggacugcaggcaugcgccaccaugcca

SEQ ID NO: 53130 - RNA, 32 nt, Human
agcugggacugcaggcaugugccaccaggccu

SEQ ID NO: 53131 - RNA, 32 nt, Human
agcugggacugcaggugcacaccaccacgccc

SEQ ID NO: 53132 - RNA, 32 nt, Human
agcugggacugcaggugcauaccaccacgccc

SEQ ID NO: 53133 - RNA, 32 nt, Human
agcugggacuggaggcgugugccaccaugccc

SEQ ID NO: 53134 - RNA, 31 nt, Human
agcugggacuucuccaggccuguguucccuc

SEQ ID NO: 53135 - RNA, 32 nt, Human
agcugggagaaagagagagcuucuguugcugc

SEQ ID NO: 53136 - RNA, 32 nt, Human
agcugggagagcagagaaaaggggccaccggu

SEQ ID NO: 53137 - RNA, 32 nt, Human
agcugggagagggacagcagcagcggcuguuc

SEQ ID NO: 53138 - RNA, 32 nt, Human
agcugggagaguccaggagcuagggacacaga

SEQ ID NO: 53139 - RNA, 32 nt, Human
agcugggagcaggugccggagccccggccugc

SEQ ID NO: 53140 - RNA, 32 nt, Human
agcugggagccccgucuccaggaaaaggagag

SEQ ID NO: 53141 - RNA, 32 nt, Human
agcugggagccugggcaugcaucgccacgucu

SEQ ID NO: 53142 - RNA, 32 nt, Human
agcugggaggacaggcauaugccaccacauca

SEQ ID NO: 53143 - RNA, 32 nt, Human
agcugggaggacaggcaugcgccaccacgccc

SEQ ID NO: 53144 - RNA, 32 nt, Human
agcugggaggagagaagaaagcggggauggug

SEQ ID NO: 53145 - RNA, 32 nt, Human
agcugggaggagcagggugagggugggcgacc

SEQ ID NO: 53146 - RNA, 32 nt, Human
agcugggaggcagaguuuucagugagccaaga

SEQ ID NO: 53147 - RNA, 32 nt, Human
agcugggaggcagauagccuugggcaaauuuu

SEQ ID NO: 53148 - RNA, 31 nt, Human
agcugggaggccaaggguucacugggcuuga

SEQ ID NO: 53149 - RNA, 22 nt, Human
agcugggaggcggagguugcag

SEQ ID NO: 53150 - RNA, 32 nt, Human
agcugggaggcggagguugcagugagccaaga

SEQ ID NO: 53151 - RNA, 32 nt, Human
agcugggagggagcagugcaccugccagcgug

SEQ ID NO: 53152 - RNA, 32 nt, Human
agcugggagggagggggaggugaaaagggcag

SEQ ID NO: 53153 - RNA, 32 nt, Human
agcugggagggggaggaggaggagcucacacc

SEQ ID NO: 53154 - RNA, 32 nt, Human
agcugggaggguccccagcccaggagguggcu

SEQ ID NO: 53155 - RNA, 32 nt, Human
agcugggaggguggaggugugggagcugaugg

SEQ ID NO: 53156 - RNA, 32 nt, Human
agcugggaguacagaugcacaccaccacaccc

SEQ ID NO: 53157 - RNA, 32 nt, Human
agcugggaguacaggcacacaccaccacaccc

SEQ ID NO: 53158 - RNA, 32 nt, Human
agcugggaguacaggcauguggcaccaugccu

SEQ ID NO: 53159 - RNA, 32 nt, Human
agcugggaguacaggugcacaccaccaugccu

SEQ ID NO: 53160 - RNA, 32 nt, Human
agcugggaguccccuuccccagcccuggguca

SEQ ID NO: 53161 - RNA, 32 nt, Human
agcugggagugagcagucagagagggagacag

SEQ ID NO: 53162 - RNA, 32 nt, Human
agcugggagugcaggugcacaccgccaugccu

SEQ ID NO: 53163 - RNA, 32 nt, Human
agcugggagugggcugggggaggggaacagga

SEQ ID NO: 53164 - RNA, 32 nt, Human
agcugggauaacaggugccagccaccaugccc

SEQ ID NO: 53165 - RNA, 16 nt, Human
agcugggauaccagca

SEQ ID NO: 53166 - RNA, 32 nt, Human
agcugggauagcaggugugugccaccaugccc

SEQ ID NO: 53167 - RNA, 32 nt, Human
agcugggauauaggauuuuuguuguuuuuguu

SEQ ID NO: 53168 - RNA, 32 nt, Human
agcugggaucacaggcacacaccaccaugccc

SEQ ID NO: 53169 - RNA, 32 nt, Human
agcugggaucacaggcaugcaccaccaugccu

SEQ ID NO: 53170 - RNA, 32 nt, Human
agcugggaucacaggugcccaccaccauggug

SEQ ID NO: 53171 - RNA, 32 nt, Human
agcugggaucacaggugugcaccaccaugccc

SEQ ID NO: 53172 - RNA, 32 nt, Human
agcugggaucauagaugccugccaccacaccc

SEQ ID NO: 53173 - RNA, 32 nt, Human
agcugggaucgcaggcgccugccaccacgccu

SEQ ID NO: 53174 - RNA, 32 nt, Human
agcugggaucguaccacugcacuccagccugg

SEQ ID NO: 53175 - RNA, 32 nt, Human
agcugggaugacaggcacaugccaccacaccu

SEQ ID NO: 53176 - RNA, 32 nt, Human
agcugggaugacaggcgcacaccaccacgccc

SEQ ID NO: 53177 - RNA, 32 nt, Human
agcugggaugacaggugcacgccaccacgccc

SEQ ID NO: 53178 - RNA, 32 nt, Human
agcugggaugauaggcaggcaccaccacaccu

SEQ ID NO: 53179 - RNA, 32 nt, Human
agcugggauuaaaggcacgugccaccaugacu

SEQ ID NO: 53180 - RNA, 32 nt, Human
agcugggauuacaaccgugugccaccacaccc

SEQ ID NO: 53181 - RNA, 32 nt, Human
agcugggauuacaagcgcccaccaccacaccc

SEQ ID NO: 53182 - RNA, 32 nt, Human
agcugggauuacaagggcacaccaccacgccc

SEQ ID NO: 53183 - RNA, 32 nt, Human
agcugggauuacaagugcccaccaccacaccc

SEQ ID NO: 53184 - RNA, 32 nt, Human
agcugggauuacaagugcccaccaccacaccu

SEQ ID NO: 53185 - RNA, 32 nt, Human
agcugggauuacaagugcccaccaccaugccc

SEQ ID NO: 53186 - RNA, 32 nt, Human
agcugggauuacaccaccaugcccagcuacua

SEQ ID NO: 53187 - RNA, 32 nt, Human
agcugggauuacacgcacaugccaccacaccc

SEQ ID NO: 53188 - RNA, 32 nt, Human
agcugggauuacacgcgugugccaccacgcuc

SEQ ID NO: 53189 - RNA, 32 nt, Human
agcugggauuacacgugcccaccaccaugccc

SEQ ID NO: 53190 - RNA, 32 nt, Human
agcugggauuacagacaggcaccaccacaccc

SEQ ID NO: 53191 - RNA, 32 nt, Human
agcugggauuacagacaugugccaccacgccc

SEQ ID NO: 53192 - RNA, 32 nt, Human
agcugggauuacagacucaugccaccacgcca

SEQ ID NO: 53193 - RNA, 32 nt, Human
agcugggauuacagaugcccaccaccaugccu

SEQ ID NO: 53194 - RNA, 32 nt, Human
agcugggauuacagaugccugccaccaugucu

SEQ ID NO: 53195 - RNA, 32 nt, Human
agcugggauuacagaugugcaccaccacgccu

SEQ ID NO: 53196 - RNA, 32 nt, Human
agcugggauuacagccaugcaccaccacaccu

SEQ ID NO: 53197 - RNA, 32 nt, Human
agcugggauuacagcgauugguuguuucguua

SEQ ID NO: 53198 - RNA, 32 nt, Human
agcugggauuacaggagcgugccaccacuccg

SEQ ID NO: 53199 - RNA, 32 nt, Human
agcugggauuacaggagugugccaccacaccu

SEQ ID NO: 53200 - RNA, 32 nt, Human
agcugggauuacaggcaaacgccaccacaccc

SEQ ID NO: 53201 - RNA, 32 nt, Human
agcugggauuacaggcaacugccaccaugccc

SEQ ID NO: 53202 - RNA, 32 nt, Human
agcugggauuacaggcaagcaccaccaugccu

SEQ ID NO: 53203 - RNA, 32 nt, Human
agcugggauuacaggcacaaaccaccaugccu

SEQ ID NO: 53204 - RNA, 32 nt, Human
agcugggauuacaggcacaagccaccaugccu

SEQ ID NO: 53205 - RNA, 32 nt, Human
agcugggauuacaggcacacacaaccacgccc

SEQ ID NO: 53206 - RNA, 32 nt, Human
agcugggauuacaggcacacaccaccacaccu

SEQ ID NO: 53207 - RNA, 32 nt, Human
agcugggauuacaggcacacaccaccacgccc

SEQ ID NO: 53208 - RNA, 32 nt, Human
agcugggauuacaggcacacaccaccacgcuu

SEQ ID NO: 53209 - RNA, 32 nt, Human
agcugggauuacaggcacacaccaccagccag

SEQ ID NO: 53210 - RNA, 32 nt, Human
agcugggauuacaggcacacaccaccauaccu

SEQ ID NO: 53211 - RNA, 32 nt, Human
agcugggauuacaggcacacaccaccaugccc

SEQ ID NO: 53212 - RNA, 32 nt, Human
agcugggauuacaggcacacacuaccacgccu

SEQ ID NO: 53213 - RNA, 32 nt, Human
agcugggauuacaggcacacgccaccacaccc

SEQ ID NO: 53214 - RNA, 32 nt, Human
agcugggauuacaggcacacgccaccacacgc

SEQ ID NO: 53215 - RNA, 32 nt, Human
agcugggauuacaggcacacgccaccaugccc

SEQ ID NO: 53216 - RNA, 32 nt, Human
agcugggauuacaggcacaggccgccacgccc

SEQ ID NO: 53217 - RNA, 32 nt, Human
agcugggauuacaggcacauaccaucaugccu

SEQ ID NO: 53218 - RNA, 32 nt, Human
agcugggauuacaggcacaugccaccacaccc

SEQ ID NO: 53219 - RNA, 32 nt, Human
agcugggauuacaggcacaugccaccacaccu

SEQ ID NO: 53220 - RNA, 32 nt, Human
agcugggauuacaggcacaugccaccaugccu

SEQ ID NO: 53221 - RNA, 32 nt, Human
agcugggauuacaggcacaugccaccaugcuc

SEQ ID NO: 53222 - RNA, 32 nt, Human
agcugggauuacaggcaccagccaccaugccu

SEQ ID NO: 53223 - RNA, 32 nt, Human
agcugggauuacaggcacccaccaacaugccc

SEQ ID NO: 53224 - RNA, 32 nt, Human
agcugggauuacaggcacccaccaccacaccu

SEQ ID NO: 53225 - RNA, 32 nt, Human
agcugggauuacaggcacccaccaccacgcac

SEQ ID NO: 53226 - RNA, 32 nt, Human
agcugggauuacaggcacccaccaccacgccc

SEQ ID NO: 53227 - RNA, 32 nt, Human
agcugggauuacaggcacccaccaccacgccu

SEQ ID NO: 53228 - RNA, 32 nt, Human
agcugggauuacaggcacccaccaccacgcuc

SEQ ID NO: 53229 - RNA, 32 nt, Human
agcugggauuacaggcacccaccaccauaucu

SEQ ID NO: 53230 - RNA, 32 nt, Human
agcugggauuacaggcacccaccaccaugccc

SEQ ID NO: 53231 - RNA, 32 nt, Human
agcugggauuacaggcacccaccaccaugccu

SEQ ID NO: 53232 - RNA, 32 nt, Human
agcugggauuacaggcacccaccaccucaccc

SEQ ID NO: 53233 - RNA, 32 nt, Human
agcugggauuacaggcacccaccacuaugccc

SEQ ID NO: 53234 - RNA, 32 nt, Human
agcugggauuacaggcacccaccaucacgcca

SEQ ID NO: 53235 - RNA, 32 nt, Human
agcugggauuacaggcacccacgaccacgcuc

SEQ ID NO: 53236 - RNA, 32 nt, Human
agcugggauuacaggcacccaucaccacaccc

SEQ ID NO: 53237 - RNA, 32 nt, Human
agcugggauuacaggcacccgccaccacaccu

SEQ ID NO: 53238 - RNA, 32 nt, Human
agcugggauuacaggcacccgccaccacgccc

SEQ ID NO: 53239 - RNA, 32 nt, Human
agcugggauuacaggcacccgccaccacgucc

SEQ ID NO: 53240 - RNA, 32 nt, Human
agcugggauuacaggcacccgccaccguaccu

SEQ ID NO: 53241 - RNA, 32 nt, Human
agcugggauuacaggcacccgccaccgugccc

SEQ ID NO: 53242 - RNA, 32 nt, Human
agcugggauuacaggcacccgccaucaugccc

SEQ ID NO: 53243 - RNA, 32 nt, Human
agcugggauuacaggcacccgcuaccacaccc

SEQ ID NO: 53244 - RNA, 32 nt, Human
agcugggauuacaggcaccuaccaccagggcc

SEQ ID NO: 53245 - RNA, 32 nt, Human
agcugggauuacaggcaccuaccaccuugccc

SEQ ID NO: 53246 - RNA, 32 nt, Human
agcugggauuacaggcaccugccaccacaccu

SEQ ID NO: 53247 - RNA, 32 nt, Human
agcugggauuacaggcaccugccaccacaucu

SEQ ID NO: 53248 - RNA, 32 nt, Human
agcugggauuacaggcaccugccaccacgccc

SEQ ID NO: 53249 - RNA, 32 nt, Human
agcugggauuacaggcaccugccaccacgccu

SEQ ID NO: 53250 - RNA, 32 nt, Human
agcugggauuacaggcaccugccaccaugccc

SEQ ID NO: 53251 - RNA, 32 nt, Human
agcugggauuacaggcaccugccauuaugccc

SEQ ID NO: 53252 - RNA, 32 nt, Human
agcugggauuacaggcaccugucaccacaccc

SEQ ID NO: 53253 - RNA, 32 nt, Human
agcugggauuacaggcaccugucaccaugccu

SEQ ID NO: 53254 - RNA, 32 nt, Human
agcugggauuacaggcacgcacaaccaugccc

SEQ ID NO: 53255 - RNA, 32 nt, Human
agcugggauuacaggcacgcaccaccacaccu

SEQ ID NO: 53256 - RNA, 32 nt, Human
agcugggauuacaggcacgcaccaccaugccu

SEQ ID NO: 53257 - RNA, 32 nt, Human
agcugggauuacaggcacgcaccuccacgucc

SEQ ID NO: 53258 - RNA, 32 nt, Human
agcugggauuacaggcacgcgccaccacaccu

SEQ ID NO: 53259 - RNA, 32 nt, Human
agcugggauuacaggcacgcgccaccacgccu

SEQ ID NO: 53260 - RNA, 32 nt, Human
agcugggauuacaggcacgcgccaccacucug

SEQ ID NO: 53261 - RNA, 32 nt, Human
agcugggauuacaggcacgcgcugccacaccc

SEQ ID NO: 53262 - RNA, 32 nt, Human
agcugggauuacaggcacgcuccaccacaccc

SEQ ID NO: 53263 - RNA, 32 nt, Human
agcugggauuacaggcacguaccaccacgccu

SEQ ID NO: 53264 - RNA, 32 nt, Human
agcugggauuacaggcacgugacaccaggccc

SEQ ID NO: 53265 - RNA, 32 nt, Human
agcugggauuacaggcacgugccaacacaccc

SEQ ID NO: 53266 - RNA, 32 nt, Human
agcugggauuacaggcacgugccaccaagccc

SEQ ID NO: 53267 - RNA, 32 nt, Human
agcugggauuacaggcacgugccaccacgccc

SEQ ID NO: 53268 - RNA, 32 nt, Human
agcugggauuacaggcacgugccaccaugucu

SEQ ID NO: 53269 - RNA, 32 nt, Human
agcugggauuacaggcacuugccaccauuccc

SEQ ID NO: 53270 - RNA, 32 nt, Human
agcugggauuacaggcagacaccaucacgccc

SEQ ID NO: 53271 - RNA, 32 nt, Human
agcugggauuacaggcagacacgccaugcccg

SEQ ID NO: 53272 - RNA, 32 nt, Human
agcugggauuacaggcagcaccacaccuggcu

SEQ ID NO: 53273 - RNA, 32 nt, Human
agcugggauuacaggcaggugccaccaugccu

SEQ ID NO: 53274 - RNA, 32 nt, Human
agcugggauuacaggcauacaccaccacaccc

SEQ ID NO: 53275 - RNA, 32 nt, Human
agcugggauuacaggcauacaccaccacgccc

SEQ ID NO: 53276 - RNA, 32 nt, Human
agcugggauuacaggcauccgccaccacgccc

SEQ ID NO: 53277 - RNA, 32 nt, Human
agcugggauuacaggcaucugccaaccaugcc

SEQ ID NO: 53278 - RNA, 32 nt, Human
agcugggauuacaggcaucugcuaccacgccu

SEQ ID NO: 53279 - RNA, 32 nt, Human
agcugggauuacaggcaugaaucaccacacuc

SEQ ID NO: 53280 - RNA, 32 nt, Human
agcugggauuacaggcaugagccacugagccc

SEQ ID NO: 53281 - RNA, 32 nt, Human
agcugggauuacaggcaugagccacugugccc

SEQ ID NO: 53282 - RNA, 32 nt, Human
agcugggauuacaggcaugagccacugugccu

SEQ ID NO: 53283 - RNA, 32 nt, Human
agcugggauuacaggcaugagucaccacgccc

SEQ ID NO: 53284 - RNA, 32 nt, Human
agcugggauuacaggcaugcaacaccacacau

SEQ ID NO: 53285 - RNA, 32 nt, Human
agcugggauuacaggcaugcaccaccacacac

SEQ ID NO: 53286 - RNA, 32 nt, Human
agcugggauuacaggcaugcaccaccacacca

SEQ ID NO: 53287 - RNA, 32 nt, Human
agcugggauuacaggcaugcaccaccacaccc

SEQ ID NO: 53288 - RNA, 32 nt, Human
agcugggauuacaggcaugcaccaccacaccu

SEQ ID NO: 53289 - RNA, 32 nt, Human
agcugggauuacaggcaugcaccaccacagcc

SEQ ID NO: 53290 - RNA, 32 nt, Human
agcugggauuacaggcaugcaccaccacgccc

SEQ ID NO: 53291 - RNA, 32 nt, Human
agcugggauuacaggcaugcaccaccacgccu

SEQ ID NO: 53292 - RNA, 32 nt, Human
agcugggauuacaggcaugcaccaccacgcuc

SEQ ID NO: 53293 - RNA, 32 nt, Human
agcugggauuacaggcaugcaccaccacgucu

SEQ ID NO: 53294 - RNA, 32 nt, Human
agcugggauuacaggcaugcaccaccacuccu

SEQ ID NO: 53295 - RNA, 32 nt, Human
agcugggauuacaggcaugcaccaccaugccc

SEQ ID NO: 53296 - RNA, 32 nt, Human
agcugggauuacaggcaugcaccaccaugccu

SEQ ID NO: 53297 - RNA, 32 nt, Human
agcugggauuacaggcaugcacuaccacaccc

SEQ ID NO: 53298 - RNA, 32 nt, Human
agcugggauuacaggcaugcacuaccacgcuu

SEQ ID NO: 53299 - RNA, 32 nt, Human
agcugggauuacaggcaugcgccaccacaccc

SEQ ID NO: 53300 - RNA, 32 nt, Human
agcugggauuacaggcaugcgccaccacaccu

SEQ ID NO: 53301 - RNA, 32 nt, Human
agcugggauuacaggcaugcgccaccacgccc

SEQ ID NO: 53302 - RNA, 32 nt, Human
agcugggauuacaggcaugcgccaccacgccu

SEQ ID NO: 53303 - RNA, 32 nt, Human
agcugggauuacaggcaugcgccaccaggccc

SEQ ID NO: 53304 - RNA, 32 nt, Human
agcugggauuacaggcaugcgccaccaugacc

SEQ ID NO: 53305 - RNA, 32 nt, Human
agcugggauuacaggcaugcgccaccaugcca

SEQ ID NO: 53306 - RNA, 32 nt, Human
agcugggauuacaggcaugcgccaccaugccc

SEQ ID NO: 53307 - RNA, 32 nt, Human
agcugggauuacaggcaugcgccaccaugccu

SEQ ID NO: 53308 - RNA, 32 nt, Human
agcugggauuacaggcaugcgccacuaugccc

SEQ ID NO: 53309 - RNA, 32 nt, Human
agcugggauuacaggcaugcgccaucaugccu

SEQ ID NO: 53310 - RNA, 32 nt, Human
agcugggauuacaggcaugcgcuaacacaccc

SEQ ID NO: 53311 - RNA, 32 nt, Human
agcugggauuacaggcaugcuccaccaugccc

SEQ ID NO: 53312 - RNA, 32 nt, Human
agcugggauuacaggcaugggccaccaugccc

SEQ ID NO: 53313 - RNA, 32 nt, Human
agcugggauuacaggcauguaccaccacaccc

SEQ ID NO: 53314 - RNA, 32 nt, Human
agcugggauuacaggcauguaccaucacaccc

SEQ ID NO: 53315 - RNA, 32 nt, Human
agcugggauuacaggcauguacuaccaugccu

SEQ ID NO: 53316 - RNA, 32 nt, Human
agcugggauuacaggcaugugagaccacgccc

SEQ ID NO: 53317 - RNA, 32 nt, Human
agcugggauuacaggcaugugcaacucaccca

SEQ ID NO: 53318 - RNA, 32 nt, Human
agcugggauuacaggcaugugccaccacaccc

SEQ ID NO: 53319 - RNA, 32 nt, Human
agcugggauuacaggcaugugccaccacaccu

SEQ ID NO: 53320 - RNA, 32 nt, Human
agcugggauuacaggcaugugccaccacacua

SEQ ID NO: 53321 - RNA, 32 nt, Human
agcugggauuacaggcaugugccaccacacuc

SEQ ID NO: 53322 - RNA, 32 nt, Human
agcugggauuacaggcaugugccaccacgcca

SEQ ID NO: 53323 - RNA, 32 nt, Human
agcugggauuacaggcaugugccaccacgccc

SEQ ID NO: 53324 - RNA, 32 nt, Human
agcugggauuacaggcaugugccaccaugccc

SEQ ID NO: 53325 - RNA, 32 nt, Human
agcugggauuacaggcaugugccaccaugccu

SEQ ID NO: 53326 - RNA, 32 nt, Human
agcugggauuacaggcaugugccacccaccac

SEQ ID NO: 53327 - RNA, 32 nt, Human
agcugggauuacaggcaugugccacuacccgg

SEQ ID NO: 53328 - RNA, 32 nt, Human
agcugggauuacaggcaugugccagcaugccc

SEQ ID NO: 53329 - RNA, 32 nt, Human
agcugggauuacaggcaugugccaucaccccg

SEQ ID NO: 53330 - RNA, 32 nt, Human
agcugggauuacaggcaugugucaccacgccc

SEQ ID NO: 53331 - RNA, 32 nt, Human
agcugggauuacaggcgcacaccaccacacac

SEQ ID NO: 53332 - RNA, 32 nt, Human
agcugggauuacaggcgcaugccaccacaccu

SEQ ID NO: 53333 - RNA, 32 nt, Human
agcugggauuacaggcgcaugccaccaugcca

SEQ ID NO: 53334 - RNA, 32 nt, Human
agcugggauuacaggcgcccaccaccacaccu

SEQ ID NO: 53335 - RNA, 32 nt, Human
agcugggauuacaggcgcccaccaccacagcc

SEQ ID NO: 53336 - RNA, 32 nt, Human
agcugggauuacaggcgcccaccaccacgucu

SEQ ID NO: 53337 - RNA, 32 nt, Human
agcugggauuacaggcgcccaccaccaugccc

SEQ ID NO: 53338 - RNA, 32 nt, Human
agcugggauuacaggcgccugccaccacaccc

SEQ ID NO: 53339 - RNA, 32 nt, Human
agcugggauuacaggcgccugccaccacaccu

SEQ ID NO: 53340 - RNA, 32 nt, Human
agcugggauuacaggcgccugccaccacgccc

SEQ ID NO: 53341 - RNA, 32 nt, Human
agcugggauuacaggcgccugccaccacgccu

SEQ ID NO: 53342 - RNA, 32 nt, Human
agcugggauuacaggcgccugccaccaugccu

SEQ ID NO: 53343 - RNA, 32 nt, Human
agcugggauuacaggcgccugccaccaugcug

SEQ ID NO: 53344 - RNA, 32 nt, Human
agcugggauuacaggcgcgugccaccacaccc

SEQ ID NO: 53345 - RNA, 32 nt, Human
agcugggauuacaggcgcgugccaccauaccg

SEQ ID NO: 53346 - RNA, 32 nt, Human
agcugggauuacaggcgcuggccacacaccca

SEQ ID NO: 53347 - RNA, 32 nt, Human
agcugggauuacaggcguacaccaccaugccu

SEQ ID NO: 53348 - RNA, 32 nt, Human
agcugggauuacaggcgugcaccacaacgccu

SEQ ID NO: 53349 - RNA, 32 nt, Human
agcugggauuacaggcgugcaccaccacgccc

SEQ ID NO: 53350 - RNA, 32 nt, Human
agcugggauuacaggcgugugccaccacaccu

SEQ ID NO: 53351 - RNA, 32 nt, Human
agcugggauuacaggcgugugccaccacgccu

SEQ ID NO: 53352 - RNA, 32 nt, Human
agcugggauuacaggcgugugccaccaugccc

SEQ ID NO: 53353 - RNA, 32 nt, Human
agcugggauuacaggcucaugccaccaugccc

SEQ ID NO: 53354 - RNA, 32 nt, Human
agcugggauuacaggcuccugccaccacgccc

SEQ ID NO: 53355 - RNA, 32 nt, Human
agcugggauuacaggcuccugccaccacgccu

SEQ ID NO: 53356 - RNA, 32 nt, Human
agcugggauuacagggcccugccaccaagccc

SEQ ID NO: 53357 - RNA, 32 nt, Human
agcugggauuacagguaccugccaccaugccc

SEQ ID NO: 53358 - RNA, 32 nt, Human
agcugggauuacagguaugugccaccacgccu

SEQ ID NO: 53359 - RNA, 32 nt, Human
agcugggauuacagguaugugccaccaugccu

SEQ ID NO: 53360 - RNA, 32 nt, Human
agcugggauuacaggugcacaccaccacaccu

SEQ ID NO: 53361 - RNA, 32 nt, Human
agcugggauuacaggugcacaccaccaugccc

SEQ ID NO: 53362 - RNA, 32 nt, Human
agcugggauuacaggugcacaccaccaugccu

SEQ ID NO: 53363 - RNA, 32 nt, Human
agcugggauuacaggugcaccacgcccggcca

SEQ ID NO: 53364 - RNA, 32 nt, Human
agcugggauuacaggugcacgccaccaugcuu

SEQ ID NO: 53365 - RNA, 32 nt, Human
agcugggauuacaggugcaggccaccaugccc

SEQ ID NO: 53366 - RNA, 32 nt, Human
agcugggauuacaggugcaugccaccacaccc

SEQ ID NO: 53367 - RNA, 32 nt, Human
agcugggauuacaggugcaugccaccacgcuc

SEQ ID NO: 53368 - RNA, 32 nt, Human
agcugggauuacaggugcaugccaccaugccu

SEQ ID NO: 53369 - RNA, 32 nt, Human
agcugggauuacaggugcaugccaccauggcu

SEQ ID NO: 53370 - RNA, 32 nt, Human
agcugggauuacaggugcaugccaucacagcu

SEQ ID NO: 53371 - RNA, 32 nt, Human
agcugggauuacaggugcccaccaacaugccu

SEQ ID NO: 53372 - RNA, 32 nt, Human
agcugggauuacaggugcccaccaccacaucc

SEQ ID NO: 53373 - RNA, 32 nt, Human
agcugggauuacaggugcccaccaccaccccu

SEQ ID NO: 53374 - RNA, 32 nt, Human
agcugggauuacaggugcccaccaccaugcca

SEQ ID NO: 53375 - RNA, 32 nt, Human
agcugggauuacaggugcccaccaccaugccc

SEQ ID NO: 53376 - RNA, 32 nt, Human
agcugggauuacaggugcccaccaccaugccu

SEQ ID NO: 53377 - RNA, 32 nt, Human
agcugggauuacaggugcccaccaccauguca

SEQ ID NO: 53378 - RNA, 32 nt, Human
agcugggauuacaggugcccaccacugcgccc

SEQ ID NO: 53379 - RNA, 32 nt, Human
agcugggauuacaggugcccaccagcacgccc

SEQ ID NO: 53380 - RNA, 32 nt, Human
agcugggauuacaggugcccgccaccacacca

SEQ ID NO: 53381 - RNA, 32 nt, Human
agcugggauuacaggugcccgccaccacaccg

SEQ ID NO: 53382 - RNA, 32 nt, Human
agcugggauuacaggugcccgccaccacaucu

SEQ ID NO: 53383 - RNA, 32 nt, Human
agcugggauuacaggugcccgccaccacgccc

SEQ ID NO: 53384 - RNA, 32 nt, Human
agcugggauuacaggugcccgccaccacgcuc

SEQ ID NO: 53385 - RNA, 32 nt, Human
agcugggauuacaggugcccgccaccaugcuc

SEQ ID NO: 53386 - RNA, 32 nt, Human
agcugggauuacaggugccugccaccacaccc

SEQ ID NO: 53387 - RNA, 32 nt, Human
agcugggauuacaggugccugccaccacgcug

SEQ ID NO: 53388 - RNA, 32 nt, Human
agcugggauuacaggugccugccaccauaccu

SEQ ID NO: 53389 - RNA, 32 nt, Human
agcugggauuacaggugccugccaccaugccc

SEQ ID NO: 53390 - RNA, 32 nt, Human
agcugggauuacaggugccugccaccaugccu

SEQ ID NO: 53391 - RNA, 32 nt, Human
agcugggauuacaggugccugccaccauuccu

SEQ ID NO: 53392 - RNA, 32 nt, Human
agcugggauuacaggugccugccacugcgucu

SEQ ID NO: 53393 - RNA, 32 nt, Human
agcugggauuacaggugccugccagcacaccu

SEQ ID NO: 53394 - RNA, 32 nt, Human
agcugggauuacaggugcgcaccaccaugccc

SEQ ID NO: 53395 - RNA, 32 nt, Human
agcugggauuacaggugcgcaccacuacgccu

SEQ ID NO: 53396 - RNA, 32 nt, Human
agcugggauuacaggugcgcaccauuacaucc

SEQ ID NO: 53397 - RNA, 32 nt, Human
agcugggauuacaggugcgcacuaccacgcca

SEQ ID NO: 53398 - RNA, 32 nt, Human
agcugggauuacaggugcgccccaccaugccc

SEQ ID NO: 53399 - RNA, 32 nt, Human
agcugggauuacaggugcgcgccaucacgccc

SEQ ID NO: 53400 - RNA, 32 nt, Human
agcugggauuacaggugcgugccaccacacca

SEQ ID NO: 53401 - RNA, 32 nt, Human
agcugggauuacaggugcgugccaccacgcac

SEQ ID NO: 53402 - RNA, 32 nt, Human
agcugggauuacaggugcgugccaccacgccc

SEQ ID NO: 53403 - RNA, 32 nt, Human
agcugggauuacaggugcucaccaccacgucc

SEQ ID NO: 53404 - RNA, 32 nt, Human
agcugggauuacagguguaugccaccacgccu

SEQ ID NO: 53405 - RNA, 32 nt, Human
agcugggauuacaggugugcaccaccacaccc

SEQ ID NO: 53406 - RNA, 32 nt, Human
agcugggauuacaggugugcaccaccacgccu

SEQ ID NO: 53407 - RNA, 32 nt, Human
agcugggauuacaggugugcaccaccauuccu

SEQ ID NO: 53408 - RNA, 32 nt, Human
agcugggauuacaggugugcaccacccguacc

SEQ ID NO: 53409 - RNA, 32 nt, Human
agcugggauuacaggugugcaccacuaccacu

SEQ ID NO: 53410 - RNA, 32 nt, Human
agcugggauuacaggugugugccaccacaccc

SEQ ID NO: 53411 - RNA, 32 nt, Human
agcugggauuacaggugugugccaccaugcuu

SEQ ID NO: 53412 - RNA, 32 nt, Human
agcugggauuacagguuugcaccaccaugccc

SEQ ID NO: 53413 - RNA, 32 nt, Human
agcugggauuacagucaggcaccaccacaccc

SEQ ID NO: 53414 - RNA, 32 nt, Human
agcugggauuacaguugccugccaccacgccc

SEQ ID NO: 53415 - RNA, 32 nt, Human
agcugggauuacaugugugugccaccacagcc

SEQ ID NO: 53416 - RNA, 32 nt, Human
agcugggauuacgggcauaugccaccacaccc

SEQ ID NO: 53417 - RNA, 32 nt, Human
agcugggauuacgggcaugugccaccacgccu

SEQ ID NO: 53418 - RNA, 32 nt, Human
agcugggauuacgggcgcccaccaccaugccc

SEQ ID NO: 53419 - RNA, 32 nt, Human
agcugggauuacgggugcgugccaccaugccu

SEQ ID NO: 53420 - RNA, 32 nt, Human
agcugggauuacuggcacacaccaccaugcac

SEQ ID NO: 53421 - RNA, 32 nt, Human
agcugggauuacuggugcacaccaccacacuc

SEQ ID NO: 53422 - RNA, 32 nt, Human
agcugggauuacuggugcccaccaccaugccc

SEQ ID NO: 53423 - RNA, 32 nt, Human
agcugggauuagaggcgugugccaccaugccu

SEQ ID NO: 53424 - RNA, 32 nt, Human
agcugggauuauagacacgugccaccacgccc

SEQ ID NO: 53425 - RNA, 32 nt, Human
agcugggauuauaggcacacaccaccacaucc

SEQ ID NO: 53426 - RNA, 32 nt, Human
agcugggauuauaggcacacaccaccauaccc

SEQ ID NO: 53427 - RNA, 32 nt, Human
agcugggauuauaggcacacaccaccaugucc

SEQ ID NO: 53428 - RNA, 32 nt, Human
agcugggauuauaggcacccaccaccacaccu

SEQ ID NO: 53429 - RNA, 32 nt, Human
agcugggauuauaggcaccugccaccacgguc

SEQ ID NO: 53430 - RNA, 32 nt, Human
agcugggauuauaggcacgugccaccacaccc

SEQ ID NO: 53431 - RNA, 32 nt, Human
agcugggauuauaggcaugcaccaccaccacc

SEQ ID NO: 53432 - RNA, 32 nt, Human
agcugggauuauaggcaugcaccaccaugccc

SEQ ID NO: 53433 - RNA, 32 nt, Human
agcugggauuauaggcgucugccaccacgccc

SEQ ID NO: 53434 - RNA, 32 nt, Human
agcugggauuauaggcgugcaccaccaugccc

SEQ ID NO: 53435 - RNA, 32 nt, Human
agcugggauuauaggcgugugccaccaugccc

SEQ ID NO: 53436 - RNA, 32 nt, Human
agcugggauuauaggugcaugccaccaugccc

SEQ ID NO: 53437 - RNA, 32 nt, Human
agcugggauuauaggugcaugcuaccacgcuc

SEQ ID NO: 53438 - RNA, 32 nt, Human
agcugggauuauaggugcccaccaccaagccc

SEQ ID NO: 53439 - RNA, 32 nt, Human
agcugggauuauaggugccugccaccaugccc

SEQ ID NO: 53440 - RNA, 32 nt, Human
agcugggauuauaggugcgcaccaccacaccc

SEQ ID NO: 53441 - RNA, 32 nt, Human
agcugggauuaugggcgcccaccaccaugccc

SEQ ID NO: 53442 - RNA, 32 nt, Human
agcugggauuaugggcgcccaccaccaugccu

SEQ ID NO: 53443 - RNA, 32 nt, Human
agcugggauuaugggugccugccaccacaccc

SEQ ID NO: 53444 - RNA, 32 nt, Human
agcugggauugcagacgugcaccaccacgcca

SEQ ID NO: 53445 - RNA, 32 nt, Human
agcugggauugcaggcacucaccaccaugccc

SEQ ID NO: 53446 - RNA, 32 nt, Human
agcugggauugcaggcgugugccaccacgccc

SEQ ID NO: 53447 - RNA, 32 nt, Human
agcugggauugcagguaugcaccaccacaccu

SEQ ID NO: 53448 - RNA, 32 nt, Human
agcugggauugcaggugcaugccaccaugccu

SEQ ID NO: 53449 - RNA, 32 nt, Human
agcugggauugcaggugcccaccaccacgccc

SEQ ID NO: 53450 - RNA, 32 nt, Human
agcugggauugcaggugcccaccaccaggccu

SEQ ID NO: 53451 - RNA, 32 nt, Human
agcugggauugcaggugccugccaccaugccu

SEQ ID NO: 53452 - RNA, 32 nt, Human
agcugggauuguaagaguaugccaccacgccc

SEQ ID NO: 53453 - RNA, 32 nt, Human
agcugggauuguagguacacaccaccaugccu

SEQ ID NO: 53454 - RNA, 32 nt, Human
agcugggauuuuaggugugcaccaccaugccu

SEQ ID NO: 53455 - RNA, 32 nt, Human
agcugggcaauuggcgggcauggaggugggug

SEQ ID NO: 53456 - RNA, 32 nt, Human
agcugggcagagcccugggggcgcggugcugc

SEQ ID NO: 53457 - RNA, 32 nt, Human
agcugggcagaggcgccccucaccucccggac

SEQ ID NO: 53458 - RNA, 32 nt, Human
agcugggcagcagggguagggguagggagccu

SEQ ID NO: 53459 - RNA, 32 nt, Human
agcugggcagcuaugagaagugccaggaccuu

SEQ ID NO: 53460 - RNA, 32 nt, Human
agcugggcaggcuggggacuccagggccuccu

SEQ ID NO: 53461 - RNA, 32 nt, Human
agcugggcagggaagagagcgcccggcucagu

SEQ ID NO: 53462 - RNA, 32 nt, Human
agcugggccacaggcuggcugugugaucuugg

SEQ ID NO: 53463 - RNA, 20 nt, Human
agcugggccacuccucuuca

SEQ ID NO: 53464 - RNA, 32 nt, Human
agcugggcccccacccggccuggguaggauga

SEQ ID NO: 53465 - RNA, 18 nt, Human
agcugggccccucccagg

SEQ ID NO: 53466 - RNA, 18 nt, Human
agcugggccccuggggca

SEQ ID NO: 53467 - RNA, 32 nt, Human
agcugggccgagccggagguuguggugucuga

SEQ ID NO: 53468 - RNA, 20 nt, Human
agcugggccucaccccggca

SEQ ID NO: 53469 - RNA, 16 nt, Human
agcugggccucugggc

SEQ ID NO: 53470 - RNA, 20 nt, Human
agcugggccugccacguggg

SEQ ID NO: 53471 - RNA, 21 nt, Human
agcugggccugccccagggca

SEQ ID NO: 53472 - RNA, 32 nt, Human
agcugggccuggagugucccugcuccagcccu

SEQ ID NO: 53473 - RNA, 32 nt, Human
agcugggccugggaacagcccuggcuugguuc

SEQ ID NO: 53474 - RNA, 17 nt, Human
agcugggccuggggaca

SEQ ID NO: 53475 - RNA, 32 nt, Human
agcugggccuuccucaccuccgcauaauguac

SEQ ID NO: 53476 - RNA, 32 nt, Human
agcugggccuucugguuugcccucucuugacu

SEQ ID NO: 53477 - RNA, 32 nt, Human
agcugggcgagaaggcggaugagcugcagcug

SEQ ID NO: 53478 - RNA, 32 nt, Human
agcugggcgaguagcugguacuacaggugcgu

SEQ ID NO: 53479 - RNA, 32 nt, Human
agcugggcgccgacaucugggcccuguggcgc

SEQ ID NO: 53480 - RNA, 32 nt, Human
agcugggcggagcuggacagccagucucagcc

SEQ ID NO: 53481 - RNA, 32 nt, Human
agcugggcugacaggcacccaccaccacaccc

SEQ ID NO: 53482 - RNA, 32 nt, Human
agcugggcuggagaagcggccacccacucauu

SEQ ID NO: 53483 - RNA, 32 nt, Human
agcugggcugggccagccuggcccugcagggc

SEQ ID NO: 53484 - RNA, 32 nt, Human
agcugggcugugguagggggugucucaggcca

SEQ ID NO: 53485 - RNA, 32 nt, Human
agcugggcuuacaggcacccaccaccaugccc

SEQ ID NO: 53486 - RNA, 32 nt, Human
agcugggcuuacgggcacaugccaccacgccu

SEQ ID NO: 53487 - RNA, 32 nt, Human
agcuggggacugccugcugucugccaguacaa

SEQ ID NO: 53488 - RNA, 32 nt, Human
agcuggggagagaaaggaaggaaacgggaccc

SEQ ID NO: 53489 - RNA, 32 nt, Human
agcuggggagagaggggacucuccggacuccc

SEQ ID NO: 53490 - RNA, 32 nt, Human
agcuggggagaggugggcucugcuuuucagag

SEQ ID NO: 53491 - RNA, 32 nt, Human
agcuggggagauggaggcugcagugagcuaua

SEQ ID NO: 53492 - RNA, 32 nt, Human
agcuggggagccagggcugaucuaggaggcug

SEQ ID NO: 53493 - RNA, 32 nt, Human
agcuggggagggaaguggauccauuucugcua

SEQ ID NO: 53494 - RNA, 32 nt, Human
agcuggggaggucgaggcagcagugagccgag

SEQ ID NO: 53495 - RNA, 32 nt, Human
agcuggggaggugggaggccaggcgagccuga

SEQ ID NO: 53496 - RNA, 25 nt, Human
agcuggggagucacccugggccugg

SEQ ID NO: 53497 - RNA, 32 nt, Human
agcuggggcacuggagccuggcccccaggaca

SEQ ID NO: 53498 - RNA, 32 nt, Human
agcuggggcaggaagacagugaagaaggaagg

SEQ ID NO: 53499 - RNA, 32 nt, Human
agcuggggcaucucacuggagcuguuccaggc

SEQ ID NO: 53500 - RNA, 32 nt, Human
agcuggggccaggcuucucuccccaccaccug

SEQ ID NO: 53501 - RNA, 21 nt, Human
agcuggggcccagggcagcau

SEQ ID NO: 53502 - RNA, 32 nt, Human
agcuggggccuccugcuggguugaagaaggag

SEQ ID NO: 53503 - RNA, 32 nt, Human
agcuggggcuacaggcacccaccaccacgccu

SEQ ID NO: 53504 - RNA, 32 nt, Human
agcuggggcuacaggcgccugccaccacaccc

SEQ ID NO: 53505 - RNA, 32 nt, Human
agcuggggcuacaggugugugccaccauacuu

SEQ ID NO: 53506 - RNA, 32 nt, Human
agcuggggcugggcauggaggcucacaccugu

SEQ ID NO: 53507 - RNA, 32 nt, Human
agcuggggcuuagcugggagguggucugaagc

SEQ ID NO: 53508 - RNA, 32 nt, Human
agcugggggaggagggaggggugggaauugaa

SEQ ID NO: 53509 - RNA, 32 nt, Human
agcugggggaggcaguggcggcuggaguaggu

SEQ ID NO: 53510 - RNA, 32 nt, Human
agcugggggaugugugggcaagagguggauug

SEQ ID NO: 53511 - RNA, 32 nt, Human
agcugggggcccuaacacuugcaccugccuug

SEQ ID NO: 53512 - RNA, 21 nt, Human
agcugggggccuccucugagc

SEQ ID NO: 53513 - RNA, 32 nt, Human
agcugggggcggaugguggcccaggagacagc

SEQ ID NO: 53514 - RNA, 32 nt, Human
agcugggggcuccugacuguagcaggugguag

SEQ ID NO: 53515 - RNA, 32 nt, Human
agcugggggcugggacugaggccuccugcagg

SEQ ID NO: 53516 - RNA, 32 nt, Human
agcugggggcuggggcgucccucuccucucuc

SEQ ID NO: 53517 - RNA, 32 nt, Human
agcugggggugggccaggcugaugggacagaa

SEQ ID NO: 53518 - RNA, 32 nt, Human
agcugggguguuccuggaagaggucggggagc

SEQ ID NO: 53519 - RNA, 32 nt, Human
agcugggguuacaggcacgggccaccagccca

SEQ ID NO: 53520 - RNA, 32 nt, Human
agcugggguuacaggcaugcaccaccaugccu

SEQ ID NO: 53521 - RNA, 32 nt, Human
agcugggguuacaggcauuugccaccgggccc

SEQ ID NO: 53522 - RNA, 32 nt, Human
agcugggguuacaggugcacgccaccacgccu

SEQ ID NO: 53523 - RNA, 32 nt, Human
agcugggguugcaucauuuccccaaguggauc

SEQ ID NO: 53524 - RNA, 32 nt, Human
agcuggguaaaggggauucugggaguugagag

SEQ ID NO: 53525 - RNA, 32 nt, Human
agcuggguaaguaggucucagcuguucuguag

SEQ ID NO: 53526 - RNA, 32 nt, Human
agcugggucuacaggugcauaccaccaugccu

SEQ ID NO: 53527 - RNA, 32 nt, Human
agcugggucucgaacuccugaccucaggugau

SEQ ID NO: 53528 - RNA, 32 nt, Human
agcugggucugaggauucaggauuguggcguu

SEQ ID NO: 53529 - RNA, 32 nt, Human
agcugggugccaggcugaggaucacugaggaa

SEQ ID NO: 53530 - RNA, 19 nt, Human
agcugggugggccugggca

SEQ ID NO: 53531 - RNA, 32 nt, Human
agcugggugggguggcucacacccgacguaau

SEQ ID NO: 53532 - RNA, 32 nt, Human
agcugggugucaggcugggguuagugagcagg

SEQ ID NO: 53533 - RNA, 32 nt, Human
agcuggguucagacuucacacugugaguucag

SEQ ID NO: 53534 - RNA, 32 nt, Human
agcuggguugccccacugugcuuguaucugca

SEQ ID NO: 53535 - RNA, 32 nt, Human
agcuggguuuacaggcacccaccaccaugccc

SEQ ID NO: 53536 - RNA, 32 nt, Human
agcuggguuuacagguaugcaccaccacgccc

SEQ ID NO: 53537 - RNA, 32 nt, Human
agcuggguuuacaggugccugccagcacgccc

SEQ ID NO: 53538 - RNA, 30 nt, Human
agcuggguuucugagucagaaagacuuggu

SEQ ID NO: 53539 - RNA, 32 nt, Human
agcugguaaauuguuccauccagaccuugggc

SEQ ID NO: 53540 - RNA, 32 nt, Human
agcugguaccucaguggggaggcuuccuuacc

SEQ ID NO: 53541 - RNA, 32 nt, Human
agcugguacuacaggcuccugccaccacgccc

SEQ ID NO: 53542 - RNA, 32 nt, Human
agcugguacuacaggugcgugccaccacaccu

SEQ ID NO: 53543 - RNA, 32 nt, Human
agcugguacuacaggugcgugccaccaugcuu

SEQ ID NO: 53544 - RNA, 32 nt, Human
agcugguaggagagggaaggcaaaaucuuucu

SEQ ID NO: 53545 - RNA, 32 nt, Human
agcugguaucacaggcgucccccaccacgccu

SEQ ID NO: 53546 - RNA, 32 nt, Human
agcugguauuagacacgauaaagacucugugg

SEQ ID NO: 53547 - RNA, 32 nt, Human
agcugguauugauguagaaccagugcauaacu

SEQ ID NO: 53548 - RNA, 21 nt, Human
agcuggucauuucgccuggga

SEQ ID NO: 53549 - RNA, 32 nt, Human
agcuggucccaaugcuagaaugaucuuuguuc

SEQ ID NO: 53550 - RNA, 32 nt, Human
agcuggucgccaccccugggccuuuccaucuc

SEQ ID NO: 53551 - RNA, 32 nt, Human
agcuggucuaccgaugcacagcaaccagccaa

SEQ ID NO: 53552 - RNA, 32 nt, Human
agcuggucuagacuguuugcugauccccaacc

SEQ ID NO: 53553 - RNA, 32 nt, Human
agcuggucucaaaccccugggcucaagcaagc

SEQ ID NO: 53554 - RNA, 32 nt, Human
agcuggucucaaacuccugaccucagguaauc

SEQ ID NO: 53555 - RNA, 32 nt, Human
agcuggucucaaacuccugaccucaggugauc

SEQ ID NO: 53556 - RNA, 32 nt, Human
agcuggucucaaacuccugaccucaggugaug

SEQ ID NO: 53557 - RNA, 32 nt, Human
agcuggucucaaacuccugaccuuaguugauc

SEQ ID NO: 53558 - RNA, 32 nt, Human
agcuggucucaaacuccuggccucaagcaguc

SEQ ID NO: 53559 - RNA, 32 nt, Human
agcuggucucaaacuccugggcucaagcgauc

SEQ ID NO: 53560 - RNA, 32 nt, Human
agcuggucucaaacuccuggguucaagccauc

SEQ ID NO: 53561 - RNA, 32 nt, Human
agcuggucucaaacugcugggcuuaugggauc

SEQ ID NO: 53562 - RNA, 32 nt, Human
agcuggucucaagcuccugggcucaagcaauc

SEQ ID NO: 53563 - RNA, 32 nt, Human
agcuggucuccccaggcaagaagguauccucu

SEQ ID NO: 53564 - RNA, 32 nt, Human
agcuggucuccucucuguugcucaauguuacc

SEQ ID NO: 53565 - RNA, 32 nt, Human
agcuggucucgaacuccugaccucaggcgauc

SEQ ID NO: 53566 - RNA, 32 nt, Human
agcuggucucgaacuccugaccucgugauccg

SEQ ID NO: 53567 - RNA, 32 nt, Human
agcuggucuggggagcauugacugccugggag

SEQ ID NO: 53568 - RNA, 32 nt, Human
agcuggucuugaacuccugacccucaugaucc

SEQ ID NO: 53569 - RNA, 32 nt, Human
agcuggucuugaacuccugaccucaggugauc

SEQ ID NO: 53570 - RNA, 32 nt, Human
agcuggucuugaacuccugacuucaugaucug

SEQ ID NO: 53571 - RNA, 22 nt, Human
agcuggugcagucugggccuga

SEQ ID NO: 53572 - RNA, 32 nt, Human
agcuggugccaaauagccccagacugggccca

SEQ ID NO: 53573 - RNA, 32 nt, Human
agcuggugccccaaaacuuccaccucccuccc

SEQ ID NO: 53574 - RNA, 18 nt, Human
agcuggugcggcuggcca

SEQ ID NO: 53575 - RNA, 32 nt, Human
agcuggugcuauggucuguucuuuaguucuag

SEQ ID NO: 53576 - RNA, 20 nt, Human
agcuggugcuggccugaggc

SEQ ID NO: 53577 - RNA, 21 nt, Human
agcuggugcuguucucagaug

SEQ ID NO: 53578 - RNA, 32 nt, Human
agcugguggacuccuguggcuaccccaucaga

SEQ ID NO: 53579 - RNA, 32 nt, Human
agcugguggcacccuccccugggccggaagac

SEQ ID NO: 53580 - RNA, 32 nt, Human
agcugguggccaggaccucauggaucagcaag

SEQ ID NO: 53581 - RNA, 31 nt, Human
agcugguggcucucuggugagcuagugucuc

SEQ ID NO: 53582 - RNA, 32 nt, Human
agcuggugggaaaggaggguucuggaaggcuu

SEQ ID NO: 53583 - RNA, 32 nt, Human
agcuggugggccgagaggcaggaagcagccuu

SEQ ID NO: 53584 - RNA, 32 nt, Human
agcuggugggcgggcaggaucugcugggcugg

SEQ ID NO: 53585 - RNA, 18 nt, Human
agcuggugggggagcuga

SEQ ID NO: 53586 - RNA, 32 nt, Human
agcugguggugccugcugucccagggagaguu

SEQ ID NO: 53587 - RNA, 32 nt, Human
agcuggugguuugaucauuucugccaugaugu

SEQ ID NO: 53588 - RNA, 32 nt, Human
agcuggugucagggagagaaacccaaccccac

SEQ ID NO: 53589 - RNA, 32 nt, Human
agcugguguccuagcaggagacuaacuagcug

SEQ ID NO: 53590 - RNA, 29 nt, Human
agcuggugucugugggugccaagggcagc

SEQ ID NO: 53591 - RNA, 32 nt, Human
agcugguuaccuuucugccugcccugugucgu

SEQ ID NO: 53592 - RNA, 32 nt, Human
agcugguuccaucugaggauacauacucuggg

SEQ ID NO: 53593 - RNA, 19 nt, Human
agcugguuccucccuggga

SEQ ID NO: 53594 - RNA, 18 nt, Human
agcugguugcuugaacug

SEQ ID NO: 53595 - RNA, 32 nt, Human
agcugguugguguggagggaaaggcuuacaca

SEQ ID NO: 53596 - RNA, 32 nt, Human
agcugguugucuucuugccugcccuguguugu

SEQ ID NO: 53597 - RNA, 32 nt, Human
agcugguuucucucauugcuuuuucuaaaucu

SEQ ID NO: 53598 - RNA, 32 nt, Human
agcugguuugaaugagacugggucauaaguga

SEQ ID NO: 53599 - RNA, 32 nt, Human
agcuguaaaccucacuggugaacguucaccuu

SEQ ID NO: 53600 - RNA, 22 nt, Human
agcuguaagaaaauaaauuucu

SEQ ID NO: 53601 - RNA, 22 nt, Human
agcuguaaggcccuacuacaga

SEQ ID NO: 53602 - RNA, 32 nt, Human
agcuguaaucacacuaaagauaucccugcccu

SEQ ID NO: 53603 - RNA, 23 nt, Human
agcuguaaucccagcuacuuggg

SEQ ID NO: 53604 - RNA, 32 nt, Human
agcuguacauaaaaguagcugauauuaguuag

SEQ ID NO: 53605 - RNA, 32 nt, Human
agcuguaccaaaacaaaaagccuguacucaca

SEQ ID NO: 53606 - RNA, 32 nt, Human
agcuguaccccacauucauuaggaaucuuggc

SEQ ID NO: 53607 - RNA, 21 nt, Human
agcuguaccugccccacccca

SEQ ID NO: 53608 - RNA, 32 nt, Human
agcuguacuacaaggaagaagggcagcaggag

SEQ ID NO: 53609 - RNA, 32 nt, Human
agcuguacuguugcucaauaaagcaccucuuc

SEQ ID NO: 53610 - RNA, 32 nt, Human
agcuguacuguugcucaauaaagcaccucuuu

SEQ ID NO: 53611 - RNA, 32 nt, Human
agcuguacuuuugauagcugugccaggaaggg

SEQ ID NO: 53612 - RNA, 32 nt, Human
agcuguagaccaacuuaacacugaacccauua

SEQ ID NO: 53613 - RNA, 18 nt, Human
agcuguagaggaccagga

SEQ ID NO: 53614 - RNA, 32 nt, Human
agcuguagugccauuagaaacugugaauuucc

SEQ ID NO: 53615 - RNA, 32 nt, Human
agcuguaucccaagugcacuguccuucugucc

SEQ ID NO: 53616 - RNA, 32 nt, Human
agcuguauuuagaacaaaucacuccgaagcaa

SEQ ID NO: 53617 - RNA, 32 nt, Human
agcugucaacacagcauccgccuugugggacu

SEQ ID NO: 53618 - RNA, 32 nt, Human
agcugucaacauccuggaagcuuugaagcuca

SEQ ID NO: 53619 - RNA, 31 nt, Human
agcugucacagcugggcagccagcugcaggg

SEQ ID NO: 53620 - RNA, 32 nt, Human
agcugucaccuucucccugucucagcugaggg

SEQ ID NO: 53621 - RNA, 32 nt, Human
agcugucaccuugcucccuccaccuccccucg

SEQ ID NO: 53622 - RNA, 32 nt, Human
agcugucagaggacugugucuccuggagcugu

SEQ ID NO: 53623 - RNA, 32 nt, Human
agcugucaggaaaucuggcucaguccccagac

SEQ ID NO: 53624 - RNA, 32 nt, Human
agcugucagucaacucugcuucccaggggcag

SEQ ID NO: 53625 - RNA, 22 nt, Human
agcugucaucagaagcugugag

SEQ ID NO: 53626 - RNA, 32 nt, Human
agcugucaucugcagccucugccuccagcccg

SEQ ID NO: 53627 - RNA, 32 nt, Human
agcugucaugcaccaugagacaaagcccaagc

SEQ ID NO: 53628 - RNA, 32 nt, Human
agcugucauguuuauaauucaaacauguagua

SEQ ID NO: 53629 - RNA, 24 nt, Human
agcugucauucaggacacuaggag

SEQ ID NO: 53630 - RNA, 32 nt, Human
agcugucauucugcugguggcuuccugcgucu

SEQ ID NO: 53631 - RNA, 32 nt, Human
agcugucauugagccucuuggaggaugguggg

SEQ ID NO: 53632 - RNA, 32 nt, Human
agcuguccacacugaagaacauguccuacaac

SEQ ID NO: 53633 - RNA, 32 nt, Human
agcugucccacccaggcccauccucugcagcc

SEQ ID NO: 53634 - RNA, 32 nt, Human
agcuguccccaggucacagaagggagaggaca

SEQ ID NO: 53635 - RNA, 23 nt, Human
agcuguccccccguccuccuccc

SEQ ID NO: 53636 - RNA, 32 nt, Human
agcugucccucacucugccauuucagcagcuc

SEQ ID NO: 53637 - RNA, 32 nt, Human
agcugucccugccucaauucaacaccaccagc

SEQ ID NO: 53638 - RNA, 18 nt, Human
agcugucccuugcuugcc

SEQ ID NO: 53639 - RNA, 32 nt, Human
agcugucccuuuccaagcagucucuggugcuu

SEQ ID NO: 53640 - RNA, 32 nt, Human
agcuguccgcaggcaccagccccagccuccca

SEQ ID NO: 53641 - RNA, 23 nt, Human
agcuguccguucaggaccaugag

SEQ ID NO: 53642 - RNA, 32 nt, Human
agcuguccuauggugaccucaggacuuggcug

SEQ ID NO: 53643 - RNA, 32 nt, Human
agcuguccuccccuuggugcuccucuuccucc

SEQ ID NO: 53644 - RNA, 19 nt, Human
agcuguccuguguguggua

SEQ ID NO: 53645 - RNA, 32 nt, Human
agcuguccuugaggaaccuuugguguguggug

SEQ ID NO: 53646 - RNA, 32 nt, Human
agcuguccuuuccccauuguguguucuuggca

SEQ ID NO: 53647 - RNA, 32 nt, Human
agcugucgagagcagcccugcccagauugcgg

SEQ ID NO: 53648 - RNA, 32 nt, Human
agcugucggaaugcagccuaaccaaaggucaa

SEQ ID NO: 53649 - RNA, 32 nt, Human
agcugucgggcaucccugucucagggacuucu

SEQ ID NO: 53650 - RNA, 32 nt, Human
agcugucuauguauguuauagauauguagaua

SEQ ID NO: 53651 - RNA, 32 nt, Human
agcugucucaaaccuccaaaagcccugaguuu

SEQ ID NO: 53652 - RNA, 32 nt, Human
agcugucucagaauuccuccuccugggacucu

SEQ ID NO: 53653 - RNA, 32 nt, Human
agcugucucagggcucugggcuucauucccug

SEQ ID NO: 53654 - RNA, 32 nt, Human
agcugucuccaucccccuuuuccgccucucuc

SEQ ID NO: 53655 - RNA, 32 nt, Human
agcugucucccuucugacauuuccuaggaagc

SEQ ID NO: 53656 - RNA, 32 nt, Human
agcugucuccguaaauggaggaaaugugggga

SEQ ID NO: 53657 - RNA, 32 nt, Human
agcugucuccuggcccugacuuuucuaagaug

SEQ ID NO: 53658 - RNA, 32 nt, Human
agcugucugaagaacagugagguggagugccu

SEQ ID NO: 53659 - RNA, 32 nt, Human
agcugucugaguuuuuaaauagcuaauacgac

SEQ ID NO: 53660 - RNA, 31 nt, Human
agcugucugcccucugggcuuggguaggggc

SEQ ID NO: 53661 - RNA, 32 nt, Human
agcugucuggacugcaaggaggcugggcacgg

SEQ ID NO: 53662 - RNA, 22 nt, Human
agcugucugugccucucuggga

SEQ ID NO: 53663 - RNA, 32 nt, Human
agcugucuguuccugcucacacugccagaauc

SEQ ID NO: 53664 - RNA, 32 nt, Human
agcugucuugcccaggcuggaguucaggggcu

SEQ ID NO: 53665 - RNA, 32 nt, Human
agcugucuuguccuugcugguuuucuggaugg

SEQ ID NO: 53666 - RNA, 32 nt, Human
agcugugaaauguuuuucucuuuuggaaaagg

SEQ ID NO: 53667 - RNA, 32 nt, Human
agcugugaacaaccaugggcaugaagauuucu

SEQ ID NO: 53668 - RNA, 32 nt, Human
agcugugaacacugcugccucuucccagccuc

SEQ ID NO: 53669 - RNA, 32 nt, Human
agcugugaacccaugaggcuugccaaguaggg

SEQ ID NO: 53670 - RNA, 32 nt, Human
agcugugaagcauaugcugugagacaacacag

SEQ ID NO: 53671 - RNA, 23 nt, Human
agcugugaaucagccagcaauau

SEQ ID NO: 53672 - RNA, 32 nt, Human
agcugugacuacaggcgcaugccaucacgcac

SEQ ID NO: 53673 - RNA, 32 nt, Human
agcugugacuccaagguuuuccuuucccauag

SEQ ID NO: 53674 - RNA, 23 nt, Human
agcugugagaaauaaauuucugu

SEQ ID NO: 53675 - RNA, 24 nt, Human
agcugugagacaauaaauuucugu

SEQ ID NO: 53676 - RNA, 32 nt, Human
agcugugagccccagccccaccugacuccagc

SEQ ID NO: 53677 - RNA, 32 nt, Human
agcugugaggaggaguuccagcaacagaaguu

SEQ ID NO: 53678 - RNA, 32 nt, Human
agcugugaggcugcgcucugcguguugugcgu

SEQ ID NO: 53679 - RNA, 32 nt, Human
agcugugagugaggggacaaggggcagguccc

SEQ ID NO: 53680 - RNA, 18 nt, Human
agcugugaucacaccacu

SEQ ID NO: 53681 - RNA, 18 nt, Human
agcugugaucauaccacu

SEQ ID NO: 53682 - RNA, 32 nt, Human
agcugugaucauaccacugcacuccagccugg

SEQ ID NO: 53683 - RNA, 18 nt, Human
agcugugaucgcaccacu

SEQ ID NO: 53684 - RNA, 32 nt, Human
agcugugauuaaaggcgccugccaccaugacu

SEQ ID NO: 53685 - RNA, 18 nt, Human
agcugugauuacaccacu

SEQ ID NO: 53686 - RNA, 23 nt, Human
agcugugauuacaccacugcacu

SEQ ID NO: 53687 - RNA, 32 nt, Human
agcugugauuacaggcaugcgccaccaugccu

SEQ ID NO: 53688 - RNA, 32 nt, Human
agcugugauuacaggcgugcaccaccacgccc

SEQ ID NO: 53689 - RNA, 32 nt, Human
agcugugauuguaccacugcacuccagcucgg

SEQ ID NO: 53690 - RNA, 23 nt, Human
agcugugauugugccacugcacu

SEQ ID NO: 53691 - RNA, 32 nt, Human
agcugugcaacuacuacugagaucagauacag

SEQ ID NO: 53692 - RNA, 32 nt, Human
agcugugccacucugggcaaaugcucuuccuu

SEQ ID NO: 53693 - RNA, 32 nt, Human
agcugugccagcugcuucugcccaccccgccu

SEQ ID NO: 53694 - RNA, 32 nt, Human
agcugugccccagcuguuccagcagcuugucu

SEQ ID NO: 53695 - RNA, 32 nt, Human
agcugugccuggaggcagucggccugcagugc

SEQ ID NO: 53696 - RNA, 32 nt, Human
agcugugccuucauuaguuugcuauagaaauc

SEQ ID NO: 53697 - RNA, 20 nt, Human
agcugugcguuuugcuauca

SEQ ID NO: 53698 - RNA, 32 nt, Human
agcugugcuccugguggaagcaagggagccca

SEQ ID NO: 53699 - RNA, 32 nt, Human
agcugugcugccgccaccucugcuccagagug

SEQ ID NO: 53700 - RNA, 32 nt, Human
agcugugcugccugcccucuaguaaguacuua

SEQ ID NO: 53701 - RNA, 32 nt, Human
agcugugcuucaguuucucucacuuugcccug

SEQ ID NO: 53702 - RNA, 32 nt, Human
agcuguggaagucugcagucuacaggagccua

SEQ ID NO: 53703 - RNA, 32 nt, Human
agcuguggaaugcagaggcaugggguugugug

SEQ ID NO: 53704 - RNA, 32 nt, Human
agcuguggagccaaugaaguaacaguagagau

SEQ ID NO: 53705 - RNA, 32 nt, Human
agcuguggagcugccuccucuccaggccuggc

SEQ ID NO: 53706 - RNA, 32 nt, Human
agcuguggaggcuggauuccaggcucccuccg

SEQ ID NO: 53707 - RNA, 32 nt, Human
agcuguggcaggcagaucacgaggucaggagu

SEQ ID NO: 53708 - RNA, 32 nt, Human
agcuguggcauggcgucacauaugcauuuaag

SEQ ID NO: 53709 - RNA, 32 nt, Human
agcuguggcccuuuccacucucuccuggccuc

SEQ ID NO: 53710 - RNA, 32 nt, Human
agcuguggccucccccuugccuuuaaccucua

SEQ ID NO: 53711 - RNA, 32 nt, Human
agcuguggcucacaccuguaaucccagcauuu

SEQ ID NO: 53712 - RNA, 32 nt, Human
agcuguggcucugccaugccgggcuguguuug

SEQ ID NO: 53713 - RNA, 32 nt, Human
agcuguggcuucucuagguucuaggggugcaa

SEQ ID NO: 53714 - RNA, 32 nt, Human
agcugugggaccuugggcaaguugccuuugug

SEQ ID NO: 53715 - RNA, 32 nt, Human
agcugugggaggagcuggaggcuucaccgugg

SEQ ID NO: 53716 - RNA, 32 nt, Human
agcugugggcggagcuaguaggggcgggcuac

SEQ ID NO: 53717 - RNA, 31 nt, Human
agcuguggggacacggcccagaugcucuggu

SEQ ID NO: 53718 - RNA, 32 nt, Human
agcuguggggcugguccauguugcccacucac

SEQ ID NO: 53719 - RNA, 32 nt, Human
agcugugggggcaguggggugggggagaccca

SEQ ID NO: 53720 - RNA, 32 nt, Human
agcugugggugaggacggcucuagcuagguga

SEQ ID NO: 53721 - RNA, 32 nt, Human
agcugugggugaggacggcucuagcuaguucc

SEQ ID NO: 53722 - RNA, 32 nt, Human
agcuguggguucgagguggaggcugcagcuga

SEQ ID NO: 53723 - RNA, 32 nt, Human
agcuguggugagccacuggcauugggcaggcg

SEQ ID NO: 53724 - RNA, 32 nt, Human
agcuguggugugagagggugaagccagagaac

SEQ ID NO: 53725 - RNA, 32 nt, Human
agcuguggugugagagggugaaggcggcgcug

SEQ ID NO: 53726 - RNA, 32 nt, Human
agcuguggugugugauggacauggaagcagug

SEQ ID NO: 53727 - RNA, 32 nt, Human
agcugugguugauuccuguguggcaguaaauu

SEQ ID NO: 53728 - RNA, 32 nt, Human
agcuguguacuaauaaagacugcagcaagcac

SEQ ID NO: 53729 - RNA, 32 nt, Human
agcuguguagaaguccuagcauuauaggaucu

SEQ ID NO: 53730 - RNA, 32 nt, Human
agcuguguccagggcuggagucagagccugcu

SEQ ID NO: 53731 - RNA, 32 nt, Human
agcugugucccagcaaggaagggaaaccauca

SEQ ID NO: 53732 - RNA, 32 nt, Human
agcugugucccccaguccgugucuuuuuagaa

SEQ ID NO: 53733 - RNA, 32 nt, Human
agcuguguccuucuauucaucuuccuaucccc

SEQ ID NO: 53734 - RNA, 31 nt, Human
agcugugugacugacugacaugacagaagug

SEQ ID NO: 53735 - RNA, 32 nt, Human
agcugugugagcucuucugccaaggggguccu

SEQ ID NO: 53736 - RNA, 32 nt, Human
agcugugugauggaagaacaaaaccaaacaua

SEQ ID NO: 53737 - RNA, 32 nt, Human
agcuguguggugcucuugccgccccuuccugg

SEQ ID NO: 53738 - RNA, 32 nt, Human
agcuguguucccugucucaggucaagcagugg

SEQ ID NO: 53739 - RNA, 32 nt, Human
agcuguguucuucccagcucccaagcccugug

SEQ ID NO: 53740 - RNA, 20 nt, Human
agcuguuacccacucuggga

SEQ ID NO: 53741 - RNA, 32 nt, Human
agcuguuacccacucugggaccagcagucuuu

SEQ ID NO: 53742 - RNA, 32 nt, Human
agcuguuacugcuccagagaagccacagaagc

SEQ ID NO: 53743 - RNA, 32 nt, Human
agcuguuagaggcccaggcugucugccugcgg

SEQ ID NO: 53744 - RNA, 32 nt, Human
agcuguuaguaauacacgaaguugauugaggc

SEQ ID NO: 53745 - RNA, 32 nt, Human
agcuguucaccauggauuccgacuggggcagg

SEQ ID NO: 53746 - RNA, 32 nt, Human
agcuguucaugcugggacugacagccugcagg

SEQ ID NO: 53747 - RNA, 32 nt, Human
agcuguuccauuuccauauucucccuuauuag

SEQ ID NO: 53748 - RNA, 32 nt, Human
agcuguucccacucuucucucuuccuccagag

SEQ ID NO: 53749 - RNA, 32 nt, Human
agcuguuccccagcugcagggagacuggagug

SEQ ID NO: 53750 - RNA, 32 nt, Human
agcuguuccugccucuuccgucaagcaagggg

SEQ ID NO: 53751 - RNA, 19 nt, Human
agcuguucuccaggugcgu

SEQ ID NO: 53752 - RNA, 32 nt, Human
agcuguucucugcuuuuccauucuggguguuu

SEQ ID NO: 53753 - RNA, 32 nt, Human
agcuguucugguggcuuccacucugaggugug

SEQ ID NO: 53754 - RNA, 32 nt, Human
agcuguucuucagcccucuauacuuuuucaua

SEQ ID NO: 53755 - RNA, 32 nt, Human
agcuguuggacaccugccuucucauguggaca

SEQ ID NO: 53756 - RNA, 32 nt, Human
agcuguuggacuggcugccucaccuaggaccc

SEQ ID NO: 53757 - RNA, 32 nt, Human
agcuguuggcggugcagggaggaggacgccgg

SEQ ID NO: 53758 - RNA, 21 nt, Human
agcuguuggcuuucucugagg

SEQ ID NO: 53759 - RNA, 32 nt, Human
agcuguuggggagggguggcaggcaggguggg

SEQ ID NO: 53760 - RNA, 32 nt, Human
agcuguuuaucaugaugcugucccuccugaug

SEQ ID NO: 53761 - RNA, 32 nt, Human
agcuguuucacucgcauccagagggccaccug

SEQ ID NO: 53762 - RNA, 32 nt, Human
agcuguuucagggguuuccuggaccacccacu

SEQ ID NO: 53763 - RNA, 32 nt, Human
agcuguuuccagggugacagaguggcgaccuc

SEQ ID NO: 53764 - RNA, 32 nt, Human
agcuguuucccaucagcuuccugcaugcuucc

SEQ ID NO: 53765 - RNA, 32 nt, Human
agcuguuucucagcccagaggugcuaagagga

SEQ ID NO: 53766 - RNA, 32 nt, Human
agcuguuucucugacuccuuguggcaucagau

SEQ ID NO: 53767 - RNA, 32 nt, Human
agcuguuucuguaccuuggaacagucuucccu

SEQ ID NO: 53768 - RNA, 32 nt, Human
agcuguuugaaggaaagaauauggauuuuuca

SEQ ID NO: 53769 - RNA, 32 nt, Human
agcuuaaacucaugauaaugcugcgaugugug

SEQ ID NO: 53770 - RNA, 32 nt, Human
agcuuaaagcuuggcacuagagcccagugcug

SEQ ID NO: 53771 - RNA, 32 nt, Human
agcuuaacaacuuccuccuacucucauuggcc

SEQ ID NO: 53772 - RNA, 32 nt, Human
agcuuaacaugaauaacaaagacuggcucagg

SEQ ID NO: 53773 - RNA, 32 nt, Human
agcuuaacccaaggcuuuuuaaauaagaucau

SEQ ID NO: 53774 - RNA, 32 nt, Human
agcuuaacuucauguaaagucuucacugccag

SEQ ID NO: 53775 - RNA, 32 nt, Human
agcuuaagacacaccugccuucauuucaacca

SEQ ID NO: 53776 - RNA, 32 nt, Human
agcuuaagccgggcaggcgagcgaaugacgga

SEQ ID NO: 53777 - RNA, 32 nt, Human
agcuuaagggaggcggcggcagcgcggcggug

SEQ ID NO: 53778 - RNA, 23 nt, Human
agcuuaaugcaaccucuaccucc

SEQ ID NO: 53779 - RNA, 32 nt, Human
agcuuaaugcaaccucuaccucccagguucaa

SEQ ID NO: 53780 - RNA, 32 nt, Human
agcuuaauucugcaaucauuugucuuuuauaa

SEQ ID NO: 53781 - RNA, 32 nt, Human
agcuuacaccuauaaucccagcacuuugggag

SEQ ID NO: 53782 - RNA, 32 nt, Human
agcuuacaccuguaaucugagcgcuuugggag

SEQ ID NO: 53783 - RNA, 32 nt, Human
agcuuacagugagccgagaucacaccacugca

SEQ ID NO: 53784 - RNA, 32 nt, Human
agcuuaccaagaaacccaugucagcaaccgca

SEQ ID NO: 53785 - RNA, 16 nt, Human
agcuuaccuacuguua

SEQ ID NO: 53786 - RNA, 32 nt, Human
agcuuaccuuccuggagaugacaugcauagaa

SEQ ID NO: 53787 - RNA, 20 nt, Human
agcuuaccuuucugcuagga

SEQ ID NO: 53788 - RNA, 32 nt, Human
agcuuaccuuuugccuuucuguugauguuaca

SEQ ID NO: 53789 - RNA, 32 nt, Human
agcuuacgccuguaaucccagcacuuugagag

SEQ ID NO: 53790 - RNA, 32 nt, Human
agcuuacgccuguuaucccagcacuuugggag

SEQ ID NO: 53791 - RNA, 32 nt, Human
agcuuacuacagccaggucuccucucugcggc

SEQ ID NO: 53792 - RNA, 32 nt, Human
agcuuacuauguguugggucugguuuuguuug

SEQ ID NO: 53793 - RNA, 32 nt, Human
agcuuacucaggaaaugaaaacaaaugauggu

SEQ ID NO: 53794 - RNA, 24 nt, Human
agcuuacugcaaccuccaccuccu

SEQ ID NO: 53795 - RNA, 32 nt, Human
agcuuacugcaaccucugccucccggguucaa

SEQ ID NO: 53796 - RNA, 32 nt, Human
agcuuacugcaaccucugucucccggguucaa

SEQ ID NO: 53797 - RNA, 32 nt, Human
agcuuacugcaagcuccgccuccuggguucac

SEQ ID NO: 53798 - RNA, 32 nt, Human
agcuuacugcacccucaaccuccugggcucaa

SEQ ID NO: 53799 - RNA, 32 nt, Human
agcuuacugcacccucugccucccgguuucaa

SEQ ID NO: 53800 - RNA, 24 nt, Human
agcuuacugcagccucaaccuccu

SEQ ID NO: 53801 - RNA, 32 nt, Human
agcuuacugcagccucaaccuccugggcucag

SEQ ID NO: 53802 - RNA, 32 nt, Human
agcuuacugcagccucgaacuccugagcucaa

SEQ ID NO: 53803 - RNA, 32 nt, Human
agcuuacugcagccuugaccucccaggcucag

SEQ ID NO: 53804 - RNA, 32 nt, Human
agcuuacugcagcuuccaucucccagguucaa

SEQ ID NO: 53805 - RNA, 32 nt, Human
agcuuacuguaaccucugccuccuggauucaa

SEQ ID NO: 53806 - RNA, 32 nt, Human
agcuuacuguaccuuccaacuccuggguucaa

SEQ ID NO: 53807 - RNA, 32 nt, Human
agcuuagaaguggugugugcucugucugucug

SEQ ID NO: 53808 - RNA, 32 nt, Human
agcuuagagaaaccuccaggagacugcuacca

SEQ ID NO: 53809 - RNA, 32 nt, Human
agcuuagagaaaccuccaggagacugcuauca

SEQ ID NO: 53810 - RNA, 32 nt, Human
agcuuagagccacgccugguaccauuuacaug

SEQ ID NO: 53811 - RNA, 32 nt, Human
agcuuagagccaguauuuauacuuugugguua

SEQ ID NO: 53812 - RNA, 32 nt, Human
agcuuagcaagucugcagcccagccccaccuc

SEQ ID NO: 53813 - RNA, 32 nt, Human
agcuuagcacagugccugguaaugagcaagca

SEQ ID NO: 53814 - RNA, 32 nt, Human
agcuuagcagggagcuaugcuucaccuccaug

SEQ ID NO: 53815 - RNA, 32 nt, Human
agcuuagcccaguuuccagggaagcauuguuu

SEQ ID NO: 53816 - RNA, 19 nt, Human
agcuuagcugccucagaga

SEQ ID NO: 53817 - RNA, 32 nt, Human
agcuuaggaccggaagagagaauuggagcugu

SEQ ID NO: 53818 - RNA, 32 nt, Human
agcuuaggagguugaggcugcagugagcugug

SEQ ID NO: 53819 - RNA, 32 nt, Human
agcuuagggaaagagaauaaauuuuagauuau

SEQ ID NO: 53820 - RNA, 32 nt, Human
agcuuagugaugacgaccacugucagccauaa

SEQ ID NO: 53821 - RNA, 32 nt, Human
agcuuagugcugggacuagcccagaaacuuga

SEQ ID NO: 53822 - RNA, 32 nt, Human
agcuuaguggaagcucugcucuggguggagag

SEQ ID NO: 53823 - RNA, 32 nt, Human
agcuuaguuccaaugcauuuggcuccagaaag

SEQ ID NO: 53824 - RNA, 32 nt, Human
agcuuaguuggcagcacucuccacacuucugu

SEQ ID NO: 53825 - RNA, 32 nt, Human
agcuuauaagagggcauauacagugaagagua

SEQ ID NO: 53826 - RNA, 32 nt, Human
agcuuauaccuguaauccuagcacuuugggag

SEQ ID NO: 53827 - RNA, 32 nt, Human
agcuuauaucccugaauucugauacuuaagag

SEQ ID NO: 53828 - RNA, 32 nt, Human
agcuuauauucagauccuaucuucauuugaau

SEQ ID NO: 53829 - RNA, 32 nt, Human
agcuuaucaaaggcaggagcuaccagcgaggg

SEQ ID NO: 53830 - RNA, 32 nt, Human
agcuuauccgagagaaagaugaggagcugcgg

SEQ ID NO: 53831 - RNA, 32 nt, Human
agcuuaucugcaggauguuucagaucugauaa

SEQ ID NO: 53832 - RNA, 31 nt, Human
agcuuaucugggagagaaacaaggccuggug

SEQ ID NO: 53833 - RNA, 32 nt, Human
agcuuaugacuuucccaccugugucauccauu

SEQ ID NO: 53834 - RNA, 32 nt, Human
agcuuaugagggcaaugggggcaccuaaacuc

SEQ ID NO: 53835 - RNA, 31 nt, Human
agcuuauggguggaugggggugggauggaag

SEQ ID NO: 53836 - RNA, 32 nt, Human
agcuuaugucuguaaucccagcacuuuugaga

SEQ ID NO: 53837 - RNA, 32 nt, Human
agcuuauuacaaccucugccuccugggcucaa

SEQ ID NO: 53838 - RNA, 32 nt, Human
agcuuauugcagucuccaccuccugaguucaa

SEQ ID NO: 53839 - RNA, 32 nt, Human
agcuuauuguacuggccugcaccagaagaugu

SEQ ID NO: 53840 - RNA, 32 nt, Human
agcuuauuuuggugaagcacaucuucuaguaa

SEQ ID NO: 53841 - RNA, 32 nt, Human
agcuucaaaccagacucugugcugcuucugcu

SEQ ID NO: 53842 - RNA, 22 nt, Human
agcuucaaacucuugggcucaa

SEQ ID NO: 53843 - RNA, 32 nt, Human
agcuucaaagagaagcuguauuuacaggagaa

SEQ ID NO: 53844 - RNA, 32 nt, Human
agcuucaaagagaagcugucuuuacaggagaa

SEQ ID NO: 53845 - RNA, 32 nt, Human
agcuucaaaggauugguggagacuaugcaugg

SEQ ID NO: 53846 - RNA, 22 nt, Human
agcuucaacuuccugggcucaa

SEQ ID NO: 53847 - RNA, 32 nt, Human
agcuucaagaucaagacugccuacgaggaguc

SEQ ID NO: 53848 - RNA, 32 nt, Human
agcuucaagccaagggcugaccuucucccagg

SEQ ID NO: 53849 - RNA, 32 nt, Human
agcuucaaggcagaaggaaaaacaggaaaagc

SEQ ID NO: 53850 - RNA, 32 nt, Human
agcuucaagguuuggauucaggauuuguuccu

SEQ ID NO: 53851 - RNA, 32 nt, Human
agcuucaccaccaaggagagagguugacauga

SEQ ID NO: 53852 - RNA, 32 nt, Human
agcuucaccacugcccaggugggugacuuuga

SEQ ID NO: 53853 - RNA, 32 nt, Human
agcuucaccgaggggagagggaaaguaagccu

SEQ ID NO: 53854 - RNA, 32 nt, Human
agcuucaccuggagagcugcuuuugcucagua

SEQ ID NO: 53855 - RNA, 32 nt, Human
agcuucacucacugucaaugauuauuuucauu

SEQ ID NO: 53856 - RNA, 32 nt, Human
agcuucacucuccaccaccuggauggcauggc

SEQ ID NO: 53857 - RNA, 32 nt, Human
agcuucacuuccucuuugaggauggagucgca

SEQ ID NO: 53858 - RNA, 32 nt, Human
agcuucagagcccaacuuucagccagacagga

SEQ ID NO: 53859 - RNA, 32 nt, Human
agcuucagaugggaagaagucagaggaaccag

SEQ ID NO: 53860 - RNA, 20 nt, Human
agcuucagccccagcagcuc

SEQ ID NO: 53861 - RNA, 32 nt, Human
agcuucagccuccagcuuuaacuucugucugc

SEQ ID NO: 53862 - RNA, 32 nt, Human
agcuucagccuccugaguagcugagauuacag

SEQ ID NO: 53863 - RNA, 32 nt, Human
agcuucagccugaagacaagggagcagucccu

SEQ ID NO: 53864 - RNA, 32 nt, Human
agcuucagcucacagcaacacaaugcagcuga

SEQ ID NO: 53865 - RNA, 32 nt, Human
agcuucagcuguagccaccccaguuucaggag

SEQ ID NO: 53866 - RNA, 32 nt, Human
agcuucaggcugggcacgguggcucacagcua

SEQ ID NO: 53867 - RNA, 32 nt, Human
agcuucaguauuacagagccacaggccgccuc

SEQ ID NO: 53868 - RNA, 32 nt, Human
agcuucauccuauccggaggcacagcacauga

SEQ ID NO: 53869 - RNA, 32 nt, Human
agcuucauggagccaugaaaauacagauuagg

SEQ ID NO: 53870 - RNA, 32 nt, Human
agcuucaugguggaauuaauuucugccagcuc

SEQ ID NO: 53871 - RNA, 32 nt, Human
agcuucauuaacacaaucaagaccaugcacau

SEQ ID NO: 53872 - RNA, 32 nt, Human
agcuucauuuccugucuuaaaaucucguuuuc

SEQ ID NO: 53873 - RNA, 32 nt, Human
agcuucauuuuaaagaagguucuuauuguguu

SEQ ID NO: 53874 - RNA, 32 nt, Human
agcuuccaaacggcauccccaggaucacuggg

SEQ ID NO: 53875 - RNA, 32 nt, Human
agcuuccaaacugcacugaggaacugggagga

SEQ ID NO: 53876 - RNA, 32 nt, Human
agcuuccaaauggcauccccaggaucacuggg

SEQ ID NO: 53877 - RNA, 32 nt, Human
agcuuccaaauggugcucagugcuccaaggaa

SEQ ID NO: 53878 - RNA, 32 nt, Human
agcuuccaacacucacuggcugugugacuuug

SEQ ID NO: 53879 - RNA, 32 nt, Human
agcuuccaaccaggauacgggaagaagaaaug

SEQ ID NO: 53880 - RNA, 32 nt, Human
agcuuccaagggcugcaucaagugcgaagcgc

SEQ ID NO: 53881 - RNA, 32 nt, Human
agcuuccaaugccucuugucuuccuauuucag

SEQ ID NO: 53882 - RNA, 32 nt, Human
agcuuccacaaacaccaucuucagcuguauga

SEQ ID NO: 53883 - RNA, 32 nt, Human
agcuuccacaagaacagagaauuguuugucca

SEQ ID NO: 53884 - RNA, 32 nt, Human
agcuuccaccugcuccccaucugcccacccac

SEQ ID NO: 53885 - RNA, 32 nt, Human
agcuuccaccuucucagggcucuggaggggga

SEQ ID NO: 53886 - RNA, 22 nt, Human
agcuuccacuuccugggcucaa

SEQ ID NO: 53887 - RNA, 32 nt, Human
agcuuccagcaacucugggcugccccacagcg

SEQ ID NO: 53888 - RNA, 18 nt, Human
agcuuccagccagccagg

SEQ ID NO: 53889 - RNA, 21 nt, Human
agcuuccagccuccccucagg

SEQ ID NO: 53890 - RNA, 32 nt, Human
agcuuccagcucuaauaaaacagcugucucua

SEQ ID NO: 53891 - RNA, 32 nt, Human
agcuuccaggauccugagauccggagcagccg

SEQ ID NO: 53892 - RNA, 32 nt, Human
agcuuccagugagccgagaucgcgccacugca

SEQ ID NO: 53893 - RNA, 32 nt, Human
agcuuccaucccugacaccucugcacucccuu

SEQ ID NO: 53894 - RNA, 32 nt, Human
agcuucccaaagugcugagauuacaggcauga

SEQ ID NO: 53895 - RNA, 32 nt, Human
agcuucccaaagugcuggcauuacaggcguga

SEQ ID NO: 53896 - RNA, 32 nt, Human
agcuucccaaagugcugggauuacagacauga

SEQ ID NO: 53897 - RNA, 32 nt, Human
agcuucccaaagugcugggauuacaggcauga

SEQ ID NO: 53898 - RNA, 32 nt, Human
agcuucccaaagugcugggauuacagguguga

SEQ ID NO: 53899 - RNA, 32 nt, Human
agcuucccaagcagcugggacuacagguaccu

SEQ ID NO: 53900 - RNA, 32 nt, Human
agcuucccaagcagcugggauuacaggugccc

SEQ ID NO: 53901 - RNA, 32 nt, Human
agcuucccaaggagcugggacugcaggcaugu

SEQ ID NO: 53902 - RNA, 32 nt, Human
agcuucccaaguagcggggaucacaggcauga

SEQ ID NO: 53903 - RNA, 32 nt, Human
agcuucccaaguagcuaggaccacaggcacgu

SEQ ID NO: 53904 - RNA, 32 nt, Human
agcuucccaaguagcugagauuacaggcgcac

SEQ ID NO: 53905 - RNA, 32 nt, Human
agcuucccaaguagcugcaacaacaggcacac

SEQ ID NO: 53906 - RNA, 32 nt, Human
agcuucccaaguagcugggaccacaggcguga

SEQ ID NO: 53907 - RNA, 32 nt, Human
agcuucccaaguagcugggacugcaagugugu

SEQ ID NO: 53908 - RNA, 32 nt, Human
agcuucccaaguagcugggacugcggguguuc

SEQ ID NO: 53909 - RNA, 32 nt, Human
agcuucccaaguagcugggauuacaggcaccc

SEQ ID NO: 53910 - RNA, 32 nt, Human
agcuucccaaguagcugggauuacaggcacgu

SEQ ID NO: 53911 - RNA, 32 nt, Human
agcuucccaaguagcugggauuacaggcguac

SEQ ID NO: 53912 - RNA, 32 nt, Human
agcuucccaaguagcugggauuuacaggugug

SEQ ID NO: 53913 - RNA, 32 nt, Human
agcuucccaaguaguugggauuacaggcgccu

SEQ ID NO: 53914 - RNA, 32 nt, Human
agcuucccaaguggcugggauuacaggcaugu

SEQ ID NO: 53915 - RNA, 32 nt, Human
agcuucccaaguggcugggauuacaggcgccc

SEQ ID NO: 53916 - RNA, 32 nt, Human
agcuucccacugcagcagcaccagucugggga

SEQ ID NO: 53917 - RNA, 32 nt, Human
agcuucccagauagcugggccacaggcgugug

SEQ ID NO: 53918 - RNA, 32 nt, Human
agcuucccaggagucuggggcucaaccucucc

SEQ ID NO: 53919 - RNA, 32 nt, Human
agcuucccauaugccacauucaccggccaccu

SEQ ID NO: 53920 - RNA, 32 nt, Human
agcuuccccagaccccaacucacugcaguuca

SEQ ID NO: 53921 - RNA, 32 nt, Human
agcuuccccagcagcugggacuacaggcacgc

SEQ ID NO: 53922 - RNA, 32 nt, Human
agcuuccccaggagcaagaccucugagcccgc

SEQ ID NO: 53923 - RNA, 32 nt, Human
agcuuccccaguagcuaggauuacagguacgc

SEQ ID NO: 53924 - RNA, 32 nt, Human
agcuuccccaguagcugggaccacaggugccc

SEQ ID NO: 53925 - RNA, 32 nt, Human
agcuuccccugccccgggccuggggcugucac

SEQ ID NO: 53926 - RNA, 32 nt, Human
agcuuccccugccuccuacauccagucuguuc

SEQ ID NO: 53927 - RNA, 32 nt, Human
agcuuccccugccuucugcggcggcagaagug

SEQ ID NO: 53928 - RNA, 32 nt, Human
agcuuccccugggguucaccccuggcugccag

SEQ ID NO: 53929 - RNA, 32 nt, Human
agcuucccgacuagcugggauuacagcugccu

SEQ ID NO: 53930 - RNA, 32 nt, Human
agcuucccgaguaacugagauuacaggcaccc

SEQ ID NO: 53931 - RNA, 32 nt, Human
agcuucccgaguagcuggaauuacaggugccc

SEQ ID NO: 53932 - RNA, 32 nt, Human
agcuucccgaguagcugggacuacaggcgccc

SEQ ID NO: 53933 - RNA, 32 nt, Human
agcuucccgaguagcugggacuacaggggccc

SEQ ID NO: 53934 - RNA, 32 nt, Human
agcuucccgaguagcugggacuauaggugcgu

SEQ ID NO: 53935 - RNA, 32 nt, Human
agcuucccgaguagcugggauuacagauguga

SEQ ID NO: 53936 - RNA, 32 nt, Human
agcuucccgaguagcugggauuacaggcacac

SEQ ID NO: 53937 - RNA, 32 nt, Human
agcuucccgaguagcugggauuacaggcgccu

SEQ ID NO: 53938 - RNA, 32 nt, Human
agcuucccgaguagcugggauuacaggcgugc

SEQ ID NO: 53939 - RNA, 32 nt, Human
agcuucccgaguagcugggauuacagguauga

SEQ ID NO: 53940 - RNA, 32 nt, Human
agcuucccgaguagcugggauuauaggcacac

SEQ ID NO: 53941 - RNA, 32 nt, Human
agcuucccgaguagcugggauuauaggcaccc

SEQ ID NO: 53942 - RNA, 32 nt, Human
agcuucccgggcagacacucucucccucagga

SEQ ID NO: 53943 - RNA, 32 nt, Human
agcuucccuaauagcuaggauuacaggugugu

SEQ ID NO: 53944 - RNA, 32 nt, Human
agcuucccucgaccuggggaggccguggccug

SEQ ID NO: 53945 - RNA, 17 nt, Human
agcuucccucuggacug

SEQ ID NO: 53946 - RNA, 32 nt, Human
agcuucccuggacucucauuuguucacuuuac

SEQ ID NO: 53947 - RNA, 32 nt, Human
agcuucccugucucuuccugccuguguaccuc

SEQ ID NO: 53948 - RNA, 32 nt, Human
agcuucccuucccuucuggggcugccacagca

SEQ ID NO: 53949 - RNA, 32 nt, Human
agcuuccgaaacugcuggagguuccagaguuu

SEQ ID NO: 53950 - RNA, 32 nt, Human
agcuuccgcugucccccugccuggagcaguuu

SEQ ID NO: 53951 - RNA, 32 nt, Human
agcuuccgggagaaggggccagagcccgguau

SEQ ID NO: 53952 - RNA, 32 nt, Human
agcuuccgucccugaggcaaaaggacacgagg

SEQ ID NO: 53953 - RNA, 32 nt, Human
agcuuccuaaagugcugggauuacaggcguga

SEQ ID NO: 53954 - RNA, 32 nt, Human
agcuuccuaaagugcugggauuacuggcauga

SEQ ID NO: 53955 - RNA, 32 nt, Human
agcuuccuaaauagcuggaauuacagguguga

SEQ ID NO: 53956 - RNA, 32 nt, Human
agcuuccuaaguagcugggauuacaggcgugc

SEQ ID NO: 53957 - RNA, 32 nt, Human
agcuuccuaaguagcuggguuuacaggcaccc

SEQ ID NO: 53958 - RNA, 32 nt, Human
agcuuccucaaauuggcagagcucuuugaacg

SEQ ID NO: 53959 - RNA, 32 nt, Human
agcuuccucagagcucaggagugggcugcuga

SEQ ID NO: 53960 - RNA, 32 nt, Human
agcuuccuccaccccucucuuuauaggccuag

SEQ ID NO: 53961 - RNA, 32 nt, Human
agcuuccucccuacucucuccaacaccugcau

SEQ ID NO: 53962 - RNA, 32 nt, Human
agcuuccuccuuggagaccccucagcgcaggg

SEQ ID NO: 53963 - RNA, 32 nt, Human
agcuuccucuacugcaaccaggcccguggcag

SEQ ID NO: 53964 - RNA, 32 nt, Human
agcuuccugaagugcugggauuacaggcauga

SEQ ID NO: 53965 - RNA, 32 nt, Human
agcuuccugacacuagagcugaccucacuacu

SEQ ID NO: 53966 - RNA, 32 nt, Human
agcuuccugacuagcugggacuacuggugugc

SEQ ID NO: 53967 - RNA, 32 nt, Human
agcuuccugaggagcugggauuauaggugcau

SEQ ID NO: 53968 - RNA, 32 nt, Human
agcuuccugaguacugggacuacaggaagaga

SEQ ID NO: 53969 - RNA, 32 nt, Human
agcuuccugaguagaugggauuacaggcgccu

SEQ ID NO: 53970 - RNA, 32 nt, Human
agcuuccugaguagcucgggccucagggcugg

SEQ ID NO: 53971 - RNA, 32 nt, Human
agcuuccugaguagcuggaaccacaggugugu

SEQ ID NO: 53972 - RNA, 32 nt, Human
agcuuccugaguagcuggaacuacagguggug

SEQ ID NO: 53973 - RNA, 32 nt, Human
agcuuccugaguagcugggacaacagguguga

SEQ ID NO: 53974 - RNA, 32 nt, Human
agcuuccugaguagcugggacuacaggagcgc

SEQ ID NO: 53975 - RNA, 32 nt, Human
agcuuccugaguagcugggacuacaggcaccc

SEQ ID NO: 53976 - RNA, 32 nt, Human
agcuuccugaguagcugggacuacaggugcgc

SEQ ID NO: 53977 - RNA, 32 nt, Human
agcuuccugaguagcugggacuacagguguac

SEQ ID NO: 53978 - RNA, 32 nt, Human
agcuuccugaguagcugggaggacaggcaugc

SEQ ID NO: 53979 - RNA, 32 nt, Human
agcuuccugaguagcugggauuacaggagcau

SEQ ID NO: 53980 - RNA, 32 nt, Human
agcuuccugaguagcugggauuacaggugcgc

SEQ ID NO: 53981 - RNA, 32 nt, Human
agcuuccugaguaggugggacuacagaugugu

SEQ ID NO: 53982 - RNA, 32 nt, Human
agcuuccugaguaggugggauuacaagcaugc

SEQ ID NO: 53983 - RNA, 32 nt, Human
agcuuccugaugccucauucaccaggaugggu

SEQ ID NO: 53984 - RNA, 32 nt, Human
agcuuccugcagccuccuacgcaggguccacg

SEQ ID NO: 53985 - RNA, 32 nt, Human
agcuuccugcagcuugcucugacacuccugag

SEQ ID NO: 53986 - RNA, 32 nt, Human
agcuuccugccugacccuagagcucccucacc

SEQ ID NO: 53987 - RNA, 32 nt, Human
agcuuccugccugcgguguucuugcaauugcc

SEQ ID NO: 53988 - RNA, 32 nt, Human
agcuuccugccugcugucagugcuggacgaag

SEQ ID NO: 53989 - RNA, 32 nt, Human
agcuuccugccuguuacucuccacaguaugcg

SEQ ID NO: 53990 - RNA, 32 nt, Human
agcuuccugcucugucacccaggcuggagugc

SEQ ID NO: 53991 - RNA, 18 nt, Human
agcuuccuggccucccag

SEQ ID NO: 53992 - RNA, 32 nt, Human
agcuuccuggggagcaggaacagaggacaggc

SEQ ID NO: 53993 - RNA, 32 nt, Human
agcuuccugucaguaaccauguuuucaauaaa

SEQ ID NO: 53994 - RNA, 32 nt, Human
agcuuccuguucucuuuccuugacugugccau

SEQ ID NO: 53995 - RNA, 32 nt, Human
agcuuccuuagaccaggcagggcugccauggu

SEQ ID NO: 53996 - RNA, 19 nt, Human
agcuuccuucgguguggua

SEQ ID NO: 53997 - RNA, 32 nt, Human
agcuucgaggccagugggaggagggaggggcc

SEQ ID NO: 53998 - RNA, 32 nt, Human
agcuucggagagaagauuaacugacggcuucu

SEQ ID NO: 53999 - RNA, 32 nt, Human
agcuucggcaguaucacaagaagauuaaagug

SEQ ID NO: 54000 - RNA, 32 nt, Human
agcuucggcugcagccugagguguguccuggg

SEQ ID NO: 54001 - RNA, 32 nt, Human
agcuucgugucugugcuggagcugcagccugc

SEQ ID NO: 54002 - RNA, 32 nt, Human
agcuucuaagggaggaaggcagcauuggggag

SEQ ID NO: 54003 - RNA, 32 nt, Human
agcuucuacacccuucugcccucucuccauug

SEQ ID NO: 54004 - RNA, 31 nt, Human
agcuucuaggauaaauacuucugaugaaaaa

SEQ ID NO: 54005 - RNA, 32 nt, Human
agcuucuagggaggcuucaagaagcuuauaau

SEQ ID NO: 54006 - RNA, 32 nt, Human
agcuucucaaaguacugggauuauauaggcau

SEQ ID NO: 54007 - RNA, 32 nt, Human
agcuucucaaagugcugggauuacaggcguga

SEQ ID NO: 54008 - RNA, 32 nt, Human
agcuucucagccuccagaacugugagaaauaa

SEQ ID NO: 54009 - RNA, 32 nt, Human
agcuucucauacaaaugucuacuccuucauuu

SEQ ID NO: 54010 - RNA, 32 nt, Human
agcuucuccacucauggccugcccugaggacu

SEQ ID NO: 54011 - RNA, 25 nt, Human
agcuucucccagccccucuuccagg

SEQ ID NO: 54012 - RNA, 18 nt, Human
agcuucucccaggcacag

SEQ ID NO: 54013 - RNA, 32 nt, Human
agcuucucccccuuccuucccaccccaguccc

SEQ ID NO: 54014 - RNA, 32 nt, Human
agcuucucccggucauggcacacaccugugcc

SEQ ID NO: 54015 - RNA, 32 nt, Human
agcuucuccugcuccucucugccucaucuccc

SEQ ID NO: 54016 - RNA, 21 nt, Human
agcuucucgcucucgccugcc

SEQ ID NO: 54017 - RNA, 32 nt, Human
agcuucucuguuuugcaguugagauaguaacc

SEQ ID NO: 54018 - RNA, 32 nt, Human
agcuucugagacgucaugaggagauucugccu

SEQ ID NO: 54019 - RNA, 32 nt, Human
agcuucugagcaagacugagcagggaaagaaa

SEQ ID NO: 54020 - RNA, 17 nt, Human
agcuucugauccuccca

SEQ ID NO: 54021 - RNA, 32 nt, Human
agcuucugcagggcuucucuuguuuacacagc

SEQ ID NO: 54022 - RNA, 32 nt, Human
agcuucugccagcugcuuuugccaguagauua

SEQ ID NO: 54023 - RNA, 32 nt, Human
agcuucugcccagcuccugguggccuuuguag

SEQ ID NO: 54024 - RNA, 32 nt, Human
agcuucugcccagggugggugggacugagcag

SEQ ID NO: 54025 - RNA, 32 nt, Human
agcuucugccuccucaccuggccgucgguacu

SEQ ID NO: 54026 - RNA, 32 nt, Human
agcuucugcugcugcuccuccucccagccccg

SEQ ID NO: 54027 - RNA, 32 nt, Human
agcuucugggagagagcaagagaggaccuugg

SEQ ID NO: 54028 - RNA, 19 nt, Human
agcuucuggggcccaggag

SEQ ID NO: 54029 - RNA, 32 nt, Human
agcuucugggguccccagggcugucaucugaa

SEQ ID NO: 54030 - RNA, 27 nt, Human
agcuucugguuuaaacgccuccuucaa

SEQ ID NO: 54031 - RNA, 32 nt, Human
agcuucugucgcucuguaaccugcacugugac

SEQ ID NO: 54032 - RNA, 32 nt, Human
agcuucuguggacugugacgcuggcagagggg

SEQ ID NO: 54033 - RNA, 32 nt, Human
agcuucuguggcuugagagccucuggggccuu

SEQ ID NO: 54034 - RNA, 32 nt, Human
agcuucuguggggagagaaguugaaggauccc

SEQ ID NO: 54035 - RNA, 32 nt, Human
agcuucuguuuuaaggaauuucucuuccuucu

SEQ ID NO: 54036 - RNA, 22 nt, Human
agcuucuuaugguccugaggcg

SEQ ID NO: 54037 - RNA, 32 nt, Human
agcuucuuauuuuucuccacugcuuggauaug

SEQ ID NO: 54038 - RNA, 32 nt, Human
agcuucuucagaaaggagaccucccggcccuc

SEQ ID NO: 54039 - RNA, 32 nt, Human
agcuucuucagccaccuucugccugcagacaa

SEQ ID NO: 54040 - RNA, 32 nt, Human
agcuucuucucagaucuauccuguucguugga

SEQ ID NO: 54041 - RNA, 32 nt, Human
agcuucuugcccaggcagagagagcaggagcg

SEQ ID NO: 54042 - RNA, 32 nt, Human
agcuucuugggaggcugagaugggaaucacuu

SEQ ID NO: 54043 - RNA, 32 nt, Human
agcuucuuucaagacguaggucagggcaguca

SEQ ID NO: 54044 - RNA, 32 nt, Human
agcuucuuucuucaucugcaaaauggaacccc

SEQ ID NO: 54045 - RNA, 32 nt, Human
agcuucuuugcagcuuccucuucuaccauuuc

SEQ ID NO: 54046 - RNA, 32 nt, Human
agcuugaacccaguggcggaggcugcagugag

SEQ ID NO: 54047 - RNA, 32 nt, Human
agcuugaagcagcuugaggccagaccuacugu

SEQ ID NO: 54048 - RNA, 32 nt, Human
agcuugacauugugguuccucacgaaggagau

SEQ ID NO: 54049 - RNA, 21 nt, Human
agcuugaccaacauggagaaa

SEQ ID NO: 54050 - RNA, 21 nt, Human
agcuugaccaacauggugaaa

SEQ ID NO: 54051 - RNA, 32 nt, Human
agcuugaccagcccagccagggcaguggcuga

SEQ ID NO: 54052 - RNA, 32 nt, Human
agcuugaccagugucugcucgccuuugugccc

SEQ ID NO: 54053 - RNA, 32 nt, Human
agcuugaccccuggacauuugcacugacuuua

SEQ ID NO: 54054 - RNA, 32 nt, Human
agcuugaccgcuggcucgcuguguggccuugg

SEQ ID NO: 54055 - RNA, 32 nt, Human
agcuugacuauggaccaaacagcucuggccua

SEQ ID NO: 54056 - RNA, 32 nt, Human
agcuugacucuauccugggaugacugaggccu

SEQ ID NO: 54057 - RNA, 32 nt, Human
agcuugagcauucagucuucugaccuguucca

SEQ ID NO: 54058 - RNA, 32 nt, Human
agcuugaguguucuguucucuuccugcccauu

SEQ ID NO: 54059 - RNA, 32 nt, Human
agcuugaguuccugccuuucccaccacaaauu

SEQ ID NO: 54060 - RNA, 32 nt, Human
agcuugaguuugaugcagggaggaggaaggcu

SEQ ID NO: 54061 - RNA, 32 nt, Human
agcuugaugcuggcagcaacuguccaugaaga

SEQ ID NO: 54062 - RNA, 32 nt, Human
agcuugauuagaagccaagacaguggcagcaa

SEQ ID NO: 54063 - RNA, 32 nt, Human
agcuugcacaaacugggcuggguugcgacugu

SEQ ID NO: 54064 - RNA, 32 nt, Human
agcuugcaccaccaaaaauggcaaacaucacc

SEQ ID NO: 54065 - RNA, 32 nt, Human
agcuugcaccauugcacuccagccugggcgac

SEQ ID NO: 54066 - RNA, 32 nt, Human
agcuugcacuacugcacuccagccugggugac

SEQ ID NO: 54067 - RNA, 21 nt, Human
agcuugcagcagcacacccca

SEQ ID NO: 54068 - RNA, 32 nt, Human
agcuugcagccccucuuucucacacgugugau

SEQ ID NO: 54069 - RNA, 32 nt, Human
agcuugcagccucaccgacgagucucaacuaa

SEQ ID NO: 54070 - RNA, 19 nt, Human
agcuugcagggguugggga

SEQ ID NO: 54071 - RNA, 32 nt, Human
agcuugcagggguuggggagggagacauccag

SEQ ID NO: 54072 - RNA, 32 nt, Human
agcuugcaguaagccgagacugagccacugca

SEQ ID NO: 54073 - RNA, 32 nt, Human
agcuugcaguaagccgagaucgcaccacugca

SEQ ID NO: 54074 - RNA, 29 nt, Human
agcuugcaguaagccgagaucgcgccacu

SEQ ID NO: 54075 - RNA, 32 nt, Human
agcuugcagucagccgagaucacgccacugca

SEQ ID NO: 54076 - RNA, 32 nt, Human
agcuugcagugaaccgagaucugccacugcac

SEQ ID NO: 54077 - RNA, 32 nt, Human
agcuugcagugagccgagaccgugccacugca

SEQ ID NO: 54078 - RNA, 32 nt, Human
agcuugcagugagccgagacugcgccaccgcg

SEQ ID NO: 54079 - RNA, 32 nt, Human
agcuugcagugagccgagauagcgccacugca

SEQ ID NO: 54080 - RNA, 32 nt, Human
agcuugcagugagccgagauaucgccacugca

SEQ ID NO: 54081 - RNA, 32 nt, Human
agcuugcagugagccgagaucacaccaccacu

SEQ ID NO: 54082 - RNA, 31 nt, Human
agcuugcagugagccgagaucacaccacugc

SEQ ID NO: 54083 - RNA, 32 nt, Human
agcuugcagugagccgagaucacaccacugca

SEQ ID NO: 54084 - RNA, 32 nt, Human
agcuugcagugagccgagaucacgccacugca

SEQ ID NO: 54085 - RNA, 32 nt, Human
agcuugcagugagccgagaucaggccauugca

SEQ ID NO: 54086 - RNA, 32 nt, Human
agcuugcagugagccgagaucaugccacaccg

SEQ ID NO: 54087 - RNA, 32 nt, Human
agcuugcagugagccgagaucaugccacugca

SEQ ID NO: 54088 - RNA, 32 nt, Human
agcuugcagugagccgagaucccgccacugca

SEQ ID NO: 54089 - RNA, 32 nt, Human
agcuugcagugagccgagaucgcaccacugca

SEQ ID NO: 54090 - RNA, 32 nt, Human
agcuugcagugagccgagaucgcgccaaugca

SEQ ID NO: 54091 - RNA, 32 nt, Human
agcuugcagugagccgagaucgcgccaccaca

SEQ ID NO: 54092 - RNA, 32 nt, Human
agcuugcagugagccgagaucgcgccaccgca

SEQ ID NO: 54093 - RNA, 32 nt, Human
agcuugcagugagccgagaucgcgccacggca

SEQ ID NO: 54094 - RNA, 32 nt, Human
agcuugcagugagccgagaucgcgccacugca

SEQ ID NO: 54095 - RNA, 32 nt, Human
agcuugcagugagccgagaucgcgccaucaca

SEQ ID NO: 54096 - RNA, 32 nt, Human
agcuugcagugagccgagaucgugccacugca

SEQ ID NO: 54097 - RNA, 32 nt, Human
agcuugcagugagccgagaucgugucacugca

SEQ ID NO: 54098 - RNA, 32 nt, Human
agcuugcagugagccgagauggagccacugca

SEQ ID NO: 54099 - RNA, 32 nt, Human
agcuugcagugagccgagauggcgccacugca

SEQ ID NO: 54100 - RNA, 32 nt, Human
agcuugcagugagccgagauggcgccacugcg

SEQ ID NO: 54101 - RNA, 32 nt, Human
agcuugcagugagccgagauggcgccauugca

SEQ ID NO: 54102 - RNA, 32 nt, Human
agcuugcagugagccgagauggugccacugca

SEQ ID NO: 54103 - RNA, 32 nt, Human
agcuugcagugagccgagauugcaccacagca

SEQ ID NO: 54104 - RNA, 32 nt, Human
agcuugcagugagccgagauugcaccacugca

SEQ ID NO: 54105 - RNA, 32 nt, Human
agcuugcagugagccgagauugcgccacugca

SEQ ID NO: 54106 - RNA, 32 nt, Human
agcuugcagugagccgagauugcgccacugcg

SEQ ID NO: 54107 - RNA, 32 nt, Human
agcuugcagugagccgagauugcgucacugca

SEQ ID NO: 54108 - RNA, 32 nt, Human
agcuugcagugagccgagauugugccacugca

SEQ ID NO: 54109 - RNA, 32 nt, Human
agcuugccaagcagcugggacuacaggugcgc

SEQ ID NO: 54110 - RNA, 32 nt, Human
agcuugccaagguccgugccucccagggcacc

SEQ ID NO: 54111 - RNA, 32 nt, Human
agcuugccacccccuccucucccuucacccag

SEQ ID NO: 54112 - RNA, 31 nt, Human
agcuugccacuucuccugccagggcugugcc

SEQ ID NO: 54113 - RNA, 32 nt, Human
agcuugccauccugugaguauaacuccuguau

SEQ ID NO: 54114 - RNA, 19 nt, Human
agcuugccccaccccgccc

SEQ ID NO: 54115 - RNA, 32 nt, Human
agcuugcccuccccucuccgccuaagccugcc

SEQ ID NO: 54116 - RNA, 32 nt, Human
agcuugccuccaggaccaccugcuuggagaac

SEQ ID NO: 54117 - RNA, 32 nt, Human
agcuugccugaccucccuuccugggcugggua

SEQ ID NO: 54118 - RNA, 17 nt, Human
agcuugccuuugaacug

SEQ ID NO: 54119 - RNA, 32 nt, Human
agcuugcgccuggcggggaggggugaaacacu

SEQ ID NO: 54120 - RNA, 32 nt, Human
agcuugcggaagggcgccccugccuggucuug

SEQ ID NO: 54121 - RNA, 32 nt, Human
agcuugcggggcgcaggaagggcgcgggccgc

SEQ ID NO: 54122 - RNA, 32 nt, Human
agcuugcggugagccgagauugcgcuacugca

SEQ ID NO: 54123 - RNA, 31 nt, Human
agcuugcgugcugcugggccugagcugucug

SEQ ID NO: 54124 - RNA, 32 nt, Human
agcuugcuaauaauagaaaacuacccauauuc

SEQ ID NO: 54125 - RNA, 32 nt, Human
agcuugcucauuucuguccugacacagcucac

SEQ ID NO: 54126 - RNA, 32 nt, Human
agcuugcuccccacugugccuuuguuagagca

SEQ ID NO: 54127 - RNA, 32 nt, Human
agcuugcucucugagugugucucauugauuca

SEQ ID NO: 54128 - RNA, 32 nt, Human
agcuugcugcaaacuccgccucccagguucaa

SEQ ID NO: 54129 - RNA, 32 nt, Human
agcuugcugcacaaugcagaccugugucuugc

SEQ ID NO: 54130 - RNA, 32 nt, Human
agcuugcugcagcuucagacagggagccagga

SEQ ID NO: 54131 - RNA, 32 nt, Human
agcuugcugggaaaagacaggagaaguacuga

SEQ ID NO: 54132 - RNA, 32 nt, Human
agcuugcuugaggcuugaguccugggcuaacu

SEQ ID NO: 54133 - RNA, 32 nt, Human
agcuugcuuuguugcacgccugggcaauuuca

SEQ ID NO: 54134 - RNA, 32 nt, Human
agcuugcuuuucgggcccuuuaucucuguguu

SEQ ID NO: 54135 - RNA, 32 nt, Human
agcuuggacuacaggcccugccaccacgcccg

SEQ ID NO: 54136 - RNA, 32 nt, Human
agcuuggacuacaggcgugcaccaccacaccu

SEQ ID NO: 54137 - RNA, 32 nt, Human
agcuuggacuauaggugcaugccaccaugccu

SEQ ID NO: 54138 - RNA, 32 nt, Human
agcuuggacuuagugggaguguuuacaccaug

SEQ ID NO: 54139 - RNA, 32 nt, Human
agcuuggacuuuggugggcaucugcggaugau

SEQ ID NO: 54140 - RNA, 32 nt, Human
agcuuggagauugaggugggaggaucaccuga

SEQ ID NO: 54141 - RNA, 32 nt, Human
agcuuggaggggcaaguuagguuucuauuuua

SEQ ID NO: 54142 - RNA, 32 nt, Human
agcuuggaggucccugaaccagaggcacuagg

SEQ ID NO: 54143 - RNA, 32 nt, Human
agcuuggauuacaggcacaagccaucaugacu

SEQ ID NO: 54144 - RNA, 32 nt, Human
agcuuggauuccagggaacacuguccagauuu

SEQ ID NO: 54145 - RNA, 32 nt, Human
agcuuggcaccaacaaugucucagccuuucag

SEQ ID NO: 54146 - RNA, 21 nt, Human
agcuuggccaacauagugaaa

SEQ ID NO: 54147 - RNA, 21 nt, Human
agcuuggccaacauggagaaa

SEQ ID NO: 54148 - RNA, 21 nt, Human
agcuuggccaacauggcgaaa

SEQ ID NO: 54149 - RNA, 20 nt, Human
agcuuggccaacaugggaaa

SEQ ID NO: 54150 - RNA, 21 nt, Human
agcuuggccaacauggugaaa

SEQ ID NO: 54151 - RNA, 21 nt, Human
agcuuggccaacauggugaag

SEQ ID NO: 54152 - RNA, 21 nt, Human
agcuuggccaagauggugaaa

SEQ ID NO: 54153 - RNA, 21 nt, Human
agcuuggccaauauagugaaa

SEQ ID NO: 54154 - RNA, 32 nt, Human
agcuuggcuuuuccucaccucaugccccuugc

SEQ ID NO: 54155 - RNA, 24 nt, Human
agcuugggaaaucaagguugcagu

SEQ ID NO: 54156 - RNA, 32 nt, Human
agcuugggaaaucaagguugcagugagcuaug

SEQ ID NO: 54157 - RNA, 24 nt, Human
agcuugggaagucgaggcugcagu

SEQ ID NO: 54158 - RNA, 32 nt, Human
agcuugggaucagaagucagaaguuuggaaug

SEQ ID NO: 54159 - RNA, 32 nt, Human
agcuugggcacagcagacuggccuggcccuga

SEQ ID NO: 54160 - RNA, 32 nt, Human
agcuugggcaggaaagggaugagggaguagga

SEQ ID NO: 54161 - RNA, 32 nt, Human
agcuugggccaggcuuccccuguccucccacc

SEQ ID NO: 54162 - RNA, 32 nt, Human
agcuuggggaaauauggaggggugugugucug

SEQ ID NO: 54163 - RNA, 21 nt, Human
agcuuggggacccuccagggu

SEQ ID NO: 54164 - RNA, 32 nt, Human
agcuuggggcuuggagaggaucuggaagucug

SEQ ID NO: 54165 - RNA, 32 nt, Human
agcuugggguccaauccaucugucccuggcau

SEQ ID NO: 54166 - RNA, 32 nt, Human
agcuuggggucccacggacaaugggugggaug

SEQ ID NO: 54167 - RNA, 32 nt, Human
agcuuggggugaggaagagggagggauggaca

SEQ ID NO: 54168 - RNA, 32 nt, Human
agcuugggguuucuuugguguuaccaucccag

SEQ ID NO: 54169 - RNA, 32 nt, Human
agcuugggugacagagugagacuccaucucaa

SEQ ID NO: 54170 - RNA, 32 nt, Human
agcuugguaauuacugcucauuucucaaccuu

SEQ ID NO: 54171 - RNA, 32 nt, Human
agcuuggucaucuaugacaccacaccagcaca

SEQ ID NO: 54172 - RNA, 32 nt, Human
agcuugguccucacccuccuguuccugggcuc

SEQ ID NO: 54173 - RNA, 32 nt, Human
agcuugguggcaaagcaggggugcaggggccu

SEQ ID NO: 54174 - RNA, 32 nt, Human
agcuugguucuuuaaagauuuggagaagauau

SEQ ID NO: 54175 - RNA, 32 nt, Human
agcuugguuuauaggcgcaugccaccaugccu

SEQ ID NO: 54176 - RNA, 32 nt, Human
agcuugguuucauguuacaaacagaaaagcuc

SEQ ID NO: 54177 - RNA, 32 nt, Human
agcuugguuuguuucccuaacuucugauuaac

SEQ ID NO: 54178 - RNA, 31 nt, Human
agcuuguacauuuucugagcugucagacauu

SEQ ID NO: 54179 - RNA, 32 nt, Human
agcuuguacuugucccccucuuugcccgagug

SEQ ID NO: 54180 - RNA, 32 nt, Human
agcuuguaggagacagaggaugugauggagcu

SEQ ID NO: 54181 - RNA, 32 nt, Human
agcuuguagggaggcaucaggaaguuuccaac

SEQ ID NO: 54182 - RNA, 29 nt, Human
agcuuguagguguuggcaucccccuuuuu

SEQ ID NO: 54183 - RNA, 32 nt, Human
agcuuguagugagccgagauugcgccacugca

SEQ ID NO: 54184 - RNA, 32 nt, Human
agcuuguauguaaggagguuuauauaaguaau

SEQ ID NO: 54185 - RNA, 32 nt, Human
agcuugucacccgcuggguuucuugaggucug

SEQ ID NO: 54186 - RNA, 32 nt, Human
agcuuguccaacaacuccaggaaaacuguuuu

SEQ ID NO: 54187 - RNA, 32 nt, Human
agcuugucuacugaagaauuacuccaguugua

SEQ ID NO: 54188 - RNA, 32 nt, Human
agcuugucucauccccagucuaccuccuuccu

SEQ ID NO: 54189 - RNA, 32 nt, Human
agcuugucuccucuccugucacccuaagagcc

SEQ ID NO: 54190 - RNA, 32 nt, Human
agcuugucugucucuggguccugggccagcca

SEQ ID NO: 54191 - RNA, 19 nt, Human
agcuugucuuuguguggua

SEQ ID NO: 54192 - RNA, 32 nt, Human
agcuugugacccugaugagcugugggaccuug

SEQ ID NO: 54193 - RNA, 32 nt, Human
agcuugugaggcaugagggcgcgggagccaca

SEQ ID NO: 54194 - RNA, 32 nt, Human
agcuuguggcggcagugggcaguccguggcau

SEQ ID NO: 54195 - RNA, 32 nt, Human
agcuuguggcugggaaagagggaugugcagug

SEQ ID NO: 54196 - RNA, 32 nt, Human
agcuugugggcuugcacugggggagggaaggg

SEQ ID NO: 54197 - RNA, 32 nt, Human
agcuuguggugagccgagaucgcgccacugca

SEQ ID NO: 54198 - RNA, 32 nt, Human
agcuuguguaucauccauuaucguauguaauc

SEQ ID NO: 54199 - RNA, 32 nt, Human
agcuuguguuaguuucagggagggguguauau

SEQ ID NO: 54200 - RNA, 32 nt, Human
agcuuguuccacugcaaauaaagccuuuuaaa

SEQ ID NO: 54201 - RNA, 32 nt, Human
agcuuguucccaagaggauaauucuuuauacu

SEQ ID NO: 54202 - RNA, 32 nt, Human
agcuuguucuaauuuuggccacuuuggcuguu

SEQ ID NO: 54203 - RNA, 18 nt, Human
agcuuguuuccuggacug

SEQ ID NO: 54204 - RNA, 32 nt, Human
agcuuuaaaauauaucuggaacuuuuuagauu

SEQ ID NO: 54205 - RNA, 32 nt, Human
agcuuuaaccuggauguggaggaggaugacau

SEQ ID NO: 54206 - RNA, 32 nt, Human
agcuuuaacuauagcucagcugcugcaagauu

SEQ ID NO: 54207 - RNA, 32 nt, Human
agcuuuaacucaguugugcucccuucaaacau

SEQ ID NO: 54208 - RNA, 32 nt, Human
agcuuuaagucuaaauacaaagcuguucugug

SEQ ID NO: 54209 - RNA, 17 nt, Human
agcuuuacauccuccca

SEQ ID NO: 54210 - RNA, 32 nt, Human
agcuuuaccacuaacuagcuguguggccuuga

SEQ ID NO: 54211 - RNA, 32 nt, Human
agcuuuaccacuugcuggcugugugacuuaag

SEQ ID NO: 54212 - RNA, 32 nt, Human
agcuuuacucaucuugagcuuugaggauguuc

SEQ ID NO: 54213 - RNA, 32 nt, Human
agcuuuacuguuucucaaguguuuuggagaaa

SEQ ID NO: 54214 - RNA, 32 nt, Human
agcuuuagaauagagauuuucucagaaaugug

SEQ ID NO: 54215 - RNA, 32 nt, Human
agcuuuagauagagacuuuagacccugcccug

SEQ ID NO: 54216 - RNA, 18 nt, Human
agcuuuagcuuccauggc

SEQ ID NO: 54217 - RNA, 31 nt, Human
agcuuuaggaaacuacuaaaaugcuguggga

SEQ ID NO: 54218 - RNA, 32 nt, Human
agcuuuaggauaauuguugauaguugacuuag

SEQ ID NO: 54219 - RNA, 32 nt, Human
agcuuuagggaaaaggcauuguucucucaauu

SEQ ID NO: 54220 - RNA, 32 nt, Human
agcuuuauacaauuuuucuuugugcacuaaau

SEQ ID NO: 54221 - RNA, 32 nt, Human
agcuuuaucacuauucucuuugcucacuggcu

SEQ ID NO: 54222 - RNA, 32 nt, Human
agcuuuauguucugagaagcacuuuaaggaau

SEQ ID NO: 54223 - RNA, 32 nt, Human
agcuuuauuaaauuaugcaugcuaagauuuaa

SEQ ID NO: 54224 - RNA, 32 nt, Human
agcuuuauugggcuuucuuugugucuugugug

SEQ ID NO: 54225 - RNA, 32 nt, Human
agcuuuauuuaaacugaauuuccaguauauuu

SEQ ID NO: 54226 - RNA, 32 nt, Human
agcuuucaaacacacaugcacacagcacaauu

SEQ ID NO: 54227 - RNA, 32 nt, Human
agcuuucacaguggacaguaagguccauccau

SEQ ID NO: 54228 - RNA, 32 nt, Human
agcuuucaccucugcauuccucaggcuguaaa

SEQ ID NO: 54229 - RNA, 20 nt, Human
agcuuucagagccagugaag

SEQ ID NO: 54230 - RNA, 31 nt, Human
agcuuucaguuucaaaucaaaccuuaaaaga

SEQ ID NO: 54231 - RNA, 32 nt, Human
agcuuucauguaaacugugcaccaagcaggaa

SEQ ID NO: 54232 - RNA, 32 nt, Human
agcuuuccaaguagcugagacuacaggccugu

SEQ ID NO: 54233 - RNA, 32 nt, Human
agcuuuccaaguagcugggauuacaggcaccc

SEQ ID NO: 54234 - RNA, 32 nt, Human
agcuuuccccauggagcuuacccagccugcag

SEQ ID NO: 54235 - RNA, 32 nt, Human
agcuuucccucccucacuuuuuccuuuguaaa

SEQ ID NO: 54236 - RNA, 32 nt, Human
agcuuuccggaagaaagggaucugggagcgag

SEQ ID NO: 54237 - RNA, 21 nt, Human
agcuuucgcccucugcuuuga

SEQ ID NO: 54238 - RNA, 32 nt, Human
agcuuucgucucucuauguggagggaaaaaga

SEQ ID NO: 54239 - RNA, 32 nt, Human
agcuuucuaugggaaugcuuuaguguuagcag

SEQ ID NO: 54240 - RNA, 32 nt, Human
agcuuucucaaaggaaacacauucucugagca

SEQ ID NO: 54241 - RNA, 32 nt, Human
agcuuucuccaaggaauauguaugaaauaacu

SEQ ID NO: 54242 - RNA, 32 nt, Human
agcuuucuccacccuggcucccaaggcuuggc

SEQ ID NO: 54243 - RNA, 32 nt, Human
agcuuucugaggaagagaaaauucagcgcuac

SEQ ID NO: 54244 - RNA, 32 nt, Human
agcuuucugaugcauccucugaaaucuaggug

SEQ ID NO: 54245 - RNA, 32 nt, Human
agcuuucugcauggauggucagucucuugccc

SEQ ID NO: 54246 - RNA, 20 nt, Human
agcuuucuggucaaaucuca

SEQ ID NO: 54247 - RNA, 32 nt, Human
agcuuucugguuggcagguggcagcaggaugg

SEQ ID NO: 54248 - RNA, 17 nt, Human
agcuuucuguuguccca

SEQ ID NO: 54249 - RNA, 32 nt, Human
agcuuucuuacagcgucuuugaaagugacugg

SEQ ID NO: 54250 - RNA, 32 nt, Human
agcuuucuucuccaaguccaaagagguacccg

SEQ ID NO: 54251 - RNA, 32 nt, Human
agcuuucuucuccaccaccaccaccuuccuuc

SEQ ID NO: 54252 - RNA, 16 nt, Human
agcuuucuucugacug

SEQ ID NO: 54253 - RNA, 32 nt, Human
agcuuucuucuugaacaccucauacccacagu

SEQ ID NO: 54254 - RNA, 32 nt, Human
agcuuucuuugcucacucgaugccacugaggc

SEQ ID NO: 54255 - RNA, 32 nt, Human
agcuuugaagaaacugauucaugcugcuaacu

SEQ ID NO: 54256 - RNA, 32 nt, Human
agcuuugaagauuaggaggagaaaaagaggag

SEQ ID NO: 54257 - RNA, 32 nt, Human
agcuuugaaggccgaaggcagugcaagagacu

SEQ ID NO: 54258 - RNA, 32 nt, Human
agcuuugaauauuagaucugaccaauaugggu

SEQ ID NO: 54259 - RNA, 21 nt, Human
agcuuugaaucugagcuucau

SEQ ID NO: 54260 - RNA, 32 nt, Human
agcuuugaccacugugauccagaagagaggug

SEQ ID NO: 54261 - RNA, 32 nt, Human
agcuuugacccgaaguaguugaagagcuacuu

SEQ ID NO: 54262 - RNA, 22 nt, Human
agcuuugacuuccugggcucaa

SEQ ID NO: 54263 - RNA, 32 nt, Human
agcuuugagacugugggccgccagucuagauc

SEQ ID NO: 54264 - RNA, 32 nt, Human
agcuuugagagaggaggaagagggagucugag

SEQ ID NO: 54265 - RNA, 32 nt, Human
agcuuugauucuguguacacacuccagcaugg

SEQ ID NO: 54266 - RNA, 32 nt, Human
agcuuugcaaacccauuaaggggaagaaugaa

SEQ ID NO: 54267 - RNA, 32 nt, Human
agcuuugcaauuucacuuacuacuuuuauccu

SEQ ID NO: 54268 - RNA, 32 nt, Human
agcuuugcagcaaccucugugcccagaacaua

SEQ ID NO: 54269 - RNA, 32 nt, Human
agcuuugcaggcgggggucugagaucagggug

SEQ ID NO: 54270 - RNA, 32 nt, Human
agcuuugcagguuugaaucucuguaauuuaac

SEQ ID NO: 54271 - RNA, 32 nt, Human
agcuuugcagugagugcugcucauguccuccc

SEQ ID NO: 54272 - RNA, 32 nt, Human
agcuuugcccaggauccauugcugcagcuucc

SEQ ID NO: 54273 - RNA, 32 nt, Human
agcuuugccgcuuuugugccucucacaggcgc

SEQ ID NO: 54274 - RNA, 32 nt, Human
agcuuugccuugcuuucuggacagcugaacac

SEQ ID NO: 54275 - RNA, 21 nt, Human
agcuuuggaagcugcuuucga

SEQ ID NO: 54276 - RNA, 22 nt, Human
agcuuuggacaauaacugcuuu

SEQ ID NO: 54277 - RNA, 32 nt, Human
agcuuuggacuaagaggguaagagaggcccag

SEQ ID NO: 54278 - RNA, 32 nt, Human
agcuuuggagcccagaggugcgggauucugac

SEQ ID NO: 54279 - RNA, 22 nt, Human
agcuuuggccagcagugagcgg

SEQ ID NO: 54280 - RNA, 32 nt, Human
agcuuuggcucgagaggcacagcuccaggcug

SEQ ID NO: 54281 - RNA, 32 nt, Human
agcuuuggcugguuccauuaggcaauauucag

SEQ ID NO: 54282 - RNA, 32 nt, Human
agcuuuggcuguuccaacucaccacagccucu

SEQ ID NO: 54283 - RNA, 23 nt, Human
agcuuugggaaaacuucauuccu

SEQ ID NO: 54284 - RNA, 32 nt, Human
agcuuugggaaaggggaaagagagcauggagg

SEQ ID NO: 54285 - RNA, 32 nt, Human
agcuuugggaggagacggggaggacagacugg

SEQ ID NO: 54286 - RNA, 32 nt, Human
agcuuugggaggccaaggugggaggaucgcuu

SEQ ID NO: 54287 - RNA, 32 nt, Human
agcuuugggcacauguauguccauucacuuuc

SEQ ID NO: 54288 - RNA, 22 nt, Human
agcuuugggcuuuccugcucug

SEQ ID NO: 54289 - RNA, 32 nt, Human
agcuuuggggugcugaggaaccucuaaucauc

SEQ ID NO: 54290 - RNA, 31 nt, Human
agcuuugggucaaauaacucgucuguccagg

SEQ ID NO: 54291 - RNA, 32 nt, Human
agcuuugguauucauguauauacaugcauuua

SEQ ID NO: 54292 - RNA, 32 nt, Human
agcuuugguucugccaucucucccacucugcc

SEQ ID NO: 54293 - RNA, 32 nt, Human
agcuuugucauccagagccagaacugcugcag

SEQ ID NO: 54294 - RNA, 32 nt, Human
agcuuugugcauccucucccaguggagcgauc

SEQ ID NO: 54295 - RNA, 32 nt, Human
agcuuuguggcuuugugaaauucuaaaggaau

SEQ ID NO: 54296 - RNA, 32 nt, Human
agcuuuguguggguuggaagagacugaagaua

SEQ ID NO: 54297 - RNA, 32 nt, Human
agcuuuguucaagaggacacagaaggauucug

SEQ ID NO: 54298 - RNA, 32 nt, Human
agcuuuguuuggcuaaugaaugaauuuacuaa

SEQ ID NO: 54299 - RNA, 32 nt, Human
agcuuuuacaguuucagaccucagcagcugua

SEQ ID NO: 54300 - RNA, 32 nt, Human
agcuuuuacccaagcccuuucuugccucucca

SEQ ID NO: 54301 - RNA, 32 nt, Human
agcuuuuacuaaaagauuuucagcugaaugga

SEQ ID NO: 54302 - RNA, 32 nt, Human
agcuuuuauuccccuagccacauggaacuuuu

SEQ ID NO: 54303 - RNA, 32 nt, Human
agcuuuuccacuuaguaaucacugugugcuuu

SEQ ID NO: 54304 - RNA, 32 nt, Human
agcuuuuccaguuaaauuggagcacugaacgu

SEQ ID NO: 54305 - RNA, 32 nt, Human
agcuuuuccauaucagcucaaccacgccgcca

SEQ ID NO: 54306 - RNA, 32 nt, Human
agcuuuucccaaaggccaaggaagggauggug

SEQ ID NO: 54307 - RNA, 32 nt, Human
agcuuuucccaaugcuaauuuccaaacaacaa

SEQ ID NO: 54308 - RNA, 32 nt, Human
agcuuuucccacaggcugcagggcaggaaagg

SEQ ID NO: 54309 - RNA, 32 nt, Human
agcuuuuccgcugaagcuuaacaggcauuaac

SEQ ID NO: 54310 - RNA, 32 nt, Human
agcuuuuccgugccucuccuccaccucucccu

SEQ ID NO: 54311 - RNA, 32 nt, Human
agcuuuucucacauggcaucacugugacacug

SEQ ID NO: 54312 - RNA, 32 nt, Human
agcuuuucucacccucuucugugcugggagga

SEQ ID NO: 54313 - RNA, 32 nt, Human
agcuuuucucccaccauaacaugaaaacagug

SEQ ID NO: 54314 - RNA, 32 nt, Human
agcuuuucuccuccccucugguugggagcacu

SEQ ID NO: 54315 - RNA, 32 nt, Human
agcuuuucuccuccucuugcagggcauggggc

SEQ ID NO: 54316 - RNA, 32 nt, Human
agcuuuucucuucugucaaccccacacgccuu

SEQ ID NO: 54317 - RNA, 32 nt, Human
agcuuuucugaaggagcuuuccuggcagggac

SEQ ID NO: 54318 - RNA, 32 nt, Human
agcuuuugaagauggcacaauaaccguccagu

SEQ ID NO: 54319 - RNA, 32 nt, Human
agcuuuugaugaagccauugcugaacuugaua

SEQ ID NO: 54320 - RNA, 21 nt, Human
agcuuuugccccauuauccca

SEQ ID NO: 54321 - RNA, 32 nt, Human
agcuuuuggaugaccucagcuugaguuucucc

SEQ ID NO: 54322 - RNA, 21 nt, Human
agcuuuugguagccgauucca

SEQ ID NO: 54323 - RNA, 32 nt, Human
agcuuuugucuccagugcaugaucucauauuu

SEQ ID NO: 54324 - RNA, 32 nt, Human
agcuuuuuaaauaucuuuuuccuucuacuccu

SEQ ID NO: 54325 - RNA, 32 nt, Human
agcuuuuuauucagauucucuuuguggccaga

SEQ ID NO: 54326 - RNA, 32 nt, Human
agcuuuuucacuccacugcccuaggggaguuc

SEQ ID NO: 54327 - RNA, 32 nt, Human
agcuuuuucauaauuaaaucuuauccaagaau

SEQ ID NO: 54328 - RNA, 32 nt, Human
agcuuuuuccagcagaacauguucccucaucu

SEQ ID NO: 54329 - RNA, 32 nt, Human
agcuuuuuccggcuaugcuucugugauaugga

SEQ ID NO: 54330 - RNA, 32 nt, Human
agcuuuuucuaacuucucaaguucuagagaaa

SEQ ID NO: 54331 - RNA, 32 nt, Human
agcuuuuucuuuccuuccuuccuuccucucuu

SEQ ID NO: 54332 - RNA, 32 nt, Human
agcuuuuuggaagaaagaacaagcuucuuuug

SEQ ID NO: 54333 - RNA, 32 nt, Human
aggaaaaaccaaaaaccaggaacaacccggau

SEQ ID NO: 54334 - RNA, 32 nt, Human
aggaaaaacuauuuaauacaugaccuagggga

SEQ ID NO: 54335 - RNA, 32 nt, Human
aggaaaaacucauguuccaguauauuucucuu

SEQ ID NO: 54336 - RNA, 32 nt, Human
aggaaaaacucuagagcaaagcagaggaacgg

SEQ ID NO: 54337 - RNA, 23 nt, Human
aggaaaaacuucagagccuaaga

SEQ ID NO: 54338 - RNA, 23 nt, Human
aggaaaaacuuguuacugaaaga

SEQ ID NO: 54339 - RNA, 32 nt, Human
aggaaaaacuuucuuccucucucuccaagagg

SEQ ID NO: 54340 - RNA, 32 nt, Human
aggaaaaagcuuuacucuuucaugccauuuua

SEQ ID NO: 54341 - RNA, 32 nt, Human
aggaaaaaguugaguaaauuucuugucauaua

SEQ ID NO: 54342 - RNA, 32 nt, Human
aggaaaaauauuaggaauaaaauaugauaaaa

SEQ ID NO: 54343 - RNA, 32 nt, Human
aggaaaaauggaaacauuuauuccuuugcaua

SEQ ID NO: 54344 - RNA, 32 nt, Human
aggaaaaauuagcucuuugaagagaaaguagu

SEQ ID NO: 54345 - RNA, 32 nt, Human
aggaaaacaaaacccaaagcuuuucaaacuuc

SEQ ID NO: 54346 - RNA, 32 nt, Human
aggaaaacacagcuccccagacuggaggcugg

SEQ ID NO: 54347 - RNA, 32 nt, Human
aggaaaacaugcuaguuuuaugcagggcauuc

SEQ ID NO: 54348 - RNA, 32 nt, Human
aggaaaaccaacaugaaacaccaaauagugug

SEQ ID NO: 54349 - RNA, 32 nt, Human
aggaaaaccagaaacgccuugccuucagcuga

SEQ ID NO: 54350 - RNA, 32 nt, Human
aggaaaaccgaguaaaggagguuauucauaag

SEQ ID NO: 54351 - RNA, 32 nt, Human
aggaaaacgaggagggagggagagggaaauug

SEQ ID NO: 54352 - RNA, 32 nt, Human
aggaaaacgguacaaacacgacacugaaauuc

SEQ ID NO: 54353 - RNA, 32 nt, Human
aggaaaacucaaaucuuuggcaaccaaggaaa

SEQ ID NO: 54354 - RNA, 32 nt, Human
aggaaaacucccucuucgucaugccaacguga

SEQ ID NO: 54355 - RNA, 32 nt, Human
aggaaaacuguuaagagaaaugagcacgcaug

SEQ ID NO: 54356 - RNA, 32 nt, Human
aggaaaagaaacagcagcagguuugauauuca

SEQ ID NO: 54357 - RNA, 32 nt, Human
aggaaaagaacaguuguaauuuguguaaacuc

SEQ ID NO: 54358 - RNA, 21 nt, Human
aggaaaagaacauuccaggca

SEQ ID NO: 54359 - RNA, 32 nt, Human
aggaaaagaagagacuaggaaagcugggccca

SEQ ID NO: 54360 - RNA, 32 nt, Human
aggaaaagacaauacccuucaaacuuugagag

SEQ ID NO: 54361 - RNA, 32 nt, Human
aggaaaagacuuauauaagaagaaaagcauuu

SEQ ID NO: 54362 - RNA, 32 nt, Human
aggaaaagagggagauuuccaggccuggguaa

SEQ ID NO: 54363 - RNA, 18 nt, Human
aggaaaagcagggcccug

SEQ ID NO: 54364 - RNA, 32 nt, Human
aggaaaagcaguuggaggucucuuccagauug

SEQ ID NO: 54365 - RNA, 32 nt, Human
aggaaaagcccaaacuccuuccacccuccagg

SEQ ID NO: 54366 - RNA, 32 nt, Human
aggaaaagcugaugcuaccugcuguggccgau

SEQ ID NO: 54367 - RNA, 32 nt, Human
aggaaaagcugauguugugcagugccaaacua

SEQ ID NO: 54368 - RNA, 32 nt, Human
aggaaaagcuguucccaugucuaacaggacuu

SEQ ID NO: 54369 - RNA, 32 nt, Human
aggaaaaggagagggaagagguagaggaugag

SEQ ID NO: 54370 - RNA, 32 nt, Human
aggaaaagggcucugcagagcuugcacauaaa

SEQ ID NO: 54371 - RNA, 20 nt, Human
aggaaaaggggacaggaaca

SEQ ID NO: 54372 - RNA, 32 nt, Human
aggaaaaggggcuuucaagccauguugaagug

SEQ ID NO: 54373 - RNA, 32 nt, Human
aggaaaagguuccuguaacaaaugugguuauc

SEQ ID NO: 54374 - RNA, 32 nt, Human
aggaaaagugaaaucagagaggcguacccuag

SEQ ID NO: 54375 - RNA, 32 nt, Human
aggaaaagugaauugcaccaucaaagaacaaa

SEQ ID NO: 54376 - RNA, 32 nt, Human
aggaaaauacaaaugcacagacugucagcaug

SEQ ID NO: 54377 - RNA, 17 nt, Human
aggaaaauccucuggcu

SEQ ID NO: 54378 - RNA, 32 nt, Human
aggaaaaucgguuccaaggacagcugccaaga

SEQ ID NO: 54379 - RNA, 32 nt, Human
aggaaaaugggcagcugucuucugccuaaugu

SEQ ID NO: 54380 - RNA, 32 nt, Human
aggaaaauuagcugggugugguggcgcaugcc

SEQ ID NO: 54381 - RNA, 32 nt, Human
aggaaaauuaucuccccugcaaagcccgguuc

SEQ ID NO: 54382 - RNA, 32 nt, Human
aggaaaauuuguaccugccguauuuaugcuuu

SEQ ID NO: 54383 - RNA, 32 nt, Human
aggaaacaaauggucaccaauguccuucaccc

SEQ ID NO: 54384 - RNA, 32 nt, Human
aggaaacaccuccagcccgcgaccuccuccca

SEQ ID NO: 54385 - RNA, 32 nt, Human
aggaaacacugcaacuuuccuuaacagccugu

SEQ ID NO: 54386 - RNA, 31 nt, Human
aggaaacacuguuuccuacucacuuagcuua

SEQ ID NO: 54387 - RNA, 32 nt, Human
aggaaacagagggucagagugguucaguggcc

SEQ ID NO: 54388 - RNA, 32 nt, Human
aggaaacagcaacccagagaggagaacuaacc

SEQ ID NO: 54389 - RNA, 18 nt, Human
aggaaacagccuggcaaa

SEQ ID NO: 54390 - RNA, 30 nt, Human
aggaaacagcugauccugcuccuguggccu

SEQ ID NO: 54391 - RNA, 32 nt, Human
aggaaacagcuggcuaagcucaucauuguuac

SEQ ID NO: 54392 - RNA, 32 nt, Human
aggaaacaggaaagagaaagaaaaggaaggaa

SEQ ID NO: 54393 - RNA, 32 nt, Human
aggaaacaggaaauguggccgggaagcagagu

SEQ ID NO: 54394 - RNA, 32 nt, Human
aggaaacaggaagaaguauggugggggcuggg

SEQ ID NO: 54395 - RNA, 32 nt, Human
aggaaacaggaagggauaggauucaagaacag

SEQ ID NO: 54396 - RNA, 20 nt, Human
aggaaacaggaccugagaaa

SEQ ID NO: 54397 - RNA, 32 nt, Human
aggaaacaggcuccuucucuucucccaucugc

SEQ ID NO: 54398 - RNA, 32 nt, Human
aggaaacaggggcagaguaauucaggcacaug

SEQ ID NO: 54399 - RNA, 32 nt, Human
aggaaacaggggcagccuggauuuuuauggua

SEQ ID NO: 54400 - RNA, 32 nt, Human
aggaaacagguaaacagauguaauuagagaca

SEQ ID NO: 54401 - RNA, 32 nt, Human
aggaaacaguagugccuguuugaguuggcaga

SEQ ID NO: 54402 - RNA, 32 nt, Human
aggaaacaguuaaaaucuugcagcagcugcaa

SEQ ID NO: 54403 - RNA, 32 nt, Human
aggaaacaucacaaaacugagcacucuucugu

SEQ ID NO: 54404 - RNA, 32 nt, Human
aggaaacaucaucugaugaugucugggaagcg

SEQ ID NO: 54405 - RNA, 21 nt, Human
aggaaacauccacacugaaga

SEQ ID NO: 54406 - RNA, 32 nt, Human
aggaaacaugucccucagguguagaagcugca

SEQ ID NO: 54407 - RNA, 32 nt, Human
aggaaaccacaguggcacagagugcagugccu

SEQ ID NO: 54408 - RNA, 32 nt, Human
aggaaaccagcagaugcccagcuguagcugug

SEQ ID NO: 54409 - RNA, 23 nt, Human
aggaaaccagggucuuccuguuc

SEQ ID NO: 54410 - RNA, 32 nt, Human
aggaaaccauguccaaaacccuagcagcggua

SEQ ID NO: 54411 - RNA, 32 nt, Human
aggaaaccccacccuuuucuccucacugugcc

SEQ ID NO: 54412 - RNA, 32 nt, Human
aggaaaccucauuccuaccuacacuggaagga

SEQ ID NO: 54413 - RNA, 32 nt, Human
aggaaaccuguagcuucaaucaugucugguaa

SEQ ID NO: 54414 - RNA, 32 nt, Human
aggaaaccuucaggaaccuggcuucugaaaaa

SEQ ID NO: 54415 - RNA, 32 nt, Human
aggaaaccuucccauucuuaauugccuuuaau

SEQ ID NO: 54416 - RNA, 32 nt, Human
aggaaacgcccuauuuccaagcauaccuguac

SEQ ID NO: 54417 - RNA, 32 nt, Human
aggaaacggugccaccaccaaggucucagccu

SEQ ID NO: 54418 - RNA, 32 nt, Human
aggaaacgucacuuucacacacacagauggaa

SEQ ID NO: 54419 - RNA, 32 nt, Human
aggaaacgugccacagagcaguagugcgcagg

SEQ ID NO: 54420 - RNA, 18 nt, Human
aggaaacuaccucuggcu

SEQ ID NO: 54421 - RNA, 20 nt, Human
aggaaacuccagggcacugc

SEQ ID NO: 54422 - RNA, 32 nt, Human
aggaaacucuuucauaaagcacuuuuguggcc

SEQ ID NO: 54423 - RNA, 32 nt, Human
aggaaacugaacacugagaucugcugcgucac

SEQ ID NO: 54424 - RNA, 32 nt, Human
aggaaacugcccaaaguggccgcuguggagga

SEQ ID NO: 54425 - RNA, 19 nt, Human
aggaaacugcccagagcca

SEQ ID NO: 54426 - RNA, 32 nt, Human
aggaaacuggaacccagugaauacucagaacc

SEQ ID NO: 54427 - RNA, 32 nt, Human
aggaaagaaacagauccacgcacucugauacc

SEQ ID NO: 54428 - RNA, 32 nt, Human
aggaaagaaaccagauuugcuuaaaucuguuc

SEQ ID NO: 54429 - RNA, 32 nt, Human
aggaaagaaacugaagaaagaagauaauagac

SEQ ID NO: 54430 - RNA, 32 nt, Human
aggaaagaaagaaagaaaagaaaagaaaaucc

SEQ ID NO: 54431 - RNA, 32 nt, Human
aggaaagaaagaaagacuguaauaaguuaccu

SEQ ID NO: 54432 - RNA, 32 nt, Human
aggaaagaaagauccucugcugaccccuggag

SEQ ID NO: 54433 - RNA, 32 nt, Human
aggaaagaaagccaagauuuagguaaugagug

SEQ ID NO: 54434 - RNA, 32 nt, Human
aggaaagaagaaaagcgagcgaggaagacgga

SEQ ID NO: 54435 - RNA, 32 nt, Human
aggaaagaagaaaagggccaggagucagacgu

SEQ ID NO: 54436 - RNA, 23 nt, Human
aggaaagaagaccuguuuauaca

SEQ ID NO: 54437 - RNA, 32 nt, Human
aggaaagaagagagaagagagacaaagaucac

SEQ ID NO: 54438 - RNA, 32 nt, Human
aggaaagaaggaaggaaggaaggaaggaagga

SEQ ID NO: 54439 - RNA, 32 nt, Human
aggaaagaaguuaagagagugagagugagugg

SEQ ID NO: 54440 - RNA, 32 nt, Human
aggaaagacagcagugaugacacugucugucu

SEQ ID NO: 54441 - RNA, 32 nt, Human
aggaaagacuuccuggccaacaugagguuucu

SEQ ID NO: 54442 - RNA, 19 nt, Human
aggaaagagaagaaacccu

SEQ ID NO: 54443 - RNA, 32 nt, Human
aggaaagagagaaggaaggaagcugaggacuu

SEQ ID NO: 54444 - RNA, 31 nt, Human
aggaaagagagaccuuucuuguuucuggacu

SEQ ID NO: 54445 - RNA, 32 nt, Human
aggaaagagagaggaggagggggaaagagcaa

SEQ ID NO: 54446 - RNA, 32 nt, Human
aggaaagagagggaagagaggcagccugccug

SEQ ID NO: 54447 - RNA, 32 nt, Human
aggaaagagccgcucacacagagaugcgcauc

SEQ ID NO: 54448 - RNA, 24 nt, Human
aggaaagagcugguagaaggggag

SEQ ID NO: 54449 - RNA, 32 nt, Human
aggaaagaggagagaaagaaagaaagggcacg

SEQ ID NO: 54450 - RNA, 32 nt, Human
aggaaagaguuggaagccuccucaaaucugcc

SEQ ID NO: 54451 - RNA, 32 nt, Human
aggaaagauccaaaauugacacccuaacauca

SEQ ID NO: 54452 - RNA, 32 nt, Human
aggaaagaucgagaaaucaaaugaaguucucc

SEQ ID NO: 54453 - RNA, 25 nt, Human
aggaaagaugaggcaucgugccuca

SEQ ID NO: 54454 - RNA, 32 nt, Human
aggaaagaugcugccagguguaguggcucacg

SEQ ID NO: 54455 - RNA, 32 nt, Human
aggaaagcaaacagucagcagugcucaaagga

SEQ ID NO: 54456 - RNA, 32 nt, Human
aggaaagcaauuagccagagaggcagagacac

SEQ ID NO: 54457 - RNA, 32 nt, Human
aggaaagcacagaggacaaaguuaauucaaaa

SEQ ID NO: 54458 - RNA, 32 nt, Human
aggaaagcacagaggccuccuguggccugcca

SEQ ID NO: 54459 - RNA, 21 nt, Human
aggaaagcacuguuucccuca

SEQ ID NO: 54460 - RNA, 32 nt, Human
aggaaagcagagggguuccugccgcuugccuc

SEQ ID NO: 54461 - RNA, 32 nt, Human
aggaaagcagcauucuggaggggagagcuuug

SEQ ID NO: 54462 - RNA, 32 nt, Human
aggaaagcagggagccacugcauccagcacau

SEQ ID NO: 54463 - RNA, 32 nt, Human
aggaaagcauuuauacuugagauaaauuauac

SEQ ID NO: 54464 - RNA, 32 nt, Human
aggaaagccaagguggaggcugagguggcugc

SEQ ID NO: 54465 - RNA, 32 nt, Human
aggaaagccacgacaguaacccaugcgaccac

SEQ ID NO: 54466 - RNA, 32 nt, Human
aggaaagccacuccaccaguagugcugguugc

SEQ ID NO: 54467 - RNA, 22 nt, Human
aggaaagccacuggaauuguca

SEQ ID NO: 54468 - RNA, 32 nt, Human
aggaaagccagcagccccagacugcccaaaaa

SEQ ID NO: 54469 - RNA, 32 nt, Human
aggaaagcccucccccuuccccuucuguguca

SEQ ID NO: 54470 - RNA, 32 nt, Human
aggaaagccgaaggcggagcagcuggaggcga

SEQ ID NO: 54471 - RNA, 32 nt, Human
aggaaagccgucucccugcuugacucgacugc

SEQ ID NO: 54472 - RNA, 32 nt, Human
aggaaagcucaggcaagcccacccucaggcau

SEQ ID NO: 54473 - RNA, 32 nt, Human
aggaaagcugcaggaaccucgugggcuccagg

SEQ ID NO: 54474 - RNA, 32 nt, Human
aggaaaggaagcagauaccuugcaaagcaacu

SEQ ID NO: 54475 - RNA, 31 nt, Human
aggaaaggaaggagagaaagaaaagcuggaa

SEQ ID NO: 54476 - RNA, 32 nt, Human
aggaaaggacugcuucagaaacucccaauucc

SEQ ID NO: 54477 - RNA, 32 nt, Human
aggaaaggacugugaauguugcaauggaaugc

SEQ ID NO: 54478 - RNA, 32 nt, Human
aggaaaggagagaagugaugucagggacaggc

SEQ ID NO: 54479 - RNA, 25 nt, Human
aggaaaggagagggcucacuuauca

SEQ ID NO: 54480 - RNA, 32 nt, Human
aggaaaggagcagaaggucuuggugaagaagg

SEQ ID NO: 54481 - RNA, 32 nt, Human
aggaaaggaggcacagcccagagaaccccuuu

SEQ ID NO: 54482 - RNA, 32 nt, Human
aggaaaggagugaaagggaaguaggaccagag

SEQ ID NO: 54483 - RNA, 32 nt, Human
aggaaaggaugggggcugaagagcagaaggga

SEQ ID NO: 54484 - RNA, 32 nt, Human
aggaaaggauugccuuucgaugaaccccagca

SEQ ID NO: 54485 - RNA, 32 nt, Human
aggaaaggcaaauucuucucuccucuggagcu

SEQ ID NO: 54486 - RNA, 32 nt, Human
aggaaaggcagaaacacaaccacucaccaguc

SEQ ID NO: 54487 - RNA, 32 nt, Human
aggaaaggcccucugcuuuucuucccagcaaa

SEQ ID NO: 54488 - RNA, 32 nt, Human
aggaaaggcugaacagaagggcuaguguauug

SEQ ID NO: 54489 - RNA, 32 nt, Human
aggaaagggaaagguagaaaccccauagcccg

SEQ ID NO: 54490 - RNA, 32 nt, Human
aggaaagggaaaggugaggccccagaggacuu

SEQ ID NO: 54491 - RNA, 32 nt, Human
aggaaagggaagcaccuccaccagccagggca

SEQ ID NO: 54492 - RNA, 32 nt, Human
aggaaagggagaccagccugaccaauauggag

SEQ ID NO: 54493 - RNA, 32 nt, Human
aggaaagggauuaggguaggggaugacagggg

SEQ ID NO: 54494 - RNA, 32 nt, Human
aggaaagggcaggccgggugagcagacggauc

SEQ ID NO: 54495 - RNA, 19 nt, Human
aggaaagggccagaagcca

SEQ ID NO: 54496 - RNA, 32 nt, Human
aggaaagggcugcuugagaugacugugguccc

SEQ ID NO: 54497 - RNA, 32 nt, Human
aggaaagggcugcuuucggcacucugcgugga

SEQ ID NO: 54498 - RNA, 32 nt, Human
aggaaaggggcacggccucccucacagcccuu

SEQ ID NO: 54499 - RNA, 32 nt, Human
aggaaaggggcaggcggcagugcacagggauu

SEQ ID NO: 54500 - RNA, 32 nt, Human
aggaaaggggcugggugcaguggcucacaccu

SEQ ID NO: 54501 - RNA, 32 nt, Human
aggaaagggggaggcggcuggggaaggggaaa

SEQ ID NO: 54502 - RNA, 32 nt, Human
aggaaagggugccucaucccagcaaccugucc

SEQ ID NO: 54503 - RNA, 32 nt, Human
aggaaagguagaaguuguucauugccgaagaa

SEQ ID NO: 54504 - RNA, 24 nt, Human
aggaaagguuuguaaaugguguca

SEQ ID NO: 54505 - RNA, 32 nt, Human
aggaaagucguacuguucacacacacaguuug

SEQ ID NO: 54506 - RNA, 32 nt, Human
aggaaagucuugaucuccugaccucgugaucc

SEQ ID NO: 54507 - RNA, 32 nt, Human
aggaaagugccugguaggacugacggcugccu

SEQ ID NO: 54508 - RNA, 32 nt, Human
aggaaaguugacuuguagagugaucuagaaca

SEQ ID NO: 54509 - RNA, 32 nt, Human
aggaaaguuguuucaaugcuguaaguaggugu

SEQ ID NO: 54510 - RNA, 32 nt, Human
aggaaaguuugcaucuaugaaaagccaauagg

SEQ ID NO: 54511 - RNA, 32 nt, Human
aggaaauaagagcagucacaacagagugaaaa

SEQ ID NO: 54512 - RNA, 32 nt, Human
aggaaauaccuacacugcagucuaagaauauu

SEQ ID NO: 54513 - RNA, 32 nt, Human
aggaaauacuauaucacuauucaagaucaucu

SEQ ID NO: 54514 - RNA, 32 nt, Human
aggaaauacucacuucccuccacccucaacag

SEQ ID NO: 54515 - RNA, 32 nt, Human
aggaaauagaucucuuucccugacugagaaug

SEQ ID NO: 54516 - RNA, 32 nt, Human
aggaaauagaugucugcacuccuggcugcagc

SEQ ID NO: 54517 - RNA, 31 nt, Human
aggaaauaguuucagucuucauuugagcaug

SEQ ID NO: 54518 - RNA, 32 nt, Human
aggaaauauaauugugccacacacacauuacu

SEQ ID NO: 54519 - RNA, 32 nt, Human
aggaaauaucagugaagcuggacuugagcugu

SEQ ID NO: 54520 - RNA, 32 nt, Human
aggaaauaucuugccaggauaccuacccaucc

SEQ ID NO: 54521 - RNA, 32 nt, Human
aggaaauauguguaugugcauguauguguaug

SEQ ID NO: 54522 - RNA, 21 nt, Human
aggaaaucacuguacuucugg

SEQ ID NO: 54523 - RNA, 32 nt, Human
aggaaauccccacccccguccaccccagagac

SEQ ID NO: 54524 - RNA, 32 nt, Human
aggaaaucccuaaaacuuccagccucacauag

SEQ ID NO: 54525 - RNA, 32 nt, Human
aggaaaucccucaaggaccacccccuacucag

SEQ ID NO: 54526 - RNA, 32 nt, Human
aggaaaucuaucucccuaucuuggguccuuga

SEQ ID NO: 54527 - RNA, 32 nt, Human
aggaaaucucucuauggauucccucaucuccu

SEQ ID NO: 54528 - RNA, 32 nt, Human
aggaaaucucuuacacacauacagcagggucc

SEQ ID NO: 54529 - RNA, 22 nt, Human
aggaaaugaaggcacaggagca

SEQ ID NO: 54530 - RNA, 32 nt, Human
aggaaaugaauccagcagccaacucgaauccc

SEQ ID NO: 54531 - RNA, 32 nt, Human
aggaaaugaccaagcucacacaugcuggcuga

SEQ ID NO: 54532 - RNA, 32 nt, Human
aggaaaugaccaggccccagagagccugugca

SEQ ID NO: 54533 - RNA, 30 nt, Human
aggaaaugagauccauguauaaaagagaua

SEQ ID NO: 54534 - RNA, 32 nt, Human
aggaaaugccaggcauccucaguggcuuaaau

SEQ ID NO: 54535 - RNA, 19 nt, Human
aggaaauggaacaggguca

SEQ ID NO: 54536 - RNA, 22 nt, Human
aggaaauggaauugguauuuca

SEQ ID NO: 54537 - RNA, 23 nt, Human
aggaaauggaauuugacuuuuua

SEQ ID NO: 54538 - RNA, 31 nt, Human
aggaaauggacaaggucaguuugaauauccc

SEQ ID NO: 54539 - RNA, 26 nt, Human
aggaaauggagaaguuugguuuguua

SEQ ID NO: 54540 - RNA, 32 nt, Human
aggaaauggagacggagaaauggcacuaaugg

SEQ ID NO: 54541 - RNA, 21 nt, Human
aggaaauggaguugaagaugu

SEQ ID NO: 54542 - RNA, 32 nt, Human
aggaaauggcgucguggcauugaggggcaucc

SEQ ID NO: 54543 - RNA, 32 nt, Human
aggaaaugggagguggaggguuguacugugac

SEQ ID NO: 54544 - RNA, 32 nt, Human
aggaaaugggcaaggcagaguaagcaggggag

SEQ ID NO: 54545 - RNA, 32 nt, Human
aggaaaugggcuuuucaggaagugaauugaug

SEQ ID NO: 54546 - RNA, 32 nt, Human
aggaaauggugaaagcuccuaucagaacuaua

SEQ ID NO: 54547 - RNA, 32 nt, Human
aggaaaugguguuaggccccuuuuccagaaga

SEQ ID NO: 54548 - RNA, 32 nt, Human
aggaaaugguugaaaacugaagguagauggug

SEQ ID NO: 54549 - RNA, 32 nt, Human
aggaaaugucgaguuuguucaucacucugaag

SEQ ID NO: 54550 - RNA, 32 nt, Human
aggaaauguuguggaauauuuuuccaaguagu

SEQ ID NO: 54551 - RNA, 32 nt, Human
aggaaauucccugaccucucaauccucaccau

SEQ ID NO: 54552 - RNA, 32 nt, Human
aggaaauugcugucuugugcuuugugucucuc

SEQ ID NO: 54553 - RNA, 32 nt, Human
aggaaauuguaggagaugucuccugaguguga

SEQ ID NO: 54554 - RNA, 32 nt, Human
aggaaauuguagggaagaucgaugaagugguc

SEQ ID NO: 54555 - RNA, 32 nt, Human
aggaaauuugaccuccaagcagcccugacagg

SEQ ID NO: 54556 - RNA, 32 nt, Human
aggaaauuugcagcuuccaaugccucuugucu

SEQ ID NO: 54557 - RNA, 32 nt, Human
aggaacaacuggacuuuuucaaagggaccuug

SEQ ID NO: 54558 - RNA, 31 nt, Human
aggaacaagcgaccuguuuggcaaggaauac

SEQ ID NO: 54559 - RNA, 21 nt, Human
aggaacaaggagaaagcaaug

SEQ ID NO: 54560 - RNA, 32 nt, Human
aggaacaaggcccacagacuggggagcuucac

SEQ ID NO: 54561 - RNA, 32 nt, Human
aggaacaagggacucuuccauggccauggcag

SEQ ID NO: 54562 - RNA, 32 nt, Human
aggaacaagguccacagacuggggagcuucac

SEQ ID NO: 54563 - RNA, 32 nt, Human
aggaacaaguaugggaugagaucaauaagccu

SEQ ID NO: 54564 - RNA, 32 nt, Human
aggaacaagugcugggaucuggcgugugugcu

SEQ ID NO: 54565 - RNA, 32 nt, Human
aggaacacaagaacacuguucaccauucugcu

SEQ ID NO: 54566 - RNA, 24 nt, Human
aggaacacagccuuguucuucucu

SEQ ID NO: 54567 - RNA, 32 nt, Human
aggaacacagugccagugcagaaguuucucca

SEQ ID NO: 54568 - RNA, 32 nt, Human
aggaacaccacugcuuuucagcauuguacugg

SEQ ID NO: 54569 - RNA, 32 nt, Human
aggaacaccuguccaucaccuccuggauggau

SEQ ID NO: 54570 - RNA, 32 nt, Human
aggaacacuagaauccccaccucagcgugagg

SEQ ID NO: 54571 - RNA, 32 nt, Human
aggaacagaagaggaaagagagacacagcugc

SEQ ID NO: 54572 - RNA, 32 nt, Human
aggaacagaaggucuggccacccuggaaggag

SEQ ID NO: 54573 - RNA, 23 nt, Human
aggaacagagaagaggccccaga

SEQ ID NO: 54574 - RNA, 32 nt, Human
aggaacagaggugccaugcagccccggguacu

SEQ ID NO: 54575 - RNA, 32 nt, Human
aggaacagccagugggagguuccagcugagcg

SEQ ID NO: 54576 - RNA, 32 nt, Human
aggaacagcccuuuugaaagugucccaguaac

SEQ ID NO: 54577 - RNA, 32 nt, Human
aggaacagccugagauaugagcaugagcccau

SEQ ID NO: 54578 - RNA, 32 nt, Human
aggaacagccuucuccugccuccucugcaccu

SEQ ID NO: 54579 - RNA, 32 nt, Human
aggaacagcucuggucugcagcucccagugag

SEQ ID NO: 54580 - RNA, 32 nt, Human
aggaacagcucuucacucagccacaccccaca

SEQ ID NO: 54581 - RNA, 30 nt, Human
aggaacagcugauucaugcuccucccgcaa

SEQ ID NO: 54582 - RNA, 32 nt, Human
aggaacagcuuugugcuccggcuuucccucag

SEQ ID NO: 54583 - RNA, 32 nt, Human
aggaacaggaagagaagaugugggagcaggag

SEQ ID NO: 54584 - RNA, 32 nt, Human
aggaacaggaauguguuggugccugagacacc

SEQ ID NO: 54585 - RNA, 18 nt, Human
aggaacaggcaguggcug

SEQ ID NO: 54586 - RNA, 31 nt, Human
aggaacaggcguuucugacgagcgggacgca

SEQ ID NO: 54587 - RNA, 32 nt, Human
aggaacagggguuugaggggaacauggggacu

SEQ ID NO: 54588 - RNA, 32 nt, Human
aggaacagugugcuucaggaaguggguugcac

SEQ ID NO: 54589 - RNA, 32 nt, Human
aggaacaucaagaagaaccggggccuguacag

SEQ ID NO: 54590 - RNA, 32 nt, Human
aggaacaucgauaaguaguguaaaaacuugca

SEQ ID NO: 54591 - RNA, 19 nt, Human
aggaacaugcccagagcca

SEQ ID NO: 54592 - RNA, 32 nt, Human
aggaacaugcucccucccucccucccauaaaa

SEQ ID NO: 54593 - RNA, 32 nt, Human
aggaacauucgcuucucucaccaggaacauuu

SEQ ID NO: 54594 - RNA, 32 nt, Human
aggaacauugccucucuggaucugcugugacc

SEQ ID NO: 54595 - RNA, 32 nt, Human
aggaacauuuuuccuguaguagcuagagugcc

SEQ ID NO: 54596 - RNA, 32 nt, Human
aggaaccacagcguucuugcgcuugagaccgc

SEQ ID NO: 54597 - RNA, 32 nt, Human
aggaaccagcacugucucugugccugacucac

SEQ ID NO: 54598 - RNA, 32 nt, Human
aggaaccagcccugccaacaccuggauuuuag

SEQ ID NO: 54599 - RNA, 32 nt, Human
aggaaccaguaggaagaugguuaaguggguac

SEQ ID NO: 54600 - RNA, 32 nt, Human
aggaaccagugaauucuuuccuggcauuuaaa

SEQ ID NO: 54601 - RNA, 32 nt, Human
aggaaccaugaagaaacaggccaacaaaacug

SEQ ID NO: 54602 - RNA, 32 nt, Human
aggaacccaagaaaggcgcgcgacaaugguag

SEQ ID NO: 54603 - RNA, 20 nt, Human
aggaacccaaggcccuggga

SEQ ID NO: 54604 - RNA, 22 nt, Human
aggaacccaaucugccuucaug

SEQ ID NO: 54605 - RNA, 32 nt, Human
aggaacccagacuggacuucagucucccucca

SEQ ID NO: 54606 - RNA, 32 nt, Human
aggaacccaucuccagaugccaaaggacuuga

SEQ ID NO: 54607 - RNA, 21 nt, Human
aggaaccccaccccuuauguc

SEQ ID NO: 54608 - RNA, 23 nt, Human
aggaaccccaugaggaaggugua

SEQ ID NO: 54609 - RNA, 32 nt, Human
aggaacccccagggaaaaccaggcugggacag

SEQ ID NO: 54610 - RNA, 32 nt, Human
aggaacccccuccauaaaauggaccauaucgg

SEQ ID NO: 54611 - RNA, 19 nt, Human
aggaaccccucucccuucc

SEQ ID NO: 54612 - RNA, 32 nt, Human
aggaacccugcuccucucuguccugccucagg

SEQ ID NO: 54613 - RNA, 20 nt, Human
aggaacccugcuucuccuca

SEQ ID NO: 54614 - RNA, 32 nt, Human
aggaacccuggagguugagguugcagugagcu

SEQ ID NO: 54615 - RNA, 32 nt, Human
aggaaccgcugcuuggauggugccauucaggc

SEQ ID NO: 54616 - RNA, 32 nt, Human
aggaaccuauggcuggcuuuccuuagcagcaa

SEQ ID NO: 54617 - RNA, 32 nt, Human
aggaaccucagaggagggggcucuggggacug

SEQ ID NO: 54618 - RNA, 32 nt, Human
aggaaccuccagcgcugagauguggccgugag

SEQ ID NO: 54619 - RNA, 18 nt, Human
aggaaccucccuccuccu

SEQ ID NO: 54620 - RNA, 32 nt, Human
aggaaccugaaccugggaaccaugaagcugga

SEQ ID NO: 54621 - RNA, 32 nt, Human
aggaaccugccugaauuuauggcauuaguggu

SEQ ID NO: 54622 - RNA, 24 nt, Human
aggaaccugggcucugcuuccucc

SEQ ID NO: 54623 - RNA, 32 nt, Human
aggaaccuguaaucccagcuacaggggaggcu

SEQ ID NO: 54624 - RNA, 32 nt, Human
aggaaccuguucuacggccagaagaacaagua

SEQ ID NO: 54625 - RNA, 32 nt, Human
aggaaccuucgccacagacuccuguacuauua

SEQ ID NO: 54626 - RNA, 32 nt, Human
aggaaccuuugguguguggugggaagcuauca

SEQ ID NO: 54627 - RNA, 32 nt, Human
aggaaccuuugucccccaaugccugcauggau

SEQ ID NO: 54628 - RNA, 32 nt, Human
aggaacgagauggcgguucuccggaggcugag

SEQ ID NO: 54629 - RNA, 32 nt, Human
aggaacgaggucucacuauauugcccagacug

SEQ ID NO: 54630 - RNA, 32 nt, Human
aggaacgccucaucucagcagccugggcucgg

SEQ ID NO: 54631 - RNA, 32 nt, Human
aggaacgcuucauuuccuuggggcugcaguuu

SEQ ID NO: 54632 - RNA, 32 nt, Human
aggaacggagauugacaaggaggcagaggccu

SEQ ID NO: 54633 - RNA, 22 nt, Human
aggaacggcacaggcguccagg

SEQ ID NO: 54634 - RNA, 19 nt, Human
aggaacgggcagccacagg

SEQ ID NO: 54635 - RNA, 32 nt, Human
aggaacgguggaggcagaggugacaguuccca

SEQ ID NO: 54636 - RNA, 32 nt, Human
aggaacgucaaggucaugggaaauaaaggcag

SEQ ID NO: 54637 - RNA, 32 nt, Human
aggaacguguaauccucagcgugcuccagccc

SEQ ID NO: 54638 - RNA, 32 nt, Human
aggaacuaauuucuucuccuggaguugcauug

SEQ ID NO: 54639 - RNA, 32 nt, Human
aggaacuacaucugacugcucuucccauaaug

SEQ ID NO: 54640 - RNA, 32 nt, Human
aggaacuacuugccuuaaauguuaauaucaaa

SEQ ID NO: 54641 - RNA, 32 nt, Human
aggaacuaggaaucaaaacccaaaaaggccca

SEQ ID NO: 54642 - RNA, 32 nt, Human
aggaacuagguaggagaggaaggauuugagaa

SEQ ID NO: 54643 - RNA, 32 nt, Human
aggaacuagucuuucuccaagaagaacucgac

SEQ ID NO: 54644 - RNA, 32 nt, Human
aggaacuauccucugcucugccacugccccag

SEQ ID NO: 54645 - RNA, 32 nt, Human
aggaacuauuugaacagcugaagaugaagaaa

SEQ ID NO: 54646 - RNA, 31 nt, Human
aggaacucaauaaagugcuuugaaaaugcug

SEQ ID NO: 54647 - RNA, 32 nt, Human
aggaacucaccuuucaaacccugguagagcau

SEQ ID NO: 54648 - RNA, 32 nt, Human
aggaacucagaugugauuuuagccagggcuug

SEQ ID NO: 54649 - RNA, 32 nt, Human
aggaacucaguuaaaaugcaguugaagaaugu

SEQ ID NO: 54650 - RNA, 21 nt, Human
aggaacucauacagcacaaga

SEQ ID NO: 54651 - RNA, 32 nt, Human
aggaacucauuaugcuacugguuguuugggga

SEQ ID NO: 54652 - RNA, 32 nt, Human
aggaacuccaggcuugucuuggcuccaaaugg

SEQ ID NO: 54653 - RNA, 32 nt, Human
aggaacuccuggugccuuucugagccugcgug

SEQ ID NO: 54654 - RNA, 32 nt, Human
aggaacucucauaagagacucaugacuucccc

SEQ ID NO: 54655 - RNA, 32 nt, Human
aggaacugaaaaugggccccuuguacaagcug

SEQ ID NO: 54656 - RNA, 32 nt, Human
aggaacugaacccaaaggaucaccugguauuc

SEQ ID NO: 54657 - RNA, 32 nt, Human
aggaacugaauacauuuccuuuaagcaugaaa

SEQ ID NO: 54658 - RNA, 32 nt, Human
aggaacugagccagaaacgcagauugggcugg

SEQ ID NO: 54659 - RNA, 32 nt, Human
aggaacugagcgaggaaggaagggagggaaag

SEQ ID NO: 54660 - RNA, 23 nt, Human
aggaacugcccaucccaccagac

SEQ ID NO: 54661 - RNA, 32 nt, Human
aggaacuggaagaagaaaaauucccagacuca

SEQ ID NO: 54662 - RNA, 32 nt, Human
aggaacuggcaaccuucaucucacuccugagg

SEQ ID NO: 54663 - RNA, 32 nt, Human
aggaacuggccgggguccggaggcagagacgg

SEQ ID NO: 54664 - RNA, 31 nt, Human
aggaacuggcuucucuuaugccaaaggaaua

SEQ ID NO: 54665 - RNA, 32 nt, Human
aggaacugggaggcagguuuggaggcugcagu

SEQ ID NO: 54666 - RNA, 32 nt, Human
aggaacugguccugggggcaccaugguuucgg

SEQ ID NO: 54667 - RNA, 32 nt, Human
aggaacugugggcuuugggagcuuucuugggu

SEQ ID NO: 54668 - RNA, 32 nt, Human
aggaacuguguguguccuacacaauggugcua

SEQ ID NO: 54669 - RNA, 32 nt, Human
aggaacuguuuuuauccagcagugaagcucuu

SEQ ID NO: 54670 - RNA, 32 nt, Human
aggaacuuagcuuuuucaacaagcuucagaau

SEQ ID NO: 54671 - RNA, 32 nt, Human
aggaacuucacucugcugcuuccgagaaccuc

SEQ ID NO: 54672 - RNA, 32 nt, Human
aggaacuucucaucuugcugaaaauuucacca

SEQ ID NO: 54673 - RNA, 32 nt, Human
aggaacuucucuaaacuuuuugcucagaggac

SEQ ID NO: 54674 - RNA, 32 nt, Human
aggaacuugagggggacaaaauucagcccaua

SEQ ID NO: 54675 - RNA, 32 nt, Human
aggaacuuggaacaauuuccccagggacuggu

SEQ ID NO: 54676 - RNA, 32 nt, Human
aggaacuuugagaaaggcaggagaagcaaaaa

SEQ ID NO: 54677 - RNA, 32 nt, Human
aggaacuuugccucucugucccucucuguagg

SEQ ID NO: 54678 - RNA, 32 nt, Human
aggaagaaaagauuugguuuucauggcagucu

SEQ ID NO: 54679 - RNA, 32 nt, Human
aggaagaaaaggaggaaggaaggaaaagguga

SEQ ID NO: 54680 - RNA, 32 nt, Human
aggaagaaaaugaagaaggagugauugaaugu

SEQ ID NO: 54681 - RNA, 32 nt, Human
aggaagaaacaaaggcagcuguggccucggcg

SEQ ID NO: 54682 - RNA, 32 nt, Human
aggaagaaacagaagagagaaggggcgggaau

SEQ ID NO: 54683 - RNA, 32 nt, Human
aggaagaaacaggaucaaaugaauaaauggug

SEQ ID NO: 54684 - RNA, 32 nt, Human
aggaagaaagaagccaauaguagaucagucca

SEQ ID NO: 54685 - RNA, 32 nt, Human
aggaagaaagaauggcuguugggcuucuuaaa

SEQ ID NO: 54686 - RNA, 32 nt, Human
aggaagaaaggaaggaaggaaagaaggaaggg

SEQ ID NO: 54687 - RNA, 32 nt, Human
aggaagaaaggaaggaaggaaggcgagagaga

SEQ ID NO: 54688 - RNA, 20 nt, Human
aggaagaaauauuuacaaug

SEQ ID NO: 54689 - RNA, 32 nt, Human
aggaagaaaugagagucuagacucaagggaca

SEQ ID NO: 54690 - RNA, 32 nt, Human
aggaagaaccgcaguccagacaggaggcuugc

SEQ ID NO: 54691 - RNA, 32 nt, Human
aggaagaaccugccaagcuuggucaucuauga

SEQ ID NO: 54692 - RNA, 32 nt, Human
aggaagaaccuguagaagaugaccucguuccg

SEQ ID NO: 54693 - RNA, 32 nt, Human
aggaagaacgugcacacauaggcgcacacauc

SEQ ID NO: 54694 - RNA, 32 nt, Human
aggaagaacugaaaggcuuuucaaccacaaaa

SEQ ID NO: 54695 - RNA, 32 nt, Human
aggaagaagaagaaggaggaggaggaggagga

SEQ ID NO: 54696 - RNA, 32 nt, Human
aggaagaagagaagagacuugcagugaacugu

SEQ ID NO: 54697 - RNA, 32 nt, Human
aggaagaagaggagaggggagaggccaccguc

SEQ ID NO: 54698 - RNA, 32 nt, Human
aggaagaagaggaggaagauggacuuucagag

SEQ ID NO: 54699 - RNA, 32 nt, Human
aggaagaagaggaggaggaggaagaggaggag

SEQ ID NO: 54700 - RNA, 32 nt, Human
aggaagaagaggaggaggaggagaugguggcc

SEQ ID NO: 54701 - RNA, 32 nt, Human
aggaagaagaggaggaggaggaggaggaggag

SEQ ID NO: 54702 - RNA, 32 nt, Human
aggaagaagaggaggaugagaaguuggaaaga

SEQ ID NO: 54703 - RNA, 23 nt, Human
aggaagaagaggcucgccuccca

SEQ ID NO: 54704 - RNA, 32 nt, Human
aggaagaagauaagcuacuaauagaaaauguu

SEQ ID NO: 54705 - RNA, 32 nt, Human
aggaagaagaugacuaaucauucuaagaccag

SEQ ID NO: 54706 - RNA, 32 nt, Human
aggaagaagccgcggggacuggcugcgcuuga

SEQ ID NO: 54707 - RNA, 32 nt, Human
aggaagaaggggcuagggcaggggagauucuc

SEQ ID NO: 54708 - RNA, 32 nt, Human
aggaagaaguuaggaggaagaagggggaaaaa

SEQ ID NO: 54709 - RNA, 32 nt, Human
aggaagaaguugagacagggaggcaggagaca

SEQ ID NO: 54710 - RNA, 32 nt, Human
aggaagaaguugaggacggucugccuucccuc

SEQ ID NO: 54711 - RNA, 32 nt, Human
aggaagaaugauuuucuuuguacuuagguuuu

SEQ ID NO: 54712 - RNA, 32 nt, Human
aggaagaauggggccucuaaggggaguguggg

SEQ ID NO: 54713 - RNA, 32 nt, Human
aggaagaauuaguuacugacuucaccugagaa

SEQ ID NO: 54714 - RNA, 32 nt, Human
aggaagacaagccacaguuguaugguugcugc

SEQ ID NO: 54715 - RNA, 32 nt, Human
aggaagacacuggcuuuacauggguucaauug

SEQ ID NO: 54716 - RNA, 32 nt, Human
aggaagacagaacauggagaaccgucagggca

SEQ ID NO: 54717 - RNA, 20 nt, Human
aggaagacagcccaccugcc

SEQ ID NO: 54718 - RNA, 32 nt, Human
aggaagacaggaaggaaggaaggaaggaagga

SEQ ID NO: 54719 - RNA, 32 nt, Human
aggaagacauuuggaaaaugauacucuagcac

SEQ ID NO: 54720 - RNA, 32 nt, Human
aggaagaccagccuggccaacauggcgaaacc

SEQ ID NO: 54721 - RNA, 18 nt, Human
aggaagaccccgcggcgg

SEQ ID NO: 54722 - RNA, 32 nt, Human
aggaagacucuugccuuuuuccugggcaacuc

SEQ ID NO: 54723 - RNA, 32 nt, Human
aggaagacugccucuccaucgcugucagagag

SEQ ID NO: 54724 - RNA, 32 nt, Human
aggaagagaaaagaugaaccuuuaagcaaaua

SEQ ID NO: 54725 - RNA, 32 nt, Human
aggaagagaagcuucccuuaaccagaggggcc

SEQ ID NO: 54726 - RNA, 22 nt, Human
aggaagagaaugaaacuugugg

SEQ ID NO: 54727 - RNA, 32 nt, Human
aggaagagacacaccugaccagccccuccccc

SEQ ID NO: 54728 - RNA, 32 nt, Human
aggaagagaccuuuccucugacggaccacuaa

SEQ ID NO: 54729 - RNA, 24 nt, Human
aggaagagacuguggaacggugca

SEQ ID NO: 54730 - RNA, 32 nt, Human
aggaagagagacauagauauuauucuucauuu

SEQ ID NO: 54731 - RNA, 24 nt, Human
aggaagagagcaggcagccucuga

SEQ ID NO: 54732 - RNA, 24 nt, Human
aggaagagagcgaggcaucccuga

SEQ ID NO: 54733 - RNA, 32 nt, Human
aggaagagagcugagcauugauggggaugggg

SEQ ID NO: 54734 - RNA, 18 nt, Human
aggaagagagcuguguug

SEQ ID NO: 54735 - RNA, 32 nt, Human
aggaagagagggagggaggcgggaggagcgcg

SEQ ID NO: 54736 - RNA, 19 nt, Human
aggaagagaggucaccccu

SEQ ID NO: 54737 - RNA, 32 nt, Human
aggaagagaugaggaguggggguccuuuaccu

SEQ ID NO: 54738 - RNA, 32 nt, Human
aggaagagaugggcagggagagugacggggag

SEQ ID NO: 54739 - RNA, 18 nt, Human
aggaagagcagccugacu

SEQ ID NO: 54740 - RNA, 32 nt, Human
aggaagagccagacugccugugaagguauaaa

SEQ ID NO: 54741 - RNA, 32 nt, Human
aggaagagccggcgccaugguggagaaggagg

SEQ ID NO: 54742 - RNA, 32 nt, Human
aggaagagccuugccaggaccugcucccagcu

SEQ ID NO: 54743 - RNA, 32 nt, Human
aggaagaggaagaccuccagcauuggucauaa

SEQ ID NO: 54744 - RNA, 32 nt, Human
aggaagaggaagggcaaauuuguuggcugcuu

SEQ ID NO: 54745 - RNA, 32 nt, Human
aggaagaggaaggggagggaagcuucccaaga

SEQ ID NO: 54746 - RNA, 32 nt, Human
aggaagaggaaggggccucauccacugucugc

SEQ ID NO: 54747 - RNA, 24 nt, Human
aggaagaggacgggaacgguguua

SEQ ID NO: 54748 - RNA, 32 nt, Human
aggaagaggagaaaagggaauuuugucuuuau

SEQ ID NO: 54749 - RNA, 32 nt, Human
aggaagaggagaaagagggagggagaugggag

SEQ ID NO: 54750 - RNA, 32 nt, Human
aggaagaggagaaagccagagagucacucuua

SEQ ID NO: 54751 - RNA, 32 nt, Human
aggaagaggagaauaaggaggagcaggaggaa

SEQ ID NO: 54752 - RNA, 32 nt, Human
aggaagaggagacauugucuccccaguugguu

SEQ ID NO: 54753 - RNA, 32 nt, Human
aggaagaggagagagaagagauggacagaccu

SEQ ID NO: 54754 - RNA, 32 nt, Human
aggaagaggagcgggagcaggagcgcggagcg

SEQ ID NO: 54755 - RNA, 32 nt, Human
aggaagaggaggaagaaggaaagaaaaagaag

SEQ ID NO: 54756 - RNA, 32 nt, Human
aggaagaggaggaagacagugggagucaucag

SEQ ID NO: 54757 - RNA, 32 nt, Human
aggaagaggaggaggaagaggacuucucacag

SEQ ID NO: 54758 - RNA, 32 nt, Human
aggaagaggaggaggaagaggaggaagaggau

SEQ ID NO: 54759 - RNA, 32 nt, Human
aggaagaggaggaggacagcggcccucugagc

SEQ ID NO: 54760 - RNA, 32 nt, Human
aggaagaggaggaggaggaagaggggagcaca

SEQ ID NO: 54761 - RNA, 32 nt, Human
aggaagaggaggaggaggaagggagcaccagu

SEQ ID NO: 54762 - RNA, 32 nt, Human
aggaagaggaggaggaggagaccggcagcaac

SEQ ID NO: 54763 - RNA, 32 nt, Human
aggaagaggaggaggaggaggaggaagcugaa

SEQ ID NO: 54764 - RNA, 32 nt, Human
aggaagaggaggaggaggaggaggcuggguug

SEQ ID NO: 54765 - RNA, 32 nt, Human
aggaagaggagggaggagggaggccgaggagg

SEQ ID NO: 54766 - RNA, 32 nt, Human
aggaagaggagguggaggcuugaugaggaggu

SEQ ID NO: 54767 - RNA, 32 nt, Human
aggaagaggagucggaagggaggcgggguauc

SEQ ID NO: 54768 - RNA, 24 nt, Human
aggaagaggaguggggugguguca

SEQ ID NO: 54769 - RNA, 32 nt, Human
aggaagaggaugaagaugaagaauaauggcua

SEQ ID NO: 54770 - RNA, 32 nt, Human
aggaagaggcagcaggagcuguuggccuuggu

SEQ ID NO: 54771 - RNA, 32 nt, Human
aggaagaggcagcaugaggaaccagagagcuu

SEQ ID NO: 54772 - RNA, 32 nt, Human
aggaagaggcaggcacaagacaaaaugaaucu

SEQ ID NO: 54773 - RNA, 32 nt, Human
aggaagaggcuuuccagggaacacuggacauu

SEQ ID NO: 54774 - RNA, 32 nt, Human
aggaagagggauagcauuuucuauuuguccag

SEQ ID NO: 54775 - RNA, 25 nt, Human
aggaagaguacucuuuggcuuguug

SEQ ID NO: 54776 - RNA, 23 nt, Human
aggaagagugggaggaggagggg

SEQ ID NO: 54777 - RNA, 22 nt, Human
aggaagaguucuuggugguguc

SEQ ID NO: 54778 - RNA, 32 nt, Human
aggaagaguugcugagaagacuacagcaaacu

SEQ ID NO: 54779 - RNA, 32 nt, Human
aggaagaugaaacugaauguccuggaugcccg

SEQ ID NO: 54780 - RNA, 32 nt, Human
aggaagaugagagaaaauuaguaggauuaguu

SEQ ID NO: 54781 - RNA, 32 nt, Human
aggaagaugagagauggucagauggaagagag

SEQ ID NO: 54782 - RNA, 32 nt, Human
aggaagaugaggggaggaaggaggugaggcgg

SEQ ID NO: 54783 - RNA, 32 nt, Human
aggaagaugcagccccuuccuccagccugaga

SEQ ID NO: 54784 - RNA, 32 nt, Human
aggaagauggacuuucagaggagugcgaggag

SEQ ID NO: 54785 - RNA, 31 nt, Human
aggaagauggccagagcuuuguguccacugc

SEQ ID NO: 54786 - RNA, 32 nt, Human
aggaagauggccugagugugcacuuuggcucu

SEQ ID NO: 54787 - RNA, 31 nt, Human
aggaagauguuaccgaguacuucagugaauu

SEQ ID NO: 54788 - RNA, 32 nt, Human
aggaagauuccagagcacgcuguggcugacaa

SEQ ID NO: 54789 - RNA, 32 nt, Human
aggaagauucuuagguccucuucaauccagca

SEQ ID NO: 54790 - RNA, 32 nt, Human
aggaagauugagccuaggaguucgagacugac

SEQ ID NO: 54791 - RNA, 20 nt, Human
aggaagauugcuugaggcca

SEQ ID NO: 54792 - RNA, 32 nt, Human
aggaagcaacagugaacucuaccuguucugga

SEQ ID NO: 54793 - RNA, 32 nt, Human
aggaagcaacccagcagugucagagaggaugg

SEQ ID NO: 54794 - RNA, 32 nt, Human
aggaagcaacucggaagaggaaagaaaggaag

SEQ ID NO: 54795 - RNA, 32 nt, Human
aggaagcaagaaaggaaggaagaaaggguggg

SEQ ID NO: 54796 - RNA, 32 nt, Human
aggaagcaagcggagguugcagugaguugaga

SEQ ID NO: 54797 - RNA, 32 nt, Human
aggaagcaagggaaggaggaagaaaggaaaga

SEQ ID NO: 54798 - RNA, 32 nt, Human
aggaagcaaucagcuaugcauuugucucacgu

SEQ ID NO: 54799 - RNA, 32 nt, Human
aggaagcacaacugugccuuuuucugaaaauc

SEQ ID NO: 54800 - RNA, 21 nt, Human
aggaagcacaugagcgccugg

SEQ ID NO: 54801 - RNA, 21 nt, Human
aggaagcacaugcacaacuga

SEQ ID NO: 54802 - RNA, 32 nt, Human
aggaagcacgugcugggcugugccucagacag

SEQ ID NO: 54803 - RNA, 32 nt, Human
aggaagcacugaagauuggggccccgccucau

SEQ ID NO: 54804 - RNA, 32 nt, Human
aggaagcacuugccaagcuuggucaucuauga

SEQ ID NO: 54805 - RNA, 32 nt, Human
aggaagcagagagacccacagagcaggaggga

SEQ ID NO: 54806 - RNA, 32 nt, Human
aggaagcagagucuuuaaugagcaugcuaauu

SEQ ID NO: 54807 - RNA, 32 nt, Human
aggaagcagcugguuggacaggauuucuugaa

SEQ ID NO: 54808 - RNA, 32 nt, Human
aggaagcaggcaggccuuggucugagacagug

SEQ ID NO: 54809 - RNA, 32 nt, Human
aggaagcaggcuuugccacaaaugucagugca

SEQ ID NO: 54810 - RNA, 32 nt, Human
aggaagcagggaagaaauggccagaagugagc

SEQ ID NO: 54811 - RNA, 32 nt, Human
aggaagcagggagggggccgggagguuuuccu

SEQ ID NO: 54812 - RNA, 23 nt, Human
aggaagcagugauguuucugcuc

SEQ ID NO: 54813 - RNA, 32 nt, Human
aggaagcagugggaggugguggcagauaugcu

SEQ ID NO: 54814 - RNA, 32 nt, Human
aggaagcauagugccagcaucugcuucuggug

SEQ ID NO: 54815 - RNA, 32 nt, Human
aggaagcauccaggaaccccagagcaggcagu

SEQ ID NO: 54816 - RNA, 32 nt, Human
aggaagcaucugaguuugagaccauggcuguu

SEQ ID NO: 54817 - RNA, 32 nt, Human
aggaagcaugacuggggaggccucaggaaacu

SEQ ID NO: 54818 - RNA, 32 nt, Human
aggaagcauggcuggggaggccucaggaaacu

SEQ ID NO: 54819 - RNA, 32 nt, Human
aggaagcauggugcuaacaucugaucagcuug

SEQ ID NO: 54820 - RNA, 32 nt, Human
aggaagccacugcaaccaggaccggaguggag

SEQ ID NO: 54821 - RNA, 22 nt, Human
aggaagccagacuccacugcuu

SEQ ID NO: 54822 - RNA, 32 nt, Human
aggaagccauuugagucuggccacuagacauc

SEQ ID NO: 54823 - RNA, 32 nt, Human
aggaagccccuggaucuuugggguaaaaggag

SEQ ID NO: 54824 - RNA, 28 nt, Human
aggaagccgacugcugccuggucugcaa

SEQ ID NO: 54825 - RNA, 32 nt, Human
aggaagccuagagagaaagaguuggaccuccu

SEQ ID NO: 54826 - RNA, 32 nt, Human
aggaagccuccaccucauguuuucaaacuuaa

SEQ ID NO: 54827 - RNA, 32 nt, Human
aggaagccugcaacccccuccaggcucagacc

SEQ ID NO: 54828 - RNA, 22 nt, Human
aggaagccuggcugcagcuucc

SEQ ID NO: 54829 - RNA, 32 nt, Human
aggaagccugggaaccuggucuguuccuucca

SEQ ID NO: 54830 - RNA, 32 nt, Human
aggaagccugggacauauuuguaccccaucuc

SEQ ID NO: 54831 - RNA, 32 nt, Human
aggaagccuggggaaaccagagcugagaccuc

SEQ ID NO: 54832 - RNA, 32 nt, Human
aggaagccuucccauuccccuucaucugauaa

SEQ ID NO: 54833 - RNA, 32 nt, Human
aggaagccuucucaagugugcauggggaguac

SEQ ID NO: 54834 - RNA, 32 nt, Human
aggaagccuucuuauuuaucuuccugcaaaca

SEQ ID NO: 54835 - RNA, 32 nt, Human
aggaagccuuucuccccaggcacguggcuuca

SEQ ID NO: 54836 - RNA, 23 nt, Human
aggaagcgagagagcugcugcca

SEQ ID NO: 54837 - RNA, 32 nt, Human
aggaagcgagagagcugcugccacugcugcua

SEQ ID NO: 54838 - RNA, 23 nt, Human
aggaagcgaggaggcggccggcc

SEQ ID NO: 54839 - RNA, 25 nt, Human
aggaagcgaggaugcgugccugcca

SEQ ID NO: 54840 - RNA, 22 nt, Human
aggaagcgcagugacagugccu

SEQ ID NO: 54841 - RNA, 21 nt, Human
aggaagcgcgguucccagcca

SEQ ID NO: 54842 - RNA, 20 nt, Human
aggaagcggcacgccugcca

SEQ ID NO: 54843 - RNA, 21 nt, Human
aggaagcggcgccaccaacca

SEQ ID NO: 54844 - RNA, 32 nt, Human
aggaagcggcgccaccaaccagccucgcagag

SEQ ID NO: 54845 - RNA, 32 nt, Human
aggaagcgggagaagugcuggggccggagcag

SEQ ID NO: 54846 - RNA, 21 nt, Human
aggaagcgggcuccaggagca

SEQ ID NO: 54847 - RNA, 32 nt, Human
aggaagcggggcuggggaggcugcaggcauca

SEQ ID NO: 54848 - RNA, 21 nt, Human
aggaagcggugccggcagcgu

SEQ ID NO: 54849 - RNA, 28 nt, Human
aggaagcuaagugcugcuguuucuuuaa

SEQ ID NO: 54850 - RNA, 32 nt, Human
aggaagcuaugccuccccgucugucagaaugg

SEQ ID NO: 54851 - RNA, 32 nt, Human
aggaagcucagccucagccuucaggccugagc

SEQ ID NO: 54852 - RNA, 32 nt, Human
aggaagcucagccuucuccucccaagguuuga

SEQ ID NO: 54853 - RNA, 32 nt, Human
aggaagcucggagccuuugguggagccgggga

SEQ ID NO: 54854 - RNA, 32 nt, Human
aggaagcucugaggaugguugcagugaggaag

SEQ ID NO: 54855 - RNA, 32 nt, Human
aggaagcucugccgcccccucccugucccuca

SEQ ID NO: 54856 - RNA, 21 nt, Human
aggaagcucuucuuccugcuu

SEQ ID NO: 54857 - RNA, 32 nt, Human
aggaagcugaccagagcaagaucugggcaagc

SEQ ID NO: 54858 - RNA, 32 nt, Human
aggaagcugcagcugucccaucauccccagca

SEQ ID NO: 54859 - RNA, 32 nt, Human
aggaagcugcaugcaugagacccacagacucu

SEQ ID NO: 54860 - RNA, 32 nt, Human
aggaagcugggaagggagaugucagguggggu

SEQ ID NO: 54861 - RNA, 32 nt, Human
aggaagcuguaggugaggagaucuguauaaua

SEQ ID NO: 54862 - RNA, 32 nt, Human
aggaagcuguucuccccaccccaggugccuuu

SEQ ID NO: 54863 - RNA, 32 nt, Human
aggaagcuuaagaaccugcuucuuucugcagu

SEQ ID NO: 54864 - RNA, 32 nt, Human
aggaagcuuggcugagcuggccuuuuaacaua

SEQ ID NO: 54865 - RNA, 32 nt, Human
aggaaggaaagaaagaugggaggaagugcagc

SEQ ID NO: 54866 - RNA, 23 nt, Human
aggaaggaaagcgacccccuaca

SEQ ID NO: 54867 - RNA, 32 nt, Human
aggaaggaaaggaggagaaaaaugugucuuca

SEQ ID NO: 54868 - RNA, 20 nt, Human
aggaaggaaccaggcccuca

SEQ ID NO: 54869 - RNA, 31 nt, Human
aggaaggaacucaagguggcuggagauggcu

SEQ ID NO: 54870 - RNA, 31 nt, Human
aggaaggaacucaaggugguggcuggagaug

SEQ ID NO: 54871 - RNA, 32 nt, Human
aggaaggaacuugaagacuaaagauuuuacuc

SEQ ID NO: 54872 - RNA, 32 nt, Human
aggaaggaagaaugugcaagauaggccgagug

SEQ ID NO: 54873 - RNA, 23 nt, Human
aggaaggaagagagggaggcggg

SEQ ID NO: 54874 - RNA, 32 nt, Human
aggaaggaagagagguagacagauacaagaug

SEQ ID NO: 54875 - RNA, 32 nt, Human
aggaaggaagauucagucuccacugagaggug

SEQ ID NO: 54876 - RNA, 32 nt, Human
aggaaggaaggaaagaaagaaaggucagcuuu

SEQ ID NO: 54877 - RNA, 32 nt, Human
aggaaggaaggaaaggaggaaagggaaacgga

SEQ ID NO: 54878 - RNA, 32 nt, Human
aggaaggaaggaagaaggaugggucaaugaaa

SEQ ID NO: 54879 - RNA, 32 nt, Human
aggaaggaaggaaggaaggaaggaagaaagaa

SEQ ID NO: 54880 - RNA, 32 nt, Human
aggaaggaaggaaggaaggaaggaaggaagaa

SEQ ID NO: 54881 - RNA, 32 nt, Human
aggaaggaaggaaggaaggaaggaaggaagga

SEQ ID NO: 54882 - RNA, 32 nt, Human
aggaaggaaggaaggaaggaaggaaggagaaa

SEQ ID NO: 54883 - RNA, 32 nt, Human
aggaaggaaggaaggaaggaaggagaaaggaa

SEQ ID NO: 54884 - RNA, 32 nt, Human
aggaaggaaggaaggaaggagaaaggaaagga

SEQ ID NO: 54885 - RNA, 32 nt, Human
aggaaggaaggacggaaggaaggaaggaagga

SEQ ID NO: 54886 - RNA, 32 nt, Human
aggaaggaaggagcaguugguucaaucucugg

SEQ ID NO: 54887 - RNA, 32 nt, Human
aggaaggaaggagcgugaccagccuguggacu

SEQ ID NO: 54888 - RNA, 21 nt, Human
aggaaggaaggauggagacgg

SEQ ID NO: 54889 - RNA, 32 nt, Human
aggaaggaagggaggaaggaaggaagaaggau

SEQ ID NO: 54890 - RNA, 32 nt, Human
aggaaggaagggagggaaagaaaggaagaaag

SEQ ID NO: 54891 - RNA, 32 nt, Human
aggaaggaagucaaggcugcagugagcuaugg

SEQ ID NO: 54892 - RNA, 32 nt, Human
aggaaggaagugacccagacaguccagccuga

SEQ ID NO: 54893 - RNA, 32 nt, Human
aggaaggaauccccuucuuagagcagaggcac

SEQ ID NO: 54894 - RNA, 18 nt, Human
aggaaggacacacaggga

SEQ ID NO: 54895 - RNA, 32 nt, Human
aggaaggaccuugccauacuccuacaaacuua

SEQ ID NO: 54896 - RNA, 32 nt, Human
aggaaggacggaaggaaggaaggaaggaagga

SEQ ID NO: 54897 - RNA, 32 nt, Human
aggaaggacuccucucccuguggcuccaugcc

SEQ ID NO: 54898 - RNA, 32 nt, Human
aggaaggacuugcugggcucuguggccagcug

SEQ ID NO: 54899 - RNA, 32 nt, Human
aggaaggacuugggaaggggagcgagaaauug

SEQ ID NO: 54900 - RNA, 32 nt, Human
aggaaggagaaagagaaggaaagaaggagccu

SEQ ID NO: 54901 - RNA, 32 nt, Human
aggaaggagaaagaggaggagagagaaaaagg

SEQ ID NO: 54902 - RNA, 32 nt, Human
aggaaggagaaaggaaaggaaggcaggaggga

SEQ ID NO: 54903 - RNA, 32 nt, Human
aggaaggagagagugcgccggagcagcguggg

SEQ ID NO: 54904 - RNA, 32 nt, Human
aggaaggagaggaggaugaaggagaagaugac

SEQ ID NO: 54905 - RNA, 32 nt, Human
aggaaggagagggagggcaggaaggaaaagaa

SEQ ID NO: 54906 - RNA, 32 nt, Human
aggaaggagagggagggggaggauagagccca

SEQ ID NO: 54907 - RNA, 20 nt, Human
aggaaggagagggcagcggg

SEQ ID NO: 54908 - RNA, 32 nt, Human
aggaaggagagggcagcggggccgccugcagc

SEQ ID NO: 54909 - RNA, 32 nt, Human
aggaaggagagggggacgugccggccgcaucc

SEQ ID NO: 54910 - RNA, 32 nt, Human
aggaaggagauagggaaaaggggcuccuugcu

SEQ ID NO: 54911 - RNA, 32 nt, Human
aggaaggagaugauagaggaaaagcaggguga

SEQ ID NO: 54912 - RNA, 21 nt, Human
aggaaggagcacacuccaggc

SEQ ID NO: 54913 - RNA, 32 nt, Human
aggaaggagcccaggagcagaggaaguagaga

SEQ ID NO: 54914 - RNA, 21 nt, Human
aggaaggaggaaaggagaggg

SEQ ID NO: 54915 - RNA, 22 nt, Human
aggaaggaggaacacugagggg

SEQ ID NO: 54916 - RNA, 18 nt, Human
aggaaggagggagccggg

SEQ ID NO: 54917 - RNA, 32 nt, Human
aggaaggagggagggaggggcagaguggagug

SEQ ID NO: 54918 - RNA, 32 nt, Human
aggaaggaguuuucacagaaacccucccucau

SEQ ID NO: 54919 - RNA, 24 nt, Human
aggaaggcaaaucacaaggucagg

SEQ ID NO: 54920 - RNA, 32 nt, Human
aggaaggcagaacuauccgcugaggaaccugg

SEQ ID NO: 54921 - RNA, 32 nt, Human
aggaaggcagagccaccuccucuccucuccca

SEQ ID NO: 54922 - RNA, 32 nt, Human
aggaaggcagagccugagauccggcaccccau

SEQ ID NO: 54923 - RNA, 19 nt, Human
aggaaggcaggagacagga

SEQ ID NO: 54924 - RNA, 32 nt, Human
aggaaggcagggaggugcugucugcugccucc

SEQ ID NO: 54925 - RNA, 32 nt, Human
aggaaggcaggugggccccagcaaaggaguag

SEQ ID NO: 54926 - RNA, 32 nt, Human
aggaaggcaguugggccccagcaaaggagugg

SEQ ID NO: 54927 - RNA, 17 nt, Human
aggaaggccacuccaca

SEQ ID NO: 54928 - RNA, 20 nt, Human
aggaaggcgaaggaggggag

SEQ ID NO: 54929 - RNA, 23 nt, Human
aggaaggcucugaguggcuagca

SEQ ID NO: 54930 - RNA, 22 nt, Human
aggaaggcucuggugcagagca

SEQ ID NO: 54931 - RNA, 24 nt, Human
aggaaggcucugucacuccaggca

SEQ ID NO: 54932 - RNA, 32 nt, Human
aggaaggcugaggaggacaggagaagggccca

SEQ ID NO: 54933 - RNA, 32 nt, Human
aggaaggcugggugcuucuugcucugacagcc

SEQ ID NO: 54934 - RNA, 32 nt, Human
aggaaggcuggugcuucucucccaggcugucc

SEQ ID NO: 54935 - RNA, 23 nt, Human
aggaaggcuguccacgcuucagg

SEQ ID NO: 54936 - RNA, 32 nt, Human
aggaagggaaaggccugcaucuugugcucagu

SEQ ID NO: 54937 - RNA, 32 nt, Human
aggaagggaaggagggagagacgggagggagg

SEQ ID NO: 54938 - RNA, 32 nt, Human
aggaagggaaggugggacaggcaggcaggacu

SEQ ID NO: 54939 - RNA, 32 nt, Human
aggaagggaccuguggcagcucacaggcauga

SEQ ID NO: 54940 - RNA, 32 nt, Human
aggaagggagaaagggaaaaagcgggaagagu

SEQ ID NO: 54941 - RNA, 32 nt, Human
aggaagggagaagggcaggugggcagggagca

SEQ ID NO: 54942 - RNA, 32 nt, Human
aggaagggagaggcagcucuuccuucagcugg

SEQ ID NO: 54943 - RNA, 32 nt, Human
aggaagggaggaaggaaggaagaaggaugggu

SEQ ID NO: 54944 - RNA, 32 nt, Human
aggaagggagggcagagggggcuguggccguc

SEQ ID NO: 54945 - RNA, 32 nt, Human
aggaagggaguuaaagacccuccuggggcucu

SEQ ID NO: 54946 - RNA, 32 nt, Human
aggaagggcacacccuuuccucaccacccgag

SEQ ID NO: 54947 - RNA, 32 nt, Human
aggaagggcacaggggcugagcacuacagaag

SEQ ID NO: 54948 - RNA, 32 nt, Human
aggaagggcaccugagccccacugccuguccc

SEQ ID NO: 54949 - RNA, 32 nt, Human
aggaagggcaggaaggagagccugcugcaugg

SEQ ID NO: 54950 - RNA, 32 nt, Human
aggaagggcguggaccagggaggcuggggcgg

SEQ ID NO: 54951 - RNA, 32 nt, Human
aggaagggcuggguagagaagaaguuccacuu

SEQ ID NO: 54952 - RNA, 32 nt, Human
aggaagggcuguaggaauggaagcuucagggc

SEQ ID NO: 54953 - RNA, 32 nt, Human
aggaaggggaagagaaaauccaaagagcaaag

SEQ ID NO: 54954 - RNA, 32 nt, Human
aggaaggggagaaagggucccccuugcugucu

SEQ ID NO: 54955 - RNA, 32 nt, Human
aggaaggggagagggacgagacccccuguccu

SEQ ID NO: 54956 - RNA, 32 nt, Human
aggaaggggagcaaggagaggaagcucucucu

SEQ ID NO: 54957 - RNA, 32 nt, Human
aggaaggggaggucaugagccaaggaaugugg

SEQ ID NO: 54958 - RNA, 21 nt, Human
aggaaggggcagagugaguca

SEQ ID NO: 54959 - RNA, 32 nt, Human
aggaaggggcucaccugucacccuuaggcagc

SEQ ID NO: 54960 - RNA, 32 nt, Human
aggaaggggcuucaguuguuccuccauggcua

SEQ ID NO: 54961 - RNA, 32 nt, Human
aggaagggggcacugaguguccgugggggaau

SEQ ID NO: 54962 - RNA, 20 nt, Human
aggaaggggggcaaagcggg

SEQ ID NO: 54963 - RNA, 32 nt, Human
aggaaggggguuucaaccauguccccuuuccc

SEQ ID NO: 54964 - RNA, 32 nt, Human
aggaagggguaccugggcugggugcagggcca

SEQ ID NO: 54965 - RNA, 31 nt, Human
aggaaggggugaauggaaaaagaguggcaac

SEQ ID NO: 54966 - RNA, 32 nt, Human
aggaaggggugagacaaggaagaggaugucug

SEQ ID NO: 54967 - RNA, 32 nt, Human
aggaaggggugaggagagcagccagaggaaaa

SEQ ID NO: 54968 - RNA, 32 nt, Human
aggaagggguguggagguccagggagagggug

SEQ ID NO: 54969 - RNA, 20 nt, Human
aggaaggguccacuccaggc

SEQ ID NO: 54970 - RNA, 32 nt, Human
aggaaggguggagaaggagagagaaauaugug

SEQ ID NO: 54971 - RNA, 32 nt, Human
aggaagggugggaaagagcgggccaguguccu

SEQ ID NO: 54972 - RNA, 32 nt, Human
aggaagguacuaagaagacagaaacaagcaaa

SEQ ID NO: 54973 - RNA, 32 nt, Human
aggaagguaguaacuuagaaagacuuaccuuu

SEQ ID NO: 54974 - RNA, 32 nt, Human
aggaaggucagggcuccugagcagcaauaaag

SEQ ID NO: 54975 - RNA, 20 nt, Human
aggaaggucauuuggagaug

SEQ ID NO: 54976 - RNA, 19 nt, Human
aggaaggucucaugccuga

SEQ ID NO: 54977 - RNA, 32 nt, Human
aggaaggucucccauugauccuggcuucaggc

SEQ ID NO: 54978 - RNA, 32 nt, Human
aggaaggugcaggagaggaggugggcaagcuu

SEQ ID NO: 54979 - RNA, 32 nt, Human
aggaaggugccuggccaugucaccuggcugcu

SEQ ID NO: 54980 - RNA, 32 nt, Human
aggaaggugcuuagauggugagggcucuagaa

SEQ ID NO: 54981 - RNA, 32 nt, Human
aggaagguggaagaaaccaugggcaggaguag

SEQ ID NO: 54982 - RNA, 32 nt, Human
aggaaggugggaagccaucagagcaggaagau

SEQ ID NO: 54983 - RNA, 32 nt, Human
aggaagguggguggcuuuuggaagguggaaaa

SEQ ID NO: 54984 - RNA, 32 nt, Human
aggaaggugucugucugggaggauggggcagu

SEQ ID NO: 54985 - RNA, 32 nt, Human
aggaagguguuauuuucauuccuggguggcaa

SEQ ID NO: 54986 - RNA, 31 nt, Human
aggaagguugagagagaggugcuggggucug

SEQ ID NO: 54987 - RNA, 21 nt, Human
aggaagguuggaccuucauca

SEQ ID NO: 54988 - RNA, 22 nt, Human
aggaaguaaaauggcaggggca

SEQ ID NO: 54989 - RNA, 32 nt, Human
aggaaguaaacagaagcaaauauuuaccgaau

SEQ ID NO: 54990 - RNA, 32 nt, Human
aggaaguaagcaucaccucaggcacagaagaa

SEQ ID NO: 54991 - RNA, 32 nt, Human
aggaaguacaccagcugccaucuuguuggucc

SEQ ID NO: 54992 - RNA, 32 nt, Human
aggaaguacagaagaugcaggggugugguauc

SEQ ID NO: 54993 - RNA, 32 nt, Human
aggaaguacuucugaacuuuggcccugagcuc

SEQ ID NO: 54994 - RNA, 22 nt, Human
aggaaguagguuucaucuauca

SEQ ID NO: 54995 - RNA, 21 nt, Human
aggaaguauacuggucuguua

SEQ ID NO: 54996 - RNA, 32 nt, Human
aggaaguaucuauucacugugaaaaucugaaa

SEQ ID NO: 54997 - RNA, 32 nt, Human
aggaaguauuuaaaggaugauagagaccauca

SEQ ID NO: 54998 - RNA, 22 nt, Human
aggaaguauuuuuggcuuuuug

SEQ ID NO: 54999 - RNA, 32 nt, Human
aggaagucaaagcaaggaaacuauguaacaug

SEQ ID NO: 55000 - RNA, 23 nt, Human
aggaagucacaguggugcccagg

SEQ ID NO: 55001 - RNA, 32 nt, Human
aggaagucacccagcuguuucucagucccaga

SEQ ID NO: 55002 - RNA, 32 nt, Human
aggaagucaccuacgacguggcccaguauaua

SEQ ID NO: 55003 - RNA, 23 nt, Human
aggaagucagcuuuugccccagg

SEQ ID NO: 55004 - RNA, 32 nt, Human
aggaagucagcuuuugccccaggugggaaucc

SEQ ID NO: 55005 - RNA, 20 nt, Human
aggaagucaugcaucuucag

SEQ ID NO: 55006 - RNA, 21 nt, Human
aggaagucauugucauucagg

SEQ ID NO: 55007 - RNA, 23 nt, Human
aggaaguccagggacagcucccu

SEQ ID NO: 55008 - RNA, 19 nt, Human
aggaagucgagccauucca

SEQ ID NO: 55009 - RNA, 23 nt, Human
aggaagucgagccauuccaggca

SEQ ID NO: 55010 - RNA, 32 nt, Human
aggaagucugagccaccucuggcuacaccaac

SEQ ID NO: 55011 - RNA, 32 nt, Human
aggaagugaauagagccuuuaggaacuuccug

SEQ ID NO: 55012 - RNA, 32 nt, Human
aggaagugacaugcccuggagacuugugggaa

SEQ ID NO: 55013 - RNA, 23 nt, Human
aggaagugacgugcuuaucacca

SEQ ID NO: 55014 - RNA, 32 nt, Human
aggaagugagaaaaggggugaggaaagagaaa

SEQ ID NO: 55015 - RNA, 32 nt, Human
aggaagugagaggugaacucagccugggacug

SEQ ID NO: 55016 - RNA, 24 nt, Human
aggaagugaggagcgucucugcca

SEQ ID NO: 55017 - RNA, 26 nt, Human
aggaagugagucagagcccauuuuca

SEQ ID NO: 55018 - RNA, 32 nt, Human
aggaagugaguguucuuggacgaacaggcucc

SEQ ID NO: 55019 - RNA, 32 nt, Human
aggaagugcccuggagggggccagcaggucac

SEQ ID NO: 55020 - RNA, 18 nt, Human
aggaagugcuauuucuca

SEQ ID NO: 55021 - RNA, 22 nt, Human
aggaaguggaggucuaucuuca

SEQ ID NO: 55022 - RNA, 32 nt, Human
aggaaguggagucauuuugccuuugaaggcug

SEQ ID NO: 55023 - RNA, 32 nt, Human
aggaaguggaucccccucagccaccucaauuc

SEQ ID NO: 55024 - RNA, 22 nt, Human
aggaaguggcaccccuccccuc

SEQ ID NO: 55025 - RNA, 32 nt, Human
aggaagugggaaguaucucagagaaucagcua

SEQ ID NO: 55026 - RNA, 25 nt, Human
aggaagugggacggcccgccugcca

SEQ ID NO: 55027 - RNA, 32 nt, Human
aggaagugggagaaggaaggggaggacagacg

SEQ ID NO: 55028 - RNA, 32 nt, Human
aggaaguggggccaacagagaggucagcagcc

SEQ ID NO: 55029 - RNA, 32 nt, Human
aggaagugggguccagacaggaguggggagcc

SEQ ID NO: 55030 - RNA, 23 nt, Human
aggaaguggggucuggccuguug

SEQ ID NO: 55031 - RNA, 32 nt, Human
aggaagugggucaagcccugggaacccucauc

SEQ ID NO: 55032 - RNA, 31 nt, Human
aggaaguggguggacuuggaggaggaacggc

SEQ ID NO: 55033 - RNA, 31 nt, Human
aggaaguggguggcaggugugaggggaugcu

SEQ ID NO: 55034 - RNA, 32 nt, Human
aggaaguguuuguaaucccagcacuuugggag

SEQ ID NO: 55035 - RNA, 32 nt, Human
aggaaguuaauguccuggaagcauugccagag

SEQ ID NO: 55036 - RNA, 23 nt, Human
aggaaguuacugucuucccauuc

SEQ ID NO: 55037 - RNA, 32 nt, Human
aggaaguuaggagguugaggcacagccugugc

SEQ ID NO: 55038 - RNA, 32 nt, Human
aggaaguuauggcagugaugccgaggaggagg

SEQ ID NO: 55039 - RNA, 32 nt, Human
aggaaguuccucgggacacggcugcuuuggga

SEQ ID NO: 55040 - RNA, 32 nt, Human
aggaaguucugacuuuucagggcuaccuuauu

SEQ ID NO: 55041 - RNA, 32 nt, Human
aggaaguucugcuaugaggaugcagcuggccc

SEQ ID NO: 55042 - RNA, 32 nt, Human
aggaaguucuggaauuacuaggaacaggguuu

SEQ ID NO: 55043 - RNA, 32 nt, Human
aggaaguucuuucuacuuccacaggugcagcc

SEQ ID NO: 55044 - RNA, 32 nt, Human
aggaaguugcucaugggagcagaccccuagag

SEQ ID NO: 55045 - RNA, 32 nt, Human
aggaaguuggagaccuugggagcuccagggaa

SEQ ID NO: 55046 - RNA, 32 nt, Human
aggaaguugucuuuguggacucugccugcaug

SEQ ID NO: 55047 - RNA, 32 nt, Human
aggaaguugugggguuggggaggccuaggguu

SEQ ID NO: 55048 - RNA, 32 nt, Human
aggaaguuuagagccacguaaaaagcugguag

SEQ ID NO: 55049 - RNA, 32 nt, Human
aggaaguuuaggaagcagcccaggaggucugu

SEQ ID NO: 55050 - RNA, 32 nt, Human
aggaaguuuccagauucauccuguucuaccug

SEQ ID NO: 55051 - RNA, 32 nt, Human
aggaaguuuucagguccuugugauaaaaccuc

SEQ ID NO: 55052 - RNA, 32 nt, Human
aggaaguuuuggcugcugcaccaucccucugg

SEQ ID NO: 55053 - RNA, 32 nt, Human
aggaauaaaauggcaccucuccagggaaagug

SEQ ID NO: 55054 - RNA, 23 nt, Human
aggaauaaagggccuacuuacca

SEQ ID NO: 55055 - RNA, 32 nt, Human
aggaauaacugcucugagcagagaugaguggu

SEQ ID NO: 55056 - RNA, 32 nt, Human
aggaauaacuuccuuauguggaggggacccca

SEQ ID NO: 55057 - RNA, 32 nt, Human
aggaauacacauacacacacaaacauacaugu

SEQ ID NO: 55058 - RNA, 32 nt, Human
aggaauacagcgacagaccuaucugaaaaguc

SEQ ID NO: 55059 - RNA, 32 nt, Human
aggaauaccugcagcguagugaccucagaucc

SEQ ID NO: 55060 - RNA, 32 nt, Human
aggaauacuguuguaagaaagggauuguucag

SEQ ID NO: 55061 - RNA, 32 nt, Human
aggaauagagccaaaugagguaggugucugag

SEQ ID NO: 55062 - RNA, 32 nt, Human
aggaauaguggugggaggaaggggaaagggcu

SEQ ID NO: 55063 - RNA, 32 nt, Human
aggaauaucucuucucagaaggaaagaauaac

SEQ ID NO: 55064 - RNA, 20 nt, Human
aggaauauggagagaagcca

SEQ ID NO: 55065 - RNA, 32 nt, Human
aggaauauucaauauucugccuuucagaaagu

SEQ ID NO: 55066 - RNA, 32 nt, Human
aggaauauuucuccaaacacaauuagcuggcu

SEQ ID NO: 55067 - RNA, 32 nt, Human
aggaauauuuuucugccccagucgucguguug

SEQ ID NO: 55068 - RNA, 32 nt, Human
aggaaucaagagcugcccuccuuguccaccca

SEQ ID NO: 55069 - RNA, 32 nt, Human
aggaaucaaugagagaucugugaagagagagg

SEQ ID NO: 55070 - RNA, 32 nt, Human
aggaaucacuggcuguuaaucuuucaaagugu

SEQ ID NO: 55071 - RNA, 32 nt, Human
aggaaucagacuccuagcuuuuguuccagaau

SEQ ID NO: 55072 - RNA, 32 nt, Human
aggaaucagagcucuguucccaucuccacuuu

SEQ ID NO: 55073 - RNA, 32 nt, Human
aggaaucagaugguauugagauuuucaguagc

SEQ ID NO: 55074 - RNA, 32 nt, Human
aggaaucaggcacuggaucacagccauacccu

SEQ ID NO: 55075 - RNA, 32 nt, Human
aggaaucauaugcagacuauaccacuguaccc

SEQ ID NO: 55076 - RNA, 32 nt, Human
aggaaucaugaggaugagggaagaagaaagag

SEQ ID NO: 55077 - RNA, 32 nt, Human
aggaaucaugucaggccugugugugaaaggaa

SEQ ID NO: 55078 - RNA, 32 nt, Human
aggaaucauuguccuuucuccaguuuuuguuc

SEQ ID NO: 55079 - RNA, 20 nt, Human
aggaauccacccccaccccc

SEQ ID NO: 55080 - RNA, 22 nt, Human
aggaaucccagggggcagcaca

SEQ ID NO: 55081 - RNA, 32 nt, Human
aggaauccucauuuuucucugcccucucacug

SEQ ID NO: 55082 - RNA, 32 nt, Human
aggaauccugccucccugucaucccaggaggg

SEQ ID NO: 55083 - RNA, 32 nt, Human
aggaauccugccugccuucagcagagaauuca

SEQ ID NO: 55084 - RNA, 32 nt, Human
aggaauccuggagaggaggacagugacaacag

SEQ ID NO: 55085 - RNA, 32 nt, Human
aggaaucgaaaaccagccugaccaacguggag

SEQ ID NO: 55086 - RNA, 32 nt, Human
aggaaucggagccggcccugcccucucggcac

SEQ ID NO: 55087 - RNA, 32 nt, Human
aggaaucguuggcagaggaucagagaccagca

SEQ ID NO: 55088 - RNA, 24 nt, Human
aggaaucucaaaaacaaacaaaca

SEQ ID NO: 55089 - RNA, 23 nt, Human
aggaaucucaagugggacaaaca

SEQ ID NO: 55090 - RNA, 32 nt, Human
aggaaucucacccucuggggugcuggcaagga

SEQ ID NO: 55091 - RNA, 32 nt, Human
aggaaucuccagggaccagccaccccaugcuc

SEQ ID NO: 55092 - RNA, 32 nt, Human
aggaaucugagaccagccugagcaacaugaug

SEQ ID NO: 55093 - RNA, 32 nt, Human
aggaaucugagauguacuucuggacucacggg

SEQ ID NO: 55094 - RNA, 32 nt, Human
aggaaucugagcccagccugggcgacaaagca

SEQ ID NO: 55095 - RNA, 32 nt, Human
aggaaucugcaguuaaaggcucccaggugacu

SEQ ID NO: 55096 - RNA, 32 nt, Human
aggaaucugcauuuuaacuagucgcggggauu

SEQ ID NO: 55097 - RNA, 32 nt, Human
aggaaucuugccaucuugcccaggcuggucuc

SEQ ID NO: 55098 - RNA, 32 nt, Human
aggaaugaaaacacacccacgccuuggaaccg

SEQ ID NO: 55099 - RNA, 32 nt, Human
aggaaugaaagagagcucuaaccagauggaac

SEQ ID NO: 55100 - RNA, 32 nt, Human
aggaaugaaagaggagaagaaacgcaacuacc

SEQ ID NO: 55101 - RNA, 32 nt, Human
aggaaugaaagccuaaaccucuuccuuuagcu

SEQ ID NO: 55102 - RNA, 32 nt, Human
aggaaugaacuaacaccaaccaaccaaauaau

SEQ ID NO: 55103 - RNA, 32 nt, Human
aggaaugaagaacauacacuggggaaaagaua

SEQ ID NO: 55104 - RNA, 32 nt, Human
aggaaugaagagccagagacuugcugugcagg

SEQ ID NO: 55105 - RNA, 18 nt, Human
aggaaugaaguacugaca

SEQ ID NO: 55106 - RNA, 32 nt, Human
aggaaugaagucaguggacuuucuuguauauu

SEQ ID NO: 55107 - RNA, 29 nt, Human
aggaaugaccucagcuguuugcuccgugu

SEQ ID NO: 55108 - RNA, 32 nt, Human
aggaaugacuguccuugagagaaccauuaguu

SEQ ID NO: 55109 - RNA, 32 nt, Human
aggaaugagagauggcaacaaucccugucccu

SEQ ID NO: 55110 - RNA, 23 nt, Human
aggaaugagauauguggaccuca

SEQ ID NO: 55111 - RNA, 19 nt, Human
aggaaugagcaggaagcca

SEQ ID NO: 55112 - RNA, 32 nt, Human
aggaaugaggggcauuggugguuaggccgguu

SEQ ID NO: 55113 - RNA, 32 nt, Human
aggaaugcaugagagacccuggacguuuuucu

SEQ ID NO: 55114 - RNA, 32 nt, Human
aggaaugcauuuuccuuggcuucaaacauacg

SEQ ID NO: 55115 - RNA, 32 nt, Human
aggaaugccacuccagggguacaguuuuuggc

SEQ ID NO: 55116 - RNA, 32 nt, Human
aggaaugccaucaucucuaguucccagggccc

SEQ ID NO: 55117 - RNA, 32 nt, Human
aggaaugccugauucuuuaauauugccuaaau

SEQ ID NO: 55118 - RNA, 32 nt, Human
aggaaugccugggagugggggugcaggcgggc

SEQ ID NO: 55119 - RNA, 32 nt, Human
aggaaugcuguugaaaugucccuucuguccuc

SEQ ID NO: 55120 - RNA, 20 nt, Human
aggaauggaaccuggagcua

SEQ ID NO: 55121 - RNA, 32 nt, Human
aggaauggaacuccaucagggaacagggcagc

SEQ ID NO: 55122 - RNA, 31 nt, Human
aggauggggcuucucccuuacggggcucaca

SEQ ID NO: 55123 - RNA, 32 nt, Human
aggaugggggcacagccuucacccucaccccc

SEQ ID NO: 55124 - RNA, 32 nt, Human
aggauggguggagcagggaagagccaggaugg

SEQ ID NO: 55125 - RNA, 26 nt, Human
aggaugguauggaauuuuguuuguua

SEQ ID NO: 55126 - RNA, 32 nt, Human
aggaugguauuacaucagcuccauuguuugag

SEQ ID NO: 55127 - RNA, 32 nt, Human
aggauggucagcauuaggcugauggggacuga

SEQ ID NO: 55128 - RNA, 32 nt, Human
aggauggucgcauuuucccugccuaccucaca

SEQ ID NO: 55129 - RNA, 32 nt, Human
aggauggucucaaacuccugaccucgugaucc

SEQ ID NO: 55130 - RNA, 32 nt, Human
aggauggucucaaucuccugaccucauauucc

SEQ ID NO: 55131 - RNA, 32 nt, Human
aggauggucucaaucuccugaccucaugaucc

SEQ ID NO: 55132 - RNA, 32 nt, Human
aggauggucucaaucuccugaccucaugaucu

SEQ ID NO: 55133 - RNA, 32 nt, Human
aggauggucucaaucuccugaccucgugaucc

SEQ ID NO: 55134 - RNA, 32 nt, Human
aggauggucucaaucuccugacuucaugaucc

SEQ ID NO: 55135 - RNA, 32 nt, Human
aggauggucucaaucucuugaccucauuauca

SEQ ID NO: 55136 - RNA, 32 nt, Human
aggauggucuccaacuccugacuucaugaucc

SEQ ID NO: 55137 - RNA, 32 nt, Human
aggauggucuccaucuccugaccucaugaucc

SEQ ID NO: 55138 - RNA, 32 nt, Human
aggauggucuccaucuccugaccucaugaugu

SEQ ID NO: 55139 - RNA, 32 nt, Human
aggauggucuccaucucuugaccucaugaucu

SEQ ID NO: 55140 - RNA, 32 nt, Human
aggauggucucgaacuccugaccucaagugau

SEQ ID NO: 55141 - RNA, 32 nt, Human
aggauggucucgaacuccugaccucaggugau

SEQ ID NO: 55142 - RNA, 32 nt, Human
aggauggucucgaacuccugacuucaugaucc

SEQ ID NO: 55143 - RNA, 32 nt, Human
aggauggucucgaacucuugaccucagguagu

SEQ ID NO: 55144 - RNA, 32 nt, Human
aggauggucucgaacucuugaccuugugaucc

SEQ ID NO: 55145 - RNA, 32 nt, Human
aggauggucucgaacucuugacuucaugaucc

SEQ ID NO: 55146 - RNA, 32 nt, Human
aggauggucucgagucuccugaccucgugauc

SEQ ID NO: 55147 - RNA, 32 nt, Human
aggauggucucgauauccugaccuugugaucc

SEQ ID NO: 55148 - RNA, 32 nt, Human
aggauggucucgaucuccucaccucgugaucc

SEQ ID NO: 55149 - RNA, 32 nt, Human
aggauggucucgaucuccugaccucaugaucc

SEQ ID NO: 55150 - RNA, 32 nt, Human
aggauggucucgaucuccugaccucaugaucu

SEQ ID NO: 55151 - RNA, 32 nt, Human
aggauggucucgaucuccugaccuccugaugc

SEQ ID NO: 55152 - RNA, 32 nt, Human
aggauggucucgaucuccugaccucgcgaucc

SEQ ID NO: 55153 - RNA, 32 nt, Human
aggauggucucgaucuccugaccucgugaucc

SEQ ID NO: 55154 - RNA, 32 nt, Human
aggauggucucgaucuccugaccucgugaucu

SEQ ID NO: 55155 - RNA, 32 nt, Human
aggauggucucgaucuccugaccucgugaugc

SEQ ID NO: 55156 - RNA, 32 nt, Human
aggauggucucgaucuccugaccucgugaugg

SEQ ID NO: 55157 - RNA, 32 nt, Human
aggauggucucgaucuccugaccucuugaucu

SEQ ID NO: 55158 - RNA, 32 nt, Human
aggauggucucgaucuccugaccuucugaucu

SEQ ID NO: 55159 - RNA, 32 nt, Human
aggauggucucgaucuccugaccuugaaucac

SEQ ID NO: 55160 - RNA, 32 nt, Human
aggauggucucgaucuccugaccuugugaucc

SEQ ID NO: 55161 - RNA, 32 nt, Human
aggauggucucgaucuccugaccuugugaucu

SEQ ID NO: 55162 - RNA, 32 nt, Human
aggauggucucgaucuccugacuucgugaucc

SEQ ID NO: 55163 - RNA, 32 nt, Human
aggauggucucgaucuccugacuucguuaucc

SEQ ID NO: 55164 - RNA, 32 nt, Human
aggauggucucgaucuccugaucucgugaucu

SEQ ID NO: 55165 - RNA, 32 nt, Human
aggauggucucgaucucuugaccucaugaucc

SEQ ID NO: 55166 - RNA, 32 nt, Human
aggauggucucgaucucuugaccucgugaucc

SEQ ID NO: 55167 - RNA, 32 nt, Human
aggauggucucgaucucuugaccucgugaucu

SEQ ID NO: 55168 - RNA, 32 nt, Human
aggauggucucgaucucuugaccucgugauuc

SEQ ID NO: 55169 - RNA, 32 nt, Human
aggauggucucgaucucuugaccuugugaucc

SEQ ID NO: 55170 - RNA, 32 nt, Human
aggauggucucgaucugcugaccucgugaucc

SEQ ID NO: 55171 - RNA, 32 nt, Human
aggauggucucgaucuucugaccucgugaucc

SEQ ID NO: 55172 - RNA, 32 nt, Human
aggauggucucgaucuucuguccuuaaaaucc

SEQ ID NO: 55173 - RNA, 32 nt, Human
aggauggucucgauuuccugaccucgugaucc

SEQ ID NO: 55174 - RNA, 32 nt, Human
aggauggucucgauuuccugaccuugugaucc

SEQ ID NO: 55175 - RNA, 32 nt, Human
aggauggucucgcucuccugaccucgugaucc

SEQ ID NO: 55176 - RNA, 32 nt, Human
aggauggucucggucuccugaccucgugaucu

SEQ ID NO: 55177 - RNA, 32 nt, Human
aggauggucuggaucucuugaccucaggugau

SEQ ID NO: 55178 - RNA, 32 nt, Human
aggauggucuugaaccccugaccucaugaucu

SEQ ID NO: 55179 - RNA, 32 nt, Human
aggauggucuugaucuccugaccgcauaaucc

SEQ ID NO: 55180 - RNA, 32 nt, Human
aggauggucuugaucuccugaccucaugaucc

SEQ ID NO: 55181 - RNA, 32 nt, Human
aggauggucuugaucuccugaccucaugaucu

SEQ ID NO: 55182 - RNA, 32 nt, Human
aggauggucuugaucuccugaccucgugaucc

SEQ ID NO: 55183 - RNA, 32 nt, Human
aggauggucuugaucuccugaccucgugauuc

SEQ ID NO: 55184 - RNA, 32 nt, Human
aggauggucuugaucuccugaccucguggauc

SEQ ID NO: 55185 - RNA, 32 nt, Human
aggauggucuugaucuccugaccuugugaucc

SEQ ID NO: 55186 - RNA, 32 nt, Human
aggauggucuugaucuccugaccuugugaucu

SEQ ID NO: 55187 - RNA, 32 nt, Human
aggauggucuugaucucuugaccucaugaucc

SEQ ID NO: 55188 - RNA, 32 nt, Human
aggauggucuugaucucuugaccucaugaucu

SEQ ID NO: 55189 - RNA, 32 nt, Human
aggauggucuugauuuccugaccucaugaucc

SEQ ID NO: 55190 - RNA, 32 nt, Human
aggauggucuugauuuccugaccucgugaucc

SEQ ID NO: 55191 - RNA, 32 nt, Human
aggauggucuuuaucuccugaccucaugaucc

SEQ ID NO: 55192 - RNA, 32 nt, Human
aggaugguugagcucaggaguucgagaucagc

SEQ ID NO: 55193 - RNA, 32 nt, Human
aggaugguuucaaacuccuggccucaagcaau

SEQ ID NO: 55194 - RNA, 32 nt, Human
aggaugguuucaauaaaccuaauaaucugaag

SEQ ID NO: 55195 - RNA, 32 nt, Human
aggaugguuucgaucuccugaccucgugaucc

SEQ ID NO: 55196 - RNA, 32 nt, Human
aggaugguuucgaucuccugaccuugugaucc

SEQ ID NO: 55197 - RNA, 32 nt, Human
aggaugguuucggucucuugaccucaugaucu

SEQ ID NO: 55198 - RNA, 22 nt, Human
aggaugguuuggaagaugagga

SEQ ID NO: 55199 - RNA, 32 nt, Human
aggaugguuuugaucuccugacuucaugaucc

SEQ ID NO: 55200 - RNA, 32 nt, Human
aggauguagcuggucacuguucuggagcuggc

SEQ ID NO: 55201 - RNA, 32 nt, Human
aggauguaggagaaaguuguuaucauuguuuu

SEQ ID NO: 55202 - RNA, 24 nt, Human
aggaugucagccguagcccuggga

SEQ ID NO: 55203 - RNA, 32 nt, Human
aggaugucaggccuggaccuccugggcaggaa

SEQ ID NO: 55204 - RNA, 32 nt, Human
aggaugucaucuuccuucacuuuuaggguccu

SEQ ID NO: 55205 - RNA, 32 nt, Human
aggauguccccaccaucccucagcccacacuc

SEQ ID NO: 55206 - RNA, 32 nt, Human
aggaugucccccagguccugccagcugggaag

SEQ ID NO: 55207 - RNA, 32 nt, Human
aggaugugacaucugugcugugaucuggauga

SEQ ID NO: 55208 - RNA, 32 nt, Human
aggaugugcacugugacugccugguggccuuu

SEQ ID NO: 55209 - RNA, 32 nt, Human
aggaugugcuuugguguauugagucugaagag

SEQ ID NO: 55210 - RNA, 32 nt, Human
aggaugugcuuugguguauugagucugaugag

SEQ ID NO: 55211 - RNA, 32 nt, Human
aggauguggaacauaaccagcacuccagaaau

SEQ ID NO: 55212 - RNA, 32 nt, Human
aggauguggaccaccugcggccccauggggug

SEQ ID NO: 55213 - RNA, 32 nt, Human
aggauguggagccugugugcuuuggugaguca

SEQ ID NO: 55214 - RNA, 32 nt, Human
aggauguggaggggcggggcagagggguccag

SEQ ID NO: 55215 - RNA, 32 nt, Human
aggauguggcacaugacagugccugaagggcu

SEQ ID NO: 55216 - RNA, 32 nt, Human
aggauguggcucaggcugggagggacuucagu

SEQ ID NO: 55217 - RNA, 32 nt, Human
aggauguggcucuccagcuuggcuucagugug

SEQ ID NO: 55218 - RNA, 32 nt, Human
aggaugugggccccagcccaaacacaucuugu

SEQ ID NO: 55219 - RNA, 32 nt, Human
aggauguggggcgagggcacagcuggggaacg

SEQ ID NO: 55220 - RNA, 29 nt, Human
aggaugugucugucuuugucacgguggac

SEQ ID NO: 55221 - RNA, 32 nt, Human
aggauguguuugcuucuucuucugccaugauu

SEQ ID NO: 55222 - RNA, 32 nt, Human
aggauguucagcaccucugccuugcagggugc

SEQ ID NO: 55223 - RNA, 32 nt, Human
aggauguucucaucucaccauucuacucauuu

SEQ ID NO: 55224 - RNA, 32 nt, Human
aggauguucucgaacuccugaacucaaguaau

SEQ ID NO: 55225 - RNA, 32 nt, Human
aggauguucucgaucuccugaccucaugaucc

SEQ ID NO: 55226 - RNA, 32 nt, Human
aggauguuuggaaggacaagacaggaaagugu

SEQ ID NO: 55227 - RNA, 32 nt, Human
aggauguuuuacuacagaucuggauggcuauu

SEQ ID NO: 55228 - RNA, 32 nt, Human
aggauguuuuagaaacccugaccugagcuggg

SEQ ID NO: 55229 - RNA, 32 nt, Human
aggauuaaaugaguuaauauauacaaauauuu

SEQ ID NO: 55230 - RNA, 32 nt, Human
aggauuaaccauuucucugaacuccaguaaga

SEQ ID NO: 55231 - RNA, 23 nt, Human
aggauuaacccuuuaagugcuga

SEQ ID NO: 55232 - RNA, 32 nt, Human
aggauuaaguccaccugucccuccugggcugc

SEQ ID NO: 55233 - RNA, 20 nt, Human
aggauuaaucauuuugacug

SEQ ID NO: 55234 - RNA, 32 nt, Human
aggauuacaagugccaugcgguagaagaggaa

SEQ ID NO: 55235 - RNA, 32 nt, Human
aggauuacauaagggacacugauauacugaaa

SEQ ID NO: 55236 - RNA, 32 nt, Human
aggauuacaucaucugcuguaacaacugcucu

SEQ ID NO: 55237 - RNA, 32 nt, Human
aggauuacgcagccaugaaggcccaggagaaa

SEQ ID NO: 55238 - RNA, 32 nt, Human
aggauuacuugacuaucucaaacacauaaauc

SEQ ID NO: 55239 - RNA, 32 nt, Human
aggauuacuugaggccagacugggcaauauag

SEQ ID NO: 55240 - RNA, 32 nt, Human
aggauuagaagaggaaacagaaacagguaaca

SEQ ID NO: 55241 - RNA, 32 nt, Human
aggauuaggaaaguuugcugaagaggaucuuu

SEQ ID NO: 55242 - RNA, 32 nt, Human
aggauuaggagaaggaagagggaacgccacau

SEQ ID NO: 55243 - RNA, 32 nt, Human
aggauuaggagguaaagccauugggagguaau

SEQ ID NO: 55244 - RNA, 32 nt, Human
aggauuaguugaguuccagcuggguuuuggga

SEQ ID NO: 55245 - RNA, 32 nt, Human
aggauuaugguggcucacgccuguaaucccag

SEQ ID NO: 55246 - RNA, 22 nt, Human
aggauuauuaauaaaagccaca

SEQ ID NO: 55247 - RNA, 32 nt, Human
aggauuauugagaggugaaggagccagguggc

SEQ ID NO: 55248 - RNA, 32 nt, Human
aggauucacagauucacauacgacugaucuug

SEQ ID NO: 55249 - RNA, 22 nt, Human
aggauucacaugccacugaagc

SEQ ID NO: 55250 - RNA, 32 nt, Human
aggauucacggaucagccugagaugucccagc

SEQ ID NO: 55251 - RNA, 32 nt, Human
aggauucacucccagccccucgccuucuaggg

SEQ ID NO: 55252 - RNA, 17 nt, Human
aggauucagagaacccc

SEQ ID NO: 55253 - RNA, 32 nt, Human
aggauucagagcagaugugaucugcgcuaggu

SEQ ID NO: 55254 - RNA, 32 nt, Human
aggauucaggaagaagaaaacucaacucagug

SEQ ID NO: 55255 - RNA, 32 nt, Human
aggauucagggacugaagccagcaugggaauu

SEQ ID NO: 55256 - RNA, 32 nt, Human
aggauucagggccggagguucuggugggggcc

SEQ ID NO: 55257 - RNA, 32 nt, Human
aggauucagguagaaaaaguauuuagcauaau

SEQ ID NO: 55258 - RNA, 32 nt, Human
aggauucaugguuguagcaagugugaggaugg

SEQ ID NO: 55259 - RNA, 32 nt, Human
aggauuccagccucccagccccucucuccgcc

SEQ ID NO: 55260 - RNA, 17 nt, Human
aggauucccagcacccc

SEQ ID NO: 55261 - RNA, 20 nt, Human
aggauucccaucuacccuga

SEQ ID NO: 55262 - RNA, 18 nt, Human
aggauuccccgaccuucc

SEQ ID NO: 55263 - RNA, 20 nt, Human
aggauuccccgaccuucccg

SEQ ID NO: 55264 - RNA, 32 nt, Human
aggauucccguagcucuucacagcugaacuca

SEQ ID NO: 55265 - RNA, 32 nt, Human
aggauuccgcccucugacacacaugccauugc

SEQ ID NO: 55266 - RNA, 32 nt, Human
aggauuccugcucuguccccugguuugcggcu

SEQ ID NO: 55267 - RNA, 19 nt, Human
aggauuccugggaccccga

SEQ ID NO: 55268 - RNA, 32 nt, Human
aggauuccuucccacccucaaagcauuaauag

SEQ ID NO: 55269 - RNA, 22 nt, Human
aggauuccuuuagaaccuccga

SEQ ID NO: 55270 - RNA, 32 nt, Human
aggauucgggucugagacuugugugucuggga

SEQ ID NO: 55271 - RNA, 32 nt, Human
aggauucucaauccuguucugcagcugaggaa

SEQ ID NO: 55272 - RNA, 32 nt, Human
aggauucugcagcuccuuuugugccaagcccg

SEQ ID NO: 55273 - RNA, 32 nt, Human
aggauucugcagcugcuuuugcauuucucuuc

SEQ ID NO: 55274 - RNA, 32 nt, Human
aggauucuguuacccagcugugcucaaaacag

SEQ ID NO: 55275 - RNA, 32 nt, Human
aggauucuuaaggagcuuuaagcuaaggaaac

SEQ ID NO: 55276 - RNA, 32 nt, Human
aggauucuuagccagucugugaaagugggccu

SEQ ID NO: 55277 - RNA, 18 nt, Human
aggauucuucugaacccc

SEQ ID NO: 55278 - RNA, 32 nt, Human
aggauucuuucagcugggaacauggcagguga

SEQ ID NO: 55279 - RNA, 32 nt, Human
aggauugaagaaaagggacugggggaaggaaa

SEQ ID NO: 55280 - RNA, 32 nt, Human
aggauugaagaaaauaguggugaugagggcuu

SEQ ID NO: 55281 - RNA, 32 nt, Human
aggauugaagaaugccgcguugggugggugcu

SEQ ID NO: 55282 - RNA, 32 nt, Human
aggauugagcuucggccucccuggcccugggu

SEQ ID NO: 55283 - RNA, 32 nt, Human
aggauugaggaagagguugcaaaguuagccga

SEQ ID NO: 55284 - RNA, 32 nt, Human
aggauugaguuucacuuccucacugacauuuu

SEQ ID NO: 55285 - RNA, 32 nt, Human
aggauugaucgaucgcuugagccugggaggug

SEQ ID NO: 55286 - RNA, 32 nt, Human
aggauugauggacaccacacaccagcuauauu

SEQ ID NO: 55287 - RNA, 32 nt, Human
aggauugauugcauagcuccucauguuucuac

SEQ ID NO: 55288 - RNA, 32 nt, Human
aggauugcagagaagaugcaagagcacuuugg

SEQ ID NO: 55289 - RNA, 32 nt, Human
aggauugcagcaaagguggucagggugauggg

SEQ ID NO: 55290 - RNA, 32 nt, Human
aggauugcagugagccaagaucgcuccauugc

SEQ ID NO: 55291 - RNA, 32 nt, Human
aggauugcgagggggacccugcuucaucuaca

SEQ ID NO: 55292 - RNA, 32 nt, Human
aggauugcgccaccacacuccagccugggcaa

SEQ ID NO: 55293 - RNA, 32 nt, Human
aggauugcgccacugcaccccagcccggguga

SEQ ID NO: 55294 - RNA, 32 nt, Human
aggauugcuaucuggaggccuuccagcugcug

SEQ ID NO: 55295 - RNA, 32 nt, Human
aggauugcuugagaccagccugggugacacag

SEQ ID NO: 55296 - RNA, 32 nt, Human
aggauugcuugaggccagccugggcaacauag

SEQ ID NO: 55297 - RNA, 32 nt, Human
aggauugcuuuguccaucuccugcuuucauuu

SEQ ID NO: 55298 - RNA, 32 nt, Human
aggauugcuuuucuguaucauaauuuuagaau

SEQ ID NO: 55299 - RNA, 32 nt, Human
aggauuggaagagauuuuaaaggccacauagg

SEQ ID NO: 55300 - RNA, 32 nt, Human
aggauuggcccccauuauggugcuucugaaua

SEQ ID NO: 55301 - RNA, 32 nt, Human
aggauuggcugcagugagguccgcaaagcccc

SEQ ID NO: 55302 - RNA, 32 nt, Human
aggauuggcuuguuaguuuaacacagccguau

SEQ ID NO: 55303 - RNA, 32 nt, Human
aggauugggggcaggaggagucuggaacacag

SEQ ID NO: 55304 - RNA, 32 nt, Human
aggauugugccacuacacuccagccuggccga

SEQ ID NO: 55305 - RNA, 32 nt, Human
aggauugugccacugcacucaagccuggguga

SEQ ID NO: 55306 - RNA, 32 nt, Human
aggauugugccacuguacuccagccugggcga

SEQ ID NO: 55307 - RNA, 32 nt, Human
aggauugugccauugcacuccagccugggcaa

SEQ ID NO: 55308 - RNA, 32 nt, Human
aggauugugggguggucaggaggccggcugcc

SEQ ID NO: 55309 - RNA, 32 nt, Human
aggauuguuucuggugacugcagccgcugccg

SEQ ID NO: 55310 - RNA, 32 nt, Human
aggauuuaaauuugaaccuggcuuucucacag

SEQ ID NO: 55311 - RNA, 32 nt, Human
aggauuuagggagagagcaagauuucuguuga

SEQ ID NO: 55312 - RNA, 18 nt, Human
aggauuuauucuccggga

SEQ ID NO: 55313 - RNA, 32 nt, Human
aggauuucaaggaaguguuugcuauucaggaa

SEQ ID NO: 55314 - RNA, 32 nt, Human
aggauuucaaguccagccugggcuacauagug

SEQ ID NO: 55315 - RNA, 32 nt, Human
aggauuucagaacacugcucuuggggucugaa

SEQ ID NO: 55316 - RNA, 32 nt, Human
aggauuucagggaaaaguguccaagcuuucag

SEQ ID NO: 55317 - RNA, 32 nt, Human
aggauuuccagaauuaggaagggaaaccaggc

SEQ ID NO: 55318 - RNA, 32 nt, Human
aggauuucgagaccagccuggccaacauggcg

SEQ ID NO: 55319 - RNA, 32 nt, Human
aggauuucuaacuccagcuguucccauacugu

SEQ ID NO: 55320 - RNA, 32 nt, Human
aggauuucuccauguuggucaggcuggucuug

SEQ ID NO: 55321 - RNA, 32 nt, Human
aggauuucucucuccuuccuccuccuuucuuu

SEQ ID NO: 55322 - RNA, 32 nt, Human
aggauuugaacccagauccccaugacgccaga

SEQ ID NO: 55323 - RNA, 32 nt, Human
aggauuugaacccagauccccaugaugccaga

SEQ ID NO: 55324 - RNA, 32 nt, Human
aggauuugaaucugcugcucucugauccuaaa

SEQ ID NO: 55325 - RNA, 32 nt, Human
aggauuugacucugaaagaagcuuugccaauu

SEQ ID NO: 55326 - RNA, 32 nt, Human
aggauuugacuuaccaccagagcauagaaaag

SEQ ID NO: 55327 - RNA, 32 nt, Human
aggauuugcucacauaguuccugcaaacuuca

SEQ ID NO: 55328 - RNA, 32 nt, Human
aggauuugcucuggacagagauggaagagccg

SEQ ID NO: 55329 - RNA, 32 nt, Human
aggauuugcuugagccugggaggcagagguug

SEQ ID NO: 55330 - RNA, 32 nt, Human
aggauuuggaaagagagcuugaugaaacagaa

SEQ ID NO: 55331 - RNA, 32 nt, Human
aggauuuggaauuaguccugggcgaccugaag

SEQ ID NO: 55332 - RNA, 32 nt, Human
aggauuuggcagcugcuccacuguuacgguug

SEQ ID NO: 55333 - RNA, 32 nt, Human
aggauuugggagagagaacaaauuuggggcag

SEQ ID NO: 55334 - RNA, 32 nt, Human
aggauuugguguuuagcuguuucucucuuuaa

SEQ ID NO: 55335 - RNA, 31 nt, Human
aggauuugguuucagcauuaguaccuacaua

SEQ ID NO: 55336 - RNA, 32 nt, Human
aggauuuguaaaccccggagcgagguucugcu

SEQ ID NO: 55337 - RNA, 32 nt, Human
aggauuuucacaaugcugcacugggcuagaaa

SEQ ID NO: 55338 - RNA, 32 nt, Human
aggauuuucacucucuuucacugggcugcuuu

SEQ ID NO: 55339 - RNA, 32 nt, Human
aggauuuucacuucuuuucucuagacuuggaa

SEQ ID NO: 55340 - RNA, 32 nt, Human
aggauuuucauugcuuauuuuaaagugucuua

SEQ ID NO: 55341 - RNA, 21 nt, Human
aggauuuucucugccccaggg

SEQ ID NO: 55342 - RNA, 32 nt, Human
aggauuuugagaccagccugaccaacauggug

SEQ ID NO: 55343 - RNA, 32 nt, Human
aggauuuugccauguuugccagccuggucucg

SEQ ID NO: 55344 - RNA, 32 nt, Human
aggauuuuguuuuguaguuugcagaugagcau

SEQ ID NO: 55345 - RNA, 32 nt, Human
aggauuuuuccagauaaauuuguacucaagga

SEQ ID NO: 55346 - RNA, 32 nt, Human
aggauuuuugacacauuuucucagggaagaau

SEQ ID NO: 55347 - RNA, 32 nt, Human
aggcaaaaacacccuucccuuuugagaaaccu

SEQ ID NO: 55348 - RNA, 32 nt, Human
aggcaaaagauaaaacagggucuagugaucca

SEQ ID NO: 55349 - RNA, 32 nt, Human
aggcaaaagccaaggcccauuagccaguuuag

SEQ ID NO: 55350 - RNA, 32 nt, Human
aggcaaaaggcagaggcugauaagaaugacaa

SEQ ID NO: 55351 - RNA, 23 nt, Human
aggcaaaaggcaucgggaagcag

SEQ ID NO: 55352 - RNA, 32 nt, Human
aggcaaaagggagagagaggggaagggggucu

SEQ ID NO: 55353 - RNA, 32 nt, Human
aggcaaaagggauuuuuacaguuagagauaaa

SEQ ID NO: 55354 - RNA, 32 nt, Human
aggcaaaauuguugccuuggccccaucaugga

SEQ ID NO: 55355 - RNA, 32 nt, Human
aggcaaacagcugugcccucuuugccuuuuug

SEQ ID NO: 55356 - RNA, 26 nt, Human
aggcaaacccagugguuucagaaaug

SEQ ID NO: 55357 - RNA, 22 nt, Human
aggcaaacugacugccauucuc

SEQ ID NO: 55358 - RNA, 32 nt, Human
aggcaaacuugaggaagcccugguucuauuuc

SEQ ID NO: 55359 - RNA, 31 nt, Human
aggcaaagaaaaggaacggacauucgguccu

SEQ ID NO: 55360 - RNA, 32 nt, Human
aggcaaagaggagcugcuccugccuccauggu

SEQ ID NO: 55361 - RNA, 32 nt, Human
aggcaaagagggugggugaaccaggccauaca

SEQ ID NO: 55362 - RNA, 22 nt, Human
aggcaaagaugaaaacuuccca

SEQ ID NO: 55363 - RNA, 22 nt, Human
aggcaaagaugagaacuuccca

SEQ ID NO: 55364 - RNA, 32 nt, Human
aggcaaagcugaagagagucaaggucacuguc

SEQ ID NO: 55365 - RNA, 32 nt, Human
aggcaaagcuuuauuuucaucucucaucuuuu

SEQ ID NO: 55366 - RNA, 21 nt, Human
aggcaaaggcagaggaauuug

SEQ ID NO: 55367 - RNA, 24 nt, Human
aggcaaaggcagguggaucaccug

SEQ ID NO: 55368 - RNA, 32 nt, Human
aggcaaaggccuggacagcuugacuugugggg

SEQ ID NO: 55369 - RNA, 24 nt, Human
aggcaaaggcgggaggaucacuug

SEQ ID NO: 55370 - RNA, 24 nt, Human
aggcaaaggcgggcggaucaccug

SEQ ID NO: 55371 - RNA, 24 nt, Human
aggcaaaggcuaaagaacuugcca

SEQ ID NO: 55372 - RNA, 32 nt, Human
aggcaaagggcgcagaggugagcacggaucac

SEQ ID NO: 55373 - RNA, 32 nt, Human
aggcaaaggugauggauucugcagugaacauu

SEQ ID NO: 55374 - RNA, 32 nt, Human
aggcaaaugaaguuaggugggguggggugggg

SEQ ID NO: 55375 - RNA, 32 nt, Human
aggcaaaugccacauugcccauuuuucagaua

SEQ ID NO: 55376 - RNA, 32 nt, Human
aggcaaauggcacugcaggugagaaccccgcc

SEQ ID NO: 55377 - RNA, 32 nt, Human
aggcaaauggcuggcguggaagcacaacccgc

SEQ ID NO: 55378 - RNA, 32 nt, Human
aggcaacaacaaaaucgcacagacacugcgug

SEQ ID NO: 55379 - RNA, 32 nt, Human
aggcaacaaccaucacccucccuccuuaagcu

SEQ ID NO: 55380 - RNA, 32 nt, Human
aggcaacaacugccccuucuuuaugcagaggu

SEQ ID NO: 55381 - RNA, 32 nt, Human
aggcaacacagccagcacggugcucuccaggg

SEQ ID NO: 55382 - RNA, 32 nt, Human
aggcaacacaggcugaaguauaagaguugaag

SEQ ID NO: 55383 - RNA, 32 nt, Human
aggcaacacagugaaacccugucucuacaaaa

SEQ ID NO: 55384 - RNA, 32 nt, Human
aggcaacacggugaaaccccaucucuacaaaa

SEQ ID NO: 55385 - RNA, 32 nt, Human
aggcaacagaacuuguuccguggauauuugga

SEQ ID NO: 55386 - RNA, 32 nt, Human
aggcaacagggugaccagcuguccugguuucc

SEQ ID NO: 55387 - RNA, 32 nt, Human
aggcaacaguucagagguagugguagaacauc

SEQ ID NO: 55388 - RNA, 32 nt, Human
aggcaacauagggagacccccaucucuacaaa

SEQ ID NO: 55389 - RNA, 32 nt, Human
aggcaacauaguaagaccucaucucuacuaaa

SEQ ID NO: 55390 - RNA, 32 nt, Human
aggcaacauagugaggccccaucuuuacaaaa

SEQ ID NO: 55391 - RNA, 32 nt, Human
aggcaacauggagaaaccccgucucuaucaga

SEQ ID NO: 55392 - RNA, 32 nt, Human
aggcaacauggcaaaaccccaucucgacaaaa

SEQ ID NO: 55393 - RNA, 32 nt, Human
aggcaacauggugaaaccccaucucuacaaaa

SEQ ID NO: 55394 - RNA, 32 nt, Human
aggcaacauggugaaacccuaucuuuucuaaa

SEQ ID NO: 55395 - RNA, 32 nt, Human
aggcaacauggugaaaccuugucucuaccaaa

SEQ ID NO: 55396 - RNA, 32 nt, Human
aggcaacauggugaaauccugucuuuaccaaa

SEQ ID NO: 55397 - RNA, 27 nt, Human
aggcaacauggugaccccaucucuacc

SEQ ID NO: 55398 - RNA, 32 nt, Human
aggcaacauugcaagacuccaucucuacaaaa

SEQ ID NO: 55399 - RNA, 32 nt, Human
aggcaacccaugugugaccaguucuccccaag

SEQ ID NO: 55400 - RNA, 32 nt, Human
aggcaaccccaccucccccucucccuccuccc

SEQ ID NO: 55401 - RNA, 32 nt, Human
aggcaaccuucuccuguuucacacagaggugg

SEQ ID NO: 55402 - RNA, 32 nt, Human
aggcaaccuuugccuucuucagaagcuuggaa

SEQ ID NO: 55403 - RNA, 32 nt, Human
aggcaacgcggaugaaacucacaaagcaaugc

SEQ ID NO: 55404 - RNA, 32 nt, Human
aggcaacgggcggcagguugcaguggaggggc

SEQ ID NO: 55405 - RNA, 32 nt, Human
aggcaacguggcugcugcccugcccaacacuc

SEQ ID NO: 55406 - RNA, 32 nt, Human
aggcaacuacagccaaaaucacuguuaaaauc

SEQ ID NO: 55407 - RNA, 32 nt, Human
aggcaacucacugucuggcagucccagccuca

SEQ ID NO: 55408 - RNA, 32 nt, Human
aggcaacucuacugucgacugccucaagggcu

SEQ ID NO: 55409 - RNA, 32 nt, Human
aggcaacugaaauaugcacccaaucaauguga

SEQ ID NO: 55410 - RNA, 23 nt, Human
aggcaacugcagagucuuagggg

SEQ ID NO: 55411 - RNA, 32 nt, Human
aggcaagaaagagauaccaagaugccaucugu

SEQ ID NO: 55412 - RNA, 32 nt, Human
aggcaagaaagcuuccuucaaccugcauagcc

SEQ ID NO: 55413 - RNA, 32 nt, Human
aggcaagaaauccuacuaauccaguuuuguuu

SEQ ID NO: 55414 - RNA, 32 nt, Human
aggcaagaacauccuggaggccaggaguucga

SEQ ID NO: 55415 - RNA, 32 nt, Human
aggcaagaacaugauuuaucuuccauaagccu

SEQ ID NO: 55416 - RNA, 32 nt, Human
aggcaagacucaggacugcucuggacauucag

SEQ ID NO: 55417 - RNA, 32 nt, Human
aggcaagacuggccuagccucccagccuacau

SEQ ID NO: 55418 - RNA, 24 nt, Human
aggcaagagaauugcuuggacuca

SEQ ID NO: 55419 - RNA, 32 nt, Human
aggcaagagccgcaccaugcaggauggggagg

SEQ ID NO: 55420 - RNA, 32 nt, Human
aggcaagaggacugcuugaggccaggaguuuc

SEQ ID NO: 55421 - RNA, 32 nt, Human
aggcaagaggagugggacaggggaguaaagga

SEQ ID NO: 55422 - RNA, 23 nt, Human
aggcaagaggauugcuugagucc

SEQ ID NO: 55423 - RNA, 23 nt, Human
aggcaagaggauugcuugggccc

SEQ ID NO: 55424 - RNA, 32 nt, Human
aggcaagagguggaaggguacugacuggguuu

SEQ ID NO: 55425 - RNA, 32 nt, Human
aggcaagaucugcagagaugccugugagauau

SEQ ID NO: 55426 - RNA, 32 nt, Human
aggcaagaugcugaaaaugcugaggcaaagcu

SEQ ID NO: 55427 - RNA, 32 nt, Human
aggcaagcaaaggagaugaaaucuguucuggg

SEQ ID NO: 55428 - RNA, 32 nt, Human
aggcaagcaauauuuucuugaucauaaauauu

SEQ ID NO: 55429 - RNA, 21 nt, Human
aggcaagcacgauggcgcuca

SEQ ID NO: 55430 - RNA, 24 nt, Human
aggcaagcagaucaugaggucagg

SEQ ID NO: 55431 - RNA, 32 nt, Human
aggcaagcagccugcaccacccugccacuggc

SEQ ID NO: 55432 - RNA, 32 nt, Human
aggcaagcauggacaggagccaagggagcagg

SEQ ID NO: 55433 - RNA, 32 nt, Human
aggcaagcccaggaguugacauuucucugccc

SEQ ID NO: 55434 - RNA, 32 nt, Human
aggcaagcccagggcacagaugcugcgauggc

SEQ ID NO: 55435 - RNA, 32 nt, Human
aggcaagccucagcagagguucuugacaguuu

SEQ ID NO: 55436 - RNA, 32 nt, Human
aggcaagccugggcauuucugcauuugugcca

SEQ ID NO: 55437 - RNA, 32 nt, Human
aggcaagcugaguuaguacaagaacagucuga

SEQ ID NO: 55438 - RNA, 32 nt, Human
aggcaagcuguaccagcagcuccuggggacgu

SEQ ID NO: 55439 - RNA, 32 nt, Human
aggcaagcuugcgacucuucuccuggaaagcu

SEQ ID NO: 55440 - RNA, 32 nt, Human
aggcaaggaaggaaaauuaauggggaagcuga

SEQ ID NO: 55441 - RNA, 32 nt, Human
aggcaaggacagugccaaaagguucugugagc

SEQ ID NO: 55442 - RNA, 32 nt, Human
aggcaaggaugucccacagaaacccaaacaag

SEQ ID NO: 55443 - RNA, 32 nt, Human
aggcaaggcaaggguuaaaaagaaaagaacaa

SEQ ID NO: 55444 - RNA, 32 nt, Human
aggcaaggcccagaccuggccucugccauccu

SEQ ID NO: 55445 - RNA, 21 nt, Human
aggcaaggccuggggugccca

SEQ ID NO: 55446 - RNA, 32 nt, Human
aggcaaggcucagagacccaggagcugguucg

SEQ ID NO: 55447 - RNA, 32 nt, Human
aggcaaggcugcaggucuggcccaggggaauu

SEQ ID NO: 55448 - RNA, 32 nt, Human
aggcaagggcaggaaaguggucuccagcccuu

SEQ ID NO: 55449 - RNA, 32 nt, Human
aggcaaggggcugcuuuccacuguggguaccu

SEQ ID NO: 55450 - RNA, 32 nt, Human
aggcaaggguuugcccaguuugcagaugagaa

SEQ ID NO: 55451 - RNA, 20 nt, Human
aggcaaggucuggccucagg

SEQ ID NO: 55452 - RNA, 32 nt, Human
aggcaagguuuucaggggacaggccaacccag

SEQ ID NO: 55453 - RNA, 32 nt, Human
aggcaagucucgaacucaugaccucaagugau

SEQ ID NO: 55454 - RNA, 26 nt, Human
aggcaagugaagcacuugaggucagg

SEQ ID NO: 55455 - RNA, 32 nt, Human
aggcaagugauggagaacuaaacaaagaacag

SEQ ID NO: 55456 - RNA, 32 nt, Human
aggcaagugauggagaacuaaauaaagaacag

SEQ ID NO: 55457 - RNA, 26 nt, Human
aggcaaguggaucacuugaggucagg

SEQ ID NO: 55458 - RNA, 24 nt, Human
aggcaaguggauuagggggucugg

SEQ ID NO: 55459 - RNA, 32 nt, Human
aggcaaguucuguaagcuuacauugcuauuug

SEQ ID NO: 55460 - RNA, 27 nt, Human
aggcaauaauggagaagagguucugga

SEQ ID NO: 55461 - RNA, 32 nt, Human
aggcaauaccucaacugccucucacuucccaa

SEQ ID NO: 55462 - RNA, 19 nt, Human
aggcaauauccucuugccc

SEQ ID NO: 55463 - RNA, 32 nt, Human
aggcaaucacggucauuuccacagccucaacc

SEQ ID NO: 55464 - RNA, 32 nt, Human
aggcaaugagccaccacgcccggguuaccuuc

SEQ ID NO: 55465 - RNA, 32 nt, Human
aggcaaugcccaggcgggccugggcacuguau

SEQ ID NO: 55466 - RNA, 19 nt, Human
aggcaauggcagcauuuca

SEQ ID NO: 55467 - RNA, 26 nt, Human
aggcaauggcagggagaaguccugga

SEQ ID NO: 55468 - RNA, 32 nt, Human
aggcaauggccacugguuuguagacagagagu

SEQ ID NO: 55469 - RNA, 31 nt, Human
aggcaauggguggaaaucaggggaacguuuc

SEQ ID NO: 55470 - RNA, 32 nt, Human
aggcaauguagaaauucuccaggggagaguga

SEQ ID NO: 55471 - RNA, 32 nt, Human
aggcaaugucucacuguuauccaggcuggagu

SEQ ID NO: 55472 - RNA, 32 nt, Human
aggcaauguucuucucauuugaauccuuaugg

SEQ ID NO: 55473 - RNA, 32 nt, Human
aggcaauuaaagaaauccacucagagaggacu

SEQ ID NO: 55474 - RNA, 32 nt, Human
aggcaauuacuggccucaaaagaggaacagag

SEQ ID NO: 55475 - RNA, 32 nt, Human
aggcaauucuaagaucuuccacaaaacaucua

SEQ ID NO: 55476 - RNA, 32 nt, Human
aggcaauucuccugccuuugccuccagaagca

SEQ ID NO: 55477 - RNA, 32 nt, Human
aggcaauuugucaaagauuguuguuggauuuu

SEQ ID NO: 55478 - RNA, 32 nt, Human
aggcacaagggggugagggaaagggaaggcuu

SEQ ID NO: 55479 - RNA, 32 nt, Human
aggcacacacaaaaggcagauucucguaaacg

SEQ ID NO: 55480 - RNA, 32 nt, Human
aggcacacacauguaugcacacacacaugcac

SEQ ID NO: 55481 - RNA, 32 nt, Human
aggcacacagaggaccacagaggcagagccuc

SEQ ID NO: 55482 - RNA, 32 nt, Human
aggcacacagcccagccccuugugaguccugg

SEQ ID NO: 55483 - RNA, 32 nt, Human
aggcacacaguccgcuucuucguccucagggu

SEQ ID NO: 55484 - RNA, 32 nt, Human
aggcacacgaagcacaagucucaggggaccau

SEQ ID NO: 55485 - RNA, 32 nt, Human
aggcacacgaaggagguggggaggugaagaug

SEQ ID NO: 55486 - RNA, 32 nt, Human
aggcacacuacagucaucacuaggcaauucug

SEQ ID NO: 55487 - RNA, 32 nt, Human
aggcacacuauuacuucugcaacucagacuga

SEQ ID NO: 55488 - RNA, 32 nt, Human
aggcacacucacaaucaacuuccugauuucac

SEQ ID NO: 55489 - RNA, 32 nt, Human
aggcacacugucagaggugaccggagaacuga

SEQ ID NO: 55490 - RNA, 32 nt, Human
aggcacacuuggggccuugagcuccagggagu

SEQ ID NO: 55491 - RNA, 32 nt, Human
aggcacagaagggcugagagaccuggccuagu

SEQ ID NO: 55492 - RNA, 32 nt, Human
aggcacagaagguugucaugggcuguuccuug

SEQ ID NO: 55493 - RNA, 18 nt, Human
aggcacagaaucgcugaa

SEQ ID NO: 55494 - RNA, 20 nt, Human
aggcacagaccagggcucca

SEQ ID NO: 55495 - RNA, 32 nt, Human
aggcacagacuuuucuuguucucuucucuauc

SEQ ID NO: 55496 - RNA, 32 nt, Human
aggcacagagaaaggaaguaaaaagaaagaaa

SEQ ID NO: 55497 - RNA, 32 nt, Human
aggcacagagcuaaggaacuugcuuaagguca

SEQ ID NO: 55498 - RNA, 21 nt, Human
aggcacagagcuggucccuag

SEQ ID NO: 55499 - RNA, 21 nt, Human
aggcacagagggcugcucaca

SEQ ID NO: 55500 - RNA, 22 nt, Human
aggcacagaugcaggcucagca

SEQ ID NO: 55501 - RNA, 32 nt, Human
aggcacagcacagcaguacuccacauuguuuc

SEQ ID NO: 55502 - RNA, 32 nt, Human
aggcacagcacagcagugacucggugagggga

SEQ ID NO: 55503 - RNA, 32 nt, Human
aggcacagcauggacaaaggcucacaggggug

SEQ ID NO: 55504 - RNA, 32 nt, Human
aggcacagccacuuccugccuccugggacucc

SEQ ID NO: 55505 - RNA, 19 nt, Human
aggcacagcuccucggggg

SEQ ID NO: 55506 - RNA, 30 nt, Human
aggcacagcuugcagacugagggcgguggg

SEQ ID NO: 55507 - RNA, 30 nt, Human
aggcacagcuugcagugagcgaagaucgca

SEQ ID NO: 55508 - RNA, 32 nt, Human
aggcacaggacuggccccuuguccucauaaaa

SEQ ID NO: 55509 - RNA, 32 nt, Human
aggcacaggcaaaggguguggcuucagagaag

SEQ ID NO: 55510 - RNA, 24 nt, Human
aggcacaggcgggaggaucacuug

SEQ ID NO: 55511 - RNA, 32 nt, Human
aggcacaggcugggauggagcacuucuucugg

SEQ ID NO: 55512 - RNA, 32 nt, Human
aggcacagucagaacucacugcagccucuaca

SEQ ID NO: 55513 - RNA, 32 nt, Human
aggcacagugaguccacuggggcacggcagcg

SEQ ID NO: 55514 - RNA, 32 nt, Human
aggcacagugugaggggcauggggaggcagga

SEQ ID NO: 55515 - RNA, 32 nt, Human
aggcacaguucacccuuagccugcacuaaggg

SEQ ID NO: 55516 - RNA, 32 nt, Human
aggcacaugagguugggggccuuugaggcugu

SEQ ID NO: 55517 - RNA, 32 nt, Human
aggcacaugucuauaauuccagcuacucagga

SEQ ID NO: 55518 - RNA, 32 nt, Human
aggcacaugugaggguccagagagaagggagu

SEQ ID NO: 55519 - RNA, 32 nt, Human
aggcaccaaacagcccaggacugccgagacuc

SEQ ID NO: 55520 - RNA, 32 nt, Human
aggcaccaaaucucccucaucuucuagugcca

SEQ ID NO: 55521 - RNA, 32 nt, Human
aggcaccaacagcacagagcaggccaguguac

SEQ ID NO: 55522 - RNA, 32 nt, Human
aggcaccaacagccagcgagccaucauuccca

SEQ ID NO: 55523 - RNA, 31 nt, Human
aggcaccaagugucucaggcagcgaggaaau

SEQ ID NO: 55524 - RNA, 32 nt, Human
aggcaccaaguucugucccccguagaaauccc

SEQ ID NO: 55525 - RNA, 32 nt, Human
aggcaccaaucaggagaaggguucugccuccc

SEQ ID NO: 55526 - RNA, 24 nt, Human
aggcaccacagagccccuugcccu

SEQ ID NO: 55527 - RNA, 32 nt, Human
aggcaccacccaugggcuucacccucagaacc

SEQ ID NO: 55528 - RNA, 32 nt, Human
aggcaccacugcacucuagccugggcaagaga

SEQ ID NO: 55529 - RNA, 32 nt, Human
aggcaccacuguggaccccugcucugcacccc

SEQ ID NO: 55530 - RNA, 32 nt, Human
aggcaccagaaugugccucagagcugugacau

SEQ ID NO: 55531 - RNA, 20 nt, Human
aggcaccagcuaccucaggg

SEQ ID NO: 55532 - RNA, 32 nt, Human
aggcaccagcugguugggaccagcagccccca

SEQ ID NO: 55533 - RNA, 32 nt, Human
aggcaccaggcagggucuagaaggcuguggug

SEQ ID NO: 55534 - RNA, 32 nt, Human
aggcaccaugaagcaggagucugcagccccga

SEQ ID NO: 55535 - RNA, 32 nt, Human
aggcaccauucaggaaccuggaccaaagcuga

SEQ ID NO: 55536 - RNA, 23 nt, Human
aggcacccacaggcacaagcuga

SEQ ID NO: 55537 - RNA, 32 nt, Human
aggcacccacccucucuggcccaggccugcug

SEQ ID NO: 55538 - RNA, 32 nt, Human
aggcacccacugacuccagccucauggaacca

SEQ ID NO: 55539 - RNA, 32 nt, Human
aggcacccaguuccugacuucccagaggcuuc

SEQ ID NO: 55540 - RNA, 32 nt, Human
aggcacccauccugacccccaggcuggagagg

SEQ ID NO: 55541 - RNA, 21 nt, Human
aggcacccaugccccagguga

SEQ ID NO: 55542 - RNA, 32 nt, Human
aggcaccccaccuugcuccugaugcaguuucu

SEQ ID NO: 55543 - RNA, 32 nt, Human
aggcacccccuucuucauugcucucuccagaa

SEQ ID NO: 55544 - RNA, 32 nt, Human
aggcaccccgggggcuggaggggcguguaccc

SEQ ID NO: 55545 - RNA, 32 nt, Human
aggcaccccucaggccugguggccacugucca

SEQ ID NO: 55546 - RNA, 32 nt, Human
aggcacccggccuuucuuucucccucuugcaa

SEQ ID NO: 55547 - RNA, 32 nt, Human
aggcacccguaaucccagcuacuugggaggcu

SEQ ID NO: 55548 - RNA, 32 nt, Human
aggcacccucauuccccucucccacccacccc

SEQ ID NO: 55549 - RNA, 32 nt, Human
aggcacccuccagcgucaggugcggauccccc

SEQ ID NO: 55550 - RNA, 32 nt, Human
aggcacccugccucugcagagcagaaagauca

SEQ ID NO: 55551 - RNA, 32 nt, Human
aggcacccugggcagagagaugcagugggugc

SEQ ID NO: 55552 - RNA, 26 nt, Human
aggcacccuucuuuccucuuccccuu

SEQ ID NO: 55553 - RNA, 23 nt, Human
aggcaccgagggggcacuggaug

SEQ ID NO: 55554 - RNA, 32 nt, Human
aggcaccgcagccugucagccaacauugccuu

SEQ ID NO: 55555 - RNA, 32 nt, Human
aggcaccgcugcucccuccagucccuccgugc

SEQ ID NO: 55556 - RNA, 32 nt, Human
aggcaccgcuguugagcagccuggugguacug

SEQ ID NO: 55557 - RNA, 20 nt, Human
aggcaccuaccaccugcccu

SEQ ID NO: 55558 - RNA, 32 nt, Human
aggcaccuauaaucccagcuacaugggaggcu

SEQ ID NO: 55559 - RNA, 32 nt, Human
aggcaccuaugguuccagcuacucaggaggcu

SEQ ID NO: 55560 - RNA, 32 nt, Human
aggcaccuauucucuuugccacccugacacca

SEQ ID NO: 55561 - RNA, 32 nt, Human
aggcaccucacagaaaugagaucaggcucugc

SEQ ID NO: 55562 - RNA, 22 nt, Human
aggcaccugacgccucuuuccc

SEQ ID NO: 55563 - RNA, 32 nt, Human
aggcaccugcaaucccagcuacaugggaggcu

SEQ ID NO: 55564 - RNA, 32 nt, Human
aggcaccugcagcccuccuuccucagcaggaa

SEQ ID NO: 55565 - RNA, 32 nt, Human
aggcaccugcagcuuccagugcuguaacagag

SEQ ID NO: 55566 - RNA, 32 nt, Human
aggcaccugccuguuuuuguuggugcacagag

SEQ ID NO: 55567 - RNA, 23 nt, Human
aggcaccugcuccucuugcccuu

SEQ ID NO: 55568 - RNA, 32 nt, Human
aggcaccugcuuaccguaaaugaucauguuau

SEQ ID NO: 55569 - RNA, 32 nt, Human
aggcaccuggcaucccagcuacuccaggggcu

SEQ ID NO: 55570 - RNA, 23 nt, Human
aggcaccugggcauccuuccccu

SEQ ID NO: 55571 - RNA, 32 nt, Human
aggcaccuguaaccccagcuacucaggagguu

SEQ ID NO: 55572 - RNA, 32 nt, Human
aggcaccuguaauccagguaugugggaggcug

SEQ ID NO: 55573 - RNA, 32 nt, Human
aggcaccuguaaucccaccuacucaggaggcu

SEQ ID NO: 55574 - RNA, 32 nt, Human
aggcaccuguaaucccagccaccugggaggcu

SEQ ID NO: 55575 - RNA, 32 nt, Human
aggcaccuguaaucccagcuaccugagaggcu

SEQ ID NO: 55576 - RNA, 32 nt, Human
aggcaccuguaaucccagcuacucaggaagcu

SEQ ID NO: 55577 - RNA, 32 nt, Human
aggcaccuguaaucccagcuacucaggaggcu

SEQ ID NO: 55578 - RNA, 32 nt, Human
aggcaccuguaaucccagcuacucgggaggcu

SEQ ID NO: 55579 - RNA, 32 nt, Human
aggcaccuguaaucccagcuacuugggagacu

SEQ ID NO: 55580 - RNA, 32 nt, Human
aggcaccuguaaucccagcuacuugggaggcu

SEQ ID NO: 55581 - RNA, 32 nt, Human
aggcaccuguaaucccagcugcccaggaggcu

SEQ ID NO: 55582 - RNA, 32 nt, Human
aggcaccuguaaucccagguacuagggaggcu

SEQ ID NO: 55583 - RNA, 32 nt, Human
aggcaccuguaaucccaguuacuugggaggcu

SEQ ID NO: 55584 - RNA, 32 nt, Human
aggcaccuguaaucccaucuacugaggcagga

SEQ ID NO: 55585 - RNA, 32 nt, Human
aggcaccuguacucccagcuacucaggaggcu

SEQ ID NO: 55586 - RNA, 32 nt, Human
aggcaccuguagucccagcuacacgggaggcu

SEQ ID NO: 55587 - RNA, 32 nt, Human
aggcaccuguagucccagcuacccgggaggcu

SEQ ID NO: 55588 - RNA, 32 nt, Human
aggcaccuguagucccagcuacucaggaggcu

SEQ ID NO: 55589 - RNA, 32 nt, Human
aggcaccuguagucccagcuacucgggaggcu

SEQ ID NO: 55590 - RNA, 32 nt, Human
aggcaccuguagucccagcuacuugggaggcu

SEQ ID NO: 55591 - RNA, 32 nt, Human
aggcaccuguagucuuagcuacucgagaggcc

SEQ ID NO: 55592 - RNA, 21 nt, Human
aggcaccugucguccugccuu

SEQ ID NO: 55593 - RNA, 21 nt, Human
aggcaccugucucccuucugc

SEQ ID NO: 55594 - RNA, 32 nt, Human
aggcaccugugaucccagcuacuuggaggcug

SEQ ID NO: 55595 - RNA, 32 nt, Human
aggcaccuguugucccagcuacucgggaggcu

SEQ ID NO: 55596 - RNA, 32 nt, Human
aggcaccuuagcaaucagccauugccugcaag

SEQ ID NO: 55597 - RNA, 32 nt, Human
aggcaccuuccacuagcaacagucuccccagg

SEQ ID NO: 55598 - RNA, 32 nt, Human
aggcacgacccucagaucucagucuagugaag

SEQ ID NO: 55599 - RNA, 22 nt, Human
aggcacgagccacugugcccgg

SEQ ID NO: 55600 - RNA, 32 nt, Human
aggcacgcacacaagccucuggacgucaagag

SEQ ID NO: 55601 - RNA, 32 nt, Human
aggcacgcacacacaaaacaagcaaauguaac

SEQ ID NO: 55602 - RNA, 32 nt, Human
aggcacgcaccacugcuucccacuggggccgg

SEQ ID NO: 55603 - RNA, 18 nt, Human
aggcacgccgugugcucu

SEQ ID NO: 55604 - RNA, 32 nt, Human
aggcacgccuguaaucccagcacuuugggagg

SEQ ID NO: 55605 - RNA, 23 nt, Human
aggcacggaggcucgugcaugua

SEQ ID NO: 55606 - RNA, 32 nt, Human
aggcacggcuggggccgcucugugcuggcgcc

SEQ ID NO: 55607 - RNA, 32 nt, Human
aggcacgggaugagucugggugaccucugcgc

SEQ ID NO: 55608 - RNA, 32 nt, Human
aggcacgggccagggaccuaggaaaagcggca

SEQ ID NO: 55609 - RNA, 32 nt, Human
aggcacgugugcuggggaaggcacugaguccu

SEQ ID NO: 55610 - RNA, 32 nt, Human
aggcacuagccucuguagcuggugguggcagc

SEQ ID NO: 55611 - RNA, 32 nt, Human
aggcacuaggcauggaugccagugagccuccc

SEQ ID NO: 55612 - RNA, 31 nt, Human
aggcacucaauaaauacuuguuuguugaaaa

SEQ ID NO: 55613 - RNA, 32 nt, Human
aggcacucacacgcccuccuguccacaacccu

SEQ ID NO: 55614 - RNA, 32 nt, Human
aggcacuccagccuggcgacagagcgagacuc

SEQ ID NO: 55615 - RNA, 32 nt, Human
aggcacuccagccugggugacagagugagacu

SEQ ID NO: 55616 - RNA, 31 nt, Human
aggcacuccauaaauaucuguugaaccuuca

SEQ ID NO: 55617 - RNA, 32 nt, Human
aggcacucucaaaucuugaacccuggaccaaa

SEQ ID NO: 55618 - RNA, 32 nt, Human
aggcacucuuucucaaacuggccucccgggac

SEQ ID NO: 55619 - RNA, 32 nt, Human
aggcacugaaggcggcggcggggccagaggcu

SEQ ID NO: 55620 - RNA, 32 nt, Human
aggcacugacccacgagcccacugccucccuc

SEQ ID NO: 55621 - RNA, 32 nt, Human
aggcacugagccacugcgcccagucaacaauc

SEQ ID NO: 55622 - RNA, 32 nt, Human
aggcacugaggguuugcaaauacuuuccuacu

SEQ ID NO: 55623 - RNA, 18 nt, Human
aggcacugcagccucggg

SEQ ID NO: 55624 - RNA, 32 nt, Human
aggcacugcagcuaugggcacugccucagccu

SEQ ID NO: 55625 - RNA, 32 nt, Human
aggcacugcagcugcucgguugcccagccucc

SEQ ID NO: 55626 - RNA, 32 nt, Human
aggcacugcaggcugggcgcaggggcucacac

SEQ ID NO: 55627 - RNA, 32 nt, Human
aggcacugcagucuccaacuccuggccucaag

SEQ ID NO: 55628 - RNA, 32 nt, Human
aggcacugcccugaggcagccucugccuaccu

SEQ ID NO: 55629 - RNA, 32 nt, Human
aggcacugcugccaugcugccuccccaggcug

SEQ ID NO: 55630 - RNA, 32 nt, Human
aggcacugcugccuuccugccucccaaggccu

SEQ ID NO: 55631 - RNA, 32 nt, Human
aggcacuggcauugugcuugacauacaucauc

SEQ ID NO: 55632 - RNA, 32 nt, Human
aggcacuggcgugggagcccugggagaccccu

SEQ ID NO: 55633 - RNA, 32 nt, Human
aggcacugggaggacaguggcugaguggaggc

SEQ ID NO: 55634 - RNA, 32 nt, Human
aggcacugggcugcggcaagugggcaggggag

SEQ ID NO: 55635 - RNA, 32 nt, Human
aggcacugggcuuagcaccacagggaacuucc

SEQ ID NO: 55636 - RNA, 32 nt, Human
aggcacuggggagggggcuucaaggagggagu

SEQ ID NO: 55637 - RNA, 32 nt, Human
aggcacuggggauacaaauuagccggggacuc

SEQ ID NO: 55638 - RNA, 18 nt, Human
aggcacuggggcuggggc

SEQ ID NO: 55639 - RNA, 32 nt, Human
aggcacugggguucggauccugggcaaaguuu

SEQ ID NO: 55640 - RNA, 32 nt, Human
aggcacuguaccaccagccuacugagauugug

SEQ ID NO: 55641 - RNA, 32 nt, Human
aggcacugucacugcccaccuccuugggccuc

SEQ ID NO: 55642 - RNA, 32 nt, Human
aggcacugugccaggugcgaggguaccaugac

SEQ ID NO: 55643 - RNA, 32 nt, Human
aggcacuguuaggcugagcaugguggcucaug

SEQ ID NO: 55644 - RNA, 32 nt, Human
aggcacuguucauauuuuagggcuuguauuau

SEQ ID NO: 55645 - RNA, 32 nt, Human
aggcacuucacucacaggccugugggaugcuc

SEQ ID NO: 55646 - RNA, 32 nt, Human
aggcacuucagccugggcgacagagcgagacu

SEQ ID NO: 55647 - RNA, 32 nt, Human
aggcacuucccaggggaagaccagagaagacc

SEQ ID NO: 55648 - RNA, 32 nt, Human
aggcacuuccucacccccucagcgccacggac

SEQ ID NO: 55649 - RNA, 32 nt, Human
aggcacuugcguggauguuucucacuugagca

SEQ ID NO: 55650 - RNA, 21 nt, Human
aggcacuugggcugccaggaa

SEQ ID NO: 55651 - RNA, 32 nt, Human
aggcacuuuccagcccugugcaguguugcuac

SEQ ID NO: 55652 - RNA, 32 nt, Human
aggcacuuugcaccacagacagauagcaagaa

SEQ ID NO: 55653 - RNA, 32 nt, Human
aggcacuuugggaggccgaggcaggcagauca

SEQ ID NO: 55654 - RNA, 32 nt, Human
aggcagaaaagcuuccucuuagaucuggccac

SEQ ID NO: 55655 - RNA, 32 nt, Human
aggcagaaaauguuuuaaggauuuucuucaaa

SEQ ID NO: 55656 - RNA, 32 nt, Human
aggcagaaacagcagaagcguuaacagcagca

SEQ ID NO: 55657 - RNA, 32 nt, Human
aggcagaaacaguaccacuggacuggaagcuc

SEQ ID NO: 55658 - RNA, 32 nt, Human
aggcagaaaggccacaacccacccuagguuga

SEQ ID NO: 55659 - RNA, 32 nt, Human
aggcagaacagugauaaagacaaggaucuaaa

SEQ ID NO: 55660 - RNA, 19 nt, Human
aggcagaacccagaaacca

SEQ ID NO: 55661 - RNA, 32 nt, Human
aggcagaagaauugcuugaacuggggaggcag

SEQ ID NO: 55662 - RNA, 32 nt, Human
aggcagaagagcuuccucauuugcugagggcu

SEQ ID NO: 55663 - RNA, 32 nt, Human
aggcagaagcccccgcccccacccucgagcuc

SEQ ID NO: 55664 - RNA, 32 nt, Human
aggcagaagccuugaacccagaaguuacucua

SEQ ID NO: 55665 - RNA, 32 nt, Human
aggcagaaggagcuauuaagccuacagcagug

SEQ ID NO: 55666 - RNA, 21 nt, Human
aggcagaaggaucgcuuaaac

SEQ ID NO: 55667 - RNA, 24 nt, Human
aggcagaaggauugcuggagccca

SEQ ID NO: 55668 - RNA, 24 nt, Human
aggcagaaggauugcuugagccca

SEQ ID NO: 55669 - RNA, 24 nt, Human
aggcagaaggauugcuuggaccca

SEQ ID NO: 55670 - RNA, 18 nt, Human
aggcagaauaauugcaga

SEQ ID NO: 55671 - RNA, 32 nt, Human
aggcagaauggaggaggcagguuuagggucug

SEQ ID NO: 55672 - RNA, 32 nt, Human
aggcagacaaacauucagaguugcuggaaugc

SEQ ID NO: 55673 - RNA, 21 nt, Human
aggcagacaaagguucauuug

SEQ ID NO: 55674 - RNA, 26 nt, Human
aggcagacagaucaccugaggucagg

SEQ ID NO: 55675 - RNA, 19 nt, Human
aggcagacagccucagcaa

SEQ ID NO: 55676 - RNA, 32 nt, Human
aggcagacaguaaacaaaacaagcaagucaau

SEQ ID NO: 55677 - RNA, 32 nt, Human
aggcagacaguaggagguuggcagaugguggg

SEQ ID NO: 55678 - RNA, 32 nt, Human
aggcagacaucagaggccagagugccuagccc

SEQ ID NO: 55679 - RNA, 22 nt, Human
aggcagacaucagcucagccug

SEQ ID NO: 55680 - RNA, 32 nt, Human
aggcagacaucuaacccugaaaaccacucgcu

SEQ ID NO: 55681 - RNA, 32 nt, Human
aggcagacccaggcaguuuggcaccagagucc

SEQ ID NO: 55682 - RNA, 18 nt, Human
aggcagaccugcccagag

SEQ ID NO: 55683 - RNA, 32 nt, Human
aggcagacgagugaguuucacacagaagaauu

SEQ ID NO: 55684 - RNA, 32 nt, Human
aggcagacgcugcggguggagacaguccuuag

SEQ ID NO: 55685 - RNA, 26 nt, Human
aggcagacggaucacuugaggucagg

SEQ ID NO: 55686 - RNA, 32 nt, Human
aggcagacugagcucaggagcuugagaccagc

SEQ ID NO: 55687 - RNA, 32 nt, Human
aggcagacuggguuucuagcccauggacuuca

SEQ ID NO: 55688 - RNA, 32 nt, Human
aggcagagaaggugugcucagcaccaaaagca

SEQ ID NO: 55689 - RNA, 32 nt, Human
aggcagagaaguaccacucucuggccuuaaac

SEQ ID NO: 55690 - RNA, 23 nt, Human
aggcagagaauugcuugaaccca

SEQ ID NO: 55691 - RNA, 32 nt, Human
aggcagagacaggcaggucgcuugagcucagg

SEQ ID NO: 55692 - RNA, 32 nt, Human
aggcagagaccaccgcgggcaccgugacgccc

SEQ ID NO: 55693 - RNA, 32 nt, Human
aggcagagacccuuugccccugccuuucuccc

SEQ ID NO: 55694 - RNA, 20 nt, Human
aggcagagaggcccggcaag

SEQ ID NO: 55695 - RNA, 32 nt, Human
aggcagagagugagggaaagggccuggccggc

SEQ ID NO: 55696 - RNA, 32 nt, Human
aggcagagaucucucaccuggaagaugggucu

SEQ ID NO: 55697 - RNA, 32 nt, Human
aggcagagaucucuggaguguugcaguuagag

SEQ ID NO: 55698 - RNA, 19 nt, Human
aggcagagauugcagugag

SEQ ID NO: 55699 - RNA, 32 nt, Human
aggcagagcagggagaggggccagcucacccu

SEQ ID NO: 55700 - RNA, 32 nt, Human
aggcagagcccaggcgugcggugcuucucggg

SEQ ID NO: 55701 - RNA, 25 nt, Human
aggcagagcccuggcagggcgcuca

SEQ ID NO: 55702 - RNA, 32 nt, Human
aggcagagcggcaagagccaggugagcuucca

SEQ ID NO: 55703 - RNA, 32 nt, Human
aggcagagcuggacagauucugugaugccaug

SEQ ID NO: 55704 - RNA, 30 nt, Human
aggcagagcuugcagucagccgagaucacg

SEQ ID NO: 55705 - RNA, 19 nt, Human
aggcagagcuugcagugag

SEQ ID NO: 55706 - RNA, 30 nt, Human
aggcagagcuugcagugagcagagaucgcg

SEQ ID NO: 55707 - RNA, 30 nt, Human
aggcagagcuugcagugagccaagaucgca

SEQ ID NO: 55708 - RNA, 30 nt, Human
aggcagagcuugcagugagccaagaucgcg

SEQ ID NO: 55709 - RNA, 30 nt, Human
aggcagagcuugcagugagccaagaucgug

SEQ ID NO: 55710 - RNA, 30 nt, Human
aggcagagcuugcagugagccgagacugcg

SEQ ID NO: 55711 - RNA, 30 nt, Human
aggcagagcuugcagugaguggagaugcgc

SEQ ID NO: 55712 - RNA, 32 nt, Human
aggcagaggaagaagggugaggacagcaccag

SEQ ID NO: 55713 - RNA, 32 nt, Human
aggcagaggaaggaaaauggggauggcugggg

SEQ ID NO: 55714 - RNA, 32 nt, Human
aggcagaggagaaguuugaagaugcauaugag

SEQ ID NO: 55715 - RNA, 32 nt, Human
aggcagaggauucuccaggaagcauggaaaau

SEQ ID NO: 55716 - RNA, 32 nt, Human
aggcagaggcagcaagaggcggcggcggggag

SEQ ID NO: 55717 - RNA, 32 nt, Human
aggcagaggccggggaagcagcgcggcauccc

SEQ ID NO: 55718 - RNA, 32 nt, Human
aggcagaggccuggggagaguuuaaggagugu

SEQ ID NO: 55719 - RNA, 19 nt, Human
aggcagaggcuacagugag

SEQ ID NO: 55720 - RNA, 23 nt, Human
aggcagaggcugagaaucagaag

SEQ ID NO: 55721 - RNA, 32 nt, Human
aggcagaggcuggaaugcaaugaugcgaucuc

SEQ ID NO: 55722 - RNA, 21 nt, Human
aggcagaggggacccagcgaa

SEQ ID NO: 55723 - RNA, 19 nt, Human
aggcagagguggcagugag

SEQ ID NO: 55724 - RNA, 24 nt, Human
aggcagagguggguggaucacuca

SEQ ID NO: 55725 - RNA, 32 nt, Human
aggcagaggugguuuucucuguuugacucuca

SEQ ID NO: 55726 - RNA, 32 nt, Human
aggcagagguuacagguuacagugagcaaaga

SEQ ID NO: 55727 - RNA, 23 nt, Human
aggcagagguugcacugagcuga

SEQ ID NO: 55728 - RNA, 19 nt, Human
aggcagagguugcagucag

SEQ ID NO: 55729 - RNA, 18 nt, Human
aggcagagguugcaguga

SEQ ID NO: 55730 - RNA, 19 nt, Human
aggcagagguugcagugag

SEQ ID NO: 55731 - RNA, 20 nt, Human
aggcagagguugcagugagc

SEQ ID NO: 55732 - RNA, 19 nt, Human
aggcagagguuguagugag

SEQ ID NO: 55733 - RNA, 32 nt, Human
aggcagagguuguagugagcugagauggggcc

SEQ ID NO: 55734 - RNA, 32 nt, Human
aggcagaguauaacccagugaagagagcauua

SEQ ID NO: 55735 - RNA, 32 nt, Human
aggcagaguccggggaagcagcgcggcauccc

SEQ ID NO: 55736 - RNA, 19 nt, Human
aggcagagucucacucugu

SEQ ID NO: 55737 - RNA, 32 nt, Human
aggcagagugagcagguaagagagggauauac

SEQ ID NO: 55738 - RNA, 32 nt, Human
aggcagagugcacaguggucaagggugcagcu

SEQ ID NO: 55739 - RNA, 32 nt, Human
aggcagagugugacagagcagagccagggcca

SEQ ID NO: 55740 - RNA, 32 nt, Human
aggcagagugugauggggaggagggacaggaa

SEQ ID NO: 55741 - RNA, 24 nt, Human
aggcagaguugggaggaucaccug

SEQ ID NO: 55742 - RNA, 19 nt, Human
aggcagaguuugcagugag

SEQ ID NO: 55743 - RNA, 21 nt, Human
aggcagaucaccugaggccag

SEQ ID NO: 55744 - RNA, 22 nt, Human
aggcagaucaccugaggucagg

SEQ ID NO: 55745 - RNA, 32 nt, Human
aggcagaucacugauccagaacacuucaagaa

SEQ ID NO: 55746 - RNA, 22 nt, Human
aggcagaucacuugaggccagg

SEQ ID NO: 55747 - RNA, 22 nt, Human
aggcagaucacuugaggucagg

SEQ ID NO: 55748 - RNA, 32 nt, Human
aggcagaucucaaacuccaggcucagaacugu

SEQ ID NO: 55749 - RNA, 32 nt, Human
aggcagaucucaaacuccugaccucgugaugc

SEQ ID NO: 55750 - RNA, 32 nt, Human
aggcagaugaacuacaagucugccuuucuucc

SEQ ID NO: 55751 - RNA, 26 nt, Human
aggcagauggaacacuugaggucagg

SEQ ID NO: 55752 - RNA, 32 nt, Human
aggcagauggaggcagggcucacacuggccuc

SEQ ID NO: 55753 - RNA, 24 nt, Human
aggcagauggaucacgaggucagg

SEQ ID NO: 55754 - RNA, 21 nt, Human
aggcagauggaucaugagguc

SEQ ID NO: 55755 - RNA, 24 nt, Human
aggcagauggaucaugaggucagg

SEQ ID NO: 55756 - RNA, 19 nt, Human
aggcagaugggacuaagug

SEQ ID NO: 55757 - RNA, 32 nt, Human
aggcagaugggggucaaaccacugccuuggcc

SEQ ID NO: 55758 - RNA, 32 nt, Human
aggcagauguggguauggggcccagugugaga

SEQ ID NO: 55759 - RNA, 32 nt, Human
aggcagauguugcagugagccgagauggcacc

SEQ ID NO: 55760 - RNA, 32 nt, Human
aggcagauuucgaauuccugaccucaagugau

SEQ ID NO: 55761 - RNA, 22 nt, Human
aggcagcaaggcagugagcuau

SEQ ID NO: 55762 - RNA, 32 nt, Human
aggcagcacagcuugcagcuucaagagagagg

SEQ ID NO: 55763 - RNA, 32 nt, Human
aggcagcaccaccacacagucaccccucccuc

SEQ ID NO: 55764 - RNA, 18 nt, Human
aggcagcaccagggcucc

SEQ ID NO: 55765 - RNA, 32 nt, Human
aggcagcaccagggcugcggagcugcugggag

SEQ ID NO: 55766 - RNA, 32 nt, Human
aggcagcacccaggaauggcagcucuguguuc

SEQ ID NO: 55767 - RNA, 32 nt, Human
aggcagcaccugccccagauggacggggcugu

SEQ ID NO: 55768 - RNA, 32 nt, Human
aggcagcagagccgaggagagcagguccacac

SEQ ID NO: 55769 - RNA, 32 nt, Human
aggcagcagcacucccaccuggcugcucugau

SEQ ID NO: 55770 - RNA, 32 nt, Human
aggcagcagcagagggagagcucggggcuugg

SEQ ID NO: 55771 - RNA, 32 nt, Human
aggcagcagcauguaauuaucaacauuaguau

SEQ ID NO: 55772 - RNA, 32 nt, Human
aggcagcagccccagucagggacuuauagaua

SEQ ID NO: 55773 - RNA, 32 nt, Human
aggcagcagcuggaguaguuacauugucauca

SEQ ID NO: 55774 - RNA, 32 nt, Human
aggcagcagcuggcaccaucagagccaggaga

SEQ ID NO: 55775 - RNA, 32 nt, Human
aggcagcaggaaggagaaaggagggaagguaa

SEQ ID NO: 55776 - RNA, 32 nt, Human
aggcagcaggagagaggagagggcagaacagg

SEQ ID NO: 55777 - RNA, 32 nt, Human
aggcagcaggauucaugcugggcauucugugu

SEQ ID NO: 55778 - RNA, 32 nt, Human
aggcagcaggcaccaguccaggagagcuucgu

SEQ ID NO: 55779 - RNA, 32 nt, Human
aggcagcagguggcagaauggggugcaugaag

SEQ ID NO: 55780 - RNA, 32 nt, Human
aggcagcagugagccgagauugcgccacuuca

SEQ ID NO: 55781 - RNA, 32 nt, Human
aggcagcagugccuggaaaaccagucccgccc

SEQ ID NO: 55782 - RNA, 32 nt, Human
aggcagcaguggcagccacucagugugagaca

SEQ ID NO: 55783 - RNA, 32 nt, Human
aggcagcagugucuguaccucgggugggaggg

SEQ ID NO: 55784 - RNA, 32 nt, Human
aggcagcaucacacuggggucacugacagacu

SEQ ID NO: 55785 - RNA, 20 nt, Human
aggcagcauccacgcccucc

SEQ ID NO: 55786 - RNA, 32 nt, Human
aggcagcaugagaugcuguccucugaucccca

SEQ ID NO: 55787 - RNA, 32 nt, Human
aggcagcauggcagagaaccagaaggaagucc

SEQ ID NO: 55788 - RNA, 32 nt, Human
aggcagcauuccaugaccagaaacagggacaa

SEQ ID NO: 55789 - RNA, 32 nt, Human
aggcagcauuggggagcaggaggcugaugguc

SEQ ID NO: 55790 - RNA, 32 nt, Human
aggcagccaaucauauccuuccugccucaccu

SEQ ID NO: 55791 - RNA, 32 nt, Human
aggcagccacagcagaacgcugaccccucacu

SEQ ID NO: 55792 - RNA, 32 nt, Human
aggcagccacccacaccuucccucucugaaug

SEQ ID NO: 55793 - RNA, 32 nt, Human
aggcagccacccugcucugccugccagcggcc

SEQ ID NO: 55794 - RNA, 32 nt, Human
aggcagccacuggccaagacucuguucugaau

SEQ ID NO: 55795 - RNA, 32 nt, Human
aggcagccagcugugcagccaggugugacugu

SEQ ID NO: 55796 - RNA, 32 nt, Human
aggcagccagugugacacugcuuuaacugcau

SEQ ID NO: 55797 - RNA, 32 nt, Human
aggcagcccaagagcucagggagccagggacc

SEQ ID NO: 55798 - RNA, 32 nt, Human
aggcagcccaccuguccugccucccaggagcc

SEQ ID NO: 55799 - RNA, 32 nt, Human
aggcagcccaggacucagaaauccagguccug

SEQ ID NO: 55800 - RNA, 32 nt, Human
aggcagccccuugccagcauccccacacccac

SEQ ID NO: 55801 - RNA, 32 nt, Human
aggcagcccuacuucuuugcuuugcccagcau

SEQ ID NO: 55802 - RNA, 32 nt, Human
aggcagcccugagaagacucugucugcccuac

SEQ ID NO: 55803 - RNA, 32 nt, Human
aggcagcccuggcaaaugaaucaaagacccau

SEQ ID NO: 55804 - RNA, 19 nt, Human
aggcagccgaggcgccggg

SEQ ID NO: 55805 - RNA, 24 nt, Human
aggcagccggaucaugaggucagg

SEQ ID NO: 55806 - RNA, 32 nt, Human
aggcagccgggaugacagcucuccccaggaau

SEQ ID NO: 55807 - RNA, 20 nt, Human
aggcagccuaggcccugggg

SEQ ID NO: 55808 - RNA, 32 nt, Human
aggcagccucucgcugcuguucaucagcagcc

SEQ ID NO: 55809 - RNA, 32 nt, Human
aggcagccugaguuuucuguccccugguaugc

SEQ ID NO: 55810 - RNA, 21 nt, Human
aggcagccugcaaggcgcuca

SEQ ID NO: 55811 - RNA, 32 nt, Human
aggcagccugcaggcuaggaaguggccuagug

SEQ ID NO: 55812 - RNA, 32 nt, Human
aggcagccugcaggcuggggacccugggugca

SEQ ID NO: 55813 - RNA, 32 nt, Human
aggcagccugcucuccucuuaugauggccuug

SEQ ID NO: 55814 - RNA, 32 nt, Human
aggcagccugcugccguaugcuucaguggcac

SEQ ID NO: 55815 - RNA, 32 nt, Human
aggcagccuucugcugaggacauaggcagaag

SEQ ID NO: 55816 - RNA, 19 nt, Human
aggcagcgaagccucgggg

SEQ ID NO: 55817 - RNA, 18 nt, Human
aggcagcgcagcggcggg

SEQ ID NO: 55818 - RNA, 32 nt, Human
aggcagcgcuggucgucaccugggcggccaga

SEQ ID NO: 55819 - RNA, 32 nt, Human
aggcagcuagcuaccuaccuugcccagugcug

SEQ ID NO: 55820 - RNA, 32 nt, Human
aggcagcucaagcugaauaaauagcugcagac

SEQ ID NO: 55821 - RNA, 32 nt, Human
aggcagcucacuggagagccuacauuccuuac

SEQ ID NO: 55822 - RNA, 32 nt, Human
aggcagcucagcccagccugggcacagccagu

SEQ ID NO: 55823 - RNA, 32 nt, Human
aggcagcucaugccagggacugggccgcuccu

SEQ ID NO: 55824 - RNA, 32 nt, Human
aggcagcuccagccugggggacaggugacccc

SEQ ID NO: 55825 - RNA, 32 nt, Human
aggcagcucccauccagcgguugaagccugau

SEQ ID NO: 55826 - RNA, 32 nt, Human
aggcagcucucuacaugccuguccugggcuag

SEQ ID NO: 55827 - RNA, 20 nt, Human
aggcagcugaaaguggaggg

SEQ ID NO: 55828 - RNA, 19 nt, Human
aggcagcugagaggcaggg

SEQ ID NO: 55829 - RNA, 18 nt, Human
aggcagcugcccucaggg

SEQ ID NO: 55830 - RNA, 32 nt, Human
aggcagcugccuggugcccagcuugcuucucg

SEQ ID NO: 55831 - RNA, 18 nt, Human
aggcagcugcuccaggaa

SEQ ID NO: 55832 - RNA, 32 nt, Human
aggcagcugcucccaggacacugaggccaaga

SEQ ID NO: 55833 - RNA, 21 nt, Human
aggcagcugcugggcugcggg

SEQ ID NO: 55834 - RNA, 32 nt, Human
aggcagcuggagugggagaaagguggcucgga

SEQ ID NO: 55835 - RNA, 32 nt, Human
aggcagcuggggagaggccccgccucuggugg

SEQ ID NO: 55836 - RNA, 32 nt, Human
aggcagcugguucucuucuggcccagggugug

SEQ ID NO: 55837 - RNA, 32 nt, Human
aggcagcuguguggcgguggggccacagggca

SEQ ID NO: 55838 - RNA, 32 nt, Human
aggcagcuuaaggccuggcucacaggcugugg

SEQ ID NO: 55839 - RNA, 32 nt, Human
aggcagcuuagcccauccagacugguccugaa

SEQ ID NO: 55840 - RNA, 21 nt, Human
aggcagcuucccacuaggggg

SEQ ID NO: 55841 - RNA, 32 nt, Human
aggcagcuuccugggcaggaggguuccauggg

SEQ ID NO: 55842 - RNA, 32 nt, Human
aggcagcuugacuugagaggacgacccuaggg

SEQ ID NO: 55843 - RNA, 32 nt, Human
aggcagcuuggcaagaccccaucucuacaaaa

SEQ ID NO: 55844 - RNA, 32 nt, Human
aggcagcuuggguggaggaagcaugcaggggc

SEQ ID NO: 55845 - RNA, 32 nt, Human
aggcagcuugugagccccucucccucuccgcc

SEQ ID NO: 55846 - RNA, 32 nt, Human
aggcagcuuugguagcuggugggacugacgcc

SEQ ID NO: 55847 - RNA, 21 nt, Human
aggcaggaaaaucgcuugaac

SEQ ID NO: 55848 - RNA, 32 nt, Human
aggcaggaacaguucugaagucaaaggcugau

SEQ ID NO: 55849 - RNA, 32 nt, Human
aggcaggaacugggaauaggcuuggagguggc

SEQ ID NO: 55850 - RNA, 32 nt, Human
aggcaggaagaaaggaaggaaggaaagaagga

SEQ ID NO: 55851 - RNA, 20 nt, Human
aggcaggaagacugcuugaa

SEQ ID NO: 55852 - RNA, 20 nt, Human
aggcaggaagauggcuugaa

SEQ ID NO: 55853 - RNA, 24 nt, Human
aggcaggaagauugcuucagccca

SEQ ID NO: 55854 - RNA, 24 nt, Human
aggcaggaagauugcuugaacuca

SEQ ID NO: 55855 - RNA, 32 nt, Human
aggcaggaagauugcuugagccuagcaguucg

SEQ ID NO: 55856 - RNA, 32 nt, Human
aggcaggaagcccaggaggagugcgggcaggg

SEQ ID NO: 55857 - RNA, 32 nt, Human
aggcaggaaggcgcuccucuccugccccgccg

SEQ ID NO: 55858 - RNA, 32 nt, Human
aggcaggaauaagaagucagacagagacagca

SEQ ID NO: 55859 - RNA, 20 nt, Human
aggcaggaccaggguuccau

SEQ ID NO: 55860 - RNA, 32 nt, Human
aggcaggacucugccaaaaguccccugccagg

SEQ ID NO: 55861 - RNA, 32 nt, Human
aggcaggacucugcuguccccugcugcuccug

SEQ ID NO: 55862 - RNA, 32 nt, Human
aggcaggagaaacaccugagcccaggaggugg

SEQ ID NO: 55863 - RNA, 21 nt, Human
aggcaggagaauagcaugaac

SEQ ID NO: 55864 - RNA, 21 nt, Human
aggcaggagaaucacuugaac

SEQ ID NO: 55865 - RNA, 21 nt, Human
aggcaggagaaucacuugaau

SEQ ID NO: 55866 - RNA, 32 nt, Human
aggcaggagaaucagagguugcagugaaccga

SEQ ID NO: 55867 - RNA, 21 nt, Human
aggcaggagaaucgccugaac

SEQ ID NO: 55868 - RNA, 20 nt, Human
aggcaggagaaucgcucgaa

SEQ ID NO: 55869 - RNA, 21 nt, Human
aggcaggagaaucgcuugaac

SEQ ID NO: 55870 - RNA, 32 nt, Human
aggcaggagaaucgcuugaaccugugggucag

SEQ ID NO: 55871 - RNA, 21 nt, Human
aggcaggagaauggcgugaac

SEQ ID NO: 55872 - RNA, 21 nt, Human
aggcaggagaauugccugaac

SEQ ID NO: 55873 - RNA, 21 nt, Human
aggcaggagaauugcucgaac

SEQ ID NO: 55874 - RNA, 21 nt, Human
aggcaggagaauugcuggaac

SEQ ID NO: 55875 - RNA, 21 nt, Human
aggcaggagaauugcuugaac

SEQ ID NO: 55876 - RNA, 23 nt, Human
aggcaggagaauugcuugaacca

SEQ ID NO: 55877 - RNA, 24 nt, Human
aggcaggagaauugcuugaaccca

SEQ ID NO: 55878 - RNA, 24 nt, Human
aggcaggagaauugcuugaacuca

SEQ ID NO: 55879 - RNA, 24 nt, Human
aggcaggagaauugcuugaaucca

SEQ ID NO: 55880 - RNA, 24 nt, Human
aggcaggagaauugcuugaauccc

SEQ ID NO: 55881 - RNA, 23 nt, Human
aggcaggagaauugcuugaccca

SEQ ID NO: 55882 - RNA, 24 nt, Human
aggcaggagaauugcuugagccca

SEQ ID NO: 55883 - RNA, 23 nt, Human
aggcaggagaauugcuugagucc

SEQ ID NO: 55884 - RNA, 32 nt, Human
aggcaggagagggaaaggcagcagcggcggca

SEQ ID NO: 55885 - RNA, 32 nt, Human
aggcaggagcagcagacaagagugcaguggug

SEQ ID NO: 55886 - RNA, 32 nt, Human
aggcaggagcaggauucgagagacaggacccc

SEQ ID NO: 55887 - RNA, 22 nt, Human
aggcaggagccccgcccuccca

SEQ ID NO: 55888 - RNA, 32 nt, Human
aggcaggagcccucucauggugaacagcaacu

SEQ ID NO: 55889 - RNA, 32 nt, Human
aggcaggaggacuaggaggaggaggaggagcc

SEQ ID NO: 55890 - RNA, 21 nt, Human
aggcaggaggaucacuugaac

SEQ ID NO: 55891 - RNA, 32 nt, Human
aggcaggaggaucgcuugagugugugaguuca

SEQ ID NO: 55892 - RNA, 24 nt, Human
aggcaggaggauugccugagccca

SEQ ID NO: 55893 - RNA, 23 nt, Human
aggcaggaggauugcuggagccu

SEQ ID NO: 55894 - RNA, 24 nt, Human
aggcaggaggauugcuugaauuca

SEQ ID NO: 55895 - RNA, 20 nt, Human
aggcaggaggauugcuugag

SEQ ID NO: 55896 - RNA, 23 nt, Human
aggcaggaggauugcuugagacc

SEQ ID NO: 55897 - RNA, 23 nt, Human
aggcaggaggauugcuugagccc

SEQ ID NO: 55898 - RNA, 24 nt, Human
aggcaggaggauugcuugagccca

SEQ ID NO: 55899 - RNA, 23 nt, Human
aggcaggaggauugcuugagccu

SEQ ID NO: 55900 - RNA, 24 nt, Human
aggcaggaggauugcuugagcuca

SEQ ID NO: 55901 - RNA, 23 nt, Human
aggcaggaggauugcuugagguc

SEQ ID NO: 55902 - RNA, 23 nt, Human
aggcaggaggauugcuugagucc

SEQ ID NO: 55903 - RNA, 23 nt, Human
aggcaggaggauugcuugagucu

SEQ ID NO: 55904 - RNA, 32 nt, Human
aggcaggaggcagagcgcggcccugcgucaga

SEQ ID NO: 55905 - RNA, 32 nt, Human
aggcaggaggcagugggcuucauggcuccuug

SEQ ID NO: 55906 - RNA, 32 nt, Human
aggcaggaggcuggggugcugugugggggcca

SEQ ID NO: 55907 - RNA, 32 nt, Human
aggcaggaggugggggaagagcugaaucucuu

SEQ ID NO: 55908 - RNA, 32 nt, Human
aggcaggaguagaagugaaaggaaaggucuga

SEQ ID NO: 55909 - RNA, 32 nt, Human
aggcaggaguggagaggcauggagaggcccca

SEQ ID NO: 55910 - RNA, 32 nt, Human
aggcaggaguuucucucggugacuacuaucgc

SEQ ID NO: 55911 - RNA, 21 nt, Human
aggcaggauaaucacuugaac

SEQ ID NO: 55912 - RNA, 32 nt, Human
aggcaggauauccccagggaaacccaucuuca

SEQ ID NO: 55913 - RNA, 24 nt, Human
aggcaggaugauugcuuaagccca

SEQ ID NO: 55914 - RNA, 32 nt, Human
aggcaggauguucaaaugauugcaguucacua

SEQ ID NO: 55915 - RNA, 31 nt, Human
aggcaggcaaugucacauuuuaaggacaugg

SEQ ID NO: 55916 - RNA, 24 nt, Human
aggcaggcacaguuuauggcguca

SEQ ID NO: 55917 - RNA, 32 nt, Human
aggcaggcacuauccaaucaccugagggccca

SEQ ID NO: 55918 - RNA, 24 nt, Human
aggcaggcagaccacgaggucagg

SEQ ID NO: 55919 - RNA, 32 nt, Human
aggcaggcagaggcugaggcugauuccacccc

SEQ ID NO: 55920 - RNA, 32 nt, Human
aggcaggcagaguggagagggagagacggagc

SEQ ID NO: 55921 - RNA, 24 nt, Human
aggcaggcagaucacaaggucagg

SEQ ID NO: 55922 - RNA, 25 nt, Human
aggcaggcagaucaccugaggucag

SEQ ID NO: 55923 - RNA, 26 nt, Human
aggcaggcagaucaccugaggucagg

SEQ ID NO: 55924 - RNA, 26 nt, Human
aggcaggcagaucaccugaggucggg

SEQ ID NO: 55925 - RNA, 32 nt, Human
aggcaggcagaucaccugagguugggaguuca

SEQ ID NO: 55926 - RNA, 26 nt, Human
aggcaggcagaucaccuggggucagg

SEQ ID NO: 55927 - RNA, 26 nt, Human
aggcaggcagaucaccuuaggucagg

SEQ ID NO: 55928 - RNA, 21 nt, Human
aggcaggcagaucacgagguc

SEQ ID NO: 55929 - RNA, 24 nt, Human
aggcaggcagaucacgaggucagg

SEQ ID NO: 55930 - RNA, 24 nt, Human
aggcaggcagaucacggggucagg

SEQ ID NO: 55931 - RNA, 26 nt, Human
aggcaggcagaucacgugaggucagg

SEQ ID NO: 55932 - RNA, 26 nt, Human
aggcaggcagaucacuugaggucagg

SEQ ID NO: 55933 - RNA, 26 nt, Human
aggcaggcagaucacuugaggucggg

SEQ ID NO: 55934 - RNA, 26 nt, Human
aggcaggcagaucagcugaggucagg

SEQ ID NO: 55935 - RNA, 26 nt, Human
aggcaggcagaucaucugaggucagg

SEQ ID NO: 55936 - RNA, 24 nt, Human
aggcaggcagaucaugaggucagg

SEQ ID NO: 55937 - RNA, 26 nt, Human
aggcaggcagaucauuugaggucagg

SEQ ID NO: 55938 - RNA, 26 nt, Human
aggcaggcagaucgccugaggucagg

SEQ ID NO: 55939 - RNA, 26 nt, Human
aggcaggcagaucgcuugaggucagg

SEQ ID NO: 55940 - RNA, 21 nt, Human
aggcaggcagcccaggcccug

SEQ ID NO: 55941 - RNA, 32 nt, Human
aggcaggcagcccuguaccccacccacauaga

SEQ ID NO: 55942 - RNA, 22 nt, Human
aggcaggcagcugcaggcgcuc

SEQ ID NO: 55943 - RNA, 32 nt, Human
aggcaggcaggcaggcaugugucagagcccuu

SEQ ID NO: 55944 - RNA, 32 nt, Human
aggcaggcaggcaggugguuggauggggaggc

SEQ ID NO: 55945 - RNA, 32 nt, Human
aggcaggcaggcaugugucagagcccuucaca

SEQ ID NO: 55946 - RNA, 32 nt, Human
aggcaggcagggcaguugggucccuugccagc

SEQ ID NO: 55947 - RNA, 23 nt, Human
aggcaggcagugcggggugccca

SEQ ID NO: 55948 - RNA, 32 nt, Human
aggcaggcagugcugguuccucugccuguguc

SEQ ID NO: 55949 - RNA, 32 nt, Human
aggcaggcauaucaacuugaggccaggaguua

SEQ ID NO: 55950 - RNA, 32 nt, Human
aggcaggccaagacuugaguuggcaacucagc

SEQ ID NO: 55951 - RNA, 24 nt, Human
aggcaggccgauugcuugagccca

SEQ ID NO: 55952 - RNA, 17 nt, Human
aggcaggccugaggcag

SEQ ID NO: 55953 - RNA, 32 nt, Human
aggcaggccuggggcugcccugcucacucuca

SEQ ID NO: 55954 - RNA, 24 nt, Human
aggcaggcgaaucacgaggucagg

SEQ ID NO: 55955 - RNA, 23 nt, Human
aggcaggcggaccacgaggucag

SEQ ID NO: 55956 - RNA, 21 nt, Human
aggcaggcggaucacaagguc

SEQ ID NO: 55957 - RNA, 24 nt, Human
aggcaggcggaucacaaggucagg

SEQ ID NO: 55958 - RNA, 24 nt, Human
aggcaggcggaucacagggucggg

SEQ ID NO: 55959 - RNA, 26 nt, Human
aggcaggcggaucaccugaggucagg

SEQ ID NO: 55960 - RNA, 26 nt, Human
aggcaggcggaucaccugaggucggg

SEQ ID NO: 55961 - RNA, 26 nt, Human
aggcaggcggaucaccugagguuagg

SEQ ID NO: 55962 - RNA, 26 nt, Human
aggcaggcggaucaccuuaggucagg

SEQ ID NO: 55963 - RNA, 21 nt, Human
aggcaggcggaucacgaaguc

SEQ ID NO: 55964 - RNA, 24 nt, Human
aggcaggcggaucacgaagucagg

SEQ ID NO: 55965 - RNA, 21 nt, Human
aggcaggcggaucacgagguc

SEQ ID NO: 55966 - RNA, 22 nt, Human
aggcaggcggaucacgagguca

SEQ ID NO: 55967 - RNA, 24 nt, Human
aggcaggcggaucacgaggucagg

SEQ ID NO: 55968 - RNA, 32 nt, Human
aggcaggcggaucacuugaggccaggaguucg

SEQ ID NO: 55969 - RNA, 26 nt, Human
aggcaggcggaucacuugaggucagg

SEQ ID NO: 55970 - RNA, 26 nt, Human
aggcaggcggaucacuugagguuagg

SEQ ID NO: 55971 - RNA, 26 nt, Human
aggcaggcggaucaucugaggucagg

SEQ ID NO: 55972 - RNA, 24 nt, Human
aggcaggcggaucaugagaucagg

SEQ ID NO: 55973 - RNA, 24 nt, Human
aggcaggcggaucaugaggucagg

SEQ ID NO: 55974 - RNA, 23 nt, Human
aggcaggcggaucaugaggucgg

SEQ ID NO: 55975 - RNA, 26 nt, Human
aggcaggcggaucuccugaggucagg

SEQ ID NO: 55976 - RNA, 26 nt, Human
aggcaggcggauuaccugaggucagg

SEQ ID NO: 55977 - RNA, 26 nt, Human
aggcaggcggauuaccuuaggucagg

SEQ ID NO: 55978 - RNA, 26 nt, Human
aggcaggcggauugccugaggucagg

SEQ ID NO: 55979 - RNA, 32 nt, Human
aggcaggcggcagcaggcucugacuuaaccac

SEQ ID NO: 55980 - RNA, 24 nt, Human
aggcaggcggcucacgaggucagg

SEQ ID NO: 55981 - RNA, 32 nt, Human
aggcaggcgggaggccaggggugcagaauugg

SEQ ID NO: 55982 - RNA, 26 nt, Human
aggcaggcgggucaccugaggucagg

SEQ ID NO: 55983 - RNA, 24 nt, Human
aggcaggcgggucaugaggucagg

SEQ ID NO: 55984 - RNA, 32 nt, Human
aggcaggcucacuggccauuuucccuagaguc

SEQ ID NO: 55985 - RNA, 32 nt, Human
aggcaggcugcaaaugacccagaagagggacc

SEQ ID NO: 55986 - RNA, 18 nt, Human
aggcaggcugccucaggg

SEQ ID NO: 55987 - RNA, 32 nt, Human
aggcaggcuucaaccagccacuccagcuuugu

SEQ ID NO: 55988 - RNA, 24 nt, Human
aggcaggcuugaugggagcgccca

SEQ ID NO: 55989 - RNA, 32 nt, Human
aggcagggaagaauugggccugugcugaucca

SEQ ID NO: 55990 - RNA, 25 nt, Human
aggcagggagaauugcuugaaccca

SEQ ID NO: 55991 - RNA, 32 nt, Human
aggcagggagaggauucuccagugagugcaca

SEQ ID NO: 55992 - RNA, 32 nt, Human
aggcagggagcuagggcagggaccaaaugaac

SEQ ID NO: 55993 - RNA, 32 nt, Human
aggcagggaggaaaagcggucuucggccuccg

SEQ ID NO: 55994 - RNA, 32 nt, Human
aggcagggaggaauccuccccacaaagaagaa

SEQ ID NO: 55995 - RNA, 32 nt, Human
aggcagggaggcagggaggcagggaggaacgg

SEQ ID NO: 55996 - RNA, 32 nt, Human
aggcagggagggggugguguccccagccgguu

SEQ ID NO: 55997 - RNA, 32 nt, Human
aggcagggagugaaucagcagagcagagggag

SEQ ID NO: 55998 - RNA, 19 nt, Human
aggcagggcaagccggggu

SEQ ID NO: 55999 - RNA, 22 nt, Human
aggcagggcagagccucagggg

SEQ ID NO: 56000 - RNA, 18 nt, Human
aggcagggcagaggggga

SEQ ID NO: 56001 - RNA, 32 nt, Human
aggcagggcagccaggggcugcagugaaauga

SEQ ID NO: 56002 - RNA, 32 nt, Human
aggcagggcagccaggggcugcagugaaaugg

SEQ ID NO: 56003 - RNA, 32 nt, Human
aggcagggccaucaggcaccagaaggauuuug

SEQ ID NO: 56004 - RNA, 24 nt, Human
aggcagggccgaggggccugcggg

SEQ ID NO: 56005 - RNA, 32 nt, Human
aggcagggccgcugcccgcccugggccggcac

SEQ ID NO: 56006 - RNA, 32 nt, Human
aggcagggcggcaggccagggaaggagaggcc

SEQ ID NO: 56007 - RNA, 32 nt, Human
aggcagggcucaaaugaggaacugguccauag

SEQ ID NO: 56008 - RNA, 32 nt, Human
aggcagggcucucuuuccuucuugccuucaga

SEQ ID NO: 56009 - RNA, 32 nt, Human
aggcagggcuggagggggaaaauaaaucauua

SEQ ID NO: 56010 - RNA, 23 nt, Human
aggcaggggaacacaaggucagg

SEQ ID NO: 56011 - RNA, 32 nt, Human
aggcaggggagguggcugguuuaaggggaacu

SEQ ID NO: 56012 - RNA, 21 nt, Human
aggcaggggaucuuccuccca

SEQ ID NO: 56013 - RNA, 32 nt, Human
aggcaggggaugaccgggacaggccugggcug

SEQ ID NO: 56014 - RNA, 32 nt, Human
aggcaggggcggggcucggagcggggccuugg

SEQ ID NO: 56015 - RNA, 32 nt, Human
aggcagggggcaagaggaaggagaagcagcuc

SEQ ID NO: 56016 - RNA, 32 nt, Human
aggcaggggugggagagccagcucucucuacc

SEQ ID NO: 56017 - RNA, 32 nt, Human
aggcagggguggggguggaggcuuccugcguc

SEQ ID NO: 56018 - RNA, 19 nt, Human
aggcagggguugcagugag

SEQ ID NO: 56019 - RNA, 32 nt, Human
aggcagggucagcagaggcuccagcgagggca

SEQ ID NO: 56020 - RNA, 32 nt, Human
aggcagggucucacucugguugcccaggcugg

SEQ ID NO: 56021 - RNA, 32 nt, Human
aggcagggugcagacagcacagucagcucugc

SEQ ID NO: 56022 - RNA, 19 nt, Human
aggcaggguggccucaggg

SEQ ID NO: 56023 - RNA, 20 nt, Human
aggcaggguuucaccauguu

SEQ ID NO: 56024 - RNA, 21 nt, Human
aggcaggguuucaccauguug

SEQ ID NO: 56025 - RNA, 21 nt, Human
aggcaggguuucuccauguug

SEQ ID NO: 56026 - RNA, 21 nt, Human
aggcagguagaucacaagguc

SEQ ID NO: 56027 - RNA, 24 nt, Human
aggcagguagaucacaaggucagg

SEQ ID NO: 56028 - RNA, 24 nt, Human
aggcagguagaucacgaggucagg

SEQ ID NO: 56029 - RNA, 24 nt, Human
aggcagguagaucaugaggucagg

SEQ ID NO: 56030 - RNA, 32 nt, Human
aggcagguaguggcacaugggcacuugacaag

SEQ ID NO: 56031 - RNA, 24 nt, Human
aggcaggucgaucacgaggucagg

SEQ ID NO: 56032 - RNA, 32 nt, Human
aggcaggucgggaggaagaagagguggaggug

SEQ ID NO: 56033 - RNA, 32 nt, Human
aggcaggucucaaaguccugaccucaggugau

SEQ ID NO: 56034 - RNA, 32 nt, Human
aggcaggucuccaacuccugaccucaagugau

SEQ ID NO: 56035 - RNA, 16 nt, Human
aggcaggucugagcca

SEQ ID NO: 56036 - RNA, 32 nt, Human
aggcaggucuugaacuccuggccucaagugau

SEQ ID NO: 56037 - RNA, 32 nt, Human
aggcaggugagaaaggcagggccacuccucag

SEQ ID NO: 56038 - RNA, 32 nt, Human
aggcaggugagaggaggaaggaagcggcggcg

SEQ ID NO: 56039 - RNA, 18 nt, Human
aggcaggugaggauguca

SEQ ID NO: 56040 - RNA, 32 nt, Human
aggcaggugaucugcugcagagcaguaaggga

SEQ ID NO: 56041 - RNA, 32 nt, Human
aggcaggugcggagauaaaggagaagcagauu

SEQ ID NO: 56042 - RNA, 32 nt, Human
aggcaggugcugccucacaauggucucuuuag

SEQ ID NO: 56043 - RNA, 32 nt, Human
aggcagguggaggcugcgcacagcuucucccg

SEQ ID NO: 56044 - RNA, 26 nt, Human
aggcagguggaucaacugaggucagg

SEQ ID NO: 56045 - RNA, 24 nt, Human
aggcagguggaucacaagaucagg

SEQ ID NO: 56046 - RNA, 24 nt, Human
aggcagguggaucacaaggucagg

SEQ ID NO: 56047 - RNA, 24 nt, Human
aggcagguggaucacaagguuggg

SEQ ID NO: 56048 - RNA, 26 nt, Human
aggcagguggaucaccuaaggucagg

SEQ ID NO: 56049 - RNA, 26 nt, Human
aggcagguggaucaccucaggucagg

SEQ ID NO: 56050 - RNA, 24 nt, Human
aggcagguggaucaccugagguca

SEQ ID NO: 56051 - RNA, 25 nt, Human
aggcagguggaucaccugaggucag

SEQ ID NO: 56052 - RNA, 26 nt, Human
aggcagguggaucaccugaggucagg

SEQ ID NO: 56053 - RNA, 26 nt, Human
aggcagguggaucaccugaggucggg

SEQ ID NO: 56054 - RNA, 26 nt, Human
aggcagguggaucaccugagguuagg

SEQ ID NO: 56055 - RNA, 26 nt, Human
aggcagguggaucaccuuaggucagg

SEQ ID NO: 56056 - RNA, 24 nt, Human
aggcagguggaucacgaggccagg

SEQ ID NO: 56057 - RNA, 21 nt, Human
aggcagguggaucacgagguc

SEQ ID NO: 56058 - RNA, 22 nt, Human
aggcagguggaucacgagguca

SEQ ID NO: 56059 - RNA, 23 nt, Human
aggcagguggaucacgaggucag

SEQ ID NO: 56060 - RNA, 24 nt, Human
aggcagguggaucacgaggucagg

SEQ ID NO: 56061 - RNA, 24 nt, Human
aggcagguggaucacgaugucagg

SEQ ID NO: 56062 - RNA, 26 nt, Human
aggcagguggaucacgugaggucagg

SEQ ID NO: 56063 - RNA, 27 nt, Human
aggcagguggaucacucugaggucagg

SEQ ID NO: 56064 - RNA, 25 nt, Human
aggcagguggaucacugaggucagg

SEQ ID NO: 56065 - RNA, 32 nt, Human
aggcagguggaucacugaggucagggguucaa

SEQ ID NO: 56066 - RNA, 26 nt, Human
aggcagguggaucacuggaggucagg

SEQ ID NO: 56067 - RNA, 26 nt, Human
aggcagguggaucacuugaggucagg

SEQ ID NO: 56068 - RNA, 26 nt, Human
aggcagguggaucacuugagguuagg

SEQ ID NO: 56069 - RNA, 21 nt, Human
aggcagguggaucauagguca

SEQ ID NO: 56070 - RNA, 23 nt, Human
aggcagguggaucaugagaucag

SEQ ID NO: 56071 - RNA, 24 nt, Human
aggcagguggaucaugagaucagg

SEQ ID NO: 56072 - RNA, 22 nt, Human
aggcagguggaucaugagguca

SEQ ID NO: 56073 - RNA, 24 nt, Human
aggcagguggaucaugaggucagg

SEQ ID NO: 56074 - RNA, 26 nt, Human
aggcagguggaucauuugaggucagg

SEQ ID NO: 56075 - RNA, 26 nt, Human
aggcagguggaucgccugaggucagg

SEQ ID NO: 56076 - RNA, 24 nt, Human
aggcagguggaucgugaggucagg

SEQ ID NO: 56077 - RNA, 25 nt, Human
aggcagguggauugccugaggucag

SEQ ID NO: 56078 - RNA, 26 nt, Human
aggcagguggauugccugaggucagg

SEQ ID NO: 56079 - RNA, 24 nt, Human
aggcagguggauugcuugaaccca

SEQ ID NO: 56080 - RNA, 24 nt, Human
aggcagguggauugcuugagccca

SEQ ID NO: 56081 - RNA, 26 nt, Human
aggcagguggauugucugaggucagg

SEQ ID NO: 56082 - RNA, 18 nt, Human
aggcaggugggccucagg

SEQ ID NO: 56083 - RNA, 32 nt, Human
aggcagguugugcagcuuaggggaggacccca

SEQ ID NO: 56084 - RNA, 32 nt, Human
aggcaguacaaggagguugccaacugcagccg

SEQ ID NO: 56085 - RNA, 32 nt, Human
aggcaguagaaaggaggaaggagggagaggga

SEQ ID NO: 56086 - RNA, 32 nt, Human
aggcaguagagggaggcgagagcccggcagcc

SEQ ID NO: 56087 - RNA, 32 nt, Human
aggcaguagccuccuccugggcuccagagggc

SEQ ID NO: 56088 - RNA, 18 nt, Human
aggcaguagccuuagggg

SEQ ID NO: 56089 - RNA, 32 nt, Human
aggcaguauggcaggcaccagcaaagaguuga

SEQ ID NO: 56090 - RNA, 31 nt, Human
aggcagucaauaaauacaugagaaauucagc

SEQ ID NO: 56091 - RNA, 32 nt, Human
aggcagucagcaccagccucagcaacugugca

SEQ ID NO: 56092 - RNA, 32 nt, Human
aggcagucagccacaggaaguguccagacagg

SEQ ID NO: 56093 - RNA, 32 nt, Human
aggcagucaggugaagaugcaggcuaggaagg

SEQ ID NO: 56094 - RNA, 32 nt, Human
aggcagucagugggccgcagccccagaccccc

SEQ ID NO: 56095 - RNA, 32 nt, Human
aggcagucaucuuuauccuguagcccaauugg

SEQ ID NO: 56096 - RNA, 32 nt, Human
aggcagucauucacgaugguuuugugccagcu

SEQ ID NO: 56097 - RNA, 32 nt, Human
aggcaguccaacagcaccagcacggcuaugac

SEQ ID NO: 56098 - RNA, 32 nt, Human
aggcaguccaagagaguucagugaggaccagc

SEQ ID NO: 56099 - RNA, 32 nt, Human
aggcagucccugaaugaccaggccaguguugu

SEQ ID NO: 56100 - RNA, 32 nt, Human
aggcagucucgaacuccugaccucaggugauc

SEQ ID NO: 56101 - RNA, 32 nt, Human
aggcagucugcaaaugaggagucagcuggaag

SEQ ID NO: 56102 - RNA, 32 nt, Human
aggcagucugcucucucucaggaucaccacgc

SEQ ID NO: 56103 - RNA, 32 nt, Human
aggcagucuggcaccucagucuggauucuaac

SEQ ID NO: 56104 - RNA, 32 nt, Human
aggcagugaccucccaaaccagccugccuggu

SEQ ID NO: 56105 - RNA, 32 nt, Human
aggcagugaccuucaaggauguggcugugguc

SEQ ID NO: 56106 - RNA, 32 nt, Human
aggcagugacuuucaguacagcuacagucacc

SEQ ID NO: 56107 - RNA, 32 nt, Human
aggcagugagccuucucuccaccaccauagac

SEQ ID NO: 56108 - RNA, 32 nt, Human
aggcagugagggagguggacggugccagcuga

SEQ ID NO: 56109 - RNA, 23 nt, Human
aggcagugagggcgaggcgcuca

SEQ ID NO: 56110 - RNA, 32 nt, Human
aggcagugcacugggcaugucacaaaggacug

SEQ ID NO: 56111 - RNA, 21 nt, Human
aggcagugcgacgaggucagg

SEQ ID NO: 56112 - RNA, 32 nt, Human
aggcagugcucaauaaaugcuucgaggcugau

SEQ ID NO: 56113 - RNA, 32 nt, Human
aggcagugcucaccucuucuuuaccagaacgg

SEQ ID NO: 56114 - RNA, 32 nt, Human
aggcagugcugguuccucugccugugucccca

SEQ ID NO: 56115 - RNA, 19 nt, Human
aggcaguggaugugacuca

SEQ ID NO: 56116 - RNA, 21 nt, Human
aggcaguggccauggcugccu

SEQ ID NO: 56117 - RNA, 32 nt, Human
aggcagugggagaagaggugguggucguuucu

SEQ ID NO: 56118 - RNA, 32 nt, Human
aggcaguggggcccgacacagacagcgccgcc

SEQ ID NO: 56119 - RNA, 31 nt, Human
aggcaguggguggagagagaauggggagacg

SEQ ID NO: 56120 - RNA, 32 nt, Human
aggcaguggugggaugggagggcaggaggcgg

SEQ ID NO: 56121 - RNA, 32 nt, Human
aggcaguguggacccaaagagugagcagcagc

SEQ ID NO: 56122 - RNA, 32 nt, Human
aggcaguguggguggagagaguggaggccucg

SEQ ID NO: 56123 - RNA, 32 nt, Human
aggcaguuaccugaaacugccuucauucacuc

SEQ ID NO: 56124 - RNA, 32 nt, Human
aggcaguucucauggaauaaaagcuaccugaa

SEQ ID NO: 56125 - RNA, 32 nt, Human
aggcaguugaaggaggcagagaagggguuggu

SEQ ID NO: 56126 - RNA, 32 nt, Human
aggcaguugcaagcgcggaggcugcgagaaau

SEQ ID NO: 56127 - RNA, 32 nt, Human
aggcaguugcggguugcaggaguucaggaaag

SEQ ID NO: 56128 - RNA, 32 nt, Human
aggcaguugugguuuuccugcccagccugcca

SEQ ID NO: 56129 - RNA, 32 nt, Human
aggcaguuuugguggguggugcugaagucugg

SEQ ID NO: 56130 - RNA, 32 nt, Human
aggcauaagcuaccacgcugggccucaauuaa

SEQ ID NO: 56131 - RNA, 32 nt, Human
aggcauaagcuaccaugcugggccugaacaua

SEQ ID NO: 56132 - RNA, 32 nt, Human
aggcauaccgcaugaugcuguacaguacaaau

SEQ ID NO: 56133 - RNA, 20 nt, Human
aggcauagacguccacggac

SEQ ID NO: 56134 - RNA, 21 nt, Human
aggcauagagagauuaaguga

SEQ ID NO: 56135 - RNA, 32 nt, Human
aggcauagagcagauaagaaaaugaauguauc

SEQ ID NO: 56136 - RNA, 19 nt, Human
aggcauagauuauuuccau

SEQ ID NO: 56137 - RNA, 32 nt, Human
aggcauagcacgaacuccuuccucacugcuau

SEQ ID NO: 56138 - RNA, 30 nt, Human
aggcauagcuugcagugagccgagauugcg

SEQ ID NO: 56139 - RNA, 32 nt, Human
aggcauaucucugccaucacauaguauuaugu

SEQ ID NO: 56140 - RNA, 32 nt, Human
aggcauauuuaguauuuuucccccaggccaga

SEQ ID NO: 56141 - RNA, 32 nt, Human
aggcaucacagaagcacaggaggccaguucug

SEQ ID NO: 56142 - RNA, 32 nt, Human
aggcaucacauugugaggaagggagcuuucug

SEQ ID NO: 56143 - RNA, 32 nt, Human
aggcaucaccuuccuucucuacccaacaaccc

SEQ ID NO: 56144 - RNA, 32 nt, Human
aggcaucagaagcacugugaagugauggagac

SEQ ID NO: 56145 - RNA, 22 nt, Human
aggcaucagagaccaguuuuaa

SEQ ID NO: 56146 - RNA, 32 nt, Human
aggcaucagcuuucagagaaugcagcugcguc

SEQ ID NO: 56147 - RNA, 32 nt, Human
aggcaucaggagugaccuccagaagcuccggg

SEQ ID NO: 56148 - RNA, 32 nt, Human
aggcaucaucccuaccucugcaggcucaggug

SEQ ID NO: 56149 - RNA, 24 nt, Human
aggcaucauuggcuccaauuuuag

SEQ ID NO: 56150 - RNA, 32 nt, Human
aggcauccccgagcagcaccaugcuuggugag

SEQ ID NO: 56151 - RNA, 32 nt, Human
aggcaucccucaccucugcauugaacuuacgu

SEQ ID NO: 56152 - RNA, 17 nt, Human
aggcauccgcucaguuc

SEQ ID NO: 56153 - RNA, 32 nt, Human
aggcauccuaccagcagcaccaucaaggcaug

SEQ ID NO: 56154 - RNA, 32 nt, Human
aggcauccuggaccuuggcguugccgcuccgc

SEQ ID NO: 56155 - RNA, 32 nt, Human
aggcaucggagcuuccagccuggggagaccuu

SEQ ID NO: 56156 - RNA, 32 nt, Human
aggcaucggaggugggcgggguugcagugacu

SEQ ID NO: 56157 - RNA, 32 nt, Human
aggcaucucaaucaugauuacaugaagcagau

SEQ ID NO: 56158 - RNA, 32 nt, Human
aggcaucuccuuucccuuccugucuuccucuc

SEQ ID NO: 56159 - RNA, 32 nt, Human
aggcaucucggcuugcaggaggccaacugcug

SEQ ID NO: 56160 - RNA, 32 nt, Human
aggcaucucuaaaagaaaggcagcagccccag

SEQ ID NO: 56161 - RNA, 32 nt, Human
aggcaucucuauaaggaugugauguuggaaaa

SEQ ID NO: 56162 - RNA, 32 nt, Human
aggcaucucuuuggcugaacaucgagaggccc

SEQ ID NO: 56163 - RNA, 32 nt, Human
aggcaucugaggauaaaucacugugaaacagc

SEQ ID NO: 56164 - RNA, 32 nt, Human
aggcaucugcaaucucagcuacucaggaggcu

SEQ ID NO: 56165 - RNA, 32 nt, Human
aggcaucugcuccccgucucccccuccaaaaa

SEQ ID NO: 56166 - RNA, 32 nt, Human
aggcaucugcugcugcuccuggcugccacuca

SEQ ID NO: 56167 - RNA, 32 nt, Human
aggcaucuggaacuuucucugccugcaggggc

SEQ ID NO: 56168 - RNA, 32 nt, Human
aggcaucugggagggcccugcccccaugggcu

SEQ ID NO: 56169 - RNA, 32 nt, Human
aggcaucuguagucccagcuacuugggaagcu

SEQ ID NO: 56170 - RNA, 31 nt, Human
aggcaucuuaauagacuucuguugaaaacuu

SEQ ID NO: 56171 - RNA, 32 nt, Human
aggcaucuucaaguaccagagaugucuccaag

SEQ ID NO: 56172 - RNA, 32 nt, Human
aggcaucuuuccaaguacucaucuaauuuaau

SEQ ID NO: 56173 - RNA, 22 nt, Human
aggcaugaaccaccgugcccgg

SEQ ID NO: 56174 - RNA, 22 nt, Human
aggcaugaaccaccgugccugg

SEQ ID NO: 56175 - RNA, 32 nt, Human
aggcaugacaggcccugcucagaggucagagg

SEQ ID NO: 56176 - RNA, 32 nt, Human
aggcaugaccucugggcucucuagguggcccu

SEQ ID NO: 56177 - RNA, 32 nt, Human
aggcaugacucugcagagaugacucagcacug

SEQ ID NO: 56178 - RNA, 32 nt, Human
aggcaugacuugcagcugucuccuggauugug

SEQ ID NO: 56179 - RNA, 21 nt, Human
aggcaugagaauugcuugaac

SEQ ID NO: 56180 - RNA, 32 nt, Human
aggcaugagcauguguguaucacuuugaagaa

SEQ ID NO: 56181 - RNA, 22 nt, Human
aggcaugagccacagugcccgg

SEQ ID NO: 56182 - RNA, 32 nt, Human
aggcaugagccaccacacccagccuucagcug

SEQ ID NO: 56183 - RNA, 32 nt, Human
aggcaugagccaccacacccagccuuuauugc

SEQ ID NO: 56184 - RNA, 23 nt, Human
aggcaugagccaccacauccggu

SEQ ID NO: 56185 - RNA, 22 nt, Human
aggcaugagccaccacaucugg

SEQ ID NO: 56186 - RNA, 23 nt, Human
aggcaugagccaccacgccuggu

SEQ ID NO: 56187 - RNA, 27 nt, Human
aggcaugagccaccacgccuguccggu

SEQ ID NO: 56188 - RNA, 22 nt, Human
aggcaugagccaccacuccugg

SEQ ID NO: 56189 - RNA, 21 nt, Human
aggcaugagccaccaggccgg

SEQ ID NO: 56190 - RNA, 32 nt, Human
aggcaugagccaccaugcccagccuccuucuc

SEQ ID NO: 56191 - RNA, 22 nt, Human
aggcaugagccaccaugcccgg

SEQ ID NO: 56192 - RNA, 22 nt, Human
aggcaugagccaccaugccugg

SEQ ID NO: 56193 - RNA, 32 nt, Human
aggcaugagccaccgcacccagccucucuugu

SEQ ID NO: 56194 - RNA, 32 nt, Human
aggcaugagccaccgcacccagccugcauucc

SEQ ID NO: 56195 - RNA, 32 nt, Human
aggcaugagccaccgcacccagccugguuauu

SEQ ID NO: 56196 - RNA, 22 nt, Human
aggcaugagccaccgcacccgg

SEQ ID NO: 56197 - RNA, 21 nt, Human
aggcaugagccaccgcaccgg

SEQ ID NO: 56198 - RNA, 23 nt, Human
aggcaugagccaccgcaccuggu

SEQ ID NO: 56199 - RNA, 22 nt, Human
aggcaugagccaccgcgcccgg

SEQ ID NO: 56200 - RNA, 32 nt, Human
aggcaugagccaccgcucccagccuuugauuu

SEQ ID NO: 56201 - RNA, 22 nt, Human
aggcaugagccaccgcucucgg

SEQ ID NO: 56202 - RNA, 19 nt, Human
aggcaugagccaccgugcc

SEQ ID NO: 56203 - RNA, 22 nt, Human
aggcaugagccaccgugcccgg

SEQ ID NO: 56204 - RNA, 22 nt, Human
aggcaugagccaccgugccugg

SEQ ID NO: 56205 - RNA, 22 nt, Human
aggcaugagccaccgugccugu

SEQ ID NO: 56206 - RNA, 22 nt, Human
aggcaugagccaccguggccgg

SEQ ID NO: 56207 - RNA, 20 nt, Human
aggcaugagccaccgugucc

SEQ ID NO: 56208 - RNA, 32 nt, Human
aggcaugagccaccucacccagcuccggucac

SEQ ID NO: 56209 - RNA, 32 nt, Human
aggcaugagccaccugcccagccauguuuggg

SEQ ID NO: 56210 - RNA, 32 nt, Human
aggcaugagccacggcacccagccucauuugc

SEQ ID NO: 56211 - RNA, 32 nt, Human
aggcaugagccacugcacccaaccccuggaaa

SEQ ID NO: 56212 - RNA, 32 nt, Human
aggcaugagccacugcacccagcccuguauuc

SEQ ID NO: 56213 - RNA, 32 nt, Human
aggcaugagccacugcacccagccucuuaaca

SEQ ID NO: 56214 - RNA, 32 nt, Human
aggcaugagccacugcacccagccuuggcggg

SEQ ID NO: 56215 - RNA, 32 nt, Human
aggcaugagccacugcacccggccuuucucau

SEQ ID NO: 56216 - RNA, 32 nt, Human
aggcaugagccacugcacccggcuugaaucau

SEQ ID NO: 56217 - RNA, 32 nt, Human
aggcaugagccacugcaccugaccugcugaau

SEQ ID NO: 56218 - RNA, 32 nt, Human
aggcaugagccacugcaccuggccuguguauu

SEQ ID NO: 56219 - RNA, 22 nt, Human
aggcaugagccacugcauccgg

SEQ ID NO: 56220 - RNA, 32 nt, Human
aggcaugagccacugcauccggccuguuaagg

SEQ ID NO: 56221 - RNA, 21 nt, Human
aggcaugagccacugcgccgg

SEQ ID NO: 56222 - RNA, 22 nt, Human
aggcaugagccacuguacccgg

SEQ ID NO: 56223 - RNA, 22 nt, Human
aggcaugagccacugugccagg

SEQ ID NO: 56224 - RNA, 22 nt, Human
aggcaugagccacugugcccgg

SEQ ID NO: 56225 - RNA, 23 nt, Human
aggcaugagccacuguguccggu

SEQ ID NO: 56226 - RNA, 32 nt, Human
aggcaugagccauugcacccagccuuaagcua

SEQ ID NO: 56227 - RNA, 32 nt, Human
aggcaugagcuacugugcccagccucuaugau

SEQ ID NO: 56228 - RNA, 32 nt, Human
aggcaugagucuccacacucugccuuuucauu

SEQ ID NO: 56229 - RNA, 29 nt, Human
aggcaugauuucaccuucacuugaacugc

SEQ ID NO: 56230 - RNA, 32 nt, Human
aggcaugcaagccaaaagggaggacagucugc

SEQ ID NO: 56231 - RNA, 32 nt, Human
aggcaugcagacaaccccacacggccacacca

SEQ ID NO: 56232 - RNA, 32 nt, Human
aggcaugcagagccauauaagccaguccgaua

SEQ ID NO: 56233 - RNA, 32 nt, Human
aggcaugcagguaaauuacugccuugucagcc

SEQ ID NO: 56234 - RNA, 32 nt, Human
aggcaugccugggaaaugcucccuuggcauaa

SEQ ID NO: 56235 - RNA, 32 nt, Human
aggcaugccuggguccugccucugccuggcag

SEQ ID NO: 56236 - RNA, 32 nt, Human
aggcaugccuguacugcccucucccaagaaug

SEQ ID NO: 56237 - RNA, 32 nt, Human
aggcaugcgaaugagcugggcccugggugagg

SEQ ID NO: 56238 - RNA, 32 nt, Human
aggcaugcugggucucuuccacagacuuuaag

SEQ ID NO: 56239 - RNA, 32 nt, Human
aggcauggaagagagccaggcagccccgaaag

SEQ ID NO: 56240 - RNA, 32 nt, Human
aggcauggagugaagacacuagcagagucagg

SEQ ID NO: 56241 - RNA, 32 nt, Human
aggcauggcaguacacaucugugguuccaguu

SEQ ID NO: 56242 - RNA, 29 nt, Human
aggcauggccagaugggccugcucugggc

SEQ ID NO: 56243 - RNA, 32 nt, Human
aggcauggcggcugcauuucauaccacaucaa

SEQ ID NO: 56244 - RNA, 32 nt, Human
aggcaugggaaugucaccuccuuugccacugu

SEQ ID NO: 56245 - RNA, 32 nt, Human
aggcaugggcagggacuuggcugcaguucugc

SEQ ID NO: 56246 - RNA, 32 nt, Human
aggcaugggggaaggggcgucuuugggagaag

SEQ ID NO: 56247 - RNA, 32 nt, Human
aggcaugggggaggcacagaaugcuggagaga

SEQ ID NO: 56248 - RNA, 32 nt, Human
aggcaugguggugugggccugcagucccagcu

SEQ ID NO: 56249 - RNA, 32 nt, Human
aggcauguacccaaacauaacggauguaaggc

SEQ ID NO: 56250 - RNA, 32 nt, Human
aggcauguauuccucagaggcgaaacugccaa

SEQ ID NO: 56251 - RNA, 29 nt, Human
aggcaugucauccgaaaagucaggacucc

SEQ ID NO: 56252 - RNA, 32 nt, Human
aggcauguccuaggcucugggugcaguaguga

SEQ ID NO: 56253 - RNA, 32 nt, Human
aggcaugucuucacuagaaagaaugagaagcc

SEQ ID NO: 56254 - RNA, 32 nt, Human
aggcaugucuuuccagaacuuucccuggcagg

SEQ ID NO: 56255 - RNA, 32 nt, Human
aggcaugugcaggguccuaggaagcauacgaa

SEQ ID NO: 56256 - RNA, 32 nt, Human
aggcaugugcaggguccuaggaagcauaugaa

SEQ ID NO: 56257 - RNA, 32 nt, Human
aggcaugugcugcaacacugaagacagaaaga

SEQ ID NO: 56258 - RNA, 32 nt, Human
aggcaugugcugguauccacaguuaauucccu

SEQ ID NO: 56259 - RNA, 32 nt, Human
aggcauguucaaagacacuacacugccucucc

SEQ ID NO: 56260 - RNA, 22 nt, Human
aggcauuaaccacacacuuuaa

SEQ ID NO: 56261 - RNA, 31 nt, Human
aggcauuacagcuagacuccgagcuuacugg

SEQ ID NO: 56262 - RNA, 32 nt, Human
aggcauuagagucucauaaggagcacgcaacc

SEQ ID NO: 56263 - RNA, 32 nt, Human
aggcauuagaugcucauaaggagugcacaacc

SEQ ID NO: 56264 - RNA, 32 nt, Human
aggcauuagauucucauaaggagugcacaauc

SEQ ID NO: 56265 - RNA, 32 nt, Human
aggcauuagauucucauaaggagugugcaauc

SEQ ID NO: 56266 - RNA, 32 nt, Human
aggcauuagauucucauaaggaguucacagcc

SEQ ID NO: 56267 - RNA, 32 nt, Human
aggcauuauucuuuuagggaaggugagagcuu

SEQ ID NO: 56268 - RNA, 32 nt, Human
aggcauucaagaccagccuaggcaggauaaua

SEQ ID NO: 56269 - RNA, 31 nt, Human
aggcauucaauaaauguugaaauaaugacac

SEQ ID NO: 56270 - RNA, 32 nt, Human
aggcauucaguuacagagcaguugguacuuug

SEQ ID NO: 56271 - RNA, 32 nt, Human
aggcauuccagccugggcaacagagugaggcu

SEQ ID NO: 56272 - RNA, 32 nt, Human
aggcauucccagcuguggcuuacuggaugcca

SEQ ID NO: 56273 - RNA, 32 nt, Human
aggcauucgaaagucugcucugccuuuacaau

SEQ ID NO: 56274 - RNA, 23 nt, Human
aggcauucgggaauaccaaguga

SEQ ID NO: 56275 - RNA, 32 nt, Human
aggcauucugcagcugggaucagccucagcuu

SEQ ID NO: 56276 - RNA, 32 nt, Human
aggcauucuugcugugcguugugaaaggguag

SEQ ID NO: 56277 - RNA, 32 nt, Human
aggcauugaggugagggaucauuuugggucag

SEQ ID NO: 56278 - RNA, 32 nt, Human
aggcauugcccagccugggaaucuuuucuuug

SEQ ID NO: 56279 - RNA, 32 nt, Human
aggcauugggagaagcagucugggggaggcca

SEQ ID NO: 56280 - RNA, 32 nt, Human
aggcauuggucaccaagagucuugcaggggga

SEQ ID NO: 56281 - RNA, 32 nt, Human
aggcauuguaccugacauugcuacguuucuac

SEQ ID NO: 56282 - RNA, 32 nt, Human
aggcauuuaaucaccaccacgaucaagaugua

SEQ ID NO: 56283 - RNA, 32 nt, Human
aggcauuuacucugaccuuaauuaagugaucc

SEQ ID NO: 56284 - RNA, 32 nt, Human
aggcauuucuucccuuccuuccuuccuucauc

SEQ ID NO: 56285 - RNA, 21 nt, Human
aggcauuucuuuucagcagug

SEQ ID NO: 56286 - RNA, 32 nt, Human
aggcauuugaauccagccugagcaauauaaca

SEQ ID NO: 56287 - RNA, 32 nt, Human
aggcauuugagaccagccuggccaacauagug

SEQ ID NO: 56288 - RNA, 32 nt, Human
aggcauuugagaccagccuggguaacauagug

SEQ ID NO: 56289 - RNA, 32 nt, Human
aggcauuugaguuugccucuucugcuuuaauc

SEQ ID NO: 56290 - RNA, 32 nt, Human
aggcauuugcaggguccucuucugggccugac

SEQ ID NO: 56291 - RNA, 32 nt, Human
aggcauuugccuggcagcuuuuguuguagauc

SEQ ID NO: 56292 - RNA, 32 nt, Human
aggcauuuucauagaggaaaguuuacagaaac

SEQ ID NO: 56293 - RNA, 32 nt, Human
aggcauuuugugaauaaguuaugucauuaauu

SEQ ID NO: 56294 - RNA, 32 nt, Human
aggcauuuuugucacugaagcugcuguuccca

SEQ ID NO: 56295 - RNA, 32 nt, Human
aggccaaaacuguccucaggucagccucucca

SEQ ID NO: 56296 - RNA, 32 nt, Human
aggccaaaauuguccucaggucagccucucca

SEQ ID NO: 56297 - RNA, 32 nt, Human
aggccaaacaaaacacaucugugggcuggaug

SEQ ID NO: 56298 - RNA, 18 nt, Human
aggccaaaccuuugggcu

SEQ ID NO: 56299 - RNA, 22 nt, Human
aggccaaagcaggacgaucacu

SEQ ID NO: 56300 - RNA, 24 nt, Human
aggccaaaucacagagggaagcaa

SEQ ID NO: 56301 - RNA, 32 nt, Human
aggccaaaugugucaccuucagccugcucuuc

SEQ ID NO: 56302 - RNA, 32 nt, Human
aggccaacagcauuggccuggccagaccaggu

SEQ ID NO: 56303 - RNA, 32 nt, Human
aggccaacagccgccucagaaaccagauucag

SEQ ID NO: 56304 - RNA, 32 nt, Human
aggccaacaggaagagcagcaaaaagauucag

SEQ ID NO: 56305 - RNA, 32 nt, Human
aggccaacauggugaaaccccgucucuacuaa

SEQ ID NO: 56306 - RNA, 32 nt, Human
aggccaaccccagccaccgccagccugagacc

SEQ ID NO: 56307 - RNA, 21 nt, Human
aggccaaccgccacccagaga

SEQ ID NO: 56308 - RNA, 32 nt, Human
aggccaacugcccagagccacagaaaauggag

SEQ ID NO: 56309 - RNA, 32 nt, Human
aggccaacugccucuaggguugcuuggugccu

SEQ ID NO: 56310 - RNA, 32 nt, Human
aggccaacuugcugcuggcacgcccagaacuu

SEQ ID NO: 56311 - RNA, 32 nt, Human
aggccaacuuggcaaaaccccaucucuacuaa

SEQ ID NO: 56312 - RNA, 32 nt, Human
aggccaagaaggucagagcccagugagaucug

SEQ ID NO: 56313 - RNA, 32 nt, Human
aggccaagagccuucucuaaggaagggagagg

SEQ ID NO: 56314 - RNA, 32 nt, Human
aggccaagagugagagaaacgggggagcaaga

SEQ ID NO: 56315 - RNA, 32 nt, Human
aggccaagcaagaaaagucaauguauggagug

SEQ ID NO: 56316 - RNA, 25 nt, Human
aggccaagcaagccaagcccaagga

SEQ ID NO: 56317 - RNA, 22 nt, Human
aggccaagcagagcucagaaga

SEQ ID NO: 56318 - RNA, 20 nt, Human
aggccaagcagaugaucgcc

SEQ ID NO: 56319 - RNA, 32 nt, Human
aggccaagccacgaccuccaccuauucaaucu

SEQ ID NO: 56320 - RNA, 24 nt, Human
aggccaagccggccugggcugcuu

SEQ ID NO: 56321 - RNA, 19 nt, Human
aggccaagcucuuccuccc

SEQ ID NO: 56322 - RNA, 20 nt, Human
aggccaagcucuugguuacc

SEQ ID NO: 56323 - RNA, 32 nt, Human
aggccaagcugaugauguuaccaagcucaaac

SEQ ID NO: 56324 - RNA, 23 nt, Human
aggccaagcugccaucccagggg

SEQ ID NO: 56325 - RNA, 32 nt, Human
aggccaaggaaggaggaaugcuugagcccaag

SEQ ID NO: 56326 - RNA, 18 nt, Human
aggccaaggacaaacgcc

SEQ ID NO: 56327 - RNA, 32 nt, Human
aggccaaggacuuacacaucaaaaguggagaa

SEQ ID NO: 56328 - RNA, 32 nt, Human
aggccaaggagacagacaucugacaaagcauu

SEQ ID NO: 56329 - RNA, 32 nt, Human
aggccaaggaggucuccgaggcuuccaaagag

SEQ ID NO: 56330 - RNA, 32 nt, Human
aggccaaggcagcauugcuugaauuugaagaa

SEQ ID NO: 56331 - RNA, 26 nt, Human
aggccaaggcaggaggaccgcuugag

SEQ ID NO: 56332 - RNA, 32 nt, Human
aggccaaggcaggcacaucaccugaguucagg

SEQ ID NO: 56333 - RNA, 21 nt, Human
aggccaaggcagguggaucac

SEQ ID NO: 56334 - RNA, 32 nt, Human
aggccaaggccagaggauugcuugagucuagc

SEQ ID NO: 56335 - RNA, 21 nt, Human
aggccaaggccugagggccuc

SEQ ID NO: 56336 - RNA, 24 nt, Human
aggccaaggcgggaggaucacuug

SEQ ID NO: 56337 - RNA, 20 nt, Human
aggccaaggcggguggauca

SEQ ID NO: 56338 - RNA, 24 nt, Human
aggccaaggcggguggcucacuug

SEQ ID NO: 56339 - RNA, 25 nt, Human
aggccaaggcuauuguugcugggga

SEQ ID NO: 56340 - RNA, 23 nt, Human
aggccaaggggcggaagagccuc

SEQ ID NO: 56341 - RNA, 32 nt, Human
aggccaaggugcaaggcgggcagaucauuuga

SEQ ID NO: 56342 - RNA, 23 nt, Human
aggccaaggugggaggaucgcuu

SEQ ID NO: 56343 - RNA, 23 nt, Human
aggccaaggugggaggauugcuu

SEQ ID NO: 56344 - RNA, 22 nt, Human
aggccaaggugggucgaucacu

SEQ ID NO: 56345 - RNA, 32 nt, Human
aggccaaguagaaugagaugagacugaguuug

SEQ ID NO: 56346 - RNA, 32 nt, Human
aggccaaguagagagcaucaggguaaauggcg

SEQ ID NO: 56347 - RNA, 32 nt, Human
aggccaaguagcucgggagaacagggcaacau

SEQ ID NO: 56348 - RNA, 22 nt, Human
aggccaaguccacaggcuggug

SEQ ID NO: 56349 - RNA, 23 nt, Human
aggccaagugggaacccaggaga

SEQ ID NO: 56350 - RNA, 18 nt, Human
aggccaagugggaggcug

SEQ ID NO: 56351 - RNA, 22 nt, Human
aggccaagugugcguccagggg

SEQ ID NO: 56352 - RNA, 19 nt, Human
aggccaaguucggggccag

SEQ ID NO: 56353 - RNA, 23 nt, Human
aggccaaguuggcugcuccgagg

SEQ ID NO: 56354 - RNA, 22 nt, Human
aggccaaguuuccagaagccuc

SEQ ID NO: 56355 - RNA, 32 nt, Human
aggccaauggagaagacagggagauggugcug

SEQ ID NO: 56356 - RNA, 23 nt, Human
aggccaauuucauacccauguca

SEQ ID NO: 56357 - RNA, 32 nt, Human
aggccacaaaggagagcuccguggagagaaga

SEQ ID NO: 56358 - RNA, 32 nt, Human
aggccacaacccugguguccacugccucaggc

SEQ ID NO: 56359 - RNA, 32 nt, Human
aggccacacagcaaaagucaccaacucaaacc

SEQ ID NO: 56360 - RNA, 32 nt, Human
aggccacacagccugggaggcgcaggggcugg

SEQ ID NO: 56361 - RNA, 32 nt, Human
aggccacacccacuccaggacacccacacggg

SEQ ID NO: 56362 - RNA, 32 nt, Human
aggccacaccggccuugcauugccugccuggc

SEQ ID NO: 56363 - RNA, 32 nt, Human
aggccacacucaagggcugacuguccaggcgc

SEQ ID NO: 56364 - RNA, 31 nt, Human
aggccacacuuucagcaaacuucacauuaaa

SEQ ID NO: 56365 - RNA, 32 nt, Human
aggccacagauucgaggcaacaauaagauuua

SEQ ID NO: 56366 - RNA, 20 nt, Human
aggccacagccagggcucca

SEQ ID NO: 56367 - RNA, 32 nt, Human
aggccacagccccuggcacugcagguggccuc

SEQ ID NO: 56368 - RNA, 32 nt, Human
aggccacagcuauuuuccuggcugugggaauc

SEQ ID NO: 56369 - RNA, 32 nt, Human
aggccacaggagcuggagggauugcaaagacc

SEQ ID NO: 56370 - RNA, 32 nt, Human
aggccacaggggcagaggcuucuccggcaggc

SEQ ID NO: 56371 - RNA, 32 nt, Human
aggccacaggggcggggacaccugccaggaug

SEQ ID NO: 56372 - RNA, 32 nt, Human
aggccacaugggcugaugcagcuuugagugcu

SEQ ID NO: 56373 - RNA, 32 nt, Human
aggccaccacaccuggcuaauguuuaaauuuu

SEQ ID NO: 56374 - RNA, 20 nt, Human
aggccaccaggcccuuggca

SEQ ID NO: 56375 - RNA, 28 nt, Human
aggccaccauugucugccucaucaggaa

SEQ ID NO: 56376 - RNA, 32 nt, Human
aggccaccauuuucuuuucuuuucuuuuucuc

SEQ ID NO: 56377 - RNA, 32 nt, Human
aggccacccacacuaaccaggucagucacugg

SEQ ID NO: 56378 - RNA, 32 nt, Human
aggccacccacagagccaacgauugcugcacg

SEQ ID NO: 56379 - RNA, 32 nt, Human
aggccacccagccgugggaggaagggggcgug

SEQ ID NO: 56380 - RNA, 32 nt, Human
aggccacccaucccuuuucauucuccagcaga

SEQ ID NO: 56381 - RNA, 22 nt, Human
aggccacccugcccaggaccca

SEQ ID NO: 56382 - RNA, 32 nt, Human
aggccacccugccucuacccaaccagggcccc

SEQ ID NO: 56383 - RNA, 32 nt, Human
aggccaccucuagcuuucuuccuaccccauuc

SEQ ID NO: 56384 - RNA, 32 nt, Human
aggccaccuggaccagcugcucagcugucuga

SEQ ID NO: 56385 - RNA, 32 nt, Human
aggccaccuggacuuccagucuggcuccaaac

SEQ ID NO: 56386 - RNA, 18 nt, Human
aggccaccugugcuucac

SEQ ID NO: 56387 - RNA, 32 nt, Human
aggccaccuuguguguuuucucacucucgaau

SEQ ID NO: 56388 - RNA, 32 nt, Human
aggccaccuuugcagcccauagggaagaaggc

SEQ ID NO: 56389 - RNA, 32 nt, Human
aggccacgacccuccugaucacucugaggaca

SEQ ID NO: 56390 - RNA, 20 nt, Human
aggccacgcaggccugaagc

SEQ ID NO: 56391 - RNA, 32 nt, Human
aggccacggugccagagguucagggagaacag

SEQ ID NO: 56392 - RNA, 32 nt, Human
aggccacgugagguuggaggccagcagggguu

SEQ ID NO: 56393 - RNA, 32 nt, Human
aggccacucccaggaggcugcggagcaaauga

SEQ ID NO: 56394 - RNA, 32 nt, Human
aggccacucccagggacccagggaggcgaugg

SEQ ID NO: 56395 - RNA, 32 nt, Human
aggccacugcaccugggcuagggguccacagg

SEQ ID NO: 56396 - RNA, 32 nt, Human
aggccacugcacuccagccugaacaacaaaga

SEQ ID NO: 56397 - RNA, 32 nt, Human
aggccacugcacuccagccugagugacagaau

SEQ ID NO: 56398 - RNA, 32 nt, Human
aggccacugcacuccagccugggcaacagagc

SEQ ID NO: 56399 - RNA, 32 nt, Human
aggccacugcacuccagccuggguaacagacg

SEQ ID NO: 56400 - RNA, 32 nt, Human
aggccacugcagcucuaccgauacuugcugcg

SEQ ID NO: 56401 - RNA, 32 nt, Human
aggccacugcauuuagccugggcgacagagcg

SEQ ID NO: 56402 - RNA, 32 nt, Human
aggccacugcccacccuggccuggacagccuc

SEQ ID NO: 56403 - RNA, 32 nt, Human
aggccacuggccaguggggaccagccucugag

SEQ ID NO: 56404 - RNA, 32 nt, Human
aggccacugguggcugagcaacgaggucgacg

SEQ ID NO: 56405 - RNA, 32 nt, Human
aggccacugguuagcucaucucagccuccucu

SEQ ID NO: 56406 - RNA, 32 nt, Human
aggccacugugagcucagcacagaguaggaag

SEQ ID NO: 56407 - RNA, 32 nt, Human
aggccacugugccaggugccucccuggccugu

SEQ ID NO: 56408 - RNA, 32 nt, Human
aggccacugugcccggccugaaucuugucuuu

SEQ ID NO: 56409 - RNA, 32 nt, Human
aggccacuucugcuguuacauaacuccucccu

SEQ ID NO: 56410 - RNA, 32 nt, Human
aggccacuuggucauucuggcauuuuauggua

SEQ ID NO: 56411 - RNA, 32 nt, Human
aggccagaacccgacccugcugugucucucuu

SEQ ID NO: 56412 - RNA, 32 nt, Human
aggccagaagcaaaccaaauuuaccagguuug

SEQ ID NO: 56413 - RNA, 23 nt, Human
aggccagaagggagguucaccug

SEQ ID NO: 56414 - RNA, 21 nt, Human
aggccagaccagggcuggggg

SEQ ID NO: 56415 - RNA, 19 nt, Human
aggccagacccaggagcca

SEQ ID NO: 56416 - RNA, 18 nt, Human
aggccagacgccugagcu

SEQ ID NO: 56417 - RNA, 32 nt, Human
aggccagacgcugauuuuauuuucucauuucc

SEQ ID NO: 56418 - RNA, 32 nt, Human
aggccagagaaaaugcacaaacuguaggaaac

SEQ ID NO: 56419 - RNA, 32 nt, Human
aggccagagaaaggcaaagcccaaugcaagaa

SEQ ID NO: 56420 - RNA, 32 nt, Human
aggccagagagggaaaaggcaggugcuuuugg

SEQ ID NO: 56421 - RNA, 32 nt, Human
aggccagagccuggcccuccugucaucugcug

SEQ ID NO: 56422 - RNA, 32 nt, Human
aggccagagcucugacaggcggugccccgccc

SEQ ID NO: 56423 - RNA, 32 nt, Human
aggccagagcugggacuggugccucuuggaau

SEQ ID NO: 56424 - RNA, 32 nt, Human
aggccagaggacuuggggaaaaugagauggag

SEQ ID NO: 56425 - RNA, 32 nt, Human
aggccagaggcagaggggugcagaagagagag

SEQ ID NO: 56426 - RNA, 32 nt, Human
aggccagaggcucguauuguguuucugcugac

SEQ ID NO: 56427 - RNA, 32 nt, Human
aggccagauggugaaaccccaucucuacaaaa

SEQ ID NO: 56428 - RNA, 32 nt, Human
aggccagauucccuuucucucccuccacauag

SEQ ID NO: 56429 - RNA, 32 nt, Human
aggccagcaacaugugccccagaucuggaagg

SEQ ID NO: 56430 - RNA, 32 nt, Human
aggccagcaaggaagagaguuugaguuguuua

SEQ ID NO: 56431 - RNA, 32 nt, Human
aggccagcaaguggcgcugggccacacuggcu

SEQ ID NO: 56432 - RNA, 32 nt, Human
aggccagcacagaggcaccagggcagcagugc

SEQ ID NO: 56433 - RNA, 26 nt, Human
aggccagcagacaggccggccagagg

SEQ ID NO: 56434 - RNA, 31 nt, Human
aggccagcauuuuucugaaaaguuggggaaa

SEQ ID NO: 56435 - RNA, 32 nt, Human
aggccagccagcaccucugccuucucagggac

SEQ ID NO: 56436 - RNA, 32 nt, Human
aggccagccagccuaucccucucuccccuaac

SEQ ID NO: 56437 - RNA, 32 nt, Human
aggccagccagccugccugccugccugccugc

SEQ ID NO: 56438 - RNA, 32 nt, Human
aggccagcccaggggucaggggcagaggugca

SEQ ID NO: 56439 - RNA, 32 nt, Human
aggccagcccagugacaugacguuauuaguuu

SEQ ID NO: 56440 - RNA, 32 nt, Human
aggccagcccucccuggcugugagcagccucc

SEQ ID NO: 56441 - RNA, 32 nt, Human
aggccagccucuguaaguuggccacacuuggg

SEQ ID NO: 56442 - RNA, 32 nt, Human
aggccagccugaccaacauggagaaaccccau

SEQ ID NO: 56443 - RNA, 22 nt, Human
aggccagccugaccaacauggu

SEQ ID NO: 56444 - RNA, 32 nt, Human
aggccagccugaccaacauggugaaacccugu

SEQ ID NO: 56445 - RNA, 32 nt, Human
aggccagccugaccaacguggagaaaugccau

SEQ ID NO: 56446 - RNA, 32 nt, Human
aggccagccuggcgaaaccccaucucuacuaa

SEQ ID NO: 56447 - RNA, 22 nt, Human
aggccagccugggcaacacagc

SEQ ID NO: 56448 - RNA, 20 nt, Human
aggccagccugggcaacaua

SEQ ID NO: 56449 - RNA, 32 nt, Human
aggccagcgccagaacccagauuuccuaacuc

SEQ ID NO: 56450 - RNA, 32 nt, Human
aggccagcuaguucugucaugaguagucggcc

SEQ ID NO: 56451 - RNA, 32 nt, Human
aggccagcuauuuuccuuuuccugugcuuucu

SEQ ID NO: 56452 - RNA, 32 nt, Human
aggccagcuccucugcccacaugucauacaag

SEQ ID NO: 56453 - RNA, 32 nt, Human
aggccagcugcucacccugccaccuccaugug

SEQ ID NO: 56454 - RNA, 32 nt, Human
aggccagcugggucucaaggaggcagguggca

SEQ ID NO: 56455 - RNA, 32 nt, Human
aggccaggaagaccagccuggccaacauggcg

SEQ ID NO: 56456 - RNA, 32 nt, Human
aggccaggaagcggaagucgccagcagcgaga

SEQ ID NO: 56457 - RNA, 32 nt, Human
aggccaggaaggaggggaaaagagugagagaa

SEQ ID NO: 56458 - RNA, 32 nt, Human
aggccaggaagggagagggagaaaaggaggag

SEQ ID NO: 56459 - RNA, 18 nt, Human
aggccaggaaugagcacc

SEQ ID NO: 56460 - RNA, 32 nt, Human
aggccaggacagaucacuugaggucaggaguu

SEQ ID NO: 56461 - RNA, 32 nt, Human
aggccaggacaguggugcaugccagucauccc

SEQ ID NO: 56462 - RNA, 19 nt, Human
aggccaggagaucgacacc

SEQ ID NO: 56463 - RNA, 20 nt, Human
aggccaggagccccgccacc

SEQ ID NO: 56464 - RNA, 23 nt, Human
aggccaggaggcagcuggcacag

SEQ ID NO: 56465 - RNA, 32 nt, Human
aggccaggaggcggagcuugcagugagccgag

SEQ ID NO: 56466 - RNA, 22 nt, Human
aggccaggaggcuucccagagg

SEQ ID NO: 56467 - RNA, 25 nt, Human
aggccaggagggacccugcccaguc

SEQ ID NO: 56468 - RNA, 32 nt, Human
aggccaggagguugaggcugcagugagcugug

SEQ ID NO: 56469 - RNA, 32 nt, Human
aggccaggagugaggcccugccggagccugag

SEQ ID NO: 56470 - RNA, 32 nt, Human
aggccaggaguuagagacugcagugagcuaug

SEQ ID NO: 56471 - RNA, 32 nt, Human
aggccaggaguucugagaccagccuggcuuac

SEQ ID NO: 56472 - RNA, 32 nt, Human
aggccaggaguugcagaccagccuggguaaca

SEQ ID NO: 56473 - RNA, 32 nt, Human
aggccaggaguuucagaucagcccaagcaaua

SEQ ID NO: 56474 - RNA, 23 nt, Human
aggccaggaguuugagaccagcu

SEQ ID NO: 56475 - RNA, 32 nt, Human
aggccaggaguuugaggcugcagugagcuaug

SEQ ID NO: 56476 - RNA, 32 nt, Human
aggccaggaguuugaggcugcagugaguuaug

SEQ ID NO: 56477 - RNA, 32 nt, Human
aggccaggaguuuugagaccagccugggaaac

SEQ ID NO: 56478 - RNA, 32 nt, Human
aggccaggauaaccugccuccacucacucgcc

SEQ ID NO: 56479 - RNA, 32 nt, Human
aggccaggaugcaggcauccacaugcccuccu

SEQ ID NO: 56480 - RNA, 22 nt, Human
aggccaggaugcuugccauggc

SEQ ID NO: 56481 - RNA, 32 nt, Human
aggccaggauucuaaauagacggcccaggcuc

SEQ ID NO: 56482 - RNA, 32 nt, Human
aggccaggcagagagaggagccugcucugcgg

SEQ ID NO: 56483 - RNA, 32 nt, Human
aggccaggcaggcagggaucccgcagcgaggg

SEQ ID NO: 56484 - RNA, 32 nt, Human
aggccaggcaggcgccgccugcggagagcacc

SEQ ID NO: 56485 - RNA, 24 nt, Human
aggccaggcauggccaccacguga

SEQ ID NO: 56486 - RNA, 25 nt, Human
aggccaggcauggcccagccuggag

SEQ ID NO: 56487 - RNA, 32 nt, Human
aggccaggcauggugagucacaccuauagucu

SEQ ID NO: 56488 - RNA, 19 nt, Human
aggccaggccaccagcacc

SEQ ID NO: 56489 - RNA, 32 nt, Human
aggccaggccaggccagguggggaaagggaca

SEQ ID NO: 56490 - RNA, 19 nt, Human
aggccaggcccagcacgcc

SEQ ID NO: 56491 - RNA, 21 nt, Human
aggccaggcccaggccagaga

SEQ ID NO: 56492 - RNA, 19 nt, Human
aggccaggcccccacggcc

SEQ ID NO: 56493 - RNA, 19 nt, Human
aggccaggcccccagacgc

SEQ ID NO: 56494 - RNA, 18 nt, Human
aggccaggccccucugcc

SEQ ID NO: 56495 - RNA, 20 nt, Human
aggccaggcccgauccuacc

SEQ ID NO: 56496 - RNA, 20 nt, Human
aggccaggcccgcgcccgcc

SEQ ID NO: 56497 - RNA, 18 nt, Human
aggccaggcccucugcac

SEQ ID NO: 56498 - RNA, 20 nt, Human
aggccaggcccugccccacc

SEQ ID NO: 56499 - RNA, 20 nt, Human
aggccaggcccugugcuggg

SEQ ID NO: 56500 - RNA, 18 nt, Human
aggccaggccgggcaacc

SEQ ID NO: 56501 - RNA, 20 nt, Human
aggccaggccuagaaucucc

SEQ ID NO: 56502 - RNA, 32 nt, Human
aggccaggccuccucaaguuggccucucagac

SEQ ID NO: 56503 - RNA, 32 nt, Human
aggccaggccucuccuggaaccaccucucugc

SEQ ID NO: 56504 - RNA, 19 nt, Human
aggccaggccuggaguccc

SEQ ID NO: 56505 - RNA, 21 nt, Human
aggccaggccuggcacggugg

SEQ ID NO: 56506 - RNA, 18 nt, Human
aggccaggcgacaucauc

SEQ ID NO: 56507 - RNA, 16 nt, Human
aggccaggcgcagugg

SEQ ID NO: 56508 - RNA, 21 nt, Human
aggccaggcgggagaacuacc

SEQ ID NO: 56509 - RNA, 20 nt, Human
aggccaggcgggcggaucac

SEQ ID NO: 56510 - RNA, 23 nt, Human
aggccaggcucagcccugugcca

SEQ ID NO: 56511 - RNA, 19 nt, Human
aggccaggcucaugccacc

SEQ ID NO: 56512 - RNA, 18 nt, Human
aggccaggcuccagcacu

SEQ ID NO: 56513 - RNA, 21 nt, Human
aggccaggcuccauccggagg

SEQ ID NO: 56514 - RNA, 20 nt, Human
aggccaggcuccgggacgcc

SEQ ID NO: 56515 - RNA, 20 nt, Human
aggccaggcuccuauaugcu

SEQ ID NO: 56516 - RNA, 20 nt, Human
aggccaggcuccuccccacu

SEQ ID NO: 56517 - RNA, 19 nt, Human
aggccaggcuccucuagcc

SEQ ID NO: 56518 - RNA, 18 nt, Human
aggccaggcuccuucacc

SEQ ID NO: 56519 - RNA, 19 nt, Human
aggccaggcucuccucacc

SEQ ID NO: 56520 - RNA, 19 nt, Human
aggccaggcugaccccacc

SEQ ID NO: 56521 - RNA, 18 nt, Human
aggccaggcugagccgcc

SEQ ID NO: 56522 - RNA, 18 nt, Human
aggccaggcugaugcacc

SEQ ID NO: 56523 - RNA, 23 nt, Human
aggccaggcugaugcaccaggga

SEQ ID NO: 56524 - RNA, 22 nt, Human
aggccaggcugccacuccggga

SEQ ID NO: 56525 - RNA, 19 nt, Human
aggccaggcugugguuucc

SEQ ID NO: 56526 - RNA, 21 nt, Human
aggccaggcuuccccgaggcc

SEQ ID NO: 56527 - RNA, 28 nt, Human
aggccaggcuucggugcuaccucagagg

SEQ ID NO: 56528 - RNA, 32 nt, Human
aggccaggcuuggaguuuggccagucuuguuu

SEQ ID NO: 56529 - RNA, 22 nt, Human
aggccagggaaagcccguguca

SEQ ID NO: 56530 - RNA, 32 nt, Human
aggccagggaagcagaggaggccagggaggca

SEQ ID NO: 56531 - RNA, 32 nt, Human
aggccagggaggcaggggaggcaggagaggcu

SEQ ID NO: 56532 - RNA, 32 nt, Human
aggccagggaggcaguggaggcaggagaggcu

SEQ ID NO: 56533 - RNA, 22 nt, Human
aggccagggagguccccgggga

SEQ ID NO: 56534 - RNA, 19 nt, Human
aggccagggauggugggga

SEQ ID NO: 56535 - RNA, 32 nt, Human
aggccagggcucaggggaaacugaggcaggaa

SEQ ID NO: 56536 - RNA, 32 nt, Human
aggccagggcugggcugugcaccugccuccca

SEQ ID NO: 56537 - RNA, 32 nt, Human
aggccaggggagagaccaggaggaaagggcag

SEQ ID NO: 56538 - RNA, 32 nt, Human
aggccaggguaaaaugucucaggcaagcaaaa

SEQ ID NO: 56539 - RNA, 32 nt, Human
aggccagguaacucuaguuacacagaaacugu

SEQ ID NO: 56540 - RNA, 24 nt, Human
aggccagguaggacauuccagagg

SEQ ID NO: 56541 - RNA, 32 nt, Human
aggccagguaggcaacacagagccaaggcggg

SEQ ID NO: 56542 - RNA, 19 nt, Human
aggccaggugagguccacc

SEQ ID NO: 56543 - RNA, 32 nt, Human
aggccaggugcaaggcagggaggcagagagaa

SEQ ID NO: 56544 - RNA, 20 nt, Human
aggccaggugcagugacuca

SEQ ID NO: 56545 - RNA, 30 nt, Human
aggccagguggccacagggacgaugcagau

SEQ ID NO: 56546 - RNA, 32 nt, Human
aggccagguggucuucaaggggaccagcuaac

SEQ ID NO: 56547 - RNA, 22 nt, Human
aggccagguguuggccuggggg

SEQ ID NO: 56548 - RNA, 24 nt, Human
aggccagguguuggugcauggaga

SEQ ID NO: 56549 - RNA, 23 nt, Human
aggccagguugggcaccugggga

SEQ ID NO: 56550 - RNA, 32 nt, Human
aggccaguaguuuugacacuucccaguggaag

SEQ ID NO: 56551 - RNA, 32 nt, Human
aggccaguccugcccuccugacuuucgguggc

SEQ ID NO: 56552 - RNA, 23 nt, Human
aggccagucucaaacuccugacc

SEQ ID NO: 56553 - RNA, 32 nt, Human
aggccagucucaaacuccugaccucaggugau

SEQ ID NO: 56554 - RNA, 32 nt, Human
aggccagucucaaacuccugaccucgugaucc

SEQ ID NO: 56555 - RNA, 32 nt, Human
aggccagucucaaacuccuggccucaugugau

SEQ ID NO: 56556 - RNA, 32 nt, Human
aggccagucuugaacuccugagcucaagcaau

SEQ ID NO: 56557 - RNA, 32 nt, Human
aggccagugcccagguuagugagcagugcccg

SEQ ID NO: 56558 - RNA, 32 nt, Human
aggccagugccccagcccagggugcuccggag

SEQ ID NO: 56559 - RNA, 18 nt, Human
aggccagugcugcacucu

SEQ ID NO: 56560 - RNA, 32 nt, Human
aggccagugggaggagggaggggccaggcagc

SEQ ID NO: 56561 - RNA, 32 nt, Human
aggccaguggugaguuagagguaugcuaucac

SEQ ID NO: 56562 - RNA, 32 nt, Human
aggccaguguccggccgaccagccugccuugg

SEQ ID NO: 56563 - RNA, 32 nt, Human
aggccaguugucaagugucaauaaaagcgcau

SEQ ID NO: 56564 - RNA, 32 nt, Human
aggccaguugugagccagggagaauguuccag

SEQ ID NO: 56565 - RNA, 32 nt, Human
aggccaguuuguuccacugaagcuuuucccac

SEQ ID NO: 56566 - RNA, 32 nt, Human
aggccauacugcuccagccggggcuccggggc

SEQ ID NO: 56567 - RNA, 24 nt, Human
aggccauacugcuggagcccauuc

SEQ ID NO: 56568 - RNA, 32 nt, Human
aggccauauauagggcuacaucuuguuaauug

SEQ ID NO: 56569 - RNA, 32 nt, Human
aggccauaugacuguaaggaauuuguaaaauu

SEQ ID NO: 56570 - RNA, 32 nt, Human
aggccaucaccaaccaacggacuuaccuuaca

SEQ ID NO: 56571 - RNA, 22 nt, Human
aggccaucagacaaccagaagc

SEQ ID NO: 56572 - RNA, 32 nt, Human
aggccaucagagauggccaggagaagggccag

SEQ ID NO: 56573 - RNA, 22 nt, Human
aggccaucagcugccaugcaca

SEQ ID NO: 56574 - RNA, 32 nt, Human
aggccaucaugcugggcuuugacagccacgag

SEQ ID NO: 56575 - RNA, 32 nt, Human
aggccauccagcgcuuuuucaguggcuauggc

SEQ ID NO: 56576 - RNA, 32 nt, Human
aggccaucccuaaugucacaguccccaacacc

SEQ ID NO: 56577 - RNA, 32 nt, Human
aggccauccuagaccagccagcuccagcugau

SEQ ID NO: 56578 - RNA, 32 nt, Human
aggccauccuuaugcuuugcaaagcacccuca

SEQ ID NO: 56579 - RNA, 32 nt, Human
aggccauccuugcugagcaucuuugagccugc

SEQ ID NO: 56580 - RNA, 32 nt, Human
aggccaucugaagagcguccugggugauggug

SEQ ID NO: 56581 - RNA, 32 nt, Human
aggccaucugcugucauugucauugucauagu

SEQ ID NO: 56582 - RNA, 22 nt, Human
aggccaucuggccgccuagcga

SEQ ID NO: 56583 - RNA, 32 nt, Human
aggccaugaauagaccuuucucaaaagaauac

SEQ ID NO: 56584 - RNA, 31 nt, Human
aggccaugacuucugccuggguccuagggcu

SEQ ID NO: 56585 - RNA, 32 nt, Human
aggccaugagccugcuacugggacccaggaag

SEQ ID NO: 56586 - RNA, 32 nt, Human
aggccaugaggguggaucacuugaggucagaa

SEQ ID NO: 56587 - RNA, 32 nt, Human
aggccauggaaaugacucuaaagauacaaaau

SEQ ID NO: 56588 - RNA, 19 nt, Human
aggccauggaagcccaugg

SEQ ID NO: 56589 - RNA, 30 nt, Human
aggccauggacaccuucagcaccaagagcc

SEQ ID NO: 56590 - RNA, 32 nt, Human
aggccauggagcagugucuggcuagguggaug

SEQ ID NO: 56591 - RNA, 22 nt, Human
aggccauggccccucaugaagu

SEQ ID NO: 56592 - RNA, 32 nt, Human
aggccauggccugcucucagcaguuugaucga

SEQ ID NO: 56593 - RNA, 20 nt, Human
aggccauggggcagccucca

SEQ ID NO: 56594 - RNA, 32 nt, Human
aggccauguccagcgggggaggcugugaguca

SEQ ID NO: 56595 - RNA, 32 nt, Human
aggccaugugagccaccgcugccagcacagag

SEQ ID NO: 56596 - RNA, 32 nt, Human
aggccauguuccauuaucucuuaaaauuggaa

SEQ ID NO: 56597 - RNA, 32 nt, Human
aggccauucagugcccuccacauggccuugcc

SEQ ID NO: 56598 - RNA, 32 nt, Human
aggccauucccccaggccugugucuucaccca

SEQ ID NO: 56599 - RNA, 32 nt, Human
aggccauucucuuccccugugugccucagugu

SEQ ID NO: 56600 - RNA, 32 nt, Human
aggccauugcacuccagccucagcaacaagag

SEQ ID NO: 56601 - RNA, 32 nt, Human
aggccauugcacuccagccugggcaauagggc

SEQ ID NO: 56602 - RNA, 32 nt, Human
aggccauuucuaaaagugcuacagaggacaga

SEQ ID NO: 56603 - RNA, 32 nt, Human
aggccauuugucucccugucuuccuuguccuc

SEQ ID NO: 56604 - RNA, 32 nt, Human
aggcccaaaagccacagaugagcauuggguug

SEQ ID NO: 56605 - RNA, 32 nt, Human
aggcccaaaggagaggccaaaagggaaaccaa

SEQ ID NO: 56606 - RNA, 18 nt, Human
aggcccaacccaccccca

SEQ ID NO: 56607 - RNA, 32 nt, Human
aggcccaacccuggggcucugaggauugggca

SEQ ID NO: 56608 - RNA, 32 nt, Human
aggcccaagcccagggcaggaaccuggagcaa

SEQ ID NO: 56609 - RNA, 32 nt, Human
aggcccaaggagguggaguggagagugggcuc

SEQ ID NO: 56610 - RNA, 20 nt, Human
aggcccaaggccgcccaggg

SEQ ID NO: 56611 - RNA, 32 nt, Human
aggcccaagguauccaagccuggggaagggca

SEQ ID NO: 56612 - RNA, 32 nt, Human
aggcccaagucaacuuucuguccagugggauu

SEQ ID NO: 56613 - RNA, 32 nt, Human
aggcccaaugcagaagaguauuaagaaagaug

SEQ ID NO: 56614 - RNA, 21 nt, Human
aggcccacaaccucaauguac

SEQ ID NO: 56615 - RNA, 32 nt, Human
aggcccacagcccagcgagggagaggucguga

SEQ ID NO: 56616 - RNA, 19 nt, Human
aggcccacagcccucagca

SEQ ID NO: 56617 - RNA, 32 nt, Human
aggcccacagcuggccccuguuggagucucuu

SEQ ID NO: 56618 - RNA, 32 nt, Human
aggcccacaggccacaccaucuguuucacuga

SEQ ID NO: 56619 - RNA, 32 nt, Human
aggcccacaggucugucaucccauaggccacc

SEQ ID NO: 56620 - RNA, 21 nt, Human
aggcccacccucucgguccgg

SEQ ID NO: 56621 - RNA, 31 nt, Human
aggcccacccucuguggcccuguguccugua

SEQ ID NO: 56622 - RNA, 32 nt, Human
aggcccaccugccucccugccugcuucgcccu

SEQ ID NO: 56623 - RNA, 32 nt, Human
aggcccaccugggcucuguccucugccaagca

SEQ ID NO: 56624 - RNA, 32 nt, Human
aggcccacucacaagcccuuggccacaacuau

SEQ ID NO: 56625 - RNA, 20 nt, Human
aggcccacugcugcugagaa

SEQ ID NO: 56626 - RNA, 32 nt, Human
aggcccacuggcugcaacaaguaccacugaca

SEQ ID NO: 56627 - RNA, 23 nt, Human
aggcccacugguuagcucagaga

SEQ ID NO: 56628 - RNA, 32 nt, Human
aggcccacuguaauacguagcucucuuaaaua

SEQ ID NO: 56629 - RNA, 32 nt, Human
aggcccacuucccagaggcuccugggccugug

SEQ ID NO: 56630 - RNA, 32 nt, Human
aggcccacuugccauaaccucuuuuggucuau

SEQ ID NO: 56631 - RNA, 32 nt, Human
aggcccagaaaaugccuggcgugagagccagc

SEQ ID NO: 56632 - RNA, 32 nt, Human
aggcccagaagcccagcagcugugggaaggaa

SEQ ID NO: 56633 - RNA, 32 nt, Human
aggcccagacacacggucccucaggucaggag

SEQ ID NO: 56634 - RNA, 32 nt, Human
aggcccagacagaggagccaggggagcccugu

SEQ ID NO: 56635 - RNA, 16 nt, Human
aggcccagaccaugca

SEQ ID NO: 56636 - RNA, 32 nt, Human
aggcccagagaagggaaauuacuugcccaaga

SEQ ID NO: 56637 - RNA, 19 nt, Human
aggcccagagaccagcaga

SEQ ID NO: 56638 - RNA, 32 nt, Human
aggcccagaggagccaagucauuaaaauggaa

SEQ ID NO: 56639 - RNA, 32 nt, Human
aggcccagaucagcuuugcacauggugcugac

SEQ ID NO: 56640 - RNA, 32 nt, Human
aggcccagaucucuaccacagaauacacccug

SEQ ID NO: 56641 - RNA, 32 nt, Human
aggcccagaugcagggcggcuuuuccaaggcc

SEQ ID NO: 56642 - RNA, 32 nt, Human
aggcccagcaaccugccagucacucaguggcc

SEQ ID NO: 56643 - RNA, 25 nt, Human
aggcccagcaccacccuccuuccca

SEQ ID NO: 56644 - RNA, 21 nt, Human
aggcccagcagcagcuggagg

SEQ ID NO: 56645 - RNA, 32 nt, Human
aggcccagccgacccccucucccugcauggca

SEQ ID NO: 56646 - RNA, 32 nt, Human
aggcccagccucggugagcacacacgcccucc

SEQ ID NO: 56647 - RNA, 19 nt, Human
aggcccagccucugugcug

SEQ ID NO: 56648 - RNA, 31 nt, Human
aggcccagccucuguggcccuguguccugca

SEQ ID NO: 56649 - RNA, 32 nt, Human
aggcccagccuggcagcuucucacaugguaaa

SEQ ID NO: 56650 - RNA, 32 nt, Human
aggcccagcgcccguccgcagcgcggccggca

SEQ ID NO: 56651 - RNA, 32 nt, Human
aggcccagcgugcagcugcagaaagguuuaga

SEQ ID NO: 56652 - RNA, 22 nt, Human
aggcccagcucagcugggccag

SEQ ID NO: 56653 - RNA, 32 nt, Human
aggcccagcucaguguggaggcugcuggcccu

SEQ ID NO: 56654 - RNA, 32 nt, Human
aggcccagcuccugcaucuugguggccccucc

SEQ ID NO: 56655 - RNA, 32 nt, Human
aggcccagcugaccaccuccugcugcagcucu

SEQ ID NO: 56656 - RNA, 32 nt, Human
aggcccagcugcagccacccggccucagggca

SEQ ID NO: 56657 - RNA, 32 nt, Human
aggcccagcuucagccucaccuucccuguggu

SEQ ID NO: 56658 - RNA, 30 nt, Human
aggcccagcuugcagcaggaggagcugcag

SEQ ID NO: 56659 - RNA, 32 nt, Human
aggcccaggaacauguuuauuuuagucaccuu

SEQ ID NO: 56660 - RNA, 32 nt, Human
aggcccaggaagggcacaggggcugagcacua

SEQ ID NO: 56661 - RNA, 32 nt, Human
aggcccaggagagggcgcugaccuguggucgu

SEQ ID NO: 56662 - RNA, 32 nt, Human
aggcccaggcagcggcggcggcggcggcucuc

SEQ ID NO: 56663 - RNA, 32 nt, Human
aggcccaggcaucggaguagaccauggccucc

SEQ ID NO: 56664 - RNA, 32 nt, Human
aggcccaggccuggguuuguacuuccaccucc

SEQ ID NO: 56665 - RNA, 32 nt, Human
aggcccaggcucuggugggccugcucucugua

SEQ ID NO: 56666 - RNA, 32 nt, Human
aggcccaggcugggguucagaccugcagagga

SEQ ID NO: 56667 - RNA, 32 nt, Human
aggcccaggcuggucucaaacuucugggcuca

SEQ ID NO: 56668 - RNA, 32 nt, Human
aggcccagggguggagguuagggguggagcuu

SEQ ID NO: 56669 - RNA, 32 nt, Human
aggcccagguacuggggaggccugaggagccc

SEQ ID NO: 56670 - RNA, 19 nt, Human
aggcccaggucccacccca

SEQ ID NO: 56671 - RNA, 32 nt, Human
aggcccaggugcuucuccuuuaugauuugagu

SEQ ID NO: 56672 - RNA, 32 nt, Human
aggcccagugaugccagaagaugggagggagg

SEQ ID NO: 56673 - RNA, 32 nt, Human
aggcccaguuuuucccuuccagcggccucucc

SEQ ID NO: 56674 - RNA, 24 nt, Human
aggcccauacccuaccucacggca

SEQ ID NO: 56675 - RNA, 24 nt, Human
aggcccauacccuacgucacggca

SEQ ID NO: 56676 - RNA, 21 nt, Human
aggcccauccaucccaugccu

SEQ ID NO: 56677 - RNA, 32 nt, Human
aggcccaucccucucuggccauggccccaagu

SEQ ID NO: 56678 - RNA, 32 nt, Human
aggcccauccugguugucaccaugaggacaau

SEQ ID NO: 56679 - RNA, 32 nt, Human
aggcccaucugccucugcccuuucuagccaag

SEQ ID NO: 56680 - RNA, 19 nt, Human
aggcccaucuuuugccuca

SEQ ID NO: 56681 - RNA, 21 nt, Human
aggcccauggcacuggggcag

SEQ ID NO: 56682 - RNA, 32 nt, Human
aggcccauguaucugcacgagcacuuagcuug

SEQ ID NO: 56683 - RNA, 19 nt, Human
aggcccaugucacugguca

SEQ ID NO: 56684 - RNA, 32 nt, Human
aggcccaugugaugaggagcugagaggacuug

SEQ ID NO: 56685 - RNA, 32 nt, Human
aggcccauuuggggcucccugugagugauucc

SEQ ID NO: 56686 - RNA, 32 nt, Human
aggccccaaaacagucuacacagcaggaggga

SEQ ID NO: 56687 - RNA, 32 nt, Human
aggccccaaacagggagccacgccagccagac

SEQ ID NO: 56688 - RNA, 32 nt, Human
aggccccaacagcaggaauccccauggagcuc

SEQ ID NO: 56689 - RNA, 32 nt, Human
aggccccacacacccaagugccccucacaccu

SEQ ID NO: 56690 - RNA, 32 nt, Human
aggccccacagcaacagaaguccaggacccac

SEQ ID NO: 56691 - RNA, 32 nt, Human
aggccccacgcccccacucucccuccacacuu

SEQ ID NO: 56692 - RNA, 32 nt, Human
aggccccacucccaguccuccugggauccugc

SEQ ID NO: 56693 - RNA, 32 nt, Human
aggccccacuggcugugcgugcccucuacaca

SEQ ID NO: 56694 - RNA, 32 nt, Human
aggccccacuuccccauaccaucaccuugggg

SEQ ID NO: 56695 - RNA, 32 nt, Human
aggccccagaggcccuggaggucuccaggggc

SEQ ID NO: 56696 - RNA, 32 nt, Human
aggccccagauggacacccaggccuguggugg

SEQ ID NO: 56697 - RNA, 19 nt, Human
aggccccaggcucagaagc

SEQ ID NO: 56698 - RNA, 22 nt, Human
aggccccagggcgagcuugcca

SEQ ID NO: 56699 - RNA, 32 nt, Human
aggccccagggcuguggguggggaaggaaggc

SEQ ID NO: 56700 - RNA, 32 nt, Human
aggccccaggggagcugugcagacugacucuc

SEQ ID NO: 56701 - RNA, 21 nt, Human
aggccccaggguggcugccuc

SEQ ID NO: 56702 - RNA, 20 nt, Human
aggccccagugugugccuca

SEQ ID NO: 56703 - RNA, 32 nt, Human
aggccccauccucccugugcccucucugcugc

SEQ ID NO: 56704 - RNA, 32 nt, Human
aggccccaucuuuacaaaaauacaaaaauuag

SEQ ID NO: 56705 - RNA, 32 nt, Human
aggccccaugcaggacaguagguuccaugggg

SEQ ID NO: 56706 - RNA, 32 nt, Human
aggcccccaagaggggcgaggccggggaggug

SEQ ID NO: 56707 - RNA, 28 nt, Human
aggcccccaaguguggucuuuuucuuuc

SEQ ID NO: 56708 - RNA, 21 nt, Human
aggcccccaccccccuuccca

SEQ ID NO: 56709 - RNA, 32 nt, Human
aggcccccagaaccacucucugcagagacagg

SEQ ID NO: 56710 - RNA, 32 nt, Human
aggcccccagaaccuggcuccagccagggggc

SEQ ID NO: 56711 - RNA, 32 nt, Human
aggcccccagcaggcucuccagucccaggaug

SEQ ID NO: 56712 - RNA, 32 nt, Human
aggcccccagcccagggcuccugcacuuacuu

SEQ ID NO: 56713 - RNA, 32 nt, Human
aggcccccagggugggaugguggggagauaag

SEQ ID NO: 56714 - RNA, 32 nt, Human
aggcccccaucuccuuaaagaguguggcaaaa

SEQ ID NO: 56715 - RNA, 18 nt, Human
aggcccccauguccaguu

SEQ ID NO: 56716 - RNA, 22 nt, Human
aggccccccggggccggggcag

SEQ ID NO: 56717 - RNA, 28 nt, Human
aggcccccgcaggcugccucuucccaac

SEQ ID NO: 56718 - RNA, 32 nt, Human
aggcccccggcccacguguccccugcccucug

SEQ ID NO: 56719 - RNA, 32 nt, Human
aggcccccuaguagcuggcauuacaggcacau

SEQ ID NO: 56720 - RNA, 32 nt, Human
aggcccccuccucuccccagaccacagggggc

SEQ ID NO: 56721 - RNA, 18 nt, Human
aggcccccugggccagcu

SEQ ID NO: 56722 - RNA, 32 nt, Human
aggccccgagacuggaguguguuccugaagag

SEQ ID NO: 56723 - RNA, 32 nt, Human
aggccccgaggcugaagaggagccaugucucc

SEQ ID NO: 56724 - RNA, 32 nt, Human
aggccccgcaggcagcccacagagccacuucg

SEQ ID NO: 56725 - RNA, 32 nt, Human
aggccccgccagcaggcgaagcagggagaugu

SEQ ID NO: 56726 - RNA, 32 nt, Human
aggccccgcccaggcuuagucacugagacagc

SEQ ID NO: 56727 - RNA, 19 nt, Human
aggccccgcccuccgcucc

SEQ ID NO: 56728 - RNA, 18 nt, Human
aggccccgcccuccuccc

SEQ ID NO: 56729 - RNA, 32 nt, Human
aggccccgccucucccuggcagcccggagccc

SEQ ID NO: 56730 - RNA, 32 nt, Human
aggccccggcagggagcugggccccgcagacg

SEQ ID NO: 56731 - RNA, 32 nt, Human
aggccccggcgcccuggugaggcccaaaccuc

SEQ ID NO: 56732 - RNA, 20 nt, Human
aggccccgggccagugucca

SEQ ID NO: 56733 - RNA, 32 nt, Human
aggccccgggcccugcgcugccugucauggcu

SEQ ID NO: 56734 - RNA, 24 nt, Human
aggccccuacagccaauggaacgg

SEQ ID NO: 56735 - RNA, 32 nt, Human
aggccccuagggccacuuccaaaggaguguga

SEQ ID NO: 56736 - RNA, 32 nt, Human
aggccccuccaggccgucacuggccugcacag

SEQ ID NO: 56737 - RNA, 32 nt, Human
aggccccucccccuggccucaggcaggcccug

SEQ ID NO: 56738 - RNA, 21 nt, Human
aggccccuccuggccaggcag

SEQ ID NO: 56739 - RNA, 19 nt, Human
aggccccuccuguccuccu

SEQ ID NO: 56740 - RNA, 32 nt, Human
aggccccucgguuugaguccaucauggaggac

SEQ ID NO: 56741 - RNA, 32 nt, Human
aggccccucuauuuuauuuuucuugaaaacau

SEQ ID NO: 56742 - RNA, 32 nt, Human
aggccccucugggcugaucuugugccauucuu

SEQ ID NO: 56743 - RNA, 19 nt, Human
aggccccugaggcccagcu

SEQ ID NO: 56744 - RNA, 32 nt, Human
aggccccugaguagcugggauuacaggcacgu

SEQ ID NO: 56745 - RNA, 18 nt, Human
aggccccugcaacugggg

SEQ ID NO: 56746 - RNA, 24 nt, Human
aggccccugcaaggguaggggaca

SEQ ID NO: 56747 - RNA, 20 nt, Human
aggccccugcagagcagggg

SEQ ID NO: 56748 - RNA, 32 nt, Human
aggccccugcagcugccucacaccgccccuug

SEQ ID NO: 56749 - RNA, 18 nt, Human
aggccccugccaccaccu

SEQ ID NO: 56750 - RNA, 20 nt, Human
aggccccugccacccugggg

SEQ ID NO: 56751 - RNA, 21 nt, Human
aggccccugcccaugcggggc

SEQ ID NO: 56752 - RNA, 32 nt, Human
aggccccugcuccuguccacagagcccacccu

SEQ ID NO: 56753 - RNA, 32 nt, Human
aggccccugcugcagagagugcagaaccgucc

SEQ ID NO: 56754 - RNA, 32 nt, Human
aggccccugcuucucccucuaggagccuaaag

SEQ ID NO: 56755 - RNA, 32 nt, Human
aggccccuggacaauugaggaugcccaucccc

SEQ ID NO: 56756 - RNA, 32 nt, Human
aggccccuggauggaugcauggggaagguuag

SEQ ID NO: 56757 - RNA, 32 nt, Human
aggccccuguaaucccagcuaauugggaggcu

SEQ ID NO: 56758 - RNA, 21 nt, Human
aggccccuguuuccugagcag

SEQ ID NO: 56759 - RNA, 32 nt, Human
aggccccuuccaggcaaagcugcuucucuucc

SEQ ID NO: 56760 - RNA, 19 nt, Human
aggccccuuugagugacuc

SEQ ID NO: 56761 - RNA, 27 nt, Human
aggcccgaaagccgccucccccuccca

SEQ ID NO: 56762 - RNA, 32 nt, Human
aggcccgaaagucccugaggcccuacuggggu

SEQ ID NO: 56763 - RNA, 32 nt, Human
aggcccgaaccauggaccuccgcaccgccgug

SEQ ID NO: 56764 - RNA, 32 nt, Human
aggcccgacuccggccucccaacaaggucuuu

SEQ ID NO: 56765 - RNA, 20 nt, Human
aggcccgagagaggcugcug

SEQ ID NO: 56766 - RNA, 32 nt, Human
aggcccgagggaucaggagcuaugggaccaga

SEQ ID NO: 56767 - RNA, 32 nt, Human
aggcccgcaggaggaggaggaucggcggacug

SEQ ID NO: 56768 - RNA, 32 nt, Human
aggcccgcagggaagugucugcacaucaccga

SEQ ID NO: 56769 - RNA, 32 nt, Human
aggcccgcccuccuggccagcagaguggggca

SEQ ID NO: 56770 - RNA, 20 nt, Human
aggcccgccuggcagugucc

SEQ ID NO: 56771 - RNA, 19 nt, Human
aggcccgcgcccgcgcccg

SEQ ID NO: 56772 - RNA, 32 nt, Human
aggcccgcgccgaggaccuggccaggccagcc

SEQ ID NO: 56773 - RNA, 32 nt, Human
aggcccggaagagagcccucaccaggaaauga

SEQ ID NO: 56774 - RNA, 28 nt, Human
aggcccggaagugcugacgcagccauca

SEQ ID NO: 56775 - RNA, 32 nt, Human
aggcccggacacacccaggaggccccucacag

SEQ ID NO: 56776 - RNA, 32 nt, Human
aggcccggaccagugccucaccuucagguagc

SEQ ID NO: 56777 - RNA, 32 nt, Human
aggcccggccuccugccucucgaaggucugca

SEQ ID NO: 56778 - RNA, 32 nt, Human
aggcccggccuccugcgucucgaaggccugca

SEQ ID NO: 56779 - RNA, 32 nt, Human
aggcccgggaaagggaagcgacguggcagggc

SEQ ID NO: 56780 - RNA, 32 nt, Human
aggcccgggaggacgcggcggcgggaaccugg

SEQ ID NO: 56781 - RNA, 32 nt, Human
aggcccgggaggcgcaggcgcaggcgcagugg

SEQ ID NO: 56782 - RNA, 32 nt, Human
aggcccgggccggcgcaggguggugcaacuuu

SEQ ID NO: 56783 - RNA, 32 nt, Human
aggcccgggcuggaggggcaguguugcuguuc

SEQ ID NO: 56784 - RNA, 32 nt, Human
aggcccggggaagggaagagcaggucaguaca

SEQ ID NO: 56785 - RNA, 32 nt, Human
aggcccggggcuuccucaucaaaguguuggug

SEQ ID NO: 56786 - RNA, 32 nt, Human
aggcccgggggcuccggcaucucgacgcggcu

SEQ ID NO: 56787 - RNA, 32 nt, Human
aggcccgggguccugguccaccccaggucccu

SEQ ID NO: 56788 - RNA, 32 nt, Human
aggcccgguggaccugccgccaugcaggacgg

SEQ ID NO: 56789 - RNA, 32 nt, Human
aggcccgguggagaauuaggugcugcugggag

SEQ ID NO: 56790 - RNA, 32 nt, Human
aggcccgguuuaaaugcaggaggaaucuggug

SEQ ID NO: 56791 - RNA, 24 nt, Human
aggcccgugaccaggccacaggga

SEQ ID NO: 56792 - RNA, 32 nt, Human
aggcccgugccucaccagacgccaugcucuca

SEQ ID NO: 56793 - RNA, 32 nt, Human
aggcccuaagaccuccuccuccaggucaggcu

SEQ ID NO: 56794 - RNA, 32 nt, Human
aggcccuacccugcccuccaccgccggcucca

SEQ ID NO: 56795 - RNA, 32 nt, Human
aggcccuagcaguccugcuaccacagauccca

SEQ ID NO: 56796 - RNA, 32 nt, Human
aggcccuagggugcuggagcugcggaggaggg

SEQ ID NO: 56797 - RNA, 32 nt, Human
aggcccuauuacccucuccagcugccacugcc

SEQ ID NO: 56798 - RNA, 32 nt, Human
aggcccucaaauagccccuccugggacucccu

SEQ ID NO: 56799 - RNA, 32 nt, Human
aggcccucaagugcccuagggaagaagcaaga

SEQ ID NO: 56800 - RNA, 32 nt, Human
aggcccucagaucccugcucuuccugccuuuc

SEQ ID NO: 56801 - RNA, 32 nt, Human
aggcccucauuuccugcacuguguucucaggu

SEQ ID NO: 56802 - RNA, 32 nt, Human
aggcccuccaaccauaaacaguccaggaugga

SEQ ID NO: 56803 - RNA, 25 nt, Human
aggcccuccagcuggaugcugggga

SEQ ID NO: 56804 - RNA, 32 nt, Human
aggcccucccugcacucucugccacauguccc

SEQ ID NO: 56805 - RNA, 32 nt, Human
aggcccuccucccaggagguagggucuuggcu

SEQ ID NO: 56806 - RNA, 32 nt, Human
aggcccuccucccccucuccccacucccucau

SEQ ID NO: 56807 - RNA, 17 nt, Human
aggcccuccuggccagg

SEQ ID NO: 56808 - RNA, 32 nt, Human
aggcccuccugguucugguugccuaaaaggug

SEQ ID NO: 56809 - RNA, 32 nt, Human
aggcccuccuuccagggaugucucuccagcuc

SEQ ID NO: 56810 - RNA, 32 nt, Human
aggcccuccuuccuuccacauuuaauugcuua

SEQ ID NO: 56811 - RNA, 32 nt, Human
aggcccucggcagagacacaggaagcggaacu

SEQ ID NO: 56812 - RNA, 32 nt, Human
aggcccucuaaugccauuuuucuaaacaguaa

SEQ ID NO: 56813 - RNA, 32 nt, Human
aggcccucucaggcaccuccugccucagccca

SEQ ID NO: 56814 - RNA, 32 nt, Human
aggcccucuucaggcuuuggcagccacagaua

SEQ ID NO: 56815 - RNA, 32 nt, Human
aggcccugaccucacugccugccuccucuacc

SEQ ID NO: 56816 - RNA, 18 nt, Human
aggcccugaccucagggg

SEQ ID NO: 56817 - RNA, 21 nt, Human
aggcccugaccuucauggugu

SEQ ID NO: 56818 - RNA, 20 nt, Human
aggcccugagcaggcagcug

SEQ ID NO: 56819 - RNA, 32 nt, Human
aggcccugagcuggggagguggggaagauucg

SEQ ID NO: 56820 - RNA, 32 nt, Human
aggcccugcacuccaccuggggacggccccuc

SEQ ID NO: 56821 - RNA, 32 nt, Human
aggcccugcaucccuugccucaggccgggcug

SEQ ID NO: 56822 - RNA, 18 nt, Human
aggcccugcucaccugca

SEQ ID NO: 56823 - RNA, 32 nt, Human
aggcccugcuccagcaucuacuucagccccag

SEQ ID NO: 56824 - RNA, 32 nt, Human
aggcccugcuccugaagccucugugaccuugg

SEQ ID NO: 56825 - RNA, 32 nt, Human
aggcccugcucuccacggccucccucuggccc

SEQ ID NO: 56826 - RNA, 32 nt, Human
aggcccugcucuuccucgucuucugggacaag

SEQ ID NO: 56827 - RNA, 32 nt, Human
aggcccugcugggacaucccacgugugauccc

SEQ ID NO: 56828 - RNA, 32 nt, Human
aggcccugcuucugcugaaccugacagccagu

SEQ ID NO: 56829 - RNA, 32 nt, Human
aggcccuggagcucggccucccuaccuucucc

SEQ ID NO: 56830 - RNA, 32 nt, Human
aggcccuggaggcugcaacauaccucaauccu

SEQ ID NO: 56831 - RNA, 32 nt, Human
aggcccuggagugggaguucugaggcagggug

SEQ ID NO: 56832 - RNA, 32 nt, Human
aggcccuggcgacugggcugagcccccaagug

SEQ ID NO: 56833 - RNA, 32 nt, Human
aggcccuggcuggagggggacccuggacugga

SEQ ID NO: 56834 - RNA, 32 nt, Human
aggcccuggcuguggagaaugcugaaggaaga

SEQ ID NO: 56835 - RNA, 32 nt, Human
aggcccugggagaggccaugagagccaccccg

SEQ ID NO: 56836 - RNA, 32 nt, Human
aggcccugggcuccuggcugggccagcagcug

SEQ ID NO: 56837 - RNA, 32 nt, Human
aggcccugggcuggaggaagacaucccagauc

SEQ ID NO: 56838 - RNA, 32 nt, Human
aggcccugggcugggugcagggacacaagggu

SEQ ID NO: 56839 - RNA, 32 nt, Human
aggcccugggcugggugcugggaagggagggu

SEQ ID NO: 56840 - RNA, 32 nt, Human
aggcccuggggagcccaguccacugagcaagc

SEQ ID NO: 56841 - RNA, 32 nt, Human
aggcccuguccaccaccuuuccuggccuugcu

SEQ ID NO: 56842 - RNA, 32 nt, Human
aggcccuguccaucuucuccccaccaccgccc

SEQ ID NO: 56843 - RNA, 32 nt, Human
aggcccugucccaucaugcauucaugucuguc

SEQ ID NO: 56844 - RNA, 32 nt, Human
aggcccugugaaggaaauggcccaugguucac

SEQ ID NO: 56845 - RNA, 32 nt, Human
aggcccugugggaacgguccaggcugguccug

SEQ ID NO: 56846 - RNA, 30 nt, Human
aggcccuuaauaaacaccuguuggauaagc

SEQ ID NO: 56847 - RNA, 32 nt, Human
aggcccuuagggaaguugucuccuuccauuca

SEQ ID NO: 56848 - RNA, 22 nt, Human
aggcccuucagagccagggcag

SEQ ID NO: 56849 - RNA, 21 nt, Human
aggcccuucaucuucauggcc

SEQ ID NO: 56850 - RNA, 32 nt, Human
aggcccuucccaagccccuaacgcaacugcca

SEQ ID NO: 56851 - RNA, 32 nt, Human
aggcccuucccaagguguggugacugugccuu

SEQ ID NO: 56852 - RNA, 32 nt, Human
aggcccuuccucucccccugucuguuuccuuc

SEQ ID NO: 56853 - RNA, 32 nt, Human
aggcccuuccucucugugccgugcuugcuccu

SEQ ID NO: 56854 - RNA, 32 nt, Human
aggcccuucuauuccugagggcucagagcuga

SEQ ID NO: 56855 - RNA, 32 nt, Human
aggcccuugacucugcccugagcuugcagcug

SEQ ID NO: 56856 - RNA, 32 nt, Human
aggcccuugaggaccacuugagcccaggagau

SEQ ID NO: 56857 - RNA, 32 nt, Human
aggcccuuuaugauuguugagcauuaauccuc

SEQ ID NO: 56858 - RNA, 32 nt, Human
aggccgaaggcagugcaagagacucuggccuc

SEQ ID NO: 56859 - RNA, 32 nt, Human
aggccgacacaccacaccuacacucccgcguc

SEQ ID NO: 56860 - RNA, 32 nt, Human
aggccgacaugcuggauuaccugcugagccug

SEQ ID NO: 56861 - RNA, 32 nt, Human
aggccgagagcauguaccagaucaaguaugag

SEQ ID NO: 56862 - RNA, 32 nt, Human
aggccgagagccccaagaagacccccgcgucu

SEQ ID NO: 56863 - RNA, 19 nt, Human
aggccgagagucagacuga

SEQ ID NO: 56864 - RNA, 20 nt, Human
aggccgagccagcccagaga

SEQ ID NO: 56865 - RNA, 32 nt, Human
aggccgagccggggcguaucaccugaggucag

SEQ ID NO: 56866 - RNA, 32 nt, Human
aggccgagcuuuguuuccuguguuugugugga

SEQ ID NO: 56867 - RNA, 32 nt, Human
aggccgaggagaaggcgcugaacgaggagaag

SEQ ID NO: 56868 - RNA, 32 nt, Human
aggccgaggcagcagauugcuugagcccagga

SEQ ID NO: 56869 - RNA, 19 nt, Human
aggccgaggcaggccggcu

SEQ ID NO: 56870 - RNA, 20 nt, Human
aggccgaggcaggcggauca

SEQ ID NO: 56871 - RNA, 20 nt, Human
aggccgaggcagguggauca

SEQ ID NO: 56872 - RNA, 21 nt, Human
aggccgaggcagguggaucac

SEQ ID NO: 56873 - RNA, 32 nt, Human
aggccgaggccggggcgggauccagagcggga

SEQ ID NO: 56874 - RNA, 26 nt, Human
aggccgaggcggaucacgaggucagg

SEQ ID NO: 56875 - RNA, 26 nt, Human
aggccgaggcggaucauaaggucagg

SEQ ID NO: 56876 - RNA, 24 nt, Human
aggccgaggcgggaggaucaccug

SEQ ID NO: 56877 - RNA, 24 nt, Human
aggccgaggcgggaggaucacuug

SEQ ID NO: 56878 - RNA, 20 nt, Human
aggccgaggcgggcggauca

SEQ ID NO: 56879 - RNA, 32 nt, Human
aggccgagggccuguggaacgagggcuccguu

SEQ ID NO: 56880 - RNA, 23 nt, Human
aggccgaggugggaggaucgcuu

SEQ ID NO: 56881 - RNA, 32 nt, Human
aggccgaggugggcggaucaccagaggucaag

SEQ ID NO: 56882 - RNA, 19 nt, Human
aggccgagguugcagugag

SEQ ID NO: 56883 - RNA, 32 nt, Human
aggccgagucuguccuggaaccaggcuugccu

SEQ ID NO: 56884 - RNA, 32 nt, Human
aggccgaguugggggcgaucaccugaggucag

SEQ ID NO: 56885 - RNA, 32 nt, Human
aggccgauggugguuucggucccuggagcccg

SEQ ID NO: 56886 - RNA, 32 nt, Human
aggccgaugugggcagaucacaaggucaggag

SEQ ID NO: 56887 - RNA, 24 nt, Human
aggccgcaagcagcugccuagggg

SEQ ID NO: 56888 - RNA, 32 nt, Human
aggccgcaagggaaguucacgggcucggcacc

SEQ ID NO: 56889 - RNA, 32 nt, Human
aggccgcacacagcggucugacccgguuuggu

SEQ ID NO: 56890 - RNA, 32 nt, Human
aggccgcaccacugcacuccagccugggugac

SEQ ID NO: 56891 - RNA, 32 nt, Human
aggccgcaccugcuggagggggacugaagggc

SEQ ID NO: 56892 - RNA, 32 nt, Human
aggccgcagaccccuucucaccucuugagggg

SEQ ID NO: 56893 - RNA, 32 nt, Human
aggccgcagagggagcaggaagaguugcugau

SEQ ID NO: 56894 - RNA, 32 nt, Human
aggccgcaggcaggugguucagugguuagggc

SEQ ID NO: 56895 - RNA, 32 nt, Human
aggccgcagggugggugauggagaaggcugag

SEQ ID NO: 56896 - RNA, 32 nt, Human
aggccgcagguguugugaagaccacucguucu

SEQ ID NO: 56897 - RNA, 32 nt, Human
aggccgcauauggacacacaugaggucgcucg

SEQ ID NO: 56898 - RNA, 32 nt, Human
aggccgccagcccggaggcugcagcccagaaa

SEQ ID NO: 56899 - RNA, 32 nt, Human
aggccgccauccagggcggggaagggagcgga

SEQ ID NO: 56900 - RNA, 32 nt, Human
aggccgcccuggagggcccggaggucccaagg

SEQ ID NO: 56901 - RNA, 32 nt, Human
aggccgccgccgccucuccuugcugcagccau

SEQ ID NO: 56902 - RNA, 32 nt, Human
aggccgccgcgaugccgcacuuccuggacugg

SEQ ID NO: 56903 - RNA, 32 nt, Human
aggccgccgugaccuauucacccuccacuucc

SEQ ID NO: 56904 - RNA, 32 nt, Human
aggccgccucagcucuccucugcgccggcccg

SEQ ID NO: 56905 - RNA, 32 nt, Human
aggccgcgacugccucucccaucugucuaucu

SEQ ID NO: 56906 - RNA, 32 nt, Human
aggccgcgccaagauggcagaggauggaggcu

SEQ ID NO: 56907 - RNA, 32 nt, Human
aggccgcgcucugugggccucugagggcggca

SEQ ID NO: 56908 - RNA, 32 nt, Human
aggccgcucccaggccccugugagugugggca

SEQ ID NO: 56909 - RNA, 32 nt, Human
aggccgcugacugccagcuccagccuggcccc

SEQ ID NO: 56910 - RNA, 32 nt, Human
aggccgcugcagcugcacagccucugcuacac

SEQ ID NO: 56911 - RNA, 32 nt, Human
aggccgcuggaugcuggagugaaaggaaggga

SEQ ID NO: 56912 - RNA, 32 nt, Human
aggccgcuuccaggaagccccgggccaggccc

SEQ ID NO: 56913 - RNA, 32 nt, Human
aggccgcuucccuaagaggcuuggaggagcug

SEQ ID NO: 56914 - RNA, 22 nt, Human
aggccggaagugcgggcgcuca

SEQ ID NO: 56915 - RNA, 32 nt, Human
aggccggacagaaaacaugacccaucaaugug

SEQ ID NO: 56916 - RNA, 32 nt, Human
aggccggacaggagagggaggggugggggaca

SEQ ID NO: 56917 - RNA, 20 nt, Human
aggccggagcaucucagggg

SEQ ID NO: 56918 - RNA, 32 nt, Human
aggccggagccuugcccucccaagacacuguu

SEQ ID NO: 56919 - RNA, 32 nt, Human
aggccggagcuguccaucagcaccaaaggccg

SEQ ID NO: 56920 - RNA, 18 nt, Human
aggccggagcugugggga

SEQ ID NO: 56921 - RNA, 24 nt, Human
aggccggaggauugcuuaaaccca

SEQ ID NO: 56922 - RNA, 24 nt, Human
aggccggaggauugcuugagccca

SEQ ID NO: 56923 - RNA, 22 nt, Human
aggccggagugcagugguguca

SEQ ID NO: 56924 - RNA, 24 nt, Human
aggccggaguggggcucccagagg

SEQ ID NO: 56925 - RNA, 32 nt, Human
aggccggcagcagcagcagagagcagagagca

SEQ ID NO: 56926 - RNA, 32 nt, Human
aggccggcaggcgggugcgcggagggcuggua

SEQ ID NO: 56927 - RNA, 32 nt, Human
aggccggcaguggaggcugagcagggacucuc

SEQ ID NO: 56928 - RNA, 32 nt, Human
aggccggcaguggcugccucucuugguucugc

SEQ ID NO: 56929 - RNA, 32 nt, Human
aggccggcauggugccugggcugccgggaacc

SEQ ID NO: 56930 - RNA, 32 nt, Human
aggccggccagccucacaucagucucuccgcc

SEQ ID NO: 56931 - RNA, 32 nt, Human
aggccggcccgagcagcacacagugauccaca

SEQ ID NO: 56932 - RNA, 32 nt, Human
aggccggcgccagccgugccucaccaggucca

SEQ ID NO: 56933 - RNA, 24 nt, Human
aggccggcggaucacgaggucagg

SEQ ID NO: 56934 - RNA, 32 nt, Human
aggccggcgguggauggggccaggaagcaugc

SEQ ID NO: 56935 - RNA, 32 nt, Human
aggccggcucuggccuccugacccagacagcg

SEQ ID NO: 56936 - RNA, 21 nt, Human
aggccgggacagaccaggagc

SEQ ID NO: 56937 - RNA, 32 nt, Human
aggccgggacaguggugcaugccagucauccc

SEQ ID NO: 56938 - RNA, 32 nt, Human
aggccgggagaaggggagccaggaccuucuca

SEQ ID NO: 56939 - RNA, 17 nt, Human
aggccgggagcaggcgc

SEQ ID NO: 56940 - RNA, 32 nt, Human
aggccgggaguggcaucugaggccaggagugg

SEQ ID NO: 56941 - RNA, 21 nt, Human
aggccgggcacgguggcucau

SEQ ID NO: 56942 - RNA, 32 nt, Human
aggccgggcacuguagcucaaaccuauaaucc

SEQ ID NO: 56943 - RNA, 19 nt, Human
aggccgggccgggcggcca

SEQ ID NO: 56944 - RNA, 21 nt, Human
aggccgggccgggcucggggg

SEQ ID NO: 56945 - RNA, 32 nt, Human
aggccgggccuccucaagucggccucucagac

SEQ ID NO: 56946 - RNA, 27 nt, Human
aggccgggcgcagccgccacccggggg

SEQ ID NO: 56947 - RNA, 23 nt, Human
aggccgggcgccugcccagcagg

SEQ ID NO: 56948 - RNA, 21 nt, Human
aggccgggcgcgguggcucau

SEQ ID NO: 56949 - RNA, 19 nt, Human
aggccgggcgggugacuca

SEQ ID NO: 56950 - RNA, 32 nt, Human
aggccgggcugagacguggccaggggaacacg

SEQ ID NO: 56951 - RNA, 32 nt, Human
aggccggggaaggagcccucccucucucccuu

SEQ ID NO: 56952 - RNA, 32 nt, Human
aggccggggaucuccaggucccaggcugggcg

SEQ ID NO: 56953 - RNA, 32 nt, Human
aggccggggccaggcucugggucaaggcagga

SEQ ID NO: 56954 - RNA, 32 nt, Human
aggccggggccauggagaaagcgcggccgcug

SEQ ID NO: 56955 - RNA, 19 nt, Human
aggccggggcucccaggaa

SEQ ID NO: 56956 - RNA, 32 nt, Human
aggccggguaccugggcugggauccggagcaa

SEQ ID NO: 56957 - RNA, 32 nt, Human
aggccgggucacaacucacugcagccuggacc

SEQ ID NO: 56958 - RNA, 21 nt, Human
aggccgggugcgguggcucau

SEQ ID NO: 56959 - RNA, 25 nt, Human
aggccgggugggccgggucaggaga

SEQ ID NO: 56960 - RNA, 23 nt, Human
aggccggucucaaacuccugacc

SEQ ID NO: 56961 - RNA, 32 nt, Human
aggccggucucaaacuccugaccucaggugau

SEQ ID NO: 56962 - RNA, 32 nt, Human
aggccggucucgaacuccuggccuuaagccac

SEQ ID NO: 56963 - RNA, 32 nt, Human
aggccggucuugaacuccuggacucaagcaau

SEQ ID NO: 56964 - RNA, 32 nt, Human
aggccggucuugaacuccugggcucaagugau

SEQ ID NO: 56965 - RNA, 24 nt, Human
aggccggugauucacaaggucagg

SEQ ID NO: 56966 - RNA, 32 nt, Human
aggccggugguggauuuccuccccgcaucuca

SEQ ID NO: 56967 - RNA, 32 nt, Human
aggccgguucuccgccgcucaggcugggagag

SEQ ID NO: 56968 - RNA, 32 nt, Human
aggccguacacaccucuguuaggaggcaaauu

SEQ ID NO: 56969 - RNA, 32 nt, Human
aggccgucccaccaggaaaucucucuauuccg

SEQ ID NO: 56970 - RNA, 32 nt, Human
aggccgucucccaaggagcagagcagagcaga

SEQ ID NO: 56971 - RNA, 32 nt, Human
aggccgugcuuaacaggaaaggaccuaccaaa

SEQ ID NO: 56972 - RNA, 32 nt, Human
aggccguggaggaagccaggaggaggguggcu

SEQ ID NO: 56973 - RNA, 18 nt, Human
aggccguggaggaugcua

SEQ ID NO: 56974 - RNA, 32 nt, Human
aggccgugugcuggcccugccccagccuagcu

SEQ ID NO: 56975 - RNA, 32 nt, Human
aggccguucagcugugacgaaggccugaagca

SEQ ID NO: 56976 - RNA, 32 nt, Human
aggccguuguccugcucugaccacagaguuuu

SEQ ID NO: 56977 - RNA, 32 nt, Human
aggccuaaaauuaugugguuuaaacaaaauua

SEQ ID NO: 56978 - RNA, 32 nt, Human
aggccuaaaccugagacuuccucugcaguuga

SEQ ID NO: 56979 - RNA, 32 nt, Human
aggccuaaaugagaggcauucugacugguugg

SEQ ID NO: 56980 - RNA, 32 nt, Human
aggccuaaccaccucccugcagucucuuauau

SEQ ID NO: 56981 - RNA, 32 nt, Human
aggccuaagcugccucccagguucuuagggcc

SEQ ID NO: 56982 - RNA, 24 nt, Human
aggccuaaucauguugugauucuc

SEQ ID NO: 56983 - RNA, 32 nt, Human
aggccuacaaaaccacaugggaguuucuuuau

SEQ ID NO: 56984 - RNA, 32 nt, Human
aggccuacacagacaaaucaggagggaacaga

SEQ ID NO: 56985 - RNA, 32 nt, Human
aggccuacagccgccggcaccggccgcgggga

SEQ ID NO: 56986 - RNA, 32 nt, Human
aggccuacagcggggaaaggacuugccagauu

SEQ ID NO: 56987 - RNA, 32 nt, Human
aggccuaccaccuguccugccugggccuuggc

SEQ ID NO: 56988 - RNA, 32 nt, Human
aggccuacccagggaggaugcagagagcuggu

SEQ ID NO: 56989 - RNA, 32 nt, Human
aggccuacccuugaggggaaugucacgugcaa

SEQ ID NO: 56990 - RNA, 32 nt, Human
aggccuacugaagggacuuaacauacucuuaa

SEQ ID NO: 56991 - RNA, 32 nt, Human
aggccuacuguugcacauggggccaaaaccag

SEQ ID NO: 56992 - RNA, 32 nt, Human
aggccuagacaggcaaggggauggagagggcu

SEQ ID NO: 56993 - RNA, 32 nt, Human
aggccuagcacaauagagacccugucaaugga

SEQ ID NO: 56994 - RNA, 32 nt, Human
aggccuagugccagguucccuggcguugguga

SEQ ID NO: 56995 - RNA, 32 nt, Human
aggccuaugaauuuaauguggaaaaauaaaaa

SEQ ID NO: 56996 - RNA, 32 nt, Human
aggccuauuaacaucauacauugucauuaguc

SEQ ID NO: 56997 - RNA, 32 nt, Human
aggccucaaaggugccuggugauaguaggcac

SEQ ID NO: 56998 - RNA, 32 nt, Human
aggccucaaccccuuucucccacccagcccca

SEQ ID NO: 56999 - RNA, 25 nt, Human
aggccucacacaggccucagaaaug

SEQ ID NO: 57000 - RNA, 32 nt, Human
aggccucacagaaacagagaucccaucuugga

SEQ ID NO: 57001 - RNA, 31 nt, Human
aggccucacagcuggcauauggaggcuguua

SEQ ID NO: 57002 - RNA, 32 nt, Human
aggccucacugcaccuuuccguguggagccca

SEQ ID NO: 57003 - RNA, 32 nt, Human
aggccucagacagcagcacgaggcaggcacuu

SEQ ID NO: 57004 - RNA, 19 nt, Human
aggccucagagagagccca

SEQ ID NO: 57005 - RNA, 32 nt, Human
aggccucagagcuguguggcagggcccccugc

SEQ ID NO: 57006 - RNA, 20 nt, Human
aggccucagauucagcagug

SEQ ID NO: 57007 - RNA, 32 nt, Human
aggccucagcaggcaggagcaucucugccucc

SEQ ID NO: 57008 - RNA, 25 nt, Human
aggccucagcgguggccguccgaga

SEQ ID NO: 57009 - RNA, 32 nt, Human
aggccucaggaaggcaaagccgggugaagcug

SEQ ID NO: 57010 - RNA, 32 nt, Human
aggccucaggcucuuaccuccuuggggcagug

SEQ ID NO: 57011 - RNA, 32 nt, Human
aggccucagggugucugggauugcuggggagg

SEQ ID NO: 57012 - RNA, 32 nt, Human
aggccucagguagaauggaagcuguucugcau

SEQ ID NO: 57013 - RNA, 32 nt, Human
aggccucagugaggcaucuaccaccuucuaca

SEQ ID NO: 57014 - RNA, 32 nt, Human
aggccucaguuuaaucaccuauccaaugagga

SEQ ID NO: 57015 - RNA, 32 nt, Human
aggccucauaacuacccugcugguaaacugca

SEQ ID NO: 57016 - RNA, 32 nt, Human
aggccucauuuccuuccucugccaccaucccu

SEQ ID NO: 57017 - RNA, 32 nt, Human
aggccuccaacauuucucuaguagccacugcu

SEQ ID NO: 57018 - RNA, 32 nt, Human
aggccuccaagucccuaagcgguuccaguuug

SEQ ID NO: 57019 - RNA, 32 nt, Human
aggccuccacccagugcugggaggugucccgc

SEQ ID NO: 57020 - RNA, 21 nt, Human
aggccuccaccugccauggag

SEQ ID NO: 57021 - RNA, 32 nt, Human
aggccuccacuccuuccaucucuuccuucaga

SEQ ID NO: 57022 - RNA, 32 nt, Human
aggccuccacugcaccuucuuagggaagggca

SEQ ID NO: 57023 - RNA, 20 nt, Human
aggccuccagcucagcagug

SEQ ID NO: 57024 - RNA, 32 nt, Human
aggccucccaggaggagagcaaggaccuggca

SEQ ID NO: 57025 - RNA, 32 nt, Human
aggccucccaugcagaggucagugagagccca

SEQ ID NO: 57026 - RNA, 32 nt, Human
aggccucccccuuccuccucgccauccuacuc

SEQ ID NO: 57027 - RNA, 32 nt, Human
aggccucccugucacuccuccuggggaccuca

SEQ ID NO: 57028 - RNA, 32 nt, Human
aggccuccgagccucaguuuccucguuugcaa

SEQ ID NO: 57029 - RNA, 19 nt, Human
aggccuccgcccuccuccc

SEQ ID NO: 57030 - RNA, 32 nt, Human
aggccuccuccaccuccaccuccaccccgccu

SEQ ID NO: 57031 - RNA, 32 nt, Human
aggccuccuccacgccuggcuccccaggacgc

SEQ ID NO: 57032 - RNA, 32 nt, Human
aggccuccuccaucauccuccauguagcgccu

SEQ ID NO: 57033 - RNA, 19 nt, Human
aggccuccucccuccuccc

SEQ ID NO: 57034 - RNA, 32 nt, Human
aggccuccucccucugaccacagggucaugcc

SEQ ID NO: 57035 - RNA, 32 nt, Human
aggccuccugacuuuucucacugccuucguua

SEQ ID NO: 57036 - RNA, 32 nt, Human
aggccuccugggaaagggagaauggcaaagac

SEQ ID NO: 57037 - RNA, 32 nt, Human
aggccuccuguggcuguuggguuccagaugcu

SEQ ID NO: 57038 - RNA, 22 nt, Human
aggccuccuugaccuucagcaa

SEQ ID NO: 57039 - RNA, 32 nt, Human
aggccucgacuuugcuggcacagggucccagg

SEQ ID NO: 57040 - RNA, 32 nt, Human
aggccucgcacuugcagaggagcccagugggc

SEQ ID NO: 57041 - RNA, 32 nt, Human
aggccucgcuagggaauugaguacagucaucu

SEQ ID NO: 57042 - RNA, 32 nt, Human
aggccucggcccccguccgcccucucucccug

SEQ ID NO: 57043 - RNA, 32 nt, Human
aggccucggugugagccagggcugcuucaaac

SEQ ID NO: 57044 - RNA, 32 nt, Human
aggccucuaaaaugcugggauuacaggcguga

SEQ ID NO: 57045 - RNA, 32 nt, Human
aggccucuagaggacagauggccaggccugug

SEQ ID NO: 57046 - RNA, 32 nt, Human
aggccucucaauccucccuccaugaucuucgc

SEQ ID NO: 57047 - RNA, 32 nt, Human
aggccucucaccucugugccucugucuccuug

SEQ ID NO: 57048 - RNA, 32 nt, Human
aggccucuccagcccuccucuggccacccaaa

SEQ ID NO: 57049 - RNA, 32 nt, Human
aggccucucccuccuccaggaagccuuccccu

SEQ ID NO: 57050 - RNA, 32 nt, Human
aggccucuccuccaaccucccacuccuucuca

SEQ ID NO: 57051 - RNA, 32 nt, Human
aggccucuccuccccucugcccccggcucuua

SEQ ID NO: 57052 - RNA, 28 nt, Human
aggccucucgcugccucauccucugaca

SEQ ID NO: 57053 - RNA, 32 nt, Human
aggccucucucucgcucucucucccucuaauc

SEQ ID NO: 57054 - RNA, 32 nt, Human
aggccucugaccccaucucccccuagcuccuc

SEQ ID NO: 57055 - RNA, 32 nt, Human
aggccucugccucugggccuuugcuuuguggc

SEQ ID NO: 57056 - RNA, 32 nt, Human
aggccucugcuccacccuccauuccuccuccc

SEQ ID NO: 57057 - RNA, 32 nt, Human
aggccucugcuccugcuccugccugcauguuc

SEQ ID NO: 57058 - RNA, 32 nt, Human
aggccucugcuccuugucuuucuuaccuguaa

SEQ ID NO: 57059 - RNA, 32 nt, Human
aggccucugcucucacugucccucucugucug

SEQ ID NO: 57060 - RNA, 32 nt, Human
aggccucugcucugccuccugaggcagguuuu

SEQ ID NO: 57061 - RNA, 32 nt, Human
aggccucugggguccagccugggagcccagac

SEQ ID NO: 57062 - RNA, 32 nt, Human
aggccucugugccaaucccagcacuccuuucc

SEQ ID NO: 57063 - RNA, 32 nt, Human
aggccucuguggccuccacuccgggaaagccc

SEQ ID NO: 57064 - RNA, 32 nt, Human
aggccucuucccuuccccaacacccucccauc

SEQ ID NO: 57065 - RNA, 32 nt, Human
aggccucuuuacaaggcccagcuccuugacaa

SEQ ID NO: 57066 - RNA, 32 nt, Human
aggccucuuugcucuccccucuugccucagga

SEQ ID NO: 57067 - RNA, 32 nt, Human
aggccugaaagcuagugaugaagaacuaaaug

SEQ ID NO: 57068 - RNA, 21 nt, Human
aggccugaaaggccauuacua

SEQ ID NO: 57069 - RNA, 32 nt, Human
aggccugaauauuuggacaagauggcagauuc

SEQ ID NO: 57070 - RNA, 32 nt, Human
aggccugacaaacauggagaaaugucaucccu

SEQ ID NO: 57071 - RNA, 32 nt, Human
aggccugaccuccagagcccagcguucaguua

SEQ ID NO: 57072 - RNA, 32 nt, Human
aggccugaccugugccucaucccgugccgcuc

SEQ ID NO: 57073 - RNA, 31 nt, Human
aggccugacuucucugggcugaggcuggucg

SEQ ID NO: 57074 - RNA, 32 nt, Human
aggccugagaagggguugcagcuguucugggc

SEQ ID NO: 57075 - RNA, 22 nt, Human
aggccugagccaccgcgcccgg

SEQ ID NO: 57076 - RNA, 22 nt, Human
aggccugagccaccgcguccgg

SEQ ID NO: 57077 - RNA, 32 nt, Human
aggccugagcugccccucccacugccuuuccu

SEQ ID NO: 57078 - RNA, 32 nt, Human
aggccugaggagcccuccuggagcucaggagg

SEQ ID NO: 57079 - RNA, 32 nt, Human
aggccugaggagggaauggaagguggaguuuc

SEQ ID NO: 57080 - RNA, 32 nt, Human
aggccugaggcaggcuguggccaggcucaggc

SEQ ID NO: 57081 - RNA, 32 nt, Human
aggccugagggagggaggcgcauggaagccgc

SEQ ID NO: 57082 - RNA, 27 nt, Human
aggccugaggugugugccacucagaga

SEQ ID NO: 57083 - RNA, 21 nt, Human
aggccugaguagcuccccucc

SEQ ID NO: 57084 - RNA, 32 nt, Human
aggccugagucaugauuggcucuggugugcuu

SEQ ID NO: 57085 - RNA, 32 nt, Human
aggccugaguuagcuguuuacugacauggugc

SEQ ID NO: 57086 - RNA, 32 nt, Human
aggccugaugaagccuaucugcagagguuggc

SEQ ID NO: 57087 - RNA, 32 nt, Human
aggccugauggagcuuguggcuggccucagau

SEQ ID NO: 57088 - RNA, 32 nt, Human
aggccugcacacaagcccacagcacagcuccc

SEQ ID NO: 57089 - RNA, 32 nt, Human
aggccugcacaucgaagguggggugggaccag

SEQ ID NO: 57090 - RNA, 32 nt, Human
aggccugcagauccagccuuccugucaacagc

SEQ ID NO: 57091 - RNA, 32 nt, Human
aggccugcagcaggagcggccaugaagaagcu

SEQ ID NO: 57092 - RNA, 32 nt, Human
aggccugcagcccagcacaggaaggaggggug

SEQ ID NO: 57093 - RNA, 32 nt, Human
aggccugcagggguggagggcagucccucaga

SEQ ID NO: 57094 - RNA, 32 nt, Human
aggccugcauguggagagauaaaacccagaca

SEQ ID NO: 57095 - RNA, 32 nt, Human
aggccugccacuggucauggguagcuagagcu

SEQ ID NO: 57096 - RNA, 22 nt, Human
aggccugcccacaacaccccag

SEQ ID NO: 57097 - RNA, 32 nt, Human
aggccugcccacuaaggaggaggagucauugc

SEQ ID NO: 57098 - RNA, 32 nt, Human
aggccugccccagcuacgccacgugcccagug

SEQ ID NO: 57099 - RNA, 22 nt, Human
aggccugccccucuccagccag

SEQ ID NO: 57100 - RNA, 32 nt, Human
aggccugcccggagccccagccccaggggacc

SEQ ID NO: 57101 - RNA, 32 nt, Human
aggccugcccucacgcucuccaucauaggcug

SEQ ID NO: 57102 - RNA, 24 nt, Human
aggccugcccucggccugguccag

SEQ ID NO: 57103 - RNA, 21 nt, Human
aggccugcccugaaacuccag

SEQ ID NO: 57104 - RNA, 32 nt, Human
aggccugcccuuccuuucucuguuucuauuag

SEQ ID NO: 57105 - RNA, 32 nt, Human
aggccugccugauuugggccacauagaucugg

SEQ ID NO: 57106 - RNA, 32 nt, Human
aggccugccuggggagucgugucccucagcug

SEQ ID NO: 57107 - RNA, 24 nt, Human
aggccugccuuccccucccuccca

SEQ ID NO: 57108 - RNA, 24 nt, Human
aggccugccuuuugccuggcccag

SEQ ID NO: 57109 - RNA, 32 nt, Human
aggccugcguguggcccuggccgugagugugc

SEQ ID NO: 57110 - RNA, 32 nt, Human
aggccugcucacaacugccccucaaguucaac

SEQ ID NO: 57111 - RNA, 32 nt, Human
aggccugcucaccaaucuuucuuucacaccgu

SEQ ID NO: 57112 - RNA, 32 nt, Human
aggccugcuccuggaccucuuuaugauauugu

SEQ ID NO: 57113 - RNA, 32 nt, Human
aggccugcuccuggggcccgugggggcccugu

SEQ ID NO: 57114 - RNA, 32 nt, Human
aggccugcucuaggaaggcagcaugcucagug

SEQ ID NO: 57115 - RNA, 32 nt, Human
aggccugcuggcaucaggucugggcaaguagc

SEQ ID NO: 57116 - RNA, 32 nt, Human
aggccugcugugcaguugccucuaggugacuu

SEQ ID NO: 57117 - RNA, 32 nt, Human
aggccugcuugacuuuccagaaugaccuugag

SEQ ID NO: 57118 - RNA, 32 nt, Human
aggccugcuuucuuugcuuucucuucucaccu

SEQ ID NO: 57119 - RNA, 32 nt, Human
aggccuggaagaggccgcccucgucuugucuc

SEQ ID NO: 57120 - RNA, 32 nt, Human
aggccuggaauccugcagcccuccccaaaaac

SEQ ID NO: 57121 - RNA, 23 nt, Human
aggccuggacacugguucaacac

SEQ ID NO: 57122 - RNA, 18 nt, Human
aggccuggacucuccuca

SEQ ID NO: 57123 - RNA, 32 nt, Human
aggccuggagagugccugucugggaaaagguc

SEQ ID NO: 57124 - RNA, 32 nt, Human
aggccuggagcuuggggugaggaagagggagg

SEQ ID NO: 57125 - RNA, 32 nt, Human
aggccuggaggaggggaacgagaggcuagagg

SEQ ID NO: 57126 - RNA, 32 nt, Human
aggccuggagucggcccccaaaaguuucacau

SEQ ID NO: 57127 - RNA, 32 nt, Human
aggccuggauucuuuugaguggugcuacugcc

SEQ ID NO: 57128 - RNA, 17 nt, Human
aggccuggcaccuacuc

SEQ ID NO: 57129 - RNA, 32 nt, Human
aggccuggcagagagcguccccgcggucgcgg

SEQ ID NO: 57130 - RNA, 32 nt, Human
aggccuggcaggcagaagcagcuguggucccu

SEQ ID NO: 57131 - RNA, 32 nt, Human
aggccuggcaggcaggcuuggcaugguuggcc

SEQ ID NO: 57132 - RNA, 32 nt, Human
aggccuggcccagccuggcccagaucuucuca

SEQ ID NO: 57133 - RNA, 32 nt, Human
aggccuggcuccuuauucacacccugcuucua

SEQ ID NO: 57134 - RNA, 32 nt, Human
aggccuggcuuccucucuugggagaccccuuc

SEQ ID NO: 57135 - RNA, 32 nt, Human
aggccugggaaccuggcugcagccugggaagg

SEQ ID NO: 57136 - RNA, 21 nt, Human
aggccugggacuuuccaacac

SEQ ID NO: 57137 - RNA, 32 nt, Human
aggccugggaggaaagugggcgcagagcccuc

SEQ ID NO: 57138 - RNA, 32 nt, Human
aggccugggcaaaugcagcccugggucuuugg

SEQ ID NO: 57139 - RNA, 32 nt, Human
aggccugggcaggguuccgggugggagcucag

SEQ ID NO: 57140 - RNA, 32 nt, Human
aggccugggccagcugccacggaggggguccg

SEQ ID NO: 57141 - RNA, 20 nt, Human
aggccugggcccccucaggg

SEQ ID NO: 57142 - RNA, 32 nt, Human
aggccugggccgaccucacaccucagcccuug

SEQ ID NO: 57143 - RNA, 32 nt, Human
aggccugggcugggcacacuccaccuucccua

SEQ ID NO: 57144 - RNA, 32 nt, Human
aggccuggggaccucagagaacucugccuugc

SEQ ID NO: 57145 - RNA, 32 nt, Human
aggccuggggagccuguccuuccaugcccuug

SEQ ID NO: 57146 - RNA, 32 nt, Human
aggccuggggcacugcuuucugcuacaccucu

SEQ ID NO: 57147 - RNA, 32 nt, Human
aggccuggggcucaggugaguccucacaggcg

SEQ ID NO: 57148 - RNA, 32 nt, Human
aggccugggggcagggagaggagugacugagc

SEQ ID NO: 57149 - RNA, 32 nt, Human
aggccugggggucgcuuccagcugccagaucc

SEQ ID NO: 57150 - RNA, 32 nt, Human
aggccuggggugaaaugagaaaggcccagaac

SEQ ID NO: 57151 - RNA, 31 nt, Human
aggccugggguggaaaggcaggggagggagg

SEQ ID NO: 57152 - RNA, 32 nt, Human
aggccuggguagggacagggugguggucccug

SEQ ID NO: 57153 - RNA, 22 nt, Human
aggccuggguccugcccuccca

SEQ ID NO: 57154 - RNA, 32 nt, Human
aggccugggucuggagccguccuggccuuccc

SEQ ID NO: 57155 - RNA, 22 nt, Human
aggccuggucuccacccuccca

SEQ ID NO: 57156 - RNA, 32 nt, Human
aggccugguggagggggaggggagaagccaag

SEQ ID NO: 57157 - RNA, 32 nt, Human
aggccugguguguucaagaccagccuggucaa

SEQ ID NO: 57158 - RNA, 32 nt, Human
aggccugguuccugguuaauaagcucucagua

SEQ ID NO: 57159 - RNA, 32 nt, Human
aggccuguaaucccagcacuuuccaaggcagg

SEQ ID NO: 57160 - RNA, 22 nt, Human
aggccugucccuccagcagugg

SEQ ID NO: 57161 - RNA, 32 nt, Human
aggccugucucucaccaacaagccaacugcuc

SEQ ID NO: 57162 - RNA, 32 nt, Human
aggccugucuuaagaggacuugugcuuccagg

SEQ ID NO: 57163 - RNA, 32 nt, Human
aggccugucuuccaccccuccugacccguaua

SEQ ID NO: 57164 - RNA, 32 nt, Human
aggccugugaagccacgggcugggucauaagg

SEQ ID NO: 57165 - RNA, 21 nt, Human
aggccugugccacccgcugcc

SEQ ID NO: 57166 - RNA, 20 nt, Human
aggccugugccacuggugcc

SEQ ID NO: 57167 - RNA, 32 nt, Human
aggccugugccacuggugccagccuggaugca

SEQ ID NO: 57168 - RNA, 32 nt, Human
aggccugugcugcugccccacgcucaaacugu

SEQ ID NO: 57169 - RNA, 23 nt, Human
aggccuguggcucucagcagugg

SEQ ID NO: 57170 - RNA, 21 nt, Human
aggccugugggagcuucugcc

SEQ ID NO: 57171 - RNA, 32 nt, Human
aggccuguggguggaaggucucuggccuugga

SEQ ID NO: 57172 - RNA, 32 nt, Human
aggccuguggucccaggaaaaggucugggggu

SEQ ID NO: 57173 - RNA, 32 nt, Human
aggccuguggucccaggagaaggucugggggu

SEQ ID NO: 57174 - RNA, 32 nt, Human
aggccuguggugugacuucugccccgaaguuc

SEQ ID NO: 57175 - RNA, 18 nt, Human
aggccuguguccuaccca

SEQ ID NO: 57176 - RNA, 32 nt, Human
aggccugugugauucccggucugcaccacaug

SEQ ID NO: 57177 - RNA, 32 nt, Human
aggccuguugaagggcccuccuguagguuuca

SEQ ID NO: 57178 - RNA, 32 nt, Human
aggccuuacaucuggcuggaaagcagagccuc

SEQ ID NO: 57179 - RNA, 32 nt, Human
aggccuucaaggggucuuuccaugacugaguc

SEQ ID NO: 57180 - RNA, 32 nt, Human
aggccuucaaguccuuuccaccucucacccau

SEQ ID NO: 57181 - RNA, 32 nt, Human
aggccuucacagugucacccacauucaccucu

SEQ ID NO: 57182 - RNA, 32 nt, Human
aggccuucacccagacuuuaccgcggaggcgg

SEQ ID NO: 57183 - RNA, 32 nt, Human
aggccuucacugaucccagccaccccagaaaa

SEQ ID NO: 57184 - RNA, 32 nt, Human
aggccuucacugcagccccaucuccuccuccu

SEQ ID NO: 57185 - RNA, 32 nt, Human
aggccuucagacuuggacugugucacacugcc

SEQ ID NO: 57186 - RNA, 32 nt, Human
aggccuucagggccagugucuccaugcagauc

SEQ ID NO: 57187 - RNA, 32 nt, Human
aggccuuccaaggggguuucagucuggacuua

SEQ ID NO: 57188 - RNA, 32 nt, Human
aggccuuccacgcagaaugacaagacugcaaa

SEQ ID NO: 57189 - RNA, 32 nt, Human
aggccuuccuaaguuuuuguuaguugugucuu

SEQ ID NO: 57190 - RNA, 20 nt, Human
aggccuuccuuccucagcuc

SEQ ID NO: 57191 - RNA, 17 nt, Human
aggccuucuaggugaga

SEQ ID NO: 57192 - RNA, 32 nt, Human
aggccuucucucugccuaccagcccucaccag

SEQ ID NO: 57193 - RNA, 32 nt, Human
aggccuugaacucugucgguugugcugacucc

SEQ ID NO: 57194 - RNA, 32 nt, Human
aggccuugaagaacuccgauauuuauguuugg

SEQ ID NO: 57195 - RNA, 32 nt, Human
aggccuugagcagcgggcugagcaggcggcag

SEQ ID NO: 57196 - RNA, 32 nt, Human
aggccuugagggaaguagaggcugggagcaaa

SEQ ID NO: 57197 - RNA, 22 nt, Human
aggccuugccccugcccuccca

SEQ ID NO: 57198 - RNA, 21 nt, Human
aggccuugcggcuccucaggg

SEQ ID NO: 57199 - RNA, 32 nt, Human
aggccuuggaaccugagcugccaaugccagcc

SEQ ID NO: 57200 - RNA, 26 nt, Human
aggccuuggacggaguccaggccaga

SEQ ID NO: 57201 - RNA, 32 nt, Human
aggccuuggauucucauaagaagcacgcaacc

SEQ ID NO: 57202 - RNA, 32 nt, Human
aggccuuggcauccugagcuucggucugucca

SEQ ID NO: 57203 - RNA, 32 nt, Human
aggccuugggaccuggggguuggugauuuggg

SEQ ID NO: 57204 - RNA, 32 nt, Human
aggccuugggcuguggaccuggggguuggaag

SEQ ID NO: 57205 - RNA, 32 nt, Human
aggccuuggggcuccgagucccuuccucuccc

SEQ ID NO: 57206 - RNA, 32 nt, Human
aggccuuggugacuuccuggggccaagaaacu

SEQ ID NO: 57207 - RNA, 32 nt, Human
aggccuuguacggggagggcccaggggcagga

SEQ ID NO: 57208 - RNA, 32 nt, Human
aggccuugugagaacugaaaggucucuuucau

SEQ ID NO: 57209 - RNA, 24 nt, Human
aggccuuuagcauaauacuguaaa

SEQ ID NO: 57210 - RNA, 32 nt, Human
aggccuuuagugugcucaacucaggccuuaaa

SEQ ID NO: 57211 - RNA, 32 nt, Human
aggccuuucgcuuccuccucagguuuuccagg

SEQ ID NO: 57212 - RNA, 32 nt, Human
aggccuuucugaaggaguuauucugcuaaaaa

SEQ ID NO: 57213 - RNA, 32 nt, Human
aggccuuugagcauauggguccagccacucag

SEQ ID NO: 57214 - RNA, 32 nt, Human
aggccuuuucccucgcccaugugggucagugg

SEQ ID NO: 57215 - RNA, 32 nt, Human
aggccuuuuugguauuucaggagggguugcua

SEQ ID NO: 57216 - RNA, 32 nt, Human
aggcgaagaggaagggcaagguggcucccucc

SEQ ID NO: 57217 - RNA, 32 nt, Human
aggcgaagccgcggcuccccagcccuuugcug

SEQ ID NO: 57218 - RNA, 32 nt, Human
aggcgaagcugcagaugccauuccagagcggg

SEQ ID NO: 57219 - RNA, 32 nt, Human
aggcgaaggaagggagguggcuccugggucau

SEQ ID NO: 57220 - RNA, 32 nt, Human
aggcgaaggugaccggggaccgagcauuucag

SEQ ID NO: 57221 - RNA, 32 nt, Human
aggcgaaucuggcuuugggggaagaggaagaa

SEQ ID NO: 57222 - RNA, 32 nt, Human
aggcgaauuggcugcccggggugcaggaggga

SEQ ID NO: 57223 - RNA, 32 nt, Human
aggcgacaggagaccguugcuccagugcaugu

SEQ ID NO: 57224 - RNA, 32 nt, Human
aggcgacagggagggucagagggaggccggcu

SEQ ID NO: 57225 - RNA, 19 nt, Human
aggcgacgcuaaaccaaga

SEQ ID NO: 57226 - RNA, 32 nt, Human
aggcgacggaggaggaagaagcagguuggucc

SEQ ID NO: 57227 - RNA, 23 nt, Human
aggcgacuagggcaccauacuca

SEQ ID NO: 57228 - RNA, 32 nt, Human
aggcgacucacacaccacaccugauuccuguu

SEQ ID NO: 57229 - RNA, 32 nt, Human
aggcgacugcugggccuccugccuggccgccc

SEQ ID NO: 57230 - RNA, 29 nt, Human
aggcgacuguagucccagcuacucaggag

SEQ ID NO: 57231 - RNA, 32 nt, Human
aggcgacuuugguggagguaguucuuuggcag

SEQ ID NO: 57232 - RNA, 32 nt, Human
aggcgagacacaaaaaggccugggacaggguc

SEQ ID NO: 57233 - RNA, 24 nt, Human
aggcgagagccacugcauccagug

SEQ ID NO: 57234 - RNA, 32 nt, Human
aggcgagaggaggaggaggaggaggagaaggc

SEQ ID NO: 57235 - RNA, 32 nt, Human
aggcgagaggggucaggagaggcgggagcaau

SEQ ID NO: 57236 - RNA, 32 nt, Human
aggcgagcacccgggagccagcgggaccuggg

SEQ ID NO: 57237 - RNA, 32 nt, Human
aggcgagcagaacucccccuggggaggaagcu

SEQ ID NO: 57238 - RNA, 26 nt, Human
aggcgagcagaucaccgaaggucagg

SEQ ID NO: 57239 - RNA, 24 nt, Human
aggcgagcagaucacgaggucagg

SEQ ID NO: 57240 - RNA, 32 nt, Human
aggcgagcagcuccuggcugggcugggcagac

SEQ ID NO: 57241 - RNA, 32 nt, Human
aggcgagcagcucugcaguuaaugcacguauu

SEQ ID NO: 57242 - RNA, 32 nt, Human
aggcgagcccaggacucgugcugcacgccggg

SEQ ID NO: 57243 - RNA, 19 nt, Human
aggcgagcccuccccagca

SEQ ID NO: 57244 - RNA, 32 nt, Human
aggcgagccgagccgagcgagcgcggcggugg

SEQ ID NO: 57245 - RNA, 32 nt, Human
aggcgagccugugacagagcgagacccugucu

SEQ ID NO: 57246 - RNA, 32 nt, Human
aggcgagcgagcccagccagcccagccagccc

SEQ ID NO: 57247 - RNA, 23 nt, Human
aggcgagcggaucaugaggucag

SEQ ID NO: 57248 - RNA, 32 nt, Human
aggcgaggaaacugaggcucggcugguggcgc

SEQ ID NO: 57249 - RNA, 32 nt, Human
aggcgaggaaggagggagugugugagaggagg

SEQ ID NO: 57250 - RNA, 32 nt, Human
aggcgaggaggaagauggcgggacggcugccg

SEQ ID NO: 57251 - RNA, 32 nt, Human
aggcgaggcagguagaucaugaggucaggaga

SEQ ID NO: 57252 - RNA, 32 nt, Human
aggcgaggcccaggccgcggccgacaugaacc

SEQ ID NO: 57253 - RNA, 32 nt, Human
aggcgaggcugagcgaaagaaggaaggacaga

SEQ ID NO: 57254 - RNA, 32 nt, Human
aggcgaggcugcagccagagggcugggaaggg

SEQ ID NO: 57255 - RNA, 32 nt, Human
aggcgagggaaaggacccuuuucucugaguaa

SEQ ID NO: 57256 - RNA, 32 nt, Human
aggcgagggcaagaagccugguggcgggucaa

SEQ ID NO: 57257 - RNA, 32 nt, Human
aggcgaggucgauggaacuggccacgcacagg

SEQ ID NO: 57258 - RNA, 32 nt, Human
aggcgagucagccuaggaggaggcagggcucc

SEQ ID NO: 57259 - RNA, 32 nt, Human
aggcgagucagggugccacaagagauagguuc

SEQ ID NO: 57260 - RNA, 26 nt, Human
aggcgagugaaucacuugaggucagg

SEQ ID NO: 57261 - RNA, 24 nt, Human
aggcgaguggaucacgaggucagg

SEQ ID NO: 57262 - RNA, 26 nt, Human
aggcgaguggaucacuugaggucagg

SEQ ID NO: 57263 - RNA, 26 nt, Human
aggcgaguggauuuccuaaggucagg

SEQ ID NO: 57264 - RNA, 32 nt, Human
aggcgaguggugcugaggugcucuguggugau

SEQ ID NO: 57265 - RNA, 32 nt, Human
aggcgaguugcauuucugaaagcccgggaaga

SEQ ID NO: 57266 - RNA, 19 nt, Human
aggcgaucagugggccagg

SEQ ID NO: 57267 - RNA, 19 nt, Human
aggcgaugaaccucggggg

SEQ ID NO: 57268 - RNA, 32 nt, Human
aggcgaugcccuuugugcuguaugacuggagg

SEQ ID NO: 57269 - RNA, 32 nt, Human
aggcgaugcugaugcugccaguccaggaacca

SEQ ID NO: 57270 - RNA, 32 nt, Human
aggcgauggccaccccagaggccaccuuuugc

SEQ ID NO: 57271 - RNA, 32 nt, Human
aggcgauguacaaaugaaagcgcgcuuucuaa

SEQ ID NO: 57272 - RNA, 32 nt, Human
aggcgauguggaccacgggauuuguagccagc

SEQ ID NO: 57273 - RNA, 32 nt, Human
aggcgcaaacuggaggcccucacagcccacua

SEQ ID NO: 57274 - RNA, 32 nt, Human
aggcgcaggaagcagaagcgcagagcgaggac

SEQ ID NO: 57275 - RNA, 32 nt, Human
aggcgcaggagcagugucgggccugggccggg

SEQ ID NO: 57276 - RNA, 32 nt, Human
aggcgcaggauccacggaagucaaagucaagc

SEQ ID NO: 57277 - RNA, 32 nt, Human
aggcgcaggcagcuggggguguguggggaaga

SEQ ID NO: 57278 - RNA, 32 nt, Human
aggcgcaggccgcggcggcgggggcgggcgug

SEQ ID NO: 57279 - RNA, 32 nt, Human
aggcgcauccugcagcccaugcuugaugccag

SEQ ID NO: 57280 - RNA, 32 nt, Human
aggcgcauucgcccuuccuaguuugcagcaau

SEQ ID NO: 57281 - RNA, 32 nt, Human
aggcgccaccacugaugccacccaggaccucg

SEQ ID NO: 57282 - RNA, 18 nt, Human
aggcgccacuguugagaa

SEQ ID NO: 57283 - RNA, 21 nt, Human
aggcgccagccccucccuccc

SEQ ID NO: 57284 - RNA, 32 nt, Human
aggcgccaguagucccagcuacuugggaggcc

SEQ ID NO: 57285 - RNA, 32 nt, Human
aggcgccauggacuggaagacacuccaggccc

SEQ ID NO: 57286 - RNA, 32 nt, Human
aggcgcccagcccuggcucuuccaugcucugc

SEQ ID NO: 57287 - RNA, 32 nt, Human
aggcgccccaagacggacaguguacauaagag

SEQ ID NO: 57288 - RNA, 32 nt, Human
aggcgcccccacacccgggcccggcuaagcgc

SEQ ID NO: 57289 - RNA, 32 nt, Human
aggcgcccugcucuucccacugcugucccugg

SEQ ID NO: 57290 - RNA, 32 nt, Human
aggcgccgaggaggaagagcgagcccggacgg

SEQ ID NO: 57291 - RNA, 20 nt, Human
aggcgccggagaaccagggg

SEQ ID NO: 57292 - RNA, 32 nt, Human
aggcgccggcagugaccaggagcaaugugcag

SEQ ID NO: 57293 - RNA, 32 nt, Human
aggcgccuauaaccccagcuauuugggaggcu

SEQ ID NO: 57294 - RNA, 32 nt, Human
aggcgccuauaaucccagcuacucaggaggcu

SEQ ID NO: 57295 - RNA, 32 nt, Human
aggcgccuauaaucccagcuacucaggagucu

SEQ ID NO: 57296 - RNA, 32 nt, Human
aggcgccuauaaucccagcuacuggggaggcu

SEQ ID NO: 57297 - RNA, 32 nt, Human
aggcgccuauagucccagcuacucaggaggcc

SEQ ID NO: 57298 - RNA, 32 nt, Human
aggcgccugaaaucccagcuacucaagaggcu

SEQ ID NO: 57299 - RNA, 32 nt, Human
aggcgccugcaaucacagcuacucaggaggcu

SEQ ID NO: 57300 - RNA, 32 nt, Human
aggcgccugcagccgcacucgccagcgacuca

SEQ ID NO: 57301 - RNA, 32 nt, Human
aggcgccugcucauguugaagugcgcuguuca

SEQ ID NO: 57302 - RNA, 32 nt, Human
aggcgccuguaauccagcuacucgggaggcug

SEQ ID NO: 57303 - RNA, 32 nt, Human
aggcgccuguaaucccagcuaaaggaggcuga

SEQ ID NO: 57304 - RNA, 32 nt, Human
aggcgccuguaaucccagcuacucaggaggcu

SEQ ID NO: 57305 - RNA, 32 nt, Human
aggcgccuguaaucccagcuacucgggaggcc

SEQ ID NO: 57306 - RNA, 32 nt, Human
aggcgccuguaaucccagcuacuggggaggcu

SEQ ID NO: 57307 - RNA, 32 nt, Human
aggcgccuguaaucccagcuacuuggaaggcu

SEQ ID NO: 57308 - RNA, 32 nt, Human
aggcgccuguaaucccagcuacuugggaggcu

SEQ ID NO: 57309 - RNA, 32 nt, Human
aggcgccuguaaucccagcuauuugggaggcu

SEQ ID NO: 57310 - RNA, 32 nt, Human
aggcgccuguaaucccaguuacucaguagcug

SEQ ID NO: 57311 - RNA, 32 nt, Human
aggcgccuguaaucucagcuacuugaaaggcu

SEQ ID NO: 57312 - RNA, 32 nt, Human
aggcgccuguagucccagcuacucaggaggcu

SEQ ID NO: 57313 - RNA, 32 nt, Human
aggcgccuguagucccagcuacucggaggcug

SEQ ID NO: 57314 - RNA, 32 nt, Human
aggcgccuguagucccagcuacucgggaggcu

SEQ ID NO: 57315 - RNA, 32 nt, Human
aggcgccuguagucccagcuacuggggaggcu

SEQ ID NO: 57316 - RNA, 32 nt, Human
aggcgccuguagucccagcuacuugggaggcc

SEQ ID NO: 57317 - RNA, 32 nt, Human
aggcgccuguagucccagcuacuugggaggcu

SEQ ID NO: 57318 - RNA, 32 nt, Human
aggcgccuguagucucagcuacucgggaggcu

SEQ ID NO: 57319 - RNA, 32 nt, Human
aggcgccuguaucccagcuacuugggaggcag

SEQ ID NO: 57320 - RNA, 32 nt, Human
aggcgccuguggucccagcuacucgggaggcu

SEQ ID NO: 57321 - RNA, 32 nt, Human
aggcgccuuugguaacagaagagaagacugug

SEQ ID NO: 57322 - RNA, 32 nt, Human
aggcgcgaccagaucugggugcgcggagagcg

SEQ ID NO: 57323 - RNA, 32 nt, Human
aggcgcgagaggaggggaugggcggggcgcgc

SEQ ID NO: 57324 - RNA, 22 nt, Human
aggcgcgagccacugcguccgg

SEQ ID NO: 57325 - RNA, 32 nt, Human
aggcgcgaggugucuuuauuuaaucugcuccg

SEQ ID NO: 57326 - RNA, 32 nt, Human
aggcgcgcagcggcucaugccuguaaucccag

SEQ ID NO: 57327 - RNA, 32 nt, Human
aggcgcgcaucccuccugacugggacgucgcc

SEQ ID NO: 57328 - RNA, 22 nt, Human
aggcgcgccgacgccugugcca

SEQ ID NO: 57329 - RNA, 32 nt, Human
aggcgcgcucggagggaagccgccaccgcgcc

SEQ ID NO: 57330 - RNA, 32 nt, Human
aggcgcggaaccugcgcugggcugaccuugag

SEQ ID NO: 57331 - RNA, 32 nt, Human
aggcgcggagcgagcuuauuccccgcucccgg

SEQ ID NO: 57332 - RNA, 32 nt, Human
aggcgcggcaggcggcaggucccggccgaagg

SEQ ID NO: 57333 - RNA, 32 nt, Human
aggcgcgggaggcggcagccgcagcgaggagg

SEQ ID NO: 57334 - RNA, 32 nt, Human
aggcgcggugggcuccgggcccaggcaccgag

SEQ ID NO: 57335 - RNA, 32 nt, Human
aggcgcguuccauggcccugcccacccaggca

SEQ ID NO: 57336 - RNA, 32 nt, Human
aggcgcguuccuuccucuuccucucuccucuc

SEQ ID NO: 57337 - RNA, 32 nt, Human
aggcgcuagauuuggugcugggcugauggguc

SEQ ID NO: 57338 - RNA, 31 nt, Human
aggcgcucaauaaauacuuguuuguugaaug

SEQ ID NO: 57339 - RNA, 32 nt, Human
aggcgcuccagccccagagccagcgucuucau

SEQ ID NO: 57340 - RNA, 32 nt, Human
aggcgcuccucccucacgcaggagacucaguu

SEQ ID NO: 57341 - RNA, 20 nt, Human
aggcgcucgccgccucgggg

SEQ ID NO: 57342 - RNA, 32 nt, Human
aggcgcucuccuccuucucugccuguuucccu

SEQ ID NO: 57343 - RNA, 32 nt, Human
aggcgcugcagcugugcuacagacacaagagg

SEQ ID NO: 57344 - RNA, 32 nt, Human
aggcgcuggagcaacagcuccccacacugcac

SEQ ID NO: 57345 - RNA, 31 nt, Human
aggcgcuggccuccugggccuugccguccag

SEQ ID NO: 57346 - RNA, 32 nt, Human
aggcgcugggagaaagaaccggcucccgaguu

SEQ ID NO: 57347 - RNA, 32 nt, Human
aggcgcugggggagggccagcccacaccuagc

SEQ ID NO: 57348 - RNA, 32 nt, Human
aggcgcuguagcuucggggaucccccgaggcu

SEQ ID NO: 57349 - RNA, 32 nt, Human
aggcgcugucauggaggacgccgccgcgccgg

SEQ ID NO: 57350 - RNA, 32 nt, Human
aggcgcugugcuucugugaggugguuuagcuu

SEQ ID NO: 57351 - RNA, 32 nt, Human
aggcgcuuacucuccuccgcucaggcccccaa

SEQ ID NO: 57352 - RNA, 32 nt, Human
aggcgcuucuagguugcuggggcucugcuggu

SEQ ID NO: 57353 - RNA, 32 nt, Human
aggcgcuuguaaucccagcuacuugggaggcu

SEQ ID NO: 57354 - RNA, 32 nt, Human
aggcgcuuguuuuggaccauugcacaaacccg

SEQ ID NO: 57355 - RNA, 19 nt, Human
aggcggaaguugcagugag

SEQ ID NO: 57356 - RNA, 32 nt, Human
aggcggaauugcuuucuucugagccggguggg

SEQ ID NO: 57357 - RNA, 32 nt, Human
aggcggacacugguccagugaggcccagagcc

SEQ ID NO: 57358 - RNA, 26 nt, Human
aggcggacagaccaccugaggucagg

SEQ ID NO: 57359 - RNA, 24 nt, Human
aggcggacagaucacgaggucagg

SEQ ID NO: 57360 - RNA, 32 nt, Human
aggcggaccagccugccucugugaugacugca

SEQ ID NO: 57361 - RNA, 32 nt, Human
aggcggaccaggagaagagcaaagaaaagcag

SEQ ID NO: 57362 - RNA, 32 nt, Human
aggcggaccaguggcccaggagccaugaggac

SEQ ID NO: 57363 - RNA, 32 nt, Human
aggcggaccucacccuucucuucccaggucua

SEQ ID NO: 57364 - RNA, 20 nt, Human
aggcggacgcugucucaggg

SEQ ID NO: 57365 - RNA, 26 nt, Human
aggcggacggaucaccugaggucagg

SEQ ID NO: 57366 - RNA, 24 nt, Human
aggcggacggaucacgaggucagg

SEQ ID NO: 57367 - RNA, 26 nt, Human
aggcggacggaucacuugagguuagg

SEQ ID NO: 57368 - RNA, 32 nt, Human
aggcggacgugaggacagccagcucccccucc

SEQ ID NO: 57369 - RNA, 19 nt, Human
aggcggagauugcagugag

SEQ ID NO: 57370 - RNA, 32 nt, Human
aggcggagcaggaggcagaggagcagauggag

SEQ ID NO: 57371 - RNA, 32 nt, Human
aggcggagcucaacgaccucauguggcgcggg

SEQ ID NO: 57372 - RNA, 19 nt, Human
aggcggagcuugcagggag

SEQ ID NO: 57373 - RNA, 30 nt, Human
aggcggagcuugcaguaagccgagacugag

SEQ ID NO: 57374 - RNA, 18 nt, Human
aggcggagcuugcaguga

SEQ ID NO: 57375 - RNA, 19 nt, Human
aggcggagcuugcagugag

SEQ ID NO: 57376 - RNA, 30 nt, Human
aggcggagcuugcagugagcagagaucacg

SEQ ID NO: 57377 - RNA, 30 nt, Human
aggcggagcuugcagugagcagagauugag

SEQ ID NO: 57378 - RNA, 30 nt, Human
aggcggagcuugcagugagccaagaccgca

SEQ ID NO: 57379 - RNA, 30 nt, Human
aggcggagcuugcagugagccaagauagug

SEQ ID NO: 57380 - RNA, 30 nt, Human
aggcggagcuugcagugagccaagaucaca

SEQ ID NO: 57381 - RNA, 30 nt, Human
aggcggagcuugcagugagccaagaucgca

SEQ ID NO: 57382 - RNA, 30 nt, Human
aggcggagcuugcagugagccaagaucgcg

SEQ ID NO: 57383 - RNA, 30 nt, Human
aggcggagcuugcagugagccaagauuacg

SEQ ID NO: 57384 - RNA, 30 nt, Human
aggcggagcuugcagugagccgagacugug

SEQ ID NO: 57385 - RNA, 30 nt, Human
aggcggagcuugcagugagcggagaucacg

SEQ ID NO: 57386 - RNA, 19 nt, Human
aggcggagcuugcggugag

SEQ ID NO: 57387 - RNA, 19 nt, Human
aggcggagcuuguagugag

SEQ ID NO: 57388 - RNA, 32 nt, Human
aggcggaggaacucccgagcugagaugcggaa

SEQ ID NO: 57389 - RNA, 24 nt, Human
aggcggaggcaggagaaucacuug

SEQ ID NO: 57390 - RNA, 32 nt, Human
aggcggaggcggaggcggagggcgaggggcgg

SEQ ID NO: 57391 - RNA, 32 nt, Human
aggcggaggcggaggcggcgggggcaggagga

SEQ ID NO: 57392 - RNA, 24 nt, Human
aggcggaggcggagguugcaguga

SEQ ID NO: 57393 - RNA, 32 nt, Human
aggcggaggcggagguugcagugagccaagau

SEQ ID NO: 57394 - RNA, 19 nt, Human
aggcggaggcugcagugag

SEQ ID NO: 57395 - RNA, 32 nt, Human
aggcggaggcugcuggugugaggaccaugcug

SEQ ID NO: 57396 - RNA, 19 nt, Human
aggcggagguggcagugag

SEQ ID NO: 57397 - RNA, 18 nt, Human
aggcggagguugcaguaa

SEQ ID NO: 57398 - RNA, 18 nt, Human
aggcggagguugcaguga

SEQ ID NO: 57399 - RNA, 19 nt, Human
aggcggagguugcagugag

SEQ ID NO: 57400 - RNA, 32 nt, Human
aggcggagguugcagugagccacugcacucca

SEQ ID NO: 57401 - RNA, 32 nt, Human
aggcggagguugcagugagccuggaucaugcc

SEQ ID NO: 57402 - RNA, 32 nt, Human
aggcggagguugcagugagcugagauugggcc

SEQ ID NO: 57403 - RNA, 32 nt, Human
aggcggagguugcagugaguugcagucacacc

SEQ ID NO: 57404 - RNA, 19 nt, Human
aggcggagguugcauugag

SEQ ID NO: 57405 - RNA, 19 nt, Human
aggcggagguugcggugag

SEQ ID NO: 57406 - RNA, 19 nt, Human
aggcggagguuguagugag

SEQ ID NO: 57407 - RNA, 32 nt, Human
aggcggagucugaggagcuggggaaggaacaa

SEQ ID NO: 57408 - RNA, 32 nt, Human
aggcggagugggaggagcuggagccaggcccg

SEQ ID NO: 57409 - RNA, 32 nt, Human
aggcggaguuuccaagacuugggugucaucau

SEQ ID NO: 57410 - RNA, 21 nt, Human
aggcggaguuucgccauguug

SEQ ID NO: 57411 - RNA, 19 nt, Human
aggcggaguuugcagugag

SEQ ID NO: 57412 - RNA, 32 nt, Human
aggcggaucgucucucagacuuggguuugcag

SEQ ID NO: 57413 - RNA, 32 nt, Human
aggcggaucugaggggcugggugcaggccccu

SEQ ID NO: 57414 - RNA, 26 nt, Human
aggcggauggaucaccugaggucagg

SEQ ID NO: 57415 - RNA, 26 nt, Human
aggcggauggaucaccugaggucggg

SEQ ID NO: 57416 - RNA, 32 nt, Human
aggcggauuagcuaucuuccaacaaugcugac

SEQ ID NO: 57417 - RNA, 32 nt, Human
aggcggcaaugcucccuccuucccagggucca

SEQ ID NO: 57418 - RNA, 32 nt, Human
aggcggcaccacugccgucauuucagcuucug

SEQ ID NO: 57419 - RNA, 32 nt, Human
aggcggcacgaccacaccaaauaacagcagca

SEQ ID NO: 57420 - RNA, 32 nt, Human
aggcggcacucugguggggcugcuccaggcau

SEQ ID NO: 57421 - RNA, 32 nt, Human
aggcggcagccgcggcggcggcggcugcagcg

SEQ ID NO: 57422 - RNA, 32 nt, Human
aggcggcagcuagccuggccaguggcuguccc

SEQ ID NO: 57423 - RNA, 32 nt, Human
aggcggcaggcagagaaguggagugacuauuu

SEQ ID NO: 57424 - RNA, 32 nt, Human
aggcggccacagcaggacuggccacacccacg

SEQ ID NO: 57425 - RNA, 32 nt, Human
aggcggccagggacucugccgaggcccugaga

SEQ ID NO: 57426 - RNA, 32 nt, Human
aggcggccagggugggagacuguucgccccgc

SEQ ID NO: 57427 - RNA, 32 nt, Human
aggcggcccugagcaccuggguucugacuuug

SEQ ID NO: 57428 - RNA, 20 nt, Human
aggcggcccuuuccucgggg

SEQ ID NO: 57429 - RNA, 32 nt, Human
aggcggccuaaggagauuccacacaugcguau

SEQ ID NO: 57430 - RNA, 32 nt, Human
aggcggccucagaacucagcugugacucuugc

SEQ ID NO: 57431 - RNA, 18 nt, Human
aggcggccucgccgggga

SEQ ID NO: 57432 - RNA, 32 nt, Human
aggcggccucgugccaugaucuguauuuaaug

SEQ ID NO: 57433 - RNA, 19 nt, Human
aggcggccuggggcggcgg

SEQ ID NO: 57434 - RNA, 32 nt, Human
aggcggccuugccacauauucuggcuccaggc

SEQ ID NO: 57435 - RNA, 32 nt, Human
aggcggcgacgguggcgccccuccucaucaug

SEQ ID NO: 57436 - RNA, 19 nt, Human
aggcggcgaggagaggcag

SEQ ID NO: 57437 - RNA, 32 nt, Human
aggcggcgccacagcccauggagcucgagaac

SEQ ID NO: 57438 - RNA, 32 nt, Human
aggcggcggcagcagaggcggcacuggcggca

SEQ ID NO: 57439 - RNA, 32 nt, Human
aggcggcggcagcagcggcggcaugaaccacu

SEQ ID NO: 57440 - RNA, 32 nt, Human
aggcggcggccauggcgggacaggaggauccg

SEQ ID NO: 57441 - RNA, 19 nt, Human
aggcggcggcggcggcgaa

SEQ ID NO: 57442 - RNA, 20 nt, Human
aggcggcggcggcucagggg

SEQ ID NO: 57443 - RNA, 32 nt, Human
aggcggcgggaugggagccgggucgucgugcg

SEQ ID NO: 57444 - RNA, 18 nt, Human
aggcggcuccggccaggg

SEQ ID NO: 57445 - RNA, 20 nt, Human
aggcggcucuccccaggcgg

SEQ ID NO: 57446 - RNA, 20 nt, Human
aggcggcucucgaucacggg

SEQ ID NO: 57447 - RNA, 18 nt, Human
aggcggcucugccgggga

SEQ ID NO: 57448 - RNA, 17 nt, Human
aggcggcugacguaagg

SEQ ID NO: 57449 - RNA, 18 nt, Human
aggcggcugagccggagg

SEQ ID NO: 57450 - RNA, 19 nt, Human
aggcggcugauccucaugg

SEQ ID NO: 57451 - RNA, 19 nt, Human
aggcggcugcagcaagcag

SEQ ID NO: 57452 - RNA, 18 nt, Human
aggcggcugcaguuucag

SEQ ID NO: 57453 - RNA, 20 nt, Human
aggcggcugccgggaagggg

SEQ ID NO: 57454 - RNA, 18 nt, Human
aggcggcugcggcucagg

SEQ ID NO: 57455 - RNA, 17 nt, Human
aggcggcugcggcugcu

SEQ ID NO: 57456 - RNA, 20 nt, Human
aggcggcugcgggucguggg

SEQ ID NO: 57457 - RNA, 19 nt, Human
aggcggcugcucgcggagg

SEQ ID NO: 57458 - RNA, 32 nt, Human
aggcggcugcuggggagccaggagaccgcgcg

SEQ ID NO: 57459 - RNA, 19 nt, Human
aggcggcuggcggaggugg

SEQ ID NO: 57460 - RNA, 32 nt, Human
aggcggcugggcagggcggcguggggcuucgc

SEQ ID NO: 57461 - RNA, 18 nt, Human
aggcggcugggccuaggg

SEQ ID NO: 57462 - RNA, 18 nt, Human
aggcggcugucccggagg

SEQ ID NO: 57463 - RNA, 17 nt, Human
aggcggcugucugaggg

SEQ ID NO: 57464 - RNA, 16 nt, Human
aggcggcuucccaggg

SEQ ID NO: 57465 - RNA, 20 nt, Human
aggcggcuuguguccacggg

SEQ ID NO: 57466 - RNA, 32 nt, Human
aggcggcuuuccucccccuggugugaggucgc

SEQ ID NO: 57467 - RNA, 32 nt, Human
aggcgggaacgcacuccuccggcuuuauucag

SEQ ID NO: 57468 - RNA, 21 nt, Human
aggcgggaagaucacaagguc

SEQ ID NO: 57469 - RNA, 24 nt, Human
aggcgggaagaucacaaggucagg

SEQ ID NO: 57470 - RNA, 32 nt, Human
aggcgggacucugaguuaucuaaugucagaca

SEQ ID NO: 57471 - RNA, 23 nt, Human
aggcgggagaauugcuugaaccc

SEQ ID NO: 57472 - RNA, 32 nt, Human
aggcgggagacagagcgcggcgaagagccauu

SEQ ID NO: 57473 - RNA, 19 nt, Human
aggcgggagcccgcagcgg

SEQ ID NO: 57474 - RNA, 24 nt, Human
aggcgggaggaucacaaggucagg

SEQ ID NO: 57475 - RNA, 24 nt, Human
aggcgggaggaucacaugagccca

SEQ ID NO: 57476 - RNA, 24 nt, Human
aggcgggaggaucacuugaaccua

SEQ ID NO: 57477 - RNA, 24 nt, Human
aggcgggaggaucacuugagccca

SEQ ID NO: 57478 - RNA, 24 nt, Human
aggcgggaggaucaugaggucagg

SEQ ID NO: 57479 - RNA, 24 nt, Human
aggcgggaggaucgcuugagccca

SEQ ID NO: 57480 - RNA, 24 nt, Human
aggcgggaggauggcaugagccca

SEQ ID NO: 57481 - RNA, 24 nt, Human
aggcgggaggauggcgugggccca

SEQ ID NO: 57482 - RNA, 24 nt, Human
aggcgggaggauggcuuuagccca

SEQ ID NO: 57483 - RNA, 24 nt, Human
aggcgggaggauuacuugagccca

SEQ ID NO: 57484 - RNA, 24 nt, Human
aggcgggaggauugcuugagccca

SEQ ID NO: 57485 - RNA, 23 nt, Human
aggcgggaggauugcuugaggcc

SEQ ID NO: 57486 - RNA, 23 nt, Human
aggcgggaggauugcuugagucc

SEQ ID NO: 57487 - RNA, 32 nt, Human
aggcgggaggcccgaggaagggagccugcugc

SEQ ID NO: 57488 - RNA, 32 nt, Human
aggcgggauacuuucagcuuuccauguaacug

SEQ ID NO: 57489 - RNA, 32 nt, Human
aggcgggauugcuugaguccagccugggcagu

SEQ ID NO: 57490 - RNA, 25 nt, Human
aggcgggcaaaucaccugaggucag

SEQ ID NO: 57491 - RNA, 32 nt, Human
aggcgggcacuggccucucaggagcaugcacc

SEQ ID NO: 57492 - RNA, 24 nt, Human
aggcgggcagaccaugaggucagg

SEQ ID NO: 57493 - RNA, 26 nt, Human
aggcgggcagauaaccugaggucagg

SEQ ID NO: 57494 - RNA, 24 nt, Human
aggcgggcagaucacaaggucagg

SEQ ID NO: 57495 - RNA, 26 nt, Human
aggcgggcagaucaccagaggucagg

SEQ ID NO: 57496 - RNA, 24 nt, Human
aggcgggcagaucaccugagguca

SEQ ID NO: 57497 - RNA, 26 nt, Human
aggcgggcagaucaccugaggucagg

SEQ ID NO: 57498 - RNA, 26 nt, Human
aggcgggcagaucaccugagguuagg

SEQ ID NO: 57499 - RNA, 24 nt, Human
aggcgggcagaucacgagaucagg

SEQ ID NO: 57500 - RNA, 21 nt, Human
aggcgggcagaucacgagguc

SEQ ID NO: 57501 - RNA, 22 nt, Human
aggcgggcagaucacgagguca

SEQ ID NO: 57502 - RNA, 23 nt, Human
aggcgggcagaucacgaggucag

SEQ ID NO: 57503 - RNA, 24 nt, Human
aggcgggcagaucacgaggucagg

SEQ ID NO: 57504 - RNA, 24 nt, Human
aggcgggcagaucacgagguuagg

SEQ ID NO: 57505 - RNA, 24 nt, Human
aggcgggcagaucacgaguucagg

SEQ ID NO: 57506 - RNA, 24 nt, Human
aggcgggcagaucacggggucagg

SEQ ID NO: 57507 - RNA, 26 nt, Human
aggcgggcagaucacuagaggucagg

SEQ ID NO: 57508 - RNA, 25 nt, Human
aggcgggcagaucacugaggucagg

SEQ ID NO: 57509 - RNA, 26 nt, Human
aggcgggcagaucacuugaggucagg

SEQ ID NO: 57510 - RNA, 26 nt, Human
aggcgggcagaucacuugaggucggg

SEQ ID NO: 57511 - RNA, 26 nt, Human
aggcgggcagaucaucugaggucagg

SEQ ID NO: 57512 - RNA, 26 nt, Human
aggcgggcagaucaucuggggucagg

SEQ ID NO: 57513 - RNA, 23 nt, Human
aggcgggcagaucaugaggucag

SEQ ID NO: 57514 - RNA, 24 nt, Human
aggcgggcagaucaugaggucagg

SEQ ID NO: 57515 - RNA, 25 nt, Human
aggcgggcagaucauuugaggucag

SEQ ID NO: 57516 - RNA, 26 nt, Human
aggcgggcagaugacuugaggucagg

SEQ ID NO: 57517 - RNA, 24 nt, Human
aggcgggcagauuacgaggucagg

SEQ ID NO: 57518 - RNA, 24 nt, Human
aggcgggcagauugcuugaaccca

SEQ ID NO: 57519 - RNA, 32 nt, Human
aggcgggcagcagccucuggggaggggaggua

SEQ ID NO: 57520 - RNA, 32 nt, Human
aggcgggcagcagccucuugggaggggaggug

SEQ ID NO: 57521 - RNA, 26 nt, Human
aggcgggcagcucaccugaggucagg

SEQ ID NO: 57522 - RNA, 32 nt, Human
aggcgggcagggcagacugacggacggacgac

SEQ ID NO: 57523 - RNA, 32 nt, Human
aggcgggcagggcagugggagagguggugugu

SEQ ID NO: 57524 - RNA, 24 nt, Human
aggcgggccgaucacgaggucagg

SEQ ID NO: 57525 - RNA, 32 nt, Human
aggcgggccuccucccaggcugcuccagacau

SEQ ID NO: 57526 - RNA, 24 nt, Human
aggcgggcgaaucacgaggucagg

SEQ ID NO: 57527 - RNA, 24 nt, Human
aggcgggcgcaucacgaggucagg

SEQ ID NO: 57528 - RNA, 32 nt, Human
aggcgggcgcucuggcccucccuuccuuaagc

SEQ ID NO: 57529 - RNA, 26 nt, Human
aggcgggcggaacaccugaggucagg

SEQ ID NO: 57530 - RNA, 26 nt, Human
aggcgggcggauagcuugaggucagg

SEQ ID NO: 57531 - RNA, 26 nt, Human
aggcgggcggaucaacugaggucggg

SEQ ID NO: 57532 - RNA, 24 nt, Human
aggcgggcggaucaauaggucagg

SEQ ID NO: 57533 - RNA, 21 nt, Human
aggcgggcggaucacaagguc

SEQ ID NO: 57534 - RNA, 24 nt, Human
aggcgggcggaucacaaggucagg

SEQ ID NO: 57535 - RNA, 24 nt, Human
aggcgggcggaucaccaggucagg

SEQ ID NO: 57536 - RNA, 26 nt, Human
aggcgggcggaucaccggaggucggg

SEQ ID NO: 57537 - RNA, 24 nt, Human
aggcgggcggaucaccugagguca

SEQ ID NO: 57538 - RNA, 25 nt, Human
aggcgggcggaucaccugaggucag

SEQ ID NO: 57539 - RNA, 26 nt, Human
aggcgggcggaucaccugaggucagg

SEQ ID NO: 57540 - RNA, 26 nt, Human
aggcgggcggaucaccugaggucggg

SEQ ID NO: 57541 - RNA, 24 nt, Human
aggcgggcggaucacgaaaucagg

SEQ ID NO: 57542 - RNA, 24 nt, Human
aggcgggcggaucacgaagucggg

SEQ ID NO: 57543 - RNA, 21 nt, Human
aggcgggcggaucacgagguc

SEQ ID NO: 57544 - RNA, 22 nt, Human
aggcgggcggaucacgagguca

SEQ ID NO: 57545 - RNA, 23 nt, Human
aggcgggcggaucacgaggucag

SEQ ID NO: 57546 - RNA, 24 nt, Human
aggcgggcggaucacgaggucagg

SEQ ID NO: 57547 - RNA, 24 nt, Human
aggcgggcggaucacgagguuagg

SEQ ID NO: 57548 - RNA, 24 nt, Human
aggcgggcggaucacuaggucagg

SEQ ID NO: 57549 - RNA, 26 nt, Human
aggcgggcggaucacucgaggucagg

SEQ ID NO: 57550 - RNA, 26 nt, Human
aggcgggcggaucacuugaggucagg

SEQ ID NO: 57551 - RNA, 26 nt, Human
aggcgggcggaucaucugaggucagg

SEQ ID NO: 57552 - RNA, 24 nt, Human
aggcgggcggaucaugaggucagg

SEQ ID NO: 57553 - RNA, 24 nt, Human
aggcgggcggaucaugagguuagg

SEQ ID NO: 57554 - RNA, 24 nt, Human
aggcgggcggaucgcagggucagg

SEQ ID NO: 57555 - RNA, 26 nt, Human
aggcgggcggaucgcuugaggucagg

SEQ ID NO: 57556 - RNA, 24 nt, Human
aggcgggcggaucucgaggucagg

SEQ ID NO: 57557 - RNA, 26 nt, Human
aggcgggcggaugaccugaggucagg

SEQ ID NO: 57558 - RNA, 26 nt, Human
aggcgggcggaugaguugaggucggg

SEQ ID NO: 57559 - RNA, 22 nt, Human
aggcgggcgggucacgagguca

SEQ ID NO: 57560 - RNA, 32 nt, Human
aggcgggcgugagacaagcccagcccgcacgc

SEQ ID NO: 57561 - RNA, 32 nt, Human
aggcgggcuggcgugggcucuucccccagccc

SEQ ID NO: 57562 - RNA, 32 nt, Human
aggcgggcuuccugccuggagcuguuuaauuu

SEQ ID NO: 57563 - RNA, 32 nt, Human
aggcggggaagcuccacuucagacagggcuug

SEQ ID NO: 57564 - RNA, 32 nt, Human
aggcggggaagcuuccucagccuugcagauau

SEQ ID NO: 57565 - RNA, 32 nt, Human
aggcggggacacaccuguguccuccgggagag

SEQ ID NO: 57566 - RNA, 32 nt, Human
aggcggggacaguggccaggaggcgagggcag

SEQ ID NO: 57567 - RNA, 32 nt, Human
aggcggggagagagugcuggaggcucuggggc

SEQ ID NO: 57568 - RNA, 24 nt, Human
aggcggggagaucacaaggucagg

SEQ ID NO: 57569 - RNA, 18 nt, Human
aggcggggaggaggcugc

SEQ ID NO: 57570 - RNA, 32 nt, Human
aggcggggagggagggaggguuggaggguuga

SEQ ID NO: 57571 - RNA, 20 nt, Human
aggcggggaggucucagggg

SEQ ID NO: 57572 - RNA, 32 nt, Human
aggcggggauugcaaaagucuccaguuaccag

SEQ ID NO: 57573 - RNA, 22 nt, Human
aggcggggcagcgggccugcag

SEQ ID NO: 57574 - RNA, 32 nt, Human
aggcggggcgugguggcucacacuuguaaucc

SEQ ID NO: 57575 - RNA, 32 nt, Human
aggcggggcuguacuguccgcuguuuggggag

SEQ ID NO: 57576 - RNA, 18 nt, Human
aggcgggggcccccgggg

SEQ ID NO: 57577 - RNA, 24 nt, Human
aggcggggggaucacaaggucagg

SEQ ID NO: 57578 - RNA, 21 nt, Human
aggcggggucucacuauauug

SEQ ID NO: 57579 - RNA, 23 nt, Human
aggcggggugggacuuccuuccu

SEQ ID NO: 57580 - RNA, 21 nt, Human
aggcgggguuucaccaugcug

SEQ ID NO: 57581 - RNA, 20 nt, Human
aggcgggguuucaccauguu

SEQ ID NO: 57582 - RNA, 21 nt, Human
aggcgggguuucaccauguug

SEQ ID NO: 57583 - RNA, 20 nt, Human
aggcgggguuucgccauguu

SEQ ID NO: 57584 - RNA, 21 nt, Human
aggcgggguuucgccauguug

SEQ ID NO: 57585 - RNA, 24 nt, Human
aggcggguagaucacaaggucagg

SEQ ID NO: 57586 - RNA, 32 nt, Human
aggcggguccaggacaucugagggcugacccu

SEQ ID NO: 57587 - RNA, 32 nt, Human
aggcgggucucgaacuccugaccucgugaucc

SEQ ID NO: 57588 - RNA, 26 nt, Human
aggcgggugaaucaccugaggucagg

SEQ ID NO: 57589 - RNA, 24 nt, Human
aggcgggugaaucacgaggucagg

SEQ ID NO: 57590 - RNA, 24 nt, Human
aggcgggugaaucaugaggucagg

SEQ ID NO: 57591 - RNA, 26 nt, Human
aggcgggugaaucccuuaaggucagg

SEQ ID NO: 57592 - RNA, 32 nt, Human
aggcgggugaggugaggagcagccccucgcgg

SEQ ID NO: 57593 - RNA, 32 nt, Human
aggcgggugagguuggugugagacugacggug

SEQ ID NO: 57594 - RNA, 32 nt, Human
aggcgggugcuggaagccagacggaacagugu

SEQ ID NO: 57595 - RNA, 26 nt, Human
aggcggguggaacacuugaggucagg

SEQ ID NO: 57596 - RNA, 26 nt, Human
aggcggguggaccaccugaggucagg

SEQ ID NO: 57597 - RNA, 24 nt, Human
aggcggguggaucaagaggucagg

SEQ ID NO: 57598 - RNA, 24 nt, Human
aggcggguggaucacaagcucagg

SEQ ID NO: 57599 - RNA, 21 nt, Human
aggcggguggaucacaagguc

SEQ ID NO: 57600 - RNA, 22 nt, Human
aggcggguggaucacaagguca

SEQ ID NO: 57601 - RNA, 24 nt, Human
aggcggguggaucacaaggucagg

SEQ ID NO: 57602 - RNA, 26 nt, Human
aggcggguggaucacccgaggucagg

SEQ ID NO: 57603 - RNA, 26 nt, Human
aggcggguggaucaccuaaggucagg

SEQ ID NO: 57604 - RNA, 32 nt, Human
aggcggguggaucaccugaggccagguguuug

SEQ ID NO: 57605 - RNA, 22 nt, Human
aggcggguggaucaccugaggu

SEQ ID NO: 57606 - RNA, 24 nt, Human
aggcggguggaucaccugagguca

SEQ ID NO: 57607 - RNA, 26 nt, Human
aggcggguggaucaccugaggucagg

SEQ ID NO: 57608 - RNA, 26 nt, Human
aggcggguggaucaccugaggucggg

SEQ ID NO: 57609 - RNA, 26 nt, Human
aggcggguggaucaccugagguuagg

SEQ ID NO: 57610 - RNA, 24 nt, Human
aggcggguggaucacgacgucagg

SEQ ID NO: 57611 - RNA, 24 nt, Human
aggcggguggaucacgagaucagg

SEQ ID NO: 57612 - RNA, 21 nt, Human
aggcggguggaucacgagguc

SEQ ID NO: 57613 - RNA, 22 nt, Human
aggcggguggaucacgagguca

SEQ ID NO: 57614 - RNA, 24 nt, Human
aggcggguggaucacgaggucagg

SEQ ID NO: 57615 - RNA, 24 nt, Human
aggcggguggaucacuaggucagg

SEQ ID NO: 57616 - RNA, 26 nt, Human
aggcggguggaucacucaaggucagg

SEQ ID NO: 57617 - RNA, 32 nt, Human
aggcggguggaucacuugaggccagguguuca

SEQ ID NO: 57618 - RNA, 25 nt, Human
aggcggguggaucacuugaggucag

SEQ ID NO: 57619 - RNA, 26 nt, Human
aggcggguggaucacuugaggucagg

SEQ ID NO: 57620 - RNA, 24 nt, Human
aggcggguggaucagaaggucagg

SEQ ID NO: 57621 - RNA, 26 nt, Human
aggcggguggaucaucugaggucagg

SEQ ID NO: 57622 - RNA, 24 nt, Human
aggcggguggaucaugaggucagg

SEQ ID NO: 57623 - RNA, 26 nt, Human
aggcggguggauccauugaggucagg

SEQ ID NO: 57624 - RNA, 24 nt, Human
aggcggguggauuacgaggucagg

SEQ ID NO: 57625 - RNA, 24 nt, Human
aggcggguggauugcuugagccca

SEQ ID NO: 57626 - RNA, 32 nt, Human
aggcggguggccuggcugugcuucauaugccc

SEQ ID NO: 57627 - RNA, 26 nt, Human
aggcgggugggucaccugaggucagg

SEQ ID NO: 57628 - RNA, 24 nt, Human
aggcggguguaucacgaggucagg

SEQ ID NO: 57629 - RNA, 32 nt, Human
aggcggguuucgaaauccugaccucaaaugau

SEQ ID NO: 57630 - RNA, 18 nt, Human
aggcgguaccuucagggg

SEQ ID NO: 57631 - RNA, 32 nt, Human
aggcgguagcgcuccucuuuacagccagauca

SEQ ID NO: 57632 - RNA, 32 nt, Human
aggcgguccccagcugccagggugcuugggga

SEQ ID NO: 57633 - RNA, 32 nt, Human
aggcggucuccccuccgagcgucucucuuggu

SEQ ID NO: 57634 - RNA, 32 nt, Human
aggcggugaccagcagcaggaggagaaagaac

SEQ ID NO: 57635 - RNA, 32 nt, Human
aggcggugcccagccggaagggggcucuggaa

SEQ ID NO: 57636 - RNA, 32 nt, Human
aggcgguggagaggaggaaggggcgggguggg

SEQ ID NO: 57637 - RNA, 32 nt, Human
aggcgguggcggcggaggcggcaccgauugcu

SEQ ID NO: 57638 - RNA, 31 nt, Human
aggcgguggcuucucccugcgaggaggggag

SEQ ID NO: 57639 - RNA, 20 nt, Human
aggcggugggaccucggggg

SEQ ID NO: 57640 - RNA, 32 nt, Human
aggcggugguagggagugugcgguggugaaaa

SEQ ID NO: 57641 - RNA, 32 nt, Human
aggcgguugagugggguccugggaagagcgcu

SEQ ID NO: 57642 - RNA, 24 nt, Human
aggcgguuggaucacgaggucagg

SEQ ID NO: 57643 - RNA, 19 nt, Human
aggcguagcuugcagugag

SEQ ID NO: 57644 - RNA, 30 nt, Human
aggcguagcuugcagugagcugagaucaca

SEQ ID NO: 57645 - RNA, 32 nt, Human
aggcguccagagugagugugaccugcgggugc

SEQ ID NO: 57646 - RNA, 32 nt, Human
aggcguccggcugcuguccccugccggggagc

SEQ ID NO: 57647 - RNA, 32 nt, Human
aggcguccgguucauucuuaccuguguuaggc

SEQ ID NO: 57648 - RNA, 32 nt, Human
aggcguccuccaccaugccuggcuaauauuuu

SEQ ID NO: 57649 - RNA, 32 nt, Human
aggcguccuccacccacgcccacuagccugcc

SEQ ID NO: 57650 - RNA, 32 nt, Human
aggcgucgagggcgccagaaguggcggcagca

SEQ ID NO: 57651 - RNA, 32 nt, Human
aggcgucggauacgcuaaaaaucaagcaguug

SEQ ID NO: 57652 - RNA, 32 nt, Human
aggcgucuccucaucccucacccugaccuuuc

SEQ ID NO: 57653 - RNA, 20 nt, Human
aggcgucuggccuucagggg

SEQ ID NO: 57654 - RNA, 32 nt, Human
aggcgucuguaaucccagcugcuugggaggcu

SEQ ID NO: 57655 - RNA, 22 nt, Human
aggcgugaaccaccacuccugg

SEQ ID NO: 57656 - RNA, 22 nt, Human
aggcgugaaccaccgcccccgg

SEQ ID NO: 57657 - RNA, 32 nt, Human
aggcgugaaccacugcacccagccuaucuuuu

SEQ ID NO: 57658 - RNA, 32 nt, Human
aggcgugaaccacugcacccagccugcugauc

SEQ ID NO: 57659 - RNA, 22 nt, Human
aggcgugaaccacugcacccgg

SEQ ID NO: 57660 - RNA, 21 nt, Human
aggcgugaaccacugugccgg

SEQ ID NO: 57661 - RNA, 20 nt, Human
aggcgugaaccacugugucc

SEQ ID NO: 57662 - RNA, 32 nt, Human
aggcgugaauccucuggaaggaacuguuugca

SEQ ID NO: 57663 - RNA, 32 nt, Human
aggcgugacacagacuguccacugcagagacc

SEQ ID NO: 57664 - RNA, 32 nt, Human
aggcgugacuagaagcggaaguaguugugggc

SEQ ID NO: 57665 - RNA, 20 nt, Human
aggcgugagacaccgugccc

SEQ ID NO: 57666 - RNA, 22 nt, Human
aggcgugagacaucgcgcccgg

SEQ ID NO: 57667 - RNA, 22 nt, Human
aggcgugagcaaccgcacccgg

SEQ ID NO: 57668 - RNA, 32 nt, Human
aggcgugagccaacacaccggaccuucauuuu

SEQ ID NO: 57669 - RNA, 22 nt, Human
aggcgugagccacagcgcccgg

SEQ ID NO: 57670 - RNA, 22 nt, Human
aggcgugagccaccaaacccgg

SEQ ID NO: 57671 - RNA, 32 nt, Human
aggcgugagccaccacacccagcccuuucacu

SEQ ID NO: 57672 - RNA, 32 nt, Human
aggcgugagccaccacacccagcucagggagg

SEQ ID NO: 57673 - RNA, 22 nt, Human
aggcgugagccaccacacccgg

SEQ ID NO: 57674 - RNA, 22 nt, Human
aggcgugagccaccacaccugg

SEQ ID NO: 57675 - RNA, 22 nt, Human
aggcgugagccaccacacuugg

SEQ ID NO: 57676 - RNA, 22 nt, Human
aggcgugagccaccacauccgg

SEQ ID NO: 57677 - RNA, 22 nt, Human
aggcgugagccaccacccccgg

SEQ ID NO: 57678 - RNA, 18 nt, Human
aggcgugagccaccaccg

SEQ ID NO: 57679 - RNA, 22 nt, Human
aggcgugagccaccacgccagg

SEQ ID NO: 57680 - RNA, 21 nt, Human
aggcgugagccaccacgcccg

SEQ ID NO: 57681 - RNA, 22 nt, Human
aggcgugagccaccacgcccgg

SEQ ID NO: 57682 - RNA, 23 nt, Human
aggcgugagccaccacgcccggu

SEQ ID NO: 57683 - RNA, 22 nt, Human
aggcgugagccaccacgccugg

SEQ ID NO: 57684 - RNA, 23 nt, Human
aggcgugagccaccacgcuuggu

SEQ ID NO: 57685 - RNA, 20 nt, Human
aggcgugagccaccacgucc

SEQ ID NO: 57686 - RNA, 22 nt, Human
aggcgugagccaccacucuugg

SEQ ID NO: 57687 - RNA, 22 nt, Human
aggcgugagccaccacugcugg

SEQ ID NO: 57688 - RNA, 21 nt, Human
aggcgugagccaccagccagg

SEQ ID NO: 57689 - RNA, 22 nt, Human
aggcgugagccaccauacccgg

SEQ ID NO: 57690 - RNA, 22 nt, Human
aggcgugagccaccaucuccgg

SEQ ID NO: 57691 - RNA, 19 nt, Human
aggcgugagccaccaugcc

SEQ ID NO: 57692 - RNA, 20 nt, Human
aggcgugagccaccaugccc

SEQ ID NO: 57693 - RNA, 22 nt, Human
aggcgugagccaccaugccccg

SEQ ID NO: 57694 - RNA, 22 nt, Human
aggcgugagccaccaugcccgg

SEQ ID NO: 57695 - RNA, 22 nt, Human
aggcgugagccaccaugccugg

SEQ ID NO: 57696 - RNA, 22 nt, Human
aggcgugagccaccaugcucgg

SEQ ID NO: 57697 - RNA, 20 nt, Human
aggcgugagccaccaugucc

SEQ ID NO: 57698 - RNA, 22 nt, Human
aggcgugagccaccauguccgg

SEQ ID NO: 57699 - RNA, 22 nt, Human
agggccgagcgaggcgcaggca

SEQ ID NO: 57700 - RNA, 32 nt, Human
agggccgaggggagagggugaccauggggaau

SEQ ID NO: 57701 - RNA, 19 nt, Human
agggccgccacacgggcgg

SEQ ID NO: 57702 - RNA, 32 nt, Human
agggccgcuccccucacccgcccccuucgagu

SEQ ID NO: 57703 - RNA, 32 nt, Human
agggccgcugcccgcccugggccggcacauug

SEQ ID NO: 57704 - RNA, 32 nt, Human
agggccgcugcccgcccugggccggcaccuug

SEQ ID NO: 57705 - RNA, 32 nt, Human
agggccgcugugcccacugcaggacaugcagc

SEQ ID NO: 57706 - RNA, 32 nt, Human
agggccggaacagcagguggcuucucaguucc

SEQ ID NO: 57707 - RNA, 23 nt, Human
agggccggaaccaucucugccga

SEQ ID NO: 57708 - RNA, 32 nt, Human
agggccggaagaggaaagaaaccagaguuucu

SEQ ID NO: 57709 - RNA, 25 nt, Human
agggccggacccccuacuugcccuu

SEQ ID NO: 57710 - RNA, 23 nt, Human
agggccggagaagcgagcggcca

SEQ ID NO: 57711 - RNA, 23 nt, Human
agggccggagcaggagcaugcua

SEQ ID NO: 57712 - RNA, 32 nt, Human
agggccggccucaccucuccccagcccccgcu

SEQ ID NO: 57713 - RNA, 22 nt, Human
agggccggcggggcagcccccu

SEQ ID NO: 57714 - RNA, 32 nt, Human
agggccggcuggggccuggggugcagcuggug

SEQ ID NO: 57715 - RNA, 20 nt, Human
agggccgggagcagaugcug

SEQ ID NO: 57716 - RNA, 18 nt, Human
agggccgggccucuggga

SEQ ID NO: 57717 - RNA, 22 nt, Human
agggccgggcgcucugugcgga

SEQ ID NO: 57718 - RNA, 27 nt, Human
agggccgggcuuggccuccugcuucau

SEQ ID NO: 57719 - RNA, 32 nt, Human
agggccggggccugaagcuggaagccaucgug

SEQ ID NO: 57720 - RNA, 21 nt, Human
agggccgggucucuccgcgga

SEQ ID NO: 57721 - RNA, 24 nt, Human
agggccgggugguggcucugagga

SEQ ID NO: 57722 - RNA, 32 nt, Human
agggccggguucccuggagaaggagaaagacu

SEQ ID NO: 57723 - RNA, 22 nt, Human
agggccggguuucagcuccggg

SEQ ID NO: 57724 - RNA, 24 nt, Human
agggccguaugcauccugccaagc

SEQ ID NO: 57725 - RNA, 32 nt, Human
agggccgucucaauggucugggaguggacacu

SEQ ID NO: 57726 - RNA, 32 nt, Human
agggccgugaagaugggaugaggagcuauaug

SEQ ID NO: 57727 - RNA, 19 nt, Human
agggccguguacacucucc

SEQ ID NO: 57728 - RNA, 32 nt, Human
agggccuacccagagaccagagagagucagcc

SEQ ID NO: 57729 - RNA, 32 nt, Human
agggccuacuggaugcgagaccuguguggcug

SEQ ID NO: 57730 - RNA, 32 nt, Human
agggccuagaagggaaagacugugcguugaua

SEQ ID NO: 57731 - RNA, 32 nt, Human
agggccuagcuuucauuugacacacagacuac

SEQ ID NO: 57732 - RNA, 32 nt, Human
agggccuagggagggugggagcugcugcugga

SEQ ID NO: 57733 - RNA, 32 nt, Human
agggccuaguacagaaggugcacacaaauguu

SEQ ID NO: 57734 - RNA, 32 nt, Human
agggccuauugaccguagaggccaggugcggu

SEQ ID NO: 57735 - RNA, 32 nt, Human
agggccucacuauggucagcucaggccaugug

SEQ ID NO: 57736 - RNA, 32 nt, Human
agggccucacucugucacccaggcugggaugc

SEQ ID NO: 57737 - RNA, 32 nt, Human
agggccucagacucugaacuucccucaagugc

SEQ ID NO: 57738 - RNA, 32 nt, Human
agggccuccagcugcccucagacacugauguc

SEQ ID NO: 57739 - RNA, 32 nt, Human
agggccuccccuuccccucucccucagaguuu

SEQ ID NO: 57740 - RNA, 31 nt, Human
agggccucccucucugccaguguuugggugg

SEQ ID NO: 57741 - RNA, 32 nt, Human
agggccuccuggaguuucaaaaggaggaagug

SEQ ID NO: 57742 - RNA, 26 nt, Human
agggccuccuuuccaaccucacaaug

SEQ ID NO: 57743 - RNA, 32 nt, Human
agggccucucccucccucccucccucucuguc

SEQ ID NO: 57744 - RNA, 32 nt, Human
agggccucuccucacugcuguugucauugcuc

SEQ ID NO: 57745 - RNA, 32 nt, Human
agggccucuccugucgccucuggacacaagug

SEQ ID NO: 57746 - RNA, 32 nt, Human
agggccucugcagauaaaugugcaggauagca

SEQ ID NO: 57747 - RNA, 32 nt, Human
agggccucugcgggacugucuguuugcagagg

SEQ ID NO: 57748 - RNA, 18 nt, Human
agggccugaacccugggu

SEQ ID NO: 57749 - RNA, 32 nt, Human
agggccugaaugugaaagaagacccucuauuu

SEQ ID NO: 57750 - RNA, 32 nt, Human
agggccugacaagaggaugggguggggguggc

SEQ ID NO: 57751 - RNA, 32 nt, Human
agggccugacacgggaagagugcaguagggag

SEQ ID NO: 57752 - RNA, 22 nt, Human
agggccugacuguccugcucac

SEQ ID NO: 57753 - RNA, 32 nt, Human
agggccugacuugagccacuccuuccuucagg

SEQ ID NO: 57754 - RNA, 32 nt, Human
agggccugagagaagcagggacaggagggagc

SEQ ID NO: 57755 - RNA, 32 nt, Human
agggccugagccuggccagccuacaaugggga

SEQ ID NO: 57756 - RNA, 32 nt, Human
agggccugagucucaacauggcugcugaucca

SEQ ID NO: 57757 - RNA, 32 nt, Human
agggccugaucuuuaccacugcaggggcugca

SEQ ID NO: 57758 - RNA, 32 nt, Human
agggccugcaagcagccagggucagagacagg

SEQ ID NO: 57759 - RNA, 18 nt, Human
agggccugcagcagugcc

SEQ ID NO: 57760 - RNA, 32 nt, Human
agggccugcagccucucccacgcugccgccgc

SEQ ID NO: 57761 - RNA, 32 nt, Human
agggccugcaggaagcuggugucagggagaga

SEQ ID NO: 57762 - RNA, 18 nt, Human
agggccugcccacgcccu

SEQ ID NO: 57763 - RNA, 32 nt, Human
agggccugcuuccugaaucuccuggguguguc

SEQ ID NO: 57764 - RNA, 32 nt, Human
agggccuggagcccagagcggggccagcugcu

SEQ ID NO: 57765 - RNA, 32 nt, Human
agggccuggcagcugcugcgcccucgcuuucu

SEQ ID NO: 57766 - RNA, 32 nt, Human
agggccuggcauguuugcccugcucugccugg

SEQ ID NO: 57767 - RNA, 22 nt, Human
agggccuggccuggcagcucug

SEQ ID NO: 57768 - RNA, 32 nt, Human
agggccuggccuugguccccacucugcgauga

SEQ ID NO: 57769 - RNA, 21 nt, Human
agggccuggcucucccuggga

SEQ ID NO: 57770 - RNA, 32 nt, Human
agggccuggcugagagacaaggguagcagcag

SEQ ID NO: 57771 - RNA, 32 nt, Human
agggccuggcuugucagcucucuagguuugau

SEQ ID NO: 57772 - RNA, 32 nt, Human
agggccugggcuggcccugcuaggcuggagaa

SEQ ID NO: 57773 - RNA, 32 nt, Human
agggccugggcugggagggagagaccggagca

SEQ ID NO: 57774 - RNA, 32 nt, Human
agggccuggguggcaggggguggguggccugu

SEQ ID NO: 57775 - RNA, 32 nt, Human
agggccugguggccccagcacacacuugggau

SEQ ID NO: 57776 - RNA, 32 nt, Human
agggccugucccuacugagagugcagggaacu

SEQ ID NO: 57777 - RNA, 32 nt, Human
agggccugugagcugcucacaacugggucaac

SEQ ID NO: 57778 - RNA, 32 nt, Human
agggccugugccuggggaggcuucagggugua

SEQ ID NO: 57779 - RNA, 32 nt, Human
agggccuguggccuauggaauauguccuccag

SEQ ID NO: 57780 - RNA, 17 nt, Human
agggccuguguccuggg

SEQ ID NO: 57781 - RNA, 32 nt, Human
agggccuguuucucccugcaggaagcccacag

SEQ ID NO: 57782 - RNA, 32 nt, Human
agggccuucaauggaucucaauaugaccuaua

SEQ ID NO: 57783 - RNA, 32 nt, Human
agggccuuccaaagugcugggauuacggacgu

SEQ ID NO: 57784 - RNA, 32 nt, Human
agggccuuccacccucggcuccugugcuggga

SEQ ID NO: 57785 - RNA, 32 nt, Human
agggccuucccccuagcaccuccucaggccag

SEQ ID NO: 57786 - RNA, 32 nt, Human
agggccuuccugggaggagucccaccagccag

SEQ ID NO: 57787 - RNA, 32 nt, Human
agggccuuccuugacagaauuguguccucucc

SEQ ID NO: 57788 - RNA, 32 nt, Human
agggccuucucaggaacacugacauugccuac

SEQ ID NO: 57789 - RNA, 32 nt, Human
agggccuugaaggaugagaaagaucuggcuga

SEQ ID NO: 57790 - RNA, 32 nt, Human
agggccuugagugcccaggagugccccacguu

SEQ ID NO: 57791 - RNA, 32 nt, Human
agggccuugagugccuggaggugcuuggccuc

SEQ ID NO: 57792 - RNA, 32 nt, Human
agggccuuuaacauuucugagguuuggagauu

SEQ ID NO: 57793 - RNA, 32 nt, Human
agggcgagagguggaaggucagaggagauggg

SEQ ID NO: 57794 - RNA, 32 nt, Human
agggcgagaggugggaggucagaggagaugga

SEQ ID NO: 57795 - RNA, 32 nt, Human
agggcgagaggugggaggucagaggagauggg

SEQ ID NO: 57796 - RNA, 32 nt, Human
agggcgagaucaggacucugucuuuguuaauc

SEQ ID NO: 57797 - RNA, 30 nt, Human
agggcgagccucucugugacucuucuguaa

SEQ ID NO: 57798 - RNA, 32 nt, Human
agggcgagcuguucucggguuccacaugccug

SEQ ID NO: 57799 - RNA, 32 nt, Human
agggcgagcuguucuuggguuccacaugccug

SEQ ID NO: 57800 - RNA, 32 nt, Human
agggcgaggagauggugcuggagccagggagc

SEQ ID NO: 57801 - RNA, 32 nt, Human
agggcgaggcaagggcgcuuucugccgacgcu

SEQ ID NO: 57802 - RNA, 32 nt, Human
agggcgaggccuggcagcuguagugcuucugg

SEQ ID NO: 57803 - RNA, 32 nt, Human
agggcgaggggcugaggucacaccucgggcac

SEQ ID NO: 57804 - RNA, 32 nt, Human
agggcgagguggggccucugcagccauccugg

SEQ ID NO: 57805 - RNA, 32 nt, Human
agggcgauggacgccuucagccccaggcaccc

SEQ ID NO: 57806 - RNA, 32 nt, Human
agggcgauucugggccuuucugaccuacuccu

SEQ ID NO: 57807 - RNA, 32 nt, Human
agggcgcaaggcgccuuucagggaaggugucu

SEQ ID NO: 57808 - RNA, 32 nt, Human
agggcgcaggccgcgcggagaugaggaggagg

SEQ ID NO: 57809 - RNA, 32 nt, Human
agggcgccagcggcuggcgaagaaggaaagag

SEQ ID NO: 57810 - RNA, 32 nt, Human
agggcgcccgggcucuggcuuccucauugagc

SEQ ID NO: 57811 - RNA, 21 nt, Human
agggcgcccuggacgccugcg

SEQ ID NO: 57812 - RNA, 32 nt, Human
agggcgccgccgcaaucucaccucucccaggc

SEQ ID NO: 57813 - RNA, 19 nt, Human
agggcgccgggagccagcu

SEQ ID NO: 57814 - RNA, 25 nt, Human
agggcgccucugggaagccugggca

SEQ ID NO: 57815 - RNA, 32 nt, Human
agggcgccuguugacaaguguggagaaacucc

SEQ ID NO: 57816 - RNA, 23 nt, Human
agggcgcgugguucggcgugcca

SEQ ID NO: 57817 - RNA, 32 nt, Human
agggcgcuccaugccucucuguccucuucuuu

SEQ ID NO: 57818 - RNA, 32 nt, Human
agggcgcucugcccucccuccuuccuucuugc

SEQ ID NO: 57819 - RNA, 32 nt, Human
agggcgcugcgaggaggagcggaaggcggaga

SEQ ID NO: 57820 - RNA, 32 nt, Human
agggcgcuguugcugccaauacagcugucaug

SEQ ID NO: 57821 - RNA, 32 nt, Human
agggcgcuugaguuggucgggggcagcggcag

SEQ ID NO: 57822 - RNA, 22 nt, Human
agggcggaaacaucacauacaa

SEQ ID NO: 57823 - RNA, 32 nt, Human
agggcggagaguucuguggugaaauaguggga

SEQ ID NO: 57824 - RNA, 32 nt, Human
agggcggagcggggcugucaccuggagaucac

SEQ ID NO: 57825 - RNA, 32 nt, Human
agggcggagcugcagaagcguguggagggccu

SEQ ID NO: 57826 - RNA, 32 nt, Human
agggcggaggaaggagaaggagggcccacagg

SEQ ID NO: 57827 - RNA, 32 nt, Human
agggcggagggcggaggggcggcgggaggagg

SEQ ID NO: 57828 - RNA, 32 nt, Human
agggcggagguggugcgugcgugcgugugugu

SEQ ID NO: 57829 - RNA, 32 nt, Human
agggcggcagcgguggcggcgguagccagcgc

SEQ ID NO: 57830 - RNA, 32 nt, Human
agggcggcaggcagggguuauccggccccacu

SEQ ID NO: 57831 - RNA, 32 nt, Human
agggcggcgggggugcggagagacaggcggag

SEQ ID NO: 57832 - RNA, 32 nt, Human
agggcgggagagagggaacggaggauguguga

SEQ ID NO: 57833 - RNA, 32 nt, Human
agggcgggaggcagcgcgggaguggggcguug

SEQ ID NO: 57834 - RNA, 32 nt, Human
agggcgggcagcacccuccgacccucccaugc

SEQ ID NO: 57835 - RNA, 32 nt, Human
agggcgggccuggagcugcgugagagugaaac

SEQ ID NO: 57836 - RNA, 32 nt, Human
agggcgggcgggcugcucggaggcagaggcag

SEQ ID NO: 57837 - RNA, 32 nt, Human
agggcgggcuccaagcgcuuugcuuccggaac

SEQ ID NO: 57838 - RNA, 32 nt, Human
agggcggggcuggaggaaugugggggauugaa

SEQ ID NO: 57839 - RNA, 32 nt, Human
agggcggggcuggccagcugugcgagaacaca

SEQ ID NO: 57840 - RNA, 32 nt, Human
agggcggggugaggaggggcggagcuuccaga

SEQ ID NO: 57841 - RNA, 32 nt, Human
agggcggucacggcggccugcccagggcgcag

SEQ ID NO: 57842 - RNA, 32 nt, Human
agggcggugggaggggaggaguggagauggcg

SEQ ID NO: 57843 - RNA, 32 nt, Human
agggcguagggugggggcagugaggaaugggu

SEQ ID NO: 57844 - RNA, 32 nt, Human
agggcgucguaccucugugagacauggcucgc

SEQ ID NO: 57845 - RNA, 32 nt, Human
agggcgucucaucuccccacaggcaucugcug

SEQ ID NO: 57846 - RNA, 18 nt, Human
agggcgugaacccgggag

SEQ ID NO: 57847 - RNA, 16 nt, Human
agggcgugggcagcuu

SEQ ID NO: 57848 - RNA, 31 nt, Human
agggcgugggucucugggguuggggucccuu

SEQ ID NO: 57849 - RNA, 32 nt, Human
agggcguguaggggguggagguucuaagacag

SEQ ID NO: 57850 - RNA, 32 nt, Human
agggcgugucagcagcaaaccuaagugugugc

SEQ ID NO: 57851 - RNA, 22 nt, Human
agggcguguggccaucguguca

SEQ ID NO: 57852 - RNA, 32 nt, Human
agggcuaagggagggggcgcuggagcuuccaa

SEQ ID NO: 57853 - RNA, 22 nt, Human
agggcuaagugcauauugugga

SEQ ID NO: 57854 - RNA, 32 nt, Human
agggcuacaggacuacaaucccaacaugugcc

SEQ ID NO: 57855 - RNA, 32 nt, Human
agggcuacaggacuacaaucccagcaugugcc

SEQ ID NO: 57856 - RNA, 23 nt, Human
agggcuacauguuucuuuuucau

SEQ ID NO: 57857 - RNA, 32 nt, Human
agggcuacugacguuucauucuugcccuuuug

SEQ ID NO: 57858 - RNA, 21 nt, Human
agggcuacuugauccuccuca

SEQ ID NO: 57859 - RNA, 32 nt, Human
agggcuagaauuacaggugugagccacugcaa

SEQ ID NO: 57860 - RNA, 32 nt, Human
agggcuagacuuacccugggaucuucuucauc

SEQ ID NO: 57861 - RNA, 32 nt, Human
agggcuagagaugucaaauggaagagacuuag

SEQ ID NO: 57862 - RNA, 32 nt, Human
agggcuagcugagcucuucaccugcauccugg

SEQ ID NO: 57863 - RNA, 32 nt, Human
agggcuaguugccaccaaccaauuuacugaug

SEQ ID NO: 57864 - RNA, 32 nt, Human
agggcuaucuaaaaauaauaaggaauuuggac

SEQ ID NO: 57865 - RNA, 32 nt, Human
agggcuaugauccuagcuggaauuacaccugc

SEQ ID NO: 57866 - RNA, 16 nt, Human
agggcuaugccugugu

SEQ ID NO: 57867 - RNA, 23 nt, Human
agggcucaacagccacgcucugu

SEQ ID NO: 57868 - RNA, 32 nt, Human
agggcucaagcaguccucccaccucagccucc

SEQ ID NO: 57869 - RNA, 32 nt, Human
agggcucaagggauccucccaccucagccucu

SEQ ID NO: 57870 - RNA, 32 nt, Human
agggcucaagugagcaaggguuucuucuggau

SEQ ID NO: 57871 - RNA, 32 nt, Human
agggcucaauccaggaccacacucuuauuggc

SEQ ID NO: 57872 - RNA, 22 nt, Human
agggcucacagggcaggccuug

SEQ ID NO: 57873 - RNA, 32 nt, Human
agggcucaccuaacuugggagggaaggggcug

SEQ ID NO: 57874 - RNA, 22 nt, Human
agggcucacgccuguaaucuca

SEQ ID NO: 57875 - RNA, 32 nt, Human
agggcucacugcagccuugaccucccaggcuc

SEQ ID NO: 57876 - RNA, 32 nt, Human
agggcucacugcagcuuugacuucccaggcuc

SEQ ID NO: 57877 - RNA, 32 nt, Human
agggcucagaagaagacaggaaaaugggggaa

SEQ ID NO: 57878 - RNA, 32 nt, Human
agggcucagaagcaggggccacagcuggagua

SEQ ID NO: 57879 - RNA, 32 nt, Human
agggcucagacgggggccauuuugccagaggc

SEQ ID NO: 57880 - RNA, 32 nt, Human
agggcucagagagguuuaguuacuuuccaaga

SEQ ID NO: 57881 - RNA, 32 nt, Human
agggcucagcagagaacaguaugggacccccu

SEQ ID NO: 57882 - RNA, 32 nt, Human
agggcucagccaagcccugcaguguguccccg

SEQ ID NO: 57883 - RNA, 32 nt, Human
agggcucagcccagggcauccaggaacaggcu

SEQ ID NO: 57884 - RNA, 24 nt, Human
agggcucagccuggcaggcuuugu

SEQ ID NO: 57885 - RNA, 18 nt, Human
agggcucaggacccggag

SEQ ID NO: 57886 - RNA, 24 nt, Human
agggcucagggcacaaggcuccgu

SEQ ID NO: 57887 - RNA, 32 nt, Human
agggcucagggugggcucagaggccacugaga

SEQ ID NO: 57888 - RNA, 32 nt, Human
agggcucaggugauccucccaccucagccacc

SEQ ID NO: 57889 - RNA, 32 nt, Human
agggcucaucccucugcagagcgcggggucac

SEQ ID NO: 57890 - RNA, 32 nt, Human
agggcucaucccuuauuaagcaucagaaaauu

SEQ ID NO: 57891 - RNA, 32 nt, Human
agggcuccacuccccuuccuuuucuuggugaa

SEQ ID NO: 57892 - RNA, 32 nt, Human
agggcuccagcuguugucucacacuuccuuga

SEQ ID NO: 57893 - RNA, 20 nt, Human
agggcuccagggccuggaca

SEQ ID NO: 57894 - RNA, 32 nt, Human
agggcucccagaggagcaucaacuccaggaga

SEQ ID NO: 57895 - RNA, 32 nt, Human
agggcucccagccugcaccgccucccacugcc

SEQ ID NO: 57896 - RNA, 32 nt, Human
agggcucccuccggcuuggcagacucagccug

SEQ ID NO: 57897 - RNA, 17 nt, Human
agggcuccgcggcgcug

SEQ ID NO: 57898 - RNA, 32 nt, Human
agggcuccgucauggccauggagaccuggggg

SEQ ID NO: 57899 - RNA, 32 nt, Human
agggcuccucaagugcccccaaagugggagcc

SEQ ID NO: 57900 - RNA, 32 nt, Human
agggcuccuccuuuacaauugaucucauuuuu

SEQ ID NO: 57901 - RNA, 32 nt, Human
agggcuccugggaggccugugggagccucccg

SEQ ID NO: 57902 - RNA, 32 nt, Human
agggcuccuggugcuccccaugugggaauagg

SEQ ID NO: 57903 - RNA, 32 nt, Human
agggcuccuguagacuucaucaacaucagcac

SEQ ID NO: 57904 - RNA, 23 nt, Human
agggcuccuuucuaccuccagug

SEQ ID NO: 57905 - RNA, 32 nt, Human
agggcucgaaggguuagagaagaaaggcagac

SEQ ID NO: 57906 - RNA, 20 nt, Human
agggcucgccacgggccuug

SEQ ID NO: 57907 - RNA, 32 nt, Human
agggcucuaagaccacccagcucucuuccugg

SEQ ID NO: 57908 - RNA, 32 nt, Human
agggcucucagccacugcuccaacacacuugc

SEQ ID NO: 57909 - RNA, 32 nt, Human
agggcucucccagagggaagcugggaaguuaa

SEQ ID NO: 57910 - RNA, 32 nt, Human
agggcucuccuuccugucccuucgaucuccuu

SEQ ID NO: 57911 - RNA, 32 nt, Human
agggcucucgagaacagauucuccccuccagu

SEQ ID NO: 57912 - RNA, 32 nt, Human
agggcucucuccccauggccucuuccccaccu

SEQ ID NO: 57913 - RNA, 32 nt, Human
agggcucucugaugccuucuaaaagaacaacu

SEQ ID NO: 57914 - RNA, 32 nt, Human
agggcucucuggaugccuuccugcugccccag

SEQ ID NO: 57915 - RNA, 32 nt, Human
agggcucugagcgggaggccugagcgggaagc

SEQ ID NO: 57916 - RNA, 20 nt, Human
agggcucugauuugcacaau

SEQ ID NO: 57917 - RNA, 32 nt, Human
agggcucugcaguaaaaacaaaggacaaccca

SEQ ID NO: 57918 - RNA, 32 nt, Human
agggcucugcuggucuuucugagucacagcug

SEQ ID NO: 57919 - RNA, 24 nt, Human
agggcucugcuguucccuccuccu

SEQ ID NO: 57920 - RNA, 19 nt, Human
agggcucuggacgcuacuc

SEQ ID NO: 57921 - RNA, 32 nt, Human
agggcucuggagccaccaucccagggcccgcu

SEQ ID NO: 57922 - RNA, 32 nt, Human
agggcucugggagccaggccuagcucucaggg

SEQ ID NO: 57923 - RNA, 32 nt, Human
agggcucuguuccaugccucucuccuuggcuu

SEQ ID NO: 57924 - RNA, 32 nt, Human
agggcucuucggcaaauguacaugggcaccuc

SEQ ID NO: 57925 - RNA, 32 nt, Human
agggcucuugagccacuugcucuagcccacuc

SEQ ID NO: 57926 - RNA, 32 nt, Human
agggcucuuucuccaugggagcuccuggugcc

SEQ ID NO: 57927 - RNA, 32 nt, Human
agggcucuuugauuugagucucagguuaaucc

SEQ ID NO: 57928 - RNA, 32 nt, Human
agggcucuuuguguucugugacagcauuuggg

SEQ ID NO: 57929 - RNA, 21 nt, Human
agggcugaaagccccaagccc

SEQ ID NO: 57930 - RNA, 32 nt, Human
agggcugaagagaagauggaggagcugguggu

SEQ ID NO: 57931 - RNA, 32 nt, Human
agggcugagauguggcaggagcucccagggaa

SEQ ID NO: 57932 - RNA, 32 nt, Human
agggcugagccauggggguuuggggcuaagaa

SEQ ID NO: 57933 - RNA, 20 nt, Human
agggcugagcucucuguggg

SEQ ID NO: 57934 - RNA, 32 nt, Human
agggcugaggaagucuuugaggugaaagugga

SEQ ID NO: 57935 - RNA, 32 nt, Human
agggcugagggagagacugaggugcagcagau

SEQ ID NO: 57936 - RNA, 32 nt, Human
agggcugaggggcagcggcuuaggcuccggcg

SEQ ID NO: 57937 - RNA, 24 nt, Human
agggcugaggucuguuucucuggg

SEQ ID NO: 57938 - RNA, 32 nt, Human
agggcugauuuucaucaaaaccaagaccuuuc

SEQ ID NO: 57939 - RNA, 32 nt, Human
agggcugcaacaccacgacuucugcccauucu

SEQ ID NO: 57940 - RNA, 32 nt, Human
agggcugcaaggggacaccacgcacagagaca

SEQ ID NO: 57941 - RNA, 32 nt, Human
agggcugcaggcgggcggagguuccaggagau

SEQ ID NO: 57942 - RNA, 32 nt, Human
agggcugcagugagccaugaggcaccacugca

SEQ ID NO: 57943 - RNA, 32 nt, Human
agggcugcagugagccgagauugugccacugc

SEQ ID NO: 57944 - RNA, 32 nt, Human
agggcugcagugagccuugauugcaccacugc

SEQ ID NO: 57945 - RNA, 32 nt, Human
agggcugcagugagguacgaucaagccacugc

SEQ ID NO: 57946 - RNA, 32 nt, Human
agggcugccaggcguauuccugccugggccuc

SEQ ID NO: 57947 - RNA, 32 nt, Human
agggcugccaggcugcagccugcugcuccagg

SEQ ID NO: 57948 - RNA, 32 nt, Human
agggcugcccacaggccucagcucuuuccagc

SEQ ID NO: 57949 - RNA, 32 nt, Human
agggcugcccgcagaggcugaggucccugcaa

SEQ ID NO: 57950 - RNA, 32 nt, Human
agggcugcccgccgcgcugccugcgccggacc

SEQ ID NO: 57951 - RNA, 20 nt, Human
agggcugccggcacuaggcg

SEQ ID NO: 57952 - RNA, 32 nt, Human
agggcugccuccaaggacacagaaggaugcca

SEQ ID NO: 57953 - RNA, 32 nt, Human
agggcugcggaugagccagggacagaagagca

SEQ ID NO: 57954 - RNA, 32 nt, Human
agggcugcguggcaauuuccacaccugugcac

SEQ ID NO: 57955 - RNA, 31 nt, Human
agggcugcucggagucaccuguuggaaugga

SEQ ID NO: 57956 - RNA, 32 nt, Human
agggcugcugccauccuggccugguggagguu

SEQ ID NO: 57957 - RNA, 32 nt, Human
agggcugcuucuaacggaugugguuuguugcu

SEQ ID NO: 57958 - RNA, 32 nt, Human
agggcuggaaccugggagcaacucuggccaau

SEQ ID NO: 57959 - RNA, 32 nt, Human
agggcuggaagggggagcugcaggccacccuc

SEQ ID NO: 57960 - RNA, 23 nt, Human
agggcuggaccucaacccugagg

SEQ ID NO: 57961 - RNA, 20 nt, Human
agggcuggaccuggaccugg

SEQ ID NO: 57962 - RNA, 32 nt, Human
agggcuggacggcgagcugggagccagcccca

SEQ ID NO: 57963 - RNA, 32 nt, Human
agggcuggagaacuuagcuggugggaaaggag

SEQ ID NO: 57964 - RNA, 32 nt, Human
agggcuggagcagaagggccaagagggccugu

SEQ ID NO: 57965 - RNA, 32 nt, Human
agggcuggagcagaggaccacaaggcagcaga

SEQ ID NO: 57966 - RNA, 32 nt, Human
agggcuggagccaaggagaacacaguugagca

SEQ ID NO: 57967 - RNA, 32 nt, Human
agggcuggaggaucgcuccuguggaaagggag

SEQ ID NO: 57968 - RNA, 32 nt, Human
agggcuggagggacaggagggcggaucaggug

SEQ ID NO: 57969 - RNA, 32 nt, Human
agggcuggagggacagggagcagggcagaaaa

SEQ ID NO: 57970 - RNA, 32 nt, Human
agggcuggauguagcugggauugaguccaugu

SEQ ID NO: 57971 - RNA, 32 nt, Human
agggcuggcagcugccgcugcaccggagagcc

SEQ ID NO: 57972 - RNA, 32 nt, Human
agggcuggcaggaaggggcgagaaaucccagg

SEQ ID NO: 57973 - RNA, 32 nt, Human
agggcuggcccauggcuucacacugggcucag

SEQ ID NO: 57974 - RNA, 32 nt, Human
agggcuggcccucaguagcugcagggagcuuu

SEQ ID NO: 57975 - RNA, 32 nt, Human
agggcuggccuuccucugugcaucacucugcu

SEQ ID NO: 57976 - RNA, 23 nt, Human
agggcuggcggcgagcucugagc

SEQ ID NO: 57977 - RNA, 31 nt, Human
agggcuggcuuaguuauuugccaaagccccu

SEQ ID NO: 57978 - RNA, 19 nt, Human
agggcugggacauccuggg

SEQ ID NO: 57979 - RNA, 22 nt, Human
agggcugggaccagcacggggc

SEQ ID NO: 57980 - RNA, 32 nt, Human
agggcugggacugcugucccuuguacaguuuu

SEQ ID NO: 57981 - RNA, 22 nt, Human
agggcugggacuggguuccagc

SEQ ID NO: 57982 - RNA, 32 nt, Human
agggcugggaggauggaaugcugggcaugaaa

SEQ ID NO: 57983 - RNA, 32 nt, Human
agggcugggauuaaaggcaugagccaccgcac

SEQ ID NO: 57984 - RNA, 32 nt, Human
agggcugggcaaggaaaaagaaaauaaagaca

SEQ ID NO: 57985 - RNA, 32 nt, Human
agggcugggcagcugggagacaggcucauggc

SEQ ID NO: 57986 - RNA, 32 nt, Human
agggcugggcaggacagagcugagggugggca

SEQ ID NO: 57987 - RNA, 32 nt, Human
agggcugggcaggcucagguggcaaggacgga

SEQ ID NO: 57988 - RNA, 32 nt, Human
agggcugggcagguccuggggaggcugagacu

SEQ ID NO: 57989 - RNA, 32 nt, Human
agggcugggcuuuggaguggggcagugcggug

SEQ ID NO: 57990 - RNA, 17 nt, Human
agggcuggggaccccug

SEQ ID NO: 57991 - RNA, 22 nt, Human
agggcuggggcagccucugggc

SEQ ID NO: 57992 - RNA, 25 nt, Human
agggcuggggcagugccagacucug

SEQ ID NO: 57993 - RNA, 18 nt, Human
agggcuggggcggagcug

SEQ ID NO: 57994 - RNA, 19 nt, Human
agggcuggggguucaggga

SEQ ID NO: 57995 - RNA, 32 nt, Human
agggcuggggucuccuggauacaauggagcag

SEQ ID NO: 57996 - RNA, 32 nt, Human
agggcuggggugagauccugaccugugcagag

SEQ ID NO: 57997 - RNA, 32 nt, Human
agggcugggguguggaagggcaagcugcacca

SEQ ID NO: 57998 - RNA, 32 nt, Human
agggcugggguuuugcuacuuguuccuauuua

SEQ ID NO: 57999 - RNA, 32 nt, Human
agggcugggugcccaccaugccccuuccucuu

SEQ ID NO: 58000 - RNA, 32 nt, Human
agggcugguauuccuacccaggaaccuccuuu

SEQ ID NO: 58001 - RNA, 24 nt, Human
agggcuggucuugaacuccugagc

SEQ ID NO: 58002 - RNA, 32 nt, Human
agggcuggugcuggggcuucuucuccugaagg

SEQ ID NO: 58003 - RNA, 32 nt, Human
agggcugucccaagucaauggaaagggaaagg

SEQ ID NO: 58004 - RNA, 32 nt, Human
agggcugucuuuggaagcagggguccugggcu

SEQ ID NO: 58005 - RNA, 32 nt, Human
agggcugugacaccuucuuuggggcucugcag

SEQ ID NO: 58006 - RNA, 32 nt, Human
agggcugugacucuggcugagcccaggaaagc

SEQ ID NO: 58007 - RNA, 17 nt, Human
agggcugugcggagcug

SEQ ID NO: 58008 - RNA, 32 nt, Human
agggcuguggucagccaagaauagaggucaua

SEQ ID NO: 58009 - RNA, 32 nt, Human
agggcuguguaagaaaagucauagguggauac

SEQ ID NO: 58010 - RNA, 32 nt, Human
agggcuguguguuccagaaggcugauaccaug

SEQ ID NO: 58011 - RNA, 25 nt, Human
agggcuguucugucaagguucagcu

SEQ ID NO: 58012 - RNA, 32 nt, Human
agggcuguuggauguauggggagcuggcagag

SEQ ID NO: 58013 - RNA, 32 nt, Human
agggcuguugggggcccucagggaggguucaa

SEQ ID NO: 58014 - RNA, 32 nt, Human
agggcuguuggugagagcagacuugaggugau

SEQ ID NO: 58015 - RNA, 32 nt, Human
agggcuuaaaguuccgggaaucaaagaucaac

SEQ ID NO: 58016 - RNA, 32 nt, Human
agggcuuaucugcaguacacucugccaugugg

SEQ ID NO: 58017 - RNA, 32 nt, Human
agggcuucaaagacuucucagcuucgagcaug

SEQ ID NO: 58018 - RNA, 32 nt, Human
agggcuucaaggcaccaccagugguauuuaau

SEQ ID NO: 58019 - RNA, 32 nt, Human
agggcuucacacccuucaggcugcacccgggc

SEQ ID NO: 58020 - RNA, 32 nt, Human
agggcuucacccaggaugacguacaggcugca

SEQ ID NO: 58021 - RNA, 32 nt, Human
agggcuucaccccgaagcuccaccuucgcucc

SEQ ID NO: 58022 - RNA, 32 nt, Human
agggcuucacucuucuuucacuggauaccaga

SEQ ID NO: 58023 - RNA, 32 nt, Human
agggcuucagccacagcacucgcaaaacccca

SEQ ID NO: 58024 - RNA, 32 nt, Human
agggcuucaggaggaggcugugaggcuggagg

SEQ ID NO: 58025 - RNA, 32 nt, Human
agggcuucaugugucuggaagggagccauuag

SEQ ID NO: 58026 - RNA, 32 nt, Human
agggcuuccaaacagaugcagaagaacccaga

SEQ ID NO: 58027 - RNA, 20 nt, Human
agggcuucccucaucuuccu

SEQ ID NO: 58028 - RNA, 32 nt, Human
agggcuuccgcucuuggcuuccagaaaaguuu

SEQ ID NO: 58029 - RNA, 32 nt, Human
agggcuuccuggagaacauuugcccguauacu

SEQ ID NO: 58030 - RNA, 32 nt, Human
agggcuuccuuccugugugcagccuagggacu

SEQ ID NO: 58031 - RNA, 32 nt, Human
agggcuucgccuucaaggguucuggaggaggg

SEQ ID NO: 58032 - RNA, 32 nt, Human
agggcuucuccuccucugucuuuuggagaacc

SEQ ID NO: 58033 - RNA, 32 nt, Human
agggcuugaagacauggccgaauaggcuacug

SEQ ID NO: 58034 - RNA, 32 nt, Human
agggcuugagacccucccucaaccggacuaau

SEQ ID NO: 58035 - RNA, 32 nt, Human
agggcuugcccaggcaugguggaucaccggag

SEQ ID NO: 58036 - RNA, 32 nt, Human
agggcuugcccccagccuuaggauuucagggu

SEQ ID NO: 58037 - RNA, 24 nt, Human
agggcuugcuuuguuuucuguuga

SEQ ID NO: 58038 - RNA, 32 nt, Human
agggcuugggcuugaacccaaccuucucccuc

SEQ ID NO: 58039 - RNA, 32 nt, Human
agggcuuguggccagccauuucucacagagag

SEQ ID NO: 58040 - RNA, 32 nt, Human
agggcuuuagcaaugagacugcagccugugac

SEQ ID NO: 58041 - RNA, 32 nt, Human
agggcuuuaugugaggauuuuuaaaaauuacc

SEQ ID NO: 58042 - RNA, 32 nt, Human
agggcuuuccaugcccccuccccaccuaaacu

SEQ ID NO: 58043 - RNA, 32 nt, Human
agggcuuucucaauaagccucagcuuucuaag

SEQ ID NO: 58044 - RNA, 32 nt, Human
agggcuuucuuuguaugcaugaucucagugaa

SEQ ID NO: 58045 - RNA, 32 nt, Human
agggcuuugagcugcacuggccccggugcugg

SEQ ID NO: 58046 - RNA, 32 nt, Human
agggcuuuucccagggcuucugauggucagca

SEQ ID NO: 58047 - RNA, 32 nt, Human
agggcuuuucucucacuuacauuuauuucuca

SEQ ID NO: 58048 - RNA, 32 nt, Human
aggggaaaccuacgugcccagagcaggaaacg

SEQ ID NO: 58049 - RNA, 32 nt, Human
aggggaaacugaguuucauccaauguggagag

SEQ ID NO: 58050 - RNA, 32 nt, Human
aggggaaagcaaagggcgucucagggaacccc

SEQ ID NO: 58051 - RNA, 32 nt, Human
aggggaaaggaucuacccuucuccuggcuccc

SEQ ID NO: 58052 - RNA, 32 nt, Human
aggggaaaggguugucucucuccuuucuguug

SEQ ID NO: 58053 - RNA, 32 nt, Human
aggggaacaagaaacuacuucuaacgggaaga

SEQ ID NO: 58054 - RNA, 32 nt, Human
aggggaacagcauuaaaguaucagcuggagcu

SEQ ID NO: 58055 - RNA, 32 nt, Human
aggggaacaggcagaggggcgguaaggaaggg

SEQ ID NO: 58056 - RNA, 32 nt, Human
aggggaacaguuaacaggggagggauacuggg

SEQ ID NO: 58057 - RNA, 32 nt, Human
aggggaaccagcugaacagagccuuucaugug

SEQ ID NO: 58058 - RNA, 32 nt, Human
aggggaacggcucaaagcuaaaaagaaauaaa

SEQ ID NO: 58059 - RNA, 31 nt, Human
aggggaacgucuucacuggguggugucagcu

SEQ ID NO: 58060 - RNA, 20 nt, Human
aggggaagaaaagaagggga

SEQ ID NO: 58061 - RNA, 32 nt, Human
aggggaagaagagagacgagaggaaacaccua

SEQ ID NO: 58062 - RNA, 32 nt, Human
aggggaagaaugaacccaagggcaaugcagag

SEQ ID NO: 58063 - RNA, 32 nt, Human
aggggaagagccucagucaggaggcucugugg

SEQ ID NO: 58064 - RNA, 32 nt, Human
aggggaagagguguuggggcaggaagugaguc

SEQ ID NO: 58065 - RNA, 32 nt, Human
aggggaagcagagggaaauggggccaugugaa

SEQ ID NO: 58066 - RNA, 32 nt, Human
aggggaagccaagauuuggcuaagugugucug

SEQ ID NO: 58067 - RNA, 32 nt, Human
aggggaagcccccagcccugugggucaugguc

SEQ ID NO: 58068 - RNA, 32 nt, Human
aggggaagccuagugggccuggccccucccag

SEQ ID NO: 58069 - RNA, 32 nt, Human
aggggaagcugagagacagaggaggaacucag

SEQ ID NO: 58070 - RNA, 32 nt, Human
aggggaaggaagagaggacaaccuguaacuuu

SEQ ID NO: 58071 - RNA, 32 nt, Human
aggggaaggaaggggcuuugggaucuggaaac

SEQ ID NO: 58072 - RNA, 32 nt, Human
aggggaaggagaaagccuuccucuucucucau

SEQ ID NO: 58073 - RNA, 32 nt, Human
aggggaaggagaagagggagaauggagcagga

SEQ ID NO: 58074 - RNA, 32 nt, Human
aggggaaggagaggcuggcauugguggagcca

SEQ ID NO: 58075 - RNA, 32 nt, Human
aggggaaggaggaggaagaaguguaagaagag

SEQ ID NO: 58076 - RNA, 32 nt, Human
aggggaaggaggaggagcuuaaaagaggcuac

SEQ ID NO: 58077 - RNA, 32 nt, Human
aggggaaggaggcggugguggaggaggcaaag

SEQ ID NO: 58078 - RNA, 32 nt, Human
aggggaaggcuccuggagggcagcccuaccuc

SEQ ID NO: 58079 - RNA, 32 nt, Human
aggggaaggcugaugucaggagagggagaggg

SEQ ID NO: 58080 - RNA, 32 nt, Human
aggggaagggaaugugaccaggucuaggucug

SEQ ID NO: 58081 - RNA, 32 nt, Human
aggggaagggagcuugcaugccuccagccagg

SEQ ID NO: 58082 - RNA, 32 nt, Human
aggggaagggaucauggagagcccucuaaagc

SEQ ID NO: 58083 - RNA, 32 nt, Human
aggggaagggcacacccccugcccaugcaugg

SEQ ID NO: 58084 - RNA, 32 nt, Human
aggggaaggguacugaaaacaccauccauuug

SEQ ID NO: 58085 - RNA, 32 nt, Human
aggggaaggguggucagggugaggauggugag

SEQ ID NO: 58086 - RNA, 32 nt, Human
aggggaaggguugccagaguccugggggcccc

SEQ ID NO: 58087 - RNA, 32 nt, Human
aggggaagugcccucuuucuucacaggauguu

SEQ ID NO: 58088 - RNA, 32 nt, Human
aggggaaugcaccaaggcucucauugaggcca

SEQ ID NO: 58089 - RNA, 32 nt, Human
aggggaaugcuuccagcuuuugcccauucagu

SEQ ID NO: 58090 - RNA, 32 nt, Human
aggggaauggaagagaaaagacagggugggag

SEQ ID NO: 58091 - RNA, 32 nt, Human
aggggaauggcuugaacccaggaggcagaggu

SEQ ID NO: 58092 - RNA, 32 nt, Human
aggggacaacaucuacccucucuuggccugcu

SEQ ID NO: 58093 - RNA, 32 nt, Human
aggggacaagagaaagaggaaaaggagccacu

SEQ ID NO: 58094 - RNA, 32 nt, Human
aggggacaagggaggcaguggcuaguggggug

SEQ ID NO: 58095 - RNA, 32 nt, Human
aggggacacaaccugcuggagugcaauggcac

SEQ ID NO: 58096 - RNA, 32 nt, Human
aggggacacaggccacacaggugugcuuugaa

SEQ ID NO: 58097 - RNA, 32 nt, Human
aggggacacaucugguugccuuggaggcagaa

SEQ ID NO: 58098 - RNA, 17 nt, Human
aggggacagauaaggac

SEQ ID NO: 58099 - RNA, 32 nt, Human
aggggacagcacauaccacccccacccaaccu

SEQ ID NO: 58100 - RNA, 32 nt, Human
aggggacagcagagcagagaggcccagggagg

SEQ ID NO: 58101 - RNA, 32 nt, Human
aggggacagcuuuuggaagaugacaucugcaa

SEQ ID NO: 58102 - RNA, 32 nt, Human
aggggacaggccggggugagugcagcucccca

SEQ ID NO: 58103 - RNA, 32 nt, Human
aggggacaggccugugcgugccauccagaguc

SEQ ID NO: 58104 - RNA, 32 nt, Human
aggggacaguggaggcuggagcuacagcugaa

SEQ ID NO: 58105 - RNA, 32 nt, Human
aggggacauggcagagaugaaagaaagaaaga

SEQ ID NO: 58106 - RNA, 18 nt, Human
aggggacccaaggagcuc

SEQ ID NO: 58107 - RNA, 32 nt, Human
aggggaccccucucacuccugcugcugcccau

SEQ ID NO: 58108 - RNA, 32 nt, Human
aggggacccuccugcacaacaucuccagggga

SEQ ID NO: 58109 - RNA, 32 nt, Human
aggggaccgugugccccaguguuuccaucuug

SEQ ID NO: 58110 - RNA, 20 nt, Human
aggggaccuccuuccagcuc

SEQ ID NO: 58111 - RNA, 32 nt, Human
aggggaccuggaccaggaaccgagccugcucu

SEQ ID NO: 58112 - RNA, 32 nt, Human
aggggaccuggagcugccagcaccaagcguga

SEQ ID NO: 58113 - RNA, 32 nt, Human
aggggaccuggugacagacgaggcugcaggcu

SEQ ID NO: 58114 - RNA, 32 nt, Human
aggggaccuucaauaaacacuuguccagugaa

SEQ ID NO: 58115 - RNA, 32 nt, Human
aggggacgagcucagcccugcgccuuggcucu

SEQ ID NO: 58116 - RNA, 32 nt, Human
aggggacgcagccugcacuacgcgccccaaga

SEQ ID NO: 58117 - RNA, 32 nt, Human
aggggacgcugguagagauggaggaggaggca

SEQ ID NO: 58118 - RNA, 32 nt, Human
aggggacgcugugugugcugcaagugaccccg

SEQ ID NO: 58119 - RNA, 32 nt, Human
aggggacggagcugugcuuagggaagagcaga

SEQ ID NO: 58120 - RNA, 32 nt, Human
aggggacggcucugguuccccacgcugccccu

SEQ ID NO: 58121 - RNA, 32 nt, Human
aggggacgugggcccugcaggcugcaggaggg

SEQ ID NO: 58122 - RNA, 32 nt, Human
aggggacuccaaugacuguugugcucuccccc

SEQ ID NO: 58123 - RNA, 32 nt, Human
aggggacuccagccugggcggggugauaauga

SEQ ID NO: 58124 - RNA, 32 nt, Human
aggggacuccuggaaugugucugugaauaaag

SEQ ID NO: 58125 - RNA, 32 nt, Human
aggggacugccuggccuuccagaugcgaacug

SEQ ID NO: 58126 - RNA, 32 nt, Human
aggggacuggggugggcugagggaacagggca

SEQ ID NO: 58127 - RNA, 32 nt, Human
aggggacuuccgagagaaaaggggcagcugga

SEQ ID NO: 58128 - RNA, 32 nt, Human
aggggagaaaaaugacaaaugacgucuucacc

SEQ ID NO: 58129 - RNA, 21 nt, Human
aggggagaaaaggagccgcuu

SEQ ID NO: 58130 - RNA, 32 nt, Human
aggggagaaauggcgaaugucauacacaugag

SEQ ID NO: 58131 - RNA, 32 nt, Human
aggggagaagcauagagggccugugagcucac

SEQ ID NO: 58132 - RNA, 19 nt, Human
aggggagaagugggacaaa

SEQ ID NO: 58133 - RNA, 32 nt, Human
aggggagaaguguccccaggagguugggggag

SEQ ID NO: 58134 - RNA, 32 nt, Human
aggggagaaguuugggguuucagucccagggc

SEQ ID NO: 58135 - RNA, 32 nt, Human
aggggagaccuggccaagggagccagccagcg

SEQ ID NO: 58136 - RNA, 32 nt, Human
aggggagacgaaggagaagcaaacacugcgca

SEQ ID NO: 58137 - RNA, 32 nt, Human
aggggagacgccgcggggccgugaccuuggcg

SEQ ID NO: 58138 - RNA, 32 nt, Human
aggggagacuagccuggaaagacugcagagcu

SEQ ID NO: 58139 - RNA, 32 nt, Human
aggggagacugaggcugaggcuggggaacauc

SEQ ID NO: 58140 - RNA, 22 nt, Human
aggggagagaagggucauagcu

SEQ ID NO: 58141 - RNA, 21 nt, Human
aggggagagaagguggucugc

SEQ ID NO: 58142 - RNA, 32 nt, Human
aggggagagaccagcucuccagccuggcagga

SEQ ID NO: 58143 - RNA, 32 nt, Human
aggggagagagaaagagagguggggagagggg

SEQ ID NO: 58144 - RNA, 32 nt, Human
aggggagagcccacuggguagaaggaacaggg

SEQ ID NO: 58145 - RNA, 32 nt, Human
aggggagagcggacugugccagugagucggcg

SEQ ID NO: 58146 - RNA, 32 nt, Human
aggggagaggagaaggaauacugcuucaaguu

SEQ ID NO: 58147 - RNA, 20 nt, Human
aggggagagggaaacgugcc

SEQ ID NO: 58148 - RNA, 32 nt, Human
aggggagaguccauugaguuugccuuucagug

SEQ ID NO: 58149 - RNA, 21 nt, Human
aggggagauccugggaucaaa

SEQ ID NO: 58150 - RNA, 32 nt, Human
aggggagaugaagcccacagagcuggaaagag

SEQ ID NO: 58151 - RNA, 32 nt, Human
aggggagaugaguuugucuguccucugcugag

SEQ ID NO: 58152 - RNA, 32 nt, Human
aggggagcaaaagagaaaaggagccaggcugg

SEQ ID NO: 58153 - RNA, 19 nt, Human
aggggagcacccugggcca

SEQ ID NO: 58154 - RNA, 32 nt, Human
aggggagcaguggagguaagggcuccacccca

SEQ ID NO: 58155 - RNA, 32 nt, Human
aggggagcaguggccaucauccucccgccagg

SEQ ID NO: 58156 - RNA, 32 nt, Human
aggggagcagugugaggggaccaccuguuuua

SEQ ID NO: 58157 - RNA, 32 nt, Human
aggggagcccaagggcuguuucugccacuugc

SEQ ID NO: 58158 - RNA, 32 nt, Human
aggggagccccaggaaggcagcauucauaagc

SEQ ID NO: 58159 - RNA, 32 nt, Human
aggggagcccuucuccgcucagucuccaggag

SEQ ID NO: 58160 - RNA, 32 nt, Human
aggggagccggggcuuugcccugcugcugucc

SEQ ID NO: 58161 - RNA, 32 nt, Human
aggggagcgggguggagggaacacgugcagug

SEQ ID NO: 58162 - RNA, 32 nt, Human
aggggagcgugggauggggaccgugggaaaga

SEQ ID NO: 58163 - RNA, 32 nt, Human
aggggagcucaguuuucaacucuucccugaac

SEQ ID NO: 58164 - RNA, 17 nt, Human
aggggagcuccaagccc

SEQ ID NO: 58165 - RNA, 32 nt, Human
aggggagcucugagaggccagcacaggaaacc

SEQ ID NO: 58166 - RNA, 32 nt, Human
aggggagcucugucuguccguguuauuuauug

SEQ ID NO: 58167 - RNA, 32 nt, Human
aggggagcuucugcaaugggaguugccacaac

SEQ ID NO: 58168 - RNA, 32 nt, Human
aggggagcuugggucccugaacacugucauuc

SEQ ID NO: 58169 - RNA, 32 nt, Human
aggggaggaaaggcuccucucuuuagucacca

SEQ ID NO: 58170 - RNA, 32 nt, Human
aggggaggaggaggaggaggagaggagcaguc

SEQ ID NO: 58171 - RNA, 32 nt, Human
aggggaggaggaggaggaggaggaggucgugg

SEQ ID NO: 58172 - RNA, 32 nt, Human
aggggaggagggagcccugaaaagagguacua

SEQ ID NO: 58173 - RNA, 32 nt, Human
aggggaggagggaggaagaauagaggaaaaca

SEQ ID NO: 58174 - RNA, 32 nt, Human
aggggaggaguggccccagaauucagcacgca

SEQ ID NO: 58175 - RNA, 32 nt, Human
aggggaggagugucauuuuugagaaucuuggg

SEQ ID NO: 58176 - RNA, 32 nt, Human
aggggaggcagaaaggagaggucuauagcucc

SEQ ID NO: 58177 - RNA, 32 nt, Human
aggggaggcaggaagaaaggaaggaaggaaag

SEQ ID NO: 58178 - RNA, 32 nt, Human
aggggaggcccagccuccgaggagaccaggaa

SEQ ID NO: 58179 - RNA, 32 nt, Human
aggggaggccgaggugggaggaucauuggauc

SEQ ID NO: 58180 - RNA, 32 nt, Human
aggggaggcugaagcaggaggaucacuugagg

SEQ ID NO: 58181 - RNA, 32 nt, Human
aggggaggcugaggcaggagaaucgcuugaac

SEQ ID NO: 58182 - RNA, 30 nt, Human
aggggagggagccacagaaagcagaguggg

SEQ ID NO: 58183 - RNA, 32 nt, Human
aggggagggaggaggaggcggcgugcagggag

SEQ ID NO: 58184 - RNA, 32 nt, Human
aggggagggaggcggggguggacagggaggca

SEQ ID NO: 58185 - RNA, 32 nt, Human
aggggagggagggagaaggaaaagugugagau

SEQ ID NO: 58186 - RNA, 32 nt, Human
aggggagggagggagaguggaggguuugacgg

SEQ ID NO: 58187 - RNA, 32 nt, Human
aggggagggcaggcccggccuggaggggugcu

SEQ ID NO: 58188 - RNA, 32 nt, Human
aggggagggccagagcagggccuucuaaauca

SEQ ID NO: 58189 - RNA, 32 nt, Human
aggggaggggcaagugggacccugccaccugg

SEQ ID NO: 58190 - RNA, 32 nt, Human
aggggaggggcgauaaauaccuuugauuguaa

SEQ ID NO: 58191 - RNA, 32 nt, Human
aggggagggucugggugcccaggaguagaaua

SEQ ID NO: 58192 - RNA, 32 nt, Human
aggggagguggaggccagaggacagggagaca

SEQ ID NO: 58193 - RNA, 32 nt, Human
aggggagguggaguuggaaauguggguguucc

SEQ ID NO: 58194 - RNA, 32 nt, Human
aggggaguagauaugagagggagccgcuccug

SEQ ID NO: 58195 - RNA, 32 nt, Human
aggggagucucaaagcuggagaguuuaccaac

SEQ ID NO: 58196 - RNA, 32 nt, Human
aggggagugccaccccacccgugcuccacgag

SEQ ID NO: 58197 - RNA, 32 nt, Human
aggggagugggauguagggcugguauucuuug

SEQ ID NO: 58198 - RNA, 32 nt, Human
aggggagugggccggagcugagccccagcgug

SEQ ID NO: 58199 - RNA, 32 nt, Human
aggggaguucuccugggacagugggcucugca

SEQ ID NO: 58200 - RNA, 32 nt, Human
aggggaguuucugcuucuucccugccucugcc

SEQ ID NO: 58201 - RNA, 24 nt, Human
aggggauagcguuuggcuguguug

SEQ ID NO: 58202 - RNA, 32 nt, Human
aggggauauggggacgugacugggacagguuc

SEQ ID NO: 58203 - RNA, 32 nt, Human
aggggaucacuugaggccaggaguuuaagacc

SEQ ID NO: 58204 - RNA, 32 nt, Human
aggggaucaggaccagccucgcaagcauuuua

SEQ ID NO: 58205 - RNA, 32 nt, Human
aggggaucccagggggcacagagcagccccuu

SEQ ID NO: 58206 - RNA, 32 nt, Human
aggggauccgggccuugcgugcagccucccaa

SEQ ID NO: 58207 - RNA, 32 nt, Human
aggggaucggagggggauugaagaaugcgcca

SEQ ID NO: 58208 - RNA, 32 nt, Human
aggggaucuaaauccucauuuaucucuucuau

SEQ ID NO: 58209 - RNA, 32 nt, Human
aggggaucucauuauguugcccaaacuggucg

SEQ ID NO: 58210 - RNA, 32 nt, Human
aggggaugacaugcccaggugucagcucaaag

SEQ ID NO: 58211 - RNA, 32 nt, Human
aggggaugcagagcccugcccagcaccaccac

SEQ ID NO: 58212 - RNA, 19 nt, Human
aggggaugccgccaccaga

SEQ ID NO: 58213 - RNA, 32 nt, Human
aggggaugcugaggccgguccccagaggagca

SEQ ID NO: 58214 - RNA, 20 nt, Human
aggggauggaccaagaauuu

SEQ ID NO: 58215 - RNA, 32 nt, Human
aggggauggccagccuauguugcugacuccau

SEQ ID NO: 58216 - RNA, 32 nt, Human
aggggauggcgcuaggggacuuggggauuucu

SEQ ID NO: 58217 - RNA, 32 nt, Human
aggggauggggacccagaggugcaguggccgc

SEQ ID NO: 58218 - RNA, 32 nt, Human
aggggaugggggcaucccugugccucacucag

SEQ ID NO: 58219 - RNA, 32 nt, Human
aggggauggugcgauagauucaagauggagag

SEQ ID NO: 58220 - RNA, 24 nt, Human
aggggaugugcagcaucugugugg

SEQ ID NO: 58221 - RNA, 32 nt, Human
aggggaugugcuguagccuggugcagaguccc

SEQ ID NO: 58222 - RNA, 32 nt, Human
aggggauuaaaaccagcccaauugucccauag

SEQ ID NO: 58223 - RNA, 32 nt, Human
aggggauuacugagacagggaagagaagugca

SEQ ID NO: 58224 - RNA, 32 nt, Human
aggggauuacugugagcucacagcaggauagg

SEQ ID NO: 58225 - RNA, 32 nt, Human
aggggauucuggcuuuuccugccagagccacc

SEQ ID NO: 58226 - RNA, 32 nt, Human
aggggauuggggagcccaggaggcagccuucc

SEQ ID NO: 58227 - RNA, 32 nt, Human
aggggauuuccuccucuccuuccuccugucga

SEQ ID NO: 58228 - RNA, 32 nt, Human
aggggauuugggcuccaugagcuccuugaggg

SEQ ID NO: 58229 - RNA, 32 nt, Human
aggggauuuuaguuccaagcagggacccuggu

SEQ ID NO: 58230 - RNA, 32 nt, Human
aggggcaaaaugugcagauacuucauuuuugu

SEQ ID NO: 58231 - RNA, 32 nt, Human
aggggcaaagagaagaagggcccccgucagau

SEQ ID NO: 58232 - RNA, 22 nt, Human
aggggcaacugagaaagaacag

SEQ ID NO: 58233 - RNA, 21 nt, Human
aggggcaaggagccccgcggc

SEQ ID NO: 58234 - RNA, 32 nt, Human
aggggcaaguaggcacaguaagggaauuuucu

SEQ ID NO: 58235 - RNA, 19 nt, Human
aggggcaagugggacccug

SEQ ID NO: 58236 - RNA, 32 nt, Human
aggggcaauggcugcuuucagcuuugaggaca

SEQ ID NO: 58237 - RNA, 18 nt, Human
aggggcacacagaaauuu

SEQ ID NO: 58238 - RNA, 32 nt, Human
aggggcacagcccaguaggaagauaguaucuu

SEQ ID NO: 58239 - RNA, 20 nt, Human
aggggcaccaagaaccugcu

SEQ ID NO: 58240 - RNA, 32 nt, Human
aggggcaccacagcccuuaaggcacgagggaa

SEQ ID NO: 58241 - RNA, 32 nt, Human
aggggcaccacuacuccagcccagaaggaaag

SEQ ID NO: 58242 - RNA, 20 nt, Human
aggggcaccucuggaggcag

SEQ ID NO: 58243 - RNA, 32 nt, Human
aggggcacgagaagagaggagcagggaggagg

SEQ ID NO: 58244 - RNA, 32 nt, Human
aggggcacgcaggccgaccuguccucgagauc

SEQ ID NO: 58245 - RNA, 32 nt, Human
aggggcacgcaggccguccuguccucgagauc

SEQ ID NO: 58246 - RNA, 32 nt, Human
aggggcacucauuucuuagcagccucucuaca

SEQ ID NO: 58247 - RNA, 32 nt, Human
aggggcacuccaggcucugggcucagacggcu

SEQ ID NO: 58248 - RNA, 32 nt, Human
aggggcacuggguggggagggagguggaggag

SEQ ID NO: 58249 - RNA, 32 nt, Human
aggggcacugucugaacuccugacugucagga

SEQ ID NO: 58250 - RNA, 32 nt, Human
aggggcacuguggccagagaaaugcuuccacg

SEQ ID NO: 58251 - RNA, 19 nt, Human
aggggcacuucagaugaga

SEQ ID NO: 58252 - RNA, 32 nt, Human
aggggcagaagagcgcgagggagcgcggggca

SEQ ID NO: 58253 - RNA, 32 nt, Human
aggggcagaagcaagaagagauuguuuugaag

SEQ ID NO: 58254 - RNA, 32 nt, Human
aggggcagagcuggggcucugggaagaggcug

SEQ ID NO: 58255 - RNA, 32 nt, Human
aggggcagagucagggcuggagguagagaccu

SEQ ID NO: 58256 - RNA, 32 nt, Human
aggggcagagucaggggcuggccagagggucu

SEQ ID NO: 58257 - RNA, 32 nt, Human
aggggcagagugagucacggcccagacugcga

SEQ ID NO: 58258 - RNA, 22 nt, Human
aggggcagcaggagaagaugca

SEQ ID NO: 58259 - RNA, 32 nt, Human
aggggcagcaggaggccagggacccgggcugg

SEQ ID NO: 58260 - RNA, 32 nt, Human
aggggcagcagucuugaggagcagggagagga

SEQ ID NO: 58261 - RNA, 32 nt, Human
aggggcagccaggaguuuuugaggcagguggu

SEQ ID NO: 58262 - RNA, 32 nt, Human
aggggcagcccaucccucuucucccuccuggg

SEQ ID NO: 58263 - RNA, 32 nt, Human
aggggcagccuggggacuugagggaggaugca

SEQ ID NO: 58264 - RNA, 32 nt, Human
aggggcagccugguggccagagcugggggcac

SEQ ID NO: 58265 - RNA, 32 nt, Human
aggggcagcuacugcgagaacuucaggccaau

SEQ ID NO: 58266 - RNA, 32 nt, Human
aggggcagcucccgagggcacugugaaggcuc

SEQ ID NO: 58267 - RNA, 18 nt, Human
aggggcagcucucuggga

SEQ ID NO: 58268 - RNA, 32 nt, Human
aggggcagcugugagcuuugcagccagccccg

SEQ ID NO: 58269 - RNA, 32 nt, Human
aggggcaggaggagcugggcagaggagcccgu

SEQ ID NO: 58270 - RNA, 32 nt, Human
aggggcaggaugggggcaggagaguuagcaaa

SEQ ID NO: 58271 - RNA, 32 nt, Human
aggggcaggcagcuaggcagggagggggcugg

SEQ ID NO: 58272 - RNA, 23 nt, Human
aggggcaggccucaaagcccgcc

SEQ ID NO: 58273 - RNA, 32 nt, Human
aggggcaggcuggcugggaaacucagcccaga

SEQ ID NO: 58274 - RNA, 32 nt, Human
aggggcaggcuuugcgagcugcauuuggccuu

SEQ ID NO: 58275 - RNA, 32 nt, Human
aggggcagggagggcgcagaacuccgcuucug

SEQ ID NO: 58276 - RNA, 18 nt, Human
aggggcagggcccaggag

SEQ ID NO: 58277 - RNA, 20 nt, Human
aggggcagggccggcccgcc

SEQ ID NO: 58278 - RNA, 32 nt, Human
aggggcaggggagagacucucuccccaccacc

SEQ ID NO: 58279 - RNA, 18 nt, Human
aggggcaggucccaggag

SEQ ID NO: 58280 - RNA, 32 nt, Human
aggggcaggugcgagggagggaagagaagaaa

SEQ ID NO: 58281 - RNA, 32 nt, Human
aggggcagugaugccuuugaggggaaggagga

SEQ ID NO: 58282 - RNA, 32 nt, Human
aggggcaguguuagagcagggcuggucauacc

SEQ ID NO: 58283 - RNA, 32 nt, Human
aggggcaguuccucuuuccuucccaagcaccg

SEQ ID NO: 58284 - RNA, 32 nt, Human
aggggcaguuuaugagaaauucagagaaacau

SEQ ID NO: 58285 - RNA, 22 nt, Human
aggggcaucguuugaagaacag

SEQ ID NO: 58286 - RNA, 32 nt, Human
aggggcaucugugugucccgucacacacugca

SEQ ID NO: 58287 - RNA, 21 nt, Human
aggggcaugaggguauuuuuu

SEQ ID NO: 58288 - RNA, 32 nt, Human
aggggcauggacacgugaugugcugcucugua

SEQ ID NO: 58289 - RNA, 32 nt, Human
aggggcauggggcaccuggugcugcugagggg

SEQ ID NO: 58290 - RNA, 18 nt, Human
aggggcauuuucauugca

SEQ ID NO: 58291 - RNA, 23 nt, Human
aggggccaaggcaggaggaucac

SEQ ID NO: 58292 - RNA, 32 nt, Human
aggggccaaggcaggaggaucacuugaggcca

SEQ ID NO: 58293 - RNA, 32 nt, Human
aggggccaauccagccuccaacucuccuagcc

SEQ ID NO: 58294 - RNA, 32 nt, Human
aggggccacagcguuagacagugcagagagaa

SEQ ID NO: 58295 - RNA, 32 nt, Human
aggggccaccaccacacaugccuuucuggggu

SEQ ID NO: 58296 - RNA, 32 nt, Human
aggggccacccggggcacaggaaagggccgcu

SEQ ID NO: 58297 - RNA, 22 nt, Human
aggggccaccggggucuaaugg

SEQ ID NO: 58298 - RNA, 32 nt, Human
aggggccacugagacguuucugccucccucuu

SEQ ID NO: 58299 - RNA, 32 nt, Human
aggggccagaaaccugcauuuuuaacauggag

SEQ ID NO: 58300 - RNA, 32 nt, Human
aggggccagacuccagccuguuuccccagccc

SEQ ID NO: 58301 - RNA, 32 nt, Human
aggggccaggagaggaagcugaggggcagagg

SEQ ID NO: 58302 - RNA, 32 nt, Human
aggggccaggcagagggcgcggggcugggcug

SEQ ID NO: 58303 - RNA, 20 nt, Human
aggggccagggacugaguga

SEQ ID NO: 58304 - RNA, 32 nt, Human
aggggccaggggaaguuuucaggccuucauca

SEQ ID NO: 58305 - RNA, 32 nt, Human
aggggccaggggaucccucucucccuagugcc

SEQ ID NO: 58306 - RNA, 18 nt, Human
aggggccaggugcagugg

SEQ ID NO: 58307 - RNA, 23 nt, Human
aggggccaugcagcuggcguagg

SEQ ID NO: 58308 - RNA, 21 nt, Human
aggggccaugcauucagaugg

SEQ ID NO: 58309 - RNA, 28 nt, Human
aggggccauggugcugccuguccaacau

SEQ ID NO: 58310 - RNA, 22 nt, Human
aggggccauguggaaaucaaga

SEQ ID NO: 58311 - RNA, 24 nt, Human
aggggccauuauuuaaccugugug

SEQ ID NO: 58312 - RNA, 32 nt, Human
aggggccauucaacuaugcugguuugguuuga

SEQ ID NO: 58313 - RNA, 21 nt, Human
aggggccauuucugccuugug

SEQ ID NO: 58314 - RNA, 32 nt, Human
aggggcccacaccucaagccuggaccagccac

SEQ ID NO: 58315 - RNA, 23 nt, Human
aggggcccacucaggacaggaac

SEQ ID NO: 58316 - RNA, 20 nt, Human
aggggcccagaccugggccc

SEQ ID NO: 58317 - RNA, 32 nt, Human
aggggcccagggcaggacccagccuggacuug

SEQ ID NO: 58318 - RNA, 32 nt, Human
aggggcccaguucucagcagcagacacucugu

SEQ ID NO: 58319 - RNA, 32 nt, Human
aggggccccaacuuagcaucccuucccuuccg

SEQ ID NO: 58320 - RNA, 32 nt, Human
aggggcccccaacacaccaccugccuugggaa

SEQ ID NO: 58321 - RNA, 32 nt, Human
aggggcccccuuggugaccccagcacauucac

SEQ ID NO: 58322 - RNA, 21 nt, Human
aggggccccgcacacccgcga

SEQ ID NO: 58323 - RNA, 32 nt, Human
aggggccccugcuucuccagccuggaccccca

SEQ ID NO: 58324 - RNA, 32 nt, Human
aggggccccuggcgagaaccgcacacaccccu

SEQ ID NO: 58325 - RNA, 32 nt, Human
aggggcccgaggagaccgugaggcucuggccu

SEQ ID NO: 58326 - RNA, 32 nt, Human
aggggcccgagguggcagaggaagggggcugc

SEQ ID NO: 58327 - RNA, 32 nt, Human
aggggcccgggccagggccacagggagccaug

SEQ ID NO: 58328 - RNA, 32 nt, Human
aggggcccugaaugucaugaaggcuugagguc

SEQ ID NO: 58329 - RNA, 21 nt, Human
aggggcccugaauuuaugugg

SEQ ID NO: 58330 - RNA, 32 nt, Human
aggggcccugcaccacagcucuccaggacaua

SEQ ID NO: 58331 - RNA, 32 nt, Human
aggggcccugcaggcaggucuguggguucugg

SEQ ID NO: 58332 - RNA, 19 nt, Human
aggggccgagcccgcgcgg

SEQ ID NO: 58333 - RNA, 32 nt, Human
aggggccgagggggcuugcccacccaccccga

SEQ ID NO: 58334 - RNA, 32 nt, Human
aggggccggaggucucacgcugggaaggagcc

SEQ ID NO: 58335 - RNA, 32 nt, Human
aggggccggccugcuggccuggggcgugcgga

SEQ ID NO: 58336 - RNA, 32 nt, Human
aggggccggcuuugcgagcugcauuuggccuu

SEQ ID NO: 58337 - RNA, 32 nt, Human
aggggccggcuuuugcuuuaaaagcuuuaaaa

SEQ ID NO: 58338 - RNA, 21 nt, Human
aggggccgguaaaccuggugg

SEQ ID NO: 58339 - RNA, 32 nt, Human
aggggccguggcuucauucuugaagucaguga

SEQ ID NO: 58340 - RNA, 32 nt, Human
aggggccuaaccuagagcagguuuccauagug

SEQ ID NO: 58341 - RNA, 19 nt, Human
aggggccuacccagaagcc

SEQ ID NO: 58342 - RNA, 32 nt, Human
aggggccuacggaggcgcaggagcggugguga

SEQ ID NO: 58343 - RNA, 32 nt, Human
aggggccucacagagggcagggccagggucca

SEQ ID NO: 58344 - RNA, 32 nt, Human
aggggccuccaucccucuuacucauuuguagu

SEQ ID NO: 58345 - RNA, 32 nt, Human
aggggccuccaucccuuuuacucauuuguagu

SEQ ID NO: 58346 - RNA, 22 nt, Human
aggggccuccgggggcuuccug

SEQ ID NO: 58347 - RNA, 32 nt, Human
aggggccuccuugugucugaugcacagaugug

SEQ ID NO: 58348 - RNA, 32 nt, Human
aggggccucgggggaagagaaggggccacuuc

SEQ ID NO: 58349 - RNA, 32 nt, Human
aggggccucuacugccugucgcuggaccaccc

SEQ ID NO: 58350 - RNA, 25 nt, Human
aggggccugagcaguccuuggccug

SEQ ID NO: 58351 - RNA, 19 nt, Human
aggggccugagcccaggcc

SEQ ID NO: 58352 - RNA, 32 nt, Human
aggggccugccacccagccccuccagugcccu

SEQ ID NO: 58353 - RNA, 32 nt, Human
aggggccugcucccagcugccacgcucuauca

SEQ ID NO: 58354 - RNA, 32 nt, Human
aggggccugcugggugguggccaucugcgacc

SEQ ID NO: 58355 - RNA, 32 nt, Human
aggggccuggacugcaggccugaccugcuccc

SEQ ID NO: 58356 - RNA, 32 nt, Human
aggggccuggagcuaucuccaucuucagcucc

SEQ ID NO: 58357 - RNA, 20 nt, Human
aggggccuggagucguggcc

SEQ ID NO: 58358 - RNA, 22 nt, Human
aggggccuggaucuauugccua

SEQ ID NO: 58359 - RNA, 22 nt, Human
aggggccuggcacagcuggccu

SEQ ID NO: 58360 - RNA, 18 nt, Human
aggggccuggccucagcc

SEQ ID NO: 58361 - RNA, 32 nt, Human
aggggccuggccuggguggggcagggccuggc

SEQ ID NO: 58362 - RNA, 21 nt, Human
aggggccuggcuguggccugu

SEQ ID NO: 58363 - RNA, 32 nt, Human
aggggccuggcuugauggggucuugaagaggg

SEQ ID NO: 58364 - RNA, 22 nt, Human
aggggccugggagcccuguggc

SEQ ID NO: 58365 - RNA, 32 nt, Human
aggggccugggagcccuguggcuggaucugag

SEQ ID NO: 58366 - RNA, 32 nt, Human
aggggccugggcagagggccuggaccugggau

SEQ ID NO: 58367 - RNA, 32 nt, Human
aggggccugggcagggcggugucuggcagcag

SEQ ID NO: 58368 - RNA, 20 nt, Human
aggggccugggcugcugcuc

SEQ ID NO: 58369 - RNA, 32 nt, Human
aggggccuggggagacggaagggcgccagggg

SEQ ID NO: 58370 - RNA, 19 nt, Human
aggggccuggggcugggcc

SEQ ID NO: 58371 - RNA, 32 nt, Human
aggggccuguaacccagcuacucgugaggcca

SEQ ID NO: 58372 - RNA, 21 nt, Human
aggggccugugcagugacuga

SEQ ID NO: 58373 - RNA, 32 nt, Human
aggggccuguguucucagccuccugaguacuu

SEQ ID NO: 58374 - RNA, 32 nt, Human
aggggccuguuuccuguucucaucuccgaagc

SEQ ID NO: 58375 - RNA, 32 nt, Human
aggggccuuaucuauucuuuggauaauucugg

SEQ ID NO: 58376 - RNA, 29 nt, Human
aggggccuugugucugugccugccugucu

SEQ ID NO: 58377 - RNA, 32 nt, Human
aggggccuugugucugugccugccugucugac

SEQ ID NO: 58378 - RNA, 20 nt, Human
aggggcgaguagcagcucug

SEQ ID NO: 58379 - RNA, 32 nt, Human
aggggcgcagcgggaccagccccacauuccac

SEQ ID NO: 58380 - RNA, 32 nt, Human
aggggcgccagccugaagcugccaggcccuga

SEQ ID NO: 58381 - RNA, 22 nt, Human
aggggcgccggggcagugucca

SEQ ID NO: 58382 - RNA, 19 nt, Human
aggggcgcgcaaaggggga

SEQ ID NO: 58383 - RNA, 32 nt, Human
aggggcgcuagccuggcccgacugggcgaguc

SEQ ID NO: 58384 - RNA, 32 nt, Human
aggggcgcuccaggagccucugcaugaggcgg

SEQ ID NO: 58385 - RNA, 32 nt, Human
aggggcgcucuugacacugugccuucauuuuc

SEQ ID NO: 58386 - RNA, 32 nt, Human
aggggcgcugauuucauaggaucuggugcugu

SEQ ID NO: 58387 - RNA, 32 nt, Human
aggggcggaggaaaggagggggccggucccgg

SEQ ID NO: 58388 - RNA, 32 nt, Human
aggggcggaggacccgcgguugaaggaggcag

SEQ ID NO: 58389 - RNA, 21 nt, Human
aggggcggaggacugcccacc

SEQ ID NO: 58390 - RNA, 32 nt, Human
aggggcggaggcacagcugcuuccagcagcca

SEQ ID NO: 58391 - RNA, 32 nt, Human
aggggcggaggcggaggcagagguggaggcgc

SEQ ID NO: 58392 - RNA, 32 nt, Human
aggggcggaugcagccuaccuccugggcagug

SEQ ID NO: 58393 - RNA, 21 nt, Human
aggggcggcccggagccagcc

SEQ ID NO: 58394 - RNA, 22 nt, Human
aggggcggcggagagcgcgccg

SEQ ID NO: 58395 - RNA, 32 nt, Human
aggggcggcggagagcgcgccgagccgcggcc

SEQ ID NO: 58396 - RNA, 32 nt, Human
aggggcggcugaaguguggggucgcugguugg

SEQ ID NO: 58397 - RNA, 32 nt, Human
aggggcggcuguaggcgcagcuucagcagacu

SEQ ID NO: 58398 - RNA, 32 nt, Human
aggggcgggagagaggcaagggguggacggag

SEQ ID NO: 58399 - RNA, 22 nt, Human
aggggcggggacaccugccagg

SEQ ID NO: 58400 - RNA, 32 nt, Human
aggggcggggagaaggcgggggcgcugcaugc

SEQ ID NO: 58401 - RNA, 23 nt, Human
aggggcggggcagggagcccgcc

SEQ ID NO: 58402 - RNA, 32 nt, Human
aggggcggggucaaacacuguugcccaggcug

SEQ ID NO: 58403 - RNA, 22 nt, Human
aggggcgugaguucauccuucu

SEQ ID NO: 58404 - RNA, 32 nt, Human
aggggcgugcuggggugguuugggagugcaca

SEQ ID NO: 58405 - RNA, 32 nt, Human
aggggcguggagcccccagagcuggaagaggg

SEQ ID NO: 58406 - RNA, 22 nt, Human
aggggcguggguucauccuucu

SEQ ID NO: 58407 - RNA, 32 nt, Human
aggggcuaaagaggaggacgaagaaaagcaga

SEQ ID NO: 58408 - RNA, 32 nt, Human
aggggcuaggacuagggugagagggagugggg

SEQ ID NO: 58409 - RNA, 32 nt, Human
aggggcuauccagagauucccaguaggagaca

SEQ ID NO: 58410 - RNA, 32 nt, Human
aggggcuauuccugucuuaggcgauuuguggg

SEQ ID NO: 58411 - RNA, 32 nt, Human
aggggcucaagaccagccuggccaacuuggug

SEQ ID NO: 58412 - RNA, 31 nt, Human
aggggcucaauaaaugcuuguugaacuugaa

SEQ ID NO: 58413 - RNA, 18 nt, Human
aggggcucaaucucagca

SEQ ID NO: 58414 - RNA, 32 nt, Human
aggggcucaccuaggugagugcacagccugug

SEQ ID NO: 58415 - RNA, 32 nt, Human
aggggcuccagccuggcaguuucugcguguua

SEQ ID NO: 58416 - RNA, 32 nt, Human
aggggcuccaggcccagcuagguggaucucca

SEQ ID NO: 58417 - RNA, 32 nt, Human
aggggcuccagguagaaugagcuguauccuug

SEQ ID NO: 58418 - RNA, 32 nt, Human
aggggcucccacugcuucuggucuccagggac

SEQ ID NO: 58419 - RNA, 32 nt, Human
aggggcuccccgggggcagacaccugugcacc

SEQ ID NO: 58420 - RNA, 32 nt, Human
aggggcucccugauuccccuaaagcuaugcac

SEQ ID NO: 58421 - RNA, 32 nt, Human
aggggcucccuucagguggcccccucuguggu

SEQ ID NO: 58422 - RNA, 32 nt, Human
aggggcuccuagugggccaggcugaccgcaga

SEQ ID NO: 58423 - RNA, 29 nt, Human
aggggcucggcugccucauccccuggcgg

SEQ ID NO: 58424 - RNA, 32 nt, Human
aggggcucucuccccucucccaucucaagaug

SEQ ID NO: 58425 - RNA, 32 nt, Human
aggggcucugccacucccagccugggaaugaa

SEQ ID NO: 58426 - RNA, 32 nt, Human
aggggcucuggagugccuuagagcagagcugc

SEQ ID NO: 58427 - RNA, 32 nt, Human
aggggcucuucagaccacacagcccugaccgg

SEQ ID NO: 58428 - RNA, 32 nt, Human
aggggcugaagaggaagguggaaggagauaaa

SEQ ID NO: 58429 - RNA, 32 nt, Human
aggggcugacagugccuggggccagagcuggg

SEQ ID NO: 58430 - RNA, 32 nt, Human
aggggcugacugccgggagacggagccaggcu

SEQ ID NO: 58431 - RNA, 26 nt, Human
aggggcugagcuggucuuucacugca

SEQ ID NO: 58432 - RNA, 32 nt, Human
aggggcugcacucagacucccuggccaagcaa

SEQ ID NO: 58433 - RNA, 32 nt, Human
aggggcugcaggaagggggaaugaggaaugau

SEQ ID NO: 58434 - RNA, 32 nt, Human
aggggcugccgcagaggccggagaccuccugg

SEQ ID NO: 58435 - RNA, 32 nt, Human
aggggcugcuacugcugccgcugcugccgcug

SEQ ID NO: 58436 - RNA, 32 nt, Human
aggggcugcuccaugcggcauucuuggagguc

SEQ ID NO: 58437 - RNA, 32 nt, Human
aggggcugcugggcaguggccugggaaugggg

SEQ ID NO: 58438 - RNA, 32 nt, Human
aggggcuggaaagaauggacuggcagagugug

SEQ ID NO: 58439 - RNA, 20 nt, Human
aggggcuggaggaccgagag

SEQ ID NO: 58440 - RNA, 32 nt, Human
aggggcuggaggccuuuuccugacugauuacu

SEQ ID NO: 58441 - RNA, 32 nt, Human
aggggcuggccucugcugagcugcuucccagu

SEQ ID NO: 58442 - RNA, 32 nt, Human
aggggcuggcuaaugugcaguggagcggggau

SEQ ID NO: 58443 - RNA, 32 nt, Human
aggggcuggcuaguggggaaauauguaguacc

SEQ ID NO: 58444 - RNA, 31 nt, Human
aggggcuggcuguugagauggguggacagga

SEQ ID NO: 58445 - RNA, 21 nt, Human
aggggcugggaagaaggggga

SEQ ID NO: 58446 - RNA, 32 nt, Human
aggggcugggcacaagcaaauaaagucuggcu

SEQ ID NO: 58447 - RNA, 32 nt, Human
aggggcugggcccgggguccugcaggcggcac

SEQ ID NO: 58448 - RNA, 32 nt, Human
aggggcugggcuggacaccagggcccgcccuc

SEQ ID NO: 58449 - RNA, 32 nt, Human
aggggcuggggagggggacagggagugagugu

SEQ ID NO: 58450 - RNA, 32 nt, Human
aggggcuggggagggggaggggcaggagcuug

SEQ ID NO: 58451 - RNA, 32 nt, Human
aggggcugggggaaaugacccgggaggguccc

SEQ ID NO: 58452 - RNA, 32 nt, Human
aggggcuggggguacacacagcucaggagaca

SEQ ID NO: 58453 - RNA, 32 nt, Human
aggggcugggguguuuaccuggagccuggaca

SEQ ID NO: 58454 - RNA, 32 nt, Human
aggggcugggugagcaggccagcugggcuaug

SEQ ID NO: 58455 - RNA, 23 nt, Human
aggggcugggugugguggcucau

SEQ ID NO: 58456 - RNA, 32 nt, Human
aggggcuggugggcaccaagagccaauggagu

SEQ ID NO: 58457 - RNA, 32 nt, Human
aggggcuggugugugggagcugcuaccuggca

SEQ ID NO: 58458 - RNA, 32 nt, Human
aggggcuguaaggugggcucugggccuuccag

SEQ ID NO: 58459 - RNA, 32 nt, Human
aggggcuguccacuuccuguggguucacagcu

SEQ ID NO: 58460 - RNA, 16 nt, Human
aggggcuguccagccc

SEQ ID NO: 58461 - RNA, 32 nt, Human
aggggcugucuauuagcauauuuccuuugagg

SEQ ID NO: 58462 - RNA, 32 nt, Human
aggggcuguggggagggaaaaugaggaguuac

SEQ ID NO: 58463 - RNA, 32 nt, Human
aggggcugugucugggugagggauggcggggu

SEQ ID NO: 58464 - RNA, 32 nt, Human
aggggcuguuauauacauauauacacaaccaa

SEQ ID NO: 58465 - RNA, 16 nt, Human
aggggcuguugcugaa

SEQ ID NO: 58466 - RNA, 32 nt, Human
aggggcuuagaggcaugggcuugcuguggguu

SEQ ID NO: 58467 - RNA, 32 nt, Human
aggggcuuccuaaccccugccugauaggugca

SEQ ID NO: 58468 - RNA, 32 nt, Human
aggggcuuccuuggacaaacuuuccagcucuc

SEQ ID NO: 58469 - RNA, 32 nt, Human
aggggcuucucccccucagcucucccucacac

SEQ ID NO: 58470 - RNA, 32 nt, Human
aggggcuucucccuuuccuugagcucucugga

SEQ ID NO: 58471 - RNA, 32 nt, Human
aggggcuucucccuuugcuugacucucauucu

SEQ ID NO: 58472 - RNA, 32 nt, Human
aggggcuugagaggaacgcccacccacgaagg

SEQ ID NO: 58473 - RNA, 32 nt, Human
aggggcuugaucuggguuagucugggggcaag

SEQ ID NO: 58474 - RNA, 32 nt, Human
aggggcuugccuggcuuggcugcagugcacuu

SEQ ID NO: 58475 - RNA, 32 nt, Human
aggggcuuggaccacacugcagccuggcuucu

SEQ ID NO: 58476 - RNA, 32 nt, Human
aggggcuugggcuucccuuugacccucuuccu

SEQ ID NO: 58477 - RNA, 32 nt, Human
aggggcuugggugggaugucgggugggauguu

SEQ ID NO: 58478 - RNA, 32 nt, Human
aggggcuuugugaccagaaagcuucauccaca

SEQ ID NO: 58479 - RNA, 32 nt, Human
agggggaaaagcuuccagaaagcagccaugaa

SEQ ID NO: 58480 - RNA, 18 nt, Human
agggggaaacuacaugaa

SEQ ID NO: 58481 - RNA, 20 nt, Human
agggggaaacugaccaagaa

SEQ ID NO: 58482 - RNA, 32 nt, Human
agggggaaagaaggagaaaggaaagaaaaacc

SEQ ID NO: 58483 - RNA, 32 nt, Human
agggggaaccagccugagugcagcugccaacu

SEQ ID NO: 58484 - RNA, 32 nt, Human
agggggaacguggcugguuggaggagguagau

SEQ ID NO: 58485 - RNA, 24 nt, Human
agggggaagaauugcuugggccca

SEQ ID NO: 58486 - RNA, 32 nt, Human
agggggaagagaggaggggagaggagaaggga

SEQ ID NO: 58487 - RNA, 32 nt, Human
agggggaagaggagaggguauggggcggcaga

SEQ ID NO: 58488 - RNA, 19 nt, Human
agggggaagcauaaggaac

SEQ ID NO: 58489 - RNA, 32 nt, Human
agggggaagccaaccccuccugugcugccggu

SEQ ID NO: 58490 - RNA, 32 nt, Human
agggggaagccaaccccuccugugcugcuggu

SEQ ID NO: 58491 - RNA, 32 nt, Human
agggggaccucaccuccugugcacagcccacc

SEQ ID NO: 58492 - RNA, 32 nt, Human
agggggacgacuucacacucacugccucaugu

SEQ ID NO: 58493 - RNA, 21 nt, Human
agggggacgagugccugggca

SEQ ID NO: 58494 - RNA, 32 nt, Human
agggggagaaaacuguacucuguccagacaug

SEQ ID NO: 58495 - RNA, 32 nt, Human
agggggagacaaaacuccuacucucaaccuca

SEQ ID NO: 58496 - RNA, 32 nt, Human
agggggagagcaucacacaugcccugaaucau

SEQ ID NO: 58497 - RNA, 32 nt, Human
agggggagaggcaccaccuggggaagacugcc

SEQ ID NO: 58498 - RNA, 32 nt, Human
agggggagagugaacugacagacucagucacu

SEQ ID NO: 58499 - RNA, 32 nt, Human
agggggagcaucccuagugaauacucacacca

SEQ ID NO: 58500 - RNA, 32 nt, Human
agggggagcccaauuccuuucucacccccucc

SEQ ID NO: 58501 - RNA, 32 nt, Human
agggggagcccaggagaccagaacaugaacuc

SEQ ID NO: 58502 - RNA, 32 nt, Human
agggggagccugggugcagcagagacagagga

SEQ ID NO: 58503 - RNA, 32 nt, Human
agggggagcuggaggcuggagccuguaacacc

SEQ ID NO: 58504 - RNA, 32 nt, Human
agggggaggaaaaggagagggaagagguagag

SEQ ID NO: 58505 - RNA, 32 nt, Human
agggggaggaagaaguaugcgcugcacauuuc

SEQ ID NO: 58506 - RNA, 32 nt, Human
agggggaggagaaggaggaagagggggaggag

SEQ ID NO: 58507 - RNA, 32 nt, Human
agggggaggagagagguaggagcuggagauga

SEQ ID NO: 58508 - RNA, 32 nt, Human
agggggaggagaggagaaagggaggaagcugg

SEQ ID NO: 58509 - RNA, 32 nt, Human
agggggaggaggaggaggaucaugaaggccgg

SEQ ID NO: 58510 - RNA, 31 nt, Human
agggggaggcacuuuaggacaccccuuaggc

SEQ ID NO: 58511 - RNA, 32 nt, Human
agggggaggcagcaagagucacuuugggggac

SEQ ID NO: 58512 - RNA, 32 nt, Human
agggggaggcccuuccgagccugggccugggu

SEQ ID NO: 58513 - RNA, 32 nt, Human
agggggagggagcacaacucagaacucaucuu

SEQ ID NO: 58514 - RNA, 32 nt, Human
agggggaggguugcccacuaggaggagcuucu

SEQ ID NO: 58515 - RNA, 32 nt, Human
agggggagguucacauguuugcagugaaaagc

SEQ ID NO: 58516 - RNA, 32 nt, Human
agggggaguggaagagguaccaggagucacuc

SEQ ID NO: 58517 - RNA, 18 nt, Human
agggggagugggggccag

SEQ ID NO: 58518 - RNA, 32 nt, Human
agggggaguucauuguugaguaugaauuuaaa

SEQ ID NO: 58519 - RNA, 32 nt, Human
agggggauagcggguggugagggaaggggcac

SEQ ID NO: 58520 - RNA, 32 nt, Human
agggggaucgcuugaguccaggaguuugagac

SEQ ID NO: 58521 - RNA, 32 nt, Human
agggggaugggcuggcuguggccagguuuagg

SEQ ID NO: 58522 - RNA, 32 nt, Human
agggggaugucaacaacagaucaagccgucau

SEQ ID NO: 58523 - RNA, 32 nt, Human
agggggcaaccaggagcacauucuggggagca

SEQ ID NO: 58524 - RNA, 32 nt, Human
agggggcacuauaguguucuuggacuugucgu

SEQ ID NO: 58525 - RNA, 32 nt, Human
agggggcacugaggaagcagaggccccuuggg

SEQ ID NO: 58526 - RNA, 20 nt, Human
agggggcacugcccgcuggu

SEQ ID NO: 58527 - RNA, 32 nt, Human
agggggcagacagcaccccuggaguccuccua

SEQ ID NO: 58528 - RNA, 32 nt, Human
agggggcagccuggccacugccuagcuggaau

SEQ ID NO: 58529 - RNA, 32 nt, Human
agggggcaggaacagcaggccuggccagccca

SEQ ID NO: 58530 - RNA, 32 nt, Human
agggggcagggacuggccagacugccugccuc

SEQ ID NO: 58531 - RNA, 19 nt, Human
agggggcaggggcugcugg

SEQ ID NO: 58532 - RNA, 32 nt, Human
agggggcaguccugugccuugugggcccucag

SEQ ID NO: 58533 - RNA, 32 nt, Human
agggggcagucuugcuuuauucauccuccauc

SEQ ID NO: 58534 - RNA, 32 nt, Human
agggggcagugaggugccccugccuggagcac

SEQ ID NO: 58535 - RNA, 21 nt, Human
agggggcaguggcaccuguug

SEQ ID NO: 58536 - RNA, 32 nt, Human
agggggcauuaugggcccugccuccccauagg

SEQ ID NO: 58537 - RNA, 32 nt, Human
agggggccaaaccagugcuccugccaccucuc

SEQ ID NO: 58538 - RNA, 32 nt, Human
agggggccaaggacacagcacugggcuggggc

SEQ ID NO: 58539 - RNA, 32 nt, Human
agggggccaaggacuuuagagcuguuuccucc

SEQ ID NO: 58540 - RNA, 32 nt, Human
agggggccaccaauaucuagcuauggaucgug

SEQ ID NO: 58541 - RNA, 17 nt, Human
agggggccagcugggga

SEQ ID NO: 58542 - RNA, 32 nt, Human
agggggccauucuuaccaguucuguuucuguu

SEQ ID NO: 58543 - RNA, 32 nt, Human
agggggcccagccucagguccucugcuucucc

SEQ ID NO: 58544 - RNA, 32 nt, Human
agggggccccaagaggagaggagaagugcuga

SEQ ID NO: 58545 - RNA, 32 nt, Human
agggggcccccugaagcgucaggcugggggca

SEQ ID NO: 58546 - RNA, 32 nt, Human
agggggcccucuuacuccuuccucucuccucc

SEQ ID NO: 58547 - RNA, 32 nt, Human
agggggcccuggaggaauggaugguggcggaa

SEQ ID NO: 58548 - RNA, 32 nt, Human
agggggccucacugccuuguuggucuccaccu

SEQ ID NO: 58549 - RNA, 32 nt, Human
agggggccuccccugcuaucccuccucccauc

SEQ ID NO: 58550 - RNA, 32 nt, Human
agggggccugcagggagccagaggguggaaau

SEQ ID NO: 58551 - RNA, 32 nt, Human
agggggccugggaggagggucuguaggaccug

SEQ ID NO: 58552 - RNA, 32 nt, Human
agggggccuucccagccugaucccuguccucc

SEQ ID NO: 58553 - RNA, 32 nt, Human
agggggccuuucucccaccaucaccgccugug

SEQ ID NO: 58554 - RNA, 32 nt, Human
agggggccuuucugcuucuuagccagcuaccu

SEQ ID NO: 58555 - RNA, 23 nt, Human
agggggcgaaucacgaggucagg

SEQ ID NO: 58556 - RNA, 21 nt, Human
agggggcgcagggacagcccc

SEQ ID NO: 58557 - RNA, 32 nt, Human
agggggcgcggaaggaaggaggcgggacggua

SEQ ID NO: 58558 - RNA, 32 nt, Human
agggggcgcugcagccacgcugggucaggcuc

SEQ ID NO: 58559 - RNA, 32 nt, Human
agggggcgcugggguguugcacuuugggggau

SEQ ID NO: 58560 - RNA, 32 nt, Human
agggggcgggcaggccggcgggcggugaugug

SEQ ID NO: 58561 - RNA, 32 nt, Human
agggggcgggucuugcucgaauguucucacuc

SEQ ID NO: 58562 - RNA, 32 nt, Human
agggggcgugagccaacagccgacggcugagg

SEQ ID NO: 58563 - RNA, 32 nt, Human
agggggcuaaagaggaaggaggggaggagguc

SEQ ID NO: 58564 - RNA, 32 nt, Human
agggggcuccuccauucccugcucacucagcc

SEQ ID NO: 58565 - RNA, 32 nt, Human
agggggcucgagaccagaccacacugccaucu

SEQ ID NO: 58566 - RNA, 32 nt, Human
agggggcucgccgguucuccagcccggacugc

SEQ ID NO: 58567 - RNA, 20 nt, Human
agggggcucuucccccagag

SEQ ID NO: 58568 - RNA, 32 nt, Human
agggggcugaggcuggacaauggugugaaccc

SEQ ID NO: 58569 - RNA, 32 nt, Human
agggggcugagggccaauugcaguggccuuug

SEQ ID NO: 58570 - RNA, 32 nt, Human
agggggcugccaggcuggcugccgaugcuccg

SEQ ID NO: 58571 - RNA, 32 nt, Human
agggggcugccauccccugccugccaccugcc

SEQ ID NO: 58572 - RNA, 21 nt, Human
agggggcugcugcccaccagc

SEQ ID NO: 58573 - RNA, 32 nt, Human
agggggcugcuuggugaugagccagccugaug

SEQ ID NO: 58574 - RNA, 32 nt, Human
agggggcugcuuugggcuuugcaccugcacuu

SEQ ID NO: 58575 - RNA, 32 nt, Human
agggggcugggcagaggguggaggagguccug

SEQ ID NO: 58576 - RNA, 32 nt, Human
agggggcugggucggcagcccaggcauccuca

SEQ ID NO: 58577 - RNA, 32 nt, Human
agggggcuguugugguuccgacuauaaacagu

SEQ ID NO: 58578 - RNA, 32 nt, Human
agggggcuuccaccauucccagaacugaucaa

SEQ ID NO: 58579 - RNA, 32 nt, Human
agggggcuuccucucuuaggggugagaaagca

SEQ ID NO: 58580 - RNA, 21 nt, Human
agggggcuucuucccugcugg

SEQ ID NO: 58581 - RNA, 32 nt, Human
agggggcuugcagcaucugcaggggccagaaa

SEQ ID NO: 58582 - RNA, 32 nt, Human
agggggcuugccuugcucucuccagggccagu

SEQ ID NO: 58583 - RNA, 32 nt, Human
agggggcuuucaaccaggcucacccaggcugg

SEQ ID NO: 58584 - RNA, 32 nt, Human
agggggcuuuguguugcuggugguguuccugg

SEQ ID NO: 58585 - RNA, 20 nt, Human
aggggggucucacuauguug

SEQ ID NO: 58586 - RNA, 20 nt, Human
agggggguuucaccguguug

SEQ ID NO: 58587 - RNA, 32 nt, Human
aggggguaaaugcuugccgcuuuagaggugga

SEQ ID NO: 58588 - RNA, 32 nt, Human
aggggguacagcuguuauacuuuaugaaccua

SEQ ID NO: 58589 - RNA, 32 nt, Human
aggggguagagggagccaggagcacuggguuc

SEQ ID NO: 58590 - RNA, 32 nt, Human
aggggguagguuuggagggaggccauuuucca

SEQ ID NO: 58591 - RNA, 32 nt, Human
aggggguaugaggaggaggagggggaggagca

SEQ ID NO: 58592 - RNA, 32 nt, Human
aggggguccagcucugcuucccuucccaccug

SEQ ID NO: 58593 - RNA, 32 nt, Human
aggggguccauaguuggacuucagagggucua

SEQ ID NO: 58594 - RNA, 32 nt, Human
agggggucucagauuggcggggaugggcagca

SEQ ID NO: 58595 - RNA, 32 nt, Human
agggggucucccucucacacugccucagugcu

SEQ ID NO: 58596 - RNA, 32 nt, Human
agggggucuggggugcagcccugccagcauca

SEQ ID NO: 58597 - RNA, 32 nt, Human
agggggugaggcagaggaucacuugagcccag

SEQ ID NO: 58598 - RNA, 32 nt, Human
agggggugagggaugaguaaggagaacacaug

SEQ ID NO: 58599 - RNA, 32 nt, Human
agggggugcaaagaagagacagcagcgcccag

SEQ ID NO: 58600 - RNA, 32 nt, Human
agggggugcagacugagcagugaacagaagga

SEQ ID NO: 58601 - RNA, 32 nt, Human
agggggugcccaggugguggcugcaagguggc

SEQ ID NO: 58602 - RNA, 31 nt, Human
agggggugccucucggaggagccugugucca

SEQ ID NO: 58603 - RNA, 32 nt, Human
agggggugcgggccacacagguagccacccug

SEQ ID NO: 58604 - RNA, 32 nt, Human
agggggugcgggugugugcuguccuggggaca

SEQ ID NO: 58605 - RNA, 32 nt, Human
aggggguggaaaaggugauggugcuggggugu

SEQ ID NO: 58606 - RNA, 31 nt, Human
aggggguggaaacugcaucacagauguuuuc

SEQ ID NO: 58607 - RNA, 32 nt, Human
aggggguggagcugcccugucccuggaggcgc

SEQ ID NO: 58608 - RNA, 32 nt, Human
aggggguggaucaccugaggucgggaguucua

SEQ ID NO: 58609 - RNA, 25 nt, Human
agggggugggaauggggugggguca

SEQ ID NO: 58610 - RNA, 18 nt, Human
agggggugggacagggac

SEQ ID NO: 58611 - RNA, 32 nt, Human
agggggugggauggagagaaugcugaaucuuu

SEQ ID NO: 58612 - RNA, 32 nt, Human
agggggugggcaggaaaggucucacuaagaac

SEQ ID NO: 58613 - RNA, 32 nt, Human
agggggugggccagccccagggccaggguccc

SEQ ID NO: 58614 - RNA, 32 nt, Human
agggggugggcccaccaccgcccagcccuccu

SEQ ID NO: 58615 - RNA, 32 nt, Human
agggggugggcugccugccugcucugagcucu

SEQ ID NO: 58616 - RNA, 32 nt, Human
aggggguggggaggggcaugugcaggaagagg

SEQ ID NO: 58617 - RNA, 32 nt, Human
aggggguggggagggggcccacaagcacgccc

SEQ ID NO: 58618 - RNA, 23 nt, Human
agggggugucaccauguuggcca

SEQ ID NO: 58619 - RNA, 20 nt, Human
agggggugugccaggccuga

SEQ ID NO: 58620 - RNA, 32 nt, Human
agggggugugccaggccugaacugagcuaagc

SEQ ID NO: 58621 - RNA, 32 nt, Human
aggggguguggaaagagcaggcuuccaggaga

SEQ ID NO: 58622 - RNA, 21 nt, Human
agggggugugucccacaaacg

SEQ ID NO: 58623 - RNA, 18 nt, Human
aggggguucuugcuccau

SEQ ID NO: 58624 - RNA, 23 nt, Human
aggggguuucaccacguuggcca

SEQ ID NO: 58625 - RNA, 23 nt, Human
aggggguuucaccauguuggcca

SEQ ID NO: 58626 - RNA, 23 nt, Human
aggggguuucaccauguuuguca

SEQ ID NO: 58627 - RNA, 32 nt, Human
aggggguuucugcgcacccacagucgccaccg

SEQ ID NO: 58628 - RNA, 32 nt, Human
agggguaagggagggcaggggugagggggagc

SEQ ID NO: 58629 - RNA, 32 nt, Human
agggguaagggcccgugggcgcagcccuagcc

SEQ ID NO: 58630 - RNA, 32 nt, Human
agggguaauggcaucuccccacuuuaggcuuc

SEQ ID NO: 58631 - RNA, 22 nt, Human
agggguacacucuccuacaaaa

SEQ ID NO: 58632 - RNA, 32 nt, Human
agggguaccaaaacaggaagccucacuaggaa

SEQ ID NO: 58633 - RNA, 32 nt, Human
agggguaccaaagugauccuccaucuuaaaga

SEQ ID NO: 58634 - RNA, 32 nt, Human
agggguacccaccccugcccuucaaccacgug

SEQ ID NO: 58635 - RNA, 32 nt, Human
agggguagcugccgaugugucuugagauuguu

SEQ ID NO: 58636 - RNA, 32 nt, Human
agggguaggacugcaggggccacuccaaacuc

SEQ ID NO: 58637 - RNA, 32 nt, Human
agggguaggcaggcacagagugcugucugcug

SEQ ID NO: 58638 - RNA, 32 nt, Human
agggguagggagaggagccgagagggagggga

SEQ ID NO: 58639 - RNA, 32 nt, Human
agggguauggcacuggugcuuaugauaccacc

SEQ ID NO: 58640 - RNA, 32 nt, Human
agggguaugguauggcagcuguggcagaggga

SEQ ID NO: 58641 - RNA, 32 nt, Human
agggguauguugggggauuggaagcacuugaa

SEQ ID NO: 58642 - RNA, 32 nt, Human
aggggucaaaccugugguguguggaagugacc

SEQ ID NO: 58643 - RNA, 32 nt, Human
aggggucacugaggccugagacccaggacucc

SEQ ID NO: 58644 - RNA, 32 nt, Human
aggggucagaagcagggacuggggcaggcgag

SEQ ID NO: 58645 - RNA, 32 nt, Human
aggggucagcaacuucauccagggcaucaagc

SEQ ID NO: 58646 - RNA, 32 nt, Human
aggggucagcagaggagagcucugggguuggg

SEQ ID NO: 58647 - RNA, 32 nt, Human
aggggucagcccaggcugcugggcuguagcca

SEQ ID NO: 58648 - RNA, 32 nt, Human
aggggucaggcagcugugucuccccacacugg

SEQ ID NO: 58649 - RNA, 32 nt, Human
aggggucagugguucucucgggucucgggaca

SEQ ID NO: 58650 - RNA, 32 nt, Human
aggggucauccagcugggccuaggggugcagg

SEQ ID NO: 58651 - RNA, 32 nt, Human
aggggucaucgcugcccagagccuggggauuc

SEQ ID NO: 58652 - RNA, 32 nt, Human
agggguccagagaggcaggcuggggaggcaag

SEQ ID NO: 58653 - RNA, 32 nt, Human
agggguccagcagaggcugacagaguggccuc

SEQ ID NO: 58654 - RNA, 20 nt, Human
agggguccagccagaagcca

SEQ ID NO: 58655 - RNA, 32 nt, Human
agggguccagugguguggggccuguugagaua

SEQ ID NO: 58656 - RNA, 32 nt, Human
aggggucccagguagucccugcucuuggcuuc

SEQ ID NO: 58657 - RNA, 32 nt, Human
aggggucccgcuuuccucagccuggaugugcc

SEQ ID NO: 58658 - RNA, 32 nt, Human
agggguccggcaugcugcuggcauuuugcugu

SEQ ID NO: 58659 - RNA, 32 nt, Human
agggguccucucucccugguugugcccucccc

SEQ ID NO: 58660 - RNA, 32 nt, Human
agggguccugaucuuaacccuuuccugggucu

SEQ ID NO: 58661 - RNA, 32 nt, Human
agggguccugggaggggauggggcugggggau

SEQ ID NO: 58662 - RNA, 32 nt, Human
aggggucgacuucgggcuggccaucugguuag

SEQ ID NO: 58663 - RNA, 32 nt, Human
aggggucggggaaaggagggagugccuccaac

SEQ ID NO: 58664 - RNA, 32 nt, Human
aggggucuaagccuucccuccugggcuaggga

SEQ ID NO: 58665 - RNA, 32 nt, Human
aggggucuaggugaugacugggauuucuaggg

SEQ ID NO: 58666 - RNA, 32 nt, Human
aggggucuccagugcuccugacuccucacagc

SEQ ID NO: 58667 - RNA, 32 nt, Human
aggggucucucccaacauauuucucuuccuug

SEQ ID NO: 58668 - RNA, 32 nt, Human
aggggucucucccuauuuuacccaagcuggcc

SEQ ID NO: 58669 - RNA, 32 nt, Human
aggggucugcauucaagcacgauguucuagaa

SEQ ID NO: 58670 - RNA, 32 nt, Human
aggggucugcuuguaguacucucaguccugau

SEQ ID NO: 58671 - RNA, 32 nt, Human
aggggucugggagucaggcccggccuauugcu

SEQ ID NO: 58672 - RNA, 32 nt, Human
aggggucugggagugugacguuguaaucuuca

SEQ ID NO: 58673 - RNA, 32 nt, Human
aggggucugggcccucuccccaucgccccggg

SEQ ID NO: 58674 - RNA, 32 nt, Human
aggggucuuggagggaccacagaggaaggugg

SEQ ID NO: 58675 - RNA, 32 nt, Human
aggggucuuggcagcauggaagugagagguga

SEQ ID NO: 58676 - RNA, 32 nt, Human
aggggucuuucugcuucuuucuugucaugcac

SEQ ID NO: 58677 - RNA, 32 nt, Human
aggggugaauucacugggucauggaagggaca

SEQ ID NO: 58678 - RNA, 21 nt, Human
aggggugacaggaccagggca

SEQ ID NO: 58679 - RNA, 21 nt, Human
aggggugacgccacgagcuaa

SEQ ID NO: 58680 - RNA, 32 nt, Human
aggggugagagagcaggagagcaggggugagg

SEQ ID NO: 58681 - RNA, 32 nt, Human
aggggugaggagagagcaagagggcaggggug

SEQ ID NO: 58682 - RNA, 32 nt, Human
aggggugagguauuuucacugcccucccugga

SEQ ID NO: 58683 - RNA, 32 nt, Human
aggggugauacagauggugauuuuaaagagca

SEQ ID NO: 58684 - RNA, 32 nt, Human
aggggugauguuagcguggcaggggagugugu

SEQ ID NO: 58685 - RNA, 32 nt, Human
aggggugauguuugcauuucccaucauuaucc

SEQ ID NO: 58686 - RNA, 32 nt, Human
aggggugcagccaggagggcagggggacacgg

SEQ ID NO: 58687 - RNA, 32 nt, Human
aggggugcagcccucauggauggaugaaugcc

SEQ ID NO: 58688 - RNA, 32 nt, Human
aggggugcaguggguguuaccaggcaaagcac

SEQ ID NO: 58689 - RNA, 32 nt, Human
aggggugccuggcgagccucugguuuuccucu

SEQ ID NO: 58690 - RNA, 32 nt, Human
aggggugcggcagcuucaggaggcagaaacga

SEQ ID NO: 58691 - RNA, 32 nt, Human
aggggugcggggcagugaugcccaggcagcuc

SEQ ID NO: 58692 - RNA, 18 nt, Human
aggggugcucuguggaaa

SEQ ID NO: 58693 - RNA, 32 nt, Human
agggguggaaaggaagagagcuugggcuggga

SEQ ID NO: 58694 - RNA, 32 nt, Human
agggguggaccuguuucucuuucacuuucauu

SEQ ID NO: 58695 - RNA, 31 nt, Human
agggguggagagaaaagaggggagggauggg

SEQ ID NO: 58696 - RNA, 32 nt, Human
agggguggagagaaaagaggggagggaugggg

SEQ ID NO: 58697 - RNA, 32 nt, Human
agggguggagcaggcaguggccagcuuugccc

SEQ ID NO: 58698 - RNA, 32 nt, Human
agggguggagcugaggcuggagggaggaaggu

SEQ ID NO: 58699 - RNA, 32 nt, Human
agggguggaggcagcaggaugagcagaaagga

SEQ ID NO: 58700 - RNA, 32 nt, Human
agggguggaggcggcccaggaggcugaagaca

SEQ ID NO: 58701 - RNA, 32 nt, Human
agggguggauuagcacccugugccucgggggu

SEQ ID NO: 58702 - RNA, 32 nt, Human
agggguggcaggcaggguggggcacugugagc

SEQ ID NO: 58703 - RNA, 32 nt, Human
aggggugggaaacuggcauacuguguguauag

SEQ ID NO: 58704 - RNA, 22 nt, Human
aggggugggagagaagauacag

SEQ ID NO: 58705 - RNA, 32 nt, Human
aggggugggagcccucacaggcaagggggcug

SEQ ID NO: 58706 - RNA, 32 nt, Human
aggggugggaggcucccagacccagggcagug

SEQ ID NO: 58707 - RNA, 32 nt, Human
aggggugggagggucaggagggcagggugaag

SEQ ID NO: 58708 - RNA, 25 nt, Human
aggggugggaguugggauaauuuuu

SEQ ID NO: 58709 - RNA, 32 nt, Human
aggggugggcaggcccagcuggaggcagcugg

SEQ ID NO: 58710 - RNA, 32 nt, Human
aggggugggcagucaggguugcaggacuguaa

SEQ ID NO: 58711 - RNA, 18 nt, Human
aggggugggccacagcca

SEQ ID NO: 58712 - RNA, 32 nt, Human
aggggugggcuggaucggaagcaacacccauu

SEQ ID NO: 58713 - RNA, 32 nt, Human
aggggugggcuggggcaaggcuuauccugggc

SEQ ID NO: 58714 - RNA, 32 nt, Human
agggguggggacggcgaggagguggaggccgg

SEQ ID NO: 58715 - RNA, 32 nt, Human
agggguggggcugcggggguuccguguccacc

SEQ ID NO: 58716 - RNA, 32 nt, Human
agggguggggcugugagcucuuaauuuguuuu

SEQ ID NO: 58717 - RNA, 32 nt, Human
aggggugggggacacuggcaaggucugccuuc

SEQ ID NO: 58718 - RNA, 32 nt, Human
aggggugggggcuggggagaggcguggcccga

SEQ ID NO: 58719 - RNA, 32 nt, Human
aggggugggggugggcaccagcucaggggcuu

SEQ ID NO: 58720 - RNA, 32 nt, Human
agggguggguggggaagugaaauguuaggcga

SEQ ID NO: 58721 - RNA, 32 nt, Human
aggggugguagaagcugcuguuuaugauaaaa

SEQ ID NO: 58722 - RNA, 32 nt, Human
aggggugguagaugcuggaagccagacacaac

SEQ ID NO: 58723 - RNA, 32 nt, Human
agggguggucaggcugaacgcagcacagaagg

SEQ ID NO: 58724 - RNA, 32 nt, Human
aggggugguggagagauggaagggcaucaggu

SEQ ID NO: 58725 - RNA, 32 nt, Human
aggggugguggagggggcugggcucacaggcc

SEQ ID NO: 58726 - RNA, 32 nt, Human
agggguguccccuugccccauccucugcccua

SEQ ID NO: 58727 - RNA, 32 nt, Human
agggguguccuccucagaccaugcccccagau

SEQ ID NO: 58728 - RNA, 32 nt, Human
agggguguccugcagugccaccagaaguggca

SEQ ID NO: 58729 - RNA, 32 nt, Human
aggggugugaggaagcagacucccuguuauau

SEQ ID NO: 58730 - RNA, 32 nt, Human
aggggugugccaccccuuggcuucccaggaag

SEQ ID NO: 58731 - RNA, 32 nt, Human
aggggugugcugcguacagccccgaugaccac

SEQ ID NO: 58732 - RNA, 32 nt, Human
agggguguucuagcuuuuugaggacagcuccu

SEQ ID NO: 58733 - RNA, 32 nt, Human
agggguuaaaggcaggaauagcaaagagugca

SEQ ID NO: 58734 - RNA, 32 nt, Human
agggguuaaugaauaaucacagugaugagcuc

SEQ ID NO: 58735 - RNA, 32 nt, Human
agggguucaaagagacagggugguaugaaaac

SEQ ID NO: 58736 - RNA, 32 nt, Human
agggguucaagaccagccugaccaacauggug

SEQ ID NO: 58737 - RNA, 32 nt, Human
agggguucaagaccagccuggccaacauggug

SEQ ID NO: 58738 - RNA, 32 nt, Human
agggguucacaucucuuuaaaggaaaggaaag

SEQ ID NO: 58739 - RNA, 32 nt, Human
agggguucagacuugggaagaaucugucagug

SEQ ID NO: 58740 - RNA, 32 nt, Human
agggguucaggacuuuggaggugguggaacag

SEQ ID NO: 58741 - RNA, 32 nt, Human
agggguucaugcuuaauaaacaugucacaaua

SEQ ID NO: 58742 - RNA, 32 nt, Human
agggguuccagaccagccuggccaacauggug

SEQ ID NO: 58743 - RNA, 32 nt, Human
agggguucgaaaccagccaggccaacuuggca

SEQ ID NO: 58744 - RNA, 32 nt, Human
agggguucgacaccagccuggccaacauggug

SEQ ID NO: 58745 - RNA, 32 nt, Human
agggguucgagaccagccuggccaacaugacg

SEQ ID NO: 58746 - RNA, 32 nt, Human
agggguucgagaccagccuggccaacauggug

SEQ ID NO: 58747 - RNA, 32 nt, Human
agggguucgagaccagccuggucaacauggca

SEQ ID NO: 58748 - RNA, 32 nt, Human
agggguucucacucugaacuuucccucucuac

SEQ ID NO: 58749 - RNA, 31 nt, Human
agggguucucuguggggcccuguguccccug

SEQ ID NO: 58750 - RNA, 32 nt, Human
agggguucucuucauagguacuugcuauaugu

SEQ ID NO: 58751 - RNA, 32 nt, Human
agggguucugaagaacucuggccaagaggacg

SEQ ID NO: 58752 - RNA, 32 nt, Human
agggguucuuaacuugggguccaucaccccag

SEQ ID NO: 58753 - RNA, 21 nt, Human
agggguugagagaggaagcag

SEQ ID NO: 58754 - RNA, 32 nt, Human
agggguugaggugggaggauugcuugagccca

SEQ ID NO: 58755 - RNA, 32 nt, Human
agggguugcugguacuucaucuggggaccccg

SEQ ID NO: 58756 - RNA, 32 nt, Human
agggguuggagguggcagauaaaagaggauuu

SEQ ID NO: 58757 - RNA, 32 nt, Human
agggguuggggagggagacauccagcuugggc

SEQ ID NO: 58758 - RNA, 32 nt, Human
agggguugucaagagagagucaaagccggaug

SEQ ID NO: 58759 - RNA, 31 nt, Human
agggguuuaauaaauaacccuugaaaacugg

SEQ ID NO: 58760 - RNA, 32 nt, Human
agggguuuaccuccuuacuuucauccaagacc

SEQ ID NO: 58761 - RNA, 32 nt, Human
agggguuucugccuccuccccacccaggucag

SEQ ID NO: 58762 - RNA, 32 nt, Human
agggguuucuuccauguugcccaggcuggucu

SEQ ID NO: 58763 - RNA, 26 nt, Human
agggguuugaacuggacauccuaaug

SEQ ID NO: 58764 - RNA, 32 nt, Human
agggguuugagaccagccugaccaacauggug

SEQ ID NO: 58765 - RNA, 32 nt, Human
agggguuugagaccagccugagcaacauagcg

SEQ ID NO: 58766 - RNA, 32 nt, Human
agggguuugagaccagccuggccaacauggug

SEQ ID NO: 58767 - RNA, 32 nt, Human
agggguuugagaccagccugggcaacauggug

SEQ ID NO: 58768 - RNA, 32 nt, Human
agggguuugagaccagccuggucaacauugca

SEQ ID NO: 58769 - RNA, 32 nt, Human
agggguuugcagcugcuccgucaucgugcggc

SEQ ID NO: 58770 - RNA, 32 nt, Human
agggguuugcagugugggaauguggcccugca

SEQ ID NO: 58771 - RNA, 32 nt, Human
agggguuugcccacuuuccucuuuuugggguu

SEQ ID NO: 58772 - RNA, 32 nt, Human
agggguuugcguucgcccuugugggcugaagc

SEQ ID NO: 58773 - RNA, 32 nt, Human
agggguuugugguccccucucagccaccccga

SEQ ID NO: 58774 - RNA, 32 nt, Human
agggguuuucuuggagcucaaguuuggaugac

SEQ ID NO: 58775 - RNA, 32 nt, Human
aggguaaaacuaggacacagaaaacauuggga

SEQ ID NO: 58776 - RNA, 32 nt, Human
aggguaaaccaguagggaauacaguacaaucc

SEQ ID NO: 58777 - RNA, 32 nt, Human
aggguaaacuaacuugaguuacacuugaauuu

SEQ ID NO: 58778 - RNA, 32 nt, Human
aggguaaagcuggguuaaaaaugcagguuucc

SEQ ID NO: 58779 - RNA, 32 nt, Human
aggguaaaucagcgguaagaacagugaacaca

SEQ ID NO: 58780 - RNA, 32 nt, Human
aggguaaccagcucuucccagcuggcugggac

SEQ ID NO: 58781 - RNA, 32 nt, Human
aggguaaccgauugggguagguggugguaguu

SEQ ID NO: 58782 - RNA, 32 nt, Human
aggguaacuaauucuggaucuuugggugcaca

SEQ ID NO: 58783 - RNA, 32 nt, Human
aggguaaggagcuagcgccaugguggccugca

SEQ ID NO: 58784 - RNA, 32 nt, Human
aggguaaggaggcuaguuacagugucuuacuu

SEQ ID NO: 58785 - RNA, 32 nt, Human
aggguaaggcaggaggaagugggugagcuccg

SEQ ID NO: 58786 - RNA, 32 nt, Human
aggguaagggaauuuaauacuuuuccacagau

SEQ ID NO: 58787 - RNA, 32 nt, Human
aggguaauaaauagcaugcaucaaagacguua

SEQ ID NO: 58788 - RNA, 32 nt, Human
aggguaauauuaucugcuacacuggaaggccg

SEQ ID NO: 58789 - RNA, 32 nt, Human
aggguaaugccacucccacaaucucaggccug

SEQ ID NO: 58790 - RNA, 32 nt, Human
aggguacagcugggcuggggaggaccugaccc

SEQ ID NO: 58791 - RNA, 32 nt, Human
aggguacaggaggaagcugggacagguccccu

SEQ ID NO: 58792 - RNA, 32 nt, Human
aggguacauacuccuuucuggggagagaaugc

SEQ ID NO: 58793 - RNA, 32 nt, Human
aggguaccgccggguauugaaggauucguagg

SEQ ID NO: 58794 - RNA, 32 nt, Human
aggguaccugaagcgaauuggcaccaaagcag

SEQ ID NO: 58795 - RNA, 32 nt, Human
aggguacugccucguaucucuuguaggcucuc

SEQ ID NO: 58796 - RNA, 32 nt, Human
aggguacuggggaggcagcggcuuuaaacaau

SEQ ID NO: 58797 - RNA, 32 nt, Human
aggguacuuggcuugcuuugcuauguguguga

SEQ ID NO: 58798 - RNA, 32 nt, Human
aggguagaaagccacagcagggggcaguccag

SEQ ID NO: 58799 - RNA, 32 nt, Human
aggguagaagggaggagguuggguagaaggcu

SEQ ID NO: 58800 - RNA, 32 nt, Human
aggguagacucuguaaacaccuccuuacucac

SEQ ID NO: 58801 - RNA, 32 nt, Human
aggguagacugggaguccugaccacgcaggcc

SEQ ID NO: 58802 - RNA, 32 nt, Human
aggguagaggagagacguggguugagaauagu

SEQ ID NO: 58803 - RNA, 32 nt, Human
aggguagaggauucagggggccuccucuccua

SEQ ID NO: 58804 - RNA, 31 nt, Human
aggguagcaagggcaguuucacugcggaggc

SEQ ID NO: 58805 - RNA, 32 nt, Human
aggguagcagcagguggcaggcuguuaaaaga

SEQ ID NO: 58806 - RNA, 32 nt, Human
aggguagcaguauuuuaauagcuauuauagac

SEQ ID NO: 58807 - RNA, 32 nt, Human
aggguaggaaaugaaucauaggguaaaaugga

SEQ ID NO: 58808 - RNA, 32 nt, Human
aggguaggagagcucagccucggauggccaac

SEQ ID NO: 58809 - RNA, 32 nt, Human
aggguaggagcagcuggagacucugcucuacc

SEQ ID NO: 58810 - RNA, 31 nt, Human
aggguaggagugccuguuuccccugcugggc

SEQ ID NO: 58811 - RNA, 32 nt, Human
aggguaggcagugggcugggccaccguggguu

SEQ ID NO: 58812 - RNA, 32 nt, Human
aggguaggcugagcuccccacccuggagcccc

SEQ ID NO: 58813 - RNA, 32 nt, Human
aggguagggaaugccucauuacucacugggcc

SEQ ID NO: 58814 - RNA, 32 nt, Human
aggguagggggaggggcuggggaagaucuguc

SEQ ID NO: 58815 - RNA, 32 nt, Human
aggguagggugagggaggacaggccaguaggg

SEQ ID NO: 58816 - RNA, 32 nt, Human
aggguaggguguggagguguggaggcccccug

SEQ ID NO: 58817 - RNA, 19 nt, Human
aggguagguggagguggga

SEQ ID NO: 58818 - RNA, 32 nt, Human
aggguagucccgaacuccugaccucaagugau

SEQ ID NO: 58819 - RNA, 32 nt, Human
aggguagugaagcucaccacuguccuuuguuu

SEQ ID NO: 58820 - RNA, 32 nt, Human
aggguagugauggauugaucagggcaagcaau

SEQ ID NO: 58821 - RNA, 32 nt, Human
aggguaguuucccuaagucuguccugagaaaa

SEQ ID NO: 58822 - RNA, 20 nt, Human
aggguaucaccaagaagcca

SEQ ID NO: 58823 - RNA, 32 nt, Human
aggguaucaccacuucaauuuuaucaagccac

SEQ ID NO: 58824 - RNA, 32 nt, Human
aggguaucuccauguuggucaggcuggucuug

SEQ ID NO: 58825 - RNA, 32 nt, Human
aggguaugaagcugcgcuccuccaucggguuu

SEQ ID NO: 58826 - RNA, 31 nt, Human
aggguaugaguggaaagaggaugggcgagga

SEQ ID NO: 58827 - RNA, 32 nt, Human
aggguauggagcucacaucaguucaucauggu

SEQ ID NO: 58828 - RNA, 30 nt, Human
aggguaugggaagagaaaugaagaagacug

SEQ ID NO: 58829 - RNA, 32 nt, Human
aggguauguuuguuuaaccucugucucuuauc

SEQ ID NO: 58830 - RNA, 32 nt, Human
aggguauguuuuuagagaaauggaaguuugag

SEQ ID NO: 58831 - RNA, 22 nt, Human
aggguauuggacacggcagcgu

SEQ ID NO: 58832 - RNA, 32 nt, Human
aggguauuuugccauguugcccaggcuagucu

SEQ ID NO: 58833 - RNA, 32 nt, Human
agggucaaaagaaccaggauugcauuugaagu

SEQ ID NO: 58834 - RNA, 32 nt, Human
agggucaaagcacaauacugggcaauucagag

SEQ ID NO: 58835 - RNA, 22 nt, Human
agggucaagugaucuuuauggg

SEQ ID NO: 58836 - RNA, 19 nt, Human
agggucacaaaguguucuu

SEQ ID NO: 58837 - RNA, 20 nt, Human
agggucacaagaggcuccag

SEQ ID NO: 58838 - RNA, 32 nt, Human
agggucacagcaaggcugggaccauggcaagc

SEQ ID NO: 58839 - RNA, 25 nt, Human
agggucacaguugagucauuugcca

SEQ ID NO: 58840 - RNA, 32 nt, Human
agggucacaugaacagauguugcaguguaccu

SEQ ID NO: 58841 - RNA, 32 nt, Human
agggucacaugcccuggcaugggcagaaacug

SEQ ID NO: 58842 - RNA, 21 nt, Human
agggucacauuugugccucac

SEQ ID NO: 58843 - RNA, 32 nt, Human
agggucaccacugccagccucaggcaacauag

SEQ ID NO: 58844 - RNA, 31 nt, Human
agggucaccagagugaugguuggagaacaug

SEQ ID NO: 58845 - RNA, 32 nt, Human
agggucacccaaauagcugagugcaguccuug

SEQ ID NO: 58846 - RNA, 32 nt, Human
agggucacccacggacagagaccaagagaggu

SEQ ID NO: 58847 - RNA, 32 nt, Human
agggucaccuggaggcagacguuguggggaag

SEQ ID NO: 58848 - RNA, 32 nt, Human
agggucacugacacagcugagaccaagcugag

SEQ ID NO: 58849 - RNA, 32 nt, Human
agggucagaagugccaagucacuggccguuaa

SEQ ID NO: 58850 - RNA, 32 nt, Human
agggucagcaagacaagcagguugcggcaagg

SEQ ID NO: 58851 - RNA, 32 nt, Human
agggucagcagccgccagacuuccugccgaag

SEQ ID NO: 58852 - RNA, 32 nt, Human
agggucagccauucacacccauccacucaccu

SEQ ID NO: 58853 - RNA, 32 nt, Human
agggucagcccuggacagaccucugcccaggg

SEQ ID NO: 58854 - RNA, 32 nt, Human
agggucagccuaaggagaugggaauaaagagg

SEQ ID NO: 58855 - RNA, 32 nt, Human
agggucagccugcugugcccacacacacccac

SEQ ID NO: 58856 - RNA, 32 nt, Human
agggucagcucuccucggaggcugcuggggag

SEQ ID NO: 58857 - RNA, 32 nt, Human
agggucaggaaggggcggcuggcuuuggggga

SEQ ID NO: 58858 - RNA, 32 nt, Human
agggucaggagagaaugggggaggaggcgguc

SEQ ID NO: 58859 - RNA, 32 nt, Human
agggucaggaugaagcagaucugcuguagacu

SEQ ID NO: 58860 - RNA, 32 nt, Human
agggucaggcaccugagauugcagucacccag

SEQ ID NO: 58861 - RNA, 32 nt, Human
agggucaggcagaaagcgugauagaggagaga

SEQ ID NO: 58862 - RNA, 32 nt, Human
agggucaggcccccuccucuccccaguuuccc

SEQ ID NO: 58863 - RNA, 20 nt, Human
agggucagggcuucugugga

SEQ ID NO: 58864 - RNA, 24 nt, Human
agggucaggucauggguaugugga

SEQ ID NO: 58865 - RNA, 32 nt, Human
agggucagguccugucaagaggagcugggugu

SEQ ID NO: 58866 - RNA, 24 nt, Human
agggucagugcugaggccugggca

SEQ ID NO: 58867 - RNA, 32 nt, Human
agggucaucuuucuuuuuaaagaauuaagcca

SEQ ID NO: 58868 - RNA, 32 nt, Human
agggucaugaagaauacugcaagugaaacugc

SEQ ID NO: 58869 - RNA, 22 nt, Human
agggucaugaguuuucugcagg

SEQ ID NO: 58870 - RNA, 16 nt, Human
agggucaugcaugaaa

SEQ ID NO: 58871 - RNA, 21 nt, Human
agggucauguccuaccugcca

SEQ ID NO: 58872 - RNA, 32 nt, Human
aggguccaccagcaggaagaaaccccaggagg

SEQ ID NO: 58873 - RNA, 32 nt, Human
aggguccacggcuucauucuugaagucaguga

SEQ ID NO: 58874 - RNA, 31 nt, Human
aggguccagagagccggcaggaggggacccu

SEQ ID NO: 58875 - RNA, 32 nt, Human
aggguccagcagcaggaagaaaccccaggagg

SEQ ID NO: 58876 - RNA, 32 nt, Human
aggguccagccucuucugccaggaagcccuuc

SEQ ID NO: 58877 - RNA, 32 nt, Human
aggguccagcugaaggugaggggauggaguag

SEQ ID NO: 58878 - RNA, 19 nt, Human
aggguccagggcccaggag

SEQ ID NO: 58879 - RNA, 32 nt, Human
aggguccagggcuucguucuugaagucaguga

SEQ ID NO: 58880 - RNA, 32 nt, Human
aggguccauggcuucauucuugaagucaguga

SEQ ID NO: 58881 - RNA, 32 nt, Human
agggucccaacugucuacuaaccggcuucccg

SEQ ID NO: 58882 - RNA, 32 nt, Human
agggucccaagugcuggucccaaccugaagcu

SEQ ID NO: 58883 - RNA, 28 nt, Human
agggucccaagugguacaucgucauagc

SEQ ID NO: 58884 - RNA, 32 nt, Human
agggucccaaguguccgggcccccagcuaccc

SEQ ID NO: 58885 - RNA, 32 nt, Human
agggucccacuauguugcucaggcugguuuug

SEQ ID NO: 58886 - RNA, 17 nt, Human
aggguccccaccuuccu

SEQ ID NO: 58887 - RNA, 23 nt, Human
aggguccccaucaccugcuucac

SEQ ID NO: 58888 - RNA, 20 nt, Human
agggucccgggcccagagcc

SEQ ID NO: 58889 - RNA, 32 nt, Human
agggucccguccuugacaccucagccucuaca

SEQ ID NO: 58890 - RNA, 32 nt, Human
agggucccuaggccuccacuucugagggcagc

SEQ ID NO: 58891 - RNA, 32 nt, Human
agggucccuccagcaaagcucccgcggaaaac

SEQ ID NO: 58892 - RNA, 19 nt, Human
agggucccuggacuggggg

SEQ ID NO: 58893 - RNA, 32 nt, Human
agggucccuguggaggugcugaagcccacagu

SEQ ID NO: 58894 - RNA, 32 nt, Human
agggucccuguuccuguuuggccaaggaaggg

SEQ ID NO: 58895 - RNA, 32 nt, Human
aggguccgccuucugcaggguucccaggcccc

SEQ ID NO: 58896 - RNA, 32 nt, Human
aggguccgcggcuucauucuugaagucaguga

SEQ ID NO: 58897 - RNA, 32 nt, Human
aggguccgcggcuucauucuugaagucgacag

SEQ ID NO: 58898 - RNA, 32 nt, Human
aggguccgcggcuucauuuuugaagucaguga

SEQ ID NO: 58899 - RNA, 32 nt, Human
aggguccgcggcuucguucuugaagucaguga

SEQ ID NO: 58900 - RNA, 32 nt, Human
aggguccgggccugaggcuggcgcccgauucu

SEQ ID NO: 58901 - RNA, 32 nt, Human
aggguccguggcuucauucuugaagucaggga

SEQ ID NO: 58902 - RNA, 32 nt, Human
aggguccguggcuucauucuugaagucaguga

SEQ ID NO: 58903 - RNA, 32 nt, Human
aggguccuccacccucccccugaccacauaca

SEQ ID NO: 58904 - RNA, 32 nt, Human
aggguccuccagcaucgugggcucaagaguug

SEQ ID NO: 58905 - RNA, 32 nt, Human
aggguccuccuugucugguucugcacccgucu

SEQ ID NO: 58906 - RNA, 32 nt, Human
aggguccugaaccuuguuucucacuggcuacu

SEQ ID NO: 58907 - RNA, 32 nt, Human
aggguccugaguaaauguguucuguauaaaca

SEQ ID NO: 58908 - RNA, 32 nt, Human
aggguccugcugucugucauguugccuuguaa

SEQ ID NO: 58909 - RNA, 32 nt, Human
aggguccuguccugcccugccacgacgcugcu

SEQ ID NO: 58910 - RNA, 19 nt, Human
aggguccuuccaccucccu

SEQ ID NO: 58911 - RNA, 32 nt, Human
aggguccuucucucccuggcccguccuccucc

SEQ ID NO: 58912 - RNA, 32 nt, Human
aggguccuuguccugcucaggcaucccugccc

SEQ ID NO: 58913 - RNA, 32 nt, Human
aggguccuuucaaggagguugaaugagacaaa

SEQ ID NO: 58914 - RNA, 32 nt, Human
agggucgcggccgccagcuaggggcgcgggaa

SEQ ID NO: 58915 - RNA, 32 nt, Human
agggucgcucagcccuggcguccuccaccacc

SEQ ID NO: 58916 - RNA, 32 nt, Human
agggucggaccugccucaauaccgccaagguc

SEQ ID NO: 58917 - RNA, 32 nt, Human
agggucggccgcuuucccucuggaccaccucc

SEQ ID NO: 58918 - RNA, 32 nt, Human
agggucgggccagccccugcacugccucgcag

SEQ ID NO: 58919 - RNA, 32 nt, Human
agggucguggccagcccugcagcuucagcacc

SEQ ID NO: 58920 - RNA, 32 nt, Human
agggucguuuacuguaucaggagugccuccua

SEQ ID NO: 58921 - RNA, 32 nt, Human
agggucuaccagccacagucucugcacguuuc

SEQ ID NO: 58922 - RNA, 32 nt, Human
agggucuagaaugcugucuccagguagcugga

SEQ ID NO: 58923 - RNA, 32 nt, Human
agggucuaggagguaagaccagcugggaugac

SEQ ID NO: 58924 - RNA, 32 nt, Human
agggucucaaacuccugaccucaggcgaucca

SEQ ID NO: 58925 - RNA, 32 nt, Human
agggucucaccacuucauuagauaaguguugu

SEQ ID NO: 58926 - RNA, 32 nt, Human
agggucucaccauguugcccagccuggucuca

SEQ ID NO: 58927 - RNA, 32 nt, Human
agggucucaccauguugcccaggcuggucuug

SEQ ID NO: 58928 - RNA, 32 nt, Human
agggucucaccauguuguccagccuggucuca

SEQ ID NO: 58929 - RNA, 32 nt, Human
agggucucacccugucacucaggcuggagcac

SEQ ID NO: 58930 - RNA, 32 nt, Human
agggucucacucuguuacccaggcuggagugc

SEQ ID NO: 58931 - RNA, 32 nt, Human
agggucucagccagaaggcaggcaggaagaga

SEQ ID NO: 58932 - RNA, 32 nt, Human
agggucuccaaggcauuuccacacuauuggug

SEQ ID NO: 58933 - RNA, 32 nt, Human
agggucuccagccucagggccuggcuucuguu

SEQ ID NO: 58934 - RNA, 32 nt, Human
agggucuccagggcccacaccugagucaugcc

SEQ ID NO: 58935 - RNA, 32 nt, Human
agggucucccacugcugugugauucuaaaagc

SEQ ID NO: 58936 - RNA, 32 nt, Human
agggucucccagagugaacuuggugcucuaag

SEQ ID NO: 58937 - RNA, 32 nt, Human
agggucucccuauguugcccaggcuggucuug

SEQ ID NO: 58938 - RNA, 32 nt, Human
agggucucccucagucgcucaggcuggagugc

SEQ ID NO: 58939 - RNA, 32 nt, Human
agggucucccucugucauccaggcuggagugc

SEQ ID NO: 58940 - RNA, 32 nt, Human
agggucucccucuguugcccaggcuggagugc

SEQ ID NO: 58941 - RNA, 32 nt, Human
agggucuccugcaggcccuugugggcuccuug

SEQ ID NO: 58942 - RNA, 32 nt, Human
agggucuccugcagugccauucugccuucuca

SEQ ID NO: 58943 - RNA, 32 nt, Human
agggucucgccauguugcccaggcugguuuaa

SEQ ID NO: 58944 - RNA, 32 nt, Human
agggucucgcucuauggcccaggcuggagcgc

SEQ ID NO: 58945 - RNA, 32 nt, Human
agggucucgcuuugacacccaggcuggagugc

SEQ ID NO: 58946 - RNA, 32 nt, Human
agggucucuccucccugcugaagucccucucc

SEQ ID NO: 58947 - RNA, 32 nt, Human
agggucucucuccuggcauccgucuuuaccca

SEQ ID NO: 58948 - RNA, 32 nt, Human
agggucucucucuuacaaccaagaacauuauc

SEQ ID NO: 58949 - RNA, 32 nt, Human
agggucucuugcccaucucuccggccaccccg

SEQ ID NO: 58950 - RNA, 32 nt, Human
agggucugaaaccuuagugagcaaaaacugau

SEQ ID NO: 58951 - RNA, 32 nt, Human
agggucugaaagguugggggaggcugggagag

SEQ ID NO: 58952 - RNA, 32 nt, Human
agggucugacucuguccuccaggccggagucc

SEQ ID NO: 58953 - RNA, 32 nt, Human
agggucugagcaccucccucaugcagacagag

SEQ ID NO: 58954 - RNA, 32 nt, Human
agggucugcacucuaacccuaggcaucacaug

SEQ ID NO: 58955 - RNA, 32 nt, Human
agggucugcagccaguucauucccagggcccc

SEQ ID NO: 58956 - RNA, 32 nt, Human
agggucugccaaggugggggucaggggccaug

SEQ ID NO: 58957 - RNA, 32 nt, Human
agggucugcccuuucccugccugaguugcuac

SEQ ID NO: 58958 - RNA, 32 nt, Human
agggucugcucugccuugaccuccuccaagag

SEQ ID NO: 58959 - RNA, 32 nt, Human
agggucuggaagcaugggggagggggagagag

SEQ ID NO: 58960 - RNA, 32 nt, Human
agggucuggagagagcgcgcaguuugcgcggc

SEQ ID NO: 58961 - RNA, 32 nt, Human
agggucugggagaacaggugggaggcuuuugu

SEQ ID NO: 58962 - RNA, 32 nt, Human
agggucugggagaggacggagcuggcucugug

SEQ ID NO: 58963 - RNA, 32 nt, Human
agggucugggcugcuggacuugaggcagagcc

SEQ ID NO: 58964 - RNA, 32 nt, Human
agggucuggggcugaagcugaugcuggcaugg

SEQ ID NO: 58965 - RNA, 31 nt, Human
agggucuggguggaaggaccgcgggugucgc

SEQ ID NO: 58966 - RNA, 16 nt, Human
agggucuguccagccc

SEQ ID NO: 58967 - RNA, 32 nt, Human
agggucugugccagcccugucagugcugcuca

SEQ ID NO: 58968 - RNA, 32 nt, Human
agggucuguuucuccccugcugugcggcuugg

SEQ ID NO: 58969 - RNA, 32 nt, Human
agggucuuaccauguugcccaggcuggucucg

SEQ ID NO: 58970 - RNA, 18 nt, Human
agggucuucagcugggga

SEQ ID NO: 58971 - RNA, 32 nt, Human
agggucuuccacccucgcccugacccuggaca

SEQ ID NO: 58972 - RNA, 32 nt, Human
agggucuucccauguugcccaggcuggucuca

SEQ ID NO: 58973 - RNA, 32 nt, Human
agggucuuccuauuaauggaagaagguaauuu

SEQ ID NO: 58974 - RNA, 32 nt, Human
agggucuugacuugggaaaaucaagccacgug

SEQ ID NO: 58975 - RNA, 32 nt, Human
agggucuugcacuccagcccaggcgagagagc

SEQ ID NO: 58976 - RNA, 32 nt, Human
agggucuugcuauauugcucggagguuugcua

SEQ ID NO: 58977 - RNA, 32 nt, Human
agggucuugcucucucacccaggcuggagugu

SEQ ID NO: 58978 - RNA, 32 nt, Human
agggucuugcucuggcgcccaggcuggaguac

SEQ ID NO: 58979 - RNA, 32 nt, Human
agggucuuggccugccuccuugcggcccuggu

SEQ ID NO: 58980 - RNA, 22 nt, Human
agggucuuggggacagcccucc

SEQ ID NO: 58981 - RNA, 32 nt, Human
agggugaaaggcgagagguugcacaggacaug

SEQ ID NO: 58982 - RNA, 32 nt, Human
agggugaagcagaggaccucagugcugaacau

SEQ ID NO: 58983 - RNA, 32 nt, Human
agggugaagcugaccuccuuccugcucucaug

SEQ ID NO: 58984 - RNA, 32 nt, Human
agggugaaggcaaggaacaaccaccuggccuc

SEQ ID NO: 58985 - RNA, 32 nt, Human
agggugaaggcggcgcuggaggcgugggucag

SEQ ID NO: 58986 - RNA, 32 nt, Human
agggugaaugugcccaggacggcugggacgag

SEQ ID NO: 58987 - RNA, 32 nt, Human
agggugaauugggguuccaccaugucacccuc

SEQ ID NO: 58988 - RNA, 32 nt, Human
agggugacagaagugggacaggagaaguuuuc

SEQ ID NO: 58989 - RNA, 32 nt, Human
agggugacgauguuugaaaaucaacacauaac

SEQ ID NO: 58990 - RNA, 32 nt, Human
agggugagaaagcacaagaggggccagcucgg

SEQ ID NO: 58991 - RNA, 32 nt, Human
agggugagaaccaguacaucugcuguccauca

SEQ ID NO: 58992 - RNA, 32 nt, Human
agggugagaagaggcugagagagaaggggaaa

SEQ ID NO: 58993 - RNA, 32 nt, Human
agggugagagagaagcugggagagcagagaaa

SEQ ID NO: 58994 - RNA, 32 nt, Human
agggugagaggcagugcuguggaaggggccug

SEQ ID NO: 58995 - RNA, 32 nt, Human
agggugagaggggagagcuggacaaacaggug

SEQ ID NO: 58996 - RNA, 32 nt, Human
agggugagaucugcacgggaggacccgagcga

SEQ ID NO: 58997 - RNA, 32 nt, Human
agggugagcagguuuggaggcaaggcggaggg

SEQ ID NO: 58998 - RNA, 21 nt, Human
agggugagccaccaugcccgg

SEQ ID NO: 58999 - RNA, 32 nt, Human
agggugagccggcacaacagccccucggccgc

SEQ ID NO: 59000 - RNA, 32 nt, Human
agggugagcuccagggauuugccuggauuuug

SEQ ID NO: 59001 - RNA, 32 nt, Human
agggugagcucuguauugaucugcagugacuc

SEQ ID NO: 59002 - RNA, 32 nt, Human
agggugaggagcagcugccagccccggcaggc

SEQ ID NO: 59003 - RNA, 32 nt, Human
agggugaggagguggaaggagccggguggaug

SEQ ID NO: 59004 - RNA, 32 nt, Human
agggugagggagugaguguucaaggaggaagg

SEQ ID NO: 59005 - RNA, 32 nt, Human
agggugagggauuaaugguggagccagaggga

SEQ ID NO: 59006 - RNA, 32 nt, Human
agggugaggggcugaggucacaccuugggcac

SEQ ID NO: 59007 - RNA, 32 nt, Human
agggugagguauaagcucacagaauucagaua

SEQ ID NO: 59008 - RNA, 32 nt, Human
agggugaggucuggcuccuggcccaggacucu

SEQ ID NO: 59009 - RNA, 32 nt, Human
agggugaguauggggccaggccccagaguccc

SEQ ID NO: 59010 - RNA, 32 nt, Human
agggugagucugaguugaaaaugcagaagagg

SEQ ID NO: 59011 - RNA, 32 nt, Human
agggugauaagaaguggucagacucugguugu

SEQ ID NO: 59012 - RNA, 32 nt, Human
agggugaucuguguguucuuagacaaacucgc

SEQ ID NO: 59013 - RNA, 21 nt, Human
agggugaugcagaggccacag

SEQ ID NO: 59014 - RNA, 32 nt, Human
agggugcacacagcaggugcagugcugucacc

SEQ ID NO: 59015 - RNA, 32 nt, Human
agggugcacacaguagguucugagcuccuggc

SEQ ID NO: 59016 - RNA, 32 nt, Human
agggugcacagcauuaguuucaaugugguuau

SEQ ID NO: 59017 - RNA, 32 nt, Human
agggugcacggccggcccugggcaggcgguag

SEQ ID NO: 59018 - RNA, 32 nt, Human
agggugcagccugaucuuccucuucucccuug

SEQ ID NO: 59019 - RNA, 32 nt, Human
agggugcaggcagaggcucgggaggccggacu

SEQ ID NO: 59020 - RNA, 32 nt, Human
agggugcaggcagaggcuggggcagaauguuu

SEQ ID NO: 59021 - RNA, 32 nt, Human
agggugcagggaagcccagcugugcucaacuc

SEQ ID NO: 59022 - RNA, 32 nt, Human
agggugcaggugcuguaugcauugguuuauau

SEQ ID NO: 59023 - RNA, 32 nt, Human
agggugcaguaagccgagauugcaccacugca

SEQ ID NO: 59024 - RNA, 32 nt, Human
agggugcauuuuccucucauuauugagaacug

SEQ ID NO: 59025 - RNA, 32 nt, Human
agggugccaaggagacagggcagggcagggac

SEQ ID NO: 59026 - RNA, 32 nt, Human
agggugcccagccugugaggcacuggcaaggu

SEQ ID NO: 59027 - RNA, 21 nt, Human
agggugccccaggccugccca

SEQ ID NO: 59028 - RNA, 32 nt, Human
agggugcccgggcuucccacaccuuccgcggc

SEQ ID NO: 59029 - RNA, 32 nt, Human
agggugcccuggauaggaggguguguacaggg

SEQ ID NO: 59030 - RNA, 32 nt, Human
agggugcccuuacccccuccccagaccuguuc

SEQ ID NO: 59031 - RNA, 32 nt, Human
agggugccggaggcaggguucgggugcguagu

SEQ ID NO: 59032 - RNA, 32 nt, Human
agggugccguuuccugcuccagcuccagaccu

SEQ ID NO: 59033 - RNA, 32 nt, Human
agggugccucggaucaucccugagaugcaggc

SEQ ID NO: 59034 - RNA, 32 nt, Human
agggugccucugcauguccuccaaggcaaagu

SEQ ID NO: 59035 - RNA, 32 nt, Human
agggugccugcucuccuugcccugggccagcc

SEQ ID NO: 59036 - RNA, 32 nt, Human
agggugccuggacccgugggguugcuucauug

SEQ ID NO: 59037 - RNA, 32 nt, Human
agggugccugggaggccagguucuggggaucc

SEQ ID NO: 59038 - RNA, 32 nt, Human
agggugccugggagguggguguggggguggug

SEQ ID NO: 59039 - RNA, 32 nt, Human
agggugccuguccaggaagagcuguguggccu

SEQ ID NO: 59040 - RNA, 32 nt, Human
agggugccuuaugggcccuccucauagguugu

SEQ ID NO: 59041 - RNA, 32 nt, Human
agggugcggcuuccaagcuggccggcccuagc

SEQ ID NO: 59042 - RNA, 32 nt, Human
agggugcggugcagagcagagcaggcaggggu

SEQ ID NO: 59043 - RNA, 32 nt, Human
agggugcucaaggauuggagaggagacaaaac

SEQ ID NO: 59044 - RNA, 32 nt, Human
agggugcucacuggcaccccaucuuccuguga

SEQ ID NO: 59045 - RNA, 32 nt, Human
agggugcucugcccacuccaucaccaugaagc

SEQ ID NO: 59046 - RNA, 32 nt, Human
agggugcugcugccacccgccccagccagcca

SEQ ID NO: 59047 - RNA, 32 nt, Human
agggugcuggacuguauggcugagggcugguu

SEQ ID NO: 59048 - RNA, 32 nt, Human
agggugcugggggcugggguucccuggcccaa

SEQ ID NO: 59049 - RNA, 32 nt, Human
agggugcugucuucccugucugauccuuagca

SEQ ID NO: 59050 - RNA, 32 nt, Human
agggugcugugucuccccuugccugugcccag

SEQ ID NO: 59051 - RNA, 32 nt, Human
agggugcuucccgggcccugcccacacacggu

SEQ ID NO: 59052 - RNA, 32 nt, Human
aggguggaaaugguguggacaggcagauucug

SEQ ID NO: 59053 - RNA, 32 nt, Human
aggguggaagguaagagguugguguggaguug

SEQ ID NO: 59054 - RNA, 32 nt, Human
aggguggaaguagaaaagcaucaacaggcugu

SEQ ID NO: 59055 - RNA, 32 nt, Human
aggguggagaggaggcaggggccgagggggug

SEQ ID NO: 59056 - RNA, 32 nt, Human
aggguggagagggagacuccugggcagccguu

SEQ ID NO: 59057 - RNA, 32 nt, Human
aggguggagagggcggugggaggcgugugccu

SEQ ID NO: 59058 - RNA, 32 nt, Human
aggguggaggcagagcacgccgagcgaguccu

SEQ ID NO: 59059 - RNA, 32 nt, Human
aggguggaggcaguguuucuccccagcaucaa

SEQ ID NO: 59060 - RNA, 32 nt, Human
aggguggaggcaguucugccagccguggcagg

SEQ ID NO: 59061 - RNA, 32 nt, Human
aggguggaggcugggcugaggauuaccauaau

SEQ ID NO: 59062 - RNA, 32 nt, Human
aggguggaggggaagggugggucucaguuagc

SEQ ID NO: 59063 - RNA, 32 nt, Human
aggguggaggggcgacaauggagggaaaucca

SEQ ID NO: 59064 - RNA, 19 nt, Human
aggguggagugagggcgga

SEQ ID NO: 59065 - RNA, 32 nt, Human
aggguggaugaaaaggagggagagaaggugga

SEQ ID NO: 59066 - RNA, 32 nt, Human
aggguggaugguggugaguggaucauuucuuu

SEQ ID NO: 59067 - RNA, 32 nt, Human
aggguggcacacagcagucuuugugccagaac

SEQ ID NO: 59068 - RNA, 32 nt, Human
aggguggcacagaagcucaucucagucauccu

SEQ ID NO: 59069 - RNA, 32 nt, Human
aggguggcaggcagugguuguggcaguggagc

SEQ ID NO: 59070 - RNA, 32 nt, Human
aggguggcaggucacugucacugccgacaucc

SEQ ID NO: 59071 - RNA, 32 nt, Human
aggguggcauggcuccccaucucggguccauc

SEQ ID NO: 59072 - RNA, 32 nt, Human
aggguggccaccacagccuuggcuccauggug

SEQ ID NO: 59073 - RNA, 32 nt, Human
aggguggccacuggaggaugggugggggccuc

SEQ ID NO: 59074 - RNA, 20 nt, Human
aggguggccccagggcuucu

SEQ ID NO: 59075 - RNA, 24 nt, Human
aggguggccucgacaucaaacugc

SEQ ID NO: 59076 - RNA, 18 nt, Human
aggguggcgaggugcgga

SEQ ID NO: 59077 - RNA, 32 nt, Human
aggguggcuacgagguagagggguggggguug

SEQ ID NO: 59078 - RNA, 32 nt, Human
aggguggcucaguuggucccagucagauacgu

SEQ ID NO: 59079 - RNA, 32 nt, Human
aggguggcuggcacgagaugugugggacuggg

SEQ ID NO: 59080 - RNA, 32 nt, Human
aggguggcuggcccggccuccacagcacccca

SEQ ID NO: 59081 - RNA, 32 nt, Human
aggguggcuggcuggcucccuggcaucagugg

SEQ ID NO: 59082 - RNA, 17 nt, Human
aggguggcuggugugga

SEQ ID NO: 59083 - RNA, 32 nt, Human
aggguggcugugggggcucaggaagcucgccc

SEQ ID NO: 59084 - RNA, 32 nt, Human
agggugggagaaggggaaagaaucucacuggc

SEQ ID NO: 59085 - RNA, 32 nt, Human
agggugggagagaagaaaagggaaagaagcug

SEQ ID NO: 59086 - RNA, 32 nt, Human
agggugggagccugggcugggcucaggcagcu

SEQ ID NO: 59087 - RNA, 32 nt, Human
agggugggagcugcugcuggacuggcccgagg

SEQ ID NO: 59088 - RNA, 32 nt, Human
agggugggagggaggaagaacggaagggaggg

SEQ ID NO: 59089 - RNA, 32 nt, Human
agggugggaggggaggcucucuggcuuuaguu

SEQ ID NO: 59090 - RNA, 32 nt, Human
agggugggagucuggagccagacagccaagcc

SEQ ID NO: 59091 - RNA, 32 nt, Human
agggugggcaaacuguaccucuuuguaucaau

SEQ ID NO: 59092 - RNA, 32 nt, Human
agggugggcaggucaaucagcacuuuguggac

SEQ ID NO: 59093 - RNA, 32 nt, Human
agggugggcaguuaucacuggggaagagagga

SEQ ID NO: 59094 - RNA, 32 nt, Human
agggugggcuguguguuaguucugagcaaauc

SEQ ID NO: 59095 - RNA, 32 nt, Human
agggugggcuuuguggucccaccaagaagcuu

SEQ ID NO: 59096 - RNA, 32 nt, Human
aggguggggaacaagaucgccucccagggcca

SEQ ID NO: 59097 - RNA, 32 nt, Human
aggguggggacggguguuccuucugggugggg

SEQ ID NO: 59098 - RNA, 32 nt, Human
aggguggggagucagagcaggucccagcccac

SEQ ID NO: 59099 - RNA, 32 nt, Human
aggguggggcauguagagucuccagggagcca

SEQ ID NO: 59100 - RNA, 32 nt, Human
aggguggggccagcccugacacccucaucccc

SEQ ID NO: 59101 - RNA, 32 nt, Human
aggguggggcccagguaaagugaacagaguua

SEQ ID NO: 59102 - RNA, 32 nt, Human
aggguggggcugggaagcauccuguuuugcau

SEQ ID NO: 59103 - RNA, 32 nt, Human
aggguggggcugucccuuccaggaguuuugcc

SEQ ID NO: 59104 - RNA, 32 nt, Human
aggguggggcuuagaauggggcuuccauggug

SEQ ID NO: 59105 - RNA, 32 nt, Human
aggguggggcuuagggacagggcccagggagg

SEQ ID NO: 59106 - RNA, 32 nt, Human
agggugggggcaagacugggcuguaggggagc

SEQ ID NO: 59107 - RNA, 32 nt, Human
aggguggggguggacgccaggguucugggaac

SEQ ID NO: 59108 - RNA, 24 nt, Human
aggguggggugaagcccguggcca

SEQ ID NO: 59109 - RNA, 32 nt, Human
aggguggggugccccagcuaggaagcaagauc

SEQ ID NO: 59110 - RNA, 32 nt, Human
agggugggguuucugaugcauccacagccaaa

SEQ ID NO: 59111 - RNA, 32 nt, Human
aggguggguacauuuaaaacugacaaguauug

SEQ ID NO: 59112 - RNA, 32 nt, Human
aggguggguaccucugagucccagggaccugg

SEQ ID NO: 59113 - RNA, 32 nt, Human
agggugggucaccagcagaagaagccgaaccc

SEQ ID NO: 59114 - RNA, 32 nt, Human
agggugggucuagacauacuauauucagagaa

SEQ ID NO: 59115 - RNA, 32 nt, Human
agggugggucugccuuucccaguccacugacu

SEQ ID NO: 59116 - RNA, 32 nt, Human
aggguggguggagggguuugcagugugggaau

SEQ ID NO: 59117 - RNA, 23 nt, Human
aggguggguggaucaccugaggu

SEQ ID NO: 59118 - RNA, 32 nt, Human
aggguggucacugccugugauacauuccucag

SEQ ID NO: 59119 - RNA, 32 nt, Human
aggguggucagaggaagccagcagggaagauc

SEQ ID NO: 59120 - RNA, 19 nt, Human
aggguggucagggugagga

SEQ ID NO: 59121 - RNA, 32 nt, Human
agggugguccagccuaggugacaggguggucc

SEQ ID NO: 59122 - RNA, 32 nt, Human
agggugguccaucuuggcacugaagauggaac

SEQ ID NO: 59123 - RNA, 32 nt, Human
agggugguccugcaccugucggggagggggcc

SEQ ID NO: 59124 - RNA, 32 nt, Human
aggguggucgccacugggacacugugaaccag

SEQ ID NO: 59125 - RNA, 32 nt, Human
aggguggucucaaacuccugaccugaggcgau

SEQ ID NO: 59126 - RNA, 32 nt, Human
aggguggucucaaacuccugggcucaagcgaa

SEQ ID NO: 59127 - RNA, 32 nt, Human
aggguggucucaaacuccugggcucaagugau

SEQ ID NO: 59128 - RNA, 32 nt, Human
aggguggucucgaacuccuggccucaagcgau

SEQ ID NO: 59129 - RNA, 32 nt, Human
aggguggucucgaauuccugaccucaguugag

SEQ ID NO: 59130 - RNA, 32 nt, Human
aggguggucucgaauuccuggacucaagcagu

SEQ ID NO: 59131 - RNA, 32 nt, Human
aggguggucucgaucuccugaccucgugaucu

SEQ ID NO: 59132 - RNA, 32 nt, Human
aggguggucucgaucucuugaccucgugaucc

SEQ ID NO: 59133 - RNA, 32 nt, Human
aggguggucucuaacuccuggccucaaaugau

SEQ ID NO: 59134 - RNA, 32 nt, Human
aggguggucuguaacuccugagcucagaugau

SEQ ID NO: 59135 - RNA, 32 nt, Human
aggguggucuugagcuccugaccucaggugau

SEQ ID NO: 59136 - RNA, 32 nt, Human
aggguggucuugaucuccugaccucgugaucc

SEQ ID NO: 59137 - RNA, 32 nt, Human
aggguggugagcugcugggguuggauuauuug

SEQ ID NO: 59138 - RNA, 32 nt, Human
aggguggugcuaagauccuccugaccucaaag

SEQ ID NO: 59139 - RNA, 32 nt, Human
agggugguggagaggagagggagaaagggaag

SEQ ID NO: 59140 - RNA, 32 nt, Human
agggugguguggccugggcauuggagucaaua

SEQ ID NO: 59141 - RNA, 32 nt, Human
agggugguuuacaggggugcucugugcagccc

SEQ ID NO: 59142 - RNA, 32 nt, Human
agggugguuucacucuccucucuccuucuuuc

SEQ ID NO: 59143 - RNA, 32 nt, Human
aggguguaggggauauuaguuuuccauuuuuc

SEQ ID NO: 59144 - RNA, 32 nt, Human
agggugucacccacugcaucuggaguacagcu

SEQ ID NO: 59145 - RNA, 32 nt, Human
agggugucccgauuaccagcaggcucccugca

SEQ ID NO: 59146 - RNA, 32 nt, Human
aggguguccugcaccggggccugggcaggagg

SEQ ID NO: 59147 - RNA, 32 nt, Human
agggugucgggcgaggcaaagugcaaagcauu

SEQ ID NO: 59148 - RNA, 32 nt, Human
agggugucuccucugcuucugggggccacagg

SEQ ID NO: 59149 - RNA, 32 nt, Human
agggugucuguagaucaagauguguauacagc

SEQ ID NO: 59150 - RNA, 32 nt, Human
agggugugagccacugcaccuggccgauaaca

SEQ ID NO: 59151 - RNA, 32 nt, Human
agggugugcccaggcccagagaugauguccag

SEQ ID NO: 59152 - RNA, 32 nt, Human
agggugugcugcacucaugggccuggucucac

SEQ ID NO: 59153 - RNA, 32 nt, Human
agggugugcuuugguguauugagucugaugag

SEQ ID NO: 59154 - RNA, 32 nt, Human
aggguguggacucugggcuccugcugccuggg

SEQ ID NO: 59155 - RNA, 32 nt, Human
aggguguggcauggcucagucuggcccccuug

SEQ ID NO: 59156 - RNA, 32 nt, Human
aggguguggccaccaggugcugugaguuucug

SEQ ID NO: 59157 - RNA, 32 nt, Human
aggguguggcuuggaacauuugggagacugag

SEQ ID NO: 59158 - RNA, 32 nt, Human
agggugugggcuggguggcggggccaggccag

SEQ ID NO: 59159 - RNA, 32 nt, Human
aggguguggggagggguggggcagggagcccc

SEQ ID NO: 59160 - RNA, 23 nt, Human
aggguguggguccugggcuguca

SEQ ID NO: 59161 - RNA, 32 nt, Human
aggguguugaaggaagguagaggguggggcuu

SEQ ID NO: 59162 - RNA, 21 nt, Human
aggguguugacccagaaucca

SEQ ID NO: 59163 - RNA, 32 nt, Human
aggguguugcccaugcuuuuggguggguccca

SEQ ID NO: 59164 - RNA, 32 nt, Human
aggguguugggauacugcagggccaggacuga

SEQ ID NO: 59165 - RNA, 32 nt, Human
aggguguuuguagacgugggggaggagaaucu

SEQ ID NO: 59166 - RNA, 32 nt, Human
aggguuaaagccgcuggagcuuggggagagaa

SEQ ID NO: 59167 - RNA, 32 nt, Human
aggguuaaauuacuucaccucuugcacuuuua

SEQ ID NO: 59168 - RNA, 32 nt, Human
aggguuaagcaacauggugcaucuguggauag

SEQ ID NO: 59169 - RNA, 32 nt, Human
aggguuaauuccugguggggcagcucggcugu

SEQ ID NO: 59170 - RNA, 32 nt, Human
aggguuacaguuucucucacaugcuuuccuca

SEQ ID NO: 59171 - RNA, 32 nt, Human
aggguuacuguagucugauguguccuucccaa

SEQ ID NO: 59172 - RNA, 32 nt, Human
aggguuaggauuacaggcgugagccaccaggc

SEQ ID NO: 59173 - RNA, 17 nt, Human
aggguuaggguuggaga

SEQ ID NO: 59174 - RNA, 32 nt, Human
aggguuaggugucagaaagaaaaggaaguaau

SEQ ID NO: 59175 - RNA, 32 nt, Human
aggguuauuccaggggcuacugaagaucuaau

SEQ ID NO: 59176 - RNA, 32 nt, Human
aggguuauugccccaaccauugcaaugggagg

SEQ ID NO: 59177 - RNA, 32 nt, Human
aggguuauuugacuauuauauaauccguuugc

SEQ ID NO: 59178 - RNA, 32 nt, Human
aggguucaaauacagaagggcccagggcccag

SEQ ID NO: 59179 - RNA, 32 nt, Human
aggguucacagacaggguuucccaccagccac

SEQ ID NO: 59180 - RNA, 32 nt, Human
aggguucagaguagcugggacuacaggcccac

SEQ ID NO: 59181 - RNA, 32 nt, Human
aggguucaggaaacacaggaauuaguagacag

SEQ ID NO: 59182 - RNA, 32 nt, Human
aggguucauguggcauuuuagagaaaagauaa

SEQ ID NO: 59183 - RNA, 32 nt, Human
aggguuccacccugcucugccugccuggggcc

SEQ ID NO: 59184 - RNA, 32 nt, Human
aggguuccagcagccuggggcaguaugucuca

SEQ ID NO: 59185 - RNA, 32 nt, Human
aggguuccagcucugggacauugugcucagga

SEQ ID NO: 59186 - RNA, 32 nt, Human
aggguuccaggcuguguguggggcccaagcau

SEQ ID NO: 59187 - RNA, 20 nt, Human
aggguuccugaccccugccc

SEQ ID NO: 59188 - RNA, 32 nt, Human
aggguucgccccaguccuccugccuggagaca

SEQ ID NO: 59189 - RNA, 32 nt, Human
aggguucuccccacgacaaccccacugcacag

SEQ ID NO: 59190 - RNA, 32 nt, Human
aggguucuccgcaggacaaccccacugcacag

SEQ ID NO: 59191 - RNA, 32 nt, Human
aggguucuccucaaagccucacaaccauagga

SEQ ID NO: 59192 - RNA, 32 nt, Human
aggguucucugaguuugcccugccuuauaaug

SEQ ID NO: 59193 - RNA, 32 nt, Human
aggguucucuuggagccaccucucagccugcc

SEQ ID NO: 59194 - RNA, 32 nt, Human
aggguucugagcagugucggccuuguggccac

SEQ ID NO: 59195 - RNA, 21 nt, Human
aggguucugccucuccaggca

SEQ ID NO: 59196 - RNA, 32 nt, Human
aggguucugccuggcgucgggcuugggccggc

SEQ ID NO: 59197 - RNA, 32 nt, Human
aggguucugggaacgcgcuggcagcccugacg

SEQ ID NO: 59198 - RNA, 32 nt, Human
aggguucugggagcucccuguggccugucugg

SEQ ID NO: 59199 - RNA, 32 nt, Human
aggguucugggcagcagagucugugauaaagg

SEQ ID NO: 59200 - RNA, 32 nt, Human
aggguucugggugggaguggggagggcgaggg

SEQ ID NO: 59201 - RNA, 32 nt, Human
aggguugaaaauccucuggacgaacagaaguc

SEQ ID NO: 59202 - RNA, 32 nt, Human
aggguugaaggaugagacuacacauuggguac

SEQ ID NO: 59203 - RNA, 32 nt, Human
aggguugacuacaucucaucaucucacgaauc

SEQ ID NO: 59204 - RNA, 32 nt, Human
aggguugacucagggggaugaucuggguccca

SEQ ID NO: 59205 - RNA, 32 nt, Human
aggguugagaagaggaaaagaacuucucauuu

SEQ ID NO: 59206 - RNA, 32 nt, Human
aggguugaggggaagauaaacuuuuaaaaagc

SEQ ID NO: 59207 - RNA, 19 nt, Human
aggguugaugcaggucugc

SEQ ID NO: 59208 - RNA, 32 nt, Human
aggguugaugggggaggcguggggaagggaaa

SEQ ID NO: 59209 - RNA, 32 nt, Human
aggguugcagugagcugagauugugccauugc

SEQ ID NO: 59210 - RNA, 32 nt, Human
aggguugcccaggguggagugcaguggcagga

SEQ ID NO: 59211 - RNA, 32 nt, Human
aggguugccugggaacagucucuccccaagau

SEQ ID NO: 59212 - RNA, 32 nt, Human
aggguugccugggcacaguggcucacaccugu

SEQ ID NO: 59213 - RNA, 32 nt, Human
aggguugcucaaguggaaauuuugucagcugu

SEQ ID NO: 59214 - RNA, 32 nt, Human
aggguugcuugagacuagccuagguaacauag

SEQ ID NO: 59215 - RNA, 32 nt, Human
aggguuggagacugucugucuuuguagaaaua

SEQ ID NO: 59216 - RNA, 22 nt, Human
aggguuggccucccuucuuggg

SEQ ID NO: 59217 - RNA, 32 nt, Human
aggguugggaggaccucuuggcgcaggagcug

SEQ ID NO: 59218 - RNA, 32 nt, Human
aggguugggauuacagguguaagccacugcuc

SEQ ID NO: 59219 - RNA, 32 nt, Human
aggguugggauuaccauuuacugaccacaucu

SEQ ID NO: 59220 - RNA, 32 nt, Human
aggguugggauuaccggcaugagccacugcac

SEQ ID NO: 59221 - RNA, 32 nt, Human
aggguugggcugaaucaaaugggagcccucca

SEQ ID NO: 59222 - RNA, 32 nt, Human
aggguugggggugggagggcaacuuacuggag

SEQ ID NO: 59223 - RNA, 32 nt, Human
aggguuggguuagaggugagcuggggccggag

SEQ ID NO: 59224 - RNA, 32 nt, Human
aggguugucaggcggagcugguaggggagcug

SEQ ID NO: 59225 - RNA, 32 nt, Human
aggguuguuagugacccacaggacaguauaga

SEQ ID NO: 59226 - RNA, 32 nt, Human
aggguuguuggaacaucugaccugugcaucca

SEQ ID NO: 59227 - RNA, 32 nt, Human
aggguuguugugaggacuaaaugaguaaagug

SEQ ID NO: 59228 - RNA, 32 nt, Human
aggguuuacacaaagugccacuuauuaaagag

SEQ ID NO: 59229 - RNA, 32 nt, Human
aggguuuacucccagcugcaguucuguucaga

SEQ ID NO: 59230 - RNA, 32 nt, Human
aggguuuaggaggucugaacacacacagugga

SEQ ID NO: 59231 - RNA, 32 nt, Human
aggguuuaggggagggccaugggcaggcuggu

SEQ ID NO: 59232 - RNA, 32 nt, Human
aggguuucaccacguuggccaggauggucucg

SEQ ID NO: 59233 - RNA, 32 nt, Human
aggguuucaccauguuggccagccuggucuug

SEQ ID NO: 59234 - RNA, 32 nt, Human
aggguuucaccauguuggucauguuggucucg

SEQ ID NO: 59235 - RNA, 32 nt, Human
aggguuuccaugggguaggaggaugggcucgc

SEQ ID NO: 59236 - RNA, 32 nt, Human
aggguuuccuggcaacacccacuugggcucua

SEQ ID NO: 59237 - RNA, 32 nt, Human
aggguuucgggagaguccuggcuuugcacuua

SEQ ID NO: 59238 - RNA, 32 nt, Human
aggguuucuccaugcuggacaggcuggucuug

SEQ ID NO: 59239 - RNA, 32 nt, Human
aggguuucuccauguuggucaggcuggucuca

SEQ ID NO: 59240 - RNA, 32 nt, Human
aggguuucuccauguuggucaggcuggucucg

SEQ ID NO: 59241 - RNA, 32 nt, Human
aggguuucuccauguuggucaggcuggucuug

SEQ ID NO: 59242 - RNA, 32 nt, Human
aggguuucugagguccaggaaucuggggacag

SEQ ID NO: 59243 - RNA, 32 nt, Human
aggguuucugcugucuccagacugucuaccaa

SEQ ID NO: 59244 - RNA, 32 nt, Human
aggguuugagagagcagccaggagagcuuagg

SEQ ID NO: 59245 - RNA, 32 nt, Human
aggguuugagcuaggcugaagcagcagaacca

SEQ ID NO: 59246 - RNA, 32 nt, Human
aggguuugcauuuaucagucuguuuuccgaug

SEQ ID NO: 59247 - RNA, 32 nt, Human
aggguuugcccaguuugcagaugagaaaccca

SEQ ID NO: 59248 - RNA, 32 nt, Human
aggguuugcugagcuucuuaaccaguggguua

SEQ ID NO: 59249 - RNA, 32 nt, Human
aggguuugcuggggccaacaccagccuaagug

SEQ ID NO: 59250 - RNA, 32 nt, Human
aggguuuggaaaccaggauuggggucugccca

SEQ ID NO: 59251 - RNA, 31 nt, Human
aggguuugggcuugauuccuguugaauaaua

SEQ ID NO: 59252 - RNA, 32 nt, Human
aggguuuggggagcagagagagccaagaaguu

SEQ ID NO: 59253 - RNA, 32 nt, Human
aggguuugggugcugggaaccaggaagagugg

SEQ ID NO: 59254 - RNA, 32 nt, Human
aggguuuguaacccagggccugugcuggcgug

SEQ ID NO: 59255 - RNA, 32 nt, Human
aggguuugucucauggucagcucgccucucaa

SEQ ID NO: 59256 - RNA, 32 nt, Human
aggguuugugcaaguuugcaaacauguucacc

SEQ ID NO: 59257 - RNA, 24 nt, Human
aggguuuuacuguucauuguguca

SEQ ID NO: 59258 - RNA, 32 nt, Human
aggguuuucagaucacaaccaggauuuaaauc

SEQ ID NO: 59259 - RNA, 32 nt, Human
aggguuuuccauuuaacaagagcacuaguaug

SEQ ID NO: 59260 - RNA, 32 nt, Human
aggguuuucucagauuccuuuuuaaucucuau

SEQ ID NO: 59261 - RNA, 32 nt, Human
aggguuuugguggcuggcgaagcuggggcgug

SEQ ID NO: 59262 - RNA, 32 nt, Human
aggguuuuucaggcugggcacagugacucaca

SEQ ID NO: 59263 - RNA, 32 nt, Human
aggguuuuuccauguugcccaggcugguuucg

SEQ ID NO: 59264 - RNA, 32 nt, Human
agguaaaacuaaaucauugcucucuauacuag

SEQ ID NO: 59265 - RNA, 32 nt, Human
agguaaaagauuagugugagaccaucauggug

SEQ ID NO: 59266 - RNA, 32 nt, Human
agguaaaaggugguagcaaggccaggcgcggu

SEQ ID NO: 59267 - RNA, 21 nt, Human
agguaaaauuuuucuuuggca

SEQ ID NO: 59268 - RNA, 32 nt, Human
agguaaacugggugaagaaggcaagagaagac

SEQ ID NO: 59269 - RNA, 32 nt, Human
agguaaagaaccacucagcaugguuuuuguca

SEQ ID NO: 59270 - RNA, 31 nt, Human
agguaaagaagaccugucugcaguaggaagg

SEQ ID NO: 59271 - RNA, 24 nt, Human
agguaaagacgggaggaucacuug

SEQ ID NO: 59272 - RNA, 32 nt, Human
agguaaagagagagagccagcccagcccuguu

SEQ ID NO: 59273 - RNA, 32 nt, Human
agguaaagauaaccuccucuuucuaugacucc

SEQ ID NO: 59274 - RNA, 32 nt, Human
agguaaaggagccauauauugaagaccauguc

SEQ ID NO: 59275 - RNA, 32 nt, Human
agguaaauucagcugcaucugaaggggcuuca

SEQ ID NO: 59276 - RNA, 17 nt, Human
agguaaauuguccugaa

SEQ ID NO: 59277 - RNA, 32 nt, Human
agguaacauacagcacuuagaagacggccuga

SEQ ID NO: 59278 - RNA, 32 nt, Human
agguaaccaagugccucuaagucaugcuuauu

SEQ ID NO: 59279 - RNA, 32 nt, Human
agguaaccaggauggcuaacaggcuuugauag

SEQ ID NO: 59280 - RNA, 20 nt, Human
agguaaccuuccuuuccucu

SEQ ID NO: 59281 - RNA, 32 nt, Human
agguaacuagacugcagcuaaccaccaccaac

SEQ ID NO: 59282 - RNA, 32 nt, Human
agguaacucaguaaacaguggagcuggaauuc

SEQ ID NO: 59283 - RNA, 32 nt, Human
agguaacuguugucugugccuuuuugaaaaac

SEQ ID NO: 59284 - RNA, 24 nt, Human
agguaagaggauugcuugagccca

SEQ ID NO: 59285 - RNA, 32 nt, Human
agguaagagucauaucacaaaaagccauuaag

SEQ ID NO: 59286 - RNA, 32 nt, Human
agguaagauaaauaaauacauacacauauguu

SEQ ID NO: 59287 - RNA, 19 nt, Human
agguaagcccugggcccug

SEQ ID NO: 59288 - RNA, 24 nt, Human
agguaagcugcguucccugggcug

SEQ ID NO: 59289 - RNA, 32 nt, Human
agguaagggagaggagaggauugauagagugu

SEQ ID NO: 59290 - RNA, 32 nt, Human
agguaaggucccuagagcagcagaacaagaug

SEQ ID NO: 59291 - RNA, 32 nt, Human
agguaaguauggggcuuucccacccacaguag

SEQ ID NO: 59292 - RNA, 32 nt, Human
agguaagucacugcagaccgaccucccugcag

SEQ ID NO: 59293 - RNA, 32 nt, Human
agguaaguggcaggacccugucaggauugcag

SEQ ID NO: 59294 - RNA, 32 nt, Human
agguaaguuugcauccaagcaaugucgucuga

SEQ ID NO: 59295 - RNA, 32 nt, Human
agguaauaaucaggaaagcaaccuuacuacug

SEQ ID NO: 59296 - RNA, 32 nt, Human
agguaauauaugcacauuguacaaaaaucaga

SEQ ID NO: 59297 - RNA, 32 nt, Human
agguaauccauggagagagaaaaagaagaggg

SEQ ID NO: 59298 - RNA, 32 nt, Human
agguaaucuuucccaccuucccaaaccuaauu

SEQ ID NO: 59299 - RNA, 32 nt, Human
agguaaugucauggaauagaaugcugucacca

SEQ ID NO: 59300 - RNA, 32 nt, Human
agguaauguguacuuuucuuaugauaagauca

SEQ ID NO: 59301 - RNA, 32 nt, Human
agguaauuaguguggucccacccuccaucuuc

SEQ ID NO: 59302 - RNA, 32 nt, Human
agguaauugaaucacagggacgggucuuuccc

SEQ ID NO: 59303 - RNA, 32 nt, Human
agguaauuugguuuuaugggguauucuggaaa

SEQ ID NO: 59304 - RNA, 32 nt, Human
agguaauuuuggcugugguggaaacuuuggug

SEQ ID NO: 59305 - RNA, 32 nt, Human
agguacaaacacauucauguuucuuuuugucu

SEQ ID NO: 59306 - RNA, 32 nt, Human
agguacaaaugaugcaaaaugugcaccuggcu

SEQ ID NO: 59307 - RNA, 32 nt, Human
agguacacagaguagcugagcaguucacuuca

SEQ ID NO: 59308 - RNA, 32 nt, Human
agguacacagccauccaggcugugcugucccu

SEQ ID NO: 59309 - RNA, 32 nt, Human
agguacacaguucaauccaucuggaaggugga

SEQ ID NO: 59310 - RNA, 31 nt, Human
agguacacaucacucuuuacauuuuucuaag

SEQ ID NO: 59311 - RNA, 32 nt, Human
agguacaccacuacacuccagccugggcaaca

SEQ ID NO: 59312 - RNA, 32 nt, Human
agguacaccauuaucacauaagugcugucagu

SEQ ID NO: 59313 - RNA, 31 nt, Human
agguacagaaagaagagaaaagacugaacug

SEQ ID NO: 59314 - RNA, 32 nt, Human
agguacagaaagaagagaaaagacugaacuga

SEQ ID NO: 59315 - RNA, 32 nt, Human
agguacagacuggagggcucguccugcuacag

SEQ ID NO: 59316 - RNA, 32 nt, Human
agguacagcacauagcccaggagccagggggu

SEQ ID NO: 59317 - RNA, 32 nt, Human
agguacagcagaaaggagaacuauccaaaacu

SEQ ID NO: 59318 - RNA, 32 nt, Human
agguacagcccugucugcgguggcugcuuugu

SEQ ID NO: 59319 - RNA, 30 nt, Human
agguacagccugacgcuauggcaggcugcc

SEQ ID NO: 59320 - RNA, 32 nt, Human
agguacaucucuaaaguggagcacuuacacca

SEQ ID NO: 59321 - RNA, 32 nt, Human
agguacaugccuguaaucccagcuacucagga

SEQ ID NO: 59322 - RNA, 32 nt, Human
agguaccaaauaccccacauaaggaaaguacu

SEQ ID NO: 59323 - RNA, 32 nt, Human
agguaccacaaaccaggugcuauguuaagugc

SEQ ID NO: 59324 - RNA, 32 nt, Human
agguaccacacagcugggcuucccaccaggcu

SEQ ID NO: 59325 - RNA, 23 nt, Human
agguaccacauugucucugagcu

SEQ ID NO: 59326 - RNA, 32 nt, Human
agguaccagccuggccgggacccggcuguggg

SEQ ID NO: 59327 - RNA, 32 nt, Human
agguaccagguagagagagggccagggcugag

SEQ ID NO: 59328 - RNA, 32 nt, Human
agguacccaaguggccugaaacaguguaggga

SEQ ID NO: 59329 - RNA, 18 nt, Human
agguaccgcugugugcau

SEQ ID NO: 59330 - RNA, 32 nt, Human
agguaccgggagugaggcugagcugccacaca

SEQ ID NO: 59331 - RNA, 32 nt, Human
agguaccuagagaggaagugagggaggccacg

SEQ ID NO: 59332 - RNA, 32 nt, Human
agguaccuccucccuuucaucucagcaagaau

SEQ ID NO: 59333 - RNA, 32 nt, Human
agguaccuguaaucccagcuacucgggaggug

SEQ ID NO: 59334 - RNA, 32 nt, Human
agguacgcaccaccaugcccagcuuguguggg

SEQ ID NO: 59335 - RNA, 32 nt, Human
agguacgcucacuguacagccaaugccuccau

SEQ ID NO: 59336 - RNA, 32 nt, Human
agguacggagucucgcucugucgcccaggcug

SEQ ID NO: 59337 - RNA, 32 nt, Human
agguacggcggcacggcugcagccuggauggg

SEQ ID NO: 59338 - RNA, 32 nt, Human
agguacggcuggggguucuguccugcucaucc

SEQ ID NO: 59339 - RNA, 32 nt, Human
agguacguagugggagaggggugugauggggc

SEQ ID NO: 59340 - RNA, 32 nt, Human
agguacuaauuacugcccagccuggggagauc

SEQ ID NO: 59341 - RNA, 32 nt, Human
agguacuacagauuuucaaaacugaaugagag

SEQ ID NO: 59342 - RNA, 32 nt, Human
agguacuacuauuauugcuauuuucaaaugag

SEQ ID NO: 59343 - RNA, 32 nt, Human
agguacuagagaccucugagaucugcacacau

SEQ ID NO: 59344 - RNA, 32 nt, Human
agguacuaucgauuuccuaaaggaccgugagu

SEQ ID NO: 59345 - RNA, 32 nt, Human
agguacucacagaacaaucaggugugaccaua

SEQ ID NO: 59346 - RNA, 32 nt, Human
agguacucccugagcaggaccccacacuuggg

SEQ ID NO: 59347 - RNA, 32 nt, Human
agguacuccugccggccucccacccggccugc

SEQ ID NO: 59348 - RNA, 32 nt, Human
agguacucgggaggcugaggcagagaauugcu

SEQ ID NO: 59349 - RNA, 32 nt, Human
agguacucuggccacagccucuggggugggag

SEQ ID NO: 59350 - RNA, 32 nt, Human
agguacugaaagcagagguggcgggaagggga

SEQ ID NO: 59351 - RNA, 32 nt, Human
agguacugaaggcuucugcagcuuuggcugca

SEQ ID NO: 59352 - RNA, 32 nt, Human
agguacugagcacagguggccccucuggaaau

SEQ ID NO: 59353 - RNA, 32 nt, Human
agguacugauccuguuucuugcucugagugcu

SEQ ID NO: 59354 - RNA, 32 nt, Human
agguacugcccaggacugggcccagauaauga

SEQ ID NO: 59355 - RNA, 32 nt, Human
agguacugggcccagaggcuuugccuugacag

SEQ ID NO: 59356 - RNA, 32 nt, Human
agguacugucaauaucucacucuuggggauau

SEQ ID NO: 59357 - RNA, 32 nt, Human
agguacugucaugggcuaggcaugguggcuca

SEQ ID NO: 59358 - RNA, 32 nt, Human
agguacuuaguucucacaccugcacuuaccag

SEQ ID NO: 59359 - RNA, 32 nt, Human
agguacuucccgaggcuauggugugagagccc

SEQ ID NO: 59360 - RNA, 32 nt, Human
agguacuucucucuccuuccuccuucuccucc

SEQ ID NO: 59361 - RNA, 18 nt, Human
agguacuuugcagucaua

SEQ ID NO: 59362 - RNA, 32 nt, Human
agguagaaagagaagacccagagugaagaagu

SEQ ID NO: 59363 - RNA, 32 nt, Human
agguagaacauccugcagcuaaaguucuuugu

SEQ ID NO: 59364 - RNA, 32 nt, Human
agguagaagagaaaggcuuccccuacacccca

SEQ ID NO: 59365 - RNA, 22 nt, Human
agguagaauuugaguuuuagca

SEQ ID NO: 59366 - RNA, 22 nt, Human
agguagagaccccacccuccca

SEQ ID NO: 59367 - RNA, 32 nt, Human
agguagagcaucaccagcuccuguggccuugu

SEQ ID NO: 59368 - RNA, 32 nt, Human
agguagagcuccaggacauucagguaccaggu

SEQ ID NO: 59369 - RNA, 32 nt, Human
agguagagcuguucgccggggcgccugcagag

SEQ ID NO: 59370 - RNA, 30 nt, Human
agguagagcuugcaguaagcagagaucaug

SEQ ID NO: 59371 - RNA, 32 nt, Human
agguagaggcacgggauaaggggccaggguca

SEQ ID NO: 59372 - RNA, 32 nt, Human
agguagagggcugucagcccugaaaaacacac

SEQ ID NO: 59373 - RNA, 32 nt, Human
agguagaggugagaauggggaggcaagaucuc

SEQ ID NO: 59374 - RNA, 18 nt, Human
agguagagguugcaguga

SEQ ID NO: 59375 - RNA, 19 nt, Human
agguagagguugcagugag

SEQ ID NO: 59376 - RNA, 32 nt, Human
agguagagguugcagugagcugagaucguagc

SEQ ID NO: 59377 - RNA, 32 nt, Human
agguagaguaagagguugaagauaacagagug

SEQ ID NO: 59378 - RNA, 32 nt, Human
agguagaguuaccaaagagcucagggaugcag

SEQ ID NO: 59379 - RNA, 23 nt, Human
agguagaugaaguugcuuugcca

SEQ ID NO: 59380 - RNA, 32 nt, Human
agguagaugcagcucuuacagauauuuacuug

SEQ ID NO: 59381 - RNA, 32 nt, Human
agguagaugcuucugauuuacuucucucaaag

SEQ ID NO: 59382 - RNA, 32 nt, Human
agguagcaagagcuccagagagaagucgagga

SEQ ID NO: 59383 - RNA, 32 nt, Human
agguagcagaacucacguucccacuauagcaa

SEQ ID NO: 59384 - RNA, 32 nt, Human
agguagcagcugugcugucucuuaaagucuga

SEQ ID NO: 59385 - RNA, 32 nt, Human
agguagcagugagccgagaucacuccacugca

SEQ ID NO: 59386 - RNA, 32 nt, Human
agguagcagugagccgagaucgcgccacugcg

SEQ ID NO: 59387 - RNA, 32 nt, Human
agguagcaucuugccauuuucuuccugcacag

SEQ ID NO: 59388 - RNA, 32 nt, Human
agguagccaacacgcugugcucagcuugcuau

SEQ ID NO: 59389 - RNA, 32 nt, Human
agguagccaaucugaauccuaaggaccucucg

SEQ ID NO: 59390 - RNA, 32 nt, Human
agguagccagugccaaggaguuccagaucgug

SEQ ID NO: 59391 - RNA, 32 nt, Human
agguagcccaggagcagggcggccaccccaag

SEQ ID NO: 59392 - RNA, 32 nt, Human
agguagccucugguggcuaugcauuuauuacu

SEQ ID NO: 59393 - RNA, 32 nt, Human
agguagcuacacagcaucuguuacgguuaaug

SEQ ID NO: 59394 - RNA, 32 nt, Human
agguagcuaccacuggugugggcugcuggcug

SEQ ID NO: 59395 - RNA, 32 nt, Human
agguagcucucuagggagaguugcaggcagag

SEQ ID NO: 59396 - RNA, 32 nt, Human
agguaggaagaaaaugggaguaagagaacaau

SEQ ID NO: 59397 - RNA, 32 nt, Human
agguaggaagauugcuugaggccaggaguccc

SEQ ID NO: 59398 - RNA, 32 nt, Human
agguaggacaggaaugucccugccugguacug

SEQ ID NO: 59399 - RNA, 24 nt, Human
agguaggagaauugcuugaaccca

SEQ ID NO: 59400 - RNA, 32 nt, Human
agguaggaggaucgcuugagccuggguagagg

SEQ ID NO: 59401 - RNA, 24 nt, Human
agguaggaggauugcuugagccca

SEQ ID NO: 59402 - RNA, 23 nt, Human
agguaggaggauugcuugagucc

SEQ ID NO: 59403 - RNA, 32 nt, Human
agguaggagggugagguccauccagguagaca

SEQ ID NO: 59404 - RNA, 32 nt, Human
agguaggaucgcuuuagcccaggaguucaaga

SEQ ID NO: 59405 - RNA, 32 nt, Human
agguaggcacaaauacauuccuuuuagaguua

SEQ ID NO: 59406 - RNA, 32 nt, Human
agguaggcaccagccacagaacuggaaagccc

SEQ ID NO: 59407 - RNA, 26 nt, Human
agguaggcagaucaccugaggucagg

SEQ ID NO: 59408 - RNA, 22 nt, Human
agguaggcagaucacgagguca

SEQ ID NO: 59409 - RNA, 26 nt, Human
agguaggcagaucacuugaggucagg

SEQ ID NO: 59410 - RNA, 32 nt, Human
agguaggcgaaaagaugacaggauacagaguc

SEQ ID NO: 59411 - RNA, 25 nt, Human
agguaggcggaucaccugaggucgg

SEQ ID NO: 59412 - RNA, 26 nt, Human
agguaggcggaucaccugagguuagg

SEQ ID NO: 59413 - RNA, 25 nt, Human
agguaggcggaucacuggggucagg

SEQ ID NO: 59414 - RNA, 32 nt, Human
agguaggcucacuucucuuucccuucaaaaug

SEQ ID NO: 59415 - RNA, 32 nt, Human
agguagggcuggauccaggaauucaaaugaug

SEQ ID NO: 59416 - RNA, 32 nt, Human
agguaggggcaggcaagagagaggauucagac

SEQ ID NO: 59417 - RNA, 25 nt, Human
agguaggggggaucacuugagccca

SEQ ID NO: 59418 - RNA, 32 nt, Human
agguaggguucaggugagcaaaaagaaagugg

SEQ ID NO: 59419 - RNA, 24 nt, Human
agguagguagauugcuugagccca

SEQ ID NO: 59420 - RNA, 32 nt, Human
agguagguagcuaugauaggcaccuaaugcuu

SEQ ID NO: 59421 - RNA, 32 nt, Human
agguaggugaagccuggccaggcgggaggcuu

SEQ ID NO: 59422 - RNA, 25 nt, Human
agguagguggauaccugaggucagg

SEQ ID NO: 59423 - RNA, 26 nt, Human
agguagguggaucacccaaggucagg

SEQ ID NO: 59424 - RNA, 26 nt, Human
agguagguggaucaccuaaggucagg

SEQ ID NO: 59425 - RNA, 26 nt, Human
agguagguggaucaccugaggucggg

SEQ ID NO: 59426 - RNA, 24 nt, Human
agguagguggaucaugaggucagg

SEQ ID NO: 59427 - RNA, 25 nt, Human
agguagguggaucgccugaggucag

SEQ ID NO: 59428 - RNA, 32 nt, Human
agguaguauugugcuuuaaaaaccagaggcuc

SEQ ID NO: 59429 - RNA, 32 nt, Human
agguagugacugagauuuggugaucuggcuga

SEQ ID NO: 59430 - RNA, 32 nt, Human
agguaguggcuguuaggcacacaguauaauuc

SEQ ID NO: 59431 - RNA, 32 nt, Human
agguagugggagagaggaaaggagggaaggca

SEQ ID NO: 59432 - RNA, 32 nt, Human
agguaguuaccugaauauagguugaaaagguu

SEQ ID NO: 59433 - RNA, 32 nt, Human
agguaguucuggugcagguaaguggcccugag

SEQ ID NO: 59434 - RNA, 32 nt, Human
agguaguugguuuguccauagcauccugagcu

SEQ ID NO: 59435 - RNA, 32 nt, Human
agguauaaaagugaugaccuaucaugaggaaa

SEQ ID NO: 59436 - RNA, 32 nt, Human
agguauaaaggccauccacauuuuaaaggguu

SEQ ID NO: 59437 - RNA, 32 nt, Human
agguauacagcaguaaucuccuauuuuggugu

SEQ ID NO: 59438 - RNA, 32 nt, Human
agguauacaggguggaguagggagaagcugcc

SEQ ID NO: 59439 - RNA, 32 nt, Human
agguauacccugcucugccacccaugaaccag

SEQ ID NO: 59440 - RNA, 32 nt, Human
agguauacuaccucagagaucagugagcagaa

SEQ ID NO: 59441 - RNA, 31 nt, Human
agguauacuuauaaauaccugcagggauuuc

SEQ ID NO: 59442 - RNA, 32 nt, Human
agguauagggcugccuuccucuuauuuauuug

SEQ ID NO: 59443 - RNA, 32 nt, Human
agguauaucggguggaaaaagauuuggaaaau

SEQ ID NO: 59444 - RNA, 19 nt, Human
agguaucaacccagaagcc

SEQ ID NO: 59445 - RNA, 32 nt, Human
agguaucaagucaacaugaaauuggaaugcaa

SEQ ID NO: 59446 - RNA, 32 nt, Human
agguaucaauauguuuucaaugccugaugacc

SEQ ID NO: 59447 - RNA, 32 nt, Human
agguaucaaucaggauugagcacugaauucca

SEQ ID NO: 59448 - RNA, 32 nt, Human
agguaucacugcacuuuaagaaacuggaggcu

SEQ ID NO: 59449 - RNA, 32 nt, Human
agguaucacugcagucaccucuucuacccuca

SEQ ID NO: 59450 - RNA, 32 nt, Human
agguaucauggacuguucaaccaguucuggac

SEQ ID NO: 59451 - RNA, 32 nt, Human
agguaucccagcuuugggcacauguaugucca

SEQ ID NO: 59452 - RNA, 32 nt, Human
agguauccugaagcaaaagacaggaguucucu

SEQ ID NO: 59453 - RNA, 32 nt, Human
agguaucuaccucccaccuucuccucaucugu

SEQ ID NO: 59454 - RNA, 32 nt, Human
agguaucucagaauuccuccuccugggacucu

SEQ ID NO: 59455 - RNA, 32 nt, Human
agguaucuuuguccuuucaccugggccucaua

SEQ ID NO: 59456 - RNA, 32 nt, Human
agguaucuuuuaaaaaucagaacagagacuua

SEQ ID NO: 59457 - RNA, 32 nt, Human
agguaucuuuuucuaaaaacuucaaguguuug

SEQ ID NO: 59458 - RNA, 32 nt, Human
agguaugaaccaccgcgcccagccuuuuuguu

SEQ ID NO: 59459 - RNA, 20 nt, Human
agguaugaagccagaagcca

SEQ ID NO: 59460 - RNA, 32 nt, Human
agguaugaaggagccugagccaugaaguggga

SEQ ID NO: 59461 - RNA, 32 nt, Human
agguaugacugauauuuagagaacaagacuaa

SEQ ID NO: 59462 - RNA, 32 nt, Human
agguaugagccacaacacccagccuuuaacgu

SEQ ID NO: 59463 - RNA, 23 nt, Human
agguaugagccaccacgcccggu

SEQ ID NO: 59464 - RNA, 22 nt, Human
agguaugagccaccgugcccgg

SEQ ID NO: 59465 - RNA, 29 nt, Human
agguaugaugaugcuguguaucaggaagg

SEQ ID NO: 59466 - RNA, 32 nt, Human
agguaugcguaggagcaagaagggacagggaa

SEQ ID NO: 59467 - RNA, 21 nt, Human
agguaugcuuucuuccagccc

SEQ ID NO: 59468 - RNA, 32 nt, Human
agguauggaaagaaccaugcagaggaauauua

SEQ ID NO: 59469 - RNA, 32 nt, Human
agguauggaaggagcgggcacuggccugagca

SEQ ID NO: 59470 - RNA, 32 nt, Human
agguauggaucacccacaaauguagcuuucag

SEQ ID NO: 59471 - RNA, 32 nt, Human
agguauggcagaggugcaagaccuaguccccu

SEQ ID NO: 59472 - RNA, 32 nt, Human
agguaugggaagcagacacggagaguggcagg

SEQ ID NO: 59473 - RNA, 32 nt, Human
agguaugggccagagaggacugggucagagag

SEQ ID NO: 59474 - RNA, 32 nt, Human
  misc_feature (8)..(10): n is a, c, g or u
agguaugnnncacgccuguaaucccagcacuu

SEQ ID NO: 59475 - RNA, 32 nt, Human
agguauguagacauaucuaauagugguuuucc

SEQ ID NO: 59476 - RNA, 32 nt, Human
agguauguagcccugucacaggacagcucacu

SEQ ID NO: 59477 - RNA, 32 nt, Human
agguauguucacagauuaauuauagggccauc

SEQ ID NO: 59478 - RNA, 32 nt, Human
agguauuaaaacuaaauuucacuacuagauug

SEQ ID NO: 59479 - RNA, 32 nt, Human
agguauuacaaaguguuaauauacaaaauucu

SEQ ID NO: 59480 - RNA, 32 nt, Human
agguauucaaaaccuuugaccacauggcccgu

SEQ ID NO: 59481 - RNA, 32 nt, Human
agguauucaagaccagccugggaaacgugggg

SEQ ID NO: 59482 - RNA, 32 nt, Human
agguauucaagcaccaccuccacccagccccu

SEQ ID NO: 59483 - RNA, 32 nt, Human
agguauucaagugauucucccaucucggucuc

SEQ ID NO: 59484 - RNA, 19 nt, Human
agguauucccagucuuccu

SEQ ID NO: 59485 - RNA, 32 nt, Human
agguauuccucaccuuucuugccuuuaccaga

SEQ ID NO: 59486 - RNA, 32 nt, Human
agguauucuuuccugacauuguuuucagaaua

SEQ ID NO: 59487 - RNA, 32 nt, Human
agguauugagcagcagauagagacacaggccu

SEQ ID NO: 59488 - RNA, 32 nt, Human
agguauugagccugauggcccagguauugagg

SEQ ID NO: 59489 - RNA, 32 nt, Human
agguauuggucuuuccuguggucccugauguu

SEQ ID NO: 59490 - RNA, 32 nt, Human
agguauuuaaagagccacccacauagcuucac

SEQ ID NO: 59491 - RNA, 32 nt, Human
agguauuucucccacagaaaugaugaaaguga

SEQ ID NO: 59492 - RNA, 18 nt, Human
agguauuugaacauuuca

SEQ ID NO: 59493 - RNA, 32 nt, Human
agguauuugcauaggaaucagaggaguuaauc

SEQ ID NO: 59494 - RNA, 32 nt, Human
agguauuuuauucucaaagugaucucaaacug

SEQ ID NO: 59495 - RNA, 32 nt, Human
agguauuuucacccucuucgccugguacagcc

SEQ ID NO: 59496 - RNA, 32 nt, Human
aggucaaaaguggcggguguggcgcggggcug

SEQ ID NO: 59497 - RNA, 32 nt, Human
aggucaaacgaccucaucacagucuuccuucc

SEQ ID NO: 59498 - RNA, 20 nt, Human
aggucaaacguaggcuucau

SEQ ID NO: 59499 - RNA, 32 nt, Human
aggucaaagaugaugcauaacagccucucuag

SEQ ID NO: 59500 - RNA, 32 nt, Human
aggucaaauucaggagauaagaaugguuuuua

SEQ ID NO: 59501 - RNA, 32 nt, Human
aggucaaauuugagauucucuguggcuucagu

SEQ ID NO: 59502 - RNA, 19 nt, Human
aggucaacacugcacucca

SEQ ID NO: 59503 - RNA, 32 nt, Human
aggucaacacugcacuccagccugggcgacag

SEQ ID NO: 59504 - RNA, 32 nt, Human
aggucaacccuugguucuuauagaugcucaga

SEQ ID NO: 59505 - RNA, 32 nt, Human
aggucaacugcggccucacagcugggccuguc

SEQ ID NO: 59506 - RNA, 32 nt, Human
aggucaagacugugguauuggggucuuuuggc

SEQ ID NO: 59507 - RNA, 32 nt, Human
aggucaagagagagcucaguuucccucucccc

SEQ ID NO: 59508 - RNA, 32 nt, Human
aggucaagcgauugagaucauccuggccaaca

SEQ ID NO: 59509 - RNA, 32 nt, Human
aggucaagcuccaaggaagggacucucuacau

SEQ ID NO: 59510 - RNA, 32 nt, Human
aggucaagcuccaaggaagggauucucuacau

SEQ ID NO: 59511 - RNA, 32 nt, Human
aggucaaggaagcaacacaauagucugugagc

SEQ ID NO: 59512 - RNA, 32 nt, Human
aggucaagggguggaaguuacaccuggugcag

SEQ ID NO: 59513 - RNA, 21 nt, Human
aggucacaagaaaggcucuau

SEQ ID NO: 59514 - RNA, 31 nt, Human
aggucacacagcaaggagguggcagagccaa

SEQ ID NO: 59515 - RNA, 32 nt, Human
aggucacacagcagcagucacuguaacagacu

SEQ ID NO: 59516 - RNA, 31 nt, Human
aggucacacagcuaguuagcggcagagccug

SEQ ID NO: 59517 - RNA, 31 nt, Human
aggucacacagcuaguuugaguagagccagu

SEQ ID NO: 59518 - RNA, 32 nt, Human
aggucacaccaccacuggaguggaugggcagu

SEQ ID NO: 59519 - RNA, 32 nt, Human
aggucacaccacugcacuccagccugggcuac

SEQ ID NO: 59520 - RNA, 32 nt, Human
aggucacaccauugcacuccaaccugggcgac

SEQ ID NO: 59521 - RNA, 32 nt, Human
aggucacacccacucccagagcaacccugggc

SEQ ID NO: 59522 - RNA, 32 nt, Human
aggucacaccgcugcacuccagccugggcaac

SEQ ID NO: 59523 - RNA, 32 nt, Human
aggucacaccuggccucacacuuugagcugag

SEQ ID NO: 59524 - RNA, 32 nt, Human
aggucacagaaaccucugccugccagguaggc

SEQ ID NO: 59525 - RNA, 32 nt, Human
aggucacagaacugccacuaugguuaaauguc

SEQ ID NO: 59526 - RNA, 32 nt, Human
aggucacagcacaacuaaauccaggacaggac

SEQ ID NO: 59527 - RNA, 32 nt, Human
aggucacagcacaagugcacaucagcacuaug

SEQ ID NO: 59528 - RNA, 32 nt, Human
aggucacagcuacuuggaaggcugagauguga

SEQ ID NO: 59529 - RNA, 32 nt, Human
aggucacagcuauggauguggaagagauagga

SEQ ID NO: 59530 - RNA, 32 nt, Human
aggucacaggcagaaaauaggagcaggauuuc

SEQ ID NO: 59531 - RNA, 32 nt, Human
aggucacaggcagagagaaucacagcagcaga

SEQ ID NO: 59532 - RNA, 32 nt, Human
aggucacaggcaggggcugcccuggacggggg

SEQ ID NO: 59533 - RNA, 32 nt, Human
aggucacaguaagccuugcagcuugagcugaa

SEQ ID NO: 59534 - RNA, 32 nt, Human
aggucacaguauucaugacaaaugugguggga

SEQ ID NO: 59535 - RNA, 19 nt, Human
aggucaccaugacaaggag

SEQ ID NO: 59536 - RNA, 32 nt, Human
aggucaccccuccacuucagcuugcccugacc

SEQ ID NO: 59537 - RNA, 32 nt, Human
aggucaccgcucgcccuaguucccaggcuuug

SEQ ID NO: 59538 - RNA, 32 nt, Human
aggucaccgcuugcucuaguucccaggcuuug

SEQ ID NO: 59539 - RNA, 24 nt, Human
aggucaccgucuccuuccaccccu

SEQ ID NO: 59540 - RNA, 32 nt, Human
aggucaccugaccuagaaucaccagaaguguu

SEQ ID NO: 59541 - RNA, 32 nt, Human
aggucaccugcacucccagccaaguggugaug

SEQ ID NO: 59542 - RNA, 32 nt, Human
aggucaccuggacucugcucccaggaagcugu

SEQ ID NO: 59543 - RNA, 32 nt, Human
aggucaccugggaucucgggguagccaggcug

SEQ ID NO: 59544 - RNA, 32 nt, Human
aggucaccuugcaggccugcuugcaggaaaug

SEQ ID NO: 59545 - RNA, 32 nt, Human
aggucaccuuggugggucgcccauggcgagau

SEQ ID NO: 59546 - RNA, 32 nt, Human
aggucacgucacugcacucuagccugggcaac

SEQ ID NO: 59547 - RNA, 31 nt, Human
aggucacucaauaaaugugcuggaguaacac

SEQ ID NO: 59548 - RNA, 32 nt, Human
aggucacucagggucaauacucagggucagug

SEQ ID NO: 59549 - RNA, 32 nt, Human
aggucacugaauggccaugggguccucaauga

SEQ ID NO: 59550 - RNA, 32 nt, Human
aggucacugcaaccuccaccucccggguucaa

SEQ ID NO: 59551 - RNA, 32 nt, Human
aggucacugcaaccucugccucccagguucaa

SEQ ID NO: 59552 - RNA, 32 nt, Human
aggucacugcaaccucugccuccuggguucaa

SEQ ID NO: 59553 - RNA, 32 nt, Human
aggucacugcacugggagguccuggcugcugc

SEQ ID NO: 59554 - RNA, 32 nt, Human
aggucacugcagcccugaccuccugggcucaa

SEQ ID NO: 59555 - RNA, 32 nt, Human
aggucacugccuggaccuggugcccuggcugc

SEQ ID NO: 59556 - RNA, 32 nt, Human
aggucacugcggccuugauuucccaggcucaa

SEQ ID NO: 59557 - RNA, 32 nt, Human
aggucacuggacuguacguuuuuaugguugug

SEQ ID NO: 59558 - RNA, 32 nt, Human
aggucacuguagccuccgccuccagggcucaa

SEQ ID NO: 59559 - RNA, 32 nt, Human
aggucacuucuucccagcccugccucaacugu

SEQ ID NO: 59560 - RNA, 32 nt, Human
aggucacuugccugccuucucuggacugcacu

SEQ ID NO: 59561 - RNA, 32 nt, Human
aggucagaagcaucugcugucaugacaccgcu

SEQ ID NO: 59562 - RNA, 32 nt, Human
aggucagaagguucccaaaccccuggggcugg

SEQ ID NO: 59563 - RNA, 32 nt, Human
aggucagacugcaagauuguuuguucagaugu

SEQ ID NO: 59564 - RNA, 32 nt, Human
aggucagagaagaggaaaagagacucagagaa

SEQ ID NO: 59565 - RNA, 32 nt, Human
aggucagagaaggucagagcugagugacguuu

SEQ ID NO: 59566 - RNA, 32 nt, Human
aggucagagaauggagagagccugugcaugau

SEQ ID NO: 59567 - RNA, 32 nt, Human
aggucagagacagagugguagagccaguccau

SEQ ID NO: 59568 - RNA, 32 nt, Human
aggucagaguuucuuuucauaacugccugaaa

SEQ ID NO: 59569 - RNA, 32 nt, Human
aggucagauaccggagaggagccaagaucccu

SEQ ID NO: 59570 - RNA, 32 nt, Human
aggucagaugaugacagcuguguccuuaacaa

SEQ ID NO: 59571 - RNA, 24 nt, Human
aggucagcaaaggccugccccguc

SEQ ID NO: 59572 - RNA, 32 nt, Human
aggucagcaaccuaaagacacuacccaagggc

SEQ ID NO: 59573 - RNA, 32 nt, Human
aggucagcagaagaaggaacugagcaguugaa

SEQ ID NO: 59574 - RNA, 32 nt, Human
aggucagcagcucccgucuccuucccucuuga

SEQ ID NO: 59575 - RNA, 32 nt, Human
aggucagccagcuccuagcagagaagagccag

SEQ ID NO: 59576 - RNA, 25 nt, Human
aggucagccaggccuccuccugguc

SEQ ID NO: 59577 - RNA, 32 nt, Human
aggucagcccaggaauuggcagaggaaguagg

SEQ ID NO: 59578 - RNA, 32 nt, Human
aggucagccgcccugcacugcccagagaccag

SEQ ID NO: 59579 - RNA, 21 nt, Human
aggucagccugacccacgguu

SEQ ID NO: 59580 - RNA, 32 nt, Human
aggucagccuuucucacaaacucuuuugaacu

SEQ ID NO: 59581 - RNA, 26 nt, Human
aggucagcuucuuccucugcccaguc

SEQ ID NO: 59582 - RNA, 32 nt, Human
aggucaggaaccugggugcagcuucauggggu

SEQ ID NO: 59583 - RNA, 23 nt, Human
aggucaggaguucaagaccagcu

SEQ ID NO: 59584 - RNA, 22 nt, Human
aggucaggaguuccagaucagc

SEQ ID NO: 59585 - RNA, 32 nt, Human
aggucaggaguuugagaccacccuggccaaca

SEQ ID NO: 59586 - RNA, 32 nt, Human
aggucaggaguuugagaucagccuggacaaca

SEQ ID NO: 59587 - RNA, 32 nt, Human
aggucaggaguuugagaucagccuggcaaaca

SEQ ID NO: 59588 - RNA, 32 nt, Human
aggucaggaguuugagaucagccuggccaaca

SEQ ID NO: 59589 - RNA, 32 nt, Human
aggucaggaguuugagaucagccuggccaaua

SEQ ID NO: 59590 - RNA, 32 nt, Human
aggucaggaguuugagaucagccuggccaaug

SEQ ID NO: 59591 - RNA, 32 nt, Human
aggucaggaguuugagccugaccaacaugcua

SEQ ID NO: 59592 - RNA, 32 nt, Human
aggucaggaguuuugagaccagccuggccaac

SEQ ID NO: 59593 - RNA, 32 nt, Human
aggucaggccaaggcagguggaucaccugagg

SEQ ID NO: 59594 - RNA, 32 nt, Human
aggucaggcuccaggagcaugagaauugaucc

SEQ ID NO: 59595 - RNA, 32 nt, Human
aggucagggagccugagcuggagccagggccc

SEQ ID NO: 59596 - RNA, 32 nt, Human
aggucagucugugccguauuccuugaaaguga

SEQ ID NO: 59597 - RNA, 32 nt, Human
aggucagugauggaggcuguggacagaaacag

SEQ ID NO: 59598 - RNA, 32 nt, Human
aggucagugcaucgaguucuguuuccguggaa

SEQ ID NO: 59599 - RNA, 32 nt, Human
aggucaguuugagaccagccugggcaacaugg

SEQ ID NO: 59600 - RNA, 32 nt, Human
aggucauaaggaugagauauauuugggguacu

SEQ ID NO: 59601 - RNA, 32 nt, Human
aggucauacagggauauauaaaagccaugcuc

SEQ ID NO: 59602 - RNA, 32 nt, Human
aggucauaccagugcacuccaggcgggugaca

SEQ ID NO: 59603 - RNA, 32 nt, Human
aggucauacucugccauuuugucucuuaaugc

SEQ ID NO: 59604 - RNA, 32 nt, Human
aggucauagauucuugagcuguugugguuuuu

SEQ ID NO: 59605 - RNA, 32 nt, Human
aggucauaucacgccugcuguagucacuucug

SEQ ID NO: 59606 - RNA, 25 nt, Human
aggucauauccugccacucccgucg

SEQ ID NO: 59607 - RNA, 32 nt, Human
aggucaucaacaucugauucaggaagcagcag

SEQ ID NO: 59608 - RNA, 20 nt, Human
aggucaucaagcaguguuca

SEQ ID NO: 59609 - RNA, 32 nt, Human
aggucaucuaggguuuuauaaaggaggaggag

SEQ ID NO: 59610 - RNA, 32 nt, Human
aggucaucucugcucuggcuuuucuccaagca

SEQ ID NO: 59611 - RNA, 32 nt, Human
aggucaucugcugucauggauuuuucaauaau

SEQ ID NO: 59612 - RNA, 32 nt, Human
aggucaugcagcuggugguggggagagcugga

SEQ ID NO: 59613 - RNA, 32 nt, Human
aggucaugccacugcacuccagccuggccugg

SEQ ID NO: 59614 - RNA, 32 nt, Human
aggucaugccacugcacuccagccugggagac

SEQ ID NO: 59615 - RNA, 32 nt, Human
aggucaugccacugcacucuagccugggugac

SEQ ID NO: 59616 - RNA, 32 nt, Human
aggucaugccacugcacugcagccugggcgac

SEQ ID NO: 59617 - RNA, 32 nt, Human
aggucaugccauuguacuccagccugggcaac

SEQ ID NO: 59618 - RNA, 32 nt, Human
aggucaugggggccuuggcaggagcgguuuug

SEQ ID NO: 59619 - RNA, 32 nt, Human
aggucauggugcuuagaggaggagccucagcu

SEQ ID NO: 59620 - RNA, 32 nt, Human
aggucauuaaauagauuuuugaagacgguucu

SEQ ID NO: 59621 - RNA, 32 nt, Human
aggucauuacucugcagugugggaagcggggc

SEQ ID NO: 59622 - RNA, 32 nt, Human
aggucauuagcaaacaugaacucacagggauc

SEQ ID NO: 59623 - RNA, 23 nt, Human
aggucauuagugucucuggggug

SEQ ID NO: 59624 - RNA, 32 nt, Human
aggucauugaucaguuuggagaguagggccac

SEQ ID NO: 59625 - RNA, 32 nt, Human
agguccaaaagcugcccacugccucuggagug

SEQ ID NO: 59626 - RNA, 32 nt, Human
agguccaaaccugggcuugucuccacuucacg

SEQ ID NO: 59627 - RNA, 32 nt, Human
agguccaaauacugaaugucuccuuuacuuuu

SEQ ID NO: 59628 - RNA, 31 nt, Human
agguccaagcugagagaaaagagucaugauc

SEQ ID NO: 59629 - RNA, 23 nt, Human
agguccaaggacacccucccucc

SEQ ID NO: 59630 - RNA, 18 nt, Human
agguccaaggacccagga

SEQ ID NO: 59631 - RNA, 32 nt, Human
agguccaaggcugcagugagccauguucacac

SEQ ID NO: 59632 - RNA, 32 nt, Human
agguccaaugggcuaggcagaguugucccagg

SEQ ID NO: 59633 - RNA, 32 nt, Human
agguccacacccgccucagaguccggagucug

SEQ ID NO: 59634 - RNA, 32 nt, Human
agguccacgggaagccuacacgcccaagguca

SEQ ID NO: 59635 - RNA, 32 nt, Human
agguccacuggacaguugggaaaacaccugac

SEQ ID NO: 59636 - RNA, 32 nt, Human
agguccacugggcugagugucccuugggccca

SEQ ID NO: 59637 - RNA, 32 nt, Human
agguccacuucuccacccacugagaccccuuu

SEQ ID NO: 59638 - RNA, 32 nt, Human
agguccagagaaggaaggagacuuagcagcca

SEQ ID NO: 59639 - RNA, 32 nt, Human
agguccagaucagaguucaggacucugagugc

SEQ ID NO: 59640 - RNA, 32 nt, Human
agguccagcaggcagcagacgguaugaccauc

SEQ ID NO: 59641 - RNA, 32 nt, Human
agguccagcaguccuggcgggcugaggagaag

SEQ ID NO: 59642 - RNA, 32 nt, Human
agguccagccuguucacacugcaccucaggua

SEQ ID NO: 59643 - RNA, 32 nt, Human
agguccagcuguucccccuggcauacaagcuu

SEQ ID NO: 59644 - RNA, 32 nt, Human
agguccaggacucagcuuucugcuucagccua

SEQ ID NO: 59645 - RNA, 32 nt, Human
agguccaggccuguguugccagagcuggcagu

SEQ ID NO: 59646 - RNA, 32 nt, Human
agguccaggcugcuguggaagcugcuguccca

SEQ ID NO: 59647 - RNA, 32 nt, Human
agguccaggggccacauggcugagggggacgc

SEQ ID NO: 59648 - RNA, 32 nt, Human
agguccagugaggacgagggugaaauuuauau

SEQ ID NO: 59649 - RNA, 32 nt, Human
agguccauaccccuuccucucucccuccuacc

SEQ ID NO: 59650 - RNA, 32 nt, Human
agguccaucaucauguaccaagccacagguca

SEQ ID NO: 59651 - RNA, 32 nt, Human
agguccaucuaggagggugccgggaggagcug

SEQ ID NO: 59652 - RNA, 32 nt, Human
agguccaucucuccacccacugaggccccuuu

SEQ ID NO: 59653 - RNA, 32 nt, Human
aggucccacagcccugagaugggccggccccc

SEQ ID NO: 59654 - RNA, 32 nt, Human
aggucccacaucuggugcugaaacucagagca

SEQ ID NO: 59655 - RNA, 32 nt, Human
aggucccacccuggacuucugaaggggugugg

SEQ ID NO: 59656 - RNA, 32 nt, Human
aggucccacugcagcccuccaagcaggugugc

SEQ ID NO: 59657 - RNA, 32 nt, Human
aggucccagcacauguguuuucaagaggccac

SEQ ID NO: 59658 - RNA, 32 nt, Human
aggucccagcccuguugccaagugaccuuguc

SEQ ID NO: 59659 - RNA, 32 nt, Human
aggucccaggcucagcagggagcugcuggaug

SEQ ID NO: 59660 - RNA, 32 nt, Human
aggucccagggugggagggcuagggaaaggga

SEQ ID NO: 59661 - RNA, 19 nt, Human
aggucccaguuuggccagg

SEQ ID NO: 59662 - RNA, 32 nt, Human
aggucccaguuuggccaggggugagggagaga

SEQ ID NO: 59663 - RNA, 32 nt, Human
aggucccaucuccaaaaacagucacauagcag

SEQ ID NO: 59664 - RNA, 32 nt, Human
aggucccaucuucacuucaagcucauuuacag

SEQ ID NO: 59665 - RNA, 32 nt, Human
aggucccauuucgugcacacucaggccagcug

SEQ ID NO: 59666 - RNA, 32 nt, Human
aggucccauuuucccccuguguuuucacgcag

SEQ ID NO: 59667 - RNA, 22 nt, Human
agguccccaccccuccccucca

SEQ ID NO: 59668 - RNA, 32 nt, Human
agguccccacuuucugcuuuccuugcccaugu

SEQ ID NO: 59669 - RNA, 32 nt, Human
agguccccagauggggagacugaggccguggc

SEQ ID NO: 59670 - RNA, 32 nt, Human
aggucccccugccuucucccacuccucacacu

SEQ ID NO: 59671 - RNA, 19 nt, Human
agguccccgccccgccacu

SEQ ID NO: 59672 - RNA, 32 nt, Human
agguccccuccacaucccagcagcccaagcuu

SEQ ID NO: 59673 - RNA, 31 nt, Human
agguccccugaucuugggccuguuucccaug

SEQ ID NO: 59674 - RNA, 32 nt, Human
agguccccugcagguuccuucuagcuggagca

SEQ ID NO: 59675 - RNA, 32 nt, Human
agguccccuggaccauccagggugcuaggggg

SEQ ID NO: 59676 - RNA, 32 nt, Human
agguccccuggcagugcugagggaccgagccc

SEQ ID NO: 59677 - RNA, 32 nt, Human
aggucccgcacuccagccucucgcugccaggg

SEQ ID NO: 59678 - RNA, 32 nt, Human
aggucccgccacugcacuccagccugggugac

SEQ ID NO: 59679 - RNA, 32 nt, Human
aggucccgucgccggugagcacgggcucccuc

SEQ ID NO: 59680 - RNA, 24 nt, Human
aggucccuacagcaagugggacag

SEQ ID NO: 59681 - RNA, 19 nt, Human
aggucccucacccugccug

SEQ ID NO: 59682 - RNA, 32 nt, Human
aggucccucccucccucugacucuuugcccag

SEQ ID NO: 59683 - RNA, 32 nt, Human
aggucccucggccuccugacugacugacugcg

SEQ ID NO: 59684 - RNA, 32 nt, Human
aggucccucugccucugcugcagacauggcgu

SEQ ID NO: 59685 - RNA, 32 nt, Human
aggucccugaguacugacggucacaggcugcc

SEQ ID NO: 59686 - RNA, 32 nt, Human
aggucccugcagcucacuguguccagcugggc

SEQ ID NO: 59687 - RNA, 32 nt, Human
aggucccugccuccuaccacucuuguuugccc

SEQ ID NO: 59688 - RNA, 21 nt, Human
aggucccugccuuaaauuuuc

SEQ ID NO: 59689 - RNA, 32 nt, Human
aggucccugcguggggaggugucacaccaggg

SEQ ID NO: 59690 - RNA, 32 nt, Human
aggucccuggugcuuccaguacugcacuuugc

SEQ ID NO: 59691 - RNA, 32 nt, Human
aggucccuuugacuucucuuggagucagucug

SEQ ID NO: 59692 - RNA, 32 nt, Human
agguccgaaagcuucguuccagagcccagcau

SEQ ID NO: 59693 - RNA, 32 nt, Human
agguccgacgcuugaccuuccugggccucaag

SEQ ID NO: 59694 - RNA, 32 nt, Human
agguccggaaggcggaggccaaucggcggcgg

SEQ ID NO: 59695 - RNA, 32 nt, Human
agguccuaaccagcugaccuugaguuaaucaa

SEQ ID NO: 59696 - RNA, 32 nt, Human
agguccuagaggagccacagcccaggggcaga

SEQ ID NO: 59697 - RNA, 27 nt, Human
agguccuaggugugaccugauaccacc

SEQ ID NO: 59698 - RNA, 32 nt, Human
agguccucacccagguuggcugugagcuccag

SEQ ID NO: 59699 - RNA, 32 nt, Human
agguccucagcaauaggguuagaaggcugcug

SEQ ID NO: 59700 - RNA, 21 nt, Human
agguccucagcccuccugccu

SEQ ID NO: 59701 - RNA, 32 nt, Human
agguccucagcccuccugccugggcuauggcu

SEQ ID NO: 59702 - RNA, 32 nt, Human
agguccuccuccuccuccuucuccucuucuuc

SEQ ID NO: 59703 - RNA, 32 nt, Human
agguccucggacaaccucucuccagcucuccg

SEQ ID NO: 59704 - RNA, 23 nt, Human
agguccucguucaggacgaugua

SEQ ID NO: 59705 - RNA, 32 nt, Human
agguccucuccccucauuuccaucucccagcc

SEQ ID NO: 59706 - RNA, 32 nt, Human
agguccucugccccaggacccccacaccaccc

SEQ ID NO: 59707 - RNA, 32 nt, Human
agguccugcccgaggcgccagcccgaggagga

SEQ ID NO: 59708 - RNA, 32 nt, Human
agguccugcccuuuuugaccagcagccaacag

SEQ ID NO: 59709 - RNA, 32 nt, Human
agguccugccuuauuuucaucucaccaugcac

SEQ ID NO: 59710 - RNA, 32 nt, Human
agguccugcgcucugggccagcgcucggccau

SEQ ID NO: 59711 - RNA, 32 nt, Human
agguccugcucccuccucggauuugauugucu

SEQ ID NO: 59712 - RNA, 32 nt, Human
agguccugcugccucucuuucacacaaugccc

SEQ ID NO: 59713 - RNA, 29 nt, Human
agguccuggcugccagcuuuccuccucug

SEQ ID NO: 59714 - RNA, 32 nt, Human
agguccugggagggacacuggaugucuuaccc

SEQ ID NO: 59715 - RNA, 32 nt, Human
agguccugggcuuucuaaagaagauuauuuuu

SEQ ID NO: 59716 - RNA, 31 nt, Human
agguccuggguggaggaagaagugguggagc

SEQ ID NO: 59717 - RNA, 31 nt, Human
agguccugguucucugggaucugcgguucaa

SEQ ID NO: 59718 - RNA, 32 nt, Human
agguccuguaugccaccagucacugcagucug

SEQ ID NO: 59719 - RNA, 31 nt, Human
agguccuguccuuaugggccugugucugguu

SEQ ID NO: 59720 - RNA, 32 nt, Human
agguccuuaccucucugacaguuacagugauc

SEQ ID NO: 59721 - RNA, 32 nt, Human
agguccuuagguccucacccucccgucuccuu

SEQ ID NO: 59722 - RNA, 32 nt, Human
agguccuuuaguuugcuucuguaagcaacggg

SEQ ID NO: 59723 - RNA, 22 nt, Human
agguccuuuauguguuguucuc

SEQ ID NO: 59724 - RNA, 32 nt, Human
agguccuuucugccaucucuguuccagcugcu

SEQ ID NO: 59725 - RNA, 32 nt, Human
agguccuuugcuccuguucccuggaggcauaa

SEQ ID NO: 59726 - RNA, 32 nt, Human
agguccuuuuggaggguggaaguuaggagcag

SEQ ID NO: 59727 - RNA, 32 nt, Human
aggucgaaacagcccuccaccucccagccaag

SEQ ID NO: 59728 - RNA, 32 nt, Human
aggucgacccuccaaguccagaugagaagagu

SEQ ID NO: 59729 - RNA, 23 nt, Human
aggucgacucgccggcgcuuccu

SEQ ID NO: 59730 - RNA, 32 nt, Human
aggucgagaagcacgaggauugcuugaggcca

SEQ ID NO: 59731 - RNA, 20 nt, Human
aggucgaggcaggcggauca

SEQ ID NO: 59732 - RNA, 32 nt, Human
aggucgaggguagauaggccuuaacuuagucc

SEQ ID NO: 59733 - RNA, 32 nt, Human
aggucgagguggggagggggaggcgggcuucc

SEQ ID NO: 59734 - RNA, 32 nt, Human
aggucgcaccacugcacuccagccugggugac

SEQ ID NO: 59735 - RNA, 32 nt, Human
aggucgcaccacugcacuccagucuggguaac

SEQ ID NO: 59736 - RNA, 32 nt, Human
aggucgcaccacugcacugcagccugggugac

SEQ ID NO: 59737 - RNA, 32 nt, Human
aggucgcaccgcuacacuccagccugggugac

SEQ ID NO: 59738 - RNA, 32 nt, Human
aggucgcaccguuguacuccagccuggugaua

SEQ ID NO: 59739 - RNA, 32 nt, Human
aggucgcagcaaauggcuucagccugggacgc

SEQ ID NO: 59740 - RNA, 32 nt, Human
aggucgcagugagccgagaucgugccacugca

SEQ ID NO: 59741 - RNA, 32 nt, Human
aggucgcaguucagcccagcugaggccugucu

SEQ ID NO: 59742 - RNA, 32 nt, Human
aggucgccacugccugcugcagagaaaacaca

SEQ ID NO: 59743 - RNA, 32 nt, Human
aggucgcgagggaagcgcugaggaucaggaag

SEQ ID NO: 59744 - RNA, 32 nt, Human
aggucgcgccacugcacuccagccugggagaa

SEQ ID NO: 59745 - RNA, 32 nt, Human
aggucgcgccacugcacuccagccugggcagc

SEQ ID NO: 59746 - RNA, 32 nt, Human
aggucgcgccacugcacuccagccugggcgac

SEQ ID NO: 59747 - RNA, 32 nt, Human
aggucgcgccacugcacuucagccugggugac

SEQ ID NO: 59748 - RNA, 32 nt, Human
aggucgcgccacugcgcuccagccuggacaac

SEQ ID NO: 59749 - RNA, 32 nt, Human
aggucgcgccauugcacuccagccugggcaac

SEQ ID NO: 59750 - RNA, 32 nt, Human
aggucgcgccauugcacuccagccugggcgac

SEQ ID NO: 59751 - RNA, 32 nt, Human
aggucgcgguaagccgagaucacaccauugca

SEQ ID NO: 59752 - RNA, 32 nt, Human
aggucgcggugagccgagaucgagccauugca

SEQ ID NO: 59753 - RNA, 32 nt, Human
aggucgcuccauugcacuccagccugggcaac

SEQ ID NO: 59754 - RNA, 32 nt, Human
aggucgcuggcgucugugccaucucugcucca

SEQ ID NO: 59755 - RNA, 32 nt, Human
aggucgcuguaaccuccgucuccuggguucaa

SEQ ID NO: 59756 - RNA, 32 nt, Human
aggucgcuguggccccagccucgccugacaga

SEQ ID NO: 59757 - RNA, 32 nt, Human
aggucggcaaagcaacauggcagagcagucau

SEQ ID NO: 59758 - RNA, 32 nt, Human
aggucggcacacacauccucauaauggcauuu

SEQ ID NO: 59759 - RNA, 32 nt, Human
aggucggcaggcagcacacagagggaccuacg

SEQ ID NO: 59760 - RNA, 32 nt, Human
aggucggcagugugaggagcugcuauggugcu

SEQ ID NO: 59761 - RNA, 32 nt, Human
aggucggcuggcagcacuggccaaggugaugg

SEQ ID NO: 59762 - RNA, 32 nt, Human
aggucgggaaggggcgcugggagaagcggggc

SEQ ID NO: 59763 - RNA, 32 nt, Human
aggucgggagcacagccgcuccccaaacccag

SEQ ID NO: 59764 - RNA, 32 nt, Human
aggucgggaggaagaagagguggagguguggu

SEQ ID NO: 59765 - RNA, 32 nt, Human
aggucgggaggcaccucuagcaugagacagug

SEQ ID NO: 59766 - RNA, 22 nt, Human
aggucgggaguuccagaccagc

SEQ ID NO: 59767 - RNA, 32 nt, Human
aggucgggaguuugagaucagccuggccaaug

SEQ ID NO: 59768 - RNA, 32 nt, Human
aggucgggccagccgccccauucuuuuaacau

SEQ ID NO: 59769 - RNA, 32 nt, Human
aggucggggaagcccucccuaagcaagacacg

SEQ ID NO: 59770 - RNA, 32 nt, Human
aggucgguggaauccugggguccuccaaaucu

SEQ ID NO: 59771 - RNA, 32 nt, Human
aggucgguuuggguuugaauucugccucuucu

SEQ ID NO: 59772 - RNA, 32 nt, Human
aggucgucaaugaugaguccucucuggucaga

SEQ ID NO: 59773 - RNA, 32 nt, Human
aggucgugccacugcacuccagccugggcaac

SEQ ID NO: 59774 - RNA, 32 nt, Human
aggucgugccacugcacuccagccugggcagc

SEQ ID NO: 59775 - RNA, 32 nt, Human
aggucgugccacugcacuccagccugggcgac

SEQ ID NO: 59776 - RNA, 32 nt, Human
aggucgugccacugcacuucagccugggugac

SEQ ID NO: 59777 - RNA, 32 nt, Human
aggucgugccacugcaugccagccugggcaac

SEQ ID NO: 59778 - RNA, 32 nt, Human
aggucgugccacugcgcuccagccugggugac

SEQ ID NO: 59779 - RNA, 32 nt, Human
aggucgugccauugcacuccagccugggugac

SEQ ID NO: 59780 - RNA, 32 nt, Human
aggucgugcuacugcacucccgccugggugac

SEQ ID NO: 59781 - RNA, 32 nt, Human
aggucgugugggccccagugcuagaucucucc

SEQ ID NO: 59782 - RNA, 32 nt, Human
aggucguuccuacuguuuuacaacagcauguc

SEQ ID NO: 59783 - RNA, 32 nt, Human
aggucuaaaaagguguuccccaucguuaaacc

SEQ ID NO: 59784 - RNA, 32 nt, Human
aggucuaaagagagaagaauccagggaacagg

SEQ ID NO: 59785 - RNA, 32 nt, Human
aggucuaccccgacucagguucugccgaugau

SEQ ID NO: 59786 - RNA, 32 nt, Human
aggucuagaaaaccagcuuguggcuaacaguc

SEQ ID NO: 59787 - RNA, 32 nt, Human
aggucuagaaaauaagccuuuggcagggaaaa

SEQ ID NO: 59788 - RNA, 32 nt, Human
aggucuagcccagccuauuuguuagggaggau

SEQ ID NO: 59789 - RNA, 32 nt, Human
aggucuaggaagagggucugcagagcagaaag

SEQ ID NO: 59790 - RNA, 32 nt, Human
aggucuaggaugugugaaguuuggaaaaauau

SEQ ID NO: 59791 - RNA, 22 nt, Human
aggucucaaaguccugaccuca

SEQ ID NO: 59792 - RNA, 32 nt, Human
aggucucaaguccuucccagcauacacacagg

SEQ ID NO: 59793 - RNA, 31 nt, Human
aggucucagagaguuaauaggaguauuuuug

SEQ ID NO: 59794 - RNA, 32 nt, Human
aggucucagcacacacuggugcagagagacau

SEQ ID NO: 59795 - RNA, 19 nt, Human
aggucucagcagggcucca

SEQ ID NO: 59796 - RNA, 32 nt, Human
aggucucagcuacucaggaggcugagaugaga

SEQ ID NO: 59797 - RNA, 32 nt, Human
aggucucagcuguucuguaggcacuuugagaa

SEQ ID NO: 59798 - RNA, 32 nt, Human
aggucucauagugagugucuucacucaagggu

SEQ ID NO: 59799 - RNA, 32 nt, Human
aggucucaucuugcaucucauccuggccugga

SEQ ID NO: 59800 - RNA, 32 nt, Human
aggucuccaaaccagacggugacgccugcggg

SEQ ID NO: 59801 - RNA, 32 nt, Human
aggucuccaagacccgccuccaugucaguguu

SEQ ID NO: 59802 - RNA, 32 nt, Human
aggucuccaauugcuuuccuccagaaagugug

SEQ ID NO: 59803 - RNA, 32 nt, Human
aggucucccacccaacuccacccgguccucug

SEQ ID NO: 59804 - RNA, 32 nt, Human
aggucuccccgagaaggagaaguucuuuaauu

SEQ ID NO: 59805 - RNA, 32 nt, Human
aggucuccgccuccucugcuucuccuuucucc

SEQ ID NO: 59806 - RNA, 32 nt, Human
aggucuccggggaggcagggguccugcagguc

SEQ ID NO: 59807 - RNA, 32 nt, Human
aggucuccuacaccgccaccaugccauucggu

SEQ ID NO: 59808 - RNA, 32 nt, Human
aggucuccuaucucucccuauccaaggcucua

SEQ ID NO: 59809 - RNA, 32 nt, Human
aggucuccuccaccauuggccguagccagcag

SEQ ID NO: 59810 - RNA, 32 nt, Human
aggucuccucuuccucucccugaagaaaccau

SEQ ID NO: 59811 - RNA, 32 nt, Human
aggucuccugcagaucugucugggcugugaug

SEQ ID NO: 59812 - RNA, 32 nt, Human
aggucuccugggaacccugucugccccuuccc

SEQ ID NO: 59813 - RNA, 31 nt, Human
aggucucgccuucacugcccuguguccucug

SEQ ID NO: 59814 - RNA, 32 nt, Human
aggucucuccacugcucucagccucccaaccc

SEQ ID NO: 59815 - RNA, 32 nt, Human
aggucucuccugcauaggcagccacuguccgu

SEQ ID NO: 59816 - RNA, 19 nt, Human
aggucucugcugaauucuc

SEQ ID NO: 59817 - RNA, 32 nt, Human
aggucucugggaacccucagaauacggcucag

SEQ ID NO: 59818 - RNA, 32 nt, Human
aggucucugggaagggcuggggcagagcaucu

SEQ ID NO: 59819 - RNA, 32 nt, Human
aggucucugguuuucucauucaugccaaugcu

SEQ ID NO: 59820 - RNA, 32 nt, Human
aggucucugugcaaauggaccaucuguuggag

SEQ ID NO: 59821 - RNA, 32 nt, Human
aggucucuucugccauugugcuggucccaucc

SEQ ID NO: 59822 - RNA, 32 nt, Human
aggucucuugugcccuguucucuuguccccac

SEQ ID NO: 59823 - RNA, 32 nt, Human
aggucugaaauggagguccuucugcuggauaa

SEQ ID NO: 59824 - RNA, 32 nt, Human
aggucugaagcugguccugggcuccgggggug

SEQ ID NO: 59825 - RNA, 19 nt, Human
aggucugacauccaagaca

SEQ ID NO: 59826 - RNA, 25 nt, Human
aggucugaccuaggguucccuccca

SEQ ID NO: 59827 - RNA, 32 nt, Human
aggucugagcagagggcggggugcaggcggaa

SEQ ID NO: 59828 - RNA, 32 nt, Human
aggucugagcccagaguugacggagggaguau

SEQ ID NO: 59829 - RNA, 32 nt, Human
aggucugaggagcagcuucaguccccgccgag

SEQ ID NO: 59830 - RNA, 32 nt, Human
aggucugauaguccucugcuaaaacaacacga

SEQ ID NO: 59831 - RNA, 32 nt, Human
aggucugaucuggguuuugccucugcccuugg

SEQ ID NO: 59832 - RNA, 32 nt, Human
aggucugaugaauggaaucugaaggggcucug

SEQ ID NO: 59833 - RNA, 32 nt, Human
aggucugaugaucacacacaaaauguaauucc

SEQ ID NO: 59834 - RNA, 32 nt, Human
aggucugaugugaaaauucaaucacgacguua

SEQ ID NO: 59835 - RNA, 32 nt, Human
aggucugauguguagcagccucuccccaucua

SEQ ID NO: 59836 - RNA, 32 nt, Human
aggucugcacacauaacacacaucaguccacc

SEQ ID NO: 59837 - RNA, 32 nt, Human
aggucugcacugcaacuucuguauccuuccuu

SEQ ID NO: 59838 - RNA, 20 nt, Human
aggucugccaagccagaagc

SEQ ID NO: 59839 - RNA, 32 nt, Human
aggucugccagcugccccggccaggcuugcgg

SEQ ID NO: 59840 - RNA, 32 nt, Human
aggucugccucccaccagacccucuccagugu

SEQ ID NO: 59841 - RNA, 32 nt, Human
aggucugccugguucccuccccaaggccacag

SEQ ID NO: 59842 - RNA, 32 nt, Human
aggucugccuguaaaugacacugugaauaaac

SEQ ID NO: 59843 - RNA, 18 nt, Human
aggucuggaaagugucca

SEQ ID NO: 59844 - RNA, 32 nt, Human
aggucuggaaggagggggcgggcagggagagg

SEQ ID NO: 59845 - RNA, 32 nt, Human
aggucuggaccaaucucccuucccagauaagc

SEQ ID NO: 59846 - RNA, 32 nt, Human
aggucuggagcagcugccucucuggggagaug

SEQ ID NO: 59847 - RNA, 32 nt, Human
aggucuggagccaggcccagagcuggcuucag

SEQ ID NO: 59848 - RNA, 32 nt, Human
aggucuggagggcugagaaugaaccugacuag

SEQ ID NO: 59849 - RNA, 24 nt, Human
aggucuggcauauacuugauuaca

SEQ ID NO: 59850 - RNA, 32 nt, Human
aggucuggcucaugccuguaaucccagcacuu

SEQ ID NO: 59851 - RNA, 32 nt, Human
aggucuggcucugccacuugccuggccauguc

SEQ ID NO: 59852 - RNA, 32 nt, Human
aggucugggagagagagcagagggcggcaggg

SEQ ID NO: 59853 - RNA, 22 nt, Human
aggucuguaagucagguuacaa

SEQ ID NO: 59854 - RNA, 32 nt, Human
aggucugugggccaaagaacagguguauauaa

SEQ ID NO: 59855 - RNA, 32 nt, Human
aggucuguuccgcaugaaacuccugcugggga

SEQ ID NO: 59856 - RNA, 32 nt, Human
aggucuguugacugagacuggccggccugugg

SEQ ID NO: 59857 - RNA, 32 nt, Human
aggucuguuuccccaucacuuucaguuugcac

SEQ ID NO: 59858 - RNA, 32 nt, Human
aggucuguuuuuccuuucaugccucuuaaaaa

SEQ ID NO: 59859 - RNA, 32 nt, Human
aggucuuacauucagucagaccuguucaauaa

SEQ ID NO: 59860 - RNA, 31 nt, Human
aggucuucaauaaauauuuaauggaagguuc

SEQ ID NO: 59861 - RNA, 32 nt, Human
aggucuucaaucagaaacaaaaggacauuaau

SEQ ID NO: 59862 - RNA, 32 nt, Human
aggucuucaguaucucuggcacuggcaauaca

SEQ ID NO: 59863 - RNA, 32 nt, Human
aggucuucccagaggcuggauaccacaguaaa

SEQ ID NO: 59864 - RNA, 32 nt, Human
aggucuucccauaggccugcaguagggcuguu

SEQ ID NO: 59865 - RNA, 17 nt, Human
aggucuucccccagagg

SEQ ID NO: 59866 - RNA, 32 nt, Human
aggucuucccuugagccacuggcgcccaggag

SEQ ID NO: 59867 - RNA, 32 nt, Human
aggucuuccugggggauuucagucuccacaua

SEQ ID NO: 59868 - RNA, 32 nt, Human
aggucuuccuguggcucccucucuccuggacu

SEQ ID NO: 59869 - RNA, 32 nt, Human
aggucuuccuguuuucaccaucuuucuaaucu

SEQ ID NO: 59870 - RNA, 32 nt, Human
aggucuucuccuccucuccaucccuauucccu

SEQ ID NO: 59871 - RNA, 32 nt, Human
aggucuucucuccuccccuccugcagaggcac

SEQ ID NO: 59872 - RNA, 32 nt, Human
aggucuugagaggugugcuggggaagguggca

SEQ ID NO: 59873 - RNA, 19 nt, Human
aggucuugagucccccacc

SEQ ID NO: 59874 - RNA, 32 nt, Human
aggucuuggagccucccuucugcucccagaag

SEQ ID NO: 59875 - RNA, 32 nt, Human
aggucuuggccaagaaauguagaccuuucccc

SEQ ID NO: 59876 - RNA, 32 nt, Human
aggucuugguucucccaggagcucagggccug

SEQ ID NO: 59877 - RNA, 32 nt, Human
aggucuuguuugcccagacucuguacauuucc

SEQ ID NO: 59878 - RNA, 32 nt, Human
aggucuuuagaauaugcucuagccaagucuaa

SEQ ID NO: 59879 - RNA, 32 nt, Human
aggucuuuccacccucuuugagaucagcguuc

SEQ ID NO: 59880 - RNA, 32 nt, Human
aggucuuuccuaaggcugcaagguuuaggcug

SEQ ID NO: 59881 - RNA, 32 nt, Human
aggucuuuccucaccccucucccaccgcuguc

SEQ ID NO: 59882 - RNA, 32 nt, Human
aggucuuuccucugcucugcugcccagcggcc

SEQ ID NO: 59883 - RNA, 32 nt, Human
aggucuuucucuucucaucaagcuccucuccu

SEQ ID NO: 59884 - RNA, 32 nt, Human
aggucuuugccugcucacccucccagaugcua

SEQ ID NO: 59885 - RNA, 32 nt, Human
aggucuuuugcaacugugccucccucugucug

SEQ ID NO: 59886 - RNA, 32 nt, Human
aggucuuuuucagugugcucaauauggucacc

SEQ ID NO: 59887 - RNA, 32 nt, Human
aggugaaaagccagauccugaccaaacauuua

SEQ ID NO: 59888 - RNA, 32 nt, Human
aggugaaacagacgagaccacugugagccaga

SEQ ID NO: 59889 - RNA, 22 nt, Human
aggugaaaccccaucucuacua

SEQ ID NO: 59890 - RNA, 31 nt, Human
aggugaaaggacuugccucagcugcucggcg

SEQ ID NO: 59891 - RNA, 22 nt, Human
aggugaaaggauugcuugagcc

SEQ ID NO: 59892 - RNA, 32 nt, Human
aggugaaagggcugccgugcagccaggcagag

SEQ ID NO: 59893 - RNA, 31 nt, Human
aggugaaaguccuccccuugccggaggccag

SEQ ID NO: 59894 - RNA, 32 nt, Human
aggugaaaugauuagacccugcccccaaacca

SEQ ID NO: 59895 - RNA, 32 nt, Human
aggugaaaugcacaagcugcuggagaaggggu

SEQ ID NO: 59896 - RNA, 32 nt, Human
aggugaacaaacagcuaacugcaucagcaaau

SEQ ID NO: 59897 - RNA, 32 nt, Human
aggugaacagguccucacgcccagcuccgccc

SEQ ID NO: 59898 - RNA, 32 nt, Human
aggugaacccaaaagaaaaacucuugaaaaca

SEQ ID NO: 59899 - RNA, 32 nt, Human
aggugaacuaugaccacuuuacucuggguuuu

SEQ ID NO: 59900 - RNA, 23 nt, Human
aggugaacucugccaggaagcag

SEQ ID NO: 59901 - RNA, 32 nt, Human
aggugaacugcaggaagaucccagcccuauac

SEQ ID NO: 59902 - RNA, 32 nt, Human
aggugaagaccaccagcuucuuugagaaacag

SEQ ID NO: 59903 - RNA, 32 nt, Human
aggugaagagcaucgggggcugagggauggaa

SEQ ID NO: 59904 - RNA, 32 nt, Human
aggugaagagccagaagugaagagugacuagu

SEQ ID NO: 59905 - RNA, 32 nt, Human
aggugaagaugugauuucuuccauccagaaag

SEQ ID NO: 59906 - RNA, 22 nt, Human
aggugaagcucacggggccagg

SEQ ID NO: 59907 - RNA, 32 nt, Human
aggugaaggaagagagacuuuaggcaagcagc

SEQ ID NO: 59908 - RNA, 32 nt, Human
aggugaaggaagaggaugagcuccagcagccu

SEQ ID NO: 59909 - RNA, 32 nt, Human
aggugaaggagacggaaaccuccaccccaucc

SEQ ID NO: 59910 - RNA, 32 nt, Human
aggugaaggaggucagaaagagauagaauuug

SEQ ID NO: 59911 - RNA, 32 nt, Human
aggugaaggauacucccuucuuucauacagaa

SEQ ID NO: 59912 - RNA, 32 nt, Human
aggugaaggcagcaggggccauggccgggagc

SEQ ID NO: 59913 - RNA, 32 nt, Human
aggugaaggcucaaggguggauccagcucgag

SEQ ID NO: 59914 - RNA, 32 nt, Human
aggugaaggugucugcagcacacacagugaga

SEQ ID NO: 59915 - RNA, 32 nt, Human
aggugaaguauucaggcugaucuggaacucug

SEQ ID NO: 59916 - RNA, 32 nt, Human
aggugacaaaggaaugagugaaugaguaagga

SEQ ID NO: 59917 - RNA, 32 nt, Human
aggugacaaagugagaccccaucucuacaaaa

SEQ ID NO: 59918 - RNA, 32 nt, Human
aggugacaauauacacaugugcgcuaaucgua

SEQ ID NO: 59919 - RNA, 21 nt, Human
aggugacagaaccuuucugga

SEQ ID NO: 59920 - RNA, 21 nt, Human
aggugacagagcagugcugga

SEQ ID NO: 59921 - RNA, 32 nt, Human
aggugacagcagguaaagagugagccacaauc

SEQ ID NO: 59922 - RNA, 32 nt, Human
aggugacaggagcuuuccaaagacaccuaggg

SEQ ID NO: 59923 - RNA, 32 nt, Human
aggugacaggaucagguuuccaugcagcauuu

SEQ ID NO: 59924 - RNA, 32 nt, Human
aggugacaggcuguuggcuggaauugcuuggu

SEQ ID NO: 59925 - RNA, 21 nt, Human
aggugacagugagguccuggg

SEQ ID NO: 59926 - RNA, 32 nt, Human
aggugacauagugagaccccaucucuacaaaa

SEQ ID NO: 59927 - RNA, 31 nt, Human
aggugacaucauaaauacuugcugaaugaau

SEQ ID NO: 59928 - RNA, 32 nt, Human
aggugacaucgccgggggagguugugggcaac

SEQ ID NO: 59929 - RNA, 23 nt, Human
aggugacaugacacagggucagg

SEQ ID NO: 59930 - RNA, 32 nt, Human
aggugaccaaaaagaccacacugcaugaccag

SEQ ID NO: 59931 - RNA, 32 nt, Human
aggugaccaagaugucaugccagaucccucag

SEQ ID NO: 59932 - RNA, 32 nt, Human
aggugaccaggccacguggaggagagucaagg

SEQ ID NO: 59933 - RNA, 32 nt, Human
aggugacccacacucuggacagucugggacau

SEQ ID NO: 59934 - RNA, 32 nt, Human
aggugacccaggagagaagggaugaaggccuu

SEQ ID NO: 59935 - RNA, 32 nt, Human
aggugacccugacagugcuuaaugaccucaga

SEQ ID NO: 59936 - RNA, 32 nt, Human
aggugacccugccuggccucccacacccccug

SEQ ID NO: 59937 - RNA, 32 nt, Human
aggugaccugaacagcagaaauuuauuuucuu

SEQ ID NO: 59938 - RNA, 32 nt, Human
aggugaccugcucucuuuccugggcccugccc

SEQ ID NO: 59939 - RNA, 24 nt, Human
aggugaccuugcaacuucauguca

SEQ ID NO: 59940 - RNA, 32 nt, Human
aggugacgccggaagagaagccagcaggcggc

SEQ ID NO: 59941 - RNA, 22 nt, Human
aggugacggacagaggccugga

SEQ ID NO: 59942 - RNA, 32 nt, Human
aggugacuaagggcuggcagaagauuagaaug

SEQ ID NO: 59943 - RNA, 21 nt, Human
aggugacuccgaguccagccc

SEQ ID NO: 59944 - RNA, 32 nt, Human
aggugacugcacugcagcccacauggagagcu

SEQ ID NO: 59945 - RNA, 32 nt, Human
aggugacugcauccuccagcaucucaacuccg

SEQ ID NO: 59946 - RNA, 32 nt, Human
aggugacuggggacuuggaacccuaggaccug

SEQ ID NO: 59947 - RNA, 32 nt, Human
aggugagaaagagaauggagaguuuugcuaca

SEQ ID NO: 59948 - RNA, 32 nt, Human
aggugagaaccagcuugucauuuucagggaau

SEQ ID NO: 59949 - RNA, 32 nt, Human
aggugagaagcagaggaaggagaggagagggg

SEQ ID NO: 59950 - RNA, 32 nt, Human
aggugagaaguuaaaccugagacagagagcaa

SEQ ID NO: 59951 - RNA, 32 nt, Human
aggugagacauauucuccauaaagcuacugua

SEQ ID NO: 59952 - RNA, 32 nt, Human
aggugagacuacagguacaugccacugugccu

SEQ ID NO: 59953 - RNA, 32 nt, Human
aggugagacuccaucugcccugggcagguucc

SEQ ID NO: 59954 - RNA, 31 nt, Human
aggugagagaggaugugugcugggccuugga

SEQ ID NO: 59955 - RNA, 32 nt, Human
aggugagaggagaaguuggagggugugaugau

SEQ ID NO: 59956 - RNA, 24 nt, Human
aggugagaggauugcccgaaccca

SEQ ID NO: 59957 - RNA, 23 nt, Human
aggugagaggauugcuugaggcc

SEQ ID NO: 59958 - RNA, 32 nt, Human
aggugagcacugcccugggcucuggcugguuc

SEQ ID NO: 59959 - RNA, 32 nt, Human
aggugagcagaggaguccagggcgggaguggg

SEQ ID NO: 59960 - RNA, 32 nt, Human
aggugagcagaggcacuggugugccugccagg

SEQ ID NO: 59961 - RNA, 26 nt, Human
aggugagcagaucaccugaggucagg

SEQ ID NO: 59962 - RNA, 26 nt, Human
aggugagcagaucaccugagguuagg

SEQ ID NO: 59963 - RNA, 32 nt, Human
aggugagcagaugccagcaccauguuuccugu

SEQ ID NO: 59964 - RNA, 24 nt, Human
aggugagcagguugcuugagccca

SEQ ID NO: 59965 - RNA, 32 nt, Human
aggugagcauguugaguuggggagcagcagga

SEQ ID NO: 59966 - RNA, 32 nt, Human
aggugagccgggcaaggcugccuccaguccua

SEQ ID NO: 59967 - RNA, 24 nt, Human
aggugagcggaucacaaggucagg

SEQ ID NO: 59968 - RNA, 26 nt, Human
aggugagcggaucaccugaggucagg

SEQ ID NO: 59969 - RNA, 32 nt, Human
aggugagcuauggugcugcaccuacugcucuu

SEQ ID NO: 59970 - RNA, 32 nt, Human
aggugagcuccuggaggccacggggacagaga

SEQ ID NO: 59971 - RNA, 32 nt, Human
aggugagcucucugacggucaggugccuuccc

SEQ ID NO: 59972 - RNA, 32 nt, Human
aggugagcugagagcugagauugcaccacugc

SEQ ID NO: 59973 - RNA, 32 nt, Human
aggugagcugccucugccccugggcaaggaag

SEQ ID NO: 59974 - RNA, 32 nt, Human
aggugagcuguguccucuaggcugccagcuca

SEQ ID NO: 59975 - RNA, 32 nt, Human
aggugaggaaacugagcccagugaaguuaaau

SEQ ID NO: 59976 - RNA, 32 nt, Human
aggugaggaauuuuaaauuggaacaagagcaa

SEQ ID NO: 59977 - RNA, 32 nt, Human
aggugaggagagaagcaucugggggcacucca

SEQ ID NO: 59978 - RNA, 32 nt, Human
aggugaggagagaaggggacacucgaguccag

SEQ ID NO: 59979 - RNA, 18 nt, Human
aggugaggagaggucagg

SEQ ID NO: 59980 - RNA, 32 nt, Human
aggugaggcaggacaggaugggggaggagggc

SEQ ID NO: 59981 - RNA, 23 nt, Human
aggugaggcccaaugaggucagg

SEQ ID NO: 59982 - RNA, 32 nt, Human
aggugagggaaacugcugguucugcuggugcc

SEQ ID NO: 59983 - RNA, 32 nt, Human
aggugagggcccugcccuggaagacuggaggg

SEQ ID NO: 59984 - RNA, 32 nt, Human
aggugagggugggaggcagaaaagaggcacag

SEQ ID NO: 59985 - RNA, 32 nt, Human
aggugaggucucucuaagucaggcugggguug

SEQ ID NO: 59986 - RNA, 32 nt, Human
aggugaggugcgucugugccacccuugucagg

SEQ ID NO: 59987 - RNA, 32 nt, Human
aggugaggugggagguuggagagccaggugag

SEQ ID NO: 59988 - RNA, 21 nt, Human
aggugagguuucaccauguug

SEQ ID NO: 59989 - RNA, 32 nt, Human
aggugaguaauuuaauuuuguucagucagauu

SEQ ID NO: 59990 - RNA, 32 nt, Human
aggugaguccuccagagcuuccuggccgggcc

SEQ ID NO: 59991 - RNA, 23 nt, Human
aggugaguggagcagagguccug

SEQ ID NO: 59992 - RNA, 25 nt, Human
aggugaguggaucaccugaggucag

SEQ ID NO: 59993 - RNA, 26 nt, Human
aggugaguggaucaccugaggucagg

SEQ ID NO: 59994 - RNA, 24 nt, Human
aggugaguggaucacgaggucagg

SEQ ID NO: 59995 - RNA, 24 nt, Human
aggugaguggauuacaaggucagg

SEQ ID NO: 59996 - RNA, 32 nt, Human
aggugaguuccagauguggagcaacuugggcu

SEQ ID NO: 59997 - RNA, 32 nt, Human
aggugauaaacaaugcuuuuugugcacuacau

SEQ ID NO: 59998 - RNA, 32 nt, Human
aggugauaaauuuuucuuuaauuccuuugguu

SEQ ID NO: 59999 - RNA, 32 nt, Human
aggugauaagccugcaugugucuggacaccaa

SEQ ID NO: 60000 - RNA, 32 nt, Human
aggugaucaugcugcaaguucuuucuggaccu

SEQ ID NO: 60001 - RNA, 18 nt, Human
aggugauccacccaccuc

SEQ ID NO: 60002 - RNA, 32 nt, Human
aggugaucccgacccucaccagucccauuugc

SEQ ID NO: 60003 - RNA, 32 nt, Human
aggugauccgcccgccuccaccucccagggug

SEQ ID NO: 60004 - RNA, 32 nt, Human
aggugauccucccaucucagccugccuccgag

SEQ ID NO: 60005 - RNA, 32 nt, Human
aggugaucuacccgccuccaccucccaaagug

SEQ ID NO: 60006 - RNA, 32 nt, Human
aggugaugaagacacagaacaggcucagucag

SEQ ID NO: 60007 - RNA, 22 nt, Human
aggugaugcagcagcaggggca

SEQ ID NO: 60008 - RNA, 31 nt, Human
aggugaugcauucucccuuaugcagggacau

SEQ ID NO: 60009 - RNA, 32 nt, Human
aggugaugcccaaggcacagggcugcagaaaa

SEQ ID NO: 60010 - RNA, 32 nt, Human
aggugauggggcugggcugagccagggaggaa

SEQ ID NO: 60011 - RNA, 30 nt, Human
aggugaugguuauccuggaacuggagauua

SEQ ID NO: 60012 - RNA, 32 nt, Human
aggugaugugauucaaaagaugccauucauag

SEQ ID NO: 60013 - RNA, 32 nt, Human
aggugauucgggcagccagggacaggagccac

SEQ ID NO: 60014 - RNA, 32 nt, Human
aggugauugauaagguuuucccagggaucucu

SEQ ID NO: 60015 - RNA, 32 nt, Human
aggugauuguguguuuuacacauugcugcauu

SEQ ID NO: 60016 - RNA, 32 nt, Human
aggugcaaacuauuuauccaucuggaaauaag

SEQ ID NO: 60017 - RNA, 32 nt, Human
aggugcaaagaggcagaucuuugcugccagcc

SEQ ID NO: 60018 - RNA, 32 nt, Human
aggugcaaucauagcucacugcagccucaaac

SEQ ID NO: 60019 - RNA, 32 nt, Human
aggugcaauggaagacacuacgcuacuugguu

SEQ ID NO: 60020 - RNA, 32 nt, Human
aggugcacagagaguccucagagcacaagcgu

SEQ ID NO: 60021 - RNA, 32 nt, Human
aggugcacaucacauucccuuguccacacugc

SEQ ID NO: 60022 - RNA, 32 nt, Human
aggugcaccacugccgucauuucagcuucugg

SEQ ID NO: 60023 - RNA, 32 nt, Human
aggugcaccacugggcuccuggguagugugug

SEQ ID NO: 60024 - RNA, 32 nt, Human
aggugcacugaggagaugaaggccgggacccc

SEQ ID NO: 60025 - RNA, 32 nt, Human
aggugcagacugccccgugcucuggcuugcag

SEQ ID NO: 60026 - RNA, 32 nt, Human
aggugcagagacgugggagacagugaaaggcu

SEQ ID NO: 60027 - RNA, 32 nt, Human
aggugcagaucagcauagaucugugauucaga

SEQ ID NO: 60028 - RNA, 32 nt, Human
aggugcagcauggacugaguucuugacaacag

SEQ ID NO: 60029 - RNA, 19 nt, Human
aggugcagccggcaggcca

SEQ ID NO: 60030 - RNA, 32 nt, Human
aggugcagccuccuuaucuaucucuuugcacu

SEQ ID NO: 60031 - RNA, 32 nt, Human
aggugcagccuggacaacaugaugagaucccc

SEQ ID NO: 60032 - RNA, 32 nt, Human
aggugcagccuggcaugggggagcguggaggc

SEQ ID NO: 60033 - RNA, 32 nt, Human
aggugcagcucagugauccucucagauuccgc

SEQ ID NO: 60034 - RNA, 32 nt, Human
aggugcagcuccagcagcaauggcagugacgg

SEQ ID NO: 60035 - RNA, 32 nt, Human
aggugcagcugcagcaguguucuaccggaagu

SEQ ID NO: 60036 - RNA, 32 nt, Human
aggugcagcuucgaggcccacagucugcgacc

SEQ ID NO: 60037 - RNA, 32 nt, Human
aggugcaggaggaacucuggaagcacugcucu

SEQ ID NO: 60038 - RNA, 32 nt, Human
aggugcagggagcaggcgagggaaggauccgu

SEQ ID NO: 60039 - RNA, 32 nt, Human
aggugcagggcaaaggucagauucugaauaua

SEQ ID NO: 60040 - RNA, 32 nt, Human
aggugcagucacucacaccugcuugcgcucac

SEQ ID NO: 60041 - RNA, 32 nt, Human
aggugcauauguauacauacacacacauauau

SEQ ID NO: 60042 - RNA, 32 nt, Human
aggugcauguguucccuaggagcucaacagga

SEQ ID NO: 60043 - RNA, 23 nt, Human
aggugcauugcagggaccaguga

SEQ ID NO: 60044 - RNA, 32 nt, Human
aggugcauuucacagcacucugggcgaaaauu

SEQ ID NO: 60045 - RNA, 32 nt, Human
aggugcauuugguccuuuccauggccaggaag

SEQ ID NO: 60046 - RNA, 32 nt, Human
aggugccaaggagccaaacagauggcuuucca

SEQ ID NO: 60047 - RNA, 32 nt, Human
aggugccaaucuccagucccaggaucccccag

SEQ ID NO: 60048 - RNA, 32 nt, Human
aggugccacagcccuggggagccagacaggcu

SEQ ID NO: 60049 - RNA, 32 nt, Human
aggugccacuguaguccggccugggcaacaga

SEQ ID NO: 60050 - RNA, 32 nt, Human
aggugccaggcuguaagcauucugagcugggc

SEQ ID NO: 60051 - RNA, 32 nt, Human
aggugccaucagcaggaggcacugugaagcac

SEQ ID NO: 60052 - RNA, 20 nt, Human
aggugccaugccugcucccu

SEQ ID NO: 60053 - RNA, 32 nt, Human
aggugcccaaagagguuauagugaaguuaacc

SEQ ID NO: 60054 - RNA, 32 nt, Human
aggugcccaacacccauucaucucaagugcuu

SEQ ID NO: 60055 - RNA, 32 nt, Human
aggugcccaagaggagaggaaugggaagagug

SEQ ID NO: 60056 - RNA, 20 nt, Human
aggugcccaccugcccggag

SEQ ID NO: 60057 - RNA, 20 nt, Human
aggugcccagcuauaccugu

SEQ ID NO: 60058 - RNA, 32 nt, Human
aggugcccccuucucgccucucuucucuucuc

SEQ ID NO: 60059 - RNA, 32 nt, Human
aggugccccugccuggagcacagggucccacg

SEQ ID NO: 60060 - RNA, 32 nt, Human
aggugccccuuccugaggguguugggggaugg

SEQ ID NO: 60061 - RNA, 32 nt, Human
aggugcccgacuccagccaugcuggcgcuacu

SEQ ID NO: 60062 - RNA, 32 nt, Human
aggugcccguguccuaugcacacaccgucaag

SEQ ID NO: 60063 - RNA, 32 nt, Human
aggugcccuccuggccugggacugcuguggca

SEQ ID NO: 60064 - RNA, 32 nt, Human
aggugcccuuggagugccacacaugcccagac

SEQ ID NO: 60065 - RNA, 32 nt, Human
aggugccgcggaucuugagaaggaggcguggc

SEQ ID NO: 60066 - RNA, 32 nt, Human
aggugccggacccggaugcggggccagaugga

SEQ ID NO: 60067 - RNA, 32 nt, Human
aggugccggggaggggcagagaggaagugguc

SEQ ID NO: 60068 - RNA, 32 nt, Human
aggugccguuauuuuccuccccucuugcucag

SEQ ID NO: 60069 - RNA, 32 nt, Human
aggugccguugcagcaguuggaugugaggcca

SEQ ID NO: 60070 - RNA, 32 nt, Human
aggugccuauaaucccagcuacuccagaggcu

SEQ ID NO: 60071 - RNA, 32 nt, Human
aggugccuccacacagccccucuccccgacca

SEQ ID NO: 60072 - RNA, 32 nt, Human
aggugccuccugacacaccugcagccucccuc

SEQ ID NO: 60073 - RNA, 32 nt, Human
aggugccucucuggcccuccacugacuguacc

SEQ ID NO: 60074 - RNA, 32 nt, Human
aggugccucugccucucgacuugcacccuggu

SEQ ID NO: 60075 - RNA, 22 nt, Human
aggugccucuguucuuugugga

SEQ ID NO: 60076 - RNA, 32 nt, Human
aggugccugagugugugggccugcugccugca

SEQ ID NO: 60077 - RNA, 32 nt, Human
aggugccugcagcgcucggcacugugggcaga

SEQ ID NO: 60078 - RNA, 32 nt, Human
aggugccugcagcuccuggcuauguccugcuu

SEQ ID NO: 60079 - RNA, 32 nt, Human
aggugccugcauuuccagccucguggcucacc

SEQ ID NO: 60080 - RNA, 32 nt, Human
aggugccugcugcugcuguauacacuugagug

SEQ ID NO: 60081 - RNA, 32 nt, Human
aggugccuggccaggcccaccugcugcagaug

SEQ ID NO: 60082 - RNA, 32 nt, Human
aggugccugggaggaguggcccugauccagga

SEQ ID NO: 60083 - RNA, 32 nt, Human
aggugccugggagggcugcugcaguggggucu

SEQ ID NO: 60084 - RNA, 32 nt, Human
aggugccugggcacagaugucuguucagcagg

SEQ ID NO: 60085 - RNA, 32 nt, Human
aggugccuguaaucacagcuacucgggaggcu

SEQ ID NO: 60086 - RNA, 32 nt, Human
aggugccuguaaucccaacuacucaggaggcu

SEQ ID NO: 60087 - RNA, 32 nt, Human
aggugccuguaaucccagcacuuugggaagcc

SEQ ID NO: 60088 - RNA, 32 nt, Human
aggugccuguaaucccagcuacucaggaggcu

SEQ ID NO: 60089 - RNA, 32 nt, Human
aggugccuguaaucccagcuacucagggggcu

SEQ ID NO: 60090 - RNA, 32 nt, Human
aggugccuguaaucccagcuacucgggaggcu

SEQ ID NO: 60091 - RNA, 32 nt, Human
aggugccuguaaucccagcuacucgguaggcu

SEQ ID NO: 60092 - RNA, 32 nt, Human
aggugccuguaaucccagcuacucugucucaa

SEQ ID NO: 60093 - RNA, 32 nt, Human
aggugccuguaaucccagcuacuggggaaagc

SEQ ID NO: 60094 - RNA, 32 nt, Human
aggugccuguaaucccagcuacuugagagucu

SEQ ID NO: 60095 - RNA, 32 nt, Human
aggugccuguaaucccagcuacuugggagacu

SEQ ID NO: 60096 - RNA, 32 nt, Human
aggugccuguaaucccagcuacuugggaggcc

SEQ ID NO: 60097 - RNA, 32 nt, Human
aggugccuguaaucccagcuacuugggaggcu

SEQ ID NO: 60098 - RNA, 32 nt, Human
aggugccuguaaucccauguacucuggaggcu

SEQ ID NO: 60099 - RNA, 32 nt, Human
aggugccuguaaucccggcuauucagaaggcc

SEQ ID NO: 60100 - RNA, 32 nt, Human
aggugccuguaauccuagcuacuuggcaggcu

SEQ ID NO: 60101 - RNA, 32 nt, Human
aggugccuguagucccagcuacucggcaggcu

SEQ ID NO: 60102 - RNA, 32 nt, Human
aggugccuguagucccagcuacucgggaagcu

SEQ ID NO: 60103 - RNA, 32 nt, Human
aggugccuguagucccagcuacucgggaggcu

SEQ ID NO: 60104 - RNA, 32 nt, Human
aggugccuguagucccagcuacucuggaggcu

SEQ ID NO: 60105 - RNA, 32 nt, Human
aggugccuguagucccagcuacuugggacacc

SEQ ID NO: 60106 - RNA, 32 nt, Human
aggugccuguagucccagcuacuugggaggcu

SEQ ID NO: 60107 - RNA, 32 nt, Human
aggugccuguagucccagcuagucgggaggcu

SEQ ID NO: 60108 - RNA, 32 nt, Human
aggugccuguagucucagcuacucaggaggcu

SEQ ID NO: 60109 - RNA, 22 nt, Human
aggugccuguaucauuggcaca

SEQ ID NO: 60110 - RNA, 32 nt, Human
aggugccuguggucccagcugcucgggaggcu

SEQ ID NO: 60111 - RNA, 32 nt, Human
aggugccuguguuuggccgaggccugugugau

SEQ ID NO: 60112 - RNA, 32 nt, Human
aggugccuuccucugcugaagccuuaccuccu

SEQ ID NO: 60113 - RNA, 32 nt, Human
aggugccuuucuuguaccucagcacuccuggg

SEQ ID NO: 60114 - RNA, 32 nt, Human
aggugcgagccaccggguccagccucucaggc

SEQ ID NO: 60115 - RNA, 22 nt, Human
aggugcgagccaccgugcccgg

SEQ ID NO: 60116 - RNA, 32 nt, Human
aggugcgcccuccacccgcugggcuaggcugg

SEQ ID NO: 60117 - RNA, 32 nt, Human
aggugcggcucuauccccaacucugugucaca

SEQ ID NO: 60118 - RNA, 32 nt, Human
aggugcggcugcaggccguuguuggucgagcu

SEQ ID NO: 60119 - RNA, 21 nt, Human
aggugcggcugcugcggcugc

SEQ ID NO: 60120 - RNA, 32 nt, Human
aggugcgggaccaucugaugugaugugaauac

SEQ ID NO: 60121 - RNA, 18 nt, Human
aggugcggggccucaggg

SEQ ID NO: 60122 - RNA, 32 nt, Human
aggugcuaccuggccuuccugccaggagcucu

SEQ ID NO: 60123 - RNA, 32 nt, Human
aggugcuagaagccaggcccaggaagguuccu

SEQ ID NO: 60124 - RNA, 24 nt, Human
aggugcuaggauuacaggcaugag

SEQ ID NO: 60125 - RNA, 32 nt, Human
aggugcuaggauuacaggcaugagccaccgca

SEQ ID NO: 60126 - RNA, 32 nt, Human
aggugcuaguacaucauucaugaucaccuuaa

SEQ ID NO: 60127 - RNA, 32 nt, Human
aggugcuaucuagaccugaaguagcgggaaga

SEQ ID NO: 60128 - RNA, 32 nt, Human
aggugcucaaaaacaaaugccuucagaggcca

SEQ ID NO: 60129 - RNA, 28 nt, Human
aggugcucaauaaagacuuguugaauga

SEQ ID NO: 60130 - RNA, 31 nt, Human
aggugcucaauaaauguugaaaccaacugaa

SEQ ID NO: 60131 - RNA, 32 nt, Human
aggugcucagccagugcgcacaggaagggcug

SEQ ID NO: 60132 - RNA, 32 nt, Human
aggugcucaguggaggccaggaaggccuugag

SEQ ID NO: 60133 - RNA, 32 nt, Human
aggugcucuccucccugccaccaugcucauca

SEQ ID NO: 60134 - RNA, 32 nt, Human
aggugcucuccuccuuucucagccauggcccc

SEQ ID NO: 60135 - RNA, 32 nt, Human
aggugcucugugagaagugcaagagcacgcug

SEQ ID NO: 60136 - RNA, 32 nt, Human
aggugcugaagaugugugucagccugaggcuu

SEQ ID NO: 60137 - RNA, 32 nt, Human
aggugcugagagaggugaccugccggaguaag

SEQ ID NO: 60138 - RNA, 32 nt, Human
aggugcugagaggggagggagacucugcggcc

SEQ ID NO: 60139 - RNA, 32 nt, Human
aggugcugagauuacaggccugaaccaccaca

SEQ ID NO: 60140 - RNA, 32 nt, Human
aggugcugagauuacaggcgugagccaccgug

SEQ ID NO: 60141 - RNA, 32 nt, Human
aggugcugagauuacauguaugagccacugca

SEQ ID NO: 60142 - RNA, 32 nt, Human
aggugcugagcgaguauccacaagcacagacc

SEQ ID NO: 60143 - RNA, 32 nt, Human
aggugcugauaguacaggcaugaaccacugug

SEQ ID NO: 60144 - RNA, 32 nt, Human
aggugcugcacaggagcccaagcacaagagca

SEQ ID NO: 60145 - RNA, 31 nt, Human
aggugcugccucucccugauccuggaucuga

SEQ ID NO: 60146 - RNA, 32 nt, Human
aggugcugccucucccugauccuggaucugag

SEQ ID NO: 60147 - RNA, 32 nt, Human
aggugcugcggcuugugagaaaaggcccacaa

SEQ ID NO: 60148 - RNA, 32 nt, Human
aggugcugcucagcagaggauaugggugggag

SEQ ID NO: 60149 - RNA, 32 nt, Human
aggugcugcugaggacauggaugaggauaucu

SEQ ID NO: 60150 - RNA, 32 nt, Human
aggugcugcugccucugagcccucccugcuaa

SEQ ID NO: 60151 - RNA, 32 nt, Human
aggugcuggaagguauuggcuccuuguuuugg

SEQ ID NO: 60152 - RNA, 24 nt, Human
aggugcuggaauuacaggcgugag

SEQ ID NO: 60153 - RNA, 24 nt, Human
aggugcuggaauuacaggugugag

SEQ ID NO: 60154 - RNA, 23 nt, Human
aggugcuggauuacaggcaugag

SEQ ID NO: 60155 - RNA, 32 nt, Human
aggugcuggauuacaggcaugagccaccucgc

SEQ ID NO: 60156 - RNA, 20 nt, Human
aggugcuggauuacaggugu

SEQ ID NO: 60157 - RNA, 32 nt, Human
aggugcuggcacuauuuucacuccaggaaagc

SEQ ID NO: 60158 - RNA, 32 nt, Human
aggugcuggcaggcaggcagggccaggagggu

SEQ ID NO: 60159 - RNA, 32 nt, Human
aggugcuggcaugauggagguggugcaccuug

SEQ ID NO: 60160 - RNA, 24 nt, Human
aggugcugggacuacaggcguggg

SEQ ID NO: 60161 - RNA, 32 nt, Human
aggugcugggagcguccucuucagcgucuuuu

SEQ ID NO: 60162 - RNA, 24 nt, Human
aggugcugggauuacaagcgugag

SEQ ID NO: 60163 - RNA, 24 nt, Human
aggugcugggauuacaggcacgag

SEQ ID NO: 60164 - RNA, 32 nt, Human
aggugcugggauuacaggcacgagccacugug

SEQ ID NO: 60165 - RNA, 32 nt, Human
aggugcugggauuacaggcauaagcuaccacg

SEQ ID NO: 60166 - RNA, 24 nt, Human
aggugcugggauuacaggcaugag

SEQ ID NO: 60167 - RNA, 32 nt, Human
aggugcugggauuacaggcaugagccaccgug

SEQ ID NO: 60168 - RNA, 32 nt, Human
aggugcugggauuacaggcaugagggaccaag

SEQ ID NO: 60169 - RNA, 24 nt, Human
aggugcugggauuacaggugugag

SEQ ID NO: 60170 - RNA, 32 nt, Human
aggugcugggauuacaggugugagccaccaca

SEQ ID NO: 60171 - RNA, 32 nt, Human
aggugcugggauuacaggugugcugcacagag

SEQ ID NO: 60172 - RNA, 21 nt, Human
aggugcugggauuauaggcgu

SEQ ID NO: 60173 - RNA, 24 nt, Human
aggugcugggauugcagacgugag

SEQ ID NO: 60174 - RNA, 24 nt, Human
aggugcugggauugcaggcgugag

SEQ ID NO: 60175 - RNA, 32 nt, Human
aggugcugggggcaccugcacacucacagcug

SEQ ID NO: 60176 - RNA, 32 nt, Human
aggugcuguuaucucguaccuccugggauggc

SEQ ID NO: 60177 - RNA, 31 nt, Human
aggugcuuaaagggacauuguaggagguacu

SEQ ID NO: 60178 - RNA, 22 nt, Human
aggugcuuacaucccaggggcc

SEQ ID NO: 60179 - RNA, 32 nt, Human
aggugcuuauaaucccagcuacucugggggcc

SEQ ID NO: 60180 - RNA, 22 nt, Human
aggugcuucagugacuuacuca

SEQ ID NO: 60181 - RNA, 32 nt, Human
aggugcuucgggagggggagagacugacccug

SEQ ID NO: 60182 - RNA, 22 nt, Human
aggugcuucuagcccugucuca

SEQ ID NO: 60183 - RNA, 23 nt, Human
aggugcuucucagaaguccugga

SEQ ID NO: 60184 - RNA, 32 nt, Human
aggugcuucucggcuuccucccccucauggcg

SEQ ID NO: 60185 - RNA, 32 nt, Human
aggugcuucuguacuuuuccagccuggaaaug

SEQ ID NO: 60186 - RNA, 32 nt, Human
aggugcuugaaggacugguuuggaaacagacc

SEQ ID NO: 60187 - RNA, 32 nt, Human
aggugcuugccugggaccaguggcagggaccc

SEQ ID NO: 60188 - RNA, 23 nt, Human
aggugcuuggaugaagcugaaaa

SEQ ID NO: 60189 - RNA, 22 nt, Human
aggugcuuggcugccucagagg

SEQ ID NO: 60190 - RNA, 32 nt, Human
aggugcuugggaacugcugguuaugagcauuc

SEQ ID NO: 60191 - RNA, 32 nt, Human
aggugcuuguaaucccagcuacuugggaggcu

SEQ ID NO: 60192 - RNA, 21 nt, Human
aggugcuuuaggucugguuca

SEQ ID NO: 60193 - RNA, 32 nt, Human
aggugcuuugggagggggagagacugauccug

SEQ ID NO: 60194 - RNA, 23 nt, Human
agguggaacgggaacagcuuccu

SEQ ID NO: 60195 - RNA, 32 nt, Human
agguggaacuacaggcauguaccaccacaccu

SEQ ID NO: 60196 - RNA, 31 nt, Human
agguggaacuggaaacuuaggagggaaagac

SEQ ID NO: 60197 - RNA, 22 nt, Human
agucagccaguugguugcugug

SEQ ID NO: 60198 - RNA, 32 nt, Human
agucagccaugucgccagcacaggucuauguc

SEQ ID NO: 60199 - RNA, 22 nt, Human
agucagccauucuuuuuccuca

SEQ ID NO: 60200 - RNA, 32 nt, Human
agucagcccaacauuuuccaccagucuguccc

SEQ ID NO: 60201 - RNA, 32 nt, Human
agucagcccgggaggucaggagcgcggcgggc

SEQ ID NO: 60202 - RNA, 32 nt, Human
agucagccuaggaggaggcagggcucccggaa

SEQ ID NO: 60203 - RNA, 32 nt, Human
agucagccuccacagaccaagcucaugacuca

SEQ ID NO: 60204 - RNA, 32 nt, Human
agucagccucuccaggcccagcuccugccuuc

SEQ ID NO: 60205 - RNA, 32 nt, Human
agucagccucuuuggggcacccucucucagcc

SEQ ID NO: 60206 - RNA, 32 nt, Human
agucagccuggcugggcucuggugggggcucc

SEQ ID NO: 60207 - RNA, 21 nt, Human
agucagccugggcuucugcca

SEQ ID NO: 60208 - RNA, 32 nt, Human
agucagccuucucucccccauaaggacuggcu

SEQ ID NO: 60209 - RNA, 23 nt, Human
agucagcugcccuuucuccugug

SEQ ID NO: 60210 - RNA, 32 nt, Human
agucagcuugccaucccuccucuucacuagca

SEQ ID NO: 60211 - RNA, 23 nt, Human
agucaggaaugauugcugacuca

SEQ ID NO: 60212 - RNA, 32 nt, Human
agucaggaauuaaacuuauaccaaugagagcc

SEQ ID NO: 60213 - RNA, 32 nt, Human
agucaggaauuuuuccucuggagacugccuaa

SEQ ID NO: 60214 - RNA, 32 nt, Human
agucaggaccgccugcaccgcaguccggggau

SEQ ID NO: 60215 - RNA, 32 nt, Human
agucaggacucugcucccaucuuugccuccac

SEQ ID NO: 60216 - RNA, 32 nt, Human
agucaggagagaccagccuggccagcauagug

SEQ ID NO: 60217 - RNA, 32 nt, Human
agucaggagaucaagaccauccuggccaacac

SEQ ID NO: 60218 - RNA, 32 nt, Human
agucaggagauuuaaacaaaauagcuuuggag

SEQ ID NO: 60219 - RNA, 32 nt, Human
agucaggagguugaggcugcagugagcuauga

SEQ ID NO: 60220 - RNA, 32 nt, Human
agucaggaguuugagagcagccugagcaacau

SEQ ID NO: 60221 - RNA, 22 nt, Human
agucaggcacguagcucagcgg

SEQ ID NO: 60222 - RNA, 32 nt, Human
agucaggcagccacaccuugguccucaucuug

SEQ ID NO: 60223 - RNA, 32 nt, Human
agucaggcagcccaagaggaucuucuuugguc

SEQ ID NO: 60224 - RNA, 32 nt, Human
agucaggcaggcugggacugaagguggcuccc

SEQ ID NO: 60225 - RNA, 32 nt, Human
agucaggcagugagacugguggggcacggggg

SEQ ID NO: 60226 - RNA, 22 nt, Human
agucaggcaguuugcuuaagga

SEQ ID NO: 60227 - RNA, 24 nt, Human
agucaggcauggcaagcccaggga

SEQ ID NO: 60228 - RNA, 32 nt, Human
agucaggcaugguggugggugccuggaguccc

SEQ ID NO: 60229 - RNA, 32 nt, Human
agucaggccacaugccuggucacugaaucaug

SEQ ID NO: 60230 - RNA, 32 nt, Human
agucaggcccaugauagucagugcaguugggg

SEQ ID NO: 60231 - RNA, 32 nt, Human
agucaggcucauuugggguaaugugaugacug

SEQ ID NO: 60232 - RNA, 32 nt, Human
agucaggcugagaaauccuuucccaggccagg

SEQ ID NO: 60233 - RNA, 32 nt, Human
agucaggcuguugcgcucccaccucagcccca

SEQ ID NO: 60234 - RNA, 32 nt, Human
agucaggcuuccagcacauucucccccauuug

SEQ ID NO: 60235 - RNA, 32 nt, Human
agucaggcuuuguacuugacccuuccccuccc

SEQ ID NO: 60236 - RNA, 32 nt, Human
agucagggagagacagaacugggggaaaggga

SEQ ID NO: 60237 - RNA, 32 nt, Human
agucagggagggcagaggguggcagcgagggc

SEQ ID NO: 60238 - RNA, 32 nt, Human
agucagggcagagaggaggagggaggcuguca

SEQ ID NO: 60239 - RNA, 32 nt, Human
agucagggcccacuccaggagggacccacugc

SEQ ID NO: 60240 - RNA, 32 nt, Human
agucaggggccaggaugcccucggaucagggc

SEQ ID NO: 60241 - RNA, 32 nt, Human
agucaggggcugggggcugagcccucaccccc

SEQ ID NO: 60242 - RNA, 32 nt, Human
agucaggggcuugguucucccacuuacacugu

SEQ ID NO: 60243 - RNA, 32 nt, Human
agucaggggugaggaggagccaggccuccugu

SEQ ID NO: 60244 - RNA, 32 nt, Human
agucagggugguguggcgguugcagcggcccc

SEQ ID NO: 60245 - RNA, 32 nt, Human
agucaggguuugaugcuugcuuccuagaaacu

SEQ ID NO: 60246 - RNA, 32 nt, Human
agucagguaauggcagaucuggcaugcacacc

SEQ ID NO: 60247 - RNA, 32 nt, Human
agucagguaccacauaaucauguuucagucag

SEQ ID NO: 60248 - RNA, 32 nt, Human
agucaggucagcugcccacagcccucuugccu

SEQ ID NO: 60249 - RNA, 20 nt, Human
agucaggugcagagguucug

SEQ ID NO: 60250 - RNA, 32 nt, Human
agucaggugguuuaccuuccagaggcuggcaa

SEQ ID NO: 60251 - RNA, 32 nt, Human
agucaggugugcuggggacagcaagaaugaug

SEQ ID NO: 60252 - RNA, 32 nt, Human
agucaguacaguacaggaaggggcugggcuga

SEQ ID NO: 60253 - RNA, 32 nt, Human
agucaguacuaugggguccugggaaacaaaga

SEQ ID NO: 60254 - RNA, 32 nt, Human
agucaguagcccugaaacuuucuacacauucc

SEQ ID NO: 60255 - RNA, 32 nt, Human
agucaguccaaucauaguacagugauguggug

SEQ ID NO: 60256 - RNA, 32 nt, Human
agucaguccucucuuuuaauacugaagggcac

SEQ ID NO: 60257 - RNA, 32 nt, Human
agucaguccuuuggaaaccagcaggucugaaa

SEQ ID NO: 60258 - RNA, 23 nt, Human
agucagucuccucccugucucca

SEQ ID NO: 60259 - RNA, 23 nt, Human
agucagugauaauuugcugaaga

SEQ ID NO: 60260 - RNA, 32 nt, Human
agucagugaugaucgcaucacaguugagugaa

SEQ ID NO: 60261 - RNA, 32 nt, Human
agucagugauugucuuuuugggcuuccccucc

SEQ ID NO: 60262 - RNA, 32 nt, Human
agucaguggauacaaguagugcagaagguuca

SEQ ID NO: 60263 - RNA, 32 nt, Human
agucaguggcaccauuuccuaaaguaacugaa

SEQ ID NO: 60264 - RNA, 32 nt, Human
agucaguggcaucacaguuuguagccucaggg

SEQ ID NO: 60265 - RNA, 32 nt, Human
agucaguggcuguuguucugucuugcugucug

SEQ ID NO: 60266 - RNA, 32 nt, Human
agucaguggggcuggacgggagccaaaaucag

SEQ ID NO: 60267 - RNA, 32 nt, Human
agucagugguuucccuuggauucauucuccua

SEQ ID NO: 60268 - RNA, 32 nt, Human
agucaguguaggcuuuguuacuuucccuuuuc

SEQ ID NO: 60269 - RNA, 32 nt, Human
agucaguguggaccucaugauuauagaggcca

SEQ ID NO: 60270 - RNA, 32 nt, Human
agucaguucaaaaccuucuggaaaggauucac

SEQ ID NO: 60271 - RNA, 32 nt, Human
agucaguucguagguggcgaucagaggcaccc

SEQ ID NO: 60272 - RNA, 32 nt, Human
agucaguuggcaagcaguggaauaagauuuuu

SEQ ID NO: 60273 - RNA, 32 nt, Human
agucaguuugaggccagaugaauagaaauugc

SEQ ID NO: 60274 - RNA, 30 nt, Human
agucaguuugcugugucagaaagcacuucu

SEQ ID NO: 60275 - RNA, 32 nt, Human
agucaguuuuaggguugccuguauccaguaac

SEQ ID NO: 60276 - RNA, 32 nt, Human
agucauaccccucaagaggcaggaugacaucu

SEQ ID NO: 60277 - RNA, 22 nt, Human
agucauagcccuggcuugggga

SEQ ID NO: 60278 - RNA, 32 nt, Human
agucauaggagguuggcaggacggguaucaca

SEQ ID NO: 60279 - RNA, 32 nt, Human
agucauaucucauucaugcugcagccuuugca

SEQ ID NO: 60280 - RNA, 32 nt, Human
agucauauuucugcuacuacuaccuucauuua

SEQ ID NO: 60281 - RNA, 32 nt, Human
agucauauuucuggguuuuauggcaggguuug

SEQ ID NO: 60282 - RNA, 32 nt, Human
agucaucaagaaaaguccaaagaagacuuuaa

SEQ ID NO: 60283 - RNA, 32 nt, Human
agucaucaauaugaagccaugauuaaugcuug

SEQ ID NO: 60284 - RNA, 32 nt, Human
agucaucacauuuggcuacuacccgggaaagc

SEQ ID NO: 60285 - RNA, 32 nt, Human
agucaucacccagcugggcuucugcaguguuu

SEQ ID NO: 60286 - RNA, 32 nt, Human
agucaucagauauuuuagccaccuacacaaaa

SEQ ID NO: 60287 - RNA, 32 nt, Human
agucaucauggacacccuccagcccggcuucc

SEQ ID NO: 60288 - RNA, 32 nt, Human
agucauccacacacaauccacacacgcauagc

SEQ ID NO: 60289 - RNA, 28 nt, Human
agucauccaggugcugccacaugacagg

SEQ ID NO: 60290 - RNA, 32 nt, Human
agucauccucaaggauuuuauccuggaacauu

SEQ ID NO: 60291 - RNA, 32 nt, Human
agucauccuuucuacugcuuuugaggcccucc

SEQ ID NO: 60292 - RNA, 32 nt, Human
agucaucgagcuguggccaacauggagcuagc

SEQ ID NO: 60293 - RNA, 32 nt, Human
agucaucgauuuuccagguguuggugaacugc

SEQ ID NO: 60294 - RNA, 32 nt, Human
agucaucucauuccacuguugguauuauauaa

SEQ ID NO: 60295 - RNA, 32 nt, Human
agucaucugcugucucuucagucugcuccauc

SEQ ID NO: 60296 - RNA, 32 nt, Human
agucaucuucuuucagugucuuuaugguagaa

SEQ ID NO: 60297 - RNA, 32 nt, Human
agucaugaacaacacugagaaacgucaaagug

SEQ ID NO: 60298 - RNA, 29 nt, Human
agucaugaggugcuucagaguacucuggg

SEQ ID NO: 60299 - RNA, 32 nt, Human
agucaugauguuuuggugguaccaccugguug

SEQ ID NO: 60300 - RNA, 32 nt, Human
agucaugcagaggccaagcucuaaagggcacc

SEQ ID NO: 60301 - RNA, 32 nt, Human
agucaugccaagcauagcccucaugucagcgc

SEQ ID NO: 60302 - RNA, 32 nt, Human
agucaugccacugcacucaaaccuggcggaca

SEQ ID NO: 60303 - RNA, 32 nt, Human
agucaugccuccugcauuucgcuacccgaguu

SEQ ID NO: 60304 - RNA, 32 nt, Human
agucaugccuuaagaagcagagcuaccuuacg

SEQ ID NO: 60305 - RNA, 19 nt, Human
agucaugcuuuugcuauca

SEQ ID NO: 60306 - RNA, 32 nt, Human
agucauggagccaugauaggccagagccugag

SEQ ID NO: 60307 - RNA, 32 nt, Human
agucauggagggacacguuccccacuuagccu

SEQ ID NO: 60308 - RNA, 32 nt, Human
agucauggaguuaagaagugagucagagagga

SEQ ID NO: 60309 - RNA, 32 nt, Human
agucauggcugcaggccagggagaugccugac

SEQ ID NO: 60310 - RNA, 32 nt, Human
agucaugggaggcagagcugggggagcgaggc

SEQ ID NO: 60311 - RNA, 29 nt, Human
agucauggggacccuauuaggucucggug

SEQ ID NO: 60312 - RNA, 32 nt, Human
agucauggggaccugaaggcugacacccagcc

SEQ ID NO: 60313 - RNA, 32 nt, Human
agucaugggguuucaccgccuuccucacucca

SEQ ID NO: 60314 - RNA, 32 nt, Human
agucauggucucagcuuugacucaaaagucaa

SEQ ID NO: 60315 - RNA, 32 nt, Human
agucauggucucagcuuugacucuaaagucaa

SEQ ID NO: 60316 - RNA, 32 nt, Human
agucaugucugcuuacagguguuauuugucug

SEQ ID NO: 60317 - RNA, 32 nt, Human
agucauguuuuauguaccauguuuucacacgu

SEQ ID NO: 60318 - RNA, 32 nt, Human
agucauuauuaggguggguaugguggcucaca

SEQ ID NO: 60319 - RNA, 32 nt, Human
agucauuccaagacuccuguccucacucaggg

SEQ ID NO: 60320 - RNA, 32 nt, Human
agucauuccaucuuucacucaggaugaaugcg

SEQ ID NO: 60321 - RNA, 32 nt, Human
agucauucuaacuauaaaagugcaaugacuaa

SEQ ID NO: 60322 - RNA, 32 nt, Human
agucauucuccccucucucauccaccucaccc

SEQ ID NO: 60323 - RNA, 32 nt, Human
agucauucucucuuuaaccauauaauuuaaaa

SEQ ID NO: 60324 - RNA, 32 nt, Human
agucauugauuccugggugucuugcuugauuu

SEQ ID NO: 60325 - RNA, 32 nt, Human
agucauugccguggugcugcugguguuuggag

SEQ ID NO: 60326 - RNA, 22 nt, Human
agucauugcuggaucugaacca

SEQ ID NO: 60327 - RNA, 32 nt, Human
agucauuggacagguuucucuccagcaagaaa

SEQ ID NO: 60328 - RNA, 32 nt, Human
agucauuguuccuuaucagauccucugcguag

SEQ ID NO: 60329 - RNA, 32 nt, Human
agucauuuccccucucugagccucggugucuu

SEQ ID NO: 60330 - RNA, 32 nt, Human
agucauuuccuguucaccccuaacccagcccc

SEQ ID NO: 60331 - RNA, 32 nt, Human
agucauuugaccaagacacagaagaugaugaa

SEQ ID NO: 60332 - RNA, 32 nt, Human
agucauuuugccuauguuucuacaaugaagug

SEQ ID NO: 60333 - RNA, 32 nt, Human
aguccaaaagaaaaggaagaggaggaaaaaca

SEQ ID NO: 60334 - RNA, 32 nt, Human
aguccaaaaggagccagagcaagucagaauuu

SEQ ID NO: 60335 - RNA, 22 nt, Human
aguccaaacaauugggagacaa

SEQ ID NO: 60336 - RNA, 32 nt, Human
aguccaaacauguggggccuggugaggcuccu

SEQ ID NO: 60337 - RNA, 32 nt, Human
aguccaaaggacagugugucacugugaacugg

SEQ ID NO: 60338 - RNA, 32 nt, Human
aguccaacaucagccaaccacacacagccgug

SEQ ID NO: 60339 - RNA, 32 nt, Human
aguccaaccuauuuaaaaaccccaccauuugg

SEQ ID NO: 60340 - RNA, 32 nt, Human
aguccaagaucauggugccaucaggguugguu

SEQ ID NO: 60341 - RNA, 32 nt, Human
aguccaagcagagaagguaggaacccuccaua

SEQ ID NO: 60342 - RNA, 24 nt, Human
aguccaagccaacagcuggugcua

SEQ ID NO: 60343 - RNA, 32 nt, Human
aguccaagcuacucaagaggcugaggugggag

SEQ ID NO: 60344 - RNA, 32 nt, Human
aguccaagcuacucaggaggcugaggcagaag

SEQ ID NO: 60345 - RNA, 32 nt, Human
aguccaagcucaaagcuggagugcaauggcgc

SEQ ID NO: 60346 - RNA, 32 nt, Human
aguccaaggaauaucaaaaauucugguuguau

SEQ ID NO: 60347 - RNA, 32 nt, Human
aguccaaggcagauccucucucccagggaauc

SEQ ID NO: 60348 - RNA, 32 nt, Human
aguccaagguacuguguuauagcaucaggaac

SEQ ID NO: 60349 - RNA, 32 nt, Human
aguccaauaacaagaccaaguaagaauguuuc

SEQ ID NO: 60350 - RNA, 32 nt, Human
aguccacacugcaaguccagagagcagggaac

SEQ ID NO: 60351 - RNA, 32 nt, Human
aguccacagagccugggcugggcccgguggag

SEQ ID NO: 60352 - RNA, 32 nt, Human
aguccacaguuguggcuccuuccagggccugg

SEQ ID NO: 60353 - RNA, 31 nt, Human
aguccacaguuucaucauuugagucaagugg

SEQ ID NO: 60354 - RNA, 21 nt, Human
aguccacaucuggcuuucuca

SEQ ID NO: 60355 - RNA, 32 nt, Human
aguccaccugaaccacacacucuaaagaaaua

SEQ ID NO: 60356 - RNA, 32 nt, Human
aguccacgugaagagccacacacccauuuucc

SEQ ID NO: 60357 - RNA, 32 nt, Human
aguccacucauccugaucucauucagcagauc

SEQ ID NO: 60358 - RNA, 32 nt, Human
aguccacugcaaccucugcccucccggguuua

SEQ ID NO: 60359 - RNA, 32 nt, Human
aguccacugcagccuaggaggguguuucccag

SEQ ID NO: 60360 - RNA, 32 nt, Human
aguccacugcauucuuauaaguucuaaauuuu

SEQ ID NO: 60361 - RNA, 32 nt, Human
aguccacugggaucauucagcagagcagagga

SEQ ID NO: 60362 - RNA, 32 nt, Human
aguccacuggucuucuauuugggaaacaagga

SEQ ID NO: 60363 - RNA, 32 nt, Human
aguccacuugaagcuguggaagaugguucauc

SEQ ID NO: 60364 - RNA, 32 nt, Human
aguccagaaacauaugugagguuguuucccuc

SEQ ID NO: 60365 - RNA, 32 nt, Human
aguccagaaagaagaauggaaggaggguggcc

SEQ ID NO: 60366 - RNA, 32 nt, Human
aguccagaaaguggcaguugcagugaguggag

SEQ ID NO: 60367 - RNA, 32 nt, Human
aguccagaagucccugaaccccaaacuguucu

SEQ ID NO: 60368 - RNA, 32 nt, Human
aguccagaagucugaaagaaucuccucucagg

SEQ ID NO: 60369 - RNA, 32 nt, Human
aguccagaaguucaagguuacagugaacuacg

SEQ ID NO: 60370 - RNA, 32 nt, Human
aguccagaaguuugagaucagccugggcaaug

SEQ ID NO: 60371 - RNA, 32 nt, Human
aguccagacacaaagagacaaagcuuugaaga

SEQ ID NO: 60372 - RNA, 32 nt, Human
aguccagacagugcucggcgggugaggaaggg

SEQ ID NO: 60373 - RNA, 32 nt, Human
aguccagaccccaugagcucucagccagcucu

SEQ ID NO: 60374 - RNA, 32 nt, Human
aguccagacucuuggugucggcccagacugca

SEQ ID NO: 60375 - RNA, 32 nt, Human
aguccagacuuggcacauggcuagggauacug

SEQ ID NO: 60376 - RNA, 32 nt, Human
aguccagagagggacuuaaggggcaagucggg

SEQ ID NO: 60377 - RNA, 32 nt, Human
aguccagagcaucagaccuggccgccuccauc

SEQ ID NO: 60378 - RNA, 32 nt, Human
aguccagagcugauacagcugcuccaaucacc

SEQ ID NO: 60379 - RNA, 32 nt, Human
aguccagauccaggacugagaucccagaacca

SEQ ID NO: 60380 - RNA, 32 nt, Human
aguccagaugcugaaggaugggaagacccaag

SEQ ID NO: 60381 - RNA, 23 nt, Human
aguccagaugucguggcucaggg

SEQ ID NO: 60382 - RNA, 32 nt, Human
aguccagcaacaacgucugccuaagcaucagc

SEQ ID NO: 60383 - RNA, 32 nt, Human
aguccagcaaccugcacuccagccugggugac

SEQ ID NO: 60384 - RNA, 32 nt, Human
aguccagcagcagccuggcugccuugucaugg

SEQ ID NO: 60385 - RNA, 16 nt, Human
aguccagccauccccu

SEQ ID NO: 60386 - RNA, 22 nt, Human
aguccagcccaggcaacacagc

SEQ ID NO: 60387 - RNA, 32 nt, Human
aguccagccgcuggugcgcggagcgguucacc

SEQ ID NO: 60388 - RNA, 32 nt, Human
aguccagccugaccaacaugaagaaacccugu

SEQ ID NO: 60389 - RNA, 32 nt, Human
aguccagccuggaggugugcucugagggccuc

SEQ ID NO: 60390 - RNA, 21 nt, Human
aguccagccugggcaacaaga

SEQ ID NO: 60391 - RNA, 26 nt, Human
aguccagccugggugacagagugaga

SEQ ID NO: 60392 - RNA, 32 nt, Human
aguccaggaauuagagguugcagugagguaug

SEQ ID NO: 60393 - RNA, 32 nt, Human
aguccaggacauugucugucugccuuccggua

SEQ ID NO: 60394 - RNA, 32 nt, Human
aguccaggacccaggagagggaagaaucugag

SEQ ID NO: 60395 - RNA, 18 nt, Human
aguccaggacuccaggag

SEQ ID NO: 60396 - RNA, 32 nt, Human
aguccaggaggcagagguucuauuaauggaga

SEQ ID NO: 60397 - RNA, 32 nt, Human
aguccaggaggcggaggcugcagugagcugug

SEQ ID NO: 60398 - RNA, 32 nt, Human
aguccaggaggucgaggcugcagugagccaag

SEQ ID NO: 60399 - RNA, 32 nt, Human
aguccaggagguugaggcugcagugagcugug

SEQ ID NO: 60400 - RNA, 32 nt, Human
aguccaggaguucaaggcugcagugaguugug

SEQ ID NO: 60401 - RNA, 32 nt, Human
aguccaggaguucaagguggcagugagcuauu

SEQ ID NO: 60402 - RNA, 32 nt, Human
aguccaggaguuggaggcuacagugagccaug

SEQ ID NO: 60403 - RNA, 32 nt, Human
aguccaggaguuuugagaccagccugggcaac

SEQ ID NO: 60404 - RNA, 32 nt, Human
aguccaggauagccucaugagcauaggccuuc

SEQ ID NO: 60405 - RNA, 32 nt, Human
aguccaggcacugcagaggccuagaggcaacc

SEQ ID NO: 60406 - RNA, 32 nt, Human
aguccaggcccggcuggucaccagggauucaa

SEQ ID NO: 60407 - RNA, 32 nt, Human
aguccaggcggacgggguggaagguucagagc

SEQ ID NO: 60408 - RNA, 32 nt, Human
aguccaggcugagccccaggaggaguaggagu

SEQ ID NO: 60409 - RNA, 32 nt, Human
aguccaggcugaugcaguggcuucaagagcuc

SEQ ID NO: 60410 - RNA, 32 nt, Human
aguccaggcugcagccgagggagcugaguagg

SEQ ID NO: 60411 - RNA, 18 nt, Human
aguccaggcugcugugcc

SEQ ID NO: 60412 - RNA, 32 nt, Human
aguccagggagggccaaguccacccagcauca

SEQ ID NO: 60413 - RNA, 32 nt, Human
aguccagggucuuugcccucucccuuguggcu

SEQ ID NO: 60414 - RNA, 32 nt, Human
aguccagggugucgcaccagcccugggcugau

SEQ ID NO: 60415 - RNA, 32 nt, Human
aguccagguguucccuguguuugaggucaagg

SEQ ID NO: 60416 - RNA, 32 nt, Human
aguccaguaaagccuuaaguggcagaauauaa

SEQ ID NO: 60417 - RNA, 32 nt, Human
aguccaguccccuuaccccuguggaccucagu

SEQ ID NO: 60418 - RNA, 32 nt, Human
aguccagugaaaggcaaagggaaagugggucg

SEQ ID NO: 60419 - RNA, 32 nt, Human
aguccagugaagaggaagaagaggaggaugag

SEQ ID NO: 60420 - RNA, 32 nt, Human
aguccagugucacccgcccugguuuauuaaca

SEQ ID NO: 60421 - RNA, 32 nt, Human
aguccagugucaucugaaggggccauuucucc

SEQ ID NO: 60422 - RNA, 32 nt, Human
aguccaguuugaaggugcucucugccaguuca

SEQ ID NO: 60423 - RNA, 32 nt, Human
aguccaucagcaaguuacuuuugagcgccuac

SEQ ID NO: 60424 - RNA, 32 nt, Human
aguccaucaggacuugaaagaccugaguccau

SEQ ID NO: 60425 - RNA, 23 nt, Human
aguccaucaguuaccagcacauu

SEQ ID NO: 60426 - RNA, 32 nt, Human
aguccaucauguccuucggcagagacauggag

SEQ ID NO: 60427 - RNA, 32 nt, Human
aguccauccuuugaggaaggcagacuuggcgg

SEQ ID NO: 60428 - RNA, 32 nt, Human
aguccaucggguccugggccucagcuucccuu

SEQ ID NO: 60429 - RNA, 32 nt, Human
aguccaugaagggggugugagggggaggguau

SEQ ID NO: 60430 - RNA, 30 nt, Human
aguccaugagucagccaccccucugcaugc

SEQ ID NO: 60431 - RNA, 32 nt, Human
aguccaugauaucuaaggaguuggcaagcuua

SEQ ID NO: 60432 - RNA, 30 nt, Human
aguccaugcaguuaaagcuagagaauaugc

SEQ ID NO: 60433 - RNA, 32 nt, Human
aguccaugcugugagcuuccuaccucagccca

SEQ ID NO: 60434 - RNA, 32 nt, Human
aguccauggaagcauccaggagggaggcugua

SEQ ID NO: 60435 - RNA, 32 nt, Human
aguccauggagaauuugcucagcuggaccagu

SEQ ID NO: 60436 - RNA, 32 nt, Human
aguccauggugucgcugugugccuguaucauu

SEQ ID NO: 60437 - RNA, 32 nt, Human
aguccauguacaguguagaugcagacucaccg

SEQ ID NO: 60438 - RNA, 30 nt, Human
aguccaugugcagccaauuuucuuuuagag

SEQ ID NO: 60439 - RNA, 32 nt, Human
aguccauguucaggaaauggcugaagcucgua

SEQ ID NO: 60440 - RNA, 32 nt, Human
aguccauguucaggaaauggcugaaguucgua

SEQ ID NO: 60441 - RNA, 32 nt, Human
aguccauuauuuccucuggcuuccucaaauuc

SEQ ID NO: 60442 - RNA, 32 nt, Human
aguccauuccaucaugaugcugugcccgcuau

SEQ ID NO: 60443 - RNA, 32 nt, Human
aguccauucccgaggggauaagaaggagacca

SEQ ID NO: 60444 - RNA, 32 nt, Human
agucccaaagugccaugagagaagcucucagg

SEQ ID NO: 60445 - RNA, 31 nt, Human
agucccaacgucugccucacagcagauucuu

SEQ ID NO: 60446 - RNA, 32 nt, Human
agucccaacuacucggaaggcugaggcaggag

SEQ ID NO: 60447 - RNA, 32 nt, Human
agucccaacuacucgggaggcugaagcaggag

SEQ ID NO: 60448 - RNA, 32 nt, Human
agucccaacuacucgggaggcugaggcgggag

SEQ ID NO: 60449 - RNA, 32 nt, Human
agucccaacuacucggguaucugaggugggag

SEQ ID NO: 60450 - RNA, 20 nt, Human
agucccaagcucuaucauua

SEQ ID NO: 60451 - RNA, 32 nt, Human
agucccaaguacagcugucccuuuguauccuu

SEQ ID NO: 60452 - RNA, 32 nt, Human
agucccaauuacucgggaggcugcagcaggag

SEQ ID NO: 60453 - RNA, 32 nt, Human
agucccacaccuccaccaccagcccagcacuc

SEQ ID NO: 60454 - RNA, 20 nt, Human
agucccacaguugcacugcc

SEQ ID NO: 60455 - RNA, 32 nt, Human
agucccacauggcuggugaggccucacaauca

SEQ ID NO: 60456 - RNA, 32 nt, Human
agucccacccagcaccauaaagaaaggcaaau

SEQ ID NO: 60457 - RNA, 32 nt, Human
agucccacccgcuccaggagagauuggcagcu

SEQ ID NO: 60458 - RNA, 32 nt, Human
agucccaccuacucgggaagcugaggcaauag

SEQ ID NO: 60459 - RNA, 32 nt, Human
agucccaccuggaggaggagguuggaggguug

SEQ ID NO: 60460 - RNA, 32 nt, Human
agucccaccugugcugugacagucccacgugg

SEQ ID NO: 60461 - RNA, 32 nt, Human
agucccacggaggaggggcagagccaggaggc

SEQ ID NO: 60462 - RNA, 32 nt, Human
agucccacucacuggccuuccuuucaauaaag

SEQ ID NO: 60463 - RNA, 16 nt, Human
agucccacuguccccu

SEQ ID NO: 60464 - RNA, 32 nt, Human
agucccacuuccccaucuccccaaguaggugg

SEQ ID NO: 60465 - RNA, 32 nt, Human
agucccagaagcuuccuggucucaugaaccua

SEQ ID NO: 60466 - RNA, 32 nt, Human
agucccagaaguaaacccucacugugaaucag

SEQ ID NO: 60467 - RNA, 32 nt, Human
agucccagagcaccucaccucccgaagccacc

SEQ ID NO: 60468 - RNA, 32 nt, Human
agucccagauacucgggaggcuaaggcaggag

SEQ ID NO: 60469 - RNA, 32 nt, Human
agucccagauacucgggaggcugaggcaggag

SEQ ID NO: 60470 - RNA, 32 nt, Human
agucccagauacuugggaggccaaggcaggag

SEQ ID NO: 60471 - RNA, 32 nt, Human
agucccagaucuugcucugccuugggguucaa

SEQ ID NO: 60472 - RNA, 32 nt, Human
agucccagcaacucgggaggcugaggcaggag

SEQ ID NO: 60473 - RNA, 32 nt, Human
agucccagcaccugugucaguaaagaaagugg

SEQ ID NO: 60474 - RNA, 32 nt, Human
agucccagcacuuugggagacugaggcaggcg

SEQ ID NO: 60475 - RNA, 20 nt, Human
agucccagcaggaacuguga

SEQ ID NO: 60476 - RNA, 32 nt, Human
agucccagccacucgggaggcugagacaggag

SEQ ID NO: 60477 - RNA, 22 nt, Human
agucccagcccaggcagggaga

SEQ ID NO: 60478 - RNA, 32 nt, Human
agucccagcccauccuggagcugucggaagcc

SEQ ID NO: 60479 - RNA, 32 nt, Human
agucccagccucagaacccaggauaggaaaug

SEQ ID NO: 60480 - RNA, 32 nt, Human
agucccagccucccccggaacccucuaccaau

SEQ ID NO: 60481 - RNA, 32 nt, Human
agucccagccucuccccucuacaacuccugcc

SEQ ID NO: 60482 - RNA, 32 nt, Human
agucccagccugccggccgguacucaccgcua

SEQ ID NO: 60483 - RNA, 32 nt, Human
agucccagcuacuaggaaggcugaggcaggag

SEQ ID NO: 60484 - RNA, 32 nt, Human
agucccagcuacuagggaggcaggaggaucac

SEQ ID NO: 60485 - RNA, 32 nt, Human
agucccagcuacuagggaggcugagccaggag

SEQ ID NO: 60486 - RNA, 32 nt, Human
agucccagcuacuagggaggcugaggcaggag

SEQ ID NO: 60487 - RNA, 32 nt, Human
agucccagcuacuauggagguugaggugggag

SEQ ID NO: 60488 - RNA, 32 nt, Human
agucccagcuacucaagaggcugaggcagaag

SEQ ID NO: 60489 - RNA, 32 nt, Human
agucccagcuacucaagaggcugaggcaggag

SEQ ID NO: 60490 - RNA, 32 nt, Human
agucccagcuacucaaguggcuaaggugagag

SEQ ID NO: 60491 - RNA, 32 nt, Human
agucccagcuacucagaagccugaggcuggga

SEQ ID NO: 60492 - RNA, 32 nt, Human
agucccagcuacucagaaggaugaggugggag

SEQ ID NO: 60493 - RNA, 32 nt, Human
agucccagcuacucagaaggccgaggcaggag

SEQ ID NO: 60494 - RNA, 32 nt, Human
agucccagcuacucagaagggugaggcagaau

SEQ ID NO: 60495 - RNA, 32 nt, Human
agucccagcuacucaggaagcugaggugagag

SEQ ID NO: 60496 - RNA, 32 nt, Human
agucccagcuacucaggagacugaggcgggag

SEQ ID NO: 60497 - RNA, 32 nt, Human
agucccagcuacucaggagacugaggcuagaa

SEQ ID NO: 60498 - RNA, 32 nt, Human
agucccagcuacucaggaggccaaggugggau

SEQ ID NO: 60499 - RNA, 32 nt, Human
agucccagcuacucaggaggccgaggcaggag

SEQ ID NO: 60500 - RNA, 32 nt, Human
agucccagcuacucaggaggcuaaagcggcag

SEQ ID NO: 60501 - RNA, 32 nt, Human
agucccagcuacucaggaggcuaagcaaaagg

SEQ ID NO: 60502 - RNA, 32 nt, Human
agucccagcuacucaggaggcuaaggcaggag

SEQ ID NO: 60503 - RNA, 32 nt, Human
agucccagcuacucaggaggcuagagcaggag

SEQ ID NO: 60504 - RNA, 32 nt, Human
agucccagcuacucaggaggcucagcagcagg

SEQ ID NO: 60505 - RNA, 32 nt, Human
agucccagcuacucaggaggcugaagcaggag

SEQ ID NO: 60506 - RNA, 32 nt, Human
agucccagcuacucaggaggcugaagcaggau

SEQ ID NO: 60507 - RNA, 32 nt, Human
agucccagcuacucaggaggcugagacaggag

SEQ ID NO: 60508 - RNA, 32 nt, Human
agucccagcuacucaggaggcugaggaagauc

SEQ ID NO: 60509 - RNA, 32 nt, Human
agucccagcuacucaggaggcugaggcaagag

SEQ ID NO: 60510 - RNA, 32 nt, Human
agucccagcuacucaggaggcugaggcaagcu

SEQ ID NO: 60511 - RNA, 32 nt, Human
agucccagcuacucaggaggcugaggcagaag

SEQ ID NO: 60512 - RNA, 32 nt, Human
agucccagcuacucaggaggcugaggcaggag

SEQ ID NO: 60513 - RNA, 32 nt, Human
agucccagcuacucaggaggcugaggcgggag

SEQ ID NO: 60514 - RNA, 32 nt, Human
agucccagcuacucaggaggcugaggcuagaa

SEQ ID NO: 60515 - RNA, 32 nt, Human
agucccagcuacucaggaggcugagguaggag

SEQ ID NO: 60516 - RNA, 32 nt, Human
agucccagcuacucaggaggcugagguaggau

SEQ ID NO: 60517 - RNA, 32 nt, Human
agucccagcuacucaggaggcugagguggaag

SEQ ID NO: 60518 - RNA, 32 nt, Human
agucccagcuacucaggaggcugaggugggaa

SEQ ID NO: 60519 - RNA, 32 nt, Human
agucccagcuacucaggaggcugaggugggac

SEQ ID NO: 60520 - RNA, 32 nt, Human
agucccagcuacucaggaggcugaggugggag

SEQ ID NO: 60521 - RNA, 32 nt, Human
agucccagcuacucaggaggcugggcaggaga

SEQ ID NO: 60522 - RNA, 32 nt, Human
agucccagcuacucaggaggcuggggaaggaa

SEQ ID NO: 60523 - RNA, 32 nt, Human
agucccagcuacucaggaggcuggggcaggag

SEQ ID NO: 60524 - RNA, 32 nt, Human
agucccagcuacucaggaggcuguggugggag

SEQ ID NO: 60525 - RNA, 32 nt, Human
agucccagcuacucaggaggcuuagguaggag

SEQ ID NO: 60526 - RNA, 32 nt, Human
agucccagcuacucaggaggcuugggugggag

SEQ ID NO: 60527 - RNA, 32 nt, Human
agucccagcuacucaggagguugaagugggag

SEQ ID NO: 60528 - RNA, 32 nt, Human
agucccagcuacucaggagguugaggcagaag

SEQ ID NO: 60529 - RNA, 32 nt, Human
agucccagcuacucaggagguugagguaggag

SEQ ID NO: 60530 - RNA, 32 nt, Human
agucccagcuacucaggagguugaggugggaa

SEQ ID NO: 60531 - RNA, 32 nt, Human
agucccagcuacucaggagucugagcugggag

SEQ ID NO: 60532 - RNA, 32 nt, Human
agucccagcuacucaggaguugaggcggaagg

SEQ ID NO: 60533 - RNA, 32 nt, Human
agucccagcuacucaggaugcugaagcagaag

SEQ ID NO: 60534 - RNA, 32 nt, Human
agucccagcuacucaggauucugaggcaggag

SEQ ID NO: 60535 - RNA, 32 nt, Human
agucccagcuacucaggcugaggcaggagaau

SEQ ID NO: 60536 - RNA, 32 nt, Human
agucccagcuacucagggcugaggcaggagaa

SEQ ID NO: 60537 - RNA, 32 nt, Human
agucccagcuacucagggggcugaggcgggag

SEQ ID NO: 60538 - RNA, 32 nt, Human
agucccagcuacucaugaggcuuaaauggagg

SEQ ID NO: 60539 - RNA, 32 nt, Human
agucccagcuacuccagagauugaggcaugag

SEQ ID NO: 60540 - RNA, 32 nt, Human
agucccagcuacuccagaggcugagauggauc

SEQ ID NO: 60541 - RNA, 32 nt, Human
agucccagcuacuccagaggucgaggcaggag

SEQ ID NO: 60542 - RNA, 32 nt, Human
agucccagcuacuccagaugcugaggcaggag

SEQ ID NO: 60543 - RNA, 32 nt, Human
agucccagcuacuccggacacugaugugagag

SEQ ID NO: 60544 - RNA, 32 nt, Human
agucccagcuacuccggaggcugaggcaggag

SEQ ID NO: 60545 - RNA, 32 nt, Human
agucccagcuacuccggaggcugagggaggag

SEQ ID NO: 60546 - RNA, 32 nt, Human
agucccagcuacuccugaggcugaggugggag

SEQ ID NO: 60547 - RNA, 32 nt, Human
agucccagcuacucgaaaggcugaggcgggag

SEQ ID NO: 60548 - RNA, 32 nt, Human
agucccagcuacucgagagccugaggcaggag

SEQ ID NO: 60549 - RNA, 32 nt, Human
agucccagcuacucgagaggcuaaggcaggaa

SEQ ID NO: 60550 - RNA, 32 nt, Human
agucccagcuacucgagaggcugaggcaggag

SEQ ID NO: 60551 - RNA, 32 nt, Human
agucccagcuacucgagaggcugaggcuggag

SEQ ID NO: 60552 - RNA, 32 nt, Human
agucccagcuacucgcgagacugaggcaggag

SEQ ID NO: 60553 - RNA, 32 nt, Human
agucccagcuacucggaaggcuaaggcaggag

SEQ ID NO: 60554 - RNA, 32 nt, Human
agucccagcuacucggaaggcugaagcaggag

SEQ ID NO: 60555 - RNA, 32 nt, Human
agucccagcuacucggaggcugaggcaguaga

SEQ ID NO: 60556 - RNA, 32 nt, Human
agucccagcuacucggcaggcugaggugggag

SEQ ID NO: 60557 - RNA, 32 nt, Human
agucccagcuacucggcaggcugcagcaggaa

SEQ ID NO: 60558 - RNA, 32 nt, Human
agucccagcuacucgggaagcuaaggugggag

SEQ ID NO: 60559 - RNA, 32 nt, Human
agucccagcuacucgggaagcugaggcaagag

SEQ ID NO: 60560 - RNA, 32 nt, Human
agucccagcuacucgggaagcugaggcagaag

SEQ ID NO: 60561 - RNA, 32 nt, Human
agucccagcuacucgggaagcugaggugggag

SEQ ID NO: 60562 - RNA, 32 nt, Human
agucccagcuacucgggagacugaggcaggag

SEQ ID NO: 60563 - RNA, 32 nt, Human
agucccagcuacucgggagcccaacgcacgag

SEQ ID NO: 60564 - RNA, 32 nt, Human
agucccagcuacucgggagccugaggcaggag

SEQ ID NO: 60565 - RNA, 32 nt, Human
agucccagcuacucgggaggccgaggcagaag

SEQ ID NO: 60566 - RNA, 32 nt, Human
agucccagcuacucgggaggcuaaggcaggag

SEQ ID NO: 60567 - RNA, 32 nt, Human
agucccagcuacucgggaggcugaagcagaag

SEQ ID NO: 60568 - RNA, 32 nt, Human
agucccagcuacucgggaggcugaagcaggag

SEQ ID NO: 60569 - RNA, 32 nt, Human
agucccagcuacucgggaggcugaagcgggag

SEQ ID NO: 60570 - RNA, 32 nt, Human
agucccagcuacucgggaggcugagacagaag

SEQ ID NO: 60571 - RNA, 32 nt, Human
agucccagcuacucgggaggcugagacaggag

SEQ ID NO: 60572 - RNA, 32 nt, Human
agucccagcuacucgggaggcugagcuucgag

SEQ ID NO: 60573 - RNA, 32 nt, Human
agucccagcuacucgggaggcugaggaaggag

SEQ ID NO: 60574 - RNA, 32 nt, Human
agucccagcuacucgggaggcugaggcaagag

SEQ ID NO: 60575 - RNA, 32 nt, Human
agucccagcuacucgggaggcugaggcacaag

SEQ ID NO: 60576 - RNA, 32 nt, Human
agucccagcuacucgggaggcugaggcacgag

SEQ ID NO: 60577 - RNA, 32 nt, Human
agucccagcuacucgggaggcugaggcagaag

SEQ ID NO: 60578 - RNA, 32 nt, Human
agucccagcuacucgggaggcugaggcaggaa

SEQ ID NO: 60579 - RNA, 32 nt, Human
agucccagcuacucgggaggcugaggcaggag

SEQ ID NO: 60580 - RNA, 32 nt, Human
agucccagcuacucgggaggcugaggcaggau

SEQ ID NO: 60581 - RNA, 32 nt, Human
agucccagcuacucgggaggcugaggcagggg

SEQ ID NO: 60582 - RNA, 32 nt, Human
agucccagcuacucgggaggcugaggcaugag

SEQ ID NO: 60583 - RNA, 32 nt, Human
agucccagcuacucgggaggcugaggccguag

SEQ ID NO: 60584 - RNA, 32 nt, Human
agucccagcuacucgggaggcugaggcgggag

SEQ ID NO: 60585 - RNA, 32 nt, Human
agucccagcuacucgggaggcugaggcuggag

SEQ ID NO: 60586 - RNA, 32 nt, Human
agucccagcuacucgggaggcugagguaggag

SEQ ID NO: 60587 - RNA, 32 nt, Human
agucccagcuacucgggaggcugaggugggag

SEQ ID NO: 60588 - RNA, 32 nt, Human
agucccagcuacucgggaggcugaugcagaag

SEQ ID NO: 60589 - RNA, 32 nt, Human
agucccagcuacucgggaggcuggggcaggag

SEQ ID NO: 60590 - RNA, 32 nt, Human
agucccagcuacucgggagguugaggcaggag

SEQ ID NO: 60591 - RNA, 32 nt, Human
agucccagcuacucgggagucugaaacaggag

SEQ ID NO: 60592 - RNA, 32 nt, Human
agucccagcuacucggggcgcugaggcaggag

SEQ ID NO: 60593 - RNA, 32 nt, Human
agucccagcuacucuagaggcugaggugggag

SEQ ID NO: 60594 - RNA, 32 nt, Human
agucccagcuacucuauagccugaggugggag

SEQ ID NO: 60595 - RNA, 32 nt, Human
agucccagcuacucugaagacugaggcaggag

SEQ ID NO: 60596 - RNA, 32 nt, Human
agucccagcuacucuggaggcugaaaugggag

SEQ ID NO: 60597 - RNA, 32 nt, Human
agucccagcuacucuggaggcugaagcaggag

SEQ ID NO: 60598 - RNA, 32 nt, Human
agucccagcuacucuggaggcugaaguuggag

SEQ ID NO: 60599 - RNA, 32 nt, Human
agucccagcuacucuggaggcugagacaggag

SEQ ID NO: 60600 - RNA, 32 nt, Human
agucccagcuacucuggaggcugaggcaggaa

SEQ ID NO: 60601 - RNA, 32 nt, Human
agucccagcuacucuggaggcugaggcaggag

SEQ ID NO: 60602 - RNA, 32 nt, Human
agucccagcuacucuggaggcugaggcgggag

SEQ ID NO: 60603 - RNA, 32 nt, Human
agucccagcuacucuggaggcugaggugaggg

SEQ ID NO: 60604 - RNA, 32 nt, Human
agucccagcuacucuggagucugaggcgagag

SEQ ID NO: 60605 - RNA, 32 nt, Human
agucccagcuacucuugaaggcugagcuggga

SEQ ID NO: 60606 - RNA, 32 nt, Human
agucccagcuacuggcgaggcugaggcuggag

SEQ ID NO: 60607 - RNA, 32 nt, Human
agucccagcuacuggggaggcugaggcagcau

SEQ ID NO: 60608 - RNA, 32 nt, Human
agucccagcuacuggggaggcugaggcaggaa

SEQ ID NO: 60609 - RNA, 32 nt, Human
agucccagcuacuggggaggcugaggcaggag

SEQ ID NO: 60610 - RNA, 32 nt, Human
agucccagcuacuggggaggcugaggcagggg

SEQ ID NO: 60611 - RNA, 32 nt, Human
agucccagcuacugguaggccgaggcaggaga

SEQ ID NO: 60612 - RNA, 32 nt, Human
agucccagcuacuuaggaggcugagaugggag

SEQ ID NO: 60613 - RNA, 32 nt, Human
agucccagcuacuuaggaggcugaggcaugag

SEQ ID NO: 60614 - RNA, 32 nt, Human
agucccagcuacuuaggaggcugaggggcaag

SEQ ID NO: 60615 - RNA, 32 nt, Human
agucccagcuacuuaggaggcugagguaggag

SEQ ID NO: 60616 - RNA, 32 nt, Human
agucccagcuacuuaggaggcugaggugggag

SEQ ID NO: 60617 - RNA, 32 nt, Human
agucccagcuacuucggggacugaggugggag

SEQ ID NO: 60618 - RNA, 32 nt, Human
agucccagcuacuugagaggcugagccgggaa

SEQ ID NO: 60619 - RNA, 32 nt, Human
agucccagcuacuugagaggcugaggcaagaa

SEQ ID NO: 60620 - RNA, 32 nt, Human
agucccagcuacuugagaggcugaggcaagag

SEQ ID NO: 60621 - RNA, 32 nt, Human
agucccagcuacuugagaggcugaggcuggag

SEQ ID NO: 60622 - RNA, 32 nt, Human
agucccagcuacuugaguggccgaggcaggag

SEQ ID NO: 60623 - RNA, 32 nt, Human
agucccagcuacuuggaagcugaggugggagg

SEQ ID NO: 60624 - RNA, 32 nt, Human
agucccagcuacuuggaaggcugagacaggag

SEQ ID NO: 60625 - RNA, 32 nt, Human
agucccagcuacuuggaggcugaggcgugaga

SEQ ID NO: 60626 - RNA, 32 nt, Human
agucccagcuacuuggagggcagaggugggag

SEQ ID NO: 60627 - RNA, 32 nt, Human
agucccagcuacuuggcaggcugaggcagaag

SEQ ID NO: 60628 - RNA, 32 nt, Human
agucccagcuacuuggcaggcugaggcaggag

SEQ ID NO: 60629 - RNA, 18 nt, Human
agucccagcuacuuggga

SEQ ID NO: 60630 - RNA, 32 nt, Human
agucccagcuacuugggaagcagaggcuggag

SEQ ID NO: 60631 - RNA, 32 nt, Human
agucccagcuacuugggaagcugaagugggag

SEQ ID NO: 60632 - RNA, 32 nt, Human
agucccagcuacuugggaagcugaggaaggag

SEQ ID NO: 60633 - RNA, 32 nt, Human
agucccagcuacuugggaagcugaggcaggag

SEQ ID NO: 60634 - RNA, 32 nt, Human
agucccagcuacuugggaagcugaggugggaa

SEQ ID NO: 60635 - RNA, 32 nt, Human
agucccagcuacuugggacaccgaggcaggag

SEQ ID NO: 60636 - RNA, 32 nt, Human
agucccagcuacuugggagacugagguggggg

SEQ ID NO: 60637 - RNA, 32 nt, Human
agucccagcuacuugggaggaugaggcaggag

SEQ ID NO: 60638 - RNA, 32 nt, Human
agucccagcuacuugggaggcagaggcaggag

SEQ ID NO: 60639 - RNA, 32 nt, Human
agucccagcuacuugggaggcagaggugggaa

SEQ ID NO: 60640 - RNA, 32 nt, Human
agucccagcuacuugggaggccaaggcacgag

SEQ ID NO: 60641 - RNA, 32 nt, Human
agucccagcuacuugggaggccaaggcaggag

SEQ ID NO: 60642 - RNA, 32 nt, Human
agucccagcuacuugggaggccgaggcacgag

SEQ ID NO: 60643 - RNA, 32 nt, Human
agucccagcuacuugggaggccgaggcaggag

SEQ ID NO: 60644 - RNA, 32 nt, Human
agucccagcuacuugggaggccuaggcaggag

SEQ ID NO: 60645 - RNA, 32 nt, Human
agucccagcuacuugggaggcuaagcccaguu

SEQ ID NO: 60646 - RNA, 32 nt, Human
agucccagcuacuugggaggcuaaggcaggag

SEQ ID NO: 60647 - RNA, 32 nt, Human
agucccagcuacuugggaggcugaagcaggag

SEQ ID NO: 60648 - RNA, 32 nt, Human
agucccagcuacuugggaggcugaagugggag

SEQ ID NO: 60649 - RNA, 32 nt, Human
agucccagcuacuugggaggcugagacaggag

SEQ ID NO: 60650 - RNA, 32 nt, Human
agucccagcuacuugggaggcugagagaggag

SEQ ID NO: 60651 - RNA, 32 nt, Human
agucccagcuacuugggaggcugagaugggag

SEQ ID NO: 60652 - RNA, 32 nt, Human
agucccagcuacuugggaggcugagcccugga

SEQ ID NO: 60653 - RNA, 32 nt, Human
agucccagcuacuugggaggcugaggcaagag

SEQ ID NO: 60654 - RNA, 32 nt, Human
agucccagcuacuugggaggcugaggcacaag

SEQ ID NO: 60655 - RNA, 32 nt, Human
agucccagcuacuugggaggcugaggcagaag

SEQ ID NO: 60656 - RNA, 32 nt, Human
agucccagcuacuugggaggcugaggcagaau

SEQ ID NO: 60657 - RNA, 32 nt, Human
agucccagcuacuugggaggcugaggcaggag

SEQ ID NO: 60658 - RNA, 32 nt, Human
agucccagcuacuugggaggcugaggcagggg

SEQ ID NO: 60659 - RNA, 32 nt, Human
agucccagcuacuugggaggcugagggcagga

SEQ ID NO: 60660 - RNA, 32 nt, Human
agucccagcuacuugggaggcugagguaggag

SEQ ID NO: 60661 - RNA, 32 nt, Human
agucccagcuacuugggaggcugaggucagag

SEQ ID NO: 60662 - RNA, 32 nt, Human
agucccagcuacuugggaggcugagguggaag

SEQ ID NO: 60663 - RNA, 32 nt, Human
agucccagcuacuugggaggcugagguggagg

SEQ ID NO: 60664 - RNA, 32 nt, Human
agucccagcuacuugggaggcugaggugggaa

SEQ ID NO: 60665 - RNA, 32 nt, Human
agucccagcuacuugggaggcugaggugggag

SEQ ID NO: 60666 - RNA, 32 nt, Human
agucccagcuacuugggaggcugagguggggg

SEQ ID NO: 60667 - RNA, 32 nt, Human
agucccagcuacuugggaggcugaguccggag

SEQ ID NO: 60668 - RNA, 32 nt, Human
agucccagcuacuugggaggcugaugcaugag

SEQ ID NO: 60669 - RNA, 32 nt, Human
agucccagcuacuugggaggcugcagcugugg

SEQ ID NO: 60670 - RNA, 32 nt, Human
agucccagcuacuugggaggcuggggaaggag

SEQ ID NO: 60671 - RNA, 32 nt, Human
agucccagcuacuugggaggcuggggcaugag

SEQ ID NO: 60672 - RNA, 32 nt, Human
agucccagcuacuugggaggcuuagucaggag

SEQ ID NO: 60673 - RNA, 32 nt, Human
agucccagcuacuugggagggcugaagccagg

SEQ ID NO: 60674 - RNA, 32 nt, Human
agucccagcuacuugggagguggaggugggag

SEQ ID NO: 60675 - RNA, 32 nt, Human
agucccagcuacuugggagguugaggcuggaa

SEQ ID NO: 60676 - RNA, 32 nt, Human
agucccagcuacuugggagguugagguaggag

SEQ ID NO: 60677 - RNA, 32 nt, Human
agucccagcuacuugggaugccgaggcaggaa

SEQ ID NO: 60678 - RNA, 32 nt, Human
agucccagcuacuugggggccugaggcacgag

SEQ ID NO: 60679 - RNA, 32 nt, Human
agucccagcuacuuggggugcugaggcgggag

SEQ ID NO: 60680 - RNA, 32 nt, Human
agucccagcuacuugguaggcugaggcaggag

SEQ ID NO: 60681 - RNA, 32 nt, Human
agucccagcuacuugugaggcugagggaggag

SEQ ID NO: 60682 - RNA, 32 nt, Human
agucccagcuacuugugaggcugaggugggag

SEQ ID NO: 60683 - RNA, 32 nt, Human
agucccagcuacuuuggaggcugaagcggaag

SEQ ID NO: 60684 - RNA, 32 nt, Human
agucccagcuacuuuggaggcugaggcaggag

SEQ ID NO: 60685 - RNA, 32 nt, Human
agucccagcuagucaagaggcugaggccagag

SEQ ID NO: 60686 - RNA, 32 nt, Human
agucccagcuagucgggaggcugaggcaggag

SEQ ID NO: 60687 - RNA, 32 nt, Human
agucccagcuauuccagggggcugaggcagga

SEQ ID NO: 60688 - RNA, 20 nt, Human
agucccagcuccacacugcc

SEQ ID NO: 60689 - RNA, 32 nt, Human
agucccagcugcucgggaggcugaggcaggag

SEQ ID NO: 60690 - RNA, 32 nt, Human
agucccagcugcucgggaggcugaggcagggg

SEQ ID NO: 60691 - RNA, 32 nt, Human
agucccagcugcucgggagggugaggcaggag

SEQ ID NO: 60692 - RNA, 32 nt, Human
agucccagcugcucggggaggcugagguagga

SEQ ID NO: 60693 - RNA, 22 nt, Human
agucccagcuggagaguccagg

SEQ ID NO: 60694 - RNA, 32 nt, Human
agucccagcuucucgggaggcugaggcaggag

SEQ ID NO: 60695 - RNA, 18 nt, Human
agucccagcuuucucugg

SEQ ID NO: 60696 - RNA, 32 nt, Human
agucccaggaggauggggaccaggaaggcugu

SEQ ID NO: 60697 - RNA, 32 nt, Human
agucccagggaccugggcaggcccaagcccac

SEQ ID NO: 60698 - RNA, 32 nt, Human
agucccagguacucgggaggcugaggcaggag

SEQ ID NO: 60699 - RNA, 19 nt, Human
agucccaguagcaaccgcc

SEQ ID NO: 60700 - RNA, 32 nt, Human
agucccaguccaaacucugauuuacaucacuu

SEQ ID NO: 60701 - RNA, 32 nt, Human
agucccaguuacucaguagacugagcucuuuu

SEQ ID NO: 60702 - RNA, 32 nt, Human
agucccaguuacucgggaggcugaggcacgag

SEQ ID NO: 60703 - RNA, 32 nt, Human
agucccaguuacucgggaggcugaggcaggag

SEQ ID NO: 60704 - RNA, 32 nt, Human
agucccaguuacucggguggcugaggcaggag

SEQ ID NO: 60705 - RNA, 32 nt, Human
agucccaguuccagggggaggccugcaggccc

SEQ ID NO: 60706 - RNA, 32 nt, Human
agucccauaccagacucacggucuccauuauu

SEQ ID NO: 60707 - RNA, 32 nt, Human
agucccauauucccucaaauuugggaaucacg

SEQ ID NO: 60708 - RNA, 32 nt, Human
agucccauccacugcaccacuacucccaagcc

SEQ ID NO: 60709 - RNA, 32 nt, Human
agucccaucugacuccccaugaggcuccuggc

SEQ ID NO: 60710 - RNA, 32 nt, Human
agucccaugaagugggcaccauugcuauugcc

SEQ ID NO: 60711 - RNA, 32 nt, Human
agucccaugaucaccccagccugugagaggca

SEQ ID NO: 60712 - RNA, 32 nt, Human
agucccaugaucgccccagccugugagcggca

SEQ ID NO: 60713 - RNA, 32 nt, Human
agucccaugauuaccccagccugugagcggca

SEQ ID NO: 60714 - RNA, 32 nt, Human
agucccaugauuaccccagccugugaguggca

SEQ ID NO: 60715 - RNA, 32 nt, Human
agucccaugccacccguccccuugugaccucc

SEQ ID NO: 60716 - RNA, 32 nt, Human
agucccauggggaaugucaacaggcaggggca

SEQ ID NO: 60717 - RNA, 32 nt, Human
aguccccaaaaacagguggaagagggaagggu

SEQ ID NO: 60718 - RNA, 32 nt, Human
aguccccaacacagugacucugaccuggaacc

SEQ ID NO: 60719 - RNA, 32 nt, Human
aguccccacaccuuggcagcucagggucccca

SEQ ID NO: 60720 - RNA, 32 nt, Human
aguccccacacuggaaaacugggaaauggcca

SEQ ID NO: 60721 - RNA, 31 nt, Human
aguccccacagcuagaaagugccagagucgu

SEQ ID NO: 60722 - RNA, 32 nt, Human
aguccccacagcuggaucagacaacuuuuggu

SEQ ID NO: 60723 - RNA, 32 nt, Human
aguccccacauacucagucaguuaucaaagua

SEQ ID NO: 60724 - RNA, 32 nt, Human
aguccccaccacagugaccacacccucacugg

SEQ ID NO: 60725 - RNA, 21 nt, Human
aguccccaccucuuccugccc

SEQ ID NO: 60726 - RNA, 32 nt, Human
aguccccacucacggugacaccaccuuccuga

SEQ ID NO: 60727 - RNA, 32 nt, Human
aguccccacugcacccccuccagaggcgacuu

SEQ ID NO: 60728 - RNA, 32 nt, Human
aguccccagaaugcugcgcuucuccuacaagg

SEQ ID NO: 60729 - RNA, 32 nt, Human
aguccccagagcaggccguacccugcuguagu

SEQ ID NO: 60730 - RNA, 32 nt, Human
aguccccaggagaggggagcuguguagugagg

SEQ ID NO: 60731 - RNA, 32 nt, Human
aguccccaggcaggaagcggguuuguuuugga

SEQ ID NO: 60732 - RNA, 32 nt, Human
aguccccagggugggggugccaggagcccuug

SEQ ID NO: 60733 - RNA, 32 nt, Human
aguccccaguucacccuccaucccucaccuuc

SEQ ID NO: 60734 - RNA, 32 nt, Human
aguccccaucuucacucuacccuucaggaccc

SEQ ID NO: 60735 - RNA, 32 nt, Human
agucccccaaaguggugggauuacagguggga

SEQ ID NO: 60736 - RNA, 22 nt, Human
agucccccaauuauuuuucuaa

SEQ ID NO: 60737 - RNA, 32 nt, Human
agucccccgaguagcugggauuacagaugccc

SEQ ID NO: 60738 - RNA, 32 nt, Human
agucccccgauuagcuggaauuacaggugccu

SEQ ID NO: 60739 - RNA, 32 nt, Human
agucccccucacaaaccaccccacagauccaa

SEQ ID NO: 60740 - RNA, 32 nt, Human
agucccccucagacuucaugucucugcucauc

SEQ ID NO: 60741 - RNA, 32 nt, Human
agucccccuccaccaccaccgccuccuacccu

SEQ ID NO: 60742 - RNA, 32 nt, Human
agucccccugagcuccagggcccagcccuacc

SEQ ID NO: 60743 - RNA, 32 nt, Human
agucccccugccagaauggaggccagugcaug

SEQ ID NO: 60744 - RNA, 21 nt, Human
aguccccggagcugcggucuc

SEQ ID NO: 60745 - RNA, 31 nt, Human
aguccccggcgcucugagguuggagagaaag

SEQ ID NO: 60746 - RNA, 22 nt, Human
aguccccgugaaggagagcccu

SEQ ID NO: 60747 - RNA, 32 nt, Human
aguccccuacucccucuucacuguggccacag

SEQ ID NO: 60748 - RNA, 32 nt, Human
aguccccucauuagacuguagcauuaggaugu

SEQ ID NO: 60749 - RNA, 32 nt, Human
aguccccucccgcuucugcagaaugcaugcuc

SEQ ID NO: 60750 - RNA, 24 nt, Human
aguccccugaguccucccaaguga

SEQ ID NO: 60751 - RNA, 32 nt, Human
aguccccugccugugcuccugcuggggaaggc

SEQ ID NO: 60752 - RNA, 32 nt, Human
aguccccugcugucugucugugggagucggac

SEQ ID NO: 60753 - RNA, 32 nt, Human
aguccccuuacaagaccucuggcuugggccgg

SEQ ID NO: 60754 - RNA, 32 nt, Human
aguccccuucacugcagagccuugccuuuccc

SEQ ID NO: 60755 - RNA, 32 nt, Human
aguccccuuccaucccagagggugggcuucag

SEQ ID NO: 60756 - RNA, 32 nt, Human
aguccccuuuuguuguagcuucaccucguuug

SEQ ID NO: 60757 - RNA, 32 nt, Human
agucccgagagugucagacaaggaagaaaucc

SEQ ID NO: 60758 - RNA, 32 nt, Human
agucccgagcucccagaaaugccacaugaugg

SEQ ID NO: 60759 - RNA, 32 nt, Human
agucccgccacugcacuccagccugggcaaca

SEQ ID NO: 60760 - RNA, 32 nt, Human
agucccgccagccucagccaggugggccugua

SEQ ID NO: 60761 - RNA, 32 nt, Human
agucccgcccuccuugcugucacaggugcagc

SEQ ID NO: 60762 - RNA, 20 nt, Human
agucccgcgggccgugcgcg

SEQ ID NO: 60763 - RNA, 32 nt, Human
agucccgcucugucacgcaggcugccaggcug

SEQ ID NO: 60764 - RNA, 32 nt, Human
agucccgcuguggagcugucagucaccggagu

SEQ ID NO: 60765 - RNA, 32 nt, Human
agucccggcuacucgggaggcugaggcaggag

SEQ ID NO: 60766 - RNA, 32 nt, Human
agucccgguuacucgggaggcugagacaggag

SEQ ID NO: 60767 - RNA, 32 nt, Human
agucccgguuagugaaaagguuugacccugau

SEQ ID NO: 60768 - RNA, 32 nt, Human
agucccgucagucacagcaacaggaggucuuc

SEQ ID NO: 60769 - RNA, 32 nt, Human
agucccgucccaggcucugggcucgggcagcc

SEQ ID NO: 60770 - RNA, 32 nt, Human
agucccguggagcccgccucuccagucccagc

SEQ ID NO: 60771 - RNA, 32 nt, Human
agucccuauuuggcuaccuacuucucuacauu

SEQ ID NO: 60772 - RNA, 32 nt, Human
agucccucacccccaacccccaugcuguuugu

SEQ ID NO: 60773 - RNA, 32 nt, Human
agucccucagucagguggugcuaguagagcua

SEQ ID NO: 60774 - RNA, 32 nt, Human
agucccuccaccaagauucaguagaagaaaua

SEQ ID NO: 60775 - RNA, 32 nt, Human
agucccucccacucccacucacugacccuguc

SEQ ID NO: 60776 - RNA, 32 nt, Human
agucccuccguucuccccuuugaccauguaau

SEQ ID NO: 60777 - RNA, 32 nt, Human
agucccuccuagacuccugggccccaugaccu

SEQ ID NO: 60778 - RNA, 32 nt, Human
agucccucucucucugcaacacucuccucaug

SEQ ID NO: 60779 - RNA, 32 nt, Human
agucccucuugcacugugcucucucccgucuc

SEQ ID NO: 60780 - RNA, 32 nt, Human
agucccugaaauguagauaggggccaccuaga

SEQ ID NO: 60781 - RNA, 32 nt, Human
agucccugaacucucgcuuucuuuuuaauccc

SEQ ID NO: 60782 - RNA, 32 nt, Human
agucccugagccgccucauggccacacucagc

SEQ ID NO: 60783 - RNA, 32 nt, Human
agucccugcagcgcggccucggcuaggcuccg

SEQ ID NO: 60784 - RNA, 32 nt, Human
agucccugcagcucagcacccccagccuggug

SEQ ID NO: 60785 - RNA, 32 nt, Human
agucccugcaggugaauaaacacacagaucug

SEQ ID NO: 60786 - RNA, 32 nt, Human
agucccugcggccucccaccucccugccuuuc

SEQ ID NO: 60787 - RNA, 32 nt, Human
agucccugcuggcccagcugagcuccacauag

SEQ ID NO: 60788 - RNA, 32 nt, Human
agucccugcuggggaagaacagccccggggcc

SEQ ID NO: 60789 - RNA, 32 nt, Human
agucccugcuuauucauguggagcagcagcua

SEQ ID NO: 60790 - RNA, 21 nt, Human
agucccuggaagcugagcucu

SEQ ID NO: 60791 - RNA, 32 nt, Human
agucccuggcauuuagucaucugugauuguuu

SEQ ID NO: 60792 - RNA, 32 nt, Human
agucccuggccucucccccuggcugaucacuc

SEQ ID NO: 60793 - RNA, 32 nt, Human
agucccugggagcccgaagugggugggcacag

SEQ ID NO: 60794 - RNA, 19 nt, Human
agucccugggcacccagga

SEQ ID NO: 60795 - RNA, 32 nt, Human
agucccugggcuggggaagacagauccaccau

SEQ ID NO: 60796 - RNA, 32 nt, Human
agucccuguacaguuucuuccucuguccaaag

SEQ ID NO: 60797 - RNA, 32 nt, Human
agucccuuauuuggaagagagaaaggaugugu

SEQ ID NO: 60798 - RNA, 32 nt, Human
agucccuucccccugaagcaauagccccuccc

SEQ ID NO: 60799 - RNA, 32 nt, Human
agucccuucgcugguaggcccuucuucaguca

SEQ ID NO: 60800 - RNA, 32 nt, Human
agucccuucuuuccucacugcuccucuccacc

SEQ ID NO: 60801 - RNA, 32 nt, Human
agucccuugagccacagcauggggcuacagaa

SEQ ID NO: 60802 - RNA, 32 nt, Human
agucccuuucauuggggaucagucccauuaaa

SEQ ID NO: 60803 - RNA, 32 nt, Human
agucccuuuccaaagcugcccccaccacccug

SEQ ID NO: 60804 - RNA, 32 nt, Human
agucccuuucuccuggauuccaugucuugaau

SEQ ID NO: 60805 - RNA, 32 nt, Human
aguccgagcuacucgggaggcugaggcagaag

SEQ ID NO: 60806 - RNA, 32 nt, Human
aguccgaggaggaggagaaggaggccugcaga

SEQ ID NO: 60807 - RNA, 32 nt, Human
aguccgaggccgcggccguggcgcugggcggc

SEQ ID NO: 60808 - RNA, 32 nt, Human
aguccgaguggagagagcgagcugagugguug

SEQ ID NO: 60809 - RNA, 21 nt, Human
aguccgaucacagaggcaggg

SEQ ID NO: 60810 - RNA, 32 nt, Human
aguccgaugaaugugcuugcucugcuggagga

SEQ ID NO: 60811 - RNA, 18 nt, Human
aguccgcaggaggcugug

SEQ ID NO: 60812 - RNA, 32 nt, Human
aguccgcaucucagcccccaggaagaggaaga

SEQ ID NO: 60813 - RNA, 32 nt, Human
aguccgcaucuguguguaucaucaauaaaguu

SEQ ID NO: 60814 - RNA, 32 nt, Human
aguccgccccaccacacuccccgccuguccug

SEQ ID NO: 60815 - RNA, 32 nt, Human
aguccggaaucagguugccuugcuugaaaucc

SEQ ID NO: 60816 - RNA, 32 nt, Human
aguccggacucgugggagacgaucgcgaugaa

SEQ ID NO: 60817 - RNA, 32 nt, Human
aguccggcucacugcaguuuugaccucccagg

SEQ ID NO: 60818 - RNA, 32 nt, Human
aguccgggaggaaguucugcccggcgcucucc

SEQ ID NO: 60819 - RNA, 32 nt, Human
aguccgggaggcaccguccggcggcgagcucu

SEQ ID NO: 60820 - RNA, 32 nt, Human
aguccgggaguuugagucugcagugagcuaug

SEQ ID NO: 60821 - RNA, 32 nt, Human
aguccgggugcucaccucuuguggaacgugca

SEQ ID NO: 60822 - RNA, 31 nt, Human
aguccguagagaccugcgcaggagccgggac

SEQ ID NO: 60823 - RNA, 32 nt, Human
aguccgucaccugaaaucauauucauguauaa

SEQ ID NO: 60824 - RNA, 32 nt, Human
aguccgugugugucuguguuguuguucggcgg

SEQ ID NO: 60825 - RNA, 32 nt, Human
aguccguuagccucucugggccucuguccauc

SEQ ID NO: 60826 - RNA, 32 nt, Human
aguccuaaaacaguaaccgugucuacauaacg

SEQ ID NO: 60827 - RNA, 32 nt, Human
aguccuaaaaggauacuuuggaacuuaacauu

SEQ ID NO: 60828 - RNA, 24 nt, Human
aguccuaacccccaguaacuguga

SEQ ID NO: 60829 - RNA, 32 nt, Human
aguccuacaccuugcccugccugggcuuuggu

SEQ ID NO: 60830 - RNA, 32 nt, Human
aguccuaccaguuaucggaggcugcgggacug

SEQ ID NO: 60831 - RNA, 32 nt, Human
aguccuagaagaaagagcagagagggagacug

SEQ ID NO: 60832 - RNA, 32 nt, Human
aguccuagaggaccugagucugcuauauuuuc

SEQ ID NO: 60833 - RNA, 32 nt, Human
aguccuagccccagagccccagccccucaugu

SEQ ID NO: 60834 - RNA, 18 nt, Human
aguccuagccgcguguga

SEQ ID NO: 60835 - RNA, 32 nt, Human
aguccuagccugguaaagacccuccaccaccc

SEQ ID NO: 60836 - RNA, 32 nt, Human
aguccuagcuacucagaagacugaggcuggag

SEQ ID NO: 60837 - RNA, 32 nt, Human
aguccuagcuacucaggaggcugagaugggag

SEQ ID NO: 60838 - RNA, 32 nt, Human
aguccuagcuacucaggaggcugaggcaggag

SEQ ID NO: 60839 - RNA, 32 nt, Human
aguccuagcuacucaggaggcugaggugggag

SEQ ID NO: 60840 - RNA, 32 nt, Human
aguccuagcuacuccggaggcugagccaggag

SEQ ID NO: 60841 - RNA, 32 nt, Human
aguccuagcuacucgagaggcugaggcaggag

SEQ ID NO: 60842 - RNA, 32 nt, Human
aguccuagcuacucggaaggcugaggcaggag

SEQ ID NO: 60843 - RNA, 32 nt, Human
aguccuagcuacucgggaggcugaggcacgag

SEQ ID NO: 60844 - RNA, 32 nt, Human
aguccuagcuacucgggaggcugaggcaggag

SEQ ID NO: 60845 - RNA, 32 nt, Human
aguccuagcuacucggggaggcugaggcagga

SEQ ID NO: 60846 - RNA, 32 nt, Human
aguccuagcugcucgggaggcugaggcaggag

SEQ ID NO: 60847 - RNA, 32 nt, Human
aguccuagcugguuccagcaaacaccaacguu

SEQ ID NO: 60848 - RNA, 32 nt, Human
aguccuaggaagagagaggcaccagaggcacc

SEQ ID NO: 60849 - RNA, 32 nt, Human
aguccuaggauuauaggcaugagccacugugc

SEQ ID NO: 60850 - RNA, 32 nt, Human
aguccuaggcugcacaccucacaagcaucucu

SEQ ID NO: 60851 - RNA, 32 nt, Human
aguccuaggcuggacagcaaugggcugcaauu

SEQ ID NO: 60852 - RNA, 32 nt, Human
aguccuauacaaaaauuagcugggcguggugg

SEQ ID NO: 60853 - RNA, 32 nt, Human
aguccuaugaggacaaagaggcuuccaugacc

SEQ ID NO: 60854 - RNA, 32 nt, Human
aguccucaaagcagcuccugaaggucuguguu

SEQ ID NO: 60855 - RNA, 32 nt, Human
aguccucaaucagccucuccaacugccaccaa

SEQ ID NO: 60856 - RNA, 32 nt, Human
aguccucacaaacccacuuuuccucuugccug

SEQ ID NO: 60857 - RNA, 32 nt, Human
aguccucacaacaaauccaggcugcagauuuu

SEQ ID NO: 60858 - RNA, 18 nt, Human
aguccucacaccccuguc

SEQ ID NO: 60859 - RNA, 32 nt, Human
aguccucaccagaagaacaggucucacaagua

SEQ ID NO: 60860 - RNA, 32 nt, Human
aguccucacccuuaacuucugccaugggaauu

SEQ ID NO: 60861 - RNA, 32 nt, Human
aguccucaccugcugguuuggagacucaugag

SEQ ID NO: 60862 - RNA, 22 nt, Human
aguccucacuggaacccgccca

SEQ ID NO: 60863 - RNA, 32 nt, Human
aguccucagcugcagccuucucugaauacagu

SEQ ID NO: 60864 - RNA, 32 nt, Human
aguccucagggcagaaaaggggccaguacauc

SEQ ID NO: 60865 - RNA, 32 nt, Human
aguccucagggucucacacccucagugcugau

SEQ ID NO: 60866 - RNA, 32 nt, Human
aguccucaucugagucucagccuggguccccc

SEQ ID NO: 60867 - RNA, 22 nt, Human
aguccucauggagacucugccg

SEQ ID NO: 60868 - RNA, 20 nt, Human
aguccucaugugcccagaga

SEQ ID NO: 60869 - RNA, 32 nt, Human
aguccuccacucgcaucucccuccccugccag

SEQ ID NO: 60870 - RNA, 20 nt, Human
aguccucccaagcugugcug

SEQ ID NO: 60871 - RNA, 32 nt, Human
aguccucccacuuuaccauccuccuuccuccc

SEQ ID NO: 60872 - RNA, 32 nt, Human
aguccuccccacccuccuuccucugucucccu

SEQ ID NO: 60873 - RNA, 31 nt, Human
aguccuccccacucugggcuugugcacacug

SEQ ID NO: 60874 - RNA, 32 nt, Human
aguccucccccuucuccugcagucucuggagg

SEQ ID NO: 60875 - RNA, 32 nt, Human
aguccuccgggggaggaggguguagcuggcau

SEQ ID NO: 60876 - RNA, 32 nt, Human
aguccuccucagacacuggagcagggaggcac

SEQ ID NO: 60877 - RNA, 32 nt, Human
aguccuccuccacuacaaccuccaugaccuug

SEQ ID NO: 60878 - RNA, 32 nt, Human
aguccuccucguuccucuccccaccgccuggc

SEQ ID NO: 60879 - RNA, 32 nt, Human
aguccuccuguccaaucucccugccauuucuc

SEQ ID NO: 60880 - RNA, 32 nt, Human
aguccuccuuaaccacuuaucucccauaugag

SEQ ID NO: 60881 - RNA, 32 nt, Human
aguccuccuucccagcucuacauucugcucug

SEQ ID NO: 60882 - RNA, 32 nt, Human
aguccucgagcaccuggccuguuugcucacau

SEQ ID NO: 60883 - RNA, 32 nt, Human
aguccucggaaccaagcuuacucucauggccg

SEQ ID NO: 60884 - RNA, 32 nt, Human
aguccucggauuacaggcaugagccaccacac

SEQ ID NO: 60885 - RNA, 32 nt, Human
aguccucucucaucuggugaucuucuuuucca

SEQ ID NO: 60886 - RNA, 32 nt, Human
aguccucugauuuuuccuccauccugcuuacc

SEQ ID NO: 60887 - RNA, 32 nt, Human
aguccucugcaucccaacauucccaggacaug

SEQ ID NO: 60888 - RNA, 32 nt, Human
aguccucugcuucaguuucauuguuaacgggc

SEQ ID NO: 60889 - RNA, 32 nt, Human
aguccucuguauccucaugagauaacgagagg

SEQ ID NO: 60890 - RNA, 18 nt, Human
aguccucuguuccuccca

SEQ ID NO: 60891 - RNA, 19 nt, Human
aguccucuugcacaucuaa

SEQ ID NO: 60892 - RNA, 21 nt, Human
aguccucuuggacacagguug

SEQ ID NO: 60893 - RNA, 32 nt, Human
aguccucuuuuucucacuaccaccugcagggu

SEQ ID NO: 60894 - RNA, 32 nt, Human
aguccugaaaacaaacugaggacuuuaguggu

SEQ ID NO: 60895 - RNA, 32 nt, Human
aguccugaaguagaugguugagauaugaguuc

SEQ ID NO: 60896 - RNA, 21 nt, Human
aguccugagaacuaauuguca

SEQ ID NO: 60897 - RNA, 32 nt, Human
aguccugagagcagcaucucuguccccacggu

SEQ ID NO: 60898 - RNA, 32 nt, Human
aguccugagagugucagacaaggaagaaaucc

SEQ ID NO: 60899 - RNA, 24 nt, Human
aguccugagcuugguuucuuccca

SEQ ID NO: 60900 - RNA, 19 nt, Human
aguccugaggacccaggag

SEQ ID NO: 60901 - RNA, 32 nt, Human
aguccugagugacccagagcaacuuugcgguu

SEQ ID NO: 60902 - RNA, 23 nt, Human
aguccugagugagcuuucuguua

SEQ ID NO: 60903 - RNA, 32 nt, Human
aguccugcaaauccaaauccacacaacuguaa

SEQ ID NO: 60904 - RNA, 32 nt, Human
aguccugcaaggaaagcaacauggaaaacagc

SEQ ID NO: 60905 - RNA, 32 nt, Human
aguccugcaccaggccugggugaguggaugcg

SEQ ID NO: 60906 - RNA, 32 nt, Human
aguccugcagagccucugggcugggcuggugc

SEQ ID NO: 60907 - RNA, 32 nt, Human
aguccugcagcuucccccuccuucccugucag

SEQ ID NO: 60908 - RNA, 32 nt, Human
aguccugccacauuccccucacugagauggua

SEQ ID NO: 60909 - RNA, 19 nt, Human
aguccugcccugccuuccu

SEQ ID NO: 60910 - RNA, 32 nt, Human
aguccugccuggccaggcagaucugugcccca

SEQ ID NO: 60911 - RNA, 32 nt, Human
aguccugccuggggucaggcccucacugaccc

SEQ ID NO: 60912 - RNA, 32 nt, Human
aguccugccuggguccuggugccuuggacccc

SEQ ID NO: 60913 - RNA, 32 nt, Human
aguccugccuuuccuuucaucaucccaaauuu

SEQ ID NO: 60914 - RNA, 32 nt, Human
aguccugcgugggccacguaggaagcagcgug

SEQ ID NO: 60915 - RNA, 32 nt, Human
aguccugcuccccucaccuuccuugggcccgu

SEQ ID NO: 60916 - RNA, 32 nt, Human
aguccugcuccgacaccaccuccacaggggaa

SEQ ID NO: 60917 - RNA, 21 nt, Human
aguccugcuccuuucugccca

SEQ ID NO: 60918 - RNA, 32 nt, Human
aguccugcucgcugcacccucuagccugacgu

SEQ ID NO: 60919 - RNA, 32 nt, Human
aguccugcucuccgcacgccaccuuaggcccg

SEQ ID NO: 60920 - RNA, 32 nt, Human
aguccugcuggguuugggcaaugucucagcag

SEQ ID NO: 60921 - RNA, 32 nt, Human
aguccugcugucccucagcugagaaucaaacc

SEQ ID NO: 60922 - RNA, 32 nt, Human
aguccugcuuccagaauuuggaaauccuaguu

SEQ ID NO: 60923 - RNA, 17 nt, Human
aguccugcuuggccuga

SEQ ID NO: 60924 - RNA, 32 nt, Human
aguccuggaaacacuuucaaccuagaguaguu

SEQ ID NO: 60925 - RNA, 32 nt, Human
aguccuggaagagagagaugagccagggcagu

SEQ ID NO: 60926 - RNA, 32 nt, Human
aguccuggaaguugaagguggagauggcccuu

SEQ ID NO: 60927 - RNA, 32 nt, Human
aguccuggaggaagcagacaaugaagggagca

SEQ ID NO: 60928 - RNA, 32 nt, Human
aguccuggcaaaugaagguggggcggggcagu

SEQ ID NO: 60929 - RNA, 32 nt, Human
aguccuggcauuaugucuaggacuaaagcagu

SEQ ID NO: 60930 - RNA, 32 nt, Human
aguccuggccagcauggugaaaccccaucucu

SEQ ID NO: 60931 - RNA, 32 nt, Human
aguccuggcccuggcccuggcauaucaccccg

SEQ ID NO: 60932 - RNA, 30 nt, Human
aguccuggccucuccauuuacuucuuccca

SEQ ID NO: 60933 - RNA, 32 nt, Human
aguccuggcuuccccugcaugaaggugacagu

SEQ ID NO: 60934 - RNA, 32 nt, Human
aguccugggauuacaggcgugagccacugugc

SEQ ID NO: 60935 - RNA, 32 nt, Human
aguccugggauuacaggcugagccaccgcgac

SEQ ID NO: 60936 - RNA, 19 nt, Human
aguccugggauuacaggug

SEQ ID NO: 60937 - RNA, 32 nt, Human
aguccugggauuacaggugugagccaccacau

SEQ ID NO: 60938 - RNA, 32 nt, Human
aguccuggggacuuccuugaagcaucauuuuc

SEQ ID NO: 60939 - RNA, 32 nt, Human
aguccuggggguaaagcccucagaucccaggg

SEQ ID NO: 60940 - RNA, 32 nt, Human
aguccuggucaaggagaucuaggucuacucca

SEQ ID NO: 60941 - RNA, 32 nt, Human
aguccuggucagagcagucaggaagcagaaaa

SEQ ID NO: 60942 - RNA, 32 nt, Human
aguccuggucccagcaguaugugugcugacuu

SEQ ID NO: 60943 - RNA, 32 nt, Human
aguccugguccuuccacugugcaccugcgcgg

SEQ ID NO: 60944 - RNA, 32 nt, Human
aguccugguuuccuggcagccugcugcgcgug

SEQ ID NO: 60945 - RNA, 32 nt, Human
aguccugguuucuuuuucucauggaagaaaug

SEQ ID NO: 60946 - RNA, 32 nt, Human
aguccuguagggaaccaguuuccagaagaggu

SEQ ID NO: 60947 - RNA, 32 nt, Human
aguccuguaggucagccuuucucacaaacucu

SEQ ID NO: 60948 - RNA, 32 nt, Human
aguccuguauuggaguucuacuuccaaauucu

SEQ ID NO: 60949 - RNA, 32 nt, Human
aguccugucauccuggucaggacuagucgcgu

SEQ ID NO: 60950 - RNA, 32 nt, Human
aguccuguccugccucagggcuuuucggagcc

SEQ ID NO: 60951 - RNA, 32 nt, Human
aguccugucuguuuauagugcugguaguauca

SEQ ID NO: 60952 - RNA, 32 nt, Human
aguccuguggugaggcccaugucaagaaggcc

SEQ ID NO: 60953 - RNA, 32 nt, Human
aguccuguuacaaaauagauaacugagcaccu

SEQ ID NO: 60954 - RNA, 32 nt, Human
aguccuguuagagauucaguagauggagccac

SEQ ID NO: 60955 - RNA, 32 nt, Human
aguccuguugguuggucaucuuugucacuucu

SEQ ID NO: 60956 - RNA, 21 nt, Human
aguccuguuguccugucauca

SEQ ID NO: 60957 - RNA, 32 nt, Human
aguccuguuucuugcuuccugccucugacuuu

SEQ ID NO: 60958 - RNA, 32 nt, Human
aguccuuaccauugggucuaaggcaguuucca

SEQ ID NO: 60959 - RNA, 31 nt, Human
aguccuucaauaaaaagcugcuuauugaaaa

SEQ ID NO: 60960 - RNA, 32 nt, Human
aguccuuccagaggagggcuggagggacagga

SEQ ID NO: 60961 - RNA, 32 nt, Human
aguccuucccacugcacuccccaguggcuggc

SEQ ID NO: 60962 - RNA, 32 nt, Human
aguccuucccagcauacacacagggaaacaaa

SEQ ID NO: 60963 - RNA, 32 nt, Human
aguccuugaaaccauuuaggagacugcuacag

SEQ ID NO: 60964 - RNA, 32 nt, Human
aguccuugaaacugagccccauucugaauccc

SEQ ID NO: 60965 - RNA, 21 nt, Human
aguccuugaagaauggguucu

SEQ ID NO: 60966 - RNA, 32 nt, Human
aguccuugauuguucgggugugcaaugucuga

SEQ ID NO: 60967 - RNA, 32 nt, Human
aguccuugcagcuggucuuuggcauugacgug

SEQ ID NO: 60968 - RNA, 31 nt, Human
aguccuugcauucaaaggguuggagauugcu

SEQ ID NO: 60969 - RNA, 32 nt, Human
aguccuugcccaggcuggagugcaguggcgcg

SEQ ID NO: 60970 - RNA, 28 nt, Human
aguccuugcccugcugccuccucauacc

SEQ ID NO: 60971 - RNA, 32 nt, Human
aguccuugcuguccacuccugcccucagucug

SEQ ID NO: 60972 - RNA, 32 nt, Human
aguccuuggacacaacgcggagcggggcugag

SEQ ID NO: 60973 - RNA, 32 nt, Human
aguccuuggugucagggagcccccaggccgca

SEQ ID NO: 60974 - RNA, 29 nt, Human
aguccuugucauugugugccuggcagugg

SEQ ID NO: 60975 - RNA, 32 nt, Human
aguccuugucauugugugccuggcaguggggg

SEQ ID NO: 60976 - RNA, 32 nt, Human
aguccuuguuguaggaguugcucucugaaugc

SEQ ID NO: 60977 - RNA, 32 nt, Human
aguccuuucagccucagaggucacagugggug

SEQ ID NO: 60978 - RNA, 32 nt, Human
aguccuuucaggaagguggagcugcauugguu

SEQ ID NO: 60979 - RNA, 19 nt, Human
aguccuuucccguccuccu

SEQ ID NO: 60980 - RNA, 32 nt, Human
aguccuuuccucacccaccccacaccaucacu

SEQ ID NO: 60981 - RNA, 32 nt, Human
aguccuuucgugccgcugccuuccucggccgc

SEQ ID NO: 60982 - RNA, 32 nt, Human
aguccuuugcaaaggcaccccuugucuuaaaa

SEQ ID NO: 60983 - RNA, 32 nt, Human
aguccuuuggccugggagguccaggcugcaau

SEQ ID NO: 60984 - RNA, 32 nt, Human
aguccuuugggguugagggagaugggagcuag

SEQ ID NO: 60985 - RNA, 32 nt, Human
aguccuuuugaaggccuauccucugcucugua

SEQ ID NO: 60986 - RNA, 32 nt, Human
agucgaagcuacucaggaggcugaggcagaag

SEQ ID NO: 60987 - RNA, 32 nt, Human
agucgaagugcuugguucuaaaugucuaaaca

SEQ ID NO: 60988 - RNA, 32 nt, Human
agucgacugucgucuucuguuagugccaugcg

SEQ ID NO: 60989 - RNA, 32 nt, Human
agucgagaaaagagcccauuugcagauggagg

SEQ ID NO: 60990 - RNA, 32 nt, Human
agucgagagccagccaauagauggaauggagg

SEQ ID NO: 60991 - RNA, 32 nt, Human
agucgagagcccagaguugagacacacuggga

SEQ ID NO: 60992 - RNA, 32 nt, Human
agucgagaucauugcacuccagccugggcaau

SEQ ID NO: 60993 - RNA, 32 nt, Human
agucgagcaagaauuagcaugugcguagugaa

SEQ ID NO: 60994 - RNA, 32 nt, Human
agucgaggcugcagugagcccagaucgagcca

SEQ ID NO: 60995 - RNA, 32 nt, Human
agucgaggggcggagagagggggccggaggag

SEQ ID NO: 60996 - RNA, 32 nt, Human
agucgaucagccagaggcagcagcaguggacu

SEQ ID NO: 60997 - RNA, 32 nt, Human
agucgaugcucaauaaauguguguugacugca

SEQ ID NO: 60998 - RNA, 32 nt, Human
agucgcaauaacaugucugcucccgagguuaa

SEQ ID NO: 60999 - RNA, 32 nt, Human
agucgcacucuuacaacaagcuucuggguuuu

SEQ ID NO: 61000 - RNA, 32 nt, Human
agucgcagcuacuagggaaguugaggcaggag

SEQ ID NO: 61001 - RNA, 32 nt, Human
agucgcagcuacucagaaggcugaggugggag

SEQ ID NO: 61002 - RNA, 32 nt, Human
agucgcagcuacucaggaggcugaggcgggag

SEQ ID NO: 61003 - RNA, 32 nt, Human
agucgcagcuacucgcgagguugaggcaggag

SEQ ID NO: 61004 - RNA, 32 nt, Human
agucgcagcuacuggggaggcugaggcaggag

SEQ ID NO: 61005 - RNA, 32 nt, Human
agucgcagcuacuugggaggcuggggcaggag

SEQ ID NO: 61006 - RNA, 32 nt, Human
agucgcaggacccggccgccagccucucccuc

SEQ ID NO: 61007 - RNA, 32 nt, Human
agucgcaguugacugagcauagaggaaacagg

SEQ ID NO: 61008 - RNA, 32 nt, Human
agucgcaucuggggcugaugggagacagugac

SEQ ID NO: 61009 - RNA, 32 nt, Human
agucgccacuggcugccugaggugcucuuaca

SEQ ID NO: 61010 - RNA, 32 nt, Human
agucgccaggcaggaggccauuccaggagugg

SEQ ID NO: 61011 - RNA, 22 nt, Human
agucgcccaggcuggagugcag

SEQ ID NO: 61012 - RNA, 32 nt, Human
agucgcccccagcuggguugugcuccacugug

SEQ ID NO: 61013 - RNA, 32 nt, Human
agucgccccgaccuuucucugcgcaguacggc

SEQ ID NO: 61014 - RNA, 22 nt, Human
agucgcccgggagcaggugcug

SEQ ID NO: 61015 - RNA, 32 nt, Human
agucgcccuaggaacaccagauuuccugguuc

SEQ ID NO: 61016 - RNA, 32 nt, Human
agucgcccucugugugcaggcagcagcugccu

SEQ ID NO: 61017 - RNA, 32 nt, Human
agucgccgaggcaccucugagcuagacagacc

SEQ ID NO: 61018 - RNA, 18 nt, Human
agucgccgcaacugcagc

SEQ ID NO: 61019 - RNA, 32 nt, Human
agucgccugcugcacuacaugagaaagggacu

SEQ ID NO: 61020 - RNA, 32 nt, Human
agucgccuggccucuucuccccucucuuccca

SEQ ID NO: 61021 - RNA, 32 nt, Human
agucgcgcggaggcggaggcuugggugcguuc

SEQ ID NO: 61022 - RNA, 32 nt, Human
agucgcggaaggcgcgggagcuugcgugcugc

SEQ ID NO: 61023 - RNA, 32 nt, Human
agucgcggaguuuccugguuggaggcuguggc

SEQ ID NO: 61024 - RNA, 25 nt, Human
agucgcucaggcuggagugcaaugg

SEQ ID NO: 61025 - RNA, 32 nt, Human
agucgcucuaagaaucugcuugaagucucgua

SEQ ID NO: 61026 - RNA, 32 nt, Human
agucgcucucccacccagccuggacuuggccc

SEQ ID NO: 61027 - RNA, 32 nt, Human
agucgcuggcauguuucacuccugcuucucuc

SEQ ID NO: 61028 - RNA, 32 nt, Human
agucgcugugccacaggcuuagggacaggacc

SEQ ID NO: 61029 - RNA, 18 nt, Human
agucggaaaaggcugcug

SEQ ID NO: 61030 - RNA, 21 nt, Human
agucggacaggaaacaucugg

SEQ ID NO: 61031 - RNA, 32 nt, Human
agucggacgagauggagcugcucuacucagcc

SEQ ID NO: 61032 - RNA, 22 nt, Human
agucggagaaauagccagucaa

SEQ ID NO: 61033 - RNA, 32 nt, Human
agucggagaugaugcagcacacacacaauucc

SEQ ID NO: 61034 - RNA, 22 nt, Human
agucggagcaaagaacuuacca

SEQ ID NO: 61035 - RNA, 32 nt, Human
agucggagcuacaggcagugccuucagcucug

SEQ ID NO: 61036 - RNA, 32 nt, Human
agucggaggcccagggccccaagugaacugcu

SEQ ID NO: 61037 - RNA, 32 nt, Human
agucggaggcgcccucagacagcaguggcauc

SEQ ID NO: 61038 - RNA, 32 nt, Human
agucggagggccuugggcaagaucgccuccuc

SEQ ID NO: 61039 - RNA, 32 nt, Human
agucggagggcggggagcuaggaggagggagc

SEQ ID NO: 61040 - RNA, 32 nt, Human
agucggaguuugagccccggaggcagagcggc

SEQ ID NO: 61041 - RNA, 32 nt, Human
agucggauggggagagguguggaguuagaucu

SEQ ID NO: 61042 - RNA, 32 nt, Human
agucggcacugaguggcccagcaccgccuagc

SEQ ID NO: 61043 - RNA, 32 nt, Human
agucggcagcagagggaacagggaagaaaccu

SEQ ID NO: 61044 - RNA, 32 nt, Human
agucggccacugcggcccccuccugaguggga

SEQ ID NO: 61045 - RNA, 32 nt, Human
agucggcccucgggggaggccuugcccaccuu

SEQ ID NO: 61046 - RNA, 32 nt, Human
agucggccugcgcuccucagccuggcgguucu

SEQ ID NO: 61047 - RNA, 32 nt, Human
agucggccuggagucugugccugguccuuugc

SEQ ID NO: 61048 - RNA, 32 nt, Human
agucggccugggaaguucacugccccaacucu

SEQ ID NO: 61049 - RNA, 32 nt, Human
agucggcggaccacagcucagccaauuggcuu

SEQ ID NO: 61050 - RNA, 32 nt, Human
agucggcggccggacugggaagauggacgcag

SEQ ID NO: 61051 - RNA, 32 nt, Human
agucggcucaacgcaaccuccgccucccaggu

SEQ ID NO: 61052 - RNA, 32 nt, Human
agucggcugggcagggcgcagggcgcuccggc

SEQ ID NO: 61053 - RNA, 32 nt, Human
agucggcuuacccgcuggccgccuccugacaa

SEQ ID NO: 61054 - RNA, 32 nt, Human
agucgggagaucaagaccauccuggcuaacac

SEQ ID NO: 61055 - RNA, 24 nt, Human
agucgggagcgcgcgaggcgcggg

SEQ ID NO: 61056 - RNA, 32 nt, Human
agucgggaggcguggagggugaccacaccuug

SEQ ID NO: 61057 - RNA, 32 nt, Human
agucgggagggagggagcgagcaggcgaagcc

SEQ ID NO: 61058 - RNA, 32 nt, Human
agucgggcuccaggcuccuccugggucugagc

SEQ ID NO: 61059 - RNA, 32 nt, Human
agucgggcuucaucuuuacgcagcgggcccgg

SEQ ID NO: 61060 - RNA, 32 nt, Human
agucggggacaaggagcuuccgucuggcaagg

SEQ ID NO: 61061 - RNA, 32 nt, Human
agucgggggucacaagccaaagccacaccgcu

SEQ ID NO: 61062 - RNA, 32 nt, Human
agucggggugaaauaaauaccucagacugauu

SEQ ID NO: 61063 - RNA, 21 nt, Human
agucgggguuucaccauguug

SEQ ID NO: 61064 - RNA, 32 nt, Human
agucggguccugccaggcagggggccuguguu

SEQ ID NO: 61065 - RNA, 23 nt, Human
agucgggugggccgccuccccuc

SEQ ID NO: 61066 - RNA, 32 nt, Human
agucgguccugggcuggcugugguguagggcg

SEQ ID NO: 61067 - RNA, 32 nt, Human
agucggugaacugccccuggccuguguccccc

SEQ ID NO: 61068 - RNA, 32 nt, Human
agucggugagcagcugggaagagcagaaccgg

SEQ ID NO: 61069 - RNA, 32 nt, Human
agucggugcugcuggaauuacugcacagcugg

SEQ ID NO: 61070 - RNA, 32 nt, Human
agucggugggagaagggcgggagggugggccc

SEQ ID NO: 61071 - RNA, 32 nt, Human
agucguaauucauagguacugacuccucagcc

SEQ ID NO: 61072 - RNA, 32 nt, Human
agucguaguaauaugugcacacacagaagggg

SEQ ID NO: 61073 - RNA, 32 nt, Human
agucguauucuuggcauauuaugaauuucuug

SEQ ID NO: 61074 - RNA, 22 nt, Human
agucgucacgccuguaauccca

SEQ ID NO: 61075 - RNA, 19 nt, Human
agucguccagaggcugucc

SEQ ID NO: 61076 - RNA, 32 nt, Human
agucguccgccccucacgcccucucuuccucu

SEQ ID NO: 61077 - RNA, 32 nt, Human
agucgucucaacugauuuacucacuuagcuuc

SEQ ID NO: 61078 - RNA, 32 nt, Human
agucgucuccaggcugcugucacugcauccag

SEQ ID NO: 61079 - RNA, 32 nt, Human
agucgugaacugugcgagcacugugguuuaca

SEQ ID NO: 61080 - RNA, 32 nt, Human
agucgugauuaaagugauaaaaccccauaucu

SEQ ID NO: 61081 - RNA, 32 nt, Human
agucgugcccccgugaucucaaggaccggucu

SEQ ID NO: 61082 - RNA, 32 nt, Human
agucgugccgauggcucucaaauggcagagga

SEQ ID NO: 61083 - RNA, 20 nt, Human
agucgugccucugacuguua

SEQ ID NO: 61084 - RNA, 32 nt, Human
agucgugcuguccccucccucucccucagucu

SEQ ID NO: 61085 - RNA, 32 nt, Human
agucguggacggggaaaggagagaugcugguc

SEQ ID NO: 61086 - RNA, 32 nt, Human
agucguggccuccuuccagaaggaaagagauu

SEQ ID NO: 61087 - RNA, 32 nt, Human
agucgugggccccagcaaggcuggagagcagg

SEQ ID NO: 61088 - RNA, 32 nt, Human
agucguggguccuccucugucccuucauugca

SEQ ID NO: 61089 - RNA, 32 nt, Human
agucgugucauccuagggguuggggcugggca

SEQ ID NO: 61090 - RNA, 32 nt, Human
agucgugucuugugacucucccaggaaucaga

SEQ ID NO: 61091 - RNA, 32 nt, Human
agucgugugcaggagccagcagggcgccaagu

SEQ ID NO: 61092 - RNA, 32 nt, Human
agucgugugcuggagugagugcugcagaaccg

SEQ ID NO: 61093 - RNA, 32 nt, Human
agucguuaacaggaaauaguauucuugcucag

SEQ ID NO: 61094 - RNA, 32 nt, Human
agucguuggaggcuggagcgcaauggcccugc

SEQ ID NO: 61095 - RNA, 32 nt, Human
agucguuucaacucuuaaagacaucuuaaucc

SEQ ID NO: 61096 - RNA, 32 nt, Human
agucuaaaaucaaagauacauggugguagggu

SEQ ID NO: 61097 - RNA, 32 nt, Human
agucuaaaucaguaauuuagaggauagugaca

SEQ ID NO: 61098 - RNA, 32 nt, Human
agucuaacaaguccaaaagcuggagugugagg

SEQ ID NO: 61099 - RNA, 32 nt, Human
agucuaaccaucauaaagacacugccugucuu

SEQ ID NO: 61100 - RNA, 32 nt, Human
agucuaaccauggugcuauuauuaggcuugcu

SEQ ID NO: 61101 - RNA, 32 nt, Human
agucuaaccuucuguguugaugcaugaaggcu

SEQ ID NO: 61102 - RNA, 32 nt, Human
agucuaagaggauuuugaccauguagaaauuc

SEQ ID NO: 61103 - RNA, 32 nt, Human
agucuaagcaaaccccagcaggaaagcagggg

SEQ ID NO: 61104 - RNA, 32 nt, Human
agucuaagcccaaacaggaauuccuguugaau

SEQ ID NO: 61105 - RNA, 23 nt, Human
agucuaagcucugcuuaugccua

SEQ ID NO: 61106 - RNA, 32 nt, Human
agucuaagcugcacuauuugguaaaccccuug

SEQ ID NO: 61107 - RNA, 31 nt, Human
agucuaaggagaccuggcagccugagauacc

SEQ ID NO: 61108 - RNA, 32 nt, Human
agucuaauuugaggcugggugcaguggcucac

SEQ ID NO: 61109 - RNA, 32 nt, Human
agucuacacgcccuuaucuucagagaaaagau

SEQ ID NO: 61110 - RNA, 21 nt, Human
agucuacacucacaaucaucu

SEQ ID NO: 61111 - RNA, 32 nt, Human
agucuacaggcuaggugcacacuggacaguca

SEQ ID NO: 61112 - RNA, 32 nt, Human
agucuaccauuuucuugcucucccuccuuccu

SEQ ID NO: 61113 - RNA, 32 nt, Human
agucuacccagagacagagaaugugucuuuau

SEQ ID NO: 61114 - RNA, 32 nt, Human
agucuacccggaggagaaagaggcuuccgggc

SEQ ID NO: 61115 - RNA, 21 nt, Human
agucuacguugucucuuucca

SEQ ID NO: 61116 - RNA, 32 nt, Human
agucuacucaagaaaucucacaaggagauauu

SEQ ID NO: 61117 - RNA, 32 nt, Human
agucuacucuaggauuuucaacuuuuuaguuu

SEQ ID NO: 61118 - RNA, 32 nt, Human
agucuacugcguagcugggauuacaggugccc

SEQ ID NO: 61119 - RNA, 32 nt, Human
agucuacuugggaggcugaggugggagaucac

SEQ ID NO: 61120 - RNA, 32 nt, Human
agucuagacaggaaagaugcagaggaaagggg

SEQ ID NO: 61121 - RNA, 32 nt, Human
agucuagagguggacauugucagggguucugg

SEQ ID NO: 61122 - RNA, 32 nt, Human
agucuagcaggaaaggagagggagcuuucccc

SEQ ID NO: 61123 - RNA, 32 nt, Human
agucuaggcaagaugaccuguucaucaggaau

SEQ ID NO: 61124 - RNA, 32 nt, Human
agucuagggggccucaggaggagggagguggg

SEQ ID NO: 61125 - RNA, 32 nt, Human
agucuagucucgaacuccugaccuugugaucc

SEQ ID NO: 61126 - RNA, 32 nt, Human
agucuagucuugaacuccugggcuacaguuac

SEQ ID NO: 61127 - RNA, 32 nt, Human
agucuagucuuuccacguuccucugccugcuu

SEQ ID NO: 61128 - RNA, 18 nt, Human
agucuaguuuuugccaca

SEQ ID NO: 61129 - RNA, 23 nt, Human
agucuauaauguaaaagcuugaa

SEQ ID NO: 61130 - RNA, 32 nt, Human
agucuauauggcaaucuguguuaugaucagaa

SEQ ID NO: 61131 - RNA, 32 nt, Human
agucuaucaugcauuauucugaguaagcucag

SEQ ID NO: 61132 - RNA, 32 nt, Human
agucuauccggcacuaggaacagccccggggg

SEQ ID NO: 61133 - RNA, 32 nt, Human
agucuaucguggaaguucaagaggaauuucuu

SEQ ID NO: 61134 - RNA, 32 nt, Human
agucuaugccugcaacuccaaauguuuguggu

SEQ ID NO: 61135 - RNA, 32 nt, Human
agucuauucuaggaaugaaccagcaaguuguu

SEQ ID NO: 61136 - RNA, 32 nt, Human
agucucaaaaucaacucucuuaugguauuaua

SEQ ID NO: 61137 - RNA, 32 nt, Human
agucucaaacuaucaccugggcuggagugcga

SEQ ID NO: 61138 - RNA, 32 nt, Human
agucucaaaugucccuucaucuccuuacucuc

SEQ ID NO: 61139 - RNA, 32 nt, Human
agucucaacucacucuagccugggugacagag

SEQ ID NO: 61140 - RNA, 32 nt, Human
agucucaagauaugagaugccuagccuacaga

SEQ ID NO: 61141 - RNA, 32 nt, Human
agucucaagauauucagcucuuggucuuugug

SEQ ID NO: 61142 - RNA, 32 nt, Human
agucucaaggcuuucucucuugcuuaacuaaa

SEQ ID NO: 61143 - RNA, 32 nt, Human
agucucaaggggauuccagccuucagaagguu

SEQ ID NO: 61144 - RNA, 19 nt, Human
agucucaaucucuacuaca

SEQ ID NO: 61145 - RNA, 18 nt, Human
agucucacaaaggccccg

SEQ ID NO: 61146 - RNA, 32 nt, Human
agucucacaaauagcugggguuacaggugugc

SEQ ID NO: 61147 - RNA, 21 nt, Human
agucucacacccgccgggccg

SEQ ID NO: 61148 - RNA, 21 nt, Human
agucucacagaaacugagcug

SEQ ID NO: 61149 - RNA, 20 nt, Human
agucucacagaaggcaggcu

SEQ ID NO: 61150 - RNA, 20 nt, Human
agucucacagagagagggcc

SEQ ID NO: 61151 - RNA, 19 nt, Human
agucucacagaggaagggc

SEQ ID NO: 61152 - RNA, 20 nt, Human
agucucacagaggccugggu

SEQ ID NO: 61153 - RNA, 17 nt, Human
agucucacagaggggcu

SEQ ID NO: 61154 - RNA, 19 nt, Human
agucucacagauugcugcc

SEQ ID NO: 61155 - RNA, 32 nt, Human
agucucacagcagaggaaaggacagggaaaaa

SEQ ID NO: 61156 - RNA, 18 nt, Human
agucucacaggccaugcc

SEQ ID NO: 61157 - RNA, 32 nt, Human
agucucacaugguggcuguacaugcacaaccg

SEQ ID NO: 61158 - RNA, 32 nt, Human
agucucaccuggggccuagaguggaagugggg

SEQ ID NO: 61159 - RNA, 32 nt, Human
agucucacgaccuacccccaccccggacugcc

SEQ ID NO: 61160 - RNA, 32 nt, Human
agucucacuauguugcccagacuggucuugaa

SEQ ID NO: 61161 - RNA, 17 nt, Human
agucucacucugucgcc

SEQ ID NO: 61162 - RNA, 18 nt, Human
agucucacucugucgccg

SEQ ID NO: 61163 - RNA, 16 nt, Human
agucucacucuguguc

SEQ ID NO: 61164 - RNA, 17 nt, Human
agucucacucuguugcc

SEQ ID NO: 61165 - RNA, 32 nt, Human
agucucacucuucacucaggcugcagugcagu

SEQ ID NO: 61166 - RNA, 32 nt, Human
agucucacugcaccagugucuuugaugguggu

SEQ ID NO: 61167 - RNA, 32 nt, Human
agucucacugcacucaggcuggagugcagugg

SEQ ID NO: 61168 - RNA, 32 nt, Human
agucucacuguguugcccagccugggugucaa

SEQ ID NO: 61169 - RNA, 32 nt, Human
agucucacuuuccuccucugugaaaugggggu

SEQ ID NO: 61170 - RNA, 32 nt, Human
agucucagaagagguugggcuuccaugccugu

SEQ ID NO: 61171 - RNA, 32 nt, Human
agucucagagugaggcgggggccuuucggaua

SEQ ID NO: 61172 - RNA, 23 nt, Human
agucucagcaucugacugugcug

SEQ ID NO: 61173 - RNA, 32 nt, Human
agucucagccacucgggaggcugaggcaggag

SEQ ID NO: 61174 - RNA, 32 nt, Human
agucucagcccagcccccaccuuuggguugua

SEQ ID NO: 61175 - RNA, 21 nt, Human
agucucagccucagguacucc

SEQ ID NO: 61176 - RNA, 32 nt, Human
agucucagcuacuagggaggcugaggcaagag

SEQ ID NO: 61177 - RNA, 32 nt, Human
agucucagcuacucagaggcugaggcaggagg

SEQ ID NO: 61178 - RNA, 32 nt, Human
agucucagcuacucaggaggcugagacaggag

SEQ ID NO: 61179 - RNA, 32 nt, Human
agucucagcuacucaggaggcugagaugagag

SEQ ID NO: 61180 - RNA, 32 nt, Human
agucucagcuacucaggaggcugaggcaggag

SEQ ID NO: 61181 - RNA, 32 nt, Human
agucucagcuacucaggaggcuguggcaggaa

SEQ ID NO: 61182 - RNA, 32 nt, Human
agucucagcuacucaggaggcuuaggcaggag

SEQ ID NO: 61183 - RNA, 32 nt, Human
agucucagcuacucggaaggcugaggcaggag

SEQ ID NO: 61184 - RNA, 32 nt, Human
agucucagcuacucgggaggaugaggcaggag

SEQ ID NO: 61185 - RNA, 32 nt, Human
agucucagcuacucgggaggcugaggcaggag

SEQ ID NO: 61186 - RNA, 32 nt, Human
agucucagcuacucuggagguuuagcaggagg

SEQ ID NO: 61187 - RNA, 32 nt, Human
agucucagcuacuuaggagaaugaggugggag

SEQ ID NO: 61188 - RNA, 32 nt, Human
agucucagcuacuuaggaggcugagguggcag

SEQ ID NO: 61189 - RNA, 32 nt, Human
agucucagcuacuuaggaggcugaggugggag

SEQ ID NO: 61190 - RNA, 32 nt, Human
agucucagcuacuugggaggccauggugggag

SEQ ID NO: 61191 - RNA, 32 nt, Human
agucucagcuacuugggaggcugaggcacaag

SEQ ID NO: 61192 - RNA, 32 nt, Human
agucucagcuacuugggaggcugaggcaggag

SEQ ID NO: 61193 - RNA, 32 nt, Human
agucucagcuaguuggggagcuaaggugggag

SEQ ID NO: 61194 - RNA, 32 nt, Human
agucucagcuuauccuggagggaauugggaac

SEQ ID NO: 61195 - RNA, 32 nt, Human
agucucagcuuggccaaggccugucacugacu

SEQ ID NO: 61196 - RNA, 32 nt, Human
agucucaggaagagcuugguacuuguggggac

SEQ ID NO: 61197 - RNA, 32 nt, Human
agucucaggcagggacagacccagaaagaaca

SEQ ID NO: 61198 - RNA, 32 nt, Human
agucucaguucugcagaggagcugagugcccc

SEQ ID NO: 61199 - RNA, 32 nt, Human
agucucauacaagcugucugauagagaacuuu

SEQ ID NO: 61200 - RNA, 20 nt, Human
agucucauagggccaugcug

SEQ ID NO: 61201 - RNA, 32 nt, Human
agucucauauuuaguauugaauacuuacauuc

SEQ ID NO: 61202 - RNA, 32 nt, Human
agucucaucagacucugaggucugggacgugu

SEQ ID NO: 61203 - RNA, 32 nt, Human
agucucaucugucuuucccuuuacagcacaga

SEQ ID NO: 61204 - RNA, 32 nt, Human
agucucaugcaaguugucugauagagaacuuu

SEQ ID NO: 61205 - RNA, 32 nt, Human
agucucaugccuguaaucccagcacuuuggga

SEQ ID NO: 61206 - RNA, 32 nt, Human
agucucaugguggaaaauucauuggggagagc

SEQ ID NO: 61207 - RNA, 32 nt, Human
agucuccaagcccacuugaaaagucacacuga

SEQ ID NO: 61208 - RNA, 32 nt, Human
agucuccaagccccacgaacccugaggagugg

SEQ ID NO: 61209 - RNA, 32 nt, Human
agucuccaagccccgugaacccugaggagugg

SEQ ID NO: 61210 - RNA, 32 nt, Human
agucuccaaucccaucuauucucugccuuuac

SEQ ID NO: 61211 - RNA, 32 nt, Human
agucuccaccacucccuuuugucuuucacaug

SEQ ID NO: 61212 - RNA, 32 nt, Human
agucuccacugcaaccacucuggccaaggcca

SEQ ID NO: 61213 - RNA, 32 nt, Human
agucuccagaacugugagacagugcauuuugu

SEQ ID NO: 61214 - RNA, 32 nt, Human
agucuccagaauagcugggacuauaggugcac

SEQ ID NO: 61215 - RNA, 32 nt, Human
agucuccaggaaccccagccuguuagggucac

SEQ ID NO: 61216 - RNA, 20 nt, Human
agucuccaguugggcugugc

SEQ ID NO: 61217 - RNA, 32 nt, Human
agucuccauaaaaggccuaagaggagggguuu

SEQ ID NO: 61218 - RNA, 32 nt, Human
agucucccaaaaugcugggauuacaggaguga

SEQ ID NO: 61219 - RNA, 32 nt, Human
agucucccaaaccaccuucccucaucuuucau

SEQ ID NO: 61220 - RNA, 32 nt, Human
agucucccaaagcgcugggauuacaggcagga

SEQ ID NO: 61221 - RNA, 32 nt, Human
agucucccaaagggcugggauuaaaggcauga

SEQ ID NO: 61222 - RNA, 32 nt, Human
agucucccaaaguacugggauuacaggcguga

SEQ ID NO: 61223 - RNA, 32 nt, Human
agucucccaaagugcuaggauuacagcgugau

SEQ ID NO: 61224 - RNA, 32 nt, Human
agucucccaaagugcugagauuacaggcauga

SEQ ID NO: 61225 - RNA, 32 nt, Human
agucucccaaagugcugggauuacaggcauga

SEQ ID NO: 61226 - RNA, 32 nt, Human
agucucccaaagugcugggauuacaggcguga

SEQ ID NO: 61227 - RNA, 32 nt, Human
agucucccaaagugcugggauuauaggcguaa

SEQ ID NO: 61228 - RNA, 32 nt, Human
agucucccaaagugcugguauuacaggcguga

SEQ ID NO: 61229 - RNA, 32 nt, Human
agucucccaaauugccgggauuacaggcauga

SEQ ID NO: 61230 - RNA, 32 nt, Human
agucucccaagcagcugggauuguagguacac

SEQ ID NO: 61231 - RNA, 32 nt, Human
agucucccaaguaccugggaugacaggcgccu

SEQ ID NO: 61232 - RNA, 32 nt, Human
agucucccaaguagcagggauuacaggcaugc

SEQ ID NO: 61233 - RNA, 32 nt, Human
agucucccaaguagcugaaauuacaggagccu

SEQ ID NO: 61234 - RNA, 32 nt, Human
agucucccaaguagcugggacuacaagcaugc

SEQ ID NO: 61235 - RNA, 32 nt, Human
agucucccaaguagcugggacuacaggcaggu

SEQ ID NO: 61236 - RNA, 32 nt, Human
agucucccaaguagcugggacuacagguacgu

SEQ ID NO: 61237 - RNA, 32 nt, Human
agucucccaaguagcugggacuauaggcacgu

SEQ ID NO: 61238 - RNA, 32 nt, Human
agucucccaaguagcugggacuauuuugcaug

SEQ ID NO: 61239 - RNA, 32 nt, Human
agucucccaaguagcugggauuacaggugugc

SEQ ID NO: 61240 - RNA, 32 nt, Human
agucucccaaguagcugggauuacaggugugu

SEQ ID NO: 61241 - RNA, 32 nt, Human
agucucccaaguagcugggauuauaggcaucc

SEQ ID NO: 61242 - RNA, 32 nt, Human
agucucccaaguagcugggguuacaggugcac

SEQ ID NO: 61243 - RNA, 32 nt, Human
agucucccaaguagcuuggauuacaggugagc

SEQ ID NO: 61244 - RNA, 32 nt, Human
agucucccaaguaggugggacuacaggcgcac

SEQ ID NO: 61245 - RNA, 32 nt, Human
agucucccacauagcugggaauacaggugcgc

SEQ ID NO: 61246 - RNA, 32 nt, Human
agucucccagcaccucugacucagcuuggcca

SEQ ID NO: 61247 - RNA, 32 nt, Human
agucucccaggagaggaugcacucgguggugg

SEQ ID NO: 61248 - RNA, 32 nt, Human
agucucccagguagcugggauuacaggcaugu

SEQ ID NO: 61249 - RNA, 32 nt, Human
agucucccagugggugaugcuuuugcugcugc

SEQ ID NO: 61250 - RNA, 32 nt, Human
agucuccccauguucugcucacuccugucucc

SEQ ID NO: 61251 - RNA, 32 nt, Human
agucucccccuuccuccugugcccuccccuuc

SEQ ID NO: 61252 - RNA, 32 nt, Human
agucuccccgagugccuggauuacaggcauga

SEQ ID NO: 61253 - RNA, 32 nt, Human
agucuccccugcccccugcccccuggaguggc

SEQ ID NO: 61254 - RNA, 32 nt, Human
agucuccccugcccucccggguagagcuggga

SEQ ID NO: 61255 - RNA, 32 nt, Human
agucucccgaagugcugggauuacagauguga

SEQ ID NO: 61256 - RNA, 32 nt, Human
agucucccgaagugcugggauuacugacauga

SEQ ID NO: 61257 - RNA, 32 nt, Human
agucucccgacuagcugggacuacaggcgccc

SEQ ID NO: 61258 - RNA, 32 nt, Human
agucucccgaguagcuaggauuacagaugugc

SEQ ID NO: 61259 - RNA, 32 nt, Human
agucucccgaguagcugggacuacaggcaccu

SEQ ID NO: 61260 - RNA, 32 nt, Human
agucucccgaguagcugggauuacaggcacuu

SEQ ID NO: 61261 - RNA, 32 nt, Human
agucucccgaguagcugggauuacaggcgugc

SEQ ID NO: 61262 - RNA, 32 nt, Human
agucucccgaguagcugggauuauaggcgccc

SEQ ID NO: 61263 - RNA, 32 nt, Human
agucucccgaguaguggaaauuacaggugugu

SEQ ID NO: 61264 - RNA, 32 nt, Human
agucucccuaagugcugggauuacagacguga

SEQ ID NO: 61265 - RNA, 32 nt, Human
agucucccuauguugcccaggcuggucuccaa

SEQ ID NO: 61266 - RNA, 16 nt, Human
agucucccuccaggaa

SEQ ID NO: 61267 - RNA, 32 nt, Human
agucucccuccaggaaaggccugaggaugugu

SEQ ID NO: 61268 - RNA, 32 nt, Human
agucucccuccccugacucccucugcuguccu

SEQ ID NO: 61269 - RNA, 32 nt, Human
agucucccuucccaucuccuguguccuggcug

SEQ ID NO: 61270 - RNA, 32 nt, Human
agucuccgccuucuguucuucuugccgaccuu

SEQ ID NO: 61271 - RNA, 32 nt, Human
agucuccggcucucuccugcaggaucggucaa

SEQ ID NO: 61272 - RNA, 32 nt, Human
agucuccuaaagugcugggauuacauguguga

SEQ ID NO: 61273 - RNA, 32 nt, Human
agucuccuaugggagcaaguugauucuaggug

SEQ ID NO: 61274 - RNA, 32 nt, Human
agucuccucaaaggaaggcagcauguguccuu

SEQ ID NO: 61275 - RNA, 32 nt, Human
agucuccucagacauagucaaagcuuugccga

SEQ ID NO: 61276 - RNA, 32 nt, Human
agucuccucaguagcuggggcuuuaggugggc

SEQ ID NO: 61277 - RNA, 32 nt, Human
agucuccuccaggcugacauuuccucaaucuu

SEQ ID NO: 61278 - RNA, 18 nt, Human
agucuccuccccuacucu

SEQ ID NO: 61279 - RNA, 32 nt, Human
agucuccucggaacaggggugaggggucgacu

SEQ ID NO: 61280 - RNA, 19 nt, Human
agucuccucucuaccgcca

SEQ ID NO: 61281 - RNA, 32 nt, Human
agucuccucuuucugaagcuuccugugccacc

SEQ ID NO: 61282 - RNA, 32 nt, Human
agucuccugacuagcugggacuacaggugcau

SEQ ID NO: 61283 - RNA, 32 nt, Human
agucuccugagcagcugggauuacaggcaaac

SEQ ID NO: 61284 - RNA, 32 nt, Human
agucuccugaguagccgggacuacaggcaugc

SEQ ID NO: 61285 - RNA, 32 nt, Human
agucuccugaguagcuaggacuacaggcacac

SEQ ID NO: 61286 - RNA, 32 nt, Human
agucuccugaguagcugagacuacagcugugc

SEQ ID NO: 61287 - RNA, 32 nt, Human
agucuccugaguagcugagacuacaggcacgc

SEQ ID NO: 61288 - RNA, 32 nt, Human
agucuccugaguagcuggaacuacaaggaagg

SEQ ID NO: 61289 - RNA, 32 nt, Human
agucuccugaguagcuggaacuacaggugugc

SEQ ID NO: 61290 - RNA, 32 nt, Human
agucuccugaguagcugggacuacaggugcgu

SEQ ID NO: 61291 - RNA, 32 nt, Human
agucuccugaguagcugggacugcaggcaugc

SEQ ID NO: 61292 - RNA, 32 nt, Human
agucuccugaguagcugggaucacaggcaugc

SEQ ID NO: 61293 - RNA, 32 nt, Human
agucuccugaguagcugggaucacagggacca

SEQ ID NO: 61294 - RNA, 32 nt, Human
agucuccugaguagcugggaugacaggcacgc

SEQ ID NO: 61295 - RNA, 32 nt, Human
agucuccugaguagcugggauuacaggcaccc

SEQ ID NO: 61296 - RNA, 32 nt, Human
agucuccugaguagcugggauuacaggugccc

SEQ ID NO: 61297 - RNA, 32 nt, Human
agucuccugaguagcugggauuacgggugcgu

SEQ ID NO: 61298 - RNA, 32 nt, Human
agucuccugaguaguugacggcuagcggggag

SEQ ID NO: 61299 - RNA, 32 nt, Human
agucuccugaguaucuaggacuacaggcccgc

SEQ ID NO: 61300 - RNA, 32 nt, Human
agucuccugaugcugagaugaauagacugggu

SEQ ID NO: 61301 - RNA, 32 nt, Human
agucuccugccucagccuucugaguagcuggg

SEQ ID NO: 61302 - RNA, 32 nt, Human
agucuccugccugcuugccaaaagcuaggaug

SEQ ID NO: 61303 - RNA, 32 nt, Human
agucuccugcuagucugacuccugaagcauca

SEQ ID NO: 61304 - RNA, 32 nt, Human
agucuccuggagggagauguuuaagagggguu

SEQ ID NO: 61305 - RNA, 21 nt, Human
agucuccugggaagcugugcc

SEQ ID NO: 61306 - RNA, 32 nt, Human
agucuccuuuccaacaggaugaugcauuugcu

SEQ ID NO: 61307 - RNA, 32 nt, Human
agucuccuuuggugauguugugggauuuuauu

SEQ ID NO: 61308 - RNA, 32 nt, Human
agucucgacuagggcaguagccccaggacucc

SEQ ID NO: 61309 - RNA, 32 nt, Human
agucucgcuauccucaaaauaugccgugugua

SEQ ID NO: 61310 - RNA, 32 nt, Human
agucucgcucugcacuccagccuggcgacuga

SEQ ID NO: 61311 - RNA, 32 nt, Human
agucucgcucugucucccagguuggagugcag

SEQ ID NO: 61312 - RNA, 32 nt, Human
agucucgcugggacagcaagaaacaggaacac

SEQ ID NO: 61313 - RNA, 32 nt, Human
agucucggacuccggcccaggagcucagcguu

SEQ ID NO: 61314 - RNA, 22 nt, Human
agucucggcgagaggaguccuc

SEQ ID NO: 61315 - RNA, 22 nt, Human
agucucggcuggagugcagugg

SEQ ID NO: 61316 - RNA, 32 nt, Human
agucucgggcccacagucaccgccgcuuaccu

SEQ ID NO: 61317 - RNA, 32 nt, Human
agucucguuccuuugugcugcggcggcggcuu

SEQ ID NO: 61318 - RNA, 32 nt, Human
agucucguugagaccaccaccauaccucagaa

SEQ ID NO: 61319 - RNA, 32 nt, Human
agucucuaaguuggcaacuuuggcugaacaaa

SEQ ID NO: 61320 - RNA, 32 nt, Human
agucucuacagcuguuucccucuuuucccauc

SEQ ID NO: 61321 - RNA, 32 nt, Human
agucucuaccuccagggaaagccuucuuacca

SEQ ID NO: 61322 - RNA, 32 nt, Human
agucucuacuaaaaauacaaaaauuagccagg

SEQ ID NO: 61323 - RNA, 32 nt, Human
agucucuacuaaaaauacaaaaauuagcccgg

SEQ ID NO: 61324 - RNA, 32 nt, Human
agucucuacuaaaaauacaaaaauuagcuagg

SEQ ID NO: 61325 - RNA, 32 nt, Human
agucucuacuaaaaauacaaaaauuagcuggg

SEQ ID NO: 61326 - RNA, 32 nt, Human
agucucuacuaaaaauacaaaaauuagucagg

SEQ ID NO: 61327 - RNA, 32 nt, Human
agucucuacuaauaauacaaaaauuagcuggg

SEQ ID NO: 61328 - RNA, 32 nt, Human
agucucuacugaaaauacagaaaaguuagcca

SEQ ID NO: 61329 - RNA, 32 nt, Human
agucucuacuuaaaauacaaaaauuagccagg

SEQ ID NO: 61330 - RNA, 32 nt, Human
agucucuaggaacccccagguccuggugcugc

SEQ ID NO: 61331 - RNA, 32 nt, Human
agucucuagucgugcacauuccugggccucag

SEQ ID NO: 61332 - RNA, 32 nt, Human
agucucucaaagugcugggauuacaggcauga

SEQ ID NO: 61333 - RNA, 32 nt, Human
agucucucaaagugcugggauuacagguguga

SEQ ID NO: 61334 - RNA, 32 nt, Human
agucucucagugaggaaugagaggccagcuuc

SEQ ID NO: 61335 - RNA, 32 nt, Human
agucucuccagaaguuuuuaaggcuacauuuu

SEQ ID NO: 61336 - RNA, 32 nt, Human
agucucuccagccucacagaugcuggccucuu

SEQ ID NO: 61337 - RNA, 32 nt, Human
agucucuccucccuagcgcucuggguccuuaa

SEQ ID NO: 61338 - RNA, 32 nt, Human
agucucucuaguagcuggaauuauaggcacac

SEQ ID NO: 61339 - RNA, 32 nt, Human
agucucucucacccuucuaggcagugcaucag

SEQ ID NO: 61340 - RNA, 32 nt, Human
agucucucugcacuccagccugggugacagag

SEQ ID NO: 61341 - RNA, 32 nt, Human
agucucucuuucucccgggccucccuucuguu

SEQ ID NO: 61342 - RNA, 32 nt, Human
agucucugaagccucaucagucaccgggacug

SEQ ID NO: 61343 - RNA, 32 nt, Human
agucucugacuccagccgcacaccuccugccu

SEQ ID NO: 61344 - RNA, 20 nt, Human
agucucugcagccugcucca

SEQ ID NO: 61345 - RNA, 32 nt, Human
agucucugccauccacaaugcuuguguucuaa

SEQ ID NO: 61346 - RNA, 31 nt, Human
agucucugccucuuucgccuaguaucucugc

SEQ ID NO: 61347 - RNA, 32 nt, Human
agucucuggcaguucuggaauggaaggguucu

SEQ ID NO: 61348 - RNA, 32 nt, Human
agucucuggcccacaucaguguuuucaguaag

SEQ ID NO: 61349 - RNA, 32 nt, Human
agucucugggcuugcccugaaauuacucgcug

SEQ ID NO: 61350 - RNA, 31 nt, Human
agucucugguggcagcuucuaccucagccaa

SEQ ID NO: 61351 - RNA, 32 nt, Human
agucucugucucuaucugaaaccuuuuugaag

SEQ ID NO: 61352 - RNA, 19 nt, Human
agucucuguugcugugcug

SEQ ID NO: 61353 - RNA, 32 nt, Human
agucucuuacccaggcuagggugcaguggugu

SEQ ID NO: 61354 - RNA, 32 nt, Human
agucucuuauucacccuggaccaacagggaga

SEQ ID NO: 61355 - RNA, 32 nt, Human
agucucuucaacccucuucucacuuuuuaaaa

SEQ ID NO: 61356 - RNA, 32 nt, Human
agucucuucccuuuaaaccuuucuuuuucucu

SEQ ID NO: 61357 - RNA, 32 nt, Human
agucucuuccuccuccuccucuucucuccacc

SEQ ID NO: 61358 - RNA, 32 nt, Human
agucucuucgaggcuuuacaguguaaacuguc

SEQ ID NO: 61359 - RNA, 21 nt, Human
agucucuucucuguauuauca

SEQ ID NO: 61360 - RNA, 32 nt, Human
agucucuugaagcauaccucaaagucauagag

SEQ ID NO: 61361 - RNA, 32 nt, Human
agucucuugaguagcugagauuacagguacgc

SEQ ID NO: 61362 - RNA, 32 nt, Human
agucucuugaguagcugggacuucaggagacu

SEQ ID NO: 61363 - RNA, 32 nt, Human
agucucuugccccaggaaaccccaucaguccc

SEQ ID NO: 61364 - RNA, 32 nt, Human
agucucuugggaaguguguuuagaaggguuca

SEQ ID NO: 61365 - RNA, 32 nt, Human
agucucuugugcuaaauuuggccaaagaugau

SEQ ID NO: 61366 - RNA, 32 nt, Human
agucucuuuccccagccaccccucucaucgcc

SEQ ID NO: 61367 - RNA, 32 nt, Human
agucucuuugggccagccgggcugcugcagac

SEQ ID NO: 61368 - RNA, 32 nt, Human
agucucuuuugccauguaaggcaacauucaca

SEQ ID NO: 61369 - RNA, 32 nt, Human
agucucuuuuuacacuucaccuccuucugcag

SEQ ID NO: 61370 - RNA, 32 nt, Human
agucucuuuuucuuccucucggcuggaagaac

SEQ ID NO: 61371 - RNA, 21 nt, Human
agucugaaacaaaguaguaaa

SEQ ID NO: 61372 - RNA, 32 nt, Human
agucugaagaaauggcacagggacagugaaug

SEQ ID NO: 61373 - RNA, 32 nt, Human
agucugaagaggaugugcugugguguauugag

SEQ ID NO: 61374 - RNA, 32 nt, Human
agucugaagcacucucgcacacacagugauuc

SEQ ID NO: 61375 - RNA, 18 nt, Human
agucugaagcuggggaga

SEQ ID NO: 61376 - RNA, 32 nt, Human
agucugaaggcugggagcucuuggggcugggc

SEQ ID NO: 61377 - RNA, 20 nt, Human
agucugaaucacugcuguca

SEQ ID NO: 61378 - RNA, 32 nt, Human
agucugaauguucuuugaaaauaacuggaguu

SEQ ID NO: 61379 - RNA, 32 nt, Human
agucugacccuccgccaggcaaaaggaagauu

SEQ ID NO: 61380 - RNA, 32 nt, Human
agucugaccucaguccucccucccucuguugu

SEQ ID NO: 61381 - RNA, 32 nt, Human
agucugagauggcuacauucauuauggacaaa

SEQ ID NO: 61382 - RNA, 32 nt, Human
agucugagcaccuugaggccuccuguuggaaa

SEQ ID NO: 61383 - RNA, 23 nt, Human
agucugagccacugccuuuccca

SEQ ID NO: 61384 - RNA, 32 nt, Human
agucugagcuacucaggaggcugauguaugag

SEQ ID NO: 61385 - RNA, 32 nt, Human
agucugaggcggagggaguaauggcaggacaa

SEQ ID NO: 61386 - RNA, 32 nt, Human
agucugagggcugcuugguguagucagguugu

SEQ ID NO: 61387 - RNA, 32 nt, Human
agucugaggguuccgguugucuuggccugaga

SEQ ID NO: 61388 - RNA, 32 nt, Human
agucugagguacacaucauauugccuacagcc

SEQ ID NO: 61389 - RNA, 23 nt, Human
agucugaguggcagaagcuucaa

SEQ ID NO: 61390 - RNA, 32 nt, Human
agucugagugguuccagcagggaagacaaaug

SEQ ID NO: 61391 - RNA, 32 nt, Human
agucugaguuacucgggagggaaaagugcagc

SEQ ID NO: 61392 - RNA, 32 nt, Human
agucugaguuucuggcguuccaugccucuggg

SEQ ID NO: 61393 - RNA, 32 nt, Human
agucugaucaaaucgugaaguaauacagugaa

SEQ ID NO: 61394 - RNA, 32 nt, Human
agucugaucuuuugacuucuacauauagugga

SEQ ID NO: 61395 - RNA, 32 nt, Human
agucugaugaggaugugcugugguguauugag

SEQ ID NO: 61396 - RNA, 32 nt, Human
agucugaugcagagccugcacucuggcacucg

SEQ ID NO: 61397 - RNA, 19 nt, Human
agucugaugccugcuuccc

SEQ ID NO: 61398 - RNA, 32 nt, Human
agucugauguaggggcaaagagacuggcuuuu

SEQ ID NO: 61399 - RNA, 19 nt, Human
agucugauuggcaccggcu

SEQ ID NO: 61400 - RNA, 32 nt, Human
agucugauuugcuucuugaaggauuuaauaac

SEQ ID NO: 61401 - RNA, 18 nt, Human
agucugauuuuaucguca

SEQ ID NO: 61402 - RNA, 32 nt, Human
agucugcaauuuaugccuacaggccagcagcu

SEQ ID NO: 61403 - RNA, 32 nt, Human
agucugcacaugcagcugcacccucccuccga

SEQ ID NO: 61404 - RNA, 32 nt, Human
agucugcacaugcuucugucugagugcaggaa

SEQ ID NO: 61405 - RNA, 32 nt, Human
agucugcacugagcuuggcucaggaaagaagg

SEQ ID NO: 61406 - RNA, 32 nt, Human
agucugcacuggagcugccuggugaccagaag

SEQ ID NO: 61407 - RNA, 32 nt, Human
agucugcagccccuccaccaucccacauccuc

SEQ ID NO: 61408 - RNA, 32 nt, Human
agucugcagugagccgagaucaugccacugca

SEQ ID NO: 61409 - RNA, 32 nt, Human
agucugcagugggcuaugguuucuugacaagu

SEQ ID NO: 61410 - RNA, 32 nt, Human
agucugccacccaggcuggaguccaguggcgu

SEQ ID NO: 61411 - RNA, 32 nt, Human
agucugccagccacacugggaaaacauuggag

SEQ ID NO: 61412 - RNA, 32 nt, Human
agucugcccugccuuuuccuuucgggcaccac

SEQ ID NO: 61413 - RNA, 32 nt, Human
agucugcccuucugauagccugccucacagag

SEQ ID NO: 61414 - RNA, 32 nt, Human
agucugccgaguagcugggauuacaggcaugc

SEQ ID NO: 61415 - RNA, 32 nt, Human
agucugccuauccuggccaggugugguggcuc

SEQ ID NO: 61416 - RNA, 32 nt, Human
agucugccucccagacuggcuacuguauguaa

SEQ ID NO: 61417 - RNA, 32 nt, Human
agucugccuccccuaugggacucccuucuacc

SEQ ID NO: 61418 - RNA, 32 nt, Human
agucugcgaucuagcccagaauccgcgauccc

SEQ ID NO: 61419 - RNA, 32 nt, Human
agucugcgcugcgaagucugggagacacucua

SEQ ID NO: 61420 - RNA, 32 nt, Human
agucugcgcuguggcccugccucugcccagcg

SEQ ID NO: 61421 - RNA, 32 nt, Human
agucugcggucugaggcucuuuggguucagac

SEQ ID NO: 61422 - RNA, 20 nt, Human
agucugcucuggcugugcug

SEQ ID NO: 61423 - RNA, 19 nt, Human
agucugcugaagcugugcc

SEQ ID NO: 61424 - RNA, 32 nt, Human
agucugcugcagaugaccucaugaacuggaag

SEQ ID NO: 61425 - RNA, 32 nt, Human
agucugcugcagcugccagaaaacaugccuac

SEQ ID NO: 61426 - RNA, 32 nt, Human
agucugcugcgagcacgacuccgcccuuggca

SEQ ID NO: 61427 - RNA, 18 nt, Human
agucugcugcuauuauua

SEQ ID NO: 61428 - RNA, 32 nt, Human
agucugcugucaggagagauggcugaaaaggu

SEQ ID NO: 61429 - RNA, 20 nt, Human
agucugcuuucucuacuguc

SEQ ID NO: 61430 - RNA, 31 nt, Human
agucugcuuuugaaggagguagggaaugaca

SEQ ID NO: 61431 - RNA, 32 nt, Human
agucuggaaaauuuguugaauguacugagcaa

SEQ ID NO: 61432 - RNA, 32 nt, Human
agucuggaagcagcagaacugaaggaaguaaa

SEQ ID NO: 61433 - RNA, 32 nt, Human
agucuggaauacuuccugucaucugccccuuc

SEQ ID NO: 61434 - RNA, 19 nt, Human
agucuggacuucaacaaga

SEQ ID NO: 61435 - RNA, 32 nt, Human
agucuggagaaagggucucccuugucuggccu

SEQ ID NO: 61436 - RNA, 32 nt, Human
agucuggagacugggagccuucacuucggccu

SEQ ID NO: 61437 - RNA, 32 nt, Human
agucuggagagcaggcaucucagaucccuaag

SEQ ID NO: 61438 - RNA, 32 nt, Human
agucuggagaugggaagucaaagaccaaagua

SEQ ID NO: 61439 - RNA, 32 nt, Human
agucuggagcccagaagggacacaccagcaca

SEQ ID NO: 61440 - RNA, 32 nt, Human
agucuggaggacgcugagggcggaggcgggag

SEQ ID NO: 61441 - RNA, 32 nt, Human
agucuggauccagcagugcuguuuucccugag

SEQ ID NO: 61442 - RNA, 32 nt, Human
agucuggcaaggugaugaccagcuggagagag

SEQ ID NO: 61443 - RNA, 32 nt, Human
agucuggcaccucuuucuucugaccucagacg

SEQ ID NO: 61444 - RNA, 32 nt, Human
agucuggcaggaagaggcaggaagggagagaa

SEQ ID NO: 61445 - RNA, 18 nt, Human
agucuggcaggcaggaga

SEQ ID NO: 61446 - RNA, 32 nt, Human
agucuggcagggucuccuagcugcuaguauag

SEQ ID NO: 61447 - RNA, 18 nt, Human
agucuggccaaaacggua

SEQ ID NO: 61448 - RNA, 21 nt, Human
agucuggccaacaucgugaaa

SEQ ID NO: 61449 - RNA, 21 nt, Human
agucuggccaacauggagaaa

SEQ ID NO: 61450 - RNA, 21 nt, Human
agucuggccaacauggcgaaa

SEQ ID NO: 61451 - RNA, 21 nt, Human
agucuggccaacauggggaaa

SEQ ID NO: 61452 - RNA, 21 nt, Human
agucuggccaacauggugaaa

SEQ ID NO: 61453 - RNA, 21 nt, Human
agucuggccaaccuggugaaa

SEQ ID NO: 61454 - RNA, 21 nt, Human
agucuggccaauauggugaaa

SEQ ID NO: 61455 - RNA, 32 nt, Human
agucuggccacugucaaggcagggaaggggcc

SEQ ID NO: 61456 - RNA, 32 nt, Human
agucuggccagccuggcccugcaggucuccca

SEQ ID NO: 61457 - RNA, 21 nt, Human
agucuggcccacauggugaaa

SEQ ID NO: 61458 - RNA, 32 nt, Human
agucuggccuagaacuccuggccucaacugau

SEQ ID NO: 61459 - RNA, 32 nt, Human
agucuggccuuucccaugcugcccucggccug

SEQ ID NO: 61460 - RNA, 32 nt, Human
agucuggcgacugccccacgcccagccguggg

SEQ ID NO: 61461 - RNA, 32 nt, Human
agucuggcuacuuugcugaagagaccacauga

SEQ ID NO: 61462 - RNA, 32 nt, Human
agucuggcuccggucacucuucuggcuuaggu

SEQ ID NO: 61463 - RNA, 32 nt, Human
agucuggcucucugucgcccaggcuggagugc

SEQ ID NO: 61464 - RNA, 32 nt, Human
agucugggaacaaagagaggagccagccuccc

SEQ ID NO: 61465 - RNA, 32 nt, Human
agucugggacacccucccuacuuugagaaucc

SEQ ID NO: 61466 - RNA, 23 nt, Human
agucugggacauccuggacuuga

SEQ ID NO: 61467 - RNA, 32 nt, Human
agucugggagaaggaggcuacagugagcugug

SEQ ID NO: 61468 - RNA, 32 nt, Human
agucugggagagaacacagggagccagccgug

SEQ ID NO: 61469 - RNA, 32 nt, Human
agucugggaggcagguuuccaagagcagggac

SEQ ID NO: 61470 - RNA, 26 nt, Human
agucugggaggcggagguugcaguga

SEQ ID NO: 61471 - RNA, 32 nt, Human
agucugggaggcggagguugcagugagcugag

SEQ ID NO: 61472 - RNA, 32 nt, Human
agucugggagggcaugggagcagugagcaggc

SEQ ID NO: 61473 - RNA, 32 nt, Human
agucugggagguggaggcugcagugagccgug

SEQ ID NO: 61474 - RNA, 32 nt, Human
agucugggagguugaggcugcagugagcugug

SEQ ID NO: 61475 - RNA, 18 nt, Human
agucugggaguaaggaga

SEQ ID NO: 61476 - RNA, 18 nt, Human
agucugggagugaggaga

SEQ ID NO: 61477 - RNA, 32 nt, Human
agucugggagugagggaaggaggcaggggugc

SEQ ID NO: 61478 - RNA, 32 nt, Human
agucugggaugccauauacaaaaguuugggcu

SEQ ID NO: 61479 - RNA, 32 nt, Human
agucugggauucaaggaccaguuccagagagg

SEQ ID NO: 61480 - RNA, 32 nt, Human
agucugggcacuggcuggucucugccugaccc

SEQ ID NO: 61481 - RNA, 32 nt, Human
agucugggcccaggcugugaguuccaggucug

SEQ ID NO: 61482 - RNA, 32 nt, Human
agucugggcgacagagugagacuccaucucaa

SEQ ID NO: 61483 - RNA, 32 nt, Human
agucugggcucugccauuucauuuuuccccac

SEQ ID NO: 61484 - RNA, 32 nt, Human
agucugggcuggauucucccuccagucucugg

SEQ ID NO: 61485 - RNA, 32 nt, Human
agucugggcuuggccagagcucagggugcuga

SEQ ID NO: 61486 - RNA, 25 nt, Human
agucuggggaggagagagacuggaa

SEQ ID NO: 61487 - RNA, 32 nt, Human
agucugggggccuggaacaggagagcgggcgu

SEQ ID NO: 61488 - RNA, 32 nt, Human
agucuggguagggcccuuugaggcagaggguc

SEQ ID NO: 61489 - RNA, 32 nt, Human
agucugggucccauccagacccuccucuccaa

SEQ ID NO: 61490 - RNA, 32 nt, Human
agucuggguggguggagggcaggcagguggcu

SEQ ID NO: 61491 - RNA, 32 nt, Human
agucugguauccugagcuucgugaguugagcg

SEQ ID NO: 61492 - RNA, 21 nt, Human
agucuggucaacauggugaaa

SEQ ID NO: 61493 - RNA, 32 nt, Human
agucuggucccuuuggggaauguggcagucag

SEQ ID NO: 61494 - RNA, 32 nt, Human
agucuggucuagaacuccugacgucaggugau

SEQ ID NO: 61495 - RNA, 32 nt, Human
agucuggucucaaacucccgaccucaggugau

SEQ ID NO: 61496 - RNA, 32 nt, Human
agucuggucucaaacuccugaccucaaggauc

SEQ ID NO: 61497 - RNA, 32 nt, Human
agucuggucuccuauagauuguuuucacugca

SEQ ID NO: 61498 - RNA, 32 nt, Human
agucuggucucgaacucugaccuugugaucca

SEQ ID NO: 61499 - RNA, 32 nt, Human
agucuggucuugaauuccugaccucaagugau

SEQ ID NO: 61500 - RNA, 32 nt, Human
agucugguuugagcaagcgagcugaaugugac

SEQ ID NO: 61501 - RNA, 23 nt, Human
agucuguaaccccaaguguaaug

SEQ ID NO: 61502 - RNA, 32 nt, Human
agucuguaagcuccuuaagaguaggguugugc

SEQ ID NO: 61503 - RNA, 22 nt, Human
agucuguacaccuuuauuauua

SEQ ID NO: 61504 - RNA, 32 nt, Human
agucuguauuacuucaggcuugugggcaaggu

SEQ ID NO: 61505 - RNA, 32 nt, Human
agucugucaacgggagggcagcagggaacaag

SEQ ID NO: 61506 - RNA, 32 nt, Human
agucugucaccaggcuggagugcaguggcaug

SEQ ID NO: 61507 - RNA, 32 nt, Human
agucugucacccaggcuggagugaucucagcu

SEQ ID NO: 61508 - RNA, 32 nt, Human
agucugucacccaggcuggagugcaguggcgu

SEQ ID NO: 61509 - RNA, 32 nt, Human
agucugucacccagguuggagugcaguggcgu

SEQ ID NO: 61510 - RNA, 32 nt, Human
agucugucaguggcauaaugguaacuaucuug

SEQ ID NO: 61511 - RNA, 32 nt, Human
agucuguccacuuugaaaauaccuuuccaggc

SEQ ID NO: 61512 - RNA, 19 nt, Human
agucugucccauacuguua

SEQ ID NO: 61513 - RNA, 22 nt, Human
agucuguccgaccguaccauua

SEQ ID NO: 61514 - RNA, 20 nt, Human
agucuguccucacugccauc

SEQ ID NO: 61515 - RNA, 32 nt, Human
agucugucgugcaccgaugagaacucuccuua

SEQ ID NO: 61516 - RNA, 32 nt, Human
agucugucuaccuuuagccaggcacaggacag

SEQ ID NO: 61517 - RNA, 18 nt, Human
agucugucucccgccguc

SEQ ID NO: 61518 - RNA, 32 nt, Human
agucugucugagguccuuaugaagcacugcug

SEQ ID NO: 61519 - RNA, 32 nt, Human
agucugucuggcuuuucuccuaucuugcuucu

SEQ ID NO: 61520 - RNA, 21 nt, Human
agucugucugucuguccauua

SEQ ID NO: 61521 - RNA, 18 nt, Human
agucugucugugcucuca

SEQ ID NO: 61522 - RNA, 18 nt, Human
agucugucuucaacuauu

SEQ ID NO: 61523 - RNA, 17 nt, Human
agucugucuuuaacaca

SEQ ID NO: 61524 - RNA, 32 nt, Human
agucugucuuucuccgcucuucucugaccccu

SEQ ID NO: 61525 - RNA, 32 nt, Human
agucugugaccugccccuucucuuuacaugca

SEQ ID NO: 61526 - RNA, 32 nt, Human
agucugugagcugauagugcagccaggacucu

SEQ ID NO: 61527 - RNA, 32 nt, Human
agucugugagcugauagugcagccaggacuug

SEQ ID NO: 61528 - RNA, 32 nt, Human
agucugugaggggagagcagagagcagaaccu

SEQ ID NO: 61529 - RNA, 32 nt, Human
agucugugcacaucugcucacaguugaguggg

SEQ ID NO: 61530 - RNA, 19 nt, Human
agucugugccuuugccguu

SEQ ID NO: 61531 - RNA, 32 nt, Human
agucugugcugucuuggcaugccuuggguuuc

SEQ ID NO: 61532 - RNA, 32 nt, Human
agucuguggaucagagaugcaccaccaagcca

SEQ ID NO: 61533 - RNA, 32 nt, Human
agucuguggccugaggugucugcucugggugg

SEQ ID NO: 61534 - RNA, 32 nt, Human
agucugugggguacgccauggugcaggcugcu

SEQ ID NO: 61535 - RNA, 32 nt, Human
agucugugggugaauggauguguguugaauuu

SEQ ID NO: 61536 - RNA, 20 nt, Human
agucuguggucuuugcauca

SEQ ID NO: 61537 - RNA, 32 nt, Human
agucuguguauccuuuuuccucuggcucuaca

SEQ ID NO: 61538 - RNA, 32 nt, Human
agucugugucaaaagagcuucucuccagagua

SEQ ID NO: 61539 - RNA, 19 nt, Human
agucugugugagcuaguuu

SEQ ID NO: 61540 - RNA, 32 nt, Human
agucugugugcuggugcaaggucugggacaaa

SEQ ID NO: 61541 - RNA, 32 nt, Human
agucuguguguagggagagagcugaguaggag

SEQ ID NO: 61542 - RNA, 32 nt, Human
agucuguguugaucuaauaauuuuggauaaag

SEQ ID NO: 61543 - RNA, 32 nt, Human
agucuguuacaccauuuagaacuuuccucagc

SEQ ID NO: 61544 - RNA, 18 nt, Human
agucuguuaccacuauua

SEQ ID NO: 61545 - RNA, 18 nt, Human
agucuguuauaugcauua

SEQ ID NO: 61546 - RNA, 19 nt, Human
agucuguuauuuauuauua

SEQ ID NO: 61547 - RNA, 16 nt, Human
agucuguucgcuauua

SEQ ID NO: 61548 - RNA, 18 nt, Human
agucuguucuagccagca

SEQ ID NO: 61549 - RNA, 32 nt, Human
agucuguucucacaccugugcgcagguuugca

SEQ ID NO: 61550 - RNA, 32 nt, Human
agucuguugcccaggcuggagugcaguggcgc

SEQ ID NO: 61551 - RNA, 32 nt, Human
agucuguuggcagacuggagugcaaucauggc

SEQ ID NO: 61552 - RNA, 18 nt, Human
agucuguuuaacucuuca

SEQ ID NO: 61553 - RNA, 18 nt, Human
agucuguuuauaucaaca

SEQ ID NO: 61554 - RNA, 32 nt, Human
agucuguuucaaugcuacaauguuugcuggga

SEQ ID NO: 61555 - RNA, 32 nt, Human
agucuguuucccaggcuggaguguagugauac

SEQ ID NO: 61556 - RNA, 17 nt, Human
agucuguuuggccauua

SEQ ID NO: 61557 - RNA, 18 nt, Human
agucuguuuuccccacca

SEQ ID NO: 61558 - RNA, 32 nt, Human
agucuguuuucccuccuuggagacagggcccu

SEQ ID NO: 61559 - RNA, 32 nt, Human
agucuguuuugcaggccucugcucugccuccu

SEQ ID NO: 61560 - RNA, 18 nt, Human
agucuguuuuuucuagca

SEQ ID NO: 61561 - RNA, 32 nt, Human
agucuuacaaguggccuuauuccaacuccaga

SEQ ID NO: 61562 - RNA, 32 nt, Human
agucuuacagaaagauaugcuuccauaauaug

SEQ ID NO: 61563 - RNA, 32 nt, Human
agucuuaccuuucuagauaucaaaugugcuau

SEQ ID NO: 61564 - RNA, 32 nt, Human
agucuuacuaaagacgugggaggaaguucucc

SEQ ID NO: 61565 - RNA, 32 nt, Human
agucuuacuccaaagacuauugcagggaggaa

SEQ ID NO: 61566 - RNA, 32 nt, Human
agucuuacuuaaaagacuuucaguuaauucuc

SEQ ID NO: 61567 - RNA, 32 nt, Human
agucuuacuuggaauaaauuuacugguacaau

SEQ ID NO: 61568 - RNA, 32 nt, Human
agucuuagaaauaggguuggucuggaaccuaa

SEQ ID NO: 61569 - RNA, 32 nt, Human
agucuuagaucuuucuagagcuuguuuguuca

SEQ ID NO: 61570 - RNA, 32 nt, Human
agucuuagcaacaguccucuggucccacagcu

SEQ ID NO: 61571 - RNA, 32 nt, Human
agucuuagcuacucaggaggcugaagcagaag

SEQ ID NO: 61572 - RNA, 32 nt, Human
agucuuagcuacucaggaggcugaggagggag

SEQ ID NO: 61573 - RNA, 32 nt, Human
agucuuagcuacucaggaggcugaggcaggag

SEQ ID NO: 61574 - RNA, 32 nt, Human
agucuuaggccugguggcugaucacuuguggg

SEQ ID NO: 61575 - RNA, 32 nt, Human
agucuuaggugaucgagggugugcccaggggg

SEQ ID NO: 61576 - RNA, 32 nt, Human
agucuuauccccaaauggcauuugcuuucgac

SEQ ID NO: 61577 - RNA, 32 nt, Human
agucuuauuugcugacuuuuucugucaugagu

SEQ ID NO: 61578 - RNA, 32 nt, Human
agucuucaacuugcacucggagcuccuuugau

SEQ ID NO: 61579 - RNA, 32 nt, Human
agucuucaagccuugguucucuaaugcagcua

SEQ ID NO: 61580 - RNA, 32 nt, Human
agucuucacacaugaucccaucuugcuaaacu

SEQ ID NO: 61581 - RNA, 32 nt, Human
agucuucauaugccagaauauaagagcaagug

SEQ ID NO: 61582 - RNA, 32 nt, Human
agucuucaucaguauauccauauuaaaacgag

SEQ ID NO: 61583 - RNA, 32 nt, Human
agucuucauuuuuaaaaacaaaaaggcaggca

SEQ ID NO: 61584 - RNA, 32 nt, Human
agucuuccaagcagcugggacuacagguaccc

SEQ ID NO: 61585 - RNA, 32 nt, Human
agucuuccaaggccagaaggagggggacaacc

SEQ ID NO: 61586 - RNA, 32 nt, Human
agucuuccacacucaacugugggaugggaggg

SEQ ID NO: 61587 - RNA, 32 nt, Human
agucuuccagcaggguucugaaagcagccugc

SEQ ID NO: 61588 - RNA, 32 nt, Human
agucuuccgaguagcugggauuacaggcgugu

SEQ ID NO: 61589 - RNA, 32 nt, Human
agucuuccgcccccagcccacucucauggucc

SEQ ID NO: 61590 - RNA, 32 nt, Human
agucuuccggguagcugggacuacaggugugc

SEQ ID NO: 61591 - RNA, 32 nt, Human
agucuuccuaccugagggguucagaggcugcu

SEQ ID NO: 61592 - RNA, 32 nt, Human
agucuuccuccucugugucuucccaaggcucu

SEQ ID NO: 61593 - RNA, 32 nt, Human
agucuuccuuucuccuggcuccagccugaagu

SEQ ID NO: 61594 - RNA, 32 nt, Human
agucuucgggagaggaggaggaguaggccgcc

SEQ ID NO: 61595 - RNA, 32 nt, Human
agucuucgggaggcagaauugaagugaacaug

SEQ ID NO: 61596 - RNA, 32 nt, Human
agucuucguucuuccuccccucaguggcaguu

SEQ ID NO: 61597 - RNA, 22 nt, Human
agucuucuagauuguucuuaua

SEQ ID NO: 61598 - RNA, 32 nt, Human
agucuucuccaauguccaaaaggcuagggggu

SEQ ID NO: 61599 - RNA, 32 nt, Human
agucuucuugcagccguguggacgaaguuugg

SEQ ID NO: 61600 - RNA, 18 nt, Human
agucuucuugcugaacug

SEQ ID NO: 61601 - RNA, 32 nt, Human
agucuucuuuaauuagagugagaagaaaagag

SEQ ID NO: 61602 - RNA, 22 nt, Human
agucuugaccuuuugggcucaa

SEQ ID NO: 61603 - RNA, 32 nt, Human
agucuugacucacugcaauucugccuccuggg

SEQ ID NO: 61604 - RNA, 22 nt, Human
agucuugagcugucucuuuuca

SEQ ID NO: 61605 - RNA, 32 nt, Human
agucuugcccucccagcucaaacccuccacug

SEQ ID NO: 61606 - RNA, 32 nt, Human
agucuugcucugcuggagugcgguggugcaau

SEQ ID NO: 61607 - RNA, 32 nt, Human
agucuugcucugcuggagugcgguggugcagu

SEQ ID NO: 61608 - RNA, 32 nt, Human
agucuugcucuguagcccaggccagagugcag

SEQ ID NO: 61609 - RNA, 32 nt, Human
agucuugcucugucgccaaguuggagugcaau

SEQ ID NO: 61610 - RNA, 31 nt, Human
agucuugcucugucucccuggcuagggugug

SEQ ID NO: 61611 - RNA, 32 nt, Human
agucuugcugguacaauuugggcuaaggaguc

SEQ ID NO: 61612 - RNA, 32 nt, Human
agucuugcugugucacccaggcugccaggcug

SEQ ID NO: 61613 - RNA, 32 nt, Human
agucuugcuuauucuucuccugggcuucuuga

SEQ ID NO: 61614 - RNA, 32 nt, Human
agucuuggagacaggcauaaauuggagugggg

SEQ ID NO: 61615 - RNA, 32 nt, Human
agucuuggagagaaccaacgacuaagguagcu

SEQ ID NO: 61616 - RNA, 32 nt, Human
agucuuggcagggaaaucccuuuuggccacac

SEQ ID NO: 61617 - RNA, 32 nt, Human
agucuuggcugcagacugagccuguaccucac

SEQ ID NO: 61618 - RNA, 22 nt, Human
agucuugggcugggugcagugg

SEQ ID NO: 61619 - RNA, 32 nt, Human
agucuugguaugacaauucacugauauuuaug

SEQ ID NO: 61620 - RNA, 32 nt, Human
agucuuggugugcagccccucuccucucuguc

SEQ ID NO: 61621 - RNA, 32 nt, Human
agucuuguacacacaacuucagcuuugcauca

SEQ ID NO: 61622 - RNA, 32 nt, Human
agucuuguacuuucuaugccucccagggagcc

SEQ ID NO: 61623 - RNA, 32 nt, Human
agucuugucagaauuggccucaguguaguuaa

SEQ ID NO: 61624 - RNA, 32 nt, Human
agucuuguccacccucuccauacaagucucaa

SEQ ID NO: 61625 - RNA, 32 nt, Human
agucuuguccuccucugucaccgacuugcugu

SEQ ID NO: 61626 - RNA, 32 nt, Human
agucuuguccugagaaauguuucucuuagucu

SEQ ID NO: 61627 - RNA, 32 nt, Human
agucuugucucaaacuccugggcucaagcgau

SEQ ID NO: 61628 - RNA, 32 nt, Human
agucuugucucuucuguccauggcuguagccc

SEQ ID NO: 61629 - RNA, 24 nt, Human
agucuugugcuaugcagcaggugu

SEQ ID NO: 61630 - RNA, 32 nt, Human
agucuuguggcccaacaagaggaagcucuccc

SEQ ID NO: 61631 - RNA, 24 nt, Human
agucuuguguuaaaagcccagugu

SEQ ID NO: 61632 - RNA, 24 nt, Human
agucuuguucuuagucucuuucca

SEQ ID NO: 61633 - RNA, 32 nt, Human
agucuuguugcccaggcuggagugcaauggcg

SEQ ID NO: 61634 - RNA, 32 nt, Human
agucuuguuucccaggcuggagugcaauggca

SEQ ID NO: 61635 - RNA, 18 nt, Human
agucuuguuucuucauca

SEQ ID NO: 61636 - RNA, 32 nt, Human
agucuuuacagcugagcacauucuggcucagg

SEQ ID NO: 61637 - RNA, 19 nt, Human
agucuuuacuuugcuauua

SEQ ID NO: 61638 - RNA, 32 nt, Human
agucuuuagcuauggugacuauuguuuauuuu

SEQ ID NO: 61639 - RNA, 32 nt, Human
agucuuucaguucuccaaaagcccaauuuaau

SEQ ID NO: 61640 - RNA, 32 nt, Human
agucuuucauuucccccuuccccauuccuuua

SEQ ID NO: 61641 - RNA, 32 nt, Human
agucuuucauuugucucuugaacaaucugaaa

SEQ ID NO: 61642 - RNA, 32 nt, Human
agucuuucccagaucccuccucugggcauauu

SEQ ID NO: 61643 - RNA, 32 nt, Human
agucuuucuaacacacugagggaaagauuaaa

SEQ ID NO: 61644 - RNA, 32 nt, Human
agucuuucucccagauuccaacagucaguguu

SEQ ID NO: 61645 - RNA, 32 nt, Human
agucuuucugggguguuuauguccucagcuga

SEQ ID NO: 61646 - RNA, 32 nt, Human
agucuuucuucagaauugucaggcugggcagg

SEQ ID NO: 61647 - RNA, 32 nt, Human
agucuuugaauccagagauuuggucuuagucc

SEQ ID NO: 61648 - RNA, 32 nt, Human
agucuuugaggugaaaguggaagagcuagaug

SEQ ID NO: 61649 - RNA, 22 nt, Human
agucuuuggagcaaggcugcug

SEQ ID NO: 61650 - RNA, 32 nt, Human
agucuuuggagccauugcugaaaacucuaaaa

SEQ ID NO: 61651 - RNA, 32 nt, Human
agucuuuggccagagcagaaaucuuacuaucu

SEQ ID NO: 61652 - RNA, 32 nt, Human
agucuuuguggacagaggcaggaucaugcugg

SEQ ID NO: 61653 - RNA, 20 nt, Human
agucuuuguugcuaucauca

SEQ ID NO: 61654 - RNA, 32 nt, Human
agucuuuuacuccaugaacaugggcuauuucu

SEQ ID NO: 61655 - RNA, 32 nt, Human
agucuuuugcuuccuuucuccuuuuuacaaaa

SEQ ID NO: 61656 - RNA, 32 nt, Human
agucuuuuguguuguuuauuuucuaccugugc

SEQ ID NO: 61657 - RNA, 32 nt, Human
agucuuuuucucagcuuaguuccagagagaaa

SEQ ID NO: 61658 - RNA, 32 nt, Human
agugaaaaacuaagggcuucauucaccaucac

SEQ ID NO: 61659 - RNA, 32 nt, Human
agugaaaaagacuucgcagcagucuucauugu

SEQ ID NO: 61660 - RNA, 32 nt, Human
agugaaaaaggagcucaaagagugcucauuaa

SEQ ID NO: 61661 - RNA, 32 nt, Human
agugaaaacucauuaaacuacucaaaucuuaa

SEQ ID NO: 61662 - RNA, 32 nt, Human
agugaaaacuucccauuugucccuucaaagau

SEQ ID NO: 61663 - RNA, 32 nt, Human
agugaaaagaggagugacaggagggaaagggg

SEQ ID NO: 61664 - RNA, 32 nt, Human
agugaaaagauaacacaggucuauugacucac

SEQ ID NO: 61665 - RNA, 32 nt, Human
agugaaaagccaugcuagaauuguagugucau

SEQ ID NO: 61666 - RNA, 32 nt, Human
agugaaaagugacaguguggaccauggaauca

SEQ ID NO: 61667 - RNA, 32 nt, Human
agugaaaaguugagcgucguuuuucuuagugu

SEQ ID NO: 61668 - RNA, 32 nt, Human
agugaaaaucugagaaagaguuaauugcaaug

SEQ ID NO: 61669 - RNA, 32 nt, Human
agugaaaaugccacucuccugugccuaccaau

SEQ ID NO: 61670 - RNA, 32 nt, Human
agugaaaccaaaaugauaaauagcuuuaagaa

SEQ ID NO: 61671 - RNA, 32 nt, Human
agugaaaccaacauccagaucuauagcagagu

SEQ ID NO: 61672 - RNA, 32 nt, Human
agugaaaccccuccucuacuaaaaauacaaaa

SEQ ID NO: 61673 - RNA, 32 nt, Human
agugaaagaacucagaaggcagugccagcagc

SEQ ID NO: 61674 - RNA, 32 nt, Human
agugaaagagaaagaauggggucgguggugaa

SEQ ID NO: 61675 - RNA, 32 nt, Human
agugaaagagaaggugaaugacguccucaaga

SEQ ID NO: 61676 - RNA, 32 nt, Human
agugaaagagauggccugguggaaagccugga

SEQ ID NO: 61677 - RNA, 32 nt, Human
agugaaagcauuucucaacaauggaucccgcu

SEQ ID NO: 61678 - RNA, 32 nt, Human
agugaaagcuccaggaaacaaaauacagagcu

SEQ ID NO: 61679 - RNA, 32 nt, Human
agugaaagcuuccugaggucuccccggaagca

SEQ ID NO: 61680 - RNA, 32 nt, Human
agugaaaggaggcuggccagaggaggaaagga

SEQ ID NO: 61681 - RNA, 32 nt, Human
agugaaaguuaaugccaauagaaaaauucaag

SEQ ID NO: 61682 - RNA, 32 nt, Human
agugaaauagaaugauuugaaaccacuacugu

SEQ ID NO: 61683 - RNA, 32 nt, Human
agugaaaugcagcaucugucuccugcuucaca

SEQ ID NO: 61684 - RNA, 32 nt, Human
agugaaaugccaccuccucacccuccuacuaa

SEQ ID NO: 61685 - RNA, 31 nt, Human
agugaaaugcugcugcugccauuucaacugu

SEQ ID NO: 61686 - RNA, 32 nt, Human
agugaaauggcaguuagaccaacagaggcuug

SEQ ID NO: 61687 - RNA, 32 nt, Human
agugaaauguuuucuuugguucauccuucuuu

SEQ ID NO: 61688 - RNA, 32 nt, Human
agugaaauuucuuaccugcaaggaaagugaac

SEQ ID NO: 61689 - RNA, 31 nt, Human
agugaacaagugugcagauugucaaauaugu

SEQ ID NO: 61690 - RNA, 32 nt, Human
agugaacaauccucaggaaaagaaggaccauu

SEQ ID NO: 61691 - RNA, 32 nt, Human
agugaacacccacguuuauuccugccugcucc

SEQ ID NO: 61692 - RNA, 32 nt, Human
agugaacagaacugauuuccagcacugcuguu

SEQ ID NO: 61693 - RNA, 32 nt, Human
agugaacagcaaggaagaguguuugcacagua

SEQ ID NO: 61694 - RNA, 32 nt, Human
agugaacagcauaugcaaagguguggaaaugu

SEQ ID NO: 61695 - RNA, 32 nt, Human
agugaacaugaaguuuagcuuagagaagaaaa

SEQ ID NO: 61696 - RNA, 32 nt, Human
agugaaccaaccaaagucaccaguucagaagu

SEQ ID NO: 61697 - RNA, 32 nt, Human
agugaaccaugauugcacuccaaccugggcga

SEQ ID NO: 61698 - RNA, 32 nt, Human
agugaacccgggaggcagagcuugcagugagc

SEQ ID NO: 61699 - RNA, 32 nt, Human
agugaacccgggaggcagagguugcagugaac

SEQ ID NO: 61700 - RNA, 32 nt, Human
agugaaccgaggaggcagagcuugcagugagc

SEQ ID NO: 61701 - RNA, 32 nt, Human
agugaaccucaagggguuuuacaggaggagcu

SEQ ID NO: 61702 - RNA, 31 nt, Human
agugaacggagaaucucagccccaugggcuc

SEQ ID NO: 61703 - RNA, 32 nt, Human
agugaacuacauacugaauauccaaguucuca

SEQ ID NO: 61704 - RNA, 32 nt, Human
agugaacucagcugucaucugcagccucugcc

SEQ ID NO: 61705 - RNA, 32 nt, Human
agugaacucuggugucucaaagaaggguagaa

SEQ ID NO: 61706 - RNA, 32 nt, Human
agugaacucuguggucacaugaagggagguuc

SEQ ID NO: 61707 - RNA, 32 nt, Human
agugaacugcagcugcugguaacccucagaaa

SEQ ID NO: 61708 - RNA, 32 nt, Human
agugaacugcuggaacucacacaugcccugau

SEQ ID NO: 61709 - RNA, 32 nt, Human
agugaacuguggacucgcuuucccaggcaggg

SEQ ID NO: 61710 - RNA, 32 nt, Human
agugaacuugcagccuuggauggggaagggcc

SEQ ID NO: 61711 - RNA, 32 nt, Human
agugaacuuuucuccuccuuuguuaacugccu

SEQ ID NO: 61712 - RNA, 32 nt, Human
agugaagaaagaggcgcagagcccuguguucc

SEQ ID NO: 61713 - RNA, 32 nt, Human
agugaagaaagccguccagacaauucucccag

SEQ ID NO: 61714 - RNA, 32 nt, Human
agugaagaaauguuacagccaggaacauauuc

SEQ ID NO: 61715 - RNA, 32 nt, Human
agugaagaagggugaagaagagaccuggggcu

SEQ ID NO: 61716 - RNA, 32 nt, Human
agugaagaagucagagggcagucaccugggga

SEQ ID NO: 61717 - RNA, 32 nt, Human
agugaagaauucuagcaucaggaacaagagaa

SEQ ID NO: 61718 - RNA, 32 nt, Human
agugaagacucugccugucggacuugcuuuga

SEQ ID NO: 61719 - RNA, 24 nt, Human
agugaagagcacagacucuguggg

SEQ ID NO: 61720 - RNA, 32 nt, Human
agugaagagcccaccuguggaaggacauggcg

SEQ ID NO: 61721 - RNA, 32 nt, Human
agugaagagccccaccucggggucacaauaaa

SEQ ID NO: 61722 - RNA, 32 nt, Human
agugaagaggaaaggggucuucccuggaacgc

SEQ ID NO: 61723 - RNA, 32 nt, Human
agugaagaguagcacauuaaagugauuuuauu

SEQ ID NO: 61724 - RNA, 32 nt, Human
agugaagaugcugaaguuuuggaugccacacc

SEQ ID NO: 61725 - RNA, 32 nt, Human
agugaagauggaagccggucccauacaggugg

SEQ ID NO: 61726 - RNA, 32 nt, Human
agugaagauggaccugcucuuauacuguugau

SEQ ID NO: 61727 - RNA, 32 nt, Human
agugaagauggccauuggcugugguuaugaca

SEQ ID NO: 61728 - RNA, 32 nt, Human
agugaagauugauuaggauucucagugaaugu

SEQ ID NO: 61729 - RNA, 32 nt, Human
agugaagcaaugaaggaagaagaaggagguug

SEQ ID NO: 61730 - RNA, 32 nt, Human
agugaagcagugucucacagggucauuacaga

SEQ ID NO: 61731 - RNA, 32 nt, Human
agugaagccacuaacaugcugugugacuuuau

SEQ ID NO: 61732 - RNA, 17 nt, Human
agugaagccagaagcca

SEQ ID NO: 61733 - RNA, 32 nt, Human
agugaagccccagcuggacucauggaugugca

SEQ ID NO: 61734 - RNA, 32 nt, Human
agugaagccugcaguggacccugcugcugcca

SEQ ID NO: 61735 - RNA, 32 nt, Human
agugaagcgcgcccggcgucacggugagugcg

SEQ ID NO: 61736 - RNA, 32 nt, Human
agugaagcucaccacuguccuuuguuuuggag

SEQ ID NO: 61737 - RNA, 31 nt, Human
agugaagcugagagagaagcaggauuuuaag

SEQ ID NO: 61738 - RNA, 32 nt, Human
agugaagcugggaggagaaggcggcggaaggu

SEQ ID NO: 61739 - RNA, 32 nt, Human
agugaaggaagagagacagaggaucaagggcu

SEQ ID NO: 61740 - RNA, 32 nt, Human
agugaaggagaaaggugaaaaugcuggaaggu

SEQ ID NO: 61741 - RNA, 32 nt, Human
agugaaggaggagaacuugggagccagguucu

SEQ ID NO: 61742 - RNA, 32 nt, Human
agugaaggaggccgccccugcccccaccugag

SEQ ID NO: 61743 - RNA, 32 nt, Human
agugaaggccuggagugcuuaagagggauuuc

SEQ ID NO: 61744 - RNA, 32 nt, Human
agugaaggcucgucuagaaccugccugagaaa

SEQ ID NO: 61745 - RNA, 32 nt, Human
agugaaggcugcaguacaucugcagacacgau

SEQ ID NO: 61746 - RNA, 32 nt, Human
agugaagggaggcaguggcggcggcggcgaac

SEQ ID NO: 61747 - RNA, 32 nt, Human
agugaagggcagggagcuggaccuggaggcgc

SEQ ID NO: 61748 - RNA, 32 nt, Human
agugaaggugacuccagcucacaguccugccg

SEQ ID NO: 61749 - RNA, 32 nt, Human
agugaaguaacaagccguggguggugacagug

SEQ ID NO: 61750 - RNA, 32 nt, Human
agugaaguaauaaaccguggguggugauagug

SEQ ID NO: 61751 - RNA, 32 nt, Human
agugaaguauuugaagccaucaacaucacaaa

SEQ ID NO: 61752 - RNA, 20 nt, Human
agugaagucaccccgugucc

SEQ ID NO: 61753 - RNA, 32 nt, Human
agugaagugauugaaacuuucuucugaugagu

SEQ ID NO: 61754 - RNA, 32 nt, Human
agugaagugcagucauacaaaauuuauacuca

SEQ ID NO: 61755 - RNA, 32 nt, Human
agugaaguggucagaagcagccagcagugagg

SEQ ID NO: 61756 - RNA, 32 nt, Human
agugaaguguguugcuucugucacuuuauauu

SEQ ID NO: 61757 - RNA, 31 nt, Human
agugaaguuagagcccagcucacuuagccag

SEQ ID NO: 61758 - RNA, 32 nt, Human
agugaaguuucccugcuuuucaucuagaucag

SEQ ID NO: 61759 - RNA, 26 nt, Human
agugaauaaagugcacauggacccug

SEQ ID NO: 61760 - RNA, 32 nt, Human
agugaauaccccaaugguuucuccaauuaugc

SEQ ID NO: 61761 - RNA, 32 nt, Human
agugaauagcuuccaccuccuuuuuggcccuc

SEQ ID NO: 61762 - RNA, 32 nt, Human
agugaauagugacuacaugaagggggcacuua

SEQ ID NO: 61763 - RNA, 32 nt, Human
agugaauauauacacacacauacagacacuca

SEQ ID NO: 61764 - RNA, 23 nt, Human
agugaaucacaccuguaauccca

SEQ ID NO: 61765 - RNA, 32 nt, Human
agugaaucccuacaaaugugaagaauguggca

SEQ ID NO: 61766 - RNA, 20 nt, Human
agugaaucuauuacugagga

SEQ ID NO: 61767 - RNA, 32 nt, Human
agugaaucucugugguugggccagucuuucua

SEQ ID NO: 61768 - RNA, 32 nt, Human
agugaaucuuucucccauccuuccccaaagag

SEQ ID NO: 61769 - RNA, 32 nt, Human
agugaaugaagaaugaaagggaaagaaugugu

SEQ ID NO: 61770 - RNA, 32 nt, Human
agugaaugcuccugaauaaaugugcauuccuc

SEQ ID NO: 61771 - RNA, 32 nt, Human
agugaaugcucuuguuaacaaauguuugcaua

SEQ ID NO: 61772 - RNA, 32 nt, Human
agugaaugggagguggaggaggguugcagcuc

SEQ ID NO: 61773 - RNA, 32 nt, Human
agugaaugggcaaaagcuggaagccuuucccu

SEQ ID NO: 61774 - RNA, 32 nt, Human
agugaauguaaaggaagauaugauugaaaagg

SEQ ID NO: 61775 - RNA, 29 nt, Human
agugaauguaagucugugccuggagagcu

SEQ ID NO: 61776 - RNA, 32 nt, Human
agugaauuaacauuuggugauuaugccuagcu

SEQ ID NO: 61777 - RNA, 32 nt, Human
agugaauuacaggucacaugaaaccaaaacgg

SEQ ID NO: 61778 - RNA, 32 nt, Human
agugaauucccugggagucaucaaagaagacc

SEQ ID NO: 61779 - RNA, 32 nt, Human
agugacaaauccagcagccaccauacugccag

SEQ ID NO: 61780 - RNA, 32 nt, Human
agugacacaggcagagcggugcagcccuccuu

SEQ ID NO: 61781 - RNA, 32 nt, Human
agugacacagggcagaggcauccauggcuggc

SEQ ID NO: 61782 - RNA, 32 nt, Human
agugacacaguuuccucugaugcagcugcuuc

SEQ ID NO: 61783 - RNA, 32 nt, Human
agugacaccugggagcuuguuaggaaugcaga

SEQ ID NO: 61784 - RNA, 32 nt, Human
agugacacuaugcacccccaccgugacccgag

SEQ ID NO: 61785 - RNA, 32 nt, Human
agugacagaaagcacaucacuucacaaggcag

SEQ ID NO: 61786 - RNA, 32 nt, Human
agugacagaaauggauucgaaauaucagugug

SEQ ID NO: 61787 - RNA, 32 nt, Human
agugacagacagcgccggagugcacggugggc

SEQ ID NO: 61788 - RNA, 32 nt, Human
agugacagcacaggagaucugcuggcucgggg

SEQ ID NO: 61789 - RNA, 32 nt, Human
agugacagccuccugacagcuuagaaaugugg

SEQ ID NO: 61790 - RNA, 32 nt, Human
agugacaggcuggucagagggcggggcuggug

SEQ ID NO: 61791 - RNA, 32 nt, Human
agugacaggguguggugguggaguggggagcu

SEQ ID NO: 61792 - RNA, 32 nt, Human
agugacaggguugguuucaaagaaaaaggucc

SEQ ID NO: 61793 - RNA, 32 nt, Human
agugacauguacacaguagaugcucaagcagu

SEQ ID NO: 61794 - RNA, 32 nt, Human
agugacauguccucucugcuugguguaaacca

SEQ ID NO: 61795 - RNA, 32 nt, Human
agugacaugugcugauccuccugccuuuaguu

SEQ ID NO: 61796 - RNA, 32 nt, Human
agugacauuguguacacacugcagcuuggggg

SEQ ID NO: 61797 - RNA, 32 nt, Human
agugacauuucuaucacaaucauuuuauggaa

SEQ ID NO: 61798 - RNA, 32 nt, Human
agugaccaaacagugugcaaaacucacaaagg

SEQ ID NO: 61799 - RNA, 32 nt, Human
agugaccaagcagcaccagcaggccugcccag

SEQ ID NO: 61800 - RNA, 32 nt, Human
agugaccaaguggagacaguaaguuagauccc

SEQ ID NO: 61801 - RNA, 32 nt, Human
agugaccaaugccuccaccucuuggaccaggu

SEQ ID NO: 61802 - RNA, 32 nt, Human
agugaccacagaacucaguguaccaaacaugc

SEQ ID NO: 61803 - RNA, 32 nt, Human
agugaccagaugucccagcuccagugcugugg

SEQ ID NO: 61804 - RNA, 18 nt, Human
agugaccagcaugggagg

SEQ ID NO: 61805 - RNA, 32 nt, Human
agugaccagcuccugcucacugcccucagaaa

SEQ ID NO: 61806 - RNA, 31 nt, Human
agugaccagcucuguggcccugugucgucag

SEQ ID NO: 61807 - RNA, 32 nt, Human
agugaccaggauagagaagcaccagaaccgcc

SEQ ID NO: 61808 - RNA, 32 nt, Human
agugaccaggaugagucauaagacugaugaaa

SEQ ID NO: 61809 - RNA, 32 nt, Human
agugaccaggcccagcagggaggacuugugca

SEQ ID NO: 61810 - RNA, 32 nt, Human
agugaccagguaggaggaggagagggaguaga

SEQ ID NO: 61811 - RNA, 32 nt, Human
agugaccauugguagggccaugguggccggga

SEQ ID NO: 61812 - RNA, 32 nt, Human
agugacccauuucucaagcuccucacguggca

SEQ ID NO: 61813 - RNA, 32 nt, Human
agugacccauuuuccugucuagacucugccuu

SEQ ID NO: 61814 - RNA, 32 nt, Human
agugaccccgaggggcccaucacugcacaaau

SEQ ID NO: 61815 - RNA, 32 nt, Human
agugaccccucgguucuccagcucacccccag

SEQ ID NO: 61816 - RNA, 32 nt, Human
agugaccccugccuacuuccuuccuguuggau

SEQ ID NO: 61817 - RNA, 32 nt, Human
agugaccccuggcauggggaccacacccugga

SEQ ID NO: 61818 - RNA, 32 nt, Human
agugaccccuuuccuguaaccugcacuuuggg

SEQ ID NO: 61819 - RNA, 32 nt, Human
agugacccguuucuguguggguccccacuccc

SEQ ID NO: 61820 - RNA, 32 nt, Human
agugacccugcagagucacucagccaaaucug

SEQ ID NO: 61821 - RNA, 15 nt, Human
agugacccugcuuca

SEQ ID NO: 61822 - RNA, 32 nt, Human
agugaccgagagaagagagcucuggcugcaga

SEQ ID NO: 61823 - RNA, 32 nt, Human
agugaccucagggcacuuugggcuuggcuaga

SEQ ID NO: 61824 - RNA, 32 nt, Human
agugaccucccucagcccccaggggaguaggu

SEQ ID NO: 61825 - RNA, 32 nt, Human
agugaccucccuggccccacuuugcccagagu

SEQ ID NO: 61826 - RNA, 32 nt, Human
agugaccucuacugcuucucugauaccagcug

SEQ ID NO: 61827 - RNA, 32 nt, Human
agugaccucugccucucccacauuccuccccg

SEQ ID NO: 61828 - RNA, 32 nt, Human
agugaccucuuucagugggagguuucugacug

SEQ ID NO: 61829 - RNA, 32 nt, Human
agugaccugcugugacacugugcucucuucug

SEQ ID NO: 61830 - RNA, 32 nt, Human
agugaccuggaaaggguacuagauggaaacuu

SEQ ID NO: 61831 - RNA, 32 nt, Human
agugaccuguucuccugagugcucuagugucu

SEQ ID NO: 61832 - RNA, 32 nt, Human
agugaccuucuccuggaugagcucuccuggcc

SEQ ID NO: 61833 - RNA, 32 nt, Human
agugaccuuuuuggccugcucuccccagcucu

SEQ ID NO: 61834 - RNA, 32 nt, Human
agugacgcuguggugugagguguucugagcuc

SEQ ID NO: 61835 - RNA, 32 nt, Human
agugacggacaugcacguggcagaucaugauu

SEQ ID NO: 61836 - RNA, 32 nt, Human
agugacggccacuccugcggugaacaguacug

SEQ ID NO: 61837 - RNA, 32 nt, Human
agugacggcugagccaagagcuugcuuucagc

SEQ ID NO: 61838 - RNA, 32 nt, Human
agugacgggguuucaccauguuggccaggcug

SEQ ID NO: 61839 - RNA, 18 nt, Human
agugacgucucccugcug

SEQ ID NO: 61840 - RNA, 32 nt, Human
agugacgugugggcagaagcgcacggagccug

SEQ ID NO: 61841 - RNA, 32 nt, Human
agugacucaaugcucagcacccagcuggcaau

SEQ ID NO: 61842 - RNA, 32 nt, Human
agugacucacaaggcuaagcugugcauggggg

SEQ ID NO: 61843 - RNA, 23 nt, Human
agugacucacaccuguaauccca

SEQ ID NO: 61844 - RNA, 32 nt, Human
agugacucagccaggcagacaugagacauggc

SEQ ID NO: 61845 - RNA, 32 nt, Human
agugacucaggucacuuguauguggccaugag

SEQ ID NO: 61846 - RNA, 23 nt, Human
agugacucgcaccuguaauccca

SEQ ID NO: 61847 - RNA, 32 nt, Human
agugacucucuaauuucacaucagcauguuca

SEQ ID NO: 61848 - RNA, 32 nt, Human
agugacucugugccugucuguuuaguucugug

SEQ ID NO: 61849 - RNA, 32 nt, Human
agugacugagggguuaccuuggaguugaugcc

SEQ ID NO: 61850 - RNA, 32 nt, Human
agugacugagggucaggggaauggagccccuc

SEQ ID NO: 61851 - RNA, 32 nt, Human
agugacugaucaguccuuguuuucagguugug

SEQ ID NO: 61852 - RNA, 32 nt, Human
agugacugcuaccuaugauuuaagugacagua

SEQ ID NO: 61853 - RNA, 32 nt, Human
agugacuggaacuucccguacauugcugcugg

SEQ ID NO: 61854 - RNA, 32 nt, Human
agugacuggagcauucaggaagaggcuuucca

SEQ ID NO: 61855 - RNA, 32 nt, Human
agugacugggcaggcagcagaaauuaaaugaa

SEQ ID NO: 61856 - RNA, 21 nt, Human
agugacuggguaaggcaggau

SEQ ID NO: 61857 - RNA, 32 nt, Human
agugacuggguuucaccauguuggccaggcug

SEQ ID NO: 61858 - RNA, 32 nt, Human
agugacuguaugccauucucuuugccaaguaa

SEQ ID NO: 61859 - RNA, 32 nt, Human
agugacuguggaauucuggggaauucugaguu

SEQ ID NO: 61860 - RNA, 31 nt, Human
agugacuguguguucccuugcccuuagauga

SEQ ID NO: 61861 - RNA, 32 nt, Human
agugacuguucccuucccucuguugcagggaa

SEQ ID NO: 61862 - RNA, 32 nt, Human
agugacuuagagacacuguguaucaguuuugc

SEQ ID NO: 61863 - RNA, 32 nt, Human
agugacuucagggacagagcagaggaaagcaa

SEQ ID NO: 61864 - RNA, 32 nt, Human
agugacuuccuggccuucccuucuuuacugau

SEQ ID NO: 61865 - RNA, 32 nt, Human
agugacuucugaccaacagaguguggggagaa

SEQ ID NO: 61866 - RNA, 32 nt, Human
agugacuugccuaagcucgaauagcugugugg

SEQ ID NO: 61867 - RNA, 32 nt, Human
agugacuuguccagagccacucugucaaaagg

SEQ ID NO: 61868 - RNA, 32 nt, Human
agugacuuuccucuuuugcauccugguggaug

SEQ ID NO: 61869 - RNA, 32 nt, Human
agugacuuuuauuuaagccuacuccugacuaa

SEQ ID NO: 61870 - RNA, 32 nt, Human
agugagaaaaacauuuuaaaauuuuaguuaaa

SEQ ID NO: 61871 - RNA, 22 nt, Human
agugagaaaacugggugaagga

SEQ ID NO: 61872 - RNA, 32 nt, Human
agugagaaaagugggacaaaauauacuuuuga

SEQ ID NO: 61873 - RNA, 32 nt, Human
agugagaaaguuuguuugagggcaguagcuca

SEQ ID NO: 61874 - RNA, 32 nt, Human
agugagaagaagcaucgagggcgaggggaaua

SEQ ID NO: 61875 - RNA, 32 nt, Human
agugagaagagggacagggacaaguaguccuu

SEQ ID NO: 61876 - RNA, 32 nt, Human
agugagaagcuaagcaccagccucugcugggc

SEQ ID NO: 61877 - RNA, 21 nt, Human
agugagaaggagcaggcacug

SEQ ID NO: 61878 - RNA, 32 nt, Human
agugagaaggaguuugccuagcaaagauaauu

SEQ ID NO: 61879 - RNA, 32 nt, Human
agugagaagggcccuguauucaccuccacugc

SEQ ID NO: 61880 - RNA, 32 nt, Human
agugagaaugugccucuggauugaccaguggc

SEQ ID NO: 61881 - RNA, 32 nt, Human
agugagacaagcaauuucucccuucugaguua

SEQ ID NO: 61882 - RNA, 32 nt, Human
agugagacacaugagggagaaggugaacccag

SEQ ID NO: 61883 - RNA, 32 nt, Human
agugagacacgugcauuccugccuuccgugaa

SEQ ID NO: 61884 - RNA, 32 nt, Human
agugagaccagccucuagacugugggcugcau

SEQ ID NO: 61885 - RNA, 32 nt, Human
agugagaccagcuucucaucaacuugggcccg

SEQ ID NO: 61886 - RNA, 23 nt, Human
agugagacccccaucucuacaaa

SEQ ID NO: 61887 - RNA, 22 nt, Human
agugagaccccguaucuacaaa

SEQ ID NO: 61888 - RNA, 19 nt, Human
agugagaccccuucucaaa

SEQ ID NO: 61889 - RNA, 19 nt, Human
agugagacccuaucucaaa

SEQ ID NO: 61890 - RNA, 19 nt, Human
agugagacccugucucaaa

SEQ ID NO: 61891 - RNA, 32 nt, Human
agugagagaauagaaaaagcgcuuuaguuugu

SEQ ID NO: 61892 - RNA, 32 nt, Human
agugagagccauaggucggcagagggaacuca

SEQ ID NO: 61893 - RNA, 32 nt, Human
agugagagccuccccugccccugccugcccac

SEQ ID NO: 61894 - RNA, 31 nt, Human
agugagagccuuuucugacgaugccgaagaa

SEQ ID NO: 61895 - RNA, 32 nt, Human
agugagaggaaaagggagagggcgguugagac

SEQ ID NO: 61896 - RNA, 32 nt, Human
agugagaggaaaggaaaagcaucuggcaugug

SEQ ID NO: 61897 - RNA, 32 nt, Human
agugagaggagaagggagagagcuguucuuuu

SEQ ID NO: 61898 - RNA, 32 nt, Human
agugagaggaggaggaggugggcagaggaagg

SEQ ID NO: 61899 - RNA, 32 nt, Human
agugagaggcagugaggaaaaccaccagcgag

SEQ ID NO: 61900 - RNA, 32 nt, Human
agugagaggcaugaaguuacaguguguuuccc

SEQ ID NO: 61901 - RNA, 32 nt, Human
agugagagggguauuuaauuccccuacuaaca

SEQ ID NO: 61902 - RNA, 32 nt, Human
agugagagguacucaauacacugagucacucc

SEQ ID NO: 61903 - RNA, 32 nt, Human
agugagaucuggaggaaugugagaagcauaug

SEQ ID NO: 61904 - RNA, 32 nt, Human
agugagaucuuguagaguggcuuuuucuucca

SEQ ID NO: 61905 - RNA, 32 nt, Human
agugagaugagcccguccuuucaccugcgauc

SEQ ID NO: 61906 - RNA, 32 nt, Human
agugagaugccugcacaucuaaccuugucaga

SEQ ID NO: 61907 - RNA, 32 nt, Human
agugagauguaggauucaaggaagaaauuagg

SEQ ID NO: 61908 - RNA, 32 nt, Human
agugagauuuggguguggagggggaggcgcca

SEQ ID NO: 61909 - RNA, 32 nt, Human
agugagauuuuccagguuaacggucauaaucg

SEQ ID NO: 61910 - RNA, 32 nt, Human
agugagcacacccgugugcacacucauacaca

SEQ ID NO: 61911 - RNA, 32 nt, Human
agugagcacgugcugugggcucugccuagaag

SEQ ID NO: 61912 - RNA, 32 nt, Human
agugagcagagcaacagaggcccccagagacu

SEQ ID NO: 61913 - RNA, 32 nt, Human
agugagcaggcugaggccaccauggagcagug

SEQ ID NO: 61914 - RNA, 32 nt, Human
agugagcaggugaggagaaagacugaaaacua

SEQ ID NO: 61915 - RNA, 32 nt, Human
agugagcaugugagacagagauaagaaauuag

SEQ ID NO: 61916 - RNA, 32 nt, Human
agugagcauuuucuaguucauaugaaaauaac

SEQ ID NO: 61917 - RNA, 32 nt, Human
agugagccaaagguacaccacuacacuccagc

SEQ ID NO: 61918 - RNA, 32 nt, Human
agugagccaagauugcacuacuacacuccagc

SEQ ID NO: 61919 - RNA, 32 nt, Human
agugagccacggcacuccacccugggcaacag

SEQ ID NO: 61920 - RNA, 32 nt, Human
agugagccacugcacuccagccugaugacaga

SEQ ID NO: 61921 - RNA, 32 nt, Human
agugagccacuguaccuggccuuuuggacuaa

SEQ ID NO: 61922 - RNA, 32 nt, Human
agugagccaugauauugccagccugggugaca

SEQ ID NO: 61923 - RNA, 32 nt, Human
agugagccauguucacaccgcugcacucaagc

SEQ ID NO: 61924 - RNA, 32 nt, Human
agugagcccaggaguccucggccagcccugcc

SEQ ID NO: 61925 - RNA, 32 nt, Human
agugagcccaggaguucaaggcugcaaugagc

SEQ ID NO: 61926 - RNA, 32 nt, Human
agugagcccaggaguucagggccagcuuugau

SEQ ID NO: 61927 - RNA, 32 nt, Human
agugagcccugccugggcuccacacccagaga

SEQ ID NO: 61928 - RNA, 32 nt, Human
agugagccgagacugugcuccagccugggcga

SEQ ID NO: 61929 - RNA, 32 nt, Human
agugagccgagauugugccccugcacuccagc

SEQ ID NO: 61930 - RNA, 32 nt, Human
agugagccgagcuugcacuacugcacuccagc

SEQ ID NO: 61931 - RNA, 32 nt, Human
agugagccuagccaggagguguuuggggcucu

SEQ ID NO: 61932 - RNA, 32 nt, Human
agugagccucaggccccgucccugcaccccac

SEQ ID NO: 61933 - RNA, 32 nt, Human
agugagccuccccuccaugcagggggaccuga

SEQ ID NO: 61934 - RNA, 32 nt, Human
agugagccuggaggaggaccugaaggaagggg

SEQ ID NO: 61935 - RNA, 32 nt, Human
agugagccugggaguucgaggcugcagugagc

SEQ ID NO: 61936 - RNA, 32 nt, Human
agugagccuuucuuuucuccugcucguggacu

SEQ ID NO: 61937 - RNA, 32 nt, Human
agugagcggagaucgccccacuacacuccagc

SEQ ID NO: 61938 - RNA, 32 nt, Human
agugagcuagggugggagaaagguggugcuga

SEQ ID NO: 61939 - RNA, 32 nt, Human
agugagcucacugugacccauccuuacucuac

SEQ ID NO: 61940 - RNA, 32 nt, Human
agugagcucaugaucauaccacugcacuuaac

SEQ ID NO: 61941 - RNA, 32 nt, Human
agugagcuccaaugcuaacucaugugccgauc

SEQ ID NO: 61942 - RNA, 32 nt, Human
agugagcuccagaucgacgcugagccucgggg

SEQ ID NO: 61943 - RNA, 32 nt, Human
agugagcuccaggaguggagggggcucauguu

SEQ ID NO: 61944 - RNA, 32 nt, Human
agugagcuccuuuacuaacauucauguuaugg

SEQ ID NO: 61945 - RNA, 32 nt, Human
agugagcucucuuugaggcuaagcaaggaggc

SEQ ID NO: 61946 - RNA, 32 nt, Human
agugagcugacugccuuggccucccagagugc

SEQ ID NO: 61947 - RNA, 32 nt, Human
agugagcugagaucuucccacugcacuccagc

SEQ ID NO: 61948 - RNA, 32 nt, Human
agugagcugagauugcacuccagccugggcga

SEQ ID NO: 61949 - RNA, 32 nt, Human
agugagcugcacugcauuccagccugggugac

SEQ ID NO: 61950 - RNA, 32 nt, Human
agugagcugcgacgggcacaccccggagcguc

SEQ ID NO: 61951 - RNA, 32 nt, Human
agugagcuggggagggaaguggauccauuucu

SEQ ID NO: 61952 - RNA, 32 nt, Human
agugagcuggggccugcugagguggggguggg

SEQ ID NO: 61953 - RNA, 31 nt, Human
agugagcugugauugcaccacuuguaacucc

SEQ ID NO: 61954 - RNA, 32 nt, Human
agugagcuuggcugcuugugaggagcuacaag

SEQ ID NO: 61955 - RNA, 32 nt, Human
agugagcuugugcuuaguauuuacauuggaug

SEQ ID NO: 61956 - RNA, 32 nt, Human
agugaggaaauggcaacacauggaagugaagu

SEQ ID NO: 61957 - RNA, 32 nt, Human
agugaggaaauggcaacacguggaggugaagu

SEQ ID NO: 61958 - RNA, 32 nt, Human
agugaggaacuagauccuucucuccucagccu

SEQ ID NO: 61959 - RNA, 24 nt, Human
agugaggaagugacuguaugugga

SEQ ID NO: 61960 - RNA, 32 nt, Human
agugaggaagugagacagggaaaacagggcag

SEQ ID NO: 61961 - RNA, 32 nt, Human
agugaggaaguggcuguccugaauugcuguaa

SEQ ID NO: 61962 - RNA, 32 nt, Human
agugaggacugcagcugcuuucuugaacaaua

SEQ ID NO: 61963 - RNA, 32 nt, Human
agugaggagaggaggagagaggcuugucaaaa

SEQ ID NO: 61964 - RNA, 32 nt, Human
agugaggaggaggaggaggagaaggaggagga

SEQ ID NO: 61965 - RNA, 32 nt, Human
agugaggaggauacugaacaggauguggcuaa

SEQ ID NO: 61966 - RNA, 32 nt, Human
agugaggaggcugaaggcagggcccagaggag

SEQ ID NO: 61967 - RNA, 32 nt, Human
agugaggagggguuuggggaggugggggcggg

SEQ ID NO: 61968 - RNA, 32 nt, Human
agugaggagguggguggaggcaugcaggggag

SEQ ID NO: 61969 - RNA, 32 nt, Human
agugaggcagugagaugcugcugcuguggauu

SEQ ID NO: 61970 - RNA, 32 nt, Human
agugaggccaaagcacuguccuguaagucuua

SEQ ID NO: 61971 - RNA, 32 nt, Human
agugaggccaggaguucaagaucagccuggcc

SEQ ID NO: 61972 - RNA, 32 nt, Human
agugaggcccagggagugcagauagcuacaga

SEQ ID NO: 61973 - RNA, 32 nt, Human
agugaggcccucagaccugccacagggcagag

SEQ ID NO: 61974 - RNA, 32 nt, Human
agugaggccucugccauguccagagggcacaa

SEQ ID NO: 61975 - RNA, 32 nt, Human
agugaggcucagaagggacacaaagagggaug

SEQ ID NO: 61976 - RNA, 32 nt, Human
agugaggcugcuuuggucuccucaagucuguc

SEQ ID NO: 61977 - RNA, 32 nt, Human
agugagggaaagucaguugagggacacaaaag

SEQ ID NO: 61978 - RNA, 32 nt, Human
agugagggaagacacgcggaaacaggcuugca

SEQ ID NO: 61979 - RNA, 22 nt, Human
agugagggaauuagaccuuugg

SEQ ID NO: 61980 - RNA, 32 nt, Human
agugagggagaaagugaucugcagggaggugg

SEQ ID NO: 61981 - RNA, 32 nt, Human
agugagggagcaagggagagcaggggaggugu

SEQ ID NO: 61982 - RNA, 32 nt, Human
agugagggaggaauuuuacugacccagcaucc

SEQ ID NO: 61983 - RNA, 32 nt, Human
agugagggagguggacggugccagcugaggcu

SEQ ID NO: 61984 - RNA, 32 nt, Human
agugagggaugccgcaaccucgacuucucagc

SEQ ID NO: 61985 - RNA, 21 nt, Human
agugagggcacugcucuugga

SEQ ID NO: 61986 - RNA, 32 nt, Human
agugagggcagaauucaacaagcacaacucac

SEQ ID NO: 61987 - RNA, 32 nt, Human
agugagggccagggagugaguguuagaagaag

SEQ ID NO: 61988 - RNA, 32 nt, Human
agugagggccauccucuuucugcuccucgaca

SEQ ID NO: 61989 - RNA, 32 nt, Human
agugagggccucagagccugaccugagagucc

SEQ ID NO: 61990 - RNA, 32 nt, Human
agugagggcgaggaggaugacgagggcgagga

SEQ ID NO: 61991 - RNA, 32 nt, Human
agugagggcuccaggaaugaggagaaucuuca

SEQ ID NO: 61992 - RNA, 32 nt, Human
agugagggggagacucacccacccucucccuc

SEQ ID NO: 61993 - RNA, 32 nt, Human
agugagggguggagcuugccaaggagcacugg

SEQ ID NO: 61994 - RNA, 32 nt, Human
agugagggugccuagcacaaugucuggcacaa

SEQ ID NO: 61995 - RNA, 32 nt, Human
agugaggguggagggagacagugggcggcagc

SEQ ID NO: 61996 - RNA, 32 nt, Human
agugaggguguagaugucugugucugugagau

SEQ ID NO: 61997 - RNA, 32 nt, Human
agugagguaggccagcuuuuaugacgcaccug

SEQ ID NO: 61998 - RNA, 32 nt, Human
agugaggucacaguccacccacccucucucug

SEQ ID NO: 61999 - RNA, 32 nt, Human
agugagguggcucuggcacugccccuggacuu

SEQ ID NO: 62000 - RNA, 32 nt, Human
agugaggugggcuccuggaacugcagcagcca

SEQ ID NO: 62001 - RNA, 32 nt, Human
agugaggugggugggagaggaagaaaguuggg

SEQ ID NO: 62002 - RNA, 32 nt, Human
agugaggugggugucccaugugcuuggucucc

SEQ ID NO: 62003 - RNA, 32 nt, Human
agugagguuccguugugcgcugugccuaucuc

SEQ ID NO: 62004 - RNA, 32 nt, Human
agugagguuucuucucuucugcccuaacuauu

SEQ ID NO: 62005 - RNA, 32 nt, Human
agugagguuuuuaucuuuuaaaggacaggccc

SEQ ID NO: 62006 - RNA, 32 nt, Human
agugaguaacaccucauucuggccgagaguag

SEQ ID NO: 62007 - RNA, 32 nt, Human
agugagucagcuuuaggugaccugguucuugu

SEQ ID NO: 62008 - RNA, 32 nt, Human
agugaguccauguggagagagcacugugugcg

SEQ ID NO: 62009 - RNA, 32 nt, Human
agugaguccuccucuuccucuggcaucaauuu

SEQ ID NO: 62010 - RNA, 24 nt, Human
agugagucuccaggaagucacaga

SEQ ID NO: 62011 - RNA, 23 nt, Human
agugagucuccaggucugccaca

SEQ ID NO: 62012 - RNA, 32 nt, Human
agugagucucggcuggagugcaguggugcagu

SEQ ID NO: 62013 - RNA, 32 nt, Human
agugagucugccucuugugcuuggugucuuuu

SEQ ID NO: 62014 - RNA, 32 nt, Human
agugagugacagccucacagccucaggcccac

SEQ ID NO: 62015 - RNA, 31 nt, Human
agugagugacuucucgugagagaucuggucg

SEQ ID NO: 62016 - RNA, 32 nt, Human
agugagugagcugaagccacaggcagcgaucc

SEQ ID NO: 62017 - RNA, 32 nt, Human
agugagugccaugcuuuuuggugagggcagau

SEQ ID NO: 62018 - RNA, 32 nt, Human
agugagugcuccaucaauaucugugcaauaau

SEQ ID NO: 62019 - RNA, 32 nt, Human
agugagugcugagcucucacccuucccccacu

SEQ ID NO: 62020 - RNA, 32 nt, Human
agugaguggagagccuacauaaaagagaguaa

SEQ ID NO: 62021 - RNA, 32 nt, Human
agugaguguucugccuguguguguuuuagguc

SEQ ID NO: 62022 - RNA, 32 nt, Human
agugaguucuaaaauacaaauaugaaagcagg

SEQ ID NO: 62023 - RNA, 32 nt, Human
agugaguucuguaaauggagacuuaggucccc

SEQ ID NO: 62024 - RNA, 32 nt, Human
agugaguugguggaaguauuuggccauggaaa

SEQ ID NO: 62025 - RNA, 21 nt, Human
agugaguuguaaagucagaga

SEQ ID NO: 62026 - RNA, 32 nt, Human
agugauaaacuaagucacauacagauaaagca

SEQ ID NO: 62027 - RNA, 32 nt, Human
agugauacauaaaauuaaagccuguggcauuu

SEQ ID NO: 62028 - RNA, 32 nt, Human
agugauaccaucccugcacuccuggguccugc

SEQ ID NO: 62029 - RNA, 32 nt, Human
agugauagaaagccaugugaggggacgagagg

SEQ ID NO: 62030 - RNA, 32 nt, Human
agugauagcgaugguguuuccucuccagggau

SEQ ID NO: 62031 - RNA, 32 nt, Human
agugauaguagccugaaccacauuuuagauaa

SEQ ID NO: 62032 - RNA, 32 nt, Human
agugauaguuaccuucacaauggugcuacccc

SEQ ID NO: 62033 - RNA, 32 nt, Human
agugauauacccuuccuuuuauagcucaaggg

SEQ ID NO: 62034 - RNA, 32 nt, Human
agugauauuuagaccccucucaguuaagaaau

SEQ ID NO: 62035 - RNA, 32 nt, Human
agugaucaacacaccaaagucucugccauaaa

SEQ ID NO: 62036 - RNA, 32 nt, Human
agugaucaagugaaaaagcugcaucaagaccc

SEQ ID NO: 62037 - RNA, 32 nt, Human
agugaucacauccugauugaguggcuauggac

SEQ ID NO: 62038 - RNA, 32 nt, Human
agugaucacgccauugcacuccagccugggug

SEQ ID NO: 62039 - RNA, 32 nt, Human
agugaucacugcacgcccaucgugcacaccug

SEQ ID NO: 62040 - RNA, 32 nt, Human
agugaucagcuaccccagcucggcgggggagc

SEQ ID NO: 62041 - RNA, 32 nt, Human
agugaucagcucccuaaaaccaugccuaagua

SEQ ID NO: 62042 - RNA, 19 nt, Human
agugaucaucagaugagau

SEQ ID NO: 62043 - RNA, 32 nt, Human
agugaucauggugugcgaguggucaauugagu

SEQ ID NO: 62044 - RNA, 32 nt, Human
agugauccacccaccucagccucccagagugc

SEQ ID NO: 62045 - RNA, 32 nt, Human
agugauccacccaucucagccuccugaguagc

SEQ ID NO: 62046 - RNA, 32 nt, Human
agugauccacuggccccacgucacacaguuac

SEQ ID NO: 62047 - RNA, 32 nt, Human
agugauccagcuuucuccuuuuggauugaggc

SEQ ID NO: 62048 - RNA, 32 nt, Human
agugauccagggaugaacacccccugugcggu

SEQ ID NO: 62049 - RNA, 32 nt, Human
agugauccugccgcccccucccugggcucguc

SEQ ID NO: 62050 - RNA, 32 nt, Human
agugaucgaguccuggcuugggagggaagguc

SEQ ID NO: 62051 - RNA, 32 nt, Human
agugaucuacccaccucggcuucccaaagugc

SEQ ID NO: 62052 - RNA, 32 nt, Human
agugaucucagaggggcccauggauuaacgcc

SEQ ID NO: 62053 - RNA, 32 nt, Human
agugaucucuacucaaguggucgugaucgggu

SEQ ID NO: 62054 - RNA, 32 nt, Human
agugaucugcccaccucugccucccaaagugc

SEQ ID NO: 62055 - RNA, 32 nt, Human
agugaucugcccaccuuggucuuccaaaguac

SEQ ID NO: 62056 - RNA, 32 nt, Human
agugaucugcccgccacagcaggcugggauca

SEQ ID NO: 62057 - RNA, 32 nt, Human
agugaucugcccgccucgaccucucucaaaau

SEQ ID NO: 62058 - RNA, 32 nt, Human
agugaucuggcugggaaaggggaccaggagug

SEQ ID NO: 62059 - RNA, 32 nt, Human
agugaucugugccuuaagaacaugcuccugcu

SEQ ID NO: 62060 - RNA, 32 nt, Human
agugaucuuaccagccagcuguccucagcgca

SEQ ID NO: 62061 - RNA, 32 nt, Human
agugaugaaagaaaacaaagaaauagaguugu

SEQ ID NO: 62062 - RNA, 32 nt, Human
agugaugaaaucaagacuauuuauuuggaaua

SEQ ID NO: 62063 - RNA, 23 nt, Human
agugaugaaauuauccuaaauac

SEQ ID NO: 62064 - RNA, 19 nt, Human
agugaugaacauuuugguc

SEQ ID NO: 62065 - RNA, 32 nt, Human
agugaugaagugaaaauaauuuacauucgaua

SEQ ID NO: 62066 - RNA, 32 nt, Human
agugaugagauuauaggcgugagccaccgcgc

SEQ ID NO: 62067 - RNA, 32 nt, Human
agugaugcauguugauguuacagucaauuugg

SEQ ID NO: 62068 - RNA, 32 nt, Human
agugaugccagaagguuugggaagaaggugug

SEQ ID NO: 62069 - RNA, 32 nt, Human
agugaugccgcaccucagucucucccucugcu

SEQ ID NO: 62070 - RNA, 32 nt, Human
agugaugccuggggacucuccuuaaucacuca

SEQ ID NO: 62071 - RNA, 32 nt, Human
agugaugcgcaacuuccucucucuuagggaau

SEQ ID NO: 62072 - RNA, 32 nt, Human
agugaugcuacuuuuaaaaggaucccaaacuu

SEQ ID NO: 62073 - RNA, 32 nt, Human
agugaugcuggcugaagcugccugugcacguu

SEQ ID NO: 62074 - RNA, 32 nt, Human
agugaugcuuccaggauuuguuuucagaaaca

SEQ ID NO: 62075 - RNA, 32 nt, Human
agugauggacgccuccacaggucuucacagag

SEQ ID NO: 62076 - RNA, 29 nt, Human
agugauggaggaaauaccagcccaggaag

SEQ ID NO: 62077 - RNA, 32 nt, Human
agugauggaggcuguggacagaaacaggucag

SEQ ID NO: 62078 - RNA, 32 nt, Human
agugauggcgaugcccuccaccucuuuccucc

SEQ ID NO: 62079 - RNA, 32 nt, Human
agugauggcuggcgccugccucccgggugucu

SEQ ID NO: 62080 - RNA, 32 nt, Human
agugauggcuuggaacacugucuuacacagca

SEQ ID NO: 62081 - RNA, 32 nt, Human
agugaugggaucucgcucuguugcccagggug

SEQ ID NO: 62082 - RNA, 32 nt, Human
agugaugggauuacagaugugagccaccgugc

SEQ ID NO: 62083 - RNA, 32 nt, Human
agugaugggauuacaggcaugagccaccgugc

SEQ ID NO: 62084 - RNA, 32 nt, Human
agugaugggauuacaggcgugagccaccgcgc

SEQ ID NO: 62085 - RNA, 32 nt, Human
agugauggggaaagcuuuuucugaagcugccu

SEQ ID NO: 62086 - RNA, 32 nt, Human
agugauggggugggcagagagaggauaggagg

SEQ ID NO: 62087 - RNA, 32 nt, Human
agugaugguggaggugcagccagggcaaggag

SEQ ID NO: 62088 - RNA, 32 nt, Human
agugaugucaucuuuuucuuuuaaagaauuaa

SEQ ID NO: 62089 - RNA, 32 nt, Human
agugauguccucucucagcuaucacaucacaa

SEQ ID NO: 62090 - RNA, 32 nt, Human
agugaugucucugcccuuccucuagccucuug

SEQ ID NO: 62091 - RNA, 32 nt, Human
agugaugucugguaacaagaugugacuuuuug

SEQ ID NO: 62092 - RNA, 20 nt, Human
agugaugugacuucuugguc

SEQ ID NO: 62093 - RNA, 32 nt, Human
agugaugugguuuucuaauuucuuugggguaa

SEQ ID NO: 62094 - RNA, 32 nt, Human
agugauguuauccugaggagcaauugggggag

SEQ ID NO: 62095 - RNA, 32 nt, Human
agugauguuguuugggagagugcaguaguaau

SEQ ID NO: 62096 - RNA, 32 nt, Human
agugauucaugccuuacagaacaucagagagu

SEQ ID NO: 62097 - RNA, 32 nt, Human
agugauuccucuucaaagauuuuagccuguaa

SEQ ID NO: 62098 - RNA, 32 nt, Human
agugauucucccgccucagucucccaaguagc

SEQ ID NO: 62099 - RNA, 32 nt, Human
agugauucuccugccucagccucccagguagc

SEQ ID NO: 62100 - RNA, 32 nt, Human
agugauucuccugccucagucucccaaguagc

SEQ ID NO: 62101 - RNA, 32 nt, Human
agugauucuccugccuuagccucccagguagc

SEQ ID NO: 62102 - RNA, 22 nt, Human
agugauucugccuguaauccca

SEQ ID NO: 62103 - RNA, 32 nt, Human
agugauucugugcaagucugucucaaucuuuu

SEQ ID NO: 62104 - RNA, 32 nt, Human
agugauucuguuugccuuuuguuuucauuggu

SEQ ID NO: 62105 - RNA, 32 nt, Human
agugauugcaccacugcacuccagccugggug

SEQ ID NO: 62106 - RNA, 32 nt, Human
agugauugcauauuauuuccauaucauaguau

SEQ ID NO: 62107 - RNA, 32 nt, Human
agugauuguacagcaggcugggcccaggaggu

SEQ ID NO: 62108 - RNA, 32 nt, Human
agugauuguuagagguaguuuucuugaauuaa

SEQ ID NO: 62109 - RNA, 32 nt, Human
agugauuuauucacaaccccaaaaucagaaaa

SEQ ID NO: 62110 - RNA, 32 nt, Human
agugauuuauucauauauuccuguccaaagcc

SEQ ID NO: 62111 - RNA, 32 nt, Human
agugauuucuacugcucuuggcccagagccag

SEQ ID NO: 62112 - RNA, 32 nt, Human
agugauuugcagccccuccuuucagaguacca

SEQ ID NO: 62113 - RNA, 32 nt, Human
agugauuugugggaaaaauaaauaaauguucu

SEQ ID NO: 62114 - RNA, 32 nt, Human
agugauuuguuaaaauaccuugcccaagaaua

SEQ ID NO: 62115 - RNA, 32 nt, Human
agugauuuuagcuucugccagcugcuuuugcc

SEQ ID NO: 62116 - RNA, 32 nt, Human
agugauuuuagugcuugucagcauuuuuccau

SEQ ID NO: 62117 - RNA, 24 nt, Human
agugauuuuggcacaagugaccga

SEQ ID NO: 62118 - RNA, 32 nt, Human
agugauuuuucagugguccuucagagggagaa

SEQ ID NO: 62119 - RNA, 32 nt, Human
agugcaaaaagcugguuucuuuagaggcacuu

SEQ ID NO: 62120 - RNA, 32 nt, Human
agugcaaaccagcauggugaaugagcuugauu

SEQ ID NO: 62121 - RNA, 32 nt, Human
agugcaaaggcccugaggcaggggugugucug

SEQ ID NO: 62122 - RNA, 32 nt, Human
agugcaaaggccuguuuggagacucuguggga

SEQ ID NO: 62123 - RNA, 32 nt, Human
agugcaaagugcccucauuuguggcccaagcc

SEQ ID NO: 62124 - RNA, 32 nt, Human
agugcaaauuuuagcauauggggccugacuuc

SEQ ID NO: 62125 - RNA, 32 nt, Human
agugcaacaaaugccagcauugccauucgggg

SEQ ID NO: 62126 - RNA, 32 nt, Human
agugcaacacugcagggcucucaggagggggu

SEQ ID NO: 62127 - RNA, 21 nt, Human
agugcaacagucaggcugcug

SEQ ID NO: 62128 - RNA, 32 nt, Human
agugcaacauggccaggggcugccucugcugc

SEQ ID NO: 62129 - RNA, 32 nt, Human
agugcaagaagcuuccuugccugagaucaccu

SEQ ID NO: 62130 - RNA, 32 nt, Human
agugcaagaauagccagcauuuccgauuuuga

SEQ ID NO: 62131 - RNA, 32 nt, Human
agugcaagacaugccaauuugagacacacggu

SEQ ID NO: 62132 - RNA, 32 nt, Human
agugcaagaggcuccaaaaggaagaaaaagaa

SEQ ID NO: 62133 - RNA, 32 nt, Human
agugcaaggugcccaggacagaaacagacccc

SEQ ID NO: 62134 - RNA, 32 nt, Human
agugcaagucagagcaaagcccagaaagcaga

SEQ ID NO: 62135 - RNA, 32 nt, Human
agugcaaguucagauucuguggcagagauuug

SEQ ID NO: 62136 - RNA, 32 nt, Human
agugcaauauuuugcaaacagcucuucuuagg

SEQ ID NO: 62137 - RNA, 32 nt, Human
agugcaaugggagacaucagagacuuuaaaaa

SEQ ID NO: 62138 - RNA, 32 nt, Human
agugcacaaagacacugguuuucaaucggcgu

SEQ ID NO: 62139 - RNA, 32 nt, Human
agugcacacacacagucuuccagccugcucug

SEQ ID NO: 62140 - RNA, 27 nt, Human
agugcacacagguccccggggacccca

SEQ ID NO: 62141 - RNA, 32 nt, Human
agugcacacauguggugguggaagagggcaug

SEQ ID NO: 62142 - RNA, 32 nt, Human
agugcacaccuguaaucccagguacucgggag

SEQ ID NO: 62143 - RNA, 32 nt, Human
agugcacagaugggccuaggagaggacucagg

SEQ ID NO: 62144 - RNA, 31 nt, Human
agugcacaggacggccccacagcagaccagc

SEQ ID NO: 62145 - RNA, 32 nt, Human
agugcacaggagaaaguuaagaagcaucacag

SEQ ID NO: 62146 - RNA, 32 nt, Human
agugcacauacccaguccuuaagcagacauug

SEQ ID NO: 62147 - RNA, 20 nt, Human
agugcacauggccugaggcg

SEQ ID NO: 62148 - RNA, 32 nt, Human
agugcaccacucggcgccgucccaggcccgac

SEQ ID NO: 62149 - RNA, 32 nt, Human
agugcaccacugcacuccagccugggcaacaa

SEQ ID NO: 62150 - RNA, 32 nt, Human
agugcaccacugcacuccagccugggcaacag

SEQ ID NO: 62151 - RNA, 32 nt, Human
agugcaccauugcacuccagccugggcaaaaa

SEQ ID NO: 62152 - RNA, 32 nt, Human
agugcaccggaauaaagagaauuuguaggcgu

SEQ ID NO: 62153 - RNA, 16 nt, Human
agugcaccuggccuga

SEQ ID NO: 62154 - RNA, 32 nt, Human
agugcaccuguaaucccagcuacucuggaggc

SEQ ID NO: 62155 - RNA, 19 nt, Human
agugcaccuuccaguccca

SEQ ID NO: 62156 - RNA, 32 nt, Human
agugcacgacaccuuuaaaaugccuagauuuc

SEQ ID NO: 62157 - RNA, 32 nt, Human
agugcacgccagccugggcgacagacucugug

SEQ ID NO: 62158 - RNA, 32 nt, Human
agugcacgccuguaaucccagcuacucaggag

SEQ ID NO: 62159 - RNA, 32 nt, Human
agugcacgccuguaaucccagcuucuugggag

SEQ ID NO: 62160 - RNA, 32 nt, Human
agugcacgccuguaaucccugcuacucgggag

SEQ ID NO: 62161 - RNA, 32 nt, Human
agugcacgcuggucccagauggggcugggggu

SEQ ID NO: 62162 - RNA, 32 nt, Human
agugcacuacuguacuccagccagggcaagag

SEQ ID NO: 62163 - RNA, 20 nt, Human
agugcacuagacagcugcug

SEQ ID NO: 62164 - RNA, 32 nt, Human
agugcacuccagccugagagacagagugagau

SEQ ID NO: 62165 - RNA, 32 nt, Human
agugcacucucucaccccuccuucaguccuac

SEQ ID NO: 62166 - RNA, 32 nt, Human
agugcacugaaagcccugucucggcuggccca

SEQ ID NO: 62167 - RNA, 32 nt, Human
agugcacuggccuccagccucaaucuguuccg

SEQ ID NO: 62168 - RNA, 32 nt, Human
agugcacugugucuugcugccugggugcccuc

SEQ ID NO: 62169 - RNA, 32 nt, Human
agugcacuugcuggauugaagaaugugagugu

SEQ ID NO: 62170 - RNA, 32 nt, Human
agugcacuuuggccugggcaugguggcucaug

SEQ ID NO: 62171 - RNA, 32 nt, Human
agugcagaagucagauggaccgauuggaucgg

SEQ ID NO: 62172 - RNA, 32 nt, Human
agugcagaaugggccagcagggcugcaggugc

SEQ ID NO: 62173 - RNA, 32 nt, Human
agugcagacaccgucaucccaccccaccugag

SEQ ID NO: 62174 - RNA, 32 nt, Human
agugcagaccagagccuugcagagccagacag

SEQ ID NO: 62175 - RNA, 32 nt, Human
agugcagaccucugacccuggagucgcucggc

SEQ ID NO: 62176 - RNA, 32 nt, Human
agugcagagacaccaccagguacugcgagaag

SEQ ID NO: 62177 - RNA, 32 nt, Human
agugcagagagggagacaggcaggcaggcagg

SEQ ID NO: 62178 - RNA, 32 nt, Human
agugcagagauggggaggaggggcucugccac

SEQ ID NO: 62179 - RNA, 32 nt, Human
agugcagaggaaaugggacaccaccuguccug

SEQ ID NO: 62180 - RNA, 22 nt, Human
agugcagaggagaagggcugcu

SEQ ID NO: 62181 - RNA, 32 nt, Human
agugcagaggcagagucuggggcucagguugg

SEQ ID NO: 62182 - RNA, 22 nt, Human
agugcagauugcuuguauguaa

SEQ ID NO: 62183 - RNA, 32 nt, Human
agugcagcaaaacccacugccuccaggaagcc

SEQ ID NO: 62184 - RNA, 32 nt, Human
agugcagcagugacaugaucauagcucacugc

SEQ ID NO: 62185 - RNA, 32 nt, Human
agugcagccagagaaugcccacugccuguaac

SEQ ID NO: 62186 - RNA, 32 nt, Human
agugcagccagcagcccugcccugccaggugg

SEQ ID NO: 62187 - RNA, 32 nt, Human
agugcagccccagggugagaaggugcccaccg

SEQ ID NO: 62188 - RNA, 32 nt, Human
agugcagcccggcgccggcgacugccugcccc

SEQ ID NO: 62189 - RNA, 32 nt, Human
agugcagccucaaacuccugggcucaagccau

SEQ ID NO: 62190 - RNA, 32 nt, Human
agugcagccucgaccaccugugcucaagcaau

SEQ ID NO: 62191 - RNA, 32 nt, Human
agugcagccucuucccuuggggccucagagag

SEQ ID NO: 62192 - RNA, 32 nt, Human
agugcagccuguaaguucuccacauugacaca

SEQ ID NO: 62193 - RNA, 32 nt, Human
agugcagcuaacugaggccucaggggcaggag

SEQ ID NO: 62194 - RNA, 31 nt, Human
agugcagcucccaugcaaaguuugcuuuuag

SEQ ID NO: 62195 - RNA, 32 nt, Human
agugcagcuccguuuggcagugcaaugguaua

SEQ ID NO: 62196 - RNA, 32 nt, Human
agugcagcuuuucauuguguugugugguuggu

SEQ ID NO: 62197 - RNA, 32 nt, Human
agugcaggagcagaaaucgaagucauccauca

SEQ ID NO: 62198 - RNA, 32 nt, Human
agugcaggcaggcagccaaaugagugggaauu

SEQ ID NO: 62199 - RNA, 32 nt, Human
agugcagggaaagaggugaucaacaaagagga

SEQ ID NO: 62200 - RNA, 32 nt, Human
agugcagggaaagaggugucaacaaagaggac

SEQ ID NO: 62201 - RNA, 32 nt, Human
agugcagggaaaggaggcagggaaaagaccag

SEQ ID NO: 62202 - RNA, 32 nt, Human
agugcagggacaccucccggguucaagcaguu

SEQ ID NO: 62203 - RNA, 32 nt, Human
agugcagggaggugugggguaagggagggaag

SEQ ID NO: 62204 - RNA, 24 nt, Human
agugcagggaguugaacuuuugga

SEQ ID NO: 62205 - RNA, 32 nt, Human
agugcagggauuacaggcaugagccaccaugc

SEQ ID NO: 62206 - RNA, 32 nt, Human
agugcagggauuacaggcgugagccacugcuc

SEQ ID NO: 62207 - RNA, 32 nt, Human
agugcagggccuguaaucccagcauuuuggga

SEQ ID NO: 62208 - RNA, 32 nt, Human
agugcagggcuuacaggugugagccacagugc

SEQ ID NO: 62209 - RNA, 32 nt, Human
agugcaggggauggcccugcugcugcuuccgg

SEQ ID NO: 62210 - RNA, 19 nt, Human
agugcagggguggcugcug

SEQ ID NO: 62211 - RNA, 32 nt, Human
agugcagggugcgggcaccaggaaagggggcg

SEQ ID NO: 62212 - RNA, 32 nt, Human
agugcagguagacuuuauuuuugaaagcaucg

SEQ ID NO: 62213 - RNA, 24 nt, Human
agugcagguagcuaacacugacca

SEQ ID NO: 62214 - RNA, 18 nt, Human
agugcaggucagccugga

SEQ ID NO: 62215 - RNA, 32 nt, Human
agugcaggucugcuuugguccuucuccuaaac

SEQ ID NO: 62216 - RNA, 32 nt, Human
agugcaggugggcauaggugcagugagugcag

SEQ ID NO: 62217 - RNA, 32 nt, Human
agugcaguauagaauaggcacuuuaaaacacu

SEQ ID NO: 62218 - RNA, 32 nt, Human
agugcagucaucaccauccucagaccucauga

SEQ ID NO: 62219 - RNA, 32 nt, Human
agugcagucaucucuuauucaugguaguguuu

SEQ ID NO: 62220 - RNA, 32 nt, Human
agugcagugagcugagauugcgccacugcacu

SEQ ID NO: 62221 - RNA, 32 nt, Human
agugcagugagugagaguccuugggagcgcgg

SEQ ID NO: 62222 - RNA, 32 nt, Human
agugcagugcgcuguaguaggcauuuuuacca

SEQ ID NO: 62223 - RNA, 32 nt, Human
agugcauaaucgagcaggaggcuggaaucugg

SEQ ID NO: 62224 - RNA, 32 nt, Human
agugcaucagauacauuuuauauuucuuaaaa

SEQ ID NO: 62225 - RNA, 24 nt, Human
agugcauccacaagcuggaucuga

SEQ ID NO: 62226 - RNA, 23 nt, Human
agugcaucgcuauaauucauuaa

SEQ ID NO: 62227 - RNA, 32 nt, Human
agugcaugaaggacagugauguggggaggccg

SEQ ID NO: 62228 - RNA, 32 nt, Human
agugcaugaauaagcauuuucccacacaauga

SEQ ID NO: 62229 - RNA, 32 nt, Human
agugcaugagccaccaugccuggccuguuuag

SEQ ID NO: 62230 - RNA, 32 nt, Human
agugcaugcacuccagccugggcaacagacag

SEQ ID NO: 62231 - RNA, 32 nt, Human
agugcaugccucuaaucccagcuacucaggag

SEQ ID NO: 62232 - RNA, 32 nt, Human
agugcaugccuguaaucccagcuacucaggag

SEQ ID NO: 62233 - RNA, 32 nt, Human
agugcaugccuguaaucccagcuacuugggag

SEQ ID NO: 62234 - RNA, 32 nt, Human
agugcaugccuguagucccagcuaccugggag

SEQ ID NO: 62235 - RNA, 32 nt, Human
agugcaugccuguagucccagcuacuugggag

SEQ ID NO: 62236 - RNA, 32 nt, Human
agugcauguguuggagagaggugggaagcaga

SEQ ID NO: 62237 - RNA, 32 nt, Human
agugcauucccaaauucuaaauagcugacccu

SEQ ID NO: 62238 - RNA, 32 nt, Human
agugcauugggaugguuuuccaggcaaggcac

SEQ ID NO: 62239 - RNA, 32 nt, Human
agugcauuugccuuuccuuucugcacuuggcu

SEQ ID NO: 62240 - RNA, 32 nt, Human
agugcauuuguaacuggauuuauuucuuaaua

SEQ ID NO: 62241 - RNA, 32 nt, Human
agugcauuuuaaccaguacucugggugcaaua

SEQ ID NO: 62242 - RNA, 25 nt, Human
agugccaaagagaagagcuuacugg

SEQ ID NO: 62243 - RNA, 32 nt, Human
agugccaaagagaagagcuuacuggguaguua

SEQ ID NO: 62244 - RNA, 32 nt, Human
agugccaacgagagccgcucccugccacagcc

SEQ ID NO: 62245 - RNA, 32 nt, Human
agugccaagaccagccuuccagccgagguuug

SEQ ID NO: 62246 - RNA, 18 nt, Human
agugccaagacugugccg

SEQ ID NO: 62247 - RNA, 32 nt, Human
agugccaagagagcugagaggagcaguuguga

SEQ ID NO: 62248 - RNA, 32 nt, Human
agugccaagagugucccucugagacccuuggg

SEQ ID NO: 62249 - RNA, 32 nt, Human
agugccaaggcucugagggugucuuggguuca

SEQ ID NO: 62250 - RNA, 32 nt, Human
agugccacaaagccacuguagccagacugccu

SEQ ID NO: 62251 - RNA, 22 nt, Human
agugccacacugugggguguug

SEQ ID NO: 62252 - RNA, 32 nt, Human
agugccacagccucgucuggaaaaaggaccag

SEQ ID NO: 62253 - RNA, 32 nt, Human
agugccacagcucuccagccugggcgacagag

SEQ ID NO: 62254 - RNA, 32 nt, Human
agugccacaggaggaggaggaggacauggggu

SEQ ID NO: 62255 - RNA, 32 nt, Human
agugccacaggguacgcacacgcagagccccg

SEQ ID NO: 62256 - RNA, 32 nt, Human
agugccacccagcaggcguuugaaaacaagaa

SEQ ID NO: 62257 - RNA, 18 nt, Human
agugccacccucgccuca

SEQ ID NO: 62258 - RNA, 32 nt, Human
agugccaccguacucuagccugggcgacagag

SEQ ID NO: 62259 - RNA, 32 nt, Human
agugccacugauuuucuagucugcuucauacc

SEQ ID NO: 62260 - RNA, 32 nt, Human
agugccacugcaaucaagcucccaguugugga

SEQ ID NO: 62261 - RNA, 32 nt, Human
agugccacugcaauccagccugggcaacagag

SEQ ID NO: 62262 - RNA, 32 nt, Human
agugccacugcaauucagccugggugacauag

SEQ ID NO: 62263 - RNA, 32 nt, Human
agugccacugcacuacagcccgggcgacagag

SEQ ID NO: 62264 - RNA, 32 nt, Human
agugccacugcacuccagccugggcaacacag

SEQ ID NO: 62265 - RNA, 32 nt, Human
agugccacugcacuccagccugggugacagag

SEQ ID NO: 62266 - RNA, 32 nt, Human
agugccacugcacuucagccugggugacagag

SEQ ID NO: 62267 - RNA, 32 nt, Human
agugccacugcacuucagcuugggcaacagag

SEQ ID NO: 62268 - RNA, 32 nt, Human
agugccacugcauuccggccugggcgacagag

SEQ ID NO: 62269 - RNA, 32 nt, Human
agugccacugugcuccagccuggaugacggag

SEQ ID NO: 62270 - RNA, 32 nt, Human
agugccacuuccuuuccauaaaccauaaugau

SEQ ID NO: 62271 - RNA, 32 nt, Human
agugccagacaggaugaaagcguaggagaacu

SEQ ID NO: 62272 - RNA, 32 nt, Human
agugccagagaagccccuggguccccagugcc

SEQ ID NO: 62273 - RNA, 32 nt, Human
agugccagcaguaugaggguuugcauuggcuu

SEQ ID NO: 62274 - RNA, 32 nt, Human
agugccagccugccucacaagagacgucuugu

SEQ ID NO: 62275 - RNA, 32 nt, Human
agugccagcuacucaggaggccgaggcaggag

SEQ ID NO: 62276 - RNA, 32 nt, Human
agugccagcuacucaggaggcugaggcaggag

SEQ ID NO: 62277 - RNA, 32 nt, Human
agugccagcuacucgggagguugagcaggagg

SEQ ID NO: 62278 - RNA, 32 nt, Human
agugccagcucccucucugucugcaccaggga

SEQ ID NO: 62279 - RNA, 32 nt, Human
agugccagcugacaccaggagcagggagaggc

SEQ ID NO: 62280 - RNA, 32 nt, Human
agugccaggauuacaggcaugagccacugugu

SEQ ID NO: 62281 - RNA, 32 nt, Human
agugccaggauuauaggccugagccacugcgu

SEQ ID NO: 62282 - RNA, 32 nt, Human
agugccaggcauucaccaugcuguuuugaugu

SEQ ID NO: 62283 - RNA, 32 nt, Human
agugccaggcucuaggcugaggugggggacac

SEQ ID NO: 62284 - RNA, 32 nt, Human
agugccaggcugggcacaauggcucgugcuug

SEQ ID NO: 62285 - RNA, 32 nt, Human
agugccagggcugggccccuuccaaauguccc

SEQ ID NO: 62286 - RNA, 32 nt, Human
agugccaggguuggccauaggagaaugagccc

SEQ ID NO: 62287 - RNA, 21 nt, Human
agugccagguggacagccagu

SEQ ID NO: 62288 - RNA, 21 nt, Human
agugccagguggcggcugcug

SEQ ID NO: 62289 - RNA, 32 nt, Human
agugccagguugaaggaugacagggugcccag

SEQ ID NO: 62290 - RNA, 22 nt, Human
agugccaguaguucacaccgaa

SEQ ID NO: 62291 - RNA, 32 nt, Human
agugccagugccugugccagagguggcgaggu

SEQ ID NO: 62292 - RNA, 32 nt, Human
agugccaguucuuaugcuaagcagguuacgug

SEQ ID NO: 62293 - RNA, 32 nt, Human
agugccaguuggacccaagagaagacugcagc

SEQ ID NO: 62294 - RNA, 25 nt, Human
agugccauacagcggaaaggcaggg

SEQ ID NO: 62295 - RNA, 21 nt, Human
agugccauaguagggguucug

SEQ ID NO: 62296 - RNA, 26 nt, Human
agugccauauaauguugaagcuguug

SEQ ID NO: 62297 - RNA, 15 nt, Human
agugccaucaugagg

SEQ ID NO: 62298 - RNA, 32 nt, Human
agugccauccaccagcuuuacucucugacaca

SEQ ID NO: 62299 - RNA, 32 nt, Human
agugccaucccuuguauccuggaauagcucca

SEQ ID NO: 62300 - RNA, 32 nt, Human
agugccauccugggugcccagggcagagcagg

SEQ ID NO: 62301 - RNA, 32 nt, Human
agugccaucgcacuccagccuggacaacagag

SEQ ID NO: 62302 - RNA, 24 nt, Human
agugccaucugggcaccauugcuc

SEQ ID NO: 62303 - RNA, 16 nt, Human
agugccaugacugaga

SEQ ID NO: 62304 - RNA, 20 nt, Human
agugccaugcugaccugcug

SEQ ID NO: 62305 - RNA, 32 nt, Human
agugccauguaccacacagauguuccugucuc

SEQ ID NO: 62306 - RNA, 19 nt, Human
agugccauuagaugauaua

SEQ ID NO: 62307 - RNA, 32 nt, Human
agugccauucagcucugggccagagcaugguc

SEQ ID NO: 62308 - RNA, 32 nt, Human
agugccauuccuguccuuaaggcacagucuca

SEQ ID NO: 62309 - RNA, 20 nt, Human
agugccauugaugugagaug

SEQ ID NO: 62310 - RNA, 32 nt, Human
agugccauugcacuccagccugcacaacaaga

SEQ ID NO: 62311 - RNA, 32 nt, Human
agugccauugcacuccggccugggcaacagag

SEQ ID NO: 62312 - RNA, 32 nt, Human
agugccauuguacuccagcuugggcaacagag

SEQ ID NO: 62313 - RNA, 32 nt, Human
agugccauuucagcaguucagugaggagcuuu

SEQ ID NO: 62314 - RNA, 17 nt, Human
agugcccaacauggcgg

SEQ ID NO: 62315 - RNA, 32 nt, Human
agugcccaccgcccuccuccacuuggaaacgg

SEQ ID NO: 62316 - RNA, 32 nt, Human
agugcccagcacaaagcagauccucaauaaac

SEQ ID NO: 62317 - RNA, 32 nt, Human
agugcccagcaugaagguggggccagugcugg

SEQ ID NO: 62318 - RNA, 32 nt, Human
agugcccagcccacccccuugcccucucccag

SEQ ID NO: 62319 - RNA, 32 nt, Human
agugcccagcuccaaggcucuagaggguguuc

SEQ ID NO: 62320 - RNA, 32 nt, Human
agugcccaggauuaggcaguaccuccugcauc

SEQ ID NO: 62321 - RNA, 32 nt, Human
agugcccaggccccacacagucuucaaagguc

SEQ ID NO: 62322 - RNA, 32 nt, Human
agugcccaucaaccucugcccaacacagagcc

SEQ ID NO: 62323 - RNA, 32 nt, Human
agugcccaugcccucugugaagugcccaaaug

SEQ ID NO: 62324 - RNA, 32 nt, Human
agugcccauuccaacucagagaaucuuuacau

SEQ ID NO: 62325 - RNA, 32 nt, Human
agugccccacagggaccccagccugggugguc

SEQ ID NO: 62326 - RNA, 32 nt, Human
agugccccacugcacuccagccugggugacag

SEQ ID NO: 62327 - RNA, 32 nt, Human
agugcccccacccucaccuucuccuggugcau

SEQ ID NO: 62328 - RNA, 32 nt, Human
agugcccccucaggccagagggcagggccaac

SEQ ID NO: 62329 - RNA, 32 nt, Human
agugcccccugccacaucuccaggcugcgcac

SEQ ID NO: 62330 - RNA, 21 nt, Human
agugccccgugcaccuggcca

SEQ ID NO: 62331 - RNA, 32 nt, Human
agugccccuccagcuguggguuggcagugucc

SEQ ID NO: 62332 - RNA, 32 nt, Human
agugccccucccucccccuggccaagccuccu

SEQ ID NO: 62333 - RNA, 20 nt, Human
agugccccucgagcagccag

SEQ ID NO: 62334 - RNA, 32 nt, Human
agugcccgaagccaggagcccggggcgccuag

SEQ ID NO: 62335 - RNA, 32 nt, Human
agugcccgagcauccucuggugaccucccuca

SEQ ID NO: 62336 - RNA, 18 nt, Human
agugcccgcaggcugcug

SEQ ID NO: 62337 - RNA, 32 nt, Human
agugcccgcugggcccagccuggggacaggga

SEQ ID NO: 62338 - RNA, 32 nt, Human
agugcccuacaaaggcuagaacacuacagggg

SEQ ID NO: 62339 - RNA, 32 nt, Human
agugcccuccacccuuccuggugucugacccg

SEQ ID NO: 62340 - RNA, 32 nt, Human
agugcccucccucuguucccuggaccaccacc

SEQ ID NO: 62341 - RNA, 18 nt, Human
agugcccuccuaccccca

SEQ ID NO: 62342 - RNA, 32 nt, Human
agugcccuccuccccucucagccuccucuuua

SEQ ID NO: 62343 - RNA, 32 nt, Human
agugcccuccuggcuccugggcugggacaagu

SEQ ID NO: 62344 - RNA, 32 nt, Human
agugcccucuagggcagccaggggaauacuau

SEQ ID NO: 62345 - RNA, 23 nt, Human
agugcccucuguugaaauuguca

SEQ ID NO: 62346 - RNA, 32 nt, Human
agugcccugagucucaaggaagagucucuagg

SEQ ID NO: 62347 - RNA, 32 nt, Human
agugcccugcaugacagagggucuuuguugug

SEQ ID NO: 62348 - RNA, 32 nt, Human
agugcccugcauuuaaucagcaccugaugacu

SEQ ID NO: 62349 - RNA, 32 nt, Human
agugcccugcugucucuggacuucccaucggc

SEQ ID NO: 62350 - RNA, 32 nt, Human
agugcccuggguggaaggaaggcacugagagc

SEQ ID NO: 62351 - RNA, 32 nt, Human
agugcccugguggcaguggcugaaguggcggc

SEQ ID NO: 62352 - RNA, 32 nt, Human
agugcccuguguuccuggagaaggcauuccag

SEQ ID NO: 62353 - RNA, 32 nt, Human
agugcccuguucugccgguguguacagccuca

SEQ ID NO: 62354 - RNA, 28 nt, Human
agugcccuuagugcugccacacucccug

SEQ ID NO: 62355 - RNA, 32 nt, Human
agugcccuuugugggugacuucaggcuucccg

SEQ ID NO: 62356 - RNA, 32 nt, Human
agugccgagcuggcugguggcaguggugucgu

SEQ ID NO: 62357 - RNA, 32 nt, Human
agugccgauaaauaaagugguacugaaacaca

SEQ ID NO: 62358 - RNA, 32 nt, Human
agugccgcagaaccccagcgucacgaggauuu

SEQ ID NO: 62359 - RNA, 32 nt, Human
agugccgccagaccuacugcugugcuguuucu

SEQ ID NO: 62360 - RNA, 32 nt, Human
agugccgccagccugaccagaggggaggugga

SEQ ID NO: 62361 - RNA, 32 nt, Human
agugccgcugcacuccauucugggcaagagcu

SEQ ID NO: 62362 - RNA, 32 nt, Human
agugccggcugcagaagggcaaggugaccauu

SEQ ID NO: 62363 - RNA, 32 nt, Human
agugccgggaugacaggcaugagccaccgcgc

SEQ ID NO: 62364 - RNA, 32 nt, Human
agugccgggauuacagacgugagccacugugc

SEQ ID NO: 62365 - RNA, 32 nt, Human
agugccgggauuacaggcaugagccacugcac

SEQ ID NO: 62366 - RNA, 32 nt, Human
agugccgggauuacaggcgugagccaccgcgc

SEQ ID NO: 62367 - RNA, 32 nt, Human
agugccgggauuacaggcgugagccaccuugc

SEQ ID NO: 62368 - RNA, 32 nt, Human
agugccgggauuacaggcgugagccacugcgc

SEQ ID NO: 62369 - RNA, 32 nt, Human
agugccggggugaacccccgggggagccgaga

SEQ ID NO: 62370 - RNA, 32 nt, Human
agugccggggugaacccccgggggagccggga

SEQ ID NO: 62371 - RNA, 22 nt, Human
agugccguauugugacaugcug

SEQ ID NO: 62372 - RNA, 32 nt, Human
agugccguuuauuucagaagcuuccuggccac

SEQ ID NO: 62373 - RNA, 32 nt, Human
agugccuacuauuaaagcuuugcuccaaguuc

SEQ ID NO: 62374 - RNA, 32 nt, Human
agugccuagagauuuucacuccucuaacaucu

SEQ ID NO: 62375 - RNA, 32 nt, Human
agugccuagaggcacggagccaccagggauca

SEQ ID NO: 62376 - RNA, 32 nt, Human
agugccuaggacuuucuuccaccagcucaaag

SEQ ID NO: 62377 - RNA, 18 nt, Human
agugccuagggcacgugg

SEQ ID NO: 62378 - RNA, 32 nt, Human
agugccucaaagcaaaggcaagcaaaggaacc

SEQ ID NO: 62379 - RNA, 32 nt, Human
agugccucacagauugugugacuuuaggcaaa

SEQ ID NO: 62380 - RNA, 32 nt, Human
agugccucaccucccccugccucccagccucc

SEQ ID NO: 62381 - RNA, 32 nt, Human
agugccucacucugucacccaggcuggagugu

SEQ ID NO: 62382 - RNA, 32 nt, Human
agugccucagaugcauccuccccuucucuuuu

SEQ ID NO: 62383 - RNA, 32 nt, Human
agugccucaguuucagcuuuccugggcaccag

SEQ ID NO: 62384 - RNA, 32 nt, Human
agugccucaucuucaacuuuugugcuucccuu

SEQ ID NO: 62385 - RNA, 32 nt, Human
agugccuccagccagagcucccugcgcucgcu

SEQ ID NO: 62386 - RNA, 32 nt, Human
agugccucccaggaguccucaggcccugggga

SEQ ID NO: 62387 - RNA, 32 nt, Human
agugccucgagggcgccguucgggcggggagg

SEQ ID NO: 62388 - RNA, 32 nt, Human
agugccucuccuggcccugaaggugccacucc

SEQ ID NO: 62389 - RNA, 32 nt, Human
agugccucuccuggcccuggaaggugccacuc

SEQ ID NO: 62390 - RNA, 32 nt, Human
agugccucuccuggcccuggaaguugccacuc

SEQ ID NO: 62391 - RNA, 32 nt, Human
agugccucugcacuccagccugcgugacaaag

SEQ ID NO: 62392 - RNA, 32 nt, Human
agugccucugccagacacacacugccugaguu

SEQ ID NO: 62393 - RNA, 32 nt, Human
agugccucuggagggcccugggcucuggcaga

SEQ ID NO: 62394 - RNA, 32 nt, Human
agugccucuugcccucuccucaccuccuuuuc

SEQ ID NO: 62395 - RNA, 32 nt, Human
agugccugaggucacuguauagggggaugugg

SEQ ID NO: 62396 - RNA, 18 nt, Human
agugccugagucacguga

SEQ ID NO: 62397 - RNA, 32 nt, Human
agugccugauccugcccugggcucagagccag

SEQ ID NO: 62398 - RNA, 32 nt, Human
agugccugcagccugcccugccucucucacag

SEQ ID NO: 62399 - RNA, 17 nt, Human
agugccugcaggcugcu

SEQ ID NO: 62400 - RNA, 32 nt, Human
agugccugcagucccagcuacucgggaagcug

SEQ ID NO: 62401 - RNA, 32 nt, Human
agugccugccagagcccaagugccaucccaca

SEQ ID NO: 62402 - RNA, 32 nt, Human
agugccugcccaccgcucuacuucuaaccagg

SEQ ID NO: 62403 - RNA, 32 nt, Human
agugccugcccucccuucaucuacgcagucaa

SEQ ID NO: 62404 - RNA, 32 nt, Human
agugccugccuccuggcugacucuugaagccc

SEQ ID NO: 62405 - RNA, 32 nt, Human
agugccugccuccuuuuucagcucgucuugcg

SEQ ID NO: 62406 - RNA, 32 nt, Human
agugccugcuucugcuccaucaggugcagggg

SEQ ID NO: 62407 - RNA, 32 nt, Human
agugccuggacccagaggcuuugcaggacagu

SEQ ID NO: 62408 - RNA, 32 nt, Human
agugccuggacucccugcuccgugaggcgaau

SEQ ID NO: 62409 - RNA, 32 nt, Human
agugccuggcacauagucagugcccuaaguau

SEQ ID NO: 62410 - RNA, 32 nt, Human
agugccuggcacucugugggugcucaauaaau

SEQ ID NO: 62411 - RNA, 32 nt, Human
agugccuggccaggggcucugcugggaucaaa

SEQ ID NO: 62412 - RNA, 32 nt, Human
agugccugguagagacagagcggaacggccac

SEQ ID NO: 62413 - RNA, 32 nt, Human
agugccugguggagacagagcggaacgcccac

SEQ ID NO: 62414 - RNA, 32 nt, Human
agugccugguggaggggccuggaaaagacacc

SEQ ID NO: 62415 - RNA, 32 nt, Human
agugccuguaaucccagcuacucgggaggcug

SEQ ID NO: 62416 - RNA, 32 nt, Human
agugccuguaaucccagcuacuugggaggcug

SEQ ID NO: 62417 - RNA, 32 nt, Human
agugccuguaaucccagcuauucgggagccug

SEQ ID NO: 62418 - RNA, 32 nt, Human
agugccuguaaucccagcuauuugggaggcug

SEQ ID NO: 62419 - RNA, 32 nt, Human
agugccuguagucccagcuacucaggaggcug

SEQ ID NO: 62420 - RNA, 32 nt, Human
agugccuguagucccagcuacucuggaggcug

SEQ ID NO: 62421 - RNA, 32 nt, Human
agugccuguagucccagcugcucgggaggcug

SEQ ID NO: 62422 - RNA, 32 nt, Human
agugccugucaccacuguggauucaccugcac

SEQ ID NO: 62423 - RNA, 19 nt, Human
agugccugucuggcugcug

SEQ ID NO: 62424 - RNA, 29 nt, Human
agugccugucugugccugggagaacagag

SEQ ID NO: 62425 - RNA, 32 nt, Human
agugccuuacacuggacuucugaccccaugag

SEQ ID NO: 62426 - RNA, 32 nt, Human
agugccuucaaggagcuuacguucuaguuagg

SEQ ID NO: 62427 - RNA, 32 nt, Human
agugccuucauacacuguaccccagcucucuu

SEQ ID NO: 62428 - RNA, 32 nt, Human
agugccuugcucccccugcucacucucugcug

SEQ ID NO: 62429 - RNA, 32 nt, Human
agugccuuguugccucugcccuuugaagucgg

SEQ ID NO: 62430 - RNA, 32 nt, Human
agugccuuuaaucccaccucaggaggcugagg

SEQ ID NO: 62431 - RNA, 19 nt, Human
agugccuuuccauccguga

SEQ ID NO: 62432 - RNA, 32 nt, Human
agugccuuuuacaaaugcaguuuaucccuggu

SEQ ID NO: 62433 - RNA, 32 nt, Human
agugcgacagaccuccaugaaggggcugccuu

SEQ ID NO: 62434 - RNA, 32 nt, Human
agugcgaccugcuuuaacucugcagcaccgcu

SEQ ID NO: 62435 - RNA, 32 nt, Human
agugcgagcugcuguguguggaggcuccugag

SEQ ID NO: 62436 - RNA, 17 nt, Human
agugcgcaagugagaua

SEQ ID NO: 62437 - RNA, 32 nt, Human
agugcgcagccuuggcugcugggaaaugccca

SEQ ID NO: 62438 - RNA, 32 nt, Human
agugcgcaggugugaguguaaguucauguagg

SEQ ID NO: 62439 - RNA, 32 nt, Human
agugcgcaugugugugcgugcaugcacauaug

SEQ ID NO: 62440 - RNA, 32 nt, Human
agugcgccacuucacuccagccugggcaacag

SEQ ID NO: 62441 - RNA, 32 nt, Human
agugcgccaucuugcaagcagcucuuccagcc

SEQ ID NO: 62442 - RNA, 32 nt, Human
agugcgcccucccucccucccaucugggggua

SEQ ID NO: 62443 - RNA, 21 nt, Human
agugcgccuggcuggcugcug

SEQ ID NO: 62444 - RNA, 32 nt, Human
agugcgcgcggagcugcugggcgccgcuuggg

SEQ ID NO: 62445 - RNA, 32 nt, Human
agugcgcuagagcauucugggguggggcuugg

SEQ ID NO: 62446 - RNA, 32 nt, Human
agugcgcuguguccaaggaccucacccagcag

SEQ ID NO: 62447 - RNA, 32 nt, Human
agugcgcuugagcugcuccaaaccuggcccuu

SEQ ID NO: 62448 - RNA, 32 nt, Human
agugcggcaccagggcaggagcugcaguagcu

SEQ ID NO: 62449 - RNA, 17 nt, Human
agugcggcccgggcugc

SEQ ID NO: 62450 - RNA, 21 nt, Human
agugcgggacuggggcuccug

SEQ ID NO: 62451 - RNA, 21 nt, Human
agugcgggaggccagcuccug

SEQ ID NO: 62452 - RNA, 18 nt, Human
agugcgggcagagcacug

SEQ ID NO: 62453 - RNA, 32 nt, Human
agugcgggccggcagaggcuggcggggagcag

SEQ ID NO: 62454 - RNA, 19 nt, Human
agugcgggccugggcccug

SEQ ID NO: 62455 - RNA, 17 nt, Human
agugcgggcgccggcgc

SEQ ID NO: 62456 - RNA, 20 nt, Human
agugcgggcucccgcugcug

SEQ ID NO: 62457 - RNA, 18 nt, Human
agugcggggaagcgccgc

SEQ ID NO: 62458 - RNA, 18 nt, Human
agugcggggagagggagc

SEQ ID NO: 62459 - RNA, 21 nt, Human
agugcggggagcaggcugcug

SEQ ID NO: 62460 - RNA, 18 nt, Human
agugcggggaggcccugc

SEQ ID NO: 62461 - RNA, 15 nt, Human
agugcggggaggcug

SEQ ID NO: 62462 - RNA, 16 nt, Human
agugcggggagugcgc

SEQ ID NO: 62463 - RNA, 32 nt, Human
agugcggggauuacaggcuugagccacugcac

SEQ ID NO: 62464 - RNA, 19 nt, Human
agugcggggcgcccggcgc

SEQ ID NO: 62465 - RNA, 17 nt, Human
agugcggggcgccgcgc

SEQ ID NO: 62466 - RNA, 18 nt, Human
agugcggggcugcucugc

SEQ ID NO: 62467 - RNA, 21 nt, Human
agugcggggucccaagcccug

SEQ ID NO: 62468 - RNA, 32 nt, Human
agugcggggugggggcagagaugaggaggccu

SEQ ID NO: 62469 - RNA, 20 nt, Human
agugcgggucaaagccucug

SEQ ID NO: 62470 - RNA, 32 nt, Human
agugcgguauugcucugugaauucaaguucaa

SEQ ID NO: 62471 - RNA, 32 nt, Human
agugcggucacauacuuccagaagagcggacc

SEQ ID NO: 62472 - RNA, 32 nt, Human
agugcgguuguacauccuccccaccucauaac

SEQ ID NO: 62473 - RNA, 32 nt, Human
agugcgucucuuuuguuccuggcuuugacaug

SEQ ID NO: 62474 - RNA, 32 nt, Human
agugcgugagccacuuuagccaggauauacuu

SEQ ID NO: 62475 - RNA, 32 nt, Human
agugcgugauuucucagugauuuccuacagug

SEQ ID NO: 62476 - RNA, 32 nt, Human
agugcgugccugugaucccagcuacuugggag

SEQ ID NO: 62477 - RNA, 32 nt, Human
agugcguggcaggccccuguggaggaucaaug

SEQ ID NO: 62478 - RNA, 32 nt, Human
agugcuaaaugagaaagcccauguaggaauac

SEQ ID NO: 62479 - RNA, 21 nt, Human
agugcuacaccaccugccuga

SEQ ID NO: 62480 - RNA, 32 nt, Human
agugcuacccaucuccccucagaagaggcuuu

SEQ ID NO: 62481 - RNA, 32 nt, Human
agugcuaccugggcacacacguagacaagggc

SEQ ID NO: 62482 - RNA, 32 nt, Human
agugcuacgugauccucugccgcccagaccuc

SEQ ID NO: 62483 - RNA, 23 nt, Human
agugcuagaauuacaggccugag

SEQ ID NO: 62484 - RNA, 32 nt, Human
agugcuagcgcuccucuccagcaugcugcggc

SEQ ID NO: 62485 - RNA, 32 nt, Human
agugcuagcuacucagaaggcugaggugggag

SEQ ID NO: 62486 - RNA, 32 nt, Human
agugcuagcuucccuuaaucuuccagcagcaa

SEQ ID NO: 62487 - RNA, 32 nt, Human
agugcuaggauuacaggagugagccacugcgc

SEQ ID NO: 62488 - RNA, 23 nt, Human
agugcuaggauuacaggcaugag

SEQ ID NO: 62489 - RNA, 32 nt, Human
agugcuaggauuacaggcaugagccacagcac

SEQ ID NO: 62490 - RNA, 32 nt, Human
agugcuaggauuacaggcaugagccaccacau

SEQ ID NO: 62491 - RNA, 32 nt, Human
agugcuaggauuacaggcaugagccaccacgc

SEQ ID NO: 62492 - RNA, 32 nt, Human
agugcuaggauuacaggcaugagccaccaugc

SEQ ID NO: 62493 - RNA, 32 nt, Human
agugcuaggauuacaggcaugagccacugcac

SEQ ID NO: 62494 - RNA, 32 nt, Human
agugcuaggauuacaggcgugagccaccaaca

SEQ ID NO: 62495 - RNA, 32 nt, Human
agugcuaggauuacaggcgugagccaccacac

SEQ ID NO: 62496 - RNA, 32 nt, Human
agugcuaggauuacaggcgugagccaccacgc

SEQ ID NO: 62497 - RNA, 32 nt, Human
agugcuaggauuacaggcgugagccaccaugc

SEQ ID NO: 62498 - RNA, 32 nt, Human
agugcuaggauuacaggcgugagccaccguac

SEQ ID NO: 62499 - RNA, 32 nt, Human
agugcuaggauuacaggcgugagccaccgugc

SEQ ID NO: 62500 - RNA, 32 nt, Human
agugcuaggauuacaggcgugagccacugcag

SEQ ID NO: 62501 - RNA, 32 nt, Human
agugcuaggauuacaggcgugagccacuuacc

SEQ ID NO: 62502 - RNA, 32 nt, Human
agugcuaggauuacagguaugagccaccaugc

SEQ ID NO: 62503 - RNA, 19 nt, Human
agugcuaggauuacaggug

SEQ ID NO: 62504 - RNA, 32 nt, Human
agugcuaggauuacaggugugagccaccacac

SEQ ID NO: 62505 - RNA, 32 nt, Human
agugcuaggauuacaggugugagccaccacgc

SEQ ID NO: 62506 - RNA, 32 nt, Human
agugcuaggauuacaggugugagccacugugc

SEQ ID NO: 62507 - RNA, 32 nt, Human
agugcuaggauuacagguuugagccaccgugc

SEQ ID NO: 62508 - RNA, 32 nt, Human
agugcuaggauuauaggcaugagccaccacac

SEQ ID NO: 62509 - RNA, 32 nt, Human
agugcuaggauuauaggcgugaaccaccacgc

SEQ ID NO: 62510 - RNA, 32 nt, Human
agugcuaggauuauaggcuugagcuacugugc

SEQ ID NO: 62511 - RNA, 32 nt, Human
agugcuaggauuauaggugugagccaucacgc

SEQ ID NO: 62512 - RNA, 32 nt, Human
agugcuaggauuccaggugugagccacaucac

SEQ ID NO: 62513 - RNA, 32 nt, Human
agugcuaggauugcaggugugagccaccacac

SEQ ID NO: 62514 - RNA, 32 nt, Human
agugcuaggauugcaggugugagccacugugc

SEQ ID NO: 62515 - RNA, 32 nt, Human
agugcuaggguuacaggcaugagccacugugc

SEQ ID NO: 62516 - RNA, 32 nt, Human
agugcuaucugcaggcuggccagcuuccucug

SEQ ID NO: 62517 - RNA, 32 nt, Human
agugcuaugagacuaggagaggaacaccccag

SEQ ID NO: 62518 - RNA, 18 nt, Human
agugcuaugugugagaua

SEQ ID NO: 62519 - RNA, 23 nt, Human
agugcucaacuuagacucugggc

SEQ ID NO: 62520 - RNA, 32 nt, Human
agugcucacuguauaugaggcuuuucauuaau

SEQ ID NO: 62521 - RNA, 32 nt, Human
agugcucaggacucccuggccccugguaccuu

SEQ ID NO: 62522 - RNA, 32 nt, Human
agugcucaggaggcagcaucuggaguuggggc

SEQ ID NO: 62523 - RNA, 32 nt, Human
agugcucaggauuacaggcgugagccacugug

SEQ ID NO: 62524 - RNA, 32 nt, Human
agugcuccaaggaaaggaaggaaggaaggaaa

SEQ ID NO: 62525 - RNA, 32 nt, Human
agugcuccccugugacgugcuccaucaccggg

SEQ ID NO: 62526 - RNA, 32 nt, Human
agugcucccgaauccagacccaggaagaaagc

SEQ ID NO: 62527 - RNA, 32 nt, Human
agugcucccgggaacucugccugcgcggcggc

SEQ ID NO: 62528 - RNA, 32 nt, Human
agugcuccgcgagcuggcaagggagacacugg

SEQ ID NO: 62529 - RNA, 32 nt, Human
agugcuccuuagaauacuacagagaggaagag

SEQ ID NO: 62530 - RNA, 19 nt, Human
agugcucggauuacaggug

SEQ ID NO: 62531 - RNA, 32 nt, Human
agugcucggauuacaggugugagccacugugc

SEQ ID NO: 62532 - RNA, 32 nt, Human
agugcucuaguugcuggaucuaauggccuguc

SEQ ID NO: 62533 - RNA, 32 nt, Human
agugcucucagcuggcagugcaaugcuuguag

SEQ ID NO: 62534 - RNA, 32 nt, Human
agugcucucccaggaccucauuguggcagacg

SEQ ID NO: 62535 - RNA, 32 nt, Human
agugcucuccugccugggcagcaacaaccaag

SEQ ID NO: 62536 - RNA, 32 nt, Human
agugcucugcuuuuagucacguguauuuucau

SEQ ID NO: 62537 - RNA, 32 nt, Human
agugcucuggcugagggccuccaggaugaaga

SEQ ID NO: 62538 - RNA, 32 nt, Human
agugcucugucaaaagcacaaaaagaaacuuu

SEQ ID NO: 62539 - RNA, 32 nt, Human
agugcugaaaucugcagugagugaaagagcag

SEQ ID NO: 62540 - RNA, 32 nt, Human
agugcugaagaaaaagaaagugaagaagucgu

SEQ ID NO: 62541 - RNA, 23 nt, Human
agugcugagauuacacacgugag

SEQ ID NO: 62542 - RNA, 32 nt, Human
agugcugagauuacaggcaugagccaccacac

SEQ ID NO: 62543 - RNA, 32 nt, Human
agugcugagauuacaggcaugagccaccacgc

SEQ ID NO: 62544 - RNA, 32 nt, Human
agugcugagauuacaggcaugagccaccaugc

SEQ ID NO: 62545 - RNA, 32 nt, Human
agugcugagauuacaggcaugagccaccgcac

SEQ ID NO: 62546 - RNA, 32 nt, Human
agugcugagauuacaggcaugagccacugcac

SEQ ID NO: 62547 - RNA, 32 nt, Human
agugcugagauuacaggccugagccaccgugc

SEQ ID NO: 62548 - RNA, 23 nt, Human
agugcugagauuacaggcgugag

SEQ ID NO: 62549 - RNA, 32 nt, Human
agugcugagauuacaggcgugagccaccacac

SEQ ID NO: 62550 - RNA, 32 nt, Human
agugcugagauuacaggcgugagccaccgugc

SEQ ID NO: 62551 - RNA, 32 nt, Human
agugcugagauuacaggcgugagccacugugc

SEQ ID NO: 62552 - RNA, 32 nt, Human
agugcugagauuacaggcuugagccaccacgc

SEQ ID NO: 62553 - RNA, 32 nt, Human
agugcugagauuacaggggugagccacugcgc

SEQ ID NO: 62554 - RNA, 19 nt, Human
agugcugagauuacaggug

SEQ ID NO: 62555 - RNA, 32 nt, Human
agugcugagauuacaggugugagccaccaggc

SEQ ID NO: 62556 - RNA, 32 nt, Human
agugcugagauuacaggugugagccaccaugc

SEQ ID NO: 62557 - RNA, 32 nt, Human
agugcugagauuacaggugugagccaccgcac

SEQ ID NO: 62558 - RNA, 32 nt, Human
agugcugagauuacaggugugagccaccgugc

SEQ ID NO: 62559 - RNA, 32 nt, Human
agugcugagauuacaggugugagccacugugc

SEQ ID NO: 62560 - RNA, 32 nt, Human
agugcugagauuacgggcaugagccaccgcac

SEQ ID NO: 62561 - RNA, 32 nt, Human
agugcugagauuacuggcuugagccacugcac

SEQ ID NO: 62562 - RNA, 32 nt, Human
agugcugagauuauaggcaugagccaccacgc

SEQ ID NO: 62563 - RNA, 32 nt, Human
agugcugagauuauaggcaugagccacugugc

SEQ ID NO: 62564 - RNA, 32 nt, Human
agugcugagauuaugggcgugagccaccguga

SEQ ID NO: 62565 - RNA, 24 nt, Human
agugcugagauuuacaggcgugag

SEQ ID NO: 62566 - RNA, 25 nt, Human
agugcugagcuuuuaacaggaaaug

SEQ ID NO: 62567 - RNA, 32 nt, Human
agugcugaggucuucugcagcaguacuaucag

SEQ ID NO: 62568 - RNA, 32 nt, Human
agugcugagguuauaggugugagccacugucc

SEQ ID NO: 62569 - RNA, 32 nt, Human
agugcugaguacaccaggcuccucaggcaccu

SEQ ID NO: 62570 - RNA, 32 nt, Human
agugcugcacacacaaugauuacgggaaagcg

SEQ ID NO: 62571 - RNA, 32 nt, Human
agugcugcacacagaguaggcaucuuuauaug

SEQ ID NO: 62572 - RNA, 22 nt, Human
agugcugcaccaggcagccagc

SEQ ID NO: 62573 - RNA, 32 nt, Human
agugcugcagaacagcagaacuucuuccucuu

SEQ ID NO: 62574 - RNA, 32 nt, Human
agugcugcagagccacguggccgccacgcagu

SEQ ID NO: 62575 - RNA, 24 nt, Human
agugcugcagggauggaguggcgu

SEQ ID NO: 62576 - RNA, 32 nt, Human
agugcugcagugaacauacacaugcuuguauc

SEQ ID NO: 62577 - RNA, 32 nt, Human
agugcugccagccugugaugcaagaguccuaa

SEQ ID NO: 62578 - RNA, 32 nt, Human
agugcugcccggggccucaucugggccagcuu

SEQ ID NO: 62579 - RNA, 32 nt, Human
agugcugcccugccauaauccccaagcccagc

SEQ ID NO: 62580 - RNA, 32 nt, Human
agugcugcgauuacaggcaugagccaccgcgc

SEQ ID NO: 62581 - RNA, 32 nt, Human
agugcugcgauuacaggcgugagccaccgcac

SEQ ID NO: 62582 - RNA, 32 nt, Human
agugcugcgguugauuccagugagggagaaag

SEQ ID NO: 62583 - RNA, 32 nt, Human
agugcugcguucucccccucuuggcucuccug

SEQ ID NO: 62584 - RNA, 32 nt, Human
agugcugcugcugaccuucacugacagcuccu

SEQ ID NO: 62585 - RNA, 32 nt, Human
agugcugcugugaaagggcucuggacagcuca

SEQ ID NO: 62586 - RNA, 23 nt, Human
agugcuggaauuacaagcaugag

SEQ ID NO: 62587 - RNA, 32 nt, Human
agugcuggaauuacaagcaugagccacugugc

SEQ ID NO: 62588 - RNA, 32 nt, Human
agugcuggaauuacaggcaugagccaccacac

SEQ ID NO: 62589 - RNA, 32 nt, Human
agugcuggaauuacaggcaugagccaccgcgc

SEQ ID NO: 62590 - RNA, 32 nt, Human
agugcuggaauuacaggccugagccaccccac

SEQ ID NO: 62591 - RNA, 32 nt, Human
agugcuggaauuacaggcgugagccaccacgc

SEQ ID NO: 62592 - RNA, 32 nt, Human
agugcuggaauuacaggcgugagccaccacuc

SEQ ID NO: 62593 - RNA, 32 nt, Human
agugcuggaauuacaggcgugagccaccaugc

SEQ ID NO: 62594 - RNA, 32 nt, Human
agugcuggaauuacaggcgugagccaccgcgc

SEQ ID NO: 62595 - RNA, 32 nt, Human
agugcuggaauuacaggcgugagccacugcgc

SEQ ID NO: 62596 - RNA, 32 nt, Human
agugcuggaauuacaggcgugagccacugcuc

SEQ ID NO: 62597 - RNA, 19 nt, Human
agugcuggaauuacaggug

SEQ ID NO: 62598 - RNA, 32 nt, Human
agugcuggaauuacaggugugagccacucugc

SEQ ID NO: 62599 - RNA, 23 nt, Human
agugcuggaauuacuggcaugag

SEQ ID NO: 62600 - RNA, 32 nt, Human
agugcuggaauuacuggcaugagccaccgagg

SEQ ID NO: 62601 - RNA, 32 nt, Human
agugcuggaauugcaggcaugagccaccacuc

SEQ ID NO: 62602 - RNA, 19 nt, Human
agugcuggacaggcugcug

SEQ ID NO: 62603 - RNA, 32 nt, Human
agugcuggagaacaguguagccuggccuguac

SEQ ID NO: 62604 - RNA, 32 nt, Human
agugcuggagauuacaggcaugagccaccacg

SEQ ID NO: 62605 - RNA, 32 nt, Human
agugcuggaggaaccacgcuuccuaacugcug

SEQ ID NO: 62606 - RNA, 18 nt, Human
agugcuggauuacaggug

SEQ ID NO: 62607 - RNA, 32 nt, Human
agugcuggcauuacaggcaugagccaccacac

SEQ ID NO: 62608 - RNA, 32 nt, Human
agugcuggcauuacaggcgugagccaccacgc

SEQ ID NO: 62609 - RNA, 32 nt, Human
agugcuggcauuacaggcgugagccacugugc

SEQ ID NO: 62610 - RNA, 32 nt, Human
agugcuggcauuacagguaugagccacugcgc

SEQ ID NO: 62611 - RNA, 19 nt, Human
agugcuggcauuacaggug

SEQ ID NO: 62612 - RNA, 32 nt, Human
agugcuggcauuacaggugugagccaccgugc

SEQ ID NO: 62613 - RNA, 32 nt, Human
agugcuggccaccugguguuggugcacagacc

SEQ ID NO: 62614 - RNA, 32 nt, Human
agugcuggccacgucuccaccuaacaacccuc

SEQ ID NO: 62615 - RNA, 32 nt, Human
agugcuggccucugccuccaucucagucacac

SEQ ID NO: 62616 - RNA, 32 nt, Human
agugcuggcugcaggcaagaccaaggccacca

SEQ ID NO: 62617 - RNA, 32 nt, Human
agugcuggcugcagggucccaggugcaggagu

SEQ ID NO: 62618 - RNA, 32 nt, Human
agugcuggcugcuggcccacagcucugcugga

SEQ ID NO: 62619 - RNA, 32 nt, Human
agugcuggcuuccucuuugcauggacucugug

SEQ ID NO: 62620 - RNA, 32 nt, Human
agugcugggaaacagugcuaagaaggauacag

SEQ ID NO: 62621 - RNA, 32 nt, Human
agugcugggaauacaggcaugagccaccgcac

SEQ ID NO: 62622 - RNA, 19 nt, Human
agugcugggaauacaggug

SEQ ID NO: 62623 - RNA, 32 nt, Human
agugcugggacuacaggcaugagccaccacgc

SEQ ID NO: 62624 - RNA, 32 nt, Human
agugcugggacuacaggcaugagccacugugc

SEQ ID NO: 62625 - RNA, 32 nt, Human
agugcugggacuacaggcgugagccaccacgc

SEQ ID NO: 62626 - RNA, 32 nt, Human
agugcugggacuauaagugugagccacugcau

SEQ ID NO: 62627 - RNA, 32 nt, Human
agugcugggacugcaggcgugagccaccgcgc

SEQ ID NO: 62628 - RNA, 32 nt, Human
agugcugggaggauccuuagagaugccuggga

SEQ ID NO: 62629 - RNA, 32 nt, Human
agugcugggagggguggagcugccucauaauc

SEQ ID NO: 62630 - RNA, 32 nt, Human
agugcugggauaacaggcgugagccacuacaa

SEQ ID NO: 62631 - RNA, 32 nt, Human
agugcugggaucacagacaugagccaccacgc

SEQ ID NO: 62632 - RNA, 32 nt, Human
agugcugggaucacaggcaugagccaccgaac

SEQ ID NO: 62633 - RNA, 32 nt, Human
agugcugggaucacaggcaugagccacugugc

SEQ ID NO: 62634 - RNA, 23 nt, Human
agugcugggaucacaggcgugag

SEQ ID NO: 62635 - RNA, 32 nt, Human
agugcugggaucacaggcgugagccaccgcac

SEQ ID NO: 62636 - RNA, 32 nt, Human
agugcugggaucacaggcgugagccacugcgc

SEQ ID NO: 62637 - RNA, 32 nt, Human
agugcugggaugacaggcaugagccaccacgc

SEQ ID NO: 62638 - RNA, 32 nt, Human
agugcugggaugacaggcaugagccaccgugc

SEQ ID NO: 62639 - RNA, 32 nt, Human
agugcugggaugacaggcgugagccacagcuc

SEQ ID NO: 62640 - RNA, 32 nt, Human
agugcugggaugacaggcgugagccaccgcgc

SEQ ID NO: 62641 - RNA, 19 nt, Human
agugcugggaugacaggug

SEQ ID NO: 62642 - RNA, 32 nt, Human
agugcugggaugacaggugugagccaccgccc

SEQ ID NO: 62643 - RNA, 32 nt, Human
agugcugggaugacaggugugagccacugcgc

SEQ ID NO: 62644 - RNA, 32 nt, Human
agugcugggaugacaguugugagccacugcgc

SEQ ID NO: 62645 - RNA, 32 nt, Human
agugcugggaugauaggcgugagccaccacac

SEQ ID NO: 62646 - RNA, 23 nt, Human
agugcugggauuaaagacgugag

SEQ ID NO: 62647 - RNA, 32 nt, Human
agugcugggauuaaagacgugagccacggcac

SEQ ID NO: 62648 - RNA, 32 nt, Human
agugcugggauuaaagcugugagccacugugc

SEQ ID NO: 62649 - RNA, 32 nt, Human
agugcugggauuaaaggcguaagccacugcgc

SEQ ID NO: 62650 - RNA, 32 nt, Human
agugcugggauuaaaggcgugagccaccaugc

SEQ ID NO: 62651 - RNA, 32 nt, Human
agugcugggauuaaaggcgugagccaccguac

SEQ ID NO: 62652 - RNA, 32 nt, Human
agugcugggauuaaaggcgugagccaccgugc

SEQ ID NO: 62653 - RNA, 32 nt, Human
agugcugggauuaaaggugugagccaccaugc

SEQ ID NO: 62654 - RNA, 32 nt, Human
agugcugggauuaacagguaugaaccaccgcg

SEQ ID NO: 62655 - RNA, 32 nt, Human
agugcugggauuaacgggugugagccacggcg

SEQ ID NO: 62656 - RNA, 32 nt, Human
agugcugggauuaaggcgugagccacugcgcc

SEQ ID NO: 62657 - RNA, 32 nt, Human
agugcugggauuaauggcgugagccaccguac

SEQ ID NO: 62658 - RNA, 32 nt, Human
agugcugggauuaauggcgugagccacuguac

SEQ ID NO: 62659 - RNA, 32 nt, Human
agugcugggauuacaagaaugagccaccgugc

SEQ ID NO: 62660 - RNA, 32 nt, Human
agugcugggauuacaagcaugagccaccacac

SEQ ID NO: 62661 - RNA, 32 nt, Human
agugcugggauuacaagcaugagccaccacgc

SEQ ID NO: 62662 - RNA, 32 nt, Human
agugcugggauuacaagcaugagccaccgcac

SEQ ID NO: 62663 - RNA, 32 nt, Human
agugcugggauuacaagcaugagccacugugc

SEQ ID NO: 62664 - RNA, 32 nt, Human
agugcugggauuacaagcaugagcuacugcac

SEQ ID NO: 62665 - RNA, 20 nt, Human
agugcugggauuacaagcgu

SEQ ID NO: 62666 - RNA, 23 nt, Human
agugcugggauuacaagcgugag

SEQ ID NO: 62667 - RNA, 32 nt, Human
agugcugggauuacaagcgugagccaccacac

SEQ ID NO: 62668 - RNA, 32 nt, Human
agugcugggauuacaagcgugagccaccgacc

SEQ ID NO: 62669 - RNA, 32 nt, Human
agugcugggauuacaagcgugagccaccgggc

SEQ ID NO: 62670 - RNA, 32 nt, Human
agugcugggauuacaagcgugagccacugcac

SEQ ID NO: 62671 - RNA, 32 nt, Human
agugcugggauuacaagcgugagccacugugc

SEQ ID NO: 62672 - RNA, 32 nt, Human
agugcugggauuacaagggugagccaccaugc

SEQ ID NO: 62673 - RNA, 32 nt, Human
agugcugggauuacaaguaugagccacugcau

SEQ ID NO: 62674 - RNA, 32 nt, Human
agugcugggauuacaagugugagccaccacac

SEQ ID NO: 62675 - RNA, 32 nt, Human
agugcugggauuacaagugugagccaccacgc

SEQ ID NO: 62676 - RNA, 32 nt, Human
agugcugggauuacaaguuugagccacugcac

SEQ ID NO: 62677 - RNA, 32 nt, Human
agugcugggauuacaauugugagccaccacgu

SEQ ID NO: 62678 - RNA, 32 nt, Human
agugcugggauuacacgcgugagccacugugc

SEQ ID NO: 62679 - RNA, 32 nt, Human
agugcugggauuacagaagugagccacuguac

SEQ ID NO: 62680 - RNA, 32 nt, Human
agugcugggauuacagacacgagccaccucac

SEQ ID NO: 62681 - RNA, 23 nt, Human
agugcugggauuacagacaugag

SEQ ID NO: 62682 - RNA, 32 nt, Human
agugcugggauuacagacaugagccaccacgc

SEQ ID NO: 62683 - RNA, 32 nt, Human
agugcugggauuacagacaugagccaccaugc

SEQ ID NO: 62684 - RNA, 32 nt, Human
agugcugggauuacagacaugagccacugcgc

SEQ ID NO: 62685 - RNA, 32 nt, Human
agugcugggauuacagacaugagccacugugc

SEQ ID NO: 62686 - RNA, 32 nt, Human
agugcugggauuacagaccugagccaccacac

SEQ ID NO: 62687 - RNA, 23 nt, Human
agugcugggauuacagacgugag

SEQ ID NO: 62688 - RNA, 32 nt, Human
agugcugggauuacagacgugagccaccacgc

SEQ ID NO: 62689 - RNA, 32 nt, Human
aguuuaccucccaagcuggaguccagugguga

SEQ ID NO: 62690 - RNA, 32 nt, Human
aguuuaccuggucuuuuccuauugaagaauuu

SEQ ID NO: 62691 - RNA, 32 nt, Human
aguuuaccuguauaacaaaccugcacauguau

SEQ ID NO: 62692 - RNA, 32 nt, Human
aguuuacgccuguaaucccagcacugugggag

SEQ ID NO: 62693 - RNA, 32 nt, Human
aguuuacgcucaucucuucucucagcuaacuu

SEQ ID NO: 62694 - RNA, 32 nt, Human
aguuuacgcuguagauggaacauguuucugug

SEQ ID NO: 62695 - RNA, 32 nt, Human
aguuuacguuuacgacuuucuucugaacugcc

SEQ ID NO: 62696 - RNA, 23 nt, Human
aguuuacucaaucuccccuugca

SEQ ID NO: 62697 - RNA, 32 nt, Human
aguuuacucccaggccagggggcugccaucuu

SEQ ID NO: 62698 - RNA, 32 nt, Human
aguuuacucucucccucuacuaauuuccugcu

SEQ ID NO: 62699 - RNA, 32 nt, Human
aguuuacugagggugauaucuucagguaauca

SEQ ID NO: 62700 - RNA, 32 nt, Human
aguuuacuguguauaggaacgguuuguauuuc

SEQ ID NO: 62701 - RNA, 24 nt, Human
aguuuacuuaugcaucucuuugca

SEQ ID NO: 62702 - RNA, 32 nt, Human
aguuuacuugagauggagucucacucuguugc

SEQ ID NO: 62703 - RNA, 24 nt, Human
aguuuacuugguuucccuugugca

SEQ ID NO: 62704 - RNA, 32 nt, Human
aguuuacuuguguuuugcuacuugcaaaggaa

SEQ ID NO: 62705 - RNA, 23 nt, Human
aguuuacuuugagccuacuugca

SEQ ID NO: 62706 - RNA, 32 nt, Human
aguuuagaaaccagcuuauugccaaagggaaa

SEQ ID NO: 62707 - RNA, 32 nt, Human
aguuuagaaaugucacacauaacuucauaaca

SEQ ID NO: 62708 - RNA, 32 nt, Human
aguuuagaagaaaaguaggaguccaaaggaag

SEQ ID NO: 62709 - RNA, 32 nt, Human
aguuuagaagugaguguaauccagcaauacag

SEQ ID NO: 62710 - RNA, 32 nt, Human
aguuuagaccugccccucccacccccacccug

SEQ ID NO: 62711 - RNA, 32 nt, Human
aguuuagagaaaauucaaggaauggaagagua

SEQ ID NO: 62712 - RNA, 32 nt, Human
aguuuagagaaaugguagaugaaaugcucuuu

SEQ ID NO: 62713 - RNA, 32 nt, Human
aguuuagauccaguuggagguucucccuggcu

SEQ ID NO: 62714 - RNA, 32 nt, Human
aguuuagcaagcaacagaaacauacugaacau

SEQ ID NO: 62715 - RNA, 32 nt, Human
aguuuagcaaguacagugcuguccuaauguga

SEQ ID NO: 62716 - RNA, 32 nt, Human
aguuuagcaauggcgucuuucucugcugagac

SEQ ID NO: 62717 - RNA, 24 nt, Human
aguuuagccaugacaaaccaaaga

SEQ ID NO: 62718 - RNA, 21 nt, Human
aguuuagccauguccucaaga

SEQ ID NO: 62719 - RNA, 24 nt, Human
aguuuagccauuuugaacuuaaga

SEQ ID NO: 62720 - RNA, 32 nt, Human
aguuuagccugggagcaguggcucacgccuau

SEQ ID NO: 62721 - RNA, 32 nt, Human
aguuuagcucacacagguguuugcugacauuc

SEQ ID NO: 62722 - RNA, 32 nt, Human
aguuuagcuccaaaggaaaagagggaaauaug

SEQ ID NO: 62723 - RNA, 32 nt, Human
aguuuagcucugagaaccguagaugauuucag

SEQ ID NO: 62724 - RNA, 32 nt, Human
aguuuaggaaaucauaauguggcagagguggu

SEQ ID NO: 62725 - RNA, 32 nt, Human
aguuuaggaauggaacgcugagcugagcugag

SEQ ID NO: 62726 - RNA, 32 nt, Human
aguuuaggaauuggaggcggcagugagucaug

SEQ ID NO: 62727 - RNA, 32 nt, Human
aguuuaggaggugacugcauccuccagcaucu

SEQ ID NO: 62728 - RNA, 32 nt, Human
aguuuagggaaagaagguugcuguggugagga

SEQ ID NO: 62729 - RNA, 32 nt, Human
aguuuagggucaaauguaaacccuggaaccug

SEQ ID NO: 62730 - RNA, 32 nt, Human
aguuuagguauuuggauuugugaagaacuagu

SEQ ID NO: 62731 - RNA, 32 nt, Human
aguuuaguaagguuguguacacugacaccuuu

SEQ ID NO: 62732 - RNA, 32 nt, Human
aguuuagucaucuguuuccucagcuugaaaug

SEQ ID NO: 62733 - RNA, 32 nt, Human
aguuuagucauggagaauacuucccacauuuu

SEQ ID NO: 62734 - RNA, 32 nt, Human
aguuuaguccauacuuugcacugacauacuuu

SEQ ID NO: 62735 - RNA, 32 nt, Human
aguuuaguggacaacuaaaucagacucuugcc

SEQ ID NO: 62736 - RNA, 24 nt, Human
aguuuaguucuugguaucuuuuca

SEQ ID NO: 62737 - RNA, 32 nt, Human
aguuuaguugacugcuggaccuuggauauucu

SEQ ID NO: 62738 - RNA, 32 nt, Human
aguuuaguuguagaauaaaacuuaugagugac

SEQ ID NO: 62739 - RNA, 32 nt, Human
aguuuaguuuaugaauuuuagguuucaugaua

SEQ ID NO: 62740 - RNA, 32 nt, Human
aguuuaguuuuaaaacugcacugccaacaagu

SEQ ID NO: 62741 - RNA, 32 nt, Human
aguuuaguuuuccuccuugccuucccuucugu

SEQ ID NO: 62742 - RNA, 32 nt, Human
aguuuaguuuuucacuuuagcaaaggggcaau

SEQ ID NO: 62743 - RNA, 20 nt, Human
aguuuauacacucucuccuc

SEQ ID NO: 62744 - RNA, 32 nt, Human
aguuuauacagagcugacucaaaaagacaaaa

SEQ ID NO: 62745 - RNA, 32 nt, Human
aguuuauauaaaggaagcauugggacuugugg

SEQ ID NO: 62746 - RNA, 32 nt, Human
aguuuaugcaacuucugccuccccagguucaa

SEQ ID NO: 62747 - RNA, 32 nt, Human
aguuuauggcaaaaauagccauuuuccaagug

SEQ ID NO: 62748 - RNA, 32 nt, Human
aguuuaugggaaugccuuuucccucuggcacu

SEQ ID NO: 62749 - RNA, 32 nt, Human
aguuuaugggagaagggacugggccggcugcc

SEQ ID NO: 62750 - RNA, 32 nt, Human
aguuuaugguuggcagaauggagagaagucac

SEQ ID NO: 62751 - RNA, 32 nt, Human
aguuuaugugccaggaacaucauucuguccuu

SEQ ID NO: 62752 - RNA, 32 nt, Human
aguuuauguugggccuuccuuuuuggaaugua

SEQ ID NO: 62753 - RNA, 32 nt, Human
aguuuauuaaagauugacauuuuaaguacaac

SEQ ID NO: 62754 - RNA, 32 nt, Human
aguuuauuagcccuugauuucagcugaaaaua

SEQ ID NO: 62755 - RNA, 32 nt, Human
aguuuauuccuccugguggggaggcucugccc

SEQ ID NO: 62756 - RNA, 31 nt, Human
aguuuauugggaugguuucagaugcucagcu

SEQ ID NO: 62757 - RNA, 32 nt, Human
aguuuauuuccaguuugaugcugcaauaccac

SEQ ID NO: 62758 - RNA, 32 nt, Human
aguuuauuuucucuuacccuuuacuaauuuaa

SEQ ID NO: 62759 - RNA, 32 nt, Human
aguuucaaaggccacauaccucucugagacug

SEQ ID NO: 62760 - RNA, 21 nt, Human
aguuucaaauaccuacuucaa

SEQ ID NO: 62761 - RNA, 32 nt, Human
aguuucaacucauacauugucuuguuugauuu

SEQ ID NO: 62762 - RNA, 32 nt, Human
aguuucaagucaaguuccaccuuagcuccagg

SEQ ID NO: 62763 - RNA, 22 nt, Human
aguuucaaguuccugggcucaa

SEQ ID NO: 62764 - RNA, 31 nt, Human
aguuucaauuaaagcuggcuguugaauaacu

SEQ ID NO: 62765 - RNA, 32 nt, Human
aguuucacagcuuugccucuucuuuuugaugu

SEQ ID NO: 62766 - RNA, 32 nt, Human
aguuucaccauguuagccaggcuggucucgaa

SEQ ID NO: 62767 - RNA, 32 nt, Human
aguuucaccauguugaccaggcuggucuugaa

SEQ ID NO: 62768 - RNA, 32 nt, Human
aguuucaccauguugcccaggcuggucucaaa

SEQ ID NO: 62769 - RNA, 32 nt, Human
aguuucaccauguuggccaggcuggucaagaa

SEQ ID NO: 62770 - RNA, 32 nt, Human
aguuucaccauguuggccaggcuggucucaaa

SEQ ID NO: 62771 - RNA, 32 nt, Human
aguuucaccauguuggccaggcuggucuccaa

SEQ ID NO: 62772 - RNA, 32 nt, Human
aguuucaccauguuggccaggcuggucucgaa

SEQ ID NO: 62773 - RNA, 32 nt, Human
aguuucaccauguuggccaggcuggucuugaa

SEQ ID NO: 62774 - RNA, 32 nt, Human
aguuucacccaccccacccuuugcuuucauuu

SEQ ID NO: 62775 - RNA, 32 nt, Human
aguuucacccagcaagcgugagaacagguacu

SEQ ID NO: 62776 - RNA, 32 nt, Human
aguuucaccguguugaccaggcuggucuugaa

SEQ ID NO: 62777 - RNA, 31 nt, Human
aguuucacuaguggaaauaccaaaagcuucc

SEQ ID NO: 62778 - RNA, 32 nt, Human
aguuucacucugugaggagugagggaacccug

SEQ ID NO: 62779 - RNA, 32 nt, Human
aguuucacuguguuggccaggcuggucucaaa

SEQ ID NO: 62780 - RNA, 22 nt, Human
aguuucagaaaauacgccugga

SEQ ID NO: 62781 - RNA, 32 nt, Human
aguuucagaacuggacuuguuccuucacugcc

SEQ ID NO: 62782 - RNA, 32 nt, Human
aguuucagaccaccuuggcaacacagugagac

SEQ ID NO: 62783 - RNA, 32 nt, Human
aguuucagcucacugcaaccuccgccucccag

SEQ ID NO: 62784 - RNA, 32 nt, Human
aguuucaggaagaggcaagaugcauucaauuu

SEQ ID NO: 62785 - RNA, 32 nt, Human
aguuucaggccugugcauguguguacagcagg

SEQ ID NO: 62786 - RNA, 32 nt, Human
aguuucaggccuguucuagcaucuggccgggg

SEQ ID NO: 62787 - RNA, 32 nt, Human
aguuucagggccugaguccccaugcccugcuc

SEQ ID NO: 62788 - RNA, 32 nt, Human
aguuucagggcuaacgaccacagggucugcac

SEQ ID NO: 62789 - RNA, 32 nt, Human
aguuucaggggcuggggcugaacuggggcucc

SEQ ID NO: 62790 - RNA, 32 nt, Human
aguuucagggguggggccccagcuggagguua

SEQ ID NO: 62791 - RNA, 32 nt, Human
aguuucaguaccucagcuaucaacauuucuga

SEQ ID NO: 62792 - RNA, 32 nt, Human
aguuucagugccagaaugaauuuucuuguuuc

SEQ ID NO: 62793 - RNA, 32 nt, Human
aguuucagugguuccugggauguaguauaagu

SEQ ID NO: 62794 - RNA, 32 nt, Human
aguuucaguuaucagaguauuagaccagacuu

SEQ ID NO: 62795 - RNA, 32 nt, Human
aguuucaguuugcauugcagcugggauugaaa

SEQ ID NO: 62796 - RNA, 32 nt, Human
aguuucaucaugaagacagagucugggagcuu

SEQ ID NO: 62797 - RNA, 32 nt, Human
aguuucaucauguuggccaggauggucucgau

SEQ ID NO: 62798 - RNA, 32 nt, Human
aguuucauugaaaaucguggcucuauugcuuu

SEQ ID NO: 62799 - RNA, 32 nt, Human
aguuucauugcauuccaugaaaagugucuugg

SEQ ID NO: 62800 - RNA, 32 nt, Human
aguuucauuucaauucuuuccaugucucauca

SEQ ID NO: 62801 - RNA, 32 nt, Human
aguuuccaaaaauguaaauauacuguaacugu

SEQ ID NO: 62802 - RNA, 23 nt, Human
aguuuccaaaauggaaccaccuc

SEQ ID NO: 62803 - RNA, 32 nt, Human
aguuuccaaauugcccuaugcugugcuccaua

SEQ ID NO: 62804 - RNA, 32 nt, Human
aguuuccaaccagcacaaauuccauagucagg

SEQ ID NO: 62805 - RNA, 32 nt, Human
aguuuccaagugagaaggggagcagguguuua

SEQ ID NO: 62806 - RNA, 32 nt, Human
aguuuccaaguugggacccagaaggugggguu

SEQ ID NO: 62807 - RNA, 32 nt, Human
aguuuccaccucagcacuuugccuuaucaaca

SEQ ID NO: 62808 - RNA, 32 nt, Human
aguuuccacugcaguggcuggagagugaccug

SEQ ID NO: 62809 - RNA, 32 nt, Human
aguuuccacugugcgggaacucugagucagaa

SEQ ID NO: 62810 - RNA, 32 nt, Human
aguuuccagaaauacaaguuagauaauuggcu

SEQ ID NO: 62811 - RNA, 32 nt, Human
aguuuccagaaguaagagggaaaaugaccacg

SEQ ID NO: 62812 - RNA, 32 nt, Human
aguuuccagacucuguuacagaaacagagggc

SEQ ID NO: 62813 - RNA, 32 nt, Human
aguuuccagaucuguguguguacugucggcgc

SEQ ID NO: 62814 - RNA, 32 nt, Human
aguuuccagcagaaagaaucagagacuuuaau

SEQ ID NO: 62815 - RNA, 32 nt, Human
aguuuccaguucccaguauguggcccagagug

SEQ ID NO: 62816 - RNA, 32 nt, Human
aguuuccaguuuuugaugaauuuuggauugua

SEQ ID NO: 62817 - RNA, 32 nt, Human
aguuuccauagacugcggacuggggucuuccu

SEQ ID NO: 62818 - RNA, 32 nt, Human
aguuucccacagauucauaaagguccauacaa

SEQ ID NO: 62819 - RNA, 32 nt, Human
aguuucccagagagacauagcuggaaaauucc

SEQ ID NO: 62820 - RNA, 32 nt, Human
aguuucccaggaguuagagggaugcgaggcua

SEQ ID NO: 62821 - RNA, 32 nt, Human
aguuucccaguucuuccugcgugcgggcgaga

SEQ ID NO: 62822 - RNA, 32 nt, Human
aguuucccaucuuugugcagcuaccuccgcau

SEQ ID NO: 62823 - RNA, 32 nt, Human
aguuuccccaaaauuggacuucucagaaccuu

SEQ ID NO: 62824 - RNA, 32 nt, Human
aguuuccccacugugucugucccaucaugcgc

SEQ ID NO: 62825 - RNA, 32 nt, Human
aguuuccccauguuggccaggcuggucuugaa

SEQ ID NO: 62826 - RNA, 32 nt, Human
aguuucccuauauaacaaaccuucacauauac

SEQ ID NO: 62827 - RNA, 32 nt, Human
aguuucccucauccucuauccguaaguguccu

SEQ ID NO: 62828 - RNA, 32 nt, Human
aguuucccuccucugacucaacaaugccauca

SEQ ID NO: 62829 - RNA, 32 nt, Human
aguuucccuuaaauugguuauuucauguuguc

SEQ ID NO: 62830 - RNA, 32 nt, Human
aguuuccguucccuccuagucucuguucgcuc

SEQ ID NO: 62831 - RNA, 32 nt, Human
aguuuccucauuuuguuugacaggguccucag

SEQ ID NO: 62832 - RNA, 32 nt, Human
aguuuccucccagucagcaccaguuuagggga

SEQ ID NO: 62833 - RNA, 32 nt, Human
aguuuccucccccuccucuucucccuccucuc

SEQ ID NO: 62834 - RNA, 32 nt, Human
aguuuccucuacugcaaacaguguucugugac

SEQ ID NO: 62835 - RNA, 32 nt, Human
aguuuccucuccccucccuucuacuuccacug

SEQ ID NO: 62836 - RNA, 32 nt, Human
aguuuccugagagaauuggccauccggaaccc

SEQ ID NO: 62837 - RNA, 32 nt, Human
aguuuccugauaguuggaugaaaaacaaggag

SEQ ID NO: 62838 - RNA, 32 nt, Human
aguuuccugcaugacagaggaggcucaaggga

SEQ ID NO: 62839 - RNA, 32 nt, Human
aguuuccugccgugcccugccugagcucucag

SEQ ID NO: 62840 - RNA, 32 nt, Human
aguuuccugcuguugcuugugaauuucuuucu

SEQ ID NO: 62841 - RNA, 32 nt, Human
aguuuccuuccaacccuucccaccuuuccccc

SEQ ID NO: 62842 - RNA, 32 nt, Human
aguuuccuuucuuggaucugcaaagaaagcuu

SEQ ID NO: 62843 - RNA, 32 nt, Human
aguuucgagcgccgcuuccuggcggcgcgcac

SEQ ID NO: 62844 - RNA, 32 nt, Human
aguuucgcaaauguggggauugcugaauaauc

SEQ ID NO: 62845 - RNA, 32 nt, Human
aguuucgcaagaugaagaguuccagagaugga

SEQ ID NO: 62846 - RNA, 32 nt, Human
aguuucgccauguuggccaggcuggucucgaa

SEQ ID NO: 62847 - RNA, 32 nt, Human
aguuucggcaggcgggugaggucgcugagggc

SEQ ID NO: 62848 - RNA, 32 nt, Human
aguuucgucauguugcccaggcuggucucagg

SEQ ID NO: 62849 - RNA, 32 nt, Human
aguuucuaaggcagggcaugagcuggaaauag

SEQ ID NO: 62850 - RNA, 32 nt, Human
aguuucuacaaaauauuuaaaaauuagccagg

SEQ ID NO: 62851 - RNA, 32 nt, Human
aguuucuacuuacuugcucuuccaccuugucc

SEQ ID NO: 62852 - RNA, 32 nt, Human
aguuucuagccccagguuccugguuguguccg

SEQ ID NO: 62853 - RNA, 32 nt, Human
aguuucuagugccacacacaguauuuagaaaa

SEQ ID NO: 62854 - RNA, 32 nt, Human
aguuucuauccaggaauguucacauccaaagg

SEQ ID NO: 62855 - RNA, 32 nt, Human
aguuucuauuuuccucccuucucagacagggc

SEQ ID NO: 62856 - RNA, 32 nt, Human
aguuucucaaaacccuuaaaagaaggacccuu

SEQ ID NO: 62857 - RNA, 32 nt, Human
aguuucucaaccuuuauuuuuaaugaaggagg

SEQ ID NO: 62858 - RNA, 31 nt, Human
aguuucucaauaaaguuguuuggaaaauauu

SEQ ID NO: 62859 - RNA, 32 nt, Human
aguuucucacuuacucuuucugagguccaggg

SEQ ID NO: 62860 - RNA, 32 nt, Human
aguuucucagacuguagccauugaaaauuaga

SEQ ID NO: 62861 - RNA, 32 nt, Human
aguuucuccaucucccugcugcagccccgagg

SEQ ID NO: 62862 - RNA, 20 nt, Human
aguuucucccccuccucucc

SEQ ID NO: 62863 - RNA, 32 nt, Human
aguuucuccuccucacagauaggggcugaggc

SEQ ID NO: 62864 - RNA, 32 nt, Human
aguuucucguggggagauggaggcagagccca

SEQ ID NO: 62865 - RNA, 32 nt, Human
aguuucucugagaaauagagacaggauucucu

SEQ ID NO: 62866 - RNA, 32 nt, Human
aguuucugagucuguguugcagccucugacac

SEQ ID NO: 62867 - RNA, 32 nt, Human
aguuucugcaccugucaaauaggguuuauguu

SEQ ID NO: 62868 - RNA, 32 nt, Human
aguuucugcacucagccaggcggcaucaaugg

SEQ ID NO: 62869 - RNA, 32 nt, Human
aguuucugccaccuccccuccugagccugcug

SEQ ID NO: 62870 - RNA, 32 nt, Human
aguuucugcgcuuccuucucccucucuccaga

SEQ ID NO: 62871 - RNA, 32 nt, Human
aguuucugcucacccacauccucccuccacag

SEQ ID NO: 62872 - RNA, 32 nt, Human
aguuucugcuucuucccugccucugccuggcc

SEQ ID NO: 62873 - RNA, 32 nt, Human
aguuucugcuuggcacagucucugccugcuug

SEQ ID NO: 62874 - RNA, 32 nt, Human
aguuucuggguccccacagagcucgggaaaca

SEQ ID NO: 62875 - RNA, 32 nt, Human
aguuucuggugcuauuuuuguguuguaaugug

SEQ ID NO: 62876 - RNA, 32 nt, Human
aguuucugguucucacacuguacucugagguc

SEQ ID NO: 62877 - RNA, 32 nt, Human
aguuucuguaaaaauggcaagccacaugcuuu

SEQ ID NO: 62878 - RNA, 32 nt, Human
aguuucuguucccagcaccugccuuugaagga

SEQ ID NO: 62879 - RNA, 32 nt, Human
aguuucuguuugauuuggaucaucucaggauc

SEQ ID NO: 62880 - RNA, 32 nt, Human
aguuucuuaauuguggacaaauuaacaguugg

SEQ ID NO: 62881 - RNA, 32 nt, Human
aguuucuuaucuauaaaaugggauuauaaaau

SEQ ID NO: 62882 - RNA, 32 nt, Human
aguuucuucauacuucugucacuuuuuccauu

SEQ ID NO: 62883 - RNA, 32 nt, Human
aguuucuucccagagagucugucccagaagga

SEQ ID NO: 62884 - RNA, 32 nt, Human
aguuucuuccccaagagcuguuagguaucaaa

SEQ ID NO: 62885 - RNA, 32 nt, Human
aguuucuucugagcucaggugucuggcuauuu

SEQ ID NO: 62886 - RNA, 32 nt, Human
aguuucuugauaggauagauacccacauacag

SEQ ID NO: 62887 - RNA, 32 nt, Human
aguuucuugcagaaaacuuucacauucaucuc

SEQ ID NO: 62888 - RNA, 32 nt, Human
aguuucuugguugggacacuccucuggcagcc

SEQ ID NO: 62889 - RNA, 32 nt, Human
aguuucuuucucuuccuucauagaugacacgg

SEQ ID NO: 62890 - RNA, 32 nt, Human
aguuucuuuuugaauacuuguuucuuuagcac

SEQ ID NO: 62891 - RNA, 32 nt, Human
aguuucuuuuugcccaggcuggagugcagugg

SEQ ID NO: 62892 - RNA, 32 nt, Human
aguuugaaaccagccuggccaacauggugaaa

SEQ ID NO: 62893 - RNA, 32 nt, Human
aguuugaaaccagucucaccaggcgcaguggc

SEQ ID NO: 62894 - RNA, 32 nt, Human
aguuugaaagagaggguucccuaugaauaaga

SEQ ID NO: 62895 - RNA, 32 nt, Human
aguuugaacucugacaccacauuuuccuucua

SEQ ID NO: 62896 - RNA, 32 nt, Human
aguuugaagaacacugguaauguguggaguau

SEQ ID NO: 62897 - RNA, 32 nt, Human
aguuugaaggacauugauaaacugugauuuua

SEQ ID NO: 62898 - RNA, 32 nt, Human
aguuugaagguaacugagagcagaugguccuc

SEQ ID NO: 62899 - RNA, 19 nt, Human
aguuugaagguucucggaa

SEQ ID NO: 62900 - RNA, 32 nt, Human
aguuugaagucuuccuccucugugucuuccca

SEQ ID NO: 62901 - RNA, 32 nt, Human
aguuugaauacugugaauucauuacgaagaau

SEQ ID NO: 62902 - RNA, 32 nt, Human
aguuugacaaauccugcaguguuuccaggcau

SEQ ID NO: 62903 - RNA, 32 nt, Human
aguuugacaguggccucagguucacagugcac

SEQ ID NO: 62904 - RNA, 32 nt, Human
aguuugaccaucacccucagcaguucagcucc

SEQ ID NO: 62905 - RNA, 32 nt, Human
aguuugacuaugccgucuucugcccuaaccug

SEQ ID NO: 62906 - RNA, 32 nt, Human
aguuugagacagcuccguguggagagcuuagc

SEQ ID NO: 62907 - RNA, 32 nt, Human
aguuugagacaggagaccuggcacuggaugca

SEQ ID NO: 62908 - RNA, 32 nt, Human
aguuugagaccagccuagucaacaugaggaaa

SEQ ID NO: 62909 - RNA, 32 nt, Human
aguuugagaccagccugagugacauagugaga

SEQ ID NO: 62910 - RNA, 32 nt, Human
aguuugagaccagccuggccaacagggugaaa

SEQ ID NO: 62911 - RNA, 32 nt, Human
aguuugagaccagccugggcaacagagugaga

SEQ ID NO: 62912 - RNA, 32 nt, Human
aguuugagaccagccugggcaacaggguaagg

SEQ ID NO: 62913 - RNA, 32 nt, Human
aguuugagaccagcuuagccaacauaguaaga

SEQ ID NO: 62914 - RNA, 32 nt, Human
aguuugagaccagcuuggugaaacccugucuc

SEQ ID NO: 62915 - RNA, 32 nt, Human
aguuugagacuauccuggucaacaugaugaaa

SEQ ID NO: 62916 - RNA, 32 nt, Human
aguuugagccagccuggccaacauggugaaac

SEQ ID NO: 62917 - RNA, 32 nt, Human
aguuugagccugggcaauguagcaagaccccc

SEQ ID NO: 62918 - RNA, 32 nt, Human
aguuugaggaagagcccagaagucuaacaggu

SEQ ID NO: 62919 - RNA, 32 nt, Human
aguuugaggaauauuucaagcucugcaacagg

SEQ ID NO: 62920 - RNA, 32 nt, Human
aguuugaggcugcagugagcugugauagcacc

SEQ ID NO: 62921 - RNA, 32 nt, Human
aguuugaggcuuuguuaaaaguggggagaagg

SEQ ID NO: 62922 - RNA, 32 nt, Human
aguuugaguguguguggugugugcaucuggug

SEQ ID NO: 62923 - RNA, 32 nt, Human
aguuugauaaucaguauaucccuucccaaccc

SEQ ID NO: 62924 - RNA, 32 nt, Human
aguuugaucucagacugcugugcuagcaauca

SEQ ID NO: 62925 - RNA, 32 nt, Human
aguuugaugcagagcuuuuuagccaugaagaa

SEQ ID NO: 62926 - RNA, 32 nt, Human
aguuugcaaaggaccagguaauuggggagggg

SEQ ID NO: 62927 - RNA, 32 nt, Human
aguuugcaccuugauuuccccagugaaaaggg

SEQ ID NO: 62928 - RNA, 32 nt, Human
aguuugcaguccugugugcuucccucucuuau

SEQ ID NO: 62929 - RNA, 32 nt, Human
aguuugcagugagccgagagugcgccacuuca

SEQ ID NO: 62930 - RNA, 32 nt, Human
aguuugcagugagccgagauagugccauugua

SEQ ID NO: 62931 - RNA, 32 nt, Human
aguuugcagugagccgagaucgugucacugca

SEQ ID NO: 62932 - RNA, 32 nt, Human
aguuugcagugcguuucaucaucuuuauguga

SEQ ID NO: 62933 - RNA, 32 nt, Human
aguuugcagugcugggcaggugacuucaucuc

SEQ ID NO: 62934 - RNA, 32 nt, Human
aguuugcaguuaugcagaauccaaaguaaaug

SEQ ID NO: 62935 - RNA, 32 nt, Human
aguuugcaucacugcacuccagccugggcaac

SEQ ID NO: 62936 - RNA, 32 nt, Human
aguuugccaaccuuauuuguagccugauuggg

SEQ ID NO: 62937 - RNA, 20 nt, Human
aguuugccagaauuuuucua

SEQ ID NO: 62938 - RNA, 32 nt, Human
aguuugcccaguacuggagaaaaugaacuggg

SEQ ID NO: 62939 - RNA, 32 nt, Human
aguuugcccgcgggugugugaagggagacagu

SEQ ID NO: 62940 - RNA, 32 nt, Human
aguuugccgagcugcccagccaggcuguuccc

SEQ ID NO: 62941 - RNA, 32 nt, Human
aguuugccuccaacaaccugaggucccugggg

SEQ ID NO: 62942 - RNA, 32 nt, Human
aguuugccucugcacgugcacacaccugcaca

SEQ ID NO: 62943 - RNA, 32 nt, Human
aguuugccugagcucaggaguuugagaccaac

SEQ ID NO: 62944 - RNA, 32 nt, Human
aguuugccuucugaccucauuuccuucuugau

SEQ ID NO: 62945 - RNA, 32 nt, Human
aguuugcuaguaucauuagaaugugaaauaga

SEQ ID NO: 62946 - RNA, 32 nt, Human
aguuugcuaugccuaggaaaugguuuaaacaa

SEQ ID NO: 62947 - RNA, 32 nt, Human
aguuugcucaggaaguucggggcaugcaggcc

SEQ ID NO: 62948 - RNA, 32 nt, Human
aguuugcucgcuuuccuccccugccggccccc

SEQ ID NO: 62949 - RNA, 32 nt, Human
aguuugcugauaaaugucuguuggauucuuuu

SEQ ID NO: 62950 - RNA, 32 nt, Human
aguuugcugcggccucgaccuccugggcuuaa

SEQ ID NO: 62951 - RNA, 20 nt, Human
aguuugcugcugauucuucc

SEQ ID NO: 62952 - RNA, 32 nt, Human
aguuugcuuaauaccugggugaugaaauaauu

SEQ ID NO: 62953 - RNA, 32 nt, Human
aguuugcuugccucaucugucaaacaagagag

SEQ ID NO: 62954 - RNA, 32 nt, Human
aguuugcuuguauuagcugugccuucauuauu

SEQ ID NO: 62955 - RNA, 32 nt, Human
aguuugcuuuccaaucaaagggcauuuauuuu

SEQ ID NO: 62956 - RNA, 19 nt, Human
aguuugcuuuucuaccauc

SEQ ID NO: 62957 - RNA, 32 nt, Human
aguuugcuuuugauuugcaucuucucacuagu

SEQ ID NO: 62958 - RNA, 32 nt, Human
aguuugcuuuugcccaaggcccuuaacauuug

SEQ ID NO: 62959 - RNA, 32 nt, Human
aguuuggaaguuauguaacagagcagguugag

SEQ ID NO: 62960 - RNA, 32 nt, Human
aguuuggaccagccugggcaacauggugaaac

SEQ ID NO: 62961 - RNA, 32 nt, Human
aguuuggacuacagguacaugccaccacaccu

SEQ ID NO: 62962 - RNA, 32 nt, Human
aguuuggagaaaugaugagcuacgccuugaug

SEQ ID NO: 62963 - RNA, 32 nt, Human
aguuuggagcagugcugaggccaaagccgccu

SEQ ID NO: 62964 - RNA, 32 nt, Human
aguuuggagcauugcccucuaagagcuuuaaa

SEQ ID NO: 62965 - RNA, 32 nt, Human
aguuuggaggcaggcguugagcugugcacauc

SEQ ID NO: 62966 - RNA, 32 nt, Human
aguuuggagggaggggaauggaagggcaugga

SEQ ID NO: 62967 - RNA, 32 nt, Human
aguuuggaggugcuccuugaggugggaaguau

SEQ ID NO: 62968 - RNA, 32 nt, Human
aguuuggcaauaguuugcauagagguaccagc

SEQ ID NO: 62969 - RNA, 32 nt, Human
aguuuggcggcggcuccgggaggcagagcggg

SEQ ID NO: 62970 - RNA, 32 nt, Human
aguuugggaaaagauuauuuuuaagcuuaaaa

SEQ ID NO: 62971 - RNA, 32 nt, Human
aguuugggacagugggggaggagaugggaagg

SEQ ID NO: 62972 - RNA, 32 nt, Human
aguuugggagagaggagagaaguggguguggu

SEQ ID NO: 62973 - RNA, 19 nt, Human
aguuugggaggcugagccg

SEQ ID NO: 62974 - RNA, 32 nt, Human
aguuugggagggcugguaagcuccauccuuuc

SEQ ID NO: 62975 - RNA, 32 nt, Human
aguuugggauggaggugggagaacaaaaauga

SEQ ID NO: 62976 - RNA, 32 nt, Human
aguuugggauuuguuuuuaaauaauuuauacc

SEQ ID NO: 62977 - RNA, 21 nt, Human
aguuugggcaacauggcgaaa

SEQ ID NO: 62978 - RNA, 32 nt, Human
aguuugggccacugcacucuagccuggcaaca

SEQ ID NO: 62979 - RNA, 32 nt, Human
aguuugggcuggaaggagagaugccagcccuc

SEQ ID NO: 62980 - RNA, 32 nt, Human
aguuugggcugggggccaggguuggguggguc

SEQ ID NO: 62981 - RNA, 32 nt, Human
aguuuggggaaagcgggaggcacuucccaggg

SEQ ID NO: 62982 - RNA, 26 nt, Human
aguuuggggagcagccccuggcuccu

SEQ ID NO: 62983 - RNA, 32 nt, Human
aguuuggggccuugguucccaccugcagaugc

SEQ ID NO: 62984 - RNA, 32 nt, Human
aguuugggggaagagaaacuugcagugaaaag

SEQ ID NO: 62985 - RNA, 32 nt, Human
aguuugggguagggcuggaggaucgcuccugu

SEQ ID NO: 62986 - RNA, 31 nt, Human
aguuuggggucaagagagcauagguagguuc

SEQ ID NO: 62987 - RNA, 32 nt, Human
aguuuggggugagguaguuggcauaggcuuau

SEQ ID NO: 62988 - RNA, 32 nt, Human
aguuugggguucuuccuggugcaggggcugaa

SEQ ID NO: 62989 - RNA, 32 nt, Human
aguuugggucugggacuggagauuggccauua

SEQ ID NO: 62990 - RNA, 32 nt, Human
aguuuggugcaggagcaggggcagggggccac

SEQ ID NO: 62991 - RNA, 19 nt, Human
aguuuggugcaucuugguu

SEQ ID NO: 62992 - RNA, 32 nt, Human
aguuugguguguccuccgccuuaccaggagaa

SEQ ID NO: 62993 - RNA, 32 nt, Human
aguuugguuccaugcuuugaaggcaggcuuua

SEQ ID NO: 62994 - RNA, 32 nt, Human
aguuugguuuuagcuggggauugugcuggcau

SEQ ID NO: 62995 - RNA, 19 nt, Human
aguuugguuuugcacauua

SEQ ID NO: 62996 - RNA, 18 nt, Human
aguuuguaaguaucauua

SEQ ID NO: 62997 - RNA, 32 nt, Human
aguuuguacauacacuaguggcauuucuuauc

SEQ ID NO: 62998 - RNA, 32 nt, Human
aguuuguacuuauuucaucaagcuuuucuaag

SEQ ID NO: 62999 - RNA, 32 nt, Human
aguuuguagauauugccaagauuucccaggcu

SEQ ID NO: 63000 - RNA, 32 nt, Human
aguuuguauguuuaaguggucaagcaaggcuc

SEQ ID NO: 63001 - RNA, 32 nt, Human
aguuuguauuuuuaguagagacaggguuucuc

SEQ ID NO: 63002 - RNA, 32 nt, Human
aguuugucacccaggcuggagugcaguggcau

SEQ ID NO: 63003 - RNA, 32 nt, Human
aguuugucacccaggcuggagugcuguggugu

SEQ ID NO: 63004 - RNA, 18 nt, Human
aguuugucaguaccguua

SEQ ID NO: 63005 - RNA, 18 nt, Human
aguuugucauucaccuca

SEQ ID NO: 63006 - RNA, 18 nt, Human
aguuuguccaucaccauu

SEQ ID NO: 63007 - RNA, 20 nt, Human
aguuugucccaucugaacug

SEQ ID NO: 63008 - RNA, 32 nt, Human
aguuugucuuaucugcugauguguccccaucu

SEQ ID NO: 63009 - RNA, 32 nt, Human
aguuugucuuccucuuguuuacgacgugaucu

SEQ ID NO: 63010 - RNA, 18 nt, Human
aguuugucuuuucuuuca

SEQ ID NO: 63011 - RNA, 32 nt, Human
aguuugucuuuucuuucagaaacaucucuuag

SEQ ID NO: 63012 - RNA, 32 nt, Human
aguuugugaaaugaugagggcauuuuaucugc

SEQ ID NO: 63013 - RNA, 32 nt, Human
aguuugugagccagcccggcccuguacagaug

SEQ ID NO: 63014 - RNA, 32 nt, Human
aguuugugagccagcccggcccuguacaggug

SEQ ID NO: 63015 - RNA, 21 nt, Human
aguuugugauugcagugaaua

SEQ ID NO: 63016 - RNA, 32 nt, Human
aguuugugccucacacuccagccuggguaaca

SEQ ID NO: 63017 - RNA, 32 nt, Human
aguuugugucuuucuuucuguccauaacugaa

SEQ ID NO: 63018 - RNA, 32 nt, Human
aguuuguguugacuuaacauugaguucaagcc

SEQ ID NO: 63019 - RNA, 19 nt, Human
aguuuguguuucuacuauu

SEQ ID NO: 63020 - RNA, 18 nt, Human
aguuuguuaaguaccauc

SEQ ID NO: 63021 - RNA, 32 nt, Human
aguuuguuaggugcauuugagcacacauuuua

SEQ ID NO: 63022 - RNA, 31 nt, Human
aguuuguucaauaaauaugcuugauggagcu

SEQ ID NO: 63023 - RNA, 32 nt, Human
aguuuguucuauucuguuuauuuggaaacugc

SEQ ID NO: 63024 - RNA, 32 nt, Human
aguuuguugcccaggcuggagugaguggcaca

SEQ ID NO: 63025 - RNA, 32 nt, Human
aguuuguuuacuuaugcccuccggaaaucaug

SEQ ID NO: 63026 - RNA, 32 nt, Human
aguuuguuuccuggaaacuuugacaagcuuua

SEQ ID NO: 63027 - RNA, 19 nt, Human
aguuuguuucuuuuuauua

SEQ ID NO: 63028 - RNA, 18 nt, Human
aguuuguuugcugccauu

SEQ ID NO: 63029 - RNA, 32 nt, Human
aguuuguuuuuaccucugccuccugguuuuca

SEQ ID NO: 63030 - RNA, 32 nt, Human
aguuuguuuuucucaggauauuguccuggccc

SEQ ID NO: 63031 - RNA, 19 nt, Human
aguuuguuuuucucuauua

SEQ ID NO: 63032 - RNA, 17 nt, Human
aguuuguuuuucuguca

SEQ ID NO: 63033 - RNA, 19 nt, Human
aguuuguuuuuuauuauca

SEQ ID NO: 63034 - RNA, 17 nt, Human
aguuuguuuuuuccuca

SEQ ID NO: 63035 - RNA, 20 nt, Human
aguuuuaaaaaccaaagcau

SEQ ID NO: 63036 - RNA, 32 nt, Human
aguuuuaaaauuaggaguuaagagagaagagg

SEQ ID NO: 63037 - RNA, 32 nt, Human
aguuuuaaaggauguucauacacaugguauag

SEQ ID NO: 63038 - RNA, 32 nt, Human
aguuuuaagaaauggcucuaucaaagaagcaa

SEQ ID NO: 63039 - RNA, 32 nt, Human
aguuuuaagaauuguuccuuggggaaaaauuu

SEQ ID NO: 63040 - RNA, 32 nt, Human
aguuuuaaggugcagggcacuuuaggguacug

SEQ ID NO: 63041 - RNA, 32 nt, Human
aguuuuacagcaguuccaacccuggaaucaac

SEQ ID NO: 63042 - RNA, 32 nt, Human
aguuuuacaggguuauacauuguuaagggacc

SEQ ID NO: 63043 - RNA, 32 nt, Human
aguuuuaccauguuggccaggcuggucuugaa

SEQ ID NO: 63044 - RNA, 32 nt, Human
aguuuuacccauuaagaaacugaagaucagag

SEQ ID NO: 63045 - RNA, 32 nt, Human
aguuuuacuaugaacagcacccugcugagauc

SEQ ID NO: 63046 - RNA, 32 nt, Human
aguuuuacugauuuuaucuccaccucucugau

SEQ ID NO: 63047 - RNA, 32 nt, Human
aguuuuacugcacauuacguuggugcaaaagu

SEQ ID NO: 63048 - RNA, 32 nt, Human
aguuuuacuguacuuucuugucugcacagaaa

SEQ ID NO: 63049 - RNA, 32 nt, Human
aguuuuagaaaugagaaaaauacagaguuuua

SEQ ID NO: 63050 - RNA, 32 nt, Human
aguuuuaguagagacgggguuucuccauguug

SEQ ID NO: 63051 - RNA, 32 nt, Human
aguuuuaguaugguuuugucucuaaugaauaa

SEQ ID NO: 63052 - RNA, 32 nt, Human
aguuuuagucaugggcuuucuucaccugcucu

SEQ ID NO: 63053 - RNA, 29 nt, Human
aguuuuaguuugugugugucuugcugggg

SEQ ID NO: 63054 - RNA, 32 nt, Human
aguuuuaucucccacuuuaggguggcagccag

SEQ ID NO: 63055 - RNA, 32 nt, Human
aguuuuaucucucucaagcucuaccuuccgca

SEQ ID NO: 63056 - RNA, 32 nt, Human
aguuuuaucugcuucaaaaugccauugaucau

SEQ ID NO: 63057 - RNA, 32 nt, Human
aguuuuauugaccccucuaauucucuuaccca

SEQ ID NO: 63058 - RNA, 32 nt, Human
aguuuuauuuggaaccuucuaagaggaaauca

SEQ ID NO: 63059 - RNA, 22 nt, Human
aguuuuauuuuggucucuucca

SEQ ID NO: 63060 - RNA, 32 nt, Human
aguuuuauuuuuggagaugacacaccuacugc

SEQ ID NO: 63061 - RNA, 32 nt, Human
aguuuucaagggagugggaggcuuccaacaua

SEQ ID NO: 63062 - RNA, 31 nt, Human
aguuuucacagcuacaaagagcuagaaaugu

SEQ ID NO: 63063 - RNA, 32 nt, Human
aguuuucaccauuuguccucagucuccuuuau

SEQ ID NO: 63064 - RNA, 32 nt, Human
aguuuucacggcaauccucugaccaccgcagg

SEQ ID NO: 63065 - RNA, 32 nt, Human
aguuuucagucacagaucacgccuuaaaagac

SEQ ID NO: 63066 - RNA, 32 nt, Human
aguuuucaucccuuuuccaguacacacagcua

SEQ ID NO: 63067 - RNA, 32 nt, Human
aguuuucaugucuauaaaauaagguggcuagu

SEQ ID NO: 63068 - RNA, 32 nt, Human
aguuuucauuguccaagcauccucagggaaca

SEQ ID NO: 63069 - RNA, 32 nt, Human
aguuuucauuuuacuguggauuuugcuauacu

SEQ ID NO: 63070 - RNA, 32 nt, Human
aguuuuccaagaaauuaagcauaacagucuca

SEQ ID NO: 63071 - RNA, 32 nt, Human
aguuuucccaacuaacaagguaaguugccaug

SEQ ID NO: 63072 - RNA, 32 nt, Human
aguuuucccaaugauguuuaaaagcuuugaga

SEQ ID NO: 63073 - RNA, 32 nt, Human
aguuuucccacauuauuugucuccaugauacc

SEQ ID NO: 63074 - RNA, 32 nt, Human
aguuuucccuccuggcagggaccccagggauu

SEQ ID NO: 63075 - RNA, 32 nt, Human
aguuuuccuccacccuuuccucucccucaguu

SEQ ID NO: 63076 - RNA, 32 nt, Human
aguuuuccucuuccucuccucguacggaguuc

SEQ ID NO: 63077 - RNA, 32 nt, Human
aguuuuccuucccagaaucucacugcucuuuu

SEQ ID NO: 63078 - RNA, 32 nt, Human
aguuuuccuuuccuagcugaugauuuguucac

SEQ ID NO: 63079 - RNA, 32 nt, Human
aguuuucuaagauuaaaucuccuucacaauga

SEQ ID NO: 63080 - RNA, 32 nt, Human
aguuuucuauuauuccaaucucugcucaguua

SEQ ID NO: 63081 - RNA, 32 nt, Human
aguuuucuauuuuaaagaggaaucugaaagca

SEQ ID NO: 63082 - RNA, 32 nt, Human
aguuuucucuauaggagauacucuccaguuua

SEQ ID NO: 63083 - RNA, 23 nt, Human
aguuuucucuucugaauuccuug

SEQ ID NO: 63084 - RNA, 32 nt, Human
aguuuucugggcaggacuuuggugguuuaaaa

SEQ ID NO: 63085 - RNA, 32 nt, Human
aguuuucuuacuuucagggaagguaagaaaau

SEQ ID NO: 63086 - RNA, 32 nt, Human
aguuuucuuagcucccuggacccgguugaccu

SEQ ID NO: 63087 - RNA, 32 nt, Human
aguuuucuuuaacagugagguggaucuuuacc

SEQ ID NO: 63088 - RNA, 32 nt, Human
aguuuucuuuccuccuuuccuccucugacuug

SEQ ID NO: 63089 - RNA, 32 nt, Human
aguuuugacagcugccagucuuccugccccuu

SEQ ID NO: 63090 - RNA, 32 nt, Human
aguuuugagauggagucuagcucuguccccug

SEQ ID NO: 63091 - RNA, 32 nt, Human
aguuuugagauggcgacuaccuuucuguaugg

SEQ ID NO: 63092 - RNA, 24 nt, Human
aguuuugauuauccaugaacccuu

SEQ ID NO: 63093 - RNA, 32 nt, Human
aguuuugauuugaggagguuugcacauguaga

SEQ ID NO: 63094 - RNA, 32 nt, Human
aguuuugcaguggugcaaucauagcucauugc

SEQ ID NO: 63095 - RNA, 32 nt, Human
aguuuugccacagaagccccagagggcuggcc

SEQ ID NO: 63096 - RNA, 32 nt, Human
aguuuugccagccauggccaggguuuggcucc

SEQ ID NO: 63097 - RNA, 32 nt, Human
aguuuugccagccuggcaacagagcaagacuc

SEQ ID NO: 63098 - RNA, 32 nt, Human
aguuuugccauguuggccaggcuggucuugaa

SEQ ID NO: 63099 - RNA, 32 nt, Human
aguuuugcuaucucucugagaagcucaucuga

SEQ ID NO: 63100 - RNA, 32 nt, Human
aguuuugcucauucuaaugauggcccauucua

SEQ ID NO: 63101 - RNA, 32 nt, Human
aguuuuggaaaccauugcaaagcugucaagug

SEQ ID NO: 63102 - RNA, 32 nt, Human
aguuuuggccacaucuugcuugcugaugagga

SEQ ID NO: 63103 - RNA, 32 nt, Human
aguuuugggauuacaagugugggccaccgcgg

SEQ ID NO: 63104 - RNA, 24 nt, Human
aguuuugggguaaagacaccugga

SEQ ID NO: 63105 - RNA, 32 nt, Human
aguuuuguaauucuagcaacaugggaaagcau

SEQ ID NO: 63106 - RNA, 32 nt, Human
aguuuuguagcaguguacccacgcuggguauu

SEQ ID NO: 63107 - RNA, 20 nt, Human
aguuuugucccagaacugug

SEQ ID NO: 63108 - RNA, 32 nt, Human
aguuuugucugaagaccaggucccacugcccc

SEQ ID NO: 63109 - RNA, 32 nt, Human
aguuuugugguguuuuaacuugcccuauuccu

SEQ ID NO: 63110 - RNA, 32 nt, Human
aguuuugugguuucugcuuucuugccuaaauc

SEQ ID NO: 63111 - RNA, 23 nt, Human
aguuuuguuauaguuguuuucua

SEQ ID NO: 63112 - RNA, 23 nt, Human
aguuuuguucuaauuucauuuca

SEQ ID NO: 63113 - RNA, 19 nt, Human
aguuuuguucuaucuuucu

SEQ ID NO: 63114 - RNA, 32 nt, Human
aguuuuguuuagagcaguuaacaucugaagug

SEQ ID NO: 63115 - RNA, 23 nt, Human
aguuuuguuuugauuuguuucca

SEQ ID NO: 63116 - RNA, 23 nt, Human
aguuuuguuuuuugcucuuuuca

SEQ ID NO: 63117 - RNA, 32 nt, Human
aguuuuuaaauggugagagugugucucugggg

SEQ ID NO: 63118 - RNA, 32 nt, Human
aguuuuuaacacucuugccaagucuagaagag

SEQ ID NO: 63119 - RNA, 32 nt, Human
aguuuuuaagggacaccagagccgcagccugc

SEQ ID NO: 63120 - RNA, 32 nt, Human
aguuuuuaaucuucagcucaucaugucccagg

SEQ ID NO: 63121 - RNA, 32 nt, Human
aguuuuuaggagaagaggagagacaggcagga

SEQ ID NO: 63122 - RNA, 25 nt, Human
aguuuuuagugaacaaucaaagcac

SEQ ID NO: 63123 - RNA, 32 nt, Human
aguuuuuaucucuagcuuuuucaagccaggua

SEQ ID NO: 63124 - RNA, 32 nt, Human
aguuuuucaaagauauuuuacuugggggugga

SEQ ID NO: 63125 - RNA, 19 nt, Human
aguuuuucagaacguggaa

SEQ ID NO: 63126 - RNA, 32 nt, Human
aguuuuucagcuccucuccacucugcuuuccc

SEQ ID NO: 63127 - RNA, 32 nt, Human
aguuuuucaggaagagaaaguagagaagaaaa

SEQ ID NO: 63128 - RNA, 32 nt, Human
aguuuuucaugggcaugauuccaaaaucaaca

SEQ ID NO: 63129 - RNA, 32 nt, Human
aguuuuucauucuuccuuguccaccaugaucu

SEQ ID NO: 63130 - RNA, 32 nt, Human
aguuuuuccaaggagaauggaaagcacuugcc

SEQ ID NO: 63131 - RNA, 32 nt, Human
aguuuuuccacagccuuggagaggggcuuuga

SEQ ID NO: 63132 - RNA, 32 nt, Human
aguuuuuccagccuccaagucaccuggccugg

SEQ ID NO: 63133 - RNA, 32 nt, Human
aguuuuuccauucaaaccaagaugcaaauuca

SEQ ID NO: 63134 - RNA, 20 nt, Human
aguuuuuccauuuaccauca

SEQ ID NO: 63135 - RNA, 32 nt, Human
aguuuuuccauuuaccaucaacauggaaacuu

SEQ ID NO: 63136 - RNA, 32 nt, Human
aguuuuucccugccagagauggcaggggaaag

SEQ ID NO: 63137 - RNA, 32 nt, Human
aguuuuuccugccccauuccccaaacagaagc

SEQ ID NO: 63138 - RNA, 32 nt, Human
aguuuuuccuuucuccgcaaccagauguacau

SEQ ID NO: 63139 - RNA, 32 nt, Human
aguuuuucuaacuccaggguaguguuuagugu

SEQ ID NO: 63140 - RNA, 32 nt, Human
aguuuuucuagccaaguguuuggggcuuuaau

SEQ ID NO: 63141 - RNA, 32 nt, Human
aguuuuucucacuaaaauauggggcaauuguu

SEQ ID NO: 63142 - RNA, 19 nt, Human
aguuuuucucaugccauca

SEQ ID NO: 63143 - RNA, 32 nt, Human
aguuuuucuccucugcugaggaaacaguaccg

SEQ ID NO: 63144 - RNA, 32 nt, Human
aguuuuugagguggggacacaggagguccagu

SEQ ID NO: 63145 - RNA, 32 nt, Human
aguuuuugauagcacaucuacaugcaucugca

SEQ ID NO: 63146 - RNA, 32 nt, Human
aguuuuuggaggaucagagggaggggaggcag

SEQ ID NO: 63147 - RNA, 32 nt, Human
aguuuuuggcaaaggaagguaacuucaaugua

SEQ ID NO: 63148 - RNA, 32 nt, Human
aguuuuuggcauugcuagaugcagagaacccu

SEQ ID NO: 63149 - RNA, 22 nt, Human
aguuuuuguacaaaagcuucaa

SEQ ID NO: 63150 - RNA, 32 nt, Human
aguuuuuguggaauuaaagugcugcugcugcg

SEQ ID NO: 63151 - RNA, 32 nt, Human
  misc_feature (2)..(2): n is a, c, g or u
anaucauucauguguccagagaucuuggaaaa

SEQ ID NO: 63152 - RNA, 32 nt, Human
  misc_feature (2)..(2): n is a, c, g or u
anucaagcaagacucugcuucuauguauggug

SEQ ID NO: 63153 - RNA, 32 nt, Human
auaaaaacaacaaauacuuccauauggagcau

SEQ ID NO: 63154 - RNA, 32 nt, Human
auaaaaacacaacuauugauucagagaaagga

SEQ ID NO: 63155 - RNA, 32 nt, Human
auaaaaacagaaaaacucagacuuggcauuuu

SEQ ID NO: 63156 - RNA, 32 nt, Human
auaaaaacauaacuuauuuaacuucuugcacu

SEQ ID NO: 63157 - RNA, 26 nt, Human
auaaaaaccaaaauauuuggcucuca

SEQ ID NO: 63158 - RNA, 32 nt, Human
auaaaaaccacacacaugcaugcacacaaaca

SEQ ID NO: 63159 - RNA, 32 nt, Human
auaaaaaccaccacccuccagccugggcaacg

SEQ ID NO: 63160 - RNA, 30 nt, Human
auaaaaacuauacaagcuucccgccucaag

SEQ ID NO: 63161 - RNA, 32 nt, Human
auaaaaacuccagaggauaaguuuacacuuaa

SEQ ID NO: 63162 - RNA, 32 nt, Human
auaaaaacugccucuguuguguuucucacugg

SEQ ID NO: 63163 - RNA, 21 nt, Human
auaaaaacuguaaacaaagca

SEQ ID NO: 63164 - RNA, 32 nt, Human
auaaaaacugugagucgagaagaaggaaagag

SEQ ID NO: 63165 - RNA, 32 nt, Human
auaaaaacuuaucuagaaggggagaaacuccc

SEQ ID NO: 63166 - RNA, 32 nt, Human
auaaaaacuuugcagaaaauuagacaguguuu

SEQ ID NO: 63167 - RNA, 32 nt, Human
auaaaaacuuugcagaaaauuagacgguguuu

SEQ ID NO: 63168 - RNA, 32 nt, Human
auaaaaagaaaagagaaggaaaggaaagagac

SEQ ID NO: 63169 - RNA, 32 nt, Human
auaaaaagaacaaacuaccugugcacaccaca

SEQ ID NO: 63170 - RNA, 32 nt, Human
auaaaaagagcuccccuuugcugacagaacug

SEQ ID NO: 63171 - RNA, 32 nt, Human
auaaaaagagcuucaggccaggcgugguggcu

SEQ ID NO: 63172 - RNA, 32 nt, Human
auaaaaagcaagagaaucagcuuugggcaaug

SEQ ID NO: 63173 - RNA, 32 nt, Human
auaaaaagcaaugccgggaggcugaggcggga

SEQ ID NO: 63174 - RNA, 32 nt, Human
auaaaaagccuuccacccuccugucugcuuua

SEQ ID NO: 63175 - RNA, 29 nt, Human
auaaaaagcuguucugucuucccacccaa

SEQ ID NO: 63176 - RNA, 32 nt, Human
auaaaaagggcuugggagauucaugcgaugug

SEQ ID NO: 63177 - RNA, 32 nt, Human
auaaaaauacaaaaauuagcuggacauggugg

SEQ ID NO: 63178 - RNA, 32 nt, Human
auaaaaauacaaaaauuagcugggcauggugc

SEQ ID NO: 63179 - RNA, 32 nt, Human
auaaaaauacaaaaauuagcugggcauggugg

SEQ ID NO: 63180 - RNA, 32 nt, Human
auaaaaauacaaaacuuagcugggcguggugg

SEQ ID NO: 63181 - RNA, 32 nt, Human
auaaaaauaguacuaguuaacugugaaaauug

SEQ ID NO: 63182 - RNA, 32 nt, Human
auaaaaauauccaugaaauucaucuaccucuu

SEQ ID NO: 63183 - RNA, 32 nt, Human
auaaaaaucuagacugacacauuuuuaagucu

SEQ ID NO: 63184 - RNA, 32 nt, Human
auaaaaaucucucauuuguguggagucauuuc

SEQ ID NO: 63185 - RNA, 32 nt, Human
auaaaaaucuggcugcgaccagucccaugugu

SEQ ID NO: 63186 - RNA, 31 nt, Human
auaaaaaugagcuuuugaggcaggcagucag

SEQ ID NO: 63187 - RNA, 32 nt, Human
auaaaaauguaaacaucuccacacacacaaaa

SEQ ID NO: 63188 - RNA, 32 nt, Human
auaaaaauuagcagggugugguggugcaugcc

SEQ ID NO: 63189 - RNA, 32 nt, Human
auaaaaauucaugucuguauuucaggagcaaa

SEQ ID NO: 63190 - RNA, 32 nt, Human
auaaaaauuuuggcuggaugcaauggcucacg

SEQ ID NO: 63191 - RNA, 21 nt, Human
auaaaacaacaaaaacaaagc

SEQ ID NO: 63192 - RNA, 32 nt, Human
auaaaacaauuuuagccuuucucaguuuauuu

SEQ ID NO: 63193 - RNA, 32 nt, Human
auaaaacacacuuucaaauuauuugaauuacc

SEQ ID NO: 63194 - RNA, 32 nt, Human
auaaaacaccaucuaauuucuucaaagaaaaa

SEQ ID NO: 63195 - RNA, 32 nt, Human
auaaaacacccacugcuuaagaggcaggcucg

SEQ ID NO: 63196 - RNA, 32 nt, Human
auaaaacacccucacagaaacaccuagaauaa

SEQ ID NO: 63197 - RNA, 32 nt, Human
auaaaacaccuuguacuuuauuuucuauaauu

SEQ ID NO: 63198 - RNA, 32 nt, Human
auaaaacacuugcuuuucuuuuugagaaaaau

SEQ ID NO: 63199 - RNA, 32 nt, Human
auaaaacaggcccugaggugugguggcucaug

SEQ ID NO: 63200 - RNA, 32 nt, Human
auaaaacauaccacaggcugggcaugguggcu

SEQ ID NO: 63201 - RNA, 31 nt, Human
auaaaacauacuucacauuagaacacagaau

SEQ ID NO: 63202 - RNA, 32 nt, Human
auaaaacaucaaacugcacagaacaguugaau

SEQ ID NO: 63203 - RNA, 32 nt, Human
auaaaacauggacugaugggucugcuccaggc

SEQ ID NO: 63204 - RNA, 32 nt, Human
auaaaacauguagauuugaaaagagaagacuu

SEQ ID NO: 63205 - RNA, 32 nt, Human
auaaaacauuucagaagaaaaaguaugaaaca

SEQ ID NO: 63206 - RNA, 32 nt, Human
auaaaaccauuuuaggaauuagaaaaaucaac

SEQ ID NO: 63207 - RNA, 32 nt, Human
auaaaaccuaucugcccaugcuuuacagccuu

SEQ ID NO: 63208 - RNA, 32 nt, Human
auaaaaccucauaugauuguccugccucaugg

SEQ ID NO: 63209 - RNA, 32 nt, Human
auaaaaccuuuauauuucugcuuuguagaaau

SEQ ID NO: 63210 - RNA, 32 nt, Human
auaaaacgugcuggcuccuccuuugccuucug

SEQ ID NO: 63211 - RNA, 32 nt, Human
auaaaacuacucucuaccucuggcugggccca

SEQ ID NO: 63212 - RNA, 32 nt, Human
auaaaacugaaauaaaccugcacugaaaccug

SEQ ID NO: 63213 - RNA, 32 nt, Human
auaaaacugccuggcuggcuccgggccgcccc

SEQ ID NO: 63214 - RNA, 32 nt, Human
auaaaacugcgaggacaucaaagugguaaaua

SEQ ID NO: 63215 - RNA, 32 nt, Human
auaaaagaaagccuggcccauggcguccagcu

SEQ ID NO: 63216 - RNA, 32 nt, Human
auaaaagaaaugcagagguuuacagaguuugc

SEQ ID NO: 63217 - RNA, 32 nt, Human
auaaaagaaauggcaggacucauauuauucag

SEQ ID NO: 63218 - RNA, 32 nt, Human
auaaaagaaaugucacagaagaaaaccacaaa

SEQ ID NO: 63219 - RNA, 32 nt, Human
auaaaagaagugagugaagaagaaccagauga

SEQ ID NO: 63220 - RNA, 32 nt, Human
auaaaagacaaaugcaacauuuuaaggcaaug

SEQ ID NO: 63221 - RNA, 32 nt, Human
auaaaagacggcaccuuugagggaaaaggcag

SEQ ID NO: 63222 - RNA, 32 nt, Human
auaaaagacuaaagacagggagcuagaugaaa

SEQ ID NO: 63223 - RNA, 32 nt, Human
auaaaagacucagcccugccuccgggaacuca

SEQ ID NO: 63224 - RNA, 32 nt, Human
auaaaagagaaaauaccagaaggaaacaaaua

SEQ ID NO: 63225 - RNA, 32 nt, Human
auaaaagagacacaccacauuuuaaugaggcu

SEQ ID NO: 63226 - RNA, 32 nt, Human
auaaaagagcacuucuguggcucauuuaaaag

SEQ ID NO: 63227 - RNA, 32 nt, Human
auaaaagaguuggccaggcaugguggcuuacg

SEQ ID NO: 63228 - RNA, 32 nt, Human
auaaaagauagaaggaaggagaugauagagga

SEQ ID NO: 63229 - RNA, 32 nt, Human
auaaaagaugugccauggcaggauagcaccaa

SEQ ID NO: 63230 - RNA, 32 nt, Human
auaaaagauguggcauucuuaagaaaguauau

SEQ ID NO: 63231 - RNA, 32 nt, Human
auaaaagcaacuccugccucccuuccucaccc

SEQ ID NO: 63232 - RNA, 32 nt, Human
auaaaagcaaguuuggcucccucuuuuccuca

SEQ ID NO: 63233 - RNA, 32 nt, Human
auaaaagcaauauguucucugaucauauacuc

SEQ ID NO: 63234 - RNA, 32 nt, Human
auaaaagcacagaacagaugugguggugguau

SEQ ID NO: 63235 - RNA, 32 nt, Human
auaaaagcccaggagcccauuuggagggccug

SEQ ID NO: 63236 - RNA, 32 nt, Human
auaaaagcuguugcaggccuuugcuaagcuau

SEQ ID NO: 63237 - RNA, 32 nt, Human
auaaaaggaaaagaaaacagaggcuuuaaauu

SEQ ID NO: 63238 - RNA, 32 nt, Human
auaaaaggauucacacuggagagaaacccuau

SEQ ID NO: 63239 - RNA, 32 nt, Human
auaaaaggcacacccauucucucaugcuugga

SEQ ID NO: 63240 - RNA, 32 nt, Human
auaaaaggcaggcagaugggccagaggagcag

SEQ ID NO: 63241 - RNA, 32 nt, Human
auaaaaggccugacauaucugagggagaagca

SEQ ID NO: 63242 - RNA, 32 nt, Human
auaaaaggcgugagccaccgcgccuggccuga

SEQ ID NO: 63243 - RNA, 32 nt, Human
auaaaagggaauagagaagagaugggacuauu

SEQ ID NO: 63244 - RNA, 32 nt, Human
auaaaagggagggagaugagaaguuucugaau

SEQ ID NO: 63245 - RNA, 32 nt, Human
auaaaaggggaggggaagguucccuggggcuu

SEQ ID NO: 63246 - RNA, 32 nt, Human
auaaaaggggagguggagagaccccuucagag

SEQ ID NO: 63247 - RNA, 32 nt, Human
auaaaagguaaauucauagcugccuuuuacua

SEQ ID NO: 63248 - RNA, 32 nt, Human
auaaaaggucucagccuguagcuuaaacuuau

SEQ ID NO: 63249 - RNA, 32 nt, Human
auaaaaguauagcagcauccucuacugaggug

SEQ ID NO: 63250 - RNA, 32 nt, Human
auaaaagucuggaaacagcccagcucucucaa

SEQ ID NO: 63251 - RNA, 32 nt, Human
auaaaagugauuaauuuuuacuugguguguac

SEQ ID NO: 63252 - RNA, 32 nt, Human
auaaaauaaguaagauguuaagagauauugau

SEQ ID NO: 63253 - RNA, 32 nt, Human
auaaaauaauaucacucuuuuaauaguauaca

SEQ ID NO: 63254 - RNA, 32 nt, Human
auaaaauaauguauauaaaauagacaagcucu

SEQ ID NO: 63255 - RNA, 32 nt, Human
auaaaauacaaaccaacgugccuaauuaauua

SEQ ID NO: 63256 - RNA, 32 nt, Human
auaaaauaccacuuucuuuucucucaucaggu

SEQ ID NO: 63257 - RNA, 32 nt, Human
auaaaauacuaaugcaauucuacagcauucaa

SEQ ID NO: 63258 - RNA, 32 nt, Human
auaaaauacugaucuguguugcauuucaaaau

SEQ ID NO: 63259 - RNA, 32 nt, Human
auaaaauacuuugcauucuaaguugccaauaa

SEQ ID NO: 63260 - RNA, 32 nt, Human
auaaaauaucuaucuuuucaucaugucuauag

SEQ ID NO: 63261 - RNA, 32 nt, Human
auaaaauaugcgucucuaugugcauugucaac

SEQ ID NO: 63262 - RNA, 32 nt, Human
auaaaaucaaccaacauaucugaaaaggauca

SEQ ID NO: 63263 - RNA, 32 nt, Human
auaaaaucacaguccgugagucuuccagcugc

SEQ ID NO: 63264 - RNA, 32 nt, Human
auaaaaucagagaaaagcagaggcagaaacuc

SEQ ID NO: 63265 - RNA, 32 nt, Human
auaaaaucaguuccuuucucuguuccucuuac

SEQ ID NO: 63266 - RNA, 32 nt, Human
auaaaauccagccuguagcuugccugaucaaa

SEQ ID NO: 63267 - RNA, 32 nt, Human
auaaaauccaugucgucgucuuuaaaaugugc

SEQ ID NO: 63268 - RNA, 32 nt, Human
auaaaauccuuccuucccauguuacuaaauua

SEQ ID NO: 63269 - RNA, 32 nt, Human
auaaaaucugcuuuucacacugggugauaaua

SEQ ID NO: 63270 - RNA, 32 nt, Human
auaaaaugaaguuuuuaaauugucaggaguug

SEQ ID NO: 63271 - RNA, 32 nt, Human
auaaaaugagccugugcucaugacagcugcuc

SEQ ID NO: 63272 - RNA, 32 nt, Human
auaaaaugauuagauugggaagguguguugau

SEQ ID NO: 63273 - RNA, 32 nt, Human
auaaaaugggcugaggguaccuuuuuggggag

SEQ ID NO: 63274 - RNA, 30 nt, Human
auaaaaugguuccugauagaucaaagaggg

SEQ ID NO: 63275 - RNA, 32 nt, Human
auaaaauuagagcuguaaggaaaaugaaaagc

SEQ ID NO: 63276 - RNA, 32 nt, Human
auaaaauugcccagucuucagcggagcaguuu

SEQ ID NO: 63277 - RNA, 32 nt, Human
auaaaauuggacugcauuucuuagaguguuuu

SEQ ID NO: 63278 - RNA, 32 nt, Human
auaaaauugggaacaggaaugagcaggaagcc

SEQ ID NO: 63279 - RNA, 32 nt, Human
auaaaauuguggcuuuaaaaaugcaugaaacc

SEQ ID NO: 63280 - RNA, 32 nt, Human
auaaaauuguucuaauuuggugccauuuccug

SEQ ID NO: 63281 - RNA, 32 nt, Human
auaaaauuucagggaaaacagaagcaaaggag

SEQ ID NO: 63282 - RNA, 30 nt, Human
auaaaauuuccuccucuauauuccaaaguu

SEQ ID NO: 63283 - RNA, 32 nt, Human
auaaaauuuucaugagaguaguuuacaaaagc

SEQ ID NO: 63284 - RNA, 32 nt, Human
auaaacaaaauaccacugucuucaagaaacau

SEQ ID NO: 63285 - RNA, 32 nt, Human
auaaacaagaauuggaagacaugaggaaagcu

SEQ ID NO: 63286 - RNA, 32 nt, Human
auaaacacacacguaauguacaugcauauagg

SEQ ID NO: 63287 - RNA, 32 nt, Human
auaaacacagcugcuuucuucuuacaccccgg

SEQ ID NO: 63288 - RNA, 26 nt, Human
auaaacaccuguguguuuaagacaug

SEQ ID NO: 63289 - RNA, 32 nt, Human
auaaacaccuuaaaugucuugucaacuggaug

SEQ ID NO: 63290 - RNA, 32 nt, Human
auaaacacggauuaccagacccugcgcaggga

SEQ ID NO: 63291 - RNA, 32 nt, Human
auaaacacugcacuuuggugcugacacugggu

SEQ ID NO: 63292 - RNA, 32 nt, Human
auaaacacuucuacaacuuaaauuuaauuuua

SEQ ID NO: 63293 - RNA, 32 nt, Human
auaaacagaaaaucuuuccucuucucauuacc

SEQ ID NO: 63294 - RNA, 32 nt, Human
auaaacagacccaauucaucaacuggaaagca

SEQ ID NO: 63295 - RNA, 32 nt, Human
auaaacagaucuuuccuauaaccuaggaaagu

SEQ ID NO: 63296 - RNA, 32 nt, Human
auaaacagcucccuugguuggaggcucuggug

SEQ ID NO: 63297 - RNA, 22 nt, Human
auaaacaguuaaaagcugaaaa

SEQ ID NO: 63298 - RNA, 32 nt, Human
auaaacauaagaaaauucacacuguagauaaa

SEQ ID NO: 63299 - RNA, 32 nt, Human
auaaacaucucuuccaaggggauggagagugg

SEQ ID NO: 63300 - RNA, 32 nt, Human
auaaacaugcuggauaucugcgguaccaaacu

SEQ ID NO: 63301 - RNA, 32 nt, Human
auaaacauugguucagucuggaaaagccagag

SEQ ID NO: 63302 - RNA, 31 nt, Human
auaaacauuuuaugcuugcauuuaaacuuga

SEQ ID NO: 63303 - RNA, 32 nt, Human
auaaaccaagucauaaauugcuguaaucuuuc

SEQ ID NO: 63304 - RNA, 32 nt, Human
auaaaccacagcugucccccaggaucccacuc

SEQ ID NO: 63305 - RNA, 32 nt, Human
auaaaccacuggcuuucucuuugucccccuag

SEQ ID NO: 63306 - RNA, 32 nt, Human
auaaaccagguaaaacugguuacccacgaggc

SEQ ID NO: 63307 - RNA, 32 nt, Human
auaaaccauuuccucaaggauuuucucaugug

SEQ ID NO: 63308 - RNA, 32 nt, Human
auaaacccaggaggccgagcugacaaagugag

SEQ ID NO: 63309 - RNA, 32 nt, Human
auaaacccugggaacaucuggcugcaggaauu

SEQ ID NO: 63310 - RNA, 32 nt, Human
auaaaccucaauugcuggagugggguguaguu

SEQ ID NO: 63311 - RNA, 32 nt, Human
auaaaccucuccccauauuuugcaaagaggaa

SEQ ID NO: 63312 - RNA, 32 nt, Human
auaaaccucuuuacuccuccagcaggcuuuuc

SEQ ID NO: 63313 - RNA, 32 nt, Human
auaaaccugcagcguuucaugccacgucuuug

SEQ ID NO: 63314 - RNA, 32 nt, Human
auaaaccuggcacuuuacaaacaaauaaacau

SEQ ID NO: 63315 - RNA, 32 nt, Human
auaaacgggugcaucccaccacucccuggagg

SEQ ID NO: 63316 - RNA, 32 nt, Human
auaaacuaaguuccucccaaaguuaggucagc

SEQ ID NO: 63317 - RNA, 32 nt, Human
auaaacuagguaaacuuggauaggcaguagau

SEQ ID NO: 63318 - RNA, 32 nt, Human
auaaacuagugugacugucuucugagcacagu

SEQ ID NO: 63319 - RNA, 32 nt, Human
auaaacucacucacacugaggccuuggggacu

SEQ ID NO: 63320 - RNA, 32 nt, Human
auaaacucagagucccagccccaaauagaccc

SEQ ID NO: 63321 - RNA, 32 nt, Human
auaaacucuaaggaagacagugauggagugaa

SEQ ID NO: 63322 - RNA, 22 nt, Human
auaaacucuagcucugaagggu

SEQ ID NO: 63323 - RNA, 23 nt, Human
auaaacucuaucugcugaaaggg

SEQ ID NO: 63324 - RNA, 26 nt, Human
auaaacucucucuuuguuuuuaaagg

SEQ ID NO: 63325 - RNA, 32 nt, Human
auaaacucuguggugcuguuggaucagguauu

SEQ ID NO: 63326 - RNA, 32 nt, Human
auaaacucuuagccucaguccagguuaaucug

SEQ ID NO: 63327 - RNA, 32 nt, Human
auaaacugcacaccuggggugauggcuuaaag

SEQ ID NO: 63328 - RNA, 32 nt, Human
auaaacugcuagccacaaauuuuaguuaugua

SEQ ID NO: 63329 - RNA, 32 nt, Human
auaaacuggcugagcuuagagagaggugcaga

SEQ ID NO: 63330 - RNA, 32 nt, Human
auaaacugggaaacugcuguggucucuguugc

SEQ ID NO: 63331 - RNA, 32 nt, Human
auaaacugggagaacuauggcagcuacuugca

SEQ ID NO: 63332 - RNA, 32 nt, Human
auaaacugggcuguucugcgugaggggaagua

SEQ ID NO: 63333 - RNA, 32 nt, Human
auaaacuuagagccaugcaaaugccagcagcu

SEQ ID NO: 63334 - RNA, 32 nt, Human
auaaacuuagaggccugugaagcucucccucu

SEQ ID NO: 63335 - RNA, 32 nt, Human
auaaacuucucccgaguuccaucucaguaaaa

SEQ ID NO: 63336 - RNA, 32 nt, Human
auaaacuuggcccugcgucuucccaggugacc

SEQ ID NO: 63337 - RNA, 32 nt, Human
auaaacuuucuuuagaugcuguucuuuaaaaa

SEQ ID NO: 63338 - RNA, 32 nt, Human
auaaagaaaaacacucaaggacuuuguucauu

SEQ ID NO: 63339 - RNA, 32 nt, Human
auaaagaaaagaggaggaggaggaggaagaaa

SEQ ID NO: 63340 - RNA, 32 nt, Human
auaaagaaaagagguuuaauugacucacaguu

SEQ ID NO: 63341 - RNA, 32 nt, Human
auaaagaaaagagguuuaauuggcucacaguu

SEQ ID NO: 63342 - RNA, 32 nt, Human
auaaagaaaagagguuuaauuggcucaugguu

SEQ ID NO: 63343 - RNA, 32 nt, Human
auaaagaaaagcuucuccucugccucauccac

SEQ ID NO: 63344 - RNA, 32 nt, Human
auaaagaaaauccugcugcucugguccuugug

SEQ ID NO: 63345 - RNA, 32 nt, Human
auaaagaaaggaugauaucucuaaagguaugu

SEQ ID NO: 63346 - RNA, 31 nt, Human
auaaagaaguuucucccugcugucaagggua

SEQ ID NO: 63347 - RNA, 32 nt, Human
auaaagaauuugucacaggaaggcugucucag

SEQ ID NO: 63348 - RNA, 24 nt, Human
auaaagacaaacuaaaacaaaaca

SEQ ID NO: 63349 - RNA, 32 nt, Human
auaaagacaacaaaagaaaucuccuaacaaaa

SEQ ID NO: 63350 - RNA, 32 nt, Human
auaaagacagaccacaccuaaaacugccuuuc

SEQ ID NO: 63351 - RNA, 32 nt, Human
auaaagacagaggcagagacugaagugaugcu

SEQ ID NO: 63352 - RNA, 32 nt, Human
auaaagaccacccuggccaacauggugaaacc

SEQ ID NO: 63353 - RNA, 32 nt, Human
auaaagacuagaaccacccccacucugcacuc

SEQ ID NO: 63354 - RNA, 32 nt, Human
auaaagacucccagaacuugugucacagggcu

SEQ ID NO: 63355 - RNA, 32 nt, Human
auaaagacugacacagaaaaucaggucagugu

SEQ ID NO: 63356 - RNA, 32 nt, Human
auaaagagacccagagagcuccaucaccccuu

SEQ ID NO: 63357 - RNA, 32 nt, Human
auaaagagacuccaagguugacuuuaguuugu

SEQ ID NO: 63358 - RNA, 32 nt, Human
auaaagagagauucauauaaagaauuauauuc

SEQ ID NO: 63359 - RNA, 32 nt, Human
auaaagagagcaggagaggagcugcagauuuc

SEQ ID NO: 63360 - RNA, 32 nt, Human
auaaagagagccaagcagaagaggaggcgaga

SEQ ID NO: 63361 - RNA, 32 nt, Human
auaaagagccggggcucagggggcuccacacc

SEQ ID NO: 63362 - RNA, 32 nt, Human
auaaagaggaaugacuuaauuaugagacugua

SEQ ID NO: 63363 - RNA, 32 nt, Human
auaaagaggagaaaggcuuaggaaguuuuucu

SEQ ID NO: 63364 - RNA, 32 nt, Human
auaaagaggcauucaugaaggcuuuuguugaa

SEQ ID NO: 63365 - RNA, 32 nt, Human
auaaagaucgauaucuacaugauggauauugu

SEQ ID NO: 63366 - RNA, 18 nt, Human
auaaagaugacuguaaga

SEQ ID NO: 63367 - RNA, 32 nt, Human
auaaagauggcagaagaaaagggaaagcaagu

SEQ ID NO: 63368 - RNA, 32 nt, Human
auaaagauuguuugacucuggagaggagaaag

SEQ ID NO: 63369 - RNA, 32 nt, Human
auaaagcaccucuucaccuugcucaccuucua

SEQ ID NO: 63370 - RNA, 32 nt, Human
auaaagcagaaauauauuacaguucauuccac

SEQ ID NO: 63371 - RNA, 32 nt, Human
auaaagcagauggggaaagacuucacacagaa

SEQ ID NO: 63372 - RNA, 32 nt, Human
auaaagcagcagcagcgcgaagauagcgagag

SEQ ID NO: 63373 - RNA, 32 nt, Human
auaaagcaggcagaaguuggaaugagcagacu

SEQ ID NO: 63374 - RNA, 32 nt, Human
auaaagcaucucuggggagggcuuaggacucu

SEQ ID NO: 63375 - RNA, 32 nt, Human
auaaagcauguucacccuuauagucuaagacu

SEQ ID NO: 63376 - RNA, 32 nt, Human
auaaagcauguuugguuuuccaaaagaacaua

SEQ ID NO: 63377 - RNA, 32 nt, Human
auaaagccaccugucaacaaacccccauuaug

SEQ ID NO: 63378 - RNA, 21 nt, Human
auaaagccagcucacaggauc

SEQ ID NO: 63379 - RNA, 32 nt, Human
auaaagccaguggaguacaggcugcaauauaa

SEQ ID NO: 63380 - RNA, 32 nt, Human
auaaagcccugccuucuacaacucagugucug

SEQ ID NO: 63381 - RNA, 32 nt, Human
auaaagccgccuggccuugucucugucaaaaa

SEQ ID NO: 63382 - RNA, 32 nt, Human
auaaagccuagagugauauguuuaucuauaaa

SEQ ID NO: 63383 - RNA, 32 nt, Human
auaaagcgagaugguaguucugccugguuugc

SEQ ID NO: 63384 - RNA, 32 nt, Human
auaaagcgggacaacacagaacuucccaguua

SEQ ID NO: 63385 - RNA, 20 nt, Human
auaaagcuggauacaguuug

SEQ ID NO: 63386 - RNA, 32 nt, Human
auaaaggaaaagagagaaaaaggcaaagcaag

SEQ ID NO: 63387 - RNA, 32 nt, Human
auaaaggaaacuggauauuuuuagcacgaugu

SEQ ID NO: 63388 - RNA, 32 nt, Human
auaaaggaaagagguuuaacugacucucaguu

SEQ ID NO: 63389 - RNA, 21 nt, Human
auaaaggaaauaugcacugcu

SEQ ID NO: 63390 - RNA, 32 nt, Human
auaaaggacaggccacaccacagcagagacca

SEQ ID NO: 63391 - RNA, 32 nt, Human
auaaaggacucaaggaccacagccucugccca

SEQ ID NO: 63392 - RNA, 32 nt, Human
auaaaggacucagcaaccagccagggacagau

SEQ ID NO: 63393 - RNA, 29 nt, Human
auaaaggagaaacugagguacccggaaaa

SEQ ID NO: 63394 - RNA, 32 nt, Human
auaaaggagaaggaggaggaggaagagagugu

SEQ ID NO: 63395 - RNA, 32 nt, Human
auaaaggagagggaaugugcaggaacagaggc

SEQ ID NO: 63396 - RNA, 32 nt, Human
auaaaggcaguacagacccaaaaagcgagcag

SEQ ID NO: 63397 - RNA, 24 nt, Human
auaaaggcauuuuggguuuuaaga

SEQ ID NO: 63398 - RNA, 32 nt, Human
auaaaggcccaagaugggaaggagauccaaac

SEQ ID NO: 63399 - RNA, 32 nt, Human
auaaagggaagaaaggaggcagcauggagaga

SEQ ID NO: 63400 - RNA, 32 nt, Human
auaaagggacuuuuagaacacaacccaaugca

SEQ ID NO: 63401 - RNA, 19 nt, Human
auaaagggagaagagggaa

SEQ ID NO: 63402 - RNA, 32 nt, Human
auaaagggauuucucggcugaagacgaggcug

SEQ ID NO: 63403 - RNA, 32 nt, Human
auaaagggccagaaaguaacuauuuuagguuu

SEQ ID NO: 63404 - RNA, 32 nt, Human
auaaaggggaagugaggagaauuucuuucaag

SEQ ID NO: 63405 - RNA, 32 nt, Human
auaaagguauuucuuccuuggugccuucaaaa

SEQ ID NO: 63406 - RNA, 32 nt, Human
auaaaguaaauguuaauugcuggagaagaacc

SEQ ID NO: 63407 - RNA, 32 nt, Human
auaaaguacguguuuacuuggugaggaggagg

SEQ ID NO: 63408 - RNA, 32 nt, Human
auaaaguagaggaaaacauaagauugaugaaa

SEQ ID NO: 63409 - RNA, 32 nt, Human
auaaaguagggagggaaggcgagaggaagcaa

SEQ ID NO: 63410 - RNA, 32 nt, Human
auaaaguauaaauauguuuauauucuguacau

SEQ ID NO: 63411 - RNA, 32 nt, Human
auaaaguaugagugaaaaagagacugaagguc

SEQ ID NO: 63412 - RNA, 32 nt, Human
auaaaguauuucagguuauccacacacuaauc

SEQ ID NO: 63413 - RNA, 32 nt, Human
auaaagucacccagcaggucaacaaugggccc

SEQ ID NO: 63414 - RNA, 32 nt, Human
auaaagucaccuaggugaggauaggcgcggga

SEQ ID NO: 63415 - RNA, 32 nt, Human
auaaagucccuccaauuaaaccaaacgcuggg

SEQ ID NO: 63416 - RNA, 32 nt, Human
auaaaguccuuucuagauccuaugugaaaaga

SEQ ID NO: 63417 - RNA, 32 nt, Human
auaaagugauuaguugaacuggcauccugcuu

SEQ ID NO: 63418 - RNA, 32 nt, Human
auaaagugggaaaugcucuuuggagaagacaa

SEQ ID NO: 63419 - RNA, 32 nt, Human
auaaaguuaagugucccucaggcagggagagg

SEQ ID NO: 63420 - RNA, 32 nt, Human
auaaaguucagugagguaggccagcuuuuaug

SEQ ID NO: 63421 - RNA, 32 nt, Human
auaaaguuguagauucuuauguguuuuuguau

SEQ ID NO: 63422 - RNA, 32 nt, Human
auaaaguuuuaaguuuucugcaaagaauccuu

SEQ ID NO: 63423 - RNA, 32 nt, Human
auaaauaaauacaaagcccauucuuccagagu

SEQ ID NO: 63424 - RNA, 32 nt, Human
auaaauaaaugauccuguaggcccacuaaucu

SEQ ID NO: 63425 - RNA, 32 nt, Human
auaaauaaccaccacacacgcgcagcccggag

SEQ ID NO: 63426 - RNA, 32 nt, Human
auaaauaacccugggcuguccagccuuaauag

SEQ ID NO: 63427 - RNA, 32 nt, Human
auaaauaaggaagaaagagggagacaguagcu

SEQ ID NO: 63428 - RNA, 32 nt, Human
auaaauacaagucccgaugcagucaaagccaa

SEQ ID NO: 63429 - RNA, 32 nt, Human
auaaauacaucucaucuaacacacacgacaaa

SEQ ID NO: 63430 - RNA, 32 nt, Human
auaaauaccauguagcaaguguacuuugugga

SEQ ID NO: 63431 - RNA, 32 nt, Human
auaaauagcaucaccauucuuugcuguggcac

SEQ ID NO: 63432 - RNA, 32 nt, Human
auaaauagcuauaaauucucucucacacacac

SEQ ID NO: 63433 - RNA, 32 nt, Human
auaaauauacagucuucccacuucacuaacca

SEQ ID NO: 63434 - RNA, 31 nt, Human
auaaauauauuucuucauugccaaagaggcu

SEQ ID NO: 63435 - RNA, 32 nt, Human
auaaauaucaguggauuuucucuguguauaug

SEQ ID NO: 63436 - RNA, 32 nt, Human
auaaauauguagauagucacauauacaccaga

SEQ ID NO: 63437 - RNA, 32 nt, Human
auaaauauuacaaacccuaagauagcuaauaa

SEQ ID NO: 63438 - RNA, 22 nt, Human
auaaauauucaugagauugccu

SEQ ID NO: 63439 - RNA, 32 nt, Human
auaaauauuuggaaugaaggggaauguacuag

SEQ ID NO: 63440 - RNA, 32 nt, Human
auaaauauuuggacaauuuugaauucugacaa

SEQ ID NO: 63441 - RNA, 32 nt, Human
auaaauauuuuauaucaggaaaguucauauuu

SEQ ID NO: 63442 - RNA, 31 nt, Human
auaaaucaacuguccaucaggugaggugugc

SEQ ID NO: 63443 - RNA, 32 nt, Human
auaaaucaagcucagucuggguuauggagaag

SEQ ID NO: 63444 - RNA, 32 nt, Human
auaaaucaaggcugcaaugcagcuggugcugu

SEQ ID NO: 63445 - RNA, 32 nt, Human
auaaaucaaucuuauuacugagagugcaaauu

SEQ ID NO: 63446 - RNA, 31 nt, Human
auaaaucacagcuggaaaacugagccggcaa

SEQ ID NO: 63447 - RNA, 29 nt, Human
auaaaucaccucuuccgcuguuuuagcug

SEQ ID NO: 63448 - RNA, 31 nt, Human
auaaaucaccucuuccgcuguuuuagcugaa

SEQ ID NO: 63449 - RNA, 32 nt, Human
auaaaucaccucuuccgcuguuuuagcugaag

SEQ ID NO: 63450 - RNA, 32 nt, Human
auaaaucaugugaaaaggaagagauacaaauu

SEQ ID NO: 63451 - RNA, 32 nt, Human
auaaaucauuugcuccugucuuuugcuuuaau

SEQ ID NO: 63452 - RNA, 32 nt, Human
auaaauccacagaaccggaugagcugcuuagg

SEQ ID NO: 63453 - RNA, 32 nt, Human
auaaauccaguaaagaaaguguaguaaauucu

SEQ ID NO: 63454 - RNA, 32 nt, Human
auaaauccaguauggugguuauagauguaaaa

SEQ ID NO: 63455 - RNA, 32 nt, Human
auaaaucgauacugcuggccaaucagugucau

SEQ ID NO: 63456 - RNA, 32 nt, Human
auaaaucuacaaagggaagccuuacuacaauu

SEQ ID NO: 63457 - RNA, 32 nt, Human
auaaaucuacagcuagacccuuagucaauagu

SEQ ID NO: 63458 - RNA, 32 nt, Human
auaaaucuccaucaucugucuuaaaguuuuau

SEQ ID NO: 63459 - RNA, 32 nt, Human
auaaaucucucuuuacccaucggcucucccua

SEQ ID NO: 63460 - RNA, 32 nt, Human
auaaaucugaaggucauguggcaucagggaaa

SEQ ID NO: 63461 - RNA, 32 nt, Human
auaaaucuggcuuacaugcacguccagucaua

SEQ ID NO: 63462 - RNA, 32 nt, Human
auaaaucuggcuuacgugcacguccagucaua

SEQ ID NO: 63463 - RNA, 32 nt, Human
auaaaugaaaagauaagggauuuggaagccac

SEQ ID NO: 63464 - RNA, 32 nt, Human
auaaaugaacaacauaaaaacuuuuguuuuga

SEQ ID NO: 63465 - RNA, 32 nt, Human
auaaaugaacuagggaaggauguaauaaauua

SEQ ID NO: 63466 - RNA, 32 nt, Human
auaaaugaagaaaagacacagagaaggaugug

SEQ ID NO: 63467 - RNA, 32 nt, Human
auaaaugagaauauguaugcacugcagagaau

SEQ ID NO: 63468 - RNA, 32 nt, Human
auaaaugagagguuuggcuucaucucaguuua

SEQ ID NO: 63469 - RNA, 32 nt, Human
auaaaugaggccgggcgcaguggugccuguaa

SEQ ID NO: 63470 - RNA, 29 nt, Human
auaaaugauuccuauuucucucagucuaa

SEQ ID NO: 63471 - RNA, 32 nt, Human
auaaaugcaaauggcuaccguuuuacaauaaa

SEQ ID NO: 63472 - RNA, 32 nt, Human
auaaaugcaaaugugcauuuuucugacgagug

SEQ ID NO: 63473 - RNA, 32 nt, Human
auaaaugcaaaugugcuuacaucuuuuggccc

SEQ ID NO: 63474 - RNA, 32 nt, Human
auaaaugcaacagucuccaccuaacaaaggca

SEQ ID NO: 63475 - RNA, 32 nt, Human
auaaaugcucuggcagugucuccauguaacua

SEQ ID NO: 63476 - RNA, 32 nt, Human
auaaaugcugacagauuuccaagaacuaccaa

SEQ ID NO: 63477 - RNA, 32 nt, Human
auaaaugcuuauaggcugggccagguggcucc

SEQ ID NO: 63478 - RNA, 32 nt, Human
auaaaugcuuguuuuaggaaagugaaucuguu

SEQ ID NO: 63479 - RNA, 32 nt, Human
auaaauggaaacaccacugcuaggggagagcu

SEQ ID NO: 63480 - RNA, 32 nt, Human
auaaauggaggugagaagauauagcugagauu

SEQ ID NO: 63481 - RNA, 32 nt, Human
auaaauggauucacucaggggagggguauuca

SEQ ID NO: 63482 - RNA, 32 nt, Human
auaaauggcaaaaacucuuucucagacuuaca

SEQ ID NO: 63483 - RNA, 31 nt, Human
auaaauggcacugccacagccaacaugccca

SEQ ID NO: 63484 - RNA, 32 nt, Human
auaaauggcauaacugauuacaggguacaguu

SEQ ID NO: 63485 - RNA, 29 nt, Human
auaaauggcuuacuaucaucaccccuggc

SEQ ID NO: 63486 - RNA, 32 nt, Human
auaaauggguccagggcugaucaaagaacucu

SEQ ID NO: 63487 - RNA, 32 nt, Human
auaaauggugcugaagcaggacccgaagccua

SEQ ID NO: 63488 - RNA, 32 nt, Human
auaaaugguguucacagcugccauauaaaguu

SEQ ID NO: 63489 - RNA, 32 nt, Human
auaaaugucagcauuggccucuguguacaaac

SEQ ID NO: 63490 - RNA, 32 nt, Human
auaaaugucuguaugcccuggaagaggggaua

SEQ ID NO: 63491 - RNA, 32 nt, Human
auaaaugugcaggauagcagaccugggugugg

SEQ ID NO: 63492 - RNA, 32 nt, Human
auaaaugugcuaaguuauuugagacuuccuca

SEQ ID NO: 63493 - RNA, 32 nt, Human
auaaaugugguguuuggccugccucagcagca

SEQ ID NO: 63494 - RNA, 32 nt, Human
auaaauguguaaugaacaaagauauguuguau

SEQ ID NO: 63495 - RNA, 32 nt, Human
auaaauguuaucuuuguacuagauagcaaccc

SEQ ID NO: 63496 - RNA, 32 nt, Human
auaaauguugauuuccuuucugcggcuccacu

SEQ ID NO: 63497 - RNA, 31 nt, Human
auaaauguuucugagcugccuguguucuccc

SEQ ID NO: 63498 - RNA, 32 nt, Human
auaaauguuuuuaaguauaaauccuacuagag

SEQ ID NO: 63499 - RNA, 32 nt, Human
auaaauuaagggacaauggggcugacagcacu

SEQ ID NO: 63500 - RNA, 32 nt, Human
auaaauuaaugagacaaagugaaaaagaaauu

SEQ ID NO: 63501 - RNA, 32 nt, Human
auaaauuaaugagacaaagugaagaagaaauu

SEQ ID NO: 63502 - RNA, 32 nt, Human
auaaauuaucuucucucuuuguauugggaacc

SEQ ID NO: 63503 - RNA, 32 nt, Human
auaaauuauucaacugacggugcaaaaacauu

SEQ ID NO: 63504 - RNA, 32 nt, Human
auaaauuauucauguaaaaguauuucaaguag

SEQ ID NO: 63505 - RNA, 32 nt, Human
auaaauucaaaaccugcaguuaacaggauauu

SEQ ID NO: 63506 - RNA, 32 nt, Human
auaaauucaagcacuaccacuggucaguuuug

SEQ ID NO: 63507 - RNA, 32 nt, Human
auaaauucacuugucaccucagugcuuuacag

SEQ ID NO: 63508 - RNA, 32 nt, Human
auaaauucagaagggaggagauguguguacag

SEQ ID NO: 63509 - RNA, 32 nt, Human
auaaauucauauaggaaugcauaggucaucug

SEQ ID NO: 63510 - RNA, 32 nt, Human
auaaauucaucaauuaauauuuugccacuuug

SEQ ID NO: 63511 - RNA, 32 nt, Human
auaaauugaaagauggagucuaaaaauuauua

SEQ ID NO: 63512 - RNA, 25 nt, Human
auaaauugaacucccugcacugcug

SEQ ID NO: 63513 - RNA, 32 nt, Human
auaaauugacuuggguugcaagcacugagcac

SEQ ID NO: 63514 - RNA, 32 nt, Human
auaaauugagaaggaauuuucucucuauaagu

SEQ ID NO: 63515 - RNA, 32 nt, Human
auaaauugcccagccucagguauucuuuauag

SEQ ID NO: 63516 - RNA, 32 nt, Human
auaaauugguccuucccuaccuugccagcuuc

SEQ ID NO: 63517 - RNA, 32 nt, Human
auaaauuuacucuguugaauauuuagcauaaa

SEQ ID NO: 63518 - RNA, 32 nt, Human
auaaauuucaaacuuuugaauauuuacccuac

SEQ ID NO: 63519 - RNA, 32 nt, Human
auaaauuucccaagcguuucuuuccaccugga

SEQ ID NO: 63520 - RNA, 32 nt, Human
auaaauuucccaaguauuugaaauuuguuuug

SEQ ID NO: 63521 - RNA, 32 nt, Human
auaaauuugagagucugugacccacuuaccuu

SEQ ID NO: 63522 - RNA, 32 nt, Human
auaaauuugcuuuuugagauguugagaggaac

SEQ ID NO: 63523 - RNA, 32 nt, Human
auaaauuuucuacaaaauuaacuuuuuauauu

SEQ ID NO: 63524 - RNA, 32 nt, Human
auaaauuuuguagcugguacacucuggccugg

SEQ ID NO: 63525 - RNA, 32 nt, Human
auaacaaacaauaucaaugcuuuaaucaagga

SEQ ID NO: 63526 - RNA, 32 nt, Human
auaacaaaguaugacaaguuaaguuuaaauaa

SEQ ID NO: 63527 - RNA, 32 nt, Human
auaacaaaugugaacagaagccagcagagaau

SEQ ID NO: 63528 - RNA, 32 nt, Human
auaacaacacagaaauaacaagggcagacuuu

SEQ ID NO: 63529 - RNA, 32 nt, Human
auaacaacugcacuccagccuggaugacagaa

SEQ ID NO: 63530 - RNA, 32 nt, Human
auaacaagagugaggaggagccagagauaguu

SEQ ID NO: 63531 - RNA, 32 nt, Human
auaacaagggucagauuuccucuccugccuua

SEQ ID NO: 63532 - RNA, 32 nt, Human
auaacaagugacaaggcagaauucuuuaaauc

SEQ ID NO: 63533 - RNA, 32 nt, Human
auaacaauaagaaacuuagggaagcaggcugu

SEQ ID NO: 63534 - RNA, 32 nt, Human
auaacaauuaagagacggcagggccuucaggc

SEQ ID NO: 63535 - RNA, 32 nt, Human
auaacacauaaauauauaauaugucaacuggc

SEQ ID NO: 63536 - RNA, 32 nt, Human
auaacaccaccaucaucaaagagcugcucaag

SEQ ID NO: 63537 - RNA, 32 nt, Human
auaacaccagagaaagcuggcaacuuuaugug

SEQ ID NO: 63538 - RNA, 32 nt, Human
auaacacuacugcauuccagccugggugacag

SEQ ID NO: 63539 - RNA, 32 nt, Human
auaacacugcacuccaggcuggacaacacagc

SEQ ID NO: 63540 - RNA, 32 nt, Human
auaacacuguguuugcaaauggagauucaggu

SEQ ID NO: 63541 - RNA, 32 nt, Human
auaacacuguuugugguaggaaaggaaaacau

SEQ ID NO: 63542 - RNA, 32 nt, Human
auaacacuuccuaucuugucacugagcugaac

SEQ ID NO: 63543 - RNA, 32 nt, Human
auaacacuuccugacaucuccuuuggaaaaga

SEQ ID NO: 63544 - RNA, 32 nt, Human
auaacacuuuggcuuuuucuccauucacgcug

SEQ ID NO: 63545 - RNA, 32 nt, Human
auaacacuuuguuugcuggauaccaaguagac

SEQ ID NO: 63546 - RNA, 32 nt, Human
auaacagaauaccacagacuggguaacgugau

SEQ ID NO: 63547 - RNA, 32 nt, Human
auaacagaugacugucaagugaaugagcuguu

SEQ ID NO: 63548 - RNA, 32 nt, Human
auaacagcaguggaauauguauuugccuauau

SEQ ID NO: 63549 - RNA, 32 nt, Human
auaacagcaguuagaaaagcagacucccugug

SEQ ID NO: 63550 - RNA, 32 nt, Human
auaacagccugagacagaggucccaggagauc

SEQ ID NO: 63551 - RNA, 32 nt, Human
auaacagccugagguuccaauucuuuaucaug

SEQ ID NO: 63552 - RNA, 32 nt, Human
auaacagcucacugcagucuugaacuccuggg

SEQ ID NO: 63553 - RNA, 32 nt, Human
auaacaggauacagaauuaacaagagaaaaug

SEQ ID NO: 63554 - RNA, 32 nt, Human
auaacaggaucuccuuugggcucuugagguug

SEQ ID NO: 63555 - RNA, 32 nt, Human
auaacaggcaugagccacugugcccagccaga

SEQ ID NO: 63556 - RNA, 32 nt, Human
auaacagggaggcagaauucagguuggcuuga

SEQ ID NO: 63557 - RNA, 32 nt, Human
auaacaggggcuucuaauuaaauuuaggggau

SEQ ID NO: 63558 - RNA, 32 nt, Human
auaacaggguuccugagcucacugaaaagacu

SEQ ID NO: 63559 - RNA, 32 nt, Human
auaacaggucauugccgagaaaaggauagcac

SEQ ID NO: 63560 - RNA, 32 nt, Human
auaacagguugagaaagagggaguuagcauca

SEQ ID NO: 63561 - RNA, 32 nt, Human
auaacaguauugugcuuuuuguggggaaagug

SEQ ID NO: 63562 - RNA, 32 nt, Human
auaacagugggugggaaagguagaggccugug

SEQ ID NO: 63563 - RNA, 32 nt, Human
auaacaguuccuucaaaauuggccuaggaaau

SEQ ID NO: 63564 - RNA, 32 nt, Human
auaacaguuuagaagccaagguuguggauuug

SEQ ID NO: 63565 - RNA, 32 nt, Human
auaacauaggugcucuuccucaucucaucucc

SEQ ID NO: 63566 - RNA, 32 nt, Human
auaacauauagucaagaaaacagacuuaaaaa

SEQ ID NO: 63567 - RNA, 32 nt, Human
auaacauccaucguggcucugccuucaaaggg

SEQ ID NO: 63568 - RNA, 32 nt, Human
auaacauccauguacacauucuuuguugauuu

SEQ ID NO: 63569 - RNA, 32 nt, Human
auaacauccuggaggcagaagcgcagaggcug

SEQ ID NO: 63570 - RNA, 32 nt, Human
auaacaugagcaguacaaaagaaaaauaaauc

SEQ ID NO: 63571 - RNA, 32 nt, Human
auaacaugaguaagaugaacuggaacacaaaa

SEQ ID NO: 63572 - RNA, 32 nt, Human
auaacaugcccacccuuccuccuuuagaaacu

SEQ ID NO: 63573 - RNA, 32 nt, Human
auaacauggacugcucaguggccagguuauca

SEQ ID NO: 63574 - RNA, 32 nt, Human
auaacauucaaaggagcucacauuuauggaau

SEQ ID NO: 63575 - RNA, 32 nt, Human
auaacauugucaaguggaaacaugcugaaauc

SEQ ID NO: 63576 - RNA, 32 nt, Human
auaacauuuaauuauaaugacauucugauuau

SEQ ID NO: 63577 - RNA, 32 nt, Human
auaacauuuacauugucaaccuuuauugacuu

SEQ ID NO: 63578 - RNA, 32 nt, Human
auaacauuuacggacucauccccagcugcacu

SEQ ID NO: 63579 - RNA, 31 nt, Human
auaaccaacauauuuauacauuuagaaucau

SEQ ID NO: 63580 - RNA, 32 nt, Human
auaaccaagaaugucuccauuguuaaaugucc

SEQ ID NO: 63581 - RNA, 32 nt, Human
auaaccaagagccuucucucuuccuguugaca

SEQ ID NO: 63582 - RNA, 32 nt, Human
auaaccaagcaagcucagcucugugggggccu

SEQ ID NO: 63583 - RNA, 32 nt, Human
auaaccaagcuuuacucccauuuggaauauag

SEQ ID NO: 63584 - RNA, 32 nt, Human
auaaccaauaaacaguaaccuccaucaaaugc

SEQ ID NO: 63585 - RNA, 32 nt, Human
auaaccaaucuacaaucucccuucacaaguuu

SEQ ID NO: 63586 - RNA, 22 nt, Human
auaaccaauugucaguucucca

SEQ ID NO: 63587 - RNA, 32 nt, Human
auaaccacaagccaccacccauuugacauccu

SEQ ID NO: 63588 - RNA, 32 nt, Human
auaaccacugcacuccaaccugggcaacaugg

SEQ ID NO: 63589 - RNA, 32 nt, Human
auaaccagagagugauuucauuuacacucaua

SEQ ID NO: 63590 - RNA, 32 nt, Human
auaaccagggcuacccagaaaaagugacuuga

SEQ ID NO: 63591 - RNA, 32 nt, Human
auaaccaugaaugacugaauaguuuaguccag

SEQ ID NO: 63592 - RNA, 32 nt, Human
auaaccaugagccuugcggcacggugagcuca

SEQ ID NO: 63593 - RNA, 25 nt, Human
auaaccaugucacgugagcauguca

SEQ ID NO: 63594 - RNA, 22 nt, Human
auaacccaccuucugccccacu

SEQ ID NO: 63595 - RNA, 32 nt, Human
auaacccaugagaacacacaugugcacagaaa

SEQ ID NO: 63596 - RNA, 32 nt, Human
auaaccccaccuccccaccccaaaaagggcaa

SEQ ID NO: 63597 - RNA, 32 nt, Human
auaaccccagaacauuccacugugacucugca

SEQ ID NO: 63598 - RNA, 32 nt, Human
auaaccccuuucuccccuuuggaccaucugcc

SEQ ID NO: 63599 - RNA, 32 nt, Human
auaaccccuuucugcuguucucccaugaucca

SEQ ID NO: 63600 - RNA, 31 nt, Human
auaacccgaauguccaucagaaggggacugc

SEQ ID NO: 63601 - RNA, 32 nt, Human
auaacccucccagcuagucuacuccagggcag

SEQ ID NO: 63602 - RNA, 32 nt, Human
auaacccuggugucaucaucucccaggaucca

SEQ ID NO: 63603 - RNA, 32 nt, Human
auaacccuuucaaauuucuccuggggccucca

SEQ ID NO: 63604 - RNA, 32 nt, Human
auaaccggaggcaggcugggugcaguggcuca

SEQ ID NO: 63605 - RNA, 32 nt, Human
auaaccgggcuaggaaccugaccgggcuggac

SEQ ID NO: 63606 - RNA, 32 nt, Human
auaaccuaaaccuacuccaaugcuaaacuaau

SEQ ID NO: 63607 - RNA, 32 nt, Human
auaaccucacccaggccuuacaacaguccccc

SEQ ID NO: 63608 - RNA, 32 nt, Human
auaaccucauacaaccuucugucccaucuccu

SEQ ID NO: 63609 - RNA, 32 nt, Human
auaaccucucaucaggauucuggguuuggaac

SEQ ID NO: 63610 - RNA, 32 nt, Human
auaaccugacaggaacaugcuacugaaguuua

SEQ ID NO: 63611 - RNA, 32 nt, Human
auaaccugucauucacauauugagugccuacu

SEQ ID NO: 63612 - RNA, 32 nt, Human
auaaccuuaaugaccaauugcuuucaauucuu

SEQ ID NO: 63613 - RNA, 32 nt, Human
auaaccuuaggcugcaacuguacauaggguua

SEQ ID NO: 63614 - RNA, 32 nt, Human
auaaccuuaguauuuucccaaccaauagaaac

SEQ ID NO: 63615 - RNA, 32 nt, Human
auaaccuuccccucagcuaauuugaaagccuc

SEQ ID NO: 63616 - RNA, 32 nt, Human
auaaccuuuuaagagaggucauucuuuugaaa

SEQ ID NO: 63617 - RNA, 32 nt, Human
auaacgacugcacuccagccuggaugacagaa

SEQ ID NO: 63618 - RNA, 32 nt, Human
auaacgagaagaauucagaaaaccacuuaagc

SEQ ID NO: 63619 - RNA, 32 nt, Human
auaacgauuguguaaagaaacagcuucuucau

SEQ ID NO: 63620 - RNA, 32 nt, Human
auaacgcagccacugaggaagagugguuuucc

SEQ ID NO: 63621 - RNA, 32 nt, Human
auaacgccugggagaagagggcuggaguucua

SEQ ID NO: 63622 - RNA, 32 nt, Human
auaacggaagugaggaagggugagaguuaucu

SEQ ID NO: 63623 - RNA, 32 nt, Human
auaacggaguuuugcucuuauugcccaggcgc

SEQ ID NO: 63624 - RNA, 32 nt, Human
auaacguguuaaauaaaugucauugucauaga

SEQ ID NO: 63625 - RNA, 32 nt, Human
auaacuaaagaaugugucagggaagaaagacu

SEQ ID NO: 63626 - RNA, 32 nt, Human
auaacuaacaugcugcucuauuuucugggugu

SEQ ID NO: 63627 - RNA, 32 nt, Human
auaacuaaccgaugaugaggccgagguaaaag

SEQ ID NO: 63628 - RNA, 32 nt, Human
auaacuaacuauucaauuauuuccauuauuaa

SEQ ID NO: 63629 - RNA, 32 nt, Human
auaacuaauucuuuugcuuaagggccuauggc

SEQ ID NO: 63630 - RNA, 32 nt, Human
auaacuacuacauuuuaaccuacuucuguuug

SEQ ID NO: 63631 - RNA, 32 nt, Human
auaacuacuaguagaaauauaacuacuacccu

SEQ ID NO: 63632 - RNA, 32 nt, Human
auaacuacugauuuaggaaaauuggaugcaga

SEQ ID NO: 63633 - RNA, 32 nt, Human
auaacuagacauauaucagaaacuuuaaaaug

SEQ ID NO: 63634 - RNA, 32 nt, Human
auaacuagcacuaguuuggccuuaugaccugg

SEQ ID NO: 63635 - RNA, 32 nt, Human
auaacuagguugaguuuuucuccucugcugag

SEQ ID NO: 63636 - RNA, 32 nt, Human
auaacucaccuucucuauccuugcucaaaaug

SEQ ID NO: 63637 - RNA, 32 nt, Human
auaacucacugcagccucaaacuucuggccuc

SEQ ID NO: 63638 - RNA, 32 nt, Human
auaacucagauggcgagaaggcagcauuaucu

SEQ ID NO: 63639 - RNA, 32 nt, Human
auaacucagcuuucaacagccauacauccaaa

SEQ ID NO: 63640 - RNA, 32 nt, Human
auaacucauguggacuuaugccagucuagagg

SEQ ID NO: 63641 - RNA, 32 nt, Human
auaacuccaggccacacuuuugaagaccagac

SEQ ID NO: 63642 - RNA, 32 nt, Human
auaacuccaguuuggcaguuugcauauuauaa

SEQ ID NO: 63643 - RNA, 29 nt, Human
auaacucuagcuguaucauccucucaccu

SEQ ID NO: 63644 - RNA, 32 nt, Human
auaacucucacccuucugacugccuuccaucc

SEQ ID NO: 63645 - RNA, 32 nt, Human
auaacucugcaaaggccugggcuggccuggca

SEQ ID NO: 63646 - RNA, 32 nt, Human
auaacucuuaaagaaaaugucauuuuagacaa

SEQ ID NO: 63647 - RNA, 19 nt, Human
auaacucuuuguuauugga

SEQ ID NO: 63648 - RNA, 24 nt, Human
auaacucuuuguugaacuagagua

SEQ ID NO: 63649 - RNA, 32 nt, Human
auaacugaaaggaaugaagaccgccaacaaga

SEQ ID NO: 63650 - RNA, 32 nt, Human
auaacugaaauacuuuacuuuuucucauaucc

SEQ ID NO: 63651 - RNA, 31 nt, Human
auaacugaagcuuuauaccuguugaacaacu

SEQ ID NO: 63652 - RNA, 32 nt, Human
auaacugaucauagaagaagaauccaguaauu

SEQ ID NO: 63653 - RNA, 32 nt, Human
auaacugauuauuacuucuguuucucuuuugg

SEQ ID NO: 63654 - RNA, 32 nt, Human
auaacugauuuccuuuuuaguccucuacugcu

SEQ ID NO: 63655 - RNA, 32 nt, Human
auaacugcaagaacuacuugacugagcuguug

SEQ ID NO: 63656 - RNA, 32 nt, Human
auaacugccagugcccuuucacagcugauuau

SEQ ID NO: 63657 - RNA, 32 nt, Human
auaacugcccaucucagcuguagguggaauuu

SEQ ID NO: 63658 - RNA, 32 nt, Human
auaacugcuuccugccuccuuccaaacugacu

SEQ ID NO: 63659 - RNA, 32 nt, Human
auaacugcuuucuaacacuaaauguggccaac

SEQ ID NO: 63660 - RNA, 32 nt, Human
auaacuggaacacaugacucugggucuguaga

SEQ ID NO: 63661 - RNA, 32 nt, Human
auaacuggggcagaaaguguguaagugaagua

SEQ ID NO: 63662 - RNA, 32 nt, Human
auaacuggggcuccugugucagguguguuuac

SEQ ID NO: 63663 - RNA, 32 nt, Human
auaacuggggguggggugaggguaggaggcau

SEQ ID NO: 63664 - RNA, 32 nt, Human
auaacugggugugguaguuuaagccuauaauc

SEQ ID NO: 63665 - RNA, 32 nt, Human
auaacugguaaaacugaccaacuuuuacuucu

SEQ ID NO: 63666 - RNA, 32 nt, Human
auaacugguuccuggaggugugcagugccccc

SEQ ID NO: 63667 - RNA, 32 nt, Human
auaacuguaacauauacauacauaagcacagg

SEQ ID NO: 63668 - RNA, 32 nt, Human
auaacugugguguuacucugucauuuauaugg

SEQ ID NO: 63669 - RNA, 32 nt, Human
auaacuguuccgcugccuucuugucugugcua

SEQ ID NO: 63670 - RNA, 23 nt, Human
auaacuuaacaauuuugcagaga

SEQ ID NO: 63671 - RNA, 32 nt, Human
auaacuuaccugaagggguuuucuugauaauu

SEQ ID NO: 63672 - RNA, 32 nt, Human
auaacuucacagucauccagucccaacaccug

SEQ ID NO: 63673 - RNA, 32 nt, Human
auaacuuccaaacaugcaaaguagaaggggcc

SEQ ID NO: 63674 - RNA, 32 nt, Human
auaacuuccaggacaaugcagauugauguuga

SEQ ID NO: 63675 - RNA, 32 nt, Human
auaacuuccaucucccuuacuggcuuguaggc

SEQ ID NO: 63676 - RNA, 32 nt, Human
auaacuuccccaagucacacagugguaucaga

SEQ ID NO: 63677 - RNA, 32 nt, Human
auaacuuccugaucuuggauuuuauagcuggg

SEQ ID NO: 63678 - RNA, 20 nt, Human
auaacuugaaaaagaacugu

SEQ ID NO: 63679 - RNA, 22 nt, Human
auaacuugauauagaaagcugu

SEQ ID NO: 63680 - RNA, 32 nt, Human
auaacuugcauuucuaacaaguucccagguga

SEQ ID NO: 63681 - RNA, 32 nt, Human
auaacuuguaccauuuuaaauggagaucauaa

SEQ ID NO: 63682 - RNA, 32 nt, Human
auaacuuguaucuucugcuuaacuccuuuaua

SEQ ID NO: 63683 - RNA, 32 nt, Human
auaacuugucuauuuuucugccuaugugugcu

SEQ ID NO: 63684 - RNA, 24 nt, Human
auaacuuguuuguaaaagagcugu

SEQ ID NO: 63685 - RNA, 24 nt, Human
auaacuuuagaaaugauucuaaua

SEQ ID NO: 63686 - RNA, 32 nt, Human
auaacuuuauagacgaaaagaccuaccuggcg

SEQ ID NO: 63687 - RNA, 32 nt, Human
auaacuuuuccuuuguguauugcaaugauaau

SEQ ID NO: 63688 - RNA, 32 nt, Human
auaacuuuuuccucucgauucccauccccaau

SEQ ID NO: 63689 - RNA, 32 nt, Human
auaagaaaacuuugcuuucuucaguuaucaca

SEQ ID NO: 63690 - RNA, 32 nt, Human
auaagaaaauaacaaagcccuuauucucuuuu

SEQ ID NO: 63691 - RNA, 32 nt, Human
auaagaaaauuagcuuggcaugguggcacgug

SEQ ID NO: 63692 - RNA, 32 nt, Human
auaagaaacucagccuguggccuuucuuccaa

SEQ ID NO: 63693 - RNA, 32 nt, Human
auaagaaacucagccuguggccuuucuuucuu

SEQ ID NO: 63694 - RNA, 32 nt, Human
auaagaaagaccugcauauggaaagggugauc

SEQ ID NO: 63695 - RNA, 32 nt, Human
auaagaaagagagagaaggaaaggagagaagg

SEQ ID NO: 63696 - RNA, 32 nt, Human
auaagaaagccagacuuuggaaaaggauaauu

SEQ ID NO: 63697 - RNA, 22 nt, Human
auaagaaaguggccauuucuca

SEQ ID NO: 63698 - RNA, 32 nt, Human
auaagaaauguucucgacagcaaguugaaagc

SEQ ID NO: 63699 - RNA, 32 nt, Human
auaagaaauuggacacacauugcccuguuuga

SEQ ID NO: 63700 - RNA, 32 nt, Human
auaagaacagagaaggaggagggggaaaggag

SEQ ID NO: 63701 - RNA, 32 nt, Human
auaagaacccaggguggagagggagacuccug

SEQ ID NO: 63702 - RNA, 32 nt, Human
auaagaacugcggauucugccugggcacacac

SEQ ID NO: 63703 - RNA, 32 nt, Human
auaagaacuggcugcugaacugucuuuaguca

SEQ ID NO: 63704 - RNA, 32 nt, Human
auaagaagaccccacuucaacuuccccucgaa

SEQ ID NO: 63705 - RNA, 32 nt, Human
auaagaagcccccgaggugguggagaaggucu

SEQ ID NO: 63706 - RNA, 32 nt, Human
auaagaaggcaagagacaaggugcuucaaaua

SEQ ID NO: 63707 - RNA, 32 nt, Human
auaagaagggcuuguggaauuugcauuuggcu

SEQ ID NO: 63708 - RNA, 32 nt, Human
auaagaaggggauggaaugggggaagaggagg

SEQ ID NO: 63709 - RNA, 32 nt, Human
auaagaauggcacuuuaccucugugguccucc

SEQ ID NO: 63710 - RNA, 32 nt, Human
auaagaauucuuuauuugcacccucccuccga

SEQ ID NO: 63711 - RNA, 32 nt, Human
auaagacaaggaugaaaucauacauggaaaau

SEQ ID NO: 63712 - RNA, 32 nt, Human
auaagacagagaaaaucacuuauuucucuaag

SEQ ID NO: 63713 - RNA, 32 nt, Human
auaagacagugaucauuaggaugaagaggaag

SEQ ID NO: 63714 - RNA, 32 nt, Human
auaagacaugcuguuugaugggcugggcuggg

SEQ ID NO: 63715 - RNA, 32 nt, Human
auaagacauggcuuuucccuuuccaccaugau

SEQ ID NO: 63716 - RNA, 31 nt, Human
auaagacauuuucucccuuuuaaagaucauc

SEQ ID NO: 63717 - RNA, 32 nt, Human
auaagaccaaaaaucgaaguguguaagauccu

SEQ ID NO: 63718 - RNA, 32 nt, Human
auaagaccugcagggcuccucauuacuguucc

SEQ ID NO: 63719 - RNA, 32 nt, Human
auaagaccugcucucuuccugaagaccuauaa

SEQ ID NO: 63720 - RNA, 32 nt, Human
auaagaccuuaaggcugggugcaguggcucac

SEQ ID NO: 63721 - RNA, 32 nt, Human
auaagacuuugaugcagaacugaacaagauau

SEQ ID NO: 63722 - RNA, 32 nt, Human
auaagagaaaguuguucuaauugugcugaaac

SEQ ID NO: 63723 - RNA, 32 nt, Human
auaagagaacuggccaaggugcccggcuuggu

SEQ ID NO: 63724 - RNA, 32 nt, Human
auaagagaagccuguuuaaagagcagaugcca

SEQ ID NO: 63725 - RNA, 32 nt, Human
auaagagaccgagagaaguaagcugggucuug

SEQ ID NO: 63726 - RNA, 32 nt, Human
auaagagacucagaaagccucaaugaaaugga

SEQ ID NO: 63727 - RNA, 32 nt, Human
auaagagacugcccugcuugguguuuugcagg

SEQ ID NO: 63728 - RNA, 32 nt, Human
auaagagagagaguaagagggagagagaagaa

SEQ ID NO: 63729 - RNA, 32 nt, Human
auaagagagaucugugcagcugcgccucaggg

SEQ ID NO: 63730 - RNA, 32 nt, Human
auaagagcaagaaaucuacagcugguguaaaa

SEQ ID NO: 63731 - RNA, 32 nt, Human
auaagagcaguggcaucacauuuguuguuguu

SEQ ID NO: 63732 - RNA, 32 nt, Human
auaagagggaggcaggaggguuagagugagua

SEQ ID NO: 63733 - RNA, 32 nt, Human
auaagagggggaaacaaagaaguaaucauucc

SEQ ID NO: 63734 - RNA, 32 nt, Human
auaagaguauucauacuggagagaaacccuac

SEQ ID NO: 63735 - RNA, 32 nt, Human
auaagagucuuuguggaaguggugaaaaguac

SEQ ID NO: 63736 - RNA, 32 nt, Human
auaagaguucucuuugauuugcacuagcacua

SEQ ID NO: 63737 - RNA, 32 nt, Human
auaagauacuuaaaagucaucuuugaaugaua

SEQ ID NO: 63738 - RNA, 32 nt, Human
auaagauauaaauauuaaaacauuuuauacuu

SEQ ID NO: 63739 - RNA, 32 nt, Human
auaagauauccuaaaaucacgcuggaaccuug

SEQ ID NO: 63740 - RNA, 32 nt, Human
auaagauauuucugaaguguauacuuggucaa

SEQ ID NO: 63741 - RNA, 31 nt, Human
auaagaucaauaaauacuuguggaaugcaaa

SEQ ID NO: 63742 - RNA, 32 nt, Human
auaagaucagguacugugucagcauugauuuc

SEQ ID NO: 63743 - RNA, 32 nt, Human
auaagauccacccacaccuaagucacagaauu

SEQ ID NO: 63744 - RNA, 18 nt, Human
auaagaugcugcugagca

SEQ ID NO: 63745 - RNA, 32 nt, Human
auaagauggcgcuuugaaggggagccgaggcc

SEQ ID NO: 63746 - RNA, 32 nt, Human
auaagaugguuuuugcaaggggaccagguucu

SEQ ID NO: 63747 - RNA, 32 nt, Human
auaagauucaaacuuugagugacauuuagucc

SEQ ID NO: 63748 - RNA, 32 nt, Human
auaagauugugaaggguuuacugcuccuucca

SEQ ID NO: 63749 - RNA, 32 nt, Human
auaagcaaaacaaagcaugucuuugaguaaca

SEQ ID NO: 63750 - RNA, 32 nt, Human
auaagcaagaaaguggguucucaccagccauc

SEQ ID NO: 63751 - RNA, 32 nt, Human
auaagcaagagccacugcucccagcucauggu

SEQ ID NO: 63752 - RNA, 32 nt, Human
auaagcaagcccagauaaaaacaaauagcaga

SEQ ID NO: 63753 - RNA, 32 nt, Human
auaagcaccaauaucaacuucauguggauuuu

SEQ ID NO: 63754 - RNA, 32 nt, Human
auaagcacuuggcuccuuuaauagcuguccgu

SEQ ID NO: 63755 - RNA, 32 nt, Human
auaagcagacuugcacaauucaagccuguauu

SEQ ID NO: 63756 - RNA, 32 nt, Human
auaagcagaguuaagaggccaggacaaaagaa

SEQ ID NO: 63757 - RNA, 32 nt, Human
auaagcagcaaggggacaaaucaccaaagaac

SEQ ID NO: 63758 - RNA, 32 nt, Human
auaagcagcccagucucuggcaguuuuuacgg

SEQ ID NO: 63759 - RNA, 32 nt, Human
auaagcaggaaagagggaugaagaagaggguu

SEQ ID NO: 63760 - RNA, 32 nt, Human
auaagcaugccacuauacuccagccugggcaa

SEQ ID NO: 63761 - RNA, 32 nt, Human
auaagcaugccuguuuucccauggccuugcuu

SEQ ID NO: 63762 - RNA, 20 nt, Human
auaagcauuacaacagagaa

SEQ ID NO: 63763 - RNA, 32 nt, Human
auaagcauuuuucugcccaauuaccugugaga

SEQ ID NO: 63764 - RNA, 32 nt, Human
auaagccaaaauacaacucaccuuuggaauca

SEQ ID NO: 63765 - RNA, 32 nt, Human
auaagccacaaaugaagagaaaagccaugccc

SEQ ID NO: 63766 - RNA, 32 nt, Human
auaagccacugcacccagcugaaaguugguau

SEQ ID NO: 63767 - RNA, 32 nt, Human
auaagccaggaaaagugaaaagagaacacagu

SEQ ID NO: 63768 - RNA, 32 nt, Human
auaagccaguuaaaccucuuuucuuuauaaau

SEQ ID NO: 63769 - RNA, 32 nt, Human
auaagccaugcugcuuugcacacacacuagcc

SEQ ID NO: 63770 - RNA, 32 nt, Human
auaagccauguuucuguauuguacauguaaag

SEQ ID NO: 63771 - RNA, 32 nt, Human
auaagcccaggccccauggagagaggcucagc

SEQ ID NO: 63772 - RNA, 32 nt, Human
auaagccgggcggauugcaaaugaaguguaau

SEQ ID NO: 63773 - RNA, 32 nt, Human
auaagccgucaaguaguaagaagaacuuggau

SEQ ID NO: 63774 - RNA, 32 nt, Human
auaagccucaguuuuccaucuguuuuugauaa

SEQ ID NO: 63775 - RNA, 32 nt, Human
auaagccucuacugggucuauauugugaauca

SEQ ID NO: 63776 - RNA, 32 nt, Human
auaagccugcaaccucuugaccuucagcuccu

SEQ ID NO: 63777 - RNA, 32 nt, Human
auaagccugcagucccagcuacuugggaggcc

SEQ ID NO: 63778 - RNA, 32 nt, Human
auaagccuguucuagagaaguaccaugcaaca

SEQ ID NO: 63779 - RNA, 32 nt, Human
auaagccuuuaauucauccucagugacucugg

SEQ ID NO: 63780 - RNA, 32 nt, Human
auaagcggaggugggaggaggagcucgccaag

SEQ ID NO: 63781 - RNA, 32 nt, Human
auaagcgugcuuuauuucacauagaggggcau

SEQ ID NO: 63782 - RNA, 32 nt, Human
auaagcuaaguccugcauguucaggcaccagc

SEQ ID NO: 63783 - RNA, 32 nt, Human
auaagcuagggagggaugacaagaaggaaaau

SEQ ID NO: 63784 - RNA, 32 nt, Human
auaagcuauauuuuccccuuguuuuuaaaagg

SEQ ID NO: 63785 - RNA, 32 nt, Human
auaagcucauacccaaauucacaaagccuauu

SEQ ID NO: 63786 - RNA, 32 nt, Human
auaagcucaugguagaaaaccauagcuaagua

SEQ ID NO: 63787 - RNA, 32 nt, Human
auaagcuccagaagugacaagacacuucacau

SEQ ID NO: 63788 - RNA, 32 nt, Human
auaagcucucaacuauaguuaacuauaucaca

SEQ ID NO: 63789 - RNA, 32 nt, Human
auaagcucuuucccucuccguuugcugcuuuu

SEQ ID NO: 63790 - RNA, 32 nt, Human
auaagcuguucugguggcaguaacaugcaaca

SEQ ID NO: 63791 - RNA, 32 nt, Human
auaagcuguuggcuucucugagcuccagugga

SEQ ID NO: 63792 - RNA, 32 nt, Human
auaagcuucccccuagcuagggaugcacgggg

SEQ ID NO: 63793 - RNA, 32 nt, Human
auaagcuuggaucuugaugaaagguuaccagg

SEQ ID NO: 63794 - RNA, 32 nt, Human
auaagcuugucacugcaaaaaguugccuuuug

SEQ ID NO: 63795 - RNA, 32 nt, Human
auaagcuuugccugcuuacuuucugccauugg

SEQ ID NO: 63796 - RNA, 32 nt, Human
auaaggaaaccagcucagagaggccaaguaac

SEQ ID NO: 63797 - RNA, 32 nt, Human
auaaggaaaccaguguugccauugagguuauc

SEQ ID NO: 63798 - RNA, 32 nt, Human
auaaggaagaaagagggagacaguagcugcuc

SEQ ID NO: 63799 - RNA, 32 nt, Human
auaaggaagagaggagagccuauccccgagca

SEQ ID NO: 63800 - RNA, 32 nt, Human
auaaggaagagcaaaggagcugagcuggugga

SEQ ID NO: 63801 - RNA, 32 nt, Human
auaaggaagagcaucucauacauaucauuauc

SEQ ID NO: 63802 - RNA, 32 nt, Human
auaaggaagugagagaccuccuacuugguucc

SEQ ID NO: 63803 - RNA, 32 nt, Human
auaaggaaguugaggaacauccaccucugucu

SEQ ID NO: 63804 - RNA, 31 nt, Human
auaaggacaagguaguuuucacuggauccuu

SEQ ID NO: 63805 - RNA, 31 nt, Human
auaaggacaggccacaccacagcagagacca

SEQ ID NO: 63806 - RNA, 32 nt, Human
auaaggagaagaaagcuucaguuuacuguuuc

SEQ ID NO: 63807 - RNA, 32 nt, Human
auaaggaggaagcugaagcgggcagaucacuu

SEQ ID NO: 63808 - RNA, 32 nt, Human
auaaggaucaauagacagaagccuggggcggg

SEQ ID NO: 63809 - RNA, 32 nt, Human
auaaggauuauuuggucuucuggauuuggagg

SEQ ID NO: 63810 - RNA, 32 nt, Human
auaaggauuuuuaaaaacuuucuggucauuuc

SEQ ID NO: 63811 - RNA, 32 nt, Human
auaaggcaaagaaugugcaguaugaguaugag

SEQ ID NO: 63812 - RNA, 32 nt, Human
auaaggcaagggggaguguagagcagagcaga

SEQ ID NO: 63813 - RNA, 32 nt, Human
auaaggcaaucagaauaaucaucuuccuuguu

SEQ ID NO: 63814 - RNA, 32 nt, Human
auaaggccaucucacuugccacugugcuguuu

SEQ ID NO: 63815 - RNA, 32 nt, Human
auaaggccccuggguacacugcagaagcccca

SEQ ID NO: 63816 - RNA, 32 nt, Human
auaaggcccuggaguccaccuccaggcugggu

SEQ ID NO: 63817 - RNA, 32 nt, Human
auaaggccuaaguuauguuugugcccaggcaa

SEQ ID NO: 63818 - RNA, 32 nt, Human
auaaggcucuuggauguauaacauacucaaaa

SEQ ID NO: 63819 - RNA, 32 nt, Human
auaaggcuuaauauuuaauugauuuguuuaau

SEQ ID NO: 63820 - RNA, 32 nt, Human
auaagggaauaaaagcuggccacugccagcuu

SEQ ID NO: 63821 - RNA, 32 nt, Human
auaagggaauaagcuguugagcuaaaccugua

SEQ ID NO: 63822 - RNA, 32 nt, Human
auaagggaaugugaccauguuuggagauaggg

SEQ ID NO: 63823 - RNA, 32 nt, Human
auaagggagagggaaauacaaggagggccucu

SEQ ID NO: 63824 - RNA, 32 nt, Human
auaagggaggcugcugugcaggggagcacagg

SEQ ID NO: 63825 - RNA, 32 nt, Human
auaagggauuucaugaaacaaaacagauaaaa

SEQ ID NO: 63826 - RNA, 32 nt, Human
auaagggcauggcccaagucugucuuugacuc

SEQ ID NO: 63827 - RNA, 32 nt, Human
auaaggggaaggaagagagagggagcaggcgg

SEQ ID NO: 63828 - RNA, 32 nt, Human
auaagggguuacucuuucaagaguaacaaaaa

SEQ ID NO: 63829 - RNA, 32 nt, Human
auaaggguauagaacugcuuuucucauaggua

SEQ ID NO: 63830 - RNA, 32 nt, Human
auaaggguuaucuuuaaguccuaagggauucc

SEQ ID NO: 63831 - RNA, 32 nt, Human
auaaggucaggagaucaagaccauccuggcua

SEQ ID NO: 63832 - RNA, 32 nt, Human
auaaggucauacaggcaagaccuggcauaaua

SEQ ID NO: 63833 - RNA, 32 nt, Human
auaaggucauuuucucccucuacucacaauac

SEQ ID NO: 63834 - RNA, 32 nt, Human
auaaggucauuuuucuccaucaggggcaaaug

SEQ ID NO: 63835 - RNA, 32 nt, Human
auaagguguggaaaaugcuuuucuguuaguag

SEQ ID NO: 63836 - RNA, 32 nt, Human
auaagguuaaaaguuguuaaugaccaaacauu

SEQ ID NO: 63837 - RNA, 32 nt, Human
auaagguugaggacagugacugccauuuguau

SEQ ID NO: 63838 - RNA, 32 nt, Human
auaaguaagacagauucuucacuguguuuuaa

SEQ ID NO: 63839 - RNA, 32 nt, Human
auaaguaggccuggagccucagcuucuguaaa

SEQ ID NO: 63840 - RNA, 32 nt, Human
auaaguauagccaccccacucucuuuugguuu

SEQ ID NO: 63841 - RNA, 32 nt, Human
auaaguaugcagcagaacuccaacuaucuuuu

SEQ ID NO: 63842 - RNA, 22 nt, Human
auaagucaccguguuggauuga

SEQ ID NO: 63843 - RNA, 32 nt, Human
auaagucagucaccuugcuccucuccagaggc

SEQ ID NO: 63844 - RNA, 32 nt, Human
auaagucaugaccaagacaaacugccaauaca

SEQ ID NO: 63845 - RNA, 32 nt, Human
auaagucaugucccagccugggcaacauagca

SEQ ID NO: 63846 - RNA, 32 nt, Human
auaagucauguuccuucaagaucauguacccc

SEQ ID NO: 63847 - RNA, 32 nt, Human
auaaguccuuccacuuugaccccauggaggau

SEQ ID NO: 63848 - RNA, 32 nt, Human
auaagucugagugcuuuccucuucuucaacac

SEQ ID NO: 63849 - RNA, 32 nt, Human
auaagucugauucuauuucuaugacuuugaau

SEQ ID NO: 63850 - RNA, 32 nt, Human
auaagucugccucugccucugccucacccugc

SEQ ID NO: 63851 - RNA, 32 nt, Human
auaagucuuccccauuccucauacucgagccu

SEQ ID NO: 63852 - RNA, 32 nt, Human
auaagucuuuuucugccccaguggccuguuug

SEQ ID NO: 63853 - RNA, 32 nt, Human
auaagugaagaaagugauauugaagaaaagac

SEQ ID NO: 63854 - RNA, 32 nt, Human
auaagugaccuaaaaugucacuguucaaauua

SEQ ID NO: 63855 - RNA, 32 nt, Human
auaagugccaggauggaaugaugggucaguug

SEQ ID NO: 63856 - RNA, 32 nt, Human
auaagugguuucuucaggaaaauaaauaucac

SEQ ID NO: 63857 - RNA, 32 nt, Human
auaaguguagacugcugucaaggaggcuucau

SEQ ID NO: 63858 - RNA, 32 nt, Human
auaaguguccacuggcccuggccaacuggccu

SEQ ID NO: 63859 - RNA, 32 nt, Human
auaagugugcagggggaugggccagggccagg

SEQ ID NO: 63860 - RNA, 32 nt, Human
auaaguuaauucuaagugcuagcucuugaaac

SEQ ID NO: 63861 - RNA, 32 nt, Human
auaaguuauauuuuuggcugggcucggucgcu

SEQ ID NO: 63862 - RNA, 32 nt, Human
auaaguucacagucagccuuuugggcagaaga

SEQ ID NO: 63863 - RNA, 32 nt, Human
auaaguucccucugagcaaccagaacaugcug

SEQ ID NO: 63864 - RNA, 32 nt, Human
auaaguucgugccaaaugaaauccuuccuguu

SEQ ID NO: 63865 - RNA, 32 nt, Human
auaaguucuucccacuuuuaagcugaugaaag

SEQ ID NO: 63866 - RNA, 32 nt, Human
auaaguugcaaaaguuggggcugcaauuaaug

SEQ ID NO: 63867 - RNA, 32 nt, Human
auaaguugcuguucuuuugucuucuuuuuaau

SEQ ID NO: 63868 - RNA, 32 nt, Human
auaaguuggauuuuccucauaauauguguggg

SEQ ID NO: 63869 - RNA, 32 nt, Human
auaaguuguaagcuccuugagagcaggaucca

SEQ ID NO: 63870 - RNA, 32 nt, Human
auaaguuguugccuauucaguguuacagauuu

SEQ ID NO: 63871 - RNA, 32 nt, Human
auaauaaaaauacuuuaccuacccugaucacc

SEQ ID NO: 63872 - RNA, 32 nt, Human
auaauaaaaggagccaguccccugcagguauc

SEQ ID NO: 63873 - RNA, 32 nt, Human
auaauaaaucaucucaucacaaaucaauacgg

SEQ ID NO: 63874 - RNA, 32 nt, Human
auaauaaaucuguaccuuaucaaacauuuucu

SEQ ID NO: 63875 - RNA, 32 nt, Human
auaauaaaugggcucauuuaguugccugggca

SEQ ID NO: 63876 - RNA, 32 nt, Human
auaauaaauguuucugagcugccuguguucuc

SEQ ID NO: 63877 - RNA, 32 nt, Human
auaauaacaauuaagagacggcagggccuuca

SEQ ID NO: 63878 - RNA, 32 nt, Human
auaauaacacaaugcucagcucagggagcaag

SEQ ID NO: 63879 - RNA, 32 nt, Human
auaauaacaggcugggugcaauggcucacacc

SEQ ID NO: 63880 - RNA, 32 nt, Human
auaauaaccaaccaaccaaccaaccaaacuuc

SEQ ID NO: 63881 - RNA, 32 nt, Human
auaauaaccuauauugaaaugccaagaauugu

SEQ ID NO: 63882 - RNA, 32 nt, Human
auaauaagaaaaucuauguuuaaucaacugag

SEQ ID NO: 63883 - RNA, 32 nt, Human
auaauaagaaacugagaaggaggaauucuggc

SEQ ID NO: 63884 - RNA, 32 nt, Human
auaauaagagaacgugccaucuguaaagcacu

SEQ ID NO: 63885 - RNA, 32 nt, Human
auaauaagaggcuacuguugugucuaauguuc

SEQ ID NO: 63886 - RNA, 32 nt, Human
auaauaagagucuucagagagaugaugggagg

SEQ ID NO: 63887 - RNA, 32 nt, Human
auaauaagguaaagagguagaaucacuuucag

SEQ ID NO: 63888 - RNA, 32 nt, Human
auaauaaggucauaauuacaccuaacguaaua

SEQ ID NO: 63889 - RNA, 32 nt, Human
auaauaagugggaaagagagggacgggucuga

SEQ ID NO: 63890 - RNA, 32 nt, Human
auaauaauacaaaaauuagcugggcguggugg

SEQ ID NO: 63891 - RNA, 32 nt, Human
auaauaauaccaaucuccuagacuucauaaga

SEQ ID NO: 63892 - RNA, 32 nt, Human
auaauaauagcccuuccaucuggcaguggggg

SEQ ID NO: 63893 - RNA, 32 nt, Human
auaauaaugauacuuauguuagaagauuguuu

SEQ ID NO: 63894 - RNA, 31 nt, Human
auaauaauguucucuggguagguguugaaaa

SEQ ID NO: 63895 - RNA, 32 nt, Human
auaauaauuauaauccaguuuuaagauaauau

SEQ ID NO: 63896 - RNA, 32 nt, Human
auaauaauuuaccuuagcagacaugcaaaagc

SEQ ID NO: 63897 - RNA, 32 nt, Human
auaauacacagaauccugcaacuuuuugcaca

SEQ ID NO: 63898 - RNA, 32 nt, Human
auaauacacagccccuggauggggagggggua

SEQ ID NO: 63899 - RNA, 32 nt, Human
auaauacaucuuccacacauuuggcccacuga

SEQ ID NO: 63900 - RNA, 20 nt, Human
auaauacauucaccucccug

SEQ ID NO: 63901 - RNA, 32 nt, Human
auaauacccugccuucucguauugcugcugag

SEQ ID NO: 63902 - RNA, 32 nt, Human
auaauaccuauguaacaaacugagcagcuguu

SEQ ID NO: 63903 - RNA, 32 nt, Human
auaauaccuaugugaugcuguaauuuuacuuu

SEQ ID NO: 63904 - RNA, 32 nt, Human
auaauaccucaguuuugagguuaugcacacua

SEQ ID NO: 63905 - RNA, 32 nt, Human
auaauaccucaguuuugauguuaugcacacua

SEQ ID NO: 63906 - RNA, 32 nt, Human
auaauaccuuguaaguugcuuuuguuuguaaa

SEQ ID NO: 63907 - RNA, 20 nt, Human
auaauacugauugccucccu

SEQ ID NO: 63908 - RNA, 32 nt, Human
auaauagaaacagcaggucuugucagcuccuu

SEQ ID NO: 63909 - RNA, 32 nt, Human
auaauagaauugcucccuaccagcugaacagg

SEQ ID NO: 63910 - RNA, 32 nt, Human
auaauagaccagcaauugcagcacuuacaauc

SEQ ID NO: 63911 - RNA, 32 nt, Human
auaauagagcaucgauucucauucucucccuc

SEQ ID NO: 63912 - RNA, 32 nt, Human
auaauagaguccauauuauauaggguguccac

SEQ ID NO: 63913 - RNA, 32 nt, Human
auaauagauugaucaugcaccauauccacagg

SEQ ID NO: 63914 - RNA, 32 nt, Human
auaauagauuucauuucacucuagccuacaua

SEQ ID NO: 63915 - RNA, 32 nt, Human
auaauagcagugguaaaaguauuugcuuaaaa

SEQ ID NO: 63916 - RNA, 32 nt, Human
auaauaggaaaccagagaggggcaggggcugg

SEQ ID NO: 63917 - RNA, 32 nt, Human
auaauaggaacaaugcauucuaaugguacaac

SEQ ID NO: 63918 - RNA, 32 nt, Human
auaauaggcuacucgggaggcugaggcuggag

SEQ ID NO: 63919 - RNA, 32 nt, Human
auaauaguccuaauaagugauuucaaguauau

SEQ ID NO: 63920 - RNA, 32 nt, Human
auaauaguccuagaguuugcagcugguaaaac

SEQ ID NO: 63921 - RNA, 32 nt, Human
auaauaguucacuuacaaaugugauuugaugu

SEQ ID NO: 63922 - RNA, 32 nt, Human
auaauaguuguucagugaaggaagucagcugc

SEQ ID NO: 63923 - RNA, 32 nt, Human
auaauauagccuguccguuugcuguuuccagg

SEQ ID NO: 63924 - RNA, 32 nt, Human
auaauauaguaauccuguaacuggguuugaaa

SEQ ID NO: 63925 - RNA, 32 nt, Human
auaauauccguguuaagaagggguucuuuggc

SEQ ID NO: 63926 - RNA, 32 nt, Human
auaauaucucauuagccaggcuuuuuaggaac

SEQ ID NO: 63927 - RNA, 32 nt, Human
auaauaugugagaggacagauuguuagauaug

SEQ ID NO: 63928 - RNA, 31 nt, Human
auaauauucaaagccaauaccaaaacgaugg

SEQ ID NO: 63929 - RNA, 32 nt, Human
auaauauucauaaaccuaugggagacucgugu

SEQ ID NO: 63930 - RNA, 32 nt, Human
auaauauuccagauuacacuguaccuggcuuc

SEQ ID NO: 63931 - RNA, 32 nt, Human
auaauauuuuuccagaauuaacaguauaaauu

SEQ ID NO: 63932 - RNA, 22 nt, Human
auaaucaaucucuacuagguua

SEQ ID NO: 63933 - RNA, 32 nt, Human
auaaucaauucaucaagccaguuauuacugaa

SEQ ID NO: 63934 - RNA, 32 nt, Human
auaaucaccugaaagaaggggaagggacagag

SEQ ID NO: 63935 - RNA, 32 nt, Human
auaaucacgccacugcacuccagccugggcug

SEQ ID NO: 63936 - RNA, 32 nt, Human
auaaucacuugaaccugggagguggaaguugc

SEQ ID NO: 63937 - RNA, 32 nt, Human
auaaucaggcuuauggcauaagaaaaaugagu

SEQ ID NO: 63938 - RNA, 31 nt, Human
auaaucagucaaauaaagugaucugugcauc

SEQ ID NO: 63939 - RNA, 32 nt, Human
auaaucagugaaacuacuuaacacagcuaauu

SEQ ID NO: 63940 - RNA, 32 nt, Human
auaaucaguuacugguaucugucacugaccuu

SEQ ID NO: 63941 - RNA, 32 nt, Human
auaaucaguuuaucuaagaaaagggaauuuua

SEQ ID NO: 63942 - RNA, 32 nt, Human
auaaucauaaaaugaacaaaaccucagagccc

SEQ ID NO: 63943 - RNA, 32 nt, Human
auaaucauaacagcaaaaaccgaccaggagcc

SEQ ID NO: 63944 - RNA, 32 nt, Human
auaaucauaauguuuacaaugcagccuacugg

SEQ ID NO: 63945 - RNA, 32 nt, Human
auaaucaucccuuaaacacucugugaugggau

SEQ ID NO: 63946 - RNA, 32 nt, Human
auaaucaucucaaggacaugguaagugaaaga

SEQ ID NO: 63947 - RNA, 32 nt, Human
auaaucaugccacuguacuccagccuggguga

SEQ ID NO: 63948 - RNA, 32 nt, Human
auaaucauguugucuaaugguacucuggauuc

SEQ ID NO: 63949 - RNA, 32 nt, Human
auaaucauugucaacccuuugaugagugauau

SEQ ID NO: 63950 - RNA, 32 nt, Human
auaauccaacccacaugagcugagaguuuuuc

SEQ ID NO: 63951 - RNA, 32 nt, Human
auaauccagcacuuugggaagccgaggcgggc

SEQ ID NO: 63952 - RNA, 32 nt, Human
auaaucccaacacuuugggaggccgagguggg

SEQ ID NO: 63953 - RNA, 32 nt, Human
auaaucccaccccuagguaaauacucaaaaca

SEQ ID NO: 63954 - RNA, 32 nt, Human
auaaucccacugcauuccagccugggcaacag

SEQ ID NO: 63955 - RNA, 32 nt, Human
auaaucccagcacuaugggaggcugaggcaag

SEQ ID NO: 63956 - RNA, 32 nt, Human
auaaucccagcacuuggggaggccguggugag

SEQ ID NO: 63957 - RNA, 32 nt, Human
auaaucccagcacuuugggaggccaaaaucac

SEQ ID NO: 63958 - RNA, 32 nt, Human
auaaucccagcacuuugggaggccaagcuugg

SEQ ID NO: 63959 - RNA, 32 nt, Human
auaaucccagcacuuugggaggcugaagcagg

SEQ ID NO: 63960 - RNA, 32 nt, Human
auaaucccagcacuuugggaggcugaaguggg

SEQ ID NO: 63961 - RNA, 32 nt, Human
auaaucccagcacuuugggaggcugaggcagg

SEQ ID NO: 63962 - RNA, 32 nt, Human
auaaucccagcacuuugggaggcugagggagg

SEQ ID NO: 63963 - RNA, 32 nt, Human
auaaucccagcacuuugggaggcugaggugag

SEQ ID NO: 63964 - RNA, 32 nt, Human
auaaucccagcacuuugggaggcugagguggg

SEQ ID NO: 63965 - RNA, 32 nt, Human
auaaucccagcacuuugggaggcugagguggu

SEQ ID NO: 63966 - RNA, 32 nt, Human
auaaucccagcgcuuuggaggcugagguugga

SEQ ID NO: 63967 - RNA, 32 nt, Human
auaaucccagugcuuuacaaggcugaggcagg

SEQ ID NO: 63968 - RNA, 32 nt, Human
auaaucccgcuacucgggaggcugaggcagga

SEQ ID NO: 63969 - RNA, 32 nt, Human
auaaucccuaaaagcacccacauuuguuucaa

SEQ ID NO: 63970 - RNA, 32 nt, Human
auaauccuagagucuuaaagcauuucaggcca

SEQ ID NO: 63971 - RNA, 32 nt, Human
auaauccuagcuacucagguggcggaggugag

SEQ ID NO: 63972 - RNA, 32 nt, Human
auaauccuauauugagcuucaguggagaauaa

SEQ ID NO: 63973 - RNA, 32 nt, Human
auaauccuccauccucuuucccagacucacuc

SEQ ID NO: 63974 - RNA, 32 nt, Human
auaauccugaaauccaaaauugcacuguguuu

SEQ ID NO: 63975 - RNA, 32 nt, Human
auaauccuggacaugggugaacaugaggagaa

SEQ ID NO: 63976 - RNA, 32 nt, Human
auaaucgcuaguguuaugucaaaguuaagccc

SEQ ID NO: 63977 - RNA, 32 nt, Human
auaaucggcccacagcucccaccccacccccu

SEQ ID NO: 63978 - RNA, 32 nt, Human
auaaucgugccacugcaguccagccuaggcaa

SEQ ID NO: 63979 - RNA, 32 nt, Human
auaaucuaaugccacugcugaucugacaggag

SEQ ID NO: 63980 - RNA, 32 nt, Human
auaaucuacuucugguaaucugagggugcuuu

SEQ ID NO: 63981 - RNA, 32 nt, Human
auaaucuagcuucuccaccucuuguuucacac

SEQ ID NO: 63982 - RNA, 32 nt, Human
auaaucuauaugauuaaagaaaauaugcauaa

SEQ ID NO: 63983 - RNA, 20 nt, Human
auaaucucaagacaccuccc

SEQ ID NO: 63984 - RNA, 32 nt, Human
auaaucucaaguuagaaaacaguagguccuga

SEQ ID NO: 63985 - RNA, 31 nt, Human
auaaucucaauaaacaguuaaaaguucgaaa

SEQ ID NO: 63986 - RNA, 32 nt, Human
auaaucucaauuauaaaauuccugccucuccc

SEQ ID NO: 63987 - RNA, 32 nt, Human
auaaucucacaaaauacagauaugcaauuuuu

SEQ ID NO: 63988 - RNA, 32 nt, Human
auaaucucagcccuuuuggaggccaagguaag

SEQ ID NO: 63989 - RNA, 32 nt, Human
auaaucucuuuacuccccugugagugauucac

SEQ ID NO: 63990 - RNA, 32 nt, Human
auaaucucuuugugcaaacaccaggaagcccu

SEQ ID NO: 63991 - RNA, 32 nt, Human
auaaucugcaguaucauacuuguuuauauuac

SEQ ID NO: 63992 - RNA, 32 nt, Human
auaaucuggacuucagagauuaagucaccaau

SEQ ID NO: 63993 - RNA, 32 nt, Human
auaaucuggcucaugguaccuguucuucuauc

SEQ ID NO: 63994 - RNA, 32 nt, Human
auaaucuggguggggaaaauggcacugcuugg

SEQ ID NO: 63995 - RNA, 32 nt, Human
auaaucugguaaccccagccaagccaaggaug

SEQ ID NO: 63996 - RNA, 32 nt, Human
auaaucuguaauuuucuuuguuuauacuuccc

SEQ ID NO: 63997 - RNA, 32 nt, Human
auaaucuuauuuggggaggaaugggugggcac

SEQ ID NO: 63998 - RNA, 32 nt, Human
auaaucuucaaaaugaagacuuuggaaaauuu

SEQ ID NO: 63999 - RNA, 32 nt, Human
auaaucuuguucugcugauuuguuucuuguaa

SEQ ID NO: 64000 - RNA, 32 nt, Human
auaaucuuucacugcagccucaaacuccugga

SEQ ID NO: 64001 - RNA, 32 nt, Human
auaaucuuugagccacaccaaaaggaaugcca

SEQ ID NO: 64002 - RNA, 32 nt, Human
auaaugaaaaacaaaucucuccuuaauuugag

SEQ ID NO: 64003 - RNA, 32 nt, Human
auaaugaaaagcuuuuaaagagcuuuggguuu

SEQ ID NO: 64004 - RNA, 32 nt, Human
auaaugaaaccaugacaacgguucgcugugga

SEQ ID NO: 64005 - RNA, 32 nt, Human
auaaugaaacgguucggaauacuggcucaaga

SEQ ID NO: 64006 - RNA, 32 nt, Human
auaaugaacccccauauacccuuccuucugga

SEQ ID NO: 64007 - RNA, 32 nt, Human
auaaugaagauuuccuuuuuccuugccuauuu

SEQ ID NO: 64008 - RNA, 31 nt, Human
auaaugacaacuucuuuagaaauuugaaugg

SEQ ID NO: 64009 - RNA, 32 nt, Human
auaaugagccguugugcuccagccugggcgac

SEQ ID NO: 64010 - RNA, 32 nt, Human
auaaugaggcugucucugaaccccggagggcg

SEQ ID NO: 64011 - RNA, 32 nt, Human
auaaugagguaguuugugguaucagagcuaag

SEQ ID NO: 64012 - RNA, 32 nt, Human
auaaugauccaagaggaaguggcaaaugagug

SEQ ID NO: 64013 - RNA, 32 nt, Human
auaaugaucuacauuuaaaacucuuuauguaa

SEQ ID NO: 64014 - RNA, 32 nt, Human
auaaugaugauaauaccacuuaucucauagca

SEQ ID NO: 64015 - RNA, 32 nt, Human
auaaugauuugagucaguauaccauuuuaccu

SEQ ID NO: 64016 - RNA, 32 nt, Human
auaaugcaagagaugcugaugccaccagaaua

SEQ ID NO: 64017 - RNA, 32 nt, Human
auaaugcacaugcucuaacugcucaacaggaa

SEQ ID NO: 64018 - RNA, 32 nt, Human
auaaugcaccuugaaggcgcagaaggaacaca

SEQ ID NO: 64019 - RNA, 32 nt, Human
auaaugcaucuucuucccuccuucuacuguac

SEQ ID NO: 64020 - RNA, 32 nt, Human
auaaugcauucuauguagccaugucacuguga

SEQ ID NO: 64021 - RNA, 32 nt, Human
auaaugccacugcacuccagccugccuggaug

SEQ ID NO: 64022 - RNA, 32 nt, Human
auaaugccauccggaucccugugcucuaucuc

SEQ ID NO: 64023 - RNA, 32 nt, Human
auaaugcccuuuauagcuaccccacaccguca

SEQ ID NO: 64024 - RNA, 32 nt, Human
auaaugccguauauguaguagcacuuuucaaa

SEQ ID NO: 64025 - RNA, 32 nt, Human
auaaugccuaucuuccugcagccuccccacgu

SEQ ID NO: 64026 - RNA, 32 nt, Human
auaaugccucagagucuucacacuguggagaa

SEQ ID NO: 64027 - RNA, 32 nt, Human
auaaugccuccaccauuuucuaccuggugacu

SEQ ID NO: 64028 - RNA, 32 nt, Human
auaaugcggugagcaggcaccacgccggcaga

SEQ ID NO: 64029 - RNA, 32 nt, Human
auaaugcugggcccaacaccugggugauggaa

SEQ ID NO: 64030 - RNA, 32 nt, Human
auaauggaagugaugaugagaaaacaggacuc

SEQ ID NO: 64031 - RNA, 32 nt, Human
auaauggacuccuccuauagugccaauagguc

SEQ ID NO: 64032 - RNA, 32 nt, Human
auaauggacucuuaagaauggaaagggaugac

SEQ ID NO: 64033 - RNA, 32 nt, Human
auaauggagaagaggacagaggauguguggga

SEQ ID NO: 64034 - RNA, 32 nt, Human
auaauggagguuucacugugaagcaucaccag

SEQ ID NO: 64035 - RNA, 32 nt, Human
auaauggauacuuugcuuggauccaagucaaa

SEQ ID NO: 64036 - RNA, 32 nt, Human
auaauggcaaaaacuggcugggcacaguggcu

SEQ ID NO: 64037 - RNA, 32 nt, Human
auaauggcaacacugcgcuccagccuggcaga

SEQ ID NO: 64038 - RNA, 32 nt, Human
auaauggcaagugacguggcccuggggaaagg

SEQ ID NO: 64039 - RNA, 32 nt, Human
auaauggcauuucuccuuucugugcacagcac

SEQ ID NO: 64040 - RNA, 32 nt, Human
auaauggcauuugagacugaauuucuaaaaau

SEQ ID NO: 64041 - RNA, 32 nt, Human
auaauggcgguuugggggagccugcuagaaug

SEQ ID NO: 64042 - RNA, 32 nt, Human
auaauggcucaauaacucugaggcugguugcu

SEQ ID NO: 64043 - RNA, 32 nt, Human
auaauggcuuauaaaugguguuuaaauaugca

SEQ ID NO: 64044 - RNA, 32 nt, Human
auaaugggacucuugcuauguugcucacacua

SEQ ID NO: 64045 - RNA, 32 nt, Human
auaaugggagccaaaauucagagaaugaaaau

SEQ ID NO: 64046 - RNA, 32 nt, Human
auaaugggccuuguaagucuuuucaccauuca

SEQ ID NO: 64047 - RNA, 32 nt, Human
auaauggggaaaauauuugggaccaagcugaa

SEQ ID NO: 64048 - RNA, 23 nt, Human
auaaugggggccuggccauccca

SEQ ID NO: 64049 - RNA, 32 nt, Human
auaaugggucaccagcucccaugcccuagaug

SEQ ID NO: 64050 - RNA, 32 nt, Human
auaauggugccacuggacuccagccugggaga

SEQ ID NO: 64051 - RNA, 32 nt, Human
auaaugguuuggcuguuucuccacccaaaucu

SEQ ID NO: 64052 - RNA, 32 nt, Human
auaauguaacagcaccuacauacccauucccu

SEQ ID NO: 64053 - RNA, 32 nt, Human
auaauguauaaauuaagcauagcaagagauua

SEQ ID NO: 64054 - RNA, 31 nt, Human
auaauguauuucugauagcauuuaaauuccu

SEQ ID NO: 64055 - RNA, 32 nt, Human
auaaugucaguaggagacuuaaccuuagugug

SEQ ID NO: 64056 - RNA, 32 nt, Human
auaaugucauuuuuacggaaacccuuucggcg

SEQ ID NO: 64057 - RNA, 32 nt, Human
auaaugucuccacuuuguccaugccauuuagc

SEQ ID NO: 64058 - RNA, 32 nt, Human
auaaugucugauguuauucuuguauuuuucug

SEQ ID NO: 64059 - RNA, 32 nt, Human
auaaugucugcucuuguguagcucaggagaca

SEQ ID NO: 64060 - RNA, 32 nt, Human
auaaugucuuccaguucuacccauguuguuga

SEQ ID NO: 64061 - RNA, 32 nt, Human
auaaugucuuccuuuucccccuucccgccugg

SEQ ID NO: 64062 - RNA, 32 nt, Human
auaaugugaagacauugucuuuucacucuauc

SEQ ID NO: 64063 - RNA, 32 nt, Human
auaauguggaaauggcaguugucccgagggcg

SEQ ID NO: 64064 - RNA, 29 nt, Human
auaaugugucuguguugcuucaaauuggu

SEQ ID NO: 64065 - RNA, 32 nt, Human
auaauguguguauguuuauauguguacauaua

SEQ ID NO: 64066 - RNA, 32 nt, Human
auaauguucacuuauacauuccuguacagaaa

SEQ ID NO: 64067 - RNA, 31 nt, Human
auaauguugugaaucuccaugccaagugaaa

SEQ ID NO: 64068 - RNA, 32 nt, Human
auaauguuuuaguuaagaguccuguuggcugc

SEQ ID NO: 64069 - RNA, 31 nt, Human
auaauuaaaguguccauugacauguacagag

SEQ ID NO: 64070 - RNA, 32 nt, Human
auaauuaagcccauccaaaagaaaaaccaacc

SEQ ID NO: 64071 - RNA, 32 nt, Human
auaauuacacauauuuguauauuucagagaag

SEQ ID NO: 64072 - RNA, 32 nt, Human
auaauuacaguguuuaagagcauuuccccuag

SEQ ID NO: 64073 - RNA, 32 nt, Human
auaauuacgucuugagucugggauuauccgca

SEQ ID NO: 64074 - RNA, 32 nt, Human
auaauuacuuuagcuuuucuccagaaaagcuu

SEQ ID NO: 64075 - RNA, 32 nt, Human
auaauuacuuucaauuuccuccaggcaugacu

SEQ ID NO: 64076 - RNA, 32 nt, Human
auaauuagaagaaacccuuuuccuucagggaa

SEQ ID NO: 64077 - RNA, 32 nt, Human
auaauuagcugcaugcugcagacucaacaaag

SEQ ID NO: 64078 - RNA, 32 nt, Human
auaauuagggcugagugacuuuucgggacaca

SEQ ID NO: 64079 - RNA, 32 nt, Human
auaauuagugauauaagcauuguuuuuauugc

SEQ ID NO: 64080 - RNA, 32 nt, Human
auaauuauagcauuaacaccagggggcagagg

SEQ ID NO: 64081 - RNA, 32 nt, Human
auaauuauaucuuccccgcccaccucacaggc

SEQ ID NO: 64082 - RNA, 32 nt, Human
auaauuaucauugcaguggagugccuggauug

SEQ ID NO: 64083 - RNA, 32 nt, Human
auaauuauuacagcaaaaguuaagaaaugaaa

SEQ ID NO: 64084 - RNA, 32 nt, Human
auaauuauuuaucuuugcauuuugcucaggua

SEQ ID NO: 64085 - RNA, 32 nt, Human
auaauucaagugacuaagcuagauacuugagg

SEQ ID NO: 64086 - RNA, 32 nt, Human
auaauucacaccuugcacagcaugagauaauu

SEQ ID NO: 64087 - RNA, 32 nt, Human
auaauucaguaggucuggggugaggccugagg

SEQ ID NO: 64088 - RNA, 32 nt, Human
auaauucauacuggaaagaaacucugcaaacc

SEQ ID NO: 64089 - RNA, 32 nt, Human
auaauucauagugauagagugcagugauguuu

SEQ ID NO: 64090 - RNA, 32 nt, Human
auaauucaugccacggaccugugcacaugccu

SEQ ID NO: 64091 - RNA, 32 nt, Human
auaauucccauaagaguaacaaaaaggaccag

SEQ ID NO: 64092 - RNA, 32 nt, Human
auaauuccucacccccaauccuuaucaauucu

SEQ ID NO: 64093 - RNA, 32 nt, Human
auaauuccugugagaacacgagaagauggugg

SEQ ID NO: 64094 - RNA, 32 nt, Human
auaauucuacuuuguuuaauguagaguaacua

SEQ ID NO: 64095 - RNA, 32 nt, Human
auaauucuauaaacugaauuauuuuaaaaggu

SEQ ID NO: 64096 - RNA, 32 nt, Human
auaauucuauacuguugauucgucugcgauuu

SEQ ID NO: 64097 - RNA, 32 nt, Human
auaauucugaugucucaagcauuggcaggcug

SEQ ID NO: 64098 - RNA, 32 nt, Human
auaauucugcaauccucuugcucaggaagugu

SEQ ID NO: 64099 - RNA, 32 nt, Human
auaauucuggaaaaccugguuuuggaugcuuu

SEQ ID NO: 64100 - RNA, 32 nt, Human
auaauucuuacugcagagaaacucuacaaacc

SEQ ID NO: 64101 - RNA, 32 nt, Human
auaauucuuccaggaaaacucagucuuccaac

SEQ ID NO: 64102 - RNA, 32 nt, Human
auaauucuugguuuuuaucuaaucagauauuc

SEQ ID NO: 64103 - RNA, 32 nt, Human
auaauugaagaaaaaugauggaagagagugga

SEQ ID NO: 64104 - RNA, 32 nt, Human
auaauugagggaagagaugggagccagggcac

SEQ ID NO: 64105 - RNA, 32 nt, Human
auaauugcacacugcagauaaacugcacaugu

SEQ ID NO: 64106 - RNA, 32 nt, Human
auaauugcacaugguuuugagaacaggaacug

SEQ ID NO: 64107 - RNA, 32 nt, Human
auaauugcaucauugcacuccagccugggcaa

SEQ ID NO: 64108 - RNA, 32 nt, Human
auaauugcuugagccugggaggcagaggcugc

SEQ ID NO: 64109 - RNA, 32 nt, Human
auaauugcuuggaccugggagguggagguugc

SEQ ID NO: 64110 - RNA, 32 nt, Human
auaauuggauacucauucuucccuucaaaacc

SEQ ID NO: 64111 - RNA, 32 nt, Human
auaauugguguugggaguguugcagugacuga

SEQ ID NO: 64112 - RNA, 32 nt, Human
auaauugugaaauauggaauuauuucugacac

SEQ ID NO: 64113 - RNA, 32 nt, Human
auaauugugauuaauuacaaaauaauugcuaa

SEQ ID NO: 64114 - RNA, 32 nt, Human
auaauugugccacugcacugcagccugggcga

SEQ ID NO: 64115 - RNA, 32 nt, Human
auaauuguugcagaggucucuguauuuugcag

SEQ ID NO: 64116 - RNA, 32 nt, Human
auaauuuaggcuucagcaucucaccagccccu

SEQ ID NO: 64117 - RNA, 32 nt, Human
auaauuuaguguuauuuuuacuuuauuuaggc

SEQ ID NO: 64118 - RNA, 32 nt, Human
auaauuuaugugaagacacaaagauguuuaaa

SEQ ID NO: 64119 - RNA, 32 nt, Human
auaauuucaugagaaagacaggcggauuccuu

SEQ ID NO: 64120 - RNA, 32 nt, Human
auaauuucuaaccucuguucucucaguaaaca

SEQ ID NO: 64121 - RNA, 32 nt, Human
auaauuucuagagagccacccuuucuacauga

SEQ ID NO: 64122 - RNA, 32 nt, Human
auaauuucuaggcuuaucuuguuuugcaguuu

SEQ ID NO: 64123 - RNA, 32 nt, Human
auaauuucuccucauuuaauauuuuucaaaau

SEQ ID NO: 64124 - RNA, 32 nt, Human
auaauuugcucuaggucccuauacuaauugag

SEQ ID NO: 64125 - RNA, 32 nt, Human
auaauuuggcaaaugcuggccuuuauggacga

SEQ ID NO: 64126 - RNA, 32 nt, Human
auaauuuggcugcugauuggcuuacuuuuaga

SEQ ID NO: 64127 - RNA, 32 nt, Human
auaauuugucagccccuggccuagggggaaga

SEQ ID NO: 64128 - RNA, 32 nt, Human
auaauuuguggaccagggauugcuuuucugaa

SEQ ID NO: 64129 - RNA, 32 nt, Human
auaauuugugucgauggauguucugugaaggc

SEQ ID NO: 64130 - RNA, 24 nt, Human
auaauuuguuccaccacuagauua

SEQ ID NO: 64131 - RNA, 32 nt, Human
auaauuuuauagcacguuuacucuagugcuag

SEQ ID NO: 64132 - RNA, 32 nt, Human
auaauuuucagcuaauuaucugggugacccag

SEQ ID NO: 64133 - RNA, 32 nt, Human
auaauuuucauuuuuaauuccucuugguguca

SEQ ID NO: 64134 - RNA, 32 nt, Human
auaauuuuccagaacuuaccucuguuuuaaaa

SEQ ID NO: 64135 - RNA, 32 nt, Human
auaauuuuccugucucugccucugggagggaa

SEQ ID NO: 64136 - RNA, 32 nt, Human
auaauuuugauguguuacaaaauacuacugug

SEQ ID NO: 64137 - RNA, 32 nt, Human
auaauuuugguuuaaaugugcugguuaguuga

SEQ ID NO: 64138 - RNA, 32 nt, Human
auaauuuuucuuggauuuauguucuguaucug

SEQ ID NO: 64139 - RNA, 32 nt, Human
auaauuuuugugauaucugccaccacagauaa

SEQ ID NO: 64140 - RNA, 32 nt, Human
auacaaaaacuagcugggcaugguggcuuuuu

SEQ ID NO: 64141 - RNA, 32 nt, Human
auacaaaaagcccuaaaugaacuguuaacuau

SEQ ID NO: 64142 - RNA, 32 nt, Human
auacaaaaauuaauugggcauggugguggaca

SEQ ID NO: 64143 - RNA, 32 nt, Human
auacaaaaauuagacuggcaugguggcaugcg

SEQ ID NO: 64144 - RNA, 32 nt, Human
auacaaaaauuagcagagcaugguggcaggcg

SEQ ID NO: 64145 - RNA, 32 nt, Human
auacaaaaauuagcagggcaugguggugcaug

SEQ ID NO: 64146 - RNA, 32 nt, Human
auacaaaaauuagccacgcaugguggcacaca

SEQ ID NO: 64147 - RNA, 32 nt, Human
auacaaaaauuagccaggcaugguggcaaacg

SEQ ID NO: 64148 - RNA, 32 nt, Human
auacaaaaauuagccaggcaugguggcacaca

SEQ ID NO: 64149 - RNA, 32 nt, Human
auacaaaaauuagccaggcaugguggcacacg

SEQ ID NO: 64150 - RNA, 32 nt, Human
auacaaaaauuagccaggcaugguggcacaug

SEQ ID NO: 64151 - RNA, 32 nt, Human
auacaaaaauuagccaggcaugguggcacgcg

SEQ ID NO: 64152 - RNA, 32 nt, Human
auacaaaaauuagccaggcaugguggcacgug

SEQ ID NO: 64153 - RNA, 32 nt, Human
auacaaaaauuagccaggcaugguggcaggag

SEQ ID NO: 64154 - RNA, 32 nt, Human
auacaaaaauuagccaggcaugguggcaggcg

SEQ ID NO: 64155 - RNA, 32 nt, Human
auacaaaaauuagccaggcaugguggcaugca

SEQ ID NO: 64156 - RNA, 32 nt, Human
auacaaaaauuagccaggcaugguggccagca

SEQ ID NO: 64157 - RNA, 32 nt, Human
auacaaaaauuagccaggcaugguggcgggcg

SEQ ID NO: 64158 - RNA, 32 nt, Human
auacaaaaauuagccaggcaugguggcgggug

SEQ ID NO: 64159 - RNA, 32 nt, Human
auacaaaaauuagccaggcaugguggcgugug

SEQ ID NO: 64160 - RNA, 32 nt, Human
auacaaaaauuagccaggcauggugguacaca

SEQ ID NO: 64161 - RNA, 32 nt, Human
auacaaaaauuagccaggcaugguggugagcc

SEQ ID NO: 64162 - RNA, 32 nt, Human
auacaaaaauuagccaggcaugguggugcaca

SEQ ID NO: 64163 - RNA, 32 nt, Human
auacaaaaauuagccaggcaugguggugcacg

SEQ ID NO: 64164 - RNA, 32 nt, Human
auacaaaaauuagccaggcaugguggugcaug

SEQ ID NO: 64165 - RNA, 32 nt, Human
auacaaaaauuagccaggcaugguggugggua

SEQ ID NO: 64166 - RNA, 32 nt, Human
auacaaaaauuagccaggcaugguggugggug

SEQ ID NO: 64167 - RNA, 32 nt, Human
auacaaaaauuagccaggcaugguggugugca

SEQ ID NO: 64168 - RNA, 32 nt, Human
auacaaaaauuagccaggcaugguggugugcg

SEQ ID NO: 64169 - RNA, 32 nt, Human
auacaaaaauuagccagguaugguggcacgug

SEQ ID NO: 64170 - RNA, 32 nt, Human
auacaaaaauuagccaugcaugguggcgggug

SEQ ID NO: 64171 - RNA, 32 nt, Human
auacaaaaauuagccaugcaugguggcucaug

SEQ ID NO: 64172 - RNA, 32 nt, Human
auacaaaaauuagccaugcaugguggugcaug

SEQ ID NO: 64173 - RNA, 32 nt, Human
auacaaaaauuagccgagcaugguggccugug

SEQ ID NO: 64174 - RNA, 32 nt, Human
auacaaaaauuagccgagcaugguggcgggca

SEQ ID NO: 64175 - RNA, 32 nt, Human
auacaaaaauuagccgggcaugguagcaggca

SEQ ID NO: 64176 - RNA, 32 nt, Human
auacaaaaauuagccgggcauggugacaggca

SEQ ID NO: 64177 - RNA, 32 nt, Human
auacaaaaauuagccgggcaugguggcacacg

SEQ ID NO: 64178 - RNA, 32 nt, Human
auacaaaaauuagccgggcaugguggcacaug

SEQ ID NO: 64179 - RNA, 32 nt, Human
auacaaaaauuagccgggcaugguggcacgcg

SEQ ID NO: 64180 - RNA, 32 nt, Human
auacaaaaauuagccgggcaugguggcacgug

SEQ ID NO: 64181 - RNA, 32 nt, Human
auacaaaaauuagccgggcaugguggcaggca

SEQ ID NO: 64182 - RNA, 32 nt, Human
auacaaaaauuagccgggcaugguggcaggcg

SEQ ID NO: 64183 - RNA, 32 nt, Human
auacaaaaauuagccgggcaugguggcaggug

SEQ ID NO: 64184 - RNA, 32 nt, Human
auacaaaaauuagccgggcaugguggcaguca

SEQ ID NO: 64185 - RNA, 32 nt, Human
auacaaaaauuagccgggcaugguggcaugca

SEQ ID NO: 64186 - RNA, 32 nt, Human
auacaaaaauuagccgggcaugguggcaugcg

SEQ ID NO: 64187 - RNA, 32 nt, Human
auacaaaaauuagccgggcaugguggcgcaug

SEQ ID NO: 64188 - RNA, 32 nt, Human
auacaaaaauuagccgggcaugguggcgcgca

SEQ ID NO: 64189 - RNA, 32 nt, Human
auacaaaaauuagccgggcaugguggcgcuca

SEQ ID NO: 64190 - RNA, 32 nt, Human
auacaaaaauuagccgggcaugguggcgggcc

SEQ ID NO: 64191 - RNA, 32 nt, Human
auacaaaaauuagccgggcaugguggcgggug

SEQ ID NO: 64192 - RNA, 32 nt, Human
auacaaaaauuagccgggcaugguggcgugca

SEQ ID NO: 64193 - RNA, 32 nt, Human
auacaaaaauuagccgggcaugguggcgugug

SEQ ID NO: 64194 - RNA, 32 nt, Human
auacaaaaauuagccgggcauggugguagggg

SEQ ID NO: 64195 - RNA, 32 nt, Human
auacaaaaauuagccgggcaugguggugcaca

SEQ ID NO: 64196 - RNA, 32 nt, Human
auacaaaaauuagccgggcaugguggugcacg

SEQ ID NO: 64197 - RNA, 32 nt, Human
auacaaaaauuagccgggcaugguggugcgua

SEQ ID NO: 64198 - RNA, 32 nt, Human
auacaaaaauuagccgggcaugguggugggca

SEQ ID NO: 64199 - RNA, 32 nt, Human
auacaaaaauuagccgggcaugguggugggcg

SEQ ID NO: 64200 - RNA, 32 nt, Human
auacaaaaauuagccgggcaugguggugggua

SEQ ID NO: 64201 - RNA, 32 nt, Human
auacaaaaauuagccgggcaugguggugugug

SEQ ID NO: 64202 - RNA, 32 nt, Human
auacaaaaauuagccgggcaugguguugcgug

SEQ ID NO: 64203 - RNA, 32 nt, Human
auacaaaaauuagccgugcaugguggugcacg

SEQ ID NO: 64204 - RNA, 32 nt, Human
auacaaaaauuagccuagcaugguggcgcaua

SEQ ID NO: 64205 - RNA, 32 nt, Human
auacaaaaauuagccuggcaugguggcaggcg

SEQ ID NO: 64206 - RNA, 32 nt, Human
auacaaaaauuagcuaggcaugguggcacacg

SEQ ID NO: 64207 - RNA, 32 nt, Human
auacaaaaauuagcuaggcaugguggcaggcg

SEQ ID NO: 64208 - RNA, 32 nt, Human
auacaaaaauuagcuaggcaugguggcgugca

SEQ ID NO: 64209 - RNA, 32 nt, Human
auacaaaaauuagcucagcaugguggcaugcg

SEQ ID NO: 64210 - RNA, 32 nt, Human
auacaaaaauuagcugagcgugguugcgcgcg

SEQ ID NO: 64211 - RNA, 32 nt, Human
auacaaaaauuagcugagugugguggcacaug

SEQ ID NO: 64212 - RNA, 32 nt, Human
auacaaaaauuagcugaucaugguggcacacg

SEQ ID NO: 64213 - RNA, 32 nt, Human
auacaaaaauuagcuggacaugguggcacgug

SEQ ID NO: 64214 - RNA, 32 nt, Human
auacaaaaauuagcuggacaugguggcgggcg

SEQ ID NO: 64215 - RNA, 32 nt, Human
auacaaaaauuagcuggacaugguggugcaug

SEQ ID NO: 64216 - RNA, 32 nt, Human
auacaaaaauuagcuggacgugguggugcaug

SEQ ID NO: 64217 - RNA, 32 nt, Human
auacaaaaauuagcuggacgugguggugugca

SEQ ID NO: 64218 - RNA, 32 nt, Human
auacaaaaauuagcuggauauggugguaugug

SEQ ID NO: 64219 - RNA, 32 nt, Human
auacaaaaauuagcuggaugugguggcacaca

SEQ ID NO: 64220 - RNA, 32 nt, Human
auacaaaaauuagcuggaugugguggcagugc

SEQ ID NO: 64221 - RNA, 32 nt, Human
auacaaaaauuagcuggcaugguggugugcac

SEQ ID NO: 64222 - RNA, 32 nt, Human
auacaaaaauuagcuggcugugguggugggca

SEQ ID NO: 64223 - RNA, 32 nt, Human
auacaaaaauuagcugggcacgguggcgggca

SEQ ID NO: 64224 - RNA, 32 nt, Human
auacaaaaauuagcugggcacgguggugcgug

SEQ ID NO: 64225 - RNA, 32 nt, Human
auacaaaaauuagcugggcauaguggcgggua

SEQ ID NO: 64226 - RNA, 32 nt, Human
auacaaaaauuagcugggcauaguggugcaug

SEQ ID NO: 64227 - RNA, 32 nt, Human
auacaaaaauuagcugggcaucauggcacaca

SEQ ID NO: 64228 - RNA, 32 nt, Human
auacaaaaauuagcugggcaugauggcaggca

SEQ ID NO: 64229 - RNA, 32 nt, Human
auacaaaaauuagcugggcaugauggcgagug

SEQ ID NO: 64230 - RNA, 32 nt, Human
auacaaaaauuagcugggcaugauggugcaug

SEQ ID NO: 64231 - RNA, 32 nt, Human
auacaaaaauuagcugggcauggcggcgugug

SEQ ID NO: 64232 - RNA, 32 nt, Human
auacaaaaauuagcugggcaugguagugcaug

SEQ ID NO: 64233 - RNA, 32 nt, Human
auacaaaaauuagcugggcauggugcgggcac

SEQ ID NO: 64234 - RNA, 32 nt, Human
auacaaaaauuagcugggcaugguggcaagag

SEQ ID NO: 64235 - RNA, 32 nt, Human
auacaaaaauuagcugggcaugguggcacaca

SEQ ID NO: 64236 - RNA, 32 nt, Human
auacaaaaauuagcugggcaugguggcacaug

SEQ ID NO: 64237 - RNA, 32 nt, Human
auacaaaaauuagcugggcaugguggcacccg

SEQ ID NO: 64238 - RNA, 32 nt, Human
auacaaaaauuagcugggcaugguggcaggcg

SEQ ID NO: 64239 - RNA, 32 nt, Human
auacaaaaauuagcugggcaugguggcaugcg

SEQ ID NO: 64240 - RNA, 32 nt, Human
auacaaaaauuagcugggcaugguggcgcacg

SEQ ID NO: 64241 - RNA, 32 nt, Human
auacaaaaauuagcugggcaugguggcgcaua

SEQ ID NO: 64242 - RNA, 32 nt, Human
auacaaaaauuagcugggcaugguggcgcaug

SEQ ID NO: 64243 - RNA, 32 nt, Human
auacaaaaauuagcugggcaugguggcgggca

SEQ ID NO: 64244 - RNA, 32 nt, Human
auacaaaaauuagcugggcaugguggcgggug

SEQ ID NO: 64245 - RNA, 32 nt, Human
auacaaaaauuagcugggcaugguggggcaug

SEQ ID NO: 64246 - RNA, 32 nt, Human
auacaaaaauuagcugggcaugguggugcaca

SEQ ID NO: 64247 - RNA, 32 nt, Human
auacaaaaauuagcugggcaugguggugcgug

SEQ ID NO: 64248 - RNA, 32 nt, Human
auacaaaaauuagcugggcaugguggugggac

SEQ ID NO: 64249 - RNA, 32 nt, Human
auacaaaaauuagcugggcaugguggugggcg

SEQ ID NO: 64250 - RNA, 32 nt, Human
auacaaaaauuagcugggcaugguggugugca

SEQ ID NO: 64251 - RNA, 32 nt, Human
auacaaaaauuagcugggcaugguggugugcg

SEQ ID NO: 64252 - RNA, 32 nt, Human
auacaaaaauuagcugggcaugguguugugca

SEQ ID NO: 64253 - RNA, 32 nt, Human
auacaaaaauuagcugggcaugguugcgugcg

SEQ ID NO: 64254 - RNA, 32 nt, Human
auacaaaaauuagcugggcauguuggcaugca

SEQ ID NO: 64255 - RNA, 32 nt, Human
auacaaaaauuagcugggcgcgguggugcaca

SEQ ID NO: 64256 - RNA, 32 nt, Human
auacaaaaauuagcugggcgggguggcacaca

SEQ ID NO: 64257 - RNA, 32 nt, Human
auacaaaaauuagcugggcgugauggcgagcg

SEQ ID NO: 64258 - RNA, 32 nt, Human
auacaaaaauuagcugggcgugauguugcuua

SEQ ID NO: 64259 - RNA, 32 nt, Human
auacaaaaauuagcugggcgugcuggcacgug

SEQ ID NO: 64260 - RNA, 32 nt, Human
auacaaaaauuagcugggcguggaggcgcgug

SEQ ID NO: 64261 - RNA, 32 nt, Human
auacaaaaauuagcugggcguggcggugcgca

SEQ ID NO: 64262 - RNA, 32 nt, Human
auacaaaaauuagcugggcgugguagugcaag

SEQ ID NO: 64263 - RNA, 32 nt, Human
auacaaaaauuagcugggcgugguagugcaug

SEQ ID NO: 64264 - RNA, 32 nt, Human
auacaaaaauuagcugggcgugguggcacaca

SEQ ID NO: 64265 - RNA, 32 nt, Human
auacaaaaauuagcugggcgugguggcacacg

SEQ ID NO: 64266 - RNA, 32 nt, Human
auacaaaaauuagcugggcgugguggcacaug

SEQ ID NO: 64267 - RNA, 32 nt, Human
auacaaaaauuagcugggcgugguggcacguu

SEQ ID NO: 64268 - RNA, 32 nt, Human
auacaaaaauuagcugggcgugguggcagaug

SEQ ID NO: 64269 - RNA, 32 nt, Human
auacaaaaauuagcugggcgugguggcaggca

SEQ ID NO: 64270 - RNA, 32 nt, Human
auacaaaaauuagcugggcgugguggcaugcg

SEQ ID NO: 64271 - RNA, 32 nt, Human
auacaaaaauuagcugggcgugguggcgcaug

SEQ ID NO: 64272 - RNA, 32 nt, Human
auacaaaaauuagcugggcgugguggcgggca

SEQ ID NO: 64273 - RNA, 32 nt, Human
auacaaaaauuagcugggcgugguggcgugca

SEQ ID NO: 64274 - RNA, 32 nt, Human
auacaaaaauuagcugggcgugguggcgugug

SEQ ID NO: 64275 - RNA, 32 nt, Human
auacaaaaauuagcugggcgugguggugcaug

SEQ ID NO: 64276 - RNA, 32 nt, Human
auacaaaaauuagcugggcgugguggugcgug

SEQ ID NO: 64277 - RNA, 32 nt, Human
auacaaaaauuagcugggcguggugguggaua

SEQ ID NO: 64278 - RNA, 32 nt, Human
auacaaaaauuagcugggcgugguggugggaa

SEQ ID NO: 64279 - RNA, 32 nt, Human
auacaaaaauuagcugggcgugguggugggcg

SEQ ID NO: 64280 - RNA, 32 nt, Human
auacaaaaauuagcugggcgugguggugggua

SEQ ID NO: 64281 - RNA, 32 nt, Human
auacaaaaauuagcugggcguggugguguacc

SEQ ID NO: 64282 - RNA, 32 nt, Human
auacaaaaauuagcugggcgugguugcacacg

SEQ ID NO: 64283 - RNA, 32 nt, Human
auacaaaaauuagcugggcguguuggcacaca

SEQ ID NO: 64284 - RNA, 32 nt, Human
auacaaaaauuagcugggcguguuggcacgcg

SEQ ID NO: 64285 - RNA, 32 nt, Human
auacaaaaauuagcugggcguuauggcgggcg

SEQ ID NO: 64286 - RNA, 32 nt, Human
auacaaaaauuagcugggcuucguggcgggua

SEQ ID NO: 64287 - RNA, 32 nt, Human
auacaaaaauuagcugggcuugguggcuggcg

SEQ ID NO: 64288 - RNA, 32 nt, Human
auacaaaaauuagcugggcuugguggugugag

SEQ ID NO: 64289 - RNA, 32 nt, Human
auacaaaaauuagcugggggugguggcaugcg

SEQ ID NO: 64290 - RNA, 32 nt, Human
auacaaaaauuagcugggguugguggcacaug

SEQ ID NO: 64291 - RNA, 32 nt, Human
auacaaaaauuagcuggguaugaugaugcacg

SEQ ID NO: 64292 - RNA, 32 nt, Human
auacaaaaauuagcuggguaugguggcacaua

SEQ ID NO: 64293 - RNA, 32 nt, Human
auacaaaaauuagcugggugcgguggcaggug

SEQ ID NO: 64294 - RNA, 32 nt, Human
auacaaaaauuagcuggguguaguggcaugcg

SEQ ID NO: 64295 - RNA, 32 nt, Human
auacaaaaauuagcuggguguaguggcgggug

SEQ ID NO: 64296 - RNA, 32 nt, Human
auacaaaaauuagcuggguguauggcgcccac

SEQ ID NO: 64297 - RNA, 32 nt, Human
auacaaaaauuagcugggugugauggccacuu

SEQ ID NO: 64298 - RNA, 32 nt, Human
auacaaaaauuagcugggugugauggugcaca

SEQ ID NO: 64299 - RNA, 32 nt, Human
auacaaaaauuagcuggguguggugacaggcg

SEQ ID NO: 64300 - RNA, 32 nt, Human
auacaaaaauuagcuggguguggugccacaug

SEQ ID NO: 64301 - RNA, 32 nt, Human
auacaaaaauuagcugggugugguggcacaca

SEQ ID NO: 64302 - RNA, 32 nt, Human
auacaaaaauuagcugggugugguggcacacg

SEQ ID NO: 64303 - RNA, 32 nt, Human
auacaaaaauuagcugggugugguggcacaug

SEQ ID NO: 64304 - RNA, 32 nt, Human
auacaaaaauuagcugggugugguggcacgug

SEQ ID NO: 64305 - RNA, 32 nt, Human
auacaaaaauuagcugggugugguggcaggca

SEQ ID NO: 64306 - RNA, 32 nt, Human
auacaaaaauuagcugggugugguggcauacg

SEQ ID NO: 64307 - RNA, 32 nt, Human
auacaaaaauuagcugggugugguggcaugcg

SEQ ID NO: 64308 - RNA, 32 nt, Human
auacaaaaauuagcugggugugguggcggcgc

SEQ ID NO: 64309 - RNA, 32 nt, Human
auacaaaaauuagcugggugugguggcgggca

SEQ ID NO: 64310 - RNA, 32 nt, Human
auacaaaaauuagcugggugugguggcgggug

SEQ ID NO: 64311 - RNA, 32 nt, Human
auacaaaaauuagcugggugugguggcgugcg

SEQ ID NO: 64312 - RNA, 32 nt, Human
auacaaaaauuagcugggugugguggcgugug

SEQ ID NO: 64313 - RNA, 32 nt, Human
auacaaaaauuagcuggguguggugguacacg

SEQ ID NO: 64314 - RNA, 32 nt, Human
auacaaaaauuagcuggguguggugguaggca

SEQ ID NO: 64315 - RNA, 32 nt, Human
auacaaaaauuagcuggguguggugguaugug

SEQ ID NO: 64316 - RNA, 32 nt, Human
auacaaaaauuagcugggugugguggugcaca

SEQ ID NO: 64317 - RNA, 32 nt, Human
auacaaaaauuagcugggugugguggugcacg

SEQ ID NO: 64318 - RNA, 32 nt, Human
auacaaaaauuagcugggugugguggugcaug

SEQ ID NO: 64319 - RNA, 32 nt, Human
auacaaaaauuagcugggugugguggugcgca

SEQ ID NO: 64320 - RNA, 32 nt, Human
auacaaaaauuagcugggugugguggugggca

SEQ ID NO: 64321 - RNA, 32 nt, Human
auacaaaaauuagcuggguguggugucagaug

SEQ ID NO: 64322 - RNA, 32 nt, Human
auacaaaaauuagcuggguguguuggugcaug

SEQ ID NO: 64323 - RNA, 32 nt, Human
auacaaaaauuagcuggucuugguggcgggcg

SEQ ID NO: 64324 - RNA, 32 nt, Human
auacaaaaauuagcugugcauagugguuggca

SEQ ID NO: 64325 - RNA, 32 nt, Human
auacaaaaauuagguggacaugguggcgagca

SEQ ID NO: 64326 - RNA, 32 nt, Human
auacaaaaauuagucaggcaugguggcacaug

SEQ ID NO: 64327 - RNA, 32 nt, Human
auacaaaaauuagucaggcaugguggugggcg

SEQ ID NO: 64328 - RNA, 32 nt, Human
auacaaaaauuaguucggcaugguggcaggcg

SEQ ID NO: 64329 - RNA, 32 nt, Human
auacaaaaauuaguugggcaugguggcacaca

SEQ ID NO: 64330 - RNA, 32 nt, Human
auacaaaaauuaguugggcaugguggugagca

SEQ ID NO: 64331 - RNA, 32 nt, Human
auacaaaaauuaguuggucauggugguguuca

SEQ ID NO: 64332 - RNA, 32 nt, Human
auacaaaaauuauccgggcaugguggcacaug

SEQ ID NO: 64333 - RNA, 32 nt, Human
auacaaaaauuaucugggcaugguggcacgug

SEQ ID NO: 64334 - RNA, 32 nt, Human
auacaaaaauuaucugggcaugguggugcaug

SEQ ID NO: 64335 - RNA, 32 nt, Human
auacaaaaauuggcugggcaugguggcgggug

SEQ ID NO: 64336 - RNA, 32 nt, Human
auacaaaaauuggucgggcauggugguggugc

SEQ ID NO: 64337 - RNA, 32 nt, Human
auacaaaaauuugcugggcaugguggcgcgug

SEQ ID NO: 64338 - RNA, 32 nt, Human
auacaaaaccucuccacuccacugaccuggug

SEQ ID NO: 64339 - RNA, 32 nt, Human
auacaaaacuuagcugggcgugguggcaugca

SEQ ID NO: 64340 - RNA, 32 nt, Human
auacaaaacuuagcugggugugguggugugau

SEQ ID NO: 64341 - RNA, 32 nt, Human
auacaaaaggggagguuuuagacaggcucccu

SEQ ID NO: 64342 - RNA, 32 nt, Human
auacaaaaguuagcugagcaugguggcgugug

SEQ ID NO: 64343 - RNA, 32 nt, Human
auacaaaaguuagcuggggcugguggugggca

SEQ ID NO: 64344 - RNA, 32 nt, Human
auacaaaaguuagcugggugugguggcagagg

SEQ ID NO: 64345 - RNA, 32 nt, Human
auacaaaaguuagcugggugugguggugugca

SEQ ID NO: 64346 - RNA, 32 nt, Human
auacaaaaguuagucgggcaugguggcgcgcc

SEQ ID NO: 64347 - RNA, 32 nt, Human
auacaaaaugugagccaggaaacccaguuuuu

SEQ ID NO: 64348 - RNA, 32 nt, Human
auacaaaauuuagccaggcaugguggcacaca

SEQ ID NO: 64349 - RNA, 32 nt, Human
auacaaaauuuagccaggcaugguggcaugca

SEQ ID NO: 64350 - RNA, 32 nt, Human
auacaaaauuuagcugggcaugguggcgugcc

SEQ ID NO: 64351 - RNA, 32 nt, Human
auacaaacaaaggacuuucucucccagcaaau

SEQ ID NO: 64352 - RNA, 32 nt, Human
auacaaacaaaugaauuuaaauacaaaaauua

SEQ ID NO: 64353 - RNA, 32 nt, Human
auacaaacaacaaaauuaucuauuuuccagag

SEQ ID NO: 64354 - RNA, 32 nt, Human
auacaaacagaauuugaucagcuuagaagcau

SEQ ID NO: 64355 - RNA, 32 nt, Human
auacaaacauuagccgggcaugguggcacgca

SEQ ID NO: 64356 - RNA, 32 nt, Human
auacaaaccacaugucuaacacuugcuaccuc

SEQ ID NO: 64357 - RNA, 32 nt, Human
auacaaaccgcgccacuauuccugccugucau

SEQ ID NO: 64358 - RNA, 32 nt, Human
auacaaacucaggccugcagaggcucugagga

SEQ ID NO: 64359 - RNA, 23 nt, Human
auacaaacuugccuuauuuucua

SEQ ID NO: 64360 - RNA, 32 nt, Human
auacaaagaaaggucagagaaaugcaugggaa

SEQ ID NO: 64361 - RNA, 18 nt, Human
auacaaagccacugccuc

SEQ ID NO: 64362 - RNA, 22 nt, Human
auacaaaguauacauacaguau

SEQ ID NO: 64363 - RNA, 17 nt, Human
auacaaagucacccuca

SEQ ID NO: 64364 - RNA, 24 nt, Human
auacaaaguguuaauaugugucau

SEQ ID NO: 64365 - RNA, 24 nt, Human
auacaaauaaaaacaauacagcau

SEQ ID NO: 64366 - RNA, 32 nt, Human
auacaaauaauguuguaauuaacucaaauuac

SEQ ID NO: 64367 - RNA, 19 nt, Human
auacaaauacacaauccuc

SEQ ID NO: 64368 - RNA, 18 nt, Human
auacaaauacuugguuca

SEQ ID NO: 64369 - RNA, 16 nt, Human
auacaaauauaccuua

SEQ ID NO: 64370 - RNA, 18 nt, Human
auacaaauauauuccuua

SEQ ID NO: 64371 - RNA, 19 nt, Human
auacaaauauccuacuuca

SEQ ID NO: 64372 - RNA, 17 nt, Human
auacaaauauuaccuca

SEQ ID NO: 64373 - RNA, 32 nt, Human
auacaaauauuagccgggcaugguggcgggcg

SEQ ID NO: 64374 - RNA, 32 nt, Human
auacaaauauuagcuggauaugguggugggca

SEQ ID NO: 64375 - RNA, 32 nt, Human
auacaaauauuagcugggcaugaugaugggcc

SEQ ID NO: 64376 - RNA, 32 nt, Human
auacaaauauuagcugggcgugguggcaggug

SEQ ID NO: 64377 - RNA, 32 nt, Human
auacaaaucucuuaaggagguggaccccaagu

SEQ ID NO: 64378 - RNA, 18 nt, Human
auacaaaugcaugacuca

SEQ ID NO: 64379 - RNA, 19 nt, Human
auacaaauguuccuccuca

SEQ ID NO: 64380 - RNA, 17 nt, Human
auacaaauuauuuccuc

SEQ ID NO: 64381 - RNA, 32 nt, Human
auacaacaggaaagguccaaauucacccucug

SEQ ID NO: 64382 - RNA, 32 nt, Human
auacaacaggugaacggguuucugccacaucu

SEQ ID NO: 64383 - RNA, 32 nt, Human
auacaacagugaucugaaaagaccaaaaagag

SEQ ID NO: 64384 - RNA, 32 nt, Human
auacaacaguuagucgggcaugguggugcaca

SEQ ID NO: 64385 - RNA, 32 nt, Human
auacaacucugugaccauggccagcaggaagc

SEQ ID NO: 64386 - RNA, 32 nt, Human
auacaacuguauugggggaaauucagccagac

SEQ ID NO: 64387 - RNA, 32 nt, Human
auacaacuguuugaauuccagaaggaccaaca

SEQ ID NO: 64388 - RNA, 21 nt, Human
auacaagaaagaaaccucaca

SEQ ID NO: 64389 - RNA, 21 nt, Human
auacaagaaccuuuuauuuuc

SEQ ID NO: 64390 - RNA, 32 nt, Human
auacaagaauuagcugggcgugguggcgugug

SEQ ID NO: 64391 - RNA, 32 nt, Human
auacaagaauuagcugggugugguggcaugug

SEQ ID NO: 64392 - RNA, 32 nt, Human
auacaagaauuagcugggugugguggcgcaug

SEQ ID NO: 64393 - RNA, 32 nt, Human
auacaagagaagaggaagggagcagagagcac

SEQ ID NO: 64394 - RNA, 32 nt, Human
auacaagcaagaagcuuacagccucaguggcg

SEQ ID NO: 64395 - RNA, 32 nt, Human
auacaagcauuaaacuggagugcaguaaaccu

SEQ ID NO: 64396 - RNA, 32 nt, Human
auacaagccaaaacaggaauauuucuccacag

SEQ ID NO: 64397 - RNA, 32 nt, Human
auacaagcccgaggaaugaggaagagaagaca

SEQ ID NO: 64398 - RNA, 32 nt, Human
auacaagccucuggugggcagagaggauagua

SEQ ID NO: 64399 - RNA, 32 nt, Human
auacaagccuuaccaacaauuacagaaacauu

SEQ ID NO: 64400 - RNA, 32 nt, Human
auacaaggauuagcugggcaugguggugugug

SEQ ID NO: 64401 - RNA, 32 nt, Human
auacaaggcucaauuccgaacuguugaaggaa

SEQ ID NO: 64402 - RNA, 32 nt, Human
auacaagguggggaaaucuggaaaaagauuuc

SEQ ID NO: 64403 - RNA, 32 nt, Human
auacaaggugugaauuugagcacaguccagaa

SEQ ID NO: 64404 - RNA, 32 nt, Human
auacaagguuaguccuucaugguauaaucuua

SEQ ID NO: 64405 - RNA, 32 nt, Human
auacaaguaggaacuuccuuuccuucacuucc

SEQ ID NO: 64406 - RNA, 32 nt, Human
auacaaguagugcagaagguucacacugcaaa

SEQ ID NO: 64407 - RNA, 18 nt, Human
auacaagucaaugcccca

SEQ ID NO: 64408 - RNA, 32 nt, Human
auacaagucucuguaccagcgcuuuauguuaa

SEQ ID NO: 64409 - RNA, 32 nt, Human
auacaagugacaugcugugcucaguauugugu

SEQ ID NO: 64410 - RNA, 32 nt, Human
auacaagugccccagagcgcauguauaugucu

SEQ ID NO: 64411 - RNA, 32 nt, Human
auacaaguuaggagcauugauaacaacacguu

SEQ ID NO: 64412 - RNA, 32 nt, Human
auacaaguuguuaggccaggugcaauggcucg

SEQ ID NO: 64413 - RNA, 32 nt, Human
auacaaguuucaugaggacagggacuuuaucc

SEQ ID NO: 64414 - RNA, 32 nt, Human
auacaauaaagugguggucucaauuaucccca

SEQ ID NO: 64415 - RNA, 32 nt, Human
auacaauaauuagccaggcaugguggcgggca

SEQ ID NO: 64416 - RNA, 32 nt, Human
auacaauaauuagcugggcgugguggcacaug

SEQ ID NO: 64417 - RNA, 32 nt, Human
auacaauaauuagcugggcgugguggcaggca

SEQ ID NO: 64418 - RNA, 19 nt, Human
auacaauacaccugcuuca

SEQ ID NO: 64419 - RNA, 32 nt, Human
auacaauacaugcacgugcacacacauacaca

SEQ ID NO: 64420 - RNA, 32 nt, Human
auacaauauaauaaaugcauaauguuaagcuu

SEQ ID NO: 64421 - RNA, 32 nt, Human
auacaauauagacugaaaauuuuaaauaugua

SEQ ID NO: 64422 - RNA, 32 nt, Human
auacaaucacagacuuauauuuccucacaaaa

SEQ ID NO: 64423 - RNA, 32 nt, Human
auacaauccuacagcagcaggagcuguggaga

SEQ ID NO: 64424 - RNA, 32 nt, Human
auacaaucuuggacaaccuccaucuucagaau

SEQ ID NO: 64425 - RNA, 18 nt, Human
auacaaugcauuuccuca

SEQ ID NO: 64426 - RNA, 18 nt, Human
auacaaugcggaugccca

SEQ ID NO: 64427 - RNA, 32 nt, Human
auacaauggaaagaugaaaauggaaaggaaga

SEQ ID NO: 64428 - RNA, 32 nt, Human
auacaauggaaaugugaauaaagaauuuacua

SEQ ID NO: 64429 - RNA, 32 nt, Human
auacaauguuugauuuuaugcacuuugucgcu

SEQ ID NO: 64430 - RNA, 32 nt, Human
auacaauucaacauuuguuuuauacguaaucu

SEQ ID NO: 64431 - RNA, 31 nt, Human
auacaauugcaaguauuaacagcagaguaga

SEQ ID NO: 64432 - RNA, 32 nt, Human
auacaauuggugauauuuuacaagaagagaga

SEQ ID NO: 64433 - RNA, 32 nt, Human
auacacaaaaggaaagagaaauggagcagcug

SEQ ID NO: 64434 - RNA, 32 nt, Human
auacacaaauuagcugcgugugguggccuaug

SEQ ID NO: 64435 - RNA, 19 nt, Human
auacacaacaacauaggga

SEQ ID NO: 64436 - RNA, 21 nt, Human
auacacaacagauaaugugga

SEQ ID NO: 64437 - RNA, 20 nt, Human
auacacaagaaaaacagaga

SEQ ID NO: 64438 - RNA, 18 nt, Human
auacacaagaucuguguc

SEQ ID NO: 64439 - RNA, 21 nt, Human
auacacaagucauacaggaga

SEQ ID NO: 64440 - RNA, 25 nt, Human
auacacaaucugcaccaaacaggga

SEQ ID NO: 64441 - RNA, 19 nt, Human
auacacacacaaauacaca

SEQ ID NO: 64442 - RNA, 22 nt, Human
auacacacacauauuuuacaca

SEQ ID NO: 64443 - RNA, 32 nt, Human
auacacacacgguucuucuagacugggggagu

SEQ ID NO: 64444 - RNA, 19 nt, Human
auacacacagacauacaca

SEQ ID NO: 64445 - RNA, 32 nt, Human
auacacacagcagugugaauagccuggccacc

SEQ ID NO: 64446 - RNA, 23 nt, Human
auacacacauacauacauacaua

SEQ ID NO: 64447 - RNA, 19 nt, Human
auacacacaugugcacaca

SEQ ID NO: 64448 - RNA, 23 nt, Human
auacacacgcaucuguacacaca

SEQ ID NO: 64449 - RNA, 32 nt, Human
auacacagacacaagacacacacgcucaaacc

SEQ ID NO: 64450 - RNA, 32 nt, Human
auacacagaguguggaggcagggaggucgagu

SEQ ID NO: 64451 - RNA, 32 nt, Human
auacacagauuuuucugcuggccaggugggcc

SEQ ID NO: 64452 - RNA, 18 nt, Human
auacacagcacacaggga

SEQ ID NO: 64453 - RNA, 32 nt, Human
auacacagccugggcuggggguggggugggag

SEQ ID NO: 64454 - RNA, 25 nt, Human
auacacaggcauacaugcaugcaca

SEQ ID NO: 64455 - RNA, 32 nt, Human
auacacauaauacaaacauacaugcaugcaca

SEQ ID NO: 64456 - RNA, 32 nt, Human
auacacauaaugagaccuuggggaugggaccc

SEQ ID NO: 64457 - RNA, 23 nt, Human
auacacauauacauacauacaca

SEQ ID NO: 64458 - RNA, 32 nt, Human
auacacauauacauacauacacacauacauac

SEQ ID NO: 64459 - RNA, 21 nt, Human
auacacauauauacacacaca

SEQ ID NO: 64460 - RNA, 21 nt, Human
auacacauauauguauacaua

SEQ ID NO: 64461 - RNA, 32 nt, Human
auacacauaugcagacacaugccagggccccc

SEQ ID NO: 64462 - RNA, 32 nt, Human
auacacaugcugggccauugugauugaagucu

SEQ ID NO: 64463 - RNA, 32 nt, Human
auacacaugcuugcaguaguuucaugaaguuu

SEQ ID NO: 64464 - RNA, 23 nt, Human
auacacauuaaucagauaucauu

SEQ ID NO: 64465 - RNA, 21 nt, Human
auacacauuauuccaccaauu

SEQ ID NO: 64466 - RNA, 32 nt, Human
auacacauucuucuccuagcacauggaucuuu

SEQ ID NO: 64467 - RNA, 32 nt, Human
auacacauuuaagacagugaggaugugaauaa

SEQ ID NO: 64468 - RNA, 32 nt, Human
auacacauuugucagcauuuccggucguggug

SEQ ID NO: 64469 - RNA, 32 nt, Human
auacaccaaucaggagaggguagcugccugca

SEQ ID NO: 64470 - RNA, 32 nt, Human
auacaccauugagacuugacugggcaacacca

SEQ ID NO: 64471 - RNA, 25 nt, Human
auacacccagaccccaggcuggaca

SEQ ID NO: 64472 - RNA, 32 nt, Human
auacacccagcagcccaagguggagggugcgu

SEQ ID NO: 64473 - RNA, 32 nt, Human
auacacccagcucuuuucaguaaaaggugaag

SEQ ID NO: 64474 - RNA, 32 nt, Human
auacacccauucccuuugcucacuauuuguuc

SEQ ID NO: 64475 - RNA, 18 nt, Human
auacaccgcccccugccc

SEQ ID NO: 64476 - RNA, 32 nt, Human
auacaccuaguucuguaugaucauaucauagu

SEQ ID NO: 64477 - RNA, 32 nt, Human
auacaccuguaauuccagcuacucauaggaua

SEQ ID NO: 64478 - RNA, 20 nt, Human
auacaccuguagucccagcu

SEQ ID NO: 64479 - RNA, 32 nt, Human
auacaccuguagucccagcuacucaggaggcu

SEQ ID NO: 64480 - RNA, 32 nt, Human
auacaccuguagucccagcuacucgggaggcu

SEQ ID NO: 64481 - RNA, 20 nt, Human
auacaccuguaguccuagcu

SEQ ID NO: 64482 - RNA, 32 nt, Human
auacaccuguaguccuagcuacucaggaggcu

SEQ ID NO: 64483 - RNA, 32 nt, Human
auacaccuguguucccagcuacucaggaggcu

SEQ ID NO: 64484 - RNA, 32 nt, Human
auacacgaacaacauggauggacugccaaaga

SEQ ID NO: 64485 - RNA, 32 nt, Human
auacacgguaacuuuucugccuugcagcauca

SEQ ID NO: 64486 - RNA, 32 nt, Human
auacacgugggggucagugaaucugcuugccu

SEQ ID NO: 64487 - RNA, 32 nt, Human
auacacuaaaaaucugagaaacucuacaugua

SEQ ID NO: 64488 - RNA, 22 nt, Human
auacacuaaaugaguaauucag

SEQ ID NO: 64489 - RNA, 32 nt, Human
auacacuaggaauccauucuuccuccaccauu

SEQ ID NO: 64490 - RNA, 32 nt, Human
auacacuaggagggcacagagaugcuacugaa

SEQ ID NO: 64491 - RNA, 32 nt, Human
auacacucagcuuuacaaaaucaugucauugu

SEQ ID NO: 64492 - RNA, 32 nt, Human
auacacucccuauugcuaacaagaccacagug

SEQ ID NO: 64493 - RNA, 32 nt, Human
auacacuccuucccuuccaucacugcagaccu

SEQ ID NO: 64494 - RNA, 32 nt, Human
auacacugcagcuuugccaaggucugugauau

SEQ ID NO: 64495 - RNA, 32 nt, Human
auacacugcaucuuuggucaucuaagauuugu

SEQ ID NO: 64496 - RNA, 32 nt, Human
auacacuggaccuauccuuuccucacugacag

SEQ ID NO: 64497 - RNA, 32 nt, Human
auacacuguuacuaucuuaaucucaagagugu

SEQ ID NO: 64498 - RNA, 32 nt, Human
auacacuguuccuagugagcagggcucuggcc

SEQ ID NO: 64499 - RNA, 20 nt, Human
auacacuguuucacugccuc

SEQ ID NO: 64500 - RNA, 32 nt, Human
auacacuuacacaccaucugauuuaaugacac

SEQ ID NO: 64501 - RNA, 32 nt, Human
auacacuuccacugccuucagcugacgucaca

SEQ ID NO: 64502 - RNA, 32 nt, Human
auacacuucucccauuuuguaucagguguguu

SEQ ID NO: 64503 - RNA, 32 nt, Human
auacacuuggcugggcaugccuguaaucccag

SEQ ID NO: 64504 - RNA, 32 nt, Human
auacacuuguagucccagcuacuuggcaggcu

SEQ ID NO: 64505 - RNA, 32 nt, Human
auacacuuguccaugauggauccacuuuaaag

SEQ ID NO: 64506 - RNA, 32 nt, Human
auacacuuuucccucacuacgacugcuucuuu

SEQ ID NO: 64507 - RNA, 32 nt, Human
auacacuuuucuugcuuuggugcucaaagugg

SEQ ID NO: 64508 - RNA, 32 nt, Human
auacagaaaagagguuuaauuggcucacaguu

SEQ ID NO: 64509 - RNA, 32 nt, Human
auacagaaaauacaaaaauuagccagguaugg

SEQ ID NO: 64510 - RNA, 32 nt, Human
auacagaaauuagccgggcauggugucgcgug

SEQ ID NO: 64511 - RNA, 32 nt, Human
auacagaaauuagccggucauggugguggaca

SEQ ID NO: 64512 - RNA, 32 nt, Human
auacagaaauuagcugggugugguugcacacg

SEQ ID NO: 64513 - RNA, 32 nt, Human
auacagaaggcuggucuuuacccuucuuccuc

SEQ ID NO: 64514 - RNA, 32 nt, Human
auacagaauucgacaccaaauuuuggaacuua

SEQ ID NO: 64515 - RNA, 32 nt, Human
auacagacaagaaaggcaaacucaccauggcc

SEQ ID NO: 64516 - RNA, 32 nt, Human
auacagacagguaaccuaguucuguguucacg

SEQ ID NO: 64517 - RNA, 32 nt, Human
auacagagagaaagaggagacacuccaggaag

SEQ ID NO: 64518 - RNA, 32 nt, Human
auacagagaguggauuuucuccccaaguccca

SEQ ID NO: 64519 - RNA, 32 nt, Human
auacagaggaaaggaaaaacaaguauuaaagg

SEQ ID NO: 64520 - RNA, 32 nt, Human
auacagaguagagcgaaggcauuugguggauc

SEQ ID NO: 64521 - RNA, 32 nt, Human
auacagauaauguucucacuacccauaauaug

SEQ ID NO: 64522 - RNA, 32 nt, Human
auacagcaaacagucaggauuaauccacaaga

SEQ ID NO: 64523 - RNA, 32 nt, Human
auacagcaaaugcugcucaucagcgucaaaau

SEQ ID NO: 64524 - RNA, 32 nt, Human
auacagcaacaacuaucuggcccaaacugcuu

SEQ ID NO: 64525 - RNA, 32 nt, Human
auacagcaaguugggcuugggaugauuauaac

SEQ ID NO: 64526 - RNA, 21 nt, Human
auacagcacuaaagucugcua

SEQ ID NO: 64527 - RNA, 32 nt, Human
auacagcagagcuagguggaaaagccuggguu

SEQ ID NO: 64528 - RNA, 32 nt, Human
auacagcaguccuucugggaaggaaauuuggg

SEQ ID NO: 64529 - RNA, 32 nt, Human
auacagcagucuugcucaaucuucccaguuuc

SEQ ID NO: 64530 - RNA, 31 nt, Human
auacagcagugagucaguuccuuggagaggg

SEQ ID NO: 64531 - RNA, 32 nt, Human
auacagcaucccaccucacaggcgaggaagcu

SEQ ID NO: 64532 - RNA, 32 nt, Human
auacagccaucuuuuagcaucuguaaacucau

SEQ ID NO: 64533 - RNA, 21 nt, Human
auacagcccuaaagucugcua

SEQ ID NO: 64534 - RNA, 32 nt, Human
auacagcgucagaaggaugccauaaccauucu

SEQ ID NO: 64535 - RNA, 32 nt, Human
auacagcuuauuaccuucaucauguccgugag

SEQ ID NO: 64536 - RNA, 32 nt, Human
auacagcuuggagagauuuuuguaucacauua

SEQ ID NO: 64537 - RNA, 32 nt, Human
auacaggaaguagcccugcaccugccagugag

SEQ ID NO: 64538 - RNA, 32 nt, Human
auacaggaauuagcuggucaugagggcgcaca

SEQ ID NO: 64539 - RNA, 32 nt, Human
auacaggagaagcacaagacagagaagggcca

SEQ ID NO: 64540 - RNA, 32 nt, Human
auacaggagaaugauggaaggaagggaggaag

SEQ ID NO: 64541 - RNA, 21 nt, Human
auacaggagagaaaccucaca

SEQ ID NO: 64542 - RNA, 32 nt, Human
auacaggagagaaaccuuacauaugugcugaa

SEQ ID NO: 64543 - RNA, 32 nt, Human
auacaggagcuggagucaaagcuggugagcaa

SEQ ID NO: 64544 - RNA, 32 nt, Human
auacaggaucugaauauuuacacacauagcac

SEQ ID NO: 64545 - RNA, 32 nt, Human
auacaggauggauacauaguuggcaacagucu

SEQ ID NO: 64546 - RNA, 32 nt, Human
auacaggcaagaagacaaaaaggagagaaaau

SEQ ID NO: 64547 - RNA, 32 nt, Human
auacaggcaccaagaggcggggguggagcagg

SEQ ID NO: 64548 - RNA, 32 nt, Human
auacaggcagcugcugcaagacugcuccucuc

SEQ ID NO: 64549 - RNA, 32 nt, Human
auacaggccagaggcagagagggcagcauaag

SEQ ID NO: 64550 - RNA, 32 nt, Human
auacaggccaggaaagccaaaugaagucauuu

SEQ ID NO: 64551 - RNA, 32 nt, Human
auacaggcgagugacugucaagaaggccaauu

SEQ ID NO: 64552 - RNA, 26 nt, Human
auacaggcgcacgccgcaccaccacg

SEQ ID NO: 64553 - RNA, 32 nt, Human
auacaggcuuucuaaacauuggcuuugcugga

SEQ ID NO: 64554 - RNA, 32 nt, Human
auacagggacuguuuccaggcacagaauauga

SEQ ID NO: 64555 - RNA, 32 nt, Human
auacagggaucaauaaaggcugaaaacuaagg

SEQ ID NO: 64556 - RNA, 32 nt, Human
auacaggggaaauguugaaaaggaagguggaa

SEQ ID NO: 64557 - RNA, 32 nt, Human
auacaggggaaugaugacaaccagcccagcca

SEQ ID NO: 64558 - RNA, 32 nt, Human
auacagguaguuuuaaaaguacccuuuugugu

SEQ ID NO: 64559 - RNA, 32 nt, Human
auacaggucuuccagucagcuggucauuuacc

SEQ ID NO: 64560 - RNA, 32 nt, Human
auacagguggcaauggaaaugggugaguggau

SEQ ID NO: 64561 - RNA, 32 nt, Human
auacaggugucaaacuccacuugacauuuacu

SEQ ID NO: 64562 - RNA, 32 nt, Human
auacaguaaaaacacaggagaagaagcugagc

SEQ ID NO: 64563 - RNA, 32 nt, Human
auacaguacagguuuguagccuaggaguccua

SEQ ID NO: 64564 - RNA, 32 nt, Human
auacaguacucaguuaggcagugcaguacuca

SEQ ID NO: 64565 - RNA, 32 nt, Human
auacaguacucuuuuauuuuucuuuuaauagc

SEQ ID NO: 64566 - RNA, 32 nt, Human
auacaguagcuggagggagucgaagcugaugg

SEQ ID NO: 64567 - RNA, 32 nt, Human
auacaguauaaauacucauuugauucucguaa

SEQ ID NO: 64568 - RNA, 32 nt, Human
auacaguccacuuucugguuucuuuuauugug

SEQ ID NO: 64569 - RNA, 19 nt, Human
auacagucugcagugcagc

SEQ ID NO: 64570 - RNA, 32 nt, Human
auacagucuucucuaguuucugaggugaauug

SEQ ID NO: 64571 - RNA, 32 nt, Human
auacagucuuucuccaucuuuggucuuauuac

SEQ ID NO: 64572 - RNA, 32 nt, Human
auacagugaauucccugggagucaucaaagaa

SEQ ID NO: 64573 - RNA, 32 nt, Human
auacagugagccagccuugcaguaggcaguag

SEQ ID NO: 64574 - RNA, 32 nt, Human
auacagugcauccuugaacugucagcccacag

SEQ ID NO: 64575 - RNA, 32 nt, Human
auacagugccuggagaaagccaaagaccuuua

SEQ ID NO: 64576 - RNA, 32 nt, Human
auacagugucuggaacuauugguucuaagaua

SEQ ID NO: 64577 - RNA, 29 nt, Human
auacagugucugugauguuuggaagcaaa

SEQ ID NO: 64578 - RNA, 19 nt, Human
auacaguugacacaccuca

SEQ ID NO: 64579 - RNA, 17 nt, Human
auacaguugcugccuua

SEQ ID NO: 64580 - RNA, 20 nt, Human
auacaguuuaaaaagccugc

SEQ ID NO: 64581 - RNA, 32 nt, Human
auacaguuuguacuuauuucaucaagcuuuuc

SEQ ID NO: 64582 - RNA, 32 nt, Human
auacauaaacuauaacaaacccugccauuuug

SEQ ID NO: 64583 - RNA, 32 nt, Human
auacauaaagagacaguaggacauuguggcug

SEQ ID NO: 64584 - RNA, 32 nt, Human
auacauaacuaaauuugauacuuauauuuucg

SEQ ID NO: 64585 - RNA, 32 nt, Human
auacauaauguuugauucuaugccauuuggac

SEQ ID NO: 64586 - RNA, 32 nt, Human
auacauaauuuggaauuguuuaagucuauuuc

SEQ ID NO: 64587 - RNA, 32 nt, Human
auacauacacagaaaaauaagcacauacucau

SEQ ID NO: 64588 - RNA, 21 nt, Human
auacauacacauauauacaca

SEQ ID NO: 64589 - RNA, 32 nt, Human
auacauacacucacugacauacacucaugugc

SEQ ID NO: 64590 - RNA, 32 nt, Human
auacauacauaauuuggaauuguuuaagucua

SEQ ID NO: 64591 - RNA, 19 nt, Human
auacauacauacauacaua

SEQ ID NO: 64592 - RNA, 32 nt, Human
auacauacccuagcaacauucuccuugcucag

SEQ ID NO: 64593 - RNA, 32 nt, Human
auacauacgugcacacacacauacauauucau

SEQ ID NO: 64594 - RNA, 32 nt, Human
auacauagaauguauaauauauacaaacuguu

SEQ ID NO: 64595 - RNA, 32 nt, Human
auacauagagacaccgaggagccucaguucug

SEQ ID NO: 64596 - RNA, 32 nt, Human
auacauaggagugggagccgaggaccacuugu

SEQ ID NO: 64597 - RNA, 32 nt, Human
auacauagucaaggguuuagagucuggagaca

SEQ ID NO: 64598 - RNA, 32 nt, Human
auacauauacaugcauagaaaugaaaugcuau

SEQ ID NO: 64599 - RNA, 32 nt, Human
auacauaugaauauagacaaaaagccauugag

SEQ ID NO: 64600 - RNA, 20 nt, Human
auacauaugcagucuaguca

SEQ ID NO: 64601 - RNA, 32 nt, Human
auacauaugugugcuuucucuuuccuuuuagg

SEQ ID NO: 64602 - RNA, 32 nt, Human
auacauauugaauaggccugaucaucugaauc

SEQ ID NO: 64603 - RNA, 19 nt, Human
auacaucacauuauacaca

SEQ ID NO: 64604 - RNA, 32 nt, Human
auacaucagcuugguaguuaacacaucaaaua

SEQ ID NO: 64605 - RNA, 21 nt, Human
auacaucagugggaaauuugg

SEQ ID NO: 64606 - RNA, 32 nt, Human
auacaucauccagcugagcggacugcuccaag

SEQ ID NO: 64607 - RNA, 32 nt, Human
auacauccauauaacauauaucacaaacuuaa

SEQ ID NO: 64608 - RNA, 32 nt, Human
auacaucccacacaccauccuccaggucuggg

SEQ ID NO: 64609 - RNA, 32 nt, Human
auacauccugcuuucccuccccaaacccauca

SEQ ID NO: 64610 - RNA, 32 nt, Human
auacauccugggaaggacccuacccagucauu

SEQ ID NO: 64611 - RNA, 32 nt, Human
auacaucucaaugucauuccuuucacaggucc

SEQ ID NO: 64612 - RNA, 32 nt, Human
auacaucucgcugcgaauacaggcagccaagg

SEQ ID NO: 64613 - RNA, 32 nt, Human
auacaucugugaccugaugguggagaacaaga

SEQ ID NO: 64614 - RNA, 32 nt, Human
auacaucuguuuauaggaaugaccucaggacu

SEQ ID NO: 64615 - RNA, 32 nt, Human
auacaucuuagagucuagggcagcaguccaua

SEQ ID NO: 64616 - RNA, 32 nt, Human
auacaugagauaaagaccucaagaaguuaaaa

SEQ ID NO: 64617 - RNA, 32 nt, Human
auacaugauaauagcaauccuugaugagugcc

SEQ ID NO: 64618 - RNA, 32 nt, Human
auacaugauacuuggguagcucaacauucuua

SEQ ID NO: 64619 - RNA, 18 nt, Human
auacaugcaaccaucacc

SEQ ID NO: 64620 - RNA, 32 nt, Human
auacaugcacacaaacaaaauguuuuaaaaug

SEQ ID NO: 64621 - RNA, 32 nt, Human
auacaugcacacugauacauacauguacugau

SEQ ID NO: 64622 - RNA, 32 nt, Human
auacaugcaucuuuaucagcagccaaaacacu

SEQ ID NO: 64623 - RNA, 32 nt, Human
auacaugccuuccuuucuacugcugcacaacc

SEQ ID NO: 64624 - RNA, 32 nt, Human
auacaugcucacaucuuacucaacaucagaga

SEQ ID NO: 64625 - RNA, 32 nt, Human
auacaugcucagguagagaaagucuccauagu

SEQ ID NO: 64626 - RNA, 32 nt, Human
auacaugcuggagcccugccucuccacugcua

SEQ ID NO: 64627 - RNA, 32 nt, Human
auacaugcuggucauaacugugccaagaaauc

SEQ ID NO: 64628 - RNA, 32 nt, Human
auacaugcuguaauuugacauucugggucaca

SEQ ID NO: 64629 - RNA, 32 nt, Human
auacaugcuuggucuucucugcagagaacuga

SEQ ID NO: 64630 - RNA, 32 nt, Human
auacauggacagcauccgguugauaugcucua

SEQ ID NO: 64631 - RNA, 22 nt, Human
auacauggaugaauugggguaa

SEQ ID NO: 64632 - RNA, 32 nt, Human
auacaugguagacggaauauuucuccauuaau

SEQ ID NO: 64633 - RNA, 32 nt, Human
auacauguaaagcauuuaaagccagaccuggc

SEQ ID NO: 64634 - RNA, 23 nt, Human
auacauguaauauauauuauaua

SEQ ID NO: 64635 - RNA, 32 nt, Human
auacauguauucucagguacacacagagcuga

SEQ ID NO: 64636 - RNA, 32 nt, Human
auacauguauuguguuuuccauggugcuacag

SEQ ID NO: 64637 - RNA, 29 nt, Human
auacaugucaugccagggaaaugcucgag

SEQ ID NO: 64638 - RNA, 32 nt, Human
auacaugugcauguucgucacaggguauauug

SEQ ID NO: 64639 - RNA, 32 nt, Human
auacaugugugacuuggccauuucugugagau

SEQ ID NO: 64640 - RNA, 32 nt, Human
auacaugugugugaaaccauuccaaaaauuua

SEQ ID NO: 64641 - RNA, 32 nt, Human
auacauuagccugucccuuucugccuuaaacc

SEQ ID NO: 64642 - RNA, 23 nt, Human
auacauuaguucccccucagcua

SEQ ID NO: 64643 - RNA, 19 nt, Human
auacauucacaucuaguca

SEQ ID NO: 64644 - RNA, 21 nt, Human
auacauucauauauauacaua

SEQ ID NO: 64645 - RNA, 32 nt, Human
auacauucauugucuucagucauacagcaaga

SEQ ID NO: 64646 - RNA, 32 nt, Human
auacauuccugagauucugggaaaggugcuca

SEQ ID NO: 64647 - RNA, 32 nt, Human
auacauugaaggaguguaggggguggggguuc

SEQ ID NO: 64648 - RNA, 32 nt, Human
auacauugaccuuccauucacugcagugggaa

SEQ ID NO: 64649 - RNA, 32 nt, Human
auacauugacuaggaagaacuaaacaagacca

SEQ ID NO: 64650 - RNA, 32 nt, Human
auacauugauacaaaguacagaaaaauacuuu

SEQ ID NO: 64651 - RNA, 32 nt, Human
auacauugccuaggugcagagaaauggaagua

SEQ ID NO: 64652 - RNA, 32 nt, Human
auacauugcggaggacaccagugagcuuccac

SEQ ID NO: 64653 - RNA, 32 nt, Human
auacauugcuauauacauaaaaaugguaacaa

SEQ ID NO: 64654 - RNA, 21 nt, Human
auacauuggagaaacuggcag

SEQ ID NO: 64655 - RNA, 20 nt, Human
auacauuuaauuguuguaag

SEQ ID NO: 64656 - RNA, 21 nt, Human
auacauuuauuuccauuauca

SEQ ID NO: 64657 - RNA, 32 nt, Human
auacauuugaaccacuaccauuuuugaaguuu

SEQ ID NO: 64658 - RNA, 32 nt, Human
auacauuuguuccaauggggagcuuggaagau

SEQ ID NO: 64659 - RNA, 32 nt, Human
auaccaaaauguuuuguuucaccaggaggugc

SEQ ID NO: 64660 - RNA, 32 nt, Human
auaccaaaauuagcugggacugguggcacguu

SEQ ID NO: 64661 - RNA, 32 nt, Human
auaccaaaauuagcugggcaugguggcacgcg

SEQ ID NO: 64662 - RNA, 32 nt, Human
auaccaaaauuagcugggcaugguggcgcgug

SEQ ID NO: 64663 - RNA, 32 nt, Human
auaccaaaauuagcugggugugguggugcacg

SEQ ID NO: 64664 - RNA, 32 nt, Human
auaccaaacucagaauuggaacuuuuuacauu

SEQ ID NO: 64665 - RNA, 32 nt, Human
auaccaaagaaauaggggguagcuagaguaaa

SEQ ID NO: 64666 - RNA, 32 nt, Human
auaccaaagaggagguuuggcuuucugugggu

SEQ ID NO: 64667 - RNA, 32 nt, Human
auaccaaauacugaugaggauacaaacuggau

SEQ ID NO: 64668 - RNA, 32 nt, Human
auaccaaaugauagaaacagacugccugaauu

SEQ ID NO: 64669 - RNA, 32 nt, Human
auaccaacauuucugugcuuuuaccaacagca

SEQ ID NO: 64670 - RNA, 32 nt, Human
auaccaagaaagcuuccucuguggaaaucugu

SEQ ID NO: 64671 - RNA, 32 nt, Human
auaccaagaagagggagcugaaaaggaaaauu

SEQ ID NO: 64672 - RNA, 32 nt, Human
auaccaagcaugaccugaguguaaucucuaac

SEQ ID NO: 64673 - RNA, 23 nt, Human
auaccaagcuagccucguacacc

SEQ ID NO: 64674 - RNA, 32 nt, Human
auaccaagcugcaggcgagcugccgggcgcuu

SEQ ID NO: 64675 - RNA, 32 nt, Human
auaccaaggagaguggcauaggagggaaaagc

SEQ ID NO: 64676 - RNA, 32 nt, Human
auaccaaggaugaccuccuccgaucagguaug

SEQ ID NO: 64677 - RNA, 32 nt, Human
auaccaagugaaaaggaagagugaagaacaga

SEQ ID NO: 64678 - RNA, 32 nt, Human
auaccaaucaguuacacucaaagcuuucuugg

SEQ ID NO: 64679 - RNA, 32 nt, Human
auaccacagugggaaaaggaaagggaagaaag

SEQ ID NO: 64680 - RNA, 32 nt, Human
auaccacaucuucucacuuauagaugguagcu

SEQ ID NO: 64681 - RNA, 32 nt, Human
auaccaccaaggagccucaucgugugcuuuua

SEQ ID NO: 64682 - RNA, 32 nt, Human
auaccaccgcacuccagccugagcaacagagu

SEQ ID NO: 64683 - RNA, 31 nt, Human
auaccaccgugcucagugcacuugugcagga

SEQ ID NO: 64684 - RNA, 32 nt, Human
auaccaccucccaucagaaaucauguccuuga

SEQ ID NO: 64685 - RNA, 32 nt, Human
auaccacggcacuccagccugggugacaguga

SEQ ID NO: 64686 - RNA, 32 nt, Human
auaccacugcacuccagccuggcgacagagca

SEQ ID NO: 64687 - RNA, 32 nt, Human
auaccacugcacuccagccugggcgacagaga

SEQ ID NO: 64688 - RNA, 32 nt, Human
auaccacugcacuccagccugggugacagagc

SEQ ID NO: 64689 - RNA, 32 nt, Human
auaccacugcacuccagucugggcaacagagc

SEQ ID NO: 64690 - RNA, 32 nt, Human
auaccacugcacugcagccugagugacacagu

SEQ ID NO: 64691 - RNA, 32 nt, Human
auaccacugcacuuaacuuggcaacagagcaa

SEQ ID NO: 64692 - RNA, 32 nt, Human
auaccacugcauuccagccugggugacagagc

SEQ ID NO: 64693 - RNA, 32 nt, Human
auaccacuucauuccagccugggugacagagc

SEQ ID NO: 64694 - RNA, 32 nt, Human
auaccagaaggcggaucccccaagaccacagu

SEQ ID NO: 64695 - RNA, 32 nt, Human
auaccagagcauaucagcagaguaggagagca

SEQ ID NO: 64696 - RNA, 32 nt, Human
auaccagagugucagaaagaaagaaugagaac

SEQ ID NO: 64697 - RNA, 32 nt, Human
auaccagaguuagcuggguauagagguggcuc

SEQ ID NO: 64698 - RNA, 32 nt, Human
auaccagauccgggaagucucucuucaccucu

SEQ ID NO: 64699 - RNA, 32 nt, Human
auaccagaugccacucugcagguugcaauaac

SEQ ID NO: 64700 - RNA, 32 nt, Human
auaccagaugccuucuucaucaugccacugaa

SEQ ID NO: 64701 - RNA, 32 nt, Human
auaccagcaccaccuuugccuucagucuuccu

SEQ ID NO: 64702 - RNA, 32 nt, Human
auaccagcagcagccuuaagcacagggagacc

SEQ ID NO: 64703 - RNA, 32 nt, Human
auaccagccugaccaacauggagaaaccccau

SEQ ID NO: 64704 - RNA, 32 nt, Human
auaccagccugaccaacauggcgaaaccccgu

SEQ ID NO: 64705 - RNA, 32 nt, Human
auaccagccugaggugucucaggggaggcugg

SEQ ID NO: 64706 - RNA, 32 nt, Human
auaccagccugguucccugccuuugugccaac

SEQ ID NO: 64707 - RNA, 32 nt, Human
auaccagcuguaaucccagcuacuugggaggc

SEQ ID NO: 64708 - RNA, 32 nt, Human
auaccagcuuuuuccaauaaaauaacaaaugu

SEQ ID NO: 64709 - RNA, 32 nt, Human
auaccaggaccacugcauuuaccagccugaua

SEQ ID NO: 64710 - RNA, 32 nt, Human
auaccaggaggcagggaugcugggggucgugg

SEQ ID NO: 64711 - RNA, 32 nt, Human
auaccaggcuacaugugcccccggguuccuuc

SEQ ID NO: 64712 - RNA, 32 nt, Human
auaccagggcccagacagaggcagagaguccg

SEQ ID NO: 64713 - RNA, 32 nt, Human
auaccagguacagccuuuccacccucauccag

SEQ ID NO: 64714 - RNA, 32 nt, Human
auaccagugcauuccagccuggguacacagcg

SEQ ID NO: 64715 - RNA, 32 nt, Human
auaccaguggaccuggaguggcugguuggucu

SEQ ID NO: 64716 - RNA, 32 nt, Human
auaccaguucccaaacaaaccaucucuccauu

SEQ ID NO: 64717 - RNA, 32 nt, Human
auaccauaaaaauacauaaaaucugaugauga

SEQ ID NO: 64718 - RNA, 32 nt, Human
auaccauauuaccuugcuguuggguuguucug

SEQ ID NO: 64719 - RNA, 32 nt, Human
auaccaucugucauagcguuuaccucaacaca

SEQ ID NO: 64720 - RNA, 32 nt, Human
auaccaucuuguccugcugaaguaucuccaug

SEQ ID NO: 64721 - RNA, 32 nt, Human
auaccauggagaaugaccucagccuucugugu

SEQ ID NO: 64722 - RNA, 30 nt, Human
auaccauggccaagaaaguugcagugauug

SEQ ID NO: 64723 - RNA, 32 nt, Human
auaccauguuggacauuugccccuaucaguug

SEQ ID NO: 64724 - RNA, 32 nt, Human
auaccauugauaagaagaagauaaaaacaaaa

SEQ ID NO: 64725 - RNA, 32 nt, Human
auaccauugcacuccagccuaggcaacaagag

SEQ ID NO: 64726 - RNA, 32 nt, Human
auaccauugcacuccagccugggcaacaagag

SEQ ID NO: 64727 - RNA, 32 nt, Human
auaccauugcuucagacacuuucccaaaguuu

SEQ ID NO: 64728 - RNA, 32 nt, Human
auaccauuucuuccugacauuugucagugaug

SEQ ID NO: 64729 - RNA, 32 nt, Human
auacccaaagcucucugucaauuacaaggcuu

SEQ ID NO: 64730 - RNA, 21 nt, Human
auacccaaaucauuugcacuu

SEQ ID NO: 64731 - RNA, 32 nt, Human
auacccaacagaacaugacuguuucuuugagg

SEQ ID NO: 64732 - RNA, 32 nt, Human
auacccaacccugcccucaccuccagggccug

SEQ ID NO: 64733 - RNA, 32 nt, Human
auacccaacuauaccaucucucuacucuuuau

SEQ ID NO: 64734 - RNA, 32 nt, Human
auacccaagcagccugauggggcaguuccccu

SEQ ID NO: 64735 - RNA, 32 nt, Human
auacccacacagucacagucacacacacauau

SEQ ID NO: 64736 - RNA, 32 nt, Human
auacccacaugggaaaaaucccaggggauguu

SEQ ID NO: 64737 - RNA, 32 nt, Human
auacccaccucgggggcuugaggaucaaauga

SEQ ID NO: 64738 - RNA, 32 nt, Human
auacccaccucugcccuccucaccuuccaguc

SEQ ID NO: 64739 - RNA, 32 nt, Human
auacccacuccccuccccuuuuucauuccuuc

SEQ ID NO: 64740 - RNA, 32 nt, Human
auacccacugauaucaguaccuuaccaacucg

SEQ ID NO: 64741 - RNA, 32 nt, Human
auacccacugcccugaccccugggcaggcccc

SEQ ID NO: 64742 - RNA, 32 nt, Human
auacccagaugggaaggaaggagacagccgcg

SEQ ID NO: 64743 - RNA, 32 nt, Human
auacccagcuacucgggaggcugaggcagaau

SEQ ID NO: 64744 - RNA, 32 nt, Human
auacccagcuuugcaaguuuuguagauugacc

SEQ ID NO: 64745 - RNA, 32 nt, Human
auacccaggaagggaggcugucuggccagccu

SEQ ID NO: 64746 - RNA, 32 nt, Human
auacccaggcucuugagcaacagugagcugcc

SEQ ID NO: 64747 - RNA, 32 nt, Human
auacccagggaggggagcaacacacacugggg

SEQ ID NO: 64748 - RNA, 32 nt, Human
auacccaguuagcacaguagguggggagucug

SEQ ID NO: 64749 - RNA, 32 nt, Human
auacccaugaguacucaacuugccuugauguc

SEQ ID NO: 64750 - RNA, 32 nt, Human
auacccauucuuugggcucugaaguuuggaau

SEQ ID NO: 64751 - RNA, 32 nt, Human
auacccauuggaaugacaucaucccuccccaa

SEQ ID NO: 64752 - RNA, 32 nt, Human
auaccccacagcaaauagaguaacugacaaac

SEQ ID NO: 64753 - RNA, 32 nt, Human
auaccccacugggcacacgcacaaacacacac

SEQ ID NO: 64754 - RNA, 32 nt, Human
auaccccagaggcauauaauuucuuguauucu

SEQ ID NO: 64755 - RNA, 32 nt, Human
auaccccauagcuggggccagcagguucugcu

SEQ ID NO: 64756 - RNA, 32 nt, Human
auacccccacacaccagucuuuuuggggguuu

SEQ ID NO: 64757 - RNA, 32 nt, Human
auacccccuggcugggcuucauggagaaaucu

SEQ ID NO: 64758 - RNA, 32 nt, Human
auaccccucaacucauuugcucuaauaaauuu

SEQ ID NO: 64759 - RNA, 32 nt, Human
auaccccucacagccccugucauuccggaguc

SEQ ID NO: 64760 - RNA, 32 nt, Human
auaccccugaggguggcugccuccucuggucc

SEQ ID NO: 64761 - RNA, 32 nt, Human
auaccccuuccuccaaauuaacuauuugguga

SEQ ID NO: 64762 - RNA, 32 nt, Human
auacccggcuaauuuuguauuuuuauagagac

SEQ ID NO: 64763 - RNA, 32 nt, Human
auacccggcuucaugccagggugcaugccggg

SEQ ID NO: 64764 - RNA, 32 nt, Human
auacccguauggugauagcuggccuuuucgcg

SEQ ID NO: 64765 - RNA, 32 nt, Human
auacccuccuuuccuucuaccuaucuugccuu

SEQ ID NO: 64766 - RNA, 32 nt, Human
auacccucugccugaccaacauggugaaaccc

SEQ ID NO: 64767 - RNA, 32 nt, Human
auacccugaaaguguguccauugaaaggcaaa

SEQ ID NO: 64768 - RNA, 32 nt, Human
auacccugaaucuuaauuuaucucccauuauu

SEQ ID NO: 64769 - RNA, 32 nt, Human
auacccugaccuggcccccucaguguugucac

SEQ ID NO: 64770 - RNA, 32 nt, Human
auacccugagccaccucucucacuuucuuuag

SEQ ID NO: 64771 - RNA, 32 nt, Human
auacccugcaacugaguccaccuucagauggu

SEQ ID NO: 64772 - RNA, 32 nt, Human
auacccugcuucaccaaaauuccugcuucauu

SEQ ID NO: 64773 - RNA, 28 nt, Human
auacccuggaacacugccucauugucuu

SEQ ID NO: 64774 - RNA, 32 nt, Human
auacccuucaaacuuugagaguuuacaucaga

SEQ ID NO: 64775 - RNA, 32 nt, Human
auacccuucagccucugcuccacagagccuaa

SEQ ID NO: 64776 - RNA, 32 nt, Human
auaccgaggccuucccucccugaggcccgcaa

SEQ ID NO: 64777 - RNA, 32 nt, Human
auaccgccaucuuacacgaaagccacagaguu

SEQ ID NO: 64778 - RNA, 32 nt, Human
auaccgcucagcucaagagucugcaccccauc

SEQ ID NO: 64779 - RNA, 32 nt, Human
auaccggacccccauucgcaucuaacaaggaa

SEQ ID NO: 64780 - RNA, 32 nt, Human
auaccggagagaaaccuuacaaaugguguggu

SEQ ID NO: 64781 - RNA, 32 nt, Human
auaccggagagguucuggcaccauuucggggu

SEQ ID NO: 64782 - RNA, 32 nt, Human
auaccggcgggcugugacucugggcagggacc

SEQ ID NO: 64783 - RNA, 32 nt, Human
auaccgggaccacaguaucaguucacccgaca

SEQ ID NO: 64784 - RNA, 32 nt, Human
auaccggguacccgggcuauggcgccggcgca

SEQ ID NO: 64785 - RNA, 32 nt, Human
auaccgucaaaaccagcacuuaccaaacucag

SEQ ID NO: 64786 - RNA, 32 nt, Human
auaccguggaaaccaucaccucaggcucgucg

SEQ ID NO: 64787 - RNA, 32 nt, Human
auaccguggggugacuuccuggucaccaaggc

SEQ ID NO: 64788 - RNA, 32 nt, Human
auaccguucacagccaaaccacugacauuccu

SEQ ID NO: 64789 - RNA, 32 nt, Human
auaccuaacacauaguaaacacccaacaauuu

SEQ ID NO: 64790 - RNA, 32 nt, Human
auaccuaacucuucaauguccagacacugaug

SEQ ID NO: 64791 - RNA, 32 nt, Human
auaccuaaguacuguaauaauaccucaauguu

SEQ ID NO: 64792 - RNA, 31 nt, Human
auaccuacauucaaggagaggggaccaugca

SEQ ID NO: 64793 - RNA, 32 nt, Human
auaccuaccuccaggguuggcgugaggauuca

SEQ ID NO: 64794 - RNA, 32 nt, Human
auaccuacuucuaggauugcaaagggagucuu

SEQ ID NO: 64795 - RNA, 32 nt, Human
auaccuagcuaaaccaucuuucaagagaaagg

SEQ ID NO: 64796 - RNA, 32 nt, Human
auaccuagcugcagauugugccaucacccuuc

SEQ ID NO: 64797 - RNA, 32 nt, Human
auaccuaguuuauaccuguuauccuggaauaa

SEQ ID NO: 64798 - RNA, 31 nt, Human
auaccucacagcuuggccauuugaggcaaag

SEQ ID NO: 64799 - RNA, 32 nt, Human
auaccucacugcagccucuugggcuuauguga

SEQ ID NO: 64800 - RNA, 32 nt, Human
auaccucacugcagcuucaacuuccugggcuc

SEQ ID NO: 64801 - RNA, 32 nt, Human
auaccucagaugggagagagccagagagagga

SEQ ID NO: 64802 - RNA, 32 nt, Human
auaccucagugcagaggucacuuguggagcaa

SEQ ID NO: 64803 - RNA, 32 nt, Human
auaccuccagcagaguaaggagucugugugau

SEQ ID NO: 64804 - RNA, 32 nt, Human
auaccuccccuccacaucacugacacagcuga

SEQ ID NO: 64805 - RNA, 32 nt, Human
auaccucccuugugacucccacaucaaccauu

SEQ ID NO: 64806 - RNA, 32 nt, Human
auaccuccuccucccuucuuucuuugaagccu

SEQ ID NO: 64807 - RNA, 32 nt, Human
auaccuccugaccccucucucccucauguccu

SEQ ID NO: 64808 - RNA, 32 nt, Human
auaccuccuucaccccagaauauuugccgucu

SEQ ID NO: 64809 - RNA, 32 nt, Human
auaccucggaggucaaaaagaaauauuucaaa

SEQ ID NO: 64810 - RNA, 32 nt, Human
auaccucggccaugcggccccugcugcuacug

SEQ ID NO: 64811 - RNA, 32 nt, Human
auaccucgguccagaucuccggauugucgggg

SEQ ID NO: 64812 - RNA, 32 nt, Human
auaccucuaaugaagcacagagagaggaagag

SEQ ID NO: 64813 - RNA, 32 nt, Human
auaccucucccuucauuagagucaucaucucc

SEQ ID NO: 64814 - RNA, 32 nt, Human
auaccucucucugcagagagcuucuggguggg

SEQ ID NO: 64815 - RNA, 32 nt, Human
auaccucuggggacaggaaagguagaggauga

SEQ ID NO: 64816 - RNA, 32 nt, Human
auaccugaaaccaaaauggauauuuuuagucu

SEQ ID NO: 64817 - RNA, 32 nt, Human
auaccugacgaacugcagcccaggucccuggc

SEQ ID NO: 64818 - RNA, 32 nt, Human
auaccugcacuaaucauucagacuucauugag

SEQ ID NO: 64819 - RNA, 32 nt, Human
auaccugcagcaucuuuaucaaguuggaggag

SEQ ID NO: 64820 - RNA, 32 nt, Human
auaccugcagugagccaaggaccaggcuaguu

SEQ ID NO: 64821 - RNA, 32 nt, Human
auaccugccccagguuaucccauuucuguugu

SEQ ID NO: 64822 - RNA, 32 nt, Human
auaccugccugggauagccgcugguaacuguu

SEQ ID NO: 64823 - RNA, 32 nt, Human
auaccugcuguucucagcuccagcuucaaacc

SEQ ID NO: 64824 - RNA, 32 nt, Human
auaccugcuucaccaucuucucauaccaucac

SEQ ID NO: 64825 - RNA, 22 nt, Human
auaccugcuuuucaucuggaca

SEQ ID NO: 64826 - RNA, 32 nt, Human
auaccuggcugcugucuuaacucguagucugg

SEQ ID NO: 64827 - RNA, 32 nt, Human
auaccugggacaggccagggagccuuuagugc

SEQ ID NO: 64828 - RNA, 32 nt, Human
auaccugggaggaaggcuuuuccuucacaauu

SEQ ID NO: 64829 - RNA, 32 nt, Human
auaccugggaggcggagauugcagugagccga

SEQ ID NO: 64830 - RNA, 32 nt, Human
auaccuggggacuugauguuccuuccagauug

SEQ ID NO: 64831 - RNA, 32 nt, Human
auaccuggguggagcccacagaccagccccca

SEQ ID NO: 64832 - RNA, 32 nt, Human
auaccuggguuauuuccaggcauauaaugugc

SEQ ID NO: 64833 - RNA, 32 nt, Human
auaccuguaguuggaggaugaauacuggagac

SEQ ID NO: 64834 - RNA, 32 nt, Human
auaccugucuguucuuaaagauuucaugguug

SEQ ID NO: 64835 - RNA, 32 nt, Human
auaccugugccucggcuuuucucagcuggaug

SEQ ID NO: 64836 - RNA, 32 nt, Human
auaccuguguucagauuguaagaucuaguccg

SEQ ID NO: 64837 - RNA, 32 nt, Human
auaccuguguuuucauucucccccucucuccc

SEQ ID NO: 64838 - RNA, 32 nt, Human
auaccuguuuagaaccaaaaccaccaugacac

SEQ ID NO: 64839 - RNA, 32 nt, Human
auaccuguuuagaugauguagagcaagguaac

SEQ ID NO: 64840 - RNA, 32 nt, Human
auaccuuacuaaaaauuuaaaaucuaggaauu

SEQ ID NO: 64841 - RNA, 32 nt, Human
auaccuuagacagaggcuguccucuacacagg

SEQ ID NO: 64842 - RNA, 32 nt, Human
auaccuucaguuauuuacaugugaauaugagg

SEQ ID NO: 64843 - RNA, 32 nt, Human
auaccuuccaagcaaugcauuaccucccccag

SEQ ID NO: 64844 - RNA, 32 nt, Human
auaccuuccucuuccccuuuaccaaauaaagc

SEQ ID NO: 64845 - RNA, 32 nt, Human
auaccuucuguaacaguggcauucccuuaauu

SEQ ID NO: 64846 - RNA, 32 nt, Human
auaccuugaaaaaguagagaacagucaugagg

SEQ ID NO: 64847 - RNA, 32 nt, Human
auaccuugcccacuccuagagacagcugugcu

SEQ ID NO: 64848 - RNA, 32 nt, Human
auaccuuggggagggaguagggggacacgggg

SEQ ID NO: 64849 - RNA, 25 nt, Human
auaccuuguguuuuguuuugauuua

SEQ ID NO: 64850 - RNA, 32 nt, Human
auaccuuuaaucuuguuuuucaugaucaucau

SEQ ID NO: 64851 - RNA, 23 nt, Human
auaccuuuaucauuccugagaca

SEQ ID NO: 64852 - RNA, 19 nt, Human
auaccuuucuaagggaaaa

SEQ ID NO: 64853 - RNA, 32 nt, Human
auaccuuucuccugagagacugaagaaucucu

SEQ ID NO: 64854 - RNA, 32 nt, Human
auaccuuugccucuccgguaagcucccuugcu

SEQ ID NO: 64855 - RNA, 23 nt, Human
auaccuuugggcugccugggaca

SEQ ID NO: 64856 - RNA, 32 nt, Human
auaccuuugugaaguugcccaccaaaacacag

SEQ ID NO: 64857 - RNA, 32 nt, Human
auaccuuuugcaccucagcugccacaccuaua

SEQ ID NO: 64858 - RNA, 32 nt, Human
auacgaaaauuagcugggcgugguggugggca

SEQ ID NO: 64859 - RNA, 32 nt, Human
auacgaaaauuagcugggugugauggcgcaug

SEQ ID NO: 64860 - RNA, 32 nt, Human
auacgaaacuuagcugggcgugguggugugug

SEQ ID NO: 64861 - RNA, 32 nt, Human
auacgaaagcacacaaaacacuccaaguuuca

SEQ ID NO: 64862 - RNA, 32 nt, Human
auacgaaaguuagucgggcaugguggcaugca

SEQ ID NO: 64863 - RNA, 32 nt, Human
auacgaacauuagcugggucugauggugugca

SEQ ID NO: 64864 - RNA, 32 nt, Human
auacgaacugcgccauggagaggagaggcacu

SEQ ID NO: 64865 - RNA, 32 nt, Human
auacgaagcccucuugcaaaguagccucuuuc

SEQ ID NO: 64866 - RNA, 32 nt, Human
auacgaaggggcagcuacauuccacgacuuuu

SEQ ID NO: 64867 - RNA, 32 nt, Human
auacgaaucucuuaaggggguggaccccaagu

SEQ ID NO: 64868 - RNA, 32 nt, Human
auacgaaugugggcauacucagagaccauccc

SEQ ID NO: 64869 - RNA, 32 nt, Human
auacgacccugaggaggaguacgacccggaga

SEQ ID NO: 64870 - RNA, 32 nt, Human
auacgacuugcagugagcgucaggagcacguc

SEQ ID NO: 64871 - RNA, 32 nt, Human
auacgagaaacugccucccugcuucgggucag

SEQ ID NO: 64872 - RNA, 32 nt, Human
auacgaggaugcuauaggucuccagcaucaca

SEQ ID NO: 64873 - RNA, 32 nt, Human
auacgaugugugugucacaucacauauugugc

SEQ ID NO: 64874 - RNA, 32 nt, Human
auacgauuuuucuagggccaugggguuugagg

SEQ ID NO: 64875 - RNA, 32 nt, Human
auacgcaagaacaucacggagacucugguguc

SEQ ID NO: 64876 - RNA, 32 nt, Human
auacgcacucccgaccccagaaacccggauuc

SEQ ID NO: 64877 - RNA, 32 nt, Human
auacgcagcuuaacuauaucuuccugcgugug

SEQ ID NO: 64878 - RNA, 32 nt, Human
auacgcauccaagaagucgggugguagcucca

SEQ ID NO: 64879 - RNA, 32 nt, Human
auacgcaucugugccagcaucccaagagugag

SEQ ID NO: 64880 - RNA, 32 nt, Human
auacgccuguaaucccagcuacucgggaggcu

SEQ ID NO: 64881 - RNA, 32 nt, Human
auacgccuguaauccuagcuacuugggaggcu

SEQ ID NO: 64882 - RNA, 32 nt, Human
auacgcgcuuucuucugauccagccuguagag

SEQ ID NO: 64883 - RNA, 32 nt, Human
auacgcuucugcacuccggggaagaaggagua

SEQ ID NO: 64884 - RNA, 32 nt, Human
auacggacagagucugcuuagaagagauacaa

SEQ ID NO: 64885 - RNA, 32 nt, Human
auacggagugggagggauugggggaggaaagg

SEQ ID NO: 64886 - RNA, 32 nt, Human
auacggccaagugcccugugugccgcuggcag

SEQ ID NO: 64887 - RNA, 32 nt, Human
auacgggacgucaucaauguguuucaccgccu

SEQ ID NO: 64888 - RNA, 32 nt, Human
auacgggagagaaaccuuauaaguguaaugaa

SEQ ID NO: 64889 - RNA, 32 nt, Human
auacgggaguugcugcacaagccugggugcuc

SEQ ID NO: 64890 - RNA, 32 nt, Human
auacggggagugaaggaaggccggcaggcauc

SEQ ID NO: 64891 - RNA, 32 nt, Human
auacggggcucccgguggccaugacgacgggu

SEQ ID NO: 64892 - RNA, 32 nt, Human
auacggguauuuuuaaagauucuccaaaaagu

SEQ ID NO: 64893 - RNA, 32 nt, Human
auacggugguucagacaacaggcauuucucuc

SEQ ID NO: 64894 - RNA, 32 nt, Human
auacgguuggaaaggaaaaaugagacacaggu

SEQ ID NO: 64895 - RNA, 32 nt, Human
auacguaaacacccaggaaggcagggggcucc

SEQ ID NO: 64896 - RNA, 32 nt, Human
auacguaauucauauaucuauaugcuucacgu

SEQ ID NO: 64897 - RNA, 32 nt, Human
auacguacaaagagaaaggggaaagugauuua

SEQ ID NO: 64898 - RNA, 32 nt, Human
auacguaggagguggggaugggggaggggagg

SEQ ID NO: 64899 - RNA, 32 nt, Human
auacguauguuuaaaaacccuuccugcuauac

SEQ ID NO: 64900 - RNA, 32 nt, Human
auacgucaacaccuaugaaaagaagcggggaa

SEQ ID NO: 64901 - RNA, 32 nt, Human
auacguccacacacaccaaggcaccucacuca

SEQ ID NO: 64902 - RNA, 32 nt, Human
auacgucccagugaaacacagcuucgucacca

SEQ ID NO: 64903 - RNA, 32 nt, Human
auacgugaaugcugugcucuuccuucaugauc

SEQ ID NO: 64904 - RNA, 32 nt, Human
auacgugacgcauacauacacauguauguaug

SEQ ID NO: 64905 - RNA, 32 nt, Human
auacgugcucauuccaucuucaauggaacaaa

SEQ ID NO: 64906 - RNA, 20 nt, Human
auacguggccaacugccuca

SEQ ID NO: 64907 - RNA, 31 nt, Human
auacguguccuccuggggguuggagaugauc

SEQ ID NO: 64908 - RNA, 32 nt, Human
auacgugugguggcucacgccuguaaucccaa

SEQ ID NO: 64909 - RNA, 32 nt, Human
auacguguuaguccuguuauuuggaggcuuuu

SEQ ID NO: 64910 - RNA, 32 nt, Human
auacguguuuuuaaaauuuguguuuucuaucu

SEQ ID NO: 64911 - RNA, 32 nt, Human
auacguugaguuuggcucuggaaggaauauga

SEQ ID NO: 64912 - RNA, 32 nt, Human
auacguugguuauuuacagcacaacaugaaaa

SEQ ID NO: 64913 - RNA, 32 nt, Human
auacguuugucagaauaauacagggaaccauu

SEQ ID NO: 64914 - RNA, 32 nt, Human
auacuaaaaauacaaaaauuggcugggugugg

SEQ ID NO: 64915 - RNA, 32 nt, Human
auacuaaaagccuguugccacuguugugucau

SEQ ID NO: 64916 - RNA, 32 nt, Human
auacuaaaauuagcuggucgcgguggcuucug

SEQ ID NO: 64917 - RNA, 32 nt, Human
auacuaaagagaaacuacaaaccugaagaugu

SEQ ID NO: 64918 - RNA, 32 nt, Human
auacuaaaucgacaaccaaauuugucauguga

SEQ ID NO: 64919 - RNA, 32 nt, Human
auacuaaggaacagaguggacuuacaacaucu

SEQ ID NO: 64920 - RNA, 32 nt, Human
auacuaaggacccccucuguacaccaacgcca

SEQ ID NO: 64921 - RNA, 32 nt, Human
auacuaauucagcaaucccccaucguuaccca

SEQ ID NO: 64922 - RNA, 32 nt, Human
auacuacaauugcacuuccagcacuuugagaa

SEQ ID NO: 64923 - RNA, 32 nt, Human
auacuacacuggagaaaacaaaacaaaccaaa

SEQ ID NO: 64924 - RNA, 32 nt, Human
auacuacagccaggcuggaauuuggugucuua

SEQ ID NO: 64925 - RNA, 32 nt, Human
auacuacaggcacccaccaccacgcccagcua

SEQ ID NO: 64926 - RNA, 22 nt, Human
auacuacaguaacugugacuga

SEQ ID NO: 64927 - RNA, 32 nt, Human
auacuaccaguucuuuaugagcacuggaaugu

SEQ ID NO: 64928 - RNA, 32 nt, Human
auacuaccucucucuucuggccugugucuaag

SEQ ID NO: 64929 - RNA, 32 nt, Human
auacuaccucugucuguuaauucuuuccuaac

SEQ ID NO: 64930 - RNA, 32 nt, Human
auacuaccuggagguuuguccucuccauuuuu

SEQ ID NO: 64931 - RNA, 32 nt, Human
auacuacugcacuccagccugggcgacaagag

SEQ ID NO: 64932 - RNA, 32 nt, Human
auacuacugccucuccuugucuuaguggguau

SEQ ID NO: 64933 - RNA, 32 nt, Human
auacuacugcguccucccugaucccacccccu

SEQ ID NO: 64934 - RNA, 32 nt, Human
auacuagcacuacuauucuuagcagugcuugg

SEQ ID NO: 64935 - RNA, 32 nt, Human
auacuagggcuggugaauuaccagaucuccgu

SEQ ID NO: 64936 - RNA, 32 nt, Human
auacuaguaaagugaaugaauuacugaguuua

SEQ ID NO: 64937 - RNA, 32 nt, Human
auacuaguacaagugguaauuuuuguacauua

SEQ ID NO: 64938 - RNA, 32 nt, Human
auacuaguaccucccucuuaaggucagggcug

SEQ ID NO: 64939 - RNA, 32 nt, Human
auacuaguuuugagcuuuagaccucagccuuu

SEQ ID NO: 64940 - RNA, 32 nt, Human
auacuauacaauauguuuauugcacuucccau

SEQ ID NO: 64941 - RNA, 32 nt, Human
auacuauagagaaacccccggggaccauguga

SEQ ID NO: 64942 - RNA, 32 nt, Human
auacuauaguuucaccuguauucuaguaaaug

SEQ ID NO: 64943 - RNA, 32 nt, Human
auacuauauuuucuccccaauaccaccaacga

SEQ ID NO: 64944 - RNA, 32 nt, Human
auacuaucuuuuaugucuaaagccauuuuaua

SEQ ID NO: 64945 - RNA, 31 nt, Human
auacuauggacaaguuccugacaauacauuu

SEQ ID NO: 64946 - RNA, 32 nt, Human
auacuauguaugcagugcaucugcauagaaca

SEQ ID NO: 64947 - RNA, 22 nt, Human
auacuauuauuaaauuuucaug

SEQ ID NO: 64948 - RNA, 32 nt, Human
auacuauuccauccacacaguuuccacccuca

SEQ ID NO: 64949 - RNA, 32 nt, Human
auacucaaugauugaugacaccaguuuuggcu

SEQ ID NO: 64950 - RNA, 32 nt, Human
auacucaccaaacccucuuccccaccacccug

SEQ ID NO: 64951 - RNA, 32 nt, Human
auacucaccaggauaccccucguuaagggcaa

SEQ ID NO: 64952 - RNA, 32 nt, Human
auacucacucacucuccaccagccugggaaau

SEQ ID NO: 64953 - RNA, 32 nt, Human
auacucagaauauggguugauuugaauaucug

SEQ ID NO: 64954 - RNA, 32 nt, Human
auacucaggaggcugaggcaggagaaucgcuu

SEQ ID NO: 64955 - RNA, 32 nt, Human
auacucaggaggcugaggcaggagaauuguuu

SEQ ID NO: 64956 - RNA, 19 nt, Human
auacucaggauaacagaga

SEQ ID NO: 64957 - RNA, 32 nt, Human
auacucagggcguuguuaacagggagugguau

SEQ ID NO: 64958 - RNA, 32 nt, Human
auacucauaauccaguuuaauccuuuuauuug

SEQ ID NO: 64959 - RNA, 32 nt, Human
auacucaucugaugucuauugugaauuggcug

SEQ ID NO: 64960 - RNA, 32 nt, Human
auacucaugcaaccagccugagucgcggugag

SEQ ID NO: 64961 - RNA, 32 nt, Human
auacucauuaaaguuaggaucuagucauggac

SEQ ID NO: 64962 - RNA, 32 nt, Human
auacucauucaccccaaaggcucuuuuaagag

SEQ ID NO: 64963 - RNA, 32 nt, Human
auacuccaccuuguguuucaaagaauuuaguu

SEQ ID NO: 64964 - RNA, 32 nt, Human
auacuccagaaagcuguagacacugcucauuu

SEQ ID NO: 64965 - RNA, 32 nt, Human
auacuccagccuggugacagagugagacucug

SEQ ID NO: 64966 - RNA, 32 nt, Human
auacuccaggcagaggaaauaguguguauaga

SEQ ID NO: 64967 - RNA, 32 nt, Human
auacuccaguuccaacaccaucuucugagaug

SEQ ID NO: 64968 - RNA, 32 nt, Human
auacucccacaggauggacucacugcagaagc

SEQ ID NO: 64969 - RNA, 32 nt, Human
auacucccccauuuguuaaaugggguccugaa

SEQ ID NO: 64970 - RNA, 32 nt, Human
auacucccucugcccuccuuuuugguuuccuu

SEQ ID NO: 64971 - RNA, 32 nt, Human
auacucccugccuccuuucuucugccuaccag

SEQ ID NO: 64972 - RNA, 32 nt, Human
auacucccugcucccugugguagagacaccug

SEQ ID NO: 64973 - RNA, 32 nt, Human
auacuccuacugucuguguggucacagcuagu

SEQ ID NO: 64974 - RNA, 32 nt, Human
auacuccuaugcuagccucuggcuccucaggg

SEQ ID NO: 64975 - RNA, 32 nt, Human
auacuccuggggaaggugagcagauggacaag

SEQ ID NO: 64976 - RNA, 32 nt, Human
auacuccuguagucccagcuacuccagagauu

SEQ ID NO: 64977 - RNA, 32 nt, Human
auacucgggaggcuaaggcaggagaaucgcuu

SEQ ID NO: 64978 - RNA, 32 nt, Human
auacucgggaggcugaagcaggagaauugcuu

SEQ ID NO: 64979 - RNA, 32 nt, Human
auacucgggaggcugaggcaggagaaucacuu

SEQ ID NO: 64980 - RNA, 32 nt, Human
auacucgggaggcugaggcaggagaauugcuu

SEQ ID NO: 64981 - RNA, 32 nt, Human
auacucggggaggcaggguagcagugcuucca

SEQ ID NO: 64982 - RNA, 32 nt, Human
auacucggucggcgacgguagaacgggcgacg

SEQ ID NO: 64983 - RNA, 22 nt, Human
auacucgugaagguguaaggua

SEQ ID NO: 64984 - RNA, 32 nt, Human
auacucuacacucauucuuaacuuuucgcaaa

SEQ ID NO: 64985 - RNA, 32 nt, Human
auacucuagaaucuugucugucacucacuaca

SEQ ID NO: 64986 - RNA, 32 nt, Human
auacucuagucguuucugcauuuccuuuaaaa

SEQ ID NO: 64987 - RNA, 32 nt, Human
auacucuaucucagaagcaaaaagccauccau

SEQ ID NO: 64988 - RNA, 32 nt, Human
auacucuauuuggggaaacaaagcagcugaca

SEQ ID NO: 64989 - RNA, 32 nt, Human
auacucucagcuugcugaguggaugacaaaaa

SEQ ID NO: 64990 - RNA, 32 nt, Human
auacucucccauuaaagaggaagagaagauuu

SEQ ID NO: 64991 - RNA, 32 nt, Human
auacucuccccuuaccuuuccucucuccauuc

SEQ ID NO: 64992 - RNA, 32 nt, Human
auacucucucacucuaauaaacuuggcacuuc

SEQ ID NO: 64993 - RNA, 32 nt, Human
auacucucucugaggcaaagauggggacaagg

SEQ ID NO: 64994 - RNA, 19 nt, Human
auacucugcacuugccuca

SEQ ID NO: 64995 - RNA, 32 nt, Human
auacucuggguacaaugcucccaaucacccug

SEQ ID NO: 64996 - RNA, 31 nt, Human
auacucugucauaaauaccauugaauauauu

SEQ ID NO: 64997 - RNA, 32 nt, Human
auacucuuccuguguccauguguucucauugu

SEQ ID NO: 64998 - RNA, 32 nt, Human
auacucuucucccaucucccuucacaggauga

SEQ ID NO: 64999 - RNA, 32 nt, Human
auacucuugacccauuaaaaacugauggaaag

SEQ ID NO: 65000 - RNA, 32 nt, Human
auacucuugagcucugugacccugcuccuguc

SEQ ID NO: 65001 - RNA, 32 nt, Human
auacucuugguauuuguggugaugggaggaug

SEQ ID NO: 65002 - RNA, 32 nt, Human
auacugaaauucugcauaaugugaacaggaua

SEQ ID NO: 65003 - RNA, 32 nt, Human
auacugaacaugaaccucaccgucccucucuc

SEQ ID NO: 65004 - RNA, 32 nt, Human
auacugaaccuacauagcccagcucuugcugu

SEQ ID NO: 65005 - RNA, 32 nt, Human
auacugaaggaacugaggccugggugauuuau

SEQ ID NO: 65006 - RNA, 32 nt, Human
auacugaagugaggauuauaagagaaauaaac

SEQ ID NO: 65007 - RNA, 32 nt, Human
auacugaaugaggccgggugcaauggcuuacg

SEQ ID NO: 65008 - RNA, 32 nt, Human
auacugacaauauuccaugagggugugcaagc

SEQ ID NO: 65009 - RNA, 32 nt, Human
auacugacagccaccagcagguggaagagauc

SEQ ID NO: 65010 - RNA, 32 nt, Human
auacugacaugcagaagaaauaagugcauucu

SEQ ID NO: 65011 - RNA, 32 nt, Human
auacugacaugcugagauaccuguaauaauug

SEQ ID NO: 65012 - RNA, 32 nt, Human
auacugaccugagaggaggcccagugagauuc

SEQ ID NO: 65013 - RNA, 32 nt, Human
auacugacgugucuugaguaauuuggaaccca

SEQ ID NO: 65014 - RNA, 32 nt, Human
auacugacucaacauggagucucacuggccaa

SEQ ID NO: 65015 - RNA, 32 nt, Human
auacugacucuagcccauguugccuugcccaa

SEQ ID NO: 65016 - RNA, 32 nt, Human
auacugacuuuaguuaguauccuuggauuuuu

SEQ ID NO: 65017 - RNA, 32 nt, Human
auacugagccucucaccucccagcccucagcc

SEQ ID NO: 65018 - RNA, 32 nt, Human
auacugagcuauacuggauucacugacaagaa

SEQ ID NO: 65019 - RNA, 32 nt, Human
auacugagcugauggugucauccagcagccuc

SEQ ID NO: 65020 - RNA, 22 nt, Human
auacugagggaacucagaggcc

SEQ ID NO: 65021 - RNA, 32 nt, Human
auacugaguacuuauaaguagcagaacauaaa

SEQ ID NO: 65022 - RNA, 32 nt, Human
auacugagucagaaacucuggaauagggcccc

SEQ ID NO: 65023 - RNA, 32 nt, Human
auacugauaaauuuuaaagaaaauaugaggaa

SEQ ID NO: 65024 - RNA, 32 nt, Human
auacugaugacagauuucugagguugccugua

SEQ ID NO: 65025 - RNA, 32 nt, Human
auacugauuccaucauuuaaucuuuaaaagua

SEQ ID NO: 65026 - RNA, 19 nt, Human
auacugcaacacugucuca

SEQ ID NO: 65027 - RNA, 32 nt, Human
auacugcaagcaccuggguucucuccaccccu

SEQ ID NO: 65028 - RNA, 21 nt, Human
auacugcacuuuuugcacagu

SEQ ID NO: 65029 - RNA, 32 nt, Human
auacugcagcaagaccaaagugguaaagaaac

SEQ ID NO: 65030 - RNA, 32 nt, Human
auacugcaugugugugcauacaugcauuuucc

SEQ ID NO: 65031 - RNA, 32 nt, Human
auacugcauucucuuuaucacauagugguugu

SEQ ID NO: 65032 - RNA, 32 nt, Human
auacugcccuagugucuccauggaccaaauuu

SEQ ID NO: 65033 - RNA, 32 nt, Human
auacugcgagugaacagugggcggcgaggcug

SEQ ID NO: 65034 - RNA, 32 nt, Human
auacugcggauggugaagguggagcaguggau

SEQ ID NO: 65035 - RNA, 23 nt, Human
auacugcuacaaggugcagagua

SEQ ID NO: 65036 - RNA, 32 nt, Human
auacugcucccaggggccuagguagcugccag

SEQ ID NO: 65037 - RNA, 32 nt, Human
auacugcucuaguuucuuaguacucuguaaug

SEQ ID NO: 65038 - RNA, 32 nt, Human
auacugcucuuuuccccucucccuccacacca

SEQ ID NO: 65039 - RNA, 32 nt, Human
auacugcuguauaagguaauaaaacucugcac

SEQ ID NO: 65040 - RNA, 32 nt, Human
auacugcuuccuugcauggauacaugggaggg

SEQ ID NO: 65041 - RNA, 23 nt, Human
auacuggaaccgauuuguacaau

SEQ ID NO: 65042 - RNA, 32 nt, Human
auacuggacccacuucuuucagaagagaugaa

SEQ ID NO: 65043 - RNA, 32 nt, Human
auacuggagaaaagccauacaaaugagaagaa

SEQ ID NO: 65044 - RNA, 32 nt, Human
auacuggagagaaaccuuagagugcagucauu

SEQ ID NO: 65045 - RNA, 32 nt, Human
auacuggagagaaaccuuauaaguguaaugag

SEQ ID NO: 65046 - RNA, 32 nt, Human
auacuggagagaaaccuuauaaguguaaugau

SEQ ID NO: 65047 - RNA, 32 nt, Human
auacuggauggagcuaccaagagcagacagag

SEQ ID NO: 65048 - RNA, 32 nt, Human
auacuggcaaaaagauuaaaaacaauugcauu

SEQ ID NO: 65049 - RNA, 32 nt, Human
auacuggcaaaaaucuaaauugcuuucuuucc

SEQ ID NO: 65050 - RNA, 32 nt, Human
auacuggcaauacuccagccuggugacagagu

SEQ ID NO: 65051 - RNA, 31 nt, Human
auacuggcacuuuuccuugcagaaagcacuc

SEQ ID NO: 65052 - RNA, 32 nt, Human
auacuggcaggcuaaauguccacugcuucuug

SEQ ID NO: 65053 - RNA, 32 nt, Human
auacuggcccucccuucucuucucuuugcugc

SEQ ID NO: 65054 - RNA, 32 nt, Human
auacugggaagaaaccauaugagugcggggaa

SEQ ID NO: 65055 - RNA, 32 nt, Human
auacugggcugcagaaucucacaugggcacca

SEQ ID NO: 65056 - RNA, 32 nt, Human
auacugggcuuggcucaugcuuuaauuagcua

SEQ ID NO: 65057 - RNA, 32 nt, Human
auacugggguccccagauucugcucuaagggg

SEQ ID NO: 65058 - RNA, 32 nt, Human
auacugguaggggccaaggccaugcuccccuu

SEQ ID NO: 65059 - RNA, 32 nt, Human
auacuggucaucuuucugacaucacaguagaa

SEQ ID NO: 65060 - RNA, 32 nt, Human
auacuggucugaucuguucuacauauuaaagu

SEQ ID NO: 65061 - RNA, 24 nt, Human
auacugucauuccaaauucucaug

SEQ ID NO: 65062 - RNA, 32 nt, Human
auacugugacgguuucaucuuuggaaaauacc

SEQ ID NO: 65063 - RNA, 32 nt, Human
auacugugaggcaucggaaggccagccuguug

SEQ ID NO: 65064 - RNA, 32 nt, Human
auacugugaugaccuuucuacuccgaaaccug

SEQ ID NO: 65065 - RNA, 32 nt, Human
auacugugccauugcacuccaagccugggcaa

SEQ ID NO: 65066 - RNA, 32 nt, Human
auacuguguguuuucccaaagcacuuuuaaaa

SEQ ID NO: 65067 - RNA, 22 nt, Human
auacuguuaccaaauucuucau

SEQ ID NO: 65068 - RNA, 32 nt, Human
auacuguucacucacucuaaaggcgcugagac

SEQ ID NO: 65069 - RNA, 32 nt, Human
auacuguucuacugcuucccucaguaucugaa

SEQ ID NO: 65070 - RNA, 32 nt, Human
auacuguucucuggcccuuacugcgcacaccc

SEQ ID NO: 65071 - RNA, 32 nt, Human
auacuguucuggacugugccuguuaguugcuc

SEQ ID NO: 65072 - RNA, 32 nt, Human
auacuguugucuaguaagugugcaauagcauu

SEQ ID NO: 65073 - RNA, 32 nt, Human
auacuguuugauacaugcuuuuauuuuccuuc

SEQ ID NO: 65074 - RNA, 32 nt, Human
auacuguuuuguuccucugaguuucuuucagu

SEQ ID NO: 65075 - RNA, 32 nt, Human
auacuuaacauggugguugugucucuuuaugc

SEQ ID NO: 65076 - RNA, 32 nt, Human
auacuuaauuuugaauuucuccuugccacguu

SEQ ID NO: 65077 - RNA, 32 nt, Human
auacuuaggggucaaaccugugguguguggaa

SEQ ID NO: 65078 - RNA, 32 nt, Human
auacuuaggguucucauuuuguaguuucuucc

SEQ ID NO: 65079 - RNA, 31 nt, Human
auacuuaguauuuucugacuauagaguacau

SEQ ID NO: 65080 - RNA, 32 nt, Human
auacuuaucuucuggcugucuuccugcugugg

SEQ ID NO: 65081 - RNA, 32 nt, Human
auacuuauuguucauuuugaaaagacuuuguu

SEQ ID NO: 65082 - RNA, 32 nt, Human
auacuuauuuggagcuugggugagauaagcau

SEQ ID NO: 65083 - RNA, 32 nt, Human
auacuucaccuuucuuuuaauuccccaugaug

SEQ ID NO: 65084 - RNA, 32 nt, Human
auacuucagauauggcagggaggccaggugga

SEQ ID NO: 65085 - RNA, 32 nt, Human
auacuucccagcuauuccaucuguggaugaaa

SEQ ID NO: 65086 - RNA, 32 nt, Human
auacuucccaggaguugugacagacuuuccuc

SEQ ID NO: 65087 - RNA, 32 nt, Human
auacuucuacaacuuuaaaacugcucauuuca

SEQ ID NO: 65088 - RNA, 20 nt, Human
auacuucuucaagauuggac

SEQ ID NO: 65089 - RNA, 32 nt, Human
auacuucuucauaauggucacagucugaggau

SEQ ID NO: 65090 - RNA, 32 nt, Human
auacuugaaagaaaccucaauuaucaguggcu

SEQ ID NO: 65091 - RNA, 32 nt, Human
auacuugaccuguccugcuguuuauuaugugg

SEQ ID NO: 65092 - RNA, 32 nt, Human
auacuugauuacaaaugaaaacucagaaacca

SEQ ID NO: 65093 - RNA, 32 nt, Human
auacuugauugaaguagcucucugcuaaaaug

SEQ ID NO: 65094 - RNA, 32 nt, Human
auacuugcaaaguguguggugugagagaggug

SEQ ID NO: 65095 - RNA, 32 nt, Human
auacuugcacacacaagugaguuaacauuuca

SEQ ID NO: 65096 - RNA, 32 nt, Human
auacuugcacacacauauuuauagcagcaaaa

SEQ ID NO: 65097 - RNA, 32 nt, Human
auacuugccaggagacagcaugggaugccauu

SEQ ID NO: 65098 - RNA, 32 nt, Human
auacuugccuucuuccuguacagggcugggaa

SEQ ID NO: 65099 - RNA, 32 nt, Human
auacuugcugaacuugaaaaccuucacucucc

SEQ ID NO: 65100 - RNA, 32 nt, Human
auacuuggacacuaaagccaggaugugcaugc

SEQ ID NO: 65101 - RNA, 32 nt, Human
auacuuggagcuuuaaaaauuaaaaggagaga

SEQ ID NO: 65102 - RNA, 32 nt, Human
auacuuggcuuggaaauuuaacacaguccuuu

SEQ ID NO: 65103 - RNA, 32 nt, Human
auacuugggacacgaugauuuaggcaccccac

SEQ ID NO: 65104 - RNA, 32 nt, Human
auacuugggaggcugagccaggagaaucacuu

SEQ ID NO: 65105 - RNA, 32 nt, Human
auacuugggaggcugaggcaggagaauugcuu

SEQ ID NO: 65106 - RNA, 22 nt, Human
auacuugguccuugcaauggug

SEQ ID NO: 65107 - RNA, 32 nt, Human
auacuugucaauguuuuuauucuuuuacaaga

SEQ ID NO: 65108 - RNA, 32 nt, Human
auacuuguccuuccucccauuuccucccuuug

SEQ ID NO: 65109 - RNA, 32 nt, Human
auacuugugucaccgauccaggguuucucuuu

SEQ ID NO: 65110 - RNA, 32 nt, Human
auacuuguuguauccaugggaaaugaggucau

SEQ ID NO: 65111 - RNA, 32 nt, Human
auacuuguuuuuaaucauuaaauacuuucuuc

SEQ ID NO: 65112 - RNA, 32 nt, Human
auacuuuacauaguaaacuuuccccuuuuaag

SEQ ID NO: 65113 - RNA, 32 nt, Human
auacuuuagggugggggagggaagggagugag

SEQ ID NO: 65114 - RNA, 32 nt, Human
auacuuuauauacuuuucuccaguaauacaug

SEQ ID NO: 65115 - RNA, 32 nt, Human
auacuuuaugagggcuggagugcacuggagca

SEQ ID NO: 65116 - RNA, 32 nt, Human
auacuuucacauacuuuaagcuuuucacccug

SEQ ID NO: 65117 - RNA, 31 nt, Human
auacuuuccuacaguaauaccaauguauaug

SEQ ID NO: 65118 - RNA, 32 nt, Human
auacuuucucuccaaaggaaacuuuuaaauca

SEQ ID NO: 65119 - RNA, 32 nt, Human
auacuuucucucucuuucaugcaguucaaagc

SEQ ID NO: 65120 - RNA, 32 nt, Human
auacuuucucuucucucucuuuuaauuuucuu

SEQ ID NO: 65121 - RNA, 32 nt, Human
auacuuucuggcagacauacagaaagcucugu

SEQ ID NO: 65122 - RNA, 32 nt, Human
auacuuucuucugauuuuaaagccauuugaua

SEQ ID NO: 65123 - RNA, 32 nt, Human
auacuuugcauccuucaauccagucaagcuga

SEQ ID NO: 65124 - RNA, 32 nt, Human
auacuuuggauaagagcuaaaccaccugccac

SEQ ID NO: 65125 - RNA, 32 nt, Human
auacuuugggaggcugaggcaagugaagcacu

SEQ ID NO: 65126 - RNA, 32 nt, Human
auacuuuguaacuaugcuugggugauauugag

SEQ ID NO: 65127 - RNA, 32 nt, Human
auacuuuuaacugcaaccaccagacacaaaug

SEQ ID NO: 65128 - RNA, 32 nt, Human
auacuuuuagacuuauauugccaagccaaagu

SEQ ID NO: 65129 - RNA, 32 nt, Human
auacuuuuauaugauuggcagugcaguaaguu

SEQ ID NO: 65130 - RNA, 32 nt, Human
auacuuuucacuccaacuuccaauaacugaca

SEQ ID NO: 65131 - RNA, 32 nt, Human
auacuuuucccauaaaguuuuaagugugaaag

SEQ ID NO: 65132 - RNA, 32 nt, Human
auacuuuucuucuucuuacuaauucuuuuagg

SEQ ID NO: 65133 - RNA, 32 nt, Human
auacuuuugcagccuuuguccugugggacgaa

SEQ ID NO: 65134 - RNA, 32 nt, Human
auacuuuuuauugagcacuuugcugcugaaau

SEQ ID NO: 65135 - RNA, 32 nt, Human
auacuuuuuccuuccugacauuuguuuuuacu

SEQ ID NO: 65136 - RNA, 32 nt, Human
auagaaaaagagaagcuggagugaagggaaga

SEQ ID NO: 65137 - RNA, 32 nt, Human
auagaaaaauuagcuaggcaugguggcacaug

SEQ ID NO: 65138 - RNA, 32 nt, Human
auagaaaaauuagcuggccaugguggugcucg

SEQ ID NO: 65139 - RNA, 32 nt, Human
auagaaaaauuagcugggcaugguggcgcgug

SEQ ID NO: 65140 - RNA, 32 nt, Human
auagaaaaauuagcugggcaugguggugggcg

SEQ ID NO: 65141 - RNA, 32 nt, Human
auagaaaagaugagaggcagaggcagacaggc

SEQ ID NO: 65142 - RNA, 32 nt, Human
auagaaaaggaaauaguggagaaagcacuggc

SEQ ID NO: 65143 - RNA, 32 nt, Human
auagaaaaucaaguuaucagcaagcaaagggc

SEQ ID NO: 65144 - RNA, 32 nt, Human
auagaaaauugucauucuagccuggauuucuc

SEQ ID NO: 65145 - RNA, 32 nt, Human
auagaaacacaggagaggaagaauuuggaaug

SEQ ID NO: 65146 - RNA, 32 nt, Human
auagaaaccaaaaggcugggcguaguggcuca

SEQ ID NO: 65147 - RNA, 32 nt, Human
auagaaacucacaacuuccuuguuuuguuauc

SEQ ID NO: 65148 - RNA, 32 nt, Human
auagaaacugagaagcagcaaucuguauuugu

SEQ ID NO: 65149 - RNA, 21 nt, Human
aucacgccaccuggacagcca

SEQ ID NO: 65150 - RNA, 32 nt, Human
aucacgccaccuggacagccagaguccaaggc

SEQ ID NO: 65151 - RNA, 22 nt, Human
aucacgccacuacacuccaacc

SEQ ID NO: 65152 - RNA, 32 nt, Human
aucacgccacuacacuccagccugggcaacag

SEQ ID NO: 65153 - RNA, 32 nt, Human
aucacgccacuacacuccagccugggcgacag

SEQ ID NO: 65154 - RNA, 22 nt, Human
aucacgccacugaacuccagcc

SEQ ID NO: 65155 - RNA, 32 nt, Human
aucacgccacugaacuccagccugggagacag

SEQ ID NO: 65156 - RNA, 32 nt, Human
aucacgccacugaacuccagccugggugacag

SEQ ID NO: 65157 - RNA, 32 nt, Human
aucacgccacugcaacuccagcuugggugaca

SEQ ID NO: 65158 - RNA, 32 nt, Human
aucacgccacugcaccccagccugggugacag

SEQ ID NO: 65159 - RNA, 22 nt, Human
aucacgccacugcacuacagcc

SEQ ID NO: 65160 - RNA, 32 nt, Human
aucacgccacugcacuacagccuggacgacag

SEQ ID NO: 65161 - RNA, 22 nt, Human
aucacgccacugcacuauagcc

SEQ ID NO: 65162 - RNA, 32 nt, Human
aucacgccacugcacuauagccuaggugacag

SEQ ID NO: 65163 - RNA, 22 nt, Human
aucacgccacugcacucaagcc

SEQ ID NO: 65164 - RNA, 32 nt, Human
aucacgccacugcacucaagccugggcgacag

SEQ ID NO: 65165 - RNA, 22 nt, Human
aucacgccacugcacuccaacc

SEQ ID NO: 65166 - RNA, 32 nt, Human
aucacgccacugcacuccaaccugggugacag

SEQ ID NO: 65167 - RNA, 32 nt, Human
aucacgccacugcacuccaacuugggcaacag

SEQ ID NO: 65168 - RNA, 32 nt, Human
aucacgccacugcacuccaccugggcaacaag

SEQ ID NO: 65169 - RNA, 32 nt, Human
aucacgccacugcacuccagcacccugggcga

SEQ ID NO: 65170 - RNA, 22 nt, Human
aucacgccacugcacuccagcc

SEQ ID NO: 65171 - RNA, 32 nt, Human
aucacgccacugcacuccagcccgggcgacag

SEQ ID NO: 65172 - RNA, 32 nt, Human
aucacgccacugcacuccagcccgggcggcag

SEQ ID NO: 65173 - RNA, 32 nt, Human
aucacgccacugcacuccagcccggggacaga

SEQ ID NO: 65174 - RNA, 32 nt, Human
aucacgccacugcacuccagccuaggcgacag

SEQ ID NO: 65175 - RNA, 32 nt, Human
aucacgccacugcacuccagccucggugacag

SEQ ID NO: 65176 - RNA, 32 nt, Human
aucacgccacugcacuccagccugagugacag

SEQ ID NO: 65177 - RNA, 32 nt, Human
aucacgccacugcacuccagccugcggacaga

SEQ ID NO: 65178 - RNA, 32 nt, Human
aucacgccacugcacuccagccuggacaacag

SEQ ID NO: 65179 - RNA, 32 nt, Human
aucacgccacugcacuccagccuggaugacag

SEQ ID NO: 65180 - RNA, 32 nt, Human
aucacgccacugcacuccagccuggcgacaga

SEQ ID NO: 65181 - RNA, 32 nt, Human
aucacgccacugcacuccagccugggagacag

SEQ ID NO: 65182 - RNA, 32 nt, Human
aucacgccacugcacuccagccugggcaacaa

SEQ ID NO: 65183 - RNA, 32 nt, Human
aucacgccacugcacuccagccugggcaacag

SEQ ID NO: 65184 - RNA, 32 nt, Human
aucacgccacugcacuccagccugggcaacgg

SEQ ID NO: 65185 - RNA, 32 nt, Human
aucacgccacugcacuccagccugggccacag

SEQ ID NO: 65186 - RNA, 32 nt, Human
aucacgccacugcacuccagccugggcgacag

SEQ ID NO: 65187 - RNA, 32 nt, Human
aucacgccacugcacuccagccugggcgaugg

SEQ ID NO: 65188 - RNA, 32 nt, Human
aucacgccacugcacuccagccugggcugcag

SEQ ID NO: 65189 - RNA, 32 nt, Human
aucacgccacugcacuccagccuggguaacaa

SEQ ID NO: 65190 - RNA, 32 nt, Human
aucacgccacugcacuccagccuggguaacag

SEQ ID NO: 65191 - RNA, 32 nt, Human
aucacgccacugcacuccagccugggugacag

SEQ ID NO: 65192 - RNA, 32 nt, Human
aucacgccacugcacuccagccuggucaacag

SEQ ID NO: 65193 - RNA, 32 nt, Human
aucacgccacugcacuccagccuggugacaga

SEQ ID NO: 65194 - RNA, 32 nt, Human
aucacgccacugcacuccagccuggugacagc

SEQ ID NO: 65195 - RNA, 32 nt, Human
aucacgccacugcacuccagccuguugacaaa

SEQ ID NO: 65196 - RNA, 32 nt, Human
aucacgccacugcacuccagcuggagugacag

SEQ ID NO: 65197 - RNA, 32 nt, Human
aucacgccacugcacuccagcuugggugacaa

SEQ ID NO: 65198 - RNA, 32 nt, Human
aucacgccacugcacuccagucugggugacag

SEQ ID NO: 65199 - RNA, 23 nt, Human
aucacgccacugcacuccaucca

SEQ ID NO: 65200 - RNA, 32 nt, Human
aucacgccacugcacuccauccagccugggug

SEQ ID NO: 65201 - RNA, 32 nt, Human
aucacgccacugcacucuagccuaggcgacag

SEQ ID NO: 65202 - RNA, 32 nt, Human
aucacgccacugcacucuagccugggauacag

SEQ ID NO: 65203 - RNA, 32 nt, Human
aucacgccacugcacucuagccugggcaacaa

SEQ ID NO: 65204 - RNA, 32 nt, Human
aucacgccacugcacucuagccugggcaauaa

SEQ ID NO: 65205 - RNA, 22 nt, Human
aucacgccacugcacuugagcc

SEQ ID NO: 65206 - RNA, 32 nt, Human
aucacgccacugcacuugagccugggcgacac

SEQ ID NO: 65207 - RNA, 22 nt, Human
aucacgccacugcauuacagcc

SEQ ID NO: 65208 - RNA, 32 nt, Human
aucacgccacugcauuacagccuggugcagag

SEQ ID NO: 65209 - RNA, 32 nt, Human
aucacgccacugcauuccagacugggcgacag

SEQ ID NO: 65210 - RNA, 22 nt, Human
aucacgccacugcauuccagcc

SEQ ID NO: 65211 - RNA, 32 nt, Human
aucacgccacugcauuccagccugggcgacag

SEQ ID NO: 65212 - RNA, 32 nt, Human
aucacgccacugcauuccagccuggugacaga

SEQ ID NO: 65213 - RNA, 32 nt, Human
aucacgccacugcauuccagccugugcgacag

SEQ ID NO: 65214 - RNA, 22 nt, Human
aucacgccacugcccuccagcc

SEQ ID NO: 65215 - RNA, 32 nt, Human
aucacgccacugcccuccagccuggggagaca

SEQ ID NO: 65216 - RNA, 22 nt, Human
aucacgccacugcgcuacagcc

SEQ ID NO: 65217 - RNA, 32 nt, Human
aucacgccacugcgcuacagccugggcgacac

SEQ ID NO: 65218 - RNA, 32 nt, Human
aucacgccacugcgcuccagccugggcgaaag

SEQ ID NO: 65219 - RNA, 22 nt, Human
aucacgccacuguacuccagcc

SEQ ID NO: 65220 - RNA, 32 nt, Human
aucacgccacuguacuccagccuggaugacac

SEQ ID NO: 65221 - RNA, 32 nt, Human
aucacgccacuguacuccagccugggagacac

SEQ ID NO: 65222 - RNA, 32 nt, Human
aucacgccacuguacuucuagccuggguuaca

SEQ ID NO: 65223 - RNA, 22 nt, Human
aucacgccacugugcuccagcc

SEQ ID NO: 65224 - RNA, 32 nt, Human
aucacgccacugugcuccagccugggcaacaa

SEQ ID NO: 65225 - RNA, 32 nt, Human
aucacgccagugcacuccagccugagagacag

SEQ ID NO: 65226 - RNA, 32 nt, Human
aucacgccauuacacuccagccugggcaacag

SEQ ID NO: 65227 - RNA, 32 nt, Human
aucacgccauugcacuacagccugggugacag

SEQ ID NO: 65228 - RNA, 22 nt, Human
aucacgccauugcacuccaacc

SEQ ID NO: 65229 - RNA, 32 nt, Human
aucacgccauugcacuccaaccugggugacaa

SEQ ID NO: 65230 - RNA, 22 nt, Human
aucacgccauugcacuccagcc

SEQ ID NO: 65231 - RNA, 32 nt, Human
aucacgccauugcacuccagccuaggcaacga

SEQ ID NO: 65232 - RNA, 32 nt, Human
aucacgccauugcacuccagccuaggcgacag

SEQ ID NO: 65233 - RNA, 32 nt, Human
aucacgccauugcacuccagccugggcaacaa

SEQ ID NO: 65234 - RNA, 32 nt, Human
aucacgccauugcacuccagccugggcaacag

SEQ ID NO: 65235 - RNA, 32 nt, Human
aucacgccauugcacuccagccugggcaacga

SEQ ID NO: 65236 - RNA, 32 nt, Human
aucacgccauugcacuccagccugggcaauaa

SEQ ID NO: 65237 - RNA, 32 nt, Human
aucacgccauugcacuccagccugggcgacag

SEQ ID NO: 65238 - RNA, 32 nt, Human
aucacgccauugcacuccagccugggggacag

SEQ ID NO: 65239 - RNA, 32 nt, Human
aucacgccauugcacuccagccugggugacac

SEQ ID NO: 65240 - RNA, 32 nt, Human
aucacgccauugcacuccagccugggugacag

SEQ ID NO: 65241 - RNA, 32 nt, Human
aucacgccauugcacuccagccugugcgacaa

SEQ ID NO: 65242 - RNA, 32 nt, Human
aucacgccauugcacuccagucugguugacag

SEQ ID NO: 65243 - RNA, 22 nt, Human
aucacgccauuguacuccagcc

SEQ ID NO: 65244 - RNA, 32 nt, Human
aucacgccauuguacuccagccuggcaacaga

SEQ ID NO: 65245 - RNA, 32 nt, Human
aucacgccauuguacuccagccugggcaacaa

SEQ ID NO: 65246 - RNA, 32 nt, Human
aucacgccauuguacuccagccugggcgacag

SEQ ID NO: 65247 - RNA, 32 nt, Human
aucacgcccggcuaauguuuuguauuuuuagu

SEQ ID NO: 65248 - RNA, 32 nt, Human
aucacgccgcugcacuccagccugagcacaga

SEQ ID NO: 65249 - RNA, 32 nt, Human
aucacgccguugcacuccagccugggcaacaa

SEQ ID NO: 65250 - RNA, 32 nt, Human
aucacgccucugcacuccagccugggcaacaa

SEQ ID NO: 65251 - RNA, 32 nt, Human
aucacgccuguaaucccagcacauugggaggc

SEQ ID NO: 65252 - RNA, 32 nt, Human
aucacgccuguaaucccagcacuuagggaggc

SEQ ID NO: 65253 - RNA, 32 nt, Human
aucacgccuguaaucccagcgcuuugggaggc

SEQ ID NO: 65254 - RNA, 22 nt, Human
aucacgccuugcccaaguguga

SEQ ID NO: 65255 - RNA, 32 nt, Human
aucacgcgaaaggguggcugaggcucuugaaa

SEQ ID NO: 65256 - RNA, 32 nt, Human
aucacggagaaaagucagagugcucagugcca

SEQ ID NO: 65257 - RNA, 32 nt, Human
aucacggcagaguucaaggccgcuuguagacu

SEQ ID NO: 65258 - RNA, 32 nt, Human
aucacggcucacugcaaccuccaccuccugag

SEQ ID NO: 65259 - RNA, 32 nt, Human
aucacggcucacugcagccucaaccuccuggg

SEQ ID NO: 65260 - RNA, 32 nt, Human
aucacggcucacugcagccucgaccuccccag

SEQ ID NO: 65261 - RNA, 32 nt, Human
aucacggcucacugcagccucuaccuccccag

SEQ ID NO: 65262 - RNA, 32 nt, Human
aucacggcucacugcagcuucaaacuccuggg

SEQ ID NO: 65263 - RNA, 32 nt, Human
aucacggcucacugcagucucugccucccaga

SEQ ID NO: 65264 - RNA, 32 nt, Human
aucacggcucacuguagucucgaccucccagg

SEQ ID NO: 65265 - RNA, 32 nt, Human
aucacgggaaugucacaaugcccagacuugga

SEQ ID NO: 65266 - RNA, 32 nt, Human
aucacgggaggaggcagcugcggcggggccga

SEQ ID NO: 65267 - RNA, 32 nt, Human
aucacgggggaugcagacauugaccaugacca

SEQ ID NO: 65268 - RNA, 32 nt, Human
aucacgguaggcagugcuugaaugagaaaagc

SEQ ID NO: 65269 - RNA, 32 nt, Human
aucacgguugacugacagcuccugggguucau

SEQ ID NO: 65270 - RNA, 32 nt, Human
aucacgucacugcacuccagcuugggcaacag

SEQ ID NO: 65271 - RNA, 32 nt, Human
aucacgucacugcacuccggccugggugacag

SEQ ID NO: 65272 - RNA, 32 nt, Human
aucacgucacugcauuccagccuggauaauag

SEQ ID NO: 65273 - RNA, 32 nt, Human
aucacgucacuguacuccagccugggugacag

SEQ ID NO: 65274 - RNA, 32 nt, Human
aucacguccuuucuaggaacauggauggagcu

SEQ ID NO: 65275 - RNA, 32 nt, Human
aucacgucuauguaaugaagccuccacaagaa

SEQ ID NO: 65276 - RNA, 32 nt, Human
aucacgucucacugcagccucaaccuccuggg

SEQ ID NO: 65277 - RNA, 32 nt, Human
aucacuacaacaaaugcuaacuucuaaucccc

SEQ ID NO: 65278 - RNA, 32 nt, Human
aucacuacaagcuuuuaacuuuuuaaguuauu

SEQ ID NO: 65279 - RNA, 32 nt, Human
aucacuacauuucaaagcaauggcuccuugag

SEQ ID NO: 65280 - RNA, 32 nt, Human
aucacuagauacugccuccucaauuucaaaag

SEQ ID NO: 65281 - RNA, 32 nt, Human
aucacuagaucuucuccaccagucauguuccc

SEQ ID NO: 65282 - RNA, 32 nt, Human
aucacuaggaggcagagguugcagugagcagu

SEQ ID NO: 65283 - RNA, 32 nt, Human
aucacuauagagaacuuaagaggcuggcuuau

SEQ ID NO: 65284 - RNA, 31 nt, Human
aucacuaugucaacagacacagguguuuccc

SEQ ID NO: 65285 - RNA, 24 nt, Human
aucacuauugaauuucucuccaca

SEQ ID NO: 65286 - RNA, 32 nt, Human
aucacucagagcagucugugacuuaguggaca

SEQ ID NO: 65287 - RNA, 32 nt, Human
aucacucagcucccaucuccuuucagaaaaau

SEQ ID NO: 65288 - RNA, 32 nt, Human
aucacucaucacuuguuuucuuuuggcuuuug

SEQ ID NO: 65289 - RNA, 32 nt, Human
aucacuccacugcacuccagccugggcaacag

SEQ ID NO: 65290 - RNA, 32 nt, Human
aucacuccacugcacuccagccugggcgacag

SEQ ID NO: 65291 - RNA, 32 nt, Human
aucacuccacugcacuccagccugggugacag

SEQ ID NO: 65292 - RNA, 20 nt, Human
aucacucccaaugccucccu

SEQ ID NO: 65293 - RNA, 32 nt, Human
aucacucccggaaauuucuuuaucucuguuac

SEQ ID NO: 65294 - RNA, 32 nt, Human
aucacuccucagugugaccucccaggccucuu

SEQ ID NO: 65295 - RNA, 32 nt, Human
aucacucgaacccaggaggcagagguugcagu

SEQ ID NO: 65296 - RNA, 32 nt, Human
aucacucgcagcuaaguuuuuguauuuuuagu

SEQ ID NO: 65297 - RNA, 32 nt, Human
aucacucgccauucuccuacugccuuccagaa

SEQ ID NO: 65298 - RNA, 32 nt, Human
aucacucgcuguuuucuggcuagcucuuggca

SEQ ID NO: 65299 - RNA, 32 nt, Human
aucacucuccauacucuuucuugugauucucc

SEQ ID NO: 65300 - RNA, 32 nt, Human
aucacucucuuccuccucuagacucuguguuu

SEQ ID NO: 65301 - RNA, 32 nt, Human
aucacucuggauggugucuguggaguucaggu

SEQ ID NO: 65302 - RNA, 32 nt, Human
aucacucugugucugaguggcuucacuccugc

SEQ ID NO: 65303 - RNA, 32 nt, Human
aucacucuuagcacccuccucuugacaaaacu

SEQ ID NO: 65304 - RNA, 32 nt, Human
aucacucuuuggagaugggaauuuguaucccc

SEQ ID NO: 65305 - RNA, 32 nt, Human
aucacugaaacccaagaggcagagguugagua

SEQ ID NO: 65306 - RNA, 32 nt, Human
aucacugaaauauuuaugacagugcauaauuu

SEQ ID NO: 65307 - RNA, 32 nt, Human
aucacugaagacugccuggaaggggccgcgcg

SEQ ID NO: 65308 - RNA, 32 nt, Human
aucacugacagcagcuccuucuggacccaguc

SEQ ID NO: 65309 - RNA, 32 nt, Human
aucacugagcuccacuccuuccucauuuugcu

SEQ ID NO: 65310 - RNA, 32 nt, Human
aucacugaggaaggggaagugggcaaagcaga

SEQ ID NO: 65311 - RNA, 32 nt, Human
aucacugagguuggccagccccugccaagugu

SEQ ID NO: 65312 - RNA, 30 nt, Human
aucacugaucacugcagccuccacuuccca

SEQ ID NO: 65313 - RNA, 32 nt, Human
aucacugauccuguaaguugucaucaaaauau

SEQ ID NO: 65314 - RNA, 32 nt, Human
aucacugaugcugaagcugcaggccugagccc

SEQ ID NO: 65315 - RNA, 32 nt, Human
aucacugcaaccuccgccuccuggguucaaac

SEQ ID NO: 65316 - RNA, 32 nt, Human
aucacugcaaccuccgccuccuggguucaagc

SEQ ID NO: 65317 - RNA, 32 nt, Human
aucacugcaaccucugccuccuggguucaagc

SEQ ID NO: 65318 - RNA, 32 nt, Human
aucacugcacuccagccugggugacagagcga

SEQ ID NO: 65319 - RNA, 32 nt, Human
aucacugcacuccagcuugggugacagagcaa

SEQ ID NO: 65320 - RNA, 32 nt, Human
aucacugcacuccauccugggugacagagaga

SEQ ID NO: 65321 - RNA, 32 nt, Human
aucacugcagccuccaacuccugggcucaagu

SEQ ID NO: 65322 - RNA, 32 nt, Human
aucacugcaguccagccugggugacagagcaa

SEQ ID NO: 65323 - RNA, 32 nt, Human
aucacugccagcuaccgccauggaugcagcag

SEQ ID NO: 65324 - RNA, 32 nt, Human
aucacugccccaggcccagcugugucccuaca

SEQ ID NO: 65325 - RNA, 32 nt, Human
aucacugccguuggucucucaugacuuaacug

SEQ ID NO: 65326 - RNA, 31 nt, Human
aucacugccuucucugggcuucaguguccuu

SEQ ID NO: 65327 - RNA, 32 nt, Human
aucacugccuucuuccuccucuugccccauuc

SEQ ID NO: 65328 - RNA, 22 nt, Human
aucacugccuugaggcgcacuu

SEQ ID NO: 65329 - RNA, 25 nt, Human
aucacugcuauauucucauugcuga

SEQ ID NO: 65330 - RNA, 32 nt, Human
aucacugcucagugcaaccucugccucccagg

SEQ ID NO: 65331 - RNA, 32 nt, Human
aucacugcucuuucuuucuucuuugucauuug

SEQ ID NO: 65332 - RNA, 32 nt, Human
aucacuggacagaagccaugaggcagagccag

SEQ ID NO: 65333 - RNA, 32 nt, Human
aucacuggaggcaugcauaaugaauggagaau

SEQ ID NO: 65334 - RNA, 32 nt, Human
aucacuggaguacaggaguuuggggcuguagu

SEQ ID NO: 65335 - RNA, 32 nt, Human
aucacuggaguucgaggcugcagugagcuaug

SEQ ID NO: 65336 - RNA, 32 nt, Human
aucacuggaguuugagaccacccuggccaaca

SEQ ID NO: 65337 - RNA, 32 nt, Human
aucacuggcuuugcacagaaguaugcucuacu

SEQ ID NO: 65338 - RNA, 32 nt, Human
aucacugggauuauaggcaugagccauuaugc

SEQ ID NO: 65339 - RNA, 32 nt, Human
aucacugggcccagaggagaggagacagacac

SEQ ID NO: 65340 - RNA, 32 nt, Human
aucacuggggaauaacuugcuccuucuucucu

SEQ ID NO: 65341 - RNA, 32 nt, Human
aucacuggggcccagagagagcuguccgccag

SEQ ID NO: 65342 - RNA, 32 nt, Human
aucacugggguuucccauguugcagcacuucu

SEQ ID NO: 65343 - RNA, 29 nt, Human
aucacuguaaaugguaaucaguuggaauu

SEQ ID NO: 65344 - RNA, 32 nt, Human
aucacugucaguggagggaagcugcugacugu

SEQ ID NO: 65345 - RNA, 32 nt, Human
aucacuguccuuuugaaccaggaaaagucaca

SEQ ID NO: 65346 - RNA, 31 nt, Human
aucacugugagugucugaugggugggcaucc

SEQ ID NO: 65347 - RNA, 32 nt, Human
aucacugugccacucuacuccagccugggcaa

SEQ ID NO: 65348 - RNA, 32 nt, Human
aucacugugccccgguggagggggaggcccuu

SEQ ID NO: 65349 - RNA, 32 nt, Human
aucacugugcuacucuacuccagccugggcaa

SEQ ID NO: 65350 - RNA, 21 nt, Human
aucacuguggcugucuggaaa

SEQ ID NO: 65351 - RNA, 32 nt, Human
aucacuguggucagucuccugucccagcuuca

SEQ ID NO: 65352 - RNA, 32 nt, Human
aucacugugguguucuccaugucugcuagcca

SEQ ID NO: 65353 - RNA, 32 nt, Human
aucacugugguugccaaauauuuacuucagaa

SEQ ID NO: 65354 - RNA, 32 nt, Human
aucacuguuacaaguuuuguuuugagaauuaa

SEQ ID NO: 65355 - RNA, 32 nt, Human
aucacuuaaaggccauaugaccuuagacaagu

SEQ ID NO: 65356 - RNA, 32 nt, Human
aucacuuacgagcucaucaacuucuccauagu

SEQ ID NO: 65357 - RNA, 32 nt, Human
aucacuuagcuuuggacuaagaggguaagaga

SEQ ID NO: 65358 - RNA, 20 nt, Human
aucacuucaaaaccaagcaa

SEQ ID NO: 65359 - RNA, 32 nt, Human
aucacuucaaaacuccagcuugcccaauaagg

SEQ ID NO: 65360 - RNA, 32 nt, Human
aucacuucaacccaggaggcagaggcuacagu

SEQ ID NO: 65361 - RNA, 32 nt, Human
aucacuucagcccaggaggucaggucaaggcu

SEQ ID NO: 65362 - RNA, 32 nt, Human
aucacuucagcccaggagguggagguugcagu

SEQ ID NO: 65363 - RNA, 32 nt, Human
aucacuuccauggcauggauguucacauacag

SEQ ID NO: 65364 - RNA, 32 nt, Human
aucacuuccauuccuguugcuguuuacacaga

SEQ ID NO: 65365 - RNA, 32 nt, Human
aucacuucccauaggccugggguuucuagacu

SEQ ID NO: 65366 - RNA, 32 nt, Human
aucacuucugcugcuccacacacccagagaag

SEQ ID NO: 65367 - RNA, 31 nt, Human
aucacuugaaccaaggagguggagguugcag

SEQ ID NO: 65368 - RNA, 32 nt, Human
aucacuugaacccaaaaggcagacauugcagu

SEQ ID NO: 65369 - RNA, 32 nt, Human
aucacuugaacccaagaggcagaguuugcagu

SEQ ID NO: 65370 - RNA, 32 nt, Human
aucacuugaacccagaagacagguugcaguga

SEQ ID NO: 65371 - RNA, 32 nt, Human
aucacuugaacccagaaggcggaaguugcagu

SEQ ID NO: 65372 - RNA, 32 nt, Human
aucacuugaacccagaaggugcagguugcagu

SEQ ID NO: 65373 - RNA, 32 nt, Human
aucacuugaacccagcaggcagagguugcagu

SEQ ID NO: 65374 - RNA, 32 nt, Human
aucacuugaacccagcaggcggagguugcggu

SEQ ID NO: 65375 - RNA, 32 nt, Human
aucacuugaacccaggaagcagagguugcagu

SEQ ID NO: 65376 - RNA, 32 nt, Human
aucacuugaacccaggaagcgggguugcagug

SEQ ID NO: 65377 - RNA, 32 nt, Human
aucacuugaacccaggaaguggagguugcagu

SEQ ID NO: 65378 - RNA, 32 nt, Human
aucacuugaacccaggaauucaggcugcagua

SEQ ID NO: 65379 - RNA, 32 nt, Human
aucacuugaacccaggagacggagguugcggu

SEQ ID NO: 65380 - RNA, 32 nt, Human
aucacuugaacccaggagacggugguugcagu

SEQ ID NO: 65381 - RNA, 32 nt, Human
aucacuugaacccaggagaggaagguugcagu

SEQ ID NO: 65382 - RNA, 32 nt, Human
aucacuugaacccaggaggcagagauugcagu

SEQ ID NO: 65383 - RNA, 32 nt, Human
aucacuugaacccaggaggcagagguugcagu

SEQ ID NO: 65384 - RNA, 32 nt, Human
aucacuugaacccaggaggcagagguugcggu

SEQ ID NO: 65385 - RNA, 32 nt, Human
aucacuugaacccaggaggcagagugagccga

SEQ ID NO: 65386 - RNA, 32 nt, Human
aucacuugaacccaggaggcagaguuugcagu

SEQ ID NO: 65387 - RNA, 32 nt, Human
aucacuugaacccaggaggcagcuguugcagu

SEQ ID NO: 65388 - RNA, 32 nt, Human
aucacuugaacccaggaggcggaaguugcagu

SEQ ID NO: 65389 - RNA, 32 nt, Human
aucacuugaacccaggaggcggagguugcagu

SEQ ID NO: 65390 - RNA, 32 nt, Human
aucacuugaacccaggaggcggagguugcggu

SEQ ID NO: 65391 - RNA, 32 nt, Human
aucacuugaacccaggagguagaggcugcagu

SEQ ID NO: 65392 - RNA, 32 nt, Human
aucacuugaacccaggagguagagguugcagu

SEQ ID NO: 65393 - RNA, 32 nt, Human
aucacuugaacccaggagguggagauugcagu

SEQ ID NO: 65394 - RNA, 32 nt, Human
aucacuugaacccaggagguggaggcugcggu

SEQ ID NO: 65395 - RNA, 32 nt, Human
aucacuugaacccaggagguggagguugcagc

SEQ ID NO: 65396 - RNA, 32 nt, Human
aucacuugaacccaggagguggagguugcagu

SEQ ID NO: 65397 - RNA, 32 nt, Human
aucacuugaacccaggagguggagguuguagu

SEQ ID NO: 65398 - RNA, 32 nt, Human
aucacuugaacccaggaggugggcauugcagu

SEQ ID NO: 65399 - RNA, 32 nt, Human
aucacuugaacccaggagguggugguugcagu

SEQ ID NO: 65400 - RNA, 32 nt, Human
aucacuugaacccaggagguguugcagugaac

SEQ ID NO: 65401 - RNA, 31 nt, Human
aucacuugaacccaggagguugaggcugcag

SEQ ID NO: 65402 - RNA, 32 nt, Human
aucacuugaacccaggagguugaggcugcagu

SEQ ID NO: 65403 - RNA, 32 nt, Human
aucacuugaacccaggaguucaaaucugcagu

SEQ ID NO: 65404 - RNA, 32 nt, Human
aucacuugaacccaggcgguggaggcuauagu

SEQ ID NO: 65405 - RNA, 32 nt, Human
aucacuugaacccaguagaggaagguugcagu

SEQ ID NO: 65406 - RNA, 32 nt, Human
aucacuugaacccaguaggcggaaguugcagu

SEQ ID NO: 65407 - RNA, 32 nt, Human
aucacuugaaccccagaggcagaggcugaagu

SEQ ID NO: 65408 - RNA, 32 nt, Human
aucacuugaacccgagaggcggagguugcagu

SEQ ID NO: 65409 - RNA, 32 nt, Human
aucacuugaacccgagagguggagguugaagu

SEQ ID NO: 65410 - RNA, 32 nt, Human
aucacuugaacccgagagguggagguugcagu

SEQ ID NO: 65411 - RNA, 32 nt, Human
aucacuugaacccggaagcgaagguugcagug

SEQ ID NO: 65412 - RNA, 32 nt, Human
aucacuugaacccggaaggcagagguugcagu

SEQ ID NO: 65413 - RNA, 32 nt, Human
aucacuugaacccggaggcggagguugcggua

SEQ ID NO: 65414 - RNA, 32 nt, Human
aucacuugaacccgggaagcagagguugcggu

SEQ ID NO: 65415 - RNA, 32 nt, Human
aucacuugaacccgggaagcggagguugcagu

SEQ ID NO: 65416 - RNA, 32 nt, Human
aucacuugaacccgggaaguggagguugccgu

SEQ ID NO: 65417 - RNA, 32 nt, Human
aucacuugaacccgggagaugaagguugcagu

SEQ ID NO: 65418 - RNA, 32 nt, Human
aucacuugaacccgggaggcaaagguugcggu

SEQ ID NO: 65419 - RNA, 32 nt, Human
aucacuugaacccgggaggcagagggugcagu

SEQ ID NO: 65420 - RNA, 32 nt, Human
aucacuugaacccgggaggcagagguugcagu

SEQ ID NO: 65421 - RNA, 32 nt, Human
aucacuugaacccgggaggcagagguugcggu

SEQ ID NO: 65422 - RNA, 32 nt, Human
aucacuugaacccgggaggcagagguuguagu

SEQ ID NO: 65423 - RNA, 32 nt, Human
aucacuugaacccgggaggcggagcuugcagu

SEQ ID NO: 65424 - RNA, 32 nt, Human
aucacuugaacccgggaggcggagguugcagu

SEQ ID NO: 65425 - RNA, 32 nt, Human
aucacuugaacccgggaggcggagguugcggu

SEQ ID NO: 65426 - RNA, 32 nt, Human
aucacuugaacccgggaggcggaguugcggug

SEQ ID NO: 65427 - RNA, 32 nt, Human
aucacuugaacccgggagggagagguugcagu

SEQ ID NO: 65428 - RNA, 32 nt, Human
aucacuugaacccgggagguggagauugcagu

SEQ ID NO: 65429 - RNA, 32 nt, Human
aucacuugaacccgggagguggaggcugcagu

SEQ ID NO: 65430 - RNA, 32 nt, Human
aucacuugaacccgggagguggagguggaggu

SEQ ID NO: 65431 - RNA, 32 nt, Human
aucacuugaacccgggagguggagguggcagu

SEQ ID NO: 65432 - RNA, 32 nt, Human
aucacuugaacccgggagguggagguugcagu

SEQ ID NO: 65433 - RNA, 32 nt, Human
aucacuugaacccgggagguggcaguugcagg

SEQ ID NO: 65434 - RNA, 32 nt, Human
aucacuugaacccgggaguuaaagguugcagu

SEQ ID NO: 65435 - RNA, 32 nt, Human
aucacuugaacccgggaugcagagguugcagu

SEQ ID NO: 65436 - RNA, 32 nt, Human
aucacuugaacccgggcagcggagguugcagu

SEQ ID NO: 65437 - RNA, 32 nt, Human
aucacuugaacccuaaaggcagagguugcagu

SEQ ID NO: 65438 - RNA, 32 nt, Human
aucacuugaacccuggaggcagaggugguagu

SEQ ID NO: 65439 - RNA, 32 nt, Human
aucacuugaacccuggagguagaaguugcagu

SEQ ID NO: 65440 - RNA, 32 nt, Human
aucacuugaacccuggagguggagguugcagu

SEQ ID NO: 65441 - RNA, 32 nt, Human
aucacuugaagccaggaggcggagguugcagu

SEQ ID NO: 65442 - RNA, 32 nt, Human
aucacuugaccagcgcuuucuggcaagacguc

SEQ ID NO: 65443 - RNA, 32 nt, Human
aucacuugacccaggagguggaggucgcagug

SEQ ID NO: 65444 - RNA, 32 nt, Human
aucacuugagcccaggaggcggaggcugcagu

SEQ ID NO: 65445 - RNA, 32 nt, Human
aucacuugagcccaggagguggaggcugcaau

SEQ ID NO: 65446 - RNA, 32 nt, Human
aucacuugagcccaggagguggagguugcagu

SEQ ID NO: 65447 - RNA, 32 nt, Human
aucacuugagcccaggagguggagguuucagc

SEQ ID NO: 65448 - RNA, 31 nt, Human
aucacuugagcccaggagguugaggcugcag

SEQ ID NO: 65449 - RNA, 32 nt, Human
aucacuugagcccaggagguugaggcugcagu

SEQ ID NO: 65450 - RNA, 32 nt, Human
aucacuugagccccggagguugagacugcagu

SEQ ID NO: 65451 - RNA, 32 nt, Human
aucacuugagcccgggaaguggagguugcacu

SEQ ID NO: 65452 - RNA, 32 nt, Human
aucacuugagcccgggagguugaggcugcagu

SEQ ID NO: 65453 - RNA, 32 nt, Human
aucacuugagccugggagguugugguugcagu

SEQ ID NO: 65454 - RNA, 32 nt, Human
aucacuugaggaguucaagaccagccugguca

SEQ ID NO: 65455 - RNA, 32 nt, Human
aucacuugaggccaggaguuugaggcugcagu

SEQ ID NO: 65456 - RNA, 32 nt, Human
aucacuugaggucaggaauuugagacuagccu

SEQ ID NO: 65457 - RNA, 32 nt, Human
aucacuugaggucaggaguuugagacuagccu

SEQ ID NO: 65458 - RNA, 32 nt, Human
aucacuugaguccaggaggcggaggcugcagu

SEQ ID NO: 65459 - RNA, 32 nt, Human
aucacuugaguccaggaguccgagaccagccu

SEQ ID NO: 65460 - RNA, 32 nt, Human
aucacuugauggcugccaggaaggcauuugac

SEQ ID NO: 65461 - RNA, 32 nt, Human
aucacuugcacuuggaagaaugugcaauugag

SEQ ID NO: 65462 - RNA, 32 nt, Human
aucacuuggcucuucucugauaugaacugggc

SEQ ID NO: 65463 - RNA, 32 nt, Human
aucacuuggguccaggagguggaggcugcagu

SEQ ID NO: 65464 - RNA, 32 nt, Human
aucacuuuccaagauuccacauucauauuacu

SEQ ID NO: 65465 - RNA, 32 nt, Human
aucacuuuccauucuuucuugaucuuacccca

SEQ ID NO: 65466 - RNA, 32 nt, Human
aucacuuuggggagagcuggagaacaggauuc

SEQ ID NO: 65467 - RNA, 32 nt, Human
aucacuuuggucuccauuuuucccaggacagg

SEQ ID NO: 65468 - RNA, 32 nt, Human
aucacuuuucuggcuacagcaggacagaauau

SEQ ID NO: 65469 - RNA, 32 nt, Human
aucacuuuugcccaggcuggagugcaguggcg

SEQ ID NO: 65470 - RNA, 32 nt, Human
aucacuuuugcucuuugacuaauccuaugcug

SEQ ID NO: 65471 - RNA, 32 nt, Human
aucacuuuugcugugaugauguguucuugugu

SEQ ID NO: 65472 - RNA, 32 nt, Human
aucacuuuuguaggugguguuaguuuuuagac

SEQ ID NO: 65473 - RNA, 32 nt, Human
aucagaaaacacaagcuggagauaaauuuggu

SEQ ID NO: 65474 - RNA, 32 nt, Human
aucagaaaaggacuagauuuguuuaagaagaa

SEQ ID NO: 65475 - RNA, 32 nt, Human
aucagaaacacaugaaaaguugucacaaaugu

SEQ ID NO: 65476 - RNA, 32 nt, Human
aucagaaagggcagaaguaggggaagaauaau

SEQ ID NO: 65477 - RNA, 32 nt, Human
aucagaaauuaccuuugacgugcagugacagu

SEQ ID NO: 65478 - RNA, 32 nt, Human
aucagaaauuuuggaaggguucuuugaaauag

SEQ ID NO: 65479 - RNA, 32 nt, Human
aucagaaccauccugaccuucuuagggacgug

SEQ ID NO: 65480 - RNA, 32 nt, Human
aucagaagaagauggccacugcccaguugcag

SEQ ID NO: 65481 - RNA, 18 nt, Human
aucagaagcaccaaguaa

SEQ ID NO: 65482 - RNA, 32 nt, Human
aucagaagcccaagggguacauuuauugcuuu

SEQ ID NO: 65483 - RNA, 32 nt, Human
aucagaagccugguugaagaggaaagacuagu

SEQ ID NO: 65484 - RNA, 32 nt, Human
aucagaagcuccaaguuccugucuucuguuuu

SEQ ID NO: 65485 - RNA, 32 nt, Human
aucagaagcucguuccuucacacucaguggcg

SEQ ID NO: 65486 - RNA, 32 nt, Human
aucagaagcuguuccugccucuuccgucaagc

SEQ ID NO: 65487 - RNA, 32 nt, Human
aucagaaggagugugcuuuaggauuuauugca

SEQ ID NO: 65488 - RNA, 32 nt, Human
aucagaagggaacgagaaaagugaagaugcug

SEQ ID NO: 65489 - RNA, 32 nt, Human
aucagaagucauguagcuccucaggggacugu

SEQ ID NO: 65490 - RNA, 32 nt, Human
aucagaauaaaggagaucggcguuuauuucgu

SEQ ID NO: 65491 - RNA, 32 nt, Human
aucagaauggcaauauacauggagaggaggga

SEQ ID NO: 65492 - RNA, 32 nt, Human
aucagaauucuccagccacuccuggauaccau

SEQ ID NO: 65493 - RNA, 32 nt, Human
aucagaauugccuggagugugcacugaaacug

SEQ ID NO: 65494 - RNA, 32 nt, Human
aucagaauugcuucucagcacuuuggguaacu

SEQ ID NO: 65495 - RNA, 32 nt, Human
aucagacaaccagaagcacauccauuuuugua

SEQ ID NO: 65496 - RNA, 32 nt, Human
aucagacacagccccagaagggggcauuaugg

SEQ ID NO: 65497 - RNA, 32 nt, Human
aucagacagacaccucccucuggagaugcagu

SEQ ID NO: 65498 - RNA, 32 nt, Human
aucagacagaggauccugggaaagcacccuaa

SEQ ID NO: 65499 - RNA, 32 nt, Human
aucagacagauggggguugggagggccuagug

SEQ ID NO: 65500 - RNA, 32 nt, Human
aucagacagcuuguacucacaggccaaggaca

SEQ ID NO: 65501 - RNA, 32 nt, Human
aucagacaguaagagaaagccaaaaagcaaug

SEQ ID NO: 65502 - RNA, 31 nt, Human
aucagacaguuucaagacacacccagucacu

SEQ ID NO: 65503 - RNA, 32 nt, Human
aucagacaucacagaugcaacuucuuguaaug

SEQ ID NO: 65504 - RNA, 18 nt, Human
aucagacaugucaagcaa

SEQ ID NO: 65505 - RNA, 32 nt, Human
aucagaccaccagauguuaccgcucgguugaa

SEQ ID NO: 65506 - RNA, 32 nt, Human
aucagaccacugcccuccagccugggcaauag

SEQ ID NO: 65507 - RNA, 32 nt, Human
aucagaccauccuggcuaacacggugaaaccc

SEQ ID NO: 65508 - RNA, 32 nt, Human
aucagaccgugccucugcggggagaggcugga

SEQ ID NO: 65509 - RNA, 19 nt, Human
aucagacucccuucacuaa

SEQ ID NO: 65510 - RNA, 32 nt, Human
aucagacugccuggccagccuggggcacugaa

SEQ ID NO: 65511 - RNA, 32 nt, Human
aucagacuggacaacauauugaaaccucaugu

SEQ ID NO: 65512 - RNA, 32 nt, Human
aucagacugggaucccagcacgugggagccau

SEQ ID NO: 65513 - RNA, 32 nt, Human
aucagacuguuacugugccuauguggaaagaa

SEQ ID NO: 65514 - RNA, 32 nt, Human
aucagagaaauccuggcauacuugggcuuccu

SEQ ID NO: 65515 - RNA, 32 nt, Human
aucagagaaguuaagaaacuugcucaacauca

SEQ ID NO: 65516 - RNA, 32 nt, Human
aucagagacccaugauaaaucacuuacaacag

SEQ ID NO: 65517 - RNA, 31 nt, Human
aucagagagacggcuccucagaugcucagcu

SEQ ID NO: 65518 - RNA, 32 nt, Human
aucagagaggcagagguggcacaggacaguaa

SEQ ID NO: 65519 - RNA, 32 nt, Human
aucagagcaacagcuacaacaaugaagaauuc

SEQ ID NO: 65520 - RNA, 32 nt, Human
aucagagcagaggccugauuagcccacuuugg

SEQ ID NO: 65521 - RNA, 32 nt, Human
aucagagcaguuacucucagcagaacaccuau

SEQ ID NO: 65522 - RNA, 32 nt, Human
aucagagccacugucugagccagagucacagc

SEQ ID NO: 65523 - RNA, 32 nt, Human
aucagagcccuccagcccuucuuuuugaaacc

SEQ ID NO: 65524 - RNA, 32 nt, Human
aucagagccgagccuggaaucaaacugccucu

SEQ ID NO: 65525 - RNA, 32 nt, Human
aucagagcuagaugaaagggcaaugcuggcag

SEQ ID NO: 65526 - RNA, 32 nt, Human
aucagagcuagaugugggcagauuugaaaaca

SEQ ID NO: 65527 - RNA, 32 nt, Human
aucagagcucacugcagcuucaacaccccagg

SEQ ID NO: 65528 - RNA, 32 nt, Human
aucagagcucacugcagcuucaaucuccuggc

SEQ ID NO: 65529 - RNA, 32 nt, Human
aucagagcucacugcauccuugaccucccaga

SEQ ID NO: 65530 - RNA, 32 nt, Human
aucagagcuccagcuacacugagucuuucaau

SEQ ID NO: 65531 - RNA, 32 nt, Human
aucagagcuuucuaugagcuauaccugaccuu

SEQ ID NO: 65532 - RNA, 32 nt, Human
aucagaggagacaaaggacgaggacucugugg

SEQ ID NO: 65533 - RNA, 32 nt, Human
aucagaggagagaugguguugggagcccuuug

SEQ ID NO: 65534 - RNA, 32 nt, Human
aucagaggaggaagaggaagaggaggaggagg

SEQ ID NO: 65535 - RNA, 32 nt, Human
aucagaggaggccacacccacuccaggacacc

SEQ ID NO: 65536 - RNA, 32 nt, Human
aucagaggcagagaccuccugaugucuugguu

SEQ ID NO: 65537 - RNA, 32 nt, Human
aucagaggcccaggugccucagagccacauug

SEQ ID NO: 65538 - RNA, 32 nt, Human
aucagagggucugaggugacucuugcaggagc

SEQ ID NO: 65539 - RNA, 32 nt, Human
aucagaggucaucccuuccuccucuccuggaa

SEQ ID NO: 65540 - RNA, 32 nt, Human
aucagaggugcuguuccgugguucugcauuaa

SEQ ID NO: 65541 - RNA, 32 nt, Human
aucagagguggaggucaggggguuagguccag

SEQ ID NO: 65542 - RNA, 32 nt, Human
aucagagugauaaaauuccugucccuaggagg

SEQ ID NO: 65543 - RNA, 32 nt, Human
aucagaguguucaugaucuacuguaccuauuu

SEQ ID NO: 65544 - RNA, 32 nt, Human
aucagauacaauauugugucuacaauugcaaa

SEQ ID NO: 65545 - RNA, 32 nt, Human
aucagauacauaccaucuuuuuaguuccuaag

SEQ ID NO: 65546 - RNA, 32 nt, Human
aucagauacuccaugaaaggucacaauuucuc

SEQ ID NO: 65547 - RNA, 32 nt, Human
aucagauagacaaccaggccaccaagaggccc

SEQ ID NO: 65548 - RNA, 32 nt, Human
aucagaucagcccucaaagaauggggucugug

SEQ ID NO: 65549 - RNA, 32 nt, Human
aucagaucauaugaaaacaaucuaagauugug

SEQ ID NO: 65550 - RNA, 32 nt, Human
aucagauccccaaaacgguauccacugcauug

SEQ ID NO: 65551 - RNA, 18 nt, Human
aucagaucgugccucuuu

SEQ ID NO: 65552 - RNA, 23 nt, Human
aucagaucuacagcuccuggaua

SEQ ID NO: 65553 - RNA, 32 nt, Human
aucagaugauuucuucuaauuuggaggcaauu

SEQ ID NO: 65554 - RNA, 32 nt, Human
aucagaugcaaacuucaucacagcagggauuu

SEQ ID NO: 65555 - RNA, 32 nt, Human
aucagaugcaggaauaaagcaggaagaaggcu

SEQ ID NO: 65556 - RNA, 32 nt, Human
aucagaugcuuugaguuuaaacccaccaugua

SEQ ID NO: 65557 - RNA, 32 nt, Human
aucagaugucacuggaaucaagcauuaaaccu

SEQ ID NO: 65558 - RNA, 32 nt, Human
aucagaugucucuguguucgggaaggucuccg

SEQ ID NO: 65559 - RNA, 24 nt, Human
aucagauguugagucuccugaaca

SEQ ID NO: 65560 - RNA, 32 nt, Human
aucagauuacggacaacucauucucaucccag

SEQ ID NO: 65561 - RNA, 32 nt, Human
aucagauuggaucaccucccacccugaggccc

SEQ ID NO: 65562 - RNA, 32 nt, Human
aucagauuguaaucccaguacuuugggaggcc

SEQ ID NO: 65563 - RNA, 32 nt, Human
aucagauugugagcuccuggagggcaggagcu

SEQ ID NO: 65564 - RNA, 31 nt, Human
aucagcaacaacagcgaggauggaaauggaa

SEQ ID NO: 65565 - RNA, 32 nt, Human
aucagcaagacccaucccaggagaccuugaag

SEQ ID NO: 65566 - RNA, 32 nt, Human
aucagcaagauauaaagcagaaugauaauccu

SEQ ID NO: 65567 - RNA, 32 nt, Human
aucagcaaggugccucacagguugugauuuua

SEQ ID NO: 65568 - RNA, 32 nt, Human
aucagcaaugccccaaacuuucucauaagcac

SEQ ID NO: 65569 - RNA, 32 nt, Human
aucagcaauuugagagaaaggcaaaguuacug

SEQ ID NO: 65570 - RNA, 32 nt, Human
aucagcaccaacagcacaguucuucauaucca

SEQ ID NO: 65571 - RNA, 32 nt, Human
aucagcacuccucaucaucacucaucugccaa

SEQ ID NO: 65572 - RNA, 32 nt, Human
aucagcacugcacuguuagcugagagugcggg

SEQ ID NO: 65573 - RNA, 32 nt, Human
aucagcacuuucucccucugccagugucucag

SEQ ID NO: 65574 - RNA, 32 nt, Human
aucagcagagcacuucuccacagcggguguca

SEQ ID NO: 65575 - RNA, 32 nt, Human
aucagcagaugguagacaguguuuauguagau

SEQ ID NO: 65576 - RNA, 32 nt, Human
aucagcagcaacaacugucaguucauccugca

SEQ ID NO: 65577 - RNA, 23 nt, Human
aucagcagccucuuccuccucca

SEQ ID NO: 65578 - RNA, 32 nt, Human
aucagcagcucuuuuccagaucaaagaacuca

SEQ ID NO: 65579 - RNA, 32 nt, Human
aucagcaggagagagaagggugaauuguauaa

SEQ ID NO: 65580 - RNA, 32 nt, Human
aucagcaggccuuaccugcacuccaggcuccu

SEQ ID NO: 65581 - RNA, 32 nt, Human
aucagcaggcuccaguugaacacuagucugug

SEQ ID NO: 65582 - RNA, 32 nt, Human
aucagcagucuucagcuccuuacaaauuacca

SEQ ID NO: 65583 - RNA, 32 nt, Human
aucagcaguuguauucaaaugaagagcucauu

SEQ ID NO: 65584 - RNA, 32 nt, Human
aucagcaucucuaguuuaccaguacuuuaaua

SEQ ID NO: 65585 - RNA, 21 nt, Human
aucagcaucugggccaggcaa

SEQ ID NO: 65586 - RNA, 32 nt, Human
aucagcaugcucucccugccuugggcuuuucu

SEQ ID NO: 65587 - RNA, 32 nt, Human
aucagcaugcuggcucuccuccugugaagaau

SEQ ID NO: 65588 - RNA, 32 nt, Human
aucagcauuaaacuccagcccagaccaccuaa

SEQ ID NO: 65589 - RNA, 32 nt, Human
aucagcauugaaugguuguuaggcagccaugu

SEQ ID NO: 65590 - RNA, 32 nt, Human
aucagccaagaaccccagugcagggcagagac

SEQ ID NO: 65591 - RNA, 32 nt, Human
aucagccaauaaaagacaagaaggaauuucca

SEQ ID NO: 65592 - RNA, 32 nt, Human
aucagccaauucccagaauuuccccaggcaau

SEQ ID NO: 65593 - RNA, 21 nt, Human
aucagccacugccuucugcug

SEQ ID NO: 65594 - RNA, 32 nt, Human
aucagccagcaaccuuagagagaggaaagaca

SEQ ID NO: 65595 - RNA, 32 nt, Human
aucagccagguguggugguaugcaccaguggu

SEQ ID NO: 65596 - RNA, 21 nt, Human
aucagccaucuuguccugugc

SEQ ID NO: 65597 - RNA, 32 nt, Human
aucagccaugccacugaagagcuggagaccug

SEQ ID NO: 65598 - RNA, 32 nt, Human
aucagccauggagcagccacaggaggaagccc

SEQ ID NO: 65599 - RNA, 21 nt, Human
aucagccauugugaaacugcu

SEQ ID NO: 65600 - RNA, 28 nt, Human
aucagcccaagugcuuguuuuauuccaa

SEQ ID NO: 65601 - RNA, 32 nt, Human
aucagcccagggucacugggaacucucucaca

SEQ ID NO: 65602 - RNA, 32 nt, Human
aucagcccauggguggcugguggagagcucaa

SEQ ID NO: 65603 - RNA, 32 nt, Human
aucagccccugccaguuccacccagcugcagg

SEQ ID NO: 65604 - RNA, 32 nt, Human
aucagccccugggaacaggccccacgcccucu

SEQ ID NO: 65605 - RNA, 24 nt, Human
aucagcccgggcaacauggugaaa

SEQ ID NO: 65606 - RNA, 32 nt, Human
aucagcccuccagacuggggcagguccuguuc

SEQ ID NO: 65607 - RNA, 32 nt, Human
aucagcccuccugauugcaaaggaauacugag

SEQ ID NO: 65608 - RNA, 32 nt, Human
aucagcccuguuaguaggaauguggcuauggc

SEQ ID NO: 65609 - RNA, 24 nt, Human
aucagccuaggcaacauggugaaa

SEQ ID NO: 65610 - RNA, 20 nt, Human
aucagccucauucuaagcaa

SEQ ID NO: 65611 - RNA, 32 nt, Human
aucagccuccucugccugcagcucccuggcuc

SEQ ID NO: 65612 - RNA, 32 nt, Human
aucagccuccugccagcaguucuugaagcuuc

SEQ ID NO: 65613 - RNA, 24 nt, Human
aucagccugaccaacaugaugaaa

SEQ ID NO: 65614 - RNA, 24 nt, Human
aucagccugaccaauauggugaaa

SEQ ID NO: 65615 - RNA, 32 nt, Human
aucagccugagcaacauaacaagacccugucu

SEQ ID NO: 65616 - RNA, 32 nt, Human
aucagccugcagcugauuucauauuccaugcu

SEQ ID NO: 65617 - RNA, 32 nt, Human
aucagccugcugggacacacggguccuccuga

SEQ ID NO: 65618 - RNA, 32 nt, Human
aucagccuggacaauacggugagacccugucu

SEQ ID NO: 65619 - RNA, 32 nt, Human
aucagccuggagaacaaagugagacccccauc

SEQ ID NO: 65620 - RNA, 32 nt, Human
aucagccuggccaacauaaggagaccuaagug

SEQ ID NO: 65621 - RNA, 18 nt, Human
aucagccuggccaacaug

SEQ ID NO: 65622 - RNA, 24 nt, Human
aucagccuggccaacaugaugaaa

SEQ ID NO: 65623 - RNA, 19 nt, Human
aucagccuggccaacaugg

SEQ ID NO: 65624 - RNA, 24 nt, Human
aucagccuggccaacauggugaaa

SEQ ID NO: 65625 - RNA, 24 nt, Human
aucagccuggccaauauggugaaa

SEQ ID NO: 65626 - RNA, 32 nt, Human
aucagccuggcuugggaaauucauguuguuga

SEQ ID NO: 65627 - RNA, 32 nt, Human
aucagccugggaaacauagugagaccccgucu

SEQ ID NO: 65628 - RNA, 20 nt, Human
aucagccugggcaacauagc

SEQ ID NO: 65629 - RNA, 24 nt, Human
aucagccugggcaacauagugaaa

SEQ ID NO: 65630 - RNA, 24 nt, Human
aucagccugggcaacauggugaaa

SEQ ID NO: 65631 - RNA, 32 nt, Human
aucagccuguguaggcagucauggcaccaaag

SEQ ID NO: 65632 - RNA, 32 nt, Human
aucagccuuucuccucuucucuucuugggaca

SEQ ID NO: 65633 - RNA, 31 nt, Human
aucagcgcauuuucuacgccugugucauugu

SEQ ID NO: 65634 - RNA, 32 nt, Human
aucagcgcauuuucuacgccugugucauugug

SEQ ID NO: 65635 - RNA, 32 nt, Human
aucagcgguccuacuggaugaagagaagaugg

SEQ ID NO: 65636 - RNA, 32 nt, Human
aucagcguggccuuguucugucaccaauguac

SEQ ID NO: 65637 - RNA, 32 nt, Human
aucagcgugggguggaggagaaguggaguuug

SEQ ID NO: 65638 - RNA, 32 nt, Human
aucagcuaaacaccacgucacuucaugcaggu

SEQ ID NO: 65639 - RNA, 19 nt, Human
aucagcuaaauaaucaucu

SEQ ID NO: 65640 - RNA, 17 nt, Human
aucagcuaagaguccuc

SEQ ID NO: 65641 - RNA, 18 nt, Human
aucagcuaauacuucucu

SEQ ID NO: 65642 - RNA, 32 nt, Human
aucagcuagauuaagcaagaggcuccagaaga

SEQ ID NO: 65643 - RNA, 17 nt, Human
aucagcuagcuuauucu

SEQ ID NO: 65644 - RNA, 32 nt, Human
aucagcuagguccaagucuccaggcaggacua

SEQ ID NO: 65645 - RNA, 19 nt, Human
aucagcuauauacucugcu

SEQ ID NO: 65646 - RNA, 32 nt, Human
aucagcuaucaaaucugaauucuaagcgccau

SEQ ID NO: 65647 - RNA, 17 nt, Human
aucagcuauugcucuuu

SEQ ID NO: 65648 - RNA, 32 nt, Human
aucagcucaacaucuucuguuaguuuuagcug

SEQ ID NO: 65649 - RNA, 32 nt, Human
aucagcucaauggacccucugccuuaucacaa

SEQ ID NO: 65650 - RNA, 32 nt, Human
aucagcucacauauguaggauaaaauuccaaa

SEQ ID NO: 65651 - RNA, 32 nt, Human
aucagcucauuucccgcaccccauuucuugcu

SEQ ID NO: 65652 - RNA, 32 nt, Human
aucagcucccucuccuccucagcuacuuauuc

SEQ ID NO: 65653 - RNA, 32 nt, Human
aucagcucccuguccuccuuucuucccccguu

SEQ ID NO: 65654 - RNA, 32 nt, Human
aucagcuccuagaguggaaccaggaaggauuc

SEQ ID NO: 65655 - RNA, 18 nt, Human
aucagcuccugccucucu

SEQ ID NO: 65656 - RNA, 32 nt, Human
aucagcuccugccucucugccaugagggcuuu

SEQ ID NO: 65657 - RNA, 21 nt, Human
aucagcuccuggagcuucucu

SEQ ID NO: 65658 - RNA, 32 nt, Human
aucagcucucauucccuaugggucaagauuuc

SEQ ID NO: 65659 - RNA, 32 nt, Human
aucagcucucuggaccugggagcuccaagaua

SEQ ID NO: 65660 - RNA, 32 nt, Human
aucagcucucuuaaaauauauagcaagauuga

SEQ ID NO: 65661 - RNA, 21 nt, Human
aucagcucuugaugccuuucu

SEQ ID NO: 65662 - RNA, 32 nt, Human
aucagcugaagaagggagaggacuuggaggau

SEQ ID NO: 65663 - RNA, 22 nt, Human
aucagcugaccauugacaauca

SEQ ID NO: 65664 - RNA, 32 nt, Human
aucagcugagcuuggugguuugaggaggagag

SEQ ID NO: 65665 - RNA, 32 nt, Human
aucagcugaugagaggcuccagaaggauuucu

SEQ ID NO: 65666 - RNA, 18 nt, Human
aucagcugcagccccucu

SEQ ID NO: 65667 - RNA, 21 nt, Human
aucagcugcagcucccacuca

SEQ ID NO: 65668 - RNA, 32 nt, Human
aucagcugccaagggagcccuagaggggacug

SEQ ID NO: 65669 - RNA, 32 nt, Human
aucagcugccauccuuuccucucuccucaggg

SEQ ID NO: 65670 - RNA, 32 nt, Human
aucagcugccgccgccucuggagcucagucuc

SEQ ID NO: 65671 - RNA, 32 nt, Human
aucagcugccuaacuuauccaucuuugaacuu

SEQ ID NO: 65672 - RNA, 18 nt, Human
aucagcugcuccuccucu

SEQ ID NO: 65673 - RNA, 17 nt, Human
aucagcugcugcucuuu

SEQ ID NO: 65674 - RNA, 32 nt, Human
aucagcuggggccugggcuguggacagaagga

SEQ ID NO: 65675 - RNA, 32 nt, Human
aucagcugguuggauuucucaccaggauuguc

SEQ ID NO: 65676 - RNA, 32 nt, Human
aucagcuguccgcccugccugccugccugugu

SEQ ID NO: 65677 - RNA, 17 nt, Human
aucagcugugccucucu

SEQ ID NO: 65678 - RNA, 32 nt, Human
aucagcuucauaaacacuuuucuuccucccug

SEQ ID NO: 65679 - RNA, 18 nt, Human
aucagcuugagucucucu

SEQ ID NO: 65680 - RNA, 32 nt, Human
aucagcuuguacuggucucauaacucugguuu

SEQ ID NO: 65681 - RNA, 22 nt, Human
aucagcuuuagcucaaaaccaa

SEQ ID NO: 65682 - RNA, 32 nt, Human
aucagcuuuaggacugacauuucuaucuugaa

SEQ ID NO: 65683 - RNA, 23 nt, Human
aucagcuuucccuggcucaggga

SEQ ID NO: 65684 - RNA, 32 nt, Human
aucagcuuuguuacugaauuaccuaaaaccag

SEQ ID NO: 65685 - RNA, 19 nt, Human
aucagcuuuuccccucuca

SEQ ID NO: 65686 - RNA, 32 nt, Human
aucagcuuuucuuauuccuuuuuauuccuuuu

SEQ ID NO: 65687 - RNA, 32 nt, Human
aucaggaaagagagaccuuucuuguuucugga

SEQ ID NO: 65688 - RNA, 17 nt, Human
aucaggaaaugccuucu

SEQ ID NO: 65689 - RNA, 32 nt, Human
aucaggaagggacauggaugugcuccugccac

SEQ ID NO: 65690 - RNA, 22 nt, Human
aucaggaaggggcugccucagg

SEQ ID NO: 65691 - RNA, 32 nt, Human
aucaggaauagauuuguucaguucaguauuua

SEQ ID NO: 65692 - RNA, 32 nt, Human
aucaggaauuccagggaagaaacucuggagaa

SEQ ID NO: 65693 - RNA, 32 nt, Human
aucaggacaggcagagguggucagggagaagg

SEQ ID NO: 65694 - RNA, 32 nt, Human
aucaggaccagccuggucaagauggugaaacu

SEQ ID NO: 65695 - RNA, 32 nt, Human
aucaggaccagugcuucccaccaggcuuuccu

SEQ ID NO: 65696 - RNA, 32 nt, Human
aucaggaccauccuggcuaacaccgugaaacu

SEQ ID NO: 65697 - RNA, 32 nt, Human
aucaggaccauccuggcuaacauggugaaacc

SEQ ID NO: 65698 - RNA, 32 nt, Human
aucaggacugcacucucuucucggcugcacua

SEQ ID NO: 65699 - RNA, 32 nt, Human
aucaggacuuguauuagcagguucuggcuaga

SEQ ID NO: 65700 - RNA, 32 nt, Human
aucaggagaaugcauuucaugucugauucugc

SEQ ID NO: 65701 - RNA, 32 nt, Human
aucaggagcaguuucucaguguucaucuucca

SEQ ID NO: 65702 - RNA, 32 nt, Human
aucaggagccagaauuucaggauccuuuuucc

SEQ ID NO: 65703 - RNA, 32 nt, Human
aucaggagccaggagagagggggacagauagg

SEQ ID NO: 65704 - RNA, 32 nt, Human
aucaggaggaaucacugcuuuaaggguauuau

SEQ ID NO: 65705 - RNA, 32 nt, Human
aucaggaggcugaggcagagaaucacuugaac

SEQ ID NO: 65706 - RNA, 32 nt, Human
aucaggaggggagaagaaggagccucugcugc

SEQ ID NO: 65707 - RNA, 32 nt, Human
aucaggagucacugcaaggcccccaggguggg

SEQ ID NO: 65708 - RNA, 32 nt, Human
aucaggaguucaauaaaugucuguugaugacu

SEQ ID NO: 65709 - RNA, 32 nt, Human
aucaggaguucugccagguuuaaggucaccug

SEQ ID NO: 65710 - RNA, 32 nt, Human
aucaggauagcacucccaggccacuuuggucu

SEQ ID NO: 65711 - RNA, 25 nt, Human
aucaggaugaugcuggccucauaga

SEQ ID NO: 65712 - RNA, 32 nt, Human
aucaggauggcugcagugccagccuggggcag

SEQ ID NO: 65713 - RNA, 32 nt, Human
aucaggauuuccucuugaaccagaaccagucu

SEQ ID NO: 65714 - RNA, 32 nt, Human
aucaggauuuggaaguuuucgaauuaggagua

SEQ ID NO: 65715 - RNA, 32 nt, Human
aucaggcacacaacuucuguuuccuucucuug

SEQ ID NO: 65716 - RNA, 32 nt, Human
aucaggcacaggaggguucagcuuugggucaa

SEQ ID NO: 65717 - RNA, 32 nt, Human
aucaggcacuagaguuuaacugcagcggaaca

SEQ ID NO: 65718 - RNA, 32 nt, Human
aucaggcacugagccacugcgcccagucaaca

SEQ ID NO: 65719 - RNA, 32 nt, Human
aucaggcagccccaaacuggugcauaaugcau

SEQ ID NO: 65720 - RNA, 32 nt, Human
aucaggcagcuguccagccaacugucucucca

SEQ ID NO: 65721 - RNA, 32 nt, Human
aucaggcaggagagcaugccuuuugcuguggu

SEQ ID NO: 65722 - RNA, 32 nt, Human
aucaggcagggacaggacgggcaagcagggcc

SEQ ID NO: 65723 - RNA, 32 nt, Human
aucaggcagggagggggcagaggcaaaucacc

SEQ ID NO: 65724 - RNA, 32 nt, Human
aucaggcaguguuucugauaggaugugaaaug

SEQ ID NO: 65725 - RNA, 32 nt, Human
aucaggcaugcccucggguccuaacaaaguau

SEQ ID NO: 65726 - RNA, 32 nt, Human
aucaggccaacguccaccccagccucacauug

SEQ ID NO: 65727 - RNA, 32 nt, Human
aucaggccacacugcugccaccucucacacgc

SEQ ID NO: 65728 - RNA, 32 nt, Human
aucaggccacugcacuccagccugaacaacaa

SEQ ID NO: 65729 - RNA, 32 nt, Human
aucaggccacugcacuccagccugggcaacag

SEQ ID NO: 65730 - RNA, 32 nt, Human
aucaggccacugcacuccagccuggguaacag

SEQ ID NO: 65731 - RNA, 32 nt, Human
aucaggccagagguuuccaaucagccuugccu

SEQ ID NO: 65732 - RNA, 32 nt, Human
aucaggccauuacauuguccauguuaaaauua

SEQ ID NO: 65733 - RNA, 32 nt, Human
aucaggccauugcacuccagccugggcaauag

SEQ ID NO: 65734 - RNA, 32 nt, Human
aucaggccauugcacuucagccugggugacag

SEQ ID NO: 65735 - RNA, 22 nt, Human
aucaggcccagaccgccucucu

SEQ ID NO: 65736 - RNA, 23 nt, Human
aucaggccccguggccucaaggg

SEQ ID NO: 65737 - RNA, 32 nt, Human
aucaggcccuaucuaagaagcucaugguauac

SEQ ID NO: 65738 - RNA, 32 nt, Human
aucaggccgccgagggcugagcuccagagccg

SEQ ID NO: 65739 - RNA, 32 nt, Human
aucaggccggacaggagagggagggguggggg

SEQ ID NO: 65740 - RNA, 32 nt, Human
aucaggccgggugggagcgagcuugcgggcag

SEQ ID NO: 65741 - RNA, 32 nt, Human
aucaggccugggacacugcucuccuuccccgc

SEQ ID NO: 65742 - RNA, 32 nt, Human
aucaggcgaggugcuaugucucaggccuguaa

SEQ ID NO: 65743 - RNA, 32 nt, Human
aucaggcgugagccccucccacccugccagac

SEQ ID NO: 65744 - RNA, 32 nt, Human
aucaggcuacagcacuccagccugggcaacaa

SEQ ID NO: 65745 - RNA, 19 nt, Human
aucaggcuagaugccuccu

SEQ ID NO: 65746 - RNA, 19 nt, Human
aucaggcuggagugcagug

SEQ ID NO: 65747 - RNA, 32 nt, Human
aucagggaaaggcugccucuuugguaucucaa

SEQ ID NO: 65748 - RNA, 19 nt, Human
aucagggaaaugccucccu

SEQ ID NO: 65749 - RNA, 32 nt, Human
aucagggaagacucaguuacagagccucacag

SEQ ID NO: 65750 - RNA, 32 nt, Human
aucagggaagggugccugggacuuggaggguc

SEQ ID NO: 65751 - RNA, 32 nt, Human
aucagggacaguuuuuccacggaugggugaca

SEQ ID NO: 65752 - RNA, 32 nt, Human
aucagggacuccugcuuccugcccagagcccc

SEQ ID NO: 65753 - RNA, 32 nt, Human
aucagggagcauggugaggggcaacggcagga

SEQ ID NO: 65754 - RNA, 32 nt, Human
aucagggagccaggacacagaggggcagagca

SEQ ID NO: 65755 - RNA, 32 nt, Human
aucagggagcgccgcgcgaggguggggaccag

SEQ ID NO: 65756 - RNA, 32 nt, Human
aucagggaggcggagguuguggugagccgaga

SEQ ID NO: 65757 - RNA, 32 nt, Human
aucagggaucacugcaaccucugccuccuggg

SEQ ID NO: 65758 - RNA, 32 nt, Human
aucagggauguauacgcuuccuuggggcagac

SEQ ID NO: 65759 - RNA, 32 nt, Human
aucagggcacuucucaacuuaaaaccauuucu

SEQ ID NO: 65760 - RNA, 32 nt, Human
aucagggcccuccugcacuccacaugaugagg

SEQ ID NO: 65761 - RNA, 32 nt, Human
aucagggccgagcagaaccgcacucuucccaa

SEQ ID NO: 65762 - RNA, 32 nt, Human
aucagggcggaagccuuaaagcagcagcgggu

SEQ ID NO: 65763 - RNA, 32 nt, Human
aucagggcggggucgggugcacugguagccug

SEQ ID NO: 65764 - RNA, 32 nt, Human
aucagggcucacugcagccucgaccuccuggg

SEQ ID NO: 65765 - RNA, 32 nt, Human
aucagggcucacugcagcuuugacuucccagg

SEQ ID NO: 65766 - RNA, 32 nt, Human
aucagggcucacuguaaccuccgacuccuggg

SEQ ID NO: 65767 - RNA, 32 nt, Human
aucaggggaaugcggcaaggcacacagggcuc

SEQ ID NO: 65768 - RNA, 32 nt, Human
aucaggggcagaggcaugaaagagucggggcu

SEQ ID NO: 65769 - RNA, 32 nt, Human
aucaggggccuuccucugcccacagagggagu

SEQ ID NO: 65770 - RNA, 32 nt, Human
aucagggggucucuucuauucucccuuggguu

SEQ ID NO: 65771 - RNA, 32 nt, Human
aucagggguagcgagguugcaggagcuggcug

SEQ ID NO: 65772 - RNA, 31 nt, Human
aucagggugcucaaggauuggagaggagaca

SEQ ID NO: 65773 - RNA, 32 nt, Human
aucagggugggccugugcuggggauggggcag

SEQ ID NO: 65774 - RNA, 32 nt, Human
aucaggguuguucugggaguccugucagcuuc

SEQ ID NO: 65775 - RNA, 32 nt, Human
aucagguaaaacugaauguggagaugcagguu

SEQ ID NO: 65776 - RNA, 32 nt, Human
aucagguaaucaggaacucuucaguugaagcu

SEQ ID NO: 65777 - RNA, 32 nt, Human
aucagguacauuccagccuguuggcaacucca

SEQ ID NO: 65778 - RNA, 32 nt, Human
aucagguagcccagacuggugauggagcagag

SEQ ID NO: 65779 - RNA, 32 nt, Human
aucaggucagaaagggaugagugaagaagcug

SEQ ID NO: 65780 - RNA, 32 nt, Human
aucagguccaucucaaaggucacacguaauag

SEQ ID NO: 65781 - RNA, 32 nt, Human
aucagguccuaucaguuaagagcugcuuguua

SEQ ID NO: 65782 - RNA, 32 nt, Human
aucaggucucugcucuucugcagccucaucuc

SEQ ID NO: 65783 - RNA, 32 nt, Human
aucaggucuguuccuguuacuguugggucuug

SEQ ID NO: 65784 - RNA, 32 nt, Human
aucaggugaccuucgcaacaaaguuugccccc

SEQ ID NO: 65785 - RNA, 32 nt, Human
aucaggugagccacagagcccaccccagacac

SEQ ID NO: 65786 - RNA, 32 nt, Human
aucaggugauucaagaugcccaaaaaugaugg

SEQ ID NO: 65787 - RNA, 32 nt, Human
aucagguggccuggcuguuucuuuggaucccu

SEQ ID NO: 65788 - RNA, 15 nt, Human
aucagguggugggaa

SEQ ID NO: 65789 - RNA, 32 nt, Human
aucagguguccaccuuccaaugaugaagcaag

SEQ ID NO: 65790 - RNA, 32 nt, Human
aucagguguuuucagguuaaccgucagaaacg

SEQ ID NO: 65791 - RNA, 20 nt, Human
aucagguuaaauucugaaca

SEQ ID NO: 65792 - RNA, 32 nt, Human
aucaguaaaugaugucgguuugcccaguauca

SEQ ID NO: 65793 - RNA, 32 nt, Human
aucaguaacugcauuauugaauuguucuuaaa

SEQ ID NO: 65794 - RNA, 32 nt, Human
aucaguaaucacccauguguaucugcaccuuc

SEQ ID NO: 65795 - RNA, 32 nt, Human
aucaguacgacagccucagagcagagcaaggg

SEQ ID NO: 65796 - RNA, 32 nt, Human
aucaguagagacauugcuguuccugcccaucc

SEQ ID NO: 65797 - RNA, 32 nt, Human
aucaguagcaagagauggcccaacgaagauga

SEQ ID NO: 65798 - RNA, 32 nt, Human
aucaguaguccuccagccugggcagcuguccc

SEQ ID NO: 65799 - RNA, 32 nt, Human
aucaguauaaaauauauaauauacacuaauau

SEQ ID NO: 65800 - RNA, 18 nt, Human
aucaguaucugccucuuu

SEQ ID NO: 65801 - RNA, 32 nt, Human
aucaguauuugugguugggaaagauggacuua

SEQ ID NO: 65802 - RNA, 18 nt, Human
aucagucaaaggcagcaa

SEQ ID NO: 65803 - RNA, 19 nt, Human
aucagucaaaggcaugcag

SEQ ID NO: 65804 - RNA, 18 nt, Human
aucagucaagggaaagca

SEQ ID NO: 65805 - RNA, 32 nt, Human
aucagucaaugccacucuccacaacaacaaug

SEQ ID NO: 65806 - RNA, 32 nt, Human
aucagucacaagaaucaaauauguaaauuaug

SEQ ID NO: 65807 - RNA, 32 nt, Human
aucagucacucagcacagcccugggcacaucg

SEQ ID NO: 65808 - RNA, 32 nt, Human
aucagucacugcacuggugcaaaggcaagcag

SEQ ID NO: 65809 - RNA, 17 nt, Human
aucagucaggacgauca

SEQ ID NO: 65810 - RNA, 32 nt, Human
aucagucaggagcugggaguugagaccuccag

SEQ ID NO: 65811 - RNA, 18 nt, Human
aucagucagggugcguaa

SEQ ID NO: 65812 - RNA, 20 nt, Human
aucagucagguuuuaagcaa

SEQ ID NO: 65813 - RNA, 19 nt, Human
aucagucagugggcacaag

SEQ ID NO: 65814 - RNA, 19 nt, Human
aucagucaguuucaugcaa

SEQ ID NO: 65815 - RNA, 32 nt, Human
aucaguccacauggaauccugacaucccagcc

SEQ ID NO: 65816 - RNA, 32 nt, Human
aucagucccacucccuccugagguccccaagg

SEQ ID NO: 65817 - RNA, 32 nt, Human
aucagucccugccugcccugccuaggucuagc

SEQ ID NO: 65818 - RNA, 32 nt, Human
aucagucccugggcacccccuccugggcucgu

SEQ ID NO: 65819 - RNA, 20 nt, Human
aucaguccucuucuaagcaa

SEQ ID NO: 65820 - RNA, 32 nt, Human
aucagucgguccugggcuggcugugguguagg

SEQ ID NO: 65821 - RNA, 32 nt, Human
aucagucuccacagcuaccaucuugucgggca

SEQ ID NO: 65822 - RNA, 32 nt, Human
aucagucucggccagaaggaggacggagagcc

SEQ ID NO: 65823 - RNA, 32 nt, Human
aucagucucuggucccagcccaccccauggcc

SEQ ID NO: 65824 - RNA, 32 nt, Human
aucagucugcacuugaaauccccagggccuga

SEQ ID NO: 65825 - RNA, 32 nt, Human
aucagucuggacaacauggcaaaacccugucu

SEQ ID NO: 65826 - RNA, 32 nt, Human
aucagucuguaaccugcaaaugaugcuauuag

SEQ ID NO: 65827 - RNA, 18 nt, Human
aucagucuguucaagcaa

SEQ ID NO: 65828 - RNA, 32 nt, Human
aucagucuuaacugaaccagcucucagaauau

SEQ ID NO: 65829 - RNA, 32 nt, Human
aucagucuugcaaauggagaaccugcucucug

SEQ ID NO: 65830 - RNA, 32 nt, Human
aucagucuuguccugggagccggguccugcug

SEQ ID NO: 65831 - RNA, 32 nt, Human
aucagucuuuuucuuuaugacuucugcuuuuu

SEQ ID NO: 65832 - RNA, 32 nt, Human
aucagugaaacuacuuaacacagcuaauuuuu

SEQ ID NO: 65833 - RNA, 32 nt, Human
aucagugaaggaagagaaggccagcagaucag

SEQ ID NO: 65834 - RNA, 32 nt, Human
aucagugaauaaccccagcugcaccaugagcc

SEQ ID NO: 65835 - RNA, 32 nt, Human
aucagugacgugcagcuugaguucaccaagcu

SEQ ID NO: 65836 - RNA, 32 nt, Human
aucagugacuguuccucuaccugccucucaca

SEQ ID NO: 65837 - RNA, 32 nt, Human
aucagugagagcuuccuauaaagaacuccagg

SEQ ID NO: 65838 - RNA, 32 nt, Human
aucagugagauacaauccagucuucucaugca

SEQ ID NO: 65839 - RNA, 32 nt, Human
aucagugaggaugaagaagacuauguuuccuc

SEQ ID NO: 65840 - RNA, 32 nt, Human
aucagugauggaagaacagucucagaacucug

SEQ ID NO: 65841 - RNA, 32 nt, Human
aucagugcagagaagccacaugacauguuggg

SEQ ID NO: 65842 - RNA, 32 nt, Human
aucagugcagcucuccgggcgaugccagaaua

SEQ ID NO: 65843 - RNA, 32 nt, Human
aucagugcccucagcaaaccuguggugcaggg

SEQ ID NO: 65844 - RNA, 32 nt, Human
aucagugccugcuccugccugcccuggcccug

SEQ ID NO: 65845 - RNA, 32 nt, Human
aucagugccuggaaggcaggugugcccgucag

SEQ ID NO: 65846 - RNA, 20 nt, Human
aucagugcuauuaaaggugg

SEQ ID NO: 65847 - RNA, 32 nt, Human
aucaguggagaaauguauuauuuccaugauca

SEQ ID NO: 65848 - RNA, 32 nt, Human
aucaguggagagaaacgcagauuuaggacccu

SEQ ID NO: 65849 - RNA, 32 nt, Human
aucaguggaggaagaggagaaagagggaggga

SEQ ID NO: 65850 - RNA, 32 nt, Human
aucaguggaggaggcagugggggcagcagcag

SEQ ID NO: 65851 - RNA, 32 nt, Human
aucaguggagugagcugaccgaggcagagcga

SEQ ID NO: 65852 - RNA, 32 nt, Human
aucaguggcuaaaguugaaaagggguugguuu

SEQ ID NO: 65853 - RNA, 18 nt, Human
aucaguggcugccuuucu

SEQ ID NO: 65854 - RNA, 32 nt, Human
aucagugggaagcagaacaacagaaggaacuu

SEQ ID NO: 65855 - RNA, 32 nt, Human
aucagugggcagcucuggucaagcacagcaug

SEQ ID NO: 65856 - RNA, 32 nt, Human
aucagugggcaggccacauguagcaggaagga

SEQ ID NO: 65857 - RNA, 32 nt, Human
aucagugggccagagcucgccggguggccgca

SEQ ID NO: 65858 - RNA, 32 nt, Human
aucagugguggaagaacggucucagaacuguu

SEQ ID NO: 65859 - RNA, 32 nt, Human
aucagugguggaagaauggucucagaacuguu

SEQ ID NO: 65860 - RNA, 32 nt, Human
aucagugucauccagaagcaaggcuauggaga

SEQ ID NO: 65861 - RNA, 32 nt, Human
aucagugucccugggcaggaggaugacccagu

SEQ ID NO: 65862 - RNA, 21 nt, Human
aucagugucgaacgucucucu

SEQ ID NO: 65863 - RNA, 32 nt, Human
aucagugucucuaguccuacccaguuuuaaag

SEQ ID NO: 65864 - RNA, 32 nt, Human
aucaguguucucaguggcaguggguggaagug

SEQ ID NO: 65865 - RNA, 16 nt, Human
aucaguuaaaccucuc

SEQ ID NO: 65866 - RNA, 30 nt, Human
aucaguuacagaguccaguggaccauuuug

SEQ ID NO: 65867 - RNA, 32 nt, Human
aucaguuacgcugaagccauggaucaacuucu

SEQ ID NO: 65868 - RNA, 32 nt, Human
aucaguuacuaaaaacaaaauuugaauccuuu

SEQ ID NO: 65869 - RNA, 19 nt, Human
aucaguuaggugcaagcaa

SEQ ID NO: 65870 - RNA, 18 nt, Human
aucaguucagccaagcaa

SEQ ID NO: 65871 - RNA, 32 nt, Human
aucaguuccgccucugccccaagagccaagag

SEQ ID NO: 65872 - RNA, 32 nt, Human
aucaguugaacccaggagguggagguugcagu

SEQ ID NO: 65873 - RNA, 32 nt, Human
aucaguugacagccuacagagaacaaagacug

SEQ ID NO: 65874 - RNA, 32 nt, Human
aucaguugaccaaaaauguacaggcuuauuuc

SEQ ID NO: 65875 - RNA, 16 nt, Human
aucaguugacucucuc

SEQ ID NO: 65876 - RNA, 18 nt, Human
aucaguugagccccugcu

SEQ ID NO: 65877 - RNA, 32 nt, Human
aucaguugcucuugcugaccccucggagcaag

SEQ ID NO: 65878 - RNA, 32 nt, Human
aucaguugcuuuuacucaguguuuucaaauag

SEQ ID NO: 65879 - RNA, 32 nt, Human
aucaguuggaaauuuauaaccaaccaaaccaa

SEQ ID NO: 65880 - RNA, 32 nt, Human
aucaguuggaguuugugucuguugcuuguaau

SEQ ID NO: 65881 - RNA, 32 nt, Human
aucaguuuccagccuacagacuuucggggguu

SEQ ID NO: 65882 - RNA, 17 nt, Human
aucaguuucugccucuu

SEQ ID NO: 65883 - RNA, 32 nt, Human
aucaguuugcaggagcaggggugcaggauccu

SEQ ID NO: 65884 - RNA, 32 nt, Human
aucaguuuguguucucccuccuuuucucuccc

SEQ ID NO: 65885 - RNA, 32 nt, Human
aucaguuuguuuagggguggggaagugucagc

SEQ ID NO: 65886 - RNA, 32 nt, Human
aucaguuuuaucuuuugaaaggcacagucuaa

SEQ ID NO: 65887 - RNA, 32 nt, Human
aucaguuuuauggauaaagaagccugagacuc

SEQ ID NO: 65888 - RNA, 32 nt, Human
aucaguuuugcacuuuagagaguguuucugac

SEQ ID NO: 65889 - RNA, 32 nt, Human
aucauaaaggacaagaugguuaagucaauucu

SEQ ID NO: 65890 - RNA, 32 nt, Human
aucauaaauucuugaaguuaaauuuggcagag

SEQ ID NO: 65891 - RNA, 32 nt, Human
aucauaaauuuguacugaacuauuuuuccuua

SEQ ID NO: 65892 - RNA, 32 nt, Human
aucauaacacugcacuccaggcuggacaacac

SEQ ID NO: 65893 - RNA, 32 nt, Human
aucauaaccccaguacucaguaggcgcugaau

SEQ ID NO: 65894 - RNA, 32 nt, Human
aucauaaccuaugaaugauggaaguccaaaau

SEQ ID NO: 65895 - RNA, 32 nt, Human
aucauaacucacugcagccucaaacuucuggc

SEQ ID NO: 65896 - RNA, 32 nt, Human
aucauaagaaaugcugcacauauaauaauggc

SEQ ID NO: 65897 - RNA, 32 nt, Human
aucauaaugaugucaugugaucagaggaaacc

SEQ ID NO: 65898 - RNA, 32 nt, Human
aucauaaugguagauccacuggcagcuugcac

SEQ ID NO: 65899 - RNA, 32 nt, Human
aucauaauucuguaucuggaauacucauagag

SEQ ID NO: 65900 - RNA, 32 nt, Human
aucauaauugugcuuucacuucccaggcucca

SEQ ID NO: 65901 - RNA, 32 nt, Human
aucauacacaucaaccuccauguccuuagucc

SEQ ID NO: 65902 - RNA, 32 nt, Human
aucauaccacggcacuccagccugggugacag

SEQ ID NO: 65903 - RNA, 32 nt, Human
aucauaccacugcacuccagccuggcgacaga

SEQ ID NO: 65904 - RNA, 32 nt, Human
aucauaccacugcacuccagccugggcgacag

SEQ ID NO: 65905 - RNA, 32 nt, Human
aucauaccacugcacuccagccugggugacag

SEQ ID NO: 65906 - RNA, 32 nt, Human
aucauaccacugcacuccagucugggcaacag

SEQ ID NO: 65907 - RNA, 32 nt, Human
aucauaccacugcacugcagccugagugacac

SEQ ID NO: 65908 - RNA, 32 nt, Human
aucauaccacugcacuuaacuuggcaacagag

SEQ ID NO: 65909 - RNA, 32 nt, Human
aucauaccacuucauuccagccugggugacag

SEQ ID NO: 65910 - RNA, 32 nt, Human
aucauaccauugcacuccagccuaggcaacaa

SEQ ID NO: 65911 - RNA, 32 nt, Human
aucauaccauugcacuccagccugggcaacaa

SEQ ID NO: 65912 - RNA, 32 nt, Human
aucauacccucagagucugggccuaucaucuu

SEQ ID NO: 65913 - RNA, 32 nt, Human
aucauaccucacugcagcuucaacuuccuggg

SEQ ID NO: 65914 - RNA, 32 nt, Human
aucauacuacugcacuccagccugggcgacaa

SEQ ID NO: 65915 - RNA, 32 nt, Human
aucauacucaagaauaguacagauguguggaa

SEQ ID NO: 65916 - RNA, 32 nt, Human
aucauacucacugcagccuugaccgccugggc

SEQ ID NO: 65917 - RNA, 32 nt, Human
aucauacuccccagucaagacuucccugacag

SEQ ID NO: 65918 - RNA, 32 nt, Human
aucauacuucauuuugugguugucuuacauuc

SEQ ID NO: 65919 - RNA, 32 nt, Human
aucauacuugauacacacguuuuuauuugcac

SEQ ID NO: 65920 - RNA, 23 nt, Human
aucauagaagcagauagcuucag

SEQ ID NO: 65921 - RNA, 32 nt, Human
aucauagacugcauacuggagagaaaccuuac

SEQ ID NO: 65922 - RNA, 32 nt, Human
aucauagaucacugcagccucaaacuccuggg

SEQ ID NO: 65923 - RNA, 32 nt, Human
aucauagcaccaaacuccuuuguccaugagau

SEQ ID NO: 65924 - RNA, 32 nt, Human
aucauagcauaucuguuaugugucguugcuuu

SEQ ID NO: 65925 - RNA, 32 nt, Human
aucauagcucacuacagccuugaacuccuggg

SEQ ID NO: 65926 - RNA, 32 nt, Human
aucauagcucacuacagcuucaaaccccugaa

SEQ ID NO: 65927 - RNA, 32 nt, Human
aucauagcucacuaccgucuugaaucccuggg

SEQ ID NO: 65928 - RNA, 32 nt, Human
aucauagcucacuauaaccuugaacuccuggg

SEQ ID NO: 65929 - RNA, 32 nt, Human
aucauagcucacuccagccuccaacuccuggg

SEQ ID NO: 65930 - RNA, 32 nt, Human
aucauagcucacuccagccugaagcaagccuc

SEQ ID NO: 65931 - RNA, 32 nt, Human
aucauagcucacugaagccucaaccucccugg

SEQ ID NO: 65932 - RNA, 32 nt, Human
aucauagcucacugcaaccucaaacuccuggg

SEQ ID NO: 65933 - RNA, 32 nt, Human
aucauagcucacugcacccucaaccuccuggg

SEQ ID NO: 65934 - RNA, 32 nt, Human
aucauagcucacugcagacuccaacuccuggc

SEQ ID NO: 65935 - RNA, 32 nt, Human
aucauagcucacugcagccucaaacuccugga

SEQ ID NO: 65936 - RNA, 32 nt, Human
aucauagcucacugcagccucaaacuccuggg

SEQ ID NO: 65937 - RNA, 32 nt, Human
aucauagcucacugcagccucaaacucuuugg

SEQ ID NO: 65938 - RNA, 32 nt, Human
aucauagcucacugcagccucauacuccuggg

SEQ ID NO: 65939 - RNA, 32 nt, Human
aucauagcucacugcagccuccaacuccuggg

SEQ ID NO: 65940 - RNA, 32 nt, Human
aucauagcucacugcagccucgaacucuuggg

SEQ ID NO: 65941 - RNA, 32 nt, Human
aucauagcucacugcagccucgaaucccuggg

SEQ ID NO: 65942 - RNA, 32 nt, Human
aucauagcucacugcagccuggaacuccuggg

SEQ ID NO: 65943 - RNA, 32 nt, Human
aucauagcucacugcagccuggaacuccuugg

SEQ ID NO: 65944 - RNA, 32 nt, Human
aucauagcucacugcagccuggaauuccuggg

SEQ ID NO: 65945 - RNA, 32 nt, Human
aucauagcucacugcagccuucaacuucuggg

SEQ ID NO: 65946 - RNA, 32 nt, Human
aucauagcucacugcagccuugaacuccuggg

SEQ ID NO: 65947 - RNA, 32 nt, Human
aucauagcucacugcagccuugaauuccuagg

SEQ ID NO: 65948 - RNA, 32 nt, Human
aucauagcucacugcagccuugacccccuccc

SEQ ID NO: 65949 - RNA, 32 nt, Human
aucauagcucacugcagccuugagcuccuagg

SEQ ID NO: 65950 - RNA, 32 nt, Human
aucauagcucacugcagccuugagcuccuggg

SEQ ID NO: 65951 - RNA, 32 nt, Human
aucauagcucacugcagccuuuaacuacuggg

SEQ ID NO: 65952 - RNA, 32 nt, Human
aucauagcucacugcagcuucaaacucuuggg

SEQ ID NO: 65953 - RNA, 32 nt, Human
aucauagcucacugcagcuuugaccucccaga

SEQ ID NO: 65954 - RNA, 32 nt, Human
aucauagcucacugcagcuuugacuuccuggg

SEQ ID NO: 65955 - RNA, 32 nt, Human
aucauagcucacugcauccuccaguuccuggg

SEQ ID NO: 65956 - RNA, 32 nt, Human
aucauagcucacugcugccucaaccucccagg

SEQ ID NO: 65957 - RNA, 32 nt, Human
aucauagcucacugcugcugcuccacccacuu

SEQ ID NO: 65958 - RNA, 32 nt, Human
aucauagcucacuggagccucuaaugccuggg

SEQ ID NO: 65959 - RNA, 32 nt, Human
aucauagcucacuguaaccucaaacuccugga

SEQ ID NO: 65960 - RNA, 32 nt, Human
aucauagcucacuguaaccuuaaacuuggacu

SEQ ID NO: 65961 - RNA, 32 nt, Human
aucauagcucacuguacccuugaacuccuggg

SEQ ID NO: 65962 - RNA, 32 nt, Human
aucauagcucacuguagccucgaccuuccggg

SEQ ID NO: 65963 - RNA, 32 nt, Human
aucauagcucauagcucacugcagccucaaac

SEQ ID NO: 65964 - RNA, 31 nt, Human
aucauaggcaccuucuuuacaucugauuaca

SEQ ID NO: 65965 - RNA, 32 nt, Human
aucauaggucacugcagccucaaacucccaaa

SEQ ID NO: 65966 - RNA, 32 nt, Human
aucauaggugugagccaccucacccggccucc

SEQ ID NO: 65967 - RNA, 32 nt, Human
aucauaguaagaucacuuguguauuuuauauu

SEQ ID NO: 65968 - RNA, 32 nt, Human
aucauaguacagaacccgaccaaaguaggcug

SEQ ID NO: 65969 - RNA, 32 nt, Human
aucauagugaguuaauuugauauucauaucgu

SEQ ID NO: 65970 - RNA, 32 nt, Human
aucauaguuauuaaccauucuaauuaaaccuu

SEQ ID NO: 65971 - RNA, 32 nt, Human
aucauauacagaaaauuagcucaaaguggauu

SEQ ID NO: 65972 - RNA, 32 nt, Human
aucauauacuccacucuagcucccagaaucua

SEQ ID NO: 65973 - RNA, 32 nt, Human
aucauauaguaagcagaagaguugccaugaaa

SEQ ID NO: 65974 - RNA, 32 nt, Human
aucauaucacugcacuccagccuggcugacag

SEQ ID NO: 65975 - RNA, 32 nt, Human
aucauauccaugaaaaaugucauuuuaagaca

SEQ ID NO: 65976 - RNA, 32 nt, Human
aucauaucucaaauacauaaccugguaauaua

SEQ ID NO: 65977 - RNA, 32 nt, Human
aucauaugaggacacagccaggaagcaucauc

SEQ ID NO: 65978 - RNA, 32 nt, Human
aucauaugauccagcaaucccacugcuggaua

SEQ ID NO: 65979 - RNA, 32 nt, Human
aucauaugucauggaauggagcuaugaaaugu

SEQ ID NO: 65980 - RNA, 32 nt, Human
aucauaugugggcucucagagaacacagagcu

SEQ ID NO: 65981 - RNA, 32 nt, Human
aucauauucaaaggaggaaagaauggaugaca

SEQ ID NO: 65982 - RNA, 32 nt, Human
aucauauucgcuugugaccaugaagcuuguca

SEQ ID NO: 65983 - RNA, 32 nt, Human
aucauauuguagcuauuagggaagagaagaau

SEQ ID NO: 65984 - RNA, 32 nt, Human
aucauauuucauuuugcagauguggccauaaa

SEQ ID NO: 65985 - RNA, 32 nt, Human
aucauauuuccccuuggacacuugguuagacg

SEQ ID NO: 65986 - RNA, 32 nt, Human
aucaucaaaaccacagcauccuugaucagaga

SEQ ID NO: 65987 - RNA, 32 nt, Human
aucaucaagaagacuuuauggaugggcugucc

SEQ ID NO: 65988 - RNA, 32 nt, Human
aucaucacaaaacucaugaugcuccagcugcu

SEQ ID NO: 65989 - RNA, 24 nt, Human
aucaucaccaccaucaucaucauc

SEQ ID NO: 65990 - RNA, 32 nt, Human
aucaucacccugcucaagaaugugggcgagcg

SEQ ID NO: 65991 - RNA, 22 nt, Human
aucaucagaaaguccucccuga

SEQ ID NO: 65992 - RNA, 22 nt, Human
aucaucagaaugugucugaaaa

SEQ ID NO: 65993 - RNA, 32 nt, Human
aucaucagaucuuuuguacauaguggcaguau

SEQ ID NO: 65994 - RNA, 32 nt, Human
aucaucagaugugccuugagaauaguauaugu

SEQ ID NO: 65995 - RNA, 32 nt, Human
aucaucagccuauuuguaauaugucugccaca

SEQ ID NO: 65996 - RNA, 32 nt, Human
aucaucagcuauucaauaaaacacuaaucuag

SEQ ID NO: 65997 - RNA, 32 nt, Human
aucaucagcuauucaauaaaauacuaaucuag

SEQ ID NO: 65998 - RNA, 32 nt, Human
aucaucagcuuuccugauucugaggcuuuggg

SEQ ID NO: 65999 - RNA, 32 nt, Human
aucaucagggauuggccgauggagaugaaaug

SEQ ID NO: 66000 - RNA, 32 nt, Human
aucaucagucaaggaagacccacuggagagga

SEQ ID NO: 66001 - RNA, 32 nt, Human
aucaucagugaagaauuguauuucaagauuca

SEQ ID NO: 66002 - RNA, 32 nt, Human
aucaucaguuaggaauauuaacaugaaggaua

SEQ ID NO: 66003 - RNA, 32 nt, Human
aucaucauaggaguguggaagcugcugguaca

SEQ ID NO: 66004 - RNA, 24 nt, Human
aucaucaucaccaccaucaucauc

SEQ ID NO: 66005 - RNA, 32 nt, Human
aucaucaucauaaaugauucaaggccugaaug

SEQ ID NO: 66006 - RNA, 25 nt, Human
aucaucaucaucaucaucauccuca

SEQ ID NO: 66007 - RNA, 25 nt, Human
aucaucaucaucauccucauccuca

SEQ ID NO: 66008 - RNA, 32 nt, Human
aucaucaucgaugugaauaaauagacauauau

SEQ ID NO: 66009 - RNA, 32 nt, Human
aucaucaucuuccuccugugcagauggaaagg

SEQ ID NO: 66010 - RNA, 32 nt, Human
aucaucaucuucuaagagcugaucaagaaauu

SEQ ID NO: 66011 - RNA, 21 nt, Human
aucauccacagcccacccagc

SEQ ID NO: 66012 - RNA, 32 nt, Human
aucauccagguaaauggcacccaggugaguag

SEQ ID NO: 66013 - RNA, 24 nt, Human
aucauccauccacaugaacaugca

SEQ ID NO: 66014 - RNA, 24 nt, Human
aucauccauccaccccugcuguca

SEQ ID NO: 66015 - RNA, 32 nt, Human
aucauccauguccuccagaggagcuuccuccu

SEQ ID NO: 66016 - RNA, 32 nt, Human
aucaucccaacaaaauaugaaacuucuguaag

SEQ ID NO: 66017 - RNA, 32 nt, Human
aucauccccauccuccagagaaacccagggag

SEQ ID NO: 66018 - RNA, 32 nt, Human
aucaucccuaugccuuuccauccugguacaug

SEQ ID NO: 66019 - RNA, 32 nt, Human
aucaucccuccccaaccccagcucucucugcu

SEQ ID NO: 66020 - RNA, 32 nt, Human
aucaucccucuccaucuguggcucccugcccc

SEQ ID NO: 66021 - RNA, 32 nt, Human
aucauccucucuggggauggugggugggggug

SEQ ID NO: 66022 - RNA, 32 nt, Human
aucauccugaaaagaaggagacagggauuuuu

SEQ ID NO: 66023 - RNA, 32 nt, Human
aucauccugccaaacuccaggcucagaugaug

SEQ ID NO: 66024 - RNA, 32 nt, Human
aucauccugccaaacuccaggcucagauguca

SEQ ID NO: 66025 - RNA, 32 nt, Human
aucauccugccaaacuccaggcucagauuguc

SEQ ID NO: 66026 - RNA, 32 nt, Human
aucauccuggaguaccuuccuggaccacucuc

SEQ ID NO: 66027 - RNA, 32 nt, Human
aucauccugggagcaacugggaggcagagcac

SEQ ID NO: 66028 - RNA, 32 nt, Human
aucauccuguugaugaauucacagaauuaacu

SEQ ID NO: 66029 - RNA, 32 nt, Human
aucauccuuaaggagcuguaggccucucgagc

SEQ ID NO: 66030 - RNA, 32 nt, Human
aucauccuugaucuuauaucugagucucccau

SEQ ID NO: 66031 - RNA, 31 nt, Human
aucaucgccuccuagaauacccagcucaacg

SEQ ID NO: 66032 - RNA, 32 nt, Human
aucaucggcggcggcaggaucggccagaggag

SEQ ID NO: 66033 - RNA, 31 nt, Human
aucaucuacagccucugcccugguagcauaa

SEQ ID NO: 66034 - RNA, 32 nt, Human
aucaucuaucuaccuagauagacagagauauc

SEQ ID NO: 66035 - RNA, 32 nt, Human
aucaucuaucuuccuuuccuuuuucuuuucuu

SEQ ID NO: 66036 - RNA, 32 nt, Human
aucaucuaucuucuagaaaaggccaaccuugc

SEQ ID NO: 66037 - RNA, 32 nt, Human
aucaucucaggagguuucaggggccuguugac

SEQ ID NO: 66038 - RNA, 32 nt, Human
aucaucucauuuaauccucccuuccucccuau

SEQ ID NO: 66039 - RNA, 32 nt, Human
aucaucuccacugucccaagcagucacuaggu

SEQ ID NO: 66040 - RNA, 32 nt, Human
aucaucuccuccacuguuuccuuuucuauguc

SEQ ID NO: 66041 - RNA, 32 nt, Human
aucaucucucacaaaacacaggcaacccagac

SEQ ID NO: 66042 - RNA, 21 nt, Human
aucaucucugccaacagucuc

SEQ ID NO: 66043 - RNA, 32 nt, Human
aucaucucuggcaccuuccaccaguggagaga

SEQ ID NO: 66044 - RNA, 32 nt, Human
aucaucugaacccaggagacagguugcaguga

SEQ ID NO: 66045 - RNA, 32 nt, Human
aucaucugaagaucaucaucugaaaagaucag

SEQ ID NO: 66046 - RNA, 32 nt, Human
aucaucugagauuucagcaguggggccacgug

SEQ ID NO: 66047 - RNA, 32 nt, Human
aucaucugagccugggagggugaggaugcaug

SEQ ID NO: 66048 - RNA, 32 nt, Human
aucaucugaggguuugggcaucagcucugccu

SEQ ID NO: 66049 - RNA, 32 nt, Human
aucaucugaggucgggagauugagacuagccu

SEQ ID NO: 66050 - RNA, 32 nt, Human
aucaucugagugugggguaauugaguacauag

SEQ ID NO: 66051 - RNA, 32 nt, Human
aucaucugcagcugccuuccucggugggccuu

SEQ ID NO: 66052 - RNA, 32 nt, Human
aucaucugcaugugcaucaaggccaguccuau

SEQ ID NO: 66053 - RNA, 22 nt, Human
aucaucugccugcccuuccuga

SEQ ID NO: 66054 - RNA, 24 nt, Human
aucaucugccugcccuuccugaug

SEQ ID NO: 66055 - RNA, 25 nt, Human
aucaucugccuguuuuuucuugaua

SEQ ID NO: 66056 - RNA, 32 nt, Human
aucaucuggguggaucaccugaggucaggagu

SEQ ID NO: 66057 - RNA, 32 nt, Human
aucaucugucuauuuuucugucuaucaucuau

SEQ ID NO: 66058 - RNA, 32 nt, Human
aucaucuguuagccccuaacucuacugccuuc

SEQ ID NO: 66059 - RNA, 32 nt, Human
aucaucuuacaaaugccucuuugcuacuuugu

SEQ ID NO: 66060 - RNA, 25 nt, Human
aucaucuucacuucagacaauucag

SEQ ID NO: 66061 - RNA, 32 nt, Human
aucaucuucagccucaggaacaaggagcugaa

SEQ ID NO: 66062 - RNA, 32 nt, Human
aucaucuucaggauaaaauaaugaggacauua

SEQ ID NO: 66063 - RNA, 32 nt, Human
aucaucuuccuaggcagucucuuccccaaagu

SEQ ID NO: 66064 - RNA, 32 nt, Human
aucaucuucguuagugcagacaggucggagga

SEQ ID NO: 66065 - RNA, 32 nt, Human
aucaucuucuccuggccaaggcucugaccaug

SEQ ID NO: 66066 - RNA, 32 nt, Human
aucaucuuuagcucuccucucaguugaaugca

SEQ ID NO: 66067 - RNA, 32 nt, Human
aucaucuuucuuggaaaccaauugaaagcguc

SEQ ID NO: 66068 - RNA, 32 nt, Human
aucaucuuugaggccagaacagcccagcugug

SEQ ID NO: 66069 - RNA, 32 nt, Human
aucaugaauggaaugacacacucugaaccgaa

SEQ ID NO: 66070 - RNA, 32 nt, Human
aucaugaauguuucuacaacacugcugcauuc

SEQ ID NO: 66071 - RNA, 32 nt, Human
aucaugacacugcacuccagccugggcaacag

SEQ ID NO: 66072 - RNA, 32 nt, Human
aucaugacagugagacggugagauggauucgu

SEQ ID NO: 66073 - RNA, 32 nt, Human
aucaugaccauccuggccaacacagugaaacc

SEQ ID NO: 66074 - RNA, 32 nt, Human
aucaugacggaagaagagagugagccgcaauu

SEQ ID NO: 66075 - RNA, 32 nt, Human
aucaugacucacugcagccucaaacuccuggg

SEQ ID NO: 66076 - RNA, 32 nt, Human
aucaugagaaagagggaagaagaagaagggau

SEQ ID NO: 66077 - RNA, 32 nt, Human
aucaugagaaaugcuaucaacaucugugauuu

SEQ ID NO: 66078 - RNA, 32 nt, Human
aucaugagauggggagacuaucuuggauuauu

SEQ ID NO: 66079 - RNA, 32 nt, Human
aucaugaggaucagagaggaaaagucacuugc

SEQ ID NO: 66080 - RNA, 32 nt, Human
aucaugaggucagcagaucgagaccagccugg

SEQ ID NO: 66081 - RNA, 32 nt, Human
aucaugauccaguaucacaguauugugcuguu

SEQ ID NO: 66082 - RNA, 32 nt, Human
aucaugauggugcuacucagccugcuacaaau

SEQ ID NO: 66083 - RNA, 32 nt, Human
aucaugcaauagcaaagucacaguuauuccua

SEQ ID NO: 66084 - RNA, 32 nt, Human
aucaugcaaucuugcagugaagaaggaguauc

SEQ ID NO: 66085 - RNA, 32 nt, Human
aucaugcagcacaagcgggccaugcaggacau

SEQ ID NO: 66086 - RNA, 32 nt, Human
aucaugcaucacucucccuucugccuccuuca

SEQ ID NO: 66087 - RNA, 32 nt, Human
aucaugccacaccguacuccagccugggcgac

SEQ ID NO: 66088 - RNA, 32 nt, Human
aucaugccacaucacuccagccugggcaacag

SEQ ID NO: 66089 - RNA, 32 nt, Human
aucaugccaccaggaauaaccaggaaguuugc

SEQ ID NO: 66090 - RNA, 32 nt, Human
aucaugccaccgcacuccagccugggcaacag

SEQ ID NO: 66091 - RNA, 32 nt, Human
aucaugccaccgcacuucagccugggugacag

SEQ ID NO: 66092 - RNA, 32 nt, Human
aucaugccaccgcacuuccagccugggugaca

SEQ ID NO: 66093 - RNA, 32 nt, Human
aucaugccacuacacuccagccuggcgacaga

SEQ ID NO: 66094 - RNA, 32 nt, Human
aucaugccacuccacuccagucugggcgacag

SEQ ID NO: 66095 - RNA, 32 nt, Human
aucaugccacucuaccuugggugacagagaga

SEQ ID NO: 66096 - RNA, 32 nt, Human
aucaugccacugaacuccagccugggcaacag

SEQ ID NO: 66097 - RNA, 32 nt, Human
aucaugccacugaacuccagccugggugacag

SEQ ID NO: 66098 - RNA, 32 nt, Human
aucaugccacugcaaucuagccugggugacag

SEQ ID NO: 66099 - RNA, 32 nt, Human
aucaugccacugcaccccagcaccuggcuaca

SEQ ID NO: 66100 - RNA, 32 nt, Human
aucaugccacugcaccccagccugggcaacag

SEQ ID NO: 66101 - RNA, 32 nt, Human
aucaugccacugcacccuagcuuggguggcaa

SEQ ID NO: 66102 - RNA, 32 nt, Human
aucaugccacugcacccuagcuuggguggcag

SEQ ID NO: 66103 - RNA, 32 nt, Human
aucaugccacugcacuagagccugggcaacag

SEQ ID NO: 66104 - RNA, 32 nt, Human
aucaugccacugcacuccaaccugggcaacag

SEQ ID NO: 66105 - RNA, 32 nt, Human
aucaugccacugcacuccaaccugggcagcag

SEQ ID NO: 66106 - RNA, 32 nt, Human
aucaugccacugcacuccaaccugggcgacag

SEQ ID NO: 66107 - RNA, 32 nt, Human
aucaugccacugcacuccaaccugggugacag

SEQ ID NO: 66108 - RNA, 32 nt, Human
aucaugccacugcacuccacucugggcaacag

SEQ ID NO: 66109 - RNA, 32 nt, Human
aucaugccacugcacuccagcaugggugaugg

SEQ ID NO: 66110 - RNA, 32 nt, Human
aucaugccacugcacuccagcccaggugacag

SEQ ID NO: 66111 - RNA, 32 nt, Human
aucaugccacugcacuccagccugagugacag

SEQ ID NO: 66112 - RNA, 32 nt, Human
aucaugccacugcacuccagccuggacaacag

SEQ ID NO: 66113 - RNA, 32 nt, Human
aucaugccacugcacuccagccuggaugacag

SEQ ID NO: 66114 - RNA, 32 nt, Human
aucaugccacugcacuccagccugggcaacaa

SEQ ID NO: 66115 - RNA, 32 nt, Human
aucaugccacugcacuccagccugggcaacac

SEQ ID NO: 66116 - RNA, 32 nt, Human
aucaugccacugcacuccagccugggcaacag

SEQ ID NO: 66117 - RNA, 32 nt, Human
aucaugccacugcacuccagccugggcaacca

SEQ ID NO: 66118 - RNA, 32 nt, Human
aucaugccacugcacuccagccugggcaaugg

SEQ ID NO: 66119 - RNA, 32 nt, Human
aucaugccacugcacuccagccugggcagcag

SEQ ID NO: 66120 - RNA, 32 nt, Human
aucaugccacugcacuccagccugggcaugag

SEQ ID NO: 66121 - RNA, 32 nt, Human
aucaugccacugcacuccagccugggccagaa

SEQ ID NO: 66122 - RNA, 32 nt, Human
aucaugccacugcacuccagccugggcgacag

SEQ ID NO: 66123 - RNA, 32 nt, Human
aucaugccacugcacuccagccugggcgacgg

SEQ ID NO: 66124 - RNA, 32 nt, Human
aucaugccacugcacuccagccugggcgaugg

SEQ ID NO: 66125 - RNA, 32 nt, Human
aucaugccacugcacuccagccugggcggcag

SEQ ID NO: 66126 - RNA, 32 nt, Human
aucaugccacugcacuccagccuggggcugac

SEQ ID NO: 66127 - RNA, 32 nt, Human
aucaugccacugcacuccagccugggugacag

SEQ ID NO: 66128 - RNA, 32 nt, Human
aucaugccacugcacuccagcuugggcgacag

SEQ ID NO: 66129 - RNA, 32 nt, Human
aucaugccacugcacuccagcuugggugagag

SEQ ID NO: 66130 - RNA, 32 nt, Human
aucaugccacugcacuccagucuggaugacag

SEQ ID NO: 66131 - RNA, 32 nt, Human
aucaugccacugcacuccagucugggugacag

SEQ ID NO: 66132 - RNA, 32 nt, Human
aucaugccacugcacuccauccugggcaacaa

SEQ ID NO: 66133 - RNA, 32 nt, Human
aucaugccacugcacuccauccugggugacag

SEQ ID NO: 66134 - RNA, 32 nt, Human
aucaugccacugcacuccggccuaggugacag

SEQ ID NO: 66135 - RNA, 32 nt, Human
aucaugccacugcacuccuccgugggugacag

SEQ ID NO: 66136 - RNA, 32 nt, Human
aucaugccacugcacuccugccugggugacaa

SEQ ID NO: 66137 - RNA, 32 nt, Human
aucaugccacugcacucuagccuaggcuacag

SEQ ID NO: 66138 - RNA, 32 nt, Human
aucaugccacugcacucugggcuggguaacag

SEQ ID NO: 66139 - RNA, 32 nt, Human
aucaugccacugcacugcacuccagccugggu

SEQ ID NO: 66140 - RNA, 32 nt, Human
aucaugccacugcacugcagcccgggcgacag

SEQ ID NO: 66141 - RNA, 32 nt, Human
aucaugccacugcacuuccagccugggugaca

SEQ ID NO: 66142 - RNA, 32 nt, Human
aucaugccacugcacuuuagccugggcaacag

SEQ ID NO: 66143 - RNA, 32 nt, Human
aucaugccacugcacuuuagccugggugacag

SEQ ID NO: 66144 - RNA, 32 nt, Human
aucaugccacugcaugccagccugggcaacag

SEQ ID NO: 66145 - RNA, 32 nt, Human
aucaugccacugcauuccagccugggcaacag

SEQ ID NO: 66146 - RNA, 32 nt, Human
aucaugccacugcauuccagccugggcgacag

SEQ ID NO: 66147 - RNA, 32 nt, Human
aucaugccacugcauuccagccugugugaugg

SEQ ID NO: 66148 - RNA, 32 nt, Human
aucaugccacugcauucuagccugggcaacag

SEQ ID NO: 66149 - RNA, 32 nt, Human
aucaugccacugcauucuagcuuugauggcga

SEQ ID NO: 66150 - RNA, 32 nt, Human
aucaugccacuggacuccagccugggugaaag

SEQ ID NO: 66151 - RNA, 32 nt, Human
aucaugccacuguacuccagccuaggugacag

SEQ ID NO: 66152 - RNA, 32 nt, Human
aucaugccacuguacuccagccugggcgacag

SEQ ID NO: 66153 - RNA, 32 nt, Human
aucaugccacuguacuccagccugggugacag

SEQ ID NO: 66154 - RNA, 32 nt, Human
aucaugccagugcacuccagccugggcaacag

SEQ ID NO: 66155 - RNA, 32 nt, Human
aucaugccauggcacuccauccugggugacaa

SEQ ID NO: 66156 - RNA, 32 nt, Human
aucaugccauuacacuccagccugggcgacag

SEQ ID NO: 66157 - RNA, 32 nt, Human
aucaugccauuacuccagccugggugacauag

SEQ ID NO: 66158 - RNA, 32 nt, Human
aucaugccauuauacuccagccugggugacag

SEQ ID NO: 66159 - RNA, 32 nt, Human
aucaugccauugcacagcagccugggugacag

SEQ ID NO: 66160 - RNA, 32 nt, Human
aucaugccauugcacuccaaccugggugacag

SEQ ID NO: 66161 - RNA, 32 nt, Human
aucaugccauugcacuccagcccagguaacag

SEQ ID NO: 66162 - RNA, 32 nt, Human
aucaugccauugcacuccagcccggguuacag

SEQ ID NO: 66163 - RNA, 32 nt, Human
aucaugccauugcacuccagccuaggcaacaa

SEQ ID NO: 66164 - RNA, 32 nt, Human
aucaugccauugcacuccagccugagugacaa

SEQ ID NO: 66165 - RNA, 32 nt, Human
aucaugccauugcacuccagccuggacaacag

SEQ ID NO: 66166 - RNA, 32 nt, Human
aucaugccauugcacuccagccugggcaacaa

SEQ ID NO: 66167 - RNA, 32 nt, Human
aucaugccauugcacuccagccugggcaacag

SEQ ID NO: 66168 - RNA, 32 nt, Human
aucaugccauugcacuccagccugggcaacga

SEQ ID NO: 66169 - RNA, 32 nt, Human
aucaugccauugcacuccagccugggcgacaa

SEQ ID NO: 66170 - RNA, 32 nt, Human
aucaugccauugcacuccagccugggcgacag

SEQ ID NO: 66171 - RNA, 32 nt, Human
aucaugccauugcacuccagccugggugacaa

SEQ ID NO: 66172 - RNA, 32 nt, Human
aucaugccauugcacuccagccugggugacag

SEQ ID NO: 66173 - RNA, 32 nt, Human
aucaugccauugcacuccagccugggugauaa

SEQ ID NO: 66174 - RNA, 32 nt, Human
aucaugccauugcacuccagcuugggugacag

SEQ ID NO: 66175 - RNA, 32 nt, Human
aucaugccauugcacuccagucugggcgacag

SEQ ID NO: 66176 - RNA, 32 nt, Human
aucaugccauugcacugcaccugggcaacaag

SEQ ID NO: 66177 - RNA, 32 nt, Human
aucaugccauugcauuccagccuaggcaacac

SEQ ID NO: 66178 - RNA, 32 nt, Human
aucaugccauugcauuccagccuuggcgacag

SEQ ID NO: 66179 - RNA, 32 nt, Human
aucaugccauuguacuucaccugggcaacaag

SEQ ID NO: 66180 - RNA, 32 nt, Human
aucaugccccuguacuccagccugggugacag

SEQ ID NO: 66181 - RNA, 32 nt, Human
aucaugcccggucccaccccucccucugucca

SEQ ID NO: 66182 - RNA, 28 nt, Human
aucaugccgcugcauuccagccugggug

SEQ ID NO: 66183 - RNA, 32 nt, Human
aucaugccguuguacuccagcuugggcaacag

SEQ ID NO: 66184 - RNA, 32 nt, Human
aucaugccuacugcacuccagccugggcaaca

SEQ ID NO: 66185 - RNA, 32 nt, Human
aucaugccucacugcagccucgaccucccugg

SEQ ID NO: 66186 - RNA, 32 nt, Human
aucaugccucacugcagccucggcuuccuggg

SEQ ID NO: 66187 - RNA, 32 nt, Human
aucaugccuguaaucccagcacuuugggaagu

SEQ ID NO: 66188 - RNA, 32 nt, Human
aucaugccuguaaucccaguacuuugggaggc

SEQ ID NO: 66189 - RNA, 32 nt, Human
aucaugcgggugugugucuggggaagagacuu

SEQ ID NO: 66190 - RNA, 32 nt, Human
aucaugcuacugcacuccagccuaggugacag

SEQ ID NO: 66191 - RNA, 32 nt, Human
aucaugcuacugcacuccagccugggcgacag

SEQ ID NO: 66192 - RNA, 32 nt, Human
aucaugcuacugcacuccagccugggugacag

SEQ ID NO: 66193 - RNA, 32 nt, Human
aucaugcuacugcacuccagcuuagguggcaa

SEQ ID NO: 66194 - RNA, 32 nt, Human
aucaugcuacugcaugccagccugggugacaa

SEQ ID NO: 66195 - RNA, 32 nt, Human
aucaugcucauggggagggagcaggggaaggu

SEQ ID NO: 66196 - RNA, 32 nt, Human
aucaugcuccaauaugaucuauuccuucuucc

SEQ ID NO: 66197 - RNA, 32 nt, Human
aucaugcugugaggaagcccaagcuaaccaca

SEQ ID NO: 66198 - RNA, 32 nt, Human
aucaugcuugcagguuugagggcacaguguuu

SEQ ID NO: 66199 - RNA, 32 nt, Human
aucauggaaauggucgggauauuuacguggug

SEQ ID NO: 66200 - RNA, 32 nt, Human
aucauggaacauaagaaaaauaaaacagaugu

SEQ ID NO: 66201 - RNA, 32 nt, Human
aucauggagaacagcaugacagcugucuuugg

SEQ ID NO: 66202 - RNA, 32 nt, Human
aucauggaguuagcuaacagcccagggaacug

SEQ ID NO: 66203 - RNA, 32 nt, Human
aucauggaguuucuuuaaauguuuuccuagag

SEQ ID NO: 66204 - RNA, 26 nt, Human
aucauggaugcuggguggucugugua

SEQ ID NO: 66205 - RNA, 32 nt, Human
aucauggcaaacauguaaguggccaaagauaa

SEQ ID NO: 66206 - RNA, 32 nt, Human
aucauggcacugcacuccagccugggcaacag

SEQ ID NO: 66207 - RNA, 32 nt, Human
aucauggcaguuuggaaaacgggcuaacugua

SEQ ID NO: 66208 - RNA, 32 nt, Human
aucauggcaucauugcauuccagccugggcaa

SEQ ID NO: 66209 - RNA, 32 nt, Human
aucauggccaaagcagcugugauguggcaagc

SEQ ID NO: 66210 - RNA, 31 nt, Human
aucauggcccaggagugaggcauucagggcu

SEQ ID NO: 66211 - RNA, 32 nt, Human
aucauggcccaggagugaggcauucagggcug

SEQ ID NO: 66212 - RNA, 32 nt, Human
aucauggcucacugcaaccuccaccuccuggg

SEQ ID NO: 66213 - RNA, 32 nt, Human
aucauggcucacugcaaccucugccucccggu

SEQ ID NO: 66214 - RNA, 32 nt, Human
aucauggcucacugcaaccuugaccucccagg

SEQ ID NO: 66215 - RNA, 32 nt, Human
aucauggcucacugcagccccaaccuucaggg

SEQ ID NO: 66216 - RNA, 32 nt, Human
aucauggcucacugcagccucaaccuagccau

SEQ ID NO: 66217 - RNA, 32 nt, Human
aucauggcucacugcagccucaaccuugaaga

SEQ ID NO: 66218 - RNA, 32 nt, Human
aucauggcucacugcagccuccaccucccagg

SEQ ID NO: 66219 - RNA, 32 nt, Human
aucauggcucacugcagccuccaccuccuuga

SEQ ID NO: 66220 - RNA, 32 nt, Human
aucauggcucacugcagccucgaacuccuggg

SEQ ID NO: 66221 - RNA, 32 nt, Human
aucauggcucacugcagccucgaccucccagg

SEQ ID NO: 66222 - RNA, 32 nt, Human
aucauggcucacugcagccucgaccuccuggg

SEQ ID NO: 66223 - RNA, 32 nt, Human
aucauggcucacugcagccucgagcuccugag

SEQ ID NO: 66224 - RNA, 32 nt, Human
aucauggcucacugcagccuggagcuccuggg

SEQ ID NO: 66225 - RNA, 32 nt, Human
aucauggcucacugcagccuugaacucccaga

SEQ ID NO: 66226 - RNA, 32 nt, Human
aucauggcucacugcagccuugaacuccugag

SEQ ID NO: 66227 - RNA, 32 nt, Human
aucauggcucacugcagccuugaacuccuggc

SEQ ID NO: 66228 - RNA, 32 nt, Human
aucauggcucacugcagccuugaccuuccagc

SEQ ID NO: 66229 - RNA, 32 nt, Human
aucauggcucacugcagccuugacuucucagg

SEQ ID NO: 66230 - RNA, 32 nt, Human
aucauggcucacugcagucucaaucucucugg

SEQ ID NO: 66231 - RNA, 32 nt, Human
aucauggcucacugcagucucugccucccagg

SEQ ID NO: 66232 - RNA, 32 nt, Human
aucauggcucacugcggccucaaacuccgggg

SEQ ID NO: 66233 - RNA, 32 nt, Human
aucauggcucacuguaaccucugccucccagg

SEQ ID NO: 66234 - RNA, 32 nt, Human
aucauggcucacuguagccacaaccucucagg

SEQ ID NO: 66235 - RNA, 32 nt, Human
aucauggcucacuguagccucgaccuccuggg

SEQ ID NO: 66236 - RNA, 32 nt, Human
aucauggcucauugcaaccuugaauuccuggg

SEQ ID NO: 66237 - RNA, 32 nt, Human
aucaugggaaugauagcccagaacaaaaagaa

SEQ ID NO: 66238 - RNA, 32 nt, Human
aucaugggacugcacuccagccugggugacag

SEQ ID NO: 66239 - RNA, 32 nt, Human
aucaugggacuugccauuuaggaggauaauuu

SEQ ID NO: 66240 - RNA, 28 nt, Human
aucaugggaggcggcugguggugggcuc

SEQ ID NO: 66241 - RNA, 32 nt, Human
aucaugggccuaauuacagucacugcaguggc

SEQ ID NO: 66242 - RNA, 32 nt, Human
aucaugggccuggagagcagcagugagcucuu

SEQ ID NO: 66243 - RNA, 32 nt, Human
aucaugggcuguauuuucaaguugauucauaa

SEQ ID NO: 66244 - RNA, 32 nt, Human
aucauggggaaaggauaguaaccuggccgggu

SEQ ID NO: 66245 - RNA, 32 nt, Human
aucauggggaacauauucuucuaguuuaagau

SEQ ID NO: 66246 - RNA, 32 nt, Human
aucauggggaaggagugcugugauugacuagu

SEQ ID NO: 66247 - RNA, 32 nt, Human
aucauggggugagcuuugaagugcuggugguc

SEQ ID NO: 66248 - RNA, 32 nt, Human
aucauggguccaggcugauagcaauggacaga

SEQ ID NO: 66249 - RNA, 32 nt, Human
aucaugguaaauauaaacuaaccacaagauag

SEQ ID NO: 66250 - RNA, 32 nt, Human
aucaugguaggcagugcuugaaugagaaaagg

SEQ ID NO: 66251 - RNA, 32 nt, Human
aucaugguccagucuucggguuucaccuccua

SEQ ID NO: 66252 - RNA, 32 nt, Human
aucauggugaagaugacaugagaugcuaaugc

SEQ ID NO: 66253 - RNA, 32 nt, Human
aucauggugaagcugaugcagcguugccgagg

SEQ ID NO: 66254 - RNA, 32 nt, Human
aucaugguggggaccgagauagagagggagac

SEQ ID NO: 66255 - RNA, 32 nt, Human
aucauggugucaggaaggcugagauguauugg

SEQ ID NO: 66256 - RNA, 32 nt, Human
aucaugguucacugcaaucucgacuuccaguu

SEQ ID NO: 66257 - RNA, 28 nt, Human
aucaugguucacugcagccucagccucc

SEQ ID NO: 66258 - RNA, 32 nt, Human
aucaugguucacugcagccucgaccucccagg

SEQ ID NO: 66259 - RNA, 32 nt, Human
aucaugguucacugcagccuugaccuccaggg

SEQ ID NO: 66260 - RNA, 32 nt, Human
aucaugguucacugcagucuugaccucccagg

SEQ ID NO: 66261 - RNA, 32 nt, Human
aucaugguucacugcagucuugaccuuuuggg

SEQ ID NO: 66262 - RNA, 32 nt, Human
aucaugguugaauugcaaacagguuggauaga

SEQ ID NO: 66263 - RNA, 32 nt, Human
aucaugguugagugaggauaagggaaagaaua

SEQ ID NO: 66264 - RNA, 32 nt, Human
aucauguaagaauuuaaacuugcugaauguaa

SEQ ID NO: 66265 - RNA, 32 nt, Human
aucauguaaggauuuaaacuugcugaauguaa

SEQ ID NO: 66266 - RNA, 32 nt, Human
aucauguagggagggacggggaggggagccag

SEQ ID NO: 66267 - RNA, 32 nt, Human
aucauguauaugguuuguguucuuuuacugug

SEQ ID NO: 66268 - RNA, 32 nt, Human
aucauguauuuugccucauguauuuuuaucac

SEQ ID NO: 66269 - RNA, 32 nt, Human
aucaugucacugcacuccagccugggugacag

SEQ ID NO: 66270 - RNA, 32 nt, Human
aucaugucacugcacucuagcuugggagacag

SEQ ID NO: 66271 - RNA, 32 nt, Human
aucaugucacuguacuccagccugggcaacag

SEQ ID NO: 66272 - RNA, 32 nt, Human
aucaugucagcacauaguagguguggccuaug

SEQ ID NO: 66273 - RNA, 26 nt, Human
aucaugucagcuuaucuucuuugaua

SEQ ID NO: 66274 - RNA, 28 nt, Human
aucauguccauggcuggcagagcugucc

SEQ ID NO: 66275 - RNA, 32 nt, Human
aucauguccuuacacuccagccuggauaacag

SEQ ID NO: 66276 - RNA, 19 nt, Human
aucaugucuaaccaaguaa

SEQ ID NO: 66277 - RNA, 28 nt, Human
aucaugucuacagccucugccgccuccu

SEQ ID NO: 66278 - RNA, 32 nt, Human
aucaugucugguaaccgggugccugagcccca

SEQ ID NO: 66279 - RNA, 32 nt, Human
aucaugucuguaauccuagcacugugggaggc

SEQ ID NO: 66280 - RNA, 32 nt, Human
aucaugucuuccuuugugcuaaacccacugcu

SEQ ID NO: 66281 - RNA, 32 nt, Human
aucaugugcuguaaaguuuuccuaaaugaggc

SEQ ID NO: 66282 - RNA, 32 nt, Human
aucaugugcuuuggugauuguuucugaaaagg

SEQ ID NO: 66283 - RNA, 29 nt, Human
aucauguggcugcugucacccuugaccag

SEQ ID NO: 66284 - RNA, 32 nt, Human
aucauguggucuuaagcaaaucacaucaucuc

SEQ ID NO: 66285 - RNA, 32 nt, Human
aucauguuauccaucccucuccaggucagaaa

SEQ ID NO: 66286 - RNA, 32 nt, Human
aucauguuggacacaguugagggugacaugca

SEQ ID NO: 66287 - RNA, 32 nt, Human
aucauguuucuguguaccuagcaauguguucc

SEQ ID NO: 66288 - RNA, 21 nt, Human
aucauguuuucccuguuggua

SEQ ID NO: 66289 - RNA, 32 nt, Human
aucauguuuugcuacaguuugcaggugaaaaa

SEQ ID NO: 66290 - RNA, 32 nt, Human
aucauuaacccccagaccagccucagaacuga

SEQ ID NO: 66291 - RNA, 32 nt, Human
aucauuacccuuuaucacaugaauucuuggaa

SEQ ID NO: 66292 - RNA, 32 nt, Human
aucauuaccugguccugagagcugagcuguag

SEQ ID NO: 66293 - RNA, 32 nt, Human
aucauuacuucugcauuuuauuuuuguuuucu

SEQ ID NO: 66294 - RNA, 32 nt, Human
aucauuagauguccucaccccuccucacugcc

SEQ ID NO: 66295 - RNA, 32 nt, Human
aucauuagugaucuguguuguagaacaugagg

SEQ ID NO: 66296 - RNA, 32 nt, Human
aucauuaucacucuuaacccacccuaaaauuu

SEQ ID NO: 66297 - RNA, 32 nt, Human
aucauuaucugcuccuugucuacuucucuacu

SEQ ID NO: 66298 - RNA, 32 nt, Human
aucauuauuaucuauuuuuaaaagcuucaaaa

SEQ ID NO: 66299 - RNA, 32 nt, Human
aucauuauucacacuccucugcccucgauuug

SEQ ID NO: 66300 - RNA, 32 nt, Human
aucauuauugucacaaauaugcacaaaacaag

SEQ ID NO: 66301 - RNA, 32 nt, Human
aucauuauuugagacuguccugugccugauua

SEQ ID NO: 66302 - RNA, 32 nt, Human
aucauucaaggagccagacaugagguccugca

SEQ ID NO: 66303 - RNA, 32 nt, Human
aucauucacagugcccuccccacagcacuacc

SEQ ID NO: 66304 - RNA, 32 nt, Human
aucauucagagcacagccugaagagaccagug

SEQ ID NO: 66305 - RNA, 32 nt, Human
aucauucagcucaccuggugcaucuggguuga

SEQ ID NO: 66306 - RNA, 32 nt, Human
aucauucaggggcagccuggggacuugaggga

SEQ ID NO: 66307 - RNA, 32 nt, Human
aucauucauauguaaguaaauauguaccuuac

SEQ ID NO: 66308 - RNA, 32 nt, Human
aucauucauccaguuaagaauuugaagaagug

SEQ ID NO: 66309 - RNA, 32 nt, Human
aucauucaucccuuaacaggcacauuagaucu

SEQ ID NO: 66310 - RNA, 32 nt, Human
aucauucauggaccaguagauuguugaaaguu

SEQ ID NO: 66311 - RNA, 32 nt, Human
aucauuccaccuaccuccacuggaccaaaaag

SEQ ID NO: 66312 - RNA, 32 nt, Human
aucauuccacugcauuucagccugggggauac

SEQ ID NO: 66313 - RNA, 32 nt, Human
aucauuccagaaggaaaagugugucagggcaa

SEQ ID NO: 66314 - RNA, 32 nt, Human
aucauuccagccugggcaacaagagugaaacu

SEQ ID NO: 66315 - RNA, 32 nt, Human
aucauuccauuacacuccagccugggcaccag

SEQ ID NO: 66316 - RNA, 32 nt, Human
aucauucccagaaacauuucccagaaaauguu

SEQ ID NO: 66317 - RNA, 32 nt, Human
aucauuccuacaugauuccuggcggcagaaac

SEQ ID NO: 66318 - RNA, 32 nt, Human
aucauuccuccucacuaggagcacuuugaugu

SEQ ID NO: 66319 - RNA, 32 nt, Human
aucauuccuucucuuguuaaagguagaagaau

SEQ ID NO: 66320 - RNA, 32 nt, Human
aucauucgagagcagacagaaggggaguacag

SEQ ID NO: 66321 - RNA, 32 nt, Human
aucauucuccucugcugacaaccucugccgca

SEQ ID NO: 66322 - RNA, 32 nt, Human
aucauucucgacaauccucccugccccgaaac

SEQ ID NO: 66323 - RNA, 23 nt, Human
aucauucugacugcguucaaaaa

SEQ ID NO: 66324 - RNA, 32 nt, Human
aucauucuggcuggagagugcaaugugucauu

SEQ ID NO: 66325 - RNA, 22 nt, Human
aucauucuguuuuugcuuaaaa

SEQ ID NO: 66326 - RNA, 32 nt, Human
aucauucuuggcugugugcgguggcucacgcc

SEQ ID NO: 66327 - RNA, 32 nt, Human
aucauucuuguugccacagcuggagcucucaa

SEQ ID NO: 66328 - RNA, 32 nt, Human
aucauugaaauggauuggucagaaauugcuau

SEQ ID NO: 66329 - RNA, 32 nt, Human
aucauugaaauuacaguagauuuuuaagaaua

SEQ ID NO: 66330 - RNA, 32 nt, Human
aucauugagaagaggaagaagauggaagcuga

SEQ ID NO: 66331 - RNA, 32 nt, Human
aucauugauagucuugugugucucacauauca

SEQ ID NO: 66332 - RNA, 32 nt, Human
aucauugauuucaguguucaagacagaagaag

SEQ ID NO: 66333 - RNA, 32 nt, Human
aucauugcacuccagccugggugacagaguga

SEQ ID NO: 66334 - RNA, 32 nt, Human
aucauugcauuccagccugggcaacagagcaa

SEQ ID NO: 66335 - RNA, 31 nt, Human
aucauugccaaugggaucaccaaagccuucc

SEQ ID NO: 66336 - RNA, 32 nt, Human
aucauugcuagauuuaaagggacuuguaagca

SEQ ID NO: 66337 - RNA, 32 nt, Human
aucauugcucacuguagccucgaauuccuggg

SEQ ID NO: 66338 - RNA, 32 nt, Human
aucauugcucuccuggacaaaguuaacagcau

SEQ ID NO: 66339 - RNA, 32 nt, Human
aucauugcuucuagaagucugcaauucuuuac

SEQ ID NO: 66340 - RNA, 32 nt, Human
aucauuggaaaacaguggaaagaggcugugug

SEQ ID NO: 66341 - RNA, 32 nt, Human
aucauuggauucaguucccaaaauagaauguu

SEQ ID NO: 66342 - RNA, 32 nt, Human
aucauuggcuguacuguggagcugucacaucu

SEQ ID NO: 66343 - RNA, 32 nt, Human
aucauugguaccaauggcauugagaggaggug

SEQ ID NO: 66344 - RNA, 32 nt, Human
aucauuguccugagagagaggagcagcgcggu

SEQ ID NO: 66345 - RNA, 32 nt, Human
aucauugucuaugauaucugcaauggaaauga

SEQ ID NO: 66346 - RNA, 32 nt, Human
aucauugugcacccaccuuccucccagggacu

SEQ ID NO: 66347 - RNA, 32 nt, Human
aucauuguggaaggcaggaccucuccugggcu

SEQ ID NO: 66348 - RNA, 32 nt, Human
aucauuguguuggacucuaucucuccauguag

SEQ ID NO: 66349 - RNA, 32 nt, Human
aucauuguucucuccaucucccuagucaucau

SEQ ID NO: 66350 - RNA, 16 nt, Human
aucauuguugccucuc

SEQ ID NO: 66351 - RNA, 32 nt, Human
aucauuguuggccaggcuggucucaaacuccu

SEQ ID NO: 66352 - RNA, 32 nt, Human
aucauuuaaacccaggaggcagagguugcagu

SEQ ID NO: 66353 - RNA, 32 nt, Human
aucauuuacagugccacacggaacccuguauu

SEQ ID NO: 66354 - RNA, 32 nt, Human
aucauuuacugauuugcagugaugaauauuuu

SEQ ID NO: 66355 - RNA, 32 nt, Human
aucauuuagauuaacauuuggggccugauagg

SEQ ID NO: 66356 - RNA, 32 nt, Human
aucauuuagcucccacuuguaagugagaacaa

SEQ ID NO: 66357 - RNA, 32 nt, Human
aucauuuaguacuuuugucuucucccaugugc

SEQ ID NO: 66358 - RNA, 32 nt, Human
aucauuucacccaaguauuuuaaaguaugugu

SEQ ID NO: 66359 - RNA, 32 nt, Human
aucauuucaccucacuccagccugggugacag

SEQ ID NO: 66360 - RNA, 32 nt, Human
aucauuucacuugucaggagugugugugagug

SEQ ID NO: 66361 - RNA, 31 nt, Human
aucauuucagcccaggagguuguggauacag

SEQ ID NO: 66362 - RNA, 32 nt, Human
aucauuuccguuuugccugugacuguaaagag

SEQ ID NO: 66363 - RNA, 32 nt, Human
aucauuuccuuuguaacagaguuuuacgacuu

SEQ ID NO: 66364 - RNA, 32 nt, Human
aucauuucugaugauagcuugggaauagagau

SEQ ID NO: 66365 - RNA, 32 nt, Human
aucauuugaacccaggacacggagauugcagu

SEQ ID NO: 66366 - RNA, 32 nt, Human
aucauuugaacccgggaggcagagguugcagu

SEQ ID NO: 66367 - RNA, 32 nt, Human
aucauuugaaguauuuuuauauguauaucuau

SEQ ID NO: 66368 - RNA, 32 nt, Human
aucauuugagccaggagguugagguugcagug

SEQ ID NO: 66369 - RNA, 32 nt, Human
aucauuugagcccagagguagaggcugcagug

SEQ ID NO: 66370 - RNA, 32 nt, Human
aucauuugagcccaggaggcugaggcugcaau

SEQ ID NO: 66371 - RNA, 32 nt, Human
aucauuugcagcugucugcuucagaaagugag

SEQ ID NO: 66372 - RNA, 32 nt, Human
aucauuugcuuuguuggcaucuguguuuauuu

SEQ ID NO: 66373 - RNA, 32 nt, Human
aucauuugucauuuuucucuggcagauuguuu

SEQ ID NO: 66374 - RNA, 32 nt, Human
aucauuuuaaaccaaaaagcugcuggauaaca

SEQ ID NO: 66375 - RNA, 32 nt, Human
aucauuuuagggucucaaaaggccccaaagag

SEQ ID NO: 66376 - RNA, 32 nt, Human
aucauuuucagcucacgugucuugucauucuu

SEQ ID NO: 66377 - RNA, 32 nt, Human
aucauuuucauaauggaaaagacucagaaaau

SEQ ID NO: 66378 - RNA, 32 nt, Human
aucauuuuccaagguggcagagcugcuugcuc

SEQ ID NO: 66379 - RNA, 32 nt, Human
aucauuuuccuacggcguuagcacuuuaagca

SEQ ID NO: 66380 - RNA, 32 nt, Human
aucauuuugccuuugggaaaauugcaggggag

SEQ ID NO: 66381 - RNA, 32 nt, Human
aucauuuuucucucauaucuuccuaauaugca

SEQ ID NO: 66382 - RNA, 32 nt, Human
aucauuuuugcuuuucaauagacuuaaggagu

SEQ ID NO: 66383 - RNA, 32 nt, Human
auccaaaaauuagcugggcaugguggcaugca

SEQ ID NO: 66384 - RNA, 32 nt, Human
auccaaaacaaagaaguaccuggaguggagag

SEQ ID NO: 66385 - RNA, 32 nt, Human
auccaaaaccagccuggauuucauacauggac

SEQ ID NO: 66386 - RNA, 32 nt, Human
auccaaaccaagaagaaaucccugauuuaccu

SEQ ID NO: 66387 - RNA, 32 nt, Human
auccaaaccccaaggauucagagaaucuugua

SEQ ID NO: 66388 - RNA, 32 nt, Human
auccaaaccccagaccacuauccaggagccug

SEQ ID NO: 66389 - RNA, 32 nt, Human
auccaaagaacagccguuccugugcggcccuu

SEQ ID NO: 66390 - RNA, 25 nt, Human
auccaaauacaugaaucuaaagcug

SEQ ID NO: 66391 - RNA, 32 nt, Human
auccaaaucaaugucuugaauccuuugaaaac

SEQ ID NO: 66392 - RNA, 32 nt, Human
auccaaaucugcauugcaaugagacccccagg

SEQ ID NO: 66393 - RNA, 32 nt, Human
auccaaauguacugagguuaccacacacuuga

SEQ ID NO: 66394 - RNA, 23 nt, Human
auccaaauguguaccauugguga

SEQ ID NO: 66395 - RNA, 32 nt, Human
auccaaauuagaaaaugcuacucuccggauga

SEQ ID NO: 66396 - RNA, 32 nt, Human
auccaaauuuuuaaacuugcuuccuaauaagu

SEQ ID NO: 66397 - RNA, 32 nt, Human
auccaacaauguccugcuuccuuggggagcug

SEQ ID NO: 66398 - RNA, 32 nt, Human
auccaacaggagacccaagaauugguucaaau

SEQ ID NO: 66399 - RNA, 32 nt, Human
auccaacaguaggaguaagugguguacaccau

SEQ ID NO: 66400 - RNA, 32 nt, Human
auccaacauggugaagccccgucucuacuaaa

SEQ ID NO: 66401 - RNA, 32 nt, Human
auccaacccaugagcuucuccccagcuaaaca

SEQ ID NO: 66402 - RNA, 32 nt, Human
auccaacccaugaugagcuccucuuccuggcu

SEQ ID NO: 66403 - RNA, 32 nt, Human
auccaaccuaauguucaugcaggauagagaac

SEQ ID NO: 66404 - RNA, 32 nt, Human
auccaaccucacuacauuguagcucaguccaa

SEQ ID NO: 66405 - RNA, 32 nt, Human
auccaaccucuuggugcuucaguuuccucauc

SEQ ID NO: 66406 - RNA, 22 nt, Human
auccaaccuggggauuuuuuaa

SEQ ID NO: 66407 - RNA, 32 nt, Human
auccaacuaccuguggaauccuaaggccccuu

SEQ ID NO: 66408 - RNA, 32 nt, Human
auccaacuccaggggccccuguugcacucccc

SEQ ID NO: 66409 - RNA, 32 nt, Human
auccaacucugacuucggaggcauucccagcc

SEQ ID NO: 66410 - RNA, 32 nt, Human
auccaacuggacaacgugugggauggaccugg

SEQ ID NO: 66411 - RNA, 32 nt, Human
auccaagaaccacagcucaucugccaacaauc

SEQ ID NO: 66412 - RNA, 32 nt, Human
auccaagaacuaagggcaaccacugggcuccg

SEQ ID NO: 66413 - RNA, 32 nt, Human
auccaagaagauuuccuggcucuggcuuuuag

SEQ ID NO: 66414 - RNA, 32 nt, Human
auccaagacaacagggugcacugcugccugua

SEQ ID NO: 66415 - RNA, 22 nt, Human
auccaagaggccaguccuccau

SEQ ID NO: 66416 - RNA, 32 nt, Human
auccaagaugcugaguggaaguggacccuggg

SEQ ID NO: 66417 - RNA, 25 nt, Human
auccaagcagauaaaaucaaggcug

SEQ ID NO: 66418 - RNA, 32 nt, Human
auccaagccuaucauuguaguaggguacuucu

SEQ ID NO: 66419 - RNA, 32 nt, Human
auccaagccuccaaggucaggaugggaucucu

SEQ ID NO: 66420 - RNA, 23 nt, Human
auccaagccugccucccaagguc

SEQ ID NO: 66421 - RNA, 32 nt, Human
auccaaggcucuucccaggccugcuggcugca

SEQ ID NO: 66422 - RNA, 32 nt, Human
auccaagggaaaggggaaaucucacagggcag

SEQ ID NO: 66423 - RNA, 32 nt, Human
auccaagggaaaguggggaggagccagcucuc

SEQ ID NO: 66424 - RNA, 32 nt, Human
auccaagggaaugaacaagaagacuaccuuga

SEQ ID NO: 66425 - RNA, 30 nt, Human
auccaaguaguauauggacaguccagggcu

SEQ ID NO: 66426 - RNA, 32 nt, Human
auccaaguauuugggagugaagaugguuguug

SEQ ID NO: 66427 - RNA, 23 nt, Human
auccaagucacccagcucuggaa

SEQ ID NO: 66428 - RNA, 32 nt, Human
auccaagucauagcuucaugucucucugcgcu

SEQ ID NO: 66429 - RNA, 23 nt, Human
auccaagugauccucccaccuca

SEQ ID NO: 66430 - RNA, 32 nt, Human
auccaaguuuuacccauuaagaaacugaagau

SEQ ID NO: 66431 - RNA, 20 nt, Human
auccaauagucuuccuccau

SEQ ID NO: 66432 - RNA, 32 nt, Human
auccaauauuguaauccuagcacuuugggagg

SEQ ID NO: 66433 - RNA, 32 nt, Human
auccaaucagccaguggccaggagagaacaaa

SEQ ID NO: 66434 - RNA, 32 nt, Human
auccaaucccugcugccaccuccugggaugga

SEQ ID NO: 66435 - RNA, 32 nt, Human
auccaaucugaauuuaccuggaagaggccuug

SEQ ID NO: 66436 - RNA, 32 nt, Human
auccaaugacaaugguacuggcauacacaggg

SEQ ID NO: 66437 - RNA, 32 nt, Human
auccaaugagauaaaaagugaaauuucccaga

SEQ ID NO: 66438 - RNA, 32 nt, Human
auccaauguugacuuagccaugguagaacucu

SEQ ID NO: 66439 - RNA, 32 nt, Human
auccaauuguugggaaagcaucuuaaguuuaa

SEQ ID NO: 66440 - RNA, 32 nt, Human
auccaauuuagcaaaauugguaccaaaaugau

SEQ ID NO: 66441 - RNA, 32 nt, Human
auccacaaagcuacggacuugcagcccacggg

SEQ ID NO: 66442 - RNA, 32 nt, Human
auccacaaauaccaccagcugcuucauccaca

SEQ ID NO: 66443 - RNA, 32 nt, Human
auccacaacugacucacacuuccccagacagg

SEQ ID NO: 66444 - RNA, 21 nt, Human
auccacaagaggcuuggcaaa

SEQ ID NO: 66445 - RNA, 22 nt, Human
auccacaaucccauuacuggga

SEQ ID NO: 66446 - RNA, 19 nt, Human
auccacacaacaccaggac

SEQ ID NO: 66447 - RNA, 22 nt, Human
auccacacaacaccaggacuua

SEQ ID NO: 66448 - RNA, 32 nt, Human
auccacacacaauccacacacgcauagcaaac

SEQ ID NO: 66449 - RNA, 32 nt, Human
auccacacacuaaucaucucagugucuuuaau

SEQ ID NO: 66450 - RNA, 32 nt, Human
auccacacacugcacccccacuccuggggcag

SEQ ID NO: 66451 - RNA, 32 nt, Human
auccacacagcccgguucaagaggagggagua

SEQ ID NO: 66452 - RNA, 19 nt, Human
auccacacaggaaaggacu

SEQ ID NO: 66453 - RNA, 32 nt, Human
auccacacaucuuuagaacuagucgucuccuc

SEQ ID NO: 66454 - RNA, 32 nt, Human
auccacaccacucuucgccacccggcugggag

SEQ ID NO: 66455 - RNA, 32 nt, Human
auccacaccaugguuuucuucuaguuccugau

SEQ ID NO: 66456 - RNA, 32 nt, Human
auccacacccaccuaucccugcagcuaauuua

SEQ ID NO: 66457 - RNA, 32 nt, Human
auccacacugcacacugccuagcccaaaacgu

SEQ ID NO: 66458 - RNA, 32 nt, Human
auccacacuucuguuaacuucccaccaccauc

SEQ ID NO: 66459 - RNA, 23 nt, Human
auccacagcuaagacaccaggac

SEQ ID NO: 66460 - RNA, 32 nt, Human
auccacagcuacuuacucaucuugccucuggc

SEQ ID NO: 66461 - RNA, 32 nt, Human
auccacagcucuguuaaauaaaugggagaaau

SEQ ID NO: 66462 - RNA, 20 nt, Human
auccacagcuuuuccuccau

SEQ ID NO: 66463 - RNA, 32 nt, Human
auccacaggguaacagugguuaccagcgaugc

SEQ ID NO: 66464 - RNA, 32 nt, Human
auccacaggguagagguuggguguguguacgg

SEQ ID NO: 66465 - RNA, 32 nt, Human
auccacagguuacaucuuuacuauucuguuac

SEQ ID NO: 66466 - RNA, 32 nt, Human
auccacagucuacaaaaccccacagcuccuga

SEQ ID NO: 66467 - RNA, 32 nt, Human
auccacaguguggauggauacuuauuugguga

SEQ ID NO: 66468 - RNA, 32 nt, Human
auccacauauccacaagaagugccucuuaggu

SEQ ID NO: 66469 - RNA, 19 nt, Human
auccacauccccuccccca

SEQ ID NO: 66470 - RNA, 31 nt, Human
auccacaugagcuacucucagggcaccaguc

SEQ ID NO: 66471 - RNA, 32 nt, Human
auccaccaagacuuuagucucucccaacccag

SEQ ID NO: 66472 - RNA, 32 nt, Human
auccaccagguaacaaugguuacccaugagga

SEQ ID NO: 66473 - RNA, 32 nt, Human
auccaccagguaacaaugguuacccuagaggc

SEQ ID NO: 66474 - RNA, 32 nt, Human
auccaccagguaacacugguuucccacgaggc

SEQ ID NO: 66475 - RNA, 32 nt, Human
auccaccagguaacagugguuacacacgaggu

SEQ ID NO: 66476 - RNA, 32 nt, Human
auccaccagguaacagugguuacccaagaggc

SEQ ID NO: 66477 - RNA, 32 nt, Human
auccaccagguaacagugguuacccuagagac

SEQ ID NO: 66478 - RNA, 32 nt, Human
auccaccagguaacagugguuacccuagaggc

SEQ ID NO: 66479 - RNA, 32 nt, Human
auccaccagguaacagugguuaccugcgaggc

SEQ ID NO: 66480 - RNA, 32 nt, Human
auccaccagguaacagugguuaccugggagac

SEQ ID NO: 66481 - RNA, 32 nt, Human
auccaccauaaggaaaggagacccuggaccaa

SEQ ID NO: 66482 - RNA, 32 nt, Human
auccaccaucauccuucaugucugcgauggag

SEQ ID NO: 66483 - RNA, 32 nt, Human
auccaccaugccacaugacagccagccugaca

SEQ ID NO: 66484 - RNA, 32 nt, Human
auccaccaugcugcugugagacucgggcaguu

SEQ ID NO: 66485 - RNA, 18 nt, Human
auccacccaccucagccu

SEQ ID NO: 66486 - RNA, 23 nt, Human
auccacccaccucagccuccgaa

SEQ ID NO: 66487 - RNA, 22 nt, Human
auccacccaccucagccuucca

SEQ ID NO: 66488 - RNA, 23 nt, Human
auccacccaccucggccuccgaa

SEQ ID NO: 66489 - RNA, 32 nt, Human
auccacccaccucggucuccccaaagugcugg

SEQ ID NO: 66490 - RNA, 32 nt, Human
auccacccacgcuuuuuccuuucuugagauaa

SEQ ID NO: 66491 - RNA, 32 nt, Human
auccacccagaaccuccacccucugacaccau

SEQ ID NO: 66492 - RNA, 32 nt, Human
auccacccagaagaaagggauucaggcauggg

SEQ ID NO: 66493 - RNA, 32 nt, Human
auccacccagcggacccagccugcugcggagg

SEQ ID NO: 66494 - RNA, 32 nt, Human
auccacccagcucuccuggagcuguucugguc

SEQ ID NO: 66495 - RNA, 21 nt, Human
auccacccagggaccccggag

SEQ ID NO: 66496 - RNA, 32 nt, Human
auccaccccaggagcccaggagccuugccuga

SEQ ID NO: 66497 - RNA, 17 nt, Human
auccaccccggcucccc

SEQ ID NO: 66498 - RNA, 32 nt, Human
auccacccuccaccucuagcccagacaccccc

SEQ ID NO: 66499 - RNA, 32 nt, Human
auccacccucuacuuucugucucucugaucuu

SEQ ID NO: 66500 - RNA, 32 nt, Human
auccacccugaggaaagagcauggagagccag

SEQ ID NO: 66501 - RNA, 21 nt, Human
auccacccuuauuugcucuca

SEQ ID NO: 66502 - RNA, 32 nt, Human
auccaccuacagcccucaugccugggcccagc

SEQ ID NO: 66503 - RNA, 32 nt, Human
auccaccucccuggcccugccccugcacucag

SEQ ID NO: 66504 - RNA, 32 nt, Human
auccaccuccucuguguccucccaaggcagca

SEQ ID NO: 66505 - RNA, 22 nt, Human
auccaccucguccuuccuccau

SEQ ID NO: 66506 - RNA, 22 nt, Human
auccaccugccucagccuucca

SEQ ID NO: 66507 - RNA, 32 nt, Human
auccaccugccucugagcuuucaccucugacu

SEQ ID NO: 66508 - RNA, 32 nt, Human
auccaccugcugggacccugcaguccucggcc

SEQ ID NO: 66509 - RNA, 22 nt, Human
auccaccugcuucagccuacca

SEQ ID NO: 66510 - RNA, 22 nt, Human
auccaccugcuucggccuccca

SEQ ID NO: 66511 - RNA, 32 nt, Human
auccaccuuacuguguuuucuacuuucagaaa

SEQ ID NO: 66512 - RNA, 19 nt, Human
auccacgacaacaaucacc

SEQ ID NO: 66513 - RNA, 32 nt, Human
auccacgaccaagcucuuccaccugcggagcu

SEQ ID NO: 66514 - RNA, 32 nt, Human
auccacgaggcagaggcagcaguagcgcugga

SEQ ID NO: 66515 - RNA, 32 nt, Human
auccacgagggagcuccuggccagcagccguc

SEQ ID NO: 66516 - RNA, 32 nt, Human
auccacgcucaaucucaggucuucacgcgggg

SEQ ID NO: 66517 - RNA, 31 nt, Human
auccacggccuuuucuggcaagagaagggcc

SEQ ID NO: 66518 - RNA, 32 nt, Human
auccacguccccguacuggcucagggaaaggc

SEQ ID NO: 66519 - RNA, 32 nt, Human
auccacgugcuuugaaacuuuuccccucaccc

SEQ ID NO: 66520 - RNA, 32 nt, Human
auccacuacaccugacagagacauccucuacu

SEQ ID NO: 66521 - RNA, 32 nt, Human
auccacuaucgugggcuaacagugagcuugag

SEQ ID NO: 66522 - RNA, 32 nt, Human
auccacuaugagacuuacagggccaagcggcu

SEQ ID NO: 66523 - RNA, 32 nt, Human
auccacucauccccuucuucucuccuuggccu

SEQ ID NO: 66524 - RNA, 32 nt, Human
auccacuccccagucucccaaaguacugggau

SEQ ID NO: 66525 - RNA, 32 nt, Human
auccacuccugcucucccuccugcaggugacc

SEQ ID NO: 66526 - RNA, 32 nt, Human
auccacuccuuugaagaucacagccauguguc

SEQ ID NO: 66527 - RNA, 32 nt, Human
auccacucuugguggguggaaguacgguuacc

SEQ ID NO: 66528 - RNA, 32 nt, Human
auccacugagccuucaucucccaugaacuuga

SEQ ID NO: 66529 - RNA, 32 nt, Human
auccacuggggaggcaggguuuguaaacuugu

SEQ ID NO: 66530 - RNA, 32 nt, Human
auccacugguaagccacaucuaaugaagagaa

SEQ ID NO: 66531 - RNA, 32 nt, Human
auccacuggucacaucauaacugucuauaggg

SEQ ID NO: 66532 - RNA, 32 nt, Human
auccacuguggacccccaaaaccuguccuguc

SEQ ID NO: 66533 - RNA, 32 nt, Human
auccacuguuuugccuucugagguuucaguua

SEQ ID NO: 66534 - RNA, 32 nt, Human
auccacuuccaggggacauuuucacaaaauau

SEQ ID NO: 66535 - RNA, 32 nt, Human
auccacuucccaaacagagccccacgcagguu

SEQ ID NO: 66536 - RNA, 32 nt, Human
auccacuugccugaggagcuggaggaagggga

SEQ ID NO: 66537 - RNA, 32 nt, Human
auccacuugcuggagcccauguuuacagacag

SEQ ID NO: 66538 - RNA, 32 nt, Human
auccacuuuagcaaaguggggugccuacuugg

SEQ ID NO: 66539 - RNA, 32 nt, Human
auccacuuugagggugagugccuccagcagaa

SEQ ID NO: 66540 - RNA, 32 nt, Human
auccacuuugcagcuucuuugagauuaccuau

SEQ ID NO: 66541 - RNA, 19 nt, Human
auccacuuugcaggacuua

SEQ ID NO: 66542 - RNA, 32 nt, Human
auccagaacgacggaggaaggggcggagaggg

SEQ ID NO: 66543 - RNA, 32 nt, Human
auccagaagacaaccacuucucuccuuuuaga

SEQ ID NO: 66544 - RNA, 32 nt, Human
auccagaagagaagaaagacauggcugacagu

SEQ ID NO: 66545 - RNA, 32 nt, Human
auccagaagaugacucaagaccggccucugcu

SEQ ID NO: 66546 - RNA, 32 nt, Human
auccagaagccagaggauggacuaagugggag

SEQ ID NO: 66547 - RNA, 32 nt, Human
auccagaaggaagauuuguggccagauugccu

SEQ ID NO: 66548 - RNA, 32 nt, Human
auccagaaggcggagguugcagugagcugaga

SEQ ID NO: 66549 - RNA, 32 nt, Human
auccagaagggcccagcacggcccuguggggu

SEQ ID NO: 66550 - RNA, 23 nt, Human
auccagaaucuacaaugaacuca

SEQ ID NO: 66551 - RNA, 32 nt, Human
auccagacacccccacccccacccucagauca

SEQ ID NO: 66552 - RNA, 32 nt, Human
auccagacaucaugaauuuuacaugguacucu

SEQ ID NO: 66553 - RNA, 32 nt, Human
auccagaccauccuggccaacauggugaaauc

SEQ ID NO: 66554 - RNA, 32 nt, Human
auccagacccucccuucuugcuggggagggga

SEQ ID NO: 66555 - RNA, 32 nt, Human
auccagaccguccuggcuaacauggugaaacc

SEQ ID NO: 66556 - RNA, 24 nt, Human
auccagaccuuguucacacucuca

SEQ ID NO: 66557 - RNA, 32 nt, Human
auccagagacaugcucuaaaucuucacaaaaa

SEQ ID NO: 66558 - RNA, 32 nt, Human
auccagagacuuuaucuuaucucuacauaaca

SEQ ID NO: 66559 - RNA, 32 nt, Human
auccagagagccaaggucagagggagagaugg

SEQ ID NO: 66560 - RNA, 22 nt, Human
auccagagauugaacacagaga

SEQ ID NO: 66561 - RNA, 24 nt, Human
auccagagcaggguggguuagaga

SEQ ID NO: 66562 - RNA, 32 nt, Human
auccagagccuggcuguggggaaagugaccac

SEQ ID NO: 66563 - RNA, 32 nt, Human
auccagagcuaacaggcuaaaguuucccauuc

SEQ ID NO: 66564 - RNA, 32 nt, Human
auccagaggcaggaacugggaauaggcuugga

SEQ ID NO: 66565 - RNA, 32 nt, Human
auccagaggccaccugcccugucuucucguac

SEQ ID NO: 66566 - RNA, 24 nt, Human
auccagaggcggagguugcaguga

SEQ ID NO: 66567 - RNA, 32 nt, Human
auccagagggcaacagugguuacccaugaggg

SEQ ID NO: 66568 - RNA, 32 nt, Human
auccagagggcgaaagauaucucuccauugug

SEQ ID NO: 66569 - RNA, 32 nt, Human
auccagaggggguggggcagaggcggagucug

SEQ ID NO: 66570 - RNA, 32 nt, Human
auccagagguuacuaaccacgggugaguaaca

SEQ ID NO: 66571 - RNA, 25 nt, Human
auccagagguuucagcuuucaguua

SEQ ID NO: 66572 - RNA, 32 nt, Human
auccagagucaucucagcccugccuuucucug

SEQ ID NO: 66573 - RNA, 22 nt, Human
auccagaguggggagacagaga

SEQ ID NO: 66574 - RNA, 32 nt, Human
auccagauaugccacacuucugccugcuguug

SEQ ID NO: 66575 - RNA, 18 nt, Human
auccagaucuccagucuu

SEQ ID NO: 66576 - RNA, 32 nt, Human
auccagcacaucuccccaguggcagccucgcc

SEQ ID NO: 66577 - RNA, 32 nt, Human
auccagcagcuggcaucugaccuuggcacucg

SEQ ID NO: 66578 - RNA, 32 nt, Human
auccagcagcuguggcgaaaaacgaaccgggg

SEQ ID NO: 66579 - RNA, 32 nt, Human
auccagcaggagaaagaguguguucaaacauc

SEQ ID NO: 66580 - RNA, 32 nt, Human
auccagcagguggagguugcagugagccaaga

SEQ ID NO: 66581 - RNA, 32 nt, Human
auccagcagucaccccaguugcagagaugagu

SEQ ID NO: 66582 - RNA, 32 nt, Human
auccagcagugugcuauucgugccucaguuuu

SEQ ID NO: 66583 - RNA, 32 nt, Human
auccagccaagaagaugaaaacuacagagaag

SEQ ID NO: 66584 - RNA, 32 nt, Human
auccagccacagcacuccagccugggugacag

SEQ ID NO: 66585 - RNA, 32 nt, Human
auccagccacgauggaugacauggcuguggau

SEQ ID NO: 66586 - RNA, 32 nt, Human
auccagccagcccagcccugugaaagauggag

SEQ ID NO: 66587 - RNA, 32 nt, Human
auccagccagcgccccuggccuguggacgccc

SEQ ID NO: 66588 - RNA, 32 nt, Human
auccagccagcuggaggaaggaagggcaggcu

SEQ ID NO: 66589 - RNA, 32 nt, Human
auccagccauauuagucuucuggcuuuucuuu

SEQ ID NO: 66590 - RNA, 32 nt, Human
auccagccauguaggaaaccugagaugcagug

SEQ ID NO: 66591 - RNA, 32 nt, Human
auccagcccauccuggccaacauggugaaacc

SEQ ID NO: 66592 - RNA, 30 nt, Human
auccagccccagcugggugacagagugaga

SEQ ID NO: 66593 - RNA, 23 nt, Human
auccagccccuccaaccucccuc

SEQ ID NO: 66594 - RNA, 32 nt, Human
auccagccucccagcagccucugcgacgggcg

SEQ ID NO: 66595 - RNA, 32 nt, Human
auccagccuccugcgacuccccaaucuggaug

SEQ ID NO: 66596 - RNA, 29 nt, Human
auccagccugcuugcaacccugggguccu

SEQ ID NO: 66597 - RNA, 25 nt, Human
auccagccugggugacagggugaga

SEQ ID NO: 66598 - RNA, 32 nt, Human
auccagccuuagccaaucaccaccucauuggg

SEQ ID NO: 66599 - RNA, 32 nt, Human
auccagccuucaacuaucuuuacccuggaaaa

SEQ ID NO: 66600 - RNA, 32 nt, Human
auccagccuucacuccagcugguuaaaaaugu

SEQ ID NO: 66601 - RNA, 23 nt, Human
auccagcgagcccuccccaccca

SEQ ID NO: 66602 - RNA, 32 nt, Human
auccagcgagugcccacccaaugucagagcag

SEQ ID NO: 66603 - RNA, 32 nt, Human
auccagcgccaggucccgccagucccagcugc

SEQ ID NO: 66604 - RNA, 32 nt, Human
auccagcgcccagagagacaccagagaaccca

SEQ ID NO: 66605 - RNA, 32 nt, Human
auccagcuaccagggcccucccaguggaggca

SEQ ID NO: 66606 - RNA, 32 nt, Human
auccagcuaggccugaccugugccucaucccg

SEQ ID NO: 66607 - RNA, 32 nt, Human
auccagcucuggaggccacggugcaggcauag

SEQ ID NO: 66608 - RNA, 32 nt, Human
auccagcugagcggacugcuccaagugugugu

SEQ ID NO: 66609 - RNA, 20 nt, Human
auccagcuuagcugcugcug

SEQ ID NO: 66610 - RNA, 22 nt, Human
auccagcuucauuauggcugcu

SEQ ID NO: 66611 - RNA, 32 nt, Human
auccagcuuccauccccuccccaaccuggcag

SEQ ID NO: 66612 - RNA, 25 nt, Human
auccagcuucccuguccuggcccca

SEQ ID NO: 66613 - RNA, 32 nt, Human
auccaggaacacccucccagcaggggauggga

SEQ ID NO: 66614 - RNA, 32 nt, Human
auccaggaaccugacuagcccaaauagcaagu

SEQ ID NO: 66615 - RNA, 32 nt, Human
auccaggaagaaugagguacauggacaacugg

SEQ ID NO: 66616 - RNA, 32 nt, Human
auccaggaagcagagguugcggugagccgaaa

SEQ ID NO: 66617 - RNA, 32 nt, Human
auccaggaauacagucugcagugcagcaacag

SEQ ID NO: 66618 - RNA, 32 nt, Human
auccaggaauguuaaggugaggugaagcucac

SEQ ID NO: 66619 - RNA, 32 nt, Human
auccaggacuccagagagucaggucaaccccg

SEQ ID NO: 66620 - RNA, 32 nt, Human
auccaggagauagaaguugcagugagcugaga

SEQ ID NO: 66621 - RNA, 32 nt, Human
auccaggagaugcucacaggccacaggaccug

SEQ ID NO: 66622 - RNA, 32 nt, Human
auccaggagccacaggaagcagugagcuuucu

SEQ ID NO: 66623 - RNA, 32 nt, Human
auccaggagcccagacugagcaaauaaguacu

SEQ ID NO: 66624 - RNA, 32 nt, Human
auccaggaggaggagguugcagugagccgaga

SEQ ID NO: 66625 - RNA, 32 nt, Human
auccaggaggcaaagguugcagugagccaaaa

SEQ ID NO: 66626 - RNA, 32 nt, Human
auccaggaggcagagcuugcagugagcugaga

SEQ ID NO: 66627 - RNA, 32 nt, Human
auccaggaggcagaggcuguggugagccaaga

SEQ ID NO: 66628 - RNA, 32 nt, Human
auccaggaggcagagguugcaaugagccaaga

SEQ ID NO: 66629 - RNA, 32 nt, Human
auccaggaggcagagguugcagugaguggagg

SEQ ID NO: 66630 - RNA, 32 nt, Human
auccaggaggcgaagguugcagugagcugaga

SEQ ID NO: 66631 - RNA, 32 nt, Human
auccaggaggcggagguugcagugaaccaaga

SEQ ID NO: 66632 - RNA, 32 nt, Human
auccaggaggcggagguugcagugagccaaga

SEQ ID NO: 66633 - RNA, 32 nt, Human
auccaggaggcggagguugcagugagccgaga

SEQ ID NO: 66634 - RNA, 32 nt, Human
auccaggagguggagccugcagugagccaaga

SEQ ID NO: 66635 - RNA, 32 nt, Human
auccaggagguggagcuugcagugagccgaga

SEQ ID NO: 66636 - RNA, 32 nt, Human
auccaggagguggagguugcagcgagccaaga

SEQ ID NO: 66637 - RNA, 32 nt, Human
auccaggagguggagguugcagugagcugaga

SEQ ID NO: 66638 - RNA, 32 nt, Human
auccaggaguccauagaaaagcuucgugcccu

SEQ ID NO: 66639 - RNA, 32 nt, Human
auccaggaguuuaaagagagucuggcucuguc

SEQ ID NO: 66640 - RNA, 32 nt, Human
auccaggaugacugaggaaucccucgucacug

SEQ ID NO: 66641 - RNA, 32 nt, Human
auccaggauguacaaggugcagccaaggcagg

SEQ ID NO: 66642 - RNA, 32 nt, Human
auccaggcaaagugcugugagggggucugagc

SEQ ID NO: 66643 - RNA, 32 nt, Human
auccaggcaauggcauuaaacauucuugcuau

SEQ ID NO: 66644 - RNA, 32 nt, Human
auccaggcacugggcccgugcagagaaggcac

SEQ ID NO: 66645 - RNA, 31 nt, Human
auccaggcacuuuucuuugugcagguguagu

SEQ ID NO: 66646 - RNA, 32 nt, Human
auccaggcagcacuuccagaaacuugacacac

SEQ ID NO: 66647 - RNA, 32 nt, Human
auccaggcagcucuucccaaucugccuucuua

SEQ ID NO: 66648 - RNA, 32 nt, Human
auccaggcaugaugccaggugcaccaacuuac

SEQ ID NO: 66649 - RNA, 32 nt, Human
auccaggcauuugagaccagccuggguaacau

SEQ ID NO: 66650 - RNA, 32 nt, Human
auccaggccccagaaagccucaccuacagaca

SEQ ID NO: 66651 - RNA, 32 nt, Human
auccaggcccucagcucagcaugggugguucu

SEQ ID NO: 66652 - RNA, 20 nt, Human
auccaggccuacuccuccau

SEQ ID NO: 66653 - RNA, 32 nt, Human
auccaggccugccaaggugaagagauacagcc

SEQ ID NO: 66654 - RNA, 32 nt, Human
auccaggcucagguuucugccuccagguacag

SEQ ID NO: 66655 - RNA, 32 nt, Human
auccaggcuccagcagcaaagccccaggagaa

SEQ ID NO: 66656 - RNA, 32 nt, Human
auccaggcuccccucauuucaccuucagcaua

SEQ ID NO: 66657 - RNA, 32 nt, Human
auccaggcugaucucaaacuccuggcuucaag

SEQ ID NO: 66658 - RNA, 32 nt, Human
auccaggcuggccucaaacuccugggcucaag

SEQ ID NO: 66659 - RNA, 32 nt, Human
auccaggcugugagccgcugcugagcaugggg

SEQ ID NO: 66660 - RNA, 32 nt, Human
auccaggcugugcgcacccaggagaaggagca

SEQ ID NO: 66661 - RNA, 32 nt, Human
auccagggaugggaggggaagggacggauggg

SEQ ID NO: 66662 - RNA, 20 nt, Human
auccagggcuuaaacaugau

SEQ ID NO: 66663 - RNA, 32 nt, Human
auccaggggagggagauggaggcacccaaacu

SEQ ID NO: 66664 - RNA, 32 nt, Human
auccagguagccuaaggacuccuggucacugg

SEQ ID NO: 66665 - RNA, 32 nt, Human
auccagguaguggaggaugaucucagagugac

SEQ ID NO: 66666 - RNA, 32 nt, Human
auccaggucuuggggagcucaggacuugggcu

SEQ ID NO: 66667 - RNA, 32 nt, Human
auccagguggcggagguugcagugagccgaga

SEQ ID NO: 66668 - RNA, 32 nt, Human
auccaggugggaggugucagagcccagcucau

SEQ ID NO: 66669 - RNA, 20 nt, Human
auccagguucucgccaggcc

SEQ ID NO: 66670 - RNA, 32 nt, Human
auccagguugcugcugccacuagagggcagcc

SEQ ID NO: 66671 - RNA, 32 nt, Human
auccaguaagcuugugacaaaugcagacuccu

SEQ ID NO: 66672 - RNA, 32 nt, Human
auccaguaaugggaacugccaucucuguagaa

SEQ ID NO: 66673 - RNA, 32 nt, Human
auccaguacagaaucgguccaggagggugcgg

SEQ ID NO: 66674 - RNA, 32 nt, Human
auccaguacugaggacccaggugggagaaugu

SEQ ID NO: 66675 - RNA, 32 nt, Human
auccaguaucaugcagugcugcccucauccuc

SEQ ID NO: 66676 - RNA, 32 nt, Human
auccagucaaucucauggaggguggaguaugg

SEQ ID NO: 66677 - RNA, 32 nt, Human
auccagucagcagauggucagcagguucaaau

SEQ ID NO: 66678 - RNA, 32 nt, Human
auccaguccacuuuaccaucaguguuuaagga

SEQ ID NO: 66679 - RNA, 24 nt, Human
auccaguccuagcacuugaucuca

SEQ ID NO: 66680 - RNA, 32 nt, Human
auccagucuaggauccucacaccagcuacuug

SEQ ID NO: 66681 - RNA, 32 nt, Human
auccagucucuugccuuccucuccucccugau

SEQ ID NO: 66682 - RNA, 32 nt, Human
auccagugaacccguccaggugccccaagagg

SEQ ID NO: 66683 - RNA, 32 nt, Human
auccagugaggugaaugaagagaguggggauc

SEQ ID NO: 66684 - RNA, 32 nt, Human
auccagugcacucaaguuuggccaagggacuc

SEQ ID NO: 66685 - RNA, 32 nt, Human
auccagugcagccugcaccaugagcuucuggu

SEQ ID NO: 66686 - RNA, 32 nt, Human
auccagugcauccccuaauucaaaaccauccu

SEQ ID NO: 66687 - RNA, 32 nt, Human
auccagugcugacguccuugugccucaccuau

SEQ ID NO: 66688 - RNA, 32 nt, Human
auccaguggaggugaugcugaaguggcagccc

SEQ ID NO: 66689 - RNA, 32 nt, Human
auccaguggcugggaggcuccaggccugagga

SEQ ID NO: 66690 - RNA, 32 nt, Human
auccagugggaaccuggguuuucuagcuggug

SEQ ID NO: 66691 - RNA, 32 nt, Human
auccagugggaggcggaggccgugagcgccca

SEQ ID NO: 66692 - RNA, 32 nt, Human
auccagugggcaagaaguagcaaacacacugg

SEQ ID NO: 66693 - RNA, 32 nt, Human
auccagugguuuucgugaaauggaauuauguu

SEQ ID NO: 66694 - RNA, 32 nt, Human
auccaguguauaaauccaauaucaugucuugu

SEQ ID NO: 66695 - RNA, 32 nt, Human
auccagugucaaagcuaugauacauuguugcu

SEQ ID NO: 66696 - RNA, 32 nt, Human
auccagugucagcuccagccuauucaauuuca

SEQ ID NO: 66697 - RNA, 32 nt, Human
auccagugugcaccccuccccauucacagagc

SEQ ID NO: 66698 - RNA, 32 nt, Human
auccaguguugaggcagaagagggugccugug

SEQ ID NO: 66699 - RNA, 32 nt, Human
auccaguucaucccagaaacacugaccugauu

SEQ ID NO: 66700 - RNA, 18 nt, Human
auccaguuccacauguuc

SEQ ID NO: 66701 - RNA, 32 nt, Human
auccaguucuuaucuacucucccuuuauucag

SEQ ID NO: 66702 - RNA, 22 nt, Human
auccaguuuacccugugcuguc

SEQ ID NO: 66703 - RNA, 32 nt, Human
auccaguuuauagcaugccuguccuaaguuac

SEQ ID NO: 66704 - RNA, 32 nt, Human
auccaguuuaugaggguugggggugagcaagg

SEQ ID NO: 66705 - RNA, 32 nt, Human
auccaguuucuuuccccagcaguuucuguccu

SEQ ID NO: 66706 - RNA, 32 nt, Human
auccaguuuuccucuuuuacggaccauccuca

SEQ ID NO: 66707 - RNA, 32 nt, Human
auccauaaaucugcaguauccaaccaaacuag

SEQ ID NO: 66708 - RNA, 32 nt, Human
auccauaaaugauacauaguagugcuuauuau

SEQ ID NO: 66709 - RNA, 32 nt, Human
auccauacaccauuaagaaacagccucugcau

SEQ ID NO: 66710 - RNA, 32 nt, Human
auccauacaggcaacuuagcuggugaaaggac

SEQ ID NO: 66711 - RNA, 32 nt, Human
auccauagagaagguaguugaaggguagggcc

SEQ ID NO: 66712 - RNA, 32 nt, Human
auccauagaguaauaaagucacuguguguaga

SEQ ID NO: 66713 - RNA, 30 nt, Human
auccauagccucuucagauuccuuauaaaa

SEQ ID NO: 66714 - RNA, 32 nt, Human
auccauaugcaucagaaucaccuguguauuuc

SEQ ID NO: 66715 - RNA, 32 nt, Human
auccauaugugaagaacuggagaagaaggagc

SEQ ID NO: 66716 - RNA, 32 nt, Human
auccaucaagcuuggcucaugggaucugcugc

SEQ ID NO: 66717 - RNA, 32 nt, Human
auccaucaaggauuuccauaggggugacuggu

SEQ ID NO: 66718 - RNA, 32 nt, Human
auccaucagaaugacaccuucucagguugccu

SEQ ID NO: 66719 - RNA, 32 nt, Human
auccaucagacaccugcugggcaucugcugug

SEQ ID NO: 66720 - RNA, 22 nt, Human
auccaucagagaugacucuguc

SEQ ID NO: 66721 - RNA, 32 nt, Human
auccaucagcaaccucagaccaacccaagaag

SEQ ID NO: 66722 - RNA, 32 nt, Human
auccaucauccaggcugcagugcagcagcgcc

SEQ ID NO: 66723 - RNA, 32 nt, Human
auccaucaucccucacagagauguagaggaug

SEQ ID NO: 66724 - RNA, 32 nt, Human
auccauccaaaacaaauuccuccuucaaccuu

SEQ ID NO: 66725 - RNA, 32 nt, Human
auccauccaucauccauccauccaccuaacca

SEQ ID NO: 66726 - RNA, 32 nt, Human
auccauccauccacccauccaucauccaucca

SEQ ID NO: 66727 - RNA, 32 nt, Human
auccauccauccacccauccauccauccaucc

SEQ ID NO: 66728 - RNA, 32 nt, Human
auccauccauccacccauccuccauccaucca

SEQ ID NO: 66729 - RNA, 32 nt, Human
auccauccauccauccuucauccagccaucca

SEQ ID NO: 66730 - RNA, 32 nt, Human
auccauccauccuccauccaucauccauccau

SEQ ID NO: 66731 - RNA, 32 nt, Human
auccaucccacacaccuuggccuucugcaagc

SEQ ID NO: 66732 - RNA, 32 nt, Human
auccaucccagcaccuggaacagggucugaca

SEQ ID NO: 66733 - RNA, 32 nt, Human
auccaucccuccacggucacguuccuguuucc

SEQ ID NO: 66734 - RNA, 32 nt, Human
auccauccguccagccaagagcucuucaucug

SEQ ID NO: 66735 - RNA, 32 nt, Human
auccauccugcacuucuacaguuuagaaagua

SEQ ID NO: 66736 - RNA, 32 nt, Human
auccauccugcaggagcacacaguucuaaacc

SEQ ID NO: 66737 - RNA, 32 nt, Human
auccauccuggagccucauggaacaggaugau

SEQ ID NO: 66738 - RNA, 32 nt, Human
auccaucuauaccucacagcaguccugggggu

SEQ ID NO: 66739 - RNA, 32 nt, Human
auccaucucugagauggaugagaaucugaguc

SEQ ID NO: 66740 - RNA, 32 nt, Human
auccaucugccucugcaggugaccguaacaac

SEQ ID NO: 66741 - RNA, 32 nt, Human
auccaucugcuccccucaacucucagagcacu

SEQ ID NO: 66742 - RNA, 32 nt, Human
auccaugagacaccccgaguugugcuucauga

SEQ ID NO: 66743 - RNA, 32 nt, Human
auccaugaggcugcugcgccauguugcacuaa

SEQ ID NO: 66744 - RNA, 32 nt, Human
auccaugcaacagucuucucugugcauuuccc

SEQ ID NO: 66745 - RNA, 32 nt, Human
auccaugcacuccuaacaugaacuaauucuca

SEQ ID NO: 66746 - RNA, 32 nt, Human
auccaugcaguaugugcaagaccuauugcugu

SEQ ID NO: 66747 - RNA, 32 nt, Human
auccaugccaauaguugcuguccccuuccagg

SEQ ID NO: 66748 - RNA, 18 nt, Human
auccaugcccccucuuua

SEQ ID NO: 66749 - RNA, 32 nt, Human
auccaugccuguaaugaagucauacuauugug

SEQ ID NO: 66750 - RNA, 32 nt, Human
auccaugcuaucuccuaaagcagucauucuga

SEQ ID NO: 66751 - RNA, 32 nt, Human
auccaugcuggguggggugagguggggugcuu

SEQ ID NO: 66752 - RNA, 32 nt, Human
auccauggaagagccuuugugaggugaauuac

SEQ ID NO: 66753 - RNA, 32 nt, Human
auccauggcagucuggcuuacaagcaauacua

SEQ ID NO: 66754 - RNA, 32 nt, Human
auccauggcccgagggggaaccugguggucuc

SEQ ID NO: 66755 - RNA, 32 nt, Human
auccauggccuggaccaccccagaucccacau

SEQ ID NO: 66756 - RNA, 32 nt, Human
auccauggcuuccuggacguucacccguagag

SEQ ID NO: 66757 - RNA, 32 nt, Human
auccaugggcacuaacccgccucccaggcuga

SEQ ID NO: 66758 - RNA, 32 nt, Human
auccaugggcaggggaauuuggagagagaccu

SEQ ID NO: 66759 - RNA, 32 nt, Human
auccaugguuaggaaauguuuaguuggagauu

SEQ ID NO: 66760 - RNA, 32 nt, Human
auccauguauagagagaaaauuuggaaaacag

SEQ ID NO: 66761 - RNA, 32 nt, Human
auccauguauugccuuucagcucuagaucccc

SEQ ID NO: 66762 - RNA, 32 nt, Human
auccauguuggagccaucaaucaaagaauugc

SEQ ID NO: 66763 - RNA, 32 nt, Human
auccauuaaaauuaauuugugcaucagaaaau

SEQ ID NO: 66764 - RNA, 32 nt, Human
auccauuaugagcugaggucagccuggaucug

SEQ ID NO: 66765 - RNA, 32 nt, Human
auccauucacaguucuuugggccagacaugcc

SEQ ID NO: 66766 - RNA, 32 nt, Human
auccauucagaaucugccccaguggagaccca

SEQ ID NO: 66767 - RNA, 32 nt, Human
auccauucauuucugagcuuuaaccucugguu

SEQ ID NO: 66768 - RNA, 32 nt, Human
auccauucugcugcugauagaucaagaaguac

SEQ ID NO: 66769 - RNA, 32 nt, Human
auccauucuguccugacgcaguacaguuuuga

SEQ ID NO: 66770 - RNA, 32 nt, Human
auccauugacucaaacuuucaccauuguaucc

SEQ ID NO: 66771 - RNA, 30 nt, Human
auccauugcauuucucaggaagugaacuaa

SEQ ID NO: 66772 - RNA, 32 nt, Human
auccauugucauaaccauuuuuaaaagucaaa

SEQ ID NO: 66773 - RNA, 32 nt, Human
auccauuuaacccugaguggacacagcacaug

SEQ ID NO: 66774 - RNA, 32 nt, Human
auccauuuaccacauauuuccaucugauaauc

SEQ ID NO: 66775 - RNA, 32 nt, Human
auccauuuaucuuuuguauaucuaagacucau

SEQ ID NO: 66776 - RNA, 32 nt, Human
auccauuuccauucaucucccccucaaaucau

SEQ ID NO: 66777 - RNA, 32 nt, Human
auccauuucuauuccuccacugcauugccauc

SEQ ID NO: 66778 - RNA, 32 nt, Human
auccauuugucaucaggaaucaaaacccacag

SEQ ID NO: 66779 - RNA, 32 nt, Human
auccauuuucacuaaaagugugugaaaccuac

SEQ ID NO: 66780 - RNA, 32 nt, Human
auccauuuucagaauuuccuggcauugauuua

SEQ ID NO: 66781 - RNA, 32 nt, Human
aucccaaaauggcugggcgaaaacuugcucua

SEQ ID NO: 66782 - RNA, 32 nt, Human
aucccaaaccuauaaaaccaguuccacuccca

SEQ ID NO: 66783 - RNA, 32 nt, Human
aucccaaagugcugagauuacaguuggcgcuc

SEQ ID NO: 66784 - RNA, 32 nt, Human
aucccaaagugcugggacuacaggccugagcu

SEQ ID NO: 66785 - RNA, 32 nt, Human
aucccaaagugcugggauuacagcaucccagc

SEQ ID NO: 66786 - RNA, 32 nt, Human
aucccaaagugcugggauuacaggcaugagcc

SEQ ID NO: 66787 - RNA, 32 nt, Human
aucccaaagugcugggauuacaggcgugagcc

SEQ ID NO: 66788 - RNA, 32 nt, Human
aucccaaagugcugggauuacaggugugagcc

SEQ ID NO: 66789 - RNA, 32 nt, Human
aucccaaagugcugggauuacgagcgugaguc

SEQ ID NO: 66790 - RNA, 32 nt, Human
aucccaaaguguugggauuacagccgugagcc

SEQ ID NO: 66791 - RNA, 32 nt, Human
aucccaaaguguugggauuauaggcacgagcc

SEQ ID NO: 66792 - RNA, 32 nt, Human
aucccaacacaaaacaaacaccaccuccgauu

SEQ ID NO: 66793 - RNA, 31 nt, Human
aucccaacacucggggagguugaggcuacag

SEQ ID NO: 66794 - RNA, 32 nt, Human
aucccaacacucggggagguugaggcuacagg

SEQ ID NO: 66795 - RNA, 32 nt, Human
aucccaacagcccagcaagaaggaggagacag

SEQ ID NO: 66796 - RNA, 32 nt, Human
aucccaacagcccagcaaggggagagagaaag

SEQ ID NO: 66797 - RNA, 32 nt, Human
aucccaaccagccacgccucagccucucccag

SEQ ID NO: 66798 - RNA, 32 nt, Human
aucccaaccccuggcugggacugaaccaccca

SEQ ID NO: 66799 - RNA, 24 nt, Human
aucccaacucacugcaacuuccgc

SEQ ID NO: 66800 - RNA, 32 nt, Human
aucccaacugcagcucugcugugggggcccgu

SEQ ID NO: 66801 - RNA, 32 nt, Human
aucccaagaaucaccuucagguugucaggaaa

SEQ ID NO: 66802 - RNA, 21 nt, Human
aucccaagacgaccucaccca

SEQ ID NO: 66803 - RNA, 32 nt, Human
aucccaagacuuucucaccaguggagaaacac

SEQ ID NO: 66804 - RNA, 32 nt, Human
aucccaagaggcaccugcagccaggaaggaaa

SEQ ID NO: 66805 - RNA, 32 nt, Human
aucccaagaugacuggggugggaggucuugcu

SEQ ID NO: 66806 - RNA, 32 nt, Human
aucccaagcaguguccuuuccuggugaacacu

SEQ ID NO: 66807 - RNA, 32 nt, Human
aucccaagcuaguucaaaacagcuugggagag

SEQ ID NO: 66808 - RNA, 32 nt, Human
aucccaaggcaggcugcuacugccuuugcuga

SEQ ID NO: 66809 - RNA, 32 nt, Human
aucccaaggcauuuacuccuuggucugucucg

SEQ ID NO: 66810 - RNA, 32 nt, Human
aucccaagguggucuguugcucuggcuuccuu

SEQ ID NO: 66811 - RNA, 32 nt, Human
aucccaaguagcugggauuacaggcacccacc

SEQ ID NO: 66812 - RNA, 32 nt, Human
aucccaaucugaauucuauacccauggugacu

SEQ ID NO: 66813 - RNA, 31 nt, Human
aucccaauggcccuguccuuuucuuuacuga

SEQ ID NO: 66814 - RNA, 32 nt, Human
aucccaauuuugcuuugagaaguugccuuuuc

SEQ ID NO: 66815 - RNA, 32 nt, Human
aucccacaaaggagagaacggagaagcuugca

SEQ ID NO: 66816 - RNA, 16 nt, Human
aucccacaacaaccac

SEQ ID NO: 66817 - RNA, 32 nt, Human
aucccacaccaugccucacaugguagacccca

SEQ ID NO: 66818 - RNA, 32 nt, Human
aucccacaccuguuucaaauccuugaaaugca

SEQ ID NO: 66819 - RNA, 32 nt, Human
aucccacagccauuuuucucucggguucuacc

SEQ ID NO: 66820 - RNA, 32 nt, Human
aucccacaggaccacacgcaggccucccugcc

SEQ ID NO: 66821 - RNA, 32 nt, Human
aucccacauggacugcaugugccaccuaccau

SEQ ID NO: 66822 - RNA, 32 nt, Human
aucccaccacugcacuccagccugggcgacag

SEQ ID NO: 66823 - RNA, 32 nt, Human
aucccaccacugcacuccagccugggugacag

SEQ ID NO: 66824 - RNA, 32 nt, Human
aucccaccagaagacagggguguuggcaggca

SEQ ID NO: 66825 - RNA, 32 nt, Human
aucccaccagccucuccaaggguggugaccaa

SEQ ID NO: 66826 - RNA, 32 nt, Human
aucccaccauugcacuccagccugggcaacag

SEQ ID NO: 66827 - RNA, 32 nt, Human
aucccacccauguuguaccaccuuggugaguc

SEQ ID NO: 66828 - RNA, 19 nt, Human
aucccaccccaucagguca

SEQ ID NO: 66829 - RNA, 32 nt, Human
aucccacccccgcaguuuccaggauuuccucc

SEQ ID NO: 66830 - RNA, 20 nt, Human
aucccacccccgggaccagc

SEQ ID NO: 66831 - RNA, 32 nt, Human
aucccacccuggggacccccaugauuggccac

SEQ ID NO: 66832 - RNA, 32 nt, Human
aucccacccuggggcccuuucagugacuccua

SEQ ID NO: 66833 - RNA, 32 nt, Human
aucccaccuccacccccuccccaaugcagaca

SEQ ID NO: 66834 - RNA, 32 nt, Human
aucccaccucuccgccucuccaucaccagccu

SEQ ID NO: 66835 - RNA, 16 nt, Human
aucccaccugccacca

SEQ ID NO: 66836 - RNA, 16 nt, Human
aucccaccugccacua

SEQ ID NO: 66837 - RNA, 32 nt, Human
aucccaccuggggaggaaaggaagggcuggga

SEQ ID NO: 66838 - RNA, 32 nt, Human
aucccacgguugacuugccuugauggcaagcu

SEQ ID NO: 66839 - RNA, 32 nt, Human
aucccacuacugcauuccagccuggguggaca

SEQ ID NO: 66840 - RNA, 25 nt, Human
aucccacucagagcccgggccugua

SEQ ID NO: 66841 - RNA, 32 nt, Human
aucccacuccauuuuucccugcucaugccugc

SEQ ID NO: 66842 - RNA, 32 nt, Human
aucccacucccggcggcccaggcacagaaggg

SEQ ID NO: 66843 - RNA, 32 nt, Human
aucccacucccucucuuuccugcuccauuggu

SEQ ID NO: 66844 - RNA, 32 nt, Human
aucccacuccuucuccccauuucugucccaca

SEQ ID NO: 66845 - RNA, 32 nt, Human
aucccacugcacucugcuuaaggguuccugcg

SEQ ID NO: 66846 - RNA, 32 nt, Human
aucccacugcauuccagccugggcaacagcgu

SEQ ID NO: 66847 - RNA, 32 nt, Human
aucccacuucagccucuugaauagcugggacu

SEQ ID NO: 66848 - RNA, 32 nt, Human
aucccacuucucacucucgauguggccucccc

SEQ ID NO: 66849 - RNA, 32 nt, Human
aucccacuugcagccuccccaggugucugccc

SEQ ID NO: 66850 - RNA, 32 nt, Human
aucccagaaaugcugugaucagagccaauaag

SEQ ID NO: 66851 - RNA, 32 nt, Human
aucccagaaucugcuauuccccaaaccacuuc

SEQ ID NO: 66852 - RNA, 32 nt, Human
aucccagacagaaacaacacaugcuauucuaa

SEQ ID NO: 66853 - RNA, 32 nt, Human
aucccagaccuguuguucucuccauccagcgu

SEQ ID NO: 66854 - RNA, 32 nt, Human
aucccagacgcugcaggagcugaagauggcga

SEQ ID NO: 66855 - RNA, 32 nt, Human
aucccagacuccaaagcccugguccuuuccug

SEQ ID NO: 66856 - RNA, 32 nt, Human
aucccagagacaaucaguaugugcuuaccugu

SEQ ID NO: 66857 - RNA, 32 nt, Human
aucccagagcugucagcaccggccucagccca

SEQ ID NO: 66858 - RNA, 32 nt, Human
aucccagaggccagcaucaacauguuuccauc

SEQ ID NO: 66859 - RNA, 32 nt, Human
aucccagaggcugaggcaggcggaucaccuga

SEQ ID NO: 66860 - RNA, 32 nt, Human
aucccagaggggccucaucagcaaagacagaa

SEQ ID NO: 66861 - RNA, 32 nt, Human
aucccagaggucgaggcugcagugagcuguga

SEQ ID NO: 66862 - RNA, 32 nt, Human
aucccagauccucugcaaucuaccugcacccc

SEQ ID NO: 66863 - RNA, 32 nt, Human
aucccagauuucagguuuuauuacaaaaugua

SEQ ID NO: 66864 - RNA, 32 nt, Human
aucccagcaacuugaugaguuaggugcagaug

SEQ ID NO: 66865 - RNA, 28 nt, Human
aucccagcaagugcugcucugcucugcc

SEQ ID NO: 66866 - RNA, 21 nt, Human
aucccagcacacaggccuggg

SEQ ID NO: 66867 - RNA, 21 nt, Human
aucccagcacaccucguggga

SEQ ID NO: 66868 - RNA, 32 nt, Human
aucccagcacagugggaggccaacgagggugg

SEQ ID NO: 66869 - RNA, 21 nt, Human
aucccagcacaugauuuggga

SEQ ID NO: 66870 - RNA, 22 nt, Human
aucccagcacuuacuuugggag

SEQ ID NO: 66871 - RNA, 23 nt, Human
aucccagcacuugaggccaggag

SEQ ID NO: 66872 - RNA, 32 nt, Human
aucccagcacuuugggaggcucaggugggcga

SEQ ID NO: 66873 - RNA, 31 nt, Human
aucccagcacuuugggagguugaggcaggcg

SEQ ID NO: 66874 - RNA, 31 nt, Human
aucccagcacuuugggagguugaggcgggca

SEQ ID NO: 66875 - RNA, 31 nt, Human
aucccagcacuuugggagguugagguaggua

SEQ ID NO: 66876 - RNA, 31 nt, Human
aucccagcacuuugggagguugaggugggca

SEQ ID NO: 66877 - RNA, 31 nt, Human
aucccagcacuuugggagguugaggugggcg

SEQ ID NO: 66878 - RNA, 31 nt, Human
aucccagcacuuugggagguugaggugggug

SEQ ID NO: 66879 - RNA, 32 nt, Human
aucccagcagccuucagggugggaggcacaag

SEQ ID NO: 66880 - RNA, 32 nt, Human
aucccagcaggcuggaugagggauaguagggc

SEQ ID NO: 66881 - RNA, 32 nt, Human
aucccagcaugcugggaggccaaggagagaga

SEQ ID NO: 66882 - RNA, 32 nt, Human
aucccagccccuaugcugccaucccccagggc

SEQ ID NO: 66883 - RNA, 32 nt, Human
aucccagcccucucugucuuaauuagcacaaa

SEQ ID NO: 66884 - RNA, 21 nt, Human
aucccagccucaggccugcca

SEQ ID NO: 66885 - RNA, 32 nt, Human
aucccagccuccauucaccaugugcuuccgug

SEQ ID NO: 66886 - RNA, 32 nt, Human
aucccagcgaugaaaccaggaacucacuuucc

SEQ ID NO: 66887 - RNA, 32 nt, Human
aucccagcggacgucccugagcacuuccgggg

SEQ ID NO: 66888 - RNA, 32 nt, Human
aucccagcuacacagccacucccagagguguc

SEQ ID NO: 66889 - RNA, 32 nt, Human
aucccagcuacuagggagacugaggcaggaga

SEQ ID NO: 66890 - RNA, 32 nt, Human
aucccagcuacucaagagguugcagugagcug

SEQ ID NO: 66891 - RNA, 32 nt, Human
aucccagcuacucaggagacugaggcagaagg

SEQ ID NO: 66892 - RNA, 32 nt, Human
aucccagcuacucaggagacugaggcagagaa

SEQ ID NO: 66893 - RNA, 32 nt, Human
aucccagcuacucaggagacugaggcaggaaa

SEQ ID NO: 66894 - RNA, 32 nt, Human
aucccagcuacucaggagacugaggcaggaga

SEQ ID NO: 66895 - RNA, 32 nt, Human
aucccagcuacucaggaggcugagggaggaga

SEQ ID NO: 66896 - RNA, 31 nt, Human
aucccagcuacucaggagguugagacaggag

SEQ ID NO: 66897 - RNA, 31 nt, Human
aucccagcuacucaggagguugaggcagcag

SEQ ID NO: 66898 - RNA, 32 nt, Human
aucccagcuacucaggagguugaggcagcaga

SEQ ID NO: 66899 - RNA, 32 nt, Human
aucccagcuacucgggagacuaggcagagaau

SEQ ID NO: 66900 - RNA, 32 nt, Human
aucccagcuacucgggagacugaggcagaaga

SEQ ID NO: 66901 - RNA, 32 nt, Human
aucccagcuacucgggagacugaggcagagaa

SEQ ID NO: 66902 - RNA, 32 nt, Human
aucccagcuacucgggagacugaggcaggaga

SEQ ID NO: 66903 - RNA, 32 nt, Human
aucccagcuacucgggaggcuaaagcaggaga

SEQ ID NO: 66904 - RNA, 31 nt, Human
aucccagcuacucgggagguugaggcaggag

SEQ ID NO: 66905 - RNA, 31 nt, Human
aucccagcuacucgggagguugagggaggag

SEQ ID NO: 66906 - RNA, 32 nt, Human
aucccagcuacucuggagacugaggugggaga

SEQ ID NO: 66907 - RNA, 32 nt, Human
aucccagcuacuggggagacugaggugggagg

SEQ ID NO: 66908 - RNA, 31 nt, Human
aucccagcuacuuaggagguugaggcuggga

SEQ ID NO: 66909 - RNA, 32 nt, Human
aucccagcuacuuaggagguugaggcugggag

SEQ ID NO: 66910 - RNA, 32 nt, Human
aucccagcuacuugagagacugaggcaggaga

SEQ ID NO: 66911 - RNA, 32 nt, Human
aucccagcuacuuggaaggcugaggcaggaga

SEQ ID NO: 66912 - RNA, 32 nt, Human
aucccagcuacuugggagacugaggcaagaga

SEQ ID NO: 66913 - RNA, 32 nt, Human
aucccagcuacuugggagacugaggcacgaga

SEQ ID NO: 66914 - RNA, 32 nt, Human
aucccagcuacuugggagacugaggcaggaga

SEQ ID NO: 66915 - RNA, 32 nt, Human
aucccagcuagacuucucccuccuggacuguc

SEQ ID NO: 66916 - RNA, 32 nt, Human
aucccagcuaggaggcugagacaggagaaugg

SEQ ID NO: 66917 - RNA, 31 nt, Human
aucccagcuauucaggagguugaggcagaag

SEQ ID NO: 66918 - RNA, 32 nt, Human
aucccagcucaccgcaacgucuaccucccagg

SEQ ID NO: 66919 - RNA, 24 nt, Human
aucccagcucacugcaaccuccgc

SEQ ID NO: 66920 - RNA, 32 nt, Human
aucccagcucacugcaaccuccgccuccuggg

SEQ ID NO: 66921 - RNA, 32 nt, Human
aucccagcucacugcaacuuccgccccgccag

SEQ ID NO: 66922 - RNA, 32 nt, Human
aucccagcucacugcagccucgaccucccugg

SEQ ID NO: 66923 - RNA, 32 nt, Human
aucccagcucuuccagcuaugacaucauguga

SEQ ID NO: 66924 - RNA, 32 nt, Human
aucccagcugacucgcucacugccuucgaagu

SEQ ID NO: 66925 - RNA, 32 nt, Human
aucccagcugcucaggagacugaggcaggaga

SEQ ID NO: 66926 - RNA, 32 nt, Human
aucccagcuggguuauugaagaugaugcaucu

SEQ ID NO: 66927 - RNA, 32 nt, Human
aucccagcuucucaggagucugaggcaggaga

SEQ ID NO: 66928 - RNA, 32 nt, Human
aucccagcuuugagagaggagugugugugcac

SEQ ID NO: 66929 - RNA, 32 nt, Human
aucccaggaauuugagguugcaguaagcuaug

SEQ ID NO: 66930 - RNA, 32 nt, Human
aucccaggagacagagguugcagugagccgag

SEQ ID NO: 66931 - RNA, 32 nt, Human
aucccaggagagaagagcucaggagaugggaa

SEQ ID NO: 66932 - RNA, 26 nt, Human
aucccaggaggcggagguugcaguga

SEQ ID NO: 66933 - RNA, 32 nt, Human
aucccaggaggcggagguugcagugaguugca

SEQ ID NO: 66934 - RNA, 32 nt, Human
aucccaggccggccugugacucuagauaaguu

SEQ ID NO: 66935 - RNA, 20 nt, Human
aucccaggcugguggcagga

SEQ ID NO: 66936 - RNA, 32 nt, Human
aucccaggggcagaaaagagcuugccuuuggc

SEQ ID NO: 66937 - RNA, 32 nt, Human
aucccagggugcugagauuacaggugugagcc

SEQ ID NO: 66938 - RNA, 32 nt, Human
aucccagguagccaugguagaguuggguagag

SEQ ID NO: 66939 - RNA, 32 nt, Human
aucccaggugcaagaguggccccuugaggccc

SEQ ID NO: 66940 - RNA, 18 nt, Human
aucccagucugauugcau

SEQ ID NO: 66941 - RNA, 32 nt, Human
aucccagugcuacaccugagguucuggagcuc

SEQ ID NO: 66942 - RNA, 32 nt, Human
aucccaguguacaaaaccugcuucucuucuca

SEQ ID NO: 66943 - RNA, 32 nt, Human
aucccaguuccuaggcaacuuguucaccaggu

SEQ ID NO: 66944 - RNA, 21 nt, Human
aucccaguuuuccgucuggga

SEQ ID NO: 66945 - RNA, 32 nt, Human
aucccauacucaaaauacccaguuuagcaagc

SEQ ID NO: 66946 - RNA, 32 nt, Human
aucccaucaccucaaagccagaggguccccaa

SEQ ID NO: 66947 - RNA, 32 nt, Human
aucccauccaccccuucucuucauccuucccu

SEQ ID NO: 66948 - RNA, 32 nt, Human
aucccauccccacccccagccccagcccaguc

SEQ ID NO: 66949 - RNA, 32 nt, Human
aucccaucccuaaaaccugccuucuccuuuua

SEQ ID NO: 66950 - RNA, 32 nt, Human
aucccaucccuaacccuugccugaccauguga

SEQ ID NO: 66951 - RNA, 32 nt, Human
aucccauccuggggccccuucagugacuccug

SEQ ID NO: 66952 - RNA, 32 nt, Human
aucccaucuaugcugucaagggcugcugguug

SEQ ID NO: 66953 - RNA, 32 nt, Human
aucccaucugggcgguggcuucacuccugagu

SEQ ID NO: 66954 - RNA, 32 nt, Human
aucccaugaucacacaucuguauuccagccug

SEQ ID NO: 66955 - RNA, 32 nt, Human
aucccaugccaggugguagcugugaguaccuc

SEQ ID NO: 66956 - RNA, 30 nt, Human
aucccaugccccagcccccacccucucgug

SEQ ID NO: 66957 - RNA, 32 nt, Human
aucccaugcugccccuaguccugggcauggug

SEQ ID NO: 66958 - RNA, 32 nt, Human
aucccaugggcugcugucuggguucuggcucu

SEQ ID NO: 66959 - RNA, 21 nt, Human
aucccaugguaaaauauucaa

SEQ ID NO: 66960 - RNA, 32 nt, Human
aucccaugucgagcugugguccccgguguugg

SEQ ID NO: 66961 - RNA, 30 nt, Human
aucccaugucggcccugaggcgcucgggcu

SEQ ID NO: 66962 - RNA, 32 nt, Human
aucccauuauuuacauauaccaaaaauacuuu

SEQ ID NO: 66963 - RNA, 32 nt, Human
aucccauugccuggcuaccgcugccuggcagc

SEQ ID NO: 66964 - RNA, 32 nt, Human
aucccauuucuguccugcucccaggaagauuc

SEQ ID NO: 66965 - RNA, 32 nt, Human
aucccauuugcccuccuccucagcuagggcca

SEQ ID NO: 66966 - RNA, 32 nt, Human
auccccaaacaguaggcuucaguucccugcca

SEQ ID NO: 66967 - RNA, 32 nt, Human
auccccaaaccagccagccuucaguuauuuac

SEQ ID NO: 66968 - RNA, 32 nt, Human
auccccaacaugguuaauuccaacucucagau

SEQ ID NO: 66969 - RNA, 32 nt, Human
auccccaacugcuccagccucugccgcugcca

SEQ ID NO: 66970 - RNA, 28 nt, Human
auccccaagaaugcugccuugucugugg

SEQ ID NO: 66971 - RNA, 32 nt, Human
auccccacaggcuggggacgggcccggugcgg

SEQ ID NO: 66972 - RNA, 32 nt, Human
auccccaccccuucugccagacugccuuugaa

SEQ ID NO: 66973 - RNA, 32 nt, Human
auccccacgcuguguaaguggaaagggcauug

SEQ ID NO: 66974 - RNA, 32 nt, Human
auccccacucauuggagugaacagugacgcaa

SEQ ID NO: 66975 - RNA, 32 nt, Human
auccccacugucaggggcagccaggacuguuc

SEQ ID NO: 66976 - RNA, 32 nt, Human
auccccagaccucacuugccucugccuccauc

SEQ ID NO: 66977 - RNA, 32 nt, Human
auccccagagucagggagggcagaggguggca

SEQ ID NO: 66978 - RNA, 32 nt, Human
auccccagagugaaagauggagcugggccaca

SEQ ID NO: 66979 - RNA, 32 nt, Human
auccccagauacucgggaggcugaagcaggag

SEQ ID NO: 66980 - RNA, 16 nt, Human
auccccagcccuucca

SEQ ID NO: 66981 - RNA, 32 nt, Human
auccccagccgacgccacucacugccuccuuc

SEQ ID NO: 66982 - RNA, 32 nt, Human
auccccagcuaggaagaaagaauggcacucuu

SEQ ID NO: 66983 - RNA, 32 nt, Human
auccccagcucucuccugauuggaauucuuug

SEQ ID NO: 66984 - RNA, 32 nt, Human
auccccagcugcgggaggcccuggugacucug

SEQ ID NO: 66985 - RNA, 32 nt, Human
auccccaggaauagaacuuaaggggugggaag

SEQ ID NO: 66986 - RNA, 32 nt, Human
auccccaggaauagaauuuaagggaugggaag

SEQ ID NO: 66987 - RNA, 32 nt, Human
auccccaggagcaaccacucugguaucuagaa

SEQ ID NO: 66988 - RNA, 32 nt, Human
auccccaggcacugccuaucccuuucccacac

SEQ ID NO: 66989 - RNA, 23 nt, Human
auccccaggccccuccgugcuca

SEQ ID NO: 66990 - RNA, 32 nt, Human
auccccaggccugacugagcggcaggggagca

SEQ ID NO: 66991 - RNA, 32 nt, Human
auccccaggccuguggccaccucgggucugga

SEQ ID NO: 66992 - RNA, 32 nt, Human
auccccagggaaggaaaggcuccgccauuugg

SEQ ID NO: 66993 - RNA, 32 nt, Human
auccccagggagcauugcgaaggagagaggcg

SEQ ID NO: 66994 - RNA, 32 nt, Human
auccccaguagugaaugagacacugcuuugac

SEQ ID NO: 66995 - RNA, 32 nt, Human
auccccauagagcaaaauucugccugugacaa

SEQ ID NO: 66996 - RNA, 32 nt, Human
auccccaucagccuggucaucaccggcgucac

SEQ ID NO: 66997 - RNA, 32 nt, Human
auccccaucccuugagugggugggccuggccu

SEQ ID NO: 66998 - RNA, 32 nt, Human
auccccauccuagcuucucucuccuuccccuc

SEQ ID NO: 66999 - RNA, 32 nt, Human
auccccaucuucauggaaccagggcuaaaggu

SEQ ID NO: 67000 - RNA, 31 nt, Human
auccccauggacaacaaggaggucccgggcg

SEQ ID NO: 67001 - RNA, 32 nt, Human
auccccauuucugcuucucuguuuccccuccu

SEQ ID NO: 67002 - RNA, 32 nt, Human
aucccccaaagucagacacagagcaagagucc

SEQ ID NO: 67003 - RNA, 32 nt, Human
aucccccaacagcagccccugccagucccucg

SEQ ID NO: 67004 - RNA, 32 nt, Human
aucccccacaguuuagagccuucugcuuuucu

SEQ ID NO: 67005 - RNA, 32 nt, Human
aucccccacccaccugccaucaggcucccaga

SEQ ID NO: 67006 - RNA, 21 nt, Human
aucccccacgcaggaccaacu

SEQ ID NO: 67007 - RNA, 18 nt, Human
aucccccagaagccuuca

SEQ ID NO: 67008 - RNA, 32 nt, Human
aucccccagcaagccagccaccugcccagccg

SEQ ID NO: 67009 - RNA, 32 nt, Human
aucccccagcaagccccucugccugcaccuca

SEQ ID NO: 67010 - RNA, 32 nt, Human
aucccccaucgcuuaucucugccuccuuccuc

SEQ ID NO: 67011 - RNA, 32 nt, Human
aucccccaucuccucaaccaccagggucugag

SEQ ID NO: 67012 - RNA, 21 nt, Human
auccccccacccuguggccac

SEQ ID NO: 67013 - RNA, 32 nt, Human
aucccccgaccgcacuccagccugggcgacag

SEQ ID NO: 67014 - RNA, 32 nt, Human
aucccccgccagcaaccauuacggucugucag

SEQ ID NO: 67015 - RNA, 32 nt, Human
aucccccgcccuccaucucccccggcucuggg

SEQ ID NO: 67016 - RNA, 32 nt, Human
aucccccggagguggaggcgcgguaccccggg

SEQ ID NO: 67017 - RNA, 32 nt, Human
aucccccggugagcuuccugcagccuguggau

SEQ ID NO: 67018 - RNA, 32 nt, Human
aucccccuaagucccuuugucuugacccccaa

SEQ ID NO: 67019 - RNA, 32 nt, Human
aucccccuacaaccccagccuccugagggcuc

SEQ ID NO: 67020 - RNA, 32 nt, Human
aucccccuaccugaaccccucuugccacugcc

SEQ ID NO: 67021 - RNA, 32 nt, Human
aucccccucccaggccuuccucccucucccau

SEQ ID NO: 67022 - RNA, 32 nt, Human
aucccccuccugaccugugacccccugccaca

SEQ ID NO: 67023 - RNA, 32 nt, Human
aucccccucuccugaagcccugccgcuguggc

SEQ ID NO: 67024 - RNA, 32 nt, Human
aucccccucugcaaagugcccucuugguuugg

SEQ ID NO: 67025 - RNA, 23 nt, Human
aucccccugcacagacuggccac

SEQ ID NO: 67026 - RNA, 23 nt, Human
aucccccugccggcagccccuca

SEQ ID NO: 67027 - RNA, 28 nt, Human
aucccccugccugcugccucagucugca

SEQ ID NO: 67028 - RNA, 24 nt, Human
aucccccugcuggccguagcccca

SEQ ID NO: 67029 - RNA, 21 nt, Human
aucccccuggcagggccagcu

SEQ ID NO: 67030 - RNA, 32 nt, Human
aucccccuuccuccucuccucccuguccugag

SEQ ID NO: 67031 - RNA, 32 nt, Human
aucccccuuuccaaccuguaacucugaugugc

SEQ ID NO: 67032 - RNA, 32 nt, Human
auccccgacagaaacgcagcagaugcagacgc

SEQ ID NO: 67033 - RNA, 32 nt, Human
auccccgaggcggagguugcacugagccgaga

SEQ ID NO: 67034 - RNA, 32 nt, Human
auccccgccugagagcuccucacugacggcuc

SEQ ID NO: 67035 - RNA, 32 nt, Human
auccccgcuuuggaugugauucccucucccca

SEQ ID NO: 67036 - RNA, 32 nt, Human
auccccggucucaaguaggccucaucugccgg

SEQ ID NO: 67037 - RNA, 32 nt, Human
auccccgugggugugaggccgggguaggacca

SEQ ID NO: 67038 - RNA, 32 nt, Human
auccccuaaagacccacccucaagcagcagau

SEQ ID NO: 67039 - RNA, 32 nt, Human
auccccuacacauacaugcacauagacacaca

SEQ ID NO: 67040 - RNA, 32 nt, Human
auccccuacaucuggcagcauguggagcaggc

SEQ ID NO: 67041 - RNA, 32 nt, Human
auccccuagauccccauuggaaaaagggagaa

SEQ ID NO: 67042 - RNA, 32 nt, Human
auccccuaggucaccguuggaaaaagggagaa

SEQ ID NO: 67043 - RNA, 32 nt, Human
auccccucaccuccuucucuuuacccccuuca

SEQ ID NO: 67044 - RNA, 32 nt, Human
auccccucaccugaggccagggaagccuugac

SEQ ID NO: 67045 - RNA, 32 nt, Human
auccccucagcacuaaccacauccacucucaa

SEQ ID NO: 67046 - RNA, 32 nt, Human
auccccucaguuccucaccccucucccugcuu

SEQ ID NO: 67047 - RNA, 32 nt, Human
auccccuccacuccagaguuggguggcacgga

SEQ ID NO: 67048 - RNA, 32 nt, Human
auccccuccacuccagaguugggugguacgga

SEQ ID NO: 67049 - RNA, 32 nt, Human
auccccuccccagccacagucugaggagcccc

SEQ ID NO: 67050 - RNA, 32 nt, Human
auccccuccccgcugccgccuccuccugggcu

SEQ ID NO: 67051 - RNA, 32 nt, Human
auccccuccccucugcuugagccuugagccuu

SEQ ID NO: 67052 - RNA, 32 nt, Human
auccccuccugccucagaccccuuugccaggg

SEQ ID NO: 67053 - RNA, 32 nt, Human
auccccucucaucuuccuccccuaaaccccac

SEQ ID NO: 67054 - RNA, 32 nt, Human
auccccucugggcugcucauccaggccuggcc

SEQ ID NO: 67055 - RNA, 32 nt, Human
auccccucuguccaugucccugccucaguuua

SEQ ID NO: 67056 - RNA, 32 nt, Human
auccccugagcucaggaguccaaccugggcaa

SEQ ID NO: 67057 - RNA, 32 nt, Human
auccccugaggguggucagccaaggcucccgu

SEQ ID NO: 67058 - RNA, 32 nt, Human
auccccugcacccgcuaccacaccagcucagc

SEQ ID NO: 67059 - RNA, 32 nt, Human
auccccuggccuccucccacuuacuuguucua

SEQ ID NO: 67060 - RNA, 32 nt, Human
auccccuguaggaggccagggaggggaacuca

SEQ ID NO: 67061 - RNA, 18 nt, Human
auccccuuaccccagugg

SEQ ID NO: 67062 - RNA, 20 nt, Human
auccccuucccucccaguga

SEQ ID NO: 67063 - RNA, 32 nt, Human
auccccuucgccaacugggacaucuuccgaca

SEQ ID NO: 67064 - RNA, 32 nt, Human
auccccuucucccggccccagccugccucccu

SEQ ID NO: 67065 - RNA, 32 nt, Human
auccccuugacucuccccucccagcccucgcu

SEQ ID NO: 67066 - RNA, 32 nt, Human
auccccuuguaaaggaguuggggaaggaagag

SEQ ID NO: 67067 - RNA, 32 nt, Human
auccccuugugagccccaugagagaagggccu

SEQ ID NO: 67068 - RNA, 32 nt, Human
auccccuuuccaaggcugcuucccuggugugu

SEQ ID NO: 67069 - RNA, 32 nt, Human
auccccuuucuuuccaaguagcuacuuggaaa

SEQ ID NO: 67070 - RNA, 32 nt, Human
auccccuuuuccccaucuucuucuuucagauc

SEQ ID NO: 67071 - RNA, 32 nt, Human
auccccuuuuuguucuuccuggaccugggcau

SEQ ID NO: 67072 - RNA, 20 nt, Human
aucccgagggccuuccugcc

SEQ ID NO: 67073 - RNA, 32 nt, Human
aucccgagucauuaauuugaagcucgcuaaca

SEQ ID NO: 67074 - RNA, 32 nt, Human
aucccgaucuggggaacucugauccaguauau

SEQ ID NO: 67075 - RNA, 32 nt, Human
aucccgcaaaaugggcuuccugccugguuuuu

SEQ ID NO: 67076 - RNA, 32 nt, Human
aucccgcagcacccuccagccuugcagaagca

SEQ ID NO: 67077 - RNA, 32 nt, Human
aucccgccacaccuuucgcucucagcuaccag

SEQ ID NO: 67078 - RNA, 32 nt, Human
aucccgccacucacuccagccuggauaaaaga

SEQ ID NO: 67079 - RNA, 32 nt, Human
aucccgccacugcacgccagccugggcgacag

SEQ ID NO: 67080 - RNA, 32 nt, Human
aucccgccacugcacuccagacugggcgacag

SEQ ID NO: 67081 - RNA, 32 nt, Human
aucccgccacugcacuccagcccaggugacag

SEQ ID NO: 67082 - RNA, 32 nt, Human
aucccgccacugcacuccagccugggcgacag

SEQ ID NO: 67083 - RNA, 32 nt, Human
aucccgccacugcacucuagccugggugacag

SEQ ID NO: 67084 - RNA, 32 nt, Human
aucccgccagcaccccagccuaagugaaagag

SEQ ID NO: 67085 - RNA, 32 nt, Human
aucccgcccagaggaguugaugccgcugucgc

SEQ ID NO: 67086 - RNA, 32 nt, Human
aucccgcccagccaugugacacuggcucccgg

SEQ ID NO: 67087 - RNA, 32 nt, Human
aucccgcgccgcugcgguucucagccggcucu

SEQ ID NO: 67088 - RNA, 32 nt, Human
aucccgcgcugccuccccggcgaucugucuga

SEQ ID NO: 67089 - RNA, 32 nt, Human
aucccgcucagugccauguccucuuuugugau

SEQ ID NO: 67090 - RNA, 32 nt, Human
aucccgcuggugcuaugugcagaucuuaacuc

SEQ ID NO: 67091 - RNA, 24 nt, Human
aucccgcuuagccugccucaccca

SEQ ID NO: 67092 - RNA, 21 nt, Human
aucccgcuucccccuccccca

SEQ ID NO: 67093 - RNA, 32 nt, Human
aucccggacugcgggcccugcagccaccugga

SEQ ID NO: 67094 - RNA, 32 nt, Human
aucccggagucugaggaccuuuaugggcuuug

SEQ ID NO: 67095 - RNA, 32 nt, Human
aucccggcagugacugccugugcccggugcug

SEQ ID NO: 67096 - RNA, 32 nt, Human
aucccggccagccccugacaucugccaucgau

SEQ ID NO: 67097 - RNA, 32 nt, Human
aucccggccucccugcacuucacucugcuccu

SEQ ID NO: 67098 - RNA, 32 nt, Human
aucccggccuggccaaccuccgccuccugggu

SEQ ID NO: 67099 - RNA, 23 nt, Human
aucccggcgggaccaaggaggug

SEQ ID NO: 67100 - RNA, 32 nt, Human
aucccggcucacugcaaccuccaccucccagg

SEQ ID NO: 67101 - RNA, 32 nt, Human
aucccggcucacugcaaccuccgccucccugg

SEQ ID NO: 67102 - RNA, 32 nt, Human
aucccgggaauucaagguugcagugagcuaug

SEQ ID NO: 67103 - RNA, 32 nt, Human
aucccgggacgcagcaggaggccaggccggcg

SEQ ID NO: 67104 - RNA, 32 nt, Human
aucccgggagccugggcuggggccugggcacu

SEQ ID NO: 67105 - RNA, 32 nt, Human
aucccgggcuguaacuugcucuuuuguuuccc

SEQ ID NO: 67106 - RNA, 32 nt, Human
aucccggggaaggagccggaccccuauggcgg

SEQ ID NO: 67107 - RNA, 32 nt, Human
aucccggggagccaggaagcagugagcccagg

SEQ ID NO: 67108 - RNA, 32 nt, Human
aucccgguccacugcaaccuccacuucccggg

SEQ ID NO: 67109 - RNA, 32 nt, Human
aucccgguuucagaagcugcagcuggucuguu

SEQ ID NO: 67110 - RNA, 32 nt, Human
aucccgucaaacaaaugguauguaauagaaag

SEQ ID NO: 67111 - RNA, 32 nt, Human
aucccguccaacaggcuggaguacaauggcga

SEQ ID NO: 67112 - RNA, 32 nt, Human
aucccgugcaacaacaagggagcucacugagu

SEQ ID NO: 67113 - RNA, 32 nt, Human
aucccguucccccuaacauccucagagaaccu

SEQ ID NO: 67114 - RNA, 32 nt, Human
aucccuaauaacaaccuucauucuucuaauac

SEQ ID NO: 67115 - RNA, 32 nt, Human
aucccuacccacguuccagccucuaggugagu

SEQ ID NO: 67116 - RNA, 17 nt, Human
aucccuaccucccacca

SEQ ID NO: 67117 - RNA, 30 nt, Human
aucccuaccugcuccccgcuccuguugcca

SEQ ID NO: 67118 - RNA, 32 nt, Human
aucccuagcuccagccucuuccugggccagcc

SEQ ID NO: 67119 - RNA, 32 nt, Human
aucccuaggagagaugaaauuugagaggugau

SEQ ID NO: 67120 - RNA, 32 nt, Human
aucccuaggugaggagaagcggcuugaagcag

SEQ ID NO: 67121 - RNA, 32 nt, Human
aucccuaucauguggaugcacacacacccucu

SEQ ID NO: 67122 - RNA, 21 nt, Human
aucccuaucuauuguaaccca

SEQ ID NO: 67123 - RNA, 32 nt, Human
aucccucaagccacaguuaaugauucagaugu

SEQ ID NO: 67124 - RNA, 32 nt, Human
aucccucacagccucuugcugcuaaaauagau

SEQ ID NO: 67125 - RNA, 32 nt, Human
aucccucaggaggaagaggaguccugcagcgc

SEQ ID NO: 67126 - RNA, 32 nt, Human
aucccucaggcauggccaggaggccgacuuca

SEQ ID NO: 67127 - RNA, 32 nt, Human
aucccucaguggcaacagaaacaggcacaacu

SEQ ID NO: 67128 - RNA, 32 nt, Human
aucccucaucuucugacccuggguucugggcu

SEQ ID NO: 67129 - RNA, 32 nt, Human
aucccuccaacugccagcacccugccauugcc

SEQ ID NO: 67130 - RNA, 32 nt, Human
aucccuccagugguaccugucacugcaaaugc

SEQ ID NO: 67131 - RNA, 32 nt, Human
aucccucccagccuauuucugcuccucucuuc

SEQ ID NO: 67132 - RNA, 32 nt, Human
aucccucccaugaaaaauggcuuccuggccgg

SEQ ID NO: 67133 - RNA, 22 nt, Human
aucccuccccacccucucucca

SEQ ID NO: 67134 - RNA, 32 nt, Human
aucccuccccacccucucuccaaggcccucuc

SEQ ID NO: 67135 - RNA, 32 nt, Human
aucccuccccuguccaccuuuguccagugcua

SEQ ID NO: 67136 - RNA, 32 nt, Human
aucccucccuccuucugaccucuuagcugggg

SEQ ID NO: 67137 - RNA, 32 nt, Human
aucccuccuuccuucuuuccuccuacagugcu

SEQ ID NO: 67138 - RNA, 32 nt, Human
aucccuccuucuagggccuauggcaguucucc

SEQ ID NO: 67139 - RNA, 32 nt, Human
aucccucgugagaccagaucaguuacauguau

SEQ ID NO: 67140 - RNA, 23 nt, Human
aucccucuauuaaccccacccca

SEQ ID NO: 67141 - RNA, 24 nt, Human
aucccucucaaucuucccugccca

SEQ ID NO: 67142 - RNA, 21 nt, Human
aucccucucaggcuccuucca

SEQ ID NO: 67143 - RNA, 24 nt, Human
aucccucuccaccccuucccccca

SEQ ID NO: 67144 - RNA, 24 nt, Human
aucccucucccacuccccacccca

SEQ ID NO: 67145 - RNA, 24 nt, Human
aucccucucccauuuagcaaccac

SEQ ID NO: 67146 - RNA, 23 nt, Human
aucccucuccuccuccaucccca

SEQ ID NO: 67147 - RNA, 32 nt, Human
aucccucucucccucacaguuccaggagcggc

SEQ ID NO: 67148 - RNA, 32 nt, Human
aucccucucugaaacagaacagcuccaauagc

SEQ ID NO: 67149 - RNA, 32 nt, Human
aucccucugcuccuuuuuaugguucuuguugu

SEQ ID NO: 67150 - RNA, 32 nt, Human
aucccucuggaaggagcuguccucacagaaug

SEQ ID NO: 67151 - RNA, 32 nt, Human
aucccucugugaccucagcccagaugugccug

SEQ ID NO: 67152 - RNA, 32 nt, Human
aucccucuguucuccccuccuaucuuuccaug

SEQ ID NO: 67153 - RNA, 32 nt, Human
aucccucuucauuccucuucucuguguucauu

SEQ ID NO: 67154 - RNA, 32 nt, Human
aucccucuuccaccaucuccucccaauguguu

SEQ ID NO: 67155 - RNA, 19 nt, Human
aucccucuuucuaccugac

SEQ ID NO: 67156 - RNA, 32 nt, Human
aucccugacaucuggaaucuggagaccaggga

SEQ ID NO: 67157 - RNA, 32 nt, Human
aucccugacaucuuuccccuuuccuuuccuuc

SEQ ID NO: 67158 - RNA, 32 nt, Human
aucccugacccauggcgcugaagaggauucag

SEQ ID NO: 67159 - RNA, 32 nt, Human
aucccugaccuggccucuggggucaggaaggc

SEQ ID NO: 67160 - RNA, 32 nt, Human
aucccugagaagcagaaccacagggaaaccuc

SEQ ID NO: 67161 - RNA, 32 nt, Human
aucccugagacuguucucccugacacugugag

SEQ ID NO: 67162 - RNA, 32 nt, Human
aucccugaggcagagguugcagugagcugaga

SEQ ID NO: 67163 - RNA, 20 nt, Human
aucccugccaccagucuggg

SEQ ID NO: 67164 - RNA, 32 nt, Human
aucccugccacuaacuuaauccuugaaguguu

SEQ ID NO: 67165 - RNA, 18 nt, Human
aucccugccaggaagcag

SEQ ID NO: 67166 - RNA, 32 nt, Human
aucccugcccugccuccagccuugguggcucc

SEQ ID NO: 67167 - RNA, 32 nt, Human
aucccugccugugagccacaccuccuagcucu

SEQ ID NO: 67168 - RNA, 18 nt, Human
aucccugccuucauggaa

SEQ ID NO: 67169 - RNA, 21 nt, Human
aucccugccuuccucucugaa

SEQ ID NO: 67170 - RNA, 32 nt, Human
aucccugcgcgcccagccugccaagcagcgug

SEQ ID NO: 67171 - RNA, 32 nt, Human
aucccugcuacuugggagacugaggcaggaga

SEQ ID NO: 67172 - RNA, 32 nt, Human
aucccugcucacugcagccuccgcuucccugg

SEQ ID NO: 67173 - RNA, 32 nt, Human
aucccugcuccuuugaccuuuuuaauagcuca

SEQ ID NO: 67174 - RNA, 32 nt, Human
aucccugcugacugcccagagacucagaggaa

SEQ ID NO: 67175 - RNA, 32 nt, Human
aucccugcugcacucagugguuggcggaaaca

SEQ ID NO: 67176 - RNA, 32 nt, Human
aucccugcugcucuccagggacucacagcaug

SEQ ID NO: 67177 - RNA, 18 nt, Human
aucccugcugggcugcug

SEQ ID NO: 67178 - RNA, 32 nt, Human
aucccugcugguacacaagaccacgacuaggg

SEQ ID NO: 67179 - RNA, 32 nt, Human
aucccuggagaaagcucacccaguuagaagag

SEQ ID NO: 67180 - RNA, 32 nt, Human
aucccuggagccugagacugggugccagcuuc

SEQ ID NO: 67181 - RNA, 32 nt, Human
aucccuggcuaccucgggauuaugugcaagcu

SEQ ID NO: 67182 - RNA, 32 nt, Human
aucccuggcugucugugagcagcacuugacag

SEQ ID NO: 67183 - RNA, 32 nt, Human
aucccugggacccucacgcccugcucccuugc

SEQ ID NO: 67184 - RNA, 32 nt, Human
aucccugggcccagccagcccugcugcacaug

SEQ ID NO: 67185 - RNA, 32 nt, Human
aucccuggggcuuccuuugcucugccuuauuu

SEQ ID NO: 67186 - RNA, 32 nt, Human
aucccuggggugaagguggcugggaauuagac

SEQ ID NO: 67187 - RNA, 32 nt, Human
aucccugggguuugcaaguuguucacuuaaaa

SEQ ID NO: 67188 - RNA, 32 nt, Human
aucccuggguucugggagacugcaggugccgc

SEQ ID NO: 67189 - RNA, 32 nt, Human
aucccuggucaacccucaaacauuccggacuc

SEQ ID NO: 67190 - RNA, 32 nt, Human
aucccugguccugagaacucaggcuggcacag

SEQ ID NO: 67191 - RNA, 32 nt, Human
aucccuguauuuuuaugugaagucuccuaguu

SEQ ID NO: 67192 - RNA, 32 nt, Human
aucccuguccagucccugucaccacccaguuu

SEQ ID NO: 67193 - RNA, 32 nt, Human
aucccuguccagucccugucaucacccaguuu

SEQ ID NO: 67194 - RNA, 32 nt, Human
aucccuguccauugauuccacucuggaacucu

SEQ ID NO: 67195 - RNA, 32 nt, Human
aucccuguccuccugggcccugaggccccugc

SEQ ID NO: 67196 - RNA, 32 nt, Human
aucccugucucuucagcuucucugaugcuuga

SEQ ID NO: 67197 - RNA, 32 nt, Human
aucccugucugaagaaugcuagcccaucuggc

SEQ ID NO: 67198 - RNA, 32 nt, Human
aucccugugcagguacagcugcagggaagccc

SEQ ID NO: 67199 - RNA, 32 nt, Human
aucccugugccucacucagcuccugcugcucu

SEQ ID NO: 67200 - RNA, 32 nt, Human
aucccuguggccauggagcuccugggugagca

SEQ ID NO: 67201 - RNA, 32 nt, Human
aucccugugugaaaauggguguuaacaaaaua

SEQ ID NO: 67202 - RNA, 32 nt, Human
aucccuguucagcccaccuuaaagguguaggc

SEQ ID NO: 67203 - RNA, 32 nt, Human
aucccuuacaugccaucauagacuucauacgg

SEQ ID NO: 67204 - RNA, 32 nt, Human
aucccuuagcuacucaggaggcugaggcagga

SEQ ID NO: 67205 - RNA, 32 nt, Human
aucccuuaggccacagugauugguucagaaau

SEQ ID NO: 67206 - RNA, 32 nt, Human
aucccuucaccagcaggccuucagaagggcaa

SEQ ID NO: 67207 - RNA, 22 nt, Human
aucccuucaccuugugaacuca

SEQ ID NO: 67208 - RNA, 32 nt, Human
aucccuucaggcuucugacacacuaguggccu

SEQ ID NO: 67209 - RNA, 32 nt, Human
aucccuucauucuugcugaguucaucuccuau

SEQ ID NO: 67210 - RNA, 32 nt, Human
aucccuuccucagacgccuugugggcuggacu

SEQ ID NO: 67211 - RNA, 32 nt, Human
aucccuuccucccauuggccucuccuugccaa

SEQ ID NO: 67212 - RNA, 32 nt, Human
aucccuuccucucaagaaaauauucuuucacc

SEQ ID NO: 67213 - RNA, 32 nt, Human
aucccuucuaaggcuguccaccaggagcccgg

SEQ ID NO: 67214 - RNA, 32 nt, Human
aucccuucucucuugcccagagagcggcauuu

SEQ ID NO: 67215 - RNA, 32 nt, Human
aucccuucucuuccuccacacccuguccuuuc

SEQ ID NO: 67216 - RNA, 32 nt, Human
aucccuucugagaucaucucccccaagaaagu

SEQ ID NO: 67217 - RNA, 32 nt, Human
aucccuugaacccaggaggcagaaguugcagu

SEQ ID NO: 67218 - RNA, 32 nt, Human
aucccuugacccuuauaacuagaagggaccuu

SEQ ID NO: 67219 - RNA, 32 nt, Human
aucccuugagccuaggagguugaggcugcagu

SEQ ID NO: 67220 - RNA, 32 nt, Human
aucccuugaguccaggagguugaggcugcagu

SEQ ID NO: 67221 - RNA, 32 nt, Human
aucccuugccagcacaugaaaacaaacuggaa

SEQ ID NO: 67222 - RNA, 32 nt, Human
aucccuugcuuugguauaauaauuugaacuuu

SEQ ID NO: 67223 - RNA, 32 nt, Human
aucccuugguucacuugagugugcaagucauu

SEQ ID NO: 67224 - RNA, 32 nt, Human
aucccuugugaaguguagagcagcagagaggc

SEQ ID NO: 67225 - RNA, 32 nt, Human
aucccuugugaaugucccuuagggaggcacca

SEQ ID NO: 67226 - RNA, 32 nt, Human
aucccuuuaagagaaccaaugauucuuuagga

SEQ ID NO: 67227 - RNA, 32 nt, Human
aucccuuuauuucagcccaucccuucguuucc

SEQ ID NO: 67228 - RNA, 19 nt, Human
aucccuuucuucccuuccc

SEQ ID NO: 67229 - RNA, 31 nt, Human
aucccuuuggucaaggagagggagagagagg

SEQ ID NO: 67230 - RNA, 32 nt, Human
aucccuuuuagcuucaccauccugggucaagc

SEQ ID NO: 67231 - RNA, 32 nt, Human
aucccuuuugauugagccuccaccucugggau

SEQ ID NO: 67232 - RNA, 32 nt, Human
aucccuuuugcagcuuuucuuuuuggcucucu

SEQ ID NO: 67233 - RNA, 32 nt, Human
aucccuuuuucuuuuuauccuuaguucuaguc

SEQ ID NO: 67234 - RNA, 32 nt, Human
aucccuuuuuguaaucaucucaucucagggua

SEQ ID NO: 67235 - RNA, 32 nt, Human
auccgaagggaaccuuggggaacugguggccu

SEQ ID NO: 67236 - RNA, 32 nt, Human
auccgacccccgaccaccaccuccgggaaaag

SEQ ID NO: 67237 - RNA, 32 nt, Human
auccgagaaauauacagaaagcacuuaagaga

SEQ ID NO: 67238 - RNA, 32 nt, Human
auccgagacucugccaggauucacaugccacu

SEQ ID NO: 67239 - RNA, 32 nt, Human
auccgagccagcuaugcugcagaagagcguau

SEQ ID NO: 67240 - RNA, 26 nt, Human
auccgaggcugcaggcaaggcuuggg

SEQ ID NO: 67241 - RNA, 32 nt, Human
auccgagggcagcagugcuggguggagagagc

SEQ ID NO: 67242 - RNA, 32 nt, Human
auccgaggucucaauccauugcgcccaggcug

SEQ ID NO: 67243 - RNA, 32 nt, Human
auccgagucggccccggggagcuccaggagag

SEQ ID NO: 67244 - RNA, 32 nt, Human
auccgaguuagcaggcagcacuguccagaugg

SEQ ID NO: 67245 - RNA, 32 nt, Human
auccgauguccugcacucggccuggauccuca

SEQ ID NO: 67246 - RNA, 32 nt, Human
auccgauuagccgacuggcccagauccagcag

SEQ ID NO: 67247 - RNA, 32 nt, Human
auccgauuucuacaacacuacagagcacuguu

SEQ ID NO: 67248 - RNA, 32 nt, Human
auccgcaauguggagcagcagccacugcacag

SEQ ID NO: 67249 - RNA, 32 nt, Human
auccgcacccaguuugauaccugcacuguccu

SEQ ID NO: 67250 - RNA, 32 nt, Human
auccgcagagucacucacccacuguguuucug

SEQ ID NO: 67251 - RNA, 32 nt, Human
auccgcaggcuuaaccagcagccuucucaggg

SEQ ID NO: 67252 - RNA, 32 nt, Human
auccgcagggaugucaacgucaauaucacagg

SEQ ID NO: 67253 - RNA, 32 nt, Human
auccgcaugggugacagcaaguucuuccgcga

SEQ ID NO: 67254 - RNA, 32 nt, Human
auccgccacugcacuccagccugggugacaga

SEQ ID NO: 67255 - RNA, 32 nt, Human
auccgccaucugcaguggagccgccaccaaaa

SEQ ID NO: 67256 - RNA, 32 nt, Human
auccgccauggagccagagagggaagggaccg

SEQ ID NO: 67257 - RNA, 32 nt, Human
auccgccauuacacuccagccugggugacaga

SEQ ID NO: 67258 - RNA, 32 nt, Human
auccgccccuuagagcccucuggcuagaggag

SEQ ID NO: 67259 - RNA, 32 nt, Human
auccgcccgccgguuccccaucauguccgaac

SEQ ID NO: 67260 - RNA, 32 nt, Human
auccgcccgccuccgccuccccaagcgcugag

SEQ ID NO: 67261 - RNA, 18 nt, Human
auccgcccucuguugcuc

SEQ ID NO: 67262 - RNA, 32 nt, Human
auccgcccuuuucauagagcgcuguuucuuga

SEQ ID NO: 67263 - RNA, 32 nt, Human
auccgccucagccucccaacaugcugggauua

SEQ ID NO: 67264 - RNA, 32 nt, Human
auccgccucugccgcccugccuggcacccacg

SEQ ID NO: 67265 - RNA, 32 nt, Human
auccgccugguaacgggcgucuucccagaugc

SEQ ID NO: 67266 - RNA, 32 nt, Human
auccgccuguagucccagcuacucaggaggcu

SEQ ID NO: 67267 - RNA, 32 nt, Human
auccgccuuucccaccgcccucccuccccagc

SEQ ID NO: 67268 - RNA, 32 nt, Human
auccgcggggagggcacaacagcugcuaccug

SEQ ID NO: 67269 - RNA, 32 nt, Human
auccgcggugaagcacugccucagcuaccagc

SEQ ID NO: 67270 - RNA, 23 nt, Human
auccgcguccacggaagagcagc

SEQ ID NO: 67271 - RNA, 32 nt, Human
auccgcuacucuuacuccccugccucccccua

SEQ ID NO: 67272 - RNA, 32 nt, Human
auccgcuacuugcaccaaccagucccggguua

SEQ ID NO: 67273 - RNA, 32 nt, Human
auccgcuccccugacccagcaguuuccucugc

SEQ ID NO: 67274 - RNA, 32 nt, Human
auccgcucugcccgcuguguccugggcaugga

SEQ ID NO: 67275 - RNA, 32 nt, Human
auccgcugcuucuguggaagugagcaugguug

SEQ ID NO: 67276 - RNA, 32 nt, Human
auccgcugucugcugcugccucuuuccuccuc

SEQ ID NO: 67277 - RNA, 32 nt, Human
auccgcuucucagacuccaauggcaguguccu

SEQ ID NO: 67278 - RNA, 32 nt, Human
auccgcuugguggaggucgagugggugcaagg

SEQ ID NO: 67279 - RNA, 32 nt, Human
auccggaagaaagcuuuacacacgucuugcac

SEQ ID NO: 67280 - RNA, 32 nt, Human
auccggaccacgugucaagguguaaucucgac

SEQ ID NO: 67281 - RNA, 32 nt, Human
auccggaccucaccaccucuuuuccuuugagc

SEQ ID NO: 67282 - RNA, 32 nt, Human
auccggacuucuaacaccaucggugaguuuca

SEQ ID NO: 67283 - RNA, 32 nt, Human
auccggagagcugucuggugugcaggacuggg

SEQ ID NO: 67284 - RNA, 32 nt, Human
auccggagaugugaguuuggggcugaagaaga

SEQ ID NO: 67285 - RNA, 32 nt, Human
auccggagcaguaaguggagaagagcucucca

SEQ ID NO: 67286 - RNA, 32 nt, Human
auccggagccaagacuuguggacagcacuuca

SEQ ID NO: 67287 - RNA, 32 nt, Human
auccggagugagcaauggaguggcugccaugg

SEQ ID NO: 67288 - RNA, 32 nt, Human
auccggaucccagaacucuggucuccaaauua

SEQ ID NO: 67289 - RNA, 32 nt, Human
auccggcacccucugggguaggagaacagcca

SEQ ID NO: 67290 - RNA, 32 nt, Human
auccggcagagggaggaaggcagagcaagugg

SEQ ID NO: 67291 - RNA, 32 nt, Human
auccggccccuccccucgccuccucuccuagg

SEQ ID NO: 67292 - RNA, 32 nt, Human
auccggcccuuaccggcaagcagcgggcuaac

SEQ ID NO: 67293 - RNA, 32 nt, Human
auccggcugggagcaugaccuuggcgucuguu

SEQ ID NO: 67294 - RNA, 32 nt, Human
auccgggaagcagagguuguagugagccaaga

SEQ ID NO: 67295 - RNA, 32 nt, Human
auccgggaagggcggcugcgggcagacgcggc

SEQ ID NO: 67296 - RNA, 32 nt, Human
auccgggacaccugggccgggcuguagaucag

SEQ ID NO: 67297 - RNA, 32 nt, Human
auccgggaccuucagacccagggaaaggguga

SEQ ID NO: 67298 - RNA, 32 nt, Human
auccgggagaugcauguugcagugagcugaga

SEQ ID NO: 67299 - RNA, 32 nt, Human
auccgggaggcagagauugcagugggccuaga

SEQ ID NO: 67300 - RNA, 32 nt, Human
auccgggaggcagagguugcaggagcugagau

SEQ ID NO: 67301 - RNA, 32 nt, Human
auccgggaggcggagguugcagugaaccgaac

SEQ ID NO: 67302 - RNA, 32 nt, Human
auccgggaggcggagguugcggugagccaagg

SEQ ID NO: 67303 - RNA, 32 nt, Human
auccgggaggcgggucuugcagugagcagaga

SEQ ID NO: 67304 - RNA, 32 nt, Human
auccgggagguggagguugcagugagccaaga

SEQ ID NO: 67305 - RNA, 32 nt, Human
auccgggcagaggcgccccucaccucccggac

SEQ ID NO: 67306 - RNA, 32 nt, Human
auccgggccacugucccaggucccaggucccg

SEQ ID NO: 67307 - RNA, 32 nt, Human
auccgggcugcucuuccccaucuggaaguggc

SEQ ID NO: 67308 - RNA, 32 nt, Human
auccgggcugggcuguucuccugcugcucucc

SEQ ID NO: 67309 - RNA, 32 nt, Human
auccggggagguggaaguugcagugggccaag

SEQ ID NO: 67310 - RNA, 32 nt, Human
auccgggggcagcucuggaggggguuugcugg

SEQ ID NO: 67311 - RNA, 32 nt, Human
auccggggguccagggaauggagcucaggucc

SEQ ID NO: 67312 - RNA, 32 nt, Human
auccgggugugguggcuucugccugaaauccc

SEQ ID NO: 67313 - RNA, 32 nt, Human
auccggucagcagccccuguggcuaaggaaca

SEQ ID NO: 67314 - RNA, 32 nt, Human
auccggucgucggggauagggaagggagggga

SEQ ID NO: 67315 - RNA, 18 nt, Human
auccgguggccuauucca

SEQ ID NO: 67316 - RNA, 32 nt, Human
auccgguggcugggaaaccucacccuugcacc

SEQ ID NO: 67317 - RNA, 32 nt, Human
auccgguuccccagucccuggagccaccgcgg

SEQ ID NO: 67318 - RNA, 32 nt, Human
auccgguuguguccugugggagggucagaggc

SEQ ID NO: 67319 - RNA, 16 nt, Human
auccguaaugccuccu

SEQ ID NO: 67320 - RNA, 32 nt, Human
auccgucacagagagauuuaagugaucuucau

SEQ ID NO: 67321 - RNA, 32 nt, Human
auccgucagccccaggagaguccugagaugau

SEQ ID NO: 67322 - RNA, 32 nt, Human
auccguccagaaggcggggagagcagcagcgg

SEQ ID NO: 67323 - RNA, 32 nt, Human
auccguccagcucagccauccagccugucucu

SEQ ID NO: 67324 - RNA, 32 nt, Human
auccguccauccuccauccaucauccauccau

SEQ ID NO: 67325 - RNA, 32 nt, Human
auccgucguugcugcccagggugcgcgucggg

SEQ ID NO: 67326 - RNA, 32 nt, Human
auccgucguuggcgcccagggugcgcgucggg

SEQ ID NO: 67327 - RNA, 32 nt, Human
auccgucuugaaggcagcuccucucugugccg

SEQ ID NO: 67328 - RNA, 25 nt, Human
auccgugagguggagguuguaguga

SEQ ID NO: 67329 - RNA, 32 nt, Human
auccgugagguggagguuguagugagucaaga

SEQ ID NO: 67330 - RNA, 31 nt, Human
auccguggcagguacgccacagcagacacaa

SEQ ID NO: 67331 - RNA, 32 nt, Human
auccguggcugcaggggucucaugugguccuc

SEQ ID NO: 67332 - RNA, 32 nt, Human
auccguggcuuccuuggcuugucgucgcauca

SEQ ID NO: 67333 - RNA, 32 nt, Human
auccgugggcuucagugucuuggucuguggga

SEQ ID NO: 67334 - RNA, 32 nt, Human
auccgugguguuuuguaagcacugcuggcgau

SEQ ID NO: 67335 - RNA, 32 nt, Human
auccgugucaacccagccauggggaagaucac

SEQ ID NO: 67336 - RNA, 32 nt, Human
auccguuugguuuauggagaaaaagaaaaugg

SEQ ID NO: 67337 - RNA, 32 nt, Human
auccguuuuauauccagguuucagaggaccug

SEQ ID NO: 67338 - RNA, 32 nt, Human
auccuaaaaagauacaccuugcaguagcagag

SEQ ID NO: 67339 - RNA, 32 nt, Human
auccuaaaagaggcgguggaagugaaaauucu

SEQ ID NO: 67340 - RNA, 32 nt, Human
auccuaaaaggaaugccaauuaaguuuuguua

SEQ ID NO: 67341 - RNA, 32 nt, Human
auccuaaaccauugguaauuuccacugucuuu

SEQ ID NO: 67342 - RNA, 32 nt, Human
auccuaaacuagcgggcaccacagaccagcug

SEQ ID NO: 67343 - RNA, 32 nt, Human
auccuaaagcagcaagagaaaaggaacaaaua

SEQ ID NO: 67344 - RNA, 32 nt, Human
auccuaaagugcugagaugacaggcaugagcc

SEQ ID NO: 67345 - RNA, 32 nt, Human
auccuaaagugcugggauuacaggcgugagcu

SEQ ID NO: 67346 - RNA, 32 nt, Human
auccuaacaccuccauaauauuuucugcuaaa

SEQ ID NO: 67347 - RNA, 32 nt, Human
auccuaacacggugaaaucccgucucuauuaa

SEQ ID NO: 67348 - RNA, 32 nt, Human
auccuaacccugggcucccuggaggacucuag

SEQ ID NO: 67349 - RNA, 32 nt, Human
auccuaaccucugucuaccaaccuuuuugcuc

SEQ ID NO: 67350 - RNA, 32 nt, Human
auccuaacuucugaguucaucucugucucugc

SEQ ID NO: 67351 - RNA, 32 nt, Human
auccuaagcccuuuuauuaauguauaaccagg

SEQ ID NO: 67352 - RNA, 32 nt, Human
auccuaaucuugugccucucccccuuugcuag

SEQ ID NO: 67353 - RNA, 32 nt, Human
auccuaauggucugggugauuggaugguuuga

SEQ ID NO: 67354 - RNA, 32 nt, Human
auccuaauucccuguucuccugccucacuauu

SEQ ID NO: 67355 - RNA, 32 nt, Human
auccuaauugugguccugccucuuuucuaagc

SEQ ID NO: 67356 - RNA, 32 nt, Human
auccuacacucugagggaguuggcaacgcaug

SEQ ID NO: 67357 - RNA, 32 nt, Human
auccuacagcauaaagcacauugcugagccag

SEQ ID NO: 67358 - RNA, 32 nt, Human
auccuacaggacagcaaggagaugccaccuaa

SEQ ID NO: 67359 - RNA, 32 nt, Human
auccuacauggcuaaaagaagcagaagcaagu

SEQ ID NO: 67360 - RNA, 32 nt, Human
auccuaccacugcacuucagccuaggugacau

SEQ ID NO: 67361 - RNA, 32 nt, Human
auccuacccucgggcccaccuggccaccugag

SEQ ID NO: 67362 - RNA, 32 nt, Human
auccuaccggaagaucaaggaggcaggccaga

SEQ ID NO: 67363 - RNA, 32 nt, Human
auccuaccucccugaccagcucuggcuucugc

SEQ ID NO: 67364 - RNA, 32 nt, Human
auccuaccuucccccaccuccccaccguaaua

SEQ ID NO: 67365 - RNA, 32 nt, Human
auccuacucaacaaaaggaaggguggucagaa

SEQ ID NO: 67366 - RNA, 32 nt, Human
auccuacucagcaaggccccaucugaucagcu

SEQ ID NO: 67367 - RNA, 32 nt, Human
auccuacuucaucagagaauucacaguggaaa

SEQ ID NO: 67368 - RNA, 32 nt, Human
auccuagaacacagugcauuugcaagucauaa

SEQ ID NO: 67369 - RNA, 32 nt, Human
auccuagacucacugucugauccggaaggcac

SEQ ID NO: 67370 - RNA, 32 nt, Human
auccuagagccagcugauaauauuuaauaauc

SEQ ID NO: 67371 - RNA, 19 nt, Human
auccuagcaccuugggagg

SEQ ID NO: 67372 - RNA, 31 nt, Human
auccuagcacuuuugggaggcagagauggga

SEQ ID NO: 67373 - RNA, 32 nt, Human
auccuagcagccgccucccagcccugccuagg

SEQ ID NO: 67374 - RNA, 32 nt, Human
auccuagcaguggagcaguaccagcugggaca

SEQ ID NO: 67375 - RNA, 32 nt, Human
auccuagccaaggggauuucguguaaauguga

SEQ ID NO: 67376 - RNA, 32 nt, Human
auccuagccagccaccuugucuccaguccugg

SEQ ID NO: 67377 - RNA, 32 nt, Human
auccuagccugccucgcaccugcugagccgca

SEQ ID NO: 67378 - RNA, 32 nt, Human
auccuagcuacucgggagacugacgggagaau

SEQ ID NO: 67379 - RNA, 32 nt, Human
auccuagcucacaugccuccccuagcaguuaa

SEQ ID NO: 67380 - RNA, 32 nt, Human
auccuaggaaacuagugggaaacuggaaauca

SEQ ID NO: 67381 - RNA, 32 nt, Human
auccuaggagggugauguugacugagacuuca

SEQ ID NO: 67382 - RNA, 32 nt, Human
auccuaggcagacugugucugaaggagcuggu

SEQ ID NO: 67383 - RNA, 32 nt, Human
auccuaggccgagaagaaccugcuagcuugac

SEQ ID NO: 67384 - RNA, 32 nt, Human
auccuaggcugggcuggcccacccucaccccc

SEQ ID NO: 67385 - RNA, 32 nt, Human
auccuagggccuggguuuucauguuuuugaaa

SEQ ID NO: 67386 - RNA, 32 nt, Human
auccuaguaccaacuuuaucacuucugauggc

SEQ ID NO: 67387 - RNA, 32 nt, Human
auccuaguuuauacuagacuaccauuuaaaaa

SEQ ID NO: 67388 - RNA, 32 nt, Human
auccuaguuuauacuauacuaccauuuaaaua

SEQ ID NO: 67389 - RNA, 32 nt, Human
auccuauacuauagggacuguaguaucuauga

SEQ ID NO: 67390 - RNA, 32 nt, Human
auccuauacugcacccuguccaccucugcucc

SEQ ID NO: 67391 - RNA, 32 nt, Human
auccuauaugaaguuccugaaacugaccuuug

SEQ ID NO: 67392 - RNA, 32 nt, Human
auccuaucacagugcccaugccauacaugcca

SEQ ID NO: 67393 - RNA, 32 nt, Human
auccuauggaagagaauauuccuacuugcagu

SEQ ID NO: 67394 - RNA, 32 nt, Human
auccuauuaguucugucccuccagagaacccu

SEQ ID NO: 67395 - RNA, 32 nt, Human
auccuauuaguucugucccucuagagaacccc

SEQ ID NO: 67396 - RNA, 32 nt, Human
auccucaaaaccuaguaaggggaccaaugauu

SEQ ID NO: 67397 - RNA, 32 nt, Human
auccucaaaccugaaaacaaguuucacgucaa

SEQ ID NO: 67398 - RNA, 32 nt, Human
auccucaaaguuaaguagucaggaaagggggc

SEQ ID NO: 67399 - RNA, 32 nt, Human
auccucaaauccuuccacagugaccccaguuu

SEQ ID NO: 67400 - RNA, 24 nt, Human
auccucaaggacauuacaguugag

SEQ ID NO: 67401 - RNA, 32 nt, Human
auccucaaggauuuuauccuggaacauuacag

SEQ ID NO: 67402 - RNA, 32 nt, Human
auccucacacugacgggggcuccauacggacc

SEQ ID NO: 67403 - RNA, 32 nt, Human
auccucacagucaagugcgaggcuggggcuga

SEQ ID NO: 67404 - RNA, 32 nt, Human
auccucaccaagcucauuacaucugccagggc

SEQ ID NO: 67405 - RNA, 32 nt, Human
auccucaccugggguucucugugugcaaagcu

SEQ ID NO: 67406 - RNA, 32 nt, Human
auccucaccuuuccuucucaccuguccugcuu

SEQ ID NO: 67407 - RNA, 21 nt, Human
auccucacucugagucuuggu

SEQ ID NO: 67408 - RNA, 32 nt, Human
auccucacugacagcuucggccgcaucaagcg

SEQ ID NO: 67409 - RNA, 32 nt, Human
auccucacugcacuccagcagaggcuagagga

SEQ ID NO: 67410 - RNA, 32 nt, Human
auccucacugggcucacugcaggcaugcugaa

SEQ ID NO: 67411 - RNA, 32 nt, Human
auccucacuuugcugccccaccaucuugcuga

SEQ ID NO: 67412 - RNA, 32 nt, Human
auccucagaaugcaggaagugccugugcuugc

SEQ ID NO: 67413 - RNA, 32 nt, Human
auccucagaggacuuucccacuucgcuccugu

SEQ ID NO: 67414 - RNA, 32 nt, Human
auccucagaggaugaagccaccaggaauuuca

SEQ ID NO: 67415 - RNA, 32 nt, Human
auccucagccauguucaagugaaguaagccug

SEQ ID NO: 67416 - RNA, 32 nt, Human
auccucagggcagagguguuaagugagaagca

SEQ ID NO: 67417 - RNA, 32 nt, Human
auccucaguagcugcaacuacagccauacccc

SEQ ID NO: 67418 - RNA, 32 nt, Human
auccucaguggggauacaagacauauaaagua

SEQ ID NO: 67419 - RNA, 32 nt, Human
auccucaguucugaaucuaccuuggccucaag

SEQ ID NO: 67420 - RNA, 32 nt, Human
auccucauaggugagucuuuucacacaucugc

SEQ ID NO: 67421 - RNA, 32 nt, Human
auccucaucugucauaucaagaaaucacuaua

SEQ ID NO: 67422 - RNA, 32 nt, Human
auccucauuaccaggaucuauaccuuuaagcu

SEQ ID NO: 67423 - RNA, 32 nt, Human
auccuccaaaagugcugggauuacaggcauga

SEQ ID NO: 67424 - RNA, 32 nt, Human
auccuccaagaauuaaaugauaagcuaggauu

SEQ ID NO: 67425 - RNA, 16 nt, Human
auccuccaccccucca

SEQ ID NO: 67426 - RNA, 32 nt, Human
auccuccagagaaacccagggaggaagacugu

SEQ ID NO: 67427 - RNA, 32 nt, Human
auccuccagcuucagcuacccaaguagcugga

SEQ ID NO: 67428 - RNA, 32 nt, Human
auccuccaugccacauuccacccugguggcca

SEQ ID NO: 67429 - RNA, 32 nt, Human
auccucccaaaaugcugggauuacaggcauaa

SEQ ID NO: 67430 - RNA, 32 nt, Human
auccucccaaagugcugggauuacaaguguga

SEQ ID NO: 67431 - RNA, 32 nt, Human
auccucccaaagugcugggauuacagguguga

SEQ ID NO: 67432 - RNA, 32 nt, Human
auccucccaaagugcugggauuauaggccuga

SEQ ID NO: 67433 - RNA, 32 nt, Human
auccucccaaaguguugggauuacagguguga

SEQ ID NO: 67434 - RNA, 32 nt, Human
auccucccaaguagcuggaacuacaggugugc

SEQ ID NO: 67435 - RNA, 32 nt, Human
auccucccaaguagcugggauuacagaugccu

SEQ ID NO: 67436 - RNA, 32 nt, Human
auccucccaaguaggugggauuacaggugccc

SEQ ID NO: 67437 - RNA, 32 nt, Human
auccucccaauguauguaucccuuuacucaca

SEQ ID NO: 67438 - RNA, 21 nt, Human
auccucccacuucagccucca

SEQ ID NO: 67439 - RNA, 32 nt, Human
auccucccagaaaggaucaguguuagaauggg

SEQ ID NO: 67440 - RNA, 21 nt, Human
auccucccauccguguuguga

SEQ ID NO: 67441 - RNA, 32 nt, Human
auccucccauggcuuccccugcccucacuccc

SEQ ID NO: 67442 - RNA, 32 nt, Human
auccuccccauuaucucccccuugucuggaua

SEQ ID NO: 67443 - RNA, 32 nt, Human
auccuccccuccacuccagcccaccggugacu

SEQ ID NO: 67444 - RNA, 32 nt, Human
auccuccccugcccugaugucagcugcuuugc

SEQ ID NO: 67445 - RNA, 32 nt, Human
auccuccccuggcugcagaugcuuagcugggc

SEQ ID NO: 67446 - RNA, 32 nt, Human
auccucccgaguaacugggacuacagaugcgu

SEQ ID NO: 67447 - RNA, 22 nt, Human
auccucccgccucagccuucca

SEQ ID NO: 67448 - RNA, 32 nt, Human
auccucccucccccaccgucccucccuuuucu

SEQ ID NO: 67449 - RNA, 32 nt, Human
auccucccucccccagccaccacccucaggug

SEQ ID NO: 67450 - RNA, 32 nt, Human
auccucccuccccuaauuaaagucucuuuuug

SEQ ID NO: 67451 - RNA, 32 nt, Human
auccucccugcacugcauucgcacaaacugcu

SEQ ID NO: 67452 - RNA, 32 nt, Human
auccuccgaccaucacggacgugaccagcgcc

SEQ ID NO: 67453 - RNA, 32 nt, Human
auccuccgagacucaaagggcaaggccauggg

SEQ ID NO: 67454 - RNA, 32 nt, Human
auccuccgcuccucccccuaguccuggugcuc

SEQ ID NO: 67455 - RNA, 32 nt, Human
auccuccggaguagcugggauuacaggcgccu

SEQ ID NO: 67456 - RNA, 24 nt, Human
auccuccuccagggacugcuguga

SEQ ID NO: 67457 - RNA, 32 nt, Human
auccuccucuagacaaaaccagccuuuaaaau

SEQ ID NO: 67458 - RNA, 32 nt, Human
auccuccucucaucugugacaacuccacgagc

SEQ ID NO: 67459 - RNA, 32 nt, Human
auccuccucugccuuuccccugcccuugaucc

SEQ ID NO: 67460 - RNA, 32 nt, Human
auccuccugagcagcugggacuacaggcacac

SEQ ID NO: 67461 - RNA, 32 nt, Human
auccuccugaguagcugggauuacaggcgugu

SEQ ID NO: 67462 - RNA, 32 nt, Human
auccuccugaguagcugggauuacaggugccu

SEQ ID NO: 67463 - RNA, 32 nt, Human
auccuccugaguagcugggguuacaggugugu

SEQ ID NO: 67464 - RNA, 32 nt, Human
auccuccugagugcuggaccucauuaaagugc

SEQ ID NO: 67465 - RNA, 32 nt, Human
auccuccugcaguuucccagcugcagccuagg

SEQ ID NO: 67466 - RNA, 32 nt, Human
auccuccugccccugggcucucagggaccccc

SEQ ID NO: 67467 - RNA, 22 nt, Human
auccuccugccucagccuucca

SEQ ID NO: 67468 - RNA, 32 nt, Human
auccuccugccucagccuucugaguagcuggg

SEQ ID NO: 67469 - RNA, 32 nt, Human
auccuccugccugggccugccaaagugcuagg

SEQ ID NO: 67470 - RNA, 32 nt, Human
auccuccugccugucagccugucagcguucuc

SEQ ID NO: 67471 - RNA, 21 nt, Human
auccuccuguccccucuggga

SEQ ID NO: 67472 - RNA, 32 nt, Human
auccuccuucacucccugucauaguuaccgau

SEQ ID NO: 67473 - RNA, 32 nt, Human
auccucgaugaggauguggaaaugcuaaggca

SEQ ID NO: 67474 - RNA, 32 nt, Human
auccucgcagagugggagaggcugcagcaagg

SEQ ID NO: 67475 - RNA, 32 nt, Human
auccucgcgcguccucacccugucucuaccag

SEQ ID NO: 67476 - RNA, 32 nt, Human
auccucgcuggugaagacccagaggaaagggg

SEQ ID NO: 67477 - RNA, 32 nt, Human
auccucggcaaggacacaacacugccccagag

SEQ ID NO: 67478 - RNA, 32 nt, Human
auccucggggccgcaggaaggaagaggaggca

SEQ ID NO: 67479 - RNA, 32 nt, Human
auccucguuguugcugucaucauguucacugu

SEQ ID NO: 67480 - RNA, 32 nt, Human
auccucuaacagcaaaccaaggugcuauucuu

SEQ ID NO: 67481 - RNA, 32 nt, Human
auccucuagaugggugugagacccuggccccg

SEQ ID NO: 67482 - RNA, 32 nt, Human
auccucuagcuugaaacuuuugcucaaguuua

SEQ ID NO: 67483 - RNA, 32 nt, Human
auccucuaugugucacaagaccagucuuucug

SEQ ID NO: 67484 - RNA, 32 nt, Human
auccucucacagaaacacugggccaaacagug

SEQ ID NO: 67485 - RNA, 32 nt, Human
auccucucaggccuccucucccccgacaaaaa

SEQ ID NO: 67486 - RNA, 28 nt, Human
auccucuccacagcugccucuucccucu

SEQ ID NO: 67487 - RNA, 32 nt, Human
auccucucccuaaucccaaagccacuccuacc

SEQ ID NO: 67488 - RNA, 24 nt, Human
auccucucccuucuuacaccguga

SEQ ID NO: 67489 - RNA, 24 nt, Human
auccucucccuucuuacacuguga

SEQ ID NO: 67490 - RNA, 32 nt, Human
auccucucuaguccuuuuguuuggaaacugag

SEQ ID NO: 67491 - RNA, 32 nt, Human
auccucucucagcguccagccuagacggcggu

SEQ ID NO: 67492 - RNA, 32 nt, Human
auccucucuccucagccucccaaagugcuggg

SEQ ID NO: 67493 - RNA, 32 nt, Human
auccucucucucuugagcaaaguauagcaaca

SEQ ID NO: 67494 - RNA, 32 nt, Human
auccucucuuucucaucuggcuuuccuuagcc

SEQ ID NO: 67495 - RNA, 32 nt, Human
auccucugaaacccucucugugccccaaguac

SEQ ID NO: 67496 - RNA, 32 nt, Human
auccucugagugacccugguuucugagcucca

SEQ ID NO: 67497 - RNA, 21 nt, Human
auccucugccaccucucucuu

SEQ ID NO: 67498 - RNA, 32 nt, Human
auccucugccuccccuuccucuucuuguuuug

SEQ ID NO: 67499 - RNA, 32 nt, Human
auccucugcuccauuucacucuuguccucaca

SEQ ID NO: 67500 - RNA, 32 nt, Human
auccucugcucccaggggaaugugggagagaa

SEQ ID NO: 67501 - RNA, 32 nt, Human
auccucuggcaugccuuggccucccaaagggc

SEQ ID NO: 67502 - RNA, 32 nt, Human
auccucuuaaguauuccugucuccaaaggacc

SEQ ID NO: 67503 - RNA, 32 nt, Human
auccucuucauacccccucaugcacccaugaa

SEQ ID NO: 67504 - RNA, 32 nt, Human
auccucuuccuccucucgcugccagacuucau

SEQ ID NO: 67505 - RNA, 32 nt, Human
auccucuucuccccguacugccucaacccuga

SEQ ID NO: 67506 - RNA, 22 nt, Human
auccucuugccuuggccugcca

SEQ ID NO: 67507 - RNA, 32 nt, Human
auccucuugguuggcccccuugucagucccag

SEQ ID NO: 67508 - RNA, 32 nt, Human
auccucuuuucuccagaguagggaagacuccc

SEQ ID NO: 67509 - RNA, 32 nt, Human
auccucuuuugaucuugugugaccuccuggag

SEQ ID NO: 67510 - RNA, 31 nt, Human
auccucuuuuucugggccccugugucucggg

SEQ ID NO: 67511 - RNA, 32 nt, Human
auccugaaaugaggcagugcauuguggagaaa

SEQ ID NO: 67512 - RNA, 32 nt, Human
auccugaaauuucagccaugaaucaggcauaa

SEQ ID NO: 67513 - RNA, 31 nt, Human
auccugaagagaccuucaccugggugccacg

SEQ ID NO: 67514 - RNA, 32 nt, Human
auccugaagcuaagguacuugucuccuugucu

SEQ ID NO: 67515 - RNA, 32 nt, Human
auccugaaugacguugaaaacucccccucccc

SEQ ID NO: 67516 - RNA, 32 nt, Human
auccugaaugugccccuggaccuucuggaccc

SEQ ID NO: 67517 - RNA, 32 nt, Human
auccugaauguucaauaacuauccacaaacuc

SEQ ID NO: 67518 - RNA, 32 nt, Human
auccugaauguucaguacuauccacaaacuca

SEQ ID NO: 67519 - RNA, 32 nt, Human
auccugacacauucugaguaacaucagcagga

SEQ ID NO: 67520 - RNA, 32 nt, Human
auccugacaucucauuucuauuuucuguaauu

SEQ ID NO: 67521 - RNA, 32 nt, Human
auccugacauuggccaggcaugguggcucacg

SEQ ID NO: 67522 - RNA, 32 nt, Human
auccugaccacucuugaacccagaaggaggac

SEQ ID NO: 67523 - RNA, 32 nt, Human
auccugaccagugcaaccacgggaugccuccu

SEQ ID NO: 67524 - RNA, 32 nt, Human
auccugaccccagcagccucagaaggauccgu

SEQ ID NO: 67525 - RNA, 32 nt, Human
auccugacccccaggcuggagaggagccaaaa

SEQ ID NO: 67526 - RNA, 32 nt, Human
auccugacugccucuuggguugucaaaaccca

SEQ ID NO: 67527 - RNA, 20 nt, Human
auccugagagcccgagcgcc

SEQ ID NO: 67528 - RNA, 32 nt, Human
auccugagaguaagcaaaggaaccaugagaac

SEQ ID NO: 67529 - RNA, 32 nt, Human
auccugagcgcaggccaggguuguuugguuuu

SEQ ID NO: 67530 - RNA, 32 nt, Human
auccugagcugagcugcuuuucuugaaguugu

SEQ ID NO: 67531 - RNA, 32 nt, Human
auccugaggauagggcagagugcccagggugg

SEQ ID NO: 67532 - RNA, 32 nt, Human
auccugaggcauagaaauugaagaauuuguaa

SEQ ID NO: 67533 - RNA, 22 nt, Human
auccugagggcuggccccugcu

SEQ ID NO: 67534 - RNA, 32 nt, Human
auccugagggguccccaggggaggccagacuc

SEQ ID NO: 67535 - RNA, 32 nt, Human
auccugaguaguaaucucacacuucauccuau

SEQ ID NO: 67536 - RNA, 32 nt, Human
auccugaguccuggcccuccugggaucugggg

SEQ ID NO: 67537 - RNA, 32 nt, Human
auccugaguugaaauuuauccuaaagauauua

SEQ ID NO: 67538 - RNA, 32 nt, Human
auccugauaaucaaggcuuagaggaggaaguu

SEQ ID NO: 67539 - RNA, 32 nt, Human
auccugauacccuuuccuucuccaugucagua

SEQ ID NO: 67540 - RNA, 32 nt, Human
auccugcaacagaagcauucucuaggucccag

SEQ ID NO: 67541 - RNA, 32 nt, Human
auccugcaccccagucccccagcccuaaaucc

SEQ ID NO: 67542 - RNA, 32 nt, Human
auccugcaccuccucccucucccuucaccuca

SEQ ID NO: 67543 - RNA, 25 nt, Human
auccugcacgccauucuccaccuca

SEQ ID NO: 67544 - RNA, 32 nt, Human
auccugcagaggagccgccuucugcugucugu

SEQ ID NO: 67545 - RNA, 32 nt, Human
auccugcagagggucaaggagcagggauguug

SEQ ID NO: 67546 - RNA, 32 nt, Human
auccugcagcacaagcuccuccacucacugcc

SEQ ID NO: 67547 - RNA, 23 nt, Human
auccugcagcagcugagggggug

SEQ ID NO: 67548 - RNA, 32 nt, Human
auccugcagccuucccaguccugcugcuugug

SEQ ID NO: 67549 - RNA, 32 nt, Human
auccugcagcuggcuggcuaccagugagcagc

SEQ ID NO: 67550 - RNA, 32 nt, Human
auccugcaggcccugaggaccgcgcugaagca

SEQ ID NO: 67551 - RNA, 32 nt, Human
auccugcagggccuuguuuuuguauuuggaga

SEQ ID NO: 67552 - RNA, 32 nt, Human
auccugcagucccucacuggcugcccucacaa

SEQ ID NO: 67553 - RNA, 32 nt, Human
auccugcaucccagucccccucccagcacccc

SEQ ID NO: 67554 - RNA, 32 nt, Human
auccugcaugggggcuccuguugcuuuggggg

SEQ ID NO: 67555 - RNA, 32 nt, Human
auccugccacugcacaccagccugggugacag

SEQ ID NO: 67556 - RNA, 32 nt, Human
auccugccacugcacuccagccugggcaacag

SEQ ID NO: 67557 - RNA, 32 nt, Human
auccugccacugcacuccagccugggcgacag

SEQ ID NO: 67558 - RNA, 32 nt, Human
auccugccacugcacuccagccugugccacag

SEQ ID NO: 67559 - RNA, 32 nt, Human
auccugccacuucacaucuacucuuccauggc

SEQ ID NO: 67560 - RNA, 32 nt, Human
auccugccacuucuaugucucuggaccacagg

SEQ ID NO: 67561 - RNA, 32 nt, Human
auccugccaucuuuccuuccuaucucccccag

SEQ ID NO: 67562 - RNA, 32 nt, Human
auccugcccagcccugccuccuggccaugccg

SEQ ID NO: 67563 - RNA, 32 nt, Human
auccugccccacagcccugccuggauuuguau

SEQ ID NO: 67564 - RNA, 32 nt, Human
auccugccccauagcccugccuggauuuguau

SEQ ID NO: 67565 - RNA, 32 nt, Human
auccugccccaucccuuccccagugcacucug

SEQ ID NO: 67566 - RNA, 32 nt, Human
auccugccccuguccuacagcagaucaauugc

SEQ ID NO: 67567 - RNA, 32 nt, Human
auccugccccuugucaucugcagcgggaucuc

SEQ ID NO: 67568 - RNA, 32 nt, Human
auccugcccggaccacagaaggagaguuggcg

SEQ ID NO: 67569 - RNA, 32 nt, Human
auccugcccucacaucuuccaccagcaccuua

SEQ ID NO: 67570 - RNA, 32 nt, Human
auccugcccucaccucacccuuuuccaacuug

SEQ ID NO: 67571 - RNA, 32 nt, Human
auccugcccuggggcucccugccagggcccug

SEQ ID NO: 67572 - RNA, 32 nt, Human
auccugccucauuaauucaagcagaaaauauc

SEQ ID NO: 67573 - RNA, 32 nt, Human
auccugccuccacccaguuccccacaaagcac

SEQ ID NO: 67574 - RNA, 32 nt, Human
auccugccugagcuccagcccccagcccccac

SEQ ID NO: 67575 - RNA, 32 nt, Human
auccugccugcucugauccucuugacccuucu

SEQ ID NO: 67576 - RNA, 32 nt, Human
auccugccuuucugucugggaggaaacagaga

SEQ ID NO: 67577 - RNA, 18 nt, Human
auccugcgcuggcugcug

SEQ ID NO: 67578 - RNA, 32 nt, Human
auccugcggcuggucugggguggggucuguug

SEQ ID NO: 67579 - RNA, 32 nt, Human
auccugcggggugggcccucuguauagcugcu

SEQ ID NO: 67580 - RNA, 18 nt, Human
auccugcuaugacugcau

SEQ ID NO: 67581 - RNA, 32 nt, Human
auccugcucagguucaaaaagaggguguauag

SEQ ID NO: 67582 - RNA, 32 nt, Human
auccugcuccacugccuuccucuagugcagcc

SEQ ID NO: 67583 - RNA, 32 nt, Human
auccugcucuccuccagccgagggacccuggu

SEQ ID NO: 67584 - RNA, 32 nt, Human
auccugcuucaguggacaaagaagaugagaca

SEQ ID NO: 67585 - RNA, 32 nt, Human
auccugcuucuccagccuuucucccauuucag

SEQ ID NO: 67586 - RNA, 32 nt, Human
auccuggaacuacauucuuucuuucugcaguu

SEQ ID NO: 67587 - RNA, 32 nt, Human
auccuggaagaaaaggagaaagugugauguag

SEQ ID NO: 67588 - RNA, 32 nt, Human
auccuggacccaagggcuugggugaugcccac

SEQ ID NO: 67589 - RNA, 19 nt, Human
auccuggacccauuacaua

SEQ ID NO: 67590 - RNA, 32 nt, Human
auccuggacccuuguucucagcacuuuuggau

SEQ ID NO: 67591 - RNA, 32 nt, Human
auccuggagccucauggaacaggaugauggca

SEQ ID NO: 67592 - RNA, 32 nt, Human
auccuggagcugcagccugccuggguggcugu

SEQ ID NO: 67593 - RNA, 32 nt, Human
auccuggaggcagagguugcagugagcugaga

SEQ ID NO: 67594 - RNA, 32 nt, Human
auccuggaggcuugguccccaggccuugaggu

SEQ ID NO: 67595 - RNA, 32 nt, Human
auccuggaggggcaggcucugcgcaucugcuc

SEQ ID NO: 67596 - RNA, 32 nt, Human
auccuggaggugaagguugcagugagccaaga

SEQ ID NO: 67597 - RNA, 32 nt, Human
auccuggauacugccaaaggaaccugaaaauc

SEQ ID NO: 67598 - RNA, 32 nt, Human
auccuggcaaaggauugugggguggucaggag

SEQ ID NO: 67599 - RNA, 32 nt, Human
auccuggcacagcuguggcgccucccagcucg

SEQ ID NO: 67600 - RNA, 20 nt, Human
auccuggcagauguaaggug

SEQ ID NO: 67601 - RNA, 32 nt, Human
auccuggcaucacauuuaacauguuaucuacu

SEQ ID NO: 67602 - RNA, 32 nt, Human
auccuggccaauaggcugcgccucaagaggug

SEQ ID NO: 67603 - RNA, 32 nt, Human
auccuggccacagacaguuucaaguaguguca

SEQ ID NO: 67604 - RNA, 32 nt, Human
auccuggccagggaauggaagggagaccagga

SEQ ID NO: 67605 - RNA, 24 nt, Human
auccuggccaugagagcugaggag

SEQ ID NO: 67606 - RNA, 32 nt, Human
auccuggcccacacaggcaccccacacaaacc

SEQ ID NO: 67607 - RNA, 32 nt, Human
auccuggcccugagccucagccucugccaugg

SEQ ID NO: 67608 - RNA, 32 nt, Human
auccuggccuccaucccuuaaaagcuuuguga

SEQ ID NO: 67609 - RNA, 32 nt, Human
auccuggccugggggagaaugcuggagggagc

SEQ ID NO: 67610 - RNA, 32 nt, Human
auccuggccuuugaaagucugauauccugaga

SEQ ID NO: 67611 - RNA, 32 nt, Human
auccuggcuaacacgggugaaaccccgucucu

SEQ ID NO: 67612 - RNA, 32 nt, Human
auccuggcuagaucugccucuguuuugcuggu

SEQ ID NO: 67613 - RNA, 31 nt, Human
auccuggcuauggugaaaccccgucucuacu

SEQ ID NO: 67614 - RNA, 32 nt, Human
auccuggcucacugcaaacucugccucccagg

SEQ ID NO: 67615 - RNA, 32 nt, Human
auccuggcucacugcaaccuccaccucccggg

SEQ ID NO: 67616 - RNA, 32 nt, Human
auccuggcucacugcaacugcagccucccggg

SEQ ID NO: 67617 - RNA, 32 nt, Human
auccuggcucacugcaaucuccaucucccggg

SEQ ID NO: 67618 - RNA, 24 nt, Human
auccuggcucacugcaaucuccgc

SEQ ID NO: 67619 - RNA, 32 nt, Human
auccuggcucacugcaaucuccgccuccccag

SEQ ID NO: 67620 - RNA, 32 nt, Human
auccuggcucacuguaaccucuggguucaagc

SEQ ID NO: 67621 - RNA, 32 nt, Human
auccuggcuccccucccucuuccacucuuucc

SEQ ID NO: 67622 - RNA, 32 nt, Human
auccuggcuccuaucucugccuuccaggcauc

SEQ ID NO: 67623 - RNA, 32 nt, Human
auccuggcugucuaugaacuaggguuuucucc

SEQ ID NO: 67624 - RNA, 32 nt, Human
auccuggcuugcagcucgggagcuuuacacac

SEQ ID NO: 67625 - RNA, 32 nt, Human
auccugggaacucaacuugaaggucugucuuc

SEQ ID NO: 67626 - RNA, 32 nt, Human
auccugggagagaggugacaaguucagaggug

SEQ ID NO: 67627 - RNA, 32 nt, Human
aucugggugaugaaaugcacugucuggaguca

SEQ ID NO: 67628 - RNA, 32 nt, Human
aucuggguucaagaagauggccagcagaugaa

SEQ ID NO: 67629 - RNA, 32 nt, Human
aucuggguucaagcgauucuccugccucauuc

SEQ ID NO: 67630 - RNA, 24 nt, Human
aucuggguucacugcaaccuccgc

SEQ ID NO: 67631 - RNA, 32 nt, Human
aucuggguucacugcaaccuccgccucuuggg

SEQ ID NO: 67632 - RNA, 32 nt, Human
aucuggguucacugcaaccucugccuccaggu

SEQ ID NO: 67633 - RNA, 32 nt, Human
aucuggguucacugcaaccucugccuccuggg

SEQ ID NO: 67634 - RNA, 32 nt, Human
aucuggguuucugcucuaugagggucccugag

SEQ ID NO: 67635 - RNA, 28 nt, Human
aucuggucaauaaagcuguuuagaccag

SEQ ID NO: 67636 - RNA, 32 nt, Human
aucuggucaucccuggcaccucuccuuuggag

SEQ ID NO: 67637 - RNA, 32 nt, Human
aucugguccaucccaaaccugacgaagcagaa

SEQ ID NO: 67638 - RNA, 32 nt, Human
aucugguccuuccuccccagcuuuuguguggg

SEQ ID NO: 67639 - RNA, 32 nt, Human
aucuggucucacugcaaccucuaccucccagg

SEQ ID NO: 67640 - RNA, 32 nt, Human
aucuggugauccaaacccucagagccagucuc

SEQ ID NO: 67641 - RNA, 32 nt, Human
aucuggugcccuccccuccacccucacaagga

SEQ ID NO: 67642 - RNA, 32 nt, Human
aucuggugccuccucaaacccagucucagaca

SEQ ID NO: 67643 - RNA, 32 nt, Human
aucugguggagggaagagagaagagguaggaa

SEQ ID NO: 67644 - RNA, 29 nt, Human
aucugguggcugcugucaucuguccccag

SEQ ID NO: 67645 - RNA, 32 nt, Human
aucugguggcuggaaaaagcaaacaaacaaac

SEQ ID NO: 67646 - RNA, 32 nt, Human
aucugguggcuucccccgcccuucccauguag

SEQ ID NO: 67647 - RNA, 32 nt, Human
aucuggugguuuuuacacauggucagaaugug

SEQ ID NO: 67648 - RNA, 32 nt, Human
aucuggugugggaagaagauggggaguuacuu

SEQ ID NO: 67649 - RNA, 32 nt, Human
aucugguuaccugugcaguugugaauacccag

SEQ ID NO: 67650 - RNA, 32 nt, Human
aucugguugggcuggauucccucuguaagccu

SEQ ID NO: 67651 - RNA, 31 nt, Human
aucugguugguggaaaacuaggugaagugcu

SEQ ID NO: 67652 - RNA, 32 nt, Human
aucugguuucacuuccuccaccuuuuaaggac

SEQ ID NO: 67653 - RNA, 32 nt, Human
aucugguuuugcugaucucauuuuggauuuag

SEQ ID NO: 67654 - RNA, 32 nt, Human
aucuguaaauaaauggacaaggcuggguucca

SEQ ID NO: 67655 - RNA, 32 nt, Human
aucuguaaauucuuugcgcccuucccggcugc

SEQ ID NO: 67656 - RNA, 32 nt, Human
aucuguaacccagcuauucaagaggcugaggc

SEQ ID NO: 67657 - RNA, 32 nt, Human
aucuguaagguucaaguauacauauuacugaa

SEQ ID NO: 67658 - RNA, 32 nt, Human
aucuguaaguuuuaaaguuugugcaaaauguc

SEQ ID NO: 67659 - RNA, 21 nt, Human
aucuguaauacagcauuuuua

SEQ ID NO: 67660 - RNA, 22 nt, Human
aucuguaauuuccuugcucuca

SEQ ID NO: 67661 - RNA, 23 nt, Human
aucuguaauuuuuugacuuuuua

SEQ ID NO: 67662 - RNA, 32 nt, Human
aucuguaccaaagaggaguauggugggagagg

SEQ ID NO: 67663 - RNA, 32 nt, Human
aucuguaccuuaacuuuaucacuguuuaaaac

SEQ ID NO: 67664 - RNA, 32 nt, Human
aucuguagaaauaucagugucuucuggggagg

SEQ ID NO: 67665 - RNA, 32 nt, Human
aucuguagacaggcucacaugcaccaggaacu

SEQ ID NO: 67666 - RNA, 32 nt, Human
aucuguagacauguguccccacugcagggagu

SEQ ID NO: 67667 - RNA, 32 nt, Human
aucuguagugagauagcauugugaacugacag

SEQ ID NO: 67668 - RNA, 32 nt, Human
aucuguaucaggucagcagaagaaggaacuga

SEQ ID NO: 67669 - RNA, 32 nt, Human
aucuguaucucucacucuacagaucauucugu

SEQ ID NO: 67670 - RNA, 32 nt, Human
aucuguaugggcccaacccugaucucaaaccu

SEQ ID NO: 67671 - RNA, 32 nt, Human
aucuguauucgccaucuacaccaaaauaaacc

SEQ ID NO: 67672 - RNA, 32 nt, Human
aucuguauugggcuaaccagagccaaauacuu

SEQ ID NO: 67673 - RNA, 32 nt, Human
aucugucacccaggcuggagcgcaguggugug

SEQ ID NO: 67674 - RNA, 32 nt, Human
aucugucacccaggcuggagugcaauggcaug

SEQ ID NO: 67675 - RNA, 32 nt, Human
aucugucacccaggcuggagugcaguagugca

SEQ ID NO: 67676 - RNA, 32 nt, Human
aucugucacccaggcuggagugcaguggcaca

SEQ ID NO: 67677 - RNA, 32 nt, Human
aucugucacccaggcuggagugcaguggcaug

SEQ ID NO: 67678 - RNA, 32 nt, Human
aucugucacccaggcuggugugcaggggugcg

SEQ ID NO: 67679 - RNA, 32 nt, Human
aucugucacucagcuucucugugucucugguu

SEQ ID NO: 67680 - RNA, 32 nt, Human
aucugucauccaagcugaggugcaguggcacg

SEQ ID NO: 67681 - RNA, 32 nt, Human
aucuguccaaagcagaggcaguggagcuugag

SEQ ID NO: 67682 - RNA, 32 nt, Human
aucuguccagaaccugcucccaccucaggccc

SEQ ID NO: 67683 - RNA, 32 nt, Human
aucuguccaguggguagguuggacuggaaaau

SEQ ID NO: 67684 - RNA, 32 nt, Human
aucuguccaucccacagcucagccuggaugcc

SEQ ID NO: 67685 - RNA, 32 nt, Human
aucuguccaugguucgagaagcugcuguucac

SEQ ID NO: 67686 - RNA, 32 nt, Human
aucugucccgugggaauccugaagucugacuc

SEQ ID NO: 67687 - RNA, 32 nt, Human
aucugucccugagagugucucugauaaaaggg

SEQ ID NO: 67688 - RNA, 32 nt, Human
aucugucccugaggaagccccacuucucugua

SEQ ID NO: 67689 - RNA, 32 nt, Human
aucuguccugcaccaucugccuaauuccuucc

SEQ ID NO: 67690 - RNA, 32 nt, Human
aucugucgcccaggcuggagugcaguagcgug

SEQ ID NO: 67691 - RNA, 32 nt, Human
aucugucuccacucaagaggcugaugggcagg

SEQ ID NO: 67692 - RNA, 32 nt, Human
aucugucuccccuuguuccugaguggccccac

SEQ ID NO: 67693 - RNA, 32 nt, Human
aucugucuccugggucugacugcuacccacua

SEQ ID NO: 67694 - RNA, 32 nt, Human
aucugucugagguuucuuccuccugggguuuc

SEQ ID NO: 67695 - RNA, 32 nt, Human
aucugucugaguuuucuuccuccugggguuuc

SEQ ID NO: 67696 - RNA, 32 nt, Human
aucugucuggccauucagaggauucuaaagac

SEQ ID NO: 67697 - RNA, 32 nt, Human
aucugucugucuagacucugcagucaccagcu

SEQ ID NO: 67698 - RNA, 32 nt, Human
aucugucugucugugggcuucagcacuuuaaa

SEQ ID NO: 67699 - RNA, 32 nt, Human
aucugucuuuaauccaucuuuuuaaucaugaa

SEQ ID NO: 67700 - RNA, 32 nt, Human
aucugugaaauuaugugaauagagaccauuuu

SEQ ID NO: 67701 - RNA, 32 nt, Human
aucugugaccggcagccccagaccugccugcc

SEQ ID NO: 67702 - RNA, 32 nt, Human
aucugugaccugaugguggagaacaagaaggu

SEQ ID NO: 67703 - RNA, 32 nt, Human
aucugugagagggaauggggugggagaugugg

SEQ ID NO: 67704 - RNA, 32 nt, Human
aucugugaggcguguguuauaaauaauauucc

SEQ ID NO: 67705 - RNA, 32 nt, Human
aucugugagggccuucuugcugccucaccuca

SEQ ID NO: 67706 - RNA, 32 nt, Human
aucugugaggugacucgugaaaguaggugauu

SEQ ID NO: 67707 - RNA, 32 nt, Human
aucugugaucugaggagguucuggaagacugg

SEQ ID NO: 67708 - RNA, 32 nt, Human
aucugugauuacaggcacgugccaccaugccc

SEQ ID NO: 67709 - RNA, 32 nt, Human
aucugugauucuuauaagagcuuugucuucag

SEQ ID NO: 67710 - RNA, 32 nt, Human
aucugugcacacauacacacgucugugccugu

SEQ ID NO: 67711 - RNA, 32 nt, Human
aucugugcagagccagccaccuugggggcugg

SEQ ID NO: 67712 - RNA, 32 nt, Human
aucugugcagcaaagcaccaugguacauguuu

SEQ ID NO: 67713 - RNA, 32 nt, Human
aucugugcauuuggcaaaaugucuuaacaaau

SEQ ID NO: 67714 - RNA, 32 nt, Human
aucugugccacccggcacuaccauuucgaggg

SEQ ID NO: 67715 - RNA, 32 nt, Human
aucugugccaugacucuucugaauguuuggac

SEQ ID NO: 67716 - RNA, 32 nt, Human
aucugugcccugcaguuaguucugauccagga

SEQ ID NO: 67717 - RNA, 32 nt, Human
aucugugccugucuguccaaccccucccccac

SEQ ID NO: 67718 - RNA, 32 nt, Human
aucugugcgaugccuccccacaugucacggga

SEQ ID NO: 67719 - RNA, 21 nt, Human
aucugugcuaggcauacaucc

SEQ ID NO: 67720 - RNA, 32 nt, Human
aucugugcucuuggugaggagagcaagaggaa

SEQ ID NO: 67721 - RNA, 32 nt, Human
aucugugcuuggcuaugacucuaccuccaggu

SEQ ID NO: 67722 - RNA, 32 nt, Human
aucuguggacuucacucaggaggagugggggc

SEQ ID NO: 67723 - RNA, 32 nt, Human
aucuguggagccaguggagacucacagcagug

SEQ ID NO: 67724 - RNA, 32 nt, Human
aucuguggccuucccugcucagccucuugguc

SEQ ID NO: 67725 - RNA, 32 nt, Human
aucuguggcugcaggggucagacagacaagga

SEQ ID NO: 67726 - RNA, 32 nt, Human
aucugugggcaccacuugacuauccaaccuga

SEQ ID NO: 67727 - RNA, 32 nt, Human
aucugugguacauuuauuuaccuacucccuga

SEQ ID NO: 67728 - RNA, 32 nt, Human
aucuguggucacauccugcccaauuccagcuc

SEQ ID NO: 67729 - RNA, 32 nt, Human
aucuguggucauugucccucugcagaauaaag

SEQ ID NO: 67730 - RNA, 32 nt, Human
aucugugguucaccuguagacagagagcagau

SEQ ID NO: 67731 - RNA, 32 nt, Human
aucugugguugaauuugcuguguuguuaugaa

SEQ ID NO: 67732 - RNA, 32 nt, Human
aucuguguacaaaaauuaguugcauuucuaua

SEQ ID NO: 67733 - RNA, 32 nt, Human
aucugugucugugacuugacuccuggagccug

SEQ ID NO: 67734 - RNA, 32 nt, Human
aucugugucuucaaacagauccugguuacagc

SEQ ID NO: 67735 - RNA, 32 nt, Human
aucugugucuuuuggaaaaggagcugcauggc

SEQ ID NO: 67736 - RNA, 32 nt, Human
aucuguguggcucaccagcaggcaugcuucgc

SEQ ID NO: 67737 - RNA, 32 nt, Human
aucugugugugugcugauuuguugucuugcca

SEQ ID NO: 67738 - RNA, 32 nt, Human
aucuguguguucucuuaagucuuuggaggaaa

SEQ ID NO: 67739 - RNA, 32 nt, Human
aucuguguuauuucuggcuuucuuugagugac

SEQ ID NO: 67740 - RNA, 32 nt, Human
aucuguguucacagacaucugggggaagaaaa

SEQ ID NO: 67741 - RNA, 32 nt, Human
aucuguguucucugccuuagaccuucugcaga

SEQ ID NO: 67742 - RNA, 32 nt, Human
aucuguuacccaggcuggagugcagugacaca

SEQ ID NO: 67743 - RNA, 32 nt, Human
aucuguuacccaggcuggagugcaguggcaug

SEQ ID NO: 67744 - RNA, 32 nt, Human
aucuguuacccaggcuggagugcaguggugcu

SEQ ID NO: 67745 - RNA, 32 nt, Human
aucuguuagagguucauguacugcuaaggcgu

SEQ ID NO: 67746 - RNA, 32 nt, Human
aucuguuauguguguuugcugcggugggaggg

SEQ ID NO: 67747 - RNA, 32 nt, Human
aucuguucacaucuuacucaacaucagagauu

SEQ ID NO: 67748 - RNA, 19 nt, Human
aucuguucagaccaagcaa

SEQ ID NO: 67749 - RNA, 32 nt, Human
aucuguucagcccaaaugaaaucuuccuuuua

SEQ ID NO: 67750 - RNA, 32 nt, Human
aucuguuccuaugcccaggaugauuuugugaa

SEQ ID NO: 67751 - RNA, 32 nt, Human
aucuguucuaguuaaugauuugggagauuuuu

SEQ ID NO: 67752 - RNA, 18 nt, Human
aucuguucuggggaucug

SEQ ID NO: 67753 - RNA, 32 nt, Human
aucuguugaaucagauauuuuaucaagauauc

SEQ ID NO: 67754 - RNA, 32 nt, Human
aucuguugaauuugggaagccuccaguuuuaa

SEQ ID NO: 67755 - RNA, 32 nt, Human
aucuguugcccaggcuggagugcaguggagca

SEQ ID NO: 67756 - RNA, 32 nt, Human
aucuguugcccagguccugcaaaggagccaug

SEQ ID NO: 67757 - RNA, 32 nt, Human
aucuguuggccaccugcaggccagucucaacc

SEQ ID NO: 67758 - RNA, 32 nt, Human
aucuguugguggagguauaaaaugaggagacu

SEQ ID NO: 67759 - RNA, 32 nt, Human
aucuguugugcgcauugaagugugcaugauua

SEQ ID NO: 67760 - RNA, 32 nt, Human
aucuguuuacagccauuuccgugccauacuuu

SEQ ID NO: 67761 - RNA, 32 nt, Human
aucuguuuauugacccagaccugggcacaggc

SEQ ID NO: 67762 - RNA, 32 nt, Human
aucuguuucagcaaccaggccugaggucagaa

SEQ ID NO: 67763 - RNA, 32 nt, Human
aucuguuuccaccugcugaauggugcucugac

SEQ ID NO: 67764 - RNA, 32 nt, Human
aucuguuuccagaguuauuauggccucagagg

SEQ ID NO: 67765 - RNA, 32 nt, Human
aucuguuucuguaguugaggacaacugugaug

SEQ ID NO: 67766 - RNA, 32 nt, Human
aucuguuucuucuccuccuuucucucccucuu

SEQ ID NO: 67767 - RNA, 32 nt, Human
aucuguuugaaggaauuuccugguuuucagau

SEQ ID NO: 67768 - RNA, 32 nt, Human
aucuguuugugccaguucuuuacauguacuaa

SEQ ID NO: 67769 - RNA, 32 nt, Human
aucuguuuguuguuguuguugaagacaguaaa

SEQ ID NO: 67770 - RNA, 32 nt, Human
aucuguuuuuaguaucagcagcauuuggcaag

SEQ ID NO: 67771 - RNA, 32 nt, Human
aucuguuuuugggcuccacuugccaggccuga

SEQ ID NO: 67772 - RNA, 32 nt, Human
aucuuaaaaauggaaguccuaaaaauuaguuu

SEQ ID NO: 67773 - RNA, 32 nt, Human
aucuuaaaauguaaauaugcugggacaaugug

SEQ ID NO: 67774 - RNA, 32 nt, Human
aucuuaaagagaccaguuacagaugcuugguu

SEQ ID NO: 67775 - RNA, 32 nt, Human
aucuuaaagccuugaaaaauguuaauaaucuu

SEQ ID NO: 67776 - RNA, 32 nt, Human
aucuuaaaguacagcgaagaagaaagggaagu

SEQ ID NO: 67777 - RNA, 32 nt, Human
aucuuaaaugauuuuugccacugguauuccuu

SEQ ID NO: 67778 - RNA, 32 nt, Human
aucuuaacaaauuccugaacaauggcuccaaa

SEQ ID NO: 67779 - RNA, 32 nt, Human
aucuuaacauuucuuacaaauccacagauugg

SEQ ID NO: 67780 - RNA, 32 nt, Human
aucuuaaccagcugagggagcuuguacaacac

SEQ ID NO: 67781 - RNA, 32 nt, Human
aucuuaacucacugcaaccuccgcuucccagg

SEQ ID NO: 67782 - RNA, 32 nt, Human
aucuuaacuuccucuucccccaagcuaucugg

SEQ ID NO: 67783 - RNA, 32 nt, Human
aucuuaagaaaauuugucuggcuacacucuuu

SEQ ID NO: 67784 - RNA, 32 nt, Human
aucuuaagaacugcccagccucagcugaaaac

SEQ ID NO: 67785 - RNA, 32 nt, Human
aucuuaagcaucagcgugacgugaccucucug

SEQ ID NO: 67786 - RNA, 32 nt, Human
aucuuaagcuuucuuuugcucucuucagcaau

SEQ ID NO: 67787 - RNA, 32 nt, Human
aucuuaaggagugaaaauagagucuaaaucuu

SEQ ID NO: 67788 - RNA, 32 nt, Human
aucuuaagggaauuuuucuaaaaaccuuuuca

SEQ ID NO: 67789 - RNA, 32 nt, Human
aucuuaaggggaaguugaaagugggggcgggg

SEQ ID NO: 67790 - RNA, 32 nt, Human
aucuuaagugcucucucuacucccagguccag

SEQ ID NO: 67791 - RNA, 32 nt, Human
aucuuaauacaacauggacaccacguugcuga

SEQ ID NO: 67792 - RNA, 22 nt, Human
aucuuaauuucuggcucuauca

SEQ ID NO: 67793 - RNA, 32 nt, Human
aucuuacacaucugccaccggaaauaccaugc

SEQ ID NO: 67794 - RNA, 32 nt, Human
aucuuacaguuggaguucaauguaacauuuua

SEQ ID NO: 67795 - RNA, 32 nt, Human
aucuuacauucuguuuucuuccagucuuugca

SEQ ID NO: 67796 - RNA, 28 nt, Human
aucuuaccaagugccaucauccuucacc

SEQ ID NO: 67797 - RNA, 32 nt, Human
aucuuaccacacacauggguguuucuauuauc

SEQ ID NO: 67798 - RNA, 32 nt, Human
aucuuaccugcucuggauugccaugagcaggu

SEQ ID NO: 67799 - RNA, 32 nt, Human
aucuuaccuguaauccuagcacuuugagacca

SEQ ID NO: 67800 - RNA, 32 nt, Human
aucuuaccuucuccuuuuuaugaagggaagag

SEQ ID NO: 67801 - RNA, 32 nt, Human
aucuuacucccaggccuccugucaccagcugu

SEQ ID NO: 67802 - RNA, 32 nt, Human
aucuuacuccugaaccuuagacaggaaguauu

SEQ ID NO: 67803 - RNA, 32 nt, Human
aucuuacucugagugugaugcagucagaggca

SEQ ID NO: 67804 - RNA, 32 nt, Human
aucuuacucuucucagcuucucagcuuggcuc

SEQ ID NO: 67805 - RNA, 32 nt, Human
aucuuacugcaagcagcguccugaggagacag

SEQ ID NO: 67806 - RNA, 32 nt, Human
aucuuacuguaccgccuguuguaucugggagc

SEQ ID NO: 67807 - RNA, 32 nt, Human
aucuuagaacucuuucugaagagaccuuauca

SEQ ID NO: 67808 - RNA, 32 nt, Human
aucuuagagcaucacucuuccucacaccacaa

SEQ ID NO: 67809 - RNA, 32 nt, Human
aucuuagagguagauuauccaggccauccccu

SEQ ID NO: 67810 - RNA, 32 nt, Human
aucuuagcucacuacaaccucugccucccagg

SEQ ID NO: 67811 - RNA, 32 nt, Human
aucuuagcucacuacaacuucugccucccagg

SEQ ID NO: 67812 - RNA, 24 nt, Human
aucuuagcucacugcaacccccgc

SEQ ID NO: 67813 - RNA, 32 nt, Human
aucuuagcucacugcaacccccgccucccggg

SEQ ID NO: 67814 - RNA, 32 nt, Human
aucuuagcucacugcaaccuccaccucccagg

SEQ ID NO: 67815 - RNA, 32 nt, Human
aucuuagcucacugcaaccuccaccucccggg

SEQ ID NO: 67816 - RNA, 32 nt, Human
aucuuagcucacugcaaccuccgccuccuggg

SEQ ID NO: 67817 - RNA, 32 nt, Human
aucuuagcucacugcaaccucugcuuccuggg

SEQ ID NO: 67818 - RNA, 24 nt, Human
aucuuagcucacugcaagcuccgc

SEQ ID NO: 67819 - RNA, 32 nt, Human
aucuuagcucacugcaagcuccgccucccagg

SEQ ID NO: 67820 - RNA, 32 nt, Human
aucuuagcucucugcaaccucugccucccagg

SEQ ID NO: 67821 - RNA, 32 nt, Human
aucuuagcuuugauaaaugacugagcuggaga

SEQ ID NO: 67822 - RNA, 32 nt, Human
aucuuaggacacagaugugcccagggaggugg

SEQ ID NO: 67823 - RNA, 32 nt, Human
aucuuaggagaaagggggcaaggaaguaaauc

SEQ ID NO: 67824 - RNA, 32 nt, Human
aucuuaggaucauggaaaaccuggaaucaagg

SEQ ID NO: 67825 - RNA, 32 nt, Human
aucuuaggcaccuugcacaggccuucucguuu

SEQ ID NO: 67826 - RNA, 32 nt, Human
aucuuaggcaugugcugguauccacaguuaau

SEQ ID NO: 67827 - RNA, 32 nt, Human
aucuuaggccuggaaguuagagugagggaaau

SEQ ID NO: 67828 - RNA, 32 nt, Human
aucuuaggccugguuauuaggggccugaucag

SEQ ID NO: 67829 - RNA, 32 nt, Human
aucuuagggaacuagggucaccuggagagccg

SEQ ID NO: 67830 - RNA, 32 nt, Human
aucuuagggacugauauugguaauuaugguca

SEQ ID NO: 67831 - RNA, 32 nt, Human
aucuuagggucagaacugcugaaagagacaaa

SEQ ID NO: 67832 - RNA, 32 nt, Human
aucuuaguaugacuuuauuuccuuccagcucu

SEQ ID NO: 67833 - RNA, 32 nt, Human
aucuuagucaucaguccuugaccucagccuuc

SEQ ID NO: 67834 - RNA, 32 nt, Human
aucuuagucauucauguuucaccagaggacag

SEQ ID NO: 67835 - RNA, 32 nt, Human
aucuuagugucugagguugacuguggguaaau

SEQ ID NO: 67836 - RNA, 32 nt, Human
aucuuaguugcugggccaguucuucugaauca

SEQ ID NO: 67837 - RNA, 32 nt, Human
aucuuauaacaugcagaugaaugcuuuauaag

SEQ ID NO: 67838 - RNA, 32 nt, Human
aucuuauacucagauuaacuauuaguuaaagg

SEQ ID NO: 67839 - RNA, 32 nt, Human
aucuuaucugucagugcugugugacagcaucg

SEQ ID NO: 67840 - RNA, 32 nt, Human
aucuuaugauucacccaccucuaccucccgaa

SEQ ID NO: 67841 - RNA, 25 nt, Human
aucuuaugcacaccucccacccccu

SEQ ID NO: 67842 - RNA, 32 nt, Human
aucuuauggaggaggaugccgcuacgaggagu

SEQ ID NO: 67843 - RNA, 32 nt, Human
aucuuaugugaucacugucauuucugcagucc

SEQ ID NO: 67844 - RNA, 32 nt, Human
aucuuauuaacuccuucucucuuuuuaacaag

SEQ ID NO: 67845 - RNA, 32 nt, Human
aucuuauucuaaugaaauguagauuuuuauuu

SEQ ID NO: 67846 - RNA, 32 nt, Human
aucuuauugaauaccuccucugugcuacccau

SEQ ID NO: 67847 - RNA, 32 nt, Human
aucuuauugauagcauuuuuacaaauguguuu

SEQ ID NO: 67848 - RNA, 32 nt, Human
aucuuauuuucucaaucuccucucucuuuccu

SEQ ID NO: 67849 - RNA, 32 nt, Human
aucuucaaaaucaguagacauuucuggacaua

SEQ ID NO: 67850 - RNA, 32 nt, Human
aucuucaaguaccuagccugacugguagggcu

SEQ ID NO: 67851 - RNA, 32 nt, Human
aucuucacaaguguguaaagcacagauuucaa

SEQ ID NO: 67852 - RNA, 32 nt, Human
aucuucaccucucucugucagcauugcuucuu

SEQ ID NO: 67853 - RNA, 32 nt, Human
aucuucacucuugccagagccauucucaauaa

SEQ ID NO: 67854 - RNA, 32 nt, Human
aucuucacuucuaaaugcauauccugagccau

SEQ ID NO: 67855 - RNA, 32 nt, Human
aucuucagaagaaaaucucuucagcacuuucc

SEQ ID NO: 67856 - RNA, 32 nt, Human
aucuucagaaucccccaggcccucucuugauc

SEQ ID NO: 67857 - RNA, 32 nt, Human
aucuucagccaaacaucuagucuuccauagac

SEQ ID NO: 67858 - RNA, 32 nt, Human
aucuucagccuccuccugggccagcucuugug

SEQ ID NO: 67859 - RNA, 32 nt, Human
aucuucagccuccugcagaaccacggugucau

SEQ ID NO: 67860 - RNA, 32 nt, Human
aucuucaggaacuucugaccucaccaagucaa

SEQ ID NO: 67861 - RNA, 32 nt, Human
aucuucaggaaggaaaaggcauccuggagaca

SEQ ID NO: 67862 - RNA, 19 nt, Human
aucuucaggacuugugaaa

SEQ ID NO: 67863 - RNA, 32 nt, Human
aucuucagggaaaggcacugcccacgccaggc

SEQ ID NO: 67864 - RNA, 32 nt, Human
aucuucagggcgggaaaggggccacuucuggc

SEQ ID NO: 67865 - RNA, 32 nt, Human
aucuucagggugggaaaggggccacuucuggc

SEQ ID NO: 67866 - RNA, 32 nt, Human
aucuucaguugcuucaggccacuuugaaugua

SEQ ID NO: 67867 - RNA, 32 nt, Human
aucuucauaagcuuuuuagcagguauauguug

SEQ ID NO: 67868 - RNA, 21 nt, Human
aucuucauacaucaccacacc

SEQ ID NO: 67869 - RNA, 32 nt, Human
aucuucauuaguuacauucaugaaauugugau

SEQ ID NO: 67870 - RNA, 32 nt, Human
aucuucauucacugggauucuggaccauaaua

SEQ ID NO: 67871 - RNA, 32 nt, Human
aucuucauuuccuugcugaauuuuuaugcuuu

SEQ ID NO: 67872 - RNA, 32 nt, Human
aucuucauuuuuggcaccucacagaacaaauu

SEQ ID NO: 67873 - RNA, 32 nt, Human
aucuuccaagaccaaagaaggaaggaaggugg

SEQ ID NO: 67874 - RNA, 32 nt, Human
aucuuccaagcauacaugcacacugauacaua

SEQ ID NO: 67875 - RNA, 32 nt, Human
aucuuccacaugcuccaagccacaggucccca

SEQ ID NO: 67876 - RNA, 32 nt, Human
aucuuccaccagcaccuuacugcccaggccua

SEQ ID NO: 67877 - RNA, 32 nt, Human
aucuuccacucuccuauuauuuugccacuacu

SEQ ID NO: 67878 - RNA, 32 nt, Human
aucuuccagcuucugucagaacuuuaggucag

SEQ ID NO: 67879 - RNA, 32 nt, Human
aucuuccaggguggggaggagaaaaucccacc

SEQ ID NO: 67880 - RNA, 32 nt, Human
aucuuccagguggggugaggcaguggguccca

SEQ ID NO: 67881 - RNA, 32 nt, Human
aucuuccaggugucuaaaucuccagucugucu

SEQ ID NO: 67882 - RNA, 22 nt, Human
aucuuccaguccugggccccca

SEQ ID NO: 67883 - RNA, 32 nt, Human
aucuuccaguggccagcacacccuagacaccc

SEQ ID NO: 67884 - RNA, 32 nt, Human
aucuucccaaagcucauuuaugagccaccaga

SEQ ID NO: 67885 - RNA, 32 nt, Human
aucuucccacaguggcuucacagacccacaag

SEQ ID NO: 67886 - RNA, 21 nt, Human
aucuucccacccgggcugugc

SEQ ID NO: 67887 - RNA, 32 nt, Human
aucuucccacugcacuccagccuggccaauaa

SEQ ID NO: 67888 - RNA, 32 nt, Human
aucuucccagguagcugggauuacaggcaugu

SEQ ID NO: 67889 - RNA, 32 nt, Human
aucuucccaucuccuaaaacucagaaugcaca

SEQ ID NO: 67890 - RNA, 32 nt, Human
aucuucccauucuaggccuacaagcacuacuu

SEQ ID NO: 67891 - RNA, 32 nt, Human
aucuuccccaaaggggaaaggaagagagugau

SEQ ID NO: 67892 - RNA, 32 nt, Human
aucuuccccgccccaaacacuagaauagacug

SEQ ID NO: 67893 - RNA, 32 nt, Human
aucuuccccucaccuuccacccaugagaacag

SEQ ID NO: 67894 - RNA, 32 nt, Human
aucuucccgacagccaacagguuuccaggaga

SEQ ID NO: 67895 - RNA, 32 nt, Human
aucuucccugacuucuuugccugcuagcagcc

SEQ ID NO: 67896 - RNA, 32 nt, Human
aucuucccugccccugugccucuguccuagac

SEQ ID NO: 67897 - RNA, 32 nt, Human
aucuucccugcuuacucucugccuaccugccu

SEQ ID NO: 67898 - RNA, 32 nt, Human
aucuucccuggcguccucucccuccuggccag

SEQ ID NO: 67899 - RNA, 32 nt, Human
aucuucccugggaagucuuucuggccaagucu

SEQ ID NO: 67900 - RNA, 32 nt, Human
aucuucccugggaggaaggcuccaaauucuca

SEQ ID NO: 67901 - RNA, 32 nt, Human
aucuucccuuugccuuuucaggauuuaggccu

SEQ ID NO: 67902 - RNA, 32 nt, Human
aucuuccgcuaucacccuaaucuccgguuccc

SEQ ID NO: 67903 - RNA, 32 nt, Human
aucuuccggugacucuggaggaagaggugggc

SEQ ID NO: 67904 - RNA, 32 nt, Human
aucuuccuccaguggcugccaggauuucuggu

SEQ ID NO: 67905 - RNA, 18 nt, Human
aucuuccuccccaaggaa

SEQ ID NO: 67906 - RNA, 32 nt, Human
aucuuccucccuuccucccuuucuuaccacag

SEQ ID NO: 67907 - RNA, 32 nt, Human
aucuuccuccucccucaucccuuccaaccuuu

SEQ ID NO: 67908 - RNA, 32 nt, Human
aucuuccucuuaccucaccccuuucaaacaaa

SEQ ID NO: 67909 - RNA, 32 nt, Human
aucuuccugaccccuccuucucccucuccugg

SEQ ID NO: 67910 - RNA, 32 nt, Human
aucuuccugcaggcccuuccucugccugcugg

SEQ ID NO: 67911 - RNA, 32 nt, Human
aucuuccugccucaggcuucugaguagcuagg

SEQ ID NO: 67912 - RNA, 32 nt, Human
aucuuccuggccccucccuggacugcuuugga

SEQ ID NO: 67913 - RNA, 24 nt, Human
aucuuccuguccgggcugcugcga

SEQ ID NO: 67914 - RNA, 32 nt, Human
aucuuccuguucuaccuccucauucagacugu

SEQ ID NO: 67915 - RNA, 32 nt, Human
aucuuccuucagcccaccucaggauccgggcu

SEQ ID NO: 67916 - RNA, 32 nt, Human
aucuuccuugcuggauguggcagaauccacac

SEQ ID NO: 67917 - RNA, 32 nt, Human
aucuuccuugcugguuguguggaagugauggg

SEQ ID NO: 67918 - RNA, 32 nt, Human
aucuuccuuucuuuaaacauggagucuaaaua

SEQ ID NO: 67919 - RNA, 32 nt, Human
aucuuccuuugucuuauacauggcuuccauuu

SEQ ID NO: 67920 - RNA, 32 nt, Human
aucuucgauccucaccucagugccccagagau

SEQ ID NO: 67921 - RNA, 32 nt, Human
aucuucgcgucccucuccgcuuuccggccggc

SEQ ID NO: 67922 - RNA, 32 nt, Human
aucuucgcucacuucaaccucugccuucuggg

SEQ ID NO: 67923 - RNA, 32 nt, Human
aucuucguucuuucucacugaccgagacucag

SEQ ID NO: 67924 - RNA, 19 nt, Human
aucuucguuuucugugaaa

SEQ ID NO: 67925 - RNA, 32 nt, Human
aucuucuaacaaacuucagccugggaagugag

SEQ ID NO: 67926 - RNA, 32 nt, Human
aucuucuaugaaagccuaugugcaugugugug

SEQ ID NO: 67927 - RNA, 32 nt, Human
aucuucucagaaagagcugcacuguggcccca

SEQ ID NO: 67928 - RNA, 32 nt, Human
aucuucucagcccugagguuugaaucugacuu

SEQ ID NO: 67929 - RNA, 32 nt, Human
aucuucucaggcucacugagugcaaugucugc

SEQ ID NO: 67930 - RNA, 32 nt, Human
aucuucucauuuuucccuacaaaaacaccagg

SEQ ID NO: 67931 - RNA, 32 nt, Human
aucuucuccacacaccccaucacccagauaau

SEQ ID NO: 67932 - RNA, 32 nt, Human
aucuucuccagaaguccuagaaacaucucauc

SEQ ID NO: 67933 - RNA, 32 nt, Human
aucuucucgcaaaaggcgagugugugggguuc

SEQ ID NO: 67934 - RNA, 32 nt, Human
aucuucucuccucuucucccuuuuaucaggcc

SEQ ID NO: 67935 - RNA, 32 nt, Human
aucuucugacauacaacugaggucaugacaag

SEQ ID NO: 67936 - RNA, 32 nt, Human
aucuucugagagaaccugcuuccuuccaucag

SEQ ID NO: 67937 - RNA, 21 nt, Human
aucuucugaugggccccacaa

SEQ ID NO: 67938 - RNA, 32 nt, Human
aucuucugcaagaggcugccuccugguccacu

SEQ ID NO: 67939 - RNA, 32 nt, Human
aucuucugcaucaagccacaucauguuaaaca

SEQ ID NO: 67940 - RNA, 32 nt, Human
aucuucugcauuuauagguuugaauaaaggcu

SEQ ID NO: 67941 - RNA, 32 nt, Human
aucuucugccccagcuuugcaggaugaaaagc

SEQ ID NO: 67942 - RNA, 32 nt, Human
aucuucugccuccuggauaucuuggagaaaau

SEQ ID NO: 67943 - RNA, 32 nt, Human
aucuucuggagugacucaaaugcagaggaagc

SEQ ID NO: 67944 - RNA, 32 nt, Human
aucuucuggcuucccugcaucuugccuuuggg

SEQ ID NO: 67945 - RNA, 32 nt, Human
aucuucugggagaaggaaaccaaaggaucuaa

SEQ ID NO: 67946 - RNA, 32 nt, Human
aucuucuggguuaggccuugccuaggcauagc

SEQ ID NO: 67947 - RNA, 32 nt, Human
aucuucuggguugaaauaauucacaaauuggu

SEQ ID NO: 67948 - RNA, 23 nt, Human
aucuucuguauuccacaauagua

SEQ ID NO: 67949 - RNA, 32 nt, Human
aucuucuucucccuucccucgcccaagggagu

SEQ ID NO: 67950 - RNA, 32 nt, Human
aucuucuucuuccuccuccgucuccuuuccuc

SEQ ID NO: 67951 - RNA, 32 nt, Human
aucuucuugaccuuuggccacugccuucccag

SEQ ID NO: 67952 - RNA, 32 nt, Human
aucuucuugugagcccugggcuuaggagucac

SEQ ID NO: 67953 - RNA, 32 nt, Human
aucuucuuuauuauuccuagucuuuccaguca

SEQ ID NO: 67954 - RNA, 32 nt, Human
aucuucuuucugcuuuggguuguucucugccc

SEQ ID NO: 67955 - RNA, 32 nt, Human
aucuucuuuggaaauaaaagauaaaagagcga

SEQ ID NO: 67956 - RNA, 32 nt, Human
aucuucuuuugggcugaccaagccaggagggc

SEQ ID NO: 67957 - RNA, 32 nt, Human
aucuugaaaugaggagacaauccuggguuauc

SEQ ID NO: 67958 - RNA, 32 nt, Human
aucuugaaccauuguuuuauauuuuucaccuu

SEQ ID NO: 67959 - RNA, 32 nt, Human
aucuugaacuccugggcucaagcaaucugcca

SEQ ID NO: 67960 - RNA, 32 nt, Human
aucuugaagugaaaccaccacaauggccauuu

SEQ ID NO: 67961 - RNA, 32 nt, Human
aucuugaauaggggcugggugaaaugaggcug

SEQ ID NO: 67962 - RNA, 32 nt, Human
aucuugacaaagccucuucuguuuccaauggg

SEQ ID NO: 67963 - RNA, 32 nt, Human
aucuugacuauaauaaagcuucccuacugcaa

SEQ ID NO: 67964 - RNA, 32 nt, Human
aucuugacucacuacaaccuccgccucccagg

SEQ ID NO: 67965 - RNA, 32 nt, Human
aucuugacucacugcaacaucugccucccggg

SEQ ID NO: 67966 - RNA, 32 nt, Human
aucuugacucacugcaaccuccaccucccagg

SEQ ID NO: 67967 - RNA, 32 nt, Human
aucuugacucacugcaaccuccgccucacagc

SEQ ID NO: 67968 - RNA, 32 nt, Human
aucuugacucacugcaaccuccgccucccagg

SEQ ID NO: 67969 - RNA, 32 nt, Human
aucuugacucacugcaaccucugccucccagg

SEQ ID NO: 67970 - RNA, 32 nt, Human
aucuugacucacugcaaccucugccucucggg

SEQ ID NO: 67971 - RNA, 32 nt, Human
aucuugacucacugcaacuucugccacccagg

SEQ ID NO: 67972 - RNA, 32 nt, Human
aucuugacucacugcaaucuccaccucccaca

SEQ ID NO: 67973 - RNA, 32 nt, Human
aucuugacucacugcagccucaaccucccagg

SEQ ID NO: 67974 - RNA, 32 nt, Human
aucuugacucacugcauuuuccaccuugggag

SEQ ID NO: 67975 - RNA, 32 nt, Human
aucuugacucgcagcaaccuccgccuccuggg

SEQ ID NO: 67976 - RNA, 32 nt, Human
aucuugagaagagaaauuguaugauggcuaug

SEQ ID NO: 67977 - RNA, 32 nt, Human
aucuugagaagcaggcggguugggugggagga

SEQ ID NO: 67978 - RNA, 32 nt, Human
aucuugagauacccaggaagggaggcugucug

SEQ ID NO: 67979 - RNA, 32 nt, Human
aucuugagcaacauucaauuaauaggcaauuu

SEQ ID NO: 67980 - RNA, 32 nt, Human
aucuugagcugggggugugagggggagggccu

SEQ ID NO: 67981 - RNA, 32 nt, Human
aucuugaggaagaugcauaauaugaguaaagu

SEQ ID NO: 67982 - RNA, 32 nt, Human
aucuugaggagaagaauuuucggagugaagac

SEQ ID NO: 67983 - RNA, 32 nt, Human
aucuugaggcagcagagucugucugcagcuau

SEQ ID NO: 67984 - RNA, 32 nt, Human
aucuugagggaagagggugagugaagcccagg

SEQ ID NO: 67985 - RNA, 32 nt, Human
aucuugaggggugaugaacacaagcaaaccaa

SEQ ID NO: 67986 - RNA, 31 nt, Human
aucuugaggucguucuccacauuccuuccag

SEQ ID NO: 67987 - RNA, 32 nt, Human
aucuugagguguugugccauucucugggaaca

SEQ ID NO: 67988 - RNA, 32 nt, Human
aucuugaguuauaucucaccauccaucagagg

SEQ ID NO: 67989 - RNA, 32 nt, Human
aucuugaguuuccaagaccuagagagcuuggg

SEQ ID NO: 67990 - RNA, 32 nt, Human
aucuugaugagacagauuuccaggcaacaaaa

SEQ ID NO: 67991 - RNA, 32 nt, Human
aucuugaugcuuucuucuuucucuuuaaauuu

SEQ ID NO: 67992 - RNA, 32 nt, Human
aucuugcaaaacugucauuuauugugaauauc

SEQ ID NO: 67993 - RNA, 32 nt, Human
aucuugcacuguuuugaaugcaucugcuauuu

SEQ ID NO: 67994 - RNA, 23 nt, Human
aucuugcagugcugcaaccugga

SEQ ID NO: 67995 - RNA, 32 nt, Human
aucuugcauauguauaguucauuuuuccugug

SEQ ID NO: 67996 - RNA, 32 nt, Human
aucuugcaucuggcuggacucaaugagcugga

SEQ ID NO: 67997 - RNA, 32 nt, Human
aucuugccaauccaguugacuucugucuucuc

SEQ ID NO: 67998 - RNA, 32 nt, Human
aucuugccacugcacaccagccugggcaacac

SEQ ID NO: 67999 - RNA, 32 nt, Human
aucuugccacugcacuccagccugggcaacag

SEQ ID NO: 68000 - RNA, 32 nt, Human
aucuugccacugcucuacagccuggaagacag

SEQ ID NO: 68001 - RNA, 32 nt, Human
aucuugccacuguacuccagccugaagagcga

SEQ ID NO: 68002 - RNA, 32 nt, Human
aucuugccucacugcaacgccugccucucagg

SEQ ID NO: 68003 - RNA, 32 nt, Human
aucuugccuccucaaguagcuucaucacagag

SEQ ID NO: 68004 - RNA, 32 nt, Human
aucuugccugcccuauuccuccucccaagucu

SEQ ID NO: 68005 - RNA, 32 nt, Human
aucuugccuuaaauucucucuaccacacugcc

SEQ ID NO: 68006 - RNA, 32 nt, Human
aucuugccuucugguuucuuccagccacauug

SEQ ID NO: 68007 - RNA, 32 nt, Human
aucuugcuaggaggcauggaagugaucuaucc

SEQ ID NO: 68008 - RNA, 16 nt, Human
aucuugcugcugcuca

SEQ ID NO: 68009 - RNA, 31 nt, Human
aucuugcuuaauaaauaucugcuggauucuu

SEQ ID NO: 68010 - RNA, 32 nt, Human
aucuuggaagagaagagaagaggacaguacca

SEQ ID NO: 68011 - RNA, 32 nt, Human
aucuuggaaguauuugaccauuucuugagaua

SEQ ID NO: 68012 - RNA, 32 nt, Human
aucuuggacauuaaccccugaggcuccaccac

SEQ ID NO: 68013 - RNA, 32 nt, Human
aucuuggacccagggagagagcuguuacugcu

SEQ ID NO: 68014 - RNA, 32 nt, Human
aucuuggaccugaggcugcuuucuugaagaaa

SEQ ID NO: 68015 - RNA, 32 nt, Human
aucuuggagaaacugaaguuacccugggcggc

SEQ ID NO: 68016 - RNA, 32 nt, Human
aucuuggagaguuucuucuugugauuuuaguu

SEQ ID NO: 68017 - RNA, 32 nt, Human
aucuuggagaugguuucccugcucccggggca

SEQ ID NO: 68018 - RNA, 32 nt, Human
aucuuggauacaguguaaaccagauccauaua

SEQ ID NO: 68019 - RNA, 32 nt, Human
aucuuggauuggagguggggguuucagagugu

SEQ ID NO: 68020 - RNA, 32 nt, Human
aucuuggauuuuuguguguauguauguaugug

SEQ ID NO: 68021 - RNA, 32 nt, Human
aucuuggcaguacaggauuucuucagacgugg

SEQ ID NO: 68022 - RNA, 22 nt, Human
aucuuggccaaugugacccgaa

SEQ ID NO: 68023 - RNA, 32 nt, Human
aucuuggccacugcaagcuccaccucccaggu

SEQ ID NO: 68024 - RNA, 32 nt, Human
aucuuggccacuuuaauaguuucugauucacu

SEQ ID NO: 68025 - RNA, 32 nt, Human
aucuuggccaggcuggugugaucauggcucau

SEQ ID NO: 68026 - RNA, 32 nt, Human
aucuuggccauccuccucuagacaaaaccagc

SEQ ID NO: 68027 - RNA, 32 nt, Human
aucuuggccaugucacuggucauugugugaaa

SEQ ID NO: 68028 - RNA, 32 nt, Human
aucuuggcccacugcaaccucugccucccggg

SEQ ID NO: 68029 - RNA, 32 nt, Human
aucuuggcccacugcaaccucugcuuccuagg

SEQ ID NO: 68030 - RNA, 32 nt, Human
aucuuggcccccugcaaccuccgccucccggg

SEQ ID NO: 68031 - RNA, 32 nt, Human
aucuuggcgcaggccuuucugugggccucacc

SEQ ID NO: 68032 - RNA, 32 nt, Human
aucuuggcuaacugcaaccuccagcuccuggg

SEQ ID NO: 68033 - RNA, 32 nt, Human
aucuuggcuaacugcaaccuccgccucccagg

SEQ ID NO: 68034 - RNA, 32 nt, Human
aucuuggcuaacugcaacuuccaccuccuggg

SEQ ID NO: 68035 - RNA, 32 nt, Human
aucuuggcuacccuacaugcucccucuggcac

SEQ ID NO: 68036 - RNA, 32 nt, Human
aucuuggcuauugugaaaaaugaugcuauaaa

SEQ ID NO: 68037 - RNA, 32 nt, Human
aucuuggcucacagcaaccucuaccuccuggg

SEQ ID NO: 68038 - RNA, 32 nt, Human
aucuuggcucacagcagccucugccucccggg

SEQ ID NO: 68039 - RNA, 22 nt, Human
aucuuggcucaccacaaccucc

SEQ ID NO: 68040 - RNA, 32 nt, Human
aucuuggcucaccacaaccucuaccuccaggg

SEQ ID NO: 68041 - RNA, 32 nt, Human
aucuuggcucaccacaaccucugccucccggg

SEQ ID NO: 68042 - RNA, 32 nt, Human
aucuuggcucaccacaaccucugccuccuggg

SEQ ID NO: 68043 - RNA, 22 nt, Human
aucuuggcucaccgcaaccucc

SEQ ID NO: 68044 - RNA, 32 nt, Human
aucuuggcucaccgcaaccuccaccuccugag

SEQ ID NO: 68045 - RNA, 24 nt, Human
aucuuggcucaccgcaaccuccgc

SEQ ID NO: 68046 - RNA, 32 nt, Human
aucuuggcucaccgcaaccuccgccucccagg

SEQ ID NO: 68047 - RNA, 32 nt, Human
aucuuggcucaccgcaaccuccgccuccuagg

SEQ ID NO: 68048 - RNA, 32 nt, Human
aucuuggcucaccgcaaccucugccuaccggg

SEQ ID NO: 68049 - RNA, 32 nt, Human
aucuuggcucaccgcaaccucugccucccugg

SEQ ID NO: 68050 - RNA, 32 nt, Human
aucuuggcucaccgcaaccucugccuccuggg

SEQ ID NO: 68051 - RNA, 32 nt, Human
aucuuggcucacgacaaccucugccucucgga

SEQ ID NO: 68052 - RNA, 32 nt, Human
aucuuggcucacuacaaccucugccucccggg

SEQ ID NO: 68053 - RNA, 32 nt, Human
aucuuggcucacuacaaccucugccucgcagg

SEQ ID NO: 68054 - RNA, 32 nt, Human
aucuuggcucacugaaaccucugccucccggu

SEQ ID NO: 68055 - RNA, 23 nt, Human
aucuuggcucacugcaaacccgc

SEQ ID NO: 68056 - RNA, 32 nt, Human
aucuuggcucacugcaaacccgccucccaggu

SEQ ID NO: 68057 - RNA, 24 nt, Human
aucuuggcucacugcaaacuccgc

SEQ ID NO: 68058 - RNA, 32 nt, Human
aucuuggcucacugcaaacuccgccuuccagg

SEQ ID NO: 68059 - RNA, 32 nt, Human
aucuuggcucacugcaaacucugccuaccagg

SEQ ID NO: 68060 - RNA, 32 nt, Human
aucuuggcucacugcaaacucugccuuuuggg

SEQ ID NO: 68061 - RNA, 32 nt, Human
aucuuggcucacugcaacauccgccucccggg

SEQ ID NO: 68062 - RNA, 32 nt, Human
aucuuggcucacugcaacaucugacuccuggg

SEQ ID NO: 68063 - RNA, 32 nt, Human
aucuuggcucacugcaaccacugcuuccuggg

SEQ ID NO: 68064 - RNA, 32 nt, Human
aucuuggcucacugcaaccacugucucccggg

SEQ ID NO: 68065 - RNA, 32 nt, Human
aucuuggcucacugcaacccccaccucccggg

SEQ ID NO: 68066 - RNA, 24 nt, Human
aucuuggcucacugcaacccccgc

SEQ ID NO: 68067 - RNA, 32 nt, Human
aucuuggcucacugcaacccccgccuccaggg

SEQ ID NO: 68068 - RNA, 23 nt, Human
aucuuggcucacugcaaccccgc

SEQ ID NO: 68069 - RNA, 32 nt, Human
aucuuggcucacugcaaccccgccucccaggu

SEQ ID NO: 68070 - RNA, 32 nt, Human
aucuuggcucacugcaacccucccucccgggu

SEQ ID NO: 68071 - RNA, 32 nt, Human
aucuuggcucacugcaaccucaaccagcccag

SEQ ID NO: 68072 - RNA, 32 nt, Human
aucuuggcucacugcaaccucagccucccagg

SEQ ID NO: 68073 - RNA, 22 nt, Human
aucuuggcucacugcaaccucc

SEQ ID NO: 68074 - RNA, 32 nt, Human
aucuuggcucacugcaaccuccacccgccggg

SEQ ID NO: 68075 - RNA, 32 nt, Human
aucuuggcucacugcaaccuccaccuccaggu

SEQ ID NO: 68076 - RNA, 32 nt, Human
aucuuggcucacugcaaccuccaccucccagg

SEQ ID NO: 68077 - RNA, 32 nt, Human
aucuuggcucacugcaaccuccaccucccagu

SEQ ID NO: 68078 - RNA, 32 nt, Human
aucuuggcucacugcaaccuccaccucccggg

SEQ ID NO: 68079 - RNA, 32 nt, Human
aucuuggcucacugcaaccuccaccuccuggg

SEQ ID NO: 68080 - RNA, 32 nt, Human
aucuuggcucacugcaaccuccaccucuggga

SEQ ID NO: 68081 - RNA, 32 nt, Human
aucuuggcucacugcaaccuccaccuuccugg

SEQ ID NO: 68082 - RNA, 32 nt, Human
aucuuggcucacugcaaccuccacuucccagg

SEQ ID NO: 68083 - RNA, 32 nt, Human
aucuuggcucacugcaaccuccacuucccggg

SEQ ID NO: 68084 - RNA, 32 nt, Human
aucuuggcucacugcaaccuccacuuccuggg

SEQ ID NO: 68085 - RNA, 32 nt, Human
aucuuggcucacugcaaccuccacuucucagg

SEQ ID NO: 68086 - RNA, 32 nt, Human
aucuuggcucacugcaaccuccgacucccagg

SEQ ID NO: 68087 - RNA, 32 nt, Human
aucuuggcucacugcaaccuccgacucccugg

SEQ ID NO: 68088 - RNA, 24 nt, Human
aucuuggcucacugcaaccuccgc

SEQ ID NO: 68089 - RNA, 32 nt, Human
aucuuggcucacugcaaccuccgccuccaggg

SEQ ID NO: 68090 - RNA, 32 nt, Human
aucuuggcucacugcaaccuccgccucccagg

SEQ ID NO: 68091 - RNA, 32 nt, Human
aucuuggcucacugcaaccuccgccucccgag

SEQ ID NO: 68092 - RNA, 32 nt, Human
aucuuggcucacugcaaccuccgccucccggg

SEQ ID NO: 68093 - RNA, 32 nt, Human
aucuuggcucacugcaaccuccgccuccuggg

SEQ ID NO: 68094 - RNA, 32 nt, Human
aucuuggcucacugcaaccuccgccucucagg

SEQ ID NO: 68095 - RNA, 32 nt, Human
aucuuggcucacugcaaccuccgccucucggg

SEQ ID NO: 68096 - RNA, 32 nt, Human
aucuuggcucacugcaaccuccgccucuuggg

SEQ ID NO: 68097 - RNA, 32 nt, Human
aucuuggcucacugcaaccuccgccuuccugg

SEQ ID NO: 68098 - RNA, 32 nt, Human
aucuuggcucacugcaaccuccgucucccagg

SEQ ID NO: 68099 - RNA, 32 nt, Human
aucuuggcucacugcaaccuccgucuccuggg

SEQ ID NO: 68100 - RNA, 32 nt, Human
aucuuggcucacugcaaccuccgucuuccggg

SEQ ID NO: 68101 - RNA, 32 nt, Human
aucuuggcucacugcaaccuccuccucccggg

SEQ ID NO: 68102 - RNA, 32 nt, Human
aucuuggcucacugcaaccuccugcuuccugg

SEQ ID NO: 68103 - RNA, 32 nt, Human
aucuuggcucacugcaaccucuaccuccuggg

SEQ ID NO: 68104 - RNA, 32 nt, Human
aucuuggcucacugcaaccucugccaccuggg

SEQ ID NO: 68105 - RNA, 32 nt, Human
aucuuggcucacugcaaccucugccccaccaa

SEQ ID NO: 68106 - RNA, 32 nt, Human
aucuuggcucacugcaaccucugccuaccgga

SEQ ID NO: 68107 - RNA, 32 nt, Human
aucuuggcucacugcaaccucugccucacagg

SEQ ID NO: 68108 - RNA, 32 nt, Human
aucuuggcucacugcaaccucugccucccagg

SEQ ID NO: 68109 - RNA, 32 nt, Human
aucuuggcucacugcaaccucugccucccggg

SEQ ID NO: 68110 - RNA, 30 nt, Human
aucuuggcucacugcaaccucugccuccug

SEQ ID NO: 68111 - RNA, 32 nt, Human
aucuuggcucacugcaaccucugccuccugaa

SEQ ID NO: 68112 - RNA, 32 nt, Human
aucuuggcucacugcaaccucugccuccuggg

SEQ ID NO: 68113 - RNA, 32 nt, Human
aucuuggcucacugcaaccucugccuccuucg

SEQ ID NO: 68114 - RNA, 32 nt, Human
aucuuggcucacugcaaccucugccugccggg

SEQ ID NO: 68115 - RNA, 32 nt, Human
aucuuggcucacugcaaccucugccuucuggg

SEQ ID NO: 68116 - RNA, 32 nt, Human
aucuuggcucacugcaaccucugcgggcucac

SEQ ID NO: 68117 - RNA, 32 nt, Human
aucuuggcucacugcaaccucugcuucccagg

SEQ ID NO: 68118 - RNA, 32 nt, Human
aucuuggcucacugcaaccucugcuucccgag

SEQ ID NO: 68119 - RNA, 32 nt, Human
aucuuggcucacugcaaccucugcuucccggg

SEQ ID NO: 68120 - RNA, 32 nt, Human
aucuuggcucacugcaaccucugucucccagg

SEQ ID NO: 68121 - RNA, 32 nt, Human
aucuuggcucacugcaaccucugucuccuggg

SEQ ID NO: 68122 - RNA, 32 nt, Human
aucuuggcucacugcaaccucugucuuccagg

SEQ ID NO: 68123 - RNA, 32 nt, Human
aucuuggcucacugcaaccucuguguccuggg

SEQ ID NO: 68124 - RNA, 32 nt, Human
aucuuggcucacugcaaccucuuccuccuggu

SEQ ID NO: 68125 - RNA, 32 nt, Human
aucuuggcucacugcaaccugcgccuccuggg

SEQ ID NO: 68126 - RNA, 32 nt, Human
aucuuggcucacugcaacguccgccucccagg

SEQ ID NO: 68127 - RNA, 32 nt, Human
aucuuggcucacugcaacgucugccuccuggg

SEQ ID NO: 68128 - RNA, 32 nt, Human
aucuuggcucacugcaacucugcuucccaggu

SEQ ID NO: 68129 - RNA, 32 nt, Human
aucuuggcucacugcaacuuccaccucuggga

SEQ ID NO: 68130 - RNA, 32 nt, Human
aucuuggcucacugcaacuuccacuucccggg

SEQ ID NO: 68131 - RNA, 32 nt, Human
aucuuggcucacugcaacuuccgccuccugug

SEQ ID NO: 68132 - RNA, 32 nt, Human
aucuuggcucacugcaacuuccgucucccggg

SEQ ID NO: 68133 - RNA, 32 nt, Human
aucuuggcucacugcaacuucuaccuccgagg

SEQ ID NO: 68134 - RNA, 32 nt, Human
aucuuggcucacugcaacuucugccaccuggg

SEQ ID NO: 68135 - RNA, 32 nt, Human
aucuuggcucacugcaacuucugccuuccagg

SEQ ID NO: 68136 - RNA, 32 nt, Human
aucuuggcucacugcaacuugggccucccagg

SEQ ID NO: 68137 - RNA, 22 nt, Human
aucuuggcucacugcaagcucc

SEQ ID NO: 68138 - RNA, 32 nt, Human
aucuuggcucacugcaagcuccaccuccuggg

SEQ ID NO: 68139 - RNA, 24 nt, Human
aucuuggcucacugcaagcuccgc

SEQ ID NO: 68140 - RNA, 32 nt, Human
aucuuggcucacugcaagcuccgccucccagg

SEQ ID NO: 68141 - RNA, 32 nt, Human
aucuuggcucacugcaagcuccgccucccgag

SEQ ID NO: 68142 - RNA, 32 nt, Human
aucuuggcucacugcaagcuccgccucccggc

SEQ ID NO: 68143 - RNA, 32 nt, Human
aucuuggcucacugcaagcuccgccucccggg

SEQ ID NO: 68144 - RNA, 32 nt, Human
aucuuggcucacugcaagcuccgccuccuggg

SEQ ID NO: 68145 - RNA, 32 nt, Human
aucuuggcucacugcaagcuccgccucucggg

SEQ ID NO: 68146 - RNA, 24 nt, Human
aucuuggcucacugcaagcucugc

SEQ ID NO: 68147 - RNA, 32 nt, Human
aucuuggcucacugcaagcucugcccuccccg

SEQ ID NO: 68148 - RNA, 32 nt, Human
aucuuggcucacugcaagcuuccccuuccggg

SEQ ID NO: 68149 - RNA, 32 nt, Human
aucuuggcucacugcaaucucuauccccuggg

SEQ ID NO: 68150 - RNA, 32 nt, Human
aucuuggcucacugcaaucucugccucucggg

SEQ ID NO: 68151 - RNA, 32 nt, Human
aucuuggcucacugcaaucucugccuuccggg

SEQ ID NO: 68152 - RNA, 32 nt, Human
aucuuggcucacugcacccucugucuguuggg

SEQ ID NO: 68153 - RNA, 32 nt, Human
aucuuggcucacugcaccuccaccuuccgggc

SEQ ID NO: 68154 - RNA, 32 nt, Human
aucuuggcucacugcaccucugucucccaagu

SEQ ID NO: 68155 - RNA, 32 nt, Human
aucuuggcucacugcagacuucaccuccugag

SEQ ID NO: 68156 - RNA, 32 nt, Human
aucuuggcucacugcagccucaaccuguuggg

SEQ ID NO: 68157 - RNA, 32 nt, Human
aucuuggcucacugcagccucaacuuccagcg

SEQ ID NO: 68158 - RNA, 32 nt, Human
aucuuggcucacugcagccuccaccuccccgg

SEQ ID NO: 68159 - RNA, 32 nt, Human
aucuuggcucacugcagccuccaccucccggg

SEQ ID NO: 68160 - RNA, 32 nt, Human
aucuuggcucacugcagccuccgccucccggg

SEQ ID NO: 68161 - RNA, 32 nt, Human
aucuuggcucacugcagccucgacuuccuggg

SEQ ID NO: 68162 - RNA, 32 nt, Human
aucuuggcucacugcagccucugccucccagg

SEQ ID NO: 68163 - RNA, 32 nt, Human
aucuuggcucacugcagccucugccucccggg

SEQ ID NO: 68164 - RNA, 32 nt, Human
aucuuggcucacugcagccucugccuccuggg

SEQ ID NO: 68165 - RNA, 32 nt, Human
aucuuggcucacugcagccuucgccucccggg

SEQ ID NO: 68166 - RNA, 32 nt, Human
aucuuggcucacugcaggcucugccucccggu

SEQ ID NO: 68167 - RNA, 32 nt, Human
aucuuggcucacugcauccuccgccuuccagg

SEQ ID NO: 68168 - RNA, 32 nt, Human
aucuuggcucacugcaugcucugccacuuggg

SEQ ID NO: 68169 - RNA, 32 nt, Human
aucuuggcucacugcggccucugccucccggc

SEQ ID NO: 68170 - RNA, 32 nt, Human
aucuuggcucacugcuaccucuaccaugagca

SEQ ID NO: 68171 - RNA, 32 nt, Human
aucuuggcucacugcugcaaccucccccuccu

SEQ ID NO: 68172 - RNA, 32 nt, Human
aucuuggcucacuguaaccuccaccucccagg

SEQ ID NO: 68173 - RNA, 32 nt, Human
aucuuggcucacuguaaccuccgccucccagg

SEQ ID NO: 68174 - RNA, 32 nt, Human
aucuuggcucacuguaaccuccgccucccggg

SEQ ID NO: 68175 - RNA, 32 nt, Human
aucuuggcucacuguaaccucugccuccagga

SEQ ID NO: 68176 - RNA, 32 nt, Human
aucuuggcucacuguaaccucugccucccagu

SEQ ID NO: 68177 - RNA, 32 nt, Human
aucuuggcucacuguaacuuccacuugccagg

SEQ ID NO: 68178 - RNA, 32 nt, Human
aucuuggcucacuguagccuugacauccuggg

SEQ ID NO: 68179 - RNA, 32 nt, Human
aucuuggcucagugcaaccuccgccuccuggg

SEQ ID NO: 68180 - RNA, 32 nt, Human
aucuuggcucauugcaaccuccgccucccucc

SEQ ID NO: 68181 - RNA, 32 nt, Human
aucuuggcucauugcaaccucugccucccagg

SEQ ID NO: 68182 - RNA, 32 nt, Human
aucuuggcucccugcaaccucugcuuccuggg

SEQ ID NO: 68183 - RNA, 32 nt, Human
aucuuggcuccucuccccuuguuccugauuuu

SEQ ID NO: 68184 - RNA, 32 nt, Human
aucuuggcuccugcuccugccgucuagacaaa

SEQ ID NO: 68185 - RNA, 32 nt, Human
aucuuggcucgcugcaaccucagcuuccagag

SEQ ID NO: 68186 - RNA, 32 nt, Human
aucuuggcucgcugcaaccuccgccucccagg

SEQ ID NO: 68187 - RNA, 31 nt, Human
aucuuggcucgcugcaaccucugccuccugg

SEQ ID NO: 68188 - RNA, 32 nt, Human
aucuuggcucgcugcaaccuucacccuucacc

SEQ ID NO: 68189 - RNA, 32 nt, Human
aucuuggcucucugcaaccucugccucccagg

SEQ ID NO: 68190 - RNA, 32 nt, Human
aucuuggcucuuugcaaccucugccuccuggg

SEQ ID NO: 68191 - RNA, 32 nt, Human
aucuuggcugacugcaacuucugccuccuggg

SEQ ID NO: 68192 - RNA, 32 nt, Human
aucuuggcuuacugcaaccuccaccucccagg

SEQ ID NO: 68193 - RNA, 32 nt, Human
aucuuggcuuacugcaaccuccaccuccuggg

SEQ ID NO: 68194 - RNA, 32 nt, Human
aucuuggcuuacugcaaccuccgccuccuggg

SEQ ID NO: 68195 - RNA, 32 nt, Human
aucuuggcuuacugcaaccucugccucccagg

SEQ ID NO: 68196 - RNA, 32 nt, Human
aucuuggcuuacugcaacuuccgacucccagg

SEQ ID NO: 68197 - RNA, 24 nt, Human
aucuuggcuuacugcaagcuccgc

SEQ ID NO: 68198 - RNA, 32 nt, Human
aucuuggcuuacugcaagcucugccuccuggg

SEQ ID NO: 68199 - RNA, 32 nt, Human
aucuuggcuuucugcaaccucugccucccagg

SEQ ID NO: 68200 - RNA, 32 nt, Human
aucuuggcuuuuaguaaucauguuggcugguc

SEQ ID NO: 68201 - RNA, 32 nt, Human
aucuugggcuuucagcccccaaaggugugaga

SEQ ID NO: 68202 - RNA, 32 nt, Human
aucuuggggaaagugaaaaauguaaucugcaa

SEQ ID NO: 68203 - RNA, 32 nt, Human
aucuuggggagguggccgggugcaguggcucg

SEQ ID NO: 68204 - RNA, 32 nt, Human
aucuuggggcaggccagcucugauguggauga

SEQ ID NO: 68205 - RNA, 24 nt, Human
aucuugggucacugcaaacuccgc

SEQ ID NO: 68206 - RNA, 32 nt, Human
aucuugggucacugcaaacuccgccucccagg

SEQ ID NO: 68207 - RNA, 32 nt, Human
aucuugggucacugcaaccucugccuccuggg

SEQ ID NO: 68208 - RNA, 32 nt, Human
aucuugggucacugcagccuccaacuccuugg

SEQ ID NO: 68209 - RNA, 32 nt, Human
aucuugggugacuucucaucacucuggaccuc

SEQ ID NO: 68210 - RNA, 31 nt, Human
aucuugggugagagagagggaccugcaggau

SEQ ID NO: 68211 - RNA, 32 nt, Human
aucuugggugagagagagggaccugcaggaug

SEQ ID NO: 68212 - RNA, 32 nt, Human
aucuugguaacgagccaagaucaugcaaccag

SEQ ID NO: 68213 - RNA, 32 nt, Human
aucuugguaauuuaaauguggcugauucaucu

SEQ ID NO: 68214 - RNA, 32 nt, Human
aucuugguagugccugccuuugaaacagggug

SEQ ID NO: 68215 - RNA, 32 nt, Human
aucuugguauacuggcugggcacaguggcuca

SEQ ID NO: 68216 - RNA, 32 nt, Human
aucuugguggccccuccaggcccagccucugc

SEQ ID NO: 68217 - RNA, 32 nt, Human
aucuugguuacaaaugagacuccuucagucag

SEQ ID NO: 68218 - RNA, 22 nt, Human
aucuugguucacugcaaccucc

SEQ ID NO: 68219 - RNA, 32 nt, Human
aucuugguucacugcaaccuccaccuccaggg

SEQ ID NO: 68220 - RNA, 32 nt, Human
aucuugguucacugcaaccuccaccucccagg

SEQ ID NO: 68221 - RNA, 32 nt, Human
aucuugguucacugcaaccuccaccucuuggg

SEQ ID NO: 68222 - RNA, 24 nt, Human
aucuugguucacugcaaccuccgc

SEQ ID NO: 68223 - RNA, 32 nt, Human
aucuugguucacugcaaccuccgcauccgggg

SEQ ID NO: 68224 - RNA, 32 nt, Human
aucuugguucacugcaaccuccgccuccugga

SEQ ID NO: 68225 - RNA, 32 nt, Human
aucuugguucacugcaaccucugccucccagg

SEQ ID NO: 68226 - RNA, 32 nt, Human
aucuugguucacugcaaccucugccucccggg

SEQ ID NO: 68227 - RNA, 22 nt, Human
aucuugguucacugcaagcucc

SEQ ID NO: 68228 - RNA, 32 nt, Human
aucuugguucacugcaagcuccaccucccggg

SEQ ID NO: 68229 - RNA, 32 nt, Human
aucuugguuuacugcaaccuccaccuccuagg

SEQ ID NO: 68230 - RNA, 32 nt, Human
aucuuguaaagucuguuuuccuuucccaagga

SEQ ID NO: 68231 - RNA, 32 nt, Human
aucuuguacauacacaaauuuuccucagguuu

SEQ ID NO: 68232 - RNA, 32 nt, Human
aucuuguagcugggguauaauugggaaauguu

SEQ ID NO: 68233 - RNA, 32 nt, Human
aucuuguauauacuuggaacauccuuucaaga

SEQ ID NO: 68234 - RNA, 32 nt, Human
aucuuguauuggagauugaaagaugcuguaau

SEQ ID NO: 68235 - RNA, 32 nt, Human
aucuuguccucaacccucucccuagaucaguc

SEQ ID NO: 68236 - RNA, 32 nt, Human
aucuugucucacugcaaccucugccucccggg

SEQ ID NO: 68237 - RNA, 32 nt, Human
aucuugucucucaggcuggguugcaauggcac

SEQ ID NO: 68238 - RNA, 19 nt, Human
aucuugucugagacugcau

SEQ ID NO: 68239 - RNA, 32 nt, Human
aucuugugacagggacaggcugaggggcaaau

SEQ ID NO: 68240 - RNA, 32 nt, Human
aucuugugaggguguguuuuucccagugugaa

SEQ ID NO: 68241 - RNA, 32 nt, Human
aucuugugccgucuaggcccagccaggcuuuu

SEQ ID NO: 68242 - RNA, 32 nt, Human
aucuugugccucucccccuuugcuaggaguug

SEQ ID NO: 68243 - RNA, 32 nt, Human
aucuugugccuggaaauagccugagguggcuc

SEQ ID NO: 68244 - RNA, 32 nt, Human
aucuugugcugcuuuucucacugacguguugc

SEQ ID NO: 68245 - RNA, 32 nt, Human
aucuugugggaccaguccugcccacauggggc

SEQ ID NO: 68246 - RNA, 32 nt, Human
aucuugugguuauucuggguuguggaaggaaa

SEQ ID NO: 68247 - RNA, 29 nt, Human
aucuugugucuguugugccugaauuuggc

SEQ ID NO: 68248 - RNA, 32 nt, Human
aucuuguguucuguuaugaaauagcacaacca

SEQ ID NO: 68249 - RNA, 32 nt, Human
aucuuguguugugccuguaugaauuuuuaaaa

SEQ ID NO: 68250 - RNA, 31 nt, Human
aucuuguuagagagcuuuucacugugaggaa

SEQ ID NO: 68251 - RNA, 32 nt, Human
aucuuguuagagagcuuuucacugugaggaag

SEQ ID NO: 68252 - RNA, 32 nt, Human
aucuuguugcugcaaugagaaauaaaugaaug

SEQ ID NO: 68253 - RNA, 32 nt, Human
aucuuguuucucccccugccagucucuucuga

SEQ ID NO: 68254 - RNA, 32 nt, Human
aucuuuaaaagugccuuaggggaacccugucc

SEQ ID NO: 68255 - RNA, 32 nt, Human
aucuuuaacagaaacaucauacugcauuaaaa

SEQ ID NO: 68256 - RNA, 32 nt, Human
aucuuuaauacaauauagaaauuguguaauag

SEQ ID NO: 68257 - RNA, 32 nt, Human
aucuuuaauaugugggacuaacagcaguguag

SEQ ID NO: 68258 - RNA, 32 nt, Human
aucuuuaauauuuuaucuuuacagauuucccu

SEQ ID NO: 68259 - RNA, 32 nt, Human
aucuuuaccuaaauugcucaggcauuauucca

SEQ ID NO: 68260 - RNA, 32 nt, Human
aucuuuacugcagcucugccggccuggagggg

SEQ ID NO: 68261 - RNA, 32 nt, Human
aucuuuagcaguuuccucagugauggaauauc

SEQ ID NO: 68262 - RNA, 32 nt, Human
aucuuuagcugcacagucuacuacucaucaac

SEQ ID NO: 68263 - RNA, 32 nt, Human
aucuuuaggguuuagaaucuaaccucaagaau

SEQ ID NO: 68264 - RNA, 32 nt, Human
aucuuuaguaaggacaaaaggaagcacugugg

SEQ ID NO: 68265 - RNA, 32 nt, Human
aucuuuagucuguguucuuucuaguuauuugg

SEQ ID NO: 68266 - RNA, 32 nt, Human
aucuuuagugcagaggauggaaaguugaugcc

SEQ ID NO: 68267 - RNA, 32 nt, Human
aucuuuaguugacucuacagucaugaaacaua

SEQ ID NO: 68268 - RNA, 32 nt, Human
aucuuuauccagagguaaucauagcugccugg

SEQ ID NO: 68269 - RNA, 32 nt, Human
aucuuuauuagcaacuauuuuuccaacuauuu

SEQ ID NO: 68270 - RNA, 32 nt, Human
aucuuuauuuagcauaucaauguggccauugu

SEQ ID NO: 68271 - RNA, 31 nt, Human
aucuuucacagcuagaaauugaaagggccuu

SEQ ID NO: 68272 - RNA, 32 nt, Human
aucuuucaccaagauggguggcaccaaccuug

SEQ ID NO: 68273 - RNA, 32 nt, Human
aucuuucacugauuucugaaucauguucuagu

SEQ ID NO: 68274 - RNA, 32 nt, Human
aucuuucagccuggagacugugcagaaacaug

SEQ ID NO: 68275 - RNA, 32 nt, Human
aucuuucagccuucugucaucaguaaaauuua

SEQ ID NO: 68276 - RNA, 32 nt, Human
aucuuucaggaaauuuuugcauguuuaauaau

SEQ ID NO: 68277 - RNA, 32 nt, Human
aucuuucauuucagucaaaucacugcagucau

SEQ ID NO: 68278 - RNA, 32 nt, Human
aucuuucccaucaacucugugugaaggcaggu

SEQ ID NO: 68279 - RNA, 32 nt, Human
aucuuucccguggagcaacuuccugcuccacg

SEQ ID NO: 68280 - RNA, 32 nt, Human
aucuuucccuuuccuuacuagaccucucuuua

SEQ ID NO: 68281 - RNA, 32 nt, Human
aucuuuccucauguucccuugaguauuucaau

SEQ ID NO: 68282 - RNA, 32 nt, Human
aucuuuccucauucacucuucacguggaccgu

SEQ ID NO: 68283 - RNA, 32 nt, Human
aucuuuccucauugacugacucugugccacgu

SEQ ID NO: 68284 - RNA, 32 nt, Human
aucuuucuacagcuacggggcuccgggcuacu

SEQ ID NO: 68285 - RNA, 23 nt, Human
aucuuucuaugugcuuacugcug

SEQ ID NO: 68286 - RNA, 32 nt, Human
aucuuucucagaggaggaggaauagacuuaaa

SEQ ID NO: 68287 - RNA, 32 nt, Human
aucuuucucauaauuaucuccuucuagguuga

SEQ ID NO: 68288 - RNA, 32 nt, Human
aucuuucucccauccuuccccaaagagaucuc

SEQ ID NO: 68289 - RNA, 32 nt, Human
aucuuucuccccgcuuccccagucuuuaaaca

SEQ ID NO: 68290 - RNA, 32 nt, Human
aucuuucugcuucugggcuuucugaaaagcuu

SEQ ID NO: 68291 - RNA, 32 nt, Human
aucuuucuguugguaguggcuuuucaucagcu

SEQ ID NO: 68292 - RNA, 32 nt, Human
aucuuucuguuucuauuuuuaugccaaugaag

SEQ ID NO: 68293 - RNA, 32 nt, Human
aucuuucuuagagaugaaaguagcccgcuuua

SEQ ID NO: 68294 - RNA, 32 nt, Human
aucuuucuucuguuucuuccuccccgcuguca

SEQ ID NO: 68295 - RNA, 32 nt, Human
aucuuucuuuccccaucuuucuauuuucugca

SEQ ID NO: 68296 - RNA, 32 nt, Human
aucuuugaaaaagcauauuuugucaucaaguu

SEQ ID NO: 68297 - RNA, 32 nt, Human
aucuuugaaaccaaguucuugucucagauuga

SEQ ID NO: 68298 - RNA, 32 nt, Human
aucuuugaaagaaucaggaggucaagucaaga

SEQ ID NO: 68299 - RNA, 32 nt, Human
aucuuugacuugggagguggaauaagaauucg

SEQ ID NO: 68300 - RNA, 32 nt, Human
aucuuugcagugaauuaugcuuugcuuuaaaa

SEQ ID NO: 68301 - RNA, 32 nt, Human
aucuuugccacccucaugcugugugacucaaa

SEQ ID NO: 68302 - RNA, 32 nt, Human
aucuuugccuccagauuucaagaggagaaauu

SEQ ID NO: 68303 - RNA, 32 nt, Human
aucuuugccuucauuucaccuuccucuucguu

SEQ ID NO: 68304 - RNA, 32 nt, Human
aucuuugccuugaaaugaauggaaaaguauuu

SEQ ID NO: 68305 - RNA, 32 nt, Human
aucuuugccuuuggagagacugccccgagcac

SEQ ID NO: 68306 - RNA, 32 nt, Human
aucuuugcucacugcaacauccaccucauggg

SEQ ID NO: 68307 - RNA, 32 nt, Human
aucuuugcucacugcaaccucugccacccggg

SEQ ID NO: 68308 - RNA, 32 nt, Human
aucuuugcucauguguuauaagccccaaguug

SEQ ID NO: 68309 - RNA, 32 nt, Human
aucuuugcuuugcugaccucucaggccucuuc

SEQ ID NO: 68310 - RNA, 22 nt, Human
aucuuuggaacaucagcaccag

SEQ ID NO: 68311 - RNA, 32 nt, Human
aucuuuggagaaggagaaagaaaggaaagaac

SEQ ID NO: 68312 - RNA, 31 nt, Human
aucuuuggagacuucuuccagaugcuaguaa

SEQ ID NO: 68313 - RNA, 32 nt, Human
aucuuuggagagaaggagguggggauccgagu

SEQ ID NO: 68314 - RNA, 32 nt, Human
aucuuuggauugauguucacagcuuuauacuu

SEQ ID NO: 68315 - RNA, 32 nt, Human
aucuuuggcagcucuuuucuucugcucagacc

SEQ ID NO: 68316 - RNA, 32 nt, Human
aucuuuggcaggaacccagggcuguucuguca

SEQ ID NO: 68317 - RNA, 32 nt, Human
aucuuuggcaggaaggcgaggcuuccgcccgg

SEQ ID NO: 68318 - RNA, 32 nt, Human
aucuuuggccgacagugguguaacugugugug

SEQ ID NO: 68319 - RNA, 32 nt, Human
aucuuuggccucugucuccacucucacuucuu

SEQ ID NO: 68320 - RNA, 32 nt, Human
aucuuuggcucuuuugaugcacaauauccauc

SEQ ID NO: 68321 - RNA, 32 nt, Human
aucuuugggggaggggaggggcaggaagaggu

SEQ ID NO: 68322 - RNA, 32 nt, Human
aucuuuggggguugguuugaggucuuagaacu

SEQ ID NO: 68323 - RNA, 32 nt, Human
aucuuuggguagaagcuggacaguacuguugc

SEQ ID NO: 68324 - RNA, 32 nt, Human
aucuuugggucagugagcuccuggagaagaga

SEQ ID NO: 68325 - RNA, 32 nt, Human
aucuuugggugguggagugcaaaggaggcgac

SEQ ID NO: 68326 - RNA, 31 nt, Human
aucuuugguaaaggaacuagagaugcaugca

SEQ ID NO: 68327 - RNA, 32 nt, Human
aucuuuggugacgggucacaggcauugguagu

SEQ ID NO: 68328 - RNA, 32 nt, Human
aucuuugguuuucccaaccaucuggaaaucuc

SEQ ID NO: 68329 - RNA, 31 nt, Human
aucuuuguauacuucugacaauugccagauc

SEQ ID NO: 68330 - RNA, 32 nt, Human
aucuuuguaucuuucauguuugccugcaguug

SEQ ID NO: 68331 - RNA, 32 nt, Human
aucuuuguccauaacuugcucugugauccagu

SEQ ID NO: 68332 - RNA, 32 nt, Human
aucuuugucuucccucggaucagcuuuaaaga

SEQ ID NO: 68333 - RNA, 32 nt, Human
aucuuugucuuugcuucuggccuguguaagca

SEQ ID NO: 68334 - RNA, 32 nt, Human
aucuuugugcagaugaccaaagcaauugacuu

SEQ ID NO: 68335 - RNA, 32 nt, Human
aucuuuguguccugacagccgugaccgugacc

SEQ ID NO: 68336 - RNA, 32 nt, Human
aucuuuguucugagucacugcaguccccaaag

SEQ ID NO: 68337 - RNA, 32 nt, Human
aucuuuguuggcgaucugagugcaguguggca

SEQ ID NO: 68338 - RNA, 32 nt, Human
aucuuuguuucaguugucugucaggguuuaau

SEQ ID NO: 68339 - RNA, 32 nt, Human
aucuuuuaauuccuauuuucugcuucauuggu

SEQ ID NO: 68340 - RNA, 32 nt, Human
aucuuuuaggccagccagcugaaggagacacu

SEQ ID NO: 68341 - RNA, 32 nt, Human
aucuuuuauacccacugacucugagcagccug

SEQ ID NO: 68342 - RNA, 32 nt, Human
aucuuuuaugacugcaacuugccuuuuccauu

SEQ ID NO: 68343 - RNA, 32 nt, Human
aucuuuuauguuuuuaaaugcauucauuuuac

SEQ ID NO: 68344 - RNA, 32 nt, Human
aucuuuuauuuuuauagcucagguauuguaau

SEQ ID NO: 68345 - RNA, 32 nt, Human
aucuuuucaagcauguucuaccaccuuggaag

SEQ ID NO: 68346 - RNA, 32 nt, Human
aucuuuucaccauggaugaaacuauaacuuaa

SEQ ID NO: 68347 - RNA, 32 nt, Human
aucuuuucagaagaaaauaaaagcauuuaauu

SEQ ID NO: 68348 - RNA, 32 nt, Human
aucuuuucagauuccauuucuuuuuacauaaa

SEQ ID NO: 68349 - RNA, 32 nt, Human
aucuuuucagcccugugguccaguguccauca

SEQ ID NO: 68350 - RNA, 25 nt, Human
aucuuuucaguguuuuuucacuuua

SEQ ID NO: 68351 - RNA, 32 nt, Human
aucuuuucauuuccuuuauaucucuuuucuuc

SEQ ID NO: 68352 - RNA, 32 nt, Human
aucuuuucggugcucccuaauccaagcagcuu

SEQ ID NO: 68353 - RNA, 32 nt, Human
aucuuuucucucucacacaugcaguccucaau

SEQ ID NO: 68354 - RNA, 32 nt, Human
aucuuuucugaccauuuuaguacagaauuagu

SEQ ID NO: 68355 - RNA, 32 nt, Human
aucuuuucuguguguaaacauaguugaaauuc

SEQ ID NO: 68356 - RNA, 32 nt, Human
aucuuuucuuacugcaaccuucgccucccgag

SEQ ID NO: 68357 - RNA, 32 nt, Human
aucuuuucuuagguauuguauuucaggguaca

SEQ ID NO: 68358 - RNA, 32 nt, Human
aucuuuucuucagauaccagauuugauauaaa

SEQ ID NO: 68359 - RNA, 32 nt, Human
aucuuuucuucagauaccagauuugauauaau

SEQ ID NO: 68360 - RNA, 32 nt, Human
aucuuuucuucugcuguuuucuuuuccccucu

SEQ ID NO: 68361 - RNA, 32 nt, Human
aucuuuucuucugcuuucuucccuccaagagc

SEQ ID NO: 68362 - RNA, 32 nt, Human
aucuuuugccuuuaagacgauucauucuuguc

SEQ ID NO: 68363 - RNA, 32 nt, Human
aucuuuuuaaaaacuacagacgucagcauguu

SEQ ID NO: 68364 - RNA, 32 nt, Human
aucuuuuuaauccaaaggugcuuuacuuuucc

SEQ ID NO: 68365 - RNA, 32 nt, Human
aucuuuuucaaaggacuguaguuuuguaaugg

SEQ ID NO: 68366 - RNA, 23 nt, Human
aucuuuuucacaauauccuauga

SEQ ID NO: 68367 - RNA, 32 nt, Human
aucuuuuucagauauuaauucauuucaucugc

SEQ ID NO: 68368 - RNA, 32 nt, Human
aucuuuuucucaaaugccauaauuaacugaaa

SEQ ID NO: 68369 - RNA, 32 nt, Human
aucuuuuuggagagucaugggaggaauguaaa

SEQ ID NO: 68370 - RNA, 20 nt, Human
augaaaaaacacuuuacuaa

SEQ ID NO: 68371 - RNA, 32 nt, Human
augaaaaaccauugaacaguuuucucgauggc

SEQ ID NO: 68372 - RNA, 32 nt, Human
augaaaaagaaacagucaagcacacaauagug

SEQ ID NO: 68373 - RNA, 25 nt, Human
augaaaaagaagcagacggugcagg

SEQ ID NO: 68374 - RNA, 32 nt, Human
augaaaaagaggagagaucucaagagggauaa

SEQ ID NO: 68375 - RNA, 29 nt, Human
augaaaaagcagggaaucucaaacuuuau

SEQ ID NO: 68376 - RNA, 32 nt, Human
augaaaaaggagagacauggaaagggagacag

SEQ ID NO: 68377 - RNA, 32 nt, Human
augaaaaauacuguggacacuuaaauaauggg

SEQ ID NO: 68378 - RNA, 32 nt, Human
augaaaaaucuguugauaaauccaucacuaua

SEQ ID NO: 68379 - RNA, 21 nt, Human
augaaaaaugugagaccaaag

SEQ ID NO: 68380 - RNA, 32 nt, Human
augaaaaauucuugccuuuccuuguuucagug

SEQ ID NO: 68381 - RNA, 32 nt, Human
augaaaacaaaauuccauuacaggggcagugc

SEQ ID NO: 68382 - RNA, 32 nt, Human
augaaaacagaauauucuguggugccagugca

SEQ ID NO: 68383 - RNA, 32 nt, Human
augaaaacagcaugggaaagacuugcccccau

SEQ ID NO: 68384 - RNA, 32 nt, Human
augaaaacaggccaggacaguggugcaugcca

SEQ ID NO: 68385 - RNA, 32 nt, Human
augaaaacaggccgggacaguggugcaugcca

SEQ ID NO: 68386 - RNA, 32 nt, Human
augaaaacaggcugggacaguggugcaugcca

SEQ ID NO: 68387 - RNA, 32 nt, Human
augaaaacccuuguagaucugcuaaacuucuc

SEQ ID NO: 68388 - RNA, 32 nt, Human
augaaaagacuucggaaaauuagucagagaug

SEQ ID NO: 68389 - RNA, 32 nt, Human
augaaaagagaauguugugauuugagcuuuua

SEQ ID NO: 68390 - RNA, 32 nt, Human
augaaaagagggcugagacuuuagcuguugag

SEQ ID NO: 68391 - RNA, 32 nt, Human
augaaaagccaagaaguaucugaaagauguca

SEQ ID NO: 68392 - RNA, 32 nt, Human
augaaaagcuggaagauugcuauagagucccu

SEQ ID NO: 68393 - RNA, 32 nt, Human
augaaaagcuguuacuggugauuauagaugag

SEQ ID NO: 68394 - RNA, 32 nt, Human
augaaaagcuuuguuuguucuuguuuuuaagu

SEQ ID NO: 68395 - RNA, 20 nt, Human
augaaaaggacacauucuga

SEQ ID NO: 68396 - RNA, 32 nt, Human
augaaaaggagaggacacagagacagaggaga

SEQ ID NO: 68397 - RNA, 32 nt, Human
augaaaaggaggaggaacaggaccaaggggug

SEQ ID NO: 68398 - RNA, 32 nt, Human
augaaaaguccccaggagaggggagcugugua

SEQ ID NO: 68399 - RNA, 22 nt, Human
augaaaaguguauuuuuggaga

SEQ ID NO: 68400 - RNA, 32 nt, Human
augaaaaguuugcugggucugcuggcugggaa

SEQ ID NO: 68401 - RNA, 32 nt, Human
augaaaauagccaugcagacaagucucucauc

SEQ ID NO: 68402 - RNA, 32 nt, Human
augaaaauauagaaugauuaucucagagcaga

SEQ ID NO: 68403 - RNA, 21 nt, Human
augaaaaucaauuuaccccau

SEQ ID NO: 68404 - RNA, 32 nt, Human
augaaaaucagguuguccuguacaguaucugc

SEQ ID NO: 68405 - RNA, 32 nt, Human
augaaaauccuuuuaaccauuuuaaccuagau

SEQ ID NO: 68406 - RNA, 32 nt, Human
augaaaaugaaccauucacagugcaagaagga

SEQ ID NO: 68407 - RNA, 32 nt, Human
augaaaaugaugaauaaccaguaccaguucca

SEQ ID NO: 68408 - RNA, 32 nt, Human
augaaaauggagccagagagccuggacaucag

SEQ ID NO: 68409 - RNA, 22 nt, Human
augaaaauggcuucugcuccau

SEQ ID NO: 68410 - RNA, 32 nt, Human
augaaaaugguguguuauuggaagauguuaaa

SEQ ID NO: 68411 - RNA, 32 nt, Human
augaaaauguauuuuuauauuauuuuacuuau

SEQ ID NO: 68412 - RNA, 32 nt, Human
augaaaauguucuauuucuugaucugaauugu

SEQ ID NO: 68413 - RNA, 24 nt, Human
augaaaauuauauuuuaacuucau

SEQ ID NO: 68414 - RNA, 32 nt, Human
augaaaauuccaguggauagacuuauauggcu

SEQ ID NO: 68415 - RNA, 32 nt, Human
augaaacaaaaacaaaaucacaagaggaagaa

SEQ ID NO: 68416 - RNA, 32 nt, Human
augaaacaaaggccagcccagggcuuagcaca

SEQ ID NO: 68417 - RNA, 32 nt, Human
augaaacaacuaaugagaaaagaaaaggaauu

SEQ ID NO: 68418 - RNA, 32 nt, Human
augaaacaagucuagucuucugguuuucuagc

SEQ ID NO: 68419 - RNA, 32 nt, Human
augaaacaggcagcguaggauggggguccagu

SEQ ID NO: 68420 - RNA, 32 nt, Human
augaaacagggcaccccagcugaccugguacu

SEQ ID NO: 68421 - RNA, 32 nt, Human
augaaacagggcaccccagcugcccugguacu

SEQ ID NO: 68422 - RNA, 32 nt, Human
augaaacaguuggugauguuucagagaaccca

SEQ ID NO: 68423 - RNA, 32 nt, Human
augaaacaucaguuggugaagcagaggacgca

SEQ ID NO: 68424 - RNA, 32 nt, Human
augaaacauugcauccaugaaggacagcacca

SEQ ID NO: 68425 - RNA, 32 nt, Human
augaaacauuucucuacuucaagaccaccucu

SEQ ID NO: 68426 - RNA, 32 nt, Human
augaaacccaggcuguagagaggauugaggcc

SEQ ID NO: 68427 - RNA, 32 nt, Human
augaaacccaucccuggacuccaggcuaagaa

SEQ ID NO: 68428 - RNA, 32 nt, Human
augaaacccccuaccacuuuugcaaauccugu

SEQ ID NO: 68429 - RNA, 32 nt, Human
augaaacgaauuuaagagaacauaucaaagag

SEQ ID NO: 68430 - RNA, 32 nt, Human
augaaacggaccucacuggacccauucuuuuu

SEQ ID NO: 68431 - RNA, 32 nt, Human
augaaacggugcaggccaggcgggcccuaaua

SEQ ID NO: 68432 - RNA, 32 nt, Human
augaaacuccaaaugcuuggaugucugauuca

SEQ ID NO: 68433 - RNA, 32 nt, Human
augaaacucccaaaggugccagagauggcugu

SEQ ID NO: 68434 - RNA, 32 nt, Human
augaaacucucaucuaguucugugauguguuu

SEQ ID NO: 68435 - RNA, 32 nt, Human
augaaacugaaguuuggugccuccucuuuauc

SEQ ID NO: 68436 - RNA, 32 nt, Human
augaaacugaguaguugaccuucaggucacga

SEQ ID NO: 68437 - RNA, 32 nt, Human
augaaacugcaacccaccugcccccagcccug

SEQ ID NO: 68438 - RNA, 32 nt, Human
augaaacugccucaccaagcacuaugcaauug

SEQ ID NO: 68439 - RNA, 32 nt, Human
augaaacugcuauauuugaaugcaguuguuca

SEQ ID NO: 68440 - RNA, 32 nt, Human
augaaacugggcugagauguguuacaggagcc

SEQ ID NO: 68441 - RNA, 32 nt, Human
augaaacuguccaccaagaucaagcagagaaa

SEQ ID NO: 68442 - RNA, 32 nt, Human
augaaacuuccccucaccuccucaucuuucca

SEQ ID NO: 68443 - RNA, 26 nt, Human
augaaagaaaaggaaugacuacagga

SEQ ID NO: 68444 - RNA, 32 nt, Human
augaaagaaagaaagaguggguuucagaagug

SEQ ID NO: 68445 - RNA, 32 nt, Human
augaaagaaagggaaaaggcagugguguguag

SEQ ID NO: 68446 - RNA, 32 nt, Human
augaaagaagcauauggcacuugugaagauaa

SEQ ID NO: 68447 - RNA, 32 nt, Human
augaaagaauguggcuuucuucagucaaagca

SEQ ID NO: 68448 - RNA, 32 nt, Human
augaaagacagugucauacaugggggaagaau

SEQ ID NO: 68449 - RNA, 32 nt, Human
augaaagagagcucuaaccagauggaacacug

SEQ ID NO: 68450 - RNA, 32 nt, Human
augaaagagaucuguaaaaccugcccaggaac

SEQ ID NO: 68451 - RNA, 32 nt, Human
augaaagaggcucaggcauaaguugagauucu

SEQ ID NO: 68452 - RNA, 32 nt, Human
augaaagaguagaagaagagagugucuccuga

SEQ ID NO: 68453 - RNA, 32 nt, Human
augaaagauacaugaguuugcauuuugaccug

SEQ ID NO: 68454 - RNA, 32 nt, Human
augaaagcagcugagagggaggcuguacccug

SEQ ID NO: 68455 - RNA, 32 nt, Human
augaaagccagccagcccuuccuccuucccuc

SEQ ID NO: 68456 - RNA, 32 nt, Human
augaaagccgugagccuccuggacuccacguc

SEQ ID NO: 68457 - RNA, 23 nt, Human
augaaagccugugucuuugaggg

SEQ ID NO: 68458 - RNA, 32 nt, Human
augaaagccuguuuugggcugaaagaaugauu

SEQ ID NO: 68459 - RNA, 32 nt, Human
augaaagcugccgaaaguuuaucugcccccag

SEQ ID NO: 68460 - RNA, 32 nt, Human
augaaaggaggaagaagaaagggacuuggaac

SEQ ID NO: 68461 - RNA, 32 nt, Human
augaaaggcugcagugccaguuuuaagaaaga

SEQ ID NO: 68462 - RNA, 32 nt, Human
augaaaggcuuagaauggaauauccucugauc

SEQ ID NO: 68463 - RNA, 22 nt, Human
augaaagggaggagacacaggc

SEQ ID NO: 68464 - RNA, 32 nt, Human
augaaaguaucugccuggcagugcaguaaaug

SEQ ID NO: 68465 - RNA, 32 nt, Human
augaaaguauugggguggagguugcagugagc

SEQ ID NO: 68466 - RNA, 32 nt, Human
augaaagugccuucccauuaugccguacgcug

SEQ ID NO: 68467 - RNA, 32 nt, Human
augaaagugccuucccauuaugcuguacccug

SEQ ID NO: 68468 - RNA, 22 nt, Human
augaaaguuauuuaagccccau

SEQ ID NO: 68469 - RNA, 32 nt, Human
augaaaguugaaaucauaccuaccucauaagg

SEQ ID NO: 68470 - RNA, 32 nt, Human
augaaauaaagaaaauaugguacauauacaca

SEQ ID NO: 68471 - RNA, 32 nt, Human
augaaauagcaucuacucaccauccuuccuca

SEQ ID NO: 68472 - RNA, 32 nt, Human
augaaauauauucaaauacauaccuuauuuua

SEQ ID NO: 68473 - RNA, 32 nt, Human
augaaauaucucccuggcaggguccucuucuu

SEQ ID NO: 68474 - RNA, 32 nt, Human
augaaauaugcugcaaucauuucugcauccuu

SEQ ID NO: 68475 - RNA, 32 nt, Human
augaaauauguauaacuuuaacuucuguuuua

SEQ ID NO: 68476 - RNA, 32 nt, Human
augaaauauucagcaaaauucuagaaaaugcu

SEQ ID NO: 68477 - RNA, 32 nt, Human
augaaaucaaaugguuuccuggauuacugcau

SEQ ID NO: 68478 - RNA, 32 nt, Human
augaaaucacaaaaucacugaggcugugacag

SEQ ID NO: 68479 - RNA, 23 nt, Human
augaaaucagugguauuuugaau

SEQ ID NO: 68480 - RNA, 32 nt, Human
augaaaucccccaggagucacuggauggaugu

SEQ ID NO: 68481 - RNA, 32 nt, Human
augaaaugaaaccuuuacccaugaccaacagu

SEQ ID NO: 68482 - RNA, 32 nt, Human
augaaaugaaggauugagggauugagggauug

SEQ ID NO: 68483 - RNA, 32 nt, Human
augaaaugagccaccgugaacagacaucugcc

SEQ ID NO: 68484 - RNA, 32 nt, Human
augaaauggaagaaggaggaagagcaugaagg

SEQ ID NO: 68485 - RNA, 32 nt, Human
augaaauggaggaucucuaaagagcaucugau

SEQ ID NO: 68486 - RNA, 32 nt, Human
augaaaugucugcacuguagucucagaucacu

SEQ ID NO: 68487 - RNA, 32 nt, Human
augaaaugugguaaaucaacuccacagaacca

SEQ ID NO: 68488 - RNA, 32 nt, Human
augaaauuauguguaauaacgcuuuauguuau

SEQ ID NO: 68489 - RNA, 32 nt, Human
augaaauucaagacaaagaagaaaaauacuca

SEQ ID NO: 68490 - RNA, 32 nt, Human
augaaauucauauggugucccaccuuauuuaa

SEQ ID NO: 68491 - RNA, 32 nt, Human
augaaauuccagccuugacuuucuucugugca

SEQ ID NO: 68492 - RNA, 32 nt, Human
augaaauucucuuccuuagaggaaagggaaag

SEQ ID NO: 68493 - RNA, 32 nt, Human
augaaauugacaccgacucugccuacauucuu

SEQ ID NO: 68494 - RNA, 32 nt, Human
augaaauugauauuuuggggaagauuaaucuu

SEQ ID NO: 68495 - RNA, 32 nt, Human
augaaauugggaguugcuguguggaaacucaa

SEQ ID NO: 68496 - RNA, 21 nt, Human
augaaauuguaccacugggua

SEQ ID NO: 68497 - RNA, 32 nt, Human
augaaauuuacagugauagaacaaaagaggau

SEQ ID NO: 68498 - RNA, 32 nt, Human
augaacaaaggccauaucauuuuuauugacaa

SEQ ID NO: 68499 - RNA, 32 nt, Human
augaacaaauuuccuugguuacaugguuuuuc

SEQ ID NO: 68500 - RNA, 32 nt, Human
augaacaagguggacacucacugaccugucac

SEQ ID NO: 68501 - RNA, 32 nt, Human
augaacaauacauccaacaaggcuucuagcaa

SEQ ID NO: 68502 - RNA, 32 nt, Human
augaacacagaaacccucccaaauccucagac

SEQ ID NO: 68503 - RNA, 32 nt, Human
augaacaccacugcacuccaccuguccacuug

SEQ ID NO: 68504 - RNA, 22 nt, Human
augaacacgucuuguuuggagg

SEQ ID NO: 68505 - RNA, 31 nt, Human
augaacacugugcaagguguuggagaaaucc

SEQ ID NO: 68506 - RNA, 20 nt, Human
augaacagaaaacauucuga

SEQ ID NO: 68507 - RNA, 21 nt, Human
augaacagauucauuugaaga

SEQ ID NO: 68508 - RNA, 32 nt, Human
augaacagccaaguagcuuccagcuuacagca

SEQ ID NO: 68509 - RNA, 32 nt, Human
augaacagccucauuuccccagcuucccugau

SEQ ID NO: 68510 - RNA, 32 nt, Human
augaacaggaauagagagaggggacugguguc

SEQ ID NO: 68511 - RNA, 32 nt, Human
augaacaggaauagaucugaauaaagcaaauc

SEQ ID NO: 68512 - RNA, 32 nt, Human
augaacaggagaaagaagcgcuuacccacucu

SEQ ID NO: 68513 - RNA, 32 nt, Human
augaacaggcagccacgaggugggugggagcu

SEQ ID NO: 68514 - RNA, 22 nt, Human
augaacaggcaguucuuggaga

SEQ ID NO: 68515 - RNA, 32 nt, Human
augaacaggcugggagugguggcucagccuac

SEQ ID NO: 68516 - RNA, 32 nt, Human
augaacagggauuuuauaccaggcgucagaag

SEQ ID NO: 68517 - RNA, 32 nt, Human
augaacagucacauacuugagagaaacuguga

SEQ ID NO: 68518 - RNA, 32 nt, Human
augaacagucacccgugcuggcuguagccccc

SEQ ID NO: 68519 - RNA, 23 nt, Human
augaacaguuucuucugugagga

SEQ ID NO: 68520 - RNA, 32 nt, Human
augaacauaaggcaaauuaauguucuaggauu

SEQ ID NO: 68521 - RNA, 32 nt, Human
augaacaucucucucugcauauuuuauccuau

SEQ ID NO: 68522 - RNA, 32 nt, Human
augaacaugaggaugggaucaaugugggauga

SEQ ID NO: 68523 - RNA, 32 nt, Human
augaacaugccacccagcuccccuuccaccac

SEQ ID NO: 68524 - RNA, 32 nt, Human
augaacaugggcuauuucuguauucauuaggu

SEQ ID NO: 68525 - RNA, 32 nt, Human
augaacaugugaaguuauacuguggcuaugca

SEQ ID NO: 68526 - RNA, 32 nt, Human
augaacauguuuguccauuaacaaacuuauaa

SEQ ID NO: 68527 - RNA, 32 nt, Human
augaacauuuaagaacugaggaaucauagaug

SEQ ID NO: 68528 - RNA, 32 nt, Human
augaaccaagaauuuaaagcccaaugaaccau

SEQ ID NO: 68529 - RNA, 32 nt, Human
augaaccaauuaagguuuuucacuacaguucu

SEQ ID NO: 68530 - RNA, 32 nt, Human
augaaccacagcuguguuuucaaauauguagu

SEQ ID NO: 68531 - RNA, 32 nt, Human
augaaccacucccauuccccuguccccaaugu

SEQ ID NO: 68532 - RNA, 32 nt, Human
augaaccaggagagacuucaaggaucaacucu

SEQ ID NO: 68533 - RNA, 32 nt, Human
augaaccagggcaugaaacugaaagugcauaa

SEQ ID NO: 68534 - RNA, 32 nt, Human
augaaccauggcaccuuugagagagggggcac

SEQ ID NO: 68535 - RNA, 32 nt, Human
augaacccaagucacauuggaacacagagcug

SEQ ID NO: 68536 - RNA, 28 nt, Human
augaacccaagugaacuuuccucauuac

SEQ ID NO: 68537 - RNA, 32 nt, Human
augaacccaggaggcagagcuugcagugagcc

SEQ ID NO: 68538 - RNA, 32 nt, Human
augaacccaggaggcagagcuuguagugagcc

SEQ ID NO: 68539 - RNA, 32 nt, Human
augaacccaggaggcagagguugcagugagcc

SEQ ID NO: 68540 - RNA, 32 nt, Human
augaacccaggaggcggagcuugcagugagcu

SEQ ID NO: 68541 - RNA, 32 nt, Human
augaacccaggagguugaagcugcggugggcc

SEQ ID NO: 68542 - RNA, 32 nt, Human
augaacccaggaguuggagcuugcagugagcc

SEQ ID NO: 68543 - RNA, 32 nt, Human
augaacccaggaugcggagguugcagugagcc

SEQ ID NO: 68544 - RNA, 32 nt, Human
augaaccccaggcuggagugcaguggcucaau

SEQ ID NO: 68545 - RNA, 32 nt, Human
augaaccccuccagaugguuuuaggauuaaaa

SEQ ID NO: 68546 - RNA, 32 nt, Human
augaacccgggaggcagagguugcagugagcc

SEQ ID NO: 68547 - RNA, 32 nt, Human
augaacccgggaggcggagguugcagucagcc

SEQ ID NO: 68548 - RNA, 32 nt, Human
augaacccgggaggugcagguugcagugagcc

SEQ ID NO: 68549 - RNA, 32 nt, Human
augaacccgguaggggagcuugcagugagccc

SEQ ID NO: 68550 - RNA, 32 nt, Human
augaacccgguagguggagguugcagugagcc

SEQ ID NO: 68551 - RNA, 32 nt, Human
augaaccucagaaaaagagcaacagaaguaau

SEQ ID NO: 68552 - RNA, 32 nt, Human
augaaccucuacugguuccuguacaucguggc

SEQ ID NO: 68553 - RNA, 32 nt, Human
augaaccucugcuucuucaucuggaucacacu

SEQ ID NO: 68554 - RNA, 32 nt, Human
augaaccugccugauucuccacuuucucugcu

SEQ ID NO: 68555 - RNA, 32 nt, Human
augaaccugccugccucagauugcuguccccg

SEQ ID NO: 68556 - RNA, 32 nt, Human
augaaccugggagguggagcaugcagccagcc

SEQ ID NO: 68557 - RNA, 32 nt, Human
augaaccugggagguggagguugcagugagcc

SEQ ID NO: 68558 - RNA, 32 nt, Human
augaacggaauaccugcuagguuccaggaaug

SEQ ID NO: 68559 - RNA, 18 nt, Human
augaacgguacauucugg

SEQ ID NO: 68560 - RNA, 21 nt, Human
augaacgguacauucuggagg

SEQ ID NO: 68561 - RNA, 21 nt, Human
augaacggugcuguucugaag

SEQ ID NO: 68562 - RNA, 32 nt, Human
augaacggugcuguucugaagucuucaaauuu

SEQ ID NO: 68563 - RNA, 32 nt, Human
augaacguggccgaggcugacaaggucacggg

SEQ ID NO: 68564 - RNA, 32 nt, Human
augaacuaccugauuucugccuccaggcuugu

SEQ ID NO: 68565 - RNA, 32 nt, Human
augaacuacgguguguuaaacaacagcagugg

SEQ ID NO: 68566 - RNA, 32 nt, Human
augaacuacugauuuuguuuucaugaaaauuc

SEQ ID NO: 68567 - RNA, 32 nt, Human
augaacuagacaugccaacagcuuggggaaga

SEQ ID NO: 68568 - RNA, 32 nt, Human
augaacucacugcauuucugugcucccuccuc

SEQ ID NO: 68569 - RNA, 32 nt, Human
augaacucagugaagccaaagccauucuaaca

SEQ ID NO: 68570 - RNA, 32 nt, Human
augaacucaucauuccagccugggcaacaaga

SEQ ID NO: 68571 - RNA, 32 nt, Human
augaacucccaggagagggaagaugggagcca

SEQ ID NO: 68572 - RNA, 32 nt, Human
augaacugcaccuuccagcccugcccauaagc

SEQ ID NO: 68573 - RNA, 32 nt, Human
augaacugcaggcugagaaaagaaggaaaaag

SEQ ID NO: 68574 - RNA, 32 nt, Human
augaacugcaguggccaguggccacaucagga

SEQ ID NO: 68575 - RNA, 32 nt, Human
augaacugcuuugggagauuaucaguagaaag

SEQ ID NO: 68576 - RNA, 21 nt, Human
augaacuguuuuuucuguaga

SEQ ID NO: 68577 - RNA, 32 nt, Human
augaacuuaaaaggagagccuggagaaucauc

SEQ ID NO: 68578 - RNA, 32 nt, Human
augaacuucaccaccacuagugucuguccaug

SEQ ID NO: 68579 - RNA, 32 nt, Human
augaacuugagacuccugauguacacugugau

SEQ ID NO: 68580 - RNA, 32 nt, Human
augaacuugcagacuguggcgcaacuggucuu

SEQ ID NO: 68581 - RNA, 32 nt, Human
augaacuugcaggaucauauaguuaauucuac

SEQ ID NO: 68582 - RNA, 32 nt, Human
augaacuugccucccuuucucccuucuccacu

SEQ ID NO: 68583 - RNA, 32 nt, Human
augaacuuuuguauuuuucauuuuucauuuga

SEQ ID NO: 68584 - RNA, 21 nt, Human
augaagaaaaaaguacuguga

SEQ ID NO: 68585 - RNA, 32 nt, Human
augaagaaaagagguuuaauugacucacaguu

SEQ ID NO: 68586 - RNA, 32 nt, Human
augaagaaaagagguuuaauuggcucacgguu

SEQ ID NO: 68587 - RNA, 32 nt, Human
augaagaaaauaagcaaagaaaaauggagacu

SEQ ID NO: 68588 - RNA, 32 nt, Human
augaagaaauauuuuaaggaaaccuauuugaa

SEQ ID NO: 68589 - RNA, 32 nt, Human
augaagaacauucaaaagugugcucaaaaaug

SEQ ID NO: 68590 - RNA, 21 nt, Human
augaagaagaagcaaccgaua

SEQ ID NO: 68591 - RNA, 32 nt, Human
augaagaaggcagggaagguaaggagugagag

SEQ ID NO: 68592 - RNA, 32 nt, Human
augaagaauagggaugacucuagugaaaagua

SEQ ID NO: 68593 - RNA, 32 nt, Human
augaagaauagggcugggcacaguggcucacg

SEQ ID NO: 68594 - RNA, 32 nt, Human
augaagaauuccagguguacuagugaauguaa

SEQ ID NO: 68595 - RNA, 32 nt, Human
augaagacacuggcauuucagugggauuguaa

SEQ ID NO: 68596 - RNA, 32 nt, Human
augaagacagaauugucaagucagggcuuuca

SEQ ID NO: 68597 - RNA, 32 nt, Human
augaagacaggaucuagaauaaucuugcucac

SEQ ID NO: 68598 - RNA, 32 nt, Human
augaagacccuagggcaaggcuugagaagcca

SEQ ID NO: 68599 - RNA, 32 nt, Human
augaagacccucucccuucuuuguagaauuaa

SEQ ID NO: 68600 - RNA, 32 nt, Human
augaagacugaggcaggcggagcugcuaagag

SEQ ID NO: 68601 - RNA, 32 nt, Human
augaagacuuaucagggcccuagaaagugcua

SEQ ID NO: 68602 - RNA, 20 nt, Human
augaagagaaugcauuuuga

SEQ ID NO: 68603 - RNA, 32 nt, Human
augaagagacugccccucccauuauugcccca

SEQ ID NO: 68604 - RNA, 32 nt, Human
augaagagagagagggucuccuauguuuccua

SEQ ID NO: 68605 - RNA, 32 nt, Human
augaagagagauggaaaacuugaugacuagcu

SEQ ID NO: 68606 - RNA, 32 nt, Human
augaagagccaagaugcuggugaagcaggugc

SEQ ID NO: 68607 - RNA, 30 nt, Human
augaagagccucuccacggcuccugcgccu

SEQ ID NO: 68608 - RNA, 32 nt, Human
augaagagcugccagauccaacagaaauguga

SEQ ID NO: 68609 - RNA, 32 nt, Human
augaagaggaagagacaugagagauacgcaca

SEQ ID NO: 68610 - RNA, 32 nt, Human
augaagaggaggguugaggcuggagaagagcc

SEQ ID NO: 68611 - RNA, 32 nt, Human
augaagaggaguaggaaggaaaauggaaucaa

SEQ ID NO: 68612 - RNA, 32 nt, Human
augaagaggcaagagcacagacuuacaaggau

SEQ ID NO: 68613 - RNA, 32 nt, Human
augaagagugauccuccuuccuucccuggccc

SEQ ID NO: 68614 - RNA, 18 nt, Human
augaagagugcauucugg

SEQ ID NO: 68615 - RNA, 32 nt, Human
augaagaucaccacugaauugcugacaaauag

SEQ ID NO: 68616 - RNA, 32 nt, Human
augaagaucagaaaauucucuccaugucaccg

SEQ ID NO: 68617 - RNA, 32 nt, Human
augaagaucugcagagugagaagccagaccau

SEQ ID NO: 68618 - RNA, 32 nt, Human
augaagaugagaucaggcauggggaaggaccc

SEQ ID NO: 68619 - RNA, 32 nt, Human
augaagaugaucauauuucauuuugcagaugu

SEQ ID NO: 68620 - RNA, 32 nt, Human
augaagauguacugaugacgccccagaaaugc

SEQ ID NO: 68621 - RNA, 32 nt, Human
augaagauucuugagccccauuuccaagaccc

SEQ ID NO: 68622 - RNA, 32 nt, Human
augaagcaaggcccugaauauauuaccaagau

SEQ ID NO: 68623 - RNA, 32 nt, Human
augaagcacaauggauuuacagcucuaggaac

SEQ ID NO: 68624 - RNA, 32 nt, Human
augaagcacauacaaaagaagacagagaaugc

SEQ ID NO: 68625 - RNA, 32 nt, Human
augaagcaccacugcccuguagaccugggaua

SEQ ID NO: 68626 - RNA, 32 nt, Human
augaagcaccuugcccaaggucucaccaggca

SEQ ID NO: 68627 - RNA, 32 nt, Human
augaagcaggcagagcucagaggaucuuggca

SEQ ID NO: 68628 - RNA, 32 nt, Human
augaagcagugucugcaggcguucagugcugc

SEQ ID NO: 68629 - RNA, 32 nt, Human
augaagcaguguugugacucuucucucucccc

SEQ ID NO: 68630 - RNA, 32 nt, Human
augaagccaccaagucuagacuugaugguguu

SEQ ID NO: 68631 - RNA, 24 nt, Human
augaagccagcagcacccagagcc

SEQ ID NO: 68632 - RNA, 32 nt, Human
augaagccaggaguucgagaccagccugacca

SEQ ID NO: 68633 - RNA, 32 nt, Human
augaagccagugcacgccagccugggcgacag

SEQ ID NO: 68634 - RNA, 32 nt, Human
augaagccauaugaaccagcugucaguugcac

SEQ ID NO: 68635 - RNA, 32 nt, Human
augaagcccagccugcacgucugucccucucu

SEQ ID NO: 68636 - RNA, 32 nt, Human
augaagccccaaauguagaaacucagccagcc

SEQ ID NO: 68637 - RNA, 32 nt, Human
augaagccccaaauguagaaacucagccaguc

SEQ ID NO: 68638 - RNA, 32 nt, Human
augaagccccuggcauuugcuggggaagggac

SEQ ID NO: 68639 - RNA, 32 nt, Human
augaagcccguuggucucagccuggcuugagc

SEQ ID NO: 68640 - RNA, 32 nt, Human
augaagccgacgaggggcucagucuaggggaa

SEQ ID NO: 68641 - RNA, 19 nt, Human
augaagccuccagguaaca

SEQ ID NO: 68642 - RNA, 21 nt, Human
augaagcggagguugcaguga

SEQ ID NO: 68643 - RNA, 32 nt, Human
augaagcuacacaaaugugguauuuaaaugca

SEQ ID NO: 68644 - RNA, 21 nt, Human
augaagcucaacacuguggua

SEQ ID NO: 68645 - RNA, 32 nt, Human
augaagcugaaccguuacucucugccaaaacc

SEQ ID NO: 68646 - RNA, 32 nt, Human
augaagcugaugugagagcccuggagagaaac

SEQ ID NO: 68647 - RNA, 32 nt, Human
augaagcuggaggcagagauuggagugauaca

SEQ ID NO: 68648 - RNA, 32 nt, Human
augaagcuuggaaaauacuauauucaacaaaa

SEQ ID NO: 68649 - RNA, 32 nt, Human
augaagcuuguccucugacuagguuucuaauu

SEQ ID NO: 68650 - RNA, 32 nt, Human
augaagcuugugaguagagcaaacaaacguuu

SEQ ID NO: 68651 - RNA, 32 nt, Human
augaaggaaagggacacaaaaauaugugacua

SEQ ID NO: 68652 - RNA, 32 nt, Human
augaaggagaagaaagaggaaaaagaaguaaa

SEQ ID NO: 68653 - RNA, 32 nt, Human
augaaggagaagcagaagcagacggcuggccu

SEQ ID NO: 68654 - RNA, 32 nt, Human
augaaggagaagggcaagagauccucugaaca

SEQ ID NO: 68655 - RNA, 32 nt, Human
augaaggagaggaggguaaaggagaaugggaa

SEQ ID NO: 68656 - RNA, 32 nt, Human
augaaggagcaggaggagaggaagaaacuuuu

SEQ ID NO: 68657 - RNA, 32 nt, Human
augaaggagccaggcuugcacacagacaauuc

SEQ ID NO: 68658 - RNA, 32 nt, Human
augaaggaguuucaacauccagcuucaucuag

SEQ ID NO: 68659 - RNA, 31 nt, Human
augaaggcaauguuuccaaggaaaggaaaug

SEQ ID NO: 68660 - RNA, 32 nt, Human
augaaggcacagacuuuucuuguucucuucuc

SEQ ID NO: 68661 - RNA, 32 nt, Human
augaaggcagagccauggaccacgcaggaagg

SEQ ID NO: 68662 - RNA, 32 nt, Human
augaaggcagaggcaugcacauuccucacuga

SEQ ID NO: 68663 - RNA, 32 nt, Human
augaaggcauguuuagaggugugucacaguua

SEQ ID NO: 68664 - RNA, 32 nt, Human
augaaggcauugaagcuugcacaagcucucca

SEQ ID NO: 68665 - RNA, 32 nt, Human
augaaggcccagguuccagucaucacaggauc

SEQ ID NO: 68666 - RNA, 22 nt, Human
augaaggcuaaaauuuuggcca

SEQ ID NO: 68667 - RNA, 32 nt, Human
augaaggcuccagggauacagaguuguccauu

SEQ ID NO: 68668 - RNA, 32 nt, Human
augaaggcugaacacaggcuuguuaaugucag

SEQ ID NO: 68669 - RNA, 32 nt, Human
augaaggcuugucagcacuuccaguuuagaac

SEQ ID NO: 68670 - RNA, 32 nt, Human
augaaggcuuuuuccaaguuugucauauaaag

SEQ ID NO: 68671 - RNA, 32 nt, Human
augaagggagaagggagguuuucucacucuag

SEQ ID NO: 68672 - RNA, 32 nt, Human
augaagggaggagcuccaggaggcgagggaag

SEQ ID NO: 68673 - RNA, 32 nt, Human
augaagggcacccaccuggcuuaagagaacga

SEQ ID NO: 68674 - RNA, 32 nt, Human
augaagggcucucuggggcauguuggaauggc

SEQ ID NO: 68675 - RNA, 32 nt, Human
augaagggcuucaggcugggggcaguggacag

SEQ ID NO: 68676 - RNA, 32 nt, Human
augaaggggugccugggcuagggcugcaggcu

SEQ ID NO: 68677 - RNA, 32 nt, Human
augaagggugugggguaaaagaugcauaaggc

SEQ ID NO: 68678 - RNA, 32 nt, Human
augaaggguuggcacagagaggguggcgacca

SEQ ID NO: 68679 - RNA, 32 nt, Human
augaagguaaacugagguaaugagagggggac

SEQ ID NO: 68680 - RNA, 32 nt, Human
augaagguacauuuucuguucucuccuagguu

SEQ ID NO: 68681 - RNA, 32 nt, Human
augaagguaggaaguaaugugugcuugcagaa

SEQ ID NO: 68682 - RNA, 32 nt, Human
augaagguauaaugggcauacaagaaacugca

SEQ ID NO: 68683 - RNA, 32 nt, Human
augaagguggagggucucuaguuccacgccuc

SEQ ID NO: 68684 - RNA, 32 nt, Human
augaaggugggacuuggagaugcugcugccua

SEQ ID NO: 68685 - RNA, 32 nt, Human
augaaggugugauugaacaagacacugaugcc

SEQ ID NO: 68686 - RNA, 32 nt, Human
augaagguuaaacauuuugccaacgcagguac

SEQ ID NO: 68687 - RNA, 32 nt, Human
augaagguuaagcuggcggugcugcuggugac

SEQ ID NO: 68688 - RNA, 32 nt, Human
augaagguuaccaaacuuguggacaggagccu

SEQ ID NO: 68689 - RNA, 32 nt, Human
augaagucacccauuccauuugacucuuuagc

SEQ ID NO: 68690 - RNA, 32 nt, Human
augaagucaggagaucaagaccauccuggcca

SEQ ID NO: 68691 - RNA, 32 nt, Human
augaagucaggaguucgagaccagccugacca

SEQ ID NO: 68692 - RNA, 20 nt, Human
augaagucaguuucuuugaa

SEQ ID NO: 68693 - RNA, 23 nt, Human
augaaguccaucuaauuuugcca

SEQ ID NO: 68694 - RNA, 32 nt, Human
augaaguccuuuauagcaaaaguuuccaguuc

SEQ ID NO: 68695 - RNA, 32 nt, Human
augaagucucacugcacucaggcuggagugca

SEQ ID NO: 68696 - RNA, 23 nt, Human
augaagucuugcuauuuuaccca

SEQ ID NO: 68697 - RNA, 32 nt, Human
augaagucuuuuaacagucucucuuuauauaa

SEQ ID NO: 68698 - RNA, 32 nt, Human
augaagugaacccaugcagugacuggaugauu

SEQ ID NO: 68699 - RNA, 32 nt, Human
augaagugagccuggacaacaacguggagccu

SEQ ID NO: 68700 - RNA, 32 nt, Human
augaagugagucuucacugucucuccauauuu

SEQ ID NO: 68701 - RNA, 31 nt, Human
augaagugcgacagcauuaaagacugaugcu

SEQ ID NO: 68702 - RNA, 32 nt, Human
augaagugucccuucccaucaguuugauucaa

SEQ ID NO: 68703 - RNA, 22 nt, Human
augaaguuacagauuuuagcca

SEQ ID NO: 68704 - RNA, 32 nt, Human
augaaguuagccaccaaguccucacaagccgu

SEQ ID NO: 68705 - RNA, 32 nt, Human
augaaguucacuauggcagccaccuccggcuc

SEQ ID NO: 68706 - RNA, 32 nt, Human
augaaguucauauccaugaauucacuccuaau

SEQ ID NO: 68707 - RNA, 32 nt, Human
augaaguucaucucaaaauggagaccaugacc

SEQ ID NO: 68708 - RNA, 32 nt, Human
augaaguucugaaauugguugaauaaaacaaa

SEQ ID NO: 68709 - RNA, 32 nt, Human
augaaguuucaagaaaaggaaauuggugggug

SEQ ID NO: 68710 - RNA, 32 nt, Human
augaauaaaagcuuguucugugugacccagca

SEQ ID NO: 68711 - RNA, 32 nt, Human
augaauacacacugcaagcuucuccuuggcuu

SEQ ID NO: 68712 - RNA, 32 nt, Human
augaauacacgagguaugaggucuaggaacau

SEQ ID NO: 68713 - RNA, 32 nt, Human
augaauaccuccccacuguggcugguaacacc

SEQ ID NO: 68714 - RNA, 32 nt, Human
augaauaccuccucauagaaguggugucuuua

SEQ ID NO: 68715 - RNA, 21 nt, Human
augaauacgguacucugaagg

SEQ ID NO: 68716 - RNA, 32 nt, Human
augaauacuaggcuuaauaccugggugaugac

SEQ ID NO: 68717 - RNA, 23 nt, Human
augaauagauguuucacugaaga

SEQ ID NO: 68718 - RNA, 32 nt, Human
augaauagcuagauguggaaagagauauguaa

SEQ ID NO: 68719 - RNA, 32 nt, Human
augaauagguaaccucaagccaccgacuccaa

SEQ ID NO: 68720 - RNA, 22 nt, Human
augaauagguguucucaggagg

SEQ ID NO: 68721 - RNA, 20 nt, Human
augaauaguacacauuuuga

SEQ ID NO: 68722 - RNA, 32 nt, Human
augaauaugucugugugaacacacaggcaugc

SEQ ID NO: 68723 - RNA, 23 nt, Human
augaauauucauguuuuugaagg

SEQ ID NO: 68724 - RNA, 32 nt, Human
augaauauuguggcugggguaauucucagcac

SEQ ID NO: 68725 - RNA, 32 nt, Human
augaauauuugaccuuaaaucuccagugacuc

SEQ ID NO: 68726 - RNA, 32 nt, Human
augaaucaccacacucggccaguuuucuaaaa

SEQ ID NO: 68727 - RNA, 32 nt, Human
augaaucacugcaccucuuugucacagggugu

SEQ ID NO: 68728 - RNA, 32 nt, Human
augaaucacuucucuuuaauuaauaguaugua

SEQ ID NO: 68729 - RNA, 32 nt, Human
augaaucagaugucugucacagaaucugggcc

SEQ ID NO: 68730 - RNA, 32 nt, Human
augaaucagauguguguucucagugaaauaac

SEQ ID NO: 68731 - RNA, 32 nt, Human
augaaucaugaaguucccccuaccuccuuuaa

SEQ ID NO: 68732 - RNA, 32 nt, Human
augaauccaggagguggagguugcagugagcu

SEQ ID NO: 68733 - RNA, 32 nt, Human
augaauccauaggauagagaaaaaucugcuug

SEQ ID NO: 68734 - RNA, 32 nt, Human
augaaucccagccaggacaagugaguugaggc

SEQ ID NO: 68735 - RNA, 32 nt, Human
augaauccuaccucuugcccagucccaggcag

SEQ ID NO: 68736 - RNA, 32 nt, Human
augaauccugcagggccaaggucugggggugc

SEQ ID NO: 68737 - RNA, 32 nt, Human
augaaucguugaugacuuauggauucugucag

SEQ ID NO: 68738 - RNA, 32 nt, Human
augaaucuaccugaguugcuggcauugggagg

SEQ ID NO: 68739 - RNA, 32 nt, Human
augaaucuacuuuuuaaaaaugauuaauuuug

SEQ ID NO: 68740 - RNA, 32 nt, Human
augaaucuccugggaauaauucugcucucugg

SEQ ID NO: 68741 - RNA, 32 nt, Human
augaaucucguuccaaagaacuaccccuuuuc

SEQ ID NO: 68742 - RNA, 32 nt, Human
augaaucucugccucucccaggcugucccccu

SEQ ID NO: 68743 - RNA, 25 nt, Human
augaaucugaauauggggagagaga

SEQ ID NO: 68744 - RNA, 32 nt, Human
augaaucugagcugauggugacuuuaaguuaa

SEQ ID NO: 68745 - RNA, 32 nt, Human
augaaucuucaaaaacuugcacaaacagaaaa

SEQ ID NO: 68746 - RNA, 32 nt, Human
augaaucuucuuuauuguccugauuuguccuc

SEQ ID NO: 68747 - RNA, 32 nt, Human
augaaucuucuuuauuguccugauuuguccug

SEQ ID NO: 68748 - RNA, 22 nt, Human
augaaucuugguauccugugaa

SEQ ID NO: 68749 - RNA, 32 nt, Human
augaaucuuuaaagggugucucuguguacuuu

SEQ ID NO: 68750 - RNA, 32 nt, Human
augaaucuuucaaagguuucccaaaccacucc

SEQ ID NO: 68751 - RNA, 32 nt, Human
augaaugaaagaaccaaggagagaugcagaga

SEQ ID NO: 68752 - RNA, 32 nt, Human
augaaugaagaaugcauggaggacugcaaacu

SEQ ID NO: 68753 - RNA, 32 nt, Human
augaaugaagcccaggggacugccauuuuaua

SEQ ID NO: 68754 - RNA, 32 nt, Human
augaaugaauguaggaaauacaauucagucca

SEQ ID NO: 68755 - RNA, 32 nt, Human
augaaugacaacauacccauuuuacagaugag

SEQ ID NO: 68756 - RNA, 32 nt, Human
augaaugacgcaagcacugaugcugaagaucc

SEQ ID NO: 68757 - RNA, 25 nt, Human
augaaugauaagcuguuucugaggg

SEQ ID NO: 68758 - RNA, 32 nt, Human
augaaugaucauguguugaaagccacauuauu

SEQ ID NO: 68759 - RNA, 32 nt, Human
augaaugcacacacgugugaagcuccugcuga

SEQ ID NO: 68760 - RNA, 32 nt, Human
augaaugccccacugcacuccagccugggcga

SEQ ID NO: 68761 - RNA, 32 nt, Human
augaaugccugcaacagugccugguacacagu

SEQ ID NO: 68762 - RNA, 32 nt, Human
augaaugcggugggugagaaucccggugcccu

SEQ ID NO: 68763 - RNA, 32 nt, Human
augaaugcuccacaauuucaacauaccacaag

SEQ ID NO: 68764 - RNA, 32 nt, Human
augaaugcugauuuuaaaaccaggucauggga

SEQ ID NO: 68765 - RNA, 32 nt, Human
augaauggacucaaacugccuuggcuucaggg

SEQ ID NO: 68766 - RNA, 32 nt, Human
augaauggagaaugagugaacuuccaaugcaa

SEQ ID NO: 68767 - RNA, 32 nt, Human
augaauggagagagacagagaggaagugcagg

SEQ ID NO: 68768 - RNA, 32 nt, Human
augaauggauuguucuuguuucucagaugggu

SEQ ID NO: 68769 - RNA, 32 nt, Human
augaaugggaagggagaacauaucuauccucu

SEQ ID NO: 68770 - RNA, 32 nt, Human
augaaugggugugugccucagagcagagguca

SEQ ID NO: 68771 - RNA, 32 nt, Human
augaaugguaaauucuaugaaaaguaagugau

SEQ ID NO: 68772 - RNA, 22 nt, Human
augaauggucaugcuuuggaga

SEQ ID NO: 68773 - RNA, 32 nt, Human
augaaugucaugauaacccacucuggaauaug

SEQ ID NO: 68774 - RNA, 23 nt, Human
augaaugucgcuaucuuugagga

SEQ ID NO: 68775 - RNA, 32 nt, Human
augaaugugaacaacagagugaucagaagagu

SEQ ID NO: 68776 - RNA, 32 nt, Human
augaaugugaaugacacuucuuauucuuaaug

SEQ ID NO: 68777 - RNA, 32 nt, Human
augaaugugcaggggaccugucucaggcuccu

SEQ ID NO: 68778 - RNA, 32 nt, Human
augaaugugcucaccugucagggcaggauggu

SEQ ID NO: 68779 - RNA, 32 nt, Human
augaauguggacugccuuuuaucucuauuuca

SEQ ID NO: 68780 - RNA, 32 nt, Human
augaauguguuuccuccacauuguauauccuu

SEQ ID NO: 68781 - RNA, 32 nt, Human
augaauguuaagcagaacaccaauggccagug

SEQ ID NO: 68782 - RNA, 32 nt, Human
augaauuaagcagcaaauacuuuuauauccaa

SEQ ID NO: 68783 - RNA, 32 nt, Human
augaauuauuuggacgguuguccacuugaaag

SEQ ID NO: 68784 - RNA, 32 nt, Human
augaauucauucuggucucucuauuaccacug

SEQ ID NO: 68785 - RNA, 32 nt, Human
augaauucauugcacuggaaugaggcucaaca

SEQ ID NO: 68786 - RNA, 32 nt, Human
augaauucccauuaaugagcagucuucaguau

SEQ ID NO: 68787 - RNA, 32 nt, Human
augaauucuccuuuguccuguuucuccuguuu

SEQ ID NO: 68788 - RNA, 32 nt, Human
augaauucucugcaaucuguuguuucgcugau

SEQ ID NO: 68789 - RNA, 32 nt, Human
augaauugagcagaaggaaacaaaguucugca

SEQ ID NO: 68790 - RNA, 32 nt, Human
augaauugaguauucuagacagcagcauaaga

SEQ ID NO: 68791 - RNA, 32 nt, Human
augaauugcuugaauccaggaggcagagguug

SEQ ID NO: 68792 - RNA, 32 nt, Human
augaauugggucuugcuguguugcccggggua

SEQ ID NO: 68793 - RNA, 32 nt, Human
augaauugugcaaggauguaaacauucagucc

SEQ ID NO: 68794 - RNA, 32 nt, Human
augaauuucauuuauugacuguucaacagagu

SEQ ID NO: 68795 - RNA, 32 nt, Human
augaauuucucaggugacauuucuauaucugc

SEQ ID NO: 68796 - RNA, 32 nt, Human
augaauuugagaccagccuggccaacagacgg

SEQ ID NO: 68797 - RNA, 32 nt, Human
augaauuuguucaccaccugucuugcuuaagc

SEQ ID NO: 68798 - RNA, 32 nt, Human
augacaaacacacaacauuacacacauauaca

SEQ ID NO: 68799 - RNA, 32 nt, Human
augacaaacacacauuacacacacaacaucac

SEQ ID NO: 68800 - RNA, 32 nt, Human
augacaaacacacauuacacacacaucacaau

SEQ ID NO: 68801 - RNA, 32 nt, Human
augacaaaccgcaagagccacagacuugccag

SEQ ID NO: 68802 - RNA, 32 nt, Human
augacaaacugucaaagugacacagaauacug

SEQ ID NO: 68803 - RNA, 32 nt, Human
augacaaagacugaguacguugugcauuuggu

SEQ ID NO: 68804 - RNA, 32 nt, Human
augacaaagaggaguggaagaagacagagaga

SEQ ID NO: 68805 - RNA, 32 nt, Human
augacaacaacaaaagagccacacuuauuucu

SEQ ID NO: 68806 - RNA, 32 nt, Human
augacaacaugcuggagccaagugcuaacacg

SEQ ID NO: 68807 - RNA, 19 nt, Human
augacaaccuaccucccug

SEQ ID NO: 68808 - RNA, 32 nt, Human
augacaacuucccagugaauucuugaaggaaa

SEQ ID NO: 68809 - RNA, 32 nt, Human
augacaaggcaccuaccaauguucuuggguca

SEQ ID NO: 68810 - RNA, 32 nt, Human
augacaaggugaugcagaugugaccuaggaug

SEQ ID NO: 68811 - RNA, 32 nt, Human
augacaagucacacccuccccauuaguauccu

SEQ ID NO: 68812 - RNA, 32 nt, Human
augacaagucucggagcugcugagaugacagg

SEQ ID NO: 68813 - RNA, 32 nt, Human
augacaaguuugaaaaucugaacacaguugcu

SEQ ID NO: 68814 - RNA, 32 nt, Human
augacaauaccagcccuggacuaccuaccugu

SEQ ID NO: 68815 - RNA, 32 nt, Human
augacaaucguccucuuuacucuccaaguuug

SEQ ID NO: 68816 - RNA, 32 nt, Human
augacaauguaggaauugcugaauuaaauguu

SEQ ID NO: 68817 - RNA, 32 nt, Human
augacaaugugaaaccaucacagcugggaaga

SEQ ID NO: 68818 - RNA, 32 nt, Human
augacaauuccccuaaccauuccucuucauau

SEQ ID NO: 68819 - RNA, 32 nt, Human
augacacaaagaaaaucaucaucccaucuuca

SEQ ID NO: 68820 - RNA, 32 nt, Human
augacacaacaaacauuuaucuugggugcaca

SEQ ID NO: 68821 - RNA, 26 nt, Human
augacacaaggggaggggacuuguca

SEQ ID NO: 68822 - RNA, 32 nt, Human
augacacagaacuauugcuaauguauaaaaca

SEQ ID NO: 68823 - RNA, 32 nt, Human
augacacagcacaacucuacagacagugaugu

SEQ ID NO: 68824 - RNA, 32 nt, Human
augacacaggaugaggaagauuaaggauaauc

SEQ ID NO: 68825 - RNA, 32 nt, Human
augacacauacagcuguacaaaguggggaaaa

SEQ ID NO: 68826 - RNA, 32 nt, Human
augacacauugauaacacaggucuuuauuccc

SEQ ID NO: 68827 - RNA, 32 nt, Human
augacaccaacugucaccacuaacucagagcc

SEQ ID NO: 68828 - RNA, 32 nt, Human
augacaccaagugcccggauaaagucagcuuc

SEQ ID NO: 68829 - RNA, 32 nt, Human
augacaccacugcacuccaaccuagguaacag

SEQ ID NO: 68830 - RNA, 32 nt, Human
augacaccaggauuugaaauaagacaggaaua

SEQ ID NO: 68831 - RNA, 32 nt, Human
augacaccaguuuuccugucaugacaagccuc

SEQ ID NO: 68832 - RNA, 32 nt, Human
augacaccaucaaaauuuaagaccaugaugaa

SEQ ID NO: 68833 - RNA, 32 nt, Human
augacaccaucccguuuccaagguugaacccu

SEQ ID NO: 68834 - RNA, 32 nt, Human
augacaccccagugaagacgguucuguccucc

SEQ ID NO: 68835 - RNA, 32 nt, Human
augacacccggagcuccugaaucaccugggga

SEQ ID NO: 68836 - RNA, 32 nt, Human
augacacccuugggcucccuccugccuccucu

SEQ ID NO: 68837 - RNA, 32 nt, Human
augacacugagggcagggagaagaaagaacac

SEQ ID NO: 68838 - RNA, 32 nt, Human
augacacugagugucagucauggagggacacg

SEQ ID NO: 68839 - RNA, 32 nt, Human
augacacugcacuccagccugggcaacagagc

SEQ ID NO: 68840 - RNA, 32 nt, Human
augacacugcacuccagccugggugauagagu

SEQ ID NO: 68841 - RNA, 32 nt, Human
augacacugcacuccagccuuggcaacaaagc

SEQ ID NO: 68842 - RNA, 32 nt, Human
augacacugcacuccagccuuggcaacagagu

SEQ ID NO: 68843 - RNA, 32 nt, Human
augacacugcccuccagccuggacaacagauu

SEQ ID NO: 68844 - RNA, 32 nt, Human
augacacugccucuauuucuauaaccauuuca

SEQ ID NO: 68845 - RNA, 19 nt, Human
augacacuggugacuugac

SEQ ID NO: 68846 - RNA, 32 nt, Human
augacacuuugaucuuggacuucccagccccu

SEQ ID NO: 68847 - RNA, 32 nt, Human
augacagaaaaaugaaaaguguuugaguucag

SEQ ID NO: 68848 - RNA, 32 nt, Human
augacagaaaagucuggaauaauguuuguuuu

SEQ ID NO: 68849 - RNA, 32 nt, Human
augacagaauuguccuggauuuugacuccauc

SEQ ID NO: 68850 - RNA, 32 nt, Human
augacagaccuccagcauccacgcaucucuug

SEQ ID NO: 68851 - RNA, 32 nt, Human
augacagauaauauguagaaauauucauaaag

SEQ ID NO: 68852 - RNA, 32 nt, Human
augacagaugaagaaggagcagaauaaauguu

SEQ ID NO: 68853 - RNA, 32 nt, Human
augacagcaccacugcacagagcuuugggagg

SEQ ID NO: 68854 - RNA, 32 nt, Human
augacagcaccacugcacuccagccaggaaug

SEQ ID NO: 68855 - RNA, 32 nt, Human
augacagcaccccugagcugggcaaagguacu

SEQ ID NO: 68856 - RNA, 32 nt, Human
augacagcaugugacccacacagccauccuag

SEQ ID NO: 68857 - RNA, 32 nt, Human
augacagccagccugacagcaccagucgcugg

SEQ ID NO: 68858 - RNA, 32 nt, Human
augacagccaugagucucacagaggaccccga

SEQ ID NO: 68859 - RNA, 32 nt, Human
augacagcccuaggaccuaacacccaccugcc

SEQ ID NO: 68860 - RNA, 32 nt, Human
augacagccucucccuacaagagaccaguagc

SEQ ID NO: 68861 - RNA, 32 nt, Human
augacagcggagagggggugauagcagcugag

SEQ ID NO: 68862 - RNA, 32 nt, Human
augacagcgucccauugagauuaugcugaugg

SEQ ID NO: 68863 - RNA, 32 nt, Human
augacaggcacuaggacgucugccuuuuuaag

SEQ ID NO: 68864 - RNA, 32 nt, Human
augacaggcaugagccaccgugcccggccggu

SEQ ID NO: 68865 - RNA, 32 nt, Human
augacaggcaugagccacgacgcccagccaca

SEQ ID NO: 68866 - RNA, 32 nt, Human
augacaggcgcacaccaccacgcccagcaaau

SEQ ID NO: 68867 - RNA, 32 nt, Human
augacaggcgcacaucaccacgcccagcugau

SEQ ID NO: 68868 - RNA, 32 nt, Human
augacaggcgugagccacagcucccagccuag

SEQ ID NO: 68869 - RNA, 32 nt, Human
augacaggcgugagccaccgcgcccagccuga

SEQ ID NO: 68870 - RNA, 32 nt, Human
augacaggcgugagccaccgcgcccggccuau

SEQ ID NO: 68871 - RNA, 32 nt, Human
augacaggcgugagccaccgcgccgggcccaa

SEQ ID NO: 68872 - RNA, 32 nt, Human
augacagggaacagcugcuggggagguggaga

SEQ ID NO: 68873 - RNA, 32 nt, Human
augacagggacgccugcgaggccaggcgggcg

SEQ ID NO: 68874 - RNA, 32 nt, Human
augacaggguagggagaugacaguggugcaug

SEQ ID NO: 68875 - RNA, 32 nt, Human
augacaggugcgagccacugcaccuggcccac

SEQ ID NO: 68876 - RNA, 32 nt, Human
augacaggugcuuuuauugucauuccagagcu

SEQ ID NO: 68877 - RNA, 32 nt, Human
augacaggugugagccaccgcccccggccccu

SEQ ID NO: 68878 - RNA, 32 nt, Human
augacaggugugagccacugcgcccagccuga

SEQ ID NO: 68879 - RNA, 32 nt, Human
augacagucuuccugcaaucccaugccugagu

SEQ ID NO: 68880 - RNA, 32 nt, Human
augacaguggacugcacgcuuggugcaucgug

SEQ ID NO: 68881 - RNA, 32 nt, Human
augacaguugugagccacugcgcccagccccu

SEQ ID NO: 68882 - RNA, 32 nt, Human
augacauacuucuccuuuguauucucucagug

SEQ ID NO: 68883 - RNA, 32 nt, Human
augacauauagcaaaggggucagggcaagugu

SEQ ID NO: 68884 - RNA, 32 nt, Human
augacaucacccaagaggaguauggagaauuc

SEQ ID NO: 68885 - RNA, 32 nt, Human
augacaucacccaggaugcaaugauccaaaag

SEQ ID NO: 68886 - RNA, 32 nt, Human
augacaucagccaggugacagcagcaggcagg

SEQ ID NO: 68887 - RNA, 32 nt, Human
augacaucauccauuuagucugugagucaaca

SEQ ID NO: 68888 - RNA, 32 nt, Human
augacauccuacucuucccucaccuuucuaca

SEQ ID NO: 68889 - RNA, 32 nt, Human
augacaucuguuuaaaaacaagcacaaccugc

SEQ ID NO: 68890 - RNA, 21 nt, Human
augacaugaaugcugcuaaag

SEQ ID NO: 68891 - RNA, 32 nt, Human
augacaugagccuggggagaccucauuugguu

SEQ ID NO: 68892 - RNA, 32 nt, Human
augacaugccacccucuccaugcccaaccuaa

SEQ ID NO: 68893 - RNA, 32 nt, Human
augacaugcccauucacuacagccuggaugac

SEQ ID NO: 68894 - RNA, 32 nt, Human
augacauggcuucugggguggagggugggggu

SEQ ID NO: 68895 - RNA, 32 nt, Human
augacauggggaggacaaagagagcucaagag

SEQ ID NO: 68896 - RNA, 32 nt, Human
augacaugggggacaguuggcagauggaguug

SEQ ID NO: 68897 - RNA, 32 nt, Human
augacauggugacacccgugcccagccugagc

SEQ ID NO: 68898 - RNA, 32 nt, Human
augacaugguuugcagaccacucuggacaugc

SEQ ID NO: 68899 - RNA, 30 nt, Human
augacaugucuguagcuaucagaaagagaa

SEQ ID NO: 68900 - RNA, 32 nt, Human
augacauguuaacugugugcccaggacagccg

SEQ ID NO: 68901 - RNA, 32 nt, Human
augacauucggaacagcaaagccauauaugca

SEQ ID NO: 68902 - RNA, 32 nt, Human
augacauucuuucuuccugccaccaaccacau

SEQ ID NO: 68903 - RNA, 32 nt, Human
augacauugucuuuaucauccuuuccccuuuc

SEQ ID NO: 68904 - RNA, 32 nt, Human
augacauuuaacauguugugaugcuugaaaac

SEQ ID NO: 68905 - RNA, 32 nt, Human
augacauuuucuggauacauuuugacaagagu

SEQ ID NO: 68906 - RNA, 16 nt, Human
augaccaacacgggga

SEQ ID NO: 68907 - RNA, 32 nt, Human
augaccaacauggagaaaccccgucucuacua

SEQ ID NO: 68908 - RNA, 32 nt, Human
augaccaacauggagaaccccaucucuacuaa

SEQ ID NO: 68909 - RNA, 32 nt, Human
augaccaacauggcgaaaccccaucucuacua

SEQ ID NO: 68910 - RNA, 32 nt, Human
augaccaacauggugaaacccugucucuacca

SEQ ID NO: 68911 - RNA, 32 nt, Human
augaccaagagcaggcuuccugcuccauggag

SEQ ID NO: 68912 - RNA, 32 nt, Human
augaccaaggacagcacccacuguugaagaug

SEQ ID NO: 68913 - RNA, 32 nt, Human
augaccaagggaauuaugcuguucauuuauaa

SEQ ID NO: 68914 - RNA, 32 nt, Human
augaccaauucgacuuccauacauacugcaug

SEQ ID NO: 68915 - RNA, 32 nt, Human
augaccacacugaaaauuacagaagugauaau

SEQ ID NO: 68916 - RNA, 32 nt, Human
augaccacauuguacaaaugaaucuguguuaa

SEQ ID NO: 68917 - RNA, 32 nt, Human
augaccaccugaagacagagaaaagggaaucu

SEQ ID NO: 68918 - RNA, 32 nt, Human
augaccacugcagccuccaccuccuaggcuca

SEQ ID NO: 68919 - RNA, 32 nt, Human
augaccagagccaaggcucacagaaaagacac

SEQ ID NO: 68920 - RNA, 32 nt, Human
augaccagaguucugugcauaacaggauccca

SEQ ID NO: 68921 - RNA, 32 nt, Human
augaccagcaguagacaaauggauacugagca

SEQ ID NO: 68922 - RNA, 32 nt, Human
augaccagccugggcaacauagcgagacugug

SEQ ID NO: 68923 - RNA, 32 nt, Human
augaccagcugcuuagucaccuggcaaagcag

SEQ ID NO: 68924 - RNA, 32 nt, Human
augaccauaccagugcauuccagccuggguac

SEQ ID NO: 68925 - RNA, 32 nt, Human
augaccauauuuacucuuucuaacuuucuuua

SEQ ID NO: 68926 - RNA, 32 nt, Human
augacccaaugccauuacagaaauuccauuac

SEQ ID NO: 68927 - RNA, 32 nt, Human
augacccacacaccucucaggggagccauggc

SEQ ID NO: 68928 - RNA, 25 nt, Human
augacccacgcccauuaugaugccg

SEQ ID NO: 68929 - RNA, 32 nt, Human
augacccagucccugggcacagguacagccac

SEQ ID NO: 68930 - RNA, 32 nt, Human
augacccauaguuaaugcuuucucuucaccag

SEQ ID NO: 68931 - RNA, 32 nt, Human
augacccauccagggcccuccccauggacacg

SEQ ID NO: 68932 - RNA, 32 nt, Human
augaccccacgucugacagccauguccaccug

SEQ ID NO: 68933 - RNA, 32 nt, Human
augaccccaggccccugcuccaccaggauguc

SEQ ID NO: 68934 - RNA, 32 nt, Human
augaccccaugucccagcuccccacacagcgc

SEQ ID NO: 68935 - RNA, 32 nt, Human
augacccccagccuggcuccauuccugguugu

SEQ ID NO: 68936 - RNA, 32 nt, Human
augacccccaggagugcugagguacaagaaag

SEQ ID NO: 68937 - RNA, 32 nt, Human
augacccccugccccugucaccaccccgagcu

SEQ ID NO: 68938 - RNA, 32 nt, Human
augacccugggugacaggaaagccuuucgaga

SEQ ID NO: 68939 - RNA, 32 nt, Human
augacccugguguuaucaucucccaggaucca

SEQ ID NO: 68940 - RNA, 32 nt, Human
augacccuugcaaucauggugcacagaauuaa

SEQ ID NO: 68941 - RNA, 32 nt, Human
augaccgagaugaccucuaugcugagcagaug

SEQ ID NO: 68942 - RNA, 32 nt, Human
augaccgcugcuucggagaagcucucgacccu

SEQ ID NO: 68943 - RNA, 32 nt, Human
augaccggcacuaguguuagccugcggaacgg

SEQ ID NO: 68944 - RNA, 32 nt, Human
augaccggguuucuuugaugcgaccucaggaa

SEQ ID NO: 68945 - RNA, 21 nt, Human
augaccuaggcacccuacgcu

SEQ ID NO: 68946 - RNA, 32 nt, Human
augaccuccugcugcaugucccuucccuuccc

SEQ ID NO: 68947 - RNA, 32 nt, Human
augaccucuagggaccagcccagacccaaggg

SEQ ID NO: 68948 - RNA, 32 nt, Human
augaccucuuuccuuguuuuguuuucaugcug

SEQ ID NO: 68949 - RNA, 32 nt, Human
augaccugcauccuuaauauccagugacuuca

SEQ ID NO: 68950 - RNA, 32 nt, Human
augaccugcucacugugucagcuguuuucccu

SEQ ID NO: 68951 - RNA, 32 nt, Human
augaccuggaaagaagggacaggcugaaaccg

SEQ ID NO: 68952 - RNA, 32 nt, Human
augaccuggcauguggaguuacagagggaucc

SEQ ID NO: 68953 - RNA, 32 nt, Human
augaccuggcucaaacuuaacuuggauuugaa

SEQ ID NO: 68954 - RNA, 32 nt, Human
augaccugguagaaggaagagaggcaaaggaa

SEQ ID NO: 68955 - RNA, 32 nt, Human
augaccuguaguucucugcuucauagaugcuu

SEQ ID NO: 68956 - RNA, 25 nt, Human
augaccugugucuguucucugggga

SEQ ID NO: 68957 - RNA, 32 nt, Human
augaccuguucaucuguggccauuccaucagg

SEQ ID NO: 68958 - RNA, 32 nt, Human
augaccuguucccauuuggaguacagugaugu

SEQ ID NO: 68959 - RNA, 32 nt, Human
augaccuuccaaacuuagaagacaucuauacu

SEQ ID NO: 68960 - RNA, 32 nt, Human
augaccuuccaaguaagcagaugggaacugaa

SEQ ID NO: 68961 - RNA, 32 nt, Human
augaccuuggauuacauaaggauuucuaugca

SEQ ID NO: 68962 - RNA, 24 nt, Human
augaccuugugauccacccaccuc

SEQ ID NO: 68963 - RNA, 22 nt, Human
augaccuugugauccgcccgcc

SEQ ID NO: 68964 - RNA, 32 nt, Human
augacgacauccucgaugaguccuccagcccc

SEQ ID NO: 68965 - RNA, 32 nt, Human
augacgacucacugcagccucaaccuccuggg

SEQ ID NO: 68966 - RNA, 32 nt, Human
augacgagcugcagagaacucagcaccaaggg

SEQ ID NO: 68967 - RNA, 32 nt, Human
augacgaugggcccugaaugccaagauucauu

SEQ ID NO: 68968 - RNA, 32 nt, Human
augacgauucugaugaugaguucugccaccgg

SEQ ID NO: 68969 - RNA, 32 nt, Human
augacgccauugcacuccagccuaggcaauaa

SEQ ID NO: 68970 - RNA, 32 nt, Human
augacgccauugcacuccagccugggugagaa

SEQ ID NO: 68971 - RNA, 32 nt, Human
augacgccugauggugcugcucaggcccaugc

SEQ ID NO: 68972 - RNA, 32 nt, Human
augacggauuagaauguauacacauguauacu

SEQ ID NO: 68973 - RNA, 32 nt, Human
augacggcaggagggcccugcuacucgcuuuu

SEQ ID NO: 68974 - RNA, 22 nt, Human
augacggcucaugccuguaauc

SEQ ID NO: 68975 - RNA, 32 nt, Human
augacgggaccccagaggugccgggugacagc

SEQ ID NO: 68976 - RNA, 32 nt, Human
augacgggccccuagccacacagcuguccuca

SEQ ID NO: 68977 - RNA, 32 nt, Human
augacgguccccaaggagaugcccgagaagug

SEQ ID NO: 68978 - RNA, 32 nt, Human
augacgguccugcaccuguuauaguagagaau

SEQ ID NO: 68979 - RNA, 32 nt, Human
augacggugccacugcacuccagcuuggguga

SEQ ID NO: 68980 - RNA, 32 nt, Human
augacgucagccaacccagcuggacuggccuu

SEQ ID NO: 68981 - RNA, 32 nt, Human
augacuaauuuuaaaagaaccugcccugaaaa

SEQ ID NO: 68982 - RNA, 21 nt, Human
augacuacacagaaucuccug

SEQ ID NO: 68983 - RNA, 32 nt, Human
augacuacagacauuaaauaaucgaaguaauu

SEQ ID NO: 68984 - RNA, 32 nt, Human
augacuacaucaauguuccugccugcaacucc

SEQ ID NO: 68985 - RNA, 32 nt, Human
augacuaccagcugguucgaaaauuaggccga

SEQ ID NO: 68986 - RNA, 32 nt, Human
augacuaccuauacauuauuucaagguuauuu

SEQ ID NO: 68987 - RNA, 32 nt, Human
augacuagcucuuugagccuguccucagagga

SEQ ID NO: 68988 - RNA, 32 nt, Human
augacuaugccacuguacuccagccuggguaa

SEQ ID NO: 68989 - RNA, 32 nt, Human
augacuaugccuggcccuggaguugcguacuu

SEQ ID NO: 68990 - RNA, 32 nt, Human
augacuauguucuucucccaaacaaggauuga

SEQ ID NO: 68991 - RNA, 32 nt, Human
augacucaauauuacaaccucuucuucucuua

SEQ ID NO: 68992 - RNA, 32 nt, Human
augacucacccaaccacauuuccuggggccuc

SEQ ID NO: 68993 - RNA, 32 nt, Human
augacucacugcagcacccccucccacuucgc

SEQ ID NO: 68994 - RNA, 26 nt, Human
augacucagagcgucugucuuuguau

SEQ ID NO: 68995 - RNA, 32 nt, Human
augacucaggcagggccccaggguggggugag

SEQ ID NO: 68996 - RNA, 31 nt, Human
augacucaguuucaguuaccugagccacagc

SEQ ID NO: 68997 - RNA, 32 nt, Human
augacuccacuguuuuucucuaaugcuugauu

SEQ ID NO: 68998 - RNA, 32 nt, Human
augacuccagaacaacaacugggaagaaacuu

SEQ ID NO: 68999 - RNA, 32 nt, Human
augacuccaugggagaaaaagaagaagccaaa

SEQ ID NO: 69000 - RNA, 28 nt, Human
augacucccacugcugccucuccugggc

SEQ ID NO: 69001 - RNA, 32 nt, Human
augacucccacugcugccucuccugggcaugg

SEQ ID NO: 69002 - RNA, 32 nt, Human
augacuccccuccccaacccccucaucuaaag

SEQ ID NO: 69003 - RNA, 32 nt, Human
augacucccuuucaaagucaaucuuuggaaaa

SEQ ID NO: 69004 - RNA, 32 nt, Human
augacucccuuucagggaaggcugggccucuu

SEQ ID NO: 69005 - RNA, 32 nt, Human
augacucccuuuuacuccccuaccccacauca

SEQ ID NO: 69006 - RNA, 32 nt, Human
augacuccuauuccuuucauuauugcuuugaa

SEQ ID NO: 69007 - RNA, 32 nt, Human
augacuccuuucucuuagugggcuacuauuua

SEQ ID NO: 69008 - RNA, 32 nt, Human
augacucucacagaugaaggccuagacgcagg

SEQ ID NO: 69009 - RNA, 32 nt, Human
augacucucccccauuucccaggucucugggu

SEQ ID NO: 69010 - RNA, 32 nt, Human
augacucucuacugccucaaccucucaggccc

SEQ ID NO: 69011 - RNA, 22 nt, Human
augacugaaagugacuuccgua

SEQ ID NO: 69012 - RNA, 32 nt, Human
augacugaacgaauuuguuuauuucccauuag

SEQ ID NO: 69013 - RNA, 32 nt, Human
augacugagcaggcccagccccagaggacaag

SEQ ID NO: 69014 - RNA, 32 nt, Human
augacugauacagguuuagcuuugugugaaaa

SEQ ID NO: 69015 - RNA, 32 nt, Human
augacugaucaaaggcaggcgauacuuccugu

SEQ ID NO: 69016 - RNA, 32 nt, Human
augacugcacuccagccugggugacagacccu

SEQ ID NO: 69017 - RNA, 32 nt, Human
augacugcacuccagccugggugacagagcaa

SEQ ID NO: 69018 - RNA, 32 nt, Human
augacugcaguggagccaguaccggcuguagu

SEQ ID NO: 69019 - RNA, 32 nt, Human
augacugcauagggaccaacacugccugacuu

SEQ ID NO: 69020 - RNA, 32 nt, Human
augacugcaucacugcacuccagccugggcaa

SEQ ID NO: 69021 - RNA, 32 nt, Human
augacugcauuuguuccugccugccucggcgg

SEQ ID NO: 69022 - RNA, 32 nt, Human
augacugccaggcacggagcagguguggagga

SEQ ID NO: 69023 - RNA, 32 nt, Human
augacugcgcuccacacauacaucauugcccg

SEQ ID NO: 69024 - RNA, 32 nt, Human
augacugcucacugcagccuccaccuccuggg

SEQ ID NO: 69025 - RNA, 32 nt, Human
augacugcucaggccucaccucccagggcuac

SEQ ID NO: 69026 - RNA, 32 nt, Human
augacugcuugaaauagucucucucccaugga

SEQ ID NO: 69027 - RNA, 32 nt, Human
augacuggaaugugacuagugaucucaggaga

SEQ ID NO: 69028 - RNA, 32 nt, Human
augacuggagagaagugagaagacucccagaa

SEQ ID NO: 69029 - RNA, 32 nt, Human
augacuguaaccuaggcugagccaagaaugga

SEQ ID NO: 69030 - RNA, 32 nt, Human
augacugugaaaagcugcaauauuuccaaugu

SEQ ID NO: 69031 - RNA, 32 nt, Human
augacugugaaccagaacagacugccucgcug

SEQ ID NO: 69032 - RNA, 32 nt, Human
augacugugccacugcaccucuagucugggug

SEQ ID NO: 69033 - RNA, 32 nt, Human
augacugugccacugcacuccagccuggucaa

SEQ ID NO: 69034 - RNA, 32 nt, Human
augacuguggugucaucuaaaaggcagaggug

SEQ ID NO: 69035 - RNA, 32 nt, Human
augacugugguguggagggagugagccagcag

SEQ ID NO: 69036 - RNA, 32 nt, Human
augacuguuccagagagcgggcagaccuggca

SEQ ID NO: 69037 - RNA, 32 nt, Human
augacuguugcugcacuccagccugagugaca

SEQ ID NO: 69038 - RNA, 32 nt, Human
augacuguuuauggaaaguaucuuuaauaaag

SEQ ID NO: 69039 - RNA, 32 nt, Human
augacuuagagaagaagaugcaaagaggcgaa

SEQ ID NO: 69040 - RNA, 32 nt, Human
augacuuagcugacuuguggcagcggggcaag

SEQ ID NO: 69041 - RNA, 32 nt, Human
augacuucagccuguaaugcugugagugcuuu

SEQ ID NO: 69042 - RNA, 32 nt, Human
augacuucaugcuauggaggugauucugauuc

SEQ ID NO: 69043 - RNA, 32 nt, Human
augacuuccucaaacugacaccaucuuaauua

SEQ ID NO: 69044 - RNA, 32 nt, Human
augacuuccugccucccugccuugugacugau

SEQ ID NO: 69045 - RNA, 32 nt, Human
augacuucgucuaugacuguaacugaguggcc

SEQ ID NO: 69046 - RNA, 32 nt, Human
augacuucucuggccaguuugccuuccacgug

SEQ ID NO: 69047 - RNA, 32 nt, Human
augacuugagcccaggaggaggaggcugcagu

SEQ ID NO: 69048 - RNA, 22 nt, Human
augacuugaggagaaacuuuua

SEQ ID NO: 69049 - RNA, 32 nt, Human
augacuugcccaggguaaaacaguccauggca

SEQ ID NO: 69050 - RNA, 32 nt, Human
augacuugcccuuucuaaaguggcaucucagc

SEQ ID NO: 69051 - RNA, 32 nt, Human
augacuugcugguucuaacuuucaauuuaaaa

SEQ ID NO: 69052 - RNA, 32 nt, Human
augacuuguucauuuuucucucccucuuuuuc

SEQ ID NO: 69053 - RNA, 32 nt, Human
augacuuguuuuugaaugcaggcaguauuuag

SEQ ID NO: 69054 - RNA, 32 nt, Human
augacuuuaccuccauucccucuacccagaac

SEQ ID NO: 69055 - RNA, 32 nt, Human
augacuuuacuaccugcagaacugcacuauaa

SEQ ID NO: 69056 - RNA, 32 nt, Human
augacuuucagugcagauucauagcuaaccca

SEQ ID NO: 69057 - RNA, 32 nt, Human
augacuuucccuaggcugagggcaguggaccc

SEQ ID NO: 69058 - RNA, 20 nt, Human
augacuuucuaguaccaaag

SEQ ID NO: 69059 - RNA, 32 nt, Human
augacuuugaaaggcaaaagaggaaucaagaa

SEQ ID NO: 69060 - RNA, 25 nt, Human
augacuuugagguucauccauguca

SEQ ID NO: 69061 - RNA, 25 nt, Human
augacuuugugguuuacccccuuca

SEQ ID NO: 69062 - RNA, 32 nt, Human
augacuuuguuuggaaacccuuuuggaggcac

SEQ ID NO: 69063 - RNA, 32 nt, Human
augacuuuuagauaugagaugacgggaagcag

SEQ ID NO: 69064 - RNA, 32 nt, Human
augacuuuuccauugaccagcucucuuccugu

SEQ ID NO: 69065 - RNA, 32 nt, Human
augacuuuucuccccagcuccaaaccucauau

SEQ ID NO: 69066 - RNA, 32 nt, Human
augacuuuugugccuuucugcuccagucucaa

SEQ ID NO: 69067 - RNA, 32 nt, Human
augagaaaaaugucgcaggagguuugcucguu

SEQ ID NO: 69068 - RNA, 32 nt, Human
augagaaaacaguucuauaaguccaggguuaa

SEQ ID NO: 69069 - RNA, 19 nt, Human
augagaaaacauauucuga

SEQ ID NO: 69070 - RNA, 19 nt, Human
augagaaaagccagccagg

SEQ ID NO: 69071 - RNA, 32 nt, Human
augagaaaagccuccuggugcaucuucaaaau

SEQ ID NO: 69072 - RNA, 32 nt, Human
augagaaaaggacagagcucuaauugauaacu

SEQ ID NO: 69073 - RNA, 32 nt, Human
augagaaaauggagguuuauggucuguucuca

SEQ ID NO: 69074 - RNA, 32 nt, Human
augagaaacugugacagaucugugucaauuaa

SEQ ID NO: 69075 - RNA, 32 nt, Human
augagaaagagggaagaagaagaagggaugau

SEQ ID NO: 69076 - RNA, 32 nt, Human
augagaaagccgacugugccagucccagccgc

SEQ ID NO: 69077 - RNA, 32 nt, Human
augagaaagcuaaacaugaaauauaaugaaua

SEQ ID NO: 69078 - RNA, 18 nt, Human
augagaaaggcccagggg

SEQ ID NO: 69079 - RNA, 32 nt, Human
augagaaaguccugugcaguccugagaugauu

SEQ ID NO: 69080 - RNA, 32 nt, Human
augagaaauggaagaugagaacucccuaagag

SEQ ID NO: 69081 - RNA, 32 nt, Human
augagaacaaauguacaaauauaaagaaagua

SEQ ID NO: 69082 - RNA, 32 nt, Human
augagaacagaggcacaggugccggcccugca

SEQ ID NO: 69083 - RNA, 20 nt, Human
augagaacagcacauucuga

SEQ ID NO: 69084 - RNA, 32 nt, Human
augagaacccgcugauaccauucuaaguccgc

SEQ ID NO: 69085 - RNA, 32 nt, Human
augagaacuagaaaggaaacaagagcauagga

SEQ ID NO: 69086 - RNA, 32 nt, Human
augagaacucaacuccuggcuccugggacugc

SEQ ID NO: 69087 - RNA, 32 nt, Human
augagaacugacacaacuuugccuuaaagagu

SEQ ID NO: 69088 - RNA, 24 nt, Human
augagaagaagcucagagcagagc

SEQ ID NO: 69089 - RNA, 22 nt, Human
augagaagaauucaucugggac

SEQ ID NO: 69090 - RNA, 32 nt, Human
augagaagacagagucuccuaguuuuguaucu

SEQ ID NO: 69091 - RNA, 32 nt, Human
augagaagagguggggaguggaagcggggaug

SEQ ID NO: 69092 - RNA, 32 nt, Human
augagaagcucacgcagagaacauucuggcug

SEQ ID NO: 69093 - RNA, 32 nt, Human
augagaagcuuuuauuuaaaacugauauauuu

SEQ ID NO: 69094 - RNA, 22 nt, Human
augagaaggaggaggacagcgc

SEQ ID NO: 69095 - RNA, 32 nt, Human
augagaaggaggaggacagcgccgaggaggaa

SEQ ID NO: 69096 - RNA, 32 nt, Human
augagaagggcacugcccucccucacccauau

SEQ ID NO: 69097 - RNA, 32 nt, Human
augagaauauggccaucaccugaaaaguuuuc

SEQ ID NO: 69098 - RNA, 32 nt, Human
augagaaucaguggguuugaggugggcccaag

SEQ ID NO: 69099 - RNA, 32 nt, Human
augagaaugaguugccuccacccugucccaac

SEQ ID NO: 69100 - RNA, 32 nt, Human
augagaaugccucuguguuugugagugugaga

SEQ ID NO: 69101 - RNA, 32 nt, Human
augagaauugagcuuaaauagaugugggugga

SEQ ID NO: 69102 - RNA, 21 nt, Human
augagacaaaaguuguuucca

SEQ ID NO: 69103 - RNA, 32 nt, Human
augagacaauacaggcaucacuggcagaggau

SEQ ID NO: 69104 - RNA, 32 nt, Human
augagacagaaaugaggagacacaccugaggc

SEQ ID NO: 69105 - RNA, 32 nt, Human
augagacagaacuugucacaaagacagcugau

SEQ ID NO: 69106 - RNA, 32 nt, Human
augagacagagugccuaagagaaacccuugca

SEQ ID NO: 69107 - RNA, 32 nt, Human
augagacaggaagcuguucacugugaaacagu

SEQ ID NO: 69108 - RNA, 31 nt, Human
augagacagguccucaggccuguguuccaag

SEQ ID NO: 69109 - RNA, 30 nt, Human
augagacauaaauuucuguuguguauaagc

SEQ ID NO: 69110 - RNA, 32 nt, Human
augagacaucuuuccagggguagaaggguuag

SEQ ID NO: 69111 - RNA, 32 nt, Human
augagaccaacaccugucugugccucaaugcc

SEQ ID NO: 69112 - RNA, 32 nt, Human
augagaccaagagggaggaggggaaggacucc

SEQ ID NO: 69113 - RNA, 32 nt, Human
augagaccaggcguucaagaccagccuggcca

SEQ ID NO: 69114 - RNA, 32 nt, Human
augagaccucccacuccuggggccagaaggag

SEQ ID NO: 69115 - RNA, 32 nt, Human
augagaccuuaguguucuccaggcucuguggc

SEQ ID NO: 69116 - RNA, 25 nt, Human
augagacgacuccggcacagagaag

SEQ ID NO: 69117 - RNA, 32 nt, Human
augagacuccuggaaacugggugggaauuggc

SEQ ID NO: 69118 - RNA, 32 nt, Human
augagacugaagacaucaagaaauaaggaggg

SEQ ID NO: 69119 - RNA, 32 nt, Human
augagacugauuagggaggggauuugcacagg

SEQ ID NO: 69120 - RNA, 32 nt, Human
augagacugcaggagagagagcagcggagggc

SEQ ID NO: 69121 - RNA, 32 nt, Human
augagacugcuggcgggcuggcugugccugag

SEQ ID NO: 69122 - RNA, 21 nt, Human
augagacugggcacagccuga

SEQ ID NO: 69123 - RNA, 32 nt, Human
augagacuucuccaagcugcuucacaagcaaa

SEQ ID NO: 69124 - RNA, 20 nt, Human
augagagaagggacacauuc

SEQ ID NO: 69125 - RNA, 32 nt, Human
augagagaauccugccucuguagaccaacauc

SEQ ID NO: 69126 - RNA, 22 nt, Human
augagagaaugguacuuaggga

SEQ ID NO: 69127 - RNA, 32 nt, Human
augagagacauauaaucuccacccucacggag

SEQ ID NO: 69128 - RNA, 32 nt, Human
augagagaccuccaggugguccuucuggggag

SEQ ID NO: 69129 - RNA, 32 nt, Human
augagagagaaauagcaaauguucuuucuaug

SEQ ID NO: 69130 - RNA, 32 nt, Human
augagagagcccagagggaggaagaagccaga

SEQ ID NO: 69131 - RNA, 24 nt, Human
augagagauuugggagagcugagc

SEQ ID NO: 69132 - RNA, 32 nt, Human
augagagcacuuuucauugacugugaacuuuu

SEQ ID NO: 69133 - RNA, 32 nt, Human
augagagcaguuuuuagcgaguauuuuagugg

SEQ ID NO: 69134 - RNA, 32 nt, Human
augagagccaacacaugcucacugccagcucc

SEQ ID NO: 69135 - RNA, 32 nt, Human
augagagcccugcaccuggccagagugucaca

SEQ ID NO: 69136 - RNA, 32 nt, Human
augagagccugacagacccuucaaaguuggac

SEQ ID NO: 69137 - RNA, 32 nt, Human
augagagcucagauggagauggugcuagaaga

SEQ ID NO: 69138 - RNA, 32 nt, Human
augagagcugcacucuggcuggggaaggcaug

SEQ ID NO: 69139 - RNA, 20 nt, Human
augagaggaaggagauagag

SEQ ID NO: 69140 - RNA, 32 nt, Human
augagaggagaaagccauccugccuggugugu

SEQ ID NO: 69141 - RNA, 15 nt, Human
augagaggcacacug

SEQ ID NO: 69142 - RNA, 32 nt, Human
augagaggccaucuaucccagccugggugauc

SEQ ID NO: 69143 - RNA, 32 nt, Human
augagaggccuauggcugcucuccaaucccgg

SEQ ID NO: 69144 - RNA, 32 nt, Human
augagaggcuguggcagcaggagacucugcgg

SEQ ID NO: 69145 - RNA, 23 nt, Human
augagagggaagagaaaacaagu

SEQ ID NO: 69146 - RNA, 24 nt, Human
augagagggaagagauagcauggc

SEQ ID NO: 69147 - RNA, 32 nt, Human
augagagggaagagauagcauggcaugcagca

SEQ ID NO: 69148 - RNA, 20 nt, Human
augagagggaagugggcaga

SEQ ID NO: 69149 - RNA, 20 nt, Human
augagagggagaagcggcag

SEQ ID NO: 69150 - RNA, 32 nt, Human
augagagggagaccggcaugcuuuguccucac

SEQ ID NO: 69151 - RNA, 32 nt, Human
augagagggagggagaggagagagagugcgag

SEQ ID NO: 69152 - RNA, 32 nt, Human
augagaggggaaguggugggggagacauagcc

SEQ ID NO: 69153 - RNA, 32 nt, Human
augagaggggcaggaagugggguccagacagg

SEQ ID NO: 69154 - RNA, 32 nt, Human
augagaggggugaggucucuguggaaggacag

SEQ ID NO: 69155 - RNA, 32 nt, Human
augagagguauuucaaaaugagugaagcauga

SEQ ID NO: 69156 - RNA, 23 nt, Human
augagagguuauggaaagcagag

SEQ ID NO: 69157 - RNA, 32 nt, Human
augagagguuuagcacuuaagaucagauucaa

SEQ ID NO: 69158 - RNA, 32 nt, Human
augagaguugcugguagcaggcucccuccuuc

SEQ ID NO: 69159 - RNA, 32 nt, Human
augagaguuucacacaccagcccauagguggg

SEQ ID NO: 69160 - RNA, 32 nt, Human
augagauaagccugcaaccucuugaccuucag

SEQ ID NO: 69161 - RNA, 32 nt, Human
augagauacccaguuuaucuuucacaaugagc

SEQ ID NO: 69162 - RNA, 32 nt, Human
augagaucaggaguucgagaccagccuggcca

SEQ ID NO: 69163 - RNA, 32 nt, Human
augagaucagugcuucaacauccagguugacg

SEQ ID NO: 69164 - RNA, 32 nt, Human
augagauccaggcuggagcggcugugccagag

SEQ ID NO: 69165 - RNA, 32 nt, Human
augagaucgggccacacuugagcugagucacc

SEQ ID NO: 69166 - RNA, 32 nt, Human
augagaucucgcuauguugcccaggccagucu

SEQ ID NO: 69167 - RNA, 32 nt, Human
augagaucuggcuguugaagacauggugaccc

SEQ ID NO: 69168 - RNA, 32 nt, Human
augagaugacugccauguacacugcagucaag

SEQ ID NO: 69169 - RNA, 32 nt, Human
augagaugagcugaguuauagagagaaaggga

SEQ ID NO: 69170 - RNA, 32 nt, Human
augagaugccguaccuccucuggaccaucaag

SEQ ID NO: 69171 - RNA, 32 nt, Human
augagauggauuggaaguggccagcagcaagu

SEQ ID NO: 69172 - RNA, 30 nt, Human
augagaugggauucuccaacauggaagaug

SEQ ID NO: 69173 - RNA, 32 nt, Human
augagaugggauucuccaacauggaagaugau

SEQ ID NO: 69174 - RNA, 32 nt, Human
augagauuccagguccugagagcugcuuugag

SEQ ID NO: 69175 - RNA, 32 nt, Human
augagauucccuaucuccuuuuagaccuggga

SEQ ID NO: 69176 - RNA, 32 nt, Human
augagauugccuuccuauauccuuccuuguuc

SEQ ID NO: 69177 - RNA, 29 nt, Human
augagauugcuguguguugccugggacac

SEQ ID NO: 69178 - RNA, 21 nt, Human
augagauuuaaauucuguggg

SEQ ID NO: 69179 - RNA, 32 nt, Human
augagcaaaugcugucauuagcaaccaugcau

SEQ ID NO: 69180 - RNA, 32 nt, Human
augagcaacucuauucauuccuugccaugugg

SEQ ID NO: 69181 - RNA, 32 nt, Human
augagcaaggagaagcgagaggcugucaguaa

SEQ ID NO: 69182 - RNA, 32 nt, Human
augagcaaguguccuaagcuaugucauccaaa

SEQ ID NO: 69183 - RNA, 32 nt, Human
augagcacccagagauggaggaagggucagcc

SEQ ID NO: 69184 - RNA, 26 nt, Human
augagcaccccuguuuucucuggaga

SEQ ID NO: 69185 - RNA, 32 nt, Human
augagcaccuccaggagccucaguuucgccuu

SEQ ID NO: 69186 - RNA, 32 nt, Human
augagcaccugggcacagguuggggcucugca

SEQ ID NO: 69187 - RNA, 32 nt, Human
augagcacuggagggcagaggccucagugucc

SEQ ID NO: 69188 - RNA, 32 nt, Human
augagcagaccagcagguacguagugggagag

SEQ ID NO: 69189 - RNA, 32 nt, Human
augagcagagacacgaacccagagccagugcc

SEQ ID NO: 69190 - RNA, 32 nt, Human
augagcagaggcaccuuuagaagaaauaaugu

SEQ ID NO: 69191 - RNA, 32 nt, Human
augagcagcacuggagccugguaaaugcagau

SEQ ID NO: 69192 - RNA, 32 nt, Human
augagcagccgagccugcuaaccgcagcuccg

SEQ ID NO: 69193 - RNA, 32 nt, Human
augagcagccugccuugaacccucucucucac

SEQ ID NO: 69194 - RNA, 32 nt, Human
augagcaggcagcagcagggcauggccccauc

SEQ ID NO: 69195 - RNA, 32 nt, Human
augagcaggggcugggaguagaggguuucugg

SEQ ID NO: 69196 - RNA, 23 nt, Human
augagcagucuccuuacugaagg

SEQ ID NO: 69197 - RNA, 22 nt, Human
augagcagucuguuguugcaga

SEQ ID NO: 69198 - RNA, 22 nt, Human
augagcagugauuuucuuagga

SEQ ID NO: 69199 - RNA, 32 nt, Human
augagcaguugugggaagagccauagguauuu

SEQ ID NO: 69200 - RNA, 32 nt, Human
augagcauaguauguggauagguaucuucacc

SEQ ID NO: 69201 - RNA, 32 nt, Human
augagcaucaaaccaccauggauuucauaauc

SEQ ID NO: 69202 - RNA, 32 nt, Human
augagcauuaaauauauuuggaauagcagaag

SEQ ID NO: 69203 - RNA, 30 nt, Human
augagcauuuccuuugagcaucaugccugc

SEQ ID NO: 69204 - RNA, 32 nt, Human
augagccaacagcaccggauccacagaauguu

SEQ ID NO: 69205 - RNA, 32 nt, Human
augagccaagcccucacuguacagaagaguga

SEQ ID NO: 69206 - RNA, 32 nt, Human
augagccaaguaaaccucuuuucuuuauaaau

SEQ ID NO: 69207 - RNA, 32 nt, Human
augagccaaguggcagcuaaaaguugggggug

SEQ ID NO: 69208 - RNA, 32 nt, Human
augagccaauuaaaccucuuuucuuuauaaau

SEQ ID NO: 69209 - RNA, 32 nt, Human
augagccacaacaucaccacccugccacuuac

SEQ ID NO: 69210 - RNA, 32 nt, Human
augagccacaguugagaagcggaggggccagc

SEQ ID NO: 69211 - RNA, 32 nt, Human
augagccaccgcacccagccucucuugugcuu

SEQ ID NO: 69212 - RNA, 32 nt, Human
augagccaccugcccagccauguuuggggcuu

SEQ ID NO: 69213 - RNA, 32 nt, Human
augagccacugcaccagccccaggggucuaau

SEQ ID NO: 69214 - RNA, 32 nt, Human
augagccacugcacccaaccccuggaaaacua

SEQ ID NO: 69215 - RNA, 32 nt, Human
augagccacugcacccagcaaugaguagucuu

SEQ ID NO: 69216 - RNA, 32 nt, Human
augagccacugcacccagccaagugaucauuu

SEQ ID NO: 69217 - RNA, 32 nt, Human
augagccacugcacccagcccuguauucuuau

SEQ ID NO: 69218 - RNA, 32 nt, Human
augagccacugcacccagccgauaggaaguuu

SEQ ID NO: 69219 - RNA, 32 nt, Human
augagccacugcacccagccuuggcgggcauc

SEQ ID NO: 69220 - RNA, 32 nt, Human
augagccacugcacccggccaagucuuugguc

SEQ ID NO: 69221 - RNA, 32 nt, Human
augagccacugcacccggcccugagaauauau

SEQ ID NO: 69222 - RNA, 32 nt, Human
augagccacugcacccggccgguggaaagcau

SEQ ID NO: 69223 - RNA, 32 nt, Human
augagccacugcaccugaccugcugaauuguu

SEQ ID NO: 69224 - RNA, 32 nt, Human
augagccacugcaccuggccuacguauuaggc

SEQ ID NO: 69225 - RNA, 32 nt, Human
augagccacugcaccuggccuaggacuggugu

SEQ ID NO: 69226 - RNA, 32 nt, Human
augagccacugcaccuggccuguguauuguuu

SEQ ID NO: 69227 - RNA, 32 nt, Human
augagccacugcacucaaccuuaagaccuacu

SEQ ID NO: 69228 - RNA, 32 nt, Human
augagccacugcauccggccuguuaaggauuu

SEQ ID NO: 69229 - RNA, 32 nt, Human
augagccacugcgcccggccugggucuccguu

SEQ ID NO: 69230 - RNA, 32 nt, Human
augagccacuguccccggccuccuggcuuccu

SEQ ID NO: 69231 - RNA, 32 nt, Human
augagccacugugcccagccuaguuucuuuuc

SEQ ID NO: 69232 - RNA, 32 nt, Human
augagccacuuuccucuccaggugaaggcagg

SEQ ID NO: 69233 - RNA, 32 nt, Human
augagccaggacagcgggaagcagggauggcc

SEQ ID NO: 69234 - RNA, 32 nt, Human
augagccaggcccugggcugggccuccacuuc

SEQ ID NO: 69235 - RNA, 32 nt, Human
augagccagucaccaucccaugauaugaaagu

SEQ ID NO: 69236 - RNA, 32 nt, Human
augagccaugaagccgcccggcagcagcucgc

SEQ ID NO: 69237 - RNA, 32 nt, Human
augagcccagccccagcucaccugccaaucca

SEQ ID NO: 69238 - RNA, 32 nt, Human
augagcccagccuguuaaaaacaaaugacccc

SEQ ID NO: 69239 - RNA, 32 nt, Human
augagcccaggagguugaggcugcagugaggu

SEQ ID NO: 69240 - RNA, 32 nt, Human
augagcccagguauucaagaccagccugggaa

SEQ ID NO: 69241 - RNA, 32 nt, Human
augagccccacagccugcacagcagcucugaa

SEQ ID NO: 69242 - RNA, 15 nt, Human
augagccccuguucu

SEQ ID NO: 69243 - RNA, 31 nt, Human
augagccggcacuucauuccuuuuuauaaug

SEQ ID NO: 69244 - RNA, 32 nt, Human
augagccgugaaugggggcagagccagauccu

SEQ ID NO: 69245 - RNA, 32 nt, Human
augagccgugcugcugggcacagccaggcaca

SEQ ID NO: 69246 - RNA, 32 nt, Human
augagccguugugcuccagccugggcgacaga

SEQ ID NO: 69247 - RNA, 32 nt, Human
augagccuaguagaauauggacuuggaaaauu

SEQ ID NO: 69248 - RNA, 32 nt, Human
augagccuauguugacucacuggguggggguc

SEQ ID NO: 69249 - RNA, 32 nt, Human
augagccuauguugacucacuggguggggucc

SEQ ID NO: 69250 - RNA, 32 nt, Human
augagccuccaccaccuccucuuugugacauc

SEQ ID NO: 69251 - RNA, 32 nt, Human
augagccucccacccucaccucccagacccug

SEQ ID NO: 69252 - RNA, 32 nt, Human
augagccucuccccagguguauuucagcagac

SEQ ID NO: 69253 - RNA, 32 nt, Human
augagccucugccuggccccugcugcuguccu

SEQ ID NO: 69254 - RNA, 32 nt, Human
augagccugcagcauuuguccaccugucccac

SEQ ID NO: 69255 - RNA, 32 nt, Human
augagccuggcuuggggguugguggggcucug

SEQ ID NO: 69256 - RNA, 32 nt, Human
augagccuguguucccagcugcuuaggaggcu

SEQ ID NO: 69257 - RNA, 32 nt, Human
augagccuucuuucugcccuccagauccacgg

SEQ ID NO: 69258 - RNA, 25 nt, Human
augagcgagguggaggcggcagcgg

SEQ ID NO: 69259 - RNA, 32 nt, Human
augagcgccuuccugcagaacacacagugccu

SEQ ID NO: 69260 - RNA, 32 nt, Human
augagcggguucccuggauagaaggagucuuc

SEQ ID NO: 69261 - RNA, 32 nt, Human
augagcggugagacgaacaaaagggaaaggaa

SEQ ID NO: 69262 - RNA, 32 nt, Human
augagcuaccucccucuuuucauaaaguauuu

SEQ ID NO: 69263 - RNA, 32 nt, Human
augagcuacugugcccagccucuaugauuuca

SEQ ID NO: 69264 - RNA, 32 nt, Human
augagcuagcugguguggguuccaaccauagg

SEQ ID NO: 69265 - RNA, 32 nt, Human
augagcuaggaacccuggacgaaaccaacaca

SEQ ID NO: 69266 - RNA, 32 nt, Human
augagcuagugaguggguacaggaagcccggg

SEQ ID NO: 69267 - RNA, 32 nt, Human
augagcuauuaaaacucagccugggacaguuu

SEQ ID NO: 69268 - RNA, 32 nt, Human
augagcucaagugauccucccaccucagccua

SEQ ID NO: 69269 - RNA, 32 nt, Human
augagcucacaguccaggucucuugcugugug

SEQ ID NO: 69270 - RNA, 32 nt, Human
augagcucaguacuugcccugugaaaauccca

SEQ ID NO: 69271 - RNA, 32 nt, Human
augagcucaucaagcucuaucuguaccuguga

SEQ ID NO: 69272 - RNA, 32 nt, Human
augagcuccucuuccuggcuucuuacugaaag

SEQ ID NO: 69273 - RNA, 32 nt, Human
augagcucucgguggaugaggcugcaguccau

SEQ ID NO: 69274 - RNA, 32 nt, Human
augagcucuugcuauguugcccaggcuggucu

SEQ ID NO: 69275 - RNA, 32 nt, Human
augagcugaguagaucacuuuaaggaugaaaa

SEQ ID NO: 69276 - RNA, 32 nt, Human
augagcugaucuguaagucacucugccccagg

SEQ ID NO: 69277 - RNA, 32 nt, Human
augagcugcacguuggaggggaagugaauuca

SEQ ID NO: 69278 - RNA, 32 nt, Human
augagcugcaguccccaggccaugagccuccc

SEQ ID NO: 69279 - RNA, 25 nt, Human
augagcugccuccauagggaaccca

SEQ ID NO: 69280 - RNA, 32 nt, Human
augagcuggagaagggcccucuggccuccuga

SEQ ID NO: 69281 - RNA, 32 nt, Human
augagcuggaggagggaggaguaaggccuugg

SEQ ID NO: 69282 - RNA, 32 nt, Human
augagcuggaguggggaugacaagacuugugu

SEQ ID NO: 69283 - RNA, 32 nt, Human
augagcuggcuucguccuucccucucuacaga

SEQ ID NO: 69284 - RNA, 32 nt, Human
augagcugggcccugggugaggugggggucug

SEQ ID NO: 69285 - RNA, 32 nt, Human
augagcugggcuguggugcagagcaagcagac

SEQ ID NO: 69286 - RNA, 32 nt, Human
augagcuggguacugacugagauaagaaaagc

SEQ ID NO: 69287 - RNA, 32 nt, Human
augagcugguugccagccuugcucugaggggc

SEQ ID NO: 69288 - RNA, 32 nt, Human
augagcugugugugaauguacguguaucaguc

SEQ ID NO: 69289 - RNA, 32 nt, Human
augagcuucacacccgaggagcuggcccagga

SEQ ID NO: 69290 - RNA, 32 nt, Human
augagcuucaccacucgucugccuccuguguc

SEQ ID NO: 69291 - RNA, 24 nt, Human
augagcuugcuguuucuuugaugg

SEQ ID NO: 69292 - RNA, 32 nt, Human
augagcuuuaagugccugucguucugaaaauu

SEQ ID NO: 69293 - RNA, 32 nt, Human
augaggaaaaagaggaaaacaagugggacacu

SEQ ID NO: 69294 - RNA, 32 nt, Human
augaggaaaaagagguaauaucagggcuucug

SEQ ID NO: 69295 - RNA, 32 nt, Human
augaggaaaaugucacagaauaaauuuauauu

SEQ ID NO: 69296 - RNA, 32 nt, Human
augaggaaaccaggcacgggagagggaggggc

SEQ ID NO: 69297 - RNA, 23 nt, Human
augaggaaacugaggcucagggg

SEQ ID NO: 69298 - RNA, 21 nt, Human
augaggaaauacuguuucuaa

SEQ ID NO: 69299 - RNA, 23 nt, Human
augaggaacaagacuuuuucuaa

SEQ ID NO: 69300 - RNA, 23 nt, Human
augaggaacagaagaagcagagc

SEQ ID NO: 69301 - RNA, 32 nt, Human
augaggaagaggagagagaagagauggacaga

SEQ ID NO: 69302 - RNA, 32 nt, Human
augaggaagauaaggcccaaggaggugaaaug

SEQ ID NO: 69303 - RNA, 19 nt, Human
augaggaagaucuugugga

SEQ ID NO: 69304 - RNA, 32 nt, Human
augaggaagauggcaguggccaccggaggacu

SEQ ID NO: 69305 - RNA, 17 nt, Human
augaggaagggcccugg

SEQ ID NO: 69306 - RNA, 32 nt, Human
augaggaagugagcucagggaggcugaguguc

SEQ ID NO: 69307 - RNA, 32 nt, Human
augaggaagugcccaagucuuccuucgggaag

SEQ ID NO: 69308 - RNA, 32 nt, Human
augaggaauaagaauggagauguuacaucugg

SEQ ID NO: 69309 - RNA, 32 nt, Human
augaggaaugcuucccacauccuugaaagaaa

SEQ ID NO: 69310 - RNA, 32 nt, Human
augaggacaccucagugacaaacacaccuuuu

SEQ ID NO: 69311 - RNA, 32 nt, Human
augaggacagaagauauucugauaagagagaa

SEQ ID NO: 69312 - RNA, 32 nt, Human
augaggacagcauugggcaacacuccuucugg

SEQ ID NO: 69313 - RNA, 32 nt, Human
augaggacagcugcagagguggcagugugugg

SEQ ID NO: 69314 - RNA, 32 nt, Human
augaggaccccagccccacuucccuggaacug

SEQ ID NO: 69315 - RNA, 32 nt, Human
augaggaccggcagagggaggaagaggaagac

SEQ ID NO: 69316 - RNA, 32 nt, Human
augaggacucugggcugcuggaauaggacacu

SEQ ID NO: 69317 - RNA, 32 nt, Human
augaggacugagcuuccucuccccaggacccg

SEQ ID NO: 69318 - RNA, 32 nt, Human
augaggacugucugccuuugagggcuugggca

SEQ ID NO: 69319 - RNA, 32 nt, Human
augaggacugugaggggaggaggcggagccgg

SEQ ID NO: 69320 - RNA, 22 nt, Human
augaggacuucaagccccacca

SEQ ID NO: 69321 - RNA, 17 nt, Human
augaggagaauauuuga

SEQ ID NO: 69322 - RNA, 18 nt, Human
augaggagacaauccugg

SEQ ID NO: 69323 - RNA, 18 nt, Human
augaggagacacaccuga

SEQ ID NO: 69324 - RNA, 32 nt, Human
augaggagagagaagaugagguuggacaagau

SEQ ID NO: 69325 - RNA, 19 nt, Human
augaggagaggcuguguga

SEQ ID NO: 69326 - RNA, 18 nt, Human
augaggagcaaaucauga

SEQ ID NO: 69327 - RNA, 32 nt, Human
augaggagcagucaugucuuacaugguggcag

SEQ ID NO: 69328 - RNA, 20 nt, Human
augaggagccucaguuuuga

SEQ ID NO: 69329 - RNA, 19 nt, Human
augaggagcguggacucug

SEQ ID NO: 69330 - RNA, 32 nt, Human
augaggagcuuccuccugauuggagugggaac

SEQ ID NO: 69331 - RNA, 32 nt, Human
augaggaggaacaggcagaagcucuccggagg

SEQ ID NO: 69332 - RNA, 18 nt, Human
augaggaggaacaguuga

SEQ ID NO: 69333 - RNA, 19 nt, Human
augaggaggaagaauuuga

SEQ ID NO: 69334 - RNA, 19 nt, Human
augaggaggaauaacuuga

SEQ ID NO: 69335 - RNA, 18 nt, Human
augaggaggacaacacug

SEQ ID NO: 69336 - RNA, 20 nt, Human
augaggaggaccaaccauga

SEQ ID NO: 69337 - RNA, 16 nt, Human
augaggaggaccacug

SEQ ID NO: 69338 - RNA, 18 nt, Human
augaggaggaccagugga

SEQ ID NO: 69339 - RNA, 19 nt, Human
augaggaggacggcaucuc

SEQ ID NO: 69340 - RNA, 17 nt, Human
augaggaggagaucugg

SEQ ID NO: 69341 - RNA, 18 nt, Human
augaggaggagaugucug

SEQ ID NO: 69342 - RNA, 17 nt, Human
augaggaggaggcccug

SEQ ID NO: 69343 - RNA, 31 nt, Human
augaggaggcagaugaugcagaugcugcugg

SEQ ID NO: 69344 - RNA, 32 nt, Human
augaggaggccugcugggagcuggaaaaguuc

SEQ ID NO: 69345 - RNA, 32 nt, Human
augaggagguacuaguuccaagcaacaaacuc

SEQ ID NO: 69346 - RNA, 32 nt, Human
augaggaggugaaucagggugggcaggugcug

SEQ ID NO: 69347 - RNA, 18 nt, Human
augaggaguacuuucuga

SEQ ID NO: 69348 - RNA, 32 nt, Human
augaggaguguugcucauuugugagccuucau

SEQ ID NO: 69349 - RNA, 21 nt, Human
augaggaugaggcccaggaga

SEQ ID NO: 69350 - RNA, 32 nt, Human
augaggaugcaggcacacugggcaagaggggg

SEQ ID NO: 69351 - RNA, 32 nt, Human
augaggauuauaauagcccugcuuuauuaaag

SEQ ID NO: 69352 - RNA, 21 nt, Human
augaggcaaaggaugcaguga

SEQ ID NO: 69353 - RNA, 32 nt, Human
augaggcacaacuauacuacauggacagagua

SEQ ID NO: 69354 - RNA, 32 nt, Human
augaggcacacagcaaguugcugucuacaaga

SEQ ID NO: 69355 - RNA, 32 nt, Human
augaggcaccacugcacucuagccugggcaag

SEQ ID NO: 69356 - RNA, 32 nt, Human
augaggcaccuugcuggagucucagauuccaa

SEQ ID NO: 69357 - RNA, 32 nt, Human
augaggcacgccugccuucuccccuccaagug

SEQ ID NO: 69358 - RNA, 32 nt, Human
augaggcagagccagaggaacagugcccacau

SEQ ID NO: 69359 - RNA, 32 nt, Human
augaggcagaggauggagcaggcugagccagg

SEQ ID NO: 69360 - RNA, 32 nt, Human
augaggcaggagaccugcuugaaccuggaggu

SEQ ID NO: 69361 - RNA, 32 nt, Human
augaggcaggcagaggugcgggucacccuuag

SEQ ID NO: 69362 - RNA, 32 nt, Human
augaggcaggugugagggacccgagcacuccu

SEQ ID NO: 69363 - RNA, 32 nt, Human
augaggcaguaggagguggggaagaaaagaag

SEQ ID NO: 69364 - RNA, 32 nt, Human
augaggccaaaggaccacagggcuaaggaugg

SEQ ID NO: 69365 - RNA, 23 nt, Human
augaggccacagcauuuuuuaaa

SEQ ID NO: 69366 - RNA, 32 nt, Human
augaggccaggaauucaagaccagccugagua

SEQ ID NO: 69367 - RNA, 32 nt, Human
augaggccaggaguucaagaccagccuggcca

SEQ ID NO: 69368 - RNA, 32 nt, Human
augaggcccaggauauggaguuguauagaaaa

SEQ ID NO: 69369 - RNA, 32 nt, Human
augaggcccugcaccuuccccaaaggaaccgc

SEQ ID NO: 69370 - RNA, 32 nt, Human
augaggcccuggagugcgcaaggagugcccgg

SEQ ID NO: 69371 - RNA, 32 nt, Human
augaggccuauguauucuacuguguuuaauac

SEQ ID NO: 69372 - RNA, 32 nt, Human
augaggccucaauacuuuucagucuuaauugu

SEQ ID NO: 69373 - RNA, 32 nt, Human
augaggccucggaggcugggguugagauuugg

SEQ ID NO: 69374 - RNA, 32 nt, Human
augaggccucuuggaccucugcucugaggcuu

SEQ ID NO: 69375 - RNA, 32 nt, Human
augaggccugcagguggccuauuuugacucag

SEQ ID NO: 69376 - RNA, 32 nt, Human
augaggcgagaggaggaggaggaggaggagaa

SEQ ID NO: 69377 - RNA, 32 nt, Human
augaggcggagcuccaggauggggaggggcuc

SEQ ID NO: 69378 - RNA, 32 nt, Human
augaggcucacuguaaacacuacauuguccug

SEQ ID NO: 69379 - RNA, 32 nt, Human
augaggcucaucagaacuagaucuugugagaa

SEQ ID NO: 69380 - RNA, 32 nt, Human
augaggcucaugggagguuuggacgggugcug

SEQ ID NO: 69381 - RNA, 32 nt, Human
augaggcucuucuaccccgugccugcaccucg

SEQ ID NO: 69382 - RNA, 32 nt, Human
augaggcugcaguccaugcagcuguucuugcc

SEQ ID NO: 69383 - RNA, 32 nt, Human
augaggcugcgcugcacuccucugcccugggg

SEQ ID NO: 69384 - RNA, 32 nt, Human
augaggcuggacugaggagggguaggccugca

SEQ ID NO: 69385 - RNA, 32 nt, Human
augaggcuuacaacuugcuaaccccaaaagaa

SEQ ID NO: 69386 - RNA, 32 nt, Human
augagggaaacugcccccaugauucaauuacc

SEQ ID NO: 69387 - RNA, 32 nt, Human
augagggaaagugaguuuugagggaggagugg

SEQ ID NO: 69388 - RNA, 25 nt, Human
augagggaagagccaaauagacuac

SEQ ID NO: 69389 - RNA, 32 nt, Human
augagggaaggugaguuuugagggaggagugg

SEQ ID NO: 69390 - RNA, 32 nt, Human
augagggagagaggagagaggagaggaaaggg

SEQ ID NO: 69391 - RNA, 32 nt, Human
augagggagauugaggcugcagugagcugugu

SEQ ID NO: 69392 - RNA, 32 nt, Human
augagggaggcaggcaauaugcagugaaaacc

SEQ ID NO: 69393 - RNA, 32 nt, Human
augagggaggucggggcugcagugagccaaga

SEQ ID NO: 69394 - RNA, 32 nt, Human
augagggagguggggcugggggccuggagugu

SEQ ID NO: 69395 - RNA, 32 nt, Human
augagggccauccugggucuguucccauggag

SEQ ID NO: 69396 - RNA, 32 nt, Human
augagggcccaggaggucaaggcuucagugag

SEQ ID NO: 69397 - RNA, 32 nt, Human
augagggcugaaaauauccuccccacaagggc

SEQ ID NO: 69398 - RNA, 32 nt, Human
augagggcugucuccccuuauucaccccuguc

SEQ ID NO: 69399 - RNA, 31 nt, Human
augaggggaaagagggaaaaagagccuguuu

SEQ ID NO: 69400 - RNA, 32 nt, Human
augaggggaagcugggguuugcagugguuuga

SEQ ID NO: 69401 - RNA, 32 nt, Human
augaggggacacaggggaggugccaucgggca

SEQ ID NO: 69402 - RNA, 32 nt, Human
augaggggacagugcagcuacaggauaugcca

SEQ ID NO: 69403 - RNA, 32 nt, Human
augaggggagcagcagcagccacacucccacc

SEQ ID NO: 69404 - RNA, 32 nt, Human
augaggggcguccauucuccuccauacauccc

SEQ ID NO: 69405 - RNA, 32 nt, Human
augaggggcugcaccuucccccaggaaugacc

SEQ ID NO: 69406 - RNA, 32 nt, Human
augagggggaaagaaggagaaaggaaagaaaa

SEQ ID NO: 69407 - RNA, 32 nt, Human
augagggguagugggggauggaagagaguacc

SEQ ID NO: 69408 - RNA, 16 nt, Human
augaggggucacucug

SEQ ID NO: 69409 - RNA, 32 nt, Human
augagggugaaguuuggcaguuacccaagaga

SEQ ID NO: 69410 - RNA, 31 nt, Human
augaggguuauuuucugaaaugcagauggga

SEQ ID NO: 69411 - RNA, 32 nt, Human
augaggguucacucuucuuguuguacaugcug

SEQ ID NO: 69412 - RNA, 32 nt, Human
augaggguucagaagaggacuugcuguggaga

SEQ ID NO: 69413 - RNA, 25 nt, Human
augaggguucaucaucccucccugc

SEQ ID NO: 69414 - RNA, 32 nt, Human
augaggguucaucaucccucccugccuaagga

SEQ ID NO: 69415 - RNA, 32 nt, Human
augaggguuggaaacauuaauaguguuaaggu

SEQ ID NO: 69416 - RNA, 23 nt, Human
augagguaacugaggcucaggga

SEQ ID NO: 69417 - RNA, 32 nt, Human
augagguagaccacgcucaguucugcccaggc

SEQ ID NO: 69418 - RNA, 32 nt, Human
augagguauacaacuaguauuuaagauaccau

SEQ ID NO: 69419 - RNA, 32 nt, Human
augagguauucuguacuucucaguuaagacuu

SEQ ID NO: 69420 - RNA, 32 nt, Human
augaggucaagagaucgagaccagccuggcca

SEQ ID NO: 69421 - RNA, 31 nt, Human
augaggucacucagagugaagcgggagaaca

SEQ ID NO: 69422 - RNA, 32 nt, Human
augaggucagaagauaaagaccacccuggcca

SEQ ID NO: 69423 - RNA, 32 nt, Human
augaggucagaaguucaagaccagccuagcca

SEQ ID NO: 69424 - RNA, 32 nt, Human
augaggucagaaguucgagaccagccuaacca

SEQ ID NO: 69425 - RNA, 32 nt, Human
augaggucagcagaucgagaccagccuggcca

SEQ ID NO: 69426 - RNA, 32 nt, Human
augaggucagcaguugagaccagccugaacaa

SEQ ID NO: 69427 - RNA, 32 nt, Human
augaggucaggacuuccagaccagccugguca

SEQ ID NO: 69428 - RNA, 32 nt, Human
augaggucaggagaucaagaccacccuggcua

SEQ ID NO: 69429 - RNA, 32 nt, Human
augaggucaggagaucaagaccauccuggcca

SEQ ID NO: 69430 - RNA, 32 nt, Human
augaggucaggagaucaagaccauccuggcua

SEQ ID NO: 69431 - RNA, 32 nt, Human
augaggucaggagaucaagaccaucguggcuu

SEQ ID NO: 69432 - RNA, 32 nt, Human
augaggucaggagaucaagaccaucuuggcua

SEQ ID NO: 69433 - RNA, 32 nt, Human
augaggucaggagauggagaccauccuggcca

SEQ ID NO: 69434 - RNA, 32 nt, Human
augaggucaggagauggagaccauccuggcua

SEQ ID NO: 69435 - RNA, 32 nt, Human
augaggucaggaguucaagaccagccuagcca

SEQ ID NO: 69436 - RNA, 32 nt, Human
augaggucaggaguucaagaccagccugacca

SEQ ID NO: 69437 - RNA, 32 nt, Human
augaggucaggaguucaagaccagccuggcca

SEQ ID NO: 69438 - RNA, 32 nt, Human
augaggucaggaguuccagaccagccugacca

SEQ ID NO: 69439 - RNA, 32 nt, Human
augaggucaggaguuccagaccagccuggcca

SEQ ID NO: 69440 - RNA, 32 nt, Human
augaggucaggaguucgagaccagcccgccca

SEQ ID NO: 69441 - RNA, 32 nt, Human
augaggucaggaguucgagaccagccuaaaca

SEQ ID NO: 69442 - RNA, 32 nt, Human
augaggucaggaguucgagaccagccugacca

SEQ ID NO: 69443 - RNA, 32 nt, Human
augaggucaggaguucgagaccagccuggcca

SEQ ID NO: 69444 - RNA, 32 nt, Human
augaggucaggaguuugagaccagccugacca

SEQ ID NO: 69445 - RNA, 32 nt, Human
augaggucaggaguuugagaccagccuggcca

SEQ ID NO: 69446 - RNA, 32 nt, Human
augaggucaguaguucgagaccagccuggcca

SEQ ID NO: 69447 - RNA, 32 nt, Human
augaggucaguaguuugagaccagccuggcca

SEQ ID NO: 69448 - RNA, 32 nt, Human
augagguccaagcugagagaaaagagucauga

SEQ ID NO: 69449 - RNA, 32 nt, Human
augaggucgggaguucaagaccagcuuggcca

SEQ ID NO: 69450 - RNA, 32 nt, Human
augaggucgggaguucgaaaccagccuggcca

SEQ ID NO: 69451 - RNA, 32 nt, Human
augaggucuaaugugccgcucuucuauuucua

SEQ ID NO: 69452 - RNA, 32 nt, Human
augaggucuaggaacauacuucagcucacaca

SEQ ID NO: 69453 - RNA, 32 nt, Human
augaggucucacuauguugcccaggcuggacu

SEQ ID NO: 69454 - RNA, 32 nt, Human
augaggucucacuauguugcccaggcuggucu

SEQ ID NO: 69455 - RNA, 32 nt, Human
augaggucucccuauguugcccaggcuggucu

SEQ ID NO: 69456 - RNA, 19 nt, Human
augaggucucgccauguug

SEQ ID NO: 69457 - RNA, 32 nt, Human
augaggucugcacucgggccggggugggugcc

SEQ ID NO: 69458 - RNA, 32 nt, Human
augaggucuugcuauguugcccaagcuaguuu

SEQ ID NO: 69459 - RNA, 32 nt, Human
augaggugaagaucacugucaucuaaagccgg

SEQ ID NO: 69460 - RNA, 32 nt, Human
augaggugaagcaaaggaaggcccuguaaaua

SEQ ID NO: 69461 - RNA, 18 nt, Human
augaggugacuauucuga

SEQ ID NO: 69462 - RNA, 32 nt, Human
augagguggaguuuuacucuuguugucuaggc

SEQ ID NO: 69463 - RNA, 32 nt, Human
augagguggggccuggccugcccagcucagag

SEQ ID NO: 69464 - RNA, 32 nt, Human
augagguggucaccaggauugagcuuccucag

SEQ ID NO: 69465 - RNA, 32 nt, Human
augagguuaaugaaguaccaagcugugcuuga

SEQ ID NO: 69466 - RNA, 32 nt, Human
augagguuacuacuaguaucuaccucaaagcg

SEQ ID NO: 69467 - RNA, 32 nt, Human
augagguuccagcaacagcugggaucacccau

SEQ ID NO: 69468 - RNA, 32 nt, Human
augagguucccugcaacccccgcccuccagcc

SEQ ID NO: 69469 - RNA, 32 nt, Human
augagguuggacaaggcuucacagaauuucug

SEQ ID NO: 69470 - RNA, 32 nt, Human
augagguugggaguucgagaccagccugacca

SEQ ID NO: 69471 - RNA, 22 nt, Human
augagguuguuaauuagaguca

SEQ ID NO: 69472 - RNA, 20 nt, Human
augagguuguuuggaaaguc

SEQ ID NO: 69473 - RNA, 32 nt, Human
augaguaaaagcuuccuaaggccuucccagga

SEQ ID NO: 69474 - RNA, 32 nt, Human
augaguaaaagcuuccugaggcuuccccagaa

SEQ ID NO: 69475 - RNA, 20 nt, Human
augaguaaaauccacaggca

SEQ ID NO: 69476 - RNA, 32 nt, Human
augaguaaacccaguagcaucuuuuugagugu

SEQ ID NO: 69477 - RNA, 32 nt, Human
augaguaacauaucgucucucccuucaaggua

SEQ ID NO: 69478 - RNA, 32 nt, Human
augaguaacuugcauucacuuccuucaaacca

SEQ ID NO: 69479 - RNA, 25 nt, Human
augaguaagaggcagacagcagagg

SEQ ID NO: 69480 - RNA, 32 nt, Human
augaguaagucuagagaggacauugcaccuuu

SEQ ID NO: 69481 - RNA, 32 nt, Human
augaguacagcagagaccuuccugcuuuuuac

SEQ ID NO: 69482 - RNA, 32 nt, Human
augaguagccacugcacuccagccugggcaac

SEQ ID NO: 69483 - RNA, 32 nt, Human
augaguagcgcuauaguuacuguccuguugau

SEQ ID NO: 69484 - RNA, 32 nt, Human
augaguaggggcacuauuguucccuccaugcc

SEQ ID NO: 69485 - RNA, 32 nt, Human
augaguagguguaggaaggagaaauguggaag

SEQ ID NO: 69486 - RNA, 32 nt, Human
augaguaguauaagccaccuauuuuuacuucc

SEQ ID NO: 69487 - RNA, 32 nt, Human
augaguaucacauacacccagcucuuuucagu

SEQ ID NO: 69488 - RNA, 32 nt, Human
augaguaugccgcugcacuccagccuggggga

SEQ ID NO: 69489 - RNA, 32 nt, Human
augaguauuuggaagaaaauugaccuagaaaa

SEQ ID NO: 69490 - RNA, 32 nt, Human
augagucaagaagggucucuuccuuuaucauu

SEQ ID NO: 69491 - RNA, 20 nt, Human
augagucaaggaguguacac

SEQ ID NO: 69492 - RNA, 30 nt, Human
augagucaauuaaaccucuuuucuuuauaa

SEQ ID NO: 69493 - RNA, 32 nt, Human
augagucaauuaaaccucuuuucuuuauaaau

SEQ ID NO: 69494 - RNA, 32 nt, Human
augagucacagagcaggcugggcacgguggcu

SEQ ID NO: 69495 - RNA, 32 nt, Human
augagucaggagcaaggaacguccagggagug

SEQ ID NO: 69496 - RNA, 32 nt, Human
augagucauggucaugauuauaaacaucagcc

SEQ ID NO: 69497 - RNA, 32 nt, Human
augaguccaggaguucgagaccagccuaggca

SEQ ID NO: 69498 - RNA, 32 nt, Human
augaguccauucaguucaugccgugcaauuuu

SEQ ID NO: 69499 - RNA, 32 nt, Human
augagucccacauccucuuuucauccauaagc

SEQ ID NO: 69500 - RNA, 32 nt, Human
augaguccccaagcuccucuggcugugggacc

SEQ ID NO: 69501 - RNA, 32 nt, Human
augaguccucccaggugaccucagcccuccca

SEQ ID NO: 69502 - RNA, 22 nt, Human
augagucgcuuaacccuugaca

SEQ ID NO: 69503 - RNA, 24 nt, Human
augagucgcuuugagcuucugaca

SEQ ID NO: 69504 - RNA, 32 nt, Human
augagucucagacaucuuuaaacaucuuuaaa

SEQ ID NO: 69505 - RNA, 32 nt, Human
augagucucgcucugcacuccagccuggcgac

SEQ ID NO: 69506 - RNA, 32 nt, Human
augagucuggaggccccaccucccuggggcuc

SEQ ID NO: 69507 - RNA, 32 nt, Human
augagucuucuuucucaauaccugcccugucu

SEQ ID NO: 69508 - RNA, 32 nt, Human
augagugaaagggagccagaagacugauugga

SEQ ID NO: 69509 - RNA, 28 nt, Human
augagugaaaggguugccucaucaagca

SEQ ID NO: 69510 - RNA, 32 nt, Human
augagugaaggcuggagccagggagcgcugga

SEQ ID NO: 69511 - RNA, 32 nt, Human
augagugaaguggucagaagcagccagcagug

SEQ ID NO: 69512 - RNA, 32 nt, Human
augagugaaguuauagcaaaucaagcugcaca

SEQ ID NO: 69513 - RNA, 32 nt, Human
augagugacuccacauccagagcugccucccu

SEQ ID NO: 69514 - RNA, 32 nt, Human
augagugagaacaggcgguguuugguuuucug

SEQ ID NO: 69515 - RNA, 32 nt, Human
augagugagaacaugcgguguuugguuuucug

SEQ ID NO: 69516 - RNA, 32 nt, Human
augagugagccccagcacccgugagcucacca

SEQ ID NO: 69517 - RNA, 32 nt, Human
augagugcaaguuuacaaaucaaagaagcauu

SEQ ID NO: 69518 - RNA, 32 nt, Human
augagugcauugcugagccaucauguuccccu

SEQ ID NO: 69519 - RNA, 32 nt, Human
augagugccagccugagccugcauggugccgc

SEQ ID NO: 69520 - RNA, 32 nt, Human
augagugccaucauggcucuccacucagacug

SEQ ID NO: 69521 - RNA, 32 nt, Human
augagugccuguaguccaagcuacucaagagg

SEQ ID NO: 69522 - RNA, 32 nt, Human
augagugcuaagagccucuggaagggagggcu

SEQ ID NO: 69523 - RNA, 32 nt, Human
augagugcugaguaguauugcagagaauguga

SEQ ID NO: 69524 - RNA, 32 nt, Human
augaguggcaaaaauugucugacucacagaaa

SEQ ID NO: 69525 - RNA, 32 nt, Human
augaguggcaacucccugggggcacaggaaac

SEQ ID NO: 69526 - RNA, 32 nt, Human
augaguggccugagccuuaacaacauguuuuu

SEQ ID NO: 69527 - RNA, 32 nt, Human
augaguggcuucucccugucauccccaggggu

SEQ ID NO: 69528 - RNA, 32 nt, Human
augagugggaggggagaaagcacacagagcuc

SEQ ID NO: 69529 - RNA, 32 nt, Human
augagugguucagccaucaccaccaguggcca

SEQ ID NO: 69530 - RNA, 32 nt, Human
augagugucugcuaugggccauucauugugcu

SEQ ID NO: 69531 - RNA, 32 nt, Human
augagugugagagcugggaugggcaggaaggg

SEQ ID NO: 69532 - RNA, 32 nt, Human
augagugugcagaugaguuagcuugacaaccu

SEQ ID NO: 69533 - RNA, 32 nt, Human
augagugugcugcucaccuucccaaguucugu

SEQ ID NO: 69534 - RNA, 32 nt, Human
augaguguggacauggcuucaguaggaaaugu

SEQ ID NO: 69535 - RNA, 32 nt, Human
augaguguggcccugaggaccagggcuggcag

SEQ ID NO: 69536 - RNA, 32 nt, Human
augaguguguuggggugagcaccaacgcccca

SEQ ID NO: 69537 - RNA, 32 nt, Human
augaguguuaccuggggaaagggcuagcaaga

SEQ ID NO: 69538 - RNA, 32 nt, Human
augaguguuuuguucuaccugcuuucaagucu

SEQ ID NO: 69539 - RNA, 32 nt, Human
augaguuaaaauauucaccagauggaacuuac

SEQ ID NO: 69540 - RNA, 32 nt, Human
augaguuaacugcucaagacccugugccacug

SEQ ID NO: 69541 - RNA, 32 nt, Human
augaguuaggcaggagcccuuccuccuugauu

SEQ ID NO: 69542 - RNA, 20 nt, Human
augaguuauauagcauccuu

SEQ ID NO: 69543 - RNA, 32 nt, Human
augaguuauuaggauuaaaguaagaauuuccu

SEQ ID NO: 69544 - RNA, 31 nt, Human
augaguucaaauguucccaugcuaagcugag

SEQ ID NO: 69545 - RNA, 32 nt, Human
augaguucaagaccagccugaccaacauggcc

SEQ ID NO: 69546 - RNA, 32 nt, Human
augaguucaagaccagccugggcaacauggua

SEQ ID NO: 69547 - RNA, 32 nt, Human
augaguucagguccuuuguagggacguggaua

SEQ ID NO: 69548 - RNA, 32 nt, Human
augaguucauuuguagcuuuagaauuuuaaaa

SEQ ID NO: 69549 - RNA, 32 nt, Human
augaguuccagaaaguaaaggugacaucggaa

SEQ ID NO: 69550 - RNA, 32 nt, Human
augaguucgaaaccagccuggccaaaacagug

SEQ ID NO: 69551 - RNA, 32 nt, Human
augaguucgagaccagccuggccaacaugaug

SEQ ID NO: 69552 - RNA, 32 nt, Human
augaguucgagaccagccuggccaacauggug

SEQ ID NO: 69553 - RNA, 32 nt, Human
augaguucucaggggucaaguucagaaacggc

SEQ ID NO: 69554 - RNA, 32 nt, Human
augaguugaaguugccuucccggggcucauuu

SEQ ID NO: 69555 - RNA, 32 nt, Human
augaguugccagggcugagagagauggagaag

SEQ ID NO: 69556 - RNA, 32 nt, Human
augaguugugaucaccccaaaaggcacaguug

SEQ ID NO: 69557 - RNA, 32 nt, Human
augaguuuccagcagcagagcuuuagguauga

SEQ ID NO: 69558 - RNA, 32 nt, Human
augaguuugacagaugcauacaugcauguaac

SEQ ID NO: 69559 - RNA, 32 nt, Human
augaguuugagaccagccuggguaacauagca

SEQ ID NO: 69560 - RNA, 32 nt, Human
augaguuugcagccaaggcuacagaggaucaa

SEQ ID NO: 69561 - RNA, 32 nt, Human
augaguuugcuaaacccagcugugauaccuca

SEQ ID NO: 69562 - RNA, 32 nt, Human
augaguuugcuacugcugugggggcauguggg

SEQ ID NO: 69563 - RNA, 32 nt, Human
augaguuugguucauucuggcaugcuguaccg

SEQ ID NO: 69564 - RNA, 32 nt, Human
augaguuugugugguucuguuuuccauuuuug

SEQ ID NO: 69565 - RNA, 32 nt, Human
augaguuuuuaaaaucagguggacuuagguga

SEQ ID NO: 69566 - RNA, 32 nt, Human
augaguuuuucaugauggugaugaguagcacu

SEQ ID NO: 69567 - RNA, 32 nt, Human
augaguuuuugccauguugcccagacuggucu

SEQ ID NO: 69568 - RNA, 31 nt, Human
augauaaagagacagugauauuggaacuugc

SEQ ID NO: 69569 - RNA, 32 nt, Human
augauaacaaaagguuucuugugacugguaac

SEQ ID NO: 69570 - RNA, 25 nt, Human
augauaacaccacugcacuccugcu

SEQ ID NO: 69571 - RNA, 32 nt, Human
augauaacauuuccucucaaaccuuaucccuu

SEQ ID NO: 69572 - RNA, 32 nt, Human
augauaaccugacaugccauucucaaaaugcu

SEQ ID NO: 69573 - RNA, 32 nt, Human
augauaacuagguacagcgacuuuaaauacag

SEQ ID NO: 69574 - RNA, 32 nt, Human
augauaacugguuuguuuguuuguuuguuucu

SEQ ID NO: 69575 - RNA, 32 nt, Human
augauaagaagauggagaagaaaacccgcaaa

SEQ ID NO: 69576 - RNA, 19 nt, Human
augauaaggcucugaaaug

SEQ ID NO: 69577 - RNA, 32 nt, Human
augauaauaacagccacagcugggcaggucgu

SEQ ID NO: 69578 - RNA, 32 nt, Human
augauacaacuugcccugggucacauaguugg

SEQ ID NO: 69579 - RNA, 32 nt, Human
augauacacauguguauguguacauugggucc

SEQ ID NO: 69580 - RNA, 32 nt, Human
augauaccaagugcugaaccugagagcagccc

SEQ ID NO: 69581 - RNA, 32 nt, Human
augauaccuaccucacaggggguugugaggau

SEQ ID NO: 69582 - RNA, 32 nt, Human
augauaccucucccucccuuuguccacaugua

SEQ ID NO: 69583 - RNA, 32 nt, Human
augauaccugcucuuuauuucaggaugagagg

SEQ ID NO: 69584 - RNA, 32 nt, Human
augauaccuggaaagcagaugaccucagaaaa

SEQ ID NO: 69585 - RNA, 32 nt, Human
augauaccuuuacaggggcagaaaaaucccca

SEQ ID NO: 69586 - RNA, 32 nt, Human
augauacucuccccuuaccuuuccucucucca

SEQ ID NO: 69587 - RNA, 32 nt, Human
augauacuucgacacuguucuuagcucaauga

SEQ ID NO: 69588 - RNA, 32 nt, Human
augauagaaccuuugauuuuucaaguggguau

SEQ ID NO: 69589 - RNA, 32 nt, Human
augauagagcagcugcucacacaggaggccgg

SEQ ID NO: 69590 - RNA, 32 nt, Human
augauagcaccacugcacuccagccugggcaa

SEQ ID NO: 69591 - RNA, 32 nt, Human
augauagcaccacugcacuccagccuggguga

SEQ ID NO: 69592 - RNA, 32 nt, Human
augauagcaccacugcaguccagccugggcga

SEQ ID NO: 69593 - RNA, 32 nt, Human
augauagcagaaugugcuucucucuggcagcu

SEQ ID NO: 69594 - RNA, 32 nt, Human
augauagcauuuuuccucucuucagucacuga

SEQ ID NO: 69595 - RNA, 32 nt, Human
augauaggcauucucauagccagggacagauu

SEQ ID NO: 69596 - RNA, 32 nt, Human
augauaggcgugagccaccacacccggccaag

SEQ ID NO: 69597 - RNA, 32 nt, Human
augauagggccugguuuacauucauuuaacuc

SEQ ID NO: 69598 - RNA, 32 nt, Human
augauaguaccacugcacuccagccugggcaa

SEQ ID NO: 69599 - RNA, 32 nt, Human
augauaguauuuuuaugcacucuucucccaca

SEQ ID NO: 69600 - RNA, 32 nt, Human
augauauaggagcuaggggaaggggguuguuu

SEQ ID NO: 69601 - RNA, 22 nt, Human
augauauaugucuucccuucca

SEQ ID NO: 69602 - RNA, 32 nt, Human
augauaucugggucccaaagagagcagcuuua

SEQ ID NO: 69603 - RNA, 23 nt, Human
augauaugaaugugaagcauaaa

SEQ ID NO: 69604 - RNA, 32 nt, Human
augauaugacucuccugcuugugccagagcca

SEQ ID NO: 69605 - RNA, 21 nt, Human
augauaugcauugacaagcuc

SEQ ID NO: 69606 - RNA, 32 nt, Human
augauaugccuguauguuggacuuugcuuuug

SEQ ID NO: 69607 - RNA, 32 nt, Human
augauauguucaaaugaaacacacacucuguu

SEQ ID NO: 69608 - RNA, 32 nt, Human
augauauugagauuguuucugagccaugugcu

SEQ ID NO: 69609 - RNA, 32 nt, Human
augauauugagugucggguggggaaggaggcc

SEQ ID NO: 69610 - RNA, 32 nt, Human
augauauuguuacugaguuuggugauugagcu

SEQ ID NO: 69611 - RNA, 32 nt, Human
augaucaaaccacuguaguccagccugaguga

SEQ ID NO: 69612 - RNA, 21 nt, Human
augaucaagauggugauggua

SEQ ID NO: 69613 - RNA, 32 nt, Human
augaucaauauugcaggagagcuuuuuguaca

SEQ ID NO: 69614 - RNA, 32 nt, Human
augaucacacaucuguauuccagccugggcaa

SEQ ID NO: 69615 - RNA, 32 nt, Human
augaucacaccaccacacuccagccugagcag

SEQ ID NO: 69616 - RNA, 32 nt, Human
augaucacaccaccucacuccagccugggcaa

SEQ ID NO: 69617 - RNA, 32 nt, Human
augaucacaccacuacacuccagccuggacaa

SEQ ID NO: 69618 - RNA, 32 nt, Human
augaucacaccacugcaauccagccucgguaa

SEQ ID NO: 69619 - RNA, 32 nt, Human
augaucacaccacugcaccccagccuggguga

SEQ ID NO: 69620 - RNA, 32 nt, Human
augaucacaccacugcacuccagccuggguga

SEQ ID NO: 69621 - RNA, 32 nt, Human
augaucacaccacugcacuccagccugggugu

SEQ ID NO: 69622 - RNA, 32 nt, Human
augaucacaccacugcacucuagccugggcaa

SEQ ID NO: 69623 - RNA, 32 nt, Human
augaucacaccacuguacuccagccugggcaa

SEQ ID NO: 69624 - RNA, 32 nt, Human
augaucacaggugauucacacguacacacaua

SEQ ID NO: 69625 - RNA, 32 nt, Human
augaucacaucacugcaguccagccuggguga

SEQ ID NO: 69626 - RNA, 32 nt, Human
augaucacgauccugcacuccagccugggcaa

SEQ ID NO: 69627 - RNA, 32 nt, Human
augaucacgccacugcacuccagccugggcga

SEQ ID NO: 69628 - RNA, 32 nt, Human
augaucacgccacugcacuccagccuggguaa

SEQ ID NO: 69629 - RNA, 32 nt, Human
augaucacucaucuugaguuaauuagaaaaua

SEQ ID NO: 69630 - RNA, 32 nt, Human
augaucagccgugggagccacgggaaucaauu

SEQ ID NO: 69631 - RNA, 32 nt, Human
augaucagcuucucccuuucuucauuuucugu

SEQ ID NO: 69632 - RNA, 32 nt, Human
augaucaguggacagucugcucuagaugagcu

SEQ ID NO: 69633 - RNA, 32 nt, Human
augaucauaccacugcacuccagccuggguga

SEQ ID NO: 69634 - RNA, 32 nt, Human
augaucauagccccaggaacccuugagguucu

SEQ ID NO: 69635 - RNA, 32 nt, Human
augaucaucacugagccagugugguuugucua

SEQ ID NO: 69636 - RNA, 32 nt, Human
augaucaucuuggcaguucuugugcuuuuacu

SEQ ID NO: 69637 - RNA, 32 nt, Human
augaucaugccacugcacuccaaccugggcaa

SEQ ID NO: 69638 - RNA, 32 nt, Human
augaucaugccacugcacuccagcauggguga

SEQ ID NO: 69639 - RNA, 32 nt, Human
augaucaugccacugcacuccagccugggcaa

SEQ ID NO: 69640 - RNA, 32 nt, Human
augaucaugccacugcacuccagccuggguga

SEQ ID NO: 69641 - RNA, 32 nt, Human
augaucaugccacugcacuccagcuuggguga

SEQ ID NO: 69642 - RNA, 32 nt, Human
augaucaugccacugcacuccagucuggauga

SEQ ID NO: 69643 - RNA, 32 nt, Human
augaucaugccacugcacuccagucuggguga

SEQ ID NO: 69644 - RNA, 32 nt, Human
augaucaugccacugcacuccauccuggguga

SEQ ID NO: 69645 - RNA, 32 nt, Human
augaucaugccacugcauuccagccugggcaa

SEQ ID NO: 69646 - RNA, 32 nt, Human
augaucaugccauugcacuccagccuggguga

SEQ ID NO: 69647 - RNA, 32 nt, Human
augaucaugccauugucuuccagccugagugu

SEQ ID NO: 69648 - RNA, 32 nt, Human
augaucaugccugugaauagccacugcacuug

SEQ ID NO: 69649 - RNA, 32 nt, Human
augaucauuaacaucagccucucugaucaaag

SEQ ID NO: 69650 - RNA, 32 nt, Human
augaucauuccacugcauuucagccuggggga

SEQ ID NO: 69651 - RNA, 32 nt, Human
augaucauucuuuagaugacgaauuaacccuu

SEQ ID NO: 69652 - RNA, 32 nt, Human
augaucauugcuuuuucucuuuacaggggaga

SEQ ID NO: 69653 - RNA, 32 nt, Human
augauccaaacuugauaaaggacaugaaaaag

SEQ ID NO: 69654 - RNA, 32 nt, Human
augauccacagaauucacuuuaugugagaucu

SEQ ID NO: 69655 - RNA, 32 nt, Human
augaucccaggaguuuaagaccagccugggca

SEQ ID NO: 69656 - RNA, 32 nt, Human
augaucccauuaacucgaugcugguaucuaca

SEQ ID NO: 69657 - RNA, 32 nt, Human
augauccggauuuaauuugauaucacagucua

SEQ ID NO: 69658 - RNA, 32 nt, Human
augauccuaccacugcacuucagccuagguga

SEQ ID NO: 69659 - RNA, 32 nt, Human
augauccugcaagcccugccuuccuuccuggg

SEQ ID NO: 69660 - RNA, 32 nt, Human
augauccugcagcaguucugggcccuaugcca

SEQ ID NO: 69661 - RNA, 32 nt, Human
augauccugccacugcacuccagccugggcga

SEQ ID NO: 69662 - RNA, 32 nt, Human
augauccuggaguguggaggcagcagcggcac

SEQ ID NO: 69663 - RNA, 32 nt, Human
augauccuuacaaguaaacagaagagaccaca

SEQ ID NO: 69664 - RNA, 32 nt, Human
augauccuuccagugagcaauucuuucuggug

SEQ ID NO: 69665 - RNA, 32 nt, Human
augaucgagccacugcacuccagccugggcaa

SEQ ID NO: 69666 - RNA, 32 nt, Human
augaucgaguuacugcacuccagccuggguga

SEQ ID NO: 69667 - RNA, 32 nt, Human
augaucgcaccacugcacccaaaccuggggag

SEQ ID NO: 69668 - RNA, 32 nt, Human
augaucgcaccacugcacuccagccuaggcga

SEQ ID NO: 69669 - RNA, 32 nt, Human
augaucgcaccacugcacuccagccuggguga

SEQ ID NO: 69670 - RNA, 32 nt, Human
augaucgcaccacugcacucuagccuggguga

SEQ ID NO: 69671 - RNA, 32 nt, Human
augaucgcaccacugcauuccagaccccaucu

SEQ ID NO: 69672 - RNA, 32 nt, Human
augaucgcaccauugcacuccagccugaguga

SEQ ID NO: 69673 - RNA, 32 nt, Human
augaucgcaucaguccacuccagccugagcaa

SEQ ID NO: 69674 - RNA, 32 nt, Human
augaucgcgacacugcacuccagccuggguga

SEQ ID NO: 69675 - RNA, 32 nt, Human
augaucgcgccacuacacuccagccugagcaa

SEQ ID NO: 69676 - RNA, 32 nt, Human
augaucgcgccacugcacuccagcccggguga

SEQ ID NO: 69677 - RNA, 32 nt, Human
augaucgcgccacugcacuccaggcugggcaa

SEQ ID NO: 69678 - RNA, 32 nt, Human
augaucgcgccacugcacuccugccugggcaa

SEQ ID NO: 69679 - RNA, 32 nt, Human
augaucgggaggaggaagaggagaauaaggag

SEQ ID NO: 69680 - RNA, 32 nt, Human
augaucguaccacugcacuccagccuagguga

SEQ ID NO: 69681 - RNA, 32 nt, Human
augaucguaugcugcuagacuacuucuuuucu

SEQ ID NO: 69682 - RNA, 32 nt, Human
augaucgugccacuacacuccagccuggguga

SEQ ID NO: 69683 - RNA, 32 nt, Human
augaucgugccacugcacuccagccugggcaa

SEQ ID NO: 69684 - RNA, 32 nt, Human
augaucucaccacuacacuccagccuggguga

SEQ ID NO: 69685 - RNA, 32 nt, Human
augaucucaccacuguacuccagccuggguga

SEQ ID NO: 69686 - RNA, 32 nt, Human
augaucucaccaugcacuccagccuagacaac

SEQ ID NO: 69687 - RNA, 32 nt, Human
augaucucacugcaaccuccaucuccugucuc

SEQ ID NO: 69688 - RNA, 32 nt, Human
augaucucagaugcaggggcugguuuuggggu

SEQ ID NO: 69689 - RNA, 32 nt, Human
augaucucaggagauguguauggguucagcuu

SEQ ID NO: 69690 - RNA, 32 nt, Human
augaucucucuagcuuugucauaguuauguga

SEQ ID NO: 69691 - RNA, 32 nt, Human
augaucucugcagcauuuuucuuggaaccucu

SEQ ID NO: 69692 - RNA, 32 nt, Human
augaucucugcucuucccucucccagauuggu

SEQ ID NO: 69693 - RNA, 32 nt, Human
augaucucuggaggcagaaugagggagugagc

SEQ ID NO: 69694 - RNA, 32 nt, Human
augaucucuucccauuuaucagauuaccuuuu

SEQ ID NO: 69695 - RNA, 32 nt, Human
augaucucuugcuguuucaucaggggaaagca

SEQ ID NO: 69696 - RNA, 32 nt, Human
augaucucuuuauuagugaaucaugcuuauuu

SEQ ID NO: 69697 - RNA, 32 nt, Human
augaucugcccaccucugccucccaaagugcu

SEQ ID NO: 69698 - RNA, 32 nt, Human
augaucugccgcuguuucugcacagaaaugag

SEQ ID NO: 69699 - RNA, 32 nt, Human
augaucugucuccagccccuuccuucugccca

SEQ ID NO: 69700 - RNA, 32 nt, Human
augaucugugugaucuugaaaaaguggcuuaa

SEQ ID NO: 69701 - RNA, 32 nt, Human
augaucuguuuaugcgauaacuccuuuuuguu

SEQ ID NO: 69702 - RNA, 32 nt, Human
augaucuuaugcacaaagauaacuggaggauu

SEQ ID NO: 69703 - RNA, 32 nt, Human
augaucuugaacuuuccagccuccaggauugu

SEQ ID NO: 69704 - RNA, 32 nt, Human
augaucuugauucccggguuucccaggagcgu

SEQ ID NO: 69705 - RNA, 32 nt, Human
augaucuugccaaggaguugggcuguuccuac

SEQ ID NO: 69706 - RNA, 17 nt, Human
augaucuugcccuugcc

SEQ ID NO: 69707 - RNA, 32 nt, Human
augaucuuggcagaugugaucaaguuaagggu

SEQ ID NO: 69708 - RNA, 32 nt, Human
augaucuuguguuuugcuauccuuuuuacugu

SEQ ID NO: 69709 - RNA, 22 nt, Human
augaugaaaaggguuuuuguau

SEQ ID NO: 69710 - RNA, 32 nt, Human
augaugaaagagacaauguaauacuguugguc

SEQ ID NO: 69711 - RNA, 32 nt, Human
augaugaaauacaggccuccaccaaauuggug

SEQ ID NO: 69712 - RNA, 32 nt, Human
augaugaaauuuccagacagaaagagcccuuu

SEQ ID NO: 69713 - RNA, 32 nt, Human
augaugaacauacaguauucauuaaugcagcg

SEQ ID NO: 69714 - RNA, 32 nt, Human
augaugaacccccuucccucuggcaggagaac

SEQ ID NO: 69715 - RNA, 32 nt, Human
augaugaaggggaggaaggagaggaggaugaa

SEQ ID NO: 69716 - RNA, 32 nt, Human
augaugaauguauagguuagggaucuuuuggu

SEQ ID NO: 69717 - RNA, 32 nt, Human
augaugaauguauagguugagugaauaaccaa

SEQ ID NO: 69718 - RNA, 32 nt, Human
augaugaauuucccucauuugcucaauaaauc

SEQ ID NO: 69719 - RNA, 32 nt, Human
augaugaccacagcccaauccagggcuuccuc

SEQ ID NO: 69720 - RNA, 32 nt, Human
augaugaccagagacagaacugguccaucaug

SEQ ID NO: 69721 - RNA, 32 nt, Human
augaugaccagggccacauccggagggggcaa

SEQ ID NO: 69722 - RNA, 32 nt, Human
augaugacccuucuugaguuuugaacaccuga

SEQ ID NO: 69723 - RNA, 32 nt, Human
augaugacugcacugccaucgugggcagaugc

SEQ ID NO: 69724 - RNA, 32 nt, Human
augaugacuguaacuucuggcuucucaagaau

SEQ ID NO: 69725 - RNA, 32 nt, Human
augaugacuucugcugcuuccgucucuggaga

SEQ ID NO: 69726 - RNA, 32 nt, Human
augaugagaagugcugcggcugaggcaaagcu

SEQ ID NO: 69727 - RNA, 32 nt, Human
augaugagacacaaucacagcuucaaaucaca

SEQ ID NO: 69728 - RNA, 32 nt, Human
augaugagccuaucauuugauuugaguucuau

SEQ ID NO: 69729 - RNA, 32 nt, Human
augaugaggaggaggaugaggaugaggaggag

SEQ ID NO: 69730 - RNA, 32 nt, Human
augaugaggaugaccuaggcacccuacgcuag

SEQ ID NO: 69731 - RNA, 17 nt, Human
augaugaggccaguuga

SEQ ID NO: 69732 - RNA, 32 nt, Human
augaugagggagaucuuuauccaucucaaguu

SEQ ID NO: 69733 - RNA, 32 nt, Human
augaugauaacagaacuuuuccucuguaucac

SEQ ID NO: 69734 - RNA, 32 nt, Human
augaugauauagaauuguggcuuuaguagcac

SEQ ID NO: 69735 - RNA, 32 nt, Human
augaugaucaaccacaccucacauuugcuuca

SEQ ID NO: 69736 - RNA, 32 nt, Human
augaugaucauugugaaaauucugaguugaag

SEQ ID NO: 69737 - RNA, 32 nt, Human
augaugauccagaauauaauuuccuggaagac

SEQ ID NO: 69738 - RNA, 32 nt, Human
augaugaucccugacagcaaaaaguuucuuuu

SEQ ID NO: 69739 - RNA, 32 nt, Human
augaugaugaaggggguggggaagaagacaca

SEQ ID NO: 69740 - RNA, 32 nt, Human
augaugaugcucuggaaugcuuggggacuuug

SEQ ID NO: 69741 - RNA, 32 nt, Human
augaugaugguuuuuauuccuggcauccagag

SEQ ID NO: 69742 - RNA, 32 nt, Human
augaugcaggucucgacucaagccugacgggc

SEQ ID NO: 69743 - RNA, 32 nt, Human
augaugcaugcacagguuguacccacagacau

SEQ ID NO: 69744 - RNA, 32 nt, Human
augaugcauuuuaagguggaguacaguaagau

SEQ ID NO: 69745 - RNA, 32 nt, Human
augaugccacugcacuccagccugggcuacag

SEQ ID NO: 69746 - RNA, 32 nt, Human
augaugccauugcacuccagccugggcaacaa

SEQ ID NO: 69747 - RNA, 32 nt, Human
augaugccauuguccuggaugaugccaccucg

SEQ ID NO: 69748 - RNA, 32 nt, Human
augaugccuccagcuucguucuuuuugcugag

SEQ ID NO: 69749 - RNA, 32 nt, Human
augaugcgagcucaucuccuguccugggugug

SEQ ID NO: 69750 - RNA, 32 nt, Human
augaugcuacccgguuccacagacagggaaac

SEQ ID NO: 69751 - RNA, 31 nt, Human
augaugcucaauagcugugaugagguccaag

SEQ ID NO: 69752 - RNA, 32 nt, Human
augaugcuccaaugcuuccaugcuucgaggga

SEQ ID NO: 69753 - RNA, 32 nt, Human
augaugcucuggacauuuuaggaagcuuaagu

SEQ ID NO: 69754 - RNA, 32 nt, Human
augaugcuggggcuggagccaaagggagagga

SEQ ID NO: 69755 - RNA, 32 nt, Human
augaugcuguuacugagaauaaugaaaaucau

SEQ ID NO: 69756 - RNA, 32 nt, Human
augauggaaggacuuacgguaucagauaccaa

SEQ ID NO: 69757 - RNA, 32 nt, Human
augauggaaugaauagaaaacuuuuucacuca

SEQ ID NO: 69758 - RNA, 32 nt, Human
augauggaggcuguggucagaaacaggucaau

SEQ ID NO: 69759 - RNA, 32 nt, Human
augauggaggcuguggucagaaacaggucagu

SEQ ID NO: 69760 - RNA, 32 nt, Human
augauggagggcgugcaguaggaguggacagu

SEQ ID NO: 69761 - RNA, 32 nt, Human
augauggcaaugaaguggcucccaaugggcag

SEQ ID NO: 69762 - RNA, 22 nt, Human
augauggcacaugccuguaauc

SEQ ID NO: 69763 - RNA, 32 nt, Human
augauggcaccacugcacuccagccugggaga

SEQ ID NO: 69764 - RNA, 32 nt, Human
augauggcaccacugcacuccagccugggcaa

SEQ ID NO: 69765 - RNA, 32 nt, Human
augauggcaccacugcacuucagccuggguga

SEQ ID NO: 69766 - RNA, 32 nt, Human
augauggcaccacuguacuccagccuggguga

SEQ ID NO: 69767 - RNA, 19 nt, Human
augauggcaccuguggucc

SEQ ID NO: 69768 - RNA, 32 nt, Human
augauggcacugcugcacuccagccugcggga

SEQ ID NO: 69769 - RNA, 32 nt, Human
augauggcaggcaccuguaaucccagcuacuc

SEQ ID NO: 69770 - RNA, 32 nt, Human
augauggcaggcgccuguagucucagcuacuc

SEQ ID NO: 69771 - RNA, 32 nt, Human
augauggcaucacuugcacuuggaagaaugug

SEQ ID NO: 69772 - RNA, 32 nt, Human
augauggccagcugcuucccuccuugguuauc

SEQ ID NO: 69773 - RNA, 32 nt, Human
augauggcgguggagguggugguuguagugug

SEQ ID NO: 69774 - RNA, 22 nt, Human
augauggcucacaccuguaauc

SEQ ID NO: 69775 - RNA, 32 nt, Human
augauggcucaggguggucauccagguugaaa

SEQ ID NO: 69776 - RNA, 21 nt, Human
augauggcucaugccuguaau

SEQ ID NO: 69777 - RNA, 32 nt, Human
augaugggaacugcccuuuucaccugccaggg

SEQ ID NO: 69778 - RNA, 22 nt, Human
augaugggacuucucaagagug

SEQ ID NO: 69779 - RNA, 32 nt, Human
augaugggagaaaaggagaaaugaagacucga

SEQ ID NO: 69780 - RNA, 32 nt, Human
augaugggaugggggaguauauacacguauag

SEQ ID NO: 69781 - RNA, 19 nt, Human
augaugggauuuuauacca

SEQ ID NO: 69782 - RNA, 32 nt, Human
augaugggcacagagcaucacaugagcuguuu

SEQ ID NO: 69783 - RNA, 32 nt, Human
augauggggcaagauggcagagguauuggguu

SEQ ID NO: 69784 - RNA, 32 nt, Human
augauggggugagggcucuugguggguuagug

SEQ ID NO: 69785 - RNA, 32 nt, Human
augauggguuucagaucuggcuuuuguuaaca

SEQ ID NO: 69786 - RNA, 24 nt, Human
augaugguaccacaccagggccuc

SEQ ID NO: 69787 - RNA, 32 nt, Human
augaugguaccccugcacuccagcccagguua

SEQ ID NO: 69788 - RNA, 32 nt, Human
augauggucucgaucuccugaccucgugaucu

SEQ ID NO: 69789 - RNA, 32 nt, Human
augauggugauacuguacuccagccugagcaa

SEQ ID NO: 69790 - RNA, 32 nt, Human
augauggugccacuacacuccagccuggguaa

SEQ ID NO: 69791 - RNA, 25 nt, Human
augauggugccacugcacuccagcc

SEQ ID NO: 69792 - RNA, 32 nt, Human
augauggugccacugcacuccagccuggggga

SEQ ID NO: 69793 - RNA, 32 nt, Human
augauggugccacugcacuccaguauggauga

SEQ ID NO: 69794 - RNA, 32 nt, Human
augauggugccacugcauuccagccuggguga

SEQ ID NO: 69795 - RNA, 32 nt, Human
augauggugcuggcucauauaguguagucccu

SEQ ID NO: 69796 - RNA, 32 nt, Human
augaugguggaggccaauacuuugccaaacca

SEQ ID NO: 69797 - RNA, 32 nt, Human
augauggugggugggugggaugaguacccccu

SEQ ID NO: 69798 - RNA, 21 nt, Human
augaugguuaaacucuguggg

SEQ ID NO: 69799 - RNA, 32 nt, Human
augauguaacaucccuuuugcucauccagauc

SEQ ID NO: 69800 - RNA, 32 nt, Human
augauguagaaacagaugagaagucaguccca

SEQ ID NO: 69801 - RNA, 32 nt, Human
augauguaggagagaggagaaaugcuggaaag

SEQ ID NO: 69802 - RNA, 32 nt, Human
augauguagggccugcugcacccuggggaggg

SEQ ID NO: 69803 - RNA, 32 nt, Human
augauguaguaaaaagauuucuccagaaaaca

SEQ ID NO: 69804 - RNA, 32 nt, Human
augauguaguaagcuauaauggugccacugga

SEQ ID NO: 69805 - RNA, 32 nt, Human
augauguagugccacccaccuccugagcuguu

SEQ ID NO: 69806 - RNA, 32 nt, Human
augauguagugccucuuucauccacuagugca

SEQ ID NO: 69807 - RNA, 32 nt, Human
augaugucaaugaugaugacagugaugaugau

SEQ ID NO: 69808 - RNA, 32 nt, Human
augaugucacacaagcuccuuaaccuuccaug

SEQ ID NO: 69809 - RNA, 32 nt, Human
augaugucacucugaaacucaggcuggaauac

SEQ ID NO: 69810 - RNA, 32 nt, Human
augaugucagccucccugucgccccucgguac

SEQ ID NO: 69811 - RNA, 32 nt, Human
augauguccagggggagaaggaagauaggacg

SEQ ID NO: 69812 - RNA, 32 nt, Human
augauguccuagugaaccuugugcuuucuuua

SEQ ID NO: 69813 - RNA, 19 nt, Human
augaugucucugaugaagc

SEQ ID NO: 69814 - RNA, 32 nt, Human
augaugucuguaacgcaguuuuguuugaaaua

SEQ ID NO: 69815 - RNA, 32 nt, Human
augaugugaugauuuucaagguguuggaggca

SEQ ID NO: 69816 - RNA, 32 nt, Human
augaugugccugcuucagccucccacagugcu

SEQ ID NO: 69817 - RNA, 32 nt, Human
augaugugccuuucuagcuuugucuaguuuau

SEQ ID NO: 69818 - RNA, 32 nt, Human
augaugugcgcccauccucccuugcuuccaga

SEQ ID NO: 69819 - RNA, 19 nt, Human
augauguggacagaagccu

SEQ ID NO: 69820 - RNA, 32 nt, Human
augauguggccaccccugacacgguggcuaau

SEQ ID NO: 69821 - RNA, 32 nt, Human
augaugugguauagccagaaugucuggucaga

SEQ ID NO: 69822 - RNA, 32 nt, Human
augauguguggggcacacggaaggcauugcug

SEQ ID NO: 69823 - RNA, 32 nt, Human
augauguugaguggcauuuucuuuuuaguuuu

SEQ ID NO: 69824 - RNA, 32 nt, Human
augauguugauaauuaacuuacccuuaucugc

SEQ ID NO: 69825 - RNA, 32 nt, Human
augauguugugcaaagaugcacuccaggaaga

SEQ ID NO: 69826 - RNA, 32 nt, Human
augauguuucauuaauaaacaguguuuuguuu

SEQ ID NO: 69827 - RNA, 22 nt, Human
augauguuucccucuccuucca

SEQ ID NO: 69828 - RNA, 32 nt, Human
augauuaaaacaauguaaaucuaaauuguaug

SEQ ID NO: 69829 - RNA, 32 nt, Human
augauuaaaagaacaggagcagaaggggcuca

SEQ ID NO: 69830 - RNA, 32 nt, Human
augauuaaaccaaggcacuccagccuggguga

SEQ ID NO: 69831 - RNA, 32 nt, Human
augauuaauuuccagcccuagaucugcugucu

SEQ ID NO: 69832 - RNA, 32 nt, Human
augauuacacaaauuugguaggggcauuugua

SEQ ID NO: 69833 - RNA, 32 nt, Human
augauuacaccacugcacuucagucuguguga

SEQ ID NO: 69834 - RNA, 32 nt, Human
augauuacaccacugcacuugagccugggcag

SEQ ID NO: 69835 - RNA, 32 nt, Human
augauuacagaaguccuacuugacaaucacau

SEQ ID NO: 69836 - RNA, 32 nt, Human
augauuacaguucugaaucuguaacacuuaca

SEQ ID NO: 69837 - RNA, 32 nt, Human
augauuacgccacugcauuguagccugggcaa

SEQ ID NO: 69838 - RNA, 32 nt, Human
augauuacuccacugcacuccagccugggcaa

SEQ ID NO: 69839 - RNA, 32 nt, Human
augauuaugccacugcuuuccagccugggcaa

SEQ ID NO: 69840 - RNA, 32 nt, Human
augauuaugccauuacacuccagccugggcaa

SEQ ID NO: 69841 - RNA, 32 nt, Human
augauuaugcugcugcacuccagccuggacaa

SEQ ID NO: 69842 - RNA, 32 nt, Human
augauuauuucugauuaauagcagaaacuuuu

SEQ ID NO: 69843 - RNA, 32 nt, Human
augauucacacuugaaugaaacccuacaaaug

SEQ ID NO: 69844 - RNA, 32 nt, Human
augauucacagcacugcacugcagccugggug

SEQ ID NO: 69845 - RNA, 32 nt, Human
augauucacagcccaggcaggacagagcagau

SEQ ID NO: 69846 - RNA, 32 nt, Human
augauucacaugcuaaagccaggauuguguug

SEQ ID NO: 69847 - RNA, 32 nt, Human
augauucagaguuuaaauggcuguaguuacaa

SEQ ID NO: 69848 - RNA, 32 nt, Human
augauucagcucccuuauacccccauuaaauu

SEQ ID NO: 69849 - RNA, 32 nt, Human
augauucaggauucagggggagaauccuucuu

SEQ ID NO: 69850 - RNA, 32 nt, Human
augauucauauauaaucauaucuaagaucuau

SEQ ID NO: 69851 - RNA, 32 nt, Human
augauucauucaaccaagucgcuggacuuuug

SEQ ID NO: 69852 - RNA, 32 nt, Human
augauucauuuugcagauuuacauuuugcuug

SEQ ID NO: 69853 - RNA, 32 nt, Human
augauuccaccauugcacuccagucugggcaa

SEQ ID NO: 69854 - RNA, 32 nt, Human
augauuccagccucucacugugccuuaugcau

SEQ ID NO: 69855 - RNA, 32 nt, Human
augauucccacacaaaaccuggauuuagauaa

SEQ ID NO: 69856 - RNA, 32 nt, Human
augauucccgcaccugggacgaugacucggac

SEQ ID NO: 69857 - RNA, 32 nt, Human
augauucccucacuguauauccucaacccucc

SEQ ID NO: 69858 - RNA, 32 nt, Human
augauucccuugcccagcuugccaaggugagg

SEQ ID NO: 69859 - RNA, 32 nt, Human
augauuccuaaacuccagccuggccaaggaga

SEQ ID NO: 69860 - RNA, 32 nt, Human
augauucucuuaguaaauuaaacauuuaaaaa

SEQ ID NO: 69861 - RNA, 32 nt, Human
augauucugagcacaugguuucugccuccagc

SEQ ID NO: 69862 - RNA, 32 nt, Human
augauucugaugcaaguggucucuccagccug

SEQ ID NO: 69863 - RNA, 32 nt, Human
augauucuguuaauguaaugaacaugggaaag

SEQ ID NO: 69864 - RNA, 32 nt, Human
augauucuuugaaaccugaugacuguuuggca

SEQ ID NO: 69865 - RNA, 32 nt, Human
augauucuuuucucccccauuaugccccuaua

SEQ ID NO: 69866 - RNA, 32 nt, Human
augauugaaucagcuuuaaagcaucauaccau

SEQ ID NO: 69867 - RNA, 32 nt, Human
augauugagcccaggagaggaagaacaaacaa

SEQ ID NO: 69868 - RNA, 32 nt, Human
augauugagugaagccaccccguccgcagcca

SEQ ID NO: 69869 - RNA, 32 nt, Human
augauugauaaccucucugccagcaaucauuc

SEQ ID NO: 69870 - RNA, 32 nt, Human
augauugaugggcuggggaacccuggagagcc

SEQ ID NO: 69871 - RNA, 32 nt, Human
augauugcacagcugcacuccagccugugcug

SEQ ID NO: 69872 - RNA, 32 nt, Human
augauugcaccacugcacuccaaccugggcaa

SEQ ID NO: 69873 - RNA, 32 nt, Human
augauugcaccacugcacuccaaccuggguga

SEQ ID NO: 69874 - RNA, 32 nt, Human
augauugcaccacugcacuccagccuggaaaa

SEQ ID NO: 69875 - RNA, 32 nt, Human
augauugcaccacugcacuccagccugggcaa

SEQ ID NO: 69876 - RNA, 32 nt, Human
augauugcaccacugcacuccagccuggguga

SEQ ID NO: 69877 - RNA, 32 nt, Human
augauugcaccacugcacuccagccugggugu

SEQ ID NO: 69878 - RNA, 32 nt, Human
augauugcaccacugcacuccagucugguuga

SEQ ID NO: 69879 - RNA, 32 nt, Human
augauugcaccacugcacucuaacuugggcaa

SEQ ID NO: 69880 - RNA, 32 nt, Human
augauugcaccacugcacucuacucuggguga

SEQ ID NO: 69881 - RNA, 32 nt, Human
augauugcaccacuguacuccagccugggcaa

SEQ ID NO: 69882 - RNA, 32 nt, Human
augauugcaccccugcacuccagccuggguga

SEQ ID NO: 69883 - RNA, 32 nt, Human
augauugcacugucgcacuccagccuggauga

SEQ ID NO: 69884 - RNA, 32 nt, Human
augauugcaucacugcacugcagccugggcaa

SEQ ID NO: 69885 - RNA, 32 nt, Human
augauugccaaagaauaguauuaaggagaaga

SEQ ID NO: 69886 - RNA, 32 nt, Human
augauugcgccacugcacuccagccugggcag

SEQ ID NO: 69887 - RNA, 32 nt, Human
augauugcgccgcugcacuccagccugggcaa

SEQ ID NO: 69888 - RNA, 32 nt, Human
augauugcuaucuuauuuuuguuauccaagac

SEQ ID NO: 69889 - RNA, 28 nt, Human
augauuggaagugcugccuacgucuucu

SEQ ID NO: 69890 - RNA, 32 nt, Human
augauuggaccacuauacuccagccuggcaac

SEQ ID NO: 69891 - RNA, 32 nt, Human
augauuggaugaguuuauucuuuucuaagcag

SEQ ID NO: 69892 - RNA, 32 nt, Human
augauuggcuucaccgccucuggaucagauga

SEQ ID NO: 69893 - RNA, 32 nt, Human
augauugggaaucuuacuauuucaucugauac

SEQ ID NO: 69894 - RNA, 32 nt, Human
augauuguaauaauguuacaugaucaugggug

SEQ ID NO: 69895 - RNA, 32 nt, Human
augauuguaccacugcacuccagccugggcaa

SEQ ID NO: 69896 - RNA, 32 nt, Human
augauuguaccacugcacuccagccuggguga

SEQ ID NO: 69897 - RNA, 32 nt, Human
augauuguaccacuguauuccagccuggacga

SEQ ID NO: 69898 - RNA, 32 nt, Human
augauuguaugacugcacuccagccuggguga

SEQ ID NO: 69899 - RNA, 32 nt, Human
augauugugccacacacuccagccuggguggc

SEQ ID NO: 69900 - RNA, 32 nt, Human
augauugugccaccgcacuccagcauggguga

SEQ ID NO: 69901 - RNA, 32 nt, Human
augauugugccacugcacuccagccugggcaa

SEQ ID NO: 69902 - RNA, 32 nt, Human
augauugugccacugcacuccagccuggguaa

SEQ ID NO: 69903 - RNA, 32 nt, Human
augauugugccacugcacuccagccugggugg

SEQ ID NO: 69904 - RNA, 32 nt, Human
augauugugccacugcacuccagccuuggcaa

SEQ ID NO: 69905 - RNA, 32 nt, Human
augauugugccacugcacuccagcuuggugac

SEQ ID NO: 69906 - RNA, 32 nt, Human
augauugugccacugcacuccagucuggacaa

SEQ ID NO: 69907 - RNA, 32 nt, Human
augauugugccacuguacuccagccugggaga

SEQ ID NO: 69908 - RNA, 32 nt, Human
augauugugccacuguacuccagccuggguga

SEQ ID NO: 69909 - RNA, 32 nt, Human
augauugugccacuucccuccagccugggcaa

SEQ ID NO: 69910 - RNA, 32 nt, Human
augauugugcuacugcacuccaaucuggcaac

SEQ ID NO: 69911 - RNA, 32 nt, Human
augauuguggcauugcacuccagccugggugg

SEQ ID NO: 69912 - RNA, 32 nt, Human
augauuguuaaguuuccugaggccuccccagc

SEQ ID NO: 69913 - RNA, 32 nt, Human
augauuguucucucccuuguagcucucugcuu

SEQ ID NO: 69914 - RNA, 32 nt, Human
augauuguuuauggaaaguaucuuuaauaaag

SEQ ID NO: 69915 - RNA, 32 nt, Human
augauuucaaugauuguuuaauuguaggucaa

SEQ ID NO: 69916 - RNA, 32 nt, Human
augauuucaccacugcauucuagccugggcaa

SEQ ID NO: 69917 - RNA, 32 nt, Human
augauuuccacuggacaguagaaaaauaugug

SEQ ID NO: 69918 - RNA, 32 nt, Human
augauuucccacugcacuccagccugagugac

SEQ ID NO: 69919 - RNA, 32 nt, Human
augauuuccuggcuggccaacugguggccagu

SEQ ID NO: 69920 - RNA, 32 nt, Human
augauuucucuccucaugacuuuuggugucuc

SEQ ID NO: 69921 - RNA, 32 nt, Human
augauuucuugcuuuggggaaaaagaaugaug

SEQ ID NO: 69922 - RNA, 32 nt, Human
augauuucuuuuuccuccucugccccaggucc

SEQ ID NO: 69923 - RNA, 32 nt, Human
augauuugggguucaauugaaaaggaacauga

SEQ ID NO: 69924 - RNA, 32 nt, Human
augauuuguaaaguguuaugcauauguauguu

SEQ ID NO: 69925 - RNA, 31 nt, Human
augauuugucagagaaccuguugaaauguga

SEQ ID NO: 69926 - RNA, 32 nt, Human
augauuuguccucagagcuaacauaaggacag

SEQ ID NO: 69927 - RNA, 32 nt, Human
augauuugugugugugaaggacauaccacguu

SEQ ID NO: 69928 - RNA, 32 nt, Human
augauuuguucccagagguuugaaacauucag

SEQ ID NO: 69929 - RNA, 32 nt, Human
augauuuuaccacugcacuccagcuugggcga

SEQ ID NO: 69930 - RNA, 32 nt, Human
augauuuugaggugugggggaagcacucuugg

SEQ ID NO: 69931 - RNA, 32 nt, Human
augauuuugauccuaaaucugccuuuucaucu

SEQ ID NO: 69932 - RNA, 32 nt, Human
augauuuuguaacccagauuuugcuguauauu

SEQ ID NO: 69933 - RNA, 32 nt, Human
augauuuuguuaaaaauugcuauggaguacuu

SEQ ID NO: 69934 - RNA, 32 nt, Human
augauuuuugcuuacaaucacuuaacuuagca

SEQ ID NO: 69935 - RNA, 32 nt, Human
augcaaaaauuaccugggcaugguggcaggug

SEQ ID NO: 69936 - RNA, 32 nt, Human
augcaaaaauuagcuggacgugguggcacacg

SEQ ID NO: 69937 - RNA, 32 nt, Human
augcaaaaauuagcugggcacgguggcgggca

SEQ ID NO: 69938 - RNA, 32 nt, Human
augcaaaaauuagcugggcaugguagcaugcg

SEQ ID NO: 69939 - RNA, 32 nt, Human
augcaaaaauuagcugggcaugguggugcacg

SEQ ID NO: 69940 - RNA, 32 nt, Human
augcaaaaauuagcugggcgugguggugugug

SEQ ID NO: 69941 - RNA, 32 nt, Human
augcaaaaauuagcugggugugguggcgggcg

SEQ ID NO: 69942 - RNA, 32 nt, Human
augcaaaaauuagcugggugugguggcgugug

SEQ ID NO: 69943 - RNA, 32 nt, Human
augcaaaacuccacuuucaaucuuuuauaucu

SEQ ID NO: 69944 - RNA, 32 nt, Human
augcaaaacuuuaggcccugccccagauuuac

SEQ ID NO: 69945 - RNA, 32 nt, Human
augcaaaagacauuucuagugaaaugccccuc

SEQ ID NO: 69946 - RNA, 32 nt, Human
augcaaaagugcuuugccaucuuaaaaaugcc

SEQ ID NO: 69947 - RNA, 32 nt, Human
augcaaaauacuguacauugugaacagaaguu

SEQ ID NO: 69948 - RNA, 21 nt, Human
augcaaaauaguuggggcaaa

SEQ ID NO: 69949 - RNA, 32 nt, Human
augcaaacaaaccaacccagagcccaugccug

SEQ ID NO: 69950 - RNA, 32 nt, Human
augcaaacacaaagaucuggauuucuggcaag

SEQ ID NO: 69951 - RNA, 32 nt, Human
augcaaacacccugaggauucagagaacaauu

SEQ ID NO: 69952 - RNA, 32 nt, Human
augcaaacaggcaaaauugguaccaaagggaa

SEQ ID NO: 69953 - RNA, 32 nt, Human
augcaaacauguuggcugggcgcuguggcuca

SEQ ID NO: 69954 - RNA, 32 nt, Human
augcaaacauuagcugggcaugguggcacaug

SEQ ID NO: 69955 - RNA, 32 nt, Human
augcaaacauuucugugccugcuggguagggg

SEQ ID NO: 69956 - RNA, 32 nt, Human
augcaaacauuuuaaugcuauuuucugcacuu

SEQ ID NO: 69957 - RNA, 32 nt, Human
augcaaacgugagucugaaugacaaucagauc

SEQ ID NO: 69958 - RNA, 32 nt, Human
augcaaacuuugggcauaaugugaacuaaaau

SEQ ID NO: 69959 - RNA, 32 nt, Human
augcaaagaaauuugccagucacuggaaguua

SEQ ID NO: 69960 - RNA, 32 nt, Human
augcaaagagccagaauauucuaaagagguga

SEQ ID NO: 69961 - RNA, 32 nt, Human
augcaaagcaccaggcgauggagcucagagga

SEQ ID NO: 69962 - RNA, 32 nt, Human
augcaaagccaccacaaugccuacaggaaggc

SEQ ID NO: 69963 - RNA, 20 nt, Human
augcaaagccuuccaugucu

SEQ ID NO: 69964 - RNA, 32 nt, Human
augcaaaggucaggaacucucuccacugcaug

SEQ ID NO: 69965 - RNA, 32 nt, Human
augcaaagguuagccgggcaugguggcgggcg

SEQ ID NO: 69966 - RNA, 32 nt, Human
augcaaaguaaaaccucagcagcugugaugaa

SEQ ID NO: 69967 - RNA, 19 nt, Human
augcaaaguucuguguuua

SEQ ID NO: 69968 - RNA, 32 nt, Human
augcaaaguuuauaccugaugaucagggcagu

SEQ ID NO: 69969 - RNA, 32 nt, Human
augcaaauaggcuuagggagggcaggugggau

SEQ ID NO: 69970 - RNA, 32 nt, Human
augcaaaucacccccgggagugcagcugggcu

SEQ ID NO: 69971 - RNA, 32 nt, Human
augcaaaugaggaaguaagucagggcgggcuu

SEQ ID NO: 69972 - RNA, 32 nt, Human
augcaacaaagaagaggagacagugugguuac

SEQ ID NO: 69973 - RNA, 32 nt, Human
augcaacaacacaguuuucacacuucaaauuu

SEQ ID NO: 69974 - RNA, 32 nt, Human
augcaacaaguuggcucuugagaauggcagua

SEQ ID NO: 69975 - RNA, 32 nt, Human
augcaacagggcugggacaggaaggcucucuu

SEQ ID NO: 69976 - RNA, 32 nt, Human
augcaacauuucucccucugggccuugaaaau

SEQ ID NO: 69977 - RNA, 32 nt, Human
augcaaccacugcaaucaaugugucauauguc

SEQ ID NO: 69978 - RNA, 32 nt, Human
augcaaccagaacacaggagaagaaaagcucc

SEQ ID NO: 69979 - RNA, 32 nt, Human
augcaaccccagcuccacuccagccuggcguc

SEQ ID NO: 69980 - RNA, 32 nt, Human
augcaaccccagucuacucagugaguuuucua

SEQ ID NO: 69981 - RNA, 32 nt, Human
augcaacggcugagccagcccagagaggcagc

SEQ ID NO: 69982 - RNA, 32 nt, Human
augcaacuaauaaaaacuaccuuacauuaauu

SEQ ID NO: 69983 - RNA, 32 nt, Human
augcaacuacuuucuuuuucuaccaaacgaaa

SEQ ID NO: 69984 - RNA, 32 nt, Human
augcaacucccagauuccaaaggauucaaguu

SEQ ID NO: 69985 - RNA, 32 nt, Human
augcaacugcuguccccgccuacucugagggg

SEQ ID NO: 69986 - RNA, 32 nt, Human
augcaacugguuuuacuagugugcaagugugu

SEQ ID NO: 69987 - RNA, 32 nt, Human
augcaacuucagccauaccauguggccuccuc

SEQ ID NO: 69988 - RNA, 32 nt, Human
augcaacuugaaaggaaacaguuuaauggugg

SEQ ID NO: 69989 - RNA, 32 nt, Human
augcaagaaagccucagaaaugacugcauaca

SEQ ID NO: 69990 - RNA, 32 nt, Human
augcaagaauuagcugggugugguggugugca

SEQ ID NO: 69991 - RNA, 32 nt, Human
augcaagacugacagugauggacucugugaca

SEQ ID NO: 69992 - RNA, 32 nt, Human
augcaagagaaaaguuauuuggaaagaagacc

SEQ ID NO: 69993 - RNA, 21 nt, Human
augcaagagaauaaaugugag

SEQ ID NO: 69994 - RNA, 32 nt, Human
augcaagaguccuaauccugaagacauugaau

SEQ ID NO: 69995 - RNA, 32 nt, Human
augcaagauaaauuaaaguuauuauaacagug

SEQ ID NO: 69996 - RNA, 32 nt, Human
augcaagauggaaugggacucccccggcugcu

SEQ ID NO: 69997 - RNA, 32 nt, Human
augcaagcaagagcacaucuacuccagcauga

SEQ ID NO: 69998 - RNA, 32 nt, Human
augcaagcacagugcuuucacgcccagccucc

SEQ ID NO: 69999 - RNA, 32 nt, Human
augcaagcacgccuuaaacacacagauauaga

SEQ ID NO: 70000 - RNA, 32 nt, Human
augcaagcuaaagccccucuauacccugguag

SEQ ID NO: 70001 - RNA, 32 nt, Human
augcaaggaguagauuguguguggggugguga

SEQ ID NO: 70002 - RNA, 32 nt, Human
augcaagggggaaaccaaaucaaaaguguaga

SEQ ID NO: 70003 - RNA, 32 nt, Human
augcaaggucaaguaucucaauccagaggacu

SEQ ID NO: 70004 - RNA, 32 nt, Human
augcaaggugucaucacaugcccagcccugac

SEQ ID NO: 70005 - RNA, 32 nt, Human
augcaaguccgaaauccagcagggcugucaaa

SEQ ID NO: 70006 - RNA, 32 nt, Human
augcaaguuguuacgauugagcuguauuacca

SEQ ID NO: 70007 - RNA, 32 nt, Human
augcaauaaaguguuuacaggaugcccuucug

SEQ ID NO: 70008 - RNA, 32 nt, Human
augcaauaaccagccaucugaucaaaguugaa

SEQ ID NO: 70009 - RNA, 32 nt, Human
augcaauaauuuaaaaucauaaagggccagug

SEQ ID NO: 70010 - RNA, 25 nt, Human
augcaauauuccauauuuuucccca

SEQ ID NO: 70011 - RNA, 32 nt, Human
augcaaucaggaagguugggggacuugggacu

SEQ ID NO: 70012 - RNA, 32 nt, Human
augcaaucauagcucacugcagccuggaacuc

SEQ ID NO: 70013 - RNA, 32 nt, Human
augcaaucucaguucacugcagucucugccuc

SEQ ID NO: 70014 - RNA, 32 nt, Human
augcaaucuccaucuggccuucauccuucucc

SEQ ID NO: 70015 - RNA, 32 nt, Human
augcaaugagccuacucugguuaagauguucu

SEQ ID NO: 70016 - RNA, 32 nt, Human
augcaauguaugcacaaauauguacaguuagu

SEQ ID NO: 70017 - RNA, 32 nt, Human
augcaaugucuaaaauggacgaaucuauauag

SEQ ID NO: 70018 - RNA, 32 nt, Human
augcaauguguuuaucacaguaucugguauac

SEQ ID NO: 70019 - RNA, 32 nt, Human
augcaauuagccucauaguuauuauccagagg

SEQ ID NO: 70020 - RNA, 32 nt, Human
augcaauucucaagucuauaagagguaugugc

SEQ ID NO: 70021 - RNA, 32 nt, Human
augcaauucugccaccaugauggaaggauuga

SEQ ID NO: 70022 - RNA, 32 nt, Human
augcaauugcacuccagccugggcaacaagaa

SEQ ID NO: 70023 - RNA, 32 nt, Human
augcaauuuccaggcugugcuguggacuucuu

SEQ ID NO: 70024 - RNA, 31 nt, Human
augcacaaaauaaauggcuguugaaauuuga

SEQ ID NO: 70025 - RNA, 32 nt, Human
augcacaaaggaugauuaauucugggacuaua

SEQ ID NO: 70026 - RNA, 32 nt, Human
augcacacaagaaaauauguguuuuucagaga

SEQ ID NO: 70027 - RNA, 21 nt, Human
augcacacacacauauacaca

SEQ ID NO: 70028 - RNA, 19 nt, Human
augcacacacauauacaca

SEQ ID NO: 70029 - RNA, 19 nt, Human
augcacacacauaugcaca

SEQ ID NO: 70030 - RNA, 32 nt, Human
augcacacacccuuugugcuggggagugacac

SEQ ID NO: 70031 - RNA, 23 nt, Human
augcacacaccgaugugcgcaca

SEQ ID NO: 70032 - RNA, 32 nt, Human
augcacacacgcagaggugcagagcgaggagg

SEQ ID NO: 70033 - RNA, 32 nt, Human
augcacacacgcaugcacacacacaaagccuu

SEQ ID NO: 70034 - RNA, 21 nt, Human
augcacacagauguacauaca

SEQ ID NO: 70035 - RNA, 32 nt, Human
augcacacaggcaugacacagguuuggauuca

SEQ ID NO: 70036 - RNA, 32 nt, Human
augcacacauacacaugcacacacacaugcac

SEQ ID NO: 70037 - RNA, 19 nt, Human
augcacacauacauacaua

SEQ ID NO: 70038 - RNA, 19 nt, Human
augcacacauauaugcaca

SEQ ID NO: 70039 - RNA, 23 nt, Human
augcacacccacaagccuauaca

SEQ ID NO: 70040 - RNA, 32 nt, Human
augcacacuuugcacacagacacacacguaua

SEQ ID NO: 70041 - RNA, 32 nt, Human
augcacagaacacacagauauaugcacacgug

SEQ ID NO: 70042 - RNA, 32 nt, Human
augcacagacuagagcagagcaauacaucaug

SEQ ID NO: 70043 - RNA, 32 nt, Human
augcacagagaaggaaaagggaacaucucauc

SEQ ID NO: 70044 - RNA, 32 nt, Human
augcacagagcagaggagggagaagcucuggg

SEQ ID NO: 70045 - RNA, 32 nt, Human
augcacagaggggaucacugugcagugggacc

SEQ ID NO: 70046 - RNA, 32 nt, Human
augcacagccauccuucccuaccuugagugag

SEQ ID NO: 70047 - RNA, 32 nt, Human
augcacagccucccugaggaugcucuuuuccu

SEQ ID NO: 70048 - RNA, 32 nt, Human
augcacagcuccauauccuggaagccucugua

SEQ ID NO: 70049 - RNA, 32 nt, Human
augcacaggaaagacacaggggaaggucaagu

SEQ ID NO: 70050 - RNA, 32 nt, Human
augcacaggccugcuugugaaucaggacugaa

SEQ ID NO: 70051 - RNA, 32 nt, Human
augcacagggcaggccacagagcucgagggac

SEQ ID NO: 70052 - RNA, 32 nt, Human
augcacagucccggggguggccuuggaggcug

SEQ ID NO: 70053 - RNA, 32 nt, Human
augcacaguggaggaaaagaacaaagaagcac

SEQ ID NO: 70054 - RNA, 32 nt, Human
augcacaguucugcacagugucuggcgcauau

SEQ ID NO: 70055 - RNA, 32 nt, Human
augcacauacacacaaaauuaggcgggagugg

SEQ ID NO: 70056 - RNA, 32 nt, Human
augcacauauagacacauacacccaaacacuu

SEQ ID NO: 70057 - RNA, 32 nt, Human
augcacauccaccauugucucugaguaguauu

SEQ ID NO: 70058 - RNA, 32 nt, Human
augcacaugcauuacacacaugcacacacaua

SEQ ID NO: 70059 - RNA, 32 nt, Human
augcaccaaucacagcucaugccgagguggag

SEQ ID NO: 70060 - RNA, 32 nt, Human
augcaccaccugacugauuuuguauuuuagua

SEQ ID NO: 70061 - RNA, 32 nt, Human
augcaccacggcacucaagccugggcaaugua

SEQ ID NO: 70062 - RNA, 32 nt, Human
augcaccacugcaccccagccugggcgacgga

SEQ ID NO: 70063 - RNA, 32 nt, Human
augcaccacugcacuccagcaugggcaacaca

SEQ ID NO: 70064 - RNA, 32 nt, Human
augcaccacugcaguccagccuaggcaacagu

SEQ ID NO: 70065 - RNA, 32 nt, Human
augcaccaggaaaauuuaggacagggacaaac

SEQ ID NO: 70066 - RNA, 16 nt, Human
augcaccaggguccca

SEQ ID NO: 70067 - RNA, 32 nt, Human
augcaccauugcacacuaaccugggugacaga

SEQ ID NO: 70068 - RNA, 32 nt, Human
augcaccccaacauugagauguguuuuuaaug

SEQ ID NO: 70069 - RNA, 32 nt, Human
augcaccuaaucuugaggcagcuucugaauug

SEQ ID NO: 70070 - RNA, 32 nt, Human
augcaccuaaucuugaggcagcuucugaguug

SEQ ID NO: 70071 - RNA, 32 nt, Human
augcaccuauguuuccagcuacuugggaggcg

SEQ ID NO: 70072 - RNA, 32 nt, Human
augcaccuauugucucaguuacuugggaggcu

SEQ ID NO: 70073 - RNA, 32 nt, Human
augcaccucgagcaacacuugugagccaugcu

SEQ ID NO: 70074 - RNA, 32 nt, Human
augcaccugcaaucccagcuacucgggaggcu

SEQ ID NO: 70075 - RNA, 32 nt, Human
augcaccugcagcugggugcugccagcagcuu

SEQ ID NO: 70076 - RNA, 32 nt, Human
augcaccugcauucccagcuacuugggaggcu

SEQ ID NO: 70077 - RNA, 32 nt, Human
augcaccuguaaacccagcuacuugggaggcu

SEQ ID NO: 70078 - RNA, 32 nt, Human
augcaccuguaaucccaacuacucagcugagg

SEQ ID NO: 70079 - RNA, 32 nt, Human
augcaccuguaaucccaacuacucuggaggcu

SEQ ID NO: 70080 - RNA, 32 nt, Human
augcaccuguaaucccaccuacucaggaggcu

SEQ ID NO: 70081 - RNA, 32 nt, Human
augcaccuguaaucccagcuacucaggaagcu

SEQ ID NO: 70082 - RNA, 32 nt, Human
augcaccuguaaucccagcuacucgggaggcu

SEQ ID NO: 70083 - RNA, 32 nt, Human
augcaccuguaaucccagcuacuugggaggcu

SEQ ID NO: 70084 - RNA, 32 nt, Human
augcaccuguagucccagcuacucaaguggcu

SEQ ID NO: 70085 - RNA, 32 nt, Human
augcaccuguagucccagcuacucaggaggcu

SEQ ID NO: 70086 - RNA, 32 nt, Human
augcaccuguagucccagcuacuccggaggcu

SEQ ID NO: 70087 - RNA, 32 nt, Human
augcaccuguagucccagcuacucuggaggcu

SEQ ID NO: 70088 - RNA, 32 nt, Human
augcaccuguagucccagcuacuugggaagcu

SEQ ID NO: 70089 - RNA, 32 nt, Human
augcaccuguagucccagcuacuuggggugcu

SEQ ID NO: 70090 - RNA, 32 nt, Human
augcaccuguagucccagcuauuugggaggcu

SEQ ID NO: 70091 - RNA, 32 nt, Human
augcaccuguagucccagcugcuugggaggcu

SEQ ID NO: 70092 - RNA, 32 nt, Human
augcaccugucaucccagcuacucgggaggcu

SEQ ID NO: 70093 - RNA, 32 nt, Human
augcaccuuacgaggcagagcaggcagacugg

SEQ ID NO: 70094 - RNA, 32 nt, Human
augcaccuuucaacuuuacaucauguccugaa

SEQ ID NO: 70095 - RNA, 32 nt, Human
augcacgcacacacacaugcacacauacacgu

SEQ ID NO: 70096 - RNA, 32 nt, Human
augcacgcacacacauacacacugaaggccac

SEQ ID NO: 70097 - RNA, 32 nt, Human
auggggguucuggcggggguuggaguacaaau

SEQ ID NO: 70098 - RNA, 32 nt, Human
augggguaaggcagaagcaccagcuguacuac

SEQ ID NO: 70099 - RNA, 28 nt, Human
augggguacccugcuucacagggcccuu

SEQ ID NO: 70100 - RNA, 23 nt, Human
augggguaccugaugaggacaag

SEQ ID NO: 70101 - RNA, 32 nt, Human
augggguacuuacacaaaccuagaugguauua

SEQ ID NO: 70102 - RNA, 32 nt, Human
augggguagaggagggcaugggagggagggag

SEQ ID NO: 70103 - RNA, 32 nt, Human
augggguaggccgggugcaguggcucacgccu

SEQ ID NO: 70104 - RNA, 32 nt, Human
auggggucacagugguuauaaagaguuauacc

SEQ ID NO: 70105 - RNA, 32 nt, Human
auggggucaucccagggcugccucccuccagc

SEQ ID NO: 70106 - RNA, 32 nt, Human
augggguccagcgcuggcugggcccagacaga

SEQ ID NO: 70107 - RNA, 32 nt, Human
auggggucgcccauggguagagacggcuuucu

SEQ ID NO: 70108 - RNA, 32 nt, Human
auggggucucacuauguugcccaggcuaguau

SEQ ID NO: 70109 - RNA, 32 nt, Human
auggggucucacuauguugcccaggcuggucu

SEQ ID NO: 70110 - RNA, 32 nt, Human
auggggucucacuauguugcccaggcuguucu

SEQ ID NO: 70111 - RNA, 32 nt, Human
auggggucucugccuauggaucauacuucaaa

SEQ ID NO: 70112 - RNA, 32 nt, Human
auggggucuuacuauguugcccaggcuggugu

SEQ ID NO: 70113 - RNA, 32 nt, Human
auggggucuuacuauguuguccaggcuaagag

SEQ ID NO: 70114 - RNA, 32 nt, Human
auggggucuuccucuguugcccaggcuggagu

SEQ ID NO: 70115 - RNA, 32 nt, Human
auggggucuugcuauguugcccaagcuggucu

SEQ ID NO: 70116 - RNA, 32 nt, Human
auggggucuugcuauguugcccaggcuggucu

SEQ ID NO: 70117 - RNA, 32 nt, Human
auggggucuuguuauguugcccaggcugaauu

SEQ ID NO: 70118 - RNA, 32 nt, Human
auggggugaaccuggggagccucgggggcaga

SEQ ID NO: 70119 - RNA, 31 nt, Human
auggggugacuucccuggucaccaaggcagu

SEQ ID NO: 70120 - RNA, 32 nt, Human
auggggugcaggaguggaggagaaacguggca

SEQ ID NO: 70121 - RNA, 32 nt, Human
auggggugcauucuagcuguugaccagauugc

SEQ ID NO: 70122 - RNA, 32 nt, Human
auggggugcugaaguggggucucagugagggg

SEQ ID NO: 70123 - RNA, 32 nt, Human
auggggugcuguguguuuuucagggcgcccug

SEQ ID NO: 70124 - RNA, 32 nt, Human
augggguggccuggccccuucucugcuuaaag

SEQ ID NO: 70125 - RNA, 32 nt, Human
auggggugggcaggccuggggugaaaugagaa

SEQ ID NO: 70126 - RNA, 32 nt, Human
auggggugggcugcucccagaaucugcucagc

SEQ ID NO: 70127 - RNA, 32 nt, Human
auggggugggggauauugagggagacagcgcu

SEQ ID NO: 70128 - RNA, 32 nt, Human
augggguggggugggaguagguagagcugaga

SEQ ID NO: 70129 - RNA, 32 nt, Human
auggggugucugcugggcccacuuacaggcag

SEQ ID NO: 70130 - RNA, 32 nt, Human
augggguguggaggggaaagggauagaaagcg

SEQ ID NO: 70131 - RNA, 32 nt, Human
augggguucucccuggaaugcaugauggcauu

SEQ ID NO: 70132 - RNA, 32 nt, Human
augggguugccccuccugaauuggaguuagcg

SEQ ID NO: 70133 - RNA, 32 nt, Human
augggguugugcaggcgagggugcagcacguu

SEQ ID NO: 70134 - RNA, 19 nt, Human
augggguuucaccacauug

SEQ ID NO: 70135 - RNA, 19 nt, Human
augggguuucaccaugcug

SEQ ID NO: 70136 - RNA, 18 nt, Human
augggguuucaccauguu

SEQ ID NO: 70137 - RNA, 19 nt, Human
augggguuucaccauguua

SEQ ID NO: 70138 - RNA, 19 nt, Human
augggguuucaccauguug

SEQ ID NO: 70139 - RNA, 32 nt, Human
augggguuucaccauguugccaaggccagucu

SEQ ID NO: 70140 - RNA, 20 nt, Human
augggguuucaccauguugg

SEQ ID NO: 70141 - RNA, 18 nt, Human
augggguuucaccguguu

SEQ ID NO: 70142 - RNA, 19 nt, Human
augggguuucacuauguug

SEQ ID NO: 70143 - RNA, 18 nt, Human
augggguuucacuguguu

SEQ ID NO: 70144 - RNA, 32 nt, Human
augggguuucaguugcgaaacaggucuguuuu

SEQ ID NO: 70145 - RNA, 19 nt, Human
augggguuucaucauguug

SEQ ID NO: 70146 - RNA, 18 nt, Human
augggguuucccauguug

SEQ ID NO: 70147 - RNA, 19 nt, Human
augggguuucgccacguug

SEQ ID NO: 70148 - RNA, 19 nt, Human
augggguuucgccauguug

SEQ ID NO: 70149 - RNA, 19 nt, Human
augggguuucgucauguug

SEQ ID NO: 70150 - RNA, 19 nt, Human
augggguuucuccauguug

SEQ ID NO: 70151 - RNA, 19 nt, Human
augggguuuuaccauguug

SEQ ID NO: 70152 - RNA, 32 nt, Human
augggguuuugccauguugcccaggcuggucu

SEQ ID NO: 70153 - RNA, 32 nt, Human
augggguuuugccauguugcccaggcuucucu

SEQ ID NO: 70154 - RNA, 32 nt, Human
augggguuuugcuauguugcccaggcuggucu

SEQ ID NO: 70155 - RNA, 32 nt, Human
auggguaaagcaggaagagagugggaaagaga

SEQ ID NO: 70156 - RNA, 25 nt, Human
auggguaggguggaagacgggggaa

SEQ ID NO: 70157 - RNA, 24 nt, Human
auggguaguaagcaugguuucuug

SEQ ID NO: 70158 - RNA, 32 nt, Human
auggguauaggggcuucauuuguucacucuga

SEQ ID NO: 70159 - RNA, 32 nt, Human
auggguaucacacccaagacuacccaccaagc

SEQ ID NO: 70160 - RNA, 32 nt, Human
augggucaacagucuuggccauuucucaucaa

SEQ ID NO: 70161 - RNA, 32 nt, Human
augggucccacugccuguccagccuggcuccc

SEQ ID NO: 70162 - RNA, 32 nt, Human
auggguccuaaccccugauuuugaugggaugu

SEQ ID NO: 70163 - RNA, 32 nt, Human
augggucucagcuaaaaugucaucccuucaaa

SEQ ID NO: 70164 - RNA, 32 nt, Human
augggucuccucuccacugagagcuggacacu

SEQ ID NO: 70165 - RNA, 32 nt, Human
augggucucuaccauggucaggucuugugcaa

SEQ ID NO: 70166 - RNA, 32 nt, Human
augggucucuggaaggcggcuugggcccuggg

SEQ ID NO: 70167 - RNA, 32 nt, Human
augggucuuucugcaggauuuaucaucccugg

SEQ ID NO: 70168 - RNA, 32 nt, Human
augggugaaugagcuugucaaugugauuuuaa

SEQ ID NO: 70169 - RNA, 20 nt, Human
augggugacuauuuugugaa

SEQ ID NO: 70170 - RNA, 32 nt, Human
augggugagacagaagcuucaucagcagugaa

SEQ ID NO: 70171 - RNA, 32 nt, Human
augggugaguaugucacaaauguauuggccaa

SEQ ID NO: 70172 - RNA, 32 nt, Human
augggugagucuguggccuucucuccagggcc

SEQ ID NO: 70173 - RNA, 25 nt, Human
augggugcaccacuacacaucagcc

SEQ ID NO: 70174 - RNA, 32 nt, Human
augggugcagcaaaguaccauggcacauguau

SEQ ID NO: 70175 - RNA, 32 nt, Human
augggugccuccugccccacacuggggccugc

SEQ ID NO: 70176 - RNA, 32 nt, Human
auggguggaauaagucugcuucaugccaaggc

SEQ ID NO: 70177 - RNA, 22 nt, Human
auggguggacucacacuugcuc

SEQ ID NO: 70178 - RNA, 32 nt, Human
auggguggagcagcagcucaagguccaggaua

SEQ ID NO: 70179 - RNA, 32 nt, Human
auggguggagcuauggcgccuccaaugaagga

SEQ ID NO: 70180 - RNA, 32 nt, Human
auggguggaucaccugagcucaggaguucaag

SEQ ID NO: 70181 - RNA, 32 nt, Human
auggguggccagcuuguacaccagucccugaa

SEQ ID NO: 70182 - RNA, 32 nt, Human
auggguggcugccugccugccugccugccuca

SEQ ID NO: 70183 - RNA, 32 nt, Human
augggugggcugucccgugagucccuagucca

SEQ ID NO: 70184 - RNA, 32 nt, Human
augggugggggccucugugagcaccacguaug

SEQ ID NO: 70185 - RNA, 32 nt, Human
auggguggguacuagggagacuggguacaagg

SEQ ID NO: 70186 - RNA, 23 nt, Human
augggugggucuaacuggcuuuu

SEQ ID NO: 70187 - RNA, 32 nt, Human
augggugguggggugcuagagcuguuuagaga

SEQ ID NO: 70188 - RNA, 32 nt, Human
augggugucccuugagucugagcuagagugug

SEQ ID NO: 70189 - RNA, 32 nt, Human
augggugucguggcaugagaucagcuggaggg

SEQ ID NO: 70190 - RNA, 32 nt, Human
augggugugaaugcacacacauacgcguacac

SEQ ID NO: 70191 - RNA, 32 nt, Human
augggugugcaugugcuugucuuagaaguauc

SEQ ID NO: 70192 - RNA, 32 nt, Human
auggguguggagccagucuccaagaggaugcc

SEQ ID NO: 70193 - RNA, 32 nt, Human
auggguguguguccuugggccgccagggucac

SEQ ID NO: 70194 - RNA, 32 nt, Human
auggguguuuuggcaccugccuguaaucucag

SEQ ID NO: 70195 - RNA, 32 nt, Human
auggguuauuucagaagauguaagcauuuuaa

SEQ ID NO: 70196 - RNA, 32 nt, Human
auggguucucaggguaugccaggggcagaaac

SEQ ID NO: 70197 - RNA, 32 nt, Human
auggguugacuugagagaagggcugaucucag

SEQ ID NO: 70198 - RNA, 32 nt, Human
auggguugaggagggcccauccccagcagccc

SEQ ID NO: 70199 - RNA, 32 nt, Human
auggguugcauaugauccagaauuacagcuga

SEQ ID NO: 70200 - RNA, 22 nt, Human
auggguuuagguugguuuuuug

SEQ ID NO: 70201 - RNA, 32 nt, Human
auggguuucagcaagaaagucugugaugugac

SEQ ID NO: 70202 - RNA, 32 nt, Human
auggguuucuacaucuucccuccugggaaugg

SEQ ID NO: 70203 - RNA, 21 nt, Human
auggguuucugaaauauuuua

SEQ ID NO: 70204 - RNA, 32 nt, Human
auggguuugagaccagccuggcaacacagcaa

SEQ ID NO: 70205 - RNA, 32 nt, Human
auggguuugggucagguggcucuggguucuga

SEQ ID NO: 70206 - RNA, 32 nt, Human
auggguuugucugucccugacuucugccucug

SEQ ID NO: 70207 - RNA, 32 nt, Human
auggguuuucuauuugaacaugugccuuuucu

SEQ ID NO: 70208 - RNA, 32 nt, Human
auggguuuuguuguuuuugggggcuaauuggu

SEQ ID NO: 70209 - RNA, 22 nt, Human
augguaaacgggaucuaaaaug

SEQ ID NO: 70210 - RNA, 32 nt, Human
augguaaagaggaaaaaggaaauacaaggaaa

SEQ ID NO: 70211 - RNA, 25 nt, Human
augguaaagauggaaaugcuggaaa

SEQ ID NO: 70212 - RNA, 32 nt, Human
augguaacacauacuccagauugaccuuauaa

SEQ ID NO: 70213 - RNA, 32 nt, Human
augguaacaccacugcacuccaaccugggcaa

SEQ ID NO: 70214 - RNA, 32 nt, Human
augguaacaguauguuaauacacacauacaua

SEQ ID NO: 70215 - RNA, 32 nt, Human
augguaaccugacacucucaggagacauuaag

SEQ ID NO: 70216 - RNA, 22 nt, Human
augguaacgggugccuguaguc

SEQ ID NO: 70217 - RNA, 22 nt, Human
augguaacucacgccuguaauc

SEQ ID NO: 70218 - RNA, 32 nt, Human
augguaacuguacauuuugugcuaaaaugcau

SEQ ID NO: 70219 - RNA, 22 nt, Human
augguaacuugugccuguaauu

SEQ ID NO: 70220 - RNA, 19 nt, Human
augguaagaaauugaagua

SEQ ID NO: 70221 - RNA, 18 nt, Human
augguaagaccucugaga

SEQ ID NO: 70222 - RNA, 32 nt, Human
augguaagacuuguauuuauaagggguaauuu

SEQ ID NO: 70223 - RNA, 19 nt, Human
augguaagaguuucuaaaa

SEQ ID NO: 70224 - RNA, 31 nt, Human
augguaagcuguaaauaccguuggaauaaaa

SEQ ID NO: 70225 - RNA, 17 nt, Human
augguaaggagaaaaua

SEQ ID NO: 70226 - RNA, 19 nt, Human
augguaagguucacaaaua

SEQ ID NO: 70227 - RNA, 18 nt, Human
augguaaguauugaaaua

SEQ ID NO: 70228 - RNA, 32 nt, Human
augguaauaauacuucaccuaccucauagggg

SEQ ID NO: 70229 - RNA, 32 nt, Human
augguaauggggauuagagaacugacaugaga

SEQ ID NO: 70230 - RNA, 23 nt, Human
augguaauucagucacuaaaaua

SEQ ID NO: 70231 - RNA, 32 nt, Human
augguacaagcagaggcucgggagaggcuccc

SEQ ID NO: 70232 - RNA, 32 nt, Human
augguacacauaacaguggaguggggaccaau

SEQ ID NO: 70233 - RNA, 21 nt, Human
augguacacuagaauuuucug

SEQ ID NO: 70234 - RNA, 32 nt, Human
augguacagccugcccucccaauuucaaaacc

SEQ ID NO: 70235 - RNA, 32 nt, Human
augguacaggcagagcucagggcgauccccag

SEQ ID NO: 70236 - RNA, 19 nt, Human
augguacaugcauuuucua

SEQ ID NO: 70237 - RNA, 32 nt, Human
augguacauggagcuuugaggugaaaacucau

SEQ ID NO: 70238 - RNA, 32 nt, Human
augguacauugaguaguguggggaagacaccu

SEQ ID NO: 70239 - RNA, 32 nt, Human
augguaccaaucaugaaucuuuguuucagguu

SEQ ID NO: 70240 - RNA, 32 nt, Human
augguaccacugcacuccagccugggugacag

SEQ ID NO: 70241 - RNA, 32 nt, Human
augguaccaucucauuaaaaauagauaccuca

SEQ ID NO: 70242 - RNA, 32 nt, Human
augguacccacgugggcauggaaauggggcag

SEQ ID NO: 70243 - RNA, 32 nt, Human
augguaccucugcacugcagccugggcaacag

SEQ ID NO: 70244 - RNA, 32 nt, Human
augguaccugcugccacucaucacagagcccu

SEQ ID NO: 70245 - RNA, 32 nt, Human
augguaccuuuuugucaggacaauuaggauug

SEQ ID NO: 70246 - RNA, 32 nt, Human
augguacuagcacaccacugcaugucucuaga

SEQ ID NO: 70247 - RNA, 32 nt, Human
augguacugcugcauccgggugucuggaggcu

SEQ ID NO: 70248 - RNA, 32 nt, Human
augguacugcuggcccaacacugcucucuuug

SEQ ID NO: 70249 - RNA, 32 nt, Human
augguacuuccucugugaacugugugugaauc

SEQ ID NO: 70250 - RNA, 32 nt, Human
augguagaaauguguuucucugcagaaacauc

SEQ ID NO: 70251 - RNA, 32 nt, Human
augguagaauggggugggggaggagggcgcac

SEQ ID NO: 70252 - RNA, 28 nt, Human
augguagcaagugcugcccuuuaucagc

SEQ ID NO: 70253 - RNA, 32 nt, Human
augguagcaaugggauauaauacccuucuaag

SEQ ID NO: 70254 - RNA, 32 nt, Human
augguagcaaugggauauaauaccuuucuaag

SEQ ID NO: 70255 - RNA, 32 nt, Human
augguagcaccacugcacuucagccuggacaa

SEQ ID NO: 70256 - RNA, 32 nt, Human
augguagcauuuuugcuugcuguguuuuccau

SEQ ID NO: 70257 - RNA, 32 nt, Human
augguagcgcacaccuguaauuccagcuacuc

SEQ ID NO: 70258 - RNA, 22 nt, Human
augguagcucacgccuguaauc

SEQ ID NO: 70259 - RNA, 20 nt, Human
augguagcucaugccuguaa

SEQ ID NO: 70260 - RNA, 22 nt, Human
augguagcucaugccuguaauc

SEQ ID NO: 70261 - RNA, 22 nt, Human
augguagcucaugcuuguaauc

SEQ ID NO: 70262 - RNA, 32 nt, Human
augguagcuuuggacuugcuuccccgucugac

SEQ ID NO: 70263 - RNA, 32 nt, Human
augguaggggaaacgugcuccuucuccaugcu

SEQ ID NO: 70264 - RNA, 22 nt, Human
augguaguccaugccuguaguc

SEQ ID NO: 70265 - RNA, 22 nt, Human
augguagugcaugccuguaguc

SEQ ID NO: 70266 - RNA, 32 nt, Human
augguaguggaggagccgaguaucuugauugu

SEQ ID NO: 70267 - RNA, 32 nt, Human
augguauagucuuucucaguucuuuuaauuuu

SEQ ID NO: 70268 - RNA, 32 nt, Human
augguauauuaacucuugagggcugcuaaacc

SEQ ID NO: 70269 - RNA, 32 nt, Human
augguaucaagaaaccccgaucacaaagauac

SEQ ID NO: 70270 - RNA, 32 nt, Human
augguauccauuagcugggacuuaaaugacuc

SEQ ID NO: 70271 - RNA, 32 nt, Human
augguauccuuccuaauuaucuuccaaaggaa

SEQ ID NO: 70272 - RNA, 32 nt, Human
augguaugaauccaggagguggagcuugcagu

SEQ ID NO: 70273 - RNA, 32 nt, Human
augguaugcucacaauuuucugcaaguugccu

SEQ ID NO: 70274 - RNA, 21 nt, Human
augguauggacagaucuucug

SEQ ID NO: 70275 - RNA, 32 nt, Human
augguauugcagcuucacugccugcguuccug

SEQ ID NO: 70276 - RNA, 32 nt, Human
augguauuuugaaaaguguucuuuccguguuc

SEQ ID NO: 70277 - RNA, 32 nt, Human
auggucaaaggggcugggcaugguggcucacg

SEQ ID NO: 70278 - RNA, 32 nt, Human
auggucaaggguguccugccugccugggucca

SEQ ID NO: 70279 - RNA, 22 nt, Human
auggucaauauuugguuuccua

SEQ ID NO: 70280 - RNA, 19 nt, Human
auggucacaagcacuccug

SEQ ID NO: 70281 - RNA, 32 nt, Human
auggucacaccacugcacuccagccugggcaa

SEQ ID NO: 70282 - RNA, 19 nt, Human
auggucacauacucuucua

SEQ ID NO: 70283 - RNA, 20 nt, Human
auggucacaugccaucucuu

SEQ ID NO: 70284 - RNA, 19 nt, Human
auggucaccaucauuccug

SEQ ID NO: 70285 - RNA, 19 nt, Human
auggucacccguauuuccu

SEQ ID NO: 70286 - RNA, 32 nt, Human
auggucacuacaggaugguggagcagggggca

SEQ ID NO: 70287 - RNA, 21 nt, Human
auggucacuagaaagucucuu

SEQ ID NO: 70288 - RNA, 32 nt, Human
auggucacuagguaugcaaucacgcauucaaa

SEQ ID NO: 70289 - RNA, 18 nt, Human
auggucacuauaguuuuc

SEQ ID NO: 70290 - RNA, 32 nt, Human
auggucacugcucuccucagggaccaggacaa

SEQ ID NO: 70291 - RNA, 19 nt, Human
auggucacuuccucucuua

SEQ ID NO: 70292 - RNA, 32 nt, Human
auggucacuuccucucuuaaaacagaaccagg

SEQ ID NO: 70293 - RNA, 22 nt, Human
auggucacuucuccauuuccug

SEQ ID NO: 70294 - RNA, 32 nt, Human
auggucagaggagacccagcuguccugcaccc

SEQ ID NO: 70295 - RNA, 32 nt, Human
auggucaggacagucagccacuacgugaugcu

SEQ ID NO: 70296 - RNA, 32 nt, Human
auggucaggaugguggugacagguguggggua

SEQ ID NO: 70297 - RNA, 32 nt, Human
auggucagugaaagcgcuuccucuuuaacucu

SEQ ID NO: 70298 - RNA, 32 nt, Human
auggucauaccaccgcacuccagccugagcaa

SEQ ID NO: 70299 - RNA, 32 nt, Human
auggucaucacugauaguaggauucuccucuc

SEQ ID NO: 70300 - RNA, 20 nt, Human
auggucaugacuuucuucug

SEQ ID NO: 70301 - RNA, 32 nt, Human
auggucaugccacugcacuccagccugggcaa

SEQ ID NO: 70302 - RNA, 19 nt, Human
auggucauuaccuuuccug

SEQ ID NO: 70303 - RNA, 20 nt, Human
auggucauuagcuccuuuua

SEQ ID NO: 70304 - RNA, 21 nt, Human
auggucauuaugccuuucucc

SEQ ID NO: 70305 - RNA, 31 nt, Human
augguccaaguguccauccagagaugagacu

SEQ ID NO: 70306 - RNA, 32 nt, Human
augguccacaggcuggagggugcauggaaccc

SEQ ID NO: 70307 - RNA, 32 nt, Human
augguccacaugcucacgcuguccaccugcca

SEQ ID NO: 70308 - RNA, 32 nt, Human
augguccaggacaggaggaugaaaugagaucc

SEQ ID NO: 70309 - RNA, 32 nt, Human
augguccaguaggaagagaagcagcccugauu

SEQ ID NO: 70310 - RNA, 32 nt, Human
augguccaucagcucucugccuuccagccaga

SEQ ID NO: 70311 - RNA, 32 nt, Human
augguccaugcauuguaauguccccuucucuc

SEQ ID NO: 70312 - RNA, 32 nt, Human
auggucccaccugugcgagacccccuguccug

SEQ ID NO: 70313 - RNA, 32 nt, Human
auggucccaggugagagaaggaagugaggcca

SEQ ID NO: 70314 - RNA, 32 nt, Human
augguccccugcccugcagcuccaccaugagg

SEQ ID NO: 70315 - RNA, 32 nt, Human
auggucccuccccugugcgccuuccucucagg

SEQ ID NO: 70316 - RNA, 24 nt, Human
auggucccucucaaguaucuccug

SEQ ID NO: 70317 - RNA, 32 nt, Human
auggucccuucccucuuucucucccuuucccu

SEQ ID NO: 70318 - RNA, 32 nt, Human
auggucccuuucuccacugcacuggagcuuug

SEQ ID NO: 70319 - RNA, 32 nt, Human
augguccgagggaccuuccacagcaaguagaa

SEQ ID NO: 70320 - RNA, 32 nt, Human
augguccucacacccagcucccugcacaccca

SEQ ID NO: 70321 - RNA, 32 nt, Human
augguccuccacccuuccugccauucugcccu

SEQ ID NO: 70322 - RNA, 31 nt, Human
augguccugcucucuggccccugcauccccu

SEQ ID NO: 70323 - RNA, 32 nt, Human
augguccugguuggcccuggcuuugccuacua

SEQ ID NO: 70324 - RNA, 32 nt, Human
auggucgcauuuucccugccuaccucacagag

SEQ ID NO: 70325 - RNA, 32 nt, Human
auggucggaggcagagguguuuccagugaucg

SEQ ID NO: 70326 - RNA, 31 nt, Human
auggucggucacuaugggccuggugucuccc

SEQ ID NO: 70327 - RNA, 21 nt, Human
auggucgugaaagcucuccua

SEQ ID NO: 70328 - RNA, 32 nt, Human
auggucuagaggcuggagauucaagaucuggg

SEQ ID NO: 70329 - RNA, 32 nt, Human
auggucuaggguagugcuggugaggagauaac

SEQ ID NO: 70330 - RNA, 32 nt, Human
auggucucaaucuccugaccucauguccaccu

SEQ ID NO: 70331 - RNA, 32 nt, Human
auggucucaaucuccugaccucauguccgccc

SEQ ID NO: 70332 - RNA, 32 nt, Human
auggucucagggaacagccugcuucccaccag

SEQ ID NO: 70333 - RNA, 32 nt, Human
auggucucaugcgcaugugucuugccccacuu

SEQ ID NO: 70334 - RNA, 32 nt, Human
auggucucauuuccuuugcuucuuuggaauau

SEQ ID NO: 70335 - RNA, 32 nt, Human
auggucuccugucuccagccugcuugaucuuu

SEQ ID NO: 70336 - RNA, 32 nt, Human
auggucucgaucuccugaccucgugaugggcc

SEQ ID NO: 70337 - RNA, 32 nt, Human
auggucucgaucuccugaccucguguccaccc

SEQ ID NO: 70338 - RNA, 32 nt, Human
auggucucgaucuccugaccuuguguccgccc

SEQ ID NO: 70339 - RNA, 32 nt, Human
auggucucgaucuccugacuucgugucugccc

SEQ ID NO: 70340 - RNA, 32 nt, Human
auggucucgaucugcugaccucgugauccacc

SEQ ID NO: 70341 - RNA, 32 nt, Human
auggucucgauuuccugaccucguguccgccc

SEQ ID NO: 70342 - RNA, 32 nt, Human
auggucucuaaccacuugacaccagaaacccc

SEQ ID NO: 70343 - RNA, 32 nt, Human
auggucucuacagggaggggagucuagggaau

SEQ ID NO: 70344 - RNA, 28 nt, Human
auggucucuagugcugccuaucaacuug

SEQ ID NO: 70345 - RNA, 32 nt, Human
auggucucuaucuccugaccucgugauccgcc

SEQ ID NO: 70346 - RNA, 32 nt, Human
auggucucuaucuccugaccucgugaucugcc

SEQ ID NO: 70347 - RNA, 32 nt, Human
auggucucuaucuccugaccucguguccgccc

SEQ ID NO: 70348 - RNA, 32 nt, Human
auggucucuaucuccugaccuugugauccgcc

SEQ ID NO: 70349 - RNA, 32 nt, Human
auggucucucccuccuggccucaggcccauuc

SEQ ID NO: 70350 - RNA, 32 nt, Human
auggucucugaagccaaaccugaguuugguuu

SEQ ID NO: 70351 - RNA, 24 nt, Human
auggucucugucacaucugggaca

SEQ ID NO: 70352 - RNA, 32 nt, Human
auggucugacaccugggcuggagugcaguggu

SEQ ID NO: 70353 - RNA, 32 nt, Human
auggucugcagcucugggcccccagccccacu

SEQ ID NO: 70354 - RNA, 32 nt, Human
auggucuggagugcucuguagaacagcccgaa

SEQ ID NO: 70355 - RNA, 32 nt, Human
auggucuggaguggucuggaaagcagggucag

SEQ ID NO: 70356 - RNA, 29 nt, Human
auggucuggcugcgcucagucccuuaagc

SEQ ID NO: 70357 - RNA, 32 nt, Human
auggucuggggugaccccaugccuguaacuga

SEQ ID NO: 70358 - RNA, 32 nt, Human
auggucugguccaaucugcaucuuguuguguc

SEQ ID NO: 70359 - RNA, 18 nt, Human
auggucuucgcgucuccu

SEQ ID NO: 70360 - RNA, 32 nt, Human
auggucuugaucuccugaccucguguccaccc

SEQ ID NO: 70361 - RNA, 32 nt, Human
auggucuuuaucuccugaccucaugauccgcc

SEQ ID NO: 70362 - RNA, 32 nt, Human
auggucuuugagacagaggauucugguguagg

SEQ ID NO: 70363 - RNA, 32 nt, Human
auggugaaaccccgucucuaccaaaauacaaa

SEQ ID NO: 70364 - RNA, 32 nt, Human
auggugaaacccugucucuaccaaaauacaaa

SEQ ID NO: 70365 - RNA, 32 nt, Human
auggugaacuggaguuucucuugugagaguuc

SEQ ID NO: 70366 - RNA, 32 nt, Human
auggugaaggaaacucagaaacuuacugcagu

SEQ ID NO: 70367 - RNA, 20 nt, Human
auggugaauccccaaaaaua

SEQ ID NO: 70368 - RNA, 32 nt, Human
auggugaaugugccagggacuguugacauuca

SEQ ID NO: 70369 - RNA, 32 nt, Human
auggugacaaguccugggcaguucugguaaac

SEQ ID NO: 70370 - RNA, 32 nt, Human
auggugacaauguguggaggacauaggccaga

SEQ ID NO: 70371 - RNA, 22 nt, Human
auggugacacacaccuguaauc

SEQ ID NO: 70372 - RNA, 22 nt, Human
auggugacacaugccuguaguc

SEQ ID NO: 70373 - RNA, 22 nt, Human
auggugacaggugccuguaauc

SEQ ID NO: 70374 - RNA, 22 nt, Human
auggugacccacaccuguaauc

SEQ ID NO: 70375 - RNA, 22 nt, Human
auggugacgggugccuguaauc

SEQ ID NO: 70376 - RNA, 32 nt, Human
auggugacucacaauuguccucagaaccuagu

SEQ ID NO: 70377 - RNA, 22 nt, Human
auggugacucacaucuguaauc

SEQ ID NO: 70378 - RNA, 22 nt, Human
auggugacucaggccuguaauc

SEQ ID NO: 70379 - RNA, 22 nt, Human
auggugacucauaccuguaauc

SEQ ID NO: 70380 - RNA, 22 nt, Human
auggugacucaugccuguaauc

SEQ ID NO: 70381 - RNA, 32 nt, Human
auggugacugauguaguuauuaauacuaccaa

SEQ ID NO: 70382 - RNA, 32 nt, Human
auggugagaaaacagaaaaaugagaucagaag

SEQ ID NO: 70383 - RNA, 32 nt, Human
auggugagaaggaggaugaagggaggagagag

SEQ ID NO: 70384 - RNA, 32 nt, Human
auggugagacuccuaaaaugacaggaguuuuu

SEQ ID NO: 70385 - RNA, 32 nt, Human
auggugagacucugccucuacaaaagaaaaau

SEQ ID NO: 70386 - RNA, 32 nt, Human
auggugagcugcaugucuggaggcuuaacaga

SEQ ID NO: 70387 - RNA, 32 nt, Human
auggugaggcgaaggccagguugggggcagug

SEQ ID NO: 70388 - RNA, 32 nt, Human
auggugaguuggcuuccagagcuguggguaga

SEQ ID NO: 70389 - RNA, 32 nt, Human
auggugauauuacuggaacucaucucauaggg

SEQ ID NO: 70390 - RNA, 32 nt, Human
auggugaugaggcacccugaggccuccauggg

SEQ ID NO: 70391 - RNA, 22 nt, Human
auggugaugagugccuguaguc

SEQ ID NO: 70392 - RNA, 22 nt, Human
auggugaugcacaccuguaauc

SEQ ID NO: 70393 - RNA, 22 nt, Human
auggugaugcaugccuguaauc

SEQ ID NO: 70394 - RNA, 32 nt, Human
auggugauggagggcaacaaggacuccgagga

SEQ ID NO: 70395 - RNA, 18 nt, Human
auggugaugucuguaauc

SEQ ID NO: 70396 - RNA, 21 nt, Human
auggugauuaaaaugaguuua

SEQ ID NO: 70397 - RNA, 32 nt, Human
auggugcaaguauaucaaagaggcacaaaaac

SEQ ID NO: 70398 - RNA, 21 nt, Human
auggugcacacgccuguaauc

SEQ ID NO: 70399 - RNA, 32 nt, Human
auggugcagaagcagcaggaggcacuugagga

SEQ ID NO: 70400 - RNA, 32 nt, Human
auggugcagcacucuggcauuuaucaccccca

SEQ ID NO: 70401 - RNA, 32 nt, Human
auggugcagguaaaagcacaucuuucucacac

SEQ ID NO: 70402 - RNA, 19 nt, Human
auggugcaugccuguaauc

SEQ ID NO: 70403 - RNA, 19 nt, Human
auggugcaugccuguaguc

SEQ ID NO: 70404 - RNA, 22 nt, Human
auggugcauuacguauuuccug

SEQ ID NO: 70405 - RNA, 24 nt, Human
auggugccaaggcugucuuuguau

SEQ ID NO: 70406 - RNA, 32 nt, Human
auggugccacuacacuccagccuggguaaaag

SEQ ID NO: 70407 - RNA, 32 nt, Human
auggugccacugcaccaucuggacaacagagc

SEQ ID NO: 70408 - RNA, 32 nt, Human
auggugccacugcacuccagccuaggugacag

SEQ ID NO: 70409 - RNA, 32 nt, Human
auggugccacugcacuccagccuggcgacaga

SEQ ID NO: 70410 - RNA, 32 nt, Human
auggugccacugcacuccagccugggcaacag

SEQ ID NO: 70411 - RNA, 32 nt, Human
auggugccacugcacuccagccugggcgaaag

SEQ ID NO: 70412 - RNA, 32 nt, Human
auggugccacugcacuccagccugggggacag

SEQ ID NO: 70413 - RNA, 32 nt, Human
auggugccacugcacuccagccugggugacag

SEQ ID NO: 70414 - RNA, 32 nt, Human
auggugccacugcacuccagccuggguggcag

SEQ ID NO: 70415 - RNA, 32 nt, Human
auggugccacugcacuccagcuuaggugacag

SEQ ID NO: 70416 - RNA, 32 nt, Human
auggugccacugcacuccaguauggaugacau

SEQ ID NO: 70417 - RNA, 32 nt, Human
auggugccacugcacuccagucugggcaacag

SEQ ID NO: 70418 - RNA, 32 nt, Human
auggugccacugcacucuaaccugggcgacag

SEQ ID NO: 70419 - RNA, 32 nt, Human
auggugccacugcacuucagccugggcaacag

SEQ ID NO: 70420 - RNA, 32 nt, Human
auggugccacugcauuccagccugggcaacag

SEQ ID NO: 70421 - RNA, 32 nt, Human
auggugccacugcauuccagccugggugacag

SEQ ID NO: 70422 - RNA, 32 nt, Human
auggugccacuggacuccagccugggagacag

SEQ ID NO: 70423 - RNA, 32 nt, Human
auggugccacuguacuccagccugggugauag

SEQ ID NO: 70424 - RNA, 32 nt, Human
auggugccaggcagggcagacauggcaaggaa

SEQ ID NO: 70425 - RNA, 32 nt, Human
auggugccaucauacucacugcagccuugacc

SEQ ID NO: 70426 - RNA, 32 nt, Human
auggugccaugaaaagguuauguaauaaaaua

SEQ ID NO: 70427 - RNA, 32 nt, Human
auggugccauugcccuccagccugggcaagaa

SEQ ID NO: 70428 - RNA, 32 nt, Human
auggugcccaagggaagagacacuccuuuccu

SEQ ID NO: 70429 - RNA, 32 nt, Human
auggugcccaggcuggagugcaguggcgugau

SEQ ID NO: 70430 - RNA, 32 nt, Human
auggugcccgugccucugugcuguguauguga

SEQ ID NO: 70431 - RNA, 32 nt, Human
auggugcccuauaugggguauuggacauagau

SEQ ID NO: 70432 - RNA, 32 nt, Human
auggugccguugcacuccagccgggcaacaag

SEQ ID NO: 70433 - RNA, 22 nt, Human
auggugccucacaccuguaauc

SEQ ID NO: 70434 - RNA, 32 nt, Human
auggugccucaguaaauauguuauuaaauaug

SEQ ID NO: 70435 - RNA, 32 nt, Human
auggugccuccagggagccuuccuggucccag

SEQ ID NO: 70436 - RNA, 32 nt, Human
auggugccuccugcccucuccucucucaggag

SEQ ID NO: 70437 - RNA, 32 nt, Human
auggugccugugugccuggccuuggggauggc

SEQ ID NO: 70438 - RNA, 32 nt, Human
auggugcgagucacggaucugcgcaggaaggg

SEQ ID NO: 70439 - RNA, 32 nt, Human
auggugcggcaucuugcuguuguacuucugaa

SEQ ID NO: 70440 - RNA, 24 nt, Human
auggugcuagcugcaaguccauca

SEQ ID NO: 70441 - RNA, 32 nt, Human
auggugcucacaaucauauacagggaacccug

SEQ ID NO: 70442 - RNA, 32 nt, Human
auggugcuccagaccaugaaacugcuagcaau

SEQ ID NO: 70443 - RNA, 32 nt, Human
auggugcucuggggcuggaggcuaguaaggaa

SEQ ID NO: 70444 - RNA, 32 nt, Human
auggugcucuuuuguugaaccuguauugauuu

SEQ ID NO: 70445 - RNA, 32 nt, Human
auggugcugaugguaaaguuugagacuuuugc

SEQ ID NO: 70446 - RNA, 25 nt, Human
auggugcugcaccuacugcucuucu

SEQ ID NO: 70447 - RNA, 22 nt, Human
auggugcugcaugccugcaauc

SEQ ID NO: 70448 - RNA, 32 nt, Human
auggugcugcuccuguccagagacaggcccuc

SEQ ID NO: 70449 - RNA, 32 nt, Human
auggugcuggcaggaauggcuaagggugaugg

SEQ ID NO: 70450 - RNA, 32 nt, Human
auggugcuugcuggugccugccaccuucaagu

SEQ ID NO: 70451 - RNA, 32 nt, Human
auggugcuuggggcuuugugaaugaucagugg

SEQ ID NO: 70452 - RNA, 32 nt, Human
augguggaaggugaacagggagcaggcacggc

SEQ ID NO: 70453 - RNA, 32 nt, Human
augguggaagucagagagcaacccuggggauu

SEQ ID NO: 70454 - RNA, 21 nt, Human
augguggacucgccuguaauc

SEQ ID NO: 70455 - RNA, 32 nt, Human
augguggagaccagggacaggagagccagcag

SEQ ID NO: 70456 - RNA, 32 nt, Human
augguggagagggagcuggggcgcauggggaa

SEQ ID NO: 70457 - RNA, 22 nt, Human
augguggagcaugccuguaguc

SEQ ID NO: 70458 - RNA, 32 nt, Human
augguggaggcagcgaugagaccuggagucua

SEQ ID NO: 70459 - RNA, 32 nt, Human
augguggagguggaggauaugaugguuacaau

SEQ ID NO: 70460 - RNA, 32 nt, Human
augguggagguggugguggugguggugguagu

SEQ ID NO: 70461 - RNA, 22 nt, Human
augguggcaaacgccuguaauc

SEQ ID NO: 70462 - RNA, 22 nt, Human
augguggcaagagccuguaauc

SEQ ID NO: 70463 - RNA, 22 nt, Human
augguggcaagcgccuguaguc

SEQ ID NO: 70464 - RNA, 32 nt, Human
augguggcaaguaccuguagucucagcuauug

SEQ ID NO: 70465 - RNA, 22 nt, Human
augguggcacaagccuguaauc

SEQ ID NO: 70466 - RNA, 22 nt, Human
augguggcacacaccuguaauc

SEQ ID NO: 70467 - RNA, 22 nt, Human
augguggcacacaccuguaguc

SEQ ID NO: 70468 - RNA, 32 nt, Human
augguggcacacaccuguagucccaggcugag

SEQ ID NO: 70469 - RNA, 22 nt, Human
augguggcacacgccuguaauc

SEQ ID NO: 70470 - RNA, 22 nt, Human
augguggcacacgccuguaguc

SEQ ID NO: 70471 - RNA, 22 nt, Human
augguggcacacgcuuguaauc

SEQ ID NO: 70472 - RNA, 32 nt, Human
augguggcacauaccuguggucucagcuauuc

SEQ ID NO: 70473 - RNA, 22 nt, Human
augguggcacaugacuguaauc

SEQ ID NO: 70474 - RNA, 22 nt, Human
augguggcacaugccuauaguc

SEQ ID NO: 70475 - RNA, 20 nt, Human
augguggcacaugccuguaa

SEQ ID NO: 70476 - RNA, 22 nt, Human
augguggcacaugccuguaauc

SEQ ID NO: 70477 - RNA, 22 nt, Human
augguggcacaugccuguaguc

SEQ ID NO: 70478 - RNA, 32 nt, Human
augguggcacaugccuguggucucagcuacuu

SEQ ID NO: 70479 - RNA, 22 nt, Human
augguggcacaugcuuguaauc

SEQ ID NO: 70480 - RNA, 32 nt, Human
augguggcaccacugcacuccagccuggguga

SEQ ID NO: 70481 - RNA, 22 nt, Human
augguggcaccugccuguaauc

SEQ ID NO: 70482 - RNA, 21 nt, Human
augguggcacgcucuguaauc

SEQ ID NO: 70483 - RNA, 32 nt, Human
augguggcacgugaguuaggucucagcuacuc

SEQ ID NO: 70484 - RNA, 32 nt, Human
augguggcaggcaccuguaaucccagcuacuu

SEQ ID NO: 70485 - RNA, 32 nt, Human
augguggcaggcaccuguagucccagccaguc

SEQ ID NO: 70486 - RNA, 32 nt, Human
augguggcaggcaccuguagucccagcuacuc

SEQ ID NO: 70487 - RNA, 22 nt, Human
augguggcaggcgccuguaauc

SEQ ID NO: 70488 - RNA, 22 nt, Human
augguggcaggcgccuguaguc

SEQ ID NO: 70489 - RNA, 22 nt, Human
augguggcaggugccuguaauc

SEQ ID NO: 70490 - RNA, 22 nt, Human
augguggcaggugccuguaguc

SEQ ID NO: 70491 - RNA, 22 nt, Human
augguggcagucaccuguaauc

SEQ ID NO: 70492 - RNA, 22 nt, Human
augguggcaguugccuguaauc

SEQ ID NO: 70493 - RNA, 22 nt, Human
augguggcauaugccuguaguc

SEQ ID NO: 70494 - RNA, 22 nt, Human
augguggcaugcgccuguaauc

SEQ ID NO: 70495 - RNA, 22 nt, Human
augguggcaugugccugcaauc

SEQ ID NO: 70496 - RNA, 22 nt, Human
augguggcaugugccuguaauc

SEQ ID NO: 70497 - RNA, 22 nt, Human
augguggcaugugccuguaguc

SEQ ID NO: 70498 - RNA, 22 nt, Human
augguggcaugugccuguauuc

SEQ ID NO: 70499 - RNA, 32 nt, Human
augguggcaugugccuguggucucagcuacuc

SEQ ID NO: 70500 - RNA, 22 nt, Human
augguggcauguggcuguaauc

SEQ ID NO: 70501 - RNA, 22 nt, Human
augguggcauuugccuguaauc

SEQ ID NO: 70502 - RNA, 30 nt, Human
augguggccaggagugcggucuacuugggg

SEQ ID NO: 70503 - RNA, 22 nt, Human
augguggcccacgccuguaauc

SEQ ID NO: 70504 - RNA, 32 nt, Human
augguggccgugguggucaugugccucguguc

SEQ ID NO: 70505 - RNA, 32 nt, Human
augguggccugaggccaggaggcugcagcugc

SEQ ID NO: 70506 - RNA, 22 nt, Human
augguggcgaaugacuguaauc

SEQ ID NO: 70507 - RNA, 22 nt, Human
augguggcgaaugccuguaauc

SEQ ID NO: 70508 - RNA, 22 nt, Human
augguggcgagugccuguaauc

SEQ ID NO: 70509 - RNA, 22 nt, Human
augguggcgcaagccuguaauc

SEQ ID NO: 70510 - RNA, 22 nt, Human
augguggcgcacaccuguaauc

SEQ ID NO: 70511 - RNA, 22 nt, Human
augguggcgcacaccuguaguc

SEQ ID NO: 70512 - RNA, 22 nt, Human
augguggcgcacgccuguaguc

SEQ ID NO: 70513 - RNA, 22 nt, Human
augguggcgcauaccuguaauc

SEQ ID NO: 70514 - RNA, 22 nt, Human
augguggcgcauaccuguaguc

SEQ ID NO: 70515 - RNA, 22 nt, Human
augguggcgcaugccuguaauc

SEQ ID NO: 70516 - RNA, 22 nt, Human
augguggcgcaugccuguaguc

SEQ ID NO: 70517 - RNA, 22 nt, Human
augguggcgcaugccugugauc

SEQ ID NO: 70518 - RNA, 32 nt, Human
augguggcgccugccuguggucucagcuacuc

SEQ ID NO: 70519 - RNA, 22 nt, Human
augguggcgggcgccuguaguc

SEQ ID NO: 70520 - RNA, 22 nt, Human
augguggcgggugccuguaauc

SEQ ID NO: 70521 - RNA, 22 nt, Human
augguggcgggugccuguaguc

SEQ ID NO: 70522 - RNA, 22 nt, Human
augguggcguacgccuguaguc

SEQ ID NO: 70523 - RNA, 22 nt, Human
augguggcguaugccuguaauc

SEQ ID NO: 70524 - RNA, 20 nt, Human
augguggcgugccuguauuc

SEQ ID NO: 70525 - RNA, 22 nt, Human
augguggcgugugccuguaauc

SEQ ID NO: 70526 - RNA, 22 nt, Human
augguggcucaagccuauaauc

SEQ ID NO: 70527 - RNA, 32 nt, Human
augguggcucaagccucuaaucucaacgcuuu

SEQ ID NO: 70528 - RNA, 22 nt, Human
augguggcucaagccuguaauc

SEQ ID NO: 70529 - RNA, 22 nt, Human
augguggcucacaccgguaauc

SEQ ID NO: 70530 - RNA, 22 nt, Human
augguggcucacaccuauaauc

SEQ ID NO: 70531 - RNA, 32 nt, Human
augguggcucacaccuguaacccccagcacuu

SEQ ID NO: 70532 - RNA, 22 nt, Human
augguggcucacaccuguaauc

SEQ ID NO: 70533 - RNA, 22 nt, Human
augguggcucacaccuguaauu

SEQ ID NO: 70534 - RNA, 32 nt, Human
augguggcucacaccuguaauuccagcacuuu

SEQ ID NO: 70535 - RNA, 32 nt, Human
augguggcucacaccuguaauucuagcacuuu

SEQ ID NO: 70536 - RNA, 32 nt, Human
augguggcucacaccuguaauuucagcaccuu

SEQ ID NO: 70537 - RNA, 22 nt, Human
augguggcucacaccugugauc

SEQ ID NO: 70538 - RNA, 32 nt, Human
augguggcucacaccugugcucccagcacuuu

SEQ ID NO: 70539 - RNA, 22 nt, Human
augguggcucacacguguaauc

SEQ ID NO: 70540 - RNA, 32 nt, Human
augguggcucacccccuguaaucccagcacuu

SEQ ID NO: 70541 - RNA, 22 nt, Human
augguggcucacgcccguaauc

SEQ ID NO: 70542 - RNA, 22 nt, Human
augguggcucacgccuauaauu

SEQ ID NO: 70543 - RNA, 22 nt, Human
augguggcucacgccugaaauc

SEQ ID NO: 70544 - RNA, 20 nt, Human
augguggcucacgccuguaa

SEQ ID NO: 70545 - RNA, 22 nt, Human
augguggcucacgccuguaauc

SEQ ID NO: 70546 - RNA, 32 nt, Human
augguggcucacgccuguaauccuagcauuuu

SEQ ID NO: 70547 - RNA, 22 nt, Human
augguggcucacgccuguaguc

SEQ ID NO: 70548 - RNA, 22 nt, Human
augguggcucacgccugugauc

SEQ ID NO: 70549 - RNA, 32 nt, Human
augguggcucacgccuguggucucagcacuuu

SEQ ID NO: 70550 - RNA, 22 nt, Human
augguggcucacgcuuguaauc

SEQ ID NO: 70551 - RNA, 22 nt, Human
augguggcucaggccuguaauc

SEQ ID NO: 70552 - RNA, 22 nt, Human
augguggcucauaccuguaauc

SEQ ID NO: 70553 - RNA, 22 nt, Human
augguggcucaugccuauaauc

SEQ ID NO: 70554 - RNA, 22 nt, Human
augguggcucaugccuauauuc

SEQ ID NO: 70555 - RNA, 22 nt, Human
augguggcucaugccuauuauc

SEQ ID NO: 70556 - RNA, 22 nt, Human
augguggcucaugccuccaauc

SEQ ID NO: 70557 - RNA, 20 nt, Human
augguggcucaugccuguaa

SEQ ID NO: 70558 - RNA, 22 nt, Human
augguggcucaugccuguaauc

SEQ ID NO: 70559 - RNA, 32 nt, Human
augguggcucaugccuguaaucccagcauuuu

SEQ ID NO: 70560 - RNA, 22 nt, Human
augguggcucaugccuguaguc

SEQ ID NO: 70561 - RNA, 32 nt, Human
augguggcucaugccuguaucccagcacuuug

SEQ ID NO: 70562 - RNA, 22 nt, Human
augguggcucaugccugugauc

SEQ ID NO: 70563 - RNA, 22 nt, Human
augguggcucaugcuuguaauc

SEQ ID NO: 70564 - RNA, 32 nt, Human
augguggcucauguuuguaaaucccagcacuu

SEQ ID NO: 70565 - RNA, 22 nt, Human
augguggcucccgccuguaauc

SEQ ID NO: 70566 - RNA, 22 nt, Human
augguggcucgugccuguaauc

SEQ ID NO: 70567 - RNA, 22 nt, Human
augguggcugacgccuguaauc

SEQ ID NO: 70568 - RNA, 22 nt, Human
augguggcuggcgccuguaguc

SEQ ID NO: 70569 - RNA, 22 nt, Human
augguggcuggugucuguaauc

SEQ ID NO: 70570 - RNA, 22 nt, Human
augguggcuuacaccuguaauc

SEQ ID NO: 70571 - RNA, 22 nt, Human
augguggcuuacaucuguaauc

SEQ ID NO: 70572 - RNA, 22 nt, Human
augguggcuuacgccuguaauc

SEQ ID NO: 70573 - RNA, 22 nt, Human
augguggcuuaugccuguaauc

SEQ ID NO: 70574 - RNA, 22 nt, Human
augguggcuugcaccuguaauc

SEQ ID NO: 70575 - RNA, 32 nt, Human
auggugggaaauucagcugaguuccaccaauu

SEQ ID NO: 70576 - RNA, 32 nt, Human
auggugggagagacugugaggcggcagcuggg

SEQ ID NO: 70577 - RNA, 32 nt, Human
auggugggagauguuguuacagaacugggcuu

SEQ ID NO: 70578 - RNA, 32 nt, Human
auggugggauaagagaaaagccaagggcagaa

SEQ ID NO: 70579 - RNA, 32 nt, Human
auggugggaugcugaggucggaggcuucgcuu

SEQ ID NO: 70580 - RNA, 32 nt, Human
auggugggcaccaaucuacaacuaugucauua

SEQ ID NO: 70581 - RNA, 19 nt, Human
auggugggcaccuguaauc

SEQ ID NO: 70582 - RNA, 32 nt, Human
augguggggaggauggggugaauuuaggaaag

SEQ ID NO: 70583 - RNA, 22 nt, Human
augguggggcacgccuguaguc

SEQ ID NO: 70584 - RNA, 22 nt, Human
augguggggcaugccuguaguc

SEQ ID NO: 70585 - RNA, 22 nt, Human
augguggggcgugccuguaguc

SEQ ID NO: 70586 - RNA, 32 nt, Human
auggugggggcagcuccucuucuucugacuca

SEQ ID NO: 70587 - RNA, 32 nt, Human
augguggggguggccccggcaggccuggcucc

SEQ ID NO: 70588 - RNA, 32 nt, Human
augguggggugagggaauaugagugcguggug

SEQ ID NO: 70589 - RNA, 22 nt, Human
augguggguugugccuguaauc

SEQ ID NO: 70590 - RNA, 22 nt, Human
auggugguacacgccuguaguc

SEQ ID NO: 70591 - RNA, 18 nt, Human
auggugguacccaagaua

SEQ ID NO: 70592 - RNA, 22 nt, Human
auggugguacucgccuguaguc

SEQ ID NO: 70593 - RNA, 22 nt, Human
auggugguagaugccuguaauu

SEQ ID NO: 70594 - RNA, 22 nt, Human
auggugguaggugccuguaauc

SEQ ID NO: 70595 - RNA, 32 nt, Human
auggugguagugcaccuguagucccagcuacu

SEQ ID NO: 70596 - RNA, 32 nt, Human
auggugguauguugaagcguugugugaucaag

SEQ ID NO: 70597 - RNA, 32 nt, Human
augguggucgagggguuggaggaauuaaaaga

SEQ ID NO: 70598 - RNA, 32 nt, Human
augguggucucaggauaacauuccaagaacgu

SEQ ID NO: 70599 - RNA, 31 nt, Human
augguggucuucuccccuugccaggccuugg

SEQ ID NO: 70600 - RNA, 32 nt, Human
augguggucuucuccccuugccaggccuugga

SEQ ID NO: 70601 - RNA, 32 nt, Human
augguggugaagaugucgguggacucuaugau

SEQ ID NO: 70602 - RNA, 22 nt, Human
augguggugagugccuguaauc

SEQ ID NO: 70603 - RNA, 22 nt, Human
augguggugcacgccuguaguc

SEQ ID NO: 70604 - RNA, 22 nt, Human
augguggugcauaccuguaguc

SEQ ID NO: 70605 - RNA, 21 nt, Human
augguggugcauccuguaauc

SEQ ID NO: 70606 - RNA, 22 nt, Human
augguggugcaugacuguaauc

SEQ ID NO: 70607 - RNA, 22 nt, Human
augguggugcaugccuguaauc

SEQ ID NO: 70608 - RNA, 22 nt, Human
augguggugcaugccuguaauu

SEQ ID NO: 70609 - RNA, 22 nt, Human
augguggugcaugccuguauuc

SEQ ID NO: 70610 - RNA, 22 nt, Human
augguggugccugccuguaguc

SEQ ID NO: 70611 - RNA, 22 nt, Human
augguggugcgugccuguaauc

SEQ ID NO: 70612 - RNA, 22 nt, Human
augguggugcgugccuguaguc

SEQ ID NO: 70613 - RNA, 32 nt, Human
auggugguggaggccaauacuuugccaaacca

SEQ ID NO: 70614 - RNA, 19 nt, Human
auggugguggccuguaauc

SEQ ID NO: 70615 - RNA, 32 nt, Human
auggugguggcuugagagccuuggggaaauua

SEQ ID NO: 70616 - RNA, 32 nt, Human
augguggugggacgucuguaaucccagcuacu

SEQ ID NO: 70617 - RNA, 32 nt, Human
augguggugggcaccuguggucucagcuacuc

SEQ ID NO: 70618 - RNA, 22 nt, Human
augguggugggugccuguaauc

SEQ ID NO: 70619 - RNA, 32 nt, Human
auggugguggugaugauguugaugacaauuau

SEQ ID NO: 70620 - RNA, 22 nt, Human
auggugguguacgccuguaauc

SEQ ID NO: 70621 - RNA, 22 nt, Human
auggugguguaugccuguaguc

SEQ ID NO: 70622 - RNA, 32 nt, Human
augguggugugcaccugagaaucccagcuacu

SEQ ID NO: 70623 - RNA, 22 nt, Human
augguggugugugccuguaauc

SEQ ID NO: 70624 - RNA, 22 nt, Human
augguggugugugccuguaguc

SEQ ID NO: 70625 - RNA, 32 nt, Human
auggugguucacaccuguaaucccggcacuuu

SEQ ID NO: 70626 - RNA, 22 nt, Human
auggugguucaugccuguaauc

SEQ ID NO: 70627 - RNA, 32 nt, Human
augguguaacacuaaaguaggugguucgugug

SEQ ID NO: 70628 - RNA, 32 nt, Human
augguguauguaaugguacaggcaaaugugac

SEQ ID NO: 70629 - RNA, 32 nt, Human
auggugucacaguguuugguucuuuuguuuug

SEQ ID NO: 70630 - RNA, 22 nt, Human
auggugucaggcaccuguaauc

SEQ ID NO: 70631 - RNA, 32 nt, Human
auggugucaggcugucacggacauaggauaaa

SEQ ID NO: 70632 - RNA, 32 nt, Human
augguguccaggcuggagugcaguggcgugau

SEQ ID NO: 70633 - RNA, 32 nt, Human
augguguccuccucugggcagcuguauaggau

SEQ ID NO: 70634 - RNA, 23 nt, Human
augguguccuggcugguuccuua

SEQ ID NO: 70635 - RNA, 32 nt, Human
auggugucugcagcagagugacagcaguggag

SEQ ID NO: 70636 - RNA, 32 nt, Human
auggugucuucauuuuuacuguauuuaacuga

SEQ ID NO: 70637 - RNA, 32 nt, Human
auggugugaacccaggaggcagagcuugcagu

SEQ ID NO: 70638 - RNA, 32 nt, Human
auggugugaacccaggaggcggugcuugcagg

SEQ ID NO: 70639 - RNA, 32 nt, Human
auggugugagugugugggugugugauaagcuu

SEQ ID NO: 70640 - RNA, 32 nt, Human
auggugugcucccagccugcagucuuuggagc

SEQ ID NO: 70641 - RNA, 18 nt, Human
auggugugcucuaaaaua

SEQ ID NO: 70642 - RNA, 32 nt, Human
augguguggaaaugcaaauaauaccaaguaaa

SEQ ID NO: 70643 - RNA, 32 nt, Human
augguguggcuggaaucauuccuguaccaaau

SEQ ID NO: 70644 - RNA, 32 nt, Human
auggugugguguuuguaggcuguggggucugg

SEQ ID NO: 70645 - RNA, 32 nt, Human
augguguguuccugucuucucuagucuugucc

SEQ ID NO: 70646 - RNA, 32 nt, Human
augguguucugacuucaagggcuggcagccag

SEQ ID NO: 70647 - RNA, 32 nt, Human
augguguugagccaucacagggcagaggucac

SEQ ID NO: 70648 - RNA, 22 nt, Human
augguguugcgugccuguaguc

SEQ ID NO: 70649 - RNA, 32 nt, Human
augguguuuagacuuaugguuguuaaaaaugu

SEQ ID NO: 70650 - RNA, 19 nt, Human
augguguuucaccauguug

SEQ ID NO: 70651 - RNA, 23 nt, Human
augguguuucaccauguuggcca

SEQ ID NO: 70652 - RNA, 32 nt, Human
augguguuucucaaacuaccaccaucuucaug

SEQ ID NO: 70653 - RNA, 32 nt, Human
augguguuucuuuuguuccuuuacagaaaugu

SEQ ID NO: 70654 - RNA, 26 nt, Human
augguuaaacugauuaguauuuccua

SEQ ID NO: 70655 - RNA, 20 nt, Human
augguuaaauacauuuccug

SEQ ID NO: 70656 - RNA, 32 nt, Human
augguuaagaguccaagaauccacauuucuaa

SEQ ID NO: 70657 - RNA, 20 nt, Human
augguuacauuacauccuua

SEQ ID NO: 70658 - RNA, 22 nt, Human
augguuacauuugaaucucuua

SEQ ID NO: 70659 - RNA, 32 nt, Human
augguuaccaugucuuucucucucacucccuc

SEQ ID NO: 70660 - RNA, 24 nt, Human
augguuacuauaugauauuuucug

SEQ ID NO: 70661 - RNA, 19 nt, Human
augguuacuccuucucuug

SEQ ID NO: 70662 - RNA, 32 nt, Human
augguuacugauggggaagugggaggcauaag

SEQ ID NO: 70663 - RNA, 32 nt, Human
augguuacuguucugucccuacaauagaaugu

SEQ ID NO: 70664 - RNA, 21 nt, Human
augguuacuuaauauuuucua

SEQ ID NO: 70665 - RNA, 19 nt, Human
augguuacuucuucucuua

SEQ ID NO: 70666 - RNA, 22 nt, Human
augguuauuccagucaucucuu

SEQ ID NO: 70667 - RNA, 32 nt, Human
augguucaaaaacagugguaggagcaaugcuu

SEQ ID NO: 70668 - RNA, 32 nt, Human
augguucaaaucuagaagaugcaguucaaaaa

SEQ ID NO: 70669 - RNA, 32 nt, Human
augguucaacacuaugaguguuugggaugugu

SEQ ID NO: 70670 - RNA, 32 nt, Human
augguucaagucacuaaagauucauuuuuguu

SEQ ID NO: 70671 - RNA, 32 nt, Human
augguucacagaggcagagugggcagggacaa

SEQ ID NO: 70672 - RNA, 32 nt, Human
augguucacagcaaugugcuacgauccaagau

SEQ ID NO: 70673 - RNA, 32 nt, Human
augguucacugcaaucucgacuuccaguuuca

SEQ ID NO: 70674 - RNA, 32 nt, Human
augguucacugcagacuccaccucuccaggcu

SEQ ID NO: 70675 - RNA, 25 nt, Human
augguucacugcagccucagccucc

SEQ ID NO: 70676 - RNA, 32 nt, Human
augguucacugcagccucgaccucccaggcuc

SEQ ID NO: 70677 - RNA, 32 nt, Human
augguucacugcagccuugaccuccagggcuc

SEQ ID NO: 70678 - RNA, 20 nt, Human
augguucacugcagcuccug

SEQ ID NO: 70679 - RNA, 32 nt, Human
augguucacugcagcuccugucacaagcuggg

SEQ ID NO: 70680 - RNA, 32 nt, Human
augguucacugcagucuugaccucccaggcuu

SEQ ID NO: 70681 - RNA, 32 nt, Human
augguucaucauugugaaagaaaugguuaucu

SEQ ID NO: 70682 - RNA, 32 nt, Human
augguucauguuacucuuucucucuccaucag

SEQ ID NO: 70683 - RNA, 32 nt, Human
augguucccacaugcauuuaugcacagaagaa

SEQ ID NO: 70684 - RNA, 32 nt, Human
augguucccacauucgcacuccauggccuccu

SEQ ID NO: 70685 - RNA, 32 nt, Human
augguuccguggaaggaacagaaacaagcacu

SEQ ID NO: 70686 - RNA, 32 nt, Human
augguuccuagagccugggggucaaguguucc

SEQ ID NO: 70687 - RNA, 32 nt, Human
augguuccucaaguuuccuuuuuaaacauuug

SEQ ID NO: 70688 - RNA, 32 nt, Human
augguuccugcccugcucacaggagcccgggc

SEQ ID NO: 70689 - RNA, 32 nt, Human
augguucuacccuuucugccuucuguuuggga

SEQ ID NO: 70690 - RNA, 32 nt, Human
augguucugaaggcucugccauccuggaaaag

SEQ ID NO: 70691 - RNA, 32 nt, Human
augguucugggggagacagaaaagaggugcgg

SEQ ID NO: 70692 - RNA, 32 nt, Human
augguucugggugagaggggagcaggcugagc

SEQ ID NO: 70693 - RNA, 32 nt, Human
augguucuuagaagccaccccuuccccaggca

SEQ ID NO: 70694 - RNA, 32 nt, Human
augguucuuaucuccccaccaucccacccugg

SEQ ID NO: 70695 - RNA, 32 nt, Human
augguucuuaucuccccaccaucccauccugg

SEQ ID NO: 70696 - RNA, 32 nt, Human
augguugaacucccaugucagcauuuuuguug

SEQ ID NO: 70697 - RNA, 32 nt, Human
augguugaaugcuguauuuucuaaagaauaaa

SEQ ID NO: 70698 - RNA, 32 nt, Human
augguugagaaaugaauaauuucccaauuagg

SEQ ID NO: 70699 - RNA, 21 nt, Human
augguugaucccucuaaaaua

SEQ ID NO: 70700 - RNA, 32 nt, Human
augguugcaaugagucaugaucacgccacugc

SEQ ID NO: 70701 - RNA, 32 nt, Human
augguugcaccacuacacuguagccuggguga

SEQ ID NO: 70702 - RNA, 32 nt, Human
augguugcaccacugcucuccaggcuugagug

SEQ ID NO: 70703 - RNA, 32 nt, Human
augguugcaccacuguacuccagccugggcga

SEQ ID NO: 70704 - RNA, 32 nt, Human
augguugcacugcagcgggaaguggcuucucu

SEQ ID NO: 70705 - RNA, 32 nt, Human
augguuggccgaugaacuuugaugacagcaau

SEQ ID NO: 70706 - RNA, 30 nt, Human
augguuggccucgcccagcuccuguacccu

SEQ ID NO: 70707 - RNA, 32 nt, Human
augguuguaauagagaaaacaaaugauugaaa

SEQ ID NO: 70708 - RNA, 22 nt, Human
augguuguacaaacaucucuug

SEQ ID NO: 70709 - RNA, 32 nt, Human
augguuguacagaggauagcaccccaccaugc

SEQ ID NO: 70710 - RNA, 32 nt, Human
augguugugaugcccaugagguguugggcugg

SEQ ID NO: 70711 - RNA, 32 nt, Human
augguugugccacugcacuccagccuggguaa

SEQ ID NO: 70712 - RNA, 32 nt, Human
augguuuaaaaaggaagaagaguggaagugaa

SEQ ID NO: 70713 - RNA, 21 nt, Human
augguuuaggccccuuaaaua

SEQ ID NO: 70714 - RNA, 32 nt, Human
augguuuaggcccuguuccagcaauaagaacc

SEQ ID NO: 70715 - RNA, 32 nt, Human
augguuuauggccugacauuacuugcaaccaa

SEQ ID NO: 70716 - RNA, 25 nt, Human
augguuuauugcugcagguuuuuug

SEQ ID NO: 70717 - RNA, 32 nt, Human
augguuucaaacacuucuccugccucagccuc

SEQ ID NO: 70718 - RNA, 32 nt, Human
augguuucagauugcuugccucuuuucucuuu

SEQ ID NO: 70719 - RNA, 32 nt, Human
augguuucagguuuuccuucccuuccuuuuuc

SEQ ID NO: 70720 - RNA, 32 nt, Human
augguuucaguuacucauagccaacugcagac

SEQ ID NO: 70721 - RNA, 32 nt, Human
augguuucauucuuaucaguccaacccuuugc

SEQ ID NO: 70722 - RNA, 32 nt, Human
augguuuccaggcagugaaagagggugauuca

SEQ ID NO: 70723 - RNA, 24 nt, Human
augguuucucaaggagauugggga

SEQ ID NO: 70724 - RNA, 32 nt, Human
augguuugaacccggcaggcggagguugcagu

SEQ ID NO: 70725 - RNA, 32 nt, Human
augguuugaagguguccccaaauguuuaugua

SEQ ID NO: 70726 - RNA, 32 nt, Human
augguuugggauaggcugggugccguggguca

SEQ ID NO: 70727 - RNA, 31 nt, Human
augguuugucacucugcaccugugucuccac

SEQ ID NO: 70728 - RNA, 22 nt, Human
augguuuucaguacauuuccua

SEQ ID NO: 70729 - RNA, 32 nt, Human
augguuuucuuaagccucuuaugaaaccauga

SEQ ID NO: 70730 - RNA, 32 nt, Human
augguuuuuaaacuugggcuucauuuuaaacu

SEQ ID NO: 70731 - RNA, 32 nt, Human
auguaaaagcuuccuccaccccucucuuuaua

SEQ ID NO: 70732 - RNA, 32 nt, Human
auguaaaauguucucagccgggcacgguggcu

SEQ ID NO: 70733 - RNA, 32 nt, Human
auguaaacagaacuggcacacacacauuaaga

SEQ ID NO: 70734 - RNA, 25 nt, Human
auguaaacagcuuuuuaaaaaauug

SEQ ID NO: 70735 - RNA, 24 nt, Human
auguaaaccauucgaagucagcua

SEQ ID NO: 70736 - RNA, 32 nt, Human
auguaaacuaaauccgcgucugugaauacguu

SEQ ID NO: 70737 - RNA, 32 nt, Human
auguaaagaacaaggaauaacaguuguaggaa

SEQ ID NO: 70738 - RNA, 32 nt, Human
auguaaagaacgcgacuuccacaaaccuggau

SEQ ID NO: 70739 - RNA, 32 nt, Human
auguaaagcacuuagcccagagccuagcacau

SEQ ID NO: 70740 - RNA, 32 nt, Human
auguaaagcgccuugcacacugccuggcacac

SEQ ID NO: 70741 - RNA, 32 nt, Human
auguaaagcuaaauacuuuccucuccaaagau

SEQ ID NO: 70742 - RNA, 32 nt, Human
auguaaaggaaaugcagguucuucaagaaggu

SEQ ID NO: 70743 - RNA, 32 nt, Human
auguaaaggccuuguuuugcuguagcaauaaa

SEQ ID NO: 70744 - RNA, 32 nt, Human
auguaaagggccuuuuaaaaaugcgggaucuu

SEQ ID NO: 70745 - RNA, 32 nt, Human
auguaaaggguccauucaugaggaauaacauc

SEQ ID NO: 70746 - RNA, 32 nt, Human
auguaaagguguacuuucuaugugccaccaag

SEQ ID NO: 70747 - RNA, 32 nt, Human
auguaaagugcugggaagagggguggggaguc

SEQ ID NO: 70748 - RNA, 32 nt, Human
auguaaauacaucaaaaauggguaauuuucuu

SEQ ID NO: 70749 - RNA, 32 nt, Human
auguaaauagggacugugcaguauuucugaca

SEQ ID NO: 70750 - RNA, 32 nt, Human
auguaaauaugcugggacaaugugugccuucu

SEQ ID NO: 70751 - RNA, 32 nt, Human
auguaaaugauggaucugauucugcuauuggu

SEQ ID NO: 70752 - RNA, 32 nt, Human
auguaaaugauuacuuucauccauccauuaua

SEQ ID NO: 70753 - RNA, 32 nt, Human
auguaaauggugccucuaggcaaaggaggcuu

SEQ ID NO: 70754 - RNA, 32 nt, Human
auguaaauucuuuauaugaaacuaucuaguuc

SEQ ID NO: 70755 - RNA, 32 nt, Human
auguaacaaaccuaguaguuuauguucaucaa

SEQ ID NO: 70756 - RNA, 32 nt, Human
auguaacaaaccugcacauccugcacauguac

SEQ ID NO: 70757 - RNA, 32 nt, Human
auguaacaaaccugcacauccugcacauguau

SEQ ID NO: 70758 - RNA, 32 nt, Human
auguaacaaaccugcacaugugggcugggcgc

SEQ ID NO: 70759 - RNA, 32 nt, Human
auguaacaaaccugcacauucugcacauauau

SEQ ID NO: 70760 - RNA, 32 nt, Human
auguaacaaaccugcacauugugcacauguac

SEQ ID NO: 70761 - RNA, 32 nt, Human
auguaacaaaccugcacguucagcacauguau

SEQ ID NO: 70762 - RNA, 32 nt, Human
auguaacaaaccugcacguucugcacauguau

SEQ ID NO: 70763 - RNA, 32 nt, Human
auguaacaaaccugcacguugugcacacguac

SEQ ID NO: 70764 - RNA, 32 nt, Human
auguaacaaaccugcacguugugcacauggua

SEQ ID NO: 70765 - RNA, 32 nt, Human
auguaacaaaccugcacguugugcacauguac

SEQ ID NO: 70766 - RNA, 32 nt, Human
auguaacaaaccugcauauccugcacauguau

SEQ ID NO: 70767 - RNA, 32 nt, Human
auguaacaaaccugcauguugugcacauguac

SEQ ID NO: 70768 - RNA, 32 nt, Human
auguaacaaaucugcacguugugcacauguac

SEQ ID NO: 70769 - RNA, 32 nt, Human
auguaacaaauuugcaaauugugcacauguac

SEQ ID NO: 70770 - RNA, 32 nt, Human
auguaacaccugcgaugagacaucggacucuc

SEQ ID NO: 70771 - RNA, 32 nt, Human
auguaacccacuggauacaguccccuuaaugu

SEQ ID NO: 70772 - RNA, 32 nt, Human
auguaacccugacugagcaaugcucagcagag

SEQ ID NO: 70773 - RNA, 32 nt, Human
auguaaccuggucagauuacuucaccucucug

SEQ ID NO: 70774 - RNA, 32 nt, Human
auguaacguucauccacucugccugcuuacac

SEQ ID NO: 70775 - RNA, 32 nt, Human
auguaacuaaccugcacaaugcgcacauguac

SEQ ID NO: 70776 - RNA, 32 nt, Human
auguaacuaaccugcacaaugugcacauguac

SEQ ID NO: 70777 - RNA, 32 nt, Human
auguaacuaaccugcacauugugcacacguac

SEQ ID NO: 70778 - RNA, 32 nt, Human
auguaacuaaccugcacauugugcacauguac

SEQ ID NO: 70779 - RNA, 32 nt, Human
auguaacucaggaccccuuuucccucuugcgu

SEQ ID NO: 70780 - RNA, 32 nt, Human
auguaacuccacucuccucucuuccaaaccuc

SEQ ID NO: 70781 - RNA, 32 nt, Human
auguaacucugccuuuuaaaguuuugcugaag

SEQ ID NO: 70782 - RNA, 32 nt, Human
auguaacugccuuuuaaaauuucauuacaaua

SEQ ID NO: 70783 - RNA, 32 nt, Human
auguaacuguauacugaauucugacaaaauaa

SEQ ID NO: 70784 - RNA, 32 nt, Human
auguaacuguuucccuuugauucuccaguauu

SEQ ID NO: 70785 - RNA, 32 nt, Human
auguaacuuccucuuaggauguuucaccaagg

SEQ ID NO: 70786 - RNA, 21 nt, Human
auguaagaggcuuaaaaugau

SEQ ID NO: 70787 - RNA, 32 nt, Human
auguaagcaauauuuccuaccauacuucacuc

SEQ ID NO: 70788 - RNA, 32 nt, Human
auguaagcacacaugcgcacacacacuugcau

SEQ ID NO: 70789 - RNA, 32 nt, Human
auguaagcagccauuaauaaacuguugcacau

SEQ ID NO: 70790 - RNA, 32 nt, Human
auguaagcuaaguuggugcagggguuuuuguc

SEQ ID NO: 70791 - RNA, 32 nt, Human
auguaagcuucaaaguagcacauuuguacugu

SEQ ID NO: 70792 - RNA, 32 nt, Human
auguaaggacucaggcuuggucaaggugguaa

SEQ ID NO: 70793 - RNA, 32 nt, Human
auguaaggcaacauucacagauccugggaaug

SEQ ID NO: 70794 - RNA, 32 nt, Human
auguaagggugcugguaugccugcugucuccc

SEQ ID NO: 70795 - RNA, 32 nt, Human
auguaaggguggaggaguuccuggagaaggac

SEQ ID NO: 70796 - RNA, 32 nt, Human
auguaagguuugugacaaagcuuuugggcgug

SEQ ID NO: 70797 - RNA, 32 nt, Human
auguaaguauuuauauucacagccucuuaugu

SEQ ID NO: 70798 - RNA, 32 nt, Human
auguaagugaccccaggcuuugcucagggccu

SEQ ID NO: 70799 - RNA, 32 nt, Human
auguaaguuccaagagaacagggacuuugucu

SEQ ID NO: 70800 - RNA, 32 nt, Human
auguaaguucugaauguucacauugcuuuacc

SEQ ID NO: 70801 - RNA, 32 nt, Human
auguaaguuuuauuuuuccuugccagggucag

SEQ ID NO: 70802 - RNA, 21 nt, Human
auguaauaaauacacuugugu

SEQ ID NO: 70803 - RNA, 32 nt, Human
auguaauaugcuguaaggcuagugcagauggg

SEQ ID NO: 70804 - RNA, 32 nt, Human
auguaaucacugggcugggugcaguggcucac

SEQ ID NO: 70805 - RNA, 32 nt, Human
auguaaucaguuaugccuauguaaugaagcuu

SEQ ID NO: 70806 - RNA, 32 nt, Human
auguaauccagaccaggcacaguggcucaugc

SEQ ID NO: 70807 - RNA, 32 nt, Human
auguaauccaggcuggggaagauggcgguggc

SEQ ID NO: 70808 - RNA, 32 nt, Human
auguaaugaaccuaauuugauuuccauuuuaa

SEQ ID NO: 70809 - RNA, 32 nt, Human
auguaaugcaaccaaguuccucccagauuaaa

SEQ ID NO: 70810 - RNA, 32 nt, Human
auguaaugcaagaaugaacagaacaagcaaaa

SEQ ID NO: 70811 - RNA, 32 nt, Human
auguaauggggagaggguggggcagaugagua

SEQ ID NO: 70812 - RNA, 32 nt, Human
auguaaugugggaggcagggcuaugcgauagu

SEQ ID NO: 70813 - RNA, 32 nt, Human
auguaauugucaucuucauuugucuucacaac

SEQ ID NO: 70814 - RNA, 32 nt, Human
auguacaaaauggucagagcuaguuggagaau

SEQ ID NO: 70815 - RNA, 32 nt, Human
auguacaaagaaugucuucagaucaaagaaaa

SEQ ID NO: 70816 - RNA, 32 nt, Human
auguacaagaaccugggcucuucacucaggaa

SEQ ID NO: 70817 - RNA, 32 nt, Human
auguacaaguuagagucagaagacguuuuaga

SEQ ID NO: 70818 - RNA, 32 nt, Human
auguacacacagauuccugucccuuugccaac

SEQ ID NO: 70819 - RNA, 28 nt, Human
auguacacaggugcugccucucccugau

SEQ ID NO: 70820 - RNA, 32 nt, Human
auguacaccaggcugggugcgguggcucacgc

SEQ ID NO: 70821 - RNA, 32 nt, Human
auguacacucugaaguacagccuggguuaguc

SEQ ID NO: 70822 - RNA, 32 nt, Human
auguacacugacugcuuuagagcccuugauaa

SEQ ID NO: 70823 - RNA, 32 nt, Human
auguacagaacacauuucucugaucuccauaa

SEQ ID NO: 70824 - RNA, 32 nt, Human
auguacagacugaggcucuggggugagguccc

SEQ ID NO: 70825 - RNA, 32 nt, Human
auguacagagccagacaaagcugugaauggcc

SEQ ID NO: 70826 - RNA, 32 nt, Human
auguacagagguuuuucugugguuguaaaugg

SEQ ID NO: 70827 - RNA, 32 nt, Human
auguacagccaagagccuagaaugacauggcc

SEQ ID NO: 70828 - RNA, 32 nt, Human
auguacagcuguaaacauuccuuaaaucuucu

SEQ ID NO: 70829 - RNA, 30 nt, Human
auguacagcuugcaaguagaagucucaggc

SEQ ID NO: 70830 - RNA, 32 nt, Human
auguacaggaagcauagugccagcaucugcuu

SEQ ID NO: 70831 - RNA, 32 nt, Human
auguacaguaguuuuauuuccacagccacauu

SEQ ID NO: 70832 - RNA, 32 nt, Human
auguacaguccccaucaguagcguauagaaca

SEQ ID NO: 70833 - RNA, 32 nt, Human
auguacauagccagagagucaugccacguggu

SEQ ID NO: 70834 - RNA, 32 nt, Human
auguacauauuuauacauacacacaccuuccu

SEQ ID NO: 70835 - RNA, 32 nt, Human
auguacaucacugaggccacugcacccuuucu

SEQ ID NO: 70836 - RNA, 32 nt, Human
auguacauggaaaauucuagggacaggagcau

SEQ ID NO: 70837 - RNA, 32 nt, Human
auguacauugauacaaccuuuaugauggcaau

SEQ ID NO: 70838 - RNA, 32 nt, Human
auguacauuuauuucagauaaaggacaauaag

SEQ ID NO: 70839 - RNA, 32 nt, Human
auguaccaacagcacaacuuugaaaacuguua

SEQ ID NO: 70840 - RNA, 31 nt, Human
auguaccaccgcgccuggccugugucuauuu

SEQ ID NO: 70841 - RNA, 32 nt, Human
auguaccaggagcugaaggugccugcagagga

SEQ ID NO: 70842 - RNA, 32 nt, Human
auguaccaucaucaugcaucauugugcaucau

SEQ ID NO: 70843 - RNA, 32 nt, Human
auguaccaucccaacccacccaccucaauccc

SEQ ID NO: 70844 - RNA, 32 nt, Human
auguacccacaccauacauacauacauauaua

SEQ ID NO: 70845 - RNA, 32 nt, Human
auguacccaggugccuuuuugcuaauuugaua

SEQ ID NO: 70846 - RNA, 32 nt, Human
auguacccuccacccuuuuccuggcccccuaa

SEQ ID NO: 70847 - RNA, 32 nt, Human
auguacccuccccuuuuaugcacuucaaauaa

SEQ ID NO: 70848 - RNA, 32 nt, Human
auguacccuuaaauugaagaaauuuaagcugc

SEQ ID NO: 70849 - RNA, 32 nt, Human
auguaccgcauccuucuuuuccucagccaccc

SEQ ID NO: 70850 - RNA, 32 nt, Human
auguaccguaggagccaagaccaccuauacua

SEQ ID NO: 70851 - RNA, 32 nt, Human
auguaccucuggcaaaugccccaccuugguga

SEQ ID NO: 70852 - RNA, 32 nt, Human
auguaccucuggcaaaugcccugguauguacc

SEQ ID NO: 70853 - RNA, 32 nt, Human
auguaccucuguuacucucagccuggaauccc

SEQ ID NO: 70854 - RNA, 32 nt, Human
auguaccugaggaaaucagagagaugguggcu

SEQ ID NO: 70855 - RNA, 32 nt, Human
auguaccugcauucccagcuacuugggaggcu

SEQ ID NO: 70856 - RNA, 32 nt, Human
auguaccugcugcaacugaaccagacuggguu

SEQ ID NO: 70857 - RNA, 32 nt, Human
auguaccuguaguuccagcuacauaggaggcu

SEQ ID NO: 70858 - RNA, 32 nt, Human
auguaccuuaaacuuccacaucacugcacccu

SEQ ID NO: 70859 - RNA, 32 nt, Human
auguacggucuggccaaaccaccuucccagcc

SEQ ID NO: 70860 - RNA, 32 nt, Human
auguacuaaaauauguaucucucuccauauau

SEQ ID NO: 70861 - RNA, 32 nt, Human
auguacuacugcacuugagcaugaauggguag

SEQ ID NO: 70862 - RNA, 32 nt, Human
auguacucaagaaaauugaacaaauguaaugg

SEQ ID NO: 70863 - RNA, 28 nt, Human
auguacucaauaaauauuuguuggcuuu

SEQ ID NO: 70864 - RNA, 32 nt, Human
auguacucagccucaggagagcuugcugcacc

SEQ ID NO: 70865 - RNA, 32 nt, Human
auguacucucacacacacaggcaccagcauac

SEQ ID NO: 70866 - RNA, 32 nt, Human
auguacugaagcugcaaaaacgagcucuucau

SEQ ID NO: 70867 - RNA, 29 nt, Human
auguacugaguguucgcaucccccuucag

SEQ ID NO: 70868 - RNA, 32 nt, Human
auguacugccuuagugcugaugccuguguacu

SEQ ID NO: 70869 - RNA, 32 nt, Human
auguacuggguaguaggagggagccuagacuu

SEQ ID NO: 70870 - RNA, 32 nt, Human
auguacuguauguagucaugcacuuuguauua

SEQ ID NO: 70871 - RNA, 32 nt, Human
auguacuuugaauuugagaagugggugauccc

SEQ ID NO: 70872 - RNA, 32 nt, Human
auguacuuuucugcauaauuucugccuucugu

SEQ ID NO: 70873 - RNA, 32 nt, Human
auguagaaaggaaacucucuucaaugaauggu

SEQ ID NO: 70874 - RNA, 19 nt, Human
auguagaacaaagcccaca

SEQ ID NO: 70875 - RNA, 32 nt, Human
auguagaagagggagaaggagaggcucugaaa

SEQ ID NO: 70876 - RNA, 20 nt, Human
auguagaagcuaagggucag

SEQ ID NO: 70877 - RNA, 25 nt, Human
auguagaagcugacugagaccugcu

SEQ ID NO: 70878 - RNA, 26 nt, Human
auguagaagcugacugagaccugcug

SEQ ID NO: 70879 - RNA, 22 nt, Human
auguagaagcugacuugaaagg

SEQ ID NO: 70880 - RNA, 32 nt, Human
auguagaaugauuuuugcuauuucuaguagaa

SEQ ID NO: 70881 - RNA, 32 nt, Human
auguagaauggcugaagagaucaagaauuuaa

SEQ ID NO: 70882 - RNA, 32 nt, Human
auguagaaugggauguauucuucugcugcugc

SEQ ID NO: 70883 - RNA, 32 nt, Human
auguagacacaaaacagcaacacuuguaugaa

SEQ ID NO: 70884 - RNA, 32 nt, Human
auguagacuauuuuugguggccaaugcuacua

SEQ ID NO: 70885 - RNA, 32 nt, Human
auguagacuguccuuagacuccugagguuuuu

SEQ ID NO: 70886 - RNA, 32 nt, Human
auguagagaaaaggugacaguuuaaggaaaaa

SEQ ID NO: 70887 - RNA, 32 nt, Human
auguagagaacagcaaaugauugaugcaguua

SEQ ID NO: 70888 - RNA, 32 nt, Human
auguagagaacaggaguccgcagcugcuggca

SEQ ID NO: 70889 - RNA, 32 nt, Human
auguagagaugaaaaauacagaauguaauggc

SEQ ID NO: 70890 - RNA, 32 nt, Human
auguagagauuugagugcaguugguacaguac

SEQ ID NO: 70891 - RNA, 32 nt, Human
auguagagugggaggacugggaguggggagcc

SEQ ID NO: 70892 - RNA, 32 nt, Human
auguagaguuaagaaccaggaggcaggaacau

SEQ ID NO: 70893 - RNA, 32 nt, Human
auguagauauuucucuuauuguuuucauguaa

SEQ ID NO: 70894 - RNA, 23 nt, Human
auguagauguacauauacaugua

SEQ ID NO: 70895 - RNA, 32 nt, Human
auguagauuuuuauuuucuacuuuugauuauu

SEQ ID NO: 70896 - RNA, 32 nt, Human
auguagcaaagcuuuuuaggauuuucagaacu

SEQ ID NO: 70897 - RNA, 32 nt, Human
auguagcaaccagaaacaacacaugcuuauua

SEQ ID NO: 70898 - RNA, 32 nt, Human
auguagcacugaguggugauacccagaccagc

SEQ ID NO: 70899 - RNA, 21 nt, Human
auguagcagaauaccaggcag

SEQ ID NO: 70900 - RNA, 32 nt, Human
auguagcagaauugcacuugugccucacgaac

SEQ ID NO: 70901 - RNA, 32 nt, Human
auguagcagugacccaggcuugggagccagaa

SEQ ID NO: 70902 - RNA, 32 nt, Human
auguagcauauguaauugcaaaaugauuuaga

SEQ ID NO: 70903 - RNA, 32 nt, Human
auguagccagcagaacugaagugugcugugac

SEQ ID NO: 70904 - RNA, 32 nt, Human
auguagccaucccggccagccccugacaucug

SEQ ID NO: 70905 - RNA, 32 nt, Human
auguagccauuuuagaggugucaaaauaaauc

SEQ ID NO: 70906 - RNA, 32 nt, Human
auguagcccaggaaaugaccgaccugaugugu

SEQ ID NO: 70907 - RNA, 32 nt, Human
auguagccccagucauccugcccagcccugcc

SEQ ID NO: 70908 - RNA, 32 nt, Human
auguagcccugagguucccuucccaggacagc

SEQ ID NO: 70909 - RNA, 32 nt, Human
auguagccuccaggcacuucugcucucuggca

SEQ ID NO: 70910 - RNA, 32 nt, Human
auguagcuaagguaaugguucauaucauacaa

SEQ ID NO: 70911 - RNA, 32 nt, Human
auguagcugaugucacucaggagcacgagcga

SEQ ID NO: 70912 - RNA, 32 nt, Human
auguagcuguguagccaugugugugcauaugg

SEQ ID NO: 70913 - RNA, 32 nt, Human
auguaggaaaaugccuugccauucuaguugaa

SEQ ID NO: 70914 - RNA, 32 nt, Human
auguaggaaggccucaaggauguaauucuagc

SEQ ID NO: 70915 - RNA, 32 nt, Human
auguaggagaaugaaacuggauccucaucucu

SEQ ID NO: 70916 - RNA, 32 nt, Human
auguaggcaaaaugucaagggaaauguaauca

SEQ ID NO: 70917 - RNA, 19 nt, Human
auguaggcacaauaagcac

SEQ ID NO: 70918 - RNA, 32 nt, Human
auguaggccgggugccccuguucuccggguuu

SEQ ID NO: 70919 - RNA, 32 nt, Human
auguaggcucucugcaaccugggccucccggg

SEQ ID NO: 70920 - RNA, 18 nt, Human
auguagggaagccuucag

SEQ ID NO: 70921 - RNA, 23 nt, Human
auguagggcaccuuggaccucuc

SEQ ID NO: 70922 - RNA, 32 nt, Human
auguaggggagggaggaaggagggccagggua

SEQ ID NO: 70923 - RNA, 21 nt, Human
auguaggggccagcccaucuc

SEQ ID NO: 70924 - RNA, 32 nt, Human
auguagggggcugucagccuuggagacucuag

SEQ ID NO: 70925 - RNA, 32 nt, Human
auguagguacuacugggucuccaggcucaucu

SEQ ID NO: 70926 - RNA, 32 nt, Human
auguaggucagagcugccuccaggcaacuugu

SEQ ID NO: 70927 - RNA, 32 nt, Human
auguagguccaaccauauuauuucucagguga

SEQ ID NO: 70928 - RNA, 32 nt, Human
auguagguuuguaacaaggcuuuugggaguga

SEQ ID NO: 70929 - RNA, 32 nt, Human
auguaguacuuguuuguaaagcacuuugagau

SEQ ID NO: 70930 - RNA, 32 nt, Human
auguaguaggacaccaguauccuaggacagag

SEQ ID NO: 70931 - RNA, 32 nt, Human
auguaguauauagcaggcugccagcgacuccu

SEQ ID NO: 70932 - RNA, 31 nt, Human
auguaguauauuuucugacuacaggagauaa

SEQ ID NO: 70933 - RNA, 32 nt, Human
auguaguccccaaauaccugaaagcugucuuu

SEQ ID NO: 70934 - RNA, 32 nt, Human
auguaguggcucaugccuuaaucccagcacuu

SEQ ID NO: 70935 - RNA, 32 nt, Human
auguaguuuuuguccaggcuugagucaccaug

SEQ ID NO: 70936 - RNA, 32 nt, Human
auguauaaagcagaaugccugccuuuccuggu

SEQ ID NO: 70937 - RNA, 32 nt, Human
auguauaacaauuuucuucagaagaauucuau

SEQ ID NO: 70938 - RNA, 32 nt, Human
auguauaaccuguuuccagccuggccugaggu

SEQ ID NO: 70939 - RNA, 32 nt, Human
auguauaccuuuuccauauuacugugaacuuu

SEQ ID NO: 70940 - RNA, 32 nt, Human
auguauacucuaguauucugguguuuuuauau

SEQ ID NO: 70941 - RNA, 32 nt, Human
auguauacuuuacauaguaaacuuuccccuuu

SEQ ID NO: 70942 - RNA, 32 nt, Human
auguauagacacaccucuaccaauccaucuuc

SEQ ID NO: 70943 - RNA, 32 nt, Human
auguauagaucuguccuuaugcccauaccaca

SEQ ID NO: 70944 - RNA, 32 nt, Human
auguauagccauugcccucuagcaggccaggc

SEQ ID NO: 70945 - RNA, 32 nt, Human
auguauaggcuccacuugacaagaccacaccu

SEQ ID NO: 70946 - RNA, 32 nt, Human
auguauauaaagcauaugagcacacaaaugga

SEQ ID NO: 70947 - RNA, 32 nt, Human
auguauauccaagucacucaggaacuuuuaug

SEQ ID NO: 70948 - RNA, 32 nt, Human
auguauaucugugaguguauauacaugcaugc

SEQ ID NO: 70949 - RNA, 19 nt, Human
auguauaugugcacacaca

SEQ ID NO: 70950 - RNA, 32 nt, Human
auguauauguguuugcuuugggaggagguggc

SEQ ID NO: 70951 - RNA, 32 nt, Human
auguauauuugaacuccucucagcugaacacc

SEQ ID NO: 70952 - RNA, 32 nt, Human
auguaucaaacaguaaagugcuucauauuugg

SEQ ID NO: 70953 - RNA, 32 nt, Human
auguaucaaaggacacaguccagggggagggu

SEQ ID NO: 70954 - RNA, 32 nt, Human
auguaucaagcaucuccaggugaccuacuguc

SEQ ID NO: 70955 - RNA, 32 nt, Human
auguaucaauaaucccagcccagucaaagcac

SEQ ID NO: 70956 - RNA, 32 nt, Human
auguaucauaugcagauacuuauugcauuucu

SEQ ID NO: 70957 - RNA, 32 nt, Human
auguauccacacacauccuugugcacacauag

SEQ ID NO: 70958 - RNA, 32 nt, Human
auguaucuacuguaugugcagaccaugucgag

SEQ ID NO: 70959 - RNA, 32 nt, Human
auguaucuauaguuggccugcaagacacuuuu

SEQ ID NO: 70960 - RNA, 32 nt, Human
auguaucuccauccuccccugcuccagccagg

SEQ ID NO: 70961 - RNA, 32 nt, Human
auguaucugaagaagaggcucagggaguaaau

SEQ ID NO: 70962 - RNA, 32 nt, Human
auguaucugagcugcucggauccagaggucau

SEQ ID NO: 70963 - RNA, 32 nt, Human
auguaucuuccagagaagauuuuauuuguggu

SEQ ID NO: 70964 - RNA, 32 nt, Human
auguaucuuucaucuuccaguuaccucuaggc

SEQ ID NO: 70965 - RNA, 32 nt, Human
auguaucuuugucuuuuccucuagaaccugcc

SEQ ID NO: 70966 - RNA, 32 nt, Human
auguaugacucuguaugggaauugccuguuug

SEQ ID NO: 70967 - RNA, 32 nt, Human
auguaugcaaggacacauauguacguaauuuc

SEQ ID NO: 70968 - RNA, 32 nt, Human
auguaugcacacacacaugcaccgcacacaua

SEQ ID NO: 70969 - RNA, 32 nt, Human
auguaugcacacacaugcgcgcacacgugcuc

SEQ ID NO: 70970 - RNA, 32 nt, Human
auguaugcacacauacccauacauguauauga

SEQ ID NO: 70971 - RNA, 32 nt, Human
auguaugcaguacuauucagaaugauauacac

SEQ ID NO: 70972 - RNA, 32 nt, Human
auguaugccauuuucucccugcaaagcagcuc

SEQ ID NO: 70973 - RNA, 32 nt, Human
auguaugcccucagugcagugggguuugcugc

SEQ ID NO: 70974 - RNA, 32 nt, Human
auguaugcucuccccucucagaugcgauuugg

SEQ ID NO: 70975 - RNA, 32 nt, Human
auguaugcugaagaauuuggagaagaaaaugc

SEQ ID NO: 70976 - RNA, 32 nt, Human
auguaugcuuccagggacaagcuuaggucaug

SEQ ID NO: 70977 - RNA, 32 nt, Human
auguauggaaauucagcuaauuuuuggugcug

SEQ ID NO: 70978 - RNA, 32 nt, Human
auguaugggacagggucucacucugucaccca

SEQ ID NO: 70979 - RNA, 32 nt, Human
auguauggggaucaccuuugccagagcugcau

SEQ ID NO: 70980 - RNA, 32 nt, Human
auguaugggugagaggaaggaggaucuccuuc

SEQ ID NO: 70981 - RNA, 32 nt, Human
auguaugguaacacuggggaaugcuugggugu

SEQ ID NO: 70982 - RNA, 32 nt, Human
auguauggugauuuuuauuuucucugucugaa

SEQ ID NO: 70983 - RNA, 32 nt, Human
auguauguaauguaaugagagcacuuuucauu

SEQ ID NO: 70984 - RNA, 32 nt, Human
auguauguacauauuccacauauguauuuagu

SEQ ID NO: 70985 - RNA, 32 nt, Human
auguauguauauuucaaaguaccacacugaaa

SEQ ID NO: 70986 - RNA, 32 nt, Human
auguaugucuaaauuccuggagaagaugauau

SEQ ID NO: 70987 - RNA, 32 nt, Human
auguaugucuucagaugccuuucugccucugu

SEQ ID NO: 70988 - RNA, 32 nt, Human
auguauguuccuuacaccuugauuccauacac

SEQ ID NO: 70989 - RNA, 32 nt, Human
auguauuacuuuucccagcaggccagugcuag

SEQ ID NO: 70990 - RNA, 32 nt, Human
auguauuagagccacaguggggccuggaacac

SEQ ID NO: 70991 - RNA, 32 nt, Human
auguauucaccuuucuuuuguaaagagaccau

SEQ ID NO: 70992 - RNA, 32 nt, Human
auguauucccuucagggauucccuguccccaa

SEQ ID NO: 70993 - RNA, 32 nt, Human
auguauucgggaggacaagggcuuccaguuuu

SEQ ID NO: 70994 - RNA, 32 nt, Human
auguauucuuuucagucuuuuguguuugauuu

SEQ ID NO: 70995 - RNA, 32 nt, Human
auguauugagugucuguuaggugcaaaguaug

SEQ ID NO: 70996 - RNA, 31 nt, Human
auguauugggucaagaagugaucuuuagcua

SEQ ID NO: 70997 - RNA, 32 nt, Human
auguauugguucuuuauuaaauaauuuuugaa

SEQ ID NO: 70998 - RNA, 32 nt, Human
auguauuuaugcugguguucuuucauguuauu

SEQ ID NO: 70999 - RNA, 32 nt, Human
auguauuuccacuugcccugaguaaaucugug

SEQ ID NO: 71000 - RNA, 32 nt, Human
auguauuuccucauaucuuucuuuuucauuac

SEQ ID NO: 71001 - RNA, 32 nt, Human
auguauuuggcuauuuuaauuguauuugacaa

SEQ ID NO: 71002 - RNA, 32 nt, Human
auguauuugggucuuauuuacauccuucuuua

SEQ ID NO: 71003 - RNA, 32 nt, Human
auguauuugugacacccuaucuugucaauaaa

SEQ ID NO: 71004 - RNA, 32 nt, Human
auguauuuguuugcauaggugaucucauuuaa

SEQ ID NO: 71005 - RNA, 32 nt, Human
auguauuuuaauuuagauucuguguuuuuaag

SEQ ID NO: 71006 - RNA, 32 nt, Human
augucaaagcucaugugaaagaggguagguug

SEQ ID NO: 71007 - RNA, 32 nt, Human
augucaacaggcaggggcagcacugcagagau

SEQ ID NO: 71008 - RNA, 32 nt, Human
augucaacaguuaugaaggccaggcgcggcgg

SEQ ID NO: 71009 - RNA, 32 nt, Human
augucaacccccaguaagggaaaggaggaugg

SEQ ID NO: 71010 - RNA, 19 nt, Human
augucaaccuugugugagu

SEQ ID NO: 71011 - RNA, 32 nt, Human
augucaacuacaaaucaaaagugcugaguuaa

SEQ ID NO: 71012 - RNA, 32 nt, Human
augucaacuugaauaggccacagggugccaaa

SEQ ID NO: 71013 - RNA, 32 nt, Human
augucaaggaagaaaggaaggaaggaaggcga

SEQ ID NO: 71014 - RNA, 31 nt, Human
augucaaguggcagcucagccaccacucagu

SEQ ID NO: 71015 - RNA, 32 nt, Human
augucaaguucaagugauaugugccuaauauc

SEQ ID NO: 71016 - RNA, 23 nt, Human
augucaaucaucacucccagcca

SEQ ID NO: 71017 - RNA, 32 nt, Human
augucaauuauaggaaaacauaguuggaaaug

SEQ ID NO: 71018 - RNA, 32 nt, Human
augucaauucacccagcucucuugccugcagg

SEQ ID NO: 71019 - RNA, 22 nt, Human
augucaauuuuuaucucuuaaa

SEQ ID NO: 71020 - RNA, 32 nt, Human
augucacaaagcuucucucaagagcucucgua

SEQ ID NO: 71021 - RNA, 32 nt, Human
augucacaacuuugcaagcucugccuuggguu

SEQ ID NO: 71022 - RNA, 32 nt, Human
augucacagaacuuuucacuuguauacuacuc

SEQ ID NO: 71023 - RNA, 32 nt, Human
augucacaggcaggucccaggguuugaguuca

SEQ ID NO: 71024 - RNA, 32 nt, Human
augucacaggcgggacuuucuucagagagugg

SEQ ID NO: 71025 - RNA, 32 nt, Human
augucacauccgcccagacagcucuuugauga

SEQ ID NO: 71026 - RNA, 32 nt, Human
augucaccacugcccuccagccugggugacag

SEQ ID NO: 71027 - RNA, 32 nt, Human
augucaccaggauaagaccacagggaagcaaa

SEQ ID NO: 71028 - RNA, 32 nt, Human
augucaccagugucuuuucuccuuccugucuu

SEQ ID NO: 71029 - RNA, 21 nt, Human
augucacccacucacucacca

SEQ ID NO: 71030 - RNA, 25 nt, Human
augucacccagacuggagugcagug

SEQ ID NO: 71031 - RNA, 25 nt, Human
augucacccaggcuggagugcaaug

SEQ ID NO: 71032 - RNA, 24 nt, Human
augucacccaggcuggagugcagu

SEQ ID NO: 71033 - RNA, 25 nt, Human
augucacccaggcuggagugcagug

SEQ ID NO: 71034 - RNA, 32 nt, Human
augucacccaggcuguggugcaguaagccaag

SEQ ID NO: 71035 - RNA, 25 nt, Human
augucacccaggguggaauacagug

SEQ ID NO: 71036 - RNA, 32 nt, Human
augucacccaugucagcugacuuuaaguaaac

SEQ ID NO: 71037 - RNA, 32 nt, Human
augucacccugccuccagcuagcuaugggccc

SEQ ID NO: 71038 - RNA, 32 nt, Human
augucacccuggcuggagugcaguagugcgau

SEQ ID NO: 71039 - RNA, 32 nt, Human
augucacccuuucagggaaauucaggcaauua

SEQ ID NO: 71040 - RNA, 18 nt, Human
augucaccuggagcgagu

SEQ ID NO: 71041 - RNA, 32 nt, Human
augucaccuuguauuacagcauguuauauaag

SEQ ID NO: 71042 - RNA, 32 nt, Human
augucacggcaaccuccgccucccagguucaa

SEQ ID NO: 71043 - RNA, 21 nt, Human
augucacuaacaaguggcaaa

SEQ ID NO: 71044 - RNA, 32 nt, Human
augucacuaaccugcacauucugcacauguac

SEQ ID NO: 71045 - RNA, 32 nt, Human
augucacuagugacuaccacacuggacagugc

SEQ ID NO: 71046 - RNA, 32 nt, Human
augucacucaggcuggagugcaguggcacaau

SEQ ID NO: 71047 - RNA, 32 nt, Human
augucacuccagccugggcaacagagugagac

SEQ ID NO: 71048 - RNA, 32 nt, Human
augucacucucuuccuuuuuguauccacucuc

SEQ ID NO: 71049 - RNA, 32 nt, Human
augucacucuugggcaucugugcucaggaggu

SEQ ID NO: 71050 - RNA, 24 nt, Human
augucacugagaagcuugugcaaa

SEQ ID NO: 71051 - RNA, 32 nt, Human
augucacugauugcauuccagccugggugaca

SEQ ID NO: 71052 - RNA, 32 nt, Human
augucacugcacuccagccugggugacagagu

SEQ ID NO: 71053 - RNA, 32 nt, Human
augucacugcacuccauccugggugacaagag

SEQ ID NO: 71054 - RNA, 32 nt, Human
augucacugcacucuagcuugggagacagagc

SEQ ID NO: 71055 - RNA, 32 nt, Human
augucacuggauucaucaccuaggugauggga

SEQ ID NO: 71056 - RNA, 32 nt, Human
augucacugguggcagauugcauugcccaaag

SEQ ID NO: 71057 - RNA, 32 nt, Human
augucacuguacuccagccugggcaacagagu

SEQ ID NO: 71058 - RNA, 32 nt, Human
augucacuuuaucagaauacuaguuuuaaaag

SEQ ID NO: 71059 - RNA, 32 nt, Human
augucagaaaaugcaucucagauggagaaggg

SEQ ID NO: 71060 - RNA, 32 nt, Human
augucagaacagcccuggaggaagguaugcaa

SEQ ID NO: 71061 - RNA, 32 nt, Human
augucagacaucuaguggggcagcucucuucc

SEQ ID NO: 71062 - RNA, 32 nt, Human
augucagauaaggcaacugggcuggucuuacu

SEQ ID NO: 71063 - RNA, 32 nt, Human
augucagaucagcaaggagaaacuucaacuca

SEQ ID NO: 71064 - RNA, 32 nt, Human
augucagcacacacuuacagagcacaaaugca

SEQ ID NO: 71065 - RNA, 32 nt, Human
augucagcaguggccugaagugaguugugcaa

SEQ ID NO: 71066 - RNA, 32 nt, Human
augucagcaguuacugccacacuccugucagc

SEQ ID NO: 71067 - RNA, 22 nt, Human
augucagcauucugacuacuua

SEQ ID NO: 71068 - RNA, 32 nt, Human
augucagcucccugcaaccuccgccuccuggg

SEQ ID NO: 71069 - RNA, 32 nt, Human
augucagcucucugcccucccugcugccgugg

SEQ ID NO: 71070 - RNA, 32 nt, Human
augucagcucuuccuguuucuaacuggcaaca

SEQ ID NO: 71071 - RNA, 32 nt, Human
augucagcucuuguuaaaaacuccucaccaaa

SEQ ID NO: 71072 - RNA, 32 nt, Human
augucagcugaccucucaccucccaugggcag

SEQ ID NO: 71073 - RNA, 32 nt, Human
augucaggccccgcccccuccccaccaacauu

SEQ ID NO: 71074 - RNA, 32 nt, Human
augucaggcuugcccaggaaaggggcugugcu

SEQ ID NO: 71075 - RNA, 32 nt, Human
augucagggagaaaguagagaacaggcaaccu

SEQ ID NO: 71076 - RNA, 32 nt, Human
augucagggugagggaggagacaaaaccacga

SEQ ID NO: 71077 - RNA, 32 nt, Human
augucagggugaggggugcaggagcgcagagg

SEQ ID NO: 71078 - RNA, 32 nt, Human
augucagguacugagcaaggccccagauccuu

SEQ ID NO: 71079 - RNA, 32 nt, Human
augucagguagcugccccuugccuucugggug

SEQ ID NO: 71080 - RNA, 32 nt, Human
augucaguauagaggcucuacuuuauguagac

SEQ ID NO: 71081 - RNA, 32 nt, Human
augucaguccuggaggcugagcuguuccccag

SEQ ID NO: 71082 - RNA, 32 nt, Human
augucagucucaucgucccaaggcuugaaauc

SEQ ID NO: 71083 - RNA, 32 nt, Human
augucagucuguccacguggagagaaguugcc

SEQ ID NO: 71084 - RNA, 32 nt, Human
augucagugacacgccacaguggccuagucag

SEQ ID NO: 71085 - RNA, 32 nt, Human
augucaguggcugaggcugcacucagagggau

SEQ ID NO: 71086 - RNA, 32 nt, Human
augucaguguaucuggauacacgaggaaaagg

SEQ ID NO: 71087 - RNA, 32 nt, Human
augucauagucuccuuucaaagaauuguguug

SEQ ID NO: 71088 - RNA, 32 nt, Human
augucauaucagauaauaccacugcagagaau

SEQ ID NO: 71089 - RNA, 32 nt, Human
augucaucaguguggcaaggucuucaguccga

SEQ ID NO: 71090 - RNA, 32 nt, Human
augucaucaguguggcaaggucuucagucuga

SEQ ID NO: 71091 - RNA, 32 nt, Human
augucaucaguguggcaagguuuucagucuga

SEQ ID NO: 71092 - RNA, 32 nt, Human
augucauccccucugcuauagucauaggccca

SEQ ID NO: 71093 - RNA, 32 nt, Human
augucauccgugugucccagacugucugcugu

SEQ ID NO: 71094 - RNA, 32 nt, Human
augucauccucagaaugugagcuguuugagau

SEQ ID NO: 71095 - RNA, 32 nt, Human
augucaucugaauugaggccuuucugugaaca

SEQ ID NO: 71096 - RNA, 32 nt, Human
augucaucuuuucuaaaagagacaaaugaagc

SEQ ID NO: 71097 - RNA, 30 nt, Human
augucaugaaaaccagccuugaccucacaa

SEQ ID NO: 71098 - RNA, 32 nt, Human
augucaugaagauaauggaauuuggagucuca

SEQ ID NO: 71099 - RNA, 32 nt, Human
augucaugaaugcauaaaauauacagaccaua

SEQ ID NO: 71100 - RNA, 32 nt, Human
augucaugaccaucacagcagaggagugacuu

SEQ ID NO: 71101 - RNA, 30 nt, Human
augucauggaauuggagaguauuaucgagg

SEQ ID NO: 71102 - RNA, 32 nt, Human
augucauggaauuggagaguuuuaucgagguu

SEQ ID NO: 71103 - RNA, 32 nt, Human
augucauggaguguaggaaagagcagaccaaa

SEQ ID NO: 71104 - RNA, 32 nt, Human
augucauggaguuuaguccuuguuucagguuu

SEQ ID NO: 71105 - RNA, 32 nt, Human
augucaugugacccugugccucaguuuccuca

SEQ ID NO: 71106 - RNA, 32 nt, Human
augucauuggggaaaugccgccagcaggacug

SEQ ID NO: 71107 - RNA, 32 nt, Human
augucauuuacaagccucucacacgcaggccu

SEQ ID NO: 71108 - RNA, 32 nt, Human
augucauuuucccauucuuccuuuacuaauaa

SEQ ID NO: 71109 - RNA, 32 nt, Human
auguccaaagaagagcuuagggucuuaguaac

SEQ ID NO: 71110 - RNA, 32 nt, Human
auguccaaagaggucucagaccuugcacaaug

SEQ ID NO: 71111 - RNA, 22 nt, Human
auguccaaauuuaccaauagca

SEQ ID NO: 71112 - RNA, 32 nt, Human
auguccacaaaaggcugccacagggaaguuca

SEQ ID NO: 71113 - RNA, 31 nt, Human
auguccacacauuagaauaccaguuggcagu

SEQ ID NO: 71114 - RNA, 21 nt, Human
auguccacauauauauacaca

SEQ ID NO: 71115 - RNA, 32 nt, Human
auguccacgagaugcuuggguugcuuuuccag

SEQ ID NO: 71116 - RNA, 32 nt, Human
auguccacguccugccccaccuccaggccacg

SEQ ID NO: 71117 - RNA, 32 nt, Human
auguccagacaugcucuuagucuacuagagag

SEQ ID NO: 71118 - RNA, 32 nt, Human
auguccagaggcaccaucccugcuaugaagag

SEQ ID NO: 71119 - RNA, 32 nt, Human
auguccagagggcacaaaacugucucaaugag

SEQ ID NO: 71120 - RNA, 32 nt, Human
auguccaggcuuuauccuccugaggaugagga

SEQ ID NO: 71121 - RNA, 32 nt, Human
auguccaguccccagccaggcucuguccccug

SEQ ID NO: 71122 - RNA, 32 nt, Human
auguccaguggcuagagguggggugggaagag

SEQ ID NO: 71123 - RNA, 32 nt, Human
auguccaguguguucgguuuguuacauauucc

SEQ ID NO: 71124 - RNA, 32 nt, Human
auguccaguguuuccuguuauccacaggagaa

SEQ ID NO: 71125 - RNA, 32 nt, Human
auguccaucaagggaggaagggugggucauca

SEQ ID NO: 71126 - RNA, 32 nt, Human
auguccaucgcuccagcuugguggugaaugcu

SEQ ID NO: 71127 - RNA, 32 nt, Human
auguccaucugaaggccuaucccacucagggc

SEQ ID NO: 71128 - RNA, 32 nt, Human
auguccaugagggagagguugcugagaaguac

SEQ ID NO: 71129 - RNA, 32 nt, Human
augucccaccccacucccaccaaaaaguacaa

SEQ ID NO: 71130 - RNA, 32 nt, Human
augucccaccuauuuucacuuguccauuccau

SEQ ID NO: 71131 - RNA, 32 nt, Human
augucccagacacaaaugaaaugucuccugag

SEQ ID NO: 71132 - RNA, 32 nt, Human
augucccagccuggccuguggcugcccuccau

SEQ ID NO: 71133 - RNA, 32 nt, Human
augucccagggcaugcagagguugcaccuaga

SEQ ID NO: 71134 - RNA, 32 nt, Human
augucccauaugcacauuuugugcauucaaua

SEQ ID NO: 71135 - RNA, 32 nt, Human
auguccccaacaagauugcuuaauaaauugug

SEQ ID NO: 71136 - RNA, 32 nt, Human
augucccccaccucauguuuucaccuuuucug

SEQ ID NO: 71137 - RNA, 32 nt, Human
augucccccagccuggcauggcugcacuguaa

SEQ ID NO: 71138 - RNA, 32 nt, Human
augucccccaucucccuuccugcacccugcug

SEQ ID NO: 71139 - RNA, 32 nt, Human
augucccccggaugguuuugguugcagauugu

SEQ ID NO: 71140 - RNA, 32 nt, Human
auguccccgcugcccucgaggcucccucuucc

SEQ ID NO: 71141 - RNA, 32 nt, Human
auguccccuccccagguccuucauucaccccu

SEQ ID NO: 71142 - RNA, 32 nt, Human
auguccccucgcccucuccagucaaggccacc

SEQ ID NO: 71143 - RNA, 18 nt, Human
augucccuaccguguaaa

SEQ ID NO: 71144 - RNA, 32 nt, Human
augucccugcagcuuccuacaucagaucugcc

SEQ ID NO: 71145 - RNA, 32 nt, Human
augucccugcugcaaaguuggugggugagaga

SEQ ID NO: 71146 - RNA, 20 nt, Human
augucccuggagaguagccu

SEQ ID NO: 71147 - RNA, 32 nt, Human
augucccuguggucccagcuacucaggaggcu

SEQ ID NO: 71148 - RNA, 32 nt, Human
augucccuuacaggaaccggcagcagcuaggc

SEQ ID NO: 71149 - RNA, 32 nt, Human
augucccuuccccucacucucacuuucucucu

SEQ ID NO: 71150 - RNA, 32 nt, Human
augucccuuccucugcauugaaaugucaucaa

SEQ ID NO: 71151 - RNA, 32 nt, Human
augucccuugcacagcccacacaugaaccauc

SEQ ID NO: 71152 - RNA, 32 nt, Human
auguccgcucuuccccgugauuuggaacuuuc

SEQ ID NO: 71153 - RNA, 32 nt, Human
auguccgggaggacaaaggcaggcacgguccc

SEQ ID NO: 71154 - RNA, 32 nt, Human
auguccgucucgcucaucaucaccgacauguc

SEQ ID NO: 71155 - RNA, 32 nt, Human
auguccuacaucacugccaagaacagcauuuc

SEQ ID NO: 71156 - RNA, 32 nt, Human
auguccuaggaaugcagccccaggaaguccca

SEQ ID NO: 71157 - RNA, 32 nt, Human
auguccuauauacuugacacuuucuccuugcu

SEQ ID NO: 71158 - RNA, 32 nt, Human
auguccucacucucgccaucuggcagaucgug

SEQ ID NO: 71159 - RNA, 32 nt, Human
auguccuccacagaaagggaggauagugaaca

SEQ ID NO: 71160 - RNA, 32 nt, Human
auguccuccagaggagcuuccuccuccaggcc

SEQ ID NO: 71161 - RNA, 32 nt, Human
auguccucgcucccuccauuccugccucucac

SEQ ID NO: 71162 - RNA, 32 nt, Human
auguccucuuagaaaaugaugcaucaggaagc

SEQ ID NO: 71163 - RNA, 32 nt, Human
auguccugaccuugaaccggaaccugagugac

SEQ ID NO: 71164 - RNA, 32 nt, Human
auguccugagggugcaauccuccaucaucuug

SEQ ID NO: 71165 - RNA, 32 nt, Human
auguccugagucugcuucagucuggagcuguu

SEQ ID NO: 71166 - RNA, 32 nt, Human
auguccugcagcugccccacuucuccuuuacg

SEQ ID NO: 71167 - RNA, 32 nt, Human
auguccugcgcugcagugagaccugggugaaa

SEQ ID NO: 71168 - RNA, 32 nt, Human
auguccugcggacucuugcccagaucucggcu

SEQ ID NO: 71169 - RNA, 32 nt, Human
auguccugcuuccuuggggagcugcagccaug

SEQ ID NO: 71170 - RNA, 32 nt, Human
auguccugggguccuucuuuguacugcaccca

SEQ ID NO: 71171 - RNA, 32 nt, Human
auguccugguccccacagcucgccaagcgcaa

SEQ ID NO: 71172 - RNA, 32 nt, Human
auguccuguaauacuucaccuccaggaacugu

SEQ ID NO: 71173 - RNA, 32 nt, Human
auguccuucgcccacuuuuugaugggguuguu

SEQ ID NO: 71174 - RNA, 32 nt, Human
auguccuugggucucuuaccuuccucagcccu

SEQ ID NO: 71175 - RNA, 32 nt, Human
auguccuugugagucacucugggccuggcugu

SEQ ID NO: 71176 - RNA, 32 nt, Human
augucgaacugcauaaaagaccugguaggcug

SEQ ID NO: 71177 - RNA, 32 nt, Human
augucgcaggcagcgggcccagccugagcaau

SEQ ID NO: 71178 - RNA, 25 nt, Human
augucgcccaagcuggagcgcaaug

SEQ ID NO: 71179 - RNA, 25 nt, Human
augucgcccaagcuggaguacagug

SEQ ID NO: 71180 - RNA, 25 nt, Human
augucgcccagacuagaaugcagug

SEQ ID NO: 71181 - RNA, 25 nt, Human
augucgcccaggcuagagugcagug

SEQ ID NO: 71182 - RNA, 25 nt, Human
augucgcccaggcuggaaugcagug

SEQ ID NO: 71183 - RNA, 25 nt, Human
augucgcccaggcuggagcgcagug

SEQ ID NO: 71184 - RNA, 25 nt, Human
augucgcccaggcuggaguacagug

SEQ ID NO: 71185 - RNA, 23 nt, Human
augucgcccaggcuggagugcag

SEQ ID NO: 71186 - RNA, 25 nt, Human
augucgcccaggcuggagugcagug

SEQ ID NO: 71187 - RNA, 32 nt, Human
augucgccugcuuaagcaaaucaugcuucucu

SEQ ID NO: 71188 - RNA, 32 nt, Human
augucgccugggagccagggccuggaguucug

SEQ ID NO: 71189 - RNA, 32 nt, Human
augucggcggcgcugggguugcagggaaaaga

SEQ ID NO: 71190 - RNA, 32 nt, Human
augucggcucacugaaccuccgccucucaggu

SEQ ID NO: 71191 - RNA, 32 nt, Human
augucggcucacugcaacguccgccuccuggg

SEQ ID NO: 71192 - RNA, 32 nt, Human
augucggcucacugcaagcuccgccuccuggg

SEQ ID NO: 71193 - RNA, 32 nt, Human
augucggcucacugccaacaucugccacccag

SEQ ID NO: 71194 - RNA, 32 nt, Human
augucggggucucaauuccaagcccugucuag

SEQ ID NO: 71195 - RNA, 32 nt, Human
augucgggguuucaucagagcuagggagcgac

SEQ ID NO: 71196 - RNA, 32 nt, Human
augucgucacaugccacauccacacacuucuu

SEQ ID NO: 71197 - RNA, 32 nt, Human
augucguccuacaagguggaagccaaggggga

SEQ ID NO: 71198 - RNA, 32 nt, Human
augucguccucggugaaaaccccagcacugga

SEQ ID NO: 71199 - RNA, 32 nt, Human
augucgugauucucccuccaccugacaguuug

SEQ ID NO: 71200 - RNA, 32 nt, Human
augucguggucccgggccuggcccaggggccc

SEQ ID NO: 71201 - RNA, 32 nt, Human
augucguguguaguggaugccaguagacaacu

SEQ ID NO: 71202 - RNA, 32 nt, Human
augucguuacgcagcugagcacugguugggau

SEQ ID NO: 71203 - RNA, 32 nt, Human
augucguuuccuuccugcuccugcugcacagc

SEQ ID NO: 71204 - RNA, 32 nt, Human
augucuaccuacuccauuguguggaccaaagg

SEQ ID NO: 71205 - RNA, 32 nt, Human
augucuaccucaccaaccucgcucaucauuug

SEQ ID NO: 71206 - RNA, 32 nt, Human
augucuacuucuuucuacacagacacaguaac

SEQ ID NO: 71207 - RNA, 32 nt, Human
augucuaggagugggagccugacagacaccac

SEQ ID NO: 71208 - RNA, 32 nt, Human
augucuagggcugagggcuuugccgccauggg

SEQ ID NO: 71209 - RNA, 32 nt, Human
augucuauagccuccagaacugugagaaauaa

SEQ ID NO: 71210 - RNA, 24 nt, Human
augucuauaguuccugagauuuua

SEQ ID NO: 71211 - RNA, 32 nt, Human
augucuaucauguuauacaaaaaucuagaaau

SEQ ID NO: 71212 - RNA, 32 nt, Human
augucuauugugauuuugaugaagacagaauu

SEQ ID NO: 71213 - RNA, 32 nt, Human
augucucaaacaguaucaaacaccauuucaua

SEQ ID NO: 71214 - RNA, 32 nt, Human
augucucacagcccuggccacuggcagaucag

SEQ ID NO: 71215 - RNA, 32 nt, Human
augucucacaggacaggagggagugagggaaa

SEQ ID NO: 71216 - RNA, 32 nt, Human
augucucacuucuuacugagcuacuuaaauca

SEQ ID NO: 71217 - RNA, 32 nt, Human
augucucagcaacuggacccccucaggagcag

SEQ ID NO: 71218 - RNA, 31 nt, Human
augucucaguuaagaaagaaagacugggcca

SEQ ID NO: 71219 - RNA, 32 nt, Human
augucucauguaauuugcauuacucuggugga

SEQ ID NO: 71220 - RNA, 32 nt, Human
augucuccacgcacagcuaauggcaguaccug

SEQ ID NO: 71221 - RNA, 24 nt, Human
augucuccacuaaaaauacaaaau

SEQ ID NO: 71222 - RNA, 32 nt, Human
augucuccacugcuucuacucuggguugggau

SEQ ID NO: 71223 - RNA, 32 nt, Human
augucucccaggcuggagugcaguggcacagu

SEQ ID NO: 71224 - RNA, 28 nt, Human
augucuccuauuuuuauaauuucugagu

SEQ ID NO: 71225 - RNA, 32 nt, Human
augucuccuccugguuuuuaguuguuuuucuu

SEQ ID NO: 71226 - RNA, 32 nt, Human
augucuccuggacucagggucugcuuccccca

SEQ ID NO: 71227 - RNA, 32 nt, Human
augucuccugggaagagccucccacaaccuca

SEQ ID NO: 71228 - RNA, 23 nt, Human
augucucuacuaaaaauacaaaa

SEQ ID NO: 71229 - RNA, 24 nt, Human
augucucuacuaaaaauacaaaau

SEQ ID NO: 71230 - RNA, 32 nt, Human
augucucucagucauuccccuggggcucaagc

SEQ ID NO: 71231 - RNA, 32 nt, Human
augucucucugcaaauccagcugguaaaauaa

SEQ ID NO: 71232 - RNA, 32 nt, Human
augucucuggcucauaaaaugagacucccuca

SEQ ID NO: 71233 - RNA, 32 nt, Human
augucucuuccagaggcaucugaggcugugug

SEQ ID NO: 71234 - RNA, 32 nt, Human
augucucuuggcuaccuucugcaugcauuucu

SEQ ID NO: 71235 - RNA, 32 nt, Human
augucucuuugugggacccaggcucaugggac

SEQ ID NO: 71236 - RNA, 26 nt, Human
augucugaccucaggugauccacccg

SEQ ID NO: 71237 - RNA, 32 nt, Human
augucugagaaaaggauccugauugagucaau

SEQ ID NO: 71238 - RNA, 32 nt, Human
augucugagaaucaguucaaggcauaugcaga

SEQ ID NO: 71239 - RNA, 32 nt, Human
augucugagcagcuccagagggagggccacca

SEQ ID NO: 71240 - RNA, 32 nt, Human
augucugagccccagugccuucuguucgggcc

SEQ ID NO: 71241 - RNA, 24 nt, Human
augucugagucaccagaaauucca

SEQ ID NO: 71242 - RNA, 32 nt, Human
augucugcacauucugguggcaggcagacaau

SEQ ID NO: 71243 - RNA, 32 nt, Human
augucugcaggcaguggcaugugggcaggggg

SEQ ID NO: 71244 - RNA, 32 nt, Human
augucugccgccagcccugcugugcugccugu

SEQ ID NO: 71245 - RNA, 32 nt, Human
augucugccugggggugggguuuucccugagc

SEQ ID NO: 71246 - RNA, 23 nt, Human
augucugccugugccucagcugu

SEQ ID NO: 71247 - RNA, 32 nt, Human
augucugcucuaagaagcagacaaccggacau

SEQ ID NO: 71248 - RNA, 32 nt, Human
augucugcucugcagguucuucauacagcugc

SEQ ID NO: 71249 - RNA, 32 nt, Human
augucuggagcuuccuuuuaaggaaagaaaag

SEQ ID NO: 71250 - RNA, 32 nt, Human
augucuggagugagugcaggcucagaucaggg

SEQ ID NO: 71251 - RNA, 32 nt, Human
augucugggagagaggauaggaugggaaugcu

SEQ ID NO: 71252 - RNA, 32 nt, Human
augucugguguuuuuaacuugaucaugaucag

SEQ ID NO: 71253 - RNA, 21 nt, Human
augucuguaaaacuugacgua

SEQ ID NO: 71254 - RNA, 32 nt, Human
augucuguaacagugaacaguuauagacuuuu

SEQ ID NO: 71255 - RNA, 32 nt, Human
augucuguaccaucgucuccuuccgcucggcc

SEQ ID NO: 71256 - RNA, 32 nt, Human
augucugugacagggagggaaggcucugcccu

SEQ ID NO: 71257 - RNA, 32 nt, Human
augucugugcugcugucaccaggcaccuuugu

SEQ ID NO: 71258 - RNA, 32 nt, Human
augucugugucagcugucuuuguaguuaggaa

SEQ ID NO: 71259 - RNA, 32 nt, Human
augucuguguuggugauauuaucaagcuagaa

SEQ ID NO: 71260 - RNA, 32 nt, Human
augucuguguuuugaggaggagggugucugug

SEQ ID NO: 71261 - RNA, 32 nt, Human
augucuguuaccccucuccaucuuaccaaguu

SEQ ID NO: 71262 - RNA, 32 nt, Human
augucuguucauguguucaguguuacagcaaa

SEQ ID NO: 71263 - RNA, 21 nt, Human
augucuguugaguacuucaua

SEQ ID NO: 71264 - RNA, 32 nt, Human
augucuguuggauucaugucuuuugcuauagu

SEQ ID NO: 71265 - RNA, 32 nt, Human
augucuguuguucaaguaauaaaaguugcccu

SEQ ID NO: 71266 - RNA, 32 nt, Human
augucuuaguguuacccuccccuagucaacag

SEQ ID NO: 71267 - RNA, 32 nt, Human
augucuuauuuuauuugucaggcacagaugcu

SEQ ID NO: 71268 - RNA, 32 nt, Human
augucuucaacaucugagucaccaagaaguaa

SEQ ID NO: 71269 - RNA, 32 nt, Human
augucuucaauaacacauucacuugagcuuuu

SEQ ID NO: 71270 - RNA, 25 nt, Human
augucuucacauaggaggaaagcga

SEQ ID NO: 71271 - RNA, 32 nt, Human
augucuucagaacuuagaugugaaaaucuaca

SEQ ID NO: 71272 - RNA, 32 nt, Human
augucuucagaggcucaucuaacucuguccuu

SEQ ID NO: 71273 - RNA, 32 nt, Human
augucuucagaugccuuucugccucugucgau

SEQ ID NO: 71274 - RNA, 32 nt, Human
augucuucaguuaucucucgaguuuugaagcu

SEQ ID NO: 71275 - RNA, 32 nt, Human
augucuuccacuuuccaucauguauguaaaau

SEQ ID NO: 71276 - RNA, 22 nt, Human
augucuucccucccccgacccc

SEQ ID NO: 71277 - RNA, 32 nt, Human
augucuuccucuuccucucucuuccagagccc

SEQ ID NO: 71278 - RNA, 32 nt, Human
augucuucucaggccaugagcugcagugacug

SEQ ID NO: 71279 - RNA, 25 nt, Human
augucuucuuuggggcucugcaguu

SEQ ID NO: 71280 - RNA, 32 nt, Human
augucuucuuuuggcuguucugauuuguaucc

SEQ ID NO: 71281 - RNA, 32 nt, Human
augucuugaaacauguucaucuggaaguauuu

SEQ ID NO: 71282 - RNA, 32 nt, Human
augucuugaguugagguuaucaucucaaugag

SEQ ID NO: 71283 - RNA, 32 nt, Human
augucuuggaaagaaaaaguucaucacagaaa

SEQ ID NO: 71284 - RNA, 32 nt, Human
augucuuggaaccugucuugaguggggacaac

SEQ ID NO: 71285 - RNA, 32 nt, Human
augucuuguuauuauucuuugccaucaugcuu

SEQ ID NO: 71286 - RNA, 32 nt, Human
augucuuuaaaaagcauguugugauguacaca

SEQ ID NO: 71287 - RNA, 32 nt, Human
augucuuuaguguugagccucuggauucuggg

SEQ ID NO: 71288 - RNA, 32 nt, Human
augucuuuaucagcagugugaaaaugaacuaa

SEQ ID NO: 71289 - RNA, 32 nt, Human
augucuuugaagcaaagccugucccgcuagcc

SEQ ID NO: 71290 - RNA, 32 nt, Human
augucuuugggaggugucugugaagcagucau

SEQ ID NO: 71291 - RNA, 32 nt, Human
augucuuuucaauaucuuuucauuuucuccca

SEQ ID NO: 71292 - RNA, 32 nt, Human
augucuuuugcuuugaucuggagggagggcug

SEQ ID NO: 71293 - RNA, 32 nt, Human
augugaaaaccugucacuugcacagaggccag

SEQ ID NO: 71294 - RNA, 32 nt, Human
augugaaacaaccugggcaacauggugaaacc

SEQ ID NO: 71295 - RNA, 32 nt, Human
augugaaacaguauguguuagcauuugagcac

SEQ ID NO: 71296 - RNA, 32 nt, Human
augugaaaccacagauauuucauuaaaacaua

SEQ ID NO: 71297 - RNA, 32 nt, Human
augugaaagauuaugccuaugugucuugcaga

SEQ ID NO: 71298 - RNA, 32 nt, Human
augugaaagugguggagggcaauggaagggaa

SEQ ID NO: 71299 - RNA, 32 nt, Human
augugaacacaaaacacauuucuauggcauag

SEQ ID NO: 71300 - RNA, 32 nt, Human
augugaaccagcccuucucuucucaguuucag

SEQ ID NO: 71301 - RNA, 32 nt, Human
augugaaccauuaaccagaucuagucaaucaa

SEQ ID NO: 71302 - RNA, 32 nt, Human
augugaaccugacggacauggacgcccugagc

SEQ ID NO: 71303 - RNA, 32 nt, Human
augugaagaaaauuauuucuuucaaaguuugc

SEQ ID NO: 71304 - RNA, 32 nt, Human
augugaagaauaugcaaagccugugaaugguc

SEQ ID NO: 71305 - RNA, 32 nt, Human
augugaagaaugugacaaagcuuacaguuuca

SEQ ID NO: 71306 - RNA, 32 nt, Human
augugaagaaugugacaaagcuuuccguguga

SEQ ID NO: 71307 - RNA, 32 nt, Human
augugaagacgagaagaaggcaacugucucca

SEQ ID NO: 71308 - RNA, 32 nt, Human
augugaagauagugacaaagcuuacaguuuca

SEQ ID NO: 71309 - RNA, 32 nt, Human
augugaagauauuuccuuuuccauucagaacc

SEQ ID NO: 71310 - RNA, 32 nt, Human
augugaaggcacaagcugcuguuauauacaac

SEQ ID NO: 71311 - RNA, 32 nt, Human
augugaaggccuaggacauuacuguacacuac

SEQ ID NO: 71312 - RNA, 32 nt, Human
augugaaguaaagaucauaauuagcuguguua

SEQ ID NO: 71313 - RNA, 32 nt, Human
augugaaguucugcauagaugccagucaacca

SEQ ID NO: 71314 - RNA, 32 nt, Human
augugaauagccacugcacuccagccugggca

SEQ ID NO: 71315 - RNA, 32 nt, Human
augugaaucuucucuccacuguaguucagggg

SEQ ID NO: 71316 - RNA, 32 nt, Human
augugaaugccaacauggccaggucauuagag

SEQ ID NO: 71317 - RNA, 32 nt, Human
augugaauuauaaaugagauaauccacaguua

SEQ ID NO: 71318 - RNA, 32 nt, Human
augugacaaagccuuuaaccaguccucaauuu

SEQ ID NO: 71319 - RNA, 32 nt, Human
augugacaaucucauuggaacaugucacaaaa

SEQ ID NO: 71320 - RNA, 24 nt, Human
augugacacaggacagccauagua

SEQ ID NO: 71321 - RNA, 32 nt, Human
augugacacucaggcuggaguggugguaaggg

SEQ ID NO: 71322 - RNA, 32 nt, Human
augugacagacaccucggcucuccuugaauaa

SEQ ID NO: 71323 - RNA, 25 nt, Human
augugacagagcucgacccaagcca

SEQ ID NO: 71324 - RNA, 32 nt, Human
augugacagauggggaaacugaggccuugaga

SEQ ID NO: 71325 - RNA, 32 nt, Human
augugacagcauggggguggacuuugauguga

SEQ ID NO: 71326 - RNA, 32 nt, Human
augugacagccauugugagacugaugcacaaa

SEQ ID NO: 71327 - RNA, 32 nt, Human
augugacaggaggcagcagaaguugcagagaa

SEQ ID NO: 71328 - RNA, 32 nt, Human
augugacagugacacuuccuggaguguagagc

SEQ ID NO: 71329 - RNA, 32 nt, Human
augugacaugaggccgacuggggccaggcuca

SEQ ID NO: 71330 - RNA, 32 nt, Human
augugacaugucugugggaagcucccagaguu

SEQ ID NO: 71331 - RNA, 32 nt, Human
augugaccaaacuaaagugagaaaaauguagg

SEQ ID NO: 71332 - RNA, 32 nt, Human
augugaccagaagugcugaugaccucagggaa

SEQ ID NO: 71333 - RNA, 32 nt, Human
augugaccagcccugaguucaccaguguucag

SEQ ID NO: 71334 - RNA, 32 nt, Human
augugacccccaggacagaauggugcuggacu

SEQ ID NO: 71335 - RNA, 32 nt, Human
augugacccuagugacgucacagaccugagau

SEQ ID NO: 71336 - RNA, 32 nt, Human
augugacccuugccaucuccaaaugagugauc

SEQ ID NO: 71337 - RNA, 32 nt, Human
augugaccuggggcaggauaccgucagugagg

SEQ ID NO: 71338 - RNA, 32 nt, Human
augugacucagagaggaggguucugggcaggg

SEQ ID NO: 71339 - RNA, 32 nt, Human
augugacucaggauggaggguggcacugucca

SEQ ID NO: 71340 - RNA, 32 nt, Human
augugacuccuggaagugacguaggagugagu

SEQ ID NO: 71341 - RNA, 32 nt, Human
augugacugagguggugcccgagcccagccag

SEQ ID NO: 71342 - RNA, 32 nt, Human
augugacuggugcugcggcggggcgugcugcg

SEQ ID NO: 71343 - RNA, 32 nt, Human
augugagaaagaaaucucuagauuugaugggu

SEQ ID NO: 71344 - RNA, 32 nt, Human
augugagaagcagaacguggugaccuuucacg

SEQ ID NO: 71345 - RNA, 32 nt, Human
augugagaaggaagggaggaguaggaaucuug

SEQ ID NO: 71346 - RNA, 32 nt, Human
augugagaaggugucacaguuugaggcgaagg

SEQ ID NO: 71347 - RNA, 32 nt, Human
augugagacaacugcacuccagugugggcgug

SEQ ID NO: 71348 - RNA, 32 nt, Human
augugagacccgcuugugaguccuccacacuc

SEQ ID NO: 71349 - RNA, 32 nt, Human
augugagacgguggacuuuuccucuggacaaa

SEQ ID NO: 71350 - RNA, 32 nt, Human
augugagagaccggaguaugauccucagugcg

SEQ ID NO: 71351 - RNA, 32 nt, Human
augugagaggcagagagggcgaguggcugcga

SEQ ID NO: 71352 - RNA, 32 nt, Human
augugagaguuuuccuuuuucugcaccacuag

SEQ ID NO: 71353 - RNA, 32 nt, Human
augugagcacacugugagaagaugccauccgc

SEQ ID NO: 71354 - RNA, 32 nt, Human
augugagcacagacccagguguuucugaaccu

SEQ ID NO: 71355 - RNA, 32 nt, Human
augugagcauggucacaagcacaaagcucaag

SEQ ID NO: 71356 - RNA, 32 nt, Human
augugagccacugcaccuggccccagaaauua

SEQ ID NO: 71357 - RNA, 32 nt, Human
augugagccacugucuuucccauuuuuggcug

SEQ ID NO: 71358 - RNA, 32 nt, Human
augugagccuggcugcucagcgucuccuggcc

SEQ ID NO: 71359 - RNA, 32 nt, Human
augugagccugggaggucaaggcugcagugag

SEQ ID NO: 71360 - RNA, 32 nt, Human
augugagcucagccacagaccucagcuggcgg

SEQ ID NO: 71361 - RNA, 32 nt, Human
augugagcuggcaguuaagagcugaauggcuc

SEQ ID NO: 71362 - RNA, 32 nt, Human
augugagcuuaggaguuggcagccuguggcau

SEQ ID NO: 71363 - RNA, 32 nt, Human
augugaggaagacaggcuucccuuccuucccc

SEQ ID NO: 71364 - RNA, 32 nt, Human
augugaggaucaggugggcaugguggcucaug

SEQ ID NO: 71365 - RNA, 32 nt, Human
augugaggaugaggagacagaaaacaaguagc

SEQ ID NO: 71366 - RNA, 32 nt, Human
augugaggcagugacaccgagcuguuugacca

SEQ ID NO: 71367 - RNA, 32 nt, Human
augugaggcugaggcagguggaucacuugagg

SEQ ID NO: 71368 - RNA, 32 nt, Human
augugaggggcugaggggcucaaggaggggag

SEQ ID NO: 71369 - RNA, 32 nt, Human
augugaggugccauccucugagcccaggucug

SEQ ID NO: 71370 - RNA, 32 nt, Human
augugagguucacaguuguauuccaguauuca

SEQ ID NO: 71371 - RNA, 32 nt, Human
augugaguccugggccuuucugccuccugaug

SEQ ID NO: 71372 - RNA, 32 nt, Human
augugagugggugggauggggacauuugaaca

SEQ ID NO: 71373 - RNA, 23 nt, Human
augugaguguacauauauacaca

SEQ ID NO: 71374 - RNA, 32 nt, Human
augugaguuucugcuuuugaaaauugcuugua

SEQ ID NO: 71375 - RNA, 32 nt, Human
augugauaaaaugaaacaauugcucaacugau

SEQ ID NO: 71376 - RNA, 32 nt, Human
augugauaaaguuuacaguggcaaaucaagcc

SEQ ID NO: 71377 - RNA, 32 nt, Human
augugauaggcacaggacaggaguaggcaccu

SEQ ID NO: 71378 - RNA, 31 nt, Human
augugaucaauuacuguccucacuuagaaca

SEQ ID NO: 71379 - RNA, 32 nt, Human
augugauccucuguaucuccccaguaaucaca

SEQ ID NO: 71380 - RNA, 32 nt, Human
augugauccugccuugcugugaaauuucugua

SEQ ID NO: 71381 - RNA, 32 nt, Human
augugaucuauucugcugaaugcucugugugc

SEQ ID NO: 71382 - RNA, 32 nt, Human
augugaucugucuuguaauauuuuguauuauu

SEQ ID NO: 71383 - RNA, 32 nt, Human
augugaugauucacuuuucaguucucaaauua

SEQ ID NO: 71384 - RNA, 32 nt, Human
augugaugcaugcucacgugucuccgcagccg

SEQ ID NO: 71385 - RNA, 30 nt, Human
augugaugcugggggcagagacagaggaga

SEQ ID NO: 71386 - RNA, 32 nt, Human
augugaugcugggggcagagacagaggagaag

SEQ ID NO: 71387 - RNA, 32 nt, Human
augugauguccuuuugcauauuuccuucauuc

SEQ ID NO: 71388 - RNA, 30 nt, Human
augugauguuggaaaauuaugggaacaugg

SEQ ID NO: 71389 - RNA, 32 nt, Human
augugauuagauaguuccugacaaaauaaaug

SEQ ID NO: 71390 - RNA, 32 nt, Human
augugauucacugccuuccucucucuaccagu

SEQ ID NO: 71391 - RNA, 32 nt, Human
augugauucccaaccaacucaggaugaaguaa

SEQ ID NO: 71392 - RNA, 32 nt, Human
augugauuccccagaacccaggacaggacagc

SEQ ID NO: 71393 - RNA, 32 nt, Human
augugauucccucuccccaaaugggccuacca

SEQ ID NO: 71394 - RNA, 32 nt, Human
augugauucuggaaguccuggaugccagagac

SEQ ID NO: 71395 - RNA, 32 nt, Human
augugauuuauucaaggucacauagaggggua

SEQ ID NO: 71396 - RNA, 32 nt, Human
augugauuuucacagauucagcucuucucucc

SEQ ID NO: 71397 - RNA, 32 nt, Human
augugcaaguguuugauucaugccauuugaua

SEQ ID NO: 71398 - RNA, 32 nt, Human
augugcacacauauacauguaggaguguuuau

SEQ ID NO: 71399 - RNA, 32 nt, Human
augugcacccccuguccccuggcugggccacc

SEQ ID NO: 71400 - RNA, 32 nt, Human
augugcacccuucucccuccagccugggcuac

SEQ ID NO: 71401 - RNA, 32 nt, Human
augugcaccugagaccugaugucuaucugugg

SEQ ID NO: 71402 - RNA, 32 nt, Human
augugcacugugacugccugguggccuuuggu

SEQ ID NO: 71403 - RNA, 32 nt, Human
augugcagacagcagagacuggcugaguggaa

SEQ ID NO: 71404 - RNA, 32 nt, Human
augugcaggacauguccagcauggacagagcc

SEQ ID NO: 71405 - RNA, 32 nt, Human
augugcaggauaggacagcuuagaaugagugc

SEQ ID NO: 71406 - RNA, 32 nt, Human
augugcagugagccaccauggaggaccaagca

SEQ ID NO: 71407 - RNA, 32 nt, Human
augugcagugucuuuucagaaaggacacucug

SEQ ID NO: 71408 - RNA, 32 nt, Human
augugcauauagacacaucuauaauuuuacac

SEQ ID NO: 71409 - RNA, 32 nt, Human
augugcauauuuaaaauauggauagagacgca

SEQ ID NO: 71410 - RNA, 32 nt, Human
augugcaucaagccagccugaccaacauggug

SEQ ID NO: 71411 - RNA, 32 nt, Human
augugcaucuucccuuucuugguuuuagaugu

SEQ ID NO: 71412 - RNA, 32 nt, Human
augugcauggugcugugaauaauugucuagua

SEQ ID NO: 71413 - RNA, 32 nt, Human
augugccaaacgucagugguguuuucauaugg

SEQ ID NO: 71414 - RNA, 32 nt, Human
augugccacgaccuggggugggcacagggagg

SEQ ID NO: 71415 - RNA, 32 nt, Human
augugccacuggacucccagccugggugacag

SEQ ID NO: 71416 - RNA, 32 nt, Human
augugccagcuacucgggaggcugaggcaaga

SEQ ID NO: 71417 - RNA, 32 nt, Human
augugccaggugcagagauuaaggaguuaucu

SEQ ID NO: 71418 - RNA, 32 nt, Human
augugccaguagucccagcuacucgaaaggcu

SEQ ID NO: 71419 - RNA, 32 nt, Human
augugcccaccuggcccugcccuggccgccac

SEQ ID NO: 71420 - RNA, 32 nt, Human
augugcccagcaccuccuuugugccaggcccc

SEQ ID NO: 71421 - RNA, 32 nt, Human
augugcccagcacuaugcugagcuuacacuaa

SEQ ID NO: 71422 - RNA, 32 nt, Human
augugcccagugcgggcugagauaaggcccug

SEQ ID NO: 71423 - RNA, 32 nt, Human
augugccccaggcuuuauuuuaauagugaucu

SEQ ID NO: 71424 - RNA, 32 nt, Human
augugccccauguccaaguccaaccugccugu

SEQ ID NO: 71425 - RNA, 32 nt, Human
augugcccuguaucuauuggcagugaccuugg

SEQ ID NO: 71426 - RNA, 32 nt, Human
augugcccuucaugccccucccugcauugagg

SEQ ID NO: 71427 - RNA, 32 nt, Human
augugccgguagccccagcuacucgggaggcu

SEQ ID NO: 71428 - RNA, 32 nt, Human
augugccuauagccccagcuacucaggaagcu

SEQ ID NO: 71429 - RNA, 32 nt, Human
augugccuauagucccagcuacuugggaggug

SEQ ID NO: 71430 - RNA, 32 nt, Human
augugccucauuaagaggcaggucuuaaucag

SEQ ID NO: 71431 - RNA, 32 nt, Human
augugccucauucugugccuccuucugugccu

SEQ ID NO: 71432 - RNA, 32 nt, Human
augugccucccauccugacuguggaguuggga

SEQ ID NO: 71433 - RNA, 30 nt, Human
augugccucuccagacugcuccugcacuua

SEQ ID NO: 71434 - RNA, 32 nt, Human
augugccugaaggcuauccacuacauucugaa

SEQ ID NO: 71435 - RNA, 32 nt, Human
augugccugagauucggauggggagcucucaa

SEQ ID NO: 71436 - RNA, 32 nt, Human
augugccugaugugguggagggagacaccagc

SEQ ID NO: 71437 - RNA, 32 nt, Human
augugccugcaaucccagcuacucaggaggcu

SEQ ID NO: 71438 - RNA, 32 nt, Human
augugccugcggucccagcugcucugauaaga

SEQ ID NO: 71439 - RNA, 32 nt, Human
augugccugcuuccuguucaccuucugccaug

SEQ ID NO: 71440 - RNA, 32 nt, Human
augugccuggagucccagcuacucaggaggcu

SEQ ID NO: 71441 - RNA, 32 nt, Human
augugccuguaaccccagcuacucaggaggcc

SEQ ID NO: 71442 - RNA, 32 nt, Human
augugccuguaaucccaccuacucgagaggcu

SEQ ID NO: 71443 - RNA, 32 nt, Human
augugccuguaaucccagcuacucaggaggcc

SEQ ID NO: 71444 - RNA, 32 nt, Human
augugccuguaaucccagcuacucaggaggcu

SEQ ID NO: 71445 - RNA, 32 nt, Human
augugccuguaaucccagcuacucaggagucu

SEQ ID NO: 71446 - RNA, 32 nt, Human
augugccuguaaucccagcuacuugggaggcu

SEQ ID NO: 71447 - RNA, 32 nt, Human
augugccuguaaucccagcuauuuggcaggcu

SEQ ID NO: 71448 - RNA, 32 nt, Human
augugccuguaaucccagcuucuggaggcuga

SEQ ID NO: 71449 - RNA, 32 nt, Human
augugccuguaaucccagcuucuugggaagcu

SEQ ID NO: 71450 - RNA, 32 nt, Human
augugccuguaaucccaguuacuggggaggcu

SEQ ID NO: 71451 - RNA, 32 nt, Human
augugccuguaaucccugcuacucaggaggcu

SEQ ID NO: 71452 - RNA, 32 nt, Human
augugccuguaauuccagcuacucgggaggcu

SEQ ID NO: 71453 - RNA, 32 nt, Human
augugccuguagucccagcuacaugggaggcu

SEQ ID NO: 71454 - RNA, 32 nt, Human
augugccuguagucccagcuacucaggaggcu

SEQ ID NO: 71455 - RNA, 32 nt, Human
augugccuguagucccagcuacucaggagucu

SEQ ID NO: 71456 - RNA, 32 nt, Human
augugccuguagucccagcuacucuggagucu

SEQ ID NO: 71457 - RNA, 32 nt, Human
augugccuguagucccagcuacuugggaggcu

SEQ ID NO: 71458 - RNA, 32 nt, Human
augugccuguagucucagcuacucaggaggcu

SEQ ID NO: 71459 - RNA, 32 nt, Human
augugccuguaguuccagcuacucaggaggcu

SEQ ID NO: 71460 - RNA, 32 nt, Human
augugccuguaucuuuuucuccacccaaaccc

SEQ ID NO: 71461 - RNA, 32 nt, Human
augugccuguauucccagcuacucaugaggcu

SEQ ID NO: 71462 - RNA, 32 nt, Human
augugccugucguuccagcuaccugggaugcu

SEQ ID NO: 71463 - RNA, 32 nt, Human
augugccugugggguggggaggcguagggguc

SEQ ID NO: 71464 - RNA, 32 nt, Human
augugccuguggucccagcuacucaagaggcu

SEQ ID NO: 71465 - RNA, 32 nt, Human
augugccuguggucccagcuacucaggaggcu

SEQ ID NO: 71466 - RNA, 32 nt, Human
augugccugugguccuagcuacucaggaggcu

SEQ ID NO: 71467 - RNA, 32 nt, Human
augugccuguggucucagcuacucaggaggcu

SEQ ID NO: 71468 - RNA, 32 nt, Human
augugccuucuaaauggcaugacauauguaga

SEQ ID NO: 71469 - RNA, 32 nt, Human
augugccuuggaccaguuccuguguuggaaug

SEQ ID NO: 71470 - RNA, 25 nt, Human
augugccuuugauuuguuagcuuua

SEQ ID NO: 71471 - RNA, 32 nt, Human
augugccuuuugguuacaugcauuaaaucuaa

SEQ ID NO: 71472 - RNA, 32 nt, Human
augugcgcaagguuguuuccugcugagagcug

SEQ ID NO: 71473 - RNA, 22 nt, Human
augugcgcccucagggcuucca

SEQ ID NO: 71474 - RNA, 32 nt, Human
augugcgcgcacacaccacacaugcacacacg

SEQ ID NO: 71475 - RNA, 32 nt, Human
augugcggaagggacccaggagaccugcagga

SEQ ID NO: 71476 - RNA, 32 nt, Human
augugcggccagcucccuccccuugaccccag

SEQ ID NO: 71477 - RNA, 23 nt, Human
augugcuaaugaaagagauucua

SEQ ID NO: 71478 - RNA, 22 nt, Human
augugcuacacuagauauuuca

SEQ ID NO: 71479 - RNA, 32 nt, Human
augugcuacugcccccaggugcuuggauggcu

SEQ ID NO: 71480 - RNA, 22 nt, Human
augugcuagcaccagaacuucu

SEQ ID NO: 71481 - RNA, 32 nt, Human
augugcuaggauuacaggcgugggccaccaca

SEQ ID NO: 71482 - RNA, 22 nt, Human
augugcuauacuagauauuuca

SEQ ID NO: 71483 - RNA, 23 nt, Human
augugcuauauauuagaaauuuc

SEQ ID NO: 71484 - RNA, 32 nt, Human
augugcuauuggagaacaggucuuuguggaga

SEQ ID NO: 71485 - RNA, 32 nt, Human
augugcucacuggcucaacuguauuuuucaaa

SEQ ID NO: 71486 - RNA, 32 nt, Human
augugcucagccaggcuggaggcggcaggcgg

SEQ ID NO: 71487 - RNA, 22 nt, Human
augugcuccaggccaugcugga

SEQ ID NO: 71488 - RNA, 19 nt, Human
augugcuccgggaccugga

SEQ ID NO: 71489 - RNA, 23 nt, Human
augugcucguuucuaaaauucua

SEQ ID NO: 71490 - RNA, 18 nt, Human
augugcucuggagcugga

SEQ ID NO: 71491 - RNA, 23 nt, Human
augugcugaaagccaaacuuuua

SEQ ID NO: 71492 - RNA, 32 nt, Human
augugcugaaagucaucugucuucugagucaa

SEQ ID NO: 71493 - RNA, 32 nt, Human
augugcugacggggguccagaggcagaguccu

SEQ ID NO: 71494 - RNA, 32 nt, Human
augugcugagauugcaggcaugagccacugcg

SEQ ID NO: 71495 - RNA, 32 nt, Human
augugcugcacuccuucccuccugccuccugc

SEQ ID NO: 71496 - RNA, 32 nt, Human
augugcugccuucuguuguggauuuccugcca

SEQ ID NO: 71497 - RNA, 32 nt, Human
augugcugcucuucuugguggggcuuugggcu

SEQ ID NO: 71498 - RNA, 32 nt, Human
augugcugggaugggagcccccugagagcagg

SEQ ID NO: 71499 - RNA, 32 nt, Human
augugcugggauuacaggcaugagccaccgca

SEQ ID NO: 71500 - RNA, 32 nt, Human
augugcugggauuacaggcgugagccuuggug

SEQ ID NO: 71501 - RNA, 32 nt, Human
augugcugggauuacaguugucacguaccgcg

SEQ ID NO: 71502 - RNA, 32 nt, Human
augugcugguggauccacucccauggauccac

SEQ ID NO: 71503 - RNA, 32 nt, Human
augugcugguuccucccaccaucaagcaggga

SEQ ID NO: 71504 - RNA, 32 nt, Human
augugcuguaguuugaaaccuaacgaauccuc

SEQ ID NO: 71505 - RNA, 24 nt, Human
augugcuguaucccaggcauacua

SEQ ID NO: 71506 - RNA, 32 nt, Human
augugcuguccagcaaagcacacauggagaag

SEQ ID NO: 71507 - RNA, 32 nt, Human
augugcugugugugcaccugcucacaggaugu

SEQ ID NO: 71508 - RNA, 32 nt, Human
augugcugugugugugcaugugugcaugacgg

SEQ ID NO: 71509 - RNA, 32 nt, Human
augugcuuacaggccaguaagcuuugaccuca

SEQ ID NO: 71510 - RNA, 32 nt, Human
augugcuuggucuccccuucugcuguucuccu

SEQ ID NO: 71511 - RNA, 32 nt, Human
augugcuuguaaucccagcuacucuggaggcu

SEQ ID NO: 71512 - RNA, 32 nt, Human
augugcuuguacauggagccucugcuguagcu

SEQ ID NO: 71513 - RNA, 32 nt, Human
augugcuuucaccucugccucaucuuuccucc

SEQ ID NO: 71514 - RNA, 32 nt, Human
augugcuuuccuggaaauuuuucuagauagaa

SEQ ID NO: 71515 - RNA, 32 nt, Human
augugcuuuguggcuucucuuuacagcuuugu

SEQ ID NO: 71516 - RNA, 24 nt, Human
augugcuuuuccaguucuucugga

SEQ ID NO: 71517 - RNA, 32 nt, Human
auguggaaacuuuuuaguucucacuacaaugu

SEQ ID NO: 71518 - RNA, 32 nt, Human
auguggaaagucugaaugcaguauuuauagac

SEQ ID NO: 71519 - RNA, 32 nt, Human
auguggaaaugagaugugcuuaggaaaggguc

SEQ ID NO: 71520 - RNA, 32 nt, Human
auguggaaauggacacagggaucuucugaagu

SEQ ID NO: 71521 - RNA, 32 nt, Human
auguggaaauucuuccuguuggcuaaagggga

SEQ ID NO: 71522 - RNA, 32 nt, Human
auguggaagaacuuaggcaucugugggcaugg

SEQ ID NO: 71523 - RNA, 32 nt, Human
auguggaagacaaauccuguccagccgggugg

SEQ ID NO: 71524 - RNA, 32 nt, Human
auguggaagagccagaggaggagcagcuuuac

SEQ ID NO: 71525 - RNA, 32 nt, Human
auguggaauguguuuucuagcuuucuuugaau

SEQ ID NO: 71526 - RNA, 31 nt, Human
auguggaauugacugccuaugccaagucccu

SEQ ID NO: 71527 - RNA, 32 nt, Human
auguggacacauauccggaaacugcagcugcu

SEQ ID NO: 71528 - RNA, 32 nt, Human
auguggaccaaauucguaccacuaucuaaaau

SEQ ID NO: 71529 - RNA, 32 nt, Human
auguggagagagcacugugugcgcagcggcag

SEQ ID NO: 71530 - RNA, 32 nt, Human
auguggagcgggguuuagcucaugcaaaagac

SEQ ID NO: 71531 - RNA, 32 nt, Human
auguggaggaauacacauacacacacaaacau

SEQ ID NO: 71532 - RNA, 32 nt, Human
auguggaggacagucugagggagccacugucc

SEQ ID NO: 71533 - RNA, 32 nt, Human
auguggaggacauguucccauggaucauaugu

SEQ ID NO: 71534 - RNA, 32 nt, Human
auguggaggagaaagagggaaucccuccacaa

SEQ ID NO: 71535 - RNA, 31 nt, Human
auguggauacuauccuaguugaguagaguag

SEQ ID NO: 71536 - RNA, 32 nt, Human
auguggauagaacuuauaagccuaguagugau

SEQ ID NO: 71537 - RNA, 32 nt, Human
auguggauauccagccagaaugcccucucucc

SEQ ID NO: 71538 - RNA, 32 nt, Human
auguggaucuaaggcaaauuguucacuuugug

SEQ ID NO: 71539 - RNA, 32 nt, Human
auguggaugcagcuguccagccacugcccuuu

SEQ ID NO: 71540 - RNA, 32 nt, Human
auguggauggccuggggacuccuggguuuucu

SEQ ID NO: 71541 - RNA, 32 nt, Human
auguggauguggccagugucagccuggagaaa

SEQ ID NO: 71542 - RNA, 32 nt, Human
auguggauucacauuucuguggagauuuucgg

SEQ ID NO: 71543 - RNA, 32 nt, Human
auguggcaaagcuuuuaaccaguccucaaacu

SEQ ID NO: 71544 - RNA, 32 nt, Human
auguggcaaagcuuuuaaccaguccucaaccc

SEQ ID NO: 71545 - RNA, 21 nt, Human
auguggcaaggucuucuggca

SEQ ID NO: 71546 - RNA, 32 nt, Human
auguggcaaugccaccccucagcccaggacua

SEQ ID NO: 71547 - RNA, 32 nt, Human
auguggcacugagcccuacccagcaccucagu

SEQ ID NO: 71548 - RNA, 32 nt, Human
auguggcacuuagguccaaggucuccagaggg

SEQ ID NO: 71549 - RNA, 32 nt, Human
auguggcagagcuuuuaaccaguccgcaaagc

SEQ ID NO: 71550 - RNA, 32 nt, Human
auguggcagaggcaggccagaggaccuaagug

SEQ ID NO: 71551 - RNA, 32 nt, Human
auguggcagcagcugcaccugggaggcaggca

SEQ ID NO: 71552 - RNA, 32 nt, Human
auguggcaggagaaagaaagaaaacgggccga

SEQ ID NO: 71553 - RNA, 32 nt, Human
auguggcaggcaaccucuguguggcagaaaaa

SEQ ID NO: 71554 - RNA, 32 nt, Human
auguggcaguggggauguggcagugaggaaga

SEQ ID NO: 71555 - RNA, 32 nt, Human
auguggcaguuucaaaggauuacuugaugcaa

SEQ ID NO: 71556 - RNA, 32 nt, Human
auguggccccagagaagggcagagggaaaggg

SEQ ID NO: 71557 - RNA, 32 nt, Human
auguggccccugccauccuuguggucacuagg

SEQ ID NO: 71558 - RNA, 32 nt, Human
auguggcccuuccucccccucauugaggacuu

SEQ ID NO: 71559 - RNA, 32 nt, Human
auguggccucagcugcugcggauccccugggc

SEQ ID NO: 71560 - RNA, 32 nt, Human
auguggccuccccucgcugccuguucaucccg

SEQ ID NO: 71561 - RNA, 32 nt, Human
auguggccucuccuguucucaggccccuacac

SEQ ID NO: 71562 - RNA, 32 nt, Human
auguggccuggagaggacaggagcugguaagg

SEQ ID NO: 71563 - RNA, 32 nt, Human
auguggccuguucacagcuacauaauugugac

SEQ ID NO: 71564 - RNA, 32 nt, Human
auguggcgggaggugaggcgggagguucagca

SEQ ID NO: 71565 - RNA, 32 nt, Human
auguggcugccccauuuauccaccuccaucuu

SEQ ID NO: 71566 - RNA, 32 nt, Human
auguggcugggcugagcagccugagcagcggc

SEQ ID NO: 71567 - RNA, 32 nt, Human
auguggcuggucucaaacuccugggcucaagu

SEQ ID NO: 71568 - RNA, 32 nt, Human
auguggcuguagucccagcuacucgggaggcu

SEQ ID NO: 71569 - RNA, 32 nt, Human
auguggcuguagucccagcuacuuuggaggcu

SEQ ID NO: 71570 - RNA, 32 nt, Human
auguggcuucucugucucuguggaaaagccau

SEQ ID NO: 71571 - RNA, 32 nt, Human
auguggcuuugguggaugggguauucuugaac

SEQ ID NO: 71572 - RNA, 32 nt, Human
augugggaaaacagggauuaacgaggggcaag

SEQ ID NO: 71573 - RNA, 32 nt, Human
augugggaaaacuuccagcccucuguuaauug

SEQ ID NO: 71574 - RNA, 32 nt, Human
augugggaaauccuucagcuuaagcucagcuc

SEQ ID NO: 71575 - RNA, 32 nt, Human
augugggaaggcagaggaucucugaggaguuc

SEQ ID NO: 71576 - RNA, 32 nt, Human
augugggaggcggagguugcagugagucagau

SEQ ID NO: 71577 - RNA, 32 nt, Human
augugggaggcugagacacgaggaucacuuga

SEQ ID NO: 71578 - RNA, 32 nt, Human
augugggagggcccuggacauggcccggcccc

SEQ ID NO: 71579 - RNA, 32 nt, Human
augugggagguggauaggucggugaugugugg

SEQ ID NO: 71580 - RNA, 32 nt, Human
augugggaguggggugggagggggcagcaggc

SEQ ID NO: 71581 - RNA, 32 nt, Human
augugggauccagguuuuagcugugcugcccg

SEQ ID NO: 71582 - RNA, 32 nt, Human
augugggauccugcccuggggcucccugccag

SEQ ID NO: 71583 - RNA, 32 nt, Human
augugggcagcuguuuaacauggcugagcccu

SEQ ID NO: 71584 - RNA, 32 nt, Human
augugggcaggggcuugugugguuuggauuuc

SEQ ID NO: 71585 - RNA, 32 nt, Human
augugggccagccugccucacuuuacccaagu

SEQ ID NO: 71586 - RNA, 32 nt, Human
augugggcccuucagcuugggcugcuuggcca

SEQ ID NO: 71587 - RNA, 32 nt, Human
augugggccucacaacucgugaccucagcuau

SEQ ID NO: 71588 - RNA, 32 nt, Human
augugggcucacugcaaccucugccuuccagg

SEQ ID NO: 71589 - RNA, 32 nt, Human
augugggcuguaauuccaccuuugcgggggag

SEQ ID NO: 71590 - RNA, 32 nt, Human
auguggggaaaagcaagagagaucagauuguu

SEQ ID NO: 71591 - RNA, 19 nt, Human
auguggggacacauucuga

SEQ ID NO: 71592 - RNA, 32 nt, Human
auguggggagcaccucugcccggccgcgaccc

SEQ ID NO: 71593 - RNA, 32 nt, Human
auguggggccugggugggcaggcaggaccugg

SEQ ID NO: 71594 - RNA, 32 nt, Human
augugggggaaaugcauccccucagaggacug

SEQ ID NO: 71595 - RNA, 32 nt, Human
augugggggugaaccuuggccuccaggacauc

SEQ ID NO: 71596 - RNA, 32 nt, Human
auguggguaaauauaaaagauauuucucucuu

SEQ ID NO: 71597 - RNA, 32 nt, Human
auguggguaaccuguaguauucugcuauacua

SEQ ID NO: 71598 - RNA, 32 nt, Human
auguggguaagaggagcagagggcaggggugc

SEQ ID NO: 71599 - RNA, 32 nt, Human
auguggguacccuuucugaagcugucagggcu

SEQ ID NO: 71600 - RNA, 32 nt, Human
augugggucauaauucugccuuccucuagggg

SEQ ID NO: 71601 - RNA, 32 nt, Human
augugggugaagagaaccgagcaaagaucaaa

SEQ ID NO: 71602 - RNA, 32 nt, Human
augugggugcaggcaugcacacacacgaugga

SEQ ID NO: 71603 - RNA, 32 nt, Human
augugggugccuguuccuuuguggacuugugu

SEQ ID NO: 71604 - RNA, 32 nt, Human
auguggguggaggaaaccuguaauuuccuucu

SEQ ID NO: 71605 - RNA, 32 nt, Human
augugguaaaugccaugaaaauuggccacuuu

SEQ ID NO: 71606 - RNA, 32 nt, Human
augugguaaguguugucagagcagggcaauau

SEQ ID NO: 71607 - RNA, 32 nt, Human
augugguacaaggacgaggugcugcugaccga

SEQ ID NO: 71608 - RNA, 32 nt, Human
augugguaccucuucuuuccuuggcuuccaug

SEQ ID NO: 71609 - RNA, 32 nt, Human
augugguacuccugaacuuucacuccuggucc

SEQ ID NO: 71610 - RNA, 32 nt, Human
augugguaguaagaggauuuucuuccauaaug

SEQ ID NO: 71611 - RNA, 32 nt, Human
augugguagugaaaaucgaggaagcaccucuc

SEQ ID NO: 71612 - RNA, 32 nt, Human
auguggucacagucucucaggcaugugcaggg

SEQ ID NO: 71613 - RNA, 32 nt, Human
augugguccaagccagcacuccugccaucaca

SEQ ID NO: 71614 - RNA, 32 nt, Human
augugguccaucucugaaaacaagagacugcu

SEQ ID NO: 71615 - RNA, 32 nt, Human
augugguccuggcucugccacuggcuugcuuu

SEQ ID NO: 71616 - RNA, 32 nt, Human
auguggucgccuaucuccuuccucugcucccu

SEQ ID NO: 71617 - RNA, 32 nt, Human
auguggucucagauacuugggaggcugaggug

SEQ ID NO: 71618 - RNA, 32 nt, Human
auguggucuccaccauauucacacaccaccac

SEQ ID NO: 71619 - RNA, 32 nt, Human
augugguggaacccuggacacugucguugaag

SEQ ID NO: 71620 - RNA, 32 nt, Human
augugguggagcugggcugggaccuccgggcu

SEQ ID NO: 71621 - RNA, 32 nt, Human
augugguggcagugccuguaaucccagcuauu

SEQ ID NO: 71622 - RNA, 32 nt, Human
augugguggucccucucuucguuguuucugcc

SEQ ID NO: 71623 - RNA, 32 nt, Human
auguggugucacagauacaucgccgagagagg

SEQ ID NO: 71624 - RNA, 32 nt, Human
augugguuaagccugguaagccugcuaaaaug

SEQ ID NO: 71625 - RNA, 32 nt, Human
augugguucccuuugucacuucuuuggugguc

SEQ ID NO: 71626 - RNA, 32 nt, Human
augugguuggaagaugcaaacuguggaugauc

SEQ ID NO: 71627 - RNA, 32 nt, Human
augugguuuucuuuuaaaaagcuccuguuuuu

SEQ ID NO: 71628 - RNA, 32 nt, Human
auguguaaagaaggaagagcaagaacauggcc

SEQ ID NO: 71629 - RNA, 32 nt, Human
auguguaacuuccucacguugugugcgauaac

SEQ ID NO: 71630 - RNA, 22 nt, Human
auguguaagaaaaggcccauua

SEQ ID NO: 71631 - RNA, 32 nt, Human
auguguaagucccaugaaggcaaagauugguc

SEQ ID NO: 71632 - RNA, 32 nt, Human
auguguaauaugcacaaguuuguuuuuguuuu

SEQ ID NO: 71633 - RNA, 21 nt, Human
auguguacacauauguacaua

SEQ ID NO: 71634 - RNA, 32 nt, Human
auguguacauaaugaaccaucuuuaaaaauaa

SEQ ID NO: 71635 - RNA, 22 nt, Human
auguguaccaguagagaagccu

SEQ ID NO: 71636 - RNA, 32 nt, Human
auguguacuucuuuccacacagacacggcaac

SEQ ID NO: 71637 - RNA, 32 nt, Human
auguguacuugauagagcuaaaauaugaucuu

SEQ ID NO: 71638 - RNA, 32 nt, Human
auguguagaagcuuguauuuguguacaggugu

SEQ ID NO: 71639 - RNA, 32 nt, Human
auguguagacaagcucucgcucugucacccag

SEQ ID NO: 71640 - RNA, 32 nt, Human
auguguagacauuccaagucacugcuugguag

SEQ ID NO: 71641 - RNA, 32 nt, Human
auguguagccuucuggaaucugcacgugacug

SEQ ID NO: 71642 - RNA, 32 nt, Human
auguguaggguuggggagagugcagugauggg

SEQ ID NO: 71643 - RNA, 32 nt, Human
auguguauacauuguucuuuacguuguucuag

SEQ ID NO: 71644 - RNA, 32 nt, Human
auguguauagcuucccaaguucuuuuacaguc

SEQ ID NO: 71645 - RNA, 32 nt, Human
auguguauauaagaaugaguugggaccucugu

SEQ ID NO: 71646 - RNA, 32 nt, Human
auguguaucccaggaccacccugggcggggag

SEQ ID NO: 71647 - RNA, 32 nt, Human
auguguaucuuuucuucagauaccagauuuga

SEQ ID NO: 71648 - RNA, 32 nt, Human
auguguaugaugcaacagagcugaagaauggg

SEQ ID NO: 71649 - RNA, 32 nt, Human
auguguauggcggugaggcgggcggguacaug

SEQ ID NO: 71650 - RNA, 32 nt, Human
auguguaugguaucauguaucucucuguggug

SEQ ID NO: 71651 - RNA, 32 nt, Human
augugucaaauacaaaaaugguaacuagguug

SEQ ID NO: 71652 - RNA, 32 nt, Human
augugucaacugccugucagccuggauucaau

SEQ ID NO: 71653 - RNA, 32 nt, Human
augugucaauuuaaccaaauucacaaauaacc

SEQ ID NO: 71654 - RNA, 32 nt, Human
augugucacuugugcuuugcucuugucccacg

SEQ ID NO: 71655 - RNA, 32 nt, Human
augugucagagaagucugaggcucccuguguu

SEQ ID NO: 71656 - RNA, 32 nt, Human
augugucagccaugccucuguggggagucugc

SEQ ID NO: 71657 - RNA, 32 nt, Human
augugucaugaaugaggaggugugugagcagg

SEQ ID NO: 71658 - RNA, 32 nt, Human
auguguccaaugcugccuucccaugaaucugu

SEQ ID NO: 71659 - RNA, 32 nt, Human
auguguccacaaaccuguccaggaguuguguc

SEQ ID NO: 71660 - RNA, 32 nt, Human
auguguccacaggaaaugaccccacaucccuu

SEQ ID NO: 71661 - RNA, 32 nt, Human
auguguccacucaacccagcugcccaggacgg

SEQ ID NO: 71662 - RNA, 32 nt, Human
auguguccagggacacagaauguugguuucua

SEQ ID NO: 71663 - RNA, 32 nt, Human
augugucccaggacagcuuugaauguggccca

SEQ ID NO: 71664 - RNA, 32 nt, Human
auguguccucaccgggguaucggccgucacuc

SEQ ID NO: 71665 - RNA, 32 nt, Human
auguguccuccccuccccucccuuccucuccu

SEQ ID NO: 71666 - RNA, 32 nt, Human
augugucgugucugcuuacauuuccuucuccc

SEQ ID NO: 71667 - RNA, 32 nt, Human
augugucuauggugcggcaucuugcuguugua

SEQ ID NO: 71668 - RNA, 32 nt, Human
augugucuauggugcugcaucuugcuguugua

SEQ ID NO: 71669 - RNA, 32 nt, Human
augugucucacaguuugaaauaagcuauuuga

SEQ ID NO: 71670 - RNA, 32 nt, Human
augugucucacccuaccguucgucucaccaau

SEQ ID NO: 71671 - RNA, 32 nt, Human
augugucuccucccacccucuuccuaaugguc

SEQ ID NO: 71672 - RNA, 32 nt, Human
augugucugaaccugaagaccucucuccuaaa

SEQ ID NO: 71673 - RNA, 32 nt, Human
augugucugcgccgaagguggaggccgaagug

SEQ ID NO: 71674 - RNA, 32 nt, Human
augugucuggcuuaaaaggccauguucuuucc

SEQ ID NO: 71675 - RNA, 32 nt, Human
augugucuguuaccaagcaaagccaguuaaag

SEQ ID NO: 71676 - RNA, 32 nt, Human
augugucuugcagauugcaagauauuuuacca

SEQ ID NO: 71677 - RNA, 32 nt, Human
augugucuuguuggggaggugacuugcauggu

SEQ ID NO: 71678 - RNA, 32 nt, Human
augugugaagcugggcagucugugguguggag

SEQ ID NO: 71679 - RNA, 32 nt, Human
augugugacugagaagcagccuggguguguaa

SEQ ID NO: 71680 - RNA, 32 nt, Human
augugugacuugaaacaaaaaugaguaucuug

SEQ ID NO: 71681 - RNA, 32 nt, Human
augugugagaagccguuucauuuuauuucuca

SEQ ID NO: 71682 - RNA, 32 nt, Human
augugugaggagcugcuggcuugcagugcgcg

SEQ ID NO: 71683 - RNA, 32 nt, Human
augugugaguuucuuuguaauaaaauguauca

SEQ ID NO: 71684 - RNA, 32 nt, Human
augugugauggccagaauaaaagccaaaaucu

SEQ ID NO: 71685 - RNA, 32 nt, Human
augugugcaccugcuuuuccugccuggaaugu

SEQ ID NO: 71686 - RNA, 32 nt, Human
augugugcagagugagaccucuggccugccau

SEQ ID NO: 71687 - RNA, 32 nt, Human
augugugcagcaccuggcucaaagaccacaca

SEQ ID NO: 71688 - RNA, 32 nt, Human
augugugccaagggaguauuuucacaaaguuc

SEQ ID NO: 71689 - RNA, 32 nt, Human
augugugccugggagaggcucugucuccuucc

SEQ ID NO: 71690 - RNA, 32 nt, Human
augugugccugggaucuccuugccccagccug

SEQ ID NO: 71691 - RNA, 32 nt, Human
augugugccuguagauacaucaucaagcccuu

SEQ ID NO: 71692 - RNA, 32 nt, Human
augugugcgugugcacacacacuuaaacacgu

SEQ ID NO: 71693 - RNA, 32 nt, Human
augugugcucgugccacacauacacauccugg

SEQ ID NO: 71694 - RNA, 32 nt, Human
augugugcuguguguguccugccuguauaugu

SEQ ID NO: 71695 - RNA, 32 nt, Human
auguguggacauccacacacagcgcugguugu

SEQ ID NO: 71696 - RNA, 32 nt, Human
auguguggcuacggcaucuguacagcaccgac

SEQ ID NO: 71697 - RNA, 32 nt, Human
auguguggcugcagacguguccacaugggccu

SEQ ID NO: 71698 - RNA, 32 nt, Human
auguguggcugcaggucgcgaagcugcuuaau

SEQ ID NO: 71699 - RNA, 32 nt, Human
augugugggcaacaaggguccugcugagcuca

SEQ ID NO: 71700 - RNA, 32 nt, Human
augugugggcugaguuuucaacugaaugauua

SEQ ID NO: 71701 - RNA, 32 nt, Human
augugugggggcagagguuaugugggaaaucu

SEQ ID NO: 71702 - RNA, 32 nt, Human
augugugguggaggccgagggccggagagugg

SEQ ID NO: 71703 - RNA, 32 nt, Human
auguguggugugugccguaugcaugggcagau

SEQ ID NO: 71704 - RNA, 32 nt, Human
augugugguguucuucuggagguugucucuuu

SEQ ID NO: 71705 - RNA, 32 nt, Human
auguguguauagaaagucuguauuccaauguu

SEQ ID NO: 71706 - RNA, 32 nt, Human
auguguguauaguacaucuguugguuauguac

SEQ ID NO: 71707 - RNA, 23 nt, Human
auguguguauauauguguauaua

SEQ ID NO: 71708 - RNA, 32 nt, Human
auguguguauaugugucauauguauguacaug

SEQ ID NO: 71709 - RNA, 21 nt, Human
auguguguauguauacaugua

SEQ ID NO: 71710 - RNA, 23 nt, Human
auguguguauuguagaaguuuua

SEQ ID NO: 71711 - RNA, 32 nt, Human
augugugucagggggagacuugcugguggguu

SEQ ID NO: 71712 - RNA, 32 nt, Human
augugugucauuuagaaguggaagcuauuagc

SEQ ID NO: 71713 - RNA, 32 nt, Human
augugugucugugucuucuccuuaaacacucg

SEQ ID NO: 71714 - RNA, 32 nt, Human
augugugugggggugugucuguggccagucau

SEQ ID NO: 71715 - RNA, 32 nt, Human
auguguguggugugugcguguuuugcugcaua

SEQ ID NO: 71716 - RNA, 29 nt, Human
auguguguggugugugugcuugguuuagg

SEQ ID NO: 71717 - RNA, 32 nt, Human
augugugugucuuuuuccuccuuucuuuuggg

SEQ ID NO: 71718 - RNA, 32 nt, Human
augugugugugauggagggaaggggacagauu

SEQ ID NO: 71719 - RNA, 32 nt, Human
augugugugugcacacacacagaaaccacgag

SEQ ID NO: 71720 - RNA, 32 nt, Human
auguguguucuaaaggaggacaugagcugugu

SEQ ID NO: 71721 - RNA, 32 nt, Human
auguguguucuccucucuccccacccccgcca

SEQ ID NO: 71722 - RNA, 32 nt, Human
auguguguugugagccaggacgcaacuugccg

SEQ ID NO: 71723 - RNA, 32 nt, Human
auguguguuucaggcuuauuugggagaacuaa

SEQ ID NO: 71724 - RNA, 32 nt, Human
auguguuaaauuuguaacuccucuuugggguc

SEQ ID NO: 71725 - RNA, 32 nt, Human
auguguuaagcauaggagauuugucagugaaa

SEQ ID NO: 71726 - RNA, 32 nt, Human
auguguuacaagcauggguucuugccgugugu

SEQ ID NO: 71727 - RNA, 32 nt, Human
auguguuagcugcagccuuuugaaacacgcaa

SEQ ID NO: 71728 - RNA, 32 nt, Human
auguguuauaagcuaggagaaucccuuuggac

SEQ ID NO: 71729 - RNA, 28 nt, Human
auguguuauacacaaucuuaaaauuuca

SEQ ID NO: 71730 - RNA, 24 nt, Human
auguguuauaucuguaguauucua

SEQ ID NO: 71731 - RNA, 32 nt, Human
auguguucaggcacagagcaaagggcugagag

SEQ ID NO: 71732 - RNA, 32 nt, Human
auguguucauguggacacacacagacacacac

SEQ ID NO: 71733 - RNA, 32 nt, Human
auguguuccacucagaaaugagaguguauuag

SEQ ID NO: 71734 - RNA, 24 nt, Human
auguguucuauuccggauguucua

SEQ ID NO: 71735 - RNA, 32 nt, Human
auguguucuggugugucuuaaaauuccaaaca

SEQ ID NO: 71736 - RNA, 32 nt, Human
auguguugaagaugaaauuggcaucaguguag

SEQ ID NO: 71737 - RNA, 23 nt, Human
auguguugauuugagaaauuuua

SEQ ID NO: 71738 - RNA, 32 nt, Human
auguguuggaacgggauuuacacacacuggag

SEQ ID NO: 71739 - RNA, 32 nt, Human
auguguugggauuacaggcgugaaccaccgcg

SEQ ID NO: 71740 - RNA, 32 nt, Human
auguguugugggaaggacccugugggagguca

SEQ ID NO: 71741 - RNA, 32 nt, Human
auguguugugggagggaggcagugggaaguag

SEQ ID NO: 71742 - RNA, 32 nt, Human
auguguuuauucauccagcaguguugcucagc

SEQ ID NO: 71743 - RNA, 24 nt, Human
auguguuucaaacauuucuggaca

SEQ ID NO: 71744 - RNA, 22 nt, Human
auguguuucaggaucuucgggc

SEQ ID NO: 71745 - RNA, 32 nt, Human
auguguuuccagaucugcuuauuguuuggguu

SEQ ID NO: 71746 - RNA, 22 nt, Human
auguguuuccuauuaaaagcca

SEQ ID NO: 71747 - RNA, 32 nt, Human
auguguuucugcuccccucccacccaagaugc

SEQ ID NO: 71748 - RNA, 23 nt, Human
auguguuugaucucaggagucca

SEQ ID NO: 71749 - RNA, 32 nt, Human
auguguuugcaaacacuugucuugaagauuau

SEQ ID NO: 71750 - RNA, 32 nt, Human
auguguuugggggacuuugccugcugcacagg

SEQ ID NO: 71751 - RNA, 24 nt, Human
auguguuuguaugcauucuggaca

SEQ ID NO: 71752 - RNA, 32 nt, Human
auguguuuguguuuguagacaaaaggcaaagg

SEQ ID NO: 71753 - RNA, 32 nt, Human
auguguuuuccaaauauagauaugaaauaucu

SEQ ID NO: 71754 - RNA, 32 nt, Human
auguguuuuccuagucccauccaggcuuccca

SEQ ID NO: 71755 - RNA, 32 nt, Human
auguguuuuguuguuuugggaauuuuuaucaa

SEQ ID NO: 71756 - RNA, 32 nt, Human
auguuaaaaguggggucucugaugccuuugcc

SEQ ID NO: 71757 - RNA, 32 nt, Human
auguuaaacauuuuagauaacugugaagauag

SEQ ID NO: 71758 - RNA, 21 nt, Human
auguuaaacuauaacaagcac

SEQ ID NO: 71759 - RNA, 32 nt, Human
auguuaaacuauuaccacacagcccauaaaac

SEQ ID NO: 71760 - RNA, 23 nt, Human
auguuaaacugcauaacaggcac

SEQ ID NO: 71761 - RNA, 32 nt, Human
auguuaaacuucaucagcgucagaccuauugu

SEQ ID NO: 71762 - RNA, 32 nt, Human
auguuaaauuggcuugaaauuuucagagaauu

SEQ ID NO: 71763 - RNA, 32 nt, Human
auguuaacacuguggaaauaaauaugaagaug

SEQ ID NO: 71764 - RNA, 32 nt, Human
auguuaaccccuggcaucuaucuagugagcag

SEQ ID NO: 71765 - RNA, 32 nt, Human
auguuaaccuugugguucgaaaucaacaaagc

SEQ ID NO: 71766 - RNA, 32 nt, Human
auguuaacugcacuuuucauuacgugaaugga

SEQ ID NO: 71767 - RNA, 32 nt, Human
auguuaagagaagggaguguguccugaagaag

SEQ ID NO: 71768 - RNA, 32 nt, Human
auguuaagauaaugcggguaacagacaauaua

SEQ ID NO: 71769 - RNA, 32 nt, Human
auguuaagcccuucugaaaaaguauccugcuu

SEQ ID NO: 71770 - RNA, 32 nt, Human
auguuaaggauguauuuauuccccuacccuga

SEQ ID NO: 71771 - RNA, 32 nt, Human
auguuaaucaugauuacuuuaagcccacaucc

SEQ ID NO: 71772 - RNA, 32 nt, Human
auguuaauccuuuaacacuaagguaacaugac

SEQ ID NO: 71773 - RNA, 32 nt, Human
auguuaaugauggaauaauguuccaucaugca

SEQ ID NO: 71774 - RNA, 32 nt, Human
auguuaauggcagaagagaaaacaauaaauca

SEQ ID NO: 71775 - RNA, 32 nt, Human
auguuaauggggacccuccaaaggaagggguu

SEQ ID NO: 71776 - RNA, 32 nt, Human
auguuaauuauuuugacaaauauuucauauau

SEQ ID NO: 71777 - RNA, 32 nt, Human
auguuaauugucuuuguuucucccucugguaa

SEQ ID NO: 71778 - RNA, 32 nt, Human
auguuaauuucucagcccccaaagaagcaucu

SEQ ID NO: 71779 - RNA, 32 nt, Human
auguuaauuuguagcuuugccccagccacuuu

SEQ ID NO: 71780 - RNA, 32 nt, Human
auguuacaaauacaggaagugcaggacugugc

SEQ ID NO: 71781 - RNA, 26 nt, Human
auguuacaacuacuuugagguggcca

SEQ ID NO: 71782 - RNA, 32 nt, Human
auguuacacaugcuuccacuccacaguaccua

SEQ ID NO: 71783 - RNA, 32 nt, Human
auguuacacuggcugguguugaacuccuaacc

SEQ ID NO: 71784 - RNA, 32 nt, Human
auguuacagccaggaacauauuccucagucag

SEQ ID NO: 71785 - RNA, 32 nt, Human
auguuacagggccuggugguguuccaguucaa

SEQ ID NO: 71786 - RNA, 32 nt, Human
auguuacaguaauccacugagauguaguuuag

SEQ ID NO: 71787 - RNA, 32 nt, Human
auguuacauauaaaacaaacaaaaagacuccg

SEQ ID NO: 71788 - RNA, 32 nt, Human
auguuacauucaaagcucuuguuuucaucaca

SEQ ID NO: 71789 - RNA, 32 nt, Human
auguuaccaaagaugaguuugagguuucaagc

SEQ ID NO: 71790 - RNA, 32 nt, Human
auguuaccaguggaugcaggcuucagugacca

SEQ ID NO: 71791 - RNA, 25 nt, Human
auguuacccaggcuggagugcagug

SEQ ID NO: 71792 - RNA, 32 nt, Human
auguuaccuuuucugauuuacacuucuguuuu

SEQ ID NO: 71793 - RNA, 32 nt, Human
auguuacucugaguuauuaauguggauuuuaa

SEQ ID NO: 71794 - RNA, 27 nt, Human
auguuacucuuuucuuucaucaauccc

SEQ ID NO: 71795 - RNA, 32 nt, Human
auguuacugcugauuuucuuuuccaaggugua

SEQ ID NO: 71796 - RNA, 32 nt, Human
auguuacuguauugcaaaaucuguuaagagca

SEQ ID NO: 71797 - RNA, 32 nt, Human
auguuacuucuagugcuaaacauggcauauuu

SEQ ID NO: 71798 - RNA, 32 nt, Human
auguuacuuucuccagcaacccugcacugggg

SEQ ID NO: 71799 - RNA, 32 nt, Human
auguuagaauuuauguucaccuuuauuacaau

SEQ ID NO: 71800 - RNA, 20 nt, Human
auguuagagaaacagagcac

SEQ ID NO: 71801 - RNA, 32 nt, Human
auguuagagagguagcgagcugcucugcuaua

SEQ ID NO: 71802 - RNA, 32 nt, Human
auguuagcaaaccuguuccauggacacuaaau

SEQ ID NO: 71803 - RNA, 32 nt, Human
auguuagcagauagccagcccauacaagaucg

SEQ ID NO: 71804 - RNA, 32 nt, Human
auguuagccauccugaaguagccgaacaguag

SEQ ID NO: 71805 - RNA, 32 nt, Human
auguuagccucugcuuucccuuccuguccuga

SEQ ID NO: 71806 - RNA, 32 nt, Human
auguuagcuguggucuugaaacuguccagcug

SEQ ID NO: 71807 - RNA, 32 nt, Human
auguuagcuuccggcuccccucccaggcugca

SEQ ID NO: 71808 - RNA, 32 nt, Human
auguuagcuuccuccuauugguacaguagaaa

SEQ ID NO: 71809 - RNA, 24 nt, Human
auguuagguagcuuacauuuucuc

SEQ ID NO: 71810 - RNA, 19 nt, Human
auguuaguauguacauaua

SEQ ID NO: 71811 - RNA, 32 nt, Human
auguuaguauuuucacugcuguguccccagcg

SEQ ID NO: 71812 - RNA, 32 nt, Human
auguuagucaccaagggaaggugguggaaugu

SEQ ID NO: 71813 - RNA, 32 nt, Human
auguuagucaggcuggucuccaccucagguga

SEQ ID NO: 71814 - RNA, 32 nt, Human
auguuagugaugugagaacaaggagcaggggu

SEQ ID NO: 71815 - RNA, 32 nt, Human
auguuaguucaauacugaaagaaaaauauuau

SEQ ID NO: 71816 - RNA, 32 nt, Human
auguuaguucucuucaagacugugcauggcuu

SEQ ID NO: 71817 - RNA, 32 nt, Human
auguuaguugacuguacuguaauguuguauca

SEQ ID NO: 71818 - RNA, 32 nt, Human
auguuauaaccuggucccuugugaacuuuuga

SEQ ID NO: 71819 - RNA, 32 nt, Human
auguuauauaaugcucacagguccuucuagca

SEQ ID NO: 71820 - RNA, 32 nt, Human
auguuaucagucucucuuuccacaguacaaac

SEQ ID NO: 71821 - RNA, 32 nt, Human
auguuaugaaaaucuuauuuaaaagagaaagc

SEQ ID NO: 71822 - RNA, 30 nt, Human
auguuaugaaauggccucccaccuucagcg

SEQ ID NO: 71823 - RNA, 32 nt, Human
auguuaugaauacauuucuacuuuauuuugaa

SEQ ID NO: 71824 - RNA, 30 nt, Human
auguuaugacaugucagccaggaccuggug

SEQ ID NO: 71825 - RNA, 32 nt, Human
auguuaugcauaaagucagugcccaacuguua

SEQ ID NO: 71826 - RNA, 32 nt, Human
auguuaugcuuugguugcuugguuggucuuuu

SEQ ID NO: 71827 - RNA, 32 nt, Human
auguuauguacaguacacucugaaaagaaauc

SEQ ID NO: 71828 - RNA, 32 nt, Human
auguuauguggaagaagugugggaaugauggg

SEQ ID NO: 71829 - RNA, 32 nt, Human
auguuauguuauuagauauuaacucuauuuaa

SEQ ID NO: 71830 - RNA, 32 nt, Human
auguuauguuuccugaauuguaguaugugacu

SEQ ID NO: 71831 - RNA, 32 nt, Human
auguuauuaugcuauagcuucuauuucuguuu

SEQ ID NO: 71832 - RNA, 32 nt, Human
auguuauuccuaucaaaccaccaaugacauuc

SEQ ID NO: 71833 - RNA, 32 nt, Human
auguuauuugugauuaagcauuagcguguaua

SEQ ID NO: 71834 - RNA, 32 nt, Human
auguucaaaacacacaguacagacagcaugga

SEQ ID NO: 71835 - RNA, 32 nt, Human
auguucaaaugauguagauugucuuagaauga

SEQ ID NO: 71836 - RNA, 32 nt, Human
auguucaaguaggcugcuuaaaagaaguugac

SEQ ID NO: 71837 - RNA, 32 nt, Human
auguucaauggagcggcacacagucuagaccc

SEQ ID NO: 71838 - RNA, 32 nt, Human
auguucacaccgcugcacucaagcuuggguga

SEQ ID NO: 71839 - RNA, 32 nt, Human
auguucacucacuguacacucaucucuggaaa

SEQ ID NO: 71840 - RNA, 22 nt, Human
auguucacucuggcaucuuuua

SEQ ID NO: 71841 - RNA, 32 nt, Human
auguucacuuggucaaggaggggucuaggagc

SEQ ID NO: 71842 - RNA, 32 nt, Human
auguucagaauggauuuaucagaaauuauacu

SEQ ID NO: 71843 - RNA, 32 nt, Human
auguucagccuaugaugaaguauuugauuauu

SEQ ID NO: 71844 - RNA, 32 nt, Human
auguucagcugguauuuuccauuuuuaaauua

SEQ ID NO: 71845 - RNA, 32 nt, Human
auguucaggaagcacagggauggaaaccucuu

SEQ ID NO: 71846 - RNA, 32 nt, Human
auguucagggaugcucauuccaugacucugcc

SEQ ID NO: 71847 - RNA, 32 nt, Human
auguucagguagcagugagcauuguucauaug

SEQ ID NO: 71848 - RNA, 32 nt, Human
auguucaguaaagaugagcgugugugaguuaa

SEQ ID NO: 71849 - RNA, 32 nt, Human
auguucagucucucaagauuuggcauuaguca

SEQ ID NO: 71850 - RNA, 32 nt, Human
auguucaucaauaccugcugagaguacugucc

SEQ ID NO: 71851 - RNA, 32 nt, Human
auguucaugacacugcacuccagccuggguga

SEQ ID NO: 71852 - RNA, 32 nt, Human
auguucauuaacaaacuucuuuaucacaugua

SEQ ID NO: 71853 - RNA, 22 nt, Human
auguucauugacuggcuuuuua

SEQ ID NO: 71854 - RNA, 32 nt, Human
auguuccaaaauuguguaaaacuccuagaaau

SEQ ID NO: 71855 - RNA, 24 nt, Human
auguuccaauuaugcaucacuucc

SEQ ID NO: 71856 - RNA, 32 nt, Human
auguuccaggcagaggaaaaggcauaugcaaa

SEQ ID NO: 71857 - RNA, 32 nt, Human
auguuccauaugggagccccaaaggaacugga

SEQ ID NO: 71858 - RNA, 32 nt, Human
auguuccaucauguuccaugcugcugcugacg

SEQ ID NO: 71859 - RNA, 32 nt, Human
auguuccauuggacaaagcaaaucacauggcc

SEQ ID NO: 71860 - RNA, 32 nt, Human
auguucccaaacuuagcaacagcggcaaacua

SEQ ID NO: 71861 - RNA, 32 nt, Human
auguucccaguuccaacaagccaaauaccaga

SEQ ID NO: 71862 - RNA, 32 nt, Human
auguucccccaaaucuccucugccaaccagag

SEQ ID NO: 71863 - RNA, 32 nt, Human
auguuccccuccauguccauguguucucauug

SEQ ID NO: 71864 - RNA, 32 nt, Human
auguucccgcauucaccugcuuuugcaguaau

SEQ ID NO: 71865 - RNA, 32 nt, Human
auguucccuucagaccagcagagugaagacag

SEQ ID NO: 71866 - RNA, 32 nt, Human
auguuccuccccauauuccuggacuucggaga

SEQ ID NO: 71867 - RNA, 32 nt, Human
auguuccuccccucaucugcccggguucagua

SEQ ID NO: 71868 - RNA, 32 nt, Human
auguuccuccuccucucuccccacuugaacca

SEQ ID NO: 71869 - RNA, 32 nt, Human
auguuccugcuguauuuccugcuucccuguug

SEQ ID NO: 71870 - RNA, 16 nt, Human
auguuccuggacaguu

SEQ ID NO: 71871 - RNA, 32 nt, Human
auguuccuggagaagaggagccagccaggucu

SEQ ID NO: 71872 - RNA, 32 nt, Human
auguuccuggagaugaaaaaugagaaggaaaa

SEQ ID NO: 71873 - RNA, 32 nt, Human
auguuccugucucuccccucccccaccuuggc

SEQ ID NO: 71874 - RNA, 32 nt, Human
auguuccuguucaucuccuccuuucucccaaa

SEQ ID NO: 71875 - RNA, 32 nt, Human
auguuccuuuagaggaagguguuuuccagugu

SEQ ID NO: 71876 - RNA, 32 nt, Human
auguuccuuuccagucugguucacgauguuua

SEQ ID NO: 71877 - RNA, 32 nt, Human
auguucgaaggcagcaauacuaugaugcuggu

SEQ ID NO: 71878 - RNA, 29 nt, Human
auguucgugcugugucugccuggacaguu

SEQ ID NO: 71879 - RNA, 32 nt, Human
auguucuacagauggaaaggggugcuugguua

SEQ ID NO: 71880 - RNA, 32 nt, Human
auguucuaccucugcacucacuguccaguaca

SEQ ID NO: 71881 - RNA, 32 nt, Human
auguucuacuccuagacuagugcuuuaccuuu

SEQ ID NO: 71882 - RNA, 32 nt, Human
auguucuagcccuucagggucuucaagggaga

SEQ ID NO: 71883 - RNA, 32 nt, Human
auguucuaucgguuuuuaagggacuugagaau

SEQ ID NO: 71884 - RNA, 32 nt, Human
auguucucacagaacagaaccccacagcugga

SEQ ID NO: 71885 - RNA, 32 nt, Human
auguucuccacuucuaaguaaagacagugggc

SEQ ID NO: 71886 - RNA, 32 nt, Human
auguucucccagcuguuccaagacugggccgu

SEQ ID NO: 71887 - RNA, 32 nt, Human
auguucucuccucuguacuggaaaggcugugg

SEQ ID NO: 71888 - RNA, 32 nt, Human
auguucugaaggcuccagggccacuuuguuug

SEQ ID NO: 71889 - RNA, 32 nt, Human
auguucugaggccuccccagccauguggaacu

SEQ ID NO: 71890 - RNA, 32 nt, Human
auguucugagugaacccacagcagucgcagaa

SEQ ID NO: 71891 - RNA, 32 nt, Human
auguucugcagauccccacaugggaggagauu

SEQ ID NO: 71892 - RNA, 32 nt, Human
auguucugcauugagccuaguuuugccauugu

SEQ ID NO: 71893 - RNA, 32 nt, Human
auguucugcuggaagccagaggcccuucaagc

SEQ ID NO: 71894 - RNA, 32 nt, Human
auguucugcuuggcucaucuugcccagagaag

SEQ ID NO: 71895 - RNA, 32 nt, Human
auguucugcuuuccuccacugugccuucgcuc

SEQ ID NO: 71896 - RNA, 32 nt, Human
auguucuggaugaaaagagcaggaguaacaau

SEQ ID NO: 71897 - RNA, 32 nt, Human
auguucuggccacuggggaugacacagguggu

SEQ ID NO: 71898 - RNA, 32 nt, Human
auguucugggcaacaucauaccucccuuauuc

SEQ ID NO: 71899 - RNA, 32 nt, Human
auguucugggugggggacagagccagauucag

SEQ ID NO: 71900 - RNA, 31 nt, Human
auguucuguaaaauuagucuguugaaaaugu

SEQ ID NO: 71901 - RNA, 32 nt, Human
auguucugucaacaagauguuugguaauuuuu

SEQ ID NO: 71902 - RNA, 32 nt, Human
auguucuguguugcagaccagagucuguuuau

SEQ ID NO: 71903 - RNA, 32 nt, Human
auguucuuauuaaccuccuuuuuauacuaagg

SEQ ID NO: 71904 - RNA, 32 nt, Human
auguucuucaaucuuauuacuaauccaugcaa

SEQ ID NO: 71905 - RNA, 32 nt, Human
auguucuucacucuuucauccagcaagugcuu

SEQ ID NO: 71906 - RNA, 32 nt, Human
auguucuucucccuguguccauguguucucau

SEQ ID NO: 71907 - RNA, 32 nt, Human
auguucuuguaucugcugcugccuguguuuuu

SEQ ID NO: 71908 - RNA, 32 nt, Human
auguucuuuccacuucauguuacugccaccaa

SEQ ID NO: 71909 - RNA, 32 nt, Human
auguucuuucuuucuccauccacuggcugaau

SEQ ID NO: 71910 - RNA, 32 nt, Human
auguucuuugcauuuuauuuuugagguuucug

SEQ ID NO: 71911 - RNA, 32 nt, Human
auguucuuuugccucccauagccucuugcuuu

SEQ ID NO: 71912 - RNA, 32 nt, Human
auguugaaaacuaauccccaaugugauuguau

SEQ ID NO: 71913 - RNA, 32 nt, Human
auguugaaaccuaauccccaaugugaugguau

SEQ ID NO: 71914 - RNA, 32 nt, Human
auguugaagcuacaguuauuuuaugauagcac

SEQ ID NO: 71915 - RNA, 32 nt, Human
auguugaaguaguggccuggaguggccuuucc

SEQ ID NO: 71916 - RNA, 32 nt, Human
auguugacccucucucagaaggucaguccagc

SEQ ID NO: 71917 - RNA, 32 nt, Human
auguugacuggaagccacccacaaacacacac

SEQ ID NO: 71918 - RNA, 32 nt, Human
auguugagaaagacaaagaaagacugaggagc

SEQ ID NO: 71919 - RNA, 32 nt, Human
auguugagccauugcuaucaugcauuccuguc

SEQ ID NO: 71920 - RNA, 32 nt, Human
auguugaguguuguuuccuucaauguuucugc

SEQ ID NO: 71921 - RNA, 32 nt, Human
auguugaugcugcuguucauggcacuacaaag

SEQ ID NO: 71922 - RNA, 32 nt, Human
auguugauguguguuucucucuacccucggcu

SEQ ID NO: 71923 - RNA, 32 nt, Human
auguugauuacaucagcgucuccuugggacac

SEQ ID NO: 71924 - RNA, 32 nt, Human
auguugcaaaggcucuugggcauuuuaaacaa

SEQ ID NO: 71925 - RNA, 32 nt, Human
auguugcaggacaccaaaaggaagaaaacaau

SEQ ID NO: 71926 - RNA, 32 nt, Human
auguugcauaguuaccagggaagauuagucca

SEQ ID NO: 71927 - RNA, 32 nt, Human
auguugccaauaucuugacaccugccaaagcu

SEQ ID NO: 71928 - RNA, 28 nt, Human
auguugcccaagcuggaguacaguagug

SEQ ID NO: 71929 - RNA, 25 nt, Human
auguugcccagacuagagugcagug

SEQ ID NO: 71930 - RNA, 25 nt, Human
auguugcccagacuggagugcagug

SEQ ID NO: 71931 - RNA, 25 nt, Human
auguugcccaggcuagagugcagug

SEQ ID NO: 71932 - RNA, 32 nt, Human
auguugcccaggcuagagugcaguggcacaau

SEQ ID NO: 71933 - RNA, 32 nt, Human
auguugcccaggcuagagugcaguggcuauuc

SEQ ID NO: 71934 - RNA, 25 nt, Human
auguugcccaggcuggaaugcagug

SEQ ID NO: 71935 - RNA, 25 nt, Human
auguugcccaggcuggaguacauug

SEQ ID NO: 71936 - RNA, 23 nt, Human
auguugcccaggcuggagugcaa

SEQ ID NO: 71937 - RNA, 28 nt, Human
auguugcccaggcuggagugcaacggug

SEQ ID NO: 71938 - RNA, 25 nt, Human
auguugcccaggcuggagugcaaug

SEQ ID NO: 71939 - RNA, 23 nt, Human
auguugcccaggcuggagugcag

SEQ ID NO: 71940 - RNA, 24 nt, Human
auguugcccaggcuggagugcagu

SEQ ID NO: 71941 - RNA, 25 nt, Human
auguugcccaggcuggagugcagug

SEQ ID NO: 71942 - RNA, 32 nt, Human
auguugcccaggcuggagugcaguggcgugau

SEQ ID NO: 71943 - RNA, 32 nt, Human
auguugcccaggcuggagugcaguggugcgau

SEQ ID NO: 71944 - RNA, 32 nt, Human
auguugcccaggcuggucuccuggcuucaagc

SEQ ID NO: 71945 - RNA, 32 nt, Human
auguugcccaggcuggucucuuaacuccuagg

SEQ ID NO: 71946 - RNA, 32 nt, Human
auguugcccaggcuggucugaagcugcugggc

SEQ ID NO: 71947 - RNA, 32 nt, Human
auguugcccaggcuggucuuuaauuccugggc

SEQ ID NO: 71948 - RNA, 32 nt, Human
auguugcccaggcuggugucaaacuccugggc

SEQ ID NO: 71949 - RNA, 32 nt, Human
auguugcccaggcuggugucgaacuccugggc

SEQ ID NO: 71950 - RNA, 32 nt, Human
auguugcccgggcuggucuagaacuccugggu

SEQ ID NO: 71951 - RNA, 32 nt, Human
auguugcccgggcuggucucaaacuccugggu

SEQ ID NO: 71952 - RNA, 32 nt, Human
auguugcccgggcuggucucaaacuuguggcu

SEQ ID NO: 71953 - RNA, 32 nt, Human
auguugcccgggcuggucucgaacuccugacc

SEQ ID NO: 71954 - RNA, 32 nt, Human
auguugccuaggcugaccuugagcucuugggc

SEQ ID NO: 71955 - RNA, 32 nt, Human
auguugccuaggcuggucuugagcuccugagc

SEQ ID NO: 71956 - RNA, 32 nt, Human
auguugccucaccagcccugaggcuccgcccc

SEQ ID NO: 71957 - RNA, 32 nt, Human
auguugccuucagaauuugugugaagguacaa

SEQ ID NO: 71958 - RNA, 32 nt, Human
auguugccuucauccuagcugcuggggaagcg

SEQ ID NO: 71959 - RNA, 32 nt, Human
auguugcgcugccggagguugagggaagcuuu

SEQ ID NO: 71960 - RNA, 32 nt, Human
auguugcuaugauuggaacaagguucccccuc

SEQ ID NO: 71961 - RNA, 32 nt, Human
auguugcugcagagacugaaugacaugcaaca

SEQ ID NO: 71962 - RNA, 32 nt, Human
auguugcugccucucugugcuuuuggccucug

SEQ ID NO: 71963 - RNA, 32 nt, Human
auguugcuguaaccaguggcccaggggauguu

SEQ ID NO: 71964 - RNA, 32 nt, Human
auguugcuuccagacauacuucucugcaacuu

SEQ ID NO: 71965 - RNA, 32 nt, Human
auguugcuugcacuccagccugggugacagag

SEQ ID NO: 71966 - RNA, 32 nt, Human
auguuggacacacugcucuaccaguccuucgu

SEQ ID NO: 71967 - RNA, 32 nt, Human
auguuggagacucuaaggauaaggcuggugcu

SEQ ID NO: 71968 - RNA, 24 nt, Human
auguuggauucuguacuuaaaagg

SEQ ID NO: 71969 - RNA, 32 nt, Human
auguuggcacuguguucacacgcauggucccc

SEQ ID NO: 71970 - RNA, 32 nt, Human
auguuggccaacauucaauuugaacagagcau

SEQ ID NO: 71971 - RNA, 32 nt, Human
auguuggccaggaguucaaaaccagccugacc

SEQ ID NO: 71972 - RNA, 32 nt, Human
auguuggccaggcugguguugaacuccugacc

SEQ ID NO: 71973 - RNA, 32 nt, Human
auguuggccaggcugguguugaacucuugacc

SEQ ID NO: 71974 - RNA, 32 nt, Human
auguuggcuaggcuggucucaaacucuugacc

SEQ ID NO: 71975 - RNA, 32 nt, Human
auguuggcucacaccuguauucccaguacuuu

SEQ ID NO: 71976 - RNA, 32 nt, Human
auguuggcucacugcaaccuccaacucccugg

SEQ ID NO: 71977 - RNA, 32 nt, Human
auguuggcucagaaucaaccucuuuaaauauu

SEQ ID NO: 71978 - RNA, 22 nt, Human
auguuggcucccgccuguaauc

SEQ ID NO: 71979 - RNA, 32 nt, Human
auguugggagaaaggcggcuucuggaaccuuc

SEQ ID NO: 71980 - RNA, 32 nt, Human
auguugggagagagcuggggcagagcggggag

SEQ ID NO: 71981 - RNA, 32 nt, Human
auguugggagcacagcucuauucugccugcuc

SEQ ID NO: 71982 - RNA, 32 nt, Human
auguugggauggaaaaugcuaaucaacuaccc

SEQ ID NO: 71983 - RNA, 32 nt, Human
auguugggcaaaaauaaguaacccaaugguag

SEQ ID NO: 71984 - RNA, 32 nt, Human
auguugggcuuccucucucaggagcagggcuu

SEQ ID NO: 71985 - RNA, 32 nt, Human
auguuggggaggaagagaggagauggauuuca

SEQ ID NO: 71986 - RNA, 32 nt, Human
auguugggugaaacugggaacaacuacucaga

SEQ ID NO: 71987 - RNA, 32 nt, Human
auguuggguuagaaucagcucuuucaaacuug

SEQ ID NO: 71988 - RNA, 32 nt, Human
auguuggucaggcugguguugaacuccugacc

SEQ ID NO: 71989 - RNA, 32 nt, Human
auguuggucucaaacuccugaccucagguaau

SEQ ID NO: 71990 - RNA, 32 nt, Human
auguuggucucgaacuccugaccucaugaucu

SEQ ID NO: 71991 - RNA, 32 nt, Human
auguuggugcugccuccgccccgugggccuag

SEQ ID NO: 71992 - RNA, 32 nt, Human
auguugguuauuuuacuguucuugccuaucua

SEQ ID NO: 71993 - RNA, 32 nt, Human
auguugguuugauacuguuaacacaccaaaaa

SEQ ID NO: 71994 - RNA, 32 nt, Human
auguuguaaauggcauugacagcugcucuuua

SEQ ID NO: 71995 - RNA, 32 nt, Human
auguuguacugaugucauuugaccacguccau

SEQ ID NO: 71996 - RNA, 32 nt, Human
auguuguaguaaaauuuaauuuuuccuuuugu

SEQ ID NO: 71997 - RNA, 32 nt, Human
auguugucauucuuacuaaucuaguccagccg

SEQ ID NO: 71998 - RNA, 32 nt, Human
auguugucuggggcugccgucaucucauggcu

SEQ ID NO: 71999 - RNA, 32 nt, Human
auguugugacuauucagaaaaggugaauaaaa

SEQ ID NO: 72000 - RNA, 32 nt, Human
auguugugagaggaacaugagccagacaaaga

SEQ ID NO: 72001 - RNA, 32 nt, Human
auguuguggcuguguguuuccuuaaugcucuc

SEQ ID NO: 72002 - RNA, 18 nt, Human
auguuguggggacugcau

SEQ ID NO: 72003 - RNA, 32 nt, Human
auguuguggugagccgagaucaagccauugca

SEQ ID NO: 72004 - RNA, 32 nt, Human
auguuguguggauguggagaugacuccauccc

SEQ ID NO: 72005 - RNA, 32 nt, Human
auguugugugugugcauguacauguauggaca

SEQ ID NO: 72006 - RNA, 32 nt, Human
auguuguguuacuguacacagaagugugugca

SEQ ID NO: 72007 - RNA, 32 nt, Human
auguuguguugcacuccaggcaccuggccaag

SEQ ID NO: 72008 - RNA, 32 nt, Human
auguuguuacccuuggaagauaaagcuggguc

SEQ ID NO: 72009 - RNA, 32 nt, Human
auguuguuuuguucugugauggcuuuuucacc

SEQ ID NO: 72010 - RNA, 32 nt, Human
auguuuaaaauguaaauuguuuuaauuauuca

SEQ ID NO: 72011 - RNA, 32 nt, Human
auguuuaacaagauggagaggccaggcacgau

SEQ ID NO: 72012 - RNA, 32 nt, Human
auguuuaaccuacaauaauucagcuauaccca

SEQ ID NO: 72013 - RNA, 32 nt, Human
auguuuaacugcagacuugccuuaaaacaaga

SEQ ID NO: 72014 - RNA, 32 nt, Human
auguuuaagagggagagaggggaggcaaagcu

SEQ ID NO: 72015 - RNA, 32 nt, Human
auguuuaagcaaagcaucugcccacacucccc

SEQ ID NO: 72016 - RNA, 32 nt, Human
auguuuaaguggucaagcaaggcucuaggagg

SEQ ID NO: 72017 - RNA, 32 nt, Human
auguuuaaguguuuagaaaucauagaaggugu

SEQ ID NO: 72018 - RNA, 32 nt, Human
auguuuaaguugaguuaguucccaucuuuuca

SEQ ID NO: 72019 - RNA, 32 nt, Human
auguuuaauggaggggaggcugagggaaaggc

SEQ ID NO: 72020 - RNA, 32 nt, Human
auguuuacaauguuguguauaaaugggacaac

SEQ ID NO: 72021 - RNA, 32 nt, Human
auguuuacagaaguggagaaaggacuaaagga

SEQ ID NO: 72022 - RNA, 32 nt, Human
auguuuacaguauuuucaguuuuauuauaaaa

SEQ ID NO: 72023 - RNA, 32 nt, Human
auguuuaccagcacacggcucuucuucccacg

SEQ ID NO: 72024 - RNA, 32 nt, Human
auguuuacccuugcggaaguugcaucacuuaa

SEQ ID NO: 72025 - RNA, 22 nt, Human
auguuuaccucaguuuauguca

SEQ ID NO: 72026 - RNA, 32 nt, Human
auguuuacuucuagaaugggccuguuguaaac

SEQ ID NO: 72027 - RNA, 24 nt, Human
auguuuacuuuucagggcaucuua

SEQ ID NO: 72028 - RNA, 32 nt, Human
auguuuagacaucaagacaagaggguagaaag

SEQ ID NO: 72029 - RNA, 32 nt, Human
auguuuagccacugccccaggcucccgugacc

SEQ ID NO: 72030 - RNA, 32 nt, Human
auguuuagguuuuaagcaaauaaaguuccagu

SEQ ID NO: 72031 - RNA, 32 nt, Human
auguuuaguaaagaucauaauuagcuguguua

SEQ ID NO: 72032 - RNA, 24 nt, Human
auguuuaguuuuguuuacccaagg

SEQ ID NO: 72033 - RNA, 32 nt, Human
auguuuauaccuuuuguuuuccuugccgcgac

SEQ ID NO: 72034 - RNA, 32 nt, Human
auguuuaucauguuguaaaguagcaucaguug

SEQ ID NO: 72035 - RNA, 32 nt, Human
auguuuaucuugggacugucuugcugggccgg

SEQ ID NO: 72036 - RNA, 32 nt, Human
auguuuauguucagaguuaacagaacaccuuu

SEQ ID NO: 72037 - RNA, 32 nt, Human
auguuuauuggaccccuccaucuugaugauau

SEQ ID NO: 72038 - RNA, 22 nt, Human
auguuuauuuccugaaauuuca

SEQ ID NO: 72039 - RNA, 21 nt, Human
auguuucaaacauucuaaaua

SEQ ID NO: 72040 - RNA, 32 nt, Human
auguuucagagacuuuaauaugcuacucugcu

SEQ ID NO: 72041 - RNA, 32 nt, Human
auguuucagaguagcuggagugaugcagggag

SEQ ID NO: 72042 - RNA, 26 nt, Human
auguuucagcucauuccauccucaca

SEQ ID NO: 72043 - RNA, 32 nt, Human
auguuucaggcaggagugggguaaauaagugu

SEQ ID NO: 72044 - RNA, 22 nt, Human
auguuucagugccacucacaua

SEQ ID NO: 72045 - RNA, 32 nt, Human
auguuucauggagcuuauuuugagaacuuucc

SEQ ID NO: 72046 - RNA, 32 nt, Human
auguuuccagaagguaagggacaguaauucug

SEQ ID NO: 72047 - RNA, 32 nt, Human
auguuuccagaguccccagucacuugcaaagg

SEQ ID NO: 72048 - RNA, 32 nt, Human
auguuucccuuuccuuucuuucaccuugucau

SEQ ID NO: 72049 - RNA, 32 nt, Human
auguuucccuuucgucuauucuaucuuuuccu

SEQ ID NO: 72050 - RNA, 32 nt, Human
auguuuccuaguuuauaauucauuugggcagu

SEQ ID NO: 72051 - RNA, 32 nt, Human
auguuuccuaugcuuugaucccuucucacuua

SEQ ID NO: 72052 - RNA, 32 nt, Human
auguuuccuggaagcugacucagucuguucac

SEQ ID NO: 72053 - RNA, 32 nt, Human
auguuucggacuuggucuuccuuuuaauuuac

SEQ ID NO: 72054 - RNA, 32 nt, Human
auguuucuacccuaaagauuuccccaguacag

SEQ ID NO: 72055 - RNA, 32 nt, Human
auguuucucagccucccccuuuacagaggaag

SEQ ID NO: 72056 - RNA, 32 nt, Human
auguuucucauccuucuugcucugccuuugag

SEQ ID NO: 72057 - RNA, 32 nt, Human
auguuucuccaaugcaaucaagcccuagacuc

SEQ ID NO: 72058 - RNA, 32 nt, Human
auguuucuccaauguuacgcucgcuugccuag

SEQ ID NO: 72059 - RNA, 32 nt, Human
auguuucuccaguucugccugcccuggcagaa

SEQ ID NO: 72060 - RNA, 32 nt, Human
auguuucugauuuaccuaagggaauucaaaua

SEQ ID NO: 72061 - RNA, 32 nt, Human
auguuucugcgcuccuagccugggugacagag

SEQ ID NO: 72062 - RNA, 32 nt, Human
auguuucugcuugcugugccuuguuauggcug

SEQ ID NO: 72063 - RNA, 32 nt, Human
auguuucugguugucugugcugccucaaagag

SEQ ID NO: 72064 - RNA, 32 nt, Human
auguuucuuagagagaagaucacugaagaaac

SEQ ID NO: 72065 - RNA, 32 nt, Human
auguuucuucagcuugagaaauuuuagaauga

SEQ ID NO: 72066 - RNA, 32 nt, Human
auguuucuugaauugauuuuguucugugguac

SEQ ID NO: 72067 - RNA, 32 nt, Human
auguuugaaagauguucccuuccuucacugua

SEQ ID NO: 72068 - RNA, 32 nt, Human
auguuugaaagccacagucaguccuuuaagca

SEQ ID NO: 72069 - RNA, 32 nt, Human
auguuugaaagccacugagauagaaggaccag

SEQ ID NO: 72070 - RNA, 32 nt, Human
auguuugaccaacaugcugaaaccccaucucu

SEQ ID NO: 72071 - RNA, 32 nt, Human
auguuugauaaauguuguccagguuccauugc

SEQ ID NO: 72072 - RNA, 32 nt, Human
auguuugauguccccaaaguaccacacugagu

SEQ ID NO: 72073 - RNA, 32 nt, Human
auguuugauucuguauucuuuauuccagugug

SEQ ID NO: 72074 - RNA, 32 nt, Human
auguuugcaaaaauauggcacauguauacauu

SEQ ID NO: 72075 - RNA, 32 nt, Human
auguuugcagcauugcacuccagccuggguga

SEQ ID NO: 72076 - RNA, 32 nt, Human
auguuugcagucagugcaagacaagucuaugg

SEQ ID NO: 72077 - RNA, 32 nt, Human
auguuugcaguucauguagcaggcaugacaga

SEQ ID NO: 72078 - RNA, 32 nt, Human
auguuugccacagccucugccuggaaccuggc

SEQ ID NO: 72079 - RNA, 32 nt, Human
auguuugccaucacccgcacccuuacuggcuc

SEQ ID NO: 72080 - RNA, 32 nt, Human
auguuugcccugcucugccugggacugagcga

SEQ ID NO: 72081 - RNA, 32 nt, Human
auguuugcuuuuguuaaaagcuuuauugagau

SEQ ID NO: 72082 - RNA, 32 nt, Human
auguuuggaauggagaaaguguguagauguau

SEQ ID NO: 72083 - RNA, 32 nt, Human
auguuugggacugaaguaaacauaucaaguua

SEQ ID NO: 72084 - RNA, 32 nt, Human
auguuugguaauaaucagcucuucuggcccac

SEQ ID NO: 72085 - RNA, 32 nt, Human
auguuuguaaaacuacacaucccuaaugugug

SEQ ID NO: 72086 - RNA, 23 nt, Human
auguuuguaaagugauuugccau

SEQ ID NO: 72087 - RNA, 23 nt, Human
auguuuguagaauucauuuuuua

SEQ ID NO: 72088 - RNA, 32 nt, Human
auguuuguaguuacuauaaaucaagcuuugga

SEQ ID NO: 72089 - RNA, 32 nt, Human
auguuugucauccuuuagaauaaugggaauua

SEQ ID NO: 72090 - RNA, 32 nt, Human
auguuugucuacugcacaagccucggccugcc

SEQ ID NO: 72091 - RNA, 22 nt, Human
auguuugucuggauuggcuaua

SEQ ID NO: 72092 - RNA, 32 nt, Human
auguuuguggcuuucucuccagccucucuuag

SEQ ID NO: 72093 - RNA, 32 nt, Human
auguuugugugugaacccuuguuuccuccaaa

SEQ ID NO: 72094 - RNA, 32 nt, Human
auguuuguugaaugaguaaaugaaucacaaac

SEQ ID NO: 72095 - RNA, 32 nt, Human
auguuuguuguuuaagccuuucaggcuacggc

SEQ ID NO: 72096 - RNA, 32 nt, Human
auguuuuaaauacaugcauugucuucacgaag

SEQ ID NO: 72097 - RNA, 32 nt, Human
auguuuuaagaaguugagaucuugugaauaua

SEQ ID NO: 72098 - RNA, 32 nt, Human
auguuuuaauaugccucauugugccuuuacug

SEQ ID NO: 72099 - RNA, 32 nt, Human
auguuuuagcacagcguuaugugucugccaca

SEQ ID NO: 72100 - RNA, 32 nt, Human
auguuuuaguaaggagagauuagaagacaaca

SEQ ID NO: 72101 - RNA, 32 nt, Human
auguuuuaucaucuggaacgguugugaagcuu

SEQ ID NO: 72102 - RNA, 32 nt, Human
auguuuuauucagguguagaugaauuucauuu

SEQ ID NO: 72103 - RNA, 32 nt, Human
auguuuucaaaaacuuagugugcaauagaguc

SEQ ID NO: 72104 - RNA, 25 nt, Human
auguuuucaaaagugccuugccaug

SEQ ID NO: 72105 - RNA, 32 nt, Human
auguuuucauuuccuugacuuauuuuuguuag

SEQ ID NO: 72106 - RNA, 32 nt, Human
auguuuucuacccugccaccucuuuucagcaa

SEQ ID NO: 72107 - RNA, 32 nt, Human
auguuuucucaaauauaugcugugccuguacu

SEQ ID NO: 72108 - RNA, 32 nt, Human
auguuuucucccuggagcugagcugagcuuuc

SEQ ID NO: 72109 - RNA, 32 nt, Human
auguuuucuccucuguuugcuucuaaugucuc

SEQ ID NO: 72110 - RNA, 32 nt, Human
auguuuucucucucacacacaaagauucaaaa

SEQ ID NO: 72111 - RNA, 32 nt, Human
auguuuucuuucuccucuuugcuuccauucau

SEQ ID NO: 72112 - RNA, 32 nt, Human
auguuuugacguuugcagucacacacaacacc

SEQ ID NO: 72113 - RNA, 32 nt, Human
auguuuugccugccaauugaaugauuucguag

SEQ ID NO: 72114 - RNA, 32 nt, Human
auguuuugcuucucucucagacugccuuccug

SEQ ID NO: 72115 - RNA, 32 nt, Human
auguuuugcuuuggugaaacauugugaaugac

SEQ ID NO: 72116 - RNA, 32 nt, Human
auguuuuggggguuugaaaaaucaaagauaau

SEQ ID NO: 72117 - RNA, 32 nt, Human
auguuuugguuucagagcacuugcccaauccu

SEQ ID NO: 72118 - RNA, 32 nt, Human
auguuuuguccuuuuaaaacauuuucuuuuga

SEQ ID NO: 72119 - RNA, 32 nt, Human
auguuuugugucagagaaaacauguacaaaac

SEQ ID NO: 72120 - RNA, 32 nt, Human
auguuuuguuucucccuccaggccaguauaaa

SEQ ID NO: 72121 - RNA, 32 nt, Human
auguuuuuaauggcucauuuaggguagauuua

SEQ ID NO: 72122 - RNA, 32 nt, Human
auguuuuuauuuaugaauaaagaaugccauuu

SEQ ID NO: 72123 - RNA, 32 nt, Human
auguuuuucauuucccguguguuuccauuucc

SEQ ID NO: 72124 - RNA, 32 nt, Human
auguuuuucauuuccucugaguucaguagcca

SEQ ID NO: 72125 - RNA, 32 nt, Human
auguuuuucuccaggauuuuggugaggguugg

SEQ ID NO: 72126 - RNA, 32 nt, Human
auguuuuucuguauuuuuaguagagacggggu

SEQ ID NO: 72127 - RNA, 32 nt, Human
auguuuuucuugaacuuuagagggcagcagag

SEQ ID NO: 72128 - RNA, 32 nt, Human
auguuuuugcuuuucaacacacaaagcacaaa

SEQ ID NO: 72129 - RNA, 32 nt, Human
auguuuuugucuuuguggcaugcagcuaacuc

SEQ ID NO: 72130 - RNA, 32 nt, Human
auuaaaaacaacacaucuccacuaccagugcu

SEQ ID NO: 72131 - RNA, 32 nt, Human
auuaaaaacucauguggaggaacucaaggaau

SEQ ID NO: 72132 - RNA, 32 nt, Human
auuaaaaagagcauaggguaaaaaccugauau

SEQ ID NO: 72133 - RNA, 32 nt, Human
auuaaaaagcaugauuuugcugugcauguacc

SEQ ID NO: 72134 - RNA, 32 nt, Human
auuaaaaaggaaaguuugccaggaggaacaaa

SEQ ID NO: 72135 - RNA, 32 nt, Human
auuaaaaaguaaaauaauaggccaggcauggu

SEQ ID NO: 72136 - RNA, 32 nt, Human
auuaaaaaugcacacggucuuugacccagcaa

SEQ ID NO: 72137 - RNA, 32 nt, Human
auuaaaacaagguaggaaugaggcuagaccuu

SEQ ID NO: 72138 - RNA, 32 nt, Human
auuaaaacauaguuaucuaguaguaggagagg

SEQ ID NO: 72139 - RNA, 32 nt, Human
auuaaaacauuagcuaggcaugguggugcaca

SEQ ID NO: 72140 - RNA, 32 nt, Human
auuaaaacauuagcugggugugguggcgcaua

SEQ ID NO: 72141 - RNA, 32 nt, Human
auuaaaaccaacaaggaguuucaugugcaaag

SEQ ID NO: 72142 - RNA, 32 nt, Human
auuaaaaccacaaugacacauaugaugcccau

SEQ ID NO: 72143 - RNA, 32 nt, Human
auuaaaaccuauagcaaucauuucaaaucuau

SEQ ID NO: 72144 - RNA, 32 nt, Human
auuaaaaccuuaagaguucuaaccaugccuac

SEQ ID NO: 72145 - RNA, 32 nt, Human
auuaaaacgccuacagcugccuccuagaauau

SEQ ID NO: 72146 - RNA, 32 nt, Human
auuaaaagaaucacaucuucagaagagaagac

SEQ ID NO: 72147 - RNA, 32 nt, Human
auuaaaagauuauccaggugugguagugugug

SEQ ID NO: 72148 - RNA, 32 nt, Human
auuaaaagcagucucggaaacacagagccagg

SEQ ID NO: 72149 - RNA, 32 nt, Human
auuaaaaggaagcagaagcauugaccauuuuu

SEQ ID NO: 72150 - RNA, 32 nt, Human
auuaaaaggaagcuuacaugccuaccaauauu

SEQ ID NO: 72151 - RNA, 27 nt, Human
auuaaaaggacuauuucucuaaaacuc

SEQ ID NO: 72152 - RNA, 28 nt, Human
auuaaaaggacuauuucucuaaaacuca

SEQ ID NO: 72153 - RNA, 32 nt, Human
auuaaaaggacuauuucucuaaaacucaaaaa

SEQ ID NO: 72154 - RNA, 32 nt, Human
auuaaaaggaugagagaagcaagagcaaacac

SEQ ID NO: 72155 - RNA, 32 nt, Human
auuaaaaggguuuaagaagaauucuuucucag

SEQ ID NO: 72156 - RNA, 32 nt, Human
auuaaaauagucaagacaacacugaccuugca

SEQ ID NO: 72157 - RNA, 32 nt, Human
auuaaaauagucucuuuaaaaggaaagaaaac

SEQ ID NO: 72158 - RNA, 32 nt, Human
auuaaaaugaaaaaugcauuagccaggugugg

SEQ ID NO: 72159 - RNA, 32 nt, Human
auuaaaaugcuggggcaagaugcaguacaagu

SEQ ID NO: 72160 - RNA, 32 nt, Human
auuaaaaugugguugagugugccuaaauuaac

SEQ ID NO: 72161 - RNA, 32 nt, Human
auuaaaauguucuggaauuauaagcaaucuuu

SEQ ID NO: 72162 - RNA, 32 nt, Human
auuaaaauuuggugcuuauaagagaaaguuaa

SEQ ID NO: 72163 - RNA, 32 nt, Human
auuaaaauuuugggucagacuuugccauaaug

SEQ ID NO: 72164 - RNA, 32 nt, Human
auuaaacaacugcccauugccaccucccccuc

SEQ ID NO: 72165 - RNA, 32 nt, Human
auuaaacaaugccauuucuugaccacuucugu

SEQ ID NO: 72166 - RNA, 32 nt, Human
auuaaacacacuuccauuucucuuggaagcau

SEQ ID NO: 72167 - RNA, 32 nt, Human
auuaaacauaagucaagauaaauguucuuacc

SEQ ID NO: 72168 - RNA, 32 nt, Human
auuaaacauggugcaauggcaccucuguccaa

SEQ ID NO: 72169 - RNA, 32 nt, Human
auuaaacauucugcauuggguauaaucuaaga

SEQ ID NO: 72170 - RNA, 32 nt, Human
auuaaaccaaggcacuccagccugggugacag

SEQ ID NO: 72171 - RNA, 32 nt, Human
auuaaaccaguauuuugagcuggcaaaauucu

SEQ ID NO: 72172 - RNA, 32 nt, Human
auuaaacccacaagcugccucugacagcagcc

SEQ ID NO: 72173 - RNA, 32 nt, Human
auuaaaccucacugcaaauuuccucccaucac

SEQ ID NO: 72174 - RNA, 32 nt, Human
auuaaacgcccaaacuaaacuccucauuccua

SEQ ID NO: 72175 - RNA, 32 nt, Human
auuaaacggugcuuguuuucuauaauguuuug

SEQ ID NO: 72176 - RNA, 32 nt, Human
auuaaacuaucaucuccaccuuccuuuugauu

SEQ ID NO: 72177 - RNA, 32 nt, Human
auuaaacugagugcugggagugaguugguaau

SEQ ID NO: 72178 - RNA, 32 nt, Human
auuaaacugugacccuagucaccagaauucag

SEQ ID NO: 72179 - RNA, 32 nt, Human
auuaaagaaaugcuacauguuccgguugcaga

SEQ ID NO: 72180 - RNA, 32 nt, Human
auuaaagaacauucuaaauuaccugguaauuu

SEQ ID NO: 72181 - RNA, 32 nt, Human
auuaaagagacauuugaacccuauguuuacug

SEQ ID NO: 72182 - RNA, 32 nt, Human
auuaaagagccuuccuggaaaauggagguugc

SEQ ID NO: 72183 - RNA, 32 nt, Human
auuaaagagugcauuuacacaaggcuggcagg

SEQ ID NO: 72184 - RNA, 32 nt, Human
auuaaagcaaacauuucgacuaaaggggcgaa

SEQ ID NO: 72185 - RNA, 32 nt, Human
auuaaagccaugcaaaagaaggucuaggucca

SEQ ID NO: 72186 - RNA, 32 nt, Human
auuaaagccugagacucaggccagaauuagga

SEQ ID NO: 72187 - RNA, 32 nt, Human
auuaaagccuuuauuccaucucucaagauaua

SEQ ID NO: 72188 - RNA, 32 nt, Human
auuaaagcuaugguuauauuagcaccaaacuu

SEQ ID NO: 72189 - RNA, 32 nt, Human
auuaaagcuggguacuaagaaaugucauuugc

SEQ ID NO: 72190 - RNA, 32 nt, Human
auuaaagcugugagccacugugccaaggcuuu

SEQ ID NO: 72191 - RNA, 32 nt, Human
auuaaaggcguaagccacugcgccuggcuguu

SEQ ID NO: 72192 - RNA, 32 nt, Human
auuaaaggcgugagccaccaugcccagccucc

SEQ ID NO: 72193 - RNA, 32 nt, Human
auuaaaggcgugagccaccgugcccagccuaa

SEQ ID NO: 72194 - RNA, 20 nt, Human
auuaaaggcuuucaguacgg

SEQ ID NO: 72195 - RNA, 32 nt, Human
auuaaaggggcugucucccaaugaaagaggca

SEQ ID NO: 72196 - RNA, 32 nt, Human
auuaaaggugugagccaccaugccuggcccua

SEQ ID NO: 72197 - RNA, 32 nt, Human
auuaaagguuuggccugcuuuaucucucgcuu

SEQ ID NO: 72198 - RNA, 32 nt, Human
auuaaaguaacaauagccugguggcagaugaa

SEQ ID NO: 72199 - RNA, 32 nt, Human
auuaaagucucccacuauuauuauaugggagu

SEQ ID NO: 72200 - RNA, 32 nt, Human
auuaaaguuagaaacgacuacagagugaaaug

SEQ ID NO: 72201 - RNA, 32 nt, Human
auuaaaguuaggaucuagucauggacacuacu

SEQ ID NO: 72202 - RNA, 32 nt, Human
auuaaaguugaaugaauuuuugaagaaucagc

SEQ ID NO: 72203 - RNA, 32 nt, Human
auuaaauaaccuguuuuacugccuguacauuc

SEQ ID NO: 72204 - RNA, 21 nt, Human
auuaaauaauuugcugugaaa

SEQ ID NO: 72205 - RNA, 32 nt, Human
auuaaauacuuugccagcacugccuuugccag

SEQ ID NO: 72206 - RNA, 32 nt, Human
auuaaauagcucagagaguacaucugccauau

SEQ ID NO: 72207 - RNA, 32 nt, Human
auuaaauauacgacacauccaggaguuuauug

SEQ ID NO: 72208 - RNA, 32 nt, Human
auuaaauauuucacagcuaaaaagcuaaagag

SEQ ID NO: 72209 - RNA, 21 nt, Human
auuaaaucagaaugcugaaua

SEQ ID NO: 72210 - RNA, 21 nt, Human
auuaaaucagcgcguuuaaca

SEQ ID NO: 72211 - RNA, 32 nt, Human
auuaaauccagccuaaacauuuugccaggaac

SEQ ID NO: 72212 - RNA, 32 nt, Human
auuaaaugaaacacaguaaagaaaguugggcu

SEQ ID NO: 72213 - RNA, 32 nt, Human
auuaaaugaauccaaaguauccuagcucuuug

SEQ ID NO: 72214 - RNA, 23 nt, Human
auuaaaugagauggcaugugaaa

SEQ ID NO: 72215 - RNA, 32 nt, Human
auuaaaugaggugaaaacaaguaggagugaau

SEQ ID NO: 72216 - RNA, 21 nt, Human
auuaaaugaguaccugugaaa

SEQ ID NO: 72217 - RNA, 24 nt, Human
auuaaaugagugcuaucugugaaa

SEQ ID NO: 72218 - RNA, 32 nt, Human
auuaaaugauuccuggccaagaaacaaaagca

SEQ ID NO: 72219 - RNA, 24 nt, Human
auuaaaugauuugcccaaagucuc

SEQ ID NO: 72220 - RNA, 23 nt, Human
auuaaauggauaucagccugaaa

SEQ ID NO: 72221 - RNA, 32 nt, Human
auuaaauguagcgacugucaacagcgugcagg

SEQ ID NO: 72222 - RNA, 32 nt, Human
auuaaauguaugguugcaucugucuuuuuaua

SEQ ID NO: 72223 - RNA, 32 nt, Human
auuaaaugugucauacauauccacuugagggc

SEQ ID NO: 72224 - RNA, 32 nt, Human
auuaaauuaacuauuaaccacauucaccuugu

SEQ ID NO: 72225 - RNA, 32 nt, Human
auuaaauuauauaauacauuacauucugguua

SEQ ID NO: 72226 - RNA, 32 nt, Human
auuaaauucagccuaaacauuuugccaggaac

SEQ ID NO: 72227 - RNA, 32 nt, Human
auuaaauucccagagcccccuaggaaagauga

SEQ ID NO: 72228 - RNA, 32 nt, Human
auuaaauucucaaaauaauccuuugaaaaggg

SEQ ID NO: 72229 - RNA, 32 nt, Human
auuaaauucugggugaaacccuuuucucccac

SEQ ID NO: 72230 - RNA, 32 nt, Human
auuaaauuggaaaauauuggaauggaaccauu

SEQ ID NO: 72231 - RNA, 32 nt, Human
auuaaauugugagcucuuagaagacaggggug

SEQ ID NO: 72232 - RNA, 32 nt, Human
auuaaauuuauaccacugagggagagacccuu

SEQ ID NO: 72233 - RNA, 32 nt, Human
auuaaauuucagacuguagagccacauuuaca

SEQ ID NO: 72234 - RNA, 32 nt, Human
auuaaauuucuuauugaauuauuugaauucaa

SEQ ID NO: 72235 - RNA, 32 nt, Human
auuaacaaggagucucaaaaagaaaugagagg

SEQ ID NO: 72236 - RNA, 32 nt, Human
auuaacaaggucucugaggucauucagggaaa

SEQ ID NO: 72237 - RNA, 32 nt, Human
auuaacaauuaauugugaauacaugcuguuac

SEQ ID NO: 72238 - RNA, 32 nt, Human
auuaacacuagaugaauuaaagacuuaaacgu

SEQ ID NO: 72239 - RNA, 32 nt, Human
auuaacacuuaagguugggugcugcuaauucu

SEQ ID NO: 72240 - RNA, 32 nt, Human
auuaacagaaggcaaaguagaagguucacaaa

SEQ ID NO: 72241 - RNA, 32 nt, Human
auuaacagagcacacuaauaauuuguauagau

SEQ ID NO: 72242 - RNA, 32 nt, Human
auuaacagaggagaggaaaaagauggcucagc

SEQ ID NO: 72243 - RNA, 32 nt, Human
auuaacagagguggauguauugcuuaugaaaa

SEQ ID NO: 72244 - RNA, 32 nt, Human
auuaacagccagcauucaaaauugauaaauua

SEQ ID NO: 72245 - RNA, 32 nt, Human
auuaacagcguaauuauacaggcauauuuaau

SEQ ID NO: 72246 - RNA, 32 nt, Human
auuaacaggcucuggaccuauaagaucaagga

SEQ ID NO: 72247 - RNA, 32 nt, Human
auuaacaucuauugcuuuuucccuucaucugu

SEQ ID NO: 72248 - RNA, 32 nt, Human
auuaacaucucaggacucuucucuuguaaaga

SEQ ID NO: 72249 - RNA, 32 nt, Human
auuaacaucuucagaaaaggaagcaggcaugg

SEQ ID NO: 72250 - RNA, 32 nt, Human
auuaaccaaggcagaaagaggugaguaacuug

SEQ ID NO: 72251 - RNA, 32 nt, Human
auuaaccaagucccgagaaaagaaagugaaua

SEQ ID NO: 72252 - RNA, 32 nt, Human
auuaaccaauccaggaacugcuuuaccuuugg

SEQ ID NO: 72253 - RNA, 32 nt, Human
auuaaccaccaagcugcagcggauggggcaag

SEQ ID NO: 72254 - RNA, 32 nt, Human
auuaaccacccuccgcaaaccccagaaccccu

SEQ ID NO: 72255 - RNA, 32 nt, Human
auuaaccaccucuucuguguuucugguagcua

SEQ ID NO: 72256 - RNA, 32 nt, Human
auuaaccaggaggagguggcugcugugcccca

SEQ ID NO: 72257 - RNA, 32 nt, Human
auuaaccauaucugcccuucagguauuuugua

SEQ ID NO: 72258 - RNA, 32 nt, Human
auuaaccaucacagcaacaugccugcuaaauu

SEQ ID NO: 72259 - RNA, 32 nt, Human
auuaacccaggagaugggggucgaggagagac

SEQ ID NO: 72260 - RNA, 32 nt, Human
auuaacccaguaaacauauacaaaguaagcuu

SEQ ID NO: 72261 - RNA, 32 nt, Human
auuaacccauuuuauuuccuguccuuaguguc

SEQ ID NO: 72262 - RNA, 32 nt, Human
auuaaccccagugcaguaggguccccaggggc

SEQ ID NO: 72263 - RNA, 32 nt, Human
auuaaccccugccucaugucuguaacauguga

SEQ ID NO: 72264 - RNA, 32 nt, Human
auuaacccuuuccacacugcuccccugacuca

SEQ ID NO: 72265 - RNA, 32 nt, Human
auuaaccuaaguguccaucaauagagaauugg

SEQ ID NO: 72266 - RNA, 32 nt, Human
auuaaccuagguguccaucaauagagaauugg

SEQ ID NO: 72267 - RNA, 32 nt, Human
auuaaccugggcaacauaaugauacccugucu

SEQ ID NO: 72268 - RNA, 32 nt, Human
auuaaccuggguugcaacuacagguggcacug

SEQ ID NO: 72269 - RNA, 32 nt, Human
auuaaccuuacuguuuaagaggccaacuucug

SEQ ID NO: 72270 - RNA, 32 nt, Human
auuaacgaggggcaaggaagaggaguuggcca

SEQ ID NO: 72271 - RNA, 32 nt, Human
auuaacuaaaauucuaaugaucuugcuaccag

SEQ ID NO: 72272 - RNA, 32 nt, Human
auuaacuagggguuguggugugcaccuguagu

SEQ ID NO: 72273 - RNA, 32 nt, Human
auuaacuagguuuaagaaaagaccugaggcuu

SEQ ID NO: 72274 - RNA, 32 nt, Human
auuaacuauauuggauagcacagccguaaaau

SEQ ID NO: 72275 - RNA, 32 nt, Human
auuaacucaaauaacuaaauuucagaaaauua

SEQ ID NO: 72276 - RNA, 28 nt, Human
auuaacucauguacagccucauccugua

SEQ ID NO: 72277 - RNA, 32 nt, Human
auuaacucccaaaaauuggaauugcuaagagc

SEQ ID NO: 72278 - RNA, 32 nt, Human
auuaacugaggguaauuacaguaguagacaug

SEQ ID NO: 72279 - RNA, 22 nt, Human
auuaacugcugaauccauguga

SEQ ID NO: 72280 - RNA, 32 nt, Human
auuaacuggaaaacauauguuccuuaugugug

SEQ ID NO: 72281 - RNA, 32 nt, Human
auuaacuguuuaauuaaaauguuguaacaagu

SEQ ID NO: 72282 - RNA, 32 nt, Human
auuaacuucaauguaaucaugccuccuauuac

SEQ ID NO: 72283 - RNA, 32 nt, Human
auuaacuucagauccagcagguuugacccacc

SEQ ID NO: 72284 - RNA, 32 nt, Human
auuaacuucccauucuuggcgugacugaaagg

SEQ ID NO: 72285 - RNA, 32 nt, Human
auuaacuucuuagaaugcaugauguguuugug

SEQ ID NO: 72286 - RNA, 32 nt, Human
auuaacuuuacugacauggagugaagugcaau

SEQ ID NO: 72287 - RNA, 32 nt, Human
auuaagaaauagacagcaugagagggaugagg

SEQ ID NO: 72288 - RNA, 32 nt, Human
auuaagaacaucaaagugaaaaaugaaaagcc

SEQ ID NO: 72289 - RNA, 32 nt, Human
auuaagaagaauagaaguggagaggggaauua

SEQ ID NO: 72290 - RNA, 32 nt, Human
auuaagaagcuggacucuacugccauuaaagc

SEQ ID NO: 72291 - RNA, 32 nt, Human
auuaagaauaaaggaggaggaaaacaacaaag

SEQ ID NO: 72292 - RNA, 32 nt, Human
auuaagaauacaaaugcugggcugggcacagu

SEQ ID NO: 72293 - RNA, 32 nt, Human
auuaagaaucuuccauaauuguuuccacaaac

SEQ ID NO: 72294 - RNA, 32 nt, Human
auuaagacaaagacacagaaauauagugcaga

SEQ ID NO: 72295 - RNA, 32 nt, Human
auuaagacaagccuggcaacacaccuggugaa

SEQ ID NO: 72296 - RNA, 32 nt, Human
auuaagacagaagauggcuggaagagauguga

SEQ ID NO: 72297 - RNA, 32 nt, Human
auuaagacuuuucuaaggacugaagauuggca

SEQ ID NO: 72298 - RNA, 32 nt, Human
auuaagagacagacugugagccuagcagggca

SEQ ID NO: 72299 - RNA, 32 nt, Human
auuaagagaugggguuucgucauguuggccag

SEQ ID NO: 72300 - RNA, 32 nt, Human
auuaagagccucccucccucccucuauccauu

SEQ ID NO: 72301 - RNA, 32 nt, Human
auuaagaggaagcaaaacgcugcccagauccu

SEQ ID NO: 72302 - RNA, 32 nt, Human
auuaagaguaguaaugaaaaacaugcucagug

SEQ ID NO: 72303 - RNA, 32 nt, Human
auuaagagucucgggcccugccccagaccuag

SEQ ID NO: 72304 - RNA, 32 nt, Human
auuaagaucauccuggccaacauggugacacc

SEQ ID NO: 72305 - RNA, 32 nt, Human
auuaagauuacuggaaugguuaagucaugguu

SEQ ID NO: 72306 - RNA, 32 nt, Human
auuaagcaaacuugagaaaggggacuauucau

SEQ ID NO: 72307 - RNA, 32 nt, Human
auuaagcaaagcauuacucuggacuuuauugu

SEQ ID NO: 72308 - RNA, 32 nt, Human
auuaagcaaauugcuuaacacuugguuccagu

SEQ ID NO: 72309 - RNA, 32 nt, Human
auuaagcaauaaaaaccaaauugucugucauu

SEQ ID NO: 72310 - RNA, 32 nt, Human
auuaagccaccgcacuccagccugggcgacag

SEQ ID NO: 72311 - RNA, 32 nt, Human
auuaagccauugguggaacuagaaagagaauc

SEQ ID NO: 72312 - RNA, 32 nt, Human
auuaagcccuacuuuguccucugcacaaagau

SEQ ID NO: 72313 - RNA, 32 nt, Human
auuaagccucgguugagcccuuguauauuaaa

SEQ ID NO: 72314 - RNA, 32 nt, Human
auuaagccucuaagaacaaaauucauuagguu

SEQ ID NO: 72315 - RNA, 32 nt, Human
auuaagccuucagggcugucucaggccuuccu

SEQ ID NO: 72316 - RNA, 32 nt, Human
auuaagccuucccugcacuacuugugccccag

SEQ ID NO: 72317 - RNA, 32 nt, Human
auuaagcgauuccuggccaagaaacaaaagca

SEQ ID NO: 72318 - RNA, 32 nt, Human
auuaagcuaaucaaggaugcaccagaaaaagg

SEQ ID NO: 72319 - RNA, 32 nt, Human
auuaagcucauuuugacuguaaugucaucaaa

SEQ ID NO: 72320 - RNA, 32 nt, Human
auuaagcuucuuccucuucauaaaauuucaga

SEQ ID NO: 72321 - RNA, 32 nt, Human
auuaagcuuggucaguccacagacacacuagg

SEQ ID NO: 72322 - RNA, 32 nt, Human
auuaaggaaaccagauuuucaauuauuuagug

SEQ ID NO: 72323 - RNA, 32 nt, Human
auuaaggaagaaaagguaggauuauaagauuu

SEQ ID NO: 72324 - RNA, 32 nt, Human
auuaaggauauauacaguuacacuuuuugcug

SEQ ID NO: 72325 - RNA, 32 nt, Human
auuaaggaucaguggcaagcuucaacucagua

SEQ ID NO: 72326 - RNA, 32 nt, Human
auuaaggcagcaaguccuggguugugaaaaau

SEQ ID NO: 72327 - RNA, 32 nt, Human
auuaaggccaggaguucaaccagccuggacaa

SEQ ID NO: 72328 - RNA, 32 nt, Human
auuaaggcuugacaaagucaaaaguuuugucc

SEQ ID NO: 72329 - RNA, 32 nt, Human
auuaagggaacagugucuguuugcauguaaga

SEQ ID NO: 72330 - RNA, 32 nt, Human
auuaagggaagaaggugggagggcauuaguca

SEQ ID NO: 72331 - RNA, 32 nt, Human
auuaagggccggcacuccaucuugcuucaaua

SEQ ID NO: 72332 - RNA, 32 nt, Human
auuaagggcucaauaaauguuagcugaaugaa

SEQ ID NO: 72333 - RNA, 32 nt, Human
auuaagggucaccaccuaauuuuacuuuguau

SEQ ID NO: 72334 - RNA, 32 nt, Human
auuaaggguguacaaauuauaauaaugcaucu

SEQ ID NO: 72335 - RNA, 32 nt, Human
auuaagguccaauacauggguuguauuuuucu

SEQ ID NO: 72336 - RNA, 32 nt, Human
auuaaguaaagauggcuucgugacuaguguuu

SEQ ID NO: 72337 - RNA, 32 nt, Human
auuaaguaaguacucaagaaaugugcaauuuu

SEQ ID NO: 72338 - RNA, 32 nt, Human
auuaaguauauacuguguuuuauuuuuaaugu

SEQ ID NO: 72339 - RNA, 32 nt, Human
auuaagucaagagaucaagaccauccuggcca

SEQ ID NO: 72340 - RNA, 25 nt, Human
auuaagucacauuuuccuuuuguua

SEQ ID NO: 72341 - RNA, 24 nt, Human
auuaagucagugcacauccuaaca

SEQ ID NO: 72342 - RNA, 32 nt, Human
auuaaguccaccugucccuccugggcugcugg

SEQ ID NO: 72343 - RNA, 32 nt, Human
auuaagugaaugcuuugcaaguuugacuguau

SEQ ID NO: 72344 - RNA, 32 nt, Human
auuaagugagaagggagacucucagccuucag

SEQ ID NO: 72345 - RNA, 32 nt, Human
auuaagugagccagucaugcaugggccgagaa

SEQ ID NO: 72346 - RNA, 32 nt, Human
auuaaguguuuauuucauaaugccauuuauac

SEQ ID NO: 72347 - RNA, 32 nt, Human
auuaaguuauaccagcaaaagugcaguagugu

SEQ ID NO: 72348 - RNA, 32 nt, Human
auuaaguucaguuauuagucugugaagugcuu

SEQ ID NO: 72349 - RNA, 32 nt, Human
auuaaguuccacaagcuguuuguacucaaaua

SEQ ID NO: 72350 - RNA, 32 nt, Human
auuaaguuucacaagcuguuuguacucaaaua

SEQ ID NO: 72351 - RNA, 32 nt, Human
auuaaguuuguucauucucugcuuuauucucu

SEQ ID NO: 72352 - RNA, 32 nt, Human
auuaauaaaucauaauuucauuuccacauuga

SEQ ID NO: 72353 - RNA, 32 nt, Human
auuaauaacaaccaagacaaugcccagauuuc

SEQ ID NO: 72354 - RNA, 32 nt, Human
auuaauaccauaagguugggaacugacgcugg

SEQ ID NO: 72355 - RNA, 31 nt, Human
auuaauacucuauuuuuacauuuaaaccuuu

SEQ ID NO: 72356 - RNA, 32 nt, Human
auuaauagcacagcagaugugugcugcccauc

SEQ ID NO: 72357 - RNA, 32 nt, Human
auuaauaggcuucuucucuuaagucuucaucu

SEQ ID NO: 72358 - RNA, 32 nt, Human
auuaauaucaauuacgaugccaaaaauugcug

SEQ ID NO: 72359 - RNA, 32 nt, Human
auuaauauugaccagagccaaugaggucaucu

SEQ ID NO: 72360 - RNA, 32 nt, Human
auuaauauuuagaguaggaugcagccucuuau

SEQ ID NO: 72361 - RNA, 32 nt, Human
auuaaucaagaggaagccaguggaacaucuuu

SEQ ID NO: 72362 - RNA, 32 nt, Human
auuaaucaauuucucaauaguucuuaaaauua

SEQ ID NO: 72363 - RNA, 32 nt, Human
auuaaucagcugguuucaacucuacugcgaaa

SEQ ID NO: 72364 - RNA, 32 nt, Human
auuaaucaggaauauuacaguaaugaggauuu

SEQ ID NO: 72365 - RNA, 32 nt, Human
auuaaucaguucauuagaaauauuuuaaaauc

SEQ ID NO: 72366 - RNA, 32 nt, Human
auuaaucauuuugcauuuuacauuuaaauaug

SEQ ID NO: 72367 - RNA, 32 nt, Human
auuaauccaguggcaggagcgaauugaauuug

SEQ ID NO: 72368 - RNA, 32 nt, Human
auuaauccccuggauccuggagaaugcaaucc

SEQ ID NO: 72369 - RNA, 32 nt, Human
auuaaucccucuuuuugugacacaaguacaau

SEQ ID NO: 72370 - RNA, 32 nt, Human
auuaauccugagucauucucucccagguaaug

SEQ ID NO: 72371 - RNA, 32 nt, Human
auuaaucuaucccuuuugugcaugcaccauuu

SEQ ID NO: 72372 - RNA, 32 nt, Human
auuaaucucauggaugguucucaaagguaaaa

SEQ ID NO: 72373 - RNA, 32 nt, Human
auuaaucuggggaagaacagagccagggaaag

SEQ ID NO: 72374 - RNA, 32 nt, Human
auuaaucuucguuccuccuacaccagcacuuc

SEQ ID NO: 72375 - RNA, 32 nt, Human
auuaaugacucucaggcacaggggguuuuaag

SEQ ID NO: 72376 - RNA, 32 nt, Human
auuaaugagaugaaaguaugcacagaauaacu

SEQ ID NO: 72377 - RNA, 32 nt, Human
auuaaugauagguauuugaguaagaaugaaaa

SEQ ID NO: 72378 - RNA, 32 nt, Human
auuaaugauauuucauacugugcaaugaacag

SEQ ID NO: 72379 - RNA, 32 nt, Human
auuaaugaucacacuaaaugauauuuguuuuu

SEQ ID NO: 72380 - RNA, 32 nt, Human
auuaaugcauuuugcugccuuuauuaggguac

SEQ ID NO: 72381 - RNA, 32 nt, Human
auuaaugcuaucucccuguguacuguuucucu

SEQ ID NO: 72382 - RNA, 29 nt, Human
auuaauggagaaacuuagaacuuaccauu

SEQ ID NO: 72383 - RNA, 32 nt, Human
auuaauggagcuggugccuugcagcuucccuu

SEQ ID NO: 72384 - RNA, 32 nt, Human
auuaauggauacugaauaagccuggcaccugc

SEQ ID NO: 72385 - RNA, 32 nt, Human
auuaauggccagguauuuuaggaugugagaag

SEQ ID NO: 72386 - RNA, 32 nt, Human
auuaauggcgugagccacuguaccuggccaua

SEQ ID NO: 72387 - RNA, 32 nt, Human
auuaaugguggagccagagggagcccagugag

SEQ ID NO: 72388 - RNA, 32 nt, Human
auuaaugguucugcaugaccuagccacugcug

SEQ ID NO: 72389 - RNA, 32 nt, Human
auuaauguaugguauuugcucugugauuguuc

SEQ ID NO: 72390 - RNA, 32 nt, Human
auuaaugucacaaagcucuagugcaaucuagu

SEQ ID NO: 72391 - RNA, 32 nt, Human
auuaaugucaguacuaccagcacuuugccaaa

SEQ ID NO: 72392 - RNA, 32 nt, Human
auuaauguggaaggucaucaauaaaggggaau

SEQ ID NO: 72393 - RNA, 32 nt, Human
auuaauguggguggagauggggaugauuguag

SEQ ID NO: 72394 - RNA, 32 nt, Human
auuaauguucuaaagauaauuucugauugaaa

SEQ ID NO: 72395 - RNA, 32 nt, Human
auuaauguugacuucccuugguuggauccucu

SEQ ID NO: 72396 - RNA, 22 nt, Human
auuaauguugguuguacaccca

SEQ ID NO: 72397 - RNA, 32 nt, Human
auuaauguuuacuuucagaaccacacgcacag

SEQ ID NO: 72398 - RNA, 32 nt, Human
auuaauuaaugucuuugaaaagggaaaaguau

SEQ ID NO: 72399 - RNA, 32 nt, Human
auuaauuacaguguccuauagaaaaugccauu

SEQ ID NO: 72400 - RNA, 32 nt, Human
auuaauuacauacagauuuuaccuauccacaa

SEQ ID NO: 72401 - RNA, 32 nt, Human
auuaauuaucaguaucuaaagccacauuguuc

SEQ ID NO: 72402 - RNA, 32 nt, Human
auuaauuauuugguuguuuuguuuucauuuuu

SEQ ID NO: 72403 - RNA, 32 nt, Human
auuaauuccuggucuaguuuccugggccuugu

SEQ ID NO: 72404 - RNA, 32 nt, Human
auuaauucucacuaaaauucagcaaaggacuu

SEQ ID NO: 72405 - RNA, 32 nt, Human
auuaauucugaagaaggaaaagaaacugacau

SEQ ID NO: 72406 - RNA, 32 nt, Human
auuaauucuugguuaaggaaugaaucaacgaa

SEQ ID NO: 72407 - RNA, 32 nt, Human
auuaauugaaauccuucucaaucuugcacccc

SEQ ID NO: 72408 - RNA, 32 nt, Human
auuaauugaacccaagaagggggcugugguaa

SEQ ID NO: 72409 - RNA, 31 nt, Human
auuaauuggguggaagauugggcaagaaguc

SEQ ID NO: 72410 - RNA, 32 nt, Human
auuaauuguaccacaugcuaauccugaagaga

SEQ ID NO: 72411 - RNA, 32 nt, Human
auuaauuucaaagcuuccucuggccagguaga

SEQ ID NO: 72412 - RNA, 32 nt, Human
auuaauuucuuauaaagcagcauaaccuuggc

SEQ ID NO: 72413 - RNA, 32 nt, Human
auuaauuugaaggugagagguaucauuuucuc

SEQ ID NO: 72414 - RNA, 32 nt, Human
auuaauuuugauacggagucucccucugucgu

SEQ ID NO: 72415 - RNA, 32 nt, Human
auuaauuuuuacuauuaaaacuucuuauauua

SEQ ID NO: 72416 - RNA, 32 nt, Human
auuacaaaaauuagcuggcaugguggugcaug

SEQ ID NO: 72417 - RNA, 32 nt, Human
auuacaaacagcugggacccugaggggcagua

SEQ ID NO: 72418 - RNA, 32 nt, Human
auuacaaacccauucauuacauaguauaagga

SEQ ID NO: 72419 - RNA, 32 nt, Human
auuacaaaguacccacauucaggaugaaguau

SEQ ID NO: 72420 - RNA, 32 nt, Human
auuacaaccuggcuuuuuauuguauuuguuuc

SEQ ID NO: 72421 - RNA, 32 nt, Human
auuacaagcaugagccaccacaccuggccuau

SEQ ID NO: 72422 - RNA, 32 nt, Human
auuacaagcaugagccaccacaccuggccugu

SEQ ID NO: 72423 - RNA, 32 nt, Human
auuacaagcaugcgucaccacagcaggcccaa

SEQ ID NO: 72424 - RNA, 32 nt, Human
auuacaagccuugugcucuuuaucucuacauu

SEQ ID NO: 72425 - RNA, 32 nt, Human
auuacaagggugagccaccaugcccggccgua

SEQ ID NO: 72426 - RNA, 32 nt, Human
auuacaagugcccaccaccaugcccagcuaau

SEQ ID NO: 72427 - RNA, 32 nt, Human
auuacaagugugagccaccacacccagccuaa

SEQ ID NO: 72428 - RNA, 32 nt, Human
auuacaagugugagccaccgcgcccggcccag

SEQ ID NO: 72429 - RNA, 32 nt, Human
auuacaagugugagccacugugcccagcuuuu

SEQ ID NO: 72430 - RNA, 32 nt, Human
auuacaauaaacauacuaagacaauggguugc

SEQ ID NO: 72431 - RNA, 32 nt, Human
auuacaauggcagaaacagacagaaagggugg

SEQ ID NO: 72432 - RNA, 32 nt, Human
auuacaaugggcugugcucuccaccucagcau

SEQ ID NO: 72433 - RNA, 32 nt, Human
auuacaauuuuuaauaaauugaauagguagua

SEQ ID NO: 72434 - RNA, 32 nt, Human
auuacacaacaguuuguuaauucuucauucuu

SEQ ID NO: 72435 - RNA, 32 nt, Human
auuacacaaguccaguuauacacuuuauuuuu

SEQ ID NO: 72436 - RNA, 32 nt, Human
auuacacacaugcacacacauaugcacacaca

SEQ ID NO: 72437 - RNA, 32 nt, Human
auuacacaguucucuuucuccaaagggcaaga

SEQ ID NO: 72438 - RNA, 32 nt, Human
auuacaccacugcacuucagucugugugacug

SEQ ID NO: 72439 - RNA, 32 nt, Human
auuacaccacugcacuugagccugggcagcag

SEQ ID NO: 72440 - RNA, 32 nt, Human
auuacaccauugcauuccagccuaggcaacag

SEQ ID NO: 72441 - RNA, 32 nt, Human
auuacaccauugcauuccagccugggcaacag

SEQ ID NO: 72442 - RNA, 32 nt, Human
auuacaccccugcacuccagccugggcggcag

SEQ ID NO: 72443 - RNA, 32 nt, Human
auuacaccccuggacuccagcuugggugacac

SEQ ID NO: 72444 - RNA, 32 nt, Human
auuacaccugccuguccuuccugggccccucc

SEQ ID NO: 72445 - RNA, 32 nt, Human
auuacacgcgugagccacugugcccagccgau

SEQ ID NO: 72446 - RNA, 32 nt, Human
auuacacgugcccaccaccaugcccagcuaau

SEQ ID NO: 72447 - RNA, 32 nt, Human
auuacacuacucagcacaagacagguuuaauc

SEQ ID NO: 72448 - RNA, 32 nt, Human
auuacacuccagccuggcugacagugcaagac

SEQ ID NO: 72449 - RNA, 32 nt, Human
auuacacuccagccugggcgaaagggugagac

SEQ ID NO: 72450 - RNA, 32 nt, Human
auuacacuccagccugggugacagagugagac

SEQ ID NO: 72451 - RNA, 32 nt, Human
auuacacugucaaauauaaaauauuguuauau

SEQ ID NO: 72452 - RNA, 32 nt, Human
auuacacuuucacuagaagcccaaaccucagc

SEQ ID NO: 72453 - RNA, 32 nt, Human
auuacagaagaggacgccuccacccacaggaa

SEQ ID NO: 72454 - RNA, 32 nt, Human
auuacagacaugugccaccacgcccagcuaau

SEQ ID NO: 72455 - RNA, 32 nt, Human
auuacagaccugagccaccacaccugggcaac

SEQ ID NO: 72456 - RNA, 32 nt, Human
auuacagacgccugccaccacgcacagcuaac

SEQ ID NO: 72457 - RNA, 32 nt, Human
auuacagacgccugccaucacgcccagcucaa

SEQ ID NO: 72458 - RNA, 32 nt, Human
auuacagacuucuuccucuagacuuggagggc

SEQ ID NO: 72459 - RNA, 32 nt, Human
auuacagagcucaccucacaccugaguuaaga

SEQ ID NO: 72460 - RNA, 32 nt, Human
auuacagaugggagccaccacgcccagcccag

SEQ ID NO: 72461 - RNA, 32 nt, Human
auuacagauguaugcuaccacgcccagguagu

SEQ ID NO: 72462 - RNA, 32 nt, Human
auuacagaugugagccaacgcacccggcuaca

SEQ ID NO: 72463 - RNA, 32 nt, Human
auuacagaugugagccaccacaccaggccggu

SEQ ID NO: 72464 - RNA, 32 nt, Human
auuacagaugugagccaccacgcccagccaga

SEQ ID NO: 72465 - RNA, 32 nt, Human
auuacagaugugagccaccacgcccggccuuu

SEQ ID NO: 72466 - RNA, 32 nt, Human
auuacagaugugagccaccaugcccagcuuuc

SEQ ID NO: 72467 - RNA, 32 nt, Human
auuacagaugugagccaccgcacccagccuga

SEQ ID NO: 72468 - RNA, 32 nt, Human
auuacagaugugagccaccguacccagcuaau

SEQ ID NO: 72469 - RNA, 32 nt, Human
auuacagaugugagccaccgugccuagccaag

SEQ ID NO: 72470 - RNA, 32 nt, Human
auuacagaugugagccacugcaccuggcaaga

SEQ ID NO: 72471 - RNA, 32 nt, Human
auuacagaugugagccacugcaccuggcccca

SEQ ID NO: 72472 - RNA, 32 nt, Human
auuacagaugugagccauggugcccggcuacu

SEQ ID NO: 72473 - RNA, 32 nt, Human
auuacagaugugagccauuguggccuaagaug

SEQ ID NO: 72474 - RNA, 32 nt, Human
auuacagaugugagccgccgcgcccagacagu

SEQ ID NO: 72475 - RNA, 32 nt, Human
auuacagaugugagccugugccuggcuggucu

SEQ ID NO: 72476 - RNA, 32 nt, Human
auuacagauuugcagacuauagaaagaguuuc

SEQ ID NO: 72477 - RNA, 32 nt, Human
auuacagcacacugaguaaccacacugggcuc

SEQ ID NO: 72478 - RNA, 32 nt, Human
auuacagcacagaaaacuguuagugacugguu

SEQ ID NO: 72479 - RNA, 32 nt, Human
auuacagcauaaucacaccucauuucuuucau

SEQ ID NO: 72480 - RNA, 32 nt, Human
auuacagccagcuuugccaucuguggaaauag

SEQ ID NO: 72481 - RNA, 32 nt, Human
auuacagccaugcggcaccauucccggcuaau

SEQ ID NO: 72482 - RNA, 32 nt, Human
auuacagccuggcccacuggccucggugguac

SEQ ID NO: 72483 - RNA, 32 nt, Human
auuacagccuggugcagagcaagacucugucu

SEQ ID NO: 72484 - RNA, 32 nt, Human
auuacagcugugagccaccgugccuggccuuu

SEQ ID NO: 72485 - RNA, 32 nt, Human
auuacagcugugagccacugcacccggccggg

SEQ ID NO: 72486 - RNA, 32 nt, Human
auuacaggaacgcgccaccacgcccagcuaau

SEQ ID NO: 72487 - RNA, 32 nt, Human
auuacaggagagaacgagcaccugccagcacc

SEQ ID NO: 72488 - RNA, 32 nt, Human
auuacaggagcaagagaaagaagauaauuuaa

SEQ ID NO: 72489 - RNA, 32 nt, Human
auuacaggagugagccaccaugcccggcuggc

SEQ ID NO: 72490 - RNA, 32 nt, Human
auuacaggagugagccaccgcgccuggucccc

SEQ ID NO: 72491 - RNA, 32 nt, Human
auuacaggagugagccaccgugcccggccuaa

SEQ ID NO: 72492 - RNA, 32 nt, Human
auuacaggagugagccacugcgccuggcccac

SEQ ID NO: 72493 - RNA, 32 nt, Human
auuacaggcacacaccacaaugccuggcaaau

SEQ ID NO: 72494 - RNA, 32 nt, Human
auuacaggcacacaccaccacgcccagcuaau

SEQ ID NO: 72495 - RNA, 32 nt, Human
auuacaggcacacaccaccacgcccagcuagu

SEQ ID NO: 72496 - RNA, 32 nt, Human
auuacaggcacacaccaccacgcuugguuaau

SEQ ID NO: 72497 - RNA, 32 nt, Human
auuacaggcacccaccaccacgcccagcuaau

SEQ ID NO: 72498 - RNA, 32 nt, Human
auuacaggcacccgccaccacgcccagcuaau

SEQ ID NO: 72499 - RNA, 32 nt, Human
auuacaggcaccugacaucacgcccagcuaau

SEQ ID NO: 72500 - RNA, 32 nt, Human
auuacaggcaccugccaccacgcccagcuaau

SEQ ID NO: 72501 - RNA, 32 nt, Human
auuacaggcaccugucaccacacccagcuaau

SEQ ID NO: 72502 - RNA, 32 nt, Human
auuacaggcacgagccacugugcccggccauc

SEQ ID NO: 72503 - RNA, 32 nt, Human
auuacaggcacgagccacugugccuggccuca

SEQ ID NO: 72504 - RNA, 32 nt, Human
auuacaggcacgugccaccacgcccagacuaa

SEQ ID NO: 72505 - RNA, 32 nt, Human
auuacaggcacgugccaucacgcccagcuaau

SEQ ID NO: 72506 - RNA, 32 nt, Human
auuacaggcagacaccaucacgcccagcuaau

SEQ ID NO: 72507 - RNA, 32 nt, Human
auuacaggcaggagccacugagcccagccaag

SEQ ID NO: 72508 - RNA, 32 nt, Human
auuacaggcauaaaccacaaugccuggccccu

SEQ ID NO: 72509 - RNA, 32 nt, Human
auuacaggcauaagccacugagcccagcccua

SEQ ID NO: 72510 - RNA, 32 nt, Human
auuacaggcauaagccacugcacccagcccac

SEQ ID NO: 72511 - RNA, 32 nt, Human
auuacaggcauaagccacugcacccagcugaa

SEQ ID NO: 72512 - RNA, 32 nt, Human
auuacaggcauaagccacugugcccaggcaga

SEQ ID NO: 72513 - RNA, 32 nt, Human
auuacaggcauccgccaccacgcccagcuaau

SEQ ID NO: 72514 - RNA, 32 nt, Human
auuacaggcaugagccacagcacccggcccag

SEQ ID NO: 72515 - RNA, 32 nt, Human
auuacaggcaugagccacagugcccggccaag

SEQ ID NO: 72516 - RNA, 32 nt, Human
auuacaggcaugagccaccaaacccagcccag

SEQ ID NO: 72517 - RNA, 32 nt, Human
auuacaggcaugagccaccacacccacacaag

SEQ ID NO: 72518 - RNA, 32 nt, Human
auuacaggcaugagccaccacacccagccccu

SEQ ID NO: 72519 - RNA, 32 nt, Human
auuacaggcaugagccaccacacccagcccgg

SEQ ID NO: 72520 - RNA, 32 nt, Human
auuacaggcaugagccaccacacccagccuuu

SEQ ID NO: 72521 - RNA, 32 nt, Human
auuacaggcaugagccaccacacccagcgaga

SEQ ID NO: 72522 - RNA, 32 nt, Human
auuacaggcaugagccaccacaccuggauugc

SEQ ID NO: 72523 - RNA, 32 nt, Human
auuacaggcaugagccaccacaccuggcaagg

SEQ ID NO: 72524 - RNA, 32 nt, Human
auuacaggcaugagccaccacaccuggcccca

SEQ ID NO: 72525 - RNA, 32 nt, Human
auuacaggcaugagccaccacgcccagccaaa

SEQ ID NO: 72526 - RNA, 32 nt, Human
auuacaggcaugagccaccacgcccagccauu

SEQ ID NO: 72527 - RNA, 32 nt, Human
auuacaggcaugagccaccacgcccagcccau

SEQ ID NO: 72528 - RNA, 32 nt, Human
auuacaggcaugagccaccacgcccagccuaa

SEQ ID NO: 72529 - RNA, 32 nt, Human
auuacaggcaugagccaccacgcccagccuau

SEQ ID NO: 72530 - RNA, 32 nt, Human
auuacaggcaugagccaccacgcccagccugu

SEQ ID NO: 72531 - RNA, 32 nt, Human
auuacaggcaugagccaccacgcccggaccau

SEQ ID NO: 72532 - RNA, 32 nt, Human
auuacaggcaugagccaccacgcccggccaaa

SEQ ID NO: 72533 - RNA, 32 nt, Human
auuacaggcaugagccaccacgcccggcccac

SEQ ID NO: 72534 - RNA, 32 nt, Human
auuacaggcaugagccaccacgcccggcuaga

SEQ ID NO: 72535 - RNA, 32 nt, Human
auuacaggcaugagccaccaggcccggccuua

SEQ ID NO: 72536 - RNA, 32 nt, Human
auuacaggcaugagccaccaugcccagccaaa

SEQ ID NO: 72537 - RNA, 32 nt, Human
auuacaggcaugagccaccaugcccagccaau

SEQ ID NO: 72538 - RNA, 32 nt, Human
auuacaggcaugagccaccaugcccagcccac

SEQ ID NO: 72539 - RNA, 32 nt, Human
auuacaggcaugagccaccaugcccagcccuc

SEQ ID NO: 72540 - RNA, 32 nt, Human
auuacaggcaugagccaccaugcccagccucc

SEQ ID NO: 72541 - RNA, 32 nt, Human
auuacaggcaugagccaccaugcccagccuuu

SEQ ID NO: 72542 - RNA, 32 nt, Human
auuacaggcaugagccaccaugcccagcugac

SEQ ID NO: 72543 - RNA, 32 nt, Human
auuacaggcaugagccaccaugcccagcugcu

SEQ ID NO: 72544 - RNA, 32 nt, Human
auuacaggcaugagccaccaugcccagucgau

SEQ ID NO: 72545 - RNA, 32 nt, Human
auuacaggcaugagccaccaugcccggcccag

SEQ ID NO: 72546 - RNA, 32 nt, Human
auuacaggcaugagccaccaugcccggccccu

SEQ ID NO: 72547 - RNA, 32 nt, Human
auuacaggcaugagccaccaugcccggccuaa

SEQ ID NO: 72548 - RNA, 32 nt, Human
auuacaggcaugagccaccaugcccggccuuc

SEQ ID NO: 72549 - RNA, 32 nt, Human
auuacaggcaugagccaccaugcccggcuguu

SEQ ID NO: 72550 - RNA, 32 nt, Human
auuacaggcaugagccaccaugccuagccagc

SEQ ID NO: 72551 - RNA, 32 nt, Human
auuacaggcaugagccaccaugccuagcccag

SEQ ID NO: 72552 - RNA, 32 nt, Human
auuacaggcaugagccaccaugccuggcccag

SEQ ID NO: 72553 - RNA, 32 nt, Human
auuacaggcaugagccaccccgcccagcugag

SEQ ID NO: 72554 - RNA, 32 nt, Human
auuacaggcaugagccaccgagcucagccucc

SEQ ID NO: 72555 - RNA, 32 nt, Human
auuacaggcaugagccaccgcacccagcaaga

SEQ ID NO: 72556 - RNA, 32 nt, Human
auuacaggcaugagccaccgcacccagcccau

SEQ ID NO: 72557 - RNA, 32 nt, Human
auuacaggcaugagccaccgcacccagccuau

SEQ ID NO: 72558 - RNA, 32 nt, Human
auuacaggcaugagccaccgcacccagccugc

SEQ ID NO: 72559 - RNA, 32 nt, Human
auuacaggcaugagccaccgcacccagccugg

SEQ ID NO: 72560 - RNA, 32 nt, Human
auuacaggcaugagccaccgcaccugacccag

SEQ ID NO: 72561 - RNA, 32 nt, Human
auuacaggcaugagccaccgcgccaggccaag

SEQ ID NO: 72562 - RNA, 32 nt, Human
auuacaggcaugagccaccgcgcccagccaag

SEQ ID NO: 72563 - RNA, 32 nt, Human
auuacaggcaugagccaccgcgcccagccuaa

SEQ ID NO: 72564 - RNA, 32 nt, Human
auuacaggcaugagccaccgcgcccagcugcc

SEQ ID NO: 72565 - RNA, 32 nt, Human
auuacaggcaugagccaccgcgcccggccacg

SEQ ID NO: 72566 - RNA, 32 nt, Human
auuacaggcaugagccaccgcgcccggccaga

SEQ ID NO: 72567 - RNA, 32 nt, Human
auuacaggcaugagccaccgcgcccggcccaa

SEQ ID NO: 72568 - RNA, 32 nt, Human
auuacaggcaugagccaccgcgcccggcccca

SEQ ID NO: 72569 - RNA, 32 nt, Human
auuacaggcaugagccaccgcgcccggccuca

SEQ ID NO: 72570 - RNA, 32 nt, Human
auuacaggcaugagccaccgcgcccggccugu

SEQ ID NO: 72571 - RNA, 32 nt, Human
auuacaggcaugagccaccgcucccagccuuu

SEQ ID NO: 72572 - RNA, 32 nt, Human
auuacaggcaugagccaccgugccaggccaac

SEQ ID NO: 72573 - RNA, 32 nt, Human
auuacaggcaugagccaccgugcccagccaaa

SEQ ID NO: 72574 - RNA, 32 nt, Human
auuacaggcaugagccaccgugcccagccaag

SEQ ID NO: 72575 - RNA, 32 nt, Human
auuacaggcaugagccaccgugcccagccagg

SEQ ID NO: 72576 - RNA, 32 nt, Human
auuacaggcaugagccaccgugcccagcccaa

SEQ ID NO: 72577 - RNA, 32 nt, Human
auuacaggcaugagccaccgugcccagccuac

SEQ ID NO: 72578 - RNA, 32 nt, Human
auuacaggcaugagccaccgugcccagccuau

SEQ ID NO: 72579 - RNA, 32 nt, Human
auuacaggcaugagccaccgugcccggcccuu

SEQ ID NO: 72580 - RNA, 32 nt, Human
auuacaggcaugagccaccgugcccggccuca

SEQ ID NO: 72581 - RNA, 32 nt, Human
auuacaggcaugagccaccgugcccggcugua

SEQ ID NO: 72582 - RNA, 32 nt, Human
auuacaggcaugagccaccgugcccggcuuca

SEQ ID NO: 72583 - RNA, 32 nt, Human
auuacaggcaugagccaccucacccagcauuu

SEQ ID NO: 72584 - RNA, 32 nt, Human
auuacaggcaugagccaccucacccagcuccg

SEQ ID NO: 72585 - RNA, 32 nt, Human
auuacaggcaugagccaccucgccuagcccac

SEQ ID NO: 72586 - RNA, 32 nt, Human
auuacaggcaugagccaccugcccagccaugu

SEQ ID NO: 72587 - RNA, 32 nt, Human
auuacaggcaugagccacggcacccagccuca

SEQ ID NO: 72588 - RNA, 32 nt, Human
auuacaggcaugagccacuacacccagccgau

SEQ ID NO: 72589 - RNA, 32 nt, Human
auuacaggcaugagccacuacgccuggccaag

SEQ ID NO: 72590 - RNA, 32 nt, Human
auuacaggcaugagccacugagcccuacuuuu

SEQ ID NO: 72591 - RNA, 32 nt, Human
auuacaggcaugagccacugcacccagacuag

SEQ ID NO: 72592 - RNA, 32 nt, Human
auucuuccugcugaaguaaagcagaaaguacu

SEQ ID NO: 72593 - RNA, 32 nt, Human
auucuuccuuccaggaugguguauggugaggc

SEQ ID NO: 72594 - RNA, 32 nt, Human
auucuuccuugaccucacagguggugguaagg

SEQ ID NO: 72595 - RNA, 32 nt, Human
auucuucuaccuaacccacugcuuuuccccag

SEQ ID NO: 72596 - RNA, 31 nt, Human
auucuucuacuuuucuguauauucagcaggg

SEQ ID NO: 72597 - RNA, 32 nt, Human
auucuucuccuguugguuauucugagucugac

SEQ ID NO: 72598 - RNA, 32 nt, Human
auucuucucucccaccccuucuucucucuucu

SEQ ID NO: 72599 - RNA, 32 nt, Human
auucuucucuguuccucuuugccuccucccca

SEQ ID NO: 72600 - RNA, 32 nt, Human
auucuucucuuccccucucuucccuuuccucu

SEQ ID NO: 72601 - RNA, 32 nt, Human
auucuucugaaaaagacuuucuucucauccag

SEQ ID NO: 72602 - RNA, 32 nt, Human
auucuucugcaggaugugucugucuuugucac

SEQ ID NO: 72603 - RNA, 32 nt, Human
auucuucugcauuauaguaagagaaaaccauu

SEQ ID NO: 72604 - RNA, 32 nt, Human
auucuucugcauuuuuggauuccacgugcuua

SEQ ID NO: 72605 - RNA, 32 nt, Human
auucuucugccucagccuucugaguagcuggg

SEQ ID NO: 72606 - RNA, 32 nt, Human
auucuucuggcuuucucucugucgaggacuug

SEQ ID NO: 72607 - RNA, 32 nt, Human
auucuucugggaaacuuugaggcacugaggca

SEQ ID NO: 72608 - RNA, 32 nt, Human
auucuucuguggggcgggcuucccagggugcu

SEQ ID NO: 72609 - RNA, 32 nt, Human
auucuucuuaguccucaccucuuccuugucuu

SEQ ID NO: 72610 - RNA, 32 nt, Human
auucuucuucuccagauugucucuagcauaau

SEQ ID NO: 72611 - RNA, 32 nt, Human
auucuugaaacuuggcuuuccauaacauggua

SEQ ID NO: 72612 - RNA, 32 nt, Human
auucuugaacccaggagacggaaguugcagug

SEQ ID NO: 72613 - RNA, 32 nt, Human
auucuugaagucagggagaccaagaacccacc

SEQ ID NO: 72614 - RNA, 32 nt, Human
auucuugaauuucugcuagaaauaaguagguu

SEQ ID NO: 72615 - RNA, 32 nt, Human
auucuugacagagagaaauaagaucacuuaga

SEQ ID NO: 72616 - RNA, 32 nt, Human
auucuugagaaaaggacccugagaaggagguu

SEQ ID NO: 72617 - RNA, 21 nt, Human
auucuugagagcauugggaua

SEQ ID NO: 72618 - RNA, 32 nt, Human
auucuugagcaaaaggaggggaagagacaauc

SEQ ID NO: 72619 - RNA, 32 nt, Human
auucuugaggucuugagggaauagugaaacac

SEQ ID NO: 72620 - RNA, 32 nt, Human
auucuugcagagccauagcaggacauguuaaa

SEQ ID NO: 72621 - RNA, 32 nt, Human
auucuugcagcuaagcaagacagccauaugau

SEQ ID NO: 72622 - RNA, 32 nt, Human
auucuugccuuauaccucuuucucucuccugu

SEQ ID NO: 72623 - RNA, 32 nt, Human
auucuugcugggacaacaaaauugggaagcgg

SEQ ID NO: 72624 - RNA, 32 nt, Human
auucuuggcagugcuuuuucuuuagcauucug

SEQ ID NO: 72625 - RNA, 32 nt, Human
auucuuggcauugcaaccuccauuucuagcuc

SEQ ID NO: 72626 - RNA, 32 nt, Human
auucuuggccucugucccauauccaauagaga

SEQ ID NO: 72627 - RNA, 32 nt, Human
auucuuggccugggugguagaggagauauccu

SEQ ID NO: 72628 - RNA, 32 nt, Human
auucuugggaagacacuuugcuccucaucuuu

SEQ ID NO: 72629 - RNA, 32 nt, Human
auucuugguauuccuccuggauggaaaggcug

SEQ ID NO: 72630 - RNA, 32 nt, Human
auucuuguaucagauccaaagcucuauuguac

SEQ ID NO: 72631 - RNA, 32 nt, Human
auucuugucacccagacuggagugcgauggca

SEQ ID NO: 72632 - RNA, 31 nt, Human
auucuugucauuuuuccucaugcagauaaca

SEQ ID NO: 72633 - RNA, 32 nt, Human
auucuugugagacugcggucagacaguggcuu

SEQ ID NO: 72634 - RNA, 32 nt, Human
auucuugugaguccuaauuccuccuuauccac

SEQ ID NO: 72635 - RNA, 32 nt, Human
auucuuguguuuuuauaaagugcccuuuucuc

SEQ ID NO: 72636 - RNA, 32 nt, Human
auucuuguuacuuauuauaggcauuuucaggc

SEQ ID NO: 72637 - RNA, 32 nt, Human
auucuuguugccgaggcuggagugcaauggcg

SEQ ID NO: 72638 - RNA, 32 nt, Human
auucuuguugccuaggcuggagugcaauggcg

SEQ ID NO: 72639 - RNA, 32 nt, Human
auucuuguugcuuuuuaaaaaucaggcuaauc

SEQ ID NO: 72640 - RNA, 32 nt, Human
auucuuuaagggaaaagaaaaauguucugaaa

SEQ ID NO: 72641 - RNA, 32 nt, Human
auucuuuacagaaccuuguagugccaaaaacu

SEQ ID NO: 72642 - RNA, 32 nt, Human
auucuuuacugcacucagauuuaagccuuaca

SEQ ID NO: 72643 - RNA, 32 nt, Human
auucuuuagaaacuaacaaagccacauuuacu

SEQ ID NO: 72644 - RNA, 32 nt, Human
auucuuuaguaaagacaggguuucuccauguu

SEQ ID NO: 72645 - RNA, 32 nt, Human
auucuuuauacuucucuucauucuuuuaaggc

SEQ ID NO: 72646 - RNA, 32 nt, Human
auucuuuauaugucuuuuaaagcacaauuuaa

SEQ ID NO: 72647 - RNA, 21 nt, Human
auucuuuauuucucucagggu

SEQ ID NO: 72648 - RNA, 32 nt, Human
auucuuucacccccucuccuccugcucagcug

SEQ ID NO: 72649 - RNA, 32 nt, Human
auucuuucacucccagcugcagcugguagccg

SEQ ID NO: 72650 - RNA, 23 nt, Human
auucuuucagcuaguuugaguga

SEQ ID NO: 72651 - RNA, 32 nt, Human
auucuuucauuucccccuuccccauuccuuua

SEQ ID NO: 72652 - RNA, 32 nt, Human
auucuuucauuucccccuucccuauuccuuua

SEQ ID NO: 72653 - RNA, 21 nt, Human
auucuuuccagacagcauccu

SEQ ID NO: 72654 - RNA, 32 nt, Human
auucuuuccauagguagaagagaaaguugauu

SEQ ID NO: 72655 - RNA, 32 nt, Human
auucuuuccuaaagaacauuuuuagcagcaaa

SEQ ID NO: 72656 - RNA, 32 nt, Human
auucuuucugugacuauuuuguuccuguagac

SEQ ID NO: 72657 - RNA, 32 nt, Human
auucuuucuuuaucaucucccuccaaagccuc

SEQ ID NO: 72658 - RNA, 32 nt, Human
auucuuucuuucugccaagaaacaaaguuuug

SEQ ID NO: 72659 - RNA, 32 nt, Human
auucuuugaacccaggaggcagagguugcagu

SEQ ID NO: 72660 - RNA, 23 nt, Human
auucuuugaacuuauuuccacuu

SEQ ID NO: 72661 - RNA, 32 nt, Human
auucuuugccugccuucccuucauccuauccu

SEQ ID NO: 72662 - RNA, 30 nt, Human
auucuuuggcaaucagugcuccuguaaguc

SEQ ID NO: 72663 - RNA, 32 nt, Human
auucuuugguaucuaggaaucugcgacuuccc

SEQ ID NO: 72664 - RNA, 32 nt, Human
auucuuugucccucagcuucucagaguccggc

SEQ ID NO: 72665 - RNA, 32 nt, Human
auucuuuguggaugagaaaagauuugagucuu

SEQ ID NO: 72666 - RNA, 32 nt, Human
auucuuuuaacuucuaccuccuggcucuaguu

SEQ ID NO: 72667 - RNA, 32 nt, Human
auucuuuucaagagcugggaugauaugcauaa

SEQ ID NO: 72668 - RNA, 32 nt, Human
auucuuuucaaguaacagcagcacuugugaaa

SEQ ID NO: 72669 - RNA, 32 nt, Human
auucuuuucaauggagcucaucuucuaucucu

SEQ ID NO: 72670 - RNA, 32 nt, Human
auucuuuuccacugcuugcagucuccaaugua

SEQ ID NO: 72671 - RNA, 32 nt, Human
auucuuuucccagaaaagagucuuugauucac

SEQ ID NO: 72672 - RNA, 32 nt, Human
auucuuuucccuugacguuuacuuucaaguaa

SEQ ID NO: 72673 - RNA, 32 nt, Human
auucuuuuccuuaaaaugggaagauaaaggca

SEQ ID NO: 72674 - RNA, 32 nt, Human
auucuuuucuccuccucucuccuuccugcugu

SEQ ID NO: 72675 - RNA, 32 nt, Human
auucuuuucuucuuuuuccuauauguccugga

SEQ ID NO: 72676 - RNA, 32 nt, Human
auucuuuugacaacauuaaauauuucugugag

SEQ ID NO: 72677 - RNA, 32 nt, Human
auucuuuugcccaggcuggagugcaguggcac

SEQ ID NO: 72678 - RNA, 32 nt, Human
auucuuuuggaaauuagagguggaaacacacu

SEQ ID NO: 72679 - RNA, 32 nt, Human
auucuuuugugccuggcuucuuucucucagcc

SEQ ID NO: 72680 - RNA, 32 nt, Human
auucuuuuucccuugcccccaaagccguggag

SEQ ID NO: 72681 - RNA, 32 nt, Human
auucuuuuucuuuauaaauuacccagguucug

SEQ ID NO: 72682 - RNA, 32 nt, Human
auucuuuuugggcucccaagaacagggagaua

SEQ ID NO: 72683 - RNA, 32 nt, Human
auucuuuuugggcucccgagaacagggagaua

SEQ ID NO: 72684 - RNA, 32 nt, Human
auucuuuuugguguauuuuugccuuccuguug

SEQ ID NO: 72685 - RNA, 32 nt, Human
auugaaaaaccagcuuuacugccgguucuugg

SEQ ID NO: 72686 - RNA, 32 nt, Human
auugaaaaaccucaguguaacuuuaauauauu

SEQ ID NO: 72687 - RNA, 32 nt, Human
auugaaaaacuaagaacaugaaaugucaagag

SEQ ID NO: 72688 - RNA, 32 nt, Human
auugaaaaauaaagaugucaauaaaaggagaa

SEQ ID NO: 72689 - RNA, 32 nt, Human
auugaaaagacaggagaaaagcaaacagaaac

SEQ ID NO: 72690 - RNA, 32 nt, Human
auugaaaagauaacauguaggccaggcagguc

SEQ ID NO: 72691 - RNA, 32 nt, Human
auugaaaagcagcacaagaacugugaaaacuu

SEQ ID NO: 72692 - RNA, 32 nt, Human
auugaaaaggaaaaccugucugagaaaaugcc

SEQ ID NO: 72693 - RNA, 32 nt, Human
auugaaaauaagagaaguaaucccagauaaua

SEQ ID NO: 72694 - RNA, 32 nt, Human
auugaaaauguuaauuacacacacaugcaugc

SEQ ID NO: 72695 - RNA, 32 nt, Human
auugaaacaagaaaggucucauucuuuaccuu

SEQ ID NO: 72696 - RNA, 32 nt, Human
auugaaaccuaaaggcauuuugaaugacauug

SEQ ID NO: 72697 - RNA, 32 nt, Human
auugaaacguguuucacugcacugguacaaau

SEQ ID NO: 72698 - RNA, 32 nt, Human
auugaaacuuuuucuguuaaaauaacauaaca

SEQ ID NO: 72699 - RNA, 32 nt, Human
auugaaagaaaaaucauagaaauaaguaaaau

SEQ ID NO: 72700 - RNA, 32 nt, Human
auugaaagacacacacccaggcaaccccugag

SEQ ID NO: 72701 - RNA, 32 nt, Human
auugaaagaggcuuccucuucucaggaagaag

SEQ ID NO: 72702 - RNA, 32 nt, Human
auugaaagaguauuugggaaauguggcaaugu

SEQ ID NO: 72703 - RNA, 32 nt, Human
auugaaagagucagcaccagcagaggcuacuc

SEQ ID NO: 72704 - RNA, 32 nt, Human
auugaaagcagaaaguucuacucucguaucug

SEQ ID NO: 72705 - RNA, 32 nt, Human
auugaaaggaggugggggauugagggagggac

SEQ ID NO: 72706 - RNA, 24 nt, Human
auugaaaguccacagucauauuca

SEQ ID NO: 72707 - RNA, 32 nt, Human
auugaaaguuuuucacauguuuucacuguaua

SEQ ID NO: 72708 - RNA, 23 nt, Human
auugaaauaaaauggaucugcca

SEQ ID NO: 72709 - RNA, 32 nt, Human
auugaaauaggcugggagagagcaauguuucu

SEQ ID NO: 72710 - RNA, 23 nt, Human
auugaaauauuugcucucugcca

SEQ ID NO: 72711 - RNA, 32 nt, Human
auugaaaugaagagaaauagccagcaggugau

SEQ ID NO: 72712 - RNA, 32 nt, Human
auugaaauggauguucucagguuguauuuauu

SEQ ID NO: 72713 - RNA, 32 nt, Human
auugaaaugguccaaguagacagcugcuuguu

SEQ ID NO: 72714 - RNA, 32 nt, Human
auugaaauuguacagguccauaauuucauuuu

SEQ ID NO: 72715 - RNA, 32 nt, Human
auugaacaaauggugccauaguuauuuuucuc

SEQ ID NO: 72716 - RNA, 32 nt, Human
auugaacaauaaaaacacuuggacacagggug

SEQ ID NO: 72717 - RNA, 32 nt, Human
auugaacagcugucuaugccaggcucuguaca

SEQ ID NO: 72718 - RNA, 32 nt, Human
auugaaccaaaccuagugcuucaaagcuccug

SEQ ID NO: 72719 - RNA, 32 nt, Human
auugaaccagaauucacccacccgggccugcc

SEQ ID NO: 72720 - RNA, 32 nt, Human
auugaacccaggaggcggagcuugcagugagc

SEQ ID NO: 72721 - RNA, 32 nt, Human
auugaacccaggagguggagguugcagugagc

SEQ ID NO: 72722 - RNA, 32 nt, Human
auugaacccgggaggcagagguugcacugagc

SEQ ID NO: 72723 - RNA, 32 nt, Human
auugaacccgggaggcggagcuuacagugagc

SEQ ID NO: 72724 - RNA, 32 nt, Human
auugaaccugcucaucuccaaggauccucucc

SEQ ID NO: 72725 - RNA, 32 nt, Human
auugaaccugggaggcggagguugcagugagc

SEQ ID NO: 72726 - RNA, 32 nt, Human
auugaaccugggaggcggagguuguagugagc

SEQ ID NO: 72727 - RNA, 32 nt, Human
auugaaccugggagguggagguugcauugagc

SEQ ID NO: 72728 - RNA, 32 nt, Human
auugaaccuuaaauaagaagugcuuuuaaugu

SEQ ID NO: 72729 - RNA, 32 nt, Human
auugaacuauuuaucugaguucccucugccgg

SEQ ID NO: 72730 - RNA, 32 nt, Human
auugaacuggggucaccuguguccuuucuuau

SEQ ID NO: 72731 - RNA, 32 nt, Human
auugaacuugaagcaucggauuacauguuugu

SEQ ID NO: 72732 - RNA, 32 nt, Human
auugaacuugccaaugguggaguguugguugg

SEQ ID NO: 72733 - RNA, 32 nt, Human
auugaacuugcccuccccuucuggccuuggug

SEQ ID NO: 72734 - RNA, 32 nt, Human
auugaagaaagaaacuuaaaauccagguuguu

SEQ ID NO: 72735 - RNA, 32 nt, Human
auugaagaaaugcaaagcuuccaggcuccacu

SEQ ID NO: 72736 - RNA, 32 nt, Human
auugaagaaaugcaggaucuggagcucaggac

SEQ ID NO: 72737 - RNA, 32 nt, Human
auugaagaacccaaggcucugagaguuaacua

SEQ ID NO: 72738 - RNA, 32 nt, Human
auugaagaauguuccuuucuucuggagaaagg

SEQ ID NO: 72739 - RNA, 32 nt, Human
auugaagaauucaccauuagaggacauuuagc

SEQ ID NO: 72740 - RNA, 32 nt, Human
auugaagacaaacacucaccaaaaagaaaaau

SEQ ID NO: 72741 - RNA, 32 nt, Human
auugaagagagggauaaaauucaggagcaagu

SEQ ID NO: 72742 - RNA, 32 nt, Human
auugaagcacagacugcagagcacuuguuaac

SEQ ID NO: 72743 - RNA, 32 nt, Human
auugaagcccagacauucuugcagcuuggacu

SEQ ID NO: 72744 - RNA, 32 nt, Human
auugaagccuuugccagccauucuuucccuuu

SEQ ID NO: 72745 - RNA, 32 nt, Human
auugaagcuagaccucuuccuuacaccauaua

SEQ ID NO: 72746 - RNA, 32 nt, Human
auugaaggaaagaaaaugcaucuucaaacauu

SEQ ID NO: 72747 - RNA, 32 nt, Human
auugaaggccuggaauuagcuuggggccaggg

SEQ ID NO: 72748 - RNA, 32 nt, Human
auugaaggcugacauggagaauguuuacuuuu

SEQ ID NO: 72749 - RNA, 32 nt, Human
auugaaggcuuaggggcuucacugcguucgca

SEQ ID NO: 72750 - RNA, 32 nt, Human
auugaaguggugcauaacauugccaaaauagu

SEQ ID NO: 72751 - RNA, 20 nt, Human
auugaauaacaugcaucuga

SEQ ID NO: 72752 - RNA, 32 nt, Human
auugaauaaggcaauauccuacucucaagcaa

SEQ ID NO: 72753 - RNA, 32 nt, Human
auugaauacuccugaauuuaccauguuacuug

SEQ ID NO: 72754 - RNA, 32 nt, Human
auugaauauaaaugccuaauuucauucuuugu

SEQ ID NO: 72755 - RNA, 32 nt, Human
auugaauauccagaaaagacuggaguuuaacu

SEQ ID NO: 72756 - RNA, 32 nt, Human
auugaauaugcacacaggcaugacacagguuu

SEQ ID NO: 72757 - RNA, 32 nt, Human
auugaauccaggcugaggauggaaggugugga

SEQ ID NO: 72758 - RNA, 32 nt, Human
auugaaugagacuucugcuacugugguuuccc

SEQ ID NO: 72759 - RNA, 32 nt, Human
auugaaugagggugagggcaucccugcugggg

SEQ ID NO: 72760 - RNA, 32 nt, Human
auugaaugaguauugagacugaggagaaugau

SEQ ID NO: 72761 - RNA, 32 nt, Human
auugaaugcuugccaugugccaggcacugugc

SEQ ID NO: 72762 - RNA, 32 nt, Human
auugaauuaauuugaggaugggauuauucuaa

SEQ ID NO: 72763 - RNA, 32 nt, Human
auugaauuaccacuccugauacagggcuuuau

SEQ ID NO: 72764 - RNA, 32 nt, Human
auugaauuuaacaaugcgaaugguagucuaac

SEQ ID NO: 72765 - RNA, 32 nt, Human
auugaauuucuuugggggaaucuauguuuuac

SEQ ID NO: 72766 - RNA, 32 nt, Human
auugaauuuuauaauggaacagaacauuggua

SEQ ID NO: 72767 - RNA, 32 nt, Human
auugacaaaagcugugcaugaagaacugccuu

SEQ ID NO: 72768 - RNA, 32 nt, Human
auugacaaaaugugucugcugaaaugcugagg

SEQ ID NO: 72769 - RNA, 32 nt, Human
auugacaaggcaaauuucaugggugaguugga

SEQ ID NO: 72770 - RNA, 32 nt, Human
auugacaauucccacauucaaaacauucucau

SEQ ID NO: 72771 - RNA, 32 nt, Human
auugacacauggacucugccugggcauguuag

SEQ ID NO: 72772 - RNA, 32 nt, Human
auugacacauucauuuuucuuugcuuauuuga

SEQ ID NO: 72773 - RNA, 32 nt, Human
auugacacgugcugggauaggggcugcagaau

SEQ ID NO: 72774 - RNA, 32 nt, Human
auugacagccuccaucccugucccccaucuug

SEQ ID NO: 72775 - RNA, 32 nt, Human
auugacagcugaacugagagaccaucacccac

SEQ ID NO: 72776 - RNA, 32 nt, Human
auugacaguuuugcacagguucuugaaaacgu

SEQ ID NO: 72777 - RNA, 32 nt, Human
auugacauccucccccuacacucccucucuga

SEQ ID NO: 72778 - RNA, 32 nt, Human
auugacaugcuaaaacuuucuaagacaggauu

SEQ ID NO: 72779 - RNA, 32 nt, Human
auugacauguacacagaacauuuuaaaacuuu

SEQ ID NO: 72780 - RNA, 32 nt, Human
auugacauguacagagaacuaacacuauuuua

SEQ ID NO: 72781 - RNA, 32 nt, Human
auugacauuagagugaaaacuccuuccuuugg

SEQ ID NO: 72782 - RNA, 32 nt, Human
auugaccaaucagcaugagcuuccuccccucu

SEQ ID NO: 72783 - RNA, 32 nt, Human
auugaccagaguaucuuuuacugauaugacca

SEQ ID NO: 72784 - RNA, 32 nt, Human
auugaccagguaacagugguuacccuagaagc

SEQ ID NO: 72785 - RNA, 32 nt, Human
auugaccaucugucuccagccaggccaccccu

SEQ ID NO: 72786 - RNA, 32 nt, Human
auugacccauagcacacacauacacaccacca

SEQ ID NO: 72787 - RNA, 32 nt, Human
auugaccgaagccacagggcagcauggaaguu

SEQ ID NO: 72788 - RNA, 32 nt, Human
auugaccggagcauuuacaggccagccuagua

SEQ ID NO: 72789 - RNA, 32 nt, Human
auugaccucagcugcacauuccuggccccggg

SEQ ID NO: 72790 - RNA, 32 nt, Human
auugaccuccacccaccugccccauguccacu

SEQ ID NO: 72791 - RNA, 32 nt, Human
auugaccugggagcaaggugcuaauucugugg

SEQ ID NO: 72792 - RNA, 32 nt, Human
auugaccugggggcaaacuuuccucuugaaug

SEQ ID NO: 72793 - RNA, 32 nt, Human
auugaccuuugucuaauaggaguuuuaaguau

SEQ ID NO: 72794 - RNA, 32 nt, Human
auugacgcaagccuggagaggagcccggggag

SEQ ID NO: 72795 - RNA, 32 nt, Human
auugacgugggccagccuccuugagacacacc

SEQ ID NO: 72796 - RNA, 32 nt, Human
auugacguuagcugccccauugccucuaaguu

SEQ ID NO: 72797 - RNA, 32 nt, Human
auugacuaauuugagccacauucccaacucua

SEQ ID NO: 72798 - RNA, 21 nt, Human
auugacuacuaaaggcaguuc

SEQ ID NO: 72799 - RNA, 32 nt, Human
auugacuagauggaccauugugccaguugcca

SEQ ID NO: 72800 - RNA, 32 nt, Human
auugacuauccagcuguuacaagagcagucga

SEQ ID NO: 72801 - RNA, 32 nt, Human
auugacucagaaugacacauuuuggcaccacg

SEQ ID NO: 72802 - RNA, 32 nt, Human
auugacucaucaucugucaguaaugagaggau

SEQ ID NO: 72803 - RNA, 32 nt, Human
auugacucuacuaaaauaacaauguuucaguc

SEQ ID NO: 72804 - RNA, 32 nt, Human
auugacucucacacugaaucagcugcugacug

SEQ ID NO: 72805 - RNA, 32 nt, Human
auugacucucccagguuuccagcuugcaacug

SEQ ID NO: 72806 - RNA, 32 nt, Human
auugacucucucuuugauaacuaagcaaaugg

SEQ ID NO: 72807 - RNA, 32 nt, Human
auugacugaaggagggccaagauggaaacaga

SEQ ID NO: 72808 - RNA, 32 nt, Human
auugacugaugaagacauaaagcucuauguuu

SEQ ID NO: 72809 - RNA, 32 nt, Human
auugacugaugccagcucugugccagacacau

SEQ ID NO: 72810 - RNA, 32 nt, Human
auugacugggaaaccugagugagacccagcaa

SEQ ID NO: 72811 - RNA, 32 nt, Human
auugacuggggucuccuggaccauucuuguga

SEQ ID NO: 72812 - RNA, 32 nt, Human
auugacugucaugggauugcagugcuugcauu

SEQ ID NO: 72813 - RNA, 32 nt, Human
auugacuguccacccagccuugcuguuaggca

SEQ ID NO: 72814 - RNA, 32 nt, Human
auugacuucagaaacuuuuucuaaauuauaaa

SEQ ID NO: 72815 - RNA, 32 nt, Human
auugacuugaaugacaggcaaaggagggugga

SEQ ID NO: 72816 - RNA, 32 nt, Human
auugacuuucccaccagaugcugaaaaugucc

SEQ ID NO: 72817 - RNA, 32 nt, Human
auugacuuucucuuacuugcuguacuaucagc

SEQ ID NO: 72818 - RNA, 32 nt, Human
auugacuuucuuagaugugaucaugacagucu

SEQ ID NO: 72819 - RNA, 32 nt, Human
auugagaaaaggaacauaugcauuuuagcuuu

SEQ ID NO: 72820 - RNA, 32 nt, Human
auugagaaaaugcagaagaucgugcagacaga

SEQ ID NO: 72821 - RNA, 32 nt, Human
auugagaaaccaggacucuucccagcccuccu

SEQ ID NO: 72822 - RNA, 32 nt, Human
auugagaaaucguaagucuauacacauuucuu

SEQ ID NO: 72823 - RNA, 32 nt, Human
auugagaacccugcaucuugcacuuugggaau

SEQ ID NO: 72824 - RNA, 32 nt, Human
auugagaagaaauccaaucucaguccuggauu

SEQ ID NO: 72825 - RNA, 32 nt, Human
auugagaauacagcuaaauaaauuugaagauu

SEQ ID NO: 72826 - RNA, 32 nt, Human
auugagacaaguguucaaacagaaagacgcuu

SEQ ID NO: 72827 - RNA, 32 nt, Human
auugagaccagccuggccaacauggugaaacc

SEQ ID NO: 72828 - RNA, 32 nt, Human
auugagaccagccugggcaacauaguaagacg

SEQ ID NO: 72829 - RNA, 32 nt, Human
auugagaccaggaguucgagaagagccugggc

SEQ ID NO: 72830 - RNA, 32 nt, Human
auugagaccauccuggauaacacagugaaacc

SEQ ID NO: 72831 - RNA, 32 nt, Human
auugagaccauccuggauaacauggugaaacc

SEQ ID NO: 72832 - RNA, 32 nt, Human
auugagaccauccuggcaaacauggugaaacc

SEQ ID NO: 72833 - RNA, 32 nt, Human
auugagaccauccuggccaacauggugaaacc

SEQ ID NO: 72834 - RNA, 32 nt, Human
auugagaccauccuggccagcauggugaaacc

SEQ ID NO: 72835 - RNA, 32 nt, Human
auugagaccauccuggcuaacauggugaaacc

SEQ ID NO: 72836 - RNA, 32 nt, Human
auugagacccuccccaaggggaugggcugcuu

SEQ ID NO: 72837 - RNA, 32 nt, Human
auugagaccuuccuggcuaacauggugaaacc

SEQ ID NO: 72838 - RNA, 32 nt, Human
auugagacgucagugauaaaugagcuagaugg

SEQ ID NO: 72839 - RNA, 32 nt, Human
auugagacuggcugcugaugcaccuugguaau

SEQ ID NO: 72840 - RNA, 32 nt, Human
auugagacuuccaagaaaacuggacaccaggu

SEQ ID NO: 72841 - RNA, 32 nt, Human
auugagagaacuguguuuuuccgacaaacggu

SEQ ID NO: 72842 - RNA, 32 nt, Human
auugagagcaugggcuguagagacagucuucu

SEQ ID NO: 72843 - RNA, 32 nt, Human
auugagagcucugcuaugccacuguugaauuu

SEQ ID NO: 72844 - RNA, 32 nt, Human
auugagaggcagcauggcugcaacugugagga

SEQ ID NO: 72845 - RNA, 32 nt, Human
auugagaggugaaggagccagguggcuucauu

SEQ ID NO: 72846 - RNA, 32 nt, Human
auugagagguguuacgagaaugcaguuaauuu

SEQ ID NO: 72847 - RNA, 32 nt, Human
auugagaguuuggacguguccgucuguccagg

SEQ ID NO: 72848 - RNA, 32 nt, Human
auugagauacuuuuucuuuuguaagugcuaca

SEQ ID NO: 72849 - RNA, 32 nt, Human
auugagauauaauucacauacaauacaauaua

SEQ ID NO: 72850 - RNA, 32 nt, Human
auugagauauaauucacauaccuuacaauuca

SEQ ID NO: 72851 - RNA, 32 nt, Human
auugagauauccuuuaucacaggauuuguuuu

SEQ ID NO: 72852 - RNA, 32 nt, Human
auugagaucauccuggccaacacggugaaacc

SEQ ID NO: 72853 - RNA, 32 nt, Human
auugagaucuuuuuggcucucugccucuaaac

SEQ ID NO: 72854 - RNA, 32 nt, Human
auugagaugaaggccagugacaugacaacugu

SEQ ID NO: 72855 - RNA, 31 nt, Human
auugagauguggaagcuguugcuguggguug

SEQ ID NO: 72856 - RNA, 32 nt, Human
auugagauuaagaugacuccuuucucuuagug

SEQ ID NO: 72857 - RNA, 32 nt, Human
auugagauucauuccagcacuugaagggggag

SEQ ID NO: 72858 - RNA, 31 nt, Human
auugagauugauguguuuucacuggauuuuu

SEQ ID NO: 72859 - RNA, 32 nt, Human
auugagcaaagcaguucuuucagaucugcaag

SEQ ID NO: 72860 - RNA, 32 nt, Human
auugagcagacugaugccugcauaagaugaau

SEQ ID NO: 72861 - RNA, 32 nt, Human
auugagcaguagcauuugccuuuuggguuuuu

SEQ ID NO: 72862 - RNA, 32 nt, Human
auugagcagucauuaugcauccauuaugaaaa

SEQ ID NO: 72863 - RNA, 32 nt, Human
auugagcauuaucaaaauccugugguauuuau

SEQ ID NO: 72864 - RNA, 32 nt, Human
auugagccaaacccuucucuggcccucaccuu

SEQ ID NO: 72865 - RNA, 32 nt, Human
auugagccaagaggugagggugcacgucuucc

SEQ ID NO: 72866 - RNA, 32 nt, Human
auugagccacugcacuccaaucugggugacag

SEQ ID NO: 72867 - RNA, 32 nt, Human
auugagccacugcacuccagccucggccacag

SEQ ID NO: 72868 - RNA, 32 nt, Human
auugagccacugcacuccagccugggugacag

SEQ ID NO: 72869 - RNA, 32 nt, Human
auugagccacugcacuccagccugggugacug

SEQ ID NO: 72870 - RNA, 32 nt, Human
auugagccauugaaggcauuccauuucuaaag

SEQ ID NO: 72871 - RNA, 32 nt, Human
auugagccauugcucuccagccugggugacac

SEQ ID NO: 72872 - RNA, 32 nt, Human
auugagcccagccuccagggcccgggcgcguu

SEQ ID NO: 72873 - RNA, 32 nt, Human
auugagcccaggagcucuagaccaccacaccc

SEQ ID NO: 72874 - RNA, 32 nt, Human
auugagcccaggaguccagccugggcaaaaua

SEQ ID NO: 72875 - RNA, 32 nt, Human
auugagcccaggaguucaagaccagccugggc

SEQ ID NO: 72876 - RNA, 32 nt, Human
auugagcccaggaguucgagaccagccugggc

SEQ ID NO: 72877 - RNA, 32 nt, Human
auugagcccuacuccccaaaauguacaaacag

SEQ ID NO: 72878 - RNA, 32 nt, Human
auugagccugcgaggccaaggcugcagcaggc

SEQ ID NO: 72879 - RNA, 32 nt, Human
auugagccuggagaagagaagacugaggggca

SEQ ID NO: 72880 - RNA, 32 nt, Human
auugagcgcugaaucgugucccaugagaucag

SEQ ID NO: 72881 - RNA, 32 nt, Human
auugagcucccaucuagcuucagcagggcaga

SEQ ID NO: 72882 - RNA, 32 nt, Human
auugagcugcaggagcuggagccauggguagg

SEQ ID NO: 72883 - RNA, 32 nt, Human
auugagcugccuccagccugguggcccagcua

SEQ ID NO: 72884 - RNA, 32 nt, Human
auugaggaacagaagaagcagagcagaugauc

SEQ ID NO: 72885 - RNA, 32 nt, Human
auugaggaaucagcagcauaggcuuuaucucc

SEQ ID NO: 72886 - RNA, 31 nt, Human
auugaggaguuuuucugagggcagagauugg

SEQ ID NO: 72887 - RNA, 32 nt, Human
auugaggauaagauggaaggcagcaguauaag

SEQ ID NO: 72888 - RNA, 32 nt, Human
auugaggauaauggugguaaaggauguaccag

SEQ ID NO: 72889 - RNA, 32 nt, Human
auugaggccaggaguucaagaccagccugggc

SEQ ID NO: 72890 - RNA, 24 nt, Human
auugaggccaggaguuggagacca

SEQ ID NO: 72891 - RNA, 32 nt, Human
auugaggccaggaguuggagaccagccugggc

SEQ ID NO: 72892 - RNA, 24 nt, Human
auugaggccaggaguuugagacca

SEQ ID NO: 72893 - RNA, 32 nt, Human
auugaggccaggaguuugagaccagccuggcc

SEQ ID NO: 72894 - RNA, 32 nt, Human
auugaggccuacaagagaggggagccuaggag

SEQ ID NO: 72895 - RNA, 32 nt, Human
auugaggcugggguacugccacuguuguuauc

SEQ ID NO: 72896 - RNA, 32 nt, Human
auugagggagauguccccacaggccaguuuua

SEQ ID NO: 72897 - RNA, 32 nt, Human
auugagggcagguggcacguggggaagagggc

SEQ ID NO: 72898 - RNA, 32 nt, Human
auugagggcuuugauacugagcuguucucaua

SEQ ID NO: 72899 - RNA, 32 nt, Human
auugaggggcaguuuuguuugccugaauaaac

SEQ ID NO: 72900 - RNA, 32 nt, Human
auugaggguaguggaaagcaggugugggacag

SEQ ID NO: 72901 - RNA, 32 nt, Human
auugagggugggcagagauagcugaugcucca

SEQ ID NO: 72902 - RNA, 32 nt, Human
auugaggugaagcucacggggccaggcugacc

SEQ ID NO: 72903 - RNA, 32 nt, Human
auugaggugggagagagaagcagagcgagaga

SEQ ID NO: 72904 - RNA, 32 nt, Human
auugagucaccaccagcccccggcagaggcug

SEQ ID NO: 72905 - RNA, 32 nt, Human
auugagucccuccuccucuucucccaugccuu

SEQ ID NO: 72906 - RNA, 32 nt, Human
auugagugcccuccuggcuccugggcugggac

SEQ ID NO: 72907 - RNA, 32 nt, Human
auugaguggacucugugcucacuggguggagc

SEQ ID NO: 72908 - RNA, 32 nt, Human
auugaguuuaaauauuuuauaacugguuuugc

SEQ ID NO: 72909 - RNA, 32 nt, Human
auugaguuuuggcuugcagggguggguuuaga

SEQ ID NO: 72910 - RNA, 32 nt, Human
auugauaaaaagagcuccccuuugcugacaga

SEQ ID NO: 72911 - RNA, 32 nt, Human
auugauaagcuuggacagaauauugcuguggu

SEQ ID NO: 72912 - RNA, 32 nt, Human
auugauaaguucuguuagcucaccauagcacu

SEQ ID NO: 72913 - RNA, 32 nt, Human
auugauagcaucucccaggaacaacgacuuuu

SEQ ID NO: 72914 - RNA, 32 nt, Human
auugauauguuauuaaaagaaacaguaauaaa

SEQ ID NO: 72915 - RNA, 32 nt, Human
auugauauucuacuggccaugaugccacugaa

SEQ ID NO: 72916 - RNA, 32 nt, Human
auugaucaccauaagaaggaacauuugugaag

SEQ ID NO: 72917 - RNA, 32 nt, Human
auugaucagcacccaccccaccccugaggcuu

SEQ ID NO: 72918 - RNA, 32 nt, Human
auugaucagcugggugagggaggaaggagugu

SEQ ID NO: 72919 - RNA, 32 nt, Human
auugaucagugagacuaugaagagcacugacu

SEQ ID NO: 72920 - RNA, 32 nt, Human
auugaucaucacauuuugauaccugccaugua

SEQ ID NO: 72921 - RNA, 31 nt, Human
auugaucaugaaaaggggguuggaggagcug

SEQ ID NO: 72922 - RNA, 32 nt, Human
auugaucauuuuagacacugggagaagagaac

SEQ ID NO: 72923 - RNA, 32 nt, Human
auugauccaguugucauccaccacagacaucu

SEQ ID NO: 72924 - RNA, 32 nt, Human
auugauccugaaguuccuuuugccaaagaugc

SEQ ID NO: 72925 - RNA, 32 nt, Human
auugauccuggaugugucugugaggguguugc

SEQ ID NO: 72926 - RNA, 32 nt, Human
auugauccuggcugugucugugaggguguugc

SEQ ID NO: 72927 - RNA, 32 nt, Human
auugauccugggugugucugugaggguguugc

SEQ ID NO: 72928 - RNA, 32 nt, Human
auugauccuuucuccucaccuucagaauccag

SEQ ID NO: 72929 - RNA, 32 nt, Human
auugaucuacauuuucuuuaguaauguuuucu

SEQ ID NO: 72930 - RNA, 32 nt, Human
auugaucucauucugccccacauuuaacugcc

SEQ ID NO: 72931 - RNA, 32 nt, Human
auugaucuccuggaggcugguucugcugccuc

SEQ ID NO: 72932 - RNA, 32 nt, Human
auugaucugagugcuuucauauuuuccaaauu

SEQ ID NO: 72933 - RNA, 32 nt, Human
auugaucugcaucagcuuauuuauaaaaguaa

SEQ ID NO: 72934 - RNA, 32 nt, Human
auugaucugcuaaugcuuucuuugccacucua

SEQ ID NO: 72935 - RNA, 32 nt, Human
auugaucugucucugcaggccagauccaggcu

SEQ ID NO: 72936 - RNA, 32 nt, Human
auugaugaaugccgacucuguacuggguucug

SEQ ID NO: 72937 - RNA, 32 nt, Human
auugaugagcaucuuauuucuuaucucuaaaa

SEQ ID NO: 72938 - RNA, 32 nt, Human
auugaugcacccccaggaaggccacgcgcuca

SEQ ID NO: 72939 - RNA, 32 nt, Human
auugaugccagcugcuccauggaccaggcccu

SEQ ID NO: 72940 - RNA, 32 nt, Human
auugaugccucuccucuucuuguucugcuguu

SEQ ID NO: 72941 - RNA, 32 nt, Human
auugaugcuacaaauggaaagccaaugccuuu

SEQ ID NO: 72942 - RNA, 32 nt, Human
auugaugcuggcacaagaugaagauaggcaag

SEQ ID NO: 72943 - RNA, 32 nt, Human
auugauggagucugcauuccaccacauaucca

SEQ ID NO: 72944 - RNA, 32 nt, Human
auugauggcaaaaagauggcagacacaagcag

SEQ ID NO: 72945 - RNA, 32 nt, Human
auugauggcuaccuuucaugucccugucuaaa

SEQ ID NO: 72946 - RNA, 32 nt, Human
auugaugggaaagauugcuuagggaguucugg

SEQ ID NO: 72947 - RNA, 29 nt, Human
auugaugucuauuuccuugagcucuuuaa

SEQ ID NO: 72948 - RNA, 32 nt, Human
auugauguuuuacugcaaaucuuaugggucua

SEQ ID NO: 72949 - RNA, 32 nt, Human
auugauguuuuuaaaauguauccugaugaaug

SEQ ID NO: 72950 - RNA, 32 nt, Human
auugauuacacaugauaauggaugauacacaa

SEQ ID NO: 72951 - RNA, 32 nt, Human
auugauuacaggugaggaaguacuggaauucc

SEQ ID NO: 72952 - RNA, 32 nt, Human
auugauuauugagaaaauguagcaguuugcau

SEQ ID NO: 72953 - RNA, 32 nt, Human
auugauuauuuuuaugauagcgguauucagga

SEQ ID NO: 72954 - RNA, 32 nt, Human
auugauucagauguuuggcaagagguggcuga

SEQ ID NO: 72955 - RNA, 32 nt, Human
auugauuccaaagaacuccaccaggaauuccu

SEQ ID NO: 72956 - RNA, 32 nt, Human
auugauuccagcacccucaggaauaccuauau

SEQ ID NO: 72957 - RNA, 32 nt, Human
auugauuccugggacuccccuccaggguggcc

SEQ ID NO: 72958 - RNA, 32 nt, Human
auugauucucccuggacaaagcaggaaagcag

SEQ ID NO: 72959 - RNA, 32 nt, Human
auugauugaaauucauguuuucucaagcucca

SEQ ID NO: 72960 - RNA, 32 nt, Human
auugauugaauggauacuauggaaaaguggau

SEQ ID NO: 72961 - RNA, 32 nt, Human
auugauugagccagugagguccaggcugcacu

SEQ ID NO: 72962 - RNA, 32 nt, Human
auugauugagcucaggagguggaagcuacacg

SEQ ID NO: 72963 - RNA, 32 nt, Human
auugauugcuagugguggaguugauuggaaga

SEQ ID NO: 72964 - RNA, 32 nt, Human
auugauugggaaugggguagggggaggaguug

SEQ ID NO: 72965 - RNA, 32 nt, Human
auugauugggcuacucagaaaagaggacccgg

SEQ ID NO: 72966 - RNA, 32 nt, Human
auugauugggggagagaaaccagcagagcaca

SEQ ID NO: 72967 - RNA, 32 nt, Human
auugauugguccugucuugggcaggucuagug

SEQ ID NO: 72968 - RNA, 32 nt, Human
auugauuucaacaaagauggccacauugauau

SEQ ID NO: 72969 - RNA, 32 nt, Human
auugauuucaagucuccuaauuuggaaugggu

SEQ ID NO: 72970 - RNA, 32 nt, Human
auugauuucaucauuuaacagaaacaaacagc

SEQ ID NO: 72971 - RNA, 32 nt, Human
auugauuucccucucccggcuuuugcuucucu

SEQ ID NO: 72972 - RNA, 32 nt, Human
auugauuucuaggaacccccaaaaggagaaua

SEQ ID NO: 72973 - RNA, 32 nt, Human
auugauuugcauucuggaaagcucucccagga

SEQ ID NO: 72974 - RNA, 32 nt, Human
auugauuugguugaucuggcugagcaggcggg

SEQ ID NO: 72975 - RNA, 22 nt, Human
auugauuuuaaccaauguagca

SEQ ID NO: 72976 - RNA, 32 nt, Human
auugauuuuuauguauggugugagaaaggauc

SEQ ID NO: 72977 - RNA, 32 nt, Human
auugauuuuugaaacuuaacucuuuuggggca

SEQ ID NO: 72978 - RNA, 32 nt, Human
auugauuuuugauagacugaagugccagauca

SEQ ID NO: 72979 - RNA, 32 nt, Human
auugcaaaagggaggaagggagccaaaggcua

SEQ ID NO: 72980 - RNA, 32 nt, Human
auugcaaacuacaccuccacccacugggcuga

SEQ ID NO: 72981 - RNA, 32 nt, Human
auugcaaacuccucuucucaccugccaaagau

SEQ ID NO: 72982 - RNA, 32 nt, Human
auugcaacacugccacuccagccugggugaca

SEQ ID NO: 72983 - RNA, 32 nt, Human
auugcaaccuguguguuugucaucauccucau

SEQ ID NO: 72984 - RNA, 32 nt, Human
auugcaagcauauuucuuuuaaugacuccagu

SEQ ID NO: 72985 - RNA, 24 nt, Human
auugcaagcuccgccucccagguu

SEQ ID NO: 72986 - RNA, 32 nt, Human
auugcaaggugcuucuguacuuuuccagccug

SEQ ID NO: 72987 - RNA, 32 nt, Human
auugcaagucaaaggcaagacaggcuuccaua

SEQ ID NO: 72988 - RNA, 32 nt, Human
auugcaauggagaucaugacacuacuguuaau

SEQ ID NO: 72989 - RNA, 32 nt, Human
auugcaauuucuacuuucauagagucauagaa

SEQ ID NO: 72990 - RNA, 32 nt, Human
auugcacacagccucugcugggagaagagagg

SEQ ID NO: 72991 - RNA, 32 nt, Human
auugcacacgucacuccagcaucucuguaaaa

SEQ ID NO: 72992 - RNA, 32 nt, Human
auugcacacugcacuccagccugggugacuag

SEQ ID NO: 72993 - RNA, 32 nt, Human
auugcacacuggcugaauagcaucccuggucc

SEQ ID NO: 72994 - RNA, 32 nt, Human
auugcacagaugagcaauuacagcagagaaaa

SEQ ID NO: 72995 - RNA, 32 nt, Human
auugcacagauggggaaacugaggcuuaggaa

SEQ ID NO: 72996 - RNA, 32 nt, Human
auugcacaguggccacagaaggcuccauuggc

SEQ ID NO: 72997 - RNA, 32 nt, Human
auugcacauaucuccccucuaaaaccuguagu

SEQ ID NO: 72998 - RNA, 32 nt, Human
auugcacaucuguuggaggacaucccagauuu

SEQ ID NO: 72999 - RNA, 32 nt, Human
auugcaccacagcacuccaaccugggugacag

SEQ ID NO: 73000 - RNA, 32 nt, Human
auugcaccaccacacuccagccugggugacaa

SEQ ID NO: 73001 - RNA, 32 nt, Human
auugcaccaccacacuccagccugggugacag

SEQ ID NO: 73002 - RNA, 32 nt, Human
auugcaccaccgcacuccagccugggugacag

SEQ ID NO: 73003 - RNA, 32 nt, Human
auugcaccacggcacuccagccugggugacag

SEQ ID NO: 73004 - RNA, 32 nt, Human
auugcaccacuacacuccagccuggaugacag

SEQ ID NO: 73005 - RNA, 32 nt, Human
auugcaccacuacacuccagccugggcaacag

SEQ ID NO: 73006 - RNA, 32 nt, Human
auugcaccacuacacuccagccugggugacaa

SEQ ID NO: 73007 - RNA, 32 nt, Human
auugcaccacugaacuccagccugggccacau

SEQ ID NO: 73008 - RNA, 32 nt, Human
auugcaccacugcacgccagccugggugaaag

SEQ ID NO: 73009 - RNA, 32 nt, Human
auugcaccacugcacuacagcuugggugacag

SEQ ID NO: 73010 - RNA, 32 nt, Human
auugcaccacugcacucaagccugggcaacag

SEQ ID NO: 73011 - RNA, 32 nt, Human
auugcaccacugcacuccaaccugggcaacag

SEQ ID NO: 73012 - RNA, 32 nt, Human
auugcaccacugcacuccaaccugggugacaa

SEQ ID NO: 73013 - RNA, 32 nt, Human
auugcaccacugcacuccaaccugggugacag

SEQ ID NO: 73014 - RNA, 32 nt, Human
auugcaccacugcacuccagcccaggcaacag

SEQ ID NO: 73015 - RNA, 32 nt, Human
auugcaccacugcacuccagccggggugacag

SEQ ID NO: 73016 - RNA, 32 nt, Human
auugcaccacugcacuccagccuaggcgacag

SEQ ID NO: 73017 - RNA, 32 nt, Human
auugcaccacugcacuccagccugagugacag

SEQ ID NO: 73018 - RNA, 32 nt, Human
auugcaccacugcacuccagccugagugagga

SEQ ID NO: 73019 - RNA, 32 nt, Human
auugcaccacugcacuccagccuggaaaacgg

SEQ ID NO: 73020 - RNA, 32 nt, Human
auugcaccacugcacuccagccuggcgacaaa

SEQ ID NO: 73021 - RNA, 32 nt, Human
auugcaccacugcacuccagccugggaaacag

SEQ ID NO: 73022 - RNA, 32 nt, Human
auugcaccacugcacuccagccugggagacag

SEQ ID NO: 73023 - RNA, 32 nt, Human
auugcaccacugcacuccagccugggcaacaa

SEQ ID NO: 73024 - RNA, 32 nt, Human
auugcaccacugcacuccagccugggcaacag

SEQ ID NO: 73025 - RNA, 32 nt, Human
auugcaccacugcacuccagccugggcaauag

SEQ ID NO: 73026 - RNA, 32 nt, Human
auugcaccacugcacuccagccugggcgacag

SEQ ID NO: 73027 - RNA, 32 nt, Human
auugcaccacugcacuccagccugggcgacug

SEQ ID NO: 73028 - RNA, 32 nt, Human
auugcaccacugcacuccagccugggcggcag

SEQ ID NO: 73029 - RNA, 32 nt, Human
auugcaccacugcacuccagccugggcuacag

SEQ ID NO: 73030 - RNA, 32 nt, Human
auugcaccacugcacuccagccuggggacaga

SEQ ID NO: 73031 - RNA, 32 nt, Human
auugcaccacugcacuccagccuggguaacaa

SEQ ID NO: 73032 - RNA, 32 nt, Human
auugcaccacugcacuccagccugggugacag

SEQ ID NO: 73033 - RNA, 32 nt, Human
auugcaccacugcacuccagccugggugauag

SEQ ID NO: 73034 - RNA, 32 nt, Human
auugcaccacugcacuccagccuggguggcag

SEQ ID NO: 73035 - RNA, 32 nt, Human
auugcaccacugcacuccagccugggugucag

SEQ ID NO: 73036 - RNA, 32 nt, Human
auugcaccacugcacuccagccuggugacaga

SEQ ID NO: 73037 - RNA, 32 nt, Human
auugcaccacugcacuccagccuggugacagg

SEQ ID NO: 73038 - RNA, 32 nt, Human
auugcaccacugcacuccaggcuggguaacag

SEQ ID NO: 73039 - RNA, 32 nt, Human
auugcaccacugcacuccagucugggcaacag

SEQ ID NO: 73040 - RNA, 32 nt, Human
auugcaccacugcacuccagucugggugagag

SEQ ID NO: 73041 - RNA, 32 nt, Human
auugcaccacugcacuccagucugguugagag

SEQ ID NO: 73042 - RNA, 32 nt, Human
auugcaccacugcacuccauccugggcaacag

SEQ ID NO: 73043 - RNA, 32 nt, Human
auugcaccacugcacucuaacuugggcaacaa

SEQ ID NO: 73044 - RNA, 32 nt, Human
auugcaccacugcacucuacucugggugacag

SEQ ID NO: 73045 - RNA, 32 nt, Human
auugcaccacugcacucuagccugcgugacac

SEQ ID NO: 73046 - RNA, 32 nt, Human
auugcaccacugcacucuagccuggggaacag

SEQ ID NO: 73047 - RNA, 32 nt, Human
auugcaccacugcacucuagccuggguaacaa

SEQ ID NO: 73048 - RNA, 32 nt, Human
auugcaccacugcacugcagccugggaaacag

SEQ ID NO: 73049 - RNA, 32 nt, Human
auugcaccacugcacuucagccuggugacaga

SEQ ID NO: 73050 - RNA, 32 nt, Human
auugcaccacugcacuucagcuugggcaacag

SEQ ID NO: 73051 - RNA, 32 nt, Human
auugcaccacugcacuuuagucugggugacag

SEQ ID NO: 73052 - RNA, 32 nt, Human
auugcaccacugcaguucagccuggaugauga

SEQ ID NO: 73053 - RNA, 32 nt, Human
auugcaccacugcauuccaaccugggcggcag

SEQ ID NO: 73054 - RNA, 32 nt, Human
auugcaccacugcauuccagcauggccacaaa

SEQ ID NO: 73055 - RNA, 32 nt, Human
auugcaccacugcauuccagccuggaugacag

SEQ ID NO: 73056 - RNA, 32 nt, Human
auugcaccacugcauuccagccuggcgacaga

SEQ ID NO: 73057 - RNA, 32 nt, Human
auugcaccacugcucuccaagcugggcaaugg

SEQ ID NO: 73058 - RNA, 32 nt, Human
auugcaccacugcucuccagccuggggaacag

SEQ ID NO: 73059 - RNA, 32 nt, Human
auugcaccacugcucucuagccugggcaaaaa

SEQ ID NO: 73060 - RNA, 32 nt, Human
auugcaccacuggacgccagccuaggcaacac

SEQ ID NO: 73061 - RNA, 32 nt, Human
auugcaccacuguacuccagcacucuagccug

SEQ ID NO: 73062 - RNA, 32 nt, Human
auugcaccacuguacuccagccugggcaacag

SEQ ID NO: 73063 - RNA, 32 nt, Human
auugcaccacuguacuccagccugggugacaa

SEQ ID NO: 73064 - RNA, 32 nt, Human
auugcaccacuguacuccagccugggugacag

SEQ ID NO: 73065 - RNA, 32 nt, Human
auugcaccacuuacuccagccugggcaacaga

SEQ ID NO: 73066 - RNA, 32 nt, Human
auugcaccacuucacuccagccugggugacgg

SEQ ID NO: 73067 - RNA, 32 nt, Human
auugcaccacuucaucccagccugggagacag

SEQ ID NO: 73068 - RNA, 32 nt, Human
auugcaccacuuguaacuccagccugggcaac

SEQ ID NO: 73069 - RNA, 32 nt, Human
auugcaccacuuuacuuagccugggugacaga

SEQ ID NO: 73070 - RNA, 32 nt, Human
auugcaccagugcacuccagcugggcgacaga

SEQ ID NO: 73071 - RNA, 32 nt, Human
auugcaccauugaacuccagccugggcaacaa

SEQ ID NO: 73072 - RNA, 32 nt, Human
auugcaccauugcaccuccagccugggcaaca

SEQ ID NO: 73073 - RNA, 32 nt, Human
auugcaccauugcacuccagccugcgcaacaa

SEQ ID NO: 73074 - RNA, 32 nt, Human
auugcaccauugcacuccagccuggcgacaga

SEQ ID NO: 73075 - RNA, 32 nt, Human
auugcaccauugcacuccagccugggcaacaa

SEQ ID NO: 73076 - RNA, 32 nt, Human
auugcaccauugcacuccagccugggcaacag

SEQ ID NO: 73077 - RNA, 32 nt, Human
auugcaccauugcacuccagccugggcaauaa

SEQ ID NO: 73078 - RNA, 32 nt, Human
auugcaccauugcacuccagccugggcgacag

SEQ ID NO: 73079 - RNA, 32 nt, Human
auugcaccauugcacuccagccugggugacag

SEQ ID NO: 73080 - RNA, 32 nt, Human
auugcaccauugcacuccagccugugcaacaa

SEQ ID NO: 73081 - RNA, 32 nt, Human
auugcaccauugcacuccagcuugggugacag

SEQ ID NO: 73082 - RNA, 32 nt, Human
auugcaccauugcacuccugccugggcaacaa

SEQ ID NO: 73083 - RNA, 32 nt, Human
auugcaccauugcauuccagccugggcaacaa

SEQ ID NO: 73084 - RNA, 32 nt, Human
auugcaccauugcauuccagccugggugacag

SEQ ID NO: 73085 - RNA, 32 nt, Human
auugcaccauuguacuccagccugggcaauaa

SEQ ID NO: 73086 - RNA, 32 nt, Human
auugcaccauuucauuccagccugggcaacau

SEQ ID NO: 73087 - RNA, 32 nt, Human
auugcaccccugcacuccagccugggugacag

SEQ ID NO: 73088 - RNA, 32 nt, Human
auugcaccccugcacuccaggcugggcaacag

SEQ ID NO: 73089 - RNA, 32 nt, Human
auugcacccugcacucuagccugggcaacaag

SEQ ID NO: 73090 - RNA, 32 nt, Human
auugcacccugggcucugggcuggcucugcac

SEQ ID NO: 73091 - RNA, 32 nt, Human
auugcaccgcugcacuccagccuggcgacaga

SEQ ID NO: 73092 - RNA, 32 nt, Human
auugcaccgugacacuccagccugggcaacag

SEQ ID NO: 73093 - RNA, 32 nt, Human
auugcaccuaucucccccaucucauugccacg

SEQ ID NO: 73094 - RNA, 32 nt, Human
auugcaccuggccaagaagagacaucuugacu

SEQ ID NO: 73095 - RNA, 32 nt, Human
auugcaccuuuguacuccagccugggcaacga

SEQ ID NO: 73096 - RNA, 32 nt, Human
auugcacgacugcacuccagccugggcaaugg

SEQ ID NO: 73097 - RNA, 32 nt, Human
auugcacgggccucucuguguuugcgugcaug

SEQ ID NO: 73098 - RNA, 32 nt, Human
auugcacuacuacacuccagccuggugacaga

SEQ ID NO: 73099 - RNA, 32 nt, Human
auugcacuacugcacuccagacuggugacgga

SEQ ID NO: 73100 - RNA, 32 nt, Human
auugcacuacugcacuccagccugggugacag

SEQ ID NO: 73101 - RNA, 32 nt, Human
auugcacuacugcauuccagccugggugacau

SEQ ID NO: 73102 - RNA, 32 nt, Human
auugcacuaggcaaguguauauuuuguauuuu

SEQ ID NO: 73103 - RNA, 32 nt, Human
auugcacuauugcacuccagccugggcaacag

SEQ ID NO: 73104 - RNA, 32 nt, Human
auugcacuccacacuccagccugagcaacaag

SEQ ID NO: 73105 - RNA, 32 nt, Human
auugcacuccagccuagauaacaagagugaga

SEQ ID NO: 73106 - RNA, 32 nt, Human
auugcacuccagccuaggcauggugagacucc

SEQ ID NO: 73107 - RNA, 32 nt, Human
auugcacuccagccuaggcgacagagugagac

SEQ ID NO: 73108 - RNA, 32 nt, Human
auugcacuccagccuggaugacagagugagac

SEQ ID NO: 73109 - RNA, 32 nt, Human
auugcacuccagccuggaugauagagugagac

SEQ ID NO: 73110 - RNA, 32 nt, Human
auugcacuccagccuggcgacagagugagacu

SEQ ID NO: 73111 - RNA, 32 nt, Human
auugcacuccagccugggcaacaagugcaaaa

SEQ ID NO: 73112 - RNA, 32 nt, Human
auugcacuccagccugggcaacagagugaaaa

SEQ ID NO: 73113 - RNA, 32 nt, Human
auugcacuccagccugggcaacagagugagac

SEQ ID NO: 73114 - RNA, 32 nt, Human
auugcacuccagccugggcaacaguguuaaga

SEQ ID NO: 73115 - RNA, 32 nt, Human
auugcacuccagccugggcaacgagugaaacu

SEQ ID NO: 73116 - RNA, 32 nt, Human
auugcacuccagccugggcaacgagugcaaaa

SEQ ID NO: 73117 - RNA, 32 nt, Human
auugcacuccagccugggcaauagagugagac

SEQ ID NO: 73118 - RNA, 32 nt, Human
auugcacuccagccugggcgacagagugacac

SEQ ID NO: 73119 - RNA, 32 nt, Human
auugcacuccagccugggcgacagagugagac

SEQ ID NO: 73120 - RNA, 32 nt, Human
auugcacuccagccugggcgacagggugagac

SEQ ID NO: 73121 - RNA, 32 nt, Human
auugcacuccagccugggcgauagagugagac

SEQ ID NO: 73122 - RNA, 32 nt, Human
auugcacuccagccugggugacagaguaacac

SEQ ID NO: 73123 - RNA, 32 nt, Human
auugcacuccagccugggugacagagugaaac

SEQ ID NO: 73124 - RNA, 32 nt, Human
auugcacuccagccugggugacagagugagac

SEQ ID NO: 73125 - RNA, 32 nt, Human
auugcacuccagccugggugacgagugaaacu

SEQ ID NO: 73126 - RNA, 32 nt, Human
auugcacuccagccugggugauaagagcaaga

SEQ ID NO: 73127 - RNA, 32 nt, Human
auugcacuccagccugggugauaagagcgaaa

SEQ ID NO: 73128 - RNA, 32 nt, Human
auugcacuccagccugggugguagaucaaggc

SEQ ID NO: 73129 - RNA, 32 nt, Human
auugcacucugacuugccuggggcuguuggca

SEQ ID NO: 73130 - RNA, 32 nt, Human
auugcacugucgcacuccagccuggaugauag

SEQ ID NO: 73131 - RNA, 32 nt, Human
auugcacuugacucaaaacugcccucggccug

SEQ ID NO: 73132 - RNA, 32 nt, Human
auugcacuuucccaccucuauaccuugccugu

SEQ ID NO: 73133 - RNA, 32 nt, Human
auugcagaaagggggaguggcggcccacgcag

SEQ ID NO: 73134 - RNA, 32 nt, Human
auugcagaagucaauccuuuguucuuuuguuu

SEQ ID NO: 73135 - RNA, 32 nt, Human
auugcagaccgggcaaggucccccaggccagg

SEQ ID NO: 73136 - RNA, 32 nt, Human
auugcagacucaugaaagacccugagcagagg

SEQ ID NO: 73137 - RNA, 32 nt, Human
auugcagagaaucagacuccuuuuccagggcc

SEQ ID NO: 73138 - RNA, 32 nt, Human
auugcagauaccugccuuucuuucuagguugu

SEQ ID NO: 73139 - RNA, 32 nt, Human
auugcagaugugagccaccgugccuggccaga

SEQ ID NO: 73140 - RNA, 32 nt, Human
auugcagaugugagccacugugccaggcuccu

SEQ ID NO: 73141 - RNA, 32 nt, Human
auugcagcaaaaucacuuaucuguucuuuucg

SEQ ID NO: 73142 - RNA, 32 nt, Human
auugcagcaguggcaaugcaauaaauguuauu

SEQ ID NO: 73143 - RNA, 32 nt, Human
auugcagccucaaacaccugugcucaagcaau

SEQ ID NO: 73144 - RNA, 32 nt, Human
auugcagccucaaacuccugggcucaagcaau

SEQ ID NO: 73145 - RNA, 32 nt, Human
auugcagccuccacuuccugggcucaagcgau

SEQ ID NO: 73146 - RNA, 32 nt, Human
auugcagcucacugcugcugccucugaaacag

SEQ ID NO: 73147 - RNA, 32 nt, Human
auugcagcuccucagcccccaggauugaccuc

SEQ ID NO: 73148 - RNA, 22 nt, Human
auugcagcugccacaaccacau

SEQ ID NO: 73149 - RNA, 32 nt, Human
auugcagcugggcgugguggcuuaugcuugua

SEQ ID NO: 73150 - RNA, 32 nt, Human
auugcagcuucuucuuucuucugcucauaaaa

SEQ ID NO: 73151 - RNA, 32 nt, Human
auugcaggaaagacagguaaagugauugcugc

SEQ ID NO: 73152 - RNA, 32 nt, Human
auugcaggaaagcgaagguggagagagaagag

SEQ ID NO: 73153 - RNA, 32 nt, Human
auugcaggaagaggaaaggccugugacagagc

SEQ ID NO: 73154 - RNA, 32 nt, Human
auugcaggaagagguggccaggagggcgcagg

SEQ ID NO: 73155 - RNA, 32 nt, Human
auugcaggaccugauuuaacagcucucuucuu

SEQ ID NO: 73156 - RNA, 32 nt, Human
auugcaggcacaugccaccacgcccagcuaau

SEQ ID NO: 73157 - RNA, 32 nt, Human
auugcaggcaugagccaccgcgcccagccaga

SEQ ID NO: 73158 - RNA, 32 nt, Human
auugcaggcaugagccaccgugcccagccuca

SEQ ID NO: 73159 - RNA, 32 nt, Human
auugcaggcaugagccacugcacccagcccug

SEQ ID NO: 73160 - RNA, 32 nt, Human
auugcaggcaugagccacugcgccuggccuaa

SEQ ID NO: 73161 - RNA, 32 nt, Human
auugcaggcaugagccacugcgccuggccuca

SEQ ID NO: 73162 - RNA, 32 nt, Human
auugcaggcaugagccacugcucccggcccua

SEQ ID NO: 73163 - RNA, 32 nt, Human
auugcaggcaugagccacuucgccuagccaag

SEQ ID NO: 73164 - RNA, 32 nt, Human
auugcaggccugagccaccgcgcccggccccu

SEQ ID NO: 73165 - RNA, 32 nt, Human
auugcaggcgugagccaccacacccggcccac

SEQ ID NO: 73166 - RNA, 32 nt, Human
auugcaggcgugagccaccacgcccggccucc

SEQ ID NO: 73167 - RNA, 32 nt, Human
auugcaggcgugagccaccaugcccggcucuc

SEQ ID NO: 73168 - RNA, 32 nt, Human
auugcaggcgugagccaccaugccuggccaga

SEQ ID NO: 73169 - RNA, 32 nt, Human
auugcaggcgugagccaccgcgcccggccugc

SEQ ID NO: 73170 - RNA, 32 nt, Human
auugcaggcgugagccacugcacccagccucu

SEQ ID NO: 73171 - RNA, 32 nt, Human
auugcaggcgugagccacugcuccuggcuuga

SEQ ID NO: 73172 - RNA, 32 nt, Human
auugcaggcgugagccacuuucccagccucuc

SEQ ID NO: 73173 - RNA, 32 nt, Human
auugcaggcuuagucguggcuacuguucuccu

SEQ ID NO: 73174 - RNA, 32 nt, Human
auugcaggggccucugggugccuuguccgggc

SEQ ID NO: 73175 - RNA, 32 nt, Human
auugcaggucugagacaguggaggcuuagugg

SEQ ID NO: 73176 - RNA, 32 nt, Human
auugcaggugcccaccaccacgcccagcuaau

SEQ ID NO: 73177 - RNA, 32 nt, Human
auugcaggugugagccaccacacccagccaug

SEQ ID NO: 73178 - RNA, 32 nt, Human
auugcaggugugagccaccacgcccagccuag

SEQ ID NO: 73179 - RNA, 32 nt, Human
auugcaggugugagccaccgcacccagccuca

SEQ ID NO: 73180 - RNA, 32 nt, Human
auugcaggugugagccacugcacccggcccuu

SEQ ID NO: 73181 - RNA, 32 nt, Human
auugcaggugugagccacugcgccuggccuaa

SEQ ID NO: 73182 - RNA, 32 nt, Human
auugcaggugugagccacugugccuggcuggc

SEQ ID NO: 73183 - RNA, 32 nt, Human
auugcaggugugagccagugcacccggccgua

SEQ ID NO: 73184 - RNA, 32 nt, Human
auugcagucuugaaaauccugagagcuaaaaa

SEQ ID NO: 73185 - RNA, 32 nt, Human
auugcagugagcugagauugcaccacugcacu

SEQ ID NO: 73186 - RNA, 32 nt, Human
auugcagugagcugagauugcgccacugcacu

SEQ ID NO: 73187 - RNA, 32 nt, Human
auugcagugagcugauaucgcaccauuguacu

SEQ ID NO: 73188 - RNA, 32 nt, Human
auugcaguuuucugccgcaaccccugagccga

SEQ ID NO: 73189 - RNA, 32 nt, Human
auugcauagccuugcuuucuugaacuaaacug

SEQ ID NO: 73190 - RNA, 32 nt, Human
auugcauagccuuguccuccugugugccugag

SEQ ID NO: 73191 - RNA, 32 nt, Human
auugcauagguuuagagagagcgacgugugac

SEQ ID NO: 73192 - RNA, 32 nt, Human
auugcauauagcuugguuuccauaacauagag

SEQ ID NO: 73193 - RNA, 32 nt, Human
auugcaucacccuccuccucugcccagaccug

SEQ ID NO: 73194 - RNA, 32 nt, Human
auugcaucacugcacuccaaccugggcaacag

SEQ ID NO: 73195 - RNA, 32 nt, Human
auugcaucacugcacuccagccugggcgaugg

SEQ ID NO: 73196 - RNA, 32 nt, Human
auugcaucacugcacuccagccugggugacag

SEQ ID NO: 73197 - RNA, 32 nt, Human
auugcaucacugcacuccagcuugggugacag

SEQ ID NO: 73198 - RNA, 32 nt, Human
auugcaucacugcacugcagccugggcaacau

SEQ ID NO: 73199 - RNA, 32 nt, Human
auugcaucaguauuuccuauuggaaaauacau

SEQ ID NO: 73200 - RNA, 32 nt, Human
auugcaucauugcacuccagccugggcaacaa

SEQ ID NO: 73201 - RNA, 32 nt, Human
auugcaucauugcacuccagccugggcaacag

SEQ ID NO: 73202 - RNA, 32 nt, Human
auugcaucuugaccaggcacaguggcucaugc

SEQ ID NO: 73203 - RNA, 31 nt, Human
auugcaugauuuucuuuacuuuugaaguaaa

SEQ ID NO: 73204 - RNA, 32 nt, Human
auugcaugcaggaagagaagaaggaagaggag

SEQ ID NO: 73205 - RNA, 32 nt, Human
auugcaugcuuccuccuuugcucuugggaaga

SEQ ID NO: 73206 - RNA, 32 nt, Human
auugcauggcugcacucuagccugggugacag

SEQ ID NO: 73207 - RNA, 32 nt, Human
auugcauguggaggucuccagcucaggaaagu

SEQ ID NO: 73208 - RNA, 32 nt, Human
auugcauguguaguuugagcacagaucccaaa

SEQ ID NO: 73209 - RNA, 32 nt, Human
auugcauuccaagugagcugugcucagcagug

SEQ ID NO: 73210 - RNA, 32 nt, Human
auugcauuccagccuaggcaacagagugagac

SEQ ID NO: 73211 - RNA, 32 nt, Human
auugcauugcacuccagcuugagcaacagagg

SEQ ID NO: 73212 - RNA, 32 nt, Human
auugcauugcauucagaguaaccugugugcau

SEQ ID NO: 73213 - RNA, 32 nt, Human
auugcauugguguuuucacccaauuguuaagu

SEQ ID NO: 73214 - RNA, 32 nt, Human
auugcauuuccaaaguagcaucuugcuagacc

SEQ ID NO: 73215 - RNA, 32 nt, Human
auugccaaaaccagcaaguacacagaguccug

SEQ ID NO: 73216 - RNA, 32 nt, Human
auugccaaaaugugauaggaaaccuacucauu

SEQ ID NO: 73217 - RNA, 32 nt, Human
auugccaaaguaguauuuucauaacuuucuug

SEQ ID NO: 73218 - RNA, 32 nt, Human
auugccaacuauacgaauggcuucgaggagau

SEQ ID NO: 73219 - RNA, 32 nt, Human
auugccaagaauuacugucaagagaaaugaua

SEQ ID NO: 73220 - RNA, 32 nt, Human
auugccaagcuuccagcugccucuucuccuaa

SEQ ID NO: 73221 - RNA, 32 nt, Human
auugccacagcaccuggauucaugauugggca

SEQ ID NO: 73222 - RNA, 22 nt, Human
auugccaccaucuuggagcuca

SEQ ID NO: 73223 - RNA, 32 nt, Human
auugccacgugugcacuuacuacucuccagua

SEQ ID NO: 73224 - RNA, 32 nt, Human
auugccacugcacuccagccuaagcaaauagc

SEQ ID NO: 73225 - RNA, 32 nt, Human
auugccacugcacuccagccugggcaacaaga

SEQ ID NO: 73226 - RNA, 32 nt, Human
auugccagacuggagugcaguggcgugaucuc

SEQ ID NO: 73227 - RNA, 32 nt, Human
auugccagccgggcccgccaggcccaggagcg

SEQ ID NO: 73228 - RNA, 32 nt, Human
auugccagccugggugacagagcaagaccuug

SEQ ID NO: 73229 - RNA, 32 nt, Human
auugccagcuacucggaaggcugaggcaggag

SEQ ID NO: 73230 - RNA, 32 nt, Human
auugccaggcagaauuaaugagcucaguucua

SEQ ID NO: 73231 - RNA, 32 nt, Human
auugccagggccugagcucugaugguccagga

SEQ ID NO: 73232 - RNA, 32 nt, Human
auugccagguaguucuuggcacuggcaccugg

SEQ ID NO: 73233 - RNA, 32 nt, Human
auugccaguagccugcaauaucuuuccuuccu

SEQ ID NO: 73234 - RNA, 32 nt, Human
auugccaguggggugggcagugcaguggggug

SEQ ID NO: 73235 - RNA, 32 nt, Human
auugccauccccucccuucuuuaaaugcaaag

SEQ ID NO: 73236 - RNA, 32 nt, Human
auugccaucuccauuccucugcccucuugagc

SEQ ID NO: 73237 - RNA, 32 nt, Human
auugccaugaaugcuaguuacaggguagaaag

SEQ ID NO: 73238 - RNA, 32 nt, Human
auugccauuccuccccuccaagagguaacaau

SEQ ID NO: 73239 - RNA, 32 nt, Human
auugccauuccuccccuccagagguaacaauu

SEQ ID NO: 73240 - RNA, 32 nt, Human
auugcccaaagauuucucaaggccugugaaga

SEQ ID NO: 73241 - RNA, 32 nt, Human
auugcccaagccggucucaaacuccugagcuc

SEQ ID NO: 73242 - RNA, 32 nt, Human
auugcccacugcacuccagccugggcaacaga

SEQ ID NO: 73243 - RNA, 32 nt, Human
auugcccacuucuguguagacaugguucuggu

SEQ ID NO: 73244 - RNA, 19 nt, Human
auugcccagccucagugca

SEQ ID NO: 73245 - RNA, 32 nt, Human
auugcccaggaucaagggugcgguguuggggg

SEQ ID NO: 73246 - RNA, 31 nt, Human
auugcccaggcugcucucacauuccuagccu

SEQ ID NO: 73247 - RNA, 22 nt, Human
auugcccaggcuggaguacaau

SEQ ID NO: 73248 - RNA, 32 nt, Human
auugcccaggcuggagugcagugagcuauuac

SEQ ID NO: 73249 - RNA, 32 nt, Human
auugcccagugccuucuguuucccaggcagcu

SEQ ID NO: 73250 - RNA, 32 nt, Human
auugcccagugcugccagagugagugagugua

SEQ ID NO: 73251 - RNA, 32 nt, Human
auugcccaugcacuuguugcagaaacagccaa

SEQ ID NO: 73252 - RNA, 32 nt, Human
auugccccacugcacuccacccugggcaaugg

SEQ ID NO: 73253 - RNA, 32 nt, Human
auugccccacugcacuccagccuaggcaacag

SEQ ID NO: 73254 - RNA, 32 nt, Human
auugccccagaacaaacagugaaauuauuaca

SEQ ID NO: 73255 - RNA, 32 nt, Human
auugccccaggaggacaccagauacagacuuc

SEQ ID NO: 73256 - RNA, 32 nt, Human
auugccccaggucuuuuccuuuuggauuuugu

SEQ ID NO: 73257 - RNA, 32 nt, Human
auugcccccggcccgcagcccaguguccugcu

SEQ ID NO: 73258 - RNA, 32 nt, Human
auugcccccugagauggccugucuucuggggu

SEQ ID NO: 73259 - RNA, 32 nt, Human
auugcccccugccugcugcuccugucacagac

SEQ ID NO: 73260 - RNA, 32 nt, Human
auugccccgugccuucaggcagucuccugggg

SEQ ID NO: 73261 - RNA, 32 nt, Human
auugccccucugccuugcccuccugggcccug

SEQ ID NO: 73262 - RNA, 32 nt, Human
auugccccugcccugcucaccaccugucacag

SEQ ID NO: 73263 - RNA, 32 nt, Human
auugccccuuucaggggaccccacuuuguagg

SEQ ID NO: 73264 - RNA, 32 nt, Human
auugccccuuucucgucccccuuuucuuccuc

SEQ ID NO: 73265 - RNA, 32 nt, Human
auugcccggcgccuggacagugaucaucuugu

SEQ ID NO: 73266 - RNA, 32 nt, Human
auugcccuccagguauccucagucuuucugcu

SEQ ID NO: 73267 - RNA, 32 nt, Human
auugcccuccccaccauccaucauagccaggc

SEQ ID NO: 73268 - RNA, 32 nt, Human
auugcccucucccccgccucuucugagcuguc

SEQ ID NO: 73269 - RNA, 32 nt, Human
auugcccugcaggcuggagugcagcggcauga

SEQ ID NO: 73270 - RNA, 32 nt, Human
auugcccugccucugucccccuuuaaacguug

SEQ ID NO: 73271 - RNA, 32 nt, Human
auugcccugggacucuggaggggccaggguac

SEQ ID NO: 73272 - RNA, 32 nt, Human
auugcccuggugagccaggucuugccgguuua

SEQ ID NO: 73273 - RNA, 32 nt, Human
auugcccuuauuccuccaccccacuucuuuua

SEQ ID NO: 73274 - RNA, 32 nt, Human
auugcccuuccucaccagcaaucugcacuuuc

SEQ ID NO: 73275 - RNA, 32 nt, Human
auugcccuuccugcuuucuuccuccaacagcu

SEQ ID NO: 73276 - RNA, 32 nt, Human
auugccggccccggacgggugaggagaacugc

SEQ ID NO: 73277 - RNA, 32 nt, Human
auugccgggauuacaggcaugagccacugugu

SEQ ID NO: 73278 - RNA, 32 nt, Human
auugccguggugcuuggcauugaggggcugca

SEQ ID NO: 73279 - RNA, 32 nt, Human
auugccuaaagaggaaggaccaaggagaugaa

SEQ ID NO: 73280 - RNA, 32 nt, Human
auugccuacaaagacaaauaccaggcuuucuc

SEQ ID NO: 73281 - RNA, 32 nt, Human
auugccuaccacauguuaugggcugaauaaug

SEQ ID NO: 73282 - RNA, 32 nt, Human
auugccuaucgccaagcaaaucgaggccauca

SEQ ID NO: 73283 - RNA, 32 nt, Human
auugccuauggcaggauucuuucuugaauuaa

SEQ ID NO: 73284 - RNA, 32 nt, Human
auugccucagccaagucucccaccucucugcu

SEQ ID NO: 73285 - RNA, 32 nt, Human
auugccucagcuccucccccucaggcugggag

SEQ ID NO: 73286 - RNA, 32 nt, Human
auugccucauuucuccacuaauacuuagcaaa

SEQ ID NO: 73287 - RNA, 32 nt, Human
auugccuccagccugaguccuaggcucuaaaa

SEQ ID NO: 73288 - RNA, 32 nt, Human
auugccuccucagcacucccuccugggaggcc

SEQ ID NO: 73289 - RNA, 32 nt, Human
auugccuccugccagagaugguuuccaaguug

SEQ ID NO: 73290 - RNA, 32 nt, Human
auugccucuccccucucccauuuucucucuug

SEQ ID NO: 73291 - RNA, 32 nt, Human
auugccucugaccuuuuauaagacaguuuauc

SEQ ID NO: 73292 - RNA, 32 nt, Human
auugccucuuucucagaauccucuuuccuccc

SEQ ID NO: 73293 - RNA, 32 nt, Human
auugccugaacccaggaggcggagguugcagu

SEQ ID NO: 73294 - RNA, 32 nt, Human
auugccugaacccaggagguggagguugcagu

SEQ ID NO: 73295 - RNA, 32 nt, Human
auugccugagaccaggagguugaggcugcagu

SEQ ID NO: 73296 - RNA, 32 nt, Human
auugccugagccugggaaguggaaguugcagu

SEQ ID NO: 73297 - RNA, 32 nt, Human
auugccugaggucaggaguuugagacuagucu

SEQ ID NO: 73298 - RNA, 32 nt, Human
auugccugaggucaggaguuugagacuauccu

SEQ ID NO: 73299 - RNA, 32 nt, Human
auugccugccuaccccaugccugcugcagaaa

SEQ ID NO: 73300 - RNA, 32 nt, Human
auugccugccucugcugcgucuuugcccacug

SEQ ID NO: 73301 - RNA, 23 nt, Human
auugccugccuuagaaacuggcu

SEQ ID NO: 73302 - RNA, 32 nt, Human
auugccuggaaccuucuucuagcauaaaugaa

SEQ ID NO: 73303 - RNA, 32 nt, Human
auugccuggaagcaaauuucaggccuucuuua

SEQ ID NO: 73304 - RNA, 32 nt, Human
auugccuggcuaaugagaaccccugguucuca

SEQ ID NO: 73305 - RNA, 32 nt, Human
auugccuggggaacuagccacacaggaggccg

SEQ ID NO: 73306 - RNA, 32 nt, Human
auugccuguaaucccagcuacuagggaggcug

SEQ ID NO: 73307 - RNA, 32 nt, Human
auugccuguagucccagcuacuugggaggcug

SEQ ID NO: 73308 - RNA, 32 nt, Human
auugccuguguguugcacuggagcacagagga

SEQ ID NO: 73309 - RNA, 32 nt, Human
auugccuguuuuccccuuccuuaucuucucuc

SEQ ID NO: 73310 - RNA, 32 nt, Human
auugccuuaaauagccucucuccccauuuagg

SEQ ID NO: 73311 - RNA, 32 nt, Human
auugccuuaucucuccccaucuagccaggaau

SEQ ID NO: 73312 - RNA, 32 nt, Human
auugccuuaugagaucauccucauguuaaacc

SEQ ID NO: 73313 - RNA, 32 nt, Human
auugccuuccuauuuugcauaauaaaugcuuc

SEQ ID NO: 73314 - RNA, 32 nt, Human
auugccuucucccuuccuguucccucaucccu

SEQ ID NO: 73315 - RNA, 32 nt, Human
auugccuucuuugaagaagguggaccuuuuaa

SEQ ID NO: 73316 - RNA, 32 nt, Human
auugccuuguaggccccagagcaaucggggaa

SEQ ID NO: 73317 - RNA, 32 nt, Human
auugccuuucuuuuccccuccuccuuuguauu

SEQ ID NO: 73318 - RNA, 32 nt, Human
auugccuuuggcaauucuucuucucaagcacu

SEQ ID NO: 73319 - RNA, 32 nt, Human
auugccuuuuaccugagggaauaaagacuucu

SEQ ID NO: 73320 - RNA, 32 nt, Human
auugccuuuuccaggaaagggaagaaaacacu

SEQ ID NO: 73321 - RNA, 32 nt, Human
auugcgacaggagggaaauggcggcucugcaa

SEQ ID NO: 73322 - RNA, 32 nt, Human
auugcgcaaaacugaaaggcaugugaagggaa

SEQ ID NO: 73323 - RNA, 32 nt, Human
auugcgccacagcauuccagccugggcgaugg

SEQ ID NO: 73324 - RNA, 32 nt, Human
auugcgccaccacacuccagccugggcaacag

SEQ ID NO: 73325 - RNA, 32 nt, Human
auugcgccaccacugcacuccagccugggcaa

SEQ ID NO: 73326 - RNA, 32 nt, Human
auugcgccaccgcacuccagccugggcaacag

SEQ ID NO: 73327 - RNA, 32 nt, Human
auugcgccaccgcacuccagccugggcgacag

SEQ ID NO: 73328 - RNA, 32 nt, Human
auugcgccacugcaaaccagccugggcaauag

SEQ ID NO: 73329 - RNA, 32 nt, Human
auugcgccacugcacaccagucuggagacaga

SEQ ID NO: 73330 - RNA, 32 nt, Human
auugcgccacugcacacuagcuugggugacag

SEQ ID NO: 73331 - RNA, 32 nt, Human
auugcgccacugcaccccagcccagugacagg

SEQ ID NO: 73332 - RNA, 32 nt, Human
auugcgccacugcaccccagcccgggugacag

SEQ ID NO: 73333 - RNA, 32 nt, Human
auugcgccacugcaccccagccuggacaacag

SEQ ID NO: 73334 - RNA, 32 nt, Human
auugcgccacugcaccccagccugggcgacag

SEQ ID NO: 73335 - RNA, 32 nt, Human
auugcgccacugcaccccagccugggugacag

SEQ ID NO: 73336 - RNA, 32 nt, Human
auugcgccacugcacucaagucugggcgacag

SEQ ID NO: 73337 - RNA, 32 nt, Human
auugcgccacugcacuccaaccugggcaauag

SEQ ID NO: 73338 - RNA, 32 nt, Human
auugcgccacugcacuccacccugggugacag

SEQ ID NO: 73339 - RNA, 23 nt, Human
auugcgccacugcacuccagcca

SEQ ID NO: 73340 - RNA, 32 nt, Human
auugcgccacugcacuccagccagggcgaagg

SEQ ID NO: 73341 - RNA, 32 nt, Human
auugcgccacugcacuccagccuaggugauag

SEQ ID NO: 73342 - RNA, 32 nt, Human
auugcgccacugcacuccagccugacgacaaa

SEQ ID NO: 73343 - RNA, 32 nt, Human
auugcgccacugcacuccagccugagcgacag

SEQ ID NO: 73344 - RNA, 32 nt, Human
auugcgccacugcacuccagccuggcgacaga

SEQ ID NO: 73345 - RNA, 32 nt, Human
auugcgccacugcacuccagccugggagacag

SEQ ID NO: 73346 - RNA, 32 nt, Human
auugcgccacugcacuccagccugggcaacaa

SEQ ID NO: 73347 - RNA, 32 nt, Human
auugcgccacugcacuccagccugggcaacag

SEQ ID NO: 73348 - RNA, 32 nt, Human
auugcgccacugcacuccagccugggcaauag

SEQ ID NO: 73349 - RNA, 32 nt, Human
auugcgccacugcacuccagccugggcagcag

SEQ ID NO: 73350 - RNA, 32 nt, Human
auugcgccacugcacuccagccugggcgacag

SEQ ID NO: 73351 - RNA, 32 nt, Human
auugcgccacugcacuccagccugggcgacgg

SEQ ID NO: 73352 - RNA, 32 nt, Human
auugcgccacugcacuccagccugggcuacag

SEQ ID NO: 73353 - RNA, 32 nt, Human
auugcgccacugcacuccagccugggggacag

SEQ ID NO: 73354 - RNA, 32 nt, Human
auugcgccacugcacuccagccuggguaacag

SEQ ID NO: 73355 - RNA, 32 nt, Human
auugcgccacugcacuccagccugggugacag

SEQ ID NO: 73356 - RNA, 32 nt, Human
auugcgccacugcacuccagccugggugacug

SEQ ID NO: 73357 - RNA, 32 nt, Human
auugcgccacugcacuccagccugguugacag

SEQ ID NO: 73358 - RNA, 32 nt, Human
auugcgccacugcacuccagcgcggaagacag

SEQ ID NO: 73359 - RNA, 32 nt, Human
auugcgccacugcacuccagcgugggcuacag

SEQ ID NO: 73360 - RNA, 32 nt, Human
auugcgccacugcacuccagucugggcgacag

SEQ ID NO: 73361 - RNA, 32 nt, Human
auugcgccacugcacuccagucuggucggcaa

SEQ ID NO: 73362 - RNA, 32 nt, Human
auugcgccacugcacuucagccuggaugacag

SEQ ID NO: 73363 - RNA, 32 nt, Human
auugcgccacugcacuucagccugggcaacag

SEQ ID NO: 73364 - RNA, 32 nt, Human
auugcgccacugcaguccgcaguccggccugg

SEQ ID NO: 73365 - RNA, 32 nt, Human
auugcgccacugcaguccgcagucuggccugg

SEQ ID NO: 73366 - RNA, 32 nt, Human
auugcgccacugcauuccagccugggugacug

SEQ ID NO: 73367 - RNA, 32 nt, Human
auugcgccacugcauuccagcuugggcgacag

SEQ ID NO: 73368 - RNA, 32 nt, Human
auugcgccacugcauucuagccuggaugacag

SEQ ID NO: 73369 - RNA, 32 nt, Human
auugcgccacugcccucuagccuagacgacag

SEQ ID NO: 73370 - RNA, 32 nt, Human
auugcgccacugcgcuccagccugggcaacag

SEQ ID NO: 73371 - RNA, 32 nt, Human
auugcgccacuguacuccagccuggcaacaga

SEQ ID NO: 73372 - RNA, 32 nt, Human
auugcgccacuguacuccagccugggugacga

SEQ ID NO: 73373 - RNA, 32 nt, Human
auugcgccacuguacuccagcuugggcaacag

SEQ ID NO: 73374 - RNA, 32 nt, Human
auugcgccacuucacuccagccugggugacag

SEQ ID NO: 73375 - RNA, 32 nt, Human
auugcgccagugcacuccagcugggcgacaga

SEQ ID NO: 73376 - RNA, 32 nt, Human
auugcgccauugcacuccagccuagguaacaa

SEQ ID NO: 73377 - RNA, 32 nt, Human
auugcgccauugcacuccagccugggcaaaaa

SEQ ID NO: 73378 - RNA, 32 nt, Human
auugcgccauugcacuccagccugggcaacaa

SEQ ID NO: 73379 - RNA, 32 nt, Human
auugcgccauugcacuccagccugggcaacac

SEQ ID NO: 73380 - RNA, 32 nt, Human
auugcgccauugcacuccagccugggcaacag

SEQ ID NO: 73381 - RNA, 32 nt, Human
auugcgccauugcacuccagccugggcaacga

SEQ ID NO: 73382 - RNA, 32 nt, Human
auugcgccauugcacuccagccuggggacaaa

SEQ ID NO: 73383 - RNA, 32 nt, Human
auugcgccauugcacucuagccugugugacag

SEQ ID NO: 73384 - RNA, 32 nt, Human
auugcgccauugcauuccagccugggcaacaa

SEQ ID NO: 73385 - RNA, 32 nt, Human
auugcgccauugcauuccagccugggugacag

SEQ ID NO: 73386 - RNA, 32 nt, Human
auugcgccauuguacuccagccugggcaacaa

SEQ ID NO: 73387 - RNA, 32 nt, Human
auugcgccauuguacuccagccugggggacag

SEQ ID NO: 73388 - RNA, 32 nt, Human
auugcgccauugugcuccagccugggugacaa

SEQ ID NO: 73389 - RNA, 32 nt, Human
auugcgcccccugcacuccagccugggcuuca

SEQ ID NO: 73390 - RNA, 32 nt, Human
auugcgccccugcacuccaaccuggacaacac

SEQ ID NO: 73391 - RNA, 32 nt, Human
auugcgccgcugcacuccagccugggcaacag

SEQ ID NO: 73392 - RNA, 32 nt, Human
auugcgccgcugcacuccagccugggcgacag

SEQ ID NO: 73393 - RNA, 32 nt, Human
auugcgccguuguacuccagccugggcaacag

SEQ ID NO: 73394 - RNA, 32 nt, Human
auugcgccucgaggcuccgaucgggcuaggcc

SEQ ID NO: 73395 - RNA, 32 nt, Human
auugcgcuacuacgcuacagccugggugacag

SEQ ID NO: 73396 - RNA, 32 nt, Human
auugcgcuacugaacuccagccuggguuacag

SEQ ID NO: 73397 - RNA, 32 nt, Human
auugcgcuacugcacuccagccuaggcaacag

SEQ ID NO: 73398 - RNA, 32 nt, Human
auugcgcuacugcacuccagccugggcgacag

SEQ ID NO: 73399 - RNA, 32 nt, Human
auugcgcuacugcacuccagccugggugacag

SEQ ID NO: 73400 - RNA, 32 nt, Human
auugcgcucagguuauguuccuuuuaccuccu

SEQ ID NO: 73401 - RNA, 32 nt, Human
auugcggagaaguugcuucugccgcucagaag

SEQ ID NO: 73402 - RNA, 32 nt, Human
auugcggaucacugucuaacauuugacuucuu

SEQ ID NO: 73403 - RNA, 32 nt, Human
auugcggaucacuguuuaacauuugacuucuu

SEQ ID NO: 73404 - RNA, 32 nt, Human
auugcggcuuucugucucuggugugaacaggc

SEQ ID NO: 73405 - RNA, 31 nt, Human
auugcgggaaaaggaacuugauuuaacagaa

SEQ ID NO: 73406 - RNA, 32 nt, Human
auugcggggagacagcucucucucccaccucc

SEQ ID NO: 73407 - RNA, 32 nt, Human
auugcgggggccugggcuagcugcuggcuacc

SEQ ID NO: 73408 - RNA, 32 nt, Human
auugcggguccccacaugcacacagaacucug

SEQ ID NO: 73409 - RNA, 32 nt, Human
auugcggugagccgggauugcgccagugcacu

SEQ ID NO: 73410 - RNA, 32 nt, Human
auugcguaguugaaagaaaaagugauccuguc

SEQ ID NO: 73411 - RNA, 32 nt, Human
auugcgucacugcacuccaaccugggugacag

SEQ ID NO: 73412 - RNA, 32 nt, Human
auugcgucacugcacuccagccugggcgacag

SEQ ID NO: 73413 - RNA, 32 nt, Human
auugcgucacugcacugcagccugggugacag

SEQ ID NO: 73414 - RNA, 32 nt, Human
auugcgucucagagaccaucuuuggagaaugg

SEQ ID NO: 73415 - RNA, 32 nt, Human
auugcgugaugagcuauuguucuggcuguuaa

SEQ ID NO: 73416 - RNA, 32 nt, Human
auugcuaaagcccacagcccccaguguggguu

SEQ ID NO: 73417 - RNA, 32 nt, Human
auugcuaaaugaugcauaguauuuuagucuac

SEQ ID NO: 73418 - RNA, 32 nt, Human
auugcuaacauggugaaaccccgucucuacua

SEQ ID NO: 73419 - RNA, 32 nt, Human
auugcuaacuagaauaaccacuuuagagaaga

SEQ ID NO: 73420 - RNA, 32 nt, Human
auugcuacagcaucuaguguacugagccugcg

SEQ ID NO: 73421 - RNA, 32 nt, Human
auugcuacuaugugaaacuuucacaugcaacc

SEQ ID NO: 73422 - RNA, 32 nt, Human
auugcuaguuucaugcuuccuccucugauuuu

SEQ ID NO: 73423 - RNA, 32 nt, Human
auugcuauaagaaaaguuacaagggaaaguuu

SEQ ID NO: 73424 - RNA, 32 nt, Human
auugcuauacugcuuaguuuuaacugguuuau

SEQ ID NO: 73425 - RNA, 32 nt, Human
auugcuauuagucuacauguauuucuguaaua

SEQ ID NO: 73426 - RNA, 32 nt, Human
auugcucaaucaccagccuuugcgaggaguug

SEQ ID NO: 73427 - RNA, 32 nt, Human
auugcucaaugccacuguccaaguuacgacuu

SEQ ID NO: 73428 - RNA, 32 nt, Human
auugcucacccagacaccaugugcaaugacau

SEQ ID NO: 73429 - RNA, 32 nt, Human
auugcucagaacuuaaguaagcaugccaacau

SEQ ID NO: 73430 - RNA, 32 nt, Human
auugcucagagaagguaaaagacugaaucuac

SEQ ID NO: 73431 - RNA, 32 nt, Human
auugcucagccaggcuguggagcagcugaggc

SEQ ID NO: 73432 - RNA, 32 nt, Human
auugcucaggcauuauuccagcaguagauagu

SEQ ID NO: 73433 - RNA, 24 nt, Human
auugcuccacuguucaccaaggaa

SEQ ID NO: 73434 - RNA, 24 nt, Human
auugcuccaggccuccgagccuca

SEQ ID NO: 73435 - RNA, 32 nt, Human
auugcuccauugcacuccagccugggcaacga

SEQ ID NO: 73436 - RNA, 32 nt, Human
auugcuccauugcacuccagccugggcgauag

SEQ ID NO: 73437 - RNA, 32 nt, Human
auugcucccagucuacuaaagcagaaagaaaa

SEQ ID NO: 73438 - RNA, 32 nt, Human
auugcuccccucucccugccacccuuccccag

SEQ ID NO: 73439 - RNA, 32 nt, Human
auugcucucaaggaucuaguggauuaguaagu

SEQ ID NO: 73440 - RNA, 32 nt, Human
auugcucuccacuguauccccucuaccuggca

SEQ ID NO: 73441 - RNA, 32 nt, Human
auugcucucccucgugcuccccaaaucaccac

SEQ ID NO: 73442 - RNA, 32 nt, Human
auugcucucuauacuaggauagacuuuaucua

SEQ ID NO: 73443 - RNA, 32 nt, Human
auugcucucucaucuugccuccagucagaugu

SEQ ID NO: 73444 - RNA, 32 nt, Human
auugcucugaaauuuaucuuaaaagagcuugc

SEQ ID NO: 73445 - RNA, 22 nt, Human
auugcucugauaaaaaauagcu

SEQ ID NO: 73446 - RNA, 32 nt, Human
auugcucugucgcccaggcuggaaugcagugg

SEQ ID NO: 73447 - RNA, 32 nt, Human
auugcucuguguacauuuaauucuucagugug

SEQ ID NO: 73448 - RNA, 32 nt, Human
auugcucuguugcccaggcuagagugcagugg

SEQ ID NO: 73449 - RNA, 32 nt, Human
auugcucuguugcccaggcuggaguacagugg

SEQ ID NO: 73450 - RNA, 32 nt, Human
auugcucuguugcccaggcuggagugcagugg

SEQ ID NO: 73451 - RNA, 24 nt, Human
auugcugaaaaguggaaauucggu

SEQ ID NO: 73452 - RNA, 32 nt, Human
auugcugaagacacaguggauauuuugggcca

SEQ ID NO: 73453 - RNA, 31 nt, Human
auugcugaagagagagacaaaagacugccaa

SEQ ID NO: 73454 - RNA, 32 nt, Human
auugcugacacuuuccccuugugaaacuguau

SEQ ID NO: 73455 - RNA, 22 nt, Human
auugcugacaucuuggagcuca

SEQ ID NO: 73456 - RNA, 32 nt, Human
auugcugagcuuaugccaggagcaucaggcug

SEQ ID NO: 73457 - RNA, 32 nt, Human
auugcugaggagaagcaggaaaccuguuuccu

SEQ ID NO: 73458 - RNA, 32 nt, Human
auugcugaggagaguggaggccaggcuggggu

SEQ ID NO: 73459 - RNA, 32 nt, Human
auugcugaggaggcggcggguagcuggcaggc

SEQ ID NO: 73460 - RNA, 32 nt, Human
auugcugauacuugaauaaucaaucucuacua

SEQ ID NO: 73461 - RNA, 32 nt, Human
auugcugauuuacacuggaucuugccuuagaa

SEQ ID NO: 73462 - RNA, 32 nt, Human
auugcugcaccucaucaggccauuacauuguc

SEQ ID NO: 73463 - RNA, 32 nt, Human
auugcugcacuccuguaacaaacauuauuuuu

SEQ ID NO: 73464 - RNA, 32 nt, Human
auugcugcacuuuggaaagucaaaaucaagug

SEQ ID NO: 73465 - RNA, 32 nt, Human
auugcugcaguuuccaccacucuuauacagga

SEQ ID NO: 73466 - RNA, 32 nt, Human
auugcugccuacgauaugcaggcugcacagaa

SEQ ID NO: 73467 - RNA, 32 nt, Human
auugcugccuuucuaaaaacccaaaauguagu

SEQ ID NO: 73468 - RNA, 32 nt, Human
auugcugccuuuguugaggugcaaggagugua

SEQ ID NO: 73469 - RNA, 32 nt, Human
auugcugcuagugccgugagcaccgcccagcc

SEQ ID NO: 73470 - RNA, 32 nt, Human
auugcugcugcuuaaauggcaggccaacuggu

SEQ ID NO: 73471 - RNA, 32 nt, Human
auugcugcuucuccaacucuugcuuggggcca

SEQ ID NO: 73472 - RNA, 32 nt, Human
auugcugcuugguucccaccucagagguucug

SEQ ID NO: 73473 - RNA, 32 nt, Human
auugcuggagagaacgcggcgauggagccggg

SEQ ID NO: 73474 - RNA, 32 nt, Human
auugcuggaugcuacacuccaugucucuuugu

SEQ ID NO: 73475 - RNA, 32 nt, Human
auugcuggcggugggagcgccgcccggucuca

SEQ ID NO: 73476 - RNA, 32 nt, Human
auugcugggauuacaggcaugagccaccacac

SEQ ID NO: 73477 - RNA, 32 nt, Human
auugcugggauuacaggcaugagccacugcac

SEQ ID NO: 73478 - RNA, 32 nt, Human
auugcugggauuacaggcgugagccaccacac

SEQ ID NO: 73479 - RNA, 32 nt, Human
auugcugggauuacaggcgugagccauggcgc

SEQ ID NO: 73480 - RNA, 32 nt, Human
auugcugggauuacaggcgugagucaccgugc

SEQ ID NO: 73481 - RNA, 32 nt, Human
auugcugggauuacaggugugagccaccgcac

SEQ ID NO: 73482 - RNA, 32 nt, Human
auugcugggauuacaggugugagccaccgcgc

SEQ ID NO: 73483 - RNA, 22 nt, Human
auugcugggcccagcaccaagg

SEQ ID NO: 73484 - RNA, 23 nt, Human
auugcugggcccuggauauugga

SEQ ID NO: 73485 - RNA, 32 nt, Human
auugcugggcucauggucagaguucccaguua

SEQ ID NO: 73486 - RNA, 32 nt, Human
auugcuggggaagaaacaaacacacaccaaac

SEQ ID NO: 73487 - RNA, 32 nt, Human
auugcuggguggaaauauucagaugcugcuua

SEQ ID NO: 73488 - RNA, 32 nt, Human
auugcuggguuuacaggcaugagccaccacgc

SEQ ID NO: 73489 - RNA, 32 nt, Human
auugcuguaaaaauaggauggcgaguuugugu

SEQ ID NO: 73490 - RNA, 32 nt, Human
auugcuguagcagauucuguucugccugcugc

SEQ ID NO: 73491 - RNA, 32 nt, Human
auugcuguaguuuggauuaacuccccucccgc

SEQ ID NO: 73492 - RNA, 32 nt, Human
auugcuguauuguuaaugaaacagguguaauc

SEQ ID NO: 73493 - RNA, 32 nt, Human
auugcugucagauuaauuccaugaucacuaaa

SEQ ID NO: 73494 - RNA, 32 nt, Human
auugcugugaagauuagugaaauaaugcaugu

SEQ ID NO: 73495 - RNA, 32 nt, Human
auugcugugagcugauuguccucuaguuucuc

SEQ ID NO: 73496 - RNA, 32 nt, Human
auugcugugaguuccugcauccuggccauggu

SEQ ID NO: 73497 - RNA, 32 nt, Human
auugcugugccucccaaaauuguuuugagcuu

SEQ ID NO: 73498 - RNA, 32 nt, Human
auugcuguggauauguccaggagaccuuagau

SEQ ID NO: 73499 - RNA, 32 nt, Human
auugcugugguguugggcaggucucugucccu

SEQ ID NO: 73500 - RNA, 32 nt, Human
auugcuuaaacccaggaggcaaaggcugcagu

SEQ ID NO: 73501 - RNA, 32 nt, Human
auugcuuaagucugggagguugaggcugcagu

SEQ ID NO: 73502 - RNA, 29 nt, Human
auugcuuaauaaacacauuuugggugauu

SEQ ID NO: 73503 - RNA, 32 nt, Human
auugcuuacuccuuuucuuaucaugcccuggg

SEQ ID NO: 73504 - RNA, 32 nt, Human
auugcuuauggcuaugagauagguugaucucg

SEQ ID NO: 73505 - RNA, 32 nt, Human
auugcuuccuuuucuuuuuccuuuugcgauuu

SEQ ID NO: 73506 - RNA, 32 nt, Human
auugcuucucaagcucuugaaccugaggaugg

SEQ ID NO: 73507 - RNA, 32 nt, Human
auugcuucucaagucuaaccagccucagcagu

SEQ ID NO: 73508 - RNA, 32 nt, Human
auugcuucucggccuuuuggcuaagaucaagu

SEQ ID NO: 73509 - RNA, 32 nt, Human
auugcuucugcucuccucagaggucccgggcu

SEQ ID NO: 73510 - RNA, 32 nt, Human
auugcuucuguacugcucuucuuuugcucuaa

SEQ ID NO: 73511 - RNA, 32 nt, Human
auugcuucuuugccucuccaugaauggccaau

SEQ ID NO: 73512 - RNA, 32 nt, Human
auugcuugaacccaagaggucgaggcugcagu

SEQ ID NO: 73513 - RNA, 32 nt, Human
auugcuugaacccagaagguagagguugcagc

SEQ ID NO: 73514 - RNA, 32 nt, Human
auugcuugaacccaggaagcagagguugcagu

SEQ ID NO: 73515 - RNA, 32 nt, Human
auugcuugaacccaggaagcggagguugcagu

SEQ ID NO: 73516 - RNA, 32 nt, Human
auugcuugaacccaggaaguggcaguugcagu

SEQ ID NO: 73517 - RNA, 32 nt, Human
auugcuugaacccaggagacagagguugcagu

SEQ ID NO: 73518 - RNA, 32 nt, Human
auugcuugaacccaggagacagagguuguagu

SEQ ID NO: 73519 - RNA, 32 nt, Human
auugcuugaacccaggagacggagguugcagu

SEQ ID NO: 73520 - RNA, 32 nt, Human
auugcuugaacccaggagauggaaguugcagu

SEQ ID NO: 73521 - RNA, 32 nt, Human
auugcuugaacccaggagauggagguugcagu

SEQ ID NO: 73522 - RNA, 32 nt, Human
auugcuugaacccaggagauggagguugcggu

SEQ ID NO: 73523 - RNA, 32 nt, Human
auugcuugaacccaggaggaagagguugcagu

SEQ ID NO: 73524 - RNA, 32 nt, Human
auugcuugaacccaggaggagguggagaucgc

SEQ ID NO: 73525 - RNA, 32 nt, Human
auugcuugaacccaggaggcagagauugcggu

SEQ ID NO: 73526 - RNA, 32 nt, Human
auugcuugaacccaggaggcagaggguugcag

SEQ ID NO: 73527 - RNA, 32 nt, Human
auugcuugaacccaggaggcagagguuacagu

SEQ ID NO: 73528 - RNA, 32 nt, Human
auugcuugaacccaggaggcagagguugcagu

SEQ ID NO: 73529 - RNA, 32 nt, Human
auugcuugaacccaggaggcagagguuguagu

SEQ ID NO: 73530 - RNA, 32 nt, Human
auugcuugaacccaggaggcgaagguugcagu

SEQ ID NO: 73531 - RNA, 32 nt, Human
auugcuugaacccaggaggcggagguagcagu

SEQ ID NO: 73532 - RNA, 32 nt, Human
auugcuugaacccaggaggcggagguaguggu

SEQ ID NO: 73533 - RNA, 32 nt, Human
auugcuugaacccaggaggcggagguugcagu

SEQ ID NO: 73534 - RNA, 32 nt, Human
auugcuugaacccaggaggcggagguugcggu

SEQ ID NO: 73535 - RNA, 32 nt, Human
auugcuugaacccaggaggcggagguuguagu

SEQ ID NO: 73536 - RNA, 32 nt, Human
auugcuugaacccaggaggcggaguuugcagu

SEQ ID NO: 73537 - RNA, 32 nt, Human
auugcuugaacccaggaggcggggguugcagu

SEQ ID NO: 73538 - RNA, 32 nt, Human
auugcuugaacccaggaggcugagguugcagu

SEQ ID NO: 73539 - RNA, 32 nt, Human
auugcuugaacccaggagguagaaguugcagu

SEQ ID NO: 73540 - RNA, 32 nt, Human
auugcuugaacccaggagguggagguugcagu

SEQ ID NO: 73541 - RNA, 32 nt, Human
auugcuugaacccaggagguggaguuugcagu

SEQ ID NO: 73542 - RNA, 32 nt, Human
auugcuugaacccaggcaguggagguugcagu

SEQ ID NO: 73543 - RNA, 32 nt, Human
auugcuugaacccagggggcagagguugcagu

SEQ ID NO: 73544 - RNA, 32 nt, Human
auugcuugaacccauaaggcagagguugcagu

SEQ ID NO: 73545 - RNA, 32 nt, Human
auugcuugaacccaugaggcggagguugcagu

SEQ ID NO: 73546 - RNA, 32 nt, Human
auugcuugaacccaugagguggagguugcggu

SEQ ID NO: 73547 - RNA, 32 nt, Human
auugcuugaacccgagaggcggaaguugcagu

SEQ ID NO: 73548 - RNA, 32 nt, Human
auugcuugaacccggaaggcggagguugcagu

SEQ ID NO: 73549 - RNA, 32 nt, Human
auugcuugaacccggaggcagagguugcagug

SEQ ID NO: 73550 - RNA, 32 nt, Human
auugcuugaacccggcaggcagagguugcagu

SEQ ID NO: 73551 - RNA, 32 nt, Human
auugcuugaacccggcgggcagagguugcagu

SEQ ID NO: 73552 - RNA, 32 nt, Human
auugcuugaacccgggagacggagguugcagu

SEQ ID NO: 73553 - RNA, 32 nt, Human
auugcuugaacccgggaggcagagauagcagu

SEQ ID NO: 73554 - RNA, 32 nt, Human
auugcuugaacccgggaggcagaggcuguagu

SEQ ID NO: 73555 - RNA, 32 nt, Human
auugcuugaacccgggaggcagagguugaagu

SEQ ID NO: 73556 - RNA, 32 nt, Human
auugcuugaacccgggaggcagagguugcagc

SEQ ID NO: 73557 - RNA, 32 nt, Human
auugcuugaacccgggaggcagagguugcagu

SEQ ID NO: 73558 - RNA, 32 nt, Human
auugcuugaacccgggaggcagagguugcggu

SEQ ID NO: 73559 - RNA, 32 nt, Human
auugcuugaacccgggaggcggagguugcagu

SEQ ID NO: 73560 - RNA, 32 nt, Human
auugcuugaacccgggaggcggagguugcggu

SEQ ID NO: 73561 - RNA, 32 nt, Human
auugcuugaacccgggaggcggaguuugcagu

SEQ ID NO: 73562 - RNA, 32 nt, Human
auugcuugaacccgggagguagagguugcagu

SEQ ID NO: 73563 - RNA, 32 nt, Human
auugcuugaacccgggagguggaggcugcagu

SEQ ID NO: 73564 - RNA, 32 nt, Human
auugcuugaacccgggagguggaggcugcggu

SEQ ID NO: 73565 - RNA, 32 nt, Human
auugcuugaacccgggagguggagguugcagu

SEQ ID NO: 73566 - RNA, 32 nt, Human
auugcuugaacccgggagguggagguugcggu

SEQ ID NO: 73567 - RNA, 32 nt, Human
auugcuugaacccgggagguggagguuguagu

SEQ ID NO: 73568 - RNA, 32 nt, Human
auugcuugaacccgggcggcggaaguugcagu

SEQ ID NO: 73569 - RNA, 32 nt, Human
auugcuugaacccgggggcagaggcugcagug

SEQ ID NO: 73570 - RNA, 32 nt, Human
auugcuugaacccgugaggcagagguugcagu

SEQ ID NO: 73571 - RNA, 32 nt, Human
auugcuugaacccgugaggcggagguuguagu

SEQ ID NO: 73572 - RNA, 32 nt, Human
auugcuugaacccuggaggcggagauugaagu

SEQ ID NO: 73573 - RNA, 32 nt, Human
auugcuugaacccuggaggcggagguugcagu

SEQ ID NO: 73574 - RNA, 32 nt, Human
auugcuugaacccuggagguggagguugcagu

SEQ ID NO: 73575 - RNA, 32 nt, Human
auugcuugaacccugggaggcagagguugcag

SEQ ID NO: 73576 - RNA, 32 nt, Human
auugcuugagccaggaagguugagguugcagu

SEQ ID NO: 73577 - RNA, 32 nt, Human
auugcuugagcccagaggcggagguugcagug

SEQ ID NO: 73578 - RNA, 32 nt, Human
auugcuugagcccaggagguugaggcugcagu

SEQ ID NO: 73579 - RNA, 32 nt, Human
auugcuugagccugggagguugaggcugcagu

SEQ ID NO: 73580 - RNA, 32 nt, Human
auugcuugagcugaggaguuugagaccagccu

SEQ ID NO: 73581 - RNA, 32 nt, Human
auugcuugaguccaggagguugaggcugcagu

SEQ ID NO: 73582 - RNA, 32 nt, Human
auugcuugagucugcgagguuggggcugccgu

SEQ ID NO: 73583 - RNA, 32 nt, Human
auugcuugauguuuucuuguaugucuacauua

SEQ ID NO: 73584 - RNA, 32 nt, Human
auugcuugcuguucuuuuucauaaucugucuu

SEQ ID NO: 73585 - RNA, 32 nt, Human
auugcuuggacugucuuugaacucugcaccuc

SEQ ID NO: 73586 - RNA, 32 nt, Human
auugcuugucaugggagacuggagugcagauu

SEQ ID NO: 73587 - RNA, 32 nt, Human
auugcuugugcagagggccacaauaaguguau

SEQ ID NO: 73588 - RNA, 32 nt, Human
auugcuuuaauguagacucauaguugaaauua

SEQ ID NO: 73589 - RNA, 32 nt, Human
auugcuuuacagccacaacacuuggauuccug

SEQ ID NO: 73590 - RNA, 32 nt, Human
auugcuuucauuucuuaaaaugcuucacuuca

SEQ ID NO: 73591 - RNA, 32 nt, Human
auugcuuucuuccuccccauuuggacccuucu

SEQ ID NO: 73592 - RNA, 32 nt, Human
auugcuuuguguauuuuguaggguucucuguu

SEQ ID NO: 73593 - RNA, 32 nt, Human
auugcuuuucaggaagaagacauggcagacua

SEQ ID NO: 73594 - RNA, 32 nt, Human
auugcuuuuccuucccuaauucauacaaugaa

SEQ ID NO: 73595 - RNA, 32 nt, Human
auugcuuuugcagcagagaccucagggagaaa

SEQ ID NO: 73596 - RNA, 32 nt, Human
auuggaaaaagcuggccgagaaccauuuauac

SEQ ID NO: 73597 - RNA, 32 nt, Human
auuggaaaagccccaguccucggggagcagau

SEQ ID NO: 73598 - RNA, 32 nt, Human
auuggaaacccagcucacgaaccgcagccagg

SEQ ID NO: 73599 - RNA, 25 nt, Human
auuggaaagauuugcacacccucca

SEQ ID NO: 73600 - RNA, 32 nt, Human
auuggaaagcagccuggccaacauagugggac

SEQ ID NO: 73601 - RNA, 32 nt, Human
auuggaaaucagaacuuugaggugaaggcaga

SEQ ID NO: 73602 - RNA, 32 nt, Human
auuggaacaaggcuucuuaagacauggaugua

SEQ ID NO: 73603 - RNA, 32 nt, Human
auuggaacacccuuuguccuucucggcggggg

SEQ ID NO: 73604 - RNA, 32 nt, Human
auuggaaccaucucaaaauaauuacaaaguuu

SEQ ID NO: 73605 - RNA, 32 nt, Human
auuggaaccaucucaaaauaauuacaaauuuu

SEQ ID NO: 73606 - RNA, 32 nt, Human
auuggaagaacaggagaaaaagaaaagcaaaa

SEQ ID NO: 73607 - RNA, 32 nt, Human
auuggaagagugagcaggacacagaggggagg

SEQ ID NO: 73608 - RNA, 32 nt, Human
auuggaagcaaaugacaucacagcaggucaga

SEQ ID NO: 73609 - RNA, 32 nt, Human
auuggaagcaacuguuuucagcaccuuuuaua

SEQ ID NO: 73610 - RNA, 32 nt, Human
auuggaagcaguauauagaaacuguuucauua

SEQ ID NO: 73611 - RNA, 32 nt, Human
auuggaagcccuugcucuugcacuuugcauua

SEQ ID NO: 73612 - RNA, 32 nt, Human
auuggaagcuguuuaaaugacaccauaucagg

SEQ ID NO: 73613 - RNA, 32 nt, Human
auuggaaggauuuagcuguacuuuaugucuca

SEQ ID NO: 73614 - RNA, 32 nt, Human
auuggaagggagccauccucugggagauugcu

SEQ ID NO: 73615 - RNA, 32 nt, Human
auuggaagguucauuugagaauucuuuccuuc

SEQ ID NO: 73616 - RNA, 32 nt, Human
auuggaauaaggggguggggagagggagagaa

SEQ ID NO: 73617 - RNA, 31 nt, Human
auuggaauacugcagaggaccaaagcugagg

SEQ ID NO: 73618 - RNA, 32 nt, Human
auuggaaucccuuuuccaacguuuucuuuaua

SEQ ID NO: 73619 - RNA, 32 nt, Human
auuggaaugggagagugaugauccaaauagga

SEQ ID NO: 73620 - RNA, 32 nt, Human
auuggaauuagagcaagguauuggacagaacc

SEQ ID NO: 73621 - RNA, 32 nt, Human
auuggaauuaucuaaggugagccccaguuucc

SEQ ID NO: 73622 - RNA, 32 nt, Human
auuggaauuguuggaaaacuuuccugaaacuu

SEQ ID NO: 73623 - RNA, 32 nt, Human
auuggacaacacaggaagucccucuggccacc

SEQ ID NO: 73624 - RNA, 32 nt, Human
auuggacaauuuauaagaacuaugggagcaau

SEQ ID NO: 73625 - RNA, 32 nt, Human
auuggacagaguuuaugaaacagcugugcuuu

SEQ ID NO: 73626 - RNA, 32 nt, Human
auuggacagcuuucacaaguaacaggauuagg

SEQ ID NO: 73627 - RNA, 32 nt, Human
auuggacagguuucucuccagcaagaaagccc

SEQ ID NO: 73628 - RNA, 21 nt, Human
auuggacaguguauccuaaca

SEQ ID NO: 73629 - RNA, 31 nt, Human
auuggacaguuucagaggccuuauuuuguca

SEQ ID NO: 73630 - RNA, 32 nt, Human
auuggacaucacaguacaccauggucuuucac

SEQ ID NO: 73631 - RNA, 32 nt, Human
auuggaccacuauacuccagccuggcaacaga

SEQ ID NO: 73632 - RNA, 32 nt, Human
auuggaccacugcucuccagccugggcaacag

SEQ ID NO: 73633 - RNA, 32 nt, Human
auuggaccaguucugcugccuaagaaggucug

SEQ ID NO: 73634 - RNA, 32 nt, Human
auuggaccauguuagaggaggaauggugucau

SEQ ID NO: 73635 - RNA, 32 nt, Human
auuggaccgcacuuaucucccuuguccuguau

SEQ ID NO: 73636 - RNA, 32 nt, Human
auuggaccuggaagaagugagucuccucucag

SEQ ID NO: 73637 - RNA, 32 nt, Human
auuggacgggagacagagugacgcacugacuc

SEQ ID NO: 73638 - RNA, 32 nt, Human
auuggacuuuuucccuuuaauacugaugaugc

SEQ ID NO: 73639 - RNA, 32 nt, Human
auuggagaaaaguuacuguucagucccugaag

SEQ ID NO: 73640 - RNA, 32 nt, Human
auuggagaaagccaguagcaacugugagaaau

SEQ ID NO: 73641 - RNA, 32 nt, Human
auuggagaacaaggagcugcugggucucagcc

SEQ ID NO: 73642 - RNA, 20 nt, Human
auuggagaagaaccaagcug

SEQ ID NO: 73643 - RNA, 32 nt, Human
auuggagaagauuuaugucagcacacacuuac

SEQ ID NO: 73644 - RNA, 32 nt, Human
auuggagaaucagcucacugcucucuagaaac

SEQ ID NO: 73645 - RNA, 32 nt, Human
auuggagaccucccuucugucuuuuaggcuau

SEQ ID NO: 73646 - RNA, 19 nt, Human
auuggagacuacuccccca

SEQ ID NO: 73647 - RNA, 32 nt, Human
auuggagagcucaggaucuggccccagagaaa

SEQ ID NO: 73648 - RNA, 32 nt, Human
auuggagagggauggggagggaagggaaggca

SEQ ID NO: 73649 - RNA, 32 nt, Human
auuggagaugagaauuguguuuggagguaacu

SEQ ID NO: 73650 - RNA, 18 nt, Human
auuggagcaggaacugga

SEQ ID NO: 73651 - RNA, 32 nt, Human
auuggagcccaugguagcauccucagcaugga

SEQ ID NO: 73652 - RNA, 32 nt, Human
auuggagcugaguacucaggaacuugacugua

SEQ ID NO: 73653 - RNA, 32 nt, Human
auuggaggaaugagucagcaggcguggcucau

SEQ ID NO: 73654 - RNA, 32 nt, Human
auuggaggccaggaguuggagaucagccuggg

SEQ ID NO: 73655 - RNA, 32 nt, Human
auuggaggcuuggggccaugcccagccagguu

SEQ ID NO: 73656 - RNA, 32 nt, Human
auuggagggaggugguguguucacgugagccu

SEQ ID NO: 73657 - RNA, 32 nt, Human
auuggagggcccuaucuugugaguggggcauc

SEQ ID NO: 73658 - RNA, 32 nt, Human
auuggagggguucuugggggagggagggagag

SEQ ID NO: 73659 - RNA, 32 nt, Human
auuggaggguggagacuguggggaaggaguuc

SEQ ID NO: 73660 - RNA, 32 nt, Human
auuggaggguggcccuccuuccccacaaggau

SEQ ID NO: 73661 - RNA, 32 nt, Human
auuggagggugguagccccuccccagccuucu

SEQ ID NO: 73662 - RNA, 32 nt, Human
auuggagguggggguuucagaguguugccacg

SEQ ID NO: 73663 - RNA, 32 nt, Human
auuggaguauagaaaauggaagaugguguugu

SEQ ID NO: 73664 - RNA, 32 nt, Human
auuggagugaagauuucugugacaugcugggu

SEQ ID NO: 73665 - RNA, 32 nt, Human
auuggaguggggcgaggagagagccagaaaac

SEQ ID NO: 73666 - RNA, 32 nt, Human
auuggagugucugagacacaggcagauuauuc

SEQ ID NO: 73667 - RNA, 32 nt, Human
auuggaguuuaggaauuggaggcggcagugag

SEQ ID NO: 73668 - RNA, 32 nt, Human
auuggauacauacaccagcauuccuuuugaac

SEQ ID NO: 73669 - RNA, 32 nt, Human
auuggaucaacagccuccucucuuggggacuc

SEQ ID NO: 73670 - RNA, 32 nt, Human
auuggaucacaaaagcuguauucuucccccua

SEQ ID NO: 73671 - RNA, 32 nt, Human
auuggaucagagcucaucuccauccagucuug

SEQ ID NO: 73672 - RNA, 32 nt, Human
auuggauccucccacaguugcccuggugauga

SEQ ID NO: 73673 - RNA, 32 nt, Human
auuggaucucaggaguuggagaucagcauggg

SEQ ID NO: 73674 - RNA, 32 nt, Human
auuggaucuuucuccacugcuguggcuggaca

SEQ ID NO: 73675 - RNA, 32 nt, Human
auuggaugacccugggugguuauggcucagaa

SEQ ID NO: 73676 - RNA, 32 nt, Human
auuggaugagcugcaggaaaauggcaggcagg

SEQ ID NO: 73677 - RNA, 32 nt, Human
auuggaugggagaagaaggaaggggguggccc

SEQ ID NO: 73678 - RNA, 31 nt, Human
auuggaugggagagagaucaaaggcugggag

SEQ ID NO: 73679 - RNA, 32 nt, Human
auuggauuacaugcucacauuuaacaaagaga

SEQ ID NO: 73680 - RNA, 32 nt, Human
auuggauuagagaauuuccagauucccuucca

SEQ ID NO: 73681 - RNA, 32 nt, Human
auuggauugaaggauacaaaauauugauccug

SEQ ID NO: 73682 - RNA, 32 nt, Human
auuggauugaaggaugcaauauugauccugga

SEQ ID NO: 73683 - RNA, 32 nt, Human
auuggauuucguuccuccugaggagaccaugc

SEQ ID NO: 73684 - RNA, 32 nt, Human
auuggauuuucauggaggccaggacagagagu

SEQ ID NO: 73685 - RNA, 32 nt, Human
auuggcaaauggguugggugcaauggcucacg

SEQ ID NO: 73686 - RNA, 32 nt, Human
auuggcacaaagcaugaagaaaccccauuuuu

SEQ ID NO: 73687 - RNA, 32 nt, Human
auuggcacaaauguuuuauacaaagaguuuga

SEQ ID NO: 73688 - RNA, 32 nt, Human
auuggcacccccagugcaggcagcagggaucc

SEQ ID NO: 73689 - RNA, 32 nt, Human
auuggcaccccuccagccuggaggccaggcuu

SEQ ID NO: 73690 - RNA, 32 nt, Human
auuggcacugcagguuuuuagagccauuuuga

SEQ ID NO: 73691 - RNA, 32 nt, Human
auuggcacuucccuguccagcacuacaacuua

SEQ ID NO: 73692 - RNA, 32 nt, Human
auuggcagacaggcacaugggaggcuggagua

SEQ ID NO: 73693 - RNA, 32 nt, Human
auuggcagagguggggguuggcuguggccugg

SEQ ID NO: 73694 - RNA, 32 nt, Human
auuggcagagugagaugggaagaagaucuucu

SEQ ID NO: 73695 - RNA, 32 nt, Human
auuggcagaugccugaggucauagcugugucc

SEQ ID NO: 73696 - RNA, 32 nt, Human
auuggcagccuggauuauggcccuagggagag

SEQ ID NO: 73697 - RNA, 32 nt, Human
auuggcaggcugggugaaaaugagaaagauga

SEQ ID NO: 73698 - RNA, 32 nt, Human
auuggcaucauucuccuugcucuguuuugcuu

SEQ ID NO: 73699 - RNA, 32 nt, Human
auuggcaugacaccugccaugccacuaucuuu

SEQ ID NO: 73700 - RNA, 32 nt, Human
auuggcaugaggaauggggauggggcuggcau

SEQ ID NO: 73701 - RNA, 32 nt, Human
auuggcauuguuagucccacaggccaaggaua

SEQ ID NO: 73702 - RNA, 32 nt, Human
auuggccaaaaaguucacagacagcaguguuu

SEQ ID NO: 73703 - RNA, 32 nt, Human
auuggccaaaggacacggcucagcaaggggga

SEQ ID NO: 73704 - RNA, 32 nt, Human
auuggccaaggccugaaggccccggagugcac

SEQ ID NO: 73705 - RNA, 32 nt, Human
auuggccaauuuccauggcagaaaaauauauu

SEQ ID NO: 73706 - RNA, 32 nt, Human
auuggccacauugaugacuacagugcccuaag

SEQ ID NO: 73707 - RNA, 32 nt, Human
auuggccacuggcuuuaugcuccucuucuauc

SEQ ID NO: 73708 - RNA, 32 nt, Human
auuggccagcucugcuugcuguguggcauugu

SEQ ID NO: 73709 - RNA, 32 nt, Human
auuggccaggggacgguagcugcaggacucug

SEQ ID NO: 73710 - RNA, 32 nt, Human
auuggccauauugaggaucacucugaauacug

SEQ ID NO: 73711 - RNA, 32 nt, Human
auuggccaucaggauauaccaggaguugguaa

SEQ ID NO: 73712 - RNA, 32 nt, Human
auuggccauugcacuccagccugggugacaga

SEQ ID NO: 73713 - RNA, 32 nt, Human
auuggcccaacaagaagguuucuguccuaauc

SEQ ID NO: 73714 - RNA, 32 nt, Human
auuggccccagugccaucuugcccagcuuggc

SEQ ID NO: 73715 - RNA, 32 nt, Human
auuggccccaucacaagagaucagugacucaa

SEQ ID NO: 73716 - RNA, 32 nt, Human
auuggcccuccagagaaggggcggccccuucu

SEQ ID NO: 73717 - RNA, 18 nt, Human
auuggcccucuggacucc

SEQ ID NO: 73718 - RNA, 32 nt, Human
auuggcccugcuccguuucccuucucuccugg

SEQ ID NO: 73719 - RNA, 32 nt, Human
auuggcccuggcugcugccacacacauaucca

SEQ ID NO: 73720 - RNA, 32 nt, Human
auuggccuaaccuccgucccagccuccuggcu

SEQ ID NO: 73721 - RNA, 32 nt, Human
auuggccuagaggggcugacuggggaggagca

SEQ ID NO: 73722 - RNA, 24 nt, Human
auuggccucccaaaagacuccagu

SEQ ID NO: 73723 - RNA, 32 nt, Human
auuggccuggcugggugcaguggcucacaccu

SEQ ID NO: 73724 - RNA, 32 nt, Human
auuggccuuccuggcugggauuucacggacgg

SEQ ID NO: 73725 - RNA, 32 nt, Human
auuggccuucuuaaauuguggccagugucuuu

SEQ ID NO: 73726 - RNA, 32 nt, Human
auuggccuuuucuauuccuguaaugaaagcug

SEQ ID NO: 73727 - RNA, 32 nt, Human
auuggcuaaagugggccuugcccagaguccag

SEQ ID NO: 73728 - RNA, 21 nt, Human
auuggcuaauaaauguugcca

SEQ ID NO: 73729 - RNA, 32 nt, Human
auuggcuauuuuaaauagguucagagaacuaa

SEQ ID NO: 73730 - RNA, 32 nt, Human
auuggcucaacuucaguugagagggugcaguc

SEQ ID NO: 73731 - RNA, 32 nt, Human
auuggcucacaguuccgcaggcuguacaggaa

SEQ ID NO: 73732 - RNA, 32 nt, Human
auuggcucacaguucugcaggcuguaugggaa

SEQ ID NO: 73733 - RNA, 32 nt, Human
auuggcucacccaagcaaggccaaaauuacca

SEQ ID NO: 73734 - RNA, 32 nt, Human
auuggcucacugcaaccucugccuucuggguu

SEQ ID NO: 73735 - RNA, 32 nt, Human
auuggcucccaagcuucccccaccucauaugu

SEQ ID NO: 73736 - RNA, 32 nt, Human
auuggcuccuggguuucauguucugugacauc

SEQ ID NO: 73737 - RNA, 32 nt, Human
auuggcucugcagcccccuaaccugccucugg

SEQ ID NO: 73738 - RNA, 32 nt, Human
auuggcugagccaagauggaggcggggcucgg

SEQ ID NO: 73739 - RNA, 32 nt, Human
auuggcugaguccauuagcucuccaguugguu

SEQ ID NO: 73740 - RNA, 31 nt, Human
auuggcugggaagucucagccaugcacggac

SEQ ID NO: 73741 - RNA, 32 nt, Human
auuggcugggagcaguggcucacaccuauagu

SEQ ID NO: 73742 - RNA, 32 nt, Human
auuggcugggccgacuccuucuccccuccugg

SEQ ID NO: 73743 - RNA, 32 nt, Human
auuggcugggggcacggaauaagcacauagua

SEQ ID NO: 73744 - RNA, 19 nt, Human
auuggcuggguaguggagu

SEQ ID NO: 73745 - RNA, 32 nt, Human
auuggcugugccguggccgccugcugcagccu

SEQ ID NO: 73746 - RNA, 32 nt, Human
auuggcuuagggcagauuuucaugcaaaaguu

SEQ ID NO: 73747 - RNA, 32 nt, Human
auuggcuucauccucuuuagaguuagacuguu

SEQ ID NO: 73748 - RNA, 32 nt, Human
auuggcuucucccugcaccagcccuguccuca

SEQ ID NO: 73749 - RNA, 32 nt, Human
auuggcuucugugguugucugagaggcauccc

SEQ ID NO: 73750 - RNA, 32 nt, Human
auugggaaaggaguagaaaaagcaguaacuga

SEQ ID NO: 73751 - RNA, 32 nt, Human
auugggaaauauuuaaagcaacagacaggcuu

SEQ ID NO: 73752 - RNA, 32 nt, Human
auugggaaccaaucauuguccaaggcaauaug

SEQ ID NO: 73753 - RNA, 32 nt, Human
auugggaaggcaggguuuguauugucaguccc

SEQ ID NO: 73754 - RNA, 32 nt, Human
auugggaauagaauggccccuuuuguucuggu

SEQ ID NO: 73755 - RNA, 32 nt, Human
auugggaccagcugggccccaccacggccacg

SEQ ID NO: 73756 - RNA, 32 nt, Human
auugggaccugcggaagccuggcuacagauaa

SEQ ID NO: 73757 - RNA, 32 nt, Human
auugggacucaggccuagcgugugucaggggg

SEQ ID NO: 73758 - RNA, 32 nt, Human
auugggacugagugcugagauugggaaggcac

SEQ ID NO: 73759 - RNA, 32 nt, Human
auugggagagguggggguggguucgcggagaa

SEQ ID NO: 73760 - RNA, 32 nt, Human
auugggaggaauagaggaggcugguacaaaua

SEQ ID NO: 73761 - RNA, 32 nt, Human
auugggaggagaaacgcggcaggccuggcuca

SEQ ID NO: 73762 - RNA, 32 nt, Human
auugggaggaugacacuuaguccaaccaccug

SEQ ID NO: 73763 - RNA, 32 nt, Human
auugggaggcuccucaggucucaggcucaggu

SEQ ID NO: 73764 - RNA, 32 nt, Human
auugggagucccaggauucaagguggaagaug

SEQ ID NO: 73765 - RNA, 32 nt, Human
auugggagugcagguugggaugugggaaugac

SEQ ID NO: 73766 - RNA, 32 nt, Human
auugggaguguguggcaugcauccucaucauc

SEQ ID NO: 73767 - RNA, 32 nt, Human
auugggaguuggguuucaguggggcaugucua

SEQ ID NO: 73768 - RNA, 32 nt, Human
auugggaucaucuccucuguccagaggucuuc

SEQ ID NO: 73769 - RNA, 32 nt, Human
auugggauccacccucacucaauauggccuca

SEQ ID NO: 73770 - RNA, 32 nt, Human
auugggauggguggagaaagacgacaagagag

SEQ ID NO: 73771 - RNA, 32 nt, Human
auugggcagaacucccccuccaggccaucuca

SEQ ID NO: 73772 - RNA, 32 nt, Human
auugggcagaggaguauaggacuggggucuag

SEQ ID NO: 73773 - RNA, 32 nt, Human
auugggcaggguggcuccaggauguuaggaac

SEQ ID NO: 73774 - RNA, 31 nt, Human
auugggcaguagguaacuggcauuccucucu

SEQ ID NO: 73775 - RNA, 32 nt, Human
auugggccacugcacuccacccugggcgacag

SEQ ID NO: 73776 - RNA, 32 nt, Human
auugggccacugcagucgagccugggcgacac

SEQ ID NO: 73777 - RNA, 32 nt, Human
auugggccagguacagugucucacaccuguaa

SEQ ID NO: 73778 - RNA, 32 nt, Human
auugggcccaggagugaaggccaagaagccca

SEQ ID NO: 73779 - RNA, 32 nt, Human
auugggccugaguggagaugggagacagaggc

SEQ ID NO: 73780 - RNA, 32 nt, Human
auugggccugguuuucuugucccuucauaccc

SEQ ID NO: 73781 - RNA, 32 nt, Human
auugggccuuccccacaauuagaauauuuuga

SEQ ID NO: 73782 - RNA, 32 nt, Human
auugggcuaguuagcacagagcagggacggca

SEQ ID NO: 73783 - RNA, 32 nt, Human
auugggcugaagcugcuccaccucauccuugc

SEQ ID NO: 73784 - RNA, 32 nt, Human
auugggcugacagcuggcccuacuuuccuccc

SEQ ID NO: 73785 - RNA, 32 nt, Human
auuggggaacccaggagcuuccaguccucucc

SEQ ID NO: 73786 - RNA, 32 nt, Human
auuggggaagaaaaggggagggggaaggcaag

SEQ ID NO: 73787 - RNA, 32 nt, Human
auuggggacacuccccucaucuugucaucacg

SEQ ID NO: 73788 - RNA, 32 nt, Human
auuggggacgggccaggcugggccaggucggg

SEQ ID NO: 73789 - RNA, 32 nt, Human
auuggggacugaggacuggaaggguggagagu

SEQ ID NO: 73790 - RNA, 32 nt, Human
auuggggagaagcuagaugaaagggaagcugg

SEQ ID NO: 73791 - RNA, 32 nt, Human
auuggggagcuccauuuucccugcugagugag

SEQ ID NO: 73792 - RNA, 32 nt, Human
auuggggaggcggagguugcagugagcugaga

SEQ ID NO: 73793 - RNA, 21 nt, Human
auuggggagugaucucuugga

SEQ ID NO: 73794 - RNA, 32 nt, Human
auuggggaucugaauuuuaaauaauuuguuuc

SEQ ID NO: 73795 - RNA, 32 nt, Human
auuggggauggggacaaagaaauagcaagaga

SEQ ID NO: 73796 - RNA, 32 nt, Human
auuggggauguuaaacaguugcaguggaaguc

SEQ ID NO: 73797 - RNA, 32 nt, Human
auuggggauuacauuucacaugagauuugggc

SEQ ID NO: 73798 - RNA, 32 nt, Human
auuggggcacauuccaggucaucgucuucugu

SEQ ID NO: 73799 - RNA, 32 nt, Human
auuggggcagacagcacuggcccagggaugcu

SEQ ID NO: 73800 - RNA, 32 nt, Human
auuggggcagcugcuguggaaacacacuggug

SEQ ID NO: 73801 - RNA, 32 nt, Human
auuggggcauguuacagagaguuucaguaaaa

SEQ ID NO: 73802 - RNA, 32 nt, Human
auuggggcccacccugcuccagcauggccuaa

SEQ ID NO: 73803 - RNA, 32 nt, Human
auuggggccccgggagagcaggagaaccgggg

SEQ ID NO: 73804 - RNA, 32 nt, Human
auuggggccugggaacgcucggcccccggcag

SEQ ID NO: 73805 - RNA, 32 nt, Human
auuggggcgggcaagggggacagccagcggag

SEQ ID NO: 73806 - RNA, 32 nt, Human
auuggggcucagggagaugaucuggccugagg

SEQ ID NO: 73807 - RNA, 32 nt, Human
auuggggcuccaauugauaaggggacauggcc

SEQ ID NO: 73808 - RNA, 32 nt, Human
auugggggaggaagagagggaggcacguagga

SEQ ID NO: 73809 - RNA, 32 nt, Human
auugggggcaggaggagucuggaacacagccu

SEQ ID NO: 73810 - RNA, 32 nt, Human
auugggggcggcgggggaggagaggggaaaga

SEQ ID NO: 73811 - RNA, 21 nt, Human
auugggggcugggaacagcag

SEQ ID NO: 73812 - RNA, 31 nt, Human
auugggggugguuugggaugggugggcagcu

SEQ ID NO: 73813 - RNA, 32 nt, Human
auugggguaauauuuccuccuuuuccaagacc

SEQ ID NO: 73814 - RNA, 32 nt, Human
auuggggucugcucuaagcugcagcaagagaa

SEQ ID NO: 73815 - RNA, 32 nt, Human
auuggggugccuggccucccugaacuguuagg

SEQ ID NO: 73816 - RNA, 32 nt, Human
auugggguuagugaccuggccagagggugcca

SEQ ID NO: 73817 - RNA, 32 nt, Human
auuggguaaagaaaauaugguauguauacauc

SEQ ID NO: 73818 - RNA, 32 nt, Human
auuggguaagcauagccauuccaaguggaaga

SEQ ID NO: 73819 - RNA, 32 nt, Human
auuggguggaagaagccaggaggaagggcauu

SEQ ID NO: 73820 - RNA, 32 nt, Human
auugggugggcuauaauccagcacuuuaggag

SEQ ID NO: 73821 - RNA, 32 nt, Human
auuggguggguuaaguacaugggugaauuuua

SEQ ID NO: 73822 - RNA, 32 nt, Human
auuggguuccuggacagaucaggcuagcccug

SEQ ID NO: 73823 - RNA, 32 nt, Human
auuggguuggcuaucuuuacuuauaaaucuac

SEQ ID NO: 73824 - RNA, 32 nt, Human
auuggguugguuugauaccacauuuaacauug

SEQ ID NO: 73825 - RNA, 32 nt, Human
auugguaaaauggguaauuuuggaaaugcuuc

SEQ ID NO: 73826 - RNA, 32 nt, Human
auugguaaagaauggaagguggagaagcuccc

SEQ ID NO: 73827 - RNA, 32 nt, Human
auugguaagcuuugcucaccucccucucucuu

SEQ ID NO: 73828 - RNA, 32 nt, Human
auugguagaagucuugggaucuugccauggga

SEQ ID NO: 73829 - RNA, 32 nt, Human
auugguagagggcucugaagagccaaaacugu

SEQ ID NO: 73830 - RNA, 22 nt, Human
auugguagguacuaaugauuua

SEQ ID NO: 73831 - RNA, 32 nt, Human
auugguagugucuagccuuuuccuccacgaca

SEQ ID NO: 73832 - RNA, 22 nt, Human
auugguauacauauggacugua

SEQ ID NO: 73833 - RNA, 32 nt, Human
auugguaugcaaaagcucaucacccauuaagg

SEQ ID NO: 73834 - RNA, 32 nt, Human
auugguauuaccuacuggacaucucuauggac

SEQ ID NO: 73835 - RNA, 32 nt, Human
auuggucacacuaauaacaucaacaucugcua

SEQ ID NO: 73836 - RNA, 32 nt, Human
auuggucaccugcuggggaugaggcauaggcc

SEQ ID NO: 73837 - RNA, 32 nt, Human
auuggucagaauuguguccagaaugugcucag

SEQ ID NO: 73838 - RNA, 32 nt, Human
auuggucagagggacagagcaaggaaugcauc

SEQ ID NO: 73839 - RNA, 32 nt, Human
auuggucagaguugggcugagcacagagaagg

SEQ ID NO: 73840 - RNA, 32 nt, Human
auuggucaguuuccaccucagcacuuugccuu

SEQ ID NO: 73841 - RNA, 32 nt, Human
auuggucauaaauaauuggcaaaauaacaaau

SEQ ID NO: 73842 - RNA, 32 nt, Human
auuggucauccuaugccuucaccagaauaacu

SEQ ID NO: 73843 - RNA, 32 nt, Human
auuggucccaccgcacuccagccugggcaaca

SEQ ID NO: 73844 - RNA, 32 nt, Human
auuggucccagcugcucccagaagaacgggcg

SEQ ID NO: 73845 - RNA, 32 nt, Human
auugguccuagagaaaagacuaugucauuuac

SEQ ID NO: 73846 - RNA, 32 nt, Human
auugguccugugguuggaaacagggucaagua

SEQ ID NO: 73847 - RNA, 32 nt, Human
auugguccuuucuccuaaacuggucuuugugc

SEQ ID NO: 73848 - RNA, 32 nt, Human
auuggucguugaguuaugggaagaacuuaagc

SEQ ID NO: 73849 - RNA, 32 nt, Human
auuggucuuuucccaaggcucuuccagaccug

SEQ ID NO: 73850 - RNA, 32 nt, Human
auuggugaacuccccagggcuccagugggcuc

SEQ ID NO: 73851 - RNA, 32 nt, Human
auuggugagcccgacuccccagccucggugcc

SEQ ID NO: 73852 - RNA, 32 nt, Human
auuggugaucaaacaaagaaacagguggggaa

SEQ ID NO: 73853 - RNA, 32 nt, Human
auuggugauggagggccagcugaggggaaguu

SEQ ID NO: 73854 - RNA, 32 nt, Human
auuggugauuucugcugccuuuuacucaugau

SEQ ID NO: 73855 - RNA, 32 nt, Human
auuggugcaagacccaucucuuaugcauugac

SEQ ID NO: 73856 - RNA, 32 nt, Human
auuggugcuuucuccucauccucaugcccccu

SEQ ID NO: 73857 - RNA, 32 nt, Human
auugguggcuuauauuuucagcaaagaauuuu

SEQ ID NO: 73858 - RNA, 32 nt, Human
auuggugggacuuaaaucacacccaaaauucc

SEQ ID NO: 73859 - RNA, 31 nt, Human
auuggugggugacagagauggguggaggggc

SEQ ID NO: 73860 - RNA, 32 nt, Human
auuggugugcacugaaugcauguauggaagaa

SEQ ID NO: 73861 - RNA, 32 nt, Human
auugguguguuguguguggguuuaugagugug

SEQ ID NO: 73862 - RNA, 32 nt, Human
auugguguuaucuguaaauuccagacacugua

SEQ ID NO: 73863 - RNA, 32 nt, Human
auugguguuaucuguaaauuccagacauugua

SEQ ID NO: 73864 - RNA, 32 nt, Human
auugguguuuagaauaagucaauguuuuuccu

SEQ ID NO: 73865 - RNA, 32 nt, Human
auugguuaucagucuucacacuuauuaaccau

SEQ ID NO: 73866 - RNA, 32 nt, Human
auugguuauccugauuugcaaagugaucaaaa

SEQ ID NO: 73867 - RNA, 32 nt, Human
auugguucacacacagacagcaaaguaugucg

SEQ ID NO: 73868 - RNA, 32 nt, Human
auugguucaggcaaucuucagcggugauccag

SEQ ID NO: 73869 - RNA, 32 nt, Human
auugguuccuagugaguuuuguggccuacucc

SEQ ID NO: 73870 - RNA, 32 nt, Human
auugguucucaaggacuaaccugugggggaaa

SEQ ID NO: 73871 - RNA, 32 nt, Human
auugguugaacccaggaggcggagguugcagu

SEQ ID NO: 73872 - RNA, 32 nt, Human
auugguugaacccgggagguggagguugcagu

SEQ ID NO: 73873 - RNA, 32 nt, Human
auugguugagcuuaggagguugaggcugcagu

SEQ ID NO: 73874 - RNA, 32 nt, Human
auugguugcucaauaaauaguugcugacuuua

SEQ ID NO: 73875 - RNA, 32 nt, Human
auugguugguguuucaugacauguggacuucu

SEQ ID NO: 73876 - RNA, 32 nt, Human
auugguuucaccaaccucagaaggcacuauuc

SEQ ID NO: 73877 - RNA, 32 nt, Human
auugguuucacucaaaaugcugcagucauuug

SEQ ID NO: 73878 - RNA, 32 nt, Human
auugguuucaucucuucugugauuccaaagag

SEQ ID NO: 73879 - RNA, 32 nt, Human
auugguuucucaaauucagguugaaauacaaa

SEQ ID NO: 73880 - RNA, 32 nt, Human
auugguuuuguucuugccuaggguuuuuaaaa

SEQ ID NO: 73881 - RNA, 32 nt, Human
auugguuuuuacuucuaggcagucccaauuuu

SEQ ID NO: 73882 - RNA, 32 nt, Human
auuguaaaaaugucaggaaaaguaugaucauc

SEQ ID NO: 73883 - RNA, 32 nt, Human
auuguaaaagggaagaaagaagaagaggaggc

SEQ ID NO: 73884 - RNA, 32 nt, Human
auuguaaaauacggaucauuuguauuuugggg

SEQ ID NO: 73885 - RNA, 32 nt, Human
auuguaaacaaguucagccacuguggaagaca

SEQ ID NO: 73886 - RNA, 32 nt, Human
auuguaaaggaaauuuaaauucuggagaauuc

SEQ ID NO: 73887 - RNA, 32 nt, Human
auuguaaaggugggcaaagccuaguagagaac

SEQ ID NO: 73888 - RNA, 32 nt, Human
auuguaaaugucccaggaucagagaccuguug

SEQ ID NO: 73889 - RNA, 32 nt, Human
auuguaacaauaaaucacagccacuugacaag

SEQ ID NO: 73890 - RNA, 32 nt, Human
auuguaacaccagagugcagccuggaucucuc

SEQ ID NO: 73891 - RNA, 32 nt, Human
auuguaacccuuguggguugcuaauaaccaag

SEQ ID NO: 73892 - RNA, 32 nt, Human
auuguaaccuccaucuccugugcucaagccau

SEQ ID NO: 73893 - RNA, 32 nt, Human
auuguaaccucucccuuguccaaaucuaggau

SEQ ID NO: 73894 - RNA, 32 nt, Human
auuguaacucacugcagccugaaacuccuugg

SEQ ID NO: 73895 - RNA, 32 nt, Human
auuguaaguccaggaugaacuaggagaaagca

SEQ ID NO: 73896 - RNA, 32 nt, Human
auuguaaguguuuacugacuggcagcuuuuau

SEQ ID NO: 73897 - RNA, 32 nt, Human
auuguaaguucaauaaaccucuuuguuuugua

SEQ ID NO: 73898 - RNA, 32 nt, Human
auuguaaguuugccuaggcuguugguguacag

SEQ ID NO: 73899 - RNA, 32 nt, Human
auuguaauaaagaaaucuuuccugugaagaua

SEQ ID NO: 73900 - RNA, 32 nt, Human
auuguaauauauuuacuuuuacaugguuauaa

SEQ ID NO: 73901 - RNA, 32 nt, Human
auuguaaucaaagaaguaaggagguaagauug

SEQ ID NO: 73902 - RNA, 32 nt, Human
auuguaauguagcacuuacuuuaaaaguauaa

SEQ ID NO: 73903 - RNA, 32 nt, Human
auuguaauguuaauuuauacuuuuggauugug

SEQ ID NO: 73904 - RNA, 32 nt, Human
auuguaauugauuucaaucuuagcugauaaau

SEQ ID NO: 73905 - RNA, 32 nt, Human
auuguacagaugucggugcagaucucuugucc

SEQ ID NO: 73906 - RNA, 32 nt, Human
auuguacaggaaaguuaagaauaccugaaaaa
